United States Patent 8,969,254 (OLIGONUCLEOTIDE ARRAY FOR TISSUE TYPING) - sequence listing, part 2

SEQ ID NO: 23094 - DNA, 24 bp, Artificial Sequence
  Description of Artificial Sequence: Synthetic oligonucleotide
agatcacccagcgcaagcgggagg

SEQ ID NO: 23095 - DNA, 23 bp, Artificial Sequence
  Description of Artificial Sequence: Synthetic oligonucleotide
gatcacccagcgcaagcgggagg

SEQ ID NO: 23096 - DNA, 23 bp, Artificial Sequence
  Description of Artificial Sequence: Synthetic oligonucleotide
atcacccagcgcaagcgggaggc

SEQ ID NO: 23097 - DNA, 22 bp, Artificial Sequence
  Description of Artificial Sequence: Synthetic oligonucleotide
tcacccagcgcaagcgggaggc

SEQ ID NO: 23098 - DNA, 21 bp, Artificial Sequence
  Description of Artificial Sequence: Synthetic oligonucleotide
cacccagcgcaagcgggaggc

SEQ ID NO: 23099 - DNA, 21 bp, Artificial Sequence
  Description of Artificial Sequence: Synthetic oligonucleotide
acccagcgcaagcgggaggcg

SEQ ID NO: 23100 - DNA, 20 bp, Artificial Sequence
  Description of Artificial Sequence: Synthetic oligonucleotide
cccagcgcaagcgggaggcg

SEQ ID NO: 23101 - DNA, 20 bp, Artificial Sequence
  Description of Artificial Sequence: Synthetic oligonucleotide
ccagcgcaagcgggaggcgg

SEQ ID NO: 23102 - DNA, 20 bp, Artificial Sequence
  Description of Artificial Sequence: Synthetic oligonucleotide
cagcgcaagcgggaggcggc

SEQ ID NO: 23103 - DNA, 20 bp, Artificial Sequence
  Description of Artificial Sequence: Synthetic oligonucleotide
agcgcaagcgggaggcggcc

SEQ ID NO: 23104 - DNA, 20 bp, Artificial Sequence
  Description of Artificial Sequence: Synthetic oligonucleotide
gcgcaagcgggaggcggcct

SEQ ID NO: 23105 - DNA, 20 bp, Artificial Sequence
  Description of Artificial Sequence: Synthetic oligonucleotide
cgcaagcgggaggcggccct

SEQ ID NO: 23106 - DNA, 20 bp, Artificial Sequence
  Description of Artificial Sequence: Synthetic oligonucleotide
gcaagcgggaggcggcccgt

SEQ ID NO: 23107 - DNA, 21 bp, Artificial Sequence
  Description of Artificial Sequence: Synthetic oligonucleotide
caagcgggaggcggcccgtga

SEQ ID NO: 23108 - DNA, 21 bp, Artificial Sequence
  Description of Artificial Sequence: Synthetic oligonucleotide
aagcgggaggcggcccgtgag

SEQ ID NO: 23109 - DNA, 20 bp, Artificial Sequence
  Description of Artificial Sequence: Synthetic oligonucleotide
agcgggaggcggcccgtgag

SEQ ID NO: 23110 - DNA, 20 bp, Artificial Sequence
  Description of Artificial Sequence: Synthetic oligonucleotide
gcgggaggcggcccgtgagt

SEQ ID NO: 23111 - DNA, 20 bp, Artificial Sequence
  Description of Artificial Sequence: Synthetic oligonucleotide
cgggaggcggcccgtgaggt

SEQ ID NO: 23112 - DNA, 29 bp, Artificial Sequence
  Description of Artificial Sequence: Synthetic oligonucleotide
gcagatacctggagaacgggaaggagaag

SEQ ID NO: 23113 - DNA, 29 bp, Artificial Sequence
  Description of Artificial Sequence: Synthetic oligonucleotide
cagatacctggagaacgggaaggagaagc

SEQ ID NO: 23114 - DNA, 30 bp, Artificial Sequence
  Description of Artificial Sequence: Synthetic oligonucleotide
agatacctggagaacgggaaggagaagctg

SEQ ID NO: 23115 - DNA, 29 bp, Artificial Sequence
  Description of Artificial Sequence: Synthetic oligonucleotide
gatacctggagaacgggaaggagaagctg

SEQ ID NO: 23116 - DNA, 29 bp, Artificial Sequence
  Description of Artificial Sequence: Synthetic oligonucleotide
atacctggagaacgggaaggagaagctgg

SEQ ID NO: 23117 - DNA, 28 bp, Artificial Sequence
  Description of Artificial Sequence: Synthetic oligonucleotide
tacctggagaacgggaaggagaagctgg

SEQ ID NO: 23118 - DNA, 27 bp, Artificial Sequence
  Description of Artificial Sequence: Synthetic oligonucleotide
acctggagaacgggaaggagaagctgg

SEQ ID NO: 23119 - DNA, 27 bp, Artificial Sequence
  Description of Artificial Sequence: Synthetic oligonucleotide
cctggagaacgggaaggagaagctgga

SEQ ID NO: 23120 - DNA, 27 bp, Artificial Sequence
  Description of Artificial Sequence: Synthetic oligonucleotide
ctggagaacgggaaggagaagctggag

SEQ ID NO: 23121 - DNA, 27 bp, Artificial Sequence
  Description of Artificial Sequence: Synthetic oligonucleotide
tggagaacgggaaggagaagctggagc

SEQ ID NO: 23122 - DNA, 26 bp, Artificial Sequence
  Description of Artificial Sequence: Synthetic oligonucleotide
ggagaacgggaaggagaagctggagc

SEQ ID NO: 23123 - DNA, 26 bp, Artificial Sequence
  Description of Artificial Sequence: Synthetic oligonucleotide
gagaacgggaaggagaagctggagcg

SEQ ID NO: 23124 - DNA, 26 bp, Artificial Sequence
  Description of Artificial Sequence: Synthetic oligonucleotide
agaacgggaaggagaagctggagcgc

SEQ ID NO: 23125 - DNA, 25 bp, Artificial Sequence
  Description of Artificial Sequence: Synthetic oligonucleotide
gaacgggaaggagaagctggagcgc

SEQ ID NO: 23126 - DNA, 25 bp, Artificial Sequence
  Description of Artificial Sequence: Synthetic oligonucleotide
aacgggaaggagaagctggagcgcg

SEQ ID NO: 23127 - DNA, 24 bp, Artificial Sequence
  Description of Artificial Sequence: Synthetic oligonucleotide
acgggaaggagaagctggagcgcg

SEQ ID NO: 23128 - DNA, 23 bp, Artificial Sequence
  Description of Artificial Sequence: Synthetic oligonucleotide
cgggaaggagaagctggagcgcg

SEQ ID NO: 23129 - DNA, 24 bp, Artificial Sequence
  Description of Artificial Sequence: Synthetic oligonucleotide
gggaaggagaagctggagcgcgct

SEQ ID NO: 23130 - DNA, 24 bp, Artificial Sequence
  Description of Artificial Sequence: Synthetic oligonucleotide
ggaaggagaagctggagcgcgctg

SEQ ID NO: 23131 - DNA, 23 bp, Artificial Sequence
  Description of Artificial Sequence: Synthetic oligonucleotide
tacacctccgtgtcccggcccga

SEQ ID NO: 23132 - DNA, 22 bp, Artificial Sequence
  Description of Artificial Sequence: Synthetic oligonucleotide
acacctccgtgtcccggcccga

SEQ ID NO: 23133 - DNA, 21 bp, Artificial Sequence
  Description of Artificial Sequence: Synthetic oligonucleotide
cacctccgtgtcccggcccga

SEQ ID NO: 23134 - DNA, 21 bp, Artificial Sequence
  Description of Artificial Sequence: Synthetic oligonucleotide
acctccgtgtcccggcccgac

SEQ ID NO: 23135 - DNA, 20 bp, Artificial Sequence
  Description of Artificial Sequence: Synthetic oligonucleotide
cctccgtgtcccggcccgac

SEQ ID NO: 23136 - DNA, 20 bp, Artificial Sequence
  Description of Artificial Sequence: Synthetic oligonucleotide
ctccgtgtcccggcccgacc

SEQ ID NO: 23137 - DNA, 20 bp, Artificial Sequence
  Description of Artificial Sequence: Synthetic oligonucleotide
tccgtgtcccggcccgaccg

SEQ ID NO: 23138 - DNA, 20 bp, Artificial Sequence
  Description of Artificial Sequence: Synthetic oligonucleotide
ccgtgtcccggcccgaccgt

SEQ ID NO: 23139 - DNA, 20 bp, Artificial Sequence
  Description of Artificial Sequence: Synthetic oligonucleotide
cgtgtcccggcccgaccgct

SEQ ID NO: 23140 - DNA, 20 bp, Artificial Sequence
  Description of Artificial Sequence: Synthetic oligonucleotide
gtgtcccggcccgaccgcgt

SEQ ID NO: 23141 - DNA, 20 bp, Artificial Sequence
  Description of Artificial Sequence: Synthetic oligonucleotide
tgtcccggcccgaccgcggt

SEQ ID NO: 23142 - DNA, 20 bp, Artificial Sequence
  Description of Artificial Sequence: Synthetic oligonucleotide
gtcccggcccgaccgcggtt

SEQ ID NO: 23143 - DNA, 20 bp, Artificial Sequence
  Description of Artificial Sequence: Synthetic oligonucleotide
tcccggcccgaccgcgggtt

SEQ ID NO: 23144 - DNA, 20 bp, Artificial Sequence
  Description of Artificial Sequence: Synthetic oligonucleotide
cccggcccgaccgcgggttt

SEQ ID NO: 23145 - DNA, 20 bp, Artificial Sequence
  Description of Artificial Sequence: Synthetic oligonucleotide
ccggcccgaccgcggggatt

SEQ ID NO: 23146 - DNA, 20 bp, Artificial Sequence
  Description of Artificial Sequence: Synthetic oligonucleotide
cggcccgaccgcggggagtt

SEQ ID NO: 23147 - DNA, 20 bp, Artificial Sequence
  Description of Artificial Sequence: Synthetic oligonucleotide
ggcccgaccgcggggagctt

SEQ ID NO: 23148 - DNA, 20 bp, Artificial Sequence
  Description of Artificial Sequence: Synthetic oligonucleotide
gcccgaccgcggggagcctt

SEQ ID NO: 23149 - DNA, 20 bp, Artificial Sequence
  Description of Artificial Sequence: Synthetic oligonucleotide
cccgaccgcggggagccctt

SEQ ID NO: 23150 - DNA, 20 bp, Artificial Sequence
  Description of Artificial Sequence: Synthetic oligonucleotide
ccgaccgcggggagcccctt

SEQ ID NO: 23151 - DNA, 20 bp, Artificial Sequence
  Description of Artificial Sequence: Synthetic oligonucleotide
cgaccgcggggagccccgtt

SEQ ID NO: 23152 - DNA, 20 bp, Artificial Sequence
  Description of Artificial Sequence: Synthetic oligonucleotide
gaccgcggggagccccgctt

SEQ ID NO: 23153 - DNA, 22 bp, Artificial Sequence
  Description of Artificial Sequence: Synthetic oligonucleotide
accgcggggagccccgcttcat

SEQ ID NO: 23154 - DNA, 27 bp, Artificial Sequence
  Description of Artificial Sequence: Synthetic oligonucleotide
cttcatctcagtgggctacgtggacgg

SEQ ID NO: 23155 - DNA, 27 bp, Artificial Sequence
  Description of Artificial Sequence: Synthetic oligonucleotide
ttcatctcagtgggctacgtggacggc

SEQ ID NO: 23156 - DNA, 27 bp, Artificial Sequence
  Description of Artificial Sequence: Synthetic oligonucleotide
tcatctcagtgggctacgtggacggca

SEQ ID NO: 23157 - DNA, 26 bp, Artificial Sequence
  Description of Artificial Sequence: Synthetic oligonucleotide
catctcagtgggctacgtggacggca

SEQ ID NO: 23158 - DNA, 26 bp, Artificial Sequence
  Description of Artificial Sequence: Synthetic oligonucleotide
atctcagtgggctacgtggacggcac

SEQ ID NO: 23159 - DNA, 25 bp, Artificial Sequence
  Description of Artificial Sequence: Synthetic oligonucleotide
tctcagtgggctacgtggacggcac

SEQ ID NO: 23160 - DNA, 24 bp, Artificial Sequence
  Description of Artificial Sequence: Synthetic oligonucleotide
ctcagtgggctacgtggacggcac

SEQ ID NO: 23161 - DNA, 24 bp, Artificial Sequence
  Description of Artificial Sequence: Synthetic oligonucleotide
tcagtgggctacgtggacggcacc

SEQ ID NO: 23162 - DNA, 23 bp, Artificial Sequence
  Description of Artificial Sequence: Synthetic oligonucleotide
cagtgggctacgtggacggcacc

SEQ ID NO: 23163 - DNA, 24 bp, Artificial Sequence
  Description of Artificial Sequence: Synthetic oligonucleotide
agtgggctacgtggacggcaccca

SEQ ID NO: 23164 - DNA, 23 bp, Artificial Sequence
  Description of Artificial Sequence: Synthetic oligonucleotide
gtgggctacgtggacggcaccca

SEQ ID NO: 23165 - DNA, 25 bp, Artificial Sequence
  Description of Artificial Sequence: Synthetic oligonucleotide
tgggctacgtggacggcacccagtt

SEQ ID NO: 23166 - DNA, 24 bp, Artificial Sequence
  Description of Artificial Sequence: Synthetic oligonucleotide
gggctacgtggacggcacccagtt

SEQ ID NO: 23167 - DNA, 24 bp, Artificial Sequence
  Description of Artificial Sequence: Synthetic oligonucleotide
ggctacgtggacggcacccagttc

SEQ ID NO: 23168 - DNA, 25 bp, Artificial Sequence
  Description of Artificial Sequence: Synthetic oligonucleotide
gctacgtggacggcacccagttcgt

SEQ ID NO: 23169 - DNA, 26 bp, Artificial Sequence
  Description of Artificial Sequence: Synthetic oligonucleotide
ctacgtggacggcacccagttcgtga

SEQ ID NO: 23170 - DNA, 26 bp, Artificial Sequence
  Description of Artificial Sequence: Synthetic oligonucleotide
tacgtggacggcacccagttcgtgag

SEQ ID NO: 23171 - DNA, 25 bp, Artificial Sequence
  Description of Artificial Sequence: Synthetic oligonucleotide
acgtggacggcacccagttcgtgag

SEQ ID NO: 23172 - DNA, 24 bp, Artificial Sequence
  Description of Artificial Sequence: Synthetic oligonucleotide
cgtggacggcacccagttcgtgag

SEQ ID NO: 23173 - DNA, 26 bp, Artificial Sequence
  Description of Artificial Sequence: Synthetic oligonucleotide
gtggacggcacccagttcgtgaggtt

SEQ ID NO: 23174 - DNA, 26 bp, Artificial Sequence
  Description of Artificial Sequence: Synthetic oligonucleotide
tggacggcacccagttcgtgaggttc

SEQ ID NO: 23175 - DNA, 25 bp, Artificial Sequence
  Description of Artificial Sequence: Synthetic oligonucleotide
ggacggcacccagttcgtgaggttc

SEQ ID NO: 23176 - DNA, 26 bp, Artificial Sequence
  Description of Artificial Sequence: Synthetic oligonucleotide
gacggcacccagttcgtgaggttcga

SEQ ID NO: 23177 - DNA, 27 bp, Artificial Sequence
  Description of Artificial Sequence: Synthetic oligonucleotide
acggcacccagttcgtgaggttcgaca

SEQ ID NO: 23178 - DNA, 26 bp, Artificial Sequence
  Description of Artificial Sequence: Synthetic oligonucleotide
cggcacccagttcgtgaggttcgaca

SEQ ID NO: 23179 - DNA, 26 bp, Artificial Sequence
  Description of Artificial Sequence: Synthetic oligonucleotide
ggcacccagttcgtgaggttcgacag

SEQ ID NO: 23180 - DNA, 26 bp, Artificial Sequence
  Description of Artificial Sequence: Synthetic oligonucleotide
gcacccagttcgtgaggttcgacagc

SEQ ID NO: 23181 - DNA, 28 bp, Artificial Sequence
  Description of Artificial Sequence: Synthetic oligonucleotide
acagactgaccgagagaacctgcggaac

SEQ ID NO: 23182 - DNA, 27 bp, Artificial Sequence
  Description of Artificial Sequence: Synthetic oligonucleotide
cagactgaccgagagaacctgcggaac

SEQ ID NO: 23183 - DNA, 27 bp, Artificial Sequence
  Description of Artificial Sequence: Synthetic oligonucleotide
agactgaccgagagaacctgcggaacc

SEQ ID NO: 23184 - DNA, 27 bp, Artificial Sequence
  Description of Artificial Sequence: Synthetic oligonucleotide
gactgaccgagagaacctgcggaacct

SEQ ID NO: 23185 - DNA, 27 bp, Artificial Sequence
  Description of Artificial Sequence: Synthetic oligonucleotide
actgaccgagagaacctgcggaacctg

SEQ ID NO: 23186 - DNA, 26 bp, Artificial Sequence
  Description of Artificial Sequence: Synthetic oligonucleotide
ctgaccgagagaacctgcggaacctg

SEQ ID NO: 23187 - DNA, 26 bp, Artificial Sequence
  Description of Artificial Sequence: Synthetic oligonucleotide
tgaccgagagaacctgcggaacctgc

SEQ ID NO: 23188 - DNA, 25 bp, Artificial Sequence
  Description of Artificial Sequence: Synthetic oligonucleotide
gaccgagagaacctgcggaacctgc

SEQ ID NO: 23189 - DNA, 25 bp, Artificial Sequence
  Description of Artificial Sequence: Synthetic oligonucleotide
accgagagaacctgcggaacctgcg

SEQ ID NO: 23190 - DNA, 24 bp, Artificial Sequence
  Description of Artificial Sequence: Synthetic oligonucleotide
ccgagagaacctgcggaacctgcg

SEQ ID NO: 23191 - DNA, 24 bp, Artificial Sequence
  Description of Artificial Sequence: Synthetic oligonucleotide
cgagagaacctgcggaacctgcgc

SEQ ID NO: 23192 - DNA, 24 bp, Artificial Sequence
  Description of Artificial Sequence: Synthetic oligonucleotide
gagagaacctgcggaacctgcgcg

SEQ ID NO: 23193 - DNA, 24 bp, Artificial Sequence
  Description of Artificial Sequence: Synthetic oligonucleotide
agagaacctgcggaacctgcgcgg

SEQ ID NO: 23194 - DNA, 23 bp, Artificial Sequence
  Description of Artificial Sequence: Synthetic oligonucleotide
gagaacctgcggaacctgcgcgg

SEQ ID NO: 23195 - DNA, 25 bp, Artificial Sequence
  Description of Artificial Sequence: Synthetic oligonucleotide
agaacctgcggaacctgcgcggcta

SEQ ID NO: 23196 - DNA, 24 bp, Artificial Sequence
  Description of Artificial Sequence: Synthetic oligonucleotide
gaacctgcggaacctgcgcggcta

SEQ ID NO: 23197 - DNA, 26 bp, Artificial Sequence
  Description of Artificial Sequence: Synthetic oligonucleotide
aacctgcggaacctgcgcggctacta

SEQ ID NO: 23198 - DNA, 25 bp, Artificial Sequence
  Description of Artificial Sequence: Synthetic oligonucleotide
acctgcggaacctgcgcggctacta

SEQ ID NO: 23199 - DNA, 20 bp, Artificial Sequence
  Description of Artificial Sequence: Synthetic oligonucleotide
gagccgcgggcgccgtggtt

SEQ ID NO: 23200 - DNA, 20 bp, Artificial Sequence
  Description of Artificial Sequence: Synthetic oligonucleotide
agccgcgggcgccgtgggtt

SEQ ID NO: 23201 - DNA, 20 bp, Artificial Sequence
  Description of Artificial Sequence: Synthetic oligonucleotide
gccgcgggcgccgtgggttt

SEQ ID NO: 23202 - DNA, 20 bp, Artificial Sequence
  Description of Artificial Sequence: Synthetic oligonucleotide
ccgcgggcgccgtgggtgtt

SEQ ID NO: 23203 - DNA, 20 bp, Artificial Sequence
  Description of Artificial Sequence: Synthetic oligonucleotide
cgcgggcgccgtgggtggat

SEQ ID NO: 23204 - DNA, 20 bp, Artificial Sequence
  Description of Artificial Sequence: Synthetic oligonucleotide
gcgggcgccgtgggtggagt

SEQ ID NO: 23205 - DNA, 20 bp, Artificial Sequence
  Description of Artificial Sequence: Synthetic oligonucleotide
cgggcgccgtgggtggagca

SEQ ID NO: 23206 - DNA, 20 bp, Artificial Sequence
  Description of Artificial Sequence: Synthetic oligonucleotide
gggcgccgtgggtggagcag

SEQ ID NO: 23207 - DNA, 21 bp, Artificial Sequence
  Description of Artificial Sequence: Synthetic oligonucleotide
ggcgccgtgggtggagcagga

SEQ ID NO: 23208 - DNA, 21 bp, Artificial Sequence
  Description of Artificial Sequence: Synthetic oligonucleotide
gcgccgtgggtggagcaggag

SEQ ID NO: 23209 - DNA, 21 bp, Artificial Sequence
  Description of Artificial Sequence: Synthetic oligonucleotide
cgccgtgggtggagcaggagg

SEQ ID NO: 23210 - DNA, 21 bp, Artificial Sequence
  Description of Artificial Sequence: Synthetic oligonucleotide
gccgtgggtggagcaggaggg

SEQ ID NO: 23211 - DNA, 21 bp, Artificial Sequence
  Description of Artificial Sequence: Synthetic oligonucleotide
ccgtgggtggagcaggagggg

SEQ ID NO: 23212 - DNA, 21 bp, Artificial Sequence
  Description of Artificial Sequence: Synthetic oligonucleotide
cgtgggtggagcaggaggggc

SEQ ID NO: 23213 - DNA, 21 bp, Artificial Sequence
  Description of Artificial Sequence: Synthetic oligonucleotide
gtgggtggagcaggaggggcc

SEQ ID NO: 23214 - DNA, 21 bp, Artificial Sequence
  Description of Artificial Sequence: Synthetic oligonucleotide
tgggtggagcaggaggggccg

SEQ ID NO: 23215 - DNA, 20 bp, Artificial Sequence
  Description of Artificial Sequence: Synthetic oligonucleotide
gggtggagcaggaggggccg

SEQ ID NO: 23216 - DNA, 21 bp, Artificial Sequence
  Description of Artificial Sequence: Synthetic oligonucleotide
ggtggagcaggaggggccgga

SEQ ID NO: 23217 - DNA, 25 bp, Artificial Sequence
  Description of Artificial Sequence: Synthetic oligonucleotide
gtggagcaggaggggccggagtatt

SEQ ID NO: 23218 - DNA, 27 bp, Artificial Sequence
  Description of Artificial Sequence: Synthetic oligonucleotide
cctgcggaacctgcgcggctactaaaa

SEQ ID NO: 23219 - DNA, 27 bp, Artificial Sequence
  Description of Artificial Sequence: Synthetic oligonucleotide
ctgcggaacctgcgcggctactaaaac

SEQ ID NO: 23220 - DNA, 27 bp, Artificial Sequence
  Description of Artificial Sequence: Synthetic oligonucleotide
tgcggaacctgcgcggctactaaaacc

SEQ ID NO: 23221 - DNA, 27 bp, Artificial Sequence
  Description of Artificial Sequence: Synthetic oligonucleotide
gcggaacctgcgcggctactaaaacca

SEQ ID NO: 23222 - DNA, 27 bp, Artificial Sequence
  Description of Artificial Sequence: Synthetic oligonucleotide
cggaacctgcgcggctactaaaaccag

SEQ ID NO: 23223 - DNA, 28 bp, Artificial Sequence
  Description of Artificial Sequence: Synthetic oligonucleotide
ggaacctgcgcggctactaaaaccagag

SEQ ID NO: 23224 - DNA, 28 bp, Artificial Sequence
  Description of Artificial Sequence: Synthetic oligonucleotide
gaacctgcgcggctactaaaaccagagc

SEQ ID NO: 23225 - DNA, 28 bp, Artificial Sequence
  Description of Artificial Sequence: Synthetic oligonucleotide
aacctgcgcggctactaaaaccagagcg

SEQ ID NO: 23226 - DNA, 27 bp, Artificial Sequence
  Description of Artificial Sequence: Synthetic oligonucleotide
acctgcgcggctactaaaaccagagcg

SEQ ID NO: 23227 - DNA, 27 bp, Artificial Sequence
  Description of Artificial Sequence: Synthetic oligonucleotide
cctgcgcggctactaaaaccagagcga

SEQ ID NO: 23228 - DNA, 27 bp, Artificial Sequence
  Description of Artificial Sequence: Synthetic oligonucleotide
ctgcgcggctactaaaaccagagcgag

SEQ ID NO: 23229 - DNA, 27 bp, Artificial Sequence
  Description of Artificial Sequence: Synthetic oligonucleotide
tgcgcggctactaaaaccagagcgagg

SEQ ID NO: 23230 - DNA, 26 bp, Artificial Sequence
  Description of Artificial Sequence: Synthetic oligonucleotide
gcgcggctactaaaaccagagcgagg

SEQ ID NO: 23231 - DNA, 26 bp, Artificial Sequence
  Description of Artificial Sequence: Synthetic oligonucleotide
cgcggctactaaaaccagagcgaggc

SEQ ID NO: 23232 - DNA, 26 bp, Artificial Sequence
  Description of Artificial Sequence: Synthetic oligonucleotide
gcggctactaaaaccagagcgaggcc

SEQ ID NO: 23233 - DNA, 26 bp, Artificial Sequence
  Description of Artificial Sequence: Synthetic oligonucleotide
cggctactaaaaccagagcgaggccg

SEQ ID NO: 23234 - DNA, 26 bp, Artificial Sequence
  Description of Artificial Sequence: Synthetic oligonucleotide
ggctactaaaaccagagcgaggccgg

SEQ ID NO: 23235 - DNA, 27 bp, Artificial Sequence
  Description of Artificial Sequence: Synthetic oligonucleotide
gctactaaaaccagagcgaggccgggt

SEQ ID NO: 23236 - DNA, 27 bp, Artificial Sequence
  Description of Artificial Sequence: Synthetic oligonucleotide
ctactaaaaccagagcgaggccgggtc

SEQ ID NO: 23237 - DNA, 28 bp, Artificial Sequence
  Description of Artificial Sequence: Synthetic oligonucleotide
tactaaaaccagagcgaggccgggtctc

SEQ ID NO: 23238 - DNA, 27 bp, Artificial Sequence
  Description of Artificial Sequence: Synthetic oligonucleotide
actaaaaccagagcgaggccgggtctc

SEQ ID NO: 23239 - DNA, 27 bp, Artificial Sequence
  Description of Artificial Sequence: Synthetic oligonucleotide
ctaaaaccagagcgaggccgggtctca

SEQ ID NO: 23240 - DNA, 27 bp, Artificial Sequence
  Description of Artificial Sequence: Synthetic oligonucleotide
taaaaccagagcgaggccgggtctcac

SEQ ID NO: 23241 - DNA, 27 bp, Artificial Sequence
  Description of Artificial Sequence: Synthetic oligonucleotide
aaaaccagagcgaggccgggtctcaca

SEQ ID NO: 23242 - DNA, 26 bp, Artificial Sequence
  Description of Artificial Sequence: Synthetic oligonucleotide
aaaccagagcgaggccgggtctcaca

SEQ ID NO: 23243 - DNA, 20 bp, Artificial Sequence
  Description of Artificial Sequence: Synthetic oligonucleotide
tccgtgtcccggcccggcgt

SEQ ID NO: 23244 - DNA, 20 bp, Artificial Sequence
  Description of Artificial Sequence: Synthetic oligonucleotide
ccgtgtcccggcccggcgtt

SEQ ID NO: 23245 - DNA, 20 bp, Artificial Sequence
  Description of Artificial Sequence: Synthetic oligonucleotide
cgtgtcccggcccggcggtt

SEQ ID NO: 23246 - DNA, 20 bp, Artificial Sequence
  Description of Artificial Sequence: Synthetic oligonucleotide
gtgtcccggcccggcggctt

SEQ ID NO: 23247 - DNA, 20 bp, Artificial Sequence
  Description of Artificial Sequence: Synthetic oligonucleotide
tgtcccggcccggcggcgtt

SEQ ID NO: 23248 - DNA, 20 bp, Artificial Sequence
  Description of Artificial Sequence: Synthetic oligonucleotide
gtcccggcccggcggcgttt

SEQ ID NO: 23249 - DNA, 20 bp, Artificial Sequence
  Description of Artificial Sequence: Synthetic oligonucleotide
tcccggcccggcggcggttt

SEQ ID NO: 23250 - DNA, 20 bp, Artificial Sequence
  Description of Artificial Sequence: Synthetic oligonucleotide
cccggcccggcggcggtttt

SEQ ID NO: 23251 - DNA, 20 bp, Artificial Sequence
  Description of Artificial Sequence: Synthetic oligonucleotide
ccggcccggcggcgggtttt

SEQ ID NO: 23252 - DNA, 20 bp, Artificial Sequence
  Description of Artificial Sequence: Synthetic oligonucleotide
cggcccggcggcggggattt

SEQ ID NO: 23253 - DNA, 20 bp, Artificial Sequence
  Description of Artificial Sequence: Synthetic oligonucleotide
ggcccggcggcggggagttt

SEQ ID NO: 23254 - DNA, 20 bp, Artificial Sequence
  Description of Artificial Sequence: Synthetic oligonucleotide
gcccggcggcggggagcttt

SEQ ID NO: 23255 - DNA, 20 bp, Artificial Sequence
  Description of Artificial Sequence: Synthetic oligonucleotide
cccggcggcggggagccttt

SEQ ID NO: 23256 - DNA, 20 bp, Artificial Sequence
  Description of Artificial Sequence: Synthetic oligonucleotide
ccggcggcggggagcccttt

SEQ ID NO: 23257 - DNA, 20 bp, Artificial Sequence
  Description of Artificial Sequence: Synthetic oligonucleotide
cggcggcggggagccccttt

SEQ ID NO: 23258 - DNA, 20 bp, Artificial Sequence
  Description of Artificial Sequence: Synthetic oligonucleotide
ggcggcggggagccccgttt

SEQ ID NO: 23259 - DNA, 20 bp, Artificial Sequence
  Description of Artificial Sequence: Synthetic oligonucleotide
gcggcggggagccccgcttt

SEQ ID NO: 23260 - DNA, 21 bp, Artificial Sequence
  Description of Artificial Sequence: Synthetic oligonucleotide
cggcggggagccccgcttcat

SEQ ID NO: 23261 - DNA, 22 bp, Artificial Sequence
  Description of Artificial Sequence: Synthetic oligonucleotide
ggcggggagccccgcttcatct

SEQ ID NO: 23262 - DNA, 23 bp, Artificial Sequence
  Description of Artificial Sequence: Synthetic oligonucleotide
acggcggctcagatcacccagcc

SEQ ID NO: 23263 - DNA, 22 bp, Artificial Sequence
  Description of Artificial Sequence: Synthetic oligonucleotide
cggcggctcagatcacccagcc

SEQ ID NO: 23264 - DNA, 24 bp, Artificial Sequence
  Description of Artificial Sequence: Synthetic oligonucleotide
ggcggctcagatcacccagcccaa

SEQ ID NO: 23265 - DNA, 25 bp, Artificial Sequence
  Description of Artificial Sequence: Synthetic oligonucleotide
gcggctcagatcacccagcccaagt

SEQ ID NO: 23266 - DNA, 25 bp, Artificial Sequence
  Description of Artificial Sequence: Synthetic oligonucleotide
cggctcagatcacccagcccaagtg

SEQ ID NO: 23267 - DNA, 25 bp, Artificial Sequence
  Description of Artificial Sequence: Synthetic oligonucleotide
ggctcagatcacccagcccaagtgg

SEQ ID NO: 23268 - DNA, 26 bp, Artificial Sequence
  Description of Artificial Sequence: Synthetic oligonucleotide
gctcagatcacccagcccaagtggga

SEQ ID NO: 23269 - DNA, 26 bp, Artificial Sequence
  Description of Artificial Sequence: Synthetic oligonucleotide
ctcagatcacccagcccaagtgggag

SEQ ID NO: 23270 - DNA, 26 bp, Artificial Sequence
  Description of Artificial Sequence: Synthetic oligonucleotide
tcagatcacccagcccaagtgggagg

SEQ ID NO: 23271 - DNA, 25 bp, Artificial Sequence
  Description of Artificial Sequence: Synthetic oligonucleotide
cagatcacccagcccaagtgggagg

SEQ ID NO: 23272 - DNA, 25 bp, Artificial Sequence
  Description of Artificial Sequence: Synthetic oligonucleotide
agatcacccagcccaagtgggaggc

SEQ ID NO: 23273 - DNA, 24 bp, Artificial Sequence
  Description of Artificial Sequence: Synthetic oligonucleotide
gatcacccagcccaagtgggaggc

SEQ ID NO: 23274 - DNA, 24 bp, Artificial Sequence
  Description of Artificial Sequence: Synthetic oligonucleotide
atcacccagcccaagtgggaggcg

SEQ ID NO: 23275 - DNA, 23 bp, Artificial Sequence
  Description of Artificial Sequence: Synthetic oligonucleotide
tcacccagcccaagtgggaggcg

SEQ ID NO: 23276 - DNA, 22 bp, Artificial Sequence
  Description of Artificial Sequence: Synthetic oligonucleotide
cacccagcccaagtgggaggcg

SEQ ID NO: 23277 - DNA, 22 bp, Artificial Sequence
  Description of Artificial Sequence: Synthetic oligonucleotide
acccagcccaagtgggaggcgg

SEQ ID NO: 23278 - DNA, 21 bp, Artificial Sequence
  Description of Artificial Sequence: Synthetic oligonucleotide
cccagcccaagtgggaggcgg

SEQ ID NO: 23279 - DNA, 21 bp, Artificial Sequence
  Description of Artificial Sequence: Synthetic oligonucleotide
ccagcccaagtgggaggcggc

SEQ ID NO: 23280 - DNA, 21 bp, Artificial Sequence
  Description of Artificial Sequence: Synthetic oligonucleotide
cagcccaagtgggaggcggcc

SEQ ID NO: 23281 - DNA, 21 bp, Artificial Sequence
  Description of Artificial Sequence: Synthetic oligonucleotide
agcccaagtgggaggcggccc

SEQ ID NO: 23282 - DNA, 20 bp, Artificial Sequence
  Description of Artificial Sequence: Synthetic oligonucleotide
gcccaagtgggaggcggccc

SEQ ID NO: 23283 - DNA, 21 bp, Artificial Sequence
  Description of Artificial Sequence: Synthetic oligonucleotide
cccaagtgggaggcggcccgt

SEQ ID NO: 23284 - DNA, 22 bp, Artificial Sequence
  Description of Artificial Sequence: Synthetic oligonucleotide
ccaagtgggaggcggcccgtga

SEQ ID NO: 23285 - DNA, 23 bp, Artificial Sequence
  Description of Artificial Sequence: Synthetic oligonucleotide
gggcgcctcctccgcgggtataa

SEQ ID NO: 23286 - DNA, 23 bp, Artificial Sequence
  Description of Artificial Sequence: Synthetic oligonucleotide
ggcgcctcctccgcgggtataac

SEQ ID NO: 23287 - DNA, 24 bp, Artificial Sequence
  Description of Artificial Sequence: Synthetic oligonucleotide
gcgcctcctccgcgggtataacca

SEQ ID NO: 23288 - DNA, 26 bp, Artificial Sequence
  Description of Artificial Sequence: Synthetic oligonucleotide
cgcctcctccgcgggtataaccagtt

SEQ ID NO: 23289 - DNA, 26 bp, Artificial Sequence
  Description of Artificial Sequence: Synthetic oligonucleotide
gcctcctccgcgggtataaccagttc

SEQ ID NO: 23290 - DNA, 26 bp, Artificial Sequence
  Description of Artificial Sequence: Synthetic oligonucleotide
cctcctccgcgggtataaccagttcg

SEQ ID NO: 23291 - DNA, 26 bp, Artificial Sequence
  Description of Artificial Sequence: Synthetic oligonucleotide
ctcctccgcgggtataaccagttcgc

SEQ ID NO: 23292 - DNA, 26 bp, Artificial Sequence
  Description of Artificial Sequence: Synthetic oligonucleotide
aaccagagcgaggccgggtctcacat

SEQ ID NO: 23293 - DNA, 25 bp, Artificial Sequence
  Description of Artificial Sequence: Synthetic oligonucleotide
accagagcgaggccgggtctcacat

SEQ ID NO: 23294 - DNA, 24 bp, Artificial Sequence
  Description of Artificial Sequence: Synthetic oligonucleotide
ccagagcgaggccgggtctcacat

SEQ ID NO: 23295 - DNA, 26 bp, Artificial Sequence
  Description of Artificial Sequence: Synthetic oligonucleotide
cagagcgaggccgggtctcacatcat

SEQ ID NO: 23296 - DNA, 26 bp, Artificial Sequence
  Description of Artificial Sequence: Synthetic oligonucleotide
agagcgaggccgggtctcacatcatc

SEQ ID NO: 23297 - DNA, 25 bp, Artificial Sequence
  Description of Artificial Sequence: Synthetic oligonucleotide
gagcgaggccgggtctcacatcatc

SEQ ID NO: 23298 - DNA, 26 bp, Artificial Sequence
  Description of Artificial Sequence: Synthetic oligonucleotide
agcgaggccgggtctcacatcatcca

SEQ ID NO: 23299 - DNA, 25 bp, Artificial Sequence
  Description of Artificial Sequence: Synthetic oligonucleotide
gcgaggccgggtctcacatcatcca

SEQ ID NO: 23300 - DNA, 26 bp, Artificial Sequence
  Description of Artificial Sequence: Synthetic oligonucleotide
cgaggccgggtctcacatcatccaga

SEQ ID NO: 23301 - DNA, 26 bp, Artificial Sequence
  Description of Artificial Sequence: Synthetic oligonucleotide
gaggccgggtctcacatcatccagag

SEQ ID NO: 23302 - DNA, 27 bp, Artificial Sequence
  Description of Artificial Sequence: Synthetic oligonucleotide
aggccgggtctcacatcatccagagga

SEQ ID NO: 23303 - DNA, 27 bp, Artificial Sequence
  Description of Artificial Sequence: Synthetic oligonucleotide
ggccgggtctcacatcatccagaggat

SEQ ID NO: 23304 - DNA, 27 bp, Artificial Sequence
  Description of Artificial Sequence: Synthetic oligonucleotide
gccgggtctcacatcatccagaggatg

SEQ ID NO: 23305 - DNA, 30 bp, Artificial Sequence
  Description of Artificial Sequence: Synthetic oligonucleotide
ccgggtctcacatcatccagaggatgtatg

SEQ ID NO: 23306 - DNA, 30 bp, Artificial Sequence
  Description of Artificial Sequence: Synthetic oligonucleotide
cgggtctcacatcatccagaggatgtatgg

SEQ ID NO: 23307 - DNA, 30 bp, Artificial Sequence
  Description of Artificial Sequence: Synthetic oligonucleotide
gggtctcacatcatccagaggatgtatggc

SEQ ID NO: 23308 - DNA, 31 bp, Artificial Sequence
  Description of Artificial Sequence: Synthetic oligonucleotide
ggtctcacatcatccagaggatgtatggctg

SEQ ID NO: 23309 - DNA, 31 bp, Artificial Sequence
  Description of Artificial Sequence: Synthetic oligonucleotide
gtctcacatcatccagaggatgtatggctgc

SEQ ID NO: 23310 - DNA, 31 bp, Artificial Sequence
  Description of Artificial Sequence: Synthetic oligonucleotide
tctcacatcatccagaggatgtatggctgcg

SEQ ID NO: 23311 - DNA, 30 bp, Artificial Sequence
  Description of Artificial Sequence: Synthetic oligonucleotide
ctcacatcatccagaggatgtatggctgcg

SEQ ID NO: 23312 - DNA, 31 bp, Artificial Sequence
  Description of Artificial Sequence: Synthetic oligonucleotide
tcacatcatccagaggatgtatggctgcgac

SEQ ID NO: 23313 - DNA, 30 bp, Artificial Sequence
  Description of Artificial Sequence: Synthetic oligonucleotide
cacatcatccagaggatgtatggctgcgac

SEQ ID NO: 23314 - DNA, 30 bp, Artificial Sequence
  Description of Artificial Sequence: Synthetic oligonucleotide
acatcatccagaggatgtatggctgcgacc

SEQ ID NO: 23315 - DNA, 29 bp, Artificial Sequence
  Description of Artificial Sequence: Synthetic oligonucleotide
catcatccagaggatgtatggctgcgacc

SEQ ID NO: 23316 - DNA, 30 bp, Artificial Sequence
  Description of Artificial Sequence: Synthetic oligonucleotide
atcatccagaggatgtatggctgcgacctg

SEQ ID NO: 23317 - DNA, 29 bp, Artificial Sequence
  Description of Artificial Sequence: Synthetic oligonucleotide
tcatccagaggatgtatggctgcgacctg

SEQ ID NO: 23318 - DNA, 28 bp, Artificial Sequence
  Description of Artificial Sequence: Synthetic oligonucleotide
catccagaggatgtatggctgcgacctg

SEQ ID NO: 23319 - DNA, 28 bp, Artificial Sequence
  Description of Artificial Sequence: Synthetic oligonucleotide
atccagaggatgtatggctgcgacctgg

SEQ ID NO: 23320 - DNA, 26 bp, Artificial Sequence
  Description of Artificial Sequence: Synthetic oligonucleotide
agaggatgtatggctgcgacctgggg

SEQ ID NO: 23321 - DNA, 25 bp, Artificial Sequence
  Description of Artificial Sequence: Synthetic oligonucleotide
gaggatgtatggctgcgacctgggg

SEQ ID NO: 23322 - DNA, 25 bp, Artificial Sequence
  Description of Artificial Sequence: Synthetic oligonucleotide
aggatgtatggctgcgacctggggc

SEQ ID NO: 23323 - DNA, 24 bp, Artificial Sequence
  Description of Artificial Sequence: Synthetic oligonucleotide
ggatgtatggctgcgacctggggc

SEQ ID NO: 23324 - DNA, 24 bp, Artificial Sequence
  Description of Artificial Sequence: Synthetic oligonucleotide
gatgtatggctgcgacctggggcc

SEQ ID NO: 23325 - DNA, 24 bp, Artificial Sequence
  Description of Artificial Sequence: Synthetic oligonucleotide
atgtatggctgcgacctggggccc

SEQ ID NO: 23326 - DNA, 23 bp, Artificial Sequence
  Description of Artificial Sequence: Synthetic oligonucleotide
tgtatggctgcgacctggggccc

SEQ ID NO: 23327 - DNA, 22 bp, Artificial Sequence
  Description of Artificial Sequence: Synthetic oligonucleotide
gtatggctgcgacctggggccc

SEQ ID NO: 23328 - DNA, 23 bp, Artificial Sequence
  Description of Artificial Sequence: Synthetic oligonucleotide
tatggctgcgacctggggcccga

SEQ ID NO: 23329 - DNA, 22 bp, Artificial Sequence
  Description of Artificial Sequence: Synthetic oligonucleotide
atggctgcgacctggggcccga

SEQ ID NO: 23330 - DNA, 21 bp, Artificial Sequence
  Description of Artificial Sequence: Synthetic oligonucleotide
tggctgcgacctggggcccga

SEQ ID NO: 23331 - DNA, 20 bp, Artificial Sequence
  Description of Artificial Sequence: Synthetic oligonucleotide
ggctgcgacctggggcccga

SEQ ID NO: 23332 - DNA, 20 bp, Artificial Sequence
  Description of Artificial Sequence: Synthetic oligonucleotide
gctgcgacctggggcccgac

SEQ ID NO: 23333 - DNA, 20 bp, Artificial Sequence
  Description of Artificial Sequence: Synthetic oligonucleotide
ctgcgacctggggcccgacg

SEQ ID NO: 23334 - DNA, 20 bp, Artificial Sequence
  Description of Artificial Sequence: Synthetic oligonucleotide
tgcgacctggggcccgacgg

SEQ ID NO: 23335 - DNA, 20 bp, Artificial Sequence
  Description of Artificial Sequence: Synthetic oligonucleotide
gcgacctggggcccgacggt

SEQ ID NO: 23336 - DNA, 20 bp, Artificial Sequence
  Description of Artificial Sequence: Synthetic oligonucleotide
cgacctggggcccgacgggt

SEQ ID NO: 23337 - DNA, 20 bp, Artificial Sequence
  Description of Artificial Sequence: Synthetic oligonucleotide
gacctggggcccgacgggct

SEQ ID NO: 23338 - DNA, 20 bp, Artificial Sequence
  Description of Artificial Sequence: Synthetic oligonucleotide
acctggggcccgacgggcgt

SEQ ID NO: 23339 - DNA, 20 bp, Artificial Sequence
  Description of Artificial Sequence: Synthetic oligonucleotide
cctggggcccgacgggcgtt

SEQ ID NO: 23340 - DNA, 20 bp, Artificial Sequence
  Description of Artificial Sequence: Synthetic oligonucleotide
ctggggcccgacgggcgctt

SEQ ID NO: 23341 - DNA, 20 bp, Artificial Sequence
  Description of Artificial Sequence: Synthetic oligonucleotide
tggggcccgacgggcgcctt

SEQ ID NO: 23342 - DNA, 20 bp, Artificial Sequence
  Description of Artificial Sequence: Synthetic oligonucleotide
ggggcccgacgggcgccttt

SEQ ID NO: 23343 - DNA, 20 bp, Artificial Sequence
  Description of Artificial Sequence: Synthetic oligonucleotide
gggcccgacgggcgcctctt

SEQ ID NO: 23344 - DNA, 20 bp, Artificial Sequence
  Description of Artificial Sequence: Synthetic oligonucleotide
ggcccgacgggcgcctcctt

SEQ ID NO: 23345 - DNA, 20 bp, Artificial Sequence
  Description of Artificial Sequence: Synthetic oligonucleotide
gcccgacgggcgcctcctct

SEQ ID NO: 23346 - DNA, 20 bp, Artificial Sequence
  Description of Artificial Sequence: Synthetic oligonucleotide
cccgacgggcgcctcctcct

SEQ ID NO: 23347 - DNA, 20 bp, Artificial Sequence
  Description of Artificial Sequence: Synthetic oligonucleotide
ccgacgggcgcctcctccgt

SEQ ID NO: 23348 - DNA, 20 bp, Artificial Sequence
  Description of Artificial Sequence: Synthetic oligonucleotide
cgacgggcgcctcctccgct

SEQ ID NO: 23349 - DNA, 22 bp, Artificial Sequence
  Description of Artificial Sequence: Synthetic oligonucleotide
agcgacgccgcgagtccgagag

SEQ ID NO: 23350 - DNA, 21 bp, Artificial Sequence
  Description of Artificial Sequence: Synthetic oligonucleotide
gcgacgccgcgagtccgagag

SEQ ID NO: 23351 - DNA, 21 bp, Artificial Sequence
  Description of Artificial Sequence: Synthetic oligonucleotide
cgacgccgcgagtccgagagg

SEQ ID NO: 23352 - DNA, 21 bp, Artificial Sequence
  Description of Artificial Sequence: Synthetic oligonucleotide
gacgccgcgagtccgagaggg

SEQ ID NO: 23353 - DNA, 22 bp, Artificial Sequence
  Description of Artificial Sequence: Synthetic oligonucleotide
acgccgcgagtccgagagggga

SEQ ID NO: 23354 - DNA, 21 bp, Artificial Sequence
  Description of Artificial Sequence: Synthetic oligonucleotide
cgccgcgagtccgagagggga

SEQ ID NO: 23355 - DNA, 21 bp, Artificial Sequence
  Description of Artificial Sequence: Synthetic oligonucleotide
gccgcgagtccgagaggggag

SEQ ID NO: 23356 - DNA, 21 bp, Artificial Sequence
  Description of Artificial Sequence: Synthetic oligonucleotide
ccgcgagtccgagaggggagc

SEQ ID NO: 23357 - DNA, 21 bp, Artificial Sequence
  Description of Artificial Sequence: Synthetic oligonucleotide
cgcgagtccgagaggggagcc

SEQ ID NO: 23358 - DNA, 21 bp, Artificial Sequence
  Description of Artificial Sequence: Synthetic oligonucleotide
gcgagtccgagaggggagccg

SEQ ID NO: 23359 - DNA, 21 bp, Artificial Sequence
  Description of Artificial Sequence: Synthetic oligonucleotide
cgagtccgagaggggagccgc

SEQ ID NO: 23360 - DNA, 21 bp, Artificial Sequence
  Description of Artificial Sequence: Synthetic oligonucleotide
gagtccgagaggggagccgcg

SEQ ID NO: 23361 - DNA, 21 bp, Artificial Sequence
  Description of Artificial Sequence: Synthetic oligonucleotide
agtccgagaggggagccgcgg

SEQ ID NO: 23362 - DNA, 20 bp, Artificial Sequence
  Description of Artificial Sequence: Synthetic oligonucleotide
gtccgagaggggagccgcgg

SEQ ID NO: 23363 - DNA, 20 bp, Artificial Sequence
  Description of Artificial Sequence: Synthetic oligonucleotide
tccgagaggggagccgcggg

SEQ ID NO: 23364 - DNA, 20 bp, Artificial Sequence
  Description of Artificial Sequence: Synthetic oligonucleotide
ccgagaggggagccgcgggt

SEQ ID NO: 23365 - DNA, 20 bp, Artificial Sequence
  Description of Artificial Sequence: Synthetic oligonucleotide
cgagaggggagccgcgggct

SEQ ID NO: 23366 - DNA, 20 bp, Artificial Sequence
  Description of Artificial Sequence: Synthetic oligonucleotide
gagaggggagccgcgggcgt

SEQ ID NO: 23367 - DNA, 20 bp, Artificial Sequence
  Description of Artificial Sequence: Synthetic oligonucleotide
agaggggagccgcgggcgct

SEQ ID NO: 23368 - DNA, 20 bp, Artificial Sequence
  Description of Artificial Sequence: Synthetic oligonucleotide
gaggggagccgcgggcgctt

SEQ ID NO: 23369 - DNA, 20 bp, Artificial Sequence
  Description of Artificial Sequence: Synthetic oligonucleotide
aggggagccgcgggcgcctt

SEQ ID NO: 23370 - DNA, 20 bp, Artificial Sequence
  Description of Artificial Sequence: Synthetic oligonucleotide
ggggagccgcgggcgccttt

SEQ ID NO: 23371 - DNA, 20 bp, Artificial Sequence
  Description of Artificial Sequence: Synthetic oligonucleotide
gggagccgcgggcgccgttt

SEQ ID NO: 23372 - DNA, 26 bp, Artificial Sequence
  Description of Artificial Sequence: Synthetic oligonucleotide
ccggagtattgggaccgggagacaca

SEQ ID NO: 23373 - DNA, 27 bp, Artificial Sequence
  Description of Artificial Sequence: Synthetic oligonucleotide
cggagtattgggaccgggagacacaga

SEQ ID NO: 23374 - DNA, 28 bp, Artificial Sequence
  Description of Artificial Sequence: Synthetic oligonucleotide
ggagtattgggaccgggagacacagaag

SEQ ID NO: 23375 - DNA, 30 bp, Artificial Sequence
  Description of Artificial Sequence: Synthetic oligonucleotide
gagtattgggaccgggagacacagaagtac

SEQ ID NO: 23376 - DNA, 32 bp, Artificial Sequence
  Description of Artificial Sequence: Synthetic oligonucleotide
agtattgggaccgggagacacagaagtacaag

SEQ ID NO: 23377 - DNA, 31 bp, Artificial Sequence
  Description of Artificial Sequence: Synthetic oligonucleotide
gtattgggaccgggagacacagaagtacaag

SEQ ID NO: 23378 - DNA, 31 bp, Artificial Sequence
  Description of Artificial Sequence: Synthetic oligonucleotide
tattgggaccgggagacacagaagtacaagc

SEQ ID NO: 23379 - DNA, 30 bp, Artificial Sequence
  Description of Artificial Sequence: Synthetic oligonucleotide
attgggaccgggagacacagaagtacaagc

SEQ ID NO: 23380 - DNA, 29 bp, Artificial Sequence
  Description of Artificial Sequence: Synthetic oligonucleotide
ttgggaccgggagacacagaagtacaagc

SEQ ID NO: 23381 - DNA, 28 bp, Artificial Sequence
  Description of Artificial Sequence: Synthetic oligonucleotide
tgggaccgggagacacagaagtacaagc

SEQ ID NO: 23382 - DNA, 27 bp, Artificial Sequence
  Description of Artificial Sequence: Synthetic oligonucleotide
gggaccgggagacacagaagtacaagc

SEQ ID NO: 23383 - DNA, 27 bp, Artificial Sequence
  Description of Artificial Sequence: Synthetic oligonucleotide
ggaccgggagacacagaagtacaagcg

SEQ ID NO: 23384 - DNA, 27 bp, Artificial Sequence
  Description of Artificial Sequence: Synthetic oligonucleotide
gaccgggagacacagaagtacaagcgc

SEQ ID NO: 23385 - DNA, 27 bp, Artificial Sequence
  Description of Artificial Sequence: Synthetic oligonucleotide
accgggagacacagaagtacaagcgcc

SEQ ID NO: 23386 - DNA, 27 bp, Artificial Sequence
  Description of Artificial Sequence: Synthetic oligonucleotide
ccgggagacacagaagtacaagcgcca

SEQ ID NO: 23387 - DNA, 27 bp, Artificial Sequence
  Description of Artificial Sequence: Synthetic oligonucleotide
cgggagacacagaagtacaagcgccag

SEQ ID NO: 23388 - DNA, 27 bp, Artificial Sequence
  Description of Artificial Sequence: Synthetic oligonucleotide
gggagacacagaagtacaagcgccagg

SEQ ID NO: 23389 - DNA, 27 bp, Artificial Sequence
  Description of Artificial Sequence: Synthetic oligonucleotide
ggagacacagaagtacaagcgccaggc

SEQ ID NO: 23390 - DNA, 28 bp, Artificial Sequence
  Description of Artificial Sequence: Synthetic oligonucleotide
gagacacagaagtacaagcgccaggcac

SEQ ID NO: 23391 - DNA, 29 bp, Artificial Sequence
  Description of Artificial Sequence: Synthetic oligonucleotide
agacacagaagtacaagcgccaggcacag

SEQ ID NO: 23392 - DNA, 28 bp, Artificial Sequence
  Description of Artificial Sequence: Synthetic oligonucleotide
gacacagaagtacaagcgccaggcacag

SEQ ID NO: 23393 - DNA, 28 bp, Artificial Sequence
  Description of Artificial Sequence: Synthetic oligonucleotide
acacagaagtacaagcgccaggcacagg

SEQ ID NO: 23394 - DNA, 27 bp, Artificial Sequence
  Description of Artificial Sequence: Synthetic oligonucleotide
cacagaagtacaagcgccaggcacagg

SEQ ID NO: 23395 - DNA, 27 bp, Artificial Sequence
  Description of Artificial Sequence: Synthetic oligonucleotide
acagaagtacaagcgccaggcacaggc

SEQ ID NO: 23396 - DNA, 27 bp, Artificial Sequence
  Description of Artificial Sequence: Synthetic oligonucleotide
cagaagtacaagcgccaggcacaggct

SEQ ID NO: 23397 - DNA, 27 bp, Artificial Sequence
  Description of Artificial Sequence: Synthetic oligonucleotide
agaagtacaagcgccaggcacaggctg

SEQ ID NO: 23398 - DNA, 27 bp, Artificial Sequence
  Description of Artificial Sequence: Synthetic oligonucleotide
gaagtacaagcgccaggcacaggctga

SEQ ID NO: 23399 - DNA, 27 bp, Artificial Sequence
  Description of Artificial Sequence: Synthetic oligonucleotide
aagtacaagcgccaggcacaggctgac

SEQ ID NO: 23400 - DNA, 26 bp, Artificial Sequence
  Description of Artificial Sequence: Synthetic oligonucleotide
agtacaagcgccaggcacaggctgac

SEQ ID NO: 23401 - DNA, 25 bp, Artificial Sequence
  Description of Artificial Sequence: Synthetic oligonucleotide
gtacaagcgccaggcacaggctgac

SEQ ID NO: 23402 - DNA, 25 bp, Artificial Sequence
  Description of Artificial Sequence: Synthetic oligonucleotide
tacaagcgccaggcacaggctgacc

SEQ ID NO: 23403 - DNA, 24 bp, Artificial Sequence
  Description of Artificial Sequence: Synthetic oligonucleotide
acaagcgccaggcacaggctgacc

SEQ ID NO: 23404 - DNA, 23 bp, Artificial Sequence
  Description of Artificial Sequence: Synthetic oligonucleotide
caagcgccaggcacaggctgacc

SEQ ID NO: 23405 - DNA, 24 bp, Artificial Sequence
  Description of Artificial Sequence: Synthetic oligonucleotide
aagcgccaggcacaggctgaccga

SEQ ID NO: 23406 - DNA, 23 bp, Artificial Sequence
  Description of Artificial Sequence: Synthetic oligonucleotide
agcgccaggcacaggctgaccga

SEQ ID NO: 23407 - DNA, 22 bp, Artificial Sequence
  Description of Artificial Sequence: Synthetic oligonucleotide
gcgccaggcacaggctgaccga

SEQ ID NO: 23408 - DNA, 23 bp, Artificial Sequence
  Description of Artificial Sequence: Synthetic oligonucleotide
cgccaggcacaggctgaccgagt

SEQ ID NO: 23409 - DNA, 24 bp, Artificial Sequence
  Description of Artificial Sequence: Synthetic oligonucleotide
gccaggcacaggctgaccgagtga

SEQ ID NO: 23410 - DNA, 24 bp, Artificial Sequence
  Description of Artificial Sequence: Synthetic oligonucleotide
ccaggcacaggctgaccgagtgag

SEQ ID NO: 23411 - DNA, 24 bp, Artificial Sequence
  Description of Artificial Sequence: Synthetic oligonucleotide
caggcacaggctgaccgagtgagc

SEQ ID NO: 23412 - DNA, 25 bp, Artificial Sequence
  Description of Artificial Sequence: Synthetic oligonucleotide
aggcacaggctgaccgagtgagcct

SEQ ID NO: 23413 - DNA, 24 bp, Artificial Sequence
  Description of Artificial Sequence: Synthetic oligonucleotide
ggcacaggctgaccgagtgagcct

SEQ ID NO: 23414 - DNA, 24 bp, Artificial Sequence
  Description of Artificial Sequence: Synthetic oligonucleotide
gcacaggctgaccgagtgagcctg

SEQ ID NO: 23415 - DNA, 24 bp, Artificial Sequence
  Description of Artificial Sequence: Synthetic oligonucleotide
cacaggctgaccgagtgagcctgc

SEQ ID NO: 23416 - DNA, 24 bp, Artificial Sequence
  Description of Artificial Sequence: Synthetic oligonucleotide
acaggctgaccgagtgagcctgcg

SEQ ID NO: 23417 - DNA, 23 bp, Artificial Sequence
  Description of Artificial Sequence: Synthetic oligonucleotide
caggctgaccgagtgagcctgcg

SEQ ID NO: 23418 - DNA, 25 bp, Artificial Sequence
  Description of Artificial Sequence: Synthetic oligonucleotide
aggctgaccgagtgagcctgcggaa

SEQ ID NO: 23419 - DNA, 24 bp, Artificial Sequence
  Description of Artificial Sequence: Synthetic oligonucleotide
ggctgaccgagtgagcctgcggaa

SEQ ID NO: 23420 - DNA, 24 bp, Artificial Sequence
  Description of Artificial Sequence: Synthetic oligonucleotide
gctgaccgagtgagcctgcggaac

SEQ ID NO: 23421 - DNA, 25 bp, Artificial Sequence
  Description of Artificial Sequence: Synthetic oligonucleotide
ctgaccgagtgagcctgcggaacct

SEQ ID NO: 23422 - DNA, 25 bp, Artificial Sequence
  Description of Artificial Sequence: Synthetic oligonucleotide
tgaccgagtgagcctgcggaacctg

SEQ ID NO: 23423 - DNA, 24 bp, Artificial Sequence
  Description of Artificial Sequence: Synthetic oligonucleotide
gaccgagtgagcctgcggaacctg

SEQ ID NO: 23424 - DNA, 24 bp, Artificial Sequence
  Description of Artificial Sequence: Synthetic oligonucleotide
accgagtgagcctgcggaacctgc

SEQ ID NO: 23425 - DNA, 23 bp, Artificial Sequence
  Description of Artificial Sequence: Synthetic oligonucleotide
ccgagtgagcctgcggaacctgc

SEQ ID NO: 23426 - DNA, 23 bp, Artificial Sequence
  Description of Artificial Sequence: Synthetic oligonucleotide
cgagtgagcctgcggaacctgcg

SEQ ID NO: 23427 - DNA, 23 bp, Artificial Sequence
  Description of Artificial Sequence: Synthetic oligonucleotide
gagtgagcctgcggaacctgcgc

SEQ ID NO: 23428 - DNA, 23 bp, Artificial Sequence
  Description of Artificial Sequence: Synthetic oligonucleotide
agtgagcctgcggaacctgcgcg

SEQ ID NO: 23429 - DNA, 22 bp, Artificial Sequence
  Description of Artificial Sequence: Synthetic oligonucleotide
gtgagcctgcggaacctgcgcg

SEQ ID NO: 23430 - DNA, 22 bp, Artificial Sequence
  Description of Artificial Sequence: Synthetic oligonucleotide
tgagcctgcggaacctgcgcgg

SEQ ID NO: 23431 - DNA, 29 bp, Artificial Sequence
  Description of Artificial Sequence: Synthetic oligonucleotide
ccgggtctcacatcatccagaggatgtac

SEQ ID NO: 23432 - DNA, 29 bp, Artificial Sequence
  Description of Artificial Sequence: Synthetic oligonucleotide
cgggtctcacatcatccagaggatgtacg

SEQ ID NO: 23433 - DNA, 29 bp, Artificial Sequence
  Description of Artificial Sequence: Synthetic oligonucleotide
gggtctcacatcatccagaggatgtacgg

SEQ ID NO: 23434 - DNA, 29 bp, Artificial Sequence
  Description of Artificial Sequence: Synthetic oligonucleotide
ggtctcacatcatccagaggatgtacggc

SEQ ID NO: 23435 - DNA, 30 bp, Artificial Sequence
  Description of Artificial Sequence: Synthetic oligonucleotide
gtctcacatcatccagaggatgtacggctg

SEQ ID NO: 23436 - DNA, 30 bp, Artificial Sequence
  Description of Artificial Sequence: Synthetic oligonucleotide
tctcacatcatccagaggatgtacggctgc

SEQ ID NO: 23437 - DNA, 29 bp, Artificial Sequence
  Description of Artificial Sequence: Synthetic oligonucleotide
ctcacatcatccagaggatgtacggctgc

SEQ ID NO: 23438 - DNA, 29 bp, Artificial Sequence
  Description of Artificial Sequence: Synthetic oligonucleotide
tcacatcatccagaggatgtacggctgcg

SEQ ID NO: 23439 - DNA, 28 bp, Artificial Sequence
  Description of Artificial Sequence: Synthetic oligonucleotide
cacatcatccagaggatgtacggctgcg

SEQ ID NO: 23440 - DNA, 29 bp, Artificial Sequence
  Description of Artificial Sequence: Synthetic oligonucleotide
acatcatccagaggatgtacggctgcgac

SEQ ID NO: 23441 - DNA, 28 bp, Artificial Sequence
  Description of Artificial Sequence: Synthetic oligonucleotide
catcatccagaggatgtacggctgcgac

SEQ ID NO: 23442 - DNA, 28 bp, Artificial Sequence
  Description of Artificial Sequence: Synthetic oligonucleotide
atcatccagaggatgtacggctgcgacg

SEQ ID NO: 23443 - DNA, 27 bp, Artificial Sequence
  Description of Artificial Sequence: Synthetic oligonucleotide
tcatccagaggatgtacggctgcgacg

SEQ ID NO: 23444 - DNA, 27 bp, Artificial Sequence
  Description of Artificial Sequence: Synthetic oligonucleotide
catccagaggatgtacggctgcgacgt

SEQ ID NO: 23445 - DNA, 27 bp, Artificial Sequence
  Description of Artificial Sequence: Synthetic oligonucleotide
atccagaggatgtacggctgcgacgtg

SEQ ID NO: 23446 - DNA, 22 bp, Artificial Sequence
  Description of Artificial Sequence: Synthetic oligonucleotide
ggcgcctcctccgcgggtatga

SEQ ID NO: 23447 - DNA, 22 bp, Artificial Sequence
  Description of Artificial Sequence: Synthetic oligonucleotide
gcgcctcctccgcgggtatgac

SEQ ID NO: 23448 - DNA, 23 bp, Artificial Sequence
  Description of Artificial Sequence: Synthetic oligonucleotide
cgcctcctccgcgggtatgacca

SEQ ID NO: 23449 - DNA, 25 bp, Artificial Sequence
  Description of Artificial Sequence: Synthetic oligonucleotide
gcctcctccgcgggtatgaccagta

SEQ ID NO: 23450 - DNA, 25 bp, Artificial Sequence
  Description of Artificial Sequence: Synthetic oligonucleotide
cctcctccgcgggtatgaccagtac

SEQ ID NO: 23451 - DNA, 25 bp, Artificial Sequence
  Description of Artificial Sequence: Synthetic oligonucleotide
ctcctccgcgggtatgaccagtacg

SEQ ID NO: 23452 - DNA, 28 bp, Artificial Sequence
  Description of Artificial Sequence: Synthetic oligonucleotide
acacagatctacaaggcccaggcacagg

SEQ ID NO: 23453 - DNA, 27 bp, Artificial Sequence
  Description of Artificial Sequence: Synthetic oligonucleotide
cacagatctacaaggcccaggcacagg

SEQ ID NO: 23454 - DNA, 27 bp, Artificial Sequence
  Description of Artificial Sequence: Synthetic oligonucleotide
acagatctacaaggcccaggcacaggc

SEQ ID NO: 23455 - DNA, 27 bp, Artificial Sequence
  Description of Artificial Sequence: Synthetic oligonucleotide
cagatctacaaggcccaggcacaggct

SEQ ID NO: 23456 - DNA, 27 bp, Artificial Sequence
  Description of Artificial Sequence: Synthetic oligonucleotide
agatctacaaggcccaggcacaggctg

SEQ ID NO: 23457 - DNA, 27 bp, Artificial Sequence
  Description of Artificial Sequence: Synthetic oligonucleotide
gatctacaaggcccaggcacaggctga

SEQ ID NO: 23458 - DNA, 27 bp, Artificial Sequence
  Description of Artificial Sequence: Synthetic oligonucleotide
atctacaaggcccaggcacaggctgac

SEQ ID NO: 23459 - DNA, 26 bp, Artificial Sequence
  Description of Artificial Sequence: Synthetic oligonucleotide
tctacaaggcccaggcacaggctgac

SEQ ID NO: 23460 - DNA, 25 bp, Artificial Sequence
  Description of Artificial Sequence: Synthetic oligonucleotide
ctacaaggcccaggcacaggctgac

SEQ ID NO: 23461 - DNA, 25 bp, Artificial Sequence
  Description of Artificial Sequence: Synthetic oligonucleotide
tacaaggcccaggcacaggctgacc

SEQ ID NO: 23462 - DNA, 24 bp, Artificial Sequence
  Description of Artificial Sequence: Synthetic oligonucleotide
acaaggcccaggcacaggctgacc

SEQ ID NO: 23463 - DNA, 23 bp, Artificial Sequence
  Description of Artificial Sequence: Synthetic oligonucleotide
caaggcccaggcacaggctgacc

SEQ ID NO: 23464 - DNA, 24 bp, Artificial Sequence
  Description of Artificial Sequence: Synthetic oligonucleotide
aaggcccaggcacaggctgaccga

SEQ ID NO: 23465 - DNA, 23 bp, Artificial Sequence
  Description of Artificial Sequence: Synthetic oligonucleotide
aggcccaggcacaggctgaccga

SEQ ID NO: 23466 - DNA, 22 bp, Artificial Sequence
  Description of Artificial Sequence: Synthetic oligonucleotide
ggcccaggcacaggctgaccga

SEQ ID NO: 23467 - DNA, 23 bp, Artificial Sequence
  Description of Artificial Sequence: Synthetic oligonucleotide
gcccaggcacaggctgaccgagt

SEQ ID NO: 23468 - DNA, 24 bp, Artificial Sequence
  Description of Artificial Sequence: Synthetic oligonucleotide
cccaggcacaggctgaccgagtga

SEQ ID NO: 23469 - DNA, 37 bp, Artificial Sequence
  Description of Artificial Sequence: Synthetic oligonucleotide
gaacacacagatctacaagaccaacacacagacttac

SEQ ID NO: 23470 - DNA, 37 bp, Artificial Sequence
  Description of Artificial Sequence: Synthetic oligonucleotide
aacacacagatctacaagaccaacacacagacttacc

SEQ ID NO: 23471 - DNA, 36 bp, Artificial Sequence
  Description of Artificial Sequence: Synthetic oligonucleotide
acacacagatctacaagaccaacacacagacttacc

SEQ ID NO: 23472 - DNA, 35 bp, Artificial Sequence
  Description of Artificial Sequence: Synthetic oligonucleotide
cacacagatctacaagaccaacacacagacttacc

SEQ ID NO: 23473 - DNA, 35 bp, Artificial Sequence
  Description of Artificial Sequence: Synthetic oligonucleotide
acacagatctacaagaccaacacacagacttaccg

SEQ ID NO: 23474 - DNA, 34 bp, Artificial Sequence
  Description of Artificial Sequence: Synthetic oligonucleotide
cacagatctacaagaccaacacacagacttaccg

SEQ ID NO: 23475 - DNA, 35 bp, Artificial Sequence
  Description of Artificial Sequence: Synthetic oligonucleotide
acagatctacaagaccaacacacagacttaccgag

SEQ ID NO: 23476 - DNA, 34 bp, Artificial Sequence
  Description of Artificial Sequence: Synthetic oligonucleotide
cagatctacaagaccaacacacagacttaccgag

SEQ ID NO: 23477 - DNA, 35 bp, Artificial Sequence
  Description of Artificial Sequence: Synthetic oligonucleotide
agatctacaagaccaacacacagacttaccgagag

SEQ ID NO: 23478 - DNA, 34 bp, Artificial Sequence
  Description of Artificial Sequence: Synthetic oligonucleotide
gatctacaagaccaacacacagacttaccgagag

SEQ ID NO: 23479 - DNA, 35 bp, Artificial Sequence
  Description of Artificial Sequence: Synthetic oligonucleotide
atctacaagaccaacacacagacttaccgagagag

SEQ ID NO: 23480 - DNA, 34 bp, Artificial Sequence
  Description of Artificial Sequence: Synthetic oligonucleotide
tctacaagaccaacacacagacttaccgagagag

SEQ ID NO: 23481 - DNA, 33 bp, Artificial Sequence
  Description of Artificial Sequence: Synthetic oligonucleotide
ctacaagaccaacacacagacttaccgagagag

SEQ ID NO: 23482 - DNA, 33 bp, Artificial Sequence
  Description of Artificial Sequence: Synthetic oligonucleotide
tacaagaccaacacacagacttaccgagagagc

SEQ ID NO: 23483 - DNA, 32 bp, Artificial Sequence
  Description of Artificial Sequence: Synthetic oligonucleotide
acaagaccaacacacagacttaccgagagagc

SEQ ID NO: 23484 - DNA, 31 bp, Artificial Sequence
  Description of Artificial Sequence: Synthetic oligonucleotide
caagaccaacacacagacttaccgagagagc

SEQ ID NO: 23485 - DNA, 31 bp, Artificial Sequence
  Description of Artificial Sequence: Synthetic oligonucleotide
aagaccaacacacagacttaccgagagagcc

SEQ ID NO: 23486 - DNA, 30 bp, Artificial Sequence
  Description of Artificial Sequence: Synthetic oligonucleotide
agaccaacacacagacttaccgagagagcc

SEQ ID NO: 23487 - DNA, 29 bp, Artificial Sequence
  Description of Artificial Sequence: Synthetic oligonucleotide
gaccaacacacagacttaccgagagagcc

SEQ ID NO: 23488 - DNA, 30 bp, Artificial Sequence
  Description of Artificial Sequence: Synthetic oligonucleotide
accaacacacagacttaccgagagagcctg

SEQ ID NO: 23489 - DNA, 29 bp, Artificial Sequence
  Description of Artificial Sequence: Synthetic oligonucleotide
ccaacacacagacttaccgagagagcctg

SEQ ID NO: 23490 - DNA, 29 bp, Artificial Sequence
  Description of Artificial Sequence: Synthetic oligonucleotide
caacacacagacttaccgagagagcctgc

SEQ ID NO: 23491 - DNA, 29 bp, Artificial Sequence
  Description of Artificial Sequence: Synthetic oligonucleotide
aacacacagacttaccgagagagcctgcg

SEQ ID NO: 23492 - DNA, 28 bp, Artificial Sequence
  Description of Artificial Sequence: Synthetic oligonucleotide
acacacagacttaccgagagagcctgcg

SEQ ID NO: 23493 - DNA, 27 bp, Artificial Sequence
  Description of Artificial Sequence: Synthetic oligonucleotide
cacacagacttaccgagagagcctgcg

SEQ ID NO: 23494 - DNA, 27 bp, Artificial Sequence
  Description of Artificial Sequence: Synthetic oligonucleotide
acacagacttaccgagagagcctgcgg

SEQ ID NO: 23495 - DNA, 27 bp, Artificial Sequence
  Description of Artificial Sequence: Synthetic oligonucleotide
cacagacttaccgagagagcctgcgga

SEQ ID NO: 23496 - DNA, 28 bp, Artificial Sequence
  Description of Artificial Sequence: Synthetic oligonucleotide
acagacttaccgagagagcctgcggaac

SEQ ID NO: 23497 - DNA, 27 bp, Artificial Sequence
  Description of Artificial Sequence: Synthetic oligonucleotide
cagacttaccgagagagcctgcggaac

SEQ ID NO: 23498 - DNA, 27 bp, Artificial Sequence
  Description of Artificial Sequence: Synthetic oligonucleotide
agacttaccgagagagcctgcggaacc

SEQ ID NO: 23499 - DNA, 27 bp, Artificial Sequence
  Description of Artificial Sequence: Synthetic oligonucleotide
gacttaccgagagagcctgcggaacct

SEQ ID NO: 23500 - DNA, 27 bp, Artificial Sequence
  Description of Artificial Sequence: Synthetic oligonucleotide
acttaccgagagagcctgcggaacctg

SEQ ID NO: 23501 - DNA, 26 bp, Artificial Sequence
  Description of Artificial Sequence: Synthetic oligonucleotide
cttaccgagagagcctgcggaacctg

SEQ ID NO: 23502 - DNA, 26 bp, Artificial Sequence
  Description of Artificial Sequence: Synthetic oligonucleotide
ttaccgagagagcctgcggaacctgc

SEQ ID NO: 23503 - DNA, 25 bp, Artificial Sequence
  Description of Artificial Sequence: Synthetic oligonucleotide
taccgagagagcctgcggaacctgc

SEQ ID NO: 23504 - DNA, 24 bp, Artificial Sequence
  Description of Artificial Sequence: Synthetic oligonucleotide
gcctcctccgcgggtatgaccagt

SEQ ID NO: 23505 - DNA, 24 bp, Artificial Sequence
  Description of Artificial Sequence: Synthetic oligonucleotide
cctcctccgcgggtatgaccagtc

SEQ ID NO: 23506 - DNA, 24 bp, Artificial Sequence
  Description of Artificial Sequence: Synthetic oligonucleotide
ctcctccgcgggtatgaccagtcc

SEQ ID NO: 23507 - DNA, 30 bp, Artificial Sequence
  Description of Artificial Sequence: Synthetic oligonucleotide
acatcatccagaggatgtatggctgcgacg

SEQ ID NO: 23508 - DNA, 29 bp, Artificial Sequence
  Description of Artificial Sequence: Synthetic oligonucleotide
catcatccagaggatgtatggctgcgacg

SEQ ID NO: 23509 - DNA, 30 bp, Artificial Sequence
  Description of Artificial Sequence: Synthetic oligonucleotide
atcatccagaggatgtatggctgcgacgtg

SEQ ID NO: 23510 - DNA, 29 bp, Artificial Sequence
  Description of Artificial Sequence: Synthetic oligonucleotide
tcatccagaggatgtatggctgcgacgtg

SEQ ID NO: 23511 - DNA, 25 bp, Artificial Sequence
  Description of Artificial Sequence: Synthetic oligonucleotide
caggacagagcctacctggagggca

SEQ ID NO: 23512 - DNA, 25 bp, Artificial Sequence
  Description of Artificial Sequence: Synthetic oligonucleotide
aggacagagcctacctggagggcac

SEQ ID NO: 23513 - DNA, 24 bp, Artificial Sequence
  Description of Artificial Sequence: Synthetic oligonucleotide
ggacagagcctacctggagggcac

SEQ ID NO: 23514 - DNA, 25 bp, Artificial Sequence
  Description of Artificial Sequence: Synthetic oligonucleotide
gacagagcctacctggagggcacgt

SEQ ID NO: 23515 - DNA, 26 bp, Artificial Sequence
  Description of Artificial Sequence: Synthetic oligonucleotide
ctggagaacgggaaggagacgctgga

SEQ ID NO: 23516 - DNA, 26 bp, Artificial Sequence
  Description of Artificial Sequence: Synthetic oligonucleotide
tggagaacgggaaggagacgctggag

SEQ ID NO: 23517 - DNA, 25 bp, Artificial Sequence
  Description of Artificial Sequence: Synthetic oligonucleotide
ggagaacgggaaggagacgctggag

SEQ ID NO: 23518 - DNA, 25 bp, Artificial Sequence
  Description of Artificial Sequence: Synthetic oligonucleotide
gagaacgggaaggagacgctggagc

SEQ ID NO: 23519 - DNA, 25 bp, Artificial Sequence
  Description of Artificial Sequence: Synthetic oligonucleotide
agaacgggaaggagacgctggagcg

SEQ ID NO: 23520 - DNA, 24 bp, Artificial Sequence
  Description of Artificial Sequence: Synthetic oligonucleotide
gaacgggaaggagacgctggagcg

SEQ ID NO: 23521 - DNA, 24 bp, Artificial Sequence
  Description of Artificial Sequence: Synthetic oligonucleotide
aacgggaaggagacgctggagcgc

SEQ ID NO: 23522 - DNA, 23 bp, Artificial Sequence
  Description of Artificial Sequence: Synthetic oligonucleotide
acgggaaggagacgctggagcgc

SEQ ID NO: 23523 - DNA, 22 bp, Artificial Sequence
  Description of Artificial Sequence: Synthetic oligonucleotide
cgggaaggagacgctggagcgc

SEQ ID NO: 23524 - DNA, 22 bp, Artificial Sequence
  Description of Artificial Sequence: Synthetic oligonucleotide
gggaaggagacgctggagcgcg

SEQ ID NO: 23525 - DNA, 22 bp, Artificial Sequence
  Description of Artificial Sequence: Synthetic oligonucleotide
ggaaggagacgctggagcgcgc

SEQ ID NO: 23526 - DNA, 22 bp, Artificial Sequence
  Description of Artificial Sequence: Synthetic oligonucleotide
gaaggagacgctggagcgcgcg

SEQ ID NO: 23527 - DNA, 22 bp, Artificial Sequence
  Description of Artificial Sequence: Synthetic oligonucleotide
aaggagacgctggagcgcgcgg

SEQ ID NO: 23528 - DNA, 23 bp, Artificial Sequence
  Description of Artificial Sequence: Synthetic oligonucleotide
cggagagcctacctggagggcct

SEQ ID NO: 23529 - DNA, 23 bp, Artificial Sequence
  Description of Artificial Sequence: Synthetic oligonucleotide
ctggagggcctgtgcgtggagtc

SEQ ID NO: 23530 - DNA, 23 bp, Artificial Sequence
  Description of Artificial Sequence: Synthetic oligonucleotide
tggagggcctgtgcgtggagtcg

SEQ ID NO: 23531 - DNA, 22 bp, Artificial Sequence
  Description of Artificial Sequence: Synthetic oligonucleotide
ggagggcctgtgcgtggagtcg

SEQ ID NO: 23532 - DNA, 23 bp, Artificial Sequence
  Description of Artificial Sequence: Synthetic oligonucleotide
gagggcctgtgcgtggagtcgct

SEQ ID NO: 23533 - DNA, 23 bp, Artificial Sequence
  Description of Artificial Sequence: Synthetic oligonucleotide
agggcctgtgcgtggagtcgctc

SEQ ID NO: 23534 - DNA, 22 bp, Artificial Sequence
  Description of Artificial Sequence: Synthetic oligonucleotide
gggcctgtgcgtggagtcgctc

SEQ ID NO: 23535 - DNA, 22 bp, Artificial Sequence
  Description of Artificial Sequence: Synthetic oligonucleotide
ggcctgtgcgtggagtcgctcc

SEQ ID NO: 23536 - DNA, 22 bp, Artificial Sequence
  Description of Artificial Sequence: Synthetic oligonucleotide
gcctgtgcgtggagtcgctccg

SEQ ID NO: 23537 - DNA, 23 bp, Artificial Sequence
  Description of Artificial Sequence: Synthetic oligonucleotide
cctgtgcgtggagtcgctccgca

SEQ ID NO: 23538 - DNA, 26 bp, Artificial Sequence
  Description of Artificial Sequence: Synthetic oligonucleotide
ctgtgcgtggagtcgctccgcagata

SEQ ID NO: 23539 - DNA, 26 bp, Artificial Sequence
  Description of Artificial Sequence: Synthetic oligonucleotide
tgtgcgtggagtcgctccgcagatac

SEQ ID NO: 23540 - DNA, 23 bp, Artificial Sequence
  Description of Artificial Sequence: Synthetic oligonucleotide
ccgcggggagctccgcttcatct

SEQ ID NO: 23541 - DNA, 24 bp, Artificial Sequence
  Description of Artificial Sequence: Synthetic oligonucleotide
cgcggggagctccgcttcatctca

SEQ ID NO: 23542 - DNA, 25 bp, Artificial Sequence
  Description of Artificial Sequence: Synthetic oligonucleotide
gcggggagctccgcttcatctcagt

SEQ ID NO: 23543 - DNA, 25 bp, Artificial Sequence
  Description of Artificial Sequence: Synthetic oligonucleotide
cggggagctccgcttcatctcagtg

SEQ ID NO: 23544 - DNA, 25 bp, Artificial Sequence
  Description of Artificial Sequence: Synthetic oligonucleotide
ggggagctccgcttcatctcagtgg

SEQ ID NO: 23545 - DNA, 25 bp, Artificial Sequence
  Description of Artificial Sequence: Synthetic oligonucleotide
gggagctccgcttcatctcagtggg

SEQ ID NO: 23546 - DNA, 27 bp, Artificial Sequence
  Description of Artificial Sequence: Synthetic oligonucleotide
ggagctccgcttcatctcagtgggcta

SEQ ID NO: 23547 - DNA, 27 bp, Artificial Sequence
  Description of Artificial Sequence: Synthetic oligonucleotide
gagctccgcttcatctcagtgggctac

SEQ ID NO: 23548 - DNA, 27 bp, Artificial Sequence
  Description of Artificial Sequence: Synthetic oligonucleotide
agctccgcttcatctcagtgggctacg

SEQ ID NO: 23549 - DNA, 27 bp, Artificial Sequence
  Description of Artificial Sequence: Synthetic oligonucleotide
gctccgcttcatctcagtgggctacgt

SEQ ID NO: 23550 - DNA, 27 bp, Artificial Sequence
  Description of Artificial Sequence: Synthetic oligonucleotide
ctccgcttcatctcagtgggctacgtg

SEQ ID NO: 23551 - DNA, 27 bp, Artificial Sequence
  Description of Artificial Sequence: Synthetic oligonucleotide
tccgcttcatctcagtgggctacgtgg

SEQ ID NO: 23552 - DNA, 22 bp, Artificial Sequence
  Description of Artificial Sequence: Synthetic oligonucleotide
tgcgctcctggaccgccgcgaa

SEQ ID NO: 23553 - DNA, 21 bp, Artificial Sequence
  Description of Artificial Sequence: Synthetic oligonucleotide
gcgctcctggaccgccgcgaa

SEQ ID NO: 23554 - DNA, 22 bp, Artificial Sequence
  Description of Artificial Sequence: Synthetic oligonucleotide
cgctcctggaccgccgcgaaca

SEQ ID NO: 23555 - DNA, 22 bp, Artificial Sequence
  Description of Artificial Sequence: Synthetic oligonucleotide
gctcctggaccgccgcgaacac

SEQ ID NO: 23556 - DNA, 22 bp, Artificial Sequence
  Description of Artificial Sequence: Synthetic oligonucleotide
ctcctggaccgccgcgaacacg

SEQ ID NO: 23557 - DNA, 22 bp, Artificial Sequence
  Description of Artificial Sequence: Synthetic oligonucleotide
tcctggaccgccgcgaacacgg

SEQ ID NO: 23558 - DNA, 21 bp, Artificial Sequence
  Description of Artificial Sequence: Synthetic oligonucleotide
cctggaccgccgcgaacacgg

SEQ ID NO: 23559 - DNA, 21 bp, Artificial Sequence
  Description of Artificial Sequence: Synthetic oligonucleotide
ctggaccgccgcgaacacggc

SEQ ID NO: 23560 - DNA, 21 bp, Artificial Sequence
  Description of Artificial Sequence: Synthetic oligonucleotide
tggaccgccgcgaacacggcg

SEQ ID NO: 23561 - DNA, 20 bp, Artificial Sequence
  Description of Artificial Sequence: Synthetic oligonucleotide
ggaccgccgcgaacacggcg

SEQ ID NO: 23562 - DNA, 20 bp, Artificial Sequence
  Description of Artificial Sequence: Synthetic oligonucleotide
gaccgccgcgaacacggcgg

SEQ ID NO: 23563 - DNA, 21 bp, Artificial Sequence
  Description of Artificial Sequence: Synthetic oligonucleotide
accgccgcgaacacggcggct

SEQ ID NO: 23564 - DNA, 20 bp, Artificial Sequence
  Description of Artificial Sequence: Synthetic oligonucleotide
ccgccgcgaacacggcggct

SEQ ID NO: 23565 - DNA, 21 bp, Artificial Sequence
  Description of Artificial Sequence: Synthetic oligonucleotide
cgccgcgaacacggcggctca

SEQ ID NO: 23566 - DNA, 23 bp, Artificial Sequence
  Description of Artificial Sequence: Synthetic oligonucleotide
gccgcgaacacggcggctcagat

SEQ ID NO: 23567 - DNA, 24 bp, Artificial Sequence
  Description of Artificial Sequence: Synthetic oligonucleotide
ccgcgaacacggcggctcagatca

SEQ ID NO: 23568 - DNA, 24 bp, Artificial Sequence
  Description of Artificial Sequence: Synthetic oligonucleotide
cgcgaacacggcggctcagatcac

SEQ ID NO: 23569 - DNA, 24 bp, Artificial Sequence
  Description of Artificial Sequence: Synthetic oligonucleotide
gcgaacacggcggctcagatcacc

SEQ ID NO: 23570 - DNA, 25 bp, Artificial Sequence
  Description of Artificial Sequence: Synthetic oligonucleotide
cgaacacggcggctcagatcaccca

SEQ ID NO: 23571 - DNA, 25 bp, Artificial Sequence
  Description of Artificial Sequence: Synthetic oligonucleotide
gaacacggcggctcagatcacccag

SEQ ID NO: 23572 - DNA, 25 bp, Artificial Sequence
  Description of Artificial Sequence: Synthetic oligonucleotide
aacacggcggctcagatcacccagc

SEQ ID NO: 23573 - DNA, 22 bp, Artificial Sequence
  Description of Artificial Sequence: Synthetic oligonucleotide
ctcctggaccgccgcgaacacc

SEQ ID NO: 23574 - DNA, 22 bp, Artificial Sequence
  Description of Artificial Sequence: Synthetic oligonucleotide
tcctggaccgccgcgaacaccg

SEQ ID NO: 23575 - DNA, 21 bp, Artificial Sequence
  Description of Artificial Sequence: Synthetic oligonucleotide
cctggaccgccgcgaacaccg

SEQ ID NO: 23576 - DNA, 21 bp, Artificial Sequence
  Description of Artificial Sequence: Synthetic oligonucleotide
ctggaccgccgcgaacaccgc

SEQ ID NO: 23577 - DNA, 21 bp, Artificial Sequence
  Description of Artificial Sequence: Synthetic oligonucleotide
tggaccgccgcgaacaccgcg

SEQ ID NO: 23578 - DNA, 20 bp, Artificial Sequence
  Description of Artificial Sequence: Synthetic oligonucleotide
ggaccgccgcgaacaccgcg

SEQ ID NO: 23579 - DNA, 20 bp, Artificial Sequence
  Description of Artificial Sequence: Synthetic oligonucleotide
gaccgccgcgaacaccgcgg

SEQ ID NO: 23580 - DNA, 21 bp, Artificial Sequence
  Description of Artificial Sequence: Synthetic oligonucleotide
accgccgcgaacaccgcggct

SEQ ID NO: 23581 - DNA, 20 bp, Artificial Sequence
  Description of Artificial Sequence: Synthetic oligonucleotide
ccgccgcgaacaccgcggct

SEQ ID NO: 23582 - DNA, 21 bp, Artificial Sequence
  Description of Artificial Sequence: Synthetic oligonucleotide
cgccgcgaacaccgcggctca

SEQ ID NO: 23583 - DNA, 23 bp, Artificial Sequence
  Description of Artificial Sequence: Synthetic oligonucleotide
gccgcgaacaccgcggctcagat

SEQ ID NO: 23584 - DNA, 24 bp, Artificial Sequence
  Description of Artificial Sequence: Synthetic oligonucleotide
ccgcgaacaccgcggctcagatca

SEQ ID NO: 23585 - DNA, 24 bp, Artificial Sequence
  Description of Artificial Sequence: Synthetic oligonucleotide
cgcgaacaccgcggctcagatcac

SEQ ID NO: 23586 - DNA, 24 bp, Artificial Sequence
  Description of Artificial Sequence: Synthetic oligonucleotide
gcgaacaccgcggctcagatcacc

SEQ ID NO: 23587 - DNA, 25 bp, Artificial Sequence
  Description of Artificial Sequence: Synthetic oligonucleotide
cgaacaccgcggctcagatcaccca

SEQ ID NO: 23588 - DNA, 25 bp, Artificial Sequence
  Description of Artificial Sequence: Synthetic oligonucleotide
gaacaccgcggctcagatcacccag

SEQ ID NO: 23589 - DNA, 25 bp, Artificial Sequence
  Description of Artificial Sequence: Synthetic oligonucleotide
aacaccgcggctcagatcacccagc

SEQ ID NO: 23590 - DNA, 21 bp, Artificial Sequence
  Description of Artificial Sequence: Synthetic oligonucleotide
agcctgcggaacctgcgcggc

SEQ ID NO: 23591 - DNA, 20 bp, Artificial Sequence
  Description of Artificial Sequence: Synthetic oligonucleotide
gcctgcggaacctgcgcggc

SEQ ID NO: 23592 - DNA, 21 bp, Artificial Sequence
  Description of Artificial Sequence: Synthetic oligonucleotide
cctgcggaacctgcgcggcca

SEQ ID NO: 23593 - DNA, 23 bp, Artificial Sequence
  Description of Artificial Sequence: Synthetic oligonucleotide
ctgcggaacctgcgcggccacta

SEQ ID NO: 23594 - DNA, 25 bp, Artificial Sequence
  Description of Artificial Sequence: Synthetic oligonucleotide
tgcggaacctgcgcggccactacaa

SEQ ID NO: 23595 - DNA, 24 bp, Artificial Sequence
  Description of Artificial Sequence: Synthetic oligonucleotide
gcggaacctgcgcggccactacaa

SEQ ID NO: 23596 - DNA, 24 bp, Artificial Sequence
  Description of Artificial Sequence: Synthetic oligonucleotide
cggaacctgcgcggccactacaac

SEQ ID NO: 23597 - DNA, 25 bp, Artificial Sequence
  Description of Artificial Sequence: Synthetic oligonucleotide
ggaacctgcgcggccactacaacca

SEQ ID NO: 23598 - DNA, 26 bp, Artificial Sequence
  Description of Artificial Sequence: Synthetic oligonucleotide
gaacctgcgcggccactacaaccaga

SEQ ID NO: 23599 - DNA, 26 bp, Artificial Sequence
  Description of Artificial Sequence: Synthetic oligonucleotide
aacctgcgcggccactacaaccagag

SEQ ID NO: 23600 - DNA, 25 bp, Artificial Sequence
  Description of Artificial Sequence: Synthetic oligonucleotide
acctgcgcggccactacaaccagag

SEQ ID NO: 23601 - DNA, 24 bp, Artificial Sequence
  Description of Artificial Sequence: Synthetic oligonucleotide
gcggccactacaaccagagcgagg

SEQ ID NO: 23602 - DNA, 24 bp, Artificial Sequence
  Description of Artificial Sequence: Synthetic oligonucleotide
cggccactacaaccagagcgaggc

SEQ ID NO: 23603 - DNA, 24 bp, Artificial Sequence
  Description of Artificial Sequence: Synthetic oligonucleotide
ggccactacaaccagagcgaggcc

SEQ ID NO: 23604 - DNA, 24 bp, Artificial Sequence
  Description of Artificial Sequence: Synthetic oligonucleotide
gccactacaaccagagcgaggccg

SEQ ID NO: 23605 - DNA, 24 bp, Artificial Sequence
  Description of Artificial Sequence: Synthetic oligonucleotide
ccactacaaccagagcgaggccgg

SEQ ID NO: 23606 - DNA, 25 bp, Artificial Sequence
  Description of Artificial Sequence: Synthetic oligonucleotide
cactacaaccagagcgaggccgggt

SEQ ID NO: 23607 - DNA, 21 bp, Artificial Sequence
  Description of Artificial Sequence: Synthetic oligonucleotide
ggcccgtgtggcggagcagga

SEQ ID NO: 23608 - DNA, 22 bp, Artificial Sequence
  Description of Artificial Sequence: Synthetic oligonucleotide
gcccgtgtggcggagcaggaca

SEQ ID NO: 23609 - DNA, 23 bp, Artificial Sequence
  Description of Artificial Sequence: Synthetic oligonucleotide
cccgtgtggcggagcaggacaga

SEQ ID NO: 23610 - DNA, 23 bp, Artificial Sequence
  Description of Artificial Sequence: Synthetic oligonucleotide
ccgtgtggcggagcaggacagag

SEQ ID NO: 23611 - DNA, 23 bp, Artificial Sequence
  Description of Artificial Sequence: Synthetic oligonucleotide
cgtgtggcggagcaggacagagc

SEQ ID NO: 23612 - DNA, 25 bp, Artificial Sequence
  Description of Artificial Sequence: Synthetic oligonucleotide
gtgtggcggagcaggacagagccta

SEQ ID NO: 23613 - DNA, 25 bp, Artificial Sequence
  Description of Artificial Sequence: Synthetic oligonucleotide
tgtggcggagcaggacagagcctac

SEQ ID NO: 23614 - DNA, 24 bp, Artificial Sequence
  Description of Artificial Sequence: Synthetic oligonucleotide
gtggcggagcaggacagagcctac

SEQ ID NO: 23615 - DNA, 25 bp, Artificial Sequence
  Description of Artificial Sequence: Synthetic oligonucleotide
tggcggagcaggacagagcctacct

SEQ ID NO: 23616 - DNA, 21 bp, Artificial Sequence
  Description of Artificial Sequence: Synthetic oligonucleotide
ggcccgtgaggcggagcagct

SEQ ID NO: 23617 - DNA, 22 bp, Artificial Sequence
  Description of Artificial Sequence: Synthetic oligonucleotide
gcccgtgaggcggagcagctga

SEQ ID NO: 23618 - DNA, 23 bp, Artificial Sequence
  Description of Artificial Sequence: Synthetic oligonucleotide
cccgtgaggcggagcagctgaga

SEQ ID NO: 23619 - DNA, 23 bp, Artificial Sequence
  Description of Artificial Sequence: Synthetic oligonucleotide
ccgtgaggcggagcagctgagag

SEQ ID NO: 23620 - DNA, 23 bp, Artificial Sequence
  Description of Artificial Sequence: Synthetic oligonucleotide
cgtgaggcggagcagctgagagc

SEQ ID NO: 23621 - DNA, 25 bp, Artificial Sequence
  Description of Artificial Sequence: Synthetic oligonucleotide
gtgaggcggagcagctgagagccta

SEQ ID NO: 23622 - DNA, 30 bp, Artificial Sequence
  Description of Artificial Sequence: Synthetic oligonucleotide
ggagtattgggaccggaacacacagatctc

SEQ ID NO: 23623 - DNA, 30 bp, Artificial Sequence
  Description of Artificial Sequence: Synthetic oligonucleotide
gagtattgggaccggaacacacagatctcc

SEQ ID NO: 23624 - DNA, 32 bp, Artificial Sequence
  Description of Artificial Sequence: Synthetic oligonucleotide
agtattgggaccggaacacacagatctccaag

SEQ ID NO: 23625 - DNA, 31 bp, Artificial Sequence
  Description of Artificial Sequence: Synthetic oligonucleotide
gtattgggaccggaacacacagatctccaag

SEQ ID NO: 23626 - DNA, 32 bp, Artificial Sequence
  Description of Artificial Sequence: Synthetic oligonucleotide
tattgggaccggaacacacagatctccaagac

SEQ ID NO: 23627 - DNA, 31 bp, Artificial Sequence
  Description of Artificial Sequence: Synthetic oligonucleotide
attgggaccggaacacacagatctccaagac

SEQ ID NO: 23628 - DNA, 30 bp, Artificial Sequence
  Description of Artificial Sequence: Synthetic oligonucleotide
ttgggaccggaacacacagatctccaagac

SEQ ID NO: 23629 - DNA, 29 bp, Artificial Sequence
  Description of Artificial Sequence: Synthetic oligonucleotide
tgggaccggaacacacagatctccaagac

SEQ ID NO: 23630 - DNA, 28 bp, Artificial Sequence
  Description of Artificial Sequence: Synthetic oligonucleotide
gggaccggaacacacagatctccaagac

SEQ ID NO: 23631 - DNA, 28 bp, Artificial Sequence
  Description of Artificial Sequence: Synthetic oligonucleotide
ggaccggaacacacagatctccaagacc

SEQ ID NO: 23632 - DNA, 30 bp, Artificial Sequence
  Description of Artificial Sequence: Synthetic oligonucleotide
gaccggaacacacagatctccaagaccaac

SEQ ID NO: 23633 - DNA, 31 bp, Artificial Sequence
  Description of Artificial Sequence: Synthetic oligonucleotide
accggaacacacagatctccaagaccaacac

SEQ ID NO: 23634 - DNA, 30 bp, Artificial Sequence
  Description of Artificial Sequence: Synthetic oligonucleotide
ccggaacacacagatctccaagaccaacac

SEQ ID NO: 23635 - DNA, 31 bp, Artificial Sequence
  Description of Artificial Sequence: Synthetic oligonucleotide
cggaacacacagatctccaagaccaacacac

SEQ ID NO: 23636 - DNA, 32 bp, Artificial Sequence
  Description of Artificial Sequence: Synthetic oligonucleotide
ggaacacacagatctccaagaccaacacacag

SEQ ID NO: 23637 - DNA, 33 bp, Artificial Sequence
  Description of Artificial Sequence: Synthetic oligonucleotide
gaacacacagatctccaagaccaacacacagac

SEQ ID NO: 23638 - DNA, 36 bp, Artificial Sequence
  Description of Artificial Sequence: Synthetic oligonucleotide
aacacacagatctccaagaccaacacacagacttac

SEQ ID NO: 23639 - DNA, 35 bp, Artificial Sequence
  Description of Artificial Sequence: Synthetic oligonucleotide
acacacagatctccaagaccaacacacagacttac

SEQ ID NO: 23640 - DNA, 34 bp, Artificial Sequence
  Description of Artificial Sequence: Synthetic oligonucleotide
cacacagatctccaagaccaacacacagacttac

SEQ ID NO: 23641 - DNA, 34 bp, Artificial Sequence
  Description of Artificial Sequence: Synthetic oligonucleotide
acacagatctccaagaccaacacacagacttacc

SEQ ID NO: 23642 - DNA, 33 bp, Artificial Sequence
  Description of Artificial Sequence: Synthetic oligonucleotide
cacagatctccaagaccaacacacagacttacc

SEQ ID NO: 23643 - DNA, 33 bp, Artificial Sequence
  Description of Artificial Sequence: Synthetic oligonucleotide
acagatctccaagaccaacacacagacttaccg

SEQ ID NO: 23644 - DNA, 32 bp, Artificial Sequence
  Description of Artificial Sequence: Synthetic oligonucleotide
cagatctccaagaccaacacacagacttaccg

SEQ ID NO: 23645 - DNA, 33 bp, Artificial Sequence
  Description of Artificial Sequence: Synthetic oligonucleotide
agatctccaagaccaacacacagacttaccgag

SEQ ID NO: 23646 - DNA, 32 bp, Artificial Sequence
  Description of Artificial Sequence: Synthetic oligonucleotide
gatctccaagaccaacacacagacttaccgag

SEQ ID NO: 23647 - DNA, 33 bp, Artificial Sequence
  Description of Artificial Sequence: Synthetic oligonucleotide
atctccaagaccaacacacagacttaccgagag

SEQ ID NO: 23648 - DNA, 32 bp, Artificial Sequence
  Description of Artificial Sequence: Synthetic oligonucleotide
tctccaagaccaacacacagacttaccgagag

SEQ ID NO: 23649 - DNA, 31 bp, Artificial Sequence
  Description of Artificial Sequence: Synthetic oligonucleotide
ctccaagaccaacacacagacttaccgagag

SEQ ID NO: 23650 - DNA, 31 bp, Artificial Sequence
  Description of Artificial Sequence: Synthetic oligonucleotide
tccaagaccaacacacagacttaccgagagg

SEQ ID NO: 23651 - DNA, 30 bp, Artificial Sequence
  Description of Artificial Sequence: Synthetic oligonucleotide
ccaagaccaacacacagacttaccgagagg

SEQ ID NO: 23652 - DNA, 31 bp, Artificial Sequence
  Description of Artificial Sequence: Synthetic oligonucleotide
caagaccaacacacagacttaccgagaggac

SEQ ID NO: 23653 - DNA, 31 bp, Artificial Sequence
  Description of Artificial Sequence: Synthetic oligonucleotide
aagaccaacacacagacttaccgagaggacc

SEQ ID NO: 23654 - DNA, 30 bp, Artificial Sequence
  Description of Artificial Sequence: Synthetic oligonucleotide
agaccaacacacagacttaccgagaggacc

SEQ ID NO: 23655 - DNA, 29 bp, Artificial Sequence
  Description of Artificial Sequence: Synthetic oligonucleotide
gaccaacacacagacttaccgagaggacc

SEQ ID NO: 23656 - DNA, 30 bp, Artificial Sequence
  Description of Artificial Sequence: Synthetic oligonucleotide
accaacacacagacttaccgagaggacctg

SEQ ID NO: 23657 - DNA, 29 bp, Artificial Sequence
  Description of Artificial Sequence: Synthetic oligonucleotide
ccaacacacagacttaccgagaggacctg

SEQ ID NO: 23658 - DNA, 29 bp, Artificial Sequence
  Description of Artificial Sequence: Synthetic oligonucleotide
caacacacagacttaccgagaggacctgc

SEQ ID NO: 23659 - DNA, 29 bp, Artificial Sequence
  Description of Artificial Sequence: Synthetic oligonucleotide
aacacacagacttaccgagaggacctgcg

SEQ ID NO: 23660 - DNA, 28 bp, Artificial Sequence
  Description of Artificial Sequence: Synthetic oligonucleotide
acacacagacttaccgagaggacctgcg

SEQ ID NO: 23661 - DNA, 27 bp, Artificial Sequence
  Description of Artificial Sequence: Synthetic oligonucleotide
cacacagacttaccgagaggacctgcg

SEQ ID NO: 23662 - DNA, 27 bp, Artificial Sequence
  Description of Artificial Sequence: Synthetic oligonucleotide
acacagacttaccgagaggacctgcgg

SEQ ID NO: 23663 - DNA, 27 bp, Artificial Sequence
  Description of Artificial Sequence: Synthetic oligonucleotide
cacagacttaccgagaggacctgcgga

SEQ ID NO: 23664 - DNA, 27 bp, Artificial Sequence
  Description of Artificial Sequence: Synthetic oligonucleotide
acagacttaccgagaggacctgcggac

SEQ ID NO: 23665 - DNA, 26 bp, Artificial Sequence
  Description of Artificial Sequence: Synthetic oligonucleotide
cagacttaccgagaggacctgcggac

SEQ ID NO: 23666 - DNA, 26 bp, Artificial Sequence
  Description of Artificial Sequence: Synthetic oligonucleotide
agacttaccgagaggacctgcggacc

SEQ ID NO: 23667 - DNA, 25 bp, Artificial Sequence
  Description of Artificial Sequence: Synthetic oligonucleotide
gacttaccgagaggacctgcggacc

SEQ ID NO: 23668 - DNA, 26 bp, Artificial Sequence
  Description of Artificial Sequence: Synthetic oligonucleotide
acttaccgagaggacctgcggaccct

SEQ ID NO: 23669 - DNA, 25 bp, Artificial Sequence
  Description of Artificial Sequence: Synthetic oligonucleotide
cttaccgagaggacctgcggaccct

SEQ ID NO: 23670 - DNA, 25 bp, Artificial Sequence
  Description of Artificial Sequence: Synthetic oligonucleotide
ttaccgagaggacctgcggaccctg

SEQ ID NO: 23671 - DNA, 24 bp, Artificial Sequence
  Description of Artificial Sequence: Synthetic oligonucleotide
taccgagaggacctgcggaccctg

SEQ ID NO: 23672 - DNA, 23 bp, Artificial Sequence
  Description of Artificial Sequence: Synthetic oligonucleotide
accgagaggacctgcggaccctg

SEQ ID NO: 23673 - DNA, 22 bp, Artificial Sequence
  Description of Artificial Sequence: Synthetic oligonucleotide
ccgagaggacctgcggaccctg

SEQ ID NO: 23674 - DNA, 23 bp, Artificial Sequence
  Description of Artificial Sequence: Synthetic oligonucleotide
cgagaggacctgcggaccctgct

SEQ ID NO: 23675 - DNA, 23 bp, Artificial Sequence
  Description of Artificial Sequence: Synthetic oligonucleotide
gagaggacctgcggaccctgctc

SEQ ID NO: 23676 - DNA, 23 bp, Artificial Sequence
  Description of Artificial Sequence: Synthetic oligonucleotide
agaggacctgcggaccctgctcc

SEQ ID NO: 23677 - DNA, 22 bp, Artificial Sequence
  Description of Artificial Sequence: Synthetic oligonucleotide
gaggacctgcggaccctgctcc

SEQ ID NO: 23678 - DNA, 22 bp, Artificial Sequence
  Description of Artificial Sequence: Synthetic oligonucleotide
aggacctgcggaccctgctccg

SEQ ID NO: 23679 - DNA, 21 bp, Artificial Sequence
  Description of Artificial Sequence: Synthetic oligonucleotide
ggacctgcggaccctgctccg

SEQ ID NO: 23680 - DNA, 23 bp, Artificial Sequence
  Description of Artificial Sequence: Synthetic oligonucleotide
gacctgcggaccctgctccgcta

SEQ ID NO: 23681 - DNA, 25 bp, Artificial Sequence
  Description of Artificial Sequence: Synthetic oligonucleotide
acctgcggaccctgctccgctacta

SEQ ID NO: 23682 - DNA, 24 bp, Artificial Sequence
  Description of Artificial Sequence: Synthetic oligonucleotide
cctgcggaccctgctccgctacta

SEQ ID NO: 23683 - DNA, 26 bp, Artificial Sequence
  Description of Artificial Sequence: Synthetic oligonucleotide
ctgcggaccctgctccgctactacaa

SEQ ID NO: 23684 - DNA, 26 bp, Artificial Sequence
  Description of Artificial Sequence: Synthetic oligonucleotide
tgcggaccctgctccgctactacaac

SEQ ID NO: 23685 - DNA, 25 bp, Artificial Sequence
  Description of Artificial Sequence: Synthetic oligonucleotide
gcggaccctgctccgctactacaac

SEQ ID NO: 23686 - DNA, 26 bp, Artificial Sequence
  Description of Artificial Sequence: Synthetic oligonucleotide
cggaccctgctccgctactacaacca

SEQ ID NO: 23687 - DNA, 27 bp, Artificial Sequence
  Description of Artificial Sequence: Synthetic oligonucleotide
ggaccctgctccgctactacaaccaga

SEQ ID NO: 23688 - DNA, 27 bp, Artificial Sequence
  Description of Artificial Sequence: Synthetic oligonucleotide
gaccctgctccgctactacaaccagag

SEQ ID NO: 23689 - DNA, 27 bp, Artificial Sequence
  Description of Artificial Sequence: Synthetic oligonucleotide
accctgctccgctactacaaccagagc

SEQ ID NO: 23690 - DNA, 26 bp, Artificial Sequence
  Description of Artificial Sequence: Synthetic oligonucleotide
ccctgctccgctactacaaccagagc

SEQ ID NO: 23691 - DNA, 27 bp, Artificial Sequence
  Description of Artificial Sequence: Synthetic oligonucleotide
cctgctccgctactacaaccagagcga

SEQ ID NO: 23692 - DNA, 27 bp, Artificial Sequence
  Description of Artificial Sequence: Synthetic oligonucleotide
ctgctccgctactacaaccagagcgag

SEQ ID NO: 23693 - DNA, 27 bp, Artificial Sequence
  Description of Artificial Sequence: Synthetic oligonucleotide
tgctccgctactacaaccagagcgagg

SEQ ID NO: 23694 - DNA, 23 bp, Artificial Sequence
  Description of Artificial Sequence: Synthetic oligonucleotide
gcctcctccgcgggtatgaccag

SEQ ID NO: 23695 - DNA, 24 bp, Artificial Sequence
  Description of Artificial Sequence: Synthetic oligonucleotide
cctcctccgcgggtatgaccagga

SEQ ID NO: 23696 - DNA, 24 bp, Artificial Sequence
  Description of Artificial Sequence: Synthetic oligonucleotide
ctcctccgcgggtatgaccaggac

SEQ ID NO: 23697 - DNA, 29 bp, Artificial Sequence
  Description of Artificial Sequence: Synthetic oligonucleotide
gctcccactccatgaggtatttcgacacc

SEQ ID NO: 23698 - DNA, 29 bp, Artificial Sequence
  Description of Artificial Sequence: Synthetic oligonucleotide
ctcccactccatgaggtatttcgacaccg

SEQ ID NO: 23699 - DNA, 29 bp, Artificial Sequence
  Description of Artificial Sequence: Synthetic oligonucleotide
tcccactccatgaggtatttcgacaccgc

SEQ ID NO: 23700 - DNA, 28 bp, Artificial Sequence
  Description of Artificial Sequence: Synthetic oligonucleotide
cccactccatgaggtatttcgacaccgc

SEQ ID NO: 23701 - DNA, 28 bp, Artificial Sequence
  Description of Artificial Sequence: Synthetic oligonucleotide
ccactccatgaggtatttcgacaccgcc

SEQ ID NO: 23702 - DNA, 30 bp, Artificial Sequence
  Description of Artificial Sequence: Synthetic oligonucleotide
cactccatgaggtatttcgacaccgccatg

SEQ ID NO: 23703 - DNA, 31 bp, Artificial Sequence
  Description of Artificial Sequence: Synthetic oligonucleotide
actccatgaggtatttcgacaccgccatgtc

SEQ ID NO: 23704 - DNA, 30 bp, Artificial Sequence
  Description of Artificial Sequence: Synthetic oligonucleotide
ctccatgaggtatttcgacaccgccatgtc

SEQ ID NO: 23705 - DNA, 30 bp, Artificial Sequence
  Description of Artificial Sequence: Synthetic oligonucleotide
tccatgaggtatttcgacaccgccatgtcc

SEQ ID NO: 23706 - DNA, 29 bp, Artificial Sequence
  Description of Artificial Sequence: Synthetic oligonucleotide
ccatgaggtatttcgacaccgccatgtcc

SEQ ID NO: 23707 - DNA, 29 bp, Artificial Sequence
  Description of Artificial Sequence: Synthetic oligonucleotide
catgaggtatttcgacaccgccatgtccc

SEQ ID NO: 23708 - DNA, 29 bp, Artificial Sequence
  Description of Artificial Sequence: Synthetic oligonucleotide
atgaggtatttcgacaccgccatgtcccg

SEQ ID NO: 23709 - DNA, 28 bp, Artificial Sequence
  Description of Artificial Sequence: Synthetic oligonucleotide
tgaggtatttcgacaccgccatgtcccg

SEQ ID NO: 23710 - DNA, 27 bp, Artificial Sequence
  Description of Artificial Sequence: Synthetic oligonucleotide
gaggtatttcgacaccgccatgtcccg

SEQ ID NO: 23711 - DNA, 27 bp, Artificial Sequence
  Description of Artificial Sequence: Synthetic oligonucleotide
aggtatttcgacaccgccatgtcccgg

SEQ ID NO: 23712 - DNA, 26 bp, Artificial Sequence
  Description of Artificial Sequence: Synthetic oligonucleotide
ggtatttcgacaccgccatgtcccgg

SEQ ID NO: 23713 - DNA, 26 bp, Artificial Sequence
  Description of Artificial Sequence: Synthetic oligonucleotide
gtatttcgacaccgccatgtcccggc

SEQ ID NO: 23714 - DNA, 26 bp, Artificial Sequence
  Description of Artificial Sequence: Synthetic oligonucleotide
tatttcgacaccgccatgtcccggcc

SEQ ID NO: 23715 - DNA, 25 bp, Artificial Sequence
  Description of Artificial Sequence: Synthetic oligonucleotide
atttcgacaccgccatgtcccggcc

SEQ ID NO: 23716 - DNA, 24 bp, Artificial Sequence
  Description of Artificial Sequence: Synthetic oligonucleotide
tttcgacaccgccatgtcccggcc

SEQ ID NO: 23717 - DNA, 23 bp, Artificial Sequence
  Description of Artificial Sequence: Synthetic oligonucleotide
ttcgacaccgccatgtcccggcc

SEQ ID NO: 23718 - DNA, 22 bp, Artificial Sequence
  Description of Artificial Sequence: Synthetic oligonucleotide
tcgacaccgccatgtcccggcc

SEQ ID NO: 23719 - DNA, 21 bp, Artificial Sequence
  Description of Artificial Sequence: Synthetic oligonucleotide
cgacaccgccatgtcccggcc

SEQ ID NO: 23720 - DNA, 21 bp, Artificial Sequence
  Description of Artificial Sequence: Synthetic oligonucleotide
gacaccgccatgtcccggccc

SEQ ID NO: 23721 - DNA, 21 bp, Artificial Sequence
  Description of Artificial Sequence: Synthetic oligonucleotide
acaccgccatgtcccggcccg

SEQ ID NO: 23722 - DNA, 20 bp, Artificial Sequence
  Description of Artificial Sequence: Synthetic oligonucleotide
caccgccatgtcccggcccg

SEQ ID NO: 23723 - DNA, 20 bp, Artificial Sequence
  Description of Artificial Sequence: Synthetic oligonucleotide
accgccatgtcccggcccgg

SEQ ID NO: 23724 - DNA, 20 bp, Artificial Sequence
  Description of Artificial Sequence: Synthetic oligonucleotide
ccgccatgtcccggcccggt

SEQ ID NO: 23725 - DNA, 20 bp, Artificial Sequence
  Description of Artificial Sequence: Synthetic oligonucleotide
cgccatgtcccggcccggct

SEQ ID NO: 23726 - DNA, 20 bp, Artificial Sequence
  Description of Artificial Sequence: Synthetic oligonucleotide
gccatgtcccggcccggcct

SEQ ID NO: 23727 - DNA, 22 bp, Artificial Sequence
  Description of Artificial Sequence: Synthetic oligonucleotide
cgagtccgagagaggagccgcc

SEQ ID NO: 23728 - DNA, 22 bp, Artificial Sequence
  Description of Artificial Sequence: Synthetic oligonucleotide
gagtccgagagaggagccgccg

SEQ ID NO: 23729 - DNA, 22 bp, Artificial Sequence
  Description of Artificial Sequence: Synthetic oligonucleotide
agtccgagagaggagccgccgg

SEQ ID NO: 23730 - DNA, 21 bp, Artificial Sequence
  Description of Artificial Sequence: Synthetic oligonucleotide
gtccgagagaggagccgccgg

SEQ ID NO: 23731 - DNA, 21 bp, Artificial Sequence
  Description of Artificial Sequence: Synthetic oligonucleotide
tccgagagaggagccgccggc

SEQ ID NO: 23732 - DNA, 20 bp, Artificial Sequence
  Description of Artificial Sequence: Synthetic oligonucleotide
ccgagagaggagccgccggc

SEQ ID NO: 23733 - DNA, 20 bp, Artificial Sequence
  Description of Artificial Sequence: Synthetic oligonucleotide
cgagagaggagccgccggcg

SEQ ID NO: 23734 - DNA, 20 bp, Artificial Sequence
  Description of Artificial Sequence: Synthetic oligonucleotide
gagagaggagccgccggcgc

SEQ ID NO: 23735 - DNA, 20 bp, Artificial Sequence
  Description of Artificial Sequence: Synthetic oligonucleotide
agagaggagccgccggcgcc

SEQ ID NO: 23736 - DNA, 20 bp, Artificial Sequence
  Description of Artificial Sequence: Synthetic oligonucleotide
gagaggagccgccggcgcct

SEQ ID NO: 23737 - DNA, 20 bp, Artificial Sequence
  Description of Artificial Sequence: Synthetic oligonucleotide
agaggagccgccggcgccgt

SEQ ID NO: 23738 - DNA, 20 bp, Artificial Sequence
  Description of Artificial Sequence: Synthetic oligonucleotide
gaggagccgccggcgccgtt

SEQ ID NO: 23739 - DNA, 20 bp, Artificial Sequence
  Description of Artificial Sequence: Synthetic oligonucleotide
aggagccgccggcgccgtgt

SEQ ID NO: 23740 - DNA, 23 bp, Artificial Sequence
  Description of Artificial Sequence: Synthetic oligonucleotide
cgcgcggaccccccaaagacaca

SEQ ID NO: 23741 - DNA, 23 bp, Artificial Sequence
  Description of Artificial Sequence: Synthetic oligonucleotide
gcgcggaccccccaaagacacac

SEQ ID NO: 23742 - DNA, 24 bp, Artificial Sequence
  Description of Artificial Sequence: Synthetic oligonucleotide
cgcggaccccccaaagacacacgt

SEQ ID NO: 23743 - DNA, 25 bp, Artificial Sequence
  Description of Artificial Sequence: Synthetic oligonucleotide
gcggaccccccaaagacacacgtga

SEQ ID NO: 23744 - DNA, 25 bp, Artificial Sequence
  Description of Artificial Sequence: Synthetic oligonucleotide
cggaccccccaaagacacacgtgac

SEQ ID NO: 23745 - DNA, 25 bp, Artificial Sequence
  Description of Artificial Sequence: Synthetic oligonucleotide
ggaccccccaaagacacacgtgacc

SEQ ID NO: 23746 - DNA, 27 bp, Artificial Sequence
  Description of Artificial Sequence: Synthetic oligonucleotide
agaacgggaaggacaagctggagcgct

SEQ ID NO: 23747 - DNA, 26 bp, Artificial Sequence
  Description of Artificial Sequence: Synthetic oligonucleotide
gaacgggaaggacaagctggagcgct

SEQ ID NO: 23748 - DNA, 27 bp, Artificial Sequence
  Description of Artificial Sequence: Synthetic oligonucleotide
aacgggaaggacaagctggagcgctct

SEQ ID NO: 23749 - DNA, 26 bp, Artificial Sequence
  Description of Artificial Sequence: Synthetic oligonucleotide
acgggaaggacaagctggagcgctct

SEQ ID NO: 23750 - DNA, 25 bp, Artificial Sequence
  Description of Artificial Sequence: Synthetic oligonucleotide
cgggaaggacaagctggagcgctct

SEQ ID NO: 23751 - DNA, 25 bp, Artificial Sequence
  Description of Artificial Sequence: Synthetic oligonucleotide
gggaaggacaagctggagcgctctg

SEQ ID NO: 23752 - DNA, 30 bp, Artificial Sequence
  Description of Artificial Sequence: Synthetic oligonucleotide
gaccggaacacacagatctacaaggccaac

SEQ ID NO: 23753 - DNA, 31 bp, Artificial Sequence
  Description of Artificial Sequence: Synthetic oligonucleotide
accggaacacacagatctacaaggccaacac

SEQ ID NO: 23754 - DNA, 30 bp, Artificial Sequence
  Description of Artificial Sequence: Synthetic oligonucleotide
ccggaacacacagatctacaaggccaacac

SEQ ID NO: 23755 - DNA, 31 bp, Artificial Sequence
  Description of Artificial Sequence: Synthetic oligonucleotide
cggaacacacagatctacaaggccaacacac

SEQ ID NO: 23756 - DNA, 32 bp, Artificial Sequence
  Description of Artificial Sequence: Synthetic oligonucleotide
ggaacacacagatctacaaggccaacacacag

SEQ ID NO: 23757 - DNA, 33 bp, Artificial Sequence
  Description of Artificial Sequence: Synthetic oligonucleotide
gaacacacagatctacaaggccaacacacagac

SEQ ID NO: 23758 - DNA, 36 bp, Artificial Sequence
  Description of Artificial Sequence: Synthetic oligonucleotide
aacacacagatctacaaggccaacacacagacttac

SEQ ID NO: 23759 - DNA, 35 bp, Artificial Sequence
  Description of Artificial Sequence: Synthetic oligonucleotide
acacacagatctacaaggccaacacacagacttac

SEQ ID NO: 23760 - DNA, 34 bp, Artificial Sequence
  Description of Artificial Sequence: Synthetic oligonucleotide
cacacagatctacaaggccaacacacagacttac

SEQ ID NO: 23761 - DNA, 34 bp, Artificial Sequence
  Description of Artificial Sequence: Synthetic oligonucleotide
acacagatctacaaggccaacacacagacttacc

SEQ ID NO: 23762 - DNA, 33 bp, Artificial Sequence
  Description of Artificial Sequence: Synthetic oligonucleotide
cacagatctacaaggccaacacacagacttacc

SEQ ID NO: 23763 - DNA, 33 bp, Artificial Sequence
  Description of Artificial Sequence: Synthetic oligonucleotide
acagatctacaaggccaacacacagacttaccg

SEQ ID NO: 23764 - DNA, 32 bp, Artificial Sequence
  Description of Artificial Sequence: Synthetic oligonucleotide
cagatctacaaggccaacacacagacttaccg

SEQ ID NO: 23765 - DNA, 33 bp, Artificial Sequence
  Description of Artificial Sequence: Synthetic oligonucleotide
agatctacaaggccaacacacagacttaccgag

SEQ ID NO: 23766 - DNA, 32 bp, Artificial Sequence
  Description of Artificial Sequence: Synthetic oligonucleotide
gatctacaaggccaacacacagacttaccgag

SEQ ID NO: 23767 - DNA, 33 bp, Artificial Sequence
  Description of Artificial Sequence: Synthetic oligonucleotide
atctacaaggccaacacacagacttaccgagag

SEQ ID NO: 23768 - DNA, 32 bp, Artificial Sequence
  Description of Artificial Sequence: Synthetic oligonucleotide
tctacaaggccaacacacagacttaccgagag

SEQ ID NO: 23769 - DNA, 31 bp, Artificial Sequence
  Description of Artificial Sequence: Synthetic oligonucleotide
ctacaaggccaacacacagacttaccgagag

SEQ ID NO: 23770 - DNA, 32 bp, Artificial Sequence
  Description of Artificial Sequence: Synthetic oligonucleotide
tacaaggccaacacacagacttaccgagagag

SEQ ID NO: 23771 - DNA, 31 bp, Artificial Sequence
  Description of Artificial Sequence: Synthetic oligonucleotide
acaaggccaacacacagacttaccgagagag

SEQ ID NO: 23772 - DNA, 30 bp, Artificial Sequence
  Description of Artificial Sequence: Synthetic oligonucleotide
caaggccaacacacagacttaccgagagag

SEQ ID NO: 23773 - DNA, 30 bp, Artificial Sequence
  Description of Artificial Sequence: Synthetic oligonucleotide
aaggccaacacacagacttaccgagagagc

SEQ ID NO: 23774 - DNA, 29 bp, Artificial Sequence
  Description of Artificial Sequence: Synthetic oligonucleotide
aggccaacacacagacttaccgagagagc

SEQ ID NO: 23775 - DNA, 28 bp, Artificial Sequence
  Description of Artificial Sequence: Synthetic oligonucleotide
ggccaacacacagacttaccgagagagc

SEQ ID NO: 23776 - DNA, 28 bp, Artificial Sequence
  Description of Artificial Sequence: Synthetic oligonucleotide
gccaacacacagacttaccgagagagcc

SEQ ID NO: 23777 - DNA, 37 bp, Artificial Sequence
  Description of Artificial Sequence: Synthetic oligonucleotide
gaacacacagatcttcaagaccaacacacagacttac

SEQ ID NO: 23778 - DNA, 37 bp, Artificial Sequence
  Description of Artificial Sequence: Synthetic oligonucleotide
aacacacagatcttcaagaccaacacacagacttacc

SEQ ID NO: 23779 - DNA, 36 bp, Artificial Sequence
  Description of Artificial Sequence: Synthetic oligonucleotide
acacacagatcttcaagaccaacacacagacttacc

SEQ ID NO: 23780 - DNA, 35 bp, Artificial Sequence
  Description of Artificial Sequence: Synthetic oligonucleotide
cacacagatcttcaagaccaacacacagacttacc

SEQ ID NO: 23781 - DNA, 35 bp, Artificial Sequence
  Description of Artificial Sequence: Synthetic oligonucleotide
acacagatcttcaagaccaacacacagacttaccg

SEQ ID NO: 23782 - DNA, 34 bp, Artificial Sequence
  Description of Artificial Sequence: Synthetic oligonucleotide
cacagatcttcaagaccaacacacagacttaccg

SEQ ID NO: 23783 - DNA, 35 bp, Artificial Sequence
  Description of Artificial Sequence: Synthetic oligonucleotide
acagatcttcaagaccaacacacagacttaccgag

SEQ ID NO: 23784 - DNA, 34 bp, Artificial Sequence
  Description of Artificial Sequence: Synthetic oligonucleotide
cagatcttcaagaccaacacacagacttaccgag

SEQ ID NO: 23785 - DNA, 35 bp, Artificial Sequence
  Description of Artificial Sequence: Synthetic oligonucleotide
agatcttcaagaccaacacacagacttaccgagag

SEQ ID NO: 23786 - DNA, 34 bp, Artificial Sequence
  Description of Artificial Sequence: Synthetic oligonucleotide
gatcttcaagaccaacacacagacttaccgagag

SEQ ID NO: 23787 - DNA, 36 bp, Artificial Sequence
  Description of Artificial Sequence: Synthetic oligonucleotide
atcttcaagaccaacacacagacttaccgagagaac

SEQ ID NO: 23788 - DNA, 35 bp, Artificial Sequence
  Description of Artificial Sequence: Synthetic oligonucleotide
tcttcaagaccaacacacagacttaccgagagaac

SEQ ID NO: 23789 - DNA, 34 bp, Artificial Sequence
  Description of Artificial Sequence: Synthetic oligonucleotide
cttcaagaccaacacacagacttaccgagagaac

SEQ ID NO: 23790 - DNA, 34 bp, Artificial Sequence
  Description of Artificial Sequence: Synthetic oligonucleotide
ttcaagaccaacacacagacttaccgagagaacc

SEQ ID NO: 23791 - DNA, 33 bp, Artificial Sequence
  Description of Artificial Sequence: Synthetic oligonucleotide
tcaagaccaacacacagacttaccgagagaacc

SEQ ID NO: 23792 - DNA, 32 bp, Artificial Sequence
  Description of Artificial Sequence: Synthetic oligonucleotide
caagaccaacacacagacttaccgagagaacc

SEQ ID NO: 23793 - DNA, 33 bp, Artificial Sequence
  Description of Artificial Sequence: Synthetic oligonucleotide
aagaccaacacacagacttaccgagagaacctg

SEQ ID NO: 23794 - DNA, 32 bp, Artificial Sequence
  Description of Artificial Sequence: Synthetic oligonucleotide
agaccaacacacagacttaccgagagaacctg

SEQ ID NO: 23795 - DNA, 31 bp, Artificial Sequence
  Description of Artificial Sequence: Synthetic oligonucleotide
gaccaacacacagacttaccgagagaacctg

SEQ ID NO: 23796 - DNA, 31 bp, Artificial Sequence
  Description of Artificial Sequence: Synthetic oligonucleotide
accaacacacagacttaccgagagaacctgc

SEQ ID NO: 23797 - DNA, 30 bp, Artificial Sequence
  Description of Artificial Sequence: Synthetic oligonucleotide
ccaacacacagacttaccgagagaacctgc

SEQ ID NO: 23798 - DNA, 30 bp, Artificial Sequence
  Description of Artificial Sequence: Synthetic oligonucleotide
caacacacagacttaccgagagaacctgcg

SEQ ID NO: 23799 - DNA, 30 bp, Artificial Sequence
  Description of Artificial Sequence: Synthetic oligonucleotide
aacacacagacttaccgagagaacctgcgg

SEQ ID NO: 23800 - DNA, 29 bp, Artificial Sequence
  Description of Artificial Sequence: Synthetic oligonucleotide
acacacagacttaccgagagaacctgcgg

SEQ ID NO: 23801 - DNA, 28 bp, Artificial Sequence
  Description of Artificial Sequence: Synthetic oligonucleotide
cacacagacttaccgagagaacctgcgg

SEQ ID NO: 23802 - DNA, 30 bp, Artificial Sequence
  Description of Artificial Sequence: Synthetic oligonucleotide
acacagacttaccgagagaacctgcggatc

SEQ ID NO: 23803 - DNA, 29 bp, Artificial Sequence
  Description of Artificial Sequence: Synthetic oligonucleotide
cacagacttaccgagagaacctgcggatc

SEQ ID NO: 23804 - DNA, 29 bp, Artificial Sequence
  Description of Artificial Sequence: Synthetic oligonucleotide
acagacttaccgagagaacctgcggatcg

SEQ ID NO: 23805 - DNA, 28 bp, Artificial Sequence
  Description of Artificial Sequence: Synthetic oligonucleotide
cagacttaccgagagaacctgcggatcg

SEQ ID NO: 23806 - DNA, 28 bp, Artificial Sequence
  Description of Artificial Sequence: Synthetic oligonucleotide
agacttaccgagagaacctgcggatcgc

SEQ ID NO: 23807 - DNA, 27 bp, Artificial Sequence
  Description of Artificial Sequence: Synthetic oligonucleotide
gacttaccgagagaacctgcggatcgc

SEQ ID NO: 23808 - DNA, 27 bp, Artificial Sequence
  Description of Artificial Sequence: Synthetic oligonucleotide
acttaccgagagaacctgcggatcgcg

SEQ ID NO: 23809 - DNA, 26 bp, Artificial Sequence
  Description of Artificial Sequence: Synthetic oligonucleotide
cttaccgagagaacctgcggatcgcg

SEQ ID NO: 23810 - DNA, 27 bp, Artificial Sequence
  Description of Artificial Sequence: Synthetic oligonucleotide
ttaccgagagaacctgcggatcgcgct

SEQ ID NO: 23811 - DNA, 26 bp, Artificial Sequence
  Description of Artificial Sequence: Synthetic oligonucleotide
taccgagagaacctgcggatcgcgct

SEQ ID NO: 23812 - DNA, 27 bp, Artificial Sequence
  Description of Artificial Sequence: Synthetic oligonucleotide
ccagttcgtgaggttcgacagcgacgt

SEQ ID NO: 23813 - DNA, 27 bp, Artificial Sequence
  Description of Artificial Sequence: Synthetic oligonucleotide
cagttcgtgaggttcgacagcgacgtc

SEQ ID NO: 23814 - DNA, 27 bp, Artificial Sequence
  Description of Artificial Sequence: Synthetic oligonucleotide
agttcgtgaggttcgacagcgacgtcg

SEQ ID NO: 23815 - DNA, 26 bp, Artificial Sequence
  Description of Artificial Sequence: Synthetic oligonucleotide
gttcgtgaggttcgacagcgacgtcg

SEQ ID NO: 23816 - DNA, 26 bp, Artificial Sequence
  Description of Artificial Sequence: Synthetic oligonucleotide
ttcgtgaggttcgacagcgacgtcgc

SEQ ID NO: 23817 - DNA, 25 bp, Artificial Sequence
  Description of Artificial Sequence: Synthetic oligonucleotide
tcgtgaggttcgacagcgacgtcgc

SEQ ID NO: 23818 - DNA, 24 bp, Artificial Sequence
  Description of Artificial Sequence: Synthetic oligonucleotide
cgtgaggttcgacagcgacgtcgc

SEQ ID NO: 23819 - DNA, 25 bp, Artificial Sequence
  Description of Artificial Sequence: Synthetic oligonucleotide
gtgaggttcgacagcgacgtcgcga

SEQ ID NO: 23820 - DNA, 26 bp, Artificial Sequence
  Description of Artificial Sequence: Synthetic oligonucleotide
tgaggttcgacagcgacgtcgcgagt

SEQ ID NO: 23821 - DNA, 25 bp, Artificial Sequence
  Description of Artificial Sequence: Synthetic oligonucleotide
gaggttcgacagcgacgtcgcgagt

SEQ ID NO: 23822 - DNA, 25 bp, Artificial Sequence
  Description of Artificial Sequence: Synthetic oligonucleotide
aggttcgacagcgacgtcgcgagtc

SEQ ID NO: 23823 - DNA, 24 bp, Artificial Sequence
  Description of Artificial Sequence: Synthetic oligonucleotide
ggttcgacagcgacgtcgcgagtc

SEQ ID NO: 23824 - DNA, 24 bp, Artificial Sequence
  Description of Artificial Sequence: Synthetic oligonucleotide
gttcgacagcgacgtcgcgagtcc

SEQ ID NO: 23825 - DNA, 25 bp, Artificial Sequence
  Description of Artificial Sequence: Synthetic oligonucleotide
ttcgacagcgacgtcgcgagtccga

SEQ ID NO: 23826 - DNA, 24 bp, Artificial Sequence
  Description of Artificial Sequence: Synthetic oligonucleotide
tcgacagcgacgtcgcgagtccga

SEQ ID NO: 23827 - DNA, 23 bp, Artificial Sequence
  Description of Artificial Sequence: Synthetic oligonucleotide
cgacagcgacgtcgcgagtccga

SEQ ID NO: 23828 - DNA, 24 bp, Artificial Sequence
  Description of Artificial Sequence: Synthetic oligonucleotide
gacagcgacgtcgcgagtccgaga

SEQ ID NO: 23829 - DNA, 25 bp, Artificial Sequence
  Description of Artificial Sequence: Synthetic oligonucleotide
acagcgacgtcgcgagtccgagaga

SEQ ID NO: 23830 - DNA, 24 bp, Artificial Sequence
  Description of Artificial Sequence: Synthetic oligonucleotide
cagcgacgtcgcgagtccgagaga

SEQ ID NO: 23831 - DNA, 24 bp, Artificial Sequence
  Description of Artificial Sequence: Synthetic oligonucleotide
agcgacgtcgcgagtccgagagag

SEQ ID NO: 23832 - DNA, 23 bp, Artificial Sequence
  Description of Artificial Sequence: Synthetic oligonucleotide
gcgacgtcgcgagtccgagagag

SEQ ID NO: 23833 - DNA, 24 bp, Artificial Sequence
  Description of Artificial Sequence: Synthetic oligonucleotide
cgacgtcgcgagtccgagagagga

SEQ ID NO: 23834 - DNA, 24 bp, Artificial Sequence
  Description of Artificial Sequence: Synthetic oligonucleotide
gacgtcgcgagtccgagagaggag

SEQ ID NO: 23835 - DNA, 24 bp, Artificial Sequence
  Description of Artificial Sequence: Synthetic oligonucleotide
acgtcgcgagtccgagagaggagc

SEQ ID NO: 23836 - DNA, 23 bp, Artificial Sequence
  Description of Artificial Sequence: Synthetic oligonucleotide
cgtcgcgagtccgagagaggagc

SEQ ID NO: 23837 - DNA, 23 bp, Artificial Sequence
  Description of Artificial Sequence: Synthetic oligonucleotide
gtcgcgagtccgagagaggagcc

SEQ ID NO: 23838 - DNA, 23 bp, Artificial Sequence
  Description of Artificial Sequence: Synthetic oligonucleotide
tcgcgagtccgagagaggagccg

SEQ ID NO: 23839 - DNA, 29 bp, Artificial Sequence
  Description of Artificial Sequence: Synthetic oligonucleotide
gcagatacctggagaacgggaaggacatg

SEQ ID NO: 23840 - DNA, 29 bp, Artificial Sequence
  Description of Artificial Sequence: Synthetic oligonucleotide
cagatacctggagaacgggaaggacatgc

SEQ ID NO: 23841 - DNA, 30 bp, Artificial Sequence
  Description of Artificial Sequence: Synthetic oligonucleotide
agatacctggagaacgggaaggacatgctg

SEQ ID NO: 23842 - DNA, 29 bp, Artificial Sequence
  Description of Artificial Sequence: Synthetic oligonucleotide
gatacctggagaacgggaaggacatgctg

SEQ ID NO: 23843 - DNA, 29 bp, Artificial Sequence
  Description of Artificial Sequence: Synthetic oligonucleotide
atacctggagaacgggaaggacatgctgg

SEQ ID NO: 23844 - DNA, 28 bp, Artificial Sequence
  Description of Artificial Sequence: Synthetic oligonucleotide
tacctggagaacgggaaggacatgctgg

SEQ ID NO: 23845 - DNA, 27 bp, Artificial Sequence
  Description of Artificial Sequence: Synthetic oligonucleotide
acctggagaacgggaaggacatgctgg

SEQ ID NO: 23846 - DNA, 27 bp, Artificial Sequence
  Description of Artificial Sequence: Synthetic oligonucleotide
cctggagaacgggaaggacatgctgga

SEQ ID NO: 23847 - DNA, 27 bp, Artificial Sequence
  Description of Artificial Sequence: Synthetic oligonucleotide
ctggagaacgggaaggacatgctggag

SEQ ID NO: 23848 - DNA, 27 bp, Artificial Sequence
  Description of Artificial Sequence: Synthetic oligonucleotide
tggagaacgggaaggacatgctggagc

SEQ ID NO: 23849 - DNA, 26 bp, Artificial Sequence
  Description of Artificial Sequence: Synthetic oligonucleotide
ggagaacgggaaggacatgctggagc

SEQ ID NO: 23850 - DNA, 26 bp, Artificial Sequence
  Description of Artificial Sequence: Synthetic oligonucleotide
gagaacgggaaggacatgctggagcg

SEQ ID NO: 23851 - DNA, 26 bp, Artificial Sequence
  Description of Artificial Sequence: Synthetic oligonucleotide
agaacgggaaggacatgctggagcgc

SEQ ID NO: 23852 - DNA, 25 bp, Artificial Sequence
  Description of Artificial Sequence: Synthetic oligonucleotide
gaacgggaaggacatgctggagcgc

SEQ ID NO: 23853 - DNA, 25 bp, Artificial Sequence
  Description of Artificial Sequence: Synthetic oligonucleotide
aacgggaaggacatgctggagcgcg

SEQ ID NO: 23854 - DNA, 24 bp, Artificial Sequence
  Description of Artificial Sequence: Synthetic oligonucleotide
acgggaaggacatgctggagcgcg

SEQ ID NO: 23855 - DNA, 23 bp, Artificial Sequence
  Description of Artificial Sequence: Synthetic oligonucleotide
cgggaaggacatgctggagcgcg

SEQ ID NO: 23856 - DNA, 24 bp, Artificial Sequence
  Description of Artificial Sequence: Synthetic oligonucleotide
gggaaggacatgctggagcgcgct

SEQ ID NO: 23857 - DNA, 25 bp, Artificial Sequence
  Description of Artificial Sequence: Synthetic oligonucleotide
ggaaggacatgctggagcgcgctga

SEQ ID NO: 23858 - DNA, 25 bp, Artificial Sequence
  Description of Artificial Sequence: Synthetic oligonucleotide
gaaggacatgctggagcgcgctgac

SEQ ID NO: 23859 - DNA, 25 bp, Artificial Sequence
  Description of Artificial Sequence: Synthetic oligonucleotide
aaggacatgctggagcgcgctgacc

SEQ ID NO: 23860 - DNA, 24 bp, Artificial Sequence
  Description of Artificial Sequence: Synthetic oligonucleotide
aggacatgctggagcgcgctgacc

SEQ ID NO: 23861 - DNA, 23 bp, Artificial Sequence
  Description of Artificial Sequence: Synthetic oligonucleotide
ggacatgctggagcgcgctgacc

SEQ ID NO: 23862 - DNA, 23 bp, Artificial Sequence
  Description of Artificial Sequence: Synthetic oligonucleotide
gacatgctggagcgcgctgaccc

SEQ ID NO: 23863 - DNA, 23 bp, Artificial Sequence
  Description of Artificial Sequence: Synthetic oligonucleotide
acatgctggagcgcgctgacccc

SEQ ID NO: 23864 - DNA, 22 bp, Artificial Sequence
  Description of Artificial Sequence: Synthetic oligonucleotide
catgctggagcgcgctgacccc

SEQ ID NO: 23865 - DNA, 22 bp, Artificial Sequence
  Description of Artificial Sequence: Synthetic oligonucleotide
atgctggagcgcgctgaccccc

SEQ ID NO: 23866 - DNA, 21 bp, Artificial Sequence
  Description of Artificial Sequence: Synthetic oligonucleotide
tgctggagcgcgctgaccccc

SEQ ID NO: 23867 - DNA, 24 bp, Artificial Sequence
  Description of Artificial Sequence: Synthetic oligonucleotide
gggagccccgcttcatctcagtgc

SEQ ID NO: 23868 - DNA, 24 bp, Artificial Sequence
  Description of Artificial Sequence: Synthetic oligonucleotide
ggagccccgcttcatctcagtgcg

SEQ ID NO: 23869 - DNA, 26 bp, Artificial Sequence
  Description of Artificial Sequence: Synthetic oligonucleotide
gagccccgcttcatctcagtgcgcta

SEQ ID NO: 23870 - DNA, 26 bp, Artificial Sequence
  Description of Artificial Sequence: Synthetic oligonucleotide
agccccgcttcatctcagtgcgctac

SEQ ID NO: 23871 - DNA, 25 bp, Artificial Sequence
  Description of Artificial Sequence: Synthetic oligonucleotide
gccccgcttcatctcagtgcgctac

SEQ ID NO: 23872 - DNA, 26 bp, Artificial Sequence
  Description of Artificial Sequence: Synthetic oligonucleotide
ccccgcttcatctcagtgcgctacgt

SEQ ID NO: 23873 - DNA, 26 bp, Artificial Sequence
  Description of Artificial Sequence: Synthetic oligonucleotide
cccgcttcatctcagtgcgctacgtg

SEQ ID NO: 23874 - DNA, 27 bp, Artificial Sequence
  Description of Artificial Sequence: Synthetic oligonucleotide
ccgcttcatctcagtgcgctacgtgga

SEQ ID NO: 23875 - DNA, 27 bp, Artificial Sequence
  Description of Artificial Sequence: Synthetic oligonucleotide
cgcttcatctcagtgcgctacgtggac

SEQ ID NO: 23876 - DNA, 27 bp, Artificial Sequence
  Description of Artificial Sequence: Synthetic oligonucleotide
gcttcatctcagtgcgctacgtggacg

SEQ ID NO: 23877 - DNA, 28 bp, Artificial Sequence
  Description of Artificial Sequence: Synthetic oligonucleotide
cttcatctcagtgcgctacgtggacgac

SEQ ID NO: 23878 - DNA, 29 bp, Artificial Sequence
  Description of Artificial Sequence: Synthetic oligonucleotide
ttcatctcagtgcgctacgtggacgacac

SEQ ID NO: 23879 - DNA, 28 bp, Artificial Sequence
  Description of Artificial Sequence: Synthetic oligonucleotide
tcatctcagtgcgctacgtggacgacac

SEQ ID NO: 23880 - DNA, 27 bp, Artificial Sequence
  Description of Artificial Sequence: Synthetic oligonucleotide
catctcagtgcgctacgtggacgacac

SEQ ID NO: 23881 - DNA, 27 bp, Artificial Sequence
  Description of Artificial Sequence: Synthetic oligonucleotide
atctcagtgcgctacgtggacgacacc

SEQ ID NO: 23882 - DNA, 26 bp, Artificial Sequence
  Description of Artificial Sequence: Synthetic oligonucleotide
tctcagtgcgctacgtggacgacacc

SEQ ID NO: 23883 - DNA, 25 bp, Artificial Sequence
  Description of Artificial Sequence: Synthetic oligonucleotide
ctcagtgcgctacgtggacgacacc

SEQ ID NO: 23884 - DNA, 26 bp, Artificial Sequence
  Description of Artificial Sequence: Synthetic oligonucleotide
tcagtgcgctacgtggacgacaccca

SEQ ID NO: 23885 - DNA, 25 bp, Artificial Sequence
  Description of Artificial Sequence: Synthetic oligonucleotide
cagtgcgctacgtggacgacaccca

SEQ ID NO: 23886 - DNA, 27 bp, Artificial Sequence
  Description of Artificial Sequence: Synthetic oligonucleotide
agtgcgctacgtggacgacacccagtt

SEQ ID NO: 23887 - DNA, 26 bp, Artificial Sequence
  Description of Artificial Sequence: Synthetic oligonucleotide
gtgcgctacgtggacgacacccagtt

SEQ ID NO: 23888 - DNA, 26 bp, Artificial Sequence
  Description of Artificial Sequence: Synthetic oligonucleotide
tgcgctacgtggacgacacccagttc

SEQ ID NO: 23889 - DNA, 25 bp, Artificial Sequence
  Description of Artificial Sequence: Synthetic oligonucleotide
gcgctacgtggacgacacccagttc

SEQ ID NO: 23890 - DNA, 26 bp, Artificial Sequence
  Description of Artificial Sequence: Synthetic oligonucleotide
cgctacgtggacgacacccagttcgt

SEQ ID NO: 23891 - DNA, 28 bp, Artificial Sequence
  Description of Artificial Sequence: Synthetic oligonucleotide
tggagaacgggaaggacaagctggagag

SEQ ID NO: 23892 - DNA, 27 bp, Artificial Sequence
  Description of Artificial Sequence: Synthetic oligonucleotide
ggagaacgggaaggacaagctggagag

SEQ ID NO: 23893 - DNA, 27 bp, Artificial Sequence
  Description of Artificial Sequence: Synthetic oligonucleotide
gagaacgggaaggacaagctggagagc

SEQ ID NO: 23894 - DNA, 27 bp, Artificial Sequence
  Description of Artificial Sequence: Synthetic oligonucleotide
agaacgggaaggacaagctggagagcg

SEQ ID NO: 23895 - DNA, 26 bp, Artificial Sequence
  Description of Artificial Sequence: Synthetic oligonucleotide
gaacgggaaggacaagctggagagcg

SEQ ID NO: 23896 - DNA, 27 bp, Artificial Sequence
  Description of Artificial Sequence: Synthetic oligonucleotide
aacgggaaggacaagctggagagcgct

SEQ ID NO: 23897 - DNA, 26 bp, Artificial Sequence
  Description of Artificial Sequence: Synthetic oligonucleotide
acgggaaggacaagctggagagcgct

SEQ ID NO: 23898 - DNA, 25 bp, Artificial Sequence
  Description of Artificial Sequence: Synthetic oligonucleotide
cgggaaggacaagctggagagcgct

SEQ ID NO: 23899 - DNA, 25 bp, Artificial Sequence
  Description of Artificial Sequence: Synthetic oligonucleotide
gggaaggacaagctggagagcgctg

SEQ ID NO: 23900 - DNA, 32 bp, Artificial Sequence
  Description of Artificial Sequence: Synthetic oligonucleotide
cttctggagaagagcagagatacacatgccag

SEQ ID NO: 23901 - DNA, 32 bp, Artificial Sequence
  Description of Artificial Sequence: Synthetic oligonucleotide
ttctggagaagagcagagatacacatgccagg

SEQ ID NO: 23902 - DNA, 31 bp, Artificial Sequence
  Description of Artificial Sequence: Synthetic oligonucleotide
tctggagaagagcagagatacacatgccagg

SEQ ID NO: 23903 - DNA, 30 bp, Artificial Sequence
  Description of Artificial Sequence: Synthetic oligonucleotide
ctggagaagagcagagatacacatgccagg

SEQ ID NO: 23904 - DNA, 32 bp, Artificial Sequence
  Description of Artificial Sequence: Synthetic oligonucleotide
tggagaagagcagagatacacatgccaggtac

SEQ ID NO: 23905 - DNA, 31 bp, Artificial Sequence
  Description of Artificial Sequence: Synthetic oligonucleotide
ggagaagagcagagatacacatgccaggtac

SEQ ID NO: 23906 - DNA, 32 bp, Artificial Sequence
  Description of Artificial Sequence: Synthetic oligonucleotide
gagaagagcagagatacacatgccaggtacag

SEQ ID NO: 23907 - DNA, 32 bp, Artificial Sequence
  Description of Artificial Sequence: Synthetic oligonucleotide
agaagagcagagatacacatgccaggtacagc

SEQ ID NO: 23908 - DNA, 31 bp, Artificial Sequence
  Description of Artificial Sequence: Synthetic oligonucleotide
gaagagcagagatacacatgccaggtacagc

SEQ ID NO: 23909 - DNA, 33 bp, Artificial Sequence
  Description of Artificial Sequence: Synthetic oligonucleotide
aagagcagagatacacatgccaggtacagcatg

SEQ ID NO: 23910 - DNA, 32 bp, Artificial Sequence
  Description of Artificial Sequence: Synthetic oligonucleotide
agagcagagatacacatgccaggtacagcatg

SEQ ID NO: 23911 - DNA, 31 bp, Artificial Sequence
  Description of Artificial Sequence: Synthetic oligonucleotide
gagcagagatacacatgccaggtacagcatg

SEQ ID NO: 23912 - DNA, 32 bp, Artificial Sequence
  Description of Artificial Sequence: Synthetic oligonucleotide
agcagagatacacatgccaggtacagcatgag

SEQ ID NO: 23913 - DNA, 31 bp, Artificial Sequence
  Description of Artificial Sequence: Synthetic oligonucleotide
gcagagatacacatgccaggtacagcatgag

SEQ ID NO: 23914 - DNA, 31 bp, Artificial Sequence
  Description of Artificial Sequence: Synthetic oligonucleotide
cagagatacacatgccaggtacagcatgagg

SEQ ID NO: 23915 - DNA, 31 bp, Artificial Sequence
  Description of Artificial Sequence: Synthetic oligonucleotide
agagatacacatgccaggtacagcatgaggg

SEQ ID NO: 23916 - DNA, 30 bp, Artificial Sequence
  Description of Artificial Sequence: Synthetic oligonucleotide
gagatacacatgccaggtacagcatgaggg

SEQ ID NO: 23917 - DNA, 30 bp, Artificial Sequence
  Description of Artificial Sequence: Synthetic oligonucleotide
agatacacatgccaggtacagcatgagggg

SEQ ID NO: 23918 - DNA, 29 bp, Artificial Sequence
  Description of Artificial Sequence: Synthetic oligonucleotide
gatacacatgccaggtacagcatgagggg

SEQ ID NO: 23919 - DNA, 29 bp, Artificial Sequence
  Description of Artificial Sequence: Synthetic oligonucleotide
atacacatgccaggtacagcatgaggggc

SEQ ID NO: 23920 - DNA, 28 bp, Artificial Sequence
  Description of Artificial Sequence: Synthetic oligonucleotide
tacacatgccaggtacagcatgaggggc

SEQ ID NO: 23921 - DNA, 27 bp, Artificial Sequence
  Description of Artificial Sequence: Synthetic oligonucleotide
acacatgccaggtacagcatgaggggc

SEQ ID NO: 23922 - DNA, 27 bp, Artificial Sequence
  Description of Artificial Sequence: Synthetic oligonucleotide
cacatgccaggtacagcatgaggggct

SEQ ID NO: 23923 - DNA, 27 bp, Artificial Sequence
  Description of Artificial Sequence: Synthetic oligonucleotide
acatgccaggtacagcatgaggggctg

SEQ ID NO: 23924 - DNA, 26 bp, Artificial Sequence
  Description of Artificial Sequence: Synthetic oligonucleotide
catgccaggtacagcatgaggggctg

SEQ ID NO: 23925 - DNA, 26 bp, Artificial Sequence
  Description of Artificial Sequence: Synthetic oligonucleotide
atgccaggtacagcatgaggggctgc

SEQ ID NO: 23926 - DNA, 25 bp, Artificial Sequence
  Description of Artificial Sequence: Synthetic oligonucleotide
tgccaggtacagcatgaggggctgc

SEQ ID NO: 23927 - DNA, 24 bp, Artificial Sequence
  Description of Artificial Sequence: Synthetic oligonucleotide
gccaggtacagcatgaggggctgc

SEQ ID NO: 23928 - DNA, 24 bp, Artificial Sequence
  Description of Artificial Sequence: Synthetic oligonucleotide
ccaggtacagcatgaggggctgcc

SEQ ID NO: 23929 - DNA, 26 bp, Artificial Sequence
  Description of Artificial Sequence: Synthetic oligonucleotide
caggtacagcatgaggggctgccgaa

SEQ ID NO: 23930 - DNA, 26 bp, Artificial Sequence
  Description of Artificial Sequence: Synthetic oligonucleotide
aggtacagcatgaggggctgccgaag

SEQ ID NO: 23931 - DNA, 25 bp, Artificial Sequence
  Description of Artificial Sequence: Synthetic oligonucleotide
ggtacagcatgaggggctgccgaag

SEQ ID NO: 23932 - DNA, 23 bp, Artificial Sequence
  Description of Artificial Sequence: Synthetic oligonucleotide
ccgtgaggcggagcagcggagaa

SEQ ID NO: 23933 - DNA, 23 bp, Artificial Sequence
  Description of Artificial Sequence: Synthetic oligonucleotide
cgtgaggcggagcagcggagaac

SEQ ID NO: 23934 - DNA, 25 bp, Artificial Sequence
  Description of Artificial Sequence: Synthetic oligonucleotide
gtgaggcggagcagcggagaaccta

SEQ ID NO: 23935 - DNA, 25 bp, Artificial Sequence
  Description of Artificial Sequence: Synthetic oligonucleotide
tgaggcggagcagcggagaacctac

SEQ ID NO: 23936 - DNA, 24 bp, Artificial Sequence
  Description of Artificial Sequence: Synthetic oligonucleotide
gaggcggagcagcggagaacctac

SEQ ID NO: 23937 - DNA, 25 bp, Artificial Sequence
  Description of Artificial Sequence: Synthetic oligonucleotide
aggcggagcagcggagaacctacct

SEQ ID NO: 23938 - DNA, 24 bp, Artificial Sequence
  Description of Artificial Sequence: Synthetic oligonucleotide
ggcggagcagcggagaacctacct

SEQ ID NO: 23939 - DNA, 24 bp, Artificial Sequence
  Description of Artificial Sequence: Synthetic oligonucleotide
gcggagcagcggagaacctacctg

SEQ ID NO: 23940 - DNA, 25 bp, Artificial Sequence
  Description of Artificial Sequence: Synthetic oligonucleotide
cggagcagcggagaacctacctgga

SEQ ID NO: 23941 - DNA, 25 bp, Artificial Sequence
  Description of Artificial Sequence: Synthetic oligonucleotide
ggagcagcggagaacctacctggag

SEQ ID NO: 23942 - DNA, 25 bp, Artificial Sequence
  Description of Artificial Sequence: Synthetic oligonucleotide
gagcagcggagaacctacctggagg

SEQ ID NO: 23943 - DNA, 25 bp, Artificial Sequence
  Description of Artificial Sequence: Synthetic oligonucleotide
agcagcggagaacctacctggaggg

SEQ ID NO: 23944 - DNA, 24 bp, Artificial Sequence
  Description of Artificial Sequence: Synthetic oligonucleotide
gcagcggagaacctacctggaggg

SEQ ID NO: 23945 - DNA, 24 bp, Artificial Sequence
  Description of Artificial Sequence: Synthetic oligonucleotide
cagcggagaacctacctggagggc

SEQ ID NO: 23946 - DNA, 25 bp, Artificial Sequence
  Description of Artificial Sequence: Synthetic oligonucleotide
agcggagaacctacctggagggcga

SEQ ID NO: 23947 - DNA, 24 bp, Artificial Sequence
  Description of Artificial Sequence: Synthetic oligonucleotide
gcggagaacctacctggagggcga

SEQ ID NO: 23948 - DNA, 25 bp, Artificial Sequence
  Description of Artificial Sequence: Synthetic oligonucleotide
cggagaacctacctggagggcgagt

SEQ ID NO: 23949 - DNA, 25 bp, Artificial Sequence
  Description of Artificial Sequence: Synthetic oligonucleotide
ggagaacctacctggagggcgagtg

SEQ ID NO: 23950 - DNA, 25 bp, Artificial Sequence
  Description of Artificial Sequence: Synthetic oligonucleotide
gagaacctacctggagggcgagtgc

SEQ ID NO: 23951 - DNA, 26 bp, Artificial Sequence
  Description of Artificial Sequence: Synthetic oligonucleotide
agaacctacctggagggcgagtgcgt

SEQ ID NO: 23952 - DNA, 25 bp, Artificial Sequence
  Description of Artificial Sequence: Synthetic oligonucleotide
gaacctacctggagggcgagtgcgt

SEQ ID NO: 23953 - DNA, 25 bp, Artificial Sequence
  Description of Artificial Sequence: Synthetic oligonucleotide
aacctacctggagggcgagtgcgtg

SEQ ID NO: 23954 - DNA, 24 bp, Artificial Sequence
  Description of Artificial Sequence: Synthetic oligonucleotide
acctacctggagggcgagtgcgtg

SEQ ID NO: 23955 - DNA, 23 bp, Artificial Sequence
  Description of Artificial Sequence: Synthetic oligonucleotide
agtccgagagaggagccgcgggt

SEQ ID NO: 23956 - DNA, 22 bp, Artificial Sequence
  Description of Artificial Sequence: Synthetic oligonucleotide
gtccgagagaggagccgcgggt

SEQ ID NO: 23957 - DNA, 22 bp, Artificial Sequence
  Description of Artificial Sequence: Synthetic oligonucleotide
tccgagagaggagccgcgggtg

SEQ ID NO: 23958 - DNA, 21 bp, Artificial Sequence
  Description of Artificial Sequence: Synthetic oligonucleotide
ccgagagaggagccgcgggtg

SEQ ID NO: 23959 - DNA, 21 bp, Artificial Sequence
  Description of Artificial Sequence: Synthetic oligonucleotide
cgagagaggagccgcgggtgc

SEQ ID NO: 23960 - DNA, 21 bp, Artificial Sequence
  Description of Artificial Sequence: Synthetic oligonucleotide
gagagaggagccgcgggtgcc

SEQ ID NO: 23961 - DNA, 22 bp, Artificial Sequence
  Description of Artificial Sequence: Synthetic oligonucleotide
agagaggagccgcgggtgccgt

SEQ ID NO: 23962 - DNA, 21 bp, Artificial Sequence
  Description of Artificial Sequence: Synthetic oligonucleotide
gagaggagccgcgggtgccgt

SEQ ID NO: 23963 - DNA, 21 bp, Artificial Sequence
  Description of Artificial Sequence: Synthetic oligonucleotide
agaggagccgcgggtgccgtg

SEQ ID NO: 23964 - DNA, 20 bp, Artificial Sequence
  Description of Artificial Sequence: Synthetic oligonucleotide
gaggagccgcgggtgccgtg

SEQ ID NO: 23965 - DNA, 23 bp, Artificial Sequence
  Description of Artificial Sequence: Synthetic oligonucleotide
aggagccgcgggtgccgtggata

SEQ ID NO: 23966 - DNA, 24 bp, Artificial Sequence
  Description of Artificial Sequence: Synthetic oligonucleotide
ggtgccgtggatagagcaggaggg

SEQ ID NO: 23967 - DNA, 24 bp, Artificial Sequence
  Description of Artificial Sequence: Synthetic oligonucleotide
gtgccgtggatagagcaggagggg

SEQ ID NO: 23968 - DNA, 24 bp, Artificial Sequence
  Description of Artificial Sequence: Synthetic oligonucleotide
tgccgtggatagagcaggaggggc

SEQ ID NO: 23969 - DNA, 29 bp, Artificial Sequence
  Description of Artificial Sequence: Synthetic oligonucleotide
aacacacagatctacaaggcccaggcacg

SEQ ID NO: 23970 - DNA, 28 bp, Artificial Sequence
  Description of Artificial Sequence: Synthetic oligonucleotide
acacacagatctacaaggcccaggcacg

SEQ ID NO: 23971 - DNA, 27 bp, Artificial Sequence
  Description of Artificial Sequence: Synthetic oligonucleotide
cacacagatctacaaggcccaggcacg

SEQ ID NO: 23972 - DNA, 27 bp, Artificial Sequence
  Description of Artificial Sequence: Synthetic oligonucleotide
acacagatctacaaggcccaggcacgg

SEQ ID NO: 23973 - DNA, 27 bp, Artificial Sequence
  Description of Artificial Sequence: Synthetic oligonucleotide
cacagatctacaaggcccaggcacgga

SEQ ID NO: 23974 - DNA, 27 bp, Artificial Sequence
  Description of Artificial Sequence: Synthetic oligonucleotide
acagatctacaaggcccaggcacggac

SEQ ID NO: 23975 - DNA, 27 bp, Artificial Sequence
  Description of Artificial Sequence: Synthetic oligonucleotide
cagatctacaaggcccaggcacggact

SEQ ID NO: 23976 - DNA, 27 bp, Artificial Sequence
  Description of Artificial Sequence: Synthetic oligonucleotide
agatctacaaggcccaggcacggactg

SEQ ID NO: 23977 - DNA, 27 bp, Artificial Sequence
  Description of Artificial Sequence: Synthetic oligonucleotide
gatctacaaggcccaggcacggactga

SEQ ID NO: 23978 - DNA, 27 bp, Artificial Sequence
  Description of Artificial Sequence: Synthetic oligonucleotide
atctacaaggcccaggcacggactgac

SEQ ID NO: 23979 - DNA, 26 bp, Artificial Sequence
  Description of Artificial Sequence: Synthetic oligonucleotide
tctacaaggcccaggcacggactgac

SEQ ID NO: 23980 - DNA, 25 bp, Artificial Sequence
  Description of Artificial Sequence: Synthetic oligonucleotide
ctacaaggcccaggcacggactgac

SEQ ID NO: 23981 - DNA, 25 bp, Artificial Sequence
  Description of Artificial Sequence: Synthetic oligonucleotide
tacaaggcccaggcacggactgacc

SEQ ID NO: 23982 - DNA, 24 bp, Artificial Sequence
  Description of Artificial Sequence: Synthetic oligonucleotide
acaaggcccaggcacggactgacc

SEQ ID NO: 23983 - DNA, 23 bp, Artificial Sequence
  Description of Artificial Sequence: Synthetic oligonucleotide
caaggcccaggcacggactgacc

SEQ ID NO: 23984 - DNA, 24 bp, Artificial Sequence
  Description of Artificial Sequence: Synthetic oligonucleotide
aaggcccaggcacggactgaccga

SEQ ID NO: 23985 - DNA, 23 bp, Artificial Sequence
  Description of Artificial Sequence: Synthetic oligonucleotide
aggcccaggcacggactgaccga

SEQ ID NO: 23986 - DNA, 22 bp, Artificial Sequence
  Description of Artificial Sequence: Synthetic oligonucleotide
ggcccaggcacggactgaccga

SEQ ID NO: 23987 - DNA, 23 bp, Artificial Sequence
  Description of Artificial Sequence: Synthetic oligonucleotide
gcccaggcacggactgaccgaga

SEQ ID NO: 23988 - DNA, 24 bp, Artificial Sequence
  Description of Artificial Sequence: Synthetic oligonucleotide
cccaggcacggactgaccgagaga

SEQ ID NO: 23989 - DNA, 24 bp, Artificial Sequence
  Description of Artificial Sequence: Synthetic oligonucleotide
ccaggcacggactgaccgagagag

SEQ ID NO: 23990 - DNA, 24 bp, Artificial Sequence
  Description of Artificial Sequence: Synthetic oligonucleotide
caggcacggactgaccgagagagc

SEQ ID NO: 23991 - DNA, 25 bp, Artificial Sequence
  Description of Artificial Sequence: Synthetic oligonucleotide
aggcacggactgaccgagagagcct

SEQ ID NO: 23992 - DNA, 24 bp, Artificial Sequence
  Description of Artificial Sequence: Synthetic oligonucleotide
ggcacggactgaccgagagagcct

SEQ ID NO: 23993 - DNA, 24 bp, Artificial Sequence
  Description of Artificial Sequence: Synthetic oligonucleotide
gcacggactgaccgagagagcctg

SEQ ID NO: 23994 - DNA, 24 bp, Artificial Sequence
  Description of Artificial Sequence: Synthetic oligonucleotide
cacggactgaccgagagagcctgc

SEQ ID NO: 23995 - DNA, 24 bp, Artificial Sequence
  Description of Artificial Sequence: Synthetic oligonucleotide
acggactgaccgagagagcctgcg

SEQ ID NO: 23996 - DNA, 23 bp, Artificial Sequence
  Description of Artificial Sequence: Synthetic oligonucleotide
cggactgaccgagagagcctgcg

SEQ ID NO: 23997 - DNA, 25 bp, Artificial Sequence
  Description of Artificial Sequence: Synthetic oligonucleotide
ggactgaccgagagagcctgcggaa

SEQ ID NO: 23998 - DNA, 26 bp, Artificial Sequence
  Description of Artificial Sequence: Synthetic oligonucleotide
ctgccgaagcccctcaccctgagata

SEQ ID NO: 23999 - DNA, 26 bp, Artificial Sequence
  Description of Artificial Sequence: Synthetic oligonucleotide
tgccgaagcccctcaccctgagatag

SEQ ID NO: 24000 - DNA, 25 bp, Artificial Sequence
  Description of Artificial Sequence: Synthetic oligonucleotide
gccgaagcccctcaccctgagatag

SEQ ID NO: 24001 - DNA, 25 bp, Artificial Sequence
  Description of Artificial Sequence: Synthetic oligonucleotide
ccgaagcccctcaccctgagatagg

SEQ ID NO: 24002 - DNA, 32 bp, Artificial Sequence
  Description of Artificial Sequence: Synthetic oligonucleotide
tccaagaccaacacacagacttaccgagagag

SEQ ID NO: 24003 - DNA, 31 bp, Artificial Sequence
  Description of Artificial Sequence: Synthetic oligonucleotide
ccaagaccaacacacagacttaccgagagag

SEQ ID NO: 24004 - DNA, 21 bp, Artificial Sequence
  Description of Artificial Sequence: Synthetic oligonucleotide
gcaagtgggaggcggcccgtg

SEQ ID NO: 24005 - DNA, 21 bp, Artificial Sequence
  Description of Artificial Sequence: Synthetic oligonucleotide
caagtgggaggcggcccgtgc

SEQ ID NO: 24006 - DNA, 21 bp, Artificial Sequence
  Description of Artificial Sequence: Synthetic oligonucleotide
aagtgggaggcggcccgtgcg

SEQ ID NO: 24007 - DNA, 20 bp, Artificial Sequence
  Description of Artificial Sequence: Synthetic oligonucleotide
agtgggaggcggcccgtgcg

SEQ ID NO: 24008 - DNA, 20 bp, Artificial Sequence
  Description of Artificial Sequence: Synthetic oligonucleotide
gtgggaggcggcccgtgcgt

SEQ ID NO: 24009 - DNA, 20 bp, Artificial Sequence
  Description of Artificial Sequence: Synthetic oligonucleotide
tgggaggcggcccgtgcggt

SEQ ID NO: 24010 - DNA, 20 bp, Artificial Sequence
  Description of Artificial Sequence: Synthetic oligonucleotide
gggaggcggcccgtgcggtt

SEQ ID NO: 24011 - DNA, 20 bp, Artificial Sequence
  Description of Artificial Sequence: Synthetic oligonucleotide
ggaggcggcccgtgcggctt

SEQ ID NO: 24012 - DNA, 20 bp, Artificial Sequence
  Description of Artificial Sequence: Synthetic oligonucleotide
gaggcggcccgtgcggcgtt

SEQ ID NO: 24013 - DNA, 20 bp, Artificial Sequence
  Description of Artificial Sequence: Synthetic oligonucleotide
aggcggcccgtgcggcggat

SEQ ID NO: 24014 - DNA, 20 bp, Artificial Sequence
  Description of Artificial Sequence: Synthetic oligonucleotide
ggcggcccgtgcggcggatt

SEQ ID NO: 24015 - DNA, 20 bp, Artificial Sequence
  Description of Artificial Sequence: Synthetic oligonucleotide
gcggcccgtgcggcggagtt

SEQ ID NO: 24016 - DNA, 20 bp, Artificial Sequence
  Description of Artificial Sequence: Synthetic oligonucleotide
cggcccgtgcggcggagcat

SEQ ID NO: 24017 - DNA, 20 bp, Artificial Sequence
  Description of Artificial Sequence: Synthetic oligonucleotide
ggcccgtgcggcggagcagt

SEQ ID NO: 24018 - DNA, 20 bp, Artificial Sequence
  Description of Artificial Sequence: Synthetic oligonucleotide
gcccgtgcggcggagcagct

SEQ ID NO: 24019 - DNA, 20 bp, Artificial Sequence
  Description of Artificial Sequence: Synthetic oligonucleotide
cccgtgcggcggagcagcgt

SEQ ID NO: 24020 - DNA, 20 bp, Artificial Sequence
  Description of Artificial Sequence: Synthetic oligonucleotide
ccgtgcggcggagcagcgga

SEQ ID NO: 24021 - DNA, 21 bp, Artificial Sequence
  Description of Artificial Sequence: Synthetic oligonucleotide
cgtgcggcggagcagcggaga

SEQ ID NO: 24022 - DNA, 21 bp, Artificial Sequence
  Description of Artificial Sequence: Synthetic oligonucleotide
gtgcggcggagcagcggagag

SEQ ID NO: 24023 - DNA, 23 bp, Artificial Sequence
  Description of Artificial Sequence: Synthetic oligonucleotide
cgtgaggcggagcagcggagagt

SEQ ID NO: 24024 - DNA, 25 bp, Artificial Sequence
  Description of Artificial Sequence: Synthetic oligonucleotide
gtgaggcggagcagcggagagtcta

SEQ ID NO: 24025 - DNA, 25 bp, Artificial Sequence
  Description of Artificial Sequence: Synthetic oligonucleotide
tgaggcggagcagcggagagtctac

SEQ ID NO: 24026 - DNA, 24 bp, Artificial Sequence
  Description of Artificial Sequence: Synthetic oligonucleotide
gaggcggagcagcggagagtctac

SEQ ID NO: 24027 - DNA, 25 bp, Artificial Sequence
  Description of Artificial Sequence: Synthetic oligonucleotide
aggcggagcagcggagagtctacct

SEQ ID NO: 24028 - DNA, 25 bp, Artificial Sequence
  Description of Artificial Sequence: Synthetic oligonucleotide
cggagagtctacctggagggcgagt

SEQ ID NO: 24029 - DNA, 25 bp, Artificial Sequence
  Description of Artificial Sequence: Synthetic oligonucleotide
ggagagtctacctggagggcgagtg

SEQ ID NO: 24030 - DNA, 25 bp, Artificial Sequence
  Description of Artificial Sequence: Synthetic oligonucleotide
gagagtctacctggagggcgagtgc

SEQ ID NO: 24031 - DNA, 26 bp, Artificial Sequence
  Description of Artificial Sequence: Synthetic oligonucleotide
agagtctacctggagggcgagtgcgt

SEQ ID NO: 24032 - DNA, 25 bp, Artificial Sequence
  Description of Artificial Sequence: Synthetic oligonucleotide
gagtctacctggagggcgagtgcgt

SEQ ID NO: 24033 - DNA, 25 bp, Artificial Sequence
  Description of Artificial Sequence: Synthetic oligonucleotide
agtctacctggagggcgagtgcgtg

SEQ ID NO: 24034 - DNA, 24 bp, Artificial Sequence
  Description of Artificial Sequence: Synthetic oligonucleotide
gtctacctggagggcgagtgcgtg

SEQ ID NO: 24035 - DNA, 25 bp, Artificial Sequence
  Description of Artificial Sequence: Synthetic oligonucleotide
tctacctggagggcgagtgcgtgga

SEQ ID NO: 24036 - DNA, 28 bp, Artificial Sequence
  Description of Artificial Sequence: Synthetic oligonucleotide
ggagtattgggaccgggagacacagatc

SEQ ID NO: 24037 - DNA, 30 bp, Artificial Sequence
  Description of Artificial Sequence: Synthetic oligonucleotide
gagtattgggaccgggagacacagatctac

SEQ ID NO: 24038 - DNA, 32 bp, Artificial Sequence
  Description of Artificial Sequence: Synthetic oligonucleotide
agtattgggaccgggagacacagatctacaag

SEQ ID NO: 24039 - DNA, 31 bp, Artificial Sequence
  Description of Artificial Sequence: Synthetic oligonucleotide
gtattgggaccgggagacacagatctacaag

SEQ ID NO: 24040 - DNA, 31 bp, Artificial Sequence
  Description of Artificial Sequence: Synthetic oligonucleotide
tattgggaccgggagacacagatctacaagg

SEQ ID NO: 24041 - DNA, 30 bp, Artificial Sequence
  Description of Artificial Sequence: Synthetic oligonucleotide
attgggaccgggagacacagatctacaagg

SEQ ID NO: 24042 - DNA, 29 bp, Artificial Sequence
  Description of Artificial Sequence: Synthetic oligonucleotide
ttgggaccgggagacacagatctacaagg

SEQ ID NO: 24043 - DNA, 28 bp, Artificial Sequence
  Description of Artificial Sequence: Synthetic oligonucleotide
tgggaccgggagacacagatctacaagg

SEQ ID NO: 24044 - DNA, 27 bp, Artificial Sequence
  Description of Artificial Sequence: Synthetic oligonucleotide
gggaccgggagacacagatctacaagg

SEQ ID NO: 24045 - DNA, 27 bp, Artificial Sequence
  Description of Artificial Sequence: Synthetic oligonucleotide
ggaccgggagacacagatctacaaggc

SEQ ID NO: 24046 - DNA, 27 bp, Artificial Sequence
  Description of Artificial Sequence: Synthetic oligonucleotide
gaccgggagacacagatctacaaggcc

SEQ ID NO: 24047 - DNA, 27 bp, Artificial Sequence
  Description of Artificial Sequence: Synthetic oligonucleotide
accgggagacacagatctacaaggccc

SEQ ID NO: 24048 - DNA, 27 bp, Artificial Sequence
  Description of Artificial Sequence: Synthetic oligonucleotide
ccgggagacacagatctacaaggccca

SEQ ID NO: 24049 - DNA, 27 bp, Artificial Sequence
  Description of Artificial Sequence: Synthetic oligonucleotide
cgggagacacagatctacaaggcccag

SEQ ID NO: 24050 - DNA, 27 bp, Artificial Sequence
  Description of Artificial Sequence: Synthetic oligonucleotide
gggagacacagatctacaaggcccagg

SEQ ID NO: 24051 - DNA, 27 bp, Artificial Sequence
  Description of Artificial Sequence: Synthetic oligonucleotide
ggagacacagatctacaaggcccaggc

SEQ ID NO: 24052 - DNA, 28 bp, Artificial Sequence
  Description of Artificial Sequence: Synthetic oligonucleotide
gagacacagatctacaaggcccaggcac

SEQ ID NO: 24053 - DNA, 29 bp, Artificial Sequence
  Description of Artificial Sequence: Synthetic oligonucleotide
agacacagatctacaaggcccaggcacag

SEQ ID NO: 24054 - DNA, 28 bp, Artificial Sequence
  Description of Artificial Sequence: Synthetic oligonucleotide
gacacagatctacaaggcccaggcacag

SEQ ID NO: 24055 - DNA, 26 bp, Artificial Sequence
  Description of Artificial Sequence: Synthetic oligonucleotide
ggcattgttgctggcctggctgtcct

SEQ ID NO: 24056 - DNA, 26 bp, Artificial Sequence
  Description of Artificial Sequence: Synthetic oligonucleotide
accgtccccatcgtgggcattgttgc

SEQ ID NO: 24057 - DNA, 27 bp, Artificial Sequence
  Description of Artificial Sequence: Synthetic oligonucleotide
cccaaagacacacgtgacccaccacct

SEQ ID NO: 24058 - DNA, 27 bp, Artificial Sequence
  Description of Artificial Sequence: Synthetic oligonucleotide
ccaaagacacacgtgacccaccacctc

SEQ ID NO: 24059 - DNA, 29 bp, Artificial Sequence
  Description of Artificial Sequence: Synthetic oligonucleotide
caaagacacacgtgacccaccacctcatc

SEQ ID NO: 24060 - DNA, 30 bp, Artificial Sequence
  Description of Artificial Sequence: Synthetic oligonucleotide
aaagacacacgtgacccaccacctcatctc

SEQ ID NO: 24061 - DNA, 29 bp, Artificial Sequence
  Description of Artificial Sequence: Synthetic oligonucleotide
aagacacacgtgacccaccacctcatctc

SEQ ID NO: 24062 - DNA, 28 bp, Artificial Sequence
  Description of Artificial Sequence: Synthetic oligonucleotide
agacacacgtgacccaccacctcatctc

SEQ ID NO: 24063 - DNA, 27 bp, Artificial Sequence
  Description of Artificial Sequence: Synthetic oligonucleotide
gacacacgtgacccaccacctcatctc

SEQ ID NO: 24064 - DNA, 28 bp, Artificial Sequence
  Description of Artificial Sequence: Synthetic oligonucleotide
acacacgtgacccaccacctcatctctg

SEQ ID NO: 24065 - DNA, 27 bp, Artificial Sequence
  Description of Artificial Sequence: Synthetic oligonucleotide
cacacgtgacccaccacctcatctctg

SEQ ID NO: 24066 - DNA, 28 bp, Artificial Sequence
  Description of Artificial Sequence: Synthetic oligonucleotide
acacgtgacccaccacctcatctctgac

SEQ ID NO: 24067 - DNA, 27 bp, Artificial Sequence
  Description of Artificial Sequence: Synthetic oligonucleotide
cacgtgacccaccacctcatctctgac

SEQ ID NO: 24068 - DNA, 27 bp, Artificial Sequence
  Description of Artificial Sequence: Synthetic oligonucleotide
acgtgacccaccacctcatctctgacc

SEQ ID NO: 24069 - DNA, 27 bp, Artificial Sequence
  Description of Artificial Sequence: Synthetic oligonucleotide
cgtgacccaccacctcatctctgacca

SEQ ID NO: 24070 - DNA, 28 bp, Artificial Sequence
  Description of Artificial Sequence: Synthetic oligonucleotide
gtgacccaccacctcatctctgaccatg

SEQ ID NO: 24071 - DNA, 27 bp, Artificial Sequence
  Description of Artificial Sequence: Synthetic oligonucleotide
cacctcatctctgaccatgaggccacc

SEQ ID NO: 24072 - DNA, 27 bp, Artificial Sequence
  Description of Artificial Sequence: Synthetic oligonucleotide
acctcatctctgaccatgaggccaccc

SEQ ID NO: 24073 - DNA, 27 bp, Artificial Sequence
  Description of Artificial Sequence: Synthetic oligonucleotide
cctcatctctgaccatgaggccaccct

SEQ ID NO: 24074 - DNA, 27 bp, Artificial Sequence
  Description of Artificial Sequence: Synthetic oligonucleotide
ctcatctctgaccatgaggccaccctg

SEQ ID NO: 24075 - DNA, 28 bp, Artificial Sequence
  Description of Artificial Sequence: Synthetic oligonucleotide
tcatctctgaccatgaggccaccctgag

SEQ ID NO: 24076 - DNA, 27 bp, Artificial Sequence
  Description of Artificial Sequence: Synthetic oligonucleotide
gggatggcgaggaccaaactcaggact

SEQ ID NO: 24077 - DNA, 27 bp, Artificial Sequence
  Description of Artificial Sequence: Synthetic oligonucleotide
ggatggcgaggaccaaactcaggactc

SEQ ID NO: 24078 - DNA, 28 bp, Artificial Sequence
  Description of Artificial Sequence: Synthetic oligonucleotide
gatggcgaggaccaaactcaggactctg

SEQ ID NO: 24079 - DNA, 29 bp, Artificial Sequence
  Description of Artificial Sequence: Synthetic oligonucleotide
atggcgaggaccaaactcaggactctgag

SEQ ID NO: 24080 - DNA, 28 bp, Artificial Sequence
  Description of Artificial Sequence: Synthetic oligonucleotide
tggcgaggaccaaactcaggactctgag

SEQ ID NO: 24081 - DNA, 27 bp, Artificial Sequence
  Description of Artificial Sequence: Synthetic oligonucleotide
ggcgaggaccaaactcaggactctgag

SEQ ID NO: 24082 - DNA, 27 bp, Artificial Sequence
  Description of Artificial Sequence: Synthetic oligonucleotide
gcgaggaccaaactcaggactctgagc

SEQ ID NO: 24083 - DNA, 29 bp, Artificial Sequence
  Description of Artificial Sequence: Synthetic oligonucleotide
cgaggaccaaactcaggactctgagcttg

SEQ ID NO: 24084 - DNA, 30 bp, Artificial Sequence
  Description of Artificial Sequence: Synthetic oligonucleotide
gaggaccaaactcaggactctgagcttgtg

SEQ ID NO: 24085 - DNA, 30 bp, Artificial Sequence
  Description of Artificial Sequence: Synthetic oligonucleotide
aggaccaaactcaggactctgagcttgtgg

SEQ ID NO: 24086 - DNA, 29 bp, Artificial Sequence
  Description of Artificial Sequence: Synthetic oligonucleotide
ggaccaaactcaggactctgagcttgtgg

SEQ ID NO: 24087 - DNA, 30 bp, Artificial Sequence
  Description of Artificial Sequence: Synthetic oligonucleotide
gaccaaactcaggactctgagcttgtggag

SEQ ID NO: 24088 - DNA, 31 bp, Artificial Sequence
  Description of Artificial Sequence: Synthetic oligonucleotide
accaaactcaggactctgagcttgtggagac

SEQ ID NO: 24089 - DNA, 30 bp, Artificial Sequence
  Description of Artificial Sequence: Synthetic oligonucleotide
ccaaactcaggactctgagcttgtggagac

SEQ ID NO: 24090 - DNA, 30 bp, Artificial Sequence
  Description of Artificial Sequence: Synthetic oligonucleotide
caaactcaggactctgagcttgtggagacc

SEQ ID NO: 24091 - DNA, 31 bp, Artificial Sequence
  Description of Artificial Sequence: Synthetic oligonucleotide
aaactcaggactctgagcttgtggagaccag

SEQ ID NO: 24092 - DNA, 30 bp, Artificial Sequence
  Description of Artificial Sequence: Synthetic oligonucleotide
aactcaggactctgagcttgtggagaccag

SEQ ID NO: 24093 - DNA, 29 bp, Artificial Sequence
  Description of Artificial Sequence: Synthetic oligonucleotide
actcaggactctgagcttgtggagaccag

SEQ ID NO: 24094 - DNA, 28 bp, Artificial Sequence
  Description of Artificial Sequence: Synthetic oligonucleotide
ctcaggactctgagcttgtggagaccag

SEQ ID NO: 24095 - DNA, 29 bp, Artificial Sequence
  Description of Artificial Sequence: Synthetic oligonucleotide
tcaggactctgagcttgtggagaccagac

SEQ ID NO: 24096 - DNA, 28 bp, Artificial Sequence
  Description of Artificial Sequence: Synthetic oligonucleotide
caggactctgagcttgtggagaccagac

SEQ ID NO: 24097 - DNA, 28 bp, Artificial Sequence
  Description of Artificial Sequence: Synthetic oligonucleotide
aggactctgagcttgtggagaccagacc

SEQ ID NO: 24098 - DNA, 27 bp, Artificial Sequence
  Description of Artificial Sequence: Synthetic oligonucleotide
ggactctgagcttgtggagaccagacc

SEQ ID NO: 24099 - DNA, 28 bp, Artificial Sequence
  Description of Artificial Sequence: Synthetic oligonucleotide
gactctgagcttgtggagaccagaccag

SEQ ID NO: 24100 - DNA, 28 bp, Artificial Sequence
  Description of Artificial Sequence: Synthetic oligonucleotide
actctgagcttgtggagaccagaccagc

SEQ ID NO: 24101 - DNA, 27 bp, Artificial Sequence
  Description of Artificial Sequence: Synthetic oligonucleotide
ctctgagcttgtggagaccagaccagc

SEQ ID NO: 24102 - DNA, 28 bp, Artificial Sequence
  Description of Artificial Sequence: Synthetic oligonucleotide
tctgagcttgtggagaccagaccagcag

SEQ ID NO: 24103 - DNA, 29 bp, Artificial Sequence
  Description of Artificial Sequence: Synthetic oligonucleotide
ctggctgtcctagcagttgtggtcatcag

SEQ ID NO: 24104 - DNA, 30 bp, Artificial Sequence
  Description of Artificial Sequence: Synthetic oligonucleotide
tggctgtcctagcagttgtggtcatcagag

SEQ ID NO: 24105 - DNA, 29 bp, Artificial Sequence
  Description of Artificial Sequence: Synthetic oligonucleotide
ggctgtcctagcagttgtggtcatcagag

SEQ ID NO: 24106 - DNA, 29 bp, Artificial Sequence
  Description of Artificial Sequence: Synthetic oligonucleotide
gctgtcctagcagttgtggtcatcagagc

SEQ ID NO: 24107 - DNA, 30 bp, Artificial Sequence
  Description of Artificial Sequence: Synthetic oligonucleotide
ctgtcctagcagttgtggtcatcagagctg

SEQ ID NO: 24108 - DNA, 31 bp, Artificial Sequence
  Description of Artificial Sequence: Synthetic oligonucleotide
tgtcctagcagttgtggtcatcagagctgtg

SEQ ID NO: 24109 - DNA, 30 bp, Artificial Sequence
  Description of Artificial Sequence: Synthetic oligonucleotide
gtcctagcagttgtggtcatcagagctgtg

SEQ ID NO: 24110 - DNA, 30 bp, Artificial Sequence
  Description of Artificial Sequence: Synthetic oligonucleotide
tcctagcagttgtggtcatcagagctgtgg

SEQ ID NO: 24111 - DNA, 29 bp, Artificial Sequence
  Description of Artificial Sequence: Synthetic oligonucleotide
cctagcagttgtggtcatcagagctgtgg

SEQ ID NO: 24112 - DNA, 30 bp, Artificial Sequence
  Description of Artificial Sequence: Synthetic oligonucleotide
ctagcagttgtggtcatcagagctgtggtc

SEQ ID NO: 24113 - DNA, 30 bp, Artificial Sequence
  Description of Artificial Sequence: Synthetic oligonucleotide
tagcagttgtggtcatcagagctgtggtcg

SEQ ID NO: 24114 - DNA, 29 bp, Artificial Sequence
  Description of Artificial Sequence: Synthetic oligonucleotide
agcagttgtggtcatcagagctgtggtcg

SEQ ID NO: 24115 - DNA, 28 bp, Artificial Sequence
  Description of Artificial Sequence: Synthetic oligonucleotide
gcagttgtggtcatcagagctgtggtcg

SEQ ID NO: 24116 - DNA, 28 bp, Artificial Sequence
  Description of Artificial Sequence: Synthetic oligonucleotide
cagttgtggtcatcagagctgtggtcgc

SEQ ID NO: 24117 - DNA, 29 bp, Artificial Sequence
  Description of Artificial Sequence: Synthetic oligonucleotide
agttgtggtcatcagagctgtggtcgctg

SEQ ID NO: 24118 - DNA, 28 bp, Artificial Sequence
  Description of Artificial Sequence: Synthetic oligonucleotide
gttgtggtcatcagagctgtggtcgctg

SEQ ID NO: 24119 - DNA, 28 bp, Artificial Sequence
  Description of Artificial Sequence: Synthetic oligonucleotide
ttgtggtcatcagagctgtggtcgctgc

SEQ ID NO: 24120 - DNA, 27 bp, Artificial Sequence
  Description of Artificial Sequence: Synthetic oligonucleotide
tgtggtcatcagagctgtggtcgctgc

SEQ ID NO: 24121 - DNA, 27 bp, Artificial Sequence
  Description of Artificial Sequence: Synthetic oligonucleotide
gtggtcatcagagctgtggtcgctgct

SEQ ID NO: 24122 - DNA, 27 bp, Artificial Sequence
  Description of Artificial Sequence: Synthetic oligonucleotide
tggtcatcagagctgtggtcgctgctg

SEQ ID NO: 24123 - DNA, 27 bp, Artificial Sequence
  Description of Artificial Sequence: Synthetic oligonucleotide
ggtcatcagagctgtggtcgctgctgt

SEQ ID NO: 24124 - DNA, 27 bp, Artificial Sequence
  Description of Artificial Sequence: Synthetic oligonucleotide
gtcatcagagctgtggtcgctgctgtg

SEQ ID NO: 24125 - DNA, 29 bp, Artificial Sequence
  Description of Artificial Sequence: Synthetic oligonucleotide
tcatcagagctgtggtcgctgctgtgatg

SEQ ID NO: 24126 - DNA, 28 bp, Artificial Sequence
  Description of Artificial Sequence: Synthetic oligonucleotide
catcagagctgtggtcgctgctgtgatg

SEQ ID NO: 24127 - DNA, 29 bp, Artificial Sequence
  Description of Artificial Sequence: Synthetic oligonucleotide
atcagagctgtggtcgctgctgtgatgtg

SEQ ID NO: 24128 - DNA, 28 bp, Artificial Sequence
  Description of Artificial Sequence: Synthetic oligonucleotide
tcagagctgtggtcgctgctgtgatgtg

SEQ ID NO: 24129 - DNA, 27 bp, Artificial Sequence
  Description of Artificial Sequence: Synthetic oligonucleotide
cagagctgtggtcgctgctgtgatgtg

SEQ ID NO: 24130 - DNA, 29 bp, Artificial Sequence
  Description of Artificial Sequence: Synthetic oligonucleotide
agagctgtggtcgctgctgtgatgtgtag

SEQ ID NO: 24131 - DNA, 22 bp, Artificial Sequence
  Description of Artificial Sequence: Synthetic oligonucleotide
cgctcctggaccgccgcggaaa

SEQ ID NO: 24132 - DNA, 22 bp, Artificial Sequence
  Description of Artificial Sequence: Synthetic oligonucleotide
gctcctggaccgccgcggaaac

SEQ ID NO: 24133 - DNA, 22 bp, Artificial Sequence
  Description of Artificial Sequence: Synthetic oligonucleotide
ctcctggaccgccgcggaaacg

SEQ ID NO: 24134 - DNA, 22 bp, Artificial Sequence
  Description of Artificial Sequence: Synthetic oligonucleotide
tcctggaccgccgcggaaacgg

SEQ ID NO: 24135 - DNA, 21 bp, Artificial Sequence
  Description of Artificial Sequence: Synthetic oligonucleotide
cctggaccgccgcggaaacgg

SEQ ID NO: 24136 - DNA, 21 bp, Artificial Sequence
  Description of Artificial Sequence: Synthetic oligonucleotide
ctggaccgccgcggaaacggc

SEQ ID NO: 24137 - DNA, 21 bp, Artificial Sequence
  Description of Artificial Sequence: Synthetic oligonucleotide
tggaccgccgcggaaacggcg

SEQ ID NO: 24138 - DNA, 20 bp, Artificial Sequence
  Description of Artificial Sequence: Synthetic oligonucleotide
ggaccgccgcggaaacggcg

SEQ ID NO: 24139 - DNA, 20 bp, Artificial Sequence
  Description of Artificial Sequence: Synthetic oligonucleotide
gaccgccgcggaaacggcgg

SEQ ID NO: 24140 - DNA, 21 bp, Artificial Sequence
  Description of Artificial Sequence: Synthetic oligonucleotide
accgccgcggaaacggcggct

SEQ ID NO: 24141 - DNA, 20 bp, Artificial Sequence
  Description of Artificial Sequence: Synthetic oligonucleotide
ccgccgcggaaacggcggct

SEQ ID NO: 24142 - DNA, 21 bp, Artificial Sequence
  Description of Artificial Sequence: Synthetic oligonucleotide
cgccgcggaaacggcggctca

SEQ ID NO: 24143 - DNA, 23 bp, Artificial Sequence
  Description of Artificial Sequence: Synthetic oligonucleotide
gccgcggaaacggcggctcagat

SEQ ID NO: 24144 - DNA, 24 bp, Artificial Sequence
  Description of Artificial Sequence: Synthetic oligonucleotide
ccgcggaaacggcggctcagatca

SEQ ID NO: 24145 - DNA, 24 bp, Artificial Sequence
  Description of Artificial Sequence: Synthetic oligonucleotide
cgcggaaacggcggctcagatcac

SEQ ID NO: 24146 - DNA, 24 bp, Artificial Sequence
  Description of Artificial Sequence: Synthetic oligonucleotide
gcggaaacggcggctcagatcacc

SEQ ID NO: 24147 - DNA, 25 bp, Artificial Sequence
  Description of Artificial Sequence: Synthetic oligonucleotide
cggaaacggcggctcagatcaccca

SEQ ID NO: 24148 - DNA, 25 bp, Artificial Sequence
  Description of Artificial Sequence: Synthetic oligonucleotide
ggaaacggcggctcagatcacccag

SEQ ID NO: 24149 - DNA, 25 bp, Artificial Sequence
  Description of Artificial Sequence: Synthetic oligonucleotide
gaaacggcggctcagatcacccagc

SEQ ID NO: 24150 - DNA, 25 bp, Artificial Sequence
  Description of Artificial Sequence: Synthetic oligonucleotide
aaacggcggctcagatcacccagcg

SEQ ID NO: 24151 - DNA, 24 bp, Artificial Sequence
  Description of Artificial Sequence: Synthetic oligonucleotide
aacggcggctcagatcacccagcg

SEQ ID NO: 24152 - DNA, 22 bp, Artificial Sequence
  Description of Artificial Sequence: Synthetic oligonucleotide
cgacgccgcgagtccgagagac

SEQ ID NO: 24153 - DNA, 23 bp, Artificial Sequence
  Description of Artificial Sequence: Synthetic oligonucleotide
gacgccgcgagtccgagagacga

SEQ ID NO: 24154 - DNA, 23 bp, Artificial Sequence
  Description of Artificial Sequence: Synthetic oligonucleotide
acgccgcgagtccgagagacgag

SEQ ID NO: 24155 - DNA, 22 bp, Artificial Sequence
  Description of Artificial Sequence: Synthetic oligonucleotide
cgccgcgagtccgagagacgag

SEQ ID NO: 24156 - DNA, 22 bp, Artificial Sequence
  Description of Artificial Sequence: Synthetic oligonucleotide
gccgcgagtccgagagacgagc

SEQ ID NO: 24157 - DNA, 22 bp, Artificial Sequence
  Description of Artificial Sequence: Synthetic oligonucleotide
ccgcgagtccgagagacgagcc

SEQ ID NO: 24158 - DNA, 22 bp, Artificial Sequence
  Description of Artificial Sequence: Synthetic oligonucleotide
cgcgagtccgagagacgagccg

SEQ ID NO: 24159 - DNA, 22 bp, Artificial Sequence
  Description of Artificial Sequence: Synthetic oligonucleotide
gcgagtccgagagacgagccgc

SEQ ID NO: 24160 - DNA, 22 bp, Artificial Sequence
  Description of Artificial Sequence: Synthetic oligonucleotide
cgagtccgagagacgagccgcg

SEQ ID NO: 24161 - DNA, 22 bp, Artificial Sequence
  Description of Artificial Sequence: Synthetic oligonucleotide
gagtccgagagacgagccgcgg

SEQ ID NO: 24162 - DNA, 22 bp, Artificial Sequence
  Description of Artificial Sequence: Synthetic oligonucleotide
agtccgagagacgagccgcggg

SEQ ID NO: 24163 - DNA, 21 bp, Artificial Sequence
  Description of Artificial Sequence: Synthetic oligonucleotide
gtccgagagacgagccgcggg

SEQ ID NO: 24164 - DNA, 21 bp, Artificial Sequence
  Description of Artificial Sequence: Synthetic oligonucleotide
tccgagagacgagccgcgggc

SEQ ID NO: 24165 - DNA, 20 bp, Artificial Sequence
  Description of Artificial Sequence: Synthetic oligonucleotide
ccgagagacgagccgcgggc

SEQ ID NO: 24166 - DNA, 20 bp, Artificial Sequence
  Description of Artificial Sequence: Synthetic oligonucleotide
cgagagacgagccgcgggcg

SEQ ID NO: 24167 - DNA, 20 bp, Artificial Sequence
  Description of Artificial Sequence: Synthetic oligonucleotide
gagagacgagccgcgggcgc

SEQ ID NO: 24168 - DNA, 20 bp, Artificial Sequence
  Description of Artificial Sequence: Synthetic oligonucleotide
agagacgagccgcgggcgcc

SEQ ID NO: 24169 - DNA, 20 bp, Artificial Sequence
  Description of Artificial Sequence: Synthetic oligonucleotide
gagacgagccgcgggcgcct

SEQ ID NO: 24170 - DNA, 20 bp, Artificial Sequence
  Description of Artificial Sequence: Synthetic oligonucleotide
agacgagccgcgggcgccgt

SEQ ID NO: 24171 - DNA, 20 bp, Artificial Sequence
  Description of Artificial Sequence: Synthetic oligonucleotide
gacgagccgcgggcgccgtt

SEQ ID NO: 24172 - DNA, 20 bp, Artificial Sequence
  Description of Artificial Sequence: Synthetic oligonucleotide
acgagccgcgggcgccgtgt

SEQ ID NO: 24173 - DNA, 20 bp, Artificial Sequence
  Description of Artificial Sequence: Synthetic oligonucleotide
cgagccgcgggcgccgtgtt

SEQ ID NO: 24174 - DNA, 22 bp, Artificial Sequence
  Description of Artificial Sequence: Synthetic oligonucleotide
atgcgggtcacggcgccccgaa

SEQ ID NO: 24175 - DNA, 21 bp, Artificial Sequence
  Description of Artificial Sequence: Synthetic oligonucleotide
tgcgggtcacggcgccccgaa

SEQ ID NO: 24176 - DNA, 20 bp, Artificial Sequence
  Description of Artificial Sequence: Synthetic oligonucleotide
gcgggtcacggcgccccgaa

SEQ ID NO: 24177 - DNA, 20 bp, Artificial Sequence
  Description of Artificial Sequence: Synthetic oligonucleotide
cgggtcacggcgccccgaac

SEQ ID NO: 24178 - DNA, 20 bp, Artificial Sequence
  Description of Artificial Sequence: Synthetic oligonucleotide
gggtcacggcgccccgaacc

SEQ ID NO: 24179 - DNA, 21 bp, Artificial Sequence
  Description of Artificial Sequence: Synthetic oligonucleotide
ggtcacggcgccccgaaccgt

SEQ ID NO: 24180 - DNA, 21 bp, Artificial Sequence
  Description of Artificial Sequence: Synthetic oligonucleotide
gtcacggcgccccgaaccgtc

SEQ ID NO: 24181 - DNA, 22 bp, Artificial Sequence
  Description of Artificial Sequence: Synthetic oligonucleotide
tcacggcgccccgaaccgtcct

SEQ ID NO: 24182 - DNA, 21 bp, Artificial Sequence
  Description of Artificial Sequence: Synthetic oligonucleotide
cacggcgccccgaaccgtcct

SEQ ID NO: 24183 - DNA, 21 bp, Artificial Sequence
  Description of Artificial Sequence: Synthetic oligonucleotide
acggcgccccgaaccgtcctc

SEQ ID NO: 24184 - DNA, 20 bp, Artificial Sequence
  Description of Artificial Sequence: Synthetic oligonucleotide
cggcgccccgaaccgtcctc

SEQ ID NO: 24185 - DNA, 24 bp, Artificial Sequence
  Description of Artificial Sequence: Synthetic oligonucleotide
ccgaaccgtcctcctgctgctctg

SEQ ID NO: 24186 - DNA, 24 bp, Artificial Sequence
  Description of Artificial Sequence: Synthetic oligonucleotide
cgaaccgtcctcctgctgctctgg

SEQ ID NO: 24187 - DNA, 24 bp, Artificial Sequence
  Description of Artificial Sequence: Synthetic oligonucleotide
gaaccgtcctcctgctgctctggg

SEQ ID NO: 24188 - DNA, 24 bp, Artificial Sequence
  Description of Artificial Sequence: Synthetic oligonucleotide
aaccgtcctcctgctgctctgggg

SEQ ID NO: 24189 - DNA, 23 bp, Artificial Sequence
  Description of Artificial Sequence: Synthetic oligonucleotide
accgtcctcctgctgctctgggg

SEQ ID NO: 24190 - DNA, 22 bp, Artificial Sequence
  Description of Artificial Sequence: Synthetic oligonucleotide
ccgtcctcctgctgctctgggg

SEQ ID NO: 24191 - DNA, 22 bp, Artificial Sequence
  Description of Artificial Sequence: Synthetic oligonucleotide
cgtcctcctgctgctctggggg

SEQ ID NO: 24192 - DNA, 22 bp, Artificial Sequence
  Description of Artificial Sequence: Synthetic oligonucleotide
gtcctcctgctgctctgggggg

SEQ ID NO: 24193 - DNA, 23 bp, Artificial Sequence
  Description of Artificial Sequence: Synthetic oligonucleotide
tcctcctgctgctctggggggca

SEQ ID NO: 24194 - DNA, 22 bp, Artificial Sequence
  Description of Artificial Sequence: Synthetic oligonucleotide
cctcctgctgctctggggggca

SEQ ID NO: 24195 - DNA, 23 bp, Artificial Sequence
  Description of Artificial Sequence: Synthetic oligonucleotide
ctcctgctgctctggggggcagt

SEQ ID NO: 24196 - DNA, 23 bp, Artificial Sequence
  Description of Artificial Sequence: Synthetic oligonucleotide
tcctgctgctctggggggcagtg

SEQ ID NO: 24197 - DNA, 22 bp, Artificial Sequence
  Description of Artificial Sequence: Synthetic oligonucleotide
cctgctgctctggggggcagtg

SEQ ID NO: 24198 - DNA, 22 bp, Artificial Sequence
  Description of Artificial Sequence: Synthetic oligonucleotide
ctgctgctctggggggcagtgg

SEQ ID NO: 24199 - DNA, 22 bp, Artificial Sequence
  Description of Artificial Sequence: Synthetic oligonucleotide
tgctgctctggggggcagtggc

SEQ ID NO: 24200 - DNA, 21 bp, Artificial Sequence
  Description of Artificial Sequence: Synthetic oligonucleotide
gctgctctggggggcagtggc

SEQ ID NO: 24201 - DNA, 21 bp, Artificial Sequence
  Description of Artificial Sequence: Synthetic oligonucleotide
ctgctctggggggcagtggcc

SEQ ID NO: 24202 - DNA, 22 bp, Artificial Sequence
  Description of Artificial Sequence: Synthetic oligonucleotide
tgctctggggggcagtggccct

SEQ ID NO: 24203 - DNA, 21 bp, Artificial Sequence
  Description of Artificial Sequence: Synthetic oligonucleotide
gctctggggggcagtggccct

SEQ ID NO: 24204 - DNA, 22 bp, Artificial Sequence
  Description of Artificial Sequence: Synthetic oligonucleotide
ctctggggggcagtggccctga

SEQ ID NO: 24205 - DNA, 22 bp, Artificial Sequence
  Description of Artificial Sequence: Synthetic oligonucleotide
tctggggggcagtggccctgac

SEQ ID NO: 24206 - DNA, 21 bp, Artificial Sequence
  Description of Artificial Sequence: Synthetic oligonucleotide
ctggggggcagtggccctgac

SEQ ID NO: 24207 - DNA, 21 bp, Artificial Sequence
  Description of Artificial Sequence: Synthetic oligonucleotide
tggggggcagtggccctgacc

SEQ ID NO: 24208 - DNA, 20 bp, Artificial Sequence
  Description of Artificial Sequence: Synthetic oligonucleotide
ggggggcagtggccctgacc

SEQ ID NO: 24209 - DNA, 21 bp, Artificial Sequence
  Description of Artificial Sequence: Synthetic oligonucleotide
gggggcagtggccctgaccga

SEQ ID NO: 24210 - DNA, 22 bp, Artificial Sequence
  Description of Artificial Sequence: Synthetic oligonucleotide
ggggcagtggccctgaccgaga

SEQ ID NO: 24211 - DNA, 22 bp, Artificial Sequence
  Description of Artificial Sequence: Synthetic oligonucleotide
gggcagtggccctgaccgagac

SEQ ID NO: 24212 - DNA, 23 bp, Artificial Sequence
  Description of Artificial Sequence: Synthetic oligonucleotide
ggcagtggccctgaccgagacct

SEQ ID NO: 24213 - DNA, 23 bp, Artificial Sequence
  Description of Artificial Sequence: Synthetic oligonucleotide
gcagtggccctgaccgagacctg

SEQ ID NO: 24214 - DNA, 23 bp, Artificial Sequence
  Description of Artificial Sequence: Synthetic oligonucleotide
cagtggccctgaccgagacctgg

SEQ ID NO: 24215 - DNA, 23 bp, Artificial Sequence
  Description of Artificial Sequence: Synthetic oligonucleotide
agtggccctgaccgagacctggg

SEQ ID NO: 24216 - DNA, 22 bp, Artificial Sequence
  Description of Artificial Sequence: Synthetic oligonucleotide
gtggccctgaccgagacctggg

SEQ ID NO: 24217 - DNA, 30 bp, Artificial Sequence
  Description of Artificial Sequence: Synthetic oligonucleotide
ctcccactccatgaggtatttctacaccgc

SEQ ID NO: 24218 - DNA, 30 bp, Artificial Sequence
  Description of Artificial Sequence: Synthetic oligonucleotide
tcccactccatgaggtatttctacaccgcc

SEQ ID NO: 24219 - DNA, 29 bp, Artificial Sequence
  Description of Artificial Sequence: Synthetic oligonucleotide
cccactccatgaggtatttctacaccgcc

SEQ ID NO: 24220 - DNA, 31 bp, Artificial Sequence
  Description of Artificial Sequence: Synthetic oligonucleotide
ccactccatgaggtatttctacaccgccatg

SEQ ID NO: 24221 - DNA, 32 bp, Artificial Sequence
  Description of Artificial Sequence: Synthetic oligonucleotide
cactccatgaggtatttctacaccgccatgtc

SEQ ID NO: 24222 - DNA, 32 bp, Artificial Sequence
  Description of Artificial Sequence: Synthetic oligonucleotide
actccatgaggtatttctacaccgccatgtcc

SEQ ID NO: 24223 - DNA, 31 bp, Artificial Sequence
  Description of Artificial Sequence: Synthetic oligonucleotide
ctccatgaggtatttctacaccgccatgtcc

SEQ ID NO: 24224 - DNA, 31 bp, Artificial Sequence
  Description of Artificial Sequence: Synthetic oligonucleotide
tccatgaggtatttctacaccgccatgtccc

SEQ ID NO: 24225 - DNA, 30 bp, Artificial Sequence
  Description of Artificial Sequence: Synthetic oligonucleotide
ccatgaggtatttctacaccgccatgtccc

SEQ ID NO: 24226 - DNA, 30 bp, Artificial Sequence
  Description of Artificial Sequence: Synthetic oligonucleotide
catgaggtatttctacaccgccatgtcccg

SEQ ID NO: 24227 - DNA, 30 bp, Artificial Sequence
  Description of Artificial Sequence: Synthetic oligonucleotide
atgaggtatttctacaccgccatgtcccgg

SEQ ID NO: 24228 - DNA, 29 bp, Artificial Sequence
  Description of Artificial Sequence: Synthetic oligonucleotide
tgaggtatttctacaccgccatgtcccgg

SEQ ID NO: 24229 - DNA, 28 bp, Artificial Sequence
  Description of Artificial Sequence: Synthetic oligonucleotide
gaggtatttctacaccgccatgtcccgg

SEQ ID NO: 24230 - DNA, 28 bp, Artificial Sequence
  Description of Artificial Sequence: Synthetic oligonucleotide
aggtatttctacaccgccatgtcccggc

SEQ ID NO: 24231 - DNA, 27 bp, Artificial Sequence
  Description of Artificial Sequence: Synthetic oligonucleotide
ggtatttctacaccgccatgtcccggc

SEQ ID NO: 24232 - DNA, 27 bp, Artificial Sequence
  Description of Artificial Sequence: Synthetic oligonucleotide
gtatttctacaccgccatgtcccggcc

SEQ ID NO: 24233 - DNA, 27 bp, Artificial Sequence
  Description of Artificial Sequence: Synthetic oligonucleotide
tatttctacaccgccatgtcccggccc

SEQ ID NO: 24234 - DNA, 26 bp, Artificial Sequence
  Description of Artificial Sequence: Synthetic oligonucleotide
atttctacaccgccatgtcccggccc

SEQ ID NO: 24235 - DNA, 25 bp, Artificial Sequence
  Description of Artificial Sequence: Synthetic oligonucleotide
tttctacaccgccatgtcccggccc

SEQ ID NO: 24236 - DNA, 24 bp, Artificial Sequence
  Description of Artificial Sequence: Synthetic oligonucleotide
ttctacaccgccatgtcccggccc

SEQ ID NO: 24237 - DNA, 23 bp, Artificial Sequence
  Description of Artificial Sequence: Synthetic oligonucleotide
tctacaccgccatgtcccggccc

SEQ ID NO: 24238 - DNA, 22 bp, Artificial Sequence
  Description of Artificial Sequence: Synthetic oligonucleotide
ctacaccgccatgtcccggccc

SEQ ID NO: 24239 - DNA, 22 bp, Artificial Sequence
  Description of Artificial Sequence: Synthetic oligonucleotide
tacaccgccatgtcccggcccg

SEQ ID NO: 24240 - DNA, 27 bp, Artificial Sequence
  Description of Artificial Sequence: Synthetic oligonucleotide
attgcagtgggctacgtggacgacacc

SEQ ID NO: 24241 - DNA, 26 bp, Artificial Sequence
  Description of Artificial Sequence: Synthetic oligonucleotide
ttgcagtgggctacgtggacgacacc

SEQ ID NO: 24242 - DNA, 25 bp, Artificial Sequence
  Description of Artificial Sequence: Synthetic oligonucleotide
tgcagtgggctacgtggacgacacc

SEQ ID NO: 24243 - DNA, 24 bp, Artificial Sequence
  Description of Artificial Sequence: Synthetic oligonucleotide
gcagtgggctacgtggacgacacc

SEQ ID NO: 24244 - DNA, 22 bp, Artificial Sequence
  Description of Artificial Sequence: Synthetic oligonucleotide
acagcgacgccgcgagtccgag

SEQ ID NO: 24245 - DNA, 21 bp, Artificial Sequence
  Description of Artificial Sequence: Synthetic oligonucleotide
cagcgacgccgcgagtccgag

SEQ ID NO: 24246 - DNA, 22 bp, Artificial Sequence
  Description of Artificial Sequence: Synthetic oligonucleotide
agcgacgccgcgagtccgagga

SEQ ID NO: 24247 - DNA, 21 bp, Artificial Sequence
  Description of Artificial Sequence: Synthetic oligonucleotide
gcgacgccgcgagtccgagga

SEQ ID NO: 24248 - DNA, 21 bp, Artificial Sequence
  Description of Artificial Sequence: Synthetic oligonucleotide
cgacgccgcgagtccgaggac

SEQ ID NO: 24249 - DNA, 21 bp, Artificial Sequence
  Description of Artificial Sequence: Synthetic oligonucleotide
gacgccgcgagtccgaggacg

SEQ ID NO: 24250 - DNA, 22 bp, Artificial Sequence
  Description of Artificial Sequence: Synthetic oligonucleotide
acgccgcgagtccgaggacgga

SEQ ID NO: 24251 - DNA, 21 bp, Artificial Sequence
  Description of Artificial Sequence: Synthetic oligonucleotide
cgccgcgagtccgaggacgga

SEQ ID NO: 24252 - DNA, 21 bp, Artificial Sequence
  Description of Artificial Sequence: Synthetic oligonucleotide
gccgcgagtccgaggacggag

SEQ ID NO: 24253 - DNA, 21 bp, Artificial Sequence
  Description of Artificial Sequence: Synthetic oligonucleotide
ccgcgagtccgaggacggagc

SEQ ID NO: 24254 - DNA, 21 bp, Artificial Sequence
  Description of Artificial Sequence: Synthetic oligonucleotide
cgcgagtccgaggacggagcc

SEQ ID NO: 24255 - DNA, 21 bp, Artificial Sequence
  Description of Artificial Sequence: Synthetic oligonucleotide
gcgagtccgaggacggagccc

SEQ ID NO: 24256 - DNA, 21 bp, Artificial Sequence
  Description of Artificial Sequence: Synthetic oligonucleotide
cgagtccgaggacggagcccc

SEQ ID NO: 24257 - DNA, 21 bp, Artificial Sequence
  Description of Artificial Sequence: Synthetic oligonucleotide
gagtccgaggacggagccccg

SEQ ID NO: 24258 - DNA, 21 bp, Artificial Sequence
  Description of Artificial Sequence: Synthetic oligonucleotide
agtccgaggacggagccccgg

SEQ ID NO: 24259 - DNA, 20 bp, Artificial Sequence
  Description of Artificial Sequence: Synthetic oligonucleotide
gtccgaggacggagccccgg

SEQ ID NO: 24260 - DNA, 20 bp, Artificial Sequence
  Description of Artificial Sequence: Synthetic oligonucleotide
tccgaggacggagccccggg

SEQ ID NO: 24261 - DNA, 20 bp, Artificial Sequence
  Description of Artificial Sequence: Synthetic oligonucleotide
ccgaggacggagccccgggt

SEQ ID NO: 24262 - DNA, 20 bp, Artificial Sequence
  Description of Artificial Sequence: Synthetic oligonucleotide
cgaggacggagccccgggct

SEQ ID NO: 24263 - DNA, 20 bp, Artificial Sequence
  Description of Artificial Sequence: Synthetic oligonucleotide
gaggacggagccccgggcgt

SEQ ID NO: 24264 - DNA, 20 bp, Artificial Sequence
  Description of Artificial Sequence: Synthetic oligonucleotide
aggacggagccccgggcgct

SEQ ID NO: 24265 - DNA, 20 bp, Artificial Sequence
  Description of Artificial Sequence: Synthetic oligonucleotide
ggacggagccccgggcgctt

SEQ ID NO: 24266 - DNA, 20 bp, Artificial Sequence
  Description of Artificial Sequence: Synthetic oligonucleotide
gacggagccccgggcgccat

SEQ ID NO: 24267 - DNA, 20 bp, Artificial Sequence
  Description of Artificial Sequence: Synthetic oligonucleotide
acggagccccgggcgccatg

SEQ ID NO: 24268 - DNA, 20 bp, Artificial Sequence
  Description of Artificial Sequence: Synthetic oligonucleotide
cggagccccgggcgccatgt

SEQ ID NO: 24269 - DNA, 22 bp, Artificial Sequence
  Description of Artificial Sequence: Synthetic oligonucleotide
ggagccccgggcgccatggata

SEQ ID NO: 24270 - DNA, 23 bp, Artificial Sequence
  Description of Artificial Sequence: Synthetic oligonucleotide
gagccccgggcgccatggataga

SEQ ID NO: 24271 - DNA, 23 bp, Artificial Sequence
  Description of Artificial Sequence: Synthetic oligonucleotide
agccccgggcgccatggatagag

SEQ ID NO: 24272 - DNA, 22 bp, Artificial Sequence
  Description of Artificial Sequence: Synthetic oligonucleotide
gccccgggcgccatggatagag

SEQ ID NO: 24273 - DNA, 23 bp, Artificial Sequence
  Description of Artificial Sequence: Synthetic oligonucleotide
ccccgggcgccatggatagagca

SEQ ID NO: 24274 - DNA, 23 bp, Artificial Sequence
  Description of Artificial Sequence: Synthetic oligonucleotide
cccgggcgccatggatagagcag

SEQ ID NO: 24275 - DNA, 24 bp, Artificial Sequence
  Description of Artificial Sequence: Synthetic oligonucleotide
ccgggcgccatggatagagcagga

SEQ ID NO: 24276 - DNA, 24 bp, Artificial Sequence
  Description of Artificial Sequence: Synthetic oligonucleotide
ggcgccatggatagagcaggaggg

SEQ ID NO: 24277 - DNA, 24 bp, Artificial Sequence
  Description of Artificial Sequence: Synthetic oligonucleotide
gcgccatggatagagcaggagggg

SEQ ID NO: 24278 - DNA, 24 bp, Artificial Sequence
  Description of Artificial Sequence: Synthetic oligonucleotide
cgccatggatagagcaggaggggc

SEQ ID NO: 24279 - DNA, 24 bp, Artificial Sequence
  Description of Artificial Sequence: Synthetic oligonucleotide
gccatggatagagcaggaggggcc

SEQ ID NO: 24280 - DNA, 24 bp, Artificial Sequence
  Description of Artificial Sequence: Synthetic oligonucleotide
ccatggatagagcaggaggggccg

SEQ ID NO: 24281 - DNA, 25 bp, Artificial Sequence
  Description of Artificial Sequence: Synthetic oligonucleotide
catggatagagcaggaggggccgga

SEQ ID NO: 24282 - DNA, 27 bp, Artificial Sequence
  Description of Artificial Sequence: Synthetic oligonucleotide
atggatagagcaggaggggccggagta

SEQ ID NO: 24283 - DNA, 27 bp, Artificial Sequence
  Description of Artificial Sequence: Synthetic oligonucleotide
tatttctacacctccgtgtcccggccg

SEQ ID NO: 24284 - DNA, 26 bp, Artificial Sequence
  Description of Artificial Sequence: Synthetic oligonucleotide
atttctacacctccgtgtcccggccg

SEQ ID NO: 24285 - DNA, 25 bp, Artificial Sequence
  Description of Artificial Sequence: Synthetic oligonucleotide
tttctacacctccgtgtcccggccg

SEQ ID NO: 24286 - DNA, 24 bp, Artificial Sequence
  Description of Artificial Sequence: Synthetic oligonucleotide
ttctacacctccgtgtcccggccg

SEQ ID NO: 24287 - DNA, 23 bp, Artificial Sequence
  Description of Artificial Sequence: Synthetic oligonucleotide
tctacacctccgtgtcccggccg

SEQ ID NO: 24288 - DNA, 22 bp, Artificial Sequence
  Description of Artificial Sequence: Synthetic oligonucleotide
ctacacctccgtgtcccggccg

SEQ ID NO: 24289 - DNA, 22 bp, Artificial Sequence
  Description of Artificial Sequence: Synthetic oligonucleotide
tacacctccgtgtcccggccgg

SEQ ID NO: 24290 - DNA, 21 bp, Artificial Sequence
  Description of Artificial Sequence: Synthetic oligonucleotide
acacctccgtgtcccggccgg

SEQ ID NO: 24291 - DNA, 20 bp, Artificial Sequence
  Description of Artificial Sequence: Synthetic oligonucleotide
cacctccgtgtcccggccgg

SEQ ID NO: 24292 - DNA, 20 bp, Artificial Sequence
  Description of Artificial Sequence: Synthetic oligonucleotide
acctccgtgtcccggccggc

SEQ ID NO: 24293 - DNA, 20 bp, Artificial Sequence
  Description of Artificial Sequence: Synthetic oligonucleotide
cctccgtgtcccggccggct

SEQ ID NO: 24294 - DNA, 20 bp, Artificial Sequence
  Description of Artificial Sequence: Synthetic oligonucleotide
ctccgtgtcccggccggcct

SEQ ID NO: 24295 - DNA, 20 bp, Artificial Sequence
  Description of Artificial Sequence: Synthetic oligonucleotide
tccgtgtcccggccggccgt

SEQ ID NO: 24296 - DNA, 20 bp, Artificial Sequence
  Description of Artificial Sequence: Synthetic oligonucleotide
ccgtgtcccggccggccgtt

SEQ ID NO: 24297 - DNA, 20 bp, Artificial Sequence
  Description of Artificial Sequence: Synthetic oligonucleotide
cgtgtcccggccggccgctt

SEQ ID NO: 24298 - DNA, 20 bp, Artificial Sequence
  Description of Artificial Sequence: Synthetic oligonucleotide
gtgtcccggccggccgcgtt

SEQ ID NO: 24299 - DNA, 20 bp, Artificial Sequence
  Description of Artificial Sequence: Synthetic oligonucleotide
tgtcccggccggccgcggtt

SEQ ID NO: 24300 - DNA, 20 bp, Artificial Sequence
  Description of Artificial Sequence: Synthetic oligonucleotide
gtcccggccggccgcggttt

SEQ ID NO: 24301 - DNA, 20 bp, Artificial Sequence
  Description of Artificial Sequence: Synthetic oligonucleotide
tcccggccggccgcgggttt

SEQ ID NO: 24302 - DNA, 20 bp, Artificial Sequence
  Description of Artificial Sequence: Synthetic oligonucleotide
cccggccggccgcgggtttt

SEQ ID NO: 24303 - DNA, 20 bp, Artificial Sequence
  Description of Artificial Sequence: Synthetic oligonucleotide
ccggccggccgcggggattt

SEQ ID NO: 24304 - DNA, 20 bp, Artificial Sequence
  Description of Artificial Sequence: Synthetic oligonucleotide
cggccggccgcggggagttt

SEQ ID NO: 24305 - DNA, 20 bp, Artificial Sequence
  Description of Artificial Sequence: Synthetic oligonucleotide
ggccggccgcggggagcttt

SEQ ID NO: 24306 - DNA, 20 bp, Artificial Sequence
  Description of Artificial Sequence: Synthetic oligonucleotide
gccggccgcggggagccttt

SEQ ID NO: 24307 - DNA, 21 bp, Artificial Sequence
  Description of Artificial Sequence: Synthetic oligonucleotide
tcctggaccgcggcggacacc

SEQ ID NO: 24308 - DNA, 20 bp, Artificial Sequence
  Description of Artificial Sequence: Synthetic oligonucleotide
cctggaccgcggcggacacc

SEQ ID NO: 24309 - DNA, 20 bp, Artificial Sequence
  Description of Artificial Sequence: Synthetic oligonucleotide
ctggaccgcggcggacaccg

SEQ ID NO: 24310 - DNA, 32 bp, Artificial Sequence
  Description of Artificial Sequence: Synthetic oligonucleotide
tattgggaccggaacacacagatctgcaagac

SEQ ID NO: 24311 - DNA, 31 bp, Artificial Sequence
  Description of Artificial Sequence: Synthetic oligonucleotide
attgggaccggaacacacagatctgcaagac

SEQ ID NO: 24312 - DNA, 30 bp, Artificial Sequence
  Description of Artificial Sequence: Synthetic oligonucleotide
ttgggaccggaacacacagatctgcaagac

SEQ ID NO: 24313 - DNA, 29 bp, Artificial Sequence
  Description of Artificial Sequence: Synthetic oligonucleotide
tgggaccggaacacacagatctgcaagac

SEQ ID NO: 24314 - DNA, 28 bp, Artificial Sequence
  Description of Artificial Sequence: Synthetic oligonucleotide
gggaccggaacacacagatctgcaagac

SEQ ID NO: 24315 - DNA, 28 bp, Artificial Sequence
  Description of Artificial Sequence: Synthetic oligonucleotide
ggaccggaacacacagatctgcaagacc

SEQ ID NO: 24316 - DNA, 30 bp, Artificial Sequence
  Description of Artificial Sequence: Synthetic oligonucleotide
gaccggaacacacagatctgcaagaccaac

SEQ ID NO: 24317 - DNA, 31 bp, Artificial Sequence
  Description of Artificial Sequence: Synthetic oligonucleotide
accggaacacacagatctgcaagaccaacac

SEQ ID NO: 24318 - DNA, 30 bp, Artificial Sequence
  Description of Artificial Sequence: Synthetic oligonucleotide
ccggaacacacagatctgcaagaccaacac

SEQ ID NO: 24319 - DNA, 31 bp, Artificial Sequence
  Description of Artificial Sequence: Synthetic oligonucleotide
cggaacacacagatctgcaagaccaacacac

SEQ ID NO: 24320 - DNA, 32 bp, Artificial Sequence
  Description of Artificial Sequence: Synthetic oligonucleotide
ggaacacacagatctgcaagaccaacacacag

SEQ ID NO: 24321 - DNA, 33 bp, Artificial Sequence
  Description of Artificial Sequence: Synthetic oligonucleotide
gaacacacagatctgcaagaccaacacacagac

SEQ ID NO: 24322 - DNA, 34 bp, Artificial Sequence
  Description of Artificial Sequence: Synthetic oligonucleotide
aacacacagatctgcaagaccaacacacagactg

SEQ ID NO: 24323 - DNA, 33 bp, Artificial Sequence
  Description of Artificial Sequence: Synthetic oligonucleotide
acacacagatctgcaagaccaacacacagactg

SEQ ID NO: 24324 - DNA, 32 bp, Artificial Sequence
  Description of Artificial Sequence: Synthetic oligonucleotide
cacacagatctgcaagaccaacacacagactg

SEQ ID NO: 24325 - DNA, 33 bp, Artificial Sequence
  Description of Artificial Sequence: Synthetic oligonucleotide
acacagatctgcaagaccaacacacagactgac

SEQ ID NO: 24326 - DNA, 32 bp, Artificial Sequence
  Description of Artificial Sequence: Synthetic oligonucleotide
cacagatctgcaagaccaacacacagactgac

SEQ ID NO: 24327 - DNA, 32 bp, Artificial Sequence
  Description of Artificial Sequence: Synthetic oligonucleotide
acagatctgcaagaccaacacacagactgacc

SEQ ID NO: 24328 - DNA, 31 bp, Artificial Sequence
  Description of Artificial Sequence: Synthetic oligonucleotide
cagatctgcaagaccaacacacagactgacc

SEQ ID NO: 24329 - DNA, 31 bp, Artificial Sequence
  Description of Artificial Sequence: Synthetic oligonucleotide
agatctgcaagaccaacacacagactgaccg

SEQ ID NO: 24330 - DNA, 30 bp, Artificial Sequence
  Description of Artificial Sequence: Synthetic oligonucleotide
gatctgcaagaccaacacacagactgaccg

SEQ ID NO: 24331 - DNA, 31 bp, Artificial Sequence
  Description of Artificial Sequence: Synthetic oligonucleotide
atctgcaagaccaacacacagactgaccgag

SEQ ID NO: 24332 - DNA, 30 bp, Artificial Sequence
  Description of Artificial Sequence: Synthetic oligonucleotide
tctgcaagaccaacacacagactgaccgag

SEQ ID NO: 24333 - DNA, 29 bp, Artificial Sequence
  Description of Artificial Sequence: Synthetic oligonucleotide
ctgcaagaccaacacacagactgaccgag

SEQ ID NO: 24334 - DNA, 30 bp, Artificial Sequence
  Description of Artificial Sequence: Synthetic oligonucleotide
tgcaagaccaacacacagactgaccgagag

SEQ ID NO: 24335 - DNA, 29 bp, Artificial Sequence
  Description of Artificial Sequence: Synthetic oligonucleotide
gcaagaccaacacacagactgaccgagag

SEQ ID NO: 24336 - DNA, 29 bp, Artificial Sequence
  Description of Artificial Sequence: Synthetic oligonucleotide
gctcccactccatgaggtatttctgcacc

SEQ ID NO: 24337 - DNA, 30 bp, Artificial Sequence
  Description of Artificial Sequence: Synthetic oligonucleotide
ctcccactccatgaggtatttctgcacctc

SEQ ID NO: 24338 - DNA, 30 bp, Artificial Sequence
  Description of Artificial Sequence: Synthetic oligonucleotide
tcccactccatgaggtatttctgcacctcc

SEQ ID NO: 24339 - DNA, 29 bp, Artificial Sequence
  Description of Artificial Sequence: Synthetic oligonucleotide
cccactccatgaggtatttctgcacctcc

SEQ ID NO: 24340 - DNA, 29 bp, Artificial Sequence
  Description of Artificial Sequence: Synthetic oligonucleotide
ccactccatgaggtatttctgcacctccg

SEQ ID NO: 24341 - DNA, 30 bp, Artificial Sequence
  Description of Artificial Sequence: Synthetic oligonucleotide
cactccatgaggtatttctgcacctccgtg

SEQ ID NO: 24342 - DNA, 31 bp, Artificial Sequence
  Description of Artificial Sequence: Synthetic oligonucleotide
actccatgaggtatttctgcacctccgtgtc

SEQ ID NO: 24343 - DNA, 30 bp, Artificial Sequence
  Description of Artificial Sequence: Synthetic oligonucleotide
ctccatgaggtatttctgcacctccgtgtc

SEQ ID NO: 24344 - DNA, 30 bp, Artificial Sequence
  Description of Artificial Sequence: Synthetic oligonucleotide
tccatgaggtatttctgcacctccgtgtcc

SEQ ID NO: 24345 - DNA, 29 bp, Artificial Sequence
  Description of Artificial Sequence: Synthetic oligonucleotide
ccatgaggtatttctgcacctccgtgtcc

SEQ ID NO: 24346 - DNA, 29 bp, Artificial Sequence
  Description of Artificial Sequence: Synthetic oligonucleotide
catgaggtatttctgcacctccgtgtccc

SEQ ID NO: 24347 - DNA, 29 bp, Artificial Sequence
  Description of Artificial Sequence: Synthetic oligonucleotide
atgaggtatttctgcacctccgtgtcccg

SEQ ID NO: 24348 - DNA, 28 bp, Artificial Sequence
  Description of Artificial Sequence: Synthetic oligonucleotide
tgaggtatttctgcacctccgtgtcccg

SEQ ID NO: 24349 - DNA, 27 bp, Artificial Sequence
  Description of Artificial Sequence: Synthetic oligonucleotide
gaggtatttctgcacctccgtgtcccg

SEQ ID NO: 24350 - DNA, 27 bp, Artificial Sequence
  Description of Artificial Sequence: Synthetic oligonucleotide
aggtatttctgcacctccgtgtcccgg

SEQ ID NO: 24351 - DNA, 26 bp, Artificial Sequence
  Description of Artificial Sequence: Synthetic oligonucleotide
ggtatttctgcacctccgtgtcccgg

SEQ ID NO: 24352 - DNA, 26 bp, Artificial Sequence
  Description of Artificial Sequence: Synthetic oligonucleotide
gtatttctgcacctccgtgtcccggc

SEQ ID NO: 24353 - DNA, 26 bp, Artificial Sequence
  Description of Artificial Sequence: Synthetic oligonucleotide
tatttctgcacctccgtgtcccggcc

SEQ ID NO: 24354 - DNA, 25 bp, Artificial Sequence
  Description of Artificial Sequence: Synthetic oligonucleotide
atttctgcacctccgtgtcccggcc

SEQ ID NO: 24355 - DNA, 24 bp, Artificial Sequence
  Description of Artificial Sequence: Synthetic oligonucleotide
tttctgcacctccgtgtcccggcc

SEQ ID NO: 24356 - DNA, 23 bp, Artificial Sequence
  Description of Artificial Sequence: Synthetic oligonucleotide
ttctgcacctccgtgtcccggcc

SEQ ID NO: 24357 - DNA, 22 bp, Artificial Sequence
  Description of Artificial Sequence: Synthetic oligonucleotide
tctgcacctccgtgtcccggcc

SEQ ID NO: 24358 - DNA, 21 bp, Artificial Sequence
  Description of Artificial Sequence: Synthetic oligonucleotide
ctgcacctccgtgtcccggcc

SEQ ID NO: 24359 - DNA, 21 bp, Artificial Sequence
  Description of Artificial Sequence: Synthetic oligonucleotide
tgcacctccgtgtcccggccc

SEQ ID NO: 24360 - DNA, 20 bp, Artificial Sequence
  Description of Artificial Sequence: Synthetic oligonucleotide
gcacctccgtgtcccggccc

SEQ ID NO: 24361 - DNA, 31 bp, Artificial Sequence
  Description of Artificial Sequence: Synthetic oligonucleotide
gctcccactccatgacgtatttctacacctc

SEQ ID NO: 24362 - DNA, 31 bp, Artificial Sequence
  Description of Artificial Sequence: Synthetic oligonucleotide
ctcccactccatgacgtatttctacacctcc

SEQ ID NO: 24363 - DNA, 31 bp, Artificial Sequence
  Description of Artificial Sequence: Synthetic oligonucleotide
tcccactccatgacgtatttctacacctccg

SEQ ID NO: 24364 - DNA, 30 bp, Artificial Sequence
  Description of Artificial Sequence: Synthetic oligonucleotide
cccactccatgacgtatttctacacctccg

SEQ ID NO: 24365 - DNA, 31 bp, Artificial Sequence
  Description of Artificial Sequence: Synthetic oligonucleotide
ccactccatgacgtatttctacacctccgtg

SEQ ID NO: 24366 - DNA, 32 bp, Artificial Sequence
  Description of Artificial Sequence: Synthetic oligonucleotide
cactccatgacgtatttctacacctccgtgtc

SEQ ID NO: 24367 - DNA, 32 bp, Artificial Sequence
  Description of Artificial Sequence: Synthetic oligonucleotide
actccatgacgtatttctacacctccgtgtcc

SEQ ID NO: 24368 - DNA, 31 bp, Artificial Sequence
  Description of Artificial Sequence: Synthetic oligonucleotide
ctccatgacgtatttctacacctccgtgtcc

SEQ ID NO: 24369 - DNA, 31 bp, Artificial Sequence
  Description of Artificial Sequence: Synthetic oligonucleotide
tccatgacgtatttctacacctccgtgtccc

SEQ ID NO: 24370 - DNA, 30 bp, Artificial Sequence
  Description of Artificial Sequence: Synthetic oligonucleotide
ccatgacgtatttctacacctccgtgtccc

SEQ ID NO: 24371 - DNA, 30 bp, Artificial Sequence
  Description of Artificial Sequence: Synthetic oligonucleotide
catgacgtatttctacacctccgtgtcccg

SEQ ID NO: 24372 - DNA, 30 bp, Artificial Sequence
  Description of Artificial Sequence: Synthetic oligonucleotide
atgacgtatttctacacctccgtgtcccgg

SEQ ID NO: 24373 - DNA, 29 bp, Artificial Sequence
  Description of Artificial Sequence: Synthetic oligonucleotide
tgacgtatttctacacctccgtgtcccgg

SEQ ID NO: 24374 - DNA, 28 bp, Artificial Sequence
  Description of Artificial Sequence: Synthetic oligonucleotide
gacgtatttctacacctccgtgtcccgg

SEQ ID NO: 24375 - DNA, 28 bp, Artificial Sequence
  Description of Artificial Sequence: Synthetic oligonucleotide
acgtatttctacacctccgtgtcccggc

SEQ ID NO: 24376 - DNA, 27 bp, Artificial Sequence
  Description of Artificial Sequence: Synthetic oligonucleotide
cgtatttctacacctccgtgtcccggc

SEQ ID NO: 24377 - DNA, 26 bp, Artificial Sequence
  Description of Artificial Sequence: Synthetic oligonucleotide
tcagtgggctacgtggacgacacgct

SEQ ID NO: 24378 - DNA, 25 bp, Artificial Sequence
  Description of Artificial Sequence: Synthetic oligonucleotide
cagtgggctacgtggacgacacgct

SEQ ID NO: 24379 - DNA, 27 bp, Artificial Sequence
  Description of Artificial Sequence: Synthetic oligonucleotide
agtgggctacgtggacgacacgctgtt

SEQ ID NO: 24380 - DNA, 26 bp, Artificial Sequence
  Description of Artificial Sequence: Synthetic oligonucleotide
gtgggctacgtggacgacacgctgtt

SEQ ID NO: 24381 - DNA, 26 bp, Artificial Sequence
  Description of Artificial Sequence: Synthetic oligonucleotide
tgggctacgtggacgacacgctgttc

SEQ ID NO: 24382 - DNA, 25 bp, Artificial Sequence
  Description of Artificial Sequence: Synthetic oligonucleotide
gggctacgtggacgacacgctgttc

SEQ ID NO: 24383 - DNA, 26 bp, Artificial Sequence
  Description of Artificial Sequence: Synthetic oligonucleotide
ggctacgtggacgacacgctgttcgt

SEQ ID NO: 24384 - DNA, 27 bp, Artificial Sequence
  Description of Artificial Sequence: Synthetic oligonucleotide
gctacgtggacgacacgctgttcgtga

SEQ ID NO: 24385 - DNA, 27 bp, Artificial Sequence
  Description of Artificial Sequence: Synthetic oligonucleotide
ctacgtggacgacacgctgttcgtgag

SEQ ID NO: 24386 - DNA, 27 bp, Artificial Sequence
  Description of Artificial Sequence: Synthetic oligonucleotide
tacgtggacgacacgctgttcgtgagg

SEQ ID NO: 24387 - DNA, 27 bp, Artificial Sequence
  Description of Artificial Sequence: Synthetic oligonucleotide
acgtggacgacacgctgttcgtgaggt

SEQ ID NO: 24388 - DNA, 27 bp, Artificial Sequence
  Description of Artificial Sequence: Synthetic oligonucleotide
cgtggacgacacgctgttcgtgaggtt

SEQ ID NO: 24389 - DNA, 27 bp, Artificial Sequence
  Description of Artificial Sequence: Synthetic oligonucleotide
gtggacgacacgctgttcgtgaggttc

SEQ ID NO: 24390 - DNA, 27 bp, Artificial Sequence
  Description of Artificial Sequence: Synthetic oligonucleotide
tggacgacacgctgttcgtgaggttcg

SEQ ID NO: 24391 - DNA, 27 bp, Artificial Sequence
  Description of Artificial Sequence: Synthetic oligonucleotide
ggacgacacgctgttcgtgaggttcga

SEQ ID NO: 24392 - DNA, 27 bp, Artificial Sequence
  Description of Artificial Sequence: Synthetic oligonucleotide
gacgacacgctgttcgtgaggttcgac

SEQ ID NO: 24393 - DNA, 28 bp, Artificial Sequence
  Description of Artificial Sequence: Synthetic oligonucleotide
acgacacgctgttcgtgaggttcgacag

SEQ ID NO: 24394 - DNA, 27 bp, Artificial Sequence
  Description of Artificial Sequence: Synthetic oligonucleotide
cgacacgctgttcgtgaggttcgacag

SEQ ID NO: 24395 - DNA, 27 bp, Artificial Sequence
  Description of Artificial Sequence: Synthetic oligonucleotide
gacacgctgttcgtgaggttcgacagc

SEQ ID NO: 24396 - DNA, 27 bp, Artificial Sequence
  Description of Artificial Sequence: Synthetic oligonucleotide
acacgctgttcgtgaggttcgacagcg

SEQ ID NO: 24397 - DNA, 27 bp, Artificial Sequence
  Description of Artificial Sequence: Synthetic oligonucleotide
cacgctgttcgtgaggttcgacagcga

SEQ ID NO: 24398 - DNA, 27 bp, Artificial Sequence
  Description of Artificial Sequence: Synthetic oligonucleotide
acgctgttcgtgaggttcgacagcgac

SEQ ID NO: 24399 - DNA, 26 bp, Artificial Sequence
  Description of Artificial Sequence: Synthetic oligonucleotide
cgctgttcgtgaggttcgacagcgac

SEQ ID NO: 24400 - DNA, 26 bp, Artificial Sequence
  Description of Artificial Sequence: Synthetic oligonucleotide
gctgttcgtgaggttcgacagcgacg

SEQ ID NO: 24401 - DNA, 26 bp, Artificial Sequence
  Description of Artificial Sequence: Synthetic oligonucleotide
ctgttcgtgaggttcgacagcgacgc

SEQ ID NO: 24402 - DNA, 26 bp, Artificial Sequence
  Description of Artificial Sequence: Synthetic oligonucleotide
tgttcgtgaggttcgacagcgacgcc

SEQ ID NO: 24403 - DNA, 20 bp, Artificial Sequence
  Description of Artificial Sequence: Synthetic oligonucleotide
gggccggacgggcgccgttt

SEQ ID NO: 24404 - DNA, 20 bp, Artificial Sequence
  Description of Artificial Sequence: Synthetic oligonucleotide
ggccggacgggcgccgcttt

SEQ ID NO: 24405 - DNA, 20 bp, Artificial Sequence
  Description of Artificial Sequence: Synthetic oligonucleotide
gccggacgggcgccgccttt

SEQ ID NO: 24406 - DNA, 20 bp, Artificial Sequence
  Description of Artificial Sequence: Synthetic oligonucleotide
ccggacgggcgccgcctctt

SEQ ID NO: 24407 - DNA, 20 bp, Artificial Sequence
  Description of Artificial Sequence: Synthetic oligonucleotide
cggacgggcgccgcctcctt

SEQ ID NO: 24408 - DNA, 20 bp, Artificial Sequence
  Description of Artificial Sequence: Synthetic oligonucleotide
ggacgggcgccgcctccgtt

SEQ ID NO: 24409 - DNA, 20 bp, Artificial Sequence
  Description of Artificial Sequence: Synthetic oligonucleotide
gacgggcgccgcctccgctt

SEQ ID NO: 24410 - DNA, 20 bp, Artificial Sequence
  Description of Artificial Sequence: Synthetic oligonucleotide
acgggcgccgcctccgcgtt

SEQ ID NO: 24411 - DNA, 20 bp, Artificial Sequence
  Description of Artificial Sequence: Synthetic oligonucleotide
cgggcgccgcctccgcgttt

SEQ ID NO: 24412 - DNA, 20 bp, Artificial Sequence
  Description of Artificial Sequence: Synthetic oligonucleotide
gggcgccgcctccgcggttt

SEQ ID NO: 24413 - DNA, 20 bp, Artificial Sequence
  Description of Artificial Sequence: Synthetic oligonucleotide
ggcgccgcctccgcgggttt

SEQ ID NO: 24414 - DNA, 20 bp, Artificial Sequence
  Description of Artificial Sequence: Synthetic oligonucleotide
gcgccgcctccgcgggcatt

SEQ ID NO: 24415 - DNA, 20 bp, Artificial Sequence
  Description of Artificial Sequence: Synthetic oligonucleotide
cgccgcctccgcgggcatga

SEQ ID NO: 24416 - DNA, 20 bp, Artificial Sequence
  Description of Artificial Sequence: Synthetic oligonucleotide
gccgcctccgcgggcatgac

SEQ ID NO: 24417 - DNA, 21 bp, Artificial Sequence
  Description of Artificial Sequence: Synthetic oligonucleotide
ccgcctccgcgggcatgacca

SEQ ID NO: 24418 - DNA, 23 bp, Artificial Sequence
  Description of Artificial Sequence: Synthetic oligonucleotide
cgcctccgcgggcatgaccagta

SEQ ID NO: 24419 - DNA, 23 bp, Artificial Sequence
  Description of Artificial Sequence: Synthetic oligonucleotide
gcctccgcgggcatgaccagtac

SEQ ID NO: 24420 - DNA, 31 bp, Artificial Sequence
  Description of Artificial Sequence: Synthetic oligonucleotide
acagatctacaaggcccaggcacagacttac

SEQ ID NO: 24421 - DNA, 30 bp, Artificial Sequence
  Description of Artificial Sequence: Synthetic oligonucleotide
cagatctacaaggcccaggcacagacttac

SEQ ID NO: 24422 - DNA, 30 bp, Artificial Sequence
  Description of Artificial Sequence: Synthetic oligonucleotide
agatctacaaggcccaggcacagacttacc

SEQ ID NO: 24423 - DNA, 29 bp, Artificial Sequence
  Description of Artificial Sequence: Synthetic oligonucleotide
gatctacaaggcccaggcacagacttacc

SEQ ID NO: 24424 - DNA, 29 bp, Artificial Sequence
  Description of Artificial Sequence: Synthetic oligonucleotide
atctacaaggcccaggcacagacttaccg

SEQ ID NO: 24425 - DNA, 28 bp, Artificial Sequence
  Description of Artificial Sequence: Synthetic oligonucleotide
tctacaaggcccaggcacagacttaccg

SEQ ID NO: 24426 - DNA, 27 bp, Artificial Sequence
  Description of Artificial Sequence: Synthetic oligonucleotide
ctacaaggcccaggcacagacttaccg

SEQ ID NO: 24427 - DNA, 28 bp, Artificial Sequence
  Description of Artificial Sequence: Synthetic oligonucleotide
tacaaggcccaggcacagacttaccgag

SEQ ID NO: 24428 - DNA, 27 bp, Artificial Sequence
  Description of Artificial Sequence: Synthetic oligonucleotide
acaaggcccaggcacagacttaccgag

SEQ ID NO: 24429 - DNA, 27 bp, Artificial Sequence
  Description of Artificial Sequence: Synthetic oligonucleotide
caaggcccaggcacagacttaccgaga

SEQ ID NO: 24430 - DNA, 27 bp, Artificial Sequence
  Description of Artificial Sequence: Synthetic oligonucleotide
aaggcccaggcacagacttaccgagag

SEQ ID NO: 24431 - DNA, 27 bp, Artificial Sequence
  Description of Artificial Sequence: Synthetic oligonucleotide
aggcccaggcacagacttaccgagaga

SEQ ID NO: 24432 - DNA, 27 bp, Artificial Sequence
  Description of Artificial Sequence: Synthetic oligonucleotide
ggcccaggcacagacttaccgagagaa

SEQ ID NO: 24433 - DNA, 27 bp, Artificial Sequence
  Description of Artificial Sequence: Synthetic oligonucleotide
gcccaggcacagacttaccgagagaac

SEQ ID NO: 24434 - DNA, 27 bp, Artificial Sequence
  Description of Artificial Sequence: Synthetic oligonucleotide
cccaggcacagacttaccgagagaacc

SEQ ID NO: 24435 - DNA, 28 bp, Artificial Sequence
  Description of Artificial Sequence: Synthetic oligonucleotide
ccaggcacagacttaccgagagaacctg

SEQ ID NO: 24436 - DNA, 28 bp, Artificial Sequence
  Description of Artificial Sequence: Synthetic oligonucleotide
caggcacagacttaccgagagaacctgc

SEQ ID NO: 24437 - DNA, 28 bp, Artificial Sequence
  Description of Artificial Sequence: Synthetic oligonucleotide
aggcacagacttaccgagagaacctgcg

SEQ ID NO: 24438 - DNA, 27 bp, Artificial Sequence
  Description of Artificial Sequence: Synthetic oligonucleotide
ggcacagacttaccgagagaacctgcg

SEQ ID NO: 24439 - DNA, 27 bp, Artificial Sequence
  Description of Artificial Sequence: Synthetic oligonucleotide
gcacagacttaccgagagaacctgcgg

SEQ ID NO: 24440 - DNA, 29 bp, Artificial Sequence
  Description of Artificial Sequence: Synthetic oligonucleotide
cacagacttaccgagagaacctgcggaac

SEQ ID NO: 24441 - DNA, 29 bp, Artificial Sequence
  Description of Artificial Sequence: Synthetic oligonucleotide
acagacttaccgagagaacctgcggaacc

SEQ ID NO: 24442 - DNA, 28 bp, Artificial Sequence
  Description of Artificial Sequence: Synthetic oligonucleotide
cagacttaccgagagaacctgcggaacc

SEQ ID NO: 24443 - DNA, 29 bp, Artificial Sequence
  Description of Artificial Sequence: Synthetic oligonucleotide
agacttaccgagagaacctgcggaacctg

SEQ ID NO: 24444 - DNA, 28 bp, Artificial Sequence
  Description of Artificial Sequence: Synthetic oligonucleotide
gacttaccgagagaacctgcggaacctg

SEQ ID NO: 24445 - DNA, 28 bp, Artificial Sequence
  Description of Artificial Sequence: Synthetic oligonucleotide
acttaccgagagaacctgcggaacctgc

SEQ ID NO: 24446 - DNA, 27 bp, Artificial Sequence
  Description of Artificial Sequence: Synthetic oligonucleotide
cttaccgagagaacctgcggaacctgc

SEQ ID NO: 24447 - DNA, 27 bp, Artificial Sequence
  Description of Artificial Sequence: Synthetic oligonucleotide
ttaccgagagaacctgcggaacctgcg

SEQ ID NO: 24448 - DNA, 26 bp, Artificial Sequence
  Description of Artificial Sequence: Synthetic oligonucleotide
taccgagagaacctgcggaacctgcg

SEQ ID NO: 24449 - DNA, 31 bp, Artificial Sequence
  Description of Artificial Sequence: Synthetic oligonucleotide
catgaggtatttctacacctccgtgtcccag

SEQ ID NO: 24450 - DNA, 31 bp, Artificial Sequence
  Description of Artificial Sequence: Synthetic oligonucleotide
atgaggtatttctacacctccgtgtcccagc

SEQ ID NO: 24451 - DNA, 30 bp, Artificial Sequence
  Description of Artificial Sequence: Synthetic oligonucleotide
tgaggtatttctacacctccgtgtcccagc

SEQ ID NO: 24452 - DNA, 29 bp, Artificial Sequence
  Description of Artificial Sequence: Synthetic oligonucleotide
gaggtatttctacacctccgtgtcccagc

SEQ ID NO: 24453 - DNA, 29 bp, Artificial Sequence
  Description of Artificial Sequence: Synthetic oligonucleotide
aggtatttctacacctccgtgtcccagcc

SEQ ID NO: 24454 - DNA, 28 bp, Artificial Sequence
  Description of Artificial Sequence: Synthetic oligonucleotide
ggtatttctacacctccgtgtcccagcc

SEQ ID NO: 24455 - DNA, 28 bp, Artificial Sequence
  Description of Artificial Sequence: Synthetic oligonucleotide
gtatttctacacctccgtgtcccagccc

SEQ ID NO: 24456 - DNA, 28 bp, Artificial Sequence
  Description of Artificial Sequence: Synthetic oligonucleotide
tatttctacacctccgtgtcccagcccg

SEQ ID NO: 24457 - DNA, 27 bp, Artificial Sequence
  Description of Artificial Sequence: Synthetic oligonucleotide
atttctacacctccgtgtcccagcccg

SEQ ID NO: 24458 - DNA, 26 bp, Artificial Sequence
  Description of Artificial Sequence: Synthetic oligonucleotide
tttctacacctccgtgtcccagcccg

SEQ ID NO: 24459 - DNA, 25 bp, Artificial Sequence
  Description of Artificial Sequence: Synthetic oligonucleotide
ttctacacctccgtgtcccagcccg

SEQ ID NO: 24460 - DNA, 24 bp, Artificial Sequence
  Description of Artificial Sequence: Synthetic oligonucleotide
tctacacctccgtgtcccagcccg

SEQ ID NO: 24461 - DNA, 23 bp, Artificial Sequence
  Description of Artificial Sequence: Synthetic oligonucleotide
ctacacctccgtgtcccagcccg

SEQ ID NO: 24462 - DNA, 23 bp, Artificial Sequence
  Description of Artificial Sequence: Synthetic oligonucleotide
tacacctccgtgtcccagcccgg

SEQ ID NO: 24463 - DNA, 22 bp, Artificial Sequence
  Description of Artificial Sequence: Synthetic oligonucleotide
acacctccgtgtcccagcccgg

SEQ ID NO: 24464 - DNA, 21 bp, Artificial Sequence
  Description of Artificial Sequence: Synthetic oligonucleotide
cacctccgtgtcccagcccgg

SEQ ID NO: 24465 - DNA, 21 bp, Artificial Sequence
  Description of Artificial Sequence: Synthetic oligonucleotide
acctccgtgtcccagcccggc

SEQ ID NO: 24466 - DNA, 20 bp, Artificial Sequence
  Description of Artificial Sequence: Synthetic oligonucleotide
cctccgtgtcccagcccggc

SEQ ID NO: 24467 - DNA, 20 bp, Artificial Sequence
  Description of Artificial Sequence: Synthetic oligonucleotide
ctccgtgtcccagcccggcc

SEQ ID NO: 24468 - DNA, 20 bp, Artificial Sequence
  Description of Artificial Sequence: Synthetic oligonucleotide
tccgtgtcccagcccggccg

SEQ ID NO: 24469 - DNA, 20 bp, Artificial Sequence
  Description of Artificial Sequence: Synthetic oligonucleotide
ccgtgtcccagcccggccgt

SEQ ID NO: 24470 - DNA, 20 bp, Artificial Sequence
  Description of Artificial Sequence: Synthetic oligonucleotide
cgtgtcccagcccggccgct

SEQ ID NO: 24471 - DNA, 20 bp, Artificial Sequence
  Description of Artificial Sequence: Synthetic oligonucleotide
gtgtcccagcccggccgcgt

SEQ ID NO: 24472 - DNA, 20 bp, Artificial Sequence
  Description of Artificial Sequence: Synthetic oligonucleotide
tgtcccagcccggccgcggt

SEQ ID NO: 24473 - DNA, 20 bp, Artificial Sequence
  Description of Artificial Sequence: Synthetic oligonucleotide
gtcccagcccggccgcggtt

SEQ ID NO: 24474 - DNA, 20 bp, Artificial Sequence
  Description of Artificial Sequence: Synthetic oligonucleotide
tcccagcccggccgcgggtt

SEQ ID NO: 24475 - DNA, 20 bp, Artificial Sequence
  Description of Artificial Sequence: Synthetic oligonucleotide
cccagcccggccgcgggttt

SEQ ID NO: 24476 - DNA, 20 bp, Artificial Sequence
  Description of Artificial Sequence: Synthetic oligonucleotide
ccagcccggccgcggggatt

SEQ ID NO: 24477 - DNA, 20 bp, Artificial Sequence
  Description of Artificial Sequence: Synthetic oligonucleotide
cagcccggccgcggggagtt

SEQ ID NO: 24478 - DNA, 20 bp, Artificial Sequence
  Description of Artificial Sequence: Synthetic oligonucleotide
agcccggccgcggggagctt

SEQ ID NO: 24479 - DNA, 26 bp, Artificial Sequence
  Description of Artificial Sequence: Synthetic oligonucleotide
cgggtctcacaccctccagaggatgt

SEQ ID NO: 24480 - DNA, 27 bp, Artificial Sequence
  Description of Artificial Sequence: Synthetic oligonucleotide
gggtctcacaccctccagaggatgtct

SEQ ID NO: 24481 - DNA, 27 bp, Artificial Sequence
  Description of Artificial Sequence: Synthetic oligonucleotide
ggtctcacaccctccagaggatgtctg

SEQ ID NO: 24482 - DNA, 27 bp, Artificial Sequence
  Description of Artificial Sequence: Synthetic oligonucleotide
gtctcacaccctccagaggatgtctgg

SEQ ID NO: 24483 - DNA, 27 bp, Artificial Sequence
  Description of Artificial Sequence: Synthetic oligonucleotide
tctcacaccctccagaggatgtctggc

SEQ ID NO: 24484 - DNA, 27 bp, Artificial Sequence
  Description of Artificial Sequence: Synthetic oligonucleotide
ctcacaccctccagaggatgtctggct

SEQ ID NO: 24485 - DNA, 27 bp, Artificial Sequence
  Description of Artificial Sequence: Synthetic oligonucleotide
tcacaccctccagaggatgtctggctg

SEQ ID NO: 24486 - DNA, 26 bp, Artificial Sequence
  Description of Artificial Sequence: Synthetic oligonucleotide
cacaccctccagaggatgtctggctg

SEQ ID NO: 24487 - DNA, 26 bp, Artificial Sequence
  Description of Artificial Sequence: Synthetic oligonucleotide
acaccctccagaggatgtctggctgc

SEQ ID NO: 24488 - DNA, 25 bp, Artificial Sequence
  Description of Artificial Sequence: Synthetic oligonucleotide
caccctccagaggatgtctggctgc

SEQ ID NO: 24489 - DNA, 26 bp, Artificial Sequence
  Description of Artificial Sequence: Synthetic oligonucleotide
accctccagaggatgtctggctgcga

SEQ ID NO: 24490 - DNA, 25 bp, Artificial Sequence
  Description of Artificial Sequence: Synthetic oligonucleotide
ccctccagaggatgtctggctgcga

SEQ ID NO: 24491 - DNA, 25 bp, Artificial Sequence
  Description of Artificial Sequence: Synthetic oligonucleotide
cctccagaggatgtctggctgcgac

SEQ ID NO: 24492 - DNA, 26 bp, Artificial Sequence
  Description of Artificial Sequence: Synthetic oligonucleotide
ctccagaggatgtctggctgcgacgt

SEQ ID NO: 24493 - DNA, 24 bp, Artificial Sequence
  Description of Artificial Sequence: Synthetic oligonucleotide
aggatgtctggctgcgacgtgggg

SEQ ID NO: 24494 - DNA, 23 bp, Artificial Sequence
  Description of Artificial Sequence: Synthetic oligonucleotide
ggatgtctggctgcgacgtgggg

SEQ ID NO: 24495 - DNA, 23 bp, Artificial Sequence
  Description of Artificial Sequence: Synthetic oligonucleotide
gatgtctggctgcgacgtggggc

SEQ ID NO: 24496 - DNA, 23 bp, Artificial Sequence
  Description of Artificial Sequence: Synthetic oligonucleotide
atgtctggctgcgacgtggggcc

SEQ ID NO: 24497 - DNA, 22 bp, Artificial Sequence
  Description of Artificial Sequence: Synthetic oligonucleotide
tgtctggctgcgacgtggggcc

SEQ ID NO: 24498 - DNA, 21 bp, Artificial Sequence
  Description of Artificial Sequence: Synthetic oligonucleotide
gtctggctgcgacgtggggcc

SEQ ID NO: 24499 - DNA, 21 bp, Artificial Sequence
  Description of Artificial Sequence: Synthetic oligonucleotide
tctggctgcgacgtggggccg

SEQ ID NO: 24500 - DNA, 20 bp, Artificial Sequence
  Description of Artificial Sequence: Synthetic oligonucleotide
ctggctgcgacgtggggccg

SEQ ID NO: 24501 - DNA, 25 bp, Artificial Sequence
  Description of Artificial Sequence: Synthetic oligonucleotide
cagagcgaggccgggtctcacactt

SEQ ID NO: 24502 - DNA, 25 bp, Artificial Sequence
  Description of Artificial Sequence: Synthetic oligonucleotide
agagcgaggccgggtctcacacttg

SEQ ID NO: 24503 - DNA, 24 bp, Artificial Sequence
  Description of Artificial Sequence: Synthetic oligonucleotide
gagcgaggccgggtctcacacttg

SEQ ID NO: 24504 - DNA, 24 bp, Artificial Sequence
  Description of Artificial Sequence: Synthetic oligonucleotide
agcgaggccgggtctcacacttgg

SEQ ID NO: 24505 - DNA, 23 bp, Artificial Sequence
  Description of Artificial Sequence: Synthetic oligonucleotide
gcgaggccgggtctcacacttgg

SEQ ID NO: 24506 - DNA, 24 bp, Artificial Sequence
  Description of Artificial Sequence: Synthetic oligonucleotide
cgaggccgggtctcacacttggca

SEQ ID NO: 24507 - DNA, 25 bp, Artificial Sequence
  Description of Artificial Sequence: Synthetic oligonucleotide
gaggccgggtctcacacttggcaga

SEQ ID NO: 24508 - DNA, 25 bp, Artificial Sequence
  Description of Artificial Sequence: Synthetic oligonucleotide
aggccgggtctcacacttggcagac

SEQ ID NO: 24509 - DNA, 24 bp, Artificial Sequence
  Description of Artificial Sequence: Synthetic oligonucleotide
ggccgggtctcacacttggcagac

SEQ ID NO: 24510 - DNA, 26 bp, Artificial Sequence
  Description of Artificial Sequence: Synthetic oligonucleotide
gccgggtctcacacttggcagacgat

SEQ ID NO: 24511 - DNA, 27 bp, Artificial Sequence
  Description of Artificial Sequence: Synthetic oligonucleotide
ccgggtctcacacttggcagacgatgt

SEQ ID NO: 24512 - DNA, 29 bp, Artificial Sequence
  Description of Artificial Sequence: Synthetic oligonucleotide
cgggtctcacacttggcagacgatgtatg

SEQ ID NO: 24513 - DNA, 29 bp, Artificial Sequence
  Description of Artificial Sequence: Synthetic oligonucleotide
gggtctcacacttggcagacgatgtatgg

SEQ ID NO: 24514 - DNA, 29 bp, Artificial Sequence
  Description of Artificial Sequence: Synthetic oligonucleotide
ggtctcacacttggcagacgatgtatggc

SEQ ID NO: 24515 - DNA, 30 bp, Artificial Sequence
  Description of Artificial Sequence: Synthetic oligonucleotide
gtctcacacttggcagacgatgtatggctg

SEQ ID NO: 24516 - DNA, 30 bp, Artificial Sequence
  Description of Artificial Sequence: Synthetic oligonucleotide
tctcacacttggcagacgatgtatggctgc

SEQ ID NO: 24517 - DNA, 29 bp, Artificial Sequence
  Description of Artificial Sequence: Synthetic oligonucleotide
ctcacacttggcagacgatgtatggctgc

SEQ ID NO: 24518 - DNA, 29 bp, Artificial Sequence
  Description of Artificial Sequence: Synthetic oligonucleotide
tcacacttggcagacgatgtatggctgcg

SEQ ID NO: 24519 - DNA, 28 bp, Artificial Sequence
  Description of Artificial Sequence: Synthetic oligonucleotide
cacacttggcagacgatgtatggctgcg

SEQ ID NO: 24520 - DNA, 29 bp, Artificial Sequence
  Description of Artificial Sequence: Synthetic oligonucleotide
acacttggcagacgatgtatggctgcgac

SEQ ID NO: 24521 - DNA, 28 bp, Artificial Sequence
  Description of Artificial Sequence: Synthetic oligonucleotide
cacttggcagacgatgtatggctgcgac

SEQ ID NO: 24522 - DNA, 28 bp, Artificial Sequence
  Description of Artificial Sequence: Synthetic oligonucleotide
acttggcagacgatgtatggctgcgacc

SEQ ID NO: 24523 - DNA, 27 bp, Artificial Sequence
  Description of Artificial Sequence: Synthetic oligonucleotide
cttggcagacgatgtatggctgcgacc

SEQ ID NO: 24524 - DNA, 28 bp, Artificial Sequence
  Description of Artificial Sequence: Synthetic oligonucleotide
ttggcagacgatgtatggctgcgacctg

SEQ ID NO: 24525 - DNA, 27 bp, Artificial Sequence
  Description of Artificial Sequence: Synthetic oligonucleotide
tggcagacgatgtatggctgcgacctg

SEQ ID NO: 24526 - DNA, 26 bp, Artificial Sequence
  Description of Artificial Sequence: Synthetic oligonucleotide
ggcagacgatgtatggctgcgacctg

SEQ ID NO: 24527 - DNA, 26 bp, Artificial Sequence
  Description of Artificial Sequence: Synthetic oligonucleotide
gcagacgatgtatggctgcgacctgg

SEQ ID NO: 24528 - DNA, 26 bp, Artificial Sequence
  Description of Artificial Sequence: Synthetic oligonucleotide
cagacgatgtatggctgcgacctggg

SEQ ID NO: 24529 - DNA, 26 bp, Artificial Sequence
  Description of Artificial Sequence: Synthetic oligonucleotide
agacgatgtatggctgcgacctgggg

SEQ ID NO: 24530 - DNA, 25 bp, Artificial Sequence
  Description of Artificial Sequence: Synthetic oligonucleotide
gacgatgtatggctgcgacctgggg

SEQ ID NO: 24531 - DNA, 25 bp, Artificial Sequence
  Description of Artificial Sequence: Synthetic oligonucleotide
acgatgtatggctgcgacctggggc

SEQ ID NO: 24532 - DNA, 24 bp, Artificial Sequence
  Description of Artificial Sequence: Synthetic oligonucleotide
cgatgtatggctgcgacctggggc

SEQ ID NO: 24533 - DNA, 24 bp, Artificial Sequence
  Description of Artificial Sequence: Synthetic oligonucleotide
atgtatggctgcgacctggggccg

SEQ ID NO: 24534 - DNA, 23 bp, Artificial Sequence
  Description of Artificial Sequence: Synthetic oligonucleotide
tgtatggctgcgacctggggccg

SEQ ID NO: 24535 - DNA, 22 bp, Artificial Sequence
  Description of Artificial Sequence: Synthetic oligonucleotide
gtatggctgcgacctggggccg

SEQ ID NO: 24536 - DNA, 23 bp, Artificial Sequence
  Description of Artificial Sequence: Synthetic oligonucleotide
tatggctgcgacctggggccgga

SEQ ID NO: 24537 - DNA, 22 bp, Artificial Sequence
  Description of Artificial Sequence: Synthetic oligonucleotide
atggctgcgacctggggccgga

SEQ ID NO: 24538 - DNA, 21 bp, Artificial Sequence
  Description of Artificial Sequence: Synthetic oligonucleotide
tggctgcgacctggggccgga

SEQ ID NO: 24539 - DNA, 20 bp, Artificial Sequence
  Description of Artificial Sequence: Synthetic oligonucleotide
ggctgcgacctggggccgga

SEQ ID NO: 24540 - DNA, 20 bp, Artificial Sequence
  Description of Artificial Sequence: Synthetic oligonucleotide
gctgcgacctggggccggac

SEQ ID NO: 24541 - DNA, 20 bp, Artificial Sequence
  Description of Artificial Sequence: Synthetic oligonucleotide
ctgcgacctggggccggacg

SEQ ID NO: 24542 - DNA, 20 bp, Artificial Sequence
  Description of Artificial Sequence: Synthetic oligonucleotide
tgcgacctggggccggacgg

SEQ ID NO: 24543 - DNA, 20 bp, Artificial Sequence
  Description of Artificial Sequence: Synthetic oligonucleotide
gcgacctggggccggacggt

SEQ ID NO: 24544 - DNA, 20 bp, Artificial Sequence
  Description of Artificial Sequence: Synthetic oligonucleotide
cgacctggggccggacgggt

SEQ ID NO: 24545 - DNA, 20 bp, Artificial Sequence
  Description of Artificial Sequence: Synthetic oligonucleotide
gacctggggccggacgggct

SEQ ID NO: 24546 - DNA, 20 bp, Artificial Sequence
  Description of Artificial Sequence: Synthetic oligonucleotide
acctggggccggacgggcgt

SEQ ID NO: 24547 - DNA, 20 bp, Artificial Sequence
  Description of Artificial Sequence: Synthetic oligonucleotide
cctggggccggacgggcgtt

SEQ ID NO: 24548 - DNA, 20 bp, Artificial Sequence
  Description of Artificial Sequence: Synthetic oligonucleotide
ctggggccggacgggcgctt

SEQ ID NO: 24549 - DNA, 26 bp, Artificial Sequence
  Description of Artificial Sequence: Synthetic oligonucleotide
gcctcctccgcgggcataaccagtta

SEQ ID NO: 24550 - DNA, 26 bp, Artificial Sequence
  Description of Artificial Sequence: Synthetic oligonucleotide
cctcctccgcgggcataaccagttag

SEQ ID NO: 24551 - DNA, 26 bp, Artificial Sequence
  Description of Artificial Sequence: Synthetic oligonucleotide
ctcctccgcgggcataaccagttagc

SEQ ID NO: 24552 - DNA, 27 bp, Artificial Sequence
  Description of Artificial Sequence: Synthetic oligonucleotide
tcctccgcgggcataaccagttagcct

SEQ ID NO: 24553 - DNA, 27 bp, Artificial Sequence
  Description of Artificial Sequence: Synthetic oligonucleotide
cctccgcgggcataaccagttagccta

SEQ ID NO: 24554 - DNA, 27 bp, Artificial Sequence
  Description of Artificial Sequence: Synthetic oligonucleotide
ctccgcgggcataaccagttagcctac

SEQ ID NO: 24555 - DNA, 27 bp, Artificial Sequence
  Description of Artificial Sequence: Synthetic oligonucleotide
tccgcgggcataaccagttagcctacg

SEQ ID NO: 24556 - DNA, 27 bp, Artificial Sequence
  Description of Artificial Sequence: Synthetic oligonucleotide
ccgcgggcataaccagttagcctacga

SEQ ID NO: 24557 - DNA, 27 bp, Artificial Sequence
  Description of Artificial Sequence: Synthetic oligonucleotide
cgcgggcataaccagttagcctacgac

SEQ ID NO: 24558 - DNA, 27 bp, Artificial Sequence
  Description of Artificial Sequence: Synthetic oligonucleotide
gcgggcataaccagttagcctacgacg

SEQ ID NO: 24559 - DNA, 27 bp, Artificial Sequence
  Description of Artificial Sequence: Synthetic oligonucleotide
cgggcataaccagttagcctacgacgg

SEQ ID NO: 24560 - DNA, 27 bp, Artificial Sequence
  Description of Artificial Sequence: Synthetic oligonucleotide
gggcataaccagttagcctacgacggc

SEQ ID NO: 24561 - DNA, 29 bp, Artificial Sequence
  Description of Artificial Sequence: Synthetic oligonucleotide
ggcataaccagttagcctacgacggcaag

SEQ ID NO: 24562 - DNA, 29 bp, Artificial Sequence
  Description of Artificial Sequence: Synthetic oligonucleotide
gcataaccagttagcctacgacggcaagg

SEQ ID NO: 24563 - DNA, 33 bp, Artificial Sequence
  Description of Artificial Sequence: Synthetic oligonucleotide
cataaccagttagcctacgacggcaaggattac

SEQ ID NO: 24564 - DNA, 35 bp, Artificial Sequence
  Description of Artificial Sequence: Synthetic oligonucleotide
ataaccagttagcctacgacggcaaggattacatc

SEQ ID NO: 24565 - DNA, 34 bp, Artificial Sequence
  Description of Artificial Sequence: Synthetic oligonucleotide
taaccagttagcctacgacggcaaggattacatc

SEQ ID NO: 24566 - DNA, 33 bp, Artificial Sequence
  Description of Artificial Sequence: Synthetic oligonucleotide
aaccagttagcctacgacggcaaggattacatc

SEQ ID NO: 24567 - DNA, 32 bp, Artificial Sequence
  Description of Artificial Sequence: Synthetic oligonucleotide
accagttagcctacgacggcaaggattacatc

SEQ ID NO: 24568 - DNA, 31 bp, Artificial Sequence
  Description of Artificial Sequence: Synthetic oligonucleotide
ccagttagcctacgacggcaaggattacatc

SEQ ID NO: 24569 - DNA, 31 bp, Artificial Sequence
  Description of Artificial Sequence: Synthetic oligonucleotide
cagttagcctacgacggcaaggattacatcg

SEQ ID NO: 24570 - DNA, 31 bp, Artificial Sequence
  Description of Artificial Sequence: Synthetic oligonucleotide
agttagcctacgacggcaaggattacatcgc

SEQ ID NO: 24571 - DNA, 30 bp, Artificial Sequence
  Description of Artificial Sequence: Synthetic oligonucleotide
gttagcctacgacggcaaggattacatcgc

SEQ ID NO: 24572 - DNA, 30 bp, Artificial Sequence
  Description of Artificial Sequence: Synthetic oligonucleotide
ttagcctacgacggcaaggattacatcgcc

SEQ ID NO: 24573 - DNA, 29 bp, Artificial Sequence
  Description of Artificial Sequence: Synthetic oligonucleotide
tagcctacgacggcaaggattacatcgcc

SEQ ID NO: 24574 - DNA, 23 bp, Artificial Sequence
  Description of Artificial Sequence: Synthetic oligonucleotide
agagagcctgcggaacctgcgcc

SEQ ID NO: 24575 - DNA, 22 bp, Artificial Sequence
  Description of Artificial Sequence: Synthetic oligonucleotide
gagagcctgcggaacctgcgcc

SEQ ID NO: 24576 - DNA, 22 bp, Artificial Sequence
  Description of Artificial Sequence: Synthetic oligonucleotide
agagcctgcggaacctgcgccg

SEQ ID NO: 24577 - DNA, 21 bp, Artificial Sequence
  Description of Artificial Sequence: Synthetic oligonucleotide
gagcctgcggaacctgcgccg

SEQ ID NO: 24578 - DNA, 23 bp, Artificial Sequence
  Description of Artificial Sequence: Synthetic oligonucleotide
agcctgcggaacctgcgccgcta

SEQ ID NO: 24579 - DNA, 22 bp, Artificial Sequence
  Description of Artificial Sequence: Synthetic oligonucleotide
gcctgcggaacctgcgccgcta

SEQ ID NO: 24580 - DNA, 24 bp, Artificial Sequence
  Description of Artificial Sequence: Synthetic oligonucleotide
cctgcggaacctgcgccgctacta

SEQ ID NO: 24581 - DNA, 26 bp, Artificial Sequence
  Description of Artificial Sequence: Synthetic oligonucleotide
ctgcggaacctgcgccgctactacaa

SEQ ID NO: 24582 - DNA, 26 bp, Artificial Sequence
  Description of Artificial Sequence: Synthetic oligonucleotide
tgcggaacctgcgccgctactacaac

SEQ ID NO: 24583 - DNA, 25 bp, Artificial Sequence
  Description of Artificial Sequence: Synthetic oligonucleotide
gcggaacctgcgccgctactacaac

SEQ ID NO: 24584 - DNA, 26 bp, Artificial Sequence
  Description of Artificial Sequence: Synthetic oligonucleotide
cggaacctgcgccgctactacaacca

SEQ ID NO: 24585 - DNA, 27 bp, Artificial Sequence
  Description of Artificial Sequence: Synthetic oligonucleotide
ggaacctgcgccgctactacaaccaga

SEQ ID NO: 24586 - DNA, 27 bp, Artificial Sequence
  Description of Artificial Sequence: Synthetic oligonucleotide
gaacctgcgccgctactacaaccagag

SEQ ID NO: 24587 - DNA, 27 bp, Artificial Sequence
  Description of Artificial Sequence: Synthetic oligonucleotide
aacctgcgccgctactacaaccagagc

SEQ ID NO: 24588 - DNA, 26 bp, Artificial Sequence
  Description of Artificial Sequence: Synthetic oligonucleotide
acctgcgccgctactacaaccagagc

SEQ ID NO: 24589 - DNA, 25 bp, Artificial Sequence
  Description of Artificial Sequence: Synthetic oligonucleotide
cctgcgccgctactacaaccagagc

SEQ ID NO: 24590 - DNA, 26 bp, Artificial Sequence
  Description of Artificial Sequence: Synthetic oligonucleotide
ctgcgccgctactacaaccagagcga

SEQ ID NO: 24591 - DNA, 26 bp, Artificial Sequence
  Description of Artificial Sequence: Synthetic oligonucleotide
tgcgccgctactacaaccagagcgag

SEQ ID NO: 24592 - DNA, 25 bp, Artificial Sequence
  Description of Artificial Sequence: Synthetic oligonucleotide
gcgccgctactacaaccagagcgag

SEQ ID NO: 24593 - DNA, 25 bp, Artificial Sequence
  Description of Artificial Sequence: Synthetic oligonucleotide
cgccgctactacaaccagagcgagg

SEQ ID NO: 24594 - DNA, 25 bp, Artificial Sequence
  Description of Artificial Sequence: Synthetic oligonucleotide
gccgctactacaaccagagcgaggc

SEQ ID NO: 24595 - DNA, 25 bp, Artificial Sequence
  Description of Artificial Sequence: Synthetic oligonucleotide
gctactacaaccagagcgagggcgg

SEQ ID NO: 24596 - DNA, 26 bp, Artificial Sequence
  Description of Artificial Sequence: Synthetic oligonucleotide
ctactacaaccagagcgagggcgggt

SEQ ID NO: 24597 - DNA, 27 bp, Artificial Sequence
  Description of Artificial Sequence: Synthetic oligonucleotide
tactacaaccagagcgagggcgggtct

SEQ ID NO: 24598 - DNA, 26 bp, Artificial Sequence
  Description of Artificial Sequence: Synthetic oligonucleotide
actacaaccagagcgagggcgggtct

SEQ ID NO: 24599 - DNA, 25 bp, Artificial Sequence
  Description of Artificial Sequence: Synthetic oligonucleotide
ctacaaccagagcgagggcgggtct

SEQ ID NO: 24600 - DNA, 26 bp, Artificial Sequence
  Description of Artificial Sequence: Synthetic oligonucleotide
tacaaccagagcgagggcgggtctca

SEQ ID NO: 24601 - DNA, 25 bp, Artificial Sequence
  Description of Artificial Sequence: Synthetic oligonucleotide
acaaccagagcgagggcgggtctca

SEQ ID NO: 24602 - DNA, 24 bp, Artificial Sequence
  Description of Artificial Sequence: Synthetic oligonucleotide
caaccagagcgagggcgggtctca

SEQ ID NO: 24603 - DNA, 25 bp, Artificial Sequence
  Description of Artificial Sequence: Synthetic oligonucleotide
aaccagagcgagggcgggtctcaca

SEQ ID NO: 24604 - DNA, 24 bp, Artificial Sequence
  Description of Artificial Sequence: Synthetic oligonucleotide
accagagcgagggcgggtctcaca

SEQ ID NO: 24605 - DNA, 23 bp, Artificial Sequence
  Description of Artificial Sequence: Synthetic oligonucleotide
ccagagcgagggcgggtctcaca

SEQ ID NO: 24606 - DNA, 23 bp, Artificial Sequence
  Description of Artificial Sequence: Synthetic oligonucleotide
cagagcgagggcgggtctcacac

SEQ ID NO: 24607 - DNA, 23 bp, Artificial Sequence
  Description of Artificial Sequence: Synthetic oligonucleotide
agagcgagggcgggtctcacacc

SEQ ID NO: 24608 - DNA, 22 bp, Artificial Sequence
  Description of Artificial Sequence: Synthetic oligonucleotide
gagcgagggcgggtctcacacc

SEQ ID NO: 24609 - DNA, 23 bp, Artificial Sequence
  Description of Artificial Sequence: Synthetic oligonucleotide
agcgagggcgggtctcacaccct

SEQ ID NO: 24610 - DNA, 22 bp, Artificial Sequence
  Description of Artificial Sequence: Synthetic oligonucleotide
gcgagggcgggtctcacaccct

SEQ ID NO: 24611 - DNA, 22 bp, Artificial Sequence
  Description of Artificial Sequence: Synthetic oligonucleotide
cgagggcgggtctcacaccctc

SEQ ID NO: 24612 - DNA, 23 bp, Artificial Sequence
  Description of Artificial Sequence: Synthetic oligonucleotide
gagggcgggtctcacaccctcca

SEQ ID NO: 24613 - DNA, 24 bp, Artificial Sequence
  Description of Artificial Sequence: Synthetic oligonucleotide
agggcgggtctcacaccctccaga

SEQ ID NO: 24614 - DNA, 23 bp, Artificial Sequence
  Description of Artificial Sequence: Synthetic oligonucleotide
gggcgggtctcacaccctccaga

SEQ ID NO: 24615 - DNA, 23 bp, Artificial Sequence
  Description of Artificial Sequence: Synthetic oligonucleotide
ggcgggtctcacaccctccagag

SEQ ID NO: 24616 - DNA, 25 bp, Artificial Sequence
  Description of Artificial Sequence: Synthetic oligonucleotide
gcgggtctcacaccctccagagcat

SEQ ID NO: 24617 - DNA, 33 bp, Artificial Sequence
  Description of Artificial Sequence: Synthetic oligonucleotide
agtattgggaccggaacacacagatcttcaagg

SEQ ID NO: 24618 - DNA, 32 bp, Artificial Sequence
  Description of Artificial Sequence: Synthetic oligonucleotide
gtattgggaccggaacacacagatcttcaagg

SEQ ID NO: 24619 - DNA, 32 bp, Artificial Sequence
  Description of Artificial Sequence: Synthetic oligonucleotide
tattgggaccggaacacacagatcttcaaggc

SEQ ID NO: 24620 - DNA, 31 bp, Artificial Sequence
  Description of Artificial Sequence: Synthetic oligonucleotide
attgggaccggaacacacagatcttcaaggc

SEQ ID NO: 24621 - DNA, 30 bp, Artificial Sequence
  Description of Artificial Sequence: Synthetic oligonucleotide
ttgggaccggaacacacagatcttcaaggc

SEQ ID NO: 24622 - DNA, 29 bp, Artificial Sequence
  Description of Artificial Sequence: Synthetic oligonucleotide
tgggaccggaacacacagatcttcaaggc

SEQ ID NO: 24623 - DNA, 28 bp, Artificial Sequence
  Description of Artificial Sequence: Synthetic oligonucleotide
gggaccggaacacacagatcttcaaggc

SEQ ID NO: 24624 - DNA, 28 bp, Artificial Sequence
  Description of Artificial Sequence: Synthetic oligonucleotide
ggaccggaacacacagatcttcaaggcc

SEQ ID NO: 24625 - DNA, 28 bp, Artificial Sequence
  Description of Artificial Sequence: Synthetic oligonucleotide
gaccggaacacacagatcttcaaggccc

SEQ ID NO: 24626 - DNA, 29 bp, Artificial Sequence
  Description of Artificial Sequence: Synthetic oligonucleotide
accggaacacacagatcttcaaggcccag

SEQ ID NO: 24627 - DNA, 28 bp, Artificial Sequence
  Description of Artificial Sequence: Synthetic oligonucleotide
ccggaacacacagatcttcaaggcccag

SEQ ID NO: 24628 - DNA, 28 bp, Artificial Sequence
  Description of Artificial Sequence: Synthetic oligonucleotide
cggaacacacagatcttcaaggcccagg

SEQ ID NO: 24629 - DNA, 28 bp, Artificial Sequence
  Description of Artificial Sequence: Synthetic oligonucleotide
ggaacacacagatcttcaaggcccaggc

SEQ ID NO: 24630 - DNA, 29 bp, Artificial Sequence
  Description of Artificial Sequence: Synthetic oligonucleotide
gaacacacagatcttcaaggcccaggcac

SEQ ID NO: 24631 - DNA, 30 bp, Artificial Sequence
  Description of Artificial Sequence: Synthetic oligonucleotide
aacacacagatcttcaaggcccaggcacag

SEQ ID NO: 24632 - DNA, 29 bp, Artificial Sequence
  Description of Artificial Sequence: Synthetic oligonucleotide
acacacagatcttcaaggcccaggcacag

SEQ ID NO: 24633 - DNA, 28 bp, Artificial Sequence
  Description of Artificial Sequence: Synthetic oligonucleotide
cacacagatcttcaaggcccaggcacag

SEQ ID NO: 24634 - DNA, 29 bp, Artificial Sequence
  Description of Artificial Sequence: Synthetic oligonucleotide
acacagatcttcaaggcccaggcacagac

SEQ ID NO: 24635 - DNA, 28 bp, Artificial Sequence
  Description of Artificial Sequence: Synthetic oligonucleotide
cacagatcttcaaggcccaggcacagac

SEQ ID NO: 24636 - DNA, 29 bp, Artificial Sequence
  Description of Artificial Sequence: Synthetic oligonucleotide
acagatcttcaaggcccaggcacagactg

SEQ ID NO: 24637 - DNA, 28 bp, Artificial Sequence
  Description of Artificial Sequence: Synthetic oligonucleotide
cagatcttcaaggcccaggcacagactg

SEQ ID NO: 24638 - DNA, 29 bp, Artificial Sequence
  Description of Artificial Sequence: Synthetic oligonucleotide
agatcttcaaggcccaggcacagactgac

SEQ ID NO: 24639 - DNA, 28 bp, Artificial Sequence
  Description of Artificial Sequence: Synthetic oligonucleotide
gatcttcaaggcccaggcacagactgac

SEQ ID NO: 24640 - DNA, 28 bp, Artificial Sequence
  Description of Artificial Sequence: Synthetic oligonucleotide
atcttcaaggcccaggcacagactgacc

SEQ ID NO: 24641 - DNA, 27 bp, Artificial Sequence
  Description of Artificial Sequence: Synthetic oligonucleotide
tcttcaaggcccaggcacagactgacc

SEQ ID NO: 24642 - DNA, 26 bp, Artificial Sequence
  Description of Artificial Sequence: Synthetic oligonucleotide
cttcaaggcccaggcacagactgacc

SEQ ID NO: 24643 - DNA, 27 bp, Artificial Sequence
  Description of Artificial Sequence: Synthetic oligonucleotide
ttcaaggcccaggcacagactgaccga

SEQ ID NO: 24644 - DNA, 26 bp, Artificial Sequence
  Description of Artificial Sequence: Synthetic oligonucleotide
tcaaggcccaggcacagactgaccga

SEQ ID NO: 24645 - DNA, 21 bp, Artificial Sequence
  Description of Artificial Sequence: Synthetic oligonucleotide
ctggaccgccgcggacacggt

SEQ ID NO: 24646 - DNA, 21 bp, Artificial Sequence
  Description of Artificial Sequence: Synthetic oligonucleotide
tggaccgccgcggacacggtg

SEQ ID NO: 24647 - DNA, 20 bp, Artificial Sequence
  Description of Artificial Sequence: Synthetic oligonucleotide
ggaccgccgcggacacggtg

SEQ ID NO: 24648 - DNA, 20 bp, Artificial Sequence
  Description of Artificial Sequence: Synthetic oligonucleotide
gaccgccgcggacacggtgg

SEQ ID NO: 24649 - DNA, 21 bp, Artificial Sequence
  Description of Artificial Sequence: Synthetic oligonucleotide
accgccgcggacacggtggct

SEQ ID NO: 24650 - DNA, 20 bp, Artificial Sequence
  Description of Artificial Sequence: Synthetic oligonucleotide
ccgccgcggacacggtggct

SEQ ID NO: 24651 - DNA, 21 bp, Artificial Sequence
  Description of Artificial Sequence: Synthetic oligonucleotide
cgccgcggacacggtggctca

SEQ ID NO: 24652 - DNA, 23 bp, Artificial Sequence
  Description of Artificial Sequence: Synthetic oligonucleotide
gccgcggacacggtggctcagat

SEQ ID NO: 24653 - DNA, 24 bp, Artificial Sequence
  Description of Artificial Sequence: Synthetic oligonucleotide
ccgcggacacggtggctcagatca

SEQ ID NO: 24654 - DNA, 24 bp, Artificial Sequence
  Description of Artificial Sequence: Synthetic oligonucleotide
cgcggacacggtggctcagatcac

SEQ ID NO: 24655 - DNA, 24 bp, Artificial Sequence
  Description of Artificial Sequence: Synthetic oligonucleotide
gcggacacggtggctcagatcacc

SEQ ID NO: 24656 - DNA, 25 bp, Artificial Sequence
  Description of Artificial Sequence: Synthetic oligonucleotide
cggacacggtggctcagatcaccca

SEQ ID NO: 24657 - DNA, 25 bp, Artificial Sequence
  Description of Artificial Sequence: Synthetic oligonucleotide
ggacacggtggctcagatcacccag

SEQ ID NO: 24658 - DNA, 25 bp, Artificial Sequence
  Description of Artificial Sequence: Synthetic oligonucleotide
gacacggtggctcagatcacccagc

SEQ ID NO: 24659 - DNA, 25 bp, Artificial Sequence
  Description of Artificial Sequence: Synthetic oligonucleotide
acacggtggctcagatcacccagcg

SEQ ID NO: 24660 - DNA, 24 bp, Artificial Sequence
  Description of Artificial Sequence: Synthetic oligonucleotide
cacggtggctcagatcacccagcg

SEQ ID NO: 24661 - DNA, 26 bp, Artificial Sequence
  Description of Artificial Sequence: Synthetic oligonucleotide
acggtggctcagatcacccagcgcaa

SEQ ID NO: 24662 - DNA, 25 bp, Artificial Sequence
  Description of Artificial Sequence: Synthetic oligonucleotide
cggtggctcagatcacccagcgcaa

SEQ ID NO: 24663 - DNA, 29 bp, Artificial Sequence
  Description of Artificial Sequence: Synthetic oligonucleotide
gctcccacgccatgaggtatttctacacc

SEQ ID NO: 24664 - DNA, 30 bp, Artificial Sequence
  Description of Artificial Sequence: Synthetic oligonucleotide
ctcccacgccatgaggtatttctacacctc

SEQ ID NO: 24665 - DNA, 30 bp, Artificial Sequence
  Description of Artificial Sequence: Synthetic oligonucleotide
tcccacgccatgaggtatttctacacctcc

SEQ ID NO: 24666 - DNA, 29 bp, Artificial Sequence
  Description of Artificial Sequence: Synthetic oligonucleotide
cccacgccatgaggtatttctacacctcc

SEQ ID NO: 24667 - DNA, 29 bp, Artificial Sequence
  Description of Artificial Sequence: Synthetic oligonucleotide
ccacgccatgaggtatttctacacctccg

SEQ ID NO: 24668 - DNA, 30 bp, Artificial Sequence
  Description of Artificial Sequence: Synthetic oligonucleotide
cacgccatgaggtatttctacacctccgtg

SEQ ID NO: 24669 - DNA, 31 bp, Artificial Sequence
  Description of Artificial Sequence: Synthetic oligonucleotide
acgccatgaggtatttctacacctccgtgtc

SEQ ID NO: 24670 - DNA, 30 bp, Artificial Sequence
  Description of Artificial Sequence: Synthetic oligonucleotide
cgccatgaggtatttctacacctccgtgtc

SEQ ID NO: 24671 - DNA, 30 bp, Artificial Sequence
  Description of Artificial Sequence: Synthetic oligonucleotide
gccatgaggtatttctacacctccgtgtcc

SEQ ID NO: 24672 - DNA, 27 bp, Artificial Sequence
  Description of Artificial Sequence: Synthetic oligonucleotide
ggctcagatcacccagcgcaagtggaa

SEQ ID NO: 24673 - DNA, 27 bp, Artificial Sequence
  Description of Artificial Sequence: Synthetic oligonucleotide
gctcagatcacccagcgcaagtggaag

SEQ ID NO: 24674 - DNA, 27 bp, Artificial Sequence
  Description of Artificial Sequence: Synthetic oligonucleotide
ctcagatcacccagcgcaagtggaagg

SEQ ID NO: 24675 - DNA, 27 bp, Artificial Sequence
  Description of Artificial Sequence: Synthetic oligonucleotide
tcagatcacccagcgcaagtggaaggc

SEQ ID NO: 24676 - DNA, 26 bp, Artificial Sequence
  Description of Artificial Sequence: Synthetic oligonucleotide
cagatcacccagcgcaagtggaaggc

SEQ ID NO: 24677 - DNA, 26 bp, Artificial Sequence
  Description of Artificial Sequence: Synthetic oligonucleotide
agatcacccagcgcaagtggaaggcg

SEQ ID NO: 24678 - DNA, 25 bp, Artificial Sequence
  Description of Artificial Sequence: Synthetic oligonucleotide
gatcacccagcgcaagtggaaggcg

SEQ ID NO: 24679 - DNA, 25 bp, Artificial Sequence
  Description of Artificial Sequence: Synthetic oligonucleotide
atcacccagcgcaagtggaaggcgg

SEQ ID NO: 24680 - DNA, 24 bp, Artificial Sequence
  Description of Artificial Sequence: Synthetic oligonucleotide
tcacccagcgcaagtggaaggcgg

SEQ ID NO: 24681 - DNA, 23 bp, Artificial Sequence
  Description of Artificial Sequence: Synthetic oligonucleotide
cacccagcgcaagtggaaggcgg

SEQ ID NO: 24682 - DNA, 23 bp, Artificial Sequence
  Description of Artificial Sequence: Synthetic oligonucleotide
acccagcgcaagtggaaggcggc

SEQ ID NO: 24683 - DNA, 22 bp, Artificial Sequence
  Description of Artificial Sequence: Synthetic oligonucleotide
cccagcgcaagtggaaggcggc

SEQ ID NO: 24684 - DNA, 22 bp, Artificial Sequence
  Description of Artificial Sequence: Synthetic oligonucleotide
ccagcgcaagtggaaggcggcc

SEQ ID NO: 24685 - DNA, 22 bp, Artificial Sequence
  Description of Artificial Sequence: Synthetic oligonucleotide
cagcgcaagtggaaggcggccc

SEQ ID NO: 24686 - DNA, 23 bp, Artificial Sequence
  Description of Artificial Sequence: Synthetic oligonucleotide
agcgcaagtggaaggcggcccgt

SEQ ID NO: 24687 - DNA, 22 bp, Artificial Sequence
  Description of Artificial Sequence: Synthetic oligonucleotide
gcgcaagtggaaggcggcccgt

SEQ ID NO: 24688 - DNA, 23 bp, Artificial Sequence
  Description of Artificial Sequence: Synthetic oligonucleotide
cgcaagtggaaggcggcccgtga

SEQ ID NO: 24689 - DNA, 23 bp, Artificial Sequence
  Description of Artificial Sequence: Synthetic oligonucleotide
gcaagtggaaggcggcccgtgag

SEQ ID NO: 24690 - DNA, 23 bp, Artificial Sequence
  Description of Artificial Sequence: Synthetic oligonucleotide
caagtggaaggcggcccgtgagg

SEQ ID NO: 24691 - DNA, 23 bp, Artificial Sequence
  Description of Artificial Sequence: Synthetic oligonucleotide
aagtggaaggcggcccgtgaggc

SEQ ID NO: 24692 - DNA, 22 bp, Artificial Sequence
  Description of Artificial Sequence: Synthetic oligonucleotide
agtggaaggcggcccgtgaggc

SEQ ID NO: 24693 - DNA, 21 bp, Artificial Sequence
  Description of Artificial Sequence: Synthetic oligonucleotide
gtggaaggcggcccgtgaggc

SEQ ID NO: 24694 - DNA, 21 bp, Artificial Sequence
  Description of Artificial Sequence: Synthetic oligonucleotide
tggaaggcggcccgtgaggcg

SEQ ID NO: 24695 - DNA, 20 bp, Artificial Sequence
  Description of Artificial Sequence: Synthetic oligonucleotide
ggaaggcggcccgtgaggcg

SEQ ID NO: 24696 - DNA, 21 bp, Artificial Sequence
  Description of Artificial Sequence: Synthetic oligonucleotide
gaaggcggcccgtgaggcgga

SEQ ID NO: 24697 - DNA, 21 bp, Artificial Sequence
  Description of Artificial Sequence: Synthetic oligonucleotide
aaggcggcccgtgaggcggag

SEQ ID NO: 24698 - DNA, 23 bp, Artificial Sequence
  Description of Artificial Sequence: Synthetic oligonucleotide
ggacacggcggctcagatcaccc

SEQ ID NO: 24699 - DNA, 23 bp, Artificial Sequence
  Description of Artificial Sequence: Synthetic oligonucleotide
gacacggcggctcagatcacccg

SEQ ID NO: 24700 - DNA, 23 bp, Artificial Sequence
  Description of Artificial Sequence: Synthetic oligonucleotide
acacggcggctcagatcacccgg

SEQ ID NO: 24701 - DNA, 22 bp, Artificial Sequence
  Description of Artificial Sequence: Synthetic oligonucleotide
cacggcggctcagatcacccgg

SEQ ID NO: 24702 - DNA, 22 bp, Artificial Sequence
  Description of Artificial Sequence: Synthetic oligonucleotide
acggcggctcagatcacccggc

SEQ ID NO: 24703 - DNA, 21 bp, Artificial Sequence
  Description of Artificial Sequence: Synthetic oligonucleotide
cggcggctcagatcacccggc

SEQ ID NO: 24704 - DNA, 21 bp, Artificial Sequence
  Description of Artificial Sequence: Synthetic oligonucleotide
ggcggctcagatcacccggcg

SEQ ID NO: 24705 - DNA, 23 bp, Artificial Sequence
  Description of Artificial Sequence: Synthetic oligonucleotide
gcggctcagatcacccggcgcaa

SEQ ID NO: 24706 - DNA, 24 bp, Artificial Sequence
  Description of Artificial Sequence: Synthetic oligonucleotide
cggctcagatcacccggcgcaagt

SEQ ID NO: 24707 - DNA, 24 bp, Artificial Sequence
  Description of Artificial Sequence: Synthetic oligonucleotide
ggctcagatcacccggcgcaagtg

SEQ ID NO: 24708 - DNA, 24 bp, Artificial Sequence
  Description of Artificial Sequence: Synthetic oligonucleotide
gctcagatcacccggcgcaagtgg

SEQ ID NO: 24709 - DNA, 25 bp, Artificial Sequence
  Description of Artificial Sequence: Synthetic oligonucleotide
ctcagatcacccggcgcaagtggga

SEQ ID NO: 24710 - DNA, 25 bp, Artificial Sequence
  Description of Artificial Sequence: Synthetic oligonucleotide
tcagatcacccggcgcaagtgggag

SEQ ID NO: 24711 - DNA, 24 bp, Artificial Sequence
  Description of Artificial Sequence: Synthetic oligonucleotide
cagatcacccggcgcaagtgggag

SEQ ID NO: 24712 - DNA, 24 bp, Artificial Sequence
  Description of Artificial Sequence: Synthetic oligonucleotide
agatcacccggcgcaagtgggagg

SEQ ID NO: 24713 - DNA, 23 bp, Artificial Sequence
  Description of Artificial Sequence: Synthetic oligonucleotide
gatcacccggcgcaagtgggagg

SEQ ID NO: 24714 - DNA, 23 bp, Artificial Sequence
  Description of Artificial Sequence: Synthetic oligonucleotide
atcacccggcgcaagtgggaggc

SEQ ID NO: 24715 - DNA, 22 bp, Artificial Sequence
  Description of Artificial Sequence: Synthetic oligonucleotide
tcacccggcgcaagtgggaggc

SEQ ID NO: 24716 - DNA, 21 bp, Artificial Sequence
  Description of Artificial Sequence: Synthetic oligonucleotide
cacccggcgcaagtgggaggc

SEQ ID NO: 24717 - DNA, 21 bp, Artificial Sequence
  Description of Artificial Sequence: Synthetic oligonucleotide
acccggcgcaagtgggaggcg

SEQ ID NO: 24718 - DNA, 20 bp, Artificial Sequence
  Description of Artificial Sequence: Synthetic oligonucleotide
cccggcgcaagtgggaggcg

SEQ ID NO: 24719 - DNA, 20 bp, Artificial Sequence
  Description of Artificial Sequence: Synthetic oligonucleotide
ccggcgcaagtgggaggcgg

SEQ ID NO: 24720 - DNA, 20 bp, Artificial Sequence
  Description of Artificial Sequence: Synthetic oligonucleotide
cggcgcaagtgggaggcggc

SEQ ID NO: 24721 - DNA, 26 bp, Artificial Sequence
  Description of Artificial Sequence: Synthetic oligonucleotide
ggcccaggcacagacttaccgagaga

SEQ ID NO: 24722 - DNA, 26 bp, Artificial Sequence
  Description of Artificial Sequence: Synthetic oligonucleotide
gcccaggcacagacttaccgagagag

SEQ ID NO: 24723 - DNA, 26 bp, Artificial Sequence
  Description of Artificial Sequence: Synthetic oligonucleotide
cccaggcacagacttaccgagagagc

SEQ ID NO: 24724 - DNA, 27 bp, Artificial Sequence
  Description of Artificial Sequence: Synthetic oligonucleotide
ccaggcacagacttaccgagagagcct

SEQ ID NO: 24725 - DNA, 27 bp, Artificial Sequence
  Description of Artificial Sequence: Synthetic oligonucleotide
caggcacagacttaccgagagagcctg

SEQ ID NO: 24726 - DNA, 27 bp, Artificial Sequence
  Description of Artificial Sequence: Synthetic oligonucleotide
aggcacagacttaccgagagagcctgc

SEQ ID NO: 24727 - DNA, 26 bp, Artificial Sequence
  Description of Artificial Sequence: Synthetic oligonucleotide
ggcacagacttaccgagagagcctgc

SEQ ID NO: 24728 - DNA, 26 bp, Artificial Sequence
  Description of Artificial Sequence: Synthetic oligonucleotide
gcacagacttaccgagagagcctgcg

SEQ ID NO: 24729 - DNA, 26 bp, Artificial Sequence
  Description of Artificial Sequence: Synthetic oligonucleotide
aaggcccaggcacagactgaccgagt

SEQ ID NO: 24730 - DNA, 25 bp, Artificial Sequence
  Description of Artificial Sequence: Synthetic oligonucleotide
aggcccaggcacagactgaccgagt

SEQ ID NO: 24731 - DNA, 24 bp, Artificial Sequence
  Description of Artificial Sequence: Synthetic oligonucleotide
ggcccaggcacagactgaccgagt

SEQ ID NO: 24732 - DNA, 25 bp, Artificial Sequence
  Description of Artificial Sequence: Synthetic oligonucleotide
gcccaggcacagactgaccgagtga

SEQ ID NO: 24733 - DNA, 25 bp, Artificial Sequence
  Description of Artificial Sequence: Synthetic oligonucleotide
cccaggcacagactgaccgagtgag

SEQ ID NO: 24734 - DNA, 25 bp, Artificial Sequence
  Description of Artificial Sequence: Synthetic oligonucleotide
ccaggcacagactgaccgagtgagc

SEQ ID NO: 24735 - DNA, 26 bp, Artificial Sequence
  Description of Artificial Sequence: Synthetic oligonucleotide
caggcacagactgaccgagtgagcct

SEQ ID NO: 24736 - DNA, 26 bp, Artificial Sequence
  Description of Artificial Sequence: Synthetic oligonucleotide
aggcacagactgaccgagtgagcctg

SEQ ID NO: 24737 - DNA, 25 bp, Artificial Sequence
  Description of Artificial Sequence: Synthetic oligonucleotide
ggcacagactgaccgagtgagcctg

SEQ ID NO: 24738 - DNA, 25 bp, Artificial Sequence
  Description of Artificial Sequence: Synthetic oligonucleotide
gcacagactgaccgagtgagcctgc

SEQ ID NO: 24739 - DNA, 25 bp, Artificial Sequence
  Description of Artificial Sequence: Synthetic oligonucleotide
cacagactgaccgagtgagcctgcg

SEQ ID NO: 24740 - DNA, 27 bp, Artificial Sequence
  Description of Artificial Sequence: Synthetic oligonucleotide
acagactgaccgagtgagcctgcggaa

SEQ ID NO: 24741 - DNA, 26 bp, Artificial Sequence
  Description of Artificial Sequence: Synthetic oligonucleotide
cagactgaccgagtgagcctgcggaa

SEQ ID NO: 24742 - DNA, 26 bp, Artificial Sequence
  Description of Artificial Sequence: Synthetic oligonucleotide
agactgaccgagtgagcctgcggaac

SEQ ID NO: 24743 - DNA, 25 bp, Artificial Sequence
  Description of Artificial Sequence: Synthetic oligonucleotide
gactgaccgagtgagcctgcggaac

SEQ ID NO: 24744 - DNA, 26 bp, Artificial Sequence
  Description of Artificial Sequence: Synthetic oligonucleotide
actgaccgagtgagcctgcggaacct

SEQ ID NO: 24745 - DNA, 26 bp, Artificial Sequence
  Description of Artificial Sequence: Synthetic oligonucleotide
ggctactacaaccagagcgaggccag

SEQ ID NO: 24746 - DNA, 27 bp, Artificial Sequence
  Description of Artificial Sequence: Synthetic oligonucleotide
gctactacaaccagagcgaggccaggt

SEQ ID NO: 24747 - DNA, 27 bp, Artificial Sequence
  Description of Artificial Sequence: Synthetic oligonucleotide
ctactacaaccagagcgaggccaggtc

SEQ ID NO: 24748 - DNA, 28 bp, Artificial Sequence
  Description of Artificial Sequence: Synthetic oligonucleotide
tactacaaccagagcgaggccaggtctc

SEQ ID NO: 24749 - DNA, 27 bp, Artificial Sequence
  Description of Artificial Sequence: Synthetic oligonucleotide
actacaaccagagcgaggccaggtctc

SEQ ID NO: 24750 - DNA, 27 bp, Artificial Sequence
  Description of Artificial Sequence: Synthetic oligonucleotide
ctacaaccagagcgaggccaggtctca

SEQ ID NO: 24751 - DNA, 27 bp, Artificial Sequence
  Description of Artificial Sequence: Synthetic oligonucleotide
tacaaccagagcgaggccaggtctcac

SEQ ID NO: 24752 - DNA, 27 bp, Artificial Sequence
  Description of Artificial Sequence: Synthetic oligonucleotide
acaaccagagcgaggccaggtctcaca

SEQ ID NO: 24753 - DNA, 26 bp, Artificial Sequence
  Description of Artificial Sequence: Synthetic oligonucleotide
caaccagagcgaggccaggtctcaca

SEQ ID NO: 24754 - DNA, 26 bp, Artificial Sequence
  Description of Artificial Sequence: Synthetic oligonucleotide
aaccagagcgaggccaggtctcacac

SEQ ID NO: 24755 - DNA, 25 bp, Artificial Sequence
  Description of Artificial Sequence: Synthetic oligonucleotide
accagagcgaggccaggtctcacac

SEQ ID NO: 24756 - DNA, 24 bp, Artificial Sequence
  Description of Artificial Sequence: Synthetic oligonucleotide
ccagagcgaggccaggtctcacac

SEQ ID NO: 24757 - DNA, 24 bp, Artificial Sequence
  Description of Artificial Sequence: Synthetic oligonucleotide
cagagcgaggccaggtctcacacc

SEQ ID NO: 24758 - DNA, 25 bp, Artificial Sequence
  Description of Artificial Sequence: Synthetic oligonucleotide
agagcgaggccaggtctcacaccct

SEQ ID NO: 24759 - DNA, 24 bp, Artificial Sequence
  Description of Artificial Sequence: Synthetic oligonucleotide
gagcgaggccaggtctcacaccct

SEQ ID NO: 24760 - DNA, 24 bp, Artificial Sequence
  Description of Artificial Sequence: Synthetic oligonucleotide
agcgaggccaggtctcacaccctc

SEQ ID NO: 24761 - DNA, 23 bp, Artificial Sequence
  Description of Artificial Sequence: Synthetic oligonucleotide
gcgaggccaggtctcacaccctc

SEQ ID NO: 24762 - DNA, 24 bp, Artificial Sequence
  Description of Artificial Sequence: Synthetic oligonucleotide
cgaggccaggtctcacaccctcca

SEQ ID NO: 24763 - DNA, 25 bp, Artificial Sequence
  Description of Artificial Sequence: Synthetic oligonucleotide
gaggccaggtctcacaccctccaga

SEQ ID NO: 24764 - DNA, 25 bp, Artificial Sequence
  Description of Artificial Sequence: Synthetic oligonucleotide
aggccaggtctcacaccctccagag

SEQ ID NO: 24765 - DNA, 24 bp, Artificial Sequence
  Description of Artificial Sequence: Synthetic oligonucleotide
ggccaggtctcacaccctccagag

SEQ ID NO: 24766 - DNA, 26 bp, Artificial Sequence
  Description of Artificial Sequence: Synthetic oligonucleotide
gccaggtctcacaccctccagagcat

SEQ ID NO: 24767 - DNA, 27 bp, Artificial Sequence
  Description of Artificial Sequence: Synthetic oligonucleotide
ccaggtctcacaccctccagagcatgt

SEQ ID NO: 24768 - DNA, 28 bp, Artificial Sequence
  Description of Artificial Sequence: Synthetic oligonucleotide
caggtctcacaccctccagagcatgtac

SEQ ID NO: 24769 - DNA, 28 bp, Artificial Sequence
  Description of Artificial Sequence: Synthetic oligonucleotide
aggtctcacaccctccagagcatgtacg

SEQ ID NO: 24770 - DNA, 25 bp, Artificial Sequence
  Description of Artificial Sequence: Synthetic oligonucleotide
caggaggggccggagtattgggact

SEQ ID NO: 24771 - DNA, 25 bp, Artificial Sequence
  Description of Artificial Sequence: Synthetic oligonucleotide
aggaggggccggagtattgggactg

SEQ ID NO: 24772 - DNA, 24 bp, Artificial Sequence
  Description of Artificial Sequence: Synthetic oligonucleotide
ggaggggccggagtattgggactg

SEQ ID NO: 24773 - DNA, 26 bp, Artificial Sequence
  Description of Artificial Sequence: Synthetic oligonucleotide
gaggggccggagtattgggactggaa

SEQ ID NO: 24774 - DNA, 27 bp, Artificial Sequence
  Description of Artificial Sequence: Synthetic oligonucleotide
aggggccggagtattgggactggaaca

SEQ ID NO: 24775 - DNA, 26 bp, Artificial Sequence
  Description of Artificial Sequence: Synthetic oligonucleotide
ggggccggagtattgggactggaaca

SEQ ID NO: 24776 - DNA, 27 bp, Artificial Sequence
  Description of Artificial Sequence: Synthetic oligonucleotide
gggccggagtattgggactggaacaca

SEQ ID NO: 24777 - DNA, 27 bp, Artificial Sequence
  Description of Artificial Sequence: Synthetic oligonucleotide
ggccggagtattgggactggaacacac

SEQ ID NO: 24778 - DNA, 28 bp, Artificial Sequence
  Description of Artificial Sequence: Synthetic oligonucleotide
gccggagtattgggactggaacacacag

SEQ ID NO: 24779 - DNA, 30 bp, Artificial Sequence
  Description of Artificial Sequence: Synthetic oligonucleotide
ccggagtattgggactggaacacacagatc

SEQ ID NO: 24780 - DNA, 32 bp, Artificial Sequence
  Description of Artificial Sequence: Synthetic oligonucleotide
cggagtattgggactggaacacacagatctac

SEQ ID NO: 24781 - DNA, 34 bp, Artificial Sequence
  Description of Artificial Sequence: Synthetic oligonucleotide
ggagtattgggactggaacacacagatctacaag

SEQ ID NO: 24782 - DNA, 34 bp, Artificial Sequence
  Description of Artificial Sequence: Synthetic oligonucleotide
gagtattgggactggaacacacagatctacaagg

SEQ ID NO: 24783 - DNA, 34 bp, Artificial Sequence
  Description of Artificial Sequence: Synthetic oligonucleotide
agtattgggactggaacacacagatctacaaggc

SEQ ID NO: 24784 - DNA, 33 bp, Artificial Sequence
  Description of Artificial Sequence: Synthetic oligonucleotide
gtattgggactggaacacacagatctacaaggc

SEQ ID NO: 24785 - DNA, 33 bp, Artificial Sequence
  Description of Artificial Sequence: Synthetic oligonucleotide
tattgggactggaacacacagatctacaaggcc

SEQ ID NO: 24786 - DNA, 32 bp, Artificial Sequence
  Description of Artificial Sequence: Synthetic oligonucleotide
attgggactggaacacacagatctacaaggcc

SEQ ID NO: 24787 - DNA, 31 bp, Artificial Sequence
  Description of Artificial Sequence: Synthetic oligonucleotide
ttgggactggaacacacagatctacaaggcc

SEQ ID NO: 24788 - DNA, 30 bp, Artificial Sequence
  Description of Artificial Sequence: Synthetic oligonucleotide
tgggactggaacacacagatctacaaggcc

SEQ ID NO: 24789 - DNA, 29 bp, Artificial Sequence
  Description of Artificial Sequence: Synthetic oligonucleotide
gggactggaacacacagatctacaaggcc

SEQ ID NO: 24790 - DNA, 29 bp, Artificial Sequence
  Description of Artificial Sequence: Synthetic oligonucleotide
ggactggaacacacagatctacaaggccc

SEQ ID NO: 24791 - DNA, 30 bp, Artificial Sequence
  Description of Artificial Sequence: Synthetic oligonucleotide
gactggaacacacagatctacaaggcccag

SEQ ID NO: 24792 - DNA, 30 bp, Artificial Sequence
  Description of Artificial Sequence: Synthetic oligonucleotide
actggaacacacagatctacaaggcccagg

SEQ ID NO: 24793 - DNA, 29 bp, Artificial Sequence
  Description of Artificial Sequence: Synthetic oligonucleotide
ctggaacacacagatctacaaggcccagg

SEQ ID NO: 24794 - DNA, 29 bp, Artificial Sequence
  Description of Artificial Sequence: Synthetic oligonucleotide
tggaacacacagatctacaaggcccaggc

SEQ ID NO: 24795 - DNA, 25 bp, Artificial Sequence
  Description of Artificial Sequence: Synthetic oligonucleotide
agagcgaggccgggtctcacacctt

SEQ ID NO: 24796 - DNA, 24 bp, Artificial Sequence
  Description of Artificial Sequence: Synthetic oligonucleotide
gagcgaggccgggtctcacacctt

SEQ ID NO: 24797 - DNA, 24 bp, Artificial Sequence
  Description of Artificial Sequence: Synthetic oligonucleotide
agcgaggccgggtctcacaccttc

SEQ ID NO: 24798 - DNA, 23 bp, Artificial Sequence
  Description of Artificial Sequence: Synthetic oligonucleotide
gcgaggccgggtctcacaccttc

SEQ ID NO: 24799 - DNA, 24 bp, Artificial Sequence
  Description of Artificial Sequence: Synthetic oligonucleotide
cgaggccgggtctcacaccttcca

SEQ ID NO: 24800 - DNA, 25 bp, Artificial Sequence
  Description of Artificial Sequence: Synthetic oligonucleotide
gaggccgggtctcacaccttccaga

SEQ ID NO: 24801 - DNA, 25 bp, Artificial Sequence
  Description of Artificial Sequence: Synthetic oligonucleotide
aggccgggtctcacaccttccagag

SEQ ID NO: 24802 - DNA, 24 bp, Artificial Sequence
  Description of Artificial Sequence: Synthetic oligonucleotide
ggccgggtctcacaccttccagag

SEQ ID NO: 24803 - DNA, 26 bp, Artificial Sequence
  Description of Artificial Sequence: Synthetic oligonucleotide
gccgggtctcacaccttccagagcat

SEQ ID NO: 24804 - DNA, 27 bp, Artificial Sequence
  Description of Artificial Sequence: Synthetic oligonucleotide
ccgggtctcacaccttccagagcatgt

SEQ ID NO: 24805 - DNA, 28 bp, Artificial Sequence
  Description of Artificial Sequence: Synthetic oligonucleotide
cgggtctcacaccttccagagcatgtac

SEQ ID NO: 24806 - DNA, 28 bp, Artificial Sequence
  Description of Artificial Sequence: Synthetic oligonucleotide
gggtctcacaccttccagagcatgtacg

SEQ ID NO: 24807 - DNA, 28 bp, Artificial Sequence
  Description of Artificial Sequence: Synthetic oligonucleotide
ggtctcacaccttccagagcatgtacgg

SEQ ID NO: 24808 - DNA, 28 bp, Artificial Sequence
  Description of Artificial Sequence: Synthetic oligonucleotide
gtctcacaccttccagagcatgtacggc

SEQ ID NO: 24809 - DNA, 29 bp, Artificial Sequence
  Description of Artificial Sequence: Synthetic oligonucleotide
tctcacaccttccagagcatgtacggctg

SEQ ID NO: 24810 - DNA, 28 bp, Artificial Sequence
  Description of Artificial Sequence: Synthetic oligonucleotide
ctcacaccttccagagcatgtacggctg

SEQ ID NO: 24811 - DNA, 28 bp, Artificial Sequence
  Description of Artificial Sequence: Synthetic oligonucleotide
tcacaccttccagagcatgtacggctgc

SEQ ID NO: 24812 - DNA, 27 bp, Artificial Sequence
  Description of Artificial Sequence: Synthetic oligonucleotide
cacaccttccagagcatgtacggctgc

SEQ ID NO: 24813 - DNA, 27 bp, Artificial Sequence
  Description of Artificial Sequence: Synthetic oligonucleotide
acaccttccagagcatgtacggctgcg

SEQ ID NO: 24814 - DNA, 27 bp, Artificial Sequence
  Description of Artificial Sequence: Synthetic oligonucleotide
caccttccagagcatgtacggctgcga

SEQ ID NO: 24815 - DNA, 27 bp, Artificial Sequence
  Description of Artificial Sequence: Synthetic oligonucleotide
accttccagagcatgtacggctgcgac

SEQ ID NO: 24816 - DNA, 26 bp, Artificial Sequence
  Description of Artificial Sequence: Synthetic oligonucleotide
ccttccagagcatgtacggctgcgac

SEQ ID NO: 24817 - DNA, 27 bp, Artificial Sequence
  Description of Artificial Sequence: Synthetic oligonucleotide
cttccagagcatgtacggctgcgacgt

SEQ ID NO: 24818 - DNA, 27 bp, Artificial Sequence
  Description of Artificial Sequence: Synthetic oligonucleotide
ttccagagcatgtacggctgcgacgtg

SEQ ID NO: 24819 - DNA, 20 bp, Artificial Sequence
  Description of Artificial Sequence: Synthetic oligonucleotide
agagaggagccgcgggcgcg

SEQ ID NO: 24820 - DNA, 20 bp, Artificial Sequence
  Description of Artificial Sequence: Synthetic oligonucleotide
gagaggagccgcgggcgcgt

SEQ ID NO: 24821 - DNA, 20 bp, Artificial Sequence
  Description of Artificial Sequence: Synthetic oligonucleotide
agaggagccgcgggcgcggt

SEQ ID NO: 24822 - DNA, 20 bp, Artificial Sequence
  Description of Artificial Sequence: Synthetic oligonucleotide
gaggagccgcgggcgcggtt

SEQ ID NO: 24823 - DNA, 20 bp, Artificial Sequence
  Description of Artificial Sequence: Synthetic oligonucleotide
aggagccgcgggcgcggtgt

SEQ ID NO: 24824 - DNA, 23 bp, Artificial Sequence
  Description of Artificial Sequence: Synthetic oligonucleotide
gcgcggtggatagagcaggaggg

SEQ ID NO: 24825 - DNA, 23 bp, Artificial Sequence
  Description of Artificial Sequence: Synthetic oligonucleotide
cgcggtggatagagcaggagggg

SEQ ID NO: 24826 - DNA, 23 bp, Artificial Sequence
  Description of Artificial Sequence: Synthetic oligonucleotide
gcggtggatagagcaggaggggc

SEQ ID NO: 24827 - DNA, 23 bp, Artificial Sequence
  Description of Artificial Sequence: Synthetic oligonucleotide
cggtggatagagcaggaggggcc

SEQ ID NO: 24828 - DNA, 23 bp, Artificial Sequence
  Description of Artificial Sequence: Synthetic oligonucleotide
ggtggatagagcaggaggggccg

SEQ ID NO: 24829 - DNA, 26 bp, Artificial Sequence
  Description of Artificial Sequence: Synthetic oligonucleotide
cggctcagatcacccagcgcaagtgt

SEQ ID NO: 24830 - DNA, 27 bp, Artificial Sequence
  Description of Artificial Sequence: Synthetic oligonucleotide
ggctcagatcacccagcgcaagtgtga

SEQ ID NO: 24831 - DNA, 27 bp, Artificial Sequence
  Description of Artificial Sequence: Synthetic oligonucleotide
gctcagatcacccagcgcaagtgtgag

SEQ ID NO: 24832 - DNA, 27 bp, Artificial Sequence
  Description of Artificial Sequence: Synthetic oligonucleotide
ctcagatcacccagcgcaagtgtgagg

SEQ ID NO: 24833 - DNA, 27 bp, Artificial Sequence
  Description of Artificial Sequence: Synthetic oligonucleotide
tcagatcacccagcgcaagtgtgaggc

SEQ ID NO: 24834 - DNA, 26 bp, Artificial Sequence
  Description of Artificial Sequence: Synthetic oligonucleotide
cagatcacccagcgcaagtgtgaggc

SEQ ID NO: 24835 - DNA, 26 bp, Artificial Sequence
  Description of Artificial Sequence: Synthetic oligonucleotide
agatcacccagcgcaagtgtgaggcg

SEQ ID NO: 24836 - DNA, 25 bp, Artificial Sequence
  Description of Artificial Sequence: Synthetic oligonucleotide
gatcacccagcgcaagtgtgaggcg

SEQ ID NO: 24837 - DNA, 25 bp, Artificial Sequence
  Description of Artificial Sequence: Synthetic oligonucleotide
atcacccagcgcaagtgtgaggcgg

SEQ ID NO: 24838 - DNA, 24 bp, Artificial Sequence
  Description of Artificial Sequence: Synthetic oligonucleotide
tcacccagcgcaagtgtgaggcgg

SEQ ID NO: 24839 - DNA, 23 bp, Artificial Sequence
  Description of Artificial Sequence: Synthetic oligonucleotide
cacccagcgcaagtgtgaggcgg

SEQ ID NO: 24840 - DNA, 23 bp, Artificial Sequence
  Description of Artificial Sequence: Synthetic oligonucleotide
acccagcgcaagtgtgaggcggc

SEQ ID NO: 24841 - DNA, 22 bp, Artificial Sequence
  Description of Artificial Sequence: Synthetic oligonucleotide
cccagcgcaagtgtgaggcggc

SEQ ID NO: 24842 - DNA, 22 bp, Artificial Sequence
  Description of Artificial Sequence: Synthetic oligonucleotide
ccagcgcaagtgtgaggcggcc

SEQ ID NO: 24843 - DNA, 22 bp, Artificial Sequence
  Description of Artificial Sequence: Synthetic oligonucleotide
cagcgcaagtgtgaggcggccc

SEQ ID NO: 24844 - DNA, 23 bp, Artificial Sequence
  Description of Artificial Sequence: Synthetic oligonucleotide
agcgcaagtgtgaggcggcccgt

SEQ ID NO: 24845 - DNA, 22 bp, Artificial Sequence
  Description of Artificial Sequence: Synthetic oligonucleotide
gcgcaagtgtgaggcggcccgt

SEQ ID NO: 24846 - DNA, 23 bp, Artificial Sequence
  Description of Artificial Sequence: Synthetic oligonucleotide
cgcaagtgtgaggcggcccgtga

SEQ ID NO: 24847 - DNA, 23 bp, Artificial Sequence
  Description of Artificial Sequence: Synthetic oligonucleotide
gcaagtgtgaggcggcccgtgag

SEQ ID NO: 24848 - DNA, 23 bp, Artificial Sequence
  Description of Artificial Sequence: Synthetic oligonucleotide
caagtgtgaggcggcccgtgagg

SEQ ID NO: 24849 - DNA, 23 bp, Artificial Sequence
  Description of Artificial Sequence: Synthetic oligonucleotide
aagtgtgaggcggcccgtgaggc

SEQ ID NO: 24850 - DNA, 22 bp, Artificial Sequence
  Description of Artificial Sequence: Synthetic oligonucleotide
agtgtgaggcggcccgtgaggc

SEQ ID NO: 24851 - DNA, 21 bp, Artificial Sequence
  Description of Artificial Sequence: Synthetic oligonucleotide
gtgtgaggcggcccgtgaggc

SEQ ID NO: 24852 - DNA, 21 bp, Artificial Sequence
  Description of Artificial Sequence: Synthetic oligonucleotide
tgtgaggcggcccgtgaggcg

SEQ ID NO: 24853 - DNA, 20 bp, Artificial Sequence
  Description of Artificial Sequence: Synthetic oligonucleotide
gtgaggcggcccgtgaggcg

SEQ ID NO: 24854 - DNA, 21 bp, Artificial Sequence
  Description of Artificial Sequence: Synthetic oligonucleotide
tgaggcggcccgtgaggcgga

SEQ ID NO: 24855 - DNA, 24 bp, Artificial Sequence
  Description of Artificial Sequence: Synthetic oligonucleotide
catgtacggctgcgacgtggggca

SEQ ID NO: 24856 - DNA, 24 bp, Artificial Sequence
  Description of Artificial Sequence: Synthetic oligonucleotide
atgtacggctgcgacgtggggcag

SEQ ID NO: 24857 - DNA, 23 bp, Artificial Sequence
  Description of Artificial Sequence: Synthetic oligonucleotide
tgtacggctgcgacgtggggcag

SEQ ID NO: 24858 - DNA, 22 bp, Artificial Sequence
  Description of Artificial Sequence: Synthetic oligonucleotide
gtacggctgcgacgtggggcag

SEQ ID NO: 24859 - DNA, 23 bp, Artificial Sequence
  Description of Artificial Sequence: Synthetic oligonucleotide
tacggctgcgacgtggggcagga

SEQ ID NO: 24860 - DNA, 22 bp, Artificial Sequence
  Description of Artificial Sequence: Synthetic oligonucleotide
acggctgcgacgtggggcagga

SEQ ID NO: 24861 - DNA, 21 bp, Artificial Sequence
  Description of Artificial Sequence: Synthetic oligonucleotide
cggctgcgacgtggggcagga

SEQ ID NO: 24862 - DNA, 21 bp, Artificial Sequence
  Description of Artificial Sequence: Synthetic oligonucleotide
ggctgcgacgtggggcaggac

SEQ ID NO: 24863 - DNA, 21 bp, Artificial Sequence
  Description of Artificial Sequence: Synthetic oligonucleotide
gctgcgacgtggggcaggacg

SEQ ID NO: 24864 - DNA, 21 bp, Artificial Sequence
  Description of Artificial Sequence: Synthetic oligonucleotide
ctgcgacgtggggcaggacgg

SEQ ID NO: 24865 - DNA, 21 bp, Artificial Sequence
  Description of Artificial Sequence: Synthetic oligonucleotide
tgcgacgtggggcaggacggg

SEQ ID NO: 24866 - DNA, 20 bp, Artificial Sequence
  Description of Artificial Sequence: Synthetic oligonucleotide
gcgacgtggggcaggacggg

SEQ ID NO: 24867 - DNA, 20 bp, Artificial Sequence
  Description of Artificial Sequence: Synthetic oligonucleotide
cgacgtggggcaggacgggc

SEQ ID NO: 24868 - DNA, 20 bp, Artificial Sequence
  Description of Artificial Sequence: Synthetic oligonucleotide
gacgtggggcaggacgggcg

SEQ ID NO: 24869 - DNA, 20 bp, Artificial Sequence
  Description of Artificial Sequence: Synthetic oligonucleotide
acgtggggcaggacgggcgc

SEQ ID NO: 24870 - DNA, 20 bp, Artificial Sequence
  Description of Artificial Sequence: Synthetic oligonucleotide
cgtggggcaggacgggcgct

SEQ ID NO: 24871 - DNA, 20 bp, Artificial Sequence
  Description of Artificial Sequence: Synthetic oligonucleotide
gtggggcaggacgggcgcct

SEQ ID NO: 24872 - DNA, 20 bp, Artificial Sequence
  Description of Artificial Sequence: Synthetic oligonucleotide
tggggcaggacgggcgcctc

SEQ ID NO: 24873 - DNA, 20 bp, Artificial Sequence
  Description of Artificial Sequence: Synthetic oligonucleotide
ggggcaggacgggcgcctct

SEQ ID NO: 24874 - DNA, 20 bp, Artificial Sequence
  Description of Artificial Sequence: Synthetic oligonucleotide
gggcaggacgggcgcctcct

SEQ ID NO: 24875 - DNA, 20 bp, Artificial Sequence
  Description of Artificial Sequence: Synthetic oligonucleotide
ggcaggacgggcgcctcctc

SEQ ID NO: 24876 - DNA, 20 bp, Artificial Sequence
  Description of Artificial Sequence: Synthetic oligonucleotide
gcaggacgggcgcctcctcc

SEQ ID NO: 24877 - DNA, 20 bp, Artificial Sequence
  Description of Artificial Sequence: Synthetic oligonucleotide
caggacgggcgcctcctccg

SEQ ID NO: 24878 - DNA, 20 bp, Artificial Sequence
  Description of Artificial Sequence: Synthetic oligonucleotide
aggacgggcgcctcctccgc

SEQ ID NO: 24879 - DNA, 27 bp, Artificial Sequence
  Description of Artificial Sequence: Synthetic oligonucleotide
ccggctcccactccatgaggtatttcg

SEQ ID NO: 24880 - DNA, 28 bp, Artificial Sequence
  Description of Artificial Sequence: Synthetic oligonucleotide
cggctcccactccatgaggtatttcgac

SEQ ID NO: 24881 - DNA, 29 bp, Artificial Sequence
  Description of Artificial Sequence: Synthetic oligonucleotide
ggctcccactccatgaggtatttcgacac

SEQ ID NO: 24882 - DNA, 28 bp, Artificial Sequence
  Description of Artificial Sequence: Synthetic oligonucleotide
gcagatacctggagaacgggaaggacac

SEQ ID NO: 24883 - DNA, 28 bp, Artificial Sequence
  Description of Artificial Sequence: Synthetic oligonucleotide
cagatacctggagaacgggaaggacacg

SEQ ID NO: 24884 - DNA, 28 bp, Artificial Sequence
  Description of Artificial Sequence: Synthetic oligonucleotide
agatacctggagaacgggaaggacacgc

SEQ ID NO: 24885 - DNA, 27 bp, Artificial Sequence
  Description of Artificial Sequence: Synthetic oligonucleotide
gatacctggagaacgggaaggacacgc

SEQ ID NO: 24886 - DNA, 28 bp, Artificial Sequence
  Description of Artificial Sequence: Synthetic oligonucleotide
atacctggagaacgggaaggacacgctg

SEQ ID NO: 24887 - DNA, 27 bp, Artificial Sequence
  Description of Artificial Sequence: Synthetic oligonucleotide
tacctggagaacgggaaggacacgctg

SEQ ID NO: 24888 - DNA, 26 bp, Artificial Sequence
  Description of Artificial Sequence: Synthetic oligonucleotide
acctggagaacgggaaggacacgctg

SEQ ID NO: 24889 - DNA, 25 bp, Artificial Sequence
  Description of Artificial Sequence: Synthetic oligonucleotide
cctggagaacgggaaggacacgctg

SEQ ID NO: 24890 - DNA, 26 bp, Artificial Sequence
  Description of Artificial Sequence: Synthetic oligonucleotide
ctggagaacgggaaggacacgctgga

SEQ ID NO: 24891 - DNA, 26 bp, Artificial Sequence
  Description of Artificial Sequence: Synthetic oligonucleotide
tggagaacgggaaggacacgctggag

SEQ ID NO: 24892 - DNA, 25 bp, Artificial Sequence
  Description of Artificial Sequence: Synthetic oligonucleotide
ggagaacgggaaggacacgctggag

SEQ ID NO: 24893 - DNA, 25 bp, Artificial Sequence
  Description of Artificial Sequence: Synthetic oligonucleotide
gagaacgggaaggacacgctggagc

SEQ ID NO: 24894 - DNA, 25 bp, Artificial Sequence
  Description of Artificial Sequence: Synthetic oligonucleotide
agaacgggaaggacacgctggagcg

SEQ ID NO: 24895 - DNA, 24 bp, Artificial Sequence
  Description of Artificial Sequence: Synthetic oligonucleotide
gaacgggaaggacacgctggagcg

SEQ ID NO: 24896 - DNA, 24 bp, Artificial Sequence
  Description of Artificial Sequence: Synthetic oligonucleotide
aacgggaaggacacgctggagcgc

SEQ ID NO: 24897 - DNA, 23 bp, Artificial Sequence
  Description of Artificial Sequence: Synthetic oligonucleotide
acgggaaggacacgctggagcgc

SEQ ID NO: 24898 - DNA, 22 bp, Artificial Sequence
  Description of Artificial Sequence: Synthetic oligonucleotide
cgggaaggacacgctggagcgc

SEQ ID NO: 24899 - DNA, 22 bp, Artificial Sequence
  Description of Artificial Sequence: Synthetic oligonucleotide
gggaaggacacgctggagcgcg

SEQ ID NO: 24900 - DNA, 22 bp, Artificial Sequence
  Description of Artificial Sequence: Synthetic oligonucleotide
ggaaggacacgctggagcgcgc

SEQ ID NO: 24901 - DNA, 22 bp, Artificial Sequence
  Description of Artificial Sequence: Synthetic oligonucleotide
gaaggacacgctggagcgcgcg

SEQ ID NO: 24902 - DNA, 23 bp, Artificial Sequence
  Description of Artificial Sequence: Synthetic oligonucleotide
aaggacacgctggagcgcgcgga

SEQ ID NO: 24903 - DNA, 22 bp, Artificial Sequence
  Description of Artificial Sequence: Synthetic oligonucleotide
aggacacgctggagcgcgcgga

SEQ ID NO: 24904 - DNA, 21 bp, Artificial Sequence
  Description of Artificial Sequence: Synthetic oligonucleotide
ggacacgctggagcgcgcgga

SEQ ID NO: 24905 - DNA, 21 bp, Artificial Sequence
  Description of Artificial Sequence: Synthetic oligonucleotide
gacacgctggagcgcgcggac

SEQ ID NO: 24906 - DNA, 21 bp, Artificial Sequence
  Description of Artificial Sequence: Synthetic oligonucleotide
acacgctggagcgcgcggacc

SEQ ID NO: 24907 - DNA, 20 bp, Artificial Sequence
  Description of Artificial Sequence: Synthetic oligonucleotide
cacgctggagcgcgcggacc

SEQ ID NO: 24908 - DNA, 20 bp, Artificial Sequence
  Description of Artificial Sequence: Synthetic oligonucleotide
acgctggagcgcgcggaccc

SEQ ID NO: 24909 - DNA, 20 bp, Artificial Sequence
  Description of Artificial Sequence: Synthetic oligonucleotide
cgctggagcgcgcggaccct

SEQ ID NO: 24910 - DNA, 20 bp, Artificial Sequence
  Description of Artificial Sequence: Synthetic oligonucleotide
gctggagcgcgcggacccct

SEQ ID NO: 24911 - DNA, 20 bp, Artificial Sequence
  Description of Artificial Sequence: Synthetic oligonucleotide
ctggagcgcgcggaccccct

SEQ ID NO: 24912 - DNA, 22 bp, Artificial Sequence
  Description of Artificial Sequence: Synthetic oligonucleotide
tggagcgcgcggaccccccaaa

SEQ ID NO: 24913 - DNA, 21 bp, Artificial Sequence
  Description of Artificial Sequence: Synthetic oligonucleotide
ggagcgcgcggaccccccaaa

SEQ ID NO: 24914 - DNA, 22 bp, Artificial Sequence
  Description of Artificial Sequence: Synthetic oligonucleotide
gagcgcgcggaccccccaaaga

SEQ ID NO: 24915 - DNA, 29 bp, Artificial Sequence
  Description of Artificial Sequence: Synthetic oligonucleotide
tcgctgctgtgatgtgtaggaggaagagc

SEQ ID NO: 24916 - DNA, 28 bp, Artificial Sequence
  Description of Artificial Sequence: Synthetic oligonucleotide
cgctgctgtgatgtgtaggaggaagagc

SEQ ID NO: 24917 - DNA, 29 bp, Artificial Sequence
  Description of Artificial Sequence: Synthetic oligonucleotide
gctgctgtgatgtgtaggaggaagagctc

SEQ ID NO: 24918 - DNA, 30 bp, Artificial Sequence
  Description of Artificial Sequence: Synthetic oligonucleotide
ctgctgtgatgtgtaggaggaagagctcag

SEQ ID NO: 24919 - DNA, 30 bp, Artificial Sequence
  Description of Artificial Sequence: Synthetic oligonucleotide
tgctgtgatgtgtaggaggaagagctcagg

SEQ ID NO: 24920 - DNA, 29 bp, Artificial Sequence
  Description of Artificial Sequence: Synthetic oligonucleotide
gctgtgatgtgtaggaggaagagctcagg

SEQ ID NO: 24921 - DNA, 30 bp, Artificial Sequence
  Description of Artificial Sequence: Synthetic oligonucleotide
ctgtgatgtgtaggaggaagagctcaggtg

SEQ ID NO: 24922 - DNA, 30 bp, Artificial Sequence
  Description of Artificial Sequence: Synthetic oligonucleotide
tgtgatgtgtaggaggaagagctcaggtgg

SEQ ID NO: 24923 - DNA, 29 bp, Artificial Sequence
  Description of Artificial Sequence: Synthetic oligonucleotide
gtgatgtgtaggaggaagagctcaggtgg

SEQ ID NO: 24924 - DNA, 33 bp, Artificial Sequence
  Description of Artificial Sequence: Synthetic oligonucleotide
tgatgtgtaggaggaagagctcaggtggaaaag

SEQ ID NO: 24925 - DNA, 32 bp, Artificial Sequence
  Description of Artificial Sequence: Synthetic oligonucleotide
gatgtgtaggaggaagagctcaggtggaaaag

SEQ ID NO: 24926 - DNA, 32 bp, Artificial Sequence
  Description of Artificial Sequence: Synthetic oligonucleotide
atgtgtaggaggaagagctcaggtggaaaagg

SEQ ID NO: 24927 - DNA, 31 bp, Artificial Sequence
  Description of Artificial Sequence: Synthetic oligonucleotide
tgtgtaggaggaagagctcaggtggaaaagg

SEQ ID NO: 24928 - DNA, 30 bp, Artificial Sequence
  Description of Artificial Sequence: Synthetic oligonucleotide
gtgtaggaggaagagctcaggtggaaaagg

SEQ ID NO: 24929 - DNA, 31 bp, Artificial Sequence
  Description of Artificial Sequence: Synthetic oligonucleotide
tgtaggaggaagagctcaggtggaaaaggag

SEQ ID NO: 24930 - DNA, 30 bp, Artificial Sequence
  Description of Artificial Sequence: Synthetic oligonucleotide
gtaggaggaagagctcaggtggaaaaggag

SEQ ID NO: 24931 - DNA, 30 bp, Artificial Sequence
  Description of Artificial Sequence: Synthetic oligonucleotide
taggaggaagagctcaggtggaaaaggagg

SEQ ID NO: 24932 - DNA, 29 bp, Artificial Sequence
  Description of Artificial Sequence: Synthetic oligonucleotide
aggaggaagagctcaggtggaaaaggagg

SEQ ID NO: 24933 - DNA, 28 bp, Artificial Sequence
  Description of Artificial Sequence: Synthetic oligonucleotide
ggaggaagagctcaggtggaaaaggagg

SEQ ID NO: 24934 - DNA, 28 bp, Artificial Sequence
  Description of Artificial Sequence: Synthetic oligonucleotide
gaggaagagctcaggtggaaaaggaggg

SEQ ID NO: 24935 - DNA, 29 bp, Artificial Sequence
  Description of Artificial Sequence: Synthetic oligonucleotide
aggaagagctcaggtggaaaaggagggag

SEQ ID NO: 24936 - DNA, 28 bp, Artificial Sequence
  Description of Artificial Sequence: Synthetic oligonucleotide
ggaagagctcaggtggaaaaggagggag

SEQ ID NO: 24937 - DNA, 28 bp, Artificial Sequence
  Description of Artificial Sequence: Synthetic oligonucleotide
gaagagctcaggtggaaaaggagggagc

SEQ ID NO: 24938 - DNA, 30 bp, Artificial Sequence
  Description of Artificial Sequence: Synthetic oligonucleotide
aagagctcaggtggaaaaggagggagctac

SEQ ID NO: 24939 - DNA, 29 bp, Artificial Sequence
  Description of Artificial Sequence: Synthetic oligonucleotide
agagctcaggtggaaaaggagggagctac

SEQ ID NO: 24940 - DNA, 28 bp, Artificial Sequence
  Description of Artificial Sequence: Synthetic oligonucleotide
gagctcaggtggaaaaggagggagctac

SEQ ID NO: 24941 - DNA, 29 bp, Artificial Sequence
  Description of Artificial Sequence: Synthetic oligonucleotide
agctcaggtggaaaaggagggagctactc

SEQ ID NO: 24942 - DNA, 28 bp, Artificial Sequence
  Description of Artificial Sequence: Synthetic oligonucleotide
gctcaggtggaaaaggagggagctactc

SEQ ID NO: 24943 - DNA, 29 bp, Artificial Sequence
  Description of Artificial Sequence: Synthetic oligonucleotide
ctcaggtggaaaaggagggagctactctc

SEQ ID NO: 24944 - DNA, 22 bp, Artificial Sequence
  Description of Artificial Sequence: Synthetic oligonucleotide
aaggacacgctggagcgcgcgg

SEQ ID NO: 24945 - DNA, 29 bp, Artificial Sequence
  Description of Artificial Sequence: Synthetic oligonucleotide
gacgacacgcagttcgtgaggttcgatag

SEQ ID NO: 24946 - DNA, 29 bp, Artificial Sequence
  Description of Artificial Sequence: Synthetic oligonucleotide
acgacacgcagttcgtgaggttcgatagc

SEQ ID NO: 24947 - DNA, 28 bp, Artificial Sequence
  Description of Artificial Sequence: Synthetic oligonucleotide
cgacacgcagttcgtgaggttcgatagc

SEQ ID NO: 24948 - DNA, 28 bp, Artificial Sequence
  Description of Artificial Sequence: Synthetic oligonucleotide
gacacgcagttcgtgaggttcgatagcg

SEQ ID NO: 24949 - DNA, 29 bp, Artificial Sequence
  Description of Artificial Sequence: Synthetic oligonucleotide
acacgcagttcgtgaggttcgatagcgac

SEQ ID NO: 24950 - DNA, 28 bp, Artificial Sequence
  Description of Artificial Sequence: Synthetic oligonucleotide
cacgcagttcgtgaggttcgatagcgac

SEQ ID NO: 24951 - DNA, 28 bp, Artificial Sequence
  Description of Artificial Sequence: Synthetic oligonucleotide
acgcagttcgtgaggttcgatagcgacg

SEQ ID NO: 24952 - DNA, 27 bp, Artificial Sequence
  Description of Artificial Sequence: Synthetic oligonucleotide
cgcagttcgtgaggttcgatagcgacg

SEQ ID NO: 24953 - DNA, 27 bp, Artificial Sequence
  Description of Artificial Sequence: Synthetic oligonucleotide
gcagttcgtgaggttcgatagcgacgc

SEQ ID NO: 24954 - DNA, 27 bp, Artificial Sequence
  Description of Artificial Sequence: Synthetic oligonucleotide
cagttcgtgaggttcgatagcgacgcc

SEQ ID NO: 24955 - DNA, 27 bp, Artificial Sequence
  Description of Artificial Sequence: Synthetic oligonucleotide
agttcgtgaggttcgatagcgacgccg

SEQ ID NO: 24956 - DNA, 26 bp, Artificial Sequence
  Description of Artificial Sequence: Synthetic oligonucleotide
gttcgtgaggttcgatagcgacgccg

SEQ ID NO: 24957 - DNA, 26 bp, Artificial Sequence
  Description of Artificial Sequence: Synthetic oligonucleotide
ttcgtgaggttcgatagcgacgccgc

SEQ ID NO: 24958 - DNA, 25 bp, Artificial Sequence
  Description of Artificial Sequence: Synthetic oligonucleotide
tcgtgaggttcgatagcgacgccgc

SEQ ID NO: 24959 - DNA, 24 bp, Artificial Sequence
  Description of Artificial Sequence: Synthetic oligonucleotide
cgtgaggttcgatagcgacgccgc

SEQ ID NO: 24960 - DNA, 25 bp, Artificial Sequence
  Description of Artificial Sequence: Synthetic oligonucleotide
gtgaggttcgatagcgacgccgcga

SEQ ID NO: 24961 - DNA, 26 bp, Artificial Sequence
  Description of Artificial Sequence: Synthetic oligonucleotide
tgaggttcgatagcgacgccgcgagt

SEQ ID NO: 24962 - DNA, 25 bp, Artificial Sequence
  Description of Artificial Sequence: Synthetic oligonucleotide
gaggttcgatagcgacgccgcgagt

SEQ ID NO: 24963 - DNA, 25 bp, Artificial Sequence
  Description of Artificial Sequence: Synthetic oligonucleotide
aggttcgatagcgacgccgcgagtc

SEQ ID NO: 24964 - DNA, 24 bp, Artificial Sequence
  Description of Artificial Sequence: Synthetic oligonucleotide
ggttcgatagcgacgccgcgagtc

SEQ ID NO: 24965 - DNA, 24 bp, Artificial Sequence
  Description of Artificial Sequence: Synthetic oligonucleotide
gttcgatagcgacgccgcgagtcc

SEQ ID NO: 24966 - DNA, 25 bp, Artificial Sequence
  Description of Artificial Sequence: Synthetic oligonucleotide
ttcgatagcgacgccgcgagtccga

SEQ ID NO: 24967 - DNA, 24 bp, Artificial Sequence
  Description of Artificial Sequence: Synthetic oligonucleotide
tcgatagcgacgccgcgagtccga

SEQ ID NO: 24968 - DNA, 23 bp, Artificial Sequence
  Description of Artificial Sequence: Synthetic oligonucleotide
cgatagcgacgccgcgagtccga

SEQ ID NO: 24969 - DNA, 24 bp, Artificial Sequence
  Description of Artificial Sequence: Synthetic oligonucleotide
gatagcgacgccgcgagtccgaga

SEQ ID NO: 24970 - DNA, 25 bp, Artificial Sequence
  Description of Artificial Sequence: Synthetic oligonucleotide
atagcgacgccgcgagtccgagaga

SEQ ID NO: 24971 - DNA, 24 bp, Artificial Sequence
  Description of Artificial Sequence: Synthetic oligonucleotide
tagcgacgccgcgagtccgagaga

SEQ ID NO: 24972 - DNA, 30 bp, Artificial Sequence
  Description of Artificial Sequence: Synthetic oligonucleotide
accaacacacagactgaccgagagagcttg

SEQ ID NO: 24973 - DNA, 29 bp, Artificial Sequence
  Description of Artificial Sequence: Synthetic oligonucleotide
ccaacacacagactgaccgagagagcttg

SEQ ID NO: 24974 - DNA, 29 bp, Artificial Sequence
  Description of Artificial Sequence: Synthetic oligonucleotide
caacacacagactgaccgagagagcttgc

SEQ ID NO: 24975 - DNA, 29 bp, Artificial Sequence
  Description of Artificial Sequence: Synthetic oligonucleotide
aacacacagactgaccgagagagcttgcg

SEQ ID NO: 24976 - DNA, 28 bp, Artificial Sequence
  Description of Artificial Sequence: Synthetic oligonucleotide
acacacagactgaccgagagagcttgcg

SEQ ID NO: 24977 - DNA, 27 bp, Artificial Sequence
  Description of Artificial Sequence: Synthetic oligonucleotide
cacacagactgaccgagagagcttgcg

SEQ ID NO: 24978 - DNA, 27 bp, Artificial Sequence
  Description of Artificial Sequence: Synthetic oligonucleotide
acacagactgaccgagagagcttgcgg

SEQ ID NO: 24979 - DNA, 27 bp, Artificial Sequence
  Description of Artificial Sequence: Synthetic oligonucleotide
cacagactgaccgagagagcttgcgga

SEQ ID NO: 24980 - DNA, 28 bp, Artificial Sequence
  Description of Artificial Sequence: Synthetic oligonucleotide
acagactgaccgagagagcttgcggaac

SEQ ID NO: 24981 - DNA, 27 bp, Artificial Sequence
  Description of Artificial Sequence: Synthetic oligonucleotide
cagactgaccgagagagcttgcggaac

SEQ ID NO: 24982 - DNA, 27 bp, Artificial Sequence
  Description of Artificial Sequence: Synthetic oligonucleotide
agactgaccgagagagcttgcggaacc

SEQ ID NO: 24983 - DNA, 27 bp, Artificial Sequence
  Description of Artificial Sequence: Synthetic oligonucleotide
gactgaccgagagagcttgcggaacct

SEQ ID NO: 24984 - DNA, 27 bp, Artificial Sequence
  Description of Artificial Sequence: Synthetic oligonucleotide
actgaccgagagagcttgcggaacctg

SEQ ID NO: 24985 - DNA, 26 bp, Artificial Sequence
  Description of Artificial Sequence: Synthetic oligonucleotide
ctgaccgagagagcttgcggaacctg

SEQ ID NO: 24986 - DNA, 26 bp, Artificial Sequence
  Description of Artificial Sequence: Synthetic oligonucleotide
tgaccgagagagcttgcggaacctgc

SEQ ID NO: 24987 - DNA, 25 bp, Artificial Sequence
  Description of Artificial Sequence: Synthetic oligonucleotide
gaccgagagagcttgcggaacctgc

SEQ ID NO: 24988 - DNA, 25 bp, Artificial Sequence
  Description of Artificial Sequence: Synthetic oligonucleotide
accgagagagcttgcggaacctgcg

SEQ ID NO: 24989 - DNA, 24 bp, Artificial Sequence
  Description of Artificial Sequence: Synthetic oligonucleotide
ccgagagagcttgcggaacctgcg

SEQ ID NO: 24990 - DNA, 24 bp, Artificial Sequence
  Description of Artificial Sequence: Synthetic oligonucleotide
cgagagagcttgcggaacctgcgc

SEQ ID NO: 24991 - DNA, 24 bp, Artificial Sequence
  Description of Artificial Sequence: Synthetic oligonucleotide
gagagagcttgcggaacctgcgcg

SEQ ID NO: 24992 - DNA, 24 bp, Artificial Sequence
  Description of Artificial Sequence: Synthetic oligonucleotide
agagagcttgcggaacctgcgcgg

SEQ ID NO: 24993 - DNA, 23 bp, Artificial Sequence
  Description of Artificial Sequence: Synthetic oligonucleotide
gagagcttgcggaacctgcgcgg

SEQ ID NO: 24994 - DNA, 25 bp, Artificial Sequence
  Description of Artificial Sequence: Synthetic oligonucleotide
agagcttgcggaacctgcgcggcta

SEQ ID NO: 24995 - DNA, 24 bp, Artificial Sequence
  Description of Artificial Sequence: Synthetic oligonucleotide
gagcttgcggaacctgcgcggcta

SEQ ID NO: 24996 - DNA, 26 bp, Artificial Sequence
  Description of Artificial Sequence: Synthetic oligonucleotide
agcttgcggaacctgcgcggctacta

SEQ ID NO: 24997 - DNA, 25 bp, Artificial Sequence
  Description of Artificial Sequence: Synthetic oligonucleotide
gcttgcggaacctgcgcggctacta

SEQ ID NO: 24998 - DNA, 27 bp, Artificial Sequence
  Description of Artificial Sequence: Synthetic oligonucleotide
cttgcggaacctgcgcggctactacaa

SEQ ID NO: 24999 - DNA, 27 bp, Artificial Sequence
  Description of Artificial Sequence: Synthetic oligonucleotide
ttgcggaacctgcgcggctactacaac

SEQ ID NO: 25000 - DNA, 36 bp, Artificial Sequence
  Description of Artificial Sequence: Synthetic oligonucleotide
tattgggaccggaacacacagatcttcaagacaaac

SEQ ID NO: 25001 - DNA, 35 bp, Artificial Sequence
  Description of Artificial Sequence: Synthetic oligonucleotide
attgggaccggaacacacagatcttcaagacaaac

SEQ ID NO: 25002 - DNA, 34 bp, Artificial Sequence
  Description of Artificial Sequence: Synthetic oligonucleotide
ttgggaccggaacacacagatcttcaagacaaac

SEQ ID NO: 25003 - DNA, 33 bp, Artificial Sequence
  Description of Artificial Sequence: Synthetic oligonucleotide
tgggaccggaacacacagatcttcaagacaaac

SEQ ID NO: 25004 - DNA, 32 bp, Artificial Sequence
  Description of Artificial Sequence: Synthetic oligonucleotide
gggaccggaacacacagatcttcaagacaaac

SEQ ID NO: 25005 - DNA, 33 bp, Artificial Sequence
  Description of Artificial Sequence: Synthetic oligonucleotide
ggaccggaacacacagatcttcaagacaaacac

SEQ ID NO: 25006 - DNA, 34 bp, Artificial Sequence
  Description of Artificial Sequence: Synthetic oligonucleotide
gaccggaacacacagatcttcaagacaaacacac

SEQ ID NO: 25007 - DNA, 35 bp, Artificial Sequence
  Description of Artificial Sequence: Synthetic oligonucleotide
accggaacacacagatcttcaagacaaacacacag

SEQ ID NO: 25008 - DNA, 34 bp, Artificial Sequence
  Description of Artificial Sequence: Synthetic oligonucleotide
ccggaacacacagatcttcaagacaaacacacag

SEQ ID NO: 25009 - DNA, 35 bp, Artificial Sequence
  Description of Artificial Sequence: Synthetic oligonucleotide
cggaacacacagatcttcaagacaaacacacagac

SEQ ID NO: 25010 - DNA, 36 bp, Artificial Sequence
  Description of Artificial Sequence: Synthetic oligonucleotide
ggaacacacagatcttcaagacaaacacacagactg

SEQ ID NO: 25011 - DNA, 37 bp, Artificial Sequence
  Description of Artificial Sequence: Synthetic oligonucleotide
gaacacacagatcttcaagacaaacacacagactgac

SEQ ID NO: 25012 - DNA, 37 bp, Artificial Sequence
  Description of Artificial Sequence: Synthetic oligonucleotide
aacacacagatcttcaagacaaacacacagactgacc

SEQ ID NO: 25013 - DNA, 36 bp, Artificial Sequence
  Description of Artificial Sequence: Synthetic oligonucleotide
acacacagatcttcaagacaaacacacagactgacc

SEQ ID NO: 25014 - DNA, 35 bp, Artificial Sequence
  Description of Artificial Sequence: Synthetic oligonucleotide
cacacagatcttcaagacaaacacacagactgacc

SEQ ID NO: 25015 - DNA, 35 bp, Artificial Sequence
  Description of Artificial Sequence: Synthetic oligonucleotide
acacagatcttcaagacaaacacacagactgaccg

SEQ ID NO: 25016 - DNA, 34 bp, Artificial Sequence
  Description of Artificial Sequence: Synthetic oligonucleotide
cacagatcttcaagacaaacacacagactgaccg

SEQ ID NO: 25017 - DNA, 35 bp, Artificial Sequence
  Description of Artificial Sequence: Synthetic oligonucleotide
acagatcttcaagacaaacacacagactgaccgag

SEQ ID NO: 25018 - DNA, 34 bp, Artificial Sequence
  Description of Artificial Sequence: Synthetic oligonucleotide
cagatcttcaagacaaacacacagactgaccgag

SEQ ID NO: 25019 - DNA, 35 bp, Artificial Sequence
  Description of Artificial Sequence: Synthetic oligonucleotide
agatcttcaagacaaacacacagactgaccgagag

SEQ ID NO: 25020 - DNA, 34 bp, Artificial Sequence
  Description of Artificial Sequence: Synthetic oligonucleotide
gatcttcaagacaaacacacagactgaccgagag

SEQ ID NO: 25021 - DNA, 35 bp, Artificial Sequence
  Description of Artificial Sequence: Synthetic oligonucleotide
atcttcaagacaaacacacagactgaccgagagag

SEQ ID NO: 25022 - DNA, 34 bp, Artificial Sequence
  Description of Artificial Sequence: Synthetic oligonucleotide
tcttcaagacaaacacacagactgaccgagagag

SEQ ID NO: 25023 - DNA, 33 bp, Artificial Sequence
  Description of Artificial Sequence: Synthetic oligonucleotide
cttcaagacaaacacacagactgaccgagagag

SEQ ID NO: 25024 - DNA, 33 bp, Artificial Sequence
  Description of Artificial Sequence: Synthetic oligonucleotide
ttcaagacaaacacacagactgaccgagagagc

SEQ ID NO: 25025 - DNA, 32 bp, Artificial Sequence
  Description of Artificial Sequence: Synthetic oligonucleotide
tcaagacaaacacacagactgaccgagagagc

SEQ ID NO: 25026 - DNA, 31 bp, Artificial Sequence
  Description of Artificial Sequence: Synthetic oligonucleotide
caagacaaacacacagactgaccgagagagc

SEQ ID NO: 25027 - DNA, 31 bp, Artificial Sequence
  Description of Artificial Sequence: Synthetic oligonucleotide
aagacaaacacacagactgaccgagagagcc

SEQ ID NO: 25028 - DNA, 30 bp, Artificial Sequence
  Description of Artificial Sequence: Synthetic oligonucleotide
agacaaacacacagactgaccgagagagcc

SEQ ID NO: 25029 - DNA, 29 bp, Artificial Sequence
  Description of Artificial Sequence: Synthetic oligonucleotide
gacaaacacacagactgaccgagagagcc

SEQ ID NO: 25030 - DNA, 30 bp, Artificial Sequence
  Description of Artificial Sequence: Synthetic oligonucleotide
acaaacacacagactgaccgagagagcctg

SEQ ID NO: 25031 - DNA, 29 bp, Artificial Sequence
  Description of Artificial Sequence: Synthetic oligonucleotide
caaacacacagactgaccgagagagcctg

SEQ ID NO: 25032 - DNA, 29 bp, Artificial Sequence
  Description of Artificial Sequence: Synthetic oligonucleotide
aaacacacagactgaccgagagagcctgc

SEQ ID NO: 25033 - DNA, 28 bp, Artificial Sequence
  Description of Artificial Sequence: Synthetic oligonucleotide
aggtatttcgacaccgccatgtcccgac

SEQ ID NO: 25034 - DNA, 27 bp, Artificial Sequence
  Description of Artificial Sequence: Synthetic oligonucleotide
ggtatttcgacaccgccatgtcccgac

SEQ ID NO: 25035 - DNA, 27 bp, Artificial Sequence
  Description of Artificial Sequence: Synthetic oligonucleotide
gtatttcgacaccgccatgtcccgacc

SEQ ID NO: 25036 - DNA, 27 bp, Artificial Sequence
  Description of Artificial Sequence: Synthetic oligonucleotide
tatttcgacaccgccatgtcccgaccc

SEQ ID NO: 25037 - DNA, 26 bp, Artificial Sequence
  Description of Artificial Sequence: Synthetic oligonucleotide
atttcgacaccgccatgtcccgaccc

SEQ ID NO: 25038 - DNA, 25 bp, Artificial Sequence
  Description of Artificial Sequence: Synthetic oligonucleotide
tttcgacaccgccatgtcccgaccc

SEQ ID NO: 25039 - DNA, 24 bp, Artificial Sequence
  Description of Artificial Sequence: Synthetic oligonucleotide
ttcgacaccgccatgtcccgaccc

SEQ ID NO: 25040 - DNA, 23 bp, Artificial Sequence
  Description of Artificial Sequence: Synthetic oligonucleotide
tcgacaccgccatgtcccgaccc

SEQ ID NO: 25041 - DNA, 22 bp, Artificial Sequence
  Description of Artificial Sequence: Synthetic oligonucleotide
cgacaccgccatgtcccgaccc

SEQ ID NO: 25042 - DNA, 22 bp, Artificial Sequence
  Description of Artificial Sequence: Synthetic oligonucleotide
gacaccgccatgtcccgacccg

SEQ ID NO: 25043 - DNA, 22 bp, Artificial Sequence
  Description of Artificial Sequence: Synthetic oligonucleotide
acaccgccatgtcccgacccgg

SEQ ID NO: 25044 - DNA, 21 bp, Artificial Sequence
  Description of Artificial Sequence: Synthetic oligonucleotide
caccgccatgtcccgacccgg

SEQ ID NO: 25045 - DNA, 21 bp, Artificial Sequence
  Description of Artificial Sequence: Synthetic oligonucleotide
accgccatgtcccgacccggc

SEQ ID NO: 25046 - DNA, 20 bp, Artificial Sequence
  Description of Artificial Sequence: Synthetic oligonucleotide
ccgccatgtcccgacccggc

SEQ ID NO: 25047 - DNA, 20 bp, Artificial Sequence
  Description of Artificial Sequence: Synthetic oligonucleotide
cgccatgtcccgacccggcc

SEQ ID NO: 25048 - DNA, 20 bp, Artificial Sequence
  Description of Artificial Sequence: Synthetic oligonucleotide
gccatgtcccgacccggccg

SEQ ID NO: 25049 - DNA, 20 bp, Artificial Sequence
  Description of Artificial Sequence: Synthetic oligonucleotide
ccatgtcccgacccggccgc

SEQ ID NO: 25050 - DNA, 20 bp, Artificial Sequence
  Description of Artificial Sequence: Synthetic oligonucleotide
catgtcccgacccggccgcg

SEQ ID NO: 25051 - DNA, 20 bp, Artificial Sequence
  Description of Artificial Sequence: Synthetic oligonucleotide
atgtcccgacccggccgcgg

SEQ ID NO: 25052 - DNA, 20 bp, Artificial Sequence
  Description of Artificial Sequence: Synthetic oligonucleotide
tgtcccgacccggccgcggt

SEQ ID NO: 25053 - DNA, 20 bp, Artificial Sequence
  Description of Artificial Sequence: Synthetic oligonucleotide
gtcccgacccggccgcggtt

SEQ ID NO: 25054 - DNA, 20 bp, Artificial Sequence
  Description of Artificial Sequence: Synthetic oligonucleotide
tcccgacccggccgcgggtt

SEQ ID NO: 25055 - DNA, 20 bp, Artificial Sequence
  Description of Artificial Sequence: Synthetic oligonucleotide
cccgacccggccgcgggttt

SEQ ID NO: 25056 - DNA, 20 bp, Artificial Sequence
  Description of Artificial Sequence: Synthetic oligonucleotide
ccgacccggccgcggggatt

SEQ ID NO: 25057 - DNA, 20 bp, Artificial Sequence
  Description of Artificial Sequence: Synthetic oligonucleotide
cgacccggccgcggggagtt

SEQ ID NO: 25058 - DNA, 20 bp, Artificial Sequence
  Description of Artificial Sequence: Synthetic oligonucleotide
gacccggccgcggggagctt

SEQ ID NO: 25059 - DNA, 20 bp, Artificial Sequence
  Description of Artificial Sequence: Synthetic oligonucleotide
acccggccgcggggagcctt

SEQ ID NO: 25060 - DNA, 26 bp, Artificial Sequence
  Description of Artificial Sequence: Synthetic oligonucleotide
atcgccttgaacgaggacctgcgctc

SEQ ID NO: 25061 - DNA, 25 bp, Artificial Sequence
  Description of Artificial Sequence: Synthetic oligonucleotide
tcgccttgaacgaggacctgcgctc

SEQ ID NO: 25062 - DNA, 24 bp, Artificial Sequence
  Description of Artificial Sequence: Synthetic oligonucleotide
cgccttgaacgaggacctgcgctc

SEQ ID NO: 25063 - DNA, 25 bp, Artificial Sequence
  Description of Artificial Sequence: Synthetic oligonucleotide
gccttgaacgaggacctgcgctcct

SEQ ID NO: 25064 - DNA, 25 bp, Artificial Sequence
  Description of Artificial Sequence: Synthetic oligonucleotide
ccttgaacgaggacctgcgctcctg

SEQ ID NO: 25065 - DNA, 26 bp, Artificial Sequence
  Description of Artificial Sequence: Synthetic oligonucleotide
cttgaacgaggacctgcgctcctgga

SEQ ID NO: 25066 - DNA, 26 bp, Artificial Sequence
  Description of Artificial Sequence: Synthetic oligonucleotide
ttgaacgaggacctgcgctcctggac

SEQ ID NO: 25067 - DNA, 22 bp, Artificial Sequence
  Description of Artificial Sequence: Synthetic oligonucleotide
agagaggagccccgggcgccat

SEQ ID NO: 25068 - DNA, 21 bp, Artificial Sequence
  Description of Artificial Sequence: Synthetic oligonucleotide
gagaggagccccgggcgccat

SEQ ID NO: 25069 - DNA, 21 bp, Artificial Sequence
  Description of Artificial Sequence: Synthetic oligonucleotide
agaggagccccgggcgccatg

SEQ ID NO: 25070 - DNA, 20 bp, Artificial Sequence
  Description of Artificial Sequence: Synthetic oligonucleotide
gaggagccccgggcgccatg

SEQ ID NO: 25071 - DNA, 23 bp, Artificial Sequence
  Description of Artificial Sequence: Synthetic oligonucleotide
aggagccccgggcgccatggata

SEQ ID NO: 25072 - DNA, 27 bp, Artificial Sequence
  Description of Artificial Sequence: Synthetic oligonucleotide
acgtgcgtggagtggctccgcagatat

SEQ ID NO: 25073 - DNA, 26 bp, Artificial Sequence
  Description of Artificial Sequence: Synthetic oligonucleotide
cgtgcgtggagtggctccgcagatat

SEQ ID NO: 25074 - DNA, 27 bp, Artificial Sequence
  Description of Artificial Sequence: Synthetic oligonucleotide
gtgcgtggagtggctccgcagatatct

SEQ ID NO: 25075 - DNA, 27 bp, Artificial Sequence
  Description of Artificial Sequence: Synthetic oligonucleotide
tgcgtggagtggctccgcagatatctg

SEQ ID NO: 25076 - DNA, 26 bp, Artificial Sequence
  Description of Artificial Sequence: Synthetic oligonucleotide
gcgtggagtggctccgcagatatctg

SEQ ID NO: 25077 - DNA, 27 bp, Artificial Sequence
  Description of Artificial Sequence: Synthetic oligonucleotide
cgtggagtggctccgcagatatctgga

SEQ ID NO: 25078 - DNA, 27 bp, Artificial Sequence
  Description of Artificial Sequence: Synthetic oligonucleotide
gtggagtggctccgcagatatctggag

SEQ ID NO: 25079 - DNA, 29 bp, Artificial Sequence
  Description of Artificial Sequence: Synthetic oligonucleotide
tggagtggctccgcagatatctggagaac

SEQ ID NO: 25080 - DNA, 28 bp, Artificial Sequence
  Description of Artificial Sequence: Synthetic oligonucleotide
ggagtggctccgcagatatctggagaac

SEQ ID NO: 25081 - DNA, 28 bp, Artificial Sequence
  Description of Artificial Sequence: Synthetic oligonucleotide
gagtggctccgcagatatctggagaacg

SEQ ID NO: 25082 - DNA, 28 bp, Artificial Sequence
  Description of Artificial Sequence: Synthetic oligonucleotide
agtggctccgcagatatctggagaacgg

SEQ ID NO: 25083 - DNA, 27 bp, Artificial Sequence
  Description of Artificial Sequence: Synthetic oligonucleotide
gtggctccgcagatatctggagaacgg

SEQ ID NO: 25084 - DNA, 27 bp, Artificial Sequence
  Description of Artificial Sequence: Synthetic oligonucleotide
tggctccgcagatatctggagaacggg

SEQ ID NO: 25085 - DNA, 27 bp, Artificial Sequence
  Description of Artificial Sequence: Synthetic oligonucleotide
ggctccgcagatatctggagaacggga

SEQ ID NO: 25086 - DNA, 28 bp, Artificial Sequence
  Description of Artificial Sequence: Synthetic oligonucleotide
gctccgcagatatctggagaacgggaag

SEQ ID NO: 25087 - DNA, 28 bp, Artificial Sequence
  Description of Artificial Sequence: Synthetic oligonucleotide
ctccgcagatatctggagaacgggaagg

SEQ ID NO: 25088 - DNA, 29 bp, Artificial Sequence
  Description of Artificial Sequence: Synthetic oligonucleotide
tccgcagatatctggagaacgggaaggac

SEQ ID NO: 25089 - DNA, 28 bp, Artificial Sequence
  Description of Artificial Sequence: Synthetic oligonucleotide
ccgcagatatctggagaacgggaaggac

SEQ ID NO: 25090 - DNA, 29 bp, Artificial Sequence
  Description of Artificial Sequence: Synthetic oligonucleotide
cgcagatatctggagaacgggaaggacac

SEQ ID NO: 25091 - DNA, 29 bp, Artificial Sequence
  Description of Artificial Sequence: Synthetic oligonucleotide
gcagatatctggagaacgggaaggacacg

SEQ ID NO: 25092 - DNA, 29 bp, Artificial Sequence
  Description of Artificial Sequence: Synthetic oligonucleotide
cagatatctggagaacgggaaggacacgc

SEQ ID NO: 25093 - DNA, 30 bp, Artificial Sequence
  Description of Artificial Sequence: Synthetic oligonucleotide
agatatctggagaacgggaaggacacgctg

SEQ ID NO: 25094 - DNA, 29 bp, Artificial Sequence
  Description of Artificial Sequence: Synthetic oligonucleotide
gatatctggagaacgggaaggacacgctg

SEQ ID NO: 25095 - DNA, 29 bp, Artificial Sequence
  Description of Artificial Sequence: Synthetic oligonucleotide
atatctggagaacgggaaggacacgctgg

SEQ ID NO: 25096 - DNA, 28 bp, Artificial Sequence
  Description of Artificial Sequence: Synthetic oligonucleotide
tatctggagaacgggaaggacacgctgg

SEQ ID NO: 25097 - DNA, 27 bp, Artificial Sequence
  Description of Artificial Sequence: Synthetic oligonucleotide
atctggagaacgggaaggacacgctgg

SEQ ID NO: 25098 - DNA, 27 bp, Artificial Sequence
  Description of Artificial Sequence: Synthetic oligonucleotide
tctggagaacgggaaggacacgctgga

SEQ ID NO: 25099 - DNA, 27 bp, Artificial Sequence
  Description of Artificial Sequence: Synthetic oligonucleotide
cagttcgtgaggttcgacagcgacgct

SEQ ID NO: 25100 - DNA, 27 bp, Artificial Sequence
  Description of Artificial Sequence: Synthetic oligonucleotide
agttcgtgaggttcgacagcgacgctg

SEQ ID NO: 25101 - DNA, 26 bp, Artificial Sequence
  Description of Artificial Sequence: Synthetic oligonucleotide
gttcgtgaggttcgacagcgacgctg

SEQ ID NO: 25102 - DNA, 26 bp, Artificial Sequence
  Description of Artificial Sequence: Synthetic oligonucleotide
ttcgtgaggttcgacagcgacgctgc

SEQ ID NO: 25103 - DNA, 25 bp, Artificial Sequence
  Description of Artificial Sequence: Synthetic oligonucleotide
tcgtgaggttcgacagcgacgctgc

SEQ ID NO: 25104 - DNA, 24 bp, Artificial Sequence
  Description of Artificial Sequence: Synthetic oligonucleotide
cgtgaggttcgacagcgacgctgc

SEQ ID NO: 25105 - DNA, 25 bp, Artificial Sequence
  Description of Artificial Sequence: Synthetic oligonucleotide
gtgaggttcgacagcgacgctgcga

SEQ ID NO: 25106 - DNA, 26 bp, Artificial Sequence
  Description of Artificial Sequence: Synthetic oligonucleotide
tgaggttcgacagcgacgctgcgagt

SEQ ID NO: 25107 - DNA, 25 bp, Artificial Sequence
  Description of Artificial Sequence: Synthetic oligonucleotide
gaggttcgacagcgacgctgcgagt

SEQ ID NO: 25108 - DNA, 25 bp, Artificial Sequence
  Description of Artificial Sequence: Synthetic oligonucleotide
aggttcgacagcgacgctgcgagtc

SEQ ID NO: 25109 - DNA, 24 bp, Artificial Sequence
  Description of Artificial Sequence: Synthetic oligonucleotide
ggttcgacagcgacgctgcgagtc

SEQ ID NO: 25110 - DNA, 24 bp, Artificial Sequence
  Description of Artificial Sequence: Synthetic oligonucleotide
gttcgacagcgacgctgcgagtcc

SEQ ID NO: 25111 - DNA, 25 bp, Artificial Sequence
  Description of Artificial Sequence: Synthetic oligonucleotide
ttcgacagcgacgctgcgagtccga

SEQ ID NO: 25112 - DNA, 24 bp, Artificial Sequence
  Description of Artificial Sequence: Synthetic oligonucleotide
tcgacagcgacgctgcgagtccga

SEQ ID NO: 25113 - DNA, 23 bp, Artificial Sequence
  Description of Artificial Sequence: Synthetic oligonucleotide
cgacagcgacgctgcgagtccga

SEQ ID NO: 25114 - DNA, 24 bp, Artificial Sequence
  Description of Artificial Sequence: Synthetic oligonucleotide
gacagcgacgctgcgagtccgaga

SEQ ID NO: 25115 - DNA, 25 bp, Artificial Sequence
  Description of Artificial Sequence: Synthetic oligonucleotide
acagcgacgctgcgagtccgagaga

SEQ ID NO: 25116 - DNA, 24 bp, Artificial Sequence
  Description of Artificial Sequence: Synthetic oligonucleotide
cagcgacgctgcgagtccgagaga

SEQ ID NO: 25117 - DNA, 24 bp, Artificial Sequence
  Description of Artificial Sequence: Synthetic oligonucleotide
agcgacgctgcgagtccgagagag

SEQ ID NO: 25118 - DNA, 23 bp, Artificial Sequence
  Description of Artificial Sequence: Synthetic oligonucleotide
gcgacgctgcgagtccgagagag

SEQ ID NO: 25119 - DNA, 24 bp, Artificial Sequence
  Description of Artificial Sequence: Synthetic oligonucleotide
cgacgctgcgagtccgagagagga

SEQ ID NO: 25120 - DNA, 24 bp, Artificial Sequence
  Description of Artificial Sequence: Synthetic oligonucleotide
gacgctgcgagtccgagagaggag

SEQ ID NO: 25121 - DNA, 24 bp, Artificial Sequence
  Description of Artificial Sequence: Synthetic oligonucleotide
acgctgcgagtccgagagaggagc

SEQ ID NO: 25122 - DNA, 23 bp, Artificial Sequence
  Description of Artificial Sequence: Synthetic oligonucleotide
cgctgcgagtccgagagaggagc

SEQ ID NO: 25123 - DNA, 23 bp, Artificial Sequence
  Description of Artificial Sequence: Synthetic oligonucleotide
gctgcgagtccgagagaggagcc

SEQ ID NO: 25124 - DNA, 23 bp, Artificial Sequence
  Description of Artificial Sequence: Synthetic oligonucleotide
ctgcgagtccgagagaggagccg

SEQ ID NO: 25125 - DNA, 23 bp, Artificial Sequence
  Description of Artificial Sequence: Synthetic oligonucleotide
tgcgagtccgagagaggagccgc

SEQ ID NO: 25126 - DNA, 24 bp, Artificial Sequence
  Description of Artificial Sequence: Synthetic oligonucleotide
gcggacaccgcggctcagatcact

SEQ ID NO: 25127 - DNA, 25 bp, Artificial Sequence
  Description of Artificial Sequence: Synthetic oligonucleotide
cggacaccgcggctcagatcactca

SEQ ID NO: 25128 - DNA, 25 bp, Artificial Sequence
  Description of Artificial Sequence: Synthetic oligonucleotide
ggacaccgcggctcagatcactcag

SEQ ID NO: 25129 - DNA, 25 bp, Artificial Sequence
  Description of Artificial Sequence: Synthetic oligonucleotide
gacaccgcggctcagatcactcagc

SEQ ID NO: 25130 - DNA, 25 bp, Artificial Sequence
  Description of Artificial Sequence: Synthetic oligonucleotide
acaccgcggctcagatcactcagcg

SEQ ID NO: 25131 - DNA, 24 bp, Artificial Sequence
  Description of Artificial Sequence: Synthetic oligonucleotide
caccgcggctcagatcactcagcg

SEQ ID NO: 25132 - DNA, 26 bp, Artificial Sequence
  Description of Artificial Sequence: Synthetic oligonucleotide
accgcggctcagatcactcagcgcaa

SEQ ID NO: 25133 - DNA, 25 bp, Artificial Sequence
  Description of Artificial Sequence: Synthetic oligonucleotide
ccgcggctcagatcactcagcgcaa

SEQ ID NO: 25134 - DNA, 26 bp, Artificial Sequence
  Description of Artificial Sequence: Synthetic oligonucleotide
cgcggctcagatcactcagcgcaagt

SEQ ID NO: 25135 - DNA, 26 bp, Artificial Sequence
  Description of Artificial Sequence: Synthetic oligonucleotide
gcggctcagatcactcagcgcaagtg

SEQ ID NO: 25136 - DNA, 26 bp, Artificial Sequence
  Description of Artificial Sequence: Synthetic oligonucleotide
cggctcagatcactcagcgcaagtgg

SEQ ID NO: 25137 - DNA, 27 bp, Artificial Sequence
  Description of Artificial Sequence: Synthetic oligonucleotide
ggctcagatcactcagcgcaagtggga

SEQ ID NO: 25138 - DNA, 27 bp, Artificial Sequence
  Description of Artificial Sequence: Synthetic oligonucleotide
gctcagatcactcagcgcaagtgggag

SEQ ID NO: 25139 - DNA, 27 bp, Artificial Sequence
  Description of Artificial Sequence: Synthetic oligonucleotide
ctcagatcactcagcgcaagtgggagg

SEQ ID NO: 25140 - DNA, 27 bp, Artificial Sequence
  Description of Artificial Sequence: Synthetic oligonucleotide
tcagatcactcagcgcaagtgggaggc

SEQ ID NO: 25141 - DNA, 26 bp, Artificial Sequence
  Description of Artificial Sequence: Synthetic oligonucleotide
cagatcactcagcgcaagtgggaggc

SEQ ID NO: 25142 - DNA, 26 bp, Artificial Sequence
  Description of Artificial Sequence: Synthetic oligonucleotide
agatcactcagcgcaagtgggaggcg

SEQ ID NO: 25143 - DNA, 25 bp, Artificial Sequence
  Description of Artificial Sequence: Synthetic oligonucleotide
gatcactcagcgcaagtgggaggcg

SEQ ID NO: 25144 - DNA, 25 bp, Artificial Sequence
  Description of Artificial Sequence: Synthetic oligonucleotide
atcactcagcgcaagtgggaggcgg

SEQ ID NO: 25145 - DNA, 24 bp, Artificial Sequence
  Description of Artificial Sequence: Synthetic oligonucleotide
tcactcagcgcaagtgggaggcgg

SEQ ID NO: 25146 - DNA, 23 bp, Artificial Sequence
  Description of Artificial Sequence: Synthetic oligonucleotide
cactcagcgcaagtgggaggcgg

SEQ ID NO: 25147 - DNA, 23 bp, Artificial Sequence
  Description of Artificial Sequence: Synthetic oligonucleotide
actcagcgcaagtgggaggcggc

SEQ ID NO: 25148 - DNA, 22 bp, Artificial Sequence
  Description of Artificial Sequence: Synthetic oligonucleotide
ctcagcgcaagtgggaggcggc

SEQ ID NO: 25149 - DNA, 22 bp, Artificial Sequence
  Description of Artificial Sequence: Synthetic oligonucleotide
tcagcgcaagtgggaggcggcc

SEQ ID NO: 25150 - DNA, 33 bp, Artificial Sequence
  Description of Artificial Sequence: Synthetic oligonucleotide
ttcaagaccaacacacagactgaccgagagaac

SEQ ID NO: 25151 - DNA, 32 bp, Artificial Sequence
  Description of Artificial Sequence: Synthetic oligonucleotide
tcaagaccaacacacagactgaccgagagaac

SEQ ID NO: 25152 - DNA, 31 bp, Artificial Sequence
  Description of Artificial Sequence: Synthetic oligonucleotide
caagaccaacacacagactgaccgagagaac

SEQ ID NO: 25153 - DNA, 31 bp, Artificial Sequence
  Description of Artificial Sequence: Synthetic oligonucleotide
aagaccaacacacagactgaccgagagaacc

SEQ ID NO: 25154 - DNA, 30 bp, Artificial Sequence
  Description of Artificial Sequence: Synthetic oligonucleotide
agaccaacacacagactgaccgagagaacc

SEQ ID NO: 25155 - DNA, 29 bp, Artificial Sequence
  Description of Artificial Sequence: Synthetic oligonucleotide
gaccaacacacagactgaccgagagaacc

SEQ ID NO: 25156 - DNA, 30 bp, Artificial Sequence
  Description of Artificial Sequence: Synthetic oligonucleotide
accaacacacagactgaccgagagaacctg

SEQ ID NO: 25157 - DNA, 29 bp, Artificial Sequence
  Description of Artificial Sequence: Synthetic oligonucleotide
ccaacacacagactgaccgagagaacctg

SEQ ID NO: 25158 - DNA, 29 bp, Artificial Sequence
  Description of Artificial Sequence: Synthetic oligonucleotide
caacacacagactgaccgagagaacctgc

SEQ ID NO: 25159 - DNA, 29 bp, Artificial Sequence
  Description of Artificial Sequence: Synthetic oligonucleotide
aacacacagactgaccgagagaacctgcg

SEQ ID NO: 25160 - DNA, 28 bp, Artificial Sequence
  Description of Artificial Sequence: Synthetic oligonucleotide
acacacagactgaccgagagaacctgcg

SEQ ID NO: 25161 - DNA, 27 bp, Artificial Sequence
  Description of Artificial Sequence: Synthetic oligonucleotide
cacacagactgaccgagagaacctgcg

SEQ ID NO: 25162 - DNA, 27 bp, Artificial Sequence
  Description of Artificial Sequence: Synthetic oligonucleotide
acacagactgaccgagagaacctgcgc

SEQ ID NO: 25163 - DNA, 27 bp, Artificial Sequence
  Description of Artificial Sequence: Synthetic oligonucleotide
cacagactgaccgagagaacctgcgca

SEQ ID NO: 25164 - DNA, 27 bp, Artificial Sequence
  Description of Artificial Sequence: Synthetic oligonucleotide
acagactgaccgagagaacctgcgcac

SEQ ID NO: 25165 - DNA, 26 bp, Artificial Sequence
  Description of Artificial Sequence: Synthetic oligonucleotide
cagactgaccgagagaacctgcgcac

SEQ ID NO: 25166 - DNA, 26 bp, Artificial Sequence
  Description of Artificial Sequence: Synthetic oligonucleotide
agactgaccgagagaacctgcgcacc

SEQ ID NO: 25167 - DNA, 25 bp, Artificial Sequence
  Description of Artificial Sequence: Synthetic oligonucleotide
gactgaccgagagaacctgcgcacc

SEQ ID NO: 25168 - DNA, 25 bp, Artificial Sequence
  Description of Artificial Sequence: Synthetic oligonucleotide
actgaccgagagaacctgcgcaccg

SEQ ID NO: 25169 - DNA, 24 bp, Artificial Sequence
  Description of Artificial Sequence: Synthetic oligonucleotide
ctgaccgagagaacctgcgcaccg

SEQ ID NO: 25170 - DNA, 24 bp, Artificial Sequence
  Description of Artificial Sequence: Synthetic oligonucleotide
tgaccgagagaacctgcgcaccgc

SEQ ID NO: 25171 - DNA, 23 bp, Artificial Sequence
  Description of Artificial Sequence: Synthetic oligonucleotide
gaccgagagaacctgcgcaccgc

SEQ ID NO: 25172 - DNA, 23 bp, Artificial Sequence
  Description of Artificial Sequence: Synthetic oligonucleotide
accgagagaacctgcgcaccgcg

SEQ ID NO: 25173 - DNA, 22 bp, Artificial Sequence
  Description of Artificial Sequence: Synthetic oligonucleotide
ccgagagaacctgcgcaccgcg

SEQ ID NO: 25174 - DNA, 23 bp, Artificial Sequence
  Description of Artificial Sequence: Synthetic oligonucleotide
cgagagaacctgcgcaccgcgct

SEQ ID NO: 25175 - DNA, 23 bp, Artificial Sequence
  Description of Artificial Sequence: Synthetic oligonucleotide
gagagaacctgcgcaccgcgctc

SEQ ID NO: 25176 - DNA, 23 bp, Artificial Sequence
  Description of Artificial Sequence: Synthetic oligonucleotide
agagaacctgcgcaccgcgctcc

SEQ ID NO: 25177 - DNA, 22 bp, Artificial Sequence
  Description of Artificial Sequence: Synthetic oligonucleotide
gagaacctgcgcaccgcgctcc

SEQ ID NO: 25178 - DNA, 22 bp, Artificial Sequence
  Description of Artificial Sequence: Synthetic oligonucleotide
agaacctgcgcaccgcgctccg

SEQ ID NO: 25179 - DNA, 21 bp, Artificial Sequence
  Description of Artificial Sequence: Synthetic oligonucleotide
gaacctgcgcaccgcgctccg

SEQ ID NO: 25180 - DNA, 23 bp, Artificial Sequence
  Description of Artificial Sequence: Synthetic oligonucleotide
aacctgcgcaccgcgctccgcta

SEQ ID NO: 25181 - DNA, 22 bp, Artificial Sequence
  Description of Artificial Sequence: Synthetic oligonucleotide
acctgcgcaccgcgctccgcta

SEQ ID NO: 25182 - DNA, 21 bp, Artificial Sequence
  Description of Artificial Sequence: Synthetic oligonucleotide
cctgcgcaccgcgctccgcta

SEQ ID NO: 25183 - DNA, 23 bp, Artificial Sequence
  Description of Artificial Sequence: Synthetic oligonucleotide
ctgcgcaccgcgctccgctacta

SEQ ID NO: 25184 - DNA, 25 bp, Artificial Sequence
  Description of Artificial Sequence: Synthetic oligonucleotide
tgcgcaccgcgctccgctactacaa

SEQ ID NO: 25185 - DNA, 24 bp, Artificial Sequence
  Description of Artificial Sequence: Synthetic oligonucleotide
gcgcaccgcgctccgctactacaa

SEQ ID NO: 25186 - DNA, 24 bp, Artificial Sequence
  Description of Artificial Sequence: Synthetic oligonucleotide
cgcaccgcgctccgctactacaac

SEQ ID NO: 25187 - DNA, 25 bp, Artificial Sequence
  Description of Artificial Sequence: Synthetic oligonucleotide
gcaccgcgctccgctactacaacca

SEQ ID NO: 25188 - DNA, 26 bp, Artificial Sequence
  Description of Artificial Sequence: Synthetic oligonucleotide
caccgcgctccgctactacaaccaga

SEQ ID NO: 25189 - DNA, 26 bp, Artificial Sequence
  Description of Artificial Sequence: Synthetic oligonucleotide
accgcgctccgctactacaaccagag

SEQ ID NO: 25190 - DNA, 25 bp, Artificial Sequence
  Description of Artificial Sequence: Synthetic oligonucleotide
ccgcgctccgctactacaaccagag

SEQ ID NO: 25191 - DNA, 34 bp, Artificial Sequence
  Description of Artificial Sequence: Synthetic oligonucleotide
aacacacagatctccaagaccaacacacagactg

SEQ ID NO: 25192 - DNA, 33 bp, Artificial Sequence
  Description of Artificial Sequence: Synthetic oligonucleotide
acacacagatctccaagaccaacacacagactg

SEQ ID NO: 25193 - DNA, 32 bp, Artificial Sequence
  Description of Artificial Sequence: Synthetic oligonucleotide
cacacagatctccaagaccaacacacagactg

SEQ ID NO: 25194 - DNA, 33 bp, Artificial Sequence
  Description of Artificial Sequence: Synthetic oligonucleotide
acacagatctccaagaccaacacacagactgac

SEQ ID NO: 25195 - DNA, 32 bp, Artificial Sequence
  Description of Artificial Sequence: Synthetic oligonucleotide
cacagatctccaagaccaacacacagactgac

SEQ ID NO: 25196 - DNA, 32 bp, Artificial Sequence
  Description of Artificial Sequence: Synthetic oligonucleotide
acagatctccaagaccaacacacagactgacc

SEQ ID NO: 25197 - DNA, 31 bp, Artificial Sequence
  Description of Artificial Sequence: Synthetic oligonucleotide
cagatctccaagaccaacacacagactgacc

SEQ ID NO: 25198 - DNA, 31 bp, Artificial Sequence
  Description of Artificial Sequence: Synthetic oligonucleotide
agatctccaagaccaacacacagactgaccg

SEQ ID NO: 25199 - DNA, 30 bp, Artificial Sequence
  Description of Artificial Sequence: Synthetic oligonucleotide
gatctccaagaccaacacacagactgaccg

SEQ ID NO: 25200 - DNA, 31 bp, Artificial Sequence
  Description of Artificial Sequence: Synthetic oligonucleotide
atctccaagaccaacacacagactgaccgag

SEQ ID NO: 25201 - DNA, 30 bp, Artificial Sequence
  Description of Artificial Sequence: Synthetic oligonucleotide
tctccaagaccaacacacagactgaccgag

SEQ ID NO: 25202 - DNA, 29 bp, Artificial Sequence
  Description of Artificial Sequence: Synthetic oligonucleotide
ctccaagaccaacacacagactgaccgag

SEQ ID NO: 25203 - DNA, 30 bp, Artificial Sequence
  Description of Artificial Sequence: Synthetic oligonucleotide
tccaagaccaacacacagactgaccgagag

SEQ ID NO: 25204 - DNA, 29 bp, Artificial Sequence
  Description of Artificial Sequence: Synthetic oligonucleotide
ccaagaccaacacacagactgaccgagag

SEQ ID NO: 25205 - DNA, 28 bp, Artificial Sequence
  Description of Artificial Sequence: Synthetic oligonucleotide
cggagtattgggaccggaacacacagac

SEQ ID NO: 25206 - DNA, 28 bp, Artificial Sequence
  Description of Artificial Sequence: Synthetic oligonucleotide
ggagtattgggaccggaacacacagacc

SEQ ID NO: 25207 - DNA, 30 bp, Artificial Sequence
  Description of Artificial Sequence: Synthetic oligonucleotide
gagtattgggaccggaacacacagaccttc

SEQ ID NO: 25208 - DNA, 32 bp, Artificial Sequence
  Description of Artificial Sequence: Synthetic oligonucleotide
agtattgggaccggaacacacagaccttcaag

SEQ ID NO: 25209 - DNA, 31 bp, Artificial Sequence
  Description of Artificial Sequence: Synthetic oligonucleotide
gtattgggaccggaacacacagaccttcaag

SEQ ID NO: 25210 - DNA, 32 bp, Artificial Sequence
  Description of Artificial Sequence: Synthetic oligonucleotide
tattgggaccggaacacacagaccttcaagac

SEQ ID NO: 25211 - DNA, 31 bp, Artificial Sequence
  Description of Artificial Sequence: Synthetic oligonucleotide
attgggaccggaacacacagaccttcaagac

SEQ ID NO: 25212 - DNA, 30 bp, Artificial Sequence
  Description of Artificial Sequence: Synthetic oligonucleotide
ttgggaccggaacacacagaccttcaagac

SEQ ID NO: 25213 - DNA, 29 bp, Artificial Sequence
  Description of Artificial Sequence: Synthetic oligonucleotide
tgggaccggaacacacagaccttcaagac

SEQ ID NO: 25214 - DNA, 28 bp, Artificial Sequence
  Description of Artificial Sequence: Synthetic oligonucleotide
gggaccggaacacacagaccttcaagac

SEQ ID NO: 25215 - DNA, 28 bp, Artificial Sequence
  Description of Artificial Sequence: Synthetic oligonucleotide
ggaccggaacacacagaccttcaagacc

SEQ ID NO: 25216 - DNA, 30 bp, Artificial Sequence
  Description of Artificial Sequence: Synthetic oligonucleotide
gaccggaacacacagaccttcaagaccaac

SEQ ID NO: 25217 - DNA, 31 bp, Artificial Sequence
  Description of Artificial Sequence: Synthetic oligonucleotide
accggaacacacagaccttcaagaccaacac

SEQ ID NO: 25218 - DNA, 30 bp, Artificial Sequence
  Description of Artificial Sequence: Synthetic oligonucleotide
ccggaacacacagaccttcaagaccaacac

SEQ ID NO: 25219 - DNA, 31 bp, Artificial Sequence
  Description of Artificial Sequence: Synthetic oligonucleotide
cggaacacacagaccttcaagaccaacacac

SEQ ID NO: 25220 - DNA, 32 bp, Artificial Sequence
  Description of Artificial Sequence: Synthetic oligonucleotide
ggaacacacagaccttcaagaccaacacacag

SEQ ID NO: 25221 - DNA, 33 bp, Artificial Sequence
  Description of Artificial Sequence: Synthetic oligonucleotide
gaacacacagaccttcaagaccaacacacagac

SEQ ID NO: 25222 - DNA, 34 bp, Artificial Sequence
  Description of Artificial Sequence: Synthetic oligonucleotide
aacacacagaccttcaagaccaacacacagactg

SEQ ID NO: 25223 - DNA, 33 bp, Artificial Sequence
  Description of Artificial Sequence: Synthetic oligonucleotide
acacacagaccttcaagaccaacacacagactg

SEQ ID NO: 25224 - DNA, 32 bp, Artificial Sequence
  Description of Artificial Sequence: Synthetic oligonucleotide
cacacagaccttcaagaccaacacacagactg

SEQ ID NO: 25225 - DNA, 33 bp, Artificial Sequence
  Description of Artificial Sequence: Synthetic oligonucleotide
acacagaccttcaagaccaacacacagactgac

SEQ ID NO: 25226 - DNA, 32 bp, Artificial Sequence
  Description of Artificial Sequence: Synthetic oligonucleotide
cacagaccttcaagaccaacacacagactgac

SEQ ID NO: 25227 - DNA, 32 bp, Artificial Sequence
  Description of Artificial Sequence: Synthetic oligonucleotide
acagaccttcaagaccaacacacagactgacc

SEQ ID NO: 25228 - DNA, 31 bp, Artificial Sequence
  Description of Artificial Sequence: Synthetic oligonucleotide
cagaccttcaagaccaacacacagactgacc

SEQ ID NO: 25229 - DNA, 31 bp, Artificial Sequence
  Description of Artificial Sequence: Synthetic oligonucleotide
agaccttcaagaccaacacacagactgaccg

SEQ ID NO: 25230 - DNA, 30 bp, Artificial Sequence
  Description of Artificial Sequence: Synthetic oligonucleotide
gaccttcaagaccaacacacagactgaccg

SEQ ID NO: 25231 - DNA, 31 bp, Artificial Sequence
  Description of Artificial Sequence: Synthetic oligonucleotide
accttcaagaccaacacacagactgaccgag

SEQ ID NO: 25232 - DNA, 30 bp, Artificial Sequence
  Description of Artificial Sequence: Synthetic oligonucleotide
ccttcaagaccaacacacagactgaccgag

SEQ ID NO: 25233 - DNA, 24 bp, Artificial Sequence
  Description of Artificial Sequence: Synthetic oligonucleotide
aacgaggacctgcgctcctggacg

SEQ ID NO: 25234 - DNA, 23 bp, Artificial Sequence
  Description of Artificial Sequence: Synthetic oligonucleotide
acgaggacctgcgctcctggacg

SEQ ID NO: 25235 - DNA, 22 bp, Artificial Sequence
  Description of Artificial Sequence: Synthetic oligonucleotide
cgaggacctgcgctcctggacg

SEQ ID NO: 25236 - DNA, 22 bp, Artificial Sequence
  Description of Artificial Sequence: Synthetic oligonucleotide
gaggacctgcgctcctggacgc

SEQ ID NO: 25237 - DNA, 22 bp, Artificial Sequence
  Description of Artificial Sequence: Synthetic oligonucleotide
aggacctgcgctcctggacgcg

SEQ ID NO: 25238 - DNA, 21 bp, Artificial Sequence
  Description of Artificial Sequence: Synthetic oligonucleotide
ggacctgcgctcctggacgcg

SEQ ID NO: 25239 - DNA, 21 bp, Artificial Sequence
  Description of Artificial Sequence: Synthetic oligonucleotide
gacctgcgctcctggacgcgg

SEQ ID NO: 25240 - DNA, 21 bp, Artificial Sequence
  Description of Artificial Sequence: Synthetic oligonucleotide
acctgcgctcctggacgcggc

SEQ ID NO: 25241 - DNA, 20 bp, Artificial Sequence
  Description of Artificial Sequence: Synthetic oligonucleotide
cctgcgctcctggacgcggc

SEQ ID NO: 25242 - DNA, 20 bp, Artificial Sequence
  Description of Artificial Sequence: Synthetic oligonucleotide
ctgcgctcctggacgcggcg

SEQ ID NO: 25243 - DNA, 21 bp, Artificial Sequence
  Description of Artificial Sequence: Synthetic oligonucleotide
tgcgctcctggacgcggcgga

SEQ ID NO: 25244 - DNA, 20 bp, Artificial Sequence
  Description of Artificial Sequence: Synthetic oligonucleotide
gcgctcctggacgcggcgga

SEQ ID NO: 25245 - DNA, 21 bp, Artificial Sequence
  Description of Artificial Sequence: Synthetic oligonucleotide
cgctcctggacgcggcggaca

SEQ ID NO: 25246 - DNA, 21 bp, Artificial Sequence
  Description of Artificial Sequence: Synthetic oligonucleotide
gctcctggacgcggcggacac

SEQ ID NO: 25247 - DNA, 21 bp, Artificial Sequence
  Description of Artificial Sequence: Synthetic oligonucleotide
ctcctggacgcggcggacacc

SEQ ID NO: 25248 - DNA, 21 bp, Artificial Sequence
  Description of Artificial Sequence: Synthetic oligonucleotide
tcctggacgcggcggacaccg

SEQ ID NO: 25249 - DNA, 20 bp, Artificial Sequence
  Description of Artificial Sequence: Synthetic oligonucleotide
cctggacgcggcggacaccg

SEQ ID NO: 25250 - DNA, 20 bp, Artificial Sequence
  Description of Artificial Sequence: Synthetic oligonucleotide
ctggacgcggcggacaccgc

SEQ ID NO: 25251 - DNA, 20 bp, Artificial Sequence
  Description of Artificial Sequence: Synthetic oligonucleotide
tggacgcggcggacaccgcg

SEQ ID NO: 25252 - DNA, 20 bp, Artificial Sequence
  Description of Artificial Sequence: Synthetic oligonucleotide
ggacgcggcggacaccgcgt

SEQ ID NO: 25253 - DNA, 20 bp, Artificial Sequence
  Description of Artificial Sequence: Synthetic oligonucleotide
gacgcggcggacaccgcggt

SEQ ID NO: 25254 - DNA, 20 bp, Artificial Sequence
  Description of Artificial Sequence: Synthetic oligonucleotide
acgcggcggacaccgcggct

SEQ ID NO: 25255 - DNA, 28 bp, Artificial Sequence
  Description of Artificial Sequence: Synthetic oligonucleotide
acttggcagacgatgtatggctgcgacg

SEQ ID NO: 25256 - DNA, 27 bp, Artificial Sequence
  Description of Artificial Sequence: Synthetic oligonucleotide
cttggcagacgatgtatggctgcgacg

SEQ ID NO: 25257 - DNA, 28 bp, Artificial Sequence
  Description of Artificial Sequence: Synthetic oligonucleotide
ttggcagacgatgtatggctgcgacgtg

SEQ ID NO: 25258 - DNA, 27 bp, Artificial Sequence
  Description of Artificial Sequence: Synthetic oligonucleotide
tggcagacgatgtatggctgcgacgtg

SEQ ID NO: 25259 - DNA, 26 bp, Artificial Sequence
  Description of Artificial Sequence: Synthetic oligonucleotide
ggcagacgatgtatggctgcgacgtg

SEQ ID NO: 25260 - DNA, 26 bp, Artificial Sequence
  Description of Artificial Sequence: Synthetic oligonucleotide
gcagacgatgtatggctgcgacgtgg

SEQ ID NO: 25261 - DNA, 26 bp, Artificial Sequence
  Description of Artificial Sequence: Synthetic oligonucleotide
cagacgatgtatggctgcgacgtggg

SEQ ID NO: 25262 - DNA, 26 bp, Artificial Sequence
  Description of Artificial Sequence: Synthetic oligonucleotide
agacgatgtatggctgcgacgtgggg

SEQ ID NO: 25263 - DNA, 25 bp, Artificial Sequence
  Description of Artificial Sequence: Synthetic oligonucleotide
gacgatgtatggctgcgacgtgggg

SEQ ID NO: 25264 - DNA, 25 bp, Artificial Sequence
  Description of Artificial Sequence: Synthetic oligonucleotide
acgatgtatggctgcgacgtggggc

SEQ ID NO: 25265 - DNA, 24 bp, Artificial Sequence
  Description of Artificial Sequence: Synthetic oligonucleotide
cgatgtatggctgcgacgtggggc

SEQ ID NO: 25266 - DNA, 24 bp, Artificial Sequence
  Description of Artificial Sequence: Synthetic oligonucleotide
ggccggagtattgggaccgggaca

SEQ ID NO: 25267 - DNA, 25 bp, Artificial Sequence
  Description of Artificial Sequence: Synthetic oligonucleotide
gccggagtattgggaccgggacaca

SEQ ID NO: 25268 - DNA, 26 bp, Artificial Sequence
  Description of Artificial Sequence: Synthetic oligonucleotide
ccggagtattgggaccgggacacaca

SEQ ID NO: 25269 - DNA, 27 bp, Artificial Sequence
  Description of Artificial Sequence: Synthetic oligonucleotide
cggagtattgggaccgggacacacaga

SEQ ID NO: 25270 - DNA, 28 bp, Artificial Sequence
  Description of Artificial Sequence: Synthetic oligonucleotide
ggagtattgggaccgggacacacagatc

SEQ ID NO: 25271 - DNA, 30 bp, Artificial Sequence
  Description of Artificial Sequence: Synthetic oligonucleotide
gagtattgggaccgggacacacagatcttc

SEQ ID NO: 25272 - DNA, 32 bp, Artificial Sequence
  Description of Artificial Sequence: Synthetic oligonucleotide
agtattgggaccgggacacacagatcttcaag

SEQ ID NO: 25273 - DNA, 31 bp, Artificial Sequence
  Description of Artificial Sequence: Synthetic oligonucleotide
gtattgggaccgggacacacagatcttcaag

SEQ ID NO: 25274 - DNA, 32 bp, Artificial Sequence
  Description of Artificial Sequence: Synthetic oligonucleotide
tattgggaccgggacacacagatcttcaagac

SEQ ID NO: 25275 - DNA, 31 bp, Artificial Sequence
  Description of Artificial Sequence: Synthetic oligonucleotide
attgggaccgggacacacagatcttcaagac

SEQ ID NO: 25276 - DNA, 30 bp, Artificial Sequence
  Description of Artificial Sequence: Synthetic oligonucleotide
ttgggaccgggacacacagatcttcaagac

SEQ ID NO: 25277 - DNA, 29 bp, Artificial Sequence
  Description of Artificial Sequence: Synthetic oligonucleotide
tgggaccgggacacacagatcttcaagac

SEQ ID NO: 25278 - DNA, 28 bp, Artificial Sequence
  Description of Artificial Sequence: Synthetic oligonucleotide
gggaccgggacacacagatcttcaagac

SEQ ID NO: 25279 - DNA, 28 bp, Artificial Sequence
  Description of Artificial Sequence: Synthetic oligonucleotide
ggaccgggacacacagatcttcaagacc

SEQ ID NO: 25280 - DNA, 30 bp, Artificial Sequence
  Description of Artificial Sequence: Synthetic oligonucleotide
gaccgggacacacagatcttcaagaccaac

SEQ ID NO: 25281 - DNA, 31 bp, Artificial Sequence
  Description of Artificial Sequence: Synthetic oligonucleotide
accgggacacacagatcttcaagaccaacac

SEQ ID NO: 25282 - DNA, 30 bp, Artificial Sequence
  Description of Artificial Sequence: Synthetic oligonucleotide
ccgggacacacagatcttcaagaccaacac

SEQ ID NO: 25283 - DNA, 31 bp, Artificial Sequence
  Description of Artificial Sequence: Synthetic oligonucleotide
cgggacacacagatcttcaagaccaacacac

SEQ ID NO: 25284 - DNA, 32 bp, Artificial Sequence
  Description of Artificial Sequence: Synthetic oligonucleotide
gggacacacagatcttcaagaccaacacacag

SEQ ID NO: 25285 - DNA, 33 bp, Artificial Sequence
  Description of Artificial Sequence: Synthetic oligonucleotide
ggacacacagatcttcaagaccaacacacagac

SEQ ID NO: 25286 - DNA, 34 bp, Artificial Sequence
  Description of Artificial Sequence: Synthetic oligonucleotide
gacacacagatcttcaagaccaacacacagactg

SEQ ID NO: 25287 - DNA, 24 bp, Artificial Sequence
  Description of Artificial Sequence: Synthetic oligonucleotide
aggacagagcctacctggagggcg

SEQ ID NO: 25288 - DNA, 23 bp, Artificial Sequence
  Description of Artificial Sequence: Synthetic oligonucleotide
ggacagagcctacctggagggcg

SEQ ID NO: 25289 - DNA, 23 bp, Artificial Sequence
  Description of Artificial Sequence: Synthetic oligonucleotide
gacagagcctacctggagggcgc

SEQ ID NO: 25290 - DNA, 24 bp, Artificial Sequence
  Description of Artificial Sequence: Synthetic oligonucleotide
acagagcctacctggagggcgcgt

SEQ ID NO: 25291 - DNA, 23 bp, Artificial Sequence
  Description of Artificial Sequence: Synthetic oligonucleotide
cagagcctacctggagggcgcgt

SEQ ID NO: 25292 - DNA, 23 bp, Artificial Sequence
  Description of Artificial Sequence: Synthetic oligonucleotide
agagcctacctggagggcgcgtg

SEQ ID NO: 25293 - DNA, 22 bp, Artificial Sequence
  Description of Artificial Sequence: Synthetic oligonucleotide
gagcctacctggagggcgcgtg

SEQ ID NO: 25294 - DNA, 22 bp, Artificial Sequence
  Description of Artificial Sequence: Synthetic oligonucleotide
agcctacctggagggcgcgtgc

SEQ ID NO: 25295 - DNA, 21 bp, Artificial Sequence
  Description of Artificial Sequence: Synthetic oligonucleotide
gcctacctggagggcgcgtgc

SEQ ID NO: 25296 - DNA, 22 bp, Artificial Sequence
  Description of Artificial Sequence: Synthetic oligonucleotide
cctacctggagggcgcgtgcgt

SEQ ID NO: 25297 - DNA, 22 bp, Artificial Sequence
  Description of Artificial Sequence: Synthetic oligonucleotide
ctacctggagggcgcgtgcgtg

SEQ ID NO: 25298 - DNA, 23 bp, Artificial Sequence
  Description of Artificial Sequence: Synthetic oligonucleotide
tacctggagggcgcgtgcgtgga

SEQ ID NO: 25299 - DNA, 22 bp, Artificial Sequence
  Description of Artificial Sequence: Synthetic oligonucleotide
acctggagggcgcgtgcgtgga

SEQ ID NO: 25300 - DNA, 21 bp, Artificial Sequence
  Description of Artificial Sequence: Synthetic oligonucleotide
cctggagggcgcgtgcgtgga

SEQ ID NO: 25301 - DNA, 22 bp, Artificial Sequence
  Description of Artificial Sequence: Synthetic oligonucleotide
ctggagggcgcgtgcgtggagt

SEQ ID NO: 25302 - DNA, 22 bp, Artificial Sequence
  Description of Artificial Sequence: Synthetic oligonucleotide
tggagggcgcgtgcgtggagtg

SEQ ID NO: 25303 - DNA, 21 bp, Artificial Sequence
  Description of Artificial Sequence: Synthetic oligonucleotide
ggagggcgcgtgcgtggagtg

SEQ ID NO: 25304 - DNA, 21 bp, Artificial Sequence
  Description of Artificial Sequence: Synthetic oligonucleotide
gagggcgcgtgcgtggagtgg

SEQ ID NO: 25305 - DNA, 22 bp, Artificial Sequence
  Description of Artificial Sequence: Synthetic oligonucleotide
agggcgcgtgcgtggagtggct

SEQ ID NO: 25306 - DNA, 21 bp, Artificial Sequence
  Description of Artificial Sequence: Synthetic oligonucleotide
gggcgcgtgcgtggagtggct

SEQ ID NO: 25307 - DNA, 21 bp, Artificial Sequence
  Description of Artificial Sequence: Synthetic oligonucleotide
ggcgcgtgcgtggagtggctc

SEQ ID NO: 25308 - DNA, 21 bp, Artificial Sequence
  Description of Artificial Sequence: Synthetic oligonucleotide
gcgcgtgcgtggagtggctcc

SEQ ID NO: 25309 - DNA, 21 bp, Artificial Sequence
  Description of Artificial Sequence: Synthetic oligonucleotide
cgcgtgcgtggagtggctccg

SEQ ID NO: 25310 - DNA, 22 bp, Artificial Sequence
  Description of Artificial Sequence: Synthetic oligonucleotide
gcgtgcgtggagtggctccgca

SEQ ID NO: 25311 - DNA, 28 bp, Artificial Sequence
  Description of Artificial Sequence: Synthetic oligonucleotide
gggtctcacaccctccagaggatgtatg

SEQ ID NO: 25312 - DNA, 28 bp, Artificial Sequence
  Description of Artificial Sequence: Synthetic oligonucleotide
ggtctcacaccctccagaggatgtatgg

SEQ ID NO: 25313 - DNA, 28 bp, Artificial Sequence
  Description of Artificial Sequence: Synthetic oligonucleotide
gtctcacaccctccagaggatgtatggc

SEQ ID NO: 25314 - DNA, 22 bp, Artificial Sequence
  Description of Artificial Sequence: Synthetic oligonucleotide
cctcctccgcgggtaccaccag

SEQ ID NO: 25315 - DNA, 23 bp, Artificial Sequence
  Description of Artificial Sequence: Synthetic oligonucleotide
ctcctccgcgggtaccaccagga

SEQ ID NO: 25316 - DNA, 23 bp, Artificial Sequence
  Description of Artificial Sequence: Synthetic oligonucleotide
tcctccgcgggtaccaccaggac

SEQ ID NO: 25317 - DNA, 22 bp, Artificial Sequence
  Description of Artificial Sequence: Synthetic oligonucleotide
cctccgcgggtaccaccaggac

SEQ ID NO: 25318 - DNA, 22 bp, Artificial Sequence
  Description of Artificial Sequence: Synthetic oligonucleotide
ctccgcgggtaccaccaggacg

SEQ ID NO: 25319 - DNA, 22 bp, Artificial Sequence
  Description of Artificial Sequence: Synthetic oligonucleotide
tccgcgggtaccaccaggacgc

SEQ ID NO: 25320 - DNA, 21 bp, Artificial Sequence
  Description of Artificial Sequence: Synthetic oligonucleotide
ccgcgggtaccaccaggacgc

SEQ ID NO: 25321 - DNA, 23 bp, Artificial Sequence
  Description of Artificial Sequence: Synthetic oligonucleotide
cgcgggtaccaccaggacgccta

SEQ ID NO: 25322 - DNA, 23 bp, Artificial Sequence
  Description of Artificial Sequence: Synthetic oligonucleotide
gcgggtaccaccaggacgcctac

SEQ ID NO: 25323 - DNA, 24 bp, Artificial Sequence
  Description of Artificial Sequence: Synthetic oligonucleotide
cgggtaccaccaggacgcctacga

SEQ ID NO: 25324 - DNA, 24 bp, Artificial Sequence
  Description of Artificial Sequence: Synthetic oligonucleotide
gggtaccaccaggacgcctacgac

SEQ ID NO: 25325 - DNA, 24 bp, Artificial Sequence
  Description of Artificial Sequence: Synthetic oligonucleotide
ggtaccaccaggacgcctacgacg

SEQ ID NO: 25326 - DNA, 24 bp, Artificial Sequence
  Description of Artificial Sequence: Synthetic oligonucleotide
gtaccaccaggacgcctacgacgg

SEQ ID NO: 25327 - DNA, 26 bp, Artificial Sequence
  Description of Artificial Sequence: Synthetic oligonucleotide
taccaccaggacgcctacgacggcaa

SEQ ID NO: 25328 - DNA, 25 bp, Artificial Sequence
  Description of Artificial Sequence: Synthetic oligonucleotide
accaccaggacgcctacgacggcaa

SEQ ID NO: 25329 - DNA, 24 bp, Artificial Sequence
  Description of Artificial Sequence: Synthetic oligonucleotide
ccaccaggacgcctacgacggcaa

SEQ ID NO: 25330 - DNA, 24 bp, Artificial Sequence
  Description of Artificial Sequence: Synthetic oligonucleotide
caccaggacgcctacgacggcaag

SEQ ID NO: 25331 - DNA, 33 bp, Artificial Sequence
  Description of Artificial Sequence: Synthetic oligonucleotide
atcttcaagaccaacacacagactgaccgagtg

SEQ ID NO: 25332 - DNA, 32 bp, Artificial Sequence
  Description of Artificial Sequence: Synthetic oligonucleotide
tcttcaagaccaacacacagactgaccgagtg

SEQ ID NO: 25333 - DNA, 31 bp, Artificial Sequence
  Description of Artificial Sequence: Synthetic oligonucleotide
cttcaagaccaacacacagactgaccgagtg

SEQ ID NO: 25334 - DNA, 32 bp, Artificial Sequence
  Description of Artificial Sequence: Synthetic oligonucleotide
ttcaagaccaacacacagactgaccgagtgag

SEQ ID NO: 25335 - DNA, 31 bp, Artificial Sequence
  Description of Artificial Sequence: Synthetic oligonucleotide
tcaagaccaacacacagactgaccgagtgag

SEQ ID NO: 25336 - DNA, 30 bp, Artificial Sequence
  Description of Artificial Sequence: Synthetic oligonucleotide
caagaccaacacacagactgaccgagtgag

SEQ ID NO: 25337 - DNA, 30 bp, Artificial Sequence
  Description of Artificial Sequence: Synthetic oligonucleotide
aagaccaacacacagactgaccgagtgagc

SEQ ID NO: 25338 - DNA, 29 bp, Artificial Sequence
  Description of Artificial Sequence: Synthetic oligonucleotide
agaccaacacacagactgaccgagtgagc

SEQ ID NO: 25339 - DNA, 28 bp, Artificial Sequence
  Description of Artificial Sequence: Synthetic oligonucleotide
gaccaacacacagactgaccgagtgagc

SEQ ID NO: 25340 - DNA, 28 bp, Artificial Sequence
  Description of Artificial Sequence: Synthetic oligonucleotide
accaacacacagactgaccgagtgagcc

SEQ ID NO: 25341 - DNA, 27 bp, Artificial Sequence
  Description of Artificial Sequence: Synthetic oligonucleotide
ccaacacacagactgaccgagtgagcc

SEQ ID NO: 25342 - DNA, 28 bp, Artificial Sequence
  Description of Artificial Sequence: Synthetic oligonucleotide
caacacacagactgaccgagtgagcctg

SEQ ID NO: 25343 - DNA, 28 bp, Artificial Sequence
  Description of Artificial Sequence: Synthetic oligonucleotide
aacacacagactgaccgagtgagcctgc

SEQ ID NO: 25344 - DNA, 27 bp, Artificial Sequence
  Description of Artificial Sequence: Synthetic oligonucleotide
acacacagactgaccgagtgagcctgc

SEQ ID NO: 25345 - DNA, 26 bp, Artificial Sequence
  Description of Artificial Sequence: Synthetic oligonucleotide
cacacagactgaccgagtgagcctgc

SEQ ID NO: 25346 - DNA, 26 bp, Artificial Sequence
  Description of Artificial Sequence: Synthetic oligonucleotide
acacagactgaccgagtgagcctgcg

SEQ ID NO: 25347 - DNA, 33 bp, Artificial Sequence
  Description of Artificial Sequence: Synthetic oligonucleotide
ggaacacacagatcttcaagaccaacacacagg

SEQ ID NO: 25348 - DNA, 33 bp, Artificial Sequence
  Description of Artificial Sequence: Synthetic oligonucleotide
gaacacacagatcttcaagaccaacacacaggc

SEQ ID NO: 25349 - DNA, 34 bp, Artificial Sequence
  Description of Artificial Sequence: Synthetic oligonucleotide
aacacacagatcttcaagaccaacacacaggctg

SEQ ID NO: 25350 - DNA, 33 bp, Artificial Sequence
  Description of Artificial Sequence: Synthetic oligonucleotide
acacacagatcttcaagaccaacacacaggctg

SEQ ID NO: 25351 - DNA, 32 bp, Artificial Sequence
  Description of Artificial Sequence: Synthetic oligonucleotide
cacacagatcttcaagaccaacacacaggctg

SEQ ID NO: 25352 - DNA, 33 bp, Artificial Sequence
  Description of Artificial Sequence: Synthetic oligonucleotide
acacagatcttcaagaccaacacacaggctgac

SEQ ID NO: 25353 - DNA, 32 bp, Artificial Sequence
  Description of Artificial Sequence: Synthetic oligonucleotide
cacagatcttcaagaccaacacacaggctgac

SEQ ID NO: 25354 - DNA, 32 bp, Artificial Sequence
  Description of Artificial Sequence: Synthetic oligonucleotide
acagatcttcaagaccaacacacaggctgacc

SEQ ID NO: 25355 - DNA, 31 bp, Artificial Sequence
  Description of Artificial Sequence: Synthetic oligonucleotide
cagatcttcaagaccaacacacaggctgacc

SEQ ID NO: 25356 - DNA, 31 bp, Artificial Sequence
  Description of Artificial Sequence: Synthetic oligonucleotide
agatcttcaagaccaacacacaggctgaccg

SEQ ID NO: 25357 - DNA, 30 bp, Artificial Sequence
  Description of Artificial Sequence: Synthetic oligonucleotide
gatcttcaagaccaacacacaggctgaccg

SEQ ID NO: 25358 - DNA, 31 bp, Artificial Sequence
  Description of Artificial Sequence: Synthetic oligonucleotide
atcttcaagaccaacacacaggctgaccgag

SEQ ID NO: 25359 - DNA, 30 bp, Artificial Sequence
  Description of Artificial Sequence: Synthetic oligonucleotide
tcttcaagaccaacacacaggctgaccgag

SEQ ID NO: 25360 - DNA, 29 bp, Artificial Sequence
  Description of Artificial Sequence: Synthetic oligonucleotide
cttcaagaccaacacacaggctgaccgag

SEQ ID NO: 25361 - DNA, 30 bp, Artificial Sequence
  Description of Artificial Sequence: Synthetic oligonucleotide
ttcaagaccaacacacaggctgaccgagag

SEQ ID NO: 25362 - DNA, 29 bp, Artificial Sequence
  Description of Artificial Sequence: Synthetic oligonucleotide
tcaagaccaacacacaggctgaccgagag

SEQ ID NO: 25363 - DNA, 28 bp, Artificial Sequence
  Description of Artificial Sequence: Synthetic oligonucleotide
caagaccaacacacaggctgaccgagag

SEQ ID NO: 25364 - DNA, 29 bp, Artificial Sequence
  Description of Artificial Sequence: Synthetic oligonucleotide
aagaccaacacacaggctgaccgagagag

SEQ ID NO: 25365 - DNA, 28 bp, Artificial Sequence
  Description of Artificial Sequence: Synthetic oligonucleotide
agaccaacacacaggctgaccgagagag

SEQ ID NO: 25366 - DNA, 27 bp, Artificial Sequence
  Description of Artificial Sequence: Synthetic oligonucleotide
gaccaacacacaggctgaccgagagag

SEQ ID NO: 25367 - DNA, 27 bp, Artificial Sequence
  Description of Artificial Sequence: Synthetic oligonucleotide
accaacacacaggctgaccgagagagc

SEQ ID NO: 25368 - DNA, 26 bp, Artificial Sequence
  Description of Artificial Sequence: Synthetic oligonucleotide
ccaacacacaggctgaccgagagagc

SEQ ID NO: 25369 - DNA, 27 bp, Artificial Sequence
  Description of Artificial Sequence: Synthetic oligonucleotide
caacacacaggctgaccgagagagcct

SEQ ID NO: 25370 - DNA, 27 bp, Artificial Sequence
  Description of Artificial Sequence: Synthetic oligonucleotide
aacacacaggctgaccgagagagcctg

SEQ ID NO: 25371 - DNA, 26 bp, Artificial Sequence
  Description of Artificial Sequence: Synthetic oligonucleotide
acacacaggctgaccgagagagcctg

SEQ ID NO: 25372 - DNA, 25 bp, Artificial Sequence
  Description of Artificial Sequence: Synthetic oligonucleotide
cacacaggctgaccgagagagcctg

SEQ ID NO: 25373 - DNA, 25 bp, Artificial Sequence
  Description of Artificial Sequence: Synthetic oligonucleotide
acacaggctgaccgagagagcctgc

SEQ ID NO: 25374 - DNA, 24 bp, Artificial Sequence
  Description of Artificial Sequence: Synthetic oligonucleotide
cacaggctgaccgagagagcctgc

SEQ ID NO: 25375 - DNA, 24 bp, Artificial Sequence
  Description of Artificial Sequence: Synthetic oligonucleotide
acaggctgaccgagagagcctgcg

SEQ ID NO: 25376 - DNA, 23 bp, Artificial Sequence
  Description of Artificial Sequence: Synthetic oligonucleotide
caggctgaccgagagagcctgcg

SEQ ID NO: 25377 - DNA, 25 bp, Artificial Sequence
  Description of Artificial Sequence: Synthetic oligonucleotide
aggctgaccgagagagcctgcggaa

SEQ ID NO: 25378 - DNA, 24 bp, Artificial Sequence
  Description of Artificial Sequence: Synthetic oligonucleotide
ggctgaccgagagagcctgcggaa

SEQ ID NO: 25379 - DNA, 24 bp, Artificial Sequence
  Description of Artificial Sequence: Synthetic oligonucleotide
gctgaccgagagagcctgcggaac

SEQ ID NO: 25380 - DNA, 29 bp, Artificial Sequence
  Description of Artificial Sequence: Synthetic oligonucleotide
gagtattgggaccgggagacacagatctc

SEQ ID NO: 25381 - DNA, 29 bp, Artificial Sequence
  Description of Artificial Sequence: Synthetic oligonucleotide
agtattgggaccgggagacacagatctcc

SEQ ID NO: 25382 - DNA, 28 bp, Artificial Sequence
  Description of Artificial Sequence: Synthetic oligonucleotide
gtattgggaccgggagacacagatctcc

SEQ ID NO: 25383 - DNA, 30 bp, Artificial Sequence
  Description of Artificial Sequence: Synthetic oligonucleotide
tattgggaccgggagacacagatctccaag

SEQ ID NO: 25384 - DNA, 29 bp, Artificial Sequence
  Description of Artificial Sequence: Synthetic oligonucleotide
attgggaccgggagacacagatctccaag

SEQ ID NO: 25385 - DNA, 28 bp, Artificial Sequence
  Description of Artificial Sequence: Synthetic oligonucleotide
ttgggaccgggagacacagatctccaag

SEQ ID NO: 25386 - DNA, 27 bp, Artificial Sequence
  Description of Artificial Sequence: Synthetic oligonucleotide
tgggaccgggagacacagatctccaag

SEQ ID NO: 25387 - DNA, 27 bp, Artificial Sequence
  Description of Artificial Sequence: Synthetic oligonucleotide
gggaccgggagacacagatctccaaga

SEQ ID NO: 25388 - DNA, 27 bp, Artificial Sequence
  Description of Artificial Sequence: Synthetic oligonucleotide
ggaccgggagacacagatctccaagac

SEQ ID NO: 25389 - DNA, 27 bp, Artificial Sequence
  Description of Artificial Sequence: Synthetic oligonucleotide
gaccgggagacacagatctccaagacc

SEQ ID NO: 25390 - DNA, 29 bp, Artificial Sequence
  Description of Artificial Sequence: Synthetic oligonucleotide
accgggagacacagatctccaagaccaac

SEQ ID NO: 25391 - DNA, 28 bp, Artificial Sequence
  Description of Artificial Sequence: Synthetic oligonucleotide
ccgggagacacagatctccaagaccaac

SEQ ID NO: 25392 - DNA, 29 bp, Artificial Sequence
  Description of Artificial Sequence: Synthetic oligonucleotide
cgggagacacagatctccaagaccaacac

SEQ ID NO: 25393 - DNA, 30 bp, Artificial Sequence
  Description of Artificial Sequence: Synthetic oligonucleotide
gggagacacagatctccaagaccaacacac

SEQ ID NO: 25394 - DNA, 31 bp, Artificial Sequence
  Description of Artificial Sequence: Synthetic oligonucleotide
ggagacacagatctccaagaccaacacacag

SEQ ID NO: 25395 - DNA, 32 bp, Artificial Sequence
  Description of Artificial Sequence: Synthetic oligonucleotide
gagacacagatctccaagaccaacacacagac

SEQ ID NO: 25396 - DNA, 33 bp, Artificial Sequence
  Description of Artificial Sequence: Synthetic oligonucleotide
agacacagatctccaagaccaacacacagactg

SEQ ID NO: 25397 - DNA, 32 bp, Artificial Sequence
  Description of Artificial Sequence: Synthetic oligonucleotide
gacacagatctccaagaccaacacacagactg

SEQ ID NO: 25398 - DNA, 27 bp, Artificial Sequence
  Description of Artificial Sequence: Synthetic oligonucleotide
acacagactgaccgagagaacctgcgg

SEQ ID NO: 25399 - DNA, 27 bp, Artificial Sequence
  Description of Artificial Sequence: Synthetic oligonucleotide
accctgcggagatcacactgacctggt

SEQ ID NO: 25400 - DNA, 27 bp, Artificial Sequence
  Description of Artificial Sequence: Synthetic oligonucleotide
ccctgcggagatcacactgacctggta

SEQ ID NO: 25401 - DNA, 27 bp, Artificial Sequence
  Description of Artificial Sequence: Synthetic oligonucleotide
cctgcggagatcacactgacctggtag

SEQ ID NO: 25402 - DNA, 27 bp, Artificial Sequence
  Description of Artificial Sequence: Synthetic oligonucleotide
ctgcggagatcacactgacctggtagc

SEQ ID NO: 25403 - DNA, 27 bp, Artificial Sequence
  Description of Artificial Sequence: Synthetic oligonucleotide
tgcggagatcacactgacctggtagcg

SEQ ID NO: 25404 - DNA, 26 bp, Artificial Sequence
  Description of Artificial Sequence: Synthetic oligonucleotide
gcggagatcacactgacctggtagcg

SEQ ID NO: 25405 - DNA, 26 bp, Artificial Sequence
  Description of Artificial Sequence: Synthetic oligonucleotide
cggagatcacactgacctggtagcgg

SEQ ID NO: 25406 - DNA, 27 bp, Artificial Sequence
  Description of Artificial Sequence: Synthetic oligonucleotide
ggagatcacactgacctggtagcggga

SEQ ID NO: 25407 - DNA, 28 bp, Artificial Sequence
  Description of Artificial Sequence: Synthetic oligonucleotide
gagatcacactgacctggtagcgggatg

SEQ ID NO: 25408 - DNA, 28 bp, Artificial Sequence
  Description of Artificial Sequence: Synthetic oligonucleotide
agatcacactgacctggtagcgggatgg

SEQ ID NO: 25409 - DNA, 27 bp, Artificial Sequence
  Description of Artificial Sequence: Synthetic oligonucleotide
gatcacactgacctggtagcgggatgg

SEQ ID NO: 25410 - DNA, 27 bp, Artificial Sequence
  Description of Artificial Sequence: Synthetic oligonucleotide
atcacactgacctggtagcgggatggc

SEQ ID NO: 25411 - DNA, 26 bp, Artificial Sequence
  Description of Artificial Sequence: Synthetic oligonucleotide
tcacactgacctggtagcgggatggc

SEQ ID NO: 25412 - DNA, 25 bp, Artificial Sequence
  Description of Artificial Sequence: Synthetic oligonucleotide
cacactgacctggtagcgggatggc

SEQ ID NO: 25413 - DNA, 26 bp, Artificial Sequence
  Description of Artificial Sequence: Synthetic oligonucleotide
acactgacctggtagcgggatggcga

SEQ ID NO: 25414 - DNA, 25 bp, Artificial Sequence
  Description of Artificial Sequence: Synthetic oligonucleotide
cactgacctggtagcgggatggcga

SEQ ID NO: 25415 - DNA, 25 bp, Artificial Sequence
  Description of Artificial Sequence: Synthetic oligonucleotide
actgacctggtagcgggatggcgag

SEQ ID NO: 25416 - DNA, 24 bp, Artificial Sequence
  Description of Artificial Sequence: Synthetic oligonucleotide
ctgacctggtagcgggatggcgag

SEQ ID NO: 25417 - DNA, 25 bp, Artificial Sequence
  Description of Artificial Sequence: Synthetic oligonucleotide
tgacctggtagcgggatggcgagga

SEQ ID NO: 25418 - DNA, 24 bp, Artificial Sequence
  Description of Artificial Sequence: Synthetic oligonucleotide
gacctggtagcgggatggcgagga

SEQ ID NO: 25419 - DNA, 24 bp, Artificial Sequence
  Description of Artificial Sequence: Synthetic oligonucleotide
acctggtagcgggatggcgaggac

SEQ ID NO: 25420 - DNA, 23 bp, Artificial Sequence
  Description of Artificial Sequence: Synthetic oligonucleotide
cctggtagcgggatggcgaggac

SEQ ID NO: 25421 - DNA, 26 bp, Artificial Sequence
  Description of Artificial Sequence: Synthetic oligonucleotide
ctggtagcgggatggcgaggaccaaa

SEQ ID NO: 25422 - DNA, 27 bp, Artificial Sequence
  Description of Artificial Sequence: Synthetic oligonucleotide
tggtagcgggatggcgaggaccaaact

SEQ ID NO: 25423 - DNA, 26 bp, Artificial Sequence
  Description of Artificial Sequence: Synthetic oligonucleotide
ggtagcgggatggcgaggaccaaact

SEQ ID NO: 25424 - DNA, 27 bp, Artificial Sequence
  Description of Artificial Sequence: Synthetic oligonucleotide
gtagcgggatggcgaggaccaaactca

SEQ ID NO: 25425 - DNA, 27 bp, Artificial Sequence
  Description of Artificial Sequence: Synthetic oligonucleotide
tagcgggatggcgaggaccaaactcag

SEQ ID NO: 25426 - DNA, 25 bp, Artificial Sequence
  Description of Artificial Sequence: Synthetic oligonucleotide
aggacagagcctacctggagggcct

SEQ ID NO: 25427 - DNA, 24 bp, Artificial Sequence
  Description of Artificial Sequence: Synthetic oligonucleotide
ggacagagcctacctggagggcct

SEQ ID NO: 25428 - DNA, 25 bp, Artificial Sequence
  Description of Artificial Sequence: Synthetic oligonucleotide
gacagagcctacctggagggcctgt

SEQ ID NO: 25429 - DNA, 25 bp, Artificial Sequence
  Description of Artificial Sequence: Synthetic oligonucleotide
acagagcctacctggagggcctgtg

SEQ ID NO: 25430 - DNA, 24 bp, Artificial Sequence
  Description of Artificial Sequence: Synthetic oligonucleotide
cagagcctacctggagggcctgtg

SEQ ID NO: 25431 - DNA, 29 bp, Artificial Sequence
  Description of Artificial Sequence: Synthetic oligonucleotide
aaggattacatcgccctgaacgaggaccc

SEQ ID NO: 25432 - DNA, 28 bp, Artificial Sequence
  Description of Artificial Sequence: Synthetic oligonucleotide
aggattacatcgccctgaacgaggaccc

SEQ ID NO: 25433 - DNA, 27 bp, Artificial Sequence
  Description of Artificial Sequence: Synthetic oligonucleotide
ggattacatcgccctgaacgaggaccc

SEQ ID NO: 25434 - DNA, 27 bp, Artificial Sequence
  Description of Artificial Sequence: Synthetic oligonucleotide
gattacatcgccctgaacgaggacccg

SEQ ID NO: 25435 - DNA, 27 bp, Artificial Sequence
  Description of Artificial Sequence: Synthetic oligonucleotide
attacatcgccctgaacgaggacccgc

SEQ ID NO: 25436 - DNA, 26 bp, Artificial Sequence
  Description of Artificial Sequence: Synthetic oligonucleotide
ttacatcgccctgaacgaggacccgc

SEQ ID NO: 25437 - DNA, 25 bp, Artificial Sequence
  Description of Artificial Sequence: Synthetic oligonucleotide
tacatcgccctgaacgaggacccgc

SEQ ID NO: 25438 - DNA, 24 bp, Artificial Sequence
  Description of Artificial Sequence: Synthetic oligonucleotide
acatcgccctgaacgaggacccgc

SEQ ID NO: 25439 - DNA, 23 bp, Artificial Sequence
  Description of Artificial Sequence: Synthetic oligonucleotide
catcgccctgaacgaggacccgc

SEQ ID NO: 25440 - DNA, 23 bp, Artificial Sequence
  Description of Artificial Sequence: Synthetic oligonucleotide
atcgccctgaacgaggacccgcg

SEQ ID NO: 25441 - DNA, 22 bp, Artificial Sequence
  Description of Artificial Sequence: Synthetic oligonucleotide
tcgccctgaacgaggacccgcg

SEQ ID NO: 25442 - DNA, 21 bp, Artificial Sequence
  Description of Artificial Sequence: Synthetic oligonucleotide
cgccctgaacgaggacccgcg

SEQ ID NO: 25443 - DNA, 22 bp, Artificial Sequence
  Description of Artificial Sequence: Synthetic oligonucleotide
gccctgaacgaggacccgcgct

SEQ ID NO: 25444 - DNA, 22 bp, Artificial Sequence
  Description of Artificial Sequence: Synthetic oligonucleotide
ccctgaacgaggacccgcgctc

SEQ ID NO: 25445 - DNA, 23 bp, Artificial Sequence
  Description of Artificial Sequence: Synthetic oligonucleotide
cctgaacgaggacccgcgctcct

SEQ ID NO: 25446 - DNA, 23 bp, Artificial Sequence
  Description of Artificial Sequence: Synthetic oligonucleotide
ctgaacgaggacccgcgctcctg

SEQ ID NO: 25447 - DNA, 24 bp, Artificial Sequence
  Description of Artificial Sequence: Synthetic oligonucleotide
tgaacgaggacccgcgctcctgga

SEQ ID NO: 25448 - DNA, 23 bp, Artificial Sequence
  Description of Artificial Sequence: Synthetic oligonucleotide
gaacgaggacccgcgctcctgga

SEQ ID NO: 25449 - DNA, 23 bp, Artificial Sequence
  Description of Artificial Sequence: Synthetic oligonucleotide
aacgaggacccgcgctcctggac

SEQ ID NO: 25450 - DNA, 22 bp, Artificial Sequence
  Description of Artificial Sequence: Synthetic oligonucleotide
acgaggacccgcgctcctggac

SEQ ID NO: 25451 - DNA, 21 bp, Artificial Sequence
  Description of Artificial Sequence: Synthetic oligonucleotide
cgaggacccgcgctcctggac

SEQ ID NO: 25452 - DNA, 21 bp, Artificial Sequence
  Description of Artificial Sequence: Synthetic oligonucleotide
gaggacccgcgctcctggacc

SEQ ID NO: 25453 - DNA, 21 bp, Artificial Sequence
  Description of Artificial Sequence: Synthetic oligonucleotide
aggacccgcgctcctggaccg

SEQ ID NO: 25454 - DNA, 20 bp, Artificial Sequence
  Description of Artificial Sequence: Synthetic oligonucleotide
ggacccgcgctcctggaccg

SEQ ID NO: 25455 - DNA, 20 bp, Artificial Sequence
  Description of Artificial Sequence: Synthetic oligonucleotide
gacccgcgctcctggaccgc

SEQ ID NO: 25456 - DNA, 20 bp, Artificial Sequence
  Description of Artificial Sequence: Synthetic oligonucleotide
acccgcgctcctggaccgcg

SEQ ID NO: 25457 - DNA, 20 bp, Artificial Sequence
  Description of Artificial Sequence: Synthetic oligonucleotide
cccgcgctcctggaccgcgt

SEQ ID NO: 25458 - DNA, 20 bp, Artificial Sequence
  Description of Artificial Sequence: Synthetic oligonucleotide
ccgcgctcctggaccgcggt

SEQ ID NO: 25459 - DNA, 20 bp, Artificial Sequence
  Description of Artificial Sequence: Synthetic oligonucleotide
cgcgctcctggaccgcggct

SEQ ID NO: 25460 - DNA, 35 bp, Artificial Sequence
  Description of Artificial Sequence: Synthetic oligonucleotide
atcttcaagaccaacacacagacttaccgagagag

SEQ ID NO: 25461 - DNA, 34 bp, Artificial Sequence
  Description of Artificial Sequence: Synthetic oligonucleotide
tcttcaagaccaacacacagacttaccgagagag

SEQ ID NO: 25462 - DNA, 33 bp, Artificial Sequence
  Description of Artificial Sequence: Synthetic oligonucleotide
cttcaagaccaacacacagacttaccgagagag

SEQ ID NO: 25463 - DNA, 33 bp, Artificial Sequence
  Description of Artificial Sequence: Synthetic oligonucleotide
ttcaagaccaacacacagacttaccgagagagc

SEQ ID NO: 25464 - DNA, 32 bp, Artificial Sequence
  Description of Artificial Sequence: Synthetic oligonucleotide
tcaagaccaacacacagacttaccgagagagc

SEQ ID NO: 25465 - DNA, 27 bp, Artificial Sequence
  Description of Artificial Sequence: Synthetic oligonucleotide
gatagagcaggaggggccggagtattc

SEQ ID NO: 25466 - DNA, 27 bp, Artificial Sequence
  Description of Artificial Sequence: Synthetic oligonucleotide
atagagcaggaggggccggagtattcg

SEQ ID NO: 25467 - DNA, 26 bp, Artificial Sequence
  Description of Artificial Sequence: Synthetic oligonucleotide
tagagcaggaggggccggagtattcg

SEQ ID NO: 25468 - DNA, 25 bp, Artificial Sequence
  Description of Artificial Sequence: Synthetic oligonucleotide
agagcaggaggggccggagtattcg

SEQ ID NO: 25469 - DNA, 24 bp, Artificial Sequence
  Description of Artificial Sequence: Synthetic oligonucleotide
gagcaggaggggccggagtattcg

SEQ ID NO: 25470 - DNA, 25 bp, Artificial Sequence
  Description of Artificial Sequence: Synthetic oligonucleotide
agcaggaggggccggagtattcgga

SEQ ID NO: 25471 - DNA, 24 bp, Artificial Sequence
  Description of Artificial Sequence: Synthetic oligonucleotide
gcaggaggggccggagtattcgga

SEQ ID NO: 25472 - DNA, 24 bp, Artificial Sequence
  Description of Artificial Sequence: Synthetic oligonucleotide
caggaggggccggagtattcggac

SEQ ID NO: 25473 - DNA, 24 bp, Artificial Sequence
  Description of Artificial Sequence: Synthetic oligonucleotide
aggaggggccggagtattcggacc

SEQ ID NO: 25474 - DNA, 23 bp, Artificial Sequence
  Description of Artificial Sequence: Synthetic oligonucleotide
ggaggggccggagtattcggacc

SEQ ID NO: 25475 - DNA, 23 bp, Artificial Sequence
  Description of Artificial Sequence: Synthetic oligonucleotide
gaggggccggagtattcggaccg

SEQ ID NO: 25476 - DNA, 25 bp, Artificial Sequence
  Description of Artificial Sequence: Synthetic oligonucleotide
aggggccggagtattcggaccggaa

SEQ ID NO: 25477 - DNA, 24 bp, Artificial Sequence
  Description of Artificial Sequence: Synthetic oligonucleotide
ggggccggagtattcggaccggaa

SEQ ID NO: 25478 - DNA, 25 bp, Artificial Sequence
  Description of Artificial Sequence: Synthetic oligonucleotide
gggccggagtattcggaccggaaca

SEQ ID NO: 25479 - DNA, 26 bp, Artificial Sequence
  Description of Artificial Sequence: Synthetic oligonucleotide
ggccggagtattcggaccggaacaca

SEQ ID NO: 25480 - DNA, 27 bp, Artificial Sequence
  Description of Artificial Sequence: Synthetic oligonucleotide
gccggagtattcggaccggaacacaca

SEQ ID NO: 25481 - DNA, 27 bp, Artificial Sequence
  Description of Artificial Sequence: Synthetic oligonucleotide
ccggagtattcggaccggaacacacag

SEQ ID NO: 25482 - DNA, 29 bp, Artificial Sequence
  Description of Artificial Sequence: Synthetic oligonucleotide
cggagtattcggaccggaacacacagatc

SEQ ID NO: 25483 - DNA, 31 bp, Artificial Sequence
  Description of Artificial Sequence: Synthetic oligonucleotide
ggagtattcggaccggaacacacagatcttc

SEQ ID NO: 25484 - DNA, 33 bp, Artificial Sequence
  Description of Artificial Sequence: Synthetic oligonucleotide
gagtattcggaccggaacacacagatcttcaag

SEQ ID NO: 25485 - DNA, 34 bp, Artificial Sequence
  Description of Artificial Sequence: Synthetic oligonucleotide
agtattcggaccggaacacacagatcttcaagac

SEQ ID NO: 25486 - DNA, 33 bp, Artificial Sequence
  Description of Artificial Sequence: Synthetic oligonucleotide
gtattcggaccggaacacacagatcttcaagac

SEQ ID NO: 25487 - DNA, 33 bp, Artificial Sequence
  Description of Artificial Sequence: Synthetic oligonucleotide
tattcggaccggaacacacagatcttcaagacc

SEQ ID NO: 25488 - DNA, 32 bp, Artificial Sequence
  Description of Artificial Sequence: Synthetic oligonucleotide
attcggaccggaacacacagatcttcaagacc

SEQ ID NO: 25489 - DNA, 31 bp, Artificial Sequence
  Description of Artificial Sequence: Synthetic oligonucleotide
ttcggaccggaacacacagatcttcaagacc

SEQ ID NO: 25490 - DNA, 30 bp, Artificial Sequence
  Description of Artificial Sequence: Synthetic oligonucleotide
tcggaccggaacacacagatcttcaagacc

SEQ ID NO: 25491 - DNA, 29 bp, Artificial Sequence
  Description of Artificial Sequence: Synthetic oligonucleotide
cggaccggaacacacagatcttcaagacc

SEQ ID NO: 25492 - DNA, 25 bp, Artificial Sequence
  Description of Artificial Sequence: Synthetic oligonucleotide
agctgagagcctacctggagggcct

SEQ ID NO: 25493 - DNA, 24 bp, Artificial Sequence
  Description of Artificial Sequence: Synthetic oligonucleotide
gctgagagcctacctggagggcct

SEQ ID NO: 25494 - DNA, 25 bp, Artificial Sequence
  Description of Artificial Sequence: Synthetic oligonucleotide
ctgagagcctacctggagggcctgt

SEQ ID NO: 25495 - DNA, 25 bp, Artificial Sequence
  Description of Artificial Sequence: Synthetic oligonucleotide
tgagagcctacctggagggcctgtg

SEQ ID NO: 25496 - DNA, 24 bp, Artificial Sequence
  Description of Artificial Sequence: Synthetic oligonucleotide
cagagcgaggccgggtctcacatc

SEQ ID NO: 25497 - DNA, 25 bp, Artificial Sequence
  Description of Artificial Sequence: Synthetic oligonucleotide
agagcgaggccgggtctcacatcct

SEQ ID NO: 25498 - DNA, 24 bp, Artificial Sequence
  Description of Artificial Sequence: Synthetic oligonucleotide
gagcgaggccgggtctcacatcct

SEQ ID NO: 25499 - DNA, 24 bp, Artificial Sequence
  Description of Artificial Sequence: Synthetic oligonucleotide
agcgaggccgggtctcacatcctc

SEQ ID NO: 25500 - DNA, 23 bp, Artificial Sequence
  Description of Artificial Sequence: Synthetic oligonucleotide
gcgaggccgggtctcacatcctc

SEQ ID NO: 25501 - DNA, 24 bp, Artificial Sequence
  Description of Artificial Sequence: Synthetic oligonucleotide
cgaggccgggtctcacatcctcca

SEQ ID NO: 25502 - DNA, 25 bp, Artificial Sequence
  Description of Artificial Sequence: Synthetic oligonucleotide
gaggccgggtctcacatcctccaga

SEQ ID NO: 25503 - DNA, 25 bp, Artificial Sequence
  Description of Artificial Sequence: Synthetic oligonucleotide
aggccgggtctcacatcctccagag

SEQ ID NO: 25504 - DNA, 24 bp, Artificial Sequence
  Description of Artificial Sequence: Synthetic oligonucleotide
ggccgggtctcacatcctccagag

SEQ ID NO: 25505 - DNA, 26 bp, Artificial Sequence
  Description of Artificial Sequence: Synthetic oligonucleotide
gccgggtctcacatcctccagagcat

SEQ ID NO: 25506 - DNA, 27 bp, Artificial Sequence
  Description of Artificial Sequence: Synthetic oligonucleotide
ccgggtctcacatcctccagagcatgt

SEQ ID NO: 25507 - DNA, 28 bp, Artificial Sequence
  Description of Artificial Sequence: Synthetic oligonucleotide
cgggtctcacatcctccagagcatgtac

SEQ ID NO: 25508 - DNA, 28 bp, Artificial Sequence
  Description of Artificial Sequence: Synthetic oligonucleotide
gggtctcacatcctccagagcatgtacg

SEQ ID NO: 25509 - DNA, 28 bp, Artificial Sequence
  Description of Artificial Sequence: Synthetic oligonucleotide
ggtctcacatcctccagagcatgtacgg

SEQ ID NO: 25510 - DNA, 28 bp, Artificial Sequence
  Description of Artificial Sequence: Synthetic oligonucleotide
gtctcacatcctccagagcatgtacggc

SEQ ID NO: 25511 - DNA, 29 bp, Artificial Sequence
  Description of Artificial Sequence: Synthetic oligonucleotide
tctcacatcctccagagcatgtacggctg

SEQ ID NO: 25512 - DNA, 28 bp, Artificial Sequence
  Description of Artificial Sequence: Synthetic oligonucleotide
ctcacatcctccagagcatgtacggctg

SEQ ID NO: 25513 - DNA, 28 bp, Artificial Sequence
  Description of Artificial Sequence: Synthetic oligonucleotide
tcacatcctccagagcatgtacggctgc

SEQ ID NO: 25514 - DNA, 27 bp, Artificial Sequence
  Description of Artificial Sequence: Synthetic oligonucleotide
cacatcctccagagcatgtacggctgc

SEQ ID NO: 25515 - DNA, 27 bp, Artificial Sequence
  Description of Artificial Sequence: Synthetic oligonucleotide
acatcctccagagcatgtacggctgcg

SEQ ID NO: 25516 - DNA, 27 bp, Artificial Sequence
  Description of Artificial Sequence: Synthetic oligonucleotide
catcctccagagcatgtacggctgcga

SEQ ID NO: 25517 - DNA, 27 bp, Artificial Sequence
  Description of Artificial Sequence: Synthetic oligonucleotide
atcctccagagcatgtacggctgcgac

SEQ ID NO: 25518 - DNA, 26 bp, Artificial Sequence
  Description of Artificial Sequence: Synthetic oligonucleotide
tcctccagagcatgtacggctgcgac

SEQ ID NO: 25519 - DNA, 25 bp, Artificial Sequence
  Description of Artificial Sequence: Synthetic oligonucleotide
accgagagagcctgcggaacctgca

SEQ ID NO: 25520 - DNA, 24 bp, Artificial Sequence
  Description of Artificial Sequence: Synthetic oligonucleotide
ccgagagagcctgcggaacctgca

SEQ ID NO: 25521 - DNA, 24 bp, Artificial Sequence
  Description of Artificial Sequence: Synthetic oligonucleotide
cgagagagcctgcggaacctgcac

SEQ ID NO: 25522 - DNA, 24 bp, Artificial Sequence
  Description of Artificial Sequence: Synthetic oligonucleotide
gagagagcctgcggaacctgcacg

SEQ ID NO: 25523 - DNA, 24 bp, Artificial Sequence
  Description of Artificial Sequence: Synthetic oligonucleotide
agagagcctgcggaacctgcacgg

SEQ ID NO: 25524 - DNA, 23 bp, Artificial Sequence
  Description of Artificial Sequence: Synthetic oligonucleotide
gagagcctgcggaacctgcacgg

SEQ ID NO: 25525 - DNA, 25 bp, Artificial Sequence
  Description of Artificial Sequence: Synthetic oligonucleotide
agagcctgcggaacctgcacggcta

SEQ ID NO: 25526 - DNA, 24 bp, Artificial Sequence
  Description of Artificial Sequence: Synthetic oligonucleotide
gagcctgcggaacctgcacggcta

SEQ ID NO: 25527 - DNA, 26 bp, Artificial Sequence
  Description of Artificial Sequence: Synthetic oligonucleotide
agcctgcggaacctgcacggctacta

SEQ ID NO: 25528 - DNA, 25 bp, Artificial Sequence
  Description of Artificial Sequence: Synthetic oligonucleotide
gcctgcggaacctgcacggctacta

SEQ ID NO: 25529 - DNA, 27 bp, Artificial Sequence
  Description of Artificial Sequence: Synthetic oligonucleotide
cctgcggaacctgcacggctactacaa

SEQ ID NO: 25530 - DNA, 27 bp, Artificial Sequence
  Description of Artificial Sequence: Synthetic oligonucleotide
ctgcggaacctgcacggctactacaac

SEQ ID NO: 25531 - DNA, 27 bp, Artificial Sequence
  Description of Artificial Sequence: Synthetic oligonucleotide
tgcggaacctgcacggctactacaacc

SEQ ID NO: 25532 - DNA, 27 bp, Artificial Sequence
  Description of Artificial Sequence: Synthetic oligonucleotide
gcggaacctgcacggctactacaacca

SEQ ID NO: 25533 - DNA, 27 bp, Artificial Sequence
  Description of Artificial Sequence: Synthetic oligonucleotide
cggaacctgcacggctactacaaccag

SEQ ID NO: 25534 - DNA, 28 bp, Artificial Sequence
  Description of Artificial Sequence: Synthetic oligonucleotide
ggaacctgcacggctactacaaccagag

SEQ ID NO: 25535 - DNA, 28 bp, Artificial Sequence
  Description of Artificial Sequence: Synthetic oligonucleotide
gaacctgcacggctactacaaccagagc

SEQ ID NO: 25536 - DNA, 28 bp, Artificial Sequence
  Description of Artificial Sequence: Synthetic oligonucleotide
aacctgcacggctactacaaccagagcg

SEQ ID NO: 25537 - DNA, 27 bp, Artificial Sequence
  Description of Artificial Sequence: Synthetic oligonucleotide
acctgcacggctactacaaccagagcg

SEQ ID NO: 25538 - DNA, 27 bp, Artificial Sequence
  Description of Artificial Sequence: Synthetic oligonucleotide
ctccgcgggcataaccagtacgcctaa

SEQ ID NO: 25539 - DNA, 27 bp, Artificial Sequence
  Description of Artificial Sequence: Synthetic oligonucleotide
tccgcgggcataaccagtacgcctaag

SEQ ID NO: 25540 - DNA, 27 bp, Artificial Sequence
  Description of Artificial Sequence: Synthetic oligonucleotide
ccgcgggcataaccagtacgcctaaga

SEQ ID NO: 25541 - DNA, 27 bp, Artificial Sequence
  Description of Artificial Sequence: Synthetic oligonucleotide
cgcgggcataaccagtacgcctaagac

SEQ ID NO: 25542 - DNA, 27 bp, Artificial Sequence
  Description of Artificial Sequence: Synthetic oligonucleotide
gcgggcataaccagtacgcctaagacg

SEQ ID NO: 25543 - DNA, 27 bp, Artificial Sequence
  Description of Artificial Sequence: Synthetic oligonucleotide
cgggcataaccagtacgcctaagacgg

SEQ ID NO: 25544 - DNA, 27 bp, Artificial Sequence
  Description of Artificial Sequence: Synthetic oligonucleotide
gggcataaccagtacgcctaagacggc

SEQ ID NO: 25545 - DNA, 29 bp, Artificial Sequence
  Description of Artificial Sequence: Synthetic oligonucleotide
ggcataaccagtacgcctaagacggcaag

SEQ ID NO: 25546 - DNA, 29 bp, Artificial Sequence
  Description of Artificial Sequence: Synthetic oligonucleotide
gcataaccagtacgcctaagacggcaagg

SEQ ID NO: 25547 - DNA, 33 bp, Artificial Sequence
  Description of Artificial Sequence: Synthetic oligonucleotide
cataaccagtacgcctaagacggcaaggattac

SEQ ID NO: 25548 - DNA, 35 bp, Artificial Sequence
  Description of Artificial Sequence: Synthetic oligonucleotide
ataaccagtacgcctaagacggcaaggattacatc

SEQ ID NO: 25549 - DNA, 34 bp, Artificial Sequence
  Description of Artificial Sequence: Synthetic oligonucleotide
taaccagtacgcctaagacggcaaggattacatc

SEQ ID NO: 25550 - DNA, 33 bp, Artificial Sequence
  Description of Artificial Sequence: Synthetic oligonucleotide
aaccagtacgcctaagacggcaaggattacatc

SEQ ID NO: 25551 - DNA, 27 bp, Artificial Sequence
  Description of Artificial Sequence: Synthetic oligonucleotide
acctggagaacgggaaggacacgctga

SEQ ID NO: 25552 - DNA, 27 bp, Artificial Sequence
  Description of Artificial Sequence: Synthetic oligonucleotide
cctggagaacgggaaggacacgctgaa

SEQ ID NO: 25553 - DNA, 27 bp, Artificial Sequence
  Description of Artificial Sequence: Synthetic oligonucleotide
ctggagaacgggaaggacacgctgaag

SEQ ID NO: 25554 - DNA, 27 bp, Artificial Sequence
  Description of Artificial Sequence: Synthetic oligonucleotide
tggagaacgggaaggacacgctgaagc

SEQ ID NO: 25555 - DNA, 26 bp, Artificial Sequence
  Description of Artificial Sequence: Synthetic oligonucleotide
ggagaacgggaaggacacgctgaagc

SEQ ID NO: 25556 - DNA, 26 bp, Artificial Sequence
  Description of Artificial Sequence: Synthetic oligonucleotide
gagaacgggaaggacacgctgaagcg

SEQ ID NO: 25557 - DNA, 26 bp, Artificial Sequence
  Description of Artificial Sequence: Synthetic oligonucleotide
agaacgggaaggacacgctgaagcgc

SEQ ID NO: 25558 - DNA, 25 bp, Artificial Sequence
  Description of Artificial Sequence: Synthetic oligonucleotide
gaacgggaaggacacgctgaagcgc

SEQ ID NO: 25559 - DNA, 25 bp, Artificial Sequence
  Description of Artificial Sequence: Synthetic oligonucleotide
aacgggaaggacacgctgaagcgcg

SEQ ID NO: 25560 - DNA, 24 bp, Artificial Sequence
  Description of Artificial Sequence: Synthetic oligonucleotide
acgggaaggacacgctgaagcgcg

SEQ ID NO: 25561 - DNA, 23 bp, Artificial Sequence
  Description of Artificial Sequence: Synthetic oligonucleotide
cgggaaggacacgctgaagcgcg

SEQ ID NO: 25562 - DNA, 23 bp, Artificial Sequence
  Description of Artificial Sequence: Synthetic oligonucleotide
gggaaggacacgctgaagcgcgc

SEQ ID NO: 25563 - DNA, 23 bp, Artificial Sequence
  Description of Artificial Sequence: Synthetic oligonucleotide
ggaaggacacgctgaagcgcgcg

SEQ ID NO: 25564 - DNA, 23 bp, Artificial Sequence
  Description of Artificial Sequence: Synthetic oligonucleotide
gaaggacacgctgaagcgcgcgg

SEQ ID NO: 25565 - DNA, 25 bp, Artificial Sequence
  Description of Artificial Sequence: Synthetic oligonucleotide
ccgggtctcacaccctccagagctt

SEQ ID NO: 25566 - DNA, 27 bp, Artificial Sequence
  Description of Artificial Sequence: Synthetic oligonucleotide
cgggtctcacaccctccagagcttgta

SEQ ID NO: 25567 - DNA, 27 bp, Artificial Sequence
  Description of Artificial Sequence: Synthetic oligonucleotide
gggtctcacaccctccagagcttgtac

SEQ ID NO: 25568 - DNA, 27 bp, Artificial Sequence
  Description of Artificial Sequence: Synthetic oligonucleotide
ggtctcacaccctccagagcttgtacg

SEQ ID NO: 25569 - DNA, 27 bp, Artificial Sequence
  Description of Artificial Sequence: Synthetic oligonucleotide
gtctcacaccctccagagcttgtacgg

SEQ ID NO: 25570 - DNA, 27 bp, Artificial Sequence
  Description of Artificial Sequence: Synthetic oligonucleotide
tctcacaccctccagagcttgtacggc

SEQ ID NO: 25571 - DNA, 27 bp, Artificial Sequence
  Description of Artificial Sequence: Synthetic oligonucleotide
ctcacaccctccagagcttgtacggct

SEQ ID NO: 25572 - DNA, 27 bp, Artificial Sequence
  Description of Artificial Sequence: Synthetic oligonucleotide
tcacaccctccagagcttgtacggctg

SEQ ID NO: 25573 - DNA, 26 bp, Artificial Sequence
  Description of Artificial Sequence: Synthetic oligonucleotide
cacaccctccagagcttgtacggctg

SEQ ID NO: 25574 - DNA, 26 bp, Artificial Sequence
  Description of Artificial Sequence: Synthetic oligonucleotide
acaccctccagagcttgtacggctgc

SEQ ID NO: 25575 - DNA, 25 bp, Artificial Sequence
  Description of Artificial Sequence: Synthetic oligonucleotide
caccctccagagcttgtacggctgc

SEQ ID NO: 25576 - DNA, 26 bp, Artificial Sequence
  Description of Artificial Sequence: Synthetic oligonucleotide
accctccagagcttgtacggctgcga

SEQ ID NO: 25577 - DNA, 25 bp, Artificial Sequence
  Description of Artificial Sequence: Synthetic oligonucleotide
ccctccagagcttgtacggctgcga

SEQ ID NO: 25578 - DNA, 25 bp, Artificial Sequence
  Description of Artificial Sequence: Synthetic oligonucleotide
cctccagagcttgtacggctgcgac

SEQ ID NO: 25579 - DNA, 26 bp, Artificial Sequence
  Description of Artificial Sequence: Synthetic oligonucleotide
ctccagagcttgtacggctgcgacgt

SEQ ID NO: 25580 - DNA, 26 bp, Artificial Sequence
  Description of Artificial Sequence: Synthetic oligonucleotide
tccagagcttgtacggctgcgacgtg

SEQ ID NO: 25581 - DNA, 25 bp, Artificial Sequence
  Description of Artificial Sequence: Synthetic oligonucleotide
ccagagcttgtacggctgcgacgtg

SEQ ID NO: 25582 - DNA, 25 bp, Artificial Sequence
  Description of Artificial Sequence: Synthetic oligonucleotide
cagagcttgtacggctgcgacgtgg

SEQ ID NO: 25583 - DNA, 25 bp, Artificial Sequence
  Description of Artificial Sequence: Synthetic oligonucleotide
agagcttgtacggctgcgacgtggg

SEQ ID NO: 25584 - DNA, 24 bp, Artificial Sequence
  Description of Artificial Sequence: Synthetic oligonucleotide
gagcttgtacggctgcgacgtggg

SEQ ID NO: 25585 - DNA, 24 bp, Artificial Sequence
  Description of Artificial Sequence: Synthetic oligonucleotide
agcttgtacggctgcgacgtgggg

SEQ ID NO: 25586 - DNA, 23 bp, Artificial Sequence
  Description of Artificial Sequence: Synthetic oligonucleotide
gcttgtacggctgcgacgtgggg

SEQ ID NO: 25587 - DNA, 23 bp, Artificial Sequence
  Description of Artificial Sequence: Synthetic oligonucleotide
cttgtacggctgcgacgtggggc

SEQ ID NO: 25588 - DNA, 23 bp, Artificial Sequence
  Description of Artificial Sequence: Synthetic oligonucleotide
ttgtacggctgcgacgtggggcc

SEQ ID NO: 25589 - DNA, 24 bp, Artificial Sequence
  Description of Artificial Sequence: Synthetic oligonucleotide
gagagagcctgcggaacctgcgct

SEQ ID NO: 25590 - DNA, 24 bp, Artificial Sequence
  Description of Artificial Sequence: Synthetic oligonucleotide
agagagcctgcggaacctgcgctg

SEQ ID NO: 25591 - DNA, 23 bp, Artificial Sequence
  Description of Artificial Sequence: Synthetic oligonucleotide
gagagcctgcggaacctgcgctg

SEQ ID NO: 25592 - DNA, 25 bp, Artificial Sequence
  Description of Artificial Sequence: Synthetic oligonucleotide
agagcctgcggaacctgcgctgcta

SEQ ID NO: 25593 - DNA, 24 bp, Artificial Sequence
  Description of Artificial Sequence: Synthetic oligonucleotide
gagcctgcggaacctgcgctgcta

SEQ ID NO: 25594 - DNA, 26 bp, Artificial Sequence
  Description of Artificial Sequence: Synthetic oligonucleotide
agcctgcggaacctgcgctgctacta

SEQ ID NO: 25595 - DNA, 25 bp, Artificial Sequence
  Description of Artificial Sequence: Synthetic oligonucleotide
gcctgcggaacctgcgctgctacta

SEQ ID NO: 25596 - DNA, 27 bp, Artificial Sequence
  Description of Artificial Sequence: Synthetic oligonucleotide
cctgcggaacctgcgctgctactacaa

SEQ ID NO: 25597 - DNA, 27 bp, Artificial Sequence
  Description of Artificial Sequence: Synthetic oligonucleotide
ctgcggaacctgcgctgctactacaac

SEQ ID NO: 25598 - DNA, 27 bp, Artificial Sequence
  Description of Artificial Sequence: Synthetic oligonucleotide
tgcggaacctgcgctgctactacaacc

SEQ ID NO: 25599 - DNA, 27 bp, Artificial Sequence
  Description of Artificial Sequence: Synthetic oligonucleotide
gcggaacctgcgctgctactacaacca

SEQ ID NO: 25600 - DNA, 27 bp, Artificial Sequence
  Description of Artificial Sequence: Synthetic oligonucleotide
cggaacctgcgctgctactacaaccag

SEQ ID NO: 25601 - DNA, 28 bp, Artificial Sequence
  Description of Artificial Sequence: Synthetic oligonucleotide
ggaacctgcgctgctactacaaccagag

SEQ ID NO: 25602 - DNA, 28 bp, Artificial Sequence
  Description of Artificial Sequence: Synthetic oligonucleotide
gaacctgcgctgctactacaaccagagc

SEQ ID NO: 25603 - DNA, 28 bp, Artificial Sequence
  Description of Artificial Sequence: Synthetic oligonucleotide
aacctgcgctgctactacaaccagagcg

SEQ ID NO: 25604 - DNA, 27 bp, Artificial Sequence
  Description of Artificial Sequence: Synthetic oligonucleotide
acctgcgctgctactacaaccagagcg

SEQ ID NO: 25605 - DNA, 27 bp, Artificial Sequence
  Description of Artificial Sequence: Synthetic oligonucleotide
cctgcgctgctactacaaccagagcga

SEQ ID NO: 25606 - DNA, 27 bp, Artificial Sequence
  Description of Artificial Sequence: Synthetic oligonucleotide
ctgcgctgctactacaaccagagcgag

SEQ ID NO: 25607 - DNA, 27 bp, Artificial Sequence
  Description of Artificial Sequence: Synthetic oligonucleotide
tgcgctgctactacaaccagagcgagg

SEQ ID NO: 25608 - DNA, 26 bp, Artificial Sequence
  Description of Artificial Sequence: Synthetic oligonucleotide
gcgctgctactacaaccagagcgagg

SEQ ID NO: 25609 - DNA, 26 bp, Artificial Sequence
  Description of Artificial Sequence: Synthetic oligonucleotide
cgctgctactacaaccagagcgaggc

SEQ ID NO: 25610 - DNA, 26 bp, Artificial Sequence
  Description of Artificial Sequence: Synthetic oligonucleotide
gctgctactacaaccagagcgaggcc

SEQ ID NO: 25611 - DNA, 26 bp, Artificial Sequence
  Description of Artificial Sequence: Synthetic oligonucleotide
ctgctactacaaccagagcgaggccg

SEQ ID NO: 25612 - DNA, 26 bp, Artificial Sequence
  Description of Artificial Sequence: Synthetic oligonucleotide
tgctactacaaccagagcgaggccgg

SEQ ID NO: 25613 - DNA, 24 bp, Artificial Sequence
  Description of Artificial Sequence: Synthetic oligonucleotide
gcctcctccgcgggcataaccagt

SEQ ID NO: 25614 - DNA, 24 bp, Artificial Sequence
  Description of Artificial Sequence: Synthetic oligonucleotide
cctcctccgcgggcataaccagtc

SEQ ID NO: 25615 - DNA, 24 bp, Artificial Sequence
  Description of Artificial Sequence: Synthetic oligonucleotide
ctcctccgcgggcataaccagtcc

SEQ ID NO: 25616 - DNA, 24 bp, Artificial Sequence
  Description of Artificial Sequence: Synthetic oligonucleotide
tcctccgcgggcataaccagtccg

SEQ ID NO: 25617 - DNA, 23 bp, Artificial Sequence
  Description of Artificial Sequence: Synthetic oligonucleotide
cctccgcgggcataaccagtccg

SEQ ID NO: 25618 - DNA, 23 bp, Artificial Sequence
  Description of Artificial Sequence: Synthetic oligonucleotide
ctccgcgggcataaccagtccgc

SEQ ID NO: 25619 - DNA, 25 bp, Artificial Sequence
  Description of Artificial Sequence: Synthetic oligonucleotide
tccgcgggcataaccagtccgccta

SEQ ID NO: 25620 - DNA, 24 bp, Artificial Sequence
  Description of Artificial Sequence: Synthetic oligonucleotide
ccgcgggcataaccagtccgccta

SEQ ID NO: 25621 - DNA, 24 bp, Artificial Sequence
  Description of Artificial Sequence: Synthetic oligonucleotide
cgcgggcataaccagtccgcctac

SEQ ID NO: 25622 - DNA, 25 bp, Artificial Sequence
  Description of Artificial Sequence: Synthetic oligonucleotide
gcgggcataaccagtccgcctacga

SEQ ID NO: 25623 - DNA, 25 bp, Artificial Sequence
  Description of Artificial Sequence: Synthetic oligonucleotide
cgggcataaccagtccgcctacgac

SEQ ID NO: 25624 - DNA, 25 bp, Artificial Sequence
  Description of Artificial Sequence: Synthetic oligonucleotide
gggcataaccagtccgcctacgacg

SEQ ID NO: 25625 - DNA, 25 bp, Artificial Sequence
  Description of Artificial Sequence: Synthetic oligonucleotide
ggcataaccagtccgcctacgacgg

SEQ ID NO: 25626 - DNA, 27 bp, Artificial Sequence
  Description of Artificial Sequence: Synthetic oligonucleotide
gcataaccagtccgcctacgacggcaa

SEQ ID NO: 25627 - DNA, 27 bp, Artificial Sequence
  Description of Artificial Sequence: Synthetic oligonucleotide
cataaccagtccgcctacgacggcaag

SEQ ID NO: 25628 - DNA, 27 bp, Artificial Sequence
  Description of Artificial Sequence: Synthetic oligonucleotide
ataaccagtccgcctacgacggcaagg

SEQ ID NO: 25629 - DNA, 27 bp, Artificial Sequence
  Description of Artificial Sequence: Synthetic oligonucleotide
taaccagtccgcctacgacggcaagga

SEQ ID NO: 25630 - DNA, 27 bp, Artificial Sequence
  Description of Artificial Sequence: Synthetic oligonucleotide
aaccagtccgcctacgacggcaaggat

SEQ ID NO: 25631 - DNA, 29 bp, Artificial Sequence
  Description of Artificial Sequence: Synthetic oligonucleotide
aacacacagactgaccgagagagcctgtg

SEQ ID NO: 25632 - DNA, 28 bp, Artificial Sequence
  Description of Artificial Sequence: Synthetic oligonucleotide
acacacagactgaccgagagagcctgtg

SEQ ID NO: 25633 - DNA, 27 bp, Artificial Sequence
  Description of Artificial Sequence: Synthetic oligonucleotide
cacacagactgaccgagagagcctgtg

SEQ ID NO: 25634 - DNA, 27 bp, Artificial Sequence
  Description of Artificial Sequence: Synthetic oligonucleotide
acacagactgaccgagagagcctgtgg

SEQ ID NO: 25635 - DNA, 27 bp, Artificial Sequence
  Description of Artificial Sequence: Synthetic oligonucleotide
cacagactgaccgagagagcctgtgga

SEQ ID NO: 25636 - DNA, 28 bp, Artificial Sequence
  Description of Artificial Sequence: Synthetic oligonucleotide
acagactgaccgagagagcctgtggaac

SEQ ID NO: 25637 - DNA, 27 bp, Artificial Sequence
  Description of Artificial Sequence: Synthetic oligonucleotide
cagactgaccgagagagcctgtggaac

SEQ ID NO: 25638 - DNA, 27 bp, Artificial Sequence
  Description of Artificial Sequence: Synthetic oligonucleotide
agactgaccgagagagcctgtggaacc

SEQ ID NO: 25639 - DNA, 27 bp, Artificial Sequence
  Description of Artificial Sequence: Synthetic oligonucleotide
gactgaccgagagagcctgtggaacct

SEQ ID NO: 25640 - DNA, 27 bp, Artificial Sequence
  Description of Artificial Sequence: Synthetic oligonucleotide
actgaccgagagagcctgtggaacctg

SEQ ID NO: 25641 - DNA, 26 bp, Artificial Sequence
  Description of Artificial Sequence: Synthetic oligonucleotide
ctgaccgagagagcctgtggaacctg

SEQ ID NO: 25642 - DNA, 26 bp, Artificial Sequence
  Description of Artificial Sequence: Synthetic oligonucleotide
tgaccgagagagcctgtggaacctgc

SEQ ID NO: 25643 - DNA, 25 bp, Artificial Sequence
  Description of Artificial Sequence: Synthetic oligonucleotide
gaccgagagagcctgtggaacctgc

SEQ ID NO: 25644 - DNA, 25 bp, Artificial Sequence
  Description of Artificial Sequence: Synthetic oligonucleotide
accgagagagcctgtggaacctgcg

SEQ ID NO: 25645 - DNA, 24 bp, Artificial Sequence
  Description of Artificial Sequence: Synthetic oligonucleotide
ccgagagagcctgtggaacctgcg

SEQ ID NO: 25646 - DNA, 24 bp, Artificial Sequence
  Description of Artificial Sequence: Synthetic oligonucleotide
cgagagagcctgtggaacctgcgc

SEQ ID NO: 25647 - DNA, 24 bp, Artificial Sequence
  Description of Artificial Sequence: Synthetic oligonucleotide
gagagagcctgtggaacctgcgcg

SEQ ID NO: 25648 - DNA, 24 bp, Artificial Sequence
  Description of Artificial Sequence: Synthetic oligonucleotide
agagagcctgtggaacctgcgcgg

SEQ ID NO: 25649 - DNA, 23 bp, Artificial Sequence
  Description of Artificial Sequence: Synthetic oligonucleotide
gagagcctgtggaacctgcgcgg

SEQ ID NO: 25650 - DNA, 25 bp, Artificial Sequence
  Description of Artificial Sequence: Synthetic oligonucleotide
agagcctgtggaacctgcgcggcta

SEQ ID NO: 25651 - DNA, 24 bp, Artificial Sequence
  Description of Artificial Sequence: Synthetic oligonucleotide
gagcctgtggaacctgcgcggcta

SEQ ID NO: 25652 - DNA, 26 bp, Artificial Sequence
  Description of Artificial Sequence: Synthetic oligonucleotide
agcctgtggaacctgcgcggctacta

SEQ ID NO: 25653 - DNA, 25 bp, Artificial Sequence
  Description of Artificial Sequence: Synthetic oligonucleotide
gcctgtggaacctgcgcggctacta

SEQ ID NO: 25654 - DNA, 27 bp, Artificial Sequence
  Description of Artificial Sequence: Synthetic oligonucleotide
cctgtggaacctgcgcggctactacaa

SEQ ID NO: 25655 - DNA, 27 bp, Artificial Sequence
  Description of Artificial Sequence: Synthetic oligonucleotide
ctgtggaacctgcgcggctactacaac

SEQ ID NO: 25656 - DNA, 27 bp, Artificial Sequence
  Description of Artificial Sequence: Synthetic oligonucleotide
tgtggaacctgcgcggctactacaacc

SEQ ID NO: 25657 - DNA, 27 bp, Artificial Sequence
  Description of Artificial Sequence: Synthetic oligonucleotide
gtggaacctgcgcggctactacaacca

SEQ ID NO: 25658 - DNA, 27 bp, Artificial Sequence
  Description of Artificial Sequence: Synthetic oligonucleotide
tggaacctgcgcggctactacaaccag

SEQ ID NO: 25659 - DNA, 22 bp, Artificial Sequence
  Description of Artificial Sequence: Synthetic oligonucleotide
agagaggagccgcgggcgccat

SEQ ID NO: 25660 - DNA, 21 bp, Artificial Sequence
  Description of Artificial Sequence: Synthetic oligonucleotide
gagaggagccgcgggcgccat

SEQ ID NO: 25661 - DNA, 21 bp, Artificial Sequence
  Description of Artificial Sequence: Synthetic oligonucleotide
agaggagccgcgggcgccatg

SEQ ID NO: 25662 - DNA, 20 bp, Artificial Sequence
  Description of Artificial Sequence: Synthetic oligonucleotide
gaggagccgcgggcgccatg

SEQ ID NO: 25663 - DNA, 23 bp, Artificial Sequence
  Description of Artificial Sequence: Synthetic oligonucleotide
aggagccgcgggcgccatggata

SEQ ID NO: 25664 - DNA, 30 bp, Artificial Sequence
  Description of Artificial Sequence: Synthetic oligonucleotide
gagtattgggaccgggagacacagatcttc

SEQ ID NO: 25665 - DNA, 32 bp, Artificial Sequence
  Description of Artificial Sequence: Synthetic oligonucleotide
agtattgggaccgggagacacagatcttcaag

SEQ ID NO: 25666 - DNA, 31 bp, Artificial Sequence
  Description of Artificial Sequence: Synthetic oligonucleotide
gtattgggaccgggagacacagatcttcaag

SEQ ID NO: 25667 - DNA, 32 bp, Artificial Sequence
  Description of Artificial Sequence: Synthetic oligonucleotide
tattgggaccgggagacacagatcttcaagac

SEQ ID NO: 25668 - DNA, 31 bp, Artificial Sequence
  Description of Artificial Sequence: Synthetic oligonucleotide
attgggaccgggagacacagatcttcaagac

SEQ ID NO: 25669 - DNA, 30 bp, Artificial Sequence
  Description of Artificial Sequence: Synthetic oligonucleotide
ttgggaccgggagacacagatcttcaagac

SEQ ID NO: 25670 - DNA, 29 bp, Artificial Sequence
  Description of Artificial Sequence: Synthetic oligonucleotide
tgggaccgggagacacagatcttcaagac

SEQ ID NO: 25671 - DNA, 28 bp, Artificial Sequence
  Description of Artificial Sequence: Synthetic oligonucleotide
gggaccgggagacacagatcttcaagac

SEQ ID NO: 25672 - DNA, 28 bp, Artificial Sequence
  Description of Artificial Sequence: Synthetic oligonucleotide
ggaccgggagacacagatcttcaagacc

SEQ ID NO: 25673 - DNA, 30 bp, Artificial Sequence
  Description of Artificial Sequence: Synthetic oligonucleotide
gaccgggagacacagatcttcaagaccaac

SEQ ID NO: 25674 - DNA, 31 bp, Artificial Sequence
  Description of Artificial Sequence: Synthetic oligonucleotide
accgggagacacagatcttcaagaccaacac

SEQ ID NO: 25675 - DNA, 30 bp, Artificial Sequence
  Description of Artificial Sequence: Synthetic oligonucleotide
ccgggagacacagatcttcaagaccaacac

SEQ ID NO: 25676 - DNA, 31 bp, Artificial Sequence
  Description of Artificial Sequence: Synthetic oligonucleotide
cgggagacacagatcttcaagaccaacacac

SEQ ID NO: 25677 - DNA, 32 bp, Artificial Sequence
  Description of Artificial Sequence: Synthetic oligonucleotide
gggagacacagatcttcaagaccaacacacag

SEQ ID NO: 25678 - DNA, 33 bp, Artificial Sequence
  Description of Artificial Sequence: Synthetic oligonucleotide
ggagacacagatcttcaagaccaacacacagac

SEQ ID NO: 25679 - DNA, 34 bp, Artificial Sequence
  Description of Artificial Sequence: Synthetic oligonucleotide
gagacacagatcttcaagaccaacacacagactg

SEQ ID NO: 25680 - DNA, 35 bp, Artificial Sequence
  Description of Artificial Sequence: Synthetic oligonucleotide
agacacagatcttcaagaccaacacacagactgac

SEQ ID NO: 25681 - DNA, 34 bp, Artificial Sequence
  Description of Artificial Sequence: Synthetic oligonucleotide
gacacagatcttcaagaccaacacacagactgac

SEQ ID NO: 25682 - DNA, 20 bp, Artificial Sequence
  Description of Artificial Sequence: Synthetic oligonucleotide
ggcccgtgtggcggagcagc

SEQ ID NO: 25683 - DNA, 20 bp, Artificial Sequence
  Description of Artificial Sequence: Synthetic oligonucleotide
gcccgtgtggcggagcagcg

SEQ ID NO: 25684 - DNA, 21 bp, Artificial Sequence
  Description of Artificial Sequence: Synthetic oligonucleotide
cccgtgtggcggagcagcgga

SEQ ID NO: 25685 - DNA, 22 bp, Artificial Sequence
  Description of Artificial Sequence: Synthetic oligonucleotide
ccgtgtggcggagcagcggaga

SEQ ID NO: 25686 - DNA, 22 bp, Artificial Sequence
  Description of Artificial Sequence: Synthetic oligonucleotide
cgtgtggcggagcagcggagag

SEQ ID NO: 25687 - DNA, 22 bp, Artificial Sequence
  Description of Artificial Sequence: Synthetic oligonucleotide
gtgtggcggagcagcggagagc

SEQ ID NO: 25688 - DNA, 29 bp, Artificial Sequence
  Description of Artificial Sequence: Synthetic oligonucleotide
gcttcatctcagtgggctacgtggactac

SEQ ID NO: 25689 - DNA, 30 bp, Artificial Sequence
  Description of Artificial Sequence: Synthetic oligonucleotide
cttcatctcagtgggctacgtggactacac

SEQ ID NO: 25690 - DNA, 30 bp, Artificial Sequence
  Description of Artificial Sequence: Synthetic oligonucleotide
ttcatctcagtgggctacgtggactacacg

SEQ ID NO: 25691 - DNA, 29 bp, Artificial Sequence
  Description of Artificial Sequence: Synthetic oligonucleotide
tcatctcagtgggctacgtggactacacg

SEQ ID NO: 25692 - DNA, 28 bp, Artificial Sequence
  Description of Artificial Sequence: Synthetic oligonucleotide
catctcagtgggctacgtggactacacg

SEQ ID NO: 25693 - DNA, 28 bp, Artificial Sequence
  Description of Artificial Sequence: Synthetic oligonucleotide
atctcagtgggctacgtggactacacgc

SEQ ID NO: 25694 - DNA, 27 bp, Artificial Sequence
  Description of Artificial Sequence: Synthetic oligonucleotide
tctcagtgggctacgtggactacacgc

SEQ ID NO: 25695 - DNA, 27 bp, Artificial Sequence
  Description of Artificial Sequence: Synthetic oligonucleotide
ctcagtgggctacgtggactacacgca

SEQ ID NO: 25696 - DNA, 27 bp, Artificial Sequence
  Description of Artificial Sequence: Synthetic oligonucleotide
tcagtgggctacgtggactacacgcag

SEQ ID NO: 25697 - DNA, 27 bp, Artificial Sequence
  Description of Artificial Sequence: Synthetic oligonucleotide
cagtgggctacgtggactacacgcagt

SEQ ID NO: 25698 - DNA, 28 bp, Artificial Sequence
  Description of Artificial Sequence: Synthetic oligonucleotide
agtgggctacgtggactacacgcagttc

SEQ ID NO: 25699 - DNA, 28 bp, Artificial Sequence
  Description of Artificial Sequence: Synthetic oligonucleotide
gctacgtggactacacgcagttcgtgag

SEQ ID NO: 25700 - DNA, 28 bp, Artificial Sequence
  Description of Artificial Sequence: Synthetic oligonucleotide
ctacgtggactacacgcagttcgtgagg

SEQ ID NO: 25701 - DNA, 30 bp, Artificial Sequence
  Description of Artificial Sequence: Synthetic oligonucleotide
tacgtggactacacgcagttcgtgaggttc

SEQ ID NO: 25702 - DNA, 29 bp, Artificial Sequence
  Description of Artificial Sequence: Synthetic oligonucleotide
acgtggactacacgcagttcgtgaggttc

SEQ ID NO: 25703 - DNA, 28 bp, Artificial Sequence
  Description of Artificial Sequence: Synthetic oligonucleotide
cgtggactacacgcagttcgtgaggttc

SEQ ID NO: 25704 - DNA, 28 bp, Artificial Sequence
  Description of Artificial Sequence: Synthetic oligonucleotide
gtggactacacgcagttcgtgaggttcg

SEQ ID NO: 25705 - DNA, 29 bp, Artificial Sequence
  Description of Artificial Sequence: Synthetic oligonucleotide
tggactacacgcagttcgtgaggttcgac

SEQ ID NO: 25706 - DNA, 28 bp, Artificial Sequence
  Description of Artificial Sequence: Synthetic oligonucleotide
ggactacacgcagttcgtgaggttcgac

SEQ ID NO: 25707 - DNA, 29 bp, Artificial Sequence
  Description of Artificial Sequence: Synthetic oligonucleotide
gactacacgcagttcgtgaggttcgacag

SEQ ID NO: 25708 - DNA, 29 bp, Artificial Sequence
  Description of Artificial Sequence: Synthetic oligonucleotide
actacacgcagttcgtgaggttcgacagc

SEQ ID NO: 25709 - DNA, 28 bp, Artificial Sequence
  Description of Artificial Sequence: Synthetic oligonucleotide
ctacacgcagttcgtgaggttcgacagc

SEQ ID NO: 25710 - DNA, 28 bp, Artificial Sequence
  Description of Artificial Sequence: Synthetic oligonucleotide
tacacgcagttcgtgaggttcgacagcg

SEQ ID NO: 25711 - DNA, 28 bp, Artificial Sequence
  Description of Artificial Sequence: Synthetic oligonucleotide
atacctggagaacgggaaggacacgcag

SEQ ID NO: 25712 - DNA, 27 bp, Artificial Sequence
  Description of Artificial Sequence: Synthetic oligonucleotide
tacctggagaacgggaaggacacgcag

SEQ ID NO: 25713 - DNA, 26 bp, Artificial Sequence
  Description of Artificial Sequence: Synthetic oligonucleotide
acctggagaacgggaaggacacgcag

SEQ ID NO: 25714 - DNA, 25 bp, Artificial Sequence
  Description of Artificial Sequence: Synthetic oligonucleotide
cctggagaacgggaaggacacgcag

SEQ ID NO: 25715 - DNA, 26 bp, Artificial Sequence
  Description of Artificial Sequence: Synthetic oligonucleotide
ctggagaacgggaaggacacgcagga

SEQ ID NO: 25716 - DNA, 26 bp, Artificial Sequence
  Description of Artificial Sequence: Synthetic oligonucleotide
tggagaacgggaaggacacgcaggag

SEQ ID NO: 25717 - DNA, 25 bp, Artificial Sequence
  Description of Artificial Sequence: Synthetic oligonucleotide
ggagaacgggaaggacacgcaggag

SEQ ID NO: 25718 - DNA, 25 bp, Artificial Sequence
  Description of Artificial Sequence: Synthetic oligonucleotide
gagaacgggaaggacacgcaggagc

SEQ ID NO: 25719 - DNA, 25 bp, Artificial Sequence
  Description of Artificial Sequence: Synthetic oligonucleotide
agaacgggaaggacacgcaggagcg

SEQ ID NO: 25720 - DNA, 24 bp, Artificial Sequence
  Description of Artificial Sequence: Synthetic oligonucleotide
gaacgggaaggacacgcaggagcg

SEQ ID NO: 25721 - DNA, 24 bp, Artificial Sequence
  Description of Artificial Sequence: Synthetic oligonucleotide
aacgggaaggacacgcaggagcgc

SEQ ID NO: 25722 - DNA, 23 bp, Artificial Sequence
  Description of Artificial Sequence: Synthetic oligonucleotide
acgggaaggacacgcaggagcgc

SEQ ID NO: 25723 - DNA, 22 bp, Artificial Sequence
  Description of Artificial Sequence: Synthetic oligonucleotide
cgggaaggacacgcaggagcgc

SEQ ID NO: 25724 - DNA, 22 bp, Artificial Sequence
  Description of Artificial Sequence: Synthetic oligonucleotide
gggaaggacacgcaggagcgcg

SEQ ID NO: 25725 - DNA, 22 bp, Artificial Sequence
  Description of Artificial Sequence: Synthetic oligonucleotide
ggaaggacacgcaggagcgcgc

SEQ ID NO: 25726 - DNA, 22 bp, Artificial Sequence
  Description of Artificial Sequence: Synthetic oligonucleotide
gaaggacacgcaggagcgcgcg

SEQ ID NO: 25727 - DNA, 22 bp, Artificial Sequence
  Description of Artificial Sequence: Synthetic oligonucleotide
aaggacacgcaggagcgcgcgg

SEQ ID NO: 25728 - DNA, 21 bp, Artificial Sequence
  Description of Artificial Sequence: Synthetic oligonucleotide
gcggcccgtgtggtggagcag

SEQ ID NO: 25729 - DNA, 22 bp, Artificial Sequence
  Description of Artificial Sequence: Synthetic oligonucleotide
cggcccgtgtggtggagcagga

SEQ ID NO: 25730 - DNA, 23 bp, Artificial Sequence
  Description of Artificial Sequence: Synthetic oligonucleotide
ggcccgtgtggtggagcaggaca

SEQ ID NO: 25731 - DNA, 24 bp, Artificial Sequence
  Description of Artificial Sequence: Synthetic oligonucleotide
gcccgtgtggtggagcaggacaga

SEQ ID NO: 25732 - DNA, 24 bp, Artificial Sequence
  Description of Artificial Sequence: Synthetic oligonucleotide
cccgtgtggtggagcaggacagag

SEQ ID NO: 25733 - DNA, 24 bp, Artificial Sequence
  Description of Artificial Sequence: Synthetic oligonucleotide
ccgtgtggtggagcaggacagagc

SEQ ID NO: 25734 - DNA, 26 bp, Artificial Sequence
  Description of Artificial Sequence: Synthetic oligonucleotide
cgtgtggtggagcaggacagagccta

SEQ ID NO: 25735 - DNA, 26 bp, Artificial Sequence
  Description of Artificial Sequence: Synthetic oligonucleotide
gtgtggtggagcaggacagagcctac

SEQ ID NO: 25736 - DNA, 27 bp, Artificial Sequence
  Description of Artificial Sequence: Synthetic oligonucleotide
tgtggtggagcaggacagagcctacct

SEQ ID NO: 25737 - DNA, 26 bp, Artificial Sequence
  Description of Artificial Sequence: Synthetic oligonucleotide
gtggtggagcaggacagagcctacct

SEQ ID NO: 25738 - DNA, 26 bp, Artificial Sequence
  Description of Artificial Sequence: Synthetic oligonucleotide
tggtggagcaggacagagcctacctg

SEQ ID NO: 25739 - DNA, 25 bp, Artificial Sequence
  Description of Artificial Sequence: Synthetic oligonucleotide
ggtggagcaggacagagcctacctg

SEQ ID NO: 25740 - DNA, 26 bp, Artificial Sequence
  Description of Artificial Sequence: Synthetic oligonucleotide
gtggagcaggacagagcctacctgga

SEQ ID NO: 25741 - DNA, 26 bp, Artificial Sequence
  Description of Artificial Sequence: Synthetic oligonucleotide
tggagcaggacagagcctacctggag

SEQ ID NO: 25742 - DNA, 20 bp, Artificial Sequence
  Description of Artificial Sequence: Synthetic oligonucleotide
accgccatgtcccggcccgc

SEQ ID NO: 25743 - DNA, 20 bp, Artificial Sequence
  Description of Artificial Sequence: Synthetic oligonucleotide
ccgccatgtcccggcccgct

SEQ ID NO: 25744 - DNA, 20 bp, Artificial Sequence
  Description of Artificial Sequence: Synthetic oligonucleotide
cgccatgtcccggcccgcct

SEQ ID NO: 25745 - DNA, 20 bp, Artificial Sequence
  Description of Artificial Sequence: Synthetic oligonucleotide
gccatgtcccggcccgccct

SEQ ID NO: 25746 - DNA, 20 bp, Artificial Sequence
  Description of Artificial Sequence: Synthetic oligonucleotide
ccatgtcccggcccgcccgt

SEQ ID NO: 25747 - DNA, 20 bp, Artificial Sequence
  Description of Artificial Sequence: Synthetic oligonucleotide
catgtcccggcccgcccgct

SEQ ID NO: 25748 - DNA, 20 bp, Artificial Sequence
  Description of Artificial Sequence: Synthetic oligonucleotide
atgtcccggcccgcccgcgt

SEQ ID NO: 25749 - DNA, 20 bp, Artificial Sequence
  Description of Artificial Sequence: Synthetic oligonucleotide
tgtcccggcccgcccgcgtt

SEQ ID NO: 25750 - DNA, 20 bp, Artificial Sequence
  Description of Artificial Sequence: Synthetic oligonucleotide
gtcccggcccgcccgcgttt

SEQ ID NO: 25751 - DNA, 20 bp, Artificial Sequence
  Description of Artificial Sequence: Synthetic oligonucleotide
tcccggcccgcccgcggttt

SEQ ID NO: 25752 - DNA, 20 bp, Artificial Sequence
  Description of Artificial Sequence: Synthetic oligonucleotide
cccggcccgcccgcggtttt

SEQ ID NO: 25753 - DNA, 20 bp, Artificial Sequence
  Description of Artificial Sequence: Synthetic oligonucleotide
ccggcccgcccgcgggtttt

SEQ ID NO: 25754 - DNA, 20 bp, Artificial Sequence
  Description of Artificial Sequence: Synthetic oligonucleotide
cggcccgcccgcggggattt

SEQ ID NO: 25755 - DNA, 20 bp, Artificial Sequence
  Description of Artificial Sequence: Synthetic oligonucleotide
ggcccgcccgcggggagttt

SEQ ID NO: 25756 - DNA, 20 bp, Artificial Sequence
  Description of Artificial Sequence: Synthetic oligonucleotide
gcccgcccgcggggagcttt

SEQ ID NO: 25757 - DNA, 20 bp, Artificial Sequence
  Description of Artificial Sequence: Synthetic oligonucleotide
cccgcccgcggggagccttt

SEQ ID NO: 25758 - DNA, 20 bp, Artificial Sequence
  Description of Artificial Sequence: Synthetic oligonucleotide
ccgcccgcggggagcccttt

SEQ ID NO: 25759 - DNA, 20 bp, Artificial Sequence
  Description of Artificial Sequence: Synthetic oligonucleotide
cgcccgcggggagccccttt

SEQ ID NO: 25760 - DNA, 20 bp, Artificial Sequence
  Description of Artificial Sequence: Synthetic oligonucleotide
gcccgcggggagccccgttt

SEQ ID NO: 25761 - DNA, 20 bp, Artificial Sequence
  Description of Artificial Sequence: Synthetic oligonucleotide
cccgcggggagccccgcttt

SEQ ID NO: 25762 - DNA, 29 bp, Artificial Sequence
  Description of Artificial Sequence: Synthetic oligonucleotide
gctcccactccttgaggtatttcgacacc

SEQ ID NO: 25763 - DNA, 29 bp, Artificial Sequence
  Description of Artificial Sequence: Synthetic oligonucleotide
ctcccactccttgaggtatttcgacaccg

SEQ ID NO: 25764 - DNA, 29 bp, Artificial Sequence
  Description of Artificial Sequence: Synthetic oligonucleotide
tcccactccttgaggtatttcgacaccgc

SEQ ID NO: 25765 - DNA, 28 bp, Artificial Sequence
  Description of Artificial Sequence: Synthetic oligonucleotide
cccactccttgaggtatttcgacaccgc

SEQ ID NO: 25766 - DNA, 28 bp, Artificial Sequence
  Description of Artificial Sequence: Synthetic oligonucleotide
ccactccttgaggtatttcgacaccgcc

SEQ ID NO: 25767 - DNA, 30 bp, Artificial Sequence
  Description of Artificial Sequence: Synthetic oligonucleotide
cactccttgaggtatttcgacaccgccatg

SEQ ID NO: 25768 - DNA, 31 bp, Artificial Sequence
  Description of Artificial Sequence: Synthetic oligonucleotide
actccttgaggtatttcgacaccgccatgtc

SEQ ID NO: 25769 - DNA, 30 bp, Artificial Sequence
  Description of Artificial Sequence: Synthetic oligonucleotide
ctccttgaggtatttcgacaccgccatgtc

SEQ ID NO: 25770 - DNA, 30 bp, Artificial Sequence
  Description of Artificial Sequence: Synthetic oligonucleotide
tccttgaggtatttcgacaccgccatgtcc

SEQ ID NO: 25771 - DNA, 29 bp, Artificial Sequence
  Description of Artificial Sequence: Synthetic oligonucleotide
ccttgaggtatttcgacaccgccatgtcc

SEQ ID NO: 25772 - DNA, 29 bp, Artificial Sequence
  Description of Artificial Sequence: Synthetic oligonucleotide
cttgaggtatttcgacaccgccatgtccc

SEQ ID NO: 25773 - DNA, 29 bp, Artificial Sequence
  Description of Artificial Sequence: Synthetic oligonucleotide
ttgaggtatttcgacaccgccatgtcccg

SEQ ID NO: 25774 - DNA, 23 bp, Artificial Sequence
  Description of Artificial Sequence: Synthetic oligonucleotide
gtggatagagcaggaggggccgg

SEQ ID NO: 25775 - DNA, 23 bp, Artificial Sequence
  Description of Artificial Sequence: Synthetic oligonucleotide
tggatagagcaggaggggccggg

SEQ ID NO: 25776 - DNA, 22 bp, Artificial Sequence
  Description of Artificial Sequence: Synthetic oligonucleotide
ggatagagcaggaggggccggg

SEQ ID NO: 25777 - DNA, 26 bp, Artificial Sequence
  Description of Artificial Sequence: Synthetic oligonucleotide
gatagagcaggaggggccggggtatt

SEQ ID NO: 25778 - DNA, 26 bp, Artificial Sequence
  Description of Artificial Sequence: Synthetic oligonucleotide
atagagcaggaggggccggggtattg

SEQ ID NO: 25779 - DNA, 25 bp, Artificial Sequence
  Description of Artificial Sequence: Synthetic oligonucleotide
tagagcaggaggggccggggtattg

SEQ ID NO: 25780 - DNA, 24 bp, Artificial Sequence
  Description of Artificial Sequence: Synthetic oligonucleotide
agagcaggaggggccggggtattg

SEQ ID NO: 25781 - DNA, 23 bp, Artificial Sequence
  Description of Artificial Sequence: Synthetic oligonucleotide
gagcaggaggggccggggtattg

SEQ ID NO: 25782 - DNA, 23 bp, Artificial Sequence
  Description of Artificial Sequence: Synthetic oligonucleotide
agcaggaggggccggggtattgg

SEQ ID NO: 25783 - DNA, 22 bp, Artificial Sequence
  Description of Artificial Sequence: Synthetic oligonucleotide
gcaggaggggccggggtattgg

SEQ ID NO: 25784 - DNA, 23 bp, Artificial Sequence
  Description of Artificial Sequence: Synthetic oligonucleotide
caggaggggccggggtattggga

SEQ ID NO: 25785 - DNA, 23 bp, Artificial Sequence
  Description of Artificial Sequence: Synthetic oligonucleotide
aggaggggccggggtattgggac

SEQ ID NO: 25786 - DNA, 22 bp, Artificial Sequence
  Description of Artificial Sequence: Synthetic oligonucleotide
ggaggggccggggtattgggac

SEQ ID NO: 25787 - DNA, 22 bp, Artificial Sequence
  Description of Artificial Sequence: Synthetic oligonucleotide
gaggggccggggtattgggacc

SEQ ID NO: 25788 - DNA, 22 bp, Artificial Sequence
  Description of Artificial Sequence: Synthetic oligonucleotide
aggggccggggtattgggaccg

SEQ ID NO: 25789 - DNA, 21 bp, Artificial Sequence
  Description of Artificial Sequence: Synthetic oligonucleotide
ggggccggggtattgggaccg

SEQ ID NO: 25790 - DNA, 23 bp, Artificial Sequence
  Description of Artificial Sequence: Synthetic oligonucleotide
gggccggggtattgggaccggaa

SEQ ID NO: 25791 - DNA, 24 bp, Artificial Sequence
  Description of Artificial Sequence: Synthetic oligonucleotide
ggccggggtattgggaccggaaca

SEQ ID NO: 25792 - DNA, 25 bp, Artificial Sequence
  Description of Artificial Sequence: Synthetic oligonucleotide
gccggggtattgggaccggaacaca

SEQ ID NO: 25793 - DNA, 26 bp, Artificial Sequence
  Description of Artificial Sequence: Synthetic oligonucleotide
ccggggtattgggaccggaacacaca

SEQ ID NO: 25794 - DNA, 27 bp, Artificial Sequence
  Description of Artificial Sequence: Synthetic oligonucleotide
cggggtattgggaccggaacacacaga

SEQ ID NO: 25795 - DNA, 28 bp, Artificial Sequence
  Description of Artificial Sequence: Synthetic oligonucleotide
ggggtattgggaccggaacacacagatc

SEQ ID NO: 25796 - DNA, 30 bp, Artificial Sequence
  Description of Artificial Sequence: Synthetic oligonucleotide
gggtattgggaccggaacacacagatcttc

SEQ ID NO: 25797 - DNA, 32 bp, Artificial Sequence
  Description of Artificial Sequence: Synthetic oligonucleotide
ggtattgggaccggaacacacagatcttcaag

SEQ ID NO: 25798 - DNA, 27 bp, Artificial Sequence
  Description of Artificial Sequence: Synthetic oligonucleotide
acaccctccagagcatgtacggctgca

SEQ ID NO: 25799 - DNA, 27 bp, Artificial Sequence
  Description of Artificial Sequence: Synthetic oligonucleotide
caccctccagagcatgtacggctgcaa

SEQ ID NO: 25800 - DNA, 27 bp, Artificial Sequence
  Description of Artificial Sequence: Synthetic oligonucleotide
accctccagagcatgtacggctgcaac

SEQ ID NO: 25801 - DNA, 26 bp, Artificial Sequence
  Description of Artificial Sequence: Synthetic oligonucleotide
ccctccagagcatgtacggctgcaac

SEQ ID NO: 25802 - DNA, 27 bp, Artificial Sequence
  Description of Artificial Sequence: Synthetic oligonucleotide
cctccagagcatgtacggctgcaacgt

SEQ ID NO: 25803 - DNA, 27 bp, Artificial Sequence
  Description of Artificial Sequence: Synthetic oligonucleotide
ctccagagcatgtacggctgcaacgtg

SEQ ID NO: 25804 - DNA, 27 bp, Artificial Sequence
  Description of Artificial Sequence: Synthetic oligonucleotide
tccagagcatgtacggctgcaacgtgg

SEQ ID NO: 25805 - DNA, 26 bp, Artificial Sequence
  Description of Artificial Sequence: Synthetic oligonucleotide
ccagagcatgtacggctgcaacgtgg

SEQ ID NO: 25806 - DNA, 26 bp, Artificial Sequence
  Description of Artificial Sequence: Synthetic oligonucleotide
cagagcatgtacggctgcaacgtggg

SEQ ID NO: 25807 - DNA, 26 bp, Artificial Sequence
  Description of Artificial Sequence: Synthetic oligonucleotide
agagcatgtacggctgcaacgtgggg

SEQ ID NO: 25808 - DNA, 25 bp, Artificial Sequence
  Description of Artificial Sequence: Synthetic oligonucleotide
gagcatgtacggctgcaacgtgggg

SEQ ID NO: 25809 - DNA, 25 bp, Artificial Sequence
  Description of Artificial Sequence: Synthetic oligonucleotide
agcatgtacggctgcaacgtggggc

SEQ ID NO: 25810 - DNA, 24 bp, Artificial Sequence
  Description of Artificial Sequence: Synthetic oligonucleotide
gcatgtacggctgcaacgtggggc

SEQ ID NO: 25811 - DNA, 24 bp, Artificial Sequence
  Description of Artificial Sequence: Synthetic oligonucleotide
catgtacggctgcaacgtggggcc

SEQ ID NO: 25812 - DNA, 24 bp, Artificial Sequence
  Description of Artificial Sequence: Synthetic oligonucleotide
atgtacggctgcaacgtggggccg

SEQ ID NO: 25813 - DNA, 23 bp, Artificial Sequence
  Description of Artificial Sequence: Synthetic oligonucleotide
tgtacggctgcaacgtggggccg

SEQ ID NO: 25814 - DNA, 22 bp, Artificial Sequence
  Description of Artificial Sequence: Synthetic oligonucleotide
gtacggctgcaacgtggggccg

SEQ ID NO: 25815 - DNA, 23 bp, Artificial Sequence
  Description of Artificial Sequence: Synthetic oligonucleotide
tacggctgcaacgtggggccgga

SEQ ID NO: 25816 - DNA, 22 bp, Artificial Sequence
  Description of Artificial Sequence: Synthetic oligonucleotide
acggctgcaacgtggggccgga

SEQ ID NO: 25817 - DNA, 21 bp, Artificial Sequence
  Description of Artificial Sequence: Synthetic oligonucleotide
cggctgcaacgtggggccgga

SEQ ID NO: 25818 - DNA, 21 bp, Artificial Sequence
  Description of Artificial Sequence: Synthetic oligonucleotide
ggctgcaacgtggggccggac

SEQ ID NO: 25819 - DNA, 21 bp, Artificial Sequence
  Description of Artificial Sequence: Synthetic oligonucleotide
gctgcaacgtggggccggacg

SEQ ID NO: 25820 - DNA, 21 bp, Artificial Sequence
  Description of Artificial Sequence: Synthetic oligonucleotide
ctgcaacgtggggccggacgg

SEQ ID NO: 25821 - DNA, 21 bp, Artificial Sequence
  Description of Artificial Sequence: Synthetic oligonucleotide
tgcaacgtggggccggacggg

SEQ ID NO: 25822 - DNA, 20 bp, Artificial Sequence
  Description of Artificial Sequence: Synthetic oligonucleotide
gcaacgtggggccggacggg

SEQ ID NO: 25823 - DNA, 20 bp, Artificial Sequence
  Description of Artificial Sequence: Synthetic oligonucleotide
caacgtggggccggacgggc

SEQ ID NO: 25824 - DNA, 20 bp, Artificial Sequence
  Description of Artificial Sequence: Synthetic oligonucleotide
aacgtggggccggacgggcg

SEQ ID NO: 25825 - DNA, 25 bp, Artificial Sequence
  Description of Artificial Sequence: Synthetic oligonucleotide
agagcgaggccgggtctcacaccat

SEQ ID NO: 25826 - DNA, 24 bp, Artificial Sequence
  Description of Artificial Sequence: Synthetic oligonucleotide
gagcgaggccgggtctcacaccat

SEQ ID NO: 25827 - DNA, 24 bp, Artificial Sequence
  Description of Artificial Sequence: Synthetic oligonucleotide
agcgaggccgggtctcacaccatc

SEQ ID NO: 25828 - DNA, 23 bp, Artificial Sequence
  Description of Artificial Sequence: Synthetic oligonucleotide
gcgaggccgggtctcacaccatc

SEQ ID NO: 25829 - DNA, 24 bp, Artificial Sequence
  Description of Artificial Sequence: Synthetic oligonucleotide
cgaggccgggtctcacaccatcca

SEQ ID NO: 25830 - DNA, 25 bp, Artificial Sequence
  Description of Artificial Sequence: Synthetic oligonucleotide
gaggccgggtctcacaccatccaga

SEQ ID NO: 25831 - DNA, 25 bp, Artificial Sequence
  Description of Artificial Sequence: Synthetic oligonucleotide
aggccgggtctcacaccatccagag

SEQ ID NO: 25832 - DNA, 24 bp, Artificial Sequence
  Description of Artificial Sequence: Synthetic oligonucleotide
ggccgggtctcacaccatccagag

SEQ ID NO: 25833 - DNA, 26 bp, Artificial Sequence
  Description of Artificial Sequence: Synthetic oligonucleotide
gccgggtctcacaccatccagaggat

SEQ ID NO: 25834 - DNA, 27 bp, Artificial Sequence
  Description of Artificial Sequence: Synthetic oligonucleotide
ccgggtctcacaccatccagaggatgt

SEQ ID NO: 25835 - DNA, 27 bp, Artificial Sequence
  Description of Artificial Sequence: Synthetic oligonucleotide
cgggtctcacaccatccagaggatgtc

SEQ ID NO: 25836 - DNA, 28 bp, Artificial Sequence
  Description of Artificial Sequence: Synthetic oligonucleotide
gggtctcacaccatccagaggatgtctg

SEQ ID NO: 25837 - DNA, 28 bp, Artificial Sequence
  Description of Artificial Sequence: Synthetic oligonucleotide
ggtctcacaccatccagaggatgtctgg

SEQ ID NO: 25838 - DNA, 28 bp, Artificial Sequence
  Description of Artificial Sequence: Synthetic oligonucleotide
gtctcacaccatccagaggatgtctggc

SEQ ID NO: 25839 - DNA, 29 bp, Artificial Sequence
  Description of Artificial Sequence: Synthetic oligonucleotide
tctcacaccatccagaggatgtctggctg

SEQ ID NO: 25840 - DNA, 28 bp, Artificial Sequence
  Description of Artificial Sequence: Synthetic oligonucleotide
ctcacaccatccagaggatgtctggctg

SEQ ID NO: 25841 - DNA, 28 bp, Artificial Sequence
  Description of Artificial Sequence: Synthetic oligonucleotide
tcacaccatccagaggatgtctggctgc

SEQ ID NO: 25842 - DNA, 27 bp, Artificial Sequence
  Description of Artificial Sequence: Synthetic oligonucleotide
cacaccatccagaggatgtctggctgc

SEQ ID NO: 25843 - DNA, 27 bp, Artificial Sequence
  Description of Artificial Sequence: Synthetic oligonucleotide
acaccatccagaggatgtctggctgcg

SEQ ID NO: 25844 - DNA, 27 bp, Artificial Sequence
  Description of Artificial Sequence: Synthetic oligonucleotide
caccatccagaggatgtctggctgcga

SEQ ID NO: 25845 - DNA, 27 bp, Artificial Sequence
  Description of Artificial Sequence: Synthetic oligonucleotide
accatccagaggatgtctggctgcgac

SEQ ID NO: 25846 - DNA, 26 bp, Artificial Sequence
  Description of Artificial Sequence: Synthetic oligonucleotide
ccatccagaggatgtctggctgcgac

SEQ ID NO: 25847 - DNA, 27 bp, Artificial Sequence
  Description of Artificial Sequence: Synthetic oligonucleotide
catccagaggatgtctggctgcgacgt

SEQ ID NO: 25848 - DNA, 27 bp, Artificial Sequence
  Description of Artificial Sequence: Synthetic oligonucleotide
atccagaggatgtctggctgcgacgtg

SEQ ID NO: 25849 - DNA, 23 bp, Artificial Sequence
  Description of Artificial Sequence: Synthetic oligonucleotide
gtgaggttcgacagcgacgccgg

SEQ ID NO: 25850 - DNA, 24 bp, Artificial Sequence
  Description of Artificial Sequence: Synthetic oligonucleotide
tgaggttcgacagcgacgccggga

SEQ ID NO: 25851 - DNA, 23 bp, Artificial Sequence
  Description of Artificial Sequence: Synthetic oligonucleotide
gaggttcgacagcgacgccggga

SEQ ID NO: 25852 - DNA, 24 bp, Artificial Sequence
  Description of Artificial Sequence: Synthetic oligonucleotide
aggttcgacagcgacgccgggagt

SEQ ID NO: 25853 - DNA, 23 bp, Artificial Sequence
  Description of Artificial Sequence: Synthetic oligonucleotide
ggttcgacagcgacgccgggagt

SEQ ID NO: 25854 - DNA, 23 bp, Artificial Sequence
  Description of Artificial Sequence: Synthetic oligonucleotide
gttcgacagcgacgccgggagtc

SEQ ID NO: 25855 - DNA, 23 bp, Artificial Sequence
  Description of Artificial Sequence: Synthetic oligonucleotide
ttcgacagcgacgccgggagtcc

SEQ ID NO: 25856 - DNA, 22 bp, Artificial Sequence
  Description of Artificial Sequence: Synthetic oligonucleotide
tcgacagcgacgccgggagtcc

SEQ ID NO: 25857 - DNA, 21 bp, Artificial Sequence
  Description of Artificial Sequence: Synthetic oligonucleotide
cgacagcgacgccgggagtcc

SEQ ID NO: 25858 - DNA, 22 bp, Artificial Sequence
  Description of Artificial Sequence: Synthetic oligonucleotide
gacagcgacgccgggagtccga

SEQ ID NO: 25859 - DNA, 23 bp, Artificial Sequence
  Description of Artificial Sequence: Synthetic oligonucleotide
acagcgacgccgggagtccgaga

SEQ ID NO: 25860 - DNA, 22 bp, Artificial Sequence
  Description of Artificial Sequence: Synthetic oligonucleotide
cagcgacgccgggagtccgaga

SEQ ID NO: 25861 - DNA, 23 bp, Artificial Sequence
  Description of Artificial Sequence: Synthetic oligonucleotide
agcgacgccgggagtccgagaga

SEQ ID NO: 25862 - DNA, 22 bp, Artificial Sequence
  Description of Artificial Sequence: Synthetic oligonucleotide
gcgacgccgggagtccgagaga

SEQ ID NO: 25863 - DNA, 22 bp, Artificial Sequence
  Description of Artificial Sequence: Synthetic oligonucleotide
cgacgccgggagtccgagagag

SEQ ID NO: 25864 - DNA, 23 bp, Artificial Sequence
  Description of Artificial Sequence: Synthetic oligonucleotide
gacgccgggagtccgagagagga

SEQ ID NO: 25865 - DNA, 23 bp, Artificial Sequence
  Description of Artificial Sequence: Synthetic oligonucleotide
acgccgggagtccgagagaggag

SEQ ID NO: 25866 - DNA, 22 bp, Artificial Sequence
  Description of Artificial Sequence: Synthetic oligonucleotide
cgccgggagtccgagagaggag

SEQ ID NO: 25867 - DNA, 22 bp, Artificial Sequence
  Description of Artificial Sequence: Synthetic oligonucleotide
gccgggagtccgagagaggagc

SEQ ID NO: 25868 - DNA, 22 bp, Artificial Sequence
  Description of Artificial Sequence: Synthetic oligonucleotide
ccgggagtccgagagaggagcc

SEQ ID NO: 25869 - DNA, 22 bp, Artificial Sequence
  Description of Artificial Sequence: Synthetic oligonucleotide
cgggagtccgagagaggagccg

SEQ ID NO: 25870 - DNA, 22 bp, Artificial Sequence
  Description of Artificial Sequence: Synthetic oligonucleotide
gggagtccgagagaggagccgc

SEQ ID NO: 25871 - DNA, 22 bp, Artificial Sequence
  Description of Artificial Sequence: Synthetic oligonucleotide
ggagtccgagagaggagccgcg

SEQ ID NO: 25872 - DNA, 35 bp, Artificial Sequence
  Description of Artificial Sequence: Synthetic oligonucleotide
agacacagatctccaagaccaacacacagacttac

SEQ ID NO: 25873 - DNA, 34 bp, Artificial Sequence
  Description of Artificial Sequence: Synthetic oligonucleotide
gacacagatctccaagaccaacacacagacttac

SEQ ID NO: 25874 - DNA, 24 bp, Artificial Sequence
  Description of Artificial Sequence: Synthetic oligonucleotide
cccgtgtggcggagcagctgagaa

SEQ ID NO: 25875 - DNA, 24 bp, Artificial Sequence
  Description of Artificial Sequence: Synthetic oligonucleotide
ccgtgtggcggagcagctgagaac

SEQ ID NO: 25876 - DNA, 26 bp, Artificial Sequence
  Description of Artificial Sequence: Synthetic oligonucleotide
cgtgtggcggagcagctgagaaccta

SEQ ID NO: 25877 - DNA, 26 bp, Artificial Sequence
  Description of Artificial Sequence: Synthetic oligonucleotide
gtgtggcggagcagctgagaacctac

SEQ ID NO: 25878 - DNA, 27 bp, Artificial Sequence
  Description of Artificial Sequence: Synthetic oligonucleotide
tgtggcggagcagctgagaacctacct

SEQ ID NO: 25879 - DNA, 26 bp, Artificial Sequence
  Description of Artificial Sequence: Synthetic oligonucleotide
gtggcggagcagctgagaacctacct

SEQ ID NO: 25880 - DNA, 26 bp, Artificial Sequence
  Description of Artificial Sequence: Synthetic oligonucleotide
tggcggagcagctgagaacctacctg

SEQ ID NO: 25881 - DNA, 25 bp, Artificial Sequence
  Description of Artificial Sequence: Synthetic oligonucleotide
ggcggagcagctgagaacctacctg

SEQ ID NO: 25882 - DNA, 26 bp, Artificial Sequence
  Description of Artificial Sequence: Synthetic oligonucleotide
gcggagcagctgagaacctacctgga

SEQ ID NO: 25883 - DNA, 26 bp, Artificial Sequence
  Description of Artificial Sequence: Synthetic oligonucleotide
cggagcagctgagaacctacctggag

SEQ ID NO: 25884 - DNA, 26 bp, Artificial Sequence
  Description of Artificial Sequence: Synthetic oligonucleotide
ggagcagctgagaacctacctggagg

SEQ ID NO: 25885 - DNA, 26 bp, Artificial Sequence
  Description of Artificial Sequence: Synthetic oligonucleotide
gagcagctgagaacctacctggaggg

SEQ ID NO: 25886 - DNA, 27 bp, Artificial Sequence
  Description of Artificial Sequence: Synthetic oligonucleotide
agcagctgagaacctacctggagggca

SEQ ID NO: 25887 - DNA, 26 bp, Artificial Sequence
  Description of Artificial Sequence: Synthetic oligonucleotide
gcagctgagaacctacctggagggca

SEQ ID NO: 25888 - DNA, 26 bp, Artificial Sequence
  Description of Artificial Sequence: Synthetic oligonucleotide
cagctgagaacctacctggagggcac

SEQ ID NO: 25889 - DNA, 27 bp, Artificial Sequence
  Description of Artificial Sequence: Synthetic oligonucleotide
agctgagaacctacctggagggcacgt

SEQ ID NO: 25890 - DNA, 26 bp, Artificial Sequence
  Description of Artificial Sequence: Synthetic oligonucleotide
gctgagaacctacctggagggcacgt

SEQ ID NO: 25891 - DNA, 26 bp, Artificial Sequence
  Description of Artificial Sequence: Synthetic oligonucleotide
ctgagaacctacctggagggcacgtg

SEQ ID NO: 25892 - DNA, 26 bp, Artificial Sequence
  Description of Artificial Sequence: Synthetic oligonucleotide
tgagaacctacctggagggcacgtgc

SEQ ID NO: 25893 - DNA, 25 bp, Artificial Sequence
  Description of Artificial Sequence: Synthetic oligonucleotide
gagaacctacctggagggcacgtgc

SEQ ID NO: 25894 - DNA, 26 bp, Artificial Sequence
  Description of Artificial Sequence: Synthetic oligonucleotide
agaacctacctggagggcacgtgcgt

SEQ ID NO: 25895 - DNA, 25 bp, Artificial Sequence
  Description of Artificial Sequence: Synthetic oligonucleotide
gaacctacctggagggcacgtgcgt

SEQ ID NO: 25896 - DNA, 25 bp, Artificial Sequence
  Description of Artificial Sequence: Synthetic oligonucleotide
aacctacctggagggcacgtgcgtg

SEQ ID NO: 25897 - DNA, 24 bp, Artificial Sequence
  Description of Artificial Sequence: Synthetic oligonucleotide
acctacctggagggcacgtgcgtg

SEQ ID NO: 25898 - DNA, 30 bp, Artificial Sequence
  Description of Artificial Sequence: Synthetic oligonucleotide
cactccatgaggtatttcgacaccgccatc

SEQ ID NO: 25899 - DNA, 31 bp, Artificial Sequence
  Description of Artificial Sequence: Synthetic oligonucleotide
actccatgaggtatttcgacaccgccatctc

SEQ ID NO: 25900 - DNA, 30 bp, Artificial Sequence
  Description of Artificial Sequence: Synthetic oligonucleotide
ctccatgaggtatttcgacaccgccatctc

SEQ ID NO: 25901 - DNA, 30 bp, Artificial Sequence
  Description of Artificial Sequence: Synthetic oligonucleotide
tccatgaggtatttcgacaccgccatctcc

SEQ ID NO: 25902 - DNA, 29 bp, Artificial Sequence
  Description of Artificial Sequence: Synthetic oligonucleotide
ccatgaggtatttcgacaccgccatctcc

SEQ ID NO: 25903 - DNA, 29 bp, Artificial Sequence
  Description of Artificial Sequence: Synthetic oligonucleotide
catgaggtatttcgacaccgccatctccc

SEQ ID NO: 25904 - DNA, 29 bp, Artificial Sequence
  Description of Artificial Sequence: Synthetic oligonucleotide
atgaggtatttcgacaccgccatctcccg

SEQ ID NO: 25905 - DNA, 28 bp, Artificial Sequence
  Description of Artificial Sequence: Synthetic oligonucleotide
tgaggtatttcgacaccgccatctcccg

SEQ ID NO: 25906 - DNA, 27 bp, Artificial Sequence
  Description of Artificial Sequence: Synthetic oligonucleotide
gaggtatttcgacaccgccatctcccg

SEQ ID NO: 25907 - DNA, 27 bp, Artificial Sequence
  Description of Artificial Sequence: Synthetic oligonucleotide
aggtatttcgacaccgccatctcccgg

SEQ ID NO: 25908 - DNA, 26 bp, Artificial Sequence
  Description of Artificial Sequence: Synthetic oligonucleotide
ggtatttcgacaccgccatctcccgg

SEQ ID NO: 25909 - DNA, 26 bp, Artificial Sequence
  Description of Artificial Sequence: Synthetic oligonucleotide
gtatttcgacaccgccatctcccggc

SEQ ID NO: 25910 - DNA, 26 bp, Artificial Sequence
  Description of Artificial Sequence: Synthetic oligonucleotide
tatttcgacaccgccatctcccggcc

SEQ ID NO: 25911 - DNA, 25 bp, Artificial Sequence
  Description of Artificial Sequence: Synthetic oligonucleotide
atttcgacaccgccatctcccggcc

SEQ ID NO: 25912 - DNA, 24 bp, Artificial Sequence
  Description of Artificial Sequence: Synthetic oligonucleotide
tttcgacaccgccatctcccggcc

SEQ ID NO: 25913 - DNA, 23 bp, Artificial Sequence
  Description of Artificial Sequence: Synthetic oligonucleotide
ttcgacaccgccatctcccggcc

SEQ ID NO: 25914 - DNA, 22 bp, Artificial Sequence
  Description of Artificial Sequence: Synthetic oligonucleotide
tcgacaccgccatctcccggcc

SEQ ID NO: 25915 - DNA, 21 bp, Artificial Sequence
  Description of Artificial Sequence: Synthetic oligonucleotide
cgacaccgccatctcccggcc

SEQ ID NO: 25916 - DNA, 21 bp, Artificial Sequence
  Description of Artificial Sequence: Synthetic oligonucleotide
gacaccgccatctcccggccc

SEQ ID NO: 25917 - DNA, 21 bp, Artificial Sequence
  Description of Artificial Sequence: Synthetic oligonucleotide
acaccgccatctcccggcccg

SEQ ID NO: 25918 - DNA, 20 bp, Artificial Sequence
  Description of Artificial Sequence: Synthetic oligonucleotide
caccgccatctcccggcccg

SEQ ID NO: 25919 - DNA, 20 bp, Artificial Sequence
  Description of Artificial Sequence: Synthetic oligonucleotide
accgccatctcccggcccgg

SEQ ID NO: 25920 - DNA, 20 bp, Artificial Sequence
  Description of Artificial Sequence: Synthetic oligonucleotide
ccgccatctcccggcccggt

SEQ ID NO: 25921 - DNA, 20 bp, Artificial Sequence
  Description of Artificial Sequence: Synthetic oligonucleotide
cgccatctcccggcccggct

SEQ ID NO: 25922 - DNA, 20 bp, Artificial Sequence
  Description of Artificial Sequence: Synthetic oligonucleotide
gccatctcccggcccggcct

SEQ ID NO: 25923 - DNA, 20 bp, Artificial Sequence
  Description of Artificial Sequence: Synthetic oligonucleotide
ccatctcccggcccggccgt

SEQ ID NO: 25924 - DNA, 20 bp, Artificial Sequence
  Description of Artificial Sequence: Synthetic oligonucleotide
catctcccggcccggccgct

SEQ ID NO: 25925 - DNA, 20 bp, Artificial Sequence
  Description of Artificial Sequence: Synthetic oligonucleotide
atctcccggcccggccgcgt

SEQ ID NO: 25926 - DNA, 27 bp, Artificial Sequence
  Description of Artificial Sequence: Synthetic oligonucleotide
cctccagagcatgtacggctgcgacat

SEQ ID NO: 25927 - DNA, 27 bp, Artificial Sequence
  Description of Artificial Sequence: Synthetic oligonucleotide
ctccagagcatgtacggctgcgacatg

SEQ ID NO: 25928 - DNA, 27 bp, Artificial Sequence
  Description of Artificial Sequence: Synthetic oligonucleotide
tccagagcatgtacggctgcgacatgg

SEQ ID NO: 25929 - DNA, 26 bp, Artificial Sequence
  Description of Artificial Sequence: Synthetic oligonucleotide
ccagagcatgtacggctgcgacatgg

SEQ ID NO: 25930 - DNA, 26 bp, Artificial Sequence
  Description of Artificial Sequence: Synthetic oligonucleotide
cagagcatgtacggctgcgacatggg

SEQ ID NO: 25931 - DNA, 26 bp, Artificial Sequence
  Description of Artificial Sequence: Synthetic oligonucleotide
agagcatgtacggctgcgacatgggg

SEQ ID NO: 25932 - DNA, 25 bp, Artificial Sequence
  Description of Artificial Sequence: Synthetic oligonucleotide
gagcatgtacggctgcgacatgggg

SEQ ID NO: 25933 - DNA, 25 bp, Artificial Sequence
  Description of Artificial Sequence: Synthetic oligonucleotide
agcatgtacggctgcgacatggggc

SEQ ID NO: 25934 - DNA, 24 bp, Artificial Sequence
  Description of Artificial Sequence: Synthetic oligonucleotide
gcatgtacggctgcgacatggggc

SEQ ID NO: 25935 - DNA, 24 bp, Artificial Sequence
  Description of Artificial Sequence: Synthetic oligonucleotide
catgtacggctgcgacatggggcc

SEQ ID NO: 25936 - DNA, 24 bp, Artificial Sequence
  Description of Artificial Sequence: Synthetic oligonucleotide
atgtacggctgcgacatggggccg

SEQ ID NO: 25937 - DNA, 23 bp, Artificial Sequence
  Description of Artificial Sequence: Synthetic oligonucleotide
tgtacggctgcgacatggggccg

SEQ ID NO: 25938 - DNA, 22 bp, Artificial Sequence
  Description of Artificial Sequence: Synthetic oligonucleotide
gtacggctgcgacatggggccg

SEQ ID NO: 25939 - DNA, 23 bp, Artificial Sequence
  Description of Artificial Sequence: Synthetic oligonucleotide
tacggctgcgacatggggccgga

SEQ ID NO: 25940 - DNA, 22 bp, Artificial Sequence
  Description of Artificial Sequence: Synthetic oligonucleotide
acggctgcgacatggggccgga

SEQ ID NO: 25941 - DNA, 21 bp, Artificial Sequence
  Description of Artificial Sequence: Synthetic oligonucleotide
cggctgcgacatggggccgga

SEQ ID NO: 25942 - DNA, 21 bp, Artificial Sequence
  Description of Artificial Sequence: Synthetic oligonucleotide
ggctgcgacatggggccggac

SEQ ID NO: 25943 - DNA, 21 bp, Artificial Sequence
  Description of Artificial Sequence: Synthetic oligonucleotide
gctgcgacatggggccggacg

SEQ ID NO: 25944 - DNA, 21 bp, Artificial Sequence
  Description of Artificial Sequence: Synthetic oligonucleotide
ctgcgacatggggccggacgg

SEQ ID NO: 25945 - DNA, 21 bp, Artificial Sequence
  Description of Artificial Sequence: Synthetic oligonucleotide
tgcgacatggggccggacggg

SEQ ID NO: 25946 - DNA, 20 bp, Artificial Sequence
  Description of Artificial Sequence: Synthetic oligonucleotide
gcgacatggggccggacggg

SEQ ID NO: 25947 - DNA, 20 bp, Artificial Sequence
  Description of Artificial Sequence: Synthetic oligonucleotide
cgacatggggccggacgggc

SEQ ID NO: 25948 - DNA, 20 bp, Artificial Sequence
  Description of Artificial Sequence: Synthetic oligonucleotide
gacatggggccggacgggcg

SEQ ID NO: 25949 - DNA, 20 bp, Artificial Sequence
  Description of Artificial Sequence: Synthetic oligonucleotide
acatggggccggacgggcgc

SEQ ID NO: 25950 - DNA, 20 bp, Artificial Sequence
  Description of Artificial Sequence: Synthetic oligonucleotide
catggggccggacgggcgct

SEQ ID NO: 25951 - DNA, 20 bp, Artificial Sequence
  Description of Artificial Sequence: Synthetic oligonucleotide
atggggccggacgggcgcct

SEQ ID NO: 25952 - DNA, 27 bp, Artificial Sequence
  Description of Artificial Sequence: Synthetic oligonucleotide
gtggacgacacgcagttcgtgaggttg

SEQ ID NO: 25953 - DNA, 27 bp, Artificial Sequence
  Description of Artificial Sequence: Synthetic oligonucleotide
tggacgacacgcagttcgtgaggttgg

SEQ ID NO: 25954 - DNA, 27 bp, Artificial Sequence
  Description of Artificial Sequence: Synthetic oligonucleotide
ggacgacacgcagttcgtgaggttgga

SEQ ID NO: 25955 - DNA, 27 bp, Artificial Sequence
  Description of Artificial Sequence: Synthetic oligonucleotide
gacgacacgcagttcgtgaggttggac

SEQ ID NO: 25956 - DNA, 28 bp, Artificial Sequence
  Description of Artificial Sequence: Synthetic oligonucleotide
acgacacgcagttcgtgaggttggacag

SEQ ID NO: 25957 - DNA, 27 bp, Artificial Sequence
  Description of Artificial Sequence: Synthetic oligonucleotide
cgacacgcagttcgtgaggttggacag

SEQ ID NO: 25958 - DNA, 27 bp, Artificial Sequence
  Description of Artificial Sequence: Synthetic oligonucleotide
gacacgcagttcgtgaggttggacagc

SEQ ID NO: 25959 - DNA, 27 bp, Artificial Sequence
  Description of Artificial Sequence: Synthetic oligonucleotide
acacgcagttcgtgaggttggacagcg

SEQ ID NO: 25960 - DNA, 27 bp, Artificial Sequence
  Description of Artificial Sequence: Synthetic oligonucleotide
cacgcagttcgtgaggttggacagcga

SEQ ID NO: 25961 - DNA, 27 bp, Artificial Sequence
  Description of Artificial Sequence: Synthetic oligonucleotide
acgcagttcgtgaggttggacagcgac

SEQ ID NO: 25962 - DNA, 26 bp, Artificial Sequence
  Description of Artificial Sequence: Synthetic oligonucleotide
cgcagttcgtgaggttggacagcgac

SEQ ID NO: 25963 - DNA, 26 bp, Artificial Sequence
  Description of Artificial Sequence: Synthetic oligonucleotide
gcagttcgtgaggttggacagcgacg

SEQ ID NO: 25964 - DNA, 26 bp, Artificial Sequence
  Description of Artificial Sequence: Synthetic oligonucleotide
cagttcgtgaggttggacagcgacgc

SEQ ID NO: 25965 - DNA, 26 bp, Artificial Sequence
  Description of Artificial Sequence: Synthetic oligonucleotide
agttcgtgaggttggacagcgacgcc

SEQ ID NO: 25966 - DNA, 25 bp, Artificial Sequence
  Description of Artificial Sequence: Synthetic oligonucleotide
gttcgtgaggttggacagcgacgcc

SEQ ID NO: 25967 - DNA, 25 bp, Artificial Sequence
  Description of Artificial Sequence: Synthetic oligonucleotide
ttcgtgaggttggacagcgacgccg

SEQ ID NO: 25968 - DNA, 24 bp, Artificial Sequence
  Description of Artificial Sequence: Synthetic oligonucleotide
tcgtgaggttggacagcgacgccg

SEQ ID NO: 25969 - DNA, 23 bp, Artificial Sequence
  Description of Artificial Sequence: Synthetic oligonucleotide
cgtgaggttggacagcgacgccg

SEQ ID NO: 25970 - DNA, 23 bp, Artificial Sequence
  Description of Artificial Sequence: Synthetic oligonucleotide
gtgaggttggacagcgacgccgc

SEQ ID NO: 25971 - DNA, 24 bp, Artificial Sequence
  Description of Artificial Sequence: Synthetic oligonucleotide
tgaggttggacagcgacgccgcga

SEQ ID NO: 25972 - DNA, 23 bp, Artificial Sequence
  Description of Artificial Sequence: Synthetic oligonucleotide
gaggttggacagcgacgccgcga

SEQ ID NO: 25973 - DNA, 24 bp, Artificial Sequence
  Description of Artificial Sequence: Synthetic oligonucleotide
aggttggacagcgacgccgcgagt

SEQ ID NO: 25974 - DNA, 23 bp, Artificial Sequence
  Description of Artificial Sequence: Synthetic oligonucleotide
ggttggacagcgacgccgcgagt

SEQ ID NO: 25975 - DNA, 23 bp, Artificial Sequence
  Description of Artificial Sequence: Synthetic oligonucleotide
gttggacagcgacgccgcgagtc

SEQ ID NO: 25976 - DNA, 23 bp, Artificial Sequence
  Description of Artificial Sequence: Synthetic oligonucleotide
ttggacagcgacgccgcgagtcc

SEQ ID NO: 25977 - DNA, 22 bp, Artificial Sequence
  Description of Artificial Sequence: Synthetic oligonucleotide
tggacagcgacgccgcgagtcc

SEQ ID NO: 25978 - DNA, 21 bp, Artificial Sequence
  Description of Artificial Sequence: Synthetic oligonucleotide
ggacagcgacgccgcgagtcc

SEQ ID NO: 25979 - DNA, 27 bp, Artificial Sequence
  Description of Artificial Sequence: Synthetic oligonucleotide
aggccgggtctcacatcatccagagca

SEQ ID NO: 25980 - DNA, 27 bp, Artificial Sequence
  Description of Artificial Sequence: Synthetic oligonucleotide
ggccgggtctcacatcatccagagcat

SEQ ID NO: 25981 - DNA, 27 bp, Artificial Sequence
  Description of Artificial Sequence: Synthetic oligonucleotide
gccgggtctcacatcatccagagcatg

SEQ ID NO: 25982 - DNA, 29 bp, Artificial Sequence
  Description of Artificial Sequence: Synthetic oligonucleotide
ccgggtctcacatcatccagagcatgtac

SEQ ID NO: 25983 - DNA, 29 bp, Artificial Sequence
  Description of Artificial Sequence: Synthetic oligonucleotide
cgggtctcacatcatccagagcatgtacg

SEQ ID NO: 25984 - DNA, 29 bp, Artificial Sequence
  Description of Artificial Sequence: Synthetic oligonucleotide
gggtctcacatcatccagagcatgtacgg

SEQ ID NO: 25985 - DNA, 29 bp, Artificial Sequence
  Description of Artificial Sequence: Synthetic oligonucleotide
ggtctcacatcatccagagcatgtacggc

SEQ ID NO: 25986 - DNA, 30 bp, Artificial Sequence
  Description of Artificial Sequence: Synthetic oligonucleotide
gtctcacatcatccagagcatgtacggctg

SEQ ID NO: 25987 - DNA, 30 bp, Artificial Sequence
  Description of Artificial Sequence: Synthetic oligonucleotide
tctcacatcatccagagcatgtacggctgc

SEQ ID NO: 25988 - DNA, 29 bp, Artificial Sequence
  Description of Artificial Sequence: Synthetic oligonucleotide
ctcacatcatccagagcatgtacggctgc

SEQ ID NO: 25989 - DNA, 29 bp, Artificial Sequence
  Description of Artificial Sequence: Synthetic oligonucleotide
tcacatcatccagagcatgtacggctgcg

SEQ ID NO: 25990 - DNA, 28 bp, Artificial Sequence
  Description of Artificial Sequence: Synthetic oligonucleotide
cacatcatccagagcatgtacggctgcg

SEQ ID NO: 25991 - DNA, 29 bp, Artificial Sequence
  Description of Artificial Sequence: Synthetic oligonucleotide
acatcatccagagcatgtacggctgcgac

SEQ ID NO: 25992 - DNA, 28 bp, Artificial Sequence
  Description of Artificial Sequence: Synthetic oligonucleotide
catcatccagagcatgtacggctgcgac

SEQ ID NO: 25993 - DNA, 28 bp, Artificial Sequence
  Description of Artificial Sequence: Synthetic oligonucleotide
atcatccagagcatgtacggctgcgacg

SEQ ID NO: 25994 - DNA, 27 bp, Artificial Sequence
  Description of Artificial Sequence: Synthetic oligonucleotide
tcatccagagcatgtacggctgcgacg

SEQ ID NO: 25995 - DNA, 27 bp, Artificial Sequence
  Description of Artificial Sequence: Synthetic oligonucleotide
catccagagcatgtacggctgcgacgt

SEQ ID NO: 25996 - DNA, 27 bp, Artificial Sequence
  Description of Artificial Sequence: Synthetic oligonucleotide
atccagagcatgtacggctgcgacgtg

SEQ ID NO: 25997 - DNA, 21 bp, Artificial Sequence
  Description of Artificial Sequence: Synthetic oligonucleotide
gcggggagccccgcttcgtct

SEQ ID NO: 25998 - DNA, 22 bp, Artificial Sequence
  Description of Artificial Sequence: Synthetic oligonucleotide
cggggagccccgcttcgtctca

SEQ ID NO: 25999 - DNA, 23 bp, Artificial Sequence
  Description of Artificial Sequence: Synthetic oligonucleotide
ggggagccccgcttcgtctcagt

SEQ ID NO: 26000 - DNA, 23 bp, Artificial Sequence
  Description of Artificial Sequence: Synthetic oligonucleotide
gggagccccgcttcgtctcagtg

SEQ ID NO: 26001 - DNA, 23 bp, Artificial Sequence
  Description of Artificial Sequence: Synthetic oligonucleotide
ggagccccgcttcgtctcagtgg

SEQ ID NO: 26002 - DNA, 23 bp, Artificial Sequence
  Description of Artificial Sequence: Synthetic oligonucleotide
gagccccgcttcgtctcagtggg

SEQ ID NO: 26003 - DNA, 25 bp, Artificial Sequence
  Description of Artificial Sequence: Synthetic oligonucleotide
agccccgcttcgtctcagtgggcta

SEQ ID NO: 26004 - DNA, 24 bp, Artificial Sequence
  Description of Artificial Sequence: Synthetic oligonucleotide
gccccgcttcgtctcagtgggcta

SEQ ID NO: 26005 - DNA, 24 bp, Artificial Sequence
  Description of Artificial Sequence: Synthetic oligonucleotide
ccccgcttcgtctcagtgggctac

SEQ ID NO: 26006 - DNA, 25 bp, Artificial Sequence
  Description of Artificial Sequence: Synthetic oligonucleotide
cccgcttcgtctcagtgggctacgt

SEQ ID NO: 26007 - DNA, 25 bp, Artificial Sequence
  Description of Artificial Sequence: Synthetic oligonucleotide
ccgcttcgtctcagtgggctacgtg

SEQ ID NO: 26008 - DNA, 26 bp, Artificial Sequence
  Description of Artificial Sequence: Synthetic oligonucleotide
cgcttcgtctcagtgggctacgtgga

SEQ ID NO: 26009 - DNA, 26 bp, Artificial Sequence
  Description of Artificial Sequence: Synthetic oligonucleotide
gcttcgtctcagtgggctacgtggac

SEQ ID NO: 26010 - DNA, 27 bp, Artificial Sequence
  Description of Artificial Sequence: Synthetic oligonucleotide
cttcgtctcagtgggctacgtggacga

SEQ ID NO: 26011 - DNA, 27 bp, Artificial Sequence
  Description of Artificial Sequence: Synthetic oligonucleotide
ttcgtctcagtgggctacgtggacgac

SEQ ID NO: 26012 - DNA, 27 bp, Artificial Sequence
  Description of Artificial Sequence: Synthetic oligonucleotide
tcgtctcagtgggctacgtggacgaca

SEQ ID NO: 26013 - DNA, 26 bp, Artificial Sequence
  Description of Artificial Sequence: Synthetic oligonucleotide
cgtctcagtgggctacgtggacgaca

SEQ ID NO: 26014 - DNA, 26 bp, Artificial Sequence
  Description of Artificial Sequence: Synthetic oligonucleotide
gtctcagtgggctacgtggacgacac

SEQ ID NO: 26015 - DNA, 27 bp, Artificial Sequence
  Description of Artificial Sequence: Synthetic oligonucleotide
ccggctcccactccatgaggtatttcc

SEQ ID NO: 26016 - DNA, 28 bp, Artificial Sequence
  Description of Artificial Sequence: Synthetic oligonucleotide
cggctcccactccatgaggtatttccac

SEQ ID NO: 26017 - DNA, 29 bp, Artificial Sequence
  Description of Artificial Sequence: Synthetic oligonucleotide
ggctcccactccatgaggtatttccacac

SEQ ID NO: 26018 - DNA, 29 bp, Artificial Sequence
  Description of Artificial Sequence: Synthetic oligonucleotide
ctcccactccatgaggtatttccacaccg

SEQ ID NO: 26019 - DNA, 29 bp, Artificial Sequence
  Description of Artificial Sequence: Synthetic oligonucleotide
tcccactccatgaggtatttccacaccgc

SEQ ID NO: 26020 - DNA, 28 bp, Artificial Sequence
  Description of Artificial Sequence: Synthetic oligonucleotide
cccactccatgaggtatttccacaccgc

SEQ ID NO: 26021 - DNA, 28 bp, Artificial Sequence
  Description of Artificial Sequence: Synthetic oligonucleotide
ccactccatgaggtatttccacaccgcc

SEQ ID NO: 26022 - DNA, 30 bp, Artificial Sequence
  Description of Artificial Sequence: Synthetic oligonucleotide
cactccatgaggtatttccacaccgccatg

SEQ ID NO: 26023 - DNA, 31 bp, Artificial Sequence
  Description of Artificial Sequence: Synthetic oligonucleotide
actccatgaggtatttccacaccgccatgtc

SEQ ID NO: 26024 - DNA, 30 bp, Artificial Sequence
  Description of Artificial Sequence: Synthetic oligonucleotide
ctccatgaggtatttccacaccgccatgtc

SEQ ID NO: 26025 - DNA, 30 bp, Artificial Sequence
  Description of Artificial Sequence: Synthetic oligonucleotide
tccatgaggtatttccacaccgccatgtcc

SEQ ID NO: 26026 - DNA, 29 bp, Artificial Sequence
  Description of Artificial Sequence: Synthetic oligonucleotide
ccatgaggtatttccacaccgccatgtcc

SEQ ID NO: 26027 - DNA, 29 bp, Artificial Sequence
  Description of Artificial Sequence: Synthetic oligonucleotide
catgaggtatttccacaccgccatgtccc

SEQ ID NO: 26028 - DNA, 29 bp, Artificial Sequence
  Description of Artificial Sequence: Synthetic oligonucleotide
atgaggtatttccacaccgccatgtcccg

SEQ ID NO: 26029 - DNA, 28 bp, Artificial Sequence
  Description of Artificial Sequence: Synthetic oligonucleotide
tgaggtatttccacaccgccatgtcccg

SEQ ID NO: 26030 - DNA, 27 bp, Artificial Sequence
  Description of Artificial Sequence: Synthetic oligonucleotide
gaggtatttccacaccgccatgtcccg

SEQ ID NO: 26031 - DNA, 27 bp, Artificial Sequence
  Description of Artificial Sequence: Synthetic oligonucleotide
aggtatttccacaccgccatgtcccgg

SEQ ID NO: 26032 - DNA, 26 bp, Artificial Sequence
  Description of Artificial Sequence: Synthetic oligonucleotide
ggtatttccacaccgccatgtcccgg

SEQ ID NO: 26033 - DNA, 26 bp, Artificial Sequence
  Description of Artificial Sequence: Synthetic oligonucleotide
gtatttccacaccgccatgtcccggc

SEQ ID NO: 26034 - DNA, 26 bp, Artificial Sequence
  Description of Artificial Sequence: Synthetic oligonucleotide
tatttccacaccgccatgtcccggcc

SEQ ID NO: 26035 - DNA, 25 bp, Artificial Sequence
  Description of Artificial Sequence: Synthetic oligonucleotide
atttccacaccgccatgtcccggcc

SEQ ID NO: 26036 - DNA, 24 bp, Artificial Sequence
  Description of Artificial Sequence: Synthetic oligonucleotide
tttccacaccgccatgtcccggcc

SEQ ID NO: 26037 - DNA, 23 bp, Artificial Sequence
  Description of Artificial Sequence: Synthetic oligonucleotide
ttccacaccgccatgtcccggcc

SEQ ID NO: 26038 - DNA, 22 bp, Artificial Sequence
  Description of Artificial Sequence: Synthetic oligonucleotide
tccacaccgccatgtcccggcc

SEQ ID NO: 26039 - DNA, 21 bp, Artificial Sequence
  Description of Artificial Sequence: Synthetic oligonucleotide
ccacaccgccatgtcccggcc

SEQ ID NO: 26040 - DNA, 21 bp, Artificial Sequence
  Description of Artificial Sequence: Synthetic oligonucleotide
cacaccgccatgtcccggccc

SEQ ID NO: 26041 - DNA, 21 bp, Artificial Sequence
  Description of Artificial Sequence: Synthetic oligonucleotide
ggtcacggcgccccgaaccct

SEQ ID NO: 26042 - DNA, 21 bp, Artificial Sequence
  Description of Artificial Sequence: Synthetic oligonucleotide
gtcacggcgccccgaaccctc

SEQ ID NO: 26043 - DNA, 22 bp, Artificial Sequence
  Description of Artificial Sequence: Synthetic oligonucleotide
tcacggcgccccgaaccctcct

SEQ ID NO: 26044 - DNA, 21 bp, Artificial Sequence
  Description of Artificial Sequence: Synthetic oligonucleotide
cacggcgccccgaaccctcct

SEQ ID NO: 26045 - DNA, 21 bp, Artificial Sequence
  Description of Artificial Sequence: Synthetic oligonucleotide
acggcgccccgaaccctcctc

SEQ ID NO: 26046 - DNA, 20 bp, Artificial Sequence
  Description of Artificial Sequence: Synthetic oligonucleotide
cggcgccccgaaccctcctc

SEQ ID NO: 26047 - DNA, 22 bp, Artificial Sequence
  Description of Artificial Sequence: Synthetic oligonucleotide
cgccccgaaccctcctcctgct

SEQ ID NO: 26048 - DNA, 22 bp, Artificial Sequence
  Description of Artificial Sequence: Synthetic oligonucleotide
gccccgaaccctcctcctgctg

SEQ ID NO: 26049 - DNA, 23 bp, Artificial Sequence
  Description of Artificial Sequence: Synthetic oligonucleotide
ccccgaaccctcctcctgctgct

SEQ ID NO: 26050 - DNA, 24 bp, Artificial Sequence
  Description of Artificial Sequence: Synthetic oligonucleotide
cccgaaccctcctcctgctgctct

SEQ ID NO: 26051 - DNA, 24 bp, Artificial Sequence
  Description of Artificial Sequence: Synthetic oligonucleotide
ccgaaccctcctcctgctgctctg

SEQ ID NO: 26052 - DNA, 24 bp, Artificial Sequence
  Description of Artificial Sequence: Synthetic oligonucleotide
cgaaccctcctcctgctgctctgg

SEQ ID NO: 26053 - DNA, 24 bp, Artificial Sequence
  Description of Artificial Sequence: Synthetic oligonucleotide
gaaccctcctcctgctgctctggg

SEQ ID NO: 26054 - DNA, 24 bp, Artificial Sequence
  Description of Artificial Sequence: Synthetic oligonucleotide
aaccctcctcctgctgctctgggg

SEQ ID NO: 26055 - DNA, 23 bp, Artificial Sequence
  Description of Artificial Sequence: Synthetic oligonucleotide
accctcctcctgctgctctgggg

SEQ ID NO: 26056 - DNA, 22 bp, Artificial Sequence
  Description of Artificial Sequence: Synthetic oligonucleotide
ccctcctcctgctgctctgggg

SEQ ID NO: 26057 - DNA, 22 bp, Artificial Sequence
  Description of Artificial Sequence: Synthetic oligonucleotide
cctcctcctgctgctctggggg

SEQ ID NO: 26058 - DNA, 22 bp, Artificial Sequence
  Description of Artificial Sequence: Synthetic oligonucleotide
ctcctcctgctgctctgggggg

SEQ ID NO: 26059 - DNA, 24 bp, Artificial Sequence
  Description of Artificial Sequence: Synthetic oligonucleotide
accgtgggctacgtggacgacacc

SEQ ID NO: 26060 - DNA, 23 bp, Artificial Sequence
  Description of Artificial Sequence: Synthetic oligonucleotide
ccgtgggctacgtggacgacacc

SEQ ID NO: 26061 - DNA, 24 bp, Artificial Sequence
  Description of Artificial Sequence: Synthetic oligonucleotide
cgtgggctacgtggacgacaccca

SEQ ID NO: 26062 - DNA, 27 bp, Artificial Sequence
  Description of Artificial Sequence: Synthetic oligonucleotide
agttcgtgaggttcgacagcgacgcca

SEQ ID NO: 26063 - DNA, 26 bp, Artificial Sequence
  Description of Artificial Sequence: Synthetic oligonucleotide
gttcgtgaggttcgacagcgacgcca

SEQ ID NO: 26064 - DNA, 26 bp, Artificial Sequence
  Description of Artificial Sequence: Synthetic oligonucleotide
ttcgtgaggttcgacagcgacgccac

SEQ ID NO: 26065 - DNA, 25 bp, Artificial Sequence
  Description of Artificial Sequence: Synthetic oligonucleotide
tcgtgaggttcgacagcgacgccac

SEQ ID NO: 26066 - DNA, 24 bp, Artificial Sequence
  Description of Artificial Sequence: Synthetic oligonucleotide
cgtgaggttcgacagcgacgccac

SEQ ID NO: 26067 - DNA, 25 bp, Artificial Sequence
  Description of Artificial Sequence: Synthetic oligonucleotide
gtgaggttcgacagcgacgccacga

SEQ ID NO: 26068 - DNA, 26 bp, Artificial Sequence
  Description of Artificial Sequence: Synthetic oligonucleotide
tgaggttcgacagcgacgccacgagt

SEQ ID NO: 26069 - DNA, 25 bp, Artificial Sequence
  Description of Artificial Sequence: Synthetic oligonucleotide
gaggttcgacagcgacgccacgagt

SEQ ID NO: 26070 - DNA, 25 bp, Artificial Sequence
  Description of Artificial Sequence: Synthetic oligonucleotide
aggttcgacagcgacgccacgagtc

SEQ ID NO: 26071 - DNA, 24 bp, Artificial Sequence
  Description of Artificial Sequence: Synthetic oligonucleotide
ggttcgacagcgacgccacgagtc

SEQ ID NO: 26072 - DNA, 24 bp, Artificial Sequence
  Description of Artificial Sequence: Synthetic oligonucleotide
gttcgacagcgacgccacgagtcc

SEQ ID NO: 26073 - DNA, 25 bp, Artificial Sequence
  Description of Artificial Sequence: Synthetic oligonucleotide
ttcgacagcgacgccacgagtccga

SEQ ID NO: 26074 - DNA, 24 bp, Artificial Sequence
  Description of Artificial Sequence: Synthetic oligonucleotide
tcgacagcgacgccacgagtccga

SEQ ID NO: 26075 - DNA, 23 bp, Artificial Sequence
  Description of Artificial Sequence: Synthetic oligonucleotide
cgacagcgacgccacgagtccga

SEQ ID NO: 26076 - DNA, 23 bp, Artificial Sequence
  Description of Artificial Sequence: Synthetic oligonucleotide
gacagcgacgccacgagtccgag

SEQ ID NO: 26077 - DNA, 25 bp, Artificial Sequence
  Description of Artificial Sequence: Synthetic oligonucleotide
acagcgacgccacgagtccgaggat

SEQ ID NO: 26078 - DNA, 24 bp, Artificial Sequence
  Description of Artificial Sequence: Synthetic oligonucleotide
cagcgacgccacgagtccgaggat

SEQ ID NO: 26079 - DNA, 24 bp, Artificial Sequence
  Description of Artificial Sequence: Synthetic oligonucleotide
agcgacgccacgagtccgaggatg

SEQ ID NO: 26080 - DNA, 23 bp, Artificial Sequence
  Description of Artificial Sequence: Synthetic oligonucleotide
gcgacgccacgagtccgaggatg

SEQ ID NO: 26081 - DNA, 23 bp, Artificial Sequence
  Description of Artificial Sequence: Synthetic oligonucleotide
cgacgccacgagtccgaggatgg

SEQ ID NO: 26082 - DNA, 23 bp, Artificial Sequence
  Description of Artificial Sequence: Synthetic oligonucleotide
gacgccacgagtccgaggatggc

SEQ ID NO: 26083 - DNA, 23 bp, Artificial Sequence
  Description of Artificial Sequence: Synthetic oligonucleotide
acgccacgagtccgaggatggcg

SEQ ID NO: 26084 - DNA, 22 bp, Artificial Sequence
  Description of Artificial Sequence: Synthetic oligonucleotide
cgccacgagtccgaggatggcg

SEQ ID NO: 26085 - DNA, 22 bp, Artificial Sequence
  Description of Artificial Sequence: Synthetic oligonucleotide
gccacgagtccgaggatggcgc

SEQ ID NO: 26086 - DNA, 22 bp, Artificial Sequence
  Description of Artificial Sequence: Synthetic oligonucleotide
ccacgagtccgaggatggcgcc

SEQ ID NO: 26087 - DNA, 22 bp, Artificial Sequence
  Description of Artificial Sequence: Synthetic oligonucleotide
cacgagtccgaggatggcgccc

SEQ ID NO: 26088 - DNA, 22 bp, Artificial Sequence
  Description of Artificial Sequence: Synthetic oligonucleotide
acgagtccgaggatggcgcccc

SEQ ID NO: 26089 - DNA, 21 bp, Artificial Sequence
  Description of Artificial Sequence: Synthetic oligonucleotide
cgagtccgaggatggcgcccc

SEQ ID NO: 26090 - DNA, 21 bp, Artificial Sequence
  Description of Artificial Sequence: Synthetic oligonucleotide
gagtccgaggatggcgccccg

SEQ ID NO: 26091 - DNA, 21 bp, Artificial Sequence
  Description of Artificial Sequence: Synthetic oligonucleotide
agtccgaggatggcgccccgg

SEQ ID NO: 26092 - DNA, 20 bp, Artificial Sequence
  Description of Artificial Sequence: Synthetic oligonucleotide
gtccgaggatggcgccccgg

SEQ ID NO: 26093 - DNA, 20 bp, Artificial Sequence
  Description of Artificial Sequence: Synthetic oligonucleotide
tccgaggatggcgccccggg

SEQ ID NO: 26094 - DNA, 20 bp, Artificial Sequence
  Description of Artificial Sequence: Synthetic oligonucleotide
ccgaggatggcgccccgggt

SEQ ID NO: 26095 - DNA, 20 bp, Artificial Sequence
  Description of Artificial Sequence: Synthetic oligonucleotide
cgaggatggcgccccgggct

SEQ ID NO: 26096 - DNA, 20 bp, Artificial Sequence
  Description of Artificial Sequence: Synthetic oligonucleotide
gaggatggcgccccgggcgt

SEQ ID NO: 26097 - DNA, 20 bp, Artificial Sequence
  Description of Artificial Sequence: Synthetic oligonucleotide
aggatggcgccccgggcgct

SEQ ID NO: 26098 - DNA, 20 bp, Artificial Sequence
  Description of Artificial Sequence: Synthetic oligonucleotide
ggatggcgccccgggcgctt

SEQ ID NO: 26099 - DNA, 20 bp, Artificial Sequence
  Description of Artificial Sequence: Synthetic oligonucleotide
gatggcgccccgggcgccat

SEQ ID NO: 26100 - DNA, 20 bp, Artificial Sequence
  Description of Artificial Sequence: Synthetic oligonucleotide
atggcgccccgggcgccatg

SEQ ID NO: 26101 - DNA, 20 bp, Artificial Sequence
  Description of Artificial Sequence: Synthetic oligonucleotide
tggcgccccgggcgccatgt

SEQ ID NO: 26102 - DNA, 20 bp, Artificial Sequence
  Description of Artificial Sequence: Synthetic oligonucleotide
ggcgccccgggcgccatgtt

SEQ ID NO: 26103 - DNA, 21 bp, Artificial Sequence
  Description of Artificial Sequence: Synthetic oligonucleotide
gcgccccgggcgccatggata

SEQ ID NO: 26104 - DNA, 22 bp, Artificial Sequence
  Description of Artificial Sequence: Synthetic oligonucleotide
cgccccgggcgccatggataga

SEQ ID NO: 26105 - DNA, 33 bp, Artificial Sequence
  Description of Artificial Sequence: Synthetic oligonucleotide
tccaagaccaacacacagacttaccgagagaac

SEQ ID NO: 26106 - DNA, 32 bp, Artificial Sequence
  Description of Artificial Sequence: Synthetic oligonucleotide
ccaagaccaacacacagacttaccgagagaac

SEQ ID NO: 26107 - DNA, 30 bp, Artificial Sequence
  Description of Artificial Sequence: Synthetic oligonucleotide
aacacacagacttaccgagagaacctgcgc

SEQ ID NO: 26108 - DNA, 29 bp, Artificial Sequence
  Description of Artificial Sequence: Synthetic oligonucleotide
acacacagacttaccgagagaacctgcgc

SEQ ID NO: 26109 - DNA, 28 bp, Artificial Sequence
  Description of Artificial Sequence: Synthetic oligonucleotide
cacacagacttaccgagagaacctgcgc

SEQ ID NO: 26110 - DNA, 29 bp, Artificial Sequence
  Description of Artificial Sequence: Synthetic oligonucleotide
acacagacttaccgagagaacctgcgcac

SEQ ID NO: 26111 - DNA, 28 bp, Artificial Sequence
  Description of Artificial Sequence: Synthetic oligonucleotide
cacagacttaccgagagaacctgcgcac

SEQ ID NO: 26112 - DNA, 28 bp, Artificial Sequence
  Description of Artificial Sequence: Synthetic oligonucleotide
acagacttaccgagagaacctgcgcacc

SEQ ID NO: 26113 - DNA, 27 bp, Artificial Sequence
  Description of Artificial Sequence: Synthetic oligonucleotide
cagacttaccgagagaacctgcgcacc

SEQ ID NO: 26114 - DNA, 27 bp, Artificial Sequence
  Description of Artificial Sequence: Synthetic oligonucleotide
agacttaccgagagaacctgcgcaccg

SEQ ID NO: 26115 - DNA, 26 bp, Artificial Sequence
  Description of Artificial Sequence: Synthetic oligonucleotide
gacttaccgagagaacctgcgcaccg

SEQ ID NO: 26116 - DNA, 26 bp, Artificial Sequence
  Description of Artificial Sequence: Synthetic oligonucleotide
acttaccgagagaacctgcgcaccgc

SEQ ID NO: 26117 - DNA, 25 bp, Artificial Sequence
  Description of Artificial Sequence: Synthetic oligonucleotide
cttaccgagagaacctgcgcaccgc

SEQ ID NO: 26118 - DNA, 25 bp, Artificial Sequence
  Description of Artificial Sequence: Synthetic oligonucleotide
ttaccgagagaacctgcgcaccgcg

SEQ ID NO: 26119 - DNA, 24 bp, Artificial Sequence
  Description of Artificial Sequence: Synthetic oligonucleotide
taccgagagaacctgcgcaccgcg

SEQ ID NO: 26120 - DNA, 25 bp, Artificial Sequence
  Description of Artificial Sequence: Synthetic oligonucleotide
acaccgcggctcagatcacccagct

SEQ ID NO: 26121 - DNA, 24 bp, Artificial Sequence
  Description of Artificial Sequence: Synthetic oligonucleotide
caccgcggctcagatcacccagct

SEQ ID NO: 26122 - DNA, 26 bp, Artificial Sequence
  Description of Artificial Sequence: Synthetic oligonucleotide
accgcggctcagatcacccagctcaa

SEQ ID NO: 26123 - DNA, 25 bp, Artificial Sequence
  Description of Artificial Sequence: Synthetic oligonucleotide
ccgcggctcagatcacccagctcaa

SEQ ID NO: 26124 - DNA, 26 bp, Artificial Sequence
  Description of Artificial Sequence: Synthetic oligonucleotide
cgcggctcagatcacccagctcaagt

SEQ ID NO: 26125 - DNA, 26 bp, Artificial Sequence
  Description of Artificial Sequence: Synthetic oligonucleotide
gcggctcagatcacccagctcaagtg

SEQ ID NO: 26126 - DNA, 26 bp, Artificial Sequence
  Description of Artificial Sequence: Synthetic oligonucleotide
cggctcagatcacccagctcaagtgg

SEQ ID NO: 26127 - DNA, 27 bp, Artificial Sequence
  Description of Artificial Sequence: Synthetic oligonucleotide
ggctcagatcacccagctcaagtggga

SEQ ID NO: 26128 - DNA, 27 bp, Artificial Sequence
  Description of Artificial Sequence: Synthetic oligonucleotide
gctcagatcacccagctcaagtgggag

SEQ ID NO: 26129 - DNA, 27 bp, Artificial Sequence
  Description of Artificial Sequence: Synthetic oligonucleotide
ctcagatcacccagctcaagtgggagg

SEQ ID NO: 26130 - DNA, 27 bp, Artificial Sequence
  Description of Artificial Sequence: Synthetic oligonucleotide
tcagatcacccagctcaagtgggaggc

SEQ ID NO: 26131 - DNA, 26 bp, Artificial Sequence
  Description of Artificial Sequence: Synthetic oligonucleotide
cagatcacccagctcaagtgggaggc

SEQ ID NO: 26132 - DNA, 26 bp, Artificial Sequence
  Description of Artificial Sequence: Synthetic oligonucleotide
agatcacccagctcaagtgggaggcg

SEQ ID NO: 26133 - DNA, 25 bp, Artificial Sequence
  Description of Artificial Sequence: Synthetic oligonucleotide
gatcacccagctcaagtgggaggcg

SEQ ID NO: 26134 - DNA, 25 bp, Artificial Sequence
  Description of Artificial Sequence: Synthetic oligonucleotide
atcacccagctcaagtgggaggcgg

SEQ ID NO: 26135 - DNA, 24 bp, Artificial Sequence
  Description of Artificial Sequence: Synthetic oligonucleotide
tcacccagctcaagtgggaggcgg

SEQ ID NO: 26136 - DNA, 23 bp, Artificial Sequence
  Description of Artificial Sequence: Synthetic oligonucleotide
cacccagctcaagtgggaggcgg

SEQ ID NO: 26137 - DNA, 23 bp, Artificial Sequence
  Description of Artificial Sequence: Synthetic oligonucleotide
acccagctcaagtgggaggcggc

SEQ ID NO: 26138 - DNA, 22 bp, Artificial Sequence
  Description of Artificial Sequence: Synthetic oligonucleotide
cccagctcaagtgggaggcggc

SEQ ID NO: 26139 - DNA, 22 bp, Artificial Sequence
  Description of Artificial Sequence: Synthetic oligonucleotide
ccagctcaagtgggaggcggcc

SEQ ID NO: 26140 - DNA, 22 bp, Artificial Sequence
  Description of Artificial Sequence: Synthetic oligonucleotide
cagctcaagtgggaggcggccc

SEQ ID NO: 26141 - DNA, 23 bp, Artificial Sequence
  Description of Artificial Sequence: Synthetic oligonucleotide
agctcaagtgggaggcggcccgt

SEQ ID NO: 26142 - DNA, 22 bp, Artificial Sequence
  Description of Artificial Sequence: Synthetic oligonucleotide
gctcaagtgggaggcggcccgt

SEQ ID NO: 26143 - DNA, 23 bp, Artificial Sequence
  Description of Artificial Sequence: Synthetic oligonucleotide
ctcaagtgggaggcggcccgtgt

SEQ ID NO: 26144 - DNA, 23 bp, Artificial Sequence
  Description of Artificial Sequence: Synthetic oligonucleotide
tcaagtgggaggcggcccgtgtg

SEQ ID NO: 26145 - DNA, 26 bp, Artificial Sequence
  Description of Artificial Sequence: Synthetic oligonucleotide
gatgggagccatcttcccagtccacc

SEQ ID NO: 26146 - DNA, 27 bp, Artificial Sequence
  Description of Artificial Sequence: Synthetic oligonucleotide
atgggagccatcttcccagtccaccgt

SEQ ID NO: 26147 - DNA, 26 bp, Artificial Sequence
  Description of Artificial Sequence: Synthetic oligonucleotide
tgggagccatcttcccagtccaccgt

SEQ ID NO: 26148 - DNA, 25 bp, Artificial Sequence
  Description of Artificial Sequence: Synthetic oligonucleotide
gggagccatcttcccagtccaccgt

SEQ ID NO: 26149 - DNA, 25 bp, Artificial Sequence
  Description of Artificial Sequence: Synthetic oligonucleotide
ggagccatcttcccagtccaccgtc

SEQ ID NO: 26150 - DNA, 25 bp, Artificial Sequence
  Description of Artificial Sequence: Synthetic oligonucleotide
gagccatcttcccagtccaccgtcc

SEQ ID NO: 26151 - DNA, 25 bp, Artificial Sequence
  Description of Artificial Sequence: Synthetic oligonucleotide
agccatcttcccagtccaccgtccc

SEQ ID NO: 26152 - DNA, 24 bp, Artificial Sequence
  Description of Artificial Sequence: Synthetic oligonucleotide
gccatcttcccagtccaccgtccc

SEQ ID NO: 26153 - DNA, 26 bp, Artificial Sequence
  Description of Artificial Sequence: Synthetic oligonucleotide
ccatcttcccagtccaccgtccccat

SEQ ID NO: 26154 - DNA, 26 bp, Artificial Sequence
  Description of Artificial Sequence: Synthetic oligonucleotide
catcttcccagtccaccgtccccatc

SEQ ID NO: 26155 - DNA, 27 bp, Artificial Sequence
  Description of Artificial Sequence: Synthetic oligonucleotide
atcttcccagtccaccgtccccatcgt

SEQ ID NO: 26156 - DNA, 24 bp, Artificial Sequence
  Description of Artificial Sequence: Synthetic oligonucleotide
gaggacctgagctcctggaccgca

SEQ ID NO: 26157 - DNA, 24 bp, Artificial Sequence
  Description of Artificial Sequence: Synthetic oligonucleotide
aggacctgagctcctggaccgcag

SEQ ID NO: 26158 - DNA, 23 bp, Artificial Sequence
  Description of Artificial Sequence: Synthetic oligonucleotide
ggacctgagctcctggaccgcag

SEQ ID NO: 26159 - DNA, 23 bp, Artificial Sequence
  Description of Artificial Sequence: Synthetic oligonucleotide
gacctgagctcctggaccgcagc

SEQ ID NO: 26160 - DNA, 23 bp, Artificial Sequence
  Description of Artificial Sequence: Synthetic oligonucleotide
acctgagctcctggaccgcagcg

SEQ ID NO: 26161 - DNA, 22 bp, Artificial Sequence
  Description of Artificial Sequence: Synthetic oligonucleotide
cctgagctcctggaccgcagcg

SEQ ID NO: 26162 - DNA, 23 bp, Artificial Sequence
  Description of Artificial Sequence: Synthetic oligonucleotide
ctgagctcctggaccgcagcgga

SEQ ID NO: 26163 - DNA, 24 bp, Artificial Sequence
  Description of Artificial Sequence: Synthetic oligonucleotide
tgagctcctggaccgcagcggaca

SEQ ID NO: 26164 - DNA, 23 bp, Artificial Sequence
  Description of Artificial Sequence: Synthetic oligonucleotide
gagctcctggaccgcagcggaca

SEQ ID NO: 26165 - DNA, 23 bp, Artificial Sequence
  Description of Artificial Sequence: Synthetic oligonucleotide
agctcctggaccgcagcggacac

SEQ ID NO: 26166 - DNA, 22 bp, Artificial Sequence
  Description of Artificial Sequence: Synthetic oligonucleotide
gctcctggaccgcagcggacac

SEQ ID NO: 26167 - DNA, 22 bp, Artificial Sequence
  Description of Artificial Sequence: Synthetic oligonucleotide
ctcctggaccgcagcggacacc

SEQ ID NO: 26168 - DNA, 22 bp, Artificial Sequence
  Description of Artificial Sequence: Synthetic oligonucleotide
tcctggaccgcagcggacaccg

SEQ ID NO: 26169 - DNA, 21 bp, Artificial Sequence
  Description of Artificial Sequence: Synthetic oligonucleotide
cctggaccgcagcggacaccg

SEQ ID NO: 26170 - DNA, 21 bp, Artificial Sequence
  Description of Artificial Sequence: Synthetic oligonucleotide
ctggaccgcagcggacaccgc

SEQ ID NO: 26171 - DNA, 21 bp, Artificial Sequence
  Description of Artificial Sequence: Synthetic oligonucleotide
tggaccgcagcggacaccgcg

SEQ ID NO: 26172 - DNA, 20 bp, Artificial Sequence
  Description of Artificial Sequence: Synthetic oligonucleotide
ggaccgcagcggacaccgcg

SEQ ID NO: 26173 - DNA, 20 bp, Artificial Sequence
  Description of Artificial Sequence: Synthetic oligonucleotide
gaccgcagcggacaccgcgg

SEQ ID NO: 26174 - DNA, 21 bp, Artificial Sequence
  Description of Artificial Sequence: Synthetic oligonucleotide
accgcagcggacaccgcggct

SEQ ID NO: 26175 - DNA, 20 bp, Artificial Sequence
  Description of Artificial Sequence: Synthetic oligonucleotide
ccgcagcggacaccgcggct

SEQ ID NO: 26176 - DNA, 21 bp, Artificial Sequence
  Description of Artificial Sequence: Synthetic oligonucleotide
cgcagcggacaccgcggctca

SEQ ID NO: 26177 - DNA, 23 bp, Artificial Sequence
  Description of Artificial Sequence: Synthetic oligonucleotide
gcagcggacaccgcggctcagat

SEQ ID NO: 26178 - DNA, 24 bp, Artificial Sequence
  Description of Artificial Sequence: Synthetic oligonucleotide
cagcggacaccgcggctcagatca

SEQ ID NO: 26179 - DNA, 24 bp, Artificial Sequence
  Description of Artificial Sequence: Synthetic oligonucleotide
agcggacaccgcggctcagatcac

SEQ ID NO: 26180 - DNA, 21 bp, Artificial Sequence
  Description of Artificial Sequence: Synthetic oligonucleotide
gcgcctcctccgcgggcacaa

SEQ ID NO: 26181 - DNA, 21 bp, Artificial Sequence
  Description of Artificial Sequence: Synthetic oligonucleotide
cgcctcctccgcgggcacaac

SEQ ID NO: 26182 - DNA, 22 bp, Artificial Sequence
  Description of Artificial Sequence: Synthetic oligonucleotide
gcctcctccgcgggcacaacca

SEQ ID NO: 26183 - DNA, 25 bp, Artificial Sequence
  Description of Artificial Sequence: Synthetic oligonucleotide
cctcctccgcgggcacaaccagtta

SEQ ID NO: 26184 - DNA, 25 bp, Artificial Sequence
  Description of Artificial Sequence: Synthetic oligonucleotide
ctcctccgcgggcacaaccagttag

SEQ ID NO: 26185 - DNA, 25 bp, Artificial Sequence
  Description of Artificial Sequence: Synthetic oligonucleotide
tcctccgcgggcacaaccagttagc

SEQ ID NO: 26186 - DNA, 24 bp, Artificial Sequence
  Description of Artificial Sequence: Synthetic oligonucleotide
cctccgcgggcacaaccagttagc

SEQ ID NO: 26187 - DNA, 26 bp, Artificial Sequence
  Description of Artificial Sequence: Synthetic oligonucleotide
ctccgcgggcacaaccagttagccta

SEQ ID NO: 26188 - DNA, 26 bp, Artificial Sequence
  Description of Artificial Sequence: Synthetic oligonucleotide
tccgcgggcacaaccagttagcctac

SEQ ID NO: 26189 - DNA, 25 bp, Artificial Sequence
  Description of Artificial Sequence: Synthetic oligonucleotide
ccgcgggcacaaccagttagcctac

SEQ ID NO: 26190 - DNA, 26 bp, Artificial Sequence
  Description of Artificial Sequence: Synthetic oligonucleotide
cgcgggcacaaccagttagcctacga

SEQ ID NO: 26191 - DNA, 26 bp, Artificial Sequence
  Description of Artificial Sequence: Synthetic oligonucleotide
gcgggcacaaccagttagcctacgac

SEQ ID NO: 26192 - DNA, 26 bp, Artificial Sequence
  Description of Artificial Sequence: Synthetic oligonucleotide
cgggcacaaccagttagcctacgacg

SEQ ID NO: 26193 - DNA, 26 bp, Artificial Sequence
  Description of Artificial Sequence: Synthetic oligonucleotide
gggcacaaccagttagcctacgacgg

SEQ ID NO: 26194 - DNA, 27 bp, Artificial Sequence
  Description of Artificial Sequence: Synthetic oligonucleotide
ggcacaaccagttagcctacgacggca

SEQ ID NO: 26195 - DNA, 28 bp, Artificial Sequence
  Description of Artificial Sequence: Synthetic oligonucleotide
gcacaaccagttagcctacgacggcaag

SEQ ID NO: 26196 - DNA, 28 bp, Artificial Sequence
  Description of Artificial Sequence: Synthetic oligonucleotide
cacaaccagttagcctacgacggcaagg

SEQ ID NO: 26197 - DNA, 32 bp, Artificial Sequence
  Description of Artificial Sequence: Synthetic oligonucleotide
acaaccagttagcctacgacggcaaggattac

SEQ ID NO: 26198 - DNA, 31 bp, Artificial Sequence
  Description of Artificial Sequence: Synthetic oligonucleotide
caaccagttagcctacgacggcaaggattac

SEQ ID NO: 26199 - DNA, 27 bp, Artificial Sequence
  Description of Artificial Sequence: Synthetic oligonucleotide
agtgcgtggagtggctccgcagatact

SEQ ID NO: 26200 - DNA, 27 bp, Artificial Sequence
  Description of Artificial Sequence: Synthetic oligonucleotide
gtgcgtggagtggctccgcagatactt

SEQ ID NO: 26201 - DNA, 27 bp, Artificial Sequence
  Description of Artificial Sequence: Synthetic oligonucleotide
tgcgtggagtggctccgcagatacttg

SEQ ID NO: 26202 - DNA, 26 bp, Artificial Sequence
  Description of Artificial Sequence: Synthetic oligonucleotide
gcgtggagtggctccgcagatacttg

SEQ ID NO: 26203 - DNA, 27 bp, Artificial Sequence
  Description of Artificial Sequence: Synthetic oligonucleotide
cgtggagtggctccgcagatacttgga

SEQ ID NO: 26204 - DNA, 27 bp, Artificial Sequence
  Description of Artificial Sequence: Synthetic oligonucleotide
gtggagtggctccgcagatacttggag

SEQ ID NO: 26205 - DNA, 29 bp, Artificial Sequence
  Description of Artificial Sequence: Synthetic oligonucleotide
tggagtggctccgcagatacttggagaac

SEQ ID NO: 26206 - DNA, 28 bp, Artificial Sequence
  Description of Artificial Sequence: Synthetic oligonucleotide
ggagtggctccgcagatacttggagaac

SEQ ID NO: 26207 - DNA, 28 bp, Artificial Sequence
  Description of Artificial Sequence: Synthetic oligonucleotide
gagtggctccgcagatacttggagaacg

SEQ ID NO: 26208 - DNA, 28 bp, Artificial Sequence
  Description of Artificial Sequence: Synthetic oligonucleotide
agtggctccgcagatacttggagaacgg

SEQ ID NO: 26209 - DNA, 27 bp, Artificial Sequence
  Description of Artificial Sequence: Synthetic oligonucleotide
gtggctccgcagatacttggagaacgg

SEQ ID NO: 26210 - DNA, 27 bp, Artificial Sequence
  Description of Artificial Sequence: Synthetic oligonucleotide
tggctccgcagatacttggagaacggg

SEQ ID NO: 26211 - DNA, 28 bp, Artificial Sequence
  Description of Artificial Sequence: Synthetic oligonucleotide
agatgggagccatcttcccagtccactg

SEQ ID NO: 26212 - DNA, 27 bp, Artificial Sequence
  Description of Artificial Sequence: Synthetic oligonucleotide
gatgggagccatcttcccagtccactg

SEQ ID NO: 26213 - DNA, 28 bp, Artificial Sequence
  Description of Artificial Sequence: Synthetic oligonucleotide
atgggagccatcttcccagtccactgtc

SEQ ID NO: 26214 - DNA, 27 bp, Artificial Sequence
  Description of Artificial Sequence: Synthetic oligonucleotide
tgggagccatcttcccagtccactgtc

SEQ ID NO: 26215 - DNA, 26 bp, Artificial Sequence
  Description of Artificial Sequence: Synthetic oligonucleotide
gggagccatcttcccagtccactgtc

SEQ ID NO: 26216 - DNA, 26 bp, Artificial Sequence
  Description of Artificial Sequence: Synthetic oligonucleotide
ggagccatcttcccagtccactgtcc

SEQ ID NO: 26217 - DNA, 26 bp, Artificial Sequence
  Description of Artificial Sequence: Synthetic oligonucleotide
gagccatcttcccagtccactgtccc

SEQ ID NO: 26218 - DNA, 27 bp, Artificial Sequence
  Description of Artificial Sequence: Synthetic oligonucleotide
agccatcttcccagtccactgtcccca

SEQ ID NO: 26219 - DNA, 27 bp, Artificial Sequence
  Description of Artificial Sequence: Synthetic oligonucleotide
gccatcttcccagtccactgtccccat

SEQ ID NO: 26220 - DNA, 27 bp, Artificial Sequence
  Description of Artificial Sequence: Synthetic oligonucleotide
ccatcttcccagtccactgtccccatc

SEQ ID NO: 26221 - DNA, 27 bp, Artificial Sequence
  Description of Artificial Sequence: Synthetic oligonucleotide
catcttcccagtccactgtccccatcg

SEQ ID NO: 26222 - DNA, 28 bp, Artificial Sequence
  Description of Artificial Sequence: Synthetic oligonucleotide
atcttcccagtccactgtccccatcgtg

SEQ ID NO: 26223 - DNA, 27 bp, Artificial Sequence
  Description of Artificial Sequence: Synthetic oligonucleotide
tcttcccagtccactgtccccatcgtg

SEQ ID NO: 26224 - DNA, 26 bp, Artificial Sequence
  Description of Artificial Sequence: Synthetic oligonucleotide
cttcccagtccactgtccccatcgtg

SEQ ID NO: 26225 - DNA, 26 bp, Artificial Sequence
  Description of Artificial Sequence: Synthetic oligonucleotide
ttcccagtccactgtccccatcgtgg

SEQ ID NO: 26226 - DNA, 25 bp, Artificial Sequence
  Description of Artificial Sequence: Synthetic oligonucleotide
tcccagtccactgtccccatcgtgg

SEQ ID NO: 26227 - DNA, 24 bp, Artificial Sequence
  Description of Artificial Sequence: Synthetic oligonucleotide
cccagtccactgtccccatcgtgg

SEQ ID NO: 26228 - DNA, 24 bp, Artificial Sequence
  Description of Artificial Sequence: Synthetic oligonucleotide
ccagtccactgtccccatcgtggg

SEQ ID NO: 26229 - DNA, 27 bp, Artificial Sequence
  Description of Artificial Sequence: Synthetic oligonucleotide
cagtccactgtccccatcgtgggcatt

SEQ ID NO: 26230 - DNA, 27 bp, Artificial Sequence
  Description of Artificial Sequence: Synthetic oligonucleotide
agtccactgtccccatcgtgggcattg

SEQ ID NO: 26231 - DNA, 27 bp, Artificial Sequence
  Description of Artificial Sequence: Synthetic oligonucleotide
gtccactgtccccatcgtgggcattgt

SEQ ID NO: 26232 - DNA, 28 bp, Artificial Sequence
  Description of Artificial Sequence: Synthetic oligonucleotide
tccactgtccccatcgtgggcattgttg

SEQ ID NO: 26233 - DNA, 27 bp, Artificial Sequence
  Description of Artificial Sequence: Synthetic oligonucleotide
ccactgtccccatcgtgggcattgttg

SEQ ID NO: 26234 - DNA, 27 bp, Artificial Sequence
  Description of Artificial Sequence: Synthetic oligonucleotide
cactgtccccatcgtgggcattgttgc

SEQ ID NO: 26235 - DNA, 28 bp, Artificial Sequence
  Description of Artificial Sequence: Synthetic oligonucleotide
actgtccccatcgtgggcattgttgctg

SEQ ID NO: 26236 - DNA, 27 bp, Artificial Sequence
  Description of Artificial Sequence: Synthetic oligonucleotide
ctgtccccatcgtgggcattgttgctg

SEQ ID NO: 26237 - DNA, 27 bp, Artificial Sequence
  Description of Artificial Sequence: Synthetic oligonucleotide
tgtccccatcgtgggcattgttgctgg

SEQ ID NO: 26238 - DNA, 28 bp, Artificial Sequence
  Description of Artificial Sequence: Synthetic oligonucleotide
acccagttcgtgaggttcgacagcgatg

SEQ ID NO: 26239 - DNA, 27 bp, Artificial Sequence
  Description of Artificial Sequence: Synthetic oligonucleotide
cccagttcgtgaggttcgacagcgatg

SEQ ID NO: 26240 - DNA, 27 bp, Artificial Sequence
  Description of Artificial Sequence: Synthetic oligonucleotide
ccagttcgtgaggttcgacagcgatgc

SEQ ID NO: 26241 - DNA, 27 bp, Artificial Sequence
  Description of Artificial Sequence: Synthetic oligonucleotide
cagttcgtgaggttcgacagcgatgcc

SEQ ID NO: 26242 - DNA, 28 bp, Artificial Sequence
  Description of Artificial Sequence: Synthetic oligonucleotide
agttcgtgaggttcgacagcgatgccac

SEQ ID NO: 26243 - DNA, 27 bp, Artificial Sequence
  Description of Artificial Sequence: Synthetic oligonucleotide
gttcgtgaggttcgacagcgatgccac

SEQ ID NO: 26244 - DNA, 27 bp, Artificial Sequence
  Description of Artificial Sequence: Synthetic oligonucleotide
ttcgtgaggttcgacagcgatgccacg

SEQ ID NO: 26245 - DNA, 27 bp, Artificial Sequence
  Description of Artificial Sequence: Synthetic oligonucleotide
tcgtgaggttcgacagcgatgccacga

SEQ ID NO: 26246 - DNA, 26 bp, Artificial Sequence
  Description of Artificial Sequence: Synthetic oligonucleotide
cgtgaggttcgacagcgatgccacga

SEQ ID NO: 26247 - DNA, 27 bp, Artificial Sequence
  Description of Artificial Sequence: Synthetic oligonucleotide
gtgaggttcgacagcgatgccacgagt

SEQ ID NO: 26248 - DNA, 27 bp, Artificial Sequence
  Description of Artificial Sequence: Synthetic oligonucleotide
tgaggttcgacagcgatgccacgagtc

SEQ ID NO: 26249 - DNA, 26 bp, Artificial Sequence
  Description of Artificial Sequence: Synthetic oligonucleotide
gaggttcgacagcgatgccacgagtc

SEQ ID NO: 26250 - DNA, 26 bp, Artificial Sequence
  Description of Artificial Sequence: Synthetic oligonucleotide
aggttcgacagcgatgccacgagtcc

SEQ ID NO: 26251 - DNA, 25 bp, Artificial Sequence
  Description of Artificial Sequence: Synthetic oligonucleotide
ggttcgacagcgatgccacgagtcc

SEQ ID NO: 26252 - DNA, 26 bp, Artificial Sequence
  Description of Artificial Sequence: Synthetic oligonucleotide
gttcgacagcgatgccacgagtccga

SEQ ID NO: 26253 - DNA, 26 bp, Artificial Sequence
  Description of Artificial Sequence: Synthetic oligonucleotide
ttcgacagcgatgccacgagtccgag

SEQ ID NO: 26254 - DNA, 25 bp, Artificial Sequence
  Description of Artificial Sequence: Synthetic oligonucleotide
tcgacagcgatgccacgagtccgag

SEQ ID NO: 26255 - DNA, 24 bp, Artificial Sequence
  Description of Artificial Sequence: Synthetic oligonucleotide
cgacagcgatgccacgagtccgag

SEQ ID NO: 26256 - DNA, 26 bp, Artificial Sequence
  Description of Artificial Sequence: Synthetic oligonucleotide
gacagcgatgccacgagtccgaggat

SEQ ID NO: 26257 - DNA, 26 bp, Artificial Sequence
  Description of Artificial Sequence: Synthetic oligonucleotide
acagcgatgccacgagtccgaggatg

SEQ ID NO: 26258 - DNA, 25 bp, Artificial Sequence
  Description of Artificial Sequence: Synthetic oligonucleotide
cagcgatgccacgagtccgaggatg

SEQ ID NO: 26259 - DNA, 25 bp, Artificial Sequence
  Description of Artificial Sequence: Synthetic oligonucleotide
agcgatgccacgagtccgaggatgg

SEQ ID NO: 26260 - DNA, 24 bp, Artificial Sequence
  Description of Artificial Sequence: Synthetic oligonucleotide
gcgatgccacgagtccgaggatgg

SEQ ID NO: 26261 - DNA, 24 bp, Artificial Sequence
  Description of Artificial Sequence: Synthetic oligonucleotide
cgatgccacgagtccgaggatggc

SEQ ID NO: 26262 - DNA, 24 bp, Artificial Sequence
  Description of Artificial Sequence: Synthetic oligonucleotide
gatgccacgagtccgaggatggcg

SEQ ID NO: 26263 - DNA, 24 bp, Artificial Sequence
  Description of Artificial Sequence: Synthetic oligonucleotide
atgccacgagtccgaggatggcgc

SEQ ID NO: 26264 - DNA, 23 bp, Artificial Sequence
  Description of Artificial Sequence: Synthetic oligonucleotide
tgccacgagtccgaggatggcgc

SEQ ID NO: 26265 - DNA, 28 bp, Artificial Sequence
  Description of Artificial Sequence: Synthetic oligonucleotide
tatttctacaccgccatgtcccggcctg

SEQ ID NO: 26266 - DNA, 27 bp, Artificial Sequence
  Description of Artificial Sequence: Synthetic oligonucleotide
atttctacaccgccatgtcccggcctg

SEQ ID NO: 26267 - DNA, 26 bp, Artificial Sequence
  Description of Artificial Sequence: Synthetic oligonucleotide
tttctacaccgccatgtcccggcctg

SEQ ID NO: 26268 - DNA, 25 bp, Artificial Sequence
  Description of Artificial Sequence: Synthetic oligonucleotide
ttctacaccgccatgtcccggcctg

SEQ ID NO: 26269 - DNA, 24 bp, Artificial Sequence
  Description of Artificial Sequence: Synthetic oligonucleotide
tctacaccgccatgtcccggcctg

SEQ ID NO: 26270 - DNA, 23 bp, Artificial Sequence
  Description of Artificial Sequence: Synthetic oligonucleotide
ctacaccgccatgtcccggcctg

SEQ ID NO: 26271 - DNA, 23 bp, Artificial Sequence
  Description of Artificial Sequence: Synthetic oligonucleotide
tacaccgccatgtcccggcctgg

SEQ ID NO: 26272 - DNA, 22 bp, Artificial Sequence
  Description of Artificial Sequence: Synthetic oligonucleotide
acaccgccatgtcccggcctgg

SEQ ID NO: 26273 - DNA, 21 bp, Artificial Sequence
  Description of Artificial Sequence: Synthetic oligonucleotide
caccgccatgtcccggcctgg

SEQ ID NO: 26274 - DNA, 21 bp, Artificial Sequence
  Description of Artificial Sequence: Synthetic oligonucleotide
accgccatgtcccggcctggc

SEQ ID NO: 26275 - DNA, 20 bp, Artificial Sequence
  Description of Artificial Sequence: Synthetic oligonucleotide
ccgccatgtcccggcctggc

SEQ ID NO: 26276 - DNA, 20 bp, Artificial Sequence
  Description of Artificial Sequence: Synthetic oligonucleotide
cgccatgtcccggcctggcc

SEQ ID NO: 26277 - DNA, 20 bp, Artificial Sequence
  Description of Artificial Sequence: Synthetic oligonucleotide
gccatgtcccggcctggccg

SEQ ID NO: 26278 - DNA, 20 bp, Artificial Sequence
  Description of Artificial Sequence: Synthetic oligonucleotide
ccatgtcccggcctggccgc

SEQ ID NO: 26279 - DNA, 20 bp, Artificial Sequence
  Description of Artificial Sequence: Synthetic oligonucleotide
catgtcccggcctggccgcg

SEQ ID NO: 26280 - DNA, 20 bp, Artificial Sequence
  Description of Artificial Sequence: Synthetic oligonucleotide
atgtcccggcctggccgcgg

SEQ ID NO: 26281 - DNA, 20 bp, Artificial Sequence
  Description of Artificial Sequence: Synthetic oligonucleotide
cgaggatggcgccccgggca

SEQ ID NO: 26282 - DNA, 20 bp, Artificial Sequence
  Description of Artificial Sequence: Synthetic oligonucleotide
gaggatggcgccccgggcac

SEQ ID NO: 26283 - DNA, 22 bp, Artificial Sequence
  Description of Artificial Sequence: Synthetic oligonucleotide
aggatggcgccccgggcaccat

SEQ ID NO: 26284 - DNA, 21 bp, Artificial Sequence
  Description of Artificial Sequence: Synthetic oligonucleotide
ggatggcgccccgggcaccat

SEQ ID NO: 26285 - DNA, 21 bp, Artificial Sequence
  Description of Artificial Sequence: Synthetic oligonucleotide
gatggcgccccgggcaccatg

SEQ ID NO: 26286 - DNA, 24 bp, Artificial Sequence
  Description of Artificial Sequence: Synthetic oligonucleotide
atggcgccccgggcaccatggata

SEQ ID NO: 26287 - DNA, 23 bp, Artificial Sequence
  Description of Artificial Sequence: Synthetic oligonucleotide
tggcgccccgggcaccatggata

SEQ ID NO: 26288 - DNA, 22 bp, Artificial Sequence
  Description of Artificial Sequence: Synthetic oligonucleotide
ggcgccccgggcaccatggata

SEQ ID NO: 26289 - DNA, 23 bp, Artificial Sequence
  Description of Artificial Sequence: Synthetic oligonucleotide
gcgccccgggcaccatggataga

SEQ ID NO: 26290 - DNA, 23 bp, Artificial Sequence
  Description of Artificial Sequence: Synthetic oligonucleotide
cgccccgggcaccatggatagag

SEQ ID NO: 26291 - DNA, 24 bp, Artificial Sequence
  Description of Artificial Sequence: Synthetic oligonucleotide
gccccgggcaccatggatagagca

SEQ ID NO: 26292 - DNA, 24 bp, Artificial Sequence
  Description of Artificial Sequence: Synthetic oligonucleotide
ccccgggcaccatggatagagcag

SEQ ID NO: 26293 - DNA, 25 bp, Artificial Sequence
  Description of Artificial Sequence: Synthetic oligonucleotide
cccgggcaccatggatagagcagga

SEQ ID NO: 26294 - DNA, 25 bp, Artificial Sequence
  Description of Artificial Sequence: Synthetic oligonucleotide
ccgggcaccatggatagagcaggag

SEQ ID NO: 26295 - DNA, 25 bp, Artificial Sequence
  Description of Artificial Sequence: Synthetic oligonucleotide
cgggcaccatggatagagcaggagg

SEQ ID NO: 26296 - DNA, 25 bp, Artificial Sequence
  Description of Artificial Sequence: Synthetic oligonucleotide
gggcaccatggatagagcaggaggg

SEQ ID NO: 26297 - DNA, 25 bp, Artificial Sequence
  Description of Artificial Sequence: Synthetic oligonucleotide
ggcaccatggatagagcaggagggg

SEQ ID NO: 26298 - DNA, 25 bp, Artificial Sequence
  Description of Artificial Sequence: Synthetic oligonucleotide
gcaccatggatagagcaggaggggc

SEQ ID NO: 26299 - DNA, 25 bp, Artificial Sequence
  Description of Artificial Sequence: Synthetic oligonucleotide
caccatggatagagcaggaggggcc

SEQ ID NO: 26300 - DNA, 25 bp, Artificial Sequence
  Description of Artificial Sequence: Synthetic oligonucleotide
accatggatagagcaggaggggccg

SEQ ID NO: 26301 - DNA, 24 bp, Artificial Sequence
  Description of Artificial Sequence: Synthetic oligonucleotide
ggctgccgaagcccctcaccctaa

SEQ ID NO: 26302 - DNA, 26 bp, Artificial Sequence
  Description of Artificial Sequence: Synthetic oligonucleotide
gctgccgaagcccctcaccctaagat

SEQ ID NO: 26303 - DNA, 26 bp, Artificial Sequence
  Description of Artificial Sequence: Synthetic oligonucleotide
ctgccgaagcccctcaccctaagatg

SEQ ID NO: 26304 - DNA, 26 bp, Artificial Sequence
  Description of Artificial Sequence: Synthetic oligonucleotide
tgccgaagcccctcaccctaagatgg

SEQ ID NO: 26305 - DNA, 25 bp, Artificial Sequence
  Description of Artificial Sequence: Synthetic oligonucleotide
gccgaagcccctcaccctaagatgg

SEQ ID NO: 26306 - DNA, 25 bp, Artificial Sequence
  Description of Artificial Sequence: Synthetic oligonucleotide
ccgaagcccctcaccctaagatggg

SEQ ID NO: 26307 - DNA, 24 bp, Artificial Sequence
  Description of Artificial Sequence: Synthetic oligonucleotide
ccatggatagagcaggaggggccc

SEQ ID NO: 26308 - DNA, 25 bp, Artificial Sequence
  Description of Artificial Sequence: Synthetic oligonucleotide
catggatagagcaggaggggcccga

SEQ ID NO: 26309 - DNA, 27 bp, Artificial Sequence
  Description of Artificial Sequence: Synthetic oligonucleotide
atggatagagcaggaggggcccgagta

SEQ ID NO: 26310 - DNA, 24 bp, Artificial Sequence
  Description of Artificial Sequence: Synthetic oligonucleotide
aggaggggcccgagtattgggacc

SEQ ID NO: 26311 - DNA, 23 bp, Artificial Sequence
  Description of Artificial Sequence: Synthetic oligonucleotide
ggaggggcccgagtattgggacc

SEQ ID NO: 26312 - DNA, 23 bp, Artificial Sequence
  Description of Artificial Sequence: Synthetic oligonucleotide
gaggggcccgagtattgggaccg

SEQ ID NO: 26313 - DNA, 23 bp, Artificial Sequence
  Description of Artificial Sequence: Synthetic oligonucleotide
aggggcccgagtattgggaccgg

SEQ ID NO: 26314 - DNA, 22 bp, Artificial Sequence
  Description of Artificial Sequence: Synthetic oligonucleotide
ggggcccgagtattgggaccgg

SEQ ID NO: 26315 - DNA, 23 bp, Artificial Sequence
  Description of Artificial Sequence: Synthetic oligonucleotide
gggcccgagtattgggaccggga

SEQ ID NO: 26316 - DNA, 24 bp, Artificial Sequence
  Description of Artificial Sequence: Synthetic oligonucleotide
ggcccgagtattgggaccgggaga

SEQ ID NO: 26317 - DNA, 25 bp, Artificial Sequence
  Description of Artificial Sequence: Synthetic oligonucleotide
gcccgagtattgggaccgggagaca

SEQ ID NO: 26318 - DNA, 26 bp, Artificial Sequence
  Description of Artificial Sequence: Synthetic oligonucleotide
cccgagtattgggaccgggagacaca

SEQ ID NO: 26319 - DNA, 27 bp, Artificial Sequence
  Description of Artificial Sequence: Synthetic oligonucleotide
ccgagtattgggaccgggagacacaga

SEQ ID NO: 26320 - DNA, 28 bp, Artificial Sequence
  Description of Artificial Sequence: Synthetic oligonucleotide
cgagtattgggaccgggagacacagatc

SEQ ID NO: 26321 - DNA, 27 bp, Artificial Sequence
  Description of Artificial Sequence: Synthetic oligonucleotide
gtgggctacgtggacgacacccagttt

SEQ ID NO: 26322 - DNA, 27 bp, Artificial Sequence
  Description of Artificial Sequence: Synthetic oligonucleotide
tgggctacgtggacgacacccagtttg

SEQ ID NO: 26323 - DNA, 27 bp, Artificial Sequence
  Description of Artificial Sequence: Synthetic oligonucleotide
gggctacgtggacgacacccagtttgt

SEQ ID NO: 26324 - DNA, 27 bp, Artificial Sequence
  Description of Artificial Sequence: Synthetic oligonucleotide
ggctacgtggacgacacccagtttgtg

SEQ ID NO: 26325 - DNA, 28 bp, Artificial Sequence
  Description of Artificial Sequence: Synthetic oligonucleotide
gctacgtggacgacacccagtttgtgag

SEQ ID NO: 26326 - DNA, 28 bp, Artificial Sequence
  Description of Artificial Sequence: Synthetic oligonucleotide
ctacgtggacgacacccagtttgtgagg

SEQ ID NO: 26327 - DNA, 30 bp, Artificial Sequence
  Description of Artificial Sequence: Synthetic oligonucleotide
tacgtggacgacacccagtttgtgaggttc

SEQ ID NO: 26328 - DNA, 29 bp, Artificial Sequence
  Description of Artificial Sequence: Synthetic oligonucleotide
acgtggacgacacccagtttgtgaggttc

SEQ ID NO: 26329 - DNA, 28 bp, Artificial Sequence
  Description of Artificial Sequence: Synthetic oligonucleotide
cgtggacgacacccagtttgtgaggttc

SEQ ID NO: 26330 - DNA, 28 bp, Artificial Sequence
  Description of Artificial Sequence: Synthetic oligonucleotide
gtggacgacacccagtttgtgaggttcg

SEQ ID NO: 26331 - DNA, 29 bp, Artificial Sequence
  Description of Artificial Sequence: Synthetic oligonucleotide
tggacgacacccagtttgtgaggttcgac

SEQ ID NO: 26332 - DNA, 28 bp, Artificial Sequence
  Description of Artificial Sequence: Synthetic oligonucleotide
ggacgacacccagtttgtgaggttcgac

SEQ ID NO: 26333 - DNA, 29 bp, Artificial Sequence
  Description of Artificial Sequence: Synthetic oligonucleotide
gacgacacccagtttgtgaggttcgacag

SEQ ID NO: 26334 - DNA, 29 bp, Artificial Sequence
  Description of Artificial Sequence: Synthetic oligonucleotide
acgacacccagtttgtgaggttcgacagc

SEQ ID NO: 26335 - DNA, 28 bp, Artificial Sequence
  Description of Artificial Sequence: Synthetic oligonucleotide
cgacacccagtttgtgaggttcgacagc

SEQ ID NO: 26336 - DNA, 28 bp, Artificial Sequence
  Description of Artificial Sequence: Synthetic oligonucleotide
gacacccagtttgtgaggttcgacagcg

SEQ ID NO: 26337 - DNA, 29 bp, Artificial Sequence
  Description of Artificial Sequence: Synthetic oligonucleotide
acacccagtttgtgaggttcgacagcgac

SEQ ID NO: 26338 - DNA, 28 bp, Artificial Sequence
  Description of Artificial Sequence: Synthetic oligonucleotide
cacccagtttgtgaggttcgacagcgac

SEQ ID NO: 26339 - DNA, 28 bp, Artificial Sequence
  Description of Artificial Sequence: Synthetic oligonucleotide
acccagtttgtgaggttcgacagcgacg

SEQ ID NO: 26340 - DNA, 27 bp, Artificial Sequence
  Description of Artificial Sequence: Synthetic oligonucleotide
cccagtttgtgaggttcgacagcgacg

SEQ ID NO: 26341 - DNA, 27 bp, Artificial Sequence
  Description of Artificial Sequence: Synthetic oligonucleotide
ccagtttgtgaggttcgacagcgacgc

SEQ ID NO: 26342 - DNA, 27 bp, Artificial Sequence
  Description of Artificial Sequence: Synthetic oligonucleotide
cagtttgtgaggttcgacagcgacgcc

SEQ ID NO: 26343 - DNA, 28 bp, Artificial Sequence
  Description of Artificial Sequence: Synthetic oligonucleotide
agtttgtgaggttcgacagcgacgccac

SEQ ID NO: 26344 - DNA, 27 bp, Artificial Sequence
  Description of Artificial Sequence: Synthetic oligonucleotide
gtttgtgaggttcgacagcgacgccac

SEQ ID NO: 26345 - DNA, 27 bp, Artificial Sequence
  Description of Artificial Sequence: Synthetic oligonucleotide
tttgtgaggttcgacagcgacgccacg

SEQ ID NO: 26346 - DNA, 27 bp, Artificial Sequence
  Description of Artificial Sequence: Synthetic oligonucleotide
ttgtgaggttcgacagcgacgccacga

SEQ ID NO: 26347 - DNA, 26 bp, Artificial Sequence
  Description of Artificial Sequence: Synthetic oligonucleotide
tgtgaggttcgacagcgacgccacga

SEQ ID NO: 26348 - DNA, 27 bp, Artificial Sequence
  Description of Artificial Sequence: Synthetic oligonucleotide
tgccatgtacagcatgaggggctgcca

SEQ ID NO: 26349 - DNA, 27 bp, Artificial Sequence
  Description of Artificial Sequence: Synthetic oligonucleotide
gccatgtacagcatgaggggctgccaa

SEQ ID NO: 26350 - DNA, 28 bp, Artificial Sequence
  Description of Artificial Sequence: Synthetic oligonucleotide
ccatgtacagcatgaggggctgccaaag

SEQ ID NO: 26351 - DNA, 28 bp, Artificial Sequence
  Description of Artificial Sequence: Synthetic oligonucleotide
catgtacagcatgaggggctgccaaagc

SEQ ID NO: 26352 - DNA, 28 bp, Artificial Sequence
  Description of Artificial Sequence: Synthetic oligonucleotide
atgtacagcatgaggggctgccaaagcc

SEQ ID NO: 26353 - DNA, 27 bp, Artificial Sequence
  Description of Artificial Sequence: Synthetic oligonucleotide
tgtacagcatgaggggctgccaaagcc

SEQ ID NO: 26354 - DNA, 26 bp, Artificial Sequence
  Description of Artificial Sequence: Synthetic oligonucleotide
gtacagcatgaggggctgccaaagcc

SEQ ID NO: 26355 - DNA, 26 bp, Artificial Sequence
  Description of Artificial Sequence: Synthetic oligonucleotide
tacagcatgaggggctgccaaagccc

SEQ ID NO: 26356 - DNA, 25 bp, Artificial Sequence
  Description of Artificial Sequence: Synthetic oligonucleotide
acagcatgaggggctgccaaagccc

SEQ ID NO: 26357 - DNA, 24 bp, Artificial Sequence
  Description of Artificial Sequence: Synthetic oligonucleotide
cagcatgaggggctgccaaagccc

SEQ ID NO: 26358 - DNA, 25 bp, Artificial Sequence
  Description of Artificial Sequence: Synthetic oligonucleotide
agcatgaggggctgccaaagcccct

SEQ ID NO: 26359 - DNA, 24 bp, Artificial Sequence
  Description of Artificial Sequence: Synthetic oligonucleotide
gcatgaggggctgccaaagcccct

SEQ ID NO: 26360 - DNA, 25 bp, Artificial Sequence
  Description of Artificial Sequence: Synthetic oligonucleotide
catgaggggctgccaaagcccctca

SEQ ID NO: 26361 - DNA, 25 bp, Artificial Sequence
  Description of Artificial Sequence: Synthetic oligonucleotide
atgaggggctgccaaagcccctcac

SEQ ID NO: 26362 - DNA, 24 bp, Artificial Sequence
  Description of Artificial Sequence: Synthetic oligonucleotide
tgaggggctgccaaagcccctcac

SEQ ID NO: 26363 - DNA, 23 bp, Artificial Sequence
  Description of Artificial Sequence: Synthetic oligonucleotide
gaggggctgccaaagcccctcac

SEQ ID NO: 26364 - DNA, 23 bp, Artificial Sequence
  Description of Artificial Sequence: Synthetic oligonucleotide
aggggctgccaaagcccctcacc

SEQ ID NO: 26365 - DNA, 22 bp, Artificial Sequence
  Description of Artificial Sequence: Synthetic oligonucleotide
ggggctgccaaagcccctcacc

SEQ ID NO: 26366 - DNA, 23 bp, Artificial Sequence
  Description of Artificial Sequence: Synthetic oligonucleotide
gggctgccaaagcccctcaccct

SEQ ID NO: 26367 - DNA, 24 bp, Artificial Sequence
  Description of Artificial Sequence: Synthetic oligonucleotide
ggctgccaaagcccctcaccctga

SEQ ID NO: 26368 - DNA, 26 bp, Artificial Sequence
  Description of Artificial Sequence: Synthetic oligonucleotide
gctgccaaagcccctcaccctgagat

SEQ ID NO: 26369 - DNA, 26 bp, Artificial Sequence
  Description of Artificial Sequence: Synthetic oligonucleotide
ctgccaaagcccctcaccctgagatg

SEQ ID NO: 26370 - DNA, 26 bp, Artificial Sequence
  Description of Artificial Sequence: Synthetic oligonucleotide
tgccaaagcccctcaccctgagatgg

SEQ ID NO: 26371 - DNA, 25 bp, Artificial Sequence
  Description of Artificial Sequence: Synthetic oligonucleotide
gccaaagcccctcaccctgagatgg

SEQ ID NO: 26372 - DNA, 26 bp, Artificial Sequence
  Description of Artificial Sequence: Synthetic oligonucleotide
ccaaagcccctcaccctgagatggga

SEQ ID NO: 26373 - DNA, 26 bp, Artificial Sequence
  Description of Artificial Sequence: Synthetic oligonucleotide
caaagcccctcaccctgagatgggag

SEQ ID NO: 26374 - DNA, 26 bp, Artificial Sequence
  Description of Artificial Sequence: Synthetic oligonucleotide
aaagcccctcaccctgagatgggagc

SEQ ID NO: 26375 - DNA, 29 bp, Artificial Sequence
  Description of Artificial Sequence: Synthetic oligonucleotide
accctgagatgggagccatcttcccaatc

SEQ ID NO: 26376 - DNA, 28 bp, Artificial Sequence
  Description of Artificial Sequence: Synthetic oligonucleotide
ccctgagatgggagccatcttcccaatc

SEQ ID NO: 26377 - DNA, 28 bp, Artificial Sequence
  Description of Artificial Sequence: Synthetic oligonucleotide
cctgagatgggagccatcttcccaatcc

SEQ ID NO: 26378 - DNA, 29 bp, Artificial Sequence
  Description of Artificial Sequence: Synthetic oligonucleotide
ctgagatgggagccatcttcccaatccac

SEQ ID NO: 26379 - DNA, 29 bp, Artificial Sequence
  Description of Artificial Sequence: Synthetic oligonucleotide
tgagatgggagccatcttcccaatccacc

SEQ ID NO: 26380 - DNA, 28 bp, Artificial Sequence
  Description of Artificial Sequence: Synthetic oligonucleotide
gagatgggagccatcttcccaatccacc

SEQ ID NO: 26381 - DNA, 28 bp, Artificial Sequence
  Description of Artificial Sequence: Synthetic oligonucleotide
agatgggagccatcttcccaatccaccg

SEQ ID NO: 26382 - DNA, 27 bp, Artificial Sequence
  Description of Artificial Sequence: Synthetic oligonucleotide
gatgggagccatcttcccaatccaccg

SEQ ID NO: 26383 - DNA, 28 bp, Artificial Sequence
  Description of Artificial Sequence: Synthetic oligonucleotide
atgggagccatcttcccaatccaccgtc

SEQ ID NO: 26384 - DNA, 27 bp, Artificial Sequence
  Description of Artificial Sequence: Synthetic oligonucleotide
tgggagccatcttcccaatccaccgtc

SEQ ID NO: 26385 - DNA, 26 bp, Artificial Sequence
  Description of Artificial Sequence: Synthetic oligonucleotide
gggagccatcttcccaatccaccgtc

SEQ ID NO: 26386 - DNA, 26 bp, Artificial Sequence
  Description of Artificial Sequence: Synthetic oligonucleotide
ggagccatcttcccaatccaccgtcc

SEQ ID NO: 26387 - DNA, 26 bp, Artificial Sequence
  Description of Artificial Sequence: Synthetic oligonucleotide
gagccatcttcccaatccaccgtccc

SEQ ID NO: 26388 - DNA, 27 bp, Artificial Sequence
  Description of Artificial Sequence: Synthetic oligonucleotide
agccatcttcccaatccaccgtcccca

SEQ ID NO: 26389 - DNA, 27 bp, Artificial Sequence
  Description of Artificial Sequence: Synthetic oligonucleotide
gccatcttcccaatccaccgtccccat

SEQ ID NO: 26390 - DNA, 27 bp, Artificial Sequence
  Description of Artificial Sequence: Synthetic oligonucleotide
ccatcttcccaatccaccgtccccatc

SEQ ID NO: 26391 - DNA, 27 bp, Artificial Sequence
  Description of Artificial Sequence: Synthetic oligonucleotide
catcttcccaatccaccgtccccatcg

SEQ ID NO: 26392 - DNA, 28 bp, Artificial Sequence
  Description of Artificial Sequence: Synthetic oligonucleotide
atcttcccaatccaccgtccccatcgtg

SEQ ID NO: 26393 - DNA, 27 bp, Artificial Sequence
  Description of Artificial Sequence: Synthetic oligonucleotide
tcttcccaatccaccgtccccatcgtg

SEQ ID NO: 26394 - DNA, 26 bp, Artificial Sequence
  Description of Artificial Sequence: Synthetic oligonucleotide
cttcccaatccaccgtccccatcgtg

SEQ ID NO: 26395 - DNA, 26 bp, Artificial Sequence
  Description of Artificial Sequence: Synthetic oligonucleotide
ttcccaatccaccgtccccatcgtgg

SEQ ID NO: 26396 - DNA, 25 bp, Artificial Sequence
  Description of Artificial Sequence: Synthetic oligonucleotide
tcccaatccaccgtccccatcgtgg

SEQ ID NO: 26397 - DNA, 24 bp, Artificial Sequence
  Description of Artificial Sequence: Synthetic oligonucleotide
cccaatccaccgtccccatcgtgg

SEQ ID NO: 26398 - DNA, 24 bp, Artificial Sequence
  Description of Artificial Sequence: Synthetic oligonucleotide
ccaatccaccgtccccatcgtggg

SEQ ID NO: 26399 - DNA, 27 bp, Artificial Sequence
  Description of Artificial Sequence: Synthetic oligonucleotide
caatccaccgtccccatcgtgggcatt

SEQ ID NO: 26400 - DNA, 27 bp, Artificial Sequence
  Description of Artificial Sequence: Synthetic oligonucleotide
aatccaccgtccccatcgtgggcattg

SEQ ID NO: 26401 - DNA, 27 bp, Artificial Sequence
  Description of Artificial Sequence: Synthetic oligonucleotide
atccaccgtccccatcgtgggcattgt

SEQ ID NO: 26402 - DNA, 25 bp, Artificial Sequence
  Description of Artificial Sequence: Synthetic oligonucleotide
agcaggaggggccggagtattgggt

SEQ ID NO: 26403 - DNA, 24 bp, Artificial Sequence
  Description of Artificial Sequence: Synthetic oligonucleotide
gcaggaggggccggagtattgggt

SEQ ID NO: 26404 - DNA, 25 bp, Artificial Sequence
  Description of Artificial Sequence: Synthetic oligonucleotide
caggaggggccggagtattgggtct

SEQ ID NO: 26405 - DNA, 25 bp, Artificial Sequence
  Description of Artificial Sequence: Synthetic oligonucleotide
aggaggggccggagtattgggtctc

SEQ ID NO: 26406 - DNA, 24 bp, Artificial Sequence
  Description of Artificial Sequence: Synthetic oligonucleotide
ggaggggccggagtattgggtctc

SEQ ID NO: 26407 - DNA, 26 bp, Artificial Sequence
  Description of Artificial Sequence: Synthetic oligonucleotide
gaggggccggagtattgggtctccaa

SEQ ID NO: 26408 - DNA, 27 bp, Artificial Sequence
  Description of Artificial Sequence: Synthetic oligonucleotide
aggggccggagtattgggtctccaaga

SEQ ID NO: 26409 - DNA, 26 bp, Artificial Sequence
  Description of Artificial Sequence: Synthetic oligonucleotide
ggggccggagtattgggtctccaaga

SEQ ID NO: 26410 - DNA, 26 bp, Artificial Sequence
  Description of Artificial Sequence: Synthetic oligonucleotide
gggccggagtattgggtctccaagac

SEQ ID NO: 26411 - DNA, 27 bp, Artificial Sequence
  Description of Artificial Sequence: Synthetic oligonucleotide
ggccggagtattgggtctccaagacca

SEQ ID NO: 26412 - DNA, 28 bp, Artificial Sequence
  Description of Artificial Sequence: Synthetic oligonucleotide
gccggagtattgggtctccaagaccaac

SEQ ID NO: 26413 - DNA, 29 bp, Artificial Sequence
  Description of Artificial Sequence: Synthetic oligonucleotide
ccggagtattgggtctccaagaccaacac

SEQ ID NO: 26414 - DNA, 30 bp, Artificial Sequence
  Description of Artificial Sequence: Synthetic oligonucleotide
cggagtattgggtctccaagaccaacacac

SEQ ID NO: 26415 - DNA, 31 bp, Artificial Sequence
  Description of Artificial Sequence: Synthetic oligonucleotide
ggagtattgggtctccaagaccaacacacag

SEQ ID NO: 26416 - DNA, 32 bp, Artificial Sequence
  Description of Artificial Sequence: Synthetic oligonucleotide
gagtattgggtctccaagaccaacacacagac

SEQ ID NO: 26417 - DNA, 35 bp, Artificial Sequence
  Description of Artificial Sequence: Synthetic oligonucleotide
agtattgggtctccaagaccaacacacagacttac

SEQ ID NO: 26418 - DNA, 34 bp, Artificial Sequence
  Description of Artificial Sequence: Synthetic oligonucleotide
gtattgggtctccaagaccaacacacagacttac

SEQ ID NO: 26419 - DNA, 34 bp, Artificial Sequence
  Description of Artificial Sequence: Synthetic oligonucleotide
tattgggtctccaagaccaacacacagacttacc

SEQ ID NO: 26420 - DNA, 33 bp, Artificial Sequence
  Description of Artificial Sequence: Synthetic oligonucleotide
attgggtctccaagaccaacacacagacttacc

SEQ ID NO: 26421 - DNA, 32 bp, Artificial Sequence
  Description of Artificial Sequence: Synthetic oligonucleotide
ttgggtctccaagaccaacacacagacttacc

SEQ ID NO: 26422 - DNA, 31 bp, Artificial Sequence
  Description of Artificial Sequence: Synthetic oligonucleotide
tgggtctccaagaccaacacacagacttacc

SEQ ID NO: 26423 - DNA, 30 bp, Artificial Sequence
  Description of Artificial Sequence: Synthetic oligonucleotide
gggtctccaagaccaacacacagacttacc

SEQ ID NO: 26424 - DNA, 30 bp, Artificial Sequence
  Description of Artificial Sequence: Synthetic oligonucleotide
ggtctccaagaccaacacacagacttaccg

SEQ ID NO: 26425 - DNA, 31 bp, Artificial Sequence
  Description of Artificial Sequence: Synthetic oligonucleotide
gtctccaagaccaacacacagacttaccgag

SEQ ID NO: 26426 - DNA, 24 bp, Artificial Sequence
  Description of Artificial Sequence: Synthetic oligonucleotide
gtgtggcggagcagctgagagcct

SEQ ID NO: 26427 - DNA, 24 bp, Artificial Sequence
  Description of Artificial Sequence: Synthetic oligonucleotide
tgtggcggagcagctgagagcctg

SEQ ID NO: 26428 - DNA, 23 bp, Artificial Sequence
  Description of Artificial Sequence: Synthetic oligonucleotide
gtggcggagcagctgagagcctg

SEQ ID NO: 26429 - DNA, 23 bp, Artificial Sequence
  Description of Artificial Sequence: Synthetic oligonucleotide
tggcggagcagctgagagcctgc

SEQ ID NO: 26430 - DNA, 22 bp, Artificial Sequence
  Description of Artificial Sequence: Synthetic oligonucleotide
ggcggagcagctgagagcctgc

SEQ ID NO: 26431 - DNA, 23 bp, Artificial Sequence
  Description of Artificial Sequence: Synthetic oligonucleotide
gcggagcagctgagagcctgcct

SEQ ID NO: 26432 - DNA, 23 bp, Artificial Sequence
  Description of Artificial Sequence: Synthetic oligonucleotide
cggagcagctgagagcctgcctg

SEQ ID NO: 26433 - DNA, 24 bp, Artificial Sequence
  Description of Artificial Sequence: Synthetic oligonucleotide
ggagcagctgagagcctgcctgga

SEQ ID NO: 26434 - DNA, 24 bp, Artificial Sequence
  Description of Artificial Sequence: Synthetic oligonucleotide
gagcagctgagagcctgcctggag

SEQ ID NO: 26435 - DNA, 24 bp, Artificial Sequence
  Description of Artificial Sequence: Synthetic oligonucleotide
agcagctgagagcctgcctggagg

SEQ ID NO: 26436 - DNA, 23 bp, Artificial Sequence
  Description of Artificial Sequence: Synthetic oligonucleotide
gcagctgagagcctgcctggagg

SEQ ID NO: 26437 - DNA, 23 bp, Artificial Sequence
  Description of Artificial Sequence: Synthetic oligonucleotide
cagctgagagcctgcctggaggg

SEQ ID NO: 26438 - DNA, 23 bp, Artificial Sequence
  Description of Artificial Sequence: Synthetic oligonucleotide
agctgagagcctgcctggagggc

SEQ ID NO: 26439 - DNA, 22 bp, Artificial Sequence
  Description of Artificial Sequence: Synthetic oligonucleotide
gctgagagcctgcctggagggc

SEQ ID NO: 26440 - DNA, 23 bp, Artificial Sequence
  Description of Artificial Sequence: Synthetic oligonucleotide
ctgagagcctgcctggagggcga

SEQ ID NO: 26441 - DNA, 24 bp, Artificial Sequence
  Description of Artificial Sequence: Synthetic oligonucleotide
tgagagcctgcctggagggcgagt

SEQ ID NO: 26442 - DNA, 23 bp, Artificial Sequence
  Description of Artificial Sequence: Synthetic oligonucleotide
gagagcctgcctggagggcgagt

SEQ ID NO: 26443 - DNA, 23 bp, Artificial Sequence
  Description of Artificial Sequence: Synthetic oligonucleotide
agagcctgcctggagggcgagtg

SEQ ID NO: 26444 - DNA, 22 bp, Artificial Sequence
  Description of Artificial Sequence: Synthetic oligonucleotide
gagcctgcctggagggcgagtg

SEQ ID NO: 26445 - DNA, 22 bp, Artificial Sequence
  Description of Artificial Sequence: Synthetic oligonucleotide
agcctgcctggagggcgagtgc

SEQ ID NO: 26446 - DNA, 21 bp, Artificial Sequence
  Description of Artificial Sequence: Synthetic oligonucleotide
gcctgcctggagggcgagtgc

SEQ ID NO: 26447 - DNA, 22 bp, Artificial Sequence
  Description of Artificial Sequence: Synthetic oligonucleotide
cctgcctggagggcgagtgcgt

SEQ ID NO: 26448 - DNA, 22 bp, Artificial Sequence
  Description of Artificial Sequence: Synthetic oligonucleotide
ctgcctggagggcgagtgcgtg

SEQ ID NO: 26449 - DNA, 23 bp, Artificial Sequence
  Description of Artificial Sequence: Synthetic oligonucleotide
tgcctggagggcgagtgcgtgga

SEQ ID NO: 26450 - DNA, 22 bp, Artificial Sequence
  Description of Artificial Sequence: Synthetic oligonucleotide
gcctggagggcgagtgcgtgga

SEQ ID NO: 26451 - DNA, 26 bp, Artificial Sequence
  Description of Artificial Sequence: Synthetic oligonucleotide
ctccagaggatgtacggctgcgacct

SEQ ID NO: 26452 - DNA, 26 bp, Artificial Sequence
  Description of Artificial Sequence: Synthetic oligonucleotide
tccagaggatgtacggctgcgacctg

SEQ ID NO: 26453 - DNA, 25 bp, Artificial Sequence
  Description of Artificial Sequence: Synthetic oligonucleotide
ccagaggatgtacggctgcgacctg

SEQ ID NO: 26454 - DNA, 25 bp, Artificial Sequence
  Description of Artificial Sequence: Synthetic oligonucleotide
cagaggatgtacggctgcgacctgg

SEQ ID NO: 26455 - DNA, 25 bp, Artificial Sequence
  Description of Artificial Sequence: Synthetic oligonucleotide
agaggatgtacggctgcgacctggg

SEQ ID NO: 26456 - DNA, 24 bp, Artificial Sequence
  Description of Artificial Sequence: Synthetic oligonucleotide
gaggatgtacggctgcgacctggg

SEQ ID NO: 26457 - DNA, 24 bp, Artificial Sequence
  Description of Artificial Sequence: Synthetic oligonucleotide
aggatgtacggctgcgacctgggg

SEQ ID NO: 26458 - DNA, 23 bp, Artificial Sequence
  Description of Artificial Sequence: Synthetic oligonucleotide
ggatgtacggctgcgacctgggg

SEQ ID NO: 26459 - DNA, 23 bp, Artificial Sequence
  Description of Artificial Sequence: Synthetic oligonucleotide
gatgtacggctgcgacctggggc

SEQ ID NO: 26460 - DNA, 23 bp, Artificial Sequence
  Description of Artificial Sequence: Synthetic oligonucleotide
atgtacggctgcgacctggggcc

SEQ ID NO: 26461 - DNA, 22 bp, Artificial Sequence
  Description of Artificial Sequence: Synthetic oligonucleotide
tgtacggctgcgacctggggcc

SEQ ID NO: 26462 - DNA, 21 bp, Artificial Sequence
  Description of Artificial Sequence: Synthetic oligonucleotide
gtacggctgcgacctggggcc

SEQ ID NO: 26463 - DNA, 21 bp, Artificial Sequence
  Description of Artificial Sequence: Synthetic oligonucleotide
tacggctgcgacctggggccg

SEQ ID NO: 26464 - DNA, 20 bp, Artificial Sequence
  Description of Artificial Sequence: Synthetic oligonucleotide
acggctgcgacctggggccg

SEQ ID NO: 26465 - DNA, 20 bp, Artificial Sequence
  Description of Artificial Sequence: Synthetic oligonucleotide
cggctgcgacctggggccgt

SEQ ID NO: 26466 - DNA, 24 bp, Artificial Sequence
  Description of Artificial Sequence: Synthetic oligonucleotide
agctgagagcctacctggagggcg

SEQ ID NO: 26467 - DNA, 23 bp, Artificial Sequence
  Description of Artificial Sequence: Synthetic oligonucleotide
gctgagagcctacctggagggcg

SEQ ID NO: 26468 - DNA, 23 bp, Artificial Sequence
  Description of Artificial Sequence: Synthetic oligonucleotide
ctgagagcctacctggagggcgg

SEQ ID NO: 26469 - DNA, 24 bp, Artificial Sequence
  Description of Artificial Sequence: Synthetic oligonucleotide
tgagagcctacctggagggcgggt

SEQ ID NO: 26470 - DNA, 23 bp, Artificial Sequence
  Description of Artificial Sequence: Synthetic oligonucleotide
gagagcctacctggagggcgggt

SEQ ID NO: 26471 - DNA, 23 bp, Artificial Sequence
  Description of Artificial Sequence: Synthetic oligonucleotide
agagcctacctggagggcgggtg

SEQ ID NO: 26472 - DNA, 22 bp, Artificial Sequence
  Description of Artificial Sequence: Synthetic oligonucleotide
gagcctacctggagggcgggtg

SEQ ID NO: 26473 - DNA, 22 bp, Artificial Sequence
  Description of Artificial Sequence: Synthetic oligonucleotide
agcctacctggagggcgggtgc

SEQ ID NO: 26474 - DNA, 21 bp, Artificial Sequence
  Description of Artificial Sequence: Synthetic oligonucleotide
gcctacctggagggcgggtgc

SEQ ID NO: 26475 - DNA, 22 bp, Artificial Sequence
  Description of Artificial Sequence: Synthetic oligonucleotide
cctacctggagggcgggtgcgt

SEQ ID NO: 26476 - DNA, 22 bp, Artificial Sequence
  Description of Artificial Sequence: Synthetic oligonucleotide
ctacctggagggcgggtgcgtg

SEQ ID NO: 26477 - DNA, 23 bp, Artificial Sequence
  Description of Artificial Sequence: Synthetic oligonucleotide
tacctggagggcgggtgcgtgga

SEQ ID NO: 26478 - DNA, 22 bp, Artificial Sequence
  Description of Artificial Sequence: Synthetic oligonucleotide
acctggagggcgggtgcgtgga

SEQ ID NO: 26479 - DNA, 21 bp, Artificial Sequence
  Description of Artificial Sequence: Synthetic oligonucleotide
cctggagggcgggtgcgtgga

SEQ ID NO: 26480 - DNA, 22 bp, Artificial Sequence
  Description of Artificial Sequence: Synthetic oligonucleotide
ctggagggcgggtgcgtggagt

SEQ ID NO: 26481 - DNA, 22 bp, Artificial Sequence
  Description of Artificial Sequence: Synthetic oligonucleotide
tggagggcgggtgcgtggagtg

SEQ ID NO: 26482 - DNA, 21 bp, Artificial Sequence
  Description of Artificial Sequence: Synthetic oligonucleotide
ggagggcgggtgcgtggagtg

SEQ ID NO: 26483 - DNA, 21 bp, Artificial Sequence
  Description of Artificial Sequence: Synthetic oligonucleotide
gagggcgggtgcgtggagtgg

SEQ ID NO: 26484 - DNA, 22 bp, Artificial Sequence
  Description of Artificial Sequence: Synthetic oligonucleotide
agggcgggtgcgtggagtggct

SEQ ID NO: 26485 - DNA, 21 bp, Artificial Sequence
  Description of Artificial Sequence: Synthetic oligonucleotide
gggcgggtgcgtggagtggct

SEQ ID NO: 26486 - DNA, 21 bp, Artificial Sequence
  Description of Artificial Sequence: Synthetic oligonucleotide
ggcgggtgcgtggagtggctc

SEQ ID NO: 26487 - DNA, 21 bp, Artificial Sequence
  Description of Artificial Sequence: Synthetic oligonucleotide
gcgggtgcgtggagtggctcc

SEQ ID NO: 26488 - DNA, 21 bp, Artificial Sequence
  Description of Artificial Sequence: Synthetic oligonucleotide
cgggtgcgtggagtggctccg

SEQ ID NO: 26489 - DNA, 22 bp, Artificial Sequence
  Description of Artificial Sequence: Synthetic oligonucleotide
gggtgcgtggagtggctccgca

SEQ ID NO: 26490 - DNA, 24 bp, Artificial Sequence
  Description of Artificial Sequence: Synthetic oligonucleotide
gagtgcgtggagtggctccgcaga

SEQ ID NO: 26491 - DNA, 25 bp, Artificial Sequence
  Description of Artificial Sequence: Synthetic oligonucleotide
agtgcgtggagtggctccgcagaca

SEQ ID NO: 26492 - DNA, 23 bp, Artificial Sequence
  Description of Artificial Sequence: Synthetic oligonucleotide
ctcaagtgggaggcggcccgtga

SEQ ID NO: 26493 - DNA, 23 bp, Artificial Sequence
  Description of Artificial Sequence: Synthetic oligonucleotide
tcaagtgggaggcggcccgtgag

SEQ ID NO: 26494 - DNA, 26 bp, Artificial Sequence
  Description of Artificial Sequence: Synthetic oligonucleotide
cggagtattgggaccgggagacacag

SEQ ID NO: 26495 - DNA, 27 bp, Artificial Sequence
  Description of Artificial Sequence: Synthetic oligonucleotide
ggagtattgggaccgggagacacaggt

SEQ ID NO: 26496 - DNA, 27 bp, Artificial Sequence
  Description of Artificial Sequence: Synthetic oligonucleotide
gagtattgggaccgggagacacaggtc

SEQ ID NO: 26497 - DNA, 28 bp, Artificial Sequence
  Description of Artificial Sequence: Synthetic oligonucleotide
agtattgggaccgggagacacaggtctc

SEQ ID NO: 26498 - DNA, 27 bp, Artificial Sequence
  Description of Artificial Sequence: Synthetic oligonucleotide
gtattgggaccgggagacacaggtctc

SEQ ID NO: 26499 - DNA, 27 bp, Artificial Sequence
  Description of Artificial Sequence: Synthetic oligonucleotide
tattgggaccgggagacacaggtctcc

SEQ ID NO: 26500 - DNA, 27 bp, Artificial Sequence
  Description of Artificial Sequence: Synthetic oligonucleotide
attgggaccgggagacacaggtctcca

SEQ ID NO: 26501 - DNA, 27 bp, Artificial Sequence
  Description of Artificial Sequence: Synthetic oligonucleotide
ttgggaccgggagacacaggtctccaa

SEQ ID NO: 26502 - DNA, 26 bp, Artificial Sequence
  Description of Artificial Sequence: Synthetic oligonucleotide
tgggaccgggagacacaggtctccaa

SEQ ID NO: 26503 - DNA, 25 bp, Artificial Sequence
  Description of Artificial Sequence: Synthetic oligonucleotide
gggaccgggagacacaggtctccaa

SEQ ID NO: 26504 - DNA, 26 bp, Artificial Sequence
  Description of Artificial Sequence: Synthetic oligonucleotide
ggaccgggagacacaggtctccaaga

SEQ ID NO: 26505 - DNA, 26 bp, Artificial Sequence
  Description of Artificial Sequence: Synthetic oligonucleotide
gaccgggagacacaggtctccaagac

SEQ ID NO: 26506 - DNA, 27 bp, Artificial Sequence
  Description of Artificial Sequence: Synthetic oligonucleotide
accgggagacacaggtctccaagacca

SEQ ID NO: 26507 - DNA, 27 bp, Artificial Sequence
  Description of Artificial Sequence: Synthetic oligonucleotide
ccgggagacacaggtctccaagaccaa

SEQ ID NO: 26508 - DNA, 27 bp, Artificial Sequence
  Description of Artificial Sequence: Synthetic oligonucleotide
cgggagacacaggtctccaagaccaac

SEQ ID NO: 26509 - DNA, 28 bp, Artificial Sequence
  Description of Artificial Sequence: Synthetic oligonucleotide
gggagacacaggtctccaagaccaacac

SEQ ID NO: 26510 - DNA, 29 bp, Artificial Sequence
  Description of Artificial Sequence: Synthetic oligonucleotide
ggagacacaggtctccaagaccaacacac

SEQ ID NO: 26511 - DNA, 30 bp, Artificial Sequence
  Description of Artificial Sequence: Synthetic oligonucleotide
gagacacaggtctccaagaccaacacacag

SEQ ID NO: 26512 - DNA, 31 bp, Artificial Sequence
  Description of Artificial Sequence: Synthetic oligonucleotide
agacacaggtctccaagaccaacacacagac

SEQ ID NO: 26513 - DNA, 30 bp, Artificial Sequence
  Description of Artificial Sequence: Synthetic oligonucleotide
gacacaggtctccaagaccaacacacagac

SEQ ID NO: 26514 - DNA, 33 bp, Artificial Sequence
  Description of Artificial Sequence: Synthetic oligonucleotide
acacaggtctccaagaccaacacacagacttac

SEQ ID NO: 26515 - DNA, 32 bp, Artificial Sequence
  Description of Artificial Sequence: Synthetic oligonucleotide
cacaggtctccaagaccaacacacagacttac

SEQ ID NO: 26516 - DNA, 32 bp, Artificial Sequence
  Description of Artificial Sequence: Synthetic oligonucleotide
acaggtctccaagaccaacacacagacttacc

SEQ ID NO: 26517 - DNA, 31 bp, Artificial Sequence
  Description of Artificial Sequence: Synthetic oligonucleotide
caggtctccaagaccaacacacagacttacc

SEQ ID NO: 26518 - DNA, 31 bp, Artificial Sequence
  Description of Artificial Sequence: Synthetic oligonucleotide
aggtctccaagaccaacacacagacttaccg

SEQ ID NO: 26519 - DNA, 27 bp, Artificial Sequence
  Description of Artificial Sequence: Synthetic oligonucleotide
acacagacttaccgagagagcctgcgc

SEQ ID NO: 26520 - DNA, 27 bp, Artificial Sequence
  Description of Artificial Sequence: Synthetic oligonucleotide
cacagacttaccgagagagcctgcgca

SEQ ID NO: 26521 - DNA, 27 bp, Artificial Sequence
  Description of Artificial Sequence: Synthetic oligonucleotide
acagacttaccgagagagcctgcgcac

SEQ ID NO: 26522 - DNA, 26 bp, Artificial Sequence
  Description of Artificial Sequence: Synthetic oligonucleotide
cagacttaccgagagagcctgcgcac

SEQ ID NO: 26523 - DNA, 26 bp, Artificial Sequence
  Description of Artificial Sequence: Synthetic oligonucleotide
agacttaccgagagagcctgcgcacc

SEQ ID NO: 26524 - DNA, 25 bp, Artificial Sequence
  Description of Artificial Sequence: Synthetic oligonucleotide
gacttaccgagagagcctgcgcacc

SEQ ID NO: 26525 - DNA, 25 bp, Artificial Sequence
  Description of Artificial Sequence: Synthetic oligonucleotide
acttaccgagagagcctgcgcaccg

SEQ ID NO: 26526 - DNA, 24 bp, Artificial Sequence
  Description of Artificial Sequence: Synthetic oligonucleotide
cttaccgagagagcctgcgcaccg

SEQ ID NO: 26527 - DNA, 24 bp, Artificial Sequence
  Description of Artificial Sequence: Synthetic oligonucleotide
ttaccgagagagcctgcgcaccgc

SEQ ID NO: 26528 - DNA, 23 bp, Artificial Sequence
  Description of Artificial Sequence: Synthetic oligonucleotide
taccgagagagcctgcgcaccgc

SEQ ID NO: 26529 - DNA, 22 bp, Artificial Sequence
  Description of Artificial Sequence: Synthetic oligonucleotide
accgagagagcctgcgcaccgc

SEQ ID NO: 26530 - DNA, 21 bp, Artificial Sequence
  Description of Artificial Sequence: Synthetic oligonucleotide
ccgagagagcctgcgcaccgc

SEQ ID NO: 26531 - DNA, 21 bp, Artificial Sequence
  Description of Artificial Sequence: Synthetic oligonucleotide
cgagagagcctgcgcaccgcg

SEQ ID NO: 26532 - DNA, 22 bp, Artificial Sequence
  Description of Artificial Sequence: Synthetic oligonucleotide
gagagagcctgcgcaccgcgct

SEQ ID NO: 26533 - DNA, 22 bp, Artificial Sequence
  Description of Artificial Sequence: Synthetic oligonucleotide
agagagcctgcgcaccgcgctc

SEQ ID NO: 26534 - DNA, 21 bp, Artificial Sequence
  Description of Artificial Sequence: Synthetic oligonucleotide
gagagcctgcgcaccgcgctc

SEQ ID NO: 26535 - DNA, 21 bp, Artificial Sequence
  Description of Artificial Sequence: Synthetic oligonucleotide
agagcctgcgcaccgcgctcc

SEQ ID NO: 26536 - DNA, 20 bp, Artificial Sequence
  Description of Artificial Sequence: Synthetic oligonucleotide
gagcctgcgcaccgcgctcc

SEQ ID NO: 26537 - DNA, 20 bp, Artificial Sequence
  Description of Artificial Sequence: Synthetic oligonucleotide
agcctgcgcaccgcgctccg

SEQ ID NO: 26538 - DNA, 20 bp, Artificial Sequence
  Description of Artificial Sequence: Synthetic oligonucleotide
gcctgcgcaccgcgctccgt

SEQ ID NO: 26539 - DNA, 29 bp, Artificial Sequence
  Description of Artificial Sequence: Synthetic oligonucleotide
cgggtctcacacttggcagacgatgtttg

SEQ ID NO: 26540 - DNA, 29 bp, Artificial Sequence
  Description of Artificial Sequence: Synthetic oligonucleotide
gggtctcacacttggcagacgatgtttgg

SEQ ID NO: 26541 - DNA, 29 bp, Artificial Sequence
  Description of Artificial Sequence: Synthetic oligonucleotide
ggtctcacacttggcagacgatgtttggc

SEQ ID NO: 26542 - DNA, 30 bp, Artificial Sequence
  Description of Artificial Sequence: Synthetic oligonucleotide
gtctcacacttggcagacgatgtttggctg

SEQ ID NO: 26543 - DNA, 30 bp, Artificial Sequence
  Description of Artificial Sequence: Synthetic oligonucleotide
tctcacacttggcagacgatgtttggctgc

SEQ ID NO: 26544 - DNA, 29 bp, Artificial Sequence
  Description of Artificial Sequence: Synthetic oligonucleotide
ctcacacttggcagacgatgtttggctgc

SEQ ID NO: 26545 - DNA, 29 bp, Artificial Sequence
  Description of Artificial Sequence: Synthetic oligonucleotide
tcacacttggcagacgatgtttggctgcg

SEQ ID NO: 26546 - DNA, 28 bp, Artificial Sequence
  Description of Artificial Sequence: Synthetic oligonucleotide
cacacttggcagacgatgtttggctgcg

SEQ ID NO: 26547 - DNA, 29 bp, Artificial Sequence
  Description of Artificial Sequence: Synthetic oligonucleotide
acacttggcagacgatgtttggctgcgac

SEQ ID NO: 26548 - DNA, 28 bp, Artificial Sequence
  Description of Artificial Sequence: Synthetic oligonucleotide
cacttggcagacgatgtttggctgcgac

SEQ ID NO: 26549 - DNA, 28 bp, Artificial Sequence
  Description of Artificial Sequence: Synthetic oligonucleotide
acttggcagacgatgtttggctgcgacc

SEQ ID NO: 26550 - DNA, 27 bp, Artificial Sequence
  Description of Artificial Sequence: Synthetic oligonucleotide
cttggcagacgatgtttggctgcgacc

SEQ ID NO: 26551 - DNA, 28 bp, Artificial Sequence
  Description of Artificial Sequence: Synthetic oligonucleotide
ttggcagacgatgtttggctgcgacctg

SEQ ID NO: 26552 - DNA, 27 bp, Artificial Sequence
  Description of Artificial Sequence: Synthetic oligonucleotide
tggcagacgatgtttggctgcgacctg

SEQ ID NO: 26553 - DNA, 26 bp, Artificial Sequence
  Description of Artificial Sequence: Synthetic oligonucleotide
ggcagacgatgtttggctgcgacctg

SEQ ID NO: 26554 - DNA, 26 bp, Artificial Sequence
  Description of Artificial Sequence: Synthetic oligonucleotide
gcagacgatgtttggctgcgacctgg

SEQ ID NO: 26555 - DNA, 26 bp, Artificial Sequence
  Description of Artificial Sequence: Synthetic oligonucleotide
cagacgatgtttggctgcgacctggg

SEQ ID NO: 26556 - DNA, 26 bp, Artificial Sequence
  Description of Artificial Sequence: Synthetic oligonucleotide
agacgatgtttggctgcgacctgggg

SEQ ID NO: 26557 - DNA, 25 bp, Artificial Sequence
  Description of Artificial Sequence: Synthetic oligonucleotide
gacgatgtttggctgcgacctgggg

SEQ ID NO: 26558 - DNA, 25 bp, Artificial Sequence
  Description of Artificial Sequence: Synthetic oligonucleotide
acgatgtttggctgcgacctggggc

SEQ ID NO: 26559 - DNA, 24 bp, Artificial Sequence
  Description of Artificial Sequence: Synthetic oligonucleotide
cgatgtttggctgcgacctggggc

SEQ ID NO: 26560 - DNA, 24 bp, Artificial Sequence
  Description of Artificial Sequence: Synthetic oligonucleotide
gatgtttggctgcgacctggggcc

SEQ ID NO: 26561 - DNA, 24 bp, Artificial Sequence
  Description of Artificial Sequence: Synthetic oligonucleotide
atgtttggctgcgacctggggccg

SEQ ID NO: 26562 - DNA, 23 bp, Artificial Sequence
  Description of Artificial Sequence: Synthetic oligonucleotide
tgtttggctgcgacctggggccg

SEQ ID NO: 26563 - DNA, 22 bp, Artificial Sequence
  Description of Artificial Sequence: Synthetic oligonucleotide
gtttggctgcgacctggggccg

SEQ ID NO: 26564 - DNA, 23 bp, Artificial Sequence
  Description of Artificial Sequence: Synthetic oligonucleotide
tttggctgcgacctggggccgga

SEQ ID NO: 26565 - DNA, 22 bp, Artificial Sequence
  Description of Artificial Sequence: Synthetic oligonucleotide
ttggctgcgacctggggccgga

SEQ ID NO: 26566 - DNA, 22 bp, Artificial Sequence
  Description of Artificial Sequence: Synthetic oligonucleotide
aacctgcgcaccgcgctccgct

SEQ ID NO: 26567 - DNA, 21 bp, Artificial Sequence
  Description of Artificial Sequence: Synthetic oligonucleotide
acctgcgcaccgcgctccgct

SEQ ID NO: 26568 - DNA, 20 bp, Artificial Sequence
  Description of Artificial Sequence: Synthetic oligonucleotide
cctgcgcaccgcgctccgct

SEQ ID NO: 26569 - DNA, 20 bp, Artificial Sequence
  Description of Artificial Sequence: Synthetic oligonucleotide
ctgcgcaccgcgctccgctg

SEQ ID NO: 26570 - DNA, 22 bp, Artificial Sequence
  Description of Artificial Sequence: Synthetic oligonucleotide
tgcgcaccgcgctccgctgcta

SEQ ID NO: 26571 - DNA, 21 bp, Artificial Sequence
  Description of Artificial Sequence: Synthetic oligonucleotide
gcgcaccgcgctccgctgcta

SEQ ID NO: 26572 - DNA, 23 bp, Artificial Sequence
  Description of Artificial Sequence: Synthetic oligonucleotide
cgcaccgcgctccgctgctacaa

SEQ ID NO: 26573 - DNA, 23 bp, Artificial Sequence
  Description of Artificial Sequence: Synthetic oligonucleotide
gcaccgcgctccgctgctacaac

SEQ ID NO: 26574 - DNA, 24 bp, Artificial Sequence
  Description of Artificial Sequence: Synthetic oligonucleotide
caccgcgctccgctgctacaacca

SEQ ID NO: 26575 - DNA, 25 bp, Artificial Sequence
  Description of Artificial Sequence: Synthetic oligonucleotide
accgcgctccgctgctacaaccaga

SEQ ID NO: 26576 - DNA, 24 bp, Artificial Sequence
  Description of Artificial Sequence: Synthetic oligonucleotide
ccgcgctccgctgctacaaccaga

SEQ ID NO: 26577 - DNA, 24 bp, Artificial Sequence
  Description of Artificial Sequence: Synthetic oligonucleotide
cgcgctccgctgctacaaccagag

SEQ ID NO: 26578 - DNA, 24 bp, Artificial Sequence
  Description of Artificial Sequence: Synthetic oligonucleotide
gcgctccgctgctacaaccagagc

SEQ ID NO: 26579 - DNA, 25 bp, Artificial Sequence
  Description of Artificial Sequence: Synthetic oligonucleotide
cgctccgctgctacaaccagagcga

SEQ ID NO: 26580 - DNA, 25 bp, Artificial Sequence
  Description of Artificial Sequence: Synthetic oligonucleotide
gctccgctgctacaaccagagcgag

SEQ ID NO: 26581 - DNA, 25 bp, Artificial Sequence
  Description of Artificial Sequence: Synthetic oligonucleotide
ctccgctgctacaaccagagcgagg

SEQ ID NO: 26582 - DNA, 25 bp, Artificial Sequence
  Description of Artificial Sequence: Synthetic oligonucleotide
tccgctgctacaaccagagcgaggc

SEQ ID NO: 26583 - DNA, 24 bp, Artificial Sequence
  Description of Artificial Sequence: Synthetic oligonucleotide
ccgctgctacaaccagagcgaggc

SEQ ID NO: 26584 - DNA, 24 bp, Artificial Sequence
  Description of Artificial Sequence: Synthetic oligonucleotide
cgctgctacaaccagagcgaggcc

SEQ ID NO: 26585 - DNA, 24 bp, Artificial Sequence
  Description of Artificial Sequence: Synthetic oligonucleotide
gctgctacaaccagagcgaggccg

SEQ ID NO: 26586 - DNA, 24 bp, Artificial Sequence
  Description of Artificial Sequence: Synthetic oligonucleotide
ctgctacaaccagagcgaggccgg

SEQ ID NO: 26587 - DNA, 25 bp, Artificial Sequence
  Description of Artificial Sequence: Synthetic oligonucleotide
tgctacaaccagagcgaggccgggt

SEQ ID NO: 26588 - DNA, 24 bp, Artificial Sequence
  Description of Artificial Sequence: Synthetic oligonucleotide
gctacaaccagagcgaggccgggt

SEQ ID NO: 26589 - DNA, 23 bp, Artificial Sequence
  Description of Artificial Sequence: Synthetic oligonucleotide
gcgccccgggcgccatggataaa

SEQ ID NO: 26590 - DNA, 23 bp, Artificial Sequence
  Description of Artificial Sequence: Synthetic oligonucleotide
cgccccgggcgccatggataaag

SEQ ID NO: 26591 - DNA, 24 bp, Artificial Sequence
  Description of Artificial Sequence: Synthetic oligonucleotide
gccccgggcgccatggataaagca

SEQ ID NO: 26592 - DNA, 24 bp, Artificial Sequence
  Description of Artificial Sequence: Synthetic oligonucleotide
ccccgggcgccatggataaagcag

SEQ ID NO: 26593 - DNA, 25 bp, Artificial Sequence
  Description of Artificial Sequence: Synthetic oligonucleotide
cccgggcgccatggataaagcagga

SEQ ID NO: 26594 - DNA, 25 bp, Artificial Sequence
  Description of Artificial Sequence: Synthetic oligonucleotide
ccgggcgccatggataaagcaggag

SEQ ID NO: 26595 - DNA, 25 bp, Artificial Sequence
  Description of Artificial Sequence: Synthetic oligonucleotide
cgggcgccatggataaagcaggagg

SEQ ID NO: 26596 - DNA, 25 bp, Artificial Sequence
  Description of Artificial Sequence: Synthetic oligonucleotide
gggcgccatggataaagcaggaggg

SEQ ID NO: 26597 - DNA, 25 bp, Artificial Sequence
  Description of Artificial Sequence: Synthetic oligonucleotide
ggcgccatggataaagcaggagggg

SEQ ID NO: 26598 - DNA, 25 bp, Artificial Sequence
  Description of Artificial Sequence: Synthetic oligonucleotide
gcgccatggataaagcaggaggggc

SEQ ID NO: 26599 - DNA, 25 bp, Artificial Sequence
  Description of Artificial Sequence: Synthetic oligonucleotide
cgccatggataaagcaggaggggcc

SEQ ID NO: 26600 - DNA, 25 bp, Artificial Sequence
  Description of Artificial Sequence: Synthetic oligonucleotide
gccatggataaagcaggaggggccg

SEQ ID NO: 26601 - DNA, 26 bp, Artificial Sequence
  Description of Artificial Sequence: Synthetic oligonucleotide
ccatggataaagcaggaggggccgga

SEQ ID NO: 26602 - DNA, 27 bp, Artificial Sequence
  Description of Artificial Sequence: Synthetic oligonucleotide
catggataaagcaggaggggccggagt

SEQ ID NO: 26603 - DNA, 30 bp, Artificial Sequence
  Description of Artificial Sequence: Synthetic oligonucleotide
atggataaagcaggaggggccggagtattg

SEQ ID NO: 26604 - DNA, 29 bp, Artificial Sequence
  Description of Artificial Sequence: Synthetic oligonucleotide
tggataaagcaggaggggccggagtattg

SEQ ID NO: 26605 - DNA, 28 bp, Artificial Sequence
  Description of Artificial Sequence: Synthetic oligonucleotide
ggataaagcaggaggggccggagtattg

SEQ ID NO: 26606 - DNA, 28 bp, Artificial Sequence
  Description of Artificial Sequence: Synthetic oligonucleotide
gataaagcaggaggggccggagtattgg

SEQ ID NO: 26607 - DNA, 28 bp, Artificial Sequence
  Description of Artificial Sequence: Synthetic oligonucleotide
ataaagcaggaggggccggagtattggg

SEQ ID NO: 26608 - DNA, 27 bp, Artificial Sequence
  Description of Artificial Sequence: Synthetic oligonucleotide
taaagcaggaggggccggagtattggg

SEQ ID NO: 26609 - DNA, 27 bp, Artificial Sequence
  Description of Artificial Sequence: Synthetic oligonucleotide
aaagcaggaggggccggagtattggga

SEQ ID NO: 26610 - DNA, 26 bp, Artificial Sequence
  Description of Artificial Sequence: Synthetic oligonucleotide
aagcaggaggggccggagtattggga

SEQ ID NO: 26611 - DNA, 27 bp, Artificial Sequence
  Description of Artificial Sequence: Synthetic oligonucleotide
gcttcatcaccgtgggctacgtggact

SEQ ID NO: 26612 - DNA, 28 bp, Artificial Sequence
  Description of Artificial Sequence: Synthetic oligonucleotide
cttcatcaccgtgggctacgtggactac

SEQ ID NO: 26613 - DNA, 29 bp, Artificial Sequence
  Description of Artificial Sequence: Synthetic oligonucleotide
ttcatcaccgtgggctacgtggactacac

SEQ ID NO: 26614 - DNA, 28 bp, Artificial Sequence
  Description of Artificial Sequence: Synthetic oligonucleotide
tcatcaccgtgggctacgtggactacac

SEQ ID NO: 26615 - DNA, 27 bp, Artificial Sequence
  Description of Artificial Sequence: Synthetic oligonucleotide
catcaccgtgggctacgtggactacac

SEQ ID NO: 26616 - DNA, 27 bp, Artificial Sequence
  Description of Artificial Sequence: Synthetic oligonucleotide
atcaccgtgggctacgtggactacacc

SEQ ID NO: 26617 - DNA, 26 bp, Artificial Sequence
  Description of Artificial Sequence: Synthetic oligonucleotide
tcaccgtgggctacgtggactacacc

SEQ ID NO: 26618 - DNA, 25 bp, Artificial Sequence
  Description of Artificial Sequence: Synthetic oligonucleotide
caccgtgggctacgtggactacacc

SEQ ID NO: 26619 - DNA, 26 bp, Artificial Sequence
  Description of Artificial Sequence: Synthetic oligonucleotide
accgtgggctacgtggactacaccca

SEQ ID NO: 26620 - DNA, 25 bp, Artificial Sequence
  Description of Artificial Sequence: Synthetic oligonucleotide
ccgtgggctacgtggactacaccca

SEQ ID NO: 26621 - DNA, 27 bp, Artificial Sequence
  Description of Artificial Sequence: Synthetic oligonucleotide
cgtgggctacgtggactacacccagtt

SEQ ID NO: 26622 - DNA, 27 bp, Artificial Sequence
  Description of Artificial Sequence: Synthetic oligonucleotide
gtgggctacgtggactacacccagttc

SEQ ID NO: 26623 - DNA, 27 bp, Artificial Sequence
  Description of Artificial Sequence: Synthetic oligonucleotide
tgggctacgtggactacacccagttcg

SEQ ID NO: 26624 - DNA, 27 bp, Artificial Sequence
  Description of Artificial Sequence: Synthetic oligonucleotide
gggctacgtggactacacccagttcgt

SEQ ID NO: 26625 - DNA, 27 bp, Artificial Sequence
  Description of Artificial Sequence: Synthetic oligonucleotide
ggctacgtggactacacccagttcgtg

SEQ ID NO: 26626 - DNA, 28 bp, Artificial Sequence
  Description of Artificial Sequence: Synthetic oligonucleotide
gctacgtggactacacccagttcgtgag

SEQ ID NO: 26627 - DNA, 28 bp, Artificial Sequence
  Description of Artificial Sequence: Synthetic oligonucleotide
ctacgtggactacacccagttcgtgagg

SEQ ID NO: 26628 - DNA, 30 bp, Artificial Sequence
  Description of Artificial Sequence: Synthetic oligonucleotide
tacgtggactacacccagttcgtgaggttc

SEQ ID NO: 26629 - DNA, 29 bp, Artificial Sequence
  Description of Artificial Sequence: Synthetic oligonucleotide
acgtggactacacccagttcgtgaggttc

SEQ ID NO: 26630 - DNA, 28 bp, Artificial Sequence
  Description of Artificial Sequence: Synthetic oligonucleotide
cgtggactacacccagttcgtgaggttc

SEQ ID NO: 26631 - DNA, 28 bp, Artificial Sequence
  Description of Artificial Sequence: Synthetic oligonucleotide
gtggactacacccagttcgtgaggttcg

SEQ ID NO: 26632 - DNA, 29 bp, Artificial Sequence
  Description of Artificial Sequence: Synthetic oligonucleotide
tggactacacccagttcgtgaggttcgac

SEQ ID NO: 26633 - DNA, 28 bp, Artificial Sequence
  Description of Artificial Sequence: Synthetic oligonucleotide
ggactacacccagttcgtgaggttcgac

SEQ ID NO: 26634 - DNA, 29 bp, Artificial Sequence
  Description of Artificial Sequence: Synthetic oligonucleotide
gactacacccagttcgtgaggttcgacag

SEQ ID NO: 26635 - DNA, 29 bp, Artificial Sequence
  Description of Artificial Sequence: Synthetic oligonucleotide
actacacccagttcgtgaggttcgacagc

SEQ ID NO: 26636 - DNA, 28 bp, Artificial Sequence
  Description of Artificial Sequence: Synthetic oligonucleotide
ctacacccagttcgtgaggttcgacagc

SEQ ID NO: 26637 - DNA, 28 bp, Artificial Sequence
  Description of Artificial Sequence: Synthetic oligonucleotide
tacacccagttcgtgaggttcgacagcg

SEQ ID NO: 26638 - DNA, 22 bp, Artificial Sequence
  Description of Artificial Sequence: Synthetic oligonucleotide
cagctcaagtgggaggcggccg

SEQ ID NO: 26639 - DNA, 23 bp, Artificial Sequence
  Description of Artificial Sequence: Synthetic oligonucleotide
agctcaagtgggaggcggccggt

SEQ ID NO: 26640 - DNA, 22 bp, Artificial Sequence
  Description of Artificial Sequence: Synthetic oligonucleotide
gctcaagtgggaggcggccggt

SEQ ID NO: 26641 - DNA, 23 bp, Artificial Sequence
  Description of Artificial Sequence: Synthetic oligonucleotide
ctcaagtgggaggcggccggtgt

SEQ ID NO: 26642 - DNA, 23 bp, Artificial Sequence
  Description of Artificial Sequence: Synthetic oligonucleotide
tcaagtgggaggcggccggtgtg

SEQ ID NO: 26643 - DNA, 22 bp, Artificial Sequence
  Description of Artificial Sequence: Synthetic oligonucleotide
caagtgggaggcggccggtgtg

SEQ ID NO: 26644 - DNA, 22 bp, Artificial Sequence
  Description of Artificial Sequence: Synthetic oligonucleotide
aagtgggaggcggccggtgtgg

SEQ ID NO: 26645 - DNA, 21 bp, Artificial Sequence
  Description of Artificial Sequence: Synthetic oligonucleotide
agtgggaggcggccggtgtgg

SEQ ID NO: 26646 - DNA, 20 bp, Artificial Sequence
  Description of Artificial Sequence: Synthetic oligonucleotide
gtgggaggcggccggtgtgg

SEQ ID NO: 26647 - DNA, 20 bp, Artificial Sequence
  Description of Artificial Sequence: Synthetic oligonucleotide
tgggaggcggccggtgtggc

SEQ ID NO: 26648 - DNA, 20 bp, Artificial Sequence
  Description of Artificial Sequence: Synthetic oligonucleotide
gggaggcggccggtgtggct

SEQ ID NO: 26649 - DNA, 20 bp, Artificial Sequence
  Description of Artificial Sequence: Synthetic oligonucleotide
ggaggcggccggtgtggcgt

SEQ ID NO: 26650 - DNA, 20 bp, Artificial Sequence
  Description of Artificial Sequence: Synthetic oligonucleotide
gaggcggccggtgtggcgga

SEQ ID NO: 26651 - DNA, 20 bp, Artificial Sequence
  Description of Artificial Sequence: Synthetic oligonucleotide
aggcggccggtgtggcggag

SEQ ID NO: 26652 - DNA, 20 bp, Artificial Sequence
  Description of Artificial Sequence: Synthetic oligonucleotide
ggcggccggtgtggcggagt

SEQ ID NO: 26653 - DNA, 20 bp, Artificial Sequence
  Description of Artificial Sequence: Synthetic oligonucleotide
gcggccggtgtggcggagca

SEQ ID NO: 26654 - DNA, 20 bp, Artificial Sequence
  Description of Artificial Sequence: Synthetic oligonucleotide
cggccggtgtggcggagcag

SEQ ID NO: 26655 - DNA, 21 bp, Artificial Sequence
  Description of Artificial Sequence: Synthetic oligonucleotide
ggccggtgtggcggagcagct

SEQ ID NO: 26656 - DNA, 22 bp, Artificial Sequence
  Description of Artificial Sequence: Synthetic oligonucleotide
gccggtgtggcggagcagctga

SEQ ID NO: 26657 - DNA, 23 bp, Artificial Sequence
  Description of Artificial Sequence: Synthetic oligonucleotide
ccggtgtggcggagcagctgaga

SEQ ID NO: 26658 - DNA, 23 bp, Artificial Sequence
  Description of Artificial Sequence: Synthetic oligonucleotide
cggtgtggcggagcagctgagag

SEQ ID NO: 26659 - DNA, 23 bp, Artificial Sequence
  Description of Artificial Sequence: Synthetic oligonucleotide
ggtgtggcggagcagctgagagc

SEQ ID NO: 26660 - DNA, 20 bp, Artificial Sequence
  Description of Artificial Sequence: Synthetic oligonucleotide
ggacgggcgcctcctccgca

SEQ ID NO: 26661 - DNA, 20 bp, Artificial Sequence
  Description of Artificial Sequence: Synthetic oligonucleotide
gacgggcgcctcctccgcag

SEQ ID NO: 26662 - DNA, 20 bp, Artificial Sequence
  Description of Artificial Sequence: Synthetic oligonucleotide
acgggcgcctcctccgcagg

SEQ ID NO: 26663 - DNA, 20 bp, Artificial Sequence
  Description of Artificial Sequence: Synthetic oligonucleotide
cgggcgcctcctccgcaggt

SEQ ID NO: 26664 - DNA, 23 bp, Artificial Sequence
  Description of Artificial Sequence: Synthetic oligonucleotide
gggcgcctcctccgcaggcataa

SEQ ID NO: 26665 - DNA, 23 bp, Artificial Sequence
  Description of Artificial Sequence: Synthetic oligonucleotide
ggcgcctcctccgcaggcataac

SEQ ID NO: 26666 - DNA, 24 bp, Artificial Sequence
  Description of Artificial Sequence: Synthetic oligonucleotide
gcgcctcctccgcaggcataacca

SEQ ID NO: 26667 - DNA, 27 bp, Artificial Sequence
  Description of Artificial Sequence: Synthetic oligonucleotide
cgcctcctccgcaggcataaccagtta

SEQ ID NO: 26668 - DNA, 27 bp, Artificial Sequence
  Description of Artificial Sequence: Synthetic oligonucleotide
gcctcctccgcaggcataaccagttag

SEQ ID NO: 26669 - DNA, 27 bp, Artificial Sequence
  Description of Artificial Sequence: Synthetic oligonucleotide
cctcctccgcaggcataaccagttagc

SEQ ID NO: 26670 - DNA, 27 bp, Artificial Sequence
  Description of Artificial Sequence: Synthetic oligonucleotide
ctcctccgcaggcataaccagttagcc

SEQ ID NO: 26671 - DNA, 29 bp, Artificial Sequence
  Description of Artificial Sequence: Synthetic oligonucleotide
tcctccgcaggcataaccagttagcctac

SEQ ID NO: 26672 - DNA, 28 bp, Artificial Sequence
  Description of Artificial Sequence: Synthetic oligonucleotide
cctccgcaggcataaccagttagcctac

SEQ ID NO: 26673 - DNA, 28 bp, Artificial Sequence
  Description of Artificial Sequence: Synthetic oligonucleotide
ctccgcaggcataaccagttagcctacg

SEQ ID NO: 26674 - DNA, 29 bp, Artificial Sequence
  Description of Artificial Sequence: Synthetic oligonucleotide
tccgcaggcataaccagttagcctacgac

SEQ ID NO: 26675 - DNA, 28 bp, Artificial Sequence
  Description of Artificial Sequence: Synthetic oligonucleotide
ccgcaggcataaccagttagcctacgac

SEQ ID NO: 26676 - DNA, 28 bp, Artificial Sequence
  Description of Artificial Sequence: Synthetic oligonucleotide
cgcaggcataaccagttagcctacgacg

SEQ ID NO: 26677 - DNA, 28 bp, Artificial Sequence
  Description of Artificial Sequence: Synthetic oligonucleotide
gcaggcataaccagttagcctacgacgg

SEQ ID NO: 26678 - DNA, 28 bp, Artificial Sequence
  Description of Artificial Sequence: Synthetic oligonucleotide
caggcataaccagttagcctacgacggc

SEQ ID NO: 26679 - DNA, 30 bp, Artificial Sequence
  Description of Artificial Sequence: Synthetic oligonucleotide
aggcataaccagttagcctacgacggcaag

SEQ ID NO: 26680 - DNA, 28 bp, Artificial Sequence
  Description of Artificial Sequence: Synthetic oligonucleotide
cgggtctcacacttggcagacgatgtac

SEQ ID NO: 26681 - DNA, 28 bp, Artificial Sequence
  Description of Artificial Sequence: Synthetic oligonucleotide
gggtctcacacttggcagacgatgtacg

SEQ ID NO: 26682 - DNA, 28 bp, Artificial Sequence
  Description of Artificial Sequence: Synthetic oligonucleotide
ggtctcacacttggcagacgatgtacgg

SEQ ID NO: 26683 - DNA, 28 bp, Artificial Sequence
  Description of Artificial Sequence: Synthetic oligonucleotide
gtctcacacttggcagacgatgtacggc

SEQ ID NO: 26684 - DNA, 29 bp, Artificial Sequence
  Description of Artificial Sequence: Synthetic oligonucleotide
tctcacacttggcagacgatgtacggctg

SEQ ID NO: 26685 - DNA, 28 bp, Artificial Sequence
  Description of Artificial Sequence: Synthetic oligonucleotide
ctcacacttggcagacgatgtacggctg

SEQ ID NO: 26686 - DNA, 28 bp, Artificial Sequence
  Description of Artificial Sequence: Synthetic oligonucleotide
tcacacttggcagacgatgtacggctgc

SEQ ID NO: 26687 - DNA, 27 bp, Artificial Sequence
  Description of Artificial Sequence: Synthetic oligonucleotide
cacacttggcagacgatgtacggctgc

SEQ ID NO: 26688 - DNA, 27 bp, Artificial Sequence
  Description of Artificial Sequence: Synthetic oligonucleotide
acacttggcagacgatgtacggctgcg

SEQ ID NO: 26689 - DNA, 27 bp, Artificial Sequence
  Description of Artificial Sequence: Synthetic oligonucleotide
cacttggcagacgatgtacggctgcga

SEQ ID NO: 26690 - DNA, 27 bp, Artificial Sequence
  Description of Artificial Sequence: Synthetic oligonucleotide
acttggcagacgatgtacggctgcgac

SEQ ID NO: 26691 - DNA, 26 bp, Artificial Sequence
  Description of Artificial Sequence: Synthetic oligonucleotide
cttggcagacgatgtacggctgcgac

SEQ ID NO: 26692 - DNA, 27 bp, Artificial Sequence
  Description of Artificial Sequence: Synthetic oligonucleotide
ttggcagacgatgtacggctgcgacgt

SEQ ID NO: 26693 - DNA, 26 bp, Artificial Sequence
  Description of Artificial Sequence: Synthetic oligonucleotide
tggcagacgatgtacggctgcgacgt

SEQ ID NO: 26694 - DNA, 25 bp, Artificial Sequence
  Description of Artificial Sequence: Synthetic oligonucleotide
ggcagacgatgtacggctgcgacgt

SEQ ID NO: 26695 - DNA, 25 bp, Artificial Sequence
  Description of Artificial Sequence: Synthetic oligonucleotide
gcagacgatgtacggctgcgacgtg

SEQ ID NO: 26696 - DNA, 25 bp, Artificial Sequence
  Description of Artificial Sequence: Synthetic oligonucleotide
cagacgatgtacggctgcgacgtgg

SEQ ID NO: 26697 - DNA, 25 bp, Artificial Sequence
  Description of Artificial Sequence: Synthetic oligonucleotide
agacgatgtacggctgcgacgtggg

SEQ ID NO: 26698 - DNA, 24 bp, Artificial Sequence
  Description of Artificial Sequence: Synthetic oligonucleotide
gacgatgtacggctgcgacgtggg

SEQ ID NO: 26699 - DNA, 24 bp, Artificial Sequence
  Description of Artificial Sequence: Synthetic oligonucleotide
acgatgtacggctgcgacgtgggg

SEQ ID NO: 26700 - DNA, 23 bp, Artificial Sequence
  Description of Artificial Sequence: Synthetic oligonucleotide
cgatgtacggctgcgacgtgggg

SEQ ID NO: 26701 - DNA, 26 bp, Artificial Sequence
  Description of Artificial Sequence: Synthetic oligonucleotide
ggctcagatcacccagctcaagtggg

SEQ ID NO: 26702 - DNA, 26 bp, Artificial Sequence
  Description of Artificial Sequence: Synthetic oligonucleotide
gctcagatcacccagctcaagtgggg

SEQ ID NO: 26703 - DNA, 26 bp, Artificial Sequence
  Description of Artificial Sequence: Synthetic oligonucleotide
ctcagatcacccagctcaagtggggg

SEQ ID NO: 26704 - DNA, 26 bp, Artificial Sequence
  Description of Artificial Sequence: Synthetic oligonucleotide
tcagatcacccagctcaagtgggggg

SEQ ID NO: 26705 - DNA, 25 bp, Artificial Sequence
  Description of Artificial Sequence: Synthetic oligonucleotide
cagatcacccagctcaagtgggggg

SEQ ID NO: 26706 - DNA, 25 bp, Artificial Sequence
  Description of Artificial Sequence: Synthetic oligonucleotide
agatcacccagctcaagtggggggc

SEQ ID NO: 26707 - DNA, 24 bp, Artificial Sequence
  Description of Artificial Sequence: Synthetic oligonucleotide
gatcacccagctcaagtggggggc

SEQ ID NO: 26708 - DNA, 24 bp, Artificial Sequence
  Description of Artificial Sequence: Synthetic oligonucleotide
atcacccagctcaagtggggggcg

SEQ ID NO: 26709 - DNA, 23 bp, Artificial Sequence
  Description of Artificial Sequence: Synthetic oligonucleotide
tcacccagctcaagtggggggcg

SEQ ID NO: 26710 - DNA, 22 bp, Artificial Sequence
  Description of Artificial Sequence: Synthetic oligonucleotide
cacccagctcaagtggggggcg

SEQ ID NO: 26711 - DNA, 22 bp, Artificial Sequence
  Description of Artificial Sequence: Synthetic oligonucleotide
acccagctcaagtggggggcgg

SEQ ID NO: 26712 - DNA, 21 bp, Artificial Sequence
  Description of Artificial Sequence: Synthetic oligonucleotide
cccagctcaagtggggggcgg

SEQ ID NO: 26713 - DNA, 21 bp, Artificial Sequence
  Description of Artificial Sequence: Synthetic oligonucleotide
ccagctcaagtggggggcggc

SEQ ID NO: 26714 - DNA, 21 bp, Artificial Sequence
  Description of Artificial Sequence: Synthetic oligonucleotide
cagctcaagtggggggcggcc

SEQ ID NO: 26715 - DNA, 21 bp, Artificial Sequence
  Description of Artificial Sequence: Synthetic oligonucleotide
agctcaagtggggggcggccc

SEQ ID NO: 26716 - DNA, 20 bp, Artificial Sequence
  Description of Artificial Sequence: Synthetic oligonucleotide
gctcaagtggggggcggccc

SEQ ID NO: 26717 - DNA, 21 bp, Artificial Sequence
  Description of Artificial Sequence: Synthetic oligonucleotide
ctcaagtggggggcggcccgt

SEQ ID NO: 26718 - DNA, 22 bp, Artificial Sequence
  Description of Artificial Sequence: Synthetic oligonucleotide
tcaagtggggggcggcccgtgt

SEQ ID NO: 26719 - DNA, 21 bp, Artificial Sequence
  Description of Artificial Sequence: Synthetic oligonucleotide
caagtggggggcggcccgtgt

SEQ ID NO: 26720 - DNA, 21 bp, Artificial Sequence
  Description of Artificial Sequence: Synthetic oligonucleotide
aagtggggggcggcccgtgtg

SEQ ID NO: 26721 - DNA, 20 bp, Artificial Sequence
  Description of Artificial Sequence: Synthetic oligonucleotide
agtggggggcggcccgtgtg

SEQ ID NO: 26722 - DNA, 20 bp, Artificial Sequence
  Description of Artificial Sequence: Synthetic oligonucleotide
gtggggggcggcccgtgtgt

SEQ ID NO: 26723 - DNA, 20 bp, Artificial Sequence
  Description of Artificial Sequence: Synthetic oligonucleotide
tggggggcggcccgtgtggt

SEQ ID NO: 26724 - DNA, 20 bp, Artificial Sequence
  Description of Artificial Sequence: Synthetic oligonucleotide
ggggggcggcccgtgtggtt

SEQ ID NO: 26725 - DNA, 20 bp, Artificial Sequence
  Description of Artificial Sequence: Synthetic oligonucleotide
gggggcggcccgtgtggctt

SEQ ID NO: 26726 - DNA, 20 bp, Artificial Sequence
  Description of Artificial Sequence: Synthetic oligonucleotide
ggggcggcccgtgtggcgtt

SEQ ID NO: 26727 - DNA, 20 bp, Artificial Sequence
  Description of Artificial Sequence: Synthetic oligonucleotide
gggcggcccgtgtggcggat

SEQ ID NO: 26728 - DNA, 26 bp, Artificial Sequence
  Description of Artificial Sequence: Synthetic oligonucleotide
cctgggcttctaccctgcggagatct

SEQ ID NO: 26729 - DNA, 27 bp, Artificial Sequence
  Description of Artificial Sequence: Synthetic oligonucleotide
ctgggcttctaccctgcggagatctca

SEQ ID NO: 26730 - DNA, 27 bp, Artificial Sequence
  Description of Artificial Sequence: Synthetic oligonucleotide
tgggcttctaccctgcggagatctcac

SEQ ID NO: 26731 - DNA, 27 bp, Artificial Sequence
  Description of Artificial Sequence: Synthetic oligonucleotide
gggcttctaccctgcggagatctcact

SEQ ID NO: 26732 - DNA, 27 bp, Artificial Sequence
  Description of Artificial Sequence: Synthetic oligonucleotide
ggcttctaccctgcggagatctcactg

SEQ ID NO: 26733 - DNA, 28 bp, Artificial Sequence
  Description of Artificial Sequence: Synthetic oligonucleotide
gcttctaccctgcggagatctcactgac

SEQ ID NO: 26734 - DNA, 28 bp, Artificial Sequence
  Description of Artificial Sequence: Synthetic oligonucleotide
cttctaccctgcggagatctcactgacc

SEQ ID NO: 26735 - DNA, 29 bp, Artificial Sequence
  Description of Artificial Sequence: Synthetic oligonucleotide
ttctaccctgcggagatctcactgacctg

SEQ ID NO: 26736 - DNA, 28 bp, Artificial Sequence
  Description of Artificial Sequence: Synthetic oligonucleotide
tctaccctgcggagatctcactgacctg

SEQ ID NO: 26737 - DNA, 27 bp, Artificial Sequence
  Description of Artificial Sequence: Synthetic oligonucleotide
ctaccctgcggagatctcactgacctg

SEQ ID NO: 26738 - DNA, 27 bp, Artificial Sequence
  Description of Artificial Sequence: Synthetic oligonucleotide
taccctgcggagatctcactgacctgg

SEQ ID NO: 26739 - DNA, 26 bp, Artificial Sequence
  Description of Artificial Sequence: Synthetic oligonucleotide
accctgcggagatctcactgacctgg

SEQ ID NO: 26740 - DNA, 25 bp, Artificial Sequence
  Description of Artificial Sequence: Synthetic oligonucleotide
ccctgcggagatctcactgacctgg

SEQ ID NO: 26741 - DNA, 26 bp, Artificial Sequence
  Description of Artificial Sequence: Synthetic oligonucleotide
cctgcggagatctcactgacctggca

SEQ ID NO: 26742 - DNA, 26 bp, Artificial Sequence
  Description of Artificial Sequence: Synthetic oligonucleotide
ctgcggagatctcactgacctggcag

SEQ ID NO: 26743 - DNA, 26 bp, Artificial Sequence
  Description of Artificial Sequence: Synthetic oligonucleotide
tgcggagatctcactgacctggcagc

SEQ ID NO: 26744 - DNA, 25 bp, Artificial Sequence
  Description of Artificial Sequence: Synthetic oligonucleotide
gcggagatctcactgacctggcagc

SEQ ID NO: 26745 - DNA, 25 bp, Artificial Sequence
  Description of Artificial Sequence: Synthetic oligonucleotide
cggagatctcactgacctggcagcg

SEQ ID NO: 26746 - DNA, 25 bp, Artificial Sequence
  Description of Artificial Sequence: Synthetic oligonucleotide
ggagatctcactgacctggcagcgg

SEQ ID NO: 26747 - DNA, 27 bp, Artificial Sequence
  Description of Artificial Sequence: Synthetic oligonucleotide
gagatctcactgacctggcagcgggat

SEQ ID NO: 26748 - DNA, 27 bp, Artificial Sequence
  Description of Artificial Sequence: Synthetic oligonucleotide
agatctcactgacctggcagcgggatg

SEQ ID NO: 26749 - DNA, 26 bp, Artificial Sequence
  Description of Artificial Sequence: Synthetic oligonucleotide
gatctcactgacctggcagcgggatg

SEQ ID NO: 26750 - DNA, 26 bp, Artificial Sequence
  Description of Artificial Sequence: Synthetic oligonucleotide
atctcactgacctggcagcgggatgg

SEQ ID NO: 26751 - DNA, 25 bp, Artificial Sequence
  Description of Artificial Sequence: Synthetic oligonucleotide
tctcactgacctggcagcgggatgg

SEQ ID NO: 26752 - DNA, 24 bp, Artificial Sequence
  Description of Artificial Sequence: Synthetic oligonucleotide
ctcactgacctggcagcgggatgg

SEQ ID NO: 26753 - DNA, 24 bp, Artificial Sequence
  Description of Artificial Sequence: Synthetic oligonucleotide
tcactgacctggcagcgggatggc

SEQ ID NO: 26754 - DNA, 30 bp, Artificial Sequence
  Description of Artificial Sequence: Synthetic oligonucleotide
acacagacttaccgagagaacctgcggaac

SEQ ID NO: 26755 - DNA, 25 bp, Artificial Sequence
  Description of Artificial Sequence: Synthetic oligonucleotide
caggaggggccggaatattgggacc

SEQ ID NO: 26756 - DNA, 25 bp, Artificial Sequence
  Description of Artificial Sequence: Synthetic oligonucleotide
aggaggggccggaatattgggaccg

SEQ ID NO: 26757 - DNA, 24 bp, Artificial Sequence
  Description of Artificial Sequence: Synthetic oligonucleotide
ggaggggccggaatattgggaccg

SEQ ID NO: 26758 - DNA, 26 bp, Artificial Sequence
  Description of Artificial Sequence: Synthetic oligonucleotide
gaggggccggaatattgggaccggaa

SEQ ID NO: 26759 - DNA, 27 bp, Artificial Sequence
  Description of Artificial Sequence: Synthetic oligonucleotide
aggggccggaatattgggaccggaaca

SEQ ID NO: 26760 - DNA, 26 bp, Artificial Sequence
  Description of Artificial Sequence: Synthetic oligonucleotide
ggggccggaatattgggaccggaaca

SEQ ID NO: 26761 - DNA, 27 bp, Artificial Sequence
  Description of Artificial Sequence: Synthetic oligonucleotide
gggccggaatattgggaccggaacaca

SEQ ID NO: 26762 - DNA, 27 bp, Artificial Sequence
  Description of Artificial Sequence: Synthetic oligonucleotide
ggccggaatattgggaccggaacacac

SEQ ID NO: 26763 - DNA, 28 bp, Artificial Sequence
  Description of Artificial Sequence: Synthetic oligonucleotide
gccggaatattgggaccggaacacacag

SEQ ID NO: 26764 - DNA, 30 bp, Artificial Sequence
  Description of Artificial Sequence: Synthetic oligonucleotide
ccggaatattgggaccggaacacacagatc

SEQ ID NO: 26765 - DNA, 31 bp, Artificial Sequence
  Description of Artificial Sequence: Synthetic oligonucleotide
cggaatattgggaccggaacacacagatctg

SEQ ID NO: 26766 - DNA, 31 bp, Artificial Sequence
  Description of Artificial Sequence: Synthetic oligonucleotide
ggaatattgggaccggaacacacagatctgc

SEQ ID NO: 26767 - DNA, 33 bp, Artificial Sequence
  Description of Artificial Sequence: Synthetic oligonucleotide
gaatattgggaccggaacacacagatctgcaag

SEQ ID NO: 26768 - DNA, 34 bp, Artificial Sequence
  Description of Artificial Sequence: Synthetic oligonucleotide
aatattgggaccggaacacacagatctgcaagac

SEQ ID NO: 26769 - DNA, 33 bp, Artificial Sequence
  Description of Artificial Sequence: Synthetic oligonucleotide
atattgggaccggaacacacagatctgcaagac

SEQ ID NO: 26770 - DNA, 24 bp, Artificial Sequence
  Description of Artificial Sequence: Synthetic oligonucleotide
aggccgggtctcacaccctccagt

SEQ ID NO: 26771 - DNA, 23 bp, Artificial Sequence
  Description of Artificial Sequence: Synthetic oligonucleotide
ggccgggtctcacaccctccagt

SEQ ID NO: 26772 - DNA, 23 bp, Artificial Sequence
  Description of Artificial Sequence: Synthetic oligonucleotide
gccgggtctcacaccctccagtg

SEQ ID NO: 26773 - DNA, 25 bp, Artificial Sequence
  Description of Artificial Sequence: Synthetic oligonucleotide
ccgggtctcacaccctccagtggat

SEQ ID NO: 26774 - DNA, 27 bp, Artificial Sequence
  Description of Artificial Sequence: Synthetic oligonucleotide
cgggtctcacaccctccagtggatgta

SEQ ID NO: 26775 - DNA, 28 bp, Artificial Sequence
  Description of Artificial Sequence: Synthetic oligonucleotide
gggtctcacaccctccagtggatgtatg

SEQ ID NO: 26776 - DNA, 28 bp, Artificial Sequence
  Description of Artificial Sequence: Synthetic oligonucleotide
ggtctcacaccctccagtggatgtatgg

SEQ ID NO: 26777 - DNA, 28 bp, Artificial Sequence
  Description of Artificial Sequence: Synthetic oligonucleotide
gtctcacaccctccagtggatgtatggc

SEQ ID NO: 26778 - DNA, 29 bp, Artificial Sequence
  Description of Artificial Sequence: Synthetic oligonucleotide
tctcacaccctccagtggatgtatggctg

SEQ ID NO: 26779 - DNA, 28 bp, Artificial Sequence
  Description of Artificial Sequence: Synthetic oligonucleotide
ctcacaccctccagtggatgtatggctg

SEQ ID NO: 26780 - DNA, 28 bp, Artificial Sequence
  Description of Artificial Sequence: Synthetic oligonucleotide
tcacaccctccagtggatgtatggctgc

SEQ ID NO: 26781 - DNA, 27 bp, Artificial Sequence
  Description of Artificial Sequence: Synthetic oligonucleotide
cacaccctccagtggatgtatggctgc

SEQ ID NO: 26782 - DNA, 27 bp, Artificial Sequence
  Description of Artificial Sequence: Synthetic oligonucleotide
acaccctccagtggatgtatggctgcg

SEQ ID NO: 26783 - DNA, 27 bp, Artificial Sequence
  Description of Artificial Sequence: Synthetic oligonucleotide
caccctccagtggatgtatggctgcga

SEQ ID NO: 26784 - DNA, 27 bp, Artificial Sequence
  Description of Artificial Sequence: Synthetic oligonucleotide
accctccagtggatgtatggctgcgac

SEQ ID NO: 26785 - DNA, 26 bp, Artificial Sequence
  Description of Artificial Sequence: Synthetic oligonucleotide
ccctccagtggatgtatggctgcgac

SEQ ID NO: 26786 - DNA, 27 bp, Artificial Sequence
  Description of Artificial Sequence: Synthetic oligonucleotide
cctccagtggatgtatggctgcgacgt

SEQ ID NO: 26787 - DNA, 27 bp, Artificial Sequence
  Description of Artificial Sequence: Synthetic oligonucleotide
ctccagtggatgtatggctgcgacgtg

SEQ ID NO: 26788 - DNA, 27 bp, Artificial Sequence
  Description of Artificial Sequence: Synthetic oligonucleotide
tccagtggatgtatggctgcgacgtgg

SEQ ID NO: 26789 - DNA, 26 bp, Artificial Sequence
  Description of Artificial Sequence: Synthetic oligonucleotide
ccagtggatgtatggctgcgacgtgg

SEQ ID NO: 26790 - DNA, 26 bp, Artificial Sequence
  Description of Artificial Sequence: Synthetic oligonucleotide
cagtggatgtatggctgcgacgtggg

SEQ ID NO: 26791 - DNA, 26 bp, Artificial Sequence
  Description of Artificial Sequence: Synthetic oligonucleotide
agtggatgtatggctgcgacgtgggg

SEQ ID NO: 26792 - DNA, 25 bp, Artificial Sequence
  Description of Artificial Sequence: Synthetic oligonucleotide
gtggatgtatggctgcgacgtgggg

SEQ ID NO: 26793 - DNA, 25 bp, Artificial Sequence
  Description of Artificial Sequence: Synthetic oligonucleotide
tggatgtatggctgcgacgtggggc

SEQ ID NO: 26794 - DNA, 27 bp, Artificial Sequence
  Description of Artificial Sequence: Synthetic oligonucleotide
cttgtggagaccagaccagcaggagac

SEQ ID NO: 26795 - DNA, 28 bp, Artificial Sequence
  Description of Artificial Sequence: Synthetic oligonucleotide
ttgtggagaccagaccagcaggagacag

SEQ ID NO: 26796 - DNA, 27 bp, Artificial Sequence
  Description of Artificial Sequence: Synthetic oligonucleotide
tgtggagaccagaccagcaggagacag

SEQ ID NO: 26797 - DNA, 27 bp, Artificial Sequence
  Description of Artificial Sequence: Synthetic oligonucleotide
gtggagaccagaccagcaggagacaga

SEQ ID NO: 26798 - DNA, 28 bp, Artificial Sequence
  Description of Artificial Sequence: Synthetic oligonucleotide
tggagaccagaccagcaggagacagaac

SEQ ID NO: 26799 - DNA, 27 bp, Artificial Sequence
  Description of Artificial Sequence: Synthetic oligonucleotide
ggagaccagaccagcaggagacagaac

SEQ ID NO: 26800 - DNA, 27 bp, Artificial Sequence
  Description of Artificial Sequence: Synthetic oligonucleotide
gagaccagaccagcaggagacagaacc

SEQ ID NO: 26801 - DNA, 29 bp, Artificial Sequence
  Description of Artificial Sequence: Synthetic oligonucleotide
agaccagaccagcaggagacagaaccttc

SEQ ID NO: 26802 - DNA, 28 bp, Artificial Sequence
  Description of Artificial Sequence: Synthetic oligonucleotide
gaccagaccagcaggagacagaaccttc

SEQ ID NO: 26803 - DNA, 28 bp, Artificial Sequence
  Description of Artificial Sequence: Synthetic oligonucleotide
accagaccagcaggagacagaaccttcc

SEQ ID NO: 26804 - DNA, 27 bp, Artificial Sequence
  Description of Artificial Sequence: Synthetic oligonucleotide
ccagaccagcaggagacagaaccttcc

SEQ ID NO: 26805 - DNA, 28 bp, Artificial Sequence
  Description of Artificial Sequence: Synthetic oligonucleotide
cagaccagcaggagacagaaccttccag

SEQ ID NO: 26806 - DNA, 30 bp, Artificial Sequence
  Description of Artificial Sequence: Synthetic oligonucleotide
agaccagcaggagacagaaccttccagaag

SEQ ID NO: 26807 - DNA, 29 bp, Artificial Sequence
  Description of Artificial Sequence: Synthetic oligonucleotide
gaccagcaggagacagaaccttccagaag

SEQ ID NO: 26808 - DNA, 30 bp, Artificial Sequence
  Description of Artificial Sequence: Synthetic oligonucleotide
accagcaggagacagaaccttccagaagtg

SEQ ID NO: 26809 - DNA, 29 bp, Artificial Sequence
  Description of Artificial Sequence: Synthetic oligonucleotide
ccagcaggagacagaaccttccagaagtg

SEQ ID NO: 26810 - DNA, 29 bp, Artificial Sequence
  Description of Artificial Sequence: Synthetic oligonucleotide
cagcaggagacagaaccttccagaagtgg

SEQ ID NO: 26811 - DNA, 29 bp, Artificial Sequence
  Description of Artificial Sequence: Synthetic oligonucleotide
agcaggagacagaaccttccagaagtggg

SEQ ID NO: 26812 - DNA, 28 bp, Artificial Sequence
  Description of Artificial Sequence: Synthetic oligonucleotide
gcaggagacagaaccttccagaagtggg

SEQ ID NO: 26813 - DNA, 28 bp, Artificial Sequence
  Description of Artificial Sequence: Synthetic oligonucleotide
caggagacagaaccttccagaagtgggc

SEQ ID NO: 26814 - DNA, 29 bp, Artificial Sequence
  Description of Artificial Sequence: Synthetic oligonucleotide
aggagacagaaccttccagaagtgggcag

SEQ ID NO: 26815 - DNA, 28 bp, Artificial Sequence
  Description of Artificial Sequence: Synthetic oligonucleotide
ggagacagaaccttccagaagtgggcag

SEQ ID NO: 26816 - DNA, 28 bp, Artificial Sequence
  Description of Artificial Sequence: Synthetic oligonucleotide
gagacagaaccttccagaagtgggcagc

SEQ ID NO: 26817 - DNA, 29 bp, Artificial Sequence
  Description of Artificial Sequence: Synthetic oligonucleotide
agacagaaccttccagaagtgggcagctg

SEQ ID NO: 26818 - DNA, 28 bp, Artificial Sequence
  Description of Artificial Sequence: Synthetic oligonucleotide
gacagaaccttccagaagtgggcagctg

SEQ ID NO: 26819 - DNA, 29 bp, Artificial Sequence
  Description of Artificial Sequence: Synthetic oligonucleotide
acagaaccttccagaagtgggcagctgtg

SEQ ID NO: 26820 - DNA, 28 bp, Artificial Sequence
  Description of Artificial Sequence: Synthetic oligonucleotide
cagaaccttccagaagtgggcagctgtg

SEQ ID NO: 26821 - DNA, 25 bp, Artificial Sequence
  Description of Artificial Sequence: Synthetic oligonucleotide
gagggagctactctcaggctgcgtc

SEQ ID NO: 26822 - DNA, 26 bp, Artificial Sequence
  Description of Artificial Sequence: Synthetic oligonucleotide
agggagctactctcaggctgcgtcca

SEQ ID NO: 26823 - DNA, 25 bp, Artificial Sequence
  Description of Artificial Sequence: Synthetic oligonucleotide
gggagctactctcaggctgcgtcca

SEQ ID NO: 26824 - DNA, 25 bp, Artificial Sequence
  Description of Artificial Sequence: Synthetic oligonucleotide
ggagctactctcaggctgcgtccag

SEQ ID NO: 26825 - DNA, 25 bp, Artificial Sequence
  Description of Artificial Sequence: Synthetic oligonucleotide
gagctactctcaggctgcgtccagc

SEQ ID NO: 26826 - DNA, 26 bp, Artificial Sequence
  Description of Artificial Sequence: Synthetic oligonucleotide
agctactctcaggctgcgtccagcga

SEQ ID NO: 26827 - DNA, 25 bp, Artificial Sequence
  Description of Artificial Sequence: Synthetic oligonucleotide
gctactctcaggctgcgtccagcga

SEQ ID NO: 26828 - DNA, 26 bp, Artificial Sequence
  Description of Artificial Sequence: Synthetic oligonucleotide
ctactctcaggctgcgtccagcgaca

SEQ ID NO: 26829 - DNA, 27 bp, Artificial Sequence
  Description of Artificial Sequence: Synthetic oligonucleotide
tactctcaggctgcgtccagcgacagt

SEQ ID NO: 26830 - DNA, 26 bp, Artificial Sequence
  Description of Artificial Sequence: Synthetic oligonucleotide
actctcaggctgcgtccagcgacagt

SEQ ID NO: 26831 - DNA, 25 bp, Artificial Sequence
  Description of Artificial Sequence: Synthetic oligonucleotide
ctctcaggctgcgtccagcgacagt

SEQ ID NO: 26832 - DNA, 25 bp, Artificial Sequence
  Description of Artificial Sequence: Synthetic oligonucleotide
tctcaggctgcgtccagcgacagtg

SEQ ID NO: 26833 - DNA, 24 bp, Artificial Sequence
  Description of Artificial Sequence: Synthetic oligonucleotide
ctcaggctgcgtccagcgacagtg

SEQ ID NO: 26834 - DNA, 24 bp, Artificial Sequence
  Description of Artificial Sequence: Synthetic oligonucleotide
tcaggctgcgtccagcgacagtgc

SEQ ID NO: 26835 - DNA, 23 bp, Artificial Sequence
  Description of Artificial Sequence: Synthetic oligonucleotide
caggctgcgtccagcgacagtgc

SEQ ID NO: 26836 - DNA, 23 bp, Artificial Sequence
  Description of Artificial Sequence: Synthetic oligonucleotide
aggctgcgtccagcgacagtgcc

SEQ ID NO: 26837 - DNA, 22 bp, Artificial Sequence
  Description of Artificial Sequence: Synthetic oligonucleotide
ggctgcgtccagcgacagtgcc

SEQ ID NO: 26838 - DNA, 23 bp, Artificial Sequence
  Description of Artificial Sequence: Synthetic oligonucleotide
gctgcgtccagcgacagtgccca

SEQ ID NO: 26839 - DNA, 23 bp, Artificial Sequence
  Description of Artificial Sequence: Synthetic oligonucleotide
ctgcgtccagcgacagtgcccag

SEQ ID NO: 26840 - DNA, 23 bp, Artificial Sequence
  Description of Artificial Sequence: Synthetic oligonucleotide
tgcgtccagcgacagtgcccagg

SEQ ID NO: 26841 - DNA, 22 bp, Artificial Sequence
  Description of Artificial Sequence: Synthetic oligonucleotide
gcgtccagcgacagtgcccagg

SEQ ID NO: 26842 - DNA, 22 bp, Artificial Sequence
  Description of Artificial Sequence: Synthetic oligonucleotide
cgtccagcgacagtgcccaggg

SEQ ID NO: 26843 - DNA, 23 bp, Artificial Sequence
  Description of Artificial Sequence: Synthetic oligonucleotide
gtccagcgacagtgcccagggct

SEQ ID NO: 26844 - DNA, 24 bp, Artificial Sequence
  Description of Artificial Sequence: Synthetic oligonucleotide
tccagcgacagtgcccagggctct

SEQ ID NO: 26845 - DNA, 23 bp, Artificial Sequence
  Description of Artificial Sequence: Synthetic oligonucleotide
ccagcgacagtgcccagggctct

SEQ ID NO: 26846 - DNA, 29 bp, Artificial Sequence
  Description of Artificial Sequence: Synthetic oligonucleotide
ccactccatgaggtatttctacaccgccg

SEQ ID NO: 26847 - DNA, 30 bp, Artificial Sequence
  Description of Artificial Sequence: Synthetic oligonucleotide
cactccatgaggtatttctacaccgccgtg

SEQ ID NO: 26848 - DNA, 31 bp, Artificial Sequence
  Description of Artificial Sequence: Synthetic oligonucleotide
actccatgaggtatttctacaccgccgtgtc

SEQ ID NO: 26849 - DNA, 30 bp, Artificial Sequence
  Description of Artificial Sequence: Synthetic oligonucleotide
ctccatgaggtatttctacaccgccgtgtc

SEQ ID NO: 26850 - DNA, 30 bp, Artificial Sequence
  Description of Artificial Sequence: Synthetic oligonucleotide
tccatgaggtatttctacaccgccgtgtcc

SEQ ID NO: 26851 - DNA, 29 bp, Artificial Sequence
  Description of Artificial Sequence: Synthetic oligonucleotide
ccatgaggtatttctacaccgccgtgtcc

SEQ ID NO: 26852 - DNA, 29 bp, Artificial Sequence
  Description of Artificial Sequence: Synthetic oligonucleotide
catgaggtatttctacaccgccgtgtccc

SEQ ID NO: 26853 - DNA, 29 bp, Artificial Sequence
  Description of Artificial Sequence: Synthetic oligonucleotide
atgaggtatttctacaccgccgtgtcccg

SEQ ID NO: 26854 - DNA, 28 bp, Artificial Sequence
  Description of Artificial Sequence: Synthetic oligonucleotide
tgaggtatttctacaccgccgtgtcccg

SEQ ID NO: 26855 - DNA, 27 bp, Artificial Sequence
  Description of Artificial Sequence: Synthetic oligonucleotide
gaggtatttctacaccgccgtgtcccg

SEQ ID NO: 26856 - DNA, 27 bp, Artificial Sequence
  Description of Artificial Sequence: Synthetic oligonucleotide
aggtatttctacaccgccgtgtcccgg

SEQ ID NO: 26857 - DNA, 26 bp, Artificial Sequence
  Description of Artificial Sequence: Synthetic oligonucleotide
ggtatttctacaccgccgtgtcccgg

SEQ ID NO: 26858 - DNA, 26 bp, Artificial Sequence
  Description of Artificial Sequence: Synthetic oligonucleotide
gtatttctacaccgccgtgtcccggc

SEQ ID NO: 26859 - DNA, 26 bp, Artificial Sequence
  Description of Artificial Sequence: Synthetic oligonucleotide
tatttctacaccgccgtgtcccggcc

SEQ ID NO: 26860 - DNA, 25 bp, Artificial Sequence
  Description of Artificial Sequence: Synthetic oligonucleotide
atttctacaccgccgtgtcccggcc

SEQ ID NO: 26861 - DNA, 24 bp, Artificial Sequence
  Description of Artificial Sequence: Synthetic oligonucleotide
tttctacaccgccgtgtcccggcc

SEQ ID NO: 26862 - DNA, 23 bp, Artificial Sequence
  Description of Artificial Sequence: Synthetic oligonucleotide
ttctacaccgccgtgtcccggcc

SEQ ID NO: 26863 - DNA, 22 bp, Artificial Sequence
  Description of Artificial Sequence: Synthetic oligonucleotide
tctacaccgccgtgtcccggcc

SEQ ID NO: 26864 - DNA, 21 bp, Artificial Sequence
  Description of Artificial Sequence: Synthetic oligonucleotide
ctacaccgccgtgtcccggcc

SEQ ID NO: 26865 - DNA, 21 bp, Artificial Sequence
  Description of Artificial Sequence: Synthetic oligonucleotide
tacaccgccgtgtcccggccc

SEQ ID NO: 26866 - DNA, 20 bp, Artificial Sequence
  Description of Artificial Sequence: Synthetic oligonucleotide
acaccgccgtgtcccggccc

SEQ ID NO: 26867 - DNA, 20 bp, Artificial Sequence
  Description of Artificial Sequence: Synthetic oligonucleotide
caccgccgtgtcccggccct

SEQ ID NO: 26868 - DNA, 20 bp, Artificial Sequence
  Description of Artificial Sequence: Synthetic oligonucleotide
accgccgtgtcccggcccgt

SEQ ID NO: 26869 - DNA, 20 bp, Artificial Sequence
  Description of Artificial Sequence: Synthetic oligonucleotide
ccgccgtgtcccggcccgtt

SEQ ID NO: 26870 - DNA, 20 bp, Artificial Sequence
  Description of Artificial Sequence: Synthetic oligonucleotide
cgccgtgtcccggcccggtt

SEQ ID NO: 26871 - DNA, 20 bp, Artificial Sequence
  Description of Artificial Sequence: Synthetic oligonucleotide
gccgtgtcccggcccggctt

SEQ ID NO: 26872 - DNA, 21 bp, Artificial Sequence
  Description of Artificial Sequence: Synthetic oligonucleotide
ctgagctcctggaccgcggcc

SEQ ID NO: 26873 - DNA, 22 bp, Artificial Sequence
  Description of Artificial Sequence: Synthetic oligonucleotide
tgagctcctggaccgcggccga

SEQ ID NO: 26874 - DNA, 21 bp, Artificial Sequence
  Description of Artificial Sequence: Synthetic oligonucleotide
gagctcctggaccgcggccga

SEQ ID NO: 26875 - DNA, 22 bp, Artificial Sequence
  Description of Artificial Sequence: Synthetic oligonucleotide
agctcctggaccgcggccgaca

SEQ ID NO: 26876 - DNA, 21 bp, Artificial Sequence
  Description of Artificial Sequence: Synthetic oligonucleotide
gctcctggaccgcggccgaca

SEQ ID NO: 26877 - DNA, 21 bp, Artificial Sequence
  Description of Artificial Sequence: Synthetic oligonucleotide
ctcctggaccgcggccgacac

SEQ ID NO: 26878 - DNA, 21 bp, Artificial Sequence
  Description of Artificial Sequence: Synthetic oligonucleotide
tcctggaccgcggccgacacc

SEQ ID NO: 26879 - DNA, 20 bp, Artificial Sequence
  Description of Artificial Sequence: Synthetic oligonucleotide
cctggaccgcggccgacacc

SEQ ID NO: 26880 - DNA, 20 bp, Artificial Sequence
  Description of Artificial Sequence: Synthetic oligonucleotide
ctggaccgcggccgacaccg

SEQ ID NO: 26881 - DNA, 20 bp, Artificial Sequence
  Description of Artificial Sequence: Synthetic oligonucleotide
tggaccgcggccgacaccgc

SEQ ID NO: 26882 - DNA, 20 bp, Artificial Sequence
  Description of Artificial Sequence: Synthetic oligonucleotide
ggaccgcggccgacaccgct

SEQ ID NO: 26883 - DNA, 20 bp, Artificial Sequence
  Description of Artificial Sequence: Synthetic oligonucleotide
gaccgcggccgacaccgcgt

SEQ ID NO: 26884 - DNA, 20 bp, Artificial Sequence
  Description of Artificial Sequence: Synthetic oligonucleotide
accgcggccgacaccgcggt

SEQ ID NO: 26885 - DNA, 20 bp, Artificial Sequence
  Description of Artificial Sequence: Synthetic oligonucleotide
ccgcggccgacaccgcggtt

SEQ ID NO: 26886 - DNA, 20 bp, Artificial Sequence
  Description of Artificial Sequence: Synthetic oligonucleotide
cgcggccgacaccgcggctt

SEQ ID NO: 26887 - DNA, 20 bp, Artificial Sequence
  Description of Artificial Sequence: Synthetic oligonucleotide
gcggccgacaccgcggctca

SEQ ID NO: 26888 - DNA, 22 bp, Artificial Sequence
  Description of Artificial Sequence: Synthetic oligonucleotide
cggccgacaccgcggctcagat

SEQ ID NO: 26889 - DNA, 23 bp, Artificial Sequence
  Description of Artificial Sequence: Synthetic oligonucleotide
ggccgacaccgcggctcagatca

SEQ ID NO: 26890 - DNA, 23 bp, Artificial Sequence
  Description of Artificial Sequence: Synthetic oligonucleotide
gccgacaccgcggctcagatcac

SEQ ID NO: 26891 - DNA, 23 bp, Artificial Sequence
  Description of Artificial Sequence: Synthetic oligonucleotide
ccgacaccgcggctcagatcacc

SEQ ID NO: 26892 - DNA, 24 bp, Artificial Sequence
  Description of Artificial Sequence: Synthetic oligonucleotide
cgacaccgcggctcagatcaccca

SEQ ID NO: 26893 - DNA, 24 bp, Artificial Sequence
  Description of Artificial Sequence: Synthetic oligonucleotide
agtccaccgtccccatcgtgggca

SEQ ID NO: 26894 - DNA, 27 bp, Artificial Sequence
  Description of Artificial Sequence: Synthetic oligonucleotide
ctgaacgaggacctgagctcctggact

SEQ ID NO: 26895 - DNA, 27 bp, Artificial Sequence
  Description of Artificial Sequence: Synthetic oligonucleotide
tgaacgaggacctgagctcctggactg

SEQ ID NO: 26896 - DNA, 26 bp, Artificial Sequence
  Description of Artificial Sequence: Synthetic oligonucleotide
gaacgaggacctgagctcctggactg

SEQ ID NO: 26897 - DNA, 26 bp, Artificial Sequence
  Description of Artificial Sequence: Synthetic oligonucleotide
aacgaggacctgagctcctggactgc

SEQ ID NO: 26898 - DNA, 25 bp, Artificial Sequence
  Description of Artificial Sequence: Synthetic oligonucleotide
acgaggacctgagctcctggactgc

SEQ ID NO: 26899 - DNA, 24 bp, Artificial Sequence
  Description of Artificial Sequence: Synthetic oligonucleotide
cgaggacctgagctcctggactgc

SEQ ID NO: 26900 - DNA, 24 bp, Artificial Sequence
  Description of Artificial Sequence: Synthetic oligonucleotide
gaggacctgagctcctggactgcg

SEQ ID NO: 26901 - DNA, 24 bp, Artificial Sequence
  Description of Artificial Sequence: Synthetic oligonucleotide
aggacctgagctcctggactgcgg

SEQ ID NO: 26902 - DNA, 23 bp, Artificial Sequence
  Description of Artificial Sequence: Synthetic oligonucleotide
ggacctgagctcctggactgcgg

SEQ ID NO: 26903 - DNA, 23 bp, Artificial Sequence
  Description of Artificial Sequence: Synthetic oligonucleotide
gacctgagctcctggactgcggc

SEQ ID NO: 26904 - DNA, 23 bp, Artificial Sequence
  Description of Artificial Sequence: Synthetic oligonucleotide
acctgagctcctggactgcggcg

SEQ ID NO: 26905 - DNA, 22 bp, Artificial Sequence
  Description of Artificial Sequence: Synthetic oligonucleotide
cctgagctcctggactgcggcg

SEQ ID NO: 26906 - DNA, 23 bp, Artificial Sequence
  Description of Artificial Sequence: Synthetic oligonucleotide
ctgagctcctggactgcggcgga

SEQ ID NO: 26907 - DNA, 24 bp, Artificial Sequence
  Description of Artificial Sequence: Synthetic oligonucleotide
tgagctcctggactgcggcggaca

SEQ ID NO: 26908 - DNA, 23 bp, Artificial Sequence
  Description of Artificial Sequence: Synthetic oligonucleotide
gagctcctggactgcggcggaca

SEQ ID NO: 26909 - DNA, 23 bp, Artificial Sequence
  Description of Artificial Sequence: Synthetic oligonucleotide
agctcctggactgcggcggacac

SEQ ID NO: 26910 - DNA, 22 bp, Artificial Sequence
  Description of Artificial Sequence: Synthetic oligonucleotide
gctcctggactgcggcggacac

SEQ ID NO: 26911 - DNA, 22 bp, Artificial Sequence
  Description of Artificial Sequence: Synthetic oligonucleotide
ctcctggactgcggcggacacc

SEQ ID NO: 26912 - DNA, 22 bp, Artificial Sequence
  Description of Artificial Sequence: Synthetic oligonucleotide
tcctggactgcggcggacaccg

SEQ ID NO: 26913 - DNA, 21 bp, Artificial Sequence
  Description of Artificial Sequence: Synthetic oligonucleotide
cctggactgcggcggacaccg

SEQ ID NO: 26914 - DNA, 21 bp, Artificial Sequence
  Description of Artificial Sequence: Synthetic oligonucleotide
ctggactgcggcggacaccgc

SEQ ID NO: 26915 - DNA, 21 bp, Artificial Sequence
  Description of Artificial Sequence: Synthetic oligonucleotide
tggactgcggcggacaccgcg

SEQ ID NO: 26916 - DNA, 20 bp, Artificial Sequence
  Description of Artificial Sequence: Synthetic oligonucleotide
ggactgcggcggacaccgcg

SEQ ID NO: 26917 - DNA, 20 bp, Artificial Sequence
  Description of Artificial Sequence: Synthetic oligonucleotide
gactgcggcggacaccgcgg

SEQ ID NO: 26918 - DNA, 21 bp, Artificial Sequence
  Description of Artificial Sequence: Synthetic oligonucleotide
actgcggcggacaccgcggct

SEQ ID NO: 26919 - DNA, 20 bp, Artificial Sequence
  Description of Artificial Sequence: Synthetic oligonucleotide
ctgcggcggacaccgcggct

SEQ ID NO: 26920 - DNA, 21 bp, Artificial Sequence
  Description of Artificial Sequence: Synthetic oligonucleotide
tgcggcggacaccgcggctca

SEQ ID NO: 26921 - DNA, 27 bp, Artificial Sequence
  Description of Artificial Sequence: Synthetic oligonucleotide
agactgaccgagagagcctgcggaact

SEQ ID NO: 26922 - DNA, 27 bp, Artificial Sequence
  Description of Artificial Sequence: Synthetic oligonucleotide
gactgaccgagagagcctgcggaactt

SEQ ID NO: 26923 - DNA, 27 bp, Artificial Sequence
  Description of Artificial Sequence: Synthetic oligonucleotide
actgaccgagagagcctgcggaacttg

SEQ ID NO: 26924 - DNA, 26 bp, Artificial Sequence
  Description of Artificial Sequence: Synthetic oligonucleotide
ctgaccgagagagcctgcggaacttg

SEQ ID NO: 26925 - DNA, 26 bp, Artificial Sequence
  Description of Artificial Sequence: Synthetic oligonucleotide
tgaccgagagagcctgcggaacttgc

SEQ ID NO: 26926 - DNA, 25 bp, Artificial Sequence
  Description of Artificial Sequence: Synthetic oligonucleotide
gaccgagagagcctgcggaacttgc

SEQ ID NO: 26927 - DNA, 25 bp, Artificial Sequence
  Description of Artificial Sequence: Synthetic oligonucleotide
accgagagagcctgcggaacttgcg

SEQ ID NO: 26928 - DNA, 24 bp, Artificial Sequence
  Description of Artificial Sequence: Synthetic oligonucleotide
ccgagagagcctgcggaacttgcg

SEQ ID NO: 26929 - DNA, 24 bp, Artificial Sequence
  Description of Artificial Sequence: Synthetic oligonucleotide
cgagagagcctgcggaacttgcgc

SEQ ID NO: 26930 - DNA, 24 bp, Artificial Sequence
  Description of Artificial Sequence: Synthetic oligonucleotide
gagagagcctgcggaacttgcgcg

SEQ ID NO: 26931 - DNA, 24 bp, Artificial Sequence
  Description of Artificial Sequence: Synthetic oligonucleotide
agagagcctgcggaacttgcgcgg

SEQ ID NO: 26932 - DNA, 23 bp, Artificial Sequence
  Description of Artificial Sequence: Synthetic oligonucleotide
gagagcctgcggaacttgcgcgg

SEQ ID NO: 26933 - DNA, 25 bp, Artificial Sequence
  Description of Artificial Sequence: Synthetic oligonucleotide
agagcctgcggaacttgcgcggcta

SEQ ID NO: 26934 - DNA, 24 bp, Artificial Sequence
  Description of Artificial Sequence: Synthetic oligonucleotide
gagcctgcggaacttgcgcggcta

SEQ ID NO: 26935 - DNA, 26 bp, Artificial Sequence
  Description of Artificial Sequence: Synthetic oligonucleotide
agcctgcggaacttgcgcggctacta

SEQ ID NO: 26936 - DNA, 25 bp, Artificial Sequence
  Description of Artificial Sequence: Synthetic oligonucleotide
gcctgcggaacttgcgcggctacta

SEQ ID NO: 26937 - DNA, 27 bp, Artificial Sequence
  Description of Artificial Sequence: Synthetic oligonucleotide
cctgcggaacttgcgcggctactacaa

SEQ ID NO: 26938 - DNA, 27 bp, Artificial Sequence
  Description of Artificial Sequence: Synthetic oligonucleotide
ctgcggaacttgcgcggctactacaac

SEQ ID NO: 26939 - DNA, 27 bp, Artificial Sequence
  Description of Artificial Sequence: Synthetic oligonucleotide
tgcggaacttgcgcggctactacaacc

SEQ ID NO: 26940 - DNA, 27 bp, Artificial Sequence
  Description of Artificial Sequence: Synthetic oligonucleotide
gcggaacttgcgcggctactacaacca

SEQ ID NO: 26941 - DNA, 27 bp, Artificial Sequence
  Description of Artificial Sequence: Synthetic oligonucleotide
cggaacttgcgcggctactacaaccag

SEQ ID NO: 26942 - DNA, 28 bp, Artificial Sequence
  Description of Artificial Sequence: Synthetic oligonucleotide
ggaacttgcgcggctactacaaccagag

SEQ ID NO: 26943 - DNA, 28 bp, Artificial Sequence
  Description of Artificial Sequence: Synthetic oligonucleotide
gaacttgcgcggctactacaaccagagc

SEQ ID NO: 26944 - DNA, 28 bp, Artificial Sequence
  Description of Artificial Sequence: Synthetic oligonucleotide
aacttgcgcggctactacaaccagagcg

SEQ ID NO: 26945 - DNA, 27 bp, Artificial Sequence
  Description of Artificial Sequence: Synthetic oligonucleotide
acttgcgcggctactacaaccagagcg

SEQ ID NO: 26946 - DNA, 27 bp, Artificial Sequence
  Description of Artificial Sequence: Synthetic oligonucleotide
cttgcgcggctactacaaccagagcga

SEQ ID NO: 26947 - DNA, 27 bp, Artificial Sequence
  Description of Artificial Sequence: Synthetic oligonucleotide
ttgcgcggctactacaaccagagcgag

SEQ ID NO: 26948 - DNA, 29 bp, Artificial Sequence
  Description of Artificial Sequence: Synthetic oligonucleotide
gctcccactccatgaggcatttctacacc

SEQ ID NO: 26949 - DNA, 29 bp, Artificial Sequence
  Description of Artificial Sequence: Synthetic oligonucleotide
ctcccactccatgaggcatttctacaccg

SEQ ID NO: 26950 - DNA, 29 bp, Artificial Sequence
  Description of Artificial Sequence: Synthetic oligonucleotide
tcccactccatgaggcatttctacaccgc

SEQ ID NO: 26951 - DNA, 28 bp, Artificial Sequence
  Description of Artificial Sequence: Synthetic oligonucleotide
cccactccatgaggcatttctacaccgc

SEQ ID NO: 26952 - DNA, 28 bp, Artificial Sequence
  Description of Artificial Sequence: Synthetic oligonucleotide
ccactccatgaggcatttctacaccgcc

SEQ ID NO: 26953 - DNA, 28 bp, Artificial Sequence
  Description of Artificial Sequence: Synthetic oligonucleotide
cactccatgaggcatttctacaccgccg

SEQ ID NO: 26954 - DNA, 29 bp, Artificial Sequence
  Description of Artificial Sequence: Synthetic oligonucleotide
actccatgaggcatttctacaccgccgtg

SEQ ID NO: 26955 - DNA, 28 bp, Artificial Sequence
  Description of Artificial Sequence: Synthetic oligonucleotide
ctccatgaggcatttctacaccgccgtg

SEQ ID NO: 26956 - DNA, 29 bp, Artificial Sequence
  Description of Artificial Sequence: Synthetic oligonucleotide
tccatgaggcatttctacaccgccgtgtc

SEQ ID NO: 26957 - DNA, 28 bp, Artificial Sequence
  Description of Artificial Sequence: Synthetic oligonucleotide
ccatgaggcatttctacaccgccgtgtc

SEQ ID NO: 26958 - DNA, 28 bp, Artificial Sequence
  Description of Artificial Sequence: Synthetic oligonucleotide
catgaggcatttctacaccgccgtgtcc

SEQ ID NO: 26959 - DNA, 28 bp, Artificial Sequence
  Description of Artificial Sequence: Synthetic oligonucleotide
atgaggcatttctacaccgccgtgtccc

SEQ ID NO: 26960 - DNA, 27 bp, Artificial Sequence
  Description of Artificial Sequence: Synthetic oligonucleotide
tgaggcatttctacaccgccgtgtccc

SEQ ID NO: 26961 - DNA, 26 bp, Artificial Sequence
  Description of Artificial Sequence: Synthetic oligonucleotide
gaggcatttctacaccgccgtgtccc

SEQ ID NO: 26962 - DNA, 26 bp, Artificial Sequence
  Description of Artificial Sequence: Synthetic oligonucleotide
aggcatttctacaccgccgtgtcccg

SEQ ID NO: 26963 - DNA, 25 bp, Artificial Sequence
  Description of Artificial Sequence: Synthetic oligonucleotide
ggcatttctacaccgccgtgtcccg

SEQ ID NO: 26964 - DNA, 25 bp, Artificial Sequence
  Description of Artificial Sequence: Synthetic oligonucleotide
gcatttctacaccgccgtgtcccgg

SEQ ID NO: 26965 - DNA, 25 bp, Artificial Sequence
  Description of Artificial Sequence: Synthetic oligonucleotide
catttctacaccgccgtgtcccggc

SEQ ID NO: 26966 - DNA, 30 bp, Artificial Sequence
  Description of Artificial Sequence: Synthetic oligonucleotide
ccggaatattgggaccggaacacacagaac

SEQ ID NO: 26967 - DNA, 31 bp, Artificial Sequence
  Description of Artificial Sequence: Synthetic oligonucleotide
cggaatattgggaccggaacacacagaactg

SEQ ID NO: 26968 - DNA, 31 bp, Artificial Sequence
  Description of Artificial Sequence: Synthetic oligonucleotide
ggaatattgggaccggaacacacagaactgc

SEQ ID NO: 26969 - DNA, 33 bp, Artificial Sequence
  Description of Artificial Sequence: Synthetic oligonucleotide
gaatattgggaccggaacacacagaactgcaag

SEQ ID NO: 26970 - DNA, 34 bp, Artificial Sequence
  Description of Artificial Sequence: Synthetic oligonucleotide
aatattgggaccggaacacacagaactgcaagac

SEQ ID NO: 26971 - DNA, 33 bp, Artificial Sequence
  Description of Artificial Sequence: Synthetic oligonucleotide
atattgggaccggaacacacagaactgcaagac

SEQ ID NO: 26972 - DNA, 32 bp, Artificial Sequence
  Description of Artificial Sequence: Synthetic oligonucleotide
tattgggaccggaacacacagaactgcaagac

SEQ ID NO: 26973 - DNA, 31 bp, Artificial Sequence
  Description of Artificial Sequence: Synthetic oligonucleotide
attgggaccggaacacacagaactgcaagac

SEQ ID NO: 26974 - DNA, 30 bp, Artificial Sequence
  Description of Artificial Sequence: Synthetic oligonucleotide
ttgggaccggaacacacagaactgcaagac

SEQ ID NO: 26975 - DNA, 29 bp, Artificial Sequence
  Description of Artificial Sequence: Synthetic oligonucleotide
tgggaccggaacacacagaactgcaagac

SEQ ID NO: 26976 - DNA, 28 bp, Artificial Sequence
  Description of Artificial Sequence: Synthetic oligonucleotide
gggaccggaacacacagaactgcaagac

SEQ ID NO: 26977 - DNA, 28 bp, Artificial Sequence
  Description of Artificial Sequence: Synthetic oligonucleotide
ggaccggaacacacagaactgcaagacc

SEQ ID NO: 26978 - DNA, 30 bp, Artificial Sequence
  Description of Artificial Sequence: Synthetic oligonucleotide
gaccggaacacacagaactgcaagaccaac

SEQ ID NO: 26979 - DNA, 31 bp, Artificial Sequence
  Description of Artificial Sequence: Synthetic oligonucleotide
accggaacacacagaactgcaagaccaacac

SEQ ID NO: 26980 - DNA, 30 bp, Artificial Sequence
  Description of Artificial Sequence: Synthetic oligonucleotide
ccggaacacacagaactgcaagaccaacac

SEQ ID NO: 26981 - DNA, 31 bp, Artificial Sequence
  Description of Artificial Sequence: Synthetic oligonucleotide
cggaacacacagaactgcaagaccaacacac

SEQ ID NO: 26982 - DNA, 32 bp, Artificial Sequence
  Description of Artificial Sequence: Synthetic oligonucleotide
ggaacacacagaactgcaagaccaacacacag

SEQ ID NO: 26983 - DNA, 33 bp, Artificial Sequence
  Description of Artificial Sequence: Synthetic oligonucleotide
gaacacacagaactgcaagaccaacacacagac

SEQ ID NO: 26984 - DNA, 34 bp, Artificial Sequence
  Description of Artificial Sequence: Synthetic oligonucleotide
aacacacagaactgcaagaccaacacacagactg

SEQ ID NO: 26985 - DNA, 33 bp, Artificial Sequence
  Description of Artificial Sequence: Synthetic oligonucleotide
acacacagaactgcaagaccaacacacagactg

SEQ ID NO: 26986 - DNA, 32 bp, Artificial Sequence
  Description of Artificial Sequence: Synthetic oligonucleotide
cacacagaactgcaagaccaacacacagactg

SEQ ID NO: 26987 - DNA, 33 bp, Artificial Sequence
  Description of Artificial Sequence: Synthetic oligonucleotide
acacagaactgcaagaccaacacacagactgac

SEQ ID NO: 26988 - DNA, 32 bp, Artificial Sequence
  Description of Artificial Sequence: Synthetic oligonucleotide
cacagaactgcaagaccaacacacagactgac

SEQ ID NO: 26989 - DNA, 32 bp, Artificial Sequence
  Description of Artificial Sequence: Synthetic oligonucleotide
acagaactgcaagaccaacacacagactgacc

SEQ ID NO: 26990 - DNA, 31 bp, Artificial Sequence
  Description of Artificial Sequence: Synthetic oligonucleotide
cagaactgcaagaccaacacacagactgacc

SEQ ID NO: 26991 - DNA, 31 bp, Artificial Sequence
  Description of Artificial Sequence: Synthetic oligonucleotide
agaactgcaagaccaacacacagactgaccg

SEQ ID NO: 26992 - DNA, 30 bp, Artificial Sequence
  Description of Artificial Sequence: Synthetic oligonucleotide
gaactgcaagaccaacacacagactgaccg

SEQ ID NO: 26993 - DNA, 31 bp, Artificial Sequence
  Description of Artificial Sequence: Synthetic oligonucleotide
aactgcaagaccaacacacagactgaccgag

SEQ ID NO: 26994 - DNA, 30 bp, Artificial Sequence
  Description of Artificial Sequence: Synthetic oligonucleotide
actgcaagaccaacacacagactgaccgag

SEQ ID NO: 26995 - DNA, 25 bp, Artificial Sequence
  Description of Artificial Sequence: Synthetic oligonucleotide
cacgtgagtggagtggctccgcaga

SEQ ID NO: 26996 - DNA, 26 bp, Artificial Sequence
  Description of Artificial Sequence: Synthetic oligonucleotide
acgtgagtggagtggctccgcagaca

SEQ ID NO: 26997 - DNA, 25 bp, Artificial Sequence
  Description of Artificial Sequence: Synthetic oligonucleotide
cgtgagtggagtggctccgcagaca

SEQ ID NO: 26998 - DNA, 25 bp, Artificial Sequence
  Description of Artificial Sequence: Synthetic oligonucleotide
gtgagtggagtggctccgcagacac

SEQ ID NO: 26999 - DNA, 26 bp, Artificial Sequence
  Description of Artificial Sequence: Synthetic oligonucleotide
tgagtggagtggctccgcagacacct

SEQ ID NO: 27000 - DNA, 25 bp, Artificial Sequence
  Description of Artificial Sequence: Synthetic oligonucleotide
gagtggagtggctccgcagacacct

SEQ ID NO: 27001 - DNA, 25 bp, Artificial Sequence
  Description of Artificial Sequence: Synthetic oligonucleotide
agtggagtggctccgcagacacctg

SEQ ID NO: 27002 - DNA, 22 bp, Artificial Sequence
  Description of Artificial Sequence: Synthetic oligonucleotide
acctgagctcctggaccgcggg

SEQ ID NO: 27003 - DNA, 21 bp, Artificial Sequence
  Description of Artificial Sequence: Synthetic oligonucleotide
cctgagctcctggaccgcggg

SEQ ID NO: 27004 - DNA, 21 bp, Artificial Sequence
  Description of Artificial Sequence: Synthetic oligonucleotide
ctgagctcctggaccgcgggg

SEQ ID NO: 27005 - DNA, 22 bp, Artificial Sequence
  Description of Artificial Sequence: Synthetic oligonucleotide
tgagctcctggaccgcggggga

SEQ ID NO: 27006 - DNA, 21 bp, Artificial Sequence
  Description of Artificial Sequence: Synthetic oligonucleotide
gagctcctggaccgcggggga

SEQ ID NO: 27007 - DNA, 22 bp, Artificial Sequence
  Description of Artificial Sequence: Synthetic oligonucleotide
agctcctggaccgcgggggaca

SEQ ID NO: 27008 - DNA, 21 bp, Artificial Sequence
  Description of Artificial Sequence: Synthetic oligonucleotide
gctcctggaccgcgggggaca

SEQ ID NO: 27009 - DNA, 21 bp, Artificial Sequence
  Description of Artificial Sequence: Synthetic oligonucleotide
ctcctggaccgcgggggacac

SEQ ID NO: 27010 - DNA, 21 bp, Artificial Sequence
  Description of Artificial Sequence: Synthetic oligonucleotide
tcctggaccgcgggggacacc

SEQ ID NO: 27011 - DNA, 20 bp, Artificial Sequence
  Description of Artificial Sequence: Synthetic oligonucleotide
cctggaccgcgggggacacc

SEQ ID NO: 27012 - DNA, 20 bp, Artificial Sequence
  Description of Artificial Sequence: Synthetic oligonucleotide
ctggaccgcgggggacaccg

SEQ ID NO: 27013 - DNA, 20 bp, Artificial Sequence
  Description of Artificial Sequence: Synthetic oligonucleotide
tggaccgcgggggacaccgc

SEQ ID NO: 27014 - DNA, 20 bp, Artificial Sequence
  Description of Artificial Sequence: Synthetic oligonucleotide
ggaccgcgggggacaccgct

SEQ ID NO: 27015 - DNA, 20 bp, Artificial Sequence
  Description of Artificial Sequence: Synthetic oligonucleotide
gaccgcgggggacaccgcgt

SEQ ID NO: 27016 - DNA, 20 bp, Artificial Sequence
  Description of Artificial Sequence: Synthetic oligonucleotide
accgcgggggacaccgcggt

SEQ ID NO: 27017 - DNA, 20 bp, Artificial Sequence
  Description of Artificial Sequence: Synthetic oligonucleotide
ccgcgggggacaccgcggtt

SEQ ID NO: 27018 - DNA, 20 bp, Artificial Sequence
  Description of Artificial Sequence: Synthetic oligonucleotide
cgcgggggacaccgcggctt

SEQ ID NO: 27019 - DNA, 20 bp, Artificial Sequence
  Description of Artificial Sequence: Synthetic oligonucleotide
gcgggggacaccgcggctca

SEQ ID NO: 27020 - DNA, 22 bp, Artificial Sequence
  Description of Artificial Sequence: Synthetic oligonucleotide
cgggggacaccgcggctcagat

SEQ ID NO: 27021 - DNA, 23 bp, Artificial Sequence
  Description of Artificial Sequence: Synthetic oligonucleotide
gggggacaccgcggctcagatca

SEQ ID NO: 27022 - DNA, 23 bp, Artificial Sequence
  Description of Artificial Sequence: Synthetic oligonucleotide
ggggacaccgcggctcagatcac

SEQ ID NO: 27023 - DNA, 23 bp, Artificial Sequence
  Description of Artificial Sequence: Synthetic oligonucleotide
gggacaccgcggctcagatcacc

SEQ ID NO: 27024 - DNA, 21 bp, Artificial Sequence
  Description of Artificial Sequence: Synthetic oligonucleotide
gcccgtgaggcggagcagctg

SEQ ID NO: 27025 - DNA, 21 bp, Artificial Sequence
  Description of Artificial Sequence: Synthetic oligonucleotide
cccgtgaggcggagcagctgg

SEQ ID NO: 27026 - DNA, 22 bp, Artificial Sequence
  Description of Artificial Sequence: Synthetic oligonucleotide
ccgtgaggcggagcagctggga

SEQ ID NO: 27027 - DNA, 22 bp, Artificial Sequence
  Description of Artificial Sequence: Synthetic oligonucleotide
cgtgaggcggagcagctgggag

SEQ ID NO: 27028 - DNA, 22 bp, Artificial Sequence
  Description of Artificial Sequence: Synthetic oligonucleotide
gtgaggcggagcagctgggagc

SEQ ID NO: 27029 - DNA, 24 bp, Artificial Sequence
  Description of Artificial Sequence: Synthetic oligonucleotide
tgaggcggagcagctgggagccta

SEQ ID NO: 27030 - DNA, 23 bp, Artificial Sequence
  Description of Artificial Sequence: Synthetic oligonucleotide
gaggcggagcagctgggagccta

SEQ ID NO: 27031 - DNA, 23 bp, Artificial Sequence
  Description of Artificial Sequence: Synthetic oligonucleotide
aggcggagcagctgggagcctac

SEQ ID NO: 27032 - DNA, 22 bp, Artificial Sequence
  Description of Artificial Sequence: Synthetic oligonucleotide
ggcggagcagctgggagcctac

SEQ ID NO: 27033 - DNA, 23 bp, Artificial Sequence
  Description of Artificial Sequence: Synthetic oligonucleotide
gcggagcagctgggagcctacct

SEQ ID NO: 27034 - DNA, 23 bp, Artificial Sequence
  Description of Artificial Sequence: Synthetic oligonucleotide
cggagcagctgggagcctacctg

SEQ ID NO: 27035 - DNA, 24 bp, Artificial Sequence
  Description of Artificial Sequence: Synthetic oligonucleotide
ggagcagctgggagcctacctgga

SEQ ID NO: 27036 - DNA, 24 bp, Artificial Sequence
  Description of Artificial Sequence: Synthetic oligonucleotide
gagcagctgggagcctacctggag

SEQ ID NO: 27037 - DNA, 24 bp, Artificial Sequence
  Description of Artificial Sequence: Synthetic oligonucleotide
agcagctgggagcctacctggagg

SEQ ID NO: 27038 - DNA, 23 bp, Artificial Sequence
  Description of Artificial Sequence: Synthetic oligonucleotide
gcagctgggagcctacctggagg

SEQ ID NO: 27039 - DNA, 23 bp, Artificial Sequence
  Description of Artificial Sequence: Synthetic oligonucleotide
cagctgggagcctacctggaggg

SEQ ID NO: 27040 - DNA, 24 bp, Artificial Sequence
  Description of Artificial Sequence: Synthetic oligonucleotide
agctgggagcctacctggagggca

SEQ ID NO: 27041 - DNA, 23 bp, Artificial Sequence
  Description of Artificial Sequence: Synthetic oligonucleotide
gctgggagcctacctggagggca

SEQ ID NO: 27042 - DNA, 23 bp, Artificial Sequence
  Description of Artificial Sequence: Synthetic oligonucleotide
ctgggagcctacctggagggcac

SEQ ID NO: 27043 - DNA, 24 bp, Artificial Sequence
  Description of Artificial Sequence: Synthetic oligonucleotide
tgggagcctacctggagggcacgt

SEQ ID NO: 27044 - DNA, 23 bp, Artificial Sequence
  Description of Artificial Sequence: Synthetic oligonucleotide
gggagcctacctggagggcacgt

SEQ ID NO: 27045 - DNA, 23 bp, Artificial Sequence
  Description of Artificial Sequence: Synthetic oligonucleotide
ggagcctacctggagggcacgtg

SEQ ID NO: 27046 - DNA, 36 bp, Artificial Sequence
  Description of Artificial Sequence: Synthetic oligonucleotide
aacacacagatctgcaagaccaacacacagacttac

SEQ ID NO: 27047 - DNA, 35 bp, Artificial Sequence
  Description of Artificial Sequence: Synthetic oligonucleotide
acacacagatctgcaagaccaacacacagacttac

SEQ ID NO: 27048 - DNA, 34 bp, Artificial Sequence
  Description of Artificial Sequence: Synthetic oligonucleotide
cacacagatctgcaagaccaacacacagacttac

SEQ ID NO: 27049 - DNA, 34 bp, Artificial Sequence
  Description of Artificial Sequence: Synthetic oligonucleotide
acacagatctgcaagaccaacacacagacttacc

SEQ ID NO: 27050 - DNA, 33 bp, Artificial Sequence
  Description of Artificial Sequence: Synthetic oligonucleotide
cacagatctgcaagaccaacacacagacttacc

SEQ ID NO: 27051 - DNA, 33 bp, Artificial Sequence
  Description of Artificial Sequence: Synthetic oligonucleotide
acagatctgcaagaccaacacacagacttaccg

SEQ ID NO: 27052 - DNA, 32 bp, Artificial Sequence
  Description of Artificial Sequence: Synthetic oligonucleotide
cagatctgcaagaccaacacacagacttaccg

SEQ ID NO: 27053 - DNA, 33 bp, Artificial Sequence
  Description of Artificial Sequence: Synthetic oligonucleotide
agatctgcaagaccaacacacagacttaccgag

SEQ ID NO: 27054 - DNA, 32 bp, Artificial Sequence
  Description of Artificial Sequence: Synthetic oligonucleotide
gatctgcaagaccaacacacagacttaccgag

SEQ ID NO: 27055 - DNA, 33 bp, Artificial Sequence
  Description of Artificial Sequence: Synthetic oligonucleotide
atctgcaagaccaacacacagacttaccgagag

SEQ ID NO: 27056 - DNA, 32 bp, Artificial Sequence
  Description of Artificial Sequence: Synthetic oligonucleotide
tctgcaagaccaacacacagacttaccgagag

SEQ ID NO: 27057 - DNA, 31 bp, Artificial Sequence
  Description of Artificial Sequence: Synthetic oligonucleotide
ctgcaagaccaacacacagacttaccgagag

SEQ ID NO: 27058 - DNA, 32 bp, Artificial Sequence
  Description of Artificial Sequence: Synthetic oligonucleotide
tgcaagaccaacacacagacttaccgagagag

SEQ ID NO: 27059 - DNA, 31 bp, Artificial Sequence
  Description of Artificial Sequence: Synthetic oligonucleotide
gcaagaccaacacacagacttaccgagagag

SEQ ID NO: 27060 - DNA, 30 bp, Artificial Sequence
  Description of Artificial Sequence: Synthetic oligonucleotide
ttcatctcagtgggctacgtggacgacatg

SEQ ID NO: 27061 - DNA, 29 bp, Artificial Sequence
  Description of Artificial Sequence: Synthetic oligonucleotide
tcatctcagtgggctacgtggacgacatg

SEQ ID NO: 27062 - DNA, 28 bp, Artificial Sequence
  Description of Artificial Sequence: Synthetic oligonucleotide
catctcagtgggctacgtggacgacatg

SEQ ID NO: 27063 - DNA, 28 bp, Artificial Sequence
  Description of Artificial Sequence: Synthetic oligonucleotide
atctcagtgggctacgtggacgacatgc

SEQ ID NO: 27064 - DNA, 27 bp, Artificial Sequence
  Description of Artificial Sequence: Synthetic oligonucleotide
tctcagtgggctacgtggacgacatgc

SEQ ID NO: 27065 - DNA, 27 bp, Artificial Sequence
  Description of Artificial Sequence: Synthetic oligonucleotide
ctcagtgggctacgtggacgacatgca

SEQ ID NO: 27066 - DNA, 27 bp, Artificial Sequence
  Description of Artificial Sequence: Synthetic oligonucleotide
tcagtgggctacgtggacgacatgcag

SEQ ID NO: 27067 - DNA, 27 bp, Artificial Sequence
  Description of Artificial Sequence: Synthetic oligonucleotide
cagtgggctacgtggacgacatgcagt

SEQ ID NO: 27068 - DNA, 28 bp, Artificial Sequence
  Description of Artificial Sequence: Synthetic oligonucleotide
agtgggctacgtggacgacatgcagttc

SEQ ID NO: 27069 - DNA, 28 bp, Artificial Sequence
  Description of Artificial Sequence: Synthetic oligonucleotide
gctacgtggacgacatgcagttcgtgag

SEQ ID NO: 27070 - DNA, 28 bp, Artificial Sequence
  Description of Artificial Sequence: Synthetic oligonucleotide
ctacgtggacgacatgcagttcgtgagg

SEQ ID NO: 27071 - DNA, 30 bp, Artificial Sequence
  Description of Artificial Sequence: Synthetic oligonucleotide
tacgtggacgacatgcagttcgtgaggttc

SEQ ID NO: 27072 - DNA, 29 bp, Artificial Sequence
  Description of Artificial Sequence: Synthetic oligonucleotide
acgtggacgacatgcagttcgtgaggttc

SEQ ID NO: 27073 - DNA, 28 bp, Artificial Sequence
  Description of Artificial Sequence: Synthetic oligonucleotide
cgtggacgacatgcagttcgtgaggttc

SEQ ID NO: 27074 - DNA, 28 bp, Artificial Sequence
  Description of Artificial Sequence: Synthetic oligonucleotide
gtggacgacatgcagttcgtgaggttcg

SEQ ID NO: 27075 - DNA, 29 bp, Artificial Sequence
  Description of Artificial Sequence: Synthetic oligonucleotide
tggacgacatgcagttcgtgaggttcgac

SEQ ID NO: 27076 - DNA, 28 bp, Artificial Sequence
  Description of Artificial Sequence: Synthetic oligonucleotide
ggacgacatgcagttcgtgaggttcgac

SEQ ID NO: 27077 - DNA, 29 bp, Artificial Sequence
  Description of Artificial Sequence: Synthetic oligonucleotide
gacgacatgcagttcgtgaggttcgacag

SEQ ID NO: 27078 - DNA, 29 bp, Artificial Sequence
  Description of Artificial Sequence: Synthetic oligonucleotide
acgacatgcagttcgtgaggttcgacagc

SEQ ID NO: 27079 - DNA, 28 bp, Artificial Sequence
  Description of Artificial Sequence: Synthetic oligonucleotide
cgacatgcagttcgtgaggttcgacagc

SEQ ID NO: 27080 - DNA, 28 bp, Artificial Sequence
  Description of Artificial Sequence: Synthetic oligonucleotide
gacatgcagttcgtgaggttcgacagcg

SEQ ID NO: 27081 - DNA, 29 bp, Artificial Sequence
  Description of Artificial Sequence: Synthetic oligonucleotide
acatgcagttcgtgaggttcgacagcgac

SEQ ID NO: 27082 - DNA, 28 bp, Artificial Sequence
  Description of Artificial Sequence: Synthetic oligonucleotide
catgcagttcgtgaggttcgacagcgac

SEQ ID NO: 27083 - DNA, 28 bp, Artificial Sequence
  Description of Artificial Sequence: Synthetic oligonucleotide
atgcagttcgtgaggttcgacagcgacg

SEQ ID NO: 27084 - DNA, 27 bp, Artificial Sequence
  Description of Artificial Sequence: Synthetic oligonucleotide
tgcagttcgtgaggttcgacagcgacg

SEQ ID NO: 27085 - DNA, 20 bp, Artificial Sequence
  Description of Artificial Sequence: Synthetic oligonucleotide
gcggcggacaccgcggctct

SEQ ID NO: 27086 - DNA, 20 bp, Artificial Sequence
  Description of Artificial Sequence: Synthetic oligonucleotide
cggcggacaccgcggctcgt

SEQ ID NO: 27087 - DNA, 21 bp, Artificial Sequence
  Description of Artificial Sequence: Synthetic oligonucleotide
ggcggacaccgcggctcggat

SEQ ID NO: 27088 - DNA, 22 bp, Artificial Sequence
  Description of Artificial Sequence: Synthetic oligonucleotide
gcggacaccgcggctcggatca

SEQ ID NO: 27089 - DNA, 22 bp, Artificial Sequence
  Description of Artificial Sequence: Synthetic oligonucleotide
cggacaccgcggctcggatcac

SEQ ID NO: 27090 - DNA, 22 bp, Artificial Sequence
  Description of Artificial Sequence: Synthetic oligonucleotide
ggacaccgcggctcggatcacc

SEQ ID NO: 27091 - DNA, 23 bp, Artificial Sequence
  Description of Artificial Sequence: Synthetic oligonucleotide
gacaccgcggctcggatcaccca

SEQ ID NO: 27092 - DNA, 23 bp, Artificial Sequence
  Description of Artificial Sequence: Synthetic oligonucleotide
acaccgcggctcggatcacccag

SEQ ID NO: 27093 - DNA, 22 bp, Artificial Sequence
  Description of Artificial Sequence: Synthetic oligonucleotide
caccgcggctcggatcacccag

SEQ ID NO: 27094 - DNA, 22 bp, Artificial Sequence
  Description of Artificial Sequence: Synthetic oligonucleotide
accgcggctcggatcacccagc

SEQ ID NO: 27095 - DNA, 21 bp, Artificial Sequence
  Description of Artificial Sequence: Synthetic oligonucleotide
ccgcggctcggatcacccagc

SEQ ID NO: 27096 - DNA, 21 bp, Artificial Sequence
  Description of Artificial Sequence: Synthetic oligonucleotide
cgcggctcggatcacccagcg

SEQ ID NO: 27097 - DNA, 30 bp, Artificial Sequence
  Description of Artificial Sequence: Synthetic oligonucleotide
atgaggtatttctacaccgccgtgtcccag

SEQ ID NO: 27098 - DNA, 29 bp, Artificial Sequence
  Description of Artificial Sequence: Synthetic oligonucleotide
tgaggtatttctacaccgccgtgtcccag

SEQ ID NO: 27099 - DNA, 28 bp, Artificial Sequence
  Description of Artificial Sequence: Synthetic oligonucleotide
gaggtatttctacaccgccgtgtcccag

SEQ ID NO: 27100 - DNA, 28 bp, Artificial Sequence
  Description of Artificial Sequence: Synthetic oligonucleotide
aggtatttctacaccgccgtgtcccagc

SEQ ID NO: 27101 - DNA, 27 bp, Artificial Sequence
  Description of Artificial Sequence: Synthetic oligonucleotide
ggtatttctacaccgccgtgtcccagc

SEQ ID NO: 27102 - DNA, 27 bp, Artificial Sequence
  Description of Artificial Sequence: Synthetic oligonucleotide
gtatttctacaccgccgtgtcccagcc

SEQ ID NO: 27103 - DNA, 27 bp, Artificial Sequence
  Description of Artificial Sequence: Synthetic oligonucleotide
tatttctacaccgccgtgtcccagccc

SEQ ID NO: 27104 - DNA, 26 bp, Artificial Sequence
  Description of Artificial Sequence: Synthetic oligonucleotide
atttctacaccgccgtgtcccagccc

SEQ ID NO: 27105 - DNA, 25 bp, Artificial Sequence
  Description of Artificial Sequence: Synthetic oligonucleotide
tttctacaccgccgtgtcccagccc

SEQ ID NO: 27106 - DNA, 24 bp, Artificial Sequence
  Description of Artificial Sequence: Synthetic oligonucleotide
ttctacaccgccgtgtcccagccc

SEQ ID NO: 27107 - DNA, 23 bp, Artificial Sequence
  Description of Artificial Sequence: Synthetic oligonucleotide
tctacaccgccgtgtcccagccc

SEQ ID NO: 27108 - DNA, 22 bp, Artificial Sequence
  Description of Artificial Sequence: Synthetic oligonucleotide
ctacaccgccgtgtcccagccc

SEQ ID NO: 27109 - DNA, 22 bp, Artificial Sequence
  Description of Artificial Sequence: Synthetic oligonucleotide
tacaccgccgtgtcccagcccg

SEQ ID NO: 27110 - DNA, 21 bp, Artificial Sequence
  Description of Artificial Sequence: Synthetic oligonucleotide
acaccgccgtgtcccagcccg

SEQ ID NO: 27111 - DNA, 20 bp, Artificial Sequence
  Description of Artificial Sequence: Synthetic oligonucleotide
caccgccgtgtcccagcccg

SEQ ID NO: 27112 - DNA, 20 bp, Artificial Sequence
  Description of Artificial Sequence: Synthetic oligonucleotide
accgccgtgtcccagcccgg

SEQ ID NO: 27113 - DNA, 20 bp, Artificial Sequence
  Description of Artificial Sequence: Synthetic oligonucleotide
ccgccgtgtcccagcccggt

SEQ ID NO: 27114 - DNA, 20 bp, Artificial Sequence
  Description of Artificial Sequence: Synthetic oligonucleotide
cgccgtgtcccagcccggct

SEQ ID NO: 27115 - DNA, 20 bp, Artificial Sequence
  Description of Artificial Sequence: Synthetic oligonucleotide
gccgtgtcccagcccggcct

SEQ ID NO: 27116 - DNA, 25 bp, Artificial Sequence
  Description of Artificial Sequence: Synthetic oligonucleotide
aaccgtcctcctgctgctctcggga

SEQ ID NO: 27117 - DNA, 24 bp, Artificial Sequence
  Description of Artificial Sequence: Synthetic oligonucleotide
accgtcctcctgctgctctcggga

SEQ ID NO: 27118 - DNA, 23 bp, Artificial Sequence
  Description of Artificial Sequence: Synthetic oligonucleotide
ccgtcctcctgctgctctcggga

SEQ ID NO: 27119 - DNA, 23 bp, Artificial Sequence
  Description of Artificial Sequence: Synthetic oligonucleotide
cgtcctcctgctgctctcgggag

SEQ ID NO: 27120 - DNA, 23 bp, Artificial Sequence
  Description of Artificial Sequence: Synthetic oligonucleotide
gtcctcctgctgctctcgggagc

SEQ ID NO: 27121 - DNA, 23 bp, Artificial Sequence
  Description of Artificial Sequence: Synthetic oligonucleotide
tcctcctgctgctctcgggagcc

SEQ ID NO: 27122 - DNA, 22 bp, Artificial Sequence
  Description of Artificial Sequence: Synthetic oligonucleotide
cctcctgctgctctcgggagcc

SEQ ID NO: 27123 - DNA, 23 bp, Artificial Sequence
  Description of Artificial Sequence: Synthetic oligonucleotide
ctcctgctgctctcgggagccct

SEQ ID NO: 27124 - DNA, 23 bp, Artificial Sequence
  Description of Artificial Sequence: Synthetic oligonucleotide
tcctgctgctctcgggagccctg

SEQ ID NO: 27125 - DNA, 22 bp, Artificial Sequence
  Description of Artificial Sequence: Synthetic oligonucleotide
cctgctgctctcgggagccctg

SEQ ID NO: 27126 - DNA, 22 bp, Artificial Sequence
  Description of Artificial Sequence: Synthetic oligonucleotide
ctgctgctctcgggagccctgg

SEQ ID NO: 27127 - DNA, 22 bp, Artificial Sequence
  Description of Artificial Sequence: Synthetic oligonucleotide
tgctgctctcgggagccctggc

SEQ ID NO: 27128 - DNA, 21 bp, Artificial Sequence
  Description of Artificial Sequence: Synthetic oligonucleotide
gctgctctcgggagccctggc

SEQ ID NO: 27129 - DNA, 21 bp, Artificial Sequence
  Description of Artificial Sequence: Synthetic oligonucleotide
ctgctctcgggagccctggcc

SEQ ID NO: 27130 - DNA, 22 bp, Artificial Sequence
  Description of Artificial Sequence: Synthetic oligonucleotide
tgctctcgggagccctggccct

SEQ ID NO: 27131 - DNA, 21 bp, Artificial Sequence
  Description of Artificial Sequence: Synthetic oligonucleotide
gctctcgggagccctggccct

SEQ ID NO: 27132 - DNA, 22 bp, Artificial Sequence
  Description of Artificial Sequence: Synthetic oligonucleotide
ctctcgggagccctggccctga

SEQ ID NO: 27133 - DNA, 22 bp, Artificial Sequence
  Description of Artificial Sequence: Synthetic oligonucleotide
tctcgggagccctggccctgac

SEQ ID NO: 27134 - DNA, 21 bp, Artificial Sequence
  Description of Artificial Sequence: Synthetic oligonucleotide
ctcgggagccctggccctgac

SEQ ID NO: 27135 - DNA, 21 bp, Artificial Sequence
  Description of Artificial Sequence: Synthetic oligonucleotide
tcgggagccctggccctgacc

SEQ ID NO: 27136 - DNA, 20 bp, Artificial Sequence
  Description of Artificial Sequence: Synthetic oligonucleotide
cgggagccctggccctgacc

SEQ ID NO: 27137 - DNA, 21 bp, Artificial Sequence
  Description of Artificial Sequence: Synthetic oligonucleotide
gggagccctggccctgaccga

SEQ ID NO: 27138 - DNA, 22 bp, Artificial Sequence
  Description of Artificial Sequence: Synthetic oligonucleotide
ggagccctggccctgaccgaga

SEQ ID NO: 27139 - DNA, 22 bp, Artificial Sequence
  Description of Artificial Sequence: Synthetic oligonucleotide
gagccctggccctgaccgagac

SEQ ID NO: 27140 - DNA, 23 bp, Artificial Sequence
  Description of Artificial Sequence: Synthetic oligonucleotide
agccctggccctgaccgagacct

SEQ ID NO: 27141 - DNA, 23 bp, Artificial Sequence
  Description of Artificial Sequence: Synthetic oligonucleotide
agcgacgccgcgagtccgaggat

SEQ ID NO: 27142 - DNA, 22 bp, Artificial Sequence
  Description of Artificial Sequence: Synthetic oligonucleotide
gcgacgccgcgagtccgaggat

SEQ ID NO: 27143 - DNA, 22 bp, Artificial Sequence
  Description of Artificial Sequence: Synthetic oligonucleotide
cgacgccgcgagtccgaggatg

SEQ ID NO: 27144 - DNA, 22 bp, Artificial Sequence
  Description of Artificial Sequence: Synthetic oligonucleotide
gacgccgcgagtccgaggatgg

SEQ ID NO: 27145 - DNA, 22 bp, Artificial Sequence
  Description of Artificial Sequence: Synthetic oligonucleotide
acgccgcgagtccgaggatggc

SEQ ID NO: 27146 - DNA, 21 bp, Artificial Sequence
  Description of Artificial Sequence: Synthetic oligonucleotide
cgccgcgagtccgaggatggc

SEQ ID NO: 27147 - DNA, 21 bp, Artificial Sequence
  Description of Artificial Sequence: Synthetic oligonucleotide
gccgcgagtccgaggatggcg

SEQ ID NO: 27148 - DNA, 21 bp, Artificial Sequence
  Description of Artificial Sequence: Synthetic oligonucleotide
ccgcgagtccgaggatggcgc

SEQ ID NO: 27149 - DNA, 21 bp, Artificial Sequence
  Description of Artificial Sequence: Synthetic oligonucleotide
cgcgagtccgaggatggcgcc

SEQ ID NO: 27150 - DNA, 21 bp, Artificial Sequence
  Description of Artificial Sequence: Synthetic oligonucleotide
gcgagtccgaggatggcgccc

SEQ ID NO: 27151 - DNA, 31 bp, Artificial Sequence
  Description of Artificial Sequence: Synthetic oligonucleotide
ctactgtgatgtgtaggaggaagagctcagg

SEQ ID NO: 27152 - DNA, 32 bp, Artificial Sequence
  Description of Artificial Sequence: Synthetic oligonucleotide
tactgtgatgtgtaggaggaagagctcaggtg

SEQ ID NO: 27153 - DNA, 31 bp, Artificial Sequence
  Description of Artificial Sequence: Synthetic oligonucleotide
actgtgatgtgtaggaggaagagctcaggtg

SEQ ID NO: 27154 - DNA, 22 bp, Artificial Sequence
  Description of Artificial Sequence: Synthetic oligonucleotide
cctgaccgagacctgggccggt

SEQ ID NO: 27155 - DNA, 23 bp, Artificial Sequence
  Description of Artificial Sequence: Synthetic oligonucleotide
ctgaccgagacctgggccggtga

SEQ ID NO: 27156 - DNA, 24 bp, Artificial Sequence
  Description of Artificial Sequence: Synthetic oligonucleotide
tgaccgagacctgggccggtgagt

SEQ ID NO: 27157 - DNA, 23 bp, Artificial Sequence
  Description of Artificial Sequence: Synthetic oligonucleotide
gaccgagacctgggccggtgagt

SEQ ID NO: 27158 - DNA, 23 bp, Artificial Sequence
  Description of Artificial Sequence: Synthetic oligonucleotide
accgagacctgggccggtgagtg

SEQ ID NO: 27159 - DNA, 22 bp, Artificial Sequence
  Description of Artificial Sequence: Synthetic oligonucleotide
ccgagacctgggccggtgagtg

SEQ ID NO: 27160 - DNA, 22 bp, Artificial Sequence
  Description of Artificial Sequence: Synthetic oligonucleotide
cgagacctgggccggtgagtgc

SEQ ID NO: 27161 - DNA, 22 bp, Artificial Sequence
  Description of Artificial Sequence: Synthetic oligonucleotide
gagacctgggccggtgagtgcg

SEQ ID NO: 27162 - DNA, 22 bp, Artificial Sequence
  Description of Artificial Sequence: Synthetic oligonucleotide
agacctgggccggtgagtgcgg

SEQ ID NO: 27163 - DNA, 21 bp, Artificial Sequence
  Description of Artificial Sequence: Synthetic oligonucleotide
gacctgggccggtgagtgcgg

SEQ ID NO: 27164 - DNA, 21 bp, Artificial Sequence
  Description of Artificial Sequence: Synthetic oligonucleotide
acctgggccggtgagtgcggg

SEQ ID NO: 27165 - DNA, 20 bp, Artificial Sequence
  Description of Artificial Sequence: Synthetic oligonucleotide
cctgggccggtgagtgcggg

SEQ ID NO: 27166 - DNA, 21 bp, Artificial Sequence
  Description of Artificial Sequence: Synthetic oligonucleotide
ctgggccggtgagtgcggggt

SEQ ID NO: 27167 - DNA, 21 bp, Artificial Sequence
  Description of Artificial Sequence: Synthetic oligonucleotide
tgggccggtgagtgcggggtc

SEQ ID NO: 27168 - DNA, 20 bp, Artificial Sequence
  Description of Artificial Sequence: Synthetic oligonucleotide
gggccggtgagtgcggggtc

SEQ ID NO: 27169 - DNA, 20 bp, Artificial Sequence
  Description of Artificial Sequence: Synthetic oligonucleotide
ggccggtgagtgcggggtcg

SEQ ID NO: 27170 - DNA, 20 bp, Artificial Sequence
  Description of Artificial Sequence: Synthetic oligonucleotide
gccggtgagtgcggggtcgg

SEQ ID NO: 27171 - DNA, 21 bp, Artificial Sequence
  Description of Artificial Sequence: Synthetic oligonucleotide
ccggtgagtgcggggtcggca

SEQ ID NO: 27172 - DNA, 21 bp, Artificial Sequence
  Description of Artificial Sequence: Synthetic oligonucleotide
cggtgagtgcggggtcggcag

SEQ ID NO: 27173 - DNA, 21 bp, Artificial Sequence
  Description of Artificial Sequence: Synthetic oligonucleotide
ggtgagtgcggggtcggcagg

SEQ ID NO: 27174 - DNA, 25 bp, Artificial Sequence
  Description of Artificial Sequence: Synthetic oligonucleotide
gtgagtgcggggtcggcagggaaat

SEQ ID NO: 27175 - DNA, 25 bp, Artificial Sequence
  Description of Artificial Sequence: Synthetic oligonucleotide
tgagtgcggggtcggcagggaaatg

SEQ ID NO: 27176 - DNA, 24 bp, Artificial Sequence
  Description of Artificial Sequence: Synthetic oligonucleotide
gagtgcggggtcggcagggaaatg

SEQ ID NO: 27177 - DNA, 24 bp, Artificial Sequence
  Description of Artificial Sequence: Synthetic oligonucleotide
agtgcggggtcggcagggaaatgg

SEQ ID NO: 27178 - DNA, 23 bp, Artificial Sequence
  Description of Artificial Sequence: Synthetic oligonucleotide
gtgcggggtcggcagggaaatgg

SEQ ID NO: 27179 - DNA, 23 bp, Artificial Sequence
  Description of Artificial Sequence: Synthetic oligonucleotide
tgcggggtcggcagggaaatggc

SEQ ID NO: 27180 - DNA, 22 bp, Artificial Sequence
  Description of Artificial Sequence: Synthetic oligonucleotide
gcggggtcggcagggaaatggc

SEQ ID NO: 27181 - DNA, 23 bp, Artificial Sequence
  Description of Artificial Sequence: Synthetic oligonucleotide
cggggtcggcagggaaatggcct

SEQ ID NO: 27182 - DNA, 24 bp, Artificial Sequence
  Description of Artificial Sequence: Synthetic oligonucleotide
ggggtcggcagggaaatggcctct

SEQ ID NO: 27183 - DNA, 25 bp, Artificial Sequence
  Description of Artificial Sequence: Synthetic oligonucleotide
gggtcggcagggaaatggcctctgt

SEQ ID NO: 27184 - DNA, 25 bp, Artificial Sequence
  Description of Artificial Sequence: Synthetic oligonucleotide
ggtcggcagggaaatggcctctgtg

SEQ ID NO: 27185 - DNA, 25 bp, Artificial Sequence
  Description of Artificial Sequence: Synthetic oligonucleotide
gtcggcagggaaatggcctctgtgg

SEQ ID NO: 27186 - DNA, 25 bp, Artificial Sequence
  Description of Artificial Sequence: Synthetic oligonucleotide
tcggcagggaaatggcctctgtggg

SEQ ID NO: 27187 - DNA, 24 bp, Artificial Sequence
  Description of Artificial Sequence: Synthetic oligonucleotide
cggcagggaaatggcctctgtggg

SEQ ID NO: 27188 - DNA, 25 bp, Artificial Sequence
  Description of Artificial Sequence: Synthetic oligonucleotide
ggcagggaaatggcctctgtgggga

SEQ ID NO: 27189 - DNA, 25 bp, Artificial Sequence
  Description of Artificial Sequence: Synthetic oligonucleotide
gcagggaaatggcctctgtggggag

SEQ ID NO: 27190 - DNA, 26 bp, Artificial Sequence
  Description of Artificial Sequence: Synthetic oligonucleotide
cagggaaatggcctctgtggggagga

SEQ ID NO: 27191 - DNA, 26 bp, Artificial Sequence
  Description of Artificial Sequence: Synthetic oligonucleotide
agggaaatggcctctgtggggaggag

SEQ ID NO: 27192 - DNA, 25 bp, Artificial Sequence
  Description of Artificial Sequence: Synthetic oligonucleotide
gggaaatggcctctgtggggaggag

SEQ ID NO: 27193 - DNA, 25 bp, Artificial Sequence
  Description of Artificial Sequence: Synthetic oligonucleotide
ggaaatggcctctgtggggaggagc

SEQ ID NO: 27194 - DNA, 26 bp, Artificial Sequence
  Description of Artificial Sequence: Synthetic oligonucleotide
gaaatggcctctgtggggaggagcga

SEQ ID NO: 27195 - DNA, 26 bp, Artificial Sequence
  Description of Artificial Sequence: Synthetic oligonucleotide
aaatggcctctgtggggaggagcgag

SEQ ID NO: 27196 - DNA, 25 bp, Artificial Sequence
  Description of Artificial Sequence: Synthetic oligonucleotide
aatggcctctgtggggaggagcgag

SEQ ID NO: 27197 - DNA, 24 bp, Artificial Sequence
  Description of Artificial Sequence: Synthetic oligonucleotide
atggcctctgtggggaggagcgag

SEQ ID NO: 27198 - DNA, 23 bp, Artificial Sequence
  Description of Artificial Sequence: Synthetic oligonucleotide
tggcctctgtggggaggagcgag

SEQ ID NO: 27199 - DNA, 22 bp, Artificial Sequence
  Description of Artificial Sequence: Synthetic oligonucleotide
ggcctctgtggggaggagcgag

SEQ ID NO: 27200 - DNA, 22 bp, Artificial Sequence
  Description of Artificial Sequence: Synthetic oligonucleotide
gcctctgtggggaggagcgagg

SEQ ID NO: 27201 - DNA, 22 bp, Artificial Sequence
  Description of Artificial Sequence: Synthetic oligonucleotide
cctctgtggggaggagcgaggg

SEQ ID NO: 27202 - DNA, 23 bp, Artificial Sequence
  Description of Artificial Sequence: Synthetic oligonucleotide
ctctgtggggaggagcgagggga

SEQ ID NO: 27203 - DNA, 23 bp, Artificial Sequence
  Description of Artificial Sequence: Synthetic oligonucleotide
tctgtggggaggagcgaggggac

SEQ ID NO: 27204 - DNA, 22 bp, Artificial Sequence
  Description of Artificial Sequence: Synthetic oligonucleotide
ctgtggggaggagcgaggggac

SEQ ID NO: 27205 - DNA, 22 bp, Artificial Sequence
  Description of Artificial Sequence: Synthetic oligonucleotide
tgtggggaggagcgaggggacc

SEQ ID NO: 27206 - DNA, 21 bp, Artificial Sequence
  Description of Artificial Sequence: Synthetic oligonucleotide
gtggggaggagcgaggggacc

SEQ ID NO: 27207 - DNA, 21 bp, Artificial Sequence
  Description of Artificial Sequence: Synthetic oligonucleotide
tggggaggagcgaggggaccg

SEQ ID NO: 27208 - DNA, 20 bp, Artificial Sequence
  Description of Artificial Sequence: Synthetic oligonucleotide
ggggaggagcgaggggaccg

SEQ ID NO: 27209 - DNA, 21 bp, Artificial Sequence
  Description of Artificial Sequence: Synthetic oligonucleotide
gggaggagcgaggggaccgca

SEQ ID NO: 27210 - DNA, 21 bp, Artificial Sequence
  Description of Artificial Sequence: Synthetic oligonucleotide
ggaggagcgaggggaccgcag

SEQ ID NO: 27211 - DNA, 21 bp, Artificial Sequence
  Description of Artificial Sequence: Synthetic oligonucleotide
gaggagcgaggggaccgcagg

SEQ ID NO: 27212 - DNA, 21 bp, Artificial Sequence
  Description of Artificial Sequence: Synthetic oligonucleotide
aggagcgaggggaccgcaggc

SEQ ID NO: 27213 - DNA, 20 bp, Artificial Sequence
  Description of Artificial Sequence: Synthetic oligonucleotide
ggagcgaggggaccgcaggc

SEQ ID NO: 27214 - DNA, 20 bp, Artificial Sequence
  Description of Artificial Sequence: Synthetic oligonucleotide
gagcgaggggaccgcaggcg

SEQ ID NO: 27215 - DNA, 20 bp, Artificial Sequence
  Description of Artificial Sequence: Synthetic oligonucleotide
agcgaggggaccgcaggcgg

SEQ ID NO: 27216 - DNA, 20 bp, Artificial Sequence
  Description of Artificial Sequence: Synthetic oligonucleotide
gcgaggggaccgcaggcggt

SEQ ID NO: 27217 - DNA, 20 bp, Artificial Sequence
  Description of Artificial Sequence: Synthetic oligonucleotide
cgaggggaccgcaggcgggt

SEQ ID NO: 27218 - DNA, 20 bp, Artificial Sequence
  Description of Artificial Sequence: Synthetic oligonucleotide
gaggggaccgcaggcggggt

SEQ ID NO: 27219 - DNA, 20 bp, Artificial Sequence
  Description of Artificial Sequence: Synthetic oligonucleotide
aggggaccgcaggcgggggt

SEQ ID NO: 27220 - DNA, 20 bp, Artificial Sequence
  Description of Artificial Sequence: Synthetic oligonucleotide
ggggaccgcaggcgggggtt

SEQ ID NO: 27221 - DNA, 20 bp, Artificial Sequence
  Description of Artificial Sequence: Synthetic oligonucleotide
gggaccgcaggcgggggctt

SEQ ID NO: 27222 - DNA, 20 bp, Artificial Sequence
  Description of Artificial Sequence: Synthetic oligonucleotide
ggaccgcaggcgggggcgtt

SEQ ID NO: 27223 - DNA, 20 bp, Artificial Sequence
  Description of Artificial Sequence: Synthetic oligonucleotide
gaccgcaggcgggggcgcat

SEQ ID NO: 27224 - DNA, 20 bp, Artificial Sequence
  Description of Artificial Sequence: Synthetic oligonucleotide
accgcaggcgggggcgcagt

SEQ ID NO: 27225 - DNA, 20 bp, Artificial Sequence
  Description of Artificial Sequence: Synthetic oligonucleotide
ccgcaggcgggggcgcagtt

SEQ ID NO: 27226 - DNA, 20 bp, Artificial Sequence
  Description of Artificial Sequence: Synthetic oligonucleotide
cgcaggcgggggcgcaggat

SEQ ID NO: 27227 - DNA, 20 bp, Artificial Sequence
  Description of Artificial Sequence: Synthetic oligonucleotide
gcaggcgggggcgcaggact

SEQ ID NO: 27228 - DNA, 20 bp, Artificial Sequence
  Description of Artificial Sequence: Synthetic oligonucleotide
caggcgggggcgcaggacct

SEQ ID NO: 27229 - DNA, 20 bp, Artificial Sequence
  Description of Artificial Sequence: Synthetic oligonucleotide
aggcgggggcgcaggaccct

SEQ ID NO: 27230 - DNA, 20 bp, Artificial Sequence
  Description of Artificial Sequence: Synthetic oligonucleotide
ggcgggggcgcaggaccctt

SEQ ID NO: 27231 - DNA, 20 bp, Artificial Sequence
  Description of Artificial Sequence: Synthetic oligonucleotide
gcgggggcgcaggacccgtt

SEQ ID NO: 27232 - DNA, 20 bp, Artificial Sequence
  Description of Artificial Sequence: Synthetic oligonucleotide
cgggggcgcaggacccggtt

SEQ ID NO: 27233 - DNA, 20 bp, Artificial Sequence
  Description of Artificial Sequence: Synthetic oligonucleotide
gggggcgcaggacccgggtt

SEQ ID NO: 27234 - DNA, 20 bp, Artificial Sequence
  Description of Artificial Sequence: Synthetic oligonucleotide
ggggcgcaggacccggggat

SEQ ID NO: 27235 - DNA, 20 bp, Artificial Sequence
  Description of Artificial Sequence: Synthetic oligonucleotide
gggcgcaggacccggggagt

SEQ ID NO: 27236 - DNA, 20 bp, Artificial Sequence
  Description of Artificial Sequence: Synthetic oligonucleotide
ggcgcaggacccggggagct

SEQ ID NO: 27237 - DNA, 20 bp, Artificial Sequence
  Description of Artificial Sequence: Synthetic oligonucleotide
gcgcaggacccggggagcct

SEQ ID NO: 27238 - DNA, 20 bp, Artificial Sequence
  Description of Artificial Sequence: Synthetic oligonucleotide
cgcaggacccggggagccgt

SEQ ID NO: 27239 - DNA, 20 bp, Artificial Sequence
  Description of Artificial Sequence: Synthetic oligonucleotide
gcaggacccggggagccgct

SEQ ID NO: 27240 - DNA, 20 bp, Artificial Sequence
  Description of Artificial Sequence: Synthetic oligonucleotide
caggacccggggagccgcgt

SEQ ID NO: 27241 - DNA, 20 bp, Artificial Sequence
  Description of Artificial Sequence: Synthetic oligonucleotide
aggacccggggagccgcgct

SEQ ID NO: 27242 - DNA, 20 bp, Artificial Sequence
  Description of Artificial Sequence: Synthetic oligonucleotide
ggacccggggagccgcgctt

SEQ ID NO: 27243 - DNA, 20 bp, Artificial Sequence
  Description of Artificial Sequence: Synthetic oligonucleotide
gacccggggagccgcgcctt

SEQ ID NO: 27244 - DNA, 20 bp, Artificial Sequence
  Description of Artificial Sequence: Synthetic oligonucleotide
acccggggagccgcgccgtt

SEQ ID NO: 27245 - DNA, 20 bp, Artificial Sequence
  Description of Artificial Sequence: Synthetic oligonucleotide
cccggggagccgcgccgttt

SEQ ID NO: 27246 - DNA, 20 bp, Artificial Sequence
  Description of Artificial Sequence: Synthetic oligonucleotide
ccggggagccgcgccggttt

SEQ ID NO: 27247 - DNA, 20 bp, Artificial Sequence
  Description of Artificial Sequence: Synthetic oligonucleotide
cggggagccgcgccgggatt

SEQ ID NO: 27248 - DNA, 20 bp, Artificial Sequence
  Description of Artificial Sequence: Synthetic oligonucleotide
ggggagccgcgccgggagtt

SEQ ID NO: 27249 - DNA, 20 bp, Artificial Sequence
  Description of Artificial Sequence: Synthetic oligonucleotide
gggagccgcgccgggaggat

SEQ ID NO: 27250 - DNA, 20 bp, Artificial Sequence
  Description of Artificial Sequence: Synthetic oligonucleotide
ggagccgcgccgggaggagt

SEQ ID NO: 27251 - DNA, 20 bp, Artificial Sequence
  Description of Artificial Sequence: Synthetic oligonucleotide
gagccgcgccgggaggaggt

SEQ ID NO: 27252 - DNA, 20 bp, Artificial Sequence
  Description of Artificial Sequence: Synthetic oligonucleotide
agccgcgccgggaggagggt

SEQ ID NO: 27253 - DNA, 20 bp, Artificial Sequence
  Description of Artificial Sequence: Synthetic oligonucleotide
gccgcgccgggaggagggtt

SEQ ID NO: 27254 - DNA, 20 bp, Artificial Sequence
  Description of Artificial Sequence: Synthetic oligonucleotide
ccgcgccgggaggagggtct

SEQ ID NO: 27255 - DNA, 20 bp, Artificial Sequence
  Description of Artificial Sequence: Synthetic oligonucleotide
cgcgccgggaggagggtcgt

SEQ ID NO: 27256 - DNA, 20 bp, Artificial Sequence
  Description of Artificial Sequence: Synthetic oligonucleotide
gcgccgggaggagggtcggt

SEQ ID NO: 27257 - DNA, 20 bp, Artificial Sequence
  Description of Artificial Sequence: Synthetic oligonucleotide
cgccgggaggagggtcgggt

SEQ ID NO: 27258 - DNA, 20 bp, Artificial Sequence
  Description of Artificial Sequence: Synthetic oligonucleotide
gccgggaggagggtcgggct

SEQ ID NO: 27259 - DNA, 20 bp, Artificial Sequence
  Description of Artificial Sequence: Synthetic oligonucleotide
ccgggaggagggtcgggcct

SEQ ID NO: 27260 - DNA, 20 bp, Artificial Sequence
  Description of Artificial Sequence: Synthetic oligonucleotide
cgggaggagggtcgggccct

SEQ ID NO: 27261 - DNA, 20 bp, Artificial Sequence
  Description of Artificial Sequence: Synthetic oligonucleotide
gggaggagggtcgggcccct

SEQ ID NO: 27262 - DNA, 20 bp, Artificial Sequence
  Description of Artificial Sequence: Synthetic oligonucleotide
ggaggagggtcgggcccctc

SEQ ID NO: 27263 - DNA, 21 bp, Artificial Sequence
  Description of Artificial Sequence: Synthetic oligonucleotide
gaggagggtcgggcccctcct

SEQ ID NO: 27264 - DNA, 21 bp, Artificial Sequence
  Description of Artificial Sequence: Synthetic oligonucleotide
aggagggtcgggcccctcctc

SEQ ID NO: 27265 - DNA, 20 bp, Artificial Sequence
  Description of Artificial Sequence: Synthetic oligonucleotide
ggagggtcgggcccctcctc

SEQ ID NO: 27266 - DNA, 20 bp, Artificial Sequence
  Description of Artificial Sequence: Synthetic oligonucleotide
gagggtcgggcccctcctcg

SEQ ID NO: 27267 - DNA, 20 bp, Artificial Sequence
  Description of Artificial Sequence: Synthetic oligonucleotide
agggtcgggcccctcctcgc

SEQ ID NO: 27268 - DNA, 20 bp, Artificial Sequence
  Description of Artificial Sequence: Synthetic oligonucleotide
gggtcgggcccctcctcgct

SEQ ID NO: 27269 - DNA, 20 bp, Artificial Sequence
  Description of Artificial Sequence: Synthetic oligonucleotide
ggtcgggcccctcctcgcct

SEQ ID NO: 27270 - DNA, 20 bp, Artificial Sequence
  Description of Artificial Sequence: Synthetic oligonucleotide
gtcgggcccctcctcgccct

SEQ ID NO: 27271 - DNA, 20 bp, Artificial Sequence
  Description of Artificial Sequence: Synthetic oligonucleotide
tcgggcccctcctcgcccct

SEQ ID NO: 27272 - DNA, 20 bp, Artificial Sequence
  Description of Artificial Sequence: Synthetic oligonucleotide
cgggcccctcctcgcccctt

SEQ ID NO: 27273 - DNA, 20 bp, Artificial Sequence
  Description of Artificial Sequence: Synthetic oligonucleotide
gggcccctcctcgcccccat

SEQ ID NO: 27274 - DNA, 20 bp, Artificial Sequence
  Description of Artificial Sequence: Synthetic oligonucleotide
ggcccctcctcgcccccagt

SEQ ID NO: 27275 - DNA, 20 bp, Artificial Sequence
  Description of Artificial Sequence: Synthetic oligonucleotide
gcccctcctcgcccccaggt

SEQ ID NO: 27276 - DNA, 20 bp, Artificial Sequence
  Description of Artificial Sequence: Synthetic oligonucleotide
cccctcctcgcccccaggct

SEQ ID NO: 27277 - DNA, 20 bp, Artificial Sequence
  Description of Artificial Sequence: Synthetic oligonucleotide
ccctcctcgcccccaggctc

SEQ ID NO: 27278 - DNA, 20 bp, Artificial Sequence
  Description of Artificial Sequence: Synthetic oligonucleotide
cctcctcgcccccaggctcc

SEQ ID NO: 27279 - DNA, 21 bp, Artificial Sequence
  Description of Artificial Sequence: Synthetic oligonucleotide
ctcctcgcccccaggctccca

SEQ ID NO: 27280 - DNA, 22 bp, Artificial Sequence
  Description of Artificial Sequence: Synthetic oligonucleotide
tcctcgcccccaggctcccact

SEQ ID NO: 27281 - DNA, 21 bp, Artificial Sequence
  Description of Artificial Sequence: Synthetic oligonucleotide
cctcgcccccaggctcccact

SEQ ID NO: 27282 - DNA, 21 bp, Artificial Sequence
  Description of Artificial Sequence: Synthetic oligonucleotide
ctcgcccccaggctcccactc

SEQ ID NO: 27283 - DNA, 23 bp, Artificial Sequence
  Description of Artificial Sequence: Synthetic oligonucleotide
tcgcccccaggctcccactccat

SEQ ID NO: 27284 - DNA, 22 bp, Artificial Sequence
  Description of Artificial Sequence: Synthetic oligonucleotide
cgcccccaggctcccactccat

SEQ ID NO: 27285 - DNA, 23 bp, Artificial Sequence
  Description of Artificial Sequence: Synthetic oligonucleotide
gcccccaggctcccactccatga

SEQ ID NO: 27286 - DNA, 23 bp, Artificial Sequence
  Description of Artificial Sequence: Synthetic oligonucleotide
cccccaggctcccactccatgag

SEQ ID NO: 27287 - DNA, 27 bp, Artificial Sequence
  Description of Artificial Sequence: Synthetic oligonucleotide
ccccaggctcccactccatgaggtatt

SEQ ID NO: 27288 - DNA, 28 bp, Artificial Sequence
  Description of Artificial Sequence: Synthetic oligonucleotide
cccaggctcccactccatgaggtatttc

SEQ ID NO: 27289 - DNA, 30 bp, Artificial Sequence
  Description of Artificial Sequence: Synthetic oligonucleotide
ccaggctcccactccatgaggtatttctac

SEQ ID NO: 27290 - DNA, 31 bp, Artificial Sequence
  Description of Artificial Sequence: Synthetic oligonucleotide
caggctcccactccatgaggtatttctacac

SEQ ID NO: 27291 - DNA, 31 bp, Artificial Sequence
  Description of Artificial Sequence: Synthetic oligonucleotide
aggctcccactccatgaggtatttctacacc

SEQ ID NO: 27292 - DNA, 27 bp, Artificial Sequence
  Description of Artificial Sequence: Synthetic oligonucleotide
catgaccagtccgcctacgacggcaaa

SEQ ID NO: 27293 - DNA, 27 bp, Artificial Sequence
  Description of Artificial Sequence: Synthetic oligonucleotide
atgaccagtccgcctacgacggcaaag

SEQ ID NO: 27294 - DNA, 27 bp, Artificial Sequence
  Description of Artificial Sequence: Synthetic oligonucleotide
tgaccagtccgcctacgacggcaaaga

SEQ ID NO: 27295 - DNA, 27 bp, Artificial Sequence
  Description of Artificial Sequence: Synthetic oligonucleotide
gaccagtccgcctacgacggcaaagat

SEQ ID NO: 27296 - DNA, 29 bp, Artificial Sequence
  Description of Artificial Sequence: Synthetic oligonucleotide
accagtccgcctacgacggcaaagattac

SEQ ID NO: 27297 - DNA, 28 bp, Artificial Sequence
  Description of Artificial Sequence: Synthetic oligonucleotide
ccagtccgcctacgacggcaaagattac

SEQ ID NO: 27298 - DNA, 30 bp, Artificial Sequence
  Description of Artificial Sequence: Synthetic oligonucleotide
cagtccgcctacgacggcaaagattacatc

SEQ ID NO: 27299 - DNA, 30 bp, Artificial Sequence
  Description of Artificial Sequence: Synthetic oligonucleotide
agtccgcctacgacggcaaagattacatcg

SEQ ID NO: 27300 - DNA, 29 bp, Artificial Sequence
  Description of Artificial Sequence: Synthetic oligonucleotide
gtccgcctacgacggcaaagattacatcg

SEQ ID NO: 27301 - DNA, 29 bp, Artificial Sequence
  Description of Artificial Sequence: Synthetic oligonucleotide
tccgcctacgacggcaaagattacatcgc

SEQ ID NO: 27302 - DNA, 28 bp, Artificial Sequence
  Description of Artificial Sequence: Synthetic oligonucleotide
ccgcctacgacggcaaagattacatcgc

SEQ ID NO: 27303 - DNA, 32 bp, Artificial Sequence
  Description of Artificial Sequence: Synthetic oligonucleotide
aaagattacatcgccctgaacgaggacctgag

SEQ ID NO: 27304 - DNA, 31 bp, Artificial Sequence
  Description of Artificial Sequence: Synthetic oligonucleotide
aagattacatcgccctgaacgaggacctgag

SEQ ID NO: 27305 - DNA, 30 bp, Artificial Sequence
  Description of Artificial Sequence: Synthetic oligonucleotide
agattacatcgccctgaacgaggacctgag

SEQ ID NO: 27306 - DNA, 32 bp, Artificial Sequence
  Description of Artificial Sequence: Synthetic oligonucleotide
aaggattacatcgccctgaatgaggacctgag

SEQ ID NO: 27307 - DNA, 31 bp, Artificial Sequence
  Description of Artificial Sequence: Synthetic oligonucleotide
aggattacatcgccctgaatgaggacctgag

SEQ ID NO: 27308 - DNA, 30 bp, Artificial Sequence
  Description of Artificial Sequence: Synthetic oligonucleotide
ggattacatcgccctgaatgaggacctgag

SEQ ID NO: 27309 - DNA, 30 bp, Artificial Sequence
  Description of Artificial Sequence: Synthetic oligonucleotide
gattacatcgccctgaatgaggacctgagc

SEQ ID NO: 27310 - DNA, 31 bp, Artificial Sequence
  Description of Artificial Sequence: Synthetic oligonucleotide
attacatcgccctgaatgaggacctgagctc

SEQ ID NO: 27311 - DNA, 30 bp, Artificial Sequence
  Description of Artificial Sequence: Synthetic oligonucleotide
ttacatcgccctgaatgaggacctgagctc

SEQ ID NO: 27312 - DNA, 29 bp, Artificial Sequence
  Description of Artificial Sequence: Synthetic oligonucleotide
tacatcgccctgaatgaggacctgagctc

SEQ ID NO: 27313 - DNA, 28 bp, Artificial Sequence
  Description of Artificial Sequence: Synthetic oligonucleotide
acatcgccctgaatgaggacctgagctc

SEQ ID NO: 27314 - DNA, 27 bp, Artificial Sequence
  Description of Artificial Sequence: Synthetic oligonucleotide
catcgccctgaatgaggacctgagctc

SEQ ID NO: 27315 - DNA, 27 bp, Artificial Sequence
  Description of Artificial Sequence: Synthetic oligonucleotide
atcgccctgaatgaggacctgagctcc

SEQ ID NO: 27316 - DNA, 27 bp, Artificial Sequence
  Description of Artificial Sequence: Synthetic oligonucleotide
tcgccctgaatgaggacctgagctcct

SEQ ID NO: 27317 - DNA, 26 bp, Artificial Sequence
  Description of Artificial Sequence: Synthetic oligonucleotide
cgccctgaatgaggacctgagctcct

SEQ ID NO: 27318 - DNA, 26 bp, Artificial Sequence
  Description of Artificial Sequence: Synthetic oligonucleotide
gccctgaatgaggacctgagctcctg

SEQ ID NO: 27319 - DNA, 27 bp, Artificial Sequence
  Description of Artificial Sequence: Synthetic oligonucleotide
ccctgaatgaggacctgagctcctgga

SEQ ID NO: 27320 - DNA, 27 bp, Artificial Sequence
  Description of Artificial Sequence: Synthetic oligonucleotide
cctgaatgaggacctgagctcctggac

SEQ ID NO: 27321 - DNA, 27 bp, Artificial Sequence
  Description of Artificial Sequence: Synthetic oligonucleotide
ctgaatgaggacctgagctcctggacc

SEQ ID NO: 27322 - DNA, 27 bp, Artificial Sequence
  Description of Artificial Sequence: Synthetic oligonucleotide
tgaatgaggacctgagctcctggaccg

SEQ ID NO: 27323 - DNA, 26 bp, Artificial Sequence
  Description of Artificial Sequence: Synthetic oligonucleotide
gaatgaggacctgagctcctggaccg

SEQ ID NO: 27324 - DNA, 26 bp, Artificial Sequence
  Description of Artificial Sequence: Synthetic oligonucleotide
aatgaggacctgagctcctggaccgc

SEQ ID NO: 27325 - DNA, 25 bp, Artificial Sequence
  Description of Artificial Sequence: Synthetic oligonucleotide
atgaggacctgagctcctggaccgc

SEQ ID NO: 27326 - DNA, 24 bp, Artificial Sequence
  Description of Artificial Sequence: Synthetic oligonucleotide
tgaggacctgagctcctggaccgc

SEQ ID NO: 27327 - DNA, 22 bp, Artificial Sequence
  Description of Artificial Sequence: Synthetic oligonucleotide
ggccctgggcttctaccctgcc

SEQ ID NO: 27328 - DNA, 23 bp, Artificial Sequence
  Description of Artificial Sequence: Synthetic oligonucleotide
gccctgggcttctaccctgccga

SEQ ID NO: 27329 - DNA, 25 bp, Artificial Sequence
  Description of Artificial Sequence: Synthetic oligonucleotide
ccctgggcttctaccctgccgagat

SEQ ID NO: 27330 - DNA, 26 bp, Artificial Sequence
  Description of Artificial Sequence: Synthetic oligonucleotide
cctgggcttctaccctgccgagatca

SEQ ID NO: 27331 - DNA, 27 bp, Artificial Sequence
  Description of Artificial Sequence: Synthetic oligonucleotide
ctgggcttctaccctgccgagatcaca

SEQ ID NO: 27332 - DNA, 27 bp, Artificial Sequence
  Description of Artificial Sequence: Synthetic oligonucleotide
tgggcttctaccctgccgagatcacac

SEQ ID NO: 27333 - DNA, 27 bp, Artificial Sequence
  Description of Artificial Sequence: Synthetic oligonucleotide
gggcttctaccctgccgagatcacact

SEQ ID NO: 27334 - DNA, 27 bp, Artificial Sequence
  Description of Artificial Sequence: Synthetic oligonucleotide
ggcttctaccctgccgagatcacactg

SEQ ID NO: 27335 - DNA, 28 bp, Artificial Sequence
  Description of Artificial Sequence: Synthetic oligonucleotide
gcttctaccctgccgagatcacactgac

SEQ ID NO: 27336 - DNA, 28 bp, Artificial Sequence
  Description of Artificial Sequence: Synthetic oligonucleotide
cttctaccctgccgagatcacactgacc

SEQ ID NO: 27337 - DNA, 29 bp, Artificial Sequence
  Description of Artificial Sequence: Synthetic oligonucleotide
ttctaccctgccgagatcacactgacctg

SEQ ID NO: 27338 - DNA, 28 bp, Artificial Sequence
  Description of Artificial Sequence: Synthetic oligonucleotide
tctaccctgccgagatcacactgacctg

SEQ ID NO: 27339 - DNA, 27 bp, Artificial Sequence
  Description of Artificial Sequence: Synthetic oligonucleotide
ctaccctgccgagatcacactgacctg

SEQ ID NO: 27340 - DNA, 27 bp, Artificial Sequence
  Description of Artificial Sequence: Synthetic oligonucleotide
taccctgccgagatcacactgacctgg

SEQ ID NO: 27341 - DNA, 26 bp, Artificial Sequence
  Description of Artificial Sequence: Synthetic oligonucleotide
accctgccgagatcacactgacctgg

SEQ ID NO: 27342 - DNA, 25 bp, Artificial Sequence
  Description of Artificial Sequence: Synthetic oligonucleotide
ccctgccgagatcacactgacctgg

SEQ ID NO: 27343 - DNA, 26 bp, Artificial Sequence
  Description of Artificial Sequence: Synthetic oligonucleotide
cctgccgagatcacactgacctggca

SEQ ID NO: 27344 - DNA, 26 bp, Artificial Sequence
  Description of Artificial Sequence: Synthetic oligonucleotide
ctgccgagatcacactgacctggcag

SEQ ID NO: 27345 - DNA, 26 bp, Artificial Sequence
  Description of Artificial Sequence: Synthetic oligonucleotide
tgccgagatcacactgacctggcagc

SEQ ID NO: 27346 - DNA, 25 bp, Artificial Sequence
  Description of Artificial Sequence: Synthetic oligonucleotide
gccgagatcacactgacctggcagc

SEQ ID NO: 27347 - DNA, 25 bp, Artificial Sequence
  Description of Artificial Sequence: Synthetic oligonucleotide
ccgagatcacactgacctggcagcg

SEQ ID NO: 27348 - DNA, 25 bp, Artificial Sequence
  Description of Artificial Sequence: Synthetic oligonucleotide
cgagatcacactgacctggcagcgg

SEQ ID NO: 27349 - DNA, 27 bp, Artificial Sequence
  Description of Artificial Sequence: Synthetic oligonucleotide
atcacactgacctggcagcgggatggt

SEQ ID NO: 27350 - DNA, 26 bp, Artificial Sequence
  Description of Artificial Sequence: Synthetic oligonucleotide
tcacactgacctggcagcgggatggt

SEQ ID NO: 27351 - DNA, 25 bp, Artificial Sequence
  Description of Artificial Sequence: Synthetic oligonucleotide
cacactgacctggcagcgggatggt

SEQ ID NO: 27352 - DNA, 26 bp, Artificial Sequence
  Description of Artificial Sequence: Synthetic oligonucleotide
acactgacctggcagcgggatggtga

SEQ ID NO: 27353 - DNA, 25 bp, Artificial Sequence
  Description of Artificial Sequence: Synthetic oligonucleotide
cactgacctggcagcgggatggtga

SEQ ID NO: 27354 - DNA, 25 bp, Artificial Sequence
  Description of Artificial Sequence: Synthetic oligonucleotide
actgacctggcagcgggatggtgag

SEQ ID NO: 27355 - DNA, 24 bp, Artificial Sequence
  Description of Artificial Sequence: Synthetic oligonucleotide
ctgacctggcagcgggatggtgag

SEQ ID NO: 27356 - DNA, 25 bp, Artificial Sequence
  Description of Artificial Sequence: Synthetic oligonucleotide
tgacctggcagcgggatggtgagga

SEQ ID NO: 27357 - DNA, 24 bp, Artificial Sequence
  Description of Artificial Sequence: Synthetic oligonucleotide
gacctggcagcgggatggtgagga

SEQ ID NO: 27358 - DNA, 24 bp, Artificial Sequence
  Description of Artificial Sequence: Synthetic oligonucleotide
acctggcagcgggatggtgaggac

SEQ ID NO: 27359 - DNA, 23 bp, Artificial Sequence
  Description of Artificial Sequence: Synthetic oligonucleotide
cctggcagcgggatggtgaggac

SEQ ID NO: 27360 - DNA, 26 bp, Artificial Sequence
  Description of Artificial Sequence: Synthetic oligonucleotide
ctggcagcgggatggtgaggaccaaa

SEQ ID NO: 27361 - DNA, 27 bp, Artificial Sequence
  Description of Artificial Sequence: Synthetic oligonucleotide
tggcagcgggatggtgaggaccaaact

SEQ ID NO: 27362 - DNA, 26 bp, Artificial Sequence
  Description of Artificial Sequence: Synthetic oligonucleotide
ggcagcgggatggtgaggaccaaact

SEQ ID NO: 27363 - DNA, 27 bp, Artificial Sequence
  Description of Artificial Sequence: Synthetic oligonucleotide
gcagcgggatggtgaggaccaaactca

SEQ ID NO: 27364 - DNA, 27 bp, Artificial Sequence
  Description of Artificial Sequence: Synthetic oligonucleotide
cagcgggatggtgaggaccaaactcag

SEQ ID NO: 27365 - DNA, 27 bp, Artificial Sequence
  Description of Artificial Sequence: Synthetic oligonucleotide
agcgggatggtgaggaccaaactcagg

SEQ ID NO: 27366 - DNA, 27 bp, Artificial Sequence
  Description of Artificial Sequence: Synthetic oligonucleotide
gcgggatggtgaggaccaaactcagga

SEQ ID NO: 27367 - DNA, 27 bp, Artificial Sequence
  Description of Artificial Sequence: Synthetic oligonucleotide
cgggatggtgaggaccaaactcaggac

SEQ ID NO: 27368 - DNA, 28 bp, Artificial Sequence
  Description of Artificial Sequence: Synthetic oligonucleotide
gggatggtgaggaccaaactcaggacac

SEQ ID NO: 27369 - DNA, 28 bp, Artificial Sequence
  Description of Artificial Sequence: Synthetic oligonucleotide
ggatggtgaggaccaaactcaggacacc

SEQ ID NO: 27370 - DNA, 28 bp, Artificial Sequence
  Description of Artificial Sequence: Synthetic oligonucleotide
gatggtgaggaccaaactcaggacaccg

SEQ ID NO: 27371 - DNA, 29 bp, Artificial Sequence
  Description of Artificial Sequence: Synthetic oligonucleotide
atggtgaggaccaaactcaggacaccgag

SEQ ID NO: 27372 - DNA, 28 bp, Artificial Sequence
  Description of Artificial Sequence: Synthetic oligonucleotide
tggtgaggaccaaactcaggacaccgag

SEQ ID NO: 27373 - DNA, 27 bp, Artificial Sequence
  Description of Artificial Sequence: Synthetic oligonucleotide
ggtgaggaccaaactcaggacaccgag

SEQ ID NO: 27374 - DNA, 27 bp, Artificial Sequence
  Description of Artificial Sequence: Synthetic oligonucleotide
gtgaggaccaaactcaggacaccgagc

SEQ ID NO: 27375 - DNA, 29 bp, Artificial Sequence
  Description of Artificial Sequence: Synthetic oligonucleotide
tgaggaccaaactcaggacaccgagcttg

SEQ ID NO: 27376 - DNA, 23 bp, Artificial Sequence
  Description of Artificial Sequence: Synthetic oligonucleotide
acctgagctcctggaccgcggca

SEQ ID NO: 27377 - DNA, 22 bp, Artificial Sequence
  Description of Artificial Sequence: Synthetic oligonucleotide
cctgagctcctggaccgcggca

SEQ ID NO: 27378 - DNA, 23 bp, Artificial Sequence
  Description of Artificial Sequence: Synthetic oligonucleotide
ctgagctcctggaccgcggcaga

SEQ ID NO: 27379 - DNA, 24 bp, Artificial Sequence
  Description of Artificial Sequence: Synthetic oligonucleotide
tgagctcctggaccgcggcagaca

SEQ ID NO: 27380 - DNA, 23 bp, Artificial Sequence
  Description of Artificial Sequence: Synthetic oligonucleotide
gagctcctggaccgcggcagaca

SEQ ID NO: 27381 - DNA, 23 bp, Artificial Sequence
  Description of Artificial Sequence: Synthetic oligonucleotide
agctcctggaccgcggcagacac

SEQ ID NO: 27382 - DNA, 22 bp, Artificial Sequence
  Description of Artificial Sequence: Synthetic oligonucleotide
gctcctggaccgcggcagacac

SEQ ID NO: 27383 - DNA, 22 bp, Artificial Sequence
  Description of Artificial Sequence: Synthetic oligonucleotide
ctcctggaccgcggcagacacg

SEQ ID NO: 27384 - DNA, 22 bp, Artificial Sequence
  Description of Artificial Sequence: Synthetic oligonucleotide
tcctggaccgcggcagacacgg

SEQ ID NO: 27385 - DNA, 21 bp, Artificial Sequence
  Description of Artificial Sequence: Synthetic oligonucleotide
cctggaccgcggcagacacgg

SEQ ID NO: 27386 - DNA, 21 bp, Artificial Sequence
  Description of Artificial Sequence: Synthetic oligonucleotide
ctggaccgcggcagacacggc

SEQ ID NO: 27387 - DNA, 21 bp, Artificial Sequence
  Description of Artificial Sequence: Synthetic oligonucleotide
tggaccgcggcagacacggcg

SEQ ID NO: 27388 - DNA, 20 bp, Artificial Sequence
  Description of Artificial Sequence: Synthetic oligonucleotide
ggaccgcggcagacacggcg

SEQ ID NO: 27389 - DNA, 20 bp, Artificial Sequence
  Description of Artificial Sequence: Synthetic oligonucleotide
gaccgcggcagacacggcgg

SEQ ID NO: 27390 - DNA, 21 bp, Artificial Sequence
  Description of Artificial Sequence: Synthetic oligonucleotide
accgcggcagacacggcggct

SEQ ID NO: 27391 - DNA, 20 bp, Artificial Sequence
  Description of Artificial Sequence: Synthetic oligonucleotide
ccgcggcagacacggcggct

SEQ ID NO: 27392 - DNA, 21 bp, Artificial Sequence
  Description of Artificial Sequence: Synthetic oligonucleotide
cgcggcagacacggcggctca

SEQ ID NO: 27393 - DNA, 23 bp, Artificial Sequence
  Description of Artificial Sequence: Synthetic oligonucleotide
gcggcagacacggcggctcagat

SEQ ID NO: 27394 - DNA, 24 bp, Artificial Sequence
  Description of Artificial Sequence: Synthetic oligonucleotide
cggcagacacggcggctcagatca

SEQ ID NO: 27395 - DNA, 24 bp, Artificial Sequence
  Description of Artificial Sequence: Synthetic oligonucleotide
ggcagacacggcggctcagatcac

SEQ ID NO: 27396 - DNA, 29 bp, Artificial Sequence
  Description of Artificial Sequence: Synthetic oligonucleotide
ttcatcgcagtgggctacgtggacgatac

SEQ ID NO: 27397 - DNA, 28 bp, Artificial Sequence
  Description of Artificial Sequence: Synthetic oligonucleotide
tcatcgcagtgggctacgtggacgatac

SEQ ID NO: 27398 - DNA, 27 bp, Artificial Sequence
  Description of Artificial Sequence: Synthetic oligonucleotide
catcgcagtgggctacgtggacgatac

SEQ ID NO: 27399 - DNA, 27 bp, Artificial Sequence
  Description of Artificial Sequence: Synthetic oligonucleotide
atcgcagtgggctacgtggacgatacc

SEQ ID NO: 27400 - DNA, 26 bp, Artificial Sequence
  Description of Artificial Sequence: Synthetic oligonucleotide
tcgcagtgggctacgtggacgatacc

SEQ ID NO: 27401 - DNA, 25 bp, Artificial Sequence
  Description of Artificial Sequence: Synthetic oligonucleotide
cgcagtgggctacgtggacgatacc

SEQ ID NO: 27402 - DNA, 26 bp, Artificial Sequence
  Description of Artificial Sequence: Synthetic oligonucleotide
gcagtgggctacgtggacgataccca

SEQ ID NO: 27403 - DNA, 27 bp, Artificial Sequence
  Description of Artificial Sequence: Synthetic oligonucleotide
cagtgggctacgtggacgatacccagt

SEQ ID NO: 27404 - DNA, 28 bp, Artificial Sequence
  Description of Artificial Sequence: Synthetic oligonucleotide
agtgggctacgtggacgatacccagttc

SEQ ID NO: 27405 - DNA, 27 bp, Artificial Sequence
  Description of Artificial Sequence: Synthetic oligonucleotide
gtgggctacgtggacgatacccagttc

SEQ ID NO: 27406 - DNA, 27 bp, Artificial Sequence
  Description of Artificial Sequence: Synthetic oligonucleotide
tgggctacgtggacgatacccagttcg

SEQ ID NO: 27407 - DNA, 27 bp, Artificial Sequence
  Description of Artificial Sequence: Synthetic oligonucleotide
gggctacgtggacgatacccagttcgt

SEQ ID NO: 27408 - DNA, 27 bp, Artificial Sequence
  Description of Artificial Sequence: Synthetic oligonucleotide
ggctacgtggacgatacccagttcgtg

SEQ ID NO: 27409 - DNA, 28 bp, Artificial Sequence
  Description of Artificial Sequence: Synthetic oligonucleotide
gctacgtggacgatacccagttcgtgag

SEQ ID NO: 27410 - DNA, 28 bp, Artificial Sequence
  Description of Artificial Sequence: Synthetic oligonucleotide
ctacgtggacgatacccagttcgtgagg

SEQ ID NO: 27411 - DNA, 30 bp, Artificial Sequence
  Description of Artificial Sequence: Synthetic oligonucleotide
tacgtggacgatacccagttcgtgaggttc

SEQ ID NO: 27412 - DNA, 29 bp, Artificial Sequence
  Description of Artificial Sequence: Synthetic oligonucleotide
acgtggacgatacccagttcgtgaggttc

SEQ ID NO: 27413 - DNA, 28 bp, Artificial Sequence
  Description of Artificial Sequence: Synthetic oligonucleotide
cgtggacgatacccagttcgtgaggttc

SEQ ID NO: 27414 - DNA, 28 bp, Artificial Sequence
  Description of Artificial Sequence: Synthetic oligonucleotide
gtggacgatacccagttcgtgaggttcg

SEQ ID NO: 27415 - DNA, 29 bp, Artificial Sequence
  Description of Artificial Sequence: Synthetic oligonucleotide
tggacgatacccagttcgtgaggttcgac

SEQ ID NO: 27416 - DNA, 28 bp, Artificial Sequence
  Description of Artificial Sequence: Synthetic oligonucleotide
ggacgatacccagttcgtgaggttcgac

SEQ ID NO: 27417 - DNA, 29 bp, Artificial Sequence
  Description of Artificial Sequence: Synthetic oligonucleotide
gacgatacccagttcgtgaggttcgacag

SEQ ID NO: 27418 - DNA, 29 bp, Artificial Sequence
  Description of Artificial Sequence: Synthetic oligonucleotide
acgatacccagttcgtgaggttcgacagc

SEQ ID NO: 27419 - DNA, 28 bp, Artificial Sequence
  Description of Artificial Sequence: Synthetic oligonucleotide
cgatacccagttcgtgaggttcgacagc

SEQ ID NO: 27420 - DNA, 28 bp, Artificial Sequence
  Description of Artificial Sequence: Synthetic oligonucleotide
gatacccagttcgtgaggttcgacagcg

SEQ ID NO: 27421 - DNA, 29 bp, Artificial Sequence
  Description of Artificial Sequence: Synthetic oligonucleotide
atacccagttcgtgaggttcgacagcgac

SEQ ID NO: 27422 - DNA, 28 bp, Artificial Sequence
  Description of Artificial Sequence: Synthetic oligonucleotide
tacccagttcgtgaggttcgacagcgac

SEQ ID NO: 27423 - DNA, 26 bp, Artificial Sequence
  Description of Artificial Sequence: Synthetic oligonucleotide
agaatgggaaggagacgctgcagcgc

SEQ ID NO: 27424 - DNA, 25 bp, Artificial Sequence
  Description of Artificial Sequence: Synthetic oligonucleotide
gaatgggaaggagacgctgcagcgc

SEQ ID NO: 27425 - DNA, 25 bp, Artificial Sequence
  Description of Artificial Sequence: Synthetic oligonucleotide
aatgggaaggagacgctgcagcgcg

SEQ ID NO: 27426 - DNA, 24 bp, Artificial Sequence
  Description of Artificial Sequence: Synthetic oligonucleotide
atgggaaggagacgctgcagcgcg

SEQ ID NO: 27427 - DNA, 23 bp, Artificial Sequence
  Description of Artificial Sequence: Synthetic oligonucleotide
tgggaaggagacgctgcagcgcg

SEQ ID NO: 27428 - DNA, 32 bp, Artificial Sequence
  Description of Artificial Sequence: Synthetic oligonucleotide
agacacagatctccaagaccaacacacagacc

SEQ ID NO: 27429 - DNA, 31 bp, Artificial Sequence
  Description of Artificial Sequence: Synthetic oligonucleotide
gacacagatctccaagaccaacacacagacc

SEQ ID NO: 27430 - DNA, 33 bp, Artificial Sequence
  Description of Artificial Sequence: Synthetic oligonucleotide
acacagatctccaagaccaacacacagacctac

SEQ ID NO: 27431 - DNA, 32 bp, Artificial Sequence
  Description of Artificial Sequence: Synthetic oligonucleotide
cacagatctccaagaccaacacacagacctac

SEQ ID NO: 27432 - DNA, 32 bp, Artificial Sequence
  Description of Artificial Sequence: Synthetic oligonucleotide
acagatctccaagaccaacacacagacctacc

SEQ ID NO: 27433 - DNA, 31 bp, Artificial Sequence
  Description of Artificial Sequence: Synthetic oligonucleotide
cagatctccaagaccaacacacagacctacc

SEQ ID NO: 27434 - DNA, 31 bp, Artificial Sequence
  Description of Artificial Sequence: Synthetic oligonucleotide
agatctccaagaccaacacacagacctaccg

SEQ ID NO: 27435 - DNA, 30 bp, Artificial Sequence
  Description of Artificial Sequence: Synthetic oligonucleotide
gatctccaagaccaacacacagacctaccg

SEQ ID NO: 27436 - DNA, 31 bp, Artificial Sequence
  Description of Artificial Sequence: Synthetic oligonucleotide
atctccaagaccaacacacagacctaccgag

SEQ ID NO: 27437 - DNA, 30 bp, Artificial Sequence
  Description of Artificial Sequence: Synthetic oligonucleotide
tctccaagaccaacacacagacctaccgag

SEQ ID NO: 27438 - DNA, 29 bp, Artificial Sequence
  Description of Artificial Sequence: Synthetic oligonucleotide
ctccaagaccaacacacagacctaccgag

SEQ ID NO: 27439 - DNA, 30 bp, Artificial Sequence
  Description of Artificial Sequence: Synthetic oligonucleotide
tccaagaccaacacacagacctaccgagag

SEQ ID NO: 27440 - DNA, 29 bp, Artificial Sequence
  Description of Artificial Sequence: Synthetic oligonucleotide
ccaagaccaacacacagacctaccgagag

SEQ ID NO: 27441 - DNA, 30 bp, Artificial Sequence
  Description of Artificial Sequence: Synthetic oligonucleotide
caagaccaacacacagacctaccgagagag

SEQ ID NO: 27442 - DNA, 30 bp, Artificial Sequence
  Description of Artificial Sequence: Synthetic oligonucleotide
aagaccaacacacagacctaccgagagagc

SEQ ID NO: 27443 - DNA, 29 bp, Artificial Sequence
  Description of Artificial Sequence: Synthetic oligonucleotide
agaccaacacacagacctaccgagagagc

SEQ ID NO: 27444 - DNA, 28 bp, Artificial Sequence
  Description of Artificial Sequence: Synthetic oligonucleotide
gaccaacacacagacctaccgagagagc

SEQ ID NO: 27445 - DNA, 28 bp, Artificial Sequence
  Description of Artificial Sequence: Synthetic oligonucleotide
accaacacacagacctaccgagagagcc

SEQ ID NO: 27446 - DNA, 27 bp, Artificial Sequence
  Description of Artificial Sequence: Synthetic oligonucleotide
ccaacacacagacctaccgagagagcc

SEQ ID NO: 27447 - DNA, 28 bp, Artificial Sequence
  Description of Artificial Sequence: Synthetic oligonucleotide
caacacacagacctaccgagagagcctg

SEQ ID NO: 27448 - DNA, 28 bp, Artificial Sequence
  Description of Artificial Sequence: Synthetic oligonucleotide
aacacacagacctaccgagagagcctgc

SEQ ID NO: 27449 - DNA, 27 bp, Artificial Sequence
  Description of Artificial Sequence: Synthetic oligonucleotide
acacacagacctaccgagagagcctgc

SEQ ID NO: 27450 - DNA, 26 bp, Artificial Sequence
  Description of Artificial Sequence: Synthetic oligonucleotide
cacacagacctaccgagagagcctgc

SEQ ID NO: 27451 - DNA, 26 bp, Artificial Sequence
  Description of Artificial Sequence: Synthetic oligonucleotide
acacagacctaccgagagagcctgcg

SEQ ID NO: 27452 - DNA, 25 bp, Artificial Sequence
  Description of Artificial Sequence: Synthetic oligonucleotide
cacagacctaccgagagagcctgcg

SEQ ID NO: 27453 - DNA, 27 bp, Artificial Sequence
  Description of Artificial Sequence: Synthetic oligonucleotide
acagacctaccgagagagcctgcggaa

SEQ ID NO: 27454 - DNA, 26 bp, Artificial Sequence
  Description of Artificial Sequence: Synthetic oligonucleotide
cagacctaccgagagagcctgcggaa

SEQ ID NO: 27455 - DNA, 26 bp, Artificial Sequence
  Description of Artificial Sequence: Synthetic oligonucleotide
agacctaccgagagagcctgcggaac

SEQ ID NO: 27456 - DNA, 25 bp, Artificial Sequence
  Description of Artificial Sequence: Synthetic oligonucleotide
gacctaccgagagagcctgcggaac

SEQ ID NO: 27457 - DNA, 26 bp, Artificial Sequence
  Description of Artificial Sequence: Synthetic oligonucleotide
acctaccgagagagcctgcggaacct

SEQ ID NO: 27458 - DNA, 25 bp, Artificial Sequence
  Description of Artificial Sequence: Synthetic oligonucleotide
cctaccgagagagcctgcggaacct

SEQ ID NO: 27459 - DNA, 25 bp, Artificial Sequence
  Description of Artificial Sequence: Synthetic oligonucleotide
ctaccgagagagcctgcggaacctg

SEQ ID NO: 27460 - DNA, 31 bp, Artificial Sequence
  Description of Artificial Sequence: Synthetic oligonucleotide
gctcccactccatgaggtatttttacaccgc

SEQ ID NO: 27461 - DNA, 31 bp, Artificial Sequence
  Description of Artificial Sequence: Synthetic oligonucleotide
ctcccactccatgaggtatttttacaccgcc

SEQ ID NO: 27462 - DNA, 33 bp, Artificial Sequence
  Description of Artificial Sequence: Synthetic oligonucleotide
tcccactccatgaggtatttttacaccgccatg

SEQ ID NO: 27463 - DNA, 32 bp, Artificial Sequence
  Description of Artificial Sequence: Synthetic oligonucleotide
cccactccatgaggtatttttacaccgccatg

SEQ ID NO: 27464 - DNA, 33 bp, Artificial Sequence
  Description of Artificial Sequence: Synthetic oligonucleotide
ccactccatgaggtatttttacaccgccatgtc

SEQ ID NO: 27465 - DNA, 33 bp, Artificial Sequence
  Description of Artificial Sequence: Synthetic oligonucleotide
cactccatgaggtatttttacaccgccatgtcc

SEQ ID NO: 27466 - DNA, 33 bp, Artificial Sequence
  Description of Artificial Sequence: Synthetic oligonucleotide
actccatgaggtatttttacaccgccatgtccc

SEQ ID NO: 27467 - DNA, 32 bp, Artificial Sequence
  Description of Artificial Sequence: Synthetic oligonucleotide
ctccatgaggtatttttacaccgccatgtccc

SEQ ID NO: 27468 - DNA, 32 bp, Artificial Sequence
  Description of Artificial Sequence: Synthetic oligonucleotide
tccatgaggtatttttacaccgccatgtcccg

SEQ ID NO: 27469 - DNA, 31 bp, Artificial Sequence
  Description of Artificial Sequence: Synthetic oligonucleotide
ccatgaggtatttttacaccgccatgtcccg

SEQ ID NO: 27470 - DNA, 31 bp, Artificial Sequence
  Description of Artificial Sequence: Synthetic oligonucleotide
catgaggtatttttacaccgccatgtcccgg

SEQ ID NO: 27471 - DNA, 31 bp, Artificial Sequence
  Description of Artificial Sequence: Synthetic oligonucleotide
atgaggtatttttacaccgccatgtcccggc

SEQ ID NO: 27472 - DNA, 30 bp, Artificial Sequence
  Description of Artificial Sequence: Synthetic oligonucleotide
tgaggtatttttacaccgccatgtcccggc

SEQ ID NO: 27473 - DNA, 29 bp, Artificial Sequence
  Description of Artificial Sequence: Synthetic oligonucleotide
gaggtatttttacaccgccatgtcccggc

SEQ ID NO: 27474 - DNA, 29 bp, Artificial Sequence
  Description of Artificial Sequence: Synthetic oligonucleotide
aggtatttttacaccgccatgtcccggcc

SEQ ID NO: 27475 - DNA, 28 bp, Artificial Sequence
  Description of Artificial Sequence: Synthetic oligonucleotide
ggtatttttacaccgccatgtcccggcc

SEQ ID NO: 27476 - DNA, 28 bp, Artificial Sequence
  Description of Artificial Sequence: Synthetic oligonucleotide
gtatttttacaccgccatgtcccggccc

SEQ ID NO: 27477 - DNA, 28 bp, Artificial Sequence
  Description of Artificial Sequence: Synthetic oligonucleotide
tatttttacaccgccatgtcccggcccg

SEQ ID NO: 27478 - DNA, 27 bp, Artificial Sequence
  Description of Artificial Sequence: Synthetic oligonucleotide
atttttacaccgccatgtcccggcccg

SEQ ID NO: 27479 - DNA, 26 bp, Artificial Sequence
  Description of Artificial Sequence: Synthetic oligonucleotide
tttttacaccgccatgtcccggcccg

SEQ ID NO: 27480 - DNA, 25 bp, Artificial Sequence
  Description of Artificial Sequence: Synthetic oligonucleotide
ttttacaccgccatgtcccggcccg

SEQ ID NO: 27481 - DNA, 24 bp, Artificial Sequence
  Description of Artificial Sequence: Synthetic oligonucleotide
tttacaccgccatgtcccggcccg

SEQ ID NO: 27482 - DNA, 23 bp, Artificial Sequence
  Description of Artificial Sequence: Synthetic oligonucleotide
ttacaccgccatgtcccggcccg

SEQ ID NO: 27483 - DNA, 21 bp, Artificial Sequence
  Description of Artificial Sequence: Synthetic oligonucleotide
tgggaggcggcccgtgaggct

SEQ ID NO: 27484 - DNA, 21 bp, Artificial Sequence
  Description of Artificial Sequence: Synthetic oligonucleotide
ggaggcggcccgtgaggctga

SEQ ID NO: 27485 - DNA, 21 bp, Artificial Sequence
  Description of Artificial Sequence: Synthetic oligonucleotide
gaggcggcccgtgaggctgag

SEQ ID NO: 27486 - DNA, 22 bp, Artificial Sequence
  Description of Artificial Sequence: Synthetic oligonucleotide
aggcggcccgtgaggctgagca

SEQ ID NO: 27487 - DNA, 21 bp, Artificial Sequence
  Description of Artificial Sequence: Synthetic oligonucleotide
ggcggcccgtgaggctgagca

SEQ ID NO: 27488 - DNA, 22 bp, Artificial Sequence
  Description of Artificial Sequence: Synthetic oligonucleotide
gcggcccgtgaggctgagcagt

SEQ ID NO: 27489 - DNA, 22 bp, Artificial Sequence
  Description of Artificial Sequence: Synthetic oligonucleotide
cggcccgtgaggctgagcagtg

SEQ ID NO: 27490 - DNA, 23 bp, Artificial Sequence
  Description of Artificial Sequence: Synthetic oligonucleotide
ggcccgtgaggctgagcagtgga

SEQ ID NO: 27491 - DNA, 24 bp, Artificial Sequence
  Description of Artificial Sequence: Synthetic oligonucleotide
gcccgtgaggctgagcagtggaga

SEQ ID NO: 27492 - DNA, 24 bp, Artificial Sequence
  Description of Artificial Sequence: Synthetic oligonucleotide
cccgtgaggctgagcagtggagag

SEQ ID NO: 27493 - DNA, 24 bp, Artificial Sequence
  Description of Artificial Sequence: Synthetic oligonucleotide
ccgtgaggctgagcagtggagagc

SEQ ID NO: 27494 - DNA, 26 bp, Artificial Sequence
  Description of Artificial Sequence: Synthetic oligonucleotide
cgtgaggctgagcagtggagagccta

SEQ ID NO: 27495 - DNA, 26 bp, Artificial Sequence
  Description of Artificial Sequence: Synthetic oligonucleotide
gtgaggctgagcagtggagagcctac

SEQ ID NO: 27496 - DNA, 27 bp, Artificial Sequence
  Description of Artificial Sequence: Synthetic oligonucleotide
tgaggctgagcagtggagagcctacct

SEQ ID NO: 27497 - DNA, 26 bp, Artificial Sequence
  Description of Artificial Sequence: Synthetic oligonucleotide
gaggctgagcagtggagagcctacct

SEQ ID NO: 27498 - DNA, 26 bp, Artificial Sequence
  Description of Artificial Sequence: Synthetic oligonucleotide
aggctgagcagtggagagcctacctg

SEQ ID NO: 27499 - DNA, 25 bp, Artificial Sequence
  Description of Artificial Sequence: Synthetic oligonucleotide
ggctgagcagtggagagcctacctg

SEQ ID NO: 27500 - DNA, 26 bp, Artificial Sequence
  Description of Artificial Sequence: Synthetic oligonucleotide
gctgagcagtggagagcctacctgga

SEQ ID NO: 27501 - DNA, 26 bp, Artificial Sequence
  Description of Artificial Sequence: Synthetic oligonucleotide
ctgagcagtggagagcctacctggag

SEQ ID NO: 27502 - DNA, 26 bp, Artificial Sequence
  Description of Artificial Sequence: Synthetic oligonucleotide
tgagcagtggagagcctacctggagg

SEQ ID NO: 27503 - DNA, 33 bp, Artificial Sequence
  Description of Artificial Sequence: Synthetic oligonucleotide
actccatgaggtatttctacaccgccatgtctc

SEQ ID NO: 27504 - DNA, 32 bp, Artificial Sequence
  Description of Artificial Sequence: Synthetic oligonucleotide
ctccatgaggtatttctacaccgccatgtctc

SEQ ID NO: 27505 - DNA, 32 bp, Artificial Sequence
  Description of Artificial Sequence: Synthetic oligonucleotide
tccatgaggtatttctacaccgccatgtctcg

SEQ ID NO: 27506 - DNA, 31 bp, Artificial Sequence
  Description of Artificial Sequence: Synthetic oligonucleotide
ccatgaggtatttctacaccgccatgtctcg

SEQ ID NO: 27507 - DNA, 31 bp, Artificial Sequence
  Description of Artificial Sequence: Synthetic oligonucleotide
catgaggtatttctacaccgccatgtctcgg

SEQ ID NO: 27508 - DNA, 31 bp, Artificial Sequence
  Description of Artificial Sequence: Synthetic oligonucleotide
atgaggtatttctacaccgccatgtctcggc

SEQ ID NO: 27509 - DNA, 30 bp, Artificial Sequence
  Description of Artificial Sequence: Synthetic oligonucleotide
tgaggtatttctacaccgccatgtctcggc

SEQ ID NO: 27510 - DNA, 29 bp, Artificial Sequence
  Description of Artificial Sequence: Synthetic oligonucleotide
gaggtatttctacaccgccatgtctcggc

SEQ ID NO: 27511 - DNA, 29 bp, Artificial Sequence
  Description of Artificial Sequence: Synthetic oligonucleotide
aggtatttctacaccgccatgtctcggcc

SEQ ID NO: 27512 - DNA, 28 bp, Artificial Sequence
  Description of Artificial Sequence: Synthetic oligonucleotide
ggtatttctacaccgccatgtctcggcc

SEQ ID NO: 27513 - DNA, 28 bp, Artificial Sequence
  Description of Artificial Sequence: Synthetic oligonucleotide
gtatttctacaccgccatgtctcggccc

SEQ ID NO: 27514 - DNA, 28 bp, Artificial Sequence
  Description of Artificial Sequence: Synthetic oligonucleotide
tatttctacaccgccatgtctcggcccg

SEQ ID NO: 27515 - DNA, 27 bp, Artificial Sequence
  Description of Artificial Sequence: Synthetic oligonucleotide
atttctacaccgccatgtctcggcccg

SEQ ID NO: 27516 - DNA, 26 bp, Artificial Sequence
  Description of Artificial Sequence: Synthetic oligonucleotide
tttctacaccgccatgtctcggcccg

SEQ ID NO: 27517 - DNA, 25 bp, Artificial Sequence
  Description of Artificial Sequence: Synthetic oligonucleotide
ttctacaccgccatgtctcggcccg

SEQ ID NO: 27518 - DNA, 24 bp, Artificial Sequence
  Description of Artificial Sequence: Synthetic oligonucleotide
tctacaccgccatgtctcggcccg

SEQ ID NO: 27519 - DNA, 23 bp, Artificial Sequence
  Description of Artificial Sequence: Synthetic oligonucleotide
ctacaccgccatgtctcggcccg

SEQ ID NO: 27520 - DNA, 23 bp, Artificial Sequence
  Description of Artificial Sequence: Synthetic oligonucleotide
tacaccgccatgtctcggcccgg

SEQ ID NO: 27521 - DNA, 22 bp, Artificial Sequence
  Description of Artificial Sequence: Synthetic oligonucleotide
acaccgccatgtctcggcccgg

SEQ ID NO: 27522 - DNA, 21 bp, Artificial Sequence
  Description of Artificial Sequence: Synthetic oligonucleotide
caccgccatgtctcggcccgg

SEQ ID NO: 27523 - DNA, 21 bp, Artificial Sequence
  Description of Artificial Sequence: Synthetic oligonucleotide
accgccatgtctcggcccggc

SEQ ID NO: 27524 - DNA, 20 bp, Artificial Sequence
  Description of Artificial Sequence: Synthetic oligonucleotide
ccgccatgtctcggcccggc

SEQ ID NO: 27525 - DNA, 20 bp, Artificial Sequence
  Description of Artificial Sequence: Synthetic oligonucleotide
cgccatgtctcggcccggcc

SEQ ID NO: 27526 - DNA, 20 bp, Artificial Sequence
  Description of Artificial Sequence: Synthetic oligonucleotide
gccatgtctcggcccggccg

SEQ ID NO: 27527 - DNA, 20 bp, Artificial Sequence
  Description of Artificial Sequence: Synthetic oligonucleotide
ccatgtctcggcccggccgc

SEQ ID NO: 27528 - DNA, 20 bp, Artificial Sequence
  Description of Artificial Sequence: Synthetic oligonucleotide
catgtctcggcccggccgcg

SEQ ID NO: 27529 - DNA, 20 bp, Artificial Sequence
  Description of Artificial Sequence: Synthetic oligonucleotide
atgtctcggcccggccgcgg

SEQ ID NO: 27530 - DNA, 23 bp, Artificial Sequence
  Description of Artificial Sequence: Synthetic oligonucleotide
cggtgggctacgtggacgacacc

SEQ ID NO: 27531 - DNA, 24 bp, Artificial Sequence
  Description of Artificial Sequence: Synthetic oligonucleotide
ggtgggctacgtggacgacaccca

SEQ ID NO: 27532 - DNA, 31 bp, Artificial Sequence
  Description of Artificial Sequence: Synthetic oligonucleotide
caaggattacatcgccctgaacgaggacttg

SEQ ID NO: 27533 - DNA, 32 bp, Artificial Sequence
  Description of Artificial Sequence: Synthetic oligonucleotide
aaggattacatcgccctgaacgaggacttgag

SEQ ID NO: 27534 - DNA, 31 bp, Artificial Sequence
  Description of Artificial Sequence: Synthetic oligonucleotide
aggattacatcgccctgaacgaggacttgag

SEQ ID NO: 27535 - DNA, 30 bp, Artificial Sequence
  Description of Artificial Sequence: Synthetic oligonucleotide
ggattacatcgccctgaacgaggacttgag

SEQ ID NO: 27536 - DNA, 30 bp, Artificial Sequence
  Description of Artificial Sequence: Synthetic oligonucleotide
gattacatcgccctgaacgaggacttgagc

SEQ ID NO: 27537 - DNA, 31 bp, Artificial Sequence
  Description of Artificial Sequence: Synthetic oligonucleotide
attacatcgccctgaacgaggacttgagctc

SEQ ID NO: 27538 - DNA, 30 bp, Artificial Sequence
  Description of Artificial Sequence: Synthetic oligonucleotide
ttacatcgccctgaacgaggacttgagctc

SEQ ID NO: 27539 - DNA, 29 bp, Artificial Sequence
  Description of Artificial Sequence: Synthetic oligonucleotide
tacatcgccctgaacgaggacttgagctc

SEQ ID NO: 27540 - DNA, 28 bp, Artificial Sequence
  Description of Artificial Sequence: Synthetic oligonucleotide
acatcgccctgaacgaggacttgagctc

SEQ ID NO: 27541 - DNA, 27 bp, Artificial Sequence
  Description of Artificial Sequence: Synthetic oligonucleotide
catcgccctgaacgaggacttgagctc

SEQ ID NO: 27542 - DNA, 27 bp, Artificial Sequence
  Description of Artificial Sequence: Synthetic oligonucleotide
atcgccctgaacgaggacttgagctcc

SEQ ID NO: 27543 - DNA, 27 bp, Artificial Sequence
  Description of Artificial Sequence: Synthetic oligonucleotide
tcgccctgaacgaggacttgagctcct

SEQ ID NO: 27544 - DNA, 26 bp, Artificial Sequence
  Description of Artificial Sequence: Synthetic oligonucleotide
cgccctgaacgaggacttgagctcct

SEQ ID NO: 27545 - DNA, 26 bp, Artificial Sequence
  Description of Artificial Sequence: Synthetic oligonucleotide
gccctgaacgaggacttgagctcctg

SEQ ID NO: 27546 - DNA, 27 bp, Artificial Sequence
  Description of Artificial Sequence: Synthetic oligonucleotide
ccctgaacgaggacttgagctcctgga

SEQ ID NO: 27547 - DNA, 27 bp, Artificial Sequence
  Description of Artificial Sequence: Synthetic oligonucleotide
cctgaacgaggacttgagctcctggac

SEQ ID NO: 27548 - DNA, 27 bp, Artificial Sequence
  Description of Artificial Sequence: Synthetic oligonucleotide
ctgaacgaggacttgagctcctggacc

SEQ ID NO: 27549 - DNA, 27 bp, Artificial Sequence
  Description of Artificial Sequence: Synthetic oligonucleotide
tgaacgaggacttgagctcctggaccg

SEQ ID NO: 27550 - DNA, 26 bp, Artificial Sequence
  Description of Artificial Sequence: Synthetic oligonucleotide
gaacgaggacttgagctcctggaccg

SEQ ID NO: 27551 - DNA, 26 bp, Artificial Sequence
  Description of Artificial Sequence: Synthetic oligonucleotide
aacgaggacttgagctcctggaccgc

SEQ ID NO: 27552 - DNA, 25 bp, Artificial Sequence
  Description of Artificial Sequence: Synthetic oligonucleotide
acgaggacttgagctcctggaccgc

SEQ ID NO: 27553 - DNA, 24 bp, Artificial Sequence
  Description of Artificial Sequence: Synthetic oligonucleotide
cgaggacttgagctcctggaccgc

SEQ ID NO: 27554 - DNA, 24 bp, Artificial Sequence
  Description of Artificial Sequence: Synthetic oligonucleotide
gaggacttgagctcctggaccgcg

SEQ ID NO: 27555 - DNA, 24 bp, Artificial Sequence
  Description of Artificial Sequence: Synthetic oligonucleotide
aggacttgagctcctggaccgcgg

SEQ ID NO: 27556 - DNA, 23 bp, Artificial Sequence
  Description of Artificial Sequence: Synthetic oligonucleotide
ggacttgagctcctggaccgcgg

SEQ ID NO: 27557 - DNA, 23 bp, Artificial Sequence
  Description of Artificial Sequence: Synthetic oligonucleotide
gacttgagctcctggaccgcggc

SEQ ID NO: 27558 - DNA, 23 bp, Artificial Sequence
  Description of Artificial Sequence: Synthetic oligonucleotide
acttgagctcctggaccgcggcg

SEQ ID NO: 27559 - DNA, 22 bp, Artificial Sequence
  Description of Artificial Sequence: Synthetic oligonucleotide
cttgagctcctggaccgcggcg

SEQ ID NO: 27560 - DNA, 23 bp, Artificial Sequence
  Description of Artificial Sequence: Synthetic oligonucleotide
ttgagctcctggaccgcggcgga

SEQ ID NO: 27561 - DNA, 23 bp, Artificial Sequence
  Description of Artificial Sequence: Synthetic oligonucleotide
gcaagtgggaggcggcccgtgaa

SEQ ID NO: 27562 - DNA, 23 bp, Artificial Sequence
  Description of Artificial Sequence: Synthetic oligonucleotide
caagtgggaggcggcccgtgaag

SEQ ID NO: 27563 - DNA, 23 bp, Artificial Sequence
  Description of Artificial Sequence: Synthetic oligonucleotide
aagtgggaggcggcccgtgaagc

SEQ ID NO: 27564 - DNA, 22 bp, Artificial Sequence
  Description of Artificial Sequence: Synthetic oligonucleotide
agtgggaggcggcccgtgaagc

SEQ ID NO: 27565 - DNA, 21 bp, Artificial Sequence
  Description of Artificial Sequence: Synthetic oligonucleotide
gtgggaggcggcccgtgaagc

SEQ ID NO: 27566 - DNA, 21 bp, Artificial Sequence
  Description of Artificial Sequence: Synthetic oligonucleotide
tgggaggcggcccgtgaagcg

SEQ ID NO: 27567 - DNA, 20 bp, Artificial Sequence
  Description of Artificial Sequence: Synthetic oligonucleotide
gggaggcggcccgtgaagcg

SEQ ID NO: 27568 - DNA, 21 bp, Artificial Sequence
  Description of Artificial Sequence: Synthetic oligonucleotide
ggaggcggcccgtgaagcgga

SEQ ID NO: 27569 - DNA, 21 bp, Artificial Sequence
  Description of Artificial Sequence: Synthetic oligonucleotide
gaggcggcccgtgaagcggag

SEQ ID NO: 27570 - DNA, 22 bp, Artificial Sequence
  Description of Artificial Sequence: Synthetic oligonucleotide
aggcggcccgtgaagcggagca

SEQ ID NO: 27571 - DNA, 21 bp, Artificial Sequence
  Description of Artificial Sequence: Synthetic oligonucleotide
ggcggcccgtgaagcggagca

SEQ ID NO: 27572 - DNA, 22 bp, Artificial Sequence
  Description of Artificial Sequence: Synthetic oligonucleotide
gcggcccgtgaagcggagcagt

SEQ ID NO: 27573 - DNA, 22 bp, Artificial Sequence
  Description of Artificial Sequence: Synthetic oligonucleotide
cggcccgtgaagcggagcagtg

SEQ ID NO: 27574 - DNA, 23 bp, Artificial Sequence
  Description of Artificial Sequence: Synthetic oligonucleotide
ggcccgtgaagcggagcagtgga

SEQ ID NO: 27575 - DNA, 24 bp, Artificial Sequence
  Description of Artificial Sequence: Synthetic oligonucleotide
gcccgtgaagcggagcagtggaga

SEQ ID NO: 27576 - DNA, 24 bp, Artificial Sequence
  Description of Artificial Sequence: Synthetic oligonucleotide
cccgtgaagcggagcagtggagag

SEQ ID NO: 27577 - DNA, 24 bp, Artificial Sequence
  Description of Artificial Sequence: Synthetic oligonucleotide
ccgtgaagcggagcagtggagagc

SEQ ID NO: 27578 - DNA, 26 bp, Artificial Sequence
  Description of Artificial Sequence: Synthetic oligonucleotide
cgtgaagcggagcagtggagagccta

SEQ ID NO: 27579 - DNA, 26 bp, Artificial Sequence
  Description of Artificial Sequence: Synthetic oligonucleotide
gtgaagcggagcagtggagagcctac

SEQ ID NO: 27580 - DNA, 27 bp, Artificial Sequence
  Description of Artificial Sequence: Synthetic oligonucleotide
tgaagcggagcagtggagagcctacct

SEQ ID NO: 27581 - DNA, 26 bp, Artificial Sequence
  Description of Artificial Sequence: Synthetic oligonucleotide
gaagcggagcagtggagagcctacct

SEQ ID NO: 27582 - DNA, 26 bp, Artificial Sequence
  Description of Artificial Sequence: Synthetic oligonucleotide
aagcggagcagtggagagcctacctg

SEQ ID NO: 27583 - DNA, 25 bp, Artificial Sequence
  Description of Artificial Sequence: Synthetic oligonucleotide
agcggagcagtggagagcctacctg

SEQ ID NO: 27584 - DNA, 21 bp, Artificial Sequence
  Description of Artificial Sequence: Synthetic oligonucleotide
gcgagtccgaggatggcgccg

SEQ ID NO: 27585 - DNA, 21 bp, Artificial Sequence
  Description of Artificial Sequence: Synthetic oligonucleotide
cgagtccgaggatggcgccgc

SEQ ID NO: 27586 - DNA, 21 bp, Artificial Sequence
  Description of Artificial Sequence: Synthetic oligonucleotide
gagtccgaggatggcgccgcg

SEQ ID NO: 27587 - DNA, 21 bp, Artificial Sequence
  Description of Artificial Sequence: Synthetic oligonucleotide
agtccgaggatggcgccgcgg

SEQ ID NO: 27588 - DNA, 20 bp, Artificial Sequence
  Description of Artificial Sequence: Synthetic oligonucleotide
gtccgaggatggcgccgcgg

SEQ ID NO: 27589 - DNA, 20 bp, Artificial Sequence
  Description of Artificial Sequence: Synthetic oligonucleotide
tccgaggatggcgccgcggg

SEQ ID NO: 27590 - DNA, 20 bp, Artificial Sequence
  Description of Artificial Sequence: Synthetic oligonucleotide
ccgaggatggcgccgcgggt

SEQ ID NO: 27591 - DNA, 20 bp, Artificial Sequence
  Description of Artificial Sequence: Synthetic oligonucleotide
cgaggatggcgccgcgggct

SEQ ID NO: 27592 - DNA, 20 bp, Artificial Sequence
  Description of Artificial Sequence: Synthetic oligonucleotide
gaggatggcgccgcgggcgt

SEQ ID NO: 27593 - DNA, 20 bp, Artificial Sequence
  Description of Artificial Sequence: Synthetic oligonucleotide
aggatggcgccgcgggcgct

SEQ ID NO: 27594 - DNA, 20 bp, Artificial Sequence
  Description of Artificial Sequence: Synthetic oligonucleotide
ggatggcgccgcgggcgctt

SEQ ID NO: 27595 - DNA, 20 bp, Artificial Sequence
  Description of Artificial Sequence: Synthetic oligonucleotide
gatggcgccgcgggcgccat

SEQ ID NO: 27596 - DNA, 20 bp, Artificial Sequence
  Description of Artificial Sequence: Synthetic oligonucleotide
atggcgccgcgggcgccatg

SEQ ID NO: 27597 - DNA, 20 bp, Artificial Sequence
  Description of Artificial Sequence: Synthetic oligonucleotide
tggcgccgcgggcgccatgt

SEQ ID NO: 27598 - DNA, 20 bp, Artificial Sequence
  Description of Artificial Sequence: Synthetic oligonucleotide
ggcgccgcgggcgccatgtt

SEQ ID NO: 27599 - DNA, 21 bp, Artificial Sequence
  Description of Artificial Sequence: Synthetic oligonucleotide
gcgccgcgggcgccatggata

SEQ ID NO: 27600 - DNA, 22 bp, Artificial Sequence
  Description of Artificial Sequence: Synthetic oligonucleotide
cgccgcgggcgccatggataga

SEQ ID NO: 27601 - DNA, 23 bp, Artificial Sequence
  Description of Artificial Sequence: Synthetic oligonucleotide
aggacctgagctcctggaccgcc

SEQ ID NO: 27602 - DNA, 22 bp, Artificial Sequence
  Description of Artificial Sequence: Synthetic oligonucleotide
ggacctgagctcctggaccgcc

SEQ ID NO: 27603 - DNA, 22 bp, Artificial Sequence
  Description of Artificial Sequence: Synthetic oligonucleotide
gacctgagctcctggaccgccg

SEQ ID NO: 27604 - DNA, 22 bp, Artificial Sequence
  Description of Artificial Sequence: Synthetic oligonucleotide
acctgagctcctggaccgccgc

SEQ ID NO: 27605 - DNA, 21 bp, Artificial Sequence
  Description of Artificial Sequence: Synthetic oligonucleotide
cctgagctcctggaccgccgc

SEQ ID NO: 27606 - DNA, 21 bp, Artificial Sequence
  Description of Artificial Sequence: Synthetic oligonucleotide
ctgagctcctggaccgccgcg

SEQ ID NO: 27607 - DNA, 22 bp, Artificial Sequence
  Description of Artificial Sequence: Synthetic oligonucleotide
tgagctcctggaccgccgcgga

SEQ ID NO: 27608 - DNA, 21 bp, Artificial Sequence
  Description of Artificial Sequence: Synthetic oligonucleotide
gagctcctggaccgccgcgga

SEQ ID NO: 27609 - DNA, 22 bp, Artificial Sequence
  Description of Artificial Sequence: Synthetic oligonucleotide
agctcctggaccgccgcggaca

SEQ ID NO: 27610 - DNA, 27 bp, Artificial Sequence
  Description of Artificial Sequence: Synthetic oligonucleotide
cagaggatgtatggctgcgacgtgggt

SEQ ID NO: 27611 - DNA, 27 bp, Artificial Sequence
  Description of Artificial Sequence: Synthetic oligonucleotide
agaggatgtatggctgcgacgtgggtc

SEQ ID NO: 27612 - DNA, 26 bp, Artificial Sequence
  Description of Artificial Sequence: Synthetic oligonucleotide
gaggatgtatggctgcgacgtgggtc

SEQ ID NO: 27613 - DNA, 26 bp, Artificial Sequence
  Description of Artificial Sequence: Synthetic oligonucleotide
aggatgtatggctgcgacgtgggtcc

SEQ ID NO: 27614 - DNA, 25 bp, Artificial Sequence
  Description of Artificial Sequence: Synthetic oligonucleotide
ggatgtatggctgcgacgtgggtcc

SEQ ID NO: 27615 - DNA, 25 bp, Artificial Sequence
  Description of Artificial Sequence: Synthetic oligonucleotide
gatgtatggctgcgacgtgggtccg

SEQ ID NO: 27616 - DNA, 26 bp, Artificial Sequence
  Description of Artificial Sequence: Synthetic oligonucleotide
atgtatggctgcgacgtgggtccgga

SEQ ID NO: 27617 - DNA, 25 bp, Artificial Sequence
  Description of Artificial Sequence: Synthetic oligonucleotide
tgtatggctgcgacgtgggtccgga

SEQ ID NO: 27618 - DNA, 24 bp, Artificial Sequence
  Description of Artificial Sequence: Synthetic oligonucleotide
gtatggctgcgacgtgggtccgga

SEQ ID NO: 27619 - DNA, 24 bp, Artificial Sequence
  Description of Artificial Sequence: Synthetic oligonucleotide
tatggctgcgacgtgggtccggac

SEQ ID NO: 27620 - DNA, 23 bp, Artificial Sequence
  Description of Artificial Sequence: Synthetic oligonucleotide
atggctgcgacgtgggtccggac

SEQ ID NO: 27621 - DNA, 22 bp, Artificial Sequence
  Description of Artificial Sequence: Synthetic oligonucleotide
tggctgcgacgtgggtccggac

SEQ ID NO: 27622 - DNA, 21 bp, Artificial Sequence
  Description of Artificial Sequence: Synthetic oligonucleotide
ggctgcgacgtgggtccggac

SEQ ID NO: 27623 - DNA, 21 bp, Artificial Sequence
  Description of Artificial Sequence: Synthetic oligonucleotide
gctgcgacgtgggtccggacg

SEQ ID NO: 27624 - DNA, 21 bp, Artificial Sequence
  Description of Artificial Sequence: Synthetic oligonucleotide
ctgcgacgtgggtccggacgg

SEQ ID NO: 27625 - DNA, 21 bp, Artificial Sequence
  Description of Artificial Sequence: Synthetic oligonucleotide
tgcgacgtgggtccggacggg

SEQ ID NO: 27626 - DNA, 20 bp, Artificial Sequence
  Description of Artificial Sequence: Synthetic oligonucleotide
gcgacgtgggtccggacggg

SEQ ID NO: 27627 - DNA, 20 bp, Artificial Sequence
  Description of Artificial Sequence: Synthetic oligonucleotide
cgacgtgggtccggacgggc

SEQ ID NO: 27628 - DNA, 20 bp, Artificial Sequence
  Description of Artificial Sequence: Synthetic oligonucleotide
gacgtgggtccggacgggcg

SEQ ID NO: 27629 - DNA, 20 bp, Artificial Sequence
  Description of Artificial Sequence: Synthetic oligonucleotide
acgtgggtccggacgggcgc

SEQ ID NO: 27630 - DNA, 20 bp, Artificial Sequence
  Description of Artificial Sequence: Synthetic oligonucleotide
cgtgggtccggacgggcgct

SEQ ID NO: 27631 - DNA, 20 bp, Artificial Sequence
  Description of Artificial Sequence: Synthetic oligonucleotide
gtgggtccggacgggcgcct

SEQ ID NO: 27632 - DNA, 20 bp, Artificial Sequence
  Description of Artificial Sequence: Synthetic oligonucleotide
tgggtccggacgggcgcctc

SEQ ID NO: 27633 - DNA, 20 bp, Artificial Sequence
  Description of Artificial Sequence: Synthetic oligonucleotide
gggtccggacgggcgcctct

SEQ ID NO: 27634 - DNA, 20 bp, Artificial Sequence
  Description of Artificial Sequence: Synthetic oligonucleotide
ggtccggacgggcgcctcct

SEQ ID NO: 27635 - DNA, 20 bp, Artificial Sequence
  Description of Artificial Sequence: Synthetic oligonucleotide
gtccggacgggcgcctcctc

SEQ ID NO: 27636 - DNA, 20 bp, Artificial Sequence
  Description of Artificial Sequence: Synthetic oligonucleotide
tccggacgggcgcctcctcc

SEQ ID NO: 27637 - DNA, 27 bp, Artificial Sequence
  Description of Artificial Sequence: Synthetic oligonucleotide
cgggtctcacaccctccagaggatgtt

SEQ ID NO: 27638 - DNA, 28 bp, Artificial Sequence
  Description of Artificial Sequence: Synthetic oligonucleotide
gggtctcacaccctccagaggatgtttg

SEQ ID NO: 27639 - DNA, 28 bp, Artificial Sequence
  Description of Artificial Sequence: Synthetic oligonucleotide
ggtctcacaccctccagaggatgtttgg

SEQ ID NO: 27640 - DNA, 28 bp, Artificial Sequence
  Description of Artificial Sequence: Synthetic oligonucleotide
gtctcacaccctccagaggatgtttggc

SEQ ID NO: 27641 - DNA, 26 bp, Artificial Sequence
  Description of Artificial Sequence: Synthetic oligonucleotide
agaggatgtttggctgcgacgtgggg

SEQ ID NO: 27642 - DNA, 25 bp, Artificial Sequence
  Description of Artificial Sequence: Synthetic oligonucleotide
gaggatgtttggctgcgacgtgggg

SEQ ID NO: 27643 - DNA, 25 bp, Artificial Sequence
  Description of Artificial Sequence: Synthetic oligonucleotide
aggatgtttggctgcgacgtggggc

SEQ ID NO: 27644 - DNA, 24 bp, Artificial Sequence
  Description of Artificial Sequence: Synthetic oligonucleotide
ggatgtttggctgcgacgtggggc

SEQ ID NO: 27645 - DNA, 23 bp, Artificial Sequence
  Description of Artificial Sequence: Synthetic oligonucleotide
aggccaccctgaggtgctgggct

SEQ ID NO: 27646 - DNA, 22 bp, Artificial Sequence
  Description of Artificial Sequence: Synthetic oligonucleotide
ggccaccctgaggtgctgggct

SEQ ID NO: 27647 - DNA, 23 bp, Artificial Sequence
  Description of Artificial Sequence: Synthetic oligonucleotide
gccaccctgaggtgctgggctct

SEQ ID NO: 27648 - DNA, 23 bp, Artificial Sequence
  Description of Artificial Sequence: Synthetic oligonucleotide
ccaccctgaggtgctgggctctg

SEQ ID NO: 27649 - DNA, 23 bp, Artificial Sequence
  Description of Artificial Sequence: Synthetic oligonucleotide
caccctgaggtgctgggctctgg

SEQ ID NO: 27650 - DNA, 23 bp, Artificial Sequence
  Description of Artificial Sequence: Synthetic oligonucleotide
accctgaggtgctgggctctggg

SEQ ID NO: 27651 - DNA, 22 bp, Artificial Sequence
  Description of Artificial Sequence: Synthetic oligonucleotide
ccctgaggtgctgggctctggg

SEQ ID NO: 27652 - DNA, 24 bp, Artificial Sequence
  Description of Artificial Sequence: Synthetic oligonucleotide
cctgaggtgctgggctctgggctt

SEQ ID NO: 27653 - DNA, 26 bp, Artificial Sequence
  Description of Artificial Sequence: Synthetic oligonucleotide
ctgaggtgctgggctctgggcttcta

SEQ ID NO: 27654 - DNA, 26 bp, Artificial Sequence
  Description of Artificial Sequence: Synthetic oligonucleotide
tgaggtgctgggctctgggcttctac

SEQ ID NO: 27655 - DNA, 25 bp, Artificial Sequence
  Description of Artificial Sequence: Synthetic oligonucleotide
gaggtgctgggctctgggcttctac

SEQ ID NO: 27656 - DNA, 25 bp, Artificial Sequence
  Description of Artificial Sequence: Synthetic oligonucleotide
aggtgctgggctctgggcttctacc

SEQ ID NO: 27657 - DNA, 24 bp, Artificial Sequence
  Description of Artificial Sequence: Synthetic oligonucleotide
ggtgctgggctctgggcttctacc

SEQ ID NO: 27658 - DNA, 25 bp, Artificial Sequence
  Description of Artificial Sequence: Synthetic oligonucleotide
gtgctgggctctgggcttctaccct

SEQ ID NO: 27659 - DNA, 25 bp, Artificial Sequence
  Description of Artificial Sequence: Synthetic oligonucleotide
tgctgggctctgggcttctaccctg

SEQ ID NO: 27660 - DNA, 24 bp, Artificial Sequence
  Description of Artificial Sequence: Synthetic oligonucleotide
gctgggctctgggcttctaccctg

SEQ ID NO: 27661 - DNA, 24 bp, Artificial Sequence
  Description of Artificial Sequence: Synthetic oligonucleotide
ctgggctctgggcttctaccctgc

SEQ ID NO: 27662 - DNA, 24 bp, Artificial Sequence
  Description of Artificial Sequence: Synthetic oligonucleotide
tgggctctgggcttctaccctgcg

SEQ ID NO: 27663 - DNA, 23 bp, Artificial Sequence
  Description of Artificial Sequence: Synthetic oligonucleotide
gggctctgggcttctaccctgcg

SEQ ID NO: 27664 - DNA, 24 bp, Artificial Sequence
  Description of Artificial Sequence: Synthetic oligonucleotide
ggctctgggcttctaccctgcgga

SEQ ID NO: 27665 - DNA, 26 bp, Artificial Sequence
  Description of Artificial Sequence: Synthetic oligonucleotide
gctctgggcttctaccctgcggagat

SEQ ID NO: 27666 - DNA, 27 bp, Artificial Sequence
  Description of Artificial Sequence: Synthetic oligonucleotide
ctctgggcttctaccctgcggagatca

SEQ ID NO: 27667 - DNA, 27 bp, Artificial Sequence
  Description of Artificial Sequence: Synthetic oligonucleotide
tctgggcttctaccctgcggagatcac

SEQ ID NO: 27668 - DNA, 27 bp, Artificial Sequence
  Description of Artificial Sequence: Synthetic oligonucleotide
caccgagcttgtggagaccagaccagt

SEQ ID NO: 27669 - DNA, 28 bp, Artificial Sequence
  Description of Artificial Sequence: Synthetic oligonucleotide
accgagcttgtggagaccagaccagtag

SEQ ID NO: 27670 - DNA, 27 bp, Artificial Sequence
  Description of Artificial Sequence: Synthetic oligonucleotide
ccgagcttgtggagaccagaccagtag

SEQ ID NO: 27671 - DNA, 27 bp, Artificial Sequence
  Description of Artificial Sequence: Synthetic oligonucleotide
cgagcttgtggagaccagaccagtagg

SEQ ID NO: 27672 - DNA, 28 bp, Artificial Sequence
  Description of Artificial Sequence: Synthetic oligonucleotide
gagcttgtggagaccagaccagtaggag

SEQ ID NO: 27673 - DNA, 31 bp, Artificial Sequence
  Description of Artificial Sequence: Synthetic oligonucleotide
agcttgtggagaccagaccagtaggagatag

SEQ ID NO: 27674 - DNA, 30 bp, Artificial Sequence
  Description of Artificial Sequence: Synthetic oligonucleotide
gcttgtggagaccagaccagtaggagatag

SEQ ID NO: 27675 - DNA, 32 bp, Artificial Sequence
  Description of Artificial Sequence: Synthetic oligonucleotide
cttgtggagaccagaccagtaggagatagaac

SEQ ID NO: 27676 - DNA, 32 bp, Artificial Sequence
  Description of Artificial Sequence: Synthetic oligonucleotide
ttgtggagaccagaccagtaggagatagaacc

SEQ ID NO: 27677 - DNA, 31 bp, Artificial Sequence
  Description of Artificial Sequence: Synthetic oligonucleotide
tgtggagaccagaccagtaggagatagaacc

SEQ ID NO: 27678 - DNA, 30 bp, Artificial Sequence
  Description of Artificial Sequence: Synthetic oligonucleotide
gtggagaccagaccagtaggagatagaacc

SEQ ID NO: 27679 - DNA, 32 bp, Artificial Sequence
  Description of Artificial Sequence: Synthetic oligonucleotide
tggagaccagaccagtaggagatagaaccttc

SEQ ID NO: 27680 - DNA, 31 bp, Artificial Sequence
  Description of Artificial Sequence: Synthetic oligonucleotide
ggagaccagaccagtaggagatagaaccttc

SEQ ID NO: 27681 - DNA, 31 bp, Artificial Sequence
  Description of Artificial Sequence: Synthetic oligonucleotide
gagaccagaccagtaggagatagaaccttcc

SEQ ID NO: 27682 - DNA, 32 bp, Artificial Sequence
  Description of Artificial Sequence: Synthetic oligonucleotide
agaccagaccagtaggagatagaaccttccag

SEQ ID NO: 27683 - DNA, 31 bp, Artificial Sequence
  Description of Artificial Sequence: Synthetic oligonucleotide
gaccagaccagtaggagatagaaccttccag

SEQ ID NO: 27684 - DNA, 33 bp, Artificial Sequence
  Description of Artificial Sequence: Synthetic oligonucleotide
accagaccagtaggagatagaaccttccagaag

SEQ ID NO: 27685 - DNA, 32 bp, Artificial Sequence
  Description of Artificial Sequence: Synthetic oligonucleotide
ccagaccagtaggagatagaaccttccagaag

SEQ ID NO: 27686 - DNA, 33 bp, Artificial Sequence
  Description of Artificial Sequence: Synthetic oligonucleotide
cagaccagtaggagatagaaccttccagaagtg

SEQ ID NO: 27687 - DNA, 33 bp, Artificial Sequence
  Description of Artificial Sequence: Synthetic oligonucleotide
agaccagtaggagatagaaccttccagaagtgg

SEQ ID NO: 27688 - DNA, 32 bp, Artificial Sequence
  Description of Artificial Sequence: Synthetic oligonucleotide
gaccagtaggagatagaaccttccagaagtgg

SEQ ID NO: 27689 - DNA, 32 bp, Artificial Sequence
  Description of Artificial Sequence: Synthetic oligonucleotide
accagtaggagatagaaccttccagaagtggg

SEQ ID NO: 27690 - DNA, 31 bp, Artificial Sequence
  Description of Artificial Sequence: Synthetic oligonucleotide
ccagtaggagatagaaccttccagaagtggg

SEQ ID NO: 27691 - DNA, 31 bp, Artificial Sequence
  Description of Artificial Sequence: Synthetic oligonucleotide
cagtaggagatagaaccttccagaagtgggc

SEQ ID NO: 27692 - DNA, 32 bp, Artificial Sequence
  Description of Artificial Sequence: Synthetic oligonucleotide
agtaggagatagaaccttccagaagtgggcag

SEQ ID NO: 27693 - DNA, 31 bp, Artificial Sequence
  Description of Artificial Sequence: Synthetic oligonucleotide
gtaggagatagaaccttccagaagtgggcag

SEQ ID NO: 27694 - DNA, 31 bp, Artificial Sequence
  Description of Artificial Sequence: Synthetic oligonucleotide
taggagatagaaccttccagaagtgggcagc

SEQ ID NO: 27695 - DNA, 21 bp, Artificial Sequence
  Description of Artificial Sequence: Synthetic oligonucleotide
tgctctcgggagccctggccc

SEQ ID NO: 27696 - DNA, 20 bp, Artificial Sequence
  Description of Artificial Sequence: Synthetic oligonucleotide
gctctcgggagccctggccc

SEQ ID NO: 27697 - DNA, 20 bp, Artificial Sequence
  Description of Artificial Sequence: Synthetic oligonucleotide
ctctcgggagccctggcccc

SEQ ID NO: 27698 - DNA, 21 bp, Artificial Sequence
  Description of Artificial Sequence: Synthetic oligonucleotide
tctcgggagccctggccccga

SEQ ID NO: 27699 - DNA, 20 bp, Artificial Sequence
  Description of Artificial Sequence: Synthetic oligonucleotide
ctcgggagccctggccccga

SEQ ID NO: 27700 - DNA, 20 bp, Artificial Sequence
  Description of Artificial Sequence: Synthetic oligonucleotide
tcgggagccctggccccgac

SEQ ID NO: 27701 - DNA, 20 bp, Artificial Sequence
  Description of Artificial Sequence: Synthetic oligonucleotide
cgggagccctggccccgact

SEQ ID NO: 27702 - DNA, 20 bp, Artificial Sequence
  Description of Artificial Sequence: Synthetic oligonucleotide
gggagccctggccccgacct

SEQ ID NO: 27703 - DNA, 20 bp, Artificial Sequence
  Description of Artificial Sequence: Synthetic oligonucleotide
ggagccctggccccgaccga

SEQ ID NO: 27704 - DNA, 21 bp, Artificial Sequence
  Description of Artificial Sequence: Synthetic oligonucleotide
gagccctggccccgaccgaga

SEQ ID NO: 27705 - DNA, 21 bp, Artificial Sequence
  Description of Artificial Sequence: Synthetic oligonucleotide
agccctggccccgaccgagac

SEQ ID NO: 27706 - DNA, 20 bp, Artificial Sequence
  Description of Artificial Sequence: Synthetic oligonucleotide
gccctggccccgaccgagac

SEQ ID NO: 27707 - DNA, 21 bp, Artificial Sequence
  Description of Artificial Sequence: Synthetic oligonucleotide
ccctggccccgaccgagacct

SEQ ID NO: 27708 - DNA, 21 bp, Artificial Sequence
  Description of Artificial Sequence: Synthetic oligonucleotide
cctggccccgaccgagacctg

SEQ ID NO: 27709 - DNA, 21 bp, Artificial Sequence
  Description of Artificial Sequence: Synthetic oligonucleotide
ctggccccgaccgagacctgg

SEQ ID NO: 27710 - DNA, 21 bp, Artificial Sequence
  Description of Artificial Sequence: Synthetic oligonucleotide
tggccccgaccgagacctggg

SEQ ID NO: 27711 - DNA, 20 bp, Artificial Sequence
  Description of Artificial Sequence: Synthetic oligonucleotide
ggccccgaccgagacctggg

SEQ ID NO: 27712 - DNA, 20 bp, Artificial Sequence
  Description of Artificial Sequence: Synthetic oligonucleotide
gccccgaccgagacctgggc

SEQ ID NO: 27713 - DNA, 20 bp, Artificial Sequence
  Description of Artificial Sequence: Synthetic oligonucleotide
ccccgaccgagacctgggcc

SEQ ID NO: 27714 - DNA, 20 bp, Artificial Sequence
  Description of Artificial Sequence: Synthetic oligonucleotide
cccgaccgagacctgggccg

SEQ ID NO: 27715 - DNA, 20 bp, Artificial Sequence
  Description of Artificial Sequence: Synthetic oligonucleotide
ccgaccgagacctgggccgg

SEQ ID NO: 27716 - DNA, 21 bp, Artificial Sequence
  Description of Artificial Sequence: Synthetic oligonucleotide
cgaccgagacctgggccggct

SEQ ID NO: 27717 - DNA, 27 bp, Artificial Sequence
  Description of Artificial Sequence: Synthetic oligonucleotide
taccctgcggagatcacactgacctgc

SEQ ID NO: 27718 - DNA, 26 bp, Artificial Sequence
  Description of Artificial Sequence: Synthetic oligonucleotide
accctgcggagatcacactgacctgc

SEQ ID NO: 27719 - DNA, 25 bp, Artificial Sequence
  Description of Artificial Sequence: Synthetic oligonucleotide
ccctgcggagatcacactgacctgc

SEQ ID NO: 27720 - DNA, 26 bp, Artificial Sequence
  Description of Artificial Sequence: Synthetic oligonucleotide
cctgcggagatcacactgacctgcca

SEQ ID NO: 27721 - DNA, 26 bp, Artificial Sequence
  Description of Artificial Sequence: Synthetic oligonucleotide
ctgcggagatcacactgacctgccag

SEQ ID NO: 27722 - DNA, 26 bp, Artificial Sequence
  Description of Artificial Sequence: Synthetic oligonucleotide
tgcggagatcacactgacctgccagc

SEQ ID NO: 27723 - DNA, 25 bp, Artificial Sequence
  Description of Artificial Sequence: Synthetic oligonucleotide
gcggagatcacactgacctgccagc

SEQ ID NO: 27724 - DNA, 25 bp, Artificial Sequence
  Description of Artificial Sequence: Synthetic oligonucleotide
cggagatcacactgacctgccagcg

SEQ ID NO: 27725 - DNA, 25 bp, Artificial Sequence
  Description of Artificial Sequence: Synthetic oligonucleotide
ggagatcacactgacctgccagcgg

SEQ ID NO: 27726 - DNA, 27 bp, Artificial Sequence
  Description of Artificial Sequence: Synthetic oligonucleotide
gagatcacactgacctgccagcgggat

SEQ ID NO: 27727 - DNA, 27 bp, Artificial Sequence
  Description of Artificial Sequence: Synthetic oligonucleotide
agatcacactgacctgccagcgggatg

SEQ ID NO: 27728 - DNA, 26 bp, Artificial Sequence
  Description of Artificial Sequence: Synthetic oligonucleotide
gatcacactgacctgccagcgggatg

SEQ ID NO: 27729 - DNA, 26 bp, Artificial Sequence
  Description of Artificial Sequence: Synthetic oligonucleotide
atcacactgacctgccagcgggatgg

SEQ ID NO: 27730 - DNA, 25 bp, Artificial Sequence
  Description of Artificial Sequence: Synthetic oligonucleotide
tcacactgacctgccagcgggatgg

SEQ ID NO: 27731 - DNA, 24 bp, Artificial Sequence
  Description of Artificial Sequence: Synthetic oligonucleotide
cacactgacctgccagcgggatgg

SEQ ID NO: 27732 - DNA, 24 bp, Artificial Sequence
  Description of Artificial Sequence: Synthetic oligonucleotide
acactgacctgccagcgggatggc

SEQ ID NO: 27733 - DNA, 23 bp, Artificial Sequence
  Description of Artificial Sequence: Synthetic oligonucleotide
cactgacctgccagcgggatggc

SEQ ID NO: 27734 - DNA, 24 bp, Artificial Sequence
  Description of Artificial Sequence: Synthetic oligonucleotide
actgacctgccagcgggatggcga

SEQ ID NO: 27735 - DNA, 23 bp, Artificial Sequence
  Description of Artificial Sequence: Synthetic oligonucleotide
ctgacctgccagcgggatggcga

SEQ ID NO: 27736 - DNA, 23 bp, Artificial Sequence
  Description of Artificial Sequence: Synthetic oligonucleotide
tgacctgccagcgggatggcgag

SEQ ID NO: 27737 - DNA, 22 bp, Artificial Sequence
  Description of Artificial Sequence: Synthetic oligonucleotide
gacctgccagcgggatggcgag

SEQ ID NO: 27738 - DNA, 23 bp, Artificial Sequence
  Description of Artificial Sequence: Synthetic oligonucleotide
acctgccagcgggatggcgagga

SEQ ID NO: 27739 - DNA, 22 bp, Artificial Sequence
  Description of Artificial Sequence: Synthetic oligonucleotide
cctgccagcgggatggcgagga

SEQ ID NO: 27740 - DNA, 22 bp, Artificial Sequence
  Description of Artificial Sequence: Synthetic oligonucleotide
ctgccagcgggatggcgaggac

SEQ ID NO: 27741 - DNA, 25 bp, Artificial Sequence
  Description of Artificial Sequence: Synthetic oligonucleotide
tgccagcgggatggcgaggaccaaa

SEQ ID NO: 27742 - DNA, 24 bp, Artificial Sequence
  Description of Artificial Sequence: Synthetic oligonucleotide
gccagcgggatggcgaggaccaaa

SEQ ID NO: 27743 - DNA, 25 bp, Artificial Sequence
  Description of Artificial Sequence: Synthetic oligonucleotide
ccagcgggatggcgaggaccaaact

SEQ ID NO: 27744 - DNA, 22 bp, Artificial Sequence
  Description of Artificial Sequence: Synthetic oligonucleotide
cagcgcaagtgggaggcggcct

SEQ ID NO: 27745 - DNA, 23 bp, Artificial Sequence
  Description of Artificial Sequence: Synthetic oligonucleotide
agcgcaagtgggaggcggcctgt

SEQ ID NO: 27746 - DNA, 22 bp, Artificial Sequence
  Description of Artificial Sequence: Synthetic oligonucleotide
gcgcaagtgggaggcggcctgt

SEQ ID NO: 27747 - DNA, 23 bp, Artificial Sequence
  Description of Artificial Sequence: Synthetic oligonucleotide
cgcaagtgggaggcggcctgtga

SEQ ID NO: 27748 - DNA, 23 bp, Artificial Sequence
  Description of Artificial Sequence: Synthetic oligonucleotide
gcaagtgggaggcggcctgtgag

SEQ ID NO: 27749 - DNA, 23 bp, Artificial Sequence
  Description of Artificial Sequence: Synthetic oligonucleotide
caagtgggaggcggcctgtgagg

SEQ ID NO: 27750 - DNA, 23 bp, Artificial Sequence
  Description of Artificial Sequence: Synthetic oligonucleotide
aagtgggaggcggcctgtgaggc

SEQ ID NO: 27751 - DNA, 22 bp, Artificial Sequence
  Description of Artificial Sequence: Synthetic oligonucleotide
agtgggaggcggcctgtgaggc

SEQ ID NO: 27752 - DNA, 21 bp, Artificial Sequence
  Description of Artificial Sequence: Synthetic oligonucleotide
gtgggaggcggcctgtgaggc

SEQ ID NO: 27753 - DNA, 21 bp, Artificial Sequence
  Description of Artificial Sequence: Synthetic oligonucleotide
tgggaggcggcctgtgaggcg

SEQ ID NO: 27754 - DNA, 20 bp, Artificial Sequence
  Description of Artificial Sequence: Synthetic oligonucleotide
gggaggcggcctgtgaggcg

SEQ ID NO: 27755 - DNA, 21 bp, Artificial Sequence
  Description of Artificial Sequence: Synthetic oligonucleotide
ggaggcggcctgtgaggcgga

SEQ ID NO: 27756 - DNA, 21 bp, Artificial Sequence
  Description of Artificial Sequence: Synthetic oligonucleotide
gaggcggcctgtgaggcggag

SEQ ID NO: 27757 - DNA, 22 bp, Artificial Sequence
  Description of Artificial Sequence: Synthetic oligonucleotide
aggcggcctgtgaggcggagca

SEQ ID NO: 27758 - DNA, 21 bp, Artificial Sequence
  Description of Artificial Sequence: Synthetic oligonucleotide
ggcggcctgtgaggcggagca

SEQ ID NO: 27759 - DNA, 22 bp, Artificial Sequence
  Description of Artificial Sequence: Synthetic oligonucleotide
gcggcctgtgaggcggagcagt

SEQ ID NO: 27760 - DNA, 22 bp, Artificial Sequence
  Description of Artificial Sequence: Synthetic oligonucleotide
cggcctgtgaggcggagcagtg

SEQ ID NO: 27761 - DNA, 23 bp, Artificial Sequence
  Description of Artificial Sequence: Synthetic oligonucleotide
ggcctgtgaggcggagcagtgga

SEQ ID NO: 27762 - DNA, 24 bp, Artificial Sequence
  Description of Artificial Sequence: Synthetic oligonucleotide
gcctgtgaggcggagcagtggaga

SEQ ID NO: 27763 - DNA, 24 bp, Artificial Sequence
  Description of Artificial Sequence: Synthetic oligonucleotide
cctgtgaggcggagcagtggagag

SEQ ID NO: 27764 - DNA, 24 bp, Artificial Sequence
  Description of Artificial Sequence: Synthetic oligonucleotide
ctgtgaggcggagcagtggagagc

SEQ ID NO: 27765 - DNA, 26 bp, Artificial Sequence
  Description of Artificial Sequence: Synthetic oligonucleotide
tgtgaggcggagcagtggagagccta

SEQ ID NO: 27766 - DNA, 25 bp, Artificial Sequence
  Description of Artificial Sequence: Synthetic oligonucleotide
acagcgacgccacgagtccgaggaa

SEQ ID NO: 27767 - DNA, 24 bp, Artificial Sequence
  Description of Artificial Sequence: Synthetic oligonucleotide
cagcgacgccacgagtccgaggaa

SEQ ID NO: 27768 - DNA, 24 bp, Artificial Sequence
  Description of Artificial Sequence: Synthetic oligonucleotide
agcgacgccacgagtccgaggaag

SEQ ID NO: 27769 - DNA, 23 bp, Artificial Sequence
  Description of Artificial Sequence: Synthetic oligonucleotide
gcgacgccacgagtccgaggaag

SEQ ID NO: 27770 - DNA, 24 bp, Artificial Sequence
  Description of Artificial Sequence: Synthetic oligonucleotide
cgacgccacgagtccgaggaagga

SEQ ID NO: 27771 - DNA, 24 bp, Artificial Sequence
  Description of Artificial Sequence: Synthetic oligonucleotide
gacgccacgagtccgaggaaggag

SEQ ID NO: 27772 - DNA, 24 bp, Artificial Sequence
  Description of Artificial Sequence: Synthetic oligonucleotide
acgccacgagtccgaggaaggagc

SEQ ID NO: 27773 - DNA, 23 bp, Artificial Sequence
  Description of Artificial Sequence: Synthetic oligonucleotide
cgccacgagtccgaggaaggagc

SEQ ID NO: 27774 - DNA, 23 bp, Artificial Sequence
  Description of Artificial Sequence: Synthetic oligonucleotide
gccacgagtccgaggaaggagcc

SEQ ID NO: 27775 - DNA, 23 bp, Artificial Sequence
  Description of Artificial Sequence: Synthetic oligonucleotide
ccacgagtccgaggaaggagccg

SEQ ID NO: 27776 - DNA, 23 bp, Artificial Sequence
  Description of Artificial Sequence: Synthetic oligonucleotide
cacgagtccgaggaaggagccgc

SEQ ID NO: 27777 - DNA, 23 bp, Artificial Sequence
  Description of Artificial Sequence: Synthetic oligonucleotide
acgagtccgaggaaggagccgcg

SEQ ID NO: 27778 - DNA, 22 bp, Artificial Sequence
  Description of Artificial Sequence: Synthetic oligonucleotide
cgagtccgaggaaggagccgcg

SEQ ID NO: 27779 - DNA, 22 bp, Artificial Sequence
  Description of Artificial Sequence: Synthetic oligonucleotide
gagtccgaggaaggagccgcgg

SEQ ID NO: 27780 - DNA, 22 bp, Artificial Sequence
  Description of Artificial Sequence: Synthetic oligonucleotide
agtccgaggaaggagccgcggg

SEQ ID NO: 27781 - DNA, 21 bp, Artificial Sequence
  Description of Artificial Sequence: Synthetic oligonucleotide
gtccgaggaaggagccgcggg

SEQ ID NO: 27782 - DNA, 21 bp, Artificial Sequence
  Description of Artificial Sequence: Synthetic oligonucleotide
tccgaggaaggagccgcgggc

SEQ ID NO: 27783 - DNA, 20 bp, Artificial Sequence
  Description of Artificial Sequence: Synthetic oligonucleotide
ccgaggaaggagccgcgggc

SEQ ID NO: 27784 - DNA, 20 bp, Artificial Sequence
  Description of Artificial Sequence: Synthetic oligonucleotide
cgaggaaggagccgcgggcg

SEQ ID NO: 27785 - DNA, 20 bp, Artificial Sequence
  Description of Artificial Sequence: Synthetic oligonucleotide
gaggaaggagccgcgggcgc

SEQ ID NO: 27786 - DNA, 22 bp, Artificial Sequence
  Description of Artificial Sequence: Synthetic oligonucleotide
aggaaggagccgcgggcgccat

SEQ ID NO: 27787 - DNA, 21 bp, Artificial Sequence
  Description of Artificial Sequence: Synthetic oligonucleotide
ggaaggagccgcgggcgccat

SEQ ID NO: 27788 - DNA, 21 bp, Artificial Sequence
  Description of Artificial Sequence: Synthetic oligonucleotide
gaaggagccgcgggcgccatg

SEQ ID NO: 27789 - DNA, 24 bp, Artificial Sequence
  Description of Artificial Sequence: Synthetic oligonucleotide
aaggagccgcgggcgccatggata

SEQ ID NO: 27790 - DNA, 24 bp, Artificial Sequence
  Description of Artificial Sequence: Synthetic oligonucleotide
cccgtgaggcggagcagctgagaa

SEQ ID NO: 27791 - DNA, 24 bp, Artificial Sequence
  Description of Artificial Sequence: Synthetic oligonucleotide
ccgtgaggcggagcagctgagaac

SEQ ID NO: 27792 - DNA, 26 bp, Artificial Sequence
  Description of Artificial Sequence: Synthetic oligonucleotide
cgtgaggcggagcagctgagaaccta

SEQ ID NO: 27793 - DNA, 26 bp, Artificial Sequence
  Description of Artificial Sequence: Synthetic oligonucleotide
gtgaggcggagcagctgagaacctac

SEQ ID NO: 27794 - DNA, 27 bp, Artificial Sequence
  Description of Artificial Sequence: Synthetic oligonucleotide
tgaggcggagcagctgagaacctacct

SEQ ID NO: 27795 - DNA, 26 bp, Artificial Sequence
  Description of Artificial Sequence: Synthetic oligonucleotide
gaggcggagcagctgagaacctacct

SEQ ID NO: 27796 - DNA, 26 bp, Artificial Sequence
  Description of Artificial Sequence: Synthetic oligonucleotide
aggcggagcagctgagaacctacctg

SEQ ID NO: 27797 - DNA, 26 bp, Artificial Sequence
  Description of Artificial Sequence: Synthetic oligonucleotide
agcagctgagaacctacctggagggc

SEQ ID NO: 27798 - DNA, 25 bp, Artificial Sequence
  Description of Artificial Sequence: Synthetic oligonucleotide
gcagctgagaacctacctggagggc

SEQ ID NO: 27799 - DNA, 26 bp, Artificial Sequence
  Description of Artificial Sequence: Synthetic oligonucleotide
cagctgagaacctacctggagggcct

SEQ ID NO: 27800 - DNA, 27 bp, Artificial Sequence
  Description of Artificial Sequence: Synthetic oligonucleotide
agctgagaacctacctggagggcctgt

SEQ ID NO: 27801 - DNA, 26 bp, Artificial Sequence
  Description of Artificial Sequence: Synthetic oligonucleotide
gctgagaacctacctggagggcctgt

SEQ ID NO: 27802 - DNA, 26 bp, Artificial Sequence
  Description of Artificial Sequence: Synthetic oligonucleotide
ctgagaacctacctggagggcctgtg

SEQ ID NO: 27803 - DNA, 26 bp, Artificial Sequence
  Description of Artificial Sequence: Synthetic oligonucleotide
tgagaacctacctggagggcctgtgc

SEQ ID NO: 27804 - DNA, 25 bp, Artificial Sequence
  Description of Artificial Sequence: Synthetic oligonucleotide
gagaacctacctggagggcctgtgc

SEQ ID NO: 27805 - DNA, 26 bp, Artificial Sequence
  Description of Artificial Sequence: Synthetic oligonucleotide
agaacctacctggagggcctgtgcgt

SEQ ID NO: 27806 - DNA, 25 bp, Artificial Sequence
  Description of Artificial Sequence: Synthetic oligonucleotide
gaacctacctggagggcctgtgcgt

SEQ ID NO: 27807 - DNA, 25 bp, Artificial Sequence
  Description of Artificial Sequence: Synthetic oligonucleotide
aacctacctggagggcctgtgcgtg

SEQ ID NO: 27808 - DNA, 24 bp, Artificial Sequence
  Description of Artificial Sequence: Synthetic oligonucleotide
acctacctggagggcctgtgcgtg

SEQ ID NO: 27809 - DNA, 24 bp, Artificial Sequence
  Description of Artificial Sequence: Synthetic oligonucleotide
gttcgacagcgacgccgcgagtct

SEQ ID NO: 27810 - DNA, 25 bp, Artificial Sequence
  Description of Artificial Sequence: Synthetic oligonucleotide
ttcgacagcgacgccgcgagtctga

SEQ ID NO: 27811 - DNA, 24 bp, Artificial Sequence
  Description of Artificial Sequence: Synthetic oligonucleotide
tcgacagcgacgccgcgagtctga

SEQ ID NO: 27812 - DNA, 23 bp, Artificial Sequence
  Description of Artificial Sequence: Synthetic oligonucleotide
cgacagcgacgccgcgagtctga

SEQ ID NO: 27813 - DNA, 23 bp, Artificial Sequence
  Description of Artificial Sequence: Synthetic oligonucleotide
gacagcgacgccgcgagtctgag

SEQ ID NO: 27814 - DNA, 25 bp, Artificial Sequence
  Description of Artificial Sequence: Synthetic oligonucleotide
acagcgacgccgcgagtctgaggat

SEQ ID NO: 27815 - DNA, 24 bp, Artificial Sequence
  Description of Artificial Sequence: Synthetic oligonucleotide
cagcgacgccgcgagtctgaggat

SEQ ID NO: 27816 - DNA, 24 bp, Artificial Sequence
  Description of Artificial Sequence: Synthetic oligonucleotide
agcgacgccgcgagtctgaggatg

SEQ ID NO: 27817 - DNA, 23 bp, Artificial Sequence
  Description of Artificial Sequence: Synthetic oligonucleotide
gcgacgccgcgagtctgaggatg

SEQ ID NO: 27818 - DNA, 23 bp, Artificial Sequence
  Description of Artificial Sequence: Synthetic oligonucleotide
cgacgccgcgagtctgaggatgg

SEQ ID NO: 27819 - DNA, 23 bp, Artificial Sequence
  Description of Artificial Sequence: Synthetic oligonucleotide
gacgccgcgagtctgaggatggc

SEQ ID NO: 27820 - DNA, 23 bp, Artificial Sequence
  Description of Artificial Sequence: Synthetic oligonucleotide
acgccgcgagtctgaggatggcg

SEQ ID NO: 27821 - DNA, 22 bp, Artificial Sequence
  Description of Artificial Sequence: Synthetic oligonucleotide
cgccgcgagtctgaggatggcg

SEQ ID NO: 27822 - DNA, 22 bp, Artificial Sequence
  Description of Artificial Sequence: Synthetic oligonucleotide
gccgcgagtctgaggatggcgc

SEQ ID NO: 27823 - DNA, 22 bp, Artificial Sequence
  Description of Artificial Sequence: Synthetic oligonucleotide
ccgcgagtctgaggatggcgcc

SEQ ID NO: 27824 - DNA, 22 bp, Artificial Sequence
  Description of Artificial Sequence: Synthetic oligonucleotide
cgcgagtctgaggatggcgccc

SEQ ID NO: 27825 - DNA, 22 bp, Artificial Sequence
  Description of Artificial Sequence: Synthetic oligonucleotide
gcgagtctgaggatggcgcccc

SEQ ID NO: 27826 - DNA, 22 bp, Artificial Sequence
  Description of Artificial Sequence: Synthetic oligonucleotide
cgagtctgaggatggcgccccg

SEQ ID NO: 27827 - DNA, 22 bp, Artificial Sequence
  Description of Artificial Sequence: Synthetic oligonucleotide
gagtctgaggatggcgccccgg

SEQ ID NO: 27828 - DNA, 22 bp, Artificial Sequence
  Description of Artificial Sequence: Synthetic oligonucleotide
agtctgaggatggcgccccggg

SEQ ID NO: 27829 - DNA, 21 bp, Artificial Sequence
  Description of Artificial Sequence: Synthetic oligonucleotide
gtctgaggatggcgccccggg

SEQ ID NO: 27830 - DNA, 21 bp, Artificial Sequence
  Description of Artificial Sequence: Synthetic oligonucleotide
tctgaggatggcgccccgggc

SEQ ID NO: 27831 - DNA, 20 bp, Artificial Sequence
  Description of Artificial Sequence: Synthetic oligonucleotide
ctgaggatggcgccccgggc

SEQ ID NO: 27832 - DNA, 20 bp, Artificial Sequence
  Description of Artificial Sequence: Synthetic oligonucleotide
tgaggatggcgccccgggcg

SEQ ID NO: 27833 - DNA, 26 bp, Artificial Sequence
  Description of Artificial Sequence: Synthetic oligonucleotide
gggtctcacaccctccagaggatgtg

SEQ ID NO: 27834 - DNA, 26 bp, Artificial Sequence
  Description of Artificial Sequence: Synthetic oligonucleotide
ggtctcacaccctccagaggatgtgc

SEQ ID NO: 27835 - DNA, 26 bp, Artificial Sequence
  Description of Artificial Sequence: Synthetic oligonucleotide
gtctcacaccctccagaggatgtgcg

SEQ ID NO: 27836 - DNA, 26 bp, Artificial Sequence
  Description of Artificial Sequence: Synthetic oligonucleotide
tctcacaccctccagaggatgtgcgg

SEQ ID NO: 27837 - DNA, 25 bp, Artificial Sequence
  Description of Artificial Sequence: Synthetic oligonucleotide
ctcacaccctccagaggatgtgcgg

SEQ ID NO: 27838 - DNA, 26 bp, Artificial Sequence
  Description of Artificial Sequence: Synthetic oligonucleotide
tcacaccctccagaggatgtgcggct

SEQ ID NO: 27839 - DNA, 25 bp, Artificial Sequence
  Description of Artificial Sequence: Synthetic oligonucleotide
cacaccctccagaggatgtgcggct

SEQ ID NO: 27840 - DNA, 25 bp, Artificial Sequence
  Description of Artificial Sequence: Synthetic oligonucleotide
acaccctccagaggatgtgcggctg

SEQ ID NO: 27841 - DNA, 24 bp, Artificial Sequence
  Description of Artificial Sequence: Synthetic oligonucleotide
caccctccagaggatgtgcggctg

SEQ ID NO: 27842 - DNA, 24 bp, Artificial Sequence
  Description of Artificial Sequence: Synthetic oligonucleotide
accctccagaggatgtgcggctgc

SEQ ID NO: 27843 - DNA, 23 bp, Artificial Sequence
  Description of Artificial Sequence: Synthetic oligonucleotide
ccctccagaggatgtgcggctgc

SEQ ID NO: 27844 - DNA, 24 bp, Artificial Sequence
  Description of Artificial Sequence: Synthetic oligonucleotide
cctccagaggatgtgcggctgcga

SEQ ID NO: 27845 - DNA, 24 bp, Artificial Sequence
  Description of Artificial Sequence: Synthetic oligonucleotide
ctccagaggatgtgcggctgcgac

SEQ ID NO: 27846 - DNA, 25 bp, Artificial Sequence
  Description of Artificial Sequence: Synthetic oligonucleotide
tccagaggatgtgcggctgcgacgt

SEQ ID NO: 27847 - DNA, 24 bp, Artificial Sequence
  Description of Artificial Sequence: Synthetic oligonucleotide
ccagaggatgtgcggctgcgacgt

SEQ ID NO: 27848 - DNA, 24 bp, Artificial Sequence
  Description of Artificial Sequence: Synthetic oligonucleotide
cagaggatgtgcggctgcgacgtg

SEQ ID NO: 27849 - DNA, 24 bp, Artificial Sequence
  Description of Artificial Sequence: Synthetic oligonucleotide
agaggatgtgcggctgcgacgtgg

SEQ ID NO: 27850 - DNA, 23 bp, Artificial Sequence
  Description of Artificial Sequence: Synthetic oligonucleotide
gaggatgtgcggctgcgacgtgg

SEQ ID NO: 27851 - DNA, 23 bp, Artificial Sequence
  Description of Artificial Sequence: Synthetic oligonucleotide
aggatgtgcggctgcgacgtggg

SEQ ID NO: 27852 - DNA, 22 bp, Artificial Sequence
  Description of Artificial Sequence: Synthetic oligonucleotide
ggatgtgcggctgcgacgtggg

SEQ ID NO: 27853 - DNA, 22 bp, Artificial Sequence
  Description of Artificial Sequence: Synthetic oligonucleotide
gatgtgcggctgcgacgtgggg

SEQ ID NO: 27854 - DNA, 22 bp, Artificial Sequence
  Description of Artificial Sequence: Synthetic oligonucleotide
atgtgcggctgcgacgtggggc

SEQ ID NO: 27855 - DNA, 21 bp, Artificial Sequence
  Description of Artificial Sequence: Synthetic oligonucleotide
tgtgcggctgcgacgtggggc

SEQ ID NO: 27856 - DNA, 20 bp, Artificial Sequence
  Description of Artificial Sequence: Synthetic oligonucleotide
gtgcggctgcgacgtggggc

SEQ ID NO: 27857 - DNA, 20 bp, Artificial Sequence
  Description of Artificial Sequence: Synthetic oligonucleotide
tgcggctgcgacgtggggcc

SEQ ID NO: 27858 - DNA, 20 bp, Artificial Sequence
  Description of Artificial Sequence: Synthetic oligonucleotide
gcggctgcgacgtggggcct

SEQ ID NO: 27859 - DNA, 22 bp, Artificial Sequence
  Description of Artificial Sequence: Synthetic oligonucleotide
caagtgggaggcggcccgtggt

SEQ ID NO: 27860 - DNA, 22 bp, Artificial Sequence
  Description of Artificial Sequence: Synthetic oligonucleotide
aagtgggaggcggcccgtggtg

SEQ ID NO: 27861 - DNA, 21 bp, Artificial Sequence
  Description of Artificial Sequence: Synthetic oligonucleotide
agtgggaggcggcccgtggtg

SEQ ID NO: 27862 - DNA, 20 bp, Artificial Sequence
  Description of Artificial Sequence: Synthetic oligonucleotide
gtgggaggcggcccgtggtg

SEQ ID NO: 27863 - DNA, 21 bp, Artificial Sequence
  Description of Artificial Sequence: Synthetic oligonucleotide
tgggaggcggcccgtggtgga

SEQ ID NO: 27864 - DNA, 20 bp, Artificial Sequence
  Description of Artificial Sequence: Synthetic oligonucleotide
gggaggcggcccgtggtgga

SEQ ID NO: 27865 - DNA, 21 bp, Artificial Sequence
  Description of Artificial Sequence: Synthetic oligonucleotide
ggaggcggcccgtggtggaga

SEQ ID NO: 27866 - DNA, 21 bp, Artificial Sequence
  Description of Artificial Sequence: Synthetic oligonucleotide
gaggcggcccgtggtggagag

SEQ ID NO: 27867 - DNA, 21 bp, Artificial Sequence
  Description of Artificial Sequence: Synthetic oligonucleotide
aggcggcccgtggtggagagc

SEQ ID NO: 27868 - DNA, 20 bp, Artificial Sequence
  Description of Artificial Sequence: Synthetic oligonucleotide
ggcggcccgtggtggagagc

SEQ ID NO: 27869 - DNA, 22 bp, Artificial Sequence
  Description of Artificial Sequence: Synthetic oligonucleotide
gcggcccgtggtggagagccta

SEQ ID NO: 27870 - DNA, 22 bp, Artificial Sequence
  Description of Artificial Sequence: Synthetic oligonucleotide
cggcccgtggtggagagcctac

SEQ ID NO: 27871 - DNA, 23 bp, Artificial Sequence
  Description of Artificial Sequence: Synthetic oligonucleotide
ggcccgtggtggagagcctacct

SEQ ID NO: 27872 - DNA, 23 bp, Artificial Sequence
  Description of Artificial Sequence: Synthetic oligonucleotide
gcccgtggtggagagcctacctg

SEQ ID NO: 27873 - DNA, 24 bp, Artificial Sequence
  Description of Artificial Sequence: Synthetic oligonucleotide
cccgtggtggagagcctacctgga

SEQ ID NO: 27874 - DNA, 24 bp, Artificial Sequence
  Description of Artificial Sequence: Synthetic oligonucleotide
ccgtggtggagagcctacctggag

SEQ ID NO: 27875 - DNA, 24 bp, Artificial Sequence
  Description of Artificial Sequence: Synthetic oligonucleotide
cgtggtggagagcctacctggagg

SEQ ID NO: 27876 - DNA, 24 bp, Artificial Sequence
  Description of Artificial Sequence: Synthetic oligonucleotide
gtggtggagagcctacctggaggg

SEQ ID NO: 27877 - DNA, 24 bp, Artificial Sequence
  Description of Artificial Sequence: Synthetic oligonucleotide
tggtggagagcctacctggagggc

SEQ ID NO: 27878 - DNA, 23 bp, Artificial Sequence
  Description of Artificial Sequence: Synthetic oligonucleotide
ggtggagagcctacctggagggc

SEQ ID NO: 27879 - DNA, 26 bp, Artificial Sequence
  Description of Artificial Sequence: Synthetic oligonucleotide
cgaggccgggtctcacatcatccaca

SEQ ID NO: 27880 - DNA, 26 bp, Artificial Sequence
  Description of Artificial Sequence: Synthetic oligonucleotide
gaggccgggtctcacatcatccacag

SEQ ID NO: 27881 - DNA, 27 bp, Artificial Sequence
  Description of Artificial Sequence: Synthetic oligonucleotide
aggccgggtctcacatcatccacagga

SEQ ID NO: 27882 - DNA, 27 bp, Artificial Sequence
  Description of Artificial Sequence: Synthetic oligonucleotide
ggccgggtctcacatcatccacaggat

SEQ ID NO: 27883 - DNA, 27 bp, Artificial Sequence
  Description of Artificial Sequence: Synthetic oligonucleotide
gccgggtctcacatcatccacaggatg

SEQ ID NO: 27884 - DNA, 30 bp, Artificial Sequence
  Description of Artificial Sequence: Synthetic oligonucleotide
ccgggtctcacatcatccacaggatgtatg

SEQ ID NO: 27885 - DNA, 30 bp, Artificial Sequence
  Description of Artificial Sequence: Synthetic oligonucleotide
cgggtctcacatcatccacaggatgtatgg

SEQ ID NO: 27886 - DNA, 30 bp, Artificial Sequence
  Description of Artificial Sequence: Synthetic oligonucleotide
gggtctcacatcatccacaggatgtatggc

SEQ ID NO: 27887 - DNA, 31 bp, Artificial Sequence
  Description of Artificial Sequence: Synthetic oligonucleotide
ggtctcacatcatccacaggatgtatggctg

SEQ ID NO: 27888 - DNA, 31 bp, Artificial Sequence
  Description of Artificial Sequence: Synthetic oligonucleotide
gtctcacatcatccacaggatgtatggctgc

SEQ ID NO: 27889 - DNA, 31 bp, Artificial Sequence
  Description of Artificial Sequence: Synthetic oligonucleotide
tctcacatcatccacaggatgtatggctgcg

SEQ ID NO: 27890 - DNA, 30 bp, Artificial Sequence
  Description of Artificial Sequence: Synthetic oligonucleotide
ctcacatcatccacaggatgtatggctgcg

SEQ ID NO: 27891 - DNA, 31 bp, Artificial Sequence
  Description of Artificial Sequence: Synthetic oligonucleotide
tcacatcatccacaggatgtatggctgcgac

SEQ ID NO: 27892 - DNA, 30 bp, Artificial Sequence
  Description of Artificial Sequence: Synthetic oligonucleotide
cacatcatccacaggatgtatggctgcgac

SEQ ID NO: 27893 - DNA, 30 bp, Artificial Sequence
  Description of Artificial Sequence: Synthetic oligonucleotide
acatcatccacaggatgtatggctgcgacg

SEQ ID NO: 27894 - DNA, 29 bp, Artificial Sequence
  Description of Artificial Sequence: Synthetic oligonucleotide
catcatccacaggatgtatggctgcgacg

SEQ ID NO: 27895 - DNA, 30 bp, Artificial Sequence
  Description of Artificial Sequence: Synthetic oligonucleotide
atcatccacaggatgtatggctgcgacgtg

SEQ ID NO: 27896 - DNA, 29 bp, Artificial Sequence
  Description of Artificial Sequence: Synthetic oligonucleotide
tcatccacaggatgtatggctgcgacgtg

SEQ ID NO: 27897 - DNA, 28 bp, Artificial Sequence
  Description of Artificial Sequence: Synthetic oligonucleotide
catccacaggatgtatggctgcgacgtg

SEQ ID NO: 27898 - DNA, 28 bp, Artificial Sequence
  Description of Artificial Sequence: Synthetic oligonucleotide
atccacaggatgtatggctgcgacgtgg

SEQ ID NO: 27899 - DNA, 27 bp, Artificial Sequence
  Description of Artificial Sequence: Synthetic oligonucleotide
tccacaggatgtatggctgcgacgtgg

SEQ ID NO: 27900 - DNA, 26 bp, Artificial Sequence
  Description of Artificial Sequence: Synthetic oligonucleotide
ccacaggatgtatggctgcgacgtgg

SEQ ID NO: 27901 - DNA, 26 bp, Artificial Sequence
  Description of Artificial Sequence: Synthetic oligonucleotide
cacaggatgtatggctgcgacgtggg

SEQ ID NO: 27902 - DNA, 26 bp, Artificial Sequence
  Description of Artificial Sequence: Synthetic oligonucleotide
acaggatgtatggctgcgacgtgggg

SEQ ID NO: 27903 - DNA, 25 bp, Artificial Sequence
  Description of Artificial Sequence: Synthetic oligonucleotide
caggatgtatggctgcgacgtgggg

SEQ ID NO: 27904 - DNA, 24 bp, Artificial Sequence
  Description of Artificial Sequence: Synthetic oligonucleotide
cggggagccccgcttcatcgcaat

SEQ ID NO: 27905 - DNA, 24 bp, Artificial Sequence
  Description of Artificial Sequence: Synthetic oligonucleotide
ggggagccccgcttcatcgcaatg

SEQ ID NO: 27906 - DNA, 24 bp, Artificial Sequence
  Description of Artificial Sequence: Synthetic oligonucleotide
gggagccccgcttcatcgcaatgg

SEQ ID NO: 27907 - DNA, 24 bp, Artificial Sequence
  Description of Artificial Sequence: Synthetic oligonucleotide
ggagccccgcttcatcgcaatggg

SEQ ID NO: 27908 - DNA, 26 bp, Artificial Sequence
  Description of Artificial Sequence: Synthetic oligonucleotide
gagccccgcttcatcgcaatgggcta

SEQ ID NO: 27909 - DNA, 26 bp, Artificial Sequence
  Description of Artificial Sequence: Synthetic oligonucleotide
agccccgcttcatcgcaatgggctac

SEQ ID NO: 27910 - DNA, 25 bp, Artificial Sequence
  Description of Artificial Sequence: Synthetic oligonucleotide
gccccgcttcatcgcaatgggctac

SEQ ID NO: 27911 - DNA, 26 bp, Artificial Sequence
  Description of Artificial Sequence: Synthetic oligonucleotide
ccccgcttcatcgcaatgggctacgt

SEQ ID NO: 27912 - DNA, 26 bp, Artificial Sequence
  Description of Artificial Sequence: Synthetic oligonucleotide
cccgcttcatcgcaatgggctacgtg

SEQ ID NO: 27913 - DNA, 27 bp, Artificial Sequence
  Description of Artificial Sequence: Synthetic oligonucleotide
ccgcttcatcgcaatgggctacgtgga

SEQ ID NO: 27914 - DNA, 27 bp, Artificial Sequence
  Description of Artificial Sequence: Synthetic oligonucleotide
cgcttcatcgcaatgggctacgtggac

SEQ ID NO: 27915 - DNA, 27 bp, Artificial Sequence
  Description of Artificial Sequence: Synthetic oligonucleotide
gcttcatcgcaatgggctacgtggacg

SEQ ID NO: 27916 - DNA, 28 bp, Artificial Sequence
  Description of Artificial Sequence: Synthetic oligonucleotide
cttcatcgcaatgggctacgtggacgac

SEQ ID NO: 27917 - DNA, 29 bp, Artificial Sequence
  Description of Artificial Sequence: Synthetic oligonucleotide
ttcatcgcaatgggctacgtggacgacac

SEQ ID NO: 27918 - DNA, 28 bp, Artificial Sequence
  Description of Artificial Sequence: Synthetic oligonucleotide
tcatcgcaatgggctacgtggacgacac

SEQ ID NO: 27919 - DNA, 27 bp, Artificial Sequence
  Description of Artificial Sequence: Synthetic oligonucleotide
catcgcaatgggctacgtggacgacac

SEQ ID NO: 27920 - DNA, 27 bp, Artificial Sequence
  Description of Artificial Sequence: Synthetic oligonucleotide
atcgcaatgggctacgtggacgacacc

SEQ ID NO: 27921 - DNA, 26 bp, Artificial Sequence
  Description of Artificial Sequence: Synthetic oligonucleotide
tcgcaatgggctacgtggacgacacc

SEQ ID NO: 27922 - DNA, 25 bp, Artificial Sequence
  Description of Artificial Sequence: Synthetic oligonucleotide
cgcaatgggctacgtggacgacacc

SEQ ID NO: 27923 - DNA, 26 bp, Artificial Sequence
  Description of Artificial Sequence: Synthetic oligonucleotide
gcaatgggctacgtggacgacaccca

SEQ ID NO: 27924 - DNA, 27 bp, Artificial Sequence
  Description of Artificial Sequence: Synthetic oligonucleotide
caatgggctacgtggacgacacccagt

SEQ ID NO: 27925 - DNA, 28 bp, Artificial Sequence
  Description of Artificial Sequence: Synthetic oligonucleotide
aatgggctacgtggacgacacccagttc

SEQ ID NO: 27926 - DNA, 27 bp, Artificial Sequence
  Description of Artificial Sequence: Synthetic oligonucleotide
atgggctacgtggacgacacccagttc

SEQ ID NO: 27927 - DNA, 20 bp, Artificial Sequence
  Description of Artificial Sequence: Synthetic oligonucleotide
tggaccgcggcggacacggg

SEQ ID NO: 27928 - DNA, 20 bp, Artificial Sequence
  Description of Artificial Sequence: Synthetic oligonucleotide
ggaccgcggcggacacgggt

SEQ ID NO: 27929 - DNA, 20 bp, Artificial Sequence
  Description of Artificial Sequence: Synthetic oligonucleotide
gaccgcggcggacacggggt

SEQ ID NO: 27930 - DNA, 20 bp, Artificial Sequence
  Description of Artificial Sequence: Synthetic oligonucleotide
accgcggcggacacgggggt

SEQ ID NO: 27931 - DNA, 20 bp, Artificial Sequence
  Description of Artificial Sequence: Synthetic oligonucleotide
ccgcggcggacacgggggtt

SEQ ID NO: 27932 - DNA, 20 bp, Artificial Sequence
  Description of Artificial Sequence: Synthetic oligonucleotide
cgcggcggacacgggggctt

SEQ ID NO: 27933 - DNA, 20 bp, Artificial Sequence
  Description of Artificial Sequence: Synthetic oligonucleotide
gcggcggacacgggggctca

SEQ ID NO: 27934 - DNA, 22 bp, Artificial Sequence
  Description of Artificial Sequence: Synthetic oligonucleotide
cggcggacacgggggctcagat

SEQ ID NO: 27935 - DNA, 23 bp, Artificial Sequence
  Description of Artificial Sequence: Synthetic oligonucleotide
ggcggacacgggggctcagatca

SEQ ID NO: 27936 - DNA, 23 bp, Artificial Sequence
  Description of Artificial Sequence: Synthetic oligonucleotide
gcggacacgggggctcagatcac

SEQ ID NO: 27937 - DNA, 23 bp, Artificial Sequence
  Description of Artificial Sequence: Synthetic oligonucleotide
cggacacgggggctcagatcacc

SEQ ID NO: 27938 - DNA, 24 bp, Artificial Sequence
  Description of Artificial Sequence: Synthetic oligonucleotide
ggacacgggggctcagatcaccca

SEQ ID NO: 27939 - DNA, 24 bp, Artificial Sequence
  Description of Artificial Sequence: Synthetic oligonucleotide
gacacgggggctcagatcacccag

SEQ ID NO: 27940 - DNA, 24 bp, Artificial Sequence
  Description of Artificial Sequence: Synthetic oligonucleotide
acacgggggctcagatcacccagc

SEQ ID NO: 27941 - DNA, 23 bp, Artificial Sequence
  Description of Artificial Sequence: Synthetic oligonucleotide
cacgggggctcagatcacccagc

SEQ ID NO: 27942 - DNA, 23 bp, Artificial Sequence
  Description of Artificial Sequence: Synthetic oligonucleotide
acgggggctcagatcacccagcg

SEQ ID NO: 27943 - DNA, 22 bp, Artificial Sequence
  Description of Artificial Sequence: Synthetic oligonucleotide
cgggggctcagatcacccagcg

SEQ ID NO: 27944 - DNA, 24 bp, Artificial Sequence
  Description of Artificial Sequence: Synthetic oligonucleotide
gggggctcagatcacccagcgcaa

SEQ ID NO: 27945 - DNA, 25 bp, Artificial Sequence
  Description of Artificial Sequence: Synthetic oligonucleotide
ggggctcagatcacccagcgcaagt

SEQ ID NO: 27946 - DNA, 25 bp, Artificial Sequence
  Description of Artificial Sequence: Synthetic oligonucleotide
gggctcagatcacccagcgcaagtg

SEQ ID NO: 27947 - DNA, 23 bp, Artificial Sequence
  Description of Artificial Sequence: Synthetic oligonucleotide
cgcggacacggcggctcagatct

SEQ ID NO: 27948 - DNA, 23 bp, Artificial Sequence
  Description of Artificial Sequence: Synthetic oligonucleotide
gcggacacggcggctcagatctc

SEQ ID NO: 27949 - DNA, 23 bp, Artificial Sequence
  Description of Artificial Sequence: Synthetic oligonucleotide
cggacacggcggctcagatctcc

SEQ ID NO: 27950 - DNA, 24 bp, Artificial Sequence
  Description of Artificial Sequence: Synthetic oligonucleotide
ggacacggcggctcagatctccca

SEQ ID NO: 27951 - DNA, 24 bp, Artificial Sequence
  Description of Artificial Sequence: Synthetic oligonucleotide
gacacggcggctcagatctcccag

SEQ ID NO: 27952 - DNA, 24 bp, Artificial Sequence
  Description of Artificial Sequence: Synthetic oligonucleotide
acacggcggctcagatctcccagc

SEQ ID NO: 27953 - DNA, 23 bp, Artificial Sequence
  Description of Artificial Sequence: Synthetic oligonucleotide
cacggcggctcagatctcccagc

SEQ ID NO: 27954 - DNA, 23 bp, Artificial Sequence
  Description of Artificial Sequence: Synthetic oligonucleotide
acggcggctcagatctcccagcg

SEQ ID NO: 27955 - DNA, 22 bp, Artificial Sequence
  Description of Artificial Sequence: Synthetic oligonucleotide
cggcggctcagatctcccagcg

SEQ ID NO: 27956 - DNA, 24 bp, Artificial Sequence
  Description of Artificial Sequence: Synthetic oligonucleotide
ggcggctcagatctcccagcgcaa

SEQ ID NO: 27957 - DNA, 26 bp, Artificial Sequence
  Description of Artificial Sequence: Synthetic oligonucleotide
gcggctcagatctcccagcgcaagtt

SEQ ID NO: 27958 - DNA, 26 bp, Artificial Sequence
  Description of Artificial Sequence: Synthetic oligonucleotide
cggctcagatctcccagcgcaagttg

SEQ ID NO: 27959 - DNA, 27 bp, Artificial Sequence
  Description of Artificial Sequence: Synthetic oligonucleotide
ggctcagatctcccagcgcaagttgga

SEQ ID NO: 27960 - DNA, 27 bp, Artificial Sequence
  Description of Artificial Sequence: Synthetic oligonucleotide
gctcagatctcccagcgcaagttggag

SEQ ID NO: 27961 - DNA, 27 bp, Artificial Sequence
  Description of Artificial Sequence: Synthetic oligonucleotide
ctcagatctcccagcgcaagttggagg

SEQ ID NO: 27962 - DNA, 27 bp, Artificial Sequence
  Description of Artificial Sequence: Synthetic oligonucleotide
tcagatctcccagcgcaagttggaggc

SEQ ID NO: 27963 - DNA, 26 bp, Artificial Sequence
  Description of Artificial Sequence: Synthetic oligonucleotide
cagatctcccagcgcaagttggaggc

SEQ ID NO: 27964 - DNA, 26 bp, Artificial Sequence
  Description of Artificial Sequence: Synthetic oligonucleotide
agatctcccagcgcaagttggaggcg

SEQ ID NO: 27965 - DNA, 25 bp, Artificial Sequence
  Description of Artificial Sequence: Synthetic oligonucleotide
gatctcccagcgcaagttggaggcg

SEQ ID NO: 27966 - DNA, 25 bp, Artificial Sequence
  Description of Artificial Sequence: Synthetic oligonucleotide
atctcccagcgcaagttggaggcgg

SEQ ID NO: 27967 - DNA, 24 bp, Artificial Sequence
  Description of Artificial Sequence: Synthetic oligonucleotide
tctcccagcgcaagttggaggcgg

SEQ ID NO: 27968 - DNA, 23 bp, Artificial Sequence
  Description of Artificial Sequence: Synthetic oligonucleotide
ctcccagcgcaagttggaggcgg

SEQ ID NO: 27969 - DNA, 23 bp, Artificial Sequence
  Description of Artificial Sequence: Synthetic oligonucleotide
tcccagcgcaagttggaggcggc

SEQ ID NO: 27970 - DNA, 22 bp, Artificial Sequence
  Description of Artificial Sequence: Synthetic oligonucleotide
cccagcgcaagttggaggcggc

SEQ ID NO: 27971 - DNA, 22 bp, Artificial Sequence
  Description of Artificial Sequence: Synthetic oligonucleotide
ccagcgcaagttggaggcggcc

SEQ ID NO: 27972 - DNA, 22 bp, Artificial Sequence
  Description of Artificial Sequence: Synthetic oligonucleotide
cagcgcaagttggaggcggccc

SEQ ID NO: 27973 - DNA, 23 bp, Artificial Sequence
  Description of Artificial Sequence: Synthetic oligonucleotide
agcgcaagttggaggcggcccgt

SEQ ID NO: 27974 - DNA, 22 bp, Artificial Sequence
  Description of Artificial Sequence: Synthetic oligonucleotide
gcgcaagttggaggcggcccgt

SEQ ID NO: 27975 - DNA, 23 bp, Artificial Sequence
  Description of Artificial Sequence: Synthetic oligonucleotide
cgcaagttggaggcggcccgtga

SEQ ID NO: 27976 - DNA, 23 bp, Artificial Sequence
  Description of Artificial Sequence: Synthetic oligonucleotide
gcaagttggaggcggcccgtgag

SEQ ID NO: 27977 - DNA, 23 bp, Artificial Sequence
  Description of Artificial Sequence: Synthetic oligonucleotide
caagttggaggcggcccgtgagg

SEQ ID NO: 27978 - DNA, 23 bp, Artificial Sequence
  Description of Artificial Sequence: Synthetic oligonucleotide
aagttggaggcggcccgtgaggc

SEQ ID NO: 27979 - DNA, 22 bp, Artificial Sequence
  Description of Artificial Sequence: Synthetic oligonucleotide
agttggaggcggcccgtgaggc

SEQ ID NO: 27980 - DNA, 21 bp, Artificial Sequence
  Description of Artificial Sequence: Synthetic oligonucleotide
gttggaggcggcccgtgaggc

SEQ ID NO: 27981 - DNA, 21 bp, Artificial Sequence
  Description of Artificial Sequence: Synthetic oligonucleotide
ttggaggcggcccgtgaggcg

SEQ ID NO: 27982 - DNA, 20 bp, Artificial Sequence
  Description of Artificial Sequence: Synthetic oligonucleotide
tggaggcggcccgtgaggcg

SEQ ID NO: 27983 - DNA, 25 bp, Artificial Sequence
  Description of Artificial Sequence: Synthetic oligonucleotide
aggccgggtctcacaccctccagat

SEQ ID NO: 27984 - DNA, 24 bp, Artificial Sequence
  Description of Artificial Sequence: Synthetic oligonucleotide
ggccgggtctcacaccctccagat

SEQ ID NO: 27985 - DNA, 26 bp, Artificial Sequence
  Description of Artificial Sequence: Synthetic oligonucleotide
gccgggtctcacaccctccagatgat

SEQ ID NO: 27986 - DNA, 27 bp, Artificial Sequence
  Description of Artificial Sequence: Synthetic oligonucleotide
ccgggtctcacaccctccagatgatgt

SEQ ID NO: 27987 - DNA, 28 bp, Artificial Sequence
  Description of Artificial Sequence: Synthetic oligonucleotide
cgggtctcacaccctccagatgatgtac

SEQ ID NO: 27988 - DNA, 28 bp, Artificial Sequence
  Description of Artificial Sequence: Synthetic oligonucleotide
gggtctcacaccctccagatgatgtacg

SEQ ID NO: 27989 - DNA, 28 bp, Artificial Sequence
  Description of Artificial Sequence: Synthetic oligonucleotide
ggtctcacaccctccagatgatgtacgg

SEQ ID NO: 27990 - DNA, 28 bp, Artificial Sequence
  Description of Artificial Sequence: Synthetic oligonucleotide
gtctcacaccctccagatgatgtacggc

SEQ ID NO: 27991 - DNA, 29 bp, Artificial Sequence
  Description of Artificial Sequence: Synthetic oligonucleotide
tctcacaccctccagatgatgtacggctg

SEQ ID NO: 27992 - DNA, 28 bp, Artificial Sequence
  Description of Artificial Sequence: Synthetic oligonucleotide
ctcacaccctccagatgatgtacggctg

SEQ ID NO: 27993 - DNA, 28 bp, Artificial Sequence
  Description of Artificial Sequence: Synthetic oligonucleotide
tcacaccctccagatgatgtacggctgc

SEQ ID NO: 27994 - DNA, 27 bp, Artificial Sequence
  Description of Artificial Sequence: Synthetic oligonucleotide
cacaccctccagatgatgtacggctgc

SEQ ID NO: 27995 - DNA, 27 bp, Artificial Sequence
  Description of Artificial Sequence: Synthetic oligonucleotide
acaccctccagatgatgtacggctgcg

SEQ ID NO: 27996 - DNA, 27 bp, Artificial Sequence
  Description of Artificial Sequence: Synthetic oligonucleotide
caccctccagatgatgtacggctgcga

SEQ ID NO: 27997 - DNA, 27 bp, Artificial Sequence
  Description of Artificial Sequence: Synthetic oligonucleotide
accctccagatgatgtacggctgcgac

SEQ ID NO: 27998 - DNA, 26 bp, Artificial Sequence
  Description of Artificial Sequence: Synthetic oligonucleotide
ccctccagatgatgtacggctgcgac

SEQ ID NO: 27999 - DNA, 27 bp, Artificial Sequence
  Description of Artificial Sequence: Synthetic oligonucleotide
cctccagatgatgtacggctgcgacgt

SEQ ID NO: 28000 - DNA, 27 bp, Artificial Sequence
  Description of Artificial Sequence: Synthetic oligonucleotide
ctccagatgatgtacggctgcgacgtg

SEQ ID NO: 28001 - DNA, 26 bp, Artificial Sequence
  Description of Artificial Sequence: Synthetic oligonucleotide
agatgatgtacggctgcgacgtgggg

SEQ ID NO: 28002 - DNA, 25 bp, Artificial Sequence
  Description of Artificial Sequence: Synthetic oligonucleotide
gatgatgtacggctgcgacgtgggg

SEQ ID NO: 28003 - DNA, 25 bp, Artificial Sequence
  Description of Artificial Sequence: Synthetic oligonucleotide
atgatgtacggctgcgacgtggggc

SEQ ID NO: 28004 - DNA, 24 bp, Artificial Sequence
  Description of Artificial Sequence: Synthetic oligonucleotide
tgatgtacggctgcgacgtggggc

SEQ ID NO: 28005 - DNA, 23 bp, Artificial Sequence
  Description of Artificial Sequence: Synthetic oligonucleotide
acagcgacgccgcgagtccgaca

SEQ ID NO: 28006 - DNA, 22 bp, Artificial Sequence
  Description of Artificial Sequence: Synthetic oligonucleotide
cagcgacgccgcgagtccgaca

SEQ ID NO: 28007 - DNA, 23 bp, Artificial Sequence
  Description of Artificial Sequence: Synthetic oligonucleotide
agcgacgccgcgagtccgacaga

SEQ ID NO: 28008 - DNA, 22 bp, Artificial Sequence
  Description of Artificial Sequence: Synthetic oligonucleotide
gcgacgccgcgagtccgacaga

SEQ ID NO: 28009 - DNA, 22 bp, Artificial Sequence
  Description of Artificial Sequence: Synthetic oligonucleotide
cgacgccgcgagtccgacagag

SEQ ID NO: 28010 - DNA, 23 bp, Artificial Sequence
  Description of Artificial Sequence: Synthetic oligonucleotide
gacgccgcgagtccgacagagga

SEQ ID NO: 28011 - DNA, 23 bp, Artificial Sequence
  Description of Artificial Sequence: Synthetic oligonucleotide
acgccgcgagtccgacagaggag

SEQ ID NO: 28012 - DNA, 22 bp, Artificial Sequence
  Description of Artificial Sequence: Synthetic oligonucleotide
cgccgcgagtccgacagaggag

SEQ ID NO: 28013 - DNA, 22 bp, Artificial Sequence
  Description of Artificial Sequence: Synthetic oligonucleotide
gccgcgagtccgacagaggagc

SEQ ID NO: 28014 - DNA, 22 bp, Artificial Sequence
  Description of Artificial Sequence: Synthetic oligonucleotide
ccgcgagtccgacagaggagcc

SEQ ID NO: 28015 - DNA, 22 bp, Artificial Sequence
  Description of Artificial Sequence: Synthetic oligonucleotide
cgcgagtccgacagaggagccg

SEQ ID NO: 28016 - DNA, 22 bp, Artificial Sequence
  Description of Artificial Sequence: Synthetic oligonucleotide
gcgagtccgacagaggagccgc

SEQ ID NO: 28017 - DNA, 22 bp, Artificial Sequence
  Description of Artificial Sequence: Synthetic oligonucleotide
cgagtccgacagaggagccgcg

SEQ ID NO: 28018 - DNA, 22 bp, Artificial Sequence
  Description of Artificial Sequence: Synthetic oligonucleotide
gagtccgacagaggagccgcgg

SEQ ID NO: 28019 - DNA, 22 bp, Artificial Sequence
  Description of Artificial Sequence: Synthetic oligonucleotide
agtccgacagaggagccgcggg

SEQ ID NO: 28020 - DNA, 21 bp, Artificial Sequence
  Description of Artificial Sequence: Synthetic oligonucleotide
gtccgacagaggagccgcggg

SEQ ID NO: 28021 - DNA, 21 bp, Artificial Sequence
  Description of Artificial Sequence: Synthetic oligonucleotide
tccgacagaggagccgcgggc

SEQ ID NO: 28022 - DNA, 20 bp, Artificial Sequence
  Description of Artificial Sequence: Synthetic oligonucleotide
ccgacagaggagccgcgggc

SEQ ID NO: 28023 - DNA, 20 bp, Artificial Sequence
  Description of Artificial Sequence: Synthetic oligonucleotide
cgacagaggagccgcgggcg

SEQ ID NO: 28024 - DNA, 20 bp, Artificial Sequence
  Description of Artificial Sequence: Synthetic oligonucleotide
gacagaggagccgcgggcgc

SEQ ID NO: 28025 - DNA, 20 bp, Artificial Sequence
  Description of Artificial Sequence: Synthetic oligonucleotide
acagaggagccgcgggcgcc

SEQ ID NO: 28026 - DNA, 20 bp, Artificial Sequence
  Description of Artificial Sequence: Synthetic oligonucleotide
cagaggagccgcgggcgcct

SEQ ID NO: 28027 - DNA, 23 bp, Artificial Sequence
  Description of Artificial Sequence: Synthetic oligonucleotide
acgccgcgagtccgaggatggct

SEQ ID NO: 28028 - DNA, 22 bp, Artificial Sequence
  Description of Artificial Sequence: Synthetic oligonucleotide
cgccgcgagtccgaggatggct

SEQ ID NO: 28029 - DNA, 22 bp, Artificial Sequence
  Description of Artificial Sequence: Synthetic oligonucleotide
gccgcgagtccgaggatggctc

SEQ ID NO: 28030 - DNA, 22 bp, Artificial Sequence
  Description of Artificial Sequence: Synthetic oligonucleotide
ccgcgagtccgaggatggctcc

SEQ ID NO: 28031 - DNA, 22 bp, Artificial Sequence
  Description of Artificial Sequence: Synthetic oligonucleotide
cgcgagtccgaggatggctccc

SEQ ID NO: 28032 - DNA, 22 bp, Artificial Sequence
  Description of Artificial Sequence: Synthetic oligonucleotide
gcgagtccgaggatggctcccc

SEQ ID NO: 28033 - DNA, 22 bp, Artificial Sequence
  Description of Artificial Sequence: Synthetic oligonucleotide
cgagtccgaggatggctccccg

SEQ ID NO: 28034 - DNA, 22 bp, Artificial Sequence
  Description of Artificial Sequence: Synthetic oligonucleotide
gagtccgaggatggctccccgg

SEQ ID NO: 28035 - DNA, 22 bp, Artificial Sequence
  Description of Artificial Sequence: Synthetic oligonucleotide
agtccgaggatggctccccggg

SEQ ID NO: 28036 - DNA, 21 bp, Artificial Sequence
  Description of Artificial Sequence: Synthetic oligonucleotide
gtccgaggatggctccccggg

SEQ ID NO: 28037 - DNA, 21 bp, Artificial Sequence
  Description of Artificial Sequence: Synthetic oligonucleotide
tccgaggatggctccccgggc

SEQ ID NO: 28038 - DNA, 20 bp, Artificial Sequence
  Description of Artificial Sequence: Synthetic oligonucleotide
ccgaggatggctccccgggc

SEQ ID NO: 28039 - DNA, 20 bp, Artificial Sequence
  Description of Artificial Sequence: Synthetic oligonucleotide
cgaggatggctccccgggcg

SEQ ID NO: 28040 - DNA, 20 bp, Artificial Sequence
  Description of Artificial Sequence: Synthetic oligonucleotide
gaggatggctccccgggcgc

SEQ ID NO: 28041 - DNA, 22 bp, Artificial Sequence
  Description of Artificial Sequence: Synthetic oligonucleotide
aggatggctccccgggcgccat

SEQ ID NO: 28042 - DNA, 21 bp, Artificial Sequence
  Description of Artificial Sequence: Synthetic oligonucleotide
ggatggctccccgggcgccat

SEQ ID NO: 28043 - DNA, 21 bp, Artificial Sequence
  Description of Artificial Sequence: Synthetic oligonucleotide
gatggctccccgggcgccatg

SEQ ID NO: 28044 - DNA, 24 bp, Artificial Sequence
  Description of Artificial Sequence: Synthetic oligonucleotide
atggctccccgggcgccatggata

SEQ ID NO: 28045 - DNA, 23 bp, Artificial Sequence
  Description of Artificial Sequence: Synthetic oligonucleotide
tggctccccgggcgccatggata

SEQ ID NO: 28046 - DNA, 22 bp, Artificial Sequence
  Description of Artificial Sequence: Synthetic oligonucleotide
ggctccccgggcgccatggata

SEQ ID NO: 28047 - DNA, 23 bp, Artificial Sequence
  Description of Artificial Sequence: Synthetic oligonucleotide
gctccccgggcgccatggataga

SEQ ID NO: 28048 - DNA, 23 bp, Artificial Sequence
  Description of Artificial Sequence: Synthetic oligonucleotide
ctccccgggcgccatggatagag

SEQ ID NO: 28049 - DNA, 24 bp, Artificial Sequence
  Description of Artificial Sequence: Synthetic oligonucleotide
tccccgggcgccatggatagagca

SEQ ID NO: 28050 - DNA, 27 bp, Artificial Sequence
  Description of Artificial Sequence: Synthetic oligonucleotide
gatggcgaggaccaaactcaggacacg

SEQ ID NO: 28051 - DNA, 27 bp, Artificial Sequence
  Description of Artificial Sequence: Synthetic oligonucleotide
atggcgaggaccaaactcaggacacgg

SEQ ID NO: 28052 - DNA, 27 bp, Artificial Sequence
  Description of Artificial Sequence: Synthetic oligonucleotide
tggcgaggaccaaactcaggacacgga

SEQ ID NO: 28053 - DNA, 26 bp, Artificial Sequence
  Description of Artificial Sequence: Synthetic oligonucleotide
ggcgaggaccaaactcaggacacgga

SEQ ID NO: 28054 - DNA, 26 bp, Artificial Sequence
  Description of Artificial Sequence: Synthetic oligonucleotide
gcgaggaccaaactcaggacacggag

SEQ ID NO: 28055 - DNA, 27 bp, Artificial Sequence
  Description of Artificial Sequence: Synthetic oligonucleotide
cgaggaccaaactcaggacacggagct

SEQ ID NO: 28056 - DNA, 28 bp, Artificial Sequence
  Description of Artificial Sequence: Synthetic oligonucleotide
gaggaccaaactcaggacacggagcttg

SEQ ID NO: 28057 - DNA, 29 bp, Artificial Sequence
  Description of Artificial Sequence: Synthetic oligonucleotide
aggaccaaactcaggacacggagcttgtg

SEQ ID NO: 28058 - DNA, 28 bp, Artificial Sequence
  Description of Artificial Sequence: Synthetic oligonucleotide
ggaccaaactcaggacacggagcttgtg

SEQ ID NO: 28059 - DNA, 28 bp, Artificial Sequence
  Description of Artificial Sequence: Synthetic oligonucleotide
gaccaaactcaggacacggagcttgtgg

SEQ ID NO: 28060 - DNA, 29 bp, Artificial Sequence
  Description of Artificial Sequence: Synthetic oligonucleotide
accaaactcaggacacggagcttgtggag

SEQ ID NO: 28061 - DNA, 28 bp, Artificial Sequence
  Description of Artificial Sequence: Synthetic oligonucleotide
ccaaactcaggacacggagcttgtggag

SEQ ID NO: 28062 - DNA, 29 bp, Artificial Sequence
  Description of Artificial Sequence: Synthetic oligonucleotide
caaactcaggacacggagcttgtggagac

SEQ ID NO: 28063 - DNA, 29 bp, Artificial Sequence
  Description of Artificial Sequence: Synthetic oligonucleotide
aaactcaggacacggagcttgtggagacc

SEQ ID NO: 28064 - DNA, 28 bp, Artificial Sequence
  Description of Artificial Sequence: Synthetic oligonucleotide
aactcaggacacggagcttgtggagacc

SEQ ID NO: 28065 - DNA, 27 bp, Artificial Sequence
  Description of Artificial Sequence: Synthetic oligonucleotide
actcaggacacggagcttgtggagacc

SEQ ID NO: 28066 - DNA, 27 bp, Artificial Sequence
  Description of Artificial Sequence: Synthetic oligonucleotide
ctcaggacacggagcttgtggagacca

SEQ ID NO: 28067 - DNA, 27 bp, Artificial Sequence
  Description of Artificial Sequence: Synthetic oligonucleotide
tcaggacacggagcttgtggagaccag

SEQ ID NO: 28068 - DNA, 27 bp, Artificial Sequence
  Description of Artificial Sequence: Synthetic oligonucleotide
caggacacggagcttgtggagaccaga

SEQ ID NO: 28069 - DNA, 27 bp, Artificial Sequence
  Description of Artificial Sequence: Synthetic oligonucleotide
aggacacggagcttgtggagaccagac

SEQ ID NO: 28070 - DNA, 26 bp, Artificial Sequence
  Description of Artificial Sequence: Synthetic oligonucleotide
ggacacggagcttgtggagaccagac

SEQ ID NO: 28071 - DNA, 27 bp, Artificial Sequence
  Description of Artificial Sequence: Synthetic oligonucleotide
gacacggagcttgtggagaccagacca

SEQ ID NO: 28072 - DNA, 27 bp, Artificial Sequence
  Description of Artificial Sequence: Synthetic oligonucleotide
acacggagcttgtggagaccagaccag

SEQ ID NO: 28073 - DNA, 26 bp, Artificial Sequence
  Description of Artificial Sequence: Synthetic oligonucleotide
cacggagcttgtggagaccagaccag

SEQ ID NO: 28074 - DNA, 27 bp, Artificial Sequence
  Description of Artificial Sequence: Synthetic oligonucleotide
acggagcttgtggagaccagaccagca

SEQ ID NO: 28075 - DNA, 26 bp, Artificial Sequence
  Description of Artificial Sequence: Synthetic oligonucleotide
cggagcttgtggagaccagaccagca

SEQ ID NO: 28076 - DNA, 26 bp, Artificial Sequence
  Description of Artificial Sequence: Synthetic oligonucleotide
ggagcttgtggagaccagaccagcag

SEQ ID NO: 28077 - DNA, 25 bp, Artificial Sequence
  Description of Artificial Sequence: Synthetic oligonucleotide
gggccggagtattgggaccgggata

SEQ ID NO: 28078 - DNA, 26 bp, Artificial Sequence
  Description of Artificial Sequence: Synthetic oligonucleotide
ggccggagtattgggaccgggataca

SEQ ID NO: 28079 - DNA, 27 bp, Artificial Sequence
  Description of Artificial Sequence: Synthetic oligonucleotide
gccggagtattgggaccgggatacaca

SEQ ID NO: 28080 - DNA, 27 bp, Artificial Sequence
  Description of Artificial Sequence: Synthetic oligonucleotide
ccggagtattgggaccgggatacacag

SEQ ID NO: 28081 - DNA, 29 bp, Artificial Sequence
  Description of Artificial Sequence: Synthetic oligonucleotide
cggagtattgggaccgggatacacagatc

SEQ ID NO: 28082 - DNA, 30 bp, Artificial Sequence
  Description of Artificial Sequence: Synthetic oligonucleotide
ggagtattgggaccgggatacacagatctc

SEQ ID NO: 28083 - DNA, 30 bp, Artificial Sequence
  Description of Artificial Sequence: Synthetic oligonucleotide
gagtattgggaccgggatacacagatctcc

SEQ ID NO: 28084 - DNA, 32 bp, Artificial Sequence
  Description of Artificial Sequence: Synthetic oligonucleotide
agtattgggaccgggatacacagatctccaag

SEQ ID NO: 28085 - DNA, 31 bp, Artificial Sequence
  Description of Artificial Sequence: Synthetic oligonucleotide
gtattgggaccgggatacacagatctccaag

SEQ ID NO: 28086 - DNA, 32 bp, Artificial Sequence
  Description of Artificial Sequence: Synthetic oligonucleotide
tattgggaccgggatacacagatctccaagac

SEQ ID NO: 28087 - DNA, 31 bp, Artificial Sequence
  Description of Artificial Sequence: Synthetic oligonucleotide
attgggaccgggatacacagatctccaagac

SEQ ID NO: 28088 - DNA, 30 bp, Artificial Sequence
  Description of Artificial Sequence: Synthetic oligonucleotide
ttgggaccgggatacacagatctccaagac

SEQ ID NO: 28089 - DNA, 29 bp, Artificial Sequence
  Description of Artificial Sequence: Synthetic oligonucleotide
tgggaccgggatacacagatctccaagac

SEQ ID NO: 28090 - DNA, 28 bp, Artificial Sequence
  Description of Artificial Sequence: Synthetic oligonucleotide
gggaccgggatacacagatctccaagac

SEQ ID NO: 28091 - DNA, 28 bp, Artificial Sequence
  Description of Artificial Sequence: Synthetic oligonucleotide
ggaccgggatacacagatctccaagacc

SEQ ID NO: 28092 - DNA, 30 bp, Artificial Sequence
  Description of Artificial Sequence: Synthetic oligonucleotide
gaccgggatacacagatctccaagaccaac

SEQ ID NO: 28093 - DNA, 31 bp, Artificial Sequence
  Description of Artificial Sequence: Synthetic oligonucleotide
accgggatacacagatctccaagaccaacac

SEQ ID NO: 28094 - DNA, 30 bp, Artificial Sequence
  Description of Artificial Sequence: Synthetic oligonucleotide
ccgggatacacagatctccaagaccaacac

SEQ ID NO: 28095 - DNA, 31 bp, Artificial Sequence
  Description of Artificial Sequence: Synthetic oligonucleotide
cgggatacacagatctccaagaccaacacac

SEQ ID NO: 28096 - DNA, 32 bp, Artificial Sequence
  Description of Artificial Sequence: Synthetic oligonucleotide
gggatacacagatctccaagaccaacacacag

SEQ ID NO: 28097 - DNA, 33 bp, Artificial Sequence
  Description of Artificial Sequence: Synthetic oligonucleotide
ggatacacagatctccaagaccaacacacagac

SEQ ID NO: 28098 - DNA, 36 bp, Artificial Sequence
  Description of Artificial Sequence: Synthetic oligonucleotide
gatacacagatctccaagaccaacacacagacttac

SEQ ID NO: 28099 - DNA, 36 bp, Artificial Sequence
  Description of Artificial Sequence: Synthetic oligonucleotide
atacacagatctccaagaccaacacacagacttacc

SEQ ID NO: 28100 - DNA, 35 bp, Artificial Sequence
  Description of Artificial Sequence: Synthetic oligonucleotide
tacacagatctccaagaccaacacacagacttacc

SEQ ID NO: 28101 - DNA, 25 bp, Artificial Sequence
  Description of Artificial Sequence: Synthetic oligonucleotide
cgccatggatagagcaggaggggct

SEQ ID NO: 28102 - DNA, 25 bp, Artificial Sequence
  Description of Artificial Sequence: Synthetic oligonucleotide
gccatggatagagcaggaggggctg

SEQ ID NO: 28103 - DNA, 26 bp, Artificial Sequence
  Description of Artificial Sequence: Synthetic oligonucleotide
ccatggatagagcaggaggggctgga

SEQ ID NO: 28104 - DNA, 27 bp, Artificial Sequence
  Description of Artificial Sequence: Synthetic oligonucleotide
catggatagagcaggaggggctggagt

SEQ ID NO: 28105 - DNA, 30 bp, Artificial Sequence
  Description of Artificial Sequence: Synthetic oligonucleotide
atggatagagcaggaggggctggagtattg

SEQ ID NO: 28106 - DNA, 25 bp, Artificial Sequence
  Description of Artificial Sequence: Synthetic oligonucleotide
caggaggggctggagtattgggacc

SEQ ID NO: 28107 - DNA, 25 bp, Artificial Sequence
  Description of Artificial Sequence: Synthetic oligonucleotide
aggaggggctggagtattgggaccg

SEQ ID NO: 28108 - DNA, 24 bp, Artificial Sequence
  Description of Artificial Sequence: Synthetic oligonucleotide
ggaggggctggagtattgggaccg

SEQ ID NO: 28109 - DNA, 24 bp, Artificial Sequence
  Description of Artificial Sequence: Synthetic oligonucleotide
gaggggctggagtattgggaccgg

SEQ ID NO: 28110 - DNA, 25 bp, Artificial Sequence
  Description of Artificial Sequence: Synthetic oligonucleotide
aggggctggagtattgggaccggga

SEQ ID NO: 28111 - DNA, 24 bp, Artificial Sequence
  Description of Artificial Sequence: Synthetic oligonucleotide
ggggctggagtattgggaccggga

SEQ ID NO: 28112 - DNA, 25 bp, Artificial Sequence
  Description of Artificial Sequence: Synthetic oligonucleotide
gggctggagtattgggaccgggaga

SEQ ID NO: 28113 - DNA, 26 bp, Artificial Sequence
  Description of Artificial Sequence: Synthetic oligonucleotide
ggctggagtattgggaccgggagaca

SEQ ID NO: 28114 - DNA, 27 bp, Artificial Sequence
  Description of Artificial Sequence: Synthetic oligonucleotide
gctggagtattgggaccgggagacaca

SEQ ID NO: 28115 - DNA, 27 bp, Artificial Sequence
  Description of Artificial Sequence: Synthetic oligonucleotide
ctggagtattgggaccgggagacacag

SEQ ID NO: 28116 - DNA, 29 bp, Artificial Sequence
  Description of Artificial Sequence: Synthetic oligonucleotide
tggagtattgggaccgggagacacagatc

SEQ ID NO: 28117 - DNA, 24 bp, Artificial Sequence
  Description of Artificial Sequence: Synthetic oligonucleotide
cgtcctcctgctgctctcgggagt

SEQ ID NO: 28118 - DNA, 24 bp, Artificial Sequence
  Description of Artificial Sequence: Synthetic oligonucleotide
gtcctcctgctgctctcgggagtc

SEQ ID NO: 28119 - DNA, 25 bp, Artificial Sequence
  Description of Artificial Sequence: Synthetic oligonucleotide
tcctcctgctgctctcgggagtcct

SEQ ID NO: 28120 - DNA, 24 bp, Artificial Sequence
  Description of Artificial Sequence: Synthetic oligonucleotide
cctcctgctgctctcgggagtcct

SEQ ID NO: 28121 - DNA, 24 bp, Artificial Sequence
  Description of Artificial Sequence: Synthetic oligonucleotide
ctcctgctgctctcgggagtcctg

SEQ ID NO: 28122 - DNA, 24 bp, Artificial Sequence
  Description of Artificial Sequence: Synthetic oligonucleotide
tcctgctgctctcgggagtcctgg

SEQ ID NO: 28123 - DNA, 23 bp, Artificial Sequence
  Description of Artificial Sequence: Synthetic oligonucleotide
cctgctgctctcgggagtcctgg

SEQ ID NO: 28124 - DNA, 23 bp, Artificial Sequence
  Description of Artificial Sequence: Synthetic oligonucleotide
ctgctgctctcgggagtcctggc

SEQ ID NO: 28125 - DNA, 23 bp, Artificial Sequence
  Description of Artificial Sequence: Synthetic oligonucleotide
tgctgctctcgggagtcctggcc

SEQ ID NO: 28126 - DNA, 22 bp, Artificial Sequence
  Description of Artificial Sequence: Synthetic oligonucleotide
gctgctctcgggagtcctggcc

SEQ ID NO: 28127 - DNA, 23 bp, Artificial Sequence
  Description of Artificial Sequence: Synthetic oligonucleotide
ctgctctcgggagtcctggccct

SEQ ID NO: 28128 - DNA, 24 bp, Artificial Sequence
  Description of Artificial Sequence: Synthetic oligonucleotide
tgctctcgggagtcctggccctga

SEQ ID NO: 28129 - DNA, 23 bp, Artificial Sequence
  Description of Artificial Sequence: Synthetic oligonucleotide
gctctcgggagtcctggccctga

SEQ ID NO: 28130 - DNA, 23 bp, Artificial Sequence
  Description of Artificial Sequence: Synthetic oligonucleotide
ctctcgggagtcctggccctgac

SEQ ID NO: 28131 - DNA, 23 bp, Artificial Sequence
  Description of Artificial Sequence: Synthetic oligonucleotide
tctcgggagtcctggccctgacc

SEQ ID NO: 28132 - DNA, 22 bp, Artificial Sequence
  Description of Artificial Sequence: Synthetic oligonucleotide
ctcgggagtcctggccctgacc

SEQ ID NO: 28133 - DNA, 23 bp, Artificial Sequence
  Description of Artificial Sequence: Synthetic oligonucleotide
tcgggagtcctggccctgaccga

SEQ ID NO: 28134 - DNA, 22 bp, Artificial Sequence
  Description of Artificial Sequence: Synthetic oligonucleotide
cgggagtcctggccctgaccga

SEQ ID NO: 28135 - DNA, 23 bp, Artificial Sequence
  Description of Artificial Sequence: Synthetic oligonucleotide
gggagtcctggccctgaccgaga

SEQ ID NO: 28136 - DNA, 23 bp, Artificial Sequence
  Description of Artificial Sequence: Synthetic oligonucleotide
ggagtcctggccctgaccgagac

SEQ ID NO: 28137 - DNA, 24 bp, Artificial Sequence
  Description of Artificial Sequence: Synthetic oligonucleotide
gagtcctggccctgaccgagacct

SEQ ID NO: 28138 - DNA, 24 bp, Artificial Sequence
  Description of Artificial Sequence: Synthetic oligonucleotide
agtcctggccctgaccgagacctg

SEQ ID NO: 28139 - DNA, 23 bp, Artificial Sequence
  Description of Artificial Sequence: Synthetic oligonucleotide
gtcctggccctgaccgagacctg

SEQ ID NO: 28140 - DNA, 23 bp, Artificial Sequence
  Description of Artificial Sequence: Synthetic oligonucleotide
tcctggccctgaccgagacctgg

SEQ ID NO: 28141 - DNA, 28 bp, Artificial Sequence
  Description of Artificial Sequence: Synthetic oligonucleotide
accaaactcaggacaccgagcttgtggg

SEQ ID NO: 28142 - DNA, 27 bp, Artificial Sequence
  Description of Artificial Sequence: Synthetic oligonucleotide
ccaaactcaggacaccgagcttgtggg

SEQ ID NO: 28143 - DNA, 27 bp, Artificial Sequence
  Description of Artificial Sequence: Synthetic oligonucleotide
caaactcaggacaccgagcttgtgggg

SEQ ID NO: 28144 - DNA, 28 bp, Artificial Sequence
  Description of Artificial Sequence: Synthetic oligonucleotide
aaactcaggacaccgagcttgtggggac

SEQ ID NO: 28145 - DNA, 27 bp, Artificial Sequence
  Description of Artificial Sequence: Synthetic oligonucleotide
aactcaggacaccgagcttgtggggac

SEQ ID NO: 28146 - DNA, 26 bp, Artificial Sequence
  Description of Artificial Sequence: Synthetic oligonucleotide
actcaggacaccgagcttgtggggac

SEQ ID NO: 28147 - DNA, 25 bp, Artificial Sequence
  Description of Artificial Sequence: Synthetic oligonucleotide
ctcaggacaccgagcttgtggggac

SEQ ID NO: 28148 - DNA, 26 bp, Artificial Sequence
  Description of Artificial Sequence: Synthetic oligonucleotide
tcaggacaccgagcttgtggggacca

SEQ ID NO: 28149 - DNA, 25 bp, Artificial Sequence
  Description of Artificial Sequence: Synthetic oligonucleotide
caggacaccgagcttgtggggacca

SEQ ID NO: 28150 - DNA, 26 bp, Artificial Sequence
  Description of Artificial Sequence: Synthetic oligonucleotide
aggacaccgagcttgtggggaccaga

SEQ ID NO: 28151 - DNA, 25 bp, Artificial Sequence
  Description of Artificial Sequence: Synthetic oligonucleotide
ggacaccgagcttgtggggaccaga

SEQ ID NO: 28152 - DNA, 25 bp, Artificial Sequence
  Description of Artificial Sequence: Synthetic oligonucleotide
gacaccgagcttgtggggaccagac

SEQ ID NO: 28153 - DNA, 26 bp, Artificial Sequence
  Description of Artificial Sequence: Synthetic oligonucleotide
acaccgagcttgtggggaccagacca

SEQ ID NO: 28154 - DNA, 25 bp, Artificial Sequence
  Description of Artificial Sequence: Synthetic oligonucleotide
caccgagcttgtggggaccagacca

SEQ ID NO: 28155 - DNA, 25 bp, Artificial Sequence
  Description of Artificial Sequence: Synthetic oligonucleotide
accgagcttgtggggaccagaccag

SEQ ID NO: 28156 - DNA, 24 bp, Artificial Sequence
  Description of Artificial Sequence: Synthetic oligonucleotide
ccgagcttgtggggaccagaccag

SEQ ID NO: 28157 - DNA, 25 bp, Artificial Sequence
  Description of Artificial Sequence: Synthetic oligonucleotide
cgagcttgtggggaccagaccagca

SEQ ID NO: 28158 - DNA, 25 bp, Artificial Sequence
  Description of Artificial Sequence: Synthetic oligonucleotide
gagcttgtggggaccagaccagcag

SEQ ID NO: 28159 - DNA, 26 bp, Artificial Sequence
  Description of Artificial Sequence: Synthetic oligonucleotide
agcttgtggggaccagaccagcagga

SEQ ID NO: 28160 - DNA, 25 bp, Artificial Sequence
  Description of Artificial Sequence: Synthetic oligonucleotide
gcttgtggggaccagaccagcagga

SEQ ID NO: 28161 - DNA, 27 bp, Artificial Sequence
  Description of Artificial Sequence: Synthetic oligonucleotide
cttgtggggaccagaccagcaggagat

SEQ ID NO: 28162 - DNA, 28 bp, Artificial Sequence
  Description of Artificial Sequence: Synthetic oligonucleotide
ttgtggggaccagaccagcaggagatag

SEQ ID NO: 28163 - DNA, 27 bp, Artificial Sequence
  Description of Artificial Sequence: Synthetic oligonucleotide
tgtggggaccagaccagcaggagatag

SEQ ID NO: 28164 - DNA, 27 bp, Artificial Sequence
  Description of Artificial Sequence: Synthetic oligonucleotide
gtggggaccagaccagcaggagataga

SEQ ID NO: 28165 - DNA, 28 bp, Artificial Sequence
  Description of Artificial Sequence: Synthetic oligonucleotide
tggggaccagaccagcaggagatagaac

SEQ ID NO: 28166 - DNA, 27 bp, Artificial Sequence
  Description of Artificial Sequence: Synthetic oligonucleotide
ggggaccagaccagcaggagatagaac

SEQ ID NO: 28167 - DNA, 27 bp, Artificial Sequence
  Description of Artificial Sequence: Synthetic oligonucleotide
gggaccagaccagcaggagatagaacc

SEQ ID NO: 28168 - DNA, 29 bp, Artificial Sequence
  Description of Artificial Sequence: Synthetic oligonucleotide
ggaccagaccagcaggagatagaaccttc

SEQ ID NO: 28169 - DNA, 23 bp, Artificial Sequence
  Description of Artificial Sequence: Synthetic oligonucleotide
ggcggacacggcggctcagatct

SEQ ID NO: 28170 - DNA, 23 bp, Artificial Sequence
  Description of Artificial Sequence: Synthetic oligonucleotide
cgcaagttggaggcggcccgtgt

SEQ ID NO: 28171 - DNA, 23 bp, Artificial Sequence
  Description of Artificial Sequence: Synthetic oligonucleotide
gcaagttggaggcggcccgtgtg

SEQ ID NO: 28172 - DNA, 23 bp, Artificial Sequence
  Description of Artificial Sequence: Synthetic oligonucleotide
caagttggaggcggcccgtgtgg

SEQ ID NO: 28173 - DNA, 23 bp, Artificial Sequence
  Description of Artificial Sequence: Synthetic oligonucleotide
aagttggaggcggcccgtgtggc

SEQ ID NO: 28174 - DNA, 22 bp, Artificial Sequence
  Description of Artificial Sequence: Synthetic oligonucleotide
agttggaggcggcccgtgtggc

SEQ ID NO: 28175 - DNA, 21 bp, Artificial Sequence
  Description of Artificial Sequence: Synthetic oligonucleotide
gttggaggcggcccgtgtggc

SEQ ID NO: 28176 - DNA, 21 bp, Artificial Sequence
  Description of Artificial Sequence: Synthetic oligonucleotide
ttggaggcggcccgtgtggcg

SEQ ID NO: 28177 - DNA, 20 bp, Artificial Sequence
  Description of Artificial Sequence: Synthetic oligonucleotide
tggaggcggcccgtgtggcg

SEQ ID NO: 28178 - DNA, 22 bp, Artificial Sequence
  Description of Artificial Sequence: Synthetic oligonucleotide
cgcgggcatgaccagtccgcct

SEQ ID NO: 28179 - DNA, 22 bp, Artificial Sequence
  Description of Artificial Sequence: Synthetic oligonucleotide
gcgggcatgaccagtccgcctg

SEQ ID NO: 28180 - DNA, 22 bp, Artificial Sequence
  Description of Artificial Sequence: Synthetic oligonucleotide
cgggcatgaccagtccgcctgc

SEQ ID NO: 28181 - DNA, 23 bp, Artificial Sequence
  Description of Artificial Sequence: Synthetic oligonucleotide
gggcatgaccagtccgcctgcga

SEQ ID NO: 28182 - DNA, 23 bp, Artificial Sequence
  Description of Artificial Sequence: Synthetic oligonucleotide
ggcatgaccagtccgcctgcgac

SEQ ID NO: 28183 - DNA, 23 bp, Artificial Sequence
  Description of Artificial Sequence: Synthetic oligonucleotide
gcatgaccagtccgcctgcgacg

SEQ ID NO: 28184 - DNA, 23 bp, Artificial Sequence
  Description of Artificial Sequence: Synthetic oligonucleotide
catgaccagtccgcctgcgacgg

SEQ ID NO: 28185 - DNA, 25 bp, Artificial Sequence
  Description of Artificial Sequence: Synthetic oligonucleotide
atgaccagtccgcctgcgacggcaa

SEQ ID NO: 28186 - DNA, 24 bp, Artificial Sequence
  Description of Artificial Sequence: Synthetic oligonucleotide
tgaccagtccgcctgcgacggcaa

SEQ ID NO: 28187 - DNA, 23 bp, Artificial Sequence
  Description of Artificial Sequence: Synthetic oligonucleotide
gaccagtccgcctgcgacggcaa

SEQ ID NO: 28188 - DNA, 23 bp, Artificial Sequence
  Description of Artificial Sequence: Synthetic oligonucleotide
accagtccgcctgcgacggcaag

SEQ ID NO: 28189 - DNA, 22 bp, Artificial Sequence
  Description of Artificial Sequence: Synthetic oligonucleotide
ccagtccgcctgcgacggcaag

SEQ ID NO: 28190 - DNA, 26 bp, Artificial Sequence
  Description of Artificial Sequence: Synthetic oligonucleotide
cagtccgcctgcgacggcaaggatta

SEQ ID NO: 28191 - DNA, 27 bp, Artificial Sequence
  Description of Artificial Sequence: Synthetic oligonucleotide
agtccgcctgcgacggcaaggattaca

SEQ ID NO: 28192 - DNA, 27 bp, Artificial Sequence
  Description of Artificial Sequence: Synthetic oligonucleotide
gtccgcctgcgacggcaaggattacat

SEQ ID NO: 28193 - DNA, 27 bp, Artificial Sequence
  Description of Artificial Sequence: Synthetic oligonucleotide
tccgcctgcgacggcaaggattacatc

SEQ ID NO: 28194 - DNA, 26 bp, Artificial Sequence
  Description of Artificial Sequence: Synthetic oligonucleotide
ccgcctgcgacggcaaggattacatc

SEQ ID NO: 28195 - DNA, 26 bp, Artificial Sequence
  Description of Artificial Sequence: Synthetic oligonucleotide
cgcctgcgacggcaaggattacatcg

SEQ ID NO: 28196 - DNA, 26 bp, Artificial Sequence
  Description of Artificial Sequence: Synthetic oligonucleotide
gcctgcgacggcaaggattacatcgc

SEQ ID NO: 28197 - DNA, 26 bp, Artificial Sequence
  Description of Artificial Sequence: Synthetic oligonucleotide
cctgcgacggcaaggattacatcgcc

SEQ ID NO: 28198 - DNA, 27 bp, Artificial Sequence
  Description of Artificial Sequence: Synthetic oligonucleotide
ctgcgacggcaaggattacatcgccct

SEQ ID NO: 28199 - DNA, 27 bp, Artificial Sequence
  Description of Artificial Sequence: Synthetic oligonucleotide
tgcgacggcaaggattacatcgccctg

SEQ ID NO: 28200 - DNA, 27 bp, Artificial Sequence
  Description of Artificial Sequence: Synthetic oligonucleotide
gcgacggcaaggattacatcgccctga

SEQ ID NO: 28201 - DNA, 24 bp, Artificial Sequence
  Description of Artificial Sequence: Synthetic oligonucleotide
cggagcagctgagagcctacctgg

SEQ ID NO: 28202 - DNA, 24 bp, Artificial Sequence
  Description of Artificial Sequence: Synthetic oligonucleotide
ggagcagctgagagcctacctggc

SEQ ID NO: 28203 - DNA, 24 bp, Artificial Sequence
  Description of Artificial Sequence: Synthetic oligonucleotide
gagcagctgagagcctacctggcg

SEQ ID NO: 28204 - DNA, 24 bp, Artificial Sequence
  Description of Artificial Sequence: Synthetic oligonucleotide
agcagctgagagcctacctggcgg

SEQ ID NO: 28205 - DNA, 23 bp, Artificial Sequence
  Description of Artificial Sequence: Synthetic oligonucleotide
gcagctgagagcctacctggcgg

SEQ ID NO: 28206 - DNA, 23 bp, Artificial Sequence
  Description of Artificial Sequence: Synthetic oligonucleotide
cagctgagagcctacctggcggg

SEQ ID NO: 28207 - DNA, 23 bp, Artificial Sequence
  Description of Artificial Sequence: Synthetic oligonucleotide
agctgagagcctacctggcgggc

SEQ ID NO: 28208 - DNA, 22 bp, Artificial Sequence
  Description of Artificial Sequence: Synthetic oligonucleotide
gctgagagcctacctggcgggc

SEQ ID NO: 28209 - DNA, 23 bp, Artificial Sequence
  Description of Artificial Sequence: Synthetic oligonucleotide
ctgagagcctacctggcgggcct

SEQ ID NO: 28210 - DNA, 24 bp, Artificial Sequence
  Description of Artificial Sequence: Synthetic oligonucleotide
tgagagcctacctggcgggcctgt

SEQ ID NO: 28211 - DNA, 23 bp, Artificial Sequence
  Description of Artificial Sequence: Synthetic oligonucleotide
gagagcctacctggcgggcctgt

SEQ ID NO: 28212 - DNA, 23 bp, Artificial Sequence
  Description of Artificial Sequence: Synthetic oligonucleotide
agagcctacctggcgggcctgtg

SEQ ID NO: 28213 - DNA, 22 bp, Artificial Sequence
  Description of Artificial Sequence: Synthetic oligonucleotide
gagcctacctggcgggcctgtg

SEQ ID NO: 28214 - DNA, 22 bp, Artificial Sequence
  Description of Artificial Sequence: Synthetic oligonucleotide
agcctacctggcgggcctgtgc

SEQ ID NO: 28215 - DNA, 21 bp, Artificial Sequence
  Description of Artificial Sequence: Synthetic oligonucleotide
gcctacctggcgggcctgtgc

SEQ ID NO: 28216 - DNA, 22 bp, Artificial Sequence
  Description of Artificial Sequence: Synthetic oligonucleotide
cctacctggcgggcctgtgcgt

SEQ ID NO: 28217 - DNA, 22 bp, Artificial Sequence
  Description of Artificial Sequence: Synthetic oligonucleotide
ctacctggcgggcctgtgcgtg

SEQ ID NO: 28218 - DNA, 23 bp, Artificial Sequence
  Description of Artificial Sequence: Synthetic oligonucleotide
tacctggcgggcctgtgcgtgga

SEQ ID NO: 28219 - DNA, 22 bp, Artificial Sequence
  Description of Artificial Sequence: Synthetic oligonucleotide
acctggcgggcctgtgcgtgga

SEQ ID NO: 28220 - DNA, 21 bp, Artificial Sequence
  Description of Artificial Sequence: Synthetic oligonucleotide
cctggcgggcctgtgcgtgga

SEQ ID NO: 28221 - DNA, 22 bp, Artificial Sequence
  Description of Artificial Sequence: Synthetic oligonucleotide
ctggcgggcctgtgcgtggagt

SEQ ID NO: 28222 - DNA, 22 bp, Artificial Sequence
  Description of Artificial Sequence: Synthetic oligonucleotide
tggcgggcctgtgcgtggagtg

SEQ ID NO: 28223 - DNA, 21 bp, Artificial Sequence
  Description of Artificial Sequence: Synthetic oligonucleotide
ggcgggcctgtgcgtggagtg

SEQ ID NO: 28224 - DNA, 21 bp, Artificial Sequence
  Description of Artificial Sequence: Synthetic oligonucleotide
gcgggcctgtgcgtggagtgg

SEQ ID NO: 28225 - DNA, 22 bp, Artificial Sequence
  Description of Artificial Sequence: Synthetic oligonucleotide
cgggcctgtgcgtggagtggct

SEQ ID NO: 28226 - DNA, 27 bp, Artificial Sequence
  Description of Artificial Sequence: Synthetic oligonucleotide
aggccgggtctcacaccctccagaata

SEQ ID NO: 28227 - DNA, 27 bp, Artificial Sequence
  Description of Artificial Sequence: Synthetic oligonucleotide
ggccgggtctcacaccctccagaatat

SEQ ID NO: 28228 - DNA, 27 bp, Artificial Sequence
  Description of Artificial Sequence: Synthetic oligonucleotide
gccgggtctcacaccctccagaatatg

SEQ ID NO: 28229 - DNA, 30 bp, Artificial Sequence
  Description of Artificial Sequence: Synthetic oligonucleotide
ccgggtctcacaccctccagaatatgtatg

SEQ ID NO: 28230 - DNA, 30 bp, Artificial Sequence
  Description of Artificial Sequence: Synthetic oligonucleotide
cgggtctcacaccctccagaatatgtatgg

SEQ ID NO: 28231 - DNA, 30 bp, Artificial Sequence
  Description of Artificial Sequence: Synthetic oligonucleotide
gggtctcacaccctccagaatatgtatggc

SEQ ID NO: 28232 - DNA, 31 bp, Artificial Sequence
  Description of Artificial Sequence: Synthetic oligonucleotide
ggtctcacaccctccagaatatgtatggctg

SEQ ID NO: 28233 - DNA, 31 bp, Artificial Sequence
  Description of Artificial Sequence: Synthetic oligonucleotide
gtctcacaccctccagaatatgtatggctgc

SEQ ID NO: 28234 - DNA, 31 bp, Artificial Sequence
  Description of Artificial Sequence: Synthetic oligonucleotide
tctcacaccctccagaatatgtatggctgcg

SEQ ID NO: 28235 - DNA, 30 bp, Artificial Sequence
  Description of Artificial Sequence: Synthetic oligonucleotide
ctcacaccctccagaatatgtatggctgcg

SEQ ID NO: 28236 - DNA, 31 bp, Artificial Sequence
  Description of Artificial Sequence: Synthetic oligonucleotide
tcacaccctccagaatatgtatggctgcgac

SEQ ID NO: 28237 - DNA, 30 bp, Artificial Sequence
  Description of Artificial Sequence: Synthetic oligonucleotide
cacaccctccagaatatgtatggctgcgac

SEQ ID NO: 28238 - DNA, 30 bp, Artificial Sequence
  Description of Artificial Sequence: Synthetic oligonucleotide
acaccctccagaatatgtatggctgcgacg

SEQ ID NO: 28239 - DNA, 29 bp, Artificial Sequence
  Description of Artificial Sequence: Synthetic oligonucleotide
caccctccagaatatgtatggctgcgacg

SEQ ID NO: 28240 - DNA, 30 bp, Artificial Sequence
  Description of Artificial Sequence: Synthetic oligonucleotide
accctccagaatatgtatggctgcgacgtg

SEQ ID NO: 28241 - DNA, 29 bp, Artificial Sequence
  Description of Artificial Sequence: Synthetic oligonucleotide
ccctccagaatatgtatggctgcgacgtg

SEQ ID NO: 28242 - DNA, 29 bp, Artificial Sequence
  Description of Artificial Sequence: Synthetic oligonucleotide
cctccagaatatgtatggctgcgacgtgg

SEQ ID NO: 28243 - DNA, 29 bp, Artificial Sequence
  Description of Artificial Sequence: Synthetic oligonucleotide
ctccagaatatgtatggctgcgacgtggg

SEQ ID NO: 28244 - DNA, 29 bp, Artificial Sequence
  Description of Artificial Sequence: Synthetic oligonucleotide
tccagaatatgtatggctgcgacgtgggg

SEQ ID NO: 28245 - DNA, 28 bp, Artificial Sequence
  Description of Artificial Sequence: Synthetic oligonucleotide
ccagaatatgtatggctgcgacgtgggg

SEQ ID NO: 28246 - DNA, 28 bp, Artificial Sequence
  Description of Artificial Sequence: Synthetic oligonucleotide
cagaatatgtatggctgcgacgtggggc

SEQ ID NO: 28247 - DNA, 28 bp, Artificial Sequence
  Description of Artificial Sequence: Synthetic oligonucleotide
agaatatgtatggctgcgacgtggggcc

SEQ ID NO: 28248 - DNA, 27 bp, Artificial Sequence
  Description of Artificial Sequence: Synthetic oligonucleotide
gaatatgtatggctgcgacgtggggcc

SEQ ID NO: 28249 - DNA, 27 bp, Artificial Sequence
  Description of Artificial Sequence: Synthetic oligonucleotide
aatatgtatggctgcgacgtggggccg

SEQ ID NO: 28250 - DNA, 26 bp, Artificial Sequence
  Description of Artificial Sequence: Synthetic oligonucleotide
atatgtatggctgcgacgtggggccg

SEQ ID NO: 28251 - DNA, 25 bp, Artificial Sequence
  Description of Artificial Sequence: Synthetic oligonucleotide
tatgtatggctgcgacgtggggccg

SEQ ID NO: 28252 - DNA, 30 bp, Artificial Sequence
  Description of Artificial Sequence: Synthetic oligonucleotide
tacgtggacgacacgcagttcgtgagtttc

SEQ ID NO: 28253 - DNA, 29 bp, Artificial Sequence
  Description of Artificial Sequence: Synthetic oligonucleotide
acgtggacgacacgcagttcgtgagtttc

SEQ ID NO: 28254 - DNA, 28 bp, Artificial Sequence
  Description of Artificial Sequence: Synthetic oligonucleotide
cgtggacgacacgcagttcgtgagtttc

SEQ ID NO: 28255 - DNA, 28 bp, Artificial Sequence
  Description of Artificial Sequence: Synthetic oligonucleotide
gtggacgacacgcagttcgtgagtttcg

SEQ ID NO: 28256 - DNA, 29 bp, Artificial Sequence
  Description of Artificial Sequence: Synthetic oligonucleotide
tggacgacacgcagttcgtgagtttcgac

SEQ ID NO: 28257 - DNA, 28 bp, Artificial Sequence
  Description of Artificial Sequence: Synthetic oligonucleotide
ggacgacacgcagttcgtgagtttcgac

SEQ ID NO: 28258 - DNA, 29 bp, Artificial Sequence
  Description of Artificial Sequence: Synthetic oligonucleotide
gacgacacgcagttcgtgagtttcgacag

SEQ ID NO: 28259 - DNA, 29 bp, Artificial Sequence
  Description of Artificial Sequence: Synthetic oligonucleotide
acgacacgcagttcgtgagtttcgacagc

SEQ ID NO: 28260 - DNA, 28 bp, Artificial Sequence
  Description of Artificial Sequence: Synthetic oligonucleotide
cgacacgcagttcgtgagtttcgacagc

SEQ ID NO: 28261 - DNA, 28 bp, Artificial Sequence
  Description of Artificial Sequence: Synthetic oligonucleotide
gacacgcagttcgtgagtttcgacagcg

SEQ ID NO: 28262 - DNA, 29 bp, Artificial Sequence
  Description of Artificial Sequence: Synthetic oligonucleotide
acacgcagttcgtgagtttcgacagcgac

SEQ ID NO: 28263 - DNA, 28 bp, Artificial Sequence
  Description of Artificial Sequence: Synthetic oligonucleotide
cacgcagttcgtgagtttcgacagcgac

SEQ ID NO: 28264 - DNA, 28 bp, Artificial Sequence
  Description of Artificial Sequence: Synthetic oligonucleotide
acgcagttcgtgagtttcgacagcgacg

SEQ ID NO: 28265 - DNA, 27 bp, Artificial Sequence
  Description of Artificial Sequence: Synthetic oligonucleotide
cgcagttcgtgagtttcgacagcgacg

SEQ ID NO: 28266 - DNA, 27 bp, Artificial Sequence
  Description of Artificial Sequence: Synthetic oligonucleotide
gcagttcgtgagtttcgacagcgacgc

SEQ ID NO: 28267 - DNA, 27 bp, Artificial Sequence
  Description of Artificial Sequence: Synthetic oligonucleotide
cagttcgtgagtttcgacagcgacgcc

SEQ ID NO: 28268 - DNA, 27 bp, Artificial Sequence
  Description of Artificial Sequence: Synthetic oligonucleotide
agttcgtgagtttcgacagcgacgccg

SEQ ID NO: 28269 - DNA, 26 bp, Artificial Sequence
  Description of Artificial Sequence: Synthetic oligonucleotide
gttcgtgagtttcgacagcgacgccg

SEQ ID NO: 28270 - DNA, 26 bp, Artificial Sequence
  Description of Artificial Sequence: Synthetic oligonucleotide
ttcgtgagtttcgacagcgacgccgc

SEQ ID NO: 28271 - DNA, 25 bp, Artificial Sequence
  Description of Artificial Sequence: Synthetic oligonucleotide
tcgtgagtttcgacagcgacgccgc

SEQ ID NO: 28272 - DNA, 24 bp, Artificial Sequence
  Description of Artificial Sequence: Synthetic oligonucleotide
cgtgagtttcgacagcgacgccgc

SEQ ID NO: 28273 - DNA, 25 bp, Artificial Sequence
  Description of Artificial Sequence: Synthetic oligonucleotide
gtgagtttcgacagcgacgccgcga

SEQ ID NO: 28274 - DNA, 26 bp, Artificial Sequence
  Description of Artificial Sequence: Synthetic oligonucleotide
tgagtttcgacagcgacgccgcgagt

SEQ ID NO: 28275 - DNA, 25 bp, Artificial Sequence
  Description of Artificial Sequence: Synthetic oligonucleotide
gagtttcgacagcgacgccgcgagt

SEQ ID NO: 28276 - DNA, 25 bp, Artificial Sequence
  Description of Artificial Sequence: Synthetic oligonucleotide
agtttcgacagcgacgccgcgagtc

SEQ ID NO: 28277 - DNA, 24 bp, Artificial Sequence
  Description of Artificial Sequence: Synthetic oligonucleotide
gtttcgacagcgacgccgcgagtc

SEQ ID NO: 28278 - DNA, 24 bp, Artificial Sequence
  Description of Artificial Sequence: Synthetic oligonucleotide
tttcgacagcgacgccgcgagtcc

SEQ ID NO: 28279 - DNA, 24 bp, Artificial Sequence
  Description of Artificial Sequence: Synthetic oligonucleotide
cctcctccgcgggcatgaccagtt

SEQ ID NO: 28280 - DNA, 24 bp, Artificial Sequence
  Description of Artificial Sequence: Synthetic oligonucleotide
ctcctccgcgggcatgaccagttc

SEQ ID NO: 28281 - DNA, 24 bp, Artificial Sequence
  Description of Artificial Sequence: Synthetic oligonucleotide
tcctccgcgggcatgaccagttcg

SEQ ID NO: 28282 - DNA, 23 bp, Artificial Sequence
  Description of Artificial Sequence: Synthetic oligonucleotide
cctccgcgggcatgaccagttcg

SEQ ID NO: 28283 - DNA, 23 bp, Artificial Sequence
  Description of Artificial Sequence: Synthetic oligonucleotide
ctccgcgggcatgaccagttcgc

SEQ ID NO: 28284 - DNA, 25 bp, Artificial Sequence
  Description of Artificial Sequence: Synthetic oligonucleotide
tccgcgggcatgaccagttcgccta

SEQ ID NO: 28285 - DNA, 24 bp, Artificial Sequence
  Description of Artificial Sequence: Synthetic oligonucleotide
ccgcgggcatgaccagttcgccta

SEQ ID NO: 28286 - DNA, 24 bp, Artificial Sequence
  Description of Artificial Sequence: Synthetic oligonucleotide
cgcgggcatgaccagttcgcctac

SEQ ID NO: 28287 - DNA, 25 bp, Artificial Sequence
  Description of Artificial Sequence: Synthetic oligonucleotide
gcgggcatgaccagttcgcctacga

SEQ ID NO: 28288 - DNA, 25 bp, Artificial Sequence
  Description of Artificial Sequence: Synthetic oligonucleotide
cgggcatgaccagttcgcctacgac

SEQ ID NO: 28289 - DNA, 25 bp, Artificial Sequence
  Description of Artificial Sequence: Synthetic oligonucleotide
gggcatgaccagttcgcctacgacg

SEQ ID NO: 28290 - DNA, 25 bp, Artificial Sequence
  Description of Artificial Sequence: Synthetic oligonucleotide
ggcatgaccagttcgcctacgacgg

SEQ ID NO: 28291 - DNA, 27 bp, Artificial Sequence
  Description of Artificial Sequence: Synthetic oligonucleotide
gcatgaccagttcgcctacgacggcaa

SEQ ID NO: 28292 - DNA, 27 bp, Artificial Sequence
  Description of Artificial Sequence: Synthetic oligonucleotide
catgaccagttcgcctacgacggcaag

SEQ ID NO: 28293 - DNA, 27 bp, Artificial Sequence
  Description of Artificial Sequence: Synthetic oligonucleotide
atgaccagttcgcctacgacggcaagg

SEQ ID NO: 28294 - DNA, 27 bp, Artificial Sequence
  Description of Artificial Sequence: Synthetic oligonucleotide
tgaccagttcgcctacgacggcaagga

SEQ ID NO: 28295 - DNA, 27 bp, Artificial Sequence
  Description of Artificial Sequence: Synthetic oligonucleotide
gaccagttcgcctacgacggcaaggat

SEQ ID NO: 28296 - DNA, 26 bp, Artificial Sequence
  Description of Artificial Sequence: Synthetic oligonucleotide
ggagtggctccgcagatacctggaga

SEQ ID NO: 28297 - DNA, 26 bp, Artificial Sequence
  Description of Artificial Sequence: Synthetic oligonucleotide
gagtggctccgcagatacctggagag

SEQ ID NO: 28298 - DNA, 26 bp, Artificial Sequence
  Description of Artificial Sequence: Synthetic oligonucleotide
agtggctccgcagatacctggagagc

SEQ ID NO: 28299 - DNA, 25 bp, Artificial Sequence
  Description of Artificial Sequence: Synthetic oligonucleotide
gtggctccgcagatacctggagagc

SEQ ID NO: 28300 - DNA, 25 bp, Artificial Sequence
  Description of Artificial Sequence: Synthetic oligonucleotide
tggctccgcagatacctggagagcg

SEQ ID NO: 28301 - DNA, 24 bp, Artificial Sequence
  Description of Artificial Sequence: Synthetic oligonucleotide
ggctccgcagatacctggagagcg

SEQ ID NO: 28302 - DNA, 24 bp, Artificial Sequence
  Description of Artificial Sequence: Synthetic oligonucleotide
gctccgcagatacctggagagcgg

SEQ ID NO: 28303 - DNA, 26 bp, Artificial Sequence
  Description of Artificial Sequence: Synthetic oligonucleotide
ctccgcagatacctggagagcgggaa

SEQ ID NO: 28304 - DNA, 26 bp, Artificial Sequence
  Description of Artificial Sequence: Synthetic oligonucleotide
tccgcagatacctggagagcgggaag

SEQ ID NO: 28305 - DNA, 25 bp, Artificial Sequence
  Description of Artificial Sequence: Synthetic oligonucleotide
ccgcagatacctggagagcgggaag

SEQ ID NO: 28306 - DNA, 26 bp, Artificial Sequence
  Description of Artificial Sequence: Synthetic oligonucleotide
cgcagatacctggagagcgggaagga

SEQ ID NO: 28307 - DNA, 27 bp, Artificial Sequence
  Description of Artificial Sequence: Synthetic oligonucleotide
gcagatacctggagagcgggaaggaga

SEQ ID NO: 28308 - DNA, 27 bp, Artificial Sequence
  Description of Artificial Sequence: Synthetic oligonucleotide
cagatacctggagagcgggaaggagac

SEQ ID NO: 28309 - DNA, 27 bp, Artificial Sequence
  Description of Artificial Sequence: Synthetic oligonucleotide
agatacctggagagcgggaaggagacg

SEQ ID NO: 28310 - DNA, 26 bp, Artificial Sequence
  Description of Artificial Sequence: Synthetic oligonucleotide
gatacctggagagcgggaaggagacg

SEQ ID NO: 28311 - DNA, 27 bp, Artificial Sequence
  Description of Artificial Sequence: Synthetic oligonucleotide
atacctggagagcgggaaggagacgct

SEQ ID NO: 28312 - DNA, 26 bp, Artificial Sequence
  Description of Artificial Sequence: Synthetic oligonucleotide
tacctggagagcgggaaggagacgct

SEQ ID NO: 28313 - DNA, 25 bp, Artificial Sequence
  Description of Artificial Sequence: Synthetic oligonucleotide
acctggagagcgggaaggagacgct

SEQ ID NO: 28314 - DNA, 24 bp, Artificial Sequence
  Description of Artificial Sequence: Synthetic oligonucleotide
cctggagagcgggaaggagacgct

SEQ ID NO: 28315 - DNA, 24 bp, Artificial Sequence
  Description of Artificial Sequence: Synthetic oligonucleotide
ctggagagcgggaaggagacgctg

SEQ ID NO: 28316 - DNA, 25 bp, Artificial Sequence
  Description of Artificial Sequence: Synthetic oligonucleotide
tggagagcgggaaggagacgctgca

SEQ ID NO: 28317 - DNA, 24 bp, Artificial Sequence
  Description of Artificial Sequence: Synthetic oligonucleotide
ggagagcgggaaggagacgctgca

SEQ ID NO: 28318 - DNA, 24 bp, Artificial Sequence
  Description of Artificial Sequence: Synthetic oligonucleotide
gagagcgggaaggagacgctgcag

SEQ ID NO: 28319 - DNA, 24 bp, Artificial Sequence
  Description of Artificial Sequence: Synthetic oligonucleotide
agagcgggaaggagacgctgcagc

SEQ ID NO: 28320 - DNA, 23 bp, Artificial Sequence
  Description of Artificial Sequence: Synthetic oligonucleotide
gagcgggaaggagacgctgcagc

SEQ ID NO: 28321 - DNA, 23 bp, Artificial Sequence
  Description of Artificial Sequence: Synthetic oligonucleotide
agcgggaaggagacgctgcagcg

SEQ ID NO: 28322 - DNA, 22 bp, Artificial Sequence
  Description of Artificial Sequence: Synthetic oligonucleotide
gcgggaaggagacgctgcagcg

SEQ ID NO: 28323 - DNA, 31 bp, Artificial Sequence
  Description of Artificial Sequence: Synthetic oligonucleotide
tattgggaccggaacacacagatctccaagg

SEQ ID NO: 28324 - DNA, 30 bp, Artificial Sequence
  Description of Artificial Sequence: Synthetic oligonucleotide
attgggaccggaacacacagatctccaagg

SEQ ID NO: 28325 - DNA, 29 bp, Artificial Sequence
  Description of Artificial Sequence: Synthetic oligonucleotide
ttgggaccggaacacacagatctccaagg

SEQ ID NO: 28326 - DNA, 28 bp, Artificial Sequence
  Description of Artificial Sequence: Synthetic oligonucleotide
tgggaccggaacacacagatctccaagg

SEQ ID NO: 28327 - DNA, 27 bp, Artificial Sequence
  Description of Artificial Sequence: Synthetic oligonucleotide
gggaccggaacacacagatctccaagg

SEQ ID NO: 28328 - DNA, 27 bp, Artificial Sequence
  Description of Artificial Sequence: Synthetic oligonucleotide
ggaccggaacacacagatctccaaggc

SEQ ID NO: 28329 - DNA, 27 bp, Artificial Sequence
  Description of Artificial Sequence: Synthetic oligonucleotide
gaccggaacacacagatctccaaggcc

SEQ ID NO: 28330 - DNA, 29 bp, Artificial Sequence
  Description of Artificial Sequence: Synthetic oligonucleotide
accggaacacacagatctccaaggccaac

SEQ ID NO: 28331 - DNA, 28 bp, Artificial Sequence
  Description of Artificial Sequence: Synthetic oligonucleotide
ccggaacacacagatctccaaggccaac

SEQ ID NO: 28332 - DNA, 29 bp, Artificial Sequence
  Description of Artificial Sequence: Synthetic oligonucleotide
cggaacacacagatctccaaggccaacac

SEQ ID NO: 28333 - DNA, 30 bp, Artificial Sequence
  Description of Artificial Sequence: Synthetic oligonucleotide
ggaacacacagatctccaaggccaacacac

SEQ ID NO: 28334 - DNA, 31 bp, Artificial Sequence
  Description of Artificial Sequence: Synthetic oligonucleotide
gaacacacagatctccaaggccaacacacag

SEQ ID NO: 28335 - DNA, 32 bp, Artificial Sequence
  Description of Artificial Sequence: Synthetic oligonucleotide
aacacacagatctccaaggccaacacacagac

SEQ ID NO: 28336 - DNA, 31 bp, Artificial Sequence
  Description of Artificial Sequence: Synthetic oligonucleotide
acacacagatctccaaggccaacacacagac

SEQ ID NO: 28337 - DNA, 30 bp, Artificial Sequence
  Description of Artificial Sequence: Synthetic oligonucleotide
cacacagatctccaaggccaacacacagac

SEQ ID NO: 28338 - DNA, 33 bp, Artificial Sequence
  Description of Artificial Sequence: Synthetic oligonucleotide
acacagatctccaaggccaacacacagacttac

SEQ ID NO: 28339 - DNA, 32 bp, Artificial Sequence
  Description of Artificial Sequence: Synthetic oligonucleotide
cacagatctccaaggccaacacacagacttac

SEQ ID NO: 28340 - DNA, 32 bp, Artificial Sequence
  Description of Artificial Sequence: Synthetic oligonucleotide
acagatctccaaggccaacacacagacttacc

SEQ ID NO: 28341 - DNA, 31 bp, Artificial Sequence
  Description of Artificial Sequence: Synthetic oligonucleotide
cagatctccaaggccaacacacagacttacc

SEQ ID NO: 28342 - DNA, 31 bp, Artificial Sequence
  Description of Artificial Sequence: Synthetic oligonucleotide
agatctccaaggccaacacacagacttaccg

SEQ ID NO: 28343 - DNA, 30 bp, Artificial Sequence
  Description of Artificial Sequence: Synthetic oligonucleotide
gatctccaaggccaacacacagacttaccg

SEQ ID NO: 28344 - DNA, 31 bp, Artificial Sequence
  Description of Artificial Sequence: Synthetic oligonucleotide
atctccaaggccaacacacagacttaccgag

SEQ ID NO: 28345 - DNA, 30 bp, Artificial Sequence
  Description of Artificial Sequence: Synthetic oligonucleotide
tctccaaggccaacacacagacttaccgag

SEQ ID NO: 28346 - DNA, 29 bp, Artificial Sequence
  Description of Artificial Sequence: Synthetic oligonucleotide
ctccaaggccaacacacagacttaccgag

SEQ ID NO: 28347 - DNA, 30 bp, Artificial Sequence
  Description of Artificial Sequence: Synthetic oligonucleotide
tccaaggccaacacacagacttaccgagag

SEQ ID NO: 28348 - DNA, 29 bp, Artificial Sequence
  Description of Artificial Sequence: Synthetic oligonucleotide
ccaaggccaacacacagacttaccgagag

SEQ ID NO: 28349 - DNA, 26 bp, Artificial Sequence
  Description of Artificial Sequence: Synthetic oligonucleotide
gggatggcgaggaccaaactcaggac

SEQ ID NO: 28350 - DNA, 26 bp, Artificial Sequence
  Description of Artificial Sequence: Synthetic oligonucleotide
ggatggcgaggaccaaactcaggacg

SEQ ID NO: 28351 - DNA, 26 bp, Artificial Sequence
  Description of Artificial Sequence: Synthetic oligonucleotide
gatggcgaggaccaaactcaggacgc

SEQ ID NO: 28352 - DNA, 26 bp, Artificial Sequence
  Description of Artificial Sequence: Synthetic oligonucleotide
atggcgaggaccaaactcaggacgcc

SEQ ID NO: 28353 - DNA, 25 bp, Artificial Sequence
  Description of Artificial Sequence: Synthetic oligonucleotide
tggcgaggaccaaactcaggacgcc

SEQ ID NO: 28354 - DNA, 24 bp, Artificial Sequence
  Description of Artificial Sequence: Synthetic oligonucleotide
ggcgaggaccaaactcaggacgcc

SEQ ID NO: 28355 - DNA, 25 bp, Artificial Sequence
  Description of Artificial Sequence: Synthetic oligonucleotide
gcgaggaccaaactcaggacgccga

SEQ ID NO: 28356 - DNA, 25 bp, Artificial Sequence
  Description of Artificial Sequence: Synthetic oligonucleotide
cgaggaccaaactcaggacgccgag

SEQ ID NO: 28357 - DNA, 27 bp, Artificial Sequence
  Description of Artificial Sequence: Synthetic oligonucleotide
gaggaccaaactcaggacgccgagctt

SEQ ID NO: 28358 - DNA, 27 bp, Artificial Sequence
  Description of Artificial Sequence: Synthetic oligonucleotide
aggaccaaactcaggacgccgagcttg

SEQ ID NO: 28359 - DNA, 27 bp, Artificial Sequence
  Description of Artificial Sequence: Synthetic oligonucleotide
ggaccaaactcaggacgccgagcttgt

SEQ ID NO: 28360 - DNA, 27 bp, Artificial Sequence
  Description of Artificial Sequence: Synthetic oligonucleotide
gaccaaactcaggacgccgagcttgtg

SEQ ID NO: 28361 - DNA, 27 bp, Artificial Sequence
  Description of Artificial Sequence: Synthetic oligonucleotide
accaaactcaggacgccgagcttgtgg

SEQ ID NO: 28362 - DNA, 27 bp, Artificial Sequence
  Description of Artificial Sequence: Synthetic oligonucleotide
ccaaactcaggacgccgagcttgtgga

SEQ ID NO: 28363 - DNA, 27 bp, Artificial Sequence
  Description of Artificial Sequence: Synthetic oligonucleotide
caaactcaggacgccgagcttgtggag

SEQ ID NO: 28364 - DNA, 28 bp, Artificial Sequence
  Description of Artificial Sequence: Synthetic oligonucleotide
aaactcaggacgccgagcttgtggagac

SEQ ID NO: 28365 - DNA, 27 bp, Artificial Sequence
  Description of Artificial Sequence: Synthetic oligonucleotide
aactcaggacgccgagcttgtggagac

SEQ ID NO: 28366 - DNA, 26 bp, Artificial Sequence
  Description of Artificial Sequence: Synthetic oligonucleotide
actcaggacgccgagcttgtggagac

SEQ ID NO: 28367 - DNA, 25 bp, Artificial Sequence
  Description of Artificial Sequence: Synthetic oligonucleotide
ctcaggacgccgagcttgtggagac

SEQ ID NO: 28368 - DNA, 26 bp, Artificial Sequence
  Description of Artificial Sequence: Synthetic oligonucleotide
tcaggacgccgagcttgtggagacca

SEQ ID NO: 28369 - DNA, 25 bp, Artificial Sequence
  Description of Artificial Sequence: Synthetic oligonucleotide
caggacgccgagcttgtggagacca

SEQ ID NO: 28370 - DNA, 26 bp, Artificial Sequence
  Description of Artificial Sequence: Synthetic oligonucleotide
aggacgccgagcttgtggagaccaga

SEQ ID NO: 28371 - DNA, 25 bp, Artificial Sequence
  Description of Artificial Sequence: Synthetic oligonucleotide
ggacgccgagcttgtggagaccaga

SEQ ID NO: 28372 - DNA, 25 bp, Artificial Sequence
  Description of Artificial Sequence: Synthetic oligonucleotide
gacgccgagcttgtggagaccagac

SEQ ID NO: 28373 - DNA, 26 bp, Artificial Sequence
  Description of Artificial Sequence: Synthetic oligonucleotide
acgccgagcttgtggagaccagacca

SEQ ID NO: 28374 - DNA, 25 bp, Artificial Sequence
  Description of Artificial Sequence: Synthetic oligonucleotide
cgccgagcttgtggagaccagacca

SEQ ID NO: 28375 - DNA, 25 bp, Artificial Sequence
  Description of Artificial Sequence: Synthetic oligonucleotide
gccgagcttgtggagaccagaccag

SEQ ID NO: 28376 - DNA, 23 bp, Artificial Sequence
  Description of Artificial Sequence: Synthetic oligonucleotide
gccgggtctcacaccctccagac

SEQ ID NO: 28377 - DNA, 25 bp, Artificial Sequence
  Description of Artificial Sequence: Synthetic oligonucleotide
ccgggtctcacaccctccagacgat

SEQ ID NO: 28378 - DNA, 27 bp, Artificial Sequence
  Description of Artificial Sequence: Synthetic oligonucleotide
cgggtctcacaccctccagacgatgta

SEQ ID NO: 28379 - DNA, 27 bp, Artificial Sequence
  Description of Artificial Sequence: Synthetic oligonucleotide
gggtctcacaccctccagacgatgtac

SEQ ID NO: 28380 - DNA, 27 bp, Artificial Sequence
  Description of Artificial Sequence: Synthetic oligonucleotide
ggtctcacaccctccagacgatgtacg

SEQ ID NO: 28381 - DNA, 27 bp, Artificial Sequence
  Description of Artificial Sequence: Synthetic oligonucleotide
gtctcacaccctccagacgatgtacgg

SEQ ID NO: 28382 - DNA, 27 bp, Artificial Sequence
  Description of Artificial Sequence: Synthetic oligonucleotide
tctcacaccctccagacgatgtacggc

SEQ ID NO: 28383 - DNA, 27 bp, Artificial Sequence
  Description of Artificial Sequence: Synthetic oligonucleotide
ctcacaccctccagacgatgtacggct

SEQ ID NO: 28384 - DNA, 27 bp, Artificial Sequence
  Description of Artificial Sequence: Synthetic oligonucleotide
tcacaccctccagacgatgtacggctg

SEQ ID NO: 28385 - DNA, 26 bp, Artificial Sequence
  Description of Artificial Sequence: Synthetic oligonucleotide
cacaccctccagacgatgtacggctg

SEQ ID NO: 28386 - DNA, 26 bp, Artificial Sequence
  Description of Artificial Sequence: Synthetic oligonucleotide
acaccctccagacgatgtacggctgc

SEQ ID NO: 28387 - DNA, 25 bp, Artificial Sequence
  Description of Artificial Sequence: Synthetic oligonucleotide
caccctccagacgatgtacggctgc

SEQ ID NO: 28388 - DNA, 26 bp, Artificial Sequence
  Description of Artificial Sequence: Synthetic oligonucleotide
accctccagacgatgtacggctgcga

SEQ ID NO: 28389 - DNA, 25 bp, Artificial Sequence
  Description of Artificial Sequence: Synthetic oligonucleotide
ccctccagacgatgtacggctgcga

SEQ ID NO: 28390 - DNA, 25 bp, Artificial Sequence
  Description of Artificial Sequence: Synthetic oligonucleotide
cctccagacgatgtacggctgcgac

SEQ ID NO: 28391 - DNA, 26 bp, Artificial Sequence
  Description of Artificial Sequence: Synthetic oligonucleotide
ctccagacgatgtacggctgcgacgt

SEQ ID NO: 28392 - DNA, 26 bp, Artificial Sequence
  Description of Artificial Sequence: Synthetic oligonucleotide
tccagacgatgtacggctgcgacgtg

SEQ ID NO: 28393 - DNA, 25 bp, Artificial Sequence
  Description of Artificial Sequence: Synthetic oligonucleotide
ccagacgatgtacggctgcgacgtg

SEQ ID NO: 28394 - DNA, 23 bp, Artificial Sequence
  Description of Artificial Sequence: Synthetic oligonucleotide
agcgacgccgcgagtccgaggaa

SEQ ID NO: 28395 - DNA, 22 bp, Artificial Sequence
  Description of Artificial Sequence: Synthetic oligonucleotide
gcgacgccgcgagtccgaggaa

SEQ ID NO: 28396 - DNA, 22 bp, Artificial Sequence
  Description of Artificial Sequence: Synthetic oligonucleotide
cgacgccgcgagtccgaggaag

SEQ ID NO: 28397 - DNA, 23 bp, Artificial Sequence
  Description of Artificial Sequence: Synthetic oligonucleotide
gacgccgcgagtccgaggaagga

SEQ ID NO: 28398 - DNA, 23 bp, Artificial Sequence
  Description of Artificial Sequence: Synthetic oligonucleotide
acgccgcgagtccgaggaaggag

SEQ ID NO: 28399 - DNA, 22 bp, Artificial Sequence
  Description of Artificial Sequence: Synthetic oligonucleotide
cgccgcgagtccgaggaaggag

SEQ ID NO: 28400 - DNA, 22 bp, Artificial Sequence
  Description of Artificial Sequence: Synthetic oligonucleotide
gccgcgagtccgaggaaggagc

SEQ ID NO: 28401 - DNA, 22 bp, Artificial Sequence
  Description of Artificial Sequence: Synthetic oligonucleotide
ccgcgagtccgaggaaggagcc

SEQ ID NO: 28402 - DNA, 22 bp, Artificial Sequence
  Description of Artificial Sequence: Synthetic oligonucleotide
cgcgagtccgaggaaggagccg

SEQ ID NO: 28403 - DNA, 22 bp, Artificial Sequence
  Description of Artificial Sequence: Synthetic oligonucleotide
gcgagtccgaggaaggagccgc

SEQ ID NO: 28404 - DNA, 21 bp, Artificial Sequence
  Description of Artificial Sequence: Synthetic oligonucleotide
agcgcaagtgggaggcggccg

SEQ ID NO: 28405 - DNA, 20 bp, Artificial Sequence
  Description of Artificial Sequence: Synthetic oligonucleotide
gcgcaagtgggaggcggccg

SEQ ID NO: 28406 - DNA, 21 bp, Artificial Sequence
  Description of Artificial Sequence: Synthetic oligonucleotide
cgcaagtgggaggcggccggt

SEQ ID NO: 28407 - DNA, 22 bp, Artificial Sequence
  Description of Artificial Sequence: Synthetic oligonucleotide
gcaagtgggaggcggccggtga

SEQ ID NO: 28408 - DNA, 22 bp, Artificial Sequence
  Description of Artificial Sequence: Synthetic oligonucleotide
caagtgggaggcggccggtgag

SEQ ID NO: 28409 - DNA, 22 bp, Artificial Sequence
  Description of Artificial Sequence: Synthetic oligonucleotide
aagtgggaggcggccggtgagg

SEQ ID NO: 28410 - DNA, 21 bp, Artificial Sequence
  Description of Artificial Sequence: Synthetic oligonucleotide
agtgggaggcggccggtgagg

SEQ ID NO: 28411 - DNA, 20 bp, Artificial Sequence
  Description of Artificial Sequence: Synthetic oligonucleotide
gtgggaggcggccggtgagg

SEQ ID NO: 28412 - DNA, 20 bp, Artificial Sequence
  Description of Artificial Sequence: Synthetic oligonucleotide
tgggaggcggccggtgaggc

SEQ ID NO: 28413 - DNA, 20 bp, Artificial Sequence
  Description of Artificial Sequence: Synthetic oligonucleotide
gggaggcggccggtgaggct

SEQ ID NO: 28414 - DNA, 20 bp, Artificial Sequence
  Description of Artificial Sequence: Synthetic oligonucleotide
ggaggcggccggtgaggcgt

SEQ ID NO: 28415 - DNA, 20 bp, Artificial Sequence
  Description of Artificial Sequence: Synthetic oligonucleotide
gaggcggccggtgaggcgga

SEQ ID NO: 28416 - DNA, 20 bp, Artificial Sequence
  Description of Artificial Sequence: Synthetic oligonucleotide
aggcggccggtgaggcggag

SEQ ID NO: 28417 - DNA, 20 bp, Artificial Sequence
  Description of Artificial Sequence: Synthetic oligonucleotide
ggcggccggtgaggcggagt

SEQ ID NO: 28418 - DNA, 20 bp, Artificial Sequence
  Description of Artificial Sequence: Synthetic oligonucleotide
gcggccggtgaggcggagca

SEQ ID NO: 28419 - DNA, 21 bp, Artificial Sequence
  Description of Artificial Sequence: Synthetic oligonucleotide
cggccggtgaggcggagcagt

SEQ ID NO: 28420 - DNA, 21 bp, Artificial Sequence
  Description of Artificial Sequence: Synthetic oligonucleotide
ggccggtgaggcggagcagtg

SEQ ID NO: 28421 - DNA, 22 bp, Artificial Sequence
  Description of Artificial Sequence: Synthetic oligonucleotide
gccggtgaggcggagcagtgga

SEQ ID NO: 28422 - DNA, 23 bp, Artificial Sequence
  Description of Artificial Sequence: Synthetic oligonucleotide
ccggtgaggcggagcagtggaga

SEQ ID NO: 28423 - DNA, 23 bp, Artificial Sequence
  Description of Artificial Sequence: Synthetic oligonucleotide
cggtgaggcggagcagtggagag

SEQ ID NO: 28424 - DNA, 23 bp, Artificial Sequence
  Description of Artificial Sequence: Synthetic oligonucleotide
ggtgaggcggagcagtggagagc

SEQ ID NO: 28425 - DNA, 28 bp, Artificial Sequence
  Description of Artificial Sequence: Synthetic oligonucleotide
caaactcaggacaccgagcttgtggagg

SEQ ID NO: 28426 - DNA, 28 bp, Artificial Sequence
  Description of Artificial Sequence: Synthetic oligonucleotide
aaactcaggacaccgagcttgtggaggc

SEQ ID NO: 28427 - DNA, 27 bp, Artificial Sequence
  Description of Artificial Sequence: Synthetic oligonucleotide
aactcaggacaccgagcttgtggaggc

SEQ ID NO: 28428 - DNA, 26 bp, Artificial Sequence
  Description of Artificial Sequence: Synthetic oligonucleotide
actcaggacaccgagcttgtggaggc

SEQ ID NO: 28429 - DNA, 25 bp, Artificial Sequence
  Description of Artificial Sequence: Synthetic oligonucleotide
ctcaggacaccgagcttgtggaggc

SEQ ID NO: 28430 - DNA, 26 bp, Artificial Sequence
  Description of Artificial Sequence: Synthetic oligonucleotide
tcaggacaccgagcttgtggaggcca

SEQ ID NO: 28431 - DNA, 25 bp, Artificial Sequence
  Description of Artificial Sequence: Synthetic oligonucleotide
caggacaccgagcttgtggaggcca

SEQ ID NO: 28432 - DNA, 26 bp, Artificial Sequence
  Description of Artificial Sequence: Synthetic oligonucleotide
aggacaccgagcttgtggaggccaga

SEQ ID NO: 28433 - DNA, 25 bp, Artificial Sequence
  Description of Artificial Sequence: Synthetic oligonucleotide
ggacaccgagcttgtggaggccaga

SEQ ID NO: 28434 - DNA, 25 bp, Artificial Sequence
  Description of Artificial Sequence: Synthetic oligonucleotide
gacaccgagcttgtggaggccagac

SEQ ID NO: 28435 - DNA, 26 bp, Artificial Sequence
  Description of Artificial Sequence: Synthetic oligonucleotide
acaccgagcttgtggaggccagacca

SEQ ID NO: 28436 - DNA, 25 bp, Artificial Sequence
  Description of Artificial Sequence: Synthetic oligonucleotide
caccgagcttgtggaggccagacca

SEQ ID NO: 28437 - DNA, 25 bp, Artificial Sequence
  Description of Artificial Sequence: Synthetic oligonucleotide
accgagcttgtggaggccagaccag

SEQ ID NO: 28438 - DNA, 24 bp, Artificial Sequence
  Description of Artificial Sequence: Synthetic oligonucleotide
ccgagcttgtggaggccagaccag

SEQ ID NO: 28439 - DNA, 25 bp, Artificial Sequence
  Description of Artificial Sequence: Synthetic oligonucleotide
cgagcttgtggaggccagaccagca

SEQ ID NO: 28440 - DNA, 25 bp, Artificial Sequence
  Description of Artificial Sequence: Synthetic oligonucleotide
gagcttgtggaggccagaccagcag

SEQ ID NO: 28441 - DNA, 26 bp, Artificial Sequence
  Description of Artificial Sequence: Synthetic oligonucleotide
agcttgtggaggccagaccagcagga

SEQ ID NO: 28442 - DNA, 25 bp, Artificial Sequence
  Description of Artificial Sequence: Synthetic oligonucleotide
gcttgtggaggccagaccagcagga

SEQ ID NO: 28443 - DNA, 27 bp, Artificial Sequence
  Description of Artificial Sequence: Synthetic oligonucleotide
cttgtggaggccagaccagcaggagat

SEQ ID NO: 28444 - DNA, 28 bp, Artificial Sequence
  Description of Artificial Sequence: Synthetic oligonucleotide
ttgtggaggccagaccagcaggagatag

SEQ ID NO: 28445 - DNA, 27 bp, Artificial Sequence
  Description of Artificial Sequence: Synthetic oligonucleotide
tgtggaggccagaccagcaggagatag

SEQ ID NO: 28446 - DNA, 27 bp, Artificial Sequence
  Description of Artificial Sequence: Synthetic oligonucleotide
gtggaggccagaccagcaggagataga

SEQ ID NO: 28447 - DNA, 28 bp, Artificial Sequence
  Description of Artificial Sequence: Synthetic oligonucleotide
tggaggccagaccagcaggagatagaac

SEQ ID NO: 28448 - DNA, 27 bp, Artificial Sequence
  Description of Artificial Sequence: Synthetic oligonucleotide
ggaggccagaccagcaggagatagaac

SEQ ID NO: 28449 - DNA, 27 bp, Artificial Sequence
  Description of Artificial Sequence: Synthetic oligonucleotide
gaggccagaccagcaggagatagaacc

SEQ ID NO: 28450 - DNA, 29 bp, Artificial Sequence
  Description of Artificial Sequence: Synthetic oligonucleotide
aggccagaccagcaggagatagaaccttc

SEQ ID NO: 28451 - DNA, 28 bp, Artificial Sequence
  Description of Artificial Sequence: Synthetic oligonucleotide
ggccagaccagcaggagatagaaccttc

SEQ ID NO: 28452 - DNA, 28 bp, Artificial Sequence
  Description of Artificial Sequence: Synthetic oligonucleotide
gccagaccagcaggagatagaaccttcc

SEQ ID NO: 28453 - DNA, 22 bp, Artificial Sequence
  Description of Artificial Sequence: Synthetic oligonucleotide
cggcggacacggcggctcacat

SEQ ID NO: 28454 - DNA, 23 bp, Artificial Sequence
  Description of Artificial Sequence: Synthetic oligonucleotide
ggcggacacggcggctcacatca

SEQ ID NO: 28455 - DNA, 23 bp, Artificial Sequence
  Description of Artificial Sequence: Synthetic oligonucleotide
gcggacacggcggctcacatcac

SEQ ID NO: 28456 - DNA, 23 bp, Artificial Sequence
  Description of Artificial Sequence: Synthetic oligonucleotide
cggacacggcggctcacatcacc

SEQ ID NO: 28457 - DNA, 24 bp, Artificial Sequence
  Description of Artificial Sequence: Synthetic oligonucleotide
ggacacggcggctcacatcaccca

SEQ ID NO: 28458 - DNA, 24 bp, Artificial Sequence
  Description of Artificial Sequence: Synthetic oligonucleotide
gacacggcggctcacatcacccag

SEQ ID NO: 28459 - DNA, 24 bp, Artificial Sequence
  Description of Artificial Sequence: Synthetic oligonucleotide
acacggcggctcacatcacccagc

SEQ ID NO: 28460 - DNA, 23 bp, Artificial Sequence
  Description of Artificial Sequence: Synthetic oligonucleotide
cacggcggctcacatcacccagc

SEQ ID NO: 28461 - DNA, 23 bp, Artificial Sequence
  Description of Artificial Sequence: Synthetic oligonucleotide
acggcggctcacatcacccagcg

SEQ ID NO: 28462 - DNA, 22 bp, Artificial Sequence
  Description of Artificial Sequence: Synthetic oligonucleotide
cggcggctcacatcacccagcg

SEQ ID NO: 28463 - DNA, 26 bp, Artificial Sequence
  Description of Artificial Sequence: Synthetic oligonucleotide
ctcacatcacccagcgcaagtgggag

SEQ ID NO: 28464 - DNA, 26 bp, Artificial Sequence
  Description of Artificial Sequence: Synthetic oligonucleotide
tcacatcacccagcgcaagtgggagg

SEQ ID NO: 28465 - DNA, 25 bp, Artificial Sequence
  Description of Artificial Sequence: Synthetic oligonucleotide
cacatcacccagcgcaagtgggagg

SEQ ID NO: 28466 - DNA, 25 bp, Artificial Sequence
  Description of Artificial Sequence: Synthetic oligonucleotide
acatcacccagcgcaagtgggaggc

SEQ ID NO: 28467 - DNA, 24 bp, Artificial Sequence
  Description of Artificial Sequence: Synthetic oligonucleotide
catcacccagcgcaagtgggaggc

SEQ ID NO: 28468 - DNA, 37 bp, Artificial Sequence
  Description of Artificial Sequence: Synthetic oligonucleotide
acacagatctacaagaccaacacacagacttaccaag

SEQ ID NO: 28469 - DNA, 36 bp, Artificial Sequence
  Description of Artificial Sequence: Synthetic oligonucleotide
cacagatctacaagaccaacacacagacttaccaag

SEQ ID NO: 28470 - DNA, 37 bp, Artificial Sequence
  Description of Artificial Sequence: Synthetic oligonucleotide
acagatctacaagaccaacacacagacttaccaagag

SEQ ID NO: 28471 - DNA, 36 bp, Artificial Sequence
  Description of Artificial Sequence: Synthetic oligonucleotide
cagatctacaagaccaacacacagacttaccaagag

SEQ ID NO: 28472 - DNA, 37 bp, Artificial Sequence
  Description of Artificial Sequence: Synthetic oligonucleotide
agatctacaagaccaacacacagacttaccaagagag

SEQ ID NO: 28473 - DNA, 36 bp, Artificial Sequence
  Description of Artificial Sequence: Synthetic oligonucleotide
gatctacaagaccaacacacagacttaccaagagag

SEQ ID NO: 28474 - DNA, 36 bp, Artificial Sequence
  Description of Artificial Sequence: Synthetic oligonucleotide
atctacaagaccaacacacagacttaccaagagagc

SEQ ID NO: 28475 - DNA, 35 bp, Artificial Sequence
  Description of Artificial Sequence: Synthetic oligonucleotide
tctacaagaccaacacacagacttaccaagagagc

SEQ ID NO: 28476 - DNA, 34 bp, Artificial Sequence
  Description of Artificial Sequence: Synthetic oligonucleotide
ctacaagaccaacacacagacttaccaagagagc

SEQ ID NO: 28477 - DNA, 34 bp, Artificial Sequence
  Description of Artificial Sequence: Synthetic oligonucleotide
tacaagaccaacacacagacttaccaagagagcc

SEQ ID NO: 28478 - DNA, 33 bp, Artificial Sequence
  Description of Artificial Sequence: Synthetic oligonucleotide
acaagaccaacacacagacttaccaagagagcc

SEQ ID NO: 28479 - DNA, 32 bp, Artificial Sequence
  Description of Artificial Sequence: Synthetic oligonucleotide
caagaccaacacacagacttaccaagagagcc

SEQ ID NO: 28480 - DNA, 33 bp, Artificial Sequence
  Description of Artificial Sequence: Synthetic oligonucleotide
aagaccaacacacagacttaccaagagagcctg

SEQ ID NO: 28481 - DNA, 32 bp, Artificial Sequence
  Description of Artificial Sequence: Synthetic oligonucleotide
agaccaacacacagacttaccaagagagcctg

SEQ ID NO: 28482 - DNA, 31 bp, Artificial Sequence
  Description of Artificial Sequence: Synthetic oligonucleotide
gaccaacacacagacttaccaagagagcctg

SEQ ID NO: 28483 - DNA, 31 bp, Artificial Sequence
  Description of Artificial Sequence: Synthetic oligonucleotide
accaacacacagacttaccaagagagcctgc

SEQ ID NO: 28484 - DNA, 30 bp, Artificial Sequence
  Description of Artificial Sequence: Synthetic oligonucleotide
ccaacacacagacttaccaagagagcctgc

SEQ ID NO: 28485 - DNA, 30 bp, Artificial Sequence
  Description of Artificial Sequence: Synthetic oligonucleotide
caacacacagacttaccaagagagcctgcg

SEQ ID NO: 28486 - DNA, 30 bp, Artificial Sequence
  Description of Artificial Sequence: Synthetic oligonucleotide
aacacacagacttaccaagagagcctgcgg

SEQ ID NO: 28487 - DNA, 29 bp, Artificial Sequence
  Description of Artificial Sequence: Synthetic oligonucleotide
acacacagacttaccaagagagcctgcgg

SEQ ID NO: 28488 - DNA, 28 bp, Artificial Sequence
  Description of Artificial Sequence: Synthetic oligonucleotide
cacacagacttaccaagagagcctgcgg

SEQ ID NO: 28489 - DNA, 30 bp, Artificial Sequence
  Description of Artificial Sequence: Synthetic oligonucleotide
acacagacttaccaagagagcctgcggaac

SEQ ID NO: 28490 - DNA, 29 bp, Artificial Sequence
  Description of Artificial Sequence: Synthetic oligonucleotide
cacagacttaccaagagagcctgcggaac

SEQ ID NO: 28491 - DNA, 29 bp, Artificial Sequence
  Description of Artificial Sequence: Synthetic oligonucleotide
acagacttaccaagagagcctgcggaacc

SEQ ID NO: 28492 - DNA, 28 bp, Artificial Sequence
  Description of Artificial Sequence: Synthetic oligonucleotide
cagacttaccaagagagcctgcggaacc

SEQ ID NO: 28493 - DNA, 29 bp, Artificial Sequence
  Description of Artificial Sequence: Synthetic oligonucleotide
agacttaccaagagagcctgcggaacctg

SEQ ID NO: 28494 - DNA, 28 bp, Artificial Sequence
  Description of Artificial Sequence: Synthetic oligonucleotide
gacttaccaagagagcctgcggaacctg

SEQ ID NO: 28495 - DNA, 28 bp, Artificial Sequence
  Description of Artificial Sequence: Synthetic oligonucleotide
acttaccaagagagcctgcggaacctgc

SEQ ID NO: 28496 - DNA, 27 bp, Artificial Sequence
  Description of Artificial Sequence: Synthetic oligonucleotide
cttaccaagagagcctgcggaacctgc

SEQ ID NO: 28497 - DNA, 27 bp, Artificial Sequence
  Description of Artificial Sequence: Synthetic oligonucleotide
ttaccaagagagcctgcggaacctgcg

SEQ ID NO: 28498 - DNA, 26 bp, Artificial Sequence
  Description of Artificial Sequence: Synthetic oligonucleotide
taccaagagagcctgcggaacctgcg

SEQ ID NO: 28499 - DNA, 25 bp, Artificial Sequence
  Description of Artificial Sequence: Synthetic oligonucleotide
accaagagagcctgcggaacctgcg

SEQ ID NO: 28500 - DNA, 24 bp, Artificial Sequence
  Description of Artificial Sequence: Synthetic oligonucleotide
ccaagagagcctgcggaacctgcg

SEQ ID NO: 28501 - DNA, 24 bp, Artificial Sequence
  Description of Artificial Sequence: Synthetic oligonucleotide
caagagagcctgcggaacctgcgc

SEQ ID NO: 28502 - DNA, 24 bp, Artificial Sequence
  Description of Artificial Sequence: Synthetic oligonucleotide
aagagagcctgcggaacctgcgcg

SEQ ID NO: 28503 - DNA, 27 bp, Artificial Sequence
  Description of Artificial Sequence: Synthetic oligonucleotide
gccggagtattgggaccggaacacaga

SEQ ID NO: 28504 - DNA, 28 bp, Artificial Sequence
  Description of Artificial Sequence: Synthetic oligonucleotide
ccggagtattgggaccggaacacagatc

SEQ ID NO: 28505 - DNA, 30 bp, Artificial Sequence
  Description of Artificial Sequence: Synthetic oligonucleotide
cggagtattgggaccggaacacagatctac

SEQ ID NO: 28506 - DNA, 32 bp, Artificial Sequence
  Description of Artificial Sequence: Synthetic oligonucleotide
ggagtattgggaccggaacacagatctacaag

SEQ ID NO: 28507 - DNA, 33 bp, Artificial Sequence
  Description of Artificial Sequence: Synthetic oligonucleotide
gagtattgggaccggaacacagatctacaagac

SEQ ID NO: 28508 - DNA, 33 bp, Artificial Sequence
  Description of Artificial Sequence: Synthetic oligonucleotide
agtattgggaccggaacacagatctacaagacc

SEQ ID NO: 28509 - DNA, 32 bp, Artificial Sequence
  Description of Artificial Sequence: Synthetic oligonucleotide
gtattgggaccggaacacagatctacaagacc

SEQ ID NO: 28510 - DNA, 34 bp, Artificial Sequence
  Description of Artificial Sequence: Synthetic oligonucleotide
tattgggaccggaacacagatctacaagaccaac

SEQ ID NO: 28511 - DNA, 33 bp, Artificial Sequence
  Description of Artificial Sequence: Synthetic oligonucleotide
attgggaccggaacacagatctacaagaccaac

SEQ ID NO: 28512 - DNA, 32 bp, Artificial Sequence
  Description of Artificial Sequence: Synthetic oligonucleotide
ttgggaccggaacacagatctacaagaccaac

SEQ ID NO: 28513 - DNA, 31 bp, Artificial Sequence
  Description of Artificial Sequence: Synthetic oligonucleotide
tgggaccggaacacagatctacaagaccaac

SEQ ID NO: 28514 - DNA, 30 bp, Artificial Sequence
  Description of Artificial Sequence: Synthetic oligonucleotide
gggaccggaacacagatctacaagaccaac

SEQ ID NO: 28515 - DNA, 31 bp, Artificial Sequence
  Description of Artificial Sequence: Synthetic oligonucleotide
ggaccggaacacagatctacaagaccaacac

SEQ ID NO: 28516 - DNA, 32 bp, Artificial Sequence
  Description of Artificial Sequence: Synthetic oligonucleotide
gaccggaacacagatctacaagaccaacacac

SEQ ID NO: 28517 - DNA, 33 bp, Artificial Sequence
  Description of Artificial Sequence: Synthetic oligonucleotide
accggaacacagatctacaagaccaacacacag

SEQ ID NO: 28518 - DNA, 32 bp, Artificial Sequence
  Description of Artificial Sequence: Synthetic oligonucleotide
ccggaacacagatctacaagaccaacacacag

SEQ ID NO: 28519 - DNA, 33 bp, Artificial Sequence
  Description of Artificial Sequence: Synthetic oligonucleotide
cggaacacagatctacaagaccaacacacagac

SEQ ID NO: 28520 - DNA, 36 bp, Artificial Sequence
  Description of Artificial Sequence: Synthetic oligonucleotide
ggaacacagatctacaagaccaacacacagacttac

SEQ ID NO: 28521 - DNA, 36 bp, Artificial Sequence
  Description of Artificial Sequence: Synthetic oligonucleotide
gaacacagatctacaagaccaacacacagacttacc

SEQ ID NO: 28522 - DNA, 36 bp, Artificial Sequence
  Description of Artificial Sequence: Synthetic oligonucleotide
aacacagatctacaagaccaacacacagacttaccg

SEQ ID NO: 28523 - DNA, 32 bp, Artificial Sequence
  Description of Artificial Sequence: Synthetic oligonucleotide
tattgggaccgggagacacagatctacaagac

SEQ ID NO: 28524 - DNA, 31 bp, Artificial Sequence
  Description of Artificial Sequence: Synthetic oligonucleotide
attgggaccgggagacacagatctacaagac

SEQ ID NO: 28525 - DNA, 30 bp, Artificial Sequence
  Description of Artificial Sequence: Synthetic oligonucleotide
ttgggaccgggagacacagatctacaagac

SEQ ID NO: 28526 - DNA, 29 bp, Artificial Sequence
  Description of Artificial Sequence: Synthetic oligonucleotide
tgggaccgggagacacagatctacaagac

SEQ ID NO: 28527 - DNA, 28 bp, Artificial Sequence
  Description of Artificial Sequence: Synthetic oligonucleotide
gggaccgggagacacagatctacaagac

SEQ ID NO: 28528 - DNA, 28 bp, Artificial Sequence
  Description of Artificial Sequence: Synthetic oligonucleotide
ggaccgggagacacagatctacaagacc

SEQ ID NO: 28529 - DNA, 30 bp, Artificial Sequence
  Description of Artificial Sequence: Synthetic oligonucleotide
gaccgggagacacagatctacaagaccaac

SEQ ID NO: 28530 - DNA, 31 bp, Artificial Sequence
  Description of Artificial Sequence: Synthetic oligonucleotide
accgggagacacagatctacaagaccaacac

SEQ ID NO: 28531 - DNA, 30 bp, Artificial Sequence
  Description of Artificial Sequence: Synthetic oligonucleotide
ccgggagacacagatctacaagaccaacac

SEQ ID NO: 28532 - DNA, 31 bp, Artificial Sequence
  Description of Artificial Sequence: Synthetic oligonucleotide
cgggagacacagatctacaagaccaacacac

SEQ ID NO: 28533 - DNA, 32 bp, Artificial Sequence
  Description of Artificial Sequence: Synthetic oligonucleotide
gggagacacagatctacaagaccaacacacag

SEQ ID NO: 28534 - DNA, 33 bp, Artificial Sequence
  Description of Artificial Sequence: Synthetic oligonucleotide
ggagacacagatctacaagaccaacacacagac

SEQ ID NO: 28535 - DNA, 36 bp, Artificial Sequence
  Description of Artificial Sequence: Synthetic oligonucleotide
gagacacagatctacaagaccaacacacagacttac

SEQ ID NO: 28536 - DNA, 36 bp, Artificial Sequence
  Description of Artificial Sequence: Synthetic oligonucleotide
agacacagatctacaagaccaacacacagacttacc

SEQ ID NO: 28537 - DNA, 35 bp, Artificial Sequence
  Description of Artificial Sequence: Synthetic oligonucleotide
gacacagatctacaagaccaacacacagacttacc

SEQ ID NO: 28538 - DNA, 21 bp, Artificial Sequence
  Description of Artificial Sequence: Synthetic oligonucleotide
tccgaggatggcgccccgggt

SEQ ID NO: 28539 - DNA, 20 bp, Artificial Sequence
  Description of Artificial Sequence: Synthetic oligonucleotide
cgaggatggcgccccgggtg

SEQ ID NO: 28540 - DNA, 20 bp, Artificial Sequence
  Description of Artificial Sequence: Synthetic oligonucleotide
gaggatggcgccccgggtgc

SEQ ID NO: 28541 - DNA, 22 bp, Artificial Sequence
  Description of Artificial Sequence: Synthetic oligonucleotide
aggatggcgccccgggtgccat

SEQ ID NO: 28542 - DNA, 21 bp, Artificial Sequence
  Description of Artificial Sequence: Synthetic oligonucleotide
ggatggcgccccgggtgccat

SEQ ID NO: 28543 - DNA, 21 bp, Artificial Sequence
  Description of Artificial Sequence: Synthetic oligonucleotide
gatggcgccccgggtgccatg

SEQ ID NO: 28544 - DNA, 24 bp, Artificial Sequence
  Description of Artificial Sequence: Synthetic oligonucleotide
atggcgccccgggtgccatggata

SEQ ID NO: 28545 - DNA, 23 bp, Artificial Sequence
  Description of Artificial Sequence: Synthetic oligonucleotide
tggcgccccgggtgccatggata

SEQ ID NO: 28546 - DNA, 22 bp, Artificial Sequence
  Description of Artificial Sequence: Synthetic oligonucleotide
ggcgccccgggtgccatggata

SEQ ID NO: 28547 - DNA, 23 bp, Artificial Sequence
  Description of Artificial Sequence: Synthetic oligonucleotide
gcgccccgggtgccatggataga

SEQ ID NO: 28548 - DNA, 23 bp, Artificial Sequence
  Description of Artificial Sequence: Synthetic oligonucleotide
cgccccgggtgccatggatagag

SEQ ID NO: 28549 - DNA, 24 bp, Artificial Sequence
  Description of Artificial Sequence: Synthetic oligonucleotide
gccccgggtgccatggatagagca

SEQ ID NO: 28550 - DNA, 24 bp, Artificial Sequence
  Description of Artificial Sequence: Synthetic oligonucleotide
ccccgggtgccatggatagagcag

SEQ ID NO: 28551 - DNA, 25 bp, Artificial Sequence
  Description of Artificial Sequence: Synthetic oligonucleotide
cccgggtgccatggatagagcagga

SEQ ID NO: 28552 - DNA, 25 bp, Artificial Sequence
  Description of Artificial Sequence: Synthetic oligonucleotide
ccgggtgccatggatagagcaggag

SEQ ID NO: 28553 - DNA, 25 bp, Artificial Sequence
  Description of Artificial Sequence: Synthetic oligonucleotide
cgggtgccatggatagagcaggagg

SEQ ID NO: 28554 - DNA, 25 bp, Artificial Sequence
  Description of Artificial Sequence: Synthetic oligonucleotide
gggtgccatggatagagcaggaggg

SEQ ID NO: 28555 - DNA, 25 bp, Artificial Sequence
  Description of Artificial Sequence: Synthetic oligonucleotide
ggtgccatggatagagcaggagggg

SEQ ID NO: 28556 - DNA, 25 bp, Artificial Sequence
  Description of Artificial Sequence: Synthetic oligonucleotide
gtgccatggatagagcaggaggggc

SEQ ID NO: 28557 - DNA, 25 bp, Artificial Sequence
  Description of Artificial Sequence: Synthetic oligonucleotide
tgccatggatagagcaggaggggcc

SEQ ID NO: 28558 - DNA, 23 bp, Artificial Sequence
  Description of Artificial Sequence: Synthetic oligonucleotide
agcctgcggaacctgcgcggctt

SEQ ID NO: 28559 - DNA, 22 bp, Artificial Sequence
  Description of Artificial Sequence: Synthetic oligonucleotide
gcctgcggaacctgcgcggctt

SEQ ID NO: 28560 - DNA, 24 bp, Artificial Sequence
  Description of Artificial Sequence: Synthetic oligonucleotide
cctgcggaacctgcgcggcttcta

SEQ ID NO: 28561 - DNA, 26 bp, Artificial Sequence
  Description of Artificial Sequence: Synthetic oligonucleotide
ctgcggaacctgcgcggcttctacaa

SEQ ID NO: 28562 - DNA, 26 bp, Artificial Sequence
  Description of Artificial Sequence: Synthetic oligonucleotide
tgcggaacctgcgcggcttctacaac

SEQ ID NO: 28563 - DNA, 25 bp, Artificial Sequence
  Description of Artificial Sequence: Synthetic oligonucleotide
gcggaacctgcgcggcttctacaac

SEQ ID NO: 28564 - DNA, 26 bp, Artificial Sequence
  Description of Artificial Sequence: Synthetic oligonucleotide
cggaacctgcgcggcttctacaacca

SEQ ID NO: 28565 - DNA, 27 bp, Artificial Sequence
  Description of Artificial Sequence: Synthetic oligonucleotide
ggaacctgcgcggcttctacaaccaga

SEQ ID NO: 28566 - DNA, 27 bp, Artificial Sequence
  Description of Artificial Sequence: Synthetic oligonucleotide
gaacctgcgcggcttctacaaccagag

SEQ ID NO: 28567 - DNA, 27 bp, Artificial Sequence
  Description of Artificial Sequence: Synthetic oligonucleotide
aacctgcgcggcttctacaaccagagc

SEQ ID NO: 28568 - DNA, 26 bp, Artificial Sequence
  Description of Artificial Sequence: Synthetic oligonucleotide
acctgcgcggcttctacaaccagagc

SEQ ID NO: 28569 - DNA, 25 bp, Artificial Sequence
  Description of Artificial Sequence: Synthetic oligonucleotide
cctgcgcggcttctacaaccagagc

SEQ ID NO: 28570 - DNA, 26 bp, Artificial Sequence
  Description of Artificial Sequence: Synthetic oligonucleotide
ctgcgcggcttctacaaccagagcga

SEQ ID NO: 28571 - DNA, 26 bp, Artificial Sequence
  Description of Artificial Sequence: Synthetic oligonucleotide
tgcgcggcttctacaaccagagcgag

SEQ ID NO: 28572 - DNA, 25 bp, Artificial Sequence
  Description of Artificial Sequence: Synthetic oligonucleotide
gcgcggcttctacaaccagagcgag

SEQ ID NO: 28573 - DNA, 25 bp, Artificial Sequence
  Description of Artificial Sequence: Synthetic oligonucleotide
cgcggcttctacaaccagagcgagg

SEQ ID NO: 28574 - DNA, 25 bp, Artificial Sequence
  Description of Artificial Sequence: Synthetic oligonucleotide
gcggcttctacaaccagagcgaggc

SEQ ID NO: 28575 - DNA, 25 bp, Artificial Sequence
  Description of Artificial Sequence: Synthetic oligonucleotide
cggcttctacaaccagagcgaggcc

SEQ ID NO: 28576 - DNA, 25 bp, Artificial Sequence
  Description of Artificial Sequence: Synthetic oligonucleotide
ggcttctacaaccagagcgaggccg

SEQ ID NO: 28577 - DNA, 25 bp, Artificial Sequence
  Description of Artificial Sequence: Synthetic oligonucleotide
gcttctacaaccagagcgaggccgg

SEQ ID NO: 28578 - DNA, 26 bp, Artificial Sequence
  Description of Artificial Sequence: Synthetic oligonucleotide
cttctacaaccagagcgaggccgggt

SEQ ID NO: 28579 - DNA, 27 bp, Artificial Sequence
  Description of Artificial Sequence: Synthetic oligonucleotide
ttctacaaccagagcgaggccgggtct

SEQ ID NO: 28580 - DNA, 26 bp, Artificial Sequence
  Description of Artificial Sequence: Synthetic oligonucleotide
tctacaaccagagcgaggccgggtct

SEQ ID NO: 28581 - DNA, 23 bp, Artificial Sequence
  Description of Artificial Sequence: Synthetic oligonucleotide
gagacctgggccggctcccactt

SEQ ID NO: 28582 - DNA, 25 bp, Artificial Sequence
  Description of Artificial Sequence: Synthetic oligonucleotide
agacctgggccggctcccacttcat

SEQ ID NO: 28583 - DNA, 24 bp, Artificial Sequence
  Description of Artificial Sequence: Synthetic oligonucleotide
gacctgggccggctcccacttcat

SEQ ID NO: 28584 - DNA, 25 bp, Artificial Sequence
  Description of Artificial Sequence: Synthetic oligonucleotide
acctgggccggctcccacttcatga

SEQ ID NO: 28585 - DNA, 24 bp, Artificial Sequence
  Description of Artificial Sequence: Synthetic oligonucleotide
cctgggccggctcccacttcatga

SEQ ID NO: 28586 - DNA, 24 bp, Artificial Sequence
  Description of Artificial Sequence: Synthetic oligonucleotide
ctgggccggctcccacttcatgag

SEQ ID NO: 28587 - DNA, 27 bp, Artificial Sequence
  Description of Artificial Sequence: Synthetic oligonucleotide
tgggccggctcccacttcatgaggtat

SEQ ID NO: 28588 - DNA, 27 bp, Artificial Sequence
  Description of Artificial Sequence: Synthetic oligonucleotide
gggccggctcccacttcatgaggtatt

SEQ ID NO: 28589 - DNA, 28 bp, Artificial Sequence
  Description of Artificial Sequence: Synthetic oligonucleotide
ggccggctcccacttcatgaggtatttc

SEQ ID NO: 28590 - DNA, 30 bp, Artificial Sequence
  Description of Artificial Sequence: Synthetic oligonucleotide
gccggctcccacttcatgaggtatttctac

SEQ ID NO: 28591 - DNA, 31 bp, Artificial Sequence
  Description of Artificial Sequence: Synthetic oligonucleotide
ccggctcccacttcatgaggtatttctacac

SEQ ID NO: 28592 - DNA, 31 bp, Artificial Sequence
  Description of Artificial Sequence: Synthetic oligonucleotide
cggctcccacttcatgaggtatttctacacc

SEQ ID NO: 28593 - DNA, 31 bp, Artificial Sequence
  Description of Artificial Sequence: Synthetic oligonucleotide
ggctcccacttcatgaggtatttctacaccg

SEQ ID NO: 28594 - DNA, 31 bp, Artificial Sequence
  Description of Artificial Sequence: Synthetic oligonucleotide
gctcccacttcatgaggtatttctacaccgc

SEQ ID NO: 28595 - DNA, 31 bp, Artificial Sequence
  Description of Artificial Sequence: Synthetic oligonucleotide
ctcccacttcatgaggtatttctacaccgcc

SEQ ID NO: 28596 - DNA, 33 bp, Artificial Sequence
  Description of Artificial Sequence: Synthetic oligonucleotide
tcccacttcatgaggtatttctacaccgccatg

SEQ ID NO: 28597 - DNA, 32 bp, Artificial Sequence
  Description of Artificial Sequence: Synthetic oligonucleotide
cccacttcatgaggtatttctacaccgccatg

SEQ ID NO: 28598 - DNA, 33 bp, Artificial Sequence
  Description of Artificial Sequence: Synthetic oligonucleotide
ccacttcatgaggtatttctacaccgccatgtc

SEQ ID NO: 28599 - DNA, 33 bp, Artificial Sequence
  Description of Artificial Sequence: Synthetic oligonucleotide
cacttcatgaggtatttctacaccgccatgtcc

SEQ ID NO: 28600 - DNA, 33 bp, Artificial Sequence
  Description of Artificial Sequence: Synthetic oligonucleotide
acttcatgaggtatttctacaccgccatgtccc

SEQ ID NO: 28601 - DNA, 32 bp, Artificial Sequence
  Description of Artificial Sequence: Synthetic oligonucleotide
cttcatgaggtatttctacaccgccatgtccc

SEQ ID NO: 28602 - DNA, 32 bp, Artificial Sequence
  Description of Artificial Sequence: Synthetic oligonucleotide
ttcatgaggtatttctacaccgccatgtcccg

SEQ ID NO: 28603 - DNA, 31 bp, Artificial Sequence
  Description of Artificial Sequence: Synthetic oligonucleotide
tcatgaggtatttctacaccgccatgtcccg

SEQ ID NO: 28604 - DNA, 27 bp, Artificial Sequence
  Description of Artificial Sequence: Synthetic oligonucleotide
gagtattgggaccgggagacacggaac

SEQ ID NO: 28605 - DNA, 29 bp, Artificial Sequence
  Description of Artificial Sequence: Synthetic oligonucleotide
agtattgggaccgggagacacggaacatg

SEQ ID NO: 28606 - DNA, 28 bp, Artificial Sequence
  Description of Artificial Sequence: Synthetic oligonucleotide
gtattgggaccgggagacacggaacatg

SEQ ID NO: 28607 - DNA, 30 bp, Artificial Sequence
  Description of Artificial Sequence: Synthetic oligonucleotide
tattgggaccgggagacacggaacatgaag

SEQ ID NO: 28608 - DNA, 29 bp, Artificial Sequence
  Description of Artificial Sequence: Synthetic oligonucleotide
attgggaccgggagacacggaacatgaag

SEQ ID NO: 28609 - DNA, 28 bp, Artificial Sequence
  Description of Artificial Sequence: Synthetic oligonucleotide
ttgggaccgggagacacggaacatgaag

SEQ ID NO: 28610 - DNA, 27 bp, Artificial Sequence
  Description of Artificial Sequence: Synthetic oligonucleotide
tgggaccgggagacacggaacatgaag

SEQ ID NO: 28611 - DNA, 26 bp, Artificial Sequence
  Description of Artificial Sequence: Synthetic oligonucleotide
gggaccgggagacacggaacatgaag

SEQ ID NO: 28612 - DNA, 26 bp, Artificial Sequence
  Description of Artificial Sequence: Synthetic oligonucleotide
ggaccgggagacacggaacatgaagg

SEQ ID NO: 28613 - DNA, 26 bp, Artificial Sequence
  Description of Artificial Sequence: Synthetic oligonucleotide
gaccgggagacacggaacatgaaggc

SEQ ID NO: 28614 - DNA, 27 bp, Artificial Sequence
  Description of Artificial Sequence: Synthetic oligonucleotide
accgggagacacggaacatgaaggcct

SEQ ID NO: 28615 - DNA, 26 bp, Artificial Sequence
  Description of Artificial Sequence: Synthetic oligonucleotide
ccgggagacacggaacatgaaggcct

SEQ ID NO: 28616 - DNA, 26 bp, Artificial Sequence
  Description of Artificial Sequence: Synthetic oligonucleotide
cgggagacacggaacatgaaggcctc

SEQ ID NO: 28617 - DNA, 26 bp, Artificial Sequence
  Description of Artificial Sequence: Synthetic oligonucleotide
gggagacacggaacatgaaggcctcc

SEQ ID NO: 28618 - DNA, 26 bp, Artificial Sequence
  Description of Artificial Sequence: Synthetic oligonucleotide
ggagacacggaacatgaaggcctccg

SEQ ID NO: 28619 - DNA, 26 bp, Artificial Sequence
  Description of Artificial Sequence: Synthetic oligonucleotide
gagacacggaacatgaaggcctccgc

SEQ ID NO: 28620 - DNA, 26 bp, Artificial Sequence
  Description of Artificial Sequence: Synthetic oligonucleotide
agacacggaacatgaaggcctccgcg

SEQ ID NO: 28621 - DNA, 25 bp, Artificial Sequence
  Description of Artificial Sequence: Synthetic oligonucleotide
gacacggaacatgaaggcctccgcg

SEQ ID NO: 28622 - DNA, 26 bp, Artificial Sequence
  Description of Artificial Sequence: Synthetic oligonucleotide
acacggaacatgaaggcctccgcgca

SEQ ID NO: 28623 - DNA, 25 bp, Artificial Sequence
  Description of Artificial Sequence: Synthetic oligonucleotide
cacggaacatgaaggcctccgcgca

SEQ ID NO: 28624 - DNA, 26 bp, Artificial Sequence
  Description of Artificial Sequence: Synthetic oligonucleotide
acggaacatgaaggcctccgcgcaga

SEQ ID NO: 28625 - DNA, 25 bp, Artificial Sequence
  Description of Artificial Sequence: Synthetic oligonucleotide
cggaacatgaaggcctccgcgcaga

SEQ ID NO: 28626 - DNA, 27 bp, Artificial Sequence
  Description of Artificial Sequence: Synthetic oligonucleotide
ggaacatgaaggcctccgcgcagactt

SEQ ID NO: 28627 - DNA, 28 bp, Artificial Sequence
  Description of Artificial Sequence: Synthetic oligonucleotide
gaacatgaaggcctccgcgcagacttac

SEQ ID NO: 28628 - DNA, 28 bp, Artificial Sequence
  Description of Artificial Sequence: Synthetic oligonucleotide
aacatgaaggcctccgcgcagacttacc

SEQ ID NO: 28629 - DNA, 27 bp, Artificial Sequence
  Description of Artificial Sequence: Synthetic oligonucleotide
acatgaaggcctccgcgcagacttacc

SEQ ID NO: 28630 - DNA, 26 bp, Artificial Sequence
  Description of Artificial Sequence: Synthetic oligonucleotide
catgaaggcctccgcgcagacttacc

SEQ ID NO: 28631 - DNA, 27 bp, Artificial Sequence
  Description of Artificial Sequence: Synthetic oligonucleotide
atgaaggcctccgcgcagacttaccga

SEQ ID NO: 28632 - DNA, 26 bp, Artificial Sequence
  Description of Artificial Sequence: Synthetic oligonucleotide
tgaaggcctccgcgcagacttaccga

SEQ ID NO: 28633 - DNA, 25 bp, Artificial Sequence
  Description of Artificial Sequence: Synthetic oligonucleotide
gaaggcctccgcgcagacttaccga

SEQ ID NO: 28634 - DNA, 26 bp, Artificial Sequence
  Description of Artificial Sequence: Synthetic oligonucleotide
aaggcctccgcgcagacttaccgaga

SEQ ID NO: 28635 - DNA, 25 bp, Artificial Sequence
  Description of Artificial Sequence: Synthetic oligonucleotide
aggcctccgcgcagacttaccgaga

SEQ ID NO: 28636 - DNA, 24 bp, Artificial Sequence
  Description of Artificial Sequence: Synthetic oligonucleotide
ggcctccgcgcagacttaccgaga

SEQ ID NO: 28637 - DNA, 26 bp, Artificial Sequence
  Description of Artificial Sequence: Synthetic oligonucleotide
gcctccgcgcagacttaccgagagaa

SEQ ID NO: 28638 - DNA, 26 bp, Artificial Sequence
  Description of Artificial Sequence: Synthetic oligonucleotide
cctccgcgcagacttaccgagagaac

SEQ ID NO: 28639 - DNA, 27 bp, Artificial Sequence
  Description of Artificial Sequence: Synthetic oligonucleotide
ctccgcgcagacttaccgagagaacct

SEQ ID NO: 28640 - DNA, 27 bp, Artificial Sequence
  Description of Artificial Sequence: Synthetic oligonucleotide
tccgcgcagacttaccgagagaacctg

SEQ ID NO: 28641 - DNA, 26 bp, Artificial Sequence
  Description of Artificial Sequence: Synthetic oligonucleotide
ccgcgcagacttaccgagagaacctg

SEQ ID NO: 28642 - DNA, 26 bp, Artificial Sequence
  Description of Artificial Sequence: Synthetic oligonucleotide
cgcgcagacttaccgagagaacctgc

SEQ ID NO: 28643 - DNA, 26 bp, Artificial Sequence
  Description of Artificial Sequence: Synthetic oligonucleotide
gcgcagacttaccgagagaacctgcg

SEQ ID NO: 28644 - DNA, 27 bp, Artificial Sequence
  Description of Artificial Sequence: Synthetic oligonucleotide
cgcagacttaccgagagaacctgcgga

SEQ ID NO: 28645 - DNA, 28 bp, Artificial Sequence
  Description of Artificial Sequence: Synthetic oligonucleotide
gcagacttaccgagagaacctgcggatc

SEQ ID NO: 28646 - DNA, 25 bp, Artificial Sequence
  Description of Artificial Sequence: Synthetic oligonucleotide
aggccgggtctcacacttggcagag

SEQ ID NO: 28647 - DNA, 24 bp, Artificial Sequence
  Description of Artificial Sequence: Synthetic oligonucleotide
ggccgggtctcacacttggcagag

SEQ ID NO: 28648 - DNA, 26 bp, Artificial Sequence
  Description of Artificial Sequence: Synthetic oligonucleotide
gccgggtctcacacttggcagaggat

SEQ ID NO: 28649 - DNA, 27 bp, Artificial Sequence
  Description of Artificial Sequence: Synthetic oligonucleotide
ccgggtctcacacttggcagaggatgt

SEQ ID NO: 28650 - DNA, 29 bp, Artificial Sequence
  Description of Artificial Sequence: Synthetic oligonucleotide
cgggtctcacacttggcagaggatgtatg

SEQ ID NO: 28651 - DNA, 29 bp, Artificial Sequence
  Description of Artificial Sequence: Synthetic oligonucleotide
gggtctcacacttggcagaggatgtatgg

SEQ ID NO: 28652 - DNA, 29 bp, Artificial Sequence
  Description of Artificial Sequence: Synthetic oligonucleotide
ggtctcacacttggcagaggatgtatggc

SEQ ID NO: 28653 - DNA, 30 bp, Artificial Sequence
  Description of Artificial Sequence: Synthetic oligonucleotide
gtctcacacttggcagaggatgtatggctg

SEQ ID NO: 28654 - DNA, 30 bp, Artificial Sequence
  Description of Artificial Sequence: Synthetic oligonucleotide
tctcacacttggcagaggatgtatggctgc

SEQ ID NO: 28655 - DNA, 29 bp, Artificial Sequence
  Description of Artificial Sequence: Synthetic oligonucleotide
ctcacacttggcagaggatgtatggctgc

SEQ ID NO: 28656 - DNA, 29 bp, Artificial Sequence
  Description of Artificial Sequence: Synthetic oligonucleotide
tcacacttggcagaggatgtatggctgcg

SEQ ID NO: 28657 - DNA, 28 bp, Artificial Sequence
  Description of Artificial Sequence: Synthetic oligonucleotide
cacacttggcagaggatgtatggctgcg

SEQ ID NO: 28658 - DNA, 29 bp, Artificial Sequence
  Description of Artificial Sequence: Synthetic oligonucleotide
acacttggcagaggatgtatggctgcgac

SEQ ID NO: 28659 - DNA, 28 bp, Artificial Sequence
  Description of Artificial Sequence: Synthetic oligonucleotide
cacttggcagaggatgtatggctgcgac

SEQ ID NO: 28660 - DNA, 28 bp, Artificial Sequence
  Description of Artificial Sequence: Synthetic oligonucleotide
acttggcagaggatgtatggctgcgacc

SEQ ID NO: 28661 - DNA, 27 bp, Artificial Sequence
  Description of Artificial Sequence: Synthetic oligonucleotide
cttggcagaggatgtatggctgcgacc

SEQ ID NO: 28662 - DNA, 28 bp, Artificial Sequence
  Description of Artificial Sequence: Synthetic oligonucleotide
ttggcagaggatgtatggctgcgacctg

SEQ ID NO: 28663 - DNA, 27 bp, Artificial Sequence
  Description of Artificial Sequence: Synthetic oligonucleotide
tggcagaggatgtatggctgcgacctg

SEQ ID NO: 28664 - DNA, 26 bp, Artificial Sequence
  Description of Artificial Sequence: Synthetic oligonucleotide
ggcagaggatgtatggctgcgacctg

SEQ ID NO: 28665 - DNA, 26 bp, Artificial Sequence
  Description of Artificial Sequence: Synthetic oligonucleotide
gcagaggatgtatggctgcgacctgg

SEQ ID NO: 28666 - DNA, 25 bp, Artificial Sequence
  Description of Artificial Sequence: Synthetic oligonucleotide
atggatagagcaggaggggccggag

SEQ ID NO: 28667 - DNA, 24 bp, Artificial Sequence
  Description of Artificial Sequence: Synthetic oligonucleotide
tggatagagcaggaggggccggag

SEQ ID NO: 28668 - DNA, 23 bp, Artificial Sequence
  Description of Artificial Sequence: Synthetic oligonucleotide
ggatagagcaggaggggccggag

SEQ ID NO: 28669 - DNA, 26 bp, Artificial Sequence
  Description of Artificial Sequence: Synthetic oligonucleotide
gatagagcaggaggggccggagcatt

SEQ ID NO: 28670 - DNA, 26 bp, Artificial Sequence
  Description of Artificial Sequence: Synthetic oligonucleotide
atagagcaggaggggccggagcattg

SEQ ID NO: 28671 - DNA, 25 bp, Artificial Sequence
  Description of Artificial Sequence: Synthetic oligonucleotide
tagagcaggaggggccggagcattg

SEQ ID NO: 28672 - DNA, 24 bp, Artificial Sequence
  Description of Artificial Sequence: Synthetic oligonucleotide
agagcaggaggggccggagcattg

SEQ ID NO: 28673 - DNA, 23 bp, Artificial Sequence
  Description of Artificial Sequence: Synthetic oligonucleotide
gagcaggaggggccggagcattg

SEQ ID NO: 28674 - DNA, 23 bp, Artificial Sequence
  Description of Artificial Sequence: Synthetic oligonucleotide
agcaggaggggccggagcattgg

SEQ ID NO: 28675 - DNA, 22 bp, Artificial Sequence
  Description of Artificial Sequence: Synthetic oligonucleotide
gcaggaggggccggagcattgg

SEQ ID NO: 28676 - DNA, 23 bp, Artificial Sequence
  Description of Artificial Sequence: Synthetic oligonucleotide
caggaggggccggagcattggga

SEQ ID NO: 28677 - DNA, 23 bp, Artificial Sequence
  Description of Artificial Sequence: Synthetic oligonucleotide
aggaggggccggagcattgggac

SEQ ID NO: 28678 - DNA, 22 bp, Artificial Sequence
  Description of Artificial Sequence: Synthetic oligonucleotide
ggaggggccggagcattgggac

SEQ ID NO: 28679 - DNA, 22 bp, Artificial Sequence
  Description of Artificial Sequence: Synthetic oligonucleotide
gaggggccggagcattgggacc

SEQ ID NO: 28680 - DNA, 22 bp, Artificial Sequence
  Description of Artificial Sequence: Synthetic oligonucleotide
aggggccggagcattgggaccg

SEQ ID NO: 28681 - DNA, 21 bp, Artificial Sequence
  Description of Artificial Sequence: Synthetic oligonucleotide
ggggccggagcattgggaccg

SEQ ID NO: 28682 - DNA, 21 bp, Artificial Sequence
  Description of Artificial Sequence: Synthetic oligonucleotide
gggccggagcattgggaccgg

SEQ ID NO: 28683 - DNA, 22 bp, Artificial Sequence
  Description of Artificial Sequence: Synthetic oligonucleotide
ggccggagcattgggaccggga

SEQ ID NO: 28684 - DNA, 23 bp, Artificial Sequence
  Description of Artificial Sequence: Synthetic oligonucleotide
gccggagcattgggaccgggaga

SEQ ID NO: 28685 - DNA, 24 bp, Artificial Sequence
  Description of Artificial Sequence: Synthetic oligonucleotide
ccggagcattgggaccgggagaca

SEQ ID NO: 28686 - DNA, 25 bp, Artificial Sequence
  Description of Artificial Sequence: Synthetic oligonucleotide
cggagcattgggaccgggagacaca

SEQ ID NO: 28687 - DNA, 27 bp, Artificial Sequence
  Description of Artificial Sequence: Synthetic oligonucleotide
ggagcattgggaccgggagacacagat

SEQ ID NO: 28688 - DNA, 27 bp, Artificial Sequence
  Description of Artificial Sequence: Synthetic oligonucleotide
gagcattgggaccgggagacacagatc

SEQ ID NO: 28689 - DNA, 28 bp, Artificial Sequence
  Description of Artificial Sequence: Synthetic oligonucleotide
agcattgggaccgggagacacagatctc

SEQ ID NO: 28690 - DNA, 27 bp, Artificial Sequence
  Description of Artificial Sequence: Synthetic oligonucleotide
gcattgggaccgggagacacagatctc

SEQ ID NO: 28691 - DNA, 27 bp, Artificial Sequence
  Description of Artificial Sequence: Synthetic oligonucleotide
cattgggaccgggagacacagatctcc

SEQ ID NO: 28692 - DNA, 21 bp, Artificial Sequence
  Description of Artificial Sequence: Synthetic oligonucleotide
cccgtgcggcggagcagctga

SEQ ID NO: 28693 - DNA, 22 bp, Artificial Sequence
  Description of Artificial Sequence: Synthetic oligonucleotide
ccgtgcggcggagcagctgaga

SEQ ID NO: 28694 - DNA, 22 bp, Artificial Sequence
  Description of Artificial Sequence: Synthetic oligonucleotide
cgtgcggcggagcagctgagag

SEQ ID NO: 28695 - DNA, 22 bp, Artificial Sequence
  Description of Artificial Sequence: Synthetic oligonucleotide
gtgcggcggagcagctgagagc

SEQ ID NO: 28696 - DNA, 33 bp, Artificial Sequence
  Description of Artificial Sequence: Synthetic oligonucleotide
acagatctccaagaccaacacacagacttaccc

SEQ ID NO: 28697 - DNA, 32 bp, Artificial Sequence
  Description of Artificial Sequence: Synthetic oligonucleotide
cagatctccaagaccaacacacagacttaccc

SEQ ID NO: 28698 - DNA, 33 bp, Artificial Sequence
  Description of Artificial Sequence: Synthetic oligonucleotide
agatctccaagaccaacacacagacttacccag

SEQ ID NO: 28699 - DNA, 32 bp, Artificial Sequence
  Description of Artificial Sequence: Synthetic oligonucleotide
gatctccaagaccaacacacagacttacccag

SEQ ID NO: 28700 - DNA, 33 bp, Artificial Sequence
  Description of Artificial Sequence: Synthetic oligonucleotide
atctccaagaccaacacacagacttacccagag

SEQ ID NO: 28701 - DNA, 32 bp, Artificial Sequence
  Description of Artificial Sequence: Synthetic oligonucleotide
tctccaagaccaacacacagacttacccagag

SEQ ID NO: 28702 - DNA, 31 bp, Artificial Sequence
  Description of Artificial Sequence: Synthetic oligonucleotide
ctccaagaccaacacacagacttacccagag

SEQ ID NO: 28703 - DNA, 32 bp, Artificial Sequence
  Description of Artificial Sequence: Synthetic oligonucleotide
tccaagaccaacacacagacttacccagagag

SEQ ID NO: 28704 - DNA, 31 bp, Artificial Sequence
  Description of Artificial Sequence: Synthetic oligonucleotide
ccaagaccaacacacagacttacccagagag

SEQ ID NO: 28705 - DNA, 31 bp, Artificial Sequence
  Description of Artificial Sequence: Synthetic oligonucleotide
caagaccaacacacagacttacccagagagc

SEQ ID NO: 28706 - DNA, 31 bp, Artificial Sequence
  Description of Artificial Sequence: Synthetic oligonucleotide
aagaccaacacacagacttacccagagagcc

SEQ ID NO: 28707 - DNA, 30 bp, Artificial Sequence
  Description of Artificial Sequence: Synthetic oligonucleotide
agaccaacacacagacttacccagagagcc

SEQ ID NO: 28708 - DNA, 29 bp, Artificial Sequence
  Description of Artificial Sequence: Synthetic oligonucleotide
gaccaacacacagacttacccagagagcc

SEQ ID NO: 28709 - DNA, 30 bp, Artificial Sequence
  Description of Artificial Sequence: Synthetic oligonucleotide
accaacacacagacttacccagagagcctg

SEQ ID NO: 28710 - DNA, 29 bp, Artificial Sequence
  Description of Artificial Sequence: Synthetic oligonucleotide
ccaacacacagacttacccagagagcctg

SEQ ID NO: 28711 - DNA, 29 bp, Artificial Sequence
  Description of Artificial Sequence: Synthetic oligonucleotide
caacacacagacttacccagagagcctgc

SEQ ID NO: 28712 - DNA, 29 bp, Artificial Sequence
  Description of Artificial Sequence: Synthetic oligonucleotide
aacacacagacttacccagagagcctgcg

SEQ ID NO: 28713 - DNA, 28 bp, Artificial Sequence
  Description of Artificial Sequence: Synthetic oligonucleotide
acacacagacttacccagagagcctgcg

SEQ ID NO: 28714 - DNA, 27 bp, Artificial Sequence
  Description of Artificial Sequence: Synthetic oligonucleotide
cacacagacttacccagagagcctgcg

SEQ ID NO: 28715 - DNA, 27 bp, Artificial Sequence
  Description of Artificial Sequence: Synthetic oligonucleotide
acacagacttacccagagagcctgcgg

SEQ ID NO: 28716 - DNA, 27 bp, Artificial Sequence
  Description of Artificial Sequence: Synthetic oligonucleotide
cacagacttacccagagagcctgcgga

SEQ ID NO: 28717 - DNA, 28 bp, Artificial Sequence
  Description of Artificial Sequence: Synthetic oligonucleotide
acagacttacccagagagcctgcggaac

SEQ ID NO: 28718 - DNA, 27 bp, Artificial Sequence
  Description of Artificial Sequence: Synthetic oligonucleotide
cagacttacccagagagcctgcggaac

SEQ ID NO: 28719 - DNA, 27 bp, Artificial Sequence
  Description of Artificial Sequence: Synthetic oligonucleotide
agacttacccagagagcctgcggaacc

SEQ ID NO: 28720 - DNA, 27 bp, Artificial Sequence
  Description of Artificial Sequence: Synthetic oligonucleotide
gacttacccagagagcctgcggaacct

SEQ ID NO: 28721 - DNA, 27 bp, Artificial Sequence
  Description of Artificial Sequence: Synthetic oligonucleotide
acttacccagagagcctgcggaacctg

SEQ ID NO: 28722 - DNA, 26 bp, Artificial Sequence
  Description of Artificial Sequence: Synthetic oligonucleotide
cttacccagagagcctgcggaacctg

SEQ ID NO: 28723 - DNA, 26 bp, Artificial Sequence
  Description of Artificial Sequence: Synthetic oligonucleotide
ttacccagagagcctgcggaacctgc

SEQ ID NO: 28724 - DNA, 25 bp, Artificial Sequence
  Description of Artificial Sequence: Synthetic oligonucleotide
tacccagagagcctgcggaacctgc

SEQ ID NO: 28725 - DNA, 24 bp, Artificial Sequence
  Description of Artificial Sequence: Synthetic oligonucleotide
acccagagagcctgcggaacctgc

SEQ ID NO: 28726 - DNA, 23 bp, Artificial Sequence
  Description of Artificial Sequence: Synthetic oligonucleotide
cccagagagcctgcggaacctgc

SEQ ID NO: 28727 - DNA, 23 bp, Artificial Sequence
  Description of Artificial Sequence: Synthetic oligonucleotide
ccagagagcctgcggaacctgcg

SEQ ID NO: 28728 - DNA, 23 bp, Artificial Sequence
  Description of Artificial Sequence: Synthetic oligonucleotide
cagagagcctgcggaacctgcgc

SEQ ID NO: 28729 - DNA, 28 bp, Artificial Sequence
  Description of Artificial Sequence: Synthetic oligonucleotide
cgggtctcacaccatccagaggatgtac

SEQ ID NO: 28730 - DNA, 28 bp, Artificial Sequence
  Description of Artificial Sequence: Synthetic oligonucleotide
gggtctcacaccatccagaggatgtacg

SEQ ID NO: 28731 - DNA, 28 bp, Artificial Sequence
  Description of Artificial Sequence: Synthetic oligonucleotide
ggtctcacaccatccagaggatgtacgg

SEQ ID NO: 28732 - DNA, 28 bp, Artificial Sequence
  Description of Artificial Sequence: Synthetic oligonucleotide
gtctcacaccatccagaggatgtacggc

SEQ ID NO: 28733 - DNA, 29 bp, Artificial Sequence
  Description of Artificial Sequence: Synthetic oligonucleotide
tctcacaccatccagaggatgtacggctg

SEQ ID NO: 28734 - DNA, 28 bp, Artificial Sequence
  Description of Artificial Sequence: Synthetic oligonucleotide
ctcacaccatccagaggatgtacggctg

SEQ ID NO: 28735 - DNA, 28 bp, Artificial Sequence
  Description of Artificial Sequence: Synthetic oligonucleotide
tcacaccatccagaggatgtacggctgc

SEQ ID NO: 28736 - DNA, 27 bp, Artificial Sequence
  Description of Artificial Sequence: Synthetic oligonucleotide
cacaccatccagaggatgtacggctgc

SEQ ID NO: 28737 - DNA, 27 bp, Artificial Sequence
  Description of Artificial Sequence: Synthetic oligonucleotide
acaccatccagaggatgtacggctgcg

SEQ ID NO: 28738 - DNA, 27 bp, Artificial Sequence
  Description of Artificial Sequence: Synthetic oligonucleotide
caccatccagaggatgtacggctgcga

SEQ ID NO: 28739 - DNA, 27 bp, Artificial Sequence
  Description of Artificial Sequence: Synthetic oligonucleotide
accatccagaggatgtacggctgcgac

SEQ ID NO: 28740 - DNA, 26 bp, Artificial Sequence
  Description of Artificial Sequence: Synthetic oligonucleotide
ccatccagaggatgtacggctgcgac

SEQ ID NO: 28741 - DNA, 20 bp, Artificial Sequence
  Description of Artificial Sequence: Synthetic oligonucleotide
cgacgtggggccggacggga

SEQ ID NO: 28742 - DNA, 20 bp, Artificial Sequence
  Description of Artificial Sequence: Synthetic oligonucleotide
gacgtggggccggacgggag

SEQ ID NO: 28743 - DNA, 20 bp, Artificial Sequence
  Description of Artificial Sequence: Synthetic oligonucleotide
acgtggggccggacgggagc

SEQ ID NO: 28744 - DNA, 20 bp, Artificial Sequence
  Description of Artificial Sequence: Synthetic oligonucleotide
cgtggggccggacgggagct

SEQ ID NO: 28745 - DNA, 20 bp, Artificial Sequence
  Description of Artificial Sequence: Synthetic oligonucleotide
gtggggccggacgggagcct

SEQ ID NO: 28746 - DNA, 20 bp, Artificial Sequence
  Description of Artificial Sequence: Synthetic oligonucleotide
tggggccggacgggagcctc

SEQ ID NO: 28747 - DNA, 20 bp, Artificial Sequence
  Description of Artificial Sequence: Synthetic oligonucleotide
ggggccggacgggagcctct

SEQ ID NO: 28748 - DNA, 20 bp, Artificial Sequence
  Description of Artificial Sequence: Synthetic oligonucleotide
gggccggacgggagcctcct

SEQ ID NO: 28749 - DNA, 20 bp, Artificial Sequence
  Description of Artificial Sequence: Synthetic oligonucleotide
ggccggacgggagcctcctc

SEQ ID NO: 28750 - DNA, 20 bp, Artificial Sequence
  Description of Artificial Sequence: Synthetic oligonucleotide
gccggacgggagcctcctcc

SEQ ID NO: 28751 - DNA, 20 bp, Artificial Sequence
  Description of Artificial Sequence: Synthetic oligonucleotide
ccggacgggagcctcctccg

SEQ ID NO: 28752 - DNA, 20 bp, Artificial Sequence
  Description of Artificial Sequence: Synthetic oligonucleotide
cggacgggagcctcctccgc

SEQ ID NO: 28753 - DNA, 20 bp, Artificial Sequence
  Description of Artificial Sequence: Synthetic oligonucleotide
ggacgggagcctcctccgcg

SEQ ID NO: 28754 - DNA, 20 bp, Artificial Sequence
  Description of Artificial Sequence: Synthetic oligonucleotide
gacgggagcctcctccgcgg

SEQ ID NO: 28755 - DNA, 20 bp, Artificial Sequence
  Description of Artificial Sequence: Synthetic oligonucleotide
acgggagcctcctccgcggg

SEQ ID NO: 28756 - DNA, 20 bp, Artificial Sequence
  Description of Artificial Sequence: Synthetic oligonucleotide
cgggagcctcctccgcgggt

SEQ ID NO: 28757 - DNA, 21 bp, Artificial Sequence
  Description of Artificial Sequence: Synthetic oligonucleotide
gggagcctcctccgcgggcat

SEQ ID NO: 28758 - DNA, 22 bp, Artificial Sequence
  Description of Artificial Sequence: Synthetic oligonucleotide
ggagcctcctccgcgggcatga

SEQ ID NO: 28759 - DNA, 22 bp, Artificial Sequence
  Description of Artificial Sequence: Synthetic oligonucleotide
gagcctcctccgcgggcatgac

SEQ ID NO: 28760 - DNA, 23 bp, Artificial Sequence
  Description of Artificial Sequence: Synthetic oligonucleotide
agcctcctccgcgggcatgacca

SEQ ID NO: 28761 - DNA, 28 bp, Artificial Sequence
  Description of Artificial Sequence: Synthetic oligonucleotide
cgcctacgacggcaaggattacatcgtc

SEQ ID NO: 28762 - DNA, 28 bp, Artificial Sequence
  Description of Artificial Sequence: Synthetic oligonucleotide
gcctacgacggcaaggattacatcgtcc

SEQ ID NO: 28763 - DNA, 29 bp, Artificial Sequence
  Description of Artificial Sequence: Synthetic oligonucleotide
cctacgacggcaaggattacatcgtcctg

SEQ ID NO: 28764 - DNA, 31 bp, Artificial Sequence
  Description of Artificial Sequence: Synthetic oligonucleotide
ctacgacggcaaggattacatcgtcctgaac

SEQ ID NO: 28765 - DNA, 31 bp, Artificial Sequence
  Description of Artificial Sequence: Synthetic oligonucleotide
tacgacggcaaggattacatcgtcctgaacg

SEQ ID NO: 28766 - DNA, 30 bp, Artificial Sequence
  Description of Artificial Sequence: Synthetic oligonucleotide
acgacggcaaggattacatcgtcctgaacg

SEQ ID NO: 28767 - DNA, 29 bp, Artificial Sequence
  Description of Artificial Sequence: Synthetic oligonucleotide
cgacggcaaggattacatcgtcctgaacg

SEQ ID NO: 28768 - DNA, 30 bp, Artificial Sequence
  Description of Artificial Sequence: Synthetic oligonucleotide
gacggcaaggattacatcgtcctgaacgag

SEQ ID NO: 28769 - DNA, 30 bp, Artificial Sequence
  Description of Artificial Sequence: Synthetic oligonucleotide
acggcaaggattacatcgtcctgaacgagg

SEQ ID NO: 28770 - DNA, 29 bp, Artificial Sequence
  Description of Artificial Sequence: Synthetic oligonucleotide
cggcaaggattacatcgtcctgaacgagg

SEQ ID NO: 28771 - DNA, 30 bp, Artificial Sequence
  Description of Artificial Sequence: Synthetic oligonucleotide
ggcaaggattacatcgtcctgaacgaggac

SEQ ID NO: 28772 - DNA, 30 bp, Artificial Sequence
  Description of Artificial Sequence: Synthetic oligonucleotide
gcaaggattacatcgtcctgaacgaggacc

SEQ ID NO: 28773 - DNA, 31 bp, Artificial Sequence
  Description of Artificial Sequence: Synthetic oligonucleotide
caaggattacatcgtcctgaacgaggacctg

SEQ ID NO: 28774 - DNA, 32 bp, Artificial Sequence
  Description of Artificial Sequence: Synthetic oligonucleotide
aaggattacatcgtcctgaacgaggacctgag

SEQ ID NO: 28775 - DNA, 31 bp, Artificial Sequence
  Description of Artificial Sequence: Synthetic oligonucleotide
aggattacatcgtcctgaacgaggacctgag

SEQ ID NO: 28776 - DNA, 30 bp, Artificial Sequence
  Description of Artificial Sequence: Synthetic oligonucleotide
ggattacatcgtcctgaacgaggacctgag

SEQ ID NO: 28777 - DNA, 30 bp, Artificial Sequence
  Description of Artificial Sequence: Synthetic oligonucleotide
gattacatcgtcctgaacgaggacctgagc

SEQ ID NO: 28778 - DNA, 31 bp, Artificial Sequence
  Description of Artificial Sequence: Synthetic oligonucleotide
attacatcgtcctgaacgaggacctgagctc

SEQ ID NO: 28779 - DNA, 30 bp, Artificial Sequence
  Description of Artificial Sequence: Synthetic oligonucleotide
ttacatcgtcctgaacgaggacctgagctc

SEQ ID NO: 28780 - DNA, 29 bp, Artificial Sequence
  Description of Artificial Sequence: Synthetic oligonucleotide
tacatcgtcctgaacgaggacctgagctc

SEQ ID NO: 28781 - DNA, 28 bp, Artificial Sequence
  Description of Artificial Sequence: Synthetic oligonucleotide
acatcgtcctgaacgaggacctgagctc

SEQ ID NO: 28782 - DNA, 27 bp, Artificial Sequence
  Description of Artificial Sequence: Synthetic oligonucleotide
catcgtcctgaacgaggacctgagctc

SEQ ID NO: 28783 - DNA, 27 bp, Artificial Sequence
  Description of Artificial Sequence: Synthetic oligonucleotide
atcgtcctgaacgaggacctgagctcc

SEQ ID NO: 28784 - DNA, 27 bp, Artificial Sequence
  Description of Artificial Sequence: Synthetic oligonucleotide
tcgtcctgaacgaggacctgagctcct

SEQ ID NO: 28785 - DNA, 26 bp, Artificial Sequence
  Description of Artificial Sequence: Synthetic oligonucleotide
cgtcctgaacgaggacctgagctcct

SEQ ID NO: 28786 - DNA, 26 bp, Artificial Sequence
  Description of Artificial Sequence: Synthetic oligonucleotide
gtcctgaacgaggacctgagctcctg

SEQ ID NO: 28787 - DNA, 27 bp, Artificial Sequence
  Description of Artificial Sequence: Synthetic oligonucleotide
tcctgaacgaggacctgagctcctgga

SEQ ID NO: 28788 - DNA, 20 bp, Artificial Sequence
  Description of Artificial Sequence: Synthetic oligonucleotide
gcggcccgtgaggcggagct

SEQ ID NO: 28789 - DNA, 20 bp, Artificial Sequence
  Description of Artificial Sequence: Synthetic oligonucleotide
cggcccgtgaggcggagcgt

SEQ ID NO: 28790 - DNA, 20 bp, Artificial Sequence
  Description of Artificial Sequence: Synthetic oligonucleotide
ggcccgtgaggcggagcggt

SEQ ID NO: 28791 - DNA, 20 bp, Artificial Sequence
  Description of Artificial Sequence: Synthetic oligonucleotide
gcccgtgaggcggagcggct

SEQ ID NO: 28792 - DNA, 21 bp, Artificial Sequence
  Description of Artificial Sequence: Synthetic oligonucleotide
cccgtgaggcggagcggctga

SEQ ID NO: 28793 - DNA, 22 bp, Artificial Sequence
  Description of Artificial Sequence: Synthetic oligonucleotide
ccgtgaggcggagcggctgaga

SEQ ID NO: 28794 - DNA, 22 bp, Artificial Sequence
  Description of Artificial Sequence: Synthetic oligonucleotide
cgtgaggcggagcggctgagag

SEQ ID NO: 28795 - DNA, 22 bp, Artificial Sequence
  Description of Artificial Sequence: Synthetic oligonucleotide
gtgaggcggagcggctgagagc

SEQ ID NO: 28796 - DNA, 24 bp, Artificial Sequence
  Description of Artificial Sequence: Synthetic oligonucleotide
tgaggcggagcggctgagagccta

SEQ ID NO: 28797 - DNA, 23 bp, Artificial Sequence
  Description of Artificial Sequence: Synthetic oligonucleotide
gaggcggagcggctgagagccta

SEQ ID NO: 28798 - DNA, 23 bp, Artificial Sequence
  Description of Artificial Sequence: Synthetic oligonucleotide
aggcggagcggctgagagcctac

SEQ ID NO: 28799 - DNA, 22 bp, Artificial Sequence
  Description of Artificial Sequence: Synthetic oligonucleotide
ggcggagcggctgagagcctac

SEQ ID NO: 28800 - DNA, 23 bp, Artificial Sequence
  Description of Artificial Sequence: Synthetic oligonucleotide
gcggagcggctgagagcctacct

SEQ ID NO: 28801 - DNA, 23 bp, Artificial Sequence
  Description of Artificial Sequence: Synthetic oligonucleotide
cggagcggctgagagcctacctg

SEQ ID NO: 28802 - DNA, 24 bp, Artificial Sequence
  Description of Artificial Sequence: Synthetic oligonucleotide
ggagcggctgagagcctacctgga

SEQ ID NO: 28803 - DNA, 24 bp, Artificial Sequence
  Description of Artificial Sequence: Synthetic oligonucleotide
gagcggctgagagcctacctggag

SEQ ID NO: 28804 - DNA, 24 bp, Artificial Sequence
  Description of Artificial Sequence: Synthetic oligonucleotide
agcggctgagagcctacctggagg

SEQ ID NO: 28805 - DNA, 23 bp, Artificial Sequence
  Description of Artificial Sequence: Synthetic oligonucleotide
gcggctgagagcctacctggagg

SEQ ID NO: 28806 - DNA, 23 bp, Artificial Sequence
  Description of Artificial Sequence: Synthetic oligonucleotide
cggctgagagcctacctggaggg

SEQ ID NO: 28807 - DNA, 23 bp, Artificial Sequence
  Description of Artificial Sequence: Synthetic oligonucleotide
ggctgagagcctacctggagggc

SEQ ID NO: 28808 - DNA, 30 bp, Artificial Sequence
  Description of Artificial Sequence: Synthetic oligonucleotide
ggcaaggattacatcgccctgaacgagtac

SEQ ID NO: 28809 - DNA, 30 bp, Artificial Sequence
  Description of Artificial Sequence: Synthetic oligonucleotide
gcaaggattacatcgccctgaacgagtacc

SEQ ID NO: 28810 - DNA, 31 bp, Artificial Sequence
  Description of Artificial Sequence: Synthetic oligonucleotide
caaggattacatcgccctgaacgagtacctg

SEQ ID NO: 28811 - DNA, 32 bp, Artificial Sequence
  Description of Artificial Sequence: Synthetic oligonucleotide
aaggattacatcgccctgaacgagtacctgag

SEQ ID NO: 28812 - DNA, 31 bp, Artificial Sequence
  Description of Artificial Sequence: Synthetic oligonucleotide
aggattacatcgccctgaacgagtacctgag

SEQ ID NO: 28813 - DNA, 30 bp, Artificial Sequence
  Description of Artificial Sequence: Synthetic oligonucleotide
ggattacatcgccctgaacgagtacctgag

SEQ ID NO: 28814 - DNA, 30 bp, Artificial Sequence
  Description of Artificial Sequence: Synthetic oligonucleotide
gattacatcgccctgaacgagtacctgagc

SEQ ID NO: 28815 - DNA, 31 bp, Artificial Sequence
  Description of Artificial Sequence: Synthetic oligonucleotide
attacatcgccctgaacgagtacctgagctc

SEQ ID NO: 28816 - DNA, 30 bp, Artificial Sequence
  Description of Artificial Sequence: Synthetic oligonucleotide
ttacatcgccctgaacgagtacctgagctc

SEQ ID NO: 28817 - DNA, 29 bp, Artificial Sequence
  Description of Artificial Sequence: Synthetic oligonucleotide
tacatcgccctgaacgagtacctgagctc

SEQ ID NO: 28818 - DNA, 28 bp, Artificial Sequence
  Description of Artificial Sequence: Synthetic oligonucleotide
acatcgccctgaacgagtacctgagctc

SEQ ID NO: 28819 - DNA, 27 bp, Artificial Sequence
  Description of Artificial Sequence: Synthetic oligonucleotide
catcgccctgaacgagtacctgagctc

SEQ ID NO: 28820 - DNA, 27 bp, Artificial Sequence
  Description of Artificial Sequence: Synthetic oligonucleotide
atcgccctgaacgagtacctgagctcc

SEQ ID NO: 28821 - DNA, 27 bp, Artificial Sequence
  Description of Artificial Sequence: Synthetic oligonucleotide
tcgccctgaacgagtacctgagctcct

SEQ ID NO: 28822 - DNA, 26 bp, Artificial Sequence
  Description of Artificial Sequence: Synthetic oligonucleotide
cgccctgaacgagtacctgagctcct

SEQ ID NO: 28823 - DNA, 26 bp, Artificial Sequence
  Description of Artificial Sequence: Synthetic oligonucleotide
gccctgaacgagtacctgagctcctg

SEQ ID NO: 28824 - DNA, 27 bp, Artificial Sequence
  Description of Artificial Sequence: Synthetic oligonucleotide
ccctgaacgagtacctgagctcctgga

SEQ ID NO: 28825 - DNA, 27 bp, Artificial Sequence
  Description of Artificial Sequence: Synthetic oligonucleotide
cctgaacgagtacctgagctcctggac

SEQ ID NO: 28826 - DNA, 27 bp, Artificial Sequence
  Description of Artificial Sequence: Synthetic oligonucleotide
ctgaacgagtacctgagctcctggacc

SEQ ID NO: 28827 - DNA, 27 bp, Artificial Sequence
  Description of Artificial Sequence: Synthetic oligonucleotide
tgaacgagtacctgagctcctggaccg

SEQ ID NO: 28828 - DNA, 26 bp, Artificial Sequence
  Description of Artificial Sequence: Synthetic oligonucleotide
gaacgagtacctgagctcctggaccg

SEQ ID NO: 28829 - DNA, 26 bp, Artificial Sequence
  Description of Artificial Sequence: Synthetic oligonucleotide
aacgagtacctgagctcctggaccgc

SEQ ID NO: 28830 - DNA, 25 bp, Artificial Sequence
  Description of Artificial Sequence: Synthetic oligonucleotide
acgagtacctgagctcctggaccgc

SEQ ID NO: 28831 - DNA, 24 bp, Artificial Sequence
  Description of Artificial Sequence: Synthetic oligonucleotide
cgagtacctgagctcctggaccgc

SEQ ID NO: 28832 - DNA, 24 bp, Artificial Sequence
  Description of Artificial Sequence: Synthetic oligonucleotide
gagtacctgagctcctggaccgcg

SEQ ID NO: 28833 - DNA, 24 bp, Artificial Sequence
  Description of Artificial Sequence: Synthetic oligonucleotide
agtacctgagctcctggaccgcgg

SEQ ID NO: 28834 - DNA, 23 bp, Artificial Sequence
  Description of Artificial Sequence: Synthetic oligonucleotide
gtacctgagctcctggaccgcgg

SEQ ID NO: 28835 - DNA, 23 bp, Artificial Sequence
  Description of Artificial Sequence: Synthetic oligonucleotide
tacctgagctcctggaccgcggc

SEQ ID NO: 28836 - DNA, 23 bp, Artificial Sequence
  Description of Artificial Sequence: Synthetic oligonucleotide
gacagcgacgccgcgagtccgaa

SEQ ID NO: 28837 - DNA, 25 bp, Artificial Sequence
  Description of Artificial Sequence: Synthetic oligonucleotide
acagcgacgccgcgagtccgaagat

SEQ ID NO: 28838 - DNA, 24 bp, Artificial Sequence
  Description of Artificial Sequence: Synthetic oligonucleotide
cagcgacgccgcgagtccgaagat

SEQ ID NO: 28839 - DNA, 24 bp, Artificial Sequence
  Description of Artificial Sequence: Synthetic oligonucleotide
agcgacgccgcgagtccgaagatg

SEQ ID NO: 28840 - DNA, 23 bp, Artificial Sequence
  Description of Artificial Sequence: Synthetic oligonucleotide
gcgacgccgcgagtccgaagatg

SEQ ID NO: 28841 - DNA, 23 bp, Artificial Sequence
  Description of Artificial Sequence: Synthetic oligonucleotide
cgacgccgcgagtccgaagatgg

SEQ ID NO: 28842 - DNA, 23 bp, Artificial Sequence
  Description of Artificial Sequence: Synthetic oligonucleotide
gacgccgcgagtccgaagatggc

SEQ ID NO: 28843 - DNA, 23 bp, Artificial Sequence
  Description of Artificial Sequence: Synthetic oligonucleotide
acgccgcgagtccgaagatggcg

SEQ ID NO: 28844 - DNA, 22 bp, Artificial Sequence
  Description of Artificial Sequence: Synthetic oligonucleotide
cgccgcgagtccgaagatggcg

SEQ ID NO: 28845 - DNA, 22 bp, Artificial Sequence
  Description of Artificial Sequence: Synthetic oligonucleotide
gccgcgagtccgaagatggcgc

SEQ ID NO: 28846 - DNA, 22 bp, Artificial Sequence
  Description of Artificial Sequence: Synthetic oligonucleotide
ccgcgagtccgaagatggcgcc

SEQ ID NO: 28847 - DNA, 22 bp, Artificial Sequence
  Description of Artificial Sequence: Synthetic oligonucleotide
cgcgagtccgaagatggcgccc

SEQ ID NO: 28848 - DNA, 22 bp, Artificial Sequence
  Description of Artificial Sequence: Synthetic oligonucleotide
gcgagtccgaagatggcgcccc

SEQ ID NO: 28849 - DNA, 22 bp, Artificial Sequence
  Description of Artificial Sequence: Synthetic oligonucleotide
cgagtccgaagatggcgccccg

SEQ ID NO: 28850 - DNA, 22 bp, Artificial Sequence
  Description of Artificial Sequence: Synthetic oligonucleotide
gagtccgaagatggcgccccgg

SEQ ID NO: 28851 - DNA, 22 bp, Artificial Sequence
  Description of Artificial Sequence: Synthetic oligonucleotide
agtccgaagatggcgccccggg

SEQ ID NO: 28852 - DNA, 21 bp, Artificial Sequence
  Description of Artificial Sequence: Synthetic oligonucleotide
gtccgaagatggcgccccggg

SEQ ID NO: 28853 - DNA, 21 bp, Artificial Sequence
  Description of Artificial Sequence: Synthetic oligonucleotide
tccgaagatggcgccccgggc

SEQ ID NO: 28854 - DNA, 20 bp, Artificial Sequence
  Description of Artificial Sequence: Synthetic oligonucleotide
ccgaagatggcgccccgggc

SEQ ID NO: 28855 - DNA, 20 bp, Artificial Sequence
  Description of Artificial Sequence: Synthetic oligonucleotide
cgaagatggcgccccgggcg

SEQ ID NO: 28856 - DNA, 20 bp, Artificial Sequence
  Description of Artificial Sequence: Synthetic oligonucleotide
gaagatggcgccccgggcgc

SEQ ID NO: 28857 - DNA, 22 bp, Artificial Sequence
  Description of Artificial Sequence: Synthetic oligonucleotide
aagatggcgccccgggcgccat

SEQ ID NO: 28858 - DNA, 21 bp, Artificial Sequence
  Description of Artificial Sequence: Synthetic oligonucleotide
agatggcgccccgggcgccat

SEQ ID NO: 28859 - DNA, 27 bp, Artificial Sequence
  Description of Artificial Sequence: Synthetic oligonucleotide
atttctacaccgccatgtcccggccca

SEQ ID NO: 28860 - DNA, 26 bp, Artificial Sequence
  Description of Artificial Sequence: Synthetic oligonucleotide
tttctacaccgccatgtcccggccca

SEQ ID NO: 28861 - DNA, 25 bp, Artificial Sequence
  Description of Artificial Sequence: Synthetic oligonucleotide
ttctacaccgccatgtcccggccca

SEQ ID NO: 28862 - DNA, 24 bp, Artificial Sequence
  Description of Artificial Sequence: Synthetic oligonucleotide
tctacaccgccatgtcccggccca

SEQ ID NO: 28863 - DNA, 23 bp, Artificial Sequence
  Description of Artificial Sequence: Synthetic oligonucleotide
ctacaccgccatgtcccggccca

SEQ ID NO: 28864 - DNA, 23 bp, Artificial Sequence
  Description of Artificial Sequence: Synthetic oligonucleotide
tacaccgccatgtcccggcccag

SEQ ID NO: 28865 - DNA, 22 bp, Artificial Sequence
  Description of Artificial Sequence: Synthetic oligonucleotide
acaccgccatgtcccggcccag

SEQ ID NO: 28866 - DNA, 21 bp, Artificial Sequence
  Description of Artificial Sequence: Synthetic oligonucleotide
caccgccatgtcccggcccag

SEQ ID NO: 28867 - DNA, 21 bp, Artificial Sequence
  Description of Artificial Sequence: Synthetic oligonucleotide
accgccatgtcccggcccagc

SEQ ID NO: 28868 - DNA, 20 bp, Artificial Sequence
  Description of Artificial Sequence: Synthetic oligonucleotide
ccgccatgtcccggcccagc

SEQ ID NO: 28869 - DNA, 20 bp, Artificial Sequence
  Description of Artificial Sequence: Synthetic oligonucleotide
cgccatgtcccggcccagcc

SEQ ID NO: 28870 - DNA, 20 bp, Artificial Sequence
  Description of Artificial Sequence: Synthetic oligonucleotide
gccatgtcccggcccagccg

SEQ ID NO: 28871 - DNA, 20 bp, Artificial Sequence
  Description of Artificial Sequence: Synthetic oligonucleotide
ccatgtcccggcccagccgc

SEQ ID NO: 28872 - DNA, 20 bp, Artificial Sequence
  Description of Artificial Sequence: Synthetic oligonucleotide
catgtcccggcccagccgcg

SEQ ID NO: 28873 - DNA, 20 bp, Artificial Sequence
  Description of Artificial Sequence: Synthetic oligonucleotide
atgtcccggcccagccgcgg

SEQ ID NO: 28874 - DNA, 20 bp, Artificial Sequence
  Description of Artificial Sequence: Synthetic oligonucleotide
tgtcccggcccagccgcggt

SEQ ID NO: 28875 - DNA, 20 bp, Artificial Sequence
  Description of Artificial Sequence: Synthetic oligonucleotide
gtcccggcccagccgcggtt

SEQ ID NO: 28876 - DNA, 20 bp, Artificial Sequence
  Description of Artificial Sequence: Synthetic oligonucleotide
tcccggcccagccgcgggtt

SEQ ID NO: 28877 - DNA, 20 bp, Artificial Sequence
  Description of Artificial Sequence: Synthetic oligonucleotide
cccggcccagccgcgggttt

SEQ ID NO: 28878 - DNA, 20 bp, Artificial Sequence
  Description of Artificial Sequence: Synthetic oligonucleotide
ccggcccagccgcggggatt

SEQ ID NO: 28879 - DNA, 20 bp, Artificial Sequence
  Description of Artificial Sequence: Synthetic oligonucleotide
cggcccagccgcggggagtt

SEQ ID NO: 28880 - DNA, 20 bp, Artificial Sequence
  Description of Artificial Sequence: Synthetic oligonucleotide
ggcccagccgcggggagctt

SEQ ID NO: 28881 - DNA, 20 bp, Artificial Sequence
  Description of Artificial Sequence: Synthetic oligonucleotide
gcccagccgcggggagcctt

SEQ ID NO: 28882 - DNA, 20 bp, Artificial Sequence
  Description of Artificial Sequence: Synthetic oligonucleotide
cccagccgcggggagccctt

SEQ ID NO: 28883 - DNA, 20 bp, Artificial Sequence
  Description of Artificial Sequence: Synthetic oligonucleotide
ccagccgcggggagcccctt

SEQ ID NO: 28884 - DNA, 20 bp, Artificial Sequence
  Description of Artificial Sequence: Synthetic oligonucleotide
cagccgcggggagccccgtt

SEQ ID NO: 28885 - DNA, 20 bp, Artificial Sequence
  Description of Artificial Sequence: Synthetic oligonucleotide
agccgcggggagccccgctt

SEQ ID NO: 28886 - DNA, 23 bp, Artificial Sequence
  Description of Artificial Sequence: Synthetic oligonucleotide
ggcctgtgcgtggagtggctcca

SEQ ID NO: 28887 - DNA, 24 bp, Artificial Sequence
  Description of Artificial Sequence: Synthetic oligonucleotide
gcctgtgcgtggagtggctccaca

SEQ ID NO: 28888 - DNA, 27 bp, Artificial Sequence
  Description of Artificial Sequence: Synthetic oligonucleotide
cctgtgcgtggagtggctccacagata

SEQ ID NO: 28889 - DNA, 27 bp, Artificial Sequence
  Description of Artificial Sequence: Synthetic oligonucleotide
ctgtgcgtggagtggctccacagatac

SEQ ID NO: 28890 - DNA, 27 bp, Artificial Sequence
  Description of Artificial Sequence: Synthetic oligonucleotide
tgtgcgtggagtggctccacagatacc

SEQ ID NO: 28891 - DNA, 26 bp, Artificial Sequence
  Description of Artificial Sequence: Synthetic oligonucleotide
agaacgggaaggagatgctgcagcgc

SEQ ID NO: 28892 - DNA, 25 bp, Artificial Sequence
  Description of Artificial Sequence: Synthetic oligonucleotide
gaacgggaaggagatgctgcagcgc

SEQ ID NO: 28893 - DNA, 25 bp, Artificial Sequence
  Description of Artificial Sequence: Synthetic oligonucleotide
aacgggaaggagatgctgcagcgcg

SEQ ID NO: 28894 - DNA, 24 bp, Artificial Sequence
  Description of Artificial Sequence: Synthetic oligonucleotide
acgggaaggagatgctgcagcgcg

SEQ ID NO: 28895 - DNA, 23 bp, Artificial Sequence
  Description of Artificial Sequence: Synthetic oligonucleotide
cgggaaggagatgctgcagcgcg

SEQ ID NO: 28896 - DNA, 23 bp, Artificial Sequence
  Description of Artificial Sequence: Synthetic oligonucleotide
gggaaggagatgctgcagcgcgc

SEQ ID NO: 28897 - DNA, 23 bp, Artificial Sequence
  Description of Artificial Sequence: Synthetic oligonucleotide
ggaaggagatgctgcagcgcgcg

SEQ ID NO: 28898 - DNA, 23 bp, Artificial Sequence
  Description of Artificial Sequence: Synthetic oligonucleotide
gaaggagatgctgcagcgcgcgg

SEQ ID NO: 28899 - DNA, 23 bp, Artificial Sequence
  Description of Artificial Sequence: Synthetic oligonucleotide
agccccgcttcatcgcagtgggc

SEQ ID NO: 28900 - DNA, 22 bp, Artificial Sequence
  Description of Artificial Sequence: Synthetic oligonucleotide
gccccgcttcatcgcagtgggc

SEQ ID NO: 28901 - DNA, 23 bp, Artificial Sequence
  Description of Artificial Sequence: Synthetic oligonucleotide
ccccgcttcatcgcagtgggcca

SEQ ID NO: 28902 - DNA, 23 bp, Artificial Sequence
  Description of Artificial Sequence: Synthetic oligonucleotide
cccgcttcatcgcagtgggccac

SEQ ID NO: 28903 - DNA, 24 bp, Artificial Sequence
  Description of Artificial Sequence: Synthetic oligonucleotide
ccgcttcatcgcagtgggccacgt

SEQ ID NO: 28904 - DNA, 24 bp, Artificial Sequence
  Description of Artificial Sequence: Synthetic oligonucleotide
cgcttcatcgcagtgggccacgtg

SEQ ID NO: 28905 - DNA, 25 bp, Artificial Sequence
  Description of Artificial Sequence: Synthetic oligonucleotide
gcttcatcgcagtgggccacgtgga

SEQ ID NO: 28906 - DNA, 25 bp, Artificial Sequence
  Description of Artificial Sequence: Synthetic oligonucleotide
cttcatcgcagtgggccacgtggac

SEQ ID NO: 28907 - DNA, 26 bp, Artificial Sequence
  Description of Artificial Sequence: Synthetic oligonucleotide
ttcatcgcagtgggccacgtggacga

SEQ ID NO: 28908 - DNA, 25 bp, Artificial Sequence
  Description of Artificial Sequence: Synthetic oligonucleotide
tcatcgcagtgggccacgtggacga

SEQ ID NO: 28909 - DNA, 24 bp, Artificial Sequence
  Description of Artificial Sequence: Synthetic oligonucleotide
catcgcagtgggccacgtggacga

SEQ ID NO: 28910 - DNA, 25 bp, Artificial Sequence
  Description of Artificial Sequence: Synthetic oligonucleotide
atcgcagtgggccacgtggacgaca

SEQ ID NO: 28911 - DNA, 24 bp, Artificial Sequence
  Description of Artificial Sequence: Synthetic oligonucleotide
tcgcagtgggccacgtggacgaca

SEQ ID NO: 28912 - DNA, 23 bp, Artificial Sequence
  Description of Artificial Sequence: Synthetic oligonucleotide
cgcagtgggccacgtggacgaca

SEQ ID NO: 28913 - DNA, 23 bp, Artificial Sequence
  Description of Artificial Sequence: Synthetic oligonucleotide
gcagtgggccacgtggacgacac

SEQ ID NO: 28914 - DNA, 23 bp, Artificial Sequence
  Description of Artificial Sequence: Synthetic oligonucleotide
cagtgggccacgtggacgacacc

SEQ ID NO: 28915 - DNA, 24 bp, Artificial Sequence
  Description of Artificial Sequence: Synthetic oligonucleotide
agtgggccacgtggacgacaccca

SEQ ID NO: 28916 - DNA, 23 bp, Artificial Sequence
  Description of Artificial Sequence: Synthetic oligonucleotide
gtgggccacgtggacgacaccca

SEQ ID NO: 28917 - DNA, 25 bp, Artificial Sequence
  Description of Artificial Sequence: Synthetic oligonucleotide
tgggccacgtggacgacacccagtt

SEQ ID NO: 28918 - DNA, 24 bp, Artificial Sequence
  Description of Artificial Sequence: Synthetic oligonucleotide
gggccacgtggacgacacccagtt

SEQ ID NO: 28919 - DNA, 24 bp, Artificial Sequence
  Description of Artificial Sequence: Synthetic oligonucleotide
ggccacgtggacgacacccagttc

SEQ ID NO: 28920 - DNA, 25 bp, Artificial Sequence
  Description of Artificial Sequence: Synthetic oligonucleotide
gccacgtggacgacacccagttcgt

SEQ ID NO: 28921 - DNA, 26 bp, Artificial Sequence
  Description of Artificial Sequence: Synthetic oligonucleotide
ccacgtggacgacacccagttcgtga

SEQ ID NO: 28922 - DNA, 26 bp, Artificial Sequence
  Description of Artificial Sequence: Synthetic oligonucleotide
cacgtggacgacacccagttcgtgag

SEQ ID NO: 28923 - DNA, 20 bp, Artificial Sequence
  Description of Artificial Sequence: Synthetic oligonucleotide
cggccggtgaggcggagcag

SEQ ID NO: 28924 - DNA, 21 bp, Artificial Sequence
  Description of Artificial Sequence: Synthetic oligonucleotide
ggccggtgaggcggagcagct

SEQ ID NO: 28925 - DNA, 22 bp, Artificial Sequence
  Description of Artificial Sequence: Synthetic oligonucleotide
gccggtgaggcggagcagctga

SEQ ID NO: 28926 - DNA, 23 bp, Artificial Sequence
  Description of Artificial Sequence: Synthetic oligonucleotide
ccggtgaggcggagcagctgaga

SEQ ID NO: 28927 - DNA, 23 bp, Artificial Sequence
  Description of Artificial Sequence: Synthetic oligonucleotide
cggtgaggcggagcagctgagag

SEQ ID NO: 28928 - DNA, 23 bp, Artificial Sequence
  Description of Artificial Sequence: Synthetic oligonucleotide
ggtgaggcggagcagctgagagc

SEQ ID NO: 28929 - DNA, 25 bp, Artificial Sequence
  Description of Artificial Sequence: Synthetic oligonucleotide
ggctacgtggacgacacccagttcg

SEQ ID NO: 28930 - DNA, 25 bp, Artificial Sequence
  Description of Artificial Sequence: Synthetic oligonucleotide
gctacgtggacgacacccagttcgg

SEQ ID NO: 28931 - DNA, 26 bp, Artificial Sequence
  Description of Artificial Sequence: Synthetic oligonucleotide
ctacgtggacgacacccagttcggga

SEQ ID NO: 28932 - DNA, 26 bp, Artificial Sequence
  Description of Artificial Sequence: Synthetic oligonucleotide
tacgtggacgacacccagttcgggag

SEQ ID NO: 28933 - DNA, 25 bp, Artificial Sequence
  Description of Artificial Sequence: Synthetic oligonucleotide
acgtggacgacacccagttcgggag

SEQ ID NO: 28934 - DNA, 24 bp, Artificial Sequence
  Description of Artificial Sequence: Synthetic oligonucleotide
cgtggacgacacccagttcgggag

SEQ ID NO: 28935 - DNA, 26 bp, Artificial Sequence
  Description of Artificial Sequence: Synthetic oligonucleotide
gtggacgacacccagttcgggaggtt

SEQ ID NO: 28936 - DNA, 26 bp, Artificial Sequence
  Description of Artificial Sequence: Synthetic oligonucleotide
tggacgacacccagttcgggaggttc

SEQ ID NO: 28937 - DNA, 25 bp, Artificial Sequence
  Description of Artificial Sequence: Synthetic oligonucleotide
ggacgacacccagttcgggaggttc

SEQ ID NO: 28938 - DNA, 26 bp, Artificial Sequence
  Description of Artificial Sequence: Synthetic oligonucleotide
gacgacacccagttcgggaggttcga

SEQ ID NO: 28939 - DNA, 27 bp, Artificial Sequence
  Description of Artificial Sequence: Synthetic oligonucleotide
acgacacccagttcgggaggttcgaca

SEQ ID NO: 28940 - DNA, 26 bp, Artificial Sequence
  Description of Artificial Sequence: Synthetic oligonucleotide
cgacacccagttcgggaggttcgaca

SEQ ID NO: 28941 - DNA, 26 bp, Artificial Sequence
  Description of Artificial Sequence: Synthetic oligonucleotide
gacacccagttcgggaggttcgacag

SEQ ID NO: 28942 - DNA, 26 bp, Artificial Sequence
  Description of Artificial Sequence: Synthetic oligonucleotide
acacccagttcgggaggttcgacagc

SEQ ID NO: 28943 - DNA, 25 bp, Artificial Sequence
  Description of Artificial Sequence: Synthetic oligonucleotide
cacccagttcgggaggttcgacagc

SEQ ID NO: 28944 - DNA, 26 bp, Artificial Sequence
  Description of Artificial Sequence: Synthetic oligonucleotide
acccagttcgggaggttcgacagcga

SEQ ID NO: 28945 - DNA, 25 bp, Artificial Sequence
  Description of Artificial Sequence: Synthetic oligonucleotide
cccagttcgggaggttcgacagcga

SEQ ID NO: 28946 - DNA, 25 bp, Artificial Sequence
  Description of Artificial Sequence: Synthetic oligonucleotide
ccagttcgggaggttcgacagcgac

SEQ ID NO: 28947 - DNA, 25 bp, Artificial Sequence
  Description of Artificial Sequence: Synthetic oligonucleotide
cagttcgggaggttcgacagcgacg

SEQ ID NO: 28948 - DNA, 25 bp, Artificial Sequence
  Description of Artificial Sequence: Synthetic oligonucleotide
agttcgggaggttcgacagcgacgc

SEQ ID NO: 28949 - DNA, 24 bp, Artificial Sequence
  Description of Artificial Sequence: Synthetic oligonucleotide
gttcgggaggttcgacagcgacgc

SEQ ID NO: 28950 - DNA, 24 bp, Artificial Sequence
  Description of Artificial Sequence: Synthetic oligonucleotide
ttcgggaggttcgacagcgacgcc

SEQ ID NO: 28951 - DNA, 23 bp, Artificial Sequence
  Description of Artificial Sequence: Synthetic oligonucleotide
tcgggaggttcgacagcgacgcc

SEQ ID NO: 28952 - DNA, 22 bp, Artificial Sequence
  Description of Artificial Sequence: Synthetic oligonucleotide
cgggaggttcgacagcgacgcc

SEQ ID NO: 28953 - DNA, 22 bp, Artificial Sequence
  Description of Artificial Sequence: Synthetic oligonucleotide
gggaggttcgacagcgacgccg

SEQ ID NO: 28954 - DNA, 22 bp, Artificial Sequence
  Description of Artificial Sequence: Synthetic oligonucleotide
ggaggttcgacagcgacgccgc

SEQ ID NO: 28955 - DNA, 22 bp, Artificial Sequence
  Description of Artificial Sequence: Synthetic oligonucleotide
tcctggaccgcggcggacacga

SEQ ID NO: 28956 - DNA, 21 bp, Artificial Sequence
  Description of Artificial Sequence: Synthetic oligonucleotide
cctggaccgcggcggacacga

SEQ ID NO: 28957 - DNA, 21 bp, Artificial Sequence
  Description of Artificial Sequence: Synthetic oligonucleotide
ctggaccgcggcggacacgac

SEQ ID NO: 28958 - DNA, 21 bp, Artificial Sequence
  Description of Artificial Sequence: Synthetic oligonucleotide
tggaccgcggcggacacgacg

SEQ ID NO: 28959 - DNA, 20 bp, Artificial Sequence
  Description of Artificial Sequence: Synthetic oligonucleotide
ggaccgcggcggacacgacg

SEQ ID NO: 28960 - DNA, 20 bp, Artificial Sequence
  Description of Artificial Sequence: Synthetic oligonucleotide
gaccgcggcggacacgacgg

SEQ ID NO: 28961 - DNA, 21 bp, Artificial Sequence
  Description of Artificial Sequence: Synthetic oligonucleotide
accgcggcggacacgacggct

SEQ ID NO: 28962 - DNA, 20 bp, Artificial Sequence
  Description of Artificial Sequence: Synthetic oligonucleotide
ccgcggcggacacgacggct

SEQ ID NO: 28963 - DNA, 21 bp, Artificial Sequence
  Description of Artificial Sequence: Synthetic oligonucleotide
cgcggcggacacgacggctca

SEQ ID NO: 28964 - DNA, 23 bp, Artificial Sequence
  Description of Artificial Sequence: Synthetic oligonucleotide
gcggcggacacgacggctcagat

SEQ ID NO: 28965 - DNA, 24 bp, Artificial Sequence
  Description of Artificial Sequence: Synthetic oligonucleotide
cggcggacacgacggctcagatca

SEQ ID NO: 28966 - DNA, 24 bp, Artificial Sequence
  Description of Artificial Sequence: Synthetic oligonucleotide
ggcggacacgacggctcagatcac

SEQ ID NO: 28967 - DNA, 24 bp, Artificial Sequence
  Description of Artificial Sequence: Synthetic oligonucleotide
gcggacacgacggctcagatcacc

SEQ ID NO: 28968 - DNA, 25 bp, Artificial Sequence
  Description of Artificial Sequence: Synthetic oligonucleotide
cggacacgacggctcagatcaccca

SEQ ID NO: 28969 - DNA, 25 bp, Artificial Sequence
  Description of Artificial Sequence: Synthetic oligonucleotide
ggacacgacggctcagatcacccag

SEQ ID NO: 28970 - DNA, 25 bp, Artificial Sequence
  Description of Artificial Sequence: Synthetic oligonucleotide
gacacgacggctcagatcacccagc

SEQ ID NO: 28971 - DNA, 25 bp, Artificial Sequence
  Description of Artificial Sequence: Synthetic oligonucleotide
acacgacggctcagatcacccagcg

SEQ ID NO: 28972 - DNA, 24 bp, Artificial Sequence
  Description of Artificial Sequence: Synthetic oligonucleotide
cacgacggctcagatcacccagcg

SEQ ID NO: 28973 - DNA, 26 bp, Artificial Sequence
  Description of Artificial Sequence: Synthetic oligonucleotide
acgacggctcagatcacccagcgcaa

SEQ ID NO: 28974 - DNA, 25 bp, Artificial Sequence
  Description of Artificial Sequence: Synthetic oligonucleotide
cgacggctcagatcacccagcgcaa

SEQ ID NO: 28975 - DNA, 26 bp, Artificial Sequence
  Description of Artificial Sequence: Synthetic oligonucleotide
gacggctcagatcacccagcgcaagt

SEQ ID NO: 28976 - DNA, 26 bp, Artificial Sequence
  Description of Artificial Sequence: Synthetic oligonucleotide
acggctcagatcacccagcgcaagtg

SEQ ID NO: 28977 - DNA, 24 bp, Artificial Sequence
  Description of Artificial Sequence: Synthetic oligonucleotide
gcggacacggcggctcagatcact

SEQ ID NO: 28978 - DNA, 25 bp, Artificial Sequence
  Description of Artificial Sequence: Synthetic oligonucleotide
cggacacggcggctcagatcactca

SEQ ID NO: 28979 - DNA, 25 bp, Artificial Sequence
  Description of Artificial Sequence: Synthetic oligonucleotide
ggacacggcggctcagatcactcag

SEQ ID NO: 28980 - DNA, 25 bp, Artificial Sequence
  Description of Artificial Sequence: Synthetic oligonucleotide
gacacggcggctcagatcactcagc

SEQ ID NO: 28981 - DNA, 25 bp, Artificial Sequence
  Description of Artificial Sequence: Synthetic oligonucleotide
acacggcggctcagatcactcagcg

SEQ ID NO: 28982 - DNA, 24 bp, Artificial Sequence
  Description of Artificial Sequence: Synthetic oligonucleotide
cacggcggctcagatcactcagcg

SEQ ID NO: 28983 - DNA, 26 bp, Artificial Sequence
  Description of Artificial Sequence: Synthetic oligonucleotide
acggcggctcagatcactcagcgcaa

SEQ ID NO: 28984 - DNA, 25 bp, Artificial Sequence
  Description of Artificial Sequence: Synthetic oligonucleotide
cggcggctcagatcactcagcgcaa

SEQ ID NO: 28985 - DNA, 26 bp, Artificial Sequence
  Description of Artificial Sequence: Synthetic oligonucleotide
ggcggctcagatcactcagcgcaagt

SEQ ID NO: 28986 - DNA, 25 bp, Artificial Sequence
  Description of Artificial Sequence: Synthetic oligonucleotide
cggacacggcggctcagatcaccta

SEQ ID NO: 28987 - DNA, 25 bp, Artificial Sequence
  Description of Artificial Sequence: Synthetic oligonucleotide
ggacacggcggctcagatcacctag

SEQ ID NO: 28988 - DNA, 25 bp, Artificial Sequence
  Description of Artificial Sequence: Synthetic oligonucleotide
gacacggcggctcagatcacctagc

SEQ ID NO: 28989 - DNA, 25 bp, Artificial Sequence
  Description of Artificial Sequence: Synthetic oligonucleotide
acacggcggctcagatcacctagcg

SEQ ID NO: 28990 - DNA, 24 bp, Artificial Sequence
  Description of Artificial Sequence: Synthetic oligonucleotide
cacggcggctcagatcacctagcg

SEQ ID NO: 28991 - DNA, 26 bp, Artificial Sequence
  Description of Artificial Sequence: Synthetic oligonucleotide
acggcggctcagatcacctagcgcaa

SEQ ID NO: 28992 - DNA, 25 bp, Artificial Sequence
  Description of Artificial Sequence: Synthetic oligonucleotide
cggcggctcagatcacctagcgcaa

SEQ ID NO: 28993 - DNA, 26 bp, Artificial Sequence
  Description of Artificial Sequence: Synthetic oligonucleotide
ggcggctcagatcacctagcgcaagt

SEQ ID NO: 28994 - DNA, 26 bp, Artificial Sequence
  Description of Artificial Sequence: Synthetic oligonucleotide
gcggctcagatcacctagcgcaagtg

SEQ ID NO: 28995 - DNA, 26 bp, Artificial Sequence
  Description of Artificial Sequence: Synthetic oligonucleotide
cggctcagatcacctagcgcaagtgg

SEQ ID NO: 28996 - DNA, 27 bp, Artificial Sequence
  Description of Artificial Sequence: Synthetic oligonucleotide
ggctcagatcacctagcgcaagtggga

SEQ ID NO: 28997 - DNA, 27 bp, Artificial Sequence
  Description of Artificial Sequence: Synthetic oligonucleotide
gctcagatcacctagcgcaagtgggag

SEQ ID NO: 28998 - DNA, 27 bp, Artificial Sequence
  Description of Artificial Sequence: Synthetic oligonucleotide
ctcagatcacctagcgcaagtgggagg

SEQ ID NO: 28999 - DNA, 27 bp, Artificial Sequence
  Description of Artificial Sequence: Synthetic oligonucleotide
tcagatcacctagcgcaagtgggaggc

SEQ ID NO: 29000 - DNA, 26 bp, Artificial Sequence
  Description of Artificial Sequence: Synthetic oligonucleotide
cagatcacctagcgcaagtgggaggc

SEQ ID NO: 29001 - DNA, 26 bp, Artificial Sequence
  Description of Artificial Sequence: Synthetic oligonucleotide
agatcacctagcgcaagtgggaggcg

SEQ ID NO: 29002 - DNA, 25 bp, Artificial Sequence
  Description of Artificial Sequence: Synthetic oligonucleotide
gatcacctagcgcaagtgggaggcg

SEQ ID NO: 29003 - DNA, 25 bp, Artificial Sequence
  Description of Artificial Sequence: Synthetic oligonucleotide
atcacctagcgcaagtgggaggcgg

SEQ ID NO: 29004 - DNA, 24 bp, Artificial Sequence
  Description of Artificial Sequence: Synthetic oligonucleotide
tcacctagcgcaagtgggaggcgg

SEQ ID NO: 29005 - DNA, 23 bp, Artificial Sequence
  Description of Artificial Sequence: Synthetic oligonucleotide
cacctagcgcaagtgggaggcgg

SEQ ID NO: 29006 - DNA, 23 bp, Artificial Sequence
  Description of Artificial Sequence: Synthetic oligonucleotide
acctagcgcaagtgggaggcggc

SEQ ID NO: 29007 - DNA, 22 bp, Artificial Sequence
  Description of Artificial Sequence: Synthetic oligonucleotide
cctagcgcaagtgggaggcggc

SEQ ID NO: 29008 - DNA, 22 bp, Artificial Sequence
  Description of Artificial Sequence: Synthetic oligonucleotide
ctagcgcaagtgggaggcggcc

SEQ ID NO: 29009 - DNA, 22 bp, Artificial Sequence
  Description of Artificial Sequence: Synthetic oligonucleotide
tagcgcaagtgggaggcggccc

SEQ ID NO: 29010 - DNA, 29 bp, Artificial Sequence
  Description of Artificial Sequence: Synthetic oligonucleotide
gctcccactccatgaggtagttctacacc

SEQ ID NO: 29011 - DNA, 29 bp, Artificial Sequence
  Description of Artificial Sequence: Synthetic oligonucleotide
ctcccactccatgaggtagttctacaccg

SEQ ID NO: 29012 - DNA, 29 bp, Artificial Sequence
  Description of Artificial Sequence: Synthetic oligonucleotide
tcccactccatgaggtagttctacaccgc

SEQ ID NO: 29013 - DNA, 28 bp, Artificial Sequence
  Description of Artificial Sequence: Synthetic oligonucleotide
cccactccatgaggtagttctacaccgc

SEQ ID NO: 29014 - DNA, 28 bp, Artificial Sequence
  Description of Artificial Sequence: Synthetic oligonucleotide
ccactccatgaggtagttctacaccgcc

SEQ ID NO: 29015 - DNA, 30 bp, Artificial Sequence
  Description of Artificial Sequence: Synthetic oligonucleotide
cactccatgaggtagttctacaccgccatg

SEQ ID NO: 29016 - DNA, 31 bp, Artificial Sequence
  Description of Artificial Sequence: Synthetic oligonucleotide
actccatgaggtagttctacaccgccatgtc

SEQ ID NO: 29017 - DNA, 30 bp, Artificial Sequence
  Description of Artificial Sequence: Synthetic oligonucleotide
ctccatgaggtagttctacaccgccatgtc

SEQ ID NO: 29018 - DNA, 30 bp, Artificial Sequence
  Description of Artificial Sequence: Synthetic oligonucleotide
tccatgaggtagttctacaccgccatgtcc

SEQ ID NO: 29019 - DNA, 29 bp, Artificial Sequence
  Description of Artificial Sequence: Synthetic oligonucleotide
ccatgaggtagttctacaccgccatgtcc

SEQ ID NO: 29020 - DNA, 29 bp, Artificial Sequence
  Description of Artificial Sequence: Synthetic oligonucleotide
catgaggtagttctacaccgccatgtccc

SEQ ID NO: 29021 - DNA, 29 bp, Artificial Sequence
  Description of Artificial Sequence: Synthetic oligonucleotide
atgaggtagttctacaccgccatgtcccg

SEQ ID NO: 29022 - DNA, 28 bp, Artificial Sequence
  Description of Artificial Sequence: Synthetic oligonucleotide
tgaggtagttctacaccgccatgtcccg

SEQ ID NO: 29023 - DNA, 27 bp, Artificial Sequence
  Description of Artificial Sequence: Synthetic oligonucleotide
gaggtagttctacaccgccatgtcccg

SEQ ID NO: 29024 - DNA, 27 bp, Artificial Sequence
  Description of Artificial Sequence: Synthetic oligonucleotide
aggtagttctacaccgccatgtcccgg

SEQ ID NO: 29025 - DNA, 26 bp, Artificial Sequence
  Description of Artificial Sequence: Synthetic oligonucleotide
ggtagttctacaccgccatgtcccgg

SEQ ID NO: 29026 - DNA, 26 bp, Artificial Sequence
  Description of Artificial Sequence: Synthetic oligonucleotide
gtagttctacaccgccatgtcccggc

SEQ ID NO: 29027 - DNA, 26 bp, Artificial Sequence
  Description of Artificial Sequence: Synthetic oligonucleotide
tagttctacaccgccatgtcccggcc

SEQ ID NO: 29028 - DNA, 25 bp, Artificial Sequence
  Description of Artificial Sequence: Synthetic oligonucleotide
agttctacaccgccatgtcccggcc

SEQ ID NO: 29029 - DNA, 24 bp, Artificial Sequence
  Description of Artificial Sequence: Synthetic oligonucleotide
gttctacaccgccatgtcccggcc

SEQ ID NO: 29030 - DNA, 24 bp, Artificial Sequence
  Description of Artificial Sequence: Synthetic oligonucleotide
ccgggtctcacaccctccagagga

SEQ ID NO: 29031 - DNA, 24 bp, Artificial Sequence
  Description of Artificial Sequence: Synthetic oligonucleotide
cgggtctcacaccctccagaggac

SEQ ID NO: 29032 - DNA, 26 bp, Artificial Sequence
  Description of Artificial Sequence: Synthetic oligonucleotide
gggtctcacaccctccagaggacgta

SEQ ID NO: 29033 - DNA, 26 bp, Artificial Sequence
  Description of Artificial Sequence: Synthetic oligonucleotide
ggtctcacaccctccagaggacgtac

SEQ ID NO: 29034 - DNA, 26 bp, Artificial Sequence
  Description of Artificial Sequence: Synthetic oligonucleotide
gtctcacaccctccagaggacgtacg

SEQ ID NO: 29035 - DNA, 26 bp, Artificial Sequence
  Description of Artificial Sequence: Synthetic oligonucleotide
tctcacaccctccagaggacgtacgg

SEQ ID NO: 29036 - DNA, 25 bp, Artificial Sequence
  Description of Artificial Sequence: Synthetic oligonucleotide
ctcacaccctccagaggacgtacgg

SEQ ID NO: 29037 - DNA, 26 bp, Artificial Sequence
  Description of Artificial Sequence: Synthetic oligonucleotide
tcacaccctccagaggacgtacggct

SEQ ID NO: 29038 - DNA, 25 bp, Artificial Sequence
  Description of Artificial Sequence: Synthetic oligonucleotide
cacaccctccagaggacgtacggct

SEQ ID NO: 29039 - DNA, 25 bp, Artificial Sequence
  Description of Artificial Sequence: Synthetic oligonucleotide
acaccctccagaggacgtacggctg

SEQ ID NO: 29040 - DNA, 24 bp, Artificial Sequence
  Description of Artificial Sequence: Synthetic oligonucleotide
caccctccagaggacgtacggctg

SEQ ID NO: 29041 - DNA, 24 bp, Artificial Sequence
  Description of Artificial Sequence: Synthetic oligonucleotide
accctccagaggacgtacggctgc

SEQ ID NO: 29042 - DNA, 23 bp, Artificial Sequence
  Description of Artificial Sequence: Synthetic oligonucleotide
ccctccagaggacgtacggctgc

SEQ ID NO: 29043 - DNA, 24 bp, Artificial Sequence
  Description of Artificial Sequence: Synthetic oligonucleotide
cctccagaggacgtacggctgcga

SEQ ID NO: 29044 - DNA, 24 bp, Artificial Sequence
  Description of Artificial Sequence: Synthetic oligonucleotide
ctccagaggacgtacggctgcgac

SEQ ID NO: 29045 - DNA, 25 bp, Artificial Sequence
  Description of Artificial Sequence: Synthetic oligonucleotide
tccagaggacgtacggctgcgacgt

SEQ ID NO: 29046 - DNA, 24 bp, Artificial Sequence
  Description of Artificial Sequence: Synthetic oligonucleotide
ccagaggacgtacggctgcgacgt

SEQ ID NO: 29047 - DNA, 24 bp, Artificial Sequence
  Description of Artificial Sequence: Synthetic oligonucleotide
cagaggacgtacggctgcgacgtg

SEQ ID NO: 29048 - DNA, 24 bp, Artificial Sequence
  Description of Artificial Sequence: Synthetic oligonucleotide
agaggacgtacggctgcgacgtgg

SEQ ID NO: 29049 - DNA, 23 bp, Artificial Sequence
  Description of Artificial Sequence: Synthetic oligonucleotide
gaggacgtacggctgcgacgtgg

SEQ ID NO: 29050 - DNA, 23 bp, Artificial Sequence
  Description of Artificial Sequence: Synthetic oligonucleotide
aggacgtacggctgcgacgtggg

SEQ ID NO: 29051 - DNA, 22 bp, Artificial Sequence
  Description of Artificial Sequence: Synthetic oligonucleotide
ggacgtacggctgcgacgtggg

SEQ ID NO: 29052 - DNA, 22 bp, Artificial Sequence
  Description of Artificial Sequence: Synthetic oligonucleotide
gacgtacggctgcgacgtgggg

SEQ ID NO: 29053 - DNA, 22 bp, Artificial Sequence
  Description of Artificial Sequence: Synthetic oligonucleotide
acgtacggctgcgacgtggggc

SEQ ID NO: 29054 - DNA, 21 bp, Artificial Sequence
  Description of Artificial Sequence: Synthetic oligonucleotide
cgtacggctgcgacgtggggc

SEQ ID NO: 29055 - DNA, 24 bp, Artificial Sequence
  Description of Artificial Sequence: Synthetic oligonucleotide
ctgtgcgtggagtggctccgcaga

SEQ ID NO: 29056 - DNA, 25 bp, Artificial Sequence
  Description of Artificial Sequence: Synthetic oligonucleotide
tgtgcgtggagtggctccgcagaca

SEQ ID NO: 29057 - DNA, 20 bp, Artificial Sequence
  Description of Artificial Sequence: Synthetic oligonucleotide
cggcccggccgcgggcattt

SEQ ID NO: 29058 - DNA, 20 bp, Artificial Sequence
  Description of Artificial Sequence: Synthetic oligonucleotide
ggcccggccgcgggcagttt

SEQ ID NO: 29059 - DNA, 20 bp, Artificial Sequence
  Description of Artificial Sequence: Synthetic oligonucleotide
gcccggccgcgggcagcttt

SEQ ID NO: 29060 - DNA, 20 bp, Artificial Sequence
  Description of Artificial Sequence: Synthetic oligonucleotide
cccggccgcgggcagccttt

SEQ ID NO: 29061 - DNA, 20 bp, Artificial Sequence
  Description of Artificial Sequence: Synthetic oligonucleotide
ccggccgcgggcagcccttt

SEQ ID NO: 29062 - DNA, 20 bp, Artificial Sequence
  Description of Artificial Sequence: Synthetic oligonucleotide
cggccgcgggcagccccttt

SEQ ID NO: 29063 - DNA, 20 bp, Artificial Sequence
  Description of Artificial Sequence: Synthetic oligonucleotide
ggccgcgggcagccccgttt

SEQ ID NO: 29064 - DNA, 20 bp, Artificial Sequence
  Description of Artificial Sequence: Synthetic oligonucleotide
gccgcgggcagccccgcttt

SEQ ID NO: 29065 - DNA, 21 bp, Artificial Sequence
  Description of Artificial Sequence: Synthetic oligonucleotide
ccgcgggcagccccgcttcat

SEQ ID NO: 29066 - DNA, 21 bp, Artificial Sequence
  Description of Artificial Sequence: Synthetic oligonucleotide
cgcgggcagccccgcttcatc

SEQ ID NO: 29067 - DNA, 21 bp, Artificial Sequence
  Description of Artificial Sequence: Synthetic oligonucleotide
gcgggcagccccgcttcatcg

SEQ ID NO: 29068 - DNA, 22 bp, Artificial Sequence
  Description of Artificial Sequence: Synthetic oligonucleotide
cgggcagccccgcttcatcgca

SEQ ID NO: 29069 - DNA, 23 bp, Artificial Sequence
  Description of Artificial Sequence: Synthetic oligonucleotide
gggcagccccgcttcatcgcagt

SEQ ID NO: 29070 - DNA, 23 bp, Artificial Sequence
  Description of Artificial Sequence: Synthetic oligonucleotide
ggcagccccgcttcatcgcagtg

SEQ ID NO: 29071 - DNA, 23 bp, Artificial Sequence
  Description of Artificial Sequence: Synthetic oligonucleotide
gcagccccgcttcatcgcagtgg

SEQ ID NO: 29072 - DNA, 23 bp, Artificial Sequence
  Description of Artificial Sequence: Synthetic oligonucleotide
cagccccgcttcatcgcagtggg

SEQ ID NO: 29073 - DNA, 27 bp, Artificial Sequence
  Description of Artificial Sequence: Synthetic oligonucleotide
catggatagagcaggaggggccggaat

SEQ ID NO: 29074 - DNA, 30 bp, Artificial Sequence
  Description of Artificial Sequence: Synthetic oligonucleotide
atggatagagcaggaggggccggaatattg

SEQ ID NO: 29075 - DNA, 24 bp, Artificial Sequence
  Description of Artificial Sequence: Synthetic oligonucleotide
ctcctccgcgggcatgaccagtca

SEQ ID NO: 29076 - DNA, 24 bp, Artificial Sequence
  Description of Artificial Sequence: Synthetic oligonucleotide
tcctccgcgggcatgaccagtcag

SEQ ID NO: 29077 - DNA, 23 bp, Artificial Sequence
  Description of Artificial Sequence: Synthetic oligonucleotide
cctccgcgggcatgaccagtcag

SEQ ID NO: 29078 - DNA, 23 bp, Artificial Sequence
  Description of Artificial Sequence: Synthetic oligonucleotide
ctccgcgggcatgaccagtcagc

SEQ ID NO: 29079 - DNA, 25 bp, Artificial Sequence
  Description of Artificial Sequence: Synthetic oligonucleotide
tccgcgggcatgaccagtcagccta

SEQ ID NO: 29080 - DNA, 24 bp, Artificial Sequence
  Description of Artificial Sequence: Synthetic oligonucleotide
ccgcgggcatgaccagtcagccta

SEQ ID NO: 29081 - DNA, 24 bp, Artificial Sequence
  Description of Artificial Sequence: Synthetic oligonucleotide
cgcgggcatgaccagtcagcctac

SEQ ID NO: 29082 - DNA, 25 bp, Artificial Sequence
  Description of Artificial Sequence: Synthetic oligonucleotide
gcgggcatgaccagtcagcctacga

SEQ ID NO: 29083 - DNA, 25 bp, Artificial Sequence
  Description of Artificial Sequence: Synthetic oligonucleotide
cgggcatgaccagtcagcctacgac

SEQ ID NO: 29084 - DNA, 25 bp, Artificial Sequence
  Description of Artificial Sequence: Synthetic oligonucleotide
gggcatgaccagtcagcctacgacg

SEQ ID NO: 29085 - DNA, 25 bp, Artificial Sequence
  Description of Artificial Sequence: Synthetic oligonucleotide
ggcatgaccagtcagcctacgacgg

SEQ ID NO: 29086 - DNA, 27 bp, Artificial Sequence
  Description of Artificial Sequence: Synthetic oligonucleotide
gcatgaccagtcagcctacgacggcaa

SEQ ID NO: 29087 - DNA, 27 bp, Artificial Sequence
  Description of Artificial Sequence: Synthetic oligonucleotide
catgaccagtcagcctacgacggcaag

SEQ ID NO: 29088 - DNA, 27 bp, Artificial Sequence
  Description of Artificial Sequence: Synthetic oligonucleotide
atgaccagtcagcctacgacggcaagg

SEQ ID NO: 29089 - DNA, 27 bp, Artificial Sequence
  Description of Artificial Sequence: Synthetic oligonucleotide
tgaccagtcagcctacgacggcaagga

SEQ ID NO: 29090 - DNA, 27 bp, Artificial Sequence
  Description of Artificial Sequence: Synthetic oligonucleotide
gaccagtcagcctacgacggcaaggat

SEQ ID NO: 29091 - DNA, 29 bp, Artificial Sequence
  Description of Artificial Sequence: Synthetic oligonucleotide
accagtcagcctacgacggcaaggattac

SEQ ID NO: 29092 - DNA, 28 bp, Artificial Sequence
  Description of Artificial Sequence: Synthetic oligonucleotide
ccagtcagcctacgacggcaaggattac

SEQ ID NO: 29093 - DNA, 30 bp, Artificial Sequence
  Description of Artificial Sequence: Synthetic oligonucleotide
cagtcagcctacgacggcaaggattacatc

SEQ ID NO: 29094 - DNA, 30 bp, Artificial Sequence
  Description of Artificial Sequence: Synthetic oligonucleotide
agtcagcctacgacggcaaggattacatcg

SEQ ID NO: 29095 - DNA, 29 bp, Artificial Sequence
  Description of Artificial Sequence: Synthetic oligonucleotide
gtcagcctacgacggcaaggattacatcg

SEQ ID NO: 29096 - DNA, 29 bp, Artificial Sequence
  Description of Artificial Sequence: Synthetic oligonucleotide
tcagcctacgacggcaaggattacatcgc

SEQ ID NO: 29097 - DNA, 28 bp, Artificial Sequence
  Description of Artificial Sequence: Synthetic oligonucleotide
cagcctacgacggcaaggattacatcgc

SEQ ID NO: 29098 - DNA, 23 bp, Artificial Sequence
  Description of Artificial Sequence: Synthetic oligonucleotide
gcggcggacacggcagctcagat

SEQ ID NO: 29099 - DNA, 24 bp, Artificial Sequence
  Description of Artificial Sequence: Synthetic oligonucleotide
cggcggacacggcagctcagatca

SEQ ID NO: 29100 - DNA, 24 bp, Artificial Sequence
  Description of Artificial Sequence: Synthetic oligonucleotide
ggcggacacggcagctcagatcac

SEQ ID NO: 29101 - DNA, 24 bp, Artificial Sequence
  Description of Artificial Sequence: Synthetic oligonucleotide
gcggacacggcagctcagatcacc

SEQ ID NO: 29102 - DNA, 25 bp, Artificial Sequence
  Description of Artificial Sequence: Synthetic oligonucleotide
cggacacggcagctcagatcaccca

SEQ ID NO: 29103 - DNA, 25 bp, Artificial Sequence
  Description of Artificial Sequence: Synthetic oligonucleotide
ggacacggcagctcagatcacccag

SEQ ID NO: 29104 - DNA, 25 bp, Artificial Sequence
  Description of Artificial Sequence: Synthetic oligonucleotide
gacacggcagctcagatcacccagc

SEQ ID NO: 29105 - DNA, 25 bp, Artificial Sequence
  Description of Artificial Sequence: Synthetic oligonucleotide
acacggcagctcagatcacccagcg

SEQ ID NO: 29106 - DNA, 24 bp, Artificial Sequence
  Description of Artificial Sequence: Synthetic oligonucleotide
cacggcagctcagatcacccagcg

SEQ ID NO: 29107 - DNA, 26 bp, Artificial Sequence
  Description of Artificial Sequence: Synthetic oligonucleotide
acggcagctcagatcacccagcgcaa

SEQ ID NO: 29108 - DNA, 25 bp, Artificial Sequence
  Description of Artificial Sequence: Synthetic oligonucleotide
cggcagctcagatcacccagcgcaa

SEQ ID NO: 29109 - DNA, 27 bp, Artificial Sequence
  Description of Artificial Sequence: Synthetic oligonucleotide
cagaagtgggcagctgtggtggtgctt

SEQ ID NO: 29110 - DNA, 28 bp, Artificial Sequence
  Description of Artificial Sequence: Synthetic oligonucleotide
agaagtgggcagctgtggtggtgctttc

SEQ ID NO: 29111 - DNA, 27 bp, Artificial Sequence
  Description of Artificial Sequence: Synthetic oligonucleotide
gaagtgggcagctgtggtggtgctttc

SEQ ID NO: 29112 - DNA, 28 bp, Artificial Sequence
  Description of Artificial Sequence: Synthetic oligonucleotide
aagtgggcagctgtggtggtgctttctg

SEQ ID NO: 29113 - DNA, 27 bp, Artificial Sequence
  Description of Artificial Sequence: Synthetic oligonucleotide
agtgggcagctgtggtggtgctttctg

SEQ ID NO: 29114 - DNA, 26 bp, Artificial Sequence
  Description of Artificial Sequence: Synthetic oligonucleotide
gtgggcagctgtggtggtgctttctg

SEQ ID NO: 29115 - DNA, 27 bp, Artificial Sequence
  Description of Artificial Sequence: Synthetic oligonucleotide
tgggcagctgtggtggtgctttctgga

SEQ ID NO: 29116 - DNA, 26 bp, Artificial Sequence
  Description of Artificial Sequence: Synthetic oligonucleotide
gggcagctgtggtggtgctttctgga

SEQ ID NO: 29117 - DNA, 27 bp, Artificial Sequence
  Description of Artificial Sequence: Synthetic oligonucleotide
ggcagctgtggtggtgctttctggaga

SEQ ID NO: 29118 - DNA, 28 bp, Artificial Sequence
  Description of Artificial Sequence: Synthetic oligonucleotide
gcagctgtggtggtgctttctggagaag

SEQ ID NO: 29119 - DNA, 29 bp, Artificial Sequence
  Description of Artificial Sequence: Synthetic oligonucleotide
cagctgtggtggtgctttctggagaagag

SEQ ID NO: 29120 - DNA, 29 bp, Artificial Sequence
  Description of Artificial Sequence: Synthetic oligonucleotide
agctgtggtggtgctttctggagaagagc

SEQ ID NO: 29121 - DNA, 28 bp, Artificial Sequence
  Description of Artificial Sequence: Synthetic oligonucleotide
gctgtggtggtgctttctggagaagagc

SEQ ID NO: 29122 - DNA, 29 bp, Artificial Sequence
  Description of Artificial Sequence: Synthetic oligonucleotide
ctgtggtggtgctttctggagaagagcag

SEQ ID NO: 29123 - DNA, 30 bp, Artificial Sequence
  Description of Artificial Sequence: Synthetic oligonucleotide
tgtggtggtgctttctggagaagagcagag

SEQ ID NO: 29124 - DNA, 29 bp, Artificial Sequence
  Description of Artificial Sequence: Synthetic oligonucleotide
gtggtggtgctttctggagaagagcagag

SEQ ID NO: 29125 - DNA, 32 bp, Artificial Sequence
  Description of Artificial Sequence: Synthetic oligonucleotide
tggtggtgctttctggagaagagcagagatac

SEQ ID NO: 29126 - DNA, 31 bp, Artificial Sequence
  Description of Artificial Sequence: Synthetic oligonucleotide
ggtggtgctttctggagaagagcagagatac

SEQ ID NO: 29127 - DNA, 32 bp, Artificial Sequence
  Description of Artificial Sequence: Synthetic oligonucleotide
gtggtgctttctggagaagagcagagatacac

SEQ ID NO: 29128 - DNA, 34 bp, Artificial Sequence
  Description of Artificial Sequence: Synthetic oligonucleotide
tggtgctttctggagaagagcagagatacacatg

SEQ ID NO: 29129 - DNA, 33 bp, Artificial Sequence
  Description of Artificial Sequence: Synthetic oligonucleotide
ggtgctttctggagaagagcagagatacacatg

SEQ ID NO: 29130 - DNA, 33 bp, Artificial Sequence
  Description of Artificial Sequence: Synthetic oligonucleotide
gtgctttctggagaagagcagagatacacatgc

SEQ ID NO: 29131 - DNA, 33 bp, Artificial Sequence
  Description of Artificial Sequence: Synthetic oligonucleotide
tgctttctggagaagagcagagatacacatgcc

SEQ ID NO: 29132 - DNA, 32 bp, Artificial Sequence
  Description of Artificial Sequence: Synthetic oligonucleotide
gctttctggagaagagcagagatacacatgcc

SEQ ID NO: 29133 - DNA, 34 bp, Artificial Sequence
  Description of Artificial Sequence: Synthetic oligonucleotide
ctttctggagaagagcagagatacacatgccatg

SEQ ID NO: 29134 - DNA, 36 bp, Artificial Sequence
  Description of Artificial Sequence: Synthetic oligonucleotide
tttctggagaagagcagagatacacatgccatgtac

SEQ ID NO: 29135 - DNA, 26 bp, Artificial Sequence
  Description of Artificial Sequence: Synthetic oligonucleotide
cggctcagatcacccagcgcaagtga

SEQ ID NO: 29136 - DNA, 27 bp, Artificial Sequence
  Description of Artificial Sequence: Synthetic oligonucleotide
ggctcagatcacccagcgcaagtgaga

SEQ ID NO: 29137 - DNA, 27 bp, Artificial Sequence
  Description of Artificial Sequence: Synthetic oligonucleotide
gctcagatcacccagcgcaagtgagag

SEQ ID NO: 29138 - DNA, 27 bp, Artificial Sequence
  Description of Artificial Sequence: Synthetic oligonucleotide
ctcagatcacccagcgcaagtgagagg

SEQ ID NO: 29139 - DNA, 27 bp, Artificial Sequence
  Description of Artificial Sequence: Synthetic oligonucleotide
tcagatcacccagcgcaagtgagaggc

SEQ ID NO: 29140 - DNA, 26 bp, Artificial Sequence
  Description of Artificial Sequence: Synthetic oligonucleotide
cagatcacccagcgcaagtgagaggc

SEQ ID NO: 29141 - DNA, 26 bp, Artificial Sequence
  Description of Artificial Sequence: Synthetic oligonucleotide
agatcacccagcgcaagtgagaggcg

SEQ ID NO: 29142 - DNA, 25 bp, Artificial Sequence
  Description of Artificial Sequence: Synthetic oligonucleotide
gatcacccagcgcaagtgagaggcg

SEQ ID NO: 29143 - DNA, 25 bp, Artificial Sequence
  Description of Artificial Sequence: Synthetic oligonucleotide
atcacccagcgcaagtgagaggcgg

SEQ ID NO: 29144 - DNA, 24 bp, Artificial Sequence
  Description of Artificial Sequence: Synthetic oligonucleotide
tcacccagcgcaagtgagaggcgg

SEQ ID NO: 29145 - DNA, 23 bp, Artificial Sequence
  Description of Artificial Sequence: Synthetic oligonucleotide
cacccagcgcaagtgagaggcgg

SEQ ID NO: 29146 - DNA, 23 bp, Artificial Sequence
  Description of Artificial Sequence: Synthetic oligonucleotide
acccagcgcaagtgagaggcggc

SEQ ID NO: 29147 - DNA, 22 bp, Artificial Sequence
  Description of Artificial Sequence: Synthetic oligonucleotide
cccagcgcaagtgagaggcggc

SEQ ID NO: 29148 - DNA, 22 bp, Artificial Sequence
  Description of Artificial Sequence: Synthetic oligonucleotide
ccagcgcaagtgagaggcggcc

SEQ ID NO: 29149 - DNA, 22 bp, Artificial Sequence
  Description of Artificial Sequence: Synthetic oligonucleotide
cagcgcaagtgagaggcggccc

SEQ ID NO: 29150 - DNA, 23 bp, Artificial Sequence
  Description of Artificial Sequence: Synthetic oligonucleotide
agcgcaagtgagaggcggcccgt

SEQ ID NO: 29151 - DNA, 22 bp, Artificial Sequence
  Description of Artificial Sequence: Synthetic oligonucleotide
gcgcaagtgagaggcggcccgt

SEQ ID NO: 29152 - DNA, 23 bp, Artificial Sequence
  Description of Artificial Sequence: Synthetic oligonucleotide
cgcaagtgagaggcggcccgtga

SEQ ID NO: 29153 - DNA, 23 bp, Artificial Sequence
  Description of Artificial Sequence: Synthetic oligonucleotide
gcaagtgagaggcggcccgtgag

SEQ ID NO: 29154 - DNA, 23 bp, Artificial Sequence
  Description of Artificial Sequence: Synthetic oligonucleotide
caagtgagaggcggcccgtgagg

SEQ ID NO: 29155 - DNA, 23 bp, Artificial Sequence
  Description of Artificial Sequence: Synthetic oligonucleotide
aagtgagaggcggcccgtgaggc

SEQ ID NO: 29156 - DNA, 22 bp, Artificial Sequence
  Description of Artificial Sequence: Synthetic oligonucleotide
agtgagaggcggcccgtgaggc

SEQ ID NO: 29157 - DNA, 21 bp, Artificial Sequence
  Description of Artificial Sequence: Synthetic oligonucleotide
gtgagaggcggcccgtgaggc

SEQ ID NO: 29158 - DNA, 21 bp, Artificial Sequence
  Description of Artificial Sequence: Synthetic oligonucleotide
tgagaggcggcccgtgaggcg

SEQ ID NO: 29159 - DNA, 20 bp, Artificial Sequence
  Description of Artificial Sequence: Synthetic oligonucleotide
gagaggcggcccgtgaggcg

SEQ ID NO: 29160 - DNA, 21 bp, Artificial Sequence
  Description of Artificial Sequence: Synthetic oligonucleotide
agaggcggcccgtgaggcgga

SEQ ID NO: 29161 - DNA, 31 bp, Artificial Sequence
  Description of Artificial Sequence: Synthetic oligonucleotide
ccactccatgaggtatttctacaccgccaag

SEQ ID NO: 29162 - DNA, 32 bp, Artificial Sequence
  Description of Artificial Sequence: Synthetic oligonucleotide
cactccatgaggtatttctacaccgccaagtc

SEQ ID NO: 29163 - DNA, 32 bp, Artificial Sequence
  Description of Artificial Sequence: Synthetic oligonucleotide
actccatgaggtatttctacaccgccaagtcc

SEQ ID NO: 29164 - DNA, 31 bp, Artificial Sequence
  Description of Artificial Sequence: Synthetic oligonucleotide
ctccatgaggtatttctacaccgccaagtcc

SEQ ID NO: 29165 - DNA, 31 bp, Artificial Sequence
  Description of Artificial Sequence: Synthetic oligonucleotide
tccatgaggtatttctacaccgccaagtccc

SEQ ID NO: 29166 - DNA, 30 bp, Artificial Sequence
  Description of Artificial Sequence: Synthetic oligonucleotide
ccatgaggtatttctacaccgccaagtccc

SEQ ID NO: 29167 - DNA, 30 bp, Artificial Sequence
  Description of Artificial Sequence: Synthetic oligonucleotide
catgaggtatttctacaccgccaagtcccg

SEQ ID NO: 29168 - DNA, 30 bp, Artificial Sequence
  Description of Artificial Sequence: Synthetic oligonucleotide
atgaggtatttctacaccgccaagtcccgg

SEQ ID NO: 29169 - DNA, 29 bp, Artificial Sequence
  Description of Artificial Sequence: Synthetic oligonucleotide
tgaggtatttctacaccgccaagtcccgg

SEQ ID NO: 29170 - DNA, 28 bp, Artificial Sequence
  Description of Artificial Sequence: Synthetic oligonucleotide
gaggtatttctacaccgccaagtcccgg

SEQ ID NO: 29171 - DNA, 28 bp, Artificial Sequence
  Description of Artificial Sequence: Synthetic oligonucleotide
aggtatttctacaccgccaagtcccggc

SEQ ID NO: 29172 - DNA, 27 bp, Artificial Sequence
  Description of Artificial Sequence: Synthetic oligonucleotide
ggtatttctacaccgccaagtcccggc

SEQ ID NO: 29173 - DNA, 27 bp, Artificial Sequence
  Description of Artificial Sequence: Synthetic oligonucleotide
gtatttctacaccgccaagtcccggcc

SEQ ID NO: 29174 - DNA, 27 bp, Artificial Sequence
  Description of Artificial Sequence: Synthetic oligonucleotide
tatttctacaccgccaagtcccggccc

SEQ ID NO: 29175 - DNA, 26 bp, Artificial Sequence
  Description of Artificial Sequence: Synthetic oligonucleotide
atttctacaccgccaagtcccggccc

SEQ ID NO: 29176 - DNA, 25 bp, Artificial Sequence
  Description of Artificial Sequence: Synthetic oligonucleotide
tttctacaccgccaagtcccggccc

SEQ ID NO: 29177 - DNA, 24 bp, Artificial Sequence
  Description of Artificial Sequence: Synthetic oligonucleotide
ttctacaccgccaagtcccggccc

SEQ ID NO: 29178 - DNA, 23 bp, Artificial Sequence
  Description of Artificial Sequence: Synthetic oligonucleotide
tctacaccgccaagtcccggccc

SEQ ID NO: 29179 - DNA, 22 bp, Artificial Sequence
  Description of Artificial Sequence: Synthetic oligonucleotide
ctacaccgccaagtcccggccc

SEQ ID NO: 29180 - DNA, 22 bp, Artificial Sequence
  Description of Artificial Sequence: Synthetic oligonucleotide
tacaccgccaagtcccggcccg

SEQ ID NO: 29181 - DNA, 21 bp, Artificial Sequence
  Description of Artificial Sequence: Synthetic oligonucleotide
acaccgccaagtcccggcccg

SEQ ID NO: 29182 - DNA, 20 bp, Artificial Sequence
  Description of Artificial Sequence: Synthetic oligonucleotide
caccgccaagtcccggcccg

SEQ ID NO: 29183 - DNA, 20 bp, Artificial Sequence
  Description of Artificial Sequence: Synthetic oligonucleotide
accgccaagtcccggcccgg

SEQ ID NO: 29184 - DNA, 20 bp, Artificial Sequence
  Description of Artificial Sequence: Synthetic oligonucleotide
ccgccaagtcccggcccggt

SEQ ID NO: 29185 - DNA, 20 bp, Artificial Sequence
  Description of Artificial Sequence: Synthetic oligonucleotide
cgccaagtcccggcccggct

SEQ ID NO: 29186 - DNA, 20 bp, Artificial Sequence
  Description of Artificial Sequence: Synthetic oligonucleotide
gccaagtcccggcccggcct

SEQ ID NO: 29187 - DNA, 20 bp, Artificial Sequence
  Description of Artificial Sequence: Synthetic oligonucleotide
ccaagtcccggcccggccgt

SEQ ID NO: 29188 - DNA, 20 bp, Artificial Sequence
  Description of Artificial Sequence: Synthetic oligonucleotide
caagtcccggcccggccgct

SEQ ID NO: 29189 - DNA, 20 bp, Artificial Sequence
  Description of Artificial Sequence: Synthetic oligonucleotide
aagtcccggcccggccgcgt

SEQ ID NO: 29190 - DNA, 20 bp, Artificial Sequence
  Description of Artificial Sequence: Synthetic oligonucleotide
agtcccggcccggccgcgtt

SEQ ID NO: 29191 - DNA, 25 bp, Artificial Sequence
  Description of Artificial Sequence: Synthetic oligonucleotide
gacacggcggctcagatcacccaga

SEQ ID NO: 29192 - DNA, 25 bp, Artificial Sequence
  Description of Artificial Sequence: Synthetic oligonucleotide
acacggcggctcagatcacccagag

SEQ ID NO: 29193 - DNA, 24 bp, Artificial Sequence
  Description of Artificial Sequence: Synthetic oligonucleotide
cacggcggctcagatcacccagag

SEQ ID NO: 29194 - DNA, 26 bp, Artificial Sequence
  Description of Artificial Sequence: Synthetic oligonucleotide
acggcggctcagatcacccagagcaa

SEQ ID NO: 29195 - DNA, 25 bp, Artificial Sequence
  Description of Artificial Sequence: Synthetic oligonucleotide
cggcggctcagatcacccagagcaa

SEQ ID NO: 29196 - DNA, 23 bp, Artificial Sequence
  Description of Artificial Sequence: Synthetic oligonucleotide
agagcaagtgggaggcggcccgt

SEQ ID NO: 29197 - DNA, 22 bp, Artificial Sequence
  Description of Artificial Sequence: Synthetic oligonucleotide
gagcaagtgggaggcggcccgt

SEQ ID NO: 29198 - DNA, 23 bp, Artificial Sequence
  Description of Artificial Sequence: Synthetic oligonucleotide
agcaagtgggaggcggcccgtga

SEQ ID NO: 29199 - DNA, 26 bp, Artificial Sequence
  Description of Artificial Sequence: Synthetic oligonucleotide
agagcctacctggagggcctgtgcat

SEQ ID NO: 29200 - DNA, 25 bp, Artificial Sequence
  Description of Artificial Sequence: Synthetic oligonucleotide
gagcctacctggagggcctgtgcat

SEQ ID NO: 29201 - DNA, 25 bp, Artificial Sequence
  Description of Artificial Sequence: Synthetic oligonucleotide
agcctacctggagggcctgtgcatg

SEQ ID NO: 29202 - DNA, 24 bp, Artificial Sequence
  Description of Artificial Sequence: Synthetic oligonucleotide
gcctacctggagggcctgtgcatg

SEQ ID NO: 29203 - DNA, 25 bp, Artificial Sequence
  Description of Artificial Sequence: Synthetic oligonucleotide
cctacctggagggcctgtgcatgga

SEQ ID NO: 29204 - DNA, 26 bp, Artificial Sequence
  Description of Artificial Sequence: Synthetic oligonucleotide
ctacctggagggcctgtgcatggagt

SEQ ID NO: 29205 - DNA, 26 bp, Artificial Sequence
  Description of Artificial Sequence: Synthetic oligonucleotide
tacctggagggcctgtgcatggagtg

SEQ ID NO: 29206 - DNA, 25 bp, Artificial Sequence
  Description of Artificial Sequence: Synthetic oligonucleotide
acctggagggcctgtgcatggagtg

SEQ ID NO: 29207 - DNA, 24 bp, Artificial Sequence
  Description of Artificial Sequence: Synthetic oligonucleotide
cctggagggcctgtgcatggagtg

SEQ ID NO: 29208 - DNA, 24 bp, Artificial Sequence
  Description of Artificial Sequence: Synthetic oligonucleotide
ctggagggcctgtgcatggagtgg

SEQ ID NO: 29209 - DNA, 25 bp, Artificial Sequence
  Description of Artificial Sequence: Synthetic oligonucleotide
tggagggcctgtgcatggagtggct

SEQ ID NO: 29210 - DNA, 24 bp, Artificial Sequence
  Description of Artificial Sequence: Synthetic oligonucleotide
ggagggcctgtgcatggagtggct

SEQ ID NO: 29211 - DNA, 24 bp, Artificial Sequence
  Description of Artificial Sequence: Synthetic oligonucleotide
gagggcctgtgcatggagtggctc

SEQ ID NO: 29212 - DNA, 24 bp, Artificial Sequence
  Description of Artificial Sequence: Synthetic oligonucleotide
agggcctgtgcatggagtggctcc

SEQ ID NO: 29213 - DNA, 23 bp, Artificial Sequence
  Description of Artificial Sequence: Synthetic oligonucleotide
gggcctgtgcatggagtggctcc

SEQ ID NO: 29214 - DNA, 23 bp, Artificial Sequence
  Description of Artificial Sequence: Synthetic oligonucleotide
ggcctgtgcatggagtggctccg

SEQ ID NO: 29215 - DNA, 24 bp, Artificial Sequence
  Description of Artificial Sequence: Synthetic oligonucleotide
gcctgtgcatggagtggctccgca

SEQ ID NO: 29216 - DNA, 27 bp, Artificial Sequence
  Description of Artificial Sequence: Synthetic oligonucleotide
cctgtgcatggagtggctccgcagata

SEQ ID NO: 29217 - DNA, 27 bp, Artificial Sequence
  Description of Artificial Sequence: Synthetic oligonucleotide
ctgtgcatggagtggctccgcagatac

SEQ ID NO: 29218 - DNA, 27 bp, Artificial Sequence
  Description of Artificial Sequence: Synthetic oligonucleotide
tgtgcatggagtggctccgcagatacc

SEQ ID NO: 29219 - DNA, 27 bp, Artificial Sequence
  Description of Artificial Sequence: Synthetic oligonucleotide
accaggacgcctacgacggcaaggttt

SEQ ID NO: 29220 - DNA, 27 bp, Artificial Sequence
  Description of Artificial Sequence: Synthetic oligonucleotide
ccaggacgcctacgacggcaaggttta

SEQ ID NO: 29221 - DNA, 27 bp, Artificial Sequence
  Description of Artificial Sequence: Synthetic oligonucleotide
caggacgcctacgacggcaaggtttac

SEQ ID NO: 29222 - DNA, 29 bp, Artificial Sequence
  Description of Artificial Sequence: Synthetic oligonucleotide
aggacgcctacgacggcaaggtttacatc

SEQ ID NO: 29223 - DNA, 28 bp, Artificial Sequence
  Description of Artificial Sequence: Synthetic oligonucleotide
ggacgcctacgacggcaaggtttacatc

SEQ ID NO: 29224 - DNA, 28 bp, Artificial Sequence
  Description of Artificial Sequence: Synthetic oligonucleotide
gacgcctacgacggcaaggtttacatcg

SEQ ID NO: 29225 - DNA, 28 bp, Artificial Sequence
  Description of Artificial Sequence: Synthetic oligonucleotide
acgcctacgacggcaaggtttacatcgc

SEQ ID NO: 29226 - DNA, 27 bp, Artificial Sequence
  Description of Artificial Sequence: Synthetic oligonucleotide
cgcctacgacggcaaggtttacatcgc

SEQ ID NO: 29227 - DNA, 27 bp, Artificial Sequence
  Description of Artificial Sequence: Synthetic oligonucleotide
gcctacgacggcaaggtttacatcgcc

SEQ ID NO: 29228 - DNA, 27 bp, Artificial Sequence
  Description of Artificial Sequence: Synthetic oligonucleotide
cctacgacggcaaggtttacatcgccc

SEQ ID NO: 29229 - DNA, 28 bp, Artificial Sequence
  Description of Artificial Sequence: Synthetic oligonucleotide
ctacgacggcaaggtttacatcgccctg

SEQ ID NO: 29230 - DNA, 30 bp, Artificial Sequence
  Description of Artificial Sequence: Synthetic oligonucleotide
tacgacggcaaggtttacatcgccctgaac

SEQ ID NO: 29231 - DNA, 29 bp, Artificial Sequence
  Description of Artificial Sequence: Synthetic oligonucleotide
acgacggcaaggtttacatcgccctgaac

SEQ ID NO: 29232 - DNA, 28 bp, Artificial Sequence
  Description of Artificial Sequence: Synthetic oligonucleotide
cgacggcaaggtttacatcgccctgaac

SEQ ID NO: 29233 - DNA, 28 bp, Artificial Sequence
  Description of Artificial Sequence: Synthetic oligonucleotide
gacggcaaggtttacatcgccctgaacg

SEQ ID NO: 29234 - DNA, 29 bp, Artificial Sequence
  Description of Artificial Sequence: Synthetic oligonucleotide
acggcaaggtttacatcgccctgaacgag

SEQ ID NO: 29235 - DNA, 28 bp, Artificial Sequence
  Description of Artificial Sequence: Synthetic oligonucleotide
cggcaaggtttacatcgccctgaacgag

SEQ ID NO: 29236 - DNA, 28 bp, Artificial Sequence
  Description of Artificial Sequence: Synthetic oligonucleotide
ggcaaggtttacatcgccctgaacgagg

SEQ ID NO: 29237 - DNA, 29 bp, Artificial Sequence
  Description of Artificial Sequence: Synthetic oligonucleotide
gcaaggtttacatcgccctgaacgaggac

SEQ ID NO: 29238 - DNA, 29 bp, Artificial Sequence
  Description of Artificial Sequence: Synthetic oligonucleotide
caaggtttacatcgccctgaacgaggacc

SEQ ID NO: 29239 - DNA, 30 bp, Artificial Sequence
  Description of Artificial Sequence: Synthetic oligonucleotide
aaggtttacatcgccctgaacgaggacctg

SEQ ID NO: 29240 - DNA, 29 bp, Artificial Sequence
  Description of Artificial Sequence: Synthetic oligonucleotide
aggtttacatcgccctgaacgaggacctg

SEQ ID NO: 29241 - DNA, 28 bp, Artificial Sequence
  Description of Artificial Sequence: Synthetic oligonucleotide
ggtttacatcgccctgaacgaggacctg

SEQ ID NO: 29242 - DNA, 29 bp, Artificial Sequence
  Description of Artificial Sequence: Synthetic oligonucleotide
gtttacatcgccctgaacgaggacctgag

SEQ ID NO: 29243 - DNA, 29 bp, Artificial Sequence
  Description of Artificial Sequence: Synthetic oligonucleotide
tttacatcgccctgaacgaggacctgagc

SEQ ID NO: 29244 - DNA, 26 bp, Artificial Sequence
  Description of Artificial Sequence: Synthetic oligonucleotide
gccgggtctcacaccctccagagtat

SEQ ID NO: 29245 - DNA, 27 bp, Artificial Sequence
  Description of Artificial Sequence: Synthetic oligonucleotide
ccgggtctcacaccctccagagtatgt

SEQ ID NO: 29246 - DNA, 28 bp, Artificial Sequence
  Description of Artificial Sequence: Synthetic oligonucleotide
cgggtctcacaccctccagagtatgtac

SEQ ID NO: 29247 - DNA, 28 bp, Artificial Sequence
  Description of Artificial Sequence: Synthetic oligonucleotide
gggtctcacaccctccagagtatgtacg

SEQ ID NO: 29248 - DNA, 28 bp, Artificial Sequence
  Description of Artificial Sequence: Synthetic oligonucleotide
ggtctcacaccctccagagtatgtacgg

SEQ ID NO: 29249 - DNA, 28 bp, Artificial Sequence
  Description of Artificial Sequence: Synthetic oligonucleotide
gtctcacaccctccagagtatgtacggc

SEQ ID NO: 29250 - DNA, 29 bp, Artificial Sequence
  Description of Artificial Sequence: Synthetic oligonucleotide
tctcacaccctccagagtatgtacggctg

SEQ ID NO: 29251 - DNA, 28 bp, Artificial Sequence
  Description of Artificial Sequence: Synthetic oligonucleotide
ctcacaccctccagagtatgtacggctg

SEQ ID NO: 29252 - DNA, 28 bp, Artificial Sequence
  Description of Artificial Sequence: Synthetic oligonucleotide
tcacaccctccagagtatgtacggctgc

SEQ ID NO: 29253 - DNA, 27 bp, Artificial Sequence
  Description of Artificial Sequence: Synthetic oligonucleotide
cacaccctccagagtatgtacggctgc

SEQ ID NO: 29254 - DNA, 27 bp, Artificial Sequence
  Description of Artificial Sequence: Synthetic oligonucleotide
acaccctccagagtatgtacggctgcg

SEQ ID NO: 29255 - DNA, 27 bp, Artificial Sequence
  Description of Artificial Sequence: Synthetic oligonucleotide
caccctccagagtatgtacggctgcga

SEQ ID NO: 29256 - DNA, 27 bp, Artificial Sequence
  Description of Artificial Sequence: Synthetic oligonucleotide
accctccagagtatgtacggctgcgac

SEQ ID NO: 29257 - DNA, 26 bp, Artificial Sequence
  Description of Artificial Sequence: Synthetic oligonucleotide
ccctccagagtatgtacggctgcgac

SEQ ID NO: 29258 - DNA, 27 bp, Artificial Sequence
  Description of Artificial Sequence: Synthetic oligonucleotide
cctccagagtatgtacggctgcgacgt

SEQ ID NO: 29259 - DNA, 27 bp, Artificial Sequence
  Description of Artificial Sequence: Synthetic oligonucleotide
ctccagagtatgtacggctgcgacgtg

SEQ ID NO: 29260 - DNA, 27 bp, Artificial Sequence
  Description of Artificial Sequence: Synthetic oligonucleotide
tccagagtatgtacggctgcgacgtgg

SEQ ID NO: 29261 - DNA, 26 bp, Artificial Sequence
  Description of Artificial Sequence: Synthetic oligonucleotide
ccagagtatgtacggctgcgacgtgg

SEQ ID NO: 29262 - DNA, 26 bp, Artificial Sequence
  Description of Artificial Sequence: Synthetic oligonucleotide
cagagtatgtacggctgcgacgtggg

SEQ ID NO: 29263 - DNA, 26 bp, Artificial Sequence
  Description of Artificial Sequence: Synthetic oligonucleotide
agagtatgtacggctgcgacgtgggg

SEQ ID NO: 29264 - DNA, 25 bp, Artificial Sequence
  Description of Artificial Sequence: Synthetic oligonucleotide
gagtatgtacggctgcgacgtgggg

SEQ ID NO: 29265 - DNA, 25 bp, Artificial Sequence
  Description of Artificial Sequence: Synthetic oligonucleotide
agtatgtacggctgcgacgtggggc

SEQ ID NO: 29266 - DNA, 24 bp, Artificial Sequence
  Description of Artificial Sequence: Synthetic oligonucleotide
gtatgtacggctgcgacgtggggc

SEQ ID NO: 29267 - DNA, 24 bp, Artificial Sequence
  Description of Artificial Sequence: Synthetic oligonucleotide
tatgtacggctgcgacgtggggcc

SEQ ID NO: 29268 - DNA, 27 bp, Artificial Sequence
  Description of Artificial Sequence: Synthetic oligonucleotide
accccatctctgaccatgaggccacca

SEQ ID NO: 29269 - DNA, 27 bp, Artificial Sequence
  Description of Artificial Sequence: Synthetic oligonucleotide
ccccatctctgaccatgaggccaccat

SEQ ID NO: 29270 - DNA, 27 bp, Artificial Sequence
  Description of Artificial Sequence: Synthetic oligonucleotide
cccatctctgaccatgaggccaccatg

SEQ ID NO: 29271 - DNA, 28 bp, Artificial Sequence
  Description of Artificial Sequence: Synthetic oligonucleotide
ccatctctgaccatgaggccaccatgag

SEQ ID NO: 29272 - DNA, 28 bp, Artificial Sequence
  Description of Artificial Sequence: Synthetic oligonucleotide
catctctgaccatgaggccaccatgagg

SEQ ID NO: 29273 - DNA, 29 bp, Artificial Sequence
  Description of Artificial Sequence: Synthetic oligonucleotide
atctctgaccatgaggccaccatgaggtg

SEQ ID NO: 29274 - DNA, 28 bp, Artificial Sequence
  Description of Artificial Sequence: Synthetic oligonucleotide
tctctgaccatgaggccaccatgaggtg

SEQ ID NO: 29275 - DNA, 27 bp, Artificial Sequence
  Description of Artificial Sequence: Synthetic oligonucleotide
ctctgaccatgaggccaccatgaggtg

SEQ ID NO: 29276 - DNA, 27 bp, Artificial Sequence
  Description of Artificial Sequence: Synthetic oligonucleotide
tctgaccatgaggccaccatgaggtgc

SEQ ID NO: 29277 - DNA, 27 bp, Artificial Sequence
  Description of Artificial Sequence: Synthetic oligonucleotide
ctgaccatgaggccaccatgaggtgct

SEQ ID NO: 29278 - DNA, 27 bp, Artificial Sequence
  Description of Artificial Sequence: Synthetic oligonucleotide
tgaccatgaggccaccatgaggtgctg

SEQ ID NO: 29279 - DNA, 26 bp, Artificial Sequence
  Description of Artificial Sequence: Synthetic oligonucleotide
gaccatgaggccaccatgaggtgctg

SEQ ID NO: 29280 - DNA, 26 bp, Artificial Sequence
  Description of Artificial Sequence: Synthetic oligonucleotide
accatgaggccaccatgaggtgctgg

SEQ ID NO: 29281 - DNA, 25 bp, Artificial Sequence
  Description of Artificial Sequence: Synthetic oligonucleotide
ccatgaggccaccatgaggtgctgg

SEQ ID NO: 29282 - DNA, 25 bp, Artificial Sequence
  Description of Artificial Sequence: Synthetic oligonucleotide
catgaggccaccatgaggtgctggg

SEQ ID NO: 29283 - DNA, 25 bp, Artificial Sequence
  Description of Artificial Sequence: Synthetic oligonucleotide
atgaggccaccatgaggtgctgggc

SEQ ID NO: 29284 - DNA, 24 bp, Artificial Sequence
  Description of Artificial Sequence: Synthetic oligonucleotide
tgaggccaccatgaggtgctgggc

SEQ ID NO: 29285 - DNA, 23 bp, Artificial Sequence
  Description of Artificial Sequence: Synthetic oligonucleotide
gaggccaccatgaggtgctgggc

SEQ ID NO: 29286 - DNA, 23 bp, Artificial Sequence
  Description of Artificial Sequence: Synthetic oligonucleotide
aggccaccatgaggtgctgggcc

SEQ ID NO: 29287 - DNA, 22 bp, Artificial Sequence
  Description of Artificial Sequence: Synthetic oligonucleotide
ggccaccatgaggtgctgggcc

SEQ ID NO: 29288 - DNA, 23 bp, Artificial Sequence
  Description of Artificial Sequence: Synthetic oligonucleotide
gccaccatgaggtgctgggccct

SEQ ID NO: 29289 - DNA, 23 bp, Artificial Sequence
  Description of Artificial Sequence: Synthetic oligonucleotide
ccaccatgaggtgctgggccctg

SEQ ID NO: 29290 - DNA, 23 bp, Artificial Sequence
  Description of Artificial Sequence: Synthetic oligonucleotide
caccatgaggtgctgggccctgg

SEQ ID NO: 29291 - DNA, 23 bp, Artificial Sequence
  Description of Artificial Sequence: Synthetic oligonucleotide
accatgaggtgctgggccctggg

SEQ ID NO: 29292 - DNA, 22 bp, Artificial Sequence
  Description of Artificial Sequence: Synthetic oligonucleotide
ccatgaggtgctgggccctggg

SEQ ID NO: 29293 - DNA, 24 bp, Artificial Sequence
  Description of Artificial Sequence: Synthetic oligonucleotide
catgaggtgctgggccctgggctt

SEQ ID NO: 29294 - DNA, 26 bp, Artificial Sequence
  Description of Artificial Sequence: Synthetic oligonucleotide
atgaggtgctgggccctgggcttcta

SEQ ID NO: 29295 - DNA, 26 bp, Artificial Sequence
  Description of Artificial Sequence: Synthetic oligonucleotide
caaagacacacgtgacccaccacccc

SEQ ID NO: 29296 - DNA, 27 bp, Artificial Sequence
  Description of Artificial Sequence: Synthetic oligonucleotide
aaagacacacgtgacccaccaccccgt

SEQ ID NO: 29297 - DNA, 26 bp, Artificial Sequence
  Description of Artificial Sequence: Synthetic oligonucleotide
aagacacacgtgacccaccaccccgt

SEQ ID NO: 29298 - DNA, 25 bp, Artificial Sequence
  Description of Artificial Sequence: Synthetic oligonucleotide
agacacacgtgacccaccaccccgt

SEQ ID NO: 29299 - DNA, 24 bp, Artificial Sequence
  Description of Artificial Sequence: Synthetic oligonucleotide
gacacacgtgacccaccaccccgt

SEQ ID NO: 29300 - DNA, 25 bp, Artificial Sequence
  Description of Artificial Sequence: Synthetic oligonucleotide
acacacgtgacccaccaccccgtct

SEQ ID NO: 29301 - DNA, 24 bp, Artificial Sequence
  Description of Artificial Sequence: Synthetic oligonucleotide
cacacgtgacccaccaccccgtct

SEQ ID NO: 29302 - DNA, 25 bp, Artificial Sequence
  Description of Artificial Sequence: Synthetic oligonucleotide
acacgtgacccaccaccccgtctct

SEQ ID NO: 29303 - DNA, 24 bp, Artificial Sequence
  Description of Artificial Sequence: Synthetic oligonucleotide
cacgtgacccaccaccccgtctct

SEQ ID NO: 29304 - DNA, 25 bp, Artificial Sequence
  Description of Artificial Sequence: Synthetic oligonucleotide
acgtgacccaccaccccgtctctga

SEQ ID NO: 29305 - DNA, 24 bp, Artificial Sequence
  Description of Artificial Sequence: Synthetic oligonucleotide
cgtgacccaccaccccgtctctga

SEQ ID NO: 29306 - DNA, 24 bp, Artificial Sequence
  Description of Artificial Sequence: Synthetic oligonucleotide
gtgacccaccaccccgtctctgac

SEQ ID NO: 29307 - DNA, 26 bp, Artificial Sequence
  Description of Artificial Sequence: Synthetic oligonucleotide
tgacccaccaccccgtctctgaccat

SEQ ID NO: 29308 - DNA, 25 bp, Artificial Sequence
  Description of Artificial Sequence: Synthetic oligonucleotide
gacccaccaccccgtctctgaccat

SEQ ID NO: 29309 - DNA, 26 bp, Artificial Sequence
  Description of Artificial Sequence: Synthetic oligonucleotide
acccaccaccccgtctctgaccatga

SEQ ID NO: 29310 - DNA, 25 bp, Artificial Sequence
  Description of Artificial Sequence: Synthetic oligonucleotide
cccaccaccccgtctctgaccatga

SEQ ID NO: 29311 - DNA, 25 bp, Artificial Sequence
  Description of Artificial Sequence: Synthetic oligonucleotide
ccaccaccccgtctctgaccatgag

SEQ ID NO: 29312 - DNA, 25 bp, Artificial Sequence
  Description of Artificial Sequence: Synthetic oligonucleotide
caccaccccgtctctgaccatgagg

SEQ ID NO: 29313 - DNA, 25 bp, Artificial Sequence
  Description of Artificial Sequence: Synthetic oligonucleotide
accaccccgtctctgaccatgaggc

SEQ ID NO: 29314 - DNA, 24 bp, Artificial Sequence
  Description of Artificial Sequence: Synthetic oligonucleotide
ccaccccgtctctgaccatgaggc

SEQ ID NO: 29315 - DNA, 25 bp, Artificial Sequence
  Description of Artificial Sequence: Synthetic oligonucleotide
caccccgtctctgaccatgaggcca

SEQ ID NO: 29316 - DNA, 25 bp, Artificial Sequence
  Description of Artificial Sequence: Synthetic oligonucleotide
accccgtctctgaccatgaggccac

SEQ ID NO: 29317 - DNA, 24 bp, Artificial Sequence
  Description of Artificial Sequence: Synthetic oligonucleotide
ccccgtctctgaccatgaggccac

SEQ ID NO: 29318 - DNA, 24 bp, Artificial Sequence
  Description of Artificial Sequence: Synthetic oligonucleotide
cccgtctctgaccatgaggccacc

SEQ ID NO: 29319 - DNA, 25 bp, Artificial Sequence
  Description of Artificial Sequence: Synthetic oligonucleotide
ccgtctctgaccatgaggccaccct

SEQ ID NO: 29320 - DNA, 26 bp, Artificial Sequence
  Description of Artificial Sequence: Synthetic oligonucleotide
cgtctctgaccatgaggccaccctga

SEQ ID NO: 29321 - DNA, 22 bp, Artificial Sequence
  Description of Artificial Sequence: Synthetic oligonucleotide
cgcaagtgggaggcggcccgta

SEQ ID NO: 29322 - DNA, 22 bp, Artificial Sequence
  Description of Artificial Sequence: Synthetic oligonucleotide
gcaagtgggaggcggcccgtac

SEQ ID NO: 29323 - DNA, 22 bp, Artificial Sequence
  Description of Artificial Sequence: Synthetic oligonucleotide
caagtgggaggcggcccgtacg

SEQ ID NO: 29324 - DNA, 22 bp, Artificial Sequence
  Description of Artificial Sequence: Synthetic oligonucleotide
aagtgggaggcggcccgtacgg

SEQ ID NO: 29325 - DNA, 21 bp, Artificial Sequence
  Description of Artificial Sequence: Synthetic oligonucleotide
agtgggaggcggcccgtacgg

SEQ ID NO: 29326 - DNA, 20 bp, Artificial Sequence
  Description of Artificial Sequence: Synthetic oligonucleotide
gtgggaggcggcccgtacgg

SEQ ID NO: 29327 - DNA, 20 bp, Artificial Sequence
  Description of Artificial Sequence: Synthetic oligonucleotide
tgggaggcggcccgtacggc

SEQ ID NO: 29328 - DNA, 20 bp, Artificial Sequence
  Description of Artificial Sequence: Synthetic oligonucleotide
gggaggcggcccgtacggct

SEQ ID NO: 29329 - DNA, 20 bp, Artificial Sequence
  Description of Artificial Sequence: Synthetic oligonucleotide
ggaggcggcccgtacggcgt

SEQ ID NO: 29330 - DNA, 20 bp, Artificial Sequence
  Description of Artificial Sequence: Synthetic oligonucleotide
gaggcggcccgtacggcgga

SEQ ID NO: 29331 - DNA, 20 bp, Artificial Sequence
  Description of Artificial Sequence: Synthetic oligonucleotide
aggcggcccgtacggcggag

SEQ ID NO: 29332 - DNA, 20 bp, Artificial Sequence
  Description of Artificial Sequence: Synthetic oligonucleotide
ggcggcccgtacggcggagt

SEQ ID NO: 29333 - DNA, 20 bp, Artificial Sequence
  Description of Artificial Sequence: Synthetic oligonucleotide
gcggcccgtacggcggagca

SEQ ID NO: 29334 - DNA, 20 bp, Artificial Sequence
  Description of Artificial Sequence: Synthetic oligonucleotide
cggcccgtacggcggagcag

SEQ ID NO: 29335 - DNA, 21 bp, Artificial Sequence
  Description of Artificial Sequence: Synthetic oligonucleotide
ggcccgtacggcggagcagct

SEQ ID NO: 29336 - DNA, 22 bp, Artificial Sequence
  Description of Artificial Sequence: Synthetic oligonucleotide
gcccgtacggcggagcagctga

SEQ ID NO: 29337 - DNA, 23 bp, Artificial Sequence
  Description of Artificial Sequence: Synthetic oligonucleotide
cccgtacggcggagcagctgaga

SEQ ID NO: 29338 - DNA, 23 bp, Artificial Sequence
  Description of Artificial Sequence: Synthetic oligonucleotide
ccgtacggcggagcagctgagag

SEQ ID NO: 29339 - DNA, 23 bp, Artificial Sequence
  Description of Artificial Sequence: Synthetic oligonucleotide
cgtacggcggagcagctgagagc

SEQ ID NO: 29340 - DNA, 25 bp, Artificial Sequence
  Description of Artificial Sequence: Synthetic oligonucleotide
gtacggcggagcagctgagagccta

SEQ ID NO: 29341 - DNA, 25 bp, Artificial Sequence
  Description of Artificial Sequence: Synthetic oligonucleotide
tacggcggagcagctgagagcctac

SEQ ID NO: 29342 - DNA, 24 bp, Artificial Sequence
  Description of Artificial Sequence: Synthetic oligonucleotide
acggcggagcagctgagagcctac

SEQ ID NO: 29343 - DNA, 27 bp, Artificial Sequence
  Description of Artificial Sequence: Synthetic oligonucleotide
tgtgacccaccaccccatctctgacct

SEQ ID NO: 29344 - DNA, 27 bp, Artificial Sequence
  Description of Artificial Sequence: Synthetic oligonucleotide
gtgacccaccaccccatctctgacctt

SEQ ID NO: 29345 - DNA, 27 bp, Artificial Sequence
  Description of Artificial Sequence: Synthetic oligonucleotide
tgacccaccaccccatctctgaccttg

SEQ ID NO: 29346 - DNA, 27 bp, Artificial Sequence
  Description of Artificial Sequence: Synthetic oligonucleotide
gacccaccaccccatctctgaccttga

SEQ ID NO: 29347 - DNA, 27 bp, Artificial Sequence
  Description of Artificial Sequence: Synthetic oligonucleotide
acccaccaccccatctctgaccttgag

SEQ ID NO: 29348 - DNA, 26 bp, Artificial Sequence
  Description of Artificial Sequence: Synthetic oligonucleotide
cccaccaccccatctctgaccttgag

SEQ ID NO: 29349 - DNA, 26 bp, Artificial Sequence
  Description of Artificial Sequence: Synthetic oligonucleotide
ccaccaccccatctctgaccttgagg

SEQ ID NO: 29350 - DNA, 26 bp, Artificial Sequence
  Description of Artificial Sequence: Synthetic oligonucleotide
caccaccccatctctgaccttgaggc

SEQ ID NO: 29351 - DNA, 27 bp, Artificial Sequence
  Description of Artificial Sequence: Synthetic oligonucleotide
accaccccatctctgaccttgaggcca

SEQ ID NO: 29352 - DNA, 26 bp, Artificial Sequence
  Description of Artificial Sequence: Synthetic oligonucleotide
ccaccccatctctgaccttgaggcca

SEQ ID NO: 29353 - DNA, 26 bp, Artificial Sequence
  Description of Artificial Sequence: Synthetic oligonucleotide
caccccatctctgaccttgaggccac

SEQ ID NO: 29354 - DNA, 26 bp, Artificial Sequence
  Description of Artificial Sequence: Synthetic oligonucleotide
accccatctctgaccttgaggccacc

SEQ ID NO: 29355 - DNA, 25 bp, Artificial Sequence
  Description of Artificial Sequence: Synthetic oligonucleotide
ccccatctctgaccttgaggccacc

SEQ ID NO: 29356 - DNA, 26 bp, Artificial Sequence
  Description of Artificial Sequence: Synthetic oligonucleotide
cccatctctgaccttgaggccaccct

SEQ ID NO: 29357 - DNA, 27 bp, Artificial Sequence
  Description of Artificial Sequence: Synthetic oligonucleotide
ccatctctgaccttgaggccaccctga

SEQ ID NO: 29358 - DNA, 27 bp, Artificial Sequence
  Description of Artificial Sequence: Synthetic oligonucleotide
catctctgaccttgaggccaccctgag

SEQ ID NO: 29359 - DNA, 27 bp, Artificial Sequence
  Description of Artificial Sequence: Synthetic oligonucleotide
atctctgaccttgaggccaccctgagg

SEQ ID NO: 29360 - DNA, 27 bp, Artificial Sequence
  Description of Artificial Sequence: Synthetic oligonucleotide
tctctgaccttgaggccaccctgaggt

SEQ ID NO: 29361 - DNA, 26 bp, Artificial Sequence
  Description of Artificial Sequence: Synthetic oligonucleotide
ctctgaccttgaggccaccctgaggt

SEQ ID NO: 29362 - DNA, 26 bp, Artificial Sequence
  Description of Artificial Sequence: Synthetic oligonucleotide
tctgaccttgaggccaccctgaggtg

SEQ ID NO: 29363 - DNA, 25 bp, Artificial Sequence
  Description of Artificial Sequence: Synthetic oligonucleotide
ctgaccttgaggccaccctgaggtg

SEQ ID NO: 29364 - DNA, 26 bp, Artificial Sequence
  Description of Artificial Sequence: Synthetic oligonucleotide
tgaccttgaggccaccctgaggtgct

SEQ ID NO: 29365 - DNA, 25 bp, Artificial Sequence
  Description of Artificial Sequence: Synthetic oligonucleotide
gaccttgaggccaccctgaggtgct

SEQ ID NO: 29366 - DNA, 25 bp, Artificial Sequence
  Description of Artificial Sequence: Synthetic oligonucleotide
accttgaggccaccctgaggtgctg

SEQ ID NO: 29367 - DNA, 24 bp, Artificial Sequence
  Description of Artificial Sequence: Synthetic oligonucleotide
ccttgaggccaccctgaggtgctg

SEQ ID NO: 29368 - DNA, 24 bp, Artificial Sequence
  Description of Artificial Sequence: Synthetic oligonucleotide
cttgaggccaccctgaggtgctgg

SEQ ID NO: 29369 - DNA, 24 bp, Artificial Sequence
  Description of Artificial Sequence: Synthetic oligonucleotide
ttgaggccaccctgaggtgctggg

SEQ ID NO: 29370 - DNA, 21 bp, Artificial Sequence
  Description of Artificial Sequence: Synthetic oligonucleotide
acgccgcgagtccgaggacgg

SEQ ID NO: 29371 - DNA, 20 bp, Artificial Sequence
  Description of Artificial Sequence: Synthetic oligonucleotide
cgccgcgagtccgaggacgg

SEQ ID NO: 29372 - DNA, 20 bp, Artificial Sequence
  Description of Artificial Sequence: Synthetic oligonucleotide
gccgcgagtccgaggacggc

SEQ ID NO: 29373 - DNA, 20 bp, Artificial Sequence
  Description of Artificial Sequence: Synthetic oligonucleotide
ccgcgagtccgaggacggcg

SEQ ID NO: 29374 - DNA, 20 bp, Artificial Sequence
  Description of Artificial Sequence: Synthetic oligonucleotide
cgcgagtccgaggacggcgc

SEQ ID NO: 29375 - DNA, 20 bp, Artificial Sequence
  Description of Artificial Sequence: Synthetic oligonucleotide
gcgagtccgaggacggcgcc

SEQ ID NO: 29376 - DNA, 20 bp, Artificial Sequence
  Description of Artificial Sequence: Synthetic oligonucleotide
cgagtccgaggacggcgccc

SEQ ID NO: 29377 - DNA, 20 bp, Artificial Sequence
  Description of Artificial Sequence: Synthetic oligonucleotide
gagtccgaggacggcgcccc

SEQ ID NO: 29378 - DNA, 20 bp, Artificial Sequence
  Description of Artificial Sequence: Synthetic oligonucleotide
agtccgaggacggcgccccg

SEQ ID NO: 29379 - DNA, 20 bp, Artificial Sequence
  Description of Artificial Sequence: Synthetic oligonucleotide
gtccgaggacggcgccccgt

SEQ ID NO: 29380 - DNA, 20 bp, Artificial Sequence
  Description of Artificial Sequence: Synthetic oligonucleotide
tccgaggacggcgccccggt

SEQ ID NO: 29381 - DNA, 20 bp, Artificial Sequence
  Description of Artificial Sequence: Synthetic oligonucleotide
ccgaggacggcgccccggtt

SEQ ID NO: 29382 - DNA, 20 bp, Artificial Sequence
  Description of Artificial Sequence: Synthetic oligonucleotide
cgaggacggcgccccgggtt

SEQ ID NO: 29383 - DNA, 20 bp, Artificial Sequence
  Description of Artificial Sequence: Synthetic oligonucleotide
gaggacggcgccccgggctt

SEQ ID NO: 29384 - DNA, 20 bp, Artificial Sequence
  Description of Artificial Sequence: Synthetic oligonucleotide
aggacggcgccccgggcgtt

SEQ ID NO: 29385 - DNA, 20 bp, Artificial Sequence
  Description of Artificial Sequence: Synthetic oligonucleotide
ggacggcgccccgggcgttt

SEQ ID NO: 29386 - DNA, 20 bp, Artificial Sequence
  Description of Artificial Sequence: Synthetic oligonucleotide
gacggcgccccgggcgcttt

SEQ ID NO: 29387 - DNA, 20 bp, Artificial Sequence
  Description of Artificial Sequence: Synthetic oligonucleotide
acggcgccccgggcgccatt

SEQ ID NO: 29388 - DNA, 20 bp, Artificial Sequence
  Description of Artificial Sequence: Synthetic oligonucleotide
cggcgccccgggcgccattt

SEQ ID NO: 29389 - DNA, 33 bp, Artificial Sequence
  Description of Artificial Sequence: Synthetic oligonucleotide
tgcaagaccaacacacagacttaccgagagaac

SEQ ID NO: 29390 - DNA, 32 bp, Artificial Sequence
  Description of Artificial Sequence: Synthetic oligonucleotide
gcaagaccaacacacagacttaccgagagaac

SEQ ID NO: 29391 - DNA, 23 bp, Artificial Sequence
  Description of Artificial Sequence: Synthetic oligonucleotide
atgcgggtcatggcgccccgaac

SEQ ID NO: 29392 - DNA, 22 bp, Artificial Sequence
  Description of Artificial Sequence: Synthetic oligonucleotide
tgcgggtcatggcgccccgaac

SEQ ID NO: 29393 - DNA, 21 bp, Artificial Sequence
  Description of Artificial Sequence: Synthetic oligonucleotide
gcgggtcatggcgccccgaac

SEQ ID NO: 29394 - DNA, 21 bp, Artificial Sequence
  Description of Artificial Sequence: Synthetic oligonucleotide
cgggtcatggcgccccgaacc

SEQ ID NO: 29395 - DNA, 22 bp, Artificial Sequence
  Description of Artificial Sequence: Synthetic oligonucleotide
gggtcatggcgccccgaaccgt

SEQ ID NO: 29396 - DNA, 28 bp, Artificial Sequence
  Description of Artificial Sequence: Synthetic oligonucleotide
gggtctcacaccctccagaggatgtaag

SEQ ID NO: 29397 - DNA, 28 bp, Artificial Sequence
  Description of Artificial Sequence: Synthetic oligonucleotide
ggtctcacaccctccagaggatgtaagg

SEQ ID NO: 29398 - DNA, 28 bp, Artificial Sequence
  Description of Artificial Sequence: Synthetic oligonucleotide
gtctcacaccctccagaggatgtaaggc

SEQ ID NO: 29399 - DNA, 29 bp, Artificial Sequence
  Description of Artificial Sequence: Synthetic oligonucleotide
tctcacaccctccagaggatgtaaggctg

SEQ ID NO: 29400 - DNA, 28 bp, Artificial Sequence
  Description of Artificial Sequence: Synthetic oligonucleotide
ctcacaccctccagaggatgtaaggctg

SEQ ID NO: 29401 - DNA, 28 bp, Artificial Sequence
  Description of Artificial Sequence: Synthetic oligonucleotide
tcacaccctccagaggatgtaaggctgc

SEQ ID NO: 29402 - DNA, 27 bp, Artificial Sequence
  Description of Artificial Sequence: Synthetic oligonucleotide
cacaccctccagaggatgtaaggctgc

SEQ ID NO: 29403 - DNA, 27 bp, Artificial Sequence
  Description of Artificial Sequence: Synthetic oligonucleotide
acaccctccagaggatgtaaggctgcg

SEQ ID NO: 29404 - DNA, 27 bp, Artificial Sequence
  Description of Artificial Sequence: Synthetic oligonucleotide
caccctccagaggatgtaaggctgcga

SEQ ID NO: 29405 - DNA, 27 bp, Artificial Sequence
  Description of Artificial Sequence: Synthetic oligonucleotide
accctccagaggatgtaaggctgcgac

SEQ ID NO: 29406 - DNA, 26 bp, Artificial Sequence
  Description of Artificial Sequence: Synthetic oligonucleotide
ccctccagaggatgtaaggctgcgac

SEQ ID NO: 29407 - DNA, 27 bp, Artificial Sequence
  Description of Artificial Sequence: Synthetic oligonucleotide
cctccagaggatgtaaggctgcgacgt

SEQ ID NO: 29408 - DNA, 27 bp, Artificial Sequence
  Description of Artificial Sequence: Synthetic oligonucleotide
ctccagaggatgtaaggctgcgacgtg

SEQ ID NO: 29409 - DNA, 27 bp, Artificial Sequence
  Description of Artificial Sequence: Synthetic oligonucleotide
tccagaggatgtaaggctgcgacgtgg

SEQ ID NO: 29410 - DNA, 26 bp, Artificial Sequence
  Description of Artificial Sequence: Synthetic oligonucleotide
ccagaggatgtaaggctgcgacgtgg

SEQ ID NO: 29411 - DNA, 26 bp, Artificial Sequence
  Description of Artificial Sequence: Synthetic oligonucleotide
cagaggatgtaaggctgcgacgtggg

SEQ ID NO: 29412 - DNA, 26 bp, Artificial Sequence
  Description of Artificial Sequence: Synthetic oligonucleotide
agaggatgtaaggctgcgacgtgggg

SEQ ID NO: 29413 - DNA, 25 bp, Artificial Sequence
  Description of Artificial Sequence: Synthetic oligonucleotide
gaggatgtaaggctgcgacgtgggg

SEQ ID NO: 29414 - DNA, 25 bp, Artificial Sequence
  Description of Artificial Sequence: Synthetic oligonucleotide
aggatgtaaggctgcgacgtggggc

SEQ ID NO: 29415 - DNA, 24 bp, Artificial Sequence
  Description of Artificial Sequence: Synthetic oligonucleotide
ggatgtaaggctgcgacgtggggc

SEQ ID NO: 29416 - DNA, 24 bp, Artificial Sequence
  Description of Artificial Sequence: Synthetic oligonucleotide
gatgtaaggctgcgacgtggggcc

SEQ ID NO: 29417 - DNA, 24 bp, Artificial Sequence
  Description of Artificial Sequence: Synthetic oligonucleotide
atgtaaggctgcgacgtggggccg

SEQ ID NO: 29418 - DNA, 23 bp, Artificial Sequence
  Description of Artificial Sequence: Synthetic oligonucleotide
tgtaaggctgcgacgtggggccg

SEQ ID NO: 29419 - DNA, 22 bp, Artificial Sequence
  Description of Artificial Sequence: Synthetic oligonucleotide
gtaaggctgcgacgtggggccg

SEQ ID NO: 29420 - DNA, 23 bp, Artificial Sequence
  Description of Artificial Sequence: Synthetic oligonucleotide
taaggctgcgacgtggggccgga

SEQ ID NO: 29421 - DNA, 22 bp, Artificial Sequence
  Description of Artificial Sequence: Synthetic oligonucleotide
aaggctgcgacgtggggccgga

SEQ ID NO: 29422 - DNA, 21 bp, Artificial Sequence
  Description of Artificial Sequence: Synthetic oligonucleotide
aggctgcgacgtggggccgga

SEQ ID NO: 29423 - DNA, 27 bp, Artificial Sequence
  Description of Artificial Sequence: Synthetic oligonucleotide
gggtctcacaccctccagaggatgttc

SEQ ID NO: 29424 - DNA, 27 bp, Artificial Sequence
  Description of Artificial Sequence: Synthetic oligonucleotide
ggtctcacaccctccagaggatgttcg

SEQ ID NO: 29425 - DNA, 27 bp, Artificial Sequence
  Description of Artificial Sequence: Synthetic oligonucleotide
gtctcacaccctccagaggatgttcgg

SEQ ID NO: 29426 - DNA, 27 bp, Artificial Sequence
  Description of Artificial Sequence: Synthetic oligonucleotide
tctcacaccctccagaggatgttcggc

SEQ ID NO: 29427 - DNA, 27 bp, Artificial Sequence
  Description of Artificial Sequence: Synthetic oligonucleotide
ctcacaccctccagaggatgttcggct

SEQ ID NO: 29428 - DNA, 27 bp, Artificial Sequence
  Description of Artificial Sequence: Synthetic oligonucleotide
tcacaccctccagaggatgttcggctg

SEQ ID NO: 29429 - DNA, 26 bp, Artificial Sequence
  Description of Artificial Sequence: Synthetic oligonucleotide
cacaccctccagaggatgttcggctg

SEQ ID NO: 29430 - DNA, 26 bp, Artificial Sequence
  Description of Artificial Sequence: Synthetic oligonucleotide
acaccctccagaggatgttcggctgc

SEQ ID NO: 29431 - DNA, 25 bp, Artificial Sequence
  Description of Artificial Sequence: Synthetic oligonucleotide
caccctccagaggatgttcggctgc

SEQ ID NO: 29432 - DNA, 26 bp, Artificial Sequence
  Description of Artificial Sequence: Synthetic oligonucleotide
accctccagaggatgttcggctgcga

SEQ ID NO: 29433 - DNA, 25 bp, Artificial Sequence
  Description of Artificial Sequence: Synthetic oligonucleotide
ccctccagaggatgttcggctgcga

SEQ ID NO: 29434 - DNA, 25 bp, Artificial Sequence
  Description of Artificial Sequence: Synthetic oligonucleotide
cctccagaggatgttcggctgcgac

SEQ ID NO: 29435 - DNA, 26 bp, Artificial Sequence
  Description of Artificial Sequence: Synthetic oligonucleotide
ctccagaggatgttcggctgcgacgt

SEQ ID NO: 29436 - DNA, 26 bp, Artificial Sequence
  Description of Artificial Sequence: Synthetic oligonucleotide
tccagaggatgttcggctgcgacgtg

SEQ ID NO: 29437 - DNA, 25 bp, Artificial Sequence
  Description of Artificial Sequence: Synthetic oligonucleotide
ccagaggatgttcggctgcgacgtg

SEQ ID NO: 29438 - DNA, 25 bp, Artificial Sequence
  Description of Artificial Sequence: Synthetic oligonucleotide
cagaggatgttcggctgcgacgtgg

SEQ ID NO: 29439 - DNA, 25 bp, Artificial Sequence
  Description of Artificial Sequence: Synthetic oligonucleotide
agaggatgttcggctgcgacgtggg

SEQ ID NO: 29440 - DNA, 24 bp, Artificial Sequence
  Description of Artificial Sequence: Synthetic oligonucleotide
gaggatgttcggctgcgacgtggg

SEQ ID NO: 29441 - DNA, 24 bp, Artificial Sequence
  Description of Artificial Sequence: Synthetic oligonucleotide
aggatgttcggctgcgacgtgggg

SEQ ID NO: 29442 - DNA, 23 bp, Artificial Sequence
  Description of Artificial Sequence: Synthetic oligonucleotide
ggatgttcggctgcgacgtgggg

SEQ ID NO: 29443 - DNA, 23 bp, Artificial Sequence
  Description of Artificial Sequence: Synthetic oligonucleotide
gatgttcggctgcgacgtggggc

SEQ ID NO: 29444 - DNA, 23 bp, Artificial Sequence
  Description of Artificial Sequence: Synthetic oligonucleotide
atgttcggctgcgacgtggggcc

SEQ ID NO: 29445 - DNA, 22 bp, Artificial Sequence
  Description of Artificial Sequence: Synthetic oligonucleotide
tgttcggctgcgacgtggggcc

SEQ ID NO: 29446 - DNA, 21 bp, Artificial Sequence
  Description of Artificial Sequence: Synthetic oligonucleotide
gttcggctgcgacgtggggcc

SEQ ID NO: 29447 - DNA, 21 bp, Artificial Sequence
  Description of Artificial Sequence: Synthetic oligonucleotide
ttcggctgcgacgtggggccg

SEQ ID NO: 29448 - DNA, 20 bp, Artificial Sequence
  Description of Artificial Sequence: Synthetic oligonucleotide
tcggctgcgacgtggggccg

SEQ ID NO: 29449 - DNA, 26 bp, Artificial Sequence
  Description of Artificial Sequence: Synthetic oligonucleotide
ggccggagtattgggaccgggagata

SEQ ID NO: 29450 - DNA, 27 bp, Artificial Sequence
  Description of Artificial Sequence: Synthetic oligonucleotide
gccggagtattgggaccgggagataca

SEQ ID NO: 29451 - DNA, 27 bp, Artificial Sequence
  Description of Artificial Sequence: Synthetic oligonucleotide
ccggagtattgggaccgggagatacag

SEQ ID NO: 29452 - DNA, 29 bp, Artificial Sequence
  Description of Artificial Sequence: Synthetic oligonucleotide
cggagtattgggaccgggagatacagatc

SEQ ID NO: 29453 - DNA, 30 bp, Artificial Sequence
  Description of Artificial Sequence: Synthetic oligonucleotide
ggagtattgggaccgggagatacagatctc

SEQ ID NO: 29454 - DNA, 30 bp, Artificial Sequence
  Description of Artificial Sequence: Synthetic oligonucleotide
gagtattgggaccgggagatacagatctcc

SEQ ID NO: 29455 - DNA, 32 bp, Artificial Sequence
  Description of Artificial Sequence: Synthetic oligonucleotide
agtattgggaccgggagatacagatctccaag

SEQ ID NO: 29456 - DNA, 31 bp, Artificial Sequence
  Description of Artificial Sequence: Synthetic oligonucleotide
gtattgggaccgggagatacagatctccaag

SEQ ID NO: 29457 - DNA, 32 bp, Artificial Sequence
  Description of Artificial Sequence: Synthetic oligonucleotide
tattgggaccgggagatacagatctccaagac

SEQ ID NO: 29458 - DNA, 31 bp, Artificial Sequence
  Description of Artificial Sequence: Synthetic oligonucleotide
attgggaccgggagatacagatctccaagac

SEQ ID NO: 29459 - DNA, 30 bp, Artificial Sequence
  Description of Artificial Sequence: Synthetic oligonucleotide
ttgggaccgggagatacagatctccaagac

SEQ ID NO: 29460 - DNA, 29 bp, Artificial Sequence
  Description of Artificial Sequence: Synthetic oligonucleotide
tgggaccgggagatacagatctccaagac

SEQ ID NO: 29461 - DNA, 28 bp, Artificial Sequence
  Description of Artificial Sequence: Synthetic oligonucleotide
gggaccgggagatacagatctccaagac

SEQ ID NO: 29462 - DNA, 28 bp, Artificial Sequence
  Description of Artificial Sequence: Synthetic oligonucleotide
ggaccgggagatacagatctccaagacc

SEQ ID NO: 29463 - DNA, 30 bp, Artificial Sequence
  Description of Artificial Sequence: Synthetic oligonucleotide
gaccgggagatacagatctccaagaccaac

SEQ ID NO: 29464 - DNA, 31 bp, Artificial Sequence
  Description of Artificial Sequence: Synthetic oligonucleotide
accgggagatacagatctccaagaccaacac

SEQ ID NO: 29465 - DNA, 30 bp, Artificial Sequence
  Description of Artificial Sequence: Synthetic oligonucleotide
ccgggagatacagatctccaagaccaacac

SEQ ID NO: 29466 - DNA, 31 bp, Artificial Sequence
  Description of Artificial Sequence: Synthetic oligonucleotide
cgggagatacagatctccaagaccaacacac

SEQ ID NO: 29467 - DNA, 32 bp, Artificial Sequence
  Description of Artificial Sequence: Synthetic oligonucleotide
gggagatacagatctccaagaccaacacacag

SEQ ID NO: 29468 - DNA, 33 bp, Artificial Sequence
  Description of Artificial Sequence: Synthetic oligonucleotide
ggagatacagatctccaagaccaacacacagac

SEQ ID NO: 29469 - DNA, 36 bp, Artificial Sequence
  Description of Artificial Sequence: Synthetic oligonucleotide
gagatacagatctccaagaccaacacacagacttac

SEQ ID NO: 29470 - DNA, 36 bp, Artificial Sequence
  Description of Artificial Sequence: Synthetic oligonucleotide
agatacagatctccaagaccaacacacagacttacc

SEQ ID NO: 29471 - DNA, 35 bp, Artificial Sequence
  Description of Artificial Sequence: Synthetic oligonucleotide
gatacagatctccaagaccaacacacagacttacc

SEQ ID NO: 29472 - DNA, 35 bp, Artificial Sequence
  Description of Artificial Sequence: Synthetic oligonucleotide
atacagatctccaagaccaacacacagacttaccg

SEQ ID NO: 29473 - DNA, 34 bp, Artificial Sequence
  Description of Artificial Sequence: Synthetic oligonucleotide
tacagatctccaagaccaacacacagacttaccg

SEQ ID NO: 29474 - DNA, 22 bp, Artificial Sequence
  Description of Artificial Sequence: Synthetic oligonucleotide
gctcctggaccgccgcggacaa

SEQ ID NO: 29475 - DNA, 22 bp, Artificial Sequence
  Description of Artificial Sequence: Synthetic oligonucleotide
ctcctggaccgccgcggacaag

SEQ ID NO: 29476 - DNA, 22 bp, Artificial Sequence
  Description of Artificial Sequence: Synthetic oligonucleotide
tcctggaccgccgcggacaagg

SEQ ID NO: 29477 - DNA, 21 bp, Artificial Sequence
  Description of Artificial Sequence: Synthetic oligonucleotide
cctggaccgccgcggacaagg

SEQ ID NO: 29478 - DNA, 21 bp, Artificial Sequence
  Description of Artificial Sequence: Synthetic oligonucleotide
ctggaccgccgcggacaaggc

SEQ ID NO: 29479 - DNA, 21 bp, Artificial Sequence
  Description of Artificial Sequence: Synthetic oligonucleotide
tggaccgccgcggacaaggcg

SEQ ID NO: 29480 - DNA, 20 bp, Artificial Sequence
  Description of Artificial Sequence: Synthetic oligonucleotide
ggaccgccgcggacaaggcg

SEQ ID NO: 29481 - DNA, 20 bp, Artificial Sequence
  Description of Artificial Sequence: Synthetic oligonucleotide
gaccgccgcggacaaggcgg

SEQ ID NO: 29482 - DNA, 21 bp, Artificial Sequence
  Description of Artificial Sequence: Synthetic oligonucleotide
accgccgcggacaaggcggct

SEQ ID NO: 29483 - DNA, 20 bp, Artificial Sequence
  Description of Artificial Sequence: Synthetic oligonucleotide
ccgccgcggacaaggcggct

SEQ ID NO: 29484 - DNA, 21 bp, Artificial Sequence
  Description of Artificial Sequence: Synthetic oligonucleotide
cgccgcggacaaggcggctca

SEQ ID NO: 29485 - DNA, 23 bp, Artificial Sequence
  Description of Artificial Sequence: Synthetic oligonucleotide
gccgcggacaaggcggctcagat

SEQ ID NO: 29486 - DNA, 24 bp, Artificial Sequence
  Description of Artificial Sequence: Synthetic oligonucleotide
ccgcggacaaggcggctcagatca

SEQ ID NO: 29487 - DNA, 24 bp, Artificial Sequence
  Description of Artificial Sequence: Synthetic oligonucleotide
cgcggacaaggcggctcagatcac

SEQ ID NO: 29488 - DNA, 24 bp, Artificial Sequence
  Description of Artificial Sequence: Synthetic oligonucleotide
gcggacaaggcggctcagatcacc

SEQ ID NO: 29489 - DNA, 25 bp, Artificial Sequence
  Description of Artificial Sequence: Synthetic oligonucleotide
cggacaaggcggctcagatcaccca

SEQ ID NO: 29490 - DNA, 25 bp, Artificial Sequence
  Description of Artificial Sequence: Synthetic oligonucleotide
ggacaaggcggctcagatcacccag

SEQ ID NO: 29491 - DNA, 25 bp, Artificial Sequence
  Description of Artificial Sequence: Synthetic oligonucleotide
gacaaggcggctcagatcacccagc

SEQ ID NO: 29492 - DNA, 25 bp, Artificial Sequence
  Description of Artificial Sequence: Synthetic oligonucleotide
acaaggcggctcagatcacccagcg

SEQ ID NO: 29493 - DNA, 24 bp, Artificial Sequence
  Description of Artificial Sequence: Synthetic oligonucleotide
caaggcggctcagatcacccagcg

SEQ ID NO: 29494 - DNA, 26 bp, Artificial Sequence
  Description of Artificial Sequence: Synthetic oligonucleotide
aaggcggctcagatcacccagcgcaa

SEQ ID NO: 29495 - DNA, 25 bp, Artificial Sequence
  Description of Artificial Sequence: Synthetic oligonucleotide
aggcggctcagatcacccagcgcaa

SEQ ID NO: 29496 - DNA, 30 bp, Artificial Sequence
  Description of Artificial Sequence: Synthetic oligonucleotide
ggagacacagatctccaagaccaacacacg

SEQ ID NO: 29497 - DNA, 30 bp, Artificial Sequence
  Description of Artificial Sequence: Synthetic oligonucleotide
gagacacagatctccaagaccaacacacgg

SEQ ID NO: 29498 - DNA, 31 bp, Artificial Sequence
  Description of Artificial Sequence: Synthetic oligonucleotide
agacacagatctccaagaccaacacacggac

SEQ ID NO: 29499 - DNA, 30 bp, Artificial Sequence
  Description of Artificial Sequence: Synthetic oligonucleotide
gacacagatctccaagaccaacacacggac

SEQ ID NO: 29500 - DNA, 33 bp, Artificial Sequence
  Description of Artificial Sequence: Synthetic oligonucleotide
acacagatctccaagaccaacacacggacttac

SEQ ID NO: 29501 - DNA, 32 bp, Artificial Sequence
  Description of Artificial Sequence: Synthetic oligonucleotide
cacagatctccaagaccaacacacggacttac

SEQ ID NO: 29502 - DNA, 32 bp, Artificial Sequence
  Description of Artificial Sequence: Synthetic oligonucleotide
acagatctccaagaccaacacacggacttacc

SEQ ID NO: 29503 - DNA, 31 bp, Artificial Sequence
  Description of Artificial Sequence: Synthetic oligonucleotide
cagatctccaagaccaacacacggacttacc

SEQ ID NO: 29504 - DNA, 31 bp, Artificial Sequence
  Description of Artificial Sequence: Synthetic oligonucleotide
agatctccaagaccaacacacggacttaccg

SEQ ID NO: 29505 - DNA, 30 bp, Artificial Sequence
  Description of Artificial Sequence: Synthetic oligonucleotide
gatctccaagaccaacacacggacttaccg

SEQ ID NO: 29506 - DNA, 31 bp, Artificial Sequence
  Description of Artificial Sequence: Synthetic oligonucleotide
atctccaagaccaacacacggacttaccgag

SEQ ID NO: 29507 - DNA, 30 bp, Artificial Sequence
  Description of Artificial Sequence: Synthetic oligonucleotide
tctccaagaccaacacacggacttaccgag

SEQ ID NO: 29508 - DNA, 29 bp, Artificial Sequence
  Description of Artificial Sequence: Synthetic oligonucleotide
ctccaagaccaacacacggacttaccgag

SEQ ID NO: 29509 - DNA, 30 bp, Artificial Sequence
  Description of Artificial Sequence: Synthetic oligonucleotide
tccaagaccaacacacggacttaccgagag

SEQ ID NO: 29510 - DNA, 29 bp, Artificial Sequence
  Description of Artificial Sequence: Synthetic oligonucleotide
ccaagaccaacacacggacttaccgagag

SEQ ID NO: 29511 - DNA, 30 bp, Artificial Sequence
  Description of Artificial Sequence: Synthetic oligonucleotide
caagaccaacacacggacttaccgagagag

SEQ ID NO: 29512 - DNA, 30 bp, Artificial Sequence
  Description of Artificial Sequence: Synthetic oligonucleotide
aagaccaacacacggacttaccgagagagc

SEQ ID NO: 29513 - DNA, 29 bp, Artificial Sequence
  Description of Artificial Sequence: Synthetic oligonucleotide
agaccaacacacggacttaccgagagagc

SEQ ID NO: 29514 - DNA, 28 bp, Artificial Sequence
  Description of Artificial Sequence: Synthetic oligonucleotide
gaccaacacacggacttaccgagagagc

SEQ ID NO: 29515 - DNA, 28 bp, Artificial Sequence
  Description of Artificial Sequence: Synthetic oligonucleotide
accaacacacggacttaccgagagagcc

SEQ ID NO: 29516 - DNA, 27 bp, Artificial Sequence
  Description of Artificial Sequence: Synthetic oligonucleotide
ccaacacacggacttaccgagagagcc

SEQ ID NO: 29517 - DNA, 28 bp, Artificial Sequence
  Description of Artificial Sequence: Synthetic oligonucleotide
caacacacggacttaccgagagagcctg

SEQ ID NO: 29518 - DNA, 28 bp, Artificial Sequence
  Description of Artificial Sequence: Synthetic oligonucleotide
aacacacggacttaccgagagagcctgc

SEQ ID NO: 29519 - DNA, 27 bp, Artificial Sequence
  Description of Artificial Sequence: Synthetic oligonucleotide
acacacggacttaccgagagagcctgc

SEQ ID NO: 29520 - DNA, 26 bp, Artificial Sequence
  Description of Artificial Sequence: Synthetic oligonucleotide
cacacggacttaccgagagagcctgc

SEQ ID NO: 29521 - DNA, 26 bp, Artificial Sequence
  Description of Artificial Sequence: Synthetic oligonucleotide
acacggacttaccgagagagcctgcg

SEQ ID NO: 29522 - DNA, 25 bp, Artificial Sequence
  Description of Artificial Sequence: Synthetic oligonucleotide
cacggacttaccgagagagcctgcg

SEQ ID NO: 29523 - DNA, 27 bp, Artificial Sequence
  Description of Artificial Sequence: Synthetic oligonucleotide
acggacttaccgagagagcctgcggaa

SEQ ID NO: 29524 - DNA, 26 bp, Artificial Sequence
  Description of Artificial Sequence: Synthetic oligonucleotide
cggacttaccgagagagcctgcggaa

SEQ ID NO: 29525 - DNA, 26 bp, Artificial Sequence
  Description of Artificial Sequence: Synthetic oligonucleotide
ggacttaccgagagagcctgcggaac

SEQ ID NO: 29526 - DNA, 24 bp, Artificial Sequence
  Description of Artificial Sequence: Synthetic oligonucleotide
cgtgggctacgtggacgacacgct

SEQ ID NO: 29527 - DNA, 27 bp, Artificial Sequence
  Description of Artificial Sequence: Synthetic oligonucleotide
tgttcgtgaggttcgacagcgacgcca

SEQ ID NO: 29528 - DNA, 36 bp, Artificial Sequence
  Description of Artificial Sequence: Synthetic oligonucleotide
gagacacagatcttcaagaccaacacacagacttac

SEQ ID NO: 29529 - DNA, 36 bp, Artificial Sequence
  Description of Artificial Sequence: Synthetic oligonucleotide
agacacagatcttcaagaccaacacacagacttacc

SEQ ID NO: 29530 - DNA, 35 bp, Artificial Sequence
  Description of Artificial Sequence: Synthetic oligonucleotide
gacacagatcttcaagaccaacacacagacttacc

SEQ ID NO: 29531 - DNA, 33 bp, Artificial Sequence
  Description of Artificial Sequence: Synthetic oligonucleotide
atctccaagaccaacacacagacttaccgagtg

SEQ ID NO: 29532 - DNA, 32 bp, Artificial Sequence
  Description of Artificial Sequence: Synthetic oligonucleotide
tctccaagaccaacacacagacttaccgagtg

SEQ ID NO: 29533 - DNA, 31 bp, Artificial Sequence
  Description of Artificial Sequence: Synthetic oligonucleotide
ctccaagaccaacacacagacttaccgagtg

SEQ ID NO: 29534 - DNA, 33 bp, Artificial Sequence
  Description of Artificial Sequence: Synthetic oligonucleotide
tccaagaccaacacacagacttaccgagtgaac

SEQ ID NO: 29535 - DNA, 32 bp, Artificial Sequence
  Description of Artificial Sequence: Synthetic oligonucleotide
ccaagaccaacacacagacttaccgagtgaac

SEQ ID NO: 29536 - DNA, 32 bp, Artificial Sequence
  Description of Artificial Sequence: Synthetic oligonucleotide
caagaccaacacacagacttaccgagtgaacc

SEQ ID NO: 29537 - DNA, 33 bp, Artificial Sequence
  Description of Artificial Sequence: Synthetic oligonucleotide
aagaccaacacacagacttaccgagtgaacctg

SEQ ID NO: 29538 - DNA, 32 bp, Artificial Sequence
  Description of Artificial Sequence: Synthetic oligonucleotide
agaccaacacacagacttaccgagtgaacctg

SEQ ID NO: 29539 - DNA, 31 bp, Artificial Sequence
  Description of Artificial Sequence: Synthetic oligonucleotide
gaccaacacacagacttaccgagtgaacctg

SEQ ID NO: 29540 - DNA, 31 bp, Artificial Sequence
  Description of Artificial Sequence: Synthetic oligonucleotide
accaacacacagacttaccgagtgaacctgc

SEQ ID NO: 29541 - DNA, 30 bp, Artificial Sequence
  Description of Artificial Sequence: Synthetic oligonucleotide
ccaacacacagacttaccgagtgaacctgc

SEQ ID NO: 29542 - DNA, 30 bp, Artificial Sequence
  Description of Artificial Sequence: Synthetic oligonucleotide
caacacacagacttaccgagtgaacctgcg

SEQ ID NO: 29543 - DNA, 30 bp, Artificial Sequence
  Description of Artificial Sequence: Synthetic oligonucleotide
aacacacagacttaccgagtgaacctgcgg

SEQ ID NO: 29544 - DNA, 29 bp, Artificial Sequence
  Description of Artificial Sequence: Synthetic oligonucleotide
acacacagacttaccgagtgaacctgcgg

SEQ ID NO: 29545 - DNA, 28 bp, Artificial Sequence
  Description of Artificial Sequence: Synthetic oligonucleotide
cacacagacttaccgagtgaacctgcgg

SEQ ID NO: 29546 - DNA, 30 bp, Artificial Sequence
  Description of Artificial Sequence: Synthetic oligonucleotide
acacagacttaccgagtgaacctgcggaac

SEQ ID NO: 29547 - DNA, 29 bp, Artificial Sequence
  Description of Artificial Sequence: Synthetic oligonucleotide
cacagacttaccgagtgaacctgcggaac

SEQ ID NO: 29548 - DNA, 29 bp, Artificial Sequence
  Description of Artificial Sequence: Synthetic oligonucleotide
acagacttaccgagtgaacctgcggaacc

SEQ ID NO: 29549 - DNA, 28 bp, Artificial Sequence
  Description of Artificial Sequence: Synthetic oligonucleotide
cagacttaccgagtgaacctgcggaacc

SEQ ID NO: 29550 - DNA, 29 bp, Artificial Sequence
  Description of Artificial Sequence: Synthetic oligonucleotide
agacttaccgagtgaacctgcggaacctg

SEQ ID NO: 29551 - DNA, 28 bp, Artificial Sequence
  Description of Artificial Sequence: Synthetic oligonucleotide
gacttaccgagtgaacctgcggaacctg

SEQ ID NO: 29552 - DNA, 28 bp, Artificial Sequence
  Description of Artificial Sequence: Synthetic oligonucleotide
acttaccgagtgaacctgcggaacctgc

SEQ ID NO: 29553 - DNA, 27 bp, Artificial Sequence
  Description of Artificial Sequence: Synthetic oligonucleotide
cttaccgagtgaacctgcggaacctgc

SEQ ID NO: 29554 - DNA, 27 bp, Artificial Sequence
  Description of Artificial Sequence: Synthetic oligonucleotide
ttaccgagtgaacctgcggaacctgcg

SEQ ID NO: 29555 - DNA, 26 bp, Artificial Sequence
  Description of Artificial Sequence: Synthetic oligonucleotide
taccgagtgaacctgcggaacctgcg

SEQ ID NO: 29556 - DNA, 25 bp, Artificial Sequence
  Description of Artificial Sequence: Synthetic oligonucleotide
accgagtgaacctgcggaacctgcg

SEQ ID NO: 29557 - DNA, 24 bp, Artificial Sequence
  Description of Artificial Sequence: Synthetic oligonucleotide
ccgagtgaacctgcggaacctgcg

SEQ ID NO: 29558 - DNA, 24 bp, Artificial Sequence
  Description of Artificial Sequence: Synthetic oligonucleotide
cgagtgaacctgcggaacctgcgc

SEQ ID NO: 29559 - DNA, 24 bp, Artificial Sequence
  Description of Artificial Sequence: Synthetic oligonucleotide
gagtgaacctgcggaacctgcgcg

SEQ ID NO: 29560 - DNA, 24 bp, Artificial Sequence
  Description of Artificial Sequence: Synthetic oligonucleotide
agtgaacctgcggaacctgcgcgg

SEQ ID NO: 29561 - DNA, 23 bp, Artificial Sequence
  Description of Artificial Sequence: Synthetic oligonucleotide
gtgaacctgcggaacctgcgcgg

SEQ ID NO: 29562 - DNA, 25 bp, Artificial Sequence
  Description of Artificial Sequence: Synthetic oligonucleotide
tgaacctgcggaacctgcgcggcta

SEQ ID NO: 29563 - DNA, 25 bp, Artificial Sequence
  Description of Artificial Sequence: Synthetic oligonucleotide
gcctcctccgcgggcataaccagtt

SEQ ID NO: 29564 - DNA, 25 bp, Artificial Sequence
  Description of Artificial Sequence: Synthetic oligonucleotide
cctcctccgcgggcataaccagttc

SEQ ID NO: 29565 - DNA, 25 bp, Artificial Sequence
  Description of Artificial Sequence: Synthetic oligonucleotide
ctcctccgcgggcataaccagttcg

SEQ ID NO: 29566 - DNA, 25 bp, Artificial Sequence
  Description of Artificial Sequence: Synthetic oligonucleotide
tcctccgcgggcataaccagttcgc

SEQ ID NO: 29567 - DNA, 24 bp, Artificial Sequence
  Description of Artificial Sequence: Synthetic oligonucleotide
cctccgcgggcataaccagttcgc

SEQ ID NO: 29568 - DNA, 26 bp, Artificial Sequence
  Description of Artificial Sequence: Synthetic oligonucleotide
ctccgcgggcataaccagttcgccta

SEQ ID NO: 29569 - DNA, 26 bp, Artificial Sequence
  Description of Artificial Sequence: Synthetic oligonucleotide
tccgcgggcataaccagttcgcctac

SEQ ID NO: 29570 - DNA, 25 bp, Artificial Sequence
  Description of Artificial Sequence: Synthetic oligonucleotide
ccgcgggcataaccagttcgcctac

SEQ ID NO: 29571 - DNA, 26 bp, Artificial Sequence
  Description of Artificial Sequence: Synthetic oligonucleotide
cgcgggcataaccagttcgcctacga

SEQ ID NO: 29572 - DNA, 26 bp, Artificial Sequence
  Description of Artificial Sequence: Synthetic oligonucleotide
gcgggcataaccagttcgcctacgac

SEQ ID NO: 29573 - DNA, 26 bp, Artificial Sequence
  Description of Artificial Sequence: Synthetic oligonucleotide
cgggcataaccagttcgcctacgacg

SEQ ID NO: 29574 - DNA, 26 bp, Artificial Sequence
  Description of Artificial Sequence: Synthetic oligonucleotide
gggcataaccagttcgcctacgacgg

SEQ ID NO: 29575 - DNA, 27 bp, Artificial Sequence
  Description of Artificial Sequence: Synthetic oligonucleotide
ggcataaccagttcgcctacgacggca

SEQ ID NO: 29576 - DNA, 28 bp, Artificial Sequence
  Description of Artificial Sequence: Synthetic oligonucleotide
gcataaccagttcgcctacgacggcaag

SEQ ID NO: 29577 - DNA, 28 bp, Artificial Sequence
  Description of Artificial Sequence: Synthetic oligonucleotide
cataaccagttcgcctacgacggcaagg

SEQ ID NO: 29578 - DNA, 29 bp, Artificial Sequence
  Description of Artificial Sequence: Synthetic oligonucleotide
tggacgacacccagttcgtgaggttcaac

SEQ ID NO: 29579 - DNA, 28 bp, Artificial Sequence
  Description of Artificial Sequence: Synthetic oligonucleotide
ggacgacacccagttcgtgaggttcaac

SEQ ID NO: 29580 - DNA, 29 bp, Artificial Sequence
  Description of Artificial Sequence: Synthetic oligonucleotide
gacgacacccagttcgtgaggttcaacag

SEQ ID NO: 29581 - DNA, 29 bp, Artificial Sequence
  Description of Artificial Sequence: Synthetic oligonucleotide
acgacacccagttcgtgaggttcaacagc

SEQ ID NO: 29582 - DNA, 28 bp, Artificial Sequence
  Description of Artificial Sequence: Synthetic oligonucleotide
cgacacccagttcgtgaggttcaacagc

SEQ ID NO: 29583 - DNA, 28 bp, Artificial Sequence
  Description of Artificial Sequence: Synthetic oligonucleotide
gacacccagttcgtgaggttcaacagcg

SEQ ID NO: 29584 - DNA, 29 bp, Artificial Sequence
  Description of Artificial Sequence: Synthetic oligonucleotide
acacccagttcgtgaggttcaacagcgac

SEQ ID NO: 29585 - DNA, 28 bp, Artificial Sequence
  Description of Artificial Sequence: Synthetic oligonucleotide
cacccagttcgtgaggttcaacagcgac

SEQ ID NO: 29586 - DNA, 28 bp, Artificial Sequence
  Description of Artificial Sequence: Synthetic oligonucleotide
acccagttcgtgaggttcaacagcgacg

SEQ ID NO: 29587 - DNA, 27 bp, Artificial Sequence
  Description of Artificial Sequence: Synthetic oligonucleotide
cccagttcgtgaggttcaacagcgacg

SEQ ID NO: 29588 - DNA, 27 bp, Artificial Sequence
  Description of Artificial Sequence: Synthetic oligonucleotide
ccagttcgtgaggttcaacagcgacgc

SEQ ID NO: 29589 - DNA, 27 bp, Artificial Sequence
  Description of Artificial Sequence: Synthetic oligonucleotide
cagttcgtgaggttcaacagcgacgcc

SEQ ID NO: 29590 - DNA, 27 bp, Artificial Sequence
  Description of Artificial Sequence: Synthetic oligonucleotide
agttcgtgaggttcaacagcgacgccg

SEQ ID NO: 29591 - DNA, 26 bp, Artificial Sequence
  Description of Artificial Sequence: Synthetic oligonucleotide
gttcgtgaggttcaacagcgacgccg

SEQ ID NO: 29592 - DNA, 26 bp, Artificial Sequence
  Description of Artificial Sequence: Synthetic oligonucleotide
ttcgtgaggttcaacagcgacgccgc

SEQ ID NO: 29593 - DNA, 25 bp, Artificial Sequence
  Description of Artificial Sequence: Synthetic oligonucleotide
tcgtgaggttcaacagcgacgccgc

SEQ ID NO: 29594 - DNA, 24 bp, Artificial Sequence
  Description of Artificial Sequence: Synthetic oligonucleotide
cgtgaggttcaacagcgacgccgc

SEQ ID NO: 29595 - DNA, 25 bp, Artificial Sequence
  Description of Artificial Sequence: Synthetic oligonucleotide
gtgaggttcaacagcgacgccgcga

SEQ ID NO: 29596 - DNA, 26 bp, Artificial Sequence
  Description of Artificial Sequence: Synthetic oligonucleotide
tgaggttcaacagcgacgccgcgagt

SEQ ID NO: 29597 - DNA, 25 bp, Artificial Sequence
  Description of Artificial Sequence: Synthetic oligonucleotide
gaggttcaacagcgacgccgcgagt

SEQ ID NO: 29598 - DNA, 25 bp, Artificial Sequence
  Description of Artificial Sequence: Synthetic oligonucleotide
aggttcaacagcgacgccgcgagtc

SEQ ID NO: 29599 - DNA, 24 bp, Artificial Sequence
  Description of Artificial Sequence: Synthetic oligonucleotide
ggttcaacagcgacgccgcgagtc

SEQ ID NO: 29600 - DNA, 24 bp, Artificial Sequence
  Description of Artificial Sequence: Synthetic oligonucleotide
gttcaacagcgacgccgcgagtcc

SEQ ID NO: 29601 - DNA, 25 bp, Artificial Sequence
  Description of Artificial Sequence: Synthetic oligonucleotide
ttcaacagcgacgccgcgagtccga

SEQ ID NO: 29602 - DNA, 24 bp, Artificial Sequence
  Description of Artificial Sequence: Synthetic oligonucleotide
tcaacagcgacgccgcgagtccga

SEQ ID NO: 29603 - DNA, 23 bp, Artificial Sequence
  Description of Artificial Sequence: Synthetic oligonucleotide
caacagcgacgccgcgagtccga

SEQ ID NO: 29604 - DNA, 23 bp, Artificial Sequence
  Description of Artificial Sequence: Synthetic oligonucleotide
aacagcgacgccgcgagtccgag

SEQ ID NO: 29605 - DNA, 29 bp, Artificial Sequence
  Description of Artificial Sequence: Synthetic oligonucleotide
gagtattgggaccgggagacacagatctg

SEQ ID NO: 29606 - DNA, 29 bp, Artificial Sequence
  Description of Artificial Sequence: Synthetic oligonucleotide
agtattgggaccgggagacacagatctgc

SEQ ID NO: 29607 - DNA, 28 bp, Artificial Sequence
  Description of Artificial Sequence: Synthetic oligonucleotide
gtattgggaccgggagacacagatctgc

SEQ ID NO: 29608 - DNA, 30 bp, Artificial Sequence
  Description of Artificial Sequence: Synthetic oligonucleotide
tattgggaccgggagacacagatctgcaag

SEQ ID NO: 29609 - DNA, 29 bp, Artificial Sequence
  Description of Artificial Sequence: Synthetic oligonucleotide
attgggaccgggagacacagatctgcaag

SEQ ID NO: 29610 - DNA, 28 bp, Artificial Sequence
  Description of Artificial Sequence: Synthetic oligonucleotide
ttgggaccgggagacacagatctgcaag

SEQ ID NO: 29611 - DNA, 27 bp, Artificial Sequence
  Description of Artificial Sequence: Synthetic oligonucleotide
tgggaccgggagacacagatctgcaag

SEQ ID NO: 29612 - DNA, 27 bp, Artificial Sequence
  Description of Artificial Sequence: Synthetic oligonucleotide
gggaccgggagacacagatctgcaaga

SEQ ID NO: 29613 - DNA, 27 bp, Artificial Sequence
  Description of Artificial Sequence: Synthetic oligonucleotide
ggaccgggagacacagatctgcaagac

SEQ ID NO: 29614 - DNA, 27 bp, Artificial Sequence
  Description of Artificial Sequence: Synthetic oligonucleotide
gaccgggagacacagatctgcaagacc

SEQ ID NO: 29615 - DNA, 29 bp, Artificial Sequence
  Description of Artificial Sequence: Synthetic oligonucleotide
accgggagacacagatctgcaagaccaac

SEQ ID NO: 29616 - DNA, 28 bp, Artificial Sequence
  Description of Artificial Sequence: Synthetic oligonucleotide
ccgggagacacagatctgcaagaccaac

SEQ ID NO: 29617 - DNA, 29 bp, Artificial Sequence
  Description of Artificial Sequence: Synthetic oligonucleotide
cgggagacacagatctgcaagaccaacac

SEQ ID NO: 29618 - DNA, 30 bp, Artificial Sequence
  Description of Artificial Sequence: Synthetic oligonucleotide
gggagacacagatctgcaagaccaacacac

SEQ ID NO: 29619 - DNA, 31 bp, Artificial Sequence
  Description of Artificial Sequence: Synthetic oligonucleotide
ggagacacagatctgcaagaccaacacacag

SEQ ID NO: 29620 - DNA, 32 bp, Artificial Sequence
  Description of Artificial Sequence: Synthetic oligonucleotide
gagacacagatctgcaagaccaacacacagac

SEQ ID NO: 29621 - DNA, 35 bp, Artificial Sequence
  Description of Artificial Sequence: Synthetic oligonucleotide
agacacagatctgcaagaccaacacacagacttac

SEQ ID NO: 29622 - DNA, 34 bp, Artificial Sequence
  Description of Artificial Sequence: Synthetic oligonucleotide
gacacagatctgcaagaccaacacacagacttac

SEQ ID NO: 29623 - DNA, 25 bp, Artificial Sequence
  Description of Artificial Sequence: Synthetic oligonucleotide
acacggcggctcagatcacccagca

SEQ ID NO: 29624 - DNA, 24 bp, Artificial Sequence
  Description of Artificial Sequence: Synthetic oligonucleotide
cacggcggctcagatcacccagca

SEQ ID NO: 29625 - DNA, 26 bp, Artificial Sequence
  Description of Artificial Sequence: Synthetic oligonucleotide
acggcggctcagatcacccagcacaa

SEQ ID NO: 29626 - DNA, 25 bp, Artificial Sequence
  Description of Artificial Sequence: Synthetic oligonucleotide
cggcggctcagatcacccagcacaa

SEQ ID NO: 29627 - DNA, 27 bp, Artificial Sequence
  Description of Artificial Sequence: Synthetic oligonucleotide
ctcagatcacccagcacaagtgggagg

SEQ ID NO: 29628 - DNA, 27 bp, Artificial Sequence
  Description of Artificial Sequence: Synthetic oligonucleotide
tcagatcacccagcacaagtgggaggc

SEQ ID NO: 29629 - DNA, 26 bp, Artificial Sequence
  Description of Artificial Sequence: Synthetic oligonucleotide
cagatcacccagcacaagtgggaggc

SEQ ID NO: 29630 - DNA, 26 bp, Artificial Sequence
  Description of Artificial Sequence: Synthetic oligonucleotide
agatcacccagcacaagtgggaggcg

SEQ ID NO: 29631 - DNA, 25 bp, Artificial Sequence
  Description of Artificial Sequence: Synthetic oligonucleotide
gatcacccagcacaagtgggaggcg

SEQ ID NO: 29632 - DNA, 25 bp, Artificial Sequence
  Description of Artificial Sequence: Synthetic oligonucleotide
atcacccagcacaagtgggaggcgg

SEQ ID NO: 29633 - DNA, 24 bp, Artificial Sequence
  Description of Artificial Sequence: Synthetic oligonucleotide
tcacccagcacaagtgggaggcgg

SEQ ID NO: 29634 - DNA, 22 bp, Artificial Sequence
  Description of Artificial Sequence: Synthetic oligonucleotide
cagcacaagtgggaggcggccc

SEQ ID NO: 29635 - DNA, 23 bp, Artificial Sequence
  Description of Artificial Sequence: Synthetic oligonucleotide
cacaagtgggaggcggcccgtga

SEQ ID NO: 29636 - DNA, 23 bp, Artificial Sequence
  Description of Artificial Sequence: Synthetic oligonucleotide
acaagtgggaggcggcccgtgag

SEQ ID NO: 29637 - DNA, 28 bp, Artificial Sequence
  Description of Artificial Sequence: Synthetic oligonucleotide
ggaccgggagacacagatctccaagatc

SEQ ID NO: 29638 - DNA, 30 bp, Artificial Sequence
  Description of Artificial Sequence: Synthetic oligonucleotide
gaccgggagacacagatctccaagatcaac

SEQ ID NO: 29639 - DNA, 31 bp, Artificial Sequence
  Description of Artificial Sequence: Synthetic oligonucleotide
accgggagacacagatctccaagatcaacac

SEQ ID NO: 29640 - DNA, 30 bp, Artificial Sequence
  Description of Artificial Sequence: Synthetic oligonucleotide
ccgggagacacagatctccaagatcaacac

SEQ ID NO: 29641 - DNA, 31 bp, Artificial Sequence
  Description of Artificial Sequence: Synthetic oligonucleotide
cgggagacacagatctccaagatcaacacac

SEQ ID NO: 29642 - DNA, 32 bp, Artificial Sequence
  Description of Artificial Sequence: Synthetic oligonucleotide
gggagacacagatctccaagatcaacacacag

SEQ ID NO: 29643 - DNA, 33 bp, Artificial Sequence
  Description of Artificial Sequence: Synthetic oligonucleotide
ggagacacagatctccaagatcaacacacagac

SEQ ID NO: 29644 - DNA, 36 bp, Artificial Sequence
  Description of Artificial Sequence: Synthetic oligonucleotide
gagacacagatctccaagatcaacacacagacttac

SEQ ID NO: 29645 - DNA, 36 bp, Artificial Sequence
  Description of Artificial Sequence: Synthetic oligonucleotide
agacacagatctccaagatcaacacacagacttacc

SEQ ID NO: 29646 - DNA, 35 bp, Artificial Sequence
  Description of Artificial Sequence: Synthetic oligonucleotide
gacacagatctccaagatcaacacacagacttacc

SEQ ID NO: 29647 - DNA, 35 bp, Artificial Sequence
  Description of Artificial Sequence: Synthetic oligonucleotide
acacagatctccaagatcaacacacagacttaccg

SEQ ID NO: 29648 - DNA, 34 bp, Artificial Sequence
  Description of Artificial Sequence: Synthetic oligonucleotide
cacagatctccaagatcaacacacagacttaccg

SEQ ID NO: 29649 - DNA, 35 bp, Artificial Sequence
  Description of Artificial Sequence: Synthetic oligonucleotide
acagatctccaagatcaacacacagacttaccgag

SEQ ID NO: 29650 - DNA, 34 bp, Artificial Sequence
  Description of Artificial Sequence: Synthetic oligonucleotide
cagatctccaagatcaacacacagacttaccgag

SEQ ID NO: 29651 - DNA, 35 bp, Artificial Sequence
  Description of Artificial Sequence: Synthetic oligonucleotide
agatctccaagatcaacacacagacttaccgagag

SEQ ID NO: 29652 - DNA, 34 bp, Artificial Sequence
  Description of Artificial Sequence: Synthetic oligonucleotide
gatctccaagatcaacacacagacttaccgagag

SEQ ID NO: 29653 - DNA, 35 bp, Artificial Sequence
  Description of Artificial Sequence: Synthetic oligonucleotide
atctccaagatcaacacacagacttaccgagagag

SEQ ID NO: 29654 - DNA, 34 bp, Artificial Sequence
  Description of Artificial Sequence: Synthetic oligonucleotide
tctccaagatcaacacacagacttaccgagagag

SEQ ID NO: 29655 - DNA, 33 bp, Artificial Sequence
  Description of Artificial Sequence: Synthetic oligonucleotide
ctccaagatcaacacacagacttaccgagagag

SEQ ID NO: 29656 - DNA, 33 bp, Artificial Sequence
  Description of Artificial Sequence: Synthetic oligonucleotide
tccaagatcaacacacagacttaccgagagagc

SEQ ID NO: 29657 - DNA, 32 bp, Artificial Sequence
  Description of Artificial Sequence: Synthetic oligonucleotide
ccaagatcaacacacagacttaccgagagagc

SEQ ID NO: 29658 - DNA, 32 bp, Artificial Sequence
  Description of Artificial Sequence: Synthetic oligonucleotide
caagatcaacacacagacttaccgagagagcc

SEQ ID NO: 29659 - DNA, 33 bp, Artificial Sequence
  Description of Artificial Sequence: Synthetic oligonucleotide
aagatcaacacacagacttaccgagagagcctg

SEQ ID NO: 29660 - DNA, 32 bp, Artificial Sequence
  Description of Artificial Sequence: Synthetic oligonucleotide
agatcaacacacagacttaccgagagagcctg

SEQ ID NO: 29661 - DNA, 31 bp, Artificial Sequence
  Description of Artificial Sequence: Synthetic oligonucleotide
gatcaacacacagacttaccgagagagcctg

SEQ ID NO: 29662 - DNA, 31 bp, Artificial Sequence
  Description of Artificial Sequence: Synthetic oligonucleotide
atcaacacacagacttaccgagagagcctgc

SEQ ID NO: 29663 - DNA, 30 bp, Artificial Sequence
  Description of Artificial Sequence: Synthetic oligonucleotide
tcaacacacagacttaccgagagagcctgc

SEQ ID NO: 29664 - DNA, 22 bp, Artificial Sequence
  Description of Artificial Sequence: Synthetic oligonucleotide
gcaagtgggaggcggcccgtca

SEQ ID NO: 29665 - DNA, 22 bp, Artificial Sequence
  Description of Artificial Sequence: Synthetic oligonucleotide
caagtgggaggcggcccgtcag

SEQ ID NO: 29666 - DNA, 22 bp, Artificial Sequence
  Description of Artificial Sequence: Synthetic oligonucleotide
aagtgggaggcggcccgtcagg

SEQ ID NO: 29667 - DNA, 21 bp, Artificial Sequence
  Description of Artificial Sequence: Synthetic oligonucleotide
agtgggaggcggcccgtcagg

SEQ ID NO: 29668 - DNA, 20 bp, Artificial Sequence
  Description of Artificial Sequence: Synthetic oligonucleotide
gtgggaggcggcccgtcagg

SEQ ID NO: 29669 - DNA, 20 bp, Artificial Sequence
  Description of Artificial Sequence: Synthetic oligonucleotide
tgggaggcggcccgtcaggc

SEQ ID NO: 29670 - DNA, 20 bp, Artificial Sequence
  Description of Artificial Sequence: Synthetic oligonucleotide
gggaggcggcccgtcaggct

SEQ ID NO: 29671 - DNA, 20 bp, Artificial Sequence
  Description of Artificial Sequence: Synthetic oligonucleotide
ggaggcggcccgtcaggcgt

SEQ ID NO: 29672 - DNA, 20 bp, Artificial Sequence
  Description of Artificial Sequence: Synthetic oligonucleotide
gaggcggcccgtcaggcgga

SEQ ID NO: 29673 - DNA, 20 bp, Artificial Sequence
  Description of Artificial Sequence: Synthetic oligonucleotide
aggcggcccgtcaggcggag

SEQ ID NO: 29674 - DNA, 20 bp, Artificial Sequence
  Description of Artificial Sequence: Synthetic oligonucleotide
ggcggcccgtcaggcggagt

SEQ ID NO: 29675 - DNA, 20 bp, Artificial Sequence
  Description of Artificial Sequence: Synthetic oligonucleotide
gcggcccgtcaggcggagca

SEQ ID NO: 29676 - DNA, 21 bp, Artificial Sequence
  Description of Artificial Sequence: Synthetic oligonucleotide
cggcccgtcaggcggagcagt

SEQ ID NO: 29677 - DNA, 21 bp, Artificial Sequence
  Description of Artificial Sequence: Synthetic oligonucleotide
ggcccgtcaggcggagcagtg

SEQ ID NO: 29678 - DNA, 22 bp, Artificial Sequence
  Description of Artificial Sequence: Synthetic oligonucleotide
gcccgtcaggcggagcagtgga

SEQ ID NO: 29679 - DNA, 23 bp, Artificial Sequence
  Description of Artificial Sequence: Synthetic oligonucleotide
cccgtcaggcggagcagtggaga

SEQ ID NO: 29680 - DNA, 23 bp, Artificial Sequence
  Description of Artificial Sequence: Synthetic oligonucleotide
ccgtcaggcggagcagtggagag

SEQ ID NO: 29681 - DNA, 23 bp, Artificial Sequence
  Description of Artificial Sequence: Synthetic oligonucleotide
cgtcaggcggagcagtggagagc

SEQ ID NO: 29682 - DNA, 25 bp, Artificial Sequence
  Description of Artificial Sequence: Synthetic oligonucleotide
gtcaggcggagcagtggagagccta

SEQ ID NO: 29683 - DNA, 25 bp, Artificial Sequence
  Description of Artificial Sequence: Synthetic oligonucleotide
tcaggcggagcagtggagagcctac

SEQ ID NO: 29684 - DNA, 24 bp, Artificial Sequence
  Description of Artificial Sequence: Synthetic oligonucleotide
caggcggagcagtggagagcctac

SEQ ID NO: 29685 - DNA, 25 bp, Artificial Sequence
  Description of Artificial Sequence: Synthetic oligonucleotide
ctgcggaacctgcgcggctactaca

SEQ ID NO: 29686 - DNA, 27 bp, Artificial Sequence
  Description of Artificial Sequence: Synthetic oligonucleotide
tgcggaacctgcgcggctactacacaa

SEQ ID NO: 29687 - DNA, 26 bp, Artificial Sequence
  Description of Artificial Sequence: Synthetic oligonucleotide
gcggaacctgcgcggctactacacaa

SEQ ID NO: 29688 - DNA, 26 bp, Artificial Sequence
  Description of Artificial Sequence: Synthetic oligonucleotide
cggaacctgcgcggctactacacaac

SEQ ID NO: 29689 - DNA, 27 bp, Artificial Sequence
  Description of Artificial Sequence: Synthetic oligonucleotide
ggaacctgcgcggctactacacaacca

SEQ ID NO: 29690 - DNA, 27 bp, Artificial Sequence
  Description of Artificial Sequence: Synthetic oligonucleotide
gaacctgcgcggctactacacaaccag

SEQ ID NO: 29691 - DNA, 28 bp, Artificial Sequence
  Description of Artificial Sequence: Synthetic oligonucleotide
aacctgcgcggctactacacaaccagag

SEQ ID NO: 29692 - DNA, 27 bp, Artificial Sequence
  Description of Artificial Sequence: Synthetic oligonucleotide
acctgcgcggctactacacaaccagag

SEQ ID NO: 29693 - DNA, 26 bp, Artificial Sequence
  Description of Artificial Sequence: Synthetic oligonucleotide
cctgcgcggctactacacaaccagag

SEQ ID NO: 29694 - DNA, 26 bp, Artificial Sequence
  Description of Artificial Sequence: Synthetic oligonucleotide
ctgcgcggctactacacaaccagagc

SEQ ID NO: 29695 - DNA, 27 bp, Artificial Sequence
  Description of Artificial Sequence: Synthetic oligonucleotide
tgcgcggctactacacaaccagagcga

SEQ ID NO: 29696 - DNA, 26 bp, Artificial Sequence
  Description of Artificial Sequence: Synthetic oligonucleotide
gcgcggctactacacaaccagagcga

SEQ ID NO: 29697 - DNA, 26 bp, Artificial Sequence
  Description of Artificial Sequence: Synthetic oligonucleotide
cgcggctactacacaaccagagcgag

SEQ ID NO: 29698 - DNA, 26 bp, Artificial Sequence
  Description of Artificial Sequence: Synthetic oligonucleotide
gcggctactacacaaccagagcgagg

SEQ ID NO: 29699 - DNA, 26 bp, Artificial Sequence
  Description of Artificial Sequence: Synthetic oligonucleotide
cggctactacacaaccagagcgaggc

SEQ ID NO: 29700 - DNA, 26 bp, Artificial Sequence
  Description of Artificial Sequence: Synthetic oligonucleotide
ggctactacacaaccagagcgaggcc

SEQ ID NO: 29701 - DNA, 26 bp, Artificial Sequence
  Description of Artificial Sequence: Synthetic oligonucleotide
gctactacacaaccagagcgaggccg

SEQ ID NO: 29702 - DNA, 26 bp, Artificial Sequence
  Description of Artificial Sequence: Synthetic oligonucleotide
ctactacacaaccagagcgaggccgg

SEQ ID NO: 29703 - DNA, 27 bp, Artificial Sequence
  Description of Artificial Sequence: Synthetic oligonucleotide
tactacacaaccagagcgaggccgggt

SEQ ID NO: 29704 - DNA, 26 bp, Artificial Sequence
  Description of Artificial Sequence: Synthetic oligonucleotide
actacacaaccagagcgaggccgggt

SEQ ID NO: 29705 - DNA, 25 bp, Artificial Sequence
  Description of Artificial Sequence: Synthetic oligonucleotide
ctacacaaccagagcgaggccgggt

SEQ ID NO: 29706 - DNA, 26 bp, Artificial Sequence
  Description of Artificial Sequence: Synthetic oligonucleotide
tacacaaccagagcgaggccgggtct

SEQ ID NO: 29707 - DNA, 25 bp, Artificial Sequence
  Description of Artificial Sequence: Synthetic oligonucleotide
acacaaccagagcgaggccgggtct

SEQ ID NO: 29708 - DNA, 24 bp, Artificial Sequence
  Description of Artificial Sequence: Synthetic oligonucleotide
cacaaccagagcgaggccgggtct

SEQ ID NO: 29709 - DNA, 22 bp, Artificial Sequence
  Description of Artificial Sequence: Synthetic oligonucleotide
ggggagccccgcttcatcgcag

SEQ ID NO: 29710 - DNA, 22 bp, Artificial Sequence
  Description of Artificial Sequence: Synthetic oligonucleotide
gggagccccgcttcatcgcagc

SEQ ID NO: 29711 - DNA, 22 bp, Artificial Sequence
  Description of Artificial Sequence: Synthetic oligonucleotide
ggagccccgcttcatcgcagcg

SEQ ID NO: 29712 - DNA, 22 bp, Artificial Sequence
  Description of Artificial Sequence: Synthetic oligonucleotide
gagccccgcttcatcgcagcgg

SEQ ID NO: 29713 - DNA, 22 bp, Artificial Sequence
  Description of Artificial Sequence: Synthetic oligonucleotide
agccccgcttcatcgcagcggg

SEQ ID NO: 29714 - DNA, 21 bp, Artificial Sequence
  Description of Artificial Sequence: Synthetic oligonucleotide
gccccgcttcatcgcagcggg

SEQ ID NO: 29715 - DNA, 23 bp, Artificial Sequence
  Description of Artificial Sequence: Synthetic oligonucleotide
ccccgcttcatcgcagcgggcta

SEQ ID NO: 29716 - DNA, 23 bp, Artificial Sequence
  Description of Artificial Sequence: Synthetic oligonucleotide
cccgcttcatcgcagcgggctac

SEQ ID NO: 29717 - DNA, 24 bp, Artificial Sequence
  Description of Artificial Sequence: Synthetic oligonucleotide
ccgcttcatcgcagcgggctacgt

SEQ ID NO: 29718 - DNA, 24 bp, Artificial Sequence
  Description of Artificial Sequence: Synthetic oligonucleotide
cgcttcatcgcagcgggctacgtg

SEQ ID NO: 29719 - DNA, 25 bp, Artificial Sequence
  Description of Artificial Sequence: Synthetic oligonucleotide
gcttcatcgcagcgggctacgtgga

SEQ ID NO: 29720 - DNA, 25 bp, Artificial Sequence
  Description of Artificial Sequence: Synthetic oligonucleotide
cttcatcgcagcgggctacgtggac

SEQ ID NO: 29721 - DNA, 26 bp, Artificial Sequence
  Description of Artificial Sequence: Synthetic oligonucleotide
ttcatcgcagcgggctacgtggacga

SEQ ID NO: 29722 - DNA, 25 bp, Artificial Sequence
  Description of Artificial Sequence: Synthetic oligonucleotide
tcatcgcagcgggctacgtggacga

SEQ ID NO: 29723 - DNA, 24 bp, Artificial Sequence
  Description of Artificial Sequence: Synthetic oligonucleotide
catcgcagcgggctacgtggacga

SEQ ID NO: 29724 - DNA, 25 bp, Artificial Sequence
  Description of Artificial Sequence: Synthetic oligonucleotide
atcgcagcgggctacgtggacgaca

SEQ ID NO: 29725 - DNA, 24 bp, Artificial Sequence
  Description of Artificial Sequence: Synthetic oligonucleotide
tcgcagcgggctacgtggacgaca

SEQ ID NO: 29726 - DNA, 23 bp, Artificial Sequence
  Description of Artificial Sequence: Synthetic oligonucleotide
cgcagcgggctacgtggacgaca

SEQ ID NO: 29727 - DNA, 23 bp, Artificial Sequence
  Description of Artificial Sequence: Synthetic oligonucleotide
gcagcgggctacgtggacgacac

SEQ ID NO: 29728 - DNA, 23 bp, Artificial Sequence
  Description of Artificial Sequence: Synthetic oligonucleotide
cagcgggctacgtggacgacacc

SEQ ID NO: 29729 - DNA, 24 bp, Artificial Sequence
  Description of Artificial Sequence: Synthetic oligonucleotide
agcgggctacgtggacgacaccca

SEQ ID NO: 29730 - DNA, 23 bp, Artificial Sequence
  Description of Artificial Sequence: Synthetic oligonucleotide
gcgggctacgtggacgacaccca

SEQ ID NO: 29731 - DNA, 25 bp, Artificial Sequence
  Description of Artificial Sequence: Synthetic oligonucleotide
cgggctacgtggacgacacccagtt

SEQ ID NO: 29732 - DNA, 25 bp, Artificial Sequence
  Description of Artificial Sequence: Synthetic oligonucleotide
cgggcgccatggatagagcaggaga

SEQ ID NO: 29733 - DNA, 25 bp, Artificial Sequence
  Description of Artificial Sequence: Synthetic oligonucleotide
gggcgccatggatagagcaggagag

SEQ ID NO: 29734 - DNA, 25 bp, Artificial Sequence
  Description of Artificial Sequence: Synthetic oligonucleotide
ggcgccatggatagagcaggagagg

SEQ ID NO: 29735 - DNA, 25 bp, Artificial Sequence
  Description of Artificial Sequence: Synthetic oligonucleotide
gcgccatggatagagcaggagaggc

SEQ ID NO: 29736 - DNA, 25 bp, Artificial Sequence
  Description of Artificial Sequence: Synthetic oligonucleotide
cgccatggatagagcaggagaggcc

SEQ ID NO: 29737 - DNA, 25 bp, Artificial Sequence
  Description of Artificial Sequence: Synthetic oligonucleotide
gccatggatagagcaggagaggccg

SEQ ID NO: 29738 - DNA, 26 bp, Artificial Sequence
  Description of Artificial Sequence: Synthetic oligonucleotide
ccatggatagagcaggagaggccgga

SEQ ID NO: 29739 - DNA, 27 bp, Artificial Sequence
  Description of Artificial Sequence: Synthetic oligonucleotide
catggatagagcaggagaggccggagt

SEQ ID NO: 29740 - DNA, 30 bp, Artificial Sequence
  Description of Artificial Sequence: Synthetic oligonucleotide
atggatagagcaggagaggccggagtattg

SEQ ID NO: 29741 - DNA, 24 bp, Artificial Sequence
  Description of Artificial Sequence: Synthetic oligonucleotide
gagaggccggagtattgggaccgg

SEQ ID NO: 29742 - DNA, 25 bp, Artificial Sequence
  Description of Artificial Sequence: Synthetic oligonucleotide
agaggccggagtattgggaccggga

SEQ ID NO: 29743 - DNA, 24 bp, Artificial Sequence
  Description of Artificial Sequence: Synthetic oligonucleotide
gaggccggagtattgggaccggga

SEQ ID NO: 29744 - DNA, 25 bp, Artificial Sequence
  Description of Artificial Sequence: Synthetic oligonucleotide
aggccggagtattgggaccgggaga

SEQ ID NO: 29745 - DNA, 27 bp, Artificial Sequence
  Description of Artificial Sequence: Synthetic oligonucleotide
cctccagaggatgtatggctgcgacct

SEQ ID NO: 29746 - DNA, 27 bp, Artificial Sequence
  Description of Artificial Sequence: Synthetic oligonucleotide
ctccagaggatgtatggctgcgacctg

SEQ ID NO: 29747 - DNA, 28 bp, Artificial Sequence
  Description of Artificial Sequence: Synthetic oligonucleotide
acagacttaccgagagagcctgcggatc

SEQ ID NO: 29748 - DNA, 27 bp, Artificial Sequence
  Description of Artificial Sequence: Synthetic oligonucleotide
cagacttaccgagagagcctgcggatc

SEQ ID NO: 29749 - DNA, 27 bp, Artificial Sequence
  Description of Artificial Sequence: Synthetic oligonucleotide
agacttaccgagagagcctgcggatcg

SEQ ID NO: 29750 - DNA, 26 bp, Artificial Sequence
  Description of Artificial Sequence: Synthetic oligonucleotide
gacttaccgagagagcctgcggatcg

SEQ ID NO: 29751 - DNA, 26 bp, Artificial Sequence
  Description of Artificial Sequence: Synthetic oligonucleotide
acttaccgagagagcctgcggatcgc

SEQ ID NO: 29752 - DNA, 25 bp, Artificial Sequence
  Description of Artificial Sequence: Synthetic oligonucleotide
cttaccgagagagcctgcggatcgc

SEQ ID NO: 29753 - DNA, 25 bp, Artificial Sequence
  Description of Artificial Sequence: Synthetic oligonucleotide
ttaccgagagagcctgcggatcgcg

SEQ ID NO: 29754 - DNA, 24 bp, Artificial Sequence
  Description of Artificial Sequence: Synthetic oligonucleotide
taccgagagagcctgcggatcgcg

SEQ ID NO: 29755 - DNA, 24 bp, Artificial Sequence
  Description of Artificial Sequence: Synthetic oligonucleotide
ccgtgaggcggagcagctgagagt

SEQ ID NO: 29756 - DNA, 26 bp, Artificial Sequence
  Description of Artificial Sequence: Synthetic oligonucleotide
cgtgaggcggagcagctgagagtcta

SEQ ID NO: 29757 - DNA, 26 bp, Artificial Sequence
  Description of Artificial Sequence: Synthetic oligonucleotide
gtgaggcggagcagctgagagtctac

SEQ ID NO: 29758 - DNA, 27 bp, Artificial Sequence
  Description of Artificial Sequence: Synthetic oligonucleotide
tgaggcggagcagctgagagtctacct

SEQ ID NO: 29759 - DNA, 26 bp, Artificial Sequence
  Description of Artificial Sequence: Synthetic oligonucleotide
gaggcggagcagctgagagtctacct

SEQ ID NO: 29760 - DNA, 26 bp, Artificial Sequence
  Description of Artificial Sequence: Synthetic oligonucleotide
aggcggagcagctgagagtctacctg

SEQ ID NO: 29761 - DNA, 25 bp, Artificial Sequence
  Description of Artificial Sequence: Synthetic oligonucleotide
ggcggagcagctgagagtctacctg

SEQ ID NO: 29762 - DNA, 26 bp, Artificial Sequence
  Description of Artificial Sequence: Synthetic oligonucleotide
gcggagcagctgagagtctacctgga

SEQ ID NO: 29763 - DNA, 26 bp, Artificial Sequence
  Description of Artificial Sequence: Synthetic oligonucleotide
cggagcagctgagagtctacctggag

SEQ ID NO: 29764 - DNA, 26 bp, Artificial Sequence
  Description of Artificial Sequence: Synthetic oligonucleotide
ggagcagctgagagtctacctggagg

SEQ ID NO: 29765 - DNA, 26 bp, Artificial Sequence
  Description of Artificial Sequence: Synthetic oligonucleotide
gagcagctgagagtctacctggaggg

SEQ ID NO: 29766 - DNA, 26 bp, Artificial Sequence
  Description of Artificial Sequence: Synthetic oligonucleotide
agcagctgagagtctacctggagggc

SEQ ID NO: 29767 - DNA, 25 bp, Artificial Sequence
  Description of Artificial Sequence: Synthetic oligonucleotide
gcagctgagagtctacctggagggc

SEQ ID NO: 29768 - DNA, 26 bp, Artificial Sequence
  Description of Artificial Sequence: Synthetic oligonucleotide
cagctgagagtctacctggagggcct

SEQ ID NO: 29769 - DNA, 27 bp, Artificial Sequence
  Description of Artificial Sequence: Synthetic oligonucleotide
agctgagagtctacctggagggcctgt

SEQ ID NO: 29770 - DNA, 26 bp, Artificial Sequence
  Description of Artificial Sequence: Synthetic oligonucleotide
gctgagagtctacctggagggcctgt

SEQ ID NO: 29771 - DNA, 26 bp, Artificial Sequence
  Description of Artificial Sequence: Synthetic oligonucleotide
ctgagagtctacctggagggcctgtg

SEQ ID NO: 29772 - DNA, 26 bp, Artificial Sequence
  Description of Artificial Sequence: Synthetic oligonucleotide
tgagagtctacctggagggcctgtgc

SEQ ID NO: 29773 - DNA, 25 bp, Artificial Sequence
  Description of Artificial Sequence: Synthetic oligonucleotide
gagagtctacctggagggcctgtgc

SEQ ID NO: 29774 - DNA, 26 bp, Artificial Sequence
  Description of Artificial Sequence: Synthetic oligonucleotide
agagtctacctggagggcctgtgcgt

SEQ ID NO: 29775 - DNA, 25 bp, Artificial Sequence
  Description of Artificial Sequence: Synthetic oligonucleotide
gagtctacctggagggcctgtgcgt

SEQ ID NO: 29776 - DNA, 25 bp, Artificial Sequence
  Description of Artificial Sequence: Synthetic oligonucleotide
agtctacctggagggcctgtgcgtg

SEQ ID NO: 29777 - DNA, 24 bp, Artificial Sequence
  Description of Artificial Sequence: Synthetic oligonucleotide
gtctacctggagggcctgtgcgtg

SEQ ID NO: 29778 - DNA, 25 bp, Artificial Sequence
  Description of Artificial Sequence: Synthetic oligonucleotide
tctacctggagggcctgtgcgtgga

SEQ ID NO: 29779 - DNA, 22 bp, Artificial Sequence
  Description of Artificial Sequence: Synthetic oligonucleotide
aggatggcgccccgggcgctat

SEQ ID NO: 29780 - DNA, 21 bp, Artificial Sequence
  Description of Artificial Sequence: Synthetic oligonucleotide
ggatggcgccccgggcgctat

SEQ ID NO: 29781 - DNA, 21 bp, Artificial Sequence
  Description of Artificial Sequence: Synthetic oligonucleotide
gatggcgccccgggcgctatg

SEQ ID NO: 29782 - DNA, 24 bp, Artificial Sequence
  Description of Artificial Sequence: Synthetic oligonucleotide
atggcgccccgggcgctatggata

SEQ ID NO: 29783 - DNA, 23 bp, Artificial Sequence
  Description of Artificial Sequence: Synthetic oligonucleotide
tggcgccccgggcgctatggata

SEQ ID NO: 29784 - DNA, 22 bp, Artificial Sequence
  Description of Artificial Sequence: Synthetic oligonucleotide
ggcgccccgggcgctatggata

SEQ ID NO: 29785 - DNA, 23 bp, Artificial Sequence
  Description of Artificial Sequence: Synthetic oligonucleotide
gcgccccgggcgctatggataga

SEQ ID NO: 29786 - DNA, 23 bp, Artificial Sequence
  Description of Artificial Sequence: Synthetic oligonucleotide
cgccccgggcgctatggatagag

SEQ ID NO: 29787 - DNA, 24 bp, Artificial Sequence
  Description of Artificial Sequence: Synthetic oligonucleotide
gccccgggcgctatggatagagca

SEQ ID NO: 29788 - DNA, 24 bp, Artificial Sequence
  Description of Artificial Sequence: Synthetic oligonucleotide
ccccgggcgctatggatagagcag

SEQ ID NO: 29789 - DNA, 25 bp, Artificial Sequence
  Description of Artificial Sequence: Synthetic oligonucleotide
cccgggcgctatggatagagcagga

SEQ ID NO: 29790 - DNA, 25 bp, Artificial Sequence
  Description of Artificial Sequence: Synthetic oligonucleotide
ccgggcgctatggatagagcaggag

SEQ ID NO: 29791 - DNA, 25 bp, Artificial Sequence
  Description of Artificial Sequence: Synthetic oligonucleotide
cgggcgctatggatagagcaggagg

SEQ ID NO: 29792 - DNA, 25 bp, Artificial Sequence
  Description of Artificial Sequence: Synthetic oligonucleotide
gggcgctatggatagagcaggaggg

SEQ ID NO: 29793 - DNA, 25 bp, Artificial Sequence
  Description of Artificial Sequence: Synthetic oligonucleotide
ggcgctatggatagagcaggagggg

SEQ ID NO: 29794 - DNA, 25 bp, Artificial Sequence
  Description of Artificial Sequence: Synthetic oligonucleotide
gcgctatggatagagcaggaggggc

SEQ ID NO: 29795 - DNA, 25 bp, Artificial Sequence
  Description of Artificial Sequence: Synthetic oligonucleotide
cgctatggatagagcaggaggggcc

SEQ ID NO: 29796 - DNA, 25 bp, Artificial Sequence
  Description of Artificial Sequence: Synthetic oligonucleotide
gctatggatagagcaggaggggccg

SEQ ID NO: 29797 - DNA, 26 bp, Artificial Sequence
  Description of Artificial Sequence: Synthetic oligonucleotide
ctatggatagagcaggaggggccgga

SEQ ID NO: 29798 - DNA, 27 bp, Artificial Sequence
  Description of Artificial Sequence: Synthetic oligonucleotide
tatggatagagcaggaggggccggagt

SEQ ID NO: 29799 - DNA, 35 bp, Artificial Sequence
  Description of Artificial Sequence: Synthetic oligonucleotide
acacagatctccaagaccaacacacagacttactg

SEQ ID NO: 29800 - DNA, 34 bp, Artificial Sequence
  Description of Artificial Sequence: Synthetic oligonucleotide
cacagatctccaagaccaacacacagacttactg

SEQ ID NO: 29801 - DNA, 35 bp, Artificial Sequence
  Description of Artificial Sequence: Synthetic oligonucleotide
acagatctccaagaccaacacacagacttactgag

SEQ ID NO: 29802 - DNA, 34 bp, Artificial Sequence
  Description of Artificial Sequence: Synthetic oligonucleotide
cagatctccaagaccaacacacagacttactgag

SEQ ID NO: 29803 - DNA, 35 bp, Artificial Sequence
  Description of Artificial Sequence: Synthetic oligonucleotide
agatctccaagaccaacacacagacttactgagag

SEQ ID NO: 29804 - DNA, 34 bp, Artificial Sequence
  Description of Artificial Sequence: Synthetic oligonucleotide
gatctccaagaccaacacacagacttactgagag

SEQ ID NO: 29805 - DNA, 35 bp, Artificial Sequence
  Description of Artificial Sequence: Synthetic oligonucleotide
atctccaagaccaacacacagacttactgagagag

SEQ ID NO: 29806 - DNA, 34 bp, Artificial Sequence
  Description of Artificial Sequence: Synthetic oligonucleotide
tctccaagaccaacacacagacttactgagagag

SEQ ID NO: 29807 - DNA, 33 bp, Artificial Sequence
  Description of Artificial Sequence: Synthetic oligonucleotide
ctccaagaccaacacacagacttactgagagag

SEQ ID NO: 29808 - DNA, 33 bp, Artificial Sequence
  Description of Artificial Sequence: Synthetic oligonucleotide
tccaagaccaacacacagacttactgagagagc

SEQ ID NO: 29809 - DNA, 32 bp, Artificial Sequence
  Description of Artificial Sequence: Synthetic oligonucleotide
ccaagaccaacacacagacttactgagagagc

SEQ ID NO: 29810 - DNA, 32 bp, Artificial Sequence
  Description of Artificial Sequence: Synthetic oligonucleotide
caagaccaacacacagacttactgagagagcc

SEQ ID NO: 29811 - DNA, 33 bp, Artificial Sequence
  Description of Artificial Sequence: Synthetic oligonucleotide
aagaccaacacacagacttactgagagagcctg

SEQ ID NO: 29812 - DNA, 32 bp, Artificial Sequence
  Description of Artificial Sequence: Synthetic oligonucleotide
agaccaacacacagacttactgagagagcctg

SEQ ID NO: 29813 - DNA, 31 bp, Artificial Sequence
  Description of Artificial Sequence: Synthetic oligonucleotide
gaccaacacacagacttactgagagagcctg

SEQ ID NO: 29814 - DNA, 31 bp, Artificial Sequence
  Description of Artificial Sequence: Synthetic oligonucleotide
accaacacacagacttactgagagagcctgc

SEQ ID NO: 29815 - DNA, 30 bp, Artificial Sequence
  Description of Artificial Sequence: Synthetic oligonucleotide
ccaacacacagacttactgagagagcctgc

SEQ ID NO: 29816 - DNA, 30 bp, Artificial Sequence
  Description of Artificial Sequence: Synthetic oligonucleotide
caacacacagacttactgagagagcctgcg

SEQ ID NO: 29817 - DNA, 30 bp, Artificial Sequence
  Description of Artificial Sequence: Synthetic oligonucleotide
aacacacagacttactgagagagcctgcgg

SEQ ID NO: 29818 - DNA, 29 bp, Artificial Sequence
  Description of Artificial Sequence: Synthetic oligonucleotide
acacacagacttactgagagagcctgcgg

SEQ ID NO: 29819 - DNA, 28 bp, Artificial Sequence
  Description of Artificial Sequence: Synthetic oligonucleotide
cacacagacttactgagagagcctgcgg

SEQ ID NO: 29820 - DNA, 30 bp, Artificial Sequence
  Description of Artificial Sequence: Synthetic oligonucleotide
acacagacttactgagagagcctgcggaac

SEQ ID NO: 29821 - DNA, 29 bp, Artificial Sequence
  Description of Artificial Sequence: Synthetic oligonucleotide
cacagacttactgagagagcctgcggaac

SEQ ID NO: 29822 - DNA, 29 bp, Artificial Sequence
  Description of Artificial Sequence: Synthetic oligonucleotide
acagacttactgagagagcctgcggaacc

SEQ ID NO: 29823 - DNA, 28 bp, Artificial Sequence
  Description of Artificial Sequence: Synthetic oligonucleotide
cagacttactgagagagcctgcggaacc

SEQ ID NO: 29824 - DNA, 29 bp, Artificial Sequence
  Description of Artificial Sequence: Synthetic oligonucleotide
agacttactgagagagcctgcggaacctg

SEQ ID NO: 29825 - DNA, 28 bp, Artificial Sequence
  Description of Artificial Sequence: Synthetic oligonucleotide
gacttactgagagagcctgcggaacctg

SEQ ID NO: 29826 - DNA, 28 bp, Artificial Sequence
  Description of Artificial Sequence: Synthetic oligonucleotide
acttactgagagagcctgcggaacctgc

SEQ ID NO: 29827 - DNA, 27 bp, Artificial Sequence
  Description of Artificial Sequence: Synthetic oligonucleotide
cttactgagagagcctgcggaacctgc

SEQ ID NO: 29828 - DNA, 27 bp, Artificial Sequence
  Description of Artificial Sequence: Synthetic oligonucleotide
ttactgagagagcctgcggaacctgcg

SEQ ID NO: 29829 - DNA, 26 bp, Artificial Sequence
  Description of Artificial Sequence: Synthetic oligonucleotide
tactgagagagcctgcggaacctgcg

SEQ ID NO: 29830 - DNA, 25 bp, Artificial Sequence
  Description of Artificial Sequence: Synthetic oligonucleotide
actgagagagcctgcggaacctgcg

SEQ ID NO: 29831 - DNA, 24 bp, Artificial Sequence
  Description of Artificial Sequence: Synthetic oligonucleotide
ctgagagagcctgcggaacctgcg

SEQ ID NO: 29832 - DNA, 24 bp, Artificial Sequence
  Description of Artificial Sequence: Synthetic oligonucleotide
tgagagagcctgcggaacctgcgc

SEQ ID NO: 29833 - DNA, 28 bp, Artificial Sequence
  Description of Artificial Sequence: Synthetic oligonucleotide
ggagtattgggaccaggagacacggaac

SEQ ID NO: 29834 - DNA, 30 bp, Artificial Sequence
  Description of Artificial Sequence: Synthetic oligonucleotide
gagtattgggaccaggagacacggaacatg

SEQ ID NO: 29835 - DNA, 32 bp, Artificial Sequence
  Description of Artificial Sequence: Synthetic oligonucleotide
agtattgggaccaggagacacggaacatgaag

SEQ ID NO: 29836 - DNA, 31 bp, Artificial Sequence
  Description of Artificial Sequence: Synthetic oligonucleotide
gtattgggaccaggagacacggaacatgaag

SEQ ID NO: 29837 - DNA, 31 bp, Artificial Sequence
  Description of Artificial Sequence: Synthetic oligonucleotide
tattgggaccaggagacacggaacatgaagg

SEQ ID NO: 29838 - DNA, 30 bp, Artificial Sequence
  Description of Artificial Sequence: Synthetic oligonucleotide
attgggaccaggagacacggaacatgaagg

SEQ ID NO: 29839 - DNA, 29 bp, Artificial Sequence
  Description of Artificial Sequence: Synthetic oligonucleotide
ttgggaccaggagacacggaacatgaagg

SEQ ID NO: 29840 - DNA, 28 bp, Artificial Sequence
  Description of Artificial Sequence: Synthetic oligonucleotide
tgggaccaggagacacggaacatgaagg

SEQ ID NO: 29841 - DNA, 27 bp, Artificial Sequence
  Description of Artificial Sequence: Synthetic oligonucleotide
gggaccaggagacacggaacatgaagg

SEQ ID NO: 29842 - DNA, 27 bp, Artificial Sequence
  Description of Artificial Sequence: Synthetic oligonucleotide
ggaccaggagacacggaacatgaaggc

SEQ ID NO: 29843 - DNA, 27 bp, Artificial Sequence
  Description of Artificial Sequence: Synthetic oligonucleotide
gaccaggagacacggaacatgaaggcc

SEQ ID NO: 29844 - DNA, 28 bp, Artificial Sequence
  Description of Artificial Sequence: Synthetic oligonucleotide
accaggagacacggaacatgaaggcctc

SEQ ID NO: 29845 - DNA, 27 bp, Artificial Sequence
  Description of Artificial Sequence: Synthetic oligonucleotide
ccaggagacacggaacatgaaggcctc

SEQ ID NO: 29846 - DNA, 27 bp, Artificial Sequence
  Description of Artificial Sequence: Synthetic oligonucleotide
caggagacacggaacatgaaggcctcc

SEQ ID NO: 29847 - DNA, 27 bp, Artificial Sequence
  Description of Artificial Sequence: Synthetic oligonucleotide
aggagacacggaacatgaaggcctccg

SEQ ID NO: 29848 - DNA, 30 bp, Artificial Sequence
  Description of Artificial Sequence: Synthetic oligonucleotide
tggagtggctccgcagatacctgaagaatg

SEQ ID NO: 29849 - DNA, 29 bp, Artificial Sequence
  Description of Artificial Sequence: Synthetic oligonucleotide
ggagtggctccgcagatacctgaagaatg

SEQ ID NO: 29850 - DNA, 29 bp, Artificial Sequence
  Description of Artificial Sequence: Synthetic oligonucleotide
gagtggctccgcagatacctgaagaatgg

SEQ ID NO: 29851 - DNA, 29 bp, Artificial Sequence
  Description of Artificial Sequence: Synthetic oligonucleotide
agtggctccgcagatacctgaagaatggg

SEQ ID NO: 29852 - DNA, 28 bp, Artificial Sequence
  Description of Artificial Sequence: Synthetic oligonucleotide
gtggctccgcagatacctgaagaatggg

SEQ ID NO: 29853 - DNA, 30 bp, Artificial Sequence
  Description of Artificial Sequence: Synthetic oligonucleotide
tggctccgcagatacctgaagaatgggaag

SEQ ID NO: 29854 - DNA, 29 bp, Artificial Sequence
  Description of Artificial Sequence: Synthetic oligonucleotide
ggctccgcagatacctgaagaatgggaag

SEQ ID NO: 29855 - DNA, 29 bp, Artificial Sequence
  Description of Artificial Sequence: Synthetic oligonucleotide
gctccgcagatacctgaagaatgggaagg

SEQ ID NO: 29856 - DNA, 30 bp, Artificial Sequence
  Description of Artificial Sequence: Synthetic oligonucleotide
ctccgcagatacctgaagaatgggaaggag

SEQ ID NO: 29857 - DNA, 31 bp, Artificial Sequence
  Description of Artificial Sequence: Synthetic oligonucleotide
tccgcagatacctgaagaatgggaaggagac

SEQ ID NO: 29858 - DNA, 30 bp, Artificial Sequence
  Description of Artificial Sequence: Synthetic oligonucleotide
ccgcagatacctgaagaatgggaaggagac

SEQ ID NO: 29859 - DNA, 30 bp, Artificial Sequence
  Description of Artificial Sequence: Synthetic oligonucleotide
cgcagatacctgaagaatgggaaggagacg

SEQ ID NO: 29860 - DNA, 30 bp, Artificial Sequence
  Description of Artificial Sequence: Synthetic oligonucleotide
gcagatacctgaagaatgggaaggagacgc

SEQ ID NO: 29861 - DNA, 31 bp, Artificial Sequence
  Description of Artificial Sequence: Synthetic oligonucleotide
cagatacctgaagaatgggaaggagacgctg

SEQ ID NO: 29862 - DNA, 31 bp, Artificial Sequence
  Description of Artificial Sequence: Synthetic oligonucleotide
agatacctgaagaatgggaaggagacgctgc

SEQ ID NO: 29863 - DNA, 30 bp, Artificial Sequence
  Description of Artificial Sequence: Synthetic oligonucleotide
gatacctgaagaatgggaaggagacgctgc

SEQ ID NO: 29864 - DNA, 31 bp, Artificial Sequence
  Description of Artificial Sequence: Synthetic oligonucleotide
atacctgaagaatgggaaggagacgctgcag

SEQ ID NO: 29865 - DNA, 30 bp, Artificial Sequence
  Description of Artificial Sequence: Synthetic oligonucleotide
tacctgaagaatgggaaggagacgctgcag

SEQ ID NO: 29866 - DNA, 29 bp, Artificial Sequence
  Description of Artificial Sequence: Synthetic oligonucleotide
acctgaagaatgggaaggagacgctgcag

SEQ ID NO: 29867 - DNA, 28 bp, Artificial Sequence
  Description of Artificial Sequence: Synthetic oligonucleotide
cctgaagaatgggaaggagacgctgcag

SEQ ID NO: 29868 - DNA, 28 bp, Artificial Sequence
  Description of Artificial Sequence: Synthetic oligonucleotide
ctgaagaatgggaaggagacgctgcagc

SEQ ID NO: 29869 - DNA, 28 bp, Artificial Sequence
  Description of Artificial Sequence: Synthetic oligonucleotide
tgaagaatgggaaggagacgctgcagcg

SEQ ID NO: 29870 - DNA, 27 bp, Artificial Sequence
  Description of Artificial Sequence: Synthetic oligonucleotide
gaagaatgggaaggagacgctgcagcg

SEQ ID NO: 29871 - DNA, 27 bp, Artificial Sequence
  Description of Artificial Sequence: Synthetic oligonucleotide
aagaatgggaaggagacgctgcagcgc

SEQ ID NO: 29872 - DNA, 31 bp, Artificial Sequence
  Description of Artificial Sequence: Synthetic oligonucleotide
ggagacacagatctccaagaccaacacacac

SEQ ID NO: 29873 - DNA, 32 bp, Artificial Sequence
  Description of Artificial Sequence: Synthetic oligonucleotide
gagacacagatctccaagaccaacacacacac

SEQ ID NO: 29874 - DNA, 35 bp, Artificial Sequence
  Description of Artificial Sequence: Synthetic oligonucleotide
agacacagatctccaagaccaacacacacacttac

SEQ ID NO: 29875 - DNA, 34 bp, Artificial Sequence
  Description of Artificial Sequence: Synthetic oligonucleotide
gacacagatctccaagaccaacacacacacttac

SEQ ID NO: 29876 - DNA, 34 bp, Artificial Sequence
  Description of Artificial Sequence: Synthetic oligonucleotide
acacagatctccaagaccaacacacacacttacc

SEQ ID NO: 29877 - DNA, 33 bp, Artificial Sequence
  Description of Artificial Sequence: Synthetic oligonucleotide
cacagatctccaagaccaacacacacacttacc

SEQ ID NO: 29878 - DNA, 33 bp, Artificial Sequence
  Description of Artificial Sequence: Synthetic oligonucleotide
acagatctccaagaccaacacacacacttaccg

SEQ ID NO: 29879 - DNA, 32 bp, Artificial Sequence
  Description of Artificial Sequence: Synthetic oligonucleotide
cagatctccaagaccaacacacacacttaccg

SEQ ID NO: 29880 - DNA, 33 bp, Artificial Sequence
  Description of Artificial Sequence: Synthetic oligonucleotide
agatctccaagaccaacacacacacttaccgag

SEQ ID NO: 29881 - DNA, 32 bp, Artificial Sequence
  Description of Artificial Sequence: Synthetic oligonucleotide
gatctccaagaccaacacacacacttaccgag

SEQ ID NO: 29882 - DNA, 33 bp, Artificial Sequence
  Description of Artificial Sequence: Synthetic oligonucleotide
atctccaagaccaacacacacacttaccgagag

SEQ ID NO: 29883 - DNA, 32 bp, Artificial Sequence
  Description of Artificial Sequence: Synthetic oligonucleotide
tctccaagaccaacacacacacttaccgagag

SEQ ID NO: 29884 - DNA, 31 bp, Artificial Sequence
  Description of Artificial Sequence: Synthetic oligonucleotide
ctccaagaccaacacacacacttaccgagag

SEQ ID NO: 29885 - DNA, 32 bp, Artificial Sequence
  Description of Artificial Sequence: Synthetic oligonucleotide
tccaagaccaacacacacacttaccgagagag

SEQ ID NO: 29886 - DNA, 31 bp, Artificial Sequence
  Description of Artificial Sequence: Synthetic oligonucleotide
ccaagaccaacacacacacttaccgagagag

SEQ ID NO: 29887 - DNA, 31 bp, Artificial Sequence
  Description of Artificial Sequence: Synthetic oligonucleotide
caagaccaacacacacacttaccgagagagc

SEQ ID NO: 29888 - DNA, 31 bp, Artificial Sequence
  Description of Artificial Sequence: Synthetic oligonucleotide
aagaccaacacacacacttaccgagagagcc

SEQ ID NO: 29889 - DNA, 30 bp, Artificial Sequence
  Description of Artificial Sequence: Synthetic oligonucleotide
agaccaacacacacacttaccgagagagcc

SEQ ID NO: 29890 - DNA, 29 bp, Artificial Sequence
  Description of Artificial Sequence: Synthetic oligonucleotide
gaccaacacacacacttaccgagagagcc

SEQ ID NO: 29891 - DNA, 30 bp, Artificial Sequence
  Description of Artificial Sequence: Synthetic oligonucleotide
accaacacacacacttaccgagagagcctg

SEQ ID NO: 29892 - DNA, 29 bp, Artificial Sequence
  Description of Artificial Sequence: Synthetic oligonucleotide
ccaacacacacacttaccgagagagcctg

SEQ ID NO: 29893 - DNA, 29 bp, Artificial Sequence
  Description of Artificial Sequence: Synthetic oligonucleotide
caacacacacacttaccgagagagcctgc

SEQ ID NO: 29894 - DNA, 29 bp, Artificial Sequence
  Description of Artificial Sequence: Synthetic oligonucleotide
aacacacacacttaccgagagagcctgcg

SEQ ID NO: 29895 - DNA, 28 bp, Artificial Sequence
  Description of Artificial Sequence: Synthetic oligonucleotide
acacacacacttaccgagagagcctgcg

SEQ ID NO: 29896 - DNA, 27 bp, Artificial Sequence
  Description of Artificial Sequence: Synthetic oligonucleotide
cacacacacttaccgagagagcctgcg

SEQ ID NO: 29897 - DNA, 27 bp, Artificial Sequence
  Description of Artificial Sequence: Synthetic oligonucleotide
acacacacttaccgagagagcctgcgg

SEQ ID NO: 29898 - DNA, 27 bp, Artificial Sequence
  Description of Artificial Sequence: Synthetic oligonucleotide
cacacacttaccgagagagcctgcgga

SEQ ID NO: 29899 - DNA, 28 bp, Artificial Sequence
  Description of Artificial Sequence: Synthetic oligonucleotide
acacacttaccgagagagcctgcggaac

SEQ ID NO: 29900 - DNA, 27 bp, Artificial Sequence
  Description of Artificial Sequence: Synthetic oligonucleotide
cacacttaccgagagagcctgcggaac

SEQ ID NO: 29901 - DNA, 27 bp, Artificial Sequence
  Description of Artificial Sequence: Synthetic oligonucleotide
acacttaccgagagagcctgcggaacc

SEQ ID NO: 29902 - DNA, 27 bp, Artificial Sequence
  Description of Artificial Sequence: Synthetic oligonucleotide
cacttaccgagagagcctgcggaacct

SEQ ID NO: 29903 - DNA, 24 bp, Artificial Sequence
  Description of Artificial Sequence: Synthetic oligonucleotide
gacagcgacgccgcgagtctgaga

SEQ ID NO: 29904 - DNA, 25 bp, Artificial Sequence
  Description of Artificial Sequence: Synthetic oligonucleotide
acagcgacgccgcgagtctgagaga

SEQ ID NO: 29905 - DNA, 24 bp, Artificial Sequence
  Description of Artificial Sequence: Synthetic oligonucleotide
cagcgacgccgcgagtctgagaga

SEQ ID NO: 29906 - DNA, 24 bp, Artificial Sequence
  Description of Artificial Sequence: Synthetic oligonucleotide
agcgacgccgcgagtctgagagag

SEQ ID NO: 29907 - DNA, 23 bp, Artificial Sequence
  Description of Artificial Sequence: Synthetic oligonucleotide
gcgacgccgcgagtctgagagag

SEQ ID NO: 29908 - DNA, 24 bp, Artificial Sequence
  Description of Artificial Sequence: Synthetic oligonucleotide
cgacgccgcgagtctgagagagga

SEQ ID NO: 29909 - DNA, 24 bp, Artificial Sequence
  Description of Artificial Sequence: Synthetic oligonucleotide
gacgccgcgagtctgagagaggag

SEQ ID NO: 29910 - DNA, 24 bp, Artificial Sequence
  Description of Artificial Sequence: Synthetic oligonucleotide
acgccgcgagtctgagagaggagc

SEQ ID NO: 29911 - DNA, 23 bp, Artificial Sequence
  Description of Artificial Sequence: Synthetic oligonucleotide
cgccgcgagtctgagagaggagc

SEQ ID NO: 29912 - DNA, 23 bp, Artificial Sequence
  Description of Artificial Sequence: Synthetic oligonucleotide
gccgcgagtctgagagaggagcc

SEQ ID NO: 29913 - DNA, 23 bp, Artificial Sequence
  Description of Artificial Sequence: Synthetic oligonucleotide
ccgcgagtctgagagaggagccg

SEQ ID NO: 29914 - DNA, 23 bp, Artificial Sequence
  Description of Artificial Sequence: Synthetic oligonucleotide
cgcgagtctgagagaggagccgc

SEQ ID NO: 29915 - DNA, 23 bp, Artificial Sequence
  Description of Artificial Sequence: Synthetic oligonucleotide
gcgagtctgagagaggagccgcg

SEQ ID NO: 29916 - DNA, 23 bp, Artificial Sequence
  Description of Artificial Sequence: Synthetic oligonucleotide
cgagtctgagagaggagccgcgg

SEQ ID NO: 29917 - DNA, 23 bp, Artificial Sequence
  Description of Artificial Sequence: Synthetic oligonucleotide
gagtctgagagaggagccgcggg

SEQ ID NO: 29918 - DNA, 23 bp, Artificial Sequence
  Description of Artificial Sequence: Synthetic oligonucleotide
agtctgagagaggagccgcgggc

SEQ ID NO: 29919 - DNA, 22 bp, Artificial Sequence
  Description of Artificial Sequence: Synthetic oligonucleotide
gtctgagagaggagccgcgggc

SEQ ID NO: 29920 - DNA, 22 bp, Artificial Sequence
  Description of Artificial Sequence: Synthetic oligonucleotide
tctgagagaggagccgcgggcg

SEQ ID NO: 29921 - DNA, 21 bp, Artificial Sequence
  Description of Artificial Sequence: Synthetic oligonucleotide
ctgagagaggagccgcgggcg

SEQ ID NO: 29922 - DNA, 21 bp, Artificial Sequence
  Description of Artificial Sequence: Synthetic oligonucleotide
tgagagaggagccgcgggcgc

SEQ ID NO: 29923 - DNA, 23 bp, Artificial Sequence
  Description of Artificial Sequence: Synthetic oligonucleotide
tggccctgaccgagacctgggct

SEQ ID NO: 29924 - DNA, 22 bp, Artificial Sequence
  Description of Artificial Sequence: Synthetic oligonucleotide
ggccctgaccgagacctgggct

SEQ ID NO: 29925 - DNA, 22 bp, Artificial Sequence
  Description of Artificial Sequence: Synthetic oligonucleotide
gccctgaccgagacctgggctg

SEQ ID NO: 29926 - DNA, 22 bp, Artificial Sequence
  Description of Artificial Sequence: Synthetic oligonucleotide
ccctgaccgagacctgggctgg

SEQ ID NO: 29927 - DNA, 23 bp, Artificial Sequence
  Description of Artificial Sequence: Synthetic oligonucleotide
cctgaccgagacctgggctggct

SEQ ID NO: 29928 - DNA, 23 bp, Artificial Sequence
  Description of Artificial Sequence: Synthetic oligonucleotide
ctgaccgagacctgggctggctc

SEQ ID NO: 29929 - DNA, 23 bp, Artificial Sequence
  Description of Artificial Sequence: Synthetic oligonucleotide
tgaccgagacctgggctggctcc

SEQ ID NO: 29930 - DNA, 22 bp, Artificial Sequence
  Description of Artificial Sequence: Synthetic oligonucleotide
gaccgagacctgggctggctcc

SEQ ID NO: 29931 - DNA, 23 bp, Artificial Sequence
  Description of Artificial Sequence: Synthetic oligonucleotide
accgagacctgggctggctccca

SEQ ID NO: 29932 - DNA, 22 bp, Artificial Sequence
  Description of Artificial Sequence: Synthetic oligonucleotide
ccgagacctgggctggctccca

SEQ ID NO: 29933 - DNA, 23 bp, Artificial Sequence
  Description of Artificial Sequence: Synthetic oligonucleotide
cgagacctgggctggctcccact

SEQ ID NO: 29934 - DNA, 23 bp, Artificial Sequence
  Description of Artificial Sequence: Synthetic oligonucleotide
gagacctgggctggctcccactc

SEQ ID NO: 29935 - DNA, 25 bp, Artificial Sequence
  Description of Artificial Sequence: Synthetic oligonucleotide
agacctgggctggctcccactccat

SEQ ID NO: 29936 - DNA, 24 bp, Artificial Sequence
  Description of Artificial Sequence: Synthetic oligonucleotide
gacctgggctggctcccactccat

SEQ ID NO: 29937 - DNA, 25 bp, Artificial Sequence
  Description of Artificial Sequence: Synthetic oligonucleotide
acctgggctggctcccactccatga

SEQ ID NO: 29938 - DNA, 24 bp, Artificial Sequence
  Description of Artificial Sequence: Synthetic oligonucleotide
cctgggctggctcccactccatga

SEQ ID NO: 29939 - DNA, 24 bp, Artificial Sequence
  Description of Artificial Sequence: Synthetic oligonucleotide
ctgggctggctcccactccatgag

SEQ ID NO: 29940 - DNA, 27 bp, Artificial Sequence
  Description of Artificial Sequence: Synthetic oligonucleotide
tgggctggctcccactccatgaggtat

SEQ ID NO: 29941 - DNA, 27 bp, Artificial Sequence
  Description of Artificial Sequence: Synthetic oligonucleotide
gggctggctcccactccatgaggtatt

SEQ ID NO: 29942 - DNA, 28 bp, Artificial Sequence
  Description of Artificial Sequence: Synthetic oligonucleotide
ggctggctcccactccatgaggtatttc

SEQ ID NO: 29943 - DNA, 28 bp, Artificial Sequence
  Description of Artificial Sequence: Synthetic oligonucleotide
gctggctcccactccatgaggtatttcc

SEQ ID NO: 29944 - DNA, 29 bp, Artificial Sequence
  Description of Artificial Sequence: Synthetic oligonucleotide
ctggctcccactccatgaggtatttccac

SEQ ID NO: 29945 - DNA, 30 bp, Artificial Sequence
  Description of Artificial Sequence: Synthetic oligonucleotide
tggctcccactccatgaggtatttccacac

SEQ ID NO: 29946 - DNA, 20 bp, Artificial Sequence
  Description of Artificial Sequence: Synthetic oligonucleotide
gacggagccccgggcgcctt

SEQ ID NO: 29947 - DNA, 20 bp, Artificial Sequence
  Description of Artificial Sequence: Synthetic oligonucleotide
acggagccccgggcgccgtt

SEQ ID NO: 29948 - DNA, 20 bp, Artificial Sequence
  Description of Artificial Sequence: Synthetic oligonucleotide
cggagccccgggcgccgttt

SEQ ID NO: 29949 - DNA, 23 bp, Artificial Sequence
  Description of Artificial Sequence: Synthetic oligonucleotide
cccgggcgccgtggatagagcaa

SEQ ID NO: 29950 - DNA, 24 bp, Artificial Sequence
  Description of Artificial Sequence: Synthetic oligonucleotide
ccgggcgccgtggatagagcaaga

SEQ ID NO: 29951 - DNA, 35 bp, Artificial Sequence
  Description of Artificial Sequence: Synthetic oligonucleotide
acacagatctccaagaccaacacacagacttacag

SEQ ID NO: 29952 - DNA, 34 bp, Artificial Sequence
  Description of Artificial Sequence: Synthetic oligonucleotide
cacagatctccaagaccaacacacagacttacag

SEQ ID NO: 29953 - DNA, 35 bp, Artificial Sequence
  Description of Artificial Sequence: Synthetic oligonucleotide
acagatctccaagaccaacacacagacttacagag

SEQ ID NO: 29954 - DNA, 34 bp, Artificial Sequence
  Description of Artificial Sequence: Synthetic oligonucleotide
cagatctccaagaccaacacacagacttacagag

SEQ ID NO: 29955 - DNA, 35 bp, Artificial Sequence
  Description of Artificial Sequence: Synthetic oligonucleotide
agatctccaagaccaacacacagacttacagagag

SEQ ID NO: 29956 - DNA, 34 bp, Artificial Sequence
  Description of Artificial Sequence: Synthetic oligonucleotide
gatctccaagaccaacacacagacttacagagag

SEQ ID NO: 29957 - DNA, 35 bp, Artificial Sequence
  Description of Artificial Sequence: Synthetic oligonucleotide
atctccaagaccaacacacagacttacagagagag

SEQ ID NO: 29958 - DNA, 34 bp, Artificial Sequence
  Description of Artificial Sequence: Synthetic oligonucleotide
tctccaagaccaacacacagacttacagagagag

SEQ ID NO: 29959 - DNA, 33 bp, Artificial Sequence
  Description of Artificial Sequence: Synthetic oligonucleotide
ctccaagaccaacacacagacttacagagagag

SEQ ID NO: 29960 - DNA, 33 bp, Artificial Sequence
  Description of Artificial Sequence: Synthetic oligonucleotide
tccaagaccaacacacagacttacagagagagc

SEQ ID NO: 29961 - DNA, 32 bp, Artificial Sequence
  Description of Artificial Sequence: Synthetic oligonucleotide
ccaagaccaacacacagacttacagagagagc

SEQ ID NO: 29962 - DNA, 32 bp, Artificial Sequence
  Description of Artificial Sequence: Synthetic oligonucleotide
caagaccaacacacagacttacagagagagcc

SEQ ID NO: 29963 - DNA, 33 bp, Artificial Sequence
  Description of Artificial Sequence: Synthetic oligonucleotide
aagaccaacacacagacttacagagagagcctg

SEQ ID NO: 29964 - DNA, 32 bp, Artificial Sequence
  Description of Artificial Sequence: Synthetic oligonucleotide
agaccaacacacagacttacagagagagcctg

SEQ ID NO: 29965 - DNA, 31 bp, Artificial Sequence
  Description of Artificial Sequence: Synthetic oligonucleotide
gaccaacacacagacttacagagagagcctg

SEQ ID NO: 29966 - DNA, 31 bp, Artificial Sequence
  Description of Artificial Sequence: Synthetic oligonucleotide
accaacacacagacttacagagagagcctgc

SEQ ID NO: 29967 - DNA, 30 bp, Artificial Sequence
  Description of Artificial Sequence: Synthetic oligonucleotide
ccaacacacagacttacagagagagcctgc

SEQ ID NO: 29968 - DNA, 30 bp, Artificial Sequence
  Description of Artificial Sequence: Synthetic oligonucleotide
caacacacagacttacagagagagcctgcg

SEQ ID NO: 29969 - DNA, 30 bp, Artificial Sequence
  Description of Artificial Sequence: Synthetic oligonucleotide
aacacacagacttacagagagagcctgcgg

SEQ ID NO: 29970 - DNA, 29 bp, Artificial Sequence
  Description of Artificial Sequence: Synthetic oligonucleotide
acacacagacttacagagagagcctgcgg

SEQ ID NO: 29971 - DNA, 28 bp, Artificial Sequence
  Description of Artificial Sequence: Synthetic oligonucleotide
cacacagacttacagagagagcctgcgg

SEQ ID NO: 29972 - DNA, 30 bp, Artificial Sequence
  Description of Artificial Sequence: Synthetic oligonucleotide
acacagacttacagagagagcctgcggaac

SEQ ID NO: 29973 - DNA, 29 bp, Artificial Sequence
  Description of Artificial Sequence: Synthetic oligonucleotide
cacagacttacagagagagcctgcggaac

SEQ ID NO: 29974 - DNA, 29 bp, Artificial Sequence
  Description of Artificial Sequence: Synthetic oligonucleotide
acagacttacagagagagcctgcggaacc

SEQ ID NO: 29975 - DNA, 28 bp, Artificial Sequence
  Description of Artificial Sequence: Synthetic oligonucleotide
cagacttacagagagagcctgcggaacc

SEQ ID NO: 29976 - DNA, 29 bp, Artificial Sequence
  Description of Artificial Sequence: Synthetic oligonucleotide
agacttacagagagagcctgcggaacctg

SEQ ID NO: 29977 - DNA, 28 bp, Artificial Sequence
  Description of Artificial Sequence: Synthetic oligonucleotide
gacttacagagagagcctgcggaacctg

SEQ ID NO: 29978 - DNA, 28 bp, Artificial Sequence
  Description of Artificial Sequence: Synthetic oligonucleotide
acttacagagagagcctgcggaacctgc

SEQ ID NO: 29979 - DNA, 27 bp, Artificial Sequence
  Description of Artificial Sequence: Synthetic oligonucleotide
cttacagagagagcctgcggaacctgc

SEQ ID NO: 29980 - DNA, 27 bp, Artificial Sequence
  Description of Artificial Sequence: Synthetic oligonucleotide
ttacagagagagcctgcggaacctgcg

SEQ ID NO: 29981 - DNA, 26 bp, Artificial Sequence
  Description of Artificial Sequence: Synthetic oligonucleotide
tacagagagagcctgcggaacctgcg

SEQ ID NO: 29982 - DNA, 25 bp, Artificial Sequence
  Description of Artificial Sequence: Synthetic oligonucleotide
acagagagagcctgcggaacctgcg

SEQ ID NO: 29983 - DNA, 24 bp, Artificial Sequence
  Description of Artificial Sequence: Synthetic oligonucleotide
cagagagagcctgcggaacctgcg

SEQ ID NO: 29984 - DNA, 24 bp, Artificial Sequence
  Description of Artificial Sequence: Synthetic oligonucleotide
agagagagcctgcggaacctgcgc

SEQ ID NO: 29985 - DNA, 25 bp, Artificial Sequence
  Description of Artificial Sequence: Synthetic oligonucleotide
gccctgaacgaggacctgagctcgt

SEQ ID NO: 29986 - DNA, 25 bp, Artificial Sequence
  Description of Artificial Sequence: Synthetic oligonucleotide
ccctgaacgaggacctgagctcgtg

SEQ ID NO: 29987 - DNA, 26 bp, Artificial Sequence
  Description of Artificial Sequence: Synthetic oligonucleotide
cctgaacgaggacctgagctcgtgga

SEQ ID NO: 29988 - DNA, 26 bp, Artificial Sequence
  Description of Artificial Sequence: Synthetic oligonucleotide
ctgaacgaggacctgagctcgtggac

SEQ ID NO: 29989 - DNA, 26 bp, Artificial Sequence
  Description of Artificial Sequence: Synthetic oligonucleotide
tgaacgaggacctgagctcgtggacc

SEQ ID NO: 29990 - DNA, 25 bp, Artificial Sequence
  Description of Artificial Sequence: Synthetic oligonucleotide
gaacgaggacctgagctcgtggacc

SEQ ID NO: 29991 - DNA, 25 bp, Artificial Sequence
  Description of Artificial Sequence: Synthetic oligonucleotide
aacgaggacctgagctcgtggaccg

SEQ ID NO: 29992 - DNA, 24 bp, Artificial Sequence
  Description of Artificial Sequence: Synthetic oligonucleotide
acgaggacctgagctcgtggaccg

SEQ ID NO: 29993 - DNA, 23 bp, Artificial Sequence
  Description of Artificial Sequence: Synthetic oligonucleotide
cgaggacctgagctcgtggaccg

SEQ ID NO: 29994 - DNA, 23 bp, Artificial Sequence
  Description of Artificial Sequence: Synthetic oligonucleotide
gaggacctgagctcgtggaccgc

SEQ ID NO: 29995 - DNA, 23 bp, Artificial Sequence
  Description of Artificial Sequence: Synthetic oligonucleotide
aggacctgagctcgtggaccgcg

SEQ ID NO: 29996 - DNA, 22 bp, Artificial Sequence
  Description of Artificial Sequence: Synthetic oligonucleotide
ggacctgagctcgtggaccgcg

SEQ ID NO: 29997 - DNA, 22 bp, Artificial Sequence
  Description of Artificial Sequence: Synthetic oligonucleotide
gacctgagctcgtggaccgcgg

SEQ ID NO: 29998 - DNA, 22 bp, Artificial Sequence
  Description of Artificial Sequence: Synthetic oligonucleotide
acctgagctcgtggaccgcggc

SEQ ID NO: 29999 - DNA, 21 bp, Artificial Sequence
  Description of Artificial Sequence: Synthetic oligonucleotide
cctgagctcgtggaccgcggc

SEQ ID NO: 30000 - DNA, 21 bp, Artificial Sequence
  Description of Artificial Sequence: Synthetic oligonucleotide
ctgagctcgtggaccgcggcg

SEQ ID NO: 30001 - DNA, 22 bp, Artificial Sequence
  Description of Artificial Sequence: Synthetic oligonucleotide
tgagctcgtggaccgcggcgga

SEQ ID NO: 30002 - DNA, 21 bp, Artificial Sequence
  Description of Artificial Sequence: Synthetic oligonucleotide
gagctcgtggaccgcggcgga

SEQ ID NO: 30003 - DNA, 22 bp, Artificial Sequence
  Description of Artificial Sequence: Synthetic oligonucleotide
agctcgtggaccgcggcggaca

SEQ ID NO: 30004 - DNA, 21 bp, Artificial Sequence
  Description of Artificial Sequence: Synthetic oligonucleotide
gctcgtggaccgcggcggaca

SEQ ID NO: 30005 - DNA, 21 bp, Artificial Sequence
  Description of Artificial Sequence: Synthetic oligonucleotide
ctcgtggaccgcggcggacac

SEQ ID NO: 30006 - DNA, 21 bp, Artificial Sequence
  Description of Artificial Sequence: Synthetic oligonucleotide
tcgtggaccgcggcggacacc

SEQ ID NO: 30007 - DNA, 20 bp, Artificial Sequence
  Description of Artificial Sequence: Synthetic oligonucleotide
cgtggaccgcggcggacacc

SEQ ID NO: 30008 - DNA, 20 bp, Artificial Sequence
  Description of Artificial Sequence: Synthetic oligonucleotide
gtggaccgcggcggacaccg

SEQ ID NO: 30009 - DNA, 31 bp, Artificial Sequence
  Description of Artificial Sequence: Synthetic oligonucleotide
gctcccattccatgaggtatttccacacctc

SEQ ID NO: 30010 - DNA, 31 bp, Artificial Sequence
  Description of Artificial Sequence: Synthetic oligonucleotide
ctcccattccatgaggtatttccacacctcc

SEQ ID NO: 30011 - DNA, 31 bp, Artificial Sequence
  Description of Artificial Sequence: Synthetic oligonucleotide
tcccattccatgaggtatttccacacctccg

SEQ ID NO: 30012 - DNA, 30 bp, Artificial Sequence
  Description of Artificial Sequence: Synthetic oligonucleotide
cccattccatgaggtatttccacacctccg

SEQ ID NO: 30013 - DNA, 31 bp, Artificial Sequence
  Description of Artificial Sequence: Synthetic oligonucleotide
ccattccatgaggtatttccacacctccgtg

SEQ ID NO: 30014 - DNA, 32 bp, Artificial Sequence
  Description of Artificial Sequence: Synthetic oligonucleotide
cattccatgaggtatttccacacctccgtgtc

SEQ ID NO: 30015 - DNA, 32 bp, Artificial Sequence
  Description of Artificial Sequence: Synthetic oligonucleotide
attccatgaggtatttccacacctccgtgtcc

SEQ ID NO: 30016 - DNA, 31 bp, Artificial Sequence
  Description of Artificial Sequence: Synthetic oligonucleotide
ttccatgaggtatttccacacctccgtgtcc

SEQ ID NO: 30017 - DNA, 26 bp, Artificial Sequence
  Description of Artificial Sequence: Synthetic oligonucleotide
ctccgcagacacctggagaacggcaa

SEQ ID NO: 30018 - DNA, 26 bp, Artificial Sequence
  Description of Artificial Sequence: Synthetic oligonucleotide
tccgcagacacctggagaacggcaag

SEQ ID NO: 30019 - DNA, 25 bp, Artificial Sequence
  Description of Artificial Sequence: Synthetic oligonucleotide
ccgcagacacctggagaacggcaag

SEQ ID NO: 30020 - DNA, 26 bp, Artificial Sequence
  Description of Artificial Sequence: Synthetic oligonucleotide
cgcagacacctggagaacggcaagga

SEQ ID NO: 30021 - DNA, 27 bp, Artificial Sequence
  Description of Artificial Sequence: Synthetic oligonucleotide
gcagacacctggagaacggcaaggaga

SEQ ID NO: 30022 - DNA, 27 bp, Artificial Sequence
  Description of Artificial Sequence: Synthetic oligonucleotide
cagacacctggagaacggcaaggagac

SEQ ID NO: 30023 - DNA, 27 bp, Artificial Sequence
  Description of Artificial Sequence: Synthetic oligonucleotide
agacacctggagaacggcaaggagacg

SEQ ID NO: 30024 - DNA, 26 bp, Artificial Sequence
  Description of Artificial Sequence: Synthetic oligonucleotide
gacacctggagaacggcaaggagacg

SEQ ID NO: 30025 - DNA, 27 bp, Artificial Sequence
  Description of Artificial Sequence: Synthetic oligonucleotide
acacctggagaacggcaaggagacgct

SEQ ID NO: 30026 - DNA, 26 bp, Artificial Sequence
  Description of Artificial Sequence: Synthetic oligonucleotide
cacctggagaacggcaaggagacgct

SEQ ID NO: 30027 - DNA, 26 bp, Artificial Sequence
  Description of Artificial Sequence: Synthetic oligonucleotide
acctggagaacggcaaggagacgctg

SEQ ID NO: 30028 - DNA, 25 bp, Artificial Sequence
  Description of Artificial Sequence: Synthetic oligonucleotide
cctggagaacggcaaggagacgctg

SEQ ID NO: 30029 - DNA, 26 bp, Artificial Sequence
  Description of Artificial Sequence: Synthetic oligonucleotide
ctggagaacggcaaggagacgctgca

SEQ ID NO: 30030 - DNA, 26 bp, Artificial Sequence
  Description of Artificial Sequence: Synthetic oligonucleotide
tggagaacggcaaggagacgctgcag

SEQ ID NO: 30031 - DNA, 25 bp, Artificial Sequence
  Description of Artificial Sequence: Synthetic oligonucleotide
ggagaacggcaaggagacgctgcag

SEQ ID NO: 30032 - DNA, 25 bp, Artificial Sequence
  Description of Artificial Sequence: Synthetic oligonucleotide
gagaacggcaaggagacgctgcagc

SEQ ID NO: 30033 - DNA, 25 bp, Artificial Sequence
  Description of Artificial Sequence: Synthetic oligonucleotide
agaacggcaaggagacgctgcagcg

SEQ ID NO: 30034 - DNA, 24 bp, Artificial Sequence
  Description of Artificial Sequence: Synthetic oligonucleotide
gaacggcaaggagacgctgcagcg

SEQ ID NO: 30035 - DNA, 24 bp, Artificial Sequence
  Description of Artificial Sequence: Synthetic oligonucleotide
aacggcaaggagacgctgcagcgc

SEQ ID NO: 30036 - DNA, 23 bp, Artificial Sequence
  Description of Artificial Sequence: Synthetic oligonucleotide
acggcaaggagacgctgcagcgc

SEQ ID NO: 30037 - DNA, 22 bp, Artificial Sequence
  Description of Artificial Sequence: Synthetic oligonucleotide
cggcaaggagacgctgcagcgc

SEQ ID NO: 30038 - DNA, 22 bp, Artificial Sequence
  Description of Artificial Sequence: Synthetic oligonucleotide
ggcaaggagacgctgcagcgcg

SEQ ID NO: 30039 - DNA, 22 bp, Artificial Sequence
  Description of Artificial Sequence: Synthetic oligonucleotide
gcaaggagacgctgcagcgcgc

SEQ ID NO: 30040 - DNA, 22 bp, Artificial Sequence
  Description of Artificial Sequence: Synthetic oligonucleotide
caaggagacgctgcagcgcgcg

SEQ ID NO: 30041 - DNA, 22 bp, Artificial Sequence
  Description of Artificial Sequence: Synthetic oligonucleotide
gaaggagacgctgcagcgcgcc

SEQ ID NO: 30042 - DNA, 22 bp, Artificial Sequence
  Description of Artificial Sequence: Synthetic oligonucleotide
aaggagacgctgcagcgcgccg

SEQ ID NO: 30043 - DNA, 27 bp, Artificial Sequence
  Description of Artificial Sequence: Synthetic oligonucleotide
cttcattgcagtgggctacgtggacgg

SEQ ID NO: 30044 - DNA, 27 bp, Artificial Sequence
  Description of Artificial Sequence: Synthetic oligonucleotide
ttcattgcagtgggctacgtggacggc

SEQ ID NO: 30045 - DNA, 27 bp, Artificial Sequence
  Description of Artificial Sequence: Synthetic oligonucleotide
tcattgcagtgggctacgtggacggca

SEQ ID NO: 30046 - DNA, 26 bp, Artificial Sequence
  Description of Artificial Sequence: Synthetic oligonucleotide
cattgcagtgggctacgtggacggca

SEQ ID NO: 30047 - DNA, 26 bp, Artificial Sequence
  Description of Artificial Sequence: Synthetic oligonucleotide
attgcagtgggctacgtggacggcac

SEQ ID NO: 30048 - DNA, 25 bp, Artificial Sequence
  Description of Artificial Sequence: Synthetic oligonucleotide
ttgcagtgggctacgtggacggcac

SEQ ID NO: 30049 - DNA, 24 bp, Artificial Sequence
  Description of Artificial Sequence: Synthetic oligonucleotide
tgcagtgggctacgtggacggcac

SEQ ID NO: 30050 - DNA, 23 bp, Artificial Sequence
  Description of Artificial Sequence: Synthetic oligonucleotide
gcagtgggctacgtggacggcac

SEQ ID NO: 30051 - DNA, 30 bp, Artificial Sequence
  Description of Artificial Sequence: Synthetic oligonucleotide
tacgacggcaaggattacatcgccctgaag

SEQ ID NO: 30052 - DNA, 29 bp, Artificial Sequence
  Description of Artificial Sequence: Synthetic oligonucleotide
acgacggcaaggattacatcgccctgaag

SEQ ID NO: 30053 - DNA, 28 bp, Artificial Sequence
  Description of Artificial Sequence: Synthetic oligonucleotide
cgacggcaaggattacatcgccctgaag

SEQ ID NO: 30054 - DNA, 28 bp, Artificial Sequence
  Description of Artificial Sequence: Synthetic oligonucleotide
gacggcaaggattacatcgccctgaagg

SEQ ID NO: 30055 - DNA, 29 bp, Artificial Sequence
  Description of Artificial Sequence: Synthetic oligonucleotide
acggcaaggattacatcgccctgaaggag

SEQ ID NO: 30056 - DNA, 28 bp, Artificial Sequence
  Description of Artificial Sequence: Synthetic oligonucleotide
cggcaaggattacatcgccctgaaggag

SEQ ID NO: 30057 - DNA, 28 bp, Artificial Sequence
  Description of Artificial Sequence: Synthetic oligonucleotide
ggcaaggattacatcgccctgaaggagg

SEQ ID NO: 30058 - DNA, 29 bp, Artificial Sequence
  Description of Artificial Sequence: Synthetic oligonucleotide
gcaaggattacatcgccctgaaggaggac

SEQ ID NO: 30059 - DNA, 29 bp, Artificial Sequence
  Description of Artificial Sequence: Synthetic oligonucleotide
caaggattacatcgccctgaaggaggacc

SEQ ID NO: 30060 - DNA, 30 bp, Artificial Sequence
  Description of Artificial Sequence: Synthetic oligonucleotide
aaggattacatcgccctgaaggaggacctg

SEQ ID NO: 30061 - DNA, 29 bp, Artificial Sequence
  Description of Artificial Sequence: Synthetic oligonucleotide
aggattacatcgccctgaaggaggacctg

SEQ ID NO: 30062 - DNA, 28 bp, Artificial Sequence
  Description of Artificial Sequence: Synthetic oligonucleotide
ggattacatcgccctgaaggaggacctg

SEQ ID NO: 30063 - DNA, 29 bp, Artificial Sequence
  Description of Artificial Sequence: Synthetic oligonucleotide
gattacatcgccctgaaggaggacctgag

SEQ ID NO: 30064 - DNA, 29 bp, Artificial Sequence
  Description of Artificial Sequence: Synthetic oligonucleotide
attacatcgccctgaaggaggacctgagc

SEQ ID NO: 30065 - DNA, 28 bp, Artificial Sequence
  Description of Artificial Sequence: Synthetic oligonucleotide
ttacatcgccctgaaggaggacctgagc

SEQ ID NO: 30066 - DNA, 27 bp, Artificial Sequence
  Description of Artificial Sequence: Synthetic oligonucleotide
tacatcgccctgaaggaggacctgagc

SEQ ID NO: 30067 - DNA, 27 bp, Artificial Sequence
  Description of Artificial Sequence: Synthetic oligonucleotide
acatcgccctgaaggaggacctgagct

SEQ ID NO: 30068 - DNA, 26 bp, Artificial Sequence
  Description of Artificial Sequence: Synthetic oligonucleotide
catcgccctgaaggaggacctgagct

SEQ ID NO: 30069 - DNA, 26 bp, Artificial Sequence
  Description of Artificial Sequence: Synthetic oligonucleotide
atcgccctgaaggaggacctgagctc

SEQ ID NO: 30070 - DNA, 25 bp, Artificial Sequence
  Description of Artificial Sequence: Synthetic oligonucleotide
tcgccctgaaggaggacctgagctc

SEQ ID NO: 30071 - DNA, 24 bp, Artificial Sequence
  Description of Artificial Sequence: Synthetic oligonucleotide
cgccctgaaggaggacctgagctc

SEQ ID NO: 30072 - DNA, 25 bp, Artificial Sequence
  Description of Artificial Sequence: Synthetic oligonucleotide
gccctgaaggaggacctgagctcct

SEQ ID NO: 30073 - DNA, 25 bp, Artificial Sequence
  Description of Artificial Sequence: Synthetic oligonucleotide
ccctgaaggaggacctgagctcctg

SEQ ID NO: 30074 - DNA, 26 bp, Artificial Sequence
  Description of Artificial Sequence: Synthetic oligonucleotide
cctgaaggaggacctgagctcctgga

SEQ ID NO: 30075 - DNA, 26 bp, Artificial Sequence
  Description of Artificial Sequence: Synthetic oligonucleotide
ctgaaggaggacctgagctcctggac

SEQ ID NO: 30076 - DNA, 26 bp, Artificial Sequence
  Description of Artificial Sequence: Synthetic oligonucleotide
tgaaggaggacctgagctcctggacc

SEQ ID NO: 30077 - DNA, 25 bp, Artificial Sequence
  Description of Artificial Sequence: Synthetic oligonucleotide
gaaggaggacctgagctcctggacc

SEQ ID NO: 30078 - DNA, 25 bp, Artificial Sequence
  Description of Artificial Sequence: Synthetic oligonucleotide
aaggaggacctgagctcctggaccg

SEQ ID NO: 30079 - DNA, 24 bp, Artificial Sequence
  Description of Artificial Sequence: Synthetic oligonucleotide
aggaggacctgagctcctggaccg

SEQ ID NO: 30080 - DNA, 23 bp, Artificial Sequence
  Description of Artificial Sequence: Synthetic oligonucleotide
ggaggacctgagctcctggaccg

SEQ ID NO: 30081 - DNA, 32 bp, Artificial Sequence
  Description of Artificial Sequence: Synthetic oligonucleotide
tccaagaccaacacacagacttaccgagtgag

SEQ ID NO: 30082 - DNA, 31 bp, Artificial Sequence
  Description of Artificial Sequence: Synthetic oligonucleotide
ccaagaccaacacacagacttaccgagtgag

SEQ ID NO: 30083 - DNA, 31 bp, Artificial Sequence
  Description of Artificial Sequence: Synthetic oligonucleotide
caagaccaacacacagacttaccgagtgagc

SEQ ID NO: 30084 - DNA, 31 bp, Artificial Sequence
  Description of Artificial Sequence: Synthetic oligonucleotide
aagaccaacacacagacttaccgagtgagcc

SEQ ID NO: 30085 - DNA, 30 bp, Artificial Sequence
  Description of Artificial Sequence: Synthetic oligonucleotide
agaccaacacacagacttaccgagtgagcc

SEQ ID NO: 30086 - DNA, 29 bp, Artificial Sequence
  Description of Artificial Sequence: Synthetic oligonucleotide
gaccaacacacagacttaccgagtgagcc

SEQ ID NO: 30087 - DNA, 30 bp, Artificial Sequence
  Description of Artificial Sequence: Synthetic oligonucleotide
accaacacacagacttaccgagtgagcctg

SEQ ID NO: 30088 - DNA, 29 bp, Artificial Sequence
  Description of Artificial Sequence: Synthetic oligonucleotide
ccaacacacagacttaccgagtgagcctg

SEQ ID NO: 30089 - DNA, 29 bp, Artificial Sequence
  Description of Artificial Sequence: Synthetic oligonucleotide
caacacacagacttaccgagtgagcctgc

SEQ ID NO: 30090 - DNA, 29 bp, Artificial Sequence
  Description of Artificial Sequence: Synthetic oligonucleotide
aacacacagacttaccgagtgagcctgcg

SEQ ID NO: 30091 - DNA, 28 bp, Artificial Sequence
  Description of Artificial Sequence: Synthetic oligonucleotide
acacacagacttaccgagtgagcctgcg

SEQ ID NO: 30092 - DNA, 27 bp, Artificial Sequence
  Description of Artificial Sequence: Synthetic oligonucleotide
cacacagacttaccgagtgagcctgcg

SEQ ID NO: 30093 - DNA, 27 bp, Artificial Sequence
  Description of Artificial Sequence: Synthetic oligonucleotide
acacagacttaccgagtgagcctgcgg

SEQ ID NO: 30094 - DNA, 27 bp, Artificial Sequence
  Description of Artificial Sequence: Synthetic oligonucleotide
cacagacttaccgagtgagcctgcgga

SEQ ID NO: 30095 - DNA, 28 bp, Artificial Sequence
  Description of Artificial Sequence: Synthetic oligonucleotide
acagacttaccgagtgagcctgcggaac

SEQ ID NO: 30096 - DNA, 27 bp, Artificial Sequence
  Description of Artificial Sequence: Synthetic oligonucleotide
cagacttaccgagtgagcctgcggaac

SEQ ID NO: 30097 - DNA, 27 bp, Artificial Sequence
  Description of Artificial Sequence: Synthetic oligonucleotide
agacttaccgagtgagcctgcggaacc

SEQ ID NO: 30098 - DNA, 27 bp, Artificial Sequence
  Description of Artificial Sequence: Synthetic oligonucleotide
gacttaccgagtgagcctgcggaacct

SEQ ID NO: 30099 - DNA, 27 bp, Artificial Sequence
  Description of Artificial Sequence: Synthetic oligonucleotide
acttaccgagtgagcctgcggaacctg

SEQ ID NO: 30100 - DNA, 26 bp, Artificial Sequence
  Description of Artificial Sequence: Synthetic oligonucleotide
cttaccgagtgagcctgcggaacctg

SEQ ID NO: 30101 - DNA, 26 bp, Artificial Sequence
  Description of Artificial Sequence: Synthetic oligonucleotide
ttaccgagtgagcctgcggaacctgc

SEQ ID NO: 30102 - DNA, 25 bp, Artificial Sequence
  Description of Artificial Sequence: Synthetic oligonucleotide
taccgagtgagcctgcggaacctgc

SEQ ID NO: 30103 - DNA, 25 bp, Artificial Sequence
  Description of Artificial Sequence: Synthetic oligonucleotide
cccgaaccctcctcctgctgctcta

SEQ ID NO: 30104 - DNA, 25 bp, Artificial Sequence
  Description of Artificial Sequence: Synthetic oligonucleotide
ccgaaccctcctcctgctgctctag

SEQ ID NO: 30105 - DNA, 25 bp, Artificial Sequence
  Description of Artificial Sequence: Synthetic oligonucleotide
cgaaccctcctcctgctgctctagg

SEQ ID NO: 30106 - DNA, 25 bp, Artificial Sequence
  Description of Artificial Sequence: Synthetic oligonucleotide
gaaccctcctcctgctgctctaggg

SEQ ID NO: 30107 - DNA, 25 bp, Artificial Sequence
  Description of Artificial Sequence: Synthetic oligonucleotide
aaccctcctcctgctgctctagggg

SEQ ID NO: 30108 - DNA, 24 bp, Artificial Sequence
  Description of Artificial Sequence: Synthetic oligonucleotide
accctcctcctgctgctctagggg

SEQ ID NO: 30109 - DNA, 23 bp, Artificial Sequence
  Description of Artificial Sequence: Synthetic oligonucleotide
ccctcctcctgctgctctagggg

SEQ ID NO: 30110 - DNA, 23 bp, Artificial Sequence
  Description of Artificial Sequence: Synthetic oligonucleotide
cctcctcctgctgctctaggggg

SEQ ID NO: 30111 - DNA, 24 bp, Artificial Sequence
  Description of Artificial Sequence: Synthetic oligonucleotide
ctcctcctgctgctctagggggca

SEQ ID NO: 30112 - DNA, 25 bp, Artificial Sequence
  Description of Artificial Sequence: Synthetic oligonucleotide
tcctcctgctgctctagggggcagt

SEQ ID NO: 30113 - DNA, 24 bp, Artificial Sequence
  Description of Artificial Sequence: Synthetic oligonucleotide
cctcctgctgctctagggggcagt

SEQ ID NO: 30114 - DNA, 24 bp, Artificial Sequence
  Description of Artificial Sequence: Synthetic oligonucleotide
ctcctgctgctctagggggcagtg

SEQ ID NO: 30115 - DNA, 24 bp, Artificial Sequence
  Description of Artificial Sequence: Synthetic oligonucleotide
tcctgctgctctagggggcagtgg

SEQ ID NO: 30116 - DNA, 23 bp, Artificial Sequence
  Description of Artificial Sequence: Synthetic oligonucleotide
cctgctgctctagggggcagtgg

SEQ ID NO: 30117 - DNA, 23 bp, Artificial Sequence
  Description of Artificial Sequence: Synthetic oligonucleotide
ctgctgctctagggggcagtggc

SEQ ID NO: 30118 - DNA, 23 bp, Artificial Sequence
  Description of Artificial Sequence: Synthetic oligonucleotide
tgctgctctagggggcagtggcc

SEQ ID NO: 30119 - DNA, 22 bp, Artificial Sequence
  Description of Artificial Sequence: Synthetic oligonucleotide
gctgctctagggggcagtggcc

SEQ ID NO: 30120 - DNA, 23 bp, Artificial Sequence
  Description of Artificial Sequence: Synthetic oligonucleotide
ctgctctagggggcagtggccct

SEQ ID NO: 30121 - DNA, 24 bp, Artificial Sequence
  Description of Artificial Sequence: Synthetic oligonucleotide
tgctctagggggcagtggccctga

SEQ ID NO: 30122 - DNA, 23 bp, Artificial Sequence
  Description of Artificial Sequence: Synthetic oligonucleotide
gctctagggggcagtggccctga

SEQ ID NO: 30123 - DNA, 23 bp, Artificial Sequence
  Description of Artificial Sequence: Synthetic oligonucleotide
ctctagggggcagtggccctgac

SEQ ID NO: 30124 - DNA, 23 bp, Artificial Sequence
  Description of Artificial Sequence: Synthetic oligonucleotide
tctagggggcagtggccctgacc

SEQ ID NO: 30125 - DNA, 22 bp, Artificial Sequence
  Description of Artificial Sequence: Synthetic oligonucleotide
ctagggggcagtggccctgacc

SEQ ID NO: 30126 - DNA, 23 bp, Artificial Sequence
  Description of Artificial Sequence: Synthetic oligonucleotide
tagggggcagtggccctgaccga

SEQ ID NO: 30127 - DNA, 22 bp, Artificial Sequence
  Description of Artificial Sequence: Synthetic oligonucleotide
agggggcagtggccctgaccga

SEQ ID NO: 30128 - DNA, 28 bp, Artificial Sequence
  Description of Artificial Sequence: Synthetic oligonucleotide
atcatccagagcatgtacggctgcgacc

SEQ ID NO: 30129 - DNA, 27 bp, Artificial Sequence
  Description of Artificial Sequence: Synthetic oligonucleotide
tcatccagagcatgtacggctgcgacc

SEQ ID NO: 30130 - DNA, 27 bp, Artificial Sequence
  Description of Artificial Sequence: Synthetic oligonucleotide
catccagagcatgtacggctgcgacct

SEQ ID NO: 30131 - DNA, 27 bp, Artificial Sequence
  Description of Artificial Sequence: Synthetic oligonucleotide
atccagagcatgtacggctgcgacctg

SEQ ID NO: 30132 - DNA, 26 bp, Artificial Sequence
  Description of Artificial Sequence: Synthetic oligonucleotide
tccagagcatgtacggctgcgacctg

SEQ ID NO: 30133 - DNA, 25 bp, Artificial Sequence
  Description of Artificial Sequence: Synthetic oligonucleotide
ccagagcatgtacggctgcgacctg

SEQ ID NO: 30134 - DNA, 25 bp, Artificial Sequence
  Description of Artificial Sequence: Synthetic oligonucleotide
cagagcatgtacggctgcgacctgg

SEQ ID NO: 30135 - DNA, 25 bp, Artificial Sequence
  Description of Artificial Sequence: Synthetic oligonucleotide
agagcatgtacggctgcgacctggg

SEQ ID NO: 30136 - DNA, 24 bp, Artificial Sequence
  Description of Artificial Sequence: Synthetic oligonucleotide
gagcatgtacggctgcgacctggg

SEQ ID NO: 30137 - DNA, 24 bp, Artificial Sequence
  Description of Artificial Sequence: Synthetic oligonucleotide
agcatgtacggctgcgacctgggg

SEQ ID NO: 30138 - DNA, 23 bp, Artificial Sequence
  Description of Artificial Sequence: Synthetic oligonucleotide
gcatgtacggctgcgacctgggg

SEQ ID NO: 30139 - DNA, 23 bp, Artificial Sequence
  Description of Artificial Sequence: Synthetic oligonucleotide
catgtacggctgcgacctggggc

SEQ ID NO: 30140 - DNA, 21 bp, Artificial Sequence
  Description of Artificial Sequence: Synthetic oligonucleotide
tacggctgcgacctggggccc

SEQ ID NO: 30141 - DNA, 20 bp, Artificial Sequence
  Description of Artificial Sequence: Synthetic oligonucleotide
acggctgcgacctggggccc

SEQ ID NO: 30142 - DNA, 20 bp, Artificial Sequence
  Description of Artificial Sequence: Synthetic oligonucleotide
cggctgcgacctggggccct

SEQ ID NO: 30143 - DNA, 26 bp, Artificial Sequence
  Description of Artificial Sequence: Synthetic oligonucleotide
agaacgggaaggagacgctgtagcgc

SEQ ID NO: 30144 - DNA, 25 bp, Artificial Sequence
  Description of Artificial Sequence: Synthetic oligonucleotide
gaacgggaaggagacgctgtagcgc

SEQ ID NO: 30145 - DNA, 25 bp, Artificial Sequence
  Description of Artificial Sequence: Synthetic oligonucleotide
aacgggaaggagacgctgtagcgcg

SEQ ID NO: 30146 - DNA, 24 bp, Artificial Sequence
  Description of Artificial Sequence: Synthetic oligonucleotide
acgggaaggagacgctgtagcgcg

SEQ ID NO: 30147 - DNA, 23 bp, Artificial Sequence
  Description of Artificial Sequence: Synthetic oligonucleotide
cgggaaggagacgctgtagcgcg

SEQ ID NO: 30148 - DNA, 23 bp, Artificial Sequence
  Description of Artificial Sequence: Synthetic oligonucleotide
gggaaggagacgctgtagcgcgc

SEQ ID NO: 30149 - DNA, 23 bp, Artificial Sequence
  Description of Artificial Sequence: Synthetic oligonucleotide
ggaaggagacgctgtagcgcgcg

SEQ ID NO: 30150 - DNA, 24 bp, Artificial Sequence
  Description of Artificial Sequence: Synthetic oligonucleotide
gaaggagacgctgtagcgcgcgga

SEQ ID NO: 30151 - DNA, 24 bp, Artificial Sequence
  Description of Artificial Sequence: Synthetic oligonucleotide
aaggagacgctgtagcgcgcggac

SEQ ID NO: 30152 - DNA, 23 bp, Artificial Sequence
  Description of Artificial Sequence: Synthetic oligonucleotide
aggagacgctgtagcgcgcggac

SEQ ID NO: 30153 - DNA, 22 bp, Artificial Sequence
  Description of Artificial Sequence: Synthetic oligonucleotide
ggagacgctgtagcgcgcggac

SEQ ID NO: 30154 - DNA, 22 bp, Artificial Sequence
  Description of Artificial Sequence: Synthetic oligonucleotide
gagacgctgtagcgcgcggacc

SEQ ID NO: 30155 - DNA, 22 bp, Artificial Sequence
  Description of Artificial Sequence: Synthetic oligonucleotide
agacgctgtagcgcgcggaccc

SEQ ID NO: 30156 - DNA, 21 bp, Artificial Sequence
  Description of Artificial Sequence: Synthetic oligonucleotide
gacgctgtagcgcgcggaccc

SEQ ID NO: 30157 - DNA, 21 bp, Artificial Sequence
  Description of Artificial Sequence: Synthetic oligonucleotide
acgctgtagcgcgcggacccc

SEQ ID NO: 30158 - DNA, 20 bp, Artificial Sequence
  Description of Artificial Sequence: Synthetic oligonucleotide
cgctgtagcgcgcggacccc

SEQ ID NO: 30159 - DNA, 20 bp, Artificial Sequence
  Description of Artificial Sequence: Synthetic oligonucleotide
gctgtagcgcgcggaccccc

SEQ ID NO: 30160 - DNA, 23 bp, Artificial Sequence
  Description of Artificial Sequence: Synthetic oligonucleotide
ctgtagcgcgcggaccccccaaa

SEQ ID NO: 30161 - DNA, 24 bp, Artificial Sequence
  Description of Artificial Sequence: Synthetic oligonucleotide
tgtagcgcgcggaccccccaaaga

SEQ ID NO: 30162 - DNA, 23 bp, Artificial Sequence
  Description of Artificial Sequence: Synthetic oligonucleotide
gtagcgcgcggaccccccaaaga

SEQ ID NO: 30163 - DNA, 24 bp, Artificial Sequence
  Description of Artificial Sequence: Synthetic oligonucleotide
tagcgcgcggaccccccaaagaca

SEQ ID NO: 30164 - DNA, 20 bp, Artificial Sequence
  Description of Artificial Sequence: Synthetic oligonucleotide
gcccggccgcggggagtctt

SEQ ID NO: 30165 - DNA, 20 bp, Artificial Sequence
  Description of Artificial Sequence: Synthetic oligonucleotide
cccggccgcggggagtcctt

SEQ ID NO: 30166 - DNA, 20 bp, Artificial Sequence
  Description of Artificial Sequence: Synthetic oligonucleotide
ccggccgcggggagtccctt

SEQ ID NO: 30167 - DNA, 20 bp, Artificial Sequence
  Description of Artificial Sequence: Synthetic oligonucleotide
cggccgcggggagtcccgtt

SEQ ID NO: 30168 - DNA, 20 bp, Artificial Sequence
  Description of Artificial Sequence: Synthetic oligonucleotide
ggccgcggggagtcccgctt

SEQ ID NO: 30169 - DNA, 22 bp, Artificial Sequence
  Description of Artificial Sequence: Synthetic oligonucleotide
gccgcggggagtcccgcttcat

SEQ ID NO: 30170 - DNA, 23 bp, Artificial Sequence
  Description of Artificial Sequence: Synthetic oligonucleotide
ccgcggggagtcccgcttcatct

SEQ ID NO: 30171 - DNA, 24 bp, Artificial Sequence
  Description of Artificial Sequence: Synthetic oligonucleotide
cgcggggagtcccgcttcatctca

SEQ ID NO: 30172 - DNA, 25 bp, Artificial Sequence
  Description of Artificial Sequence: Synthetic oligonucleotide
gcggggagtcccgcttcatctcagt

SEQ ID NO: 30173 - DNA, 25 bp, Artificial Sequence
  Description of Artificial Sequence: Synthetic oligonucleotide
cggggagtcccgcttcatctcagtg

SEQ ID NO: 30174 - DNA, 25 bp, Artificial Sequence
  Description of Artificial Sequence: Synthetic oligonucleotide
ggggagtcccgcttcatctcagtgg

SEQ ID NO: 30175 - DNA, 25 bp, Artificial Sequence
  Description of Artificial Sequence: Synthetic oligonucleotide
gggagtcccgcttcatctcagtggg

SEQ ID NO: 30176 - DNA, 27 bp, Artificial Sequence
  Description of Artificial Sequence: Synthetic oligonucleotide
ggagtcccgcttcatctcagtgggcta

SEQ ID NO: 30177 - DNA, 27 bp, Artificial Sequence
  Description of Artificial Sequence: Synthetic oligonucleotide
gagtcccgcttcatctcagtgggctac

SEQ ID NO: 30178 - DNA, 27 bp, Artificial Sequence
  Description of Artificial Sequence: Synthetic oligonucleotide
agtcccgcttcatctcagtgggctacg

SEQ ID NO: 30179 - DNA, 27 bp, Artificial Sequence
  Description of Artificial Sequence: Synthetic oligonucleotide
gtcccgcttcatctcagtgggctacgt

SEQ ID NO: 30180 - DNA, 27 bp, Artificial Sequence
  Description of Artificial Sequence: Synthetic oligonucleotide
tcccgcttcatctcagtgggctacgtg

SEQ ID NO: 30181 - DNA, 25 bp, Artificial Sequence
  Description of Artificial Sequence: Synthetic oligonucleotide
cagtccaccatccccatcgtgggca

SEQ ID NO: 30182 - DNA, 29 bp, Artificial Sequence
  Description of Artificial Sequence: Synthetic oligonucleotide
cgggtctcacaccctccagatgatgtttg

SEQ ID NO: 30183 - DNA, 29 bp, Artificial Sequence
  Description of Artificial Sequence: Synthetic oligonucleotide
gggtctcacaccctccagatgatgtttgg

SEQ ID NO: 30184 - DNA, 29 bp, Artificial Sequence
  Description of Artificial Sequence: Synthetic oligonucleotide
ggtctcacaccctccagatgatgtttggc

SEQ ID NO: 30185 - DNA, 30 bp, Artificial Sequence
  Description of Artificial Sequence: Synthetic oligonucleotide
gtctcacaccctccagatgatgtttggctg

SEQ ID NO: 30186 - DNA, 21 bp, Artificial Sequence
  Description of Artificial Sequence: Synthetic oligonucleotide
gcggccagtgtggcggagcag

SEQ ID NO: 30187 - DNA, 22 bp, Artificial Sequence
  Description of Artificial Sequence: Synthetic oligonucleotide
cggccagtgtggcggagcagct

SEQ ID NO: 30188 - DNA, 23 bp, Artificial Sequence
  Description of Artificial Sequence: Synthetic oligonucleotide
ggccagtgtggcggagcagctga

SEQ ID NO: 30189 - DNA, 24 bp, Artificial Sequence
  Description of Artificial Sequence: Synthetic oligonucleotide
gccagtgtggcggagcagctgaga

SEQ ID NO: 30190 - DNA, 24 bp, Artificial Sequence
  Description of Artificial Sequence: Synthetic oligonucleotide
ccagtgtggcggagcagctgagag

SEQ ID NO: 30191 - DNA, 24 bp, Artificial Sequence
  Description of Artificial Sequence: Synthetic oligonucleotide
cagtgtggcggagcagctgagagc

SEQ ID NO: 30192 - DNA, 26 bp, Artificial Sequence
  Description of Artificial Sequence: Synthetic oligonucleotide
agtgtggcggagcagctgagagccta

SEQ ID NO: 30193 - DNA, 22 bp, Artificial Sequence
  Description of Artificial Sequence: Synthetic oligonucleotide
gcaagtgggaggcggccggtgt

SEQ ID NO: 30194 - DNA, 25 bp, Artificial Sequence
  Description of Artificial Sequence: Synthetic oligonucleotide
gacaccgcggctcagatcacccaga

SEQ ID NO: 30195 - DNA, 25 bp, Artificial Sequence
  Description of Artificial Sequence: Synthetic oligonucleotide
acaccgcggctcagatcacccagag

SEQ ID NO: 30196 - DNA, 24 bp, Artificial Sequence
  Description of Artificial Sequence: Synthetic oligonucleotide
caccgcggctcagatcacccagag

SEQ ID NO: 30197 - DNA, 26 bp, Artificial Sequence
  Description of Artificial Sequence: Synthetic oligonucleotide
accgcggctcagatcacccagagcaa

SEQ ID NO: 30198 - DNA, 25 bp, Artificial Sequence
  Description of Artificial Sequence: Synthetic oligonucleotide
ccgcggctcagatcacccagagcaa

SEQ ID NO: 30199 - DNA, 26 bp, Artificial Sequence
  Description of Artificial Sequence: Synthetic oligonucleotide
cgcggctcagatcacccagagcaagt

SEQ ID NO: 30200 - DNA, 23 bp, Artificial Sequence
  Description of Artificial Sequence: Synthetic oligonucleotide
agcaagtgggaggcggcccgtgt

SEQ ID NO: 30201 - DNA, 24 bp, Artificial Sequence
  Description of Artificial Sequence: Synthetic oligonucleotide
aggacctgagctcctggaccgcga

SEQ ID NO: 30202 - DNA, 23 bp, Artificial Sequence
  Description of Artificial Sequence: Synthetic oligonucleotide
ggacctgagctcctggaccgcga

SEQ ID NO: 30203 - DNA, 23 bp, Artificial Sequence
  Description of Artificial Sequence: Synthetic oligonucleotide
gacctgagctcctggaccgcgac

SEQ ID NO: 30204 - DNA, 23 bp, Artificial Sequence
  Description of Artificial Sequence: Synthetic oligonucleotide
acctgagctcctggaccgcgacg

SEQ ID NO: 30205 - DNA, 22 bp, Artificial Sequence
  Description of Artificial Sequence: Synthetic oligonucleotide
cctgagctcctggaccgcgacg

SEQ ID NO: 30206 - DNA, 23 bp, Artificial Sequence
  Description of Artificial Sequence: Synthetic oligonucleotide
ctgagctcctggaccgcgacgga

SEQ ID NO: 30207 - DNA, 24 bp, Artificial Sequence
  Description of Artificial Sequence: Synthetic oligonucleotide
tgagctcctggaccgcgacggaca

SEQ ID NO: 30208 - DNA, 23 bp, Artificial Sequence
  Description of Artificial Sequence: Synthetic oligonucleotide
gagctcctggaccgcgacggaca

SEQ ID NO: 30209 - DNA, 23 bp, Artificial Sequence
  Description of Artificial Sequence: Synthetic oligonucleotide
agctcctggaccgcgacggacac

SEQ ID NO: 30210 - DNA, 22 bp, Artificial Sequence
  Description of Artificial Sequence: Synthetic oligonucleotide
gctcctggaccgcgacggacac

SEQ ID NO: 30211 - DNA, 22 bp, Artificial Sequence
  Description of Artificial Sequence: Synthetic oligonucleotide
ctcctggaccgcgacggacacc

SEQ ID NO: 30212 - DNA, 22 bp, Artificial Sequence
  Description of Artificial Sequence: Synthetic oligonucleotide
tcctggaccgcgacggacaccg

SEQ ID NO: 30213 - DNA, 21 bp, Artificial Sequence
  Description of Artificial Sequence: Synthetic oligonucleotide
cctggaccgcgacggacaccg

SEQ ID NO: 30214 - DNA, 21 bp, Artificial Sequence
  Description of Artificial Sequence: Synthetic oligonucleotide
ctggaccgcgacggacaccgc

SEQ ID NO: 30215 - DNA, 21 bp, Artificial Sequence
  Description of Artificial Sequence: Synthetic oligonucleotide
tggaccgcgacggacaccgcg

SEQ ID NO: 30216 - DNA, 20 bp, Artificial Sequence
  Description of Artificial Sequence: Synthetic oligonucleotide
ggaccgcgacggacaccgcg

SEQ ID NO: 30217 - DNA, 20 bp, Artificial Sequence
  Description of Artificial Sequence: Synthetic oligonucleotide
gaccgcgacggacaccgcgg

SEQ ID NO: 30218 - DNA, 21 bp, Artificial Sequence
  Description of Artificial Sequence: Synthetic oligonucleotide
accgcgacggacaccgcggct

SEQ ID NO: 30219 - DNA, 20 bp, Artificial Sequence
  Description of Artificial Sequence: Synthetic oligonucleotide
ccgcgacggacaccgcggct

SEQ ID NO: 30220 - DNA, 21 bp, Artificial Sequence
  Description of Artificial Sequence: Synthetic oligonucleotide
cgcgacggacaccgcggctca

SEQ ID NO: 30221 - DNA, 23 bp, Artificial Sequence
  Description of Artificial Sequence: Synthetic oligonucleotide
gcgacggacaccgcggctcagat

SEQ ID NO: 30222 - DNA, 24 bp, Artificial Sequence
  Description of Artificial Sequence: Synthetic oligonucleotide
cgacggacaccgcggctcagatca

SEQ ID NO: 30223 - DNA, 24 bp, Artificial Sequence
  Description of Artificial Sequence: Synthetic oligonucleotide
gacggacaccgcggctcagatcac

SEQ ID NO: 30224 - DNA, 24 bp, Artificial Sequence
  Description of Artificial Sequence: Synthetic oligonucleotide
acggacaccgcggctcagatcacc

SEQ ID NO: 30225 - DNA, 23 bp, Artificial Sequence
  Description of Artificial Sequence: Synthetic oligonucleotide
gggaaggacaagctggagcgcgc

SEQ ID NO: 30226 - DNA, 23 bp, Artificial Sequence
  Description of Artificial Sequence: Synthetic oligonucleotide
ggaaggacaagctggagcgcgcg

SEQ ID NO: 30227 - DNA, 23 bp, Artificial Sequence
  Description of Artificial Sequence: Synthetic oligonucleotide
gaaggacaagctggagcgcgcgg

SEQ ID NO: 30228 - DNA, 23 bp, Artificial Sequence
  Description of Artificial Sequence: Synthetic oligonucleotide
cagagcgaggccgggtctcacag

SEQ ID NO: 30229 - DNA, 23 bp, Artificial Sequence
  Description of Artificial Sequence: Synthetic oligonucleotide
agagcgaggccgggtctcacagc

SEQ ID NO: 30230 - DNA, 22 bp, Artificial Sequence
  Description of Artificial Sequence: Synthetic oligonucleotide
gagcgaggccgggtctcacagc

SEQ ID NO: 30231 - DNA, 23 bp, Artificial Sequence
  Description of Artificial Sequence: Synthetic oligonucleotide
agcgaggccgggtctcacagcct

SEQ ID NO: 30232 - DNA, 22 bp, Artificial Sequence
  Description of Artificial Sequence: Synthetic oligonucleotide
gcgaggccgggtctcacagcct

SEQ ID NO: 30233 - DNA, 22 bp, Artificial Sequence
  Description of Artificial Sequence: Synthetic oligonucleotide
cgaggccgggtctcacagcctc

SEQ ID NO: 30234 - DNA, 23 bp, Artificial Sequence
  Description of Artificial Sequence: Synthetic oligonucleotide
gaggccgggtctcacagcctcca

SEQ ID NO: 30235 - DNA, 24 bp, Artificial Sequence
  Description of Artificial Sequence: Synthetic oligonucleotide
aggccgggtctcacagcctccaga

SEQ ID NO: 30236 - DNA, 23 bp, Artificial Sequence
  Description of Artificial Sequence: Synthetic oligonucleotide
ggccgggtctcacagcctccaga

SEQ ID NO: 30237 - DNA, 23 bp, Artificial Sequence
  Description of Artificial Sequence: Synthetic oligonucleotide
gccgggtctcacagcctccagag

SEQ ID NO: 30238 - DNA, 25 bp, Artificial Sequence
  Description of Artificial Sequence: Synthetic oligonucleotide
ccgggtctcacagcctccagaggat

SEQ ID NO: 30239 - DNA, 27 bp, Artificial Sequence
  Description of Artificial Sequence: Synthetic oligonucleotide
cgggtctcacagcctccagaggatgta

SEQ ID NO: 30240 - DNA, 27 bp, Artificial Sequence
  Description of Artificial Sequence: Synthetic oligonucleotide
gggtctcacagcctccagaggatgtac

SEQ ID NO: 30241 - DNA, 27 bp, Artificial Sequence
  Description of Artificial Sequence: Synthetic oligonucleotide
ggtctcacagcctccagaggatgtacg

SEQ ID NO: 30242 - DNA, 27 bp, Artificial Sequence
  Description of Artificial Sequence: Synthetic oligonucleotide
gtctcacagcctccagaggatgtacgg

SEQ ID NO: 30243 - DNA, 27 bp, Artificial Sequence
  Description of Artificial Sequence: Synthetic oligonucleotide
tctcacagcctccagaggatgtacggc

SEQ ID NO: 30244 - DNA, 27 bp, Artificial Sequence
  Description of Artificial Sequence: Synthetic oligonucleotide
ctcacagcctccagaggatgtacggct

SEQ ID NO: 30245 - DNA, 27 bp, Artificial Sequence
  Description of Artificial Sequence: Synthetic oligonucleotide
tcacagcctccagaggatgtacggctg

SEQ ID NO: 30246 - DNA, 26 bp, Artificial Sequence
  Description of Artificial Sequence: Synthetic oligonucleotide
cacagcctccagaggatgtacggctg

SEQ ID NO: 30247 - DNA, 26 bp, Artificial Sequence
  Description of Artificial Sequence: Synthetic oligonucleotide
acagcctccagaggatgtacggctgc

SEQ ID NO: 30248 - DNA, 25 bp, Artificial Sequence
  Description of Artificial Sequence: Synthetic oligonucleotide
cagcctccagaggatgtacggctgc

SEQ ID NO: 30249 - DNA, 26 bp, Artificial Sequence
  Description of Artificial Sequence: Synthetic oligonucleotide
agcctccagaggatgtacggctgcga

SEQ ID NO: 30250 - DNA, 25 bp, Artificial Sequence
  Description of Artificial Sequence: Synthetic oligonucleotide
gcctccagaggatgtacggctgcga

SEQ ID NO: 30251 - DNA, 21 bp, Artificial Sequence
  Description of Artificial Sequence: Synthetic oligonucleotide
cgcctcctccgcgggcatgag

SEQ ID NO: 30252 - DNA, 22 bp, Artificial Sequence
  Description of Artificial Sequence: Synthetic oligonucleotide
gcctcctccgcgggcatgagca

SEQ ID NO: 30253 - DNA, 23 bp, Artificial Sequence
  Description of Artificial Sequence: Synthetic oligonucleotide
cctcctccgcgggcatgagcagt

SEQ ID NO: 30254 - DNA, 23 bp, Artificial Sequence
  Description of Artificial Sequence: Synthetic oligonucleotide
ctcctccgcgggcatgagcagtc

SEQ ID NO: 30255 - DNA, 23 bp, Artificial Sequence
  Description of Artificial Sequence: Synthetic oligonucleotide
tcctccgcgggcatgagcagtcc

SEQ ID NO: 30256 - DNA, 22 bp, Artificial Sequence
  Description of Artificial Sequence: Synthetic oligonucleotide
cctccgcgggcatgagcagtcc

SEQ ID NO: 30257 - DNA, 22 bp, Artificial Sequence
  Description of Artificial Sequence: Synthetic oligonucleotide
ctccgcgggcatgagcagtccg

SEQ ID NO: 30258 - DNA, 22 bp, Artificial Sequence
  Description of Artificial Sequence: Synthetic oligonucleotide
tccgcgggcatgagcagtccgc

SEQ ID NO: 30259 - DNA, 21 bp, Artificial Sequence
  Description of Artificial Sequence: Synthetic oligonucleotide
ccgcgggcatgagcagtccgc

SEQ ID NO: 30260 - DNA, 23 bp, Artificial Sequence
  Description of Artificial Sequence: Synthetic oligonucleotide
cgcgggcatgagcagtccgccta

SEQ ID NO: 30261 - DNA, 23 bp, Artificial Sequence
  Description of Artificial Sequence: Synthetic oligonucleotide
gcgggcatgagcagtccgcctac

SEQ ID NO: 30262 - DNA, 24 bp, Artificial Sequence
  Description of Artificial Sequence: Synthetic oligonucleotide
cgggcatgagcagtccgcctacga

SEQ ID NO: 30263 - DNA, 24 bp, Artificial Sequence
  Description of Artificial Sequence: Synthetic oligonucleotide
gggcatgagcagtccgcctacgac

SEQ ID NO: 30264 - DNA, 24 bp, Artificial Sequence
  Description of Artificial Sequence: Synthetic oligonucleotide
ggcatgagcagtccgcctacgacg

SEQ ID NO: 30265 - DNA, 24 bp, Artificial Sequence
  Description of Artificial Sequence: Synthetic oligonucleotide
gcatgagcagtccgcctacgacgg

SEQ ID NO: 30266 - DNA, 26 bp, Artificial Sequence
  Description of Artificial Sequence: Synthetic oligonucleotide
catgagcagtccgcctacgacggcaa

SEQ ID NO: 30267 - DNA, 26 bp, Artificial Sequence
  Description of Artificial Sequence: Synthetic oligonucleotide
atgagcagtccgcctacgacggcaag

SEQ ID NO: 30268 - DNA, 25 bp, Artificial Sequence
  Description of Artificial Sequence: Synthetic oligonucleotide
tgagcagtccgcctacgacggcaag

SEQ ID NO: 30269 - DNA, 24 bp, Artificial Sequence
  Description of Artificial Sequence: Synthetic oligonucleotide
gagcagtccgcctacgacggcaag

SEQ ID NO: 30270 - DNA, 27 bp, Artificial Sequence
  Description of Artificial Sequence: Synthetic oligonucleotide
agcagtccgcctacgacggcaaggatt

SEQ ID NO: 30271 - DNA, 27 bp, Artificial Sequence
  Description of Artificial Sequence: Synthetic oligonucleotide
gcagtccgcctacgacggcaaggatta

SEQ ID NO: 30272 - DNA, 27 bp, Artificial Sequence
  Description of Artificial Sequence: Synthetic oligonucleotide
ggcacccagttcgtgaggttcgacaga

SEQ ID NO: 30273 - DNA, 27 bp, Artificial Sequence
  Description of Artificial Sequence: Synthetic oligonucleotide
gcacccagttcgtgaggttcgacagag

SEQ ID NO: 30274 - DNA, 28 bp, Artificial Sequence
  Description of Artificial Sequence: Synthetic oligonucleotide
cacccagttcgtgaggttcgacagagac

SEQ ID NO: 30275 - DNA, 28 bp, Artificial Sequence
  Description of Artificial Sequence: Synthetic oligonucleotide
acccagttcgtgaggttcgacagagacg

SEQ ID NO: 30276 - DNA, 27 bp, Artificial Sequence
  Description of Artificial Sequence: Synthetic oligonucleotide
cccagttcgtgaggttcgacagagacg

SEQ ID NO: 30277 - DNA, 27 bp, Artificial Sequence
  Description of Artificial Sequence: Synthetic oligonucleotide
ccagttcgtgaggttcgacagagacgc

SEQ ID NO: 30278 - DNA, 27 bp, Artificial Sequence
  Description of Artificial Sequence: Synthetic oligonucleotide
cagttcgtgaggttcgacagagacgcc

SEQ ID NO: 30279 - DNA, 27 bp, Artificial Sequence
  Description of Artificial Sequence: Synthetic oligonucleotide
agttcgtgaggttcgacagagacgccg

SEQ ID NO: 30280 - DNA, 26 bp, Artificial Sequence
  Description of Artificial Sequence: Synthetic oligonucleotide
gttcgtgaggttcgacagagacgccg

SEQ ID NO: 30281 - DNA, 26 bp, Artificial Sequence
  Description of Artificial Sequence: Synthetic oligonucleotide
ttcgtgaggttcgacagagacgccgc

SEQ ID NO: 30282 - DNA, 25 bp, Artificial Sequence
  Description of Artificial Sequence: Synthetic oligonucleotide
tcgtgaggttcgacagagacgccgc

SEQ ID NO: 30283 - DNA, 24 bp, Artificial Sequence
  Description of Artificial Sequence: Synthetic oligonucleotide
cgtgaggttcgacagagacgccgc

SEQ ID NO: 30284 - DNA, 25 bp, Artificial Sequence
  Description of Artificial Sequence: Synthetic oligonucleotide
gtgaggttcgacagagacgccgcga

SEQ ID NO: 30285 - DNA, 26 bp, Artificial Sequence
  Description of Artificial Sequence: Synthetic oligonucleotide
tgaggttcgacagagacgccgcgagt

SEQ ID NO: 30286 - DNA, 25 bp, Artificial Sequence
  Description of Artificial Sequence: Synthetic oligonucleotide
gaggttcgacagagacgccgcgagt

SEQ ID NO: 30287 - DNA, 25 bp, Artificial Sequence
  Description of Artificial Sequence: Synthetic oligonucleotide
aggttcgacagagacgccgcgagtc

SEQ ID NO: 30288 - DNA, 24 bp, Artificial Sequence
  Description of Artificial Sequence: Synthetic oligonucleotide
ggttcgacagagacgccgcgagtc

SEQ ID NO: 30289 - DNA, 24 bp, Artificial Sequence
  Description of Artificial Sequence: Synthetic oligonucleotide
gttcgacagagacgccgcgagtcc

SEQ ID NO: 30290 - DNA, 25 bp, Artificial Sequence
  Description of Artificial Sequence: Synthetic oligonucleotide
ttcgacagagacgccgcgagtccga

SEQ ID NO: 30291 - DNA, 24 bp, Artificial Sequence
  Description of Artificial Sequence: Synthetic oligonucleotide
tcgacagagacgccgcgagtccga

SEQ ID NO: 30292 - DNA, 23 bp, Artificial Sequence
  Description of Artificial Sequence: Synthetic oligonucleotide
cgacagagacgccgcgagtccga

SEQ ID NO: 30293 - DNA, 23 bp, Artificial Sequence
  Description of Artificial Sequence: Synthetic oligonucleotide
gacagagacgccgcgagtccgag

SEQ ID NO: 30294 - DNA, 24 bp, Artificial Sequence
  Description of Artificial Sequence: Synthetic oligonucleotide
acagagacgccgcgagtccgagga

SEQ ID NO: 30295 - DNA, 23 bp, Artificial Sequence
  Description of Artificial Sequence: Synthetic oligonucleotide
cagagacgccgcgagtccgagga

SEQ ID NO: 30296 - DNA, 23 bp, Artificial Sequence
  Description of Artificial Sequence: Synthetic oligonucleotide
agagacgccgcgagtccgaggac

SEQ ID NO: 30297 - DNA, 22 bp, Artificial Sequence
  Description of Artificial Sequence: Synthetic oligonucleotide
gagacgccgcgagtccgaggac

SEQ ID NO: 30298 - DNA, 22 bp, Artificial Sequence
  Description of Artificial Sequence: Synthetic oligonucleotide
agacgccgcgagtccgaggacg

SEQ ID NO: 30299 - DNA, 27 bp, Artificial Sequence
  Description of Artificial Sequence: Synthetic oligonucleotide
gggtctcacaccctccagtggatgtac

SEQ ID NO: 30300 - DNA, 27 bp, Artificial Sequence
  Description of Artificial Sequence: Synthetic oligonucleotide
ggtctcacaccctccagtggatgtacg

SEQ ID NO: 30301 - DNA, 27 bp, Artificial Sequence
  Description of Artificial Sequence: Synthetic oligonucleotide
gtctcacaccctccagtggatgtacgg

SEQ ID NO: 30302 - DNA, 27 bp, Artificial Sequence
  Description of Artificial Sequence: Synthetic oligonucleotide
tctcacaccctccagtggatgtacggc

SEQ ID NO: 30303 - DNA, 27 bp, Artificial Sequence
  Description of Artificial Sequence: Synthetic oligonucleotide
ctcacaccctccagtggatgtacggct

SEQ ID NO: 30304 - DNA, 27 bp, Artificial Sequence
  Description of Artificial Sequence: Synthetic oligonucleotide
tcacaccctccagtggatgtacggctg

SEQ ID NO: 30305 - DNA, 26 bp, Artificial Sequence
  Description of Artificial Sequence: Synthetic oligonucleotide
cacaccctccagtggatgtacggctg

SEQ ID NO: 30306 - DNA, 26 bp, Artificial Sequence
  Description of Artificial Sequence: Synthetic oligonucleotide
acaccctccagtggatgtacggctgc

SEQ ID NO: 30307 - DNA, 25 bp, Artificial Sequence
  Description of Artificial Sequence: Synthetic oligonucleotide
caccctccagtggatgtacggctgc

SEQ ID NO: 30308 - DNA, 26 bp, Artificial Sequence
  Description of Artificial Sequence: Synthetic oligonucleotide
accctccagtggatgtacggctgcga

SEQ ID NO: 30309 - DNA, 25 bp, Artificial Sequence
  Description of Artificial Sequence: Synthetic oligonucleotide
ccctccagtggatgtacggctgcga

SEQ ID NO: 30310 - DNA, 25 bp, Artificial Sequence
  Description of Artificial Sequence: Synthetic oligonucleotide
cctccagtggatgtacggctgcgac

SEQ ID NO: 30311 - DNA, 26 bp, Artificial Sequence
  Description of Artificial Sequence: Synthetic oligonucleotide
ctccagtggatgtacggctgcgacgt

SEQ ID NO: 30312 - DNA, 26 bp, Artificial Sequence
  Description of Artificial Sequence: Synthetic oligonucleotide
tccagtggatgtacggctgcgacgtg

SEQ ID NO: 30313 - DNA, 25 bp, Artificial Sequence
  Description of Artificial Sequence: Synthetic oligonucleotide
ccagtggatgtacggctgcgacgtg

SEQ ID NO: 30314 - DNA, 25 bp, Artificial Sequence
  Description of Artificial Sequence: Synthetic oligonucleotide
cagtggatgtacggctgcgacgtgg

SEQ ID NO: 30315 - DNA, 25 bp, Artificial Sequence
  Description of Artificial Sequence: Synthetic oligonucleotide
agtggatgtacggctgcgacgtggg

SEQ ID NO: 30316 - DNA, 24 bp, Artificial Sequence
  Description of Artificial Sequence: Synthetic oligonucleotide
gtggatgtacggctgcgacgtggg

SEQ ID NO: 30317 - DNA, 24 bp, Artificial Sequence
  Description of Artificial Sequence: Synthetic oligonucleotide
tggatgtacggctgcgacgtgggg

SEQ ID NO: 30318 - DNA, 21 bp, Artificial Sequence
  Description of Artificial Sequence: Synthetic oligonucleotide
tccgaggacggagccccggga

SEQ ID NO: 30319 - DNA, 20 bp, Artificial Sequence
  Description of Artificial Sequence: Synthetic oligonucleotide
ccgaggacggagccccggga

SEQ ID NO: 30320 - DNA, 20 bp, Artificial Sequence
  Description of Artificial Sequence: Synthetic oligonucleotide
cgaggacggagccccgggag

SEQ ID NO: 30321 - DNA, 20 bp, Artificial Sequence
  Description of Artificial Sequence: Synthetic oligonucleotide
gaggacggagccccgggagc

SEQ ID NO: 30322 - DNA, 20 bp, Artificial Sequence
  Description of Artificial Sequence: Synthetic oligonucleotide
aggacggagccccgggagcc

SEQ ID NO: 30323 - DNA, 20 bp, Artificial Sequence
  Description of Artificial Sequence: Synthetic oligonucleotide
ggacggagccccgggagcct

SEQ ID NO: 30324 - DNA, 20 bp, Artificial Sequence
  Description of Artificial Sequence: Synthetic oligonucleotide
gacggagccccgggagccgt

SEQ ID NO: 30325 - DNA, 20 bp, Artificial Sequence
  Description of Artificial Sequence: Synthetic oligonucleotide
acggagccccgggagccgtg

SEQ ID NO: 30326 - DNA, 20 bp, Artificial Sequence
  Description of Artificial Sequence: Synthetic oligonucleotide
cggagccccgggagccgtgt

SEQ ID NO: 30327 - DNA, 22 bp, Artificial Sequence
  Description of Artificial Sequence: Synthetic oligonucleotide
ggagccccgggagccgtggata

SEQ ID NO: 30328 - DNA, 23 bp, Artificial Sequence
  Description of Artificial Sequence: Synthetic oligonucleotide
gagccccgggagccgtggataga

SEQ ID NO: 30329 - DNA, 23 bp, Artificial Sequence
  Description of Artificial Sequence: Synthetic oligonucleotide
agccccgggagccgtggatagag

SEQ ID NO: 30330 - DNA, 22 bp, Artificial Sequence
  Description of Artificial Sequence: Synthetic oligonucleotide
gccccgggagccgtggatagag

SEQ ID NO: 30331 - DNA, 24 bp, Artificial Sequence
  Description of Artificial Sequence: Synthetic oligonucleotide
ccccgggagccgtggatagagcaa

SEQ ID NO: 30332 - DNA, 25 bp, Artificial Sequence
  Description of Artificial Sequence: Synthetic oligonucleotide
cccgggagccgtggatagagcaaga

SEQ ID NO: 30333 - DNA, 25 bp, Artificial Sequence
  Description of Artificial Sequence: Synthetic oligonucleotide
ccgggagccgtggatagagcaagag

SEQ ID NO: 30334 - DNA, 25 bp, Artificial Sequence
  Description of Artificial Sequence: Synthetic oligonucleotide
cgggagccgtggatagagcaagagg

SEQ ID NO: 30335 - DNA, 25 bp, Artificial Sequence
  Description of Artificial Sequence: Synthetic oligonucleotide
gggagccgtggatagagcaagaggg

SEQ ID NO: 30336 - DNA, 25 bp, Artificial Sequence
  Description of Artificial Sequence: Synthetic oligonucleotide
ggagccgtggatagagcaagagggg

SEQ ID NO: 30337 - DNA, 25 bp, Artificial Sequence
  Description of Artificial Sequence: Synthetic oligonucleotide
gagccgtggatagagcaagaggggc

SEQ ID NO: 30338 - DNA, 25 bp, Artificial Sequence
  Description of Artificial Sequence: Synthetic oligonucleotide
agccgtggatagagcaagaggggcc

SEQ ID NO: 30339 - DNA, 27 bp, Artificial Sequence
  Description of Artificial Sequence: Synthetic oligonucleotide
tcagatcacccagcgcaagtgggagga

SEQ ID NO: 30340 - DNA, 26 bp, Artificial Sequence
  Description of Artificial Sequence: Synthetic oligonucleotide
cagatcacccagcgcaagtgggagga

SEQ ID NO: 30341 - DNA, 26 bp, Artificial Sequence
  Description of Artificial Sequence: Synthetic oligonucleotide
agatcacccagcgcaagtgggaggag

SEQ ID NO: 30342 - DNA, 25 bp, Artificial Sequence
  Description of Artificial Sequence: Synthetic oligonucleotide
gatcacccagcgcaagtgggaggag

SEQ ID NO: 30343 - DNA, 25 bp, Artificial Sequence
  Description of Artificial Sequence: Synthetic oligonucleotide
atcacccagcgcaagtgggaggagg

SEQ ID NO: 30344 - DNA, 24 bp, Artificial Sequence
  Description of Artificial Sequence: Synthetic oligonucleotide
tcacccagcgcaagtgggaggagg

SEQ ID NO: 30345 - DNA, 23 bp, Artificial Sequence
  Description of Artificial Sequence: Synthetic oligonucleotide
cacccagcgcaagtgggaggagg

SEQ ID NO: 30346 - DNA, 23 bp, Artificial Sequence
  Description of Artificial Sequence: Synthetic oligonucleotide
acccagcgcaagtgggaggaggc

SEQ ID NO: 30347 - DNA, 22 bp, Artificial Sequence
  Description of Artificial Sequence: Synthetic oligonucleotide
cccagcgcaagtgggaggaggc

SEQ ID NO: 30348 - DNA, 22 bp, Artificial Sequence
  Description of Artificial Sequence: Synthetic oligonucleotide
ccagcgcaagtgggaggaggcc

SEQ ID NO: 30349 - DNA, 22 bp, Artificial Sequence
  Description of Artificial Sequence: Synthetic oligonucleotide
cagcgcaagtgggaggaggccc

SEQ ID NO: 30350 - DNA, 23 bp, Artificial Sequence
  Description of Artificial Sequence: Synthetic oligonucleotide
agcgcaagtgggaggaggcccgt

SEQ ID NO: 30351 - DNA, 22 bp, Artificial Sequence
  Description of Artificial Sequence: Synthetic oligonucleotide
gcgcaagtgggaggaggcccgt

SEQ ID NO: 30352 - DNA, 23 bp, Artificial Sequence
  Description of Artificial Sequence: Synthetic oligonucleotide
cgcaagtgggaggaggcccgtgt

SEQ ID NO: 30353 - DNA, 23 bp, Artificial Sequence
  Description of Artificial Sequence: Synthetic oligonucleotide
gcaagtgggaggaggcccgtgtg

SEQ ID NO: 30354 - DNA, 23 bp, Artificial Sequence
  Description of Artificial Sequence: Synthetic oligonucleotide
caagtgggaggaggcccgtgtgg

SEQ ID NO: 30355 - DNA, 23 bp, Artificial Sequence
  Description of Artificial Sequence: Synthetic oligonucleotide
aagtgggaggaggcccgtgtggc

SEQ ID NO: 30356 - DNA, 22 bp, Artificial Sequence
  Description of Artificial Sequence: Synthetic oligonucleotide
agtgggaggaggcccgtgtggc

SEQ ID NO: 30357 - DNA, 21 bp, Artificial Sequence
  Description of Artificial Sequence: Synthetic oligonucleotide
gtgggaggaggcccgtgtggc

SEQ ID NO: 30358 - DNA, 21 bp, Artificial Sequence
  Description of Artificial Sequence: Synthetic oligonucleotide
tgggaggaggcccgtgtggcg

SEQ ID NO: 30359 - DNA, 20 bp, Artificial Sequence
  Description of Artificial Sequence: Synthetic oligonucleotide
gggaggaggcccgtgtggcg

SEQ ID NO: 30360 - DNA, 21 bp, Artificial Sequence
  Description of Artificial Sequence: Synthetic oligonucleotide
ggaggaggcccgtgtggcgga

SEQ ID NO: 30361 - DNA, 21 bp, Artificial Sequence
  Description of Artificial Sequence: Synthetic oligonucleotide
gaggaggcccgtgtggcggag

SEQ ID NO: 30362 - DNA, 22 bp, Artificial Sequence
  Description of Artificial Sequence: Synthetic oligonucleotide
aggaggcccgtgtggcggagca

SEQ ID NO: 30363 - DNA, 21 bp, Artificial Sequence
  Description of Artificial Sequence: Synthetic oligonucleotide
ggaggcccgtgtggcggagca

SEQ ID NO: 30364 - DNA, 21 bp, Artificial Sequence
  Description of Artificial Sequence: Synthetic oligonucleotide
gaggcccgtgtggcggagcag

SEQ ID NO: 30365 - DNA, 22 bp, Artificial Sequence
  Description of Artificial Sequence: Synthetic oligonucleotide
aggcccgtgtggcggagcagct

SEQ ID NO: 30366 - DNA, 27 bp, Artificial Sequence
  Description of Artificial Sequence: Synthetic oligonucleotide
tggacggcacccagttcgtgaggttct

SEQ ID NO: 30367 - DNA, 27 bp, Artificial Sequence
  Description of Artificial Sequence: Synthetic oligonucleotide
ggacggcacccagttcgtgaggttcta

SEQ ID NO: 30368 - DNA, 27 bp, Artificial Sequence
  Description of Artificial Sequence: Synthetic oligonucleotide
gacggcacccagttcgtgaggttctac

SEQ ID NO: 30369 - DNA, 28 bp, Artificial Sequence
  Description of Artificial Sequence: Synthetic oligonucleotide
acggcacccagttcgtgaggttctacag

SEQ ID NO: 30370 - DNA, 27 bp, Artificial Sequence
  Description of Artificial Sequence: Synthetic oligonucleotide
cggcacccagttcgtgaggttctacag

SEQ ID NO: 30371 - DNA, 27 bp, Artificial Sequence
  Description of Artificial Sequence: Synthetic oligonucleotide
ggcacccagttcgtgaggttctacagc

SEQ ID NO: 30372 - DNA, 27 bp, Artificial Sequence
  Description of Artificial Sequence: Synthetic oligonucleotide
gcacccagttcgtgaggttctacagcg

SEQ ID NO: 30373 - DNA, 28 bp, Artificial Sequence
  Description of Artificial Sequence: Synthetic oligonucleotide
cacccagttcgtgaggttctacagcgac

SEQ ID NO: 30374 - DNA, 28 bp, Artificial Sequence
  Description of Artificial Sequence: Synthetic oligonucleotide
acccagttcgtgaggttctacagcgacg

SEQ ID NO: 30375 - DNA, 27 bp, Artificial Sequence
  Description of Artificial Sequence: Synthetic oligonucleotide
cccagttcgtgaggttctacagcgacg

SEQ ID NO: 30376 - DNA, 27 bp, Artificial Sequence
  Description of Artificial Sequence: Synthetic oligonucleotide
ccagttcgtgaggttctacagcgacgc

SEQ ID NO: 30377 - DNA, 27 bp, Artificial Sequence
  Description of Artificial Sequence: Synthetic oligonucleotide
cagttcgtgaggttctacagcgacgcc

SEQ ID NO: 30378 - DNA, 27 bp, Artificial Sequence
  Description of Artificial Sequence: Synthetic oligonucleotide
agttcgtgaggttctacagcgacgccg

SEQ ID NO: 30379 - DNA, 26 bp, Artificial Sequence
  Description of Artificial Sequence: Synthetic oligonucleotide
gttcgtgaggttctacagcgacgccg

SEQ ID NO: 30380 - DNA, 26 bp, Artificial Sequence
  Description of Artificial Sequence: Synthetic oligonucleotide
ttcgtgaggttctacagcgacgccgc

SEQ ID NO: 30381 - DNA, 25 bp, Artificial Sequence
  Description of Artificial Sequence: Synthetic oligonucleotide
tcgtgaggttctacagcgacgccgc

SEQ ID NO: 30382 - DNA, 24 bp, Artificial Sequence
  Description of Artificial Sequence: Synthetic oligonucleotide
cgtgaggttctacagcgacgccgc

SEQ ID NO: 30383 - DNA, 25 bp, Artificial Sequence
  Description of Artificial Sequence: Synthetic oligonucleotide
gtgaggttctacagcgacgccgcga

SEQ ID NO: 30384 - DNA, 26 bp, Artificial Sequence
  Description of Artificial Sequence: Synthetic oligonucleotide
tgaggttctacagcgacgccgcgagt

SEQ ID NO: 30385 - DNA, 25 bp, Artificial Sequence
  Description of Artificial Sequence: Synthetic oligonucleotide
gaggttctacagcgacgccgcgagt

SEQ ID NO: 30386 - DNA, 25 bp, Artificial Sequence
  Description of Artificial Sequence: Synthetic oligonucleotide
aggttctacagcgacgccgcgagtc

SEQ ID NO: 30387 - DNA, 24 bp, Artificial Sequence
  Description of Artificial Sequence: Synthetic oligonucleotide
ggttctacagcgacgccgcgagtc

SEQ ID NO: 30388 - DNA, 24 bp, Artificial Sequence
  Description of Artificial Sequence: Synthetic oligonucleotide
gttctacagcgacgccgcgagtcc

SEQ ID NO: 30389 - DNA, 25 bp, Artificial Sequence
  Description of Artificial Sequence: Synthetic oligonucleotide
ttctacagcgacgccgcgagtccga

SEQ ID NO: 30390 - DNA, 24 bp, Artificial Sequence
  Description of Artificial Sequence: Synthetic oligonucleotide
tctacagcgacgccgcgagtccga

SEQ ID NO: 30391 - DNA, 23 bp, Artificial Sequence
  Description of Artificial Sequence: Synthetic oligonucleotide
ctacagcgacgccgcgagtccga

SEQ ID NO: 30392 - DNA, 23 bp, Artificial Sequence
  Description of Artificial Sequence: Synthetic oligonucleotide
tacagcgacgccgcgagtccgag

SEQ ID NO: 30393 - DNA, 26 bp, Artificial Sequence
  Description of Artificial Sequence: Synthetic oligonucleotide
gggaccgggagacacagatctgcaag

SEQ ID NO: 30394 - DNA, 26 bp, Artificial Sequence
  Description of Artificial Sequence: Synthetic oligonucleotide
ggaccgggagacacagatctgcaagg

SEQ ID NO: 30395 - DNA, 26 bp, Artificial Sequence
  Description of Artificial Sequence: Synthetic oligonucleotide
gaccgggagacacagatctgcaaggc

SEQ ID NO: 30396 - DNA, 27 bp, Artificial Sequence
  Description of Artificial Sequence: Synthetic oligonucleotide
accgggagacacagatctgcaaggcca

SEQ ID NO: 30397 - DNA, 27 bp, Artificial Sequence
  Description of Artificial Sequence: Synthetic oligonucleotide
ccgggagacacagatctgcaaggccaa

SEQ ID NO: 30398 - DNA, 27 bp, Artificial Sequence
  Description of Artificial Sequence: Synthetic oligonucleotide
cgggagacacagatctgcaaggccaag

SEQ ID NO: 30399 - DNA, 27 bp, Artificial Sequence
  Description of Artificial Sequence: Synthetic oligonucleotide
gggagacacagatctgcaaggccaagg

SEQ ID NO: 30400 - DNA, 27 bp, Artificial Sequence
  Description of Artificial Sequence: Synthetic oligonucleotide
ggagacacagatctgcaaggccaaggc

SEQ ID NO: 30401 - DNA, 28 bp, Artificial Sequence
  Description of Artificial Sequence: Synthetic oligonucleotide
gagacacagatctgcaaggccaaggcac

SEQ ID NO: 30402 - DNA, 29 bp, Artificial Sequence
  Description of Artificial Sequence: Synthetic oligonucleotide
agacacagatctgcaaggccaaggcacag

SEQ ID NO: 30403 - DNA, 28 bp, Artificial Sequence
  Description of Artificial Sequence: Synthetic oligonucleotide
gacacagatctgcaaggccaaggcacag

SEQ ID NO: 30404 - DNA, 29 bp, Artificial Sequence
  Description of Artificial Sequence: Synthetic oligonucleotide
acacagatctgcaaggccaaggcacagac

SEQ ID NO: 30405 - DNA, 28 bp, Artificial Sequence
  Description of Artificial Sequence: Synthetic oligonucleotide
cacagatctgcaaggccaaggcacagac

SEQ ID NO: 30406 - DNA, 31 bp, Artificial Sequence
  Description of Artificial Sequence: Synthetic oligonucleotide
acagatctgcaaggccaaggcacagacttac

SEQ ID NO: 30407 - DNA, 30 bp, Artificial Sequence
  Description of Artificial Sequence: Synthetic oligonucleotide
cagatctgcaaggccaaggcacagacttac

SEQ ID NO: 30408 - DNA, 30 bp, Artificial Sequence
  Description of Artificial Sequence: Synthetic oligonucleotide
agatctgcaaggccaaggcacagacttacc

SEQ ID NO: 30409 - DNA, 29 bp, Artificial Sequence
  Description of Artificial Sequence: Synthetic oligonucleotide
gatctgcaaggccaaggcacagacttacc

SEQ ID NO: 30410 - DNA, 29 bp, Artificial Sequence
  Description of Artificial Sequence: Synthetic oligonucleotide
atctgcaaggccaaggcacagacttaccg

SEQ ID NO: 30411 - DNA, 28 bp, Artificial Sequence
  Description of Artificial Sequence: Synthetic oligonucleotide
tctgcaaggccaaggcacagacttaccg

SEQ ID NO: 30412 - DNA, 27 bp, Artificial Sequence
  Description of Artificial Sequence: Synthetic oligonucleotide
ctgcaaggccaaggcacagacttaccg

SEQ ID NO: 30413 - DNA, 28 bp, Artificial Sequence
  Description of Artificial Sequence: Synthetic oligonucleotide
tgcaaggccaaggcacagacttaccgag

SEQ ID NO: 30414 - DNA, 27 bp, Artificial Sequence
  Description of Artificial Sequence: Synthetic oligonucleotide
gcaaggccaaggcacagacttaccgag

SEQ ID NO: 30415 - DNA, 28 bp, Artificial Sequence
  Description of Artificial Sequence: Synthetic oligonucleotide
caaggccaaggcacagacttaccgagag

SEQ ID NO: 30416 - DNA, 30 bp, Artificial Sequence
  Description of Artificial Sequence: Synthetic oligonucleotide
aaggccaaggcacagacttaccgagagaac

SEQ ID NO: 30417 - DNA, 29 bp, Artificial Sequence
  Description of Artificial Sequence: Synthetic oligonucleotide
aggccaaggcacagacttaccgagagaac

SEQ ID NO: 30418 - DNA, 28 bp, Artificial Sequence
  Description of Artificial Sequence: Synthetic oligonucleotide
ggccaaggcacagacttaccgagagaac

SEQ ID NO: 30419 - DNA, 28 bp, Artificial Sequence
  Description of Artificial Sequence: Synthetic oligonucleotide
gccaaggcacagacttaccgagagaacc

SEQ ID NO: 30420 - DNA, 29 bp, Artificial Sequence
  Description of Artificial Sequence: Synthetic oligonucleotide
ccaaggcacagacttaccgagagaacctg

SEQ ID NO: 30421 - DNA, 29 bp, Artificial Sequence
  Description of Artificial Sequence: Synthetic oligonucleotide
caaggcacagacttaccgagagaacctgc

SEQ ID NO: 30422 - DNA, 29 bp, Artificial Sequence
  Description of Artificial Sequence: Synthetic oligonucleotide
aaggcacagacttaccgagagaacctgcg

SEQ ID NO: 30423 - DNA, 27 bp, Artificial Sequence
  Description of Artificial Sequence: Synthetic oligonucleotide
gcacagacttaccgagagaacctgcgc

SEQ ID NO: 30424 - DNA, 29 bp, Artificial Sequence
  Description of Artificial Sequence: Synthetic oligonucleotide
acagatctgcaaggccaaggcacagactg

SEQ ID NO: 30425 - DNA, 28 bp, Artificial Sequence
  Description of Artificial Sequence: Synthetic oligonucleotide
cagatctgcaaggccaaggcacagactg

SEQ ID NO: 30426 - DNA, 29 bp, Artificial Sequence
  Description of Artificial Sequence: Synthetic oligonucleotide
agatctgcaaggccaaggcacagactgac

SEQ ID NO: 30427 - DNA, 28 bp, Artificial Sequence
  Description of Artificial Sequence: Synthetic oligonucleotide
gatctgcaaggccaaggcacagactgac

SEQ ID NO: 30428 - DNA, 28 bp, Artificial Sequence
  Description of Artificial Sequence: Synthetic oligonucleotide
atctgcaaggccaaggcacagactgacc

SEQ ID NO: 30429 - DNA, 27 bp, Artificial Sequence
  Description of Artificial Sequence: Synthetic oligonucleotide
tctgcaaggccaaggcacagactgacc

SEQ ID NO: 30430 - DNA, 26 bp, Artificial Sequence
  Description of Artificial Sequence: Synthetic oligonucleotide
ctgcaaggccaaggcacagactgacc

SEQ ID NO: 30431 - DNA, 27 bp, Artificial Sequence
  Description of Artificial Sequence: Synthetic oligonucleotide
tgcaaggccaaggcacagactgaccga

SEQ ID NO: 30432 - DNA, 26 bp, Artificial Sequence
  Description of Artificial Sequence: Synthetic oligonucleotide
gcaaggccaaggcacagactgaccga

SEQ ID NO: 30433 - DNA, 27 bp, Artificial Sequence
  Description of Artificial Sequence: Synthetic oligonucleotide
caaggccaaggcacagactgaccgaga

SEQ ID NO: 30434 - DNA, 27 bp, Artificial Sequence
  Description of Artificial Sequence: Synthetic oligonucleotide
aaggccaaggcacagactgaccgagag

SEQ ID NO: 30435 - DNA, 27 bp, Artificial Sequence
  Description of Artificial Sequence: Synthetic oligonucleotide
aggccaaggcacagactgaccgagaga

SEQ ID NO: 30436 - DNA, 27 bp, Artificial Sequence
  Description of Artificial Sequence: Synthetic oligonucleotide
ggccaaggcacagactgaccgagagaa

SEQ ID NO: 30437 - DNA, 27 bp, Artificial Sequence
  Description of Artificial Sequence: Synthetic oligonucleotide
gccaaggcacagactgaccgagagaac

SEQ ID NO: 30438 - DNA, 27 bp, Artificial Sequence
  Description of Artificial Sequence: Synthetic oligonucleotide
ccaaggcacagactgaccgagagaacc

SEQ ID NO: 30439 - DNA, 28 bp, Artificial Sequence
  Description of Artificial Sequence: Synthetic oligonucleotide
caaggcacagactgaccgagagaacctg

SEQ ID NO: 30440 - DNA, 28 bp, Artificial Sequence
  Description of Artificial Sequence: Synthetic oligonucleotide
aaggcacagactgaccgagagaacctgc

SEQ ID NO: 30441 - DNA, 28 bp, Artificial Sequence
  Description of Artificial Sequence: Synthetic oligonucleotide
agcattgggaccgggagacacagatctg

SEQ ID NO: 30442 - DNA, 27 bp, Artificial Sequence
  Description of Artificial Sequence: Synthetic oligonucleotide
gcattgggaccgggagacacagatctg

SEQ ID NO: 30443 - DNA, 27 bp, Artificial Sequence
  Description of Artificial Sequence: Synthetic oligonucleotide
cattgggaccgggagacacagatctgc

SEQ ID NO: 30444 - DNA, 26 bp, Artificial Sequence
  Description of Artificial Sequence: Synthetic oligonucleotide
aggccaaggcacagactgaccgagag

SEQ ID NO: 30445 - DNA, 25 bp, Artificial Sequence
  Description of Artificial Sequence: Synthetic oligonucleotide
ggccaaggcacagactgaccgagag

SEQ ID NO: 30446 - DNA, 26 bp, Artificial Sequence
  Description of Artificial Sequence: Synthetic oligonucleotide
gccaaggcacagactgaccgagagga

SEQ ID NO: 30447 - DNA, 26 bp, Artificial Sequence
  Description of Artificial Sequence: Synthetic oligonucleotide
ccaaggcacagactgaccgagaggac

SEQ ID NO: 30448 - DNA, 27 bp, Artificial Sequence
  Description of Artificial Sequence: Synthetic oligonucleotide
caaggcacagactgaccgagaggacct

SEQ ID NO: 30449 - DNA, 27 bp, Artificial Sequence
  Description of Artificial Sequence: Synthetic oligonucleotide
aaggcacagactgaccgagaggacctg

SEQ ID NO: 30450 - DNA, 26 bp, Artificial Sequence
  Description of Artificial Sequence: Synthetic oligonucleotide
aggcacagactgaccgagaggacctg

SEQ ID NO: 30451 - DNA, 25 bp, Artificial Sequence
  Description of Artificial Sequence: Synthetic oligonucleotide
ggcacagactgaccgagaggacctg

SEQ ID NO: 30452 - DNA, 25 bp, Artificial Sequence
  Description of Artificial Sequence: Synthetic oligonucleotide
gcacagactgaccgagaggacctgc

SEQ ID NO: 30453 - DNA, 25 bp, Artificial Sequence
  Description of Artificial Sequence: Synthetic oligonucleotide
cacagactgaccgagaggacctgcg

SEQ ID NO: 30454 - DNA, 26 bp, Artificial Sequence
  Description of Artificial Sequence: Synthetic oligonucleotide
acagactgaccgagaggacctgcgga

SEQ ID NO: 30455 - DNA, 25 bp, Artificial Sequence
  Description of Artificial Sequence: Synthetic oligonucleotide
cagactgaccgagaggacctgcgga

SEQ ID NO: 30456 - DNA, 25 bp, Artificial Sequence
  Description of Artificial Sequence: Synthetic oligonucleotide
agactgaccgagaggacctgcggac

SEQ ID NO: 30457 - DNA, 24 bp, Artificial Sequence
  Description of Artificial Sequence: Synthetic oligonucleotide
gactgaccgagaggacctgcggac

SEQ ID NO: 30458 - DNA, 24 bp, Artificial Sequence
  Description of Artificial Sequence: Synthetic oligonucleotide
actgaccgagaggacctgcggacc

SEQ ID NO: 30459 - DNA, 23 bp, Artificial Sequence
  Description of Artificial Sequence: Synthetic oligonucleotide
ctgaccgagaggacctgcggacc

SEQ ID NO: 30460 - DNA, 24 bp, Artificial Sequence
  Description of Artificial Sequence: Synthetic oligonucleotide
tgaccgagaggacctgcggaccct

SEQ ID NO: 30461 - DNA, 23 bp, Artificial Sequence
  Description of Artificial Sequence: Synthetic oligonucleotide
gaccgagaggacctgcggaccct

SEQ ID NO: 30462 - DNA, 26 bp, Artificial Sequence
  Description of Artificial Sequence: Synthetic oligonucleotide
ggccaaggcacagactgaccgagaga

SEQ ID NO: 30463 - DNA, 26 bp, Artificial Sequence
  Description of Artificial Sequence: Synthetic oligonucleotide
gccaaggcacagactgaccgagagag

SEQ ID NO: 30464 - DNA, 26 bp, Artificial Sequence
  Description of Artificial Sequence: Synthetic oligonucleotide
ccaaggcacagactgaccgagagagc

SEQ ID NO: 30465 - DNA, 27 bp, Artificial Sequence
  Description of Artificial Sequence: Synthetic oligonucleotide
caaggcacagactgaccgagagagcct

SEQ ID NO: 30466 - DNA, 27 bp, Artificial Sequence
  Description of Artificial Sequence: Synthetic oligonucleotide
aaggcacagactgaccgagagagcctg

SEQ ID NO: 30467 - DNA, 26 bp, Artificial Sequence
  Description of Artificial Sequence: Synthetic oligonucleotide
acagactgaccgagagagcctgcgga

SEQ ID NO: 30468 - DNA, 25 bp, Artificial Sequence
  Description of Artificial Sequence: Synthetic oligonucleotide
cagactgaccgagagagcctgcgga

SEQ ID NO: 30469 - DNA, 25 bp, Artificial Sequence
  Description of Artificial Sequence: Synthetic oligonucleotide
agactgaccgagagagcctgcggac

SEQ ID NO: 30470 - DNA, 24 bp, Artificial Sequence
  Description of Artificial Sequence: Synthetic oligonucleotide
gactgaccgagagagcctgcggac

SEQ ID NO: 30471 - DNA, 24 bp, Artificial Sequence
  Description of Artificial Sequence: Synthetic oligonucleotide
actgaccgagagagcctgcggacc

SEQ ID NO: 30472 - DNA, 23 bp, Artificial Sequence
  Description of Artificial Sequence: Synthetic oligonucleotide
ctgaccgagagagcctgcggacc

SEQ ID NO: 30473 - DNA, 24 bp, Artificial Sequence
  Description of Artificial Sequence: Synthetic oligonucleotide
tgaccgagagagcctgcggaccct

SEQ ID NO: 30474 - DNA, 23 bp, Artificial Sequence
  Description of Artificial Sequence: Synthetic oligonucleotide
gaccgagagagcctgcggaccct

SEQ ID NO: 30475 - DNA, 23 bp, Artificial Sequence
  Description of Artificial Sequence: Synthetic oligonucleotide
accgagagagcctgcggaccctg

SEQ ID NO: 30476 - DNA, 22 bp, Artificial Sequence
  Description of Artificial Sequence: Synthetic oligonucleotide
ccgagagagcctgcggaccctg

SEQ ID NO: 30477 - DNA, 23 bp, Artificial Sequence
  Description of Artificial Sequence: Synthetic oligonucleotide
cgagagagcctgcggaccctgct

SEQ ID NO: 30478 - DNA, 23 bp, Artificial Sequence
  Description of Artificial Sequence: Synthetic oligonucleotide
gagagagcctgcggaccctgctc

SEQ ID NO: 30479 - DNA, 23 bp, Artificial Sequence
  Description of Artificial Sequence: Synthetic oligonucleotide
agagagcctgcggaccctgctcc

SEQ ID NO: 30480 - DNA, 22 bp, Artificial Sequence
  Description of Artificial Sequence: Synthetic oligonucleotide
gagagcctgcggaccctgctcc

SEQ ID NO: 30481 - DNA, 22 bp, Artificial Sequence
  Description of Artificial Sequence: Synthetic oligonucleotide
agagcctgcggaccctgctccg

SEQ ID NO: 30482 - DNA, 21 bp, Artificial Sequence
  Description of Artificial Sequence: Synthetic oligonucleotide
gagcctgcggaccctgctccg

SEQ ID NO: 30483 - DNA, 23 bp, Artificial Sequence
  Description of Artificial Sequence: Synthetic oligonucleotide
agcctgcggaccctgctccgcta

SEQ ID NO: 30484 - DNA, 22 bp, Artificial Sequence
  Description of Artificial Sequence: Synthetic oligonucleotide
gcctgcggaccctgctccgcta

SEQ ID NO: 30485 - DNA, 23 bp, Artificial Sequence
  Description of Artificial Sequence: Synthetic oligonucleotide
tgggccctgggcttctaccctgg

SEQ ID NO: 30486 - DNA, 22 bp, Artificial Sequence
  Description of Artificial Sequence: Synthetic oligonucleotide
gggccctgggcttctaccctgg

SEQ ID NO: 30487 - DNA, 22 bp, Artificial Sequence
  Description of Artificial Sequence: Synthetic oligonucleotide
ggccctgggcttctaccctggg

SEQ ID NO: 30488 - DNA, 23 bp, Artificial Sequence
  Description of Artificial Sequence: Synthetic oligonucleotide
gccctgggcttctaccctgggga

SEQ ID NO: 30489 - DNA, 25 bp, Artificial Sequence
  Description of Artificial Sequence: Synthetic oligonucleotide
ccctgggcttctaccctggggagat

SEQ ID NO: 30490 - DNA, 26 bp, Artificial Sequence
  Description of Artificial Sequence: Synthetic oligonucleotide
cctgggcttctaccctggggagatca

SEQ ID NO: 30491 - DNA, 27 bp, Artificial Sequence
  Description of Artificial Sequence: Synthetic oligonucleotide
ctgggcttctaccctggggagatcaca

SEQ ID NO: 30492 - DNA, 27 bp, Artificial Sequence
  Description of Artificial Sequence: Synthetic oligonucleotide
tgggcttctaccctggggagatcacac

SEQ ID NO: 30493 - DNA, 27 bp, Artificial Sequence
  Description of Artificial Sequence: Synthetic oligonucleotide
gggcttctaccctggggagatcacact

SEQ ID NO: 30494 - DNA, 27 bp, Artificial Sequence
  Description of Artificial Sequence: Synthetic oligonucleotide
ggcttctaccctggggagatcacactg

SEQ ID NO: 30495 - DNA, 28 bp, Artificial Sequence
  Description of Artificial Sequence: Synthetic oligonucleotide
gcttctaccctggggagatcacactgac

SEQ ID NO: 30496 - DNA, 28 bp, Artificial Sequence
  Description of Artificial Sequence: Synthetic oligonucleotide
cttctaccctggggagatcacactgacc

SEQ ID NO: 30497 - DNA, 29 bp, Artificial Sequence
  Description of Artificial Sequence: Synthetic oligonucleotide
ttctaccctggggagatcacactgacctg

SEQ ID NO: 30498 - DNA, 28 bp, Artificial Sequence
  Description of Artificial Sequence: Synthetic oligonucleotide
tctaccctggggagatcacactgacctg

SEQ ID NO: 30499 - DNA, 27 bp, Artificial Sequence
  Description of Artificial Sequence: Synthetic oligonucleotide
ctaccctggggagatcacactgacctg

SEQ ID NO: 30500 - DNA, 27 bp, Artificial Sequence
  Description of Artificial Sequence: Synthetic oligonucleotide
taccctggggagatcacactgacctgg

SEQ ID NO: 30501 - DNA, 26 bp, Artificial Sequence
  Description of Artificial Sequence: Synthetic oligonucleotide
accctggggagatcacactgacctgg

SEQ ID NO: 30502 - DNA, 25 bp, Artificial Sequence
  Description of Artificial Sequence: Synthetic oligonucleotide
ccctggggagatcacactgacctgg

SEQ ID NO: 30503 - DNA, 26 bp, Artificial Sequence
  Description of Artificial Sequence: Synthetic oligonucleotide
cctggggagatcacactgacctggca

SEQ ID NO: 30504 - DNA, 26 bp, Artificial Sequence
  Description of Artificial Sequence: Synthetic oligonucleotide
ctggggagatcacactgacctggcag

SEQ ID NO: 30505 - DNA, 26 bp, Artificial Sequence
  Description of Artificial Sequence: Synthetic oligonucleotide
tggggagatcacactgacctggcagc

SEQ ID NO: 30506 - DNA, 25 bp, Artificial Sequence
  Description of Artificial Sequence: Synthetic oligonucleotide
ggggagatcacactgacctggcagc

SEQ ID NO: 30507 - DNA, 25 bp, Artificial Sequence
  Description of Artificial Sequence: Synthetic oligonucleotide
gggagatcacactgacctggcagcg

SEQ ID NO: 30508 - DNA, 25 bp, Artificial Sequence
  Description of Artificial Sequence: Synthetic oligonucleotide
cgggtaccaccaggacgcctacgat

SEQ ID NO: 30509 - DNA, 25 bp, Artificial Sequence
  Description of Artificial Sequence: Synthetic oligonucleotide
gggtaccaccaggacgcctacgatg

SEQ ID NO: 30510 - DNA, 25 bp, Artificial Sequence
  Description of Artificial Sequence: Synthetic oligonucleotide
ggtaccaccaggacgcctacgatgg

SEQ ID NO: 30511 - DNA, 27 bp, Artificial Sequence
  Description of Artificial Sequence: Synthetic oligonucleotide
gtaccaccaggacgcctacgatggcaa

SEQ ID NO: 30512 - DNA, 27 bp, Artificial Sequence
  Description of Artificial Sequence: Synthetic oligonucleotide
taccaccaggacgcctacgatggcaag

SEQ ID NO: 30513 - DNA, 26 bp, Artificial Sequence
  Description of Artificial Sequence: Synthetic oligonucleotide
accaccaggacgcctacgatggcaag

SEQ ID NO: 30514 - DNA, 25 bp, Artificial Sequence
  Description of Artificial Sequence: Synthetic oligonucleotide
ccaccaggacgcctacgatggcaag

SEQ ID NO: 30515 - DNA, 27 bp, Artificial Sequence
  Description of Artificial Sequence: Synthetic oligonucleotide
caccaggacgcctacgatggcaaggat

SEQ ID NO: 30516 - DNA, 29 bp, Artificial Sequence
  Description of Artificial Sequence: Synthetic oligonucleotide
accaggacgcctacgatggcaaggattac

SEQ ID NO: 30517 - DNA, 28 bp, Artificial Sequence
  Description of Artificial Sequence: Synthetic oligonucleotide
ccaggacgcctacgatggcaaggattac

SEQ ID NO: 30518 - DNA, 30 bp, Artificial Sequence
  Description of Artificial Sequence: Synthetic oligonucleotide
caggacgcctacgatggcaaggattacatc

SEQ ID NO: 30519 - DNA, 30 bp, Artificial Sequence
  Description of Artificial Sequence: Synthetic oligonucleotide
aggacgcctacgatggcaaggattacatcg

SEQ ID NO: 30520 - DNA, 29 bp, Artificial Sequence
  Description of Artificial Sequence: Synthetic oligonucleotide
ggacgcctacgatggcaaggattacatcg

SEQ ID NO: 30521 - DNA, 29 bp, Artificial Sequence
  Description of Artificial Sequence: Synthetic oligonucleotide
gacgcctacgatggcaaggattacatcgc

SEQ ID NO: 30522 - DNA, 29 bp, Artificial Sequence
  Description of Artificial Sequence: Synthetic oligonucleotide
acgcctacgatggcaaggattacatcgcc

SEQ ID NO: 30523 - DNA, 28 bp, Artificial Sequence
  Description of Artificial Sequence: Synthetic oligonucleotide
cgcctacgatggcaaggattacatcgcc

SEQ ID NO: 30524 - DNA, 28 bp, Artificial Sequence
  Description of Artificial Sequence: Synthetic oligonucleotide
gcctacgatggcaaggattacatcgccc

SEQ ID NO: 30525 - DNA, 29 bp, Artificial Sequence
  Description of Artificial Sequence: Synthetic oligonucleotide
cctacgatggcaaggattacatcgccctg

SEQ ID NO: 30526 - DNA, 31 bp, Artificial Sequence
  Description of Artificial Sequence: Synthetic oligonucleotide
ctacgatggcaaggattacatcgccctgaac

SEQ ID NO: 30527 - DNA, 31 bp, Artificial Sequence
  Description of Artificial Sequence: Synthetic oligonucleotide
tacgatggcaaggattacatcgccctgaacg

SEQ ID NO: 30528 - DNA, 30 bp, Artificial Sequence
  Description of Artificial Sequence: Synthetic oligonucleotide
acgatggcaaggattacatcgccctgaacg

SEQ ID NO: 30529 - DNA, 29 bp, Artificial Sequence
  Description of Artificial Sequence: Synthetic oligonucleotide
cgatggcaaggattacatcgccctgaacg

SEQ ID NO: 30530 - DNA, 30 bp, Artificial Sequence
  Description of Artificial Sequence: Synthetic oligonucleotide
gatggcaaggattacatcgccctgaacgag

SEQ ID NO: 30531 - DNA, 30 bp, Artificial Sequence
  Description of Artificial Sequence: Synthetic oligonucleotide
atggcaaggattacatcgccctgaacgagg

SEQ ID NO: 30532 - DNA, 29 bp, Artificial Sequence
  Description of Artificial Sequence: Synthetic oligonucleotide
tggcaaggattacatcgccctgaacgagg

SEQ ID NO: 30533 - DNA, 27 bp, Artificial Sequence
  Description of Artificial Sequence: Synthetic oligonucleotide
taccaccaggacgcctacgacggcaaa

SEQ ID NO: 30534 - DNA, 26 bp, Artificial Sequence
  Description of Artificial Sequence: Synthetic oligonucleotide
accaccaggacgcctacgacggcaaa

SEQ ID NO: 30535 - DNA, 25 bp, Artificial Sequence
  Description of Artificial Sequence: Synthetic oligonucleotide
ccaccaggacgcctacgacggcaaa

SEQ ID NO: 30536 - DNA, 27 bp, Artificial Sequence
  Description of Artificial Sequence: Synthetic oligonucleotide
caccaggacgcctacgacggcaaagat

SEQ ID NO: 30537 - DNA, 29 bp, Artificial Sequence
  Description of Artificial Sequence: Synthetic oligonucleotide
accaggacgcctacgacggcaaagattac

SEQ ID NO: 30538 - DNA, 28 bp, Artificial Sequence
  Description of Artificial Sequence: Synthetic oligonucleotide
ccaggacgcctacgacggcaaagattac

SEQ ID NO: 30539 - DNA, 30 bp, Artificial Sequence
  Description of Artificial Sequence: Synthetic oligonucleotide
caggacgcctacgacggcaaagattacatc

SEQ ID NO: 30540 - DNA, 30 bp, Artificial Sequence
  Description of Artificial Sequence: Synthetic oligonucleotide
aggacgcctacgacggcaaagattacatcg

SEQ ID NO: 30541 - DNA, 29 bp, Artificial Sequence
  Description of Artificial Sequence: Synthetic oligonucleotide
ggacgcctacgacggcaaagattacatcg

SEQ ID NO: 30542 - DNA, 29 bp, Artificial Sequence
  Description of Artificial Sequence: Synthetic oligonucleotide
gacgcctacgacggcaaagattacatcgc

SEQ ID NO: 30543 - DNA, 21 bp, Artificial Sequence
  Description of Artificial Sequence: Synthetic oligonucleotide
tggaccgccgcggacacggca

SEQ ID NO: 30544 - DNA, 20 bp, Artificial Sequence
  Description of Artificial Sequence: Synthetic oligonucleotide
ggaccgccgcggacacggca

SEQ ID NO: 30545 - DNA, 20 bp, Artificial Sequence
  Description of Artificial Sequence: Synthetic oligonucleotide
gaccgccgcggacacggcag

SEQ ID NO: 30546 - DNA, 21 bp, Artificial Sequence
  Description of Artificial Sequence: Synthetic oligonucleotide
accgccgcggacacggcagct

SEQ ID NO: 30547 - DNA, 20 bp, Artificial Sequence
  Description of Artificial Sequence: Synthetic oligonucleotide
ccgccgcggacacggcagct

SEQ ID NO: 30548 - DNA, 21 bp, Artificial Sequence
  Description of Artificial Sequence: Synthetic oligonucleotide
cgccgcggacacggcagctca

SEQ ID NO: 30549 - DNA, 23 bp, Artificial Sequence
  Description of Artificial Sequence: Synthetic oligonucleotide
gccgcggacacggcagctcagat

SEQ ID NO: 30550 - DNA, 24 bp, Artificial Sequence
  Description of Artificial Sequence: Synthetic oligonucleotide
ccgcggacacggcagctcagatca

SEQ ID NO: 30551 - DNA, 24 bp, Artificial Sequence
  Description of Artificial Sequence: Synthetic oligonucleotide
cgcggacacggcagctcagatcac

SEQ ID NO: 30552 - DNA, 27 bp, Artificial Sequence
  Description of Artificial Sequence: Synthetic oligonucleotide
gaggccggttctcacaccctccagaat

SEQ ID NO: 30553 - DNA, 29 bp, Artificial Sequence
  Description of Artificial Sequence: Synthetic oligonucleotide
aggccggttctcacaccctccagaatatg

SEQ ID NO: 30554 - DNA, 28 bp, Artificial Sequence
  Description of Artificial Sequence: Synthetic oligonucleotide
ggccggttctcacaccctccagaatatg

SEQ ID NO: 30555 - DNA, 31 bp, Artificial Sequence
  Description of Artificial Sequence: Synthetic oligonucleotide
gccggttctcacaccctccagaatatgtatg

SEQ ID NO: 30556 - DNA, 31 bp, Artificial Sequence
  Description of Artificial Sequence: Synthetic oligonucleotide
ccggttctcacaccctccagaatatgtatgg

SEQ ID NO: 30557 - DNA, 31 bp, Artificial Sequence
  Description of Artificial Sequence: Synthetic oligonucleotide
cggttctcacaccctccagaatatgtatggc

SEQ ID NO: 30558 - DNA, 32 bp, Artificial Sequence
  Description of Artificial Sequence: Synthetic oligonucleotide
ggttctcacaccctccagaatatgtatggctg

SEQ ID NO: 30559 - DNA, 32 bp, Artificial Sequence
  Description of Artificial Sequence: Synthetic oligonucleotide
gttctcacaccctccagaatatgtatggctgc

SEQ ID NO: 30560 - DNA, 32 bp, Artificial Sequence
  Description of Artificial Sequence: Synthetic oligonucleotide
ttctcacaccctccagaatatgtatggctgcg

SEQ ID NO: 30561 - DNA, 27 bp, Artificial Sequence
  Description of Artificial Sequence: Synthetic oligonucleotide
tatttccacacctccgtgtcccggcct

SEQ ID NO: 30562 - DNA, 26 bp, Artificial Sequence
  Description of Artificial Sequence: Synthetic oligonucleotide
atttccacacctccgtgtcccggcct

SEQ ID NO: 30563 - DNA, 25 bp, Artificial Sequence
  Description of Artificial Sequence: Synthetic oligonucleotide
tttccacacctccgtgtcccggcct

SEQ ID NO: 30564 - DNA, 24 bp, Artificial Sequence
  Description of Artificial Sequence: Synthetic oligonucleotide
ttccacacctccgtgtcccggcct

SEQ ID NO: 30565 - DNA, 23 bp, Artificial Sequence
  Description of Artificial Sequence: Synthetic oligonucleotide
tccacacctccgtgtcccggcct

SEQ ID NO: 30566 - DNA, 22 bp, Artificial Sequence
  Description of Artificial Sequence: Synthetic oligonucleotide
ccacacctccgtgtcccggcct

SEQ ID NO: 30567 - DNA, 22 bp, Artificial Sequence
  Description of Artificial Sequence: Synthetic oligonucleotide
cacacctccgtgtcccggcctg

SEQ ID NO: 30568 - DNA, 26 bp, Artificial Sequence
  Description of Artificial Sequence: Synthetic oligonucleotide
cggagcagctgagagcctacctggaa

SEQ ID NO: 30569 - DNA, 26 bp, Artificial Sequence
  Description of Artificial Sequence: Synthetic oligonucleotide
ggagcagctgagagcctacctggaag

SEQ ID NO: 30570 - DNA, 26 bp, Artificial Sequence
  Description of Artificial Sequence: Synthetic oligonucleotide
gagcagctgagagcctacctggaagg

SEQ ID NO: 30571 - DNA, 26 bp, Artificial Sequence
  Description of Artificial Sequence: Synthetic oligonucleotide
agcagctgagagcctacctggaaggc

SEQ ID NO: 30572 - DNA, 25 bp, Artificial Sequence
  Description of Artificial Sequence: Synthetic oligonucleotide
gcagctgagagcctacctggaaggc

SEQ ID NO: 30573 - DNA, 26 bp, Artificial Sequence
  Description of Artificial Sequence: Synthetic oligonucleotide
cagctgagagcctacctggaaggcga

SEQ ID NO: 30574 - DNA, 27 bp, Artificial Sequence
  Description of Artificial Sequence: Synthetic oligonucleotide
agctgagagcctacctggaaggcgagt

SEQ ID NO: 30575 - DNA, 26 bp, Artificial Sequence
  Description of Artificial Sequence: Synthetic oligonucleotide
gctgagagcctacctggaaggcgagt

SEQ ID NO: 30576 - DNA, 26 bp, Artificial Sequence
  Description of Artificial Sequence: Synthetic oligonucleotide
ctgagagcctacctggaaggcgagtg

SEQ ID NO: 30577 - DNA, 26 bp, Artificial Sequence
  Description of Artificial Sequence: Synthetic oligonucleotide
tgagagcctacctggaaggcgagtgc

SEQ ID NO: 30578 - DNA, 25 bp, Artificial Sequence
  Description of Artificial Sequence: Synthetic oligonucleotide
gagagcctacctggaaggcgagtgc

SEQ ID NO: 30579 - DNA, 26 bp, Artificial Sequence
  Description of Artificial Sequence: Synthetic oligonucleotide
agagcctacctggaaggcgagtgcgt

SEQ ID NO: 30580 - DNA, 25 bp, Artificial Sequence
  Description of Artificial Sequence: Synthetic oligonucleotide
gagcctacctggaaggcgagtgcgt

SEQ ID NO: 30581 - DNA, 25 bp, Artificial Sequence
  Description of Artificial Sequence: Synthetic oligonucleotide
agcctacctggaaggcgagtgcgtg

SEQ ID NO: 30582 - DNA, 24 bp, Artificial Sequence
  Description of Artificial Sequence: Synthetic oligonucleotide
gcctacctggaaggcgagtgcgtg

SEQ ID NO: 30583 - DNA, 25 bp, Artificial Sequence
  Description of Artificial Sequence: Synthetic oligonucleotide
cctacctggaaggcgagtgcgtgga

SEQ ID NO: 30584 - DNA, 26 bp, Artificial Sequence
  Description of Artificial Sequence: Synthetic oligonucleotide
ctacctggaaggcgagtgcgtggagt

SEQ ID NO: 30585 - DNA, 26 bp, Artificial Sequence
  Description of Artificial Sequence: Synthetic oligonucleotide
tacctggaaggcgagtgcgtggagtg

SEQ ID NO: 30586 - DNA, 25 bp, Artificial Sequence
  Description of Artificial Sequence: Synthetic oligonucleotide
acctggaaggcgagtgcgtggagtg

SEQ ID NO: 30587 - DNA, 24 bp, Artificial Sequence
  Description of Artificial Sequence: Synthetic oligonucleotide
cctggaaggcgagtgcgtggagtg

SEQ ID NO: 30588 - DNA, 24 bp, Artificial Sequence
  Description of Artificial Sequence: Synthetic oligonucleotide
ctggaaggcgagtgcgtggagtgg

SEQ ID NO: 30589 - DNA, 25 bp, Artificial Sequence
  Description of Artificial Sequence: Synthetic oligonucleotide
tggaaggcgagtgcgtggagtggct

SEQ ID NO: 30590 - DNA, 24 bp, Artificial Sequence
  Description of Artificial Sequence: Synthetic oligonucleotide
ggaaggcgagtgcgtggagtggct

SEQ ID NO: 30591 - DNA, 24 bp, Artificial Sequence
  Description of Artificial Sequence: Synthetic oligonucleotide
gaaggcgagtgcgtggagtggctc

SEQ ID NO: 30592 - DNA, 24 bp, Artificial Sequence
  Description of Artificial Sequence: Synthetic oligonucleotide
aaggcgagtgcgtggagtggctcc

SEQ ID NO: 30593 - DNA, 23 bp, Artificial Sequence
  Description of Artificial Sequence: Synthetic oligonucleotide
aggcgagtgcgtggagtggctcc

SEQ ID NO: 30594 - DNA, 23 bp, Artificial Sequence
  Description of Artificial Sequence: Synthetic oligonucleotide
agccgcgggcgccgtggatagaa

SEQ ID NO: 30595 - DNA, 22 bp, Artificial Sequence
  Description of Artificial Sequence: Synthetic oligonucleotide
gccgcgggcgccgtggatagaa

SEQ ID NO: 30596 - DNA, 23 bp, Artificial Sequence
  Description of Artificial Sequence: Synthetic oligonucleotide
ccgcgggcgccgtggatagaaca

SEQ ID NO: 30597 - DNA, 23 bp, Artificial Sequence
  Description of Artificial Sequence: Synthetic oligonucleotide
cgcgggcgccgtggatagaacag

SEQ ID NO: 30598 - DNA, 24 bp, Artificial Sequence
  Description of Artificial Sequence: Synthetic oligonucleotide
gcgggcgccgtggatagaacagga

SEQ ID NO: 30599 - DNA, 24 bp, Artificial Sequence
  Description of Artificial Sequence: Synthetic oligonucleotide
cgggcgccgtggatagaacaggag

SEQ ID NO: 30600 - DNA, 24 bp, Artificial Sequence
  Description of Artificial Sequence: Synthetic oligonucleotide
gggcgccgtggatagaacaggagg

SEQ ID NO: 30601 - DNA, 24 bp, Artificial Sequence
  Description of Artificial Sequence: Synthetic oligonucleotide
ggcgccgtggatagaacaggaggg

SEQ ID NO: 30602 - DNA, 24 bp, Artificial Sequence
  Description of Artificial Sequence: Synthetic oligonucleotide
gcgccgtggatagaacaggagggg

SEQ ID NO: 30603 - DNA, 24 bp, Artificial Sequence
  Description of Artificial Sequence: Synthetic oligonucleotide
cgccgtggatagaacaggaggggc

SEQ ID NO: 30604 - DNA, 24 bp, Artificial Sequence
  Description of Artificial Sequence: Synthetic oligonucleotide
gccgtggatagaacaggaggggcc

SEQ ID NO: 30605 - DNA, 24 bp, Artificial Sequence
  Description of Artificial Sequence: Synthetic oligonucleotide
ccgtggatagaacaggaggggccg

SEQ ID NO: 30606 - DNA, 25 bp, Artificial Sequence
  Description of Artificial Sequence: Synthetic oligonucleotide
cgtggatagaacaggaggggccgga

SEQ ID NO: 30607 - DNA, 27 bp, Artificial Sequence
  Description of Artificial Sequence: Synthetic oligonucleotide
gtggatagaacaggaggggccggagta

SEQ ID NO: 30608 - DNA, 29 bp, Artificial Sequence
  Description of Artificial Sequence: Synthetic oligonucleotide
tggatagaacaggaggggccggagtattg

SEQ ID NO: 30609 - DNA, 28 bp, Artificial Sequence
  Description of Artificial Sequence: Synthetic oligonucleotide
ggatagaacaggaggggccggagtattg

SEQ ID NO: 30610 - DNA, 28 bp, Artificial Sequence
  Description of Artificial Sequence: Synthetic oligonucleotide
gatagaacaggaggggccggagtattgg

SEQ ID NO: 30611 - DNA, 28 bp, Artificial Sequence
  Description of Artificial Sequence: Synthetic oligonucleotide
atagaacaggaggggccggagtattggg

SEQ ID NO: 30612 - DNA, 27 bp, Artificial Sequence
  Description of Artificial Sequence: Synthetic oligonucleotide
tagaacaggaggggccggagtattggg

SEQ ID NO: 30613 - DNA, 27 bp, Artificial Sequence
  Description of Artificial Sequence: Synthetic oligonucleotide
agaacaggaggggccggagtattggga

SEQ ID NO: 30614 - DNA, 26 bp, Artificial Sequence
  Description of Artificial Sequence: Synthetic oligonucleotide
gaacaggaggggccggagtattggga

SEQ ID NO: 30615 - DNA, 26 bp, Artificial Sequence
  Description of Artificial Sequence: Synthetic oligonucleotide
aacaggaggggccggagtattgggac

SEQ ID NO: 30616 - DNA, 25 bp, Artificial Sequence
  Description of Artificial Sequence: Synthetic oligonucleotide
acaggaggggccggagtattgggac

SEQ ID NO: 30617 - DNA, 31 bp, Artificial Sequence
  Description of Artificial Sequence: Synthetic oligonucleotide
tattgggaccgggagacacagatctgcaaag

SEQ ID NO: 30618 - DNA, 30 bp, Artificial Sequence
  Description of Artificial Sequence: Synthetic oligonucleotide
attgggaccgggagacacagatctgcaaag

SEQ ID NO: 30619 - DNA, 29 bp, Artificial Sequence
  Description of Artificial Sequence: Synthetic oligonucleotide
ttgggaccgggagacacagatctgcaaag

SEQ ID NO: 30620 - DNA, 28 bp, Artificial Sequence
  Description of Artificial Sequence: Synthetic oligonucleotide
tgggaccgggagacacagatctgcaaag

SEQ ID NO: 30621 - DNA, 27 bp, Artificial Sequence
  Description of Artificial Sequence: Synthetic oligonucleotide
gggaccgggagacacagatctgcaaag

SEQ ID NO: 30622 - DNA, 27 bp, Artificial Sequence
  Description of Artificial Sequence: Synthetic oligonucleotide
ggaccgggagacacagatctgcaaagc

SEQ ID NO: 30623 - DNA, 27 bp, Artificial Sequence
  Description of Artificial Sequence: Synthetic oligonucleotide
gaccgggagacacagatctgcaaagcc

SEQ ID NO: 30624 - DNA, 29 bp, Artificial Sequence
  Description of Artificial Sequence: Synthetic oligonucleotide
accgggagacacagatctgcaaagccaag

SEQ ID NO: 30625 - DNA, 28 bp, Artificial Sequence
  Description of Artificial Sequence: Synthetic oligonucleotide
ccgggagacacagatctgcaaagccaag

SEQ ID NO: 30626 - DNA, 28 bp, Artificial Sequence
  Description of Artificial Sequence: Synthetic oligonucleotide
cgggagacacagatctgcaaagccaagg

SEQ ID NO: 30627 - DNA, 28 bp, Artificial Sequence
  Description of Artificial Sequence: Synthetic oligonucleotide
gggagacacagatctgcaaagccaaggc

SEQ ID NO: 30628 - DNA, 29 bp, Artificial Sequence
  Description of Artificial Sequence: Synthetic oligonucleotide
ggagacacagatctgcaaagccaaggcac

SEQ ID NO: 30629 - DNA, 30 bp, Artificial Sequence
  Description of Artificial Sequence: Synthetic oligonucleotide
gagacacagatctgcaaagccaaggcacag

SEQ ID NO: 30630 - DNA, 31 bp, Artificial Sequence
  Description of Artificial Sequence: Synthetic oligonucleotide
agacacagatctgcaaagccaaggcacagac

SEQ ID NO: 30631 - DNA, 30 bp, Artificial Sequence
  Description of Artificial Sequence: Synthetic oligonucleotide
gacacagatctgcaaagccaaggcacagac

SEQ ID NO: 30632 - DNA, 31 bp, Artificial Sequence
  Description of Artificial Sequence: Synthetic oligonucleotide
acacagatctgcaaagccaaggcacagactg

SEQ ID NO: 30633 - DNA, 30 bp, Artificial Sequence
  Description of Artificial Sequence: Synthetic oligonucleotide
cacagatctgcaaagccaaggcacagactg

SEQ ID NO: 30634 - DNA, 31 bp, Artificial Sequence
  Description of Artificial Sequence: Synthetic oligonucleotide
acagatctgcaaagccaaggcacagactgac

SEQ ID NO: 30635 - DNA, 30 bp, Artificial Sequence
  Description of Artificial Sequence: Synthetic oligonucleotide
cagatctgcaaagccaaggcacagactgac

SEQ ID NO: 30636 - DNA, 30 bp, Artificial Sequence
  Description of Artificial Sequence: Synthetic oligonucleotide
agatctgcaaagccaaggcacagactgacc

SEQ ID NO: 30637 - DNA, 29 bp, Artificial Sequence
  Description of Artificial Sequence: Synthetic oligonucleotide
gatctgcaaagccaaggcacagactgacc

SEQ ID NO: 30638 - DNA, 29 bp, Artificial Sequence
  Description of Artificial Sequence: Synthetic oligonucleotide
atctgcaaagccaaggcacagactgaccg

SEQ ID NO: 30639 - DNA, 28 bp, Artificial Sequence
  Description of Artificial Sequence: Synthetic oligonucleotide
tctgcaaagccaaggcacagactgaccg

SEQ ID NO: 30640 - DNA, 27 bp, Artificial Sequence
  Description of Artificial Sequence: Synthetic oligonucleotide
ctgcaaagccaaggcacagactgaccg

SEQ ID NO: 30641 - DNA, 28 bp, Artificial Sequence
  Description of Artificial Sequence: Synthetic oligonucleotide
tgcaaagccaaggcacagactgaccgag

SEQ ID NO: 30642 - DNA, 27 bp, Artificial Sequence
  Description of Artificial Sequence: Synthetic oligonucleotide
gcaaagccaaggcacagactgaccgag

SEQ ID NO: 30643 - DNA, 28 bp, Artificial Sequence
  Description of Artificial Sequence: Synthetic oligonucleotide
caaagccaaggcacagactgaccgagag

SEQ ID NO: 30644 - DNA, 28 bp, Artificial Sequence
  Description of Artificial Sequence: Synthetic oligonucleotide
aaagccaaggcacagactgaccgagagg

SEQ ID NO: 30645 - DNA, 27 bp, Artificial Sequence
  Description of Artificial Sequence: Synthetic oligonucleotide
aagccaaggcacagactgaccgagagg

SEQ ID NO: 30646 - DNA, 27 bp, Artificial Sequence
  Description of Artificial Sequence: Synthetic oligonucleotide
agccaaggcacagactgaccgagagga

SEQ ID NO: 30647 - DNA, 22 bp, Artificial Sequence
  Description of Artificial Sequence: Synthetic oligonucleotide
tccgagagaggagccgcgggca

SEQ ID NO: 30648 - DNA, 21 bp, Artificial Sequence
  Description of Artificial Sequence: Synthetic oligonucleotide
ccgagagaggagccgcgggca

SEQ ID NO: 30649 - DNA, 21 bp, Artificial Sequence
  Description of Artificial Sequence: Synthetic oligonucleotide
cgagagaggagccgcgggcac

SEQ ID NO: 30650 - DNA, 21 bp, Artificial Sequence
  Description of Artificial Sequence: Synthetic oligonucleotide
gagagaggagccgcgggcacc

SEQ ID NO: 30651 - DNA, 22 bp, Artificial Sequence
  Description of Artificial Sequence: Synthetic oligonucleotide
agagaggagccgcgggcaccgt

SEQ ID NO: 30652 - DNA, 21 bp, Artificial Sequence
  Description of Artificial Sequence: Synthetic oligonucleotide
gagaggagccgcgggcaccgt

SEQ ID NO: 30653 - DNA, 21 bp, Artificial Sequence
  Description of Artificial Sequence: Synthetic oligonucleotide
agaggagccgcgggcaccgtg

SEQ ID NO: 30654 - DNA, 20 bp, Artificial Sequence
  Description of Artificial Sequence: Synthetic oligonucleotide
gaggagccgcgggcaccgtg

SEQ ID NO: 30655 - DNA, 23 bp, Artificial Sequence
  Description of Artificial Sequence: Synthetic oligonucleotide
aggagccgcgggcaccgtggata

SEQ ID NO: 30656 - DNA, 29 bp, Artificial Sequence
  Description of Artificial Sequence: Synthetic oligonucleotide
atctgcaaggccaaggcacagactgacag

SEQ ID NO: 30657 - DNA, 28 bp, Artificial Sequence
  Description of Artificial Sequence: Synthetic oligonucleotide
tctgcaaggccaaggcacagactgacag

SEQ ID NO: 30658 - DNA, 27 bp, Artificial Sequence
  Description of Artificial Sequence: Synthetic oligonucleotide
ctgcaaggccaaggcacagactgacag

SEQ ID NO: 30659 - DNA, 28 bp, Artificial Sequence
  Description of Artificial Sequence: Synthetic oligonucleotide
tgcaaggccaaggcacagactgacagag

SEQ ID NO: 30660 - DNA, 27 bp, Artificial Sequence
  Description of Artificial Sequence: Synthetic oligonucleotide
gcaaggccaaggcacagactgacagag

SEQ ID NO: 30661 - DNA, 28 bp, Artificial Sequence
  Description of Artificial Sequence: Synthetic oligonucleotide
caaggccaaggcacagactgacagagag

SEQ ID NO: 30662 - DNA, 28 bp, Artificial Sequence
  Description of Artificial Sequence: Synthetic oligonucleotide
aaggccaaggcacagactgacagagagg

SEQ ID NO: 30663 - DNA, 27 bp, Artificial Sequence
  Description of Artificial Sequence: Synthetic oligonucleotide
aggccaaggcacagactgacagagagg

SEQ ID NO: 30664 - DNA, 27 bp, Artificial Sequence
  Description of Artificial Sequence: Synthetic oligonucleotide
ggccaaggcacagactgacagagagga

SEQ ID NO: 30665 - DNA, 27 bp, Artificial Sequence
  Description of Artificial Sequence: Synthetic oligonucleotide
gccaaggcacagactgacagagaggac

SEQ ID NO: 30666 - DNA, 27 bp, Artificial Sequence
  Description of Artificial Sequence: Synthetic oligonucleotide
ccaaggcacagactgacagagaggacc

SEQ ID NO: 30667 - DNA, 28 bp, Artificial Sequence
  Description of Artificial Sequence: Synthetic oligonucleotide
caaggcacagactgacagagaggacctg

SEQ ID NO: 30668 - DNA, 28 bp, Artificial Sequence
  Description of Artificial Sequence: Synthetic oligonucleotide
aaggcacagactgacagagaggacctgc

SEQ ID NO: 30669 - DNA, 27 bp, Artificial Sequence
  Description of Artificial Sequence: Synthetic oligonucleotide
aggcacagactgacagagaggacctgc

SEQ ID NO: 30670 - DNA, 26 bp, Artificial Sequence
  Description of Artificial Sequence: Synthetic oligonucleotide
ggcacagactgacagagaggacctgc

SEQ ID NO: 30671 - DNA, 26 bp, Artificial Sequence
  Description of Artificial Sequence: Synthetic oligonucleotide
gcacagactgacagagaggacctgcg

SEQ ID NO: 30672 - DNA, 27 bp, Artificial Sequence
  Description of Artificial Sequence: Synthetic oligonucleotide
cacagactgacagagaggacctgcgga

SEQ ID NO: 30673 - DNA, 27 bp, Artificial Sequence
  Description of Artificial Sequence: Synthetic oligonucleotide
acagactgacagagaggacctgcggac

SEQ ID NO: 30674 - DNA, 26 bp, Artificial Sequence
  Description of Artificial Sequence: Synthetic oligonucleotide
cagactgacagagaggacctgcggac

SEQ ID NO: 30675 - DNA, 26 bp, Artificial Sequence
  Description of Artificial Sequence: Synthetic oligonucleotide
agactgacagagaggacctgcggacc

SEQ ID NO: 30676 - DNA, 25 bp, Artificial Sequence
  Description of Artificial Sequence: Synthetic oligonucleotide
gactgacagagaggacctgcggacc

SEQ ID NO: 30677 - DNA, 26 bp, Artificial Sequence
  Description of Artificial Sequence: Synthetic oligonucleotide
actgacagagaggacctgcggaccct

SEQ ID NO: 30678 - DNA, 25 bp, Artificial Sequence
  Description of Artificial Sequence: Synthetic oligonucleotide
ctgacagagaggacctgcggaccct

SEQ ID NO: 30679 - DNA, 25 bp, Artificial Sequence
  Description of Artificial Sequence: Synthetic oligonucleotide
tgacagagaggacctgcggaccctg

SEQ ID NO: 30680 - DNA, 24 bp, Artificial Sequence
  Description of Artificial Sequence: Synthetic oligonucleotide
gacagagaggacctgcggaccctg

SEQ ID NO: 30681 - DNA, 25 bp, Artificial Sequence
  Description of Artificial Sequence: Synthetic oligonucleotide
acagagaggacctgcggaccctgct

SEQ ID NO: 30682 - DNA, 24 bp, Artificial Sequence
  Description of Artificial Sequence: Synthetic oligonucleotide
cagagaggacctgcggaccctgct

SEQ ID NO: 30683 - DNA, 24 bp, Artificial Sequence
  Description of Artificial Sequence: Synthetic oligonucleotide
agagaggacctgcggaccctgctc

SEQ ID NO: 30684 - DNA, 26 bp, Artificial Sequence
  Description of Artificial Sequence: Synthetic oligonucleotide
tggatagagcaggaggggccggagta

SEQ ID NO: 30685 - DNA, 25 bp, Artificial Sequence
  Description of Artificial Sequence: Synthetic oligonucleotide
ggatagagcaggaggggccggagta

SEQ ID NO: 30686 - DNA, 26 bp, Artificial Sequence
  Description of Artificial Sequence: Synthetic oligonucleotide
gatagagcaggaggggccggagtact

SEQ ID NO: 30687 - DNA, 26 bp, Artificial Sequence
  Description of Artificial Sequence: Synthetic oligonucleotide
atagagcaggaggggccggagtactg

SEQ ID NO: 30688 - DNA, 25 bp, Artificial Sequence
  Description of Artificial Sequence: Synthetic oligonucleotide
tagagcaggaggggccggagtactg

SEQ ID NO: 30689 - DNA, 24 bp, Artificial Sequence
  Description of Artificial Sequence: Synthetic oligonucleotide
agagcaggaggggccggagtactg

SEQ ID NO: 30690 - DNA, 23 bp, Artificial Sequence
  Description of Artificial Sequence: Synthetic oligonucleotide
gagcaggaggggccggagtactg

SEQ ID NO: 30691 - DNA, 23 bp, Artificial Sequence
  Description of Artificial Sequence: Synthetic oligonucleotide
agcaggaggggccggagtactgg

SEQ ID NO: 30692 - DNA, 22 bp, Artificial Sequence
  Description of Artificial Sequence: Synthetic oligonucleotide
gcaggaggggccggagtactgg

SEQ ID NO: 30693 - DNA, 23 bp, Artificial Sequence
  Description of Artificial Sequence: Synthetic oligonucleotide
caggaggggccggagtactggga

SEQ ID NO: 30694 - DNA, 23 bp, Artificial Sequence
  Description of Artificial Sequence: Synthetic oligonucleotide
aggaggggccggagtactgggac

SEQ ID NO: 30695 - DNA, 22 bp, Artificial Sequence
  Description of Artificial Sequence: Synthetic oligonucleotide
ggaggggccggagtactgggac

SEQ ID NO: 30696 - DNA, 22 bp, Artificial Sequence
  Description of Artificial Sequence: Synthetic oligonucleotide
gaggggccggagtactgggacc

SEQ ID NO: 30697 - DNA, 22 bp, Artificial Sequence
  Description of Artificial Sequence: Synthetic oligonucleotide
aggggccggagtactgggaccg

SEQ ID NO: 30698 - DNA, 21 bp, Artificial Sequence
  Description of Artificial Sequence: Synthetic oligonucleotide
ggggccggagtactgggaccg

SEQ ID NO: 30699 - DNA, 21 bp, Artificial Sequence
  Description of Artificial Sequence: Synthetic oligonucleotide
gggccggagtactgggaccgg

SEQ ID NO: 30700 - DNA, 22 bp, Artificial Sequence
  Description of Artificial Sequence: Synthetic oligonucleotide
ggccggagtactgggaccggga

SEQ ID NO: 30701 - DNA, 23 bp, Artificial Sequence
  Description of Artificial Sequence: Synthetic oligonucleotide
gccggagtactgggaccgggaga

SEQ ID NO: 30702 - DNA, 24 bp, Artificial Sequence
  Description of Artificial Sequence: Synthetic oligonucleotide
ccggagtactgggaccgggagaca

SEQ ID NO: 30703 - DNA, 25 bp, Artificial Sequence
  Description of Artificial Sequence: Synthetic oligonucleotide
cggagtactgggaccgggagacaca

SEQ ID NO: 30704 - DNA, 27 bp, Artificial Sequence
  Description of Artificial Sequence: Synthetic oligonucleotide
ggagtactgggaccgggagacacagat

SEQ ID NO: 30705 - DNA, 27 bp, Artificial Sequence
  Description of Artificial Sequence: Synthetic oligonucleotide
gagtactgggaccgggagacacagatc

SEQ ID NO: 30706 - DNA, 28 bp, Artificial Sequence
  Description of Artificial Sequence: Synthetic oligonucleotide
agtactgggaccgggagacacagatctg

SEQ ID NO: 30707 - DNA, 27 bp, Artificial Sequence
  Description of Artificial Sequence: Synthetic oligonucleotide
gtactgggaccgggagacacagatctg

SEQ ID NO: 30708 - DNA, 27 bp, Artificial Sequence
  Description of Artificial Sequence: Synthetic oligonucleotide
tactgggaccgggagacacagatctgc

SEQ ID NO: 30709 - DNA, 27 bp, Artificial Sequence
  Description of Artificial Sequence: Synthetic oligonucleotide
actgggaccgggagacacagatctgca

SEQ ID NO: 30710 - DNA, 27 bp, Artificial Sequence
  Description of Artificial Sequence: Synthetic oligonucleotide
ctgggaccgggagacacagatctgcaa

SEQ ID NO: 30711 - DNA, 20 bp, Artificial Sequence
  Description of Artificial Sequence: Synthetic oligonucleotide
acgtggggccggacgggcga

SEQ ID NO: 30712 - DNA, 20 bp, Artificial Sequence
  Description of Artificial Sequence: Synthetic oligonucleotide
cgtggggccggacgggcgat

SEQ ID NO: 30713 - DNA, 20 bp, Artificial Sequence
  Description of Artificial Sequence: Synthetic oligonucleotide
gtggggccggacgggcgact

SEQ ID NO: 30714 - DNA, 20 bp, Artificial Sequence
  Description of Artificial Sequence: Synthetic oligonucleotide
tggggccggacgggcgactc

SEQ ID NO: 30715 - DNA, 20 bp, Artificial Sequence
  Description of Artificial Sequence: Synthetic oligonucleotide
ggggccggacgggcgactct

SEQ ID NO: 30716 - DNA, 20 bp, Artificial Sequence
  Description of Artificial Sequence: Synthetic oligonucleotide
gggccggacgggcgactcct

SEQ ID NO: 30717 - DNA, 20 bp, Artificial Sequence
  Description of Artificial Sequence: Synthetic oligonucleotide
ggccggacgggcgactcctc

SEQ ID NO: 30718 - DNA, 20 bp, Artificial Sequence
  Description of Artificial Sequence: Synthetic oligonucleotide
gccggacgggcgactcctcc

SEQ ID NO: 30719 - DNA, 20 bp, Artificial Sequence
  Description of Artificial Sequence: Synthetic oligonucleotide
ccggacgggcgactcctccg

SEQ ID NO: 30720 - DNA, 20 bp, Artificial Sequence
  Description of Artificial Sequence: Synthetic oligonucleotide
cggacgggcgactcctccgc

SEQ ID NO: 30721 - DNA, 20 bp, Artificial Sequence
  Description of Artificial Sequence: Synthetic oligonucleotide
ggacgggcgactcctccgcg

SEQ ID NO: 30722 - DNA, 20 bp, Artificial Sequence
  Description of Artificial Sequence: Synthetic oligonucleotide
gacgggcgactcctccgcgg

SEQ ID NO: 30723 - DNA, 22 bp, Artificial Sequence
  Description of Artificial Sequence: Synthetic oligonucleotide
acgggcgactcctccgcgggta

SEQ ID NO: 30724 - DNA, 21 bp, Artificial Sequence
  Description of Artificial Sequence: Synthetic oligonucleotide
cgggcgactcctccgcgggta

SEQ ID NO: 30725 - DNA, 21 bp, Artificial Sequence
  Description of Artificial Sequence: Synthetic oligonucleotide
gggcgactcctccgcgggtac

SEQ ID NO: 30726 - DNA, 22 bp, Artificial Sequence
  Description of Artificial Sequence: Synthetic oligonucleotide
ggcgactcctccgcgggtacca

SEQ ID NO: 30727 - DNA, 22 bp, Artificial Sequence
  Description of Artificial Sequence: Synthetic oligonucleotide
gcgactcctccgcgggtaccac

SEQ ID NO: 30728 - DNA, 23 bp, Artificial Sequence
  Description of Artificial Sequence: Synthetic oligonucleotide
cgactcctccgcgggtaccacca

SEQ ID NO: 30729 - DNA, 23 bp, Artificial Sequence
  Description of Artificial Sequence: Synthetic oligonucleotide
gactcctccgcgggtaccaccag

SEQ ID NO: 30730 - DNA, 24 bp, Artificial Sequence
  Description of Artificial Sequence: Synthetic oligonucleotide
actcctccgcgggtaccaccagga

SEQ ID NO: 30731 - DNA, 30 bp, Artificial Sequence
  Description of Artificial Sequence: Synthetic oligonucleotide
tccagaatatgtatggctgcgacgtgggac

SEQ ID NO: 30732 - DNA, 29 bp, Artificial Sequence
  Description of Artificial Sequence: Synthetic oligonucleotide
ccagaatatgtatggctgcgacgtgggac

SEQ ID NO: 30733 - DNA, 29 bp, Artificial Sequence
  Description of Artificial Sequence: Synthetic oligonucleotide
cagaatatgtatggctgcgacgtgggacc

SEQ ID NO: 30734 - DNA, 29 bp, Artificial Sequence
  Description of Artificial Sequence: Synthetic oligonucleotide
agaatatgtatggctgcgacgtgggaccg

SEQ ID NO: 30735 - DNA, 28 bp, Artificial Sequence
  Description of Artificial Sequence: Synthetic oligonucleotide
gaatatgtatggctgcgacgtgggaccg

SEQ ID NO: 30736 - DNA, 28 bp, Artificial Sequence
  Description of Artificial Sequence: Synthetic oligonucleotide
aatatgtatggctgcgacgtgggaccgg

SEQ ID NO: 30737 - DNA, 27 bp, Artificial Sequence
  Description of Artificial Sequence: Synthetic oligonucleotide
atatgtatggctgcgacgtgggaccgg

SEQ ID NO: 30738 - DNA, 27 bp, Artificial Sequence
  Description of Artificial Sequence: Synthetic oligonucleotide
tatgtatggctgcgacgtgggaccgga

SEQ ID NO: 30739 - DNA, 26 bp, Artificial Sequence
  Description of Artificial Sequence: Synthetic oligonucleotide
atgtatggctgcgacgtgggaccgga

SEQ ID NO: 30740 - DNA, 25 bp, Artificial Sequence
  Description of Artificial Sequence: Synthetic oligonucleotide
tgtatggctgcgacgtgggaccgga

SEQ ID NO: 30741 - DNA, 24 bp, Artificial Sequence
  Description of Artificial Sequence: Synthetic oligonucleotide
gtatggctgcgacgtgggaccgga

SEQ ID NO: 30742 - DNA, 24 bp, Artificial Sequence
  Description of Artificial Sequence: Synthetic oligonucleotide
tatggctgcgacgtgggaccggac

SEQ ID NO: 30743 - DNA, 23 bp, Artificial Sequence
  Description of Artificial Sequence: Synthetic oligonucleotide
atggctgcgacgtgggaccggac

SEQ ID NO: 30744 - DNA, 22 bp, Artificial Sequence
  Description of Artificial Sequence: Synthetic oligonucleotide
tggctgcgacgtgggaccggac

SEQ ID NO: 30745 - DNA, 21 bp, Artificial Sequence
  Description of Artificial Sequence: Synthetic oligonucleotide
ggctgcgacgtgggaccggac

SEQ ID NO: 30746 - DNA, 21 bp, Artificial Sequence
  Description of Artificial Sequence: Synthetic oligonucleotide
gctgcgacgtgggaccggacg

SEQ ID NO: 30747 - DNA, 21 bp, Artificial Sequence
  Description of Artificial Sequence: Synthetic oligonucleotide
ctgcgacgtgggaccggacgg

SEQ ID NO: 30748 - DNA, 21 bp, Artificial Sequence
  Description of Artificial Sequence: Synthetic oligonucleotide
tgcgacgtgggaccggacggg

SEQ ID NO: 30749 - DNA, 20 bp, Artificial Sequence
  Description of Artificial Sequence: Synthetic oligonucleotide
gcgacgtgggaccggacggg

SEQ ID NO: 30750 - DNA, 20 bp, Artificial Sequence
  Description of Artificial Sequence: Synthetic oligonucleotide
cgacgtgggaccggacgggc

SEQ ID NO: 30751 - DNA, 20 bp, Artificial Sequence
  Description of Artificial Sequence: Synthetic oligonucleotide
gacgtgggaccggacgggcg

SEQ ID NO: 30752 - DNA, 20 bp, Artificial Sequence
  Description of Artificial Sequence: Synthetic oligonucleotide
acgtgggaccggacgggcgc

SEQ ID NO: 30753 - DNA, 20 bp, Artificial Sequence
  Description of Artificial Sequence: Synthetic oligonucleotide
cgtgggaccggacgggcgct

SEQ ID NO: 30754 - DNA, 20 bp, Artificial Sequence
  Description of Artificial Sequence: Synthetic oligonucleotide
gtgggaccggacgggcgcct

SEQ ID NO: 30755 - DNA, 20 bp, Artificial Sequence
  Description of Artificial Sequence: Synthetic oligonucleotide
tgggaccggacgggcgcctc

SEQ ID NO: 30756 - DNA, 20 bp, Artificial Sequence
  Description of Artificial Sequence: Synthetic oligonucleotide
gggaccggacgggcgcctct

SEQ ID NO: 30757 - DNA, 20 bp, Artificial Sequence
  Description of Artificial Sequence: Synthetic oligonucleotide
ggaccggacgggcgcctcct

SEQ ID NO: 30758 - DNA, 20 bp, Artificial Sequence
  Description of Artificial Sequence: Synthetic oligonucleotide
gaccggacgggcgcctcctc

SEQ ID NO: 30759 - DNA, 20 bp, Artificial Sequence
  Description of Artificial Sequence: Synthetic oligonucleotide
accggacgggcgcctcctcc

SEQ ID NO: 30760 - DNA, 23 bp, Artificial Sequence
  Description of Artificial Sequence: Synthetic oligonucleotide
ctcctccgcgggtaccaccagca

SEQ ID NO: 30761 - DNA, 23 bp, Artificial Sequence
  Description of Artificial Sequence: Synthetic oligonucleotide
tcctccgcgggtaccaccagcac

SEQ ID NO: 30762 - DNA, 22 bp, Artificial Sequence
  Description of Artificial Sequence: Synthetic oligonucleotide
cctccgcgggtaccaccagcac

SEQ ID NO: 30763 - DNA, 22 bp, Artificial Sequence
  Description of Artificial Sequence: Synthetic oligonucleotide
ctccgcgggtaccaccagcacg

SEQ ID NO: 30764 - DNA, 22 bp, Artificial Sequence
  Description of Artificial Sequence: Synthetic oligonucleotide
tccgcgggtaccaccagcacgc

SEQ ID NO: 30765 - DNA, 21 bp, Artificial Sequence
  Description of Artificial Sequence: Synthetic oligonucleotide
ccgcgggtaccaccagcacgc

SEQ ID NO: 30766 - DNA, 23 bp, Artificial Sequence
  Description of Artificial Sequence: Synthetic oligonucleotide
cgcgggtaccaccagcacgccta

SEQ ID NO: 30767 - DNA, 23 bp, Artificial Sequence
  Description of Artificial Sequence: Synthetic oligonucleotide
gcgggtaccaccagcacgcctac

SEQ ID NO: 30768 - DNA, 24 bp, Artificial Sequence
  Description of Artificial Sequence: Synthetic oligonucleotide
cgggtaccaccagcacgcctacga

SEQ ID NO: 30769 - DNA, 24 bp, Artificial Sequence
  Description of Artificial Sequence: Synthetic oligonucleotide
gggtaccaccagcacgcctacgac

SEQ ID NO: 30770 - DNA, 24 bp, Artificial Sequence
  Description of Artificial Sequence: Synthetic oligonucleotide
ggtaccaccagcacgcctacgacg

SEQ ID NO: 30771 - DNA, 24 bp, Artificial Sequence
  Description of Artificial Sequence: Synthetic oligonucleotide
gtaccaccagcacgcctacgacgg

SEQ ID NO: 30772 - DNA, 26 bp, Artificial Sequence
  Description of Artificial Sequence: Synthetic oligonucleotide
taccaccagcacgcctacgacggcaa

SEQ ID NO: 30773 - DNA, 25 bp, Artificial Sequence
  Description of Artificial Sequence: Synthetic oligonucleotide
accaccagcacgcctacgacggcaa

SEQ ID NO: 30774 - DNA, 24 bp, Artificial Sequence
  Description of Artificial Sequence: Synthetic oligonucleotide
ccaccagcacgcctacgacggcaa

SEQ ID NO: 30775 - DNA, 24 bp, Artificial Sequence
  Description of Artificial Sequence: Synthetic oligonucleotide
caccagcacgcctacgacggcaag

SEQ ID NO: 30776 - DNA, 27 bp, Artificial Sequence
  Description of Artificial Sequence: Synthetic oligonucleotide
accagcacgcctacgacggcaaggatt

SEQ ID NO: 30777 - DNA, 27 bp, Artificial Sequence
  Description of Artificial Sequence: Synthetic oligonucleotide
ccagcacgcctacgacggcaaggatta

SEQ ID NO: 30778 - DNA, 33 bp, Artificial Sequence
  Description of Artificial Sequence: Synthetic oligonucleotide
agacacagatctgcaagaccaacacacagactg

SEQ ID NO: 30779 - DNA, 32 bp, Artificial Sequence
  Description of Artificial Sequence: Synthetic oligonucleotide
gacacagatctgcaagaccaacacacagactg

SEQ ID NO: 30780 - DNA, 23 bp, Artificial Sequence
  Description of Artificial Sequence: Synthetic oligonucleotide
atgcgggtcacggagccccgaac

SEQ ID NO: 30781 - DNA, 22 bp, Artificial Sequence
  Description of Artificial Sequence: Synthetic oligonucleotide
tgcgggtcacggagccccgaac

SEQ ID NO: 30782 - DNA, 21 bp, Artificial Sequence
  Description of Artificial Sequence: Synthetic oligonucleotide
gcgggtcacggagccccgaac

SEQ ID NO: 30783 - DNA, 21 bp, Artificial Sequence
  Description of Artificial Sequence: Synthetic oligonucleotide
cgggtcacggagccccgaacc

SEQ ID NO: 30784 - DNA, 22 bp, Artificial Sequence
  Description of Artificial Sequence: Synthetic oligonucleotide
gggtcacggagccccgaaccct

SEQ ID NO: 30785 - DNA, 22 bp, Artificial Sequence
  Description of Artificial Sequence: Synthetic oligonucleotide
ggtcacggagccccgaaccctc

SEQ ID NO: 30786 - DNA, 23 bp, Artificial Sequence
  Description of Artificial Sequence: Synthetic oligonucleotide
gtcacggagccccgaaccctcct

SEQ ID NO: 30787 - DNA, 23 bp, Artificial Sequence
  Description of Artificial Sequence: Synthetic oligonucleotide
tcacggagccccgaaccctcctc

SEQ ID NO: 30788 - DNA, 22 bp, Artificial Sequence
  Description of Artificial Sequence: Synthetic oligonucleotide
cacggagccccgaaccctcctc

SEQ ID NO: 30789 - DNA, 23 bp, Artificial Sequence
  Description of Artificial Sequence: Synthetic oligonucleotide
acggagccccgaaccctcctcct

SEQ ID NO: 30790 - DNA, 22 bp, Artificial Sequence
  Description of Artificial Sequence: Synthetic oligonucleotide
cggagccccgaaccctcctcct

SEQ ID NO: 30791 - DNA, 22 bp, Artificial Sequence
  Description of Artificial Sequence: Synthetic oligonucleotide
ggagccccgaaccctcctcctg

SEQ ID NO: 30792 - DNA, 23 bp, Artificial Sequence
  Description of Artificial Sequence: Synthetic oligonucleotide
gagccccgaaccctcctcctgct

SEQ ID NO: 30793 - DNA, 23 bp, Artificial Sequence
  Description of Artificial Sequence: Synthetic oligonucleotide
agccccgaaccctcctcctgctg

SEQ ID NO: 30794 - DNA, 29 bp, Artificial Sequence
  Description of Artificial Sequence: Synthetic oligonucleotide
caagaccaacacacagactgaccgagagg

SEQ ID NO: 30795 - DNA, 30 bp, Artificial Sequence
  Description of Artificial Sequence: Synthetic oligonucleotide
aagaccaacacacagactgaccgagaggac

SEQ ID NO: 30796 - DNA, 29 bp, Artificial Sequence
  Description of Artificial Sequence: Synthetic oligonucleotide
agaccaacacacagactgaccgagaggac

SEQ ID NO: 30797 - DNA, 28 bp, Artificial Sequence
  Description of Artificial Sequence: Synthetic oligonucleotide
gaccaacacacagactgaccgagaggac

SEQ ID NO: 30798 - DNA, 28 bp, Artificial Sequence
  Description of Artificial Sequence: Synthetic oligonucleotide
accaacacacagactgaccgagaggacc

SEQ ID NO: 30799 - DNA, 27 bp, Artificial Sequence
  Description of Artificial Sequence: Synthetic oligonucleotide
ccaacacacagactgaccgagaggacc

SEQ ID NO: 30800 - DNA, 28 bp, Artificial Sequence
  Description of Artificial Sequence: Synthetic oligonucleotide
caacacacagactgaccgagaggacctg

SEQ ID NO: 30801 - DNA, 28 bp, Artificial Sequence
  Description of Artificial Sequence: Synthetic oligonucleotide
aacacacagactgaccgagaggacctgc

SEQ ID NO: 30802 - DNA, 27 bp, Artificial Sequence
  Description of Artificial Sequence: Synthetic oligonucleotide
acacacagactgaccgagaggacctgc

SEQ ID NO: 30803 - DNA, 26 bp, Artificial Sequence
  Description of Artificial Sequence: Synthetic oligonucleotide
cacacagactgaccgagaggacctgc

SEQ ID NO: 30804 - DNA, 26 bp, Artificial Sequence
  Description of Artificial Sequence: Synthetic oligonucleotide
acacagactgaccgagaggacctgcg

SEQ ID NO: 30805 - DNA, 27 bp, Artificial Sequence
  Description of Artificial Sequence: Synthetic oligonucleotide
tggatagagcaggaggggccggagttt

SEQ ID NO: 30806 - DNA, 27 bp, Artificial Sequence
  Description of Artificial Sequence: Synthetic oligonucleotide
ggatagagcaggaggggccggagtttt

SEQ ID NO: 30807 - DNA, 27 bp, Artificial Sequence
  Description of Artificial Sequence: Synthetic oligonucleotide
gatagagcaggaggggccggagttttg

SEQ ID NO: 30808 - DNA, 27 bp, Artificial Sequence
  Description of Artificial Sequence: Synthetic oligonucleotide
atagagcaggaggggccggagttttgg

SEQ ID NO: 30809 - DNA, 26 bp, Artificial Sequence
  Description of Artificial Sequence: Synthetic oligonucleotide
tagagcaggaggggccggagttttgg

SEQ ID NO: 30810 - DNA, 25 bp, Artificial Sequence
  Description of Artificial Sequence: Synthetic oligonucleotide
agagcaggaggggccggagttttgg

SEQ ID NO: 30811 - DNA, 24 bp, Artificial Sequence
  Description of Artificial Sequence: Synthetic oligonucleotide
gagcaggaggggccggagttttgg

SEQ ID NO: 30812 - DNA, 25 bp, Artificial Sequence
  Description of Artificial Sequence: Synthetic oligonucleotide
agcaggaggggccggagttttggga

SEQ ID NO: 30813 - DNA, 24 bp, Artificial Sequence
  Description of Artificial Sequence: Synthetic oligonucleotide
gcaggaggggccggagttttggga

SEQ ID NO: 30814 - DNA, 24 bp, Artificial Sequence
  Description of Artificial Sequence: Synthetic oligonucleotide
caggaggggccggagttttgggac

SEQ ID NO: 30815 - DNA, 24 bp, Artificial Sequence
  Description of Artificial Sequence: Synthetic oligonucleotide
aggaggggccggagttttgggacc

SEQ ID NO: 30816 - DNA, 23 bp, Artificial Sequence
  Description of Artificial Sequence: Synthetic oligonucleotide
ggaggggccggagttttgggacc

SEQ ID NO: 30817 - DNA, 23 bp, Artificial Sequence
  Description of Artificial Sequence: Synthetic oligonucleotide
gaggggccggagttttgggaccg

SEQ ID NO: 30818 - DNA, 23 bp, Artificial Sequence
  Description of Artificial Sequence: Synthetic oligonucleotide
aggggccggagttttgggaccgg

SEQ ID NO: 30819 - DNA, 22 bp, Artificial Sequence
  Description of Artificial Sequence: Synthetic oligonucleotide
ggggccggagttttgggaccgg

SEQ ID NO: 30820 - DNA, 23 bp, Artificial Sequence
  Description of Artificial Sequence: Synthetic oligonucleotide
gggccggagttttgggaccggga

SEQ ID NO: 30821 - DNA, 24 bp, Artificial Sequence
  Description of Artificial Sequence: Synthetic oligonucleotide
ggccggagttttgggaccgggaga

SEQ ID NO: 30822 - DNA, 25 bp, Artificial Sequence
  Description of Artificial Sequence: Synthetic oligonucleotide
gccggagttttgggaccgggagaca

SEQ ID NO: 30823 - DNA, 26 bp, Artificial Sequence
  Description of Artificial Sequence: Synthetic oligonucleotide
ccggagttttgggaccgggagacaca

SEQ ID NO: 30824 - DNA, 27 bp, Artificial Sequence
  Description of Artificial Sequence: Synthetic oligonucleotide
cggagttttgggaccgggagacacaga

SEQ ID NO: 30825 - DNA, 28 bp, Artificial Sequence
  Description of Artificial Sequence: Synthetic oligonucleotide
ggagttttgggaccgggagacacagatc

SEQ ID NO: 30826 - DNA, 29 bp, Artificial Sequence
  Description of Artificial Sequence: Synthetic oligonucleotide
gagttttgggaccgggagacacagatctg

SEQ ID NO: 30827 - DNA, 29 bp, Artificial Sequence
  Description of Artificial Sequence: Synthetic oligonucleotide
agttttgggaccgggagacacagatctgc

SEQ ID NO: 30828 - DNA, 28 bp, Artificial Sequence
  Description of Artificial Sequence: Synthetic oligonucleotide
gttttgggaccgggagacacagatctgc

SEQ ID NO: 30829 - DNA, 30 bp, Artificial Sequence
  Description of Artificial Sequence: Synthetic oligonucleotide
ttttgggaccgggagacacagatctgcaag

SEQ ID NO: 30830 - DNA, 29 bp, Artificial Sequence
  Description of Artificial Sequence: Synthetic oligonucleotide
tttgggaccgggagacacagatctgcaag

SEQ ID NO: 30831 - DNA, 29 bp, Artificial Sequence
  Description of Artificial Sequence: Synthetic oligonucleotide
ccgggtctcacaccctccagaatatgtac

SEQ ID NO: 30832 - DNA, 29 bp, Artificial Sequence
  Description of Artificial Sequence: Synthetic oligonucleotide
cgggtctcacaccctccagaatatgtacg

SEQ ID NO: 30833 - DNA, 29 bp, Artificial Sequence
  Description of Artificial Sequence: Synthetic oligonucleotide
gggtctcacaccctccagaatatgtacgg

SEQ ID NO: 30834 - DNA, 29 bp, Artificial Sequence
  Description of Artificial Sequence: Synthetic oligonucleotide
ggtctcacaccctccagaatatgtacggc

SEQ ID NO: 30835 - DNA, 30 bp, Artificial Sequence
  Description of Artificial Sequence: Synthetic oligonucleotide
gtctcacaccctccagaatatgtacggctg

SEQ ID NO: 30836 - DNA, 30 bp, Artificial Sequence
  Description of Artificial Sequence: Synthetic oligonucleotide
tctcacaccctccagaatatgtacggctgc

SEQ ID NO: 30837 - DNA, 29 bp, Artificial Sequence
  Description of Artificial Sequence: Synthetic oligonucleotide
ctcacaccctccagaatatgtacggctgc

SEQ ID NO: 30838 - DNA, 29 bp, Artificial Sequence
  Description of Artificial Sequence: Synthetic oligonucleotide
tcacaccctccagaatatgtacggctgcg

SEQ ID NO: 30839 - DNA, 28 bp, Artificial Sequence
  Description of Artificial Sequence: Synthetic oligonucleotide
cacaccctccagaatatgtacggctgcg

SEQ ID NO: 30840 - DNA, 29 bp, Artificial Sequence
  Description of Artificial Sequence: Synthetic oligonucleotide
acaccctccagaatatgtacggctgcgac

SEQ ID NO: 30841 - DNA, 28 bp, Artificial Sequence
  Description of Artificial Sequence: Synthetic oligonucleotide
caccctccagaatatgtacggctgcgac

SEQ ID NO: 30842 - DNA, 28 bp, Artificial Sequence
  Description of Artificial Sequence: Synthetic oligonucleotide
accctccagaatatgtacggctgcgacg

SEQ ID NO: 30843 - DNA, 27 bp, Artificial Sequence
  Description of Artificial Sequence: Synthetic oligonucleotide
ccctccagaatatgtacggctgcgacg

SEQ ID NO: 30844 - DNA, 28 bp, Artificial Sequence
  Description of Artificial Sequence: Synthetic oligonucleotide
cctccagaatatgtacggctgcgacgtg

SEQ ID NO: 30845 - DNA, 28 bp, Artificial Sequence
  Description of Artificial Sequence: Synthetic oligonucleotide
ctccagaatatgtacggctgcgacgtgg

SEQ ID NO: 30846 - DNA, 28 bp, Artificial Sequence
  Description of Artificial Sequence: Synthetic oligonucleotide
tccagaatatgtacggctgcgacgtggg

SEQ ID NO: 30847 - DNA, 27 bp, Artificial Sequence
  Description of Artificial Sequence: Synthetic oligonucleotide
ccagaatatgtacggctgcgacgtggg

SEQ ID NO: 30848 - DNA, 27 bp, Artificial Sequence
  Description of Artificial Sequence: Synthetic oligonucleotide
cagaatatgtacggctgcgacgtgggg

SEQ ID NO: 30849 - DNA, 27 bp, Artificial Sequence
  Description of Artificial Sequence: Synthetic oligonucleotide
agaatatgtacggctgcgacgtggggc

SEQ ID NO: 30850 - DNA, 26 bp, Artificial Sequence
  Description of Artificial Sequence: Synthetic oligonucleotide
gaatatgtacggctgcgacgtggggc

SEQ ID NO: 30851 - DNA, 26 bp, Artificial Sequence
  Description of Artificial Sequence: Synthetic oligonucleotide
aatatgtacggctgcgacgtggggcc

SEQ ID NO: 30852 - DNA, 25 bp, Artificial Sequence
  Description of Artificial Sequence: Synthetic oligonucleotide
atatgtacggctgcgacgtggggcc

SEQ ID NO: 30853 - DNA, 27 bp, Artificial Sequence
  Description of Artificial Sequence: Synthetic oligonucleotide
acagacttaccgagagagcctgcggac

SEQ ID NO: 30854 - DNA, 26 bp, Artificial Sequence
  Description of Artificial Sequence: Synthetic oligonucleotide
cagacttaccgagagagcctgcggac

SEQ ID NO: 30855 - DNA, 26 bp, Artificial Sequence
  Description of Artificial Sequence: Synthetic oligonucleotide
agacttaccgagagagcctgcggacc

SEQ ID NO: 30856 - DNA, 25 bp, Artificial Sequence
  Description of Artificial Sequence: Synthetic oligonucleotide
gacttaccgagagagcctgcggacc

SEQ ID NO: 30857 - DNA, 26 bp, Artificial Sequence
  Description of Artificial Sequence: Synthetic oligonucleotide
acttaccgagagagcctgcggaccct

SEQ ID NO: 30858 - DNA, 25 bp, Artificial Sequence
  Description of Artificial Sequence: Synthetic oligonucleotide
cttaccgagagagcctgcggaccct

SEQ ID NO: 30859 - DNA, 25 bp, Artificial Sequence
  Description of Artificial Sequence: Synthetic oligonucleotide
ttaccgagagagcctgcggaccctg

SEQ ID NO: 30860 - DNA, 24 bp, Artificial Sequence
  Description of Artificial Sequence: Synthetic oligonucleotide
taccgagagagcctgcggaccctg

SEQ ID NO: 30861 - DNA, 25 bp, Artificial Sequence
  Description of Artificial Sequence: Synthetic oligonucleotide
gcggctcagatctcccagcgcaagt

SEQ ID NO: 30862 - DNA, 25 bp, Artificial Sequence
  Description of Artificial Sequence: Synthetic oligonucleotide
cggctcagatctcccagcgcaagtg

SEQ ID NO: 30863 - DNA, 25 bp, Artificial Sequence
  Description of Artificial Sequence: Synthetic oligonucleotide
ggctcagatctcccagcgcaagtgg

SEQ ID NO: 30864 - DNA, 26 bp, Artificial Sequence
  Description of Artificial Sequence: Synthetic oligonucleotide
gctcagatctcccagcgcaagtggga

SEQ ID NO: 30865 - DNA, 26 bp, Artificial Sequence
  Description of Artificial Sequence: Synthetic oligonucleotide
ctcagatctcccagcgcaagtgggag

SEQ ID NO: 30866 - DNA, 26 bp, Artificial Sequence
  Description of Artificial Sequence: Synthetic oligonucleotide
tcagatctcccagcgcaagtgggagg

SEQ ID NO: 30867 - DNA, 25 bp, Artificial Sequence
  Description of Artificial Sequence: Synthetic oligonucleotide
cagatctcccagcgcaagtgggagg

SEQ ID NO: 30868 - DNA, 25 bp, Artificial Sequence
  Description of Artificial Sequence: Synthetic oligonucleotide
agatctcccagcgcaagtgggaggc

SEQ ID NO: 30869 - DNA, 24 bp, Artificial Sequence
  Description of Artificial Sequence: Synthetic oligonucleotide
gatctcccagcgcaagtgggaggc

SEQ ID NO: 30870 - DNA, 24 bp, Artificial Sequence
  Description of Artificial Sequence: Synthetic oligonucleotide
atctcccagcgcaagtgggaggcg

SEQ ID NO: 30871 - DNA, 23 bp, Artificial Sequence
  Description of Artificial Sequence: Synthetic oligonucleotide
tctcccagcgcaagtgggaggcg

SEQ ID NO: 30872 - DNA, 22 bp, Artificial Sequence
  Description of Artificial Sequence: Synthetic oligonucleotide
ctcccagcgcaagtgggaggcg

SEQ ID NO: 30873 - DNA, 22 bp, Artificial Sequence
  Description of Artificial Sequence: Synthetic oligonucleotide
tcccagcgcaagtgggaggcgg

SEQ ID NO: 30874 - DNA, 26 bp, Artificial Sequence
  Description of Artificial Sequence: Synthetic oligonucleotide
accgggagacacagatctgcaaggcc

SEQ ID NO: 30875 - DNA, 25 bp, Artificial Sequence
  Description of Artificial Sequence: Synthetic oligonucleotide
ccgggagacacagatctgcaaggcc

SEQ ID NO: 30876 - DNA, 26 bp, Artificial Sequence
  Description of Artificial Sequence: Synthetic oligonucleotide
cgggagacacagatctgcaaggccca

SEQ ID NO: 30877 - DNA, 26 bp, Artificial Sequence
  Description of Artificial Sequence: Synthetic oligonucleotide
gggagacacagatctgcaaggcccag

SEQ ID NO: 30878 - DNA, 26 bp, Artificial Sequence
  Description of Artificial Sequence: Synthetic oligonucleotide
ggagacacagatctgcaaggcccagg

SEQ ID NO: 30879 - DNA, 27 bp, Artificial Sequence
  Description of Artificial Sequence: Synthetic oligonucleotide
gagacacagatctgcaaggcccaggca

SEQ ID NO: 30880 - DNA, 27 bp, Artificial Sequence
  Description of Artificial Sequence: Synthetic oligonucleotide
agacacagatctgcaaggcccaggcac

SEQ ID NO: 30881 - DNA, 27 bp, Artificial Sequence
  Description of Artificial Sequence: Synthetic oligonucleotide
gacacagatctgcaaggcccaggcaca

SEQ ID NO: 30882 - DNA, 22 bp, Artificial Sequence
  Description of Artificial Sequence: Synthetic oligonucleotide
ctcctggaccgccgcggacaca

SEQ ID NO: 30883 - DNA, 22 bp, Artificial Sequence
  Description of Artificial Sequence: Synthetic oligonucleotide
tcctggaccgccgcggacacag

SEQ ID NO: 30884 - DNA, 21 bp, Artificial Sequence
  Description of Artificial Sequence: Synthetic oligonucleotide
cctggaccgccgcggacacag

SEQ ID NO: 30885 - DNA, 21 bp, Artificial Sequence
  Description of Artificial Sequence: Synthetic oligonucleotide
ctggaccgccgcggacacagc

SEQ ID NO: 30886 - DNA, 21 bp, Artificial Sequence
  Description of Artificial Sequence: Synthetic oligonucleotide
tggaccgccgcggacacagcg

SEQ ID NO: 30887 - DNA, 20 bp, Artificial Sequence
  Description of Artificial Sequence: Synthetic oligonucleotide
ggaccgccgcggacacagcg

SEQ ID NO: 30888 - DNA, 20 bp, Artificial Sequence
  Description of Artificial Sequence: Synthetic oligonucleotide
gaccgccgcggacacagcgg

SEQ ID NO: 30889 - DNA, 21 bp, Artificial Sequence
  Description of Artificial Sequence: Synthetic oligonucleotide
accgccgcggacacagcggct

SEQ ID NO: 30890 - DNA, 20 bp, Artificial Sequence
  Description of Artificial Sequence: Synthetic oligonucleotide
ccgccgcggacacagcggct

SEQ ID NO: 30891 - DNA, 21 bp, Artificial Sequence
  Description of Artificial Sequence: Synthetic oligonucleotide
cgccgcggacacagcggctca

SEQ ID NO: 30892 - DNA, 23 bp, Artificial Sequence
  Description of Artificial Sequence: Synthetic oligonucleotide
gccgcggacacagcggctcagat

SEQ ID NO: 30893 - DNA, 24 bp, Artificial Sequence
  Description of Artificial Sequence: Synthetic oligonucleotide
ccgcggacacagcggctcagatca

SEQ ID NO: 30894 - DNA, 24 bp, Artificial Sequence
  Description of Artificial Sequence: Synthetic oligonucleotide
cgcggacacagcggctcagatcac

SEQ ID NO: 30895 - DNA, 24 bp, Artificial Sequence
  Description of Artificial Sequence: Synthetic oligonucleotide
gcggacacagcggctcagatcacc

SEQ ID NO: 30896 - DNA, 25 bp, Artificial Sequence
  Description of Artificial Sequence: Synthetic oligonucleotide
cggacacagcggctcagatcaccca

SEQ ID NO: 30897 - DNA, 25 bp, Artificial Sequence
  Description of Artificial Sequence: Synthetic oligonucleotide
ggacacagcggctcagatcacccag

SEQ ID NO: 30898 - DNA, 25 bp, Artificial Sequence
  Description of Artificial Sequence: Synthetic oligonucleotide
gacacagcggctcagatcacccagc

SEQ ID NO: 30899 - DNA, 25 bp, Artificial Sequence
  Description of Artificial Sequence: Synthetic oligonucleotide
acacagcggctcagatcacccagcg

SEQ ID NO: 30900 - DNA, 24 bp, Artificial Sequence
  Description of Artificial Sequence: Synthetic oligonucleotide
cacagcggctcagatcacccagcg

SEQ ID NO: 30901 - DNA, 26 bp, Artificial Sequence
  Description of Artificial Sequence: Synthetic oligonucleotide
acagcggctcagatcacccagcgcaa

SEQ ID NO: 30902 - DNA, 25 bp, Artificial Sequence
  Description of Artificial Sequence: Synthetic oligonucleotide
cagcggctcagatcacccagcgcaa

SEQ ID NO: 30903 - DNA, 26 bp, Artificial Sequence
  Description of Artificial Sequence: Synthetic oligonucleotide
agcggctcagatcacccagcgcaagt

SEQ ID NO: 30904 - DNA, 25 bp, Artificial Sequence
  Description of Artificial Sequence: Synthetic oligonucleotide
cccatcgtgggcattgttgctggcc

SEQ ID NO: 30905 - DNA, 29 bp, Artificial Sequence
  Description of Artificial Sequence: Synthetic oligonucleotide
agacacagatctgcaaggccaaggcactg

SEQ ID NO: 30906 - DNA, 28 bp, Artificial Sequence
  Description of Artificial Sequence: Synthetic oligonucleotide
gacacagatctgcaaggccaaggcactg

SEQ ID NO: 30907 - DNA, 29 bp, Artificial Sequence
  Description of Artificial Sequence: Synthetic oligonucleotide
acacagatctgcaaggccaaggcactgac

SEQ ID NO: 30908 - DNA, 28 bp, Artificial Sequence
  Description of Artificial Sequence: Synthetic oligonucleotide
cacagatctgcaaggccaaggcactgac

SEQ ID NO: 30909 - DNA, 29 bp, Artificial Sequence
  Description of Artificial Sequence: Synthetic oligonucleotide
acagatctgcaaggccaaggcactgactg

SEQ ID NO: 30910 - DNA, 28 bp, Artificial Sequence
  Description of Artificial Sequence: Synthetic oligonucleotide
cagatctgcaaggccaaggcactgactg

SEQ ID NO: 30911 - DNA, 29 bp, Artificial Sequence
  Description of Artificial Sequence: Synthetic oligonucleotide
agatctgcaaggccaaggcactgactgac

SEQ ID NO: 30912 - DNA, 28 bp, Artificial Sequence
  Description of Artificial Sequence: Synthetic oligonucleotide
gatctgcaaggccaaggcactgactgac

SEQ ID NO: 30913 - DNA, 28 bp, Artificial Sequence
  Description of Artificial Sequence: Synthetic oligonucleotide
atctgcaaggccaaggcactgactgacc

SEQ ID NO: 30914 - DNA, 27 bp, Artificial Sequence
  Description of Artificial Sequence: Synthetic oligonucleotide
tctgcaaggccaaggcactgactgacc

SEQ ID NO: 30915 - DNA, 26 bp, Artificial Sequence
  Description of Artificial Sequence: Synthetic oligonucleotide
ctgcaaggccaaggcactgactgacc

SEQ ID NO: 30916 - DNA, 27 bp, Artificial Sequence
  Description of Artificial Sequence: Synthetic oligonucleotide
tgcaaggccaaggcactgactgaccga

SEQ ID NO: 30917 - DNA, 26 bp, Artificial Sequence
  Description of Artificial Sequence: Synthetic oligonucleotide
gcaaggccaaggcactgactgaccga

SEQ ID NO: 30918 - DNA, 27 bp, Artificial Sequence
  Description of Artificial Sequence: Synthetic oligonucleotide
caaggccaaggcactgactgaccgaga

SEQ ID NO: 30919 - DNA, 27 bp, Artificial Sequence
  Description of Artificial Sequence: Synthetic oligonucleotide
aaggccaaggcactgactgaccgagag

SEQ ID NO: 30920 - DNA, 26 bp, Artificial Sequence
  Description of Artificial Sequence: Synthetic oligonucleotide
aggccaaggcactgactgaccgagag

SEQ ID NO: 30921 - DNA, 25 bp, Artificial Sequence
  Description of Artificial Sequence: Synthetic oligonucleotide
ggccaaggcactgactgaccgagag

SEQ ID NO: 30922 - DNA, 26 bp, Artificial Sequence
  Description of Artificial Sequence: Synthetic oligonucleotide
gccaaggcactgactgaccgagagga

SEQ ID NO: 30923 - DNA, 26 bp, Artificial Sequence
  Description of Artificial Sequence: Synthetic oligonucleotide
ccaaggcactgactgaccgagaggac

SEQ ID NO: 30924 - DNA, 27 bp, Artificial Sequence
  Description of Artificial Sequence: Synthetic oligonucleotide
caaggcactgactgaccgagaggacct

SEQ ID NO: 30925 - DNA, 27 bp, Artificial Sequence
  Description of Artificial Sequence: Synthetic oligonucleotide
aaggcactgactgaccgagaggacctg

SEQ ID NO: 30926 - DNA, 26 bp, Artificial Sequence
  Description of Artificial Sequence: Synthetic oligonucleotide
aggcactgactgaccgagaggacctg

SEQ ID NO: 30927 - DNA, 25 bp, Artificial Sequence
  Description of Artificial Sequence: Synthetic oligonucleotide
ggcactgactgaccgagaggacctg

SEQ ID NO: 30928 - DNA, 25 bp, Artificial Sequence
  Description of Artificial Sequence: Synthetic oligonucleotide
gcactgactgaccgagaggacctgc

SEQ ID NO: 30929 - DNA, 25 bp, Artificial Sequence
  Description of Artificial Sequence: Synthetic oligonucleotide
cactgactgaccgagaggacctgcg

SEQ ID NO: 30930 - DNA, 26 bp, Artificial Sequence
  Description of Artificial Sequence: Synthetic oligonucleotide
actgactgaccgagaggacctgcgga

SEQ ID NO: 30931 - DNA, 25 bp, Artificial Sequence
  Description of Artificial Sequence: Synthetic oligonucleotide
ctgactgaccgagaggacctgcgga

SEQ ID NO: 30932 - DNA, 25 bp, Artificial Sequence
  Description of Artificial Sequence: Synthetic oligonucleotide
tgactgaccgagaggacctgcggac

SEQ ID NO: 30933 - DNA, 27 bp, Artificial Sequence
  Description of Artificial Sequence: Synthetic oligonucleotide
acagactgaccgagaggacctgcggaa

SEQ ID NO: 30934 - DNA, 26 bp, Artificial Sequence
  Description of Artificial Sequence: Synthetic oligonucleotide
cagactgaccgagaggacctgcggaa

SEQ ID NO: 30935 - DNA, 26 bp, Artificial Sequence
  Description of Artificial Sequence: Synthetic oligonucleotide
agactgaccgagaggacctgcggaac

SEQ ID NO: 30936 - DNA, 25 bp, Artificial Sequence
  Description of Artificial Sequence: Synthetic oligonucleotide
gactgaccgagaggacctgcggaac

SEQ ID NO: 30937 - DNA, 26 bp, Artificial Sequence
  Description of Artificial Sequence: Synthetic oligonucleotide
actgaccgagaggacctgcggaacct

SEQ ID NO: 30938 - DNA, 25 bp, Artificial Sequence
  Description of Artificial Sequence: Synthetic oligonucleotide
ctgaccgagaggacctgcggaacct

SEQ ID NO: 30939 - DNA, 25 bp, Artificial Sequence
  Description of Artificial Sequence: Synthetic oligonucleotide
tgaccgagaggacctgcggaacctg

SEQ ID NO: 30940 - DNA, 24 bp, Artificial Sequence
  Description of Artificial Sequence: Synthetic oligonucleotide
gaccgagaggacctgcggaacctg

SEQ ID NO: 30941 - DNA, 24 bp, Artificial Sequence
  Description of Artificial Sequence: Synthetic oligonucleotide
accgagaggacctgcggaacctgc

SEQ ID NO: 30942 - DNA, 23 bp, Artificial Sequence
  Description of Artificial Sequence: Synthetic oligonucleotide
ccgagaggacctgcggaacctgc

SEQ ID NO: 30943 - DNA, 23 bp, Artificial Sequence
  Description of Artificial Sequence: Synthetic oligonucleotide
cgagaggacctgcggaacctgcg

SEQ ID NO: 30944 - DNA, 23 bp, Artificial Sequence
  Description of Artificial Sequence: Synthetic oligonucleotide
gagaggacctgcggaacctgcgc

SEQ ID NO: 30945 - DNA, 23 bp, Artificial Sequence
  Description of Artificial Sequence: Synthetic oligonucleotide
agaggacctgcggaacctgcgcg

SEQ ID NO: 30946 - DNA, 22 bp, Artificial Sequence
  Description of Artificial Sequence: Synthetic oligonucleotide
gaggacctgcggaacctgcgcg

SEQ ID NO: 30947 - DNA, 22 bp, Artificial Sequence
  Description of Artificial Sequence: Synthetic oligonucleotide
aggacctgcggaacctgcgcgg

SEQ ID NO: 30948 - DNA, 21 bp, Artificial Sequence
  Description of Artificial Sequence: Synthetic oligonucleotide
ggacctgcggaacctgcgcgg

SEQ ID NO: 30949 - DNA, 23 bp, Artificial Sequence
  Description of Artificial Sequence: Synthetic oligonucleotide
gacctgcggaacctgcgcggcta

SEQ ID NO: 30950 - DNA, 25 bp, Artificial Sequence
  Description of Artificial Sequence: Synthetic oligonucleotide
agcatgtacggctgcgacgtggggt

SEQ ID NO: 30951 - DNA, 24 bp, Artificial Sequence
  Description of Artificial Sequence: Synthetic oligonucleotide
gcatgtacggctgcgacgtggggt

SEQ ID NO: 30952 - DNA, 24 bp, Artificial Sequence
  Description of Artificial Sequence: Synthetic oligonucleotide
catgtacggctgcgacgtggggtc

SEQ ID NO: 30953 - DNA, 29 bp, Artificial Sequence
  Description of Artificial Sequence: Synthetic oligonucleotide
aaggccaaggcacagacttaccgagagag

SEQ ID NO: 30954 - DNA, 28 bp, Artificial Sequence
  Description of Artificial Sequence: Synthetic oligonucleotide
aggccaaggcacagacttaccgagagag

SEQ ID NO: 30955 - DNA, 27 bp, Artificial Sequence
  Description of Artificial Sequence: Synthetic oligonucleotide
ggccaaggcacagacttaccgagagag

SEQ ID NO: 30956 - DNA, 27 bp, Artificial Sequence
  Description of Artificial Sequence: Synthetic oligonucleotide
gccaaggcacagacttaccgagagagc

SEQ ID NO: 30957 - DNA, 27 bp, Artificial Sequence
  Description of Artificial Sequence: Synthetic oligonucleotide
ccaaggcacagacttaccgagagagcc

SEQ ID NO: 30958 - DNA, 28 bp, Artificial Sequence
  Description of Artificial Sequence: Synthetic oligonucleotide
caaggcacagacttaccgagagagcctg

SEQ ID NO: 30959 - DNA, 28 bp, Artificial Sequence
  Description of Artificial Sequence: Synthetic oligonucleotide
aaggcacagacttaccgagagagcctgc

SEQ ID NO: 30960 - DNA, 27 bp, Artificial Sequence
  Description of Artificial Sequence: Synthetic oligonucleotide
ccaccaccccatctctgaccatgaggt

SEQ ID NO: 30961 - DNA, 27 bp, Artificial Sequence
  Description of Artificial Sequence: Synthetic oligonucleotide
caccaccccatctctgaccatgaggtc

SEQ ID NO: 30962 - DNA, 28 bp, Artificial Sequence
  Description of Artificial Sequence: Synthetic oligonucleotide
accaccccatctctgaccatgaggtcac

SEQ ID NO: 30963 - DNA, 27 bp, Artificial Sequence
  Description of Artificial Sequence: Synthetic oligonucleotide
ccaccccatctctgaccatgaggtcac

SEQ ID NO: 30964 - DNA, 27 bp, Artificial Sequence
  Description of Artificial Sequence: Synthetic oligonucleotide
caccccatctctgaccatgaggtcacc

SEQ ID NO: 30965 - DNA, 27 bp, Artificial Sequence
  Description of Artificial Sequence: Synthetic oligonucleotide
accccatctctgaccatgaggtcaccc

SEQ ID NO: 30966 - DNA, 27 bp, Artificial Sequence
  Description of Artificial Sequence: Synthetic oligonucleotide
ccccatctctgaccatgaggtcaccct

SEQ ID NO: 30967 - DNA, 27 bp, Artificial Sequence
  Description of Artificial Sequence: Synthetic oligonucleotide
cccatctctgaccatgaggtcaccctg

SEQ ID NO: 30968 - DNA, 28 bp, Artificial Sequence
  Description of Artificial Sequence: Synthetic oligonucleotide
ccatctctgaccatgaggtcaccctgag

SEQ ID NO: 30969 - DNA, 28 bp, Artificial Sequence
  Description of Artificial Sequence: Synthetic oligonucleotide
catctctgaccatgaggtcaccctgagg

SEQ ID NO: 30970 - DNA, 29 bp, Artificial Sequence
  Description of Artificial Sequence: Synthetic oligonucleotide
atctctgaccatgaggtcaccctgaggtg

SEQ ID NO: 30971 - DNA, 28 bp, Artificial Sequence
  Description of Artificial Sequence: Synthetic oligonucleotide
tctctgaccatgaggtcaccctgaggtg

SEQ ID NO: 30972 - DNA, 27 bp, Artificial Sequence
  Description of Artificial Sequence: Synthetic oligonucleotide
ctctgaccatgaggtcaccctgaggtg

SEQ ID NO: 30973 - DNA, 27 bp, Artificial Sequence
  Description of Artificial Sequence: Synthetic oligonucleotide
tctgaccatgaggtcaccctgaggtgc

SEQ ID NO: 30974 - DNA, 27 bp, Artificial Sequence
  Description of Artificial Sequence: Synthetic oligonucleotide
ctgaccatgaggtcaccctgaggtgct

SEQ ID NO: 30975 - DNA, 27 bp, Artificial Sequence
  Description of Artificial Sequence: Synthetic oligonucleotide
tgaccatgaggtcaccctgaggtgctg

SEQ ID NO: 30976 - DNA, 26 bp, Artificial Sequence
  Description of Artificial Sequence: Synthetic oligonucleotide
gaccatgaggtcaccctgaggtgctg

SEQ ID NO: 30977 - DNA, 26 bp, Artificial Sequence
  Description of Artificial Sequence: Synthetic oligonucleotide
accatgaggtcaccctgaggtgctgg

SEQ ID NO: 30978 - DNA, 25 bp, Artificial Sequence
  Description of Artificial Sequence: Synthetic oligonucleotide
ccatgaggtcaccctgaggtgctgg

SEQ ID NO: 30979 - DNA, 25 bp, Artificial Sequence
  Description of Artificial Sequence: Synthetic oligonucleotide
catgaggtcaccctgaggtgctggg

SEQ ID NO: 30980 - DNA, 25 bp, Artificial Sequence
  Description of Artificial Sequence: Synthetic oligonucleotide
atgaggtcaccctgaggtgctgggc

SEQ ID NO: 30981 - DNA, 24 bp, Artificial Sequence
  Description of Artificial Sequence: Synthetic oligonucleotide
tgaggtcaccctgaggtgctgggc

SEQ ID NO: 30982 - DNA, 23 bp, Artificial Sequence
  Description of Artificial Sequence: Synthetic oligonucleotide
gaggtcaccctgaggtgctgggc

SEQ ID NO: 30983 - DNA, 23 bp, Artificial Sequence
  Description of Artificial Sequence: Synthetic oligonucleotide
aggtcaccctgaggtgctgggcc

SEQ ID NO: 30984 - DNA, 22 bp, Artificial Sequence
  Description of Artificial Sequence: Synthetic oligonucleotide
ggtcaccctgaggtgctgggcc

SEQ ID NO: 30985 - DNA, 23 bp, Artificial Sequence
  Description of Artificial Sequence: Synthetic oligonucleotide
gtcaccctgaggtgctgggccct

SEQ ID NO: 30986 - DNA, 23 bp, Artificial Sequence
  Description of Artificial Sequence: Synthetic oligonucleotide
tcaccctgaggtgctgggccctg

SEQ ID NO: 30987 - DNA, 20 bp, Artificial Sequence
  Description of Artificial Sequence: Synthetic oligonucleotide
agccgcgggcgccgtggaga

SEQ ID NO: 30988 - DNA, 20 bp, Artificial Sequence
  Description of Artificial Sequence: Synthetic oligonucleotide
gccgcgggcgccgtggagat

SEQ ID NO: 30989 - DNA, 20 bp, Artificial Sequence
  Description of Artificial Sequence: Synthetic oligonucleotide
ccgcgggcgccgtggagaga

SEQ ID NO: 30990 - DNA, 20 bp, Artificial Sequence
  Description of Artificial Sequence: Synthetic oligonucleotide
cgcgggcgccgtggagagag

SEQ ID NO: 30991 - DNA, 21 bp, Artificial Sequence
  Description of Artificial Sequence: Synthetic oligonucleotide
gcgggcgccgtggagagagca

SEQ ID NO: 30992 - DNA, 21 bp, Artificial Sequence
  Description of Artificial Sequence: Synthetic oligonucleotide
cgggcgccgtggagagagcag

SEQ ID NO: 30993 - DNA, 22 bp, Artificial Sequence
  Description of Artificial Sequence: Synthetic oligonucleotide
gggcgccgtggagagagcagga

SEQ ID NO: 30994 - DNA, 22 bp, Artificial Sequence
  Description of Artificial Sequence: Synthetic oligonucleotide
ggcgccgtggagagagcaggag

SEQ ID NO: 30995 - DNA, 22 bp, Artificial Sequence
  Description of Artificial Sequence: Synthetic oligonucleotide
gcgccgtggagagagcaggagg

SEQ ID NO: 30996 - DNA, 22 bp, Artificial Sequence
  Description of Artificial Sequence: Synthetic oligonucleotide
cgccgtggagagagcaggaggg

SEQ ID NO: 30997 - DNA, 22 bp, Artificial Sequence
  Description of Artificial Sequence: Synthetic oligonucleotide
gccgtggagagagcaggagggg

SEQ ID NO: 30998 - DNA, 22 bp, Artificial Sequence
  Description of Artificial Sequence: Synthetic oligonucleotide
ccgtggagagagcaggaggggc

SEQ ID NO: 30999 - DNA, 22 bp, Artificial Sequence
  Description of Artificial Sequence: Synthetic oligonucleotide
cgtggagagagcaggaggggcc

SEQ ID NO: 31000 - DNA, 22 bp, Artificial Sequence
  Description of Artificial Sequence: Synthetic oligonucleotide
gtggagagagcaggaggggccg

SEQ ID NO: 31001 - DNA, 23 bp, Artificial Sequence
  Description of Artificial Sequence: Synthetic oligonucleotide
tggagagagcaggaggggccgga

SEQ ID NO: 31002 - DNA, 22 bp, Artificial Sequence
  Description of Artificial Sequence: Synthetic oligonucleotide
ggagagagcaggaggggccgga

SEQ ID NO: 31003 - DNA, 26 bp, Artificial Sequence
  Description of Artificial Sequence: Synthetic oligonucleotide
gagagagcaggaggggccggagtatt

SEQ ID NO: 31004 - DNA, 26 bp, Artificial Sequence
  Description of Artificial Sequence: Synthetic oligonucleotide
agagagcaggaggggccggagtattg

SEQ ID NO: 31005 - DNA, 25 bp, Artificial Sequence
  Description of Artificial Sequence: Synthetic oligonucleotide
gagagcaggaggggccggagtattg

SEQ ID NO: 31006 - DNA, 25 bp, Artificial Sequence
  Description of Artificial Sequence: Synthetic oligonucleotide
accgagaggacctgcggaccctgtt

SEQ ID NO: 31007 - DNA, 24 bp, Artificial Sequence
  Description of Artificial Sequence: Synthetic oligonucleotide
ccgagaggacctgcggaccctgtt

SEQ ID NO: 31008 - DNA, 24 bp, Artificial Sequence
  Description of Artificial Sequence: Synthetic oligonucleotide
cgagaggacctgcggaccctgttc

SEQ ID NO: 31009 - DNA, 24 bp, Artificial Sequence
  Description of Artificial Sequence: Synthetic oligonucleotide
gagaggacctgcggaccctgttcc

SEQ ID NO: 31010 - DNA, 24 bp, Artificial Sequence
  Description of Artificial Sequence: Synthetic oligonucleotide
agaggacctgcggaccctgttccg

SEQ ID NO: 31011 - DNA, 23 bp, Artificial Sequence
  Description of Artificial Sequence: Synthetic oligonucleotide
gaggacctgcggaccctgttccg

SEQ ID NO: 31012 - DNA, 25 bp, Artificial Sequence
  Description of Artificial Sequence: Synthetic oligonucleotide
aggacctgcggaccctgttccgcta

SEQ ID NO: 31013 - DNA, 24 bp, Artificial Sequence
  Description of Artificial Sequence: Synthetic oligonucleotide
ggacctgcggaccctgttccgcta

SEQ ID NO: 31014 - DNA, 26 bp, Artificial Sequence
  Description of Artificial Sequence: Synthetic oligonucleotide
gacctgcggaccctgttccgctacta

SEQ ID NO: 31015 - DNA, 27 bp, Artificial Sequence
  Description of Artificial Sequence: Synthetic oligonucleotide
acctgcggaccctgttccgctactaca

SEQ ID NO: 31016 - DNA, 27 bp, Artificial Sequence
  Description of Artificial Sequence: Synthetic oligonucleotide
cctgcggaccctgttccgctactacaa

SEQ ID NO: 31017 - DNA, 27 bp, Artificial Sequence
  Description of Artificial Sequence: Synthetic oligonucleotide
ctgcggaccctgttccgctactacaac

SEQ ID NO: 31018 - DNA, 27 bp, Artificial Sequence
  Description of Artificial Sequence: Synthetic oligonucleotide
tgcggaccctgttccgctactacaacc

SEQ ID NO: 31019 - DNA, 27 bp, Artificial Sequence
  Description of Artificial Sequence: Synthetic oligonucleotide
gcggaccctgttccgctactacaacca

SEQ ID NO: 31020 - DNA, 27 bp, Artificial Sequence
  Description of Artificial Sequence: Synthetic oligonucleotide
cggaccctgttccgctactacaaccag

SEQ ID NO: 31021 - DNA, 28 bp, Artificial Sequence
  Description of Artificial Sequence: Synthetic oligonucleotide
ggaccctgttccgctactacaaccagag

SEQ ID NO: 31022 - DNA, 28 bp, Artificial Sequence
  Description of Artificial Sequence: Synthetic oligonucleotide
gaccctgttccgctactacaaccagagc

SEQ ID NO: 31023 - DNA, 28 bp, Artificial Sequence
  Description of Artificial Sequence: Synthetic oligonucleotide
accctgttccgctactacaaccagagcg

SEQ ID NO: 31024 - DNA, 27 bp, Artificial Sequence
  Description of Artificial Sequence: Synthetic oligonucleotide
ccctgttccgctactacaaccagagcg

SEQ ID NO: 31025 - DNA, 28 bp, Artificial Sequence
  Description of Artificial Sequence: Synthetic oligonucleotide
cctgttccgctactacaaccagagcgag

SEQ ID NO: 31026 - DNA, 28 bp, Artificial Sequence
  Description of Artificial Sequence: Synthetic oligonucleotide
ctgttccgctactacaaccagagcgagg

SEQ ID NO: 31027 - DNA, 28 bp, Artificial Sequence
  Description of Artificial Sequence: Synthetic oligonucleotide
tgttccgctactacaaccagagcgaggc

SEQ ID NO: 31028 - DNA, 27 bp, Artificial Sequence
  Description of Artificial Sequence: Synthetic oligonucleotide
gttccgctactacaaccagagcgaggc

SEQ ID NO: 31029 - DNA, 27 bp, Artificial Sequence
  Description of Artificial Sequence: Synthetic oligonucleotide
ttccgctactacaaccagagcgaggcc

SEQ ID NO: 31030 - DNA, 23 bp, Artificial Sequence
  Description of Artificial Sequence: Synthetic oligonucleotide
ctggagggcgagtgcgtggagtc

SEQ ID NO: 31031 - DNA, 23 bp, Artificial Sequence
  Description of Artificial Sequence: Synthetic oligonucleotide
tggagggcgagtgcgtggagtcg

SEQ ID NO: 31032 - DNA, 22 bp, Artificial Sequence
  Description of Artificial Sequence: Synthetic oligonucleotide
ggagggcgagtgcgtggagtcg

SEQ ID NO: 31033 - DNA, 23 bp, Artificial Sequence
  Description of Artificial Sequence: Synthetic oligonucleotide
gagggcgagtgcgtggagtcgct

SEQ ID NO: 31034 - DNA, 23 bp, Artificial Sequence
  Description of Artificial Sequence: Synthetic oligonucleotide
agggcgagtgcgtggagtcgctc

SEQ ID NO: 31035 - DNA, 22 bp, Artificial Sequence
  Description of Artificial Sequence: Synthetic oligonucleotide
gggcgagtgcgtggagtcgctc

SEQ ID NO: 31036 - DNA, 22 bp, Artificial Sequence
  Description of Artificial Sequence: Synthetic oligonucleotide
ggcgagtgcgtggagtcgctcc

SEQ ID NO: 31037 - DNA, 22 bp, Artificial Sequence
  Description of Artificial Sequence: Synthetic oligonucleotide
gcgagtgcgtggagtcgctccg

SEQ ID NO: 31038 - DNA, 23 bp, Artificial Sequence
  Description of Artificial Sequence: Synthetic oligonucleotide
cgagtgcgtggagtcgctccgca

SEQ ID NO: 31039 - DNA, 26 bp, Artificial Sequence
  Description of Artificial Sequence: Synthetic oligonucleotide
gagtgcgtggagtcgctccgcagata

SEQ ID NO: 31040 - DNA, 26 bp, Artificial Sequence
  Description of Artificial Sequence: Synthetic oligonucleotide
agtgcgtggagtcgctccgcagatac

SEQ ID NO: 31041 - DNA, 23 bp, Artificial Sequence
  Description of Artificial Sequence: Synthetic oligonucleotide
gccgcgagtccgagagaggagca

SEQ ID NO: 31042 - DNA, 23 bp, Artificial Sequence
  Description of Artificial Sequence: Synthetic oligonucleotide
ccgcgagtccgagagaggagcag

SEQ ID NO: 31043 - DNA, 23 bp, Artificial Sequence
  Description of Artificial Sequence: Synthetic oligonucleotide
cgcgagtccgagagaggagcagc

SEQ ID NO: 31044 - DNA, 23 bp, Artificial Sequence
  Description of Artificial Sequence: Synthetic oligonucleotide
gcgagtccgagagaggagcagcg

SEQ ID NO: 31045 - DNA, 23 bp, Artificial Sequence
  Description of Artificial Sequence: Synthetic oligonucleotide
cgagtccgagagaggagcagcgg

SEQ ID NO: 31046 - DNA, 23 bp, Artificial Sequence
  Description of Artificial Sequence: Synthetic oligonucleotide
gagtccgagagaggagcagcggg

SEQ ID NO: 31047 - DNA, 23 bp, Artificial Sequence
  Description of Artificial Sequence: Synthetic oligonucleotide
agtccgagagaggagcagcgggc

SEQ ID NO: 31048 - DNA, 22 bp, Artificial Sequence
  Description of Artificial Sequence: Synthetic oligonucleotide
gtccgagagaggagcagcgggc

SEQ ID NO: 31049 - DNA, 22 bp, Artificial Sequence
  Description of Artificial Sequence: Synthetic oligonucleotide
tccgagagaggagcagcgggcg

SEQ ID NO: 31050 - DNA, 21 bp, Artificial Sequence
  Description of Artificial Sequence: Synthetic oligonucleotide
ccgagagaggagcagcgggcg

SEQ ID NO: 31051 - DNA, 21 bp, Artificial Sequence
  Description of Artificial Sequence: Synthetic oligonucleotide
cgagagaggagcagcgggcgc

SEQ ID NO: 31052 - DNA, 21 bp, Artificial Sequence
  Description of Artificial Sequence: Synthetic oligonucleotide
gagagaggagcagcgggcgcc

SEQ ID NO: 31053 - DNA, 22 bp, Artificial Sequence
  Description of Artificial Sequence: Synthetic oligonucleotide
agagaggagcagcgggcgccgt

SEQ ID NO: 31054 - DNA, 21 bp, Artificial Sequence
  Description of Artificial Sequence: Synthetic oligonucleotide
gagaggagcagcgggcgccgt

SEQ ID NO: 31055 - DNA, 21 bp, Artificial Sequence
  Description of Artificial Sequence: Synthetic oligonucleotide
agaggagcagcgggcgccgtg

SEQ ID NO: 31056 - DNA, 20 bp, Artificial Sequence
  Description of Artificial Sequence: Synthetic oligonucleotide
gaggagcagcgggcgccgtg

SEQ ID NO: 31057 - DNA, 23 bp, Artificial Sequence
  Description of Artificial Sequence: Synthetic oligonucleotide
aggagcagcgggcgccgtggata

SEQ ID NO: 31058 - DNA, 22 bp, Artificial Sequence
  Description of Artificial Sequence: Synthetic oligonucleotide
ggagcagcgggcgccgtggata

SEQ ID NO: 31059 - DNA, 23 bp, Artificial Sequence
  Description of Artificial Sequence: Synthetic oligonucleotide
gagcagcgggcgccgtggataga

SEQ ID NO: 31060 - DNA, 23 bp, Artificial Sequence
  Description of Artificial Sequence: Synthetic oligonucleotide
agcagcgggcgccgtggatagag

SEQ ID NO: 31061 - DNA, 22 bp, Artificial Sequence
  Description of Artificial Sequence: Synthetic oligonucleotide
gcagcgggcgccgtggatagag

SEQ ID NO: 31062 - DNA, 23 bp, Artificial Sequence
  Description of Artificial Sequence: Synthetic oligonucleotide
cagcgggcgccgtggatagagca

SEQ ID NO: 31063 - DNA, 23 bp, Artificial Sequence
  Description of Artificial Sequence: Synthetic oligonucleotide
agcgggcgccgtggatagagcag

SEQ ID NO: 31064 - DNA, 27 bp, Artificial Sequence
  Description of Artificial Sequence: Synthetic oligonucleotide
acagactgaccgagaggacctgcggat

SEQ ID NO: 31065 - DNA, 26 bp, Artificial Sequence
  Description of Artificial Sequence: Synthetic oligonucleotide
cagactgaccgagaggacctgcggat

SEQ ID NO: 31066 - DNA, 26 bp, Artificial Sequence
  Description of Artificial Sequence: Synthetic oligonucleotide
agactgaccgagaggacctgcggatc

SEQ ID NO: 31067 - DNA, 25 bp, Artificial Sequence
  Description of Artificial Sequence: Synthetic oligonucleotide
gactgaccgagaggacctgcggatc

SEQ ID NO: 31068 - DNA, 25 bp, Artificial Sequence
  Description of Artificial Sequence: Synthetic oligonucleotide
actgaccgagaggacctgcggatcg

SEQ ID NO: 31069 - DNA, 24 bp, Artificial Sequence
  Description of Artificial Sequence: Synthetic oligonucleotide
ctgaccgagaggacctgcggatcg

SEQ ID NO: 31070 - DNA, 24 bp, Artificial Sequence
  Description of Artificial Sequence: Synthetic oligonucleotide
tgaccgagaggacctgcggatcgc

SEQ ID NO: 31071 - DNA, 23 bp, Artificial Sequence
  Description of Artificial Sequence: Synthetic oligonucleotide
gaccgagaggacctgcggatcgc

SEQ ID NO: 31072 - DNA, 23 bp, Artificial Sequence
  Description of Artificial Sequence: Synthetic oligonucleotide
accgagaggacctgcggatcgcg

SEQ ID NO: 31073 - DNA, 22 bp, Artificial Sequence
  Description of Artificial Sequence: Synthetic oligonucleotide
ccgagaggacctgcggatcgcg

SEQ ID NO: 31074 - DNA, 23 bp, Artificial Sequence
  Description of Artificial Sequence: Synthetic oligonucleotide
cgagaggacctgcggatcgcgct

SEQ ID NO: 31075 - DNA, 23 bp, Artificial Sequence
  Description of Artificial Sequence: Synthetic oligonucleotide
gagaggacctgcggatcgcgctc

SEQ ID NO: 31076 - DNA, 23 bp, Artificial Sequence
  Description of Artificial Sequence: Synthetic oligonucleotide
agaggacctgcggatcgcgctcc

SEQ ID NO: 31077 - DNA, 22 bp, Artificial Sequence
  Description of Artificial Sequence: Synthetic oligonucleotide
gaggacctgcggatcgcgctcc

SEQ ID NO: 31078 - DNA, 22 bp, Artificial Sequence
  Description of Artificial Sequence: Synthetic oligonucleotide
aggacctgcggatcgcgctccg

SEQ ID NO: 31079 - DNA, 21 bp, Artificial Sequence
  Description of Artificial Sequence: Synthetic oligonucleotide
ggacctgcggatcgcgctccg

SEQ ID NO: 31080 - DNA, 23 bp, Artificial Sequence
  Description of Artificial Sequence: Synthetic oligonucleotide
gacctgcggatcgcgctccgcta

SEQ ID NO: 31081 - DNA, 20 bp, Artificial Sequence
  Description of Artificial Sequence: Synthetic oligonucleotide
tggggccggaccggcgcctt

SEQ ID NO: 31082 - DNA, 20 bp, Artificial Sequence
  Description of Artificial Sequence: Synthetic oligonucleotide
ggggccggaccggcgccttt

SEQ ID NO: 31083 - DNA, 20 bp, Artificial Sequence
  Description of Artificial Sequence: Synthetic oligonucleotide
gggccggaccggcgcctctt

SEQ ID NO: 31084 - DNA, 20 bp, Artificial Sequence
  Description of Artificial Sequence: Synthetic oligonucleotide
ggccggaccggcgcctcctt

SEQ ID NO: 31085 - DNA, 20 bp, Artificial Sequence
  Description of Artificial Sequence: Synthetic oligonucleotide
gccggaccggcgcctcctct

SEQ ID NO: 31086 - DNA, 20 bp, Artificial Sequence
  Description of Artificial Sequence: Synthetic oligonucleotide
ccggaccggcgcctcctcct

SEQ ID NO: 31087 - DNA, 20 bp, Artificial Sequence
  Description of Artificial Sequence: Synthetic oligonucleotide
cggaccggcgcctcctccgt

SEQ ID NO: 31088 - DNA, 20 bp, Artificial Sequence
  Description of Artificial Sequence: Synthetic oligonucleotide
ggaccggcgcctcctccgct

SEQ ID NO: 31089 - DNA, 20 bp, Artificial Sequence
  Description of Artificial Sequence: Synthetic oligonucleotide
gaccggcgcctcctccgcgt

SEQ ID NO: 31090 - DNA, 20 bp, Artificial Sequence
  Description of Artificial Sequence: Synthetic oligonucleotide
accggcgcctcctccgcggt

SEQ ID NO: 31091 - DNA, 20 bp, Artificial Sequence
  Description of Artificial Sequence: Synthetic oligonucleotide
ccggcgcctcctccgcggtt

SEQ ID NO: 31092 - DNA, 20 bp, Artificial Sequence
  Description of Artificial Sequence: Synthetic oligonucleotide
cggcgcctcctccgcgggta

SEQ ID NO: 31093 - DNA, 21 bp, Artificial Sequence
  Description of Artificial Sequence: Synthetic oligonucleotide
tgagctcctggaccgccgcgg

SEQ ID NO: 31094 - DNA, 20 bp, Artificial Sequence
  Description of Artificial Sequence: Synthetic oligonucleotide
gagctcctggaccgccgcgg

SEQ ID NO: 31095 - DNA, 20 bp, Artificial Sequence
  Description of Artificial Sequence: Synthetic oligonucleotide
agctcctggaccgccgcggg

SEQ ID NO: 31096 - DNA, 20 bp, Artificial Sequence
  Description of Artificial Sequence: Synthetic oligonucleotide
gctcctggaccgccgcgggt

SEQ ID NO: 31097 - DNA, 20 bp, Artificial Sequence
  Description of Artificial Sequence: Synthetic oligonucleotide
ctcctggaccgccgcgggca

SEQ ID NO: 31098 - DNA, 20 bp, Artificial Sequence
  Description of Artificial Sequence: Synthetic oligonucleotide
tcctggaccgccgcgggcac

SEQ ID NO: 31099 - DNA, 20 bp, Artificial Sequence
  Description of Artificial Sequence: Synthetic oligonucleotide
cctggaccgccgcgggcact

SEQ ID NO: 31100 - DNA, 20 bp, Artificial Sequence
  Description of Artificial Sequence: Synthetic oligonucleotide
ctggaccgccgcgggcacgt

SEQ ID NO: 31101 - DNA, 20 bp, Artificial Sequence
  Description of Artificial Sequence: Synthetic oligonucleotide
tggaccgccgcgggcacggt

SEQ ID NO: 31102 - DNA, 20 bp, Artificial Sequence
  Description of Artificial Sequence: Synthetic oligonucleotide
ggaccgccgcgggcacggtt

SEQ ID NO: 31103 - DNA, 20 bp, Artificial Sequence
  Description of Artificial Sequence: Synthetic oligonucleotide
gaccgccgcgggcacggctt

SEQ ID NO: 31104 - DNA, 20 bp, Artificial Sequence
  Description of Artificial Sequence: Synthetic oligonucleotide
accgccgcgggcacggcgtt

SEQ ID NO: 31105 - DNA, 20 bp, Artificial Sequence
  Description of Artificial Sequence: Synthetic oligonucleotide
ccgccgcgggcacggcgttt

SEQ ID NO: 31106 - DNA, 20 bp, Artificial Sequence
  Description of Artificial Sequence: Synthetic oligonucleotide
cgccgcgggcacggcggttt

SEQ ID NO: 31107 - DNA, 20 bp, Artificial Sequence
  Description of Artificial Sequence: Synthetic oligonucleotide
gccgcgggcacggcggcttt

SEQ ID NO: 31108 - DNA, 20 bp, Artificial Sequence
  Description of Artificial Sequence: Synthetic oligonucleotide
ccgcgggcacggcggctcat

SEQ ID NO: 31109 - DNA, 21 bp, Artificial Sequence
  Description of Artificial Sequence: Synthetic oligonucleotide
cgcgggcacggcggctcagat

SEQ ID NO: 31110 - DNA, 22 bp, Artificial Sequence
  Description of Artificial Sequence: Synthetic oligonucleotide
gcgggcacggcggctcagatca

SEQ ID NO: 31111 - DNA, 22 bp, Artificial Sequence
  Description of Artificial Sequence: Synthetic oligonucleotide
cgggcacggcggctcagatcac

SEQ ID NO: 31112 - DNA, 22 bp, Artificial Sequence
  Description of Artificial Sequence: Synthetic oligonucleotide
gggcacggcggctcagatcacc

SEQ ID NO: 31113 - DNA, 23 bp, Artificial Sequence
  Description of Artificial Sequence: Synthetic oligonucleotide
ggcacggcggctcagatcaccca

SEQ ID NO: 31114 - DNA, 23 bp, Artificial Sequence
  Description of Artificial Sequence: Synthetic oligonucleotide
gcacggcggctcagatcacccag

SEQ ID NO: 31115 - DNA, 26 bp, Artificial Sequence
  Description of Artificial Sequence: Synthetic oligonucleotide
agaacgggaaggagacgctgcagtgc

SEQ ID NO: 31116 - DNA, 25 bp, Artificial Sequence
  Description of Artificial Sequence: Synthetic oligonucleotide
gaacgggaaggagacgctgcagtgc

SEQ ID NO: 31117 - DNA, 25 bp, Artificial Sequence
  Description of Artificial Sequence: Synthetic oligonucleotide
aacgggaaggagacgctgcagtgcg

SEQ ID NO: 31118 - DNA, 24 bp, Artificial Sequence
  Description of Artificial Sequence: Synthetic oligonucleotide
acgggaaggagacgctgcagtgcg

SEQ ID NO: 31119 - DNA, 23 bp, Artificial Sequence
  Description of Artificial Sequence: Synthetic oligonucleotide
cgggaaggagacgctgcagtgcg

SEQ ID NO: 31120 - DNA, 23 bp, Artificial Sequence
  Description of Artificial Sequence: Synthetic oligonucleotide
gggaaggagacgctgcagtgcgc

SEQ ID NO: 31121 - DNA, 23 bp, Artificial Sequence
  Description of Artificial Sequence: Synthetic oligonucleotide
ggaaggagacgctgcagtgcgcg

SEQ ID NO: 31122 - DNA, 23 bp, Artificial Sequence
  Description of Artificial Sequence: Synthetic oligonucleotide
gaaggagacgctgcagtgcgcgg

SEQ ID NO: 31123 - DNA, 30 bp, Artificial Sequence
  Description of Artificial Sequence: Synthetic oligonucleotide
gagacacagatctgcaaggccaaggcatag

SEQ ID NO: 31124 - DNA, 31 bp, Artificial Sequence
  Description of Artificial Sequence: Synthetic oligonucleotide
agacacagatctgcaaggccaaggcatagac

SEQ ID NO: 31125 - DNA, 30 bp, Artificial Sequence
  Description of Artificial Sequence: Synthetic oligonucleotide
gacacagatctgcaaggccaaggcatagac

SEQ ID NO: 31126 - DNA, 31 bp, Artificial Sequence
  Description of Artificial Sequence: Synthetic oligonucleotide
acacagatctgcaaggccaaggcatagactg

SEQ ID NO: 31127 - DNA, 30 bp, Artificial Sequence
  Description of Artificial Sequence: Synthetic oligonucleotide
cacagatctgcaaggccaaggcatagactg

SEQ ID NO: 31128 - DNA, 31 bp, Artificial Sequence
  Description of Artificial Sequence: Synthetic oligonucleotide
acagatctgcaaggccaaggcatagactgac

SEQ ID NO: 31129 - DNA, 30 bp, Artificial Sequence
  Description of Artificial Sequence: Synthetic oligonucleotide
cagatctgcaaggccaaggcatagactgac

SEQ ID NO: 31130 - DNA, 30 bp, Artificial Sequence
  Description of Artificial Sequence: Synthetic oligonucleotide
agatctgcaaggccaaggcatagactgacc

SEQ ID NO: 31131 - DNA, 29 bp, Artificial Sequence
  Description of Artificial Sequence: Synthetic oligonucleotide
gatctgcaaggccaaggcatagactgacc

SEQ ID NO: 31132 - DNA, 29 bp, Artificial Sequence
  Description of Artificial Sequence: Synthetic oligonucleotide
atctgcaaggccaaggcatagactgaccg

SEQ ID NO: 31133 - DNA, 28 bp, Artificial Sequence
  Description of Artificial Sequence: Synthetic oligonucleotide
tctgcaaggccaaggcatagactgaccg

SEQ ID NO: 31134 - DNA, 27 bp, Artificial Sequence
  Description of Artificial Sequence: Synthetic oligonucleotide
ctgcaaggccaaggcatagactgaccg

SEQ ID NO: 31135 - DNA, 28 bp, Artificial Sequence
  Description of Artificial Sequence: Synthetic oligonucleotide
tgcaaggccaaggcatagactgaccgag

SEQ ID NO: 31136 - DNA, 27 bp, Artificial Sequence
  Description of Artificial Sequence: Synthetic oligonucleotide
gcaaggccaaggcatagactgaccgag

SEQ ID NO: 31137 - DNA, 28 bp, Artificial Sequence
  Description of Artificial Sequence: Synthetic oligonucleotide
caaggccaaggcatagactgaccgagag

SEQ ID NO: 31138 - DNA, 28 bp, Artificial Sequence
  Description of Artificial Sequence: Synthetic oligonucleotide
aaggccaaggcatagactgaccgagagg

SEQ ID NO: 31139 - DNA, 27 bp, Artificial Sequence
  Description of Artificial Sequence: Synthetic oligonucleotide
aggccaaggcatagactgaccgagagg

SEQ ID NO: 31140 - DNA, 27 bp, Artificial Sequence
  Description of Artificial Sequence: Synthetic oligonucleotide
ggccaaggcatagactgaccgagagga

SEQ ID NO: 31141 - DNA, 27 bp, Artificial Sequence
  Description of Artificial Sequence: Synthetic oligonucleotide
gccaaggcatagactgaccgagaggac

SEQ ID NO: 31142 - DNA, 27 bp, Artificial Sequence
  Description of Artificial Sequence: Synthetic oligonucleotide
ccaaggcatagactgaccgagaggacc

SEQ ID NO: 31143 - DNA, 28 bp, Artificial Sequence
  Description of Artificial Sequence: Synthetic oligonucleotide
caaggcatagactgaccgagaggacctg

SEQ ID NO: 31144 - DNA, 28 bp, Artificial Sequence
  Description of Artificial Sequence: Synthetic oligonucleotide
aaggcatagactgaccgagaggacctgc

SEQ ID NO: 31145 - DNA, 27 bp, Artificial Sequence
  Description of Artificial Sequence: Synthetic oligonucleotide
aggcatagactgaccgagaggacctgc

SEQ ID NO: 31146 - DNA, 26 bp, Artificial Sequence
  Description of Artificial Sequence: Synthetic oligonucleotide
ggcatagactgaccgagaggacctgc

SEQ ID NO: 31147 - DNA, 26 bp, Artificial Sequence
  Description of Artificial Sequence: Synthetic oligonucleotide
gcatagactgaccgagaggacctgcg

SEQ ID NO: 31148 - DNA, 27 bp, Artificial Sequence
  Description of Artificial Sequence: Synthetic oligonucleotide
catagactgaccgagaggacctgcgga

SEQ ID NO: 31149 - DNA, 27 bp, Artificial Sequence
  Description of Artificial Sequence: Synthetic oligonucleotide
atagactgaccgagaggacctgcggac

SEQ ID NO: 31150 - DNA, 26 bp, Artificial Sequence
  Description of Artificial Sequence: Synthetic oligonucleotide
tagactgaccgagaggacctgcggac

SEQ ID NO: 31151 - DNA, 24 bp, Artificial Sequence
  Description of Artificial Sequence: Synthetic oligonucleotide
acacggcggctcagatcacccagg

SEQ ID NO: 31152 - DNA, 23 bp, Artificial Sequence
  Description of Artificial Sequence: Synthetic oligonucleotide
cacggcggctcagatcacccagg

SEQ ID NO: 31153 - DNA, 23 bp, Artificial Sequence
  Description of Artificial Sequence: Synthetic oligonucleotide
acggcggctcagatcacccaggg

SEQ ID NO: 31154 - DNA, 22 bp, Artificial Sequence
  Description of Artificial Sequence: Synthetic oligonucleotide
cggcggctcagatcacccaggg

SEQ ID NO: 31155 - DNA, 24 bp, Artificial Sequence
  Description of Artificial Sequence: Synthetic oligonucleotide
ggcggctcagatcacccagggcaa

SEQ ID NO: 31156 - DNA, 25 bp, Artificial Sequence
  Description of Artificial Sequence: Synthetic oligonucleotide
gcggctcagatcacccagggcaagt

SEQ ID NO: 31157 - DNA, 25 bp, Artificial Sequence
  Description of Artificial Sequence: Synthetic oligonucleotide
cggctcagatcacccagggcaagtg

SEQ ID NO: 31158 - DNA, 25 bp, Artificial Sequence
  Description of Artificial Sequence: Synthetic oligonucleotide
ggctcagatcacccagggcaagtgg

SEQ ID NO: 31159 - DNA, 26 bp, Artificial Sequence
  Description of Artificial Sequence: Synthetic oligonucleotide
gctcagatcacccagggcaagtggga

SEQ ID NO: 31160 - DNA, 26 bp, Artificial Sequence
  Description of Artificial Sequence: Synthetic oligonucleotide
ctcagatcacccagggcaagtgggag

SEQ ID NO: 31161 - DNA, 26 bp, Artificial Sequence
  Description of Artificial Sequence: Synthetic oligonucleotide
tcagatcacccagggcaagtgggagg

SEQ ID NO: 31162 - DNA, 25 bp, Artificial Sequence
  Description of Artificial Sequence: Synthetic oligonucleotide
cagatcacccagggcaagtgggagg

SEQ ID NO: 31163 - DNA, 25 bp, Artificial Sequence
  Description of Artificial Sequence: Synthetic oligonucleotide
agatcacccagggcaagtgggaggc

SEQ ID NO: 31164 - DNA, 24 bp, Artificial Sequence
  Description of Artificial Sequence: Synthetic oligonucleotide
gatcacccagggcaagtgggaggc

SEQ ID NO: 31165 - DNA, 24 bp, Artificial Sequence
  Description of Artificial Sequence: Synthetic oligonucleotide
atcacccagggcaagtgggaggcg

SEQ ID NO: 31166 - DNA, 23 bp, Artificial Sequence
  Description of Artificial Sequence: Synthetic oligonucleotide
tcacccagggcaagtgggaggcg

SEQ ID NO: 31167 - DNA, 22 bp, Artificial Sequence
  Description of Artificial Sequence: Synthetic oligonucleotide
cacccagggcaagtgggaggcg

SEQ ID NO: 31168 - DNA, 22 bp, Artificial Sequence
  Description of Artificial Sequence: Synthetic oligonucleotide
acccagggcaagtgggaggcgg

SEQ ID NO: 31169 - DNA, 21 bp, Artificial Sequence
  Description of Artificial Sequence: Synthetic oligonucleotide
cccagggcaagtgggaggcgg

SEQ ID NO: 31170 - DNA, 21 bp, Artificial Sequence
  Description of Artificial Sequence: Synthetic oligonucleotide
ccagggcaagtgggaggcggc

SEQ ID NO: 31171 - DNA, 21 bp, Artificial Sequence
  Description of Artificial Sequence: Synthetic oligonucleotide
cagggcaagtgggaggcggcc

SEQ ID NO: 31172 - DNA, 21 bp, Artificial Sequence
  Description of Artificial Sequence: Synthetic oligonucleotide
agggcaagtgggaggcggccc

SEQ ID NO: 31173 - DNA, 20 bp, Artificial Sequence
  Description of Artificial Sequence: Synthetic oligonucleotide
gggcaagtgggaggcggccc

SEQ ID NO: 31174 - DNA, 21 bp, Artificial Sequence
  Description of Artificial Sequence: Synthetic oligonucleotide
ggcaagtgggaggcggcccgt

SEQ ID NO: 31175 - DNA, 32 bp, Artificial Sequence
  Description of Artificial Sequence: Synthetic oligonucleotide
aaggattacatcgccctgaactaggacctgag

SEQ ID NO: 31176 - DNA, 31 bp, Artificial Sequence
  Description of Artificial Sequence: Synthetic oligonucleotide
aggattacatcgccctgaactaggacctgag

SEQ ID NO: 31177 - DNA, 30 bp, Artificial Sequence
  Description of Artificial Sequence: Synthetic oligonucleotide
ggattacatcgccctgaactaggacctgag

SEQ ID NO: 31178 - DNA, 30 bp, Artificial Sequence
  Description of Artificial Sequence: Synthetic oligonucleotide
gattacatcgccctgaactaggacctgagc

SEQ ID NO: 31179 - DNA, 31 bp, Artificial Sequence
  Description of Artificial Sequence: Synthetic oligonucleotide
attacatcgccctgaactaggacctgagctc

SEQ ID NO: 31180 - DNA, 30 bp, Artificial Sequence
  Description of Artificial Sequence: Synthetic oligonucleotide
ttacatcgccctgaactaggacctgagctc

SEQ ID NO: 31181 - DNA, 29 bp, Artificial Sequence
  Description of Artificial Sequence: Synthetic oligonucleotide
tacatcgccctgaactaggacctgagctc

SEQ ID NO: 31182 - DNA, 28 bp, Artificial Sequence
  Description of Artificial Sequence: Synthetic oligonucleotide
acatcgccctgaactaggacctgagctc

SEQ ID NO: 31183 - DNA, 27 bp, Artificial Sequence
  Description of Artificial Sequence: Synthetic oligonucleotide
catcgccctgaactaggacctgagctc

SEQ ID NO: 31184 - DNA, 27 bp, Artificial Sequence
  Description of Artificial Sequence: Synthetic oligonucleotide
atcgccctgaactaggacctgagctcc

SEQ ID NO: 31185 - DNA, 27 bp, Artificial Sequence
  Description of Artificial Sequence: Synthetic oligonucleotide
tcgccctgaactaggacctgagctcct

SEQ ID NO: 31186 - DNA, 26 bp, Artificial Sequence
  Description of Artificial Sequence: Synthetic oligonucleotide
cgccctgaactaggacctgagctcct

SEQ ID NO: 31187 - DNA, 26 bp, Artificial Sequence
  Description of Artificial Sequence: Synthetic oligonucleotide
gccctgaactaggacctgagctcctg

SEQ ID NO: 31188 - DNA, 27 bp, Artificial Sequence
  Description of Artificial Sequence: Synthetic oligonucleotide
ccctgaactaggacctgagctcctgga

SEQ ID NO: 31189 - DNA, 27 bp, Artificial Sequence
  Description of Artificial Sequence: Synthetic oligonucleotide
cctgaactaggacctgagctcctggac

SEQ ID NO: 31190 - DNA, 27 bp, Artificial Sequence
  Description of Artificial Sequence: Synthetic oligonucleotide
ctgaactaggacctgagctcctggacc

SEQ ID NO: 31191 - DNA, 27 bp, Artificial Sequence
  Description of Artificial Sequence: Synthetic oligonucleotide
tgaactaggacctgagctcctggaccg

SEQ ID NO: 31192 - DNA, 26 bp, Artificial Sequence
  Description of Artificial Sequence: Synthetic oligonucleotide
gaactaggacctgagctcctggaccg

SEQ ID NO: 31193 - DNA, 26 bp, Artificial Sequence
  Description of Artificial Sequence: Synthetic oligonucleotide
aactaggacctgagctcctggaccgc

SEQ ID NO: 31194 - DNA, 25 bp, Artificial Sequence
  Description of Artificial Sequence: Synthetic oligonucleotide
actaggacctgagctcctggaccgc

SEQ ID NO: 31195 - DNA, 24 bp, Artificial Sequence
  Description of Artificial Sequence: Synthetic oligonucleotide
ctaggacctgagctcctggaccgc

SEQ ID NO: 31196 - DNA, 24 bp, Artificial Sequence
  Description of Artificial Sequence: Synthetic oligonucleotide
taggacctgagctcctggaccgcc

SEQ ID NO: 31197 - DNA, 23 bp, Artificial Sequence
  Description of Artificial Sequence: Synthetic oligonucleotide
ccgcgggcgccgtggatagagta

SEQ ID NO: 31198 - DNA, 23 bp, Artificial Sequence
  Description of Artificial Sequence: Synthetic oligonucleotide
cgcgggcgccgtggatagagtag

SEQ ID NO: 31199 - DNA, 24 bp, Artificial Sequence
  Description of Artificial Sequence: Synthetic oligonucleotide
gcgggcgccgtggatagagtagga

SEQ ID NO: 31200 - DNA, 24 bp, Artificial Sequence
  Description of Artificial Sequence: Synthetic oligonucleotide
cgggcgccgtggatagagtaggag

SEQ ID NO: 31201 - DNA, 24 bp, Artificial Sequence
  Description of Artificial Sequence: Synthetic oligonucleotide
gggcgccgtggatagagtaggagg

SEQ ID NO: 31202 - DNA, 24 bp, Artificial Sequence
  Description of Artificial Sequence: Synthetic oligonucleotide
ggcgccgtggatagagtaggaggg

SEQ ID NO: 31203 - DNA, 24 bp, Artificial Sequence
  Description of Artificial Sequence: Synthetic oligonucleotide
gcgccgtggatagagtaggagggg

SEQ ID NO: 31204 - DNA, 24 bp, Artificial Sequence
  Description of Artificial Sequence: Synthetic oligonucleotide
cgccgtggatagagtaggaggggc

SEQ ID NO: 31205 - DNA, 24 bp, Artificial Sequence
  Description of Artificial Sequence: Synthetic oligonucleotide
gccgtggatagagtaggaggggcc

SEQ ID NO: 31206 - DNA, 24 bp, Artificial Sequence
  Description of Artificial Sequence: Synthetic oligonucleotide
ccgtggatagagtaggaggggccg

SEQ ID NO: 31207 - DNA, 25 bp, Artificial Sequence
  Description of Artificial Sequence: Synthetic oligonucleotide
cgtggatagagtaggaggggccgga

SEQ ID NO: 31208 - DNA, 27 bp, Artificial Sequence
  Description of Artificial Sequence: Synthetic oligonucleotide
gtggatagagtaggaggggccggagta

SEQ ID NO: 31209 - DNA, 29 bp, Artificial Sequence
  Description of Artificial Sequence: Synthetic oligonucleotide
tggatagagtaggaggggccggagtattg

SEQ ID NO: 31210 - DNA, 28 bp, Artificial Sequence
  Description of Artificial Sequence: Synthetic oligonucleotide
ggatagagtaggaggggccggagtattg

SEQ ID NO: 31211 - DNA, 28 bp, Artificial Sequence
  Description of Artificial Sequence: Synthetic oligonucleotide
gatagagtaggaggggccggagtattgg

SEQ ID NO: 31212 - DNA, 28 bp, Artificial Sequence
  Description of Artificial Sequence: Synthetic oligonucleotide
atagagtaggaggggccggagtattggg

SEQ ID NO: 31213 - DNA, 27 bp, Artificial Sequence
  Description of Artificial Sequence: Synthetic oligonucleotide
tagagtaggaggggccggagtattggg

SEQ ID NO: 31214 - DNA, 27 bp, Artificial Sequence
  Description of Artificial Sequence: Synthetic oligonucleotide
agagtaggaggggccggagtattggga

SEQ ID NO: 31215 - DNA, 26 bp, Artificial Sequence
  Description of Artificial Sequence: Synthetic oligonucleotide
gagtaggaggggccggagtattggga

SEQ ID NO: 31216 - DNA, 26 bp, Artificial Sequence
  Description of Artificial Sequence: Synthetic oligonucleotide
agtaggaggggccggagtattgggac

SEQ ID NO: 31217 - DNA, 25 bp, Artificial Sequence
  Description of Artificial Sequence: Synthetic oligonucleotide
gtaggaggggccggagtattgggac

SEQ ID NO: 31218 - DNA, 25 bp, Artificial Sequence
  Description of Artificial Sequence: Synthetic oligonucleotide
taggaggggccggagtattgggacc

SEQ ID NO: 31219 - DNA, 24 bp, Artificial Sequence
  Description of Artificial Sequence: Synthetic oligonucleotide
gtgaggcggagcagctgagagcca

SEQ ID NO: 31220 - DNA, 24 bp, Artificial Sequence
  Description of Artificial Sequence: Synthetic oligonucleotide
tgaggcggagcagctgagagccac

SEQ ID NO: 31221 - DNA, 23 bp, Artificial Sequence
  Description of Artificial Sequence: Synthetic oligonucleotide
gaggcggagcagctgagagccac

SEQ ID NO: 31222 - DNA, 24 bp, Artificial Sequence
  Description of Artificial Sequence: Synthetic oligonucleotide
aggcggagcagctgagagccacct

SEQ ID NO: 31223 - DNA, 23 bp, Artificial Sequence
  Description of Artificial Sequence: Synthetic oligonucleotide
ggcggagcagctgagagccacct

SEQ ID NO: 31224 - DNA, 23 bp, Artificial Sequence
  Description of Artificial Sequence: Synthetic oligonucleotide
gcggagcagctgagagccacctg

SEQ ID NO: 31225 - DNA, 24 bp, Artificial Sequence
  Description of Artificial Sequence: Synthetic oligonucleotide
cggagcagctgagagccacctgga

SEQ ID NO: 31226 - DNA, 24 bp, Artificial Sequence
  Description of Artificial Sequence: Synthetic oligonucleotide
ggagcagctgagagccacctggag

SEQ ID NO: 31227 - DNA, 24 bp, Artificial Sequence
  Description of Artificial Sequence: Synthetic oligonucleotide
gagcagctgagagccacctggagg

SEQ ID NO: 31228 - DNA, 24 bp, Artificial Sequence
  Description of Artificial Sequence: Synthetic oligonucleotide
agcagctgagagccacctggaggg

SEQ ID NO: 31229 - DNA, 23 bp, Artificial Sequence
  Description of Artificial Sequence: Synthetic oligonucleotide
gcagctgagagccacctggaggg

SEQ ID NO: 31230 - DNA, 23 bp, Artificial Sequence
  Description of Artificial Sequence: Synthetic oligonucleotide
cagctgagagccacctggagggc

SEQ ID NO: 31231 - DNA, 24 bp, Artificial Sequence
  Description of Artificial Sequence: Synthetic oligonucleotide
agctgagagccacctggagggcga

SEQ ID NO: 31232 - DNA, 23 bp, Artificial Sequence
  Description of Artificial Sequence: Synthetic oligonucleotide
gctgagagccacctggagggcga

SEQ ID NO: 31233 - DNA, 24 bp, Artificial Sequence
  Description of Artificial Sequence: Synthetic oligonucleotide
ctgagagccacctggagggcgagt

SEQ ID NO: 31234 - DNA, 24 bp, Artificial Sequence
  Description of Artificial Sequence: Synthetic oligonucleotide
tgagagccacctggagggcgagtg

SEQ ID NO: 31235 - DNA, 23 bp, Artificial Sequence
  Description of Artificial Sequence: Synthetic oligonucleotide
gagagccacctggagggcgagtg

SEQ ID NO: 31236 - DNA, 23 bp, Artificial Sequence
  Description of Artificial Sequence: Synthetic oligonucleotide
agagccacctggagggcgagtgc

SEQ ID NO: 31237 - DNA, 22 bp, Artificial Sequence
  Description of Artificial Sequence: Synthetic oligonucleotide
gagccacctggagggcgagtgc

SEQ ID NO: 31238 - DNA, 23 bp, Artificial Sequence
  Description of Artificial Sequence: Synthetic oligonucleotide
agccacctggagggcgagtgcgt

SEQ ID NO: 31239 - DNA, 22 bp, Artificial Sequence
  Description of Artificial Sequence: Synthetic oligonucleotide
gccacctggagggcgagtgcgt

SEQ ID NO: 31240 - DNA, 22 bp, Artificial Sequence
  Description of Artificial Sequence: Synthetic oligonucleotide
ccacctggagggcgagtgcgtg

SEQ ID NO: 31241 - DNA, 23 bp, Artificial Sequence
  Description of Artificial Sequence: Synthetic oligonucleotide
cacctggagggcgagtgcgtgga

SEQ ID NO: 31242 - DNA, 28 bp, Artificial Sequence
  Description of Artificial Sequence: Synthetic oligonucleotide
atgccatgtacagcatgaggggctgctg

SEQ ID NO: 31243 - DNA, 27 bp, Artificial Sequence
  Description of Artificial Sequence: Synthetic oligonucleotide
tgccatgtacagcatgaggggctgctg

SEQ ID NO: 31244 - DNA, 27 bp, Artificial Sequence
  Description of Artificial Sequence: Synthetic oligonucleotide
gccatgtacagcatgaggggctgctga

SEQ ID NO: 31245 - DNA, 28 bp, Artificial Sequence
  Description of Artificial Sequence: Synthetic oligonucleotide
ccatgtacagcatgaggggctgctgaag

SEQ ID NO: 31246 - DNA, 28 bp, Artificial Sequence
  Description of Artificial Sequence: Synthetic oligonucleotide
catgtacagcatgaggggctgctgaagc

SEQ ID NO: 31247 - DNA, 28 bp, Artificial Sequence
  Description of Artificial Sequence: Synthetic oligonucleotide
atgtacagcatgaggggctgctgaagcc

SEQ ID NO: 31248 - DNA, 27 bp, Artificial Sequence
  Description of Artificial Sequence: Synthetic oligonucleotide
tgtacagcatgaggggctgctgaagcc

SEQ ID NO: 31249 - DNA, 26 bp, Artificial Sequence
  Description of Artificial Sequence: Synthetic oligonucleotide
gtacagcatgaggggctgctgaagcc

SEQ ID NO: 31250 - DNA, 26 bp, Artificial Sequence
  Description of Artificial Sequence: Synthetic oligonucleotide
tacagcatgaggggctgctgaagccc

SEQ ID NO: 31251 - DNA, 25 bp, Artificial Sequence
  Description of Artificial Sequence: Synthetic oligonucleotide
acagcatgaggggctgctgaagccc

SEQ ID NO: 31252 - DNA, 24 bp, Artificial Sequence
  Description of Artificial Sequence: Synthetic oligonucleotide
cagcatgaggggctgctgaagccc

SEQ ID NO: 31253 - DNA, 25 bp, Artificial Sequence
  Description of Artificial Sequence: Synthetic oligonucleotide
agcatgaggggctgctgaagcccct

SEQ ID NO: 31254 - DNA, 24 bp, Artificial Sequence
  Description of Artificial Sequence: Synthetic oligonucleotide
gcatgaggggctgctgaagcccct

SEQ ID NO: 31255 - DNA, 25 bp, Artificial Sequence
  Description of Artificial Sequence: Synthetic oligonucleotide
catgaggggctgctgaagcccctca

SEQ ID NO: 31256 - DNA, 25 bp, Artificial Sequence
  Description of Artificial Sequence: Synthetic oligonucleotide
atgaggggctgctgaagcccctcac

SEQ ID NO: 31257 - DNA, 24 bp, Artificial Sequence
  Description of Artificial Sequence: Synthetic oligonucleotide
tgaggggctgctgaagcccctcac

SEQ ID NO: 31258 - DNA, 23 bp, Artificial Sequence
  Description of Artificial Sequence: Synthetic oligonucleotide
gaggggctgctgaagcccctcac

SEQ ID NO: 31259 - DNA, 23 bp, Artificial Sequence
  Description of Artificial Sequence: Synthetic oligonucleotide
aggggctgctgaagcccctcacc

SEQ ID NO: 31260 - DNA, 22 bp, Artificial Sequence
  Description of Artificial Sequence: Synthetic oligonucleotide
ggggctgctgaagcccctcacc

SEQ ID NO: 31261 - DNA, 23 bp, Artificial Sequence
  Description of Artificial Sequence: Synthetic oligonucleotide
gggctgctgaagcccctcaccct

SEQ ID NO: 31262 - DNA, 24 bp, Artificial Sequence
  Description of Artificial Sequence: Synthetic oligonucleotide
ggctgctgaagcccctcaccctga

SEQ ID NO: 31263 - DNA, 26 bp, Artificial Sequence
  Description of Artificial Sequence: Synthetic oligonucleotide
gctgctgaagcccctcaccctgagat

SEQ ID NO: 31264 - DNA, 26 bp, Artificial Sequence
  Description of Artificial Sequence: Synthetic oligonucleotide
ctgctgaagcccctcaccctgagatg

SEQ ID NO: 31265 - DNA, 26 bp, Artificial Sequence
  Description of Artificial Sequence: Synthetic oligonucleotide
tgctgaagcccctcaccctgagatgg

SEQ ID NO: 31266 - DNA, 25 bp, Artificial Sequence
  Description of Artificial Sequence: Synthetic oligonucleotide
gctgaagcccctcaccctgagatgg

SEQ ID NO: 31267 - DNA, 26 bp, Artificial Sequence
  Description of Artificial Sequence: Synthetic oligonucleotide
ctgaagcccctcaccctgagatggga

SEQ ID NO: 31268 - DNA, 26 bp, Artificial Sequence
  Description of Artificial Sequence: Synthetic oligonucleotide
tgaagcccctcaccctgagatgggag

SEQ ID NO: 31269 - DNA, 26 bp, Artificial Sequence
  Description of Artificial Sequence: Synthetic oligonucleotide
cgtgtggcggagcagctgagagctta

SEQ ID NO: 31270 - DNA, 26 bp, Artificial Sequence
  Description of Artificial Sequence: Synthetic oligonucleotide
gtgtggcggagcagctgagagcttac

SEQ ID NO: 31271 - DNA, 27 bp, Artificial Sequence
  Description of Artificial Sequence: Synthetic oligonucleotide
tgtggcggagcagctgagagcttacct

SEQ ID NO: 31272 - DNA, 26 bp, Artificial Sequence
  Description of Artificial Sequence: Synthetic oligonucleotide
gtggcggagcagctgagagcttacct

SEQ ID NO: 31273 - DNA, 26 bp, Artificial Sequence
  Description of Artificial Sequence: Synthetic oligonucleotide
tggcggagcagctgagagcttacctg

SEQ ID NO: 31274 - DNA, 25 bp, Artificial Sequence
  Description of Artificial Sequence: Synthetic oligonucleotide
ggcggagcagctgagagcttacctg

SEQ ID NO: 31275 - DNA, 26 bp, Artificial Sequence
  Description of Artificial Sequence: Synthetic oligonucleotide
gcggagcagctgagagcttacctgga

SEQ ID NO: 31276 - DNA, 26 bp, Artificial Sequence
  Description of Artificial Sequence: Synthetic oligonucleotide
cggagcagctgagagcttacctggag

SEQ ID NO: 31277 - DNA, 26 bp, Artificial Sequence
  Description of Artificial Sequence: Synthetic oligonucleotide
ggagcagctgagagcttacctggagg

SEQ ID NO: 31278 - DNA, 26 bp, Artificial Sequence
  Description of Artificial Sequence: Synthetic oligonucleotide
gagcagctgagagcttacctggaggg

SEQ ID NO: 31279 - DNA, 26 bp, Artificial Sequence
  Description of Artificial Sequence: Synthetic oligonucleotide
agcagctgagagcttacctggagggc

SEQ ID NO: 31280 - DNA, 25 bp, Artificial Sequence
  Description of Artificial Sequence: Synthetic oligonucleotide
gcagctgagagcttacctggagggc

SEQ ID NO: 31281 - DNA, 26 bp, Artificial Sequence
  Description of Artificial Sequence: Synthetic oligonucleotide
cagctgagagcttacctggagggcct

SEQ ID NO: 31282 - DNA, 27 bp, Artificial Sequence
  Description of Artificial Sequence: Synthetic oligonucleotide
agctgagagcttacctggagggcctgt

SEQ ID NO: 31283 - DNA, 26 bp, Artificial Sequence
  Description of Artificial Sequence: Synthetic oligonucleotide
gctgagagcttacctggagggcctgt

SEQ ID NO: 31284 - DNA, 26 bp, Artificial Sequence
  Description of Artificial Sequence: Synthetic oligonucleotide
ctgagagcttacctggagggcctgtg

SEQ ID NO: 31285 - DNA, 26 bp, Artificial Sequence
  Description of Artificial Sequence: Synthetic oligonucleotide
tgagagcttacctggagggcctgtgc

SEQ ID NO: 31286 - DNA, 25 bp, Artificial Sequence
  Description of Artificial Sequence: Synthetic oligonucleotide
gagagcttacctggagggcctgtgc

SEQ ID NO: 31287 - DNA, 26 bp, Artificial Sequence
  Description of Artificial Sequence: Synthetic oligonucleotide
agagcttacctggagggcctgtgcgt

SEQ ID NO: 31288 - DNA, 25 bp, Artificial Sequence
  Description of Artificial Sequence: Synthetic oligonucleotide
gagcttacctggagggcctgtgcgt

SEQ ID NO: 31289 - DNA, 25 bp, Artificial Sequence
  Description of Artificial Sequence: Synthetic oligonucleotide
agcttacctggagggcctgtgcgtg

SEQ ID NO: 31290 - DNA, 24 bp, Artificial Sequence
  Description of Artificial Sequence: Synthetic oligonucleotide
gcttacctggagggcctgtgcgtg

SEQ ID NO: 31291 - DNA, 25 bp, Artificial Sequence
  Description of Artificial Sequence: Synthetic oligonucleotide
cttacctggagggcctgtgcgtgga

SEQ ID NO: 31292 - DNA, 26 bp, Artificial Sequence
  Description of Artificial Sequence: Synthetic oligonucleotide
ttacctggagggcctgtgcgtggagt

SEQ ID NO: 31293 - DNA, 24 bp, Artificial Sequence
  Description of Artificial Sequence: Synthetic oligonucleotide
ggcagctgtggtggtgccttctgg

SEQ ID NO: 31294 - DNA, 24 bp, Artificial Sequence
  Description of Artificial Sequence: Synthetic oligonucleotide
gcagctgtggtggtgccttctggg

SEQ ID NO: 31295 - DNA, 26 bp, Artificial Sequence
  Description of Artificial Sequence: Synthetic oligonucleotide
cagctgtggtggtgccttctggggaa

SEQ ID NO: 31296 - DNA, 27 bp, Artificial Sequence
  Description of Artificial Sequence: Synthetic oligonucleotide
agctgtggtggtgccttctggggaaga

SEQ ID NO: 31297 - DNA, 26 bp, Artificial Sequence
  Description of Artificial Sequence: Synthetic oligonucleotide
gctgtggtggtgccttctggggaaga

SEQ ID NO: 31298 - DNA, 26 bp, Artificial Sequence
  Description of Artificial Sequence: Synthetic oligonucleotide
ctgtggtggtgccttctggggaagag

SEQ ID NO: 31299 - DNA, 27 bp, Artificial Sequence
  Description of Artificial Sequence: Synthetic oligonucleotide
tgtggtggtgccttctggggaagagca

SEQ ID NO: 31300 - DNA, 26 bp, Artificial Sequence
  Description of Artificial Sequence: Synthetic oligonucleotide
gtggtggtgccttctggggaagagca

SEQ ID NO: 31301 - DNA, 27 bp, Artificial Sequence
  Description of Artificial Sequence: Synthetic oligonucleotide
tggtggtgccttctggggaagagcaga

SEQ ID NO: 31302 - DNA, 26 bp, Artificial Sequence
  Description of Artificial Sequence: Synthetic oligonucleotide
ggtggtgccttctggggaagagcaga

SEQ ID NO: 31303 - DNA, 27 bp, Artificial Sequence
  Description of Artificial Sequence: Synthetic oligonucleotide
gtggtgccttctggggaagagcagaga

SEQ ID NO: 31304 - DNA, 29 bp, Artificial Sequence
  Description of Artificial Sequence: Synthetic oligonucleotide
tggtgccttctggggaagagcagagatac

SEQ ID NO: 31305 - DNA, 28 bp, Artificial Sequence
  Description of Artificial Sequence: Synthetic oligonucleotide
ggtgccttctggggaagagcagagatac

SEQ ID NO: 31306 - DNA, 29 bp, Artificial Sequence
  Description of Artificial Sequence: Synthetic oligonucleotide
gtgccttctggggaagagcagagatacac

SEQ ID NO: 31307 - DNA, 31 bp, Artificial Sequence
  Description of Artificial Sequence: Synthetic oligonucleotide
tgccttctggggaagagcagagatacacatg

SEQ ID NO: 31308 - DNA, 30 bp, Artificial Sequence
  Description of Artificial Sequence: Synthetic oligonucleotide
gccttctggggaagagcagagatacacatg

SEQ ID NO: 31309 - DNA, 30 bp, Artificial Sequence
  Description of Artificial Sequence: Synthetic oligonucleotide
ccttctggggaagagcagagatacacatgc

SEQ ID NO: 31310 - DNA, 30 bp, Artificial Sequence
  Description of Artificial Sequence: Synthetic oligonucleotide
cttctggggaagagcagagatacacatgcc

SEQ ID NO: 31311 - DNA, 32 bp, Artificial Sequence
  Description of Artificial Sequence: Synthetic oligonucleotide
ttctggggaagagcagagatacacatgccatg

SEQ ID NO: 31312 - DNA, 31 bp, Artificial Sequence
  Description of Artificial Sequence: Synthetic oligonucleotide
tctggggaagagcagagatacacatgccatg

SEQ ID NO: 31313 - DNA, 30 bp, Artificial Sequence
  Description of Artificial Sequence: Synthetic oligonucleotide
ctggggaagagcagagatacacatgccatg

SEQ ID NO: 31314 - DNA, 32 bp, Artificial Sequence
  Description of Artificial Sequence: Synthetic oligonucleotide
tggggaagagcagagatacacatgccatgtac

SEQ ID NO: 31315 - DNA, 31 bp, Artificial Sequence
  Description of Artificial Sequence: Synthetic oligonucleotide
ggggaagagcagagatacacatgccatgtac

SEQ ID NO: 31316 - DNA, 32 bp, Artificial Sequence
  Description of Artificial Sequence: Synthetic oligonucleotide
gggaagagcagagatacacatgccatgtacag

SEQ ID NO: 31317 - DNA, 32 bp, Artificial Sequence
  Description of Artificial Sequence: Synthetic oligonucleotide
ggaagagcagagatacacatgccatgtacagc

SEQ ID NO: 31318 - DNA, 28 bp, Artificial Sequence
  Description of Artificial Sequence: Synthetic oligonucleotide
atcatccagaggatgtacggctgcgacc

SEQ ID NO: 31319 - DNA, 27 bp, Artificial Sequence
  Description of Artificial Sequence: Synthetic oligonucleotide
tcatccagaggatgtacggctgcgacc

SEQ ID NO: 31320 - DNA, 27 bp, Artificial Sequence
  Description of Artificial Sequence: Synthetic oligonucleotide
catccagaggatgtacggctgcgacct

SEQ ID NO: 31321 - DNA, 27 bp, Artificial Sequence
  Description of Artificial Sequence: Synthetic oligonucleotide
atccagaggatgtacggctgcgacctg

SEQ ID NO: 31322 - DNA, 25 bp, Artificial Sequence
  Description of Artificial Sequence: Synthetic oligonucleotide
ggcgccatggatagagcaggaggga

SEQ ID NO: 31323 - DNA, 25 bp, Artificial Sequence
  Description of Artificial Sequence: Synthetic oligonucleotide
gcgccatggatagagcaggagggac

SEQ ID NO: 31324 - DNA, 25 bp, Artificial Sequence
  Description of Artificial Sequence: Synthetic oligonucleotide
cgccatggatagagcaggagggacc

SEQ ID NO: 31325 - DNA, 25 bp, Artificial Sequence
  Description of Artificial Sequence: Synthetic oligonucleotide
gccatggatagagcaggagggaccg

SEQ ID NO: 31326 - DNA, 26 bp, Artificial Sequence
  Description of Artificial Sequence: Synthetic oligonucleotide
ccatggatagagcaggagggaccgga

SEQ ID NO: 31327 - DNA, 27 bp, Artificial Sequence
  Description of Artificial Sequence: Synthetic oligonucleotide
catggatagagcaggagggaccggagt

SEQ ID NO: 31328 - DNA, 30 bp, Artificial Sequence
  Description of Artificial Sequence: Synthetic oligonucleotide
atggatagagcaggagggaccggagtattg

SEQ ID NO: 31329 - DNA, 29 bp, Artificial Sequence
  Description of Artificial Sequence: Synthetic oligonucleotide
tggatagagcaggagggaccggagtattg

SEQ ID NO: 31330 - DNA, 28 bp, Artificial Sequence
  Description of Artificial Sequence: Synthetic oligonucleotide
ggatagagcaggagggaccggagtattg

SEQ ID NO: 31331 - DNA, 28 bp, Artificial Sequence
  Description of Artificial Sequence: Synthetic oligonucleotide
gatagagcaggagggaccggagtattgg

SEQ ID NO: 31332 - DNA, 28 bp, Artificial Sequence
  Description of Artificial Sequence: Synthetic oligonucleotide
atagagcaggagggaccggagtattggg

SEQ ID NO: 31333 - DNA, 27 bp, Artificial Sequence
  Description of Artificial Sequence: Synthetic oligonucleotide
tagagcaggagggaccggagtattggg

SEQ ID NO: 31334 - DNA, 27 bp, Artificial Sequence
  Description of Artificial Sequence: Synthetic oligonucleotide
agagcaggagggaccggagtattggga

SEQ ID NO: 31335 - DNA, 26 bp, Artificial Sequence
  Description of Artificial Sequence: Synthetic oligonucleotide
gagcaggagggaccggagtattggga

SEQ ID NO: 31336 - DNA, 26 bp, Artificial Sequence
  Description of Artificial Sequence: Synthetic oligonucleotide
agcaggagggaccggagtattgggac

SEQ ID NO: 31337 - DNA, 25 bp, Artificial Sequence
  Description of Artificial Sequence: Synthetic oligonucleotide
gcaggagggaccggagtattgggac

SEQ ID NO: 31338 - DNA, 25 bp, Artificial Sequence
  Description of Artificial Sequence: Synthetic oligonucleotide
caggagggaccggagtattgggacc

SEQ ID NO: 31339 - DNA, 25 bp, Artificial Sequence
  Description of Artificial Sequence: Synthetic oligonucleotide
aggagggaccggagtattgggaccg

SEQ ID NO: 31340 - DNA, 24 bp, Artificial Sequence
  Description of Artificial Sequence: Synthetic oligonucleotide
ggagggaccggagtattgggaccg

SEQ ID NO: 31341 - DNA, 26 bp, Artificial Sequence
  Description of Artificial Sequence: Synthetic oligonucleotide
gagggaccggagtattgggaccggaa

SEQ ID NO: 31342 - DNA, 27 bp, Artificial Sequence
  Description of Artificial Sequence: Synthetic oligonucleotide
agggaccggagtattgggaccggaaca

SEQ ID NO: 31343 - DNA, 26 bp, Artificial Sequence
  Description of Artificial Sequence: Synthetic oligonucleotide
gggaccggagtattgggaccggaaca

SEQ ID NO: 31344 - DNA, 27 bp, Artificial Sequence
  Description of Artificial Sequence: Synthetic oligonucleotide
ggaccggagtattgggaccggaacaca

SEQ ID NO: 31345 - DNA, 27 bp, Artificial Sequence
  Description of Artificial Sequence: Synthetic oligonucleotide
gaccggagtattgggaccggaacacac

SEQ ID NO: 31346 - DNA, 28 bp, Artificial Sequence
  Description of Artificial Sequence: Synthetic oligonucleotide
accggagtattgggaccggaacacacag

SEQ ID NO: 31347 - DNA, 27 bp, Artificial Sequence
  Description of Artificial Sequence: Synthetic oligonucleotide
taaccagagcgaggccgggtctcacat

SEQ ID NO: 31348 - DNA, 24 bp, Artificial Sequence
  Description of Artificial Sequence: Synthetic oligonucleotide
gagggcctgtgcgtggagtggctt

SEQ ID NO: 31349 - DNA, 24 bp, Artificial Sequence
  Description of Artificial Sequence: Synthetic oligonucleotide
agggcctgtgcgtggagtggcttc

SEQ ID NO: 31350 - DNA, 23 bp, Artificial Sequence
  Description of Artificial Sequence: Synthetic oligonucleotide
gggcctgtgcgtggagtggcttc

SEQ ID NO: 31351 - DNA, 23 bp, Artificial Sequence
  Description of Artificial Sequence: Synthetic oligonucleotide
ggcctgtgcgtggagtggcttcg

SEQ ID NO: 31352 - DNA, 24 bp, Artificial Sequence
  Description of Artificial Sequence: Synthetic oligonucleotide
gcctgtgcgtggagtggcttcgca

SEQ ID NO: 31353 - DNA, 27 bp, Artificial Sequence
  Description of Artificial Sequence: Synthetic oligonucleotide
cctgtgcgtggagtggcttcgcagata

SEQ ID NO: 31354 - DNA, 27 bp, Artificial Sequence
  Description of Artificial Sequence: Synthetic oligonucleotide
ctgtgcgtggagtggcttcgcagatac

SEQ ID NO: 31355 - DNA, 27 bp, Artificial Sequence
  Description of Artificial Sequence: Synthetic oligonucleotide
tgtgcgtggagtggcttcgcagatacc

SEQ ID NO: 31356 - DNA, 21 bp, Artificial Sequence
  Description of Artificial Sequence: Synthetic oligonucleotide
gcgagtccgaggacggagccg

SEQ ID NO: 31357 - DNA, 21 bp, Artificial Sequence
  Description of Artificial Sequence: Synthetic oligonucleotide
cgagtccgaggacggagccgc

SEQ ID NO: 31358 - DNA, 21 bp, Artificial Sequence
  Description of Artificial Sequence: Synthetic oligonucleotide
gagtccgaggacggagccgcg

SEQ ID NO: 31359 - DNA, 21 bp, Artificial Sequence
  Description of Artificial Sequence: Synthetic oligonucleotide
agtccgaggacggagccgcgg

SEQ ID NO: 31360 - DNA, 20 bp, Artificial Sequence
  Description of Artificial Sequence: Synthetic oligonucleotide
gtccgaggacggagccgcgg

SEQ ID NO: 31361 - DNA, 20 bp, Artificial Sequence
  Description of Artificial Sequence: Synthetic oligonucleotide
tccgaggacggagccgcggg

SEQ ID NO: 31362 - DNA, 20 bp, Artificial Sequence
  Description of Artificial Sequence: Synthetic oligonucleotide
ccgaggacggagccgcgggt

SEQ ID NO: 31363 - DNA, 20 bp, Artificial Sequence
  Description of Artificial Sequence: Synthetic oligonucleotide
cgaggacggagccgcgggct

SEQ ID NO: 31364 - DNA, 20 bp, Artificial Sequence
  Description of Artificial Sequence: Synthetic oligonucleotide
gacggagccgcgggcgccat

SEQ ID NO: 31365 - DNA, 20 bp, Artificial Sequence
  Description of Artificial Sequence: Synthetic oligonucleotide
acggagccgcgggcgccatg

SEQ ID NO: 31366 - DNA, 20 bp, Artificial Sequence
  Description of Artificial Sequence: Synthetic oligonucleotide
cggagccgcgggcgccatgt

SEQ ID NO: 31367 - DNA, 33 bp, Artificial Sequence
  Description of Artificial Sequence: Synthetic oligonucleotide
ggaccggaacacacagatcttcaagaccaatac

SEQ ID NO: 31368 - DNA, 34 bp, Artificial Sequence
  Description of Artificial Sequence: Synthetic oligonucleotide
gaccggaacacacagatcttcaagaccaatacac

SEQ ID NO: 31369 - DNA, 35 bp, Artificial Sequence
  Description of Artificial Sequence: Synthetic oligonucleotide
accggaacacacagatcttcaagaccaatacacag

SEQ ID NO: 31370 - DNA, 34 bp, Artificial Sequence
  Description of Artificial Sequence: Synthetic oligonucleotide
ccggaacacacagatcttcaagaccaatacacag

SEQ ID NO: 31371 - DNA, 35 bp, Artificial Sequence
  Description of Artificial Sequence: Synthetic oligonucleotide
cggaacacacagatcttcaagaccaatacacagac

SEQ ID NO: 31372 - DNA, 38 bp, Artificial Sequence
  Description of Artificial Sequence: Synthetic oligonucleotide
ggaacacacagatcttcaagaccaatacacagacttac

SEQ ID NO: 31373 - DNA, 38 bp, Artificial Sequence
  Description of Artificial Sequence: Synthetic oligonucleotide
gaacacacagatcttcaagaccaatacacagacttacc

SEQ ID NO: 31374 - DNA, 38 bp, Artificial Sequence
  Description of Artificial Sequence: Synthetic oligonucleotide
aacacacagatcttcaagaccaatacacagacttaccg

SEQ ID NO: 31375 - DNA, 37 bp, Artificial Sequence
  Description of Artificial Sequence: Synthetic oligonucleotide
acacacagatcttcaagaccaatacacagacttaccg

SEQ ID NO: 31376 - DNA, 36 bp, Artificial Sequence
  Description of Artificial Sequence: Synthetic oligonucleotide
cacacagatcttcaagaccaatacacagacttaccg

SEQ ID NO: 31377 - DNA, 37 bp, Artificial Sequence
  Description of Artificial Sequence: Synthetic oligonucleotide
acacagatcttcaagaccaatacacagacttaccgag

SEQ ID NO: 31378 - DNA, 36 bp, Artificial Sequence
  Description of Artificial Sequence: Synthetic oligonucleotide
cacagatcttcaagaccaatacacagacttaccgag

SEQ ID NO: 31379 - DNA, 37 bp, Artificial Sequence
  Description of Artificial Sequence: Synthetic oligonucleotide
acagatcttcaagaccaatacacagacttaccgagag

SEQ ID NO: 31380 - DNA, 36 bp, Artificial Sequence
  Description of Artificial Sequence: Synthetic oligonucleotide
cagatcttcaagaccaatacacagacttaccgagag

SEQ ID NO: 31381 - DNA, 37 bp, Artificial Sequence
  Description of Artificial Sequence: Synthetic oligonucleotide
agatcttcaagaccaatacacagacttaccgagagag

SEQ ID NO: 31382 - DNA, 36 bp, Artificial Sequence
  Description of Artificial Sequence: Synthetic oligonucleotide
gatcttcaagaccaatacacagacttaccgagagag

SEQ ID NO: 31383 - DNA, 36 bp, Artificial Sequence
  Description of Artificial Sequence: Synthetic oligonucleotide
atcttcaagaccaatacacagacttaccgagagagc

SEQ ID NO: 31384 - DNA, 35 bp, Artificial Sequence
  Description of Artificial Sequence: Synthetic oligonucleotide
tcttcaagaccaatacacagacttaccgagagagc

SEQ ID NO: 31385 - DNA, 34 bp, Artificial Sequence
  Description of Artificial Sequence: Synthetic oligonucleotide
cttcaagaccaatacacagacttaccgagagagc

SEQ ID NO: 31386 - DNA, 34 bp, Artificial Sequence
  Description of Artificial Sequence: Synthetic oligonucleotide
ttcaagaccaatacacagacttaccgagagagcc

SEQ ID NO: 31387 - DNA, 33 bp, Artificial Sequence
  Description of Artificial Sequence: Synthetic oligonucleotide
tcaagaccaatacacagacttaccgagagagcc

SEQ ID NO: 31388 - DNA, 32 bp, Artificial Sequence
  Description of Artificial Sequence: Synthetic oligonucleotide
caagaccaatacacagacttaccgagagagcc

SEQ ID NO: 31389 - DNA, 33 bp, Artificial Sequence
  Description of Artificial Sequence: Synthetic oligonucleotide
aagaccaatacacagacttaccgagagagcctg

SEQ ID NO: 31390 - DNA, 32 bp, Artificial Sequence
  Description of Artificial Sequence: Synthetic oligonucleotide
agaccaatacacagacttaccgagagagcctg

SEQ ID NO: 31391 - DNA, 31 bp, Artificial Sequence
  Description of Artificial Sequence: Synthetic oligonucleotide
gaccaatacacagacttaccgagagagcctg

SEQ ID NO: 31392 - DNA, 31 bp, Artificial Sequence
  Description of Artificial Sequence: Synthetic oligonucleotide
accaatacacagacttaccgagagagcctgc

SEQ ID NO: 31393 - DNA, 30 bp, Artificial Sequence
  Description of Artificial Sequence: Synthetic oligonucleotide
ccaatacacagacttaccgagagagcctgc

SEQ ID NO: 31394 - DNA, 30 bp, Artificial Sequence
  Description of Artificial Sequence: Synthetic oligonucleotide
caatacacagacttaccgagagagcctgcg

SEQ ID NO: 31395 - DNA, 30 bp, Artificial Sequence
  Description of Artificial Sequence: Synthetic oligonucleotide
aatacacagacttaccgagagagcctgcgg

SEQ ID NO: 31396 - DNA, 29 bp, Artificial Sequence
  Description of Artificial Sequence: Synthetic oligonucleotide
atacacagacttaccgagagagcctgcgg

SEQ ID NO: 31397 - DNA, 28 bp, Artificial Sequence
  Description of Artificial Sequence: Synthetic oligonucleotide
tacacagacttaccgagagagcctgcgg

SEQ ID NO: 31398 - DNA, 20 bp, Artificial Sequence
  Description of Artificial Sequence: Synthetic oligonucleotide
catgtcccggcccggccgtg

SEQ ID NO: 31399 - DNA, 20 bp, Artificial Sequence
  Description of Artificial Sequence: Synthetic oligonucleotide
atgtcccggcccggccgtgg

SEQ ID NO: 31400 - DNA, 30 bp, Artificial Sequence
  Description of Artificial Sequence: Synthetic oligonucleotide
tacgtggacgacacccagttcgtgagattc

SEQ ID NO: 31401 - DNA, 29 bp, Artificial Sequence
  Description of Artificial Sequence: Synthetic oligonucleotide
acgtggacgacacccagttcgtgagattc

SEQ ID NO: 31402 - DNA, 28 bp, Artificial Sequence
  Description of Artificial Sequence: Synthetic oligonucleotide
cgtggacgacacccagttcgtgagattc

SEQ ID NO: 31403 - DNA, 28 bp, Artificial Sequence
  Description of Artificial Sequence: Synthetic oligonucleotide
gtggacgacacccagttcgtgagattcg

SEQ ID NO: 31404 - DNA, 29 bp, Artificial Sequence
  Description of Artificial Sequence: Synthetic oligonucleotide
tggacgacacccagttcgtgagattcgac

SEQ ID NO: 31405 - DNA, 28 bp, Artificial Sequence
  Description of Artificial Sequence: Synthetic oligonucleotide
ggacgacacccagttcgtgagattcgac

SEQ ID NO: 31406 - DNA, 29 bp, Artificial Sequence
  Description of Artificial Sequence: Synthetic oligonucleotide
gacgacacccagttcgtgagattcgacag

SEQ ID NO: 31407 - DNA, 29 bp, Artificial Sequence
  Description of Artificial Sequence: Synthetic oligonucleotide
acgacacccagttcgtgagattcgacagc

SEQ ID NO: 31408 - DNA, 28 bp, Artificial Sequence
  Description of Artificial Sequence: Synthetic oligonucleotide
cgacacccagttcgtgagattcgacagc

SEQ ID NO: 31409 - DNA, 28 bp, Artificial Sequence
  Description of Artificial Sequence: Synthetic oligonucleotide
gacacccagttcgtgagattcgacagcg

SEQ ID NO: 31410 - DNA, 29 bp, Artificial Sequence
  Description of Artificial Sequence: Synthetic oligonucleotide
acacccagttcgtgagattcgacagcgac

SEQ ID NO: 31411 - DNA, 28 bp, Artificial Sequence
  Description of Artificial Sequence: Synthetic oligonucleotide
cacccagttcgtgagattcgacagcgac

SEQ ID NO: 31412 - DNA, 28 bp, Artificial Sequence
  Description of Artificial Sequence: Synthetic oligonucleotide
acccagttcgtgagattcgacagcgacg

SEQ ID NO: 31413 - DNA, 27 bp, Artificial Sequence
  Description of Artificial Sequence: Synthetic oligonucleotide
cccagttcgtgagattcgacagcgacg

SEQ ID NO: 31414 - DNA, 27 bp, Artificial Sequence
  Description of Artificial Sequence: Synthetic oligonucleotide
ccagttcgtgagattcgacagcgacgc

SEQ ID NO: 31415 - DNA, 27 bp, Artificial Sequence
  Description of Artificial Sequence: Synthetic oligonucleotide
cagttcgtgagattcgacagcgacgcc

SEQ ID NO: 31416 - DNA, 27 bp, Artificial Sequence
  Description of Artificial Sequence: Synthetic oligonucleotide
agttcgtgagattcgacagcgacgccg

SEQ ID NO: 31417 - DNA, 26 bp, Artificial Sequence
  Description of Artificial Sequence: Synthetic oligonucleotide
gttcgtgagattcgacagcgacgccg

SEQ ID NO: 31418 - DNA, 26 bp, Artificial Sequence
  Description of Artificial Sequence: Synthetic oligonucleotide
ttcgtgagattcgacagcgacgccgc

SEQ ID NO: 31419 - DNA, 25 bp, Artificial Sequence
  Description of Artificial Sequence: Synthetic oligonucleotide
tcgtgagattcgacagcgacgccgc

SEQ ID NO: 31420 - DNA, 24 bp, Artificial Sequence
  Description of Artificial Sequence: Synthetic oligonucleotide
cgtgagattcgacagcgacgccgc

SEQ ID NO: 31421 - DNA, 25 bp, Artificial Sequence
  Description of Artificial Sequence: Synthetic oligonucleotide
gtgagattcgacagcgacgccgcga

SEQ ID NO: 31422 - DNA, 26 bp, Artificial Sequence
  Description of Artificial Sequence: Synthetic oligonucleotide
tgagattcgacagcgacgccgcgagt

SEQ ID NO: 31423 - DNA, 25 bp, Artificial Sequence
  Description of Artificial Sequence: Synthetic oligonucleotide
gagattcgacagcgacgccgcgagt

SEQ ID NO: 31424 - DNA, 25 bp, Artificial Sequence
  Description of Artificial Sequence: Synthetic oligonucleotide
agattcgacagcgacgccgcgagtc

SEQ ID NO: 31425 - DNA, 24 bp, Artificial Sequence
  Description of Artificial Sequence: Synthetic oligonucleotide
gattcgacagcgacgccgcgagtc

SEQ ID NO: 31426 - DNA, 24 bp, Artificial Sequence
  Description of Artificial Sequence: Synthetic oligonucleotide
attcgacagcgacgccgcgagtcc

SEQ ID NO: 31427 - DNA, 30 bp, Artificial Sequence
  Description of Artificial Sequence: Synthetic oligonucleotide
agtccgcctacgacggcaaggattacatag

SEQ ID NO: 31428 - DNA, 29 bp, Artificial Sequence
  Description of Artificial Sequence: Synthetic oligonucleotide
gtccgcctacgacggcaaggattacatag

SEQ ID NO: 31429 - DNA, 29 bp, Artificial Sequence
  Description of Artificial Sequence: Synthetic oligonucleotide
tccgcctacgacggcaaggattacatagc

SEQ ID NO: 31430 - DNA, 28 bp, Artificial Sequence
  Description of Artificial Sequence: Synthetic oligonucleotide
ccgcctacgacggcaaggattacatagc

SEQ ID NO: 31431 - DNA, 31 bp, Artificial Sequence
  Description of Artificial Sequence: Synthetic oligonucleotide
ctacgacggcaaggattacatagccctgaac

SEQ ID NO: 31432 - DNA, 31 bp, Artificial Sequence
  Description of Artificial Sequence: Synthetic oligonucleotide
tacgacggcaaggattacatagccctgaacg

SEQ ID NO: 31433 - DNA, 30 bp, Artificial Sequence
  Description of Artificial Sequence: Synthetic oligonucleotide
acgacggcaaggattacatagccctgaacg

SEQ ID NO: 31434 - DNA, 29 bp, Artificial Sequence
  Description of Artificial Sequence: Synthetic oligonucleotide
cgacggcaaggattacatagccctgaacg

SEQ ID NO: 31435 - DNA, 30 bp, Artificial Sequence
  Description of Artificial Sequence: Synthetic oligonucleotide
gacggcaaggattacatagccctgaacgag

SEQ ID NO: 31436 - DNA, 30 bp, Artificial Sequence
  Description of Artificial Sequence: Synthetic oligonucleotide
acggcaaggattacatagccctgaacgagg

SEQ ID NO: 31437 - DNA, 29 bp, Artificial Sequence
  Description of Artificial Sequence: Synthetic oligonucleotide
cggcaaggattacatagccctgaacgagg

SEQ ID NO: 31438 - DNA, 30 bp, Artificial Sequence
  Description of Artificial Sequence: Synthetic oligonucleotide
ggcaaggattacatagccctgaacgaggac

SEQ ID NO: 31439 - DNA, 30 bp, Artificial Sequence
  Description of Artificial Sequence: Synthetic oligonucleotide
gcaaggattacatagccctgaacgaggacc

SEQ ID NO: 31440 - DNA, 31 bp, Artificial Sequence
  Description of Artificial Sequence: Synthetic oligonucleotide
caaggattacatagccctgaacgaggacctg

SEQ ID NO: 31441 - DNA, 32 bp, Artificial Sequence
  Description of Artificial Sequence: Synthetic oligonucleotide
aaggattacatagccctgaacgaggacctgag

SEQ ID NO: 31442 - DNA, 31 bp, Artificial Sequence
  Description of Artificial Sequence: Synthetic oligonucleotide
aggattacatagccctgaacgaggacctgag

SEQ ID NO: 31443 - DNA, 30 bp, Artificial Sequence
  Description of Artificial Sequence: Synthetic oligonucleotide
ggattacatagccctgaacgaggacctgag

SEQ ID NO: 31444 - DNA, 30 bp, Artificial Sequence
  Description of Artificial Sequence: Synthetic oligonucleotide
gattacatagccctgaacgaggacctgagc

SEQ ID NO: 31445 - DNA, 31 bp, Artificial Sequence
  Description of Artificial Sequence: Synthetic oligonucleotide
attacatagccctgaacgaggacctgagctc

SEQ ID NO: 31446 - DNA, 30 bp, Artificial Sequence
  Description of Artificial Sequence: Synthetic oligonucleotide
ttacatagccctgaacgaggacctgagctc

SEQ ID NO: 31447 - DNA, 29 bp, Artificial Sequence
  Description of Artificial Sequence: Synthetic oligonucleotide
tacatagccctgaacgaggacctgagctc

SEQ ID NO: 31448 - DNA, 28 bp, Artificial Sequence
  Description of Artificial Sequence: Synthetic oligonucleotide
acatagccctgaacgaggacctgagctc

SEQ ID NO: 31449 - DNA, 27 bp, Artificial Sequence
  Description of Artificial Sequence: Synthetic oligonucleotide
catagccctgaacgaggacctgagctc

SEQ ID NO: 31450 - DNA, 27 bp, Artificial Sequence
  Description of Artificial Sequence: Synthetic oligonucleotide
atagccctgaacgaggacctgagctcc

SEQ ID NO: 31451 - DNA, 27 bp, Artificial Sequence
  Description of Artificial Sequence: Synthetic oligonucleotide
tagccctgaacgaggacctgagctcct

SEQ ID NO: 31452 - DNA, 26 bp, Artificial Sequence
  Description of Artificial Sequence: Synthetic oligonucleotide
agccctgaacgaggacctgagctcct

SEQ ID NO: 31453 - DNA, 27 bp, Artificial Sequence
  Description of Artificial Sequence: Synthetic oligonucleotide
cagaggatgtatggctgcgacctgggt

SEQ ID NO: 31454 - DNA, 27 bp, Artificial Sequence
  Description of Artificial Sequence: Synthetic oligonucleotide
agaggatgtatggctgcgacctgggtc

SEQ ID NO: 31455 - DNA, 26 bp, Artificial Sequence
  Description of Artificial Sequence: Synthetic oligonucleotide
gaggatgtatggctgcgacctgggtc

SEQ ID NO: 31456 - DNA, 26 bp, Artificial Sequence
  Description of Artificial Sequence: Synthetic oligonucleotide
aggatgtatggctgcgacctgggtcc

SEQ ID NO: 31457 - DNA, 25 bp, Artificial Sequence
  Description of Artificial Sequence: Synthetic oligonucleotide
ggatgtatggctgcgacctgggtcc

SEQ ID NO: 31458 - DNA, 25 bp, Artificial Sequence
  Description of Artificial Sequence: Synthetic oligonucleotide
gatgtatggctgcgacctgggtccc

SEQ ID NO: 31459 - DNA, 26 bp, Artificial Sequence
  Description of Artificial Sequence: Synthetic oligonucleotide
atgtatggctgcgacctgggtcccga

SEQ ID NO: 31460 - DNA, 25 bp, Artificial Sequence
  Description of Artificial Sequence: Synthetic oligonucleotide
tgtatggctgcgacctgggtcccga

SEQ ID NO: 31461 - DNA, 24 bp, Artificial Sequence
  Description of Artificial Sequence: Synthetic oligonucleotide
gtatggctgcgacctgggtcccga

SEQ ID NO: 31462 - DNA, 24 bp, Artificial Sequence
  Description of Artificial Sequence: Synthetic oligonucleotide
tatggctgcgacctgggtcccgac

SEQ ID NO: 31463 - DNA, 23 bp, Artificial Sequence
  Description of Artificial Sequence: Synthetic oligonucleotide
atggctgcgacctgggtcccgac

SEQ ID NO: 31464 - DNA, 22 bp, Artificial Sequence
  Description of Artificial Sequence: Synthetic oligonucleotide
tggctgcgacctgggtcccgac

SEQ ID NO: 31465 - DNA, 21 bp, Artificial Sequence
  Description of Artificial Sequence: Synthetic oligonucleotide
ggctgcgacctgggtcccgac

SEQ ID NO: 31466 - DNA, 21 bp, Artificial Sequence
  Description of Artificial Sequence: Synthetic oligonucleotide
gctgcgacctgggtcccgacg

SEQ ID NO: 31467 - DNA, 21 bp, Artificial Sequence
  Description of Artificial Sequence: Synthetic oligonucleotide
ctgcgacctgggtcccgacgg

SEQ ID NO: 31468 - DNA, 21 bp, Artificial Sequence
  Description of Artificial Sequence: Synthetic oligonucleotide
tgcgacctgggtcccgacggg

SEQ ID NO: 31469 - DNA, 20 bp, Artificial Sequence
  Description of Artificial Sequence: Synthetic oligonucleotide
gcgacctgggtcccgacggg

SEQ ID NO: 31470 - DNA, 20 bp, Artificial Sequence
  Description of Artificial Sequence: Synthetic oligonucleotide
cgacctgggtcccgacgggc

SEQ ID NO: 31471 - DNA, 20 bp, Artificial Sequence
  Description of Artificial Sequence: Synthetic oligonucleotide
gacctgggtcccgacgggcg

SEQ ID NO: 31472 - DNA, 20 bp, Artificial Sequence
  Description of Artificial Sequence: Synthetic oligonucleotide
acctgggtcccgacgggcgc

SEQ ID NO: 31473 - DNA, 20 bp, Artificial Sequence
  Description of Artificial Sequence: Synthetic oligonucleotide
cctgggtcccgacgggcgct

SEQ ID NO: 31474 - DNA, 20 bp, Artificial Sequence
  Description of Artificial Sequence: Synthetic oligonucleotide
ctgggtcccgacgggcgcct

SEQ ID NO: 31475 - DNA, 20 bp, Artificial Sequence
  Description of Artificial Sequence: Synthetic oligonucleotide
tgggtcccgacgggcgcctc

SEQ ID NO: 31476 - DNA, 20 bp, Artificial Sequence
  Description of Artificial Sequence: Synthetic oligonucleotide
gggtcccgacgggcgcctct

SEQ ID NO: 31477 - DNA, 20 bp, Artificial Sequence
  Description of Artificial Sequence: Synthetic oligonucleotide
ggtcccgacgggcgcctcct

SEQ ID NO: 31478 - DNA, 20 bp, Artificial Sequence
  Description of Artificial Sequence: Synthetic oligonucleotide
gtcccgacgggcgcctcctc

SEQ ID NO: 31479 - DNA, 20 bp, Artificial Sequence
  Description of Artificial Sequence: Synthetic oligonucleotide
tcccgacgggcgcctcctcc

SEQ ID NO: 31480 - DNA, 22 bp, Artificial Sequence
  Description of Artificial Sequence: Synthetic oligonucleotide
cgacgccgcgagtccgaggact

SEQ ID NO: 31481 - DNA, 23 bp, Artificial Sequence
  Description of Artificial Sequence: Synthetic oligonucleotide
gacgccgcgagtccgaggactga

SEQ ID NO: 31482 - DNA, 23 bp, Artificial Sequence
  Description of Artificial Sequence: Synthetic oligonucleotide
acgccgcgagtccgaggactgag

SEQ ID NO: 31483 - DNA, 22 bp, Artificial Sequence
  Description of Artificial Sequence: Synthetic oligonucleotide
cgccgcgagtccgaggactgag

SEQ ID NO: 31484 - DNA, 22 bp, Artificial Sequence
  Description of Artificial Sequence: Synthetic oligonucleotide
gccgcgagtccgaggactgagc

SEQ ID NO: 31485 - DNA, 22 bp, Artificial Sequence
  Description of Artificial Sequence: Synthetic oligonucleotide
ccgcgagtccgaggactgagcc

SEQ ID NO: 31486 - DNA, 22 bp, Artificial Sequence
  Description of Artificial Sequence: Synthetic oligonucleotide
cgcgagtccgaggactgagccc

SEQ ID NO: 31487 - DNA, 22 bp, Artificial Sequence
  Description of Artificial Sequence: Synthetic oligonucleotide
gcgagtccgaggactgagcccc

SEQ ID NO: 31488 - DNA, 22 bp, Artificial Sequence
  Description of Artificial Sequence: Synthetic oligonucleotide
cgagtccgaggactgagccccg

SEQ ID NO: 31489 - DNA, 22 bp, Artificial Sequence
  Description of Artificial Sequence: Synthetic oligonucleotide
gagtccgaggactgagccccgg

SEQ ID NO: 31490 - DNA, 22 bp, Artificial Sequence
  Description of Artificial Sequence: Synthetic oligonucleotide
agtccgaggactgagccccggg

SEQ ID NO: 31491 - DNA, 21 bp, Artificial Sequence
  Description of Artificial Sequence: Synthetic oligonucleotide
gtccgaggactgagccccggg

SEQ ID NO: 31492 - DNA, 21 bp, Artificial Sequence
  Description of Artificial Sequence: Synthetic oligonucleotide
tccgaggactgagccccgggc

SEQ ID NO: 31493 - DNA, 20 bp, Artificial Sequence
  Description of Artificial Sequence: Synthetic oligonucleotide
ccgaggactgagccccgggc

SEQ ID NO: 31494 - DNA, 20 bp, Artificial Sequence
  Description of Artificial Sequence: Synthetic oligonucleotide
cgaggactgagccccgggcg

SEQ ID NO: 31495 - DNA, 20 bp, Artificial Sequence
  Description of Artificial Sequence: Synthetic oligonucleotide
gaggactgagccccgggcgc

SEQ ID NO: 31496 - DNA, 22 bp, Artificial Sequence
  Description of Artificial Sequence: Synthetic oligonucleotide
aggactgagccccgggcgccat

SEQ ID NO: 31497 - DNA, 21 bp, Artificial Sequence
  Description of Artificial Sequence: Synthetic oligonucleotide
ggactgagccccgggcgccat

SEQ ID NO: 31498 - DNA, 21 bp, Artificial Sequence
  Description of Artificial Sequence: Synthetic oligonucleotide
gactgagccccgggcgccatg

SEQ ID NO: 31499 - DNA, 24 bp, Artificial Sequence
  Description of Artificial Sequence: Synthetic oligonucleotide
actgagccccgggcgccatggata

SEQ ID NO: 31500 - DNA, 23 bp, Artificial Sequence
  Description of Artificial Sequence: Synthetic oligonucleotide
ctgagccccgggcgccatggata

SEQ ID NO: 31501 - DNA, 24 bp, Artificial Sequence
  Description of Artificial Sequence: Synthetic oligonucleotide
tgagccccgggcgccatggataga

SEQ ID NO: 31502 - DNA, 27 bp, Artificial Sequence
  Description of Artificial Sequence: Synthetic oligonucleotide
ctgtgcgtggagtggctccgcagatat

SEQ ID NO: 31503 - DNA, 27 bp, Artificial Sequence
  Description of Artificial Sequence: Synthetic oligonucleotide
tgtgcgtggagtggctccgcagatatc

SEQ ID NO: 31504 - DNA, 29 bp, Artificial Sequence
  Description of Artificial Sequence: Synthetic oligonucleotide
tccgcagatatctggagaacgggaaggag

SEQ ID NO: 31505 - DNA, 28 bp, Artificial Sequence
  Description of Artificial Sequence: Synthetic oligonucleotide
ccgcagatatctggagaacgggaaggag

SEQ ID NO: 31506 - DNA, 29 bp, Artificial Sequence
  Description of Artificial Sequence: Synthetic oligonucleotide
cgcagatatctggagaacgggaaggagac

SEQ ID NO: 31507 - DNA, 29 bp, Artificial Sequence
  Description of Artificial Sequence: Synthetic oligonucleotide
gcagatatctggagaacgggaaggagacg

SEQ ID NO: 31508 - DNA, 29 bp, Artificial Sequence
  Description of Artificial Sequence: Synthetic oligonucleotide
cagatatctggagaacgggaaggagacgc

SEQ ID NO: 31509 - DNA, 30 bp, Artificial Sequence
  Description of Artificial Sequence: Synthetic oligonucleotide
agatatctggagaacgggaaggagacgctg

SEQ ID NO: 31510 - DNA, 29 bp, Artificial Sequence
  Description of Artificial Sequence: Synthetic oligonucleotide
gatatctggagaacgggaaggagacgctg

SEQ ID NO: 31511 - DNA, 29 bp, Artificial Sequence
  Description of Artificial Sequence: Synthetic oligonucleotide
atatctggagaacgggaaggagacgctgc

SEQ ID NO: 31512 - DNA, 28 bp, Artificial Sequence
  Description of Artificial Sequence: Synthetic oligonucleotide
tatctggagaacgggaaggagacgctgc

SEQ ID NO: 31513 - DNA, 27 bp, Artificial Sequence
  Description of Artificial Sequence: Synthetic oligonucleotide
atctggagaacgggaaggagacgctgc

SEQ ID NO: 31514 - DNA, 27 bp, Artificial Sequence
  Description of Artificial Sequence: Synthetic oligonucleotide
tctggagaacgggaaggagacgctgca

SEQ ID NO: 31515 - DNA, 26 bp, Artificial Sequence
  Description of Artificial Sequence: Synthetic oligonucleotide
agttcgtgaggttcgacagcgacgcg

SEQ ID NO: 31516 - DNA, 25 bp, Artificial Sequence
  Description of Artificial Sequence: Synthetic oligonucleotide
gttcgtgaggttcgacagcgacgcg

SEQ ID NO: 31517 - DNA, 25 bp, Artificial Sequence
  Description of Artificial Sequence: Synthetic oligonucleotide
ttcgtgaggttcgacagcgacgcgg

SEQ ID NO: 31518 - DNA, 24 bp, Artificial Sequence
  Description of Artificial Sequence: Synthetic oligonucleotide
tcgtgaggttcgacagcgacgcgg

SEQ ID NO: 31519 - DNA, 23 bp, Artificial Sequence
  Description of Artificial Sequence: Synthetic oligonucleotide
cgtgaggttcgacagcgacgcgg

SEQ ID NO: 31520 - DNA, 23 bp, Artificial Sequence
  Description of Artificial Sequence: Synthetic oligonucleotide
gtgaggttcgacagcgacgcggc

SEQ ID NO: 31521 - DNA, 24 bp, Artificial Sequence
  Description of Artificial Sequence: Synthetic oligonucleotide
tgaggttcgacagcgacgcggcga

SEQ ID NO: 31522 - DNA, 23 bp, Artificial Sequence
  Description of Artificial Sequence: Synthetic oligonucleotide
gaggttcgacagcgacgcggcga

SEQ ID NO: 31523 - DNA, 24 bp, Artificial Sequence
  Description of Artificial Sequence: Synthetic oligonucleotide
aggttcgacagcgacgcggcgagt

SEQ ID NO: 31524 - DNA, 23 bp, Artificial Sequence
  Description of Artificial Sequence: Synthetic oligonucleotide
ggttcgacagcgacgcggcgagt

SEQ ID NO: 31525 - DNA, 23 bp, Artificial Sequence
  Description of Artificial Sequence: Synthetic oligonucleotide
gttcgacagcgacgcggcgagtc

SEQ ID NO: 31526 - DNA, 23 bp, Artificial Sequence
  Description of Artificial Sequence: Synthetic oligonucleotide
ttcgacagcgacgcggcgagtcc

SEQ ID NO: 31527 - DNA, 22 bp, Artificial Sequence
  Description of Artificial Sequence: Synthetic oligonucleotide
tcgacagcgacgcggcgagtcc

SEQ ID NO: 31528 - DNA, 21 bp, Artificial Sequence
  Description of Artificial Sequence: Synthetic oligonucleotide
cgacagcgacgcggcgagtcc

SEQ ID NO: 31529 - DNA, 22 bp, Artificial Sequence
  Description of Artificial Sequence: Synthetic oligonucleotide
gacagcgacgcggcgagtccga

SEQ ID NO: 31530 - DNA, 22 bp, Artificial Sequence
  Description of Artificial Sequence: Synthetic oligonucleotide
acagcgacgcggcgagtccgag

SEQ ID NO: 31531 - DNA, 21 bp, Artificial Sequence
  Description of Artificial Sequence: Synthetic oligonucleotide
cagcgacgcggcgagtccgag

SEQ ID NO: 31532 - DNA, 22 bp, Artificial Sequence
  Description of Artificial Sequence: Synthetic oligonucleotide
agcgacgcggcgagtccgagga

SEQ ID NO: 31533 - DNA, 21 bp, Artificial Sequence
  Description of Artificial Sequence: Synthetic oligonucleotide
gcgacgcggcgagtccgagga

SEQ ID NO: 31534 - DNA, 21 bp, Artificial Sequence
  Description of Artificial Sequence: Synthetic oligonucleotide
cgacgcggcgagtccgaggac

SEQ ID NO: 31535 - DNA, 21 bp, Artificial Sequence
  Description of Artificial Sequence: Synthetic oligonucleotide
gacgcggcgagtccgaggacg

SEQ ID NO: 31536 - DNA, 22 bp, Artificial Sequence
  Description of Artificial Sequence: Synthetic oligonucleotide
acgcggcgagtccgaggacgga

SEQ ID NO: 31537 - DNA, 21 bp, Artificial Sequence
  Description of Artificial Sequence: Synthetic oligonucleotide
cgcggcgagtccgaggacgga

SEQ ID NO: 31538 - DNA, 21 bp, Artificial Sequence
  Description of Artificial Sequence: Synthetic oligonucleotide
gcggcgagtccgaggacggag

SEQ ID NO: 31539 - DNA, 21 bp, Artificial Sequence
  Description of Artificial Sequence: Synthetic oligonucleotide
cggcgagtccgaggacggagc

SEQ ID NO: 31540 - DNA, 21 bp, Artificial Sequence
  Description of Artificial Sequence: Synthetic oligonucleotide
ggcgagtccgaggacggagcc

SEQ ID NO: 31541 - DNA, 20 bp, Artificial Sequence
  Description of Artificial Sequence: Synthetic oligonucleotide
gaggacggagccccgggcct

SEQ ID NO: 31542 - DNA, 20 bp, Artificial Sequence
  Description of Artificial Sequence: Synthetic oligonucleotide
aggacggagccccgggccct

SEQ ID NO: 31543 - DNA, 20 bp, Artificial Sequence
  Description of Artificial Sequence: Synthetic oligonucleotide
ggacggagccccgggccctt

SEQ ID NO: 31544 - DNA, 20 bp, Artificial Sequence
  Description of Artificial Sequence: Synthetic oligonucleotide
gacggagccccgggccccat

SEQ ID NO: 31545 - DNA, 20 bp, Artificial Sequence
  Description of Artificial Sequence: Synthetic oligonucleotide
acggagccccgggccccatg

SEQ ID NO: 31546 - DNA, 20 bp, Artificial Sequence
  Description of Artificial Sequence: Synthetic oligonucleotide
cggagccccgggccccatgt

SEQ ID NO: 31547 - DNA, 22 bp, Artificial Sequence
  Description of Artificial Sequence: Synthetic oligonucleotide
ggagccccgggccccatggata

SEQ ID NO: 31548 - DNA, 23 bp, Artificial Sequence
  Description of Artificial Sequence: Synthetic oligonucleotide
gagccccgggccccatggataga

SEQ ID NO: 31549 - DNA, 23 bp, Artificial Sequence
  Description of Artificial Sequence: Synthetic oligonucleotide
agccccgggccccatggatagag

SEQ ID NO: 31550 - DNA, 22 bp, Artificial Sequence
  Description of Artificial Sequence: Synthetic oligonucleotide
gccccgggccccatggatagag

SEQ ID NO: 31551 - DNA, 23 bp, Artificial Sequence
  Description of Artificial Sequence: Synthetic oligonucleotide
ccccgggccccatggatagagca

SEQ ID NO: 31552 - DNA, 23 bp, Artificial Sequence
  Description of Artificial Sequence: Synthetic oligonucleotide
cccgggccccatggatagagcag

SEQ ID NO: 31553 - DNA, 24 bp, Artificial Sequence
  Description of Artificial Sequence: Synthetic oligonucleotide
ccgggccccatggatagagcagga

SEQ ID NO: 31554 - DNA, 24 bp, Artificial Sequence
  Description of Artificial Sequence: Synthetic oligonucleotide
cgggccccatggatagagcaggag

SEQ ID NO: 31555 - DNA, 24 bp, Artificial Sequence
  Description of Artificial Sequence: Synthetic oligonucleotide
gggccccatggatagagcaggagg

SEQ ID NO: 31556 - DNA, 24 bp, Artificial Sequence
  Description of Artificial Sequence: Synthetic oligonucleotide
ggccccatggatagagcaggaggg

SEQ ID NO: 31557 - DNA, 24 bp, Artificial Sequence
  Description of Artificial Sequence: Synthetic oligonucleotide
gccccatggatagagcaggagggg

SEQ ID NO: 31558 - DNA, 24 bp, Artificial Sequence
  Description of Artificial Sequence: Synthetic oligonucleotide
ccccatggatagagcaggaggggc

SEQ ID NO: 31559 - DNA, 24 bp, Artificial Sequence
  Description of Artificial Sequence: Synthetic oligonucleotide
cccatggatagagcaggaggggcc

SEQ ID NO: 31560 - DNA, 23 bp, Artificial Sequence
  Description of Artificial Sequence: Synthetic oligonucleotide
gggcgcttcctccgcgggcataa

SEQ ID NO: 31561 - DNA, 23 bp, Artificial Sequence
  Description of Artificial Sequence: Synthetic oligonucleotide
ggcgcttcctccgcgggcataac

SEQ ID NO: 31562 - DNA, 24 bp, Artificial Sequence
  Description of Artificial Sequence: Synthetic oligonucleotide
gcgcttcctccgcgggcataacca

SEQ ID NO: 31563 - DNA, 26 bp, Artificial Sequence
  Description of Artificial Sequence: Synthetic oligonucleotide
cgcttcctccgcgggcataaccagta

SEQ ID NO: 31564 - DNA, 26 bp, Artificial Sequence
  Description of Artificial Sequence: Synthetic oligonucleotide
gcttcctccgcgggcataaccagtac

SEQ ID NO: 31565 - DNA, 26 bp, Artificial Sequence
  Description of Artificial Sequence: Synthetic oligonucleotide
cttcctccgcgggcataaccagtacg

SEQ ID NO: 31566 - DNA, 26 bp, Artificial Sequence
  Description of Artificial Sequence: Synthetic oligonucleotide
ttcctccgcgggcataaccagtacgc

SEQ ID NO: 31567 - DNA, 23 bp, Artificial Sequence
  Description of Artificial Sequence: Synthetic oligonucleotide
gagagagcctgcggaacctgcgg

SEQ ID NO: 31568 - DNA, 23 bp, Artificial Sequence
  Description of Artificial Sequence: Synthetic oligonucleotide
agagagcctgcggaacctgcggg

SEQ ID NO: 31569 - DNA, 22 bp, Artificial Sequence
  Description of Artificial Sequence: Synthetic oligonucleotide
gagagcctgcggaacctgcggg

SEQ ID NO: 31570 - DNA, 22 bp, Artificial Sequence
  Description of Artificial Sequence: Synthetic oligonucleotide
agagcctgcggaacctgcgggg

SEQ ID NO: 31571 - DNA, 21 bp, Artificial Sequence
  Description of Artificial Sequence: Synthetic oligonucleotide
gagcctgcggaacctgcgggg

SEQ ID NO: 31572 - DNA, 23 bp, Artificial Sequence
  Description of Artificial Sequence: Synthetic oligonucleotide
agcctgcggaacctgcggggcta

SEQ ID NO: 31573 - DNA, 22 bp, Artificial Sequence
  Description of Artificial Sequence: Synthetic oligonucleotide
gcctgcggaacctgcggggcta

SEQ ID NO: 31574 - DNA, 24 bp, Artificial Sequence
  Description of Artificial Sequence: Synthetic oligonucleotide
cctgcggaacctgcggggctacta

SEQ ID NO: 31575 - DNA, 26 bp, Artificial Sequence
  Description of Artificial Sequence: Synthetic oligonucleotide
ctgcggaacctgcggggctactacaa

SEQ ID NO: 31576 - DNA, 26 bp, Artificial Sequence
  Description of Artificial Sequence: Synthetic oligonucleotide
tgcggaacctgcggggctactacaac

SEQ ID NO: 31577 - DNA, 25 bp, Artificial Sequence
  Description of Artificial Sequence: Synthetic oligonucleotide
gcggaacctgcggggctactacaac

SEQ ID NO: 31578 - DNA, 26 bp, Artificial Sequence
  Description of Artificial Sequence: Synthetic oligonucleotide
cggaacctgcggggctactacaacca

SEQ ID NO: 31579 - DNA, 27 bp, Artificial Sequence
  Description of Artificial Sequence: Synthetic oligonucleotide
ggaacctgcggggctactacaaccaga

SEQ ID NO: 31580 - DNA, 27 bp, Artificial Sequence
  Description of Artificial Sequence: Synthetic oligonucleotide
gaacctgcggggctactacaaccagag

SEQ ID NO: 31581 - DNA, 27 bp, Artificial Sequence
  Description of Artificial Sequence: Synthetic oligonucleotide
aacctgcggggctactacaaccagagc

SEQ ID NO: 31582 - DNA, 26 bp, Artificial Sequence
  Description of Artificial Sequence: Synthetic oligonucleotide
acctgcggggctactacaaccagagc

SEQ ID NO: 31583 - DNA, 25 bp, Artificial Sequence
  Description of Artificial Sequence: Synthetic oligonucleotide
cctgcggggctactacaaccagagc

SEQ ID NO: 31584 - DNA, 26 bp, Artificial Sequence
  Description of Artificial Sequence: Synthetic oligonucleotide
ctgcggggctactacaaccagagcga

SEQ ID NO: 31585 - DNA, 26 bp, Artificial Sequence
  Description of Artificial Sequence: Synthetic oligonucleotide
tgcggggctactacaaccagagcgag

SEQ ID NO: 31586 - DNA, 25 bp, Artificial Sequence
  Description of Artificial Sequence: Synthetic oligonucleotide
gcggggctactacaaccagagcgag

SEQ ID NO: 31587 - DNA, 25 bp, Artificial Sequence
  Description of Artificial Sequence: Synthetic oligonucleotide
cggggctactacaaccagagcgagg

SEQ ID NO: 31588 - DNA, 25 bp, Artificial Sequence
  Description of Artificial Sequence: Synthetic oligonucleotide
ggggctactacaaccagagcgaggc

SEQ ID NO: 31589 - DNA, 25 bp, Artificial Sequence
  Description of Artificial Sequence: Synthetic oligonucleotide
gggctactacaaccagagcgaggcc

SEQ ID NO: 31590 - DNA, 24 bp, Artificial Sequence
  Description of Artificial Sequence: Synthetic oligonucleotide
gcctgtgcgtggagtggctccgta

SEQ ID NO: 31591 - DNA, 27 bp, Artificial Sequence
  Description of Artificial Sequence: Synthetic oligonucleotide
cctgtgcgtggagtggctccgtagata

SEQ ID NO: 31592 - DNA, 27 bp, Artificial Sequence
  Description of Artificial Sequence: Synthetic oligonucleotide
ctgtgcgtggagtggctccgtagatac

SEQ ID NO: 31593 - DNA, 27 bp, Artificial Sequence
  Description of Artificial Sequence: Synthetic oligonucleotide
tgtgcgtggagtggctccgtagatacc

SEQ ID NO: 31594 - DNA, 27 bp, Artificial Sequence
  Description of Artificial Sequence: Synthetic oligonucleotide
gtgcgtggagtggctccgtagatacct

SEQ ID NO: 31595 - DNA, 27 bp, Artificial Sequence
  Description of Artificial Sequence: Synthetic oligonucleotide
tgcgtggagtggctccgtagatacctg

SEQ ID NO: 31596 - DNA, 26 bp, Artificial Sequence
  Description of Artificial Sequence: Synthetic oligonucleotide
gcgtggagtggctccgtagatacctg

SEQ ID NO: 31597 - DNA, 27 bp, Artificial Sequence
  Description of Artificial Sequence: Synthetic oligonucleotide
cgtggagtggctccgtagatacctgga

SEQ ID NO: 31598 - DNA, 27 bp, Artificial Sequence
  Description of Artificial Sequence: Synthetic oligonucleotide
gtggagtggctccgtagatacctggag

SEQ ID NO: 31599 - DNA, 29 bp, Artificial Sequence
  Description of Artificial Sequence: Synthetic oligonucleotide
tggagtggctccgtagatacctggagaac

SEQ ID NO: 31600 - DNA, 28 bp, Artificial Sequence
  Description of Artificial Sequence: Synthetic oligonucleotide
ggagtggctccgtagatacctggagaac

SEQ ID NO: 31601 - DNA, 28 bp, Artificial Sequence
  Description of Artificial Sequence: Synthetic oligonucleotide
gagtggctccgtagatacctggagaacg

SEQ ID NO: 31602 - DNA, 28 bp, Artificial Sequence
  Description of Artificial Sequence: Synthetic oligonucleotide
agtggctccgtagatacctggagaacgg

SEQ ID NO: 31603 - DNA, 27 bp, Artificial Sequence
  Description of Artificial Sequence: Synthetic oligonucleotide
gtggctccgtagatacctggagaacgg

SEQ ID NO: 31604 - DNA, 27 bp, Artificial Sequence
  Description of Artificial Sequence: Synthetic oligonucleotide
tggctccgtagatacctggagaacggg

SEQ ID NO: 31605 - DNA, 27 bp, Artificial Sequence
  Description of Artificial Sequence: Synthetic oligonucleotide
ggctccgtagatacctggagaacggga

SEQ ID NO: 31606 - DNA, 28 bp, Artificial Sequence
  Description of Artificial Sequence: Synthetic oligonucleotide
gctccgtagatacctggagaacgggaag

SEQ ID NO: 31607 - DNA, 28 bp, Artificial Sequence
  Description of Artificial Sequence: Synthetic oligonucleotide
ctccgtagatacctggagaacgggaagg

SEQ ID NO: 31608 - DNA, 29 bp, Artificial Sequence
  Description of Artificial Sequence: Synthetic oligonucleotide
tccgtagatacctggagaacgggaaggag

SEQ ID NO: 31609 - DNA, 28 bp, Artificial Sequence
  Description of Artificial Sequence: Synthetic oligonucleotide
ccgtagatacctggagaacgggaaggag

SEQ ID NO: 31610 - DNA, 29 bp, Artificial Sequence
  Description of Artificial Sequence: Synthetic oligonucleotide
cgtagatacctggagaacgggaaggagac

SEQ ID NO: 31611 - DNA, 29 bp, Artificial Sequence
  Description of Artificial Sequence: Synthetic oligonucleotide
gtagatacctggagaacgggaaggagacg

SEQ ID NO: 31612 - DNA, 29 bp, Artificial Sequence
  Description of Artificial Sequence: Synthetic oligonucleotide
tagatacctggagaacgggaaggagacgc

SEQ ID NO: 31613 - DNA, 33 bp, Artificial Sequence
  Description of Artificial Sequence: Synthetic oligonucleotide
aagaccaacacacagacttaccgagagagcttg

SEQ ID NO: 31614 - DNA, 32 bp, Artificial Sequence
  Description of Artificial Sequence: Synthetic oligonucleotide
agaccaacacacagacttaccgagagagcttg

SEQ ID NO: 31615 - DNA, 31 bp, Artificial Sequence
  Description of Artificial Sequence: Synthetic oligonucleotide
gaccaacacacagacttaccgagagagcttg

SEQ ID NO: 31616 - DNA, 31 bp, Artificial Sequence
  Description of Artificial Sequence: Synthetic oligonucleotide
accaacacacagacttaccgagagagcttgc

SEQ ID NO: 31617 - DNA, 30 bp, Artificial Sequence
  Description of Artificial Sequence: Synthetic oligonucleotide
ccaacacacagacttaccgagagagcttgc

SEQ ID NO: 31618 - DNA, 30 bp, Artificial Sequence
  Description of Artificial Sequence: Synthetic oligonucleotide
caacacacagacttaccgagagagcttgcg

SEQ ID NO: 31619 - DNA, 30 bp, Artificial Sequence
  Description of Artificial Sequence: Synthetic oligonucleotide
aacacacagacttaccgagagagcttgcgg

SEQ ID NO: 31620 - DNA, 29 bp, Artificial Sequence
  Description of Artificial Sequence: Synthetic oligonucleotide
acacacagacttaccgagagagcttgcgg

SEQ ID NO: 31621 - DNA, 28 bp, Artificial Sequence
  Description of Artificial Sequence: Synthetic oligonucleotide
cacacagacttaccgagagagcttgcgg

SEQ ID NO: 31622 - DNA, 30 bp, Artificial Sequence
  Description of Artificial Sequence: Synthetic oligonucleotide
acacagacttaccgagagagcttgcggaac

SEQ ID NO: 31623 - DNA, 29 bp, Artificial Sequence
  Description of Artificial Sequence: Synthetic oligonucleotide
cacagacttaccgagagagcttgcggaac

SEQ ID NO: 31624 - DNA, 29 bp, Artificial Sequence
  Description of Artificial Sequence: Synthetic oligonucleotide
acagacttaccgagagagcttgcggaacc

SEQ ID NO: 31625 - DNA, 28 bp, Artificial Sequence
  Description of Artificial Sequence: Synthetic oligonucleotide
cagacttaccgagagagcttgcggaacc

SEQ ID NO: 31626 - DNA, 29 bp, Artificial Sequence
  Description of Artificial Sequence: Synthetic oligonucleotide
agacttaccgagagagcttgcggaacctg

SEQ ID NO: 31627 - DNA, 28 bp, Artificial Sequence
  Description of Artificial Sequence: Synthetic oligonucleotide
gacttaccgagagagcttgcggaacctg

SEQ ID NO: 31628 - DNA, 28 bp, Artificial Sequence
  Description of Artificial Sequence: Synthetic oligonucleotide
acttaccgagagagcttgcggaacctgc

SEQ ID NO: 31629 - DNA, 27 bp, Artificial Sequence
  Description of Artificial Sequence: Synthetic oligonucleotide
cttaccgagagagcttgcggaacctgc

SEQ ID NO: 31630 - DNA, 27 bp, Artificial Sequence
  Description of Artificial Sequence: Synthetic oligonucleotide
ttaccgagagagcttgcggaacctgcg

SEQ ID NO: 31631 - DNA, 26 bp, Artificial Sequence
  Description of Artificial Sequence: Synthetic oligonucleotide
taccgagagagcttgcggaacctgcg

SEQ ID NO: 31632 - DNA, 27 bp, Artificial Sequence
  Description of Artificial Sequence: Synthetic oligonucleotide
cagtgggctacgtggacgacacccaat

SEQ ID NO: 31633 - DNA, 28 bp, Artificial Sequence
  Description of Artificial Sequence: Synthetic oligonucleotide
agtgggctacgtggacgacacccaattc

SEQ ID NO: 31634 - DNA, 27 bp, Artificial Sequence
  Description of Artificial Sequence: Synthetic oligonucleotide
gtgggctacgtggacgacacccaattc

SEQ ID NO: 31635 - DNA, 27 bp, Artificial Sequence
  Description of Artificial Sequence: Synthetic oligonucleotide
tgggctacgtggacgacacccaattcg

SEQ ID NO: 31636 - DNA, 27 bp, Artificial Sequence
  Description of Artificial Sequence: Synthetic oligonucleotide
gggctacgtggacgacacccaattcgt

SEQ ID NO: 31637 - DNA, 27 bp, Artificial Sequence
  Description of Artificial Sequence: Synthetic oligonucleotide
ggctacgtggacgacacccaattcgtg

SEQ ID NO: 31638 - DNA, 28 bp, Artificial Sequence
  Description of Artificial Sequence: Synthetic oligonucleotide
gctacgtggacgacacccaattcgtgag

SEQ ID NO: 31639 - DNA, 28 bp, Artificial Sequence
  Description of Artificial Sequence: Synthetic oligonucleotide
ctacgtggacgacacccaattcgtgagg

SEQ ID NO: 31640 - DNA, 30 bp, Artificial Sequence
  Description of Artificial Sequence: Synthetic oligonucleotide
tacgtggacgacacccaattcgtgaggttc

SEQ ID NO: 31641 - DNA, 29 bp, Artificial Sequence
  Description of Artificial Sequence: Synthetic oligonucleotide
acgtggacgacacccaattcgtgaggttc

SEQ ID NO: 31642 - DNA, 28 bp, Artificial Sequence
  Description of Artificial Sequence: Synthetic oligonucleotide
cgtggacgacacccaattcgtgaggttc

SEQ ID NO: 31643 - DNA, 28 bp, Artificial Sequence
  Description of Artificial Sequence: Synthetic oligonucleotide
gtggacgacacccaattcgtgaggttcg

SEQ ID NO: 31644 - DNA, 29 bp, Artificial Sequence
  Description of Artificial Sequence: Synthetic oligonucleotide
tggacgacacccaattcgtgaggttcgac

SEQ ID NO: 31645 - DNA, 28 bp, Artificial Sequence
  Description of Artificial Sequence: Synthetic oligonucleotide
ggacgacacccaattcgtgaggttcgac

SEQ ID NO: 31646 - DNA, 29 bp, Artificial Sequence
  Description of Artificial Sequence: Synthetic oligonucleotide
gacgacacccaattcgtgaggttcgacag

SEQ ID NO: 31647 - DNA, 29 bp, Artificial Sequence
  Description of Artificial Sequence: Synthetic oligonucleotide
acgacacccaattcgtgaggttcgacagc

SEQ ID NO: 31648 - DNA, 28 bp, Artificial Sequence
  Description of Artificial Sequence: Synthetic oligonucleotide
cgacacccaattcgtgaggttcgacagc

SEQ ID NO: 31649 - DNA, 28 bp, Artificial Sequence
  Description of Artificial Sequence: Synthetic oligonucleotide
gacacccaattcgtgaggttcgacagcg

SEQ ID NO: 31650 - DNA, 29 bp, Artificial Sequence
  Description of Artificial Sequence: Synthetic oligonucleotide
acacccaattcgtgaggttcgacagcgac

SEQ ID NO: 31651 - DNA, 28 bp, Artificial Sequence
  Description of Artificial Sequence: Synthetic oligonucleotide
cacccaattcgtgaggttcgacagcgac

SEQ ID NO: 31652 - DNA, 28 bp, Artificial Sequence
  Description of Artificial Sequence: Synthetic oligonucleotide
acccaattcgtgaggttcgacagcgacg

SEQ ID NO: 31653 - DNA, 27 bp, Artificial Sequence
  Description of Artificial Sequence: Synthetic oligonucleotide
cccaattcgtgaggttcgacagcgacg

SEQ ID NO: 31654 - DNA, 27 bp, Artificial Sequence
  Description of Artificial Sequence: Synthetic oligonucleotide
ccaattcgtgaggttcgacagcgacgc

SEQ ID NO: 31655 - DNA, 27 bp, Artificial Sequence
  Description of Artificial Sequence: Synthetic oligonucleotide
caattcgtgaggttcgacagcgacgcc

SEQ ID NO: 31656 - DNA, 27 bp, Artificial Sequence
  Description of Artificial Sequence: Synthetic oligonucleotide
aattcgtgaggttcgacagcgacgccg

SEQ ID NO: 31657 - DNA, 26 bp, Artificial Sequence
  Description of Artificial Sequence: Synthetic oligonucleotide
attcgtgaggttcgacagcgacgccg

SEQ ID NO: 31658 - DNA, 26 bp, Artificial Sequence
  Description of Artificial Sequence: Synthetic oligonucleotide
ctccagagcatgtacggctgcgacct

SEQ ID NO: 31659 - DNA, 27 bp, Artificial Sequence
  Description of Artificial Sequence: Synthetic oligonucleotide
tgtgcgtggagtggctccgcagatact

SEQ ID NO: 31660 - DNA, 23 bp, Artificial Sequence
  Description of Artificial Sequence: Synthetic oligonucleotide
tacaccgccatgtcccggcccgt

SEQ ID NO: 31661 - DNA, 22 bp, Artificial Sequence
  Description of Artificial Sequence: Synthetic oligonucleotide
acaccgccatgtcccggcccgt

SEQ ID NO: 31662 - DNA, 21 bp, Artificial Sequence
  Description of Artificial Sequence: Synthetic oligonucleotide
caccgccatgtcccggcccgt

SEQ ID NO: 31663 - DNA, 21 bp, Artificial Sequence
  Description of Artificial Sequence: Synthetic oligonucleotide
accgccatgtcccggcccgtc

SEQ ID NO: 31664 - DNA, 20 bp, Artificial Sequence
  Description of Artificial Sequence: Synthetic oligonucleotide
ccgccatgtcccggcccgtc

SEQ ID NO: 31665 - DNA, 20 bp, Artificial Sequence
  Description of Artificial Sequence: Synthetic oligonucleotide
cgccatgtcccggcccgtcc

SEQ ID NO: 31666 - DNA, 20 bp, Artificial Sequence
  Description of Artificial Sequence: Synthetic oligonucleotide
gccatgtcccggcccgtccg

SEQ ID NO: 31667 - DNA, 20 bp, Artificial Sequence
  Description of Artificial Sequence: Synthetic oligonucleotide
ccatgtcccggcccgtccgc

SEQ ID NO: 31668 - DNA, 20 bp, Artificial Sequence
  Description of Artificial Sequence: Synthetic oligonucleotide
catgtcccggcccgtccgcg

SEQ ID NO: 31669 - DNA, 20 bp, Artificial Sequence
  Description of Artificial Sequence: Synthetic oligonucleotide
atgtcccggcccgtccgcgg

SEQ ID NO: 31670 - DNA, 20 bp, Artificial Sequence
  Description of Artificial Sequence: Synthetic oligonucleotide
tgtcccggcccgtccgcggt

SEQ ID NO: 31671 - DNA, 20 bp, Artificial Sequence
  Description of Artificial Sequence: Synthetic oligonucleotide
gtcccggcccgtccgcggtt

SEQ ID NO: 31672 - DNA, 20 bp, Artificial Sequence
  Description of Artificial Sequence: Synthetic oligonucleotide
tcccggcccgtccgcgggtt

SEQ ID NO: 31673 - DNA, 20 bp, Artificial Sequence
  Description of Artificial Sequence: Synthetic oligonucleotide
cccggcccgtccgcgggttt

SEQ ID NO: 31674 - DNA, 20 bp, Artificial Sequence
  Description of Artificial Sequence: Synthetic oligonucleotide
ccggcccgtccgcggggatt

SEQ ID NO: 31675 - DNA, 20 bp, Artificial Sequence
  Description of Artificial Sequence: Synthetic oligonucleotide
cggcccgtccgcggggagtt

SEQ ID NO: 31676 - DNA, 20 bp, Artificial Sequence
  Description of Artificial Sequence: Synthetic oligonucleotide
ggcccgtccgcggggagctt

SEQ ID NO: 31677 - DNA, 20 bp, Artificial Sequence
  Description of Artificial Sequence: Synthetic oligonucleotide
gcccgtccgcggggagcctt

SEQ ID NO: 31678 - DNA, 20 bp, Artificial Sequence
  Description of Artificial Sequence: Synthetic oligonucleotide
cccgtccgcggggagccctt

SEQ ID NO: 31679 - DNA, 20 bp, Artificial Sequence
  Description of Artificial Sequence: Synthetic oligonucleotide
ccgtccgcggggagcccctt

SEQ ID NO: 31680 - DNA, 20 bp, Artificial Sequence
  Description of Artificial Sequence: Synthetic oligonucleotide
cgtccgcggggagccccgtt

SEQ ID NO: 31681 - DNA, 20 bp, Artificial Sequence
  Description of Artificial Sequence: Synthetic oligonucleotide
gtccgcggggagccccgctt

SEQ ID NO: 31682 - DNA, 22 bp, Artificial Sequence
  Description of Artificial Sequence: Synthetic oligonucleotide
tccgcggggagccccgcttcat

SEQ ID NO: 31683 - DNA, 25 bp, Artificial Sequence
  Description of Artificial Sequence: Synthetic oligonucleotide
ttcgacagcgacgccgcgagtccaa

SEQ ID NO: 31684 - DNA, 24 bp, Artificial Sequence
  Description of Artificial Sequence: Synthetic oligonucleotide
tcgacagcgacgccgcgagtccaa

SEQ ID NO: 31685 - DNA, 23 bp, Artificial Sequence
  Description of Artificial Sequence: Synthetic oligonucleotide
cgacagcgacgccgcgagtccaa

SEQ ID NO: 31686 - DNA, 23 bp, Artificial Sequence
  Description of Artificial Sequence: Synthetic oligonucleotide
gacagcgacgccgcgagtccaag

SEQ ID NO: 31687 - DNA, 24 bp, Artificial Sequence
  Description of Artificial Sequence: Synthetic oligonucleotide
acagcgacgccgcgagtccaagga

SEQ ID NO: 31688 - DNA, 23 bp, Artificial Sequence
  Description of Artificial Sequence: Synthetic oligonucleotide
cagcgacgccgcgagtccaagga

SEQ ID NO: 31689 - DNA, 23 bp, Artificial Sequence
  Description of Artificial Sequence: Synthetic oligonucleotide
agcgacgccgcgagtccaaggac

SEQ ID NO: 31690 - DNA, 22 bp, Artificial Sequence
  Description of Artificial Sequence: Synthetic oligonucleotide
gcgacgccgcgagtccaaggac

SEQ ID NO: 31691 - DNA, 22 bp, Artificial Sequence
  Description of Artificial Sequence: Synthetic oligonucleotide
cgacgccgcgagtccaaggacg

SEQ ID NO: 31692 - DNA, 23 bp, Artificial Sequence
  Description of Artificial Sequence: Synthetic oligonucleotide
gacgccgcgagtccaaggacgga

SEQ ID NO: 31693 - DNA, 23 bp, Artificial Sequence
  Description of Artificial Sequence: Synthetic oligonucleotide
acgccgcgagtccaaggacggag

SEQ ID NO: 31694 - DNA, 22 bp, Artificial Sequence
  Description of Artificial Sequence: Synthetic oligonucleotide
cgccgcgagtccaaggacggag

SEQ ID NO: 31695 - DNA, 22 bp, Artificial Sequence
  Description of Artificial Sequence: Synthetic oligonucleotide
gccgcgagtccaaggacggagc

SEQ ID NO: 31696 - DNA, 22 bp, Artificial Sequence
  Description of Artificial Sequence: Synthetic oligonucleotide
ccgcgagtccaaggacggagcc

SEQ ID NO: 31697 - DNA, 22 bp, Artificial Sequence
  Description of Artificial Sequence: Synthetic oligonucleotide
cgcgagtccaaggacggagccc

SEQ ID NO: 31698 - DNA, 22 bp, Artificial Sequence
  Description of Artificial Sequence: Synthetic oligonucleotide
gcgagtccaaggacggagcccc

SEQ ID NO: 31699 - DNA, 22 bp, Artificial Sequence
  Description of Artificial Sequence: Synthetic oligonucleotide
cgagtccaaggacggagccccg

SEQ ID NO: 31700 - DNA, 22 bp, Artificial Sequence
  Description of Artificial Sequence: Synthetic oligonucleotide
gagtccaaggacggagccccgg

SEQ ID NO: 31701 - DNA, 22 bp, Artificial Sequence
  Description of Artificial Sequence: Synthetic oligonucleotide
agtccaaggacggagccccggg

SEQ ID NO: 31702 - DNA, 21 bp, Artificial Sequence
  Description of Artificial Sequence: Synthetic oligonucleotide
gtccaaggacggagccccggg

SEQ ID NO: 31703 - DNA, 21 bp, Artificial Sequence
  Description of Artificial Sequence: Synthetic oligonucleotide
tccaaggacggagccccgggc

SEQ ID NO: 31704 - DNA, 20 bp, Artificial Sequence
  Description of Artificial Sequence: Synthetic oligonucleotide
ccaaggacggagccccgggc

SEQ ID NO: 31705 - DNA, 20 bp, Artificial Sequence
  Description of Artificial Sequence: Synthetic oligonucleotide
caaggacggagccccgggcg

SEQ ID NO: 31706 - DNA, 20 bp, Artificial Sequence
  Description of Artificial Sequence: Synthetic oligonucleotide
aaggacggagccccgggcgc

SEQ ID NO: 31707 - DNA, 23 bp, Artificial Sequence
  Description of Artificial Sequence: Synthetic oligonucleotide
ggaaggagacgctgcagcgcgca

SEQ ID NO: 31708 - DNA, 23 bp, Artificial Sequence
  Description of Artificial Sequence: Synthetic oligonucleotide
gaaggagacgctgcagcgcgcag

SEQ ID NO: 31709 - DNA, 23 bp, Artificial Sequence
  Description of Artificial Sequence: Synthetic oligonucleotide
gttcgacagcgacgccgcgagtg

SEQ ID NO: 31710 - DNA, 23 bp, Artificial Sequence
  Description of Artificial Sequence: Synthetic oligonucleotide
ttcgacagcgacgccgcgagtgc

SEQ ID NO: 31711 - DNA, 22 bp, Artificial Sequence
  Description of Artificial Sequence: Synthetic oligonucleotide
tcgacagcgacgccgcgagtgc

SEQ ID NO: 31712 - DNA, 21 bp, Artificial Sequence
  Description of Artificial Sequence: Synthetic oligonucleotide
cgacagcgacgccgcgagtgc

SEQ ID NO: 31713 - DNA, 22 bp, Artificial Sequence
  Description of Artificial Sequence: Synthetic oligonucleotide
gacagcgacgccgcgagtgcga

SEQ ID NO: 31714 - DNA, 22 bp, Artificial Sequence
  Description of Artificial Sequence: Synthetic oligonucleotide
acagcgacgccgcgagtgcgag

SEQ ID NO: 31715 - DNA, 21 bp, Artificial Sequence
  Description of Artificial Sequence: Synthetic oligonucleotide
cagcgacgccgcgagtgcgag

SEQ ID NO: 31716 - DNA, 22 bp, Artificial Sequence
  Description of Artificial Sequence: Synthetic oligonucleotide
agcgacgccgcgagtgcgagga

SEQ ID NO: 31717 - DNA, 21 bp, Artificial Sequence
  Description of Artificial Sequence: Synthetic oligonucleotide
gcgacgccgcgagtgcgagga

SEQ ID NO: 31718 - DNA, 21 bp, Artificial Sequence
  Description of Artificial Sequence: Synthetic oligonucleotide
cgacgccgcgagtgcgaggac

SEQ ID NO: 31719 - DNA, 21 bp, Artificial Sequence
  Description of Artificial Sequence: Synthetic oligonucleotide
gacgccgcgagtgcgaggacg

SEQ ID NO: 31720 - DNA, 22 bp, Artificial Sequence
  Description of Artificial Sequence: Synthetic oligonucleotide
acgccgcgagtgcgaggacgga

SEQ ID NO: 31721 - DNA, 21 bp, Artificial Sequence
  Description of Artificial Sequence: Synthetic oligonucleotide
cgccgcgagtgcgaggacgga

SEQ ID NO: 31722 - DNA, 21 bp, Artificial Sequence
  Description of Artificial Sequence: Synthetic oligonucleotide
gccgcgagtgcgaggacggag

SEQ ID NO: 31723 - DNA, 21 bp, Artificial Sequence
  Description of Artificial Sequence: Synthetic oligonucleotide
ccgcgagtgcgaggacggagc

SEQ ID NO: 31724 - DNA, 21 bp, Artificial Sequence
  Description of Artificial Sequence: Synthetic oligonucleotide
cgcgagtgcgaggacggagcc

SEQ ID NO: 31725 - DNA, 21 bp, Artificial Sequence
  Description of Artificial Sequence: Synthetic oligonucleotide
gcgagtgcgaggacggagccc

SEQ ID NO: 31726 - DNA, 21 bp, Artificial Sequence
  Description of Artificial Sequence: Synthetic oligonucleotide
cgagtgcgaggacggagcccc

SEQ ID NO: 31727 - DNA, 21 bp, Artificial Sequence
  Description of Artificial Sequence: Synthetic oligonucleotide
gagtgcgaggacggagccccg

SEQ ID NO: 31728 - DNA, 21 bp, Artificial Sequence
  Description of Artificial Sequence: Synthetic oligonucleotide
agtgcgaggacggagccccgg

SEQ ID NO: 31729 - DNA, 20 bp, Artificial Sequence
  Description of Artificial Sequence: Synthetic oligonucleotide
gtgcgaggacggagccccgg

SEQ ID NO: 31730 - DNA, 20 bp, Artificial Sequence
  Description of Artificial Sequence: Synthetic oligonucleotide
tgcgaggacggagccccggg

SEQ ID NO: 31731 - DNA, 20 bp, Artificial Sequence
  Description of Artificial Sequence: Synthetic oligonucleotide
gcgaggacggagccccgggt

SEQ ID NO: 31732 - DNA, 25 bp, Artificial Sequence
  Description of Artificial Sequence: Synthetic oligonucleotide
ggctactacaaccagagcgaggccc

SEQ ID NO: 31733 - DNA, 25 bp, Artificial Sequence
  Description of Artificial Sequence: Synthetic oligonucleotide
gctactacaaccagagcgaggcccg

SEQ ID NO: 31734 - DNA, 26 bp, Artificial Sequence
  Description of Artificial Sequence: Synthetic oligonucleotide
ctactacaaccagagcgaggcccggt

SEQ ID NO: 31735 - DNA, 27 bp, Artificial Sequence
  Description of Artificial Sequence: Synthetic oligonucleotide
tactacaaccagagcgaggcccggtct

SEQ ID NO: 31736 - DNA, 26 bp, Artificial Sequence
  Description of Artificial Sequence: Synthetic oligonucleotide
actacaaccagagcgaggcccggtct

SEQ ID NO: 31737 - DNA, 25 bp, Artificial Sequence
  Description of Artificial Sequence: Synthetic oligonucleotide
ctacaaccagagcgaggcccggtct

SEQ ID NO: 31738 - DNA, 26 bp, Artificial Sequence
  Description of Artificial Sequence: Synthetic oligonucleotide
tacaaccagagcgaggcccggtctca

SEQ ID NO: 31739 - DNA, 25 bp, Artificial Sequence
  Description of Artificial Sequence: Synthetic oligonucleotide
acaaccagagcgaggcccggtctca

SEQ ID NO: 31740 - DNA, 24 bp, Artificial Sequence
  Description of Artificial Sequence: Synthetic oligonucleotide
caaccagagcgaggcccggtctca

SEQ ID NO: 31741 - DNA, 26 bp, Artificial Sequence
  Description of Artificial Sequence: Synthetic oligonucleotide
aaccagagcgaggcccggtctcacat

SEQ ID NO: 31742 - DNA, 25 bp, Artificial Sequence
  Description of Artificial Sequence: Synthetic oligonucleotide
accagagcgaggcccggtctcacat

SEQ ID NO: 31743 - DNA, 24 bp, Artificial Sequence
  Description of Artificial Sequence: Synthetic oligonucleotide
ccagagcgaggcccggtctcacat

SEQ ID NO: 31744 - DNA, 26 bp, Artificial Sequence
  Description of Artificial Sequence: Synthetic oligonucleotide
cagagcgaggcccggtctcacatcat

SEQ ID NO: 31745 - DNA, 26 bp, Artificial Sequence
  Description of Artificial Sequence: Synthetic oligonucleotide
agagcgaggcccggtctcacatcatc

SEQ ID NO: 31746 - DNA, 25 bp, Artificial Sequence
  Description of Artificial Sequence: Synthetic oligonucleotide
gagcgaggcccggtctcacatcatc

SEQ ID NO: 31747 - DNA, 26 bp, Artificial Sequence
  Description of Artificial Sequence: Synthetic oligonucleotide
agcgaggcccggtctcacatcatcca

SEQ ID NO: 31748 - DNA, 25 bp, Artificial Sequence
  Description of Artificial Sequence: Synthetic oligonucleotide
gcgaggcccggtctcacatcatcca

SEQ ID NO: 31749 - DNA, 26 bp, Artificial Sequence
  Description of Artificial Sequence: Synthetic oligonucleotide
cgaggcccggtctcacatcatccaga

SEQ ID NO: 31750 - DNA, 26 bp, Artificial Sequence
  Description of Artificial Sequence: Synthetic oligonucleotide
gaggcccggtctcacatcatccagag

SEQ ID NO: 31751 - DNA, 27 bp, Artificial Sequence
  Description of Artificial Sequence: Synthetic oligonucleotide
aggcccggtctcacatcatccagagga

SEQ ID NO: 31752 - DNA, 27 bp, Artificial Sequence
  Description of Artificial Sequence: Synthetic oligonucleotide
ggcccggtctcacatcatccagaggat

SEQ ID NO: 31753 - DNA, 27 bp, Artificial Sequence
  Description of Artificial Sequence: Synthetic oligonucleotide
gcccggtctcacatcatccagaggatg

SEQ ID NO: 31754 - DNA, 30 bp, Artificial Sequence
  Description of Artificial Sequence: Synthetic oligonucleotide
cccggtctcacatcatccagaggatgtatg

SEQ ID NO: 31755 - DNA, 30 bp, Artificial Sequence
  Description of Artificial Sequence: Synthetic oligonucleotide
ccggtctcacatcatccagaggatgtatgg

SEQ ID NO: 31756 - DNA, 30 bp, Artificial Sequence
  Description of Artificial Sequence: Synthetic oligonucleotide
cggtctcacatcatccagaggatgtatggc

SEQ ID NO: 31757 - DNA, 27 bp, Artificial Sequence
  Description of Artificial Sequence: Synthetic oligonucleotide
caaccagagcgaggccaggtctcacat

SEQ ID NO: 31758 - DNA, 27 bp, Artificial Sequence
  Description of Artificial Sequence: Synthetic oligonucleotide
aaccagagcgaggccaggtctcacatc

SEQ ID NO: 31759 - DNA, 27 bp, Artificial Sequence
  Description of Artificial Sequence: Synthetic oligonucleotide
accagagcgaggccaggtctcacatca

SEQ ID NO: 31760 - DNA, 27 bp, Artificial Sequence
  Description of Artificial Sequence: Synthetic oligonucleotide
ccagagcgaggccaggtctcacatcat

SEQ ID NO: 31761 - DNA, 27 bp, Artificial Sequence
  Description of Artificial Sequence: Synthetic oligonucleotide
cagagcgaggccaggtctcacatcatc

SEQ ID NO: 31762 - DNA, 27 bp, Artificial Sequence
  Description of Artificial Sequence: Synthetic oligonucleotide
agagcgaggccaggtctcacatcatcc

SEQ ID NO: 31763 - DNA, 27 bp, Artificial Sequence
  Description of Artificial Sequence: Synthetic oligonucleotide
gagcgaggccaggtctcacatcatcca

SEQ ID NO: 31764 - DNA, 27 bp, Artificial Sequence
  Description of Artificial Sequence: Synthetic oligonucleotide
agcgaggccaggtctcacatcatccag

SEQ ID NO: 31765 - DNA, 27 bp, Artificial Sequence
  Description of Artificial Sequence: Synthetic oligonucleotide
gcgaggccaggtctcacatcatccaga

SEQ ID NO: 31766 - DNA, 27 bp, Artificial Sequence
  Description of Artificial Sequence: Synthetic oligonucleotide
cgaggccaggtctcacatcatccagag

SEQ ID NO: 31767 - DNA, 27 bp, Artificial Sequence
  Description of Artificial Sequence: Synthetic oligonucleotide
gaggccaggtctcacatcatccagagg

SEQ ID NO: 31768 - DNA, 29 bp, Artificial Sequence
  Description of Artificial Sequence: Synthetic oligonucleotide
aggccaggtctcacatcatccagaggatg

SEQ ID NO: 31769 - DNA, 28 bp, Artificial Sequence
  Description of Artificial Sequence: Synthetic oligonucleotide
ggccaggtctcacatcatccagaggatg

SEQ ID NO: 31770 - DNA, 31 bp, Artificial Sequence
  Description of Artificial Sequence: Synthetic oligonucleotide
gccaggtctcacatcatccagaggatgtatg

SEQ ID NO: 31771 - DNA, 31 bp, Artificial Sequence
  Description of Artificial Sequence: Synthetic oligonucleotide
ccaggtctcacatcatccagaggatgtatgg

SEQ ID NO: 31772 - DNA, 31 bp, Artificial Sequence
  Description of Artificial Sequence: Synthetic oligonucleotide
caggtctcacatcatccagaggatgtatggc

SEQ ID NO: 31773 - DNA, 32 bp, Artificial Sequence
  Description of Artificial Sequence: Synthetic oligonucleotide
aggtctcacatcatccagaggatgtatggctg

SEQ ID NO: 31774 - DNA, 27 bp, Artificial Sequence
  Description of Artificial Sequence: Synthetic oligonucleotide
cccagttcgtgaggttcgacagcgact

SEQ ID NO: 31775 - DNA, 27 bp, Artificial Sequence
  Description of Artificial Sequence: Synthetic oligonucleotide
ccagttcgtgaggttcgacagcgactc

SEQ ID NO: 31776 - DNA, 27 bp, Artificial Sequence
  Description of Artificial Sequence: Synthetic oligonucleotide
cagttcgtgaggttcgacagcgactcc

SEQ ID NO: 31777 - DNA, 27 bp, Artificial Sequence
  Description of Artificial Sequence: Synthetic oligonucleotide
agttcgtgaggttcgacagcgactccg

SEQ ID NO: 31778 - DNA, 26 bp, Artificial Sequence
  Description of Artificial Sequence: Synthetic oligonucleotide
gttcgtgaggttcgacagcgactccg

SEQ ID NO: 31779 - DNA, 26 bp, Artificial Sequence
  Description of Artificial Sequence: Synthetic oligonucleotide
ttcgtgaggttcgacagcgactccgc

SEQ ID NO: 31780 - DNA, 25 bp, Artificial Sequence
  Description of Artificial Sequence: Synthetic oligonucleotide
tcgtgaggttcgacagcgactccgc

SEQ ID NO: 31781 - DNA, 24 bp, Artificial Sequence
  Description of Artificial Sequence: Synthetic oligonucleotide
cgtgaggttcgacagcgactccgc

SEQ ID NO: 31782 - DNA, 25 bp, Artificial Sequence
  Description of Artificial Sequence: Synthetic oligonucleotide
gtgaggttcgacagcgactccgcga

SEQ ID NO: 31783 - DNA, 26 bp, Artificial Sequence
  Description of Artificial Sequence: Synthetic oligonucleotide
tgaggttcgacagcgactccgcgagt

SEQ ID NO: 31784 - DNA, 25 bp, Artificial Sequence
  Description of Artificial Sequence: Synthetic oligonucleotide
gaggttcgacagcgactccgcgagt

SEQ ID NO: 31785 - DNA, 25 bp, Artificial Sequence
  Description of Artificial Sequence: Synthetic oligonucleotide
aggttcgacagcgactccgcgagtc

SEQ ID NO: 31786 - DNA, 24 bp, Artificial Sequence
  Description of Artificial Sequence: Synthetic oligonucleotide
ggttcgacagcgactccgcgagtc

SEQ ID NO: 31787 - DNA, 24 bp, Artificial Sequence
  Description of Artificial Sequence: Synthetic oligonucleotide
gttcgacagcgactccgcgagtcc

SEQ ID NO: 31788 - DNA, 25 bp, Artificial Sequence
  Description of Artificial Sequence: Synthetic oligonucleotide
ttcgacagcgactccgcgagtccga

SEQ ID NO: 31789 - DNA, 24 bp, Artificial Sequence
  Description of Artificial Sequence: Synthetic oligonucleotide
tcgacagcgactccgcgagtccga

SEQ ID NO: 31790 - DNA, 23 bp, Artificial Sequence
  Description of Artificial Sequence: Synthetic oligonucleotide
cgacagcgactccgcgagtccga

SEQ ID NO: 31791 - DNA, 23 bp, Artificial Sequence
  Description of Artificial Sequence: Synthetic oligonucleotide
gacagcgactccgcgagtccgag

SEQ ID NO: 31792 - DNA, 24 bp, Artificial Sequence
  Description of Artificial Sequence: Synthetic oligonucleotide
acagcgactccgcgagtccgagga

SEQ ID NO: 31793 - DNA, 23 bp, Artificial Sequence
  Description of Artificial Sequence: Synthetic oligonucleotide
cagcgactccgcgagtccgagga

SEQ ID NO: 31794 - DNA, 23 bp, Artificial Sequence
  Description of Artificial Sequence: Synthetic oligonucleotide
agcgactccgcgagtccgaggac

SEQ ID NO: 31795 - DNA, 22 bp, Artificial Sequence
  Description of Artificial Sequence: Synthetic oligonucleotide
gcgactccgcgagtccgaggac

SEQ ID NO: 31796 - DNA, 22 bp, Artificial Sequence
  Description of Artificial Sequence: Synthetic oligonucleotide
cgactccgcgagtccgaggacg

SEQ ID NO: 31797 - DNA, 23 bp, Artificial Sequence
  Description of Artificial Sequence: Synthetic oligonucleotide
gactccgcgagtccgaggacgga

SEQ ID NO: 31798 - DNA, 23 bp, Artificial Sequence
  Description of Artificial Sequence: Synthetic oligonucleotide
actccgcgagtccgaggacggag

SEQ ID NO: 31799 - DNA, 22 bp, Artificial Sequence
  Description of Artificial Sequence: Synthetic oligonucleotide
ctccgcgagtccgaggacggag

SEQ ID NO: 31800 - DNA, 22 bp, Artificial Sequence
  Description of Artificial Sequence: Synthetic oligonucleotide
tccgcgagtccgaggacggagc

SEQ ID NO: 31801 - DNA, 24 bp, Artificial Sequence
  Description of Artificial Sequence: Synthetic oligonucleotide
acagcgacgccgcgagtctgagga

SEQ ID NO: 31802 - DNA, 23 bp, Artificial Sequence
  Description of Artificial Sequence: Synthetic oligonucleotide
cagcgacgccgcgagtctgagga

SEQ ID NO: 31803 - DNA, 23 bp, Artificial Sequence
  Description of Artificial Sequence: Synthetic oligonucleotide
agcgacgccgcgagtctgaggac

SEQ ID NO: 31804 - DNA, 22 bp, Artificial Sequence
  Description of Artificial Sequence: Synthetic oligonucleotide
gcgacgccgcgagtctgaggac

SEQ ID NO: 31805 - DNA, 22 bp, Artificial Sequence
  Description of Artificial Sequence: Synthetic oligonucleotide
cgacgccgcgagtctgaggacg

SEQ ID NO: 31806 - DNA, 23 bp, Artificial Sequence
  Description of Artificial Sequence: Synthetic oligonucleotide
gacgccgcgagtctgaggacgga

SEQ ID NO: 31807 - DNA, 23 bp, Artificial Sequence
  Description of Artificial Sequence: Synthetic oligonucleotide
acgccgcgagtctgaggacggag

SEQ ID NO: 31808 - DNA, 22 bp, Artificial Sequence
  Description of Artificial Sequence: Synthetic oligonucleotide
cgccgcgagtctgaggacggag

SEQ ID NO: 31809 - DNA, 22 bp, Artificial Sequence
  Description of Artificial Sequence: Synthetic oligonucleotide
gccgcgagtctgaggacggagc

SEQ ID NO: 31810 - DNA, 22 bp, Artificial Sequence
  Description of Artificial Sequence: Synthetic oligonucleotide
ccgcgagtctgaggacggagcc

SEQ ID NO: 31811 - DNA, 22 bp, Artificial Sequence
  Description of Artificial Sequence: Synthetic oligonucleotide
cgcgagtctgaggacggagccc

SEQ ID NO: 31812 - DNA, 22 bp, Artificial Sequence
  Description of Artificial Sequence: Synthetic oligonucleotide
gcgagtctgaggacggagcccc

SEQ ID NO: 31813 - DNA, 22 bp, Artificial Sequence
  Description of Artificial Sequence: Synthetic oligonucleotide
cgagtctgaggacggagccccg

SEQ ID NO: 31814 - DNA, 22 bp, Artificial Sequence
  Description of Artificial Sequence: Synthetic oligonucleotide
gagtctgaggacggagccccgg

SEQ ID NO: 31815 - DNA, 22 bp, Artificial Sequence
  Description of Artificial Sequence: Synthetic oligonucleotide
agtctgaggacggagccccggg

SEQ ID NO: 31816 - DNA, 21 bp, Artificial Sequence
  Description of Artificial Sequence: Synthetic oligonucleotide
gtctgaggacggagccccggg

SEQ ID NO: 31817 - DNA, 21 bp, Artificial Sequence
  Description of Artificial Sequence: Synthetic oligonucleotide
tctgaggacggagccccgggc

SEQ ID NO: 31818 - DNA, 20 bp, Artificial Sequence
  Description of Artificial Sequence: Synthetic oligonucleotide
ctgaggacggagccccgggc

SEQ ID NO: 31819 - DNA, 20 bp, Artificial Sequence
  Description of Artificial Sequence: Synthetic oligonucleotide
tgaggacggagccccgggcg

SEQ ID NO: 31820 - DNA, 24 bp, Artificial Sequence
  Description of Artificial Sequence: Synthetic oligonucleotide
agcctacctggagggcctgtgcct

SEQ ID NO: 31821 - DNA, 23 bp, Artificial Sequence
  Description of Artificial Sequence: Synthetic oligonucleotide
gcctacctggagggcctgtgcct

SEQ ID NO: 31822 - DNA, 23 bp, Artificial Sequence
  Description of Artificial Sequence: Synthetic oligonucleotide
cctacctggagggcctgtgcctg

SEQ ID NO: 31823 - DNA, 24 bp, Artificial Sequence
  Description of Artificial Sequence: Synthetic oligonucleotide
ctacctggagggcctgtgcctgga

SEQ ID NO: 31824 - DNA, 25 bp, Artificial Sequence
  Description of Artificial Sequence: Synthetic oligonucleotide
tacctggagggcctgtgcctggagt

SEQ ID NO: 31825 - DNA, 24 bp, Artificial Sequence
  Description of Artificial Sequence: Synthetic oligonucleotide
acctggagggcctgtgcctggagt

SEQ ID NO: 31826 - DNA, 23 bp, Artificial Sequence
  Description of Artificial Sequence: Synthetic oligonucleotide
cctggagggcctgtgcctggagt

SEQ ID NO: 31827 - DNA, 23 bp, Artificial Sequence
  Description of Artificial Sequence: Synthetic oligonucleotide
ctggagggcctgtgcctggagtg

SEQ ID NO: 31828 - DNA, 23 bp, Artificial Sequence
  Description of Artificial Sequence: Synthetic oligonucleotide
tggagggcctgtgcctggagtgg

SEQ ID NO: 31829 - DNA, 22 bp, Artificial Sequence
  Description of Artificial Sequence: Synthetic oligonucleotide
ggagggcctgtgcctggagtgg

SEQ ID NO: 31830 - DNA, 23 bp, Artificial Sequence
  Description of Artificial Sequence: Synthetic oligonucleotide
gagggcctgtgcctggagtggct

SEQ ID NO: 31831 - DNA, 23 bp, Artificial Sequence
  Description of Artificial Sequence: Synthetic oligonucleotide
agggcctgtgcctggagtggctc

SEQ ID NO: 31832 - DNA, 22 bp, Artificial Sequence
  Description of Artificial Sequence: Synthetic oligonucleotide
gggcctgtgcctggagtggctc

SEQ ID NO: 31833 - DNA, 22 bp, Artificial Sequence
  Description of Artificial Sequence: Synthetic oligonucleotide
ggcctgtgcctggagtggctcc

SEQ ID NO: 31834 - DNA, 22 bp, Artificial Sequence
  Description of Artificial Sequence: Synthetic oligonucleotide
gcctgtgcctggagtggctccg

SEQ ID NO: 31835 - DNA, 23 bp, Artificial Sequence
  Description of Artificial Sequence: Synthetic oligonucleotide
cctgtgcctggagtggctccgca

SEQ ID NO: 31836 - DNA, 26 bp, Artificial Sequence
  Description of Artificial Sequence: Synthetic oligonucleotide
ctgtgcctggagtggctccgcagata

SEQ ID NO: 31837 - DNA, 26 bp, Artificial Sequence
  Description of Artificial Sequence: Synthetic oligonucleotide
tgtgcctggagtggctccgcagatac

SEQ ID NO: 31838 - DNA, 25 bp, Artificial Sequence
  Description of Artificial Sequence: Synthetic oligonucleotide
gatgtatggctgcgacctggggtcc

SEQ ID NO: 31839 - DNA, 26 bp, Artificial Sequence
  Description of Artificial Sequence: Synthetic oligonucleotide
atgtatggctgcgacctggggtccga

SEQ ID NO: 31840 - DNA, 25 bp, Artificial Sequence
  Description of Artificial Sequence: Synthetic oligonucleotide
tgtatggctgcgacctggggtccga

SEQ ID NO: 31841 - DNA, 24 bp, Artificial Sequence
  Description of Artificial Sequence: Synthetic oligonucleotide
gtatggctgcgacctggggtccga

SEQ ID NO: 31842 - DNA, 24 bp, Artificial Sequence
  Description of Artificial Sequence: Synthetic oligonucleotide
tatggctgcgacctggggtccgac

SEQ ID NO: 31843 - DNA, 23 bp, Artificial Sequence
  Description of Artificial Sequence: Synthetic oligonucleotide
atggctgcgacctggggtccgac

SEQ ID NO: 31844 - DNA, 22 bp, Artificial Sequence
  Description of Artificial Sequence: Synthetic oligonucleotide
tggctgcgacctggggtccgac

SEQ ID NO: 31845 - DNA, 21 bp, Artificial Sequence
  Description of Artificial Sequence: Synthetic oligonucleotide
ggctgcgacctggggtccgac

SEQ ID NO: 31846 - DNA, 21 bp, Artificial Sequence
  Description of Artificial Sequence: Synthetic oligonucleotide
gctgcgacctggggtccgacg

SEQ ID NO: 31847 - DNA, 21 bp, Artificial Sequence
  Description of Artificial Sequence: Synthetic oligonucleotide
ctgcgacctggggtccgacgg

SEQ ID NO: 31848 - DNA, 21 bp, Artificial Sequence
  Description of Artificial Sequence: Synthetic oligonucleotide
tgcgacctggggtccgacggg

SEQ ID NO: 31849 - DNA, 20 bp, Artificial Sequence
  Description of Artificial Sequence: Synthetic oligonucleotide
gcgacctggggtccgacggg

SEQ ID NO: 31850 - DNA, 20 bp, Artificial Sequence
  Description of Artificial Sequence: Synthetic oligonucleotide
cgacctggggtccgacgggc

SEQ ID NO: 31851 - DNA, 20 bp, Artificial Sequence
  Description of Artificial Sequence: Synthetic oligonucleotide
gacctggggtccgacgggcg

SEQ ID NO: 31852 - DNA, 20 bp, Artificial Sequence
  Description of Artificial Sequence: Synthetic oligonucleotide
acctggggtccgacgggcgc

SEQ ID NO: 31853 - DNA, 20 bp, Artificial Sequence
  Description of Artificial Sequence: Synthetic oligonucleotide
cctggggtccgacgggcgct

SEQ ID NO: 31854 - DNA, 20 bp, Artificial Sequence
  Description of Artificial Sequence: Synthetic oligonucleotide
ctggggtccgacgggcgcct

SEQ ID NO: 31855 - DNA, 20 bp, Artificial Sequence
  Description of Artificial Sequence: Synthetic oligonucleotide
tggggtccgacgggcgcctc

SEQ ID NO: 31856 - DNA, 20 bp, Artificial Sequence
  Description of Artificial Sequence: Synthetic oligonucleotide
ggggtccgacgggcgcctct

SEQ ID NO: 31857 - DNA, 20 bp, Artificial Sequence
  Description of Artificial Sequence: Synthetic oligonucleotide
gggtccgacgggcgcctcct

SEQ ID NO: 31858 - DNA, 20 bp, Artificial Sequence
  Description of Artificial Sequence: Synthetic oligonucleotide
ggtccgacgggcgcctcctc

SEQ ID NO: 31859 - DNA, 20 bp, Artificial Sequence
  Description of Artificial Sequence: Synthetic oligonucleotide
gtccgacgggcgcctcctcc

SEQ ID NO: 31860 - DNA, 20 bp, Artificial Sequence
  Description of Artificial Sequence: Synthetic oligonucleotide
tccgacgggcgcctcctccg

SEQ ID NO: 31861 - DNA, 22 bp, Artificial Sequence
  Description of Artificial Sequence: Synthetic oligonucleotide
cctgcggaacctgcgcggctac

SEQ ID NO: 31862 - DNA, 23 bp, Artificial Sequence
  Description of Artificial Sequence: Synthetic oligonucleotide
ctgcggaacctgcgcggctacca

SEQ ID NO: 31863 - DNA, 25 bp, Artificial Sequence
  Description of Artificial Sequence: Synthetic oligonucleotide
tgcggaacctgcgcggctaccacaa

SEQ ID NO: 31864 - DNA, 24 bp, Artificial Sequence
  Description of Artificial Sequence: Synthetic oligonucleotide
gcggaacctgcgcggctaccacaa

SEQ ID NO: 31865 - DNA, 24 bp, Artificial Sequence
  Description of Artificial Sequence: Synthetic oligonucleotide
cggaacctgcgcggctaccacaac

SEQ ID NO: 31866 - DNA, 25 bp, Artificial Sequence
  Description of Artificial Sequence: Synthetic oligonucleotide
ggaacctgcgcggctaccacaacca

SEQ ID NO: 31867 - DNA, 26 bp, Artificial Sequence
  Description of Artificial Sequence: Synthetic oligonucleotide
gaacctgcgcggctaccacaaccaga

SEQ ID NO: 31868 - DNA, 26 bp, Artificial Sequence
  Description of Artificial Sequence: Synthetic oligonucleotide
aacctgcgcggctaccacaaccagag

SEQ ID NO: 31869 - DNA, 25 bp, Artificial Sequence
  Description of Artificial Sequence: Synthetic oligonucleotide
acctgcgcggctaccacaaccagag

SEQ ID NO: 31870 - DNA, 24 bp, Artificial Sequence
  Description of Artificial Sequence: Synthetic oligonucleotide
ctaccacaaccagagcgaggccgg

SEQ ID NO: 31871 - DNA, 25 bp, Artificial Sequence
  Description of Artificial Sequence: Synthetic oligonucleotide
taccacaaccagagcgaggccgggt

SEQ ID NO: 31872 - DNA, 24 bp, Artificial Sequence
  Description of Artificial Sequence: Synthetic oligonucleotide
accacaaccagagcgaggccgggt

SEQ ID NO: 31873 - DNA, 23 bp, Artificial Sequence
  Description of Artificial Sequence: Synthetic oligonucleotide
ccacaaccagagcgaggccgggt

SEQ ID NO: 31874 - DNA, 20 bp, Artificial Sequence
  Description of Artificial Sequence: Synthetic oligonucleotide
ccgcggggagccccgccttt

SEQ ID NO: 31875 - DNA, 20 bp, Artificial Sequence
  Description of Artificial Sequence: Synthetic oligonucleotide
cgcggggagccccgcctcat

SEQ ID NO: 31876 - DNA, 20 bp, Artificial Sequence
  Description of Artificial Sequence: Synthetic oligonucleotide
gcggggagccccgcctcatc

SEQ ID NO: 31877 - DNA, 20 bp, Artificial Sequence
  Description of Artificial Sequence: Synthetic oligonucleotide
cggggagccccgcctcatcg

SEQ ID NO: 31878 - DNA, 21 bp, Artificial Sequence
  Description of Artificial Sequence: Synthetic oligonucleotide
ggggagccccgcctcatcgca

SEQ ID NO: 31879 - DNA, 22 bp, Artificial Sequence
  Description of Artificial Sequence: Synthetic oligonucleotide
gggagccccgcctcatcgcagt

SEQ ID NO: 31880 - DNA, 22 bp, Artificial Sequence
  Description of Artificial Sequence: Synthetic oligonucleotide
ggagccccgcctcatcgcagtg

SEQ ID NO: 31881 - DNA, 22 bp, Artificial Sequence
  Description of Artificial Sequence: Synthetic oligonucleotide
gagccccgcctcatcgcagtgg

SEQ ID NO: 31882 - DNA, 22 bp, Artificial Sequence
  Description of Artificial Sequence: Synthetic oligonucleotide
agccccgcctcatcgcagtggg

SEQ ID NO: 31883 - DNA, 21 bp, Artificial Sequence
  Description of Artificial Sequence: Synthetic oligonucleotide
gccccgcctcatcgcagtggg

SEQ ID NO: 31884 - DNA, 23 bp, Artificial Sequence
  Description of Artificial Sequence: Synthetic oligonucleotide
ccccgcctcatcgcagtgggcta

SEQ ID NO: 31885 - DNA, 23 bp, Artificial Sequence
  Description of Artificial Sequence: Synthetic oligonucleotide
cccgcctcatcgcagtgggctac

SEQ ID NO: 31886 - DNA, 24 bp, Artificial Sequence
  Description of Artificial Sequence: Synthetic oligonucleotide
ccgcctcatcgcagtgggctacgt

SEQ ID NO: 31887 - DNA, 24 bp, Artificial Sequence
  Description of Artificial Sequence: Synthetic oligonucleotide
cgcctcatcgcagtgggctacgtg

SEQ ID NO: 31888 - DNA, 25 bp, Artificial Sequence
  Description of Artificial Sequence: Synthetic oligonucleotide
gcctcatcgcagtgggctacgtgga

SEQ ID NO: 31889 - DNA, 25 bp, Artificial Sequence
  Description of Artificial Sequence: Synthetic oligonucleotide
cctcatcgcagtgggctacgtggac

SEQ ID NO: 31890 - DNA, 26 bp, Artificial Sequence
  Description of Artificial Sequence: Synthetic oligonucleotide
ctcatcgcagtgggctacgtggacga

SEQ ID NO: 31891 - DNA, 27 bp, Artificial Sequence
  Description of Artificial Sequence: Synthetic oligonucleotide
gtggacgacacccagttcgtgaggttg

SEQ ID NO: 31892 - DNA, 27 bp, Artificial Sequence
  Description of Artificial Sequence: Synthetic oligonucleotide
tggacgacacccagttcgtgaggttgg

SEQ ID NO: 31893 - DNA, 27 bp, Artificial Sequence
  Description of Artificial Sequence: Synthetic oligonucleotide
ggacgacacccagttcgtgaggttgga

SEQ ID NO: 31894 - DNA, 27 bp, Artificial Sequence
  Description of Artificial Sequence: Synthetic oligonucleotide
gacgacacccagttcgtgaggttggac

SEQ ID NO: 31895 - DNA, 28 bp, Artificial Sequence
  Description of Artificial Sequence: Synthetic oligonucleotide
acgacacccagttcgtgaggttggacag

SEQ ID NO: 31896 - DNA, 27 bp, Artificial Sequence
  Description of Artificial Sequence: Synthetic oligonucleotide
cgacacccagttcgtgaggttggacag

SEQ ID NO: 31897 - DNA, 27 bp, Artificial Sequence
  Description of Artificial Sequence: Synthetic oligonucleotide
gacacccagttcgtgaggttggacagc

SEQ ID NO: 31898 - DNA, 27 bp, Artificial Sequence
  Description of Artificial Sequence: Synthetic oligonucleotide
acacccagttcgtgaggttggacagcg

SEQ ID NO: 31899 - DNA, 27 bp, Artificial Sequence
  Description of Artificial Sequence: Synthetic oligonucleotide
cacccagttcgtgaggttggacagcga

SEQ ID NO: 31900 - DNA, 27 bp, Artificial Sequence
  Description of Artificial Sequence: Synthetic oligonucleotide
acccagttcgtgaggttggacagcgac

SEQ ID NO: 31901 - DNA, 26 bp, Artificial Sequence
  Description of Artificial Sequence: Synthetic oligonucleotide
cccagttcgtgaggttggacagcgac

SEQ ID NO: 31902 - DNA, 26 bp, Artificial Sequence
  Description of Artificial Sequence: Synthetic oligonucleotide
ccagttcgtgaggttggacagcgacg

SEQ ID NO: 31903 - DNA, 26 bp, Artificial Sequence
  Description of Artificial Sequence: Synthetic oligonucleotide
acgtggacgacacccagttcgtgagg

SEQ ID NO: 31904 - DNA, 25 bp, Artificial Sequence
  Description of Artificial Sequence: Synthetic oligonucleotide
cgtggacgacacccagttcgtgagg

SEQ ID NO: 31905 - DNA, 26 bp, Artificial Sequence
  Description of Artificial Sequence: Synthetic oligonucleotide
gtggacgacacccagttcgtgaggct

SEQ ID NO: 31906 - DNA, 26 bp, Artificial Sequence
  Description of Artificial Sequence: Synthetic oligonucleotide
tggacgacacccagttcgtgaggctc

SEQ ID NO: 31907 - DNA, 25 bp, Artificial Sequence
  Description of Artificial Sequence: Synthetic oligonucleotide
ggacgacacccagttcgtgaggctc

SEQ ID NO: 31908 - DNA, 26 bp, Artificial Sequence
  Description of Artificial Sequence: Synthetic oligonucleotide
gacgacacccagttcgtgaggctcga

SEQ ID NO: 31909 - DNA, 27 bp, Artificial Sequence
  Description of Artificial Sequence: Synthetic oligonucleotide
acgacacccagttcgtgaggctcgaca

SEQ ID NO: 31910 - DNA, 26 bp, Artificial Sequence
  Description of Artificial Sequence: Synthetic oligonucleotide
cgacacccagttcgtgaggctcgaca

SEQ ID NO: 31911 - DNA, 26 bp, Artificial Sequence
  Description of Artificial Sequence: Synthetic oligonucleotide
gacacccagttcgtgaggctcgacag

SEQ ID NO: 31912 - DNA, 26 bp, Artificial Sequence
  Description of Artificial Sequence: Synthetic oligonucleotide
acacccagttcgtgaggctcgacagc

SEQ ID NO: 31913 - DNA, 25 bp, Artificial Sequence
  Description of Artificial Sequence: Synthetic oligonucleotide
cacccagttcgtgaggctcgacagc

SEQ ID NO: 31914 - DNA, 26 bp, Artificial Sequence
  Description of Artificial Sequence: Synthetic oligonucleotide
acccagttcgtgaggctcgacagcga

SEQ ID NO: 31915 - DNA, 25 bp, Artificial Sequence
  Description of Artificial Sequence: Synthetic oligonucleotide
cccagttcgtgaggctcgacagcga

SEQ ID NO: 31916 - DNA, 25 bp, Artificial Sequence
  Description of Artificial Sequence: Synthetic oligonucleotide
ccagttcgtgaggctcgacagcgac

SEQ ID NO: 31917 - DNA, 25 bp, Artificial Sequence
  Description of Artificial Sequence: Synthetic oligonucleotide
cagttcgtgaggctcgacagcgacg

SEQ ID NO: 31918 - DNA, 25 bp, Artificial Sequence
  Description of Artificial Sequence: Synthetic oligonucleotide
agttcgtgaggctcgacagcgacgc

SEQ ID NO: 31919 - DNA, 24 bp, Artificial Sequence
  Description of Artificial Sequence: Synthetic oligonucleotide
gttcgtgaggctcgacagcgacgc

SEQ ID NO: 31920 - DNA, 24 bp, Artificial Sequence
  Description of Artificial Sequence: Synthetic oligonucleotide
ttcgtgaggctcgacagcgacgcc

SEQ ID NO: 31921 - DNA, 23 bp, Artificial Sequence
  Description of Artificial Sequence: Synthetic oligonucleotide
tcgtgaggctcgacagcgacgcc

SEQ ID NO: 31922 - DNA, 22 bp, Artificial Sequence
  Description of Artificial Sequence: Synthetic oligonucleotide
cgtgaggctcgacagcgacgcc

SEQ ID NO: 31923 - DNA, 22 bp, Artificial Sequence
  Description of Artificial Sequence: Synthetic oligonucleotide
gtgaggctcgacagcgacgccg

SEQ ID NO: 31924 - DNA, 22 bp, Artificial Sequence
  Description of Artificial Sequence: Synthetic oligonucleotide
tgaggctcgacagcgacgccgc

SEQ ID NO: 31925 - DNA, 21 bp, Artificial Sequence
  Description of Artificial Sequence: Synthetic oligonucleotide
gaggctcgacagcgacgccgc

SEQ ID NO: 31926 - DNA, 22 bp, Artificial Sequence
  Description of Artificial Sequence: Synthetic oligonucleotide
aggctcgacagcgacgccgcga

SEQ ID NO: 31927 - DNA, 21 bp, Artificial Sequence
  Description of Artificial Sequence: Synthetic oligonucleotide
ggctcgacagcgacgccgcga

SEQ ID NO: 31928 - DNA, 22 bp, Artificial Sequence
  Description of Artificial Sequence: Synthetic oligonucleotide
gctcgacagcgacgccgcgagt

SEQ ID NO: 31929 - DNA, 22 bp, Artificial Sequence
  Description of Artificial Sequence: Synthetic oligonucleotide
ctcgacagcgacgccgcgagtc

SEQ ID NO: 31930 - DNA, 25 bp, Artificial Sequence
  Description of Artificial Sequence: Synthetic oligonucleotide
acaccgcggctcagatcacccagca

SEQ ID NO: 31931 - DNA, 24 bp, Artificial Sequence
  Description of Artificial Sequence: Synthetic oligonucleotide
caccgcggctcagatcacccagca

SEQ ID NO: 31932 - DNA, 26 bp, Artificial Sequence
  Description of Artificial Sequence: Synthetic oligonucleotide
accgcggctcagatcacccagcacaa

SEQ ID NO: 31933 - DNA, 25 bp, Artificial Sequence
  Description of Artificial Sequence: Synthetic oligonucleotide
ccgcggctcagatcacccagcacaa

SEQ ID NO: 31934 - DNA, 26 bp, Artificial Sequence
  Description of Artificial Sequence: Synthetic oligonucleotide
cgcggctcagatcacccagcacaagt

SEQ ID NO: 31935 - DNA, 26 bp, Artificial Sequence
  Description of Artificial Sequence: Synthetic oligonucleotide
gatagagcaggaggggccggagtatg

SEQ ID NO: 31936 - DNA, 26 bp, Artificial Sequence
  Description of Artificial Sequence: Synthetic oligonucleotide
atagagcaggaggggccggagtatgg

SEQ ID NO: 31937 - DNA, 25 bp, Artificial Sequence
  Description of Artificial Sequence: Synthetic oligonucleotide
tagagcaggaggggccggagtatgg

SEQ ID NO: 31938 - DNA, 24 bp, Artificial Sequence
  Description of Artificial Sequence: Synthetic oligonucleotide
agagcaggaggggccggagtatgg

SEQ ID NO: 31939 - DNA, 23 bp, Artificial Sequence
  Description of Artificial Sequence: Synthetic oligonucleotide
gagcaggaggggccggagtatgg

SEQ ID NO: 31940 - DNA, 23 bp, Artificial Sequence
  Description of Artificial Sequence: Synthetic oligonucleotide
agcaggaggggccggagtatggg

SEQ ID NO: 31941 - DNA, 22 bp, Artificial Sequence
  Description of Artificial Sequence: Synthetic oligonucleotide
gcaggaggggccggagtatggg

SEQ ID NO: 31942 - DNA, 23 bp, Artificial Sequence
  Description of Artificial Sequence: Synthetic oligonucleotide
caggaggggccggagtatgggga

SEQ ID NO: 31943 - DNA, 23 bp, Artificial Sequence
  Description of Artificial Sequence: Synthetic oligonucleotide
aggaggggccggagtatggggac

SEQ ID NO: 31944 - DNA, 22 bp, Artificial Sequence
  Description of Artificial Sequence: Synthetic oligonucleotide
ggaggggccggagtatggggac

SEQ ID NO: 31945 - DNA, 22 bp, Artificial Sequence
  Description of Artificial Sequence: Synthetic oligonucleotide
gaggggccggagtatggggacc

SEQ ID NO: 31946 - DNA, 22 bp, Artificial Sequence
  Description of Artificial Sequence: Synthetic oligonucleotide
aggggccggagtatggggaccg

SEQ ID NO: 31947 - DNA, 21 bp, Artificial Sequence
  Description of Artificial Sequence: Synthetic oligonucleotide
ggggccggagtatggggaccg

SEQ ID NO: 31948 - DNA, 23 bp, Artificial Sequence
  Description of Artificial Sequence: Synthetic oligonucleotide
gggccggagtatggggaccggaa

SEQ ID NO: 31949 - DNA, 24 bp, Artificial Sequence
  Description of Artificial Sequence: Synthetic oligonucleotide
ggccggagtatggggaccggaaca

SEQ ID NO: 31950 - DNA, 25 bp, Artificial Sequence
  Description of Artificial Sequence: Synthetic oligonucleotide
gccggagtatggggaccggaacaca

SEQ ID NO: 31951 - DNA, 26 bp, Artificial Sequence
  Description of Artificial Sequence: Synthetic oligonucleotide
ccggagtatggggaccggaacacaca

SEQ ID NO: 31952 - DNA, 27 bp, Artificial Sequence
  Description of Artificial Sequence: Synthetic oligonucleotide
cggagtatggggaccggaacacacaga

SEQ ID NO: 31953 - DNA, 28 bp, Artificial Sequence
  Description of Artificial Sequence: Synthetic oligonucleotide
ggagtatggggaccggaacacacagatc

SEQ ID NO: 31954 - DNA, 30 bp, Artificial Sequence
  Description of Artificial Sequence: Synthetic oligonucleotide
gagtatggggaccggaacacacagatcttc

SEQ ID NO: 31955 - DNA, 32 bp, Artificial Sequence
  Description of Artificial Sequence: Synthetic oligonucleotide
agtatggggaccggaacacacagatcttcaag

SEQ ID NO: 31956 - DNA, 31 bp, Artificial Sequence
  Description of Artificial Sequence: Synthetic oligonucleotide
gtatggggaccggaacacacagatcttcaag

SEQ ID NO: 31957 - DNA, 32 bp, Artificial Sequence
  Description of Artificial Sequence: Synthetic oligonucleotide
tatggggaccggaacacacagatcttcaagac

SEQ ID NO: 31958 - DNA, 31 bp, Artificial Sequence
  Description of Artificial Sequence: Synthetic oligonucleotide
atggggaccggaacacacagatcttcaagac

SEQ ID NO: 31959 - DNA, 30 bp, Artificial Sequence
  Description of Artificial Sequence: Synthetic oligonucleotide
tggggaccggaacacacagatcttcaagac

SEQ ID NO: 31960 - DNA, 29 bp, Artificial Sequence
  Description of Artificial Sequence: Synthetic oligonucleotide
ggggaccggaacacacagatcttcaagac

SEQ ID NO: 31961 - DNA, 30 bp, Artificial Sequence
  Description of Artificial Sequence: Synthetic oligonucleotide
ccggagtattgggaccggaacacacatatc

SEQ ID NO: 31962 - DNA, 32 bp, Artificial Sequence
  Description of Artificial Sequence: Synthetic oligonucleotide
cggagtattgggaccggaacacacatatcttc

SEQ ID NO: 31963 - DNA, 34 bp, Artificial Sequence
  Description of Artificial Sequence: Synthetic oligonucleotide
ggagtattgggaccggaacacacatatcttcaag

SEQ ID NO: 31964 - DNA, 35 bp, Artificial Sequence
  Description of Artificial Sequence: Synthetic oligonucleotide
gagtattgggaccggaacacacatatcttcaagac

SEQ ID NO: 31965 - DNA, 35 bp, Artificial Sequence
  Description of Artificial Sequence: Synthetic oligonucleotide
agtattgggaccggaacacacatatcttcaagacc

SEQ ID NO: 31966 - DNA, 34 bp, Artificial Sequence
  Description of Artificial Sequence: Synthetic oligonucleotide
gtattgggaccggaacacacatatcttcaagacc

SEQ ID NO: 31967 - DNA, 36 bp, Artificial Sequence
  Description of Artificial Sequence: Synthetic oligonucleotide
tattgggaccggaacacacatatcttcaagaccaac

SEQ ID NO: 31968 - DNA, 35 bp, Artificial Sequence
  Description of Artificial Sequence: Synthetic oligonucleotide
attgggaccggaacacacatatcttcaagaccaac

SEQ ID NO: 31969 - DNA, 34 bp, Artificial Sequence
  Description of Artificial Sequence: Synthetic oligonucleotide
ttgggaccggaacacacatatcttcaagaccaac

SEQ ID NO: 31970 - DNA, 33 bp, Artificial Sequence
  Description of Artificial Sequence: Synthetic oligonucleotide
tgggaccggaacacacatatcttcaagaccaac

SEQ ID NO: 31971 - DNA, 32 bp, Artificial Sequence
  Description of Artificial Sequence: Synthetic oligonucleotide
gggaccggaacacacatatcttcaagaccaac

SEQ ID NO: 31972 - DNA, 33 bp, Artificial Sequence
  Description of Artificial Sequence: Synthetic oligonucleotide
ggaccggaacacacatatcttcaagaccaacac

SEQ ID NO: 31973 - DNA, 34 bp, Artificial Sequence
  Description of Artificial Sequence: Synthetic oligonucleotide
gaccggaacacacatatcttcaagaccaacacac

SEQ ID NO: 31974 - DNA, 35 bp, Artificial Sequence
  Description of Artificial Sequence: Synthetic oligonucleotide
accggaacacacatatcttcaagaccaacacacag

SEQ ID NO: 31975 - DNA, 34 bp, Artificial Sequence
  Description of Artificial Sequence: Synthetic oligonucleotide
ccggaacacacatatcttcaagaccaacacacag

SEQ ID NO: 31976 - DNA, 35 bp, Artificial Sequence
  Description of Artificial Sequence: Synthetic oligonucleotide
cggaacacacatatcttcaagaccaacacacagac

SEQ ID NO: 31977 - DNA, 38 bp, Artificial Sequence
  Description of Artificial Sequence: Synthetic oligonucleotide
ggaacacacatatcttcaagaccaacacacagacttac

SEQ ID NO: 31978 - DNA, 38 bp, Artificial Sequence
  Description of Artificial Sequence: Synthetic oligonucleotide
gaacacacatatcttcaagaccaacacacagacttacc

SEQ ID NO: 31979 - DNA, 38 bp, Artificial Sequence
  Description of Artificial Sequence: Synthetic oligonucleotide
aacacacatatcttcaagaccaacacacagacttaccg

SEQ ID NO: 31980 - DNA, 37 bp, Artificial Sequence
  Description of Artificial Sequence: Synthetic oligonucleotide
acacacatatcttcaagaccaacacacagacttaccg

SEQ ID NO: 31981 - DNA, 36 bp, Artificial Sequence
  Description of Artificial Sequence: Synthetic oligonucleotide
cacacatatcttcaagaccaacacacagacttaccg

SEQ ID NO: 31982 - DNA, 37 bp, Artificial Sequence
  Description of Artificial Sequence: Synthetic oligonucleotide
acacatatcttcaagaccaacacacagacttaccgag

SEQ ID NO: 31983 - DNA, 36 bp, Artificial Sequence
  Description of Artificial Sequence: Synthetic oligonucleotide
cacatatcttcaagaccaacacacagacttaccgag

SEQ ID NO: 31984 - DNA, 37 bp, Artificial Sequence
  Description of Artificial Sequence: Synthetic oligonucleotide
acatatcttcaagaccaacacacagacttaccgagag

SEQ ID NO: 31985 - DNA, 36 bp, Artificial Sequence
  Description of Artificial Sequence: Synthetic oligonucleotide
catatcttcaagaccaacacacagacttaccgagag

SEQ ID NO: 31986 - DNA, 37 bp, Artificial Sequence
  Description of Artificial Sequence: Synthetic oligonucleotide
atatcttcaagaccaacacacagacttaccgagagag

SEQ ID NO: 31987 - DNA, 36 bp, Artificial Sequence
  Description of Artificial Sequence: Synthetic oligonucleotide
tatcttcaagaccaacacacagacttaccgagagag

SEQ ID NO: 31988 - DNA, 24 bp, Artificial Sequence
  Description of Artificial Sequence: Synthetic oligonucleotide
atgtacggctgcgacgtggggtcc

SEQ ID NO: 31989 - DNA, 23 bp, Artificial Sequence
  Description of Artificial Sequence: Synthetic oligonucleotide
tgtacggctgcgacgtggggtcc

SEQ ID NO: 31990 - DNA, 22 bp, Artificial Sequence
  Description of Artificial Sequence: Synthetic oligonucleotide
gtacggctgcgacgtggggtcc

SEQ ID NO: 31991 - DNA, 23 bp, Artificial Sequence
  Description of Artificial Sequence: Synthetic oligonucleotide
tacggctgcgacgtggggtccga

SEQ ID NO: 31992 - DNA, 22 bp, Artificial Sequence
  Description of Artificial Sequence: Synthetic oligonucleotide
acggctgcgacgtggggtccga

SEQ ID NO: 31993 - DNA, 21 bp, Artificial Sequence
  Description of Artificial Sequence: Synthetic oligonucleotide
cggctgcgacgtggggtccga

SEQ ID NO: 31994 - DNA, 21 bp, Artificial Sequence
  Description of Artificial Sequence: Synthetic oligonucleotide
ggctgcgacgtggggtccgac

SEQ ID NO: 31995 - DNA, 21 bp, Artificial Sequence
  Description of Artificial Sequence: Synthetic oligonucleotide
gctgcgacgtggggtccgacg

SEQ ID NO: 31996 - DNA, 21 bp, Artificial Sequence
  Description of Artificial Sequence: Synthetic oligonucleotide
ctgcgacgtggggtccgacgg

SEQ ID NO: 31997 - DNA, 21 bp, Artificial Sequence
  Description of Artificial Sequence: Synthetic oligonucleotide
tgcgacgtggggtccgacggg

SEQ ID NO: 31998 - DNA, 20 bp, Artificial Sequence
  Description of Artificial Sequence: Synthetic oligonucleotide
gcgacgtggggtccgacggg

SEQ ID NO: 31999 - DNA, 20 bp, Artificial Sequence
  Description of Artificial Sequence: Synthetic oligonucleotide
cgacgtggggtccgacgggc

SEQ ID NO: 32000 - DNA, 20 bp, Artificial Sequence
  Description of Artificial Sequence: Synthetic oligonucleotide
gacgtggggtccgacgggcg

SEQ ID NO: 32001 - DNA, 20 bp, Artificial Sequence
  Description of Artificial Sequence: Synthetic oligonucleotide
acgtggggtccgacgggcgc

SEQ ID NO: 32002 - DNA, 20 bp, Artificial Sequence
  Description of Artificial Sequence: Synthetic oligonucleotide
cgtggggtccgacgggcgct

SEQ ID NO: 32003 - DNA, 20 bp, Artificial Sequence
  Description of Artificial Sequence: Synthetic oligonucleotide
gtggggtccgacgggcgcct

SEQ ID NO: 32004 - DNA, 25 bp, Artificial Sequence
  Description of Artificial Sequence: Synthetic oligonucleotide
ggcatgaccagtccgcctacgacga

SEQ ID NO: 32005 - DNA, 27 bp, Artificial Sequence
  Description of Artificial Sequence: Synthetic oligonucleotide
gcatgaccagtccgcctacgacgacaa

SEQ ID NO: 32006 - DNA, 27 bp, Artificial Sequence
  Description of Artificial Sequence: Synthetic oligonucleotide
catgaccagtccgcctacgacgacaag

SEQ ID NO: 32007 - DNA, 27 bp, Artificial Sequence
  Description of Artificial Sequence: Synthetic oligonucleotide
atgaccagtccgcctacgacgacaagg

SEQ ID NO: 32008 - DNA, 27 bp, Artificial Sequence
  Description of Artificial Sequence: Synthetic oligonucleotide
tgaccagtccgcctacgacgacaagga

SEQ ID NO: 32009 - DNA, 27 bp, Artificial Sequence
  Description of Artificial Sequence: Synthetic oligonucleotide
gaccagtccgcctacgacgacaaggat

SEQ ID NO: 32010 - DNA, 29 bp, Artificial Sequence
  Description of Artificial Sequence: Synthetic oligonucleotide
accagtccgcctacgacgacaaggattac

SEQ ID NO: 32011 - DNA, 28 bp, Artificial Sequence
  Description of Artificial Sequence: Synthetic oligonucleotide
ccagtccgcctacgacgacaaggattac

SEQ ID NO: 32012 - DNA, 30 bp, Artificial Sequence
  Description of Artificial Sequence: Synthetic oligonucleotide
cagtccgcctacgacgacaaggattacatc

SEQ ID NO: 32013 - DNA, 30 bp, Artificial Sequence
  Description of Artificial Sequence: Synthetic oligonucleotide
agtccgcctacgacgacaaggattacatcg

SEQ ID NO: 32014 - DNA, 29 bp, Artificial Sequence
  Description of Artificial Sequence: Synthetic oligonucleotide
gtccgcctacgacgacaaggattacatcg

SEQ ID NO: 32015 - DNA, 29 bp, Artificial Sequence
  Description of Artificial Sequence: Synthetic oligonucleotide
tccgcctacgacgacaaggattacatcgc

SEQ ID NO: 32016 - DNA, 28 bp, Artificial Sequence
  Description of Artificial Sequence: Synthetic oligonucleotide
ccgcctacgacgacaaggattacatcgc

SEQ ID NO: 32017 - DNA, 28 bp, Artificial Sequence
  Description of Artificial Sequence: Synthetic oligonucleotide
cgcctacgacgacaaggattacatcgcc

SEQ ID NO: 32018 - DNA, 28 bp, Artificial Sequence
  Description of Artificial Sequence: Synthetic oligonucleotide
gcctacgacgacaaggattacatcgccc

SEQ ID NO: 32019 - DNA, 29 bp, Artificial Sequence
  Description of Artificial Sequence: Synthetic oligonucleotide
cctacgacgacaaggattacatcgccctg

SEQ ID NO: 32020 - DNA, 31 bp, Artificial Sequence
  Description of Artificial Sequence: Synthetic oligonucleotide
ctacgacgacaaggattacatcgccctgaac

SEQ ID NO: 32021 - DNA, 31 bp, Artificial Sequence
  Description of Artificial Sequence: Synthetic oligonucleotide
tacgacgacaaggattacatcgccctgaacg

SEQ ID NO: 32022 - DNA, 30 bp, Artificial Sequence
  Description of Artificial Sequence: Synthetic oligonucleotide
acgacgacaaggattacatcgccctgaacg

SEQ ID NO: 32023 - DNA, 29 bp, Artificial Sequence
  Description of Artificial Sequence: Synthetic oligonucleotide
cgacgacaaggattacatcgccctgaacg

SEQ ID NO: 32024 - DNA, 30 bp, Artificial Sequence
  Description of Artificial Sequence: Synthetic oligonucleotide
gacgacaaggattacatcgccctgaacgag

SEQ ID NO: 32025 - DNA, 30 bp, Artificial Sequence
  Description of Artificial Sequence: Synthetic oligonucleotide
acgacaaggattacatcgccctgaacgagg

SEQ ID NO: 32026 - DNA, 29 bp, Artificial Sequence
  Description of Artificial Sequence: Synthetic oligonucleotide
cgacaaggattacatcgccctgaacgagg

SEQ ID NO: 32027 - DNA, 30 bp, Artificial Sequence
  Description of Artificial Sequence: Synthetic oligonucleotide
gacaaggattacatcgccctgaacgaggac

SEQ ID NO: 32028 - DNA, 30 bp, Artificial Sequence
  Description of Artificial Sequence: Synthetic oligonucleotide
acaaggattacatcgccctgaacgaggacc

SEQ ID NO: 32029 - DNA, 26 bp, Artificial Sequence
  Description of Artificial Sequence: Synthetic oligonucleotide
ggctactacaaccagagcgaggccga

SEQ ID NO: 32030 - DNA, 27 bp, Artificial Sequence
  Description of Artificial Sequence: Synthetic oligonucleotide
gctactacaaccagagcgaggccgagt

SEQ ID NO: 32031 - DNA, 27 bp, Artificial Sequence
  Description of Artificial Sequence: Synthetic oligonucleotide
ctactacaaccagagcgaggccgagtc

SEQ ID NO: 32032 - DNA, 28 bp, Artificial Sequence
  Description of Artificial Sequence: Synthetic oligonucleotide
tactacaaccagagcgaggccgagtctc

SEQ ID NO: 32033 - DNA, 27 bp, Artificial Sequence
  Description of Artificial Sequence: Synthetic oligonucleotide
actacaaccagagcgaggccgagtctc

SEQ ID NO: 32034 - DNA, 27 bp, Artificial Sequence
  Description of Artificial Sequence: Synthetic oligonucleotide
ctacaaccagagcgaggccgagtctca

SEQ ID NO: 32035 - DNA, 27 bp, Artificial Sequence
  Description of Artificial Sequence: Synthetic oligonucleotide
tacaaccagagcgaggccgagtctcac

SEQ ID NO: 32036 - DNA, 27 bp, Artificial Sequence
  Description of Artificial Sequence: Synthetic oligonucleotide
acaaccagagcgaggccgagtctcaca

SEQ ID NO: 32037 - DNA, 27 bp, Artificial Sequence
  Description of Artificial Sequence: Synthetic oligonucleotide
caaccagagcgaggccgagtctcacat

SEQ ID NO: 32038 - DNA, 27 bp, Artificial Sequence
  Description of Artificial Sequence: Synthetic oligonucleotide
aaccagagcgaggccgagtctcacatc

SEQ ID NO: 32039 - DNA, 27 bp, Artificial Sequence
  Description of Artificial Sequence: Synthetic oligonucleotide
accagagcgaggccgagtctcacatca

SEQ ID NO: 32040 - DNA, 27 bp, Artificial Sequence
  Description of Artificial Sequence: Synthetic oligonucleotide
ccagagcgaggccgagtctcacatcat

SEQ ID NO: 32041 - DNA, 27 bp, Artificial Sequence
  Description of Artificial Sequence: Synthetic oligonucleotide
cagagcgaggccgagtctcacatcatc

SEQ ID NO: 32042 - DNA, 27 bp, Artificial Sequence
  Description of Artificial Sequence: Synthetic oligonucleotide
agagcgaggccgagtctcacatcatcc

SEQ ID NO: 32043 - DNA, 27 bp, Artificial Sequence
  Description of Artificial Sequence: Synthetic oligonucleotide
gagcgaggccgagtctcacatcatcca

SEQ ID NO: 32044 - DNA, 27 bp, Artificial Sequence
  Description of Artificial Sequence: Synthetic oligonucleotide
agcgaggccgagtctcacatcatccag

SEQ ID NO: 32045 - DNA, 27 bp, Artificial Sequence
  Description of Artificial Sequence: Synthetic oligonucleotide
gcgaggccgagtctcacatcatccaga

SEQ ID NO: 32046 - DNA, 27 bp, Artificial Sequence
  Description of Artificial Sequence: Synthetic oligonucleotide
cgaggccgagtctcacatcatccagag

SEQ ID NO: 32047 - DNA, 27 bp, Artificial Sequence
  Description of Artificial Sequence: Synthetic oligonucleotide
gaggccgagtctcacatcatccagagg

SEQ ID NO: 32048 - DNA, 29 bp, Artificial Sequence
  Description of Artificial Sequence: Synthetic oligonucleotide
aggccgagtctcacatcatccagaggatg

SEQ ID NO: 32049 - DNA, 28 bp, Artificial Sequence
  Description of Artificial Sequence: Synthetic oligonucleotide
ggccgagtctcacatcatccagaggatg

SEQ ID NO: 32050 - DNA, 31 bp, Artificial Sequence
  Description of Artificial Sequence: Synthetic oligonucleotide
gccgagtctcacatcatccagaggatgtatg

SEQ ID NO: 32051 - DNA, 31 bp, Artificial Sequence
  Description of Artificial Sequence: Synthetic oligonucleotide
ccgagtctcacatcatccagaggatgtatgg

SEQ ID NO: 32052 - DNA, 31 bp, Artificial Sequence
  Description of Artificial Sequence: Synthetic oligonucleotide
cgagtctcacatcatccagaggatgtatggc

SEQ ID NO: 32053 - DNA, 32 bp, Artificial Sequence
  Description of Artificial Sequence: Synthetic oligonucleotide
gagtctcacatcatccagaggatgtatggctg

SEQ ID NO: 32054 - DNA, 32 bp, Artificial Sequence
  Description of Artificial Sequence: Synthetic oligonucleotide
agtctcacatcatccagaggatgtatggctgc

SEQ ID NO: 32055 - DNA, 27 bp, Artificial Sequence
  Description of Artificial Sequence: Synthetic oligonucleotide
ccgggtctcacatcatccagaggatgc

SEQ ID NO: 32056 - DNA, 29 bp, Artificial Sequence
  Description of Artificial Sequence: Synthetic oligonucleotide
cgggtctcacatcatccagaggatgcatg

SEQ ID NO: 32057 - DNA, 29 bp, Artificial Sequence
  Description of Artificial Sequence: Synthetic oligonucleotide
gggtctcacatcatccagaggatgcatgg

SEQ ID NO: 32058 - DNA, 29 bp, Artificial Sequence
  Description of Artificial Sequence: Synthetic oligonucleotide
ggtctcacatcatccagaggatgcatggc

SEQ ID NO: 32059 - DNA, 30 bp, Artificial Sequence
  Description of Artificial Sequence: Synthetic oligonucleotide
gtctcacatcatccagaggatgcatggctg

SEQ ID NO: 32060 - DNA, 30 bp, Artificial Sequence
  Description of Artificial Sequence: Synthetic oligonucleotide
tctcacatcatccagaggatgcatggctgc

SEQ ID NO: 32061 - DNA, 29 bp, Artificial Sequence
  Description of Artificial Sequence: Synthetic oligonucleotide
ctcacatcatccagaggatgcatggctgc

SEQ ID NO: 32062 - DNA, 29 bp, Artificial Sequence
  Description of Artificial Sequence: Synthetic oligonucleotide
tcacatcatccagaggatgcatggctgcg

SEQ ID NO: 32063 - DNA, 28 bp, Artificial Sequence
  Description of Artificial Sequence: Synthetic oligonucleotide
cacatcatccagaggatgcatggctgcg

SEQ ID NO: 32064 - DNA, 29 bp, Artificial Sequence
  Description of Artificial Sequence: Synthetic oligonucleotide
acatcatccagaggatgcatggctgcgac

SEQ ID NO: 32065 - DNA, 28 bp, Artificial Sequence
  Description of Artificial Sequence: Synthetic oligonucleotide
catcatccagaggatgcatggctgcgac

SEQ ID NO: 32066 - DNA, 28 bp, Artificial Sequence
  Description of Artificial Sequence: Synthetic oligonucleotide
atcatccagaggatgcatggctgcgacc

SEQ ID NO: 32067 - DNA, 27 bp, Artificial Sequence
  Description of Artificial Sequence: Synthetic oligonucleotide
tcatccagaggatgcatggctgcgacc

SEQ ID NO: 32068 - DNA, 27 bp, Artificial Sequence
  Description of Artificial Sequence: Synthetic oligonucleotide
catccagaggatgcatggctgcgacct

SEQ ID NO: 32069 - DNA, 27 bp, Artificial Sequence
  Description of Artificial Sequence: Synthetic oligonucleotide
atccagaggatgcatggctgcgacctg

SEQ ID NO: 32070 - DNA, 26 bp, Artificial Sequence
  Description of Artificial Sequence: Synthetic oligonucleotide
tccagaggatgcatggctgcgacctg

SEQ ID NO: 32071 - DNA, 25 bp, Artificial Sequence
  Description of Artificial Sequence: Synthetic oligonucleotide
ccagaggatgcatggctgcgacctg

SEQ ID NO: 32072 - DNA, 25 bp, Artificial Sequence
  Description of Artificial Sequence: Synthetic oligonucleotide
cagaggatgcatggctgcgacctgg

SEQ ID NO: 32073 - DNA, 25 bp, Artificial Sequence
  Description of Artificial Sequence: Synthetic oligonucleotide
agaggatgcatggctgcgacctggg

SEQ ID NO: 32074 - DNA, 24 bp, Artificial Sequence
  Description of Artificial Sequence: Synthetic oligonucleotide
gaggatgcatggctgcgacctggg

SEQ ID NO: 32075 - DNA, 24 bp, Artificial Sequence
  Description of Artificial Sequence: Synthetic oligonucleotide
aggatgcatggctgcgacctgggg

SEQ ID NO: 32076 - DNA, 23 bp, Artificial Sequence
  Description of Artificial Sequence: Synthetic oligonucleotide
ggatgcatggctgcgacctgggg

SEQ ID NO: 32077 - DNA, 23 bp, Artificial Sequence
  Description of Artificial Sequence: Synthetic oligonucleotide
gatgcatggctgcgacctggggc

SEQ ID NO: 32078 - DNA, 23 bp, Artificial Sequence
  Description of Artificial Sequence: Synthetic oligonucleotide
atgcatggctgcgacctggggcc

SEQ ID NO: 32079 - DNA, 22 bp, Artificial Sequence
  Description of Artificial Sequence: Synthetic oligonucleotide
tgcatggctgcgacctggggcc

SEQ ID NO: 32080 - DNA, 21 bp, Artificial Sequence
  Description of Artificial Sequence: Synthetic oligonucleotide
gcatggctgcgacctggggcc

SEQ ID NO: 32081 - DNA, 21 bp, Artificial Sequence
  Description of Artificial Sequence: Synthetic oligonucleotide
catggctgcgacctggggccc

SEQ ID NO: 32082 - DNA, 21 bp, Artificial Sequence
  Description of Artificial Sequence: Synthetic oligonucleotide
gcgcctcctccgcgggcatca

SEQ ID NO: 32083 - DNA, 21 bp, Artificial Sequence
  Description of Artificial Sequence: Synthetic oligonucleotide
cgcctcctccgcgggcatcac

SEQ ID NO: 32084 - DNA, 22 bp, Artificial Sequence
  Description of Artificial Sequence: Synthetic oligonucleotide
gcctcctccgcgggcatcacca

SEQ ID NO: 32085 - DNA, 23 bp, Artificial Sequence
  Description of Artificial Sequence: Synthetic oligonucleotide
cctcctccgcgggcatcaccagt

SEQ ID NO: 32086 - DNA, 23 bp, Artificial Sequence
  Description of Artificial Sequence: Synthetic oligonucleotide
ctcctccgcgggcatcaccagtc

SEQ ID NO: 32087 - DNA, 23 bp, Artificial Sequence
  Description of Artificial Sequence: Synthetic oligonucleotide
tcctccgcgggcatcaccagtcc

SEQ ID NO: 32088 - DNA, 22 bp, Artificial Sequence
  Description of Artificial Sequence: Synthetic oligonucleotide
cctccgcgggcatcaccagtcc

SEQ ID NO: 32089 - DNA, 22 bp, Artificial Sequence
  Description of Artificial Sequence: Synthetic oligonucleotide
ctccgcgggcatcaccagtccg

SEQ ID NO: 32090 - DNA, 22 bp, Artificial Sequence
  Description of Artificial Sequence: Synthetic oligonucleotide
tccgcgggcatcaccagtccgc

SEQ ID NO: 32091 - DNA, 21 bp, Artificial Sequence
  Description of Artificial Sequence: Synthetic oligonucleotide
ccgcgggcatcaccagtccgc

SEQ ID NO: 32092 - DNA, 23 bp, Artificial Sequence
  Description of Artificial Sequence: Synthetic oligonucleotide
cgcgggcatcaccagtccgccta

SEQ ID NO: 32093 - DNA, 23 bp, Artificial Sequence
  Description of Artificial Sequence: Synthetic oligonucleotide
gcgggcatcaccagtccgcctac

SEQ ID NO: 32094 - DNA, 24 bp, Artificial Sequence
  Description of Artificial Sequence: Synthetic oligonucleotide
cgggcatcaccagtccgcctacga

SEQ ID NO: 32095 - DNA, 24 bp, Artificial Sequence
  Description of Artificial Sequence: Synthetic oligonucleotide
gggcatcaccagtccgcctacgac

SEQ ID NO: 32096 - DNA, 24 bp, Artificial Sequence
  Description of Artificial Sequence: Synthetic oligonucleotide
ggcatcaccagtccgcctacgacg

SEQ ID NO: 32097 - DNA, 24 bp, Artificial Sequence
  Description of Artificial Sequence: Synthetic oligonucleotide
gcatcaccagtccgcctacgacgg

SEQ ID NO: 32098 - DNA, 26 bp, Artificial Sequence
  Description of Artificial Sequence: Synthetic oligonucleotide
catcaccagtccgcctacgacggcaa

SEQ ID NO: 32099 - DNA, 26 bp, Artificial Sequence
  Description of Artificial Sequence: Synthetic oligonucleotide
atcaccagtccgcctacgacggcaag

SEQ ID NO: 32100 - DNA, 25 bp, Artificial Sequence
  Description of Artificial Sequence: Synthetic oligonucleotide
tcaccagtccgcctacgacggcaag

SEQ ID NO: 32101 - DNA, 25 bp, Artificial Sequence
  Description of Artificial Sequence: Synthetic oligonucleotide
gggcgccatggatagagcaggagga

SEQ ID NO: 32102 - DNA, 25 bp, Artificial Sequence
  Description of Artificial Sequence: Synthetic oligonucleotide
ggcgccatggatagagcaggaggag

SEQ ID NO: 32103 - DNA, 25 bp, Artificial Sequence
  Description of Artificial Sequence: Synthetic oligonucleotide
gcgccatggatagagcaggaggagc

SEQ ID NO: 32104 - DNA, 25 bp, Artificial Sequence
  Description of Artificial Sequence: Synthetic oligonucleotide
cgccatggatagagcaggaggagcc

SEQ ID NO: 32105 - DNA, 25 bp, Artificial Sequence
  Description of Artificial Sequence: Synthetic oligonucleotide
gccatggatagagcaggaggagccg

SEQ ID NO: 32106 - DNA, 26 bp, Artificial Sequence
  Description of Artificial Sequence: Synthetic oligonucleotide
ccatggatagagcaggaggagccgga

SEQ ID NO: 32107 - DNA, 27 bp, Artificial Sequence
  Description of Artificial Sequence: Synthetic oligonucleotide
catggatagagcaggaggagccggagt

SEQ ID NO: 32108 - DNA, 30 bp, Artificial Sequence
  Description of Artificial Sequence: Synthetic oligonucleotide
atggatagagcaggaggagccggagtattg

SEQ ID NO: 32109 - DNA, 25 bp, Artificial Sequence
  Description of Artificial Sequence: Synthetic oligonucleotide
caggaggagccggagtattgggacc

SEQ ID NO: 32110 - DNA, 25 bp, Artificial Sequence
  Description of Artificial Sequence: Synthetic oligonucleotide
aggaggagccggagtattgggaccg

SEQ ID NO: 32111 - DNA, 24 bp, Artificial Sequence
  Description of Artificial Sequence: Synthetic oligonucleotide
ggaggagccggagtattgggaccg

SEQ ID NO: 32112 - DNA, 26 bp, Artificial Sequence
  Description of Artificial Sequence: Synthetic oligonucleotide
gaggagccggagtattgggaccggaa

SEQ ID NO: 32113 - DNA, 27 bp, Artificial Sequence
  Description of Artificial Sequence: Synthetic oligonucleotide
aggagccggagtattgggaccggaaca

SEQ ID NO: 32114 - DNA, 26 bp, Artificial Sequence
  Description of Artificial Sequence: Synthetic oligonucleotide
ggagccggagtattgggaccggaaca

SEQ ID NO: 32115 - DNA, 27 bp, Artificial Sequence
  Description of Artificial Sequence: Synthetic oligonucleotide
gagccggagtattgggaccggaacaca

SEQ ID NO: 32116 - DNA, 27 bp, Artificial Sequence
  Description of Artificial Sequence: Synthetic oligonucleotide
agccggagtattgggaccggaacacac

SEQ ID NO: 32117 - DNA, 25 bp, Artificial Sequence
  Description of Artificial Sequence: Synthetic oligonucleotide
cggaacctgcgcggctactacaacc

SEQ ID NO: 32118 - DNA, 25 bp, Artificial Sequence
  Description of Artificial Sequence: Synthetic oligonucleotide
ggaacctgcgcggctactacaaccg

SEQ ID NO: 32119 - DNA, 26 bp, Artificial Sequence
  Description of Artificial Sequence: Synthetic oligonucleotide
gaacctgcgcggctactacaaccgga

SEQ ID NO: 32120 - DNA, 26 bp, Artificial Sequence
  Description of Artificial Sequence: Synthetic oligonucleotide
aacctgcgcggctactacaaccggag

SEQ ID NO: 32121 - DNA, 25 bp, Artificial Sequence
  Description of Artificial Sequence: Synthetic oligonucleotide
acctgcgcggctactacaaccggag

SEQ ID NO: 32122 - DNA, 24 bp, Artificial Sequence
  Description of Artificial Sequence: Synthetic oligonucleotide
cctgcgcggctactacaaccggag

SEQ ID NO: 32123 - DNA, 24 bp, Artificial Sequence
  Description of Artificial Sequence: Synthetic oligonucleotide
ctgcgcggctactacaaccggagc

SEQ ID NO: 32124 - DNA, 25 bp, Artificial Sequence
  Description of Artificial Sequence: Synthetic oligonucleotide
tgcgcggctactacaaccggagcga

SEQ ID NO: 32125 - DNA, 24 bp, Artificial Sequence
  Description of Artificial Sequence: Synthetic oligonucleotide
gcgcggctactacaaccggagcga

SEQ ID NO: 32126 - DNA, 24 bp, Artificial Sequence
  Description of Artificial Sequence: Synthetic oligonucleotide
cgcggctactacaaccggagcgag

SEQ ID NO: 32127 - DNA, 24 bp, Artificial Sequence
  Description of Artificial Sequence: Synthetic oligonucleotide
gcggctactacaaccggagcgagg

SEQ ID NO: 32128 - DNA, 24 bp, Artificial Sequence
  Description of Artificial Sequence: Synthetic oligonucleotide
cggctactacaaccggagcgaggc

SEQ ID NO: 32129 - DNA, 24 bp, Artificial Sequence
  Description of Artificial Sequence: Synthetic oligonucleotide
ggctactacaaccggagcgaggcc

SEQ ID NO: 32130 - DNA, 24 bp, Artificial Sequence
  Description of Artificial Sequence: Synthetic oligonucleotide
gctactacaaccggagcgaggccg

SEQ ID NO: 32131 - DNA, 24 bp, Artificial Sequence
  Description of Artificial Sequence: Synthetic oligonucleotide
ctactacaaccggagcgaggccgg

SEQ ID NO: 32132 - DNA, 25 bp, Artificial Sequence
  Description of Artificial Sequence: Synthetic oligonucleotide
tactacaaccggagcgaggccgggt

SEQ ID NO: 32133 - DNA, 24 bp, Artificial Sequence
  Description of Artificial Sequence: Synthetic oligonucleotide
actacaaccggagcgaggccgggt

SEQ ID NO: 32134 - DNA, 23 bp, Artificial Sequence
  Description of Artificial Sequence: Synthetic oligonucleotide
ctacaaccggagcgaggccgggt

SEQ ID NO: 32135 - DNA, 24 bp, Artificial Sequence
  Description of Artificial Sequence: Synthetic oligonucleotide
tacaaccggagcgaggccgggtct

SEQ ID NO: 32136 - DNA, 23 bp, Artificial Sequence
  Description of Artificial Sequence: Synthetic oligonucleotide
acaaccggagcgaggccgggtct

SEQ ID NO: 32137 - DNA, 22 bp, Artificial Sequence
  Description of Artificial Sequence: Synthetic oligonucleotide
caaccggagcgaggccgggtct

SEQ ID NO: 32138 - DNA, 23 bp, Artificial Sequence
  Description of Artificial Sequence: Synthetic oligonucleotide
aaccggagcgaggccgggtctca

SEQ ID NO: 32139 - DNA, 22 bp, Artificial Sequence
  Description of Artificial Sequence: Synthetic oligonucleotide
accggagcgaggccgggtctca

SEQ ID NO: 32140 - DNA, 21 bp, Artificial Sequence
  Description of Artificial Sequence: Synthetic oligonucleotide
ccggagcgaggccgggtctca

SEQ ID NO: 32141 - DNA, 23 bp, Artificial Sequence
  Description of Artificial Sequence: Synthetic oligonucleotide
cggagcgaggccgggtctcacat

SEQ ID NO: 32142 - DNA, 25 bp, Artificial Sequence
  Description of Artificial Sequence: Synthetic oligonucleotide
ggagcgaggccgggtctcacatcat

SEQ ID NO: 32143 - DNA, 21 bp, Artificial Sequence
  Description of Artificial Sequence: Synthetic oligonucleotide
tacggctgcgacgtggggccc

SEQ ID NO: 32144 - DNA, 20 bp, Artificial Sequence
  Description of Artificial Sequence: Synthetic oligonucleotide
acggctgcgacgtggggccc

SEQ ID NO: 32145 - DNA, 20 bp, Artificial Sequence
  Description of Artificial Sequence: Synthetic oligonucleotide
cggctgcgacgtggggccct

SEQ ID NO: 32146 - DNA, 26 bp, Artificial Sequence
  Description of Artificial Sequence: Synthetic oligonucleotide
cagaggatgtatggctgcgacctggc

SEQ ID NO: 32147 - DNA, 26 bp, Artificial Sequence
  Description of Artificial Sequence: Synthetic oligonucleotide
agaggatgtatggctgcgacctggcg

SEQ ID NO: 32148 - DNA, 25 bp, Artificial Sequence
  Description of Artificial Sequence: Synthetic oligonucleotide
gaggatgtatggctgcgacctggcg

SEQ ID NO: 32149 - DNA, 25 bp, Artificial Sequence
  Description of Artificial Sequence: Synthetic oligonucleotide
aggatgtatggctgcgacctggcgc

SEQ ID NO: 32150 - DNA, 24 bp, Artificial Sequence
  Description of Artificial Sequence: Synthetic oligonucleotide
ggatgtatggctgcgacctggcgc

SEQ ID NO: 32151 - DNA, 24 bp, Artificial Sequence
  Description of Artificial Sequence: Synthetic oligonucleotide
gatgtatggctgcgacctggcgcc

SEQ ID NO: 32152 - DNA, 24 bp, Artificial Sequence
  Description of Artificial Sequence: Synthetic oligonucleotide
atgtatggctgcgacctggcgccc

SEQ ID NO: 32153 - DNA, 23 bp, Artificial Sequence
  Description of Artificial Sequence: Synthetic oligonucleotide
tgtatggctgcgacctggcgccc

SEQ ID NO: 32154 - DNA, 22 bp, Artificial Sequence
  Description of Artificial Sequence: Synthetic oligonucleotide
gtatggctgcgacctggcgccc

SEQ ID NO: 32155 - DNA, 23 bp, Artificial Sequence
  Description of Artificial Sequence: Synthetic oligonucleotide
tatggctgcgacctggcgcccga

SEQ ID NO: 32156 - DNA, 22 bp, Artificial Sequence
  Description of Artificial Sequence: Synthetic oligonucleotide
atggctgcgacctggcgcccga

SEQ ID NO: 32157 - DNA, 21 bp, Artificial Sequence
  Description of Artificial Sequence: Synthetic oligonucleotide
tggctgcgacctggcgcccga

SEQ ID NO: 32158 - DNA, 20 bp, Artificial Sequence
  Description of Artificial Sequence: Synthetic oligonucleotide
ggctgcgacctggcgcccga

SEQ ID NO: 32159 - DNA, 20 bp, Artificial Sequence
  Description of Artificial Sequence: Synthetic oligonucleotide
gctgcgacctggcgcccgac

SEQ ID NO: 32160 - DNA, 20 bp, Artificial Sequence
  Description of Artificial Sequence: Synthetic oligonucleotide
ctgcgacctggcgcccgacg

SEQ ID NO: 32161 - DNA, 20 bp, Artificial Sequence
  Description of Artificial Sequence: Synthetic oligonucleotide
tgcgacctggcgcccgacgg

SEQ ID NO: 32162 - DNA, 20 bp, Artificial Sequence
  Description of Artificial Sequence: Synthetic oligonucleotide
gcgacctggcgcccgacggt

SEQ ID NO: 32163 - DNA, 20 bp, Artificial Sequence
  Description of Artificial Sequence: Synthetic oligonucleotide
cgacctggcgcccgacgggt

SEQ ID NO: 32164 - DNA, 20 bp, Artificial Sequence
  Description of Artificial Sequence: Synthetic oligonucleotide
gacctggcgcccgacgggct

SEQ ID NO: 32165 - DNA, 20 bp, Artificial Sequence
  Description of Artificial Sequence: Synthetic oligonucleotide
acctggcgcccgacgggcgt

SEQ ID NO: 32166 - DNA, 20 bp, Artificial Sequence
  Description of Artificial Sequence: Synthetic oligonucleotide
cctggcgcccgacgggcgtt

SEQ ID NO: 32167 - DNA, 20 bp, Artificial Sequence
  Description of Artificial Sequence: Synthetic oligonucleotide
ctggcgcccgacgggcgctt

SEQ ID NO: 32168 - DNA, 20 bp, Artificial Sequence
  Description of Artificial Sequence: Synthetic oligonucleotide
tggcgcccgacgggcgcctt

SEQ ID NO: 32169 - DNA, 20 bp, Artificial Sequence
  Description of Artificial Sequence: Synthetic oligonucleotide
ggcgcccgacgggcgccttt

SEQ ID NO: 32170 - DNA, 20 bp, Artificial Sequence
  Description of Artificial Sequence: Synthetic oligonucleotide
gcgcccgacgggcgcctctt

SEQ ID NO: 32171 - DNA, 20 bp, Artificial Sequence
  Description of Artificial Sequence: Synthetic oligonucleotide
cgcccgacgggcgcctcctt

SEQ ID NO: 32172 - DNA, 24 bp, Artificial Sequence
  Description of Artificial Sequence: Synthetic oligonucleotide
aaccagagcgaggccgggtctcac

SEQ ID NO: 32173 - DNA, 23 bp, Artificial Sequence
  Description of Artificial Sequence: Synthetic oligonucleotide
accagagcgaggccgggtctcac

SEQ ID NO: 32174 - DNA, 22 bp, Artificial Sequence
  Description of Artificial Sequence: Synthetic oligonucleotide
ccagagcgaggccgggtctcac

SEQ ID NO: 32175 - DNA, 23 bp, Artificial Sequence
  Description of Artificial Sequence: Synthetic oligonucleotide
cagagcgaggccgggtctcacgt

SEQ ID NO: 32176 - DNA, 25 bp, Artificial Sequence
  Description of Artificial Sequence: Synthetic oligonucleotide
agagcgaggccgggtctcacgtcat

SEQ ID NO: 32177 - DNA, 24 bp, Artificial Sequence
  Description of Artificial Sequence: Synthetic oligonucleotide
gagcgaggccgggtctcacgtcat

SEQ ID NO: 32178 - DNA, 24 bp, Artificial Sequence
  Description of Artificial Sequence: Synthetic oligonucleotide
agcgaggccgggtctcacgtcatc

SEQ ID NO: 32179 - DNA, 23 bp, Artificial Sequence
  Description of Artificial Sequence: Synthetic oligonucleotide
gcgaggccgggtctcacgtcatc

SEQ ID NO: 32180 - DNA, 24 bp, Artificial Sequence
  Description of Artificial Sequence: Synthetic oligonucleotide
cgaggccgggtctcacgtcatcca

SEQ ID NO: 32181 - DNA, 25 bp, Artificial Sequence
  Description of Artificial Sequence: Synthetic oligonucleotide
gaggccgggtctcacgtcatccaga

SEQ ID NO: 32182 - DNA, 25 bp, Artificial Sequence
  Description of Artificial Sequence: Synthetic oligonucleotide
aggccgggtctcacgtcatccagag

SEQ ID NO: 32183 - DNA, 24 bp, Artificial Sequence
  Description of Artificial Sequence: Synthetic oligonucleotide
ggccgggtctcacgtcatccagag

SEQ ID NO: 32184 - DNA, 26 bp, Artificial Sequence
  Description of Artificial Sequence: Synthetic oligonucleotide
gccgggtctcacgtcatccagaggat

SEQ ID NO: 32185 - DNA, 27 bp, Artificial Sequence
  Description of Artificial Sequence: Synthetic oligonucleotide
ccgggtctcacgtcatccagaggatgt

SEQ ID NO: 32186 - DNA, 29 bp, Artificial Sequence
  Description of Artificial Sequence: Synthetic oligonucleotide
cgggtctcacgtcatccagaggatgtatg

SEQ ID NO: 32187 - DNA, 29 bp, Artificial Sequence
  Description of Artificial Sequence: Synthetic oligonucleotide
gggtctcacgtcatccagaggatgtatgg

SEQ ID NO: 32188 - DNA, 29 bp, Artificial Sequence
  Description of Artificial Sequence: Synthetic oligonucleotide
ggtctcacgtcatccagaggatgtatggc

SEQ ID NO: 32189 - DNA, 30 bp, Artificial Sequence
  Description of Artificial Sequence: Synthetic oligonucleotide
gtctcacgtcatccagaggatgtatggctg

SEQ ID NO: 32190 - DNA, 30 bp, Artificial Sequence
  Description of Artificial Sequence: Synthetic oligonucleotide
tctcacgtcatccagaggatgtatggctgc

SEQ ID NO: 32191 - DNA, 29 bp, Artificial Sequence
  Description of Artificial Sequence: Synthetic oligonucleotide
ctcacgtcatccagaggatgtatggctgc

SEQ ID NO: 32192 - DNA, 29 bp, Artificial Sequence
  Description of Artificial Sequence: Synthetic oligonucleotide
tcacgtcatccagaggatgtatggctgcg

SEQ ID NO: 32193 - DNA, 28 bp, Artificial Sequence
  Description of Artificial Sequence: Synthetic oligonucleotide
cacgtcatccagaggatgtatggctgcg

SEQ ID NO: 32194 - DNA, 29 bp, Artificial Sequence
  Description of Artificial Sequence: Synthetic oligonucleotide
acgtcatccagaggatgtatggctgcgac

SEQ ID NO: 32195 - DNA, 28 bp, Artificial Sequence
  Description of Artificial Sequence: Synthetic oligonucleotide
cgtcatccagaggatgtatggctgcgac

SEQ ID NO: 32196 - DNA, 28 bp, Artificial Sequence
  Description of Artificial Sequence: Synthetic oligonucleotide
gtcatccagaggatgtatggctgcgacc

SEQ ID NO: 32197 - DNA, 22 bp, Artificial Sequence
  Description of Artificial Sequence: Synthetic oligonucleotide
gccgcgagtccgaggacggagt

SEQ ID NO: 32198 - DNA, 22 bp, Artificial Sequence
  Description of Artificial Sequence: Synthetic oligonucleotide
ccgcgagtccgaggacggagtc

SEQ ID NO: 32199 - DNA, 22 bp, Artificial Sequence
  Description of Artificial Sequence: Synthetic oligonucleotide
cgcgagtccgaggacggagtcc

SEQ ID NO: 32200 - DNA, 22 bp, Artificial Sequence
  Description of Artificial Sequence: Synthetic oligonucleotide
gcgagtccgaggacggagtccc

SEQ ID NO: 32201 - DNA, 22 bp, Artificial Sequence
  Description of Artificial Sequence: Synthetic oligonucleotide
cgagtccgaggacggagtcccg

SEQ ID NO: 32202 - DNA, 22 bp, Artificial Sequence
  Description of Artificial Sequence: Synthetic oligonucleotide
gagtccgaggacggagtcccgg

SEQ ID NO: 32203 - DNA, 22 bp, Artificial Sequence
  Description of Artificial Sequence: Synthetic oligonucleotide
agtccgaggacggagtcccggg

SEQ ID NO: 32204 - DNA, 21 bp, Artificial Sequence
  Description of Artificial Sequence: Synthetic oligonucleotide
gtccgaggacggagtcccggg

SEQ ID NO: 32205 - DNA, 21 bp, Artificial Sequence
  Description of Artificial Sequence: Synthetic oligonucleotide
tccgaggacggagtcccgggc

SEQ ID NO: 32206 - DNA, 20 bp, Artificial Sequence
  Description of Artificial Sequence: Synthetic oligonucleotide
ccgaggacggagtcccgggc

SEQ ID NO: 32207 - DNA, 20 bp, Artificial Sequence
  Description of Artificial Sequence: Synthetic oligonucleotide
cgaggacggagtcccgggcg

SEQ ID NO: 32208 - DNA, 20 bp, Artificial Sequence
  Description of Artificial Sequence: Synthetic oligonucleotide
gaggacggagtcccgggcgc

SEQ ID NO: 32209 - DNA, 22 bp, Artificial Sequence
  Description of Artificial Sequence: Synthetic oligonucleotide
aggacggagtcccgggcgccat

SEQ ID NO: 32210 - DNA, 21 bp, Artificial Sequence
  Description of Artificial Sequence: Synthetic oligonucleotide
ggacggagtcccgggcgccat

SEQ ID NO: 32211 - DNA, 21 bp, Artificial Sequence
  Description of Artificial Sequence: Synthetic oligonucleotide
gacggagtcccgggcgccatg

SEQ ID NO: 32212 - DNA, 24 bp, Artificial Sequence
  Description of Artificial Sequence: Synthetic oligonucleotide
acggagtcccgggcgccatggata

SEQ ID NO: 32213 - DNA, 23 bp, Artificial Sequence
  Description of Artificial Sequence: Synthetic oligonucleotide
cggagtcccgggcgccatggata

SEQ ID NO: 32214 - DNA, 24 bp, Artificial Sequence
  Description of Artificial Sequence: Synthetic oligonucleotide
ggagtcccgggcgccatggataga

SEQ ID NO: 32215 - DNA, 24 bp, Artificial Sequence
  Description of Artificial Sequence: Synthetic oligonucleotide
gagtcccgggcgccatggatagag

SEQ ID NO: 32216 - DNA, 25 bp, Artificial Sequence
  Description of Artificial Sequence: Synthetic oligonucleotide
agtcccgggcgccatggatagagca

SEQ ID NO: 32217 - DNA, 24 bp, Artificial Sequence
  Description of Artificial Sequence: Synthetic oligonucleotide
gtcccgggcgccatggatagagca

SEQ ID NO: 32218 - DNA, 24 bp, Artificial Sequence
  Description of Artificial Sequence: Synthetic oligonucleotide
tcccgggcgccatggatagagcag

SEQ ID NO: 32219 - DNA, 35 bp, Artificial Sequence
  Description of Artificial Sequence: Synthetic oligonucleotide
accggaacacacagatcttcaagaccaacacatag

SEQ ID NO: 32220 - DNA, 34 bp, Artificial Sequence
  Description of Artificial Sequence: Synthetic oligonucleotide
ccggaacacacagatcttcaagaccaacacatag

SEQ ID NO: 32221 - DNA, 35 bp, Artificial Sequence
  Description of Artificial Sequence: Synthetic oligonucleotide
cggaacacacagatcttcaagaccaacacatagac

SEQ ID NO: 32222 - DNA, 38 bp, Artificial Sequence
  Description of Artificial Sequence: Synthetic oligonucleotide
ggaacacacagatcttcaagaccaacacatagacttac

SEQ ID NO: 32223 - DNA, 38 bp, Artificial Sequence
  Description of Artificial Sequence: Synthetic oligonucleotide
gaacacacagatcttcaagaccaacacatagacttacc

SEQ ID NO: 32224 - DNA, 38 bp, Artificial Sequence
  Description of Artificial Sequence: Synthetic oligonucleotide
aacacacagatcttcaagaccaacacatagacttaccg

SEQ ID NO: 32225 - DNA, 37 bp, Artificial Sequence
  Description of Artificial Sequence: Synthetic oligonucleotide
acacacagatcttcaagaccaacacatagacttaccg

SEQ ID NO: 32226 - DNA, 36 bp, Artificial Sequence
  Description of Artificial Sequence: Synthetic oligonucleotide
cacacagatcttcaagaccaacacatagacttaccg

SEQ ID NO: 32227 - DNA, 37 bp, Artificial Sequence
  Description of Artificial Sequence: Synthetic oligonucleotide
acacagatcttcaagaccaacacatagacttaccgag

SEQ ID NO: 32228 - DNA, 36 bp, Artificial Sequence
  Description of Artificial Sequence: Synthetic oligonucleotide
cacagatcttcaagaccaacacatagacttaccgag

SEQ ID NO: 32229 - DNA, 37 bp, Artificial Sequence
  Description of Artificial Sequence: Synthetic oligonucleotide
acagatcttcaagaccaacacatagacttaccgagag

SEQ ID NO: 32230 - DNA, 36 bp, Artificial Sequence
  Description of Artificial Sequence: Synthetic oligonucleotide
cagatcttcaagaccaacacatagacttaccgagag

SEQ ID NO: 32231 - DNA, 37 bp, Artificial Sequence
  Description of Artificial Sequence: Synthetic oligonucleotide
agatcttcaagaccaacacatagacttaccgagagag

SEQ ID NO: 32232 - DNA, 36 bp, Artificial Sequence
  Description of Artificial Sequence: Synthetic oligonucleotide
gatcttcaagaccaacacatagacttaccgagagag

SEQ ID NO: 32233 - DNA, 36 bp, Artificial Sequence
  Description of Artificial Sequence: Synthetic oligonucleotide
atcttcaagaccaacacatagacttaccgagagagc

SEQ ID NO: 32234 - DNA, 35 bp, Artificial Sequence
  Description of Artificial Sequence: Synthetic oligonucleotide
tcttcaagaccaacacatagacttaccgagagagc

SEQ ID NO: 32235 - DNA, 34 bp, Artificial Sequence
  Description of Artificial Sequence: Synthetic oligonucleotide
cttcaagaccaacacatagacttaccgagagagc

SEQ ID NO: 32236 - DNA, 34 bp, Artificial Sequence
  Description of Artificial Sequence: Synthetic oligonucleotide
ttcaagaccaacacatagacttaccgagagagcc

SEQ ID NO: 32237 - DNA, 33 bp, Artificial Sequence
  Description of Artificial Sequence: Synthetic oligonucleotide
tcaagaccaacacatagacttaccgagagagcc

SEQ ID NO: 32238 - DNA, 32 bp, Artificial Sequence
  Description of Artificial Sequence: Synthetic oligonucleotide
caagaccaacacatagacttaccgagagagcc

SEQ ID NO: 32239 - DNA, 33 bp, Artificial Sequence
  Description of Artificial Sequence: Synthetic oligonucleotide
aagaccaacacatagacttaccgagagagcctg

SEQ ID NO: 32240 - DNA, 32 bp, Artificial Sequence
  Description of Artificial Sequence: Synthetic oligonucleotide
agaccaacacatagacttaccgagagagcctg

SEQ ID NO: 32241 - DNA, 31 bp, Artificial Sequence
  Description of Artificial Sequence: Synthetic oligonucleotide
gaccaacacatagacttaccgagagagcctg

SEQ ID NO: 32242 - DNA, 31 bp, Artificial Sequence
  Description of Artificial Sequence: Synthetic oligonucleotide
accaacacatagacttaccgagagagcctgc

SEQ ID NO: 32243 - DNA, 30 bp, Artificial Sequence
  Description of Artificial Sequence: Synthetic oligonucleotide
ccaacacatagacttaccgagagagcctgc

SEQ ID NO: 32244 - DNA, 30 bp, Artificial Sequence
  Description of Artificial Sequence: Synthetic oligonucleotide
caacacatagacttaccgagagagcctgcg

SEQ ID NO: 32245 - DNA, 30 bp, Artificial Sequence
  Description of Artificial Sequence: Synthetic oligonucleotide
aacacatagacttaccgagagagcctgcgg

SEQ ID NO: 32246 - DNA, 29 bp, Artificial Sequence
  Description of Artificial Sequence: Synthetic oligonucleotide
acacatagacttaccgagagagcctgcgg

SEQ ID NO: 32247 - DNA, 28 bp, Artificial Sequence
  Description of Artificial Sequence: Synthetic oligonucleotide
cacatagacttaccgagagagcctgcgg

SEQ ID NO: 32248 - DNA, 30 bp, Artificial Sequence
  Description of Artificial Sequence: Synthetic oligonucleotide
acatagacttaccgagagagcctgcggaac

SEQ ID NO: 32249 - DNA, 29 bp, Artificial Sequence
  Description of Artificial Sequence: Synthetic oligonucleotide
catagacttaccgagagagcctgcggaac

SEQ ID NO: 32250 - DNA, 29 bp, Artificial Sequence
  Description of Artificial Sequence: Synthetic oligonucleotide
atagacttaccgagagagcctgcggaacc

SEQ ID NO: 32251 - DNA, 28 bp, Artificial Sequence
  Description of Artificial Sequence: Synthetic oligonucleotide
tagacttaccgagagagcctgcggaacc

SEQ ID NO: 32252 - DNA, 26 bp, Artificial Sequence
  Description of Artificial Sequence: Synthetic oligonucleotide
agccccgcttcatcgcagtgggctaa

SEQ ID NO: 32253 - DNA, 25 bp, Artificial Sequence
  Description of Artificial Sequence: Synthetic oligonucleotide
gccccgcttcatcgcagtgggctaa

SEQ ID NO: 32254 - DNA, 26 bp, Artificial Sequence
  Description of Artificial Sequence: Synthetic oligonucleotide
ccccgcttcatcgcagtgggctaagt

SEQ ID NO: 32255 - DNA, 26 bp, Artificial Sequence
  Description of Artificial Sequence: Synthetic oligonucleotide
cccgcttcatcgcagtgggctaagtg

SEQ ID NO: 32256 - DNA, 27 bp, Artificial Sequence
  Description of Artificial Sequence: Synthetic oligonucleotide
ccgcttcatcgcagtgggctaagtgga

SEQ ID NO: 32257 - DNA, 27 bp, Artificial Sequence
  Description of Artificial Sequence: Synthetic oligonucleotide
cgcttcatcgcagtgggctaagtggac

SEQ ID NO: 32258 - DNA, 27 bp, Artificial Sequence
  Description of Artificial Sequence: Synthetic oligonucleotide
gcttcatcgcagtgggctaagtggacg

SEQ ID NO: 32259 - DNA, 28 bp, Artificial Sequence
  Description of Artificial Sequence: Synthetic oligonucleotide
cttcatcgcagtgggctaagtggacgac

SEQ ID NO: 32260 - DNA, 29 bp, Artificial Sequence
  Description of Artificial Sequence: Synthetic oligonucleotide
ttcatcgcagtgggctaagtggacgacac

SEQ ID NO: 32261 - DNA, 28 bp, Artificial Sequence
  Description of Artificial Sequence: Synthetic oligonucleotide
tcatcgcagtgggctaagtggacgacac

SEQ ID NO: 32262 - DNA, 27 bp, Artificial Sequence
  Description of Artificial Sequence: Synthetic oligonucleotide
catcgcagtgggctaagtggacgacac

SEQ ID NO: 32263 - DNA, 27 bp, Artificial Sequence
  Description of Artificial Sequence: Synthetic oligonucleotide
atcgcagtgggctaagtggacgacacc

SEQ ID NO: 32264 - DNA, 26 bp, Artificial Sequence
  Description of Artificial Sequence: Synthetic oligonucleotide
tcgcagtgggctaagtggacgacacc

SEQ ID NO: 32265 - DNA, 25 bp, Artificial Sequence
  Description of Artificial Sequence: Synthetic oligonucleotide
cgcagtgggctaagtggacgacacc

SEQ ID NO: 32266 - DNA, 26 bp, Artificial Sequence
  Description of Artificial Sequence: Synthetic oligonucleotide
gcagtgggctaagtggacgacaccca

SEQ ID NO: 32267 - DNA, 27 bp, Artificial Sequence
  Description of Artificial Sequence: Synthetic oligonucleotide
cagtgggctaagtggacgacacccagt

SEQ ID NO: 32268 - DNA, 28 bp, Artificial Sequence
  Description of Artificial Sequence: Synthetic oligonucleotide
agtgggctaagtggacgacacccagttc

SEQ ID NO: 32269 - DNA, 27 bp, Artificial Sequence
  Description of Artificial Sequence: Synthetic oligonucleotide
gtgggctaagtggacgacacccagttc

SEQ ID NO: 32270 - DNA, 27 bp, Artificial Sequence
  Description of Artificial Sequence: Synthetic oligonucleotide
tgggctaagtggacgacacccagttcg

SEQ ID NO: 32271 - DNA, 27 bp, Artificial Sequence
  Description of Artificial Sequence: Synthetic oligonucleotide
gggctaagtggacgacacccagttcgt

SEQ ID NO: 32272 - DNA, 27 bp, Artificial Sequence
  Description of Artificial Sequence: Synthetic oligonucleotide
ggctaagtggacgacacccagttcgtg

SEQ ID NO: 32273 - DNA, 28 bp, Artificial Sequence
  Description of Artificial Sequence: Synthetic oligonucleotide
gctaagtggacgacacccagttcgtgag

SEQ ID NO: 32274 - DNA, 28 bp, Artificial Sequence
  Description of Artificial Sequence: Synthetic oligonucleotide
ctaagtggacgacacccagttcgtgagg

SEQ ID NO: 32275 - DNA, 30 bp, Artificial Sequence
  Description of Artificial Sequence: Synthetic oligonucleotide
taagtggacgacacccagttcgtgaggttc

SEQ ID NO: 32276 - DNA, 29 bp, Artificial Sequence
  Description of Artificial Sequence: Synthetic oligonucleotide
aagtggacgacacccagttcgtgaggttc

SEQ ID NO: 32277 - DNA, 28 bp, Artificial Sequence
  Description of Artificial Sequence: Synthetic oligonucleotide
agtggacgacacccagttcgtgaggttc

SEQ ID NO: 32278 - DNA, 20 bp, Artificial Sequence
  Description of Artificial Sequence: Synthetic oligonucleotide
gacgggcgcctcctccgcct

SEQ ID NO: 32279 - DNA, 20 bp, Artificial Sequence
  Description of Artificial Sequence: Synthetic oligonucleotide
acgggcgcctcctccgccgt

SEQ ID NO: 32280 - DNA, 20 bp, Artificial Sequence
  Description of Artificial Sequence: Synthetic oligonucleotide
cgggcgcctcctccgccgtt

SEQ ID NO: 32281 - DNA, 20 bp, Artificial Sequence
  Description of Artificial Sequence: Synthetic oligonucleotide
gggcgcctcctccgccggtt

SEQ ID NO: 32282 - DNA, 20 bp, Artificial Sequence
  Description of Artificial Sequence: Synthetic oligonucleotide
ggcgcctcctccgccggcat

SEQ ID NO: 32283 - DNA, 21 bp, Artificial Sequence
  Description of Artificial Sequence: Synthetic oligonucleotide
gcgcctcctccgccggcatga

SEQ ID NO: 32284 - DNA, 21 bp, Artificial Sequence
  Description of Artificial Sequence: Synthetic oligonucleotide
cgcctcctccgccggcatgac

SEQ ID NO: 32285 - DNA, 22 bp, Artificial Sequence
  Description of Artificial Sequence: Synthetic oligonucleotide
gcctcctccgccggcatgacca

SEQ ID NO: 32286 - DNA, 23 bp, Artificial Sequence
  Description of Artificial Sequence: Synthetic oligonucleotide
cctcctccgccggcatgaccagt

SEQ ID NO: 32287 - DNA, 23 bp, Artificial Sequence
  Description of Artificial Sequence: Synthetic oligonucleotide
ctcctccgccggcatgaccagtc

SEQ ID NO: 32288 - DNA, 23 bp, Artificial Sequence
  Description of Artificial Sequence: Synthetic oligonucleotide
tcctccgccggcatgaccagtcc

SEQ ID NO: 32289 - DNA, 22 bp, Artificial Sequence
  Description of Artificial Sequence: Synthetic oligonucleotide
cctccgccggcatgaccagtcc

SEQ ID NO: 32290 - DNA, 22 bp, Artificial Sequence
  Description of Artificial Sequence: Synthetic oligonucleotide
ctccgccggcatgaccagtccg

SEQ ID NO: 32291 - DNA, 22 bp, Artificial Sequence
  Description of Artificial Sequence: Synthetic oligonucleotide
tccgccggcatgaccagtccgc

SEQ ID NO: 32292 - DNA, 21 bp, Artificial Sequence
  Description of Artificial Sequence: Synthetic oligonucleotide
ccgccggcatgaccagtccgc

SEQ ID NO: 32293 - DNA, 23 bp, Artificial Sequence
  Description of Artificial Sequence: Synthetic oligonucleotide
cgccggcatgaccagtccgccta

SEQ ID NO: 32294 - DNA, 23 bp, Artificial Sequence
  Description of Artificial Sequence: Synthetic oligonucleotide
gccggcatgaccagtccgcctac

SEQ ID NO: 32295 - DNA, 24 bp, Artificial Sequence
  Description of Artificial Sequence: Synthetic oligonucleotide
ccggcatgaccagtccgcctacga

SEQ ID NO: 32296 - DNA, 24 bp, Artificial Sequence
  Description of Artificial Sequence: Synthetic oligonucleotide
cggcatgaccagtccgcctacgac

SEQ ID NO: 32297 - DNA, 22 bp, Artificial Sequence
  Description of Artificial Sequence: Synthetic oligonucleotide
gagggcctgtgcgtggagtggc

SEQ ID NO: 32298 - DNA, 22 bp, Artificial Sequence
  Description of Artificial Sequence: Synthetic oligonucleotide
agggcctgtgcgtggagtggcc

SEQ ID NO: 32299 - DNA, 21 bp, Artificial Sequence
  Description of Artificial Sequence: Synthetic oligonucleotide
gggcctgtgcgtggagtggcc

SEQ ID NO: 32300 - DNA, 21 bp, Artificial Sequence
  Description of Artificial Sequence: Synthetic oligonucleotide
ggcctgtgcgtggagtggccc

SEQ ID NO: 32301 - DNA, 21 bp, Artificial Sequence
  Description of Artificial Sequence: Synthetic oligonucleotide
gcctgtgcgtggagtggcccc

SEQ ID NO: 32302 - DNA, 21 bp, Artificial Sequence
  Description of Artificial Sequence: Synthetic oligonucleotide
cctgtgcgtggagtggccccg

SEQ ID NO: 32303 - DNA, 22 bp, Artificial Sequence
  Description of Artificial Sequence: Synthetic oligonucleotide
ctgtgcgtggagtggccccgca

SEQ ID NO: 32304 - DNA, 25 bp, Artificial Sequence
  Description of Artificial Sequence: Synthetic oligonucleotide
tgtgcgtggagtggccccgcagata

SEQ ID NO: 32305 - DNA, 24 bp, Artificial Sequence
  Description of Artificial Sequence: Synthetic oligonucleotide
gtgcgtggagtggccccgcagata

SEQ ID NO: 32306 - DNA, 24 bp, Artificial Sequence
  Description of Artificial Sequence: Synthetic oligonucleotide
tgcgtggagtggccccgcagatac

SEQ ID NO: 32307 - DNA, 23 bp, Artificial Sequence
  Description of Artificial Sequence: Synthetic oligonucleotide
gcgtggagtggccccgcagatac

SEQ ID NO: 32308 - DNA, 24 bp, Artificial Sequence
  Description of Artificial Sequence: Synthetic oligonucleotide
cgtggagtggccccgcagatacct

SEQ ID NO: 32309 - DNA, 24 bp, Artificial Sequence
  Description of Artificial Sequence: Synthetic oligonucleotide
gtggagtggccccgcagatacctg

SEQ ID NO: 32310 - DNA, 25 bp, Artificial Sequence
  Description of Artificial Sequence: Synthetic oligonucleotide
tggagtggccccgcagatacctgga

SEQ ID NO: 32311 - DNA, 24 bp, Artificial Sequence
  Description of Artificial Sequence: Synthetic oligonucleotide
ggagtggccccgcagatacctgga

SEQ ID NO: 32312 - DNA, 26 bp, Artificial Sequence
  Description of Artificial Sequence: Synthetic oligonucleotide
gagtggccccgcagatacctggagaa

SEQ ID NO: 32313 - DNA, 26 bp, Artificial Sequence
  Description of Artificial Sequence: Synthetic oligonucleotide
agtggccccgcagatacctggagaac

SEQ ID NO: 32314 - DNA, 25 bp, Artificial Sequence
  Description of Artificial Sequence: Synthetic oligonucleotide
gtggccccgcagatacctggagaac

SEQ ID NO: 32315 - DNA, 25 bp, Artificial Sequence
  Description of Artificial Sequence: Synthetic oligonucleotide
tggccccgcagatacctggagaacg

SEQ ID NO: 32316 - DNA, 24 bp, Artificial Sequence
  Description of Artificial Sequence: Synthetic oligonucleotide
ggccccgcagatacctggagaacg

SEQ ID NO: 32317 - DNA, 24 bp, Artificial Sequence
  Description of Artificial Sequence: Synthetic oligonucleotide
gccccgcagatacctggagaacgg

SEQ ID NO: 32318 - DNA, 26 bp, Artificial Sequence
  Description of Artificial Sequence: Synthetic oligonucleotide
ccccgcagatacctggagaacgggaa

SEQ ID NO: 32319 - DNA, 26 bp, Artificial Sequence
  Description of Artificial Sequence: Synthetic oligonucleotide
cccgcagatacctggagaacgggaag

SEQ ID NO: 32320 - DNA, 21 bp, Artificial Sequence
  Description of Artificial Sequence: Synthetic oligonucleotide
gcgcctcctccgcgggcatgt

SEQ ID NO: 32321 - DNA, 21 bp, Artificial Sequence
  Description of Artificial Sequence: Synthetic oligonucleotide
cgcctcctccgcgggcatgtc

SEQ ID NO: 32322 - DNA, 22 bp, Artificial Sequence
  Description of Artificial Sequence: Synthetic oligonucleotide
gcctcctccgcgggcatgtcca

SEQ ID NO: 32323 - DNA, 23 bp, Artificial Sequence
  Description of Artificial Sequence: Synthetic oligonucleotide
cctcctccgcgggcatgtccagt

SEQ ID NO: 32324 - DNA, 23 bp, Artificial Sequence
  Description of Artificial Sequence: Synthetic oligonucleotide
ctcctccgcgggcatgtccagtc

SEQ ID NO: 32325 - DNA, 23 bp, Artificial Sequence
  Description of Artificial Sequence: Synthetic oligonucleotide
tcctccgcgggcatgtccagtcc

SEQ ID NO: 32326 - DNA, 22 bp, Artificial Sequence
  Description of Artificial Sequence: Synthetic oligonucleotide
cctccgcgggcatgtccagtcc

SEQ ID NO: 32327 - DNA, 22 bp, Artificial Sequence
  Description of Artificial Sequence: Synthetic oligonucleotide
ctccgcgggcatgtccagtccg

SEQ ID NO: 32328 - DNA, 22 bp, Artificial Sequence
  Description of Artificial Sequence: Synthetic oligonucleotide
tccgcgggcatgtccagtccgc

SEQ ID NO: 32329 - DNA, 21 bp, Artificial Sequence
  Description of Artificial Sequence: Synthetic oligonucleotide
ccgcgggcatgtccagtccgc

SEQ ID NO: 32330 - DNA, 23 bp, Artificial Sequence
  Description of Artificial Sequence: Synthetic oligonucleotide
cgcgggcatgtccagtccgccta

SEQ ID NO: 32331 - DNA, 23 bp, Artificial Sequence
  Description of Artificial Sequence: Synthetic oligonucleotide
gcgggcatgtccagtccgcctac

SEQ ID NO: 32332 - DNA, 24 bp, Artificial Sequence
  Description of Artificial Sequence: Synthetic oligonucleotide
cgggcatgtccagtccgcctacga

SEQ ID NO: 32333 - DNA, 24 bp, Artificial Sequence
  Description of Artificial Sequence: Synthetic oligonucleotide
gggcatgtccagtccgcctacgac

SEQ ID NO: 32334 - DNA, 24 bp, Artificial Sequence
  Description of Artificial Sequence: Synthetic oligonucleotide
ggcatgtccagtccgcctacgacg

SEQ ID NO: 32335 - DNA, 24 bp, Artificial Sequence
  Description of Artificial Sequence: Synthetic oligonucleotide
gcatgtccagtccgcctacgacgg

SEQ ID NO: 32336 - DNA, 26 bp, Artificial Sequence
  Description of Artificial Sequence: Synthetic oligonucleotide
catgtccagtccgcctacgacggcaa

SEQ ID NO: 32337 - DNA, 26 bp, Artificial Sequence
  Description of Artificial Sequence: Synthetic oligonucleotide
atgtccagtccgcctacgacggcaag

SEQ ID NO: 32338 - DNA, 25 bp, Artificial Sequence
  Description of Artificial Sequence: Synthetic oligonucleotide
tgtccagtccgcctacgacggcaag

SEQ ID NO: 32339 - DNA, 24 bp, Artificial Sequence
  Description of Artificial Sequence: Synthetic oligonucleotide
gtccagtccgcctacgacggcaag

SEQ ID NO: 32340 - DNA, 27 bp, Artificial Sequence
  Description of Artificial Sequence: Synthetic oligonucleotide
tccagtccgcctacgacggcaaggatt

SEQ ID NO: 32341 - DNA, 32 bp, Artificial Sequence
  Description of Artificial Sequence: Synthetic oligonucleotide
accagcaggagatagaaccttccagaagtgag

SEQ ID NO: 32342 - DNA, 31 bp, Artificial Sequence
  Description of Artificial Sequence: Synthetic oligonucleotide
ccagcaggagatagaaccttccagaagtgag

SEQ ID NO: 32343 - DNA, 31 bp, Artificial Sequence
  Description of Artificial Sequence: Synthetic oligonucleotide
cagcaggagatagaaccttccagaagtgagc

SEQ ID NO: 32344 - DNA, 32 bp, Artificial Sequence
  Description of Artificial Sequence: Synthetic oligonucleotide
agcaggagatagaaccttccagaagtgagcag

SEQ ID NO: 32345 - DNA, 31 bp, Artificial Sequence
  Description of Artificial Sequence: Synthetic oligonucleotide
gcaggagatagaaccttccagaagtgagcag

SEQ ID NO: 32346 - DNA, 31 bp, Artificial Sequence
  Description of Artificial Sequence: Synthetic oligonucleotide
caggagatagaaccttccagaagtgagcagc

SEQ ID NO: 32347 - DNA, 32 bp, Artificial Sequence
  Description of Artificial Sequence: Synthetic oligonucleotide
aggagatagaaccttccagaagtgagcagctg

SEQ ID NO: 32348 - DNA, 31 bp, Artificial Sequence
  Description of Artificial Sequence: Synthetic oligonucleotide
ggagatagaaccttccagaagtgagcagctg

SEQ ID NO: 32349 - DNA, 32 bp, Artificial Sequence
  Description of Artificial Sequence: Synthetic oligonucleotide
gagatagaaccttccagaagtgagcagctgtg

SEQ ID NO: 32350 - DNA, 32 bp, Artificial Sequence
  Description of Artificial Sequence: Synthetic oligonucleotide
agatagaaccttccagaagtgagcagctgtgg

SEQ ID NO: 32351 - DNA, 31 bp, Artificial Sequence
  Description of Artificial Sequence: Synthetic oligonucleotide
gatagaaccttccagaagtgagcagctgtgg

SEQ ID NO: 32352 - DNA, 32 bp, Artificial Sequence
  Description of Artificial Sequence: Synthetic oligonucleotide
atagaaccttccagaagtgagcagctgtggtg

SEQ ID NO: 32353 - DNA, 31 bp, Artificial Sequence
  Description of Artificial Sequence: Synthetic oligonucleotide
tagaaccttccagaagtgagcagctgtggtg

SEQ ID NO: 32354 - DNA, 30 bp, Artificial Sequence
  Description of Artificial Sequence: Synthetic oligonucleotide
agaaccttccagaagtgagcagctgtggtg

SEQ ID NO: 32355 - DNA, 29 bp, Artificial Sequence
  Description of Artificial Sequence: Synthetic oligonucleotide
gaaccttccagaagtgagcagctgtggtg

SEQ ID NO: 32356 - DNA, 29 bp, Artificial Sequence
  Description of Artificial Sequence: Synthetic oligonucleotide
aaccttccagaagtgagcagctgtggtgg

SEQ ID NO: 32357 - DNA, 28 bp, Artificial Sequence
  Description of Artificial Sequence: Synthetic oligonucleotide
accttccagaagtgagcagctgtggtgg

SEQ ID NO: 32358 - DNA, 27 bp, Artificial Sequence
  Description of Artificial Sequence: Synthetic oligonucleotide
ccttccagaagtgagcagctgtggtgg

SEQ ID NO: 32359 - DNA, 28 bp, Artificial Sequence
  Description of Artificial Sequence: Synthetic oligonucleotide
cttccagaagtgagcagctgtggtggtg

SEQ ID NO: 32360 - DNA, 28 bp, Artificial Sequence
  Description of Artificial Sequence: Synthetic oligonucleotide
ttccagaagtgagcagctgtggtggtgc

SEQ ID NO: 32361 - DNA, 27 bp, Artificial Sequence
  Description of Artificial Sequence: Synthetic oligonucleotide
tccagaagtgagcagctgtggtggtgc

SEQ ID NO: 32362 - DNA, 26 bp, Artificial Sequence
  Description of Artificial Sequence: Synthetic oligonucleotide
ccagaagtgagcagctgtggtggtgc

SEQ ID NO: 32363 - DNA, 27 bp, Artificial Sequence
  Description of Artificial Sequence: Synthetic oligonucleotide
cagaagtgagcagctgtggtggtgcct

SEQ ID NO: 32364 - DNA, 28 bp, Artificial Sequence
  Description of Artificial Sequence: Synthetic oligonucleotide
agaagtgagcagctgtggtggtgccttc

SEQ ID NO: 32365 - DNA, 27 bp, Artificial Sequence
  Description of Artificial Sequence: Synthetic oligonucleotide
gaagtgagcagctgtggtggtgccttc

SEQ ID NO: 32366 - DNA, 28 bp, Artificial Sequence
  Description of Artificial Sequence: Synthetic oligonucleotide
aagtgagcagctgtggtggtgccttctg

SEQ ID NO: 32367 - DNA, 27 bp, Artificial Sequence
  Description of Artificial Sequence: Synthetic oligonucleotide
agtgagcagctgtggtggtgccttctg

SEQ ID NO: 32368 - DNA, 26 bp, Artificial Sequence
  Description of Artificial Sequence: Synthetic oligonucleotide
gtgagcagctgtggtggtgccttctg

SEQ ID NO: 32369 - DNA, 27 bp, Artificial Sequence
  Description of Artificial Sequence: Synthetic oligonucleotide
tgagcagctgtggtggtgccttctgga

SEQ ID NO: 32370 - DNA, 26 bp, Artificial Sequence
  Description of Artificial Sequence: Synthetic oligonucleotide
gagcagctgtggtggtgccttctgga

SEQ ID NO: 32371 - DNA, 27 bp, Artificial Sequence
  Description of Artificial Sequence: Synthetic oligonucleotide
agcagctgtggtggtgccttctggaga

SEQ ID NO: 32372 - DNA, 26 bp, Artificial Sequence
  Description of Artificial Sequence: Synthetic oligonucleotide
tgggctacgtggacgacacccagttg

SEQ ID NO: 32373 - DNA, 25 bp, Artificial Sequence
  Description of Artificial Sequence: Synthetic oligonucleotide
gggctacgtggacgacacccagttg

SEQ ID NO: 32374 - DNA, 26 bp, Artificial Sequence
  Description of Artificial Sequence: Synthetic oligonucleotide
ggctacgtggacgacacccagttggt

SEQ ID NO: 32375 - DNA, 27 bp, Artificial Sequence
  Description of Artificial Sequence: Synthetic oligonucleotide
gctacgtggacgacacccagttggtga

SEQ ID NO: 32376 - DNA, 27 bp, Artificial Sequence
  Description of Artificial Sequence: Synthetic oligonucleotide
ctacgtggacgacacccagttggtgag

SEQ ID NO: 32377 - DNA, 27 bp, Artificial Sequence
  Description of Artificial Sequence: Synthetic oligonucleotide
tacgtggacgacacccagttggtgagg

SEQ ID NO: 32378 - DNA, 27 bp, Artificial Sequence
  Description of Artificial Sequence: Synthetic oligonucleotide
acgtggacgacacccagttggtgaggt

SEQ ID NO: 32379 - DNA, 27 bp, Artificial Sequence
  Description of Artificial Sequence: Synthetic oligonucleotide
cgtggacgacacccagttggtgaggtt

SEQ ID NO: 32380 - DNA, 27 bp, Artificial Sequence
  Description of Artificial Sequence: Synthetic oligonucleotide
gtggacgacacccagttggtgaggttc

SEQ ID NO: 32381 - DNA, 27 bp, Artificial Sequence
  Description of Artificial Sequence: Synthetic oligonucleotide
tggacgacacccagttggtgaggttcg

SEQ ID NO: 32382 - DNA, 27 bp, Artificial Sequence
  Description of Artificial Sequence: Synthetic oligonucleotide
ggacgacacccagttggtgaggttcga

SEQ ID NO: 32383 - DNA, 27 bp, Artificial Sequence
  Description of Artificial Sequence: Synthetic oligonucleotide
gacgacacccagttggtgaggttcgac

SEQ ID NO: 32384 - DNA, 28 bp, Artificial Sequence
  Description of Artificial Sequence: Synthetic oligonucleotide
acgacacccagttggtgaggttcgacag

SEQ ID NO: 32385 - DNA, 27 bp, Artificial Sequence
  Description of Artificial Sequence: Synthetic oligonucleotide
cgacacccagttggtgaggttcgacag

SEQ ID NO: 32386 - DNA, 27 bp, Artificial Sequence
  Description of Artificial Sequence: Synthetic oligonucleotide
gacacccagttggtgaggttcgacagc

SEQ ID NO: 32387 - DNA, 27 bp, Artificial Sequence
  Description of Artificial Sequence: Synthetic oligonucleotide
acacccagttggtgaggttcgacagcg

SEQ ID NO: 32388 - DNA, 27 bp, Artificial Sequence
  Description of Artificial Sequence: Synthetic oligonucleotide
cacccagttggtgaggttcgacagcga

SEQ ID NO: 32389 - DNA, 27 bp, Artificial Sequence
  Description of Artificial Sequence: Synthetic oligonucleotide
acccagttggtgaggttcgacagcgac

SEQ ID NO: 32390 - DNA, 26 bp, Artificial Sequence
  Description of Artificial Sequence: Synthetic oligonucleotide
cccagttggtgaggttcgacagcgac

SEQ ID NO: 32391 - DNA, 26 bp, Artificial Sequence
  Description of Artificial Sequence: Synthetic oligonucleotide
ccagttggtgaggttcgacagcgacg

SEQ ID NO: 32392 - DNA, 26 bp, Artificial Sequence
  Description of Artificial Sequence: Synthetic oligonucleotide
cagttggtgaggttcgacagcgacgc

SEQ ID NO: 32393 - DNA, 26 bp, Artificial Sequence
  Description of Artificial Sequence: Synthetic oligonucleotide
agttggtgaggttcgacagcgacgcc

SEQ ID NO: 32394 - DNA, 25 bp, Artificial Sequence
  Description of Artificial Sequence: Synthetic oligonucleotide
gttggtgaggttcgacagcgacgcc

SEQ ID NO: 32395 - DNA, 25 bp, Artificial Sequence
  Description of Artificial Sequence: Synthetic oligonucleotide
ttggtgaggttcgacagcgacgccg

SEQ ID NO: 32396 - DNA, 24 bp, Artificial Sequence
  Description of Artificial Sequence: Synthetic oligonucleotide
tggtgaggttcgacagcgacgccg

SEQ ID NO: 32397 - DNA, 23 bp, Artificial Sequence
  Description of Artificial Sequence: Synthetic oligonucleotide
ggtgaggttcgacagcgacgccg

SEQ ID NO: 32398 - DNA, 28 bp, Artificial Sequence
  Description of Artificial Sequence: Synthetic oligonucleotide
ctacgtggacgacacccagttcgtgaag

SEQ ID NO: 32399 - DNA, 30 bp, Artificial Sequence
  Description of Artificial Sequence: Synthetic oligonucleotide
tacgtggacgacacccagttcgtgaagttc

SEQ ID NO: 32400 - DNA, 29 bp, Artificial Sequence
  Description of Artificial Sequence: Synthetic oligonucleotide
acgtggacgacacccagttcgtgaagttc

SEQ ID NO: 32401 - DNA, 28 bp, Artificial Sequence
  Description of Artificial Sequence: Synthetic oligonucleotide
cgtggacgacacccagttcgtgaagttc

SEQ ID NO: 32402 - DNA, 28 bp, Artificial Sequence
  Description of Artificial Sequence: Synthetic oligonucleotide
gtggacgacacccagttcgtgaagttcg

SEQ ID NO: 32403 - DNA, 29 bp, Artificial Sequence
  Description of Artificial Sequence: Synthetic oligonucleotide
tggacgacacccagttcgtgaagttcgac

SEQ ID NO: 32404 - DNA, 28 bp, Artificial Sequence
  Description of Artificial Sequence: Synthetic oligonucleotide
ggacgacacccagttcgtgaagttcgac

SEQ ID NO: 32405 - DNA, 29 bp, Artificial Sequence
  Description of Artificial Sequence: Synthetic oligonucleotide
gacgacacccagttcgtgaagttcgacag

SEQ ID NO: 32406 - DNA, 29 bp, Artificial Sequence
  Description of Artificial Sequence: Synthetic oligonucleotide
acgacacccagttcgtgaagttcgacagc

SEQ ID NO: 32407 - DNA, 28 bp, Artificial Sequence
  Description of Artificial Sequence: Synthetic oligonucleotide
cgacacccagttcgtgaagttcgacagc

SEQ ID NO: 32408 - DNA, 28 bp, Artificial Sequence
  Description of Artificial Sequence: Synthetic oligonucleotide
gacacccagttcgtgaagttcgacagcg

SEQ ID NO: 32409 - DNA, 29 bp, Artificial Sequence
  Description of Artificial Sequence: Synthetic oligonucleotide
acacccagttcgtgaagttcgacagcgac

SEQ ID NO: 32410 - DNA, 28 bp, Artificial Sequence
  Description of Artificial Sequence: Synthetic oligonucleotide
cacccagttcgtgaagttcgacagcgac

SEQ ID NO: 32411 - DNA, 28 bp, Artificial Sequence
  Description of Artificial Sequence: Synthetic oligonucleotide
acccagttcgtgaagttcgacagcgacg

SEQ ID NO: 32412 - DNA, 27 bp, Artificial Sequence
  Description of Artificial Sequence: Synthetic oligonucleotide
cccagttcgtgaagttcgacagcgacg

SEQ ID NO: 32413 - DNA, 27 bp, Artificial Sequence
  Description of Artificial Sequence: Synthetic oligonucleotide
ccagttcgtgaagttcgacagcgacgc

SEQ ID NO: 32414 - DNA, 27 bp, Artificial Sequence
  Description of Artificial Sequence: Synthetic oligonucleotide
cagttcgtgaagttcgacagcgacgcc

SEQ ID NO: 32415 - DNA, 27 bp, Artificial Sequence
  Description of Artificial Sequence: Synthetic oligonucleotide
agttcgtgaagttcgacagcgacgccg

SEQ ID NO: 32416 - DNA, 26 bp, Artificial Sequence
  Description of Artificial Sequence: Synthetic oligonucleotide
gttcgtgaagttcgacagcgacgccg

SEQ ID NO: 32417 - DNA, 26 bp, Artificial Sequence
  Description of Artificial Sequence: Synthetic oligonucleotide
ttcgtgaagttcgacagcgacgccgc

SEQ ID NO: 32418 - DNA, 25 bp, Artificial Sequence
  Description of Artificial Sequence: Synthetic oligonucleotide
tcgtgaagttcgacagcgacgccgc

SEQ ID NO: 32419 - DNA, 24 bp, Artificial Sequence
  Description of Artificial Sequence: Synthetic oligonucleotide
cgtgaagttcgacagcgacgccgc

SEQ ID NO: 32420 - DNA, 25 bp, Artificial Sequence
  Description of Artificial Sequence: Synthetic oligonucleotide
gtgaagttcgacagcgacgccgcga

SEQ ID NO: 32421 - DNA, 26 bp, Artificial Sequence
  Description of Artificial Sequence: Synthetic oligonucleotide
tgaagttcgacagcgacgccgcgagt

SEQ ID NO: 32422 - DNA, 25 bp, Artificial Sequence
  Description of Artificial Sequence: Synthetic oligonucleotide
gaagttcgacagcgacgccgcgagt

SEQ ID NO: 32423 - DNA, 25 bp, Artificial Sequence
  Description of Artificial Sequence: Synthetic oligonucleotide
aagttcgacagcgacgccgcgagtc

SEQ ID NO: 32424 - DNA, 24 bp, Artificial Sequence
  Description of Artificial Sequence: Synthetic oligonucleotide
agttcgacagcgacgccgcgagtc

SEQ ID NO: 32425 - DNA, 20 bp, Artificial Sequence
  Description of Artificial Sequence: Synthetic oligonucleotide
gaggcggcccgtgtggcgca

SEQ ID NO: 32426 - DNA, 20 bp, Artificial Sequence
  Description of Artificial Sequence: Synthetic oligonucleotide
aggcggcccgtgtggcgcag

SEQ ID NO: 32427 - DNA, 20 bp, Artificial Sequence
  Description of Artificial Sequence: Synthetic oligonucleotide
ggcggcccgtgtggcgcagt

SEQ ID NO: 32428 - DNA, 20 bp, Artificial Sequence
  Description of Artificial Sequence: Synthetic oligonucleotide
gcggcccgtgtggcgcagca

SEQ ID NO: 32429 - DNA, 20 bp, Artificial Sequence
  Description of Artificial Sequence: Synthetic oligonucleotide
cggcccgtgtggcgcagcag

SEQ ID NO: 32430 - DNA, 21 bp, Artificial Sequence
  Description of Artificial Sequence: Synthetic oligonucleotide
ggcccgtgtggcgcagcagct

SEQ ID NO: 32431 - DNA, 22 bp, Artificial Sequence
  Description of Artificial Sequence: Synthetic oligonucleotide
gcccgtgtggcgcagcagctga

SEQ ID NO: 32432 - DNA, 23 bp, Artificial Sequence
  Description of Artificial Sequence: Synthetic oligonucleotide
cccgtgtggcgcagcagctgaga

SEQ ID NO: 32433 - DNA, 23 bp, Artificial Sequence
  Description of Artificial Sequence: Synthetic oligonucleotide
ccgtgtggcgcagcagctgagag

SEQ ID NO: 32434 - DNA, 23 bp, Artificial Sequence
  Description of Artificial Sequence: Synthetic oligonucleotide
cgtgtggcgcagcagctgagagc

SEQ ID NO: 32435 - DNA, 25 bp, Artificial Sequence
  Description of Artificial Sequence: Synthetic oligonucleotide
gtgtggcgcagcagctgagagccta

SEQ ID NO: 32436 - DNA, 25 bp, Artificial Sequence
  Description of Artificial Sequence: Synthetic oligonucleotide
tgtggcgcagcagctgagagcctac

SEQ ID NO: 32437 - DNA, 24 bp, Artificial Sequence
  Description of Artificial Sequence: Synthetic oligonucleotide
gtggcgcagcagctgagagcctac

SEQ ID NO: 32438 - DNA, 25 bp, Artificial Sequence
  Description of Artificial Sequence: Synthetic oligonucleotide
tggcgcagcagctgagagcctacct

SEQ ID NO: 32439 - DNA, 24 bp, Artificial Sequence
  Description of Artificial Sequence: Synthetic oligonucleotide
ggcgcagcagctgagagcctacct

SEQ ID NO: 32440 - DNA, 24 bp, Artificial Sequence
  Description of Artificial Sequence: Synthetic oligonucleotide
gcgcagcagctgagagcctacctg

SEQ ID NO: 32441 - DNA, 25 bp, Artificial Sequence
  Description of Artificial Sequence: Synthetic oligonucleotide
cgcagcagctgagagcctacctgga

SEQ ID NO: 32442 - DNA, 25 bp, Artificial Sequence
  Description of Artificial Sequence: Synthetic oligonucleotide
gcagcagctgagagcctacctggag

SEQ ID NO: 32443 - DNA, 25 bp, Artificial Sequence
  Description of Artificial Sequence: Synthetic oligonucleotide
cagcagctgagagcctacctggagg

SEQ ID NO: 32444 - DNA, 27 bp, Artificial Sequence
  Description of Artificial Sequence: Synthetic oligonucleotide
atcgcagtgggctacgtggacaacacc

SEQ ID NO: 32445 - DNA, 26 bp, Artificial Sequence
  Description of Artificial Sequence: Synthetic oligonucleotide
tcgcagtgggctacgtggacaacacc

SEQ ID NO: 32446 - DNA, 25 bp, Artificial Sequence
  Description of Artificial Sequence: Synthetic oligonucleotide
cgcagtgggctacgtggacaacacc

SEQ ID NO: 32447 - DNA, 26 bp, Artificial Sequence
  Description of Artificial Sequence: Synthetic oligonucleotide
gcagtgggctacgtggacaacaccca

SEQ ID NO: 32448 - DNA, 27 bp, Artificial Sequence
  Description of Artificial Sequence: Synthetic oligonucleotide
cagtgggctacgtggacaacacccagt

SEQ ID NO: 32449 - DNA, 28 bp, Artificial Sequence
  Description of Artificial Sequence: Synthetic oligonucleotide
agtgggctacgtggacaacacccagttc

SEQ ID NO: 32450 - DNA, 27 bp, Artificial Sequence
  Description of Artificial Sequence: Synthetic oligonucleotide
gtgggctacgtggacaacacccagttc

SEQ ID NO: 32451 - DNA, 27 bp, Artificial Sequence
  Description of Artificial Sequence: Synthetic oligonucleotide
tgggctacgtggacaacacccagttcg

SEQ ID NO: 32452 - DNA, 27 bp, Artificial Sequence
  Description of Artificial Sequence: Synthetic oligonucleotide
gggctacgtggacaacacccagttcgt

SEQ ID NO: 32453 - DNA, 27 bp, Artificial Sequence
  Description of Artificial Sequence: Synthetic oligonucleotide
ggctacgtggacaacacccagttcgtg

SEQ ID NO: 32454 - DNA, 28 bp, Artificial Sequence
  Description of Artificial Sequence: Synthetic oligonucleotide
gctacgtggacaacacccagttcgtgag

SEQ ID NO: 32455 - DNA, 28 bp, Artificial Sequence
  Description of Artificial Sequence: Synthetic oligonucleotide
ctacgtggacaacacccagttcgtgagg

SEQ ID NO: 32456 - DNA, 30 bp, Artificial Sequence
  Description of Artificial Sequence: Synthetic oligonucleotide
tacgtggacaacacccagttcgtgaggttc

SEQ ID NO: 32457 - DNA, 29 bp, Artificial Sequence
  Description of Artificial Sequence: Synthetic oligonucleotide
acgtggacaacacccagttcgtgaggttc

SEQ ID NO: 32458 - DNA, 28 bp, Artificial Sequence
  Description of Artificial Sequence: Synthetic oligonucleotide
cgtggacaacacccagttcgtgaggttc

SEQ ID NO: 32459 - DNA, 28 bp, Artificial Sequence
  Description of Artificial Sequence: Synthetic oligonucleotide
gtggacaacacccagttcgtgaggttcg

SEQ ID NO: 32460 - DNA, 29 bp, Artificial Sequence
  Description of Artificial Sequence: Synthetic oligonucleotide
tggacaacacccagttcgtgaggttcgac

SEQ ID NO: 32461 - DNA, 28 bp, Artificial Sequence
  Description of Artificial Sequence: Synthetic oligonucleotide
ggacaacacccagttcgtgaggttcgac

SEQ ID NO: 32462 - DNA, 29 bp, Artificial Sequence
  Description of Artificial Sequence: Synthetic oligonucleotide
gacaacacccagttcgtgaggttcgacag

SEQ ID NO: 32463 - DNA, 29 bp, Artificial Sequence
  Description of Artificial Sequence: Synthetic oligonucleotide
acaacacccagttcgtgaggttcgacagc

SEQ ID NO: 32464 - DNA, 28 bp, Artificial Sequence
  Description of Artificial Sequence: Synthetic oligonucleotide
caacacccagttcgtgaggttcgacagc

SEQ ID NO: 32465 - DNA, 28 bp, Artificial Sequence
  Description of Artificial Sequence: Synthetic oligonucleotide
aacacccagttcgtgaggttcgacagcg

SEQ ID NO: 32466 - DNA, 29 bp, Artificial Sequence
  Description of Artificial Sequence: Synthetic oligonucleotide
acggcaaggattacatcgccctgaacgac

SEQ ID NO: 32467 - DNA, 28 bp, Artificial Sequence
  Description of Artificial Sequence: Synthetic oligonucleotide
cggcaaggattacatcgccctgaacgac

SEQ ID NO: 32468 - DNA, 28 bp, Artificial Sequence
  Description of Artificial Sequence: Synthetic oligonucleotide
ggcaaggattacatcgccctgaacgacg

SEQ ID NO: 32469 - DNA, 29 bp, Artificial Sequence
  Description of Artificial Sequence: Synthetic oligonucleotide
gcaaggattacatcgccctgaacgacgac

SEQ ID NO: 32470 - DNA, 29 bp, Artificial Sequence
  Description of Artificial Sequence: Synthetic oligonucleotide
caaggattacatcgccctgaacgacgacc

SEQ ID NO: 32471 - DNA, 30 bp, Artificial Sequence
  Description of Artificial Sequence: Synthetic oligonucleotide
aaggattacatcgccctgaacgacgacctg

SEQ ID NO: 32472 - DNA, 29 bp, Artificial Sequence
  Description of Artificial Sequence: Synthetic oligonucleotide
aggattacatcgccctgaacgacgacctg

SEQ ID NO: 32473 - DNA, 28 bp, Artificial Sequence
  Description of Artificial Sequence: Synthetic oligonucleotide
ggattacatcgccctgaacgacgacctg

SEQ ID NO: 32474 - DNA, 29 bp, Artificial Sequence
  Description of Artificial Sequence: Synthetic oligonucleotide
gattacatcgccctgaacgacgacctgag

SEQ ID NO: 32475 - DNA, 29 bp, Artificial Sequence
  Description of Artificial Sequence: Synthetic oligonucleotide
attacatcgccctgaacgacgacctgagc

SEQ ID NO: 32476 - DNA, 28 bp, Artificial Sequence
  Description of Artificial Sequence: Synthetic oligonucleotide
ttacatcgccctgaacgacgacctgagc

SEQ ID NO: 32477 - DNA, 27 bp, Artificial Sequence
  Description of Artificial Sequence: Synthetic oligonucleotide
tacatcgccctgaacgacgacctgagc

SEQ ID NO: 32478 - DNA, 27 bp, Artificial Sequence
  Description of Artificial Sequence: Synthetic oligonucleotide
acatcgccctgaacgacgacctgagct

SEQ ID NO: 32479 - DNA, 26 bp, Artificial Sequence
  Description of Artificial Sequence: Synthetic oligonucleotide
catcgccctgaacgacgacctgagct

SEQ ID NO: 32480 - DNA, 26 bp, Artificial Sequence
  Description of Artificial Sequence: Synthetic oligonucleotide
atcgccctgaacgacgacctgagctc

SEQ ID NO: 32481 - DNA, 25 bp, Artificial Sequence
  Description of Artificial Sequence: Synthetic oligonucleotide
tcgccctgaacgacgacctgagctc

SEQ ID NO: 32482 - DNA, 24 bp, Artificial Sequence
  Description of Artificial Sequence: Synthetic oligonucleotide
cgccctgaacgacgacctgagctc

SEQ ID NO: 32483 - DNA, 25 bp, Artificial Sequence
  Description of Artificial Sequence: Synthetic oligonucleotide
gccctgaacgacgacctgagctcct

SEQ ID NO: 32484 - DNA, 25 bp, Artificial Sequence
  Description of Artificial Sequence: Synthetic oligonucleotide
ccctgaacgacgacctgagctcctg

SEQ ID NO: 32485 - DNA, 26 bp, Artificial Sequence
  Description of Artificial Sequence: Synthetic oligonucleotide
cctgaacgacgacctgagctcctgga

SEQ ID NO: 32486 - DNA, 26 bp, Artificial Sequence
  Description of Artificial Sequence: Synthetic oligonucleotide
ctgaacgacgacctgagctcctggac

SEQ ID NO: 32487 - DNA, 26 bp, Artificial Sequence
  Description of Artificial Sequence: Synthetic oligonucleotide
tgaacgacgacctgagctcctggacc

SEQ ID NO: 32488 - DNA, 25 bp, Artificial Sequence
  Description of Artificial Sequence: Synthetic oligonucleotide
gaacgacgacctgagctcctggacc

SEQ ID NO: 32489 - DNA, 25 bp, Artificial Sequence
  Description of Artificial Sequence: Synthetic oligonucleotide
aacgacgacctgagctcctggaccg

SEQ ID NO: 32490 - DNA, 24 bp, Artificial Sequence
  Description of Artificial Sequence: Synthetic oligonucleotide
acgacgacctgagctcctggaccg

SEQ ID NO: 32491 - DNA, 23 bp, Artificial Sequence
  Description of Artificial Sequence: Synthetic oligonucleotide
cgacgacctgagctcctggaccg

SEQ ID NO: 32492 - DNA, 23 bp, Artificial Sequence
  Description of Artificial Sequence: Synthetic oligonucleotide
gacgacctgagctcctggaccgc

SEQ ID NO: 32493 - DNA, 23 bp, Artificial Sequence
  Description of Artificial Sequence: Synthetic oligonucleotide
acgacctgagctcctggaccgcg

SEQ ID NO: 32494 - DNA, 22 bp, Artificial Sequence
  Description of Artificial Sequence: Synthetic oligonucleotide
cgacctgagctcctggaccgcg

SEQ ID NO: 32495 - DNA, 20 bp, Artificial Sequence
  Description of Artificial Sequence: Synthetic oligonucleotide
gaggcggcccgtgtggcggt

SEQ ID NO: 32496 - DNA, 20 bp, Artificial Sequence
  Description of Artificial Sequence: Synthetic oligonucleotide
aggcggcccgtgtggcgggt

SEQ ID NO: 32497 - DNA, 20 bp, Artificial Sequence
  Description of Artificial Sequence: Synthetic oligonucleotide
ggcggcccgtgtggcgggtt

SEQ ID NO: 32498 - DNA, 20 bp, Artificial Sequence
  Description of Artificial Sequence: Synthetic oligonucleotide
gcggcccgtgtggcgggctt

SEQ ID NO: 32499 - DNA, 20 bp, Artificial Sequence
  Description of Artificial Sequence: Synthetic oligonucleotide
cggcccgtgtggcgggcgtt

SEQ ID NO: 32500 - DNA, 20 bp, Artificial Sequence
  Description of Artificial Sequence: Synthetic oligonucleotide
ggcccgtgtggcgggcggat

SEQ ID NO: 32501 - DNA, 20 bp, Artificial Sequence
  Description of Artificial Sequence: Synthetic oligonucleotide
gcccgtgtggcgggcggagt

SEQ ID NO: 32502 - DNA, 20 bp, Artificial Sequence
  Description of Artificial Sequence: Synthetic oligonucleotide
cccgtgtggcgggcggagca

SEQ ID NO: 32503 - DNA, 20 bp, Artificial Sequence
  Description of Artificial Sequence: Synthetic oligonucleotide
ccgtgtggcgggcggagcag

SEQ ID NO: 32504 - DNA, 21 bp, Artificial Sequence
  Description of Artificial Sequence: Synthetic oligonucleotide
cgtgtggcgggcggagcagct

SEQ ID NO: 32505 - DNA, 22 bp, Artificial Sequence
  Description of Artificial Sequence: Synthetic oligonucleotide
gtgtggcgggcggagcagctga

SEQ ID NO: 32506 - DNA, 23 bp, Artificial Sequence
  Description of Artificial Sequence: Synthetic oligonucleotide
tgtggcgggcggagcagctgaga

SEQ ID NO: 32507 - DNA, 22 bp, Artificial Sequence
  Description of Artificial Sequence: Synthetic oligonucleotide
gtggcgggcggagcagctgaga

SEQ ID NO: 32508 - DNA, 22 bp, Artificial Sequence
  Description of Artificial Sequence: Synthetic oligonucleotide
tggcgggcggagcagctgagag

SEQ ID NO: 32509 - DNA, 21 bp, Artificial Sequence
  Description of Artificial Sequence: Synthetic oligonucleotide
ggcgggcggagcagctgagag

SEQ ID NO: 32510 - DNA, 21 bp, Artificial Sequence
  Description of Artificial Sequence: Synthetic oligonucleotide
gcgggcggagcagctgagagc

SEQ ID NO: 32511 - DNA, 30 bp, Artificial Sequence
  Description of Artificial Sequence: Synthetic oligonucleotide
ccgggtctcacatcatccagaggatgtttg

SEQ ID NO: 32512 - DNA, 30 bp, Artificial Sequence
  Description of Artificial Sequence: Synthetic oligonucleotide
cgggtctcacatcatccagaggatgtttgg

SEQ ID NO: 32513 - DNA, 30 bp, Artificial Sequence
  Description of Artificial Sequence: Synthetic oligonucleotide
gggtctcacatcatccagaggatgtttggc

SEQ ID NO: 32514 - DNA, 31 bp, Artificial Sequence
  Description of Artificial Sequence: Synthetic oligonucleotide
ggtctcacatcatccagaggatgtttggctg

SEQ ID NO: 32515 - DNA, 31 bp, Artificial Sequence
  Description of Artificial Sequence: Synthetic oligonucleotide
gtctcacatcatccagaggatgtttggctgc

SEQ ID NO: 32516 - DNA, 31 bp, Artificial Sequence
  Description of Artificial Sequence: Synthetic oligonucleotide
tctcacatcatccagaggatgtttggctgcg

SEQ ID NO: 32517 - DNA, 30 bp, Artificial Sequence
  Description of Artificial Sequence: Synthetic oligonucleotide
ctcacatcatccagaggatgtttggctgcg

SEQ ID NO: 32518 - DNA, 31 bp, Artificial Sequence
  Description of Artificial Sequence: Synthetic oligonucleotide
tcacatcatccagaggatgtttggctgcgac

SEQ ID NO: 32519 - DNA, 30 bp, Artificial Sequence
  Description of Artificial Sequence: Synthetic oligonucleotide
cacatcatccagaggatgtttggctgcgac

SEQ ID NO: 32520 - DNA, 30 bp, Artificial Sequence
  Description of Artificial Sequence: Synthetic oligonucleotide
acatcatccagaggatgtttggctgcgacc

SEQ ID NO: 32521 - DNA, 29 bp, Artificial Sequence
  Description of Artificial Sequence: Synthetic oligonucleotide
catcatccagaggatgtttggctgcgacc

SEQ ID NO: 32522 - DNA, 30 bp, Artificial Sequence
  Description of Artificial Sequence: Synthetic oligonucleotide
atcatccagaggatgtttggctgcgacctg

SEQ ID NO: 32523 - DNA, 29 bp, Artificial Sequence
  Description of Artificial Sequence: Synthetic oligonucleotide
tcatccagaggatgtttggctgcgacctg

SEQ ID NO: 32524 - DNA, 28 bp, Artificial Sequence
  Description of Artificial Sequence: Synthetic oligonucleotide
catccagaggatgtttggctgcgacctg

SEQ ID NO: 32525 - DNA, 28 bp, Artificial Sequence
  Description of Artificial Sequence: Synthetic oligonucleotide
atccagaggatgtttggctgcgacctgg

SEQ ID NO: 32526 - DNA, 27 bp, Artificial Sequence
  Description of Artificial Sequence: Synthetic oligonucleotide
tccagaggatgtttggctgcgacctgg

SEQ ID NO: 32527 - DNA, 26 bp, Artificial Sequence
  Description of Artificial Sequence: Synthetic oligonucleotide
ccagaggatgtttggctgcgacctgg

SEQ ID NO: 32528 - DNA, 26 bp, Artificial Sequence
  Description of Artificial Sequence: Synthetic oligonucleotide
cagaggatgtttggctgcgacctggg

SEQ ID NO: 32529 - DNA, 26 bp, Artificial Sequence
  Description of Artificial Sequence: Synthetic oligonucleotide
agaggatgtttggctgcgacctgggg

SEQ ID NO: 32530 - DNA, 25 bp, Artificial Sequence
  Description of Artificial Sequence: Synthetic oligonucleotide
gaggatgtttggctgcgacctgggg

SEQ ID NO: 32531 - DNA, 25 bp, Artificial Sequence
  Description of Artificial Sequence: Synthetic oligonucleotide
aggatgtttggctgcgacctggggc

SEQ ID NO: 32532 - DNA, 24 bp, Artificial Sequence
  Description of Artificial Sequence: Synthetic oligonucleotide
ggatgtttggctgcgacctggggc

SEQ ID NO: 32533 - DNA, 24 bp, Artificial Sequence
  Description of Artificial Sequence: Synthetic oligonucleotide
atgtttggctgcgacctggggccc

SEQ ID NO: 32534 - DNA, 23 bp, Artificial Sequence
  Description of Artificial Sequence: Synthetic oligonucleotide
tgtttggctgcgacctggggccc

SEQ ID NO: 32535 - DNA, 22 bp, Artificial Sequence
  Description of Artificial Sequence: Synthetic oligonucleotide
gtttggctgcgacctggggccc

SEQ ID NO: 32536 - DNA, 23 bp, Artificial Sequence
  Description of Artificial Sequence: Synthetic oligonucleotide
tttggctgcgacctggggcccga

SEQ ID NO: 32537 - DNA, 22 bp, Artificial Sequence
  Description of Artificial Sequence: Synthetic oligonucleotide
ttggctgcgacctggggcccga

SEQ ID NO: 32538 - DNA, 27 bp, Artificial Sequence
  Description of Artificial Sequence: Synthetic oligonucleotide
cagagcgaggccgggtctcacatcata

SEQ ID NO: 32539 - DNA, 27 bp, Artificial Sequence
  Description of Artificial Sequence: Synthetic oligonucleotide
agagcgaggccgggtctcacatcatac

SEQ ID NO: 32540 - DNA, 27 bp, Artificial Sequence
  Description of Artificial Sequence: Synthetic oligonucleotide
gagcgaggccgggtctcacatcataca

SEQ ID NO: 32541 - DNA, 27 bp, Artificial Sequence
  Description of Artificial Sequence: Synthetic oligonucleotide
agcgaggccgggtctcacatcatacag

SEQ ID NO: 32542 - DNA, 27 bp, Artificial Sequence
  Description of Artificial Sequence: Synthetic oligonucleotide
gcgaggccgggtctcacatcatacaga

SEQ ID NO: 32543 - DNA, 27 bp, Artificial Sequence
  Description of Artificial Sequence: Synthetic oligonucleotide
cgaggccgggtctcacatcatacagag

SEQ ID NO: 32544 - DNA, 27 bp, Artificial Sequence
  Description of Artificial Sequence: Synthetic oligonucleotide
gaggccgggtctcacatcatacagagg

SEQ ID NO: 32545 - DNA, 29 bp, Artificial Sequence
  Description of Artificial Sequence: Synthetic oligonucleotide
aggccgggtctcacatcatacagaggatg

SEQ ID NO: 32546 - DNA, 28 bp, Artificial Sequence
  Description of Artificial Sequence: Synthetic oligonucleotide
ggccgggtctcacatcatacagaggatg

SEQ ID NO: 32547 - DNA, 31 bp, Artificial Sequence
  Description of Artificial Sequence: Synthetic oligonucleotide
gccgggtctcacatcatacagaggatgtatg

SEQ ID NO: 32548 - DNA, 31 bp, Artificial Sequence
  Description of Artificial Sequence: Synthetic oligonucleotide
ccgggtctcacatcatacagaggatgtatgg

SEQ ID NO: 32549 - DNA, 31 bp, Artificial Sequence
  Description of Artificial Sequence: Synthetic oligonucleotide
cgggtctcacatcatacagaggatgtatggc

SEQ ID NO: 32550 - DNA, 32 bp, Artificial Sequence
  Description of Artificial Sequence: Synthetic oligonucleotide
gggtctcacatcatacagaggatgtatggctg

SEQ ID NO: 32551 - DNA, 32 bp, Artificial Sequence
  Description of Artificial Sequence: Synthetic oligonucleotide
ggtctcacatcatacagaggatgtatggctgc

SEQ ID NO: 32552 - DNA, 32 bp, Artificial Sequence
  Description of Artificial Sequence: Synthetic oligonucleotide
gtctcacatcatacagaggatgtatggctgcg

SEQ ID NO: 32553 - DNA, 33 bp, Artificial Sequence
  Description of Artificial Sequence: Synthetic oligonucleotide
tctcacatcatacagaggatgtatggctgcgac

SEQ ID NO: 32554 - DNA, 32 bp, Artificial Sequence
  Description of Artificial Sequence: Synthetic oligonucleotide
ctcacatcatacagaggatgtatggctgcgac

SEQ ID NO: 32555 - DNA, 32 bp, Artificial Sequence
  Description of Artificial Sequence: Synthetic oligonucleotide
tcacatcatacagaggatgtatggctgcgacc

SEQ ID NO: 32556 - DNA, 31 bp, Artificial Sequence
  Description of Artificial Sequence: Synthetic oligonucleotide
cacatcatacagaggatgtatggctgcgacc

SEQ ID NO: 32557 - DNA, 32 bp, Artificial Sequence
  Description of Artificial Sequence: Synthetic oligonucleotide
acatcatacagaggatgtatggctgcgacctg

SEQ ID NO: 32558 - DNA, 31 bp, Artificial Sequence
  Description of Artificial Sequence: Synthetic oligonucleotide
catcatacagaggatgtatggctgcgacctg

SEQ ID NO: 32559 - DNA, 31 bp, Artificial Sequence
  Description of Artificial Sequence: Synthetic oligonucleotide
atcatacagaggatgtatggctgcgacctgg

SEQ ID NO: 32560 - DNA, 30 bp, Artificial Sequence
  Description of Artificial Sequence: Synthetic oligonucleotide
tcatacagaggatgtatggctgcgacctgg

SEQ ID NO: 32561 - DNA, 29 bp, Artificial Sequence
  Description of Artificial Sequence: Synthetic oligonucleotide
catacagaggatgtatggctgcgacctgg

SEQ ID NO: 32562 - DNA, 29 bp, Artificial Sequence
  Description of Artificial Sequence: Synthetic oligonucleotide
atacagaggatgtatggctgcgacctggg

SEQ ID NO: 32563 - DNA, 28 bp, Artificial Sequence
  Description of Artificial Sequence: Synthetic oligonucleotide
tacagaggatgtatggctgcgacctggg

SEQ ID NO: 32564 - DNA, 27 bp, Artificial Sequence
  Description of Artificial Sequence: Synthetic oligonucleotide
acagaggatgtatggctgcgacctggg

SEQ ID NO: 32565 - DNA, 24 bp, Artificial Sequence
  Description of Artificial Sequence: Synthetic oligonucleotide
agagagcctgcggaacctgcgcga

SEQ ID NO: 32566 - DNA, 23 bp, Artificial Sequence
  Description of Artificial Sequence: Synthetic oligonucleotide
gagagcctgcggaacctgcgcga

SEQ ID NO: 32567 - DNA, 25 bp, Artificial Sequence
  Description of Artificial Sequence: Synthetic oligonucleotide
agagcctgcggaacctgcgcgacta

SEQ ID NO: 32568 - DNA, 24 bp, Artificial Sequence
  Description of Artificial Sequence: Synthetic oligonucleotide
gagcctgcggaacctgcgcgacta

SEQ ID NO: 32569 - DNA, 26 bp, Artificial Sequence
  Description of Artificial Sequence: Synthetic oligonucleotide
agcctgcggaacctgcgcgactacta

SEQ ID NO: 32570 - DNA, 25 bp, Artificial Sequence
  Description of Artificial Sequence: Synthetic oligonucleotide
gcctgcggaacctgcgcgactacta

SEQ ID NO: 32571 - DNA, 27 bp, Artificial Sequence
  Description of Artificial Sequence: Synthetic oligonucleotide
cctgcggaacctgcgcgactactacaa

SEQ ID NO: 32572 - DNA, 27 bp, Artificial Sequence
  Description of Artificial Sequence: Synthetic oligonucleotide
ctgcggaacctgcgcgactactacaac

SEQ ID NO: 32573 - DNA, 27 bp, Artificial Sequence
  Description of Artificial Sequence: Synthetic oligonucleotide
tgcggaacctgcgcgactactacaacc

SEQ ID NO: 32574 - DNA, 27 bp, Artificial Sequence
  Description of Artificial Sequence: Synthetic oligonucleotide
gcggaacctgcgcgactactacaacca

SEQ ID NO: 32575 - DNA, 27 bp, Artificial Sequence
  Description of Artificial Sequence: Synthetic oligonucleotide
cggaacctgcgcgactactacaaccag

SEQ ID NO: 32576 - DNA, 28 bp, Artificial Sequence
  Description of Artificial Sequence: Synthetic oligonucleotide
ggaacctgcgcgactactacaaccagag

SEQ ID NO: 32577 - DNA, 28 bp, Artificial Sequence
  Description of Artificial Sequence: Synthetic oligonucleotide
gaacctgcgcgactactacaaccagagc

SEQ ID NO: 32578 - DNA, 28 bp, Artificial Sequence
  Description of Artificial Sequence: Synthetic oligonucleotide
aacctgcgcgactactacaaccagagcg

SEQ ID NO: 32579 - DNA, 27 bp, Artificial Sequence
  Description of Artificial Sequence: Synthetic oligonucleotide
acctgcgcgactactacaaccagagcg

SEQ ID NO: 32580 - DNA, 27 bp, Artificial Sequence
  Description of Artificial Sequence: Synthetic oligonucleotide
cctgcgcgactactacaaccagagcga

SEQ ID NO: 32581 - DNA, 27 bp, Artificial Sequence
  Description of Artificial Sequence: Synthetic oligonucleotide
ctgcgcgactactacaaccagagcgag

SEQ ID NO: 32582 - DNA, 27 bp, Artificial Sequence
  Description of Artificial Sequence: Synthetic oligonucleotide
tgcgcgactactacaaccagagcgagg

SEQ ID NO: 32583 - DNA, 26 bp, Artificial Sequence
  Description of Artificial Sequence: Synthetic oligonucleotide
gcgcgactactacaaccagagcgagg

SEQ ID NO: 32584 - DNA, 26 bp, Artificial Sequence
  Description of Artificial Sequence: Synthetic oligonucleotide
cgcgactactacaaccagagcgaggc

SEQ ID NO: 32585 - DNA, 26 bp, Artificial Sequence
  Description of Artificial Sequence: Synthetic oligonucleotide
gcgactactacaaccagagcgaggcc

SEQ ID NO: 32586 - DNA, 26 bp, Artificial Sequence
  Description of Artificial Sequence: Synthetic oligonucleotide
cgactactacaaccagagcgaggccg

SEQ ID NO: 32587 - DNA, 26 bp, Artificial Sequence
  Description of Artificial Sequence: Synthetic oligonucleotide
gactactacaaccagagcgaggccgg

SEQ ID NO: 32588 - DNA, 27 bp, Artificial Sequence
  Description of Artificial Sequence: Synthetic oligonucleotide
actactacaaccagagcgaggccgggt

SEQ ID NO: 32589 - DNA, 29 bp, Artificial Sequence
  Description of Artificial Sequence: Synthetic oligonucleotide
caggagatagaaccttccagaagtgggcg

SEQ ID NO: 32590 - DNA, 29 bp, Artificial Sequence
  Description of Artificial Sequence: Synthetic oligonucleotide
aggagatagaaccttccagaagtgggcgc

SEQ ID NO: 32591 - DNA, 28 bp, Artificial Sequence
  Description of Artificial Sequence: Synthetic oligonucleotide
ggagatagaaccttccagaagtgggcgc

SEQ ID NO: 32592 - DNA, 29 bp, Artificial Sequence
  Description of Artificial Sequence: Synthetic oligonucleotide
gagatagaaccttccagaagtgggcgctg

SEQ ID NO: 32593 - DNA, 30 bp, Artificial Sequence
  Description of Artificial Sequence: Synthetic oligonucleotide
agatagaaccttccagaagtgggcgctgtg

SEQ ID NO: 32594 - DNA, 29 bp, Artificial Sequence
  Description of Artificial Sequence: Synthetic oligonucleotide
gatagaaccttccagaagtgggcgctgtg

SEQ ID NO: 32595 - DNA, 29 bp, Artificial Sequence
  Description of Artificial Sequence: Synthetic oligonucleotide
atagaaccttccagaagtgggcgctgtgg

SEQ ID NO: 32596 - DNA, 28 bp, Artificial Sequence
  Description of Artificial Sequence: Synthetic oligonucleotide
tagaaccttccagaagtgggcgctgtgg

SEQ ID NO: 32597 - DNA, 27 bp, Artificial Sequence
  Description of Artificial Sequence: Synthetic oligonucleotide
agaaccttccagaagtgggcgctgtgg

SEQ ID NO: 32598 - DNA, 27 bp, Artificial Sequence
  Description of Artificial Sequence: Synthetic oligonucleotide
gaaccttccagaagtgggcgctgtggt

SEQ ID NO: 32599 - DNA, 27 bp, Artificial Sequence
  Description of Artificial Sequence: Synthetic oligonucleotide
aaccttccagaagtgggcgctgtggtg

SEQ ID NO: 32600 - DNA, 26 bp, Artificial Sequence
  Description of Artificial Sequence: Synthetic oligonucleotide
accttccagaagtgggcgctgtggtg

SEQ ID NO: 32601 - DNA, 25 bp, Artificial Sequence
  Description of Artificial Sequence: Synthetic oligonucleotide
ccttccagaagtgggcgctgtggtg

SEQ ID NO: 32602 - DNA, 26 bp, Artificial Sequence
  Description of Artificial Sequence: Synthetic oligonucleotide
cttccagaagtgggcgctgtggtggt

SEQ ID NO: 32603 - DNA, 26 bp, Artificial Sequence
  Description of Artificial Sequence: Synthetic oligonucleotide
ttccagaagtgggcgctgtggtggtg

SEQ ID NO: 32604 - DNA, 25 bp, Artificial Sequence
  Description of Artificial Sequence: Synthetic oligonucleotide
tccagaagtgggcgctgtggtggtg

SEQ ID NO: 32605 - DNA, 24 bp, Artificial Sequence
  Description of Artificial Sequence: Synthetic oligonucleotide
ccagaagtgggcgctgtggtggtg

SEQ ID NO: 32606 - DNA, 24 bp, Artificial Sequence
  Description of Artificial Sequence: Synthetic oligonucleotide
cagaagtgggcgctgtggtggtgc

SEQ ID NO: 32607 - DNA, 26 bp, Artificial Sequence
  Description of Artificial Sequence: Synthetic oligonucleotide
agaagtgggcgctgtggtggtgcctt

SEQ ID NO: 32608 - DNA, 25 bp, Artificial Sequence
  Description of Artificial Sequence: Synthetic oligonucleotide
gaagtgggcgctgtggtggtgcctt

SEQ ID NO: 32609 - DNA, 26 bp, Artificial Sequence
  Description of Artificial Sequence: Synthetic oligonucleotide
aagtgggcgctgtggtggtgccttct

SEQ ID NO: 32610 - DNA, 25 bp, Artificial Sequence
  Description of Artificial Sequence: Synthetic oligonucleotide
agtgggcgctgtggtggtgccttct

SEQ ID NO: 32611 - DNA, 24 bp, Artificial Sequence
  Description of Artificial Sequence: Synthetic oligonucleotide
gtgggcgctgtggtggtgccttct

SEQ ID NO: 32612 - DNA, 24 bp, Artificial Sequence
  Description of Artificial Sequence: Synthetic oligonucleotide
tgggcgctgtggtggtgccttctg

SEQ ID NO: 32613 - DNA, 23 bp, Artificial Sequence
  Description of Artificial Sequence: Synthetic oligonucleotide
gggcgctgtggtggtgccttctg

SEQ ID NO: 32614 - DNA, 24 bp, Artificial Sequence
  Description of Artificial Sequence: Synthetic oligonucleotide
ggcgctgtggtggtgccttctgga

SEQ ID NO: 32615 - DNA, 26 bp, Artificial Sequence
  Description of Artificial Sequence: Synthetic oligonucleotide
gcgctgtggtggtgccttctggagaa

SEQ ID NO: 32616 - DNA, 27 bp, Artificial Sequence
  Description of Artificial Sequence: Synthetic oligonucleotide
cgctgtggtggtgccttctggagaaga

SEQ ID NO: 32617 - DNA, 30 bp, Artificial Sequence
  Description of Artificial Sequence: Synthetic oligonucleotide
gctggctcccactccatgaggtatttctac

SEQ ID NO: 32618 - DNA, 31 bp, Artificial Sequence
  Description of Artificial Sequence: Synthetic oligonucleotide
ctggctcccactccatgaggtatttctacac

SEQ ID NO: 32619 - DNA, 31 bp, Artificial Sequence
  Description of Artificial Sequence: Synthetic oligonucleotide
tggctcccactccatgaggtatttctacacc

SEQ ID NO: 32620 - DNA, 28 bp, Artificial Sequence
  Description of Artificial Sequence: Synthetic oligonucleotide
ccgggtctcacatcatccagaggatgtc

SEQ ID NO: 32621 - DNA, 29 bp, Artificial Sequence
  Description of Artificial Sequence: Synthetic oligonucleotide
cgggtctcacatcatccagaggatgtctg

SEQ ID NO: 32622 - DNA, 29 bp, Artificial Sequence
  Description of Artificial Sequence: Synthetic oligonucleotide
gggtctcacatcatccagaggatgtctgg

SEQ ID NO: 32623 - DNA, 29 bp, Artificial Sequence
  Description of Artificial Sequence: Synthetic oligonucleotide
ggtctcacatcatccagaggatgtctggc

SEQ ID NO: 32624 - DNA, 30 bp, Artificial Sequence
  Description of Artificial Sequence: Synthetic oligonucleotide
gtctcacatcatccagaggatgtctggctg

SEQ ID NO: 32625 - DNA, 30 bp, Artificial Sequence
  Description of Artificial Sequence: Synthetic oligonucleotide
tctcacatcatccagaggatgtctggctgc

SEQ ID NO: 32626 - DNA, 29 bp, Artificial Sequence
  Description of Artificial Sequence: Synthetic oligonucleotide
ctcacatcatccagaggatgtctggctgc

SEQ ID NO: 32627 - DNA, 29 bp, Artificial Sequence
  Description of Artificial Sequence: Synthetic oligonucleotide
tcacatcatccagaggatgtctggctgcg

SEQ ID NO: 32628 - DNA, 28 bp, Artificial Sequence
  Description of Artificial Sequence: Synthetic oligonucleotide
cacatcatccagaggatgtctggctgcg

SEQ ID NO: 32629 - DNA, 29 bp, Artificial Sequence
  Description of Artificial Sequence: Synthetic oligonucleotide
acatcatccagaggatgtctggctgcgac

SEQ ID NO: 32630 - DNA, 28 bp, Artificial Sequence
  Description of Artificial Sequence: Synthetic oligonucleotide
catcatccagaggatgtctggctgcgac

SEQ ID NO: 32631 - DNA, 28 bp, Artificial Sequence
  Description of Artificial Sequence: Synthetic oligonucleotide
atcatccagaggatgtctggctgcgacc

SEQ ID NO: 32632 - DNA, 27 bp, Artificial Sequence
  Description of Artificial Sequence: Synthetic oligonucleotide
tcatccagaggatgtctggctgcgacc

SEQ ID NO: 32633 - DNA, 27 bp, Artificial Sequence
  Description of Artificial Sequence: Synthetic oligonucleotide
catccagaggatgtctggctgcgacct

SEQ ID NO: 32634 - DNA, 27 bp, Artificial Sequence
  Description of Artificial Sequence: Synthetic oligonucleotide
atccagaggatgtctggctgcgacctg

SEQ ID NO: 32635 - DNA, 26 bp, Artificial Sequence
  Description of Artificial Sequence: Synthetic oligonucleotide
tccagaggatgtctggctgcgacctg

SEQ ID NO: 32636 - DNA, 25 bp, Artificial Sequence
  Description of Artificial Sequence: Synthetic oligonucleotide
ccagaggatgtctggctgcgacctg

SEQ ID NO: 32637 - DNA, 25 bp, Artificial Sequence
  Description of Artificial Sequence: Synthetic oligonucleotide
cagaggatgtctggctgcgacctgg

SEQ ID NO: 32638 - DNA, 25 bp, Artificial Sequence
  Description of Artificial Sequence: Synthetic oligonucleotide
agaggatgtctggctgcgacctggg

SEQ ID NO: 32639 - DNA, 24 bp, Artificial Sequence
  Description of Artificial Sequence: Synthetic oligonucleotide
gaggatgtctggctgcgacctggg

SEQ ID NO: 32640 - DNA, 24 bp, Artificial Sequence
  Description of Artificial Sequence: Synthetic oligonucleotide
aggatgtctggctgcgacctgggg

SEQ ID NO: 32641 - DNA, 23 bp, Artificial Sequence
  Description of Artificial Sequence: Synthetic oligonucleotide
ggatgtctggctgcgacctgggg

SEQ ID NO: 32642 - DNA, 23 bp, Artificial Sequence
  Description of Artificial Sequence: Synthetic oligonucleotide
gatgtctggctgcgacctggggc

SEQ ID NO: 32643 - DNA, 23 bp, Artificial Sequence
  Description of Artificial Sequence: Synthetic oligonucleotide
atgtctggctgcgacctggggcc

SEQ ID NO: 32644 - DNA, 22 bp, Artificial Sequence
  Description of Artificial Sequence: Synthetic oligonucleotide
tgtctggctgcgacctggggcc

SEQ ID NO: 32645 - DNA, 21 bp, Artificial Sequence
  Description of Artificial Sequence: Synthetic oligonucleotide
gtctggctgcgacctggggcc

SEQ ID NO: 32646 - DNA, 21 bp, Artificial Sequence
  Description of Artificial Sequence: Synthetic oligonucleotide
tctggctgcgacctggggccc

SEQ ID NO: 32647 - DNA, 20 bp, Artificial Sequence
  Description of Artificial Sequence: Synthetic oligonucleotide
ctggctgcgacctggggccc

SEQ ID NO: 32648 - DNA, 35 bp, Artificial Sequence
  Description of Artificial Sequence: Synthetic oligonucleotide
atcttcaagaccaacacacagacttaccgagagtg

SEQ ID NO: 32649 - DNA, 34 bp, Artificial Sequence
  Description of Artificial Sequence: Synthetic oligonucleotide
tcttcaagaccaacacacagacttaccgagagtg

SEQ ID NO: 32650 - DNA, 33 bp, Artificial Sequence
  Description of Artificial Sequence: Synthetic oligonucleotide
cttcaagaccaacacacagacttaccgagagtg

SEQ ID NO: 32651 - DNA, 33 bp, Artificial Sequence
  Description of Artificial Sequence: Synthetic oligonucleotide
ttcaagaccaacacacagacttaccgagagtgc

SEQ ID NO: 32652 - DNA, 32 bp, Artificial Sequence
  Description of Artificial Sequence: Synthetic oligonucleotide
tcaagaccaacacacagacttaccgagagtgc

SEQ ID NO: 32653 - DNA, 31 bp, Artificial Sequence
  Description of Artificial Sequence: Synthetic oligonucleotide
caagaccaacacacagacttaccgagagtgc

SEQ ID NO: 32654 - DNA, 31 bp, Artificial Sequence
  Description of Artificial Sequence: Synthetic oligonucleotide
aagaccaacacacagacttaccgagagtgcc

SEQ ID NO: 32655 - DNA, 30 bp, Artificial Sequence
  Description of Artificial Sequence: Synthetic oligonucleotide
agaccaacacacagacttaccgagagtgcc

SEQ ID NO: 32656 - DNA, 29 bp, Artificial Sequence
  Description of Artificial Sequence: Synthetic oligonucleotide
gaccaacacacagacttaccgagagtgcc

SEQ ID NO: 32657 - DNA, 30 bp, Artificial Sequence
  Description of Artificial Sequence: Synthetic oligonucleotide
accaacacacagacttaccgagagtgcctg

SEQ ID NO: 32658 - DNA, 29 bp, Artificial Sequence
  Description of Artificial Sequence: Synthetic oligonucleotide
ccaacacacagacttaccgagagtgcctg

SEQ ID NO: 32659 - DNA, 29 bp, Artificial Sequence
  Description of Artificial Sequence: Synthetic oligonucleotide
caacacacagacttaccgagagtgcctgc

SEQ ID NO: 32660 - DNA, 29 bp, Artificial Sequence
  Description of Artificial Sequence: Synthetic oligonucleotide
aacacacagacttaccgagagtgcctgcg

SEQ ID NO: 32661 - DNA, 28 bp, Artificial Sequence
  Description of Artificial Sequence: Synthetic oligonucleotide
acacacagacttaccgagagtgcctgcg

SEQ ID NO: 32662 - DNA, 27 bp, Artificial Sequence
  Description of Artificial Sequence: Synthetic oligonucleotide
cacacagacttaccgagagtgcctgcg

SEQ ID NO: 32663 - DNA, 27 bp, Artificial Sequence
  Description of Artificial Sequence: Synthetic oligonucleotide
acacagacttaccgagagtgcctgcgg

SEQ ID NO: 32664 - DNA, 27 bp, Artificial Sequence
  Description of Artificial Sequence: Synthetic oligonucleotide
cacagacttaccgagagtgcctgcgga

SEQ ID NO: 32665 - DNA, 28 bp, Artificial Sequence
  Description of Artificial Sequence: Synthetic oligonucleotide
acagacttaccgagagtgcctgcggaac

SEQ ID NO: 32666 - DNA, 27 bp, Artificial Sequence
  Description of Artificial Sequence: Synthetic oligonucleotide
cagacttaccgagagtgcctgcggaac

SEQ ID NO: 32667 - DNA, 27 bp, Artificial Sequence
  Description of Artificial Sequence: Synthetic oligonucleotide
agacttaccgagagtgcctgcggaacc

SEQ ID NO: 32668 - DNA, 27 bp, Artificial Sequence
  Description of Artificial Sequence: Synthetic oligonucleotide
gacttaccgagagtgcctgcggaacct

SEQ ID NO: 32669 - DNA, 27 bp, Artificial Sequence
  Description of Artificial Sequence: Synthetic oligonucleotide
acttaccgagagtgcctgcggaacctg

SEQ ID NO: 32670 - DNA, 26 bp, Artificial Sequence
  Description of Artificial Sequence: Synthetic oligonucleotide
cttaccgagagtgcctgcggaacctg

SEQ ID NO: 32671 - DNA, 26 bp, Artificial Sequence
  Description of Artificial Sequence: Synthetic oligonucleotide
ttaccgagagtgcctgcggaacctgc

SEQ ID NO: 32672 - DNA, 25 bp, Artificial Sequence
  Description of Artificial Sequence: Synthetic oligonucleotide
taccgagagtgcctgcggaacctgc

SEQ ID NO: 32673 - DNA, 24 bp, Artificial Sequence
  Description of Artificial Sequence: Synthetic oligonucleotide
accgagagtgcctgcggaacctgc

SEQ ID NO: 32674 - DNA, 23 bp, Artificial Sequence
  Description of Artificial Sequence: Synthetic oligonucleotide
ccgagagtgcctgcggaacctgc

SEQ ID NO: 32675 - DNA, 23 bp, Artificial Sequence
  Description of Artificial Sequence: Synthetic oligonucleotide
cgagagtgcctgcggaacctgcg

SEQ ID NO: 32676 - DNA, 23 bp, Artificial Sequence
  Description of Artificial Sequence: Synthetic oligonucleotide
gagagtgcctgcggaacctgcgc

SEQ ID NO: 32677 - DNA, 23 bp, Artificial Sequence
  Description of Artificial Sequence: Synthetic oligonucleotide
agagtgcctgcggaacctgcgcg

SEQ ID NO: 32678 - DNA, 22 bp, Artificial Sequence
  Description of Artificial Sequence: Synthetic oligonucleotide
gagtgcctgcggaacctgcgcg

SEQ ID NO: 32679 - DNA, 22 bp, Artificial Sequence
  Description of Artificial Sequence: Synthetic oligonucleotide
agtgcctgcggaacctgcgcgg

SEQ ID NO: 32680 - DNA, 21 bp, Artificial Sequence
  Description of Artificial Sequence: Synthetic oligonucleotide
gtgcctgcggaacctgcgcgg

SEQ ID NO: 32681 - DNA, 23 bp, Artificial Sequence
  Description of Artificial Sequence: Synthetic oligonucleotide
tgcctgcggaacctgcgcggcta

SEQ ID NO: 32682 - DNA, 26 bp, Artificial Sequence
  Description of Artificial Sequence: Synthetic oligonucleotide
ctgaacgaggacctgagctcctggag

SEQ ID NO: 32683 - DNA, 26 bp, Artificial Sequence
  Description of Artificial Sequence: Synthetic oligonucleotide
tgaacgaggacctgagctcctggagg

SEQ ID NO: 32684 - DNA, 25 bp, Artificial Sequence
  Description of Artificial Sequence: Synthetic oligonucleotide
gaacgaggacctgagctcctggagg

SEQ ID NO: 32685 - DNA, 25 bp, Artificial Sequence
  Description of Artificial Sequence: Synthetic oligonucleotide
aacgaggacctgagctcctggaggc

SEQ ID NO: 32686 - DNA, 24 bp, Artificial Sequence
  Description of Artificial Sequence: Synthetic oligonucleotide
acgaggacctgagctcctggaggc

SEQ ID NO: 32687 - DNA, 23 bp, Artificial Sequence
  Description of Artificial Sequence: Synthetic oligonucleotide
cgaggacctgagctcctggaggc

SEQ ID NO: 32688 - DNA, 23 bp, Artificial Sequence
  Description of Artificial Sequence: Synthetic oligonucleotide
gaggacctgagctcctggaggcg

SEQ ID NO: 32689 - DNA, 24 bp, Artificial Sequence
  Description of Artificial Sequence: Synthetic oligonucleotide
aggacctgagctcctggaggcgga

SEQ ID NO: 32690 - DNA, 23 bp, Artificial Sequence
  Description of Artificial Sequence: Synthetic oligonucleotide
ggacctgagctcctggaggcgga

SEQ ID NO: 32691 - DNA, 24 bp, Artificial Sequence
  Description of Artificial Sequence: Synthetic oligonucleotide
gacctgagctcctggaggcggaca

SEQ ID NO: 32692 - DNA, 24 bp, Artificial Sequence
  Description of Artificial Sequence: Synthetic oligonucleotide
acctgagctcctggaggcggacac

SEQ ID NO: 32693 - DNA, 23 bp, Artificial Sequence
  Description of Artificial Sequence: Synthetic oligonucleotide
cctgagctcctggaggcggacac

SEQ ID NO: 32694 - DNA, 23 bp, Artificial Sequence
  Description of Artificial Sequence: Synthetic oligonucleotide
ctgagctcctggaggcggacacc

SEQ ID NO: 32695 - DNA, 23 bp, Artificial Sequence
  Description of Artificial Sequence: Synthetic oligonucleotide
tgagctcctggaggcggacaccg

SEQ ID NO: 32696 - DNA, 22 bp, Artificial Sequence
  Description of Artificial Sequence: Synthetic oligonucleotide
gagctcctggaggcggacaccg

SEQ ID NO: 32697 - DNA, 22 bp, Artificial Sequence
  Description of Artificial Sequence: Synthetic oligonucleotide
agctcctggaggcggacaccgc

SEQ ID NO: 32698 - DNA, 21 bp, Artificial Sequence
  Description of Artificial Sequence: Synthetic oligonucleotide
gctcctggaggcggacaccgc

SEQ ID NO: 32699 - DNA, 21 bp, Artificial Sequence
  Description of Artificial Sequence: Synthetic oligonucleotide
ctcctggaggcggacaccgcg

SEQ ID NO: 32700 - DNA, 21 bp, Artificial Sequence
  Description of Artificial Sequence: Synthetic oligonucleotide
tcctggaggcggacaccgcgg

SEQ ID NO: 32701 - DNA, 20 bp, Artificial Sequence
  Description of Artificial Sequence: Synthetic oligonucleotide
cctggaggcggacaccgcgg

SEQ ID NO: 32702 - DNA, 21 bp, Artificial Sequence
  Description of Artificial Sequence: Synthetic oligonucleotide
ctggaggcggacaccgcggct

SEQ ID NO: 32703 - DNA, 22 bp, Artificial Sequence
  Description of Artificial Sequence: Synthetic oligonucleotide
tggaggcggacaccgcggctca

SEQ ID NO: 32704 - DNA, 21 bp, Artificial Sequence
  Description of Artificial Sequence: Synthetic oligonucleotide
ggaggcggacaccgcggctca

SEQ ID NO: 32705 - DNA, 23 bp, Artificial Sequence
  Description of Artificial Sequence: Synthetic oligonucleotide
gaggcggacaccgcggctcagat

SEQ ID NO: 32706 - DNA, 24 bp, Artificial Sequence
  Description of Artificial Sequence: Synthetic oligonucleotide
aggcggacaccgcggctcagatca

SEQ ID NO: 32707 - DNA, 26 bp, Artificial Sequence
  Description of Artificial Sequence: Synthetic oligonucleotide
agaacgggaaggagacgctgcagcac

SEQ ID NO: 32708 - DNA, 25 bp, Artificial Sequence
  Description of Artificial Sequence: Synthetic oligonucleotide
gaacgggaaggagacgctgcagcac

SEQ ID NO: 32709 - DNA, 25 bp, Artificial Sequence
  Description of Artificial Sequence: Synthetic oligonucleotide
aacgggaaggagacgctgcagcacg

SEQ ID NO: 32710 - DNA, 24 bp, Artificial Sequence
  Description of Artificial Sequence: Synthetic oligonucleotide
acgggaaggagacgctgcagcacg

SEQ ID NO: 32711 - DNA, 23 bp, Artificial Sequence
  Description of Artificial Sequence: Synthetic oligonucleotide
cgggaaggagacgctgcagcacg

SEQ ID NO: 32712 - DNA, 23 bp, Artificial Sequence
  Description of Artificial Sequence: Synthetic oligonucleotide
gggaaggagacgctgcagcacgc

SEQ ID NO: 32713 - DNA, 23 bp, Artificial Sequence
  Description of Artificial Sequence: Synthetic oligonucleotide
ggaaggagacgctgcagcacgcg

SEQ ID NO: 32714 - DNA, 23 bp, Artificial Sequence
  Description of Artificial Sequence: Synthetic oligonucleotide
gaaggagacgctgcagcacgcgg

SEQ ID NO: 32715 - DNA, 24 bp, Artificial Sequence
  Description of Artificial Sequence: Synthetic oligonucleotide
agagcctacctggagggcctgtgg

SEQ ID NO: 32716 - DNA, 23 bp, Artificial Sequence
  Description of Artificial Sequence: Synthetic oligonucleotide
gagcctacctggagggcctgtgg

SEQ ID NO: 32717 - DNA, 24 bp, Artificial Sequence
  Description of Artificial Sequence: Synthetic oligonucleotide
agcctacctggagggcctgtgggt

SEQ ID NO: 32718 - DNA, 23 bp, Artificial Sequence
  Description of Artificial Sequence: Synthetic oligonucleotide
gcctacctggagggcctgtgggt

SEQ ID NO: 32719 - DNA, 23 bp, Artificial Sequence
  Description of Artificial Sequence: Synthetic oligonucleotide
cctacctggagggcctgtgggtg

SEQ ID NO: 32720 - DNA, 24 bp, Artificial Sequence
  Description of Artificial Sequence: Synthetic oligonucleotide
ctacctggagggcctgtgggtgga

SEQ ID NO: 32721 - DNA, 25 bp, Artificial Sequence
  Description of Artificial Sequence: Synthetic oligonucleotide
tacctggagggcctgtgggtggagt

SEQ ID NO: 32722 - DNA, 24 bp, Artificial Sequence
  Description of Artificial Sequence: Synthetic oligonucleotide
acctggagggcctgtgggtggagt

SEQ ID NO: 32723 - DNA, 23 bp, Artificial Sequence
  Description of Artificial Sequence: Synthetic oligonucleotide
cctggagggcctgtgggtggagt

SEQ ID NO: 32724 - DNA, 23 bp, Artificial Sequence
  Description of Artificial Sequence: Synthetic oligonucleotide
ctggagggcctgtgggtggagtg

SEQ ID NO: 32725 - DNA, 23 bp, Artificial Sequence
  Description of Artificial Sequence: Synthetic oligonucleotide
tggagggcctgtgggtggagtgg

SEQ ID NO: 32726 - DNA, 22 bp, Artificial Sequence
  Description of Artificial Sequence: Synthetic oligonucleotide
ggagggcctgtgggtggagtgg

SEQ ID NO: 32727 - DNA, 23 bp, Artificial Sequence
  Description of Artificial Sequence: Synthetic oligonucleotide
gagggcctgtgggtggagtggct

SEQ ID NO: 32728 - DNA, 23 bp, Artificial Sequence
  Description of Artificial Sequence: Synthetic oligonucleotide
agggcctgtgggtggagtggctc

SEQ ID NO: 32729 - DNA, 22 bp, Artificial Sequence
  Description of Artificial Sequence: Synthetic oligonucleotide
gggcctgtgggtggagtggctc

SEQ ID NO: 32730 - DNA, 22 bp, Artificial Sequence
  Description of Artificial Sequence: Synthetic oligonucleotide
ggcctgtgggtggagtggctcc

SEQ ID NO: 32731 - DNA, 22 bp, Artificial Sequence
  Description of Artificial Sequence: Synthetic oligonucleotide
gcctgtgggtggagtggctccg

SEQ ID NO: 32732 - DNA, 23 bp, Artificial Sequence
  Description of Artificial Sequence: Synthetic oligonucleotide
cctgtgggtggagtggctccgca

SEQ ID NO: 32733 - DNA, 26 bp, Artificial Sequence
  Description of Artificial Sequence: Synthetic oligonucleotide
ctgtgggtggagtggctccgcagata

SEQ ID NO: 32734 - DNA, 26 bp, Artificial Sequence
  Description of Artificial Sequence: Synthetic oligonucleotide
tgtgggtggagtggctccgcagatac

SEQ ID NO: 32735 - DNA, 25 bp, Artificial Sequence
  Description of Artificial Sequence: Synthetic oligonucleotide
gtgggtggagtggctccgcagatac

SEQ ID NO: 32736 - DNA, 26 bp, Artificial Sequence
  Description of Artificial Sequence: Synthetic oligonucleotide
tgggtggagtggctccgcagatacct

SEQ ID NO: 32737 - DNA, 25 bp, Artificial Sequence
  Description of Artificial Sequence: Synthetic oligonucleotide
gggtggagtggctccgcagatacct

SEQ ID NO: 32738 - DNA, 25 bp, Artificial Sequence
  Description of Artificial Sequence: Synthetic oligonucleotide
ggtggagtggctccgcagatacctg

SEQ ID NO: 32739 - DNA, 22 bp, Artificial Sequence
  Description of Artificial Sequence: Synthetic oligonucleotide
cgcgcggaccccccaaagacac

SEQ ID NO: 32740 - DNA, 22 bp, Artificial Sequence
  Description of Artificial Sequence: Synthetic oligonucleotide
gcgcggaccccccaaagacacg

SEQ ID NO: 32741 - DNA, 22 bp, Artificial Sequence
  Description of Artificial Sequence: Synthetic oligonucleotide
cgcggaccccccaaagacacgc

SEQ ID NO: 32742 - DNA, 23 bp, Artificial Sequence
  Description of Artificial Sequence: Synthetic oligonucleotide
gcggaccccccaaagacacgcgt

SEQ ID NO: 32743 - DNA, 24 bp, Artificial Sequence
  Description of Artificial Sequence: Synthetic oligonucleotide
cggaccccccaaagacacgcgtga

SEQ ID NO: 32744 - DNA, 24 bp, Artificial Sequence
  Description of Artificial Sequence: Synthetic oligonucleotide
ggaccccccaaagacacgcgtgac

SEQ ID NO: 32745 - DNA, 24 bp, Artificial Sequence
  Description of Artificial Sequence: Synthetic oligonucleotide
gaccccccaaagacacgcgtgacc

SEQ ID NO: 32746 - DNA, 25 bp, Artificial Sequence
  Description of Artificial Sequence: Synthetic oligonucleotide
accccccaaagacacgcgtgaccca

SEQ ID NO: 32747 - DNA, 24 bp, Artificial Sequence
  Description of Artificial Sequence: Synthetic oligonucleotide
ccccccaaagacacgcgtgaccca

SEQ ID NO: 32748 - DNA, 24 bp, Artificial Sequence
  Description of Artificial Sequence: Synthetic oligonucleotide
cccccaaagacacgcgtgacccac

SEQ ID NO: 32749 - DNA, 25 bp, Artificial Sequence
  Description of Artificial Sequence: Synthetic oligonucleotide
ccccaaagacacgcgtgacccacca

SEQ ID NO: 32750 - DNA, 25 bp, Artificial Sequence
  Description of Artificial Sequence: Synthetic oligonucleotide
cccaaagacacgcgtgacccaccac

SEQ ID NO: 32751 - DNA, 25 bp, Artificial Sequence
  Description of Artificial Sequence: Synthetic oligonucleotide
ccaaagacacgcgtgacccaccacc

SEQ ID NO: 32752 - DNA, 25 bp, Artificial Sequence
  Description of Artificial Sequence: Synthetic oligonucleotide
caaagacacgcgtgacccaccaccc

SEQ ID NO: 32753 - DNA, 25 bp, Artificial Sequence
  Description of Artificial Sequence: Synthetic oligonucleotide
aaagacacgcgtgacccaccacccc

SEQ ID NO: 32754 - DNA, 24 bp, Artificial Sequence
  Description of Artificial Sequence: Synthetic oligonucleotide
aagacacgcgtgacccaccacccc

SEQ ID NO: 32755 - DNA, 23 bp, Artificial Sequence
  Description of Artificial Sequence: Synthetic oligonucleotide
agacacgcgtgacccaccacccc

SEQ ID NO: 32756 - DNA, 22 bp, Artificial Sequence
  Description of Artificial Sequence: Synthetic oligonucleotide
gacacgcgtgacccaccacccc

SEQ ID NO: 32757 - DNA, 23 bp, Artificial Sequence
  Description of Artificial Sequence: Synthetic oligonucleotide
acacgcgtgacccaccaccccgt

SEQ ID NO: 32758 - DNA, 22 bp, Artificial Sequence
  Description of Artificial Sequence: Synthetic oligonucleotide
cacgcgtgacccaccaccccgt

SEQ ID NO: 32759 - DNA, 23 bp, Artificial Sequence
  Description of Artificial Sequence: Synthetic oligonucleotide
acgcgtgacccaccaccccgtct

SEQ ID NO: 32760 - DNA, 22 bp, Artificial Sequence
  Description of Artificial Sequence: Synthetic oligonucleotide
cgcgtgacccaccaccccgtct

SEQ ID NO: 32761 - DNA, 23 bp, Artificial Sequence
  Description of Artificial Sequence: Synthetic oligonucleotide
gcgtgacccaccaccccgtctct

SEQ ID NO: 32762 - DNA, 35 bp, Artificial Sequence
  Description of Artificial Sequence: Synthetic oligonucleotide
agatcttcaagaccaacacacagacttaccgagtg

SEQ ID NO: 32763 - DNA, 34 bp, Artificial Sequence
  Description of Artificial Sequence: Synthetic oligonucleotide
gatcttcaagaccaacacacagacttaccgagtg

SEQ ID NO: 32764 - DNA, 35 bp, Artificial Sequence
  Description of Artificial Sequence: Synthetic oligonucleotide
atcttcaagaccaacacacagacttaccgagtgag

SEQ ID NO: 32765 - DNA, 34 bp, Artificial Sequence
  Description of Artificial Sequence: Synthetic oligonucleotide
tcttcaagaccaacacacagacttaccgagtgag

SEQ ID NO: 32766 - DNA, 33 bp, Artificial Sequence
  Description of Artificial Sequence: Synthetic oligonucleotide
cttcaagaccaacacacagacttaccgagtgag

SEQ ID NO: 32767 - DNA, 33 bp, Artificial Sequence
  Description of Artificial Sequence: Synthetic oligonucleotide
ttcaagaccaacacacagacttaccgagtgagc

SEQ ID NO: 32768 - DNA, 32 bp, Artificial Sequence
  Description of Artificial Sequence: Synthetic oligonucleotide
tcaagaccaacacacagacttaccgagtgagc

SEQ ID NO: 32769 - DNA, 26 bp, Artificial Sequence
  Description of Artificial Sequence: Synthetic oligonucleotide
gccgggtctcacatcctccagaggat

SEQ ID NO: 32770 - DNA, 27 bp, Artificial Sequence
  Description of Artificial Sequence: Synthetic oligonucleotide
ccgggtctcacatcctccagaggatgt

SEQ ID NO: 32771 - DNA, 29 bp, Artificial Sequence
  Description of Artificial Sequence: Synthetic oligonucleotide
cgggtctcacatcctccagaggatgtatg

SEQ ID NO: 32772 - DNA, 29 bp, Artificial Sequence
  Description of Artificial Sequence: Synthetic oligonucleotide
gggtctcacatcctccagaggatgtatgg

SEQ ID NO: 32773 - DNA, 29 bp, Artificial Sequence
  Description of Artificial Sequence: Synthetic oligonucleotide
ggtctcacatcctccagaggatgtatggc

SEQ ID NO: 32774 - DNA, 30 bp, Artificial Sequence
  Description of Artificial Sequence: Synthetic oligonucleotide
gtctcacatcctccagaggatgtatggctg

SEQ ID NO: 32775 - DNA, 30 bp, Artificial Sequence
  Description of Artificial Sequence: Synthetic oligonucleotide
tctcacatcctccagaggatgtatggctgc

SEQ ID NO: 32776 - DNA, 29 bp, Artificial Sequence
  Description of Artificial Sequence: Synthetic oligonucleotide
ctcacatcctccagaggatgtatggctgc

SEQ ID NO: 32777 - DNA, 29 bp, Artificial Sequence
  Description of Artificial Sequence: Synthetic oligonucleotide
tcacatcctccagaggatgtatggctgcg

SEQ ID NO: 32778 - DNA, 28 bp, Artificial Sequence
  Description of Artificial Sequence: Synthetic oligonucleotide
cacatcctccagaggatgtatggctgcg

SEQ ID NO: 32779 - DNA, 29 bp, Artificial Sequence
  Description of Artificial Sequence: Synthetic oligonucleotide
acatcctccagaggatgtatggctgcgac

SEQ ID NO: 32780 - DNA, 28 bp, Artificial Sequence
  Description of Artificial Sequence: Synthetic oligonucleotide
catcctccagaggatgtatggctgcgac

SEQ ID NO: 32781 - DNA, 28 bp, Artificial Sequence
  Description of Artificial Sequence: Synthetic oligonucleotide
atcctccagaggatgtatggctgcgacc

SEQ ID NO: 32782 - DNA, 27 bp, Artificial Sequence
  Description of Artificial Sequence: Synthetic oligonucleotide
tcctccagaggatgtatggctgcgacc

SEQ ID NO: 32783 - DNA, 31 bp, Artificial Sequence
  Description of Artificial Sequence: Synthetic oligonucleotide
tccatgaggtatttctacaccgccatgtccg

SEQ ID NO: 32784 - DNA, 30 bp, Artificial Sequence
  Description of Artificial Sequence: Synthetic oligonucleotide
ccatgaggtatttctacaccgccatgtccg

SEQ ID NO: 32785 - DNA, 30 bp, Artificial Sequence
  Description of Artificial Sequence: Synthetic oligonucleotide
catgaggtatttctacaccgccatgtccgg

SEQ ID NO: 32786 - DNA, 30 bp, Artificial Sequence
  Description of Artificial Sequence: Synthetic oligonucleotide
atgaggtatttctacaccgccatgtccggg

SEQ ID NO: 32787 - DNA, 29 bp, Artificial Sequence
  Description of Artificial Sequence: Synthetic oligonucleotide
tgaggtatttctacaccgccatgtccggg

SEQ ID NO: 32788 - DNA, 28 bp, Artificial Sequence
  Description of Artificial Sequence: Synthetic oligonucleotide
gaggtatttctacaccgccatgtccggg

SEQ ID NO: 32789 - DNA, 28 bp, Artificial Sequence
  Description of Artificial Sequence: Synthetic oligonucleotide
aggtatttctacaccgccatgtccgggc

SEQ ID NO: 32790 - DNA, 27 bp, Artificial Sequence
  Description of Artificial Sequence: Synthetic oligonucleotide
ggtatttctacaccgccatgtccgggc

SEQ ID NO: 32791 - DNA, 27 bp, Artificial Sequence
  Description of Artificial Sequence: Synthetic oligonucleotide
gtatttctacaccgccatgtccgggcc

SEQ ID NO: 32792 - DNA, 27 bp, Artificial Sequence
  Description of Artificial Sequence: Synthetic oligonucleotide
tatttctacaccgccatgtccgggccc

SEQ ID NO: 32793 - DNA, 26 bp, Artificial Sequence
  Description of Artificial Sequence: Synthetic oligonucleotide
atttctacaccgccatgtccgggccc

SEQ ID NO: 32794 - DNA, 25 bp, Artificial Sequence
  Description of Artificial Sequence: Synthetic oligonucleotide
tttctacaccgccatgtccgggccc

SEQ ID NO: 32795 - DNA, 24 bp, Artificial Sequence
  Description of Artificial Sequence: Synthetic oligonucleotide
ttctacaccgccatgtccgggccc

SEQ ID NO: 32796 - DNA, 23 bp, Artificial Sequence
  Description of Artificial Sequence: Synthetic oligonucleotide
tctacaccgccatgtccgggccc

SEQ ID NO: 32797 - DNA, 22 bp, Artificial Sequence
  Description of Artificial Sequence: Synthetic oligonucleotide
ctacaccgccatgtccgggccc

SEQ ID NO: 32798 - DNA, 22 bp, Artificial Sequence
  Description of Artificial Sequence: Synthetic oligonucleotide
tacaccgccatgtccgggcccg

SEQ ID NO: 32799 - DNA, 21 bp, Artificial Sequence
  Description of Artificial Sequence: Synthetic oligonucleotide
acaccgccatgtccgggcccg

SEQ ID NO: 32800 - DNA, 20 bp, Artificial Sequence
  Description of Artificial Sequence: Synthetic oligonucleotide
caccgccatgtccgggcccg

SEQ ID NO: 32801 - DNA, 20 bp, Artificial Sequence
  Description of Artificial Sequence: Synthetic oligonucleotide
accgccatgtccgggcccgg

SEQ ID NO: 32802 - DNA, 20 bp, Artificial Sequence
  Description of Artificial Sequence: Synthetic oligonucleotide
ccgccatgtccgggcccggt

SEQ ID NO: 32803 - DNA, 20 bp, Artificial Sequence
  Description of Artificial Sequence: Synthetic oligonucleotide
cgccatgtccgggcccggct

SEQ ID NO: 32804 - DNA, 20 bp, Artificial Sequence
  Description of Artificial Sequence: Synthetic oligonucleotide
gccatgtccgggcccggcct

SEQ ID NO: 32805 - DNA, 20 bp, Artificial Sequence
  Description of Artificial Sequence: Synthetic oligonucleotide
ccatgtccgggcccggccgt

SEQ ID NO: 32806 - DNA, 20 bp, Artificial Sequence
  Description of Artificial Sequence: Synthetic oligonucleotide
catgtccgggcccggccgct

SEQ ID NO: 32807 - DNA, 20 bp, Artificial Sequence
  Description of Artificial Sequence: Synthetic oligonucleotide
atgtccgggcccggccgcgt

SEQ ID NO: 32808 - DNA, 20 bp, Artificial Sequence
  Description of Artificial Sequence: Synthetic oligonucleotide
tgtccgggcccggccgcgtt

SEQ ID NO: 32809 - DNA, 20 bp, Artificial Sequence
  Description of Artificial Sequence: Synthetic oligonucleotide
gtccgggcccggccgcgttt

SEQ ID NO: 32810 - DNA, 20 bp, Artificial Sequence
  Description of Artificial Sequence: Synthetic oligonucleotide
tccgggcccggccgcggttt

SEQ ID NO: 32811 - DNA, 20 bp, Artificial Sequence
  Description of Artificial Sequence: Synthetic oligonucleotide
ccgggcccggccgcggtttt

SEQ ID NO: 32812 - DNA, 20 bp, Artificial Sequence
  Description of Artificial Sequence: Synthetic oligonucleotide
cgggcccggccgcgggtttt

SEQ ID NO: 32813 - DNA, 20 bp, Artificial Sequence
  Description of Artificial Sequence: Synthetic oligonucleotide
gggcccggccgcggggattt

SEQ ID NO: 32814 - DNA, 30 bp, Artificial Sequence
  Description of Artificial Sequence: Synthetic oligonucleotide
gaccggaacacacagatcttcaaggccaac

SEQ ID NO: 32815 - DNA, 31 bp, Artificial Sequence
  Description of Artificial Sequence: Synthetic oligonucleotide
accggaacacacagatcttcaaggccaacac

SEQ ID NO: 32816 - DNA, 30 bp, Artificial Sequence
  Description of Artificial Sequence: Synthetic oligonucleotide
ccggaacacacagatcttcaaggccaacac

SEQ ID NO: 32817 - DNA, 31 bp, Artificial Sequence
  Description of Artificial Sequence: Synthetic oligonucleotide
cggaacacacagatcttcaaggccaacacac

SEQ ID NO: 32818 - DNA, 32 bp, Artificial Sequence
  Description of Artificial Sequence: Synthetic oligonucleotide
ggaacacacagatcttcaaggccaacacacag

SEQ ID NO: 32819 - DNA, 33 bp, Artificial Sequence
  Description of Artificial Sequence: Synthetic oligonucleotide
gaacacacagatcttcaaggccaacacacagac

SEQ ID NO: 32820 - DNA, 36 bp, Artificial Sequence
  Description of Artificial Sequence: Synthetic oligonucleotide
aacacacagatcttcaaggccaacacacagacttac

SEQ ID NO: 32821 - DNA, 35 bp, Artificial Sequence
  Description of Artificial Sequence: Synthetic oligonucleotide
acacacagatcttcaaggccaacacacagacttac

SEQ ID NO: 32822 - DNA, 34 bp, Artificial Sequence
  Description of Artificial Sequence: Synthetic oligonucleotide
cacacagatcttcaaggccaacacacagacttac

SEQ ID NO: 32823 - DNA, 34 bp, Artificial Sequence
  Description of Artificial Sequence: Synthetic oligonucleotide
acacagatcttcaaggccaacacacagacttacc

SEQ ID NO: 32824 - DNA, 33 bp, Artificial Sequence
  Description of Artificial Sequence: Synthetic oligonucleotide
cacagatcttcaaggccaacacacagacttacc

SEQ ID NO: 32825 - DNA, 33 bp, Artificial Sequence
  Description of Artificial Sequence: Synthetic oligonucleotide
acagatcttcaaggccaacacacagacttaccg

SEQ ID NO: 32826 - DNA, 32 bp, Artificial Sequence
  Description of Artificial Sequence: Synthetic oligonucleotide
cagatcttcaaggccaacacacagacttaccg

SEQ ID NO: 32827 - DNA, 33 bp, Artificial Sequence
  Description of Artificial Sequence: Synthetic oligonucleotide
agatcttcaaggccaacacacagacttaccgag

SEQ ID NO: 32828 - DNA, 32 bp, Artificial Sequence
  Description of Artificial Sequence: Synthetic oligonucleotide
gatcttcaaggccaacacacagacttaccgag

SEQ ID NO: 32829 - DNA, 33 bp, Artificial Sequence
  Description of Artificial Sequence: Synthetic oligonucleotide
atcttcaaggccaacacacagacttaccgagag

SEQ ID NO: 32830 - DNA, 32 bp, Artificial Sequence
  Description of Artificial Sequence: Synthetic oligonucleotide
tcttcaaggccaacacacagacttaccgagag

SEQ ID NO: 32831 - DNA, 31 bp, Artificial Sequence
  Description of Artificial Sequence: Synthetic oligonucleotide
cttcaaggccaacacacagacttaccgagag

SEQ ID NO: 32832 - DNA, 32 bp, Artificial Sequence
  Description of Artificial Sequence: Synthetic oligonucleotide
ttcaaggccaacacacagacttaccgagagag

SEQ ID NO: 32833 - DNA, 31 bp, Artificial Sequence
  Description of Artificial Sequence: Synthetic oligonucleotide
tcaaggccaacacacagacttaccgagagag

SEQ ID NO: 32834 - DNA, 24 bp, Artificial Sequence
  Description of Artificial Sequence: Synthetic oligonucleotide
ctgggccctgggcttctaccctga

SEQ ID NO: 32835 - DNA, 24 bp, Artificial Sequence
  Description of Artificial Sequence: Synthetic oligonucleotide
tgggccctgggcttctaccctgag

SEQ ID NO: 32836 - DNA, 23 bp, Artificial Sequence
  Description of Artificial Sequence: Synthetic oligonucleotide
gggccctgggcttctaccctgag

SEQ ID NO: 32837 - DNA, 24 bp, Artificial Sequence
  Description of Artificial Sequence: Synthetic oligonucleotide
ggccctgggcttctaccctgagga

SEQ ID NO: 32838 - DNA, 26 bp, Artificial Sequence
  Description of Artificial Sequence: Synthetic oligonucleotide
gccctgggcttctaccctgaggagat

SEQ ID NO: 32839 - DNA, 27 bp, Artificial Sequence
  Description of Artificial Sequence: Synthetic oligonucleotide
ccctgggcttctaccctgaggagatca

SEQ ID NO: 32840 - DNA, 27 bp, Artificial Sequence
  Description of Artificial Sequence: Synthetic oligonucleotide
cctgggcttctaccctgaggagatcac

SEQ ID NO: 32841 - DNA, 28 bp, Artificial Sequence
  Description of Artificial Sequence: Synthetic oligonucleotide
ctgggcttctaccctgaggagatcacac

SEQ ID NO: 32842 - DNA, 29 bp, Artificial Sequence
  Description of Artificial Sequence: Synthetic oligonucleotide
tgggcttctaccctgaggagatcacactg

SEQ ID NO: 32843 - DNA, 28 bp, Artificial Sequence
  Description of Artificial Sequence: Synthetic oligonucleotide
gggcttctaccctgaggagatcacactg

SEQ ID NO: 32844 - DNA, 29 bp, Artificial Sequence
  Description of Artificial Sequence: Synthetic oligonucleotide
ggcttctaccctgaggagatcacactgac

SEQ ID NO: 32845 - DNA, 29 bp, Artificial Sequence
  Description of Artificial Sequence: Synthetic oligonucleotide
gcttctaccctgaggagatcacactgacc

SEQ ID NO: 32846 - DNA, 30 bp, Artificial Sequence
  Description of Artificial Sequence: Synthetic oligonucleotide
cttctaccctgaggagatcacactgacctg

SEQ ID NO: 32847 - DNA, 30 bp, Artificial Sequence
  Description of Artificial Sequence: Synthetic oligonucleotide
ttctaccctgaggagatcacactgacctgg

SEQ ID NO: 32848 - DNA, 29 bp, Artificial Sequence
  Description of Artificial Sequence: Synthetic oligonucleotide
tctaccctgaggagatcacactgacctgg

SEQ ID NO: 32849 - DNA, 28 bp, Artificial Sequence
  Description of Artificial Sequence: Synthetic oligonucleotide
ctaccctgaggagatcacactgacctgg

SEQ ID NO: 32850 - DNA, 28 bp, Artificial Sequence
  Description of Artificial Sequence: Synthetic oligonucleotide
taccctgaggagatcacactgacctggc

SEQ ID NO: 32851 - DNA, 27 bp, Artificial Sequence
  Description of Artificial Sequence: Synthetic oligonucleotide
accctgaggagatcacactgacctggc

SEQ ID NO: 32852 - DNA, 27 bp, Artificial Sequence
  Description of Artificial Sequence: Synthetic oligonucleotide
ccctgaggagatcacactgacctggca

SEQ ID NO: 32853 - DNA, 27 bp, Artificial Sequence
  Description of Artificial Sequence: Synthetic oligonucleotide
cctgaggagatcacactgacctggcag

SEQ ID NO: 32854 - DNA, 27 bp, Artificial Sequence
  Description of Artificial Sequence: Synthetic oligonucleotide
ctgaggagatcacactgacctggcagc

SEQ ID NO: 32855 - DNA, 27 bp, Artificial Sequence
  Description of Artificial Sequence: Synthetic oligonucleotide
tgaggagatcacactgacctggcagcg

SEQ ID NO: 32856 - DNA, 26 bp, Artificial Sequence
  Description of Artificial Sequence: Synthetic oligonucleotide
gaggagatcacactgacctggcagcg

SEQ ID NO: 32857 - DNA, 26 bp, Artificial Sequence
  Description of Artificial Sequence: Synthetic oligonucleotide
aggagatcacactgacctggcagcgg

SEQ ID NO: 32858 - DNA, 26 bp, Artificial Sequence
  Description of Artificial Sequence: Synthetic oligonucleotide
atgtatggctgcgacctggggcccta

SEQ ID NO: 32859 - DNA, 25 bp, Artificial Sequence
  Description of Artificial Sequence: Synthetic oligonucleotide
tgtatggctgcgacctggggcccta

SEQ ID NO: 32860 - DNA, 24 bp, Artificial Sequence
  Description of Artificial Sequence: Synthetic oligonucleotide
gtatggctgcgacctggggcccta

SEQ ID NO: 32861 - DNA, 24 bp, Artificial Sequence
  Description of Artificial Sequence: Synthetic oligonucleotide
tatggctgcgacctggggccctac

SEQ ID NO: 32862 - DNA, 23 bp, Artificial Sequence
  Description of Artificial Sequence: Synthetic oligonucleotide
atggctgcgacctggggccctac

SEQ ID NO: 32863 - DNA, 22 bp, Artificial Sequence
  Description of Artificial Sequence: Synthetic oligonucleotide
tggctgcgacctggggccctac

SEQ ID NO: 32864 - DNA, 21 bp, Artificial Sequence
  Description of Artificial Sequence: Synthetic oligonucleotide
ggctgcgacctggggccctac

SEQ ID NO: 32865 - DNA, 21 bp, Artificial Sequence
  Description of Artificial Sequence: Synthetic oligonucleotide
gctgcgacctggggccctacg

SEQ ID NO: 32866 - DNA, 21 bp, Artificial Sequence
  Description of Artificial Sequence: Synthetic oligonucleotide
ctgcgacctggggccctacgg

SEQ ID NO: 32867 - DNA, 21 bp, Artificial Sequence
  Description of Artificial Sequence: Synthetic oligonucleotide
tgcgacctggggccctacggg

SEQ ID NO: 32868 - DNA, 20 bp, Artificial Sequence
  Description of Artificial Sequence: Synthetic oligonucleotide
gcgacctggggccctacggg

SEQ ID NO: 32869 - DNA, 20 bp, Artificial Sequence
  Description of Artificial Sequence: Synthetic oligonucleotide
cgacctggggccctacgggc

SEQ ID NO: 32870 - DNA, 20 bp, Artificial Sequence
  Description of Artificial Sequence: Synthetic oligonucleotide
gacctggggccctacgggcg

SEQ ID NO: 32871 - DNA, 22 bp, Artificial Sequence
  Description of Artificial Sequence: Synthetic oligonucleotide
acctggggccctacgggcgctt

SEQ ID NO: 32872 - DNA, 21 bp, Artificial Sequence
  Description of Artificial Sequence: Synthetic oligonucleotide
cctggggccctacgggcgctt

SEQ ID NO: 32873 - DNA, 21 bp, Artificial Sequence
  Description of Artificial Sequence: Synthetic oligonucleotide
ctggggccctacgggcgcttc

SEQ ID NO: 32874 - DNA, 22 bp, Artificial Sequence
  Description of Artificial Sequence: Synthetic oligonucleotide
tggggccctacgggcgcttcct

SEQ ID NO: 32875 - DNA, 21 bp, Artificial Sequence
  Description of Artificial Sequence: Synthetic oligonucleotide
ggggccctacgggcgcttcct

SEQ ID NO: 32876 - DNA, 21 bp, Artificial Sequence
  Description of Artificial Sequence: Synthetic oligonucleotide
gggccctacgggcgcttcctc

SEQ ID NO: 32877 - DNA, 21 bp, Artificial Sequence
  Description of Artificial Sequence: Synthetic oligonucleotide
ggccctacgggcgcttcctcc

SEQ ID NO: 32878 - DNA, 21 bp, Artificial Sequence
  Description of Artificial Sequence: Synthetic oligonucleotide
gccctacgggcgcttcctccg

SEQ ID NO: 32879 - DNA, 21 bp, Artificial Sequence
  Description of Artificial Sequence: Synthetic oligonucleotide
ccctacgggcgcttcctccgc

SEQ ID NO: 32880 - DNA, 21 bp, Artificial Sequence
  Description of Artificial Sequence: Synthetic oligonucleotide
cctacgggcgcttcctccgcg

SEQ ID NO: 32881 - DNA, 21 bp, Artificial Sequence
  Description of Artificial Sequence: Synthetic oligonucleotide
ctacgggcgcttcctccgcgg

SEQ ID NO: 32882 - DNA, 21 bp, Artificial Sequence
  Description of Artificial Sequence: Synthetic oligonucleotide
tacgggcgcttcctccgcggg

SEQ ID NO: 32883 - DNA, 24 bp, Artificial Sequence
  Description of Artificial Sequence: Synthetic oligonucleotide
agggcctgtgcgtggagtggctct

SEQ ID NO: 32884 - DNA, 23 bp, Artificial Sequence
  Description of Artificial Sequence: Synthetic oligonucleotide
gggcctgtgcgtggagtggctct

SEQ ID NO: 32885 - DNA, 23 bp, Artificial Sequence
  Description of Artificial Sequence: Synthetic oligonucleotide
ggcctgtgcgtggagtggctctg

SEQ ID NO: 32886 - DNA, 24 bp, Artificial Sequence
  Description of Artificial Sequence: Synthetic oligonucleotide
gcctgtgcgtggagtggctctgca

SEQ ID NO: 32887 - DNA, 27 bp, Artificial Sequence
  Description of Artificial Sequence: Synthetic oligonucleotide
cctgtgcgtggagtggctctgcagata

SEQ ID NO: 32888 - DNA, 27 bp, Artificial Sequence
  Description of Artificial Sequence: Synthetic oligonucleotide
ctgtgcgtggagtggctctgcagatac

SEQ ID NO: 32889 - DNA, 27 bp, Artificial Sequence
  Description of Artificial Sequence: Synthetic oligonucleotide
tgtgcgtggagtggctctgcagatacc

SEQ ID NO: 32890 - DNA, 27 bp, Artificial Sequence
  Description of Artificial Sequence: Synthetic oligonucleotide
gtgcgtggagtggctctgcagatacct

SEQ ID NO: 32891 - DNA, 27 bp, Artificial Sequence
  Description of Artificial Sequence: Synthetic oligonucleotide
tgcgtggagtggctctgcagatacctg

SEQ ID NO: 32892 - DNA, 26 bp, Artificial Sequence
  Description of Artificial Sequence: Synthetic oligonucleotide
gcgtggagtggctctgcagatacctg

SEQ ID NO: 32893 - DNA, 27 bp, Artificial Sequence
  Description of Artificial Sequence: Synthetic oligonucleotide
cgtggagtggctctgcagatacctgga

SEQ ID NO: 32894 - DNA, 27 bp, Artificial Sequence
  Description of Artificial Sequence: Synthetic oligonucleotide
gtggagtggctctgcagatacctggag

SEQ ID NO: 32895 - DNA, 29 bp, Artificial Sequence
  Description of Artificial Sequence: Synthetic oligonucleotide
tggagtggctctgcagatacctggagaac

SEQ ID NO: 32896 - DNA, 28 bp, Artificial Sequence
  Description of Artificial Sequence: Synthetic oligonucleotide
ggagtggctctgcagatacctggagaac

SEQ ID NO: 32897 - DNA, 28 bp, Artificial Sequence
  Description of Artificial Sequence: Synthetic oligonucleotide
gagtggctctgcagatacctggagaacg

SEQ ID NO: 32898 - DNA, 28 bp, Artificial Sequence
  Description of Artificial Sequence: Synthetic oligonucleotide
agtggctctgcagatacctggagaacgg

SEQ ID NO: 32899 - DNA, 27 bp, Artificial Sequence
  Description of Artificial Sequence: Synthetic oligonucleotide
gtggctctgcagatacctggagaacgg

SEQ ID NO: 32900 - DNA, 27 bp, Artificial Sequence
  Description of Artificial Sequence: Synthetic oligonucleotide
tggctctgcagatacctggagaacggg

SEQ ID NO: 32901 - DNA, 27 bp, Artificial Sequence
  Description of Artificial Sequence: Synthetic oligonucleotide
ggctctgcagatacctggagaacggga

SEQ ID NO: 32902 - DNA, 28 bp, Artificial Sequence
  Description of Artificial Sequence: Synthetic oligonucleotide
gctctgcagatacctggagaacgggaag

SEQ ID NO: 32903 - DNA, 28 bp, Artificial Sequence
  Description of Artificial Sequence: Synthetic oligonucleotide
ctctgcagatacctggagaacgggaagg

SEQ ID NO: 32904 - DNA, 29 bp, Artificial Sequence
  Description of Artificial Sequence: Synthetic oligonucleotide
tctgcagatacctggagaacgggaaggag

SEQ ID NO: 32905 - DNA, 28 bp, Artificial Sequence
  Description of Artificial Sequence: Synthetic oligonucleotide
ctgcagatacctggagaacgggaaggag

SEQ ID NO: 32906 - DNA, 29 bp, Artificial Sequence
  Description of Artificial Sequence: Synthetic oligonucleotide
tgcagatacctggagaacgggaaggagac

SEQ ID NO: 32907 - DNA, 36 bp, Artificial Sequence
  Description of Artificial Sequence: Synthetic oligonucleotide
aacacacagatcttcaagaccaacacacaggcttac

SEQ ID NO: 32908 - DNA, 35 bp, Artificial Sequence
  Description of Artificial Sequence: Synthetic oligonucleotide
acacacagatcttcaagaccaacacacaggcttac

SEQ ID NO: 32909 - DNA, 34 bp, Artificial Sequence
  Description of Artificial Sequence: Synthetic oligonucleotide
cacacagatcttcaagaccaacacacaggcttac

SEQ ID NO: 32910 - DNA, 34 bp, Artificial Sequence
  Description of Artificial Sequence: Synthetic oligonucleotide
acacagatcttcaagaccaacacacaggcttacc

SEQ ID NO: 32911 - DNA, 33 bp, Artificial Sequence
  Description of Artificial Sequence: Synthetic oligonucleotide
cacagatcttcaagaccaacacacaggcttacc

SEQ ID NO: 32912 - DNA, 33 bp, Artificial Sequence
  Description of Artificial Sequence: Synthetic oligonucleotide
acagatcttcaagaccaacacacaggcttaccg

SEQ ID NO: 32913 - DNA, 32 bp, Artificial Sequence
  Description of Artificial Sequence: Synthetic oligonucleotide
cagatcttcaagaccaacacacaggcttaccg

SEQ ID NO: 32914 - DNA, 33 bp, Artificial Sequence
  Description of Artificial Sequence: Synthetic oligonucleotide
agatcttcaagaccaacacacaggcttaccgag

SEQ ID NO: 32915 - DNA, 32 bp, Artificial Sequence
  Description of Artificial Sequence: Synthetic oligonucleotide
gatcttcaagaccaacacacaggcttaccgag

SEQ ID NO: 32916 - DNA, 33 bp, Artificial Sequence
  Description of Artificial Sequence: Synthetic oligonucleotide
atcttcaagaccaacacacaggcttaccgagag

SEQ ID NO: 32917 - DNA, 32 bp, Artificial Sequence
  Description of Artificial Sequence: Synthetic oligonucleotide
tcttcaagaccaacacacaggcttaccgagag

SEQ ID NO: 32918 - DNA, 31 bp, Artificial Sequence
  Description of Artificial Sequence: Synthetic oligonucleotide
cttcaagaccaacacacaggcttaccgagag

SEQ ID NO: 32919 - DNA, 32 bp, Artificial Sequence
  Description of Artificial Sequence: Synthetic oligonucleotide
ttcaagaccaacacacaggcttaccgagagag

SEQ ID NO: 32920 - DNA, 31 bp, Artificial Sequence
  Description of Artificial Sequence: Synthetic oligonucleotide
tcaagaccaacacacaggcttaccgagagag

SEQ ID NO: 32921 - DNA, 30 bp, Artificial Sequence
  Description of Artificial Sequence: Synthetic oligonucleotide
caagaccaacacacaggcttaccgagagag

SEQ ID NO: 32922 - DNA, 30 bp, Artificial Sequence
  Description of Artificial Sequence: Synthetic oligonucleotide
aagaccaacacacaggcttaccgagagagc

SEQ ID NO: 32923 - DNA, 29 bp, Artificial Sequence
  Description of Artificial Sequence: Synthetic oligonucleotide
agaccaacacacaggcttaccgagagagc

SEQ ID NO: 32924 - DNA, 28 bp, Artificial Sequence
  Description of Artificial Sequence: Synthetic oligonucleotide
gaccaacacacaggcttaccgagagagc

SEQ ID NO: 32925 - DNA, 28 bp, Artificial Sequence
  Description of Artificial Sequence: Synthetic oligonucleotide
accaacacacaggcttaccgagagagcc

SEQ ID NO: 32926 - DNA, 27 bp, Artificial Sequence
  Description of Artificial Sequence: Synthetic oligonucleotide
ccaacacacaggcttaccgagagagcc

SEQ ID NO: 32927 - DNA, 28 bp, Artificial Sequence
  Description of Artificial Sequence: Synthetic oligonucleotide
caacacacaggcttaccgagagagcctg

SEQ ID NO: 32928 - DNA, 28 bp, Artificial Sequence
  Description of Artificial Sequence: Synthetic oligonucleotide
aacacacaggcttaccgagagagcctgc

SEQ ID NO: 32929 - DNA, 27 bp, Artificial Sequence
  Description of Artificial Sequence: Synthetic oligonucleotide
acacacaggcttaccgagagagcctgc

SEQ ID NO: 32930 - DNA, 26 bp, Artificial Sequence
  Description of Artificial Sequence: Synthetic oligonucleotide
cacacaggcttaccgagagagcctgc

SEQ ID NO: 32931 - DNA, 26 bp, Artificial Sequence
  Description of Artificial Sequence: Synthetic oligonucleotide
acacaggcttaccgagagagcctgcg

SEQ ID NO: 32932 - DNA, 25 bp, Artificial Sequence
  Description of Artificial Sequence: Synthetic oligonucleotide
cacaggcttaccgagagagcctgcg

SEQ ID NO: 32933 - DNA, 27 bp, Artificial Sequence
  Description of Artificial Sequence: Synthetic oligonucleotide
acaggcttaccgagagagcctgcggaa

SEQ ID NO: 32934 - DNA, 26 bp, Artificial Sequence
  Description of Artificial Sequence: Synthetic oligonucleotide
caggcttaccgagagagcctgcggaa

SEQ ID NO: 32935 - DNA, 26 bp, Artificial Sequence
  Description of Artificial Sequence: Synthetic oligonucleotide
aggcttaccgagagagcctgcggaac

SEQ ID NO: 32936 - DNA, 25 bp, Artificial Sequence
  Description of Artificial Sequence: Synthetic oligonucleotide
ggcttaccgagagagcctgcggaac

SEQ ID NO: 32937 - DNA, 26 bp, Artificial Sequence
  Description of Artificial Sequence: Synthetic oligonucleotide
gcttaccgagagagcctgcggaacct

SEQ ID NO: 32938 - DNA, 26 bp, Artificial Sequence
  Description of Artificial Sequence: Synthetic oligonucleotide
ctggcagcgggatggcgaggacaaaa

SEQ ID NO: 32939 - DNA, 27 bp, Artificial Sequence
  Description of Artificial Sequence: Synthetic oligonucleotide
tggcagcgggatggcgaggacaaaact

SEQ ID NO: 32940 - DNA, 26 bp, Artificial Sequence
  Description of Artificial Sequence: Synthetic oligonucleotide
ggcagcgggatggcgaggacaaaact

SEQ ID NO: 32941 - DNA, 27 bp, Artificial Sequence
  Description of Artificial Sequence: Synthetic oligonucleotide
gcagcgggatggcgaggacaaaactca

SEQ ID NO: 32942 - DNA, 27 bp, Artificial Sequence
  Description of Artificial Sequence: Synthetic oligonucleotide
cagcgggatggcgaggacaaaactcag

SEQ ID NO: 32943 - DNA, 27 bp, Artificial Sequence
  Description of Artificial Sequence: Synthetic oligonucleotide
agcgggatggcgaggacaaaactcagg

SEQ ID NO: 32944 - DNA, 27 bp, Artificial Sequence
  Description of Artificial Sequence: Synthetic oligonucleotide
gcgggatggcgaggacaaaactcagga

SEQ ID NO: 32945 - DNA, 27 bp, Artificial Sequence
  Description of Artificial Sequence: Synthetic oligonucleotide
cgggatggcgaggacaaaactcaggac

SEQ ID NO: 32946 - DNA, 28 bp, Artificial Sequence
  Description of Artificial Sequence: Synthetic oligonucleotide
gggatggcgaggacaaaactcaggacac

SEQ ID NO: 32947 - DNA, 29 bp, Artificial Sequence
  Description of Artificial Sequence: Synthetic oligonucleotide
ggatggcgaggacaaaactcaggacactg

SEQ ID NO: 32948 - DNA, 30 bp, Artificial Sequence
  Description of Artificial Sequence: Synthetic oligonucleotide
gatggcgaggacaaaactcaggacactgag

SEQ ID NO: 32949 - DNA, 30 bp, Artificial Sequence
  Description of Artificial Sequence: Synthetic oligonucleotide
atggcgaggacaaaactcaggacactgagc

SEQ ID NO: 32950 - DNA, 29 bp, Artificial Sequence
  Description of Artificial Sequence: Synthetic oligonucleotide
tggcgaggacaaaactcaggacactgagc

SEQ ID NO: 32951 - DNA, 28 bp, Artificial Sequence
  Description of Artificial Sequence: Synthetic oligonucleotide
ggcgaggacaaaactcaggacactgagc

SEQ ID NO: 32952 - DNA, 30 bp, Artificial Sequence
  Description of Artificial Sequence: Synthetic oligonucleotide
gcgaggacaaaactcaggacactgagcttg

SEQ ID NO: 32953 - DNA, 31 bp, Artificial Sequence
  Description of Artificial Sequence: Synthetic oligonucleotide
cgaggacaaaactcaggacactgagcttgtg

SEQ ID NO: 32954 - DNA, 31 bp, Artificial Sequence
  Description of Artificial Sequence: Synthetic oligonucleotide
gaggacaaaactcaggacactgagcttgtgg

SEQ ID NO: 32955 - DNA, 32 bp, Artificial Sequence
  Description of Artificial Sequence: Synthetic oligonucleotide
aggacaaaactcaggacactgagcttgtggag

SEQ ID NO: 32956 - DNA, 31 bp, Artificial Sequence
  Description of Artificial Sequence: Synthetic oligonucleotide
ggacaaaactcaggacactgagcttgtggag

SEQ ID NO: 32957 - DNA, 32 bp, Artificial Sequence
  Description of Artificial Sequence: Synthetic oligonucleotide
gacaaaactcaggacactgagcttgtggagac

SEQ ID NO: 32958 - DNA, 32 bp, Artificial Sequence
  Description of Artificial Sequence: Synthetic oligonucleotide
acaaaactcaggacactgagcttgtggagacc

SEQ ID NO: 32959 - DNA, 31 bp, Artificial Sequence
  Description of Artificial Sequence: Synthetic oligonucleotide
caaaactcaggacactgagcttgtggagacc

SEQ ID NO: 32960 - DNA, 32 bp, Artificial Sequence
  Description of Artificial Sequence: Synthetic oligonucleotide
aaaactcaggacactgagcttgtggagaccag

SEQ ID NO: 32961 - DNA, 27 bp, Artificial Sequence
  Description of Artificial Sequence: Synthetic oligonucleotide
tggacgacacccagttcgtgaggttcc

SEQ ID NO: 32962 - DNA, 27 bp, Artificial Sequence
  Description of Artificial Sequence: Synthetic oligonucleotide
ggacgacacccagttcgtgaggttcca

SEQ ID NO: 32963 - DNA, 27 bp, Artificial Sequence
  Description of Artificial Sequence: Synthetic oligonucleotide
gacgacacccagttcgtgaggttccac

SEQ ID NO: 32964 - DNA, 28 bp, Artificial Sequence
  Description of Artificial Sequence: Synthetic oligonucleotide
acgacacccagttcgtgaggttccacag

SEQ ID NO: 32965 - DNA, 27 bp, Artificial Sequence
  Description of Artificial Sequence: Synthetic oligonucleotide
cgacacccagttcgtgaggttccacag

SEQ ID NO: 32966 - DNA, 27 bp, Artificial Sequence
  Description of Artificial Sequence: Synthetic oligonucleotide
gacacccagttcgtgaggttccacagc

SEQ ID NO: 32967 - DNA, 27 bp, Artificial Sequence
  Description of Artificial Sequence: Synthetic oligonucleotide
acacccagttcgtgaggttccacagcg

SEQ ID NO: 32968 - DNA, 27 bp, Artificial Sequence
  Description of Artificial Sequence: Synthetic oligonucleotide
cacccagttcgtgaggttccacagcga

SEQ ID NO: 32969 - DNA, 27 bp, Artificial Sequence
  Description of Artificial Sequence: Synthetic oligonucleotide
acccagttcgtgaggttccacagcgac

SEQ ID NO: 32970 - DNA, 26 bp, Artificial Sequence
  Description of Artificial Sequence: Synthetic oligonucleotide
cccagttcgtgaggttccacagcgac

SEQ ID NO: 32971 - DNA, 26 bp, Artificial Sequence
  Description of Artificial Sequence: Synthetic oligonucleotide
ccagttcgtgaggttccacagcgacg

SEQ ID NO: 32972 - DNA, 26 bp, Artificial Sequence
  Description of Artificial Sequence: Synthetic oligonucleotide
cagttcgtgaggttccacagcgacgc

SEQ ID NO: 32973 - DNA, 26 bp, Artificial Sequence
  Description of Artificial Sequence: Synthetic oligonucleotide
agttcgtgaggttccacagcgacgcc

SEQ ID NO: 32974 - DNA, 25 bp, Artificial Sequence
  Description of Artificial Sequence: Synthetic oligonucleotide
gttcgtgaggttccacagcgacgcc

SEQ ID NO: 32975 - DNA, 25 bp, Artificial Sequence
  Description of Artificial Sequence: Synthetic oligonucleotide
ttcgtgaggttccacagcgacgccg

SEQ ID NO: 32976 - DNA, 24 bp, Artificial Sequence
  Description of Artificial Sequence: Synthetic oligonucleotide
tcgtgaggttccacagcgacgccg

SEQ ID NO: 32977 - DNA, 23 bp, Artificial Sequence
  Description of Artificial Sequence: Synthetic oligonucleotide
cgtgaggttccacagcgacgccg

SEQ ID NO: 32978 - DNA, 23 bp, Artificial Sequence
  Description of Artificial Sequence: Synthetic oligonucleotide
gtgaggttccacagcgacgccgc

SEQ ID NO: 32979 - DNA, 24 bp, Artificial Sequence
  Description of Artificial Sequence: Synthetic oligonucleotide
tgaggttccacagcgacgccgcga

SEQ ID NO: 32980 - DNA, 23 bp, Artificial Sequence
  Description of Artificial Sequence: Synthetic oligonucleotide
gaggttccacagcgacgccgcga

SEQ ID NO: 32981 - DNA, 24 bp, Artificial Sequence
  Description of Artificial Sequence: Synthetic oligonucleotide
aggttccacagcgacgccgcgagt

SEQ ID NO: 32982 - DNA, 23 bp, Artificial Sequence
  Description of Artificial Sequence: Synthetic oligonucleotide
ggttccacagcgacgccgcgagt

SEQ ID NO: 32983 - DNA, 23 bp, Artificial Sequence
  Description of Artificial Sequence: Synthetic oligonucleotide
gttccacagcgacgccgcgagtc

SEQ ID NO: 32984 - DNA, 23 bp, Artificial Sequence
  Description of Artificial Sequence: Synthetic oligonucleotide
ttccacagcgacgccgcgagtcc

SEQ ID NO: 32985 - DNA, 22 bp, Artificial Sequence
  Description of Artificial Sequence: Synthetic oligonucleotide
tccacagcgacgccgcgagtcc

SEQ ID NO: 32986 - DNA, 21 bp, Artificial Sequence
  Description of Artificial Sequence: Synthetic oligonucleotide
ccacagcgacgccgcgagtcc

SEQ ID NO: 32987 - DNA, 22 bp, Artificial Sequence
  Description of Artificial Sequence: Synthetic oligonucleotide
cacagcgacgccgcgagtccga

SEQ ID NO: 32988 - DNA, 27 bp, Artificial Sequence
  Description of Artificial Sequence: Synthetic oligonucleotide
ggccgggtctcacatcatccagaggaa

SEQ ID NO: 32989 - DNA, 27 bp, Artificial Sequence
  Description of Artificial Sequence: Synthetic oligonucleotide
gccgggtctcacatcatccagaggaag

SEQ ID NO: 32990 - DNA, 30 bp, Artificial Sequence
  Description of Artificial Sequence: Synthetic oligonucleotide
ccgggtctcacatcatccagaggaagtatg

SEQ ID NO: 32991 - DNA, 30 bp, Artificial Sequence
  Description of Artificial Sequence: Synthetic oligonucleotide
cgggtctcacatcatccagaggaagtatgg

SEQ ID NO: 32992 - DNA, 30 bp, Artificial Sequence
  Description of Artificial Sequence: Synthetic oligonucleotide
gggtctcacatcatccagaggaagtatggc

SEQ ID NO: 32993 - DNA, 31 bp, Artificial Sequence
  Description of Artificial Sequence: Synthetic oligonucleotide
ggtctcacatcatccagaggaagtatggctg

SEQ ID NO: 32994 - DNA, 31 bp, Artificial Sequence
  Description of Artificial Sequence: Synthetic oligonucleotide
gtctcacatcatccagaggaagtatggctgc

SEQ ID NO: 32995 - DNA, 31 bp, Artificial Sequence
  Description of Artificial Sequence: Synthetic oligonucleotide
tctcacatcatccagaggaagtatggctgcg

SEQ ID NO: 32996 - DNA, 30 bp, Artificial Sequence
  Description of Artificial Sequence: Synthetic oligonucleotide
ctcacatcatccagaggaagtatggctgcg

SEQ ID NO: 32997 - DNA, 31 bp, Artificial Sequence
  Description of Artificial Sequence: Synthetic oligonucleotide
tcacatcatccagaggaagtatggctgcgac

SEQ ID NO: 32998 - DNA, 30 bp, Artificial Sequence
  Description of Artificial Sequence: Synthetic oligonucleotide
cacatcatccagaggaagtatggctgcgac

SEQ ID NO: 32999 - DNA, 30 bp, Artificial Sequence
  Description of Artificial Sequence: Synthetic oligonucleotide
acatcatccagaggaagtatggctgcgacc

SEQ ID NO: 33000 - DNA, 29 bp, Artificial Sequence
  Description of Artificial Sequence: Synthetic oligonucleotide
catcatccagaggaagtatggctgcgacc

SEQ ID NO: 33001 - DNA, 30 bp, Artificial Sequence
  Description of Artificial Sequence: Synthetic oligonucleotide
atcatccagaggaagtatggctgcgacctg

SEQ ID NO: 33002 - DNA, 29 bp, Artificial Sequence
  Description of Artificial Sequence: Synthetic oligonucleotide
tcatccagaggaagtatggctgcgacctg

SEQ ID NO: 33003 - DNA, 28 bp, Artificial Sequence
  Description of Artificial Sequence: Synthetic oligonucleotide
catccagaggaagtatggctgcgacctg

SEQ ID NO: 33004 - DNA, 28 bp, Artificial Sequence
  Description of Artificial Sequence: Synthetic oligonucleotide
atccagaggaagtatggctgcgacctgg

SEQ ID NO: 33005 - DNA, 27 bp, Artificial Sequence
  Description of Artificial Sequence: Synthetic oligonucleotide
tccagaggaagtatggctgcgacctgg

SEQ ID NO: 33006 - DNA, 26 bp, Artificial Sequence
  Description of Artificial Sequence: Synthetic oligonucleotide
ccagaggaagtatggctgcgacctgg

SEQ ID NO: 33007 - DNA, 26 bp, Artificial Sequence
  Description of Artificial Sequence: Synthetic oligonucleotide
cagaggaagtatggctgcgacctggg

SEQ ID NO: 33008 - DNA, 26 bp, Artificial Sequence
  Description of Artificial Sequence: Synthetic oligonucleotide
agaggaagtatggctgcgacctgggg

SEQ ID NO: 33009 - DNA, 25 bp, Artificial Sequence
  Description of Artificial Sequence: Synthetic oligonucleotide
gaggaagtatggctgcgacctgggg

SEQ ID NO: 33010 - DNA, 25 bp, Artificial Sequence
  Description of Artificial Sequence: Synthetic oligonucleotide
aggaagtatggctgcgacctggggc

SEQ ID NO: 33011 - DNA, 24 bp, Artificial Sequence
  Description of Artificial Sequence: Synthetic oligonucleotide
ggaagtatggctgcgacctggggc

SEQ ID NO: 33012 - DNA, 24 bp, Artificial Sequence
  Description of Artificial Sequence: Synthetic oligonucleotide
gaagtatggctgcgacctggggcc

SEQ ID NO: 33013 - DNA, 24 bp, Artificial Sequence
  Description of Artificial Sequence: Synthetic oligonucleotide
aagtatggctgcgacctggggccc

SEQ ID NO: 33014 - DNA, 23 bp, Artificial Sequence
  Description of Artificial Sequence: Synthetic oligonucleotide
agtatggctgcgacctggggccc

SEQ ID NO: 33015 - DNA, 27 bp, Artificial Sequence
  Description of Artificial Sequence: Synthetic oligonucleotide
acttaccgagaggacctgcggacccta

SEQ ID NO: 33016 - DNA, 26 bp, Artificial Sequence
  Description of Artificial Sequence: Synthetic oligonucleotide
cttaccgagaggacctgcggacccta

SEQ ID NO: 33017 - DNA, 27 bp, Artificial Sequence
  Description of Artificial Sequence: Synthetic oligonucleotide
ttaccgagaggacctgcggaccctact

SEQ ID NO: 33018 - DNA, 26 bp, Artificial Sequence
  Description of Artificial Sequence: Synthetic oligonucleotide
taccgagaggacctgcggaccctact

SEQ ID NO: 33019 - DNA, 25 bp, Artificial Sequence
  Description of Artificial Sequence: Synthetic oligonucleotide
accgagaggacctgcggaccctact

SEQ ID NO: 33020 - DNA, 24 bp, Artificial Sequence
  Description of Artificial Sequence: Synthetic oligonucleotide
ccgagaggacctgcggaccctact

SEQ ID NO: 33021 - DNA, 24 bp, Artificial Sequence
  Description of Artificial Sequence: Synthetic oligonucleotide
cgagaggacctgcggaccctactc

SEQ ID NO: 33022 - DNA, 24 bp, Artificial Sequence
  Description of Artificial Sequence: Synthetic oligonucleotide
gagaggacctgcggaccctactcc

SEQ ID NO: 33023 - DNA, 24 bp, Artificial Sequence
  Description of Artificial Sequence: Synthetic oligonucleotide
agaggacctgcggaccctactccg

SEQ ID NO: 33024 - DNA, 23 bp, Artificial Sequence
  Description of Artificial Sequence: Synthetic oligonucleotide
gaggacctgcggaccctactccg

SEQ ID NO: 33025 - DNA, 25 bp, Artificial Sequence
  Description of Artificial Sequence: Synthetic oligonucleotide
aggacctgcggaccctactccgcta

SEQ ID NO: 33026 - DNA, 24 bp, Artificial Sequence
  Description of Artificial Sequence: Synthetic oligonucleotide
ggacctgcggaccctactccgcta

SEQ ID NO: 33027 - DNA, 26 bp, Artificial Sequence
  Description of Artificial Sequence: Synthetic oligonucleotide
gacctgcggaccctactccgctacta

SEQ ID NO: 33028 - DNA, 27 bp, Artificial Sequence
  Description of Artificial Sequence: Synthetic oligonucleotide
acctgcggaccctactccgctactaca

SEQ ID NO: 33029 - DNA, 27 bp, Artificial Sequence
  Description of Artificial Sequence: Synthetic oligonucleotide
cctgcggaccctactccgctactacaa

SEQ ID NO: 33030 - DNA, 27 bp, Artificial Sequence
  Description of Artificial Sequence: Synthetic oligonucleotide
ctgcggaccctactccgctactacaac

SEQ ID NO: 33031 - DNA, 27 bp, Artificial Sequence
  Description of Artificial Sequence: Synthetic oligonucleotide
tgcggaccctactccgctactacaacc

SEQ ID NO: 33032 - DNA, 27 bp, Artificial Sequence
  Description of Artificial Sequence: Synthetic oligonucleotide
gcggaccctactccgctactacaacca

SEQ ID NO: 33033 - DNA, 27 bp, Artificial Sequence
  Description of Artificial Sequence: Synthetic oligonucleotide
cggaccctactccgctactacaaccag

SEQ ID NO: 33034 - DNA, 28 bp, Artificial Sequence
  Description of Artificial Sequence: Synthetic oligonucleotide
ggaccctactccgctactacaaccagag

SEQ ID NO: 33035 - DNA, 28 bp, Artificial Sequence
  Description of Artificial Sequence: Synthetic oligonucleotide
gaccctactccgctactacaaccagagc

SEQ ID NO: 33036 - DNA, 28 bp, Artificial Sequence
  Description of Artificial Sequence: Synthetic oligonucleotide
accctactccgctactacaaccagagcg

SEQ ID NO: 33037 - DNA, 27 bp, Artificial Sequence
  Description of Artificial Sequence: Synthetic oligonucleotide
ccctactccgctactacaaccagagcg

SEQ ID NO: 33038 - DNA, 28 bp, Artificial Sequence
  Description of Artificial Sequence: Synthetic oligonucleotide
cctactccgctactacaaccagagcgag

SEQ ID NO: 33039 - DNA, 28 bp, Artificial Sequence
  Description of Artificial Sequence: Synthetic oligonucleotide
ctactccgctactacaaccagagcgagg

SEQ ID NO: 33040 - DNA, 28 bp, Artificial Sequence
  Description of Artificial Sequence: Synthetic oligonucleotide
tactccgctactacaaccagagcgaggc

SEQ ID NO: 33041 - DNA, 27 bp, Artificial Sequence
  Description of Artificial Sequence: Synthetic oligonucleotide
actccgctactacaaccagagcgaggc

SEQ ID NO: 33042 - DNA, 29 bp, Artificial Sequence
  Description of Artificial Sequence: Synthetic oligonucleotide
caagaccaacacacagacctaccgagagg

SEQ ID NO: 33043 - DNA, 30 bp, Artificial Sequence
  Description of Artificial Sequence: Synthetic oligonucleotide
aagaccaacacacagacctaccgagaggac

SEQ ID NO: 33044 - DNA, 29 bp, Artificial Sequence
  Description of Artificial Sequence: Synthetic oligonucleotide
agaccaacacacagacctaccgagaggac

SEQ ID NO: 33045 - DNA, 28 bp, Artificial Sequence
  Description of Artificial Sequence: Synthetic oligonucleotide
gaccaacacacagacctaccgagaggac

SEQ ID NO: 33046 - DNA, 28 bp, Artificial Sequence
  Description of Artificial Sequence: Synthetic oligonucleotide
accaacacacagacctaccgagaggacc

SEQ ID NO: 33047 - DNA, 27 bp, Artificial Sequence
  Description of Artificial Sequence: Synthetic oligonucleotide
ccaacacacagacctaccgagaggacc

SEQ ID NO: 33048 - DNA, 28 bp, Artificial Sequence
  Description of Artificial Sequence: Synthetic oligonucleotide
caacacacagacctaccgagaggacctg

SEQ ID NO: 33049 - DNA, 28 bp, Artificial Sequence
  Description of Artificial Sequence: Synthetic oligonucleotide
aacacacagacctaccgagaggacctgc

SEQ ID NO: 33050 - DNA, 27 bp, Artificial Sequence
  Description of Artificial Sequence: Synthetic oligonucleotide
acacacagacctaccgagaggacctgc

SEQ ID NO: 33051 - DNA, 26 bp, Artificial Sequence
  Description of Artificial Sequence: Synthetic oligonucleotide
cacacagacctaccgagaggacctgc

SEQ ID NO: 33052 - DNA, 26 bp, Artificial Sequence
  Description of Artificial Sequence: Synthetic oligonucleotide
acacagacctaccgagaggacctgcg

SEQ ID NO: 33053 - DNA, 25 bp, Artificial Sequence
  Description of Artificial Sequence: Synthetic oligonucleotide
cacagacctaccgagaggacctgcg

SEQ ID NO: 33054 - DNA, 26 bp, Artificial Sequence
  Description of Artificial Sequence: Synthetic oligonucleotide
acagacctaccgagaggacctgcgga

SEQ ID NO: 33055 - DNA, 25 bp, Artificial Sequence
  Description of Artificial Sequence: Synthetic oligonucleotide
cagacctaccgagaggacctgcgga

SEQ ID NO: 33056 - DNA, 25 bp, Artificial Sequence
  Description of Artificial Sequence: Synthetic oligonucleotide
agacctaccgagaggacctgcggac

SEQ ID NO: 33057 - DNA, 24 bp, Artificial Sequence
  Description of Artificial Sequence: Synthetic oligonucleotide
gacctaccgagaggacctgcggac

SEQ ID NO: 33058 - DNA, 24 bp, Artificial Sequence
  Description of Artificial Sequence: Synthetic oligonucleotide
acctaccgagaggacctgcggacc

SEQ ID NO: 33059 - DNA, 23 bp, Artificial Sequence
  Description of Artificial Sequence: Synthetic oligonucleotide
cctaccgagaggacctgcggacc

SEQ ID NO: 33060 - DNA, 24 bp, Artificial Sequence
  Description of Artificial Sequence: Synthetic oligonucleotide
ctaccgagaggacctgcggaccct

SEQ ID NO: 33061 - DNA, 27 bp, Artificial Sequence
  Description of Artificial Sequence: Synthetic oligonucleotide
agcaggacagagcctacctggagggaa

SEQ ID NO: 33062 - DNA, 26 bp, Artificial Sequence
  Description of Artificial Sequence: Synthetic oligonucleotide
gcaggacagagcctacctggagggaa

SEQ ID NO: 33063 - DNA, 26 bp, Artificial Sequence
  Description of Artificial Sequence: Synthetic oligonucleotide
caggacagagcctacctggagggaac

SEQ ID NO: 33064 - DNA, 27 bp, Artificial Sequence
  Description of Artificial Sequence: Synthetic oligonucleotide
aggacagagcctacctggagggaacgt

SEQ ID NO: 33065 - DNA, 26 bp, Artificial Sequence
  Description of Artificial Sequence: Synthetic oligonucleotide
ggacagagcctacctggagggaacgt

SEQ ID NO: 33066 - DNA, 26 bp, Artificial Sequence
  Description of Artificial Sequence: Synthetic oligonucleotide
gacagagcctacctggagggaacgtg

SEQ ID NO: 33067 - DNA, 26 bp, Artificial Sequence
  Description of Artificial Sequence: Synthetic oligonucleotide
acagagcctacctggagggaacgtgc

SEQ ID NO: 33068 - DNA, 25 bp, Artificial Sequence
  Description of Artificial Sequence: Synthetic oligonucleotide
cagagcctacctggagggaacgtgc

SEQ ID NO: 33069 - DNA, 26 bp, Artificial Sequence
  Description of Artificial Sequence: Synthetic oligonucleotide
agagcctacctggagggaacgtgcgt

SEQ ID NO: 33070 - DNA, 25 bp, Artificial Sequence
  Description of Artificial Sequence: Synthetic oligonucleotide
gagcctacctggagggaacgtgcgt

SEQ ID NO: 33071 - DNA, 25 bp, Artificial Sequence
  Description of Artificial Sequence: Synthetic oligonucleotide
agcctacctggagggaacgtgcgtg

SEQ ID NO: 33072 - DNA, 24 bp, Artificial Sequence
  Description of Artificial Sequence: Synthetic oligonucleotide
gcctacctggagggaacgtgcgtg

SEQ ID NO: 33073 - DNA, 25 bp, Artificial Sequence
  Description of Artificial Sequence: Synthetic oligonucleotide
cctacctggagggaacgtgcgtgga

SEQ ID NO: 33074 - DNA, 26 bp, Artificial Sequence
  Description of Artificial Sequence: Synthetic oligonucleotide
ctacctggagggaacgtgcgtggagt

SEQ ID NO: 33075 - DNA, 26 bp, Artificial Sequence
  Description of Artificial Sequence: Synthetic oligonucleotide
tacctggagggaacgtgcgtggagtg

SEQ ID NO: 33076 - DNA, 25 bp, Artificial Sequence
  Description of Artificial Sequence: Synthetic oligonucleotide
acctggagggaacgtgcgtggagtg

SEQ ID NO: 33077 - DNA, 24 bp, Artificial Sequence
  Description of Artificial Sequence: Synthetic oligonucleotide
cctggagggaacgtgcgtggagtg

SEQ ID NO: 33078 - DNA, 24 bp, Artificial Sequence
  Description of Artificial Sequence: Synthetic oligonucleotide
ctggagggaacgtgcgtggagtgg

SEQ ID NO: 33079 - DNA, 25 bp, Artificial Sequence
  Description of Artificial Sequence: Synthetic oligonucleotide
tggagggaacgtgcgtggagtggct

SEQ ID NO: 33080 - DNA, 24 bp, Artificial Sequence
  Description of Artificial Sequence: Synthetic oligonucleotide
ggagggaacgtgcgtggagtggct

SEQ ID NO: 33081 - DNA, 24 bp, Artificial Sequence
  Description of Artificial Sequence: Synthetic oligonucleotide
gagggaacgtgcgtggagtggctc

SEQ ID NO: 33082 - DNA, 24 bp, Artificial Sequence
  Description of Artificial Sequence: Synthetic oligonucleotide
agggaacgtgcgtggagtggctcc

SEQ ID NO: 33083 - DNA, 23 bp, Artificial Sequence
  Description of Artificial Sequence: Synthetic oligonucleotide
gggaacgtgcgtggagtggctcc

SEQ ID NO: 33084 - DNA, 23 bp, Artificial Sequence
  Description of Artificial Sequence: Synthetic oligonucleotide
ggaacgtgcgtggagtggctccg

SEQ ID NO: 33085 - DNA, 24 bp, Artificial Sequence
  Description of Artificial Sequence: Synthetic oligonucleotide
gaacgtgcgtggagtggctccgca

SEQ ID NO: 33086 - DNA, 27 bp, Artificial Sequence
  Description of Artificial Sequence: Synthetic oligonucleotide
aacgtgcgtggagtggctccgcagata

SEQ ID NO: 33087 - DNA, 28 bp, Artificial Sequence
  Description of Artificial Sequence: Synthetic oligonucleotide
atctcagtgggctacgtggacgacacac

SEQ ID NO: 33088 - DNA, 27 bp, Artificial Sequence
  Description of Artificial Sequence: Synthetic oligonucleotide
tctcagtgggctacgtggacgacacac

SEQ ID NO: 33089 - DNA, 27 bp, Artificial Sequence
  Description of Artificial Sequence: Synthetic oligonucleotide
ctcagtgggctacgtggacgacacaca

SEQ ID NO: 33090 - DNA, 27 bp, Artificial Sequence
  Description of Artificial Sequence: Synthetic oligonucleotide
tcagtgggctacgtggacgacacacag

SEQ ID NO: 33091 - DNA, 27 bp, Artificial Sequence
  Description of Artificial Sequence: Synthetic oligonucleotide
cagtgggctacgtggacgacacacagt

SEQ ID NO: 33092 - DNA, 28 bp, Artificial Sequence
  Description of Artificial Sequence: Synthetic oligonucleotide
agtgggctacgtggacgacacacagttc

SEQ ID NO: 33093 - DNA, 27 bp, Artificial Sequence
  Description of Artificial Sequence: Synthetic oligonucleotide
gtgggctacgtggacgacacacagttc

SEQ ID NO: 33094 - DNA, 27 bp, Artificial Sequence
  Description of Artificial Sequence: Synthetic oligonucleotide
tgggctacgtggacgacacacagttcg

SEQ ID NO: 33095 - DNA, 27 bp, Artificial Sequence
  Description of Artificial Sequence: Synthetic oligonucleotide
gggctacgtggacgacacacagttcgt

SEQ ID NO: 33096 - DNA, 27 bp, Artificial Sequence
  Description of Artificial Sequence: Synthetic oligonucleotide
ggctacgtggacgacacacagttcgtg

SEQ ID NO: 33097 - DNA, 28 bp, Artificial Sequence
  Description of Artificial Sequence: Synthetic oligonucleotide
gctacgtggacgacacacagttcgtgag

SEQ ID NO: 33098 - DNA, 28 bp, Artificial Sequence
  Description of Artificial Sequence: Synthetic oligonucleotide
ctacgtggacgacacacagttcgtgagg

SEQ ID NO: 33099 - DNA, 30 bp, Artificial Sequence
  Description of Artificial Sequence: Synthetic oligonucleotide
tacgtggacgacacacagttcgtgaggttc

SEQ ID NO: 33100 - DNA, 29 bp, Artificial Sequence
  Description of Artificial Sequence: Synthetic oligonucleotide
acgtggacgacacacagttcgtgaggttc

SEQ ID NO: 33101 - DNA, 28 bp, Artificial Sequence
  Description of Artificial Sequence: Synthetic oligonucleotide
cgtggacgacacacagttcgtgaggttc

SEQ ID NO: 33102 - DNA, 28 bp, Artificial Sequence
  Description of Artificial Sequence: Synthetic oligonucleotide
gtggacgacacacagttcgtgaggttcg

SEQ ID NO: 33103 - DNA, 29 bp, Artificial Sequence
  Description of Artificial Sequence: Synthetic oligonucleotide
tggacgacacacagttcgtgaggttcgac

SEQ ID NO: 33104 - DNA, 28 bp, Artificial Sequence
  Description of Artificial Sequence: Synthetic oligonucleotide
ggacgacacacagttcgtgaggttcgac

SEQ ID NO: 33105 - DNA, 29 bp, Artificial Sequence
  Description of Artificial Sequence: Synthetic oligonucleotide
gacgacacacagttcgtgaggttcgacag

SEQ ID NO: 33106 - DNA, 29 bp, Artificial Sequence
  Description of Artificial Sequence: Synthetic oligonucleotide
acgacacacagttcgtgaggttcgacagc

SEQ ID NO: 33107 - DNA, 28 bp, Artificial Sequence
  Description of Artificial Sequence: Synthetic oligonucleotide
cgacacacagttcgtgaggttcgacagc

SEQ ID NO: 33108 - DNA, 28 bp, Artificial Sequence
  Description of Artificial Sequence: Synthetic oligonucleotide
gacacacagttcgtgaggttcgacagcg

SEQ ID NO: 33109 - DNA, 29 bp, Artificial Sequence
  Description of Artificial Sequence: Synthetic oligonucleotide
acacacagttcgtgaggttcgacagcgac

SEQ ID NO: 33110 - DNA, 28 bp, Artificial Sequence
  Description of Artificial Sequence: Synthetic oligonucleotide
cacacagttcgtgaggttcgacagcgac

SEQ ID NO: 33111 - DNA, 28 bp, Artificial Sequence
  Description of Artificial Sequence: Synthetic oligonucleotide
acacagttcgtgaggttcgacagcgacg

SEQ ID NO: 33112 - DNA, 27 bp, Artificial Sequence
  Description of Artificial Sequence: Synthetic oligonucleotide
cacagttcgtgaggttcgacagcgacg

SEQ ID NO: 33113 - DNA, 27 bp, Artificial Sequence
  Description of Artificial Sequence: Synthetic oligonucleotide
acagttcgtgaggttcgacagcgacgc

SEQ ID NO: 33114 - DNA, 27 bp, Artificial Sequence
  Description of Artificial Sequence: Synthetic oligonucleotide
ccctgctccgctactacaaccagagct

SEQ ID NO: 33115 - DNA, 28 bp, Artificial Sequence
  Description of Artificial Sequence: Synthetic oligonucleotide
cctgctccgctactacaaccagagctag

SEQ ID NO: 33116 - DNA, 28 bp, Artificial Sequence
  Description of Artificial Sequence: Synthetic oligonucleotide
ctgctccgctactacaaccagagctagg

SEQ ID NO: 33117 - DNA, 28 bp, Artificial Sequence
  Description of Artificial Sequence: Synthetic oligonucleotide
tgctccgctactacaaccagagctaggc

SEQ ID NO: 33118 - DNA, 27 bp, Artificial Sequence
  Description of Artificial Sequence: Synthetic oligonucleotide
gctccgctactacaaccagagctaggc

SEQ ID NO: 33119 - DNA, 27 bp, Artificial Sequence
  Description of Artificial Sequence: Synthetic oligonucleotide
ctccgctactacaaccagagctaggcc

SEQ ID NO: 33120 - DNA, 27 bp, Artificial Sequence
  Description of Artificial Sequence: Synthetic oligonucleotide
tccgctactacaaccagagctaggccg

SEQ ID NO: 33121 - DNA, 26 bp, Artificial Sequence
  Description of Artificial Sequence: Synthetic oligonucleotide
ccgctactacaaccagagctaggccg

SEQ ID NO: 33122 - DNA, 26 bp, Artificial Sequence
  Description of Artificial Sequence: Synthetic oligonucleotide
cgctactacaaccagagctaggccgg

SEQ ID NO: 33123 - DNA, 27 bp, Artificial Sequence
  Description of Artificial Sequence: Synthetic oligonucleotide
gctactacaaccagagctaggccgggt

SEQ ID NO: 33124 - DNA, 27 bp, Artificial Sequence
  Description of Artificial Sequence: Synthetic oligonucleotide
ctactacaaccagagctaggccgggtc

SEQ ID NO: 33125 - DNA, 28 bp, Artificial Sequence
  Description of Artificial Sequence: Synthetic oligonucleotide
tactacaaccagagctaggccgggtctc

SEQ ID NO: 33126 - DNA, 27 bp, Artificial Sequence
  Description of Artificial Sequence: Synthetic oligonucleotide
actacaaccagagctaggccgggtctc

SEQ ID NO: 33127 - DNA, 27 bp, Artificial Sequence
  Description of Artificial Sequence: Synthetic oligonucleotide
ctacaaccagagctaggccgggtctca

SEQ ID NO: 33128 - DNA, 27 bp, Artificial Sequence
  Description of Artificial Sequence: Synthetic oligonucleotide
tacaaccagagctaggccgggtctcac

SEQ ID NO: 33129 - DNA, 27 bp, Artificial Sequence
  Description of Artificial Sequence: Synthetic oligonucleotide
acaaccagagctaggccgggtctcaca

SEQ ID NO: 33130 - DNA, 26 bp, Artificial Sequence
  Description of Artificial Sequence: Synthetic oligonucleotide
caaccagagctaggccgggtctcaca

SEQ ID NO: 33131 - DNA, 26 bp, Artificial Sequence
  Description of Artificial Sequence: Synthetic oligonucleotide
aaccagagctaggccgggtctcacac

SEQ ID NO: 33132 - DNA, 25 bp, Artificial Sequence
  Description of Artificial Sequence: Synthetic oligonucleotide
accagagctaggccgggtctcacac

SEQ ID NO: 33133 - DNA, 24 bp, Artificial Sequence
  Description of Artificial Sequence: Synthetic oligonucleotide
ccagagctaggccgggtctcacac

SEQ ID NO: 33134 - DNA, 26 bp, Artificial Sequence
  Description of Artificial Sequence: Synthetic oligonucleotide
cagagctaggccgggtctcacaccat

SEQ ID NO: 33135 - DNA, 26 bp, Artificial Sequence
  Description of Artificial Sequence: Synthetic oligonucleotide
agagctaggccgggtctcacaccatc

SEQ ID NO: 33136 - DNA, 25 bp, Artificial Sequence
  Description of Artificial Sequence: Synthetic oligonucleotide
gagctaggccgggtctcacaccatc

SEQ ID NO: 33137 - DNA, 26 bp, Artificial Sequence
  Description of Artificial Sequence: Synthetic oligonucleotide
agctaggccgggtctcacaccatcca

SEQ ID NO: 33138 - DNA, 25 bp, Artificial Sequence
  Description of Artificial Sequence: Synthetic oligonucleotide
gctaggccgggtctcacaccatcca

SEQ ID NO: 33139 - DNA, 26 bp, Artificial Sequence
  Description of Artificial Sequence: Synthetic oligonucleotide
ctaggccgggtctcacaccatccaga

SEQ ID NO: 33140 - DNA, 26 bp, Artificial Sequence
  Description of Artificial Sequence: Synthetic oligonucleotide
taggccgggtctcacaccatccagag

SEQ ID NO: 33141 - DNA, 28 bp, Artificial Sequence
  Description of Artificial Sequence: Synthetic oligonucleotide
acagacttaccgagaggacctgcggaac

SEQ ID NO: 33142 - DNA, 27 bp, Artificial Sequence
  Description of Artificial Sequence: Synthetic oligonucleotide
cagacttaccgagaggacctgcggaac

SEQ ID NO: 33143 - DNA, 27 bp, Artificial Sequence
  Description of Artificial Sequence: Synthetic oligonucleotide
agacttaccgagaggacctgcggaacc

SEQ ID NO: 33144 - DNA, 27 bp, Artificial Sequence
  Description of Artificial Sequence: Synthetic oligonucleotide
gacttaccgagaggacctgcggaacct

SEQ ID NO: 33145 - DNA, 27 bp, Artificial Sequence
  Description of Artificial Sequence: Synthetic oligonucleotide
acttaccgagaggacctgcggaacctg

SEQ ID NO: 33146 - DNA, 26 bp, Artificial Sequence
  Description of Artificial Sequence: Synthetic oligonucleotide
cttaccgagaggacctgcggaacctg

SEQ ID NO: 33147 - DNA, 26 bp, Artificial Sequence
  Description of Artificial Sequence: Synthetic oligonucleotide
ttaccgagaggacctgcggaacctgc

SEQ ID NO: 33148 - DNA, 25 bp, Artificial Sequence
  Description of Artificial Sequence: Synthetic oligonucleotide
taccgagaggacctgcggaacctgc

SEQ ID NO: 33149 - DNA, 22 bp, Artificial Sequence
  Description of Artificial Sequence: Synthetic oligonucleotide
cgcgagtccgaggaaggagccc

SEQ ID NO: 33150 - DNA, 22 bp, Artificial Sequence
  Description of Artificial Sequence: Synthetic oligonucleotide
gcgagtccgaggaaggagcccc

SEQ ID NO: 33151 - DNA, 22 bp, Artificial Sequence
  Description of Artificial Sequence: Synthetic oligonucleotide
cgagtccgaggaaggagccccg

SEQ ID NO: 33152 - DNA, 22 bp, Artificial Sequence
  Description of Artificial Sequence: Synthetic oligonucleotide
gagtccgaggaaggagccccgg

SEQ ID NO: 33153 - DNA, 22 bp, Artificial Sequence
  Description of Artificial Sequence: Synthetic oligonucleotide
agtccgaggaaggagccccggg

SEQ ID NO: 33154 - DNA, 21 bp, Artificial Sequence
  Description of Artificial Sequence: Synthetic oligonucleotide
gtccgaggaaggagccccggg

SEQ ID NO: 33155 - DNA, 21 bp, Artificial Sequence
  Description of Artificial Sequence: Synthetic oligonucleotide
tccgaggaaggagccccgggc

SEQ ID NO: 33156 - DNA, 20 bp, Artificial Sequence
  Description of Artificial Sequence: Synthetic oligonucleotide
ccgaggaaggagccccgggc

SEQ ID NO: 33157 - DNA, 20 bp, Artificial Sequence
  Description of Artificial Sequence: Synthetic oligonucleotide
cgaggaaggagccccgggcg

SEQ ID NO: 33158 - DNA, 20 bp, Artificial Sequence
  Description of Artificial Sequence: Synthetic oligonucleotide
gaggaaggagccccgggcgc

SEQ ID NO: 33159 - DNA, 20 bp, Artificial Sequence
  Description of Artificial Sequence: Synthetic oligonucleotide
aggaaggagccccgggcgcc

SEQ ID NO: 33160 - DNA, 20 bp, Artificial Sequence
  Description of Artificial Sequence: Synthetic oligonucleotide
ggaaggagccccgggcgcct

SEQ ID NO: 33161 - DNA, 20 bp, Artificial Sequence
  Description of Artificial Sequence: Synthetic oligonucleotide
gaaggagccccgggcgccgt

SEQ ID NO: 33162 - DNA, 20 bp, Artificial Sequence
  Description of Artificial Sequence: Synthetic oligonucleotide
aaggagccccgggcgccgtg

SEQ ID NO: 33163 - DNA, 27 bp, Artificial Sequence
  Description of Artificial Sequence: Synthetic oligonucleotide
ttaccgagagagcctgcggaacctgct

SEQ ID NO: 33164 - DNA, 26 bp, Artificial Sequence
  Description of Artificial Sequence: Synthetic oligonucleotide
taccgagagagcctgcggaacctgct

SEQ ID NO: 33165 - DNA, 25 bp, Artificial Sequence
  Description of Artificial Sequence: Synthetic oligonucleotide
accgagagagcctgcggaacctgct

SEQ ID NO: 33166 - DNA, 24 bp, Artificial Sequence
  Description of Artificial Sequence: Synthetic oligonucleotide
ccgagagagcctgcggaacctgct

SEQ ID NO: 33167 - DNA, 24 bp, Artificial Sequence
  Description of Artificial Sequence: Synthetic oligonucleotide
cgagagagcctgcggaacctgctc

SEQ ID NO: 33168 - DNA, 24 bp, Artificial Sequence
  Description of Artificial Sequence: Synthetic oligonucleotide
gagagagcctgcggaacctgctcc

SEQ ID NO: 33169 - DNA, 24 bp, Artificial Sequence
  Description of Artificial Sequence: Synthetic oligonucleotide
agagagcctgcggaacctgctccg

SEQ ID NO: 33170 - DNA, 23 bp, Artificial Sequence
  Description of Artificial Sequence: Synthetic oligonucleotide
gagagcctgcggaacctgctccg

SEQ ID NO: 33171 - DNA, 25 bp, Artificial Sequence
  Description of Artificial Sequence: Synthetic oligonucleotide
agagcctgcggaacctgctccgcta

SEQ ID NO: 33172 - DNA, 24 bp, Artificial Sequence
  Description of Artificial Sequence: Synthetic oligonucleotide
gagcctgcggaacctgctccgcta

SEQ ID NO: 33173 - DNA, 26 bp, Artificial Sequence
  Description of Artificial Sequence: Synthetic oligonucleotide
agcctgcggaacctgctccgctacta

SEQ ID NO: 33174 - DNA, 25 bp, Artificial Sequence
  Description of Artificial Sequence: Synthetic oligonucleotide
gcctgcggaacctgctccgctacta

SEQ ID NO: 33175 - DNA, 27 bp, Artificial Sequence
  Description of Artificial Sequence: Synthetic oligonucleotide
cctgcggaacctgctccgctactacaa

SEQ ID NO: 33176 - DNA, 27 bp, Artificial Sequence
  Description of Artificial Sequence: Synthetic oligonucleotide
ctgcggaacctgctccgctactacaac

SEQ ID NO: 33177 - DNA, 27 bp, Artificial Sequence
  Description of Artificial Sequence: Synthetic oligonucleotide
tgcggaacctgctccgctactacaacc

SEQ ID NO: 33178 - DNA, 27 bp, Artificial Sequence
  Description of Artificial Sequence: Synthetic oligonucleotide
gcggaacctgctccgctactacaacca

SEQ ID NO: 33179 - DNA, 27 bp, Artificial Sequence
  Description of Artificial Sequence: Synthetic oligonucleotide
cggaacctgctccgctactacaaccag

SEQ ID NO: 33180 - DNA, 28 bp, Artificial Sequence
  Description of Artificial Sequence: Synthetic oligonucleotide
ggaacctgctccgctactacaaccagag

SEQ ID NO: 33181 - DNA, 28 bp, Artificial Sequence
  Description of Artificial Sequence: Synthetic oligonucleotide
gaacctgctccgctactacaaccagagc

SEQ ID NO: 33182 - DNA, 28 bp, Artificial Sequence
  Description of Artificial Sequence: Synthetic oligonucleotide
aacctgctccgctactacaaccagagcg

SEQ ID NO: 33183 - DNA, 27 bp, Artificial Sequence
  Description of Artificial Sequence: Synthetic oligonucleotide
acctgctccgctactacaaccagagcg

SEQ ID NO: 33184 - DNA, 20 bp, Artificial Sequence
  Description of Artificial Sequence: Synthetic oligonucleotide
gagccccgggcgccgtggat

SEQ ID NO: 33185 - DNA, 20 bp, Artificial Sequence
  Description of Artificial Sequence: Synthetic oligonucleotide
agccccgggcgccgtggaca

SEQ ID NO: 33186 - DNA, 20 bp, Artificial Sequence
  Description of Artificial Sequence: Synthetic oligonucleotide
gccccgggcgccgtggacat

SEQ ID NO: 33187 - DNA, 20 bp, Artificial Sequence
  Description of Artificial Sequence: Synthetic oligonucleotide
ccccgggcgccgtggacaga

SEQ ID NO: 33188 - DNA, 20 bp, Artificial Sequence
  Description of Artificial Sequence: Synthetic oligonucleotide
cccgggcgccgtggacagag

SEQ ID NO: 33189 - DNA, 21 bp, Artificial Sequence
  Description of Artificial Sequence: Synthetic oligonucleotide
ccgggcgccgtggacagagca

SEQ ID NO: 33190 - DNA, 22 bp, Artificial Sequence
  Description of Artificial Sequence: Synthetic oligonucleotide
ggcgccgtggacagagcaggag

SEQ ID NO: 33191 - DNA, 22 bp, Artificial Sequence
  Description of Artificial Sequence: Synthetic oligonucleotide
gcgccgtggacagagcaggagg

SEQ ID NO: 33192 - DNA, 22 bp, Artificial Sequence
  Description of Artificial Sequence: Synthetic oligonucleotide
cgccgtggacagagcaggaggg

SEQ ID NO: 33193 - DNA, 22 bp, Artificial Sequence
  Description of Artificial Sequence: Synthetic oligonucleotide
gccgtggacagagcaggagggg

SEQ ID NO: 33194 - DNA, 22 bp, Artificial Sequence
  Description of Artificial Sequence: Synthetic oligonucleotide
ccgtggacagagcaggaggggc

SEQ ID NO: 33195 - DNA, 22 bp, Artificial Sequence
  Description of Artificial Sequence: Synthetic oligonucleotide
cgtggacagagcaggaggggcc

SEQ ID NO: 33196 - DNA, 22 bp, Artificial Sequence
  Description of Artificial Sequence: Synthetic oligonucleotide
gtggacagagcaggaggggccg

SEQ ID NO: 33197 - DNA, 23 bp, Artificial Sequence
  Description of Artificial Sequence: Synthetic oligonucleotide
tggacagagcaggaggggccgga

SEQ ID NO: 33198 - DNA, 22 bp, Artificial Sequence
  Description of Artificial Sequence: Synthetic oligonucleotide
ggacagagcaggaggggccgga

SEQ ID NO: 33199 - DNA, 26 bp, Artificial Sequence
  Description of Artificial Sequence: Synthetic oligonucleotide
gacagagcaggaggggccggagtatt

SEQ ID NO: 33200 - DNA, 26 bp, Artificial Sequence
  Description of Artificial Sequence: Synthetic oligonucleotide
acagagcaggaggggccggagtattg

SEQ ID NO: 33201 - DNA, 25 bp, Artificial Sequence
  Description of Artificial Sequence: Synthetic oligonucleotide
cagagcaggaggggccggagtattg

SEQ ID NO: 33202 - DNA, 26 bp, Artificial Sequence
  Description of Artificial Sequence: Synthetic oligonucleotide
gacagagcctacctggagggcacgta

SEQ ID NO: 33203 - DNA, 26 bp, Artificial Sequence
  Description of Artificial Sequence: Synthetic oligonucleotide
acagagcctacctggagggcacgtac

SEQ ID NO: 33204 - DNA, 25 bp, Artificial Sequence
  Description of Artificial Sequence: Synthetic oligonucleotide
cagagcctacctggagggcacgtac

SEQ ID NO: 33205 - DNA, 26 bp, Artificial Sequence
  Description of Artificial Sequence: Synthetic oligonucleotide
agagcctacctggagggcacgtacgt

SEQ ID NO: 33206 - DNA, 25 bp, Artificial Sequence
  Description of Artificial Sequence: Synthetic oligonucleotide
gagcctacctggagggcacgtacgt

SEQ ID NO: 33207 - DNA, 25 bp, Artificial Sequence
  Description of Artificial Sequence: Synthetic oligonucleotide
agcctacctggagggcacgtacgtg

SEQ ID NO: 33208 - DNA, 24 bp, Artificial Sequence
  Description of Artificial Sequence: Synthetic oligonucleotide
gcctacctggagggcacgtacgtg

SEQ ID NO: 33209 - DNA, 25 bp, Artificial Sequence
  Description of Artificial Sequence: Synthetic oligonucleotide
cctacctggagggcacgtacgtgga

SEQ ID NO: 33210 - DNA, 26 bp, Artificial Sequence
  Description of Artificial Sequence: Synthetic oligonucleotide
ctacctggagggcacgtacgtggagt

SEQ ID NO: 33211 - DNA, 26 bp, Artificial Sequence
  Description of Artificial Sequence: Synthetic oligonucleotide
tacctggagggcacgtacgtggagtg

SEQ ID NO: 33212 - DNA, 25 bp, Artificial Sequence
  Description of Artificial Sequence: Synthetic oligonucleotide
acctggagggcacgtacgtggagtg

SEQ ID NO: 33213 - DNA, 24 bp, Artificial Sequence
  Description of Artificial Sequence: Synthetic oligonucleotide
cctggagggcacgtacgtggagtg

SEQ ID NO: 33214 - DNA, 24 bp, Artificial Sequence
  Description of Artificial Sequence: Synthetic oligonucleotide
ctggagggcacgtacgtggagtgg

SEQ ID NO: 33215 - DNA, 25 bp, Artificial Sequence
  Description of Artificial Sequence: Synthetic oligonucleotide
tggagggcacgtacgtggagtggct

SEQ ID NO: 33216 - DNA, 24 bp, Artificial Sequence
  Description of Artificial Sequence: Synthetic oligonucleotide
ggagggcacgtacgtggagtggct

SEQ ID NO: 33217 - DNA, 24 bp, Artificial Sequence
  Description of Artificial Sequence: Synthetic oligonucleotide
gagggcacgtacgtggagtggctc

SEQ ID NO: 33218 - DNA, 24 bp, Artificial Sequence
  Description of Artificial Sequence: Synthetic oligonucleotide
agggcacgtacgtggagtggctcc

SEQ ID NO: 33219 - DNA, 23 bp, Artificial Sequence
  Description of Artificial Sequence: Synthetic oligonucleotide
gggcacgtacgtggagtggctcc

SEQ ID NO: 33220 - DNA, 23 bp, Artificial Sequence
  Description of Artificial Sequence: Synthetic oligonucleotide
ggcacgtacgtggagtggctccg

SEQ ID NO: 33221 - DNA, 24 bp, Artificial Sequence
  Description of Artificial Sequence: Synthetic oligonucleotide
gcacgtacgtggagtggctccgca

SEQ ID NO: 33222 - DNA, 27 bp, Artificial Sequence
  Description of Artificial Sequence: Synthetic oligonucleotide
cacgtacgtggagtggctccgcagata

SEQ ID NO: 33223 - DNA, 27 bp, Artificial Sequence
  Description of Artificial Sequence: Synthetic oligonucleotide
acgtacgtggagtggctccgcagatac

SEQ ID NO: 33224 - DNA, 26 bp, Artificial Sequence
  Description of Artificial Sequence: Synthetic oligonucleotide
cgtacgtggagtggctccgcagatac

SEQ ID NO: 33225 - DNA, 27 bp, Artificial Sequence
  Description of Artificial Sequence: Synthetic oligonucleotide
gtacgtggagtggctccgcagatacct

SEQ ID NO: 33226 - DNA, 27 bp, Artificial Sequence
  Description of Artificial Sequence: Synthetic oligonucleotide
tacgtggagtggctccgcagatacctg

SEQ ID NO: 33227 - DNA, 26 bp, Artificial Sequence
  Description of Artificial Sequence: Synthetic oligonucleotide
acgtggagtggctccgcagatacctg

SEQ ID NO: 33228 - DNA, 25 bp, Artificial Sequence
  Description of Artificial Sequence: Synthetic oligonucleotide
atcacccagcgcaagtgggaggcga

SEQ ID NO: 33229 - DNA, 24 bp, Artificial Sequence
  Description of Artificial Sequence: Synthetic oligonucleotide
tcacccagcgcaagtgggaggcga

SEQ ID NO: 33230 - DNA, 23 bp, Artificial Sequence
  Description of Artificial Sequence: Synthetic oligonucleotide
cacccagcgcaagtgggaggcga

SEQ ID NO: 33231 - DNA, 23 bp, Artificial Sequence
  Description of Artificial Sequence: Synthetic oligonucleotide
acccagcgcaagtgggaggcgac

SEQ ID NO: 33232 - DNA, 22 bp, Artificial Sequence
  Description of Artificial Sequence: Synthetic oligonucleotide
cccagcgcaagtgggaggcgac

SEQ ID NO: 33233 - DNA, 22 bp, Artificial Sequence
  Description of Artificial Sequence: Synthetic oligonucleotide
ccagcgcaagtgggaggcgacc

SEQ ID NO: 33234 - DNA, 22 bp, Artificial Sequence
  Description of Artificial Sequence: Synthetic oligonucleotide
cagcgcaagtgggaggcgaccc

SEQ ID NO: 33235 - DNA, 23 bp, Artificial Sequence
  Description of Artificial Sequence: Synthetic oligonucleotide
agcgcaagtgggaggcgacccgt

SEQ ID NO: 33236 - DNA, 22 bp, Artificial Sequence
  Description of Artificial Sequence: Synthetic oligonucleotide
gcgcaagtgggaggcgacccgt

SEQ ID NO: 33237 - DNA, 23 bp, Artificial Sequence
  Description of Artificial Sequence: Synthetic oligonucleotide
cgcaagtgggaggcgacccgtgt

SEQ ID NO: 33238 - DNA, 23 bp, Artificial Sequence
  Description of Artificial Sequence: Synthetic oligonucleotide
gcaagtgggaggcgacccgtgtg

SEQ ID NO: 33239 - DNA, 23 bp, Artificial Sequence
  Description of Artificial Sequence: Synthetic oligonucleotide
caagtgggaggcgacccgtgtgg

SEQ ID NO: 33240 - DNA, 23 bp, Artificial Sequence
  Description of Artificial Sequence: Synthetic oligonucleotide
aagtgggaggcgacccgtgtggc

SEQ ID NO: 33241 - DNA, 22 bp, Artificial Sequence
  Description of Artificial Sequence: Synthetic oligonucleotide
agtgggaggcgacccgtgtggc

SEQ ID NO: 33242 - DNA, 21 bp, Artificial Sequence
  Description of Artificial Sequence: Synthetic oligonucleotide
gtgggaggcgacccgtgtggc

SEQ ID NO: 33243 - DNA, 21 bp, Artificial Sequence
  Description of Artificial Sequence: Synthetic oligonucleotide
tgggaggcgacccgtgtggcg

SEQ ID NO: 33244 - DNA, 20 bp, Artificial Sequence
  Description of Artificial Sequence: Synthetic oligonucleotide
gggaggcgacccgtgtggcg

SEQ ID NO: 33245 - DNA, 21 bp, Artificial Sequence
  Description of Artificial Sequence: Synthetic oligonucleotide
ggaggcgacccgtgtggcgga

SEQ ID NO: 33246 - DNA, 21 bp, Artificial Sequence
  Description of Artificial Sequence: Synthetic oligonucleotide
gaggcgacccgtgtggcggag

SEQ ID NO: 33247 - DNA, 22 bp, Artificial Sequence
  Description of Artificial Sequence: Synthetic oligonucleotide
aggcgacccgtgtggcggagca

SEQ ID NO: 33248 - DNA, 21 bp, Artificial Sequence
  Description of Artificial Sequence: Synthetic oligonucleotide
ggcgacccgtgtggcggagca

SEQ ID NO: 33249 - DNA, 21 bp, Artificial Sequence
  Description of Artificial Sequence: Synthetic oligonucleotide
gcgacccgtgtggcggagcag

SEQ ID NO: 33250 - DNA, 22 bp, Artificial Sequence
  Description of Artificial Sequence: Synthetic oligonucleotide
cgacccgtgtggcggagcagga

SEQ ID NO: 33251 - DNA, 23 bp, Artificial Sequence
  Description of Artificial Sequence: Synthetic oligonucleotide
gacccgtgtggcggagcaggaca

SEQ ID NO: 33252 - DNA, 24 bp, Artificial Sequence
  Description of Artificial Sequence: Synthetic oligonucleotide
acccgtgtggcggagcaggacaga

SEQ ID NO: 33253 - DNA, 24 bp, Artificial Sequence
  Description of Artificial Sequence: Synthetic oligonucleotide
tgagctcctggaccgcggcggaaa

SEQ ID NO: 33254 - DNA, 23 bp, Artificial Sequence
  Description of Artificial Sequence: Synthetic oligonucleotide
gagctcctggaccgcggcggaaa

SEQ ID NO: 33255 - DNA, 23 bp, Artificial Sequence
  Description of Artificial Sequence: Synthetic oligonucleotide
agctcctggaccgcggcggaaac

SEQ ID NO: 33256 - DNA, 22 bp, Artificial Sequence
  Description of Artificial Sequence: Synthetic oligonucleotide
gctcctggaccgcggcggaaac

SEQ ID NO: 33257 - DNA, 22 bp, Artificial Sequence
  Description of Artificial Sequence: Synthetic oligonucleotide
ctcctggaccgcggcggaaacc

SEQ ID NO: 33258 - DNA, 22 bp, Artificial Sequence
  Description of Artificial Sequence: Synthetic oligonucleotide
tcctggaccgcggcggaaaccg

SEQ ID NO: 33259 - DNA, 21 bp, Artificial Sequence
  Description of Artificial Sequence: Synthetic oligonucleotide
cctggaccgcggcggaaaccg

SEQ ID NO: 33260 - DNA, 21 bp, Artificial Sequence
  Description of Artificial Sequence: Synthetic oligonucleotide
ctggaccgcggcggaaaccgc

SEQ ID NO: 33261 - DNA, 21 bp, Artificial Sequence
  Description of Artificial Sequence: Synthetic oligonucleotide
tggaccgcggcggaaaccgcg

SEQ ID NO: 33262 - DNA, 20 bp, Artificial Sequence
  Description of Artificial Sequence: Synthetic oligonucleotide
ggaccgcggcggaaaccgcg

SEQ ID NO: 33263 - DNA, 20 bp, Artificial Sequence
  Description of Artificial Sequence: Synthetic oligonucleotide
gaccgcggcggaaaccgcgg

SEQ ID NO: 33264 - DNA, 21 bp, Artificial Sequence
  Description of Artificial Sequence: Synthetic oligonucleotide
accgcggcggaaaccgcggct

SEQ ID NO: 33265 - DNA, 20 bp, Artificial Sequence
  Description of Artificial Sequence: Synthetic oligonucleotide
ccgcggcggaaaccgcggct

SEQ ID NO: 33266 - DNA, 21 bp, Artificial Sequence
  Description of Artificial Sequence: Synthetic oligonucleotide
cgcggcggaaaccgcggctca

SEQ ID NO: 33267 - DNA, 23 bp, Artificial Sequence
  Description of Artificial Sequence: Synthetic oligonucleotide
gcggcggaaaccgcggctcagat

SEQ ID NO: 33268 - DNA, 24 bp, Artificial Sequence
  Description of Artificial Sequence: Synthetic oligonucleotide
cggcggaaaccgcggctcagatca

SEQ ID NO: 33269 - DNA, 24 bp, Artificial Sequence
  Description of Artificial Sequence: Synthetic oligonucleotide
ggcggaaaccgcggctcagatcac

SEQ ID NO: 33270 - DNA, 24 bp, Artificial Sequence
  Description of Artificial Sequence: Synthetic oligonucleotide
gcggaaaccgcggctcagatcacc

SEQ ID NO: 33271 - DNA, 25 bp, Artificial Sequence
  Description of Artificial Sequence: Synthetic oligonucleotide
cggaaaccgcggctcagatcaccca

SEQ ID NO: 33272 - DNA, 25 bp, Artificial Sequence
  Description of Artificial Sequence: Synthetic oligonucleotide
ggaaaccgcggctcagatcacccag

SEQ ID NO: 33273 - DNA, 25 bp, Artificial Sequence
  Description of Artificial Sequence: Synthetic oligonucleotide
gaaaccgcggctcagatcacccagc

SEQ ID NO: 33274 - DNA, 25 bp, Artificial Sequence
  Description of Artificial Sequence: Synthetic oligonucleotide
aaaccgcggctcagatcacccagcg

SEQ ID NO: 33275 - DNA, 24 bp, Artificial Sequence
  Description of Artificial Sequence: Synthetic oligonucleotide
aaccgcggctcagatcacccagcg

SEQ ID NO: 33276 - DNA, 23 bp, Artificial Sequence
  Description of Artificial Sequence: Synthetic oligonucleotide
gatgtctggctgcgacgtggggg

SEQ ID NO: 33277 - DNA, 23 bp, Artificial Sequence
  Description of Artificial Sequence: Synthetic oligonucleotide
atgtctggctgcgacgtgggggc

SEQ ID NO: 33278 - DNA, 22 bp, Artificial Sequence
  Description of Artificial Sequence: Synthetic oligonucleotide
tgtctggctgcgacgtgggggc

SEQ ID NO: 33279 - DNA, 21 bp, Artificial Sequence
  Description of Artificial Sequence: Synthetic oligonucleotide
gtctggctgcgacgtgggggc

SEQ ID NO: 33280 - DNA, 21 bp, Artificial Sequence
  Description of Artificial Sequence: Synthetic oligonucleotide
tctggctgcgacgtgggggcg

SEQ ID NO: 33281 - DNA, 20 bp, Artificial Sequence
  Description of Artificial Sequence: Synthetic oligonucleotide
ctggctgcgacgtgggggcg

SEQ ID NO: 33282 - DNA, 21 bp, Artificial Sequence
  Description of Artificial Sequence: Synthetic oligonucleotide
tggctgcgacgtgggggcgga

SEQ ID NO: 33283 - DNA, 20 bp, Artificial Sequence
  Description of Artificial Sequence: Synthetic oligonucleotide
ggctgcgacgtgggggcgga

SEQ ID NO: 33284 - DNA, 20 bp, Artificial Sequence
  Description of Artificial Sequence: Synthetic oligonucleotide
gctgcgacgtgggggcggac

SEQ ID NO: 33285 - DNA, 20 bp, Artificial Sequence
  Description of Artificial Sequence: Synthetic oligonucleotide
ctgcgacgtgggggcggacg

SEQ ID NO: 33286 - DNA, 20 bp, Artificial Sequence
  Description of Artificial Sequence: Synthetic oligonucleotide
tgcgacgtgggggcggacgg

SEQ ID NO: 33287 - DNA, 20 bp, Artificial Sequence
  Description of Artificial Sequence: Synthetic oligonucleotide
gcgacgtgggggcggacggt

SEQ ID NO: 33288 - DNA, 20 bp, Artificial Sequence
  Description of Artificial Sequence: Synthetic oligonucleotide
cgacgtgggggcggacgggt

SEQ ID NO: 33289 - DNA, 20 bp, Artificial Sequence
  Description of Artificial Sequence: Synthetic oligonucleotide
gacgtgggggcggacgggct

SEQ ID NO: 33290 - DNA, 20 bp, Artificial Sequence
  Description of Artificial Sequence: Synthetic oligonucleotide
acgtgggggcggacgggcgt

SEQ ID NO: 33291 - DNA, 20 bp, Artificial Sequence
  Description of Artificial Sequence: Synthetic oligonucleotide
cgtgggggcggacgggcgtt

SEQ ID NO: 33292 - DNA, 20 bp, Artificial Sequence
  Description of Artificial Sequence: Synthetic oligonucleotide
gtgggggcggacgggcgctt

SEQ ID NO: 33293 - DNA, 20 bp, Artificial Sequence
  Description of Artificial Sequence: Synthetic oligonucleotide
tgggggcggacgggcgcctt

SEQ ID NO: 33294 - DNA, 20 bp, Artificial Sequence
  Description of Artificial Sequence: Synthetic oligonucleotide
gggggcggacgggcgccttt

SEQ ID NO: 33295 - DNA, 20 bp, Artificial Sequence
  Description of Artificial Sequence: Synthetic oligonucleotide
ggggcggacgggcgcctctt

SEQ ID NO: 33296 - DNA, 20 bp, Artificial Sequence
  Description of Artificial Sequence: Synthetic oligonucleotide
gggcggacgggcgcctcctt

SEQ ID NO: 33297 - DNA, 20 bp, Artificial Sequence
  Description of Artificial Sequence: Synthetic oligonucleotide
ggcggacgggcgcctcctct

SEQ ID NO: 33298 - DNA, 20 bp, Artificial Sequence
  Description of Artificial Sequence: Synthetic oligonucleotide
gcggacgggcgcctcctcct

SEQ ID NO: 33299 - DNA, 34 bp, Artificial Sequence
  Description of Artificial Sequence: Synthetic oligonucleotide
atcttcaagaccaacacacagacttaccgagagg

SEQ ID NO: 33300 - DNA, 33 bp, Artificial Sequence
  Description of Artificial Sequence: Synthetic oligonucleotide
tcttcaagaccaacacacagacttaccgagagg

SEQ ID NO: 33301 - DNA, 32 bp, Artificial Sequence
  Description of Artificial Sequence: Synthetic oligonucleotide
cttcaagaccaacacacagacttaccgagagg

SEQ ID NO: 33302 - DNA, 33 bp, Artificial Sequence
  Description of Artificial Sequence: Synthetic oligonucleotide
ttcaagaccaacacacagacttaccgagaggac

SEQ ID NO: 33303 - DNA, 32 bp, Artificial Sequence
  Description of Artificial Sequence: Synthetic oligonucleotide
tcaagaccaacacacagacttaccgagaggac

SEQ ID NO: 33304 - DNA, 25 bp, Artificial Sequence
  Description of Artificial Sequence: Synthetic oligonucleotide
ctgaagcccctcaccctgagatggg

SEQ ID NO: 33305 - DNA, 24 bp, Artificial Sequence
  Description of Artificial Sequence: Synthetic oligonucleotide
cctcctccgcgggcacaaccagtt

SEQ ID NO: 33306 - DNA, 24 bp, Artificial Sequence
  Description of Artificial Sequence: Synthetic oligonucleotide
ctcctccgcgggcacaaccagttc

SEQ ID NO: 33307 - DNA, 24 bp, Artificial Sequence
  Description of Artificial Sequence: Synthetic oligonucleotide
tcctccgcgggcacaaccagttcg

SEQ ID NO: 33308 - DNA, 23 bp, Artificial Sequence
  Description of Artificial Sequence: Synthetic oligonucleotide
cctccgcgggcacaaccagttcg

SEQ ID NO: 33309 - DNA, 23 bp, Artificial Sequence
  Description of Artificial Sequence: Synthetic oligonucleotide
ctccgcgggcacaaccagttcgc

SEQ ID NO: 33310 - DNA, 25 bp, Artificial Sequence
  Description of Artificial Sequence: Synthetic oligonucleotide
tccgcgggcacaaccagttcgccta

SEQ ID NO: 33311 - DNA, 24 bp, Artificial Sequence
  Description of Artificial Sequence: Synthetic oligonucleotide
ccgcgggcacaaccagttcgccta

SEQ ID NO: 33312 - DNA, 24 bp, Artificial Sequence
  Description of Artificial Sequence: Synthetic oligonucleotide
cgcgggcacaaccagttcgcctac

SEQ ID NO: 33313 - DNA, 25 bp, Artificial Sequence
  Description of Artificial Sequence: Synthetic oligonucleotide
gcgggcacaaccagttcgcctacga

SEQ ID NO: 33314 - DNA, 25 bp, Artificial Sequence
  Description of Artificial Sequence: Synthetic oligonucleotide
cgggcacaaccagttcgcctacgac

SEQ ID NO: 33315 - DNA, 25 bp, Artificial Sequence
  Description of Artificial Sequence: Synthetic oligonucleotide
gggcacaaccagttcgcctacgacg

SEQ ID NO: 33316 - DNA, 25 bp, Artificial Sequence
  Description of Artificial Sequence: Synthetic oligonucleotide
ggcacaaccagttcgcctacgacgg

SEQ ID NO: 33317 - DNA, 27 bp, Artificial Sequence
  Description of Artificial Sequence: Synthetic oligonucleotide
gcacaaccagttcgcctacgacggcaa

SEQ ID NO: 33318 - DNA, 27 bp, Artificial Sequence
  Description of Artificial Sequence: Synthetic oligonucleotide
cacaaccagttcgcctacgacggcaag

SEQ ID NO: 33319 - DNA, 27 bp, Artificial Sequence
  Description of Artificial Sequence: Synthetic oligonucleotide
acaaccagttcgcctacgacggcaagg

SEQ ID NO: 33320 - DNA, 27 bp, Artificial Sequence
  Description of Artificial Sequence: Synthetic oligonucleotide
caaccagttcgcctacgacggcaagga

SEQ ID NO: 33321 - DNA, 32 bp, Artificial Sequence
  Description of Artificial Sequence: Synthetic oligonucleotide
gctcacactccatgaggtatttctacacctcc

SEQ ID NO: 33322 - DNA, 32 bp, Artificial Sequence
  Description of Artificial Sequence: Synthetic oligonucleotide
ctcacactccatgaggtatttctacacctccg

SEQ ID NO: 33323 - DNA, 33 bp, Artificial Sequence
  Description of Artificial Sequence: Synthetic oligonucleotide
tcacactccatgaggtatttctacacctccgtg

SEQ ID NO: 33324 - DNA, 32 bp, Artificial Sequence
  Description of Artificial Sequence: Synthetic oligonucleotide
cacactccatgaggtatttctacacctccgtg

SEQ ID NO: 33325 - DNA, 33 bp, Artificial Sequence
  Description of Artificial Sequence: Synthetic oligonucleotide
acactccatgaggtatttctacacctccgtgtc

SEQ ID NO: 33326 - DNA, 27 bp, Artificial Sequence
  Description of Artificial Sequence: Synthetic oligonucleotide
ctgaacgaggacctgagctcctggaca

SEQ ID NO: 33327 - DNA, 27 bp, Artificial Sequence
  Description of Artificial Sequence: Synthetic oligonucleotide
tgaacgaggacctgagctcctggacag

SEQ ID NO: 33328 - DNA, 26 bp, Artificial Sequence
  Description of Artificial Sequence: Synthetic oligonucleotide
gaacgaggacctgagctcctggacag

SEQ ID NO: 33329 - DNA, 26 bp, Artificial Sequence
  Description of Artificial Sequence: Synthetic oligonucleotide
aacgaggacctgagctcctggacagc

SEQ ID NO: 33330 - DNA, 25 bp, Artificial Sequence
  Description of Artificial Sequence: Synthetic oligonucleotide
acgaggacctgagctcctggacagc

SEQ ID NO: 33331 - DNA, 24 bp, Artificial Sequence
  Description of Artificial Sequence: Synthetic oligonucleotide
cgaggacctgagctcctggacagc

SEQ ID NO: 33332 - DNA, 24 bp, Artificial Sequence
  Description of Artificial Sequence: Synthetic oligonucleotide
gaggacctgagctcctggacagcg

SEQ ID NO: 33333 - DNA, 24 bp, Artificial Sequence
  Description of Artificial Sequence: Synthetic oligonucleotide
aggacctgagctcctggacagcgg

SEQ ID NO: 33334 - DNA, 23 bp, Artificial Sequence
  Description of Artificial Sequence: Synthetic oligonucleotide
ggacctgagctcctggacagcgg

SEQ ID NO: 33335 - DNA, 23 bp, Artificial Sequence
  Description of Artificial Sequence: Synthetic oligonucleotide
gacctgagctcctggacagcggc

SEQ ID NO: 33336 - DNA, 23 bp, Artificial Sequence
  Description of Artificial Sequence: Synthetic oligonucleotide
acctgagctcctggacagcggcg

SEQ ID NO: 33337 - DNA, 22 bp, Artificial Sequence
  Description of Artificial Sequence: Synthetic oligonucleotide
cctgagctcctggacagcggcg

SEQ ID NO: 33338 - DNA, 23 bp, Artificial Sequence
  Description of Artificial Sequence: Synthetic oligonucleotide
ctgagctcctggacagcggcgga

SEQ ID NO: 33339 - DNA, 24 bp, Artificial Sequence
  Description of Artificial Sequence: Synthetic oligonucleotide
tgagctcctggacagcggcggaca

SEQ ID NO: 33340 - DNA, 23 bp, Artificial Sequence
  Description of Artificial Sequence: Synthetic oligonucleotide
gagctcctggacagcggcggaca

SEQ ID NO: 33341 - DNA, 23 bp, Artificial Sequence
  Description of Artificial Sequence: Synthetic oligonucleotide
agctcctggacagcggcggacac

SEQ ID NO: 33342 - DNA, 22 bp, Artificial Sequence
  Description of Artificial Sequence: Synthetic oligonucleotide
gctcctggacagcggcggacac

SEQ ID NO: 33343 - DNA, 22 bp, Artificial Sequence
  Description of Artificial Sequence: Synthetic oligonucleotide
ctcctggacagcggcggacacc

SEQ ID NO: 33344 - DNA, 22 bp, Artificial Sequence
  Description of Artificial Sequence: Synthetic oligonucleotide
tcctggacagcggcggacaccg

SEQ ID NO: 33345 - DNA, 21 bp, Artificial Sequence
  Description of Artificial Sequence: Synthetic oligonucleotide
cctggacagcggcggacaccg

SEQ ID NO: 33346 - DNA, 21 bp, Artificial Sequence
  Description of Artificial Sequence: Synthetic oligonucleotide
ctggacagcggcggacaccgc

SEQ ID NO: 33347 - DNA, 21 bp, Artificial Sequence
  Description of Artificial Sequence: Synthetic oligonucleotide
tggacagcggcggacaccgcg

SEQ ID NO: 33348 - DNA, 20 bp, Artificial Sequence
  Description of Artificial Sequence: Synthetic oligonucleotide
ggacagcggcggacaccgcg

SEQ ID NO: 33349 - DNA, 20 bp, Artificial Sequence
  Description of Artificial Sequence: Synthetic oligonucleotide
gacagcggcggacaccgcgg

SEQ ID NO: 33350 - DNA, 21 bp, Artificial Sequence
  Description of Artificial Sequence: Synthetic oligonucleotide
acagcggcggacaccgcggct

SEQ ID NO: 33351 - DNA, 20 bp, Artificial Sequence
  Description of Artificial Sequence: Synthetic oligonucleotide
cagcggcggacaccgcggct

SEQ ID NO: 33352 - DNA, 21 bp, Artificial Sequence
  Description of Artificial Sequence: Synthetic oligonucleotide
agcggcggacaccgcggctca

SEQ ID NO: 33353 - DNA, 24 bp, Artificial Sequence
  Description of Artificial Sequence: Synthetic oligonucleotide
gaggggccggaatattgggaccgg

SEQ ID NO: 33354 - DNA, 25 bp, Artificial Sequence
  Description of Artificial Sequence: Synthetic oligonucleotide
aggggccggaatattgggaccggga

SEQ ID NO: 33355 - DNA, 24 bp, Artificial Sequence
  Description of Artificial Sequence: Synthetic oligonucleotide
ggggccggaatattgggaccggga

SEQ ID NO: 33356 - DNA, 25 bp, Artificial Sequence
  Description of Artificial Sequence: Synthetic oligonucleotide
gggccggaatattgggaccgggaga

SEQ ID NO: 33357 - DNA, 26 bp, Artificial Sequence
  Description of Artificial Sequence: Synthetic oligonucleotide
ggccggaatattgggaccgggagaca

SEQ ID NO: 33358 - DNA, 27 bp, Artificial Sequence
  Description of Artificial Sequence: Synthetic oligonucleotide
gccggaatattgggaccgggagacaca

SEQ ID NO: 33359 - DNA, 27 bp, Artificial Sequence
  Description of Artificial Sequence: Synthetic oligonucleotide
ccggaatattgggaccgggagacacag

SEQ ID NO: 33360 - DNA, 29 bp, Artificial Sequence
  Description of Artificial Sequence: Synthetic oligonucleotide
cggaatattgggaccgggagacacagatc

SEQ ID NO: 33361 - DNA, 30 bp, Artificial Sequence
  Description of Artificial Sequence: Synthetic oligonucleotide
ggaatattgggaccgggagacacagatctc

SEQ ID NO: 33362 - DNA, 30 bp, Artificial Sequence
  Description of Artificial Sequence: Synthetic oligonucleotide
gaatattgggaccgggagacacagatctcc

SEQ ID NO: 33363 - DNA, 32 bp, Artificial Sequence
  Description of Artificial Sequence: Synthetic oligonucleotide
aatattgggaccgggagacacagatctccaag

SEQ ID NO: 33364 - DNA, 31 bp, Artificial Sequence
  Description of Artificial Sequence: Synthetic oligonucleotide
atattgggaccgggagacacagatctccaag

SEQ ID NO: 33365 - DNA, 26 bp, Artificial Sequence
  Description of Artificial Sequence: Synthetic oligonucleotide
acagactgaccgagagagcctgcgca

SEQ ID NO: 33366 - DNA, 25 bp, Artificial Sequence
  Description of Artificial Sequence: Synthetic oligonucleotide
cagactgaccgagagagcctgcgca

SEQ ID NO: 33367 - DNA, 25 bp, Artificial Sequence
  Description of Artificial Sequence: Synthetic oligonucleotide
agactgaccgagagagcctgcgcac

SEQ ID NO: 33368 - DNA, 24 bp, Artificial Sequence
  Description of Artificial Sequence: Synthetic oligonucleotide
gactgaccgagagagcctgcgcac

SEQ ID NO: 33369 - DNA, 24 bp, Artificial Sequence
  Description of Artificial Sequence: Synthetic oligonucleotide
actgaccgagagagcctgcgcacc

SEQ ID NO: 33370 - DNA, 23 bp, Artificial Sequence
  Description of Artificial Sequence: Synthetic oligonucleotide
ctgaccgagagagcctgcgcacc

SEQ ID NO: 33371 - DNA, 23 bp, Artificial Sequence
  Description of Artificial Sequence: Synthetic oligonucleotide
tgaccgagagagcctgcgcaccg

SEQ ID NO: 33372 - DNA, 22 bp, Artificial Sequence
  Description of Artificial Sequence: Synthetic oligonucleotide
gaccgagagagcctgcgcaccg

SEQ ID NO: 33373 - DNA, 24 bp, Artificial Sequence
  Description of Artificial Sequence: Synthetic oligonucleotide
catggatagagcaggaggggccgg

SEQ ID NO: 33374 - DNA, 27 bp, Artificial Sequence
  Description of Artificial Sequence: Synthetic oligonucleotide
atggatagagcaggaggggccgggata

SEQ ID NO: 33375 - DNA, 27 bp, Artificial Sequence
  Description of Artificial Sequence: Synthetic oligonucleotide
tggatagagcaggaggggccgggatat

SEQ ID NO: 33376 - DNA, 27 bp, Artificial Sequence
  Description of Artificial Sequence: Synthetic oligonucleotide
ggatagagcaggaggggccgggatatt

SEQ ID NO: 33377 - DNA, 27 bp, Artificial Sequence
  Description of Artificial Sequence: Synthetic oligonucleotide
gatagagcaggaggggccgggatattg

SEQ ID NO: 33378 - DNA, 27 bp, Artificial Sequence
  Description of Artificial Sequence: Synthetic oligonucleotide
atagagcaggaggggccgggatattgg

SEQ ID NO: 33379 - DNA, 26 bp, Artificial Sequence
  Description of Artificial Sequence: Synthetic oligonucleotide
tagagcaggaggggccgggatattgg

SEQ ID NO: 33380 - DNA, 25 bp, Artificial Sequence
  Description of Artificial Sequence: Synthetic oligonucleotide
agagcaggaggggccgggatattgg

SEQ ID NO: 33381 - DNA, 24 bp, Artificial Sequence
  Description of Artificial Sequence: Synthetic oligonucleotide
gagcaggaggggccgggatattgg

SEQ ID NO: 33382 - DNA, 25 bp, Artificial Sequence
  Description of Artificial Sequence: Synthetic oligonucleotide
agcaggaggggccgggatattggga

SEQ ID NO: 33383 - DNA, 24 bp, Artificial Sequence
  Description of Artificial Sequence: Synthetic oligonucleotide
gcaggaggggccgggatattggga

SEQ ID NO: 33384 - DNA, 24 bp, Artificial Sequence
  Description of Artificial Sequence: Synthetic oligonucleotide
caggaggggccgggatattgggac

SEQ ID NO: 33385 - DNA, 24 bp, Artificial Sequence
  Description of Artificial Sequence: Synthetic oligonucleotide
aggaggggccgggatattgggacc

SEQ ID NO: 33386 - DNA, 23 bp, Artificial Sequence
  Description of Artificial Sequence: Synthetic oligonucleotide
ggaggggccgggatattgggacc

SEQ ID NO: 33387 - DNA, 23 bp, Artificial Sequence
  Description of Artificial Sequence: Synthetic oligonucleotide
gaggggccgggatattgggaccg

SEQ ID NO: 33388 - DNA, 25 bp, Artificial Sequence
  Description of Artificial Sequence: Synthetic oligonucleotide
aggggccgggatattgggaccggaa

SEQ ID NO: 33389 - DNA, 24 bp, Artificial Sequence
  Description of Artificial Sequence: Synthetic oligonucleotide
ggggccgggatattgggaccggaa

SEQ ID NO: 33390 - DNA, 25 bp, Artificial Sequence
  Description of Artificial Sequence: Synthetic oligonucleotide
gggccgggatattgggaccggaaca

SEQ ID NO: 33391 - DNA, 26 bp, Artificial Sequence
  Description of Artificial Sequence: Synthetic oligonucleotide
ggccgggatattgggaccggaacaca

SEQ ID NO: 33392 - DNA, 27 bp, Artificial Sequence
  Description of Artificial Sequence: Synthetic oligonucleotide
gccgggatattgggaccggaacacaca

SEQ ID NO: 33393 - DNA, 27 bp, Artificial Sequence
  Description of Artificial Sequence: Synthetic oligonucleotide
ccgggatattgggaccggaacacacag

SEQ ID NO: 33394 - DNA, 29 bp, Artificial Sequence
  Description of Artificial Sequence: Synthetic oligonucleotide
cgggatattgggaccggaacacacagatc

SEQ ID NO: 33395 - DNA, 31 bp, Artificial Sequence
  Description of Artificial Sequence: Synthetic oligonucleotide
gggatattgggaccggaacacacagatcttc

SEQ ID NO: 33396 - DNA, 33 bp, Artificial Sequence
  Description of Artificial Sequence: Synthetic oligonucleotide
ggatattgggaccggaacacacagatcttcaag

SEQ ID NO: 33397 - DNA, 34 bp, Artificial Sequence
  Description of Artificial Sequence: Synthetic oligonucleotide
gatattgggaccggaacacacagatcttcaagac

SEQ ID NO: 33398 - DNA, 34 bp, Artificial Sequence
  Description of Artificial Sequence: Synthetic oligonucleotide
atattgggaccggaacacacagatcttcaagacc

SEQ ID NO: 33399 - DNA, 27 bp, Artificial Sequence
  Description of Artificial Sequence: Synthetic oligonucleotide
gcagctgagaacctacctggagggcat

SEQ ID NO: 33400 - DNA, 27 bp, Artificial Sequence
  Description of Artificial Sequence: Synthetic oligonucleotide
cagctgagaacctacctggagggcatg

SEQ ID NO: 33401 - DNA, 28 bp, Artificial Sequence
  Description of Artificial Sequence: Synthetic oligonucleotide
agctgagaacctacctggagggcatgtg

SEQ ID NO: 33402 - DNA, 27 bp, Artificial Sequence
  Description of Artificial Sequence: Synthetic oligonucleotide
gctgagaacctacctggagggcatgtg

SEQ ID NO: 33403 - DNA, 27 bp, Artificial Sequence
  Description of Artificial Sequence: Synthetic oligonucleotide
ctgagaacctacctggagggcatgtgc

SEQ ID NO: 33404 - DNA, 27 bp, Artificial Sequence
  Description of Artificial Sequence: Synthetic oligonucleotide
tgagaacctacctggagggcatgtgcg

SEQ ID NO: 33405 - DNA, 27 bp, Artificial Sequence
  Description of Artificial Sequence: Synthetic oligonucleotide
gagaacctacctggagggcatgtgcgt

SEQ ID NO: 33406 - DNA, 27 bp, Artificial Sequence
  Description of Artificial Sequence: Synthetic oligonucleotide
agaacctacctggagggcatgtgcgtg

SEQ ID NO: 33407 - DNA, 26 bp, Artificial Sequence
  Description of Artificial Sequence: Synthetic oligonucleotide
gaacctacctggagggcatgtgcgtg

SEQ ID NO: 33408 - DNA, 27 bp, Artificial Sequence
  Description of Artificial Sequence: Synthetic oligonucleotide
aacctacctggagggcatgtgcgtgga

SEQ ID NO: 33409 - DNA, 26 bp, Artificial Sequence
  Description of Artificial Sequence: Synthetic oligonucleotide
acctacctggagggcatgtgcgtgga

SEQ ID NO: 33410 - DNA, 22 bp, Artificial Sequence
  Description of Artificial Sequence: Synthetic oligonucleotide
agctcctggaccgcggcggaga

SEQ ID NO: 33411 - DNA, 21 bp, Artificial Sequence
  Description of Artificial Sequence: Synthetic oligonucleotide
gctcctggaccgcggcggaga

SEQ ID NO: 33412 - DNA, 21 bp, Artificial Sequence
  Description of Artificial Sequence: Synthetic oligonucleotide
ctcctggaccgcggcggagac

SEQ ID NO: 33413 - DNA, 21 bp, Artificial Sequence
  Description of Artificial Sequence: Synthetic oligonucleotide
tcctggaccgcggcggagacc

SEQ ID NO: 33414 - DNA, 20 bp, Artificial Sequence
  Description of Artificial Sequence: Synthetic oligonucleotide
cctggaccgcggcggagacc

SEQ ID NO: 33415 - DNA, 20 bp, Artificial Sequence
  Description of Artificial Sequence: Synthetic oligonucleotide
ctggaccgcggcggagaccg

SEQ ID NO: 33416 - DNA, 20 bp, Artificial Sequence
  Description of Artificial Sequence: Synthetic oligonucleotide
tggaccgcggcggagaccgc

SEQ ID NO: 33417 - DNA, 20 bp, Artificial Sequence
  Description of Artificial Sequence: Synthetic oligonucleotide
ggaccgcggcggagaccgct

SEQ ID NO: 33418 - DNA, 20 bp, Artificial Sequence
  Description of Artificial Sequence: Synthetic oligonucleotide
gaccgcggcggagaccgcgt

SEQ ID NO: 33419 - DNA, 20 bp, Artificial Sequence
  Description of Artificial Sequence: Synthetic oligonucleotide
accgcggcggagaccgcggt

SEQ ID NO: 33420 - DNA, 20 bp, Artificial Sequence
  Description of Artificial Sequence: Synthetic oligonucleotide
ccgcggcggagaccgcggtt

SEQ ID NO: 33421 - DNA, 20 bp, Artificial Sequence
  Description of Artificial Sequence: Synthetic oligonucleotide
cgcggcggagaccgcggctt

SEQ ID NO: 33422 - DNA, 20 bp, Artificial Sequence
  Description of Artificial Sequence: Synthetic oligonucleotide
gcggcggagaccgcggctca

SEQ ID NO: 33423 - DNA, 22 bp, Artificial Sequence
  Description of Artificial Sequence: Synthetic oligonucleotide
cggcggagaccgcggctcagat

SEQ ID NO: 33424 - DNA, 23 bp, Artificial Sequence
  Description of Artificial Sequence: Synthetic oligonucleotide
ggcggagaccgcggctcagatca

SEQ ID NO: 33425 - DNA, 23 bp, Artificial Sequence
  Description of Artificial Sequence: Synthetic oligonucleotide
gcggagaccgcggctcagatcac

SEQ ID NO: 33426 - DNA, 23 bp, Artificial Sequence
  Description of Artificial Sequence: Synthetic oligonucleotide
cggagaccgcggctcagatcacc

SEQ ID NO: 33427 - DNA, 24 bp, Artificial Sequence
  Description of Artificial Sequence: Synthetic oligonucleotide
ggagaccgcggctcagatcaccca

SEQ ID NO: 33428 - DNA, 24 bp, Artificial Sequence
  Description of Artificial Sequence: Synthetic oligonucleotide
gagaccgcggctcagatcacccag

SEQ ID NO: 33429 - DNA, 24 bp, Artificial Sequence
  Description of Artificial Sequence: Synthetic oligonucleotide
agaccgcggctcagatcacccagc

SEQ ID NO: 33430 - DNA, 23 bp, Artificial Sequence
  Description of Artificial Sequence: Synthetic oligonucleotide
gaccgcggctcagatcacccagc

SEQ ID NO: 33431 - DNA, 26 bp, Artificial Sequence
  Description of Artificial Sequence: Synthetic oligonucleotide
ggtggagcaggaggggccggaatatt

SEQ ID NO: 33432 - DNA, 26 bp, Artificial Sequence
  Description of Artificial Sequence: Synthetic oligonucleotide
gtggagcaggaggggccggaatattg

SEQ ID NO: 33433 - DNA, 26 bp, Artificial Sequence
  Description of Artificial Sequence: Synthetic oligonucleotide
tggagcaggaggggccggaatattgg

SEQ ID NO: 33434 - DNA, 25 bp, Artificial Sequence
  Description of Artificial Sequence: Synthetic oligonucleotide
ggagcaggaggggccggaatattgg

SEQ ID NO: 33435 - DNA, 24 bp, Artificial Sequence
  Description of Artificial Sequence: Synthetic oligonucleotide
gacagcgacgccacgagtccgaga

SEQ ID NO: 33436 - DNA, 25 bp, Artificial Sequence
  Description of Artificial Sequence: Synthetic oligonucleotide
acagcgacgccacgagtccgagaga

SEQ ID NO: 33437 - DNA, 24 bp, Artificial Sequence
  Description of Artificial Sequence: Synthetic oligonucleotide
cagcgacgccacgagtccgagaga

SEQ ID NO: 33438 - DNA, 24 bp, Artificial Sequence
  Description of Artificial Sequence: Synthetic oligonucleotide
agcgacgccacgagtccgagagag

SEQ ID NO: 33439 - DNA, 23 bp, Artificial Sequence
  Description of Artificial Sequence: Synthetic oligonucleotide
gcgacgccacgagtccgagagag

SEQ ID NO: 33440 - DNA, 24 bp, Artificial Sequence
  Description of Artificial Sequence: Synthetic oligonucleotide
cgacgccacgagtccgagagagga

SEQ ID NO: 33441 - DNA, 24 bp, Artificial Sequence
  Description of Artificial Sequence: Synthetic oligonucleotide
gacgccacgagtccgagagaggag

SEQ ID NO: 33442 - DNA, 24 bp, Artificial Sequence
  Description of Artificial Sequence: Synthetic oligonucleotide
acgccacgagtccgagagaggagc

SEQ ID NO: 33443 - DNA, 23 bp, Artificial Sequence
  Description of Artificial Sequence: Synthetic oligonucleotide
cgccacgagtccgagagaggagc

SEQ ID NO: 33444 - DNA, 23 bp, Artificial Sequence
  Description of Artificial Sequence: Synthetic oligonucleotide
gccacgagtccgagagaggagcc

SEQ ID NO: 33445 - DNA, 23 bp, Artificial Sequence
  Description of Artificial Sequence: Synthetic oligonucleotide
ccacgagtccgagagaggagccg

SEQ ID NO: 33446 - DNA, 23 bp, Artificial Sequence
  Description of Artificial Sequence: Synthetic oligonucleotide
cacgagtccgagagaggagccgc

SEQ ID NO: 33447 - DNA, 23 bp, Artificial Sequence
  Description of Artificial Sequence: Synthetic oligonucleotide
acgagtccgagagaggagccgcg

SEQ ID NO: 33448 - DNA, 35 bp, Artificial Sequence
  Description of Artificial Sequence: Synthetic oligonucleotide
acagatctgcaagaccaacacacagacttacctag

SEQ ID NO: 33449 - DNA, 34 bp, Artificial Sequence
  Description of Artificial Sequence: Synthetic oligonucleotide
cagatctgcaagaccaacacacagacttacctag

SEQ ID NO: 33450 - DNA, 35 bp, Artificial Sequence
  Description of Artificial Sequence: Synthetic oligonucleotide
agatctgcaagaccaacacacagacttacctagag

SEQ ID NO: 33451 - DNA, 34 bp, Artificial Sequence
  Description of Artificial Sequence: Synthetic oligonucleotide
gatctgcaagaccaacacacagacttacctagag

SEQ ID NO: 33452 - DNA, 36 bp, Artificial Sequence
  Description of Artificial Sequence: Synthetic oligonucleotide
atctgcaagaccaacacacagacttacctagagaac

SEQ ID NO: 33453 - DNA, 35 bp, Artificial Sequence
  Description of Artificial Sequence: Synthetic oligonucleotide
tctgcaagaccaacacacagacttacctagagaac

SEQ ID NO: 33454 - DNA, 34 bp, Artificial Sequence
  Description of Artificial Sequence: Synthetic oligonucleotide
ctgcaagaccaacacacagacttacctagagaac

SEQ ID NO: 33455 - DNA, 34 bp, Artificial Sequence
  Description of Artificial Sequence: Synthetic oligonucleotide
tgcaagaccaacacacagacttacctagagaacc

SEQ ID NO: 33456 - DNA, 33 bp, Artificial Sequence
  Description of Artificial Sequence: Synthetic oligonucleotide
gcaagaccaacacacagacttacctagagaacc

SEQ ID NO: 33457 - DNA, 34 bp, Artificial Sequence
  Description of Artificial Sequence: Synthetic oligonucleotide
caagaccaacacacagacttacctagagaacctg

SEQ ID NO: 33458 - DNA, 34 bp, Artificial Sequence
  Description of Artificial Sequence: Synthetic oligonucleotide
aagaccaacacacagacttacctagagaacctgc

SEQ ID NO: 33459 - DNA, 33 bp, Artificial Sequence
  Description of Artificial Sequence: Synthetic oligonucleotide
agaccaacacacagacttacctagagaacctgc

SEQ ID NO: 33460 - DNA, 32 bp, Artificial Sequence
  Description of Artificial Sequence: Synthetic oligonucleotide
gaccaacacacagacttacctagagaacctgc

SEQ ID NO: 33461 - DNA, 32 bp, Artificial Sequence
  Description of Artificial Sequence: Synthetic oligonucleotide
accaacacacagacttacctagagaacctgcg

SEQ ID NO: 33462 - DNA, 31 bp, Artificial Sequence
  Description of Artificial Sequence: Synthetic oligonucleotide
ccaacacacagacttacctagagaacctgcg

SEQ ID NO: 33463 - DNA, 31 bp, Artificial Sequence
  Description of Artificial Sequence: Synthetic oligonucleotide
caacacacagacttacctagagaacctgcgg

SEQ ID NO: 33464 - DNA, 33 bp, Artificial Sequence
  Description of Artificial Sequence: Synthetic oligonucleotide
aacacacagacttacctagagaacctgcggatc

SEQ ID NO: 33465 - DNA, 32 bp, Artificial Sequence
  Description of Artificial Sequence: Synthetic oligonucleotide
acacacagacttacctagagaacctgcggatc

SEQ ID NO: 33466 - DNA, 31 bp, Artificial Sequence
  Description of Artificial Sequence: Synthetic oligonucleotide
cacacagacttacctagagaacctgcggatc

SEQ ID NO: 33467 - DNA, 31 bp, Artificial Sequence
  Description of Artificial Sequence: Synthetic oligonucleotide
acacagacttacctagagaacctgcggatcg

SEQ ID NO: 33468 - DNA, 30 bp, Artificial Sequence
  Description of Artificial Sequence: Synthetic oligonucleotide
cacagacttacctagagaacctgcggatcg

SEQ ID NO: 33469 - DNA, 30 bp, Artificial Sequence
  Description of Artificial Sequence: Synthetic oligonucleotide
acagacttacctagagaacctgcggatcgc

SEQ ID NO: 33470 - DNA, 29 bp, Artificial Sequence
  Description of Artificial Sequence: Synthetic oligonucleotide
cagacttacctagagaacctgcggatcgc

SEQ ID NO: 33471 - DNA, 29 bp, Artificial Sequence
  Description of Artificial Sequence: Synthetic oligonucleotide
agacttacctagagaacctgcggatcgcg

SEQ ID NO: 33472 - DNA, 28 bp, Artificial Sequence
  Description of Artificial Sequence: Synthetic oligonucleotide
gacttacctagagaacctgcggatcgcg

SEQ ID NO: 33473 - DNA, 28 bp, Artificial Sequence
  Description of Artificial Sequence: Synthetic oligonucleotide
acttacctagagaacctgcggatcgcgc

SEQ ID NO: 33474 - DNA, 27 bp, Artificial Sequence
  Description of Artificial Sequence: Synthetic oligonucleotide
cttacctagagaacctgcggatcgcgc

SEQ ID NO: 33475 - DNA, 28 bp, Artificial Sequence
  Description of Artificial Sequence: Synthetic oligonucleotide
ttacctagagaacctgcggatcgcgctc

SEQ ID NO: 33476 - DNA, 27 bp, Artificial Sequence
  Description of Artificial Sequence: Synthetic oligonucleotide
tacctagagaacctgcggatcgcgctc

SEQ ID NO: 33477 - DNA, 26 bp, Artificial Sequence
  Description of Artificial Sequence: Synthetic oligonucleotide
acctagagaacctgcggatcgcgctc

SEQ ID NO: 33478 - DNA, 25 bp, Artificial Sequence
  Description of Artificial Sequence: Synthetic oligonucleotide
cctagagaacctgcggatcgcgctc

SEQ ID NO: 33479 - DNA, 25 bp, Artificial Sequence
  Description of Artificial Sequence: Synthetic oligonucleotide
ctagagaacctgcggatcgcgctcc

SEQ ID NO: 33480 - DNA, 25 bp, Artificial Sequence
  Description of Artificial Sequence: Synthetic oligonucleotide
tagagaacctgcggatcgcgctccg

SEQ ID NO: 33481 - DNA, 25 bp, Artificial Sequence
  Description of Artificial Sequence: Synthetic oligonucleotide
ctactacaaccagagcgaggccggg

SEQ ID NO: 33482 - DNA, 25 bp, Artificial Sequence
  Description of Artificial Sequence: Synthetic oligonucleotide
tactacaaccagagcgaggccgggc

SEQ ID NO: 33483 - DNA, 24 bp, Artificial Sequence
  Description of Artificial Sequence: Synthetic oligonucleotide
actacaaccagagcgaggccgggc

SEQ ID NO: 33484 - DNA, 23 bp, Artificial Sequence
  Description of Artificial Sequence: Synthetic oligonucleotide
ctacaaccagagcgaggccgggc

SEQ ID NO: 33485 - DNA, 24 bp, Artificial Sequence
  Description of Artificial Sequence: Synthetic oligonucleotide
tacaaccagagcgaggccgggcct

SEQ ID NO: 33486 - DNA, 23 bp, Artificial Sequence
  Description of Artificial Sequence: Synthetic oligonucleotide
acaaccagagcgaggccgggcct

SEQ ID NO: 33487 - DNA, 22 bp, Artificial Sequence
  Description of Artificial Sequence: Synthetic oligonucleotide
caaccagagcgaggccgggcct

SEQ ID NO: 33488 - DNA, 23 bp, Artificial Sequence
  Description of Artificial Sequence: Synthetic oligonucleotide
aaccagagcgaggccgggcctca

SEQ ID NO: 33489 - DNA, 22 bp, Artificial Sequence
  Description of Artificial Sequence: Synthetic oligonucleotide
accagagcgaggccgggcctca

SEQ ID NO: 33490 - DNA, 21 bp, Artificial Sequence
  Description of Artificial Sequence: Synthetic oligonucleotide
ccagagcgaggccgggcctca

SEQ ID NO: 33491 - DNA, 22 bp, Artificial Sequence
  Description of Artificial Sequence: Synthetic oligonucleotide
cagagcgaggccgggcctcaca

SEQ ID NO: 33492 - DNA, 22 bp, Artificial Sequence
  Description of Artificial Sequence: Synthetic oligonucleotide
agagcgaggccgggcctcacac

SEQ ID NO: 33493 - DNA, 21 bp, Artificial Sequence
  Description of Artificial Sequence: Synthetic oligonucleotide
gagcgaggccgggcctcacac

SEQ ID NO: 33494 - DNA, 21 bp, Artificial Sequence
  Description of Artificial Sequence: Synthetic oligonucleotide
agcgaggccgggcctcacacc

SEQ ID NO: 33495 - DNA, 20 bp, Artificial Sequence
  Description of Artificial Sequence: Synthetic oligonucleotide
gcgaggccgggcctcacacc

SEQ ID NO: 33496 - DNA, 21 bp, Artificial Sequence
  Description of Artificial Sequence: Synthetic oligonucleotide
cgaggccgggcctcacaccct

SEQ ID NO: 33497 - DNA, 21 bp, Artificial Sequence
  Description of Artificial Sequence: Synthetic oligonucleotide
gaggccgggcctcacaccctc

SEQ ID NO: 33498 - DNA, 22 bp, Artificial Sequence
  Description of Artificial Sequence: Synthetic oligonucleotide
aggccgggcctcacaccctcca

SEQ ID NO: 33499 - DNA, 21 bp, Artificial Sequence
  Description of Artificial Sequence: Synthetic oligonucleotide
ggccgggcctcacaccctcca

SEQ ID NO: 33500 - DNA, 22 bp, Artificial Sequence
  Description of Artificial Sequence: Synthetic oligonucleotide
gccgggcctcacaccctccaga

SEQ ID NO: 33501 - DNA, 22 bp, Artificial Sequence
  Description of Artificial Sequence: Synthetic oligonucleotide
ccgggcctcacaccctccagag

SEQ ID NO: 33502 - DNA, 24 bp, Artificial Sequence
  Description of Artificial Sequence: Synthetic oligonucleotide
cgggcctcacaccctccagaggat

SEQ ID NO: 33503 - DNA, 26 bp, Artificial Sequence
  Description of Artificial Sequence: Synthetic oligonucleotide
gggcctcacaccctccagaggatgta

SEQ ID NO: 33504 - DNA, 26 bp, Artificial Sequence
  Description of Artificial Sequence: Synthetic oligonucleotide
ggcctcacaccctccagaggatgtac

SEQ ID NO: 33505 - DNA, 26 bp, Artificial Sequence
  Description of Artificial Sequence: Synthetic oligonucleotide
gcctcacaccctccagaggatgtacg

SEQ ID NO: 33506 - DNA, 26 bp, Artificial Sequence
  Description of Artificial Sequence: Synthetic oligonucleotide
cctcacaccctccagaggatgtacgg

SEQ ID NO: 33507 - DNA, 31 bp, Artificial Sequence
  Description of Artificial Sequence: Synthetic oligonucleotide
tgcaagaccaacacacagacttaccgagagg

SEQ ID NO: 33508 - DNA, 30 bp, Artificial Sequence
  Description of Artificial Sequence: Synthetic oligonucleotide
gcaagaccaacacacagacttaccgagagg

SEQ ID NO: 33509 - DNA, 29 bp, Artificial Sequence
  Description of Artificial Sequence: Synthetic oligonucleotide
acatgtgacccaccaccccatctctgaac

SEQ ID NO: 33510 - DNA, 28 bp, Artificial Sequence
  Description of Artificial Sequence: Synthetic oligonucleotide
catgtgacccaccaccccatctctgaac

SEQ ID NO: 33511 - DNA, 30 bp, Artificial Sequence
  Description of Artificial Sequence: Synthetic oligonucleotide
atgtgacccaccaccccatctctgaacatg

SEQ ID NO: 33512 - DNA, 29 bp, Artificial Sequence
  Description of Artificial Sequence: Synthetic oligonucleotide
tgtgacccaccaccccatctctgaacatg

SEQ ID NO: 33513 - DNA, 28 bp, Artificial Sequence
  Description of Artificial Sequence: Synthetic oligonucleotide
gtgacccaccaccccatctctgaacatg

SEQ ID NO: 33514 - DNA, 29 bp, Artificial Sequence
  Description of Artificial Sequence: Synthetic oligonucleotide
tgacccaccaccccatctctgaacatgag

SEQ ID NO: 33515 - DNA, 28 bp, Artificial Sequence
  Description of Artificial Sequence: Synthetic oligonucleotide
gacccaccaccccatctctgaacatgag

SEQ ID NO: 33516 - DNA, 28 bp, Artificial Sequence
  Description of Artificial Sequence: Synthetic oligonucleotide
acccaccaccccatctctgaacatgagg

SEQ ID NO: 33517 - DNA, 27 bp, Artificial Sequence
  Description of Artificial Sequence: Synthetic oligonucleotide
cccaccaccccatctctgaacatgagg

SEQ ID NO: 33518 - DNA, 27 bp, Artificial Sequence
  Description of Artificial Sequence: Synthetic oligonucleotide
ccaccaccccatctctgaacatgaggc

SEQ ID NO: 33519 - DNA, 27 bp, Artificial Sequence
  Description of Artificial Sequence: Synthetic oligonucleotide
caccaccccatctctgaacatgaggcc

SEQ ID NO: 33520 - DNA, 28 bp, Artificial Sequence
  Description of Artificial Sequence: Synthetic oligonucleotide
accaccccatctctgaacatgaggccac

SEQ ID NO: 33521 - DNA, 27 bp, Artificial Sequence
  Description of Artificial Sequence: Synthetic oligonucleotide
ccaccccatctctgaacatgaggccac

SEQ ID NO: 33522 - DNA, 27 bp, Artificial Sequence
  Description of Artificial Sequence: Synthetic oligonucleotide
caccccatctctgaacatgaggccacc

SEQ ID NO: 33523 - DNA, 27 bp, Artificial Sequence
  Description of Artificial Sequence: Synthetic oligonucleotide
accccatctctgaacatgaggccaccc

SEQ ID NO: 33524 - DNA, 27 bp, Artificial Sequence
  Description of Artificial Sequence: Synthetic oligonucleotide
ccccatctctgaacatgaggccaccct

SEQ ID NO: 33525 - DNA, 27 bp, Artificial Sequence
  Description of Artificial Sequence: Synthetic oligonucleotide
cccatctctgaacatgaggccaccctg

SEQ ID NO: 33526 - DNA, 28 bp, Artificial Sequence
  Description of Artificial Sequence: Synthetic oligonucleotide
ccatctctgaacatgaggccaccctgag

SEQ ID NO: 33527 - DNA, 28 bp, Artificial Sequence
  Description of Artificial Sequence: Synthetic oligonucleotide
catctctgaacatgaggccaccctgagg

SEQ ID NO: 33528 - DNA, 29 bp, Artificial Sequence
  Description of Artificial Sequence: Synthetic oligonucleotide
atctctgaacatgaggccaccctgaggtg

SEQ ID NO: 33529 - DNA, 28 bp, Artificial Sequence
  Description of Artificial Sequence: Synthetic oligonucleotide
tctctgaacatgaggccaccctgaggtg

SEQ ID NO: 33530 - DNA, 27 bp, Artificial Sequence
  Description of Artificial Sequence: Synthetic oligonucleotide
ctctgaacatgaggccaccctgaggtg

SEQ ID NO: 33531 - DNA, 27 bp, Artificial Sequence
  Description of Artificial Sequence: Synthetic oligonucleotide
tctgaacatgaggccaccctgaggtgc

SEQ ID NO: 33532 - DNA, 27 bp, Artificial Sequence
  Description of Artificial Sequence: Synthetic oligonucleotide
ctgaacatgaggccaccctgaggtgct

SEQ ID NO: 33533 - DNA, 27 bp, Artificial Sequence
  Description of Artificial Sequence: Synthetic oligonucleotide
tgaacatgaggccaccctgaggtgctg

SEQ ID NO: 33534 - DNA, 26 bp, Artificial Sequence
  Description of Artificial Sequence: Synthetic oligonucleotide
gaacatgaggccaccctgaggtgctg

SEQ ID NO: 33535 - DNA, 26 bp, Artificial Sequence
  Description of Artificial Sequence: Synthetic oligonucleotide
aacatgaggccaccctgaggtgctgg

SEQ ID NO: 33536 - DNA, 25 bp, Artificial Sequence
  Description of Artificial Sequence: Synthetic oligonucleotide
acatgaggccaccctgaggtgctgg

SEQ ID NO: 33537 - DNA, 25 bp, Artificial Sequence
  Description of Artificial Sequence: Synthetic oligonucleotide
cagaggatgtacggctgcgacgtgc

SEQ ID NO: 33538 - DNA, 25 bp, Artificial Sequence
  Description of Artificial Sequence: Synthetic oligonucleotide
agaggatgtacggctgcgacgtgcg

SEQ ID NO: 33539 - DNA, 24 bp, Artificial Sequence
  Description of Artificial Sequence: Synthetic oligonucleotide
gaggatgtacggctgcgacgtgcg

SEQ ID NO: 33540 - DNA, 24 bp, Artificial Sequence
  Description of Artificial Sequence: Synthetic oligonucleotide
aggatgtacggctgcgacgtgcgg

SEQ ID NO: 33541 - DNA, 23 bp, Artificial Sequence
  Description of Artificial Sequence: Synthetic oligonucleotide
ggatgtacggctgcgacgtgcgg

SEQ ID NO: 33542 - DNA, 23 bp, Artificial Sequence
  Description of Artificial Sequence: Synthetic oligonucleotide
gatgtacggctgcgacgtgcggc

SEQ ID NO: 33543 - DNA, 23 bp, Artificial Sequence
  Description of Artificial Sequence: Synthetic oligonucleotide
atgtacggctgcgacgtgcggcc

SEQ ID NO: 33544 - DNA, 22 bp, Artificial Sequence
  Description of Artificial Sequence: Synthetic oligonucleotide
tgtacggctgcgacgtgcggcc

SEQ ID NO: 33545 - DNA, 21 bp, Artificial Sequence
  Description of Artificial Sequence: Synthetic oligonucleotide
gtacggctgcgacgtgcggcc

SEQ ID NO: 33546 - DNA, 21 bp, Artificial Sequence
  Description of Artificial Sequence: Synthetic oligonucleotide
tacggctgcgacgtgcggccg

SEQ ID NO: 33547 - DNA, 20 bp, Artificial Sequence
  Description of Artificial Sequence: Synthetic oligonucleotide
acggctgcgacgtgcggccg

SEQ ID NO: 33548 - DNA, 20 bp, Artificial Sequence
  Description of Artificial Sequence: Synthetic oligonucleotide
cggctgcgacgtgcggccgt

SEQ ID NO: 33549 - DNA, 20 bp, Artificial Sequence
  Description of Artificial Sequence: Synthetic oligonucleotide
ggctgcgacgtgcggccgga

SEQ ID NO: 33550 - DNA, 20 bp, Artificial Sequence
  Description of Artificial Sequence: Synthetic oligonucleotide
gctgcgacgtgcggccggac

SEQ ID NO: 33551 - DNA, 20 bp, Artificial Sequence
  Description of Artificial Sequence: Synthetic oligonucleotide
ctgcgacgtgcggccggacg

SEQ ID NO: 33552 - DNA, 20 bp, Artificial Sequence
  Description of Artificial Sequence: Synthetic oligonucleotide
tgcgacgtgcggccggacgg

SEQ ID NO: 33553 - DNA, 20 bp, Artificial Sequence
  Description of Artificial Sequence: Synthetic oligonucleotide
gcgacgtgcggccggacggt

SEQ ID NO: 33554 - DNA, 20 bp, Artificial Sequence
  Description of Artificial Sequence: Synthetic oligonucleotide
cgacgtgcggccggacgggt

SEQ ID NO: 33555 - DNA, 20 bp, Artificial Sequence
  Description of Artificial Sequence: Synthetic oligonucleotide
gacgtgcggccggacgggct

SEQ ID NO: 33556 - DNA, 20 bp, Artificial Sequence
  Description of Artificial Sequence: Synthetic oligonucleotide
acgtgcggccggacgggcgt

SEQ ID NO: 33557 - DNA, 20 bp, Artificial Sequence
  Description of Artificial Sequence: Synthetic oligonucleotide
cgtgcggccggacgggcgtt

SEQ ID NO: 33558 - DNA, 20 bp, Artificial Sequence
  Description of Artificial Sequence: Synthetic oligonucleotide
gtgcggccggacgggcgctt

SEQ ID NO: 33559 - DNA, 20 bp, Artificial Sequence
  Description of Artificial Sequence: Synthetic oligonucleotide
tgcggccggacgggcgcctt

SEQ ID NO: 33560 - DNA, 20 bp, Artificial Sequence
  Description of Artificial Sequence: Synthetic oligonucleotide
gcggccggacgggcgccttt

SEQ ID NO: 33561 - DNA, 20 bp, Artificial Sequence
  Description of Artificial Sequence: Synthetic oligonucleotide
cggccggacgggcgcctctt

SEQ ID NO: 33562 - DNA, 27 bp, Artificial Sequence
  Description of Artificial Sequence: Synthetic oligonucleotide
gcagctgagaacctacctggagggcaa

SEQ ID NO: 33563 - DNA, 27 bp, Artificial Sequence
  Description of Artificial Sequence: Synthetic oligonucleotide
cagctgagaacctacctggagggcaag

SEQ ID NO: 33564 - DNA, 28 bp, Artificial Sequence
  Description of Artificial Sequence: Synthetic oligonucleotide
agctgagaacctacctggagggcaagtg

SEQ ID NO: 33565 - DNA, 27 bp, Artificial Sequence
  Description of Artificial Sequence: Synthetic oligonucleotide
gctgagaacctacctggagggcaagtg

SEQ ID NO: 33566 - DNA, 27 bp, Artificial Sequence
  Description of Artificial Sequence: Synthetic oligonucleotide
ctgagaacctacctggagggcaagtgc

SEQ ID NO: 33567 - DNA, 27 bp, Artificial Sequence
  Description of Artificial Sequence: Synthetic oligonucleotide
tgagaacctacctggagggcaagtgcg

SEQ ID NO: 33568 - DNA, 27 bp, Artificial Sequence
  Description of Artificial Sequence: Synthetic oligonucleotide
gagaacctacctggagggcaagtgcgt

SEQ ID NO: 33569 - DNA, 27 bp, Artificial Sequence
  Description of Artificial Sequence: Synthetic oligonucleotide
agaacctacctggagggcaagtgcgtg

SEQ ID NO: 33570 - DNA, 26 bp, Artificial Sequence
  Description of Artificial Sequence: Synthetic oligonucleotide
gaacctacctggagggcaagtgcgtg

SEQ ID NO: 33571 - DNA, 27 bp, Artificial Sequence
  Description of Artificial Sequence: Synthetic oligonucleotide
aacctacctggagggcaagtgcgtgga

SEQ ID NO: 33572 - DNA, 26 bp, Artificial Sequence
  Description of Artificial Sequence: Synthetic oligonucleotide
acctacctggagggcaagtgcgtgga

SEQ ID NO: 33573 - DNA, 26 bp, Artificial Sequence
  Description of Artificial Sequence: Synthetic oligonucleotide
gccgggtctcacaccttccagaggat

SEQ ID NO: 33574 - DNA, 27 bp, Artificial Sequence
  Description of Artificial Sequence: Synthetic oligonucleotide
ccgggtctcacaccttccagaggatgt

SEQ ID NO: 33575 - DNA, 28 bp, Artificial Sequence
  Description of Artificial Sequence: Synthetic oligonucleotide
cgggtctcacaccttccagaggatgtac

SEQ ID NO: 33576 - DNA, 28 bp, Artificial Sequence
  Description of Artificial Sequence: Synthetic oligonucleotide
gggtctcacaccttccagaggatgtacg

SEQ ID NO: 33577 - DNA, 28 bp, Artificial Sequence
  Description of Artificial Sequence: Synthetic oligonucleotide
ggtctcacaccttccagaggatgtacgg

SEQ ID NO: 33578 - DNA, 28 bp, Artificial Sequence
  Description of Artificial Sequence: Synthetic oligonucleotide
gtctcacaccttccagaggatgtacggc

SEQ ID NO: 33579 - DNA, 29 bp, Artificial Sequence
  Description of Artificial Sequence: Synthetic oligonucleotide
tctcacaccttccagaggatgtacggctg

SEQ ID NO: 33580 - DNA, 28 bp, Artificial Sequence
  Description of Artificial Sequence: Synthetic oligonucleotide
ctcacaccttccagaggatgtacggctg

SEQ ID NO: 33581 - DNA, 28 bp, Artificial Sequence
  Description of Artificial Sequence: Synthetic oligonucleotide
tcacaccttccagaggatgtacggctgc

SEQ ID NO: 33582 - DNA, 27 bp, Artificial Sequence
  Description of Artificial Sequence: Synthetic oligonucleotide
cacaccttccagaggatgtacggctgc

SEQ ID NO: 33583 - DNA, 27 bp, Artificial Sequence
  Description of Artificial Sequence: Synthetic oligonucleotide
acaccttccagaggatgtacggctgcg

SEQ ID NO: 33584 - DNA, 27 bp, Artificial Sequence
  Description of Artificial Sequence: Synthetic oligonucleotide
caccttccagaggatgtacggctgcga

SEQ ID NO: 33585 - DNA, 27 bp, Artificial Sequence
  Description of Artificial Sequence: Synthetic oligonucleotide
accttccagaggatgtacggctgcgac

SEQ ID NO: 33586 - DNA, 26 bp, Artificial Sequence
  Description of Artificial Sequence: Synthetic oligonucleotide
ccttccagaggatgtacggctgcgac

SEQ ID NO: 33587 - DNA, 27 bp, Artificial Sequence
  Description of Artificial Sequence: Synthetic oligonucleotide
cttccagaggatgtacggctgcgacgt

SEQ ID NO: 33588 - DNA, 27 bp, Artificial Sequence
  Description of Artificial Sequence: Synthetic oligonucleotide
ttccagaggatgtacggctgcgacgtg

SEQ ID NO: 33589 - DNA, 27 bp, Artificial Sequence
  Description of Artificial Sequence: Synthetic oligonucleotide
cgtggatagagcaggaggggccagaat

SEQ ID NO: 33590 - DNA, 30 bp, Artificial Sequence
  Description of Artificial Sequence: Synthetic oligonucleotide
gtggatagagcaggaggggccagaatattg

SEQ ID NO: 33591 - DNA, 30 bp, Artificial Sequence
  Description of Artificial Sequence: Synthetic oligonucleotide
tggatagagcaggaggggccagaatattgg

SEQ ID NO: 33592 - DNA, 29 bp, Artificial Sequence
  Description of Artificial Sequence: Synthetic oligonucleotide
ggatagagcaggaggggccagaatattgg

SEQ ID NO: 33593 - DNA, 29 bp, Artificial Sequence
  Description of Artificial Sequence: Synthetic oligonucleotide
gatagagcaggaggggccagaatattggg

SEQ ID NO: 33594 - DNA, 30 bp, Artificial Sequence
  Description of Artificial Sequence: Synthetic oligonucleotide
atagagcaggaggggccagaatattgggac

SEQ ID NO: 33595 - DNA, 29 bp, Artificial Sequence
  Description of Artificial Sequence: Synthetic oligonucleotide
tagagcaggaggggccagaatattgggac

SEQ ID NO: 33596 - DNA, 28 bp, Artificial Sequence
  Description of Artificial Sequence: Synthetic oligonucleotide
agagcaggaggggccagaatattgggac

SEQ ID NO: 33597 - DNA, 27 bp, Artificial Sequence
  Description of Artificial Sequence: Synthetic oligonucleotide
gagcaggaggggccagaatattgggac

SEQ ID NO: 33598 - DNA, 27 bp, Artificial Sequence
  Description of Artificial Sequence: Synthetic oligonucleotide
agcaggaggggccagaatattgggacc

SEQ ID NO: 33599 - DNA, 26 bp, Artificial Sequence
  Description of Artificial Sequence: Synthetic oligonucleotide
gcaggaggggccagaatattgggacc

SEQ ID NO: 33600 - DNA, 26 bp, Artificial Sequence
  Description of Artificial Sequence: Synthetic oligonucleotide
caggaggggccagaatattgggaccg

SEQ ID NO: 33601 - DNA, 27 bp, Artificial Sequence
  Description of Artificial Sequence: Synthetic oligonucleotide
aggaggggccagaatattgggaccgga

SEQ ID NO: 33602 - DNA, 27 bp, Artificial Sequence
  Description of Artificial Sequence: Synthetic oligonucleotide
ggaggggccagaatattgggaccggaa

SEQ ID NO: 33603 - DNA, 27 bp, Artificial Sequence
  Description of Artificial Sequence: Synthetic oligonucleotide
gaggggccagaatattgggaccggaac

SEQ ID NO: 33604 - DNA, 28 bp, Artificial Sequence
  Description of Artificial Sequence: Synthetic oligonucleotide
aggggccagaatattgggaccggaacac

SEQ ID NO: 33605 - DNA, 27 bp, Artificial Sequence
  Description of Artificial Sequence: Synthetic oligonucleotide
ggggccagaatattgggaccggaacac

SEQ ID NO: 33606 - DNA, 28 bp, Artificial Sequence
  Description of Artificial Sequence: Synthetic oligonucleotide
gggccagaatattgggaccggaacacac

SEQ ID NO: 33607 - DNA, 29 bp, Artificial Sequence
  Description of Artificial Sequence: Synthetic oligonucleotide
ggccagaatattgggaccggaacacacag

SEQ ID NO: 33608 - DNA, 31 bp, Artificial Sequence
  Description of Artificial Sequence: Synthetic oligonucleotide
gccagaatattgggaccggaacacacagatc

SEQ ID NO: 33609 - DNA, 32 bp, Artificial Sequence
  Description of Artificial Sequence: Synthetic oligonucleotide
ccagaatattgggaccggaacacacagatctg

SEQ ID NO: 33610 - DNA, 32 bp, Artificial Sequence
  Description of Artificial Sequence: Synthetic oligonucleotide
cagaatattgggaccggaacacacagatctgc

SEQ ID NO: 33611 - DNA, 34 bp, Artificial Sequence
  Description of Artificial Sequence: Synthetic oligonucleotide
agaatattgggaccggaacacacagatctgcaag

SEQ ID NO: 33612 - DNA, 21 bp, Artificial Sequence
  Description of Artificial Sequence: Synthetic oligonucleotide
agcgacgccgcgagtccgagg

SEQ ID NO: 33613 - DNA, 20 bp, Artificial Sequence
  Description of Artificial Sequence: Synthetic oligonucleotide
gcgacgccgcgagtccgagg

SEQ ID NO: 33614 - DNA, 21 bp, Artificial Sequence
  Description of Artificial Sequence: Synthetic oligonucleotide
cgacgccgcgagtccgaggga

SEQ ID NO: 33615 - DNA, 21 bp, Artificial Sequence
  Description of Artificial Sequence: Synthetic oligonucleotide
gacgccgcgagtccgagggag

SEQ ID NO: 33616 - DNA, 22 bp, Artificial Sequence
  Description of Artificial Sequence: Synthetic oligonucleotide
acgccgcgagtccgagggagga

SEQ ID NO: 33617 - DNA, 21 bp, Artificial Sequence
  Description of Artificial Sequence: Synthetic oligonucleotide
cgccgcgagtccgagggagga

SEQ ID NO: 33618 - DNA, 21 bp, Artificial Sequence
  Description of Artificial Sequence: Synthetic oligonucleotide
gccgcgagtccgagggaggag

SEQ ID NO: 33619 - DNA, 21 bp, Artificial Sequence
  Description of Artificial Sequence: Synthetic oligonucleotide
ccgcgagtccgagggaggagc

SEQ ID NO: 33620 - DNA, 21 bp, Artificial Sequence
  Description of Artificial Sequence: Synthetic oligonucleotide
cgcgagtccgagggaggagcc

SEQ ID NO: 33621 - DNA, 21 bp, Artificial Sequence
  Description of Artificial Sequence: Synthetic oligonucleotide
gcgagtccgagggaggagccg

SEQ ID NO: 33622 - DNA, 21 bp, Artificial Sequence
  Description of Artificial Sequence: Synthetic oligonucleotide
cgagtccgagggaggagccgc

SEQ ID NO: 33623 - DNA, 21 bp, Artificial Sequence
  Description of Artificial Sequence: Synthetic oligonucleotide
gagtccgagggaggagccgcg

SEQ ID NO: 33624 - DNA, 21 bp, Artificial Sequence
  Description of Artificial Sequence: Synthetic oligonucleotide
agtccgagggaggagccgcgg

SEQ ID NO: 33625 - DNA, 20 bp, Artificial Sequence
  Description of Artificial Sequence: Synthetic oligonucleotide
gtccgagggaggagccgcgg

SEQ ID NO: 33626 - DNA, 20 bp, Artificial Sequence
  Description of Artificial Sequence: Synthetic oligonucleotide
tccgagggaggagccgcggg

SEQ ID NO: 33627 - DNA, 20 bp, Artificial Sequence
  Description of Artificial Sequence: Synthetic oligonucleotide
ccgagggaggagccgcgggt

SEQ ID NO: 33628 - DNA, 20 bp, Artificial Sequence
  Description of Artificial Sequence: Synthetic oligonucleotide
cgagggaggagccgcgggct

SEQ ID NO: 33629 - DNA, 20 bp, Artificial Sequence
  Description of Artificial Sequence: Synthetic oligonucleotide
gagggaggagccgcgggcgt

SEQ ID NO: 33630 - DNA, 20 bp, Artificial Sequence
  Description of Artificial Sequence: Synthetic oligonucleotide
agggaggagccgcgggcgct

SEQ ID NO: 33631 - DNA, 20 bp, Artificial Sequence
  Description of Artificial Sequence: Synthetic oligonucleotide
gggaggagccgcgggcgctt

SEQ ID NO: 33632 - DNA, 20 bp, Artificial Sequence
  Description of Artificial Sequence: Synthetic oligonucleotide
ggaggagccgcgggcgcctt

SEQ ID NO: 33633 - DNA, 24 bp, Artificial Sequence
  Description of Artificial Sequence: Synthetic oligonucleotide
cagagcgaggccgggtctcacact

SEQ ID NO: 33634 - DNA, 25 bp, Artificial Sequence
  Description of Artificial Sequence: Synthetic oligonucleotide
agagcgaggccgggtctcacactct

SEQ ID NO: 33635 - DNA, 24 bp, Artificial Sequence
  Description of Artificial Sequence: Synthetic oligonucleotide
gagcgaggccgggtctcacactct

SEQ ID NO: 33636 - DNA, 24 bp, Artificial Sequence
  Description of Artificial Sequence: Synthetic oligonucleotide
agcgaggccgggtctcacactctc

SEQ ID NO: 33637 - DNA, 23 bp, Artificial Sequence
  Description of Artificial Sequence: Synthetic oligonucleotide
gcgaggccgggtctcacactctc

SEQ ID NO: 33638 - DNA, 24 bp, Artificial Sequence
  Description of Artificial Sequence: Synthetic oligonucleotide
cgaggccgggtctcacactctcca

SEQ ID NO: 33639 - DNA, 25 bp, Artificial Sequence
  Description of Artificial Sequence: Synthetic oligonucleotide
gaggccgggtctcacactctccaga

SEQ ID NO: 33640 - DNA, 25 bp, Artificial Sequence
  Description of Artificial Sequence: Synthetic oligonucleotide
aggccgggtctcacactctccagag

SEQ ID NO: 33641 - DNA, 24 bp, Artificial Sequence
  Description of Artificial Sequence: Synthetic oligonucleotide
ggccgggtctcacactctccagag

SEQ ID NO: 33642 - DNA, 26 bp, Artificial Sequence
  Description of Artificial Sequence: Synthetic oligonucleotide
gccgggtctcacactctccagaggat

SEQ ID NO: 33643 - DNA, 27 bp, Artificial Sequence
  Description of Artificial Sequence: Synthetic oligonucleotide
ccgggtctcacactctccagaggatgt

SEQ ID NO: 33644 - DNA, 28 bp, Artificial Sequence
  Description of Artificial Sequence: Synthetic oligonucleotide
cgggtctcacactctccagaggatgtac

SEQ ID NO: 33645 - DNA, 28 bp, Artificial Sequence
  Description of Artificial Sequence: Synthetic oligonucleotide
gggtctcacactctccagaggatgtacg

SEQ ID NO: 33646 - DNA, 28 bp, Artificial Sequence
  Description of Artificial Sequence: Synthetic oligonucleotide
ggtctcacactctccagaggatgtacgg

SEQ ID NO: 33647 - DNA, 28 bp, Artificial Sequence
  Description of Artificial Sequence: Synthetic oligonucleotide
gtctcacactctccagaggatgtacggc

SEQ ID NO: 33648 - DNA, 29 bp, Artificial Sequence
  Description of Artificial Sequence: Synthetic oligonucleotide
tctcacactctccagaggatgtacggctg

SEQ ID NO: 33649 - DNA, 28 bp, Artificial Sequence
  Description of Artificial Sequence: Synthetic oligonucleotide
ctcacactctccagaggatgtacggctg

SEQ ID NO: 33650 - DNA, 28 bp, Artificial Sequence
  Description of Artificial Sequence: Synthetic oligonucleotide
tcacactctccagaggatgtacggctgc

SEQ ID NO: 33651 - DNA, 27 bp, Artificial Sequence
  Description of Artificial Sequence: Synthetic oligonucleotide
cacactctccagaggatgtacggctgc

SEQ ID NO: 33652 - DNA, 27 bp, Artificial Sequence
  Description of Artificial Sequence: Synthetic oligonucleotide
acactctccagaggatgtacggctgcg

SEQ ID NO: 33653 - DNA, 27 bp, Artificial Sequence
  Description of Artificial Sequence: Synthetic oligonucleotide
cactctccagaggatgtacggctgcga

SEQ ID NO: 33654 - DNA, 27 bp, Artificial Sequence
  Description of Artificial Sequence: Synthetic oligonucleotide
actctccagaggatgtacggctgcgac

SEQ ID NO: 33655 - DNA, 26 bp, Artificial Sequence
  Description of Artificial Sequence: Synthetic oligonucleotide
ctctccagaggatgtacggctgcgac

SEQ ID NO: 33656 - DNA, 27 bp, Artificial Sequence
  Description of Artificial Sequence: Synthetic oligonucleotide
tctccagaggatgtacggctgcgacgt

SEQ ID NO: 33657 - DNA, 27 bp, Artificial Sequence
  Description of Artificial Sequence: Synthetic oligonucleotide
cacaccctccagaggatgtacggctgt

SEQ ID NO: 33658 - DNA, 27 bp, Artificial Sequence
  Description of Artificial Sequence: Synthetic oligonucleotide
acaccctccagaggatgtacggctgtg

SEQ ID NO: 33659 - DNA, 27 bp, Artificial Sequence
  Description of Artificial Sequence: Synthetic oligonucleotide
caccctccagaggatgtacggctgtga

SEQ ID NO: 33660 - DNA, 27 bp, Artificial Sequence
  Description of Artificial Sequence: Synthetic oligonucleotide
accctccagaggatgtacggctgtgac

SEQ ID NO: 33661 - DNA, 26 bp, Artificial Sequence
  Description of Artificial Sequence: Synthetic oligonucleotide
ccctccagaggatgtacggctgtgac

SEQ ID NO: 33662 - DNA, 27 bp, Artificial Sequence
  Description of Artificial Sequence: Synthetic oligonucleotide
cctccagaggatgtacggctgtgacgt

SEQ ID NO: 33663 - DNA, 27 bp, Artificial Sequence
  Description of Artificial Sequence: Synthetic oligonucleotide
ctccagaggatgtacggctgtgacgtg

SEQ ID NO: 33664 - DNA, 27 bp, Artificial Sequence
  Description of Artificial Sequence: Synthetic oligonucleotide
tccagaggatgtacggctgtgacgtgg

SEQ ID NO: 33665 - DNA, 26 bp, Artificial Sequence
  Description of Artificial Sequence: Synthetic oligonucleotide
ccagaggatgtacggctgtgacgtgg

SEQ ID NO: 33666 - DNA, 26 bp, Artificial Sequence
  Description of Artificial Sequence: Synthetic oligonucleotide
cagaggatgtacggctgtgacgtggg

SEQ ID NO: 33667 - DNA, 26 bp, Artificial Sequence
  Description of Artificial Sequence: Synthetic oligonucleotide
agaggatgtacggctgtgacgtgggg

SEQ ID NO: 33668 - DNA, 25 bp, Artificial Sequence
  Description of Artificial Sequence: Synthetic oligonucleotide
gaggatgtacggctgtgacgtgggg

SEQ ID NO: 33669 - DNA, 25 bp, Artificial Sequence
  Description of Artificial Sequence: Synthetic oligonucleotide
aggatgtacggctgtgacgtggggc

SEQ ID NO: 33670 - DNA, 24 bp, Artificial Sequence
  Description of Artificial Sequence: Synthetic oligonucleotide
ggatgtacggctgtgacgtggggc

SEQ ID NO: 33671 - DNA, 24 bp, Artificial Sequence
  Description of Artificial Sequence: Synthetic oligonucleotide
gatgtacggctgtgacgtggggcc

SEQ ID NO: 33672 - DNA, 24 bp, Artificial Sequence
  Description of Artificial Sequence: Synthetic oligonucleotide
atgtacggctgtgacgtggggccg

SEQ ID NO: 33673 - DNA, 23 bp, Artificial Sequence
  Description of Artificial Sequence: Synthetic oligonucleotide
tgtacggctgtgacgtggggccg

SEQ ID NO: 33674 - DNA, 22 bp, Artificial Sequence
  Description of Artificial Sequence: Synthetic oligonucleotide
gtacggctgtgacgtggggccg

SEQ ID NO: 33675 - DNA, 23 bp, Artificial Sequence
  Description of Artificial Sequence: Synthetic oligonucleotide
tacggctgtgacgtggggccgga

SEQ ID NO: 33676 - DNA, 22 bp, Artificial Sequence
  Description of Artificial Sequence: Synthetic oligonucleotide
acggctgtgacgtggggccgga

SEQ ID NO: 33677 - DNA, 21 bp, Artificial Sequence
  Description of Artificial Sequence: Synthetic oligonucleotide
cggctgtgacgtggggccgga

SEQ ID NO: 33678 - DNA, 21 bp, Artificial Sequence
  Description of Artificial Sequence: Synthetic oligonucleotide
ggctgtgacgtggggccggac

SEQ ID NO: 33679 - DNA, 21 bp, Artificial Sequence
  Description of Artificial Sequence: Synthetic oligonucleotide
gctgtgacgtggggccggacg

SEQ ID NO: 33680 - DNA, 21 bp, Artificial Sequence
  Description of Artificial Sequence: Synthetic oligonucleotide
ctgtgacgtggggccggacgg

SEQ ID NO: 33681 - DNA, 21 bp, Artificial Sequence
  Description of Artificial Sequence: Synthetic oligonucleotide
tgtgacgtggggccggacggg

SEQ ID NO: 33682 - DNA, 20 bp, Artificial Sequence
  Description of Artificial Sequence: Synthetic oligonucleotide
gtgacgtggggccggacggg

SEQ ID NO: 33683 - DNA, 20 bp, Artificial Sequence
  Description of Artificial Sequence: Synthetic oligonucleotide
tgacgtggggccggacgggc

SEQ ID NO: 33684 - DNA, 27 bp, Artificial Sequence
  Description of Artificial Sequence: Synthetic oligonucleotide
gtgtggcggagcagctgagaacctact

SEQ ID NO: 33685 - DNA, 28 bp, Artificial Sequence
  Description of Artificial Sequence: Synthetic oligonucleotide
tgtggcggagcagctgagaacctacttg

SEQ ID NO: 33686 - DNA, 27 bp, Artificial Sequence
  Description of Artificial Sequence: Synthetic oligonucleotide
gtggcggagcagctgagaacctacttg

SEQ ID NO: 33687 - DNA, 27 bp, Artificial Sequence
  Description of Artificial Sequence: Synthetic oligonucleotide
tggcggagcagctgagaacctacttgg

SEQ ID NO: 33688 - DNA, 27 bp, Artificial Sequence
  Description of Artificial Sequence: Synthetic oligonucleotide
ggcggagcagctgagaacctacttgga

SEQ ID NO: 33689 - DNA, 27 bp, Artificial Sequence
  Description of Artificial Sequence: Synthetic oligonucleotide
gcggagcagctgagaacctacttggag

SEQ ID NO: 33690 - DNA, 27 bp, Artificial Sequence
  Description of Artificial Sequence: Synthetic oligonucleotide
cggagcagctgagaacctacttggagg

SEQ ID NO: 33691 - DNA, 27 bp, Artificial Sequence
  Description of Artificial Sequence: Synthetic oligonucleotide
ggagcagctgagaacctacttggaggg

SEQ ID NO: 33692 - DNA, 27 bp, Artificial Sequence
  Description of Artificial Sequence: Synthetic oligonucleotide
gagcagctgagaacctacttggagggc

SEQ ID NO: 33693 - DNA, 28 bp, Artificial Sequence
  Description of Artificial Sequence: Synthetic oligonucleotide
agcagctgagaacctacttggagggcac

SEQ ID NO: 33694 - DNA, 27 bp, Artificial Sequence
  Description of Artificial Sequence: Synthetic oligonucleotide
gcagctgagaacctacttggagggcac

SEQ ID NO: 33695 - DNA, 27 bp, Artificial Sequence
  Description of Artificial Sequence: Synthetic oligonucleotide
cagctgagaacctacttggagggcacg

SEQ ID NO: 33696 - DNA, 28 bp, Artificial Sequence
  Description of Artificial Sequence: Synthetic oligonucleotide
agctgagaacctacttggagggcacgtg

SEQ ID NO: 33697 - DNA, 27 bp, Artificial Sequence
  Description of Artificial Sequence: Synthetic oligonucleotide
gctgagaacctacttggagggcacgtg

SEQ ID NO: 33698 - DNA, 27 bp, Artificial Sequence
  Description of Artificial Sequence: Synthetic oligonucleotide
ctgagaacctacttggagggcacgtgc

SEQ ID NO: 33699 - DNA, 27 bp, Artificial Sequence
  Description of Artificial Sequence: Synthetic oligonucleotide
tgagaacctacttggagggcacgtgcg

SEQ ID NO: 33700 - DNA, 27 bp, Artificial Sequence
  Description of Artificial Sequence: Synthetic oligonucleotide
gagaacctacttggagggcacgtgcgt

SEQ ID NO: 33701 - DNA, 27 bp, Artificial Sequence
  Description of Artificial Sequence: Synthetic oligonucleotide
agaacctacttggagggcacgtgcgtg

SEQ ID NO: 33702 - DNA, 26 bp, Artificial Sequence
  Description of Artificial Sequence: Synthetic oligonucleotide
gaacctacttggagggcacgtgcgtg

SEQ ID NO: 33703 - DNA, 27 bp, Artificial Sequence
  Description of Artificial Sequence: Synthetic oligonucleotide
aacctacttggagggcacgtgcgtgga

SEQ ID NO: 33704 - DNA, 26 bp, Artificial Sequence
  Description of Artificial Sequence: Synthetic oligonucleotide
acctacttggagggcacgtgcgtgga

SEQ ID NO: 33705 - DNA, 25 bp, Artificial Sequence
  Description of Artificial Sequence: Synthetic oligonucleotide
cctacttggagggcacgtgcgtgga

SEQ ID NO: 33706 - DNA, 26 bp, Artificial Sequence
  Description of Artificial Sequence: Synthetic oligonucleotide
ctacttggagggcacgtgcgtggagt

SEQ ID NO: 33707 - DNA, 26 bp, Artificial Sequence
  Description of Artificial Sequence: Synthetic oligonucleotide
tacttggagggcacgtgcgtggagtg

SEQ ID NO: 33708 - DNA, 25 bp, Artificial Sequence
  Description of Artificial Sequence: Synthetic oligonucleotide
acttggagggcacgtgcgtggagtg

SEQ ID NO: 33709 - DNA, 24 bp, Artificial Sequence
  Description of Artificial Sequence: Synthetic oligonucleotide
cttggagggcacgtgcgtggagtg

SEQ ID NO: 33710 - DNA, 24 bp, Artificial Sequence
  Description of Artificial Sequence: Synthetic oligonucleotide
ttggagggcacgtgcgtggagtgg

SEQ ID NO: 33711 - DNA, 24 bp, Artificial Sequence
  Description of Artificial Sequence: Synthetic oligonucleotide
gagggcacgtgcgtggagtggctt

SEQ ID NO: 33712 - DNA, 24 bp, Artificial Sequence
  Description of Artificial Sequence: Synthetic oligonucleotide
agggcacgtgcgtggagtggcttc

SEQ ID NO: 33713 - DNA, 23 bp, Artificial Sequence
  Description of Artificial Sequence: Synthetic oligonucleotide
gggcacgtgcgtggagtggcttc

SEQ ID NO: 33714 - DNA, 23 bp, Artificial Sequence
  Description of Artificial Sequence: Synthetic oligonucleotide
ggcacgtgcgtggagtggcttcg

SEQ ID NO: 33715 - DNA, 24 bp, Artificial Sequence
  Description of Artificial Sequence: Synthetic oligonucleotide
gcacgtgcgtggagtggcttcgca

SEQ ID NO: 33716 - DNA, 27 bp, Artificial Sequence
  Description of Artificial Sequence: Synthetic oligonucleotide
cacgtgcgtggagtggcttcgcagata

SEQ ID NO: 33717 - DNA, 27 bp, Artificial Sequence
  Description of Artificial Sequence: Synthetic oligonucleotide
acgtgcgtggagtggcttcgcagatac

SEQ ID NO: 33718 - DNA, 26 bp, Artificial Sequence
  Description of Artificial Sequence: Synthetic oligonucleotide
cgtgcgtggagtggcttcgcagatac

SEQ ID NO: 33719 - DNA, 23 bp, Artificial Sequence
  Description of Artificial Sequence: Synthetic oligonucleotide
ccgtgtggcggagcagcggagaa

SEQ ID NO: 33720 - DNA, 23 bp, Artificial Sequence
  Description of Artificial Sequence: Synthetic oligonucleotide
cgtgtggcggagcagcggagaac

SEQ ID NO: 33721 - DNA, 25 bp, Artificial Sequence
  Description of Artificial Sequence: Synthetic oligonucleotide
gtgtggcggagcagcggagaaccta

SEQ ID NO: 33722 - DNA, 25 bp, Artificial Sequence
  Description of Artificial Sequence: Synthetic oligonucleotide
tgtggcggagcagcggagaacctac

SEQ ID NO: 33723 - DNA, 24 bp, Artificial Sequence
  Description of Artificial Sequence: Synthetic oligonucleotide
gtggcggagcagcggagaacctac

SEQ ID NO: 33724 - DNA, 25 bp, Artificial Sequence
  Description of Artificial Sequence: Synthetic oligonucleotide
tggcggagcagcggagaacctacct

SEQ ID NO: 33725 - DNA, 25 bp, Artificial Sequence
  Description of Artificial Sequence: Synthetic oligonucleotide
cagcggagaacctacctggagggca

SEQ ID NO: 33726 - DNA, 25 bp, Artificial Sequence
  Description of Artificial Sequence: Synthetic oligonucleotide
agcggagaacctacctggagggcac

SEQ ID NO: 33727 - DNA, 24 bp, Artificial Sequence
  Description of Artificial Sequence: Synthetic oligonucleotide
gcggagaacctacctggagggcac

SEQ ID NO: 33728 - DNA, 25 bp, Artificial Sequence
  Description of Artificial Sequence: Synthetic oligonucleotide
cggagaacctacctggagggcacgt

SEQ ID NO: 33729 - DNA, 25 bp, Artificial Sequence
  Description of Artificial Sequence: Synthetic oligonucleotide
ggagaacctacctggagggcacgtg

SEQ ID NO: 33730 - DNA, 28 bp, Artificial Sequence
  Description of Artificial Sequence: Synthetic oligonucleotide
cactccatgaggtatttcgacaccgccg

SEQ ID NO: 33731 - DNA, 29 bp, Artificial Sequence
  Description of Artificial Sequence: Synthetic oligonucleotide
actccatgaggtatttcgacaccgccgtg

SEQ ID NO: 33732 - DNA, 28 bp, Artificial Sequence
  Description of Artificial Sequence: Synthetic oligonucleotide
ctccatgaggtatttcgacaccgccgtg

SEQ ID NO: 33733 - DNA, 29 bp, Artificial Sequence
  Description of Artificial Sequence: Synthetic oligonucleotide
tccatgaggtatttcgacaccgccgtgtc

SEQ ID NO: 33734 - DNA, 28 bp, Artificial Sequence
  Description of Artificial Sequence: Synthetic oligonucleotide
ccatgaggtatttcgacaccgccgtgtc

SEQ ID NO: 33735 - DNA, 28 bp, Artificial Sequence
  Description of Artificial Sequence: Synthetic oligonucleotide
catgaggtatttcgacaccgccgtgtcc

SEQ ID NO: 33736 - DNA, 28 bp, Artificial Sequence
  Description of Artificial Sequence: Synthetic oligonucleotide
atgaggtatttcgacaccgccgtgtccc

SEQ ID NO: 33737 - DNA, 27 bp, Artificial Sequence
  Description of Artificial Sequence: Synthetic oligonucleotide
tgaggtatttcgacaccgccgtgtccc

SEQ ID NO: 33738 - DNA, 26 bp, Artificial Sequence
  Description of Artificial Sequence: Synthetic oligonucleotide
gaggtatttcgacaccgccgtgtccc

SEQ ID NO: 33739 - DNA, 26 bp, Artificial Sequence
  Description of Artificial Sequence: Synthetic oligonucleotide
aggtatttcgacaccgccgtgtcccg

SEQ ID NO: 33740 - DNA, 25 bp, Artificial Sequence
  Description of Artificial Sequence: Synthetic oligonucleotide
ggtatttcgacaccgccgtgtcccg

SEQ ID NO: 33741 - DNA, 25 bp, Artificial Sequence
  Description of Artificial Sequence: Synthetic oligonucleotide
gtatttcgacaccgccgtgtcccgg

SEQ ID NO: 33742 - DNA, 25 bp, Artificial Sequence
  Description of Artificial Sequence: Synthetic oligonucleotide
tatttcgacaccgccgtgtcccggc

SEQ ID NO: 33743 - DNA, 24 bp, Artificial Sequence
  Description of Artificial Sequence: Synthetic oligonucleotide
atttcgacaccgccgtgtcccggc

SEQ ID NO: 33744 - DNA, 23 bp, Artificial Sequence
  Description of Artificial Sequence: Synthetic oligonucleotide
tttcgacaccgccgtgtcccggc

SEQ ID NO: 33745 - DNA, 22 bp, Artificial Sequence
  Description of Artificial Sequence: Synthetic oligonucleotide
ttcgacaccgccgtgtcccggc

SEQ ID NO: 33746 - DNA, 21 bp, Artificial Sequence
  Description of Artificial Sequence: Synthetic oligonucleotide
tcgacaccgccgtgtcccggc

SEQ ID NO: 33747 - DNA, 20 bp, Artificial Sequence
  Description of Artificial Sequence: Synthetic oligonucleotide
cgacaccgccgtgtcccggc

SEQ ID NO: 33748 - DNA, 20 bp, Artificial Sequence
  Description of Artificial Sequence: Synthetic oligonucleotide
gacaccgccgtgtcccggcc

SEQ ID NO: 33749 - DNA, 24 bp, Artificial Sequence
  Description of Artificial Sequence: Synthetic oligonucleotide
aggccgggtctcacaccctccaca

SEQ ID NO: 33750 - DNA, 23 bp, Artificial Sequence
  Description of Artificial Sequence: Synthetic oligonucleotide
ggccgggtctcacaccctccaca

SEQ ID NO: 33751 - DNA, 23 bp, Artificial Sequence
  Description of Artificial Sequence: Synthetic oligonucleotide
gccgggtctcacaccctccacag

SEQ ID NO: 33752 - DNA, 25 bp, Artificial Sequence
  Description of Artificial Sequence: Synthetic oligonucleotide
ccgggtctcacaccctccacaggat

SEQ ID NO: 33753 - DNA, 27 bp, Artificial Sequence
  Description of Artificial Sequence: Synthetic oligonucleotide
cgggtctcacaccctccacaggatgta

SEQ ID NO: 33754 - DNA, 27 bp, Artificial Sequence
  Description of Artificial Sequence: Synthetic oligonucleotide
gggtctcacaccctccacaggatgtac

SEQ ID NO: 33755 - DNA, 27 bp, Artificial Sequence
  Description of Artificial Sequence: Synthetic oligonucleotide
ggtctcacaccctccacaggatgtacg

SEQ ID NO: 33756 - DNA, 27 bp, Artificial Sequence
  Description of Artificial Sequence: Synthetic oligonucleotide
gtctcacaccctccacaggatgtacgg

SEQ ID NO: 33757 - DNA, 27 bp, Artificial Sequence
  Description of Artificial Sequence: Synthetic oligonucleotide
tctcacaccctccacaggatgtacggc

SEQ ID NO: 33758 - DNA, 27 bp, Artificial Sequence
  Description of Artificial Sequence: Synthetic oligonucleotide
ctcacaccctccacaggatgtacggct

SEQ ID NO: 33759 - DNA, 27 bp, Artificial Sequence
  Description of Artificial Sequence: Synthetic oligonucleotide
tcacaccctccacaggatgtacggctg

SEQ ID NO: 33760 - DNA, 26 bp, Artificial Sequence
  Description of Artificial Sequence: Synthetic oligonucleotide
cacaccctccacaggatgtacggctg

SEQ ID NO: 33761 - DNA, 26 bp, Artificial Sequence
  Description of Artificial Sequence: Synthetic oligonucleotide
acaccctccacaggatgtacggctgc

SEQ ID NO: 33762 - DNA, 25 bp, Artificial Sequence
  Description of Artificial Sequence: Synthetic oligonucleotide
caccctccacaggatgtacggctgc

SEQ ID NO: 33763 - DNA, 26 bp, Artificial Sequence
  Description of Artificial Sequence: Synthetic oligonucleotide
accctccacaggatgtacggctgcga

SEQ ID NO: 33764 - DNA, 25 bp, Artificial Sequence
  Description of Artificial Sequence: Synthetic oligonucleotide
ccctccacaggatgtacggctgcga

SEQ ID NO: 33765 - DNA, 25 bp, Artificial Sequence
  Description of Artificial Sequence: Synthetic oligonucleotide
cctccacaggatgtacggctgcgac

SEQ ID NO: 33766 - DNA, 26 bp, Artificial Sequence
  Description of Artificial Sequence: Synthetic oligonucleotide
ctccacaggatgtacggctgcgacgt

SEQ ID NO: 33767 - DNA, 26 bp, Artificial Sequence
  Description of Artificial Sequence: Synthetic oligonucleotide
tccacaggatgtacggctgcgacgtg

SEQ ID NO: 33768 - DNA, 25 bp, Artificial Sequence
  Description of Artificial Sequence: Synthetic oligonucleotide
ccacaggatgtacggctgcgacgtg

SEQ ID NO: 33769 - DNA, 25 bp, Artificial Sequence
  Description of Artificial Sequence: Synthetic oligonucleotide
cacaggatgtacggctgcgacgtgg

SEQ ID NO: 33770 - DNA, 25 bp, Artificial Sequence
  Description of Artificial Sequence: Synthetic oligonucleotide
acaggatgtacggctgcgacgtggg

SEQ ID NO: 33771 - DNA, 24 bp, Artificial Sequence
  Description of Artificial Sequence: Synthetic oligonucleotide
caggatgtacggctgcgacgtggg

SEQ ID NO: 33772 - DNA, 27 bp, Artificial Sequence
  Description of Artificial Sequence: Synthetic oligonucleotide
cgcctcctccgcgggtataaccagtta

SEQ ID NO: 33773 - DNA, 27 bp, Artificial Sequence
  Description of Artificial Sequence: Synthetic oligonucleotide
gcctcctccgcgggtataaccagttag

SEQ ID NO: 33774 - DNA, 27 bp, Artificial Sequence
  Description of Artificial Sequence: Synthetic oligonucleotide
cctcctccgcgggtataaccagttagc

SEQ ID NO: 33775 - DNA, 27 bp, Artificial Sequence
  Description of Artificial Sequence: Synthetic oligonucleotide
ctcctccgcgggtataaccagttagcc

SEQ ID NO: 33776 - DNA, 29 bp, Artificial Sequence
  Description of Artificial Sequence: Synthetic oligonucleotide
tcctccgcgggtataaccagttagcctac

SEQ ID NO: 33777 - DNA, 28 bp, Artificial Sequence
  Description of Artificial Sequence: Synthetic oligonucleotide
cctccgcgggtataaccagttagcctac

SEQ ID NO: 33778 - DNA, 28 bp, Artificial Sequence
  Description of Artificial Sequence: Synthetic oligonucleotide
ctccgcgggtataaccagttagcctacg

SEQ ID NO: 33779 - DNA, 29 bp, Artificial Sequence
  Description of Artificial Sequence: Synthetic oligonucleotide
tccgcgggtataaccagttagcctacgac

SEQ ID NO: 33780 - DNA, 28 bp, Artificial Sequence
  Description of Artificial Sequence: Synthetic oligonucleotide
ccgcgggtataaccagttagcctacgac

SEQ ID NO: 33781 - DNA, 28 bp, Artificial Sequence
  Description of Artificial Sequence: Synthetic oligonucleotide
cgcgggtataaccagttagcctacgacg

SEQ ID NO: 33782 - DNA, 28 bp, Artificial Sequence
  Description of Artificial Sequence: Synthetic oligonucleotide
gcgggtataaccagttagcctacgacgg

SEQ ID NO: 33783 - DNA, 28 bp, Artificial Sequence
  Description of Artificial Sequence: Synthetic oligonucleotide
cgggtataaccagttagcctacgacggc

SEQ ID NO: 33784 - DNA, 30 bp, Artificial Sequence
  Description of Artificial Sequence: Synthetic oligonucleotide
gggtataaccagttagcctacgacggcaag

SEQ ID NO: 33785 - DNA, 30 bp, Artificial Sequence
  Description of Artificial Sequence: Synthetic oligonucleotide
ggtataaccagttagcctacgacggcaagg

SEQ ID NO: 33786 - DNA, 34 bp, Artificial Sequence
  Description of Artificial Sequence: Synthetic oligonucleotide
gtataaccagttagcctacgacggcaaggattac

SEQ ID NO: 33787 - DNA, 36 bp, Artificial Sequence
  Description of Artificial Sequence: Synthetic oligonucleotide
tataaccagttagcctacgacggcaaggattacatc

SEQ ID NO: 33788 - DNA, 24 bp, Artificial Sequence
  Description of Artificial Sequence: Synthetic oligonucleotide
cccgtgaggcggagcagtggagaa

SEQ ID NO: 33789 - DNA, 24 bp, Artificial Sequence
  Description of Artificial Sequence: Synthetic oligonucleotide
ccgtgaggcggagcagtggagaac

SEQ ID NO: 33790 - DNA, 26 bp, Artificial Sequence
  Description of Artificial Sequence: Synthetic oligonucleotide
cgtgaggcggagcagtggagaaccta

SEQ ID NO: 33791 - DNA, 26 bp, Artificial Sequence
  Description of Artificial Sequence: Synthetic oligonucleotide
gtgaggcggagcagtggagaacctac

SEQ ID NO: 33792 - DNA, 27 bp, Artificial Sequence
  Description of Artificial Sequence: Synthetic oligonucleotide
tgaggcggagcagtggagaacctacct

SEQ ID NO: 33793 - DNA, 26 bp, Artificial Sequence
  Description of Artificial Sequence: Synthetic oligonucleotide
gaggcggagcagtggagaacctacct

SEQ ID NO: 33794 - DNA, 26 bp, Artificial Sequence
  Description of Artificial Sequence: Synthetic oligonucleotide
aggcggagcagtggagaacctacctg

SEQ ID NO: 33795 - DNA, 25 bp, Artificial Sequence
  Description of Artificial Sequence: Synthetic oligonucleotide
ggcggagcagtggagaacctacctg

SEQ ID NO: 33796 - DNA, 26 bp, Artificial Sequence
  Description of Artificial Sequence: Synthetic oligonucleotide
gcggagcagtggagaacctacctgga

SEQ ID NO: 33797 - DNA, 26 bp, Artificial Sequence
  Description of Artificial Sequence: Synthetic oligonucleotide
cggagcagtggagaacctacctggag

SEQ ID NO: 33798 - DNA, 26 bp, Artificial Sequence
  Description of Artificial Sequence: Synthetic oligonucleotide
ggagcagtggagaacctacctggagg

SEQ ID NO: 33799 - DNA, 26 bp, Artificial Sequence
  Description of Artificial Sequence: Synthetic oligonucleotide
gagcagtggagaacctacctggaggg

SEQ ID NO: 33800 - DNA, 27 bp, Artificial Sequence
  Description of Artificial Sequence: Synthetic oligonucleotide
agcagtggagaacctacctggagggca

SEQ ID NO: 33801 - DNA, 26 bp, Artificial Sequence
  Description of Artificial Sequence: Synthetic oligonucleotide
gcagtggagaacctacctggagggca

SEQ ID NO: 33802 - DNA, 26 bp, Artificial Sequence
  Description of Artificial Sequence: Synthetic oligonucleotide
cagtggagaacctacctggagggcac

SEQ ID NO: 33803 - DNA, 27 bp, Artificial Sequence
  Description of Artificial Sequence: Synthetic oligonucleotide
agtggagaacctacctggagggcacgt

SEQ ID NO: 33804 - DNA, 26 bp, Artificial Sequence
  Description of Artificial Sequence: Synthetic oligonucleotide
gtggagaacctacctggagggcacgt

SEQ ID NO: 33805 - DNA, 26 bp, Artificial Sequence
  Description of Artificial Sequence: Synthetic oligonucleotide
tggagaacctacctggagggcacgtg

SEQ ID NO: 33806 - DNA, 36 bp, Artificial Sequence
  Description of Artificial Sequence: Synthetic oligonucleotide
atctacaagaccaacacacagacttaccgagagaac

SEQ ID NO: 33807 - DNA, 35 bp, Artificial Sequence
  Description of Artificial Sequence: Synthetic oligonucleotide
tctacaagaccaacacacagacttaccgagagaac

SEQ ID NO: 33808 - DNA, 34 bp, Artificial Sequence
  Description of Artificial Sequence: Synthetic oligonucleotide
ctacaagaccaacacacagacttaccgagagaac

SEQ ID NO: 33809 - DNA, 34 bp, Artificial Sequence
  Description of Artificial Sequence: Synthetic oligonucleotide
tacaagaccaacacacagacttaccgagagaacc

SEQ ID NO: 33810 - DNA, 33 bp, Artificial Sequence
  Description of Artificial Sequence: Synthetic oligonucleotide
acaagaccaacacacagacttaccgagagaacc

SEQ ID NO: 33811 - DNA, 30 bp, Artificial Sequence
  Description of Artificial Sequence: Synthetic oligonucleotide
ggaatattgggaccgggagacacagatctg

SEQ ID NO: 33812 - DNA, 30 bp, Artificial Sequence
  Description of Artificial Sequence: Synthetic oligonucleotide
gaatattgggaccgggagacacagatctgc

SEQ ID NO: 33813 - DNA, 32 bp, Artificial Sequence
  Description of Artificial Sequence: Synthetic oligonucleotide
aatattgggaccgggagacacagatctgcaag

SEQ ID NO: 33814 - DNA, 31 bp, Artificial Sequence
  Description of Artificial Sequence: Synthetic oligonucleotide
atattgggaccgggagacacagatctgcaag

SEQ ID NO: 33815 - DNA, 23 bp, Artificial Sequence
  Description of Artificial Sequence: Synthetic oligonucleotide
ggacaccgcggctcagatcaccc

SEQ ID NO: 33816 - DNA, 23 bp, Artificial Sequence
  Description of Artificial Sequence: Synthetic oligonucleotide
gacaccgcggctcagatcacccg

SEQ ID NO: 33817 - DNA, 23 bp, Artificial Sequence
  Description of Artificial Sequence: Synthetic oligonucleotide
acaccgcggctcagatcacccgg

SEQ ID NO: 33818 - DNA, 22 bp, Artificial Sequence
  Description of Artificial Sequence: Synthetic oligonucleotide
caccgcggctcagatcacccgg

SEQ ID NO: 33819 - DNA, 22 bp, Artificial Sequence
  Description of Artificial Sequence: Synthetic oligonucleotide
accgcggctcagatcacccggc

SEQ ID NO: 33820 - DNA, 21 bp, Artificial Sequence
  Description of Artificial Sequence: Synthetic oligonucleotide
ccgcggctcagatcacccggc

SEQ ID NO: 33821 - DNA, 21 bp, Artificial Sequence
  Description of Artificial Sequence: Synthetic oligonucleotide
cgcggctcagatcacccggcg

SEQ ID NO: 33822 - DNA, 24 bp, Artificial Sequence
  Description of Artificial Sequence: Synthetic oligonucleotide
ccgggtctcacaccctccagagca

SEQ ID NO: 33823 - DNA, 24 bp, Artificial Sequence
  Description of Artificial Sequence: Synthetic oligonucleotide
cgggtctcacaccctccagagcac

SEQ ID NO: 33824 - DNA, 26 bp, Artificial Sequence
  Description of Artificial Sequence: Synthetic oligonucleotide
gggtctcacaccctccagagcacgta

SEQ ID NO: 33825 - DNA, 26 bp, Artificial Sequence
  Description of Artificial Sequence: Synthetic oligonucleotide
ggtctcacaccctccagagcacgtac

SEQ ID NO: 33826 - DNA, 26 bp, Artificial Sequence
  Description of Artificial Sequence: Synthetic oligonucleotide
gtctcacaccctccagagcacgtacg

SEQ ID NO: 33827 - DNA, 26 bp, Artificial Sequence
  Description of Artificial Sequence: Synthetic oligonucleotide
tctcacaccctccagagcacgtacgg

SEQ ID NO: 33828 - DNA, 25 bp, Artificial Sequence
  Description of Artificial Sequence: Synthetic oligonucleotide
ctcacaccctccagagcacgtacgg

SEQ ID NO: 33829 - DNA, 26 bp, Artificial Sequence
  Description of Artificial Sequence: Synthetic oligonucleotide
tcacaccctccagagcacgtacggct

SEQ ID NO: 33830 - DNA, 25 bp, Artificial Sequence
  Description of Artificial Sequence: Synthetic oligonucleotide
cacaccctccagagcacgtacggct

SEQ ID NO: 33831 - DNA, 25 bp, Artificial Sequence
  Description of Artificial Sequence: Synthetic oligonucleotide
acaccctccagagcacgtacggctg

SEQ ID NO: 33832 - DNA, 24 bp, Artificial Sequence
  Description of Artificial Sequence: Synthetic oligonucleotide
caccctccagagcacgtacggctg

SEQ ID NO: 33833 - DNA, 24 bp, Artificial Sequence
  Description of Artificial Sequence: Synthetic oligonucleotide
accctccagagcacgtacggctgc

SEQ ID NO: 33834 - DNA, 23 bp, Artificial Sequence
  Description of Artificial Sequence: Synthetic oligonucleotide
ccctccagagcacgtacggctgc

SEQ ID NO: 33835 - DNA, 24 bp, Artificial Sequence
  Description of Artificial Sequence: Synthetic oligonucleotide
cctccagagcacgtacggctgcga

SEQ ID NO: 33836 - DNA, 24 bp, Artificial Sequence
  Description of Artificial Sequence: Synthetic oligonucleotide
ctccagagcacgtacggctgcgac

SEQ ID NO: 33837 - DNA, 25 bp, Artificial Sequence
  Description of Artificial Sequence: Synthetic oligonucleotide
tccagagcacgtacggctgcgacgt

SEQ ID NO: 33838 - DNA, 24 bp, Artificial Sequence
  Description of Artificial Sequence: Synthetic oligonucleotide
ccagagcacgtacggctgcgacgt

SEQ ID NO: 33839 - DNA, 24 bp, Artificial Sequence
  Description of Artificial Sequence: Synthetic oligonucleotide
cagagcacgtacggctgcgacgtg

SEQ ID NO: 33840 - DNA, 24 bp, Artificial Sequence
  Description of Artificial Sequence: Synthetic oligonucleotide
agagcacgtacggctgcgacgtgg

SEQ ID NO: 33841 - DNA, 23 bp, Artificial Sequence
  Description of Artificial Sequence: Synthetic oligonucleotide
gagcacgtacggctgcgacgtgg

SEQ ID NO: 33842 - DNA, 23 bp, Artificial Sequence
  Description of Artificial Sequence: Synthetic oligonucleotide
agcacgtacggctgcgacgtggg

SEQ ID NO: 33843 - DNA, 22 bp, Artificial Sequence
  Description of Artificial Sequence: Synthetic oligonucleotide
gcacgtacggctgcgacgtggg

SEQ ID NO: 33844 - DNA, 22 bp, Artificial Sequence
  Description of Artificial Sequence: Synthetic oligonucleotide
cacgtacggctgcgacgtgggg

SEQ ID NO: 33845 - DNA, 20 bp, Artificial Sequence
  Description of Artificial Sequence: Synthetic oligonucleotide
ggacgggcgcctcctccggt

SEQ ID NO: 33846 - DNA, 20 bp, Artificial Sequence
  Description of Artificial Sequence: Synthetic oligonucleotide
gacgggcgcctcctccgggt

SEQ ID NO: 33847 - DNA, 23 bp, Artificial Sequence
  Description of Artificial Sequence: Synthetic oligonucleotide
acgggcgcctcctccgggcataa

SEQ ID NO: 33848 - DNA, 22 bp, Artificial Sequence
  Description of Artificial Sequence: Synthetic oligonucleotide
cgggcgcctcctccgggcataa

SEQ ID NO: 33849 - DNA, 22 bp, Artificial Sequence
  Description of Artificial Sequence: Synthetic oligonucleotide
gggcgcctcctccgggcataac

SEQ ID NO: 33850 - DNA, 23 bp, Artificial Sequence
  Description of Artificial Sequence: Synthetic oligonucleotide
ggcgcctcctccgggcataacca

SEQ ID NO: 33851 - DNA, 25 bp, Artificial Sequence
  Description of Artificial Sequence: Synthetic oligonucleotide
gcgcctcctccgggcataaccagtt

SEQ ID NO: 33852 - DNA, 25 bp, Artificial Sequence
  Description of Artificial Sequence: Synthetic oligonucleotide
cgcctcctccgggcataaccagttc

SEQ ID NO: 33853 - DNA, 25 bp, Artificial Sequence
  Description of Artificial Sequence: Synthetic oligonucleotide
gcctcctccgggcataaccagttcg

SEQ ID NO: 33854 - DNA, 25 bp, Artificial Sequence
  Description of Artificial Sequence: Synthetic oligonucleotide
cctcctccgggcataaccagttcgc

SEQ ID NO: 33855 - DNA, 27 bp, Artificial Sequence
  Description of Artificial Sequence: Synthetic oligonucleotide
ctcctccgggcataaccagttcgccta

SEQ ID NO: 33856 - DNA, 27 bp, Artificial Sequence
  Description of Artificial Sequence: Synthetic oligonucleotide
tcctccgggcataaccagttcgcctac

SEQ ID NO: 33857 - DNA, 26 bp, Artificial Sequence
  Description of Artificial Sequence: Synthetic oligonucleotide
cctccgggcataaccagttcgcctac

SEQ ID NO: 33858 - DNA, 27 bp, Artificial Sequence
  Description of Artificial Sequence: Synthetic oligonucleotide
ctccgggcataaccagttcgcctacga

SEQ ID NO: 33859 - DNA, 27 bp, Artificial Sequence
  Description of Artificial Sequence: Synthetic oligonucleotide
tccgggcataaccagttcgcctacgac

SEQ ID NO: 33860 - DNA, 26 bp, Artificial Sequence
  Description of Artificial Sequence: Synthetic oligonucleotide
ccgggcataaccagttcgcctacgac

SEQ ID NO: 33861 - DNA, 23 bp, Artificial Sequence
  Description of Artificial Sequence: Synthetic oligonucleotide
agcgcaagtgggaggcggccctt

SEQ ID NO: 33862 - DNA, 22 bp, Artificial Sequence
  Description of Artificial Sequence: Synthetic oligonucleotide
gcgcaagtgggaggcggccctt

SEQ ID NO: 33863 - DNA, 23 bp, Artificial Sequence
  Description of Artificial Sequence: Synthetic oligonucleotide
cgcaagtgggaggcggcccttgt

SEQ ID NO: 33864 - DNA, 23 bp, Artificial Sequence
  Description of Artificial Sequence: Synthetic oligonucleotide
gcaagtgggaggcggcccttgtg

SEQ ID NO: 33865 - DNA, 21 bp, Artificial Sequence
  Description of Artificial Sequence: Synthetic oligonucleotide
gcggcccttgtggcggagcag

SEQ ID NO: 33866 - DNA, 22 bp, Artificial Sequence
  Description of Artificial Sequence: Synthetic oligonucleotide
cggcccttgtggcggagcagct

SEQ ID NO: 33867 - DNA, 23 bp, Artificial Sequence
  Description of Artificial Sequence: Synthetic oligonucleotide
ggcccttgtggcggagcagctga

SEQ ID NO: 33868 - DNA, 25 bp, Artificial Sequence
  Description of Artificial Sequence: Synthetic oligonucleotide
gcccttgtggcggagcagctgagaa

SEQ ID NO: 33869 - DNA, 25 bp, Artificial Sequence
  Description of Artificial Sequence: Synthetic oligonucleotide
cccttgtggcggagcagctgagaac

SEQ ID NO: 33870 - DNA, 27 bp, Artificial Sequence
  Description of Artificial Sequence: Synthetic oligonucleotide
ccttgtggcggagcagctgagaaccta

SEQ ID NO: 33871 - DNA, 27 bp, Artificial Sequence
  Description of Artificial Sequence: Synthetic oligonucleotide
cttgtggcggagcagctgagaacctac

SEQ ID NO: 33872 - DNA, 27 bp, Artificial Sequence
  Description of Artificial Sequence: Synthetic oligonucleotide
ttgtggcggagcagctgagaacctacc

SEQ ID NO: 33873 - DNA, 30 bp, Artificial Sequence
  Description of Artificial Sequence: Synthetic oligonucleotide
tgcaagaccaacacacagactgaccgagtg

SEQ ID NO: 33874 - DNA, 29 bp, Artificial Sequence
  Description of Artificial Sequence: Synthetic oligonucleotide
gcaagaccaacacacagactgaccgagtg

SEQ ID NO: 33875 - DNA, 27 bp, Artificial Sequence
  Description of Artificial Sequence: Synthetic oligonucleotide
gctgagaacctacctggagggcacgtt

SEQ ID NO: 33876 - DNA, 27 bp, Artificial Sequence
  Description of Artificial Sequence: Synthetic oligonucleotide
ctgagaacctacctggagggcacgttc

SEQ ID NO: 33877 - DNA, 27 bp, Artificial Sequence
  Description of Artificial Sequence: Synthetic oligonucleotide
tgagaacctacctggagggcacgttcg

SEQ ID NO: 33878 - DNA, 27 bp, Artificial Sequence
  Description of Artificial Sequence: Synthetic oligonucleotide
gagaacctacctggagggcacgttcgt

SEQ ID NO: 33879 - DNA, 27 bp, Artificial Sequence
  Description of Artificial Sequence: Synthetic oligonucleotide
agaacctacctggagggcacgttcgtg

SEQ ID NO: 33880 - DNA, 26 bp, Artificial Sequence
  Description of Artificial Sequence: Synthetic oligonucleotide
gaacctacctggagggcacgttcgtg

SEQ ID NO: 33881 - DNA, 27 bp, Artificial Sequence
  Description of Artificial Sequence: Synthetic oligonucleotide
aacctacctggagggcacgttcgtgga

SEQ ID NO: 33882 - DNA, 26 bp, Artificial Sequence
  Description of Artificial Sequence: Synthetic oligonucleotide
acctacctggagggcacgttcgtgga

SEQ ID NO: 33883 - DNA, 25 bp, Artificial Sequence
  Description of Artificial Sequence: Synthetic oligonucleotide
cctacctggagggcacgttcgtgga

SEQ ID NO: 33884 - DNA, 26 bp, Artificial Sequence
  Description of Artificial Sequence: Synthetic oligonucleotide
ctacctggagggcacgttcgtggagt

SEQ ID NO: 33885 - DNA, 26 bp, Artificial Sequence
  Description of Artificial Sequence: Synthetic oligonucleotide
tacctggagggcacgttcgtggagtg

SEQ ID NO: 33886 - DNA, 25 bp, Artificial Sequence
  Description of Artificial Sequence: Synthetic oligonucleotide
acctggagggcacgttcgtggagtg

SEQ ID NO: 33887 - DNA, 24 bp, Artificial Sequence
  Description of Artificial Sequence: Synthetic oligonucleotide
cctggagggcacgttcgtggagtg

SEQ ID NO: 33888 - DNA, 24 bp, Artificial Sequence
  Description of Artificial Sequence: Synthetic oligonucleotide
ctggagggcacgttcgtggagtgg

SEQ ID NO: 33889 - DNA, 25 bp, Artificial Sequence
  Description of Artificial Sequence: Synthetic oligonucleotide
tggagggcacgttcgtggagtggct

SEQ ID NO: 33890 - DNA, 24 bp, Artificial Sequence
  Description of Artificial Sequence: Synthetic oligonucleotide
ggagggcacgttcgtggagtggct

SEQ ID NO: 33891 - DNA, 24 bp, Artificial Sequence
  Description of Artificial Sequence: Synthetic oligonucleotide
gagggcacgttcgtggagtggctc

SEQ ID NO: 33892 - DNA, 24 bp, Artificial Sequence
  Description of Artificial Sequence: Synthetic oligonucleotide
agggcacgttcgtggagtggctcc

SEQ ID NO: 33893 - DNA, 23 bp, Artificial Sequence
  Description of Artificial Sequence: Synthetic oligonucleotide
gggcacgttcgtggagtggctcc

SEQ ID NO: 33894 - DNA, 23 bp, Artificial Sequence
  Description of Artificial Sequence: Synthetic oligonucleotide
ggcacgttcgtggagtggctccg

SEQ ID NO: 33895 - DNA, 24 bp, Artificial Sequence
  Description of Artificial Sequence: Synthetic oligonucleotide
gcacgttcgtggagtggctccgca

SEQ ID NO: 33896 - DNA, 27 bp, Artificial Sequence
  Description of Artificial Sequence: Synthetic oligonucleotide
cacgttcgtggagtggctccgcagata

SEQ ID NO: 33897 - DNA, 27 bp, Artificial Sequence
  Description of Artificial Sequence: Synthetic oligonucleotide
acgttcgtggagtggctccgcagatac

SEQ ID NO: 33898 - DNA, 26 bp, Artificial Sequence
  Description of Artificial Sequence: Synthetic oligonucleotide
cgttcgtggagtggctccgcagatac

SEQ ID NO: 33899 - DNA, 31 bp, Artificial Sequence
  Description of Artificial Sequence: Synthetic oligonucleotide
cggaatattgggaccggaacacacagatctc

SEQ ID NO: 33900 - DNA, 31 bp, Artificial Sequence
  Description of Artificial Sequence: Synthetic oligonucleotide
ggaatattgggaccggaacacacagatctcc

SEQ ID NO: 33901 - DNA, 33 bp, Artificial Sequence
  Description of Artificial Sequence: Synthetic oligonucleotide
gaatattgggaccggaacacacagatctccaag

SEQ ID NO: 33902 - DNA, 34 bp, Artificial Sequence
  Description of Artificial Sequence: Synthetic oligonucleotide
aatattgggaccggaacacacagatctccaagac

SEQ ID NO: 33903 - DNA, 33 bp, Artificial Sequence
  Description of Artificial Sequence: Synthetic oligonucleotide
atattgggaccggaacacacagatctccaagac

SEQ ID NO: 33904 - DNA, 27 bp, Artificial Sequence
  Description of Artificial Sequence: Synthetic oligonucleotide
ctgagaacctacctggagggcacgtga

SEQ ID NO: 33905 - DNA, 27 bp, Artificial Sequence
  Description of Artificial Sequence: Synthetic oligonucleotide
tgagaacctacctggagggcacgtgag

SEQ ID NO: 33906 - DNA, 27 bp, Artificial Sequence
  Description of Artificial Sequence: Synthetic oligonucleotide
gagaacctacctggagggcacgtgagt

SEQ ID NO: 33907 - DNA, 27 bp, Artificial Sequence
  Description of Artificial Sequence: Synthetic oligonucleotide
agaacctacctggagggcacgtgagtg

SEQ ID NO: 33908 - DNA, 26 bp, Artificial Sequence
  Description of Artificial Sequence: Synthetic oligonucleotide
gaacctacctggagggcacgtgagtg

SEQ ID NO: 33909 - DNA, 27 bp, Artificial Sequence
  Description of Artificial Sequence: Synthetic oligonucleotide
aacctacctggagggcacgtgagtgga

SEQ ID NO: 33910 - DNA, 26 bp, Artificial Sequence
  Description of Artificial Sequence: Synthetic oligonucleotide
acctacctggagggcacgtgagtgga

SEQ ID NO: 33911 - DNA, 28 bp, Artificial Sequence
  Description of Artificial Sequence: Synthetic oligonucleotide
tggatagagcaggaggggccggaatatc

SEQ ID NO: 33912 - DNA, 27 bp, Artificial Sequence
  Description of Artificial Sequence: Synthetic oligonucleotide
ggatagagcaggaggggccggaatatc

SEQ ID NO: 33913 - DNA, 27 bp, Artificial Sequence
  Description of Artificial Sequence: Synthetic oligonucleotide
gatagagcaggaggggccggaatatcg

SEQ ID NO: 33914 - DNA, 27 bp, Artificial Sequence
  Description of Artificial Sequence: Synthetic oligonucleotide
atagagcaggaggggccggaatatcgg

SEQ ID NO: 33915 - DNA, 26 bp, Artificial Sequence
  Description of Artificial Sequence: Synthetic oligonucleotide
tagagcaggaggggccggaatatcgg

SEQ ID NO: 33916 - DNA, 25 bp, Artificial Sequence
  Description of Artificial Sequence: Synthetic oligonucleotide
agagcaggaggggccggaatatcgg

SEQ ID NO: 33917 - DNA, 24 bp, Artificial Sequence
  Description of Artificial Sequence: Synthetic oligonucleotide
gagcaggaggggccggaatatcgg

SEQ ID NO: 33918 - DNA, 25 bp, Artificial Sequence
  Description of Artificial Sequence: Synthetic oligonucleotide
agcaggaggggccggaatatcggga

SEQ ID NO: 33919 - DNA, 24 bp, Artificial Sequence
  Description of Artificial Sequence: Synthetic oligonucleotide
gcaggaggggccggaatatcggga

SEQ ID NO: 33920 - DNA, 24 bp, Artificial Sequence
  Description of Artificial Sequence: Synthetic oligonucleotide
caggaggggccggaatatcgggac

SEQ ID NO: 33921 - DNA, 24 bp, Artificial Sequence
  Description of Artificial Sequence: Synthetic oligonucleotide
aggaggggccggaatatcgggacc

SEQ ID NO: 33922 - DNA, 23 bp, Artificial Sequence
  Description of Artificial Sequence: Synthetic oligonucleotide
ggaggggccggaatatcgggacc

SEQ ID NO: 33923 - DNA, 23 bp, Artificial Sequence
  Description of Artificial Sequence: Synthetic oligonucleotide
gaggggccggaatatcgggaccg

SEQ ID NO: 33924 - DNA, 25 bp, Artificial Sequence
  Description of Artificial Sequence: Synthetic oligonucleotide
aggggccggaatatcgggaccggaa

SEQ ID NO: 33925 - DNA, 24 bp, Artificial Sequence
  Description of Artificial Sequence: Synthetic oligonucleotide
ggggccggaatatcgggaccggaa

SEQ ID NO: 33926 - DNA, 25 bp, Artificial Sequence
  Description of Artificial Sequence: Synthetic oligonucleotide
gggccggaatatcgggaccggaaca

SEQ ID NO: 33927 - DNA, 26 bp, Artificial Sequence
  Description of Artificial Sequence: Synthetic oligonucleotide
ggccggaatatcgggaccggaacaca

SEQ ID NO: 33928 - DNA, 27 bp, Artificial Sequence
  Description of Artificial Sequence: Synthetic oligonucleotide
gccggaatatcgggaccggaacacaca

SEQ ID NO: 33929 - DNA, 27 bp, Artificial Sequence
  Description of Artificial Sequence: Synthetic oligonucleotide
ccggaatatcgggaccggaacacacag

SEQ ID NO: 33930 - DNA, 29 bp, Artificial Sequence
  Description of Artificial Sequence: Synthetic oligonucleotide
cggaatatcgggaccggaacacacagatc

SEQ ID NO: 33931 - DNA, 30 bp, Artificial Sequence
  Description of Artificial Sequence: Synthetic oligonucleotide
ggaatatcgggaccggaacacacagatctg

SEQ ID NO: 33932 - DNA, 30 bp, Artificial Sequence
  Description of Artificial Sequence: Synthetic oligonucleotide
gaatatcgggaccggaacacacagatctgc

SEQ ID NO: 33933 - DNA, 32 bp, Artificial Sequence
  Description of Artificial Sequence: Synthetic oligonucleotide
aatatcgggaccggaacacacagatctgcaag

SEQ ID NO: 33934 - DNA, 31 bp, Artificial Sequence
  Description of Artificial Sequence: Synthetic oligonucleotide
atatcgggaccggaacacacagatctgcaag

SEQ ID NO: 33935 - DNA, 30 bp, Artificial Sequence
  Description of Artificial Sequence: Synthetic oligonucleotide
tatcgggaccggaacacacagatctgcaag

SEQ ID NO: 33936 - DNA, 29 bp, Artificial Sequence
  Description of Artificial Sequence: Synthetic oligonucleotide
atcgggaccggaacacacagatctgcaag

SEQ ID NO: 33937 - DNA, 28 bp, Artificial Sequence
  Description of Artificial Sequence: Synthetic oligonucleotide
tcgggaccggaacacacagatctgcaag

SEQ ID NO: 33938 - DNA, 27 bp, Artificial Sequence
  Description of Artificial Sequence: Synthetic oligonucleotide
cgggaccggaacacacagatctgcaag

SEQ ID NO: 33939 - DNA, 27 bp, Artificial Sequence
  Description of Artificial Sequence: Synthetic oligonucleotide
accccccaaagacacatgtgacccacg

SEQ ID NO: 33940 - DNA, 27 bp, Artificial Sequence
  Description of Artificial Sequence: Synthetic oligonucleotide
ccccccaaagacacatgtgacccacga

SEQ ID NO: 33941 - DNA, 27 bp, Artificial Sequence
  Description of Artificial Sequence: Synthetic oligonucleotide
cccccaaagacacatgtgacccacgac

SEQ ID NO: 33942 - DNA, 27 bp, Artificial Sequence
  Description of Artificial Sequence: Synthetic oligonucleotide
ccccaaagacacatgtgacccacgacc

SEQ ID NO: 33943 - DNA, 27 bp, Artificial Sequence
  Description of Artificial Sequence: Synthetic oligonucleotide
cccaaagacacatgtgacccacgaccc

SEQ ID NO: 33944 - DNA, 27 bp, Artificial Sequence
  Description of Artificial Sequence: Synthetic oligonucleotide
ccaaagacacatgtgacccacgacccc

SEQ ID NO: 33945 - DNA, 29 bp, Artificial Sequence
  Description of Artificial Sequence: Synthetic oligonucleotide
caaagacacatgtgacccacgaccccatc

SEQ ID NO: 33946 - DNA, 30 bp, Artificial Sequence
  Description of Artificial Sequence: Synthetic oligonucleotide
aaagacacatgtgacccacgaccccatctc

SEQ ID NO: 33947 - DNA, 29 bp, Artificial Sequence
  Description of Artificial Sequence: Synthetic oligonucleotide
aagacacatgtgacccacgaccccatctc

SEQ ID NO: 33948 - DNA, 28 bp, Artificial Sequence
  Description of Artificial Sequence: Synthetic oligonucleotide
agacacatgtgacccacgaccccatctc

SEQ ID NO: 33949 - DNA, 27 bp, Artificial Sequence
  Description of Artificial Sequence: Synthetic oligonucleotide
gacacatgtgacccacgaccccatctc

SEQ ID NO: 33950 - DNA, 28 bp, Artificial Sequence
  Description of Artificial Sequence: Synthetic oligonucleotide
acacatgtgacccacgaccccatctctg

SEQ ID NO: 33951 - DNA, 27 bp, Artificial Sequence
  Description of Artificial Sequence: Synthetic oligonucleotide
cacatgtgacccacgaccccatctctg

SEQ ID NO: 33952 - DNA, 28 bp, Artificial Sequence
  Description of Artificial Sequence: Synthetic oligonucleotide
acatgtgacccacgaccccatctctgac

SEQ ID NO: 33953 - DNA, 27 bp, Artificial Sequence
  Description of Artificial Sequence: Synthetic oligonucleotide
catgtgacccacgaccccatctctgac

SEQ ID NO: 33954 - DNA, 27 bp, Artificial Sequence
  Description of Artificial Sequence: Synthetic oligonucleotide
atgtgacccacgaccccatctctgacc

SEQ ID NO: 33955 - DNA, 27 bp, Artificial Sequence
  Description of Artificial Sequence: Synthetic oligonucleotide
tgtgacccacgaccccatctctgacca

SEQ ID NO: 33956 - DNA, 27 bp, Artificial Sequence
  Description of Artificial Sequence: Synthetic oligonucleotide
gtgacccacgaccccatctctgaccat

SEQ ID NO: 33957 - DNA, 27 bp, Artificial Sequence
  Description of Artificial Sequence: Synthetic oligonucleotide
tgacccacgaccccatctctgaccatg

SEQ ID NO: 33958 - DNA, 27 bp, Artificial Sequence
  Description of Artificial Sequence: Synthetic oligonucleotide
gacccacgaccccatctctgaccatga

SEQ ID NO: 33959 - DNA, 27 bp, Artificial Sequence
  Description of Artificial Sequence: Synthetic oligonucleotide
acccacgaccccatctctgaccatgag

SEQ ID NO: 33960 - DNA, 26 bp, Artificial Sequence
  Description of Artificial Sequence: Synthetic oligonucleotide
cccacgaccccatctctgaccatgag

SEQ ID NO: 33961 - DNA, 26 bp, Artificial Sequence
  Description of Artificial Sequence: Synthetic oligonucleotide
ccacgaccccatctctgaccatgagg

SEQ ID NO: 33962 - DNA, 26 bp, Artificial Sequence
  Description of Artificial Sequence: Synthetic oligonucleotide
cacgaccccatctctgaccatgaggc

SEQ ID NO: 33963 - DNA, 27 bp, Artificial Sequence
  Description of Artificial Sequence: Synthetic oligonucleotide
acgaccccatctctgaccatgaggcca

SEQ ID NO: 33964 - DNA, 26 bp, Artificial Sequence
  Description of Artificial Sequence: Synthetic oligonucleotide
cgaccccatctctgaccatgaggcca

SEQ ID NO: 33965 - DNA, 26 bp, Artificial Sequence
  Description of Artificial Sequence: Synthetic oligonucleotide
gaccccatctctgaccatgaggccac

SEQ ID NO: 33966 - DNA, 26 bp, Artificial Sequence
  Description of Artificial Sequence: Synthetic oligonucleotide
cagctgagaacctacctggagggcga

SEQ ID NO: 33967 - DNA, 27 bp, Artificial Sequence
  Description of Artificial Sequence: Synthetic oligonucleotide
agctgagaacctacctggagggcgagt

SEQ ID NO: 33968 - DNA, 26 bp, Artificial Sequence
  Description of Artificial Sequence: Synthetic oligonucleotide
gctgagaacctacctggagggcgagt

SEQ ID NO: 33969 - DNA, 26 bp, Artificial Sequence
  Description of Artificial Sequence: Synthetic oligonucleotide
ctgagaacctacctggagggcgagtg

SEQ ID NO: 33970 - DNA, 26 bp, Artificial Sequence
  Description of Artificial Sequence: Synthetic oligonucleotide
tgagaacctacctggagggcgagtgc

SEQ ID NO: 33971 - DNA, 25 bp, Artificial Sequence
  Description of Artificial Sequence: Synthetic oligonucleotide
gctactacaaccagagcgaggccgc

SEQ ID NO: 33972 - DNA, 26 bp, Artificial Sequence
  Description of Artificial Sequence: Synthetic oligonucleotide
ctactacaaccagagcgaggccgcgt

SEQ ID NO: 33973 - DNA, 27 bp, Artificial Sequence
  Description of Artificial Sequence: Synthetic oligonucleotide
tactacaaccagagcgaggccgcgtct

SEQ ID NO: 33974 - DNA, 26 bp, Artificial Sequence
  Description of Artificial Sequence: Synthetic oligonucleotide
actacaaccagagcgaggccgcgtct

SEQ ID NO: 33975 - DNA, 25 bp, Artificial Sequence
  Description of Artificial Sequence: Synthetic oligonucleotide
ctacaaccagagcgaggccgcgtct

SEQ ID NO: 33976 - DNA, 26 bp, Artificial Sequence
  Description of Artificial Sequence: Synthetic oligonucleotide
tacaaccagagcgaggccgcgtctca

SEQ ID NO: 33977 - DNA, 25 bp, Artificial Sequence
  Description of Artificial Sequence: Synthetic oligonucleotide
acaaccagagcgaggccgcgtctca

SEQ ID NO: 33978 - DNA, 24 bp, Artificial Sequence
  Description of Artificial Sequence: Synthetic oligonucleotide
caaccagagcgaggccgcgtctca

SEQ ID NO: 33979 - DNA, 25 bp, Artificial Sequence
  Description of Artificial Sequence: Synthetic oligonucleotide
aaccagagcgaggccgcgtctcaca

SEQ ID NO: 33980 - DNA, 24 bp, Artificial Sequence
  Description of Artificial Sequence: Synthetic oligonucleotide
accagagcgaggccgcgtctcaca

SEQ ID NO: 33981 - DNA, 23 bp, Artificial Sequence
  Description of Artificial Sequence: Synthetic oligonucleotide
ccagagcgaggccgcgtctcaca

SEQ ID NO: 33982 - DNA, 23 bp, Artificial Sequence
  Description of Artificial Sequence: Synthetic oligonucleotide
cagagcgaggccgcgtctcacac

SEQ ID NO: 33983 - DNA, 23 bp, Artificial Sequence
  Description of Artificial Sequence: Synthetic oligonucleotide
agagcgaggccgcgtctcacacc

SEQ ID NO: 33984 - DNA, 22 bp, Artificial Sequence
  Description of Artificial Sequence: Synthetic oligonucleotide
gagcgaggccgcgtctcacacc

SEQ ID NO: 33985 - DNA, 23 bp, Artificial Sequence
  Description of Artificial Sequence: Synthetic oligonucleotide
agcgaggccgcgtctcacaccct

SEQ ID NO: 33986 - DNA, 22 bp, Artificial Sequence
  Description of Artificial Sequence: Synthetic oligonucleotide
gcgaggccgcgtctcacaccct

SEQ ID NO: 33987 - DNA, 22 bp, Artificial Sequence
  Description of Artificial Sequence: Synthetic oligonucleotide
cgaggccgcgtctcacaccctc

SEQ ID NO: 33988 - DNA, 23 bp, Artificial Sequence
  Description of Artificial Sequence: Synthetic oligonucleotide
gaggccgcgtctcacaccctcca

SEQ ID NO: 33989 - DNA, 24 bp, Artificial Sequence
  Description of Artificial Sequence: Synthetic oligonucleotide
aggccgcgtctcacaccctccaga

SEQ ID NO: 33990 - DNA, 23 bp, Artificial Sequence
  Description of Artificial Sequence: Synthetic oligonucleotide
ggccgcgtctcacaccctccaga

SEQ ID NO: 33991 - DNA, 23 bp, Artificial Sequence
  Description of Artificial Sequence: Synthetic oligonucleotide
gccgcgtctcacaccctccagag

SEQ ID NO: 33992 - DNA, 25 bp, Artificial Sequence
  Description of Artificial Sequence: Synthetic oligonucleotide
ccgcgtctcacaccctccagaggat

SEQ ID NO: 33993 - DNA, 27 bp, Artificial Sequence
  Description of Artificial Sequence: Synthetic oligonucleotide
cgcgtctcacaccctccagaggatgta

SEQ ID NO: 33994 - DNA, 27 bp, Artificial Sequence
  Description of Artificial Sequence: Synthetic oligonucleotide
gcgtctcacaccctccagaggatgtac

SEQ ID NO: 33995 - DNA, 27 bp, Artificial Sequence
  Description of Artificial Sequence: Synthetic oligonucleotide
cgtctcacaccctccagaggatgtacg

SEQ ID NO: 33996 - DNA, 28 bp, Artificial Sequence
  Description of Artificial Sequence: Synthetic oligonucleotide
gaccggaacacacagatctgcaagaccg

SEQ ID NO: 33997 - DNA, 29 bp, Artificial Sequence
  Description of Artificial Sequence: Synthetic oligonucleotide
accggaacacacagatctgcaagaccgac

SEQ ID NO: 33998 - DNA, 28 bp, Artificial Sequence
  Description of Artificial Sequence: Synthetic oligonucleotide
ccggaacacacagatctgcaagaccgac

SEQ ID NO: 33999 - DNA, 29 bp, Artificial Sequence
  Description of Artificial Sequence: Synthetic oligonucleotide
cggaacacacagatctgcaagaccgacac

SEQ ID NO: 34000 - DNA, 30 bp, Artificial Sequence
  Description of Artificial Sequence: Synthetic oligonucleotide
ggaacacacagatctgcaagaccgacacac

SEQ ID NO: 34001 - DNA, 31 bp, Artificial Sequence
  Description of Artificial Sequence: Synthetic oligonucleotide
gaacacacagatctgcaagaccgacacacag

SEQ ID NO: 34002 - DNA, 32 bp, Artificial Sequence
  Description of Artificial Sequence: Synthetic oligonucleotide
aacacacagatctgcaagaccgacacacagac

SEQ ID NO: 34003 - DNA, 31 bp, Artificial Sequence
  Description of Artificial Sequence: Synthetic oligonucleotide
acacacagatctgcaagaccgacacacagac

SEQ ID NO: 34004 - DNA, 30 bp, Artificial Sequence
  Description of Artificial Sequence: Synthetic oligonucleotide
cacacagatctgcaagaccgacacacagac

SEQ ID NO: 34005 - DNA, 31 bp, Artificial Sequence
  Description of Artificial Sequence: Synthetic oligonucleotide
acacagatctgcaagaccgacacacagactg

SEQ ID NO: 34006 - DNA, 30 bp, Artificial Sequence
  Description of Artificial Sequence: Synthetic oligonucleotide
cacagatctgcaagaccgacacacagactg

SEQ ID NO: 34007 - DNA, 31 bp, Artificial Sequence
  Description of Artificial Sequence: Synthetic oligonucleotide
acagatctgcaagaccgacacacagactgac

SEQ ID NO: 34008 - DNA, 30 bp, Artificial Sequence
  Description of Artificial Sequence: Synthetic oligonucleotide
cagatctgcaagaccgacacacagactgac

SEQ ID NO: 34009 - DNA, 30 bp, Artificial Sequence
  Description of Artificial Sequence: Synthetic oligonucleotide
agatctgcaagaccgacacacagactgacc

SEQ ID NO: 34010 - DNA, 29 bp, Artificial Sequence
  Description of Artificial Sequence: Synthetic oligonucleotide
gatctgcaagaccgacacacagactgacc

SEQ ID NO: 34011 - DNA, 29 bp, Artificial Sequence
  Description of Artificial Sequence: Synthetic oligonucleotide
atctgcaagaccgacacacagactgaccg

SEQ ID NO: 34012 - DNA, 28 bp, Artificial Sequence
  Description of Artificial Sequence: Synthetic oligonucleotide
tctgcaagaccgacacacagactgaccg

SEQ ID NO: 34013 - DNA, 27 bp, Artificial Sequence
  Description of Artificial Sequence: Synthetic oligonucleotide
ctgcaagaccgacacacagactgaccg

SEQ ID NO: 34014 - DNA, 28 bp, Artificial Sequence
  Description of Artificial Sequence: Synthetic oligonucleotide
tgcaagaccgacacacagactgaccgag

SEQ ID NO: 34015 - DNA, 27 bp, Artificial Sequence
  Description of Artificial Sequence: Synthetic oligonucleotide
gcaagaccgacacacagactgaccgag

SEQ ID NO: 34016 - DNA, 28 bp, Artificial Sequence
  Description of Artificial Sequence: Synthetic oligonucleotide
caagaccgacacacagactgaccgagag

SEQ ID NO: 34017 - DNA, 29 bp, Artificial Sequence
  Description of Artificial Sequence: Synthetic oligonucleotide
aagaccgacacacagactgaccgagagag

SEQ ID NO: 34018 - DNA, 28 bp, Artificial Sequence
  Description of Artificial Sequence: Synthetic oligonucleotide
agaccgacacacagactgaccgagagag

SEQ ID NO: 34019 - DNA, 27 bp, Artificial Sequence
  Description of Artificial Sequence: Synthetic oligonucleotide
gaccgacacacagactgaccgagagag

SEQ ID NO: 34020 - DNA, 27 bp, Artificial Sequence
  Description of Artificial Sequence: Synthetic oligonucleotide
accgacacacagactgaccgagagagc

SEQ ID NO: 34021 - DNA, 26 bp, Artificial Sequence
  Description of Artificial Sequence: Synthetic oligonucleotide
ccgacacacagactgaccgagagagc

SEQ ID NO: 34022 - DNA, 27 bp, Artificial Sequence
  Description of Artificial Sequence: Synthetic oligonucleotide
cgacacacagactgaccgagagagcct

SEQ ID NO: 34023 - DNA, 27 bp, Artificial Sequence
  Description of Artificial Sequence: Synthetic oligonucleotide
gacacacagactgaccgagagagcctg

SEQ ID NO: 34024 - DNA, 27 bp, Artificial Sequence
  Description of Artificial Sequence: Synthetic oligonucleotide
tgagaacctacctggagggcacgtgca

SEQ ID NO: 34025 - DNA, 27 bp, Artificial Sequence
  Description of Artificial Sequence: Synthetic oligonucleotide
gagaacctacctggagggcacgtgcat

SEQ ID NO: 34026 - DNA, 27 bp, Artificial Sequence
  Description of Artificial Sequence: Synthetic oligonucleotide
agaacctacctggagggcacgtgcatg

SEQ ID NO: 34027 - DNA, 26 bp, Artificial Sequence
  Description of Artificial Sequence: Synthetic oligonucleotide
gaacctacctggagggcacgtgcatg

SEQ ID NO: 34028 - DNA, 27 bp, Artificial Sequence
  Description of Artificial Sequence: Synthetic oligonucleotide
aacctacctggagggcacgtgcatgga

SEQ ID NO: 34029 - DNA, 26 bp, Artificial Sequence
  Description of Artificial Sequence: Synthetic oligonucleotide
acctacctggagggcacgtgcatgga

SEQ ID NO: 34030 - DNA, 22 bp, Artificial Sequence
  Description of Artificial Sequence: Synthetic oligonucleotide
cgcggggagccccgcttcatgt

SEQ ID NO: 34031 - DNA, 23 bp, Artificial Sequence
  Description of Artificial Sequence: Synthetic oligonucleotide
gcggggagccccgcttcatgtca

SEQ ID NO: 34032 - DNA, 24 bp, Artificial Sequence
  Description of Artificial Sequence: Synthetic oligonucleotide
cggggagccccgcttcatgtcagt

SEQ ID NO: 34033 - DNA, 24 bp, Artificial Sequence
  Description of Artificial Sequence: Synthetic oligonucleotide
ggggagccccgcttcatgtcagtg

SEQ ID NO: 34034 - DNA, 24 bp, Artificial Sequence
  Description of Artificial Sequence: Synthetic oligonucleotide
gggagccccgcttcatgtcagtgg

SEQ ID NO: 34035 - DNA, 24 bp, Artificial Sequence
  Description of Artificial Sequence: Synthetic oligonucleotide
ggagccccgcttcatgtcagtggg

SEQ ID NO: 34036 - DNA, 26 bp, Artificial Sequence
  Description of Artificial Sequence: Synthetic oligonucleotide
gagccccgcttcatgtcagtgggcta

SEQ ID NO: 34037 - DNA, 26 bp, Artificial Sequence
  Description of Artificial Sequence: Synthetic oligonucleotide
agccccgcttcatgtcagtgggctac

SEQ ID NO: 34038 - DNA, 25 bp, Artificial Sequence
  Description of Artificial Sequence: Synthetic oligonucleotide
gccccgcttcatgtcagtgggctac

SEQ ID NO: 34039 - DNA, 26 bp, Artificial Sequence
  Description of Artificial Sequence: Synthetic oligonucleotide
ccccgcttcatgtcagtgggctacgt

SEQ ID NO: 34040 - DNA, 26 bp, Artificial Sequence
  Description of Artificial Sequence: Synthetic oligonucleotide
cccgcttcatgtcagtgggctacgtg

SEQ ID NO: 34041 - DNA, 27 bp, Artificial Sequence
  Description of Artificial Sequence: Synthetic oligonucleotide
ccgcttcatgtcagtgggctacgtgga

SEQ ID NO: 34042 - DNA, 27 bp, Artificial Sequence
  Description of Artificial Sequence: Synthetic oligonucleotide
cgcttcatgtcagtgggctacgtggac

SEQ ID NO: 34043 - DNA, 27 bp, Artificial Sequence
  Description of Artificial Sequence: Synthetic oligonucleotide
gcttcatgtcagtgggctacgtggacg

SEQ ID NO: 34044 - DNA, 28 bp, Artificial Sequence
  Description of Artificial Sequence: Synthetic oligonucleotide
cttcatgtcagtgggctacgtggacgac

SEQ ID NO: 34045 - DNA, 29 bp, Artificial Sequence
  Description of Artificial Sequence: Synthetic oligonucleotide
ttcatgtcagtgggctacgtggacgacac

SEQ ID NO: 34046 - DNA, 28 bp, Artificial Sequence
  Description of Artificial Sequence: Synthetic oligonucleotide
tcatgtcagtgggctacgtggacgacac

SEQ ID NO: 34047 - DNA, 27 bp, Artificial Sequence
  Description of Artificial Sequence: Synthetic oligonucleotide
catgtcagtgggctacgtggacgacac

SEQ ID NO: 34048 - DNA, 27 bp, Artificial Sequence
  Description of Artificial Sequence: Synthetic oligonucleotide
atgtcagtgggctacgtggacgacacg

SEQ ID NO: 34049 - DNA, 26 bp, Artificial Sequence
  Description of Artificial Sequence: Synthetic oligonucleotide
tgtcagtgggctacgtggacgacacg

SEQ ID NO: 34050 - DNA, 25 bp, Artificial Sequence
  Description of Artificial Sequence: Synthetic oligonucleotide
gtcagtgggctacgtggacgacacg

SEQ ID NO: 34051 - DNA, 25 bp, Artificial Sequence
  Description of Artificial Sequence: Synthetic oligonucleotide
agatcacccagcgcaagtgggaggg

SEQ ID NO: 34052 - DNA, 24 bp, Artificial Sequence
  Description of Artificial Sequence: Synthetic oligonucleotide
gatcacccagcgcaagtgggaggg

SEQ ID NO: 34053 - DNA, 24 bp, Artificial Sequence
  Description of Artificial Sequence: Synthetic oligonucleotide
atcacccagcgcaagtgggagggg

SEQ ID NO: 34054 - DNA, 23 bp, Artificial Sequence
  Description of Artificial Sequence: Synthetic oligonucleotide
tcacccagcgcaagtgggagggg

SEQ ID NO: 34055 - DNA, 22 bp, Artificial Sequence
  Description of Artificial Sequence: Synthetic oligonucleotide
cacccagcgcaagtgggagggg

SEQ ID NO: 34056 - DNA, 22 bp, Artificial Sequence
  Description of Artificial Sequence: Synthetic oligonucleotide
acccagcgcaagtgggaggggg

SEQ ID NO: 34057 - DNA, 21 bp, Artificial Sequence
  Description of Artificial Sequence: Synthetic oligonucleotide
cccagcgcaagtgggaggggg

SEQ ID NO: 34058 - DNA, 21 bp, Artificial Sequence
  Description of Artificial Sequence: Synthetic oligonucleotide
ccagcgcaagtgggagggggc

SEQ ID NO: 34059 - DNA, 21 bp, Artificial Sequence
  Description of Artificial Sequence: Synthetic oligonucleotide
cagcgcaagtgggagggggcc

SEQ ID NO: 34060 - DNA, 21 bp, Artificial Sequence
  Description of Artificial Sequence: Synthetic oligonucleotide
agcgcaagtgggagggggccc

SEQ ID NO: 34061 - DNA, 20 bp, Artificial Sequence
  Description of Artificial Sequence: Synthetic oligonucleotide
gcgcaagtgggagggggccc

SEQ ID NO: 34062 - DNA, 21 bp, Artificial Sequence
  Description of Artificial Sequence: Synthetic oligonucleotide
cgcaagtgggagggggcccgt

SEQ ID NO: 34063 - DNA, 22 bp, Artificial Sequence
  Description of Artificial Sequence: Synthetic oligonucleotide
gcaagtgggagggggcccgtgt

SEQ ID NO: 34064 - DNA, 22 bp, Artificial Sequence
  Description of Artificial Sequence: Synthetic oligonucleotide
caagtgggagggggcccgtgtg

SEQ ID NO: 34065 - DNA, 22 bp, Artificial Sequence
  Description of Artificial Sequence: Synthetic oligonucleotide
aagtgggagggggcccgtgtgg

SEQ ID NO: 34066 - DNA, 21 bp, Artificial Sequence
  Description of Artificial Sequence: Synthetic oligonucleotide
agtgggagggggcccgtgtgg

SEQ ID NO: 34067 - DNA, 20 bp, Artificial Sequence
  Description of Artificial Sequence: Synthetic oligonucleotide
gtgggagggggcccgtgtgg

SEQ ID NO: 34068 - DNA, 20 bp, Artificial Sequence
  Description of Artificial Sequence: Synthetic oligonucleotide
tgggagggggcccgtgtggc

SEQ ID NO: 34069 - DNA, 20 bp, Artificial Sequence
  Description of Artificial Sequence: Synthetic oligonucleotide
gggagggggcccgtgtggct

SEQ ID NO: 34070 - DNA, 20 bp, Artificial Sequence
  Description of Artificial Sequence: Synthetic oligonucleotide
ggagggggcccgtgtggcgt

SEQ ID NO: 34071 - DNA, 20 bp, Artificial Sequence
  Description of Artificial Sequence: Synthetic oligonucleotide
gagggggcccgtgtggcgga

SEQ ID NO: 34072 - DNA, 20 bp, Artificial Sequence
  Description of Artificial Sequence: Synthetic oligonucleotide
agggggcccgtgtggcggag

SEQ ID NO: 34073 - DNA, 20 bp, Artificial Sequence
  Description of Artificial Sequence: Synthetic oligonucleotide
gggggcccgtgtggcggagt

SEQ ID NO: 34074 - DNA, 20 bp, Artificial Sequence
  Description of Artificial Sequence: Synthetic oligonucleotide
ggggcccgtgtggcggagca

SEQ ID NO: 34075 - DNA, 20 bp, Artificial Sequence
  Description of Artificial Sequence: Synthetic oligonucleotide
gggcccgtgtggcggagcag

SEQ ID NO: 34076 - DNA, 32 bp, Artificial Sequence
  Description of Artificial Sequence: Synthetic oligonucleotide
cggaatattgggaccggaacacacagatcttc

SEQ ID NO: 34077 - DNA, 34 bp, Artificial Sequence
  Description of Artificial Sequence: Synthetic oligonucleotide
ggaatattgggaccggaacacacagatcttcaag

SEQ ID NO: 34078 - DNA, 35 bp, Artificial Sequence
  Description of Artificial Sequence: Synthetic oligonucleotide
gaatattgggaccggaacacacagatcttcaagac

SEQ ID NO: 34079 - DNA, 35 bp, Artificial Sequence
  Description of Artificial Sequence: Synthetic oligonucleotide
aatattgggaccggaacacacagatcttcaagacc

SEQ ID NO: 34080 - DNA, 32 bp, Artificial Sequence
  Description of Artificial Sequence: Synthetic oligonucleotide
tggtggtgccttctggagaagagcagatatac

SEQ ID NO: 34081 - DNA, 31 bp, Artificial Sequence
  Description of Artificial Sequence: Synthetic oligonucleotide
ggtggtgccttctggagaagagcagatatac

SEQ ID NO: 34082 - DNA, 32 bp, Artificial Sequence
  Description of Artificial Sequence: Synthetic oligonucleotide
gtggtgccttctggagaagagcagatatacac

SEQ ID NO: 34083 - DNA, 34 bp, Artificial Sequence
  Description of Artificial Sequence: Synthetic oligonucleotide
tggtgccttctggagaagagcagatatacacatg

SEQ ID NO: 34084 - DNA, 33 bp, Artificial Sequence
  Description of Artificial Sequence: Synthetic oligonucleotide
ggtgccttctggagaagagcagatatacacatg

SEQ ID NO: 34085 - DNA, 33 bp, Artificial Sequence
  Description of Artificial Sequence: Synthetic oligonucleotide
gtgccttctggagaagagcagatatacacatgc

SEQ ID NO: 34086 - DNA, 33 bp, Artificial Sequence
  Description of Artificial Sequence: Synthetic oligonucleotide
tgccttctggagaagagcagatatacacatgcc

SEQ ID NO: 34087 - DNA, 32 bp, Artificial Sequence
  Description of Artificial Sequence: Synthetic oligonucleotide
gccttctggagaagagcagatatacacatgcc

SEQ ID NO: 34088 - DNA, 34 bp, Artificial Sequence
  Description of Artificial Sequence: Synthetic oligonucleotide
ccttctggagaagagcagatatacacatgccatg

SEQ ID NO: 34089 - DNA, 36 bp, Artificial Sequence
  Description of Artificial Sequence: Synthetic oligonucleotide
cttctggagaagagcagatatacacatgccatgtac

SEQ ID NO: 34090 - DNA, 37 bp, Artificial Sequence
  Description of Artificial Sequence: Synthetic oligonucleotide
ttctggagaagagcagatatacacatgccatgtacag

SEQ ID NO: 34091 - DNA, 36 bp, Artificial Sequence
  Description of Artificial Sequence: Synthetic oligonucleotide
tctggagaagagcagatatacacatgccatgtacag

SEQ ID NO: 34092 - DNA, 35 bp, Artificial Sequence
  Description of Artificial Sequence: Synthetic oligonucleotide
ctggagaagagcagatatacacatgccatgtacag

SEQ ID NO: 34093 - DNA, 35 bp, Artificial Sequence
  Description of Artificial Sequence: Synthetic oligonucleotide
tggagaagagcagatatacacatgccatgtacagc

SEQ ID NO: 34094 - DNA, 34 bp, Artificial Sequence
  Description of Artificial Sequence: Synthetic oligonucleotide
ggagaagagcagatatacacatgccatgtacagc

SEQ ID NO: 34095 - DNA, 36 bp, Artificial Sequence
  Description of Artificial Sequence: Synthetic oligonucleotide
gagaagagcagatatacacatgccatgtacagcatg

SEQ ID NO: 34096 - DNA, 37 bp, Artificial Sequence
  Description of Artificial Sequence: Synthetic oligonucleotide
agaagagcagatatacacatgccatgtacagcatgag

SEQ ID NO: 34097 - DNA, 36 bp, Artificial Sequence
  Description of Artificial Sequence: Synthetic oligonucleotide
gaagagcagatatacacatgccatgtacagcatgag

SEQ ID NO: 34098 - DNA, 36 bp, Artificial Sequence
  Description of Artificial Sequence: Synthetic oligonucleotide
aagagcagatatacacatgccatgtacagcatgagg

SEQ ID NO: 34099 - DNA, 35 bp, Artificial Sequence
  Description of Artificial Sequence: Synthetic oligonucleotide
agagcagatatacacatgccatgtacagcatgagg

SEQ ID NO: 34100 - DNA, 34 bp, Artificial Sequence
  Description of Artificial Sequence: Synthetic oligonucleotide
gagcagatatacacatgccatgtacagcatgagg

SEQ ID NO: 34101 - DNA, 34 bp, Artificial Sequence
  Description of Artificial Sequence: Synthetic oligonucleotide
agcagatatacacatgccatgtacagcatgaggg

SEQ ID NO: 34102 - DNA, 33 bp, Artificial Sequence
  Description of Artificial Sequence: Synthetic oligonucleotide
gcagatatacacatgccatgtacagcatgaggg

SEQ ID NO: 34103 - DNA, 33 bp, Artificial Sequence
  Description of Artificial Sequence: Synthetic oligonucleotide
cagatatacacatgccatgtacagcatgagggg

SEQ ID NO: 34104 - DNA, 33 bp, Artificial Sequence
  Description of Artificial Sequence: Synthetic oligonucleotide
agatatacacatgccatgtacagcatgaggggc

SEQ ID NO: 34105 - DNA, 32 bp, Artificial Sequence
  Description of Artificial Sequence: Synthetic oligonucleotide
gatatacacatgccatgtacagcatgaggggc

SEQ ID NO: 34106 - DNA, 33 bp, Artificial Sequence
  Description of Artificial Sequence: Synthetic oligonucleotide
atatacacatgccatgtacagcatgaggggctg

SEQ ID NO: 34107 - DNA, 32 bp, Artificial Sequence
  Description of Artificial Sequence: Synthetic oligonucleotide
tatacacatgccatgtacagcatgaggggctg

SEQ ID NO: 34108 - DNA, 23 bp, Artificial Sequence
  Description of Artificial Sequence: Synthetic oligonucleotide
ccgtgcggcggagcagctgagaa

SEQ ID NO: 34109 - DNA, 23 bp, Artificial Sequence
  Description of Artificial Sequence: Synthetic oligonucleotide
cgtgcggcggagcagctgagaac

SEQ ID NO: 34110 - DNA, 25 bp, Artificial Sequence
  Description of Artificial Sequence: Synthetic oligonucleotide
gtgcggcggagcagctgagaaccta

SEQ ID NO: 34111 - DNA, 25 bp, Artificial Sequence
  Description of Artificial Sequence: Synthetic oligonucleotide
tgcggcggagcagctgagaacctac

SEQ ID NO: 34112 - DNA, 24 bp, Artificial Sequence
  Description of Artificial Sequence: Synthetic oligonucleotide
gcggcggagcagctgagaacctac

SEQ ID NO: 34113 - DNA, 25 bp, Artificial Sequence
  Description of Artificial Sequence: Synthetic oligonucleotide
cggcggagcagctgagaacctacct

SEQ ID NO: 34114 - DNA, 23 bp, Artificial Sequence
  Description of Artificial Sequence: Synthetic oligonucleotide
atgcgggtcacggcaccccgaac

SEQ ID NO: 34115 - DNA, 22 bp, Artificial Sequence
  Description of Artificial Sequence: Synthetic oligonucleotide
tgcgggtcacggcaccccgaac

SEQ ID NO: 34116 - DNA, 21 bp, Artificial Sequence
  Description of Artificial Sequence: Synthetic oligonucleotide
gcgggtcacggcaccccgaac

SEQ ID NO: 34117 - DNA, 21 bp, Artificial Sequence
  Description of Artificial Sequence: Synthetic oligonucleotide
cgggtcacggcaccccgaacc

SEQ ID NO: 34118 - DNA, 22 bp, Artificial Sequence
  Description of Artificial Sequence: Synthetic oligonucleotide
gggtcacggcaccccgaaccgt

SEQ ID NO: 34119 - DNA, 22 bp, Artificial Sequence
  Description of Artificial Sequence: Synthetic oligonucleotide
ggtcacggcaccccgaaccgtc

SEQ ID NO: 34120 - DNA, 23 bp, Artificial Sequence
  Description of Artificial Sequence: Synthetic oligonucleotide
gtcacggcaccccgaaccgtcct

SEQ ID NO: 34121 - DNA, 23 bp, Artificial Sequence
  Description of Artificial Sequence: Synthetic oligonucleotide
tcacggcaccccgaaccgtcctc

SEQ ID NO: 34122 - DNA, 22 bp, Artificial Sequence
  Description of Artificial Sequence: Synthetic oligonucleotide
cacggcaccccgaaccgtcctc

SEQ ID NO: 34123 - DNA, 23 bp, Artificial Sequence
  Description of Artificial Sequence: Synthetic oligonucleotide
acggcaccccgaaccgtcctcct

SEQ ID NO: 34124 - DNA, 22 bp, Artificial Sequence
  Description of Artificial Sequence: Synthetic oligonucleotide
cggcaccccgaaccgtcctcct

SEQ ID NO: 34125 - DNA, 22 bp, Artificial Sequence
  Description of Artificial Sequence: Synthetic oligonucleotide
ggcaccccgaaccgtcctcctg

SEQ ID NO: 34126 - DNA, 23 bp, Artificial Sequence
  Description of Artificial Sequence: Synthetic oligonucleotide
gcaccccgaaccgtcctcctgct

SEQ ID NO: 34127 - DNA, 23 bp, Artificial Sequence
  Description of Artificial Sequence: Synthetic oligonucleotide
caccccgaaccgtcctcctgctg

SEQ ID NO: 34128 - DNA, 24 bp, Artificial Sequence
  Description of Artificial Sequence: Synthetic oligonucleotide
accccgaaccgtcctcctgctgct

SEQ ID NO: 34129 - DNA, 21 bp, Artificial Sequence
  Description of Artificial Sequence: Synthetic oligonucleotide
gccctgaccgagacctgggcg

SEQ ID NO: 34130 - DNA, 21 bp, Artificial Sequence
  Description of Artificial Sequence: Synthetic oligonucleotide
ccctgaccgagacctgggcgg

SEQ ID NO: 34131 - DNA, 21 bp, Artificial Sequence
  Description of Artificial Sequence: Synthetic oligonucleotide
cctgaccgagacctgggcggg

SEQ ID NO: 34132 - DNA, 22 bp, Artificial Sequence
  Description of Artificial Sequence: Synthetic oligonucleotide
ctgaccgagacctgggcgggct

SEQ ID NO: 34133 - DNA, 22 bp, Artificial Sequence
  Description of Artificial Sequence: Synthetic oligonucleotide
tgaccgagacctgggcgggctc

SEQ ID NO: 34134 - DNA, 21 bp, Artificial Sequence
  Description of Artificial Sequence: Synthetic oligonucleotide
gaccgagacctgggcgggctc

SEQ ID NO: 34135 - DNA, 21 bp, Artificial Sequence
  Description of Artificial Sequence: Synthetic oligonucleotide
accgagacctgggcgggctcc

SEQ ID NO: 34136 - DNA, 20 bp, Artificial Sequence
  Description of Artificial Sequence: Synthetic oligonucleotide
ccgagacctgggcgggctcc

SEQ ID NO: 34137 - DNA, 21 bp, Artificial Sequence
  Description of Artificial Sequence: Synthetic oligonucleotide
cgagacctgggcgggctccca

SEQ ID NO: 34138 - DNA, 22 bp, Artificial Sequence
  Description of Artificial Sequence: Synthetic oligonucleotide
gagacctgggcgggctcccact

SEQ ID NO: 34139 - DNA, 27 bp, Artificial Sequence
  Description of Artificial Sequence: Synthetic oligonucleotide
cgggctcccactccatgaggtatttcc

SEQ ID NO: 34140 - DNA, 28 bp, Artificial Sequence
  Description of Artificial Sequence: Synthetic oligonucleotide
gggctcccactccatgaggtatttccac

SEQ ID NO: 34141 - DNA, 20 bp, Artificial Sequence
  Description of Artificial Sequence: Synthetic oligonucleotide
aggaaggagccgcgggcgcc

SEQ ID NO: 34142 - DNA, 20 bp, Artificial Sequence
  Description of Artificial Sequence: Synthetic oligonucleotide
ggaaggagccgcgggcgcct

SEQ ID NO: 34143 - DNA, 20 bp, Artificial Sequence
  Description of Artificial Sequence: Synthetic oligonucleotide
gaaggagccgcgggcgccgt

SEQ ID NO: 34144 - DNA, 20 bp, Artificial Sequence
  Description of Artificial Sequence: Synthetic oligonucleotide
aaggagccgcgggcgccgtg

SEQ ID NO: 34145 - DNA, 25 bp, Artificial Sequence
  Description of Artificial Sequence: Synthetic oligonucleotide
ggacacggcggctcagatctcccaa

SEQ ID NO: 34146 - DNA, 25 bp, Artificial Sequence
  Description of Artificial Sequence: Synthetic oligonucleotide
gacacggcggctcagatctcccaac

SEQ ID NO: 34147 - DNA, 25 bp, Artificial Sequence
  Description of Artificial Sequence: Synthetic oligonucleotide
acacggcggctcagatctcccaacg

SEQ ID NO: 34148 - DNA, 24 bp, Artificial Sequence
  Description of Artificial Sequence: Synthetic oligonucleotide
cacggcggctcagatctcccaacg

SEQ ID NO: 34149 - DNA, 26 bp, Artificial Sequence
  Description of Artificial Sequence: Synthetic oligonucleotide
acggcggctcagatctcccaacgcaa

SEQ ID NO: 34150 - DNA, 25 bp, Artificial Sequence
  Description of Artificial Sequence: Synthetic oligonucleotide
cggcggctcagatctcccaacgcaa

SEQ ID NO: 34151 - DNA, 27 bp, Artificial Sequence
  Description of Artificial Sequence: Synthetic oligonucleotide
ggcggctcagatctcccaacgcaagtt

SEQ ID NO: 34152 - DNA, 27 bp, Artificial Sequence
  Description of Artificial Sequence: Synthetic oligonucleotide
gcggctcagatctcccaacgcaagttg

SEQ ID NO: 34153 - DNA, 27 bp, Artificial Sequence
  Description of Artificial Sequence: Synthetic oligonucleotide
cggctcagatctcccaacgcaagttgg

SEQ ID NO: 34154 - DNA, 28 bp, Artificial Sequence
  Description of Artificial Sequence: Synthetic oligonucleotide
ggctcagatctcccaacgcaagttggag

SEQ ID NO: 34155 - DNA, 28 bp, Artificial Sequence
  Description of Artificial Sequence: Synthetic oligonucleotide
gctcagatctcccaacgcaagttggagg

SEQ ID NO: 34156 - DNA, 28 bp, Artificial Sequence
  Description of Artificial Sequence: Synthetic oligonucleotide
ctcagatctcccaacgcaagttggaggc

SEQ ID NO: 34157 - DNA, 28 bp, Artificial Sequence
  Description of Artificial Sequence: Synthetic oligonucleotide
tcagatctcccaacgcaagttggaggcg

SEQ ID NO: 34158 - DNA, 27 bp, Artificial Sequence
  Description of Artificial Sequence: Synthetic oligonucleotide
cagatctcccaacgcaagttggaggcg

SEQ ID NO: 34159 - DNA, 27 bp, Artificial Sequence
  Description of Artificial Sequence: Synthetic oligonucleotide
agatctcccaacgcaagttggaggcgg

SEQ ID NO: 34160 - DNA, 26 bp, Artificial Sequence
  Description of Artificial Sequence: Synthetic oligonucleotide
gatctcccaacgcaagttggaggcgg

SEQ ID NO: 34161 - DNA, 26 bp, Artificial Sequence
  Description of Artificial Sequence: Synthetic oligonucleotide
atctcccaacgcaagttggaggcggc

SEQ ID NO: 34162 - DNA, 25 bp, Artificial Sequence
  Description of Artificial Sequence: Synthetic oligonucleotide
tctcccaacgcaagttggaggcggc

SEQ ID NO: 34163 - DNA, 24 bp, Artificial Sequence
  Description of Artificial Sequence: Synthetic oligonucleotide
ctcccaacgcaagttggaggcggc

SEQ ID NO: 34164 - DNA, 24 bp, Artificial Sequence
  Description of Artificial Sequence: Synthetic oligonucleotide
tcccaacgcaagttggaggcggcc

SEQ ID NO: 34165 - DNA, 23 bp, Artificial Sequence
  Description of Artificial Sequence: Synthetic oligonucleotide
cccaacgcaagttggaggcggcc

SEQ ID NO: 34166 - DNA, 23 bp, Artificial Sequence
  Description of Artificial Sequence: Synthetic oligonucleotide
ccaacgcaagttggaggcggccc

SEQ ID NO: 34167 - DNA, 24 bp, Artificial Sequence
  Description of Artificial Sequence: Synthetic oligonucleotide
caacgcaagttggaggcggcccgt

SEQ ID NO: 34168 - DNA, 25 bp, Artificial Sequence
  Description of Artificial Sequence: Synthetic oligonucleotide
aacgcaagttggaggcggcccgtgt

SEQ ID NO: 34169 - DNA, 24 bp, Artificial Sequence
  Description of Artificial Sequence: Synthetic oligonucleotide
acgcaagttggaggcggcccgtgt

SEQ ID NO: 34170 - DNA, 26 bp, Artificial Sequence
  Description of Artificial Sequence: Synthetic oligonucleotide
gtgtggcggagcagctgagagcctat

SEQ ID NO: 34171 - DNA, 27 bp, Artificial Sequence
  Description of Artificial Sequence: Synthetic oligonucleotide
tgtggcggagcagctgagagcctatct

SEQ ID NO: 34172 - DNA, 26 bp, Artificial Sequence
  Description of Artificial Sequence: Synthetic oligonucleotide
gtggcggagcagctgagagcctatct

SEQ ID NO: 34173 - DNA, 26 bp, Artificial Sequence
  Description of Artificial Sequence: Synthetic oligonucleotide
tggcggagcagctgagagcctatctg

SEQ ID NO: 34174 - DNA, 25 bp, Artificial Sequence
  Description of Artificial Sequence: Synthetic oligonucleotide
ggcggagcagctgagagcctatctg

SEQ ID NO: 34175 - DNA, 26 bp, Artificial Sequence
  Description of Artificial Sequence: Synthetic oligonucleotide
gcggagcagctgagagcctatctgga

SEQ ID NO: 34176 - DNA, 26 bp, Artificial Sequence
  Description of Artificial Sequence: Synthetic oligonucleotide
cggagcagctgagagcctatctggag

SEQ ID NO: 34177 - DNA, 26 bp, Artificial Sequence
  Description of Artificial Sequence: Synthetic oligonucleotide
ggagcagctgagagcctatctggagg

SEQ ID NO: 34178 - DNA, 26 bp, Artificial Sequence
  Description of Artificial Sequence: Synthetic oligonucleotide
gagcagctgagagcctatctggaggg

SEQ ID NO: 34179 - DNA, 26 bp, Artificial Sequence
  Description of Artificial Sequence: Synthetic oligonucleotide
agcagctgagagcctatctggagggc

SEQ ID NO: 34180 - DNA, 25 bp, Artificial Sequence
  Description of Artificial Sequence: Synthetic oligonucleotide
gcagctgagagcctatctggagggc

SEQ ID NO: 34181 - DNA, 26 bp, Artificial Sequence
  Description of Artificial Sequence: Synthetic oligonucleotide
cagctgagagcctatctggagggcga

SEQ ID NO: 34182 - DNA, 27 bp, Artificial Sequence
  Description of Artificial Sequence: Synthetic oligonucleotide
agctgagagcctatctggagggcgagt

SEQ ID NO: 34183 - DNA, 26 bp, Artificial Sequence
  Description of Artificial Sequence: Synthetic oligonucleotide
gctgagagcctatctggagggcgagt

SEQ ID NO: 34184 - DNA, 26 bp, Artificial Sequence
  Description of Artificial Sequence: Synthetic oligonucleotide
ctgagagcctatctggagggcgagtg

SEQ ID NO: 34185 - DNA, 26 bp, Artificial Sequence
  Description of Artificial Sequence: Synthetic oligonucleotide
tgagagcctatctggagggcgagtgc

SEQ ID NO: 34186 - DNA, 25 bp, Artificial Sequence
  Description of Artificial Sequence: Synthetic oligonucleotide
gagagcctatctggagggcgagtgc

SEQ ID NO: 34187 - DNA, 26 bp, Artificial Sequence
  Description of Artificial Sequence: Synthetic oligonucleotide
agagcctatctggagggcgagtgcgt

SEQ ID NO: 34188 - DNA, 25 bp, Artificial Sequence
  Description of Artificial Sequence: Synthetic oligonucleotide
gagcctatctggagggcgagtgcgt

SEQ ID NO: 34189 - DNA, 25 bp, Artificial Sequence
  Description of Artificial Sequence: Synthetic oligonucleotide
agcctatctggagggcgagtgcgtg

SEQ ID NO: 34190 - DNA, 24 bp, Artificial Sequence
  Description of Artificial Sequence: Synthetic oligonucleotide
gcctatctggagggcgagtgcgtg

SEQ ID NO: 34191 - DNA, 25 bp, Artificial Sequence
  Description of Artificial Sequence: Synthetic oligonucleotide
cctatctggagggcgagtgcgtgga

SEQ ID NO: 34192 - DNA, 26 bp, Artificial Sequence
  Description of Artificial Sequence: Synthetic oligonucleotide
ctatctggagggcgagtgcgtggagt

SEQ ID NO: 34193 - DNA, 26 bp, Artificial Sequence
  Description of Artificial Sequence: Synthetic oligonucleotide
tatctggagggcgagtgcgtggagtg

SEQ ID NO: 34194 - DNA, 25 bp, Artificial Sequence
  Description of Artificial Sequence: Synthetic oligonucleotide
atctggagggcgagtgcgtggagtg

SEQ ID NO: 34195 - DNA, 24 bp, Artificial Sequence
  Description of Artificial Sequence: Synthetic oligonucleotide
tctggagggcgagtgcgtggagtg

SEQ ID NO: 34196 - DNA, 26 bp, Artificial Sequence
  Description of Artificial Sequence: Synthetic oligonucleotide
atcgccctgaacgaggacctgcgttc

SEQ ID NO: 34197 - DNA, 25 bp, Artificial Sequence
  Description of Artificial Sequence: Synthetic oligonucleotide
tcgccctgaacgaggacctgcgttc

SEQ ID NO: 34198 - DNA, 24 bp, Artificial Sequence
  Description of Artificial Sequence: Synthetic oligonucleotide
cgccctgaacgaggacctgcgttc

SEQ ID NO: 34199 - DNA, 25 bp, Artificial Sequence
  Description of Artificial Sequence: Synthetic oligonucleotide
gccctgaacgaggacctgcgttcct

SEQ ID NO: 34200 - DNA, 25 bp, Artificial Sequence
  Description of Artificial Sequence: Synthetic oligonucleotide
ccctgaacgaggacctgcgttcctg

SEQ ID NO: 34201 - DNA, 26 bp, Artificial Sequence
  Description of Artificial Sequence: Synthetic oligonucleotide
cctgaacgaggacctgcgttcctgga

SEQ ID NO: 34202 - DNA, 26 bp, Artificial Sequence
  Description of Artificial Sequence: Synthetic oligonucleotide
ctgaacgaggacctgcgttcctggac

SEQ ID NO: 34203 - DNA, 26 bp, Artificial Sequence
  Description of Artificial Sequence: Synthetic oligonucleotide
tgaacgaggacctgcgttcctggacc

SEQ ID NO: 34204 - DNA, 25 bp, Artificial Sequence
  Description of Artificial Sequence: Synthetic oligonucleotide
gaacgaggacctgcgttcctggacc

SEQ ID NO: 34205 - DNA, 25 bp, Artificial Sequence
  Description of Artificial Sequence: Synthetic oligonucleotide
aacgaggacctgcgttcctggaccg

SEQ ID NO: 34206 - DNA, 24 bp, Artificial Sequence
  Description of Artificial Sequence: Synthetic oligonucleotide
acgaggacctgcgttcctggaccg

SEQ ID NO: 34207 - DNA, 23 bp, Artificial Sequence
  Description of Artificial Sequence: Synthetic oligonucleotide
cgaggacctgcgttcctggaccg

SEQ ID NO: 34208 - DNA, 23 bp, Artificial Sequence
  Description of Artificial Sequence: Synthetic oligonucleotide
gaggacctgcgttcctggaccgc

SEQ ID NO: 34209 - DNA, 23 bp, Artificial Sequence
  Description of Artificial Sequence: Synthetic oligonucleotide
aggacctgcgttcctggaccgcc

SEQ ID NO: 34210 - DNA, 22 bp, Artificial Sequence
  Description of Artificial Sequence: Synthetic oligonucleotide
ggacctgcgttcctggaccgcc

SEQ ID NO: 34211 - DNA, 22 bp, Artificial Sequence
  Description of Artificial Sequence: Synthetic oligonucleotide
gacctgcgttcctggaccgccg

SEQ ID NO: 34212 - DNA, 22 bp, Artificial Sequence
  Description of Artificial Sequence: Synthetic oligonucleotide
acctgcgttcctggaccgccgc

SEQ ID NO: 34213 - DNA, 21 bp, Artificial Sequence
  Description of Artificial Sequence: Synthetic oligonucleotide
cctgcgttcctggaccgccgc

SEQ ID NO: 34214 - DNA, 21 bp, Artificial Sequence
  Description of Artificial Sequence: Synthetic oligonucleotide
ctgcgttcctggaccgccgcg

SEQ ID NO: 34215 - DNA, 22 bp, Artificial Sequence
  Description of Artificial Sequence: Synthetic oligonucleotide
tgcgttcctggaccgccgcgga

SEQ ID NO: 34216 - DNA, 21 bp, Artificial Sequence
  Description of Artificial Sequence: Synthetic oligonucleotide
gcgttcctggaccgccgcgga

SEQ ID NO: 34217 - DNA, 22 bp, Artificial Sequence
  Description of Artificial Sequence: Synthetic oligonucleotide
cgttcctggaccgccgcggaca

SEQ ID NO: 34218 - DNA, 22 bp, Artificial Sequence
  Description of Artificial Sequence: Synthetic oligonucleotide
gttcctggaccgccgcggacac

SEQ ID NO: 34219 - DNA, 22 bp, Artificial Sequence
  Description of Artificial Sequence: Synthetic oligonucleotide
ttcctggaccgccgcggacacg

SEQ ID NO: 34220 - DNA, 27 bp, Artificial Sequence
  Description of Artificial Sequence: Synthetic oligonucleotide
tatttccacaccgccatgtcccggcct

SEQ ID NO: 34221 - DNA, 26 bp, Artificial Sequence
  Description of Artificial Sequence: Synthetic oligonucleotide
atttccacaccgccatgtcccggcct

SEQ ID NO: 34222 - DNA, 25 bp, Artificial Sequence
  Description of Artificial Sequence: Synthetic oligonucleotide
tttccacaccgccatgtcccggcct

SEQ ID NO: 34223 - DNA, 24 bp, Artificial Sequence
  Description of Artificial Sequence: Synthetic oligonucleotide
ttccacaccgccatgtcccggcct

SEQ ID NO: 34224 - DNA, 23 bp, Artificial Sequence
  Description of Artificial Sequence: Synthetic oligonucleotide
tccacaccgccatgtcccggcct

SEQ ID NO: 34225 - DNA, 22 bp, Artificial Sequence
  Description of Artificial Sequence: Synthetic oligonucleotide
ccacaccgccatgtcccggcct

SEQ ID NO: 34226 - DNA, 22 bp, Artificial Sequence
  Description of Artificial Sequence: Synthetic oligonucleotide
cacaccgccatgtcccggcctg

SEQ ID NO: 34227 - DNA, 23 bp, Artificial Sequence
  Description of Artificial Sequence: Synthetic oligonucleotide
ccgcggggagccccgcttcatta

SEQ ID NO: 34228 - DNA, 23 bp, Artificial Sequence
  Description of Artificial Sequence: Synthetic oligonucleotide
cgcggggagccccgcttcattac

SEQ ID NO: 34229 - DNA, 23 bp, Artificial Sequence
  Description of Artificial Sequence: Synthetic oligonucleotide
gcggggagccccgcttcattacc

SEQ ID NO: 34230 - DNA, 24 bp, Artificial Sequence
  Description of Artificial Sequence: Synthetic oligonucleotide
cggggagccccgcttcattaccgt

SEQ ID NO: 34231 - DNA, 24 bp, Artificial Sequence
  Description of Artificial Sequence: Synthetic oligonucleotide
ggggagccccgcttcattaccgtg

SEQ ID NO: 34232 - DNA, 24 bp, Artificial Sequence
  Description of Artificial Sequence: Synthetic oligonucleotide
gggagccccgcttcattaccgtgg

SEQ ID NO: 34233 - DNA, 24 bp, Artificial Sequence
  Description of Artificial Sequence: Synthetic oligonucleotide
ggagccccgcttcattaccgtggg

SEQ ID NO: 34234 - DNA, 26 bp, Artificial Sequence
  Description of Artificial Sequence: Synthetic oligonucleotide
gagccccgcttcattaccgtgggcta

SEQ ID NO: 34235 - DNA, 26 bp, Artificial Sequence
  Description of Artificial Sequence: Synthetic oligonucleotide
agccccgcttcattaccgtgggctac

SEQ ID NO: 34236 - DNA, 25 bp, Artificial Sequence
  Description of Artificial Sequence: Synthetic oligonucleotide
gccccgcttcattaccgtgggctac

SEQ ID NO: 34237 - DNA, 26 bp, Artificial Sequence
  Description of Artificial Sequence: Synthetic oligonucleotide
ccccgcttcattaccgtgggctacgt

SEQ ID NO: 34238 - DNA, 26 bp, Artificial Sequence
  Description of Artificial Sequence: Synthetic oligonucleotide
cccgcttcattaccgtgggctacgtg

SEQ ID NO: 34239 - DNA, 27 bp, Artificial Sequence
  Description of Artificial Sequence: Synthetic oligonucleotide
ccgcttcattaccgtgggctacgtgga

SEQ ID NO: 34240 - DNA, 27 bp, Artificial Sequence
  Description of Artificial Sequence: Synthetic oligonucleotide
cgcttcattaccgtgggctacgtggac

SEQ ID NO: 34241 - DNA, 27 bp, Artificial Sequence
  Description of Artificial Sequence: Synthetic oligonucleotide
gcttcattaccgtgggctacgtggacg

SEQ ID NO: 34242 - DNA, 28 bp, Artificial Sequence
  Description of Artificial Sequence: Synthetic oligonucleotide
cttcattaccgtgggctacgtggacgac

SEQ ID NO: 34243 - DNA, 29 bp, Artificial Sequence
  Description of Artificial Sequence: Synthetic oligonucleotide
ttcattaccgtgggctacgtggacgacac

SEQ ID NO: 34244 - DNA, 28 bp, Artificial Sequence
  Description of Artificial Sequence: Synthetic oligonucleotide
tcattaccgtgggctacgtggacgacac

SEQ ID NO: 34245 - DNA, 27 bp, Artificial Sequence
  Description of Artificial Sequence: Synthetic oligonucleotide
cattaccgtgggctacgtggacgacac

SEQ ID NO: 34246 - DNA, 27 bp, Artificial Sequence
  Description of Artificial Sequence: Synthetic oligonucleotide
attaccgtgggctacgtggacgacacg

SEQ ID NO: 34247 - DNA, 26 bp, Artificial Sequence
  Description of Artificial Sequence: Synthetic oligonucleotide
ttaccgtgggctacgtggacgacacg

SEQ ID NO: 34248 - DNA, 25 bp, Artificial Sequence
  Description of Artificial Sequence: Synthetic oligonucleotide
taccgtgggctacgtggacgacacg

SEQ ID NO: 34249 - DNA, 21 bp, Artificial Sequence
  Description of Artificial Sequence: Synthetic oligonucleotide
ttggaggcggcccgtgtggcc

SEQ ID NO: 34250 - DNA, 20 bp, Artificial Sequence
  Description of Artificial Sequence: Synthetic oligonucleotide
tggaggcggcccgtgtggcc

SEQ ID NO: 34251 - DNA, 20 bp, Artificial Sequence
  Description of Artificial Sequence: Synthetic oligonucleotide
ggaggcggcccgtgtggcct

SEQ ID NO: 34252 - DNA, 20 bp, Artificial Sequence
  Description of Artificial Sequence: Synthetic oligonucleotide
gaggcggcccgtgtggccga

SEQ ID NO: 34253 - DNA, 20 bp, Artificial Sequence
  Description of Artificial Sequence: Synthetic oligonucleotide
aggcggcccgtgtggccgag

SEQ ID NO: 34254 - DNA, 20 bp, Artificial Sequence
  Description of Artificial Sequence: Synthetic oligonucleotide
ggcggcccgtgtggccgagt

SEQ ID NO: 34255 - DNA, 20 bp, Artificial Sequence
  Description of Artificial Sequence: Synthetic oligonucleotide
gcggcccgtgtggccgagca

SEQ ID NO: 34256 - DNA, 20 bp, Artificial Sequence
  Description of Artificial Sequence: Synthetic oligonucleotide
cggcccgtgtggccgagcag

SEQ ID NO: 34257 - DNA, 21 bp, Artificial Sequence
  Description of Artificial Sequence: Synthetic oligonucleotide
ggcccgtgtggccgagcagct

SEQ ID NO: 34258 - DNA, 22 bp, Artificial Sequence
  Description of Artificial Sequence: Synthetic oligonucleotide
gcccgtgtggccgagcagctga

SEQ ID NO: 34259 - DNA, 23 bp, Artificial Sequence
  Description of Artificial Sequence: Synthetic oligonucleotide
cccgtgtggccgagcagctgaga

SEQ ID NO: 34260 - DNA, 23 bp, Artificial Sequence
  Description of Artificial Sequence: Synthetic oligonucleotide
ccgtgtggccgagcagctgagag

SEQ ID NO: 34261 - DNA, 23 bp, Artificial Sequence
  Description of Artificial Sequence: Synthetic oligonucleotide
cgtgtggccgagcagctgagagc

SEQ ID NO: 34262 - DNA, 25 bp, Artificial Sequence
  Description of Artificial Sequence: Synthetic oligonucleotide
gtgtggccgagcagctgagagccta

SEQ ID NO: 34263 - DNA, 25 bp, Artificial Sequence
  Description of Artificial Sequence: Synthetic oligonucleotide
tgtggccgagcagctgagagcctac

SEQ ID NO: 34264 - DNA, 24 bp, Artificial Sequence
  Description of Artificial Sequence: Synthetic oligonucleotide
gtggccgagcagctgagagcctac

SEQ ID NO: 34265 - DNA, 25 bp, Artificial Sequence
  Description of Artificial Sequence: Synthetic oligonucleotide
tggccgagcagctgagagcctacct

SEQ ID NO: 34266 - DNA, 24 bp, Artificial Sequence
  Description of Artificial Sequence: Synthetic oligonucleotide
ggccgagcagctgagagcctacct

SEQ ID NO: 34267 - DNA, 24 bp, Artificial Sequence
  Description of Artificial Sequence: Synthetic oligonucleotide
gccgagcagctgagagcctacctg

SEQ ID NO: 34268 - DNA, 25 bp, Artificial Sequence
  Description of Artificial Sequence: Synthetic oligonucleotide
ccgagcagctgagagcctacctgga

SEQ ID NO: 34269 - DNA, 25 bp, Artificial Sequence
  Description of Artificial Sequence: Synthetic oligonucleotide
cgagcagctgagagcctacctggag

SEQ ID NO: 34270 - DNA, 27 bp, Artificial Sequence
  Description of Artificial Sequence: Synthetic oligonucleotide
cgcttcatcaccgtgggctacgtggat

SEQ ID NO: 34271 - DNA, 27 bp, Artificial Sequence
  Description of Artificial Sequence: Synthetic oligonucleotide
gcttcatcaccgtgggctacgtggatg

SEQ ID NO: 34272 - DNA, 28 bp, Artificial Sequence
  Description of Artificial Sequence: Synthetic oligonucleotide
cttcatcaccgtgggctacgtggatgac

SEQ ID NO: 34273 - DNA, 29 bp, Artificial Sequence
  Description of Artificial Sequence: Synthetic oligonucleotide
ttcatcaccgtgggctacgtggatgacac

SEQ ID NO: 34274 - DNA, 28 bp, Artificial Sequence
  Description of Artificial Sequence: Synthetic oligonucleotide
tcatcaccgtgggctacgtggatgacac

SEQ ID NO: 34275 - DNA, 27 bp, Artificial Sequence
  Description of Artificial Sequence: Synthetic oligonucleotide
catcaccgtgggctacgtggatgacac

SEQ ID NO: 34276 - DNA, 27 bp, Artificial Sequence
  Description of Artificial Sequence: Synthetic oligonucleotide
atcaccgtgggctacgtggatgacacg

SEQ ID NO: 34277 - DNA, 26 bp, Artificial Sequence
  Description of Artificial Sequence: Synthetic oligonucleotide
tcaccgtgggctacgtggatgacacg

SEQ ID NO: 34278 - DNA, 25 bp, Artificial Sequence
  Description of Artificial Sequence: Synthetic oligonucleotide
caccgtgggctacgtggatgacacg

SEQ ID NO: 34279 - DNA, 26 bp, Artificial Sequence
  Description of Artificial Sequence: Synthetic oligonucleotide
accgtgggctacgtggatgacacgct

SEQ ID NO: 34280 - DNA, 25 bp, Artificial Sequence
  Description of Artificial Sequence: Synthetic oligonucleotide
ccgtgggctacgtggatgacacgct

SEQ ID NO: 34281 - DNA, 27 bp, Artificial Sequence
  Description of Artificial Sequence: Synthetic oligonucleotide
cgtgggctacgtggatgacacgctgtt

SEQ ID NO: 34282 - DNA, 27 bp, Artificial Sequence
  Description of Artificial Sequence: Synthetic oligonucleotide
gtgggctacgtggatgacacgctgttc

SEQ ID NO: 34283 - DNA, 27 bp, Artificial Sequence
  Description of Artificial Sequence: Synthetic oligonucleotide
tgggctacgtggatgacacgctgttcg

SEQ ID NO: 34284 - DNA, 27 bp, Artificial Sequence
  Description of Artificial Sequence: Synthetic oligonucleotide
gggctacgtggatgacacgctgttcgt

SEQ ID NO: 34285 - DNA, 27 bp, Artificial Sequence
  Description of Artificial Sequence: Synthetic oligonucleotide
ggctacgtggatgacacgctgttcgtg

SEQ ID NO: 34286 - DNA, 28 bp, Artificial Sequence
  Description of Artificial Sequence: Synthetic oligonucleotide
gctacgtggatgacacgctgttcgtgag

SEQ ID NO: 34287 - DNA, 28 bp, Artificial Sequence
  Description of Artificial Sequence: Synthetic oligonucleotide
ctacgtggatgacacgctgttcgtgagg

SEQ ID NO: 34288 - DNA, 30 bp, Artificial Sequence
  Description of Artificial Sequence: Synthetic oligonucleotide
tacgtggatgacacgctgttcgtgaggttc

SEQ ID NO: 34289 - DNA, 29 bp, Artificial Sequence
  Description of Artificial Sequence: Synthetic oligonucleotide
acgtggatgacacgctgttcgtgaggttc

SEQ ID NO: 34290 - DNA, 28 bp, Artificial Sequence
  Description of Artificial Sequence: Synthetic oligonucleotide
cgtggatgacacgctgttcgtgaggttc

SEQ ID NO: 34291 - DNA, 28 bp, Artificial Sequence
  Description of Artificial Sequence: Synthetic oligonucleotide
gtggatgacacgctgttcgtgaggttcg

SEQ ID NO: 34292 - DNA, 29 bp, Artificial Sequence
  Description of Artificial Sequence: Synthetic oligonucleotide
tggatgacacgctgttcgtgaggttcgac

SEQ ID NO: 34293 - DNA, 28 bp, Artificial Sequence
  Description of Artificial Sequence: Synthetic oligonucleotide
ggatgacacgctgttcgtgaggttcgac

SEQ ID NO: 34294 - DNA, 29 bp, Artificial Sequence
  Description of Artificial Sequence: Synthetic oligonucleotide
gatgacacgctgttcgtgaggttcgacag

SEQ ID NO: 34295 - DNA, 29 bp, Artificial Sequence
  Description of Artificial Sequence: Synthetic oligonucleotide
atgacacgctgttcgtgaggttcgacagc

SEQ ID NO: 34296 - DNA, 28 bp, Artificial Sequence
  Description of Artificial Sequence: Synthetic oligonucleotide
tgacacgctgttcgtgaggttcgacagc

SEQ ID NO: 34297 - DNA, 29 bp, Artificial Sequence
  Description of Artificial Sequence: Synthetic oligonucleotide
agtattgggaccgggagacacagatctcg

SEQ ID NO: 34298 - DNA, 28 bp, Artificial Sequence
  Description of Artificial Sequence: Synthetic oligonucleotide
gtattgggaccgggagacacagatctcg

SEQ ID NO: 34299 - DNA, 30 bp, Artificial Sequence
  Description of Artificial Sequence: Synthetic oligonucleotide
tattgggaccgggagacacagatctcgaag

SEQ ID NO: 34300 - DNA, 29 bp, Artificial Sequence
  Description of Artificial Sequence: Synthetic oligonucleotide
attgggaccgggagacacagatctcgaag

SEQ ID NO: 34301 - DNA, 28 bp, Artificial Sequence
  Description of Artificial Sequence: Synthetic oligonucleotide
ttgggaccgggagacacagatctcgaag

SEQ ID NO: 34302 - DNA, 27 bp, Artificial Sequence
  Description of Artificial Sequence: Synthetic oligonucleotide
tgggaccgggagacacagatctcgaag

SEQ ID NO: 34303 - DNA, 27 bp, Artificial Sequence
  Description of Artificial Sequence: Synthetic oligonucleotide
gggaccgggagacacagatctcgaaga

SEQ ID NO: 34304 - DNA, 27 bp, Artificial Sequence
  Description of Artificial Sequence: Synthetic oligonucleotide
ggaccgggagacacagatctcgaagac

SEQ ID NO: 34305 - DNA, 27 bp, Artificial Sequence
  Description of Artificial Sequence: Synthetic oligonucleotide
gaccgggagacacagatctcgaagacc

SEQ ID NO: 34306 - DNA, 29 bp, Artificial Sequence
  Description of Artificial Sequence: Synthetic oligonucleotide
accgggagacacagatctcgaagaccaac

SEQ ID NO: 34307 - DNA, 28 bp, Artificial Sequence
  Description of Artificial Sequence: Synthetic oligonucleotide
ccgggagacacagatctcgaagaccaac

SEQ ID NO: 34308 - DNA, 29 bp, Artificial Sequence
  Description of Artificial Sequence: Synthetic oligonucleotide
cgggagacacagatctcgaagaccaacac

SEQ ID NO: 34309 - DNA, 30 bp, Artificial Sequence
  Description of Artificial Sequence: Synthetic oligonucleotide
gggagacacagatctcgaagaccaacacac

SEQ ID NO: 34310 - DNA, 31 bp, Artificial Sequence
  Description of Artificial Sequence: Synthetic oligonucleotide
ggagacacagatctcgaagaccaacacacag

SEQ ID NO: 34311 - DNA, 32 bp, Artificial Sequence
  Description of Artificial Sequence: Synthetic oligonucleotide
gagacacagatctcgaagaccaacacacagac

SEQ ID NO: 34312 - DNA, 35 bp, Artificial Sequence
  Description of Artificial Sequence: Synthetic oligonucleotide
agacacagatctcgaagaccaacacacagacttac

SEQ ID NO: 34313 - DNA, 34 bp, Artificial Sequence
  Description of Artificial Sequence: Synthetic oligonucleotide
gacacagatctcgaagaccaacacacagacttac

SEQ ID NO: 34314 - DNA, 34 bp, Artificial Sequence
  Description of Artificial Sequence: Synthetic oligonucleotide
acacagatctcgaagaccaacacacagacttacc

SEQ ID NO: 34315 - DNA, 33 bp, Artificial Sequence
  Description of Artificial Sequence: Synthetic oligonucleotide
cacagatctcgaagaccaacacacagacttacc

SEQ ID NO: 34316 - DNA, 33 bp, Artificial Sequence
  Description of Artificial Sequence: Synthetic oligonucleotide
acagatctcgaagaccaacacacagacttaccg

SEQ ID NO: 34317 - DNA, 32 bp, Artificial Sequence
  Description of Artificial Sequence: Synthetic oligonucleotide
cagatctcgaagaccaacacacagacttaccg

SEQ ID NO: 34318 - DNA, 33 bp, Artificial Sequence
  Description of Artificial Sequence: Synthetic oligonucleotide
agatctcgaagaccaacacacagacttaccgag

SEQ ID NO: 34319 - DNA, 32 bp, Artificial Sequence
  Description of Artificial Sequence: Synthetic oligonucleotide
gatctcgaagaccaacacacagacttaccgag

SEQ ID NO: 34320 - DNA, 33 bp, Artificial Sequence
  Description of Artificial Sequence: Synthetic oligonucleotide
atctcgaagaccaacacacagacttaccgagag

SEQ ID NO: 34321 - DNA, 32 bp, Artificial Sequence
  Description of Artificial Sequence: Synthetic oligonucleotide
tctcgaagaccaacacacagacttaccgagag

SEQ ID NO: 34322 - DNA, 31 bp, Artificial Sequence
  Description of Artificial Sequence: Synthetic oligonucleotide
ctcgaagaccaacacacagacttaccgagag

SEQ ID NO: 34323 - DNA, 32 bp, Artificial Sequence
  Description of Artificial Sequence: Synthetic oligonucleotide
tcgaagaccaacacacagacttaccgagagag

SEQ ID NO: 34324 - DNA, 31 bp, Artificial Sequence
  Description of Artificial Sequence: Synthetic oligonucleotide
cgaagaccaacacacagacttaccgagagag

SEQ ID NO: 34325 - DNA, 31 bp, Artificial Sequence
  Description of Artificial Sequence: Synthetic oligonucleotide
gaagaccaacacacagacttaccgagagagc

SEQ ID NO: 34326 - DNA, 24 bp, Artificial Sequence
  Description of Artificial Sequence: Synthetic oligonucleotide
cgtgggctacgtggacgacaccct

SEQ ID NO: 34327 - DNA, 26 bp, Artificial Sequence
  Description of Artificial Sequence: Synthetic oligonucleotide
gtgggctacgtggacgacaccctgtt

SEQ ID NO: 34328 - DNA, 26 bp, Artificial Sequence
  Description of Artificial Sequence: Synthetic oligonucleotide
tgggctacgtggacgacaccctgttc

SEQ ID NO: 34329 - DNA, 25 bp, Artificial Sequence
  Description of Artificial Sequence: Synthetic oligonucleotide
gggctacgtggacgacaccctgttc

SEQ ID NO: 34330 - DNA, 26 bp, Artificial Sequence
  Description of Artificial Sequence: Synthetic oligonucleotide
ggctacgtggacgacaccctgttcgt

SEQ ID NO: 34331 - DNA, 27 bp, Artificial Sequence
  Description of Artificial Sequence: Synthetic oligonucleotide
gctacgtggacgacaccctgttcgtga

SEQ ID NO: 34332 - DNA, 27 bp, Artificial Sequence
  Description of Artificial Sequence: Synthetic oligonucleotide
ctacgtggacgacaccctgttcgtgag

SEQ ID NO: 34333 - DNA, 27 bp, Artificial Sequence
  Description of Artificial Sequence: Synthetic oligonucleotide
tacgtggacgacaccctgttcgtgagg

SEQ ID NO: 34334 - DNA, 27 bp, Artificial Sequence
  Description of Artificial Sequence: Synthetic oligonucleotide
acgtggacgacaccctgttcgtgaggt

SEQ ID NO: 34335 - DNA, 27 bp, Artificial Sequence
  Description of Artificial Sequence: Synthetic oligonucleotide
cgtggacgacaccctgttcgtgaggtt

SEQ ID NO: 34336 - DNA, 27 bp, Artificial Sequence
  Description of Artificial Sequence: Synthetic oligonucleotide
gtggacgacaccctgttcgtgaggttc

SEQ ID NO: 34337 - DNA, 27 bp, Artificial Sequence
  Description of Artificial Sequence: Synthetic oligonucleotide
tggacgacaccctgttcgtgaggttcg

SEQ ID NO: 34338 - DNA, 27 bp, Artificial Sequence
  Description of Artificial Sequence: Synthetic oligonucleotide
ggacgacaccctgttcgtgaggttcga

SEQ ID NO: 34339 - DNA, 27 bp, Artificial Sequence
  Description of Artificial Sequence: Synthetic oligonucleotide
gacgacaccctgttcgtgaggttcgac

SEQ ID NO: 34340 - DNA, 28 bp, Artificial Sequence
  Description of Artificial Sequence: Synthetic oligonucleotide
acgacaccctgttcgtgaggttcgacag

SEQ ID NO: 34341 - DNA, 27 bp, Artificial Sequence
  Description of Artificial Sequence: Synthetic oligonucleotide
cgacaccctgttcgtgaggttcgacag

SEQ ID NO: 34342 - DNA, 27 bp, Artificial Sequence
  Description of Artificial Sequence: Synthetic oligonucleotide
gacaccctgttcgtgaggttcgacagc

SEQ ID NO: 34343 - DNA, 27 bp, Artificial Sequence
  Description of Artificial Sequence: Synthetic oligonucleotide
acaccctgttcgtgaggttcgacagcg

SEQ ID NO: 34344 - DNA, 27 bp, Artificial Sequence
  Description of Artificial Sequence: Synthetic oligonucleotide
caccctgttcgtgaggttcgacagcga

SEQ ID NO: 34345 - DNA, 27 bp, Artificial Sequence
  Description of Artificial Sequence: Synthetic oligonucleotide
accctgttcgtgaggttcgacagcgac

SEQ ID NO: 34346 - DNA, 26 bp, Artificial Sequence
  Description of Artificial Sequence: Synthetic oligonucleotide
ccctgttcgtgaggttcgacagcgac

SEQ ID NO: 34347 - DNA, 26 bp, Artificial Sequence
  Description of Artificial Sequence: Synthetic oligonucleotide
cctgttcgtgaggttcgacagcgacg

SEQ ID NO: 34348 - DNA, 27 bp, Artificial Sequence
  Description of Artificial Sequence: Synthetic oligonucleotide
ttcgtgaggttcgacagcgacgccaca

SEQ ID NO: 34349 - DNA, 27 bp, Artificial Sequence
  Description of Artificial Sequence: Synthetic oligonucleotide
tcgtgaggttcgacagcgacgccacaa

SEQ ID NO: 34350 - DNA, 26 bp, Artificial Sequence
  Description of Artificial Sequence: Synthetic oligonucleotide
cgtgaggttcgacagcgacgccacaa

SEQ ID NO: 34351 - DNA, 27 bp, Artificial Sequence
  Description of Artificial Sequence: Synthetic oligonucleotide
gtgaggttcgacagcgacgccacaagt

SEQ ID NO: 34352 - DNA, 27 bp, Artificial Sequence
  Description of Artificial Sequence: Synthetic oligonucleotide
tgaggttcgacagcgacgccacaagtc

SEQ ID NO: 34353 - DNA, 26 bp, Artificial Sequence
  Description of Artificial Sequence: Synthetic oligonucleotide
gaggttcgacagcgacgccacaagtc

SEQ ID NO: 34354 - DNA, 26 bp, Artificial Sequence
  Description of Artificial Sequence: Synthetic oligonucleotide
aggttcgacagcgacgccacaagtcc

SEQ ID NO: 34355 - DNA, 25 bp, Artificial Sequence
  Description of Artificial Sequence: Synthetic oligonucleotide
ggttcgacagcgacgccacaagtcc

SEQ ID NO: 34356 - DNA, 26 bp, Artificial Sequence
  Description of Artificial Sequence: Synthetic oligonucleotide
gttcgacagcgacgccacaagtccga

SEQ ID NO: 34357 - DNA, 26 bp, Artificial Sequence
  Description of Artificial Sequence: Synthetic oligonucleotide
ttcgacagcgacgccacaagtccgag

SEQ ID NO: 34358 - DNA, 25 bp, Artificial Sequence
  Description of Artificial Sequence: Synthetic oligonucleotide
tcgacagcgacgccacaagtccgag

SEQ ID NO: 34359 - DNA, 24 bp, Artificial Sequence
  Description of Artificial Sequence: Synthetic oligonucleotide
cgacagcgacgccacaagtccgag

SEQ ID NO: 34360 - DNA, 26 bp, Artificial Sequence
  Description of Artificial Sequence: Synthetic oligonucleotide
gacagcgacgccacaagtccgaggaa

SEQ ID NO: 34361 - DNA, 26 bp, Artificial Sequence
  Description of Artificial Sequence: Synthetic oligonucleotide
acagcgacgccacaagtccgaggaag

SEQ ID NO: 34362 - DNA, 25 bp, Artificial Sequence
  Description of Artificial Sequence: Synthetic oligonucleotide
cagcgacgccacaagtccgaggaag

SEQ ID NO: 34363 - DNA, 26 bp, Artificial Sequence
  Description of Artificial Sequence: Synthetic oligonucleotide
agcgacgccacaagtccgaggaagga

SEQ ID NO: 34364 - DNA, 25 bp, Artificial Sequence
  Description of Artificial Sequence: Synthetic oligonucleotide
gcgacgccacaagtccgaggaagga

SEQ ID NO: 34365 - DNA, 25 bp, Artificial Sequence
  Description of Artificial Sequence: Synthetic oligonucleotide
cgacgccacaagtccgaggaaggag

SEQ ID NO: 34366 - DNA, 25 bp, Artificial Sequence
  Description of Artificial Sequence: Synthetic oligonucleotide
gacgccacaagtccgaggaaggagc

SEQ ID NO: 34367 - DNA, 25 bp, Artificial Sequence
  Description of Artificial Sequence: Synthetic oligonucleotide
acgccacaagtccgaggaaggagcc

SEQ ID NO: 34368 - DNA, 24 bp, Artificial Sequence
  Description of Artificial Sequence: Synthetic oligonucleotide
cgccacaagtccgaggaaggagcc

SEQ ID NO: 34369 - DNA, 24 bp, Artificial Sequence
  Description of Artificial Sequence: Synthetic oligonucleotide
gccacaagtccgaggaaggagccg

SEQ ID NO: 34370 - DNA, 24 bp, Artificial Sequence
  Description of Artificial Sequence: Synthetic oligonucleotide
ccacaagtccgaggaaggagccgc

SEQ ID NO: 34371 - DNA, 24 bp, Artificial Sequence
  Description of Artificial Sequence: Synthetic oligonucleotide
cacaagtccgaggaaggagccgcg

SEQ ID NO: 34372 - DNA, 24 bp, Artificial Sequence
  Description of Artificial Sequence: Synthetic oligonucleotide
acaagtccgaggaaggagccgcgg

SEQ ID NO: 34373 - DNA, 23 bp, Artificial Sequence
  Description of Artificial Sequence: Synthetic oligonucleotide
caagtccgaggaaggagccgcgg

SEQ ID NO: 34374 - DNA, 23 bp, Artificial Sequence
  Description of Artificial Sequence: Synthetic oligonucleotide
aagtccgaggaaggagccgcggg

SEQ ID NO: 34375 - DNA, 31 bp, Artificial Sequence
  Description of Artificial Sequence: Synthetic oligonucleotide
ctacgacggcaaggattacatcgctctgaac

SEQ ID NO: 34376 - DNA, 31 bp, Artificial Sequence
  Description of Artificial Sequence: Synthetic oligonucleotide
tacgacggcaaggattacatcgctctgaacg

SEQ ID NO: 34377 - DNA, 30 bp, Artificial Sequence
  Description of Artificial Sequence: Synthetic oligonucleotide
acgacggcaaggattacatcgctctgaacg

SEQ ID NO: 34378 - DNA, 29 bp, Artificial Sequence
  Description of Artificial Sequence: Synthetic oligonucleotide
cgacggcaaggattacatcgctctgaacg

SEQ ID NO: 34379 - DNA, 30 bp, Artificial Sequence
  Description of Artificial Sequence: Synthetic oligonucleotide
gacggcaaggattacatcgctctgaacgag

SEQ ID NO: 34380 - DNA, 30 bp, Artificial Sequence
  Description of Artificial Sequence: Synthetic oligonucleotide
acggcaaggattacatcgctctgaacgagg

SEQ ID NO: 34381 - DNA, 29 bp, Artificial Sequence
  Description of Artificial Sequence: Synthetic oligonucleotide
cggcaaggattacatcgctctgaacgagg

SEQ ID NO: 34382 - DNA, 30 bp, Artificial Sequence
  Description of Artificial Sequence: Synthetic oligonucleotide
ggcaaggattacatcgctctgaacgaggac

SEQ ID NO: 34383 - DNA, 30 bp, Artificial Sequence
  Description of Artificial Sequence: Synthetic oligonucleotide
gcaaggattacatcgctctgaacgaggacc

SEQ ID NO: 34384 - DNA, 31 bp, Artificial Sequence
  Description of Artificial Sequence: Synthetic oligonucleotide
caaggattacatcgctctgaacgaggacctg

SEQ ID NO: 34385 - DNA, 31 bp, Artificial Sequence
  Description of Artificial Sequence: Synthetic oligonucleotide
aaggattacatcgctctgaacgaggacctgc

SEQ ID NO: 34386 - DNA, 30 bp, Artificial Sequence
  Description of Artificial Sequence: Synthetic oligonucleotide
aggattacatcgctctgaacgaggacctgc

SEQ ID NO: 34387 - DNA, 29 bp, Artificial Sequence
  Description of Artificial Sequence: Synthetic oligonucleotide
ggattacatcgctctgaacgaggacctgc

SEQ ID NO: 34388 - DNA, 29 bp, Artificial Sequence
  Description of Artificial Sequence: Synthetic oligonucleotide
gattacatcgctctgaacgaggacctgcg

SEQ ID NO: 34389 - DNA, 29 bp, Artificial Sequence
  Description of Artificial Sequence: Synthetic oligonucleotide
attacatcgctctgaacgaggacctgcgc

SEQ ID NO: 34390 - DNA, 28 bp, Artificial Sequence
  Description of Artificial Sequence: Synthetic oligonucleotide
ttacatcgctctgaacgaggacctgcgc

SEQ ID NO: 34391 - DNA, 27 bp, Artificial Sequence
  Description of Artificial Sequence: Synthetic oligonucleotide
tacatcgctctgaacgaggacctgcgc

SEQ ID NO: 34392 - DNA, 27 bp, Artificial Sequence
  Description of Artificial Sequence: Synthetic oligonucleotide
acatcgctctgaacgaggacctgcgct

SEQ ID NO: 34393 - DNA, 26 bp, Artificial Sequence
  Description of Artificial Sequence: Synthetic oligonucleotide
catcgctctgaacgaggacctgcgct

SEQ ID NO: 34394 - DNA, 26 bp, Artificial Sequence
  Description of Artificial Sequence: Synthetic oligonucleotide
atcgctctgaacgaggacctgcgctc

SEQ ID NO: 34395 - DNA, 25 bp, Artificial Sequence
  Description of Artificial Sequence: Synthetic oligonucleotide
tcgctctgaacgaggacctgcgctc

SEQ ID NO: 34396 - DNA, 24 bp, Artificial Sequence
  Description of Artificial Sequence: Synthetic oligonucleotide
cgctctgaacgaggacctgcgctc

SEQ ID NO: 34397 - DNA, 25 bp, Artificial Sequence
  Description of Artificial Sequence: Synthetic oligonucleotide
gctctgaacgaggacctgcgctcct

SEQ ID NO: 34398 - DNA, 25 bp, Artificial Sequence
  Description of Artificial Sequence: Synthetic oligonucleotide
ctctgaacgaggacctgcgctcctg

SEQ ID NO: 34399 - DNA, 26 bp, Artificial Sequence
  Description of Artificial Sequence: Synthetic oligonucleotide
tctgaacgaggacctgcgctcctgga

SEQ ID NO: 34400 - DNA, 28 bp, Artificial Sequence
  Description of Artificial Sequence: Synthetic oligonucleotide
gggtctcacaccctccagagcatgtatg

SEQ ID NO: 34401 - DNA, 28 bp, Artificial Sequence
  Description of Artificial Sequence: Synthetic oligonucleotide
ggtctcacaccctccagagcatgtatgg

SEQ ID NO: 34402 - DNA, 28 bp, Artificial Sequence
  Description of Artificial Sequence: Synthetic oligonucleotide
gtctcacaccctccagagcatgtatggc

SEQ ID NO: 34403 - DNA, 29 bp, Artificial Sequence
  Description of Artificial Sequence: Synthetic oligonucleotide
tctcacaccctccagagcatgtatggctg

SEQ ID NO: 34404 - DNA, 28 bp, Artificial Sequence
  Description of Artificial Sequence: Synthetic oligonucleotide
ctcacaccctccagagcatgtatggctg

SEQ ID NO: 34405 - DNA, 28 bp, Artificial Sequence
  Description of Artificial Sequence: Synthetic oligonucleotide
tcacaccctccagagcatgtatggctgc

SEQ ID NO: 34406 - DNA, 27 bp, Artificial Sequence
  Description of Artificial Sequence: Synthetic oligonucleotide
cacaccctccagagcatgtatggctgc

SEQ ID NO: 34407 - DNA, 27 bp, Artificial Sequence
  Description of Artificial Sequence: Synthetic oligonucleotide
acaccctccagagcatgtatggctgcg

SEQ ID NO: 34408 - DNA, 27 bp, Artificial Sequence
  Description of Artificial Sequence: Synthetic oligonucleotide
caccctccagagcatgtatggctgcga

SEQ ID NO: 34409 - DNA, 27 bp, Artificial Sequence
  Description of Artificial Sequence: Synthetic oligonucleotide
accctccagagcatgtatggctgcgac

SEQ ID NO: 34410 - DNA, 26 bp, Artificial Sequence
  Description of Artificial Sequence: Synthetic oligonucleotide
ccctccagagcatgtatggctgcgac

SEQ ID NO: 34411 - DNA, 27 bp, Artificial Sequence
  Description of Artificial Sequence: Synthetic oligonucleotide
cctccagagcatgtatggctgcgacgt

SEQ ID NO: 34412 - DNA, 27 bp, Artificial Sequence
  Description of Artificial Sequence: Synthetic oligonucleotide
ctccagagcatgtatggctgcgacgtg

SEQ ID NO: 34413 - DNA, 27 bp, Artificial Sequence
  Description of Artificial Sequence: Synthetic oligonucleotide
tccagagcatgtatggctgcgacgtgg

SEQ ID NO: 34414 - DNA, 26 bp, Artificial Sequence
  Description of Artificial Sequence: Synthetic oligonucleotide
ccagagcatgtatggctgcgacgtgg

SEQ ID NO: 34415 - DNA, 26 bp, Artificial Sequence
  Description of Artificial Sequence: Synthetic oligonucleotide
cagagcatgtatggctgcgacgtggg

SEQ ID NO: 34416 - DNA, 26 bp, Artificial Sequence
  Description of Artificial Sequence: Synthetic oligonucleotide
agagcatgtatggctgcgacgtgggg

SEQ ID NO: 34417 - DNA, 25 bp, Artificial Sequence
  Description of Artificial Sequence: Synthetic oligonucleotide
gagcatgtatggctgcgacgtgggg

SEQ ID NO: 34418 - DNA, 25 bp, Artificial Sequence
  Description of Artificial Sequence: Synthetic oligonucleotide
agcatgtatggctgcgacgtggggc

SEQ ID NO: 34419 - DNA, 24 bp, Artificial Sequence
  Description of Artificial Sequence: Synthetic oligonucleotide
gcatgtatggctgcgacgtggggc

SEQ ID NO: 34420 - DNA, 24 bp, Artificial Sequence
  Description of Artificial Sequence: Synthetic oligonucleotide
catgtatggctgcgacgtggggcc

SEQ ID NO: 34421 - DNA, 20 bp, Artificial Sequence
  Description of Artificial Sequence: Synthetic oligonucleotide
gccggacgggcgcctcctgt

SEQ ID NO: 34422 - DNA, 20 bp, Artificial Sequence
  Description of Artificial Sequence: Synthetic oligonucleotide
ccggacgggcgcctcctgct

SEQ ID NO: 34423 - DNA, 20 bp, Artificial Sequence
  Description of Artificial Sequence: Synthetic oligonucleotide
cggacgggcgcctcctgcgt

SEQ ID NO: 34424 - DNA, 20 bp, Artificial Sequence
  Description of Artificial Sequence: Synthetic oligonucleotide
ggacgggcgcctcctgcgct

SEQ ID NO: 34425 - DNA, 20 bp, Artificial Sequence
  Description of Artificial Sequence: Synthetic oligonucleotide
gacgggcgcctcctgcgcgt

SEQ ID NO: 34426 - DNA, 20 bp, Artificial Sequence
  Description of Artificial Sequence: Synthetic oligonucleotide
acgggcgcctcctgcgcggt

SEQ ID NO: 34427 - DNA, 20 bp, Artificial Sequence
  Description of Artificial Sequence: Synthetic oligonucleotide
cgggcgcctcctgcgcggtt

SEQ ID NO: 34428 - DNA, 20 bp, Artificial Sequence
  Description of Artificial Sequence: Synthetic oligonucleotide
gggcgcctcctgcgcgggtt

SEQ ID NO: 34429 - DNA, 22 bp, Artificial Sequence
  Description of Artificial Sequence: Synthetic oligonucleotide
ggcgcctcctgcgcgggcataa

SEQ ID NO: 34430 - DNA, 22 bp, Artificial Sequence
  Description of Artificial Sequence: Synthetic oligonucleotide
gcgcctcctgcgcgggcataac

SEQ ID NO: 34431 - DNA, 23 bp, Artificial Sequence
  Description of Artificial Sequence: Synthetic oligonucleotide
cgcctcctgcgcgggcataacca

SEQ ID NO: 34432 - DNA, 25 bp, Artificial Sequence
  Description of Artificial Sequence: Synthetic oligonucleotide
gcctcctgcgcgggcataaccagta

SEQ ID NO: 34433 - DNA, 25 bp, Artificial Sequence
  Description of Artificial Sequence: Synthetic oligonucleotide
cctcctgcgcgggcataaccagtac

SEQ ID NO: 34434 - DNA, 25 bp, Artificial Sequence
  Description of Artificial Sequence: Synthetic oligonucleotide
ctcctgcgcgggcataaccagtacg

SEQ ID NO: 34435 - DNA, 25 bp, Artificial Sequence
  Description of Artificial Sequence: Synthetic oligonucleotide
tcctgcgcgggcataaccagtacgc

SEQ ID NO: 34436 - DNA, 24 bp, Artificial Sequence
  Description of Artificial Sequence: Synthetic oligonucleotide
cctgcgcgggcataaccagtacgc

SEQ ID NO: 34437 - DNA, 26 bp, Artificial Sequence
  Description of Artificial Sequence: Synthetic oligonucleotide
ctgcgcgggcataaccagtacgccta

SEQ ID NO: 34438 - DNA, 26 bp, Artificial Sequence
  Description of Artificial Sequence: Synthetic oligonucleotide
tgcgcgggcataaccagtacgcctac

SEQ ID NO: 34439 - DNA, 25 bp, Artificial Sequence
  Description of Artificial Sequence: Synthetic oligonucleotide
gcgcgggcataaccagtacgcctac

SEQ ID NO: 34440 - DNA, 23 bp, Artificial Sequence
  Description of Artificial Sequence: Synthetic oligonucleotide
agcctacctggagggcgagtgcg

SEQ ID NO: 34441 - DNA, 22 bp, Artificial Sequence
  Description of Artificial Sequence: Synthetic oligonucleotide
gcctacctggagggcgagtgcg

SEQ ID NO: 34442 - DNA, 22 bp, Artificial Sequence
  Description of Artificial Sequence: Synthetic oligonucleotide
cctacctggagggcgagtgcgc

SEQ ID NO: 34443 - DNA, 22 bp, Artificial Sequence
  Description of Artificial Sequence: Synthetic oligonucleotide
ctacctggagggcgagtgcgcg

SEQ ID NO: 34444 - DNA, 23 bp, Artificial Sequence
  Description of Artificial Sequence: Synthetic oligonucleotide
tacctggagggcgagtgcgcgga

SEQ ID NO: 34445 - DNA, 22 bp, Artificial Sequence
  Description of Artificial Sequence: Synthetic oligonucleotide
acctggagggcgagtgcgcgga

SEQ ID NO: 34446 - DNA, 21 bp, Artificial Sequence
  Description of Artificial Sequence: Synthetic oligonucleotide
cctggagggcgagtgcgcgga

SEQ ID NO: 34447 - DNA, 22 bp, Artificial Sequence
  Description of Artificial Sequence: Synthetic oligonucleotide
ctggagggcgagtgcgcggagt

SEQ ID NO: 34448 - DNA, 22 bp, Artificial Sequence
  Description of Artificial Sequence: Synthetic oligonucleotide
tggagggcgagtgcgcggagtg

SEQ ID NO: 34449 - DNA, 21 bp, Artificial Sequence
  Description of Artificial Sequence: Synthetic oligonucleotide
ggagggcgagtgcgcggagtg

SEQ ID NO: 34450 - DNA, 21 bp, Artificial Sequence
  Description of Artificial Sequence: Synthetic oligonucleotide
gagggcgagtgcgcggagtgg

SEQ ID NO: 34451 - DNA, 22 bp, Artificial Sequence
  Description of Artificial Sequence: Synthetic oligonucleotide
agggcgagtgcgcggagtggct

SEQ ID NO: 34452 - DNA, 21 bp, Artificial Sequence
  Description of Artificial Sequence: Synthetic oligonucleotide
gggcgagtgcgcggagtggct

SEQ ID NO: 34453 - DNA, 21 bp, Artificial Sequence
  Description of Artificial Sequence: Synthetic oligonucleotide
ggcgagtgcgcggagtggctc

SEQ ID NO: 34454 - DNA, 21 bp, Artificial Sequence
  Description of Artificial Sequence: Synthetic oligonucleotide
gcgagtgcgcggagtggctcc

SEQ ID NO: 34455 - DNA, 21 bp, Artificial Sequence
  Description of Artificial Sequence: Synthetic oligonucleotide
cgagtgcgcggagtggctccg

SEQ ID NO: 34456 - DNA, 22 bp, Artificial Sequence
  Description of Artificial Sequence: Synthetic oligonucleotide
gagtgcgcggagtggctccgca

SEQ ID NO: 34457 - DNA, 25 bp, Artificial Sequence
  Description of Artificial Sequence: Synthetic oligonucleotide
agtgcgcggagtggctccgcagata

SEQ ID NO: 34458 - DNA, 25 bp, Artificial Sequence
  Description of Artificial Sequence: Synthetic oligonucleotide
cgcgggcataaccagtacgcctacg

SEQ ID NO: 34459 - DNA, 25 bp, Artificial Sequence
  Description of Artificial Sequence: Synthetic oligonucleotide
gcgggcataaccagtacgcctacgg

SEQ ID NO: 34460 - DNA, 25 bp, Artificial Sequence
  Description of Artificial Sequence: Synthetic oligonucleotide
cgggcataaccagtacgcctacggc

SEQ ID NO: 34461 - DNA, 25 bp, Artificial Sequence
  Description of Artificial Sequence: Synthetic oligonucleotide
gggcataaccagtacgcctacggcg

SEQ ID NO: 34462 - DNA, 25 bp, Artificial Sequence
  Description of Artificial Sequence: Synthetic oligonucleotide
ggcataaccagtacgcctacggcgg

SEQ ID NO: 34463 - DNA, 27 bp, Artificial Sequence
  Description of Artificial Sequence: Synthetic oligonucleotide
gcataaccagtacgcctacggcggcaa

SEQ ID NO: 34464 - DNA, 27 bp, Artificial Sequence
  Description of Artificial Sequence: Synthetic oligonucleotide
cataaccagtacgcctacggcggcaag

SEQ ID NO: 34465 - DNA, 27 bp, Artificial Sequence
  Description of Artificial Sequence: Synthetic oligonucleotide
ataaccagtacgcctacggcggcaagg

SEQ ID NO: 34466 - DNA, 27 bp, Artificial Sequence
  Description of Artificial Sequence: Synthetic oligonucleotide
taaccagtacgcctacggcggcaagga

SEQ ID NO: 34467 - DNA, 27 bp, Artificial Sequence
  Description of Artificial Sequence: Synthetic oligonucleotide
aaccagtacgcctacggcggcaaggat

SEQ ID NO: 34468 - DNA, 27 bp, Artificial Sequence
  Description of Artificial Sequence: Synthetic oligonucleotide
accagtacgcctacggcggcaaggatt

SEQ ID NO: 34469 - DNA, 27 bp, Artificial Sequence
  Description of Artificial Sequence: Synthetic oligonucleotide
ccagtacgcctacggcggcaaggatta

SEQ ID NO: 34470 - DNA, 27 bp, Artificial Sequence
  Description of Artificial Sequence: Synthetic oligonucleotide
cagtacgcctacggcggcaaggattac

SEQ ID NO: 34471 - DNA, 29 bp, Artificial Sequence
  Description of Artificial Sequence: Synthetic oligonucleotide
agtacgcctacggcggcaaggattacatc

SEQ ID NO: 34472 - DNA, 28 bp, Artificial Sequence
  Description of Artificial Sequence: Synthetic oligonucleotide
gtacgcctacggcggcaaggattacatc

SEQ ID NO: 34473 - DNA, 28 bp, Artificial Sequence
  Description of Artificial Sequence: Synthetic oligonucleotide
tacgcctacggcggcaaggattacatcg

SEQ ID NO: 34474 - DNA, 28 bp, Artificial Sequence
  Description of Artificial Sequence: Synthetic oligonucleotide
cgggagacacagatctccaagaccaacg

SEQ ID NO: 34475 - DNA, 28 bp, Artificial Sequence
  Description of Artificial Sequence: Synthetic oligonucleotide
gggagacacagatctccaagaccaacgc

SEQ ID NO: 34476 - DNA, 29 bp, Artificial Sequence
  Description of Artificial Sequence: Synthetic oligonucleotide
ggagacacagatctccaagaccaacgcac

SEQ ID NO: 34477 - DNA, 30 bp, Artificial Sequence
  Description of Artificial Sequence: Synthetic oligonucleotide
gagacacagatctccaagaccaacgcacag

SEQ ID NO: 34478 - DNA, 31 bp, Artificial Sequence
  Description of Artificial Sequence: Synthetic oligonucleotide
agacacagatctccaagaccaacgcacagac

SEQ ID NO: 34479 - DNA, 30 bp, Artificial Sequence
  Description of Artificial Sequence: Synthetic oligonucleotide
gacacagatctccaagaccaacgcacagac

SEQ ID NO: 34480 - DNA, 33 bp, Artificial Sequence
  Description of Artificial Sequence: Synthetic oligonucleotide
acacagatctccaagaccaacgcacagacttac

SEQ ID NO: 34481 - DNA, 32 bp, Artificial Sequence
  Description of Artificial Sequence: Synthetic oligonucleotide
cacagatctccaagaccaacgcacagacttac

SEQ ID NO: 34482 - DNA, 32 bp, Artificial Sequence
  Description of Artificial Sequence: Synthetic oligonucleotide
acagatctccaagaccaacgcacagacttacc

SEQ ID NO: 34483 - DNA, 31 bp, Artificial Sequence
  Description of Artificial Sequence: Synthetic oligonucleotide
cagatctccaagaccaacgcacagacttacc

SEQ ID NO: 34484 - DNA, 31 bp, Artificial Sequence
  Description of Artificial Sequence: Synthetic oligonucleotide
agatctccaagaccaacgcacagacttaccg

SEQ ID NO: 34485 - DNA, 30 bp, Artificial Sequence
  Description of Artificial Sequence: Synthetic oligonucleotide
gatctccaagaccaacgcacagacttaccg

SEQ ID NO: 34486 - DNA, 31 bp, Artificial Sequence
  Description of Artificial Sequence: Synthetic oligonucleotide
atctccaagaccaacgcacagacttaccgag

SEQ ID NO: 34487 - DNA, 30 bp, Artificial Sequence
  Description of Artificial Sequence: Synthetic oligonucleotide
tctccaagaccaacgcacagacttaccgag

SEQ ID NO: 34488 - DNA, 29 bp, Artificial Sequence
  Description of Artificial Sequence: Synthetic oligonucleotide
ctccaagaccaacgcacagacttaccgag

SEQ ID NO: 34489 - DNA, 30 bp, Artificial Sequence
  Description of Artificial Sequence: Synthetic oligonucleotide
tccaagaccaacgcacagacttaccgagag

SEQ ID NO: 34490 - DNA, 29 bp, Artificial Sequence
  Description of Artificial Sequence: Synthetic oligonucleotide
ccaagaccaacgcacagacttaccgagag

SEQ ID NO: 34491 - DNA, 30 bp, Artificial Sequence
  Description of Artificial Sequence: Synthetic oligonucleotide
caagaccaacgcacagacttaccgagagag

SEQ ID NO: 34492 - DNA, 30 bp, Artificial Sequence
  Description of Artificial Sequence: Synthetic oligonucleotide
aagaccaacgcacagacttaccgagagagc

SEQ ID NO: 34493 - DNA, 29 bp, Artificial Sequence
  Description of Artificial Sequence: Synthetic oligonucleotide
agaccaacgcacagacttaccgagagagc

SEQ ID NO: 34494 - DNA, 28 bp, Artificial Sequence
  Description of Artificial Sequence: Synthetic oligonucleotide
gaccaacgcacagacttaccgagagagc

SEQ ID NO: 34495 - DNA, 28 bp, Artificial Sequence
  Description of Artificial Sequence: Synthetic oligonucleotide
accaacgcacagacttaccgagagagcc

SEQ ID NO: 34496 - DNA, 27 bp, Artificial Sequence
  Description of Artificial Sequence: Synthetic oligonucleotide
ccaacgcacagacttaccgagagagcc

SEQ ID NO: 34497 - DNA, 28 bp, Artificial Sequence
  Description of Artificial Sequence: Synthetic oligonucleotide
caacgcacagacttaccgagagagcctg

SEQ ID NO: 34498 - DNA, 28 bp, Artificial Sequence
  Description of Artificial Sequence: Synthetic oligonucleotide
aacgcacagacttaccgagagagcctgc

SEQ ID NO: 34499 - DNA, 27 bp, Artificial Sequence
  Description of Artificial Sequence: Synthetic oligonucleotide
acgcacagacttaccgagagagcctgc

SEQ ID NO: 34500 - DNA, 26 bp, Artificial Sequence
  Description of Artificial Sequence: Synthetic oligonucleotide
cgcacagacttaccgagagagcctgc

SEQ ID NO: 34501 - DNA, 27 bp, Artificial Sequence
  Description of Artificial Sequence: Synthetic oligonucleotide
cgagtgcgtggagtggctccgcaaata

SEQ ID NO: 34502 - DNA, 27 bp, Artificial Sequence
  Description of Artificial Sequence: Synthetic oligonucleotide
gagtgcgtggagtggctccgcaaatac

SEQ ID NO: 34503 - DNA, 27 bp, Artificial Sequence
  Description of Artificial Sequence: Synthetic oligonucleotide
agtgcgtggagtggctccgcaaatacc

SEQ ID NO: 34504 - DNA, 27 bp, Artificial Sequence
  Description of Artificial Sequence: Synthetic oligonucleotide
gtgcgtggagtggctccgcaaatacct

SEQ ID NO: 34505 - DNA, 27 bp, Artificial Sequence
  Description of Artificial Sequence: Synthetic oligonucleotide
tgcgtggagtggctccgcaaatacctg

SEQ ID NO: 34506 - DNA, 26 bp, Artificial Sequence
  Description of Artificial Sequence: Synthetic oligonucleotide
gcgtggagtggctccgcaaatacctg

SEQ ID NO: 34507 - DNA, 27 bp, Artificial Sequence
  Description of Artificial Sequence: Synthetic oligonucleotide
cgtggagtggctccgcaaatacctgga

SEQ ID NO: 34508 - DNA, 27 bp, Artificial Sequence
  Description of Artificial Sequence: Synthetic oligonucleotide
gtggagtggctccgcaaatacctggag

SEQ ID NO: 34509 - DNA, 29 bp, Artificial Sequence
  Description of Artificial Sequence: Synthetic oligonucleotide
tggagtggctccgcaaatacctggagaac

SEQ ID NO: 34510 - DNA, 28 bp, Artificial Sequence
  Description of Artificial Sequence: Synthetic oligonucleotide
ggagtggctccgcaaatacctggagaac

SEQ ID NO: 34511 - DNA, 28 bp, Artificial Sequence
  Description of Artificial Sequence: Synthetic oligonucleotide
gagtggctccgcaaatacctggagaacg

SEQ ID NO: 34512 - DNA, 28 bp, Artificial Sequence
  Description of Artificial Sequence: Synthetic oligonucleotide
agtggctccgcaaatacctggagaacgg

SEQ ID NO: 34513 - DNA, 27 bp, Artificial Sequence
  Description of Artificial Sequence: Synthetic oligonucleotide
gtggctccgcaaatacctggagaacgg

SEQ ID NO: 34514 - DNA, 27 bp, Artificial Sequence
  Description of Artificial Sequence: Synthetic oligonucleotide
tggctccgcaaatacctggagaacggg

SEQ ID NO: 34515 - DNA, 27 bp, Artificial Sequence
  Description of Artificial Sequence: Synthetic oligonucleotide
ggctccgcaaatacctggagaacggga

SEQ ID NO: 34516 - DNA, 28 bp, Artificial Sequence
  Description of Artificial Sequence: Synthetic oligonucleotide
gctccgcaaatacctggagaacgggaag

SEQ ID NO: 34517 - DNA, 28 bp, Artificial Sequence
  Description of Artificial Sequence: Synthetic oligonucleotide
ctccgcaaatacctggagaacgggaagg

SEQ ID NO: 34518 - DNA, 29 bp, Artificial Sequence
  Description of Artificial Sequence: Synthetic oligonucleotide
tccgcaaatacctggagaacgggaaggag

SEQ ID NO: 34519 - DNA, 28 bp, Artificial Sequence
  Description of Artificial Sequence: Synthetic oligonucleotide
ccgcaaatacctggagaacgggaaggag

SEQ ID NO: 34520 - DNA, 29 bp, Artificial Sequence
  Description of Artificial Sequence: Synthetic oligonucleotide
cgcaaatacctggagaacgggaaggagac

SEQ ID NO: 34521 - DNA, 29 bp, Artificial Sequence
  Description of Artificial Sequence: Synthetic oligonucleotide
gcaaatacctggagaacgggaaggagacg

SEQ ID NO: 34522 - DNA, 29 bp, Artificial Sequence
  Description of Artificial Sequence: Synthetic oligonucleotide
caaatacctggagaacgggaaggagacgc

SEQ ID NO: 34523 - DNA, 30 bp, Artificial Sequence
  Description of Artificial Sequence: Synthetic oligonucleotide
aaatacctggagaacgggaaggagacgctg

SEQ ID NO: 34524 - DNA, 29 bp, Artificial Sequence
  Description of Artificial Sequence: Synthetic oligonucleotide
aatacctggagaacgggaaggagacgctg

SEQ ID NO: 34525 - DNA, 23 bp, Artificial Sequence
  Description of Artificial Sequence: Synthetic oligonucleotide
ggcgagtgcgtggagtggctcct

SEQ ID NO: 34526 - DNA, 24 bp, Artificial Sequence
  Description of Artificial Sequence: Synthetic oligonucleotide
gcgagtgcgtggagtggctcctca

SEQ ID NO: 34527 - DNA, 27 bp, Artificial Sequence
  Description of Artificial Sequence: Synthetic oligonucleotide
cgagtgcgtggagtggctcctcagata

SEQ ID NO: 34528 - DNA, 27 bp, Artificial Sequence
  Description of Artificial Sequence: Synthetic oligonucleotide
gagtgcgtggagtggctcctcagatac

SEQ ID NO: 34529 - DNA, 27 bp, Artificial Sequence
  Description of Artificial Sequence: Synthetic oligonucleotide
agtgcgtggagtggctcctcagatacc

SEQ ID NO: 34530 - DNA, 27 bp, Artificial Sequence
  Description of Artificial Sequence: Synthetic oligonucleotide
gtgcgtggagtggctcctcagatacct

SEQ ID NO: 34531 - DNA, 27 bp, Artificial Sequence
  Description of Artificial Sequence: Synthetic oligonucleotide
tgcgtggagtggctcctcagatacctg

SEQ ID NO: 34532 - DNA, 26 bp, Artificial Sequence
  Description of Artificial Sequence: Synthetic oligonucleotide
gcgtggagtggctcctcagatacctg

SEQ ID NO: 34533 - DNA, 27 bp, Artificial Sequence
  Description of Artificial Sequence: Synthetic oligonucleotide
cgtggagtggctcctcagatacctgga

SEQ ID NO: 34534 - DNA, 27 bp, Artificial Sequence
  Description of Artificial Sequence: Synthetic oligonucleotide
gtggagtggctcctcagatacctggag

SEQ ID NO: 34535 - DNA, 29 bp, Artificial Sequence
  Description of Artificial Sequence: Synthetic oligonucleotide
tggagtggctcctcagatacctggagaac

SEQ ID NO: 34536 - DNA, 28 bp, Artificial Sequence
  Description of Artificial Sequence: Synthetic oligonucleotide
ggagtggctcctcagatacctggagaac

SEQ ID NO: 34537 - DNA, 28 bp, Artificial Sequence
  Description of Artificial Sequence: Synthetic oligonucleotide
gagtggctcctcagatacctggagaacg

SEQ ID NO: 34538 - DNA, 28 bp, Artificial Sequence
  Description of Artificial Sequence: Synthetic oligonucleotide
agtggctcctcagatacctggagaacgg

SEQ ID NO: 34539 - DNA, 27 bp, Artificial Sequence
  Description of Artificial Sequence: Synthetic oligonucleotide
gtggctcctcagatacctggagaacgg

SEQ ID NO: 34540 - DNA, 27 bp, Artificial Sequence
  Description of Artificial Sequence: Synthetic oligonucleotide
tggctcctcagatacctggagaacggg

SEQ ID NO: 34541 - DNA, 27 bp, Artificial Sequence
  Description of Artificial Sequence: Synthetic oligonucleotide
ggctcctcagatacctggagaacggga

SEQ ID NO: 34542 - DNA, 28 bp, Artificial Sequence
  Description of Artificial Sequence: Synthetic oligonucleotide
gctcctcagatacctggagaacgggaag

SEQ ID NO: 34543 - DNA, 28 bp, Artificial Sequence
  Description of Artificial Sequence: Synthetic oligonucleotide
ctcctcagatacctggagaacgggaagg

SEQ ID NO: 34544 - DNA, 29 bp, Artificial Sequence
  Description of Artificial Sequence: Synthetic oligonucleotide
tcctcagatacctggagaacgggaaggag

SEQ ID NO: 34545 - DNA, 28 bp, Artificial Sequence
  Description of Artificial Sequence: Synthetic oligonucleotide
cctcagatacctggagaacgggaaggag

SEQ ID NO: 34546 - DNA, 29 bp, Artificial Sequence
  Description of Artificial Sequence: Synthetic oligonucleotide
ctcagatacctggagaacgggaaggagac

SEQ ID NO: 34547 - DNA, 29 bp, Artificial Sequence
  Description of Artificial Sequence: Synthetic oligonucleotide
tcagatacctggagaacgggaaggagacg

SEQ ID NO: 34548 - DNA, 20 bp, Artificial Sequence
  Description of Artificial Sequence: Synthetic oligonucleotide
ccgcggacacggcggctcag

SEQ ID NO: 34549 - DNA, 21 bp, Artificial Sequence
  Description of Artificial Sequence: Synthetic oligonucleotide
cgcggacacggcggctcagct

SEQ ID NO: 34550 - DNA, 22 bp, Artificial Sequence
  Description of Artificial Sequence: Synthetic oligonucleotide
gcggacacggcggctcagctct

SEQ ID NO: 34551 - DNA, 22 bp, Artificial Sequence
  Description of Artificial Sequence: Synthetic oligonucleotide
cggacacggcggctcagctctc

SEQ ID NO: 34552 - DNA, 22 bp, Artificial Sequence
  Description of Artificial Sequence: Synthetic oligonucleotide
ggacacggcggctcagctctcc

SEQ ID NO: 34553 - DNA, 23 bp, Artificial Sequence
  Description of Artificial Sequence: Synthetic oligonucleotide
gacacggcggctcagctctccca

SEQ ID NO: 34554 - DNA, 23 bp, Artificial Sequence
  Description of Artificial Sequence: Synthetic oligonucleotide
acacggcggctcagctctcccag

SEQ ID NO: 34555 - DNA, 22 bp, Artificial Sequence
  Description of Artificial Sequence: Synthetic oligonucleotide
cacggcggctcagctctcccag

SEQ ID NO: 34556 - DNA, 22 bp, Artificial Sequence
  Description of Artificial Sequence: Synthetic oligonucleotide
acggcggctcagctctcccagc

SEQ ID NO: 34557 - DNA, 21 bp, Artificial Sequence
  Description of Artificial Sequence: Synthetic oligonucleotide
cggcggctcagctctcccagc

SEQ ID NO: 34558 - DNA, 21 bp, Artificial Sequence
  Description of Artificial Sequence: Synthetic oligonucleotide
ggcggctcagctctcccagcg

SEQ ID NO: 34559 - DNA, 23 bp, Artificial Sequence
  Description of Artificial Sequence: Synthetic oligonucleotide
gcggctcagctctcccagcgcaa

SEQ ID NO: 34560 - DNA, 25 bp, Artificial Sequence
  Description of Artificial Sequence: Synthetic oligonucleotide
cggctcagctctcccagcgcaagtt

SEQ ID NO: 34561 - DNA, 25 bp, Artificial Sequence
  Description of Artificial Sequence: Synthetic oligonucleotide
ggctcagctctcccagcgcaagttg

SEQ ID NO: 34562 - DNA, 26 bp, Artificial Sequence
  Description of Artificial Sequence: Synthetic oligonucleotide
gctcagctctcccagcgcaagttgga

SEQ ID NO: 34563 - DNA, 26 bp, Artificial Sequence
  Description of Artificial Sequence: Synthetic oligonucleotide
ctcagctctcccagcgcaagttggag

SEQ ID NO: 34564 - DNA, 26 bp, Artificial Sequence
  Description of Artificial Sequence: Synthetic oligonucleotide
tcagctctcccagcgcaagttggagg

SEQ ID NO: 34565 - DNA, 25 bp, Artificial Sequence
  Description of Artificial Sequence: Synthetic oligonucleotide
cagctctcccagcgcaagttggagg

SEQ ID NO: 34566 - DNA, 25 bp, Artificial Sequence
  Description of Artificial Sequence: Synthetic oligonucleotide
agctctcccagcgcaagttggaggc

SEQ ID NO: 34567 - DNA, 24 bp, Artificial Sequence
  Description of Artificial Sequence: Synthetic oligonucleotide
gctctcccagcgcaagttggaggc

SEQ ID NO: 34568 - DNA, 24 bp, Artificial Sequence
  Description of Artificial Sequence: Synthetic oligonucleotide
ctctcccagcgcaagttggaggcg

SEQ ID NO: 34569 - DNA, 28 bp, Artificial Sequence
  Description of Artificial Sequence: Synthetic oligonucleotide
ataaccagtacgcctacgacggcaaggg

SEQ ID NO: 34570 - DNA, 27 bp, Artificial Sequence
  Description of Artificial Sequence: Synthetic oligonucleotide
taaccagtacgcctacgacggcaaggg

SEQ ID NO: 34571 - DNA, 27 bp, Artificial Sequence
  Description of Artificial Sequence: Synthetic oligonucleotide
aaccagtacgcctacgacggcaagggt

SEQ ID NO: 34572 - DNA, 27 bp, Artificial Sequence
  Description of Artificial Sequence: Synthetic oligonucleotide
accagtacgcctacgacggcaagggtt

SEQ ID NO: 34573 - DNA, 27 bp, Artificial Sequence
  Description of Artificial Sequence: Synthetic oligonucleotide
ccagtacgcctacgacggcaagggtta

SEQ ID NO: 34574 - DNA, 27 bp, Artificial Sequence
  Description of Artificial Sequence: Synthetic oligonucleotide
cagtacgcctacgacggcaagggttac

SEQ ID NO: 34575 - DNA, 29 bp, Artificial Sequence
  Description of Artificial Sequence: Synthetic oligonucleotide
agtacgcctacgacggcaagggttacatc

SEQ ID NO: 34576 - DNA, 28 bp, Artificial Sequence
  Description of Artificial Sequence: Synthetic oligonucleotide
gtacgcctacgacggcaagggttacatc

SEQ ID NO: 34577 - DNA, 28 bp, Artificial Sequence
  Description of Artificial Sequence: Synthetic oligonucleotide
tacgcctacgacggcaagggttacatcg

SEQ ID NO: 34578 - DNA, 27 bp, Artificial Sequence
  Description of Artificial Sequence: Synthetic oligonucleotide
acgcctacgacggcaagggttacatcg

SEQ ID NO: 34579 - DNA, 26 bp, Artificial Sequence
  Description of Artificial Sequence: Synthetic oligonucleotide
cgcctacgacggcaagggttacatcg

SEQ ID NO: 34580 - DNA, 26 bp, Artificial Sequence
  Description of Artificial Sequence: Synthetic oligonucleotide
gcctacgacggcaagggttacatcgc

SEQ ID NO: 34581 - DNA, 26 bp, Artificial Sequence
  Description of Artificial Sequence: Synthetic oligonucleotide
cctacgacggcaagggttacatcgcc

SEQ ID NO: 34582 - DNA, 27 bp, Artificial Sequence
  Description of Artificial Sequence: Synthetic oligonucleotide
ctacgacggcaagggttacatcgccct

SEQ ID NO: 34583 - DNA, 27 bp, Artificial Sequence
  Description of Artificial Sequence: Synthetic oligonucleotide
tacgacggcaagggttacatcgccctg

SEQ ID NO: 34584 - DNA, 27 bp, Artificial Sequence
  Description of Artificial Sequence: Synthetic oligonucleotide
acgacggcaagggttacatcgccctga

SEQ ID NO: 34585 - DNA, 27 bp, Artificial Sequence
  Description of Artificial Sequence: Synthetic oligonucleotide
cgacggcaagggttacatcgccctgaa

SEQ ID NO: 34586 - DNA, 27 bp, Artificial Sequence
  Description of Artificial Sequence: Synthetic oligonucleotide
gacggcaagggttacatcgccctgaac

SEQ ID NO: 34587 - DNA, 27 bp, Artificial Sequence
  Description of Artificial Sequence: Synthetic oligonucleotide
acggcaagggttacatcgccctgaacg

SEQ ID NO: 34588 - DNA, 27 bp, Artificial Sequence
  Description of Artificial Sequence: Synthetic oligonucleotide
cggcaagggttacatcgccctgaacga

SEQ ID NO: 34589 - DNA, 27 bp, Artificial Sequence
  Description of Artificial Sequence: Synthetic oligonucleotide
ggcaagggttacatcgccctgaacgag

SEQ ID NO: 34590 - DNA, 27 bp, Artificial Sequence
  Description of Artificial Sequence: Synthetic oligonucleotide
gcaagggttacatcgccctgaacgagg

SEQ ID NO: 34591 - DNA, 28 bp, Artificial Sequence
  Description of Artificial Sequence: Synthetic oligonucleotide
caagggttacatcgccctgaacgaggac

SEQ ID NO: 34592 - DNA, 28 bp, Artificial Sequence
  Description of Artificial Sequence: Synthetic oligonucleotide
aagggttacatcgccctgaacgaggacc

SEQ ID NO: 34593 - DNA, 27 bp, Artificial Sequence
  Description of Artificial Sequence: Synthetic oligonucleotide
agggttacatcgccctgaacgaggacc

SEQ ID NO: 34594 - DNA, 27 bp, Artificial Sequence
  Description of Artificial Sequence: Synthetic oligonucleotide
gggttacatcgccctgaacgaggacct

SEQ ID NO: 34595 - DNA, 27 bp, Artificial Sequence
  Description of Artificial Sequence: Synthetic oligonucleotide
ggttacatcgccctgaacgaggacctg

SEQ ID NO: 34596 - DNA, 27 bp, Artificial Sequence
  Description of Artificial Sequence: Synthetic oligonucleotide
gttacatcgccctgaacgaggacctgc

SEQ ID NO: 34597 - DNA, 26 bp, Artificial Sequence
  Description of Artificial Sequence: Synthetic oligonucleotide
ggagcagctgagagcctacctggaga

SEQ ID NO: 34598 - DNA, 26 bp, Artificial Sequence
  Description of Artificial Sequence: Synthetic oligonucleotide
gagcagctgagagcctacctggagag

SEQ ID NO: 34599 - DNA, 26 bp, Artificial Sequence
  Description of Artificial Sequence: Synthetic oligonucleotide
agcagctgagagcctacctggagagc

SEQ ID NO: 34600 - DNA, 25 bp, Artificial Sequence
  Description of Artificial Sequence: Synthetic oligonucleotide
gcagctgagagcctacctggagagc

SEQ ID NO: 34601 - DNA, 26 bp, Artificial Sequence
  Description of Artificial Sequence: Synthetic oligonucleotide
cagctgagagcctacctggagagcga

SEQ ID NO: 34602 - DNA, 27 bp, Artificial Sequence
  Description of Artificial Sequence: Synthetic oligonucleotide
agctgagagcctacctggagagcgagt

SEQ ID NO: 34603 - DNA, 26 bp, Artificial Sequence
  Description of Artificial Sequence: Synthetic oligonucleotide
gctgagagcctacctggagagcgagt

SEQ ID NO: 34604 - DNA, 26 bp, Artificial Sequence
  Description of Artificial Sequence: Synthetic oligonucleotide
ctgagagcctacctggagagcgagtg

SEQ ID NO: 34605 - DNA, 26 bp, Artificial Sequence
  Description of Artificial Sequence: Synthetic oligonucleotide
tgagagcctacctggagagcgagtgc

SEQ ID NO: 34606 - DNA, 25 bp, Artificial Sequence
  Description of Artificial Sequence: Synthetic oligonucleotide
gagagcctacctggagagcgagtgc

SEQ ID NO: 34607 - DNA, 26 bp, Artificial Sequence
  Description of Artificial Sequence: Synthetic oligonucleotide
agagcctacctggagagcgagtgcgt

SEQ ID NO: 34608 - DNA, 25 bp, Artificial Sequence
  Description of Artificial Sequence: Synthetic oligonucleotide
gagcctacctggagagcgagtgcgt

SEQ ID NO: 34609 - DNA, 25 bp, Artificial Sequence
  Description of Artificial Sequence: Synthetic oligonucleotide
agcctacctggagagcgagtgcgtg

SEQ ID NO: 34610 - DNA, 24 bp, Artificial Sequence
  Description of Artificial Sequence: Synthetic oligonucleotide
gcctacctggagagcgagtgcgtg

SEQ ID NO: 34611 - DNA, 25 bp, Artificial Sequence
  Description of Artificial Sequence: Synthetic oligonucleotide
cctacctggagagcgagtgcgtgga

SEQ ID NO: 34612 - DNA, 26 bp, Artificial Sequence
  Description of Artificial Sequence: Synthetic oligonucleotide
ctacctggagagcgagtgcgtggagt

SEQ ID NO: 34613 - DNA, 26 bp, Artificial Sequence
  Description of Artificial Sequence: Synthetic oligonucleotide
tacctggagagcgagtgcgtggagtg

SEQ ID NO: 34614 - DNA, 25 bp, Artificial Sequence
  Description of Artificial Sequence: Synthetic oligonucleotide
acctggagagcgagtgcgtggagtg

SEQ ID NO: 34615 - DNA, 24 bp, Artificial Sequence
  Description of Artificial Sequence: Synthetic oligonucleotide
cctggagagcgagtgcgtggagtg

SEQ ID NO: 34616 - DNA, 24 bp, Artificial Sequence
  Description of Artificial Sequence: Synthetic oligonucleotide
ctggagagcgagtgcgtggagtgg

SEQ ID NO: 34617 - DNA, 25 bp, Artificial Sequence
  Description of Artificial Sequence: Synthetic oligonucleotide
tggagagcgagtgcgtggagtggct

SEQ ID NO: 34618 - DNA, 24 bp, Artificial Sequence
  Description of Artificial Sequence: Synthetic oligonucleotide
ggagagcgagtgcgtggagtggct

SEQ ID NO: 34619 - DNA, 24 bp, Artificial Sequence
  Description of Artificial Sequence: Synthetic oligonucleotide
gagagcgagtgcgtggagtggctc

SEQ ID NO: 34620 - DNA, 24 bp, Artificial Sequence
  Description of Artificial Sequence: Synthetic oligonucleotide
agagcgagtgcgtggagtggctcc

SEQ ID NO: 34621 - DNA, 23 bp, Artificial Sequence
  Description of Artificial Sequence: Synthetic oligonucleotide
gagcgagtgcgtggagtggctcc

SEQ ID NO: 34622 - DNA, 23 bp, Artificial Sequence
  Description of Artificial Sequence: Synthetic oligonucleotide
agcgagtgcgtggagtggctccg

SEQ ID NO: 34623 - DNA, 27 bp, Artificial Sequence
  Description of Artificial Sequence: Synthetic oligonucleotide
gcagacacctggagaacgggaaggaca

SEQ ID NO: 34624 - DNA, 28 bp, Artificial Sequence
  Description of Artificial Sequence: Synthetic oligonucleotide
cagacacctggagaacgggaaggacaag

SEQ ID NO: 34625 - DNA, 28 bp, Artificial Sequence
  Description of Artificial Sequence: Synthetic oligonucleotide
agacacctggagaacgggaaggacaagc

SEQ ID NO: 34626 - DNA, 27 bp, Artificial Sequence
  Description of Artificial Sequence: Synthetic oligonucleotide
gacacctggagaacgggaaggacaagc

SEQ ID NO: 34627 - DNA, 28 bp, Artificial Sequence
  Description of Artificial Sequence: Synthetic oligonucleotide
acacctggagaacgggaaggacaagctg

SEQ ID NO: 34628 - DNA, 27 bp, Artificial Sequence
  Description of Artificial Sequence: Synthetic oligonucleotide
cacctggagaacgggaaggacaagctg

SEQ ID NO: 34629 - DNA, 24 bp, Artificial Sequence
  Description of Artificial Sequence: Synthetic oligonucleotide
gaggggccggagtattgggactgg

SEQ ID NO: 34630 - DNA, 25 bp, Artificial Sequence
  Description of Artificial Sequence: Synthetic oligonucleotide
aggggccggagtattgggactggga

SEQ ID NO: 34631 - DNA, 24 bp, Artificial Sequence
  Description of Artificial Sequence: Synthetic oligonucleotide
ggggccggagtattgggactggga

SEQ ID NO: 34632 - DNA, 25 bp, Artificial Sequence
  Description of Artificial Sequence: Synthetic oligonucleotide
gggccggagtattgggactgggaga

SEQ ID NO: 34633 - DNA, 26 bp, Artificial Sequence
  Description of Artificial Sequence: Synthetic oligonucleotide
ggccggagtattgggactgggagaca

SEQ ID NO: 34634 - DNA, 27 bp, Artificial Sequence
  Description of Artificial Sequence: Synthetic oligonucleotide
gccggagtattgggactgggagacaca

SEQ ID NO: 34635 - DNA, 27 bp, Artificial Sequence
  Description of Artificial Sequence: Synthetic oligonucleotide
ccggagtattgggactgggagacacag

SEQ ID NO: 34636 - DNA, 29 bp, Artificial Sequence
  Description of Artificial Sequence: Synthetic oligonucleotide
cggagtattgggactgggagacacagatc

SEQ ID NO: 34637 - DNA, 30 bp, Artificial Sequence
  Description of Artificial Sequence: Synthetic oligonucleotide
ggagtattgggactgggagacacagatctc

SEQ ID NO: 34638 - DNA, 30 bp, Artificial Sequence
  Description of Artificial Sequence: Synthetic oligonucleotide
gagtattgggactgggagacacagatctcc

SEQ ID NO: 34639 - DNA, 32 bp, Artificial Sequence
  Description of Artificial Sequence: Synthetic oligonucleotide
agtattgggactgggagacacagatctccaag

SEQ ID NO: 34640 - DNA, 31 bp, Artificial Sequence
  Description of Artificial Sequence: Synthetic oligonucleotide
gtattgggactgggagacacagatctccaag

SEQ ID NO: 34641 - DNA, 32 bp, Artificial Sequence
  Description of Artificial Sequence: Synthetic oligonucleotide
tattgggactgggagacacagatctccaagac

SEQ ID NO: 34642 - DNA, 31 bp, Artificial Sequence
  Description of Artificial Sequence: Synthetic oligonucleotide
attgggactgggagacacagatctccaagac

SEQ ID NO: 34643 - DNA, 30 bp, Artificial Sequence
  Description of Artificial Sequence: Synthetic oligonucleotide
ttgggactgggagacacagatctccaagac

SEQ ID NO: 34644 - DNA, 29 bp, Artificial Sequence
  Description of Artificial Sequence: Synthetic oligonucleotide
tgggactgggagacacagatctccaagac

SEQ ID NO: 34645 - DNA, 28 bp, Artificial Sequence
  Description of Artificial Sequence: Synthetic oligonucleotide
gggactgggagacacagatctccaagac

SEQ ID NO: 34646 - DNA, 28 bp, Artificial Sequence
  Description of Artificial Sequence: Synthetic oligonucleotide
ggactgggagacacagatctccaagacc

SEQ ID NO: 34647 - DNA, 30 bp, Artificial Sequence
  Description of Artificial Sequence: Synthetic oligonucleotide
gactgggagacacagatctccaagaccaac

SEQ ID NO: 34648 - DNA, 31 bp, Artificial Sequence
  Description of Artificial Sequence: Synthetic oligonucleotide
actgggagacacagatctccaagaccaacac

SEQ ID NO: 34649 - DNA, 30 bp, Artificial Sequence
  Description of Artificial Sequence: Synthetic oligonucleotide
ctgggagacacagatctccaagaccaacac

SEQ ID NO: 34650 - DNA, 31 bp, Artificial Sequence
  Description of Artificial Sequence: Synthetic oligonucleotide
tgggagacacagatctccaagaccaacacac

SEQ ID NO: 34651 - DNA, 22 bp, Artificial Sequence
  Description of Artificial Sequence: Synthetic oligonucleotide
cccgtgtggcggagcagctgag

SEQ ID NO: 34652 - DNA, 22 bp, Artificial Sequence
  Description of Artificial Sequence: Synthetic oligonucleotide
ccgtgtggcggagcagctgagc

SEQ ID NO: 34653 - DNA, 22 bp, Artificial Sequence
  Description of Artificial Sequence: Synthetic oligonucleotide
cgtgtggcggagcagctgagcg

SEQ ID NO: 34654 - DNA, 22 bp, Artificial Sequence
  Description of Artificial Sequence: Synthetic oligonucleotide
gtgtggcggagcagctgagcgc

SEQ ID NO: 34655 - DNA, 24 bp, Artificial Sequence
  Description of Artificial Sequence: Synthetic oligonucleotide
tgtggcggagcagctgagcgccta

SEQ ID NO: 34656 - DNA, 23 bp, Artificial Sequence
  Description of Artificial Sequence: Synthetic oligonucleotide
gtggcggagcagctgagcgccta

SEQ ID NO: 34657 - DNA, 23 bp, Artificial Sequence
  Description of Artificial Sequence: Synthetic oligonucleotide
tggcggagcagctgagcgcctac

SEQ ID NO: 34658 - DNA, 22 bp, Artificial Sequence
  Description of Artificial Sequence: Synthetic oligonucleotide
ggcggagcagctgagcgcctac

SEQ ID NO: 34659 - DNA, 23 bp, Artificial Sequence
  Description of Artificial Sequence: Synthetic oligonucleotide
gcggagcagctgagcgcctacct

SEQ ID NO: 34660 - DNA, 23 bp, Artificial Sequence
  Description of Artificial Sequence: Synthetic oligonucleotide
cggagcagctgagcgcctacctg

SEQ ID NO: 34661 - DNA, 24 bp, Artificial Sequence
  Description of Artificial Sequence: Synthetic oligonucleotide
ggagcagctgagcgcctacctgga

SEQ ID NO: 34662 - DNA, 24 bp, Artificial Sequence
  Description of Artificial Sequence: Synthetic oligonucleotide
gagcagctgagcgcctacctggag

SEQ ID NO: 34663 - DNA, 24 bp, Artificial Sequence
  Description of Artificial Sequence: Synthetic oligonucleotide
agcagctgagcgcctacctggagg

SEQ ID NO: 34664 - DNA, 23 bp, Artificial Sequence
  Description of Artificial Sequence: Synthetic oligonucleotide
gcagctgagcgcctacctggagg

SEQ ID NO: 34665 - DNA, 23 bp, Artificial Sequence
  Description of Artificial Sequence: Synthetic oligonucleotide
cagctgagcgcctacctggaggg

SEQ ID NO: 34666 - DNA, 23 bp, Artificial Sequence
  Description of Artificial Sequence: Synthetic oligonucleotide
agctgagcgcctacctggagggc

SEQ ID NO: 34667 - DNA, 22 bp, Artificial Sequence
  Description of Artificial Sequence: Synthetic oligonucleotide
gctgagcgcctacctggagggc

SEQ ID NO: 34668 - DNA, 23 bp, Artificial Sequence
  Description of Artificial Sequence: Synthetic oligonucleotide
ctgagcgcctacctggagggcga

SEQ ID NO: 34669 - DNA, 24 bp, Artificial Sequence
  Description of Artificial Sequence: Synthetic oligonucleotide
tgagcgcctacctggagggcgagt

SEQ ID NO: 34670 - DNA, 23 bp, Artificial Sequence
  Description of Artificial Sequence: Synthetic oligonucleotide
gagcgcctacctggagggcgagt

SEQ ID NO: 34671 - DNA, 23 bp, Artificial Sequence
  Description of Artificial Sequence: Synthetic oligonucleotide
agcgcctacctggagggcgagtg

SEQ ID NO: 34672 - DNA, 22 bp, Artificial Sequence
  Description of Artificial Sequence: Synthetic oligonucleotide
gcgcctacctggagggcgagtg

SEQ ID NO: 34673 - DNA, 22 bp, Artificial Sequence
  Description of Artificial Sequence: Synthetic oligonucleotide
cgcctacctggagggcgagtgc

SEQ ID NO: 34674 - DNA, 26 bp, Artificial Sequence
  Description of Artificial Sequence: Synthetic oligonucleotide
atcgccctgaactaggacctgcgctc

SEQ ID NO: 34675 - DNA, 25 bp, Artificial Sequence
  Description of Artificial Sequence: Synthetic oligonucleotide
tcgccctgaactaggacctgcgctc

SEQ ID NO: 34676 - DNA, 24 bp, Artificial Sequence
  Description of Artificial Sequence: Synthetic oligonucleotide
cgccctgaactaggacctgcgctc

SEQ ID NO: 34677 - DNA, 25 bp, Artificial Sequence
  Description of Artificial Sequence: Synthetic oligonucleotide
gccctgaactaggacctgcgctcct

SEQ ID NO: 34678 - DNA, 25 bp, Artificial Sequence
  Description of Artificial Sequence: Synthetic oligonucleotide
ccctgaactaggacctgcgctcctg

SEQ ID NO: 34679 - DNA, 26 bp, Artificial Sequence
  Description of Artificial Sequence: Synthetic oligonucleotide
cctgaactaggacctgcgctcctgga

SEQ ID NO: 34680 - DNA, 26 bp, Artificial Sequence
  Description of Artificial Sequence: Synthetic oligonucleotide
ctgaactaggacctgcgctcctggac

SEQ ID NO: 34681 - DNA, 26 bp, Artificial Sequence
  Description of Artificial Sequence: Synthetic oligonucleotide
tgaactaggacctgcgctcctggacc

SEQ ID NO: 34682 - DNA, 25 bp, Artificial Sequence
  Description of Artificial Sequence: Synthetic oligonucleotide
gaactaggacctgcgctcctggacc

SEQ ID NO: 34683 - DNA, 25 bp, Artificial Sequence
  Description of Artificial Sequence: Synthetic oligonucleotide
aactaggacctgcgctcctggaccg

SEQ ID NO: 34684 - DNA, 24 bp, Artificial Sequence
  Description of Artificial Sequence: Synthetic oligonucleotide
actaggacctgcgctcctggaccg

SEQ ID NO: 34685 - DNA, 23 bp, Artificial Sequence
  Description of Artificial Sequence: Synthetic oligonucleotide
ctaggacctgcgctcctggaccg

SEQ ID NO: 34686 - DNA, 23 bp, Artificial Sequence
  Description of Artificial Sequence: Synthetic oligonucleotide
taggacctgcgctcctggaccgc

SEQ ID NO: 34687 - DNA, 33 bp, Artificial Sequence
  Description of Artificial Sequence: Synthetic oligonucleotide
atctccaagaccaacacacagacttaccgagac

SEQ ID NO: 34688 - DNA, 32 bp, Artificial Sequence
  Description of Artificial Sequence: Synthetic oligonucleotide
tctccaagaccaacacacagacttaccgagac

SEQ ID NO: 34689 - DNA, 31 bp, Artificial Sequence
  Description of Artificial Sequence: Synthetic oligonucleotide
ctccaagaccaacacacagacttaccgagac

SEQ ID NO: 34690 - DNA, 32 bp, Artificial Sequence
  Description of Artificial Sequence: Synthetic oligonucleotide
tccaagaccaacacacagacttaccgagacag

SEQ ID NO: 34691 - DNA, 31 bp, Artificial Sequence
  Description of Artificial Sequence: Synthetic oligonucleotide
ccaagaccaacacacagacttaccgagacag

SEQ ID NO: 34692 - DNA, 31 bp, Artificial Sequence
  Description of Artificial Sequence: Synthetic oligonucleotide
caagaccaacacacagacttaccgagacagc

SEQ ID NO: 34693 - DNA, 31 bp, Artificial Sequence
  Description of Artificial Sequence: Synthetic oligonucleotide
aagaccaacacacagacttaccgagacagcc

SEQ ID NO: 34694 - DNA, 30 bp, Artificial Sequence
  Description of Artificial Sequence: Synthetic oligonucleotide
agaccaacacacagacttaccgagacagcc

SEQ ID NO: 34695 - DNA, 29 bp, Artificial Sequence
  Description of Artificial Sequence: Synthetic oligonucleotide
gaccaacacacagacttaccgagacagcc

SEQ ID NO: 34696 - DNA, 30 bp, Artificial Sequence
  Description of Artificial Sequence: Synthetic oligonucleotide
accaacacacagacttaccgagacagcctg

SEQ ID NO: 34697 - DNA, 29 bp, Artificial Sequence
  Description of Artificial Sequence: Synthetic oligonucleotide
ccaacacacagacttaccgagacagcctg

SEQ ID NO: 34698 - DNA, 29 bp, Artificial Sequence
  Description of Artificial Sequence: Synthetic oligonucleotide
caacacacagacttaccgagacagcctgc

SEQ ID NO: 34699 - DNA, 29 bp, Artificial Sequence
  Description of Artificial Sequence: Synthetic oligonucleotide
aacacacagacttaccgagacagcctgcg

SEQ ID NO: 34700 - DNA, 28 bp, Artificial Sequence
  Description of Artificial Sequence: Synthetic oligonucleotide
acacacagacttaccgagacagcctgcg

SEQ ID NO: 34701 - DNA, 27 bp, Artificial Sequence
  Description of Artificial Sequence: Synthetic oligonucleotide
cacacagacttaccgagacagcctgcg

SEQ ID NO: 34702 - DNA, 27 bp, Artificial Sequence
  Description of Artificial Sequence: Synthetic oligonucleotide
acacagacttaccgagacagcctgcgg

SEQ ID NO: 34703 - DNA, 27 bp, Artificial Sequence
  Description of Artificial Sequence: Synthetic oligonucleotide
cacagacttaccgagacagcctgcgga

SEQ ID NO: 34704 - DNA, 28 bp, Artificial Sequence
  Description of Artificial Sequence: Synthetic oligonucleotide
acagacttaccgagacagcctgcggaac

SEQ ID NO: 34705 - DNA, 27 bp, Artificial Sequence
  Description of Artificial Sequence: Synthetic oligonucleotide
cagacttaccgagacagcctgcggaac

SEQ ID NO: 34706 - DNA, 27 bp, Artificial Sequence
  Description of Artificial Sequence: Synthetic oligonucleotide
agacttaccgagacagcctgcggaacc

SEQ ID NO: 34707 - DNA, 27 bp, Artificial Sequence
  Description of Artificial Sequence: Synthetic oligonucleotide
gacttaccgagacagcctgcggaacct

SEQ ID NO: 34708 - DNA, 27 bp, Artificial Sequence
  Description of Artificial Sequence: Synthetic oligonucleotide
acttaccgagacagcctgcggaacctg

SEQ ID NO: 34709 - DNA, 26 bp, Artificial Sequence
  Description of Artificial Sequence: Synthetic oligonucleotide
cttaccgagacagcctgcggaacctg

SEQ ID NO: 34710 - DNA, 26 bp, Artificial Sequence
  Description of Artificial Sequence: Synthetic oligonucleotide
ttaccgagacagcctgcggaacctgc

SEQ ID NO: 34711 - DNA, 25 bp, Artificial Sequence
  Description of Artificial Sequence: Synthetic oligonucleotide
taccgagacagcctgcggaacctgc

SEQ ID NO: 34712 - DNA, 24 bp, Artificial Sequence
  Description of Artificial Sequence: Synthetic oligonucleotide
accgagacagcctgcggaacctgc

SEQ ID NO: 34713 - DNA, 23 bp, Artificial Sequence
  Description of Artificial Sequence: Synthetic oligonucleotide
ccgagacagcctgcggaacctgc

SEQ ID NO: 34714 - DNA, 23 bp, Artificial Sequence
  Description of Artificial Sequence: Synthetic oligonucleotide
cgagacagcctgcggaacctgcg

SEQ ID NO: 34715 - DNA, 23 bp, Artificial Sequence
  Description of Artificial Sequence: Synthetic oligonucleotide
gagacagcctgcggaacctgcgc

SEQ ID NO: 34716 - DNA, 23 bp, Artificial Sequence
  Description of Artificial Sequence: Synthetic oligonucleotide
agacagcctgcggaacctgcgcg

SEQ ID NO: 34717 - DNA, 22 bp, Artificial Sequence
  Description of Artificial Sequence: Synthetic oligonucleotide
gacagcctgcggaacctgcgcg

SEQ ID NO: 34718 - DNA, 22 bp, Artificial Sequence
  Description of Artificial Sequence: Synthetic oligonucleotide
acagcctgcggaacctgcgcgg

SEQ ID NO: 34719 - DNA, 21 bp, Artificial Sequence
  Description of Artificial Sequence: Synthetic oligonucleotide
cagcctgcggaacctgcgcgg

SEQ ID NO: 34720 - DNA, 20 bp, Artificial Sequence
  Description of Artificial Sequence: Synthetic oligonucleotide
gccgcggacacggcggctga

SEQ ID NO: 34721 - DNA, 22 bp, Artificial Sequence
  Description of Artificial Sequence: Synthetic oligonucleotide
ccgcggacacggcggctgagat

SEQ ID NO: 34722 - DNA, 23 bp, Artificial Sequence
  Description of Artificial Sequence: Synthetic oligonucleotide
cgcggacacggcggctgagatca

SEQ ID NO: 34723 - DNA, 23 bp, Artificial Sequence
  Description of Artificial Sequence: Synthetic oligonucleotide
gcggacacggcggctgagatcac

SEQ ID NO: 34724 - DNA, 23 bp, Artificial Sequence
  Description of Artificial Sequence: Synthetic oligonucleotide
cggacacggcggctgagatcacc

SEQ ID NO: 34725 - DNA, 24 bp, Artificial Sequence
  Description of Artificial Sequence: Synthetic oligonucleotide
ggacacggcggctgagatcaccca

SEQ ID NO: 34726 - DNA, 24 bp, Artificial Sequence
  Description of Artificial Sequence: Synthetic oligonucleotide
gacacggcggctgagatcacccag

SEQ ID NO: 34727 - DNA, 24 bp, Artificial Sequence
  Description of Artificial Sequence: Synthetic oligonucleotide
acacggcggctgagatcacccagc

SEQ ID NO: 34728 - DNA, 23 bp, Artificial Sequence
  Description of Artificial Sequence: Synthetic oligonucleotide
cacggcggctgagatcacccagc

SEQ ID NO: 34729 - DNA, 23 bp, Artificial Sequence
  Description of Artificial Sequence: Synthetic oligonucleotide
acggcggctgagatcacccagcg

SEQ ID NO: 34730 - DNA, 22 bp, Artificial Sequence
  Description of Artificial Sequence: Synthetic oligonucleotide
cggcggctgagatcacccagcg

SEQ ID NO: 34731 - DNA, 23 bp, Artificial Sequence
  Description of Artificial Sequence: Synthetic oligonucleotide
ccgcggggagtcccgcttcatca

SEQ ID NO: 34732 - DNA, 23 bp, Artificial Sequence
  Description of Artificial Sequence: Synthetic oligonucleotide
cgcggggagtcccgcttcatcac

SEQ ID NO: 34733 - DNA, 23 bp, Artificial Sequence
  Description of Artificial Sequence: Synthetic oligonucleotide
gcggggagtcccgcttcatcacc

SEQ ID NO: 34734 - DNA, 24 bp, Artificial Sequence
  Description of Artificial Sequence: Synthetic oligonucleotide
cggggagtcccgcttcatcaccgt

SEQ ID NO: 34735 - DNA, 24 bp, Artificial Sequence
  Description of Artificial Sequence: Synthetic oligonucleotide
ggggagtcccgcttcatcaccgtg

SEQ ID NO: 34736 - DNA, 24 bp, Artificial Sequence
  Description of Artificial Sequence: Synthetic oligonucleotide
gggagtcccgcttcatcaccgtgg

SEQ ID NO: 34737 - DNA, 24 bp, Artificial Sequence
  Description of Artificial Sequence: Synthetic oligonucleotide
ggagtcccgcttcatcaccgtggg

SEQ ID NO: 34738 - DNA, 26 bp, Artificial Sequence
  Description of Artificial Sequence: Synthetic oligonucleotide
gagtcccgcttcatcaccgtgggcta

SEQ ID NO: 34739 - DNA, 26 bp, Artificial Sequence
  Description of Artificial Sequence: Synthetic oligonucleotide
agtcccgcttcatcaccgtgggctac

SEQ ID NO: 34740 - DNA, 25 bp, Artificial Sequence
  Description of Artificial Sequence: Synthetic oligonucleotide
gtcccgcttcatcaccgtgggctac

SEQ ID NO: 34741 - DNA, 26 bp, Artificial Sequence
  Description of Artificial Sequence: Synthetic oligonucleotide
tcccgcttcatcaccgtgggctacgt

SEQ ID NO: 34742 - DNA, 26 bp, Artificial Sequence
  Description of Artificial Sequence: Synthetic oligonucleotide
cgcctcctccgcgggcataaccatta

SEQ ID NO: 34743 - DNA, 26 bp, Artificial Sequence
  Description of Artificial Sequence: Synthetic oligonucleotide
gcctcctccgcgggcataaccattac

SEQ ID NO: 34744 - DNA, 26 bp, Artificial Sequence
  Description of Artificial Sequence: Synthetic oligonucleotide
cctcctccgcgggcataaccattacg

SEQ ID NO: 34745 - DNA, 26 bp, Artificial Sequence
  Description of Artificial Sequence: Synthetic oligonucleotide
ctcctccgcgggcataaccattacgc

SEQ ID NO: 34746 - DNA, 27 bp, Artificial Sequence
  Description of Artificial Sequence: Synthetic oligonucleotide
tcctccgcgggcataaccattacgcct

SEQ ID NO: 34747 - DNA, 27 bp, Artificial Sequence
  Description of Artificial Sequence: Synthetic oligonucleotide
cctccgcgggcataaccattacgccta

SEQ ID NO: 34748 - DNA, 27 bp, Artificial Sequence
  Description of Artificial Sequence: Synthetic oligonucleotide
ctccgcgggcataaccattacgcctac

SEQ ID NO: 34749 - DNA, 27 bp, Artificial Sequence
  Description of Artificial Sequence: Synthetic oligonucleotide
tccgcgggcataaccattacgcctacg

SEQ ID NO: 34750 - DNA, 27 bp, Artificial Sequence
  Description of Artificial Sequence: Synthetic oligonucleotide
ccgcgggcataaccattacgcctacga

SEQ ID NO: 34751 - DNA, 27 bp, Artificial Sequence
  Description of Artificial Sequence: Synthetic oligonucleotide
cgcgggcataaccattacgcctacgac

SEQ ID NO: 34752 - DNA, 27 bp, Artificial Sequence
  Description of Artificial Sequence: Synthetic oligonucleotide
gcgggcataaccattacgcctacgacg

SEQ ID NO: 34753 - DNA, 27 bp, Artificial Sequence
  Description of Artificial Sequence: Synthetic oligonucleotide
cgggcataaccattacgcctacgacgg

SEQ ID NO: 34754 - DNA, 27 bp, Artificial Sequence
  Description of Artificial Sequence: Synthetic oligonucleotide
gggcataaccattacgcctacgacggc

SEQ ID NO: 34755 - DNA, 29 bp, Artificial Sequence
  Description of Artificial Sequence: Synthetic oligonucleotide
ggcataaccattacgcctacgacggcaag

SEQ ID NO: 34756 - DNA, 29 bp, Artificial Sequence
  Description of Artificial Sequence: Synthetic oligonucleotide
gcataaccattacgcctacgacggcaagg

SEQ ID NO: 34757 - DNA, 33 bp, Artificial Sequence
  Description of Artificial Sequence: Synthetic oligonucleotide
cataaccattacgcctacgacggcaaggattac

SEQ ID NO: 34758 - DNA, 35 bp, Artificial Sequence
  Description of Artificial Sequence: Synthetic oligonucleotide
ataaccattacgcctacgacggcaaggattacatc

SEQ ID NO: 34759 - DNA, 34 bp, Artificial Sequence
  Description of Artificial Sequence: Synthetic oligonucleotide
taaccattacgcctacgacggcaaggattacatc

SEQ ID NO: 34760 - DNA, 33 bp, Artificial Sequence
  Description of Artificial Sequence: Synthetic oligonucleotide
aaccattacgcctacgacggcaaggattacatc

SEQ ID NO: 34761 - DNA, 32 bp, Artificial Sequence
  Description of Artificial Sequence: Synthetic oligonucleotide
accattacgcctacgacggcaaggattacatc

SEQ ID NO: 34762 - DNA, 31 bp, Artificial Sequence
  Description of Artificial Sequence: Synthetic oligonucleotide
ccattacgcctacgacggcaaggattacatc

SEQ ID NO: 34763 - DNA, 31 bp, Artificial Sequence
  Description of Artificial Sequence: Synthetic oligonucleotide
cattacgcctacgacggcaaggattacatcg

SEQ ID NO: 34764 - DNA, 31 bp, Artificial Sequence
  Description of Artificial Sequence: Synthetic oligonucleotide
attacgcctacgacggcaaggattacatcgc

SEQ ID NO: 34765 - DNA, 30 bp, Artificial Sequence
  Description of Artificial Sequence: Synthetic oligonucleotide
ttacgcctacgacggcaaggattacatcgc

SEQ ID NO: 34766 - DNA, 23 bp, Artificial Sequence
  Description of Artificial Sequence: Synthetic oligonucleotide
aaggagccgcgggcgccatggat

SEQ ID NO: 34767 - DNA, 22 bp, Artificial Sequence
  Description of Artificial Sequence: Synthetic oligonucleotide
aggagccgcgggcgccatggat

SEQ ID NO: 34768 - DNA, 21 bp, Artificial Sequence
  Description of Artificial Sequence: Synthetic oligonucleotide
ggagccgcgggcgccatggat

SEQ ID NO: 34769 - DNA, 21 bp, Artificial Sequence
  Description of Artificial Sequence: Synthetic oligonucleotide
gagccgcgggcgccatggatg

SEQ ID NO: 34770 - DNA, 22 bp, Artificial Sequence
  Description of Artificial Sequence: Synthetic oligonucleotide
agccgcgggcgccatggatgga

SEQ ID NO: 34771 - DNA, 21 bp, Artificial Sequence
  Description of Artificial Sequence: Synthetic oligonucleotide
gccgcgggcgccatggatgga

SEQ ID NO: 34772 - DNA, 21 bp, Artificial Sequence
  Description of Artificial Sequence: Synthetic oligonucleotide
ccgcgggcgccatggatggag

SEQ ID NO: 34773 - DNA, 22 bp, Artificial Sequence
  Description of Artificial Sequence: Synthetic oligonucleotide
cgcgggcgccatggatggagca

SEQ ID NO: 34774 - DNA, 22 bp, Artificial Sequence
  Description of Artificial Sequence: Synthetic oligonucleotide
gcgggcgccatggatggagcag

SEQ ID NO: 34775 - DNA, 23 bp, Artificial Sequence
  Description of Artificial Sequence: Synthetic oligonucleotide
cgggcgccatggatggagcagga

SEQ ID NO: 34776 - DNA, 23 bp, Artificial Sequence
  Description of Artificial Sequence: Synthetic oligonucleotide
gggcgccatggatggagcaggag

SEQ ID NO: 34777 - DNA, 23 bp, Artificial Sequence
  Description of Artificial Sequence: Synthetic oligonucleotide
ggcgccatggatggagcaggagg

SEQ ID NO: 34778 - DNA, 23 bp, Artificial Sequence
  Description of Artificial Sequence: Synthetic oligonucleotide
gcgccatggatggagcaggaggg

SEQ ID NO: 34779 - DNA, 23 bp, Artificial Sequence
  Description of Artificial Sequence: Synthetic oligonucleotide
cgccatggatggagcaggagggg

SEQ ID NO: 34780 - DNA, 23 bp, Artificial Sequence
  Description of Artificial Sequence: Synthetic oligonucleotide
gccatggatggagcaggaggggc

SEQ ID NO: 34781 - DNA, 23 bp, Artificial Sequence
  Description of Artificial Sequence: Synthetic oligonucleotide
ccatggatggagcaggaggggcc

SEQ ID NO: 34782 - DNA, 23 bp, Artificial Sequence
  Description of Artificial Sequence: Synthetic oligonucleotide
catggatggagcaggaggggccg

SEQ ID NO: 34783 - DNA, 24 bp, Artificial Sequence
  Description of Artificial Sequence: Synthetic oligonucleotide
atggatggagcaggaggggccgga

SEQ ID NO: 34784 - DNA, 23 bp, Artificial Sequence
  Description of Artificial Sequence: Synthetic oligonucleotide
ggaaggagacgctgcagcgcgct

SEQ ID NO: 34785 - DNA, 23 bp, Artificial Sequence
  Description of Artificial Sequence: Synthetic oligonucleotide
gaaggagacgctgcagcgcgctg

SEQ ID NO: 34786 - DNA, 20 bp, Artificial Sequence
  Description of Artificial Sequence: Synthetic oligonucleotide
ccggacgggcgcctcctcgt

SEQ ID NO: 34787 - DNA, 20 bp, Artificial Sequence
  Description of Artificial Sequence: Synthetic oligonucleotide
cggacgggcgcctcctcggt

SEQ ID NO: 34788 - DNA, 20 bp, Artificial Sequence
  Description of Artificial Sequence: Synthetic oligonucleotide
ggacgggcgcctcctcggct

SEQ ID NO: 34789 - DNA, 20 bp, Artificial Sequence
  Description of Artificial Sequence: Synthetic oligonucleotide
gacgggcgcctcctcggcgt

SEQ ID NO: 34790 - DNA, 20 bp, Artificial Sequence
  Description of Artificial Sequence: Synthetic oligonucleotide
acgggcgcctcctcggcggt

SEQ ID NO: 34791 - DNA, 20 bp, Artificial Sequence
  Description of Artificial Sequence: Synthetic oligonucleotide
cgggcgcctcctcggcggtt

SEQ ID NO: 34792 - DNA, 20 bp, Artificial Sequence
  Description of Artificial Sequence: Synthetic oligonucleotide
gggcgcctcctcggcgggtt

SEQ ID NO: 34793 - DNA, 22 bp, Artificial Sequence
  Description of Artificial Sequence: Synthetic oligonucleotide
ggcgcctcctcggcgggcataa

SEQ ID NO: 34794 - DNA, 22 bp, Artificial Sequence
  Description of Artificial Sequence: Synthetic oligonucleotide
gcgcctcctcggcgggcataac

SEQ ID NO: 34795 - DNA, 23 bp, Artificial Sequence
  Description of Artificial Sequence: Synthetic oligonucleotide
cgcctcctcggcgggcataacca

SEQ ID NO: 34796 - DNA, 25 bp, Artificial Sequence
  Description of Artificial Sequence: Synthetic oligonucleotide
gcctcctcggcgggcataaccagta

SEQ ID NO: 34797 - DNA, 25 bp, Artificial Sequence
  Description of Artificial Sequence: Synthetic oligonucleotide
cctcctcggcgggcataaccagtac

SEQ ID NO: 34798 - DNA, 25 bp, Artificial Sequence
  Description of Artificial Sequence: Synthetic oligonucleotide
ctcctcggcgggcataaccagtacg

SEQ ID NO: 34799 - DNA, 25 bp, Artificial Sequence
  Description of Artificial Sequence: Synthetic oligonucleotide
tcctcggcgggcataaccagtacgc

SEQ ID NO: 34800 - DNA, 24 bp, Artificial Sequence
  Description of Artificial Sequence: Synthetic oligonucleotide
cctcggcgggcataaccagtacgc

SEQ ID NO: 34801 - DNA, 26 bp, Artificial Sequence
  Description of Artificial Sequence: Synthetic oligonucleotide
ctcggcgggcataaccagtacgccta

SEQ ID NO: 34802 - DNA, 26 bp, Artificial Sequence
  Description of Artificial Sequence: Synthetic oligonucleotide
tcggcgggcataaccagtacgcctac

SEQ ID NO: 34803 - DNA, 25 bp, Artificial Sequence
  Description of Artificial Sequence: Synthetic oligonucleotide
cggcgggcataaccagtacgcctac

SEQ ID NO: 34804 - DNA, 26 bp, Artificial Sequence
  Description of Artificial Sequence: Synthetic oligonucleotide
ggcgggcataaccagtacgcctacga

SEQ ID NO: 34805 - DNA, 24 bp, Artificial Sequence
  Description of Artificial Sequence: Synthetic oligonucleotide
ctgagagcctacctggagggcgag

SEQ ID NO: 34806 - DNA, 24 bp, Artificial Sequence
  Description of Artificial Sequence: Synthetic oligonucleotide
tgagagcctacctggagggcgagc

SEQ ID NO: 34807 - DNA, 23 bp, Artificial Sequence
  Description of Artificial Sequence: Synthetic oligonucleotide
gagagcctacctggagggcgagc

SEQ ID NO: 34808 - DNA, 23 bp, Artificial Sequence
  Description of Artificial Sequence: Synthetic oligonucleotide
agagcctacctggagggcgagcg

SEQ ID NO: 34809 - DNA, 22 bp, Artificial Sequence
  Description of Artificial Sequence: Synthetic oligonucleotide
gagcctacctggagggcgagcg

SEQ ID NO: 34810 - DNA, 22 bp, Artificial Sequence
  Description of Artificial Sequence: Synthetic oligonucleotide
agcctacctggagggcgagcgc

SEQ ID NO: 34811 - DNA, 21 bp, Artificial Sequence
  Description of Artificial Sequence: Synthetic oligonucleotide
gcctacctggagggcgagcgc

SEQ ID NO: 34812 - DNA, 22 bp, Artificial Sequence
  Description of Artificial Sequence: Synthetic oligonucleotide
cctacctggagggcgagcgcgt

SEQ ID NO: 34813 - DNA, 22 bp, Artificial Sequence
  Description of Artificial Sequence: Synthetic oligonucleotide
ctacctggagggcgagcgcgtg

SEQ ID NO: 34814 - DNA, 23 bp, Artificial Sequence
  Description of Artificial Sequence: Synthetic oligonucleotide
tacctggagggcgagcgcgtgga

SEQ ID NO: 34815 - DNA, 22 bp, Artificial Sequence
  Description of Artificial Sequence: Synthetic oligonucleotide
acctggagggcgagcgcgtgga

SEQ ID NO: 34816 - DNA, 21 bp, Artificial Sequence
  Description of Artificial Sequence: Synthetic oligonucleotide
cctggagggcgagcgcgtgga

SEQ ID NO: 34817 - DNA, 22 bp, Artificial Sequence
  Description of Artificial Sequence: Synthetic oligonucleotide
ctggagggcgagcgcgtggagt

SEQ ID NO: 34818 - DNA, 22 bp, Artificial Sequence
  Description of Artificial Sequence: Synthetic oligonucleotide
tggagggcgagcgcgtggagtg

SEQ ID NO: 34819 - DNA, 21 bp, Artificial Sequence
  Description of Artificial Sequence: Synthetic oligonucleotide
ggagggcgagcgcgtggagtg

SEQ ID NO: 34820 - DNA, 21 bp, Artificial Sequence
  Description of Artificial Sequence: Synthetic oligonucleotide
gagggcgagcgcgtggagtgg

SEQ ID NO: 34821 - DNA, 22 bp, Artificial Sequence
  Description of Artificial Sequence: Synthetic oligonucleotide
agggcgagcgcgtggagtggct

SEQ ID NO: 34822 - DNA, 21 bp, Artificial Sequence
  Description of Artificial Sequence: Synthetic oligonucleotide
gggcgagcgcgtggagtggct

SEQ ID NO: 34823 - DNA, 21 bp, Artificial Sequence
  Description of Artificial Sequence: Synthetic oligonucleotide
ggcgagcgcgtggagtggctc

SEQ ID NO: 34824 - DNA, 21 bp, Artificial Sequence
  Description of Artificial Sequence: Synthetic oligonucleotide
gcgagcgcgtggagtggctcc

SEQ ID NO: 34825 - DNA, 21 bp, Artificial Sequence
  Description of Artificial Sequence: Synthetic oligonucleotide
cgagcgcgtggagtggctccg

SEQ ID NO: 34826 - DNA, 22 bp, Artificial Sequence
  Description of Artificial Sequence: Synthetic oligonucleotide
gagcgcgtggagtggctccgca

SEQ ID NO: 34827 - DNA, 25 bp, Artificial Sequence
  Description of Artificial Sequence: Synthetic oligonucleotide
agcgcgtggagtggctccgcagata

SEQ ID NO: 34828 - DNA, 24 bp, Artificial Sequence
  Description of Artificial Sequence: Synthetic oligonucleotide
gcgcgtggagtggctccgcagata

SEQ ID NO: 34829 - DNA, 24 bp, Artificial Sequence
  Description of Artificial Sequence: Synthetic oligonucleotide
cgcgtggagtggctccgcagatac

SEQ ID NO: 34830 - DNA, 36 bp, Artificial Sequence
  Description of Artificial Sequence: Synthetic oligonucleotide
gagacacagatctccaagaccaacacacagatttac

SEQ ID NO: 34831 - DNA, 36 bp, Artificial Sequence
  Description of Artificial Sequence: Synthetic oligonucleotide
agacacagatctccaagaccaacacacagatttacc

SEQ ID NO: 34832 - DNA, 35 bp, Artificial Sequence
  Description of Artificial Sequence: Synthetic oligonucleotide
gacacagatctccaagaccaacacacagatttacc

SEQ ID NO: 34833 - DNA, 35 bp, Artificial Sequence
  Description of Artificial Sequence: Synthetic oligonucleotide
acacagatctccaagaccaacacacagatttaccg

SEQ ID NO: 34834 - DNA, 34 bp, Artificial Sequence
  Description of Artificial Sequence: Synthetic oligonucleotide
cacagatctccaagaccaacacacagatttaccg

SEQ ID NO: 34835 - DNA, 35 bp, Artificial Sequence
  Description of Artificial Sequence: Synthetic oligonucleotide
acagatctccaagaccaacacacagatttaccgag

SEQ ID NO: 34836 - DNA, 34 bp, Artificial Sequence
  Description of Artificial Sequence: Synthetic oligonucleotide
cagatctccaagaccaacacacagatttaccgag

SEQ ID NO: 34837 - DNA, 35 bp, Artificial Sequence
  Description of Artificial Sequence: Synthetic oligonucleotide
agatctccaagaccaacacacagatttaccgagag

SEQ ID NO: 34838 - DNA, 34 bp, Artificial Sequence
  Description of Artificial Sequence: Synthetic oligonucleotide
gatctccaagaccaacacacagatttaccgagag

SEQ ID NO: 34839 - DNA, 35 bp, Artificial Sequence
  Description of Artificial Sequence: Synthetic oligonucleotide
atctccaagaccaacacacagatttaccgagagag

SEQ ID NO: 34840 - DNA, 34 bp, Artificial Sequence
  Description of Artificial Sequence: Synthetic oligonucleotide
tctccaagaccaacacacagatttaccgagagag

SEQ ID NO: 34841 - DNA, 33 bp, Artificial Sequence
  Description of Artificial Sequence: Synthetic oligonucleotide
ctccaagaccaacacacagatttaccgagagag

SEQ ID NO: 34842 - DNA, 33 bp, Artificial Sequence
  Description of Artificial Sequence: Synthetic oligonucleotide
tccaagaccaacacacagatttaccgagagagc

SEQ ID NO: 34843 - DNA, 32 bp, Artificial Sequence
  Description of Artificial Sequence: Synthetic oligonucleotide
ccaagaccaacacacagatttaccgagagagc

SEQ ID NO: 34844 - DNA, 32 bp, Artificial Sequence
  Description of Artificial Sequence: Synthetic oligonucleotide
caagaccaacacacagatttaccgagagagcc

SEQ ID NO: 34845 - DNA, 33 bp, Artificial Sequence
  Description of Artificial Sequence: Synthetic oligonucleotide
aagaccaacacacagatttaccgagagagcctg

SEQ ID NO: 34846 - DNA, 32 bp, Artificial Sequence
  Description of Artificial Sequence: Synthetic oligonucleotide
agaccaacacacagatttaccgagagagcctg

SEQ ID NO: 34847 - DNA, 31 bp, Artificial Sequence
  Description of Artificial Sequence: Synthetic oligonucleotide
gaccaacacacagatttaccgagagagcctg

SEQ ID NO: 34848 - DNA, 31 bp, Artificial Sequence
  Description of Artificial Sequence: Synthetic oligonucleotide
accaacacacagatttaccgagagagcctgc

SEQ ID NO: 34849 - DNA, 30 bp, Artificial Sequence
  Description of Artificial Sequence: Synthetic oligonucleotide
ccaacacacagatttaccgagagagcctgc

SEQ ID NO: 34850 - DNA, 30 bp, Artificial Sequence
  Description of Artificial Sequence: Synthetic oligonucleotide
caacacacagatttaccgagagagcctgcg

SEQ ID NO: 34851 - DNA, 30 bp, Artificial Sequence
  Description of Artificial Sequence: Synthetic oligonucleotide
aacacacagatttaccgagagagcctgcgg

SEQ ID NO: 34852 - DNA, 29 bp, Artificial Sequence
  Description of Artificial Sequence: Synthetic oligonucleotide
acacacagatttaccgagagagcctgcgg

SEQ ID NO: 34853 - DNA, 28 bp, Artificial Sequence
  Description of Artificial Sequence: Synthetic oligonucleotide
cacacagatttaccgagagagcctgcgg

SEQ ID NO: 34854 - DNA, 30 bp, Artificial Sequence
  Description of Artificial Sequence: Synthetic oligonucleotide
acacagatttaccgagagagcctgcggaac

SEQ ID NO: 34855 - DNA, 29 bp, Artificial Sequence
  Description of Artificial Sequence: Synthetic oligonucleotide
cacagatttaccgagagagcctgcggaac

SEQ ID NO: 34856 - DNA, 29 bp, Artificial Sequence
  Description of Artificial Sequence: Synthetic oligonucleotide
acagatttaccgagagagcctgcggaacc

SEQ ID NO: 34857 - DNA, 28 bp, Artificial Sequence
  Description of Artificial Sequence: Synthetic oligonucleotide
cagatttaccgagagagcctgcggaacc

SEQ ID NO: 34858 - DNA, 29 bp, Artificial Sequence
  Description of Artificial Sequence: Synthetic oligonucleotide
agatttaccgagagagcctgcggaacctg

SEQ ID NO: 34859 - DNA, 28 bp, Artificial Sequence
  Description of Artificial Sequence: Synthetic oligonucleotide
gatttaccgagagagcctgcggaacctg

SEQ ID NO: 34860 - DNA, 28 bp, Artificial Sequence
  Description of Artificial Sequence: Synthetic oligonucleotide
atttaccgagagagcctgcggaacctgc

SEQ ID NO: 34861 - DNA, 27 bp, Artificial Sequence
  Description of Artificial Sequence: Synthetic oligonucleotide
tttaccgagagagcctgcggaacctgc

SEQ ID NO: 34862 - DNA, 30 bp, Artificial Sequence
  Description of Artificial Sequence: Synthetic oligonucleotide
caacacacagacttaccgagagagcctgtg

SEQ ID NO: 34863 - DNA, 30 bp, Artificial Sequence
  Description of Artificial Sequence: Synthetic oligonucleotide
aacacacagacttaccgagagagcctgtgg

SEQ ID NO: 34864 - DNA, 29 bp, Artificial Sequence
  Description of Artificial Sequence: Synthetic oligonucleotide
acacacagacttaccgagagagcctgtgg

SEQ ID NO: 34865 - DNA, 28 bp, Artificial Sequence
  Description of Artificial Sequence: Synthetic oligonucleotide
cacacagacttaccgagagagcctgtgg

SEQ ID NO: 34866 - DNA, 30 bp, Artificial Sequence
  Description of Artificial Sequence: Synthetic oligonucleotide
acacagacttaccgagagagcctgtggaac

SEQ ID NO: 34867 - DNA, 29 bp, Artificial Sequence
  Description of Artificial Sequence: Synthetic oligonucleotide
cacagacttaccgagagagcctgtggaac

SEQ ID NO: 34868 - DNA, 29 bp, Artificial Sequence
  Description of Artificial Sequence: Synthetic oligonucleotide
acagacttaccgagagagcctgtggaacc

SEQ ID NO: 34869 - DNA, 28 bp, Artificial Sequence
  Description of Artificial Sequence: Synthetic oligonucleotide
cagacttaccgagagagcctgtggaacc

SEQ ID NO: 34870 - DNA, 29 bp, Artificial Sequence
  Description of Artificial Sequence: Synthetic oligonucleotide
agacttaccgagagagcctgtggaacctg

SEQ ID NO: 34871 - DNA, 28 bp, Artificial Sequence
  Description of Artificial Sequence: Synthetic oligonucleotide
gacttaccgagagagcctgtggaacctg

SEQ ID NO: 34872 - DNA, 28 bp, Artificial Sequence
  Description of Artificial Sequence: Synthetic oligonucleotide
acttaccgagagagcctgtggaacctgc

SEQ ID NO: 34873 - DNA, 27 bp, Artificial Sequence
  Description of Artificial Sequence: Synthetic oligonucleotide
cttaccgagagagcctgtggaacctgc

SEQ ID NO: 34874 - DNA, 27 bp, Artificial Sequence
  Description of Artificial Sequence: Synthetic oligonucleotide
ttaccgagagagcctgtggaacctgcg

SEQ ID NO: 34875 - DNA, 26 bp, Artificial Sequence
  Description of Artificial Sequence: Synthetic oligonucleotide
taccgagagagcctgtggaacctgcg

SEQ ID NO: 34876 - DNA, 21 bp, Artificial Sequence
  Description of Artificial Sequence: Synthetic oligonucleotide
acctgggccggctcccactcc

SEQ ID NO: 34877 - DNA, 20 bp, Artificial Sequence
  Description of Artificial Sequence: Synthetic oligonucleotide
cctgggccggctcccactcc

SEQ ID NO: 34878 - DNA, 21 bp, Artificial Sequence
  Description of Artificial Sequence: Synthetic oligonucleotide
ctgggccggctcccactccgt

SEQ ID NO: 34879 - DNA, 22 bp, Artificial Sequence
  Description of Artificial Sequence: Synthetic oligonucleotide
tgggccggctcccactccgtga

SEQ ID NO: 34880 - DNA, 21 bp, Artificial Sequence
  Description of Artificial Sequence: Synthetic oligonucleotide
gggccggctcccactccgtga

SEQ ID NO: 34881 - DNA, 21 bp, Artificial Sequence
  Description of Artificial Sequence: Synthetic oligonucleotide
ggccggctcccactccgtgag

SEQ ID NO: 34882 - DNA, 26 bp, Artificial Sequence
  Description of Artificial Sequence: Synthetic oligonucleotide
gccggctcccactccgtgaggtattt

SEQ ID NO: 34883 - DNA, 26 bp, Artificial Sequence
  Description of Artificial Sequence: Synthetic oligonucleotide
ccggctcccactccgtgaggtatttc

SEQ ID NO: 34884 - DNA, 27 bp, Artificial Sequence
  Description of Artificial Sequence: Synthetic oligonucleotide
cggctcccactccgtgaggtatttcca

SEQ ID NO: 34885 - DNA, 27 bp, Artificial Sequence
  Description of Artificial Sequence: Synthetic oligonucleotide
ggctcccactccgtgaggtatttccac

SEQ ID NO: 34886 - DNA, 28 bp, Artificial Sequence
  Description of Artificial Sequence: Synthetic oligonucleotide
gctcccactccgtgaggtatttccacac

SEQ ID NO: 34887 - DNA, 28 bp, Artificial Sequence
  Description of Artificial Sequence: Synthetic oligonucleotide
ctcccactccgtgaggtatttccacacc

SEQ ID NO: 34888 - DNA, 28 bp, Artificial Sequence
  Description of Artificial Sequence: Synthetic oligonucleotide
tcccactccgtgaggtatttccacaccg

SEQ ID NO: 34889 - DNA, 27 bp, Artificial Sequence
  Description of Artificial Sequence: Synthetic oligonucleotide
cccactccgtgaggtatttccacaccg

SEQ ID NO: 34890 - DNA, 27 bp, Artificial Sequence
  Description of Artificial Sequence: Synthetic oligonucleotide
ccactccgtgaggtatttccacaccgc

SEQ ID NO: 34891 - DNA, 27 bp, Artificial Sequence
  Description of Artificial Sequence: Synthetic oligonucleotide
cactccgtgaggtatttccacaccgcc

SEQ ID NO: 34892 - DNA, 29 bp, Artificial Sequence
  Description of Artificial Sequence: Synthetic oligonucleotide
actccgtgaggtatttccacaccgccatg

SEQ ID NO: 34893 - DNA, 28 bp, Artificial Sequence
  Description of Artificial Sequence: Synthetic oligonucleotide
ctccgtgaggtatttccacaccgccatg

SEQ ID NO: 34894 - DNA, 29 bp, Artificial Sequence
  Description of Artificial Sequence: Synthetic oligonucleotide
tccgtgaggtatttccacaccgccatgtc

SEQ ID NO: 34895 - DNA, 28 bp, Artificial Sequence
  Description of Artificial Sequence: Synthetic oligonucleotide
ccgtgaggtatttccacaccgccatgtc

SEQ ID NO: 34896 - DNA, 28 bp, Artificial Sequence
  Description of Artificial Sequence: Synthetic oligonucleotide
cgtgaggtatttccacaccgccatgtcc

SEQ ID NO: 34897 - DNA, 28 bp, Artificial Sequence
  Description of Artificial Sequence: Synthetic oligonucleotide
gtgaggtatttccacaccgccatgtccc

SEQ ID NO: 34898 - DNA, 22 bp, Artificial Sequence
  Description of Artificial Sequence: Synthetic oligonucleotide
cagagcgaggccgggtctcacg

SEQ ID NO: 34899 - DNA, 22 bp, Artificial Sequence
  Description of Artificial Sequence: Synthetic oligonucleotide
agagcgaggccgggtctcacgc

SEQ ID NO: 34900 - DNA, 21 bp, Artificial Sequence
  Description of Artificial Sequence: Synthetic oligonucleotide
gagcgaggccgggtctcacgc

SEQ ID NO: 34901 - DNA, 21 bp, Artificial Sequence
  Description of Artificial Sequence: Synthetic oligonucleotide
agcgaggccgggtctcacgcc

SEQ ID NO: 34902 - DNA, 20 bp, Artificial Sequence
  Description of Artificial Sequence: Synthetic oligonucleotide
gcgaggccgggtctcacgcc

SEQ ID NO: 34903 - DNA, 21 bp, Artificial Sequence
  Description of Artificial Sequence: Synthetic oligonucleotide
cgaggccgggtctcacgccct

SEQ ID NO: 34904 - DNA, 21 bp, Artificial Sequence
  Description of Artificial Sequence: Synthetic oligonucleotide
gaggccgggtctcacgccctc

SEQ ID NO: 34905 - DNA, 22 bp, Artificial Sequence
  Description of Artificial Sequence: Synthetic oligonucleotide
aggccgggtctcacgccctcca

SEQ ID NO: 34906 - DNA, 21 bp, Artificial Sequence
  Description of Artificial Sequence: Synthetic oligonucleotide
ggccgggtctcacgccctcca

SEQ ID NO: 34907 - DNA, 22 bp, Artificial Sequence
  Description of Artificial Sequence: Synthetic oligonucleotide
gccgggtctcacgccctccaga

SEQ ID NO: 34908 - DNA, 22 bp, Artificial Sequence
  Description of Artificial Sequence: Synthetic oligonucleotide
ccgggtctcacgccctccagag

SEQ ID NO: 34909 - DNA, 24 bp, Artificial Sequence
  Description of Artificial Sequence: Synthetic oligonucleotide
cgggtctcacgccctccagaggat

SEQ ID NO: 34910 - DNA, 26 bp, Artificial Sequence
  Description of Artificial Sequence: Synthetic oligonucleotide
gggtctcacgccctccagaggatgta

SEQ ID NO: 34911 - DNA, 26 bp, Artificial Sequence
  Description of Artificial Sequence: Synthetic oligonucleotide
ggtctcacgccctccagaggatgtac

SEQ ID NO: 34912 - DNA, 26 bp, Artificial Sequence
  Description of Artificial Sequence: Synthetic oligonucleotide
gtctcacgccctccagaggatgtacg

SEQ ID NO: 34913 - DNA, 26 bp, Artificial Sequence
  Description of Artificial Sequence: Synthetic oligonucleotide
tctcacgccctccagaggatgtacgg

SEQ ID NO: 34914 - DNA, 25 bp, Artificial Sequence
  Description of Artificial Sequence: Synthetic oligonucleotide
ctcacgccctccagaggatgtacgg

SEQ ID NO: 34915 - DNA, 26 bp, Artificial Sequence
  Description of Artificial Sequence: Synthetic oligonucleotide
tcacgccctccagaggatgtacggct

SEQ ID NO: 34916 - DNA, 25 bp, Artificial Sequence
  Description of Artificial Sequence: Synthetic oligonucleotide
cacgccctccagaggatgtacggct

SEQ ID NO: 34917 - DNA, 25 bp, Artificial Sequence
  Description of Artificial Sequence: Synthetic oligonucleotide
acgccctccagaggatgtacggctg

SEQ ID NO: 34918 - DNA, 24 bp, Artificial Sequence
  Description of Artificial Sequence: Synthetic oligonucleotide
cgccctccagaggatgtacggctg

SEQ ID NO: 34919 - DNA, 24 bp, Artificial Sequence
  Description of Artificial Sequence: Synthetic oligonucleotide
gccctccagaggatgtacggctgc

SEQ ID NO: 34920 - DNA, 29 bp, Artificial Sequence
  Description of Artificial Sequence: Synthetic oligonucleotide
tccgcagatacctggagaacgggaagaac

SEQ ID NO: 34921 - DNA, 28 bp, Artificial Sequence
  Description of Artificial Sequence: Synthetic oligonucleotide
ccgcagatacctggagaacgggaagaac

SEQ ID NO: 34922 - DNA, 30 bp, Artificial Sequence
  Description of Artificial Sequence: Synthetic oligonucleotide
cgcagatacctggagaacgggaagaacaag

SEQ ID NO: 34923 - DNA, 30 bp, Artificial Sequence
  Description of Artificial Sequence: Synthetic oligonucleotide
gcagatacctggagaacgggaagaacaagc

SEQ ID NO: 34924 - DNA, 31 bp, Artificial Sequence
  Description of Artificial Sequence: Synthetic oligonucleotide
cagatacctggagaacgggaagaacaagctg

SEQ ID NO: 34925 - DNA, 31 bp, Artificial Sequence
  Description of Artificial Sequence: Synthetic oligonucleotide
agatacctggagaacgggaagaacaagctgg

SEQ ID NO: 34926 - DNA, 30 bp, Artificial Sequence
  Description of Artificial Sequence: Synthetic oligonucleotide
gatacctggagaacgggaagaacaagctgg

SEQ ID NO: 34927 - DNA, 31 bp, Artificial Sequence
  Description of Artificial Sequence: Synthetic oligonucleotide
atacctggagaacgggaagaacaagctggag

SEQ ID NO: 34928 - DNA, 30 bp, Artificial Sequence
  Description of Artificial Sequence: Synthetic oligonucleotide
tacctggagaacgggaagaacaagctggag

SEQ ID NO: 34929 - DNA, 29 bp, Artificial Sequence
  Description of Artificial Sequence: Synthetic oligonucleotide
acctggagaacgggaagaacaagctggag

SEQ ID NO: 34930 - DNA, 28 bp, Artificial Sequence
  Description of Artificial Sequence: Synthetic oligonucleotide
cctggagaacgggaagaacaagctggag

SEQ ID NO: 34931 - DNA, 28 bp, Artificial Sequence
  Description of Artificial Sequence: Synthetic oligonucleotide
ctggagaacgggaagaacaagctggagc

SEQ ID NO: 34932 - DNA, 28 bp, Artificial Sequence
  Description of Artificial Sequence: Synthetic oligonucleotide
tggagaacgggaagaacaagctggagcg

SEQ ID NO: 34933 - DNA, 27 bp, Artificial Sequence
  Description of Artificial Sequence: Synthetic oligonucleotide
ggagaacgggaagaacaagctggagcg

SEQ ID NO: 34934 - DNA, 27 bp, Artificial Sequence
  Description of Artificial Sequence: Synthetic oligonucleotide
gagaacgggaagaacaagctggagcgc

SEQ ID NO: 34935 - DNA, 27 bp, Artificial Sequence
  Description of Artificial Sequence: Synthetic oligonucleotide
agaacgggaagaacaagctggagcgcg

SEQ ID NO: 34936 - DNA, 26 bp, Artificial Sequence
  Description of Artificial Sequence: Synthetic oligonucleotide
gaacgggaagaacaagctggagcgcg

SEQ ID NO: 34937 - DNA, 27 bp, Artificial Sequence
  Description of Artificial Sequence: Synthetic oligonucleotide
aacgggaagaacaagctggagcgcgct

SEQ ID NO: 34938 - DNA, 26 bp, Artificial Sequence
  Description of Artificial Sequence: Synthetic oligonucleotide
acgggaagaacaagctggagcgcgct

SEQ ID NO: 34939 - DNA, 25 bp, Artificial Sequence
  Description of Artificial Sequence: Synthetic oligonucleotide
cgggaagaacaagctggagcgcgct

SEQ ID NO: 34940 - DNA, 26 bp, Artificial Sequence
  Description of Artificial Sequence: Synthetic oligonucleotide
gggaagaacaagctggagcgcgctga

SEQ ID NO: 34941 - DNA, 26 bp, Artificial Sequence
  Description of Artificial Sequence: Synthetic oligonucleotide
ggaagaacaagctggagcgcgctgac

SEQ ID NO: 34942 - DNA, 26 bp, Artificial Sequence
  Description of Artificial Sequence: Synthetic oligonucleotide
gaagaacaagctggagcgcgctgacc

SEQ ID NO: 34943 - DNA, 26 bp, Artificial Sequence
  Description of Artificial Sequence: Synthetic oligonucleotide
aagaacaagctggagcgcgctgaccc

SEQ ID NO: 34944 - DNA, 25 bp, Artificial Sequence
  Description of Artificial Sequence: Synthetic oligonucleotide
agaacaagctggagcgcgctgaccc

SEQ ID NO: 34945 - DNA, 24 bp, Artificial Sequence
  Description of Artificial Sequence: Synthetic oligonucleotide
gaacaagctggagcgcgctgaccc

SEQ ID NO: 34946 - DNA, 24 bp, Artificial Sequence
  Description of Artificial Sequence: Synthetic oligonucleotide
aacaagctggagcgcgctgacccc

SEQ ID NO: 34947 - DNA, 28 bp, Artificial Sequence
  Description of Artificial Sequence: Synthetic oligonucleotide
ctgggtttctaccctgcggagatcacag

SEQ ID NO: 34948 - DNA, 29 bp, Artificial Sequence
  Description of Artificial Sequence: Synthetic oligonucleotide
tgggtttctaccctgcggagatcacagtg

SEQ ID NO: 34949 - DNA, 28 bp, Artificial Sequence
  Description of Artificial Sequence: Synthetic oligonucleotide
gggtttctaccctgcggagatcacagtg

SEQ ID NO: 34950 - DNA, 29 bp, Artificial Sequence
  Description of Artificial Sequence: Synthetic oligonucleotide
ggtttctaccctgcggagatcacagtgac

SEQ ID NO: 34951 - DNA, 29 bp, Artificial Sequence
  Description of Artificial Sequence: Synthetic oligonucleotide
gtttctaccctgcggagatcacagtgacc

SEQ ID NO: 34952 - DNA, 30 bp, Artificial Sequence
  Description of Artificial Sequence: Synthetic oligonucleotide
tttctaccctgcggagatcacagtgacctg

SEQ ID NO: 34953 - DNA, 29 bp, Artificial Sequence
  Description of Artificial Sequence: Synthetic oligonucleotide
ttctaccctgcggagatcacagtgacctg

SEQ ID NO: 34954 - DNA, 28 bp, Artificial Sequence
  Description of Artificial Sequence: Synthetic oligonucleotide
tctaccctgcggagatcacagtgacctg

SEQ ID NO: 34955 - DNA, 27 bp, Artificial Sequence
  Description of Artificial Sequence: Synthetic oligonucleotide
ctaccctgcggagatcacagtgacctg

SEQ ID NO: 34956 - DNA, 27 bp, Artificial Sequence
  Description of Artificial Sequence: Synthetic oligonucleotide
taccctgcggagatcacagtgacctgg

SEQ ID NO: 34957 - DNA, 26 bp, Artificial Sequence
  Description of Artificial Sequence: Synthetic oligonucleotide
accctgcggagatcacagtgacctgg

SEQ ID NO: 34958 - DNA, 25 bp, Artificial Sequence
  Description of Artificial Sequence: Synthetic oligonucleotide
ccctgcggagatcacagtgacctgg

SEQ ID NO: 34959 - DNA, 26 bp, Artificial Sequence
  Description of Artificial Sequence: Synthetic oligonucleotide
cctgcggagatcacagtgacctggca

SEQ ID NO: 34960 - DNA, 26 bp, Artificial Sequence
  Description of Artificial Sequence: Synthetic oligonucleotide
ctgcggagatcacagtgacctggcag

SEQ ID NO: 34961 - DNA, 26 bp, Artificial Sequence
  Description of Artificial Sequence: Synthetic oligonucleotide
tgcggagatcacagtgacctggcagc

SEQ ID NO: 34962 - DNA, 25 bp, Artificial Sequence
  Description of Artificial Sequence: Synthetic oligonucleotide
gcggagatcacagtgacctggcagc

SEQ ID NO: 34963 - DNA, 25 bp, Artificial Sequence
  Description of Artificial Sequence: Synthetic oligonucleotide
cggagatcacagtgacctggcagcg

SEQ ID NO: 34964 - DNA, 25 bp, Artificial Sequence
  Description of Artificial Sequence: Synthetic oligonucleotide
ggagatcacagtgacctggcagcgg

SEQ ID NO: 34965 - DNA, 27 bp, Artificial Sequence
  Description of Artificial Sequence: Synthetic oligonucleotide
gagatcacagtgacctggcagcgggat

SEQ ID NO: 34966 - DNA, 27 bp, Artificial Sequence
  Description of Artificial Sequence: Synthetic oligonucleotide
agatcacagtgacctggcagcgggatg

SEQ ID NO: 34967 - DNA, 26 bp, Artificial Sequence
  Description of Artificial Sequence: Synthetic oligonucleotide
gatcacagtgacctggcagcgggatg

SEQ ID NO: 34968 - DNA, 26 bp, Artificial Sequence
  Description of Artificial Sequence: Synthetic oligonucleotide
atcacagtgacctggcagcgggatgg

SEQ ID NO: 34969 - DNA, 25 bp, Artificial Sequence
  Description of Artificial Sequence: Synthetic oligonucleotide
tcacagtgacctggcagcgggatgg

SEQ ID NO: 34970 - DNA, 24 bp, Artificial Sequence
  Description of Artificial Sequence: Synthetic oligonucleotide
cacagtgacctggcagcgggatgg

SEQ ID NO: 34971 - DNA, 24 bp, Artificial Sequence
  Description of Artificial Sequence: Synthetic oligonucleotide
acagtgacctggcagcgggatggc

SEQ ID NO: 34972 - DNA, 23 bp, Artificial Sequence
  Description of Artificial Sequence: Synthetic oligonucleotide
cagtgacctggcagcgggatggc

SEQ ID NO: 34973 - DNA, 24 bp, Artificial Sequence
  Description of Artificial Sequence: Synthetic oligonucleotide
agtgacctggcagcgggatggcga

SEQ ID NO: 34974 - DNA, 23 bp, Artificial Sequence
  Description of Artificial Sequence: Synthetic oligonucleotide
gtgacctggcagcgggatggcga

SEQ ID NO: 34975 - DNA, 27 bp, Artificial Sequence
  Description of Artificial Sequence: Synthetic oligonucleotide
tagagcaggaggggccggagtattgga

SEQ ID NO: 34976 - DNA, 26 bp, Artificial Sequence
  Description of Artificial Sequence: Synthetic oligonucleotide
agagcaggaggggccggagtattgga

SEQ ID NO: 34977 - DNA, 25 bp, Artificial Sequence
  Description of Artificial Sequence: Synthetic oligonucleotide
gagcaggaggggccggagtattgga

SEQ ID NO: 34978 - DNA, 25 bp, Artificial Sequence
  Description of Artificial Sequence: Synthetic oligonucleotide
agcaggaggggccggagtattggac

SEQ ID NO: 34979 - DNA, 24 bp, Artificial Sequence
  Description of Artificial Sequence: Synthetic oligonucleotide
gcaggaggggccggagtattggac

SEQ ID NO: 34980 - DNA, 24 bp, Artificial Sequence
  Description of Artificial Sequence: Synthetic oligonucleotide
caggaggggccggagtattggacc

SEQ ID NO: 34981 - DNA, 24 bp, Artificial Sequence
  Description of Artificial Sequence: Synthetic oligonucleotide
aggaggggccggagtattggaccg

SEQ ID NO: 34982 - DNA, 23 bp, Artificial Sequence
  Description of Artificial Sequence: Synthetic oligonucleotide
ggaggggccggagtattggaccg

SEQ ID NO: 34983 - DNA, 23 bp, Artificial Sequence
  Description of Artificial Sequence: Synthetic oligonucleotide
gaggggccggagtattggaccgg

SEQ ID NO: 34984 - DNA, 24 bp, Artificial Sequence
  Description of Artificial Sequence: Synthetic oligonucleotide
aggggccggagtattggaccggga

SEQ ID NO: 34985 - DNA, 23 bp, Artificial Sequence
  Description of Artificial Sequence: Synthetic oligonucleotide
ggggccggagtattggaccggga

SEQ ID NO: 34986 - DNA, 24 bp, Artificial Sequence
  Description of Artificial Sequence: Synthetic oligonucleotide
gggccggagtattggaccgggaga

SEQ ID NO: 34987 - DNA, 25 bp, Artificial Sequence
  Description of Artificial Sequence: Synthetic oligonucleotide
ggccggagtattggaccgggagaca

SEQ ID NO: 34988 - DNA, 26 bp, Artificial Sequence
  Description of Artificial Sequence: Synthetic oligonucleotide
gccggagtattggaccgggagacaca

SEQ ID NO: 34989 - DNA, 27 bp, Artificial Sequence
  Description of Artificial Sequence: Synthetic oligonucleotide
ccggagtattggaccgggagacacaga

SEQ ID NO: 34990 - DNA, 28 bp, Artificial Sequence
  Description of Artificial Sequence: Synthetic oligonucleotide
cggagtattggaccgggagacacagatc

SEQ ID NO: 34991 - DNA, 29 bp, Artificial Sequence
  Description of Artificial Sequence: Synthetic oligonucleotide
ggagtattggaccgggagacacagatctc

SEQ ID NO: 34992 - DNA, 29 bp, Artificial Sequence
  Description of Artificial Sequence: Synthetic oligonucleotide
gagtattggaccgggagacacagatctcc

SEQ ID NO: 34993 - DNA, 31 bp, Artificial Sequence
  Description of Artificial Sequence: Synthetic oligonucleotide
agtattggaccgggagacacagatctccaag

SEQ ID NO: 34994 - DNA, 30 bp, Artificial Sequence
  Description of Artificial Sequence: Synthetic oligonucleotide
gtattggaccgggagacacagatctccaag

SEQ ID NO: 34995 - DNA, 31 bp, Artificial Sequence
  Description of Artificial Sequence: Synthetic oligonucleotide
tattggaccgggagacacagatctccaagac

SEQ ID NO: 34996 - DNA, 30 bp, Artificial Sequence
  Description of Artificial Sequence: Synthetic oligonucleotide
attggaccgggagacacagatctccaagac

SEQ ID NO: 34997 - DNA, 29 bp, Artificial Sequence
  Description of Artificial Sequence: Synthetic oligonucleotide
ttggaccgggagacacagatctccaagac

SEQ ID NO: 34998 - DNA, 28 bp, Artificial Sequence
  Description of Artificial Sequence: Synthetic oligonucleotide
tggaccgggagacacagatctccaagac

SEQ ID NO: 34999 - DNA, 25 bp, Artificial Sequence
  Description of Artificial Sequence: Synthetic oligonucleotide
cgacagtgcccagggctctgatgtg

SEQ ID NO: 35000 - DNA, 27 bp, Artificial Sequence
  Description of Artificial Sequence: Synthetic oligonucleotide
cgggtctcacaccctccagagcatgtt

SEQ ID NO: 35001 - DNA, 27 bp, Artificial Sequence
  Description of Artificial Sequence: Synthetic oligonucleotide
gggtctcacaccctccagagcatgttc

SEQ ID NO: 35002 - DNA, 27 bp, Artificial Sequence
  Description of Artificial Sequence: Synthetic oligonucleotide
ggtctcacaccctccagagcatgttcg

SEQ ID NO: 35003 - DNA, 27 bp, Artificial Sequence
  Description of Artificial Sequence: Synthetic oligonucleotide
gtctcacaccctccagagcatgttcgg

SEQ ID NO: 35004 - DNA, 27 bp, Artificial Sequence
  Description of Artificial Sequence: Synthetic oligonucleotide
tctcacaccctccagagcatgttcggc

SEQ ID NO: 35005 - DNA, 27 bp, Artificial Sequence
  Description of Artificial Sequence: Synthetic oligonucleotide
ctcacaccctccagagcatgttcggct

SEQ ID NO: 35006 - DNA, 27 bp, Artificial Sequence
  Description of Artificial Sequence: Synthetic oligonucleotide
tcacaccctccagagcatgttcggctg

SEQ ID NO: 35007 - DNA, 26 bp, Artificial Sequence
  Description of Artificial Sequence: Synthetic oligonucleotide
cacaccctccagagcatgttcggctg

SEQ ID NO: 35008 - DNA, 26 bp, Artificial Sequence
  Description of Artificial Sequence: Synthetic oligonucleotide
acaccctccagagcatgttcggctgc

SEQ ID NO: 35009 - DNA, 25 bp, Artificial Sequence
  Description of Artificial Sequence: Synthetic oligonucleotide
caccctccagagcatgttcggctgc

SEQ ID NO: 35010 - DNA, 26 bp, Artificial Sequence
  Description of Artificial Sequence: Synthetic oligonucleotide
accctccagagcatgttcggctgcga

SEQ ID NO: 35011 - DNA, 25 bp, Artificial Sequence
  Description of Artificial Sequence: Synthetic oligonucleotide
ccctccagagcatgttcggctgcga

SEQ ID NO: 35012 - DNA, 25 bp, Artificial Sequence
  Description of Artificial Sequence: Synthetic oligonucleotide
cctccagagcatgttcggctgcgac

SEQ ID NO: 35013 - DNA, 26 bp, Artificial Sequence
  Description of Artificial Sequence: Synthetic oligonucleotide
ctccagagcatgttcggctgcgacgt

SEQ ID NO: 35014 - DNA, 26 bp, Artificial Sequence
  Description of Artificial Sequence: Synthetic oligonucleotide
tccagagcatgttcggctgcgacgtg

SEQ ID NO: 35015 - DNA, 25 bp, Artificial Sequence
  Description of Artificial Sequence: Synthetic oligonucleotide
ccagagcatgttcggctgcgacgtg

SEQ ID NO: 35016 - DNA, 25 bp, Artificial Sequence
  Description of Artificial Sequence: Synthetic oligonucleotide
cagagcatgttcggctgcgacgtgg

SEQ ID NO: 35017 - DNA, 25 bp, Artificial Sequence
  Description of Artificial Sequence: Synthetic oligonucleotide
agagcatgttcggctgcgacgtggg

SEQ ID NO: 35018 - DNA, 24 bp, Artificial Sequence
  Description of Artificial Sequence: Synthetic oligonucleotide
gagcatgttcggctgcgacgtggg

SEQ ID NO: 35019 - DNA, 24 bp, Artificial Sequence
  Description of Artificial Sequence: Synthetic oligonucleotide
agcatgttcggctgcgacgtgggg

SEQ ID NO: 35020 - DNA, 23 bp, Artificial Sequence
  Description of Artificial Sequence: Synthetic oligonucleotide
gcatgttcggctgcgacgtgggg

SEQ ID NO: 35021 - DNA, 23 bp, Artificial Sequence
  Description of Artificial Sequence: Synthetic oligonucleotide
catgttcggctgcgacgtggggc

SEQ ID NO: 35022 - DNA, 27 bp, Artificial Sequence
  Description of Artificial Sequence: Synthetic oligonucleotide
agtgggcagctgtggtggtgccttctt

SEQ ID NO: 35023 - DNA, 26 bp, Artificial Sequence
  Description of Artificial Sequence: Synthetic oligonucleotide
gtgggcagctgtggtggtgccttctt

SEQ ID NO: 35024 - DNA, 27 bp, Artificial Sequence
  Description of Artificial Sequence: Synthetic oligonucleotide
tgggcagctgtggtggtgccttcttga

SEQ ID NO: 35025 - DNA, 26 bp, Artificial Sequence
  Description of Artificial Sequence: Synthetic oligonucleotide
gggcagctgtggtggtgccttcttga

SEQ ID NO: 35026 - DNA, 27 bp, Artificial Sequence
  Description of Artificial Sequence: Synthetic oligonucleotide
ggcagctgtggtggtgccttcttgaga

SEQ ID NO: 35027 - DNA, 28 bp, Artificial Sequence
  Description of Artificial Sequence: Synthetic oligonucleotide
gcagctgtggtggtgccttcttgagaag

SEQ ID NO: 35028 - DNA, 29 bp, Artificial Sequence
  Description of Artificial Sequence: Synthetic oligonucleotide
cagctgtggtggtgccttcttgagaagag

SEQ ID NO: 35029 - DNA, 29 bp, Artificial Sequence
  Description of Artificial Sequence: Synthetic oligonucleotide
agctgtggtggtgccttcttgagaagagc

SEQ ID NO: 35030 - DNA, 28 bp, Artificial Sequence
  Description of Artificial Sequence: Synthetic oligonucleotide
gctgtggtggtgccttcttgagaagagc

SEQ ID NO: 35031 - DNA, 29 bp, Artificial Sequence
  Description of Artificial Sequence: Synthetic oligonucleotide
ctgtggtggtgccttcttgagaagagcag

SEQ ID NO: 35032 - DNA, 30 bp, Artificial Sequence
  Description of Artificial Sequence: Synthetic oligonucleotide
tgtggtggtgccttcttgagaagagcagag

SEQ ID NO: 35033 - DNA, 29 bp, Artificial Sequence
  Description of Artificial Sequence: Synthetic oligonucleotide
gtggtggtgccttcttgagaagagcagag

SEQ ID NO: 35034 - DNA, 32 bp, Artificial Sequence
  Description of Artificial Sequence: Synthetic oligonucleotide
tggtggtgccttcttgagaagagcagagatac

SEQ ID NO: 35035 - DNA, 31 bp, Artificial Sequence
  Description of Artificial Sequence: Synthetic oligonucleotide
ggtggtgccttcttgagaagagcagagatac

SEQ ID NO: 35036 - DNA, 32 bp, Artificial Sequence
  Description of Artificial Sequence: Synthetic oligonucleotide
gtggtgccttcttgagaagagcagagatacac

SEQ ID NO: 35037 - DNA, 34 bp, Artificial Sequence
  Description of Artificial Sequence: Synthetic oligonucleotide
tggtgccttcttgagaagagcagagatacacatg

SEQ ID NO: 35038 - DNA, 33 bp, Artificial Sequence
  Description of Artificial Sequence: Synthetic oligonucleotide
ggtgccttcttgagaagagcagagatacacatg

SEQ ID NO: 35039 - DNA, 33 bp, Artificial Sequence
  Description of Artificial Sequence: Synthetic oligonucleotide
gtgccttcttgagaagagcagagatacacatgc

SEQ ID NO: 35040 - DNA, 33 bp, Artificial Sequence
  Description of Artificial Sequence: Synthetic oligonucleotide
tgccttcttgagaagagcagagatacacatgcc

SEQ ID NO: 35041 - DNA, 32 bp, Artificial Sequence
  Description of Artificial Sequence: Synthetic oligonucleotide
gccttcttgagaagagcagagatacacatgcc

SEQ ID NO: 35042 - DNA, 34 bp, Artificial Sequence
  Description of Artificial Sequence: Synthetic oligonucleotide
ccttcttgagaagagcagagatacacatgccatg

SEQ ID NO: 35043 - DNA, 36 bp, Artificial Sequence
  Description of Artificial Sequence: Synthetic oligonucleotide
cttcttgagaagagcagagatacacatgccatgtac

SEQ ID NO: 35044 - DNA, 37 bp, Artificial Sequence
  Description of Artificial Sequence: Synthetic oligonucleotide
ttcttgagaagagcagagatacacatgccatgtacag

SEQ ID NO: 35045 - DNA, 36 bp, Artificial Sequence
  Description of Artificial Sequence: Synthetic oligonucleotide
tcttgagaagagcagagatacacatgccatgtacag

SEQ ID NO: 35046 - DNA, 35 bp, Artificial Sequence
  Description of Artificial Sequence: Synthetic oligonucleotide
cttgagaagagcagagatacacatgccatgtacag

SEQ ID NO: 35047 - DNA, 35 bp, Artificial Sequence
  Description of Artificial Sequence: Synthetic oligonucleotide
ttgagaagagcagagatacacatgccatgtacagc

SEQ ID NO: 35048 - DNA, 34 bp, Artificial Sequence
  Description of Artificial Sequence: Synthetic oligonucleotide
tgagaagagcagagatacacatgccatgtacagc

SEQ ID NO: 35049 - DNA, 24 bp, Artificial Sequence
  Description of Artificial Sequence: Synthetic oligonucleotide
gaggagccggagtattgggaccgg

SEQ ID NO: 35050 - DNA, 25 bp, Artificial Sequence
  Description of Artificial Sequence: Synthetic oligonucleotide
aggagccggagtattgggaccggga

SEQ ID NO: 35051 - DNA, 24 bp, Artificial Sequence
  Description of Artificial Sequence: Synthetic oligonucleotide
ggagccggagtattgggaccggga

SEQ ID NO: 35052 - DNA, 25 bp, Artificial Sequence
  Description of Artificial Sequence: Synthetic oligonucleotide
gagccggagtattgggaccgggaga

SEQ ID NO: 35053 - DNA, 26 bp, Artificial Sequence
  Description of Artificial Sequence: Synthetic oligonucleotide
agccggagtattgggaccgggagaca

SEQ ID NO: 35054 - DNA, 27 bp, Artificial Sequence
  Description of Artificial Sequence: Synthetic oligonucleotide
ggagtattgggaccgggagacacggat

SEQ ID NO: 35055 - DNA, 27 bp, Artificial Sequence
  Description of Artificial Sequence: Synthetic oligonucleotide
gagtattgggaccgggagacacggatc

SEQ ID NO: 35056 - DNA, 28 bp, Artificial Sequence
  Description of Artificial Sequence: Synthetic oligonucleotide
agtattgggaccgggagacacggatctc

SEQ ID NO: 35057 - DNA, 27 bp, Artificial Sequence
  Description of Artificial Sequence: Synthetic oligonucleotide
gtattgggaccgggagacacggatctc

SEQ ID NO: 35058 - DNA, 27 bp, Artificial Sequence
  Description of Artificial Sequence: Synthetic oligonucleotide
tattgggaccgggagacacggatctcc

SEQ ID NO: 35059 - DNA, 27 bp, Artificial Sequence
  Description of Artificial Sequence: Synthetic oligonucleotide
attgggaccgggagacacggatctcca

SEQ ID NO: 35060 - DNA, 27 bp, Artificial Sequence
  Description of Artificial Sequence: Synthetic oligonucleotide
ttgggaccgggagacacggatctccaa

SEQ ID NO: 35061 - DNA, 26 bp, Artificial Sequence
  Description of Artificial Sequence: Synthetic oligonucleotide
tgggaccgggagacacggatctccaa

SEQ ID NO: 35062 - DNA, 25 bp, Artificial Sequence
  Description of Artificial Sequence: Synthetic oligonucleotide
gggaccgggagacacggatctccaa

SEQ ID NO: 35063 - DNA, 26 bp, Artificial Sequence
  Description of Artificial Sequence: Synthetic oligonucleotide
ggaccgggagacacggatctccaaga

SEQ ID NO: 35064 - DNA, 26 bp, Artificial Sequence
  Description of Artificial Sequence: Synthetic oligonucleotide
gaccgggagacacggatctccaagac

SEQ ID NO: 35065 - DNA, 27 bp, Artificial Sequence
  Description of Artificial Sequence: Synthetic oligonucleotide
accgggagacacggatctccaagacca

SEQ ID NO: 35066 - DNA, 27 bp, Artificial Sequence
  Description of Artificial Sequence: Synthetic oligonucleotide
ccgggagacacggatctccaagaccaa

SEQ ID NO: 35067 - DNA, 27 bp, Artificial Sequence
  Description of Artificial Sequence: Synthetic oligonucleotide
cgggagacacggatctccaagaccaac

SEQ ID NO: 35068 - DNA, 28 bp, Artificial Sequence
  Description of Artificial Sequence: Synthetic oligonucleotide
gggagacacggatctccaagaccaacac

SEQ ID NO: 35069 - DNA, 29 bp, Artificial Sequence
  Description of Artificial Sequence: Synthetic oligonucleotide
ggagacacggatctccaagaccaacacac

SEQ ID NO: 35070 - DNA, 30 bp, Artificial Sequence
  Description of Artificial Sequence: Synthetic oligonucleotide
gagacacggatctccaagaccaacacacag

SEQ ID NO: 35071 - DNA, 31 bp, Artificial Sequence
  Description of Artificial Sequence: Synthetic oligonucleotide
agacacggatctccaagaccaacacacagac

SEQ ID NO: 35072 - DNA, 30 bp, Artificial Sequence
  Description of Artificial Sequence: Synthetic oligonucleotide
gacacggatctccaagaccaacacacagac

SEQ ID NO: 35073 - DNA, 33 bp, Artificial Sequence
  Description of Artificial Sequence: Synthetic oligonucleotide
acacggatctccaagaccaacacacagacttac

SEQ ID NO: 35074 - DNA, 32 bp, Artificial Sequence
  Description of Artificial Sequence: Synthetic oligonucleotide
cacggatctccaagaccaacacacagacttac

SEQ ID NO: 35075 - DNA, 32 bp, Artificial Sequence
  Description of Artificial Sequence: Synthetic oligonucleotide
acggatctccaagaccaacacacagacttacc

SEQ ID NO: 35076 - DNA, 31 bp, Artificial Sequence
  Description of Artificial Sequence: Synthetic oligonucleotide
cggatctccaagaccaacacacagacttacc

SEQ ID NO: 35077 - DNA, 31 bp, Artificial Sequence
  Description of Artificial Sequence: Synthetic oligonucleotide
ggatctccaagaccaacacacagacttaccg

SEQ ID NO: 35078 - DNA, 34 bp, Artificial Sequence
  Description of Artificial Sequence: Synthetic oligonucleotide
acacagatctccaagaccaacacacagacttacg

SEQ ID NO: 35079 - DNA, 33 bp, Artificial Sequence
  Description of Artificial Sequence: Synthetic oligonucleotide
cacagatctccaagaccaacacacagacttacg

SEQ ID NO: 35080 - DNA, 33 bp, Artificial Sequence
  Description of Artificial Sequence: Synthetic oligonucleotide
acagatctccaagaccaacacacagacttacgg

SEQ ID NO: 35081 - DNA, 32 bp, Artificial Sequence
  Description of Artificial Sequence: Synthetic oligonucleotide
cagatctccaagaccaacacacagacttacgg

SEQ ID NO: 35082 - DNA, 33 bp, Artificial Sequence
  Description of Artificial Sequence: Synthetic oligonucleotide
agatctccaagaccaacacacagacttacggag

SEQ ID NO: 35083 - DNA, 32 bp, Artificial Sequence
  Description of Artificial Sequence: Synthetic oligonucleotide
gatctccaagaccaacacacagacttacggag

SEQ ID NO: 35084 - DNA, 33 bp, Artificial Sequence
  Description of Artificial Sequence: Synthetic oligonucleotide
atctccaagaccaacacacagacttacggagag

SEQ ID NO: 35085 - DNA, 32 bp, Artificial Sequence
  Description of Artificial Sequence: Synthetic oligonucleotide
tctccaagaccaacacacagacttacggagag

SEQ ID NO: 35086 - DNA, 31 bp, Artificial Sequence
  Description of Artificial Sequence: Synthetic oligonucleotide
ctccaagaccaacacacagacttacggagag

SEQ ID NO: 35087 - DNA, 32 bp, Artificial Sequence
  Description of Artificial Sequence: Synthetic oligonucleotide
tccaagaccaacacacagacttacggagagag

SEQ ID NO: 35088 - DNA, 31 bp, Artificial Sequence
  Description of Artificial Sequence: Synthetic oligonucleotide
ccaagaccaacacacagacttacggagagag

SEQ ID NO: 35089 - DNA, 31 bp, Artificial Sequence
  Description of Artificial Sequence: Synthetic oligonucleotide
caagaccaacacacagacttacggagagagc

SEQ ID NO: 35090 - DNA, 31 bp, Artificial Sequence
  Description of Artificial Sequence: Synthetic oligonucleotide
aagaccaacacacagacttacggagagagcc

SEQ ID NO: 35091 - DNA, 30 bp, Artificial Sequence
  Description of Artificial Sequence: Synthetic oligonucleotide
agaccaacacacagacttacggagagagcc

SEQ ID NO: 35092 - DNA, 29 bp, Artificial Sequence
  Description of Artificial Sequence: Synthetic oligonucleotide
gaccaacacacagacttacggagagagcc

SEQ ID NO: 35093 - DNA, 30 bp, Artificial Sequence
  Description of Artificial Sequence: Synthetic oligonucleotide
accaacacacagacttacggagagagcctg

SEQ ID NO: 35094 - DNA, 29 bp, Artificial Sequence
  Description of Artificial Sequence: Synthetic oligonucleotide
ccaacacacagacttacggagagagcctg

SEQ ID NO: 35095 - DNA, 29 bp, Artificial Sequence
  Description of Artificial Sequence: Synthetic oligonucleotide
caacacacagacttacggagagagcctgc

SEQ ID NO: 35096 - DNA, 29 bp, Artificial Sequence
  Description of Artificial Sequence: Synthetic oligonucleotide
aacacacagacttacggagagagcctgcg

SEQ ID NO: 35097 - DNA, 28 bp, Artificial Sequence
  Description of Artificial Sequence: Synthetic oligonucleotide
acacacagacttacggagagagcctgcg

SEQ ID NO: 35098 - DNA, 27 bp, Artificial Sequence
  Description of Artificial Sequence: Synthetic oligonucleotide
cacacagacttacggagagagcctgcg

SEQ ID NO: 35099 - DNA, 27 bp, Artificial Sequence
  Description of Artificial Sequence: Synthetic oligonucleotide
acacagacttacggagagagcctgcgg

SEQ ID NO: 35100 - DNA, 27 bp, Artificial Sequence
  Description of Artificial Sequence: Synthetic oligonucleotide
cacagacttacggagagagcctgcgga

SEQ ID NO: 35101 - DNA, 28 bp, Artificial Sequence
  Description of Artificial Sequence: Synthetic oligonucleotide
acagacttacggagagagcctgcggaac

SEQ ID NO: 35102 - DNA, 27 bp, Artificial Sequence
  Description of Artificial Sequence: Synthetic oligonucleotide
cagacttacggagagagcctgcggaac

SEQ ID NO: 35103 - DNA, 27 bp, Artificial Sequence
  Description of Artificial Sequence: Synthetic oligonucleotide
agacttacggagagagcctgcggaacc

SEQ ID NO: 35104 - DNA, 27 bp, Artificial Sequence
  Description of Artificial Sequence: Synthetic oligonucleotide
gacttacggagagagcctgcggaacct

SEQ ID NO: 35105 - DNA, 27 bp, Artificial Sequence
  Description of Artificial Sequence: Synthetic oligonucleotide
acttacggagagagcctgcggaacctg

SEQ ID NO: 35106 - DNA, 26 bp, Artificial Sequence
  Description of Artificial Sequence: Synthetic oligonucleotide
cttacggagagagcctgcggaacctg

SEQ ID NO: 35107 - DNA, 26 bp, Artificial Sequence
  Description of Artificial Sequence: Synthetic oligonucleotide
ttacggagagagcctgcggaacctgc

SEQ ID NO: 35108 - DNA, 25 bp, Artificial Sequence
  Description of Artificial Sequence: Synthetic oligonucleotide
tacggagagagcctgcggaacctgc

SEQ ID NO: 35109 - DNA, 24 bp, Artificial Sequence
  Description of Artificial Sequence: Synthetic oligonucleotide
acggagagagcctgcggaacctgc

SEQ ID NO: 35110 - DNA, 23 bp, Artificial Sequence
  Description of Artificial Sequence: Synthetic oligonucleotide
cggagagagcctgcggaacctgc

SEQ ID NO: 35111 - DNA, 23 bp, Artificial Sequence
  Description of Artificial Sequence: Synthetic oligonucleotide
ggagagagcctgcggaacctgcg

SEQ ID NO: 35112 - DNA, 26 bp, Artificial Sequence
  Description of Artificial Sequence: Synthetic oligonucleotide
ctacctggagggcgagtgcgtggatt

SEQ ID NO: 35113 - DNA, 26 bp, Artificial Sequence
  Description of Artificial Sequence: Synthetic oligonucleotide
tacctggagggcgagtgcgtggattg

SEQ ID NO: 35114 - DNA, 25 bp, Artificial Sequence
  Description of Artificial Sequence: Synthetic oligonucleotide
acctggagggcgagtgcgtggattg

SEQ ID NO: 35115 - DNA, 24 bp, Artificial Sequence
  Description of Artificial Sequence: Synthetic oligonucleotide
cctggagggcgagtgcgtggattg

SEQ ID NO: 35116 - DNA, 24 bp, Artificial Sequence
  Description of Artificial Sequence: Synthetic oligonucleotide
ctggagggcgagtgcgtggattgg

SEQ ID NO: 35117 - DNA, 25 bp, Artificial Sequence
  Description of Artificial Sequence: Synthetic oligonucleotide
tggagggcgagtgcgtggattggct

SEQ ID NO: 35118 - DNA, 24 bp, Artificial Sequence
  Description of Artificial Sequence: Synthetic oligonucleotide
ggagggcgagtgcgtggattggct

SEQ ID NO: 35119 - DNA, 24 bp, Artificial Sequence
  Description of Artificial Sequence: Synthetic oligonucleotide
gagggcgagtgcgtggattggctc

SEQ ID NO: 35120 - DNA, 24 bp, Artificial Sequence
  Description of Artificial Sequence: Synthetic oligonucleotide
agggcgagtgcgtggattggctcc

SEQ ID NO: 35121 - DNA, 23 bp, Artificial Sequence
  Description of Artificial Sequence: Synthetic oligonucleotide
gggcgagtgcgtggattggctcc

SEQ ID NO: 35122 - DNA, 23 bp, Artificial Sequence
  Description of Artificial Sequence: Synthetic oligonucleotide
ggcgagtgcgtggattggctccg

SEQ ID NO: 35123 - DNA, 24 bp, Artificial Sequence
  Description of Artificial Sequence: Synthetic oligonucleotide
gcgagtgcgtggattggctccgca

SEQ ID NO: 35124 - DNA, 27 bp, Artificial Sequence
  Description of Artificial Sequence: Synthetic oligonucleotide
cgagtgcgtggattggctccgcagata

SEQ ID NO: 35125 - DNA, 27 bp, Artificial Sequence
  Description of Artificial Sequence: Synthetic oligonucleotide
gagtgcgtggattggctccgcagatac

SEQ ID NO: 35126 - DNA, 27 bp, Artificial Sequence
  Description of Artificial Sequence: Synthetic oligonucleotide
agtgcgtggattggctccgcagatacc

SEQ ID NO: 35127 - DNA, 27 bp, Artificial Sequence
  Description of Artificial Sequence: Synthetic oligonucleotide
gtgcgtggattggctccgcagatacct

SEQ ID NO: 35128 - DNA, 27 bp, Artificial Sequence
  Description of Artificial Sequence: Synthetic oligonucleotide
tgcgtggattggctccgcagatacctg

SEQ ID NO: 35129 - DNA, 26 bp, Artificial Sequence
  Description of Artificial Sequence: Synthetic oligonucleotide
gcgtggattggctccgcagatacctg

SEQ ID NO: 35130 - DNA, 27 bp, Artificial Sequence
  Description of Artificial Sequence: Synthetic oligonucleotide
cgtggattggctccgcagatacctgga

SEQ ID NO: 35131 - DNA, 27 bp, Artificial Sequence
  Description of Artificial Sequence: Synthetic oligonucleotide
gtggattggctccgcagatacctggag

SEQ ID NO: 35132 - DNA, 29 bp, Artificial Sequence
  Description of Artificial Sequence: Synthetic oligonucleotide
tggattggctccgcagatacctggagaac

SEQ ID NO: 35133 - DNA, 28 bp, Artificial Sequence
  Description of Artificial Sequence: Synthetic oligonucleotide
ggattggctccgcagatacctggagaac

SEQ ID NO: 35134 - DNA, 28 bp, Artificial Sequence
  Description of Artificial Sequence: Synthetic oligonucleotide
gattggctccgcagatacctggagaacg

SEQ ID NO: 35135 - DNA, 28 bp, Artificial Sequence
  Description of Artificial Sequence: Synthetic oligonucleotide
attggctccgcagatacctggagaacgg

SEQ ID NO: 35136 - DNA, 27 bp, Artificial Sequence
  Description of Artificial Sequence: Synthetic oligonucleotide
ttggctccgcagatacctggagaacgg

SEQ ID NO: 35137 - DNA, 27 bp, Artificial Sequence
  Description of Artificial Sequence: Synthetic oligonucleotide
gccatggatagagcaggaggggcctta

SEQ ID NO: 35138 - DNA, 27 bp, Artificial Sequence
  Description of Artificial Sequence: Synthetic oligonucleotide
ccatggatagagcaggaggggccttag

SEQ ID NO: 35139 - DNA, 31 bp, Artificial Sequence
  Description of Artificial Sequence: Synthetic oligonucleotide
catggatagagcaggaggggccttagtattg

SEQ ID NO: 35140 - DNA, 31 bp, Artificial Sequence
  Description of Artificial Sequence: Synthetic oligonucleotide
atggatagagcaggaggggccttagtattgg

SEQ ID NO: 35141 - DNA, 30 bp, Artificial Sequence
  Description of Artificial Sequence: Synthetic oligonucleotide
tggatagagcaggaggggccttagtattgg

SEQ ID NO: 35142 - DNA, 29 bp, Artificial Sequence
  Description of Artificial Sequence: Synthetic oligonucleotide
ggatagagcaggaggggccttagtattgg

SEQ ID NO: 35143 - DNA, 29 bp, Artificial Sequence
  Description of Artificial Sequence: Synthetic oligonucleotide
gatagagcaggaggggccttagtattggg

SEQ ID NO: 35144 - DNA, 30 bp, Artificial Sequence
  Description of Artificial Sequence: Synthetic oligonucleotide
atagagcaggaggggccttagtattgggac

SEQ ID NO: 35145 - DNA, 29 bp, Artificial Sequence
  Description of Artificial Sequence: Synthetic oligonucleotide
tagagcaggaggggccttagtattgggac

SEQ ID NO: 35146 - DNA, 28 bp, Artificial Sequence
  Description of Artificial Sequence: Synthetic oligonucleotide
agagcaggaggggccttagtattgggac

SEQ ID NO: 35147 - DNA, 27 bp, Artificial Sequence
  Description of Artificial Sequence: Synthetic oligonucleotide
gagcaggaggggccttagtattgggac

SEQ ID NO: 35148 - DNA, 27 bp, Artificial Sequence
  Description of Artificial Sequence: Synthetic oligonucleotide
agcaggaggggccttagtattgggacc

SEQ ID NO: 35149 - DNA, 26 bp, Artificial Sequence
  Description of Artificial Sequence: Synthetic oligonucleotide
gcaggaggggccttagtattgggacc

SEQ ID NO: 35150 - DNA, 26 bp, Artificial Sequence
  Description of Artificial Sequence: Synthetic oligonucleotide
caggaggggccttagtattgggaccg

SEQ ID NO: 35151 - DNA, 26 bp, Artificial Sequence
  Description of Artificial Sequence: Synthetic oligonucleotide
aggaggggccttagtattgggaccgg

SEQ ID NO: 35152 - DNA, 25 bp, Artificial Sequence
  Description of Artificial Sequence: Synthetic oligonucleotide
ggaggggccttagtattgggaccgg

SEQ ID NO: 35153 - DNA, 26 bp, Artificial Sequence
  Description of Artificial Sequence: Synthetic oligonucleotide
gaggggccttagtattgggaccggga

SEQ ID NO: 35154 - DNA, 27 bp, Artificial Sequence
  Description of Artificial Sequence: Synthetic oligonucleotide
aggggccttagtattgggaccgggaga

SEQ ID NO: 35155 - DNA, 26 bp, Artificial Sequence
  Description of Artificial Sequence: Synthetic oligonucleotide
ggggccttagtattgggaccgggaga

SEQ ID NO: 35156 - DNA, 27 bp, Artificial Sequence
  Description of Artificial Sequence: Synthetic oligonucleotide
gggccttagtattgggaccgggagaca

SEQ ID NO: 35157 - DNA, 27 bp, Artificial Sequence
  Description of Artificial Sequence: Synthetic oligonucleotide
ggccttagtattgggaccgggagacac

SEQ ID NO: 35158 - DNA, 28 bp, Artificial Sequence
  Description of Artificial Sequence: Synthetic oligonucleotide
gccttagtattgggaccgggagacacag

SEQ ID NO: 35159 - DNA, 30 bp, Artificial Sequence
  Description of Artificial Sequence: Synthetic oligonucleotide
ccttagtattgggaccgggagacacagatc

SEQ ID NO: 35160 - DNA, 31 bp, Artificial Sequence
  Description of Artificial Sequence: Synthetic oligonucleotide
cttagtattgggaccgggagacacagatctc

SEQ ID NO: 35161 - DNA, 31 bp, Artificial Sequence
  Description of Artificial Sequence: Synthetic oligonucleotide
ttagtattgggaccgggagacacagatctcc

SEQ ID NO: 35162 - DNA, 30 bp, Artificial Sequence
  Description of Artificial Sequence: Synthetic oligonucleotide
tagtattgggaccgggagacacagatctcc

SEQ ID NO: 35163 - DNA, 25 bp, Artificial Sequence
  Description of Artificial Sequence: Synthetic oligonucleotide
gcctcctccgcgggcataaccagaa

SEQ ID NO: 35164 - DNA, 25 bp, Artificial Sequence
  Description of Artificial Sequence: Synthetic oligonucleotide
cctcctccgcgggcataaccagaac

SEQ ID NO: 35165 - DNA, 25 bp, Artificial Sequence
  Description of Artificial Sequence: Synthetic oligonucleotide
ctcctccgcgggcataaccagaacg

SEQ ID NO: 35166 - DNA, 25 bp, Artificial Sequence
  Description of Artificial Sequence: Synthetic oligonucleotide
tcctccgcgggcataaccagaacgc

SEQ ID NO: 35167 - DNA, 24 bp, Artificial Sequence
  Description of Artificial Sequence: Synthetic oligonucleotide
cctccgcgggcataaccagaacgc

SEQ ID NO: 35168 - DNA, 26 bp, Artificial Sequence
  Description of Artificial Sequence: Synthetic oligonucleotide
ctccgcgggcataaccagaacgccta

SEQ ID NO: 35169 - DNA, 26 bp, Artificial Sequence
  Description of Artificial Sequence: Synthetic oligonucleotide
tccgcgggcataaccagaacgcctac

SEQ ID NO: 35170 - DNA, 25 bp, Artificial Sequence
  Description of Artificial Sequence: Synthetic oligonucleotide
ccgcgggcataaccagaacgcctac

SEQ ID NO: 35171 - DNA, 26 bp, Artificial Sequence
  Description of Artificial Sequence: Synthetic oligonucleotide
cgcgggcataaccagaacgcctacga

SEQ ID NO: 35172 - DNA, 26 bp, Artificial Sequence
  Description of Artificial Sequence: Synthetic oligonucleotide
gcgggcataaccagaacgcctacgac

SEQ ID NO: 35173 - DNA, 26 bp, Artificial Sequence
  Description of Artificial Sequence: Synthetic oligonucleotide
cgggcataaccagaacgcctacgacg

SEQ ID NO: 35174 - DNA, 26 bp, Artificial Sequence
  Description of Artificial Sequence: Synthetic oligonucleotide
gggcataaccagaacgcctacgacgg

SEQ ID NO: 35175 - DNA, 27 bp, Artificial Sequence
  Description of Artificial Sequence: Synthetic oligonucleotide
ggcataaccagaacgcctacgacggca

SEQ ID NO: 35176 - DNA, 28 bp, Artificial Sequence
  Description of Artificial Sequence: Synthetic oligonucleotide
gcataaccagaacgcctacgacggcaag

SEQ ID NO: 35177 - DNA, 28 bp, Artificial Sequence
  Description of Artificial Sequence: Synthetic oligonucleotide
cataaccagaacgcctacgacggcaagg

SEQ ID NO: 35178 - DNA, 32 bp, Artificial Sequence
  Description of Artificial Sequence: Synthetic oligonucleotide
ataaccagaacgcctacgacggcaaggattac

SEQ ID NO: 35179 - DNA, 31 bp, Artificial Sequence
  Description of Artificial Sequence: Synthetic oligonucleotide
taaccagaacgcctacgacggcaaggattac

SEQ ID NO: 35180 - DNA, 30 bp, Artificial Sequence
  Description of Artificial Sequence: Synthetic oligonucleotide
aaccagaacgcctacgacggcaaggattac

SEQ ID NO: 35181 - DNA, 29 bp, Artificial Sequence
  Description of Artificial Sequence: Synthetic oligonucleotide
accagaacgcctacgacggcaaggattac

SEQ ID NO: 35182 - DNA, 28 bp, Artificial Sequence
  Description of Artificial Sequence: Synthetic oligonucleotide
ccagaacgcctacgacggcaaggattac

SEQ ID NO: 35183 - DNA, 30 bp, Artificial Sequence
  Description of Artificial Sequence: Synthetic oligonucleotide
cagaacgcctacgacggcaaggattacatc

SEQ ID NO: 35184 - DNA, 30 bp, Artificial Sequence
  Description of Artificial Sequence: Synthetic oligonucleotide
agaacgcctacgacggcaaggattacatcg

SEQ ID NO: 35185 - DNA, 29 bp, Artificial Sequence
  Description of Artificial Sequence: Synthetic oligonucleotide
gaacgcctacgacggcaaggattacatcg

SEQ ID NO: 35186 - DNA, 29 bp, Artificial Sequence
  Description of Artificial Sequence: Synthetic oligonucleotide
aacgcctacgacggcaaggattacatcgc

SEQ ID NO: 35187 - DNA, 26 bp, Artificial Sequence
  Description of Artificial Sequence: Synthetic oligonucleotide
ccggagtattgggacccggagacaca

SEQ ID NO: 35188 - DNA, 27 bp, Artificial Sequence
  Description of Artificial Sequence: Synthetic oligonucleotide
cggagtattgggacccggagacacaga

SEQ ID NO: 35189 - DNA, 28 bp, Artificial Sequence
  Description of Artificial Sequence: Synthetic oligonucleotide
ggagtattgggacccggagacacagatc

SEQ ID NO: 35190 - DNA, 29 bp, Artificial Sequence
  Description of Artificial Sequence: Synthetic oligonucleotide
gagtattgggacccggagacacagatctc

SEQ ID NO: 35191 - DNA, 29 bp, Artificial Sequence
  Description of Artificial Sequence: Synthetic oligonucleotide
agtattgggacccggagacacagatctcc

SEQ ID NO: 35192 - DNA, 28 bp, Artificial Sequence
  Description of Artificial Sequence: Synthetic oligonucleotide
gtattgggacccggagacacagatctcc

SEQ ID NO: 35193 - DNA, 30 bp, Artificial Sequence
  Description of Artificial Sequence: Synthetic oligonucleotide
tattgggacccggagacacagatctccaag

SEQ ID NO: 35194 - DNA, 29 bp, Artificial Sequence
  Description of Artificial Sequence: Synthetic oligonucleotide
attgggacccggagacacagatctccaag

SEQ ID NO: 35195 - DNA, 28 bp, Artificial Sequence
  Description of Artificial Sequence: Synthetic oligonucleotide
ttgggacccggagacacagatctccaag

SEQ ID NO: 35196 - DNA, 27 bp, Artificial Sequence
  Description of Artificial Sequence: Synthetic oligonucleotide
tgggacccggagacacagatctccaag

SEQ ID NO: 35197 - DNA, 27 bp, Artificial Sequence
  Description of Artificial Sequence: Synthetic oligonucleotide
gggacccggagacacagatctccaaga

SEQ ID NO: 35198 - DNA, 27 bp, Artificial Sequence
  Description of Artificial Sequence: Synthetic oligonucleotide
ggacccggagacacagatctccaagac

SEQ ID NO: 35199 - DNA, 27 bp, Artificial Sequence
  Description of Artificial Sequence: Synthetic oligonucleotide
gacccggagacacagatctccaagacc

SEQ ID NO: 35200 - DNA, 29 bp, Artificial Sequence
  Description of Artificial Sequence: Synthetic oligonucleotide
acccggagacacagatctccaagaccaac

SEQ ID NO: 35201 - DNA, 28 bp, Artificial Sequence
  Description of Artificial Sequence: Synthetic oligonucleotide
cccggagacacagatctccaagaccaac

SEQ ID NO: 35202 - DNA, 29 bp, Artificial Sequence
  Description of Artificial Sequence: Synthetic oligonucleotide
ccggagacacagatctccaagaccaacac

SEQ ID NO: 35203 - DNA, 30 bp, Artificial Sequence
  Description of Artificial Sequence: Synthetic oligonucleotide
cggagacacagatctccaagaccaacacac

SEQ ID NO: 35204 - DNA, 25 bp, Artificial Sequence
  Description of Artificial Sequence: Synthetic oligonucleotide
cgaggccgggtctcacatcatccag

SEQ ID NO: 35205 - DNA, 26 bp, Artificial Sequence
  Description of Artificial Sequence: Synthetic oligonucleotide
gaggccgggtctcacatcatccaggt

SEQ ID NO: 35206 - DNA, 27 bp, Artificial Sequence
  Description of Artificial Sequence: Synthetic oligonucleotide
aggccgggtctcacatcatccaggtga

SEQ ID NO: 35207 - DNA, 27 bp, Artificial Sequence
  Description of Artificial Sequence: Synthetic oligonucleotide
ggccgggtctcacatcatccaggtgat

SEQ ID NO: 35208 - DNA, 27 bp, Artificial Sequence
  Description of Artificial Sequence: Synthetic oligonucleotide
gccgggtctcacatcatccaggtgatg

SEQ ID NO: 35209 - DNA, 30 bp, Artificial Sequence
  Description of Artificial Sequence: Synthetic oligonucleotide
ccgggtctcacatcatccaggtgatgtatg

SEQ ID NO: 35210 - DNA, 30 bp, Artificial Sequence
  Description of Artificial Sequence: Synthetic oligonucleotide
cgggtctcacatcatccaggtgatgtatgg

SEQ ID NO: 35211 - DNA, 30 bp, Artificial Sequence
  Description of Artificial Sequence: Synthetic oligonucleotide
gggtctcacatcatccaggtgatgtatggc

SEQ ID NO: 35212 - DNA, 31 bp, Artificial Sequence
  Description of Artificial Sequence: Synthetic oligonucleotide
ggtctcacatcatccaggtgatgtatggctg

SEQ ID NO: 35213 - DNA, 31 bp, Artificial Sequence
  Description of Artificial Sequence: Synthetic oligonucleotide
gtctcacatcatccaggtgatgtatggctgc

SEQ ID NO: 35214 - DNA, 31 bp, Artificial Sequence
  Description of Artificial Sequence: Synthetic oligonucleotide
tctcacatcatccaggtgatgtatggctgcg

SEQ ID NO: 35215 - DNA, 30 bp, Artificial Sequence
  Description of Artificial Sequence: Synthetic oligonucleotide
ctcacatcatccaggtgatgtatggctgcg

SEQ ID NO: 35216 - DNA, 31 bp, Artificial Sequence
  Description of Artificial Sequence: Synthetic oligonucleotide
tcacatcatccaggtgatgtatggctgcgac

SEQ ID NO: 35217 - DNA, 30 bp, Artificial Sequence
  Description of Artificial Sequence: Synthetic oligonucleotide
cacatcatccaggtgatgtatggctgcgac

SEQ ID NO: 35218 - DNA, 30 bp, Artificial Sequence
  Description of Artificial Sequence: Synthetic oligonucleotide
acatcatccaggtgatgtatggctgcgacg

SEQ ID NO: 35219 - DNA, 29 bp, Artificial Sequence
  Description of Artificial Sequence: Synthetic oligonucleotide
catcatccaggtgatgtatggctgcgacg

SEQ ID NO: 35220 - DNA, 30 bp, Artificial Sequence
  Description of Artificial Sequence: Synthetic oligonucleotide
atcatccaggtgatgtatggctgcgacgtg

SEQ ID NO: 35221 - DNA, 29 bp, Artificial Sequence
  Description of Artificial Sequence: Synthetic oligonucleotide
tcatccaggtgatgtatggctgcgacgtg

SEQ ID NO: 35222 - DNA, 28 bp, Artificial Sequence
  Description of Artificial Sequence: Synthetic oligonucleotide
catccaggtgatgtatggctgcgacgtg

SEQ ID NO: 35223 - DNA, 28 bp, Artificial Sequence
  Description of Artificial Sequence: Synthetic oligonucleotide
atccaggtgatgtatggctgcgacgtgg

SEQ ID NO: 35224 - DNA, 27 bp, Artificial Sequence
  Description of Artificial Sequence: Synthetic oligonucleotide
tccaggtgatgtatggctgcgacgtgg

SEQ ID NO: 35225 - DNA, 26 bp, Artificial Sequence
  Description of Artificial Sequence: Synthetic oligonucleotide
ccaggtgatgtatggctgcgacgtgg

SEQ ID NO: 35226 - DNA, 33 bp, Artificial Sequence
  Description of Artificial Sequence: Synthetic oligonucleotide
cataaccagtacgcctacgacggcaagaattac

SEQ ID NO: 35227 - DNA, 35 bp, Artificial Sequence
  Description of Artificial Sequence: Synthetic oligonucleotide
ataaccagtacgcctacgacggcaagaattacatc

SEQ ID NO: 35228 - DNA, 34 bp, Artificial Sequence
  Description of Artificial Sequence: Synthetic oligonucleotide
taaccagtacgcctacgacggcaagaattacatc

SEQ ID NO: 35229 - DNA, 33 bp, Artificial Sequence
  Description of Artificial Sequence: Synthetic oligonucleotide
aaccagtacgcctacgacggcaagaattacatc

SEQ ID NO: 35230 - DNA, 32 bp, Artificial Sequence
  Description of Artificial Sequence: Synthetic oligonucleotide
accagtacgcctacgacggcaagaattacatc

SEQ ID NO: 35231 - DNA, 31 bp, Artificial Sequence
  Description of Artificial Sequence: Synthetic oligonucleotide
ccagtacgcctacgacggcaagaattacatc

SEQ ID NO: 35232 - DNA, 31 bp, Artificial Sequence
  Description of Artificial Sequence: Synthetic oligonucleotide
cagtacgcctacgacggcaagaattacatcg

SEQ ID NO: 35233 - DNA, 31 bp, Artificial Sequence
  Description of Artificial Sequence: Synthetic oligonucleotide
agtacgcctacgacggcaagaattacatcgc

SEQ ID NO: 35234 - DNA, 30 bp, Artificial Sequence
  Description of Artificial Sequence: Synthetic oligonucleotide
gtacgcctacgacggcaagaattacatcgc

SEQ ID NO: 35235 - DNA, 30 bp, Artificial Sequence
  Description of Artificial Sequence: Synthetic oligonucleotide
tacgcctacgacggcaagaattacatcgcc

SEQ ID NO: 35236 - DNA, 29 bp, Artificial Sequence
  Description of Artificial Sequence: Synthetic oligonucleotide
acgcctacgacggcaagaattacatcgcc

SEQ ID NO: 35237 - DNA, 28 bp, Artificial Sequence
  Description of Artificial Sequence: Synthetic oligonucleotide
cgcctacgacggcaagaattacatcgcc

SEQ ID NO: 35238 - DNA, 28 bp, Artificial Sequence
  Description of Artificial Sequence: Synthetic oligonucleotide
gcctacgacggcaagaattacatcgccc

SEQ ID NO: 35239 - DNA, 29 bp, Artificial Sequence
  Description of Artificial Sequence: Synthetic oligonucleotide
cctacgacggcaagaattacatcgccctg

SEQ ID NO: 35240 - DNA, 31 bp, Artificial Sequence
  Description of Artificial Sequence: Synthetic oligonucleotide
ctacgacggcaagaattacatcgccctgaac

SEQ ID NO: 35241 - DNA, 31 bp, Artificial Sequence
  Description of Artificial Sequence: Synthetic oligonucleotide
tacgacggcaagaattacatcgccctgaacg

SEQ ID NO: 35242 - DNA, 30 bp, Artificial Sequence
  Description of Artificial Sequence: Synthetic oligonucleotide
acgacggcaagaattacatcgccctgaacg

SEQ ID NO: 35243 - DNA, 29 bp, Artificial Sequence
  Description of Artificial Sequence: Synthetic oligonucleotide
cgacggcaagaattacatcgccctgaacg

SEQ ID NO: 35244 - DNA, 30 bp, Artificial Sequence
  Description of Artificial Sequence: Synthetic oligonucleotide
gacggcaagaattacatcgccctgaacgag

SEQ ID NO: 35245 - DNA, 30 bp, Artificial Sequence
  Description of Artificial Sequence: Synthetic oligonucleotide
acggcaagaattacatcgccctgaacgagg

SEQ ID NO: 35246 - DNA, 29 bp, Artificial Sequence
  Description of Artificial Sequence: Synthetic oligonucleotide
cggcaagaattacatcgccctgaacgagg

SEQ ID NO: 35247 - DNA, 30 bp, Artificial Sequence
  Description of Artificial Sequence: Synthetic oligonucleotide
ggcaagaattacatcgccctgaacgaggac

SEQ ID NO: 35248 - DNA, 30 bp, Artificial Sequence
  Description of Artificial Sequence: Synthetic oligonucleotide
gcaagaattacatcgccctgaacgaggacc

SEQ ID NO: 35249 - DNA, 31 bp, Artificial Sequence
  Description of Artificial Sequence: Synthetic oligonucleotide
caagaattacatcgccctgaacgaggacctg

SEQ ID NO: 35250 - DNA, 31 bp, Artificial Sequence
  Description of Artificial Sequence: Synthetic oligonucleotide
aagaattacatcgccctgaacgaggacctgc

SEQ ID NO: 35251 - DNA, 30 bp, Artificial Sequence
  Description of Artificial Sequence: Synthetic oligonucleotide
agaattacatcgccctgaacgaggacctgc

SEQ ID NO: 35252 - DNA, 29 bp, Artificial Sequence
  Description of Artificial Sequence: Synthetic oligonucleotide
gaattacatcgccctgaacgaggacctgc

SEQ ID NO: 35253 - DNA, 29 bp, Artificial Sequence
  Description of Artificial Sequence: Synthetic oligonucleotide
aattacatcgccctgaacgaggacctgcg

SEQ ID NO: 35254 - DNA, 24 bp, Artificial Sequence
  Description of Artificial Sequence: Synthetic oligonucleotide
gaaggagacgctgcagcgcgctga

SEQ ID NO: 35255 - DNA, 24 bp, Artificial Sequence
  Description of Artificial Sequence: Synthetic oligonucleotide
aaggagacgctgcagcgcgctgac

SEQ ID NO: 35256 - DNA, 23 bp, Artificial Sequence
  Description of Artificial Sequence: Synthetic oligonucleotide
aggagacgctgcagcgcgctgac

SEQ ID NO: 35257 - DNA, 22 bp, Artificial Sequence
  Description of Artificial Sequence: Synthetic oligonucleotide
ggagacgctgcagcgcgctgac

SEQ ID NO: 35258 - DNA, 22 bp, Artificial Sequence
  Description of Artificial Sequence: Synthetic oligonucleotide
gagacgctgcagcgcgctgacc

SEQ ID NO: 35259 - DNA, 22 bp, Artificial Sequence
  Description of Artificial Sequence: Synthetic oligonucleotide
agacgctgcagcgcgctgaccc

SEQ ID NO: 35260 - DNA, 21 bp, Artificial Sequence
  Description of Artificial Sequence: Synthetic oligonucleotide
gacgctgcagcgcgctgaccc

SEQ ID NO: 35261 - DNA, 21 bp, Artificial Sequence
  Description of Artificial Sequence: Synthetic oligonucleotide
acgctgcagcgcgctgacccc

SEQ ID NO: 35262 - DNA, 20 bp, Artificial Sequence
  Description of Artificial Sequence: Synthetic oligonucleotide
cgctgcagcgcgctgacccc

SEQ ID NO: 35263 - DNA, 20 bp, Artificial Sequence
  Description of Artificial Sequence: Synthetic oligonucleotide
gctgcagcgcgctgaccccc

SEQ ID NO: 35264 - DNA, 23 bp, Artificial Sequence
  Description of Artificial Sequence: Synthetic oligonucleotide
ctgcagcgcgctgaccccccaaa

SEQ ID NO: 35265 - DNA, 24 bp, Artificial Sequence
  Description of Artificial Sequence: Synthetic oligonucleotide
tgcagcgcgctgaccccccaaaga

SEQ ID NO: 35266 - DNA, 23 bp, Artificial Sequence
  Description of Artificial Sequence: Synthetic oligonucleotide
gcagcgcgctgaccccccaaaga

SEQ ID NO: 35267 - DNA, 24 bp, Artificial Sequence
  Description of Artificial Sequence: Synthetic oligonucleotide
cagcgcgctgaccccccaaagaca

SEQ ID NO: 35268 - DNA, 24 bp, Artificial Sequence
  Description of Artificial Sequence: Synthetic oligonucleotide
agggcgagtgcgtggagtggctca

SEQ ID NO: 35269 - DNA, 23 bp, Artificial Sequence
  Description of Artificial Sequence: Synthetic oligonucleotide
gggcgagtgcgtggagtggctca

SEQ ID NO: 35270 - DNA, 23 bp, Artificial Sequence
  Description of Artificial Sequence: Synthetic oligonucleotide
ggcgagtgcgtggagtggctcag

SEQ ID NO: 35271 - DNA, 24 bp, Artificial Sequence
  Description of Artificial Sequence: Synthetic oligonucleotide
gcgagtgcgtggagtggctcagca

SEQ ID NO: 35272 - DNA, 27 bp, Artificial Sequence
  Description of Artificial Sequence: Synthetic oligonucleotide
cgagtgcgtggagtggctcagcagata

SEQ ID NO: 35273 - DNA, 27 bp, Artificial Sequence
  Description of Artificial Sequence: Synthetic oligonucleotide
gagtgcgtggagtggctcagcagatac

SEQ ID NO: 35274 - DNA, 27 bp, Artificial Sequence
  Description of Artificial Sequence: Synthetic oligonucleotide
agtgcgtggagtggctcagcagatacc

SEQ ID NO: 35275 - DNA, 27 bp, Artificial Sequence
  Description of Artificial Sequence: Synthetic oligonucleotide
gtgcgtggagtggctcagcagatacct

SEQ ID NO: 35276 - DNA, 27 bp, Artificial Sequence
  Description of Artificial Sequence: Synthetic oligonucleotide
tgcgtggagtggctcagcagatacctg

SEQ ID NO: 35277 - DNA, 26 bp, Artificial Sequence
  Description of Artificial Sequence: Synthetic oligonucleotide
gcgtggagtggctcagcagatacctg

SEQ ID NO: 35278 - DNA, 27 bp, Artificial Sequence
  Description of Artificial Sequence: Synthetic oligonucleotide
cgtggagtggctcagcagatacctgga

SEQ ID NO: 35279 - DNA, 27 bp, Artificial Sequence
  Description of Artificial Sequence: Synthetic oligonucleotide
gtggagtggctcagcagatacctggag

SEQ ID NO: 35280 - DNA, 29 bp, Artificial Sequence
  Description of Artificial Sequence: Synthetic oligonucleotide
tggagtggctcagcagatacctggagaac

SEQ ID NO: 35281 - DNA, 28 bp, Artificial Sequence
  Description of Artificial Sequence: Synthetic oligonucleotide
ggagtggctcagcagatacctggagaac

SEQ ID NO: 35282 - DNA, 28 bp, Artificial Sequence
  Description of Artificial Sequence: Synthetic oligonucleotide
gagtggctcagcagatacctggagaacg

SEQ ID NO: 35283 - DNA, 28 bp, Artificial Sequence
  Description of Artificial Sequence: Synthetic oligonucleotide
agtggctcagcagatacctggagaacgg

SEQ ID NO: 35284 - DNA, 27 bp, Artificial Sequence
  Description of Artificial Sequence: Synthetic oligonucleotide
gtggctcagcagatacctggagaacgg

SEQ ID NO: 35285 - DNA, 27 bp, Artificial Sequence
  Description of Artificial Sequence: Synthetic oligonucleotide
tggctcagcagatacctggagaacggg

SEQ ID NO: 35286 - DNA, 27 bp, Artificial Sequence
  Description of Artificial Sequence: Synthetic oligonucleotide
ggctcagcagatacctggagaacggga

SEQ ID NO: 35287 - DNA, 28 bp, Artificial Sequence
  Description of Artificial Sequence: Synthetic oligonucleotide
gctcagcagatacctggagaacgggaag

SEQ ID NO: 35288 - DNA, 28 bp, Artificial Sequence
  Description of Artificial Sequence: Synthetic oligonucleotide
ctcagcagatacctggagaacgggaagg

SEQ ID NO: 35289 - DNA, 29 bp, Artificial Sequence
  Description of Artificial Sequence: Synthetic oligonucleotide
tcagcagatacctggagaacgggaaggac

SEQ ID NO: 35290 - DNA, 28 bp, Artificial Sequence
  Description of Artificial Sequence: Synthetic oligonucleotide
cagcagatacctggagaacgggaaggac

SEQ ID NO: 35291 - DNA, 30 bp, Artificial Sequence
  Description of Artificial Sequence: Synthetic oligonucleotide
agcagatacctggagaacgggaaggacaag

SEQ ID NO: 35292 - DNA, 32 bp, Artificial Sequence
  Description of Artificial Sequence: Synthetic oligonucleotide
atagaaccttccagaagtgggcagctgtgatg

SEQ ID NO: 35293 - DNA, 31 bp, Artificial Sequence
  Description of Artificial Sequence: Synthetic oligonucleotide
tagaaccttccagaagtgggcagctgtgatg

SEQ ID NO: 35294 - DNA, 30 bp, Artificial Sequence
  Description of Artificial Sequence: Synthetic oligonucleotide
agaaccttccagaagtgggcagctgtgatg

SEQ ID NO: 35295 - DNA, 29 bp, Artificial Sequence
  Description of Artificial Sequence: Synthetic oligonucleotide
gaaccttccagaagtgggcagctgtgatg

SEQ ID NO: 35296 - DNA, 29 bp, Artificial Sequence
  Description of Artificial Sequence: Synthetic oligonucleotide
aaccttccagaagtgggcagctgtgatgg

SEQ ID NO: 35297 - DNA, 28 bp, Artificial Sequence
  Description of Artificial Sequence: Synthetic oligonucleotide
accttccagaagtgggcagctgtgatgg

SEQ ID NO: 35298 - DNA, 27 bp, Artificial Sequence
  Description of Artificial Sequence: Synthetic oligonucleotide
ccttccagaagtgggcagctgtgatgg

SEQ ID NO: 35299 - DNA, 28 bp, Artificial Sequence
  Description of Artificial Sequence: Synthetic oligonucleotide
cttccagaagtgggcagctgtgatggtg

SEQ ID NO: 35300 - DNA, 28 bp, Artificial Sequence
  Description of Artificial Sequence: Synthetic oligonucleotide
ttccagaagtgggcagctgtgatggtgc

SEQ ID NO: 35301 - DNA, 27 bp, Artificial Sequence
  Description of Artificial Sequence: Synthetic oligonucleotide
tccagaagtgggcagctgtgatggtgc

SEQ ID NO: 35302 - DNA, 26 bp, Artificial Sequence
  Description of Artificial Sequence: Synthetic oligonucleotide
ccagaagtgggcagctgtgatggtgc

SEQ ID NO: 35303 - DNA, 27 bp, Artificial Sequence
  Description of Artificial Sequence: Synthetic oligonucleotide
cagaagtgggcagctgtgatggtgcct

SEQ ID NO: 35304 - DNA, 28 bp, Artificial Sequence
  Description of Artificial Sequence: Synthetic oligonucleotide
agaagtgggcagctgtgatggtgccttc

SEQ ID NO: 35305 - DNA, 27 bp, Artificial Sequence
  Description of Artificial Sequence: Synthetic oligonucleotide
gaagtgggcagctgtgatggtgccttc

SEQ ID NO: 35306 - DNA, 28 bp, Artificial Sequence
  Description of Artificial Sequence: Synthetic oligonucleotide
aagtgggcagctgtgatggtgccttctg

SEQ ID NO: 35307 - DNA, 27 bp, Artificial Sequence
  Description of Artificial Sequence: Synthetic oligonucleotide
agtgggcagctgtgatggtgccttctg

SEQ ID NO: 35308 - DNA, 26 bp, Artificial Sequence
  Description of Artificial Sequence: Synthetic oligonucleotide
gtgggcagctgtgatggtgccttctg

SEQ ID NO: 35309 - DNA, 27 bp, Artificial Sequence
  Description of Artificial Sequence: Synthetic oligonucleotide
tgggcagctgtgatggtgccttctgga

SEQ ID NO: 35310 - DNA, 26 bp, Artificial Sequence
  Description of Artificial Sequence: Synthetic oligonucleotide
gggcagctgtgatggtgccttctgga

SEQ ID NO: 35311 - DNA, 27 bp, Artificial Sequence
  Description of Artificial Sequence: Synthetic oligonucleotide
ggcagctgtgatggtgccttctggaga

SEQ ID NO: 35312 - DNA, 28 bp, Artificial Sequence
  Description of Artificial Sequence: Synthetic oligonucleotide
gcagctgtgatggtgccttctggagaag

SEQ ID NO: 35313 - DNA, 29 bp, Artificial Sequence
  Description of Artificial Sequence: Synthetic oligonucleotide
cagctgtgatggtgccttctggagaagag

SEQ ID NO: 35314 - DNA, 29 bp, Artificial Sequence
  Description of Artificial Sequence: Synthetic oligonucleotide
agctgtgatggtgccttctggagaagagc

SEQ ID NO: 35315 - DNA, 28 bp, Artificial Sequence
  Description of Artificial Sequence: Synthetic oligonucleotide
gctgtgatggtgccttctggagaagagc

SEQ ID NO: 35316 - DNA, 29 bp, Artificial Sequence
  Description of Artificial Sequence: Synthetic oligonucleotide
ctgtgatggtgccttctggagaagagcag

SEQ ID NO: 35317 - DNA, 30 bp, Artificial Sequence
  Description of Artificial Sequence: Synthetic oligonucleotide
tgtgatggtgccttctggagaagagcagag

SEQ ID NO: 35318 - DNA, 29 bp, Artificial Sequence
  Description of Artificial Sequence: Synthetic oligonucleotide
gtgatggtgccttctggagaagagcagag

SEQ ID NO: 35319 - DNA, 32 bp, Artificial Sequence
  Description of Artificial Sequence: Synthetic oligonucleotide
tgatggtgccttctggagaagagcagagatac

SEQ ID NO: 35320 - DNA, 31 bp, Artificial Sequence
  Description of Artificial Sequence: Synthetic oligonucleotide
gatggtgccttctggagaagagcagagatac

SEQ ID NO: 35321 - DNA, 32 bp, Artificial Sequence
  Description of Artificial Sequence: Synthetic oligonucleotide
atggtgccttctggagaagagcagagatacac

SEQ ID NO: 35322 - DNA, 25 bp, Artificial Sequence
  Description of Artificial Sequence: Synthetic oligonucleotide
ccatgtacagcatgaggggctgccg

SEQ ID NO: 35323 - DNA, 26 bp, Artificial Sequence
  Description of Artificial Sequence: Synthetic oligonucleotide
catgtacagcatgaggggctgccgga

SEQ ID NO: 35324 - DNA, 26 bp, Artificial Sequence
  Description of Artificial Sequence: Synthetic oligonucleotide
atgtacagcatgaggggctgccggag

SEQ ID NO: 35325 - DNA, 25 bp, Artificial Sequence
  Description of Artificial Sequence: Synthetic oligonucleotide
tgtacagcatgaggggctgccggag

SEQ ID NO: 35326 - DNA, 24 bp, Artificial Sequence
  Description of Artificial Sequence: Synthetic oligonucleotide
gtacagcatgaggggctgccggag

SEQ ID NO: 35327 - DNA, 24 bp, Artificial Sequence
  Description of Artificial Sequence: Synthetic oligonucleotide
tacagcatgaggggctgccggagc

SEQ ID NO: 35328 - DNA, 23 bp, Artificial Sequence
  Description of Artificial Sequence: Synthetic oligonucleotide
acagcatgaggggctgccggagc

SEQ ID NO: 35329 - DNA, 22 bp, Artificial Sequence
  Description of Artificial Sequence: Synthetic oligonucleotide
cagcatgaggggctgccggagc

SEQ ID NO: 35330 - DNA, 22 bp, Artificial Sequence
  Description of Artificial Sequence: Synthetic oligonucleotide
agcatgaggggctgccggagcc

SEQ ID NO: 35331 - DNA, 21 bp, Artificial Sequence
  Description of Artificial Sequence: Synthetic oligonucleotide
gcatgaggggctgccggagcc

SEQ ID NO: 35332 - DNA, 21 bp, Artificial Sequence
  Description of Artificial Sequence: Synthetic oligonucleotide
catgaggggctgccggagccc

SEQ ID NO: 35333 - DNA, 22 bp, Artificial Sequence
  Description of Artificial Sequence: Synthetic oligonucleotide
atgaggggctgccggagcccct

SEQ ID NO: 35334 - DNA, 21 bp, Artificial Sequence
  Description of Artificial Sequence: Synthetic oligonucleotide
tgaggggctgccggagcccct

SEQ ID NO: 35335 - DNA, 20 bp, Artificial Sequence
  Description of Artificial Sequence: Synthetic oligonucleotide
gaggggctgccggagcccct

SEQ ID NO: 35336 - DNA, 21 bp, Artificial Sequence
  Description of Artificial Sequence: Synthetic oligonucleotide
aggggctgccggagcccctca

SEQ ID NO: 35337 - DNA, 20 bp, Artificial Sequence
  Description of Artificial Sequence: Synthetic oligonucleotide
ggggctgccggagcccctca

SEQ ID NO: 35338 - DNA, 20 bp, Artificial Sequence
  Description of Artificial Sequence: Synthetic oligonucleotide
gggctgccggagcccctcac

SEQ ID NO: 35339 - DNA, 20 bp, Artificial Sequence
  Description of Artificial Sequence: Synthetic oligonucleotide
ggctgccggagcccctcacc

SEQ ID NO: 35340 - DNA, 21 bp, Artificial Sequence
  Description of Artificial Sequence: Synthetic oligonucleotide
gctgccggagcccctcaccct

SEQ ID NO: 35341 - DNA, 22 bp, Artificial Sequence
  Description of Artificial Sequence: Synthetic oligonucleotide
ctgccggagcccctcaccctga

SEQ ID NO: 35342 - DNA, 24 bp, Artificial Sequence
  Description of Artificial Sequence: Synthetic oligonucleotide
tgccggagcccctcaccctgagat

SEQ ID NO: 35343 - DNA, 23 bp, Artificial Sequence
  Description of Artificial Sequence: Synthetic oligonucleotide
gccggagcccctcaccctgagat

SEQ ID NO: 35344 - DNA, 23 bp, Artificial Sequence
  Description of Artificial Sequence: Synthetic oligonucleotide
ccggagcccctcaccctgagatg

SEQ ID NO: 35345 - DNA, 23 bp, Artificial Sequence
  Description of Artificial Sequence: Synthetic oligonucleotide
cggagcccctcaccctgagatgg

SEQ ID NO: 35346 - DNA, 23 bp, Artificial Sequence
  Description of Artificial Sequence: Synthetic oligonucleotide
ggagcccctcaccctgagatggg

SEQ ID NO: 35347 - DNA, 29 bp, Artificial Sequence
  Description of Artificial Sequence: Synthetic oligonucleotide
gctcccactccatgacgtatttccacacc

SEQ ID NO: 35348 - DNA, 30 bp, Artificial Sequence
  Description of Artificial Sequence: Synthetic oligonucleotide
ctcccactccatgacgtatttccacacctc

SEQ ID NO: 35349 - DNA, 30 bp, Artificial Sequence
  Description of Artificial Sequence: Synthetic oligonucleotide
tcccactccatgacgtatttccacacctcc

SEQ ID NO: 35350 - DNA, 29 bp, Artificial Sequence
  Description of Artificial Sequence: Synthetic oligonucleotide
cccactccatgacgtatttccacacctcc

SEQ ID NO: 35351 - DNA, 29 bp, Artificial Sequence
  Description of Artificial Sequence: Synthetic oligonucleotide
ccactccatgacgtatttccacacctccg

SEQ ID NO: 35352 - DNA, 30 bp, Artificial Sequence
  Description of Artificial Sequence: Synthetic oligonucleotide
cactccatgacgtatttccacacctccgtg

SEQ ID NO: 35353 - DNA, 31 bp, Artificial Sequence
  Description of Artificial Sequence: Synthetic oligonucleotide
actccatgacgtatttccacacctccgtgtc

SEQ ID NO: 35354 - DNA, 30 bp, Artificial Sequence
  Description of Artificial Sequence: Synthetic oligonucleotide
ctccatgacgtatttccacacctccgtgtc

SEQ ID NO: 35355 - DNA, 30 bp, Artificial Sequence
  Description of Artificial Sequence: Synthetic oligonucleotide
tccatgacgtatttccacacctccgtgtcc

SEQ ID NO: 35356 - DNA, 29 bp, Artificial Sequence
  Description of Artificial Sequence: Synthetic oligonucleotide
ccatgacgtatttccacacctccgtgtcc

SEQ ID NO: 35357 - DNA, 29 bp, Artificial Sequence
  Description of Artificial Sequence: Synthetic oligonucleotide
catgacgtatttccacacctccgtgtccc

SEQ ID NO: 35358 - DNA, 29 bp, Artificial Sequence
  Description of Artificial Sequence: Synthetic oligonucleotide
atgacgtatttccacacctccgtgtcccg

SEQ ID NO: 35359 - DNA, 28 bp, Artificial Sequence
  Description of Artificial Sequence: Synthetic oligonucleotide
tgacgtatttccacacctccgtgtcccg

SEQ ID NO: 35360 - DNA, 27 bp, Artificial Sequence
  Description of Artificial Sequence: Synthetic oligonucleotide
gacgtatttccacacctccgtgtcccg

SEQ ID NO: 35361 - DNA, 27 bp, Artificial Sequence
  Description of Artificial Sequence: Synthetic oligonucleotide
acgtatttccacacctccgtgtcccgg

SEQ ID NO: 35362 - DNA, 26 bp, Artificial Sequence
  Description of Artificial Sequence: Synthetic oligonucleotide
cgtatttccacacctccgtgtcccgg

SEQ ID NO: 35363 - DNA, 26 bp, Artificial Sequence
  Description of Artificial Sequence: Synthetic oligonucleotide
ctccagaggatgtctggctgcgacct

SEQ ID NO: 35364 - DNA, 20 bp, Artificial Sequence
  Description of Artificial Sequence: Synthetic oligonucleotide
gaccgccgcggacacggcga

SEQ ID NO: 35365 - DNA, 21 bp, Artificial Sequence
  Description of Artificial Sequence: Synthetic oligonucleotide
accgccgcggacacggcgact

SEQ ID NO: 35366 - DNA, 20 bp, Artificial Sequence
  Description of Artificial Sequence: Synthetic oligonucleotide
ccgccgcggacacggcgact

SEQ ID NO: 35367 - DNA, 21 bp, Artificial Sequence
  Description of Artificial Sequence: Synthetic oligonucleotide
cgccgcggacacggcgactca

SEQ ID NO: 35368 - DNA, 23 bp, Artificial Sequence
  Description of Artificial Sequence: Synthetic oligonucleotide
gccgcggacacggcgactcagat

SEQ ID NO: 35369 - DNA, 24 bp, Artificial Sequence
  Description of Artificial Sequence: Synthetic oligonucleotide
ccgcggacacggcgactcagatct

SEQ ID NO: 35370 - DNA, 24 bp, Artificial Sequence
  Description of Artificial Sequence: Synthetic oligonucleotide
cgcggacacggcgactcagatctc

SEQ ID NO: 35371 - DNA, 24 bp, Artificial Sequence
  Description of Artificial Sequence: Synthetic oligonucleotide
gcggacacggcgactcagatctcc

SEQ ID NO: 35372 - DNA, 25 bp, Artificial Sequence
  Description of Artificial Sequence: Synthetic oligonucleotide
cggacacggcgactcagatctccca

SEQ ID NO: 35373 - DNA, 25 bp, Artificial Sequence
  Description of Artificial Sequence: Synthetic oligonucleotide
ggacacggcgactcagatctcccag

SEQ ID NO: 35374 - DNA, 25 bp, Artificial Sequence
  Description of Artificial Sequence: Synthetic oligonucleotide
gacacggcgactcagatctcccagc

SEQ ID NO: 35375 - DNA, 25 bp, Artificial Sequence
  Description of Artificial Sequence: Synthetic oligonucleotide
acacggcgactcagatctcccagcg

SEQ ID NO: 35376 - DNA, 24 bp, Artificial Sequence
  Description of Artificial Sequence: Synthetic oligonucleotide
cacggcgactcagatctcccagcg

SEQ ID NO: 35377 - DNA, 26 bp, Artificial Sequence
  Description of Artificial Sequence: Synthetic oligonucleotide
acggcgactcagatctcccagcgcaa

SEQ ID NO: 35378 - DNA, 25 bp, Artificial Sequence
  Description of Artificial Sequence: Synthetic oligonucleotide
cggcgactcagatctcccagcgcaa

SEQ ID NO: 35379 - DNA, 27 bp, Artificial Sequence
  Description of Artificial Sequence: Synthetic oligonucleotide
ggcgactcagatctcccagcgcaagtt

SEQ ID NO: 35380 - DNA, 27 bp, Artificial Sequence
  Description of Artificial Sequence: Synthetic oligonucleotide
gcgactcagatctcccagcgcaagttg

SEQ ID NO: 35381 - DNA, 27 bp, Artificial Sequence
  Description of Artificial Sequence: Synthetic oligonucleotide
cgactcagatctcccagcgcaagttgg

SEQ ID NO: 35382 - DNA, 28 bp, Artificial Sequence
  Description of Artificial Sequence: Synthetic oligonucleotide
gactcagatctcccagcgcaagttggag

SEQ ID NO: 35383 - DNA, 28 bp, Artificial Sequence
  Description of Artificial Sequence: Synthetic oligonucleotide
actcagatctcccagcgcaagttggagg

SEQ ID NO: 35384 - DNA, 24 bp, Artificial Sequence
  Description of Artificial Sequence: Synthetic oligonucleotide
ccgcggacacggtggctcagatct

SEQ ID NO: 35385 - DNA, 24 bp, Artificial Sequence
  Description of Artificial Sequence: Synthetic oligonucleotide
cgcggacacggtggctcagatctc

SEQ ID NO: 35386 - DNA, 24 bp, Artificial Sequence
  Description of Artificial Sequence: Synthetic oligonucleotide
gcggacacggtggctcagatctcc

SEQ ID NO: 35387 - DNA, 25 bp, Artificial Sequence
  Description of Artificial Sequence: Synthetic oligonucleotide
cggacacggtggctcagatctccca

SEQ ID NO: 35388 - DNA, 25 bp, Artificial Sequence
  Description of Artificial Sequence: Synthetic oligonucleotide
ggacacggtggctcagatctcccag

SEQ ID NO: 35389 - DNA, 25 bp, Artificial Sequence
  Description of Artificial Sequence: Synthetic oligonucleotide
gacacggtggctcagatctcccagc

SEQ ID NO: 35390 - DNA, 25 bp, Artificial Sequence
  Description of Artificial Sequence: Synthetic oligonucleotide
acacggtggctcagatctcccagcg

SEQ ID NO: 35391 - DNA, 24 bp, Artificial Sequence
  Description of Artificial Sequence: Synthetic oligonucleotide
cacggtggctcagatctcccagcg

SEQ ID NO: 35392 - DNA, 26 bp, Artificial Sequence
  Description of Artificial Sequence: Synthetic oligonucleotide
acggtggctcagatctcccagcgcaa

SEQ ID NO: 35393 - DNA, 25 bp, Artificial Sequence
  Description of Artificial Sequence: Synthetic oligonucleotide
cggtggctcagatctcccagcgcaa

SEQ ID NO: 35394 - DNA, 27 bp, Artificial Sequence
  Description of Artificial Sequence: Synthetic oligonucleotide
ggtggctcagatctcccagcgcaagtt

SEQ ID NO: 35395 - DNA, 27 bp, Artificial Sequence
  Description of Artificial Sequence: Synthetic oligonucleotide
gtggctcagatctcccagcgcaagttg

SEQ ID NO: 35396 - DNA, 27 bp, Artificial Sequence
  Description of Artificial Sequence: Synthetic oligonucleotide
tggctcagatctcccagcgcaagttgg

SEQ ID NO: 35397 - DNA, 35 bp, Artificial Sequence
  Description of Artificial Sequence: Synthetic oligonucleotide
acagatctccaagaccaacacacagacttaccaag

SEQ ID NO: 35398 - DNA, 34 bp, Artificial Sequence
  Description of Artificial Sequence: Synthetic oligonucleotide
cagatctccaagaccaacacacagacttaccaag

SEQ ID NO: 35399 - DNA, 35 bp, Artificial Sequence
  Description of Artificial Sequence: Synthetic oligonucleotide
agatctccaagaccaacacacagacttaccaagag

SEQ ID NO: 35400 - DNA, 34 bp, Artificial Sequence
  Description of Artificial Sequence: Synthetic oligonucleotide
gatctccaagaccaacacacagacttaccaagag

SEQ ID NO: 35401 - DNA, 35 bp, Artificial Sequence
  Description of Artificial Sequence: Synthetic oligonucleotide
atctccaagaccaacacacagacttaccaagagag

SEQ ID NO: 35402 - DNA, 34 bp, Artificial Sequence
  Description of Artificial Sequence: Synthetic oligonucleotide
tctccaagaccaacacacagacttaccaagagag

SEQ ID NO: 35403 - DNA, 33 bp, Artificial Sequence
  Description of Artificial Sequence: Synthetic oligonucleotide
ctccaagaccaacacacagacttaccaagagag

SEQ ID NO: 35404 - DNA, 33 bp, Artificial Sequence
  Description of Artificial Sequence: Synthetic oligonucleotide
tccaagaccaacacacagacttaccaagagagc

SEQ ID NO: 35405 - DNA, 32 bp, Artificial Sequence
  Description of Artificial Sequence: Synthetic oligonucleotide
ccaagaccaacacacagacttaccaagagagc

SEQ ID NO: 35406 - DNA, 22 bp, Artificial Sequence
  Description of Artificial Sequence: Synthetic oligonucleotide
cagcgcaagttggaggcggccg

SEQ ID NO: 35407 - DNA, 23 bp, Artificial Sequence
  Description of Artificial Sequence: Synthetic oligonucleotide
agcgcaagttggaggcggccggt

SEQ ID NO: 35408 - DNA, 22 bp, Artificial Sequence
  Description of Artificial Sequence: Synthetic oligonucleotide
gcgcaagttggaggcggccggt

SEQ ID NO: 35409 - DNA, 23 bp, Artificial Sequence
  Description of Artificial Sequence: Synthetic oligonucleotide
cgcaagttggaggcggccggtgt

SEQ ID NO: 35410 - DNA, 23 bp, Artificial Sequence
  Description of Artificial Sequence: Synthetic oligonucleotide
gcaagttggaggcggccggtgtg

SEQ ID NO: 35411 - DNA, 23 bp, Artificial Sequence
  Description of Artificial Sequence: Synthetic oligonucleotide
caagttggaggcggccggtgtgg

SEQ ID NO: 35412 - DNA, 23 bp, Artificial Sequence
  Description of Artificial Sequence: Synthetic oligonucleotide
aagttggaggcggccggtgtggc

SEQ ID NO: 35413 - DNA, 22 bp, Artificial Sequence
  Description of Artificial Sequence: Synthetic oligonucleotide
agttggaggcggccggtgtggc

SEQ ID NO: 35414 - DNA, 21 bp, Artificial Sequence
  Description of Artificial Sequence: Synthetic oligonucleotide
gttggaggcggccggtgtggc

SEQ ID NO: 35415 - DNA, 21 bp, Artificial Sequence
  Description of Artificial Sequence: Synthetic oligonucleotide
ttggaggcggccggtgtggcg

SEQ ID NO: 35416 - DNA, 20 bp, Artificial Sequence
  Description of Artificial Sequence: Synthetic oligonucleotide
tggaggcggccggtgtggcg

SEQ ID NO: 35417 - DNA, 26 bp, Artificial Sequence
  Description of Artificial Sequence: Synthetic oligonucleotide
gcggctcagatcacccagcgcaagtt

SEQ ID NO: 35418 - DNA, 26 bp, Artificial Sequence
  Description of Artificial Sequence: Synthetic oligonucleotide
cggctcagatcacccagcgcaagttg

SEQ ID NO: 35419 - DNA, 27 bp, Artificial Sequence
  Description of Artificial Sequence: Synthetic oligonucleotide
ggctcagatcacccagcgcaagttgga

SEQ ID NO: 35420 - DNA, 27 bp, Artificial Sequence
  Description of Artificial Sequence: Synthetic oligonucleotide
gctcagatcacccagcgcaagttggag

SEQ ID NO: 35421 - DNA, 27 bp, Artificial Sequence
  Description of Artificial Sequence: Synthetic oligonucleotide
ctcagatcacccagcgcaagttggagg

SEQ ID NO: 35422 - DNA, 27 bp, Artificial Sequence
  Description of Artificial Sequence: Synthetic oligonucleotide
tcagatcacccagcgcaagttggaggc

SEQ ID NO: 35423 - DNA, 26 bp, Artificial Sequence
  Description of Artificial Sequence: Synthetic oligonucleotide
cagatcacccagcgcaagttggaggc

SEQ ID NO: 35424 - DNA, 26 bp, Artificial Sequence
  Description of Artificial Sequence: Synthetic oligonucleotide
agatcacccagcgcaagttggaggcg

SEQ ID NO: 35425 - DNA, 25 bp, Artificial Sequence
  Description of Artificial Sequence: Synthetic oligonucleotide
gatcacccagcgcaagttggaggcg

SEQ ID NO: 35426 - DNA, 25 bp, Artificial Sequence
  Description of Artificial Sequence: Synthetic oligonucleotide
atcacccagcgcaagttggaggcgg

SEQ ID NO: 35427 - DNA, 24 bp, Artificial Sequence
  Description of Artificial Sequence: Synthetic oligonucleotide
tcacccagcgcaagttggaggcgg

SEQ ID NO: 35428 - DNA, 23 bp, Artificial Sequence
  Description of Artificial Sequence: Synthetic oligonucleotide
cacccagcgcaagttggaggcgg

SEQ ID NO: 35429 - DNA, 23 bp, Artificial Sequence
  Description of Artificial Sequence: Synthetic oligonucleotide
acccagcgcaagttggaggcggc

SEQ ID NO: 35430 - DNA, 29 bp, Artificial Sequence
  Description of Artificial Sequence: Synthetic oligonucleotide
acagacttaccgagagagcctgcggaaac

SEQ ID NO: 35431 - DNA, 28 bp, Artificial Sequence
  Description of Artificial Sequence: Synthetic oligonucleotide
cagacttaccgagagagcctgcggaaac

SEQ ID NO: 35432 - DNA, 29 bp, Artificial Sequence
  Description of Artificial Sequence: Synthetic oligonucleotide
agacttaccgagagagcctgcggaaactg

SEQ ID NO: 35433 - DNA, 28 bp, Artificial Sequence
  Description of Artificial Sequence: Synthetic oligonucleotide
gacttaccgagagagcctgcggaaactg

SEQ ID NO: 35434 - DNA, 28 bp, Artificial Sequence
  Description of Artificial Sequence: Synthetic oligonucleotide
acttaccgagagagcctgcggaaactgc

SEQ ID NO: 35435 - DNA, 27 bp, Artificial Sequence
  Description of Artificial Sequence: Synthetic oligonucleotide
cttaccgagagagcctgcggaaactgc

SEQ ID NO: 35436 - DNA, 27 bp, Artificial Sequence
  Description of Artificial Sequence: Synthetic oligonucleotide
ttaccgagagagcctgcggaaactgcg

SEQ ID NO: 35437 - DNA, 26 bp, Artificial Sequence
  Description of Artificial Sequence: Synthetic oligonucleotide
taccgagagagcctgcggaaactgcg

SEQ ID NO: 35438 - DNA, 25 bp, Artificial Sequence
  Description of Artificial Sequence: Synthetic oligonucleotide
accgagagagcctgcggaaactgcg

SEQ ID NO: 35439 - DNA, 24 bp, Artificial Sequence
  Description of Artificial Sequence: Synthetic oligonucleotide
ccgagagagcctgcggaaactgcg

SEQ ID NO: 35440 - DNA, 24 bp, Artificial Sequence
  Description of Artificial Sequence: Synthetic oligonucleotide
cgagagagcctgcggaaactgcgc

SEQ ID NO: 35441 - DNA, 24 bp, Artificial Sequence
  Description of Artificial Sequence: Synthetic oligonucleotide
gagagagcctgcggaaactgcgcg

SEQ ID NO: 35442 - DNA, 24 bp, Artificial Sequence
  Description of Artificial Sequence: Synthetic oligonucleotide
agagagcctgcggaaactgcgcgg

SEQ ID NO: 35443 - DNA, 23 bp, Artificial Sequence
  Description of Artificial Sequence: Synthetic oligonucleotide
gagagcctgcggaaactgcgcgg

SEQ ID NO: 35444 - DNA, 25 bp, Artificial Sequence
  Description of Artificial Sequence: Synthetic oligonucleotide
agagcctgcggaaactgcgcggcta

SEQ ID NO: 35445 - DNA, 24 bp, Artificial Sequence
  Description of Artificial Sequence: Synthetic oligonucleotide
gagcctgcggaaactgcgcggcta

SEQ ID NO: 35446 - DNA, 26 bp, Artificial Sequence
  Description of Artificial Sequence: Synthetic oligonucleotide
agcctgcggaaactgcgcggctacta

SEQ ID NO: 35447 - DNA, 25 bp, Artificial Sequence
  Description of Artificial Sequence: Synthetic oligonucleotide
gcctgcggaaactgcgcggctacta

SEQ ID NO: 35448 - DNA, 27 bp, Artificial Sequence
  Description of Artificial Sequence: Synthetic oligonucleotide
cctgcggaaactgcgcggctactacaa

SEQ ID NO: 35449 - DNA, 27 bp, Artificial Sequence
  Description of Artificial Sequence: Synthetic oligonucleotide
ctgcggaaactgcgcggctactacaac

SEQ ID NO: 35450 - DNA, 27 bp, Artificial Sequence
  Description of Artificial Sequence: Synthetic oligonucleotide
tgcggaaactgcgcggctactacaacc

SEQ ID NO: 35451 - DNA, 27 bp, Artificial Sequence
  Description of Artificial Sequence: Synthetic oligonucleotide
gcggaaactgcgcggctactacaacca

SEQ ID NO: 35452 - DNA, 27 bp, Artificial Sequence
  Description of Artificial Sequence: Synthetic oligonucleotide
cggaaactgcgcggctactacaaccag

SEQ ID NO: 35453 - DNA, 28 bp, Artificial Sequence
  Description of Artificial Sequence: Synthetic oligonucleotide
ggaaactgcgcggctactacaaccagag

SEQ ID NO: 35454 - DNA, 28 bp, Artificial Sequence
  Description of Artificial Sequence: Synthetic oligonucleotide
gaaactgcgcggctactacaaccagagc

SEQ ID NO: 35455 - DNA, 28 bp, Artificial Sequence
  Description of Artificial Sequence: Synthetic oligonucleotide
aaactgcgcggctactacaaccagagcg

SEQ ID NO: 35456 - DNA, 27 bp, Artificial Sequence
  Description of Artificial Sequence: Synthetic oligonucleotide
aactgcgcggctactacaaccagagcg

SEQ ID NO: 35457 - DNA, 27 bp, Artificial Sequence
  Description of Artificial Sequence: Synthetic oligonucleotide
actgcgcggctactacaaccagagcga

SEQ ID NO: 35458 - DNA, 22 bp, Artificial Sequence
  Description of Artificial Sequence: Synthetic oligonucleotide
acctgcgctcctggaccgccgt

SEQ ID NO: 35459 - DNA, 21 bp, Artificial Sequence
  Description of Artificial Sequence: Synthetic oligonucleotide
cctgcgctcctggaccgccgt

SEQ ID NO: 35460 - DNA, 21 bp, Artificial Sequence
  Description of Artificial Sequence: Synthetic oligonucleotide
ctgcgctcctggaccgccgtg

SEQ ID NO: 35461 - DNA, 22 bp, Artificial Sequence
  Description of Artificial Sequence: Synthetic oligonucleotide
tgcgctcctggaccgccgtgga

SEQ ID NO: 35462 - DNA, 21 bp, Artificial Sequence
  Description of Artificial Sequence: Synthetic oligonucleotide
gcgctcctggaccgccgtgga

SEQ ID NO: 35463 - DNA, 22 bp, Artificial Sequence
  Description of Artificial Sequence: Synthetic oligonucleotide
cgctcctggaccgccgtggaca

SEQ ID NO: 35464 - DNA, 22 bp, Artificial Sequence
  Description of Artificial Sequence: Synthetic oligonucleotide
gctcctggaccgccgtggacac

SEQ ID NO: 35465 - DNA, 22 bp, Artificial Sequence
  Description of Artificial Sequence: Synthetic oligonucleotide
ctcctggaccgccgtggacacg

SEQ ID NO: 35466 - DNA, 22 bp, Artificial Sequence
  Description of Artificial Sequence: Synthetic oligonucleotide
tcctggaccgccgtggacacgg

SEQ ID NO: 35467 - DNA, 21 bp, Artificial Sequence
  Description of Artificial Sequence: Synthetic oligonucleotide
cctggaccgccgtggacacgg

SEQ ID NO: 35468 - DNA, 21 bp, Artificial Sequence
  Description of Artificial Sequence: Synthetic oligonucleotide
ctggaccgccgtggacacggc

SEQ ID NO: 35469 - DNA, 21 bp, Artificial Sequence
  Description of Artificial Sequence: Synthetic oligonucleotide
tggaccgccgtggacacggcg

SEQ ID NO: 35470 - DNA, 20 bp, Artificial Sequence
  Description of Artificial Sequence: Synthetic oligonucleotide
ggaccgccgtggacacggcg

SEQ ID NO: 35471 - DNA, 20 bp, Artificial Sequence
  Description of Artificial Sequence: Synthetic oligonucleotide
gaccgccgtggacacggcgg

SEQ ID NO: 35472 - DNA, 21 bp, Artificial Sequence
  Description of Artificial Sequence: Synthetic oligonucleotide
accgccgtggacacggcggct

SEQ ID NO: 35473 - DNA, 20 bp, Artificial Sequence
  Description of Artificial Sequence: Synthetic oligonucleotide
ccgccgtggacacggcggct

SEQ ID NO: 35474 - DNA, 21 bp, Artificial Sequence
  Description of Artificial Sequence: Synthetic oligonucleotide
cgccgtggacacggcggctca

SEQ ID NO: 35475 - DNA, 23 bp, Artificial Sequence
  Description of Artificial Sequence: Synthetic oligonucleotide
gccgtggacacggcggctcagat

SEQ ID NO: 35476 - DNA, 24 bp, Artificial Sequence
  Description of Artificial Sequence: Synthetic oligonucleotide
ccgtggacacggcggctcagatca

SEQ ID NO: 35477 - DNA, 24 bp, Artificial Sequence
  Description of Artificial Sequence: Synthetic oligonucleotide
cgtggacacggcggctcagatcac

SEQ ID NO: 35478 - DNA, 24 bp, Artificial Sequence
  Description of Artificial Sequence: Synthetic oligonucleotide
gtggacacggcggctcagatcacc

SEQ ID NO: 35479 - DNA, 25 bp, Artificial Sequence
  Description of Artificial Sequence: Synthetic oligonucleotide
tggacacggcggctcagatcaccca

SEQ ID NO: 35480 - DNA, 20 bp, Artificial Sequence
  Description of Artificial Sequence: Synthetic oligonucleotide
atgtcccggcccggccgcct

SEQ ID NO: 35481 - DNA, 22 bp, Artificial Sequence
  Description of Artificial Sequence: Synthetic oligonucleotide
cgccgggagccccgcttcatca

SEQ ID NO: 35482 - DNA, 22 bp, Artificial Sequence
  Description of Artificial Sequence: Synthetic oligonucleotide
gccgggagccccgcttcatcac

SEQ ID NO: 35483 - DNA, 22 bp, Artificial Sequence
  Description of Artificial Sequence: Synthetic oligonucleotide
ccgggagccccgcttcatcacc

SEQ ID NO: 35484 - DNA, 23 bp, Artificial Sequence
  Description of Artificial Sequence: Synthetic oligonucleotide
cgggagccccgcttcatcaccgt

SEQ ID NO: 35485 - DNA, 26 bp, Artificial Sequence
  Description of Artificial Sequence: Synthetic oligonucleotide
acatcgccctgaacgaggacctgcgt

SEQ ID NO: 35486 - DNA, 25 bp, Artificial Sequence
  Description of Artificial Sequence: Synthetic oligonucleotide
catcgccctgaacgaggacctgcgt

SEQ ID NO: 35487 - DNA, 25 bp, Artificial Sequence
  Description of Artificial Sequence: Synthetic oligonucleotide
atcgccctgaacgaggacctgcgtc

SEQ ID NO: 35488 - DNA, 24 bp, Artificial Sequence
  Description of Artificial Sequence: Synthetic oligonucleotide
tcgccctgaacgaggacctgcgtc

SEQ ID NO: 35489 - DNA, 23 bp, Artificial Sequence
  Description of Artificial Sequence: Synthetic oligonucleotide
cgccctgaacgaggacctgcgtc

SEQ ID NO: 35490 - DNA, 23 bp, Artificial Sequence
  Description of Artificial Sequence: Synthetic oligonucleotide
gccctgaacgaggacctgcgtcc

SEQ ID NO: 35491 - DNA, 24 bp, Artificial Sequence
  Description of Artificial Sequence: Synthetic oligonucleotide
ccctgaacgaggacctgcgtccct

SEQ ID NO: 35492 - DNA, 24 bp, Artificial Sequence
  Description of Artificial Sequence: Synthetic oligonucleotide
cctgaacgaggacctgcgtccctg

SEQ ID NO: 35493 - DNA, 25 bp, Artificial Sequence
  Description of Artificial Sequence: Synthetic oligonucleotide
ctgaacgaggacctgcgtccctgga

SEQ ID NO: 35494 - DNA, 25 bp, Artificial Sequence
  Description of Artificial Sequence: Synthetic oligonucleotide
tgaacgaggacctgcgtccctggac

SEQ ID NO: 35495 - DNA, 24 bp, Artificial Sequence
  Description of Artificial Sequence: Synthetic oligonucleotide
gaacgaggacctgcgtccctggac

SEQ ID NO: 35496 - DNA, 24 bp, Artificial Sequence
  Description of Artificial Sequence: Synthetic oligonucleotide
aacgaggacctgcgtccctggacc

SEQ ID NO: 35497 - DNA, 23 bp, Artificial Sequence
  Description of Artificial Sequence: Synthetic oligonucleotide
acgaggacctgcgtccctggacc

SEQ ID NO: 35498 - DNA, 22 bp, Artificial Sequence
  Description of Artificial Sequence: Synthetic oligonucleotide
cgaggacctgcgtccctggacc

SEQ ID NO: 35499 - DNA, 22 bp, Artificial Sequence
  Description of Artificial Sequence: Synthetic oligonucleotide
gaggacctgcgtccctggaccg

SEQ ID NO: 35500 - DNA, 22 bp, Artificial Sequence
  Description of Artificial Sequence: Synthetic oligonucleotide
aggacctgcgtccctggaccgc

SEQ ID NO: 35501 - DNA, 21 bp, Artificial Sequence
  Description of Artificial Sequence: Synthetic oligonucleotide
ggacctgcgtccctggaccgc

SEQ ID NO: 35502 - DNA, 21 bp, Artificial Sequence
  Description of Artificial Sequence: Synthetic oligonucleotide
gacctgcgtccctggaccgcc

SEQ ID NO: 35503 - DNA, 21 bp, Artificial Sequence
  Description of Artificial Sequence: Synthetic oligonucleotide
acctgcgtccctggaccgccg

SEQ ID NO: 35504 - DNA, 20 bp, Artificial Sequence
  Description of Artificial Sequence: Synthetic oligonucleotide
cctgcgtccctggaccgccg

SEQ ID NO: 35505 - DNA, 20 bp, Artificial Sequence
  Description of Artificial Sequence: Synthetic oligonucleotide
ctgcgtccctggaccgccgc

SEQ ID NO: 35506 - DNA, 20 bp, Artificial Sequence
  Description of Artificial Sequence: Synthetic oligonucleotide
tgcgtccctggaccgccgcg

SEQ ID NO: 35507 - DNA, 20 bp, Artificial Sequence
  Description of Artificial Sequence: Synthetic oligonucleotide
gcgtccctggaccgccgcgt

SEQ ID NO: 35508 - DNA, 20 bp, Artificial Sequence
  Description of Artificial Sequence: Synthetic oligonucleotide
cgtccctggaccgccgcgga

SEQ ID NO: 35509 - DNA, 21 bp, Artificial Sequence
  Description of Artificial Sequence: Synthetic oligonucleotide
gtccctggaccgccgcggaca

SEQ ID NO: 35510 - DNA, 21 bp, Artificial Sequence
  Description of Artificial Sequence: Synthetic oligonucleotide
tccctggaccgccgcggacac

SEQ ID NO: 35511 - DNA, 20 bp, Artificial Sequence
  Description of Artificial Sequence: Synthetic oligonucleotide
ccctggaccgccgcggacac

SEQ ID NO: 35512 - DNA, 23 bp, Artificial Sequence
  Description of Artificial Sequence: Synthetic oligonucleotide
aggggccggagtattcggaccgg

SEQ ID NO: 35513 - DNA, 22 bp, Artificial Sequence
  Description of Artificial Sequence: Synthetic oligonucleotide
ggggccggagtattcggaccgg

SEQ ID NO: 35514 - DNA, 23 bp, Artificial Sequence
  Description of Artificial Sequence: Synthetic oligonucleotide
gggccggagtattcggaccggga

SEQ ID NO: 35515 - DNA, 24 bp, Artificial Sequence
  Description of Artificial Sequence: Synthetic oligonucleotide
ggccggagtattcggaccgggaga

SEQ ID NO: 35516 - DNA, 25 bp, Artificial Sequence
  Description of Artificial Sequence: Synthetic oligonucleotide
gccggagtattcggaccgggagaca

SEQ ID NO: 35517 - DNA, 26 bp, Artificial Sequence
  Description of Artificial Sequence: Synthetic oligonucleotide
ccggagtattcggaccgggagacaca

SEQ ID NO: 35518 - DNA, 27 bp, Artificial Sequence
  Description of Artificial Sequence: Synthetic oligonucleotide
cggagtattcggaccgggagacacaga

SEQ ID NO: 35519 - DNA, 28 bp, Artificial Sequence
  Description of Artificial Sequence: Synthetic oligonucleotide
ggagtattcggaccgggagacacagatc

SEQ ID NO: 35520 - DNA, 29 bp, Artificial Sequence
  Description of Artificial Sequence: Synthetic oligonucleotide
gagtattcggaccgggagacacagatctc

SEQ ID NO: 35521 - DNA, 29 bp, Artificial Sequence
  Description of Artificial Sequence: Synthetic oligonucleotide
agtattcggaccgggagacacagatctcc

SEQ ID NO: 35522 - DNA, 28 bp, Artificial Sequence
  Description of Artificial Sequence: Synthetic oligonucleotide
gtattcggaccgggagacacagatctcc

SEQ ID NO: 35523 - DNA, 30 bp, Artificial Sequence
  Description of Artificial Sequence: Synthetic oligonucleotide
tattcggaccgggagacacagatctccaag

SEQ ID NO: 35524 - DNA, 29 bp, Artificial Sequence
  Description of Artificial Sequence: Synthetic oligonucleotide
attcggaccgggagacacagatctccaag

SEQ ID NO: 35525 - DNA, 28 bp, Artificial Sequence
  Description of Artificial Sequence: Synthetic oligonucleotide
ttcggaccgggagacacagatctccaag

SEQ ID NO: 35526 - DNA, 27 bp, Artificial Sequence
  Description of Artificial Sequence: Synthetic oligonucleotide
tcggaccgggagacacagatctccaag

SEQ ID NO: 35527 - DNA, 27 bp, Artificial Sequence
  Description of Artificial Sequence: Synthetic oligonucleotide
cggaccgggagacacagatctccaaga

SEQ ID NO: 35528 - DNA, 24 bp, Artificial Sequence
  Description of Artificial Sequence: Synthetic oligonucleotide
cgcggacacggcggctcagatcat

SEQ ID NO: 35529 - DNA, 24 bp, Artificial Sequence
  Description of Artificial Sequence: Synthetic oligonucleotide
gcggacacggcggctcagatcatc

SEQ ID NO: 35530 - DNA, 25 bp, Artificial Sequence
  Description of Artificial Sequence: Synthetic oligonucleotide
cggacacggcggctcagatcatcca

SEQ ID NO: 35531 - DNA, 25 bp, Artificial Sequence
  Description of Artificial Sequence: Synthetic oligonucleotide
ggacacggcggctcagatcatccag

SEQ ID NO: 35532 - DNA, 25 bp, Artificial Sequence
  Description of Artificial Sequence: Synthetic oligonucleotide
gacacggcggctcagatcatccagc

SEQ ID NO: 35533 - DNA, 25 bp, Artificial Sequence
  Description of Artificial Sequence: Synthetic oligonucleotide
acacggcggctcagatcatccagcg

SEQ ID NO: 35534 - DNA, 24 bp, Artificial Sequence
  Description of Artificial Sequence: Synthetic oligonucleotide
cacggcggctcagatcatccagcg

SEQ ID NO: 35535 - DNA, 26 bp, Artificial Sequence
  Description of Artificial Sequence: Synthetic oligonucleotide
acggcggctcagatcatccagcgcaa

SEQ ID NO: 35536 - DNA, 25 bp, Artificial Sequence
  Description of Artificial Sequence: Synthetic oligonucleotide
cggcggctcagatcatccagcgcaa

SEQ ID NO: 35537 - DNA, 26 bp, Artificial Sequence
  Description of Artificial Sequence: Synthetic oligonucleotide
ggcggctcagatcatccagcgcaagt

SEQ ID NO: 35538 - DNA, 26 bp, Artificial Sequence
  Description of Artificial Sequence: Synthetic oligonucleotide
gcggctcagatcatccagcgcaagtg

SEQ ID NO: 35539 - DNA, 26 bp, Artificial Sequence
  Description of Artificial Sequence: Synthetic oligonucleotide
cggctcagatcatccagcgcaagtgg

SEQ ID NO: 35540 - DNA, 27 bp, Artificial Sequence
  Description of Artificial Sequence: Synthetic oligonucleotide
ggctcagatcatccagcgcaagtggga

SEQ ID NO: 35541 - DNA, 27 bp, Artificial Sequence
  Description of Artificial Sequence: Synthetic oligonucleotide
gctcagatcatccagcgcaagtgggag

SEQ ID NO: 35542 - DNA, 27 bp, Artificial Sequence
  Description of Artificial Sequence: Synthetic oligonucleotide
ctcagatcatccagcgcaagtgggagg

SEQ ID NO: 35543 - DNA, 27 bp, Artificial Sequence
  Description of Artificial Sequence: Synthetic oligonucleotide
tcagatcatccagcgcaagtgggaggc

SEQ ID NO: 35544 - DNA, 26 bp, Artificial Sequence
  Description of Artificial Sequence: Synthetic oligonucleotide
cagatcatccagcgcaagtgggaggc

SEQ ID NO: 35545 - DNA, 26 bp, Artificial Sequence
  Description of Artificial Sequence: Synthetic oligonucleotide
agatcatccagcgcaagtgggaggcg

SEQ ID NO: 35546 - DNA, 25 bp, Artificial Sequence
  Description of Artificial Sequence: Synthetic oligonucleotide
gatcatccagcgcaagtgggaggcg

SEQ ID NO: 35547 - DNA, 25 bp, Artificial Sequence
  Description of Artificial Sequence: Synthetic oligonucleotide
atcatccagcgcaagtgggaggcgg

SEQ ID NO: 35548 - DNA, 24 bp, Artificial Sequence
  Description of Artificial Sequence: Synthetic oligonucleotide
tcatccagcgcaagtgggaggcgg

SEQ ID NO: 35549 - DNA, 23 bp, Artificial Sequence
  Description of Artificial Sequence: Synthetic oligonucleotide
catccagcgcaagtgggaggcgg

SEQ ID NO: 35550 - DNA, 23 bp, Artificial Sequence
  Description of Artificial Sequence: Synthetic oligonucleotide
atccagcgcaagtgggaggcggc

SEQ ID NO: 35551 - DNA, 22 bp, Artificial Sequence
  Description of Artificial Sequence: Synthetic oligonucleotide
tccagcgcaagtgggaggcggc

SEQ ID NO: 35552 - DNA, 25 bp, Artificial Sequence
  Description of Artificial Sequence: Synthetic oligonucleotide
tacaaccagagcgaggccgggtctc

SEQ ID NO: 35553 - DNA, 24 bp, Artificial Sequence
  Description of Artificial Sequence: Synthetic oligonucleotide
acaaccagagcgaggccgggtctc

SEQ ID NO: 35554 - DNA, 23 bp, Artificial Sequence
  Description of Artificial Sequence: Synthetic oligonucleotide
caaccagagcgaggccgggtctc

SEQ ID NO: 35555 - DNA, 23 bp, Artificial Sequence
  Description of Artificial Sequence: Synthetic oligonucleotide
aaccagagcgaggccgggtctcg

SEQ ID NO: 35556 - DNA, 22 bp, Artificial Sequence
  Description of Artificial Sequence: Synthetic oligonucleotide
accagagcgaggccgggtctcg

SEQ ID NO: 35557 - DNA, 21 bp, Artificial Sequence
  Description of Artificial Sequence: Synthetic oligonucleotide
ccagagcgaggccgggtctcg

SEQ ID NO: 35558 - DNA, 22 bp, Artificial Sequence
  Description of Artificial Sequence: Synthetic oligonucleotide
cagagcgaggccgggtctcgca

SEQ ID NO: 35559 - DNA, 22 bp, Artificial Sequence
  Description of Artificial Sequence: Synthetic oligonucleotide
agagcgaggccgggtctcgcac

SEQ ID NO: 35560 - DNA, 21 bp, Artificial Sequence
  Description of Artificial Sequence: Synthetic oligonucleotide
gagcgaggccgggtctcgcac

SEQ ID NO: 35561 - DNA, 21 bp, Artificial Sequence
  Description of Artificial Sequence: Synthetic oligonucleotide
agcgaggccgggtctcgcacc

SEQ ID NO: 35562 - DNA, 20 bp, Artificial Sequence
  Description of Artificial Sequence: Synthetic oligonucleotide
gcgaggccgggtctcgcacc

SEQ ID NO: 35563 - DNA, 21 bp, Artificial Sequence
  Description of Artificial Sequence: Synthetic oligonucleotide
cgaggccgggtctcgcaccct

SEQ ID NO: 35564 - DNA, 21 bp, Artificial Sequence
  Description of Artificial Sequence: Synthetic oligonucleotide
gaggccgggtctcgcaccctc

SEQ ID NO: 35565 - DNA, 22 bp, Artificial Sequence
  Description of Artificial Sequence: Synthetic oligonucleotide
aggccgggtctcgcaccctcca

SEQ ID NO: 35566 - DNA, 21 bp, Artificial Sequence
  Description of Artificial Sequence: Synthetic oligonucleotide
ggccgggtctcgcaccctcca

SEQ ID NO: 35567 - DNA, 22 bp, Artificial Sequence
  Description of Artificial Sequence: Synthetic oligonucleotide
gccgggtctcgcaccctccaga

SEQ ID NO: 35568 - DNA, 22 bp, Artificial Sequence
  Description of Artificial Sequence: Synthetic oligonucleotide
ccgggtctcgcaccctccagag

SEQ ID NO: 35569 - DNA, 24 bp, Artificial Sequence
  Description of Artificial Sequence: Synthetic oligonucleotide
cgggtctcgcaccctccagaggat

SEQ ID NO: 35570 - DNA, 26 bp, Artificial Sequence
  Description of Artificial Sequence: Synthetic oligonucleotide
gggtctcgcaccctccagaggatgta

SEQ ID NO: 35571 - DNA, 26 bp, Artificial Sequence
  Description of Artificial Sequence: Synthetic oligonucleotide
ggtctcgcaccctccagaggatgtac

SEQ ID NO: 35572 - DNA, 26 bp, Artificial Sequence
  Description of Artificial Sequence: Synthetic oligonucleotide
gtctcgcaccctccagaggatgtacg

SEQ ID NO: 35573 - DNA, 26 bp, Artificial Sequence
  Description of Artificial Sequence: Synthetic oligonucleotide
tctcgcaccctccagaggatgtacgg

SEQ ID NO: 35574 - DNA, 25 bp, Artificial Sequence
  Description of Artificial Sequence: Synthetic oligonucleotide
ctcgcaccctccagaggatgtacgg

SEQ ID NO: 35575 - DNA, 26 bp, Artificial Sequence
  Description of Artificial Sequence: Synthetic oligonucleotide
tcgcaccctccagaggatgtacggct

SEQ ID NO: 35576 - DNA, 25 bp, Artificial Sequence
  Description of Artificial Sequence: Synthetic oligonucleotide
cgcaccctccagaggatgtacggct

SEQ ID NO: 35577 - DNA, 25 bp, Artificial Sequence
  Description of Artificial Sequence: Synthetic oligonucleotide
gcaccctccagaggatgtacggctg

SEQ ID NO: 35578 - DNA, 26 bp, Artificial Sequence
  Description of Artificial Sequence: Synthetic oligonucleotide
cgcctcctccgcgggtataaccagta

SEQ ID NO: 35579 - DNA, 26 bp, Artificial Sequence
  Description of Artificial Sequence: Synthetic oligonucleotide
gcctcctccgcgggtataaccagtac

SEQ ID NO: 35580 - DNA, 26 bp, Artificial Sequence
  Description of Artificial Sequence: Synthetic oligonucleotide
cctcctccgcgggtataaccagtacg

SEQ ID NO: 35581 - DNA, 26 bp, Artificial Sequence
  Description of Artificial Sequence: Synthetic oligonucleotide
ctcctccgcgggtataaccagtacgc

SEQ ID NO: 35582 - DNA, 27 bp, Artificial Sequence
  Description of Artificial Sequence: Synthetic oligonucleotide
tcctccgcgggtataaccagtacgcct

SEQ ID NO: 35583 - DNA, 27 bp, Artificial Sequence
  Description of Artificial Sequence: Synthetic oligonucleotide
cctccgcgggtataaccagtacgccta

SEQ ID NO: 35584 - DNA, 27 bp, Artificial Sequence
  Description of Artificial Sequence: Synthetic oligonucleotide
ctccgcgggtataaccagtacgcctac

SEQ ID NO: 35585 - DNA, 27 bp, Artificial Sequence
  Description of Artificial Sequence: Synthetic oligonucleotide
tccgcgggtataaccagtacgcctacg

SEQ ID NO: 35586 - DNA, 27 bp, Artificial Sequence
  Description of Artificial Sequence: Synthetic oligonucleotide
ccgcgggtataaccagtacgcctacga

SEQ ID NO: 35587 - DNA, 27 bp, Artificial Sequence
  Description of Artificial Sequence: Synthetic oligonucleotide
cgcgggtataaccagtacgcctacgac

SEQ ID NO: 35588 - DNA, 27 bp, Artificial Sequence
  Description of Artificial Sequence: Synthetic oligonucleotide
gcgggtataaccagtacgcctacgacg

SEQ ID NO: 35589 - DNA, 27 bp, Artificial Sequence
  Description of Artificial Sequence: Synthetic oligonucleotide
cgggtataaccagtacgcctacgacgg

SEQ ID NO: 35590 - DNA, 27 bp, Artificial Sequence
  Description of Artificial Sequence: Synthetic oligonucleotide
gggtataaccagtacgcctacgacggc

SEQ ID NO: 35591 - DNA, 29 bp, Artificial Sequence
  Description of Artificial Sequence: Synthetic oligonucleotide
ggtataaccagtacgcctacgacggcaag

SEQ ID NO: 35592 - DNA, 29 bp, Artificial Sequence
  Description of Artificial Sequence: Synthetic oligonucleotide
gtataaccagtacgcctacgacggcaagg

SEQ ID NO: 35593 - DNA, 33 bp, Artificial Sequence
  Description of Artificial Sequence: Synthetic oligonucleotide
tataaccagtacgcctacgacggcaaggattac

SEQ ID NO: 35594 - DNA, 23 bp, Artificial Sequence
  Description of Artificial Sequence: Synthetic oligonucleotide
gtgtggcggagcagctgagagcc

SEQ ID NO: 35595 - DNA, 24 bp, Artificial Sequence
  Description of Artificial Sequence: Synthetic oligonucleotide
tgtggcggagcagctgagagccca

SEQ ID NO: 35596 - DNA, 23 bp, Artificial Sequence
  Description of Artificial Sequence: Synthetic oligonucleotide
gtggcggagcagctgagagccca

SEQ ID NO: 35597 - DNA, 23 bp, Artificial Sequence
  Description of Artificial Sequence: Synthetic oligonucleotide
tggcggagcagctgagagcccac

SEQ ID NO: 35598 - DNA, 22 bp, Artificial Sequence
  Description of Artificial Sequence: Synthetic oligonucleotide
ggcggagcagctgagagcccac

SEQ ID NO: 35599 - DNA, 23 bp, Artificial Sequence
  Description of Artificial Sequence: Synthetic oligonucleotide
gcggagcagctgagagcccacct

SEQ ID NO: 35600 - DNA, 23 bp, Artificial Sequence
  Description of Artificial Sequence: Synthetic oligonucleotide
cggagcagctgagagcccacctg

SEQ ID NO: 35601 - DNA, 24 bp, Artificial Sequence
  Description of Artificial Sequence: Synthetic oligonucleotide
ggagcagctgagagcccacctgga

SEQ ID NO: 35602 - DNA, 24 bp, Artificial Sequence
  Description of Artificial Sequence: Synthetic oligonucleotide
gagcagctgagagcccacctggag

SEQ ID NO: 35603 - DNA, 24 bp, Artificial Sequence
  Description of Artificial Sequence: Synthetic oligonucleotide
agcagctgagagcccacctggagg

SEQ ID NO: 35604 - DNA, 23 bp, Artificial Sequence
  Description of Artificial Sequence: Synthetic oligonucleotide
gcagctgagagcccacctggagg

SEQ ID NO: 35605 - DNA, 23 bp, Artificial Sequence
  Description of Artificial Sequence: Synthetic oligonucleotide
cagctgagagcccacctggaggg

SEQ ID NO: 35606 - DNA, 23 bp, Artificial Sequence
  Description of Artificial Sequence: Synthetic oligonucleotide
agctgagagcccacctggagggc

SEQ ID NO: 35607 - DNA, 22 bp, Artificial Sequence
  Description of Artificial Sequence: Synthetic oligonucleotide
gctgagagcccacctggagggc

SEQ ID NO: 35608 - DNA, 23 bp, Artificial Sequence
  Description of Artificial Sequence: Synthetic oligonucleotide
ctgagagcccacctggagggcga

SEQ ID NO: 35609 - DNA, 24 bp, Artificial Sequence
  Description of Artificial Sequence: Synthetic oligonucleotide
tgagagcccacctggagggcgagt

SEQ ID NO: 35610 - DNA, 23 bp, Artificial Sequence
  Description of Artificial Sequence: Synthetic oligonucleotide
gagagcccacctggagggcgagt

SEQ ID NO: 35611 - DNA, 23 bp, Artificial Sequence
  Description of Artificial Sequence: Synthetic oligonucleotide
agagcccacctggagggcgagtg

SEQ ID NO: 35612 - DNA, 22 bp, Artificial Sequence
  Description of Artificial Sequence: Synthetic oligonucleotide
gagcccacctggagggcgagtg

SEQ ID NO: 35613 - DNA, 22 bp, Artificial Sequence
  Description of Artificial Sequence: Synthetic oligonucleotide
agcccacctggagggcgagtgc

SEQ ID NO: 35614 - DNA, 21 bp, Artificial Sequence
  Description of Artificial Sequence: Synthetic oligonucleotide
gcccacctggagggcgagtgc

SEQ ID NO: 35615 - DNA, 22 bp, Artificial Sequence
  Description of Artificial Sequence: Synthetic oligonucleotide
cccacctggagggcgagtgcgt

SEQ ID NO: 35616 - DNA, 25 bp, Artificial Sequence
  Description of Artificial Sequence: Synthetic oligonucleotide
acacggcggctcagatcacccagct

SEQ ID NO: 35617 - DNA, 24 bp, Artificial Sequence
  Description of Artificial Sequence: Synthetic oligonucleotide
cacggcggctcagatcacccagct

SEQ ID NO: 35618 - DNA, 26 bp, Artificial Sequence
  Description of Artificial Sequence: Synthetic oligonucleotide
acggcggctcagatcacccagctcaa

SEQ ID NO: 35619 - DNA, 25 bp, Artificial Sequence
  Description of Artificial Sequence: Synthetic oligonucleotide
cggcggctcagatcacccagctcaa

SEQ ID NO: 35620 - DNA, 26 bp, Artificial Sequence
  Description of Artificial Sequence: Synthetic oligonucleotide
ggcggctcagatcacccagctcaagt

SEQ ID NO: 35621 - DNA, 25 bp, Artificial Sequence
  Description of Artificial Sequence: Synthetic oligonucleotide
ttcgtgcggttcgacagcgacgcca

SEQ ID NO: 35622 - DNA, 24 bp, Artificial Sequence
  Description of Artificial Sequence: Synthetic oligonucleotide
tcgtgcggttcgacagcgacgcca

SEQ ID NO: 35623 - DNA, 23 bp, Artificial Sequence
  Description of Artificial Sequence: Synthetic oligonucleotide
cgtgcggttcgacagcgacgcca

SEQ ID NO: 35624 - DNA, 23 bp, Artificial Sequence
  Description of Artificial Sequence: Synthetic oligonucleotide
gtgcggttcgacagcgacgccac

SEQ ID NO: 35625 - DNA, 24 bp, Artificial Sequence
  Description of Artificial Sequence: Synthetic oligonucleotide
tgcggttcgacagcgacgccacga

SEQ ID NO: 35626 - DNA, 23 bp, Artificial Sequence
  Description of Artificial Sequence: Synthetic oligonucleotide
gcggttcgacagcgacgccacga

SEQ ID NO: 35627 - DNA, 24 bp, Artificial Sequence
  Description of Artificial Sequence: Synthetic oligonucleotide
cggttcgacagcgacgccacgagt

SEQ ID NO: 35628 - DNA, 30 bp, Artificial Sequence
  Description of Artificial Sequence: Synthetic oligonucleotide
gcgaggaccaaactcaggacactgagtttg

SEQ ID NO: 35629 - DNA, 31 bp, Artificial Sequence
  Description of Artificial Sequence: Synthetic oligonucleotide
cgaggaccaaactcaggacactgagtttgtg

SEQ ID NO: 35630 - DNA, 31 bp, Artificial Sequence
  Description of Artificial Sequence: Synthetic oligonucleotide
gaggaccaaactcaggacactgagtttgtgg

SEQ ID NO: 35631 - DNA, 32 bp, Artificial Sequence
  Description of Artificial Sequence: Synthetic oligonucleotide
aggaccaaactcaggacactgagtttgtggag

SEQ ID NO: 35632 - DNA, 31 bp, Artificial Sequence
  Description of Artificial Sequence: Synthetic oligonucleotide
ggaccaaactcaggacactgagtttgtggag

SEQ ID NO: 35633 - DNA, 32 bp, Artificial Sequence
  Description of Artificial Sequence: Synthetic oligonucleotide
gaccaaactcaggacactgagtttgtggagac

SEQ ID NO: 35634 - DNA, 32 bp, Artificial Sequence
  Description of Artificial Sequence: Synthetic oligonucleotide
accaaactcaggacactgagtttgtggagacc

SEQ ID NO: 35635 - DNA, 31 bp, Artificial Sequence
  Description of Artificial Sequence: Synthetic oligonucleotide
ccaaactcaggacactgagtttgtggagacc

SEQ ID NO: 35636 - DNA, 32 bp, Artificial Sequence
  Description of Artificial Sequence: Synthetic oligonucleotide
caaactcaggacactgagtttgtggagaccag

SEQ ID NO: 35637 - DNA, 33 bp, Artificial Sequence
  Description of Artificial Sequence: Synthetic oligonucleotide
aaactcaggacactgagtttgtggagaccagac

SEQ ID NO: 35638 - DNA, 32 bp, Artificial Sequence
  Description of Artificial Sequence: Synthetic oligonucleotide
aactcaggacactgagtttgtggagaccagac

SEQ ID NO: 35639 - DNA, 31 bp, Artificial Sequence
  Description of Artificial Sequence: Synthetic oligonucleotide
actcaggacactgagtttgtggagaccagac

SEQ ID NO: 35640 - DNA, 30 bp, Artificial Sequence
  Description of Artificial Sequence: Synthetic oligonucleotide
ctcaggacactgagtttgtggagaccagac

SEQ ID NO: 35641 - DNA, 30 bp, Artificial Sequence
  Description of Artificial Sequence: Synthetic oligonucleotide
tcaggacactgagtttgtggagaccagacc

SEQ ID NO: 35642 - DNA, 29 bp, Artificial Sequence
  Description of Artificial Sequence: Synthetic oligonucleotide
caggacactgagtttgtggagaccagacc

SEQ ID NO: 35643 - DNA, 30 bp, Artificial Sequence
  Description of Artificial Sequence: Synthetic oligonucleotide
aggacactgagtttgtggagaccagaccag

SEQ ID NO: 35644 - DNA, 29 bp, Artificial Sequence
  Description of Artificial Sequence: Synthetic oligonucleotide
ggacactgagtttgtggagaccagaccag

SEQ ID NO: 35645 - DNA, 29 bp, Artificial Sequence
  Description of Artificial Sequence: Synthetic oligonucleotide
gacactgagtttgtggagaccagaccagc

SEQ ID NO: 35646 - DNA, 30 bp, Artificial Sequence
  Description of Artificial Sequence: Synthetic oligonucleotide
acactgagtttgtggagaccagaccagcag

SEQ ID NO: 35647 - DNA, 29 bp, Artificial Sequence
  Description of Artificial Sequence: Synthetic oligonucleotide
cactgagtttgtggagaccagaccagcag

SEQ ID NO: 35648 - DNA, 29 bp, Artificial Sequence
  Description of Artificial Sequence: Synthetic oligonucleotide
actgagtttgtggagaccagaccagcagg

SEQ ID NO: 35649 - DNA, 28 bp, Artificial Sequence
  Description of Artificial Sequence: Synthetic oligonucleotide
ctgagtttgtggagaccagaccagcagg

SEQ ID NO: 35650 - DNA, 29 bp, Artificial Sequence
  Description of Artificial Sequence: Synthetic oligonucleotide
tgagtttgtggagaccagaccagcaggag

SEQ ID NO: 35651 - DNA, 28 bp, Artificial Sequence
  Description of Artificial Sequence: Synthetic oligonucleotide
gagtttgtggagaccagaccagcaggag

SEQ ID NO: 35652 - DNA, 31 bp, Artificial Sequence
  Description of Artificial Sequence: Synthetic oligonucleotide
agtttgtggagaccagaccagcaggagatag

SEQ ID NO: 35653 - DNA, 30 bp, Artificial Sequence
  Description of Artificial Sequence: Synthetic oligonucleotide
gtttgtggagaccagaccagcaggagatag

SEQ ID NO: 35654 - DNA, 32 bp, Artificial Sequence
  Description of Artificial Sequence: Synthetic oligonucleotide
tttgtggagaccagaccagcaggagatagaac

SEQ ID NO: 35655 - DNA, 25 bp, Artificial Sequence
  Description of Artificial Sequence: Synthetic oligonucleotide
tccaccgtccccatcgtgggcattg

SEQ ID NO: 35656 - DNA, 28 bp, Artificial Sequence
  Description of Artificial Sequence: Synthetic oligonucleotide
acttggcagaggatgtatggctgcgacg

SEQ ID NO: 35657 - DNA, 27 bp, Artificial Sequence
  Description of Artificial Sequence: Synthetic oligonucleotide
cttggcagaggatgtatggctgcgacg

SEQ ID NO: 35658 - DNA, 28 bp, Artificial Sequence
  Description of Artificial Sequence: Synthetic oligonucleotide
ttggcagaggatgtatggctgcgacgtg

SEQ ID NO: 35659 - DNA, 27 bp, Artificial Sequence
  Description of Artificial Sequence: Synthetic oligonucleotide
tggcagaggatgtatggctgcgacgtg

SEQ ID NO: 35660 - DNA, 26 bp, Artificial Sequence
  Description of Artificial Sequence: Synthetic oligonucleotide
ggcagaggatgtatggctgcgacgtg

SEQ ID NO: 35661 - DNA, 26 bp, Artificial Sequence
  Description of Artificial Sequence: Synthetic oligonucleotide
gcagaggatgtatggctgcgacgtgg

SEQ ID NO: 35662 - DNA, 22 bp, Artificial Sequence
  Description of Artificial Sequence: Synthetic oligonucleotide
tccgaggaaggagccgcgggct

SEQ ID NO: 35663 - DNA, 21 bp, Artificial Sequence
  Description of Artificial Sequence: Synthetic oligonucleotide
ccgaggaaggagccgcgggct

SEQ ID NO: 35664 - DNA, 21 bp, Artificial Sequence
  Description of Artificial Sequence: Synthetic oligonucleotide
cgaggaaggagccgcgggctc

SEQ ID NO: 35665 - DNA, 23 bp, Artificial Sequence
  Description of Artificial Sequence: Synthetic oligonucleotide
gaggaaggagccgcgggctccat

SEQ ID NO: 35666 - DNA, 23 bp, Artificial Sequence
  Description of Artificial Sequence: Synthetic oligonucleotide
aggaaggagccgcgggctccatg

SEQ ID NO: 35667 - DNA, 22 bp, Artificial Sequence
  Description of Artificial Sequence: Synthetic oligonucleotide
ggaaggagccgcgggctccatg

SEQ ID NO: 35668 - DNA, 25 bp, Artificial Sequence
  Description of Artificial Sequence: Synthetic oligonucleotide
gaaggagccgcgggctccatggata

SEQ ID NO: 35669 - DNA, 26 bp, Artificial Sequence
  Description of Artificial Sequence: Synthetic oligonucleotide
aaggagccgcgggctccatggataga

SEQ ID NO: 35670 - DNA, 25 bp, Artificial Sequence
  Description of Artificial Sequence: Synthetic oligonucleotide
aggagccgcgggctccatggataga

SEQ ID NO: 35671 - DNA, 24 bp, Artificial Sequence
  Description of Artificial Sequence: Synthetic oligonucleotide
ggagccgcgggctccatggataga

SEQ ID NO: 35672 - DNA, 24 bp, Artificial Sequence
  Description of Artificial Sequence: Synthetic oligonucleotide
gagccgcgggctccatggatagag

SEQ ID NO: 35673 - DNA, 25 bp, Artificial Sequence
  Description of Artificial Sequence: Synthetic oligonucleotide
agccgcgggctccatggatagagca

SEQ ID NO: 35674 - DNA, 24 bp, Artificial Sequence
  Description of Artificial Sequence: Synthetic oligonucleotide
gccgcgggctccatggatagagca

SEQ ID NO: 35675 - DNA, 24 bp, Artificial Sequence
  Description of Artificial Sequence: Synthetic oligonucleotide
ccgcgggctccatggatagagcag

SEQ ID NO: 35676 - DNA, 25 bp, Artificial Sequence
  Description of Artificial Sequence: Synthetic oligonucleotide
cgcgggctccatggatagagcagga

SEQ ID NO: 35677 - DNA, 25 bp, Artificial Sequence
  Description of Artificial Sequence: Synthetic oligonucleotide
gcgggctccatggatagagcaggag

SEQ ID NO: 35678 - DNA, 25 bp, Artificial Sequence
  Description of Artificial Sequence: Synthetic oligonucleotide
cgggctccatggatagagcaggagg

SEQ ID NO: 35679 - DNA, 25 bp, Artificial Sequence
  Description of Artificial Sequence: Synthetic oligonucleotide
gggctccatggatagagcaggaggg

SEQ ID NO: 35680 - DNA, 25 bp, Artificial Sequence
  Description of Artificial Sequence: Synthetic oligonucleotide
ggctccatggatagagcaggagggg

SEQ ID NO: 35681 - DNA, 25 bp, Artificial Sequence
  Description of Artificial Sequence: Synthetic oligonucleotide
gctccatggatagagcaggaggggc

SEQ ID NO: 35682 - DNA, 25 bp, Artificial Sequence
  Description of Artificial Sequence: Synthetic oligonucleotide
ctccatggatagagcaggaggggcc

SEQ ID NO: 35683 - DNA, 25 bp, Artificial Sequence
  Description of Artificial Sequence: Synthetic oligonucleotide
tccatggatagagcaggaggggccg

SEQ ID NO: 35684 - DNA, 23 bp, Artificial Sequence
  Description of Artificial Sequence: Synthetic oligonucleotide
ccgcggagagccccgcttcatca

SEQ ID NO: 35685 - DNA, 23 bp, Artificial Sequence
  Description of Artificial Sequence: Synthetic oligonucleotide
cgcggagagccccgcttcatcac

SEQ ID NO: 35686 - DNA, 23 bp, Artificial Sequence
  Description of Artificial Sequence: Synthetic oligonucleotide
gcggagagccccgcttcatcacc

SEQ ID NO: 35687 - DNA, 24 bp, Artificial Sequence
  Description of Artificial Sequence: Synthetic oligonucleotide
cggagagccccgcttcatcaccgt

SEQ ID NO: 35688 - DNA, 24 bp, Artificial Sequence
  Description of Artificial Sequence: Synthetic oligonucleotide
ggagagccccgcttcatcaccgtg

SEQ ID NO: 35689 - DNA, 24 bp, Artificial Sequence
  Description of Artificial Sequence: Synthetic oligonucleotide
gagagccccgcttcatcaccgtgg

SEQ ID NO: 35690 - DNA, 24 bp, Artificial Sequence
  Description of Artificial Sequence: Synthetic oligonucleotide
agagccccgcttcatcaccgtggg

SEQ ID NO: 35691 - DNA, 28 bp, Artificial Sequence
  Description of Artificial Sequence: Synthetic oligonucleotide
acagacttaccgagagagcctgcggaag

SEQ ID NO: 35692 - DNA, 27 bp, Artificial Sequence
  Description of Artificial Sequence: Synthetic oligonucleotide
cagacttaccgagagagcctgcggaag

SEQ ID NO: 35693 - DNA, 27 bp, Artificial Sequence
  Description of Artificial Sequence: Synthetic oligonucleotide
agacttaccgagagagcctgcggaagc

SEQ ID NO: 35694 - DNA, 27 bp, Artificial Sequence
  Description of Artificial Sequence: Synthetic oligonucleotide
gacttaccgagagagcctgcggaagct

SEQ ID NO: 35695 - DNA, 27 bp, Artificial Sequence
  Description of Artificial Sequence: Synthetic oligonucleotide
acttaccgagagagcctgcggaagctg

SEQ ID NO: 35696 - DNA, 26 bp, Artificial Sequence
  Description of Artificial Sequence: Synthetic oligonucleotide
cttaccgagagagcctgcggaagctg

SEQ ID NO: 35697 - DNA, 26 bp, Artificial Sequence
  Description of Artificial Sequence: Synthetic oligonucleotide
ttaccgagagagcctgcggaagctgc

SEQ ID NO: 35698 - DNA, 25 bp, Artificial Sequence
  Description of Artificial Sequence: Synthetic oligonucleotide
taccgagagagcctgcggaagctgc

SEQ ID NO: 35699 - DNA, 24 bp, Artificial Sequence
  Description of Artificial Sequence: Synthetic oligonucleotide
accgagagagcctgcggaagctgc

SEQ ID NO: 35700 - DNA, 23 bp, Artificial Sequence
  Description of Artificial Sequence: Synthetic oligonucleotide
ccgagagagcctgcggaagctgc

SEQ ID NO: 35701 - DNA, 23 bp, Artificial Sequence
  Description of Artificial Sequence: Synthetic oligonucleotide
cgagagagcctgcggaagctgcg

SEQ ID NO: 35702 - DNA, 23 bp, Artificial Sequence
  Description of Artificial Sequence: Synthetic oligonucleotide
gagagagcctgcggaagctgcgc

SEQ ID NO: 35703 - DNA, 23 bp, Artificial Sequence
  Description of Artificial Sequence: Synthetic oligonucleotide
agagagcctgcggaagctgcgcg

SEQ ID NO: 35704 - DNA, 22 bp, Artificial Sequence
  Description of Artificial Sequence: Synthetic oligonucleotide
gagagcctgcggaagctgcgcg

SEQ ID NO: 35705 - DNA, 22 bp, Artificial Sequence
  Description of Artificial Sequence: Synthetic oligonucleotide
agagcctgcggaagctgcgcgg

SEQ ID NO: 35706 - DNA, 21 bp, Artificial Sequence
  Description of Artificial Sequence: Synthetic oligonucleotide
gagcctgcggaagctgcgcgg

SEQ ID NO: 35707 - DNA, 23 bp, Artificial Sequence
  Description of Artificial Sequence: Synthetic oligonucleotide
agcctgcggaagctgcgcggcta

SEQ ID NO: 35708 - DNA, 22 bp, Artificial Sequence
  Description of Artificial Sequence: Synthetic oligonucleotide
gcctgcggaagctgcgcggcta

SEQ ID NO: 35709 - DNA, 24 bp, Artificial Sequence
  Description of Artificial Sequence: Synthetic oligonucleotide
cctgcggaagctgcgcggctacta

SEQ ID NO: 35710 - DNA, 26 bp, Artificial Sequence
  Description of Artificial Sequence: Synthetic oligonucleotide
ctgcggaagctgcgcggctactacaa

SEQ ID NO: 35711 - DNA, 26 bp, Artificial Sequence
  Description of Artificial Sequence: Synthetic oligonucleotide
tgcggaagctgcgcggctactacaac

SEQ ID NO: 35712 - DNA, 25 bp, Artificial Sequence
  Description of Artificial Sequence: Synthetic oligonucleotide
gcggaagctgcgcggctactacaac

SEQ ID NO: 35713 - DNA, 26 bp, Artificial Sequence
  Description of Artificial Sequence: Synthetic oligonucleotide
cggaagctgcgcggctactacaacca

SEQ ID NO: 35714 - DNA, 27 bp, Artificial Sequence
  Description of Artificial Sequence: Synthetic oligonucleotide
ggaagctgcgcggctactacaaccaga

SEQ ID NO: 35715 - DNA, 27 bp, Artificial Sequence
  Description of Artificial Sequence: Synthetic oligonucleotide
gaagctgcgcggctactacaaccagag

SEQ ID NO: 35716 - DNA, 27 bp, Artificial Sequence
  Description of Artificial Sequence: Synthetic oligonucleotide
aagctgcgcggctactacaaccagagc

SEQ ID NO: 35717 - DNA, 26 bp, Artificial Sequence
  Description of Artificial Sequence: Synthetic oligonucleotide
agctgcgcggctactacaaccagagc

SEQ ID NO: 35718 - DNA, 25 bp, Artificial Sequence
  Description of Artificial Sequence: Synthetic oligonucleotide
gctgcgcggctactacaaccagagc

SEQ ID NO: 35719 - DNA, 26 bp, Artificial Sequence
  Description of Artificial Sequence: Synthetic oligonucleotide
ctggagaacgggaaggacacgctgca

SEQ ID NO: 35720 - DNA, 26 bp, Artificial Sequence
  Description of Artificial Sequence: Synthetic oligonucleotide
tggagaacgggaaggacacgctgcag

SEQ ID NO: 35721 - DNA, 25 bp, Artificial Sequence
  Description of Artificial Sequence: Synthetic oligonucleotide
ggagaacgggaaggacacgctgcag

SEQ ID NO: 35722 - DNA, 25 bp, Artificial Sequence
  Description of Artificial Sequence: Synthetic oligonucleotide
gagaacgggaaggacacgctgcagc

SEQ ID NO: 35723 - DNA, 25 bp, Artificial Sequence
  Description of Artificial Sequence: Synthetic oligonucleotide
agaacgggaaggacacgctgcagcg

SEQ ID NO: 35724 - DNA, 24 bp, Artificial Sequence
  Description of Artificial Sequence: Synthetic oligonucleotide
gaacgggaaggacacgctgcagcg

SEQ ID NO: 35725 - DNA, 24 bp, Artificial Sequence
  Description of Artificial Sequence: Synthetic oligonucleotide
aacgggaaggacacgctgcagcgc

SEQ ID NO: 35726 - DNA, 23 bp, Artificial Sequence
  Description of Artificial Sequence: Synthetic oligonucleotide
acgggaaggacacgctgcagcgc

SEQ ID NO: 35727 - DNA, 22 bp, Artificial Sequence
  Description of Artificial Sequence: Synthetic oligonucleotide
cgggaaggacacgctgcagcgc

SEQ ID NO: 35728 - DNA, 22 bp, Artificial Sequence
  Description of Artificial Sequence: Synthetic oligonucleotide
gggaaggacacgctgcagcgcg

SEQ ID NO: 35729 - DNA, 22 bp, Artificial Sequence
  Description of Artificial Sequence: Synthetic oligonucleotide
ggaaggacacgctgcagcgcgc

SEQ ID NO: 35730 - DNA, 22 bp, Artificial Sequence
  Description of Artificial Sequence: Synthetic oligonucleotide
gaaggacacgctgcagcgcgcg

SEQ ID NO: 35731 - DNA, 22 bp, Artificial Sequence
  Description of Artificial Sequence: Synthetic oligonucleotide
aaggacacgctgcagcgcgcgg

SEQ ID NO: 35732 - DNA, 20 bp, Artificial Sequence
  Description of Artificial Sequence: Synthetic oligonucleotide
gacgggcgcctcctccgcga

SEQ ID NO: 35733 - DNA, 20 bp, Artificial Sequence
  Description of Artificial Sequence: Synthetic oligonucleotide
acgggcgcctcctccgcgag

SEQ ID NO: 35734 - DNA, 20 bp, Artificial Sequence
  Description of Artificial Sequence: Synthetic oligonucleotide
cgggcgcctcctccgcgagt

SEQ ID NO: 35735 - DNA, 23 bp, Artificial Sequence
  Description of Artificial Sequence: Synthetic oligonucleotide
gggcgcctcctccgcgagcataa

SEQ ID NO: 35736 - DNA, 23 bp, Artificial Sequence
  Description of Artificial Sequence: Synthetic oligonucleotide
ggcgcctcctccgcgagcataac

SEQ ID NO: 35737 - DNA, 24 bp, Artificial Sequence
  Description of Artificial Sequence: Synthetic oligonucleotide
gcgcctcctccgcgagcataacca

SEQ ID NO: 35738 - DNA, 26 bp, Artificial Sequence
  Description of Artificial Sequence: Synthetic oligonucleotide
cgcctcctccgcgagcataaccagta

SEQ ID NO: 35739 - DNA, 26 bp, Artificial Sequence
  Description of Artificial Sequence: Synthetic oligonucleotide
gcctcctccgcgagcataaccagtac

SEQ ID NO: 35740 - DNA, 26 bp, Artificial Sequence
  Description of Artificial Sequence: Synthetic oligonucleotide
cctcctccgcgagcataaccagtacg

SEQ ID NO: 35741 - DNA, 26 bp, Artificial Sequence
  Description of Artificial Sequence: Synthetic oligonucleotide
ctcctccgcgagcataaccagtacgc

SEQ ID NO: 35742 - DNA, 27 bp, Artificial Sequence
  Description of Artificial Sequence: Synthetic oligonucleotide
tcctccgcgagcataaccagtacgcct

SEQ ID NO: 35743 - DNA, 27 bp, Artificial Sequence
  Description of Artificial Sequence: Synthetic oligonucleotide
cctccgcgagcataaccagtacgccta

SEQ ID NO: 35744 - DNA, 27 bp, Artificial Sequence
  Description of Artificial Sequence: Synthetic oligonucleotide
ctccgcgagcataaccagtacgcctac

SEQ ID NO: 35745 - DNA, 27 bp, Artificial Sequence
  Description of Artificial Sequence: Synthetic oligonucleotide
tccgcgagcataaccagtacgcctacg

SEQ ID NO: 35746 - DNA, 27 bp, Artificial Sequence
  Description of Artificial Sequence: Synthetic oligonucleotide
ccgcgagcataaccagtacgcctacga

SEQ ID NO: 35747 - DNA, 27 bp, Artificial Sequence
  Description of Artificial Sequence: Synthetic oligonucleotide
cgcgagcataaccagtacgcctacgac

SEQ ID NO: 35748 - DNA, 27 bp, Artificial Sequence
  Description of Artificial Sequence: Synthetic oligonucleotide
gcgagcataaccagtacgcctacgacg

SEQ ID NO: 35749 - DNA, 27 bp, Artificial Sequence
  Description of Artificial Sequence: Synthetic oligonucleotide
cgagcataaccagtacgcctacgacgg

SEQ ID NO: 35750 - DNA, 27 bp, Artificial Sequence
  Description of Artificial Sequence: Synthetic oligonucleotide
gagcataaccagtacgcctacgacggc

SEQ ID NO: 35751 - DNA, 29 bp, Artificial Sequence
  Description of Artificial Sequence: Synthetic oligonucleotide
agcataaccagtacgcctacgacggcaag

SEQ ID NO: 35752 - DNA, 27 bp, Artificial Sequence
  Description of Artificial Sequence: Synthetic oligonucleotide
atcaccgtgggctacgtggactacacg

SEQ ID NO: 35753 - DNA, 26 bp, Artificial Sequence
  Description of Artificial Sequence: Synthetic oligonucleotide
tcaccgtgggctacgtggactacacg

SEQ ID NO: 35754 - DNA, 25 bp, Artificial Sequence
  Description of Artificial Sequence: Synthetic oligonucleotide
caccgtgggctacgtggactacacg

SEQ ID NO: 35755 - DNA, 26 bp, Artificial Sequence
  Description of Artificial Sequence: Synthetic oligonucleotide
accgtgggctacgtggactacacgct

SEQ ID NO: 35756 - DNA, 25 bp, Artificial Sequence
  Description of Artificial Sequence: Synthetic oligonucleotide
ccgtgggctacgtggactacacgct

SEQ ID NO: 35757 - DNA, 27 bp, Artificial Sequence
  Description of Artificial Sequence: Synthetic oligonucleotide
cgtgggctacgtggactacacgctgtt

SEQ ID NO: 35758 - DNA, 27 bp, Artificial Sequence
  Description of Artificial Sequence: Synthetic oligonucleotide
gtgggctacgtggactacacgctgttc

SEQ ID NO: 35759 - DNA, 27 bp, Artificial Sequence
  Description of Artificial Sequence: Synthetic oligonucleotide
tgggctacgtggactacacgctgttcg

SEQ ID NO: 35760 - DNA, 27 bp, Artificial Sequence
  Description of Artificial Sequence: Synthetic oligonucleotide
gggctacgtggactacacgctgttcgt

SEQ ID NO: 35761 - DNA, 27 bp, Artificial Sequence
  Description of Artificial Sequence: Synthetic oligonucleotide
ggctacgtggactacacgctgttcgtg

SEQ ID NO: 35762 - DNA, 28 bp, Artificial Sequence
  Description of Artificial Sequence: Synthetic oligonucleotide
gctacgtggactacacgctgttcgtgag

SEQ ID NO: 35763 - DNA, 28 bp, Artificial Sequence
  Description of Artificial Sequence: Synthetic oligonucleotide
ctacgtggactacacgctgttcgtgagg

SEQ ID NO: 35764 - DNA, 30 bp, Artificial Sequence
  Description of Artificial Sequence: Synthetic oligonucleotide
tacgtggactacacgctgttcgtgaggttc

SEQ ID NO: 35765 - DNA, 29 bp, Artificial Sequence
  Description of Artificial Sequence: Synthetic oligonucleotide
acgtggactacacgctgttcgtgaggttc

SEQ ID NO: 35766 - DNA, 28 bp, Artificial Sequence
  Description of Artificial Sequence: Synthetic oligonucleotide
cgtggactacacgctgttcgtgaggttc

SEQ ID NO: 35767 - DNA, 28 bp, Artificial Sequence
  Description of Artificial Sequence: Synthetic oligonucleotide
gtggactacacgctgttcgtgaggttcg

SEQ ID NO: 35768 - DNA, 29 bp, Artificial Sequence
  Description of Artificial Sequence: Synthetic oligonucleotide
tggactacacgctgttcgtgaggttcgac

SEQ ID NO: 35769 - DNA, 28 bp, Artificial Sequence
  Description of Artificial Sequence: Synthetic oligonucleotide
ggactacacgctgttcgtgaggttcgac

SEQ ID NO: 35770 - DNA, 29 bp, Artificial Sequence
  Description of Artificial Sequence: Synthetic oligonucleotide
gactacacgctgttcgtgaggttcgacag

SEQ ID NO: 35771 - DNA, 29 bp, Artificial Sequence
  Description of Artificial Sequence: Synthetic oligonucleotide
actacacgctgttcgtgaggttcgacagc

SEQ ID NO: 35772 - DNA, 28 bp, Artificial Sequence
  Description of Artificial Sequence: Synthetic oligonucleotide
ctacacgctgttcgtgaggttcgacagc

SEQ ID NO: 35773 - DNA, 28 bp, Artificial Sequence
  Description of Artificial Sequence: Synthetic oligonucleotide
tacacgctgttcgtgaggttcgacagcg

SEQ ID NO: 35774 - DNA, 21 bp, Artificial Sequence
  Description of Artificial Sequence: Synthetic oligonucleotide
tggaccgcggcggacaccgca

SEQ ID NO: 35775 - DNA, 20 bp, Artificial Sequence
  Description of Artificial Sequence: Synthetic oligonucleotide
ggaccgcggcggacaccgca

SEQ ID NO: 35776 - DNA, 20 bp, Artificial Sequence
  Description of Artificial Sequence: Synthetic oligonucleotide
gaccgcggcggacaccgcag

SEQ ID NO: 35777 - DNA, 21 bp, Artificial Sequence
  Description of Artificial Sequence: Synthetic oligonucleotide
accgcggcggacaccgcagct

SEQ ID NO: 35778 - DNA, 20 bp, Artificial Sequence
  Description of Artificial Sequence: Synthetic oligonucleotide
ccgcggcggacaccgcagct

SEQ ID NO: 35779 - DNA, 21 bp, Artificial Sequence
  Description of Artificial Sequence: Synthetic oligonucleotide
cgcggcggacaccgcagctca

SEQ ID NO: 35780 - DNA, 23 bp, Artificial Sequence
  Description of Artificial Sequence: Synthetic oligonucleotide
gcggcggacaccgcagctcagat

SEQ ID NO: 35781 - DNA, 24 bp, Artificial Sequence
  Description of Artificial Sequence: Synthetic oligonucleotide
cggcggacaccgcagctcagatca

SEQ ID NO: 35782 - DNA, 24 bp, Artificial Sequence
  Description of Artificial Sequence: Synthetic oligonucleotide
ggcggacaccgcagctcagatcac

SEQ ID NO: 35783 - DNA, 24 bp, Artificial Sequence
  Description of Artificial Sequence: Synthetic oligonucleotide
gcggacaccgcagctcagatcacc

SEQ ID NO: 35784 - DNA, 25 bp, Artificial Sequence
  Description of Artificial Sequence: Synthetic oligonucleotide
cggacaccgcagctcagatcaccca

SEQ ID NO: 35785 - DNA, 25 bp, Artificial Sequence
  Description of Artificial Sequence: Synthetic oligonucleotide
ggacaccgcagctcagatcacccag

SEQ ID NO: 35786 - DNA, 25 bp, Artificial Sequence
  Description of Artificial Sequence: Synthetic oligonucleotide
gacaccgcagctcagatcacccagc

SEQ ID NO: 35787 - DNA, 25 bp, Artificial Sequence
  Description of Artificial Sequence: Synthetic oligonucleotide
acaccgcagctcagatcacccagcg

SEQ ID NO: 35788 - DNA, 24 bp, Artificial Sequence
  Description of Artificial Sequence: Synthetic oligonucleotide
caccgcagctcagatcacccagcg

SEQ ID NO: 35789 - DNA, 26 bp, Artificial Sequence
  Description of Artificial Sequence: Synthetic oligonucleotide
accgcagctcagatcacccagcgcaa

SEQ ID NO: 35790 - DNA, 25 bp, Artificial Sequence
  Description of Artificial Sequence: Synthetic oligonucleotide
ccgcagctcagatcacccagcgcaa

SEQ ID NO: 35791 - DNA, 26 bp, Artificial Sequence
  Description of Artificial Sequence: Synthetic oligonucleotide
cgcagctcagatcacccagcgcaagt

SEQ ID NO: 35792 - DNA, 23 bp, Artificial Sequence
  Description of Artificial Sequence: Synthetic oligonucleotide
agcctacctggagggcacgtgcg

SEQ ID NO: 35793 - DNA, 22 bp, Artificial Sequence
  Description of Artificial Sequence: Synthetic oligonucleotide
gcctacctggagggcacgtgcg

SEQ ID NO: 35794 - DNA, 22 bp, Artificial Sequence
  Description of Artificial Sequence: Synthetic oligonucleotide
cctacctggagggcacgtgcgg

SEQ ID NO: 35795 - DNA, 22 bp, Artificial Sequence
  Description of Artificial Sequence: Synthetic oligonucleotide
ctacctggagggcacgtgcggg

SEQ ID NO: 35796 - DNA, 23 bp, Artificial Sequence
  Description of Artificial Sequence: Synthetic oligonucleotide
tacctggagggcacgtgcgggga

SEQ ID NO: 35797 - DNA, 22 bp, Artificial Sequence
  Description of Artificial Sequence: Synthetic oligonucleotide
acctggagggcacgtgcgggga

SEQ ID NO: 35798 - DNA, 21 bp, Artificial Sequence
  Description of Artificial Sequence: Synthetic oligonucleotide
cctggagggcacgtgcgggga

SEQ ID NO: 35799 - DNA, 22 bp, Artificial Sequence
  Description of Artificial Sequence: Synthetic oligonucleotide
ctggagggcacgtgcggggagt

SEQ ID NO: 35800 - DNA, 22 bp, Artificial Sequence
  Description of Artificial Sequence: Synthetic oligonucleotide
tggagggcacgtgcggggagtg

SEQ ID NO: 35801 - DNA, 21 bp, Artificial Sequence
  Description of Artificial Sequence: Synthetic oligonucleotide
ggagggcacgtgcggggagtg

SEQ ID NO: 35802 - DNA, 21 bp, Artificial Sequence
  Description of Artificial Sequence: Synthetic oligonucleotide
gagggcacgtgcggggagtgg

SEQ ID NO: 35803 - DNA, 22 bp, Artificial Sequence
  Description of Artificial Sequence: Synthetic oligonucleotide
agggcacgtgcggggagtggct

SEQ ID NO: 35804 - DNA, 21 bp, Artificial Sequence
  Description of Artificial Sequence: Synthetic oligonucleotide
gggcacgtgcggggagtggct

SEQ ID NO: 35805 - DNA, 21 bp, Artificial Sequence
  Description of Artificial Sequence: Synthetic oligonucleotide
ggcacgtgcggggagtggctc

SEQ ID NO: 35806 - DNA, 21 bp, Artificial Sequence
  Description of Artificial Sequence: Synthetic oligonucleotide
gcacgtgcggggagtggctcc

SEQ ID NO: 35807 - DNA, 21 bp, Artificial Sequence
  Description of Artificial Sequence: Synthetic oligonucleotide
cacgtgcggggagtggctccg

SEQ ID NO: 35808 - DNA, 22 bp, Artificial Sequence
  Description of Artificial Sequence: Synthetic oligonucleotide
acgtgcggggagtggctccgca

SEQ ID NO: 35809 - DNA, 21 bp, Artificial Sequence
  Description of Artificial Sequence: Synthetic oligonucleotide
cgtgcggggagtggctccgca

SEQ ID NO: 35810 - DNA, 24 bp, Artificial Sequence
  Description of Artificial Sequence: Synthetic oligonucleotide
gtgcggggagtggctccgcagata

SEQ ID NO: 35811 - DNA, 24 bp, Artificial Sequence
  Description of Artificial Sequence: Synthetic oligonucleotide
tgcggggagtggctccgcagatac

SEQ ID NO: 35812 - DNA, 23 bp, Artificial Sequence
  Description of Artificial Sequence: Synthetic oligonucleotide
gcggggagtggctccgcagatac

SEQ ID NO: 35813 - DNA, 24 bp, Artificial Sequence
  Description of Artificial Sequence: Synthetic oligonucleotide
cggggagtggctccgcagatacct

SEQ ID NO: 35814 - DNA, 24 bp, Artificial Sequence
  Description of Artificial Sequence: Synthetic oligonucleotide
ggggagtggctccgcagatacctg

SEQ ID NO: 35815 - DNA, 25 bp, Artificial Sequence
  Description of Artificial Sequence: Synthetic oligonucleotide
gggagtggctccgcagatacctgga

SEQ ID NO: 35816 - DNA, 25 bp, Artificial Sequence
  Description of Artificial Sequence: Synthetic oligonucleotide
gaagcccctcaccctgagatggggt

SEQ ID NO: 35817 - DNA, 25 bp, Artificial Sequence
  Description of Artificial Sequence: Synthetic oligonucleotide
aagcccctcaccctgagatggggtg

SEQ ID NO: 35818 - DNA, 24 bp, Artificial Sequence
  Description of Artificial Sequence: Synthetic oligonucleotide
agcccctcaccctgagatggggtg

SEQ ID NO: 35819 - DNA, 23 bp, Artificial Sequence
  Description of Artificial Sequence: Synthetic oligonucleotide
gcccctcaccctgagatggggtg

SEQ ID NO: 35820 - DNA, 27 bp, Artificial Sequence
  Description of Artificial Sequence: Synthetic oligonucleotide
cccctcaccctgagatggggtggaaaa

SEQ ID NO: 35821 - DNA, 27 bp, Artificial Sequence
  Description of Artificial Sequence: Synthetic oligonucleotide
ccctcaccctgagatggggtggaaaag

SEQ ID NO: 35822 - DNA, 27 bp, Artificial Sequence
  Description of Artificial Sequence: Synthetic oligonucleotide
cctcaccctgagatggggtggaaaagg

SEQ ID NO: 35823 - DNA, 28 bp, Artificial Sequence
  Description of Artificial Sequence: Synthetic oligonucleotide
ctcaccctgagatggggtggaaaaggag

SEQ ID NO: 35824 - DNA, 28 bp, Artificial Sequence
  Description of Artificial Sequence: Synthetic oligonucleotide
tcaccctgagatggggtggaaaaggagg

SEQ ID NO: 35825 - DNA, 27 bp, Artificial Sequence
  Description of Artificial Sequence: Synthetic oligonucleotide
caccctgagatggggtggaaaaggagg

SEQ ID NO: 35826 - DNA, 27 bp, Artificial Sequence
  Description of Artificial Sequence: Synthetic oligonucleotide
accctgagatggggtggaaaaggaggg

SEQ ID NO: 35827 - DNA, 27 bp, Artificial Sequence
  Description of Artificial Sequence: Synthetic oligonucleotide
ccctgagatggggtggaaaaggaggga

SEQ ID NO: 35828 - DNA, 27 bp, Artificial Sequence
  Description of Artificial Sequence: Synthetic oligonucleotide
cctgagatggggtggaaaaggagggag

SEQ ID NO: 35829 - DNA, 27 bp, Artificial Sequence
  Description of Artificial Sequence: Synthetic oligonucleotide
ctgagatggggtggaaaaggagggagc

SEQ ID NO: 35830 - DNA, 29 bp, Artificial Sequence
  Description of Artificial Sequence: Synthetic oligonucleotide
tgagatggggtggaaaaggagggagctac

SEQ ID NO: 35831 - DNA, 28 bp, Artificial Sequence
  Description of Artificial Sequence: Synthetic oligonucleotide
gagatggggtggaaaaggagggagctac

SEQ ID NO: 35832 - DNA, 29 bp, Artificial Sequence
  Description of Artificial Sequence: Synthetic oligonucleotide
agatggggtggaaaaggagggagctactc

SEQ ID NO: 35833 - DNA, 28 bp, Artificial Sequence
  Description of Artificial Sequence: Synthetic oligonucleotide
gatggggtggaaaaggagggagctactc

SEQ ID NO: 35834 - DNA, 29 bp, Artificial Sequence
  Description of Artificial Sequence: Synthetic oligonucleotide
atggggtggaaaaggagggagctactctc

SEQ ID NO: 35835 - DNA, 28 bp, Artificial Sequence
  Description of Artificial Sequence: Synthetic oligonucleotide
tggggtggaaaaggagggagctactctc

SEQ ID NO: 35836 - DNA, 27 bp, Artificial Sequence
  Description of Artificial Sequence: Synthetic oligonucleotide
ggggtggaaaaggagggagctactctc

SEQ ID NO: 35837 - DNA, 28 bp, Artificial Sequence
  Description of Artificial Sequence: Synthetic oligonucleotide
gggtggaaaaggagggagctactctcag

SEQ ID NO: 35838 - DNA, 33 bp, Artificial Sequence
  Description of Artificial Sequence: Synthetic oligonucleotide
tcgaagaccaacacacagacttaccgagagaac

SEQ ID NO: 35839 - DNA, 32 bp, Artificial Sequence
  Description of Artificial Sequence: Synthetic oligonucleotide
cgaagaccaacacacagacttaccgagagaac

SEQ ID NO: 35840 - DNA, 32 bp, Artificial Sequence
  Description of Artificial Sequence: Synthetic oligonucleotide
gaagaccaacacacagacttaccgagagaacc

SEQ ID NO: 35841 - DNA, 22 bp, Artificial Sequence
  Description of Artificial Sequence: Synthetic oligonucleotide
caagtgggaggcggcccgtgtc

SEQ ID NO: 35842 - DNA, 22 bp, Artificial Sequence
  Description of Artificial Sequence: Synthetic oligonucleotide
aagtgggaggcggcccgtgtcg

SEQ ID NO: 35843 - DNA, 21 bp, Artificial Sequence
  Description of Artificial Sequence: Synthetic oligonucleotide
agtgggaggcggcccgtgtcg

SEQ ID NO: 35844 - DNA, 20 bp, Artificial Sequence
  Description of Artificial Sequence: Synthetic oligonucleotide
gtgggaggcggcccgtgtcg

SEQ ID NO: 35845 - DNA, 20 bp, Artificial Sequence
  Description of Artificial Sequence: Synthetic oligonucleotide
tgggaggcggcccgtgtcgc

SEQ ID NO: 35846 - DNA, 20 bp, Artificial Sequence
  Description of Artificial Sequence: Synthetic oligonucleotide
gggaggcggcccgtgtcgct

SEQ ID NO: 35847 - DNA, 20 bp, Artificial Sequence
  Description of Artificial Sequence: Synthetic oligonucleotide
ggaggcggcccgtgtcgcgt

SEQ ID NO: 35848 - DNA, 20 bp, Artificial Sequence
  Description of Artificial Sequence: Synthetic oligonucleotide
gaggcggcccgtgtcgcgga

SEQ ID NO: 35849 - DNA, 20 bp, Artificial Sequence
  Description of Artificial Sequence: Synthetic oligonucleotide
aggcggcccgtgtcgcggag

SEQ ID NO: 35850 - DNA, 20 bp, Artificial Sequence
  Description of Artificial Sequence: Synthetic oligonucleotide
ggcggcccgtgtcgcggagt

SEQ ID NO: 35851 - DNA, 20 bp, Artificial Sequence
  Description of Artificial Sequence: Synthetic oligonucleotide
gcggcccgtgtcgcggagca

SEQ ID NO: 35852 - DNA, 20 bp, Artificial Sequence
  Description of Artificial Sequence: Synthetic oligonucleotide
cggcccgtgtcgcggagcag

SEQ ID NO: 35853 - DNA, 21 bp, Artificial Sequence
  Description of Artificial Sequence: Synthetic oligonucleotide
ggcccgtgtcgcggagcagga

SEQ ID NO: 35854 - DNA, 22 bp, Artificial Sequence
  Description of Artificial Sequence: Synthetic oligonucleotide
gcccgtgtcgcggagcaggaca

SEQ ID NO: 35855 - DNA, 23 bp, Artificial Sequence
  Description of Artificial Sequence: Synthetic oligonucleotide
cccgtgtcgcggagcaggacaga

SEQ ID NO: 35856 - DNA, 23 bp, Artificial Sequence
  Description of Artificial Sequence: Synthetic oligonucleotide
ccgtgtcgcggagcaggacagag

SEQ ID NO: 35857 - DNA, 23 bp, Artificial Sequence
  Description of Artificial Sequence: Synthetic oligonucleotide
cgtgtcgcggagcaggacagagc

SEQ ID NO: 35858 - DNA, 25 bp, Artificial Sequence
  Description of Artificial Sequence: Synthetic oligonucleotide
gtgtcgcggagcaggacagagccta

SEQ ID NO: 35859 - DNA, 25 bp, Artificial Sequence
  Description of Artificial Sequence: Synthetic oligonucleotide
tgtcgcggagcaggacagagcctac

SEQ ID NO: 35860 - DNA, 24 bp, Artificial Sequence
  Description of Artificial Sequence: Synthetic oligonucleotide
gtcgcggagcaggacagagcctac

SEQ ID NO: 35861 - DNA, 25 bp, Artificial Sequence
  Description of Artificial Sequence: Synthetic oligonucleotide
tcgcggagcaggacagagcctacct

SEQ ID NO: 35862 - DNA, 24 bp, Artificial Sequence
  Description of Artificial Sequence: Synthetic oligonucleotide
cgcggagcaggacagagcctacct

SEQ ID NO: 35863 - DNA, 22 bp, Artificial Sequence
  Description of Artificial Sequence: Synthetic oligonucleotide
ctcctggaccgcggcggacact

SEQ ID NO: 35864 - DNA, 22 bp, Artificial Sequence
  Description of Artificial Sequence: Synthetic oligonucleotide
tcctggaccgcggcggacactg

SEQ ID NO: 35865 - DNA, 21 bp, Artificial Sequence
  Description of Artificial Sequence: Synthetic oligonucleotide
cctggaccgcggcggacactg

SEQ ID NO: 35866 - DNA, 21 bp, Artificial Sequence
  Description of Artificial Sequence: Synthetic oligonucleotide
ctggaccgcggcggacactgc

SEQ ID NO: 35867 - DNA, 21 bp, Artificial Sequence
  Description of Artificial Sequence: Synthetic oligonucleotide
tggaccgcggcggacactgcg

SEQ ID NO: 35868 - DNA, 20 bp, Artificial Sequence
  Description of Artificial Sequence: Synthetic oligonucleotide
ggaccgcggcggacactgcg

SEQ ID NO: 35869 - DNA, 20 bp, Artificial Sequence
  Description of Artificial Sequence: Synthetic oligonucleotide
gaccgcggcggacactgcgg

SEQ ID NO: 35870 - DNA, 21 bp, Artificial Sequence
  Description of Artificial Sequence: Synthetic oligonucleotide
accgcggcggacactgcggct

SEQ ID NO: 35871 - DNA, 20 bp, Artificial Sequence
  Description of Artificial Sequence: Synthetic oligonucleotide
ccgcggcggacactgcggct

SEQ ID NO: 35872 - DNA, 21 bp, Artificial Sequence
  Description of Artificial Sequence: Synthetic oligonucleotide
cgcggcggacactgcggctca

SEQ ID NO: 35873 - DNA, 23 bp, Artificial Sequence
  Description of Artificial Sequence: Synthetic oligonucleotide
gcggcggacactgcggctcagat

SEQ ID NO: 35874 - DNA, 24 bp, Artificial Sequence
  Description of Artificial Sequence: Synthetic oligonucleotide
cggcggacactgcggctcagatca

SEQ ID NO: 35875 - DNA, 24 bp, Artificial Sequence
  Description of Artificial Sequence: Synthetic oligonucleotide
ggcggacactgcggctcagatcac

SEQ ID NO: 35876 - DNA, 24 bp, Artificial Sequence
  Description of Artificial Sequence: Synthetic oligonucleotide
gcggacactgcggctcagatcacc

SEQ ID NO: 35877 - DNA, 25 bp, Artificial Sequence
  Description of Artificial Sequence: Synthetic oligonucleotide
cggacactgcggctcagatcaccca

SEQ ID NO: 35878 - DNA, 25 bp, Artificial Sequence
  Description of Artificial Sequence: Synthetic oligonucleotide
ggacactgcggctcagatcacccag

SEQ ID NO: 35879 - DNA, 25 bp, Artificial Sequence
  Description of Artificial Sequence: Synthetic oligonucleotide
gacactgcggctcagatcacccagc

SEQ ID NO: 35880 - DNA, 25 bp, Artificial Sequence
  Description of Artificial Sequence: Synthetic oligonucleotide
acactgcggctcagatcacccagcg

SEQ ID NO: 35881 - DNA, 24 bp, Artificial Sequence
  Description of Artificial Sequence: Synthetic oligonucleotide
cactgcggctcagatcacccagcg

SEQ ID NO: 35882 - DNA, 26 bp, Artificial Sequence
  Description of Artificial Sequence: Synthetic oligonucleotide
actgcggctcagatcacccagcgcaa

SEQ ID NO: 35883 - DNA, 25 bp, Artificial Sequence
  Description of Artificial Sequence: Synthetic oligonucleotide
ctgcggctcagatcacccagcgcaa

SEQ ID NO: 35884 - DNA, 26 bp, Artificial Sequence
  Description of Artificial Sequence: Synthetic oligonucleotide
tgcggctcagatcacccagcgcaagt

SEQ ID NO: 35885 - DNA, 29 bp, Artificial Sequence
  Description of Artificial Sequence: Synthetic oligonucleotide
gggagacacagatctccaagaccaacacg

SEQ ID NO: 35886 - DNA, 29 bp, Artificial Sequence
  Description of Artificial Sequence: Synthetic oligonucleotide
ggagacacagatctccaagaccaacacgc

SEQ ID NO: 35887 - DNA, 30 bp, Artificial Sequence
  Description of Artificial Sequence: Synthetic oligonucleotide
gagacacagatctccaagaccaacacgcag

SEQ ID NO: 35888 - DNA, 31 bp, Artificial Sequence
  Description of Artificial Sequence: Synthetic oligonucleotide
agacacagatctccaagaccaacacgcagac

SEQ ID NO: 35889 - DNA, 30 bp, Artificial Sequence
  Description of Artificial Sequence: Synthetic oligonucleotide
gacacagatctccaagaccaacacgcagac

SEQ ID NO: 35890 - DNA, 33 bp, Artificial Sequence
  Description of Artificial Sequence: Synthetic oligonucleotide
acacagatctccaagaccaacacgcagacttac

SEQ ID NO: 35891 - DNA, 32 bp, Artificial Sequence
  Description of Artificial Sequence: Synthetic oligonucleotide
cacagatctccaagaccaacacgcagacttac

SEQ ID NO: 35892 - DNA, 32 bp, Artificial Sequence
  Description of Artificial Sequence: Synthetic oligonucleotide
acagatctccaagaccaacacgcagacttacc

SEQ ID NO: 35893 - DNA, 31 bp, Artificial Sequence
  Description of Artificial Sequence: Synthetic oligonucleotide
cagatctccaagaccaacacgcagacttacc

SEQ ID NO: 35894 - DNA, 31 bp, Artificial Sequence
  Description of Artificial Sequence: Synthetic oligonucleotide
agatctccaagaccaacacgcagacttaccg

SEQ ID NO: 35895 - DNA, 30 bp, Artificial Sequence
  Description of Artificial Sequence: Synthetic oligonucleotide
gatctccaagaccaacacgcagacttaccg

SEQ ID NO: 35896 - DNA, 31 bp, Artificial Sequence
  Description of Artificial Sequence: Synthetic oligonucleotide
atctccaagaccaacacgcagacttaccgag

SEQ ID NO: 35897 - DNA, 30 bp, Artificial Sequence
  Description of Artificial Sequence: Synthetic oligonucleotide
tctccaagaccaacacgcagacttaccgag

SEQ ID NO: 35898 - DNA, 29 bp, Artificial Sequence
  Description of Artificial Sequence: Synthetic oligonucleotide
ctccaagaccaacacgcagacttaccgag

SEQ ID NO: 35899 - DNA, 30 bp, Artificial Sequence
  Description of Artificial Sequence: Synthetic oligonucleotide
tccaagaccaacacgcagacttaccgagag

SEQ ID NO: 35900 - DNA, 29 bp, Artificial Sequence
  Description of Artificial Sequence: Synthetic oligonucleotide
ccaagaccaacacgcagacttaccgagag

SEQ ID NO: 35901 - DNA, 31 bp, Artificial Sequence
  Description of Artificial Sequence: Synthetic oligonucleotide
caagaccaacacgcagacttaccgagagaac

SEQ ID NO: 35902 - DNA, 31 bp, Artificial Sequence
  Description of Artificial Sequence: Synthetic oligonucleotide
aagaccaacacgcagacttaccgagagaacc

SEQ ID NO: 35903 - DNA, 30 bp, Artificial Sequence
  Description of Artificial Sequence: Synthetic oligonucleotide
agaccaacacgcagacttaccgagagaacc

SEQ ID NO: 35904 - DNA, 29 bp, Artificial Sequence
  Description of Artificial Sequence: Synthetic oligonucleotide
gaccaacacgcagacttaccgagagaacc

SEQ ID NO: 35905 - DNA, 30 bp, Artificial Sequence
  Description of Artificial Sequence: Synthetic oligonucleotide
accaacacgcagacttaccgagagaacctg

SEQ ID NO: 35906 - DNA, 29 bp, Artificial Sequence
  Description of Artificial Sequence: Synthetic oligonucleotide
ccaacacgcagacttaccgagagaacctg

SEQ ID NO: 35907 - DNA, 29 bp, Artificial Sequence
  Description of Artificial Sequence: Synthetic oligonucleotide
caacacgcagacttaccgagagaacctgc

SEQ ID NO: 35908 - DNA, 29 bp, Artificial Sequence
  Description of Artificial Sequence: Synthetic oligonucleotide
aacacgcagacttaccgagagaacctgcg

SEQ ID NO: 35909 - DNA, 28 bp, Artificial Sequence
  Description of Artificial Sequence: Synthetic oligonucleotide
acacgcagacttaccgagagaacctgcg

SEQ ID NO: 35910 - DNA, 27 bp, Artificial Sequence
  Description of Artificial Sequence: Synthetic oligonucleotide
cacgcagacttaccgagagaacctgcg

SEQ ID NO: 35911 - DNA, 27 bp, Artificial Sequence
  Description of Artificial Sequence: Synthetic oligonucleotide
acgcagacttaccgagagaacctgcgc

SEQ ID NO: 35912 - DNA, 27 bp, Artificial Sequence
  Description of Artificial Sequence: Synthetic oligonucleotide
cgcagacttaccgagagaacctgcgca

SEQ ID NO: 35913 - DNA, 27 bp, Artificial Sequence
  Description of Artificial Sequence: Synthetic oligonucleotide
gcagacttaccgagagaacctgcgcac

SEQ ID NO: 35914 - DNA, 23 bp, Artificial Sequence
  Description of Artificial Sequence: Synthetic oligonucleotide
acgggcgcctccttcgcgggtat

SEQ ID NO: 35915 - DNA, 22 bp, Artificial Sequence
  Description of Artificial Sequence: Synthetic oligonucleotide
cgggcgcctccttcgcgggtat

SEQ ID NO: 35916 - DNA, 23 bp, Artificial Sequence
  Description of Artificial Sequence: Synthetic oligonucleotide
gggcgcctccttcgcgggtatga

SEQ ID NO: 35917 - DNA, 23 bp, Artificial Sequence
  Description of Artificial Sequence: Synthetic oligonucleotide
ggcgcctccttcgcgggtatgac

SEQ ID NO: 35918 - DNA, 24 bp, Artificial Sequence
  Description of Artificial Sequence: Synthetic oligonucleotide
gcgcctccttcgcgggtatgacca

SEQ ID NO: 35919 - DNA, 24 bp, Artificial Sequence
  Description of Artificial Sequence: Synthetic oligonucleotide
cgcctccttcgcgggtatgaccag

SEQ ID NO: 35920 - DNA, 25 bp, Artificial Sequence
  Description of Artificial Sequence: Synthetic oligonucleotide
gcctccttcgcgggtatgaccagga

SEQ ID NO: 35921 - DNA, 25 bp, Artificial Sequence
  Description of Artificial Sequence: Synthetic oligonucleotide
cctccttcgcgggtatgaccaggac

SEQ ID NO: 35922 - DNA, 25 bp, Artificial Sequence
  Description of Artificial Sequence: Synthetic oligonucleotide
ctccttcgcgggtatgaccaggacg

SEQ ID NO: 35923 - DNA, 25 bp, Artificial Sequence
  Description of Artificial Sequence: Synthetic oligonucleotide
tccttcgcgggtatgaccaggacgc

SEQ ID NO: 35924 - DNA, 24 bp, Artificial Sequence
  Description of Artificial Sequence: Synthetic oligonucleotide
ccttcgcgggtatgaccaggacgc

SEQ ID NO: 35925 - DNA, 26 bp, Artificial Sequence
  Description of Artificial Sequence: Synthetic oligonucleotide
cttcgcgggtatgaccaggacgccta

SEQ ID NO: 35926 - DNA, 26 bp, Artificial Sequence
  Description of Artificial Sequence: Synthetic oligonucleotide
ttcgcgggtatgaccaggacgcctac

SEQ ID NO: 35927 - DNA, 25 bp, Artificial Sequence
  Description of Artificial Sequence: Synthetic oligonucleotide
tcgcgggtatgaccaggacgcctac

SEQ ID NO: 35928 - DNA, 24 bp, Artificial Sequence
  Description of Artificial Sequence: Synthetic oligonucleotide
ctggagggcctgtgcgtggagtca

SEQ ID NO: 35929 - DNA, 25 bp, Artificial Sequence
  Description of Artificial Sequence: Synthetic oligonucleotide
tggagggcctgtgcgtggagtcact

SEQ ID NO: 35930 - DNA, 24 bp, Artificial Sequence
  Description of Artificial Sequence: Synthetic oligonucleotide
ggagggcctgtgcgtggagtcact

SEQ ID NO: 35931 - DNA, 24 bp, Artificial Sequence
  Description of Artificial Sequence: Synthetic oligonucleotide
gagggcctgtgcgtggagtcactc

SEQ ID NO: 35932 - DNA, 24 bp, Artificial Sequence
  Description of Artificial Sequence: Synthetic oligonucleotide
agggcctgtgcgtggagtcactcc

SEQ ID NO: 35933 - DNA, 23 bp, Artificial Sequence
  Description of Artificial Sequence: Synthetic oligonucleotide
gggcctgtgcgtggagtcactcc

SEQ ID NO: 35934 - DNA, 23 bp, Artificial Sequence
  Description of Artificial Sequence: Synthetic oligonucleotide
ggcctgtgcgtggagtcactccg

SEQ ID NO: 35935 - DNA, 24 bp, Artificial Sequence
  Description of Artificial Sequence: Synthetic oligonucleotide
gcctgtgcgtggagtcactccgca

SEQ ID NO: 35936 - DNA, 27 bp, Artificial Sequence
  Description of Artificial Sequence: Synthetic oligonucleotide
cctgtgcgtggagtcactccgcagata

SEQ ID NO: 35937 - DNA, 27 bp, Artificial Sequence
  Description of Artificial Sequence: Synthetic oligonucleotide
ctgtgcgtggagtcactccgcagatac

SEQ ID NO: 35938 - DNA, 27 bp, Artificial Sequence
  Description of Artificial Sequence: Synthetic oligonucleotide
tgtgcgtggagtcactccgcagatacc

SEQ ID NO: 35939 - DNA, 27 bp, Artificial Sequence
  Description of Artificial Sequence: Synthetic oligonucleotide
gtgcgtggagtcactccgcagatacct

SEQ ID NO: 35940 - DNA, 27 bp, Artificial Sequence
  Description of Artificial Sequence: Synthetic oligonucleotide
tgcgtggagtcactccgcagatacctg

SEQ ID NO: 35941 - DNA, 26 bp, Artificial Sequence
  Description of Artificial Sequence: Synthetic oligonucleotide
gcgtggagtcactccgcagatacctg

SEQ ID NO: 35942 - DNA, 27 bp, Artificial Sequence
  Description of Artificial Sequence: Synthetic oligonucleotide
cgtggagtcactccgcagatacctgga

SEQ ID NO: 35943 - DNA, 27 bp, Artificial Sequence
  Description of Artificial Sequence: Synthetic oligonucleotide
gtggagtcactccgcagatacctggag

SEQ ID NO: 35944 - DNA, 29 bp, Artificial Sequence
  Description of Artificial Sequence: Synthetic oligonucleotide
tggagtcactccgcagatacctggagaac

SEQ ID NO: 35945 - DNA, 28 bp, Artificial Sequence
  Description of Artificial Sequence: Synthetic oligonucleotide
ggagtcactccgcagatacctggagaac

SEQ ID NO: 35946 - DNA, 28 bp, Artificial Sequence
  Description of Artificial Sequence: Synthetic oligonucleotide
gagtcactccgcagatacctggagaacg

SEQ ID NO: 35947 - DNA, 28 bp, Artificial Sequence
  Description of Artificial Sequence: Synthetic oligonucleotide
agtcactccgcagatacctggagaacgg

SEQ ID NO: 35948 - DNA, 27 bp, Artificial Sequence
  Description of Artificial Sequence: Synthetic oligonucleotide
gtcactccgcagatacctggagaacgg

SEQ ID NO: 35949 - DNA, 27 bp, Artificial Sequence
  Description of Artificial Sequence: Synthetic oligonucleotide
tcactccgcagatacctggagaacggg

SEQ ID NO: 35950 - DNA, 27 bp, Artificial Sequence
  Description of Artificial Sequence: Synthetic oligonucleotide
cactccgcagatacctggagaacggga

SEQ ID NO: 35951 - DNA, 26 bp, Artificial Sequence
  Description of Artificial Sequence: Synthetic oligonucleotide
cgtgtggcggagcaggacagagctta

SEQ ID NO: 35952 - DNA, 26 bp, Artificial Sequence
  Description of Artificial Sequence: Synthetic oligonucleotide
gtgtggcggagcaggacagagcttac

SEQ ID NO: 35953 - DNA, 27 bp, Artificial Sequence
  Description of Artificial Sequence: Synthetic oligonucleotide
tgtggcggagcaggacagagcttacct

SEQ ID NO: 35954 - DNA, 26 bp, Artificial Sequence
  Description of Artificial Sequence: Synthetic oligonucleotide
gtggcggagcaggacagagcttacct

SEQ ID NO: 35955 - DNA, 26 bp, Artificial Sequence
  Description of Artificial Sequence: Synthetic oligonucleotide
tggcggagcaggacagagcttacctg

SEQ ID NO: 35956 - DNA, 25 bp, Artificial Sequence
  Description of Artificial Sequence: Synthetic oligonucleotide
ggcggagcaggacagagcttacctg

SEQ ID NO: 35957 - DNA, 26 bp, Artificial Sequence
  Description of Artificial Sequence: Synthetic oligonucleotide
gcggagcaggacagagcttacctgga

SEQ ID NO: 35958 - DNA, 26 bp, Artificial Sequence
  Description of Artificial Sequence: Synthetic oligonucleotide
cggagcaggacagagcttacctggag

SEQ ID NO: 35959 - DNA, 26 bp, Artificial Sequence
  Description of Artificial Sequence: Synthetic oligonucleotide
ggagcaggacagagcttacctggagg

SEQ ID NO: 35960 - DNA, 26 bp, Artificial Sequence
  Description of Artificial Sequence: Synthetic oligonucleotide
gagcaggacagagcttacctggaggg

SEQ ID NO: 35961 - DNA, 26 bp, Artificial Sequence
  Description of Artificial Sequence: Synthetic oligonucleotide
agcaggacagagcttacctggagggc

SEQ ID NO: 35962 - DNA, 25 bp, Artificial Sequence
  Description of Artificial Sequence: Synthetic oligonucleotide
gcaggacagagcttacctggagggc

SEQ ID NO: 35963 - DNA, 26 bp, Artificial Sequence
  Description of Artificial Sequence: Synthetic oligonucleotide
caggacagagcttacctggagggcct

SEQ ID NO: 35964 - DNA, 27 bp, Artificial Sequence
  Description of Artificial Sequence: Synthetic oligonucleotide
aggacagagcttacctggagggcctgt

SEQ ID NO: 35965 - DNA, 26 bp, Artificial Sequence
  Description of Artificial Sequence: Synthetic oligonucleotide
ggacagagcttacctggagggcctgt

SEQ ID NO: 35966 - DNA, 26 bp, Artificial Sequence
  Description of Artificial Sequence: Synthetic oligonucleotide
gacagagcttacctggagggcctgtg

SEQ ID NO: 35967 - DNA, 26 bp, Artificial Sequence
  Description of Artificial Sequence: Synthetic oligonucleotide
acagagcttacctggagggcctgtgc

SEQ ID NO: 35968 - DNA, 25 bp, Artificial Sequence
  Description of Artificial Sequence: Synthetic oligonucleotide
cagagcttacctggagggcctgtgc

SEQ ID NO: 35969 - DNA, 20 bp, Artificial Sequence
  Description of Artificial Sequence: Synthetic oligonucleotide
gggccggacgggcgccttct

SEQ ID NO: 35970 - DNA, 20 bp, Artificial Sequence
  Description of Artificial Sequence: Synthetic oligonucleotide
ggccggacgggcgccttctc

SEQ ID NO: 35971 - DNA, 20 bp, Artificial Sequence
  Description of Artificial Sequence: Synthetic oligonucleotide
gccggacgggcgccttctcc

SEQ ID NO: 35972 - DNA, 20 bp, Artificial Sequence
  Description of Artificial Sequence: Synthetic oligonucleotide
ccggacgggcgccttctccg

SEQ ID NO: 35973 - DNA, 20 bp, Artificial Sequence
  Description of Artificial Sequence: Synthetic oligonucleotide
cggacgggcgccttctccgc

SEQ ID NO: 35974 - DNA, 20 bp, Artificial Sequence
  Description of Artificial Sequence: Synthetic oligonucleotide
ggacgggcgccttctccgcg

SEQ ID NO: 35975 - DNA, 20 bp, Artificial Sequence
  Description of Artificial Sequence: Synthetic oligonucleotide
gacgggcgccttctccgcgg

SEQ ID NO: 35976 - DNA, 23 bp, Artificial Sequence
  Description of Artificial Sequence: Synthetic oligonucleotide
acgggcgccttctccgcgggtat

SEQ ID NO: 35977 - DNA, 22 bp, Artificial Sequence
  Description of Artificial Sequence: Synthetic oligonucleotide
cgggcgccttctccgcgggtat

SEQ ID NO: 35978 - DNA, 23 bp, Artificial Sequence
  Description of Artificial Sequence: Synthetic oligonucleotide
gggcgccttctccgcgggtatga

SEQ ID NO: 35979 - DNA, 23 bp, Artificial Sequence
  Description of Artificial Sequence: Synthetic oligonucleotide
ggcgccttctccgcgggtatgac

SEQ ID NO: 35980 - DNA, 24 bp, Artificial Sequence
  Description of Artificial Sequence: Synthetic oligonucleotide
gcgccttctccgcgggtatgacca

SEQ ID NO: 35981 - DNA, 24 bp, Artificial Sequence
  Description of Artificial Sequence: Synthetic oligonucleotide
cgccttctccgcgggtatgaccag

SEQ ID NO: 35982 - DNA, 25 bp, Artificial Sequence
  Description of Artificial Sequence: Synthetic oligonucleotide
gccttctccgcgggtatgaccagga

SEQ ID NO: 35983 - DNA, 25 bp, Artificial Sequence
  Description of Artificial Sequence: Synthetic oligonucleotide
ccttctccgcgggtatgaccaggac

SEQ ID NO: 35984 - DNA, 25 bp, Artificial Sequence
  Description of Artificial Sequence: Synthetic oligonucleotide
cttctccgcgggtatgaccaggacg

SEQ ID NO: 35985 - DNA, 25 bp, Artificial Sequence
  Description of Artificial Sequence: Synthetic oligonucleotide
ttctccgcgggtatgaccaggacgc

SEQ ID NO: 35986 - DNA, 24 bp, Artificial Sequence
  Description of Artificial Sequence: Synthetic oligonucleotide
tctccgcgggtatgaccaggacgc

SEQ ID NO: 35987 - DNA, 26 bp, Artificial Sequence
  Description of Artificial Sequence: Synthetic oligonucleotide
gttcgacagcgacgccacgagtccta

SEQ ID NO: 35988 - DNA, 26 bp, Artificial Sequence
  Description of Artificial Sequence: Synthetic oligonucleotide
ttcgacagcgacgccacgagtcctag

SEQ ID NO: 35989 - DNA, 25 bp, Artificial Sequence
  Description of Artificial Sequence: Synthetic oligonucleotide
tcgacagcgacgccacgagtcctag

SEQ ID NO: 35990 - DNA, 24 bp, Artificial Sequence
  Description of Artificial Sequence: Synthetic oligonucleotide
cgacagcgacgccacgagtcctag

SEQ ID NO: 35991 - DNA, 26 bp, Artificial Sequence
  Description of Artificial Sequence: Synthetic oligonucleotide
gacagcgacgccacgagtcctaggaa

SEQ ID NO: 35992 - DNA, 26 bp, Artificial Sequence
  Description of Artificial Sequence: Synthetic oligonucleotide
acagcgacgccacgagtcctaggaag

SEQ ID NO: 35993 - DNA, 25 bp, Artificial Sequence
  Description of Artificial Sequence: Synthetic oligonucleotide
cagcgacgccacgagtcctaggaag

SEQ ID NO: 35994 - DNA, 26 bp, Artificial Sequence
  Description of Artificial Sequence: Synthetic oligonucleotide
agcgacgccacgagtcctaggaagga

SEQ ID NO: 35995 - DNA, 25 bp, Artificial Sequence
  Description of Artificial Sequence: Synthetic oligonucleotide
gcgacgccacgagtcctaggaagga

SEQ ID NO: 35996 - DNA, 25 bp, Artificial Sequence
  Description of Artificial Sequence: Synthetic oligonucleotide
cgacgccacgagtcctaggaaggag

SEQ ID NO: 35997 - DNA, 25 bp, Artificial Sequence
  Description of Artificial Sequence: Synthetic oligonucleotide
gacgccacgagtcctaggaaggagc

SEQ ID NO: 35998 - DNA, 25 bp, Artificial Sequence
  Description of Artificial Sequence: Synthetic oligonucleotide
acgccacgagtcctaggaaggagcc

SEQ ID NO: 35999 - DNA, 24 bp, Artificial Sequence
  Description of Artificial Sequence: Synthetic oligonucleotide
cgccacgagtcctaggaaggagcc

SEQ ID NO: 36000 - DNA, 24 bp, Artificial Sequence
  Description of Artificial Sequence: Synthetic oligonucleotide
gccacgagtcctaggaaggagccg

SEQ ID NO: 36001 - DNA, 24 bp, Artificial Sequence
  Description of Artificial Sequence: Synthetic oligonucleotide
ccacgagtcctaggaaggagccgc

SEQ ID NO: 36002 - DNA, 24 bp, Artificial Sequence
  Description of Artificial Sequence: Synthetic oligonucleotide
cacgagtcctaggaaggagccgcg

SEQ ID NO: 36003 - DNA, 24 bp, Artificial Sequence
  Description of Artificial Sequence: Synthetic oligonucleotide
acgagtcctaggaaggagccgcgg

SEQ ID NO: 36004 - DNA, 23 bp, Artificial Sequence
  Description of Artificial Sequence: Synthetic oligonucleotide
cgagtcctaggaaggagccgcgg

SEQ ID NO: 36005 - DNA, 23 bp, Artificial Sequence
  Description of Artificial Sequence: Synthetic oligonucleotide
gagtcctaggaaggagccgcggg

SEQ ID NO: 36006 - DNA, 23 bp, Artificial Sequence
  Description of Artificial Sequence: Synthetic oligonucleotide
agtcctaggaaggagccgcgggc

SEQ ID NO: 36007 - DNA, 22 bp, Artificial Sequence
  Description of Artificial Sequence: Synthetic oligonucleotide
gtcctaggaaggagccgcgggc

SEQ ID NO: 36008 - DNA, 22 bp, Artificial Sequence
  Description of Artificial Sequence: Synthetic oligonucleotide
tcctaggaaggagccgcgggcg

SEQ ID NO: 36009 - DNA, 21 bp, Artificial Sequence
  Description of Artificial Sequence: Synthetic oligonucleotide
cctaggaaggagccgcgggcg

SEQ ID NO: 36010 - DNA, 21 bp, Artificial Sequence
  Description of Artificial Sequence: Synthetic oligonucleotide
ctaggaaggagccgcgggcgc

SEQ ID NO: 36011 - DNA, 23 bp, Artificial Sequence
  Description of Artificial Sequence: Synthetic oligonucleotide
taggaaggagccgcgggcgccat

SEQ ID NO: 36012 - DNA, 25 bp, Artificial Sequence
  Description of Artificial Sequence: Synthetic oligonucleotide
agaagtgggcagctgtggtggtgcc

SEQ ID NO: 36013 - DNA, 24 bp, Artificial Sequence
  Description of Artificial Sequence: Synthetic oligonucleotide
gaagtgggcagctgtggtggtgcc

SEQ ID NO: 36014 - DNA, 25 bp, Artificial Sequence
  Description of Artificial Sequence: Synthetic oligonucleotide
aagtgggcagctgtggtggtgccct

SEQ ID NO: 36015 - DNA, 24 bp, Artificial Sequence
  Description of Artificial Sequence: Synthetic oligonucleotide
agtgggcagctgtggtggtgccct

SEQ ID NO: 36016 - DNA, 23 bp, Artificial Sequence
  Description of Artificial Sequence: Synthetic oligonucleotide
gtgggcagctgtggtggtgccct

SEQ ID NO: 36017 - DNA, 24 bp, Artificial Sequence
  Description of Artificial Sequence: Synthetic oligonucleotide
tgggcagctgtggtggtgccctct

SEQ ID NO: 36018 - DNA, 23 bp, Artificial Sequence
  Description of Artificial Sequence: Synthetic oligonucleotide
gggcagctgtggtggtgccctct

SEQ ID NO: 36019 - DNA, 23 bp, Artificial Sequence
  Description of Artificial Sequence: Synthetic oligonucleotide
ggcagctgtggtggtgccctctg

SEQ ID NO: 36020 - DNA, 24 bp, Artificial Sequence
  Description of Artificial Sequence: Synthetic oligonucleotide
gcagctgtggtggtgccctctgga

SEQ ID NO: 36021 - DNA, 26 bp, Artificial Sequence
  Description of Artificial Sequence: Synthetic oligonucleotide
cagctgtggtggtgccctctggagaa

SEQ ID NO: 36022 - DNA, 27 bp, Artificial Sequence
  Description of Artificial Sequence: Synthetic oligonucleotide
agctgtggtggtgccctctggagaaga

SEQ ID NO: 36023 - DNA, 26 bp, Artificial Sequence
  Description of Artificial Sequence: Synthetic oligonucleotide
gctgtggtggtgccctctggagaaga

SEQ ID NO: 36024 - DNA, 26 bp, Artificial Sequence
  Description of Artificial Sequence: Synthetic oligonucleotide
ctgtggtggtgccctctggagaagag

SEQ ID NO: 36025 - DNA, 27 bp, Artificial Sequence
  Description of Artificial Sequence: Synthetic oligonucleotide
tgtggtggtgccctctggagaagagca

SEQ ID NO: 36026 - DNA, 26 bp, Artificial Sequence
  Description of Artificial Sequence: Synthetic oligonucleotide
gtggtggtgccctctggagaagagca

SEQ ID NO: 36027 - DNA, 27 bp, Artificial Sequence
  Description of Artificial Sequence: Synthetic oligonucleotide
tggtggtgccctctggagaagagcaga

SEQ ID NO: 36028 - DNA, 26 bp, Artificial Sequence
  Description of Artificial Sequence: Synthetic oligonucleotide
ggtggtgccctctggagaagagcaga

SEQ ID NO: 36029 - DNA, 27 bp, Artificial Sequence
  Description of Artificial Sequence: Synthetic oligonucleotide
gtggtgccctctggagaagagcagaga

SEQ ID NO: 36030 - DNA, 29 bp, Artificial Sequence
  Description of Artificial Sequence: Synthetic oligonucleotide
tggtgccctctggagaagagcagagatac

SEQ ID NO: 36031 - DNA, 28 bp, Artificial Sequence
  Description of Artificial Sequence: Synthetic oligonucleotide
ggtgccctctggagaagagcagagatac

SEQ ID NO: 36032 - DNA, 29 bp, Artificial Sequence
  Description of Artificial Sequence: Synthetic oligonucleotide
gtgccctctggagaagagcagagatacac

SEQ ID NO: 36033 - DNA, 31 bp, Artificial Sequence
  Description of Artificial Sequence: Synthetic oligonucleotide
tgccctctggagaagagcagagatacacatg

SEQ ID NO: 36034 - DNA, 30 bp, Artificial Sequence
  Description of Artificial Sequence: Synthetic oligonucleotide
gccctctggagaagagcagagatacacatg

SEQ ID NO: 36035 - DNA, 30 bp, Artificial Sequence
  Description of Artificial Sequence: Synthetic oligonucleotide
ccctctggagaagagcagagatacacatgc

SEQ ID NO: 36036 - DNA, 30 bp, Artificial Sequence
  Description of Artificial Sequence: Synthetic oligonucleotide
cctctggagaagagcagagatacacatgcc

SEQ ID NO: 36037 - DNA, 32 bp, Artificial Sequence
  Description of Artificial Sequence: Synthetic oligonucleotide
ctctggagaagagcagagatacacatgccatg

SEQ ID NO: 36038 - DNA, 32 bp, Artificial Sequence
  Description of Artificial Sequence: Synthetic oligonucleotide
agatagaaccttccagaagtgggcagctgtag

SEQ ID NO: 36039 - DNA, 31 bp, Artificial Sequence
  Description of Artificial Sequence: Synthetic oligonucleotide
gatagaaccttccagaagtgggcagctgtag

SEQ ID NO: 36040 - DNA, 32 bp, Artificial Sequence
  Description of Artificial Sequence: Synthetic oligonucleotide
atagaaccttccagaagtgggcagctgtagtg

SEQ ID NO: 36041 - DNA, 31 bp, Artificial Sequence
  Description of Artificial Sequence: Synthetic oligonucleotide
tagaaccttccagaagtgggcagctgtagtg

SEQ ID NO: 36042 - DNA, 30 bp, Artificial Sequence
  Description of Artificial Sequence: Synthetic oligonucleotide
agaaccttccagaagtgggcagctgtagtg

SEQ ID NO: 36043 - DNA, 29 bp, Artificial Sequence
  Description of Artificial Sequence: Synthetic oligonucleotide
gaaccttccagaagtgggcagctgtagtg

SEQ ID NO: 36044 - DNA, 29 bp, Artificial Sequence
  Description of Artificial Sequence: Synthetic oligonucleotide
aaccttccagaagtgggcagctgtagtgg

SEQ ID NO: 36045 - DNA, 28 bp, Artificial Sequence
  Description of Artificial Sequence: Synthetic oligonucleotide
accttccagaagtgggcagctgtagtgg

SEQ ID NO: 36046 - DNA, 27 bp, Artificial Sequence
  Description of Artificial Sequence: Synthetic oligonucleotide
ccttccagaagtgggcagctgtagtgg

SEQ ID NO: 36047 - DNA, 28 bp, Artificial Sequence
  Description of Artificial Sequence: Synthetic oligonucleotide
cttccagaagtgggcagctgtagtggtg

SEQ ID NO: 36048 - DNA, 28 bp, Artificial Sequence
  Description of Artificial Sequence: Synthetic oligonucleotide
ttccagaagtgggcagctgtagtggtgc

SEQ ID NO: 36049 - DNA, 27 bp, Artificial Sequence
  Description of Artificial Sequence: Synthetic oligonucleotide
tccagaagtgggcagctgtagtggtgc

SEQ ID NO: 36050 - DNA, 26 bp, Artificial Sequence
  Description of Artificial Sequence: Synthetic oligonucleotide
ccagaagtgggcagctgtagtggtgc

SEQ ID NO: 36051 - DNA, 27 bp, Artificial Sequence
  Description of Artificial Sequence: Synthetic oligonucleotide
cagaagtgggcagctgtagtggtgcct

SEQ ID NO: 36052 - DNA, 28 bp, Artificial Sequence
  Description of Artificial Sequence: Synthetic oligonucleotide
agaagtgggcagctgtagtggtgccttc

SEQ ID NO: 36053 - DNA, 27 bp, Artificial Sequence
  Description of Artificial Sequence: Synthetic oligonucleotide
gaagtgggcagctgtagtggtgccttc

SEQ ID NO: 36054 - DNA, 28 bp, Artificial Sequence
  Description of Artificial Sequence: Synthetic oligonucleotide
aagtgggcagctgtagtggtgccttctg

SEQ ID NO: 36055 - DNA, 27 bp, Artificial Sequence
  Description of Artificial Sequence: Synthetic oligonucleotide
agtgggcagctgtagtggtgccttctg

SEQ ID NO: 36056 - DNA, 26 bp, Artificial Sequence
  Description of Artificial Sequence: Synthetic oligonucleotide
gtgggcagctgtagtggtgccttctg

SEQ ID NO: 36057 - DNA, 27 bp, Artificial Sequence
  Description of Artificial Sequence: Synthetic oligonucleotide
tgggcagctgtagtggtgccttctgga

SEQ ID NO: 36058 - DNA, 26 bp, Artificial Sequence
  Description of Artificial Sequence: Synthetic oligonucleotide
gggcagctgtagtggtgccttctgga

SEQ ID NO: 36059 - DNA, 27 bp, Artificial Sequence
  Description of Artificial Sequence: Synthetic oligonucleotide
ggcagctgtagtggtgccttctggaga

SEQ ID NO: 36060 - DNA, 28 bp, Artificial Sequence
  Description of Artificial Sequence: Synthetic oligonucleotide
gcagctgtagtggtgccttctggagaag

SEQ ID NO: 36061 - DNA, 29 bp, Artificial Sequence
  Description of Artificial Sequence: Synthetic oligonucleotide
cagctgtagtggtgccttctggagaagag

SEQ ID NO: 36062 - DNA, 29 bp, Artificial Sequence
  Description of Artificial Sequence: Synthetic oligonucleotide
agctgtagtggtgccttctggagaagagc

SEQ ID NO: 36063 - DNA, 28 bp, Artificial Sequence
  Description of Artificial Sequence: Synthetic oligonucleotide
gctgtagtggtgccttctggagaagagc

SEQ ID NO: 36064 - DNA, 29 bp, Artificial Sequence
  Description of Artificial Sequence: Synthetic oligonucleotide
ctgtagtggtgccttctggagaagagcag

SEQ ID NO: 36065 - DNA, 30 bp, Artificial Sequence
  Description of Artificial Sequence: Synthetic oligonucleotide
tgtagtggtgccttctggagaagagcagag

SEQ ID NO: 36066 - DNA, 29 bp, Artificial Sequence
  Description of Artificial Sequence: Synthetic oligonucleotide
gtagtggtgccttctggagaagagcagag

SEQ ID NO: 36067 - DNA, 32 bp, Artificial Sequence
  Description of Artificial Sequence: Synthetic oligonucleotide
tagtggtgccttctggagaagagcagagatac

SEQ ID NO: 36068 - DNA, 31 bp, Artificial Sequence
  Description of Artificial Sequence: Synthetic oligonucleotide
agtggtgccttctggagaagagcagagatac

SEQ ID NO: 36069 - DNA, 31 bp, Artificial Sequence
  Description of Artificial Sequence: Synthetic oligonucleotide
tctcacatcatccagaggatgtacggctgtg

SEQ ID NO: 36070 - DNA, 30 bp, Artificial Sequence
  Description of Artificial Sequence: Synthetic oligonucleotide
ctcacatcatccagaggatgtacggctgtg

SEQ ID NO: 36071 - DNA, 31 bp, Artificial Sequence
  Description of Artificial Sequence: Synthetic oligonucleotide
tcacatcatccagaggatgtacggctgtgac

SEQ ID NO: 36072 - DNA, 30 bp, Artificial Sequence
  Description of Artificial Sequence: Synthetic oligonucleotide
cacatcatccagaggatgtacggctgtgac

SEQ ID NO: 36073 - DNA, 30 bp, Artificial Sequence
  Description of Artificial Sequence: Synthetic oligonucleotide
acatcatccagaggatgtacggctgtgacg

SEQ ID NO: 36074 - DNA, 29 bp, Artificial Sequence
  Description of Artificial Sequence: Synthetic oligonucleotide
catcatccagaggatgtacggctgtgacg

SEQ ID NO: 36075 - DNA, 30 bp, Artificial Sequence
  Description of Artificial Sequence: Synthetic oligonucleotide
atcatccagaggatgtacggctgtgacgtg

SEQ ID NO: 36076 - DNA, 29 bp, Artificial Sequence
  Description of Artificial Sequence: Synthetic oligonucleotide
tcatccagaggatgtacggctgtgacgtg

SEQ ID NO: 36077 - DNA, 28 bp, Artificial Sequence
  Description of Artificial Sequence: Synthetic oligonucleotide
catccagaggatgtacggctgtgacgtg

SEQ ID NO: 36078 - DNA, 28 bp, Artificial Sequence
  Description of Artificial Sequence: Synthetic oligonucleotide
atccagaggatgtacggctgtgacgtgg

SEQ ID NO: 36079 - DNA, 25 bp, Artificial Sequence
  Description of Artificial Sequence: Synthetic oligonucleotide
tccgcgggtatgaccaggacgcgta

SEQ ID NO: 36080 - DNA, 24 bp, Artificial Sequence
  Description of Artificial Sequence: Synthetic oligonucleotide
ccgcgggtatgaccaggacgcgta

SEQ ID NO: 36081 - DNA, 24 bp, Artificial Sequence
  Description of Artificial Sequence: Synthetic oligonucleotide
cgcgggtatgaccaggacgcgtac

SEQ ID NO: 36082 - DNA, 25 bp, Artificial Sequence
  Description of Artificial Sequence: Synthetic oligonucleotide
gcgggtatgaccaggacgcgtacga

SEQ ID NO: 36083 - DNA, 25 bp, Artificial Sequence
  Description of Artificial Sequence: Synthetic oligonucleotide
cgggtatgaccaggacgcgtacgac

SEQ ID NO: 36084 - DNA, 25 bp, Artificial Sequence
  Description of Artificial Sequence: Synthetic oligonucleotide
gggtatgaccaggacgcgtacgacg

SEQ ID NO: 36085 - DNA, 25 bp, Artificial Sequence
  Description of Artificial Sequence: Synthetic oligonucleotide
ggtatgaccaggacgcgtacgacgg

SEQ ID NO: 36086 - DNA, 27 bp, Artificial Sequence
  Description of Artificial Sequence: Synthetic oligonucleotide
gtatgaccaggacgcgtacgacggcaa

SEQ ID NO: 36087 - DNA, 27 bp, Artificial Sequence
  Description of Artificial Sequence: Synthetic oligonucleotide
tatgaccaggacgcgtacgacggcaag

SEQ ID NO: 36088 - DNA, 26 bp, Artificial Sequence
  Description of Artificial Sequence: Synthetic oligonucleotide
atgaccaggacgcgtacgacggcaag

SEQ ID NO: 36089 - DNA, 25 bp, Artificial Sequence
  Description of Artificial Sequence: Synthetic oligonucleotide
tgaccaggacgcgtacgacggcaag

SEQ ID NO: 36090 - DNA, 24 bp, Artificial Sequence
  Description of Artificial Sequence: Synthetic oligonucleotide
gaccaggacgcgtacgacggcaag

SEQ ID NO: 36091 - DNA, 27 bp, Artificial Sequence
  Description of Artificial Sequence: Synthetic oligonucleotide
accaggacgcgtacgacggcaaggatt

SEQ ID NO: 36092 - DNA, 27 bp, Artificial Sequence
  Description of Artificial Sequence: Synthetic oligonucleotide
ccaggacgcgtacgacggcaaggatta

SEQ ID NO: 36093 - DNA, 27 bp, Artificial Sequence
  Description of Artificial Sequence: Synthetic oligonucleotide
caggacgcgtacgacggcaaggattac

SEQ ID NO: 36094 - DNA, 29 bp, Artificial Sequence
  Description of Artificial Sequence: Synthetic oligonucleotide
aggacgcgtacgacggcaaggattacatc

SEQ ID NO: 36095 - DNA, 28 bp, Artificial Sequence
  Description of Artificial Sequence: Synthetic oligonucleotide
ggacgcgtacgacggcaaggattacatc

SEQ ID NO: 36096 - DNA, 28 bp, Artificial Sequence
  Description of Artificial Sequence: Synthetic oligonucleotide
gacgcgtacgacggcaaggattacatcg

SEQ ID NO: 36097 - DNA, 28 bp, Artificial Sequence
  Description of Artificial Sequence: Synthetic oligonucleotide
acgcgtacgacggcaaggattacatcgc

SEQ ID NO: 36098 - DNA, 27 bp, Artificial Sequence
  Description of Artificial Sequence: Synthetic oligonucleotide
cgcgtacgacggcaaggattacatcgc

SEQ ID NO: 36099 - DNA, 27 bp, Artificial Sequence
  Description of Artificial Sequence: Synthetic oligonucleotide
gcgtacgacggcaaggattacatcgcc

SEQ ID NO: 36100 - DNA, 27 bp, Artificial Sequence
  Description of Artificial Sequence: Synthetic oligonucleotide
cgtacgacggcaaggattacatcgccc

SEQ ID NO: 36101 - DNA, 28 bp, Artificial Sequence
  Description of Artificial Sequence: Synthetic oligonucleotide
gtacgacggcaaggattacatcgccctg

SEQ ID NO: 36102 - DNA, 31 bp, Artificial Sequence
  Description of Artificial Sequence: Synthetic oligonucleotide
gctcccactccatgaggtatttctacacagc

SEQ ID NO: 36103 - DNA, 31 bp, Artificial Sequence
  Description of Artificial Sequence: Synthetic oligonucleotide
ctcccactccatgaggtatttctacacagcc

SEQ ID NO: 36104 - DNA, 33 bp, Artificial Sequence
  Description of Artificial Sequence: Synthetic oligonucleotide
tcccactccatgaggtatttctacacagccatg

SEQ ID NO: 36105 - DNA, 32 bp, Artificial Sequence
  Description of Artificial Sequence: Synthetic oligonucleotide
cccactccatgaggtatttctacacagccatg

SEQ ID NO: 36106 - DNA, 33 bp, Artificial Sequence
  Description of Artificial Sequence: Synthetic oligonucleotide
ccactccatgaggtatttctacacagccatgtc

SEQ ID NO: 36107 - DNA, 33 bp, Artificial Sequence
  Description of Artificial Sequence: Synthetic oligonucleotide
cactccatgaggtatttctacacagccatgtcc

SEQ ID NO: 36108 - DNA, 33 bp, Artificial Sequence
  Description of Artificial Sequence: Synthetic oligonucleotide
actccatgaggtatttctacacagccatgtccc

SEQ ID NO: 36109 - DNA, 32 bp, Artificial Sequence
  Description of Artificial Sequence: Synthetic oligonucleotide
ctccatgaggtatttctacacagccatgtccc

SEQ ID NO: 36110 - DNA, 32 bp, Artificial Sequence
  Description of Artificial Sequence: Synthetic oligonucleotide
tccatgaggtatttctacacagccatgtcccg

SEQ ID NO: 36111 - DNA, 31 bp, Artificial Sequence
  Description of Artificial Sequence: Synthetic oligonucleotide
ccatgaggtatttctacacagccatgtcccg

SEQ ID NO: 36112 - DNA, 31 bp, Artificial Sequence
  Description of Artificial Sequence: Synthetic oligonucleotide
catgaggtatttctacacagccatgtcccgg

SEQ ID NO: 36113 - DNA, 31 bp, Artificial Sequence
  Description of Artificial Sequence: Synthetic oligonucleotide
atgaggtatttctacacagccatgtcccggc

SEQ ID NO: 36114 - DNA, 30 bp, Artificial Sequence
  Description of Artificial Sequence: Synthetic oligonucleotide
tgaggtatttctacacagccatgtcccggc

SEQ ID NO: 36115 - DNA, 29 bp, Artificial Sequence
  Description of Artificial Sequence: Synthetic oligonucleotide
gaggtatttctacacagccatgtcccggc

SEQ ID NO: 36116 - DNA, 29 bp, Artificial Sequence
  Description of Artificial Sequence: Synthetic oligonucleotide
aggtatttctacacagccatgtcccggcc

SEQ ID NO: 36117 - DNA, 28 bp, Artificial Sequence
  Description of Artificial Sequence: Synthetic oligonucleotide
ggtatttctacacagccatgtcccggcc

SEQ ID NO: 36118 - DNA, 28 bp, Artificial Sequence
  Description of Artificial Sequence: Synthetic oligonucleotide
gtatttctacacagccatgtcccggccc

SEQ ID NO: 36119 - DNA, 28 bp, Artificial Sequence
  Description of Artificial Sequence: Synthetic oligonucleotide
tatttctacacagccatgtcccggcccg

SEQ ID NO: 36120 - DNA, 27 bp, Artificial Sequence
  Description of Artificial Sequence: Synthetic oligonucleotide
atttctacacagccatgtcccggcccg

SEQ ID NO: 36121 - DNA, 26 bp, Artificial Sequence
  Description of Artificial Sequence: Synthetic oligonucleotide
tttctacacagccatgtcccggcccg

SEQ ID NO: 36122 - DNA, 25 bp, Artificial Sequence
  Description of Artificial Sequence: Synthetic oligonucleotide
ttctacacagccatgtcccggcccg

SEQ ID NO: 36123 - DNA, 24 bp, Artificial Sequence
  Description of Artificial Sequence: Synthetic oligonucleotide
tctacacagccatgtcccggcccg

SEQ ID NO: 36124 - DNA, 23 bp, Artificial Sequence
  Description of Artificial Sequence: Synthetic oligonucleotide
ctacacagccatgtcccggcccg

SEQ ID NO: 36125 - DNA, 23 bp, Artificial Sequence
  Description of Artificial Sequence: Synthetic oligonucleotide
tacacagccatgtcccggcccgg

SEQ ID NO: 36126 - DNA, 22 bp, Artificial Sequence
  Description of Artificial Sequence: Synthetic oligonucleotide
acacagccatgtcccggcccgg

SEQ ID NO: 36127 - DNA, 21 bp, Artificial Sequence
  Description of Artificial Sequence: Synthetic oligonucleotide
cacagccatgtcccggcccgg

SEQ ID NO: 36128 - DNA, 21 bp, Artificial Sequence
  Description of Artificial Sequence: Synthetic oligonucleotide
acagccatgtcccggcccggc

SEQ ID NO: 36129 - DNA, 20 bp, Artificial Sequence
  Description of Artificial Sequence: Synthetic oligonucleotide
cagccatgtcccggcccggc

SEQ ID NO: 36130 - DNA, 20 bp, Artificial Sequence
  Description of Artificial Sequence: Synthetic oligonucleotide
agccatgtcccggcccggcc

SEQ ID NO: 36131 - DNA, 24 bp, Artificial Sequence
  Description of Artificial Sequence: Synthetic oligonucleotide
aacgggaaggagacgctgcagcgg

SEQ ID NO: 36132 - DNA, 23 bp, Artificial Sequence
  Description of Artificial Sequence: Synthetic oligonucleotide
acgggaaggagacgctgcagcgg

SEQ ID NO: 36133 - DNA, 22 bp, Artificial Sequence
  Description of Artificial Sequence: Synthetic oligonucleotide
cgggaaggagacgctgcagcgg

SEQ ID NO: 36134 - DNA, 22 bp, Artificial Sequence
  Description of Artificial Sequence: Synthetic oligonucleotide
gggaaggagacgctgcagcggg

SEQ ID NO: 36135 - DNA, 22 bp, Artificial Sequence
  Description of Artificial Sequence: Synthetic oligonucleotide
ggaaggagacgctgcagcgggc

SEQ ID NO: 36136 - DNA, 22 bp, Artificial Sequence
  Description of Artificial Sequence: Synthetic oligonucleotide
gaaggagacgctgcagcgggcg

SEQ ID NO: 36137 - DNA, 22 bp, Artificial Sequence
  Description of Artificial Sequence: Synthetic oligonucleotide
aaggagacgctgcagcgggcgg

SEQ ID NO: 36138 - DNA, 27 bp, Artificial Sequence
  Description of Artificial Sequence: Synthetic oligonucleotide
ctccgctactacaaccagagcgaggct

SEQ ID NO: 36139 - DNA, 27 bp, Artificial Sequence
  Description of Artificial Sequence: Synthetic oligonucleotide
tccgctactacaaccagagcgaggctg

SEQ ID NO: 36140 - DNA, 26 bp, Artificial Sequence
  Description of Artificial Sequence: Synthetic oligonucleotide
ccgctactacaaccagagcgaggctg

SEQ ID NO: 36141 - DNA, 26 bp, Artificial Sequence
  Description of Artificial Sequence: Synthetic oligonucleotide
cgctactacaaccagagcgaggctgg

SEQ ID NO: 36142 - DNA, 27 bp, Artificial Sequence
  Description of Artificial Sequence: Synthetic oligonucleotide
gctactacaaccagagcgaggctgggt

SEQ ID NO: 36143 - DNA, 27 bp, Artificial Sequence
  Description of Artificial Sequence: Synthetic oligonucleotide
ctactacaaccagagcgaggctgggtc

SEQ ID NO: 36144 - DNA, 28 bp, Artificial Sequence
  Description of Artificial Sequence: Synthetic oligonucleotide
tactacaaccagagcgaggctgggtctc

SEQ ID NO: 36145 - DNA, 27 bp, Artificial Sequence
  Description of Artificial Sequence: Synthetic oligonucleotide
actacaaccagagcgaggctgggtctc

SEQ ID NO: 36146 - DNA, 27 bp, Artificial Sequence
  Description of Artificial Sequence: Synthetic oligonucleotide
ctacaaccagagcgaggctgggtctca

SEQ ID NO: 36147 - DNA, 27 bp, Artificial Sequence
  Description of Artificial Sequence: Synthetic oligonucleotide
tacaaccagagcgaggctgggtctcac

SEQ ID NO: 36148 - DNA, 27 bp, Artificial Sequence
  Description of Artificial Sequence: Synthetic oligonucleotide
acaaccagagcgaggctgggtctcaca

SEQ ID NO: 36149 - DNA, 27 bp, Artificial Sequence
  Description of Artificial Sequence: Synthetic oligonucleotide
caaccagagcgaggctgggtctcacat

SEQ ID NO: 36150 - DNA, 27 bp, Artificial Sequence
  Description of Artificial Sequence: Synthetic oligonucleotide
aaccagagcgaggctgggtctcacatc

SEQ ID NO: 36151 - DNA, 27 bp, Artificial Sequence
  Description of Artificial Sequence: Synthetic oligonucleotide
accagagcgaggctgggtctcacatca

SEQ ID NO: 36152 - DNA, 27 bp, Artificial Sequence
  Description of Artificial Sequence: Synthetic oligonucleotide
ccagagcgaggctgggtctcacatcat

SEQ ID NO: 36153 - DNA, 27 bp, Artificial Sequence
  Description of Artificial Sequence: Synthetic oligonucleotide
cagagcgaggctgggtctcacatcatc

SEQ ID NO: 36154 - DNA, 27 bp, Artificial Sequence
  Description of Artificial Sequence: Synthetic oligonucleotide
agagcgaggctgggtctcacatcatcc

SEQ ID NO: 36155 - DNA, 27 bp, Artificial Sequence
  Description of Artificial Sequence: Synthetic oligonucleotide
gagcgaggctgggtctcacatcatcca

SEQ ID NO: 36156 - DNA, 27 bp, Artificial Sequence
  Description of Artificial Sequence: Synthetic oligonucleotide
agcgaggctgggtctcacatcatccag

SEQ ID NO: 36157 - DNA, 27 bp, Artificial Sequence
  Description of Artificial Sequence: Synthetic oligonucleotide
gcgaggctgggtctcacatcatccaga

SEQ ID NO: 36158 - DNA, 27 bp, Artificial Sequence
  Description of Artificial Sequence: Synthetic oligonucleotide
cgaggctgggtctcacatcatccagag

SEQ ID NO: 36159 - DNA, 27 bp, Artificial Sequence
  Description of Artificial Sequence: Synthetic oligonucleotide
gaggctgggtctcacatcatccagagg

SEQ ID NO: 36160 - DNA, 29 bp, Artificial Sequence
  Description of Artificial Sequence: Synthetic oligonucleotide
aggctgggtctcacatcatccagaggatg

SEQ ID NO: 36161 - DNA, 28 bp, Artificial Sequence
  Description of Artificial Sequence: Synthetic oligonucleotide
ggctgggtctcacatcatccagaggatg

SEQ ID NO: 36162 - DNA, 30 bp, Artificial Sequence
  Description of Artificial Sequence: Synthetic oligonucleotide
gctgggtctcacatcatccagaggatgtac

SEQ ID NO: 36163 - DNA, 30 bp, Artificial Sequence
  Description of Artificial Sequence: Synthetic oligonucleotide
ctgggtctcacatcatccagaggatgtacg

SEQ ID NO: 36164 - DNA, 30 bp, Artificial Sequence
  Description of Artificial Sequence: Synthetic oligonucleotide
tgggtctcacatcatccagaggatgtacgg

SEQ ID NO: 36165 - DNA, 31 bp, Artificial Sequence
  Description of Artificial Sequence: Synthetic oligonucleotide
gctcacactccatgaggtatttctacaccgc

SEQ ID NO: 36166 - DNA, 31 bp, Artificial Sequence
  Description of Artificial Sequence: Synthetic oligonucleotide
ctcacactccatgaggtatttctacaccgcc

SEQ ID NO: 36167 - DNA, 33 bp, Artificial Sequence
  Description of Artificial Sequence: Synthetic oligonucleotide
tcacactccatgaggtatttctacaccgccatg

SEQ ID NO: 36168 - DNA, 32 bp, Artificial Sequence
  Description of Artificial Sequence: Synthetic oligonucleotide
cacactccatgaggtatttctacaccgccatg

SEQ ID NO: 36169 - DNA, 33 bp, Artificial Sequence
  Description of Artificial Sequence: Synthetic oligonucleotide
acactccatgaggtatttctacaccgccatgtc

SEQ ID NO: 36170 - DNA, 25 bp, Artificial Sequence
  Description of Artificial Sequence: Synthetic oligonucleotide
gacagagcctacctggagggcctct

SEQ ID NO: 36171 - DNA, 25 bp, Artificial Sequence
  Description of Artificial Sequence: Synthetic oligonucleotide
acagagcctacctggagggcctctg

SEQ ID NO: 36172 - DNA, 24 bp, Artificial Sequence
  Description of Artificial Sequence: Synthetic oligonucleotide
cagagcctacctggagggcctctg

SEQ ID NO: 36173 - DNA, 24 bp, Artificial Sequence
  Description of Artificial Sequence: Synthetic oligonucleotide
agagcctacctggagggcctctgc

SEQ ID NO: 36174 - DNA, 23 bp, Artificial Sequence
  Description of Artificial Sequence: Synthetic oligonucleotide
gagcctacctggagggcctctgc

SEQ ID NO: 36175 - DNA, 24 bp, Artificial Sequence
  Description of Artificial Sequence: Synthetic oligonucleotide
agcctacctggagggcctctgcgt

SEQ ID NO: 36176 - DNA, 23 bp, Artificial Sequence
  Description of Artificial Sequence: Synthetic oligonucleotide
gcctacctggagggcctctgcgt

SEQ ID NO: 36177 - DNA, 23 bp, Artificial Sequence
  Description of Artificial Sequence: Synthetic oligonucleotide
cctacctggagggcctctgcgtg

SEQ ID NO: 36178 - DNA, 24 bp, Artificial Sequence
  Description of Artificial Sequence: Synthetic oligonucleotide
ctacctggagggcctctgcgtgga

SEQ ID NO: 36179 - DNA, 25 bp, Artificial Sequence
  Description of Artificial Sequence: Synthetic oligonucleotide
tacctggagggcctctgcgtggagt

SEQ ID NO: 36180 - DNA, 24 bp, Artificial Sequence
  Description of Artificial Sequence: Synthetic oligonucleotide
acctggagggcctctgcgtggagt

SEQ ID NO: 36181 - DNA, 23 bp, Artificial Sequence
  Description of Artificial Sequence: Synthetic oligonucleotide
cctggagggcctctgcgtggagt

SEQ ID NO: 36182 - DNA, 23 bp, Artificial Sequence
  Description of Artificial Sequence: Synthetic oligonucleotide
ctggagggcctctgcgtggagtc

SEQ ID NO: 36183 - DNA, 23 bp, Artificial Sequence
  Description of Artificial Sequence: Synthetic oligonucleotide
tggagggcctctgcgtggagtcg

SEQ ID NO: 36184 - DNA, 22 bp, Artificial Sequence
  Description of Artificial Sequence: Synthetic oligonucleotide
ggagggcctctgcgtggagtcg

SEQ ID NO: 36185 - DNA, 23 bp, Artificial Sequence
  Description of Artificial Sequence: Synthetic oligonucleotide
gagggcctctgcgtggagtcgct

SEQ ID NO: 36186 - DNA, 23 bp, Artificial Sequence
  Description of Artificial Sequence: Synthetic oligonucleotide
agggcctctgcgtggagtcgctc

SEQ ID NO: 36187 - DNA, 22 bp, Artificial Sequence
  Description of Artificial Sequence: Synthetic oligonucleotide
gggcctctgcgtggagtcgctc

SEQ ID NO: 36188 - DNA, 22 bp, Artificial Sequence
  Description of Artificial Sequence: Synthetic oligonucleotide
ggcctctgcgtggagtcgctcc

SEQ ID NO: 36189 - DNA, 22 bp, Artificial Sequence
  Description of Artificial Sequence: Synthetic oligonucleotide
gcctctgcgtggagtcgctccg

SEQ ID NO: 36190 - DNA, 23 bp, Artificial Sequence
  Description of Artificial Sequence: Synthetic oligonucleotide
cctctgcgtggagtcgctccgca

SEQ ID NO: 36191 - DNA, 26 bp, Artificial Sequence
  Description of Artificial Sequence: Synthetic oligonucleotide
ctctgcgtggagtcgctccgcagata

SEQ ID NO: 36192 - DNA, 26 bp, Artificial Sequence
  Description of Artificial Sequence: Synthetic oligonucleotide
tctgcgtggagtcgctccgcagatac

SEQ ID NO: 36193 - DNA, 25 bp, Artificial Sequence
  Description of Artificial Sequence: Synthetic oligonucleotide
ctgcgtggagtcgctccgcagatac

SEQ ID NO: 36194 - DNA, 28 bp, Artificial Sequence
  Description of Artificial Sequence: Synthetic oligonucleotide
cgggtctcacacttggcagaggatgtac

SEQ ID NO: 36195 - DNA, 28 bp, Artificial Sequence
  Description of Artificial Sequence: Synthetic oligonucleotide
gggtctcacacttggcagaggatgtacg

SEQ ID NO: 36196 - DNA, 28 bp, Artificial Sequence
  Description of Artificial Sequence: Synthetic oligonucleotide
ggtctcacacttggcagaggatgtacgg

SEQ ID NO: 36197 - DNA, 28 bp, Artificial Sequence
  Description of Artificial Sequence: Synthetic oligonucleotide
gtctcacacttggcagaggatgtacggc

SEQ ID NO: 36198 - DNA, 29 bp, Artificial Sequence
  Description of Artificial Sequence: Synthetic oligonucleotide
tctcacacttggcagaggatgtacggctg

SEQ ID NO: 36199 - DNA, 28 bp, Artificial Sequence
  Description of Artificial Sequence: Synthetic oligonucleotide
ctcacacttggcagaggatgtacggctg

SEQ ID NO: 36200 - DNA, 28 bp, Artificial Sequence
  Description of Artificial Sequence: Synthetic oligonucleotide
tcacacttggcagaggatgtacggctgc

SEQ ID NO: 36201 - DNA, 27 bp, Artificial Sequence
  Description of Artificial Sequence: Synthetic oligonucleotide
cacacttggcagaggatgtacggctgc

SEQ ID NO: 36202 - DNA, 27 bp, Artificial Sequence
  Description of Artificial Sequence: Synthetic oligonucleotide
acacttggcagaggatgtacggctgcg

SEQ ID NO: 36203 - DNA, 27 bp, Artificial Sequence
  Description of Artificial Sequence: Synthetic oligonucleotide
cacttggcagaggatgtacggctgcga

SEQ ID NO: 36204 - DNA, 27 bp, Artificial Sequence
  Description of Artificial Sequence: Synthetic oligonucleotide
acttggcagaggatgtacggctgcgac

SEQ ID NO: 36205 - DNA, 26 bp, Artificial Sequence
  Description of Artificial Sequence: Synthetic oligonucleotide
cttggcagaggatgtacggctgcgac

SEQ ID NO: 36206 - DNA, 27 bp, Artificial Sequence
  Description of Artificial Sequence: Synthetic oligonucleotide
ttggcagaggatgtacggctgcgacgt

SEQ ID NO: 36207 - DNA, 26 bp, Artificial Sequence
  Description of Artificial Sequence: Synthetic oligonucleotide
tggcagaggatgtacggctgcgacgt

SEQ ID NO: 36208 - DNA, 25 bp, Artificial Sequence
  Description of Artificial Sequence: Synthetic oligonucleotide
ggcagaggatgtacggctgcgacgt

SEQ ID NO: 36209 - DNA, 25 bp, Artificial Sequence
  Description of Artificial Sequence: Synthetic oligonucleotide
gcagaggatgtacggctgcgacgtg

SEQ ID NO: 36210 - DNA, 25 bp, Artificial Sequence
  Description of Artificial Sequence: Synthetic oligonucleotide
tggagggcctgtgcgtggagtcgtt

SEQ ID NO: 36211 - DNA, 24 bp, Artificial Sequence
  Description of Artificial Sequence: Synthetic oligonucleotide
ggagggcctgtgcgtggagtcgtt

SEQ ID NO: 36212 - DNA, 24 bp, Artificial Sequence
  Description of Artificial Sequence: Synthetic oligonucleotide
gagggcctgtgcgtggagtcgttc

SEQ ID NO: 36213 - DNA, 24 bp, Artificial Sequence
  Description of Artificial Sequence: Synthetic oligonucleotide
agggcctgtgcgtggagtcgttcc

SEQ ID NO: 36214 - DNA, 23 bp, Artificial Sequence
  Description of Artificial Sequence: Synthetic oligonucleotide
gggcctgtgcgtggagtcgttcc

SEQ ID NO: 36215 - DNA, 23 bp, Artificial Sequence
  Description of Artificial Sequence: Synthetic oligonucleotide
ggcctgtgcgtggagtcgttccg

SEQ ID NO: 36216 - DNA, 24 bp, Artificial Sequence
  Description of Artificial Sequence: Synthetic oligonucleotide
gcctgtgcgtggagtcgttccgca

SEQ ID NO: 36217 - DNA, 27 bp, Artificial Sequence
  Description of Artificial Sequence: Synthetic oligonucleotide
cctgtgcgtggagtcgttccgcagata

SEQ ID NO: 36218 - DNA, 27 bp, Artificial Sequence
  Description of Artificial Sequence: Synthetic oligonucleotide
ctgtgcgtggagtcgttccgcagatac

SEQ ID NO: 36219 - DNA, 27 bp, Artificial Sequence
  Description of Artificial Sequence: Synthetic oligonucleotide
tgtgcgtggagtcgttccgcagatacc

SEQ ID NO: 36220 - DNA, 27 bp, Artificial Sequence
  Description of Artificial Sequence: Synthetic oligonucleotide
gtgcgtggagtcgttccgcagatacct

SEQ ID NO: 36221 - DNA, 27 bp, Artificial Sequence
  Description of Artificial Sequence: Synthetic oligonucleotide
tgcgtggagtcgttccgcagatacctg

SEQ ID NO: 36222 - DNA, 26 bp, Artificial Sequence
  Description of Artificial Sequence: Synthetic oligonucleotide
gcgtggagtcgttccgcagatacctg

SEQ ID NO: 36223 - DNA, 27 bp, Artificial Sequence
  Description of Artificial Sequence: Synthetic oligonucleotide
cgtggagtcgttccgcagatacctgga

SEQ ID NO: 36224 - DNA, 27 bp, Artificial Sequence
  Description of Artificial Sequence: Synthetic oligonucleotide
gtggagtcgttccgcagatacctggag

SEQ ID NO: 36225 - DNA, 29 bp, Artificial Sequence
  Description of Artificial Sequence: Synthetic oligonucleotide
tggagtcgttccgcagatacctggagaac

SEQ ID NO: 36226 - DNA, 28 bp, Artificial Sequence
  Description of Artificial Sequence: Synthetic oligonucleotide
ggagtcgttccgcagatacctggagaac

SEQ ID NO: 36227 - DNA, 28 bp, Artificial Sequence
  Description of Artificial Sequence: Synthetic oligonucleotide
gagtcgttccgcagatacctggagaacg

SEQ ID NO: 36228 - DNA, 28 bp, Artificial Sequence
  Description of Artificial Sequence: Synthetic oligonucleotide
agtcgttccgcagatacctggagaacgg

SEQ ID NO: 36229 - DNA, 27 bp, Artificial Sequence
  Description of Artificial Sequence: Synthetic oligonucleotide
gtcgttccgcagatacctggagaacgg

SEQ ID NO: 36230 - DNA, 27 bp, Artificial Sequence
  Description of Artificial Sequence: Synthetic oligonucleotide
tcgttccgcagatacctggagaacggg

SEQ ID NO: 36231 - DNA, 27 bp, Artificial Sequence
  Description of Artificial Sequence: Synthetic oligonucleotide
cgttccgcagatacctggagaacggga

SEQ ID NO: 36232 - DNA, 23 bp, Artificial Sequence
  Description of Artificial Sequence: Synthetic oligonucleotide
cgcaagtgggaggcggcctgtgt

SEQ ID NO: 36233 - DNA, 23 bp, Artificial Sequence
  Description of Artificial Sequence: Synthetic oligonucleotide
gcaagtgggaggcggcctgtgtg

SEQ ID NO: 36234 - DNA, 23 bp, Artificial Sequence
  Description of Artificial Sequence: Synthetic oligonucleotide
caagtgggaggcggcctgtgtgg

SEQ ID NO: 36235 - DNA, 23 bp, Artificial Sequence
  Description of Artificial Sequence: Synthetic oligonucleotide
aagtgggaggcggcctgtgtggc

SEQ ID NO: 36236 - DNA, 22 bp, Artificial Sequence
  Description of Artificial Sequence: Synthetic oligonucleotide
agtgggaggcggcctgtgtggc

SEQ ID NO: 36237 - DNA, 21 bp, Artificial Sequence
  Description of Artificial Sequence: Synthetic oligonucleotide
gtgggaggcggcctgtgtggc

SEQ ID NO: 36238 - DNA, 21 bp, Artificial Sequence
  Description of Artificial Sequence: Synthetic oligonucleotide
tgggaggcggcctgtgtggcg

SEQ ID NO: 36239 - DNA, 20 bp, Artificial Sequence
  Description of Artificial Sequence: Synthetic oligonucleotide
gggaggcggcctgtgtggcg

SEQ ID NO: 36240 - DNA, 21 bp, Artificial Sequence
  Description of Artificial Sequence: Synthetic oligonucleotide
ggaggcggcctgtgtggcgga

SEQ ID NO: 36241 - DNA, 21 bp, Artificial Sequence
  Description of Artificial Sequence: Synthetic oligonucleotide
gaggcggcctgtgtggcggag

SEQ ID NO: 36242 - DNA, 22 bp, Artificial Sequence
  Description of Artificial Sequence: Synthetic oligonucleotide
aggcggcctgtgtggcggagca

SEQ ID NO: 36243 - DNA, 21 bp, Artificial Sequence
  Description of Artificial Sequence: Synthetic oligonucleotide
ggcggcctgtgtggcggagca

SEQ ID NO: 36244 - DNA, 21 bp, Artificial Sequence
  Description of Artificial Sequence: Synthetic oligonucleotide
gcggcctgtgtggcggagcag

SEQ ID NO: 36245 - DNA, 22 bp, Artificial Sequence
  Description of Artificial Sequence: Synthetic oligonucleotide
cggcctgtgtggcggagcagga

SEQ ID NO: 36246 - DNA, 23 bp, Artificial Sequence
  Description of Artificial Sequence: Synthetic oligonucleotide
ggcctgtgtggcggagcaggaca

SEQ ID NO: 36247 - DNA, 24 bp, Artificial Sequence
  Description of Artificial Sequence: Synthetic oligonucleotide
gcctgtgtggcggagcaggacaga

SEQ ID NO: 36248 - DNA, 24 bp, Artificial Sequence
  Description of Artificial Sequence: Synthetic oligonucleotide
cctgtgtggcggagcaggacagag

SEQ ID NO: 36249 - DNA, 24 bp, Artificial Sequence
  Description of Artificial Sequence: Synthetic oligonucleotide
ctgtgtggcggagcaggacagagc

SEQ ID NO: 36250 - DNA, 26 bp, Artificial Sequence
  Description of Artificial Sequence: Synthetic oligonucleotide
tgtgtggcggagcaggacagagccta

SEQ ID NO: 36251 - DNA, 26 bp, Artificial Sequence
  Description of Artificial Sequence: Synthetic oligonucleotide
tggagtcgctccgcagatacctggag

SEQ ID NO: 36252 - DNA, 25 bp, Artificial Sequence
  Description of Artificial Sequence: Synthetic oligonucleotide
ggagtcgctccgcagatacctggag

SEQ ID NO: 36253 - DNA, 26 bp, Artificial Sequence
  Description of Artificial Sequence: Synthetic oligonucleotide
gagtcgctccgcagatacctggagga

SEQ ID NO: 36254 - DNA, 26 bp, Artificial Sequence
  Description of Artificial Sequence: Synthetic oligonucleotide
agtcgctccgcagatacctggaggac

SEQ ID NO: 36255 - DNA, 25 bp, Artificial Sequence
  Description of Artificial Sequence: Synthetic oligonucleotide
gtcgctccgcagatacctggaggac

SEQ ID NO: 36256 - DNA, 25 bp, Artificial Sequence
  Description of Artificial Sequence: Synthetic oligonucleotide
tcgctccgcagatacctggaggacg

SEQ ID NO: 36257 - DNA, 24 bp, Artificial Sequence
  Description of Artificial Sequence: Synthetic oligonucleotide
cgctccgcagatacctggaggacg

SEQ ID NO: 36258 - DNA, 24 bp, Artificial Sequence
  Description of Artificial Sequence: Synthetic oligonucleotide
gctccgcagatacctggaggacgg

SEQ ID NO: 36259 - DNA, 26 bp, Artificial Sequence
  Description of Artificial Sequence: Synthetic oligonucleotide
ctccgcagatacctggaggacgggaa

SEQ ID NO: 36260 - DNA, 26 bp, Artificial Sequence
  Description of Artificial Sequence: Synthetic oligonucleotide
tccgcagatacctggaggacgggaag

SEQ ID NO: 36261 - DNA, 25 bp, Artificial Sequence
  Description of Artificial Sequence: Synthetic oligonucleotide
ccgcagatacctggaggacgggaag

SEQ ID NO: 36262 - DNA, 26 bp, Artificial Sequence
  Description of Artificial Sequence: Synthetic oligonucleotide
cgcagatacctggaggacgggaagga

SEQ ID NO: 36263 - DNA, 27 bp, Artificial Sequence
  Description of Artificial Sequence: Synthetic oligonucleotide
gcagatacctggaggacgggaaggaga

SEQ ID NO: 36264 - DNA, 27 bp, Artificial Sequence
  Description of Artificial Sequence: Synthetic oligonucleotide
cagatacctggaggacgggaaggagac

SEQ ID NO: 36265 - DNA, 27 bp, Artificial Sequence
  Description of Artificial Sequence: Synthetic oligonucleotide
agatacctggaggacgggaaggagacg

SEQ ID NO: 36266 - DNA, 26 bp, Artificial Sequence
  Description of Artificial Sequence: Synthetic oligonucleotide
gatacctggaggacgggaaggagacg

SEQ ID NO: 36267 - DNA, 27 bp, Artificial Sequence
  Description of Artificial Sequence: Synthetic oligonucleotide
atacctggaggacgggaaggagacgct

SEQ ID NO: 36268 - DNA, 26 bp, Artificial Sequence
  Description of Artificial Sequence: Synthetic oligonucleotide
tacctggaggacgggaaggagacgct

SEQ ID NO: 36269 - DNA, 25 bp, Artificial Sequence
  Description of Artificial Sequence: Synthetic oligonucleotide
acctggaggacgggaaggagacgct

SEQ ID NO: 36270 - DNA, 24 bp, Artificial Sequence
  Description of Artificial Sequence: Synthetic oligonucleotide
cctggaggacgggaaggagacgct

SEQ ID NO: 36271 - DNA, 24 bp, Artificial Sequence
  Description of Artificial Sequence: Synthetic oligonucleotide
ctggaggacgggaaggagacgctg

SEQ ID NO: 36272 - DNA, 25 bp, Artificial Sequence
  Description of Artificial Sequence: Synthetic oligonucleotide
tggaggacgggaaggagacgctgca

SEQ ID NO: 36273 - DNA, 24 bp, Artificial Sequence
  Description of Artificial Sequence: Synthetic oligonucleotide
ggaggacgggaaggagacgctgca

SEQ ID NO: 36274 - DNA, 24 bp, Artificial Sequence
  Description of Artificial Sequence: Synthetic oligonucleotide
gaggacgggaaggagacgctgcag

SEQ ID NO: 36275 - DNA, 24 bp, Artificial Sequence
  Description of Artificial Sequence: Synthetic oligonucleotide
aggacgggaaggagacgctgcagc

SEQ ID NO: 36276 - DNA, 23 bp, Artificial Sequence
  Description of Artificial Sequence: Synthetic oligonucleotide
ggacgggaaggagacgctgcagc

SEQ ID NO: 36277 - DNA, 23 bp, Artificial Sequence
  Description of Artificial Sequence: Synthetic oligonucleotide
gacgggaaggagacgctgcagcg

SEQ ID NO: 36278 - DNA, 23 bp, Artificial Sequence
  Description of Artificial Sequence: Synthetic oligonucleotide
gaaggagacgctgtagcgcgcgg

SEQ ID NO: 36279 - DNA, 27 bp, Artificial Sequence
  Description of Artificial Sequence: Synthetic oligonucleotide
agacttaccgagagaacctgcgcaccc

SEQ ID NO: 36280 - DNA, 26 bp, Artificial Sequence
  Description of Artificial Sequence: Synthetic oligonucleotide
gacttaccgagagaacctgcgcaccc

SEQ ID NO: 36281 - DNA, 26 bp, Artificial Sequence
  Description of Artificial Sequence: Synthetic oligonucleotide
acttaccgagagaacctgcgcacccc

SEQ ID NO: 36282 - DNA, 25 bp, Artificial Sequence
  Description of Artificial Sequence: Synthetic oligonucleotide
cttaccgagagaacctgcgcacccc

SEQ ID NO: 36283 - DNA, 25 bp, Artificial Sequence
  Description of Artificial Sequence: Synthetic oligonucleotide
ttaccgagagaacctgcgcaccccg

SEQ ID NO: 36284 - DNA, 24 bp, Artificial Sequence
  Description of Artificial Sequence: Synthetic oligonucleotide
taccgagagaacctgcgcaccccg

SEQ ID NO: 36285 - DNA, 23 bp, Artificial Sequence
  Description of Artificial Sequence: Synthetic oligonucleotide
accgagagaacctgcgcaccccg

SEQ ID NO: 36286 - DNA, 22 bp, Artificial Sequence
  Description of Artificial Sequence: Synthetic oligonucleotide
ccgagagaacctgcgcaccccg

SEQ ID NO: 36287 - DNA, 23 bp, Artificial Sequence
  Description of Artificial Sequence: Synthetic oligonucleotide
cgagagaacctgcgcaccccgct

SEQ ID NO: 36288 - DNA, 23 bp, Artificial Sequence
  Description of Artificial Sequence: Synthetic oligonucleotide
gagagaacctgcgcaccccgctc

SEQ ID NO: 36289 - DNA, 23 bp, Artificial Sequence
  Description of Artificial Sequence: Synthetic oligonucleotide
agagaacctgcgcaccccgctcc

SEQ ID NO: 36290 - DNA, 22 bp, Artificial Sequence
  Description of Artificial Sequence: Synthetic oligonucleotide
gagaacctgcgcaccccgctcc

SEQ ID NO: 36291 - DNA, 22 bp, Artificial Sequence
  Description of Artificial Sequence: Synthetic oligonucleotide
agaacctgcgcaccccgctccg

SEQ ID NO: 36292 - DNA, 21 bp, Artificial Sequence
  Description of Artificial Sequence: Synthetic oligonucleotide
gaacctgcgcaccccgctccg

SEQ ID NO: 36293 - DNA, 23 bp, Artificial Sequence
  Description of Artificial Sequence: Synthetic oligonucleotide
aacctgcgcaccccgctccgcta

SEQ ID NO: 36294 - DNA, 22 bp, Artificial Sequence
  Description of Artificial Sequence: Synthetic oligonucleotide
acctgcgcaccccgctccgcta

SEQ ID NO: 36295 - DNA, 21 bp, Artificial Sequence
  Description of Artificial Sequence: Synthetic oligonucleotide
cctgcgcaccccgctccgcta

SEQ ID NO: 36296 - DNA, 23 bp, Artificial Sequence
  Description of Artificial Sequence: Synthetic oligonucleotide
ctgcgcaccccgctccgctacta

SEQ ID NO: 36297 - DNA, 25 bp, Artificial Sequence
  Description of Artificial Sequence: Synthetic oligonucleotide
tgcgcaccccgctccgctactacaa

SEQ ID NO: 36298 - DNA, 24 bp, Artificial Sequence
  Description of Artificial Sequence: Synthetic oligonucleotide
gcgcaccccgctccgctactacaa

SEQ ID NO: 36299 - DNA, 24 bp, Artificial Sequence
  Description of Artificial Sequence: Synthetic oligonucleotide
cgcaccccgctccgctactacaac

SEQ ID NO: 36300 - DNA, 25 bp, Artificial Sequence
  Description of Artificial Sequence: Synthetic oligonucleotide
gcaccccgctccgctactacaacca

SEQ ID NO: 36301 - DNA, 26 bp, Artificial Sequence
  Description of Artificial Sequence: Synthetic oligonucleotide
caccccgctccgctactacaaccaga

SEQ ID NO: 36302 - DNA, 26 bp, Artificial Sequence
  Description of Artificial Sequence: Synthetic oligonucleotide
accccgctccgctactacaaccagag

SEQ ID NO: 36303 - DNA, 25 bp, Artificial Sequence
  Description of Artificial Sequence: Synthetic oligonucleotide
ccccgctccgctactacaaccagag

SEQ ID NO: 36304 - DNA, 25 bp, Artificial Sequence
  Description of Artificial Sequence: Synthetic oligonucleotide
cccgctccgctactacaaccagagc

SEQ ID NO: 36305 - DNA, 26 bp, Artificial Sequence
  Description of Artificial Sequence: Synthetic oligonucleotide
ccgctccgctactacaaccagagcga

SEQ ID NO: 36306 - DNA, 24 bp, Artificial Sequence
  Description of Artificial Sequence: Synthetic oligonucleotide
caggaggggccggagtattgggag

SEQ ID NO: 36307 - DNA, 24 bp, Artificial Sequence
  Description of Artificial Sequence: Synthetic oligonucleotide
aggaggggccggagtattgggagc

SEQ ID NO: 36308 - DNA, 23 bp, Artificial Sequence
  Description of Artificial Sequence: Synthetic oligonucleotide
ggaggggccggagtattgggagc

SEQ ID NO: 36309 - DNA, 23 bp, Artificial Sequence
  Description of Artificial Sequence: Synthetic oligonucleotide
gaggggccggagtattgggagcg

SEQ ID NO: 36310 - DNA, 23 bp, Artificial Sequence
  Description of Artificial Sequence: Synthetic oligonucleotide
aggggccggagtattgggagcgg

SEQ ID NO: 36311 - DNA, 22 bp, Artificial Sequence
  Description of Artificial Sequence: Synthetic oligonucleotide
ggggccggagtattgggagcgg

SEQ ID NO: 36312 - DNA, 23 bp, Artificial Sequence
  Description of Artificial Sequence: Synthetic oligonucleotide
gggccggagtattgggagcggga

SEQ ID NO: 36313 - DNA, 24 bp, Artificial Sequence
  Description of Artificial Sequence: Synthetic oligonucleotide
ggccggagtattgggagcgggaga

SEQ ID NO: 36314 - DNA, 25 bp, Artificial Sequence
  Description of Artificial Sequence: Synthetic oligonucleotide
gccggagtattgggagcgggagaca

SEQ ID NO: 36315 - DNA, 26 bp, Artificial Sequence
  Description of Artificial Sequence: Synthetic oligonucleotide
ccggagtattgggagcgggagacaca

SEQ ID NO: 36316 - DNA, 27 bp, Artificial Sequence
  Description of Artificial Sequence: Synthetic oligonucleotide
cggagtattgggagcgggagacacaga

SEQ ID NO: 36317 - DNA, 28 bp, Artificial Sequence
  Description of Artificial Sequence: Synthetic oligonucleotide
ggagtattgggagcgggagacacagatc

SEQ ID NO: 36318 - DNA, 29 bp, Artificial Sequence
  Description of Artificial Sequence: Synthetic oligonucleotide
gagtattgggagcgggagacacagatctc

SEQ ID NO: 36319 - DNA, 29 bp, Artificial Sequence
  Description of Artificial Sequence: Synthetic oligonucleotide
agtattgggagcgggagacacagatctcc

SEQ ID NO: 36320 - DNA, 28 bp, Artificial Sequence
  Description of Artificial Sequence: Synthetic oligonucleotide
gtattgggagcgggagacacagatctcc

SEQ ID NO: 36321 - DNA, 30 bp, Artificial Sequence
  Description of Artificial Sequence: Synthetic oligonucleotide
tattgggagcgggagacacagatctccaag

SEQ ID NO: 36322 - DNA, 29 bp, Artificial Sequence
  Description of Artificial Sequence: Synthetic oligonucleotide
attgggagcgggagacacagatctccaag

SEQ ID NO: 36323 - DNA, 28 bp, Artificial Sequence
  Description of Artificial Sequence: Synthetic oligonucleotide
ttgggagcgggagacacagatctccaag

SEQ ID NO: 36324 - DNA, 27 bp, Artificial Sequence
  Description of Artificial Sequence: Synthetic oligonucleotide
tgggagcgggagacacagatctccaag

SEQ ID NO: 36325 - DNA, 27 bp, Artificial Sequence
  Description of Artificial Sequence: Synthetic oligonucleotide
gggagcgggagacacagatctccaaga

SEQ ID NO: 36326 - DNA, 27 bp, Artificial Sequence
  Description of Artificial Sequence: Synthetic oligonucleotide
ggagcgggagacacagatctccaagac

SEQ ID NO: 36327 - DNA, 27 bp, Artificial Sequence
  Description of Artificial Sequence: Synthetic oligonucleotide
gagcgggagacacagatctccaagacc

SEQ ID NO: 36328 - DNA, 29 bp, Artificial Sequence
  Description of Artificial Sequence: Synthetic oligonucleotide
agcgggagacacagatctccaagaccaac

SEQ ID NO: 36329 - DNA, 28 bp, Artificial Sequence
  Description of Artificial Sequence: Synthetic oligonucleotide
gcgggagacacagatctccaagaccaac

SEQ ID NO: 36330 - DNA, 23 bp, Artificial Sequence
  Description of Artificial Sequence: Synthetic oligonucleotide
gcctcctccgcgggcataaccag

SEQ ID NO: 36331 - DNA, 24 bp, Artificial Sequence
  Description of Artificial Sequence: Synthetic oligonucleotide
cctcctccgcgggcataaccagga

SEQ ID NO: 36332 - DNA, 24 bp, Artificial Sequence
  Description of Artificial Sequence: Synthetic oligonucleotide
ctcctccgcgggcataaccaggac

SEQ ID NO: 36333 - DNA, 24 bp, Artificial Sequence
  Description of Artificial Sequence: Synthetic oligonucleotide
tcctccgcgggcataaccaggacg

SEQ ID NO: 36334 - DNA, 23 bp, Artificial Sequence
  Description of Artificial Sequence: Synthetic oligonucleotide
cctccgcgggcataaccaggacg

SEQ ID NO: 36335 - DNA, 23 bp, Artificial Sequence
  Description of Artificial Sequence: Synthetic oligonucleotide
ctccgcgggcataaccaggacgc

SEQ ID NO: 36336 - DNA, 25 bp, Artificial Sequence
  Description of Artificial Sequence: Synthetic oligonucleotide
tccgcgggcataaccaggacgccta

SEQ ID NO: 36337 - DNA, 24 bp, Artificial Sequence
  Description of Artificial Sequence: Synthetic oligonucleotide
ccgcgggcataaccaggacgccta

SEQ ID NO: 36338 - DNA, 24 bp, Artificial Sequence
  Description of Artificial Sequence: Synthetic oligonucleotide
cgcgggcataaccaggacgcctac

SEQ ID NO: 36339 - DNA, 25 bp, Artificial Sequence
  Description of Artificial Sequence: Synthetic oligonucleotide
gcgggcataaccaggacgcctacga

SEQ ID NO: 36340 - DNA, 25 bp, Artificial Sequence
  Description of Artificial Sequence: Synthetic oligonucleotide
cgggcataaccaggacgcctacgac

SEQ ID NO: 36341 - DNA, 25 bp, Artificial Sequence
  Description of Artificial Sequence: Synthetic oligonucleotide
gggcataaccaggacgcctacgacg

SEQ ID NO: 36342 - DNA, 25 bp, Artificial Sequence
  Description of Artificial Sequence: Synthetic oligonucleotide
ggcataaccaggacgcctacgacgg

SEQ ID NO: 36343 - DNA, 27 bp, Artificial Sequence
  Description of Artificial Sequence: Synthetic oligonucleotide
gcataaccaggacgcctacgacggcaa

SEQ ID NO: 36344 - DNA, 27 bp, Artificial Sequence
  Description of Artificial Sequence: Synthetic oligonucleotide
cataaccaggacgcctacgacggcaag

SEQ ID NO: 36345 - DNA, 27 bp, Artificial Sequence
  Description of Artificial Sequence: Synthetic oligonucleotide
ataaccaggacgcctacgacggcaagg

SEQ ID NO: 36346 - DNA, 27 bp, Artificial Sequence
  Description of Artificial Sequence: Synthetic oligonucleotide
taaccaggacgcctacgacggcaagga

SEQ ID NO: 36347 - DNA, 27 bp, Artificial Sequence
  Description of Artificial Sequence: Synthetic oligonucleotide
aaccaggacgcctacgacggcaaggat

SEQ ID NO: 36348 - DNA, 22 bp, Artificial Sequence
  Description of Artificial Sequence: Synthetic oligonucleotide
atgcggtcacggcgccccgaac

SEQ ID NO: 36349 - DNA, 21 bp, Artificial Sequence
  Description of Artificial Sequence: Synthetic oligonucleotide
tgcggtcacggcgccccgaac

SEQ ID NO: 36350 - DNA, 20 bp, Artificial Sequence
  Description of Artificial Sequence: Synthetic oligonucleotide
gcggtcacggcgccccgaac

SEQ ID NO: 36351 - DNA, 20 bp, Artificial Sequence
  Description of Artificial Sequence: Synthetic oligonucleotide
cggtcacggcgccccgaacc

SEQ ID NO: 36352 - DNA, 21 bp, Artificial Sequence
  Description of Artificial Sequence: Synthetic oligonucleotide
cgcggcggacaccgcggctta

SEQ ID NO: 36353 - DNA, 23 bp, Artificial Sequence
  Description of Artificial Sequence: Synthetic oligonucleotide
gcggcggacaccgcggcttagat

SEQ ID NO: 36354 - DNA, 24 bp, Artificial Sequence
  Description of Artificial Sequence: Synthetic oligonucleotide
cggcggacaccgcggcttagatca

SEQ ID NO: 36355 - DNA, 24 bp, Artificial Sequence
  Description of Artificial Sequence: Synthetic oligonucleotide
ggcggacaccgcggcttagatcac

SEQ ID NO: 36356 - DNA, 24 bp, Artificial Sequence
  Description of Artificial Sequence: Synthetic oligonucleotide
gcggacaccgcggcttagatcacc

SEQ ID NO: 36357 - DNA, 25 bp, Artificial Sequence
  Description of Artificial Sequence: Synthetic oligonucleotide
cggacaccgcggcttagatcaccca

SEQ ID NO: 36358 - DNA, 25 bp, Artificial Sequence
  Description of Artificial Sequence: Synthetic oligonucleotide
ggacaccgcggcttagatcacccag

SEQ ID NO: 36359 - DNA, 25 bp, Artificial Sequence
  Description of Artificial Sequence: Synthetic oligonucleotide
gacaccgcggcttagatcacccagc

SEQ ID NO: 36360 - DNA, 25 bp, Artificial Sequence
  Description of Artificial Sequence: Synthetic oligonucleotide
acaccgcggcttagatcacccagcg

SEQ ID NO: 36361 - DNA, 24 bp, Artificial Sequence
  Description of Artificial Sequence: Synthetic oligonucleotide
caccgcggcttagatcacccagcg

SEQ ID NO: 36362 - DNA, 26 bp, Artificial Sequence
  Description of Artificial Sequence: Synthetic oligonucleotide
accgcggcttagatcacccagcgcaa

SEQ ID NO: 36363 - DNA, 25 bp, Artificial Sequence
  Description of Artificial Sequence: Synthetic oligonucleotide
ccgcggcttagatcacccagcgcaa

SEQ ID NO: 36364 - DNA, 26 bp, Artificial Sequence
  Description of Artificial Sequence: Synthetic oligonucleotide
cgcggcttagatcacccagcgcaagt

SEQ ID NO: 36365 - DNA, 26 bp, Artificial Sequence
  Description of Artificial Sequence: Synthetic oligonucleotide
gcggcttagatcacccagcgcaagtg

SEQ ID NO: 36366 - DNA, 26 bp, Artificial Sequence
  Description of Artificial Sequence: Synthetic oligonucleotide
cggcttagatcacccagcgcaagtgg

SEQ ID NO: 36367 - DNA, 27 bp, Artificial Sequence
  Description of Artificial Sequence: Synthetic oligonucleotide
ggcttagatcacccagcgcaagtggga

SEQ ID NO: 36368 - DNA, 27 bp, Artificial Sequence
  Description of Artificial Sequence: Synthetic oligonucleotide
gcttagatcacccagcgcaagtgggag

SEQ ID NO: 36369 - DNA, 27 bp, Artificial Sequence
  Description of Artificial Sequence: Synthetic oligonucleotide
cttagatcacccagcgcaagtgggagg

SEQ ID NO: 36370 - DNA, 27 bp, Artificial Sequence
  Description of Artificial Sequence: Synthetic oligonucleotide
ttagatcacccagcgcaagtgggaggc

SEQ ID NO: 36371 - DNA, 26 bp, Artificial Sequence
  Description of Artificial Sequence: Synthetic oligonucleotide
tagatcacccagcgcaagtgggaggc

SEQ ID NO: 36372 - DNA, 26 bp, Artificial Sequence
  Description of Artificial Sequence: Synthetic oligonucleotide
tgggctacgtggacgacacgctgttg

SEQ ID NO: 36373 - DNA, 25 bp, Artificial Sequence
  Description of Artificial Sequence: Synthetic oligonucleotide
gggctacgtggacgacacgctgttg

SEQ ID NO: 36374 - DNA, 26 bp, Artificial Sequence
  Description of Artificial Sequence: Synthetic oligonucleotide
ggctacgtggacgacacgctgttggt

SEQ ID NO: 36375 - DNA, 27 bp, Artificial Sequence
  Description of Artificial Sequence: Synthetic oligonucleotide
gctacgtggacgacacgctgttggtga

SEQ ID NO: 36376 - DNA, 27 bp, Artificial Sequence
  Description of Artificial Sequence: Synthetic oligonucleotide
ctacgtggacgacacgctgttggtgag

SEQ ID NO: 36377 - DNA, 27 bp, Artificial Sequence
  Description of Artificial Sequence: Synthetic oligonucleotide
tacgtggacgacacgctgttggtgagg

SEQ ID NO: 36378 - DNA, 27 bp, Artificial Sequence
  Description of Artificial Sequence: Synthetic oligonucleotide
acgtggacgacacgctgttggtgaggt

SEQ ID NO: 36379 - DNA, 27 bp, Artificial Sequence
  Description of Artificial Sequence: Synthetic oligonucleotide
cgtggacgacacgctgttggtgaggtt

SEQ ID NO: 36380 - DNA, 27 bp, Artificial Sequence
  Description of Artificial Sequence: Synthetic oligonucleotide
gtggacgacacgctgttggtgaggttc

SEQ ID NO: 36381 - DNA, 27 bp, Artificial Sequence
  Description of Artificial Sequence: Synthetic oligonucleotide
tggacgacacgctgttggtgaggttcg

SEQ ID NO: 36382 - DNA, 27 bp, Artificial Sequence
  Description of Artificial Sequence: Synthetic oligonucleotide
ggacgacacgctgttggtgaggttcga

SEQ ID NO: 36383 - DNA, 27 bp, Artificial Sequence
  Description of Artificial Sequence: Synthetic oligonucleotide
gacgacacgctgttggtgaggttcgac

SEQ ID NO: 36384 - DNA, 28 bp, Artificial Sequence
  Description of Artificial Sequence: Synthetic oligonucleotide
acgacacgctgttggtgaggttcgacag

SEQ ID NO: 36385 - DNA, 27 bp, Artificial Sequence
  Description of Artificial Sequence: Synthetic oligonucleotide
cgacacgctgttggtgaggttcgacag

SEQ ID NO: 36386 - DNA, 27 bp, Artificial Sequence
  Description of Artificial Sequence: Synthetic oligonucleotide
gacacgctgttggtgaggttcgacagc

SEQ ID NO: 36387 - DNA, 27 bp, Artificial Sequence
  Description of Artificial Sequence: Synthetic oligonucleotide
acacgctgttggtgaggttcgacagcg

SEQ ID NO: 36388 - DNA, 27 bp, Artificial Sequence
  Description of Artificial Sequence: Synthetic oligonucleotide
cacgctgttggtgaggttcgacagcga

SEQ ID NO: 36389 - DNA, 27 bp, Artificial Sequence
  Description of Artificial Sequence: Synthetic oligonucleotide
acgctgttggtgaggttcgacagcgac

SEQ ID NO: 36390 - DNA, 26 bp, Artificial Sequence
  Description of Artificial Sequence: Synthetic oligonucleotide
cgctgttggtgaggttcgacagcgac

SEQ ID NO: 36391 - DNA, 26 bp, Artificial Sequence
  Description of Artificial Sequence: Synthetic oligonucleotide
gctgttggtgaggttcgacagcgacg

SEQ ID NO: 36392 - DNA, 26 bp, Artificial Sequence
  Description of Artificial Sequence: Synthetic oligonucleotide
ctgttggtgaggttcgacagcgacgc

SEQ ID NO: 36393 - DNA, 27 bp, Artificial Sequence
  Description of Artificial Sequence: Synthetic oligonucleotide
tgttggtgaggttcgacagcgacgcca

SEQ ID NO: 36394 - DNA, 26 bp, Artificial Sequence
  Description of Artificial Sequence: Synthetic oligonucleotide
gttggtgaggttcgacagcgacgcca

SEQ ID NO: 36395 - DNA, 26 bp, Artificial Sequence
  Description of Artificial Sequence: Synthetic oligonucleotide
ttggtgaggttcgacagcgacgccac

SEQ ID NO: 36396 - DNA, 25 bp, Artificial Sequence
  Description of Artificial Sequence: Synthetic oligonucleotide
tggtgaggttcgacagcgacgccac

SEQ ID NO: 36397 - DNA, 24 bp, Artificial Sequence
  Description of Artificial Sequence: Synthetic oligonucleotide
ggtgaggttcgacagcgacgccac

SEQ ID NO: 36398 - DNA, 23 bp, Artificial Sequence
  Description of Artificial Sequence: Synthetic oligonucleotide
agcctacctggagggcctgtgcg

SEQ ID NO: 36399 - DNA, 22 bp, Artificial Sequence
  Description of Artificial Sequence: Synthetic oligonucleotide
gcctacctggagggcctgtgcg

SEQ ID NO: 36400 - DNA, 22 bp, Artificial Sequence
  Description of Artificial Sequence: Synthetic oligonucleotide
cctacctggagggcctgtgcgc

SEQ ID NO: 36401 - DNA, 22 bp, Artificial Sequence
  Description of Artificial Sequence: Synthetic oligonucleotide
ctacctggagggcctgtgcgcg

SEQ ID NO: 36402 - DNA, 23 bp, Artificial Sequence
  Description of Artificial Sequence: Synthetic oligonucleotide
tacctggagggcctgtgcgcgga

SEQ ID NO: 36403 - DNA, 22 bp, Artificial Sequence
  Description of Artificial Sequence: Synthetic oligonucleotide
acctggagggcctgtgcgcgga

SEQ ID NO: 36404 - DNA, 21 bp, Artificial Sequence
  Description of Artificial Sequence: Synthetic oligonucleotide
cctggagggcctgtgcgcgga

SEQ ID NO: 36405 - DNA, 22 bp, Artificial Sequence
  Description of Artificial Sequence: Synthetic oligonucleotide
ctggagggcctgtgcgcggagt

SEQ ID NO: 36406 - DNA, 22 bp, Artificial Sequence
  Description of Artificial Sequence: Synthetic oligonucleotide
tggagggcctgtgcgcggagtc

SEQ ID NO: 36407 - DNA, 21 bp, Artificial Sequence
  Description of Artificial Sequence: Synthetic oligonucleotide
ggagggcctgtgcgcggagtc

SEQ ID NO: 36408 - DNA, 21 bp, Artificial Sequence
  Description of Artificial Sequence: Synthetic oligonucleotide
gagggcctgtgcgcggagtcg

SEQ ID NO: 36409 - DNA, 22 bp, Artificial Sequence
  Description of Artificial Sequence: Synthetic oligonucleotide
agggcctgtgcgcggagtcgct

SEQ ID NO: 36410 - DNA, 21 bp, Artificial Sequence
  Description of Artificial Sequence: Synthetic oligonucleotide
gggcctgtgcgcggagtcgct

SEQ ID NO: 36411 - DNA, 21 bp, Artificial Sequence
  Description of Artificial Sequence: Synthetic oligonucleotide
ggcctgtgcgcggagtcgctc

SEQ ID NO: 36412 - DNA, 21 bp, Artificial Sequence
  Description of Artificial Sequence: Synthetic oligonucleotide
gcctgtgcgcggagtcgctcc

SEQ ID NO: 36413 - DNA, 21 bp, Artificial Sequence
  Description of Artificial Sequence: Synthetic oligonucleotide
cctgtgcgcggagtcgctccg

SEQ ID NO: 36414 - DNA, 22 bp, Artificial Sequence
  Description of Artificial Sequence: Synthetic oligonucleotide
ctgtgcgcggagtcgctccgca

SEQ ID NO: 36415 - DNA, 25 bp, Artificial Sequence
  Description of Artificial Sequence: Synthetic oligonucleotide
tgtgcgcggagtcgctccgcagata

SEQ ID NO: 36416 - DNA, 24 bp, Artificial Sequence
  Description of Artificial Sequence: Synthetic oligonucleotide
gtgcgcggagtcgctccgcagata

SEQ ID NO: 36417 - DNA, 24 bp, Artificial Sequence
  Description of Artificial Sequence: Synthetic oligonucleotide
tgcgcggagtcgctccgcagatac

SEQ ID NO: 36418 - DNA, 23 bp, Artificial Sequence
  Description of Artificial Sequence: Synthetic oligonucleotide
gcgcggagtcgctccgcagatac

SEQ ID NO: 36419 - DNA, 24 bp, Artificial Sequence
  Description of Artificial Sequence: Synthetic oligonucleotide
cgcggagtcgctccgcagatacct

SEQ ID NO: 36420 - DNA, 24 bp, Artificial Sequence
  Description of Artificial Sequence: Synthetic oligonucleotide
gcggagtcgctccgcagatacctg

SEQ ID NO: 36421 - DNA, 25 bp, Artificial Sequence
  Description of Artificial Sequence: Synthetic oligonucleotide
cggagtcgctccgcagatacctgga

SEQ ID NO: 36422 - DNA, 29 bp, Artificial Sequence
  Description of Artificial Sequence: Synthetic oligonucleotide
gacgcctacgacggcaaggattacatcac

SEQ ID NO: 36423 - DNA, 29 bp, Artificial Sequence
  Description of Artificial Sequence: Synthetic oligonucleotide
acgcctacgacggcaaggattacatcacc

SEQ ID NO: 36424 - DNA, 28 bp, Artificial Sequence
  Description of Artificial Sequence: Synthetic oligonucleotide
cgcctacgacggcaaggattacatcacc

SEQ ID NO: 36425 - DNA, 28 bp, Artificial Sequence
  Description of Artificial Sequence: Synthetic oligonucleotide
gcctacgacggcaaggattacatcaccc

SEQ ID NO: 36426 - DNA, 29 bp, Artificial Sequence
  Description of Artificial Sequence: Synthetic oligonucleotide
cctacgacggcaaggattacatcaccctg

SEQ ID NO: 36427 - DNA, 31 bp, Artificial Sequence
  Description of Artificial Sequence: Synthetic oligonucleotide
ctacgacggcaaggattacatcaccctgaac

SEQ ID NO: 36428 - DNA, 31 bp, Artificial Sequence
  Description of Artificial Sequence: Synthetic oligonucleotide
tacgacggcaaggattacatcaccctgaacg

SEQ ID NO: 36429 - DNA, 30 bp, Artificial Sequence
  Description of Artificial Sequence: Synthetic oligonucleotide
acgacggcaaggattacatcaccctgaacg

SEQ ID NO: 36430 - DNA, 29 bp, Artificial Sequence
  Description of Artificial Sequence: Synthetic oligonucleotide
cgacggcaaggattacatcaccctgaacg

SEQ ID NO: 36431 - DNA, 30 bp, Artificial Sequence
  Description of Artificial Sequence: Synthetic oligonucleotide
gacggcaaggattacatcaccctgaacgag

SEQ ID NO: 36432 - DNA, 30 bp, Artificial Sequence
  Description of Artificial Sequence: Synthetic oligonucleotide
acggcaaggattacatcaccctgaacgagg

SEQ ID NO: 36433 - DNA, 29 bp, Artificial Sequence
  Description of Artificial Sequence: Synthetic oligonucleotide
cggcaaggattacatcaccctgaacgagg

SEQ ID NO: 36434 - DNA, 30 bp, Artificial Sequence
  Description of Artificial Sequence: Synthetic oligonucleotide
ggcaaggattacatcaccctgaacgaggac

SEQ ID NO: 36435 - DNA, 30 bp, Artificial Sequence
  Description of Artificial Sequence: Synthetic oligonucleotide
gcaaggattacatcaccctgaacgaggacc

SEQ ID NO: 36436 - DNA, 31 bp, Artificial Sequence
  Description of Artificial Sequence: Synthetic oligonucleotide
caaggattacatcaccctgaacgaggacctg

SEQ ID NO: 36437 - DNA, 32 bp, Artificial Sequence
  Description of Artificial Sequence: Synthetic oligonucleotide
aaggattacatcaccctgaacgaggacctgag

SEQ ID NO: 36438 - DNA, 31 bp, Artificial Sequence
  Description of Artificial Sequence: Synthetic oligonucleotide
aggattacatcaccctgaacgaggacctgag

SEQ ID NO: 36439 - DNA, 30 bp, Artificial Sequence
  Description of Artificial Sequence: Synthetic oligonucleotide
ggattacatcaccctgaacgaggacctgag

SEQ ID NO: 36440 - DNA, 30 bp, Artificial Sequence
  Description of Artificial Sequence: Synthetic oligonucleotide
gattacatcaccctgaacgaggacctgagc

SEQ ID NO: 36441 - DNA, 31 bp, Artificial Sequence
  Description of Artificial Sequence: Synthetic oligonucleotide
attacatcaccctgaacgaggacctgagctc

SEQ ID NO: 36442 - DNA, 30 bp, Artificial Sequence
  Description of Artificial Sequence: Synthetic oligonucleotide
ttacatcaccctgaacgaggacctgagctc

SEQ ID NO: 36443 - DNA, 29 bp, Artificial Sequence
  Description of Artificial Sequence: Synthetic oligonucleotide
tacatcaccctgaacgaggacctgagctc

SEQ ID NO: 36444 - DNA, 28 bp, Artificial Sequence
  Description of Artificial Sequence: Synthetic oligonucleotide
acatcaccctgaacgaggacctgagctc

SEQ ID NO: 36445 - DNA, 27 bp, Artificial Sequence
  Description of Artificial Sequence: Synthetic oligonucleotide
catcaccctgaacgaggacctgagctc

SEQ ID NO: 36446 - DNA, 27 bp, Artificial Sequence
  Description of Artificial Sequence: Synthetic oligonucleotide
atcaccctgaacgaggacctgagctcc

SEQ ID NO: 36447 - DNA, 27 bp, Artificial Sequence
  Description of Artificial Sequence: Synthetic oligonucleotide
tcaccctgaacgaggacctgagctcct

SEQ ID NO: 36448 - DNA, 26 bp, Artificial Sequence
  Description of Artificial Sequence: Synthetic oligonucleotide
caccctgaacgaggacctgagctcct

SEQ ID NO: 36449 - DNA, 26 bp, Artificial Sequence
  Description of Artificial Sequence: Synthetic oligonucleotide
accctgaacgaggacctgagctcctg

SEQ ID NO: 36450 - DNA, 23 bp, Artificial Sequence
  Description of Artificial Sequence: Synthetic oligonucleotide
ggcccgtgtggcggagcaggaaa

SEQ ID NO: 36451 - DNA, 24 bp, Artificial Sequence
  Description of Artificial Sequence: Synthetic oligonucleotide
gcccgtgtggcggagcaggaaaga

SEQ ID NO: 36452 - DNA, 24 bp, Artificial Sequence
  Description of Artificial Sequence: Synthetic oligonucleotide
cccgtgtggcggagcaggaaagag

SEQ ID NO: 36453 - DNA, 24 bp, Artificial Sequence
  Description of Artificial Sequence: Synthetic oligonucleotide
ccgtgtggcggagcaggaaagagc

SEQ ID NO: 36454 - DNA, 26 bp, Artificial Sequence
  Description of Artificial Sequence: Synthetic oligonucleotide
cgtgtggcggagcaggaaagagccta

SEQ ID NO: 36455 - DNA, 26 bp, Artificial Sequence
  Description of Artificial Sequence: Synthetic oligonucleotide
gtgtggcggagcaggaaagagcctac

SEQ ID NO: 36456 - DNA, 27 bp, Artificial Sequence
  Description of Artificial Sequence: Synthetic oligonucleotide
tgtggcggagcaggaaagagcctacct

SEQ ID NO: 36457 - DNA, 26 bp, Artificial Sequence
  Description of Artificial Sequence: Synthetic oligonucleotide
gtggcggagcaggaaagagcctacct

SEQ ID NO: 36458 - DNA, 26 bp, Artificial Sequence
  Description of Artificial Sequence: Synthetic oligonucleotide
tggcggagcaggaaagagcctacctg

SEQ ID NO: 36459 - DNA, 25 bp, Artificial Sequence
  Description of Artificial Sequence: Synthetic oligonucleotide
ggcggagcaggaaagagcctacctg

SEQ ID NO: 36460 - DNA, 26 bp, Artificial Sequence
  Description of Artificial Sequence: Synthetic oligonucleotide
gcggagcaggaaagagcctacctgga

SEQ ID NO: 36461 - DNA, 26 bp, Artificial Sequence
  Description of Artificial Sequence: Synthetic oligonucleotide
cggagcaggaaagagcctacctggag

SEQ ID NO: 36462 - DNA, 26 bp, Artificial Sequence
  Description of Artificial Sequence: Synthetic oligonucleotide
ggagcaggaaagagcctacctggagg

SEQ ID NO: 36463 - DNA, 26 bp, Artificial Sequence
  Description of Artificial Sequence: Synthetic oligonucleotide
gagcaggaaagagcctacctggaggg

SEQ ID NO: 36464 - DNA, 26 bp, Artificial Sequence
  Description of Artificial Sequence: Synthetic oligonucleotide
agcaggaaagagcctacctggagggc

SEQ ID NO: 36465 - DNA, 25 bp, Artificial Sequence
  Description of Artificial Sequence: Synthetic oligonucleotide
gcaggaaagagcctacctggagggc

SEQ ID NO: 36466 - DNA, 26 bp, Artificial Sequence
  Description of Artificial Sequence: Synthetic oligonucleotide
caggaaagagcctacctggagggcct

SEQ ID NO: 36467 - DNA, 27 bp, Artificial Sequence
  Description of Artificial Sequence: Synthetic oligonucleotide
aggaaagagcctacctggagggcctgt

SEQ ID NO: 36468 - DNA, 26 bp, Artificial Sequence
  Description of Artificial Sequence: Synthetic oligonucleotide
ggaaagagcctacctggagggcctgt

SEQ ID NO: 36469 - DNA, 26 bp, Artificial Sequence
  Description of Artificial Sequence: Synthetic oligonucleotide
gaaagagcctacctggagggcctgtg

SEQ ID NO: 36470 - DNA, 26 bp, Artificial Sequence
  Description of Artificial Sequence: Synthetic oligonucleotide
aaagagcctacctggagggcctgtgc

SEQ ID NO: 36471 - DNA, 25 bp, Artificial Sequence
  Description of Artificial Sequence: Synthetic oligonucleotide
aagagcctacctggagggcctgtgc

SEQ ID NO: 36472 - DNA, 20 bp, Artificial Sequence
  Description of Artificial Sequence: Synthetic oligonucleotide
acgtggggccggacgggctc

SEQ ID NO: 36473 - DNA, 20 bp, Artificial Sequence
  Description of Artificial Sequence: Synthetic oligonucleotide
cgtggggccggacgggctct

SEQ ID NO: 36474 - DNA, 20 bp, Artificial Sequence
  Description of Artificial Sequence: Synthetic oligonucleotide
gtggggccggacgggctcct

SEQ ID NO: 36475 - DNA, 20 bp, Artificial Sequence
  Description of Artificial Sequence: Synthetic oligonucleotide
tggggccggacgggctcctc

SEQ ID NO: 36476 - DNA, 20 bp, Artificial Sequence
  Description of Artificial Sequence: Synthetic oligonucleotide
ggggccggacgggctcctct

SEQ ID NO: 36477 - DNA, 20 bp, Artificial Sequence
  Description of Artificial Sequence: Synthetic oligonucleotide
gggccggacgggctcctcct

SEQ ID NO: 36478 - DNA, 20 bp, Artificial Sequence
  Description of Artificial Sequence: Synthetic oligonucleotide
ggccggacgggctcctcctc

SEQ ID NO: 36479 - DNA, 20 bp, Artificial Sequence
  Description of Artificial Sequence: Synthetic oligonucleotide
gccggacgggctcctcctcc

SEQ ID NO: 36480 - DNA, 20 bp, Artificial Sequence
  Description of Artificial Sequence: Synthetic oligonucleotide
ccggacgggctcctcctccg

SEQ ID NO: 36481 - DNA, 20 bp, Artificial Sequence
  Description of Artificial Sequence: Synthetic oligonucleotide
cggacgggctcctcctccgc

SEQ ID NO: 36482 - DNA, 20 bp, Artificial Sequence
  Description of Artificial Sequence: Synthetic oligonucleotide
ggacgggctcctcctccgcg

SEQ ID NO: 36483 - DNA, 20 bp, Artificial Sequence
  Description of Artificial Sequence: Synthetic oligonucleotide
gacgggctcctcctccgcgg

SEQ ID NO: 36484 - DNA, 23 bp, Artificial Sequence
  Description of Artificial Sequence: Synthetic oligonucleotide
acgggctcctcctccgcgggtat

SEQ ID NO: 36485 - DNA, 22 bp, Artificial Sequence
  Description of Artificial Sequence: Synthetic oligonucleotide
cgggctcctcctccgcgggtat

SEQ ID NO: 36486 - DNA, 23 bp, Artificial Sequence
  Description of Artificial Sequence: Synthetic oligonucleotide
gggctcctcctccgcgggtatga

SEQ ID NO: 36487 - DNA, 23 bp, Artificial Sequence
  Description of Artificial Sequence: Synthetic oligonucleotide
ggctcctcctccgcgggtatgac

SEQ ID NO: 36488 - DNA, 24 bp, Artificial Sequence
  Description of Artificial Sequence: Synthetic oligonucleotide
gctcctcctccgcgggtatgacca

SEQ ID NO: 36489 - DNA, 24 bp, Artificial Sequence
  Description of Artificial Sequence: Synthetic oligonucleotide
ctcctcctccgcgggtatgaccag

SEQ ID NO: 36490 - DNA, 25 bp, Artificial Sequence
  Description of Artificial Sequence: Synthetic oligonucleotide
tcctcctccgcgggtatgaccagga

SEQ ID NO: 36491 - DNA, 26 bp, Artificial Sequence
  Description of Artificial Sequence: Synthetic oligonucleotide
cgggtatgaccaggacgcctacgaca

SEQ ID NO: 36492 - DNA, 26 bp, Artificial Sequence
  Description of Artificial Sequence: Synthetic oligonucleotide
gggtatgaccaggacgcctacgacag

SEQ ID NO: 36493 - DNA, 27 bp, Artificial Sequence
  Description of Artificial Sequence: Synthetic oligonucleotide
ggtatgaccaggacgcctacgacagca

SEQ ID NO: 36494 - DNA, 28 bp, Artificial Sequence
  Description of Artificial Sequence: Synthetic oligonucleotide
gtatgaccaggacgcctacgacagcaag

SEQ ID NO: 36495 - DNA, 28 bp, Artificial Sequence
  Description of Artificial Sequence: Synthetic oligonucleotide
tatgaccaggacgcctacgacagcaagg

SEQ ID NO: 36496 - DNA, 27 bp, Artificial Sequence
  Description of Artificial Sequence: Synthetic oligonucleotide
atgaccaggacgcctacgacagcaagg

SEQ ID NO: 36497 - DNA, 27 bp, Artificial Sequence
  Description of Artificial Sequence: Synthetic oligonucleotide
tgaccaggacgcctacgacagcaagga

SEQ ID NO: 36498 - DNA, 27 bp, Artificial Sequence
  Description of Artificial Sequence: Synthetic oligonucleotide
gaccaggacgcctacgacagcaaggat

SEQ ID NO: 36499 - DNA, 29 bp, Artificial Sequence
  Description of Artificial Sequence: Synthetic oligonucleotide
accaggacgcctacgacagcaaggattac

SEQ ID NO: 36500 - DNA, 28 bp, Artificial Sequence
  Description of Artificial Sequence: Synthetic oligonucleotide
ccaggacgcctacgacagcaaggattac

SEQ ID NO: 36501 - DNA, 30 bp, Artificial Sequence
  Description of Artificial Sequence: Synthetic oligonucleotide
caggacgcctacgacagcaaggattacatc

SEQ ID NO: 36502 - DNA, 30 bp, Artificial Sequence
  Description of Artificial Sequence: Synthetic oligonucleotide
aggacgcctacgacagcaaggattacatcg

SEQ ID NO: 36503 - DNA, 29 bp, Artificial Sequence
  Description of Artificial Sequence: Synthetic oligonucleotide
ggacgcctacgacagcaaggattacatcg

SEQ ID NO: 36504 - DNA, 29 bp, Artificial Sequence
  Description of Artificial Sequence: Synthetic oligonucleotide
gacgcctacgacagcaaggattacatcgc

SEQ ID NO: 36505 - DNA, 29 bp, Artificial Sequence
  Description of Artificial Sequence: Synthetic oligonucleotide
acgcctacgacagcaaggattacatcgcc

SEQ ID NO: 36506 - DNA, 28 bp, Artificial Sequence
  Description of Artificial Sequence: Synthetic oligonucleotide
cgcctacgacagcaaggattacatcgcc

SEQ ID NO: 36507 - DNA, 28 bp, Artificial Sequence
  Description of Artificial Sequence: Synthetic oligonucleotide
gcctacgacagcaaggattacatcgccc

SEQ ID NO: 36508 - DNA, 29 bp, Artificial Sequence
  Description of Artificial Sequence: Synthetic oligonucleotide
cctacgacagcaaggattacatcgccctg

SEQ ID NO: 36509 - DNA, 31 bp, Artificial Sequence
  Description of Artificial Sequence: Synthetic oligonucleotide
ctacgacagcaaggattacatcgccctgaac

SEQ ID NO: 36510 - DNA, 31 bp, Artificial Sequence
  Description of Artificial Sequence: Synthetic oligonucleotide
tacgacagcaaggattacatcgccctgaacg

SEQ ID NO: 36511 - DNA, 30 bp, Artificial Sequence
  Description of Artificial Sequence: Synthetic oligonucleotide
acgacagcaaggattacatcgccctgaacg

SEQ ID NO: 36512 - DNA, 29 bp, Artificial Sequence
  Description of Artificial Sequence: Synthetic oligonucleotide
cgacagcaaggattacatcgccctgaacg

SEQ ID NO: 36513 - DNA, 30 bp, Artificial Sequence
  Description of Artificial Sequence: Synthetic oligonucleotide
gacagcaaggattacatcgccctgaacgag

SEQ ID NO: 36514 - DNA, 30 bp, Artificial Sequence
  Description of Artificial Sequence: Synthetic oligonucleotide
acagcaaggattacatcgccctgaacgagg

SEQ ID NO: 36515 - DNA, 29 bp, Artificial Sequence
  Description of Artificial Sequence: Synthetic oligonucleotide
cagcaaggattacatcgccctgaacgagg

SEQ ID NO: 36516 - DNA, 30 bp, Artificial Sequence
  Description of Artificial Sequence: Synthetic oligonucleotide
agcaaggattacatcgccctgaacgaggac

SEQ ID NO: 36517 - DNA, 21 bp, Artificial Sequence
  Description of Artificial Sequence: Synthetic oligonucleotide
gcggggagccccgcttcatcc

SEQ ID NO: 36518 - DNA, 21 bp, Artificial Sequence
  Description of Artificial Sequence: Synthetic oligonucleotide
cggggagccccgcttcatccc

SEQ ID NO: 36519 - DNA, 21 bp, Artificial Sequence
  Description of Artificial Sequence: Synthetic oligonucleotide
ggggagccccgcttcatcccc

SEQ ID NO: 36520 - DNA, 22 bp, Artificial Sequence
  Description of Artificial Sequence: Synthetic oligonucleotide
gggagccccgcttcatccccgt

SEQ ID NO: 36521 - DNA, 22 bp, Artificial Sequence
  Description of Artificial Sequence: Synthetic oligonucleotide
ggagccccgcttcatccccgtg

SEQ ID NO: 36522 - DNA, 22 bp, Artificial Sequence
  Description of Artificial Sequence: Synthetic oligonucleotide
gagccccgcttcatccccgtgg

SEQ ID NO: 36523 - DNA, 22 bp, Artificial Sequence
  Description of Artificial Sequence: Synthetic oligonucleotide
agccccgcttcatccccgtggg

SEQ ID NO: 36524 - DNA, 21 bp, Artificial Sequence
  Description of Artificial Sequence: Synthetic oligonucleotide
gccccgcttcatccccgtggg

SEQ ID NO: 36525 - DNA, 23 bp, Artificial Sequence
  Description of Artificial Sequence: Synthetic oligonucleotide
ccccgcttcatccccgtgggcta

SEQ ID NO: 36526 - DNA, 23 bp, Artificial Sequence
  Description of Artificial Sequence: Synthetic oligonucleotide
cccgcttcatccccgtgggctac

SEQ ID NO: 36527 - DNA, 24 bp, Artificial Sequence
  Description of Artificial Sequence: Synthetic oligonucleotide
ccgcttcatccccgtgggctacgt

SEQ ID NO: 36528 - DNA, 24 bp, Artificial Sequence
  Description of Artificial Sequence: Synthetic oligonucleotide
cgcttcatccccgtgggctacgtg

SEQ ID NO: 36529 - DNA, 25 bp, Artificial Sequence
  Description of Artificial Sequence: Synthetic oligonucleotide
gcttcatccccgtgggctacgtgga

SEQ ID NO: 36530 - DNA, 25 bp, Artificial Sequence
  Description of Artificial Sequence: Synthetic oligonucleotide
cttcatccccgtgggctacgtggac

SEQ ID NO: 36531 - DNA, 26 bp, Artificial Sequence
  Description of Artificial Sequence: Synthetic oligonucleotide
ttcatccccgtgggctacgtggacga

SEQ ID NO: 36532 - DNA, 25 bp, Artificial Sequence
  Description of Artificial Sequence: Synthetic oligonucleotide
tcatccccgtgggctacgtggacga

SEQ ID NO: 36533 - DNA, 24 bp, Artificial Sequence
  Description of Artificial Sequence: Synthetic oligonucleotide
catccccgtgggctacgtggacga

SEQ ID NO: 36534 - DNA, 25 bp, Artificial Sequence
  Description of Artificial Sequence: Synthetic oligonucleotide
atccccgtgggctacgtggacgaca

SEQ ID NO: 36535 - DNA, 24 bp, Artificial Sequence
  Description of Artificial Sequence: Synthetic oligonucleotide
tccccgtgggctacgtggacgaca

SEQ ID NO: 36536 - DNA, 23 bp, Artificial Sequence
  Description of Artificial Sequence: Synthetic oligonucleotide
ccccgtgggctacgtggacgaca

SEQ ID NO: 36537 - DNA, 23 bp, Artificial Sequence
  Description of Artificial Sequence: Synthetic oligonucleotide
cccgtgggctacgtggacgacac

SEQ ID NO: 36538 - DNA, 22 bp, Artificial Sequence
  Description of Artificial Sequence: Synthetic oligonucleotide
cctcctccgcgggcatgaccag

SEQ ID NO: 36539 - DNA, 23 bp, Artificial Sequence
  Description of Artificial Sequence: Synthetic oligonucleotide
ctcctccgcgggcatgaccagga

SEQ ID NO: 36540 - DNA, 23 bp, Artificial Sequence
  Description of Artificial Sequence: Synthetic oligonucleotide
tcctccgcgggcatgaccaggac

SEQ ID NO: 36541 - DNA, 22 bp, Artificial Sequence
  Description of Artificial Sequence: Synthetic oligonucleotide
cctccgcgggcatgaccaggac

SEQ ID NO: 36542 - DNA, 22 bp, Artificial Sequence
  Description of Artificial Sequence: Synthetic oligonucleotide
ctccgcgggcatgaccaggacg

SEQ ID NO: 36543 - DNA, 22 bp, Artificial Sequence
  Description of Artificial Sequence: Synthetic oligonucleotide
tccgcgggcatgaccaggacgc

SEQ ID NO: 36544 - DNA, 21 bp, Artificial Sequence
  Description of Artificial Sequence: Synthetic oligonucleotide
ccgcgggcatgaccaggacgc

SEQ ID NO: 36545 - DNA, 23 bp, Artificial Sequence
  Description of Artificial Sequence: Synthetic oligonucleotide
cgcgggcatgaccaggacgccta

SEQ ID NO: 36546 - DNA, 23 bp, Artificial Sequence
  Description of Artificial Sequence: Synthetic oligonucleotide
gcgggcatgaccaggacgcctac

SEQ ID NO: 36547 - DNA, 24 bp, Artificial Sequence
  Description of Artificial Sequence: Synthetic oligonucleotide
cgggcatgaccaggacgcctacga

SEQ ID NO: 36548 - DNA, 24 bp, Artificial Sequence
  Description of Artificial Sequence: Synthetic oligonucleotide
gggcatgaccaggacgcctacgac

SEQ ID NO: 36549 - DNA, 24 bp, Artificial Sequence
  Description of Artificial Sequence: Synthetic oligonucleotide
ggcatgaccaggacgcctacgacg

SEQ ID NO: 36550 - DNA, 24 bp, Artificial Sequence
  Description of Artificial Sequence: Synthetic oligonucleotide
gcatgaccaggacgcctacgacgg

SEQ ID NO: 36551 - DNA, 26 bp, Artificial Sequence
  Description of Artificial Sequence: Synthetic oligonucleotide
catgaccaggacgcctacgacggcaa

SEQ ID NO: 36552 - DNA, 20 bp, Artificial Sequence
  Description of Artificial Sequence: Synthetic oligonucleotide
gaccgcggcggacaccgcct

SEQ ID NO: 36553 - DNA, 20 bp, Artificial Sequence
  Description of Artificial Sequence: Synthetic oligonucleotide
accgcggcggacaccgccgt

SEQ ID NO: 36554 - DNA, 20 bp, Artificial Sequence
  Description of Artificial Sequence: Synthetic oligonucleotide
ccgcggcggacaccgccgtt

SEQ ID NO: 36555 - DNA, 20 bp, Artificial Sequence
  Description of Artificial Sequence: Synthetic oligonucleotide
cgcggcggacaccgccgctt

SEQ ID NO: 36556 - DNA, 20 bp, Artificial Sequence
  Description of Artificial Sequence: Synthetic oligonucleotide
gcggcggacaccgccgcgtt

SEQ ID NO: 36557 - DNA, 20 bp, Artificial Sequence
  Description of Artificial Sequence: Synthetic oligonucleotide
cggcggacaccgccgcgcaa

SEQ ID NO: 36558 - DNA, 21 bp, Artificial Sequence
  Description of Artificial Sequence: Synthetic oligonucleotide
ggcggacaccgccgcgcaagt

SEQ ID NO: 36559 - DNA, 21 bp, Artificial Sequence
  Description of Artificial Sequence: Synthetic oligonucleotide
gcggacaccgccgcgcaagtg

SEQ ID NO: 36560 - DNA, 21 bp, Artificial Sequence
  Description of Artificial Sequence: Synthetic oligonucleotide
cggacaccgccgcgcaagtgg

SEQ ID NO: 36561 - DNA, 22 bp, Artificial Sequence
  Description of Artificial Sequence: Synthetic oligonucleotide
ggacaccgccgcgcaagtggga

SEQ ID NO: 36562 - DNA, 22 bp, Artificial Sequence
  Description of Artificial Sequence: Synthetic oligonucleotide
gacaccgccgcgcaagtgggag

SEQ ID NO: 36563 - DNA, 22 bp, Artificial Sequence
  Description of Artificial Sequence: Synthetic oligonucleotide
acaccgccgcgcaagtgggagg

SEQ ID NO: 36564 - DNA, 21 bp, Artificial Sequence
  Description of Artificial Sequence: Synthetic oligonucleotide
caccgccgcgcaagtgggagg

SEQ ID NO: 36565 - DNA, 21 bp, Artificial Sequence
  Description of Artificial Sequence: Synthetic oligonucleotide
accgccgcgcaagtgggaggc

SEQ ID NO: 36566 - DNA, 20 bp, Artificial Sequence
  Description of Artificial Sequence: Synthetic oligonucleotide
ccgccgcgcaagtgggaggc

SEQ ID NO: 36567 - DNA, 20 bp, Artificial Sequence
  Description of Artificial Sequence: Synthetic oligonucleotide
cgccgcgcaagtgggaggcg

SEQ ID NO: 36568 - DNA, 20 bp, Artificial Sequence
  Description of Artificial Sequence: Synthetic oligonucleotide
gccgcgcaagtgggaggcgg

SEQ ID NO: 36569 - DNA, 20 bp, Artificial Sequence
  Description of Artificial Sequence: Synthetic oligonucleotide
ccgcgcaagtgggaggcggc

SEQ ID NO: 36570 - DNA, 20 bp, Artificial Sequence
  Description of Artificial Sequence: Synthetic oligonucleotide
cgcgcaagtgggaggcggcc

SEQ ID NO: 36571 - DNA, 30 bp, Artificial Sequence
  Description of Artificial Sequence: Synthetic oligonucleotide
ccgggtctcacatcatccagaggatgtaag

SEQ ID NO: 36572 - DNA, 30 bp, Artificial Sequence
  Description of Artificial Sequence: Synthetic oligonucleotide
cgggtctcacatcatccagaggatgtaagg

SEQ ID NO: 36573 - DNA, 30 bp, Artificial Sequence
  Description of Artificial Sequence: Synthetic oligonucleotide
gggtctcacatcatccagaggatgtaaggc

SEQ ID NO: 36574 - DNA, 31 bp, Artificial Sequence
  Description of Artificial Sequence: Synthetic oligonucleotide
ggtctcacatcatccagaggatgtaaggctg

SEQ ID NO: 36575 - DNA, 31 bp, Artificial Sequence
  Description of Artificial Sequence: Synthetic oligonucleotide
gtctcacatcatccagaggatgtaaggctgc

SEQ ID NO: 36576 - DNA, 31 bp, Artificial Sequence
  Description of Artificial Sequence: Synthetic oligonucleotide
tctcacatcatccagaggatgtaaggctgcg

SEQ ID NO: 36577 - DNA, 30 bp, Artificial Sequence
  Description of Artificial Sequence: Synthetic oligonucleotide
ctcacatcatccagaggatgtaaggctgcg

SEQ ID NO: 36578 - DNA, 31 bp, Artificial Sequence
  Description of Artificial Sequence: Synthetic oligonucleotide
tcacatcatccagaggatgtaaggctgcgac

SEQ ID NO: 36579 - DNA, 30 bp, Artificial Sequence
  Description of Artificial Sequence: Synthetic oligonucleotide
cacatcatccagaggatgtaaggctgcgac

SEQ ID NO: 36580 - DNA, 30 bp, Artificial Sequence
  Description of Artificial Sequence: Synthetic oligonucleotide
acatcatccagaggatgtaaggctgcgacg

SEQ ID NO: 36581 - DNA, 29 bp, Artificial Sequence
  Description of Artificial Sequence: Synthetic oligonucleotide
catcatccagaggatgtaaggctgcgacg

SEQ ID NO: 36582 - DNA, 30 bp, Artificial Sequence
  Description of Artificial Sequence: Synthetic oligonucleotide
atcatccagaggatgtaaggctgcgacgtg

SEQ ID NO: 36583 - DNA, 29 bp, Artificial Sequence
  Description of Artificial Sequence: Synthetic oligonucleotide
tcatccagaggatgtaaggctgcgacgtg

SEQ ID NO: 36584 - DNA, 28 bp, Artificial Sequence
  Description of Artificial Sequence: Synthetic oligonucleotide
catccagaggatgtaaggctgcgacgtg

SEQ ID NO: 36585 - DNA, 28 bp, Artificial Sequence
  Description of Artificial Sequence: Synthetic oligonucleotide
atccagaggatgtaaggctgcgacgtgg

SEQ ID NO: 36586 - DNA, 36 bp, Artificial Sequence
  Description of Artificial Sequence: Synthetic oligonucleotide
atctccaagaccaacacacagacttactgagagaac

SEQ ID NO: 36587 - DNA, 35 bp, Artificial Sequence
  Description of Artificial Sequence: Synthetic oligonucleotide
tctccaagaccaacacacagacttactgagagaac

SEQ ID NO: 36588 - DNA, 34 bp, Artificial Sequence
  Description of Artificial Sequence: Synthetic oligonucleotide
ctccaagaccaacacacagacttactgagagaac

SEQ ID NO: 36589 - DNA, 34 bp, Artificial Sequence
  Description of Artificial Sequence: Synthetic oligonucleotide
tccaagaccaacacacagacttactgagagaacc

SEQ ID NO: 36590 - DNA, 33 bp, Artificial Sequence
  Description of Artificial Sequence: Synthetic oligonucleotide
ccaagaccaacacacagacttactgagagaacc

SEQ ID NO: 36591 - DNA, 34 bp, Artificial Sequence
  Description of Artificial Sequence: Synthetic oligonucleotide
caagaccaacacacagacttactgagagaacctg

SEQ ID NO: 36592 - DNA, 34 bp, Artificial Sequence
  Description of Artificial Sequence: Synthetic oligonucleotide
aagaccaacacacagacttactgagagaacctgc

SEQ ID NO: 36593 - DNA, 33 bp, Artificial Sequence
  Description of Artificial Sequence: Synthetic oligonucleotide
agaccaacacacagacttactgagagaacctgc

SEQ ID NO: 36594 - DNA, 32 bp, Artificial Sequence
  Description of Artificial Sequence: Synthetic oligonucleotide
gaccaacacacagacttactgagagaacctgc

SEQ ID NO: 36595 - DNA, 32 bp, Artificial Sequence
  Description of Artificial Sequence: Synthetic oligonucleotide
accaacacacagacttactgagagaacctgcg

SEQ ID NO: 36596 - DNA, 31 bp, Artificial Sequence
  Description of Artificial Sequence: Synthetic oligonucleotide
ccaacacacagacttactgagagaacctgcg

SEQ ID NO: 36597 - DNA, 31 bp, Artificial Sequence
  Description of Artificial Sequence: Synthetic oligonucleotide
caacacacagacttactgagagaacctgcgc

SEQ ID NO: 36598 - DNA, 32 bp, Artificial Sequence
  Description of Artificial Sequence: Synthetic oligonucleotide
aacacacagacttactgagagaacctgcgcac

SEQ ID NO: 36599 - DNA, 31 bp, Artificial Sequence
  Description of Artificial Sequence: Synthetic oligonucleotide
acacacagacttactgagagaacctgcgcac

SEQ ID NO: 36600 - DNA, 30 bp, Artificial Sequence
  Description of Artificial Sequence: Synthetic oligonucleotide
cacacagacttactgagagaacctgcgcac

SEQ ID NO: 36601 - DNA, 30 bp, Artificial Sequence
  Description of Artificial Sequence: Synthetic oligonucleotide
acacagacttactgagagaacctgcgcacc

SEQ ID NO: 36602 - DNA, 29 bp, Artificial Sequence
  Description of Artificial Sequence: Synthetic oligonucleotide
cacagacttactgagagaacctgcgcacc

SEQ ID NO: 36603 - DNA, 29 bp, Artificial Sequence
  Description of Artificial Sequence: Synthetic oligonucleotide
acagacttactgagagaacctgcgcaccg

SEQ ID NO: 36604 - DNA, 28 bp, Artificial Sequence
  Description of Artificial Sequence: Synthetic oligonucleotide
cagacttactgagagaacctgcgcaccg

SEQ ID NO: 36605 - DNA, 28 bp, Artificial Sequence
  Description of Artificial Sequence: Synthetic oligonucleotide
agacttactgagagaacctgcgcaccgc

SEQ ID NO: 36606 - DNA, 27 bp, Artificial Sequence
  Description of Artificial Sequence: Synthetic oligonucleotide
gacttactgagagaacctgcgcaccgc

SEQ ID NO: 36607 - DNA, 27 bp, Artificial Sequence
  Description of Artificial Sequence: Synthetic oligonucleotide
acttactgagagaacctgcgcaccgcg

SEQ ID NO: 36608 - DNA, 26 bp, Artificial Sequence
  Description of Artificial Sequence: Synthetic oligonucleotide
cttactgagagaacctgcgcaccgcg

SEQ ID NO: 36609 - DNA, 27 bp, Artificial Sequence
  Description of Artificial Sequence: Synthetic oligonucleotide
ttactgagagaacctgcgcaccgcgct

SEQ ID NO: 36610 - DNA, 26 bp, Artificial Sequence
  Description of Artificial Sequence: Synthetic oligonucleotide
tactgagagaacctgcgcaccgcgct

SEQ ID NO: 36611 - DNA, 25 bp, Artificial Sequence
  Description of Artificial Sequence: Synthetic oligonucleotide
actgagagaacctgcgcaccgcgct

SEQ ID NO: 36612 - DNA, 24 bp, Artificial Sequence
  Description of Artificial Sequence: Synthetic oligonucleotide
ctgagagaacctgcgcaccgcgct

SEQ ID NO: 36613 - DNA, 24 bp, Artificial Sequence
  Description of Artificial Sequence: Synthetic oligonucleotide
tgagagaacctgcgcaccgcgctc

SEQ ID NO: 36614 - DNA, 26 bp, Artificial Sequence
  Description of Artificial Sequence: Synthetic oligonucleotide
agcgacgccacgagtccgaggaagta

SEQ ID NO: 36615 - DNA, 25 bp, Artificial Sequence
  Description of Artificial Sequence: Synthetic oligonucleotide
gcgacgccacgagtccgaggaagta

SEQ ID NO: 36616 - DNA, 25 bp, Artificial Sequence
  Description of Artificial Sequence: Synthetic oligonucleotide
cgacgccacgagtccgaggaagtag

SEQ ID NO: 36617 - DNA, 25 bp, Artificial Sequence
  Description of Artificial Sequence: Synthetic oligonucleotide
gacgccacgagtccgaggaagtagc

SEQ ID NO: 36618 - DNA, 25 bp, Artificial Sequence
  Description of Artificial Sequence: Synthetic oligonucleotide
acgccacgagtccgaggaagtagcc

SEQ ID NO: 36619 - DNA, 24 bp, Artificial Sequence
  Description of Artificial Sequence: Synthetic oligonucleotide
cgccacgagtccgaggaagtagcc

SEQ ID NO: 36620 - DNA, 24 bp, Artificial Sequence
  Description of Artificial Sequence: Synthetic oligonucleotide
gccacgagtccgaggaagtagccg

SEQ ID NO: 36621 - DNA, 24 bp, Artificial Sequence
  Description of Artificial Sequence: Synthetic oligonucleotide
ccacgagtccgaggaagtagccgc

SEQ ID NO: 36622 - DNA, 24 bp, Artificial Sequence
  Description of Artificial Sequence: Synthetic oligonucleotide
cacgagtccgaggaagtagccgcg

SEQ ID NO: 36623 - DNA, 24 bp, Artificial Sequence
  Description of Artificial Sequence: Synthetic oligonucleotide
acgagtccgaggaagtagccgcgg

SEQ ID NO: 36624 - DNA, 23 bp, Artificial Sequence
  Description of Artificial Sequence: Synthetic oligonucleotide
cgagtccgaggaagtagccgcgg

SEQ ID NO: 36625 - DNA, 23 bp, Artificial Sequence
  Description of Artificial Sequence: Synthetic oligonucleotide
gagtccgaggaagtagccgcggg

SEQ ID NO: 36626 - DNA, 23 bp, Artificial Sequence
  Description of Artificial Sequence: Synthetic oligonucleotide
agtccgaggaagtagccgcgggc

SEQ ID NO: 36627 - DNA, 22 bp, Artificial Sequence
  Description of Artificial Sequence: Synthetic oligonucleotide
gtccgaggaagtagccgcgggc

SEQ ID NO: 36628 - DNA, 22 bp, Artificial Sequence
  Description of Artificial Sequence: Synthetic oligonucleotide
tccgaggaagtagccgcgggcg

SEQ ID NO: 36629 - DNA, 21 bp, Artificial Sequence
  Description of Artificial Sequence: Synthetic oligonucleotide
ccgaggaagtagccgcgggcg

SEQ ID NO: 36630 - DNA, 21 bp, Artificial Sequence
  Description of Artificial Sequence: Synthetic oligonucleotide
cgaggaagtagccgcgggcgc

SEQ ID NO: 36631 - DNA, 23 bp, Artificial Sequence
  Description of Artificial Sequence: Synthetic oligonucleotide
gaggaagtagccgcgggcgccat

SEQ ID NO: 36632 - DNA, 23 bp, Artificial Sequence
  Description of Artificial Sequence: Synthetic oligonucleotide
aggaagtagccgcgggcgccatg

SEQ ID NO: 36633 - DNA, 22 bp, Artificial Sequence
  Description of Artificial Sequence: Synthetic oligonucleotide
ggaagtagccgcgggcgccatg

SEQ ID NO: 36634 - DNA, 25 bp, Artificial Sequence
  Description of Artificial Sequence: Synthetic oligonucleotide
gaagtagccgcgggcgccatggata

SEQ ID NO: 36635 - DNA, 26 bp, Artificial Sequence
  Description of Artificial Sequence: Synthetic oligonucleotide
aagtagccgcgggcgccatggataga

SEQ ID NO: 36636 - DNA, 25 bp, Artificial Sequence
  Description of Artificial Sequence: Synthetic oligonucleotide
agtagccgcgggcgccatggataga

SEQ ID NO: 36637 - DNA, 24 bp, Artificial Sequence
  Description of Artificial Sequence: Synthetic oligonucleotide
gtagccgcgggcgccatggataga

SEQ ID NO: 36638 - DNA, 24 bp, Artificial Sequence
  Description of Artificial Sequence: Synthetic oligonucleotide
tagccgcgggcgccatggatagag

SEQ ID NO: 36639 - DNA, 27 bp, Artificial Sequence
  Description of Artificial Sequence: Synthetic oligonucleotide
gacacgctgttcgtgaggttcgacagg

SEQ ID NO: 36640 - DNA, 27 bp, Artificial Sequence
  Description of Artificial Sequence: Synthetic oligonucleotide
acacgctgttcgtgaggttcgacaggg

SEQ ID NO: 36641 - DNA, 27 bp, Artificial Sequence
  Description of Artificial Sequence: Synthetic oligonucleotide
cacgctgttcgtgaggttcgacaggga

SEQ ID NO: 36642 - DNA, 27 bp, Artificial Sequence
  Description of Artificial Sequence: Synthetic oligonucleotide
acgctgttcgtgaggttcgacagggac

SEQ ID NO: 36643 - DNA, 26 bp, Artificial Sequence
  Description of Artificial Sequence: Synthetic oligonucleotide
cgctgttcgtgaggttcgacagggac

SEQ ID NO: 36644 - DNA, 26 bp, Artificial Sequence
  Description of Artificial Sequence: Synthetic oligonucleotide
gctgttcgtgaggttcgacagggacg

SEQ ID NO: 36645 - DNA, 26 bp, Artificial Sequence
  Description of Artificial Sequence: Synthetic oligonucleotide
ctgttcgtgaggttcgacagggacgc

SEQ ID NO: 36646 - DNA, 27 bp, Artificial Sequence
  Description of Artificial Sequence: Synthetic oligonucleotide
tgttcgtgaggttcgacagggacgcca

SEQ ID NO: 36647 - DNA, 26 bp, Artificial Sequence
  Description of Artificial Sequence: Synthetic oligonucleotide
gttcgtgaggttcgacagggacgcca

SEQ ID NO: 36648 - DNA, 26 bp, Artificial Sequence
  Description of Artificial Sequence: Synthetic oligonucleotide
ttcgtgaggttcgacagggacgccac

SEQ ID NO: 36649 - DNA, 25 bp, Artificial Sequence
  Description of Artificial Sequence: Synthetic oligonucleotide
tcgtgaggttcgacagggacgccac

SEQ ID NO: 36650 - DNA, 24 bp, Artificial Sequence
  Description of Artificial Sequence: Synthetic oligonucleotide
cgtgaggttcgacagggacgccac

SEQ ID NO: 36651 - DNA, 25 bp, Artificial Sequence
  Description of Artificial Sequence: Synthetic oligonucleotide
gtgaggttcgacagggacgccacga

SEQ ID NO: 36652 - DNA, 26 bp, Artificial Sequence
  Description of Artificial Sequence: Synthetic oligonucleotide
tgaggttcgacagggacgccacgagt

SEQ ID NO: 36653 - DNA, 25 bp, Artificial Sequence
  Description of Artificial Sequence: Synthetic oligonucleotide
gaggttcgacagggacgccacgagt

SEQ ID NO: 36654 - DNA, 25 bp, Artificial Sequence
  Description of Artificial Sequence: Synthetic oligonucleotide
aggttcgacagggacgccacgagtc

SEQ ID NO: 36655 - DNA, 24 bp, Artificial Sequence
  Description of Artificial Sequence: Synthetic oligonucleotide
ggttcgacagggacgccacgagtc

SEQ ID NO: 36656 - DNA, 24 bp, Artificial Sequence
  Description of Artificial Sequence: Synthetic oligonucleotide
gttcgacagggacgccacgagtcc

SEQ ID NO: 36657 - DNA, 25 bp, Artificial Sequence
  Description of Artificial Sequence: Synthetic oligonucleotide
ttcgacagggacgccacgagtccga

SEQ ID NO: 36658 - DNA, 24 bp, Artificial Sequence
  Description of Artificial Sequence: Synthetic oligonucleotide
tcgacagggacgccacgagtccga

SEQ ID NO: 36659 - DNA, 23 bp, Artificial Sequence
  Description of Artificial Sequence: Synthetic oligonucleotide
cgacagggacgccacgagtccga

SEQ ID NO: 36660 - DNA, 23 bp, Artificial Sequence
  Description of Artificial Sequence: Synthetic oligonucleotide
gacagggacgccacgagtccgag

SEQ ID NO: 36661 - DNA, 25 bp, Artificial Sequence
  Description of Artificial Sequence: Synthetic oligonucleotide
acagggacgccacgagtccgaggaa

SEQ ID NO: 36662 - DNA, 24 bp, Artificial Sequence
  Description of Artificial Sequence: Synthetic oligonucleotide
cagggacgccacgagtccgaggaa

SEQ ID NO: 36663 - DNA, 24 bp, Artificial Sequence
  Description of Artificial Sequence: Synthetic oligonucleotide
agggacgccacgagtccgaggaag

SEQ ID NO: 36664 - DNA, 23 bp, Artificial Sequence
  Description of Artificial Sequence: Synthetic oligonucleotide
gggacgccacgagtccgaggaag

SEQ ID NO: 36665 - DNA, 24 bp, Artificial Sequence
  Description of Artificial Sequence: Synthetic oligonucleotide
ggacgccacgagtccgaggaagga

SEQ ID NO: 36666 - DNA, 28 bp, Artificial Sequence
  Description of Artificial Sequence: Synthetic oligonucleotide
ccccaaagacacatgtgacccaccacac

SEQ ID NO: 36667 - DNA, 28 bp, Artificial Sequence
  Description of Artificial Sequence: Synthetic oligonucleotide
cccaaagacacatgtgacccaccacacc

SEQ ID NO: 36668 - DNA, 30 bp, Artificial Sequence
  Description of Artificial Sequence: Synthetic oligonucleotide
ccaaagacacatgtgacccaccacaccatc

SEQ ID NO: 36669 - DNA, 31 bp, Artificial Sequence
  Description of Artificial Sequence: Synthetic oligonucleotide
caaagacacatgtgacccaccacaccatctc

SEQ ID NO: 36670 - DNA, 32 bp, Artificial Sequence
  Description of Artificial Sequence: Synthetic oligonucleotide
aaagacacatgtgacccaccacaccatctctg

SEQ ID NO: 36671 - DNA, 31 bp, Artificial Sequence
  Description of Artificial Sequence: Synthetic oligonucleotide
aagacacatgtgacccaccacaccatctctg

SEQ ID NO: 36672 - DNA, 30 bp, Artificial Sequence
  Description of Artificial Sequence: Synthetic oligonucleotide
agacacatgtgacccaccacaccatctctg

SEQ ID NO: 36673 - DNA, 29 bp, Artificial Sequence
  Description of Artificial Sequence: Synthetic oligonucleotide
gacacatgtgacccaccacaccatctctg

SEQ ID NO: 36674 - DNA, 30 bp, Artificial Sequence
  Description of Artificial Sequence: Synthetic oligonucleotide
acacatgtgacccaccacaccatctctgac

SEQ ID NO: 36675 - DNA, 29 bp, Artificial Sequence
  Description of Artificial Sequence: Synthetic oligonucleotide
cacatgtgacccaccacaccatctctgac

SEQ ID NO: 36676 - DNA, 29 bp, Artificial Sequence
  Description of Artificial Sequence: Synthetic oligonucleotide
acatgtgacccaccacaccatctctgacc

SEQ ID NO: 36677 - DNA, 28 bp, Artificial Sequence
  Description of Artificial Sequence: Synthetic oligonucleotide
catgtgacccaccacaccatctctgacc

SEQ ID NO: 36678 - DNA, 30 bp, Artificial Sequence
  Description of Artificial Sequence: Synthetic oligonucleotide
atgtgacccaccacaccatctctgaccatg

SEQ ID NO: 36679 - DNA, 29 bp, Artificial Sequence
  Description of Artificial Sequence: Synthetic oligonucleotide
tgtgacccaccacaccatctctgaccatg

SEQ ID NO: 36680 - DNA, 28 bp, Artificial Sequence
  Description of Artificial Sequence: Synthetic oligonucleotide
gtgacccaccacaccatctctgaccatg

SEQ ID NO: 36681 - DNA, 29 bp, Artificial Sequence
  Description of Artificial Sequence: Synthetic oligonucleotide
tgacccaccacaccatctctgaccatgag

SEQ ID NO: 36682 - DNA, 28 bp, Artificial Sequence
  Description of Artificial Sequence: Synthetic oligonucleotide
gacccaccacaccatctctgaccatgag

SEQ ID NO: 36683 - DNA, 28 bp, Artificial Sequence
  Description of Artificial Sequence: Synthetic oligonucleotide
acccaccacaccatctctgaccatgagg

SEQ ID NO: 36684 - DNA, 27 bp, Artificial Sequence
  Description of Artificial Sequence: Synthetic oligonucleotide
cccaccacaccatctctgaccatgagg

SEQ ID NO: 36685 - DNA, 28 bp, Artificial Sequence
  Description of Artificial Sequence: Synthetic oligonucleotide
ccaccacaccatctctgaccatgaggtc

SEQ ID NO: 36686 - DNA, 29 bp, Artificial Sequence
  Description of Artificial Sequence: Synthetic oligonucleotide
caccacaccatctctgaccatgaggtcac

SEQ ID NO: 36687 - DNA, 29 bp, Artificial Sequence
  Description of Artificial Sequence: Synthetic oligonucleotide
accacaccatctctgaccatgaggtcacc

SEQ ID NO: 36688 - DNA, 28 bp, Artificial Sequence
  Description of Artificial Sequence: Synthetic oligonucleotide
ccacaccatctctgaccatgaggtcacc

SEQ ID NO: 36689 - DNA, 28 bp, Artificial Sequence
  Description of Artificial Sequence: Synthetic oligonucleotide
cacaccatctctgaccatgaggtcaccc

SEQ ID NO: 36690 - DNA, 29 bp, Artificial Sequence
  Description of Artificial Sequence: Synthetic oligonucleotide
acaccatctctgaccatgaggtcaccctg

SEQ ID NO: 36691 - DNA, 28 bp, Artificial Sequence
  Description of Artificial Sequence: Synthetic oligonucleotide
caccatctctgaccatgaggtcaccctg

SEQ ID NO: 36692 - DNA, 29 bp, Artificial Sequence
  Description of Artificial Sequence: Synthetic oligonucleotide
accatctctgaccatgaggtcaccctgag

SEQ ID NO: 36693 - DNA, 23 bp, Artificial Sequence
  Description of Artificial Sequence: Synthetic oligonucleotide
accgcggctcagatcacccagcc

SEQ ID NO: 36694 - DNA, 22 bp, Artificial Sequence
  Description of Artificial Sequence: Synthetic oligonucleotide
ccgcggctcagatcacccagcc

SEQ ID NO: 36695 - DNA, 24 bp, Artificial Sequence
  Description of Artificial Sequence: Synthetic oligonucleotide
cgcggctcagatcacccagcccaa

SEQ ID NO: 36696 - DNA, 22 bp, Artificial Sequence
  Description of Artificial Sequence: Synthetic oligonucleotide
ccaagtgggaggcggcccgtgt

SEQ ID NO: 36697 - DNA, 25 bp, Artificial Sequence
  Description of Artificial Sequence: Synthetic oligonucleotide
agcgaggccgggtctcacatcatcc

SEQ ID NO: 36698 - DNA, 24 bp, Artificial Sequence
  Description of Artificial Sequence: Synthetic oligonucleotide
gcgaggccgggtctcacatcatcc

SEQ ID NO: 36699 - DNA, 24 bp, Artificial Sequence
  Description of Artificial Sequence: Synthetic oligonucleotide
cgaggccgggtctcacatcatccg

SEQ ID NO: 36700 - DNA, 25 bp, Artificial Sequence
  Description of Artificial Sequence: Synthetic oligonucleotide
gaggccgggtctcacatcatccgga

SEQ ID NO: 36701 - DNA, 25 bp, Artificial Sequence
  Description of Artificial Sequence: Synthetic oligonucleotide
aggccgggtctcacatcatccggag

SEQ ID NO: 36702 - DNA, 24 bp, Artificial Sequence
  Description of Artificial Sequence: Synthetic oligonucleotide
ggccgggtctcacatcatccggag

SEQ ID NO: 36703 - DNA, 26 bp, Artificial Sequence
  Description of Artificial Sequence: Synthetic oligonucleotide
gccgggtctcacatcatccggaggat

SEQ ID NO: 36704 - DNA, 27 bp, Artificial Sequence
  Description of Artificial Sequence: Synthetic oligonucleotide
ccgggtctcacatcatccggaggatgt

SEQ ID NO: 36705 - DNA, 28 bp, Artificial Sequence
  Description of Artificial Sequence: Synthetic oligonucleotide
cgggtctcacatcatccggaggatgtac

SEQ ID NO: 36706 - DNA, 28 bp, Artificial Sequence
  Description of Artificial Sequence: Synthetic oligonucleotide
gggtctcacatcatccggaggatgtacg

SEQ ID NO: 36707 - DNA, 28 bp, Artificial Sequence
  Description of Artificial Sequence: Synthetic oligonucleotide
ggtctcacatcatccggaggatgtacgg

SEQ ID NO: 36708 - DNA, 28 bp, Artificial Sequence
  Description of Artificial Sequence: Synthetic oligonucleotide
gtctcacatcatccggaggatgtacggc

SEQ ID NO: 36709 - DNA, 29 bp, Artificial Sequence
  Description of Artificial Sequence: Synthetic oligonucleotide
tctcacatcatccggaggatgtacggctg

SEQ ID NO: 36710 - DNA, 28 bp, Artificial Sequence
  Description of Artificial Sequence: Synthetic oligonucleotide
ctcacatcatccggaggatgtacggctg

SEQ ID NO: 36711 - DNA, 28 bp, Artificial Sequence
  Description of Artificial Sequence: Synthetic oligonucleotide
tcacatcatccggaggatgtacggctgc

SEQ ID NO: 36712 - DNA, 27 bp, Artificial Sequence
  Description of Artificial Sequence: Synthetic oligonucleotide
cacatcatccggaggatgtacggctgc

SEQ ID NO: 36713 - DNA, 27 bp, Artificial Sequence
  Description of Artificial Sequence: Synthetic oligonucleotide
acatcatccggaggatgtacggctgcg

SEQ ID NO: 36714 - DNA, 27 bp, Artificial Sequence
  Description of Artificial Sequence: Synthetic oligonucleotide
catcatccggaggatgtacggctgcga

SEQ ID NO: 36715 - DNA, 27 bp, Artificial Sequence
  Description of Artificial Sequence: Synthetic oligonucleotide
atcatccggaggatgtacggctgcgac

SEQ ID NO: 36716 - DNA, 26 bp, Artificial Sequence
  Description of Artificial Sequence: Synthetic oligonucleotide
tcatccggaggatgtacggctgcgac

SEQ ID NO: 36717 - DNA, 25 bp, Artificial Sequence
  Description of Artificial Sequence: Synthetic oligonucleotide
catccggaggatgtacggctgcgac

SEQ ID NO: 36718 - DNA, 26 bp, Artificial Sequence
  Description of Artificial Sequence: Synthetic oligonucleotide
atccggaggatgtacggctgcgacgt

SEQ ID NO: 36719 - DNA, 25 bp, Artificial Sequence
  Description of Artificial Sequence: Synthetic oligonucleotide
tccggaggatgtacggctgcgacgt

SEQ ID NO: 36720 - DNA, 24 bp, Artificial Sequence
  Description of Artificial Sequence: Synthetic oligonucleotide
ccggaggatgtacggctgcgacgt

SEQ ID NO: 36721 - DNA, 24 bp, Artificial Sequence
  Description of Artificial Sequence: Synthetic oligonucleotide
cggaggatgtacggctgcgacgtg

SEQ ID NO: 36722 - DNA, 24 bp, Artificial Sequence
  Description of Artificial Sequence: Synthetic oligonucleotide
ggaggatgtacggctgcgacgtgg

SEQ ID NO: 36723 - DNA, 23 bp, Artificial Sequence
  Description of Artificial Sequence: Synthetic oligonucleotide
agtccgaggaaggagccgcggga

SEQ ID NO: 36724 - DNA, 22 bp, Artificial Sequence
  Description of Artificial Sequence: Synthetic oligonucleotide
gtccgaggaaggagccgcggga

SEQ ID NO: 36725 - DNA, 22 bp, Artificial Sequence
  Description of Artificial Sequence: Synthetic oligonucleotide
tccgaggaaggagccgcgggag

SEQ ID NO: 36726 - DNA, 21 bp, Artificial Sequence
  Description of Artificial Sequence: Synthetic oligonucleotide
ccgaggaaggagccgcgggag

SEQ ID NO: 36727 - DNA, 21 bp, Artificial Sequence
  Description of Artificial Sequence: Synthetic oligonucleotide
cgaggaaggagccgcgggagc

SEQ ID NO: 36728 - DNA, 23 bp, Artificial Sequence
  Description of Artificial Sequence: Synthetic oligonucleotide
gaggaaggagccgcgggagccat

SEQ ID NO: 36729 - DNA, 23 bp, Artificial Sequence
  Description of Artificial Sequence: Synthetic oligonucleotide
aggaaggagccgcgggagccatg

SEQ ID NO: 36730 - DNA, 22 bp, Artificial Sequence
  Description of Artificial Sequence: Synthetic oligonucleotide
ggaaggagccgcgggagccatg

SEQ ID NO: 36731 - DNA, 25 bp, Artificial Sequence
  Description of Artificial Sequence: Synthetic oligonucleotide
gaaggagccgcgggagccatggata

SEQ ID NO: 36732 - DNA, 26 bp, Artificial Sequence
  Description of Artificial Sequence: Synthetic oligonucleotide
aaggagccgcgggagccatggataga

SEQ ID NO: 36733 - DNA, 25 bp, Artificial Sequence
  Description of Artificial Sequence: Synthetic oligonucleotide
aggagccgcgggagccatggataga

SEQ ID NO: 36734 - DNA, 24 bp, Artificial Sequence
  Description of Artificial Sequence: Synthetic oligonucleotide
ggagccgcgggagccatggataga

SEQ ID NO: 36735 - DNA, 24 bp, Artificial Sequence
  Description of Artificial Sequence: Synthetic oligonucleotide
gagccgcgggagccatggatagag

SEQ ID NO: 36736 - DNA, 25 bp, Artificial Sequence
  Description of Artificial Sequence: Synthetic oligonucleotide
agccgcgggagccatggatagagca

SEQ ID NO: 36737 - DNA, 24 bp, Artificial Sequence
  Description of Artificial Sequence: Synthetic oligonucleotide
gccgcgggagccatggatagagca

SEQ ID NO: 36738 - DNA, 24 bp, Artificial Sequence
  Description of Artificial Sequence: Synthetic oligonucleotide
ccgcgggagccatggatagagcag

SEQ ID NO: 36739 - DNA, 25 bp, Artificial Sequence
  Description of Artificial Sequence: Synthetic oligonucleotide
cgcgggagccatggatagagcagga

SEQ ID NO: 36740 - DNA, 25 bp, Artificial Sequence
  Description of Artificial Sequence: Synthetic oligonucleotide
gcgggagccatggatagagcaggag

SEQ ID NO: 36741 - DNA, 25 bp, Artificial Sequence
  Description of Artificial Sequence: Synthetic oligonucleotide
cgggagccatggatagagcaggagg

SEQ ID NO: 36742 - DNA, 25 bp, Artificial Sequence
  Description of Artificial Sequence: Synthetic oligonucleotide
gggagccatggatagagcaggaggg

SEQ ID NO: 36743 - DNA, 25 bp, Artificial Sequence
  Description of Artificial Sequence: Synthetic oligonucleotide
ggagccatggatagagcaggagggg

SEQ ID NO: 36744 - DNA, 25 bp, Artificial Sequence
  Description of Artificial Sequence: Synthetic oligonucleotide
gagccatggatagagcaggaggggc

SEQ ID NO: 36745 - DNA, 25 bp, Artificial Sequence
  Description of Artificial Sequence: Synthetic oligonucleotide
agccatggatagagcaggaggggcc

SEQ ID NO: 36746 - DNA, 23 bp, Artificial Sequence
  Description of Artificial Sequence: Synthetic oligonucleotide
cgtgtggcggagcaggacagagg

SEQ ID NO: 36747 - DNA, 25 bp, Artificial Sequence
  Description of Artificial Sequence: Synthetic oligonucleotide
gtgtggcggagcaggacagaggcta

SEQ ID NO: 36748 - DNA, 25 bp, Artificial Sequence
  Description of Artificial Sequence: Synthetic oligonucleotide
tgtggcggagcaggacagaggctac

SEQ ID NO: 36749 - DNA, 24 bp, Artificial Sequence
  Description of Artificial Sequence: Synthetic oligonucleotide
gtggcggagcaggacagaggctac

SEQ ID NO: 36750 - DNA, 25 bp, Artificial Sequence
  Description of Artificial Sequence: Synthetic oligonucleotide
tggcggagcaggacagaggctacct

SEQ ID NO: 36751 - DNA, 24 bp, Artificial Sequence
  Description of Artificial Sequence: Synthetic oligonucleotide
ggcggagcaggacagaggctacct

SEQ ID NO: 36752 - DNA, 24 bp, Artificial Sequence
  Description of Artificial Sequence: Synthetic oligonucleotide
gcggagcaggacagaggctacctg

SEQ ID NO: 36753 - DNA, 25 bp, Artificial Sequence
  Description of Artificial Sequence: Synthetic oligonucleotide
cggagcaggacagaggctacctgga

SEQ ID NO: 36754 - DNA, 25 bp, Artificial Sequence
  Description of Artificial Sequence: Synthetic oligonucleotide
ggagcaggacagaggctacctggag

SEQ ID NO: 36755 - DNA, 25 bp, Artificial Sequence
  Description of Artificial Sequence: Synthetic oligonucleotide
gagcaggacagaggctacctggagg

SEQ ID NO: 36756 - DNA, 25 bp, Artificial Sequence
  Description of Artificial Sequence: Synthetic oligonucleotide
agcaggacagaggctacctggaggg

SEQ ID NO: 36757 - DNA, 24 bp, Artificial Sequence
  Description of Artificial Sequence: Synthetic oligonucleotide
gcaggacagaggctacctggaggg

SEQ ID NO: 36758 - DNA, 24 bp, Artificial Sequence
  Description of Artificial Sequence: Synthetic oligonucleotide
caggacagaggctacctggagggc

SEQ ID NO: 36759 - DNA, 25 bp, Artificial Sequence
  Description of Artificial Sequence: Synthetic oligonucleotide
aggacagaggctacctggagggcct

SEQ ID NO: 36760 - DNA, 24 bp, Artificial Sequence
  Description of Artificial Sequence: Synthetic oligonucleotide
ggacagaggctacctggagggcct

SEQ ID NO: 36761 - DNA, 25 bp, Artificial Sequence
  Description of Artificial Sequence: Synthetic oligonucleotide
gacagaggctacctggagggcctgt

SEQ ID NO: 36762 - DNA, 25 bp, Artificial Sequence
  Description of Artificial Sequence: Synthetic oligonucleotide
acagaggctacctggagggcctgtg

SEQ ID NO: 36763 - DNA, 24 bp, Artificial Sequence
  Description of Artificial Sequence: Synthetic oligonucleotide
cagaggctacctggagggcctgtg

SEQ ID NO: 36764 - DNA, 24 bp, Artificial Sequence
  Description of Artificial Sequence: Synthetic oligonucleotide
agaggctacctggagggcctgtgc

SEQ ID NO: 36765 - DNA, 23 bp, Artificial Sequence
  Description of Artificial Sequence: Synthetic oligonucleotide
gaggctacctggagggcctgtgc

SEQ ID NO: 36766 - DNA, 24 bp, Artificial Sequence
  Description of Artificial Sequence: Synthetic oligonucleotide
aggctacctggagggcctgtgcgt

SEQ ID NO: 36767 - DNA, 23 bp, Artificial Sequence
  Description of Artificial Sequence: Synthetic oligonucleotide
ggctacctggagggcctgtgcgt

SEQ ID NO: 36768 - DNA, 23 bp, Artificial Sequence
  Description of Artificial Sequence: Synthetic oligonucleotide
gctacctggagggcctgtgcgtg

SEQ ID NO: 36769 - DNA, 29 bp, Artificial Sequence
  Description of Artificial Sequence: Synthetic oligonucleotide
caaggattacatcgccctgaacgaggacg

SEQ ID NO: 36770 - DNA, 30 bp, Artificial Sequence
  Description of Artificial Sequence: Synthetic oligonucleotide
aaggattacatcgccctgaacgaggacgtg

SEQ ID NO: 36771 - DNA, 29 bp, Artificial Sequence
  Description of Artificial Sequence: Synthetic oligonucleotide
aggattacatcgccctgaacgaggacgtg

SEQ ID NO: 36772 - DNA, 28 bp, Artificial Sequence
  Description of Artificial Sequence: Synthetic oligonucleotide
ggattacatcgccctgaacgaggacgtg

SEQ ID NO: 36773 - DNA, 29 bp, Artificial Sequence
  Description of Artificial Sequence: Synthetic oligonucleotide
gattacatcgccctgaacgaggacgtgag

SEQ ID NO: 36774 - DNA, 29 bp, Artificial Sequence
  Description of Artificial Sequence: Synthetic oligonucleotide
attacatcgccctgaacgaggacgtgagc

SEQ ID NO: 36775 - DNA, 28 bp, Artificial Sequence
  Description of Artificial Sequence: Synthetic oligonucleotide
ttacatcgccctgaacgaggacgtgagc

SEQ ID NO: 36776 - DNA, 27 bp, Artificial Sequence
  Description of Artificial Sequence: Synthetic oligonucleotide
tacatcgccctgaacgaggacgtgagc

SEQ ID NO: 36777 - DNA, 27 bp, Artificial Sequence
  Description of Artificial Sequence: Synthetic oligonucleotide
acatcgccctgaacgaggacgtgagct

SEQ ID NO: 36778 - DNA, 26 bp, Artificial Sequence
  Description of Artificial Sequence: Synthetic oligonucleotide
catcgccctgaacgaggacgtgagct

SEQ ID NO: 36779 - DNA, 26 bp, Artificial Sequence
  Description of Artificial Sequence: Synthetic oligonucleotide
atcgccctgaacgaggacgtgagctc

SEQ ID NO: 36780 - DNA, 25 bp, Artificial Sequence
  Description of Artificial Sequence: Synthetic oligonucleotide
tcgccctgaacgaggacgtgagctc

SEQ ID NO: 36781 - DNA, 24 bp, Artificial Sequence
  Description of Artificial Sequence: Synthetic oligonucleotide
cgccctgaacgaggacgtgagctc

SEQ ID NO: 36782 - DNA, 25 bp, Artificial Sequence
  Description of Artificial Sequence: Synthetic oligonucleotide
gccctgaacgaggacgtgagctcct

SEQ ID NO: 36783 - DNA, 25 bp, Artificial Sequence
  Description of Artificial Sequence: Synthetic oligonucleotide
ccctgaacgaggacgtgagctcctg

SEQ ID NO: 36784 - DNA, 26 bp, Artificial Sequence
  Description of Artificial Sequence: Synthetic oligonucleotide
cctgaacgaggacgtgagctcctgga

SEQ ID NO: 36785 - DNA, 26 bp, Artificial Sequence
  Description of Artificial Sequence: Synthetic oligonucleotide
ctgaacgaggacgtgagctcctggac

SEQ ID NO: 36786 - DNA, 26 bp, Artificial Sequence
  Description of Artificial Sequence: Synthetic oligonucleotide
tgaacgaggacgtgagctcctggacc

SEQ ID NO: 36787 - DNA, 25 bp, Artificial Sequence
  Description of Artificial Sequence: Synthetic oligonucleotide
gaacgaggacgtgagctcctggacc

SEQ ID NO: 36788 - DNA, 25 bp, Artificial Sequence
  Description of Artificial Sequence: Synthetic oligonucleotide
aacgaggacgtgagctcctggaccg

SEQ ID NO: 36789 - DNA, 24 bp, Artificial Sequence
  Description of Artificial Sequence: Synthetic oligonucleotide
acgaggacgtgagctcctggaccg

SEQ ID NO: 36790 - DNA, 23 bp, Artificial Sequence
  Description of Artificial Sequence: Synthetic oligonucleotide
cgaggacgtgagctcctggaccg

SEQ ID NO: 36791 - DNA, 23 bp, Artificial Sequence
  Description of Artificial Sequence: Synthetic oligonucleotide
gaggacgtgagctcctggaccgc

SEQ ID NO: 36792 - DNA, 23 bp, Artificial Sequence
  Description of Artificial Sequence: Synthetic oligonucleotide
aggacgtgagctcctggaccgcg

SEQ ID NO: 36793 - DNA, 22 bp, Artificial Sequence
  Description of Artificial Sequence: Synthetic oligonucleotide
ggacgtgagctcctggaccgcg

SEQ ID NO: 36794 - DNA, 22 bp, Artificial Sequence
  Description of Artificial Sequence: Synthetic oligonucleotide
gacgtgagctcctggaccgcgg

SEQ ID NO: 36795 - DNA, 22 bp, Artificial Sequence
  Description of Artificial Sequence: Synthetic oligonucleotide
acgtgagctcctggaccgcggc

SEQ ID NO: 36796 - DNA, 21 bp, Artificial Sequence
  Description of Artificial Sequence: Synthetic oligonucleotide
cgtgagctcctggaccgcggc

SEQ ID NO: 36797 - DNA, 21 bp, Artificial Sequence
  Description of Artificial Sequence: Synthetic oligonucleotide
gtgagctcctggaccgcggcg

SEQ ID NO: 36798 - DNA, 23 bp, Artificial Sequence
  Description of Artificial Sequence: Synthetic oligonucleotide
ggcctgtgcgtggagtcgctcct

SEQ ID NO: 36799 - DNA, 24 bp, Artificial Sequence
  Description of Artificial Sequence: Synthetic oligonucleotide
gcctgtgcgtggagtcgctcctca

SEQ ID NO: 36800 - DNA, 27 bp, Artificial Sequence
  Description of Artificial Sequence: Synthetic oligonucleotide
cctgtgcgtggagtcgctcctcagata

SEQ ID NO: 36801 - DNA, 27 bp, Artificial Sequence
  Description of Artificial Sequence: Synthetic oligonucleotide
ctgtgcgtggagtcgctcctcagatac

SEQ ID NO: 36802 - DNA, 27 bp, Artificial Sequence
  Description of Artificial Sequence: Synthetic oligonucleotide
tgtgcgtggagtcgctcctcagatacc

SEQ ID NO: 36803 - DNA, 27 bp, Artificial Sequence
  Description of Artificial Sequence: Synthetic oligonucleotide
gtgcgtggagtcgctcctcagatacct

SEQ ID NO: 36804 - DNA, 27 bp, Artificial Sequence
  Description of Artificial Sequence: Synthetic oligonucleotide
tgcgtggagtcgctcctcagatacctg

SEQ ID NO: 36805 - DNA, 26 bp, Artificial Sequence
  Description of Artificial Sequence: Synthetic oligonucleotide
gcgtggagtcgctcctcagatacctg

SEQ ID NO: 36806 - DNA, 27 bp, Artificial Sequence
  Description of Artificial Sequence: Synthetic oligonucleotide
cgtggagtcgctcctcagatacctgga

SEQ ID NO: 36807 - DNA, 27 bp, Artificial Sequence
  Description of Artificial Sequence: Synthetic oligonucleotide
gtggagtcgctcctcagatacctggag

SEQ ID NO: 36808 - DNA, 29 bp, Artificial Sequence
  Description of Artificial Sequence: Synthetic oligonucleotide
tggagtcgctcctcagatacctggagaac

SEQ ID NO: 36809 - DNA, 28 bp, Artificial Sequence
  Description of Artificial Sequence: Synthetic oligonucleotide
ggagtcgctcctcagatacctggagaac

SEQ ID NO: 36810 - DNA, 28 bp, Artificial Sequence
  Description of Artificial Sequence: Synthetic oligonucleotide
gagtcgctcctcagatacctggagaacg

SEQ ID NO: 36811 - DNA, 28 bp, Artificial Sequence
  Description of Artificial Sequence: Synthetic oligonucleotide
agtcgctcctcagatacctggagaacgg

SEQ ID NO: 36812 - DNA, 27 bp, Artificial Sequence
  Description of Artificial Sequence: Synthetic oligonucleotide
gtcgctcctcagatacctggagaacgg

SEQ ID NO: 36813 - DNA, 27 bp, Artificial Sequence
  Description of Artificial Sequence: Synthetic oligonucleotide
tcgctcctcagatacctggagaacggg

SEQ ID NO: 36814 - DNA, 27 bp, Artificial Sequence
  Description of Artificial Sequence: Synthetic oligonucleotide
cgctcctcagatacctggagaacggga

SEQ ID NO: 36815 - DNA, 29 bp, Artificial Sequence
  Description of Artificial Sequence: Synthetic oligonucleotide
acgacacgctgttcgtgaggttcgacaac

SEQ ID NO: 36816 - DNA, 28 bp, Artificial Sequence
  Description of Artificial Sequence: Synthetic oligonucleotide
cgacacgctgttcgtgaggttcgacaac

SEQ ID NO: 36817 - DNA, 28 bp, Artificial Sequence
  Description of Artificial Sequence: Synthetic oligonucleotide
gacacgctgttcgtgaggttcgacaacg

SEQ ID NO: 36818 - DNA, 29 bp, Artificial Sequence
  Description of Artificial Sequence: Synthetic oligonucleotide
acacgctgttcgtgaggttcgacaacgac

SEQ ID NO: 36819 - DNA, 28 bp, Artificial Sequence
  Description of Artificial Sequence: Synthetic oligonucleotide
cacgctgttcgtgaggttcgacaacgac

SEQ ID NO: 36820 - DNA, 28 bp, Artificial Sequence
  Description of Artificial Sequence: Synthetic oligonucleotide
acgctgttcgtgaggttcgacaacgacg

SEQ ID NO: 36821 - DNA, 27 bp, Artificial Sequence
  Description of Artificial Sequence: Synthetic oligonucleotide
cgctgttcgtgaggttcgacaacgacg

SEQ ID NO: 36822 - DNA, 27 bp, Artificial Sequence
  Description of Artificial Sequence: Synthetic oligonucleotide
gctgttcgtgaggttcgacaacgacgc

SEQ ID NO: 36823 - DNA, 27 bp, Artificial Sequence
  Description of Artificial Sequence: Synthetic oligonucleotide
ctgttcgtgaggttcgacaacgacgcc

SEQ ID NO: 36824 - DNA, 28 bp, Artificial Sequence
  Description of Artificial Sequence: Synthetic oligonucleotide
tgttcgtgaggttcgacaacgacgccac

SEQ ID NO: 36825 - DNA, 27 bp, Artificial Sequence
  Description of Artificial Sequence: Synthetic oligonucleotide
gttcgtgaggttcgacaacgacgccac

SEQ ID NO: 36826 - DNA, 27 bp, Artificial Sequence
  Description of Artificial Sequence: Synthetic oligonucleotide
ttcgtgaggttcgacaacgacgccacg

SEQ ID NO: 36827 - DNA, 27 bp, Artificial Sequence
  Description of Artificial Sequence: Synthetic oligonucleotide
tcgtgaggttcgacaacgacgccacga

SEQ ID NO: 36828 - DNA, 26 bp, Artificial Sequence
  Description of Artificial Sequence: Synthetic oligonucleotide
cgtgaggttcgacaacgacgccacga

SEQ ID NO: 36829 - DNA, 27 bp, Artificial Sequence
  Description of Artificial Sequence: Synthetic oligonucleotide
gtgaggttcgacaacgacgccacgagt

SEQ ID NO: 36830 - DNA, 27 bp, Artificial Sequence
  Description of Artificial Sequence: Synthetic oligonucleotide
tgaggttcgacaacgacgccacgagtc

SEQ ID NO: 36831 - DNA, 26 bp, Artificial Sequence
  Description of Artificial Sequence: Synthetic oligonucleotide
gaggttcgacaacgacgccacgagtc

SEQ ID NO: 36832 - DNA, 26 bp, Artificial Sequence
  Description of Artificial Sequence: Synthetic oligonucleotide
aggttcgacaacgacgccacgagtcc

SEQ ID NO: 36833 - DNA, 25 bp, Artificial Sequence
  Description of Artificial Sequence: Synthetic oligonucleotide
ggttcgacaacgacgccacgagtcc

SEQ ID NO: 36834 - DNA, 26 bp, Artificial Sequence
  Description of Artificial Sequence: Synthetic oligonucleotide
gttcgacaacgacgccacgagtccga

SEQ ID NO: 36835 - DNA, 26 bp, Artificial Sequence
  Description of Artificial Sequence: Synthetic oligonucleotide
ttcgacaacgacgccacgagtccgag

SEQ ID NO: 36836 - DNA, 25 bp, Artificial Sequence
  Description of Artificial Sequence: Synthetic oligonucleotide
tcgacaacgacgccacgagtccgag

SEQ ID NO: 36837 - DNA, 24 bp, Artificial Sequence
  Description of Artificial Sequence: Synthetic oligonucleotide
cgacaacgacgccacgagtccgag

SEQ ID NO: 36838 - DNA, 26 bp, Artificial Sequence
  Description of Artificial Sequence: Synthetic oligonucleotide
gacaacgacgccacgagtccgaggaa

SEQ ID NO: 36839 - DNA, 26 bp, Artificial Sequence
  Description of Artificial Sequence: Synthetic oligonucleotide
acaacgacgccacgagtccgaggaag

SEQ ID NO: 36840 - DNA, 25 bp, Artificial Sequence
  Description of Artificial Sequence: Synthetic oligonucleotide
caacgacgccacgagtccgaggaag

SEQ ID NO: 36841 - DNA, 26 bp, Artificial Sequence
  Description of Artificial Sequence: Synthetic oligonucleotide
aacgacgccacgagtccgaggaagga

SEQ ID NO: 36842 - DNA, 25 bp, Artificial Sequence
  Description of Artificial Sequence: Synthetic oligonucleotide
acgacgccacgagtccgaggaagga

SEQ ID NO: 36843 - DNA, 26 bp, Artificial Sequence
  Description of Artificial Sequence: Synthetic oligonucleotide
acagcgacgccacgagtccgaggaat

SEQ ID NO: 36844 - DNA, 25 bp, Artificial Sequence
  Description of Artificial Sequence: Synthetic oligonucleotide
cagcgacgccacgagtccgaggaat

SEQ ID NO: 36845 - DNA, 26 bp, Artificial Sequence
  Description of Artificial Sequence: Synthetic oligonucleotide
agcgacgccacgagtccgaggaatga

SEQ ID NO: 36846 - DNA, 25 bp, Artificial Sequence
  Description of Artificial Sequence: Synthetic oligonucleotide
gcgacgccacgagtccgaggaatga

SEQ ID NO: 36847 - DNA, 25 bp, Artificial Sequence
  Description of Artificial Sequence: Synthetic oligonucleotide
cgacgccacgagtccgaggaatgag

SEQ ID NO: 36848 - DNA, 25 bp, Artificial Sequence
  Description of Artificial Sequence: Synthetic oligonucleotide
gacgccacgagtccgaggaatgagc

SEQ ID NO: 36849 - DNA, 25 bp, Artificial Sequence
  Description of Artificial Sequence: Synthetic oligonucleotide
acgccacgagtccgaggaatgagcc

SEQ ID NO: 36850 - DNA, 24 bp, Artificial Sequence
  Description of Artificial Sequence: Synthetic oligonucleotide
cgccacgagtccgaggaatgagcc

SEQ ID NO: 36851 - DNA, 24 bp, Artificial Sequence
  Description of Artificial Sequence: Synthetic oligonucleotide
gccacgagtccgaggaatgagccg

SEQ ID NO: 36852 - DNA, 24 bp, Artificial Sequence
  Description of Artificial Sequence: Synthetic oligonucleotide
ccacgagtccgaggaatgagccgc

SEQ ID NO: 36853 - DNA, 24 bp, Artificial Sequence
  Description of Artificial Sequence: Synthetic oligonucleotide
cacgagtccgaggaatgagccgcg

SEQ ID NO: 36854 - DNA, 24 bp, Artificial Sequence
  Description of Artificial Sequence: Synthetic oligonucleotide
acgagtccgaggaatgagccgcgg

SEQ ID NO: 36855 - DNA, 23 bp, Artificial Sequence
  Description of Artificial Sequence: Synthetic oligonucleotide
cgagtccgaggaatgagccgcgg

SEQ ID NO: 36856 - DNA, 23 bp, Artificial Sequence
  Description of Artificial Sequence: Synthetic oligonucleotide
gagtccgaggaatgagccgcggg

SEQ ID NO: 36857 - DNA, 23 bp, Artificial Sequence
  Description of Artificial Sequence: Synthetic oligonucleotide
agtccgaggaatgagccgcgggc

SEQ ID NO: 36858 - DNA, 22 bp, Artificial Sequence
  Description of Artificial Sequence: Synthetic oligonucleotide
gtccgaggaatgagccgcgggc

SEQ ID NO: 36859 - DNA, 22 bp, Artificial Sequence
  Description of Artificial Sequence: Synthetic oligonucleotide
tccgaggaatgagccgcgggcg

SEQ ID NO: 36860 - DNA, 21 bp, Artificial Sequence
  Description of Artificial Sequence: Synthetic oligonucleotide
ccgaggaatgagccgcgggcg

SEQ ID NO: 36861 - DNA, 21 bp, Artificial Sequence
  Description of Artificial Sequence: Synthetic oligonucleotide
cgaggaatgagccgcgggcgc

SEQ ID NO: 36862 - DNA, 23 bp, Artificial Sequence
  Description of Artificial Sequence: Synthetic oligonucleotide
gaggaatgagccgcgggcgccat

SEQ ID NO: 36863 - DNA, 23 bp, Artificial Sequence
  Description of Artificial Sequence: Synthetic oligonucleotide
aggaatgagccgcgggcgccatg

SEQ ID NO: 36864 - DNA, 22 bp, Artificial Sequence
  Description of Artificial Sequence: Synthetic oligonucleotide
ggaatgagccgcgggcgccatg

SEQ ID NO: 36865 - DNA, 25 bp, Artificial Sequence
  Description of Artificial Sequence: Synthetic oligonucleotide
gaatgagccgcgggcgccatggata

SEQ ID NO: 36866 - DNA, 26 bp, Artificial Sequence
  Description of Artificial Sequence: Synthetic oligonucleotide
aatgagccgcgggcgccatggataga

SEQ ID NO: 36867 - DNA, 25 bp, Artificial Sequence
  Description of Artificial Sequence: Synthetic oligonucleotide
atgagccgcgggcgccatggataga

SEQ ID NO: 36868 - DNA, 24 bp, Artificial Sequence
  Description of Artificial Sequence: Synthetic oligonucleotide
tgagccgcgggcgccatggataga

SEQ ID NO: 36869 - DNA, 20 bp, Artificial Sequence
  Description of Artificial Sequence: Synthetic oligonucleotide
cggccgcggggagccccatt

SEQ ID NO: 36870 - DNA, 20 bp, Artificial Sequence
  Description of Artificial Sequence: Synthetic oligonucleotide
ggccgcggggagccccactt

SEQ ID NO: 36871 - DNA, 22 bp, Artificial Sequence
  Description of Artificial Sequence: Synthetic oligonucleotide
gccgcggggagccccacttcat

SEQ ID NO: 36872 - DNA, 23 bp, Artificial Sequence
  Description of Artificial Sequence: Synthetic oligonucleotide
ccgcggggagccccacttcatca

SEQ ID NO: 36873 - DNA, 23 bp, Artificial Sequence
  Description of Artificial Sequence: Synthetic oligonucleotide
cgcggggagccccacttcatcac

SEQ ID NO: 36874 - DNA, 23 bp, Artificial Sequence
  Description of Artificial Sequence: Synthetic oligonucleotide
gcggggagccccacttcatcacc

SEQ ID NO: 36875 - DNA, 24 bp, Artificial Sequence
  Description of Artificial Sequence: Synthetic oligonucleotide
cggggagccccacttcatcaccgt

SEQ ID NO: 36876 - DNA, 24 bp, Artificial Sequence
  Description of Artificial Sequence: Synthetic oligonucleotide
ggggagccccacttcatcaccgtg

SEQ ID NO: 36877 - DNA, 24 bp, Artificial Sequence
  Description of Artificial Sequence: Synthetic oligonucleotide
gggagccccacttcatcaccgtgg

SEQ ID NO: 36878 - DNA, 24 bp, Artificial Sequence
  Description of Artificial Sequence: Synthetic oligonucleotide
ggagccccacttcatcaccgtggg

SEQ ID NO: 36879 - DNA, 26 bp, Artificial Sequence
  Description of Artificial Sequence: Synthetic oligonucleotide
gagccccacttcatcaccgtgggcta

SEQ ID NO: 36880 - DNA, 26 bp, Artificial Sequence
  Description of Artificial Sequence: Synthetic oligonucleotide
agccccacttcatcaccgtgggctac

SEQ ID NO: 36881 - DNA, 25 bp, Artificial Sequence
  Description of Artificial Sequence: Synthetic oligonucleotide
gccccacttcatcaccgtgggctac

SEQ ID NO: 36882 - DNA, 26 bp, Artificial Sequence
  Description of Artificial Sequence: Synthetic oligonucleotide
ccccacttcatcaccgtgggctacgt

SEQ ID NO: 36883 - DNA, 26 bp, Artificial Sequence
  Description of Artificial Sequence: Synthetic oligonucleotide
cccacttcatcaccgtgggctacgtg

SEQ ID NO: 36884 - DNA, 27 bp, Artificial Sequence
  Description of Artificial Sequence: Synthetic oligonucleotide
ccacttcatcaccgtgggctacgtgga

SEQ ID NO: 36885 - DNA, 27 bp, Artificial Sequence
  Description of Artificial Sequence: Synthetic oligonucleotide
cacttcatcaccgtgggctacgtggac

SEQ ID NO: 36886 - DNA, 27 bp, Artificial Sequence
  Description of Artificial Sequence: Synthetic oligonucleotide
acttcatcaccgtgggctacgtggacg

SEQ ID NO: 36887 - DNA, 30 bp, Artificial Sequence
  Description of Artificial Sequence: Synthetic oligonucleotide
ccactccatgaggtatttctacaccgccac

SEQ ID NO: 36888 - DNA, 30 bp, Artificial Sequence
  Description of Artificial Sequence: Synthetic oligonucleotide
cactccatgaggtatttctacaccgccacg

SEQ ID NO: 36889 - DNA, 31 bp, Artificial Sequence
  Description of Artificial Sequence: Synthetic oligonucleotide
actccatgaggtatttctacaccgccacgtc

SEQ ID NO: 36890 - DNA, 30 bp, Artificial Sequence
  Description of Artificial Sequence: Synthetic oligonucleotide
ctccatgaggtatttctacaccgccacgtc

SEQ ID NO: 36891 - DNA, 30 bp, Artificial Sequence
  Description of Artificial Sequence: Synthetic oligonucleotide
tccatgaggtatttctacaccgccacgtcc

SEQ ID NO: 36892 - DNA, 29 bp, Artificial Sequence
  Description of Artificial Sequence: Synthetic oligonucleotide
ccatgaggtatttctacaccgccacgtcc

SEQ ID NO: 36893 - DNA, 29 bp, Artificial Sequence
  Description of Artificial Sequence: Synthetic oligonucleotide
catgaggtatttctacaccgccacgtccc

SEQ ID NO: 36894 - DNA, 29 bp, Artificial Sequence
  Description of Artificial Sequence: Synthetic oligonucleotide
atgaggtatttctacaccgccacgtcccg

SEQ ID NO: 36895 - DNA, 28 bp, Artificial Sequence
  Description of Artificial Sequence: Synthetic oligonucleotide
tgaggtatttctacaccgccacgtcccg

SEQ ID NO: 36896 - DNA, 27 bp, Artificial Sequence
  Description of Artificial Sequence: Synthetic oligonucleotide
gaggtatttctacaccgccacgtcccg

SEQ ID NO: 36897 - DNA, 27 bp, Artificial Sequence
  Description of Artificial Sequence: Synthetic oligonucleotide
aggtatttctacaccgccacgtcccgg

SEQ ID NO: 36898 - DNA, 26 bp, Artificial Sequence
  Description of Artificial Sequence: Synthetic oligonucleotide
ggtatttctacaccgccacgtcccgg

SEQ ID NO: 36899 - DNA, 26 bp, Artificial Sequence
  Description of Artificial Sequence: Synthetic oligonucleotide
gtatttctacaccgccacgtcccggc

SEQ ID NO: 36900 - DNA, 26 bp, Artificial Sequence
  Description of Artificial Sequence: Synthetic oligonucleotide
tatttctacaccgccacgtcccggcc

SEQ ID NO: 36901 - DNA, 25 bp, Artificial Sequence
  Description of Artificial Sequence: Synthetic oligonucleotide
atttctacaccgccacgtcccggcc

SEQ ID NO: 36902 - DNA, 24 bp, Artificial Sequence
  Description of Artificial Sequence: Synthetic oligonucleotide
tttctacaccgccacgtcccggcc

SEQ ID NO: 36903 - DNA, 23 bp, Artificial Sequence
  Description of Artificial Sequence: Synthetic oligonucleotide
ttctacaccgccacgtcccggcc

SEQ ID NO: 36904 - DNA, 22 bp, Artificial Sequence
  Description of Artificial Sequence: Synthetic oligonucleotide
tctacaccgccacgtcccggcc

SEQ ID NO: 36905 - DNA, 21 bp, Artificial Sequence
  Description of Artificial Sequence: Synthetic oligonucleotide
ctacaccgccacgtcccggcc

SEQ ID NO: 36906 - DNA, 21 bp, Artificial Sequence
  Description of Artificial Sequence: Synthetic oligonucleotide
tacaccgccacgtcccggccc

SEQ ID NO: 36907 - DNA, 20 bp, Artificial Sequence
  Description of Artificial Sequence: Synthetic oligonucleotide
acaccgccacgtcccggccc

SEQ ID NO: 36908 - DNA, 20 bp, Artificial Sequence
  Description of Artificial Sequence: Synthetic oligonucleotide
caccgccacgtcccggccct

SEQ ID NO: 36909 - DNA, 20 bp, Artificial Sequence
  Description of Artificial Sequence: Synthetic oligonucleotide
accgccacgtcccggcccgt

SEQ ID NO: 36910 - DNA, 20 bp, Artificial Sequence
  Description of Artificial Sequence: Synthetic oligonucleotide
ccgccacgtcccggcccgtt

SEQ ID NO: 36911 - DNA, 20 bp, Artificial Sequence
  Description of Artificial Sequence: Synthetic oligonucleotide
cgccacgtcccggcccggtt

SEQ ID NO: 36912 - DNA, 20 bp, Artificial Sequence
  Description of Artificial Sequence: Synthetic oligonucleotide
gccacgtcccggcccggctt

SEQ ID NO: 36913 - DNA, 20 bp, Artificial Sequence
  Description of Artificial Sequence: Synthetic oligonucleotide
ccacgtcccggcccggcctt

SEQ ID NO: 36914 - DNA, 20 bp, Artificial Sequence
  Description of Artificial Sequence: Synthetic oligonucleotide
cacgtcccggcccggccgtt

SEQ ID NO: 36915 - DNA, 20 bp, Artificial Sequence
  Description of Artificial Sequence: Synthetic oligonucleotide
acgtcccggcccggccgctt

SEQ ID NO: 36916 - DNA, 20 bp, Artificial Sequence
  Description of Artificial Sequence: Synthetic oligonucleotide
cgtcccggcccggccgcttt

SEQ ID NO: 36917 - DNA, 20 bp, Artificial Sequence
  Description of Artificial Sequence: Synthetic oligonucleotide
gggccggacgggcgcctcat

SEQ ID NO: 36918 - DNA, 20 bp, Artificial Sequence
  Description of Artificial Sequence: Synthetic oligonucleotide
ggccggacgggcgcctcatc

SEQ ID NO: 36919 - DNA, 20 bp, Artificial Sequence
  Description of Artificial Sequence: Synthetic oligonucleotide
gccggacgggcgcctcatcc

SEQ ID NO: 36920 - DNA, 20 bp, Artificial Sequence
  Description of Artificial Sequence: Synthetic oligonucleotide
ccggacgggcgcctcatccg

SEQ ID NO: 36921 - DNA, 20 bp, Artificial Sequence
  Description of Artificial Sequence: Synthetic oligonucleotide
cggacgggcgcctcatccgc

SEQ ID NO: 36922 - DNA, 20 bp, Artificial Sequence
  Description of Artificial Sequence: Synthetic oligonucleotide
ggacgggcgcctcatccgcg

SEQ ID NO: 36923 - DNA, 20 bp, Artificial Sequence
  Description of Artificial Sequence: Synthetic oligonucleotide
gacgggcgcctcatccgcgg

SEQ ID NO: 36924 - DNA, 23 bp, Artificial Sequence
  Description of Artificial Sequence: Synthetic oligonucleotide
acgggcgcctcatccgcgggtat

SEQ ID NO: 36925 - DNA, 22 bp, Artificial Sequence
  Description of Artificial Sequence: Synthetic oligonucleotide
cgggcgcctcatccgcgggtat

SEQ ID NO: 36926 - DNA, 23 bp, Artificial Sequence
  Description of Artificial Sequence: Synthetic oligonucleotide
gggcgcctcatccgcgggtatga

SEQ ID NO: 36927 - DNA, 23 bp, Artificial Sequence
  Description of Artificial Sequence: Synthetic oligonucleotide
ggcgcctcatccgcgggtatgac

SEQ ID NO: 36928 - DNA, 24 bp, Artificial Sequence
  Description of Artificial Sequence: Synthetic oligonucleotide
gcgcctcatccgcgggtatgacca

SEQ ID NO: 36929 - DNA, 24 bp, Artificial Sequence
  Description of Artificial Sequence: Synthetic oligonucleotide
cgcctcatccgcgggtatgaccag

SEQ ID NO: 36930 - DNA, 25 bp, Artificial Sequence
  Description of Artificial Sequence: Synthetic oligonucleotide
gcctcatccgcgggtatgaccagga

SEQ ID NO: 36931 - DNA, 25 bp, Artificial Sequence
  Description of Artificial Sequence: Synthetic oligonucleotide
cctcatccgcgggtatgaccaggac

SEQ ID NO: 36932 - DNA, 25 bp, Artificial Sequence
  Description of Artificial Sequence: Synthetic oligonucleotide
ctcatccgcgggtatgaccaggacg

SEQ ID NO: 36933 - DNA, 25 bp, Artificial Sequence
  Description of Artificial Sequence: Synthetic oligonucleotide
tcatccgcgggtatgaccaggacgc

SEQ ID NO: 36934 - DNA, 24 bp, Artificial Sequence
  Description of Artificial Sequence: Synthetic oligonucleotide
catccgcgggtatgaccaggacgc

SEQ ID NO: 36935 - DNA, 26 bp, Artificial Sequence
  Description of Artificial Sequence: Synthetic oligonucleotide
atccgcgggtatgaccaggacgccta

SEQ ID NO: 36936 - DNA, 20 bp, Artificial Sequence
  Description of Artificial Sequence: Synthetic oligonucleotide
ggcgcctcctccgcgggtgt

SEQ ID NO: 36937 - DNA, 21 bp, Artificial Sequence
  Description of Artificial Sequence: Synthetic oligonucleotide
gcgcctcctccgcgggtgtga

SEQ ID NO: 36938 - DNA, 21 bp, Artificial Sequence
  Description of Artificial Sequence: Synthetic oligonucleotide
cgcctcctccgcgggtgtgac

SEQ ID NO: 36939 - DNA, 22 bp, Artificial Sequence
  Description of Artificial Sequence: Synthetic oligonucleotide
gcctcctccgcgggtgtgacca

SEQ ID NO: 36940 - DNA, 22 bp, Artificial Sequence
  Description of Artificial Sequence: Synthetic oligonucleotide
cctcctccgcgggtgtgaccag

SEQ ID NO: 36941 - DNA, 23 bp, Artificial Sequence
  Description of Artificial Sequence: Synthetic oligonucleotide
ctcctccgcgggtgtgaccagga

SEQ ID NO: 36942 - DNA, 23 bp, Artificial Sequence
  Description of Artificial Sequence: Synthetic oligonucleotide
tcctccgcgggtgtgaccaggac

SEQ ID NO: 36943 - DNA, 22 bp, Artificial Sequence
  Description of Artificial Sequence: Synthetic oligonucleotide
cctccgcgggtgtgaccaggac

SEQ ID NO: 36944 - DNA, 22 bp, Artificial Sequence
  Description of Artificial Sequence: Synthetic oligonucleotide
ctccgcgggtgtgaccaggacg

SEQ ID NO: 36945 - DNA, 22 bp, Artificial Sequence
  Description of Artificial Sequence: Synthetic oligonucleotide
tccgcgggtgtgaccaggacgc

SEQ ID NO: 36946 - DNA, 21 bp, Artificial Sequence
  Description of Artificial Sequence: Synthetic oligonucleotide
ccgcgggtgtgaccaggacgc

SEQ ID NO: 36947 - DNA, 23 bp, Artificial Sequence
  Description of Artificial Sequence: Synthetic oligonucleotide
cgcgggtgtgaccaggacgccta

SEQ ID NO: 36948 - DNA, 23 bp, Artificial Sequence
  Description of Artificial Sequence: Synthetic oligonucleotide
gcgggtgtgaccaggacgcctac

SEQ ID NO: 36949 - DNA, 24 bp, Artificial Sequence
  Description of Artificial Sequence: Synthetic oligonucleotide
cgggtgtgaccaggacgcctacga

SEQ ID NO: 36950 - DNA, 24 bp, Artificial Sequence
  Description of Artificial Sequence: Synthetic oligonucleotide
gggtgtgaccaggacgcctacgac

SEQ ID NO: 36951 - DNA, 24 bp, Artificial Sequence
  Description of Artificial Sequence: Synthetic oligonucleotide
ggtgtgaccaggacgcctacgacg

SEQ ID NO: 36952 - DNA, 24 bp, Artificial Sequence
  Description of Artificial Sequence: Synthetic oligonucleotide
gtgtgaccaggacgcctacgacgg

SEQ ID NO: 36953 - DNA, 26 bp, Artificial Sequence
  Description of Artificial Sequence: Synthetic oligonucleotide
tgtgaccaggacgcctacgacggcaa

SEQ ID NO: 36954 - DNA, 25 bp, Artificial Sequence
  Description of Artificial Sequence: Synthetic oligonucleotide
gtgaccaggacgcctacgacggcaa

SEQ ID NO: 36955 - DNA, 24 bp, Artificial Sequence
  Description of Artificial Sequence: Synthetic oligonucleotide
cccgtgtggcggagcaggacagaa

SEQ ID NO: 36956 - DNA, 24 bp, Artificial Sequence
  Description of Artificial Sequence: Synthetic oligonucleotide
ccgtgtggcggagcaggacagaac

SEQ ID NO: 36957 - DNA, 26 bp, Artificial Sequence
  Description of Artificial Sequence: Synthetic oligonucleotide
cgtgtggcggagcaggacagaaccta

SEQ ID NO: 36958 - DNA, 26 bp, Artificial Sequence
  Description of Artificial Sequence: Synthetic oligonucleotide
gtgtggcggagcaggacagaacctac

SEQ ID NO: 36959 - DNA, 27 bp, Artificial Sequence
  Description of Artificial Sequence: Synthetic oligonucleotide
tgtggcggagcaggacagaacctacct

SEQ ID NO: 36960 - DNA, 26 bp, Artificial Sequence
  Description of Artificial Sequence: Synthetic oligonucleotide
gtggcggagcaggacagaacctacct

SEQ ID NO: 36961 - DNA, 26 bp, Artificial Sequence
  Description of Artificial Sequence: Synthetic oligonucleotide
tggcggagcaggacagaacctacctg

SEQ ID NO: 36962 - DNA, 25 bp, Artificial Sequence
  Description of Artificial Sequence: Synthetic oligonucleotide
ggcggagcaggacagaacctacctg

SEQ ID NO: 36963 - DNA, 26 bp, Artificial Sequence
  Description of Artificial Sequence: Synthetic oligonucleotide
gcggagcaggacagaacctacctgga

SEQ ID NO: 36964 - DNA, 26 bp, Artificial Sequence
  Description of Artificial Sequence: Synthetic oligonucleotide
cggagcaggacagaacctacctggag

SEQ ID NO: 36965 - DNA, 26 bp, Artificial Sequence
  Description of Artificial Sequence: Synthetic oligonucleotide
ggagcaggacagaacctacctggagg

SEQ ID NO: 36966 - DNA, 26 bp, Artificial Sequence
  Description of Artificial Sequence: Synthetic oligonucleotide
gagcaggacagaacctacctggaggg

SEQ ID NO: 36967 - DNA, 26 bp, Artificial Sequence
  Description of Artificial Sequence: Synthetic oligonucleotide
agcaggacagaacctacctggagggc

SEQ ID NO: 36968 - DNA, 25 bp, Artificial Sequence
  Description of Artificial Sequence: Synthetic oligonucleotide
gcaggacagaacctacctggagggc

SEQ ID NO: 36969 - DNA, 26 bp, Artificial Sequence
  Description of Artificial Sequence: Synthetic oligonucleotide
caggacagaacctacctggagggcct

SEQ ID NO: 36970 - DNA, 27 bp, Artificial Sequence
  Description of Artificial Sequence: Synthetic oligonucleotide
aggacagaacctacctggagggcctgt

SEQ ID NO: 36971 - DNA, 26 bp, Artificial Sequence
  Description of Artificial Sequence: Synthetic oligonucleotide
ggacagaacctacctggagggcctgt

SEQ ID NO: 36972 - DNA, 26 bp, Artificial Sequence
  Description of Artificial Sequence: Synthetic oligonucleotide
gacagaacctacctggagggcctgtg

SEQ ID NO: 36973 - DNA, 26 bp, Artificial Sequence
  Description of Artificial Sequence: Synthetic oligonucleotide
acagaacctacctggagggcctgtgc

SEQ ID NO: 36974 - DNA, 25 bp, Artificial Sequence
  Description of Artificial Sequence: Synthetic oligonucleotide
cagaacctacctggagggcctgtgc

SEQ ID NO: 36975 - DNA, 23 bp, Artificial Sequence
  Description of Artificial Sequence: Synthetic oligonucleotide
cgcaagtgggaggcggcccgtat

SEQ ID NO: 36976 - DNA, 23 bp, Artificial Sequence
  Description of Artificial Sequence: Synthetic oligonucleotide
gcaagtgggaggcggcccgtatg

SEQ ID NO: 36977 - DNA, 23 bp, Artificial Sequence
  Description of Artificial Sequence: Synthetic oligonucleotide
caagtgggaggcggcccgtatgg

SEQ ID NO: 36978 - DNA, 23 bp, Artificial Sequence
  Description of Artificial Sequence: Synthetic oligonucleotide
aagtgggaggcggcccgtatggc

SEQ ID NO: 36979 - DNA, 22 bp, Artificial Sequence
  Description of Artificial Sequence: Synthetic oligonucleotide
agtgggaggcggcccgtatggc

SEQ ID NO: 36980 - DNA, 21 bp, Artificial Sequence
  Description of Artificial Sequence: Synthetic oligonucleotide
gtgggaggcggcccgtatggc

SEQ ID NO: 36981 - DNA, 21 bp, Artificial Sequence
  Description of Artificial Sequence: Synthetic oligonucleotide
tgggaggcggcccgtatggcg

SEQ ID NO: 36982 - DNA, 20 bp, Artificial Sequence
  Description of Artificial Sequence: Synthetic oligonucleotide
gggaggcggcccgtatggcg

SEQ ID NO: 36983 - DNA, 21 bp, Artificial Sequence
  Description of Artificial Sequence: Synthetic oligonucleotide
ggaggcggcccgtatggcgga

SEQ ID NO: 36984 - DNA, 21 bp, Artificial Sequence
  Description of Artificial Sequence: Synthetic oligonucleotide
gaggcggcccgtatggcggag

SEQ ID NO: 36985 - DNA, 22 bp, Artificial Sequence
  Description of Artificial Sequence: Synthetic oligonucleotide
aggcggcccgtatggcggagca

SEQ ID NO: 36986 - DNA, 21 bp, Artificial Sequence
  Description of Artificial Sequence: Synthetic oligonucleotide
ggcggcccgtatggcggagca

SEQ ID NO: 36987 - DNA, 21 bp, Artificial Sequence
  Description of Artificial Sequence: Synthetic oligonucleotide
gcggcccgtatggcggagcag

SEQ ID NO: 36988 - DNA, 22 bp, Artificial Sequence
  Description of Artificial Sequence: Synthetic oligonucleotide
cggcccgtatggcggagcagct

SEQ ID NO: 36989 - DNA, 23 bp, Artificial Sequence
  Description of Artificial Sequence: Synthetic oligonucleotide
ggcccgtatggcggagcagctga

SEQ ID NO: 36990 - DNA, 24 bp, Artificial Sequence
  Description of Artificial Sequence: Synthetic oligonucleotide
gcccgtatggcggagcagctgaga

SEQ ID NO: 36991 - DNA, 24 bp, Artificial Sequence
  Description of Artificial Sequence: Synthetic oligonucleotide
cccgtatggcggagcagctgagag

SEQ ID NO: 36992 - DNA, 24 bp, Artificial Sequence
  Description of Artificial Sequence: Synthetic oligonucleotide
ccgtatggcggagcagctgagagc

SEQ ID NO: 36993 - DNA, 26 bp, Artificial Sequence
  Description of Artificial Sequence: Synthetic oligonucleotide
cgtatggcggagcagctgagagccta

SEQ ID NO: 36994 - DNA, 26 bp, Artificial Sequence
  Description of Artificial Sequence: Synthetic oligonucleotide
gtatggcggagcagctgagagcctac

SEQ ID NO: 36995 - DNA, 27 bp, Artificial Sequence
  Description of Artificial Sequence: Synthetic oligonucleotide
tatggcggagcagctgagagcctacct

SEQ ID NO: 36996 - DNA, 26 bp, Artificial Sequence
  Description of Artificial Sequence: Synthetic oligonucleotide
atggcggagcagctgagagcctacct

SEQ ID NO: 36997 - DNA, 27 bp, Artificial Sequence
  Description of Artificial Sequence: Synthetic oligonucleotide
catcaccgtgggctacgtggacgacaa

SEQ ID NO: 36998 - DNA, 27 bp, Artificial Sequence
  Description of Artificial Sequence: Synthetic oligonucleotide
atcaccgtgggctacgtggacgacaag

SEQ ID NO: 36999 - DNA, 26 bp, Artificial Sequence
  Description of Artificial Sequence: Synthetic oligonucleotide
tcaccgtgggctacgtggacgacaag

SEQ ID NO: 37000 - DNA, 25 bp, Artificial Sequence
  Description of Artificial Sequence: Synthetic oligonucleotide
caccgtgggctacgtggacgacaag

SEQ ID NO: 37001 - DNA, 26 bp, Artificial Sequence
  Description of Artificial Sequence: Synthetic oligonucleotide
accgtgggctacgtggacgacaagct

SEQ ID NO: 37002 - DNA, 25 bp, Artificial Sequence
  Description of Artificial Sequence: Synthetic oligonucleotide
ccgtgggctacgtggacgacaagct

SEQ ID NO: 37003 - DNA, 27 bp, Artificial Sequence
  Description of Artificial Sequence: Synthetic oligonucleotide
cgtgggctacgtggacgacaagctgtt

SEQ ID NO: 37004 - DNA, 27 bp, Artificial Sequence
  Description of Artificial Sequence: Synthetic oligonucleotide
gtgggctacgtggacgacaagctgttc

SEQ ID NO: 37005 - DNA, 27 bp, Artificial Sequence
  Description of Artificial Sequence: Synthetic oligonucleotide
tgggctacgtggacgacaagctgttcg

SEQ ID NO: 37006 - DNA, 27 bp, Artificial Sequence
  Description of Artificial Sequence: Synthetic oligonucleotide
gggctacgtggacgacaagctgttcgt

SEQ ID NO: 37007 - DNA, 27 bp, Artificial Sequence
  Description of Artificial Sequence: Synthetic oligonucleotide
ggctacgtggacgacaagctgttcgtg

SEQ ID NO: 37008 - DNA, 28 bp, Artificial Sequence
  Description of Artificial Sequence: Synthetic oligonucleotide
gctacgtggacgacaagctgttcgtgag

SEQ ID NO: 37009 - DNA, 28 bp, Artificial Sequence
  Description of Artificial Sequence: Synthetic oligonucleotide
ctacgtggacgacaagctgttcgtgagg

SEQ ID NO: 37010 - DNA, 30 bp, Artificial Sequence
  Description of Artificial Sequence: Synthetic oligonucleotide
tacgtggacgacaagctgttcgtgaggttc

SEQ ID NO: 37011 - DNA, 29 bp, Artificial Sequence
  Description of Artificial Sequence: Synthetic oligonucleotide
acgtggacgacaagctgttcgtgaggttc

SEQ ID NO: 37012 - DNA, 28 bp, Artificial Sequence
  Description of Artificial Sequence: Synthetic oligonucleotide
cgtggacgacaagctgttcgtgaggttc

SEQ ID NO: 37013 - DNA, 28 bp, Artificial Sequence
  Description of Artificial Sequence: Synthetic oligonucleotide
gtggacgacaagctgttcgtgaggttcg

SEQ ID NO: 37014 - DNA, 29 bp, Artificial Sequence
  Description of Artificial Sequence: Synthetic oligonucleotide
tggacgacaagctgttcgtgaggttcgac

SEQ ID NO: 37015 - DNA, 28 bp, Artificial Sequence
  Description of Artificial Sequence: Synthetic oligonucleotide
ggacgacaagctgttcgtgaggttcgac

SEQ ID NO: 37016 - DNA, 29 bp, Artificial Sequence
  Description of Artificial Sequence: Synthetic oligonucleotide
gacgacaagctgttcgtgaggttcgacag

SEQ ID NO: 37017 - DNA, 29 bp, Artificial Sequence
  Description of Artificial Sequence: Synthetic oligonucleotide
acgacaagctgttcgtgaggttcgacagc

SEQ ID NO: 37018 - DNA, 28 bp, Artificial Sequence
  Description of Artificial Sequence: Synthetic oligonucleotide
cgacaagctgttcgtgaggttcgacagc

SEQ ID NO: 37019 - DNA, 28 bp, Artificial Sequence
  Description of Artificial Sequence: Synthetic oligonucleotide
gacaagctgttcgtgaggttcgacagcg

SEQ ID NO: 37020 - DNA, 29 bp, Artificial Sequence
  Description of Artificial Sequence: Synthetic oligonucleotide
acaagctgttcgtgaggttcgacagcgac

SEQ ID NO: 37021 - DNA, 28 bp, Artificial Sequence
  Description of Artificial Sequence: Synthetic oligonucleotide
caagctgttcgtgaggttcgacagcgac

SEQ ID NO: 37022 - DNA, 28 bp, Artificial Sequence
  Description of Artificial Sequence: Synthetic oligonucleotide
aagctgttcgtgaggttcgacagcgacg

SEQ ID NO: 37023 - DNA, 27 bp, Artificial Sequence
  Description of Artificial Sequence: Synthetic oligonucleotide
agctgttcgtgaggttcgacagcgacg

SEQ ID NO: 37024 - DNA, 24 bp, Artificial Sequence
  Description of Artificial Sequence: Synthetic oligonucleotide
gacaccgcggctcagatcacccac

SEQ ID NO: 37025 - DNA, 24 bp, Artificial Sequence
  Description of Artificial Sequence: Synthetic oligonucleotide
acaccgcggctcagatcacccacc

SEQ ID NO: 37026 - DNA, 23 bp, Artificial Sequence
  Description of Artificial Sequence: Synthetic oligonucleotide
caccgcggctcagatcacccacc

SEQ ID NO: 37027 - DNA, 23 bp, Artificial Sequence
  Description of Artificial Sequence: Synthetic oligonucleotide
accgcggctcagatcacccaccg

SEQ ID NO: 37028 - DNA, 22 bp, Artificial Sequence
  Description of Artificial Sequence: Synthetic oligonucleotide
ccgcggctcagatcacccaccg

SEQ ID NO: 37029 - DNA, 24 bp, Artificial Sequence
  Description of Artificial Sequence: Synthetic oligonucleotide
cgcggctcagatcacccaccgcaa

SEQ ID NO: 37030 - DNA, 25 bp, Artificial Sequence
  Description of Artificial Sequence: Synthetic oligonucleotide
gcggctcagatcacccaccgcaagt

SEQ ID NO: 37031 - DNA, 25 bp, Artificial Sequence
  Description of Artificial Sequence: Synthetic oligonucleotide
cggctcagatcacccaccgcaagtg

SEQ ID NO: 37032 - DNA, 25 bp, Artificial Sequence
  Description of Artificial Sequence: Synthetic oligonucleotide
ggctcagatcacccaccgcaagtgg

SEQ ID NO: 37033 - DNA, 26 bp, Artificial Sequence
  Description of Artificial Sequence: Synthetic oligonucleotide
gctcagatcacccaccgcaagtggga

SEQ ID NO: 37034 - DNA, 26 bp, Artificial Sequence
  Description of Artificial Sequence: Synthetic oligonucleotide
ctcagatcacccaccgcaagtgggag

SEQ ID NO: 37035 - DNA, 26 bp, Artificial Sequence
  Description of Artificial Sequence: Synthetic oligonucleotide
tcagatcacccaccgcaagtgggagg

SEQ ID NO: 37036 - DNA, 25 bp, Artificial Sequence
  Description of Artificial Sequence: Synthetic oligonucleotide
cagatcacccaccgcaagtgggagg

SEQ ID NO: 37037 - DNA, 25 bp, Artificial Sequence
  Description of Artificial Sequence: Synthetic oligonucleotide
agatcacccaccgcaagtgggaggc

SEQ ID NO: 37038 - DNA, 24 bp, Artificial Sequence
  Description of Artificial Sequence: Synthetic oligonucleotide
gatcacccaccgcaagtgggaggc

SEQ ID NO: 37039 - DNA, 24 bp, Artificial Sequence
  Description of Artificial Sequence: Synthetic oligonucleotide
atcacccaccgcaagtgggaggcg

SEQ ID NO: 37040 - DNA, 23 bp, Artificial Sequence
  Description of Artificial Sequence: Synthetic oligonucleotide
tcacccaccgcaagtgggaggcg

SEQ ID NO: 37041 - DNA, 22 bp, Artificial Sequence
  Description of Artificial Sequence: Synthetic oligonucleotide
cacccaccgcaagtgggaggcg

SEQ ID NO: 37042 - DNA, 22 bp, Artificial Sequence
  Description of Artificial Sequence: Synthetic oligonucleotide
acccaccgcaagtgggaggcgg

SEQ ID NO: 37043 - DNA, 21 bp, Artificial Sequence
  Description of Artificial Sequence: Synthetic oligonucleotide
cccaccgcaagtgggaggcgg

SEQ ID NO: 37044 - DNA, 21 bp, Artificial Sequence
  Description of Artificial Sequence: Synthetic oligonucleotide
ccaccgcaagtgggaggcggc

SEQ ID NO: 37045 - DNA, 21 bp, Artificial Sequence
  Description of Artificial Sequence: Synthetic oligonucleotide
caccgcaagtgggaggcggcc

SEQ ID NO: 37046 - DNA, 21 bp, Artificial Sequence
  Description of Artificial Sequence: Synthetic oligonucleotide
accgcaagtgggaggcggccc

SEQ ID NO: 37047 - DNA, 20 bp, Artificial Sequence
  Description of Artificial Sequence: Synthetic oligonucleotide
ccgcaagtgggaggcggccc

SEQ ID NO: 37048 - DNA, 25 bp, Artificial Sequence
  Description of Artificial Sequence: Synthetic oligonucleotide
gaggccgggtctcacatcatccagg

SEQ ID NO: 37049 - DNA, 25 bp, Artificial Sequence
  Description of Artificial Sequence: Synthetic oligonucleotide
aggccgggtctcacatcatccaggg

SEQ ID NO: 37050 - DNA, 24 bp, Artificial Sequence
  Description of Artificial Sequence: Synthetic oligonucleotide
ggccgggtctcacatcatccaggg

SEQ ID NO: 37051 - DNA, 26 bp, Artificial Sequence
  Description of Artificial Sequence: Synthetic oligonucleotide
gccgggtctcacatcatccaggggat

SEQ ID NO: 37052 - DNA, 27 bp, Artificial Sequence
  Description of Artificial Sequence: Synthetic oligonucleotide
ccgggtctcacatcatccaggggatgt

SEQ ID NO: 37053 - DNA, 28 bp, Artificial Sequence
  Description of Artificial Sequence: Synthetic oligonucleotide
cgggtctcacatcatccaggggatgtac

SEQ ID NO: 37054 - DNA, 28 bp, Artificial Sequence
  Description of Artificial Sequence: Synthetic oligonucleotide
gggtctcacatcatccaggggatgtacg

SEQ ID NO: 37055 - DNA, 28 bp, Artificial Sequence
  Description of Artificial Sequence: Synthetic oligonucleotide
ggtctcacatcatccaggggatgtacgg

SEQ ID NO: 37056 - DNA, 28 bp, Artificial Sequence
  Description of Artificial Sequence: Synthetic oligonucleotide
gtctcacatcatccaggggatgtacggc

SEQ ID NO: 37057 - DNA, 29 bp, Artificial Sequence
  Description of Artificial Sequence: Synthetic oligonucleotide
tctcacatcatccaggggatgtacggctg

SEQ ID NO: 37058 - DNA, 28 bp, Artificial Sequence
  Description of Artificial Sequence: Synthetic oligonucleotide
ctcacatcatccaggggatgtacggctg

SEQ ID NO: 37059 - DNA, 28 bp, Artificial Sequence
  Description of Artificial Sequence: Synthetic oligonucleotide
tcacatcatccaggggatgtacggctgc

SEQ ID NO: 37060 - DNA, 27 bp, Artificial Sequence
  Description of Artificial Sequence: Synthetic oligonucleotide
cacatcatccaggggatgtacggctgc

SEQ ID NO: 37061 - DNA, 27 bp, Artificial Sequence
  Description of Artificial Sequence: Synthetic oligonucleotide
acatcatccaggggatgtacggctgcg

SEQ ID NO: 37062 - DNA, 27 bp, Artificial Sequence
  Description of Artificial Sequence: Synthetic oligonucleotide
catcatccaggggatgtacggctgcga

SEQ ID NO: 37063 - DNA, 27 bp, Artificial Sequence
  Description of Artificial Sequence: Synthetic oligonucleotide
atcatccaggggatgtacggctgcgac

SEQ ID NO: 37064 - DNA, 26 bp, Artificial Sequence
  Description of Artificial Sequence: Synthetic oligonucleotide
tcatccaggggatgtacggctgcgac

SEQ ID NO: 37065 - DNA, 25 bp, Artificial Sequence
  Description of Artificial Sequence: Synthetic oligonucleotide
catccaggggatgtacggctgcgac

SEQ ID NO: 37066 - DNA, 26 bp, Artificial Sequence
  Description of Artificial Sequence: Synthetic oligonucleotide
atccaggggatgtacggctgcgacgt

SEQ ID NO: 37067 - DNA, 25 bp, Artificial Sequence
  Description of Artificial Sequence: Synthetic oligonucleotide
tccaggggatgtacggctgcgacgt

SEQ ID NO: 37068 - DNA, 24 bp, Artificial Sequence
  Description of Artificial Sequence: Synthetic oligonucleotide
ccaggggatgtacggctgcgacgt

SEQ ID NO: 37069 - DNA, 24 bp, Artificial Sequence
  Description of Artificial Sequence: Synthetic oligonucleotide
caggggatgtacggctgcgacgtg

SEQ ID NO: 37070 - DNA, 24 bp, Artificial Sequence
  Description of Artificial Sequence: Synthetic oligonucleotide
aggggatgtacggctgcgacgtgg

SEQ ID NO: 37071 - DNA, 23 bp, Artificial Sequence
  Description of Artificial Sequence: Synthetic oligonucleotide
ggggatgtacggctgcgacgtgg

SEQ ID NO: 37072 - DNA, 23 bp, Artificial Sequence
  Description of Artificial Sequence: Synthetic oligonucleotide
gggatgtacggctgcgacgtggg

SEQ ID NO: 37073 - DNA, 25 bp, Artificial Sequence
  Description of Artificial Sequence: Synthetic oligonucleotide
aggatgtacggctgcgacgtggggt

SEQ ID NO: 37074 - DNA, 24 bp, Artificial Sequence
  Description of Artificial Sequence: Synthetic oligonucleotide
ggatgtacggctgcgacgtggggt

SEQ ID NO: 37075 - DNA, 26 bp, Artificial Sequence
  Description of Artificial Sequence: Synthetic oligonucleotide
aaccagagcgaggccgggtctcagta

SEQ ID NO: 37076 - DNA, 25 bp, Artificial Sequence
  Description of Artificial Sequence: Synthetic oligonucleotide
accagagcgaggccgggtctcagta

SEQ ID NO: 37077 - DNA, 24 bp, Artificial Sequence
  Description of Artificial Sequence: Synthetic oligonucleotide
ccagagcgaggccgggtctcagta

SEQ ID NO: 37078 - DNA, 26 bp, Artificial Sequence
  Description of Artificial Sequence: Synthetic oligonucleotide
cagagcgaggccgggtctcagtacat

SEQ ID NO: 37079 - DNA, 26 bp, Artificial Sequence
  Description of Artificial Sequence: Synthetic oligonucleotide
agagcgaggccgggtctcagtacatc

SEQ ID NO: 37080 - DNA, 25 bp, Artificial Sequence
  Description of Artificial Sequence: Synthetic oligonucleotide
gagcgaggccgggtctcagtacatc

SEQ ID NO: 37081 - DNA, 26 bp, Artificial Sequence
  Description of Artificial Sequence: Synthetic oligonucleotide
agcgaggccgggtctcagtacatcca

SEQ ID NO: 37082 - DNA, 25 bp, Artificial Sequence
  Description of Artificial Sequence: Synthetic oligonucleotide
gcgaggccgggtctcagtacatcca

SEQ ID NO: 37083 - DNA, 26 bp, Artificial Sequence
  Description of Artificial Sequence: Synthetic oligonucleotide
cgaggccgggtctcagtacatccaga

SEQ ID NO: 37084 - DNA, 26 bp, Artificial Sequence
  Description of Artificial Sequence: Synthetic oligonucleotide
gaggccgggtctcagtacatccagag

SEQ ID NO: 37085 - DNA, 27 bp, Artificial Sequence
  Description of Artificial Sequence: Synthetic oligonucleotide
aggccgggtctcagtacatccagagga

SEQ ID NO: 37086 - DNA, 27 bp, Artificial Sequence
  Description of Artificial Sequence: Synthetic oligonucleotide
ggccgggtctcagtacatccagaggat

SEQ ID NO: 37087 - DNA, 27 bp, Artificial Sequence
  Description of Artificial Sequence: Synthetic oligonucleotide
gccgggtctcagtacatccagaggatg

SEQ ID NO: 37088 - DNA, 29 bp, Artificial Sequence
  Description of Artificial Sequence: Synthetic oligonucleotide
ccgggtctcagtacatccagaggatgtac

SEQ ID NO: 37089 - DNA, 29 bp, Artificial Sequence
  Description of Artificial Sequence: Synthetic oligonucleotide
cgggtctcagtacatccagaggatgtacg

SEQ ID NO: 37090 - DNA, 29 bp, Artificial Sequence
  Description of Artificial Sequence: Synthetic oligonucleotide
gggtctcagtacatccagaggatgtacgg

SEQ ID NO: 37091 - DNA, 29 bp, Artificial Sequence
  Description of Artificial Sequence: Synthetic oligonucleotide
ggtctcagtacatccagaggatgtacggc

SEQ ID NO: 37092 - DNA, 30 bp, Artificial Sequence
  Description of Artificial Sequence: Synthetic oligonucleotide
gtctcagtacatccagaggatgtacggctg

SEQ ID NO: 37093 - DNA, 30 bp, Artificial Sequence
  Description of Artificial Sequence: Synthetic oligonucleotide
tctcagtacatccagaggatgtacggctgc

SEQ ID NO: 37094 - DNA, 29 bp, Artificial Sequence
  Description of Artificial Sequence: Synthetic oligonucleotide
ctcagtacatccagaggatgtacggctgc

SEQ ID NO: 37095 - DNA, 29 bp, Artificial Sequence
  Description of Artificial Sequence: Synthetic oligonucleotide
tcagtacatccagaggatgtacggctgcg

SEQ ID NO: 37096 - DNA, 28 bp, Artificial Sequence
  Description of Artificial Sequence: Synthetic oligonucleotide
cagtacatccagaggatgtacggctgcg

SEQ ID NO: 37097 - DNA, 29 bp, Artificial Sequence
  Description of Artificial Sequence: Synthetic oligonucleotide
agtacatccagaggatgtacggctgcgac

SEQ ID NO: 37098 - DNA, 28 bp, Artificial Sequence
  Description of Artificial Sequence: Synthetic oligonucleotide
gtacatccagaggatgtacggctgcgac

SEQ ID NO: 37099 - DNA, 28 bp, Artificial Sequence
  Description of Artificial Sequence: Synthetic oligonucleotide
tacatccagaggatgtacggctgcgacg

SEQ ID NO: 37100 - DNA, 27 bp, Artificial Sequence
  Description of Artificial Sequence: Synthetic oligonucleotide
acatccagaggatgtacggctgcgacg

SEQ ID NO: 37101 - DNA, 23 bp, Artificial Sequence
  Description of Artificial Sequence: Synthetic oligonucleotide
gcgcctcctccgcgggtataacc

SEQ ID NO: 37102 - DNA, 23 bp, Artificial Sequence
  Description of Artificial Sequence: Synthetic oligonucleotide
cgcctcctccgcgggtataaccg

SEQ ID NO: 37103 - DNA, 26 bp, Artificial Sequence
  Description of Artificial Sequence: Synthetic oligonucleotide
gcctcctccgcgggtataaccggtta

SEQ ID NO: 37104 - DNA, 26 bp, Artificial Sequence
  Description of Artificial Sequence: Synthetic oligonucleotide
cctcctccgcgggtataaccggttag

SEQ ID NO: 37105 - DNA, 26 bp, Artificial Sequence
  Description of Artificial Sequence: Synthetic oligonucleotide
ctcctccgcgggtataaccggttagc

SEQ ID NO: 37106 - DNA, 27 bp, Artificial Sequence
  Description of Artificial Sequence: Synthetic oligonucleotide
tcctccgcgggtataaccggttagcct

SEQ ID NO: 37107 - DNA, 27 bp, Artificial Sequence
  Description of Artificial Sequence: Synthetic oligonucleotide
cctccgcgggtataaccggttagccta

SEQ ID NO: 37108 - DNA, 27 bp, Artificial Sequence
  Description of Artificial Sequence: Synthetic oligonucleotide
ctccgcgggtataaccggttagcctac

SEQ ID NO: 37109 - DNA, 27 bp, Artificial Sequence
  Description of Artificial Sequence: Synthetic oligonucleotide
tccgcgggtataaccggttagcctacg

SEQ ID NO: 37110 - DNA, 27 bp, Artificial Sequence
  Description of Artificial Sequence: Synthetic oligonucleotide
ccgcgggtataaccggttagcctacga

SEQ ID NO: 37111 - DNA, 27 bp, Artificial Sequence
  Description of Artificial Sequence: Synthetic oligonucleotide
cgcgggtataaccggttagcctacgac

SEQ ID NO: 37112 - DNA, 27 bp, Artificial Sequence
  Description of Artificial Sequence: Synthetic oligonucleotide
gcgggtataaccggttagcctacgacg

SEQ ID NO: 37113 - DNA, 27 bp, Artificial Sequence
  Description of Artificial Sequence: Synthetic oligonucleotide
cgggtataaccggttagcctacgacgg

SEQ ID NO: 37114 - DNA, 27 bp, Artificial Sequence
  Description of Artificial Sequence: Synthetic oligonucleotide
gggtataaccggttagcctacgacggc

SEQ ID NO: 37115 - DNA, 29 bp, Artificial Sequence
  Description of Artificial Sequence: Synthetic oligonucleotide
ggtataaccggttagcctacgacggcaag

SEQ ID NO: 37116 - DNA, 29 bp, Artificial Sequence
  Description of Artificial Sequence: Synthetic oligonucleotide
gtataaccggttagcctacgacggcaagg

SEQ ID NO: 37117 - DNA, 33 bp, Artificial Sequence
  Description of Artificial Sequence: Synthetic oligonucleotide
tataaccggttagcctacgacggcaaggattac

SEQ ID NO: 37118 - DNA, 32 bp, Artificial Sequence
  Description of Artificial Sequence: Synthetic oligonucleotide
ataaccggttagcctacgacggcaaggattac

SEQ ID NO: 37119 - DNA, 31 bp, Artificial Sequence
  Description of Artificial Sequence: Synthetic oligonucleotide
taaccggttagcctacgacggcaaggattac

SEQ ID NO: 37120 - DNA, 30 bp, Artificial Sequence
  Description of Artificial Sequence: Synthetic oligonucleotide
aaccggttagcctacgacggcaaggattac

SEQ ID NO: 37121 - DNA, 29 bp, Artificial Sequence
  Description of Artificial Sequence: Synthetic oligonucleotide
accggttagcctacgacggcaaggattac

SEQ ID NO: 37122 - DNA, 28 bp, Artificial Sequence
  Description of Artificial Sequence: Synthetic oligonucleotide
ccggttagcctacgacggcaaggattac

SEQ ID NO: 37123 - DNA, 30 bp, Artificial Sequence
  Description of Artificial Sequence: Synthetic oligonucleotide
cggttagcctacgacggcaaggattacatc

SEQ ID NO: 37124 - DNA, 30 bp, Artificial Sequence
  Description of Artificial Sequence: Synthetic oligonucleotide
ggttagcctacgacggcaaggattacatcg

SEQ ID NO: 37125 - DNA, 24 bp, Artificial Sequence
  Description of Artificial Sequence: Synthetic oligonucleotide
ccgtgtggcggagcaggacagagt

SEQ ID NO: 37126 - DNA, 26 bp, Artificial Sequence
  Description of Artificial Sequence: Synthetic oligonucleotide
cgtgtggcggagcaggacagagtcta

SEQ ID NO: 37127 - DNA, 26 bp, Artificial Sequence
  Description of Artificial Sequence: Synthetic oligonucleotide
gtgtggcggagcaggacagagtctac

SEQ ID NO: 37128 - DNA, 27 bp, Artificial Sequence
  Description of Artificial Sequence: Synthetic oligonucleotide
tgtggcggagcaggacagagtctacct

SEQ ID NO: 37129 - DNA, 26 bp, Artificial Sequence
  Description of Artificial Sequence: Synthetic oligonucleotide
gtggcggagcaggacagagtctacct

SEQ ID NO: 37130 - DNA, 26 bp, Artificial Sequence
  Description of Artificial Sequence: Synthetic oligonucleotide
tggcggagcaggacagagtctacctg

SEQ ID NO: 37131 - DNA, 25 bp, Artificial Sequence
  Description of Artificial Sequence: Synthetic oligonucleotide
ggcggagcaggacagagtctacctg

SEQ ID NO: 37132 - DNA, 26 bp, Artificial Sequence
  Description of Artificial Sequence: Synthetic oligonucleotide
gcggagcaggacagagtctacctgga

SEQ ID NO: 37133 - DNA, 26 bp, Artificial Sequence
  Description of Artificial Sequence: Synthetic oligonucleotide
cggagcaggacagagtctacctggag

SEQ ID NO: 37134 - DNA, 26 bp, Artificial Sequence
  Description of Artificial Sequence: Synthetic oligonucleotide
ggagcaggacagagtctacctggagg

SEQ ID NO: 37135 - DNA, 26 bp, Artificial Sequence
  Description of Artificial Sequence: Synthetic oligonucleotide
gagcaggacagagtctacctggaggg

SEQ ID NO: 37136 - DNA, 26 bp, Artificial Sequence
  Description of Artificial Sequence: Synthetic oligonucleotide
agcaggacagagtctacctggagggc

SEQ ID NO: 37137 - DNA, 25 bp, Artificial Sequence
  Description of Artificial Sequence: Synthetic oligonucleotide
gcaggacagagtctacctggagggc

SEQ ID NO: 37138 - DNA, 26 bp, Artificial Sequence
  Description of Artificial Sequence: Synthetic oligonucleotide
caggacagagtctacctggagggcct

SEQ ID NO: 37139 - DNA, 27 bp, Artificial Sequence
  Description of Artificial Sequence: Synthetic oligonucleotide
aggacagagtctacctggagggcctgt

SEQ ID NO: 37140 - DNA, 26 bp, Artificial Sequence
  Description of Artificial Sequence: Synthetic oligonucleotide
ggacagagtctacctggagggcctgt

SEQ ID NO: 37141 - DNA, 26 bp, Artificial Sequence
  Description of Artificial Sequence: Synthetic oligonucleotide
gacagagtctacctggagggcctgtg

SEQ ID NO: 37142 - DNA, 26 bp, Artificial Sequence
  Description of Artificial Sequence: Synthetic oligonucleotide
acagagtctacctggagggcctgtgc

SEQ ID NO: 37143 - DNA, 25 bp, Artificial Sequence
  Description of Artificial Sequence: Synthetic oligonucleotide
cagagtctacctggagggcctgtgc

SEQ ID NO: 37144 - DNA, 26 bp, Artificial Sequence
  Description of Artificial Sequence: Synthetic oligonucleotide
tgtgacccaccaccccatctctgacc

SEQ ID NO: 37145 - DNA, 25 bp, Artificial Sequence
  Description of Artificial Sequence: Synthetic oligonucleotide
gtgacccaccaccccatctctgacc

SEQ ID NO: 37146 - DNA, 26 bp, Artificial Sequence
  Description of Artificial Sequence: Synthetic oligonucleotide
tgacccaccaccccatctctgaccgt

SEQ ID NO: 37147 - DNA, 25 bp, Artificial Sequence
  Description of Artificial Sequence: Synthetic oligonucleotide
gacccaccaccccatctctgaccgt

SEQ ID NO: 37148 - DNA, 26 bp, Artificial Sequence
  Description of Artificial Sequence: Synthetic oligonucleotide
acccaccaccccatctctgaccgtga

SEQ ID NO: 37149 - DNA, 25 bp, Artificial Sequence
  Description of Artificial Sequence: Synthetic oligonucleotide
cccaccaccccatctctgaccgtga

SEQ ID NO: 37150 - DNA, 25 bp, Artificial Sequence
  Description of Artificial Sequence: Synthetic oligonucleotide
ccaccaccccatctctgaccgtgag

SEQ ID NO: 37151 - DNA, 25 bp, Artificial Sequence
  Description of Artificial Sequence: Synthetic oligonucleotide
caccaccccatctctgaccgtgagg

SEQ ID NO: 37152 - DNA, 25 bp, Artificial Sequence
  Description of Artificial Sequence: Synthetic oligonucleotide
accaccccatctctgaccgtgaggc

SEQ ID NO: 37153 - DNA, 24 bp, Artificial Sequence
  Description of Artificial Sequence: Synthetic oligonucleotide
ccaccccatctctgaccgtgaggc

SEQ ID NO: 37154 - DNA, 25 bp, Artificial Sequence
  Description of Artificial Sequence: Synthetic oligonucleotide
caccccatctctgaccgtgaggcca

SEQ ID NO: 37155 - DNA, 25 bp, Artificial Sequence
  Description of Artificial Sequence: Synthetic oligonucleotide
accccatctctgaccgtgaggccac

SEQ ID NO: 37156 - DNA, 24 bp, Artificial Sequence
  Description of Artificial Sequence: Synthetic oligonucleotide
ccccatctctgaccgtgaggccac

SEQ ID NO: 37157 - DNA, 24 bp, Artificial Sequence
  Description of Artificial Sequence: Synthetic oligonucleotide
cccatctctgaccgtgaggccacc

SEQ ID NO: 37158 - DNA, 25 bp, Artificial Sequence
  Description of Artificial Sequence: Synthetic oligonucleotide
ccatctctgaccgtgaggccaccct

SEQ ID NO: 37159 - DNA, 26 bp, Artificial Sequence
  Description of Artificial Sequence: Synthetic oligonucleotide
catctctgaccgtgaggccaccctga

SEQ ID NO: 37160 - DNA, 26 bp, Artificial Sequence
  Description of Artificial Sequence: Synthetic oligonucleotide
atctctgaccgtgaggccaccctgag

SEQ ID NO: 37161 - DNA, 25 bp, Artificial Sequence
  Description of Artificial Sequence: Synthetic oligonucleotide
tctctgaccgtgaggccaccctgag

SEQ ID NO: 37162 - DNA, 24 bp, Artificial Sequence
  Description of Artificial Sequence: Synthetic oligonucleotide
ctctgaccgtgaggccaccctgag

SEQ ID NO: 37163 - DNA, 25 bp, Artificial Sequence
  Description of Artificial Sequence: Synthetic oligonucleotide
tctgaccgtgaggccaccctgaggt

SEQ ID NO: 37164 - DNA, 24 bp, Artificial Sequence
  Description of Artificial Sequence: Synthetic oligonucleotide
ctgaccgtgaggccaccctgaggt

SEQ ID NO: 37165 - DNA, 24 bp, Artificial Sequence
  Description of Artificial Sequence: Synthetic oligonucleotide
tgaccgtgaggccaccctgaggtg

SEQ ID NO: 37166 - DNA, 23 bp, Artificial Sequence
  Description of Artificial Sequence: Synthetic oligonucleotide
gaccgtgaggccaccctgaggtg

SEQ ID NO: 37167 - DNA, 24 bp, Artificial Sequence
  Description of Artificial Sequence: Synthetic oligonucleotide
accgtgaggccaccctgaggtgct

SEQ ID NO: 37168 - DNA, 23 bp, Artificial Sequence
  Description of Artificial Sequence: Synthetic oligonucleotide
ccgtgaggccaccctgaggtgct

SEQ ID NO: 37169 - DNA, 23 bp, Artificial Sequence
  Description of Artificial Sequence: Synthetic oligonucleotide
cgtgaggccaccctgaggtgctg

SEQ ID NO: 37170 - DNA, 23 bp, Artificial Sequence
  Description of Artificial Sequence: Synthetic oligonucleotide
gtgaggccaccctgaggtgctgg

SEQ ID NO: 37171 - DNA, 28 bp, Artificial Sequence
  Description of Artificial Sequence: Synthetic oligonucleotide
cgcttcctccgcgggtataaccagttag

SEQ ID NO: 37172 - DNA, 28 bp, Artificial Sequence
  Description of Artificial Sequence: Synthetic oligonucleotide
gcttcctccgcgggtataaccagttagc

SEQ ID NO: 37173 - DNA, 28 bp, Artificial Sequence
  Description of Artificial Sequence: Synthetic oligonucleotide
cttcctccgcgggtataaccagttagcc

SEQ ID NO: 37174 - DNA, 30 bp, Artificial Sequence
  Description of Artificial Sequence: Synthetic oligonucleotide
ttcctccgcgggtataaccagttagcctac

SEQ ID NO: 37175 - DNA, 29 bp, Artificial Sequence
  Description of Artificial Sequence: Synthetic oligonucleotide
acacagaagtacaagcgccaggcacagac

SEQ ID NO: 37176 - DNA, 28 bp, Artificial Sequence
  Description of Artificial Sequence: Synthetic oligonucleotide
cacagaagtacaagcgccaggcacagac

SEQ ID NO: 37177 - DNA, 29 bp, Artificial Sequence
  Description of Artificial Sequence: Synthetic oligonucleotide
acagaagtacaagcgccaggcacagactg

SEQ ID NO: 37178 - DNA, 28 bp, Artificial Sequence
  Description of Artificial Sequence: Synthetic oligonucleotide
cagaagtacaagcgccaggcacagactg

SEQ ID NO: 37179 - DNA, 29 bp, Artificial Sequence
  Description of Artificial Sequence: Synthetic oligonucleotide
agaagtacaagcgccaggcacagactgac

SEQ ID NO: 37180 - DNA, 28 bp, Artificial Sequence
  Description of Artificial Sequence: Synthetic oligonucleotide
gaagtacaagcgccaggcacagactgac

SEQ ID NO: 37181 - DNA, 28 bp, Artificial Sequence
  Description of Artificial Sequence: Synthetic oligonucleotide
aagtacaagcgccaggcacagactgacc

SEQ ID NO: 37182 - DNA, 27 bp, Artificial Sequence
  Description of Artificial Sequence: Synthetic oligonucleotide
agtacaagcgccaggcacagactgacc

SEQ ID NO: 37183 - DNA, 26 bp, Artificial Sequence
  Description of Artificial Sequence: Synthetic oligonucleotide
gtacaagcgccaggcacagactgacc

SEQ ID NO: 37184 - DNA, 27 bp, Artificial Sequence
  Description of Artificial Sequence: Synthetic oligonucleotide
tacaagcgccaggcacagactgaccga

SEQ ID NO: 37185 - DNA, 26 bp, Artificial Sequence
  Description of Artificial Sequence: Synthetic oligonucleotide
acaagcgccaggcacagactgaccga

SEQ ID NO: 37186 - DNA, 25 bp, Artificial Sequence
  Description of Artificial Sequence: Synthetic oligonucleotide
caagcgccaggcacagactgaccga

SEQ ID NO: 37187 - DNA, 26 bp, Artificial Sequence
  Description of Artificial Sequence: Synthetic oligonucleotide
aagcgccaggcacagactgaccgagt

SEQ ID NO: 37188 - DNA, 25 bp, Artificial Sequence
  Description of Artificial Sequence: Synthetic oligonucleotide
agcgccaggcacagactgaccgagt

SEQ ID NO: 37189 - DNA, 24 bp, Artificial Sequence
  Description of Artificial Sequence: Synthetic oligonucleotide
gcgccaggcacagactgaccgagt

SEQ ID NO: 37190 - DNA, 25 bp, Artificial Sequence
  Description of Artificial Sequence: Synthetic oligonucleotide
cgccaggcacagactgaccgagtga

SEQ ID NO: 37191 - DNA, 25 bp, Artificial Sequence
  Description of Artificial Sequence: Synthetic oligonucleotide
gccaggcacagactgaccgagtgag

SEQ ID NO: 37192 - DNA, 30 bp, Artificial Sequence
  Description of Artificial Sequence: Synthetic oligonucleotide
agaagtacaagcgccaggcacagactgatc

SEQ ID NO: 37193 - DNA, 29 bp, Artificial Sequence
  Description of Artificial Sequence: Synthetic oligonucleotide
gaagtacaagcgccaggcacagactgatc

SEQ ID NO: 37194 - DNA, 29 bp, Artificial Sequence
  Description of Artificial Sequence: Synthetic oligonucleotide
aagtacaagcgccaggcacagactgatcg

SEQ ID NO: 37195 - DNA, 28 bp, Artificial Sequence
  Description of Artificial Sequence: Synthetic oligonucleotide
agtacaagcgccaggcacagactgatcg

SEQ ID NO: 37196 - DNA, 27 bp, Artificial Sequence
  Description of Artificial Sequence: Synthetic oligonucleotide
gtacaagcgccaggcacagactgatcg

SEQ ID NO: 37197 - DNA, 28 bp, Artificial Sequence
  Description of Artificial Sequence: Synthetic oligonucleotide
tacaagcgccaggcacagactgatcgag

SEQ ID NO: 37198 - DNA, 27 bp, Artificial Sequence
  Description of Artificial Sequence: Synthetic oligonucleotide
acaagcgccaggcacagactgatcgag

SEQ ID NO: 37199 - DNA, 27 bp, Artificial Sequence
  Description of Artificial Sequence: Synthetic oligonucleotide
caagcgccaggcacagactgatcgagt

SEQ ID NO: 37200 - DNA, 27 bp, Artificial Sequence
  Description of Artificial Sequence: Synthetic oligonucleotide
aagcgccaggcacagactgatcgagtg

SEQ ID NO: 37201 - DNA, 27 bp, Artificial Sequence
  Description of Artificial Sequence: Synthetic oligonucleotide
agcgccaggcacagactgatcgagtga

SEQ ID NO: 37202 - DNA, 26 bp, Artificial Sequence
  Description of Artificial Sequence: Synthetic oligonucleotide
gcgccaggcacagactgatcgagtga

SEQ ID NO: 37203 - DNA, 26 bp, Artificial Sequence
  Description of Artificial Sequence: Synthetic oligonucleotide
cgccaggcacagactgatcgagtgag

SEQ ID NO: 37204 - DNA, 26 bp, Artificial Sequence
  Description of Artificial Sequence: Synthetic oligonucleotide
gccaggcacagactgatcgagtgagc

SEQ ID NO: 37205 - DNA, 27 bp, Artificial Sequence
  Description of Artificial Sequence: Synthetic oligonucleotide
ccaggcacagactgatcgagtgagcct

SEQ ID NO: 37206 - DNA, 27 bp, Artificial Sequence
  Description of Artificial Sequence: Synthetic oligonucleotide
caggcacagactgatcgagtgagcctg

SEQ ID NO: 37207 - DNA, 27 bp, Artificial Sequence
  Description of Artificial Sequence: Synthetic oligonucleotide
aggcacagactgatcgagtgagcctgc

SEQ ID NO: 37208 - DNA, 26 bp, Artificial Sequence
  Description of Artificial Sequence: Synthetic oligonucleotide
ggcacagactgatcgagtgagcctgc

SEQ ID NO: 37209 - DNA, 26 bp, Artificial Sequence
  Description of Artificial Sequence: Synthetic oligonucleotide
gcacagactgatcgagtgagcctgcg

SEQ ID NO: 37210 - DNA, 27 bp, Artificial Sequence
  Description of Artificial Sequence: Synthetic oligonucleotide
cacagactgatcgagtgagcctgcgga

SEQ ID NO: 37211 - DNA, 28 bp, Artificial Sequence
  Description of Artificial Sequence: Synthetic oligonucleotide
acagactgatcgagtgagcctgcggaac

SEQ ID NO: 37212 - DNA, 27 bp, Artificial Sequence
  Description of Artificial Sequence: Synthetic oligonucleotide
cagactgatcgagtgagcctgcggaac

SEQ ID NO: 37213 - DNA, 27 bp, Artificial Sequence
  Description of Artificial Sequence: Synthetic oligonucleotide
agactgatcgagtgagcctgcggaacc

SEQ ID NO: 37214 - DNA, 27 bp, Artificial Sequence
  Description of Artificial Sequence: Synthetic oligonucleotide
gactgatcgagtgagcctgcggaacct

SEQ ID NO: 37215 - DNA, 27 bp, Artificial Sequence
  Description of Artificial Sequence: Synthetic oligonucleotide
actgatcgagtgagcctgcggaacctg

SEQ ID NO: 37216 - DNA, 26 bp, Artificial Sequence
  Description of Artificial Sequence: Synthetic oligonucleotide
ctgatcgagtgagcctgcggaacctg

SEQ ID NO: 37217 - DNA, 26 bp, Artificial Sequence
  Description of Artificial Sequence: Synthetic oligonucleotide
tgatcgagtgagcctgcggaacctgc

SEQ ID NO: 37218 - DNA, 25 bp, Artificial Sequence
  Description of Artificial Sequence: Synthetic oligonucleotide
gatcgagtgagcctgcggaacctgc

SEQ ID NO: 37219 - DNA, 25 bp, Artificial Sequence
  Description of Artificial Sequence: Synthetic oligonucleotide
atcgagtgagcctgcggaacctgcg

SEQ ID NO: 37220 - DNA, 24 bp, Artificial Sequence
  Description of Artificial Sequence: Synthetic oligonucleotide
tcgagtgagcctgcggaacctgcg

SEQ ID NO: 37221 - DNA, 21 bp, Artificial Sequence
  Description of Artificial Sequence: Synthetic oligonucleotide
tgggaggcggcccgtgaggca

SEQ ID NO: 37222 - DNA, 20 bp, Artificial Sequence
  Description of Artificial Sequence: Synthetic oligonucleotide
gggaggcggcccgtgaggca

SEQ ID NO: 37223 - DNA, 21 bp, Artificial Sequence
  Description of Artificial Sequence: Synthetic oligonucleotide
ggaggcggcccgtgaggcaga

SEQ ID NO: 37224 - DNA, 21 bp, Artificial Sequence
  Description of Artificial Sequence: Synthetic oligonucleotide
gaggcggcccgtgaggcagag

SEQ ID NO: 37225 - DNA, 22 bp, Artificial Sequence
  Description of Artificial Sequence: Synthetic oligonucleotide
aggcggcccgtgaggcagagca

SEQ ID NO: 37226 - DNA, 21 bp, Artificial Sequence
  Description of Artificial Sequence: Synthetic oligonucleotide
ggcggcccgtgaggcagagca

SEQ ID NO: 37227 - DNA, 22 bp, Artificial Sequence
  Description of Artificial Sequence: Synthetic oligonucleotide
gcggcccgtgaggcagagcagt

SEQ ID NO: 37228 - DNA, 22 bp, Artificial Sequence
  Description of Artificial Sequence: Synthetic oligonucleotide
cggcccgtgaggcagagcagtg

SEQ ID NO: 37229 - DNA, 23 bp, Artificial Sequence
  Description of Artificial Sequence: Synthetic oligonucleotide
ggcccgtgaggcagagcagtgga

SEQ ID NO: 37230 - DNA, 24 bp, Artificial Sequence
  Description of Artificial Sequence: Synthetic oligonucleotide
gcccgtgaggcagagcagtggaga

SEQ ID NO: 37231 - DNA, 24 bp, Artificial Sequence
  Description of Artificial Sequence: Synthetic oligonucleotide
cccgtgaggcagagcagtggagag

SEQ ID NO: 37232 - DNA, 24 bp, Artificial Sequence
  Description of Artificial Sequence: Synthetic oligonucleotide
ccgtgaggcagagcagtggagagc

SEQ ID NO: 37233 - DNA, 26 bp, Artificial Sequence
  Description of Artificial Sequence: Synthetic oligonucleotide
cgtgaggcagagcagtggagagccta

SEQ ID NO: 37234 - DNA, 26 bp, Artificial Sequence
  Description of Artificial Sequence: Synthetic oligonucleotide
gtgaggcagagcagtggagagcctac

SEQ ID NO: 37235 - DNA, 27 bp, Artificial Sequence
  Description of Artificial Sequence: Synthetic oligonucleotide
tgaggcagagcagtggagagcctacct

SEQ ID NO: 37236 - DNA, 26 bp, Artificial Sequence
  Description of Artificial Sequence: Synthetic oligonucleotide
gaggcagagcagtggagagcctacct

SEQ ID NO: 37237 - DNA, 26 bp, Artificial Sequence
  Description of Artificial Sequence: Synthetic oligonucleotide
aggcagagcagtggagagcctacctg

SEQ ID NO: 37238 - DNA, 25 bp, Artificial Sequence
  Description of Artificial Sequence: Synthetic oligonucleotide
ggcagagcagtggagagcctacctg

SEQ ID NO: 37239 - DNA, 26 bp, Artificial Sequence
  Description of Artificial Sequence: Synthetic oligonucleotide
gcagagcagtggagagcctacctgga

SEQ ID NO: 37240 - DNA, 26 bp, Artificial Sequence
  Description of Artificial Sequence: Synthetic oligonucleotide
cagagcagtggagagcctacctggag

SEQ ID NO: 37241 - DNA, 26 bp, Artificial Sequence
  Description of Artificial Sequence: Synthetic oligonucleotide
agagcagtggagagcctacctggagg

SEQ ID NO: 37242 - DNA, 28 bp, Artificial Sequence
  Description of Artificial Sequence: Synthetic oligonucleotide
agaagtacaagcgccaggcacagactgg

SEQ ID NO: 37243 - DNA, 27 bp, Artificial Sequence
  Description of Artificial Sequence: Synthetic oligonucleotide
gaagtacaagcgccaggcacagactgg

SEQ ID NO: 37244 - DNA, 27 bp, Artificial Sequence
  Description of Artificial Sequence: Synthetic oligonucleotide
aagtacaagcgccaggcacagactggc

SEQ ID NO: 37245 - DNA, 26 bp, Artificial Sequence
  Description of Artificial Sequence: Synthetic oligonucleotide
agtacaagcgccaggcacagactggc

SEQ ID NO: 37246 - DNA, 25 bp, Artificial Sequence
  Description of Artificial Sequence: Synthetic oligonucleotide
gtacaagcgccaggcacagactggc

SEQ ID NO: 37247 - DNA, 25 bp, Artificial Sequence
  Description of Artificial Sequence: Synthetic oligonucleotide
tacaagcgccaggcacagactggcc

SEQ ID NO: 37248 - DNA, 24 bp, Artificial Sequence
  Description of Artificial Sequence: Synthetic oligonucleotide
acaagcgccaggcacagactggcc

SEQ ID NO: 37249 - DNA, 23 bp, Artificial Sequence
  Description of Artificial Sequence: Synthetic oligonucleotide
caagcgccaggcacagactggcc

SEQ ID NO: 37250 - DNA, 24 bp, Artificial Sequence
  Description of Artificial Sequence: Synthetic oligonucleotide
aagcgccaggcacagactggccga

SEQ ID NO: 37251 - DNA, 23 bp, Artificial Sequence
  Description of Artificial Sequence: Synthetic oligonucleotide
agcgccaggcacagactggccga

SEQ ID NO: 37252 - DNA, 22 bp, Artificial Sequence
  Description of Artificial Sequence: Synthetic oligonucleotide
gcgccaggcacagactggccga

SEQ ID NO: 37253 - DNA, 23 bp, Artificial Sequence
  Description of Artificial Sequence: Synthetic oligonucleotide
cgccaggcacagactggccgagt

SEQ ID NO: 37254 - DNA, 24 bp, Artificial Sequence
  Description of Artificial Sequence: Synthetic oligonucleotide
gccaggcacagactggccgagtga

SEQ ID NO: 37255 - DNA, 24 bp, Artificial Sequence
  Description of Artificial Sequence: Synthetic oligonucleotide
ccaggcacagactggccgagtgag

SEQ ID NO: 37256 - DNA, 24 bp, Artificial Sequence
  Description of Artificial Sequence: Synthetic oligonucleotide
caggcacagactggccgagtgagc

SEQ ID NO: 37257 - DNA, 25 bp, Artificial Sequence
  Description of Artificial Sequence: Synthetic oligonucleotide
aggcacagactggccgagtgagcct

SEQ ID NO: 37258 - DNA, 24 bp, Artificial Sequence
  Description of Artificial Sequence: Synthetic oligonucleotide
ggcacagactggccgagtgagcct

SEQ ID NO: 37259 - DNA, 24 bp, Artificial Sequence
  Description of Artificial Sequence: Synthetic oligonucleotide
gcacagactggccgagtgagcctg

SEQ ID NO: 37260 - DNA, 24 bp, Artificial Sequence
  Description of Artificial Sequence: Synthetic oligonucleotide
cacagactggccgagtgagcctgc

SEQ ID NO: 37261 - DNA, 24 bp, Artificial Sequence
  Description of Artificial Sequence: Synthetic oligonucleotide
acagactggccgagtgagcctgcg

SEQ ID NO: 37262 - DNA, 23 bp, Artificial Sequence
  Description of Artificial Sequence: Synthetic oligonucleotide
cagactggccgagtgagcctgcg

SEQ ID NO: 37263 - DNA, 25 bp, Artificial Sequence
  Description of Artificial Sequence: Synthetic oligonucleotide
agactggccgagtgagcctgcggaa

SEQ ID NO: 37264 - DNA, 24 bp, Artificial Sequence
  Description of Artificial Sequence: Synthetic oligonucleotide
gactggccgagtgagcctgcggaa

SEQ ID NO: 37265 - DNA, 24 bp, Artificial Sequence
  Description of Artificial Sequence: Synthetic oligonucleotide
actggccgagtgagcctgcggaac

SEQ ID NO: 37266 - DNA, 23 bp, Artificial Sequence
  Description of Artificial Sequence: Synthetic oligonucleotide
ctggccgagtgagcctgcggaac

SEQ ID NO: 37267 - DNA, 24 bp, Artificial Sequence
  Description of Artificial Sequence: Synthetic oligonucleotide
tggccgagtgagcctgcggaacct

SEQ ID NO: 37268 - DNA, 23 bp, Artificial Sequence
  Description of Artificial Sequence: Synthetic oligonucleotide
ggccgagtgagcctgcggaacct

SEQ ID NO: 37269 - DNA, 23 bp, Artificial Sequence
  Description of Artificial Sequence: Synthetic oligonucleotide
gccgagtgagcctgcggaacctg

SEQ ID NO: 37270 - DNA, 22 bp, Artificial Sequence
  Description of Artificial Sequence: Synthetic oligonucleotide
acgccgcgagtccgaggatggg

SEQ ID NO: 37271 - DNA, 21 bp, Artificial Sequence
  Description of Artificial Sequence: Synthetic oligonucleotide
cgccgcgagtccgaggatggg

SEQ ID NO: 37272 - DNA, 21 bp, Artificial Sequence
  Description of Artificial Sequence: Synthetic oligonucleotide
gccgcgagtccgaggatgggg

SEQ ID NO: 37273 - DNA, 21 bp, Artificial Sequence
  Description of Artificial Sequence: Synthetic oligonucleotide
ccgcgagtccgaggatggggc

SEQ ID NO: 37274 - DNA, 21 bp, Artificial Sequence
  Description of Artificial Sequence: Synthetic oligonucleotide
cgcgagtccgaggatggggcc

SEQ ID NO: 37275 - DNA, 21 bp, Artificial Sequence
  Description of Artificial Sequence: Synthetic oligonucleotide
gcgagtccgaggatggggccc

SEQ ID NO: 37276 - DNA, 21 bp, Artificial Sequence
  Description of Artificial Sequence: Synthetic oligonucleotide
cgagtccgaggatggggcccc

SEQ ID NO: 37277 - DNA, 21 bp, Artificial Sequence
  Description of Artificial Sequence: Synthetic oligonucleotide
gagtccgaggatggggccccg

SEQ ID NO: 37278 - DNA, 21 bp, Artificial Sequence
  Description of Artificial Sequence: Synthetic oligonucleotide
agtccgaggatggggccccgg

SEQ ID NO: 37279 - DNA, 20 bp, Artificial Sequence
  Description of Artificial Sequence: Synthetic oligonucleotide
gtccgaggatggggccccgg

SEQ ID NO: 37280 - DNA, 20 bp, Artificial Sequence
  Description of Artificial Sequence: Synthetic oligonucleotide
tccgaggatggggccccggg

SEQ ID NO: 37281 - DNA, 20 bp, Artificial Sequence
  Description of Artificial Sequence: Synthetic oligonucleotide
ccgaggatggggccccgggt

SEQ ID NO: 37282 - DNA, 20 bp, Artificial Sequence
  Description of Artificial Sequence: Synthetic oligonucleotide
cgaggatggggccccgggct

SEQ ID NO: 37283 - DNA, 20 bp, Artificial Sequence
  Description of Artificial Sequence: Synthetic oligonucleotide
gaggatggggccccgggcgt

SEQ ID NO: 37284 - DNA, 20 bp, Artificial Sequence
  Description of Artificial Sequence: Synthetic oligonucleotide
aggatggggccccgggcgct

SEQ ID NO: 37285 - DNA, 20 bp, Artificial Sequence
  Description of Artificial Sequence: Synthetic oligonucleotide
ggatggggccccgggcgctt

SEQ ID NO: 37286 - DNA, 20 bp, Artificial Sequence
  Description of Artificial Sequence: Synthetic oligonucleotide
gatggggccccgggcgccat

SEQ ID NO: 37287 - DNA, 20 bp, Artificial Sequence
  Description of Artificial Sequence: Synthetic oligonucleotide
atggggccccgggcgccatg

SEQ ID NO: 37288 - DNA, 20 bp, Artificial Sequence
  Description of Artificial Sequence: Synthetic oligonucleotide
tggggccccgggcgccatgt

SEQ ID NO: 37289 - DNA, 20 bp, Artificial Sequence
  Description of Artificial Sequence: Synthetic oligonucleotide
ggggccccgggcgccatgtt

SEQ ID NO: 37290 - DNA, 21 bp, Artificial Sequence
  Description of Artificial Sequence: Synthetic oligonucleotide
gggccccgggcgccatggata

SEQ ID NO: 37291 - DNA, 22 bp, Artificial Sequence
  Description of Artificial Sequence: Synthetic oligonucleotide
ggccccgggcgccatggataga

SEQ ID NO: 37292 - DNA, 25 bp, Artificial Sequence
  Description of Artificial Sequence: Synthetic oligonucleotide
gagagcctacctggagggcctgtga

SEQ ID NO: 37293 - DNA, 26 bp, Artificial Sequence
  Description of Artificial Sequence: Synthetic oligonucleotide
agagcctacctggagggcctgtgagt

SEQ ID NO: 37294 - DNA, 25 bp, Artificial Sequence
  Description of Artificial Sequence: Synthetic oligonucleotide
gagcctacctggagggcctgtgagt

SEQ ID NO: 37295 - DNA, 25 bp, Artificial Sequence
  Description of Artificial Sequence: Synthetic oligonucleotide
agcctacctggagggcctgtgagtg

SEQ ID NO: 37296 - DNA, 24 bp, Artificial Sequence
  Description of Artificial Sequence: Synthetic oligonucleotide
gcctacctggagggcctgtgagtg

SEQ ID NO: 37297 - DNA, 25 bp, Artificial Sequence
  Description of Artificial Sequence: Synthetic oligonucleotide
cctacctggagggcctgtgagtgga

SEQ ID NO: 37298 - DNA, 26 bp, Artificial Sequence
  Description of Artificial Sequence: Synthetic oligonucleotide
ctacctggagggcctgtgagtggagt

SEQ ID NO: 37299 - DNA, 26 bp, Artificial Sequence
  Description of Artificial Sequence: Synthetic oligonucleotide
tacctggagggcctgtgagtggagtg

SEQ ID NO: 37300 - DNA, 25 bp, Artificial Sequence
  Description of Artificial Sequence: Synthetic oligonucleotide
acctggagggcctgtgagtggagtg

SEQ ID NO: 37301 - DNA, 24 bp, Artificial Sequence
  Description of Artificial Sequence: Synthetic oligonucleotide
cctggagggcctgtgagtggagtg

SEQ ID NO: 37302 - DNA, 24 bp, Artificial Sequence
  Description of Artificial Sequence: Synthetic oligonucleotide
ctggagggcctgtgagtggagtgg

SEQ ID NO: 37303 - DNA, 25 bp, Artificial Sequence
  Description of Artificial Sequence: Synthetic oligonucleotide
tggagggcctgtgagtggagtggct

SEQ ID NO: 37304 - DNA, 24 bp, Artificial Sequence
  Description of Artificial Sequence: Synthetic oligonucleotide
ggagggcctgtgagtggagtggct

SEQ ID NO: 37305 - DNA, 24 bp, Artificial Sequence
  Description of Artificial Sequence: Synthetic oligonucleotide
gagggcctgtgagtggagtggctc

SEQ ID NO: 37306 - DNA, 24 bp, Artificial Sequence
  Description of Artificial Sequence: Synthetic oligonucleotide
agggcctgtgagtggagtggctcc

SEQ ID NO: 37307 - DNA, 23 bp, Artificial Sequence
  Description of Artificial Sequence: Synthetic oligonucleotide
gggcctgtgagtggagtggctcc

SEQ ID NO: 37308 - DNA, 23 bp, Artificial Sequence
  Description of Artificial Sequence: Synthetic oligonucleotide
ggcctgtgagtggagtggctccg

SEQ ID NO: 37309 - DNA, 24 bp, Artificial Sequence
  Description of Artificial Sequence: Synthetic oligonucleotide
gcctgtgagtggagtggctccgca

SEQ ID NO: 37310 - DNA, 27 bp, Artificial Sequence
  Description of Artificial Sequence: Synthetic oligonucleotide
cctgtgagtggagtggctccgcagata

SEQ ID NO: 37311 - DNA, 27 bp, Artificial Sequence
  Description of Artificial Sequence: Synthetic oligonucleotide
ctgtgagtggagtggctccgcagatac

SEQ ID NO: 37312 - DNA, 27 bp, Artificial Sequence
  Description of Artificial Sequence: Synthetic oligonucleotide
tgtgagtggagtggctccgcagatacc

SEQ ID NO: 37313 - DNA, 24 bp, Artificial Sequence
  Description of Artificial Sequence: Synthetic oligonucleotide
cggcggacacggcggctcagatta

SEQ ID NO: 37314 - DNA, 24 bp, Artificial Sequence
  Description of Artificial Sequence: Synthetic oligonucleotide
ggcggacacggcggctcagattac

SEQ ID NO: 37315 - DNA, 24 bp, Artificial Sequence
  Description of Artificial Sequence: Synthetic oligonucleotide
gcggacacggcggctcagattacc

SEQ ID NO: 37316 - DNA, 25 bp, Artificial Sequence
  Description of Artificial Sequence: Synthetic oligonucleotide
cggacacggcggctcagattaccca

SEQ ID NO: 37317 - DNA, 25 bp, Artificial Sequence
  Description of Artificial Sequence: Synthetic oligonucleotide
ggacacggcggctcagattacccag

SEQ ID NO: 37318 - DNA, 25 bp, Artificial Sequence
  Description of Artificial Sequence: Synthetic oligonucleotide
gacacggcggctcagattacccagc

SEQ ID NO: 37319 - DNA, 25 bp, Artificial Sequence
  Description of Artificial Sequence: Synthetic oligonucleotide
acacggcggctcagattacccagcg

SEQ ID NO: 37320 - DNA, 24 bp, Artificial Sequence
  Description of Artificial Sequence: Synthetic oligonucleotide
cacggcggctcagattacccagcg

SEQ ID NO: 37321 - DNA, 26 bp, Artificial Sequence
  Description of Artificial Sequence: Synthetic oligonucleotide
acggcggctcagattacccagcgcaa

SEQ ID NO: 37322 - DNA, 25 bp, Artificial Sequence
  Description of Artificial Sequence: Synthetic oligonucleotide
cggcggctcagattacccagcgcaa

SEQ ID NO: 37323 - DNA, 26 bp, Artificial Sequence
  Description of Artificial Sequence: Synthetic oligonucleotide
ggcggctcagattacccagcgcaagt

SEQ ID NO: 37324 - DNA, 26 bp, Artificial Sequence
  Description of Artificial Sequence: Synthetic oligonucleotide
gcggctcagattacccagcgcaagtg

SEQ ID NO: 37325 - DNA, 26 bp, Artificial Sequence
  Description of Artificial Sequence: Synthetic oligonucleotide
cggctcagattacccagcgcaagtgg

SEQ ID NO: 37326 - DNA, 27 bp, Artificial Sequence
  Description of Artificial Sequence: Synthetic oligonucleotide
ggctcagattacccagcgcaagtggga

SEQ ID NO: 37327 - DNA, 27 bp, Artificial Sequence
  Description of Artificial Sequence: Synthetic oligonucleotide
gctcagattacccagcgcaagtgggag

SEQ ID NO: 37328 - DNA, 27 bp, Artificial Sequence
  Description of Artificial Sequence: Synthetic oligonucleotide
ctcagattacccagcgcaagtgggagg

SEQ ID NO: 37329 - DNA, 27 bp, Artificial Sequence
  Description of Artificial Sequence: Synthetic oligonucleotide
tcagattacccagcgcaagtgggaggc

SEQ ID NO: 37330 - DNA, 26 bp, Artificial Sequence
  Description of Artificial Sequence: Synthetic oligonucleotide
cagattacccagcgcaagtgggaggc

SEQ ID NO: 37331 - DNA, 26 bp, Artificial Sequence
  Description of Artificial Sequence: Synthetic oligonucleotide
agattacccagcgcaagtgggaggcg

SEQ ID NO: 37332 - DNA, 25 bp, Artificial Sequence
  Description of Artificial Sequence: Synthetic oligonucleotide
gattacccagcgcaagtgggaggcg

SEQ ID NO: 37333 - DNA, 25 bp, Artificial Sequence
  Description of Artificial Sequence: Synthetic oligonucleotide
attacccagcgcaagtgggaggcgg

SEQ ID NO: 37334 - DNA, 24 bp, Artificial Sequence
  Description of Artificial Sequence: Synthetic oligonucleotide
ttacccagcgcaagtgggaggcgg

SEQ ID NO: 37335 - DNA, 23 bp, Artificial Sequence
  Description of Artificial Sequence: Synthetic oligonucleotide
tacccagcgcaagtgggaggcgg

SEQ ID NO: 37336 - DNA, 26 bp, Artificial Sequence
  Description of Artificial Sequence: Synthetic oligonucleotide
acactgacctggcagcgggatggcta

SEQ ID NO: 37337 - DNA, 25 bp, Artificial Sequence
  Description of Artificial Sequence: Synthetic oligonucleotide
cactgacctggcagcgggatggcta

SEQ ID NO: 37338 - DNA, 25 bp, Artificial Sequence
  Description of Artificial Sequence: Synthetic oligonucleotide
actgacctggcagcgggatggctag

SEQ ID NO: 37339 - DNA, 24 bp, Artificial Sequence
  Description of Artificial Sequence: Synthetic oligonucleotide
ctgacctggcagcgggatggctag

SEQ ID NO: 37340 - DNA, 25 bp, Artificial Sequence
  Description of Artificial Sequence: Synthetic oligonucleotide
tgacctggcagcgggatggctagga

SEQ ID NO: 37341 - DNA, 24 bp, Artificial Sequence
  Description of Artificial Sequence: Synthetic oligonucleotide
gacctggcagcgggatggctagga

SEQ ID NO: 37342 - DNA, 24 bp, Artificial Sequence
  Description of Artificial Sequence: Synthetic oligonucleotide
acctggcagcgggatggctaggac

SEQ ID NO: 37343 - DNA, 23 bp, Artificial Sequence
  Description of Artificial Sequence: Synthetic oligonucleotide
cctggcagcgggatggctaggac

SEQ ID NO: 37344 - DNA, 26 bp, Artificial Sequence
  Description of Artificial Sequence: Synthetic oligonucleotide
ctggcagcgggatggctaggaccaaa

SEQ ID NO: 37345 - DNA, 27 bp, Artificial Sequence
  Description of Artificial Sequence: Synthetic oligonucleotide
tggcagcgggatggctaggaccaaact

SEQ ID NO: 37346 - DNA, 26 bp, Artificial Sequence
  Description of Artificial Sequence: Synthetic oligonucleotide
ggcagcgggatggctaggaccaaact

SEQ ID NO: 37347 - DNA, 27 bp, Artificial Sequence
  Description of Artificial Sequence: Synthetic oligonucleotide
gcagcgggatggctaggaccaaactca

SEQ ID NO: 37348 - DNA, 27 bp, Artificial Sequence
  Description of Artificial Sequence: Synthetic oligonucleotide
cagcgggatggctaggaccaaactcag

SEQ ID NO: 37349 - DNA, 27 bp, Artificial Sequence
  Description of Artificial Sequence: Synthetic oligonucleotide
agcgggatggctaggaccaaactcagg

SEQ ID NO: 37350 - DNA, 27 bp, Artificial Sequence
  Description of Artificial Sequence: Synthetic oligonucleotide
gcgggatggctaggaccaaactcagga

SEQ ID NO: 37351 - DNA, 27 bp, Artificial Sequence
  Description of Artificial Sequence: Synthetic oligonucleotide
cgggatggctaggaccaaactcaggac

SEQ ID NO: 37352 - DNA, 28 bp, Artificial Sequence
  Description of Artificial Sequence: Synthetic oligonucleotide
gggatggctaggaccaaactcaggacac

SEQ ID NO: 37353 - DNA, 28 bp, Artificial Sequence
  Description of Artificial Sequence: Synthetic oligonucleotide
ggatggctaggaccaaactcaggacacc

SEQ ID NO: 37354 - DNA, 28 bp, Artificial Sequence
  Description of Artificial Sequence: Synthetic oligonucleotide
gatggctaggaccaaactcaggacaccg

SEQ ID NO: 37355 - DNA, 29 bp, Artificial Sequence
  Description of Artificial Sequence: Synthetic oligonucleotide
atggctaggaccaaactcaggacaccgag

SEQ ID NO: 37356 - DNA, 28 bp, Artificial Sequence
  Description of Artificial Sequence: Synthetic oligonucleotide
tggctaggaccaaactcaggacaccgag

SEQ ID NO: 37357 - DNA, 27 bp, Artificial Sequence
  Description of Artificial Sequence: Synthetic oligonucleotide
ggctaggaccaaactcaggacaccgag

SEQ ID NO: 37358 - DNA, 27 bp, Artificial Sequence
  Description of Artificial Sequence: Synthetic oligonucleotide
gctaggaccaaactcaggacaccgagc

SEQ ID NO: 37359 - DNA, 29 bp, Artificial Sequence
  Description of Artificial Sequence: Synthetic oligonucleotide
ctaggaccaaactcaggacaccgagcttg

SEQ ID NO: 37360 - DNA, 30 bp, Artificial Sequence
  Description of Artificial Sequence: Synthetic oligonucleotide
taggaccaaactcaggacaccgagcttgtg

SEQ ID NO: 37361 - DNA, 30 bp, Artificial Sequence
  Description of Artificial Sequence: Synthetic oligonucleotide
gagtattgggaccgggagacacagaagttc

SEQ ID NO: 37362 - DNA, 32 bp, Artificial Sequence
  Description of Artificial Sequence: Synthetic oligonucleotide
agtattgggaccgggagacacagaagttcaag

SEQ ID NO: 37363 - DNA, 31 bp, Artificial Sequence
  Description of Artificial Sequence: Synthetic oligonucleotide
gtattgggaccgggagacacagaagttcaag

SEQ ID NO: 37364 - DNA, 31 bp, Artificial Sequence
  Description of Artificial Sequence: Synthetic oligonucleotide
tattgggaccgggagacacagaagttcaagc

SEQ ID NO: 37365 - DNA, 30 bp, Artificial Sequence
  Description of Artificial Sequence: Synthetic oligonucleotide
attgggaccgggagacacagaagttcaagc

SEQ ID NO: 37366 - DNA, 29 bp, Artificial Sequence
  Description of Artificial Sequence: Synthetic oligonucleotide
ttgggaccgggagacacagaagttcaagc

SEQ ID NO: 37367 - DNA, 28 bp, Artificial Sequence
  Description of Artificial Sequence: Synthetic oligonucleotide
tgggaccgggagacacagaagttcaagc

SEQ ID NO: 37368 - DNA, 27 bp, Artificial Sequence
  Description of Artificial Sequence: Synthetic oligonucleotide
gggaccgggagacacagaagttcaagc

SEQ ID NO: 37369 - DNA, 27 bp, Artificial Sequence
  Description of Artificial Sequence: Synthetic oligonucleotide
ggaccgggagacacagaagttcaagcg

SEQ ID NO: 37370 - DNA, 27 bp, Artificial Sequence
  Description of Artificial Sequence: Synthetic oligonucleotide
gaccgggagacacagaagttcaagcgc

SEQ ID NO: 37371 - DNA, 27 bp, Artificial Sequence
  Description of Artificial Sequence: Synthetic oligonucleotide
accgggagacacagaagttcaagcgcc

SEQ ID NO: 37372 - DNA, 27 bp, Artificial Sequence
  Description of Artificial Sequence: Synthetic oligonucleotide
ccgggagacacagaagttcaagcgcca

SEQ ID NO: 37373 - DNA, 27 bp, Artificial Sequence
  Description of Artificial Sequence: Synthetic oligonucleotide
cgggagacacagaagttcaagcgccag

SEQ ID NO: 37374 - DNA, 27 bp, Artificial Sequence
  Description of Artificial Sequence: Synthetic oligonucleotide
gggagacacagaagttcaagcgccagg

SEQ ID NO: 37375 - DNA, 27 bp, Artificial Sequence
  Description of Artificial Sequence: Synthetic oligonucleotide
ggagacacagaagttcaagcgccaggc

SEQ ID NO: 37376 - DNA, 28 bp, Artificial Sequence
  Description of Artificial Sequence: Synthetic oligonucleotide
gagacacagaagttcaagcgccaggcac

SEQ ID NO: 37377 - DNA, 29 bp, Artificial Sequence
  Description of Artificial Sequence: Synthetic oligonucleotide
agacacagaagttcaagcgccaggcacag

SEQ ID NO: 37378 - DNA, 28 bp, Artificial Sequence
  Description of Artificial Sequence: Synthetic oligonucleotide
gacacagaagttcaagcgccaggcacag

SEQ ID NO: 37379 - DNA, 29 bp, Artificial Sequence
  Description of Artificial Sequence: Synthetic oligonucleotide
acacagaagttcaagcgccaggcacagac

SEQ ID NO: 37380 - DNA, 28 bp, Artificial Sequence
  Description of Artificial Sequence: Synthetic oligonucleotide
cacagaagttcaagcgccaggcacagac

SEQ ID NO: 37381 - DNA, 29 bp, Artificial Sequence
  Description of Artificial Sequence: Synthetic oligonucleotide
acagaagttcaagcgccaggcacagactg

SEQ ID NO: 37382 - DNA, 28 bp, Artificial Sequence
  Description of Artificial Sequence: Synthetic oligonucleotide
cagaagttcaagcgccaggcacagactg

SEQ ID NO: 37383 - DNA, 29 bp, Artificial Sequence
  Description of Artificial Sequence: Synthetic oligonucleotide
agaagttcaagcgccaggcacagactgac

SEQ ID NO: 37384 - DNA, 28 bp, Artificial Sequence
  Description of Artificial Sequence: Synthetic oligonucleotide
gaagttcaagcgccaggcacagactgac

SEQ ID NO: 37385 - DNA, 28 bp, Artificial Sequence
  Description of Artificial Sequence: Synthetic oligonucleotide
aagttcaagcgccaggcacagactgacc

SEQ ID NO: 37386 - DNA, 27 bp, Artificial Sequence
  Description of Artificial Sequence: Synthetic oligonucleotide
agttcaagcgccaggcacagactgacc

SEQ ID NO: 37387 - DNA, 26 bp, Artificial Sequence
  Description of Artificial Sequence: Synthetic oligonucleotide
gttcaagcgccaggcacagactgacc

SEQ ID NO: 37388 - DNA, 27 bp, Artificial Sequence
  Description of Artificial Sequence: Synthetic oligonucleotide
ttcaagcgccaggcacagactgaccga

SEQ ID NO: 37389 - DNA, 26 bp, Artificial Sequence
  Description of Artificial Sequence: Synthetic oligonucleotide
tcaagcgccaggcacagactgaccga

SEQ ID NO: 37390 - DNA, 29 bp, Artificial Sequence
  Description of Artificial Sequence: Synthetic oligonucleotide
acacccagttcgtgaggttcgacagcaac

SEQ ID NO: 37391 - DNA, 28 bp, Artificial Sequence
  Description of Artificial Sequence: Synthetic oligonucleotide
cacccagttcgtgaggttcgacagcaac

SEQ ID NO: 37392 - DNA, 28 bp, Artificial Sequence
  Description of Artificial Sequence: Synthetic oligonucleotide
acccagttcgtgaggttcgacagcaacg

SEQ ID NO: 37393 - DNA, 27 bp, Artificial Sequence
  Description of Artificial Sequence: Synthetic oligonucleotide
cccagttcgtgaggttcgacagcaacg

SEQ ID NO: 37394 - DNA, 27 bp, Artificial Sequence
  Description of Artificial Sequence: Synthetic oligonucleotide
ccagttcgtgaggttcgacagcaacgc

SEQ ID NO: 37395 - DNA, 27 bp, Artificial Sequence
  Description of Artificial Sequence: Synthetic oligonucleotide
cagttcgtgaggttcgacagcaacgcc

SEQ ID NO: 37396 - DNA, 27 bp, Artificial Sequence
  Description of Artificial Sequence: Synthetic oligonucleotide
agttcgtgaggttcgacagcaacgccg

SEQ ID NO: 37397 - DNA, 26 bp, Artificial Sequence
  Description of Artificial Sequence: Synthetic oligonucleotide
gttcgtgaggttcgacagcaacgccg

SEQ ID NO: 37398 - DNA, 26 bp, Artificial Sequence
  Description of Artificial Sequence: Synthetic oligonucleotide
ttcgtgaggttcgacagcaacgccgc

SEQ ID NO: 37399 - DNA, 25 bp, Artificial Sequence
  Description of Artificial Sequence: Synthetic oligonucleotide
tcgtgaggttcgacagcaacgccgc

SEQ ID NO: 37400 - DNA, 24 bp, Artificial Sequence
  Description of Artificial Sequence: Synthetic oligonucleotide
cgtgaggttcgacagcaacgccgc

SEQ ID NO: 37401 - DNA, 25 bp, Artificial Sequence
  Description of Artificial Sequence: Synthetic oligonucleotide
gtgaggttcgacagcaacgccgcga

SEQ ID NO: 37402 - DNA, 26 bp, Artificial Sequence
  Description of Artificial Sequence: Synthetic oligonucleotide
tgaggttcgacagcaacgccgcgagt

SEQ ID NO: 37403 - DNA, 25 bp, Artificial Sequence
  Description of Artificial Sequence: Synthetic oligonucleotide
gaggttcgacagcaacgccgcgagt

SEQ ID NO: 37404 - DNA, 25 bp, Artificial Sequence
  Description of Artificial Sequence: Synthetic oligonucleotide
aggttcgacagcaacgccgcgagtc

SEQ ID NO: 37405 - DNA, 24 bp, Artificial Sequence
  Description of Artificial Sequence: Synthetic oligonucleotide
ggttcgacagcaacgccgcgagtc

SEQ ID NO: 37406 - DNA, 24 bp, Artificial Sequence
  Description of Artificial Sequence: Synthetic oligonucleotide
gttcgacagcaacgccgcgagtcc

SEQ ID NO: 37407 - DNA, 25 bp, Artificial Sequence
  Description of Artificial Sequence: Synthetic oligonucleotide
ttcgacagcaacgccgcgagtccga

SEQ ID NO: 37408 - DNA, 24 bp, Artificial Sequence
  Description of Artificial Sequence: Synthetic oligonucleotide
tcgacagcaacgccgcgagtccga

SEQ ID NO: 37409 - DNA, 23 bp, Artificial Sequence
  Description of Artificial Sequence: Synthetic oligonucleotide
cgacagcaacgccgcgagtccga

SEQ ID NO: 37410 - DNA, 23 bp, Artificial Sequence
  Description of Artificial Sequence: Synthetic oligonucleotide
gacagcaacgccgcgagtccgag

SEQ ID NO: 37411 - DNA, 25 bp, Artificial Sequence
  Description of Artificial Sequence: Synthetic oligonucleotide
acagcaacgccgcgagtccgaggat

SEQ ID NO: 37412 - DNA, 24 bp, Artificial Sequence
  Description of Artificial Sequence: Synthetic oligonucleotide
cagcaacgccgcgagtccgaggat

SEQ ID NO: 37413 - DNA, 24 bp, Artificial Sequence
  Description of Artificial Sequence: Synthetic oligonucleotide
agcaacgccgcgagtccgaggatg

SEQ ID NO: 37414 - DNA, 23 bp, Artificial Sequence
  Description of Artificial Sequence: Synthetic oligonucleotide
gcaacgccgcgagtccgaggatg

SEQ ID NO: 37415 - DNA, 23 bp, Artificial Sequence
  Description of Artificial Sequence: Synthetic oligonucleotide
caacgccgcgagtccgaggatgg

SEQ ID NO: 37416 - DNA, 23 bp, Artificial Sequence
  Description of Artificial Sequence: Synthetic oligonucleotide
aacgccgcgagtccgaggatggc

SEQ ID NO: 37417 - DNA, 26 bp, Artificial Sequence
  Description of Artificial Sequence: Synthetic oligonucleotide
ccgggagacacagaagtacaagcgcc

SEQ ID NO: 37418 - DNA, 26 bp, Artificial Sequence
  Description of Artificial Sequence: Synthetic oligonucleotide
cgggagacacagaagtacaagcgccg

SEQ ID NO: 37419 - DNA, 26 bp, Artificial Sequence
  Description of Artificial Sequence: Synthetic oligonucleotide
gggagacacagaagtacaagcgccgg

SEQ ID NO: 37420 - DNA, 26 bp, Artificial Sequence
  Description of Artificial Sequence: Synthetic oligonucleotide
ggagacacagaagtacaagcgccggg

SEQ ID NO: 37421 - DNA, 27 bp, Artificial Sequence
  Description of Artificial Sequence: Synthetic oligonucleotide
gagacacagaagtacaagcgccgggca

SEQ ID NO: 37422 - DNA, 27 bp, Artificial Sequence
  Description of Artificial Sequence: Synthetic oligonucleotide
agacacagaagtacaagcgccgggcac

SEQ ID NO: 37423 - DNA, 27 bp, Artificial Sequence
  Description of Artificial Sequence: Synthetic oligonucleotide
gacacagaagtacaagcgccgggcaca

SEQ ID NO: 37424 - DNA, 27 bp, Artificial Sequence
  Description of Artificial Sequence: Synthetic oligonucleotide
acacagaagtacaagcgccgggcacag

SEQ ID NO: 37425 - DNA, 27 bp, Artificial Sequence
  Description of Artificial Sequence: Synthetic oligonucleotide
cacagaagtacaagcgccgggcacaga

SEQ ID NO: 37426 - DNA, 27 bp, Artificial Sequence
  Description of Artificial Sequence: Synthetic oligonucleotide
acagaagtacaagcgccgggcacagac

SEQ ID NO: 37427 - DNA, 27 bp, Artificial Sequence
  Description of Artificial Sequence: Synthetic oligonucleotide
cagaagtacaagcgccgggcacagact

SEQ ID NO: 37428 - DNA, 27 bp, Artificial Sequence
  Description of Artificial Sequence: Synthetic oligonucleotide
agaagtacaagcgccgggcacagactg

SEQ ID NO: 37429 - DNA, 27 bp, Artificial Sequence
  Description of Artificial Sequence: Synthetic oligonucleotide
gaagtacaagcgccgggcacagactga

SEQ ID NO: 37430 - DNA, 27 bp, Artificial Sequence
  Description of Artificial Sequence: Synthetic oligonucleotide
aagtacaagcgccgggcacagactgac

SEQ ID NO: 37431 - DNA, 26 bp, Artificial Sequence
  Description of Artificial Sequence: Synthetic oligonucleotide
agtacaagcgccgggcacagactgac

SEQ ID NO: 37432 - DNA, 25 bp, Artificial Sequence
  Description of Artificial Sequence: Synthetic oligonucleotide
gtacaagcgccgggcacagactgac

SEQ ID NO: 37433 - DNA, 25 bp, Artificial Sequence
  Description of Artificial Sequence: Synthetic oligonucleotide
tacaagcgccgggcacagactgacc

SEQ ID NO: 37434 - DNA, 24 bp, Artificial Sequence
  Description of Artificial Sequence: Synthetic oligonucleotide
acaagcgccgggcacagactgacc

SEQ ID NO: 37435 - DNA, 23 bp, Artificial Sequence
  Description of Artificial Sequence: Synthetic oligonucleotide
caagcgccgggcacagactgacc

SEQ ID NO: 37436 - DNA, 24 bp, Artificial Sequence
  Description of Artificial Sequence: Synthetic oligonucleotide
aagcgccgggcacagactgaccga

SEQ ID NO: 37437 - DNA, 23 bp, Artificial Sequence
  Description of Artificial Sequence: Synthetic oligonucleotide
agcgccgggcacagactgaccga

SEQ ID NO: 37438 - DNA, 22 bp, Artificial Sequence
  Description of Artificial Sequence: Synthetic oligonucleotide
gcgccgggcacagactgaccga

SEQ ID NO: 37439 - DNA, 23 bp, Artificial Sequence
  Description of Artificial Sequence: Synthetic oligonucleotide
cgccgggcacagactgaccgagt

SEQ ID NO: 37440 - DNA, 24 bp, Artificial Sequence
  Description of Artificial Sequence: Synthetic oligonucleotide
gccgggcacagactgaccgagtga

SEQ ID NO: 37441 - DNA, 24 bp, Artificial Sequence
  Description of Artificial Sequence: Synthetic oligonucleotide
ccgggcacagactgaccgagtgag

SEQ ID NO: 37442 - DNA, 24 bp, Artificial Sequence
  Description of Artificial Sequence: Synthetic oligonucleotide
cgggcacagactgaccgagtgagc

SEQ ID NO: 37443 - DNA, 25 bp, Artificial Sequence
  Description of Artificial Sequence: Synthetic oligonucleotide
gggcacagactgaccgagtgagcct

SEQ ID NO: 37444 - DNA, 26 bp, Artificial Sequence
  Description of Artificial Sequence: Synthetic oligonucleotide
cctgaacgaggacctgagctcctggt

SEQ ID NO: 37445 - DNA, 26 bp, Artificial Sequence
  Description of Artificial Sequence: Synthetic oligonucleotide
ctgaacgaggacctgagctcctggtc

SEQ ID NO: 37446 - DNA, 26 bp, Artificial Sequence
  Description of Artificial Sequence: Synthetic oligonucleotide
tgaacgaggacctgagctcctggtcc

SEQ ID NO: 37447 - DNA, 25 bp, Artificial Sequence
  Description of Artificial Sequence: Synthetic oligonucleotide
gaacgaggacctgagctcctggtcc

SEQ ID NO: 37448 - DNA, 25 bp, Artificial Sequence
  Description of Artificial Sequence: Synthetic oligonucleotide
aacgaggacctgagctcctggtccg

SEQ ID NO: 37449 - DNA, 24 bp, Artificial Sequence
  Description of Artificial Sequence: Synthetic oligonucleotide
acgaggacctgagctcctggtccg

SEQ ID NO: 37450 - DNA, 23 bp, Artificial Sequence
  Description of Artificial Sequence: Synthetic oligonucleotide
cgaggacctgagctcctggtccg

SEQ ID NO: 37451 - DNA, 23 bp, Artificial Sequence
  Description of Artificial Sequence: Synthetic oligonucleotide
gaggacctgagctcctggtccgc

SEQ ID NO: 37452 - DNA, 23 bp, Artificial Sequence
  Description of Artificial Sequence: Synthetic oligonucleotide
aggacctgagctcctggtccgcg

SEQ ID NO: 37453 - DNA, 22 bp, Artificial Sequence
  Description of Artificial Sequence: Synthetic oligonucleotide
ggacctgagctcctggtccgcg

SEQ ID NO: 37454 - DNA, 22 bp, Artificial Sequence
  Description of Artificial Sequence: Synthetic oligonucleotide
gacctgagctcctggtccgcgg

SEQ ID NO: 37455 - DNA, 22 bp, Artificial Sequence
  Description of Artificial Sequence: Synthetic oligonucleotide
acctgagctcctggtccgcggc

SEQ ID NO: 37456 - DNA, 21 bp, Artificial Sequence
  Description of Artificial Sequence: Synthetic oligonucleotide
cctgagctcctggtccgcggc

SEQ ID NO: 37457 - DNA, 21 bp, Artificial Sequence
  Description of Artificial Sequence: Synthetic oligonucleotide
ctgagctcctggtccgcggcg

SEQ ID NO: 37458 - DNA, 22 bp, Artificial Sequence
  Description of Artificial Sequence: Synthetic oligonucleotide
tgagctcctggtccgcggcgga

SEQ ID NO: 37459 - DNA, 21 bp, Artificial Sequence
  Description of Artificial Sequence: Synthetic oligonucleotide
gagctcctggtccgcggcgga

SEQ ID NO: 37460 - DNA, 22 bp, Artificial Sequence
  Description of Artificial Sequence: Synthetic oligonucleotide
agctcctggtccgcggcggaca

SEQ ID NO: 37461 - DNA, 21 bp, Artificial Sequence
  Description of Artificial Sequence: Synthetic oligonucleotide
gctcctggtccgcggcggaca

SEQ ID NO: 37462 - DNA, 21 bp, Artificial Sequence
  Description of Artificial Sequence: Synthetic oligonucleotide
ctcctggtccgcggcggacac

SEQ ID NO: 37463 - DNA, 21 bp, Artificial Sequence
  Description of Artificial Sequence: Synthetic oligonucleotide
tcctggtccgcggcggacacg

SEQ ID NO: 37464 - DNA, 20 bp, Artificial Sequence
  Description of Artificial Sequence: Synthetic oligonucleotide
cctggtccgcggcggacacg

SEQ ID NO: 37465 - DNA, 20 bp, Artificial Sequence
  Description of Artificial Sequence: Synthetic oligonucleotide
ctggtccgcggcggacacgg

SEQ ID NO: 37466 - DNA, 20 bp, Artificial Sequence
  Description of Artificial Sequence: Synthetic oligonucleotide
tggtccgcggcggacacggc

SEQ ID NO: 37467 - DNA, 20 bp, Artificial Sequence
  Description of Artificial Sequence: Synthetic oligonucleotide
ggtccgcggcggacacggct

SEQ ID NO: 37468 - DNA, 20 bp, Artificial Sequence
  Description of Artificial Sequence: Synthetic oligonucleotide
gtccgcggcggacacggcgt

SEQ ID NO: 37469 - DNA, 20 bp, Artificial Sequence
  Description of Artificial Sequence: Synthetic oligonucleotide
tccgcggcggacacggcggt

SEQ ID NO: 37470 - DNA, 26 bp, Artificial Sequence
  Description of Artificial Sequence: Synthetic oligonucleotide
tcatcggagctgtggtcgctgctgtg

SEQ ID NO: 37471 - DNA, 25 bp, Artificial Sequence
  Description of Artificial Sequence: Synthetic oligonucleotide
catcggagctgtggtcgctgctgtg

SEQ ID NO: 37472 - DNA, 26 bp, Artificial Sequence
  Description of Artificial Sequence: Synthetic oligonucleotide
atcggagctgtggtcgctgctgtggt

SEQ ID NO: 37473 - DNA, 25 bp, Artificial Sequence
  Description of Artificial Sequence: Synthetic oligonucleotide
tcggagctgtggtcgctgctgtggt

SEQ ID NO: 37474 - DNA, 24 bp, Artificial Sequence
  Description of Artificial Sequence: Synthetic oligonucleotide
cggagctgtggtcgctgctgtggt

SEQ ID NO: 37475 - DNA, 25 bp, Artificial Sequence
  Description of Artificial Sequence: Synthetic oligonucleotide
ggagctgtggtcgctgctgtggtgt

SEQ ID NO: 37476 - DNA, 27 bp, Artificial Sequence
  Description of Artificial Sequence: Synthetic oligonucleotide
gagctgtggtcgctgctgtggtgtgta

SEQ ID NO: 37477 - DNA, 27 bp, Artificial Sequence
  Description of Artificial Sequence: Synthetic oligonucleotide
agctgtggtcgctgctgtggtgtgtag

SEQ ID NO: 37478 - DNA, 26 bp, Artificial Sequence
  Description of Artificial Sequence: Synthetic oligonucleotide
gctgtggtcgctgctgtggtgtgtag

SEQ ID NO: 37479 - DNA, 27 bp, Artificial Sequence
  Description of Artificial Sequence: Synthetic oligonucleotide
ctgtggtcgctgctgtggtgtgtagga

SEQ ID NO: 37480 - DNA, 27 bp, Artificial Sequence
  Description of Artificial Sequence: Synthetic oligonucleotide
tgtggtcgctgctgtggtgtgtaggag

SEQ ID NO: 37481 - DNA, 26 bp, Artificial Sequence
  Description of Artificial Sequence: Synthetic oligonucleotide
gtggtcgctgctgtggtgtgtaggag

SEQ ID NO: 37482 - DNA, 27 bp, Artificial Sequence
  Description of Artificial Sequence: Synthetic oligonucleotide
tggtcgctgctgtggtgtgtaggagga

SEQ ID NO: 37483 - DNA, 27 bp, Artificial Sequence
  Description of Artificial Sequence: Synthetic oligonucleotide
ggtcgctgctgtggtgtgtaggaggaa

SEQ ID NO: 37484 - DNA, 27 bp, Artificial Sequence
  Description of Artificial Sequence: Synthetic oligonucleotide
gtcgctgctgtggtgtgtaggaggaag

SEQ ID NO: 37485 - DNA, 28 bp, Artificial Sequence
  Description of Artificial Sequence: Synthetic oligonucleotide
tcgctgctgtggtgtgtaggaggaagag

SEQ ID NO: 37486 - DNA, 27 bp, Artificial Sequence
  Description of Artificial Sequence: Synthetic oligonucleotide
cgctgctgtggtgtgtaggaggaagag

SEQ ID NO: 37487 - DNA, 27 bp, Artificial Sequence
  Description of Artificial Sequence: Synthetic oligonucleotide
gctgctgtggtgtgtaggaggaagagc

SEQ ID NO: 37488 - DNA, 28 bp, Artificial Sequence
  Description of Artificial Sequence: Synthetic oligonucleotide
ctgctgtggtgtgtaggaggaagagctc

SEQ ID NO: 37489 - DNA, 29 bp, Artificial Sequence
  Description of Artificial Sequence: Synthetic oligonucleotide
tgctgtggtgtgtaggaggaagagctcag

SEQ ID NO: 37490 - DNA, 28 bp, Artificial Sequence
  Description of Artificial Sequence: Synthetic oligonucleotide
gctgtggtgtgtaggaggaagagctcag

SEQ ID NO: 37491 - DNA, 28 bp, Artificial Sequence
  Description of Artificial Sequence: Synthetic oligonucleotide
ctgtggtgtgtaggaggaagagctcagg

SEQ ID NO: 37492 - DNA, 29 bp, Artificial Sequence
  Description of Artificial Sequence: Synthetic oligonucleotide
tgtggtgtgtaggaggaagagctcaggtg

SEQ ID NO: 37493 - DNA, 28 bp, Artificial Sequence
  Description of Artificial Sequence: Synthetic oligonucleotide
gtggtgtgtaggaggaagagctcaggtg

SEQ ID NO: 37494 - DNA, 28 bp, Artificial Sequence
  Description of Artificial Sequence: Synthetic oligonucleotide
tggtgtgtaggaggaagagctcaggtgg

SEQ ID NO: 37495 - DNA, 27 bp, Artificial Sequence
  Description of Artificial Sequence: Synthetic oligonucleotide
ggtgtgtaggaggaagagctcaggtgg

SEQ ID NO: 37496 - DNA, 31 bp, Artificial Sequence
  Description of Artificial Sequence: Synthetic oligonucleotide
gtgtgtaggaggaagagctcaggtggaaaag

SEQ ID NO: 37497 - DNA, 31 bp, Artificial Sequence
  Description of Artificial Sequence: Synthetic oligonucleotide
cagcaggagatagaaccttccagaagtggac

SEQ ID NO: 37498 - DNA, 32 bp, Artificial Sequence
  Description of Artificial Sequence: Synthetic oligonucleotide
agcaggagatagaaccttccagaagtggacag

SEQ ID NO: 37499 - DNA, 31 bp, Artificial Sequence
  Description of Artificial Sequence: Synthetic oligonucleotide
gcaggagatagaaccttccagaagtggacag

SEQ ID NO: 37500 - DNA, 31 bp, Artificial Sequence
  Description of Artificial Sequence: Synthetic oligonucleotide
caggagatagaaccttccagaagtggacagc

SEQ ID NO: 37501 - DNA, 32 bp, Artificial Sequence
  Description of Artificial Sequence: Synthetic oligonucleotide
aggagatagaaccttccagaagtggacagctg

SEQ ID NO: 37502 - DNA, 31 bp, Artificial Sequence
  Description of Artificial Sequence: Synthetic oligonucleotide
ggagatagaaccttccagaagtggacagctg

SEQ ID NO: 37503 - DNA, 32 bp, Artificial Sequence
  Description of Artificial Sequence: Synthetic oligonucleotide
gagatagaaccttccagaagtggacagctgtg

SEQ ID NO: 37504 - DNA, 32 bp, Artificial Sequence
  Description of Artificial Sequence: Synthetic oligonucleotide
agatagaaccttccagaagtggacagctgtgg

SEQ ID NO: 37505 - DNA, 31 bp, Artificial Sequence
  Description of Artificial Sequence: Synthetic oligonucleotide
gatagaaccttccagaagtggacagctgtgg

SEQ ID NO: 37506 - DNA, 32 bp, Artificial Sequence
  Description of Artificial Sequence: Synthetic oligonucleotide
atagaaccttccagaagtggacagctgtggtg

SEQ ID NO: 37507 - DNA, 31 bp, Artificial Sequence
  Description of Artificial Sequence: Synthetic oligonucleotide
tagaaccttccagaagtggacagctgtggtg

SEQ ID NO: 37508 - DNA, 30 bp, Artificial Sequence
  Description of Artificial Sequence: Synthetic oligonucleotide
agaaccttccagaagtggacagctgtggtg

SEQ ID NO: 37509 - DNA, 29 bp, Artificial Sequence
  Description of Artificial Sequence: Synthetic oligonucleotide
gaaccttccagaagtggacagctgtggtg

SEQ ID NO: 37510 - DNA, 29 bp, Artificial Sequence
  Description of Artificial Sequence: Synthetic oligonucleotide
aaccttccagaagtggacagctgtggtgg

SEQ ID NO: 37511 - DNA, 28 bp, Artificial Sequence
  Description of Artificial Sequence: Synthetic oligonucleotide
accttccagaagtggacagctgtggtgg

SEQ ID NO: 37512 - DNA, 27 bp, Artificial Sequence
  Description of Artificial Sequence: Synthetic oligonucleotide
ccttccagaagtggacagctgtggtgg

SEQ ID NO: 37513 - DNA, 28 bp, Artificial Sequence
  Description of Artificial Sequence: Synthetic oligonucleotide
cttccagaagtggacagctgtggtggtg

SEQ ID NO: 37514 - DNA, 28 bp, Artificial Sequence
  Description of Artificial Sequence: Synthetic oligonucleotide
ttccagaagtggacagctgtggtggtgc

SEQ ID NO: 37515 - DNA, 27 bp, Artificial Sequence
  Description of Artificial Sequence: Synthetic oligonucleotide
tccagaagtggacagctgtggtggtgc

SEQ ID NO: 37516 - DNA, 26 bp, Artificial Sequence
  Description of Artificial Sequence: Synthetic oligonucleotide
ccagaagtggacagctgtggtggtgc

SEQ ID NO: 37517 - DNA, 27 bp, Artificial Sequence
  Description of Artificial Sequence: Synthetic oligonucleotide
cagaagtggacagctgtggtggtgcct

SEQ ID NO: 37518 - DNA, 28 bp, Artificial Sequence
  Description of Artificial Sequence: Synthetic oligonucleotide
agaagtggacagctgtggtggtgccttc

SEQ ID NO: 37519 - DNA, 27 bp, Artificial Sequence
  Description of Artificial Sequence: Synthetic oligonucleotide
gaagtggacagctgtggtggtgccttc

SEQ ID NO: 37520 - DNA, 28 bp, Artificial Sequence
  Description of Artificial Sequence: Synthetic oligonucleotide
aagtggacagctgtggtggtgccttctg

SEQ ID NO: 37521 - DNA, 27 bp, Artificial Sequence
  Description of Artificial Sequence: Synthetic oligonucleotide
agtggacagctgtggtggtgccttctg

SEQ ID NO: 37522 - DNA, 26 bp, Artificial Sequence
  Description of Artificial Sequence: Synthetic oligonucleotide
gtggacagctgtggtggtgccttctg

SEQ ID NO: 37523 - DNA, 27 bp, Artificial Sequence
  Description of Artificial Sequence: Synthetic oligonucleotide
tggacagctgtggtggtgccttctgga

SEQ ID NO: 37524 - DNA, 26 bp, Artificial Sequence
  Description of Artificial Sequence: Synthetic oligonucleotide
ggacagctgtggtggtgccttctgga

SEQ ID NO: 37525 - DNA, 27 bp, Artificial Sequence
  Description of Artificial Sequence: Synthetic oligonucleotide
gacagctgtggtggtgccttctggaga

SEQ ID NO: 37526 - DNA, 28 bp, Artificial Sequence
  Description of Artificial Sequence: Synthetic oligonucleotide
acagctgtggtggtgccttctggagaag

SEQ ID NO: 37527 - DNA, 22 bp, Artificial Sequence
  Description of Artificial Sequence: Synthetic oligonucleotide
agagaggagccgcgggcgcctt

SEQ ID NO: 37528 - DNA, 21 bp, Artificial Sequence
  Description of Artificial Sequence: Synthetic oligonucleotide
gagaggagccgcgggcgcctt

SEQ ID NO: 37529 - DNA, 21 bp, Artificial Sequence
  Description of Artificial Sequence: Synthetic oligonucleotide
agaggagccgcgggcgccttg

SEQ ID NO: 37530 - DNA, 20 bp, Artificial Sequence
  Description of Artificial Sequence: Synthetic oligonucleotide
gaggagccgcgggcgccttg

SEQ ID NO: 37531 - DNA, 23 bp, Artificial Sequence
  Description of Artificial Sequence: Synthetic oligonucleotide
aggagccgcgggcgccttggata

SEQ ID NO: 37532 - DNA, 22 bp, Artificial Sequence
  Description of Artificial Sequence: Synthetic oligonucleotide
ggagccgcgggcgccttggata

SEQ ID NO: 37533 - DNA, 23 bp, Artificial Sequence
  Description of Artificial Sequence: Synthetic oligonucleotide
gagccgcgggcgccttggataga

SEQ ID NO: 37534 - DNA, 23 bp, Artificial Sequence
  Description of Artificial Sequence: Synthetic oligonucleotide
agccgcgggcgccttggatagag

SEQ ID NO: 37535 - DNA, 22 bp, Artificial Sequence
  Description of Artificial Sequence: Synthetic oligonucleotide
gccgcgggcgccttggatagag

SEQ ID NO: 37536 - DNA, 23 bp, Artificial Sequence
  Description of Artificial Sequence: Synthetic oligonucleotide
ccgcgggcgccttggatagagca

SEQ ID NO: 37537 - DNA, 23 bp, Artificial Sequence
  Description of Artificial Sequence: Synthetic oligonucleotide
cgcgggcgccttggatagagcag

SEQ ID NO: 37538 - DNA, 24 bp, Artificial Sequence
  Description of Artificial Sequence: Synthetic oligonucleotide
gcgggcgccttggatagagcagga

SEQ ID NO: 37539 - DNA, 24 bp, Artificial Sequence
  Description of Artificial Sequence: Synthetic oligonucleotide
cgggcgccttggatagagcaggag

SEQ ID NO: 37540 - DNA, 24 bp, Artificial Sequence
  Description of Artificial Sequence: Synthetic oligonucleotide
gggcgccttggatagagcaggagg

SEQ ID NO: 37541 - DNA, 24 bp, Artificial Sequence
  Description of Artificial Sequence: Synthetic oligonucleotide
ggcgccttggatagagcaggaggg

SEQ ID NO: 37542 - DNA, 24 bp, Artificial Sequence
  Description of Artificial Sequence: Synthetic oligonucleotide
gcgccttggatagagcaggagggg

SEQ ID NO: 37543 - DNA, 24 bp, Artificial Sequence
  Description of Artificial Sequence: Synthetic oligonucleotide
cgccttggatagagcaggaggggc

SEQ ID NO: 37544 - DNA, 24 bp, Artificial Sequence
  Description of Artificial Sequence: Synthetic oligonucleotide
gccttggatagagcaggaggggcc

SEQ ID NO: 37545 - DNA, 24 bp, Artificial Sequence
  Description of Artificial Sequence: Synthetic oligonucleotide
ccttggatagagcaggaggggccg

SEQ ID NO: 37546 - DNA, 25 bp, Artificial Sequence
  Description of Artificial Sequence: Synthetic oligonucleotide
cttggatagagcaggaggggccgga

SEQ ID NO: 37547 - DNA, 27 bp, Artificial Sequence
  Description of Artificial Sequence: Synthetic oligonucleotide
ttggatagagcaggaggggccggagta

SEQ ID NO: 37548 - DNA, 26 bp, Artificial Sequence
  Description of Artificial Sequence: Synthetic oligonucleotide
tacagcatgaggggctgccgaagcct

SEQ ID NO: 37549 - DNA, 25 bp, Artificial Sequence
  Description of Artificial Sequence: Synthetic oligonucleotide
acagcatgaggggctgccgaagcct

SEQ ID NO: 37550 - DNA, 24 bp, Artificial Sequence
  Description of Artificial Sequence: Synthetic oligonucleotide
cagcatgaggggctgccgaagcct

SEQ ID NO: 37551 - DNA, 25 bp, Artificial Sequence
  Description of Artificial Sequence: Synthetic oligonucleotide
agcatgaggggctgccgaagcctct

SEQ ID NO: 37552 - DNA, 24 bp, Artificial Sequence
  Description of Artificial Sequence: Synthetic oligonucleotide
gcatgaggggctgccgaagcctct

SEQ ID NO: 37553 - DNA, 25 bp, Artificial Sequence
  Description of Artificial Sequence: Synthetic oligonucleotide
catgaggggctgccgaagcctctca

SEQ ID NO: 37554 - DNA, 25 bp, Artificial Sequence
  Description of Artificial Sequence: Synthetic oligonucleotide
atgaggggctgccgaagcctctcac

SEQ ID NO: 37555 - DNA, 24 bp, Artificial Sequence
  Description of Artificial Sequence: Synthetic oligonucleotide
tgaggggctgccgaagcctctcac

SEQ ID NO: 37556 - DNA, 23 bp, Artificial Sequence
  Description of Artificial Sequence: Synthetic oligonucleotide
gaggggctgccgaagcctctcac

SEQ ID NO: 37557 - DNA, 23 bp, Artificial Sequence
  Description of Artificial Sequence: Synthetic oligonucleotide
aggggctgccgaagcctctcacc

SEQ ID NO: 37558 - DNA, 22 bp, Artificial Sequence
  Description of Artificial Sequence: Synthetic oligonucleotide
ggggctgccgaagcctctcacc

SEQ ID NO: 37559 - DNA, 23 bp, Artificial Sequence
  Description of Artificial Sequence: Synthetic oligonucleotide
gggctgccgaagcctctcaccct

SEQ ID NO: 37560 - DNA, 24 bp, Artificial Sequence
  Description of Artificial Sequence: Synthetic oligonucleotide
ggctgccgaagcctctcaccctga

SEQ ID NO: 37561 - DNA, 26 bp, Artificial Sequence
  Description of Artificial Sequence: Synthetic oligonucleotide
gctgccgaagcctctcaccctgagat

SEQ ID NO: 37562 - DNA, 26 bp, Artificial Sequence
  Description of Artificial Sequence: Synthetic oligonucleotide
ctgccgaagcctctcaccctgagatg

SEQ ID NO: 37563 - DNA, 26 bp, Artificial Sequence
  Description of Artificial Sequence: Synthetic oligonucleotide
tgccgaagcctctcaccctgagatgg

SEQ ID NO: 37564 - DNA, 25 bp, Artificial Sequence
  Description of Artificial Sequence: Synthetic oligonucleotide
gccgaagcctctcaccctgagatgg

SEQ ID NO: 37565 - DNA, 26 bp, Artificial Sequence
  Description of Artificial Sequence: Synthetic oligonucleotide
ccgaagcctctcaccctgagatggga

SEQ ID NO: 37566 - DNA, 26 bp, Artificial Sequence
  Description of Artificial Sequence: Synthetic oligonucleotide
cgaagcctctcaccctgagatgggag

SEQ ID NO: 37567 - DNA, 26 bp, Artificial Sequence
  Description of Artificial Sequence: Synthetic oligonucleotide
gaagcctctcaccctgagatgggagc

SEQ ID NO: 37568 - DNA, 26 bp, Artificial Sequence
  Description of Artificial Sequence: Synthetic oligonucleotide
aagcctctcaccctgagatgggagcc

SEQ ID NO: 37569 - DNA, 25 bp, Artificial Sequence
  Description of Artificial Sequence: Synthetic oligonucleotide
agcctctcaccctgagatgggagcc

SEQ ID NO: 37570 - DNA, 24 bp, Artificial Sequence
  Description of Artificial Sequence: Synthetic oligonucleotide
gcctctcaccctgagatgggagcc

SEQ ID NO: 37571 - DNA, 25 bp, Artificial Sequence
  Description of Artificial Sequence: Synthetic oligonucleotide
cctctcaccctgagatgggagccgt

SEQ ID NO: 37572 - DNA, 27 bp, Artificial Sequence
  Description of Artificial Sequence: Synthetic oligonucleotide
ctctcaccctgagatgggagccgtctt

SEQ ID NO: 37573 - DNA, 27 bp, Artificial Sequence
  Description of Artificial Sequence: Synthetic oligonucleotide
tctcaccctgagatgggagccgtcttc

SEQ ID NO: 37574 - DNA, 22 bp, Artificial Sequence
  Description of Artificial Sequence: Synthetic oligonucleotide
gccgcggggagccccgctttat

SEQ ID NO: 37575 - DNA, 23 bp, Artificial Sequence
  Description of Artificial Sequence: Synthetic oligonucleotide
ccgcggggagccccgctttatct

SEQ ID NO: 37576 - DNA, 24 bp, Artificial Sequence
  Description of Artificial Sequence: Synthetic oligonucleotide
cgcggggagccccgctttatctca

SEQ ID NO: 37577 - DNA, 25 bp, Artificial Sequence
  Description of Artificial Sequence: Synthetic oligonucleotide
gcggggagccccgctttatctcagt

SEQ ID NO: 37578 - DNA, 25 bp, Artificial Sequence
  Description of Artificial Sequence: Synthetic oligonucleotide
cggggagccccgctttatctcagtg

SEQ ID NO: 37579 - DNA, 25 bp, Artificial Sequence
  Description of Artificial Sequence: Synthetic oligonucleotide
ggggagccccgctttatctcagtgg

SEQ ID NO: 37580 - DNA, 25 bp, Artificial Sequence
  Description of Artificial Sequence: Synthetic oligonucleotide
gggagccccgctttatctcagtggg

SEQ ID NO: 37581 - DNA, 27 bp, Artificial Sequence
  Description of Artificial Sequence: Synthetic oligonucleotide
ggagccccgctttatctcagtgggcta

SEQ ID NO: 37582 - DNA, 27 bp, Artificial Sequence
  Description of Artificial Sequence: Synthetic oligonucleotide
gagccccgctttatctcagtgggctac

SEQ ID NO: 37583 - DNA, 27 bp, Artificial Sequence
  Description of Artificial Sequence: Synthetic oligonucleotide
agccccgctttatctcagtgggctacg

SEQ ID NO: 37584 - DNA, 27 bp, Artificial Sequence
  Description of Artificial Sequence: Synthetic oligonucleotide
gccccgctttatctcagtgggctacgt

SEQ ID NO: 37585 - DNA, 27 bp, Artificial Sequence
  Description of Artificial Sequence: Synthetic oligonucleotide
ccccgctttatctcagtgggctacgtg

SEQ ID NO: 37586 - DNA, 27 bp, Artificial Sequence
  Description of Artificial Sequence: Synthetic oligonucleotide
cccgctttatctcagtgggctacgtgg

SEQ ID NO: 37587 - DNA, 28 bp, Artificial Sequence
  Description of Artificial Sequence: Synthetic oligonucleotide
ccgctttatctcagtgggctacgtggac

SEQ ID NO: 37588 - DNA, 28 bp, Artificial Sequence
  Description of Artificial Sequence: Synthetic oligonucleotide
cgctttatctcagtgggctacgtggacg

SEQ ID NO: 37589 - DNA, 29 bp, Artificial Sequence
  Description of Artificial Sequence: Synthetic oligonucleotide
gctttatctcagtgggctacgtggacgac

SEQ ID NO: 37590 - DNA, 30 bp, Artificial Sequence
  Description of Artificial Sequence: Synthetic oligonucleotide
ctttatctcagtgggctacgtggacgacac

SEQ ID NO: 37591 - DNA, 30 bp, Artificial Sequence
  Description of Artificial Sequence: Synthetic oligonucleotide
tttatctcagtgggctacgtggacgacacc

SEQ ID NO: 37592 - DNA, 29 bp, Artificial Sequence
  Description of Artificial Sequence: Synthetic oligonucleotide
ttatctcagtgggctacgtggacgacacc

SEQ ID NO: 37593 - DNA, 28 bp, Artificial Sequence
  Description of Artificial Sequence: Synthetic oligonucleotide
tatctcagtgggctacgtggacgacacc

SEQ ID NO: 37594 - DNA, 22 bp, Artificial Sequence
  Description of Artificial Sequence: Synthetic oligonucleotide
gcggggagccccgcttcatctc

SEQ ID NO: 37595 - DNA, 22 bp, Artificial Sequence
  Description of Artificial Sequence: Synthetic oligonucleotide
cggggagccccgcttcatctcc

SEQ ID NO: 37596 - DNA, 23 bp, Artificial Sequence
  Description of Artificial Sequence: Synthetic oligonucleotide
ggggagccccgcttcatctccgt

SEQ ID NO: 37597 - DNA, 23 bp, Artificial Sequence
  Description of Artificial Sequence: Synthetic oligonucleotide
gggagccccgcttcatctccgtg

SEQ ID NO: 37598 - DNA, 23 bp, Artificial Sequence
  Description of Artificial Sequence: Synthetic oligonucleotide
ggagccccgcttcatctccgtgg

SEQ ID NO: 37599 - DNA, 23 bp, Artificial Sequence
  Description of Artificial Sequence: Synthetic oligonucleotide
gagccccgcttcatctccgtggg

SEQ ID NO: 37600 - DNA, 25 bp, Artificial Sequence
  Description of Artificial Sequence: Synthetic oligonucleotide
agccccgcttcatctccgtgggcta

SEQ ID NO: 37601 - DNA, 24 bp, Artificial Sequence
  Description of Artificial Sequence: Synthetic oligonucleotide
gccccgcttcatctccgtgggcta

SEQ ID NO: 37602 - DNA, 24 bp, Artificial Sequence
  Description of Artificial Sequence: Synthetic oligonucleotide
ccccgcttcatctccgtgggctac

SEQ ID NO: 37603 - DNA, 25 bp, Artificial Sequence
  Description of Artificial Sequence: Synthetic oligonucleotide
cccgcttcatctccgtgggctacgt

SEQ ID NO: 37604 - DNA, 25 bp, Artificial Sequence
  Description of Artificial Sequence: Synthetic oligonucleotide
ccgcttcatctccgtgggctacgtg

SEQ ID NO: 37605 - DNA, 26 bp, Artificial Sequence
  Description of Artificial Sequence: Synthetic oligonucleotide
cgcttcatctccgtgggctacgtgga

SEQ ID NO: 37606 - DNA, 26 bp, Artificial Sequence
  Description of Artificial Sequence: Synthetic oligonucleotide
gcttcatctccgtgggctacgtggac

SEQ ID NO: 37607 - DNA, 27 bp, Artificial Sequence
  Description of Artificial Sequence: Synthetic oligonucleotide
cttcatctccgtgggctacgtggacga

SEQ ID NO: 37608 - DNA, 27 bp, Artificial Sequence
  Description of Artificial Sequence: Synthetic oligonucleotide
ttcatctccgtgggctacgtggacgac

SEQ ID NO: 37609 - DNA, 27 bp, Artificial Sequence
  Description of Artificial Sequence: Synthetic oligonucleotide
tcatctccgtgggctacgtggacgaca

SEQ ID NO: 37610 - DNA, 26 bp, Artificial Sequence
  Description of Artificial Sequence: Synthetic oligonucleotide
catctccgtgggctacgtggacgaca

SEQ ID NO: 37611 - DNA, 26 bp, Artificial Sequence
  Description of Artificial Sequence: Synthetic oligonucleotide
atctccgtgggctacgtggacgacac

SEQ ID NO: 37612 - DNA, 25 bp, Artificial Sequence
  Description of Artificial Sequence: Synthetic oligonucleotide
tctccgtgggctacgtggacgacac

SEQ ID NO: 37613 - DNA, 24 bp, Artificial Sequence
  Description of Artificial Sequence: Synthetic oligonucleotide
ctccgtgggctacgtggacgacac

SEQ ID NO: 37614 - DNA, 24 bp, Artificial Sequence
  Description of Artificial Sequence: Synthetic oligonucleotide
tccgtgggctacgtggacgacacc

SEQ ID NO: 37615 - DNA, 29 bp, Artificial Sequence
  Description of Artificial Sequence: Synthetic oligonucleotide
ggatggcgaggaccaaactcaggacattg

SEQ ID NO: 37616 - DNA, 30 bp, Artificial Sequence
  Description of Artificial Sequence: Synthetic oligonucleotide
gatggcgaggaccaaactcaggacattgag

SEQ ID NO: 37617 - DNA, 30 bp, Artificial Sequence
  Description of Artificial Sequence: Synthetic oligonucleotide
atggcgaggaccaaactcaggacattgagc

SEQ ID NO: 37618 - DNA, 29 bp, Artificial Sequence
  Description of Artificial Sequence: Synthetic oligonucleotide
tggcgaggaccaaactcaggacattgagc

SEQ ID NO: 37619 - DNA, 28 bp, Artificial Sequence
  Description of Artificial Sequence: Synthetic oligonucleotide
ggcgaggaccaaactcaggacattgagc

SEQ ID NO: 37620 - DNA, 30 bp, Artificial Sequence
  Description of Artificial Sequence: Synthetic oligonucleotide
gcgaggaccaaactcaggacattgagcttg

SEQ ID NO: 37621 - DNA, 31 bp, Artificial Sequence
  Description of Artificial Sequence: Synthetic oligonucleotide
cgaggaccaaactcaggacattgagcttgtg

SEQ ID NO: 37622 - DNA, 31 bp, Artificial Sequence
  Description of Artificial Sequence: Synthetic oligonucleotide
gaggaccaaactcaggacattgagcttgtgg

SEQ ID NO: 37623 - DNA, 32 bp, Artificial Sequence
  Description of Artificial Sequence: Synthetic oligonucleotide
aggaccaaactcaggacattgagcttgtggag

SEQ ID NO: 37624 - DNA, 31 bp, Artificial Sequence
  Description of Artificial Sequence: Synthetic oligonucleotide
ggaccaaactcaggacattgagcttgtggag

SEQ ID NO: 37625 - DNA, 32 bp, Artificial Sequence
  Description of Artificial Sequence: Synthetic oligonucleotide
gaccaaactcaggacattgagcttgtggagac

SEQ ID NO: 37626 - DNA, 32 bp, Artificial Sequence
  Description of Artificial Sequence: Synthetic oligonucleotide
accaaactcaggacattgagcttgtggagacc

SEQ ID NO: 37627 - DNA, 31 bp, Artificial Sequence
  Description of Artificial Sequence: Synthetic oligonucleotide
ccaaactcaggacattgagcttgtggagacc

SEQ ID NO: 37628 - DNA, 32 bp, Artificial Sequence
  Description of Artificial Sequence: Synthetic oligonucleotide
caaactcaggacattgagcttgtggagaccag

SEQ ID NO: 37629 - DNA, 33 bp, Artificial Sequence
  Description of Artificial Sequence: Synthetic oligonucleotide
aaactcaggacattgagcttgtggagaccagac

SEQ ID NO: 37630 - DNA, 32 bp, Artificial Sequence
  Description of Artificial Sequence: Synthetic oligonucleotide
aactcaggacattgagcttgtggagaccagac

SEQ ID NO: 37631 - DNA, 31 bp, Artificial Sequence
  Description of Artificial Sequence: Synthetic oligonucleotide
actcaggacattgagcttgtggagaccagac

SEQ ID NO: 37632 - DNA, 30 bp, Artificial Sequence
  Description of Artificial Sequence: Synthetic oligonucleotide
ctcaggacattgagcttgtggagaccagac

SEQ ID NO: 37633 - DNA, 30 bp, Artificial Sequence
  Description of Artificial Sequence: Synthetic oligonucleotide
tcaggacattgagcttgtggagaccagacc

SEQ ID NO: 37634 - DNA, 29 bp, Artificial Sequence
  Description of Artificial Sequence: Synthetic oligonucleotide
caggacattgagcttgtggagaccagacc

SEQ ID NO: 37635 - DNA, 30 bp, Artificial Sequence
  Description of Artificial Sequence: Synthetic oligonucleotide
aggacattgagcttgtggagaccagaccag

SEQ ID NO: 37636 - DNA, 29 bp, Artificial Sequence
  Description of Artificial Sequence: Synthetic oligonucleotide
ggacattgagcttgtggagaccagaccag

SEQ ID NO: 37637 - DNA, 29 bp, Artificial Sequence
  Description of Artificial Sequence: Synthetic oligonucleotide
gacattgagcttgtggagaccagaccagc

SEQ ID NO: 37638 - DNA, 30 bp, Artificial Sequence
  Description of Artificial Sequence: Synthetic oligonucleotide
acattgagcttgtggagaccagaccagcag

SEQ ID NO: 37639 - DNA, 29 bp, Artificial Sequence
  Description of Artificial Sequence: Synthetic oligonucleotide
cattgagcttgtggagaccagaccagcag

SEQ ID NO: 37640 - DNA, 29 bp, Artificial Sequence
  Description of Artificial Sequence: Synthetic oligonucleotide
attgagcttgtggagaccagaccagcagg

SEQ ID NO: 37641 - DNA, 28 bp, Artificial Sequence
  Description of Artificial Sequence: Synthetic oligonucleotide
ttgagcttgtggagaccagaccagcagg

SEQ ID NO: 37642 - DNA, 26 bp, Artificial Sequence
  Description of Artificial Sequence: Synthetic oligonucleotide
tacctggagggcgagtgcgtggagtt

SEQ ID NO: 37643 - DNA, 25 bp, Artificial Sequence
  Description of Artificial Sequence: Synthetic oligonucleotide
acctggagggcgagtgcgtggagtt

SEQ ID NO: 37644 - DNA, 24 bp, Artificial Sequence
  Description of Artificial Sequence: Synthetic oligonucleotide
cctggagggcgagtgcgtggagtt

SEQ ID NO: 37645 - DNA, 24 bp, Artificial Sequence
  Description of Artificial Sequence: Synthetic oligonucleotide
ctggagggcgagtgcgtggagttg

SEQ ID NO: 37646 - DNA, 25 bp, Artificial Sequence
  Description of Artificial Sequence: Synthetic oligonucleotide
tggagggcgagtgcgtggagttgct

SEQ ID NO: 37647 - DNA, 24 bp, Artificial Sequence
  Description of Artificial Sequence: Synthetic oligonucleotide
ggagggcgagtgcgtggagttgct

SEQ ID NO: 37648 - DNA, 24 bp, Artificial Sequence
  Description of Artificial Sequence: Synthetic oligonucleotide
gagggcgagtgcgtggagttgctc

SEQ ID NO: 37649 - DNA, 24 bp, Artificial Sequence
  Description of Artificial Sequence: Synthetic oligonucleotide
agggcgagtgcgtggagttgctcc

SEQ ID NO: 37650 - DNA, 23 bp, Artificial Sequence
  Description of Artificial Sequence: Synthetic oligonucleotide
gggcgagtgcgtggagttgctcc

SEQ ID NO: 37651 - DNA, 23 bp, Artificial Sequence
  Description of Artificial Sequence: Synthetic oligonucleotide
ggcgagtgcgtggagttgctccg

SEQ ID NO: 37652 - DNA, 24 bp, Artificial Sequence
  Description of Artificial Sequence: Synthetic oligonucleotide
gcgagtgcgtggagttgctccgca

SEQ ID NO: 37653 - DNA, 27 bp, Artificial Sequence
  Description of Artificial Sequence: Synthetic oligonucleotide
cgagtgcgtggagttgctccgcagata

SEQ ID NO: 37654 - DNA, 27 bp, Artificial Sequence
  Description of Artificial Sequence: Synthetic oligonucleotide
gagtgcgtggagttgctccgcagatac

SEQ ID NO: 37655 - DNA, 27 bp, Artificial Sequence
  Description of Artificial Sequence: Synthetic oligonucleotide
agtgcgtggagttgctccgcagatacc

SEQ ID NO: 37656 - DNA, 27 bp, Artificial Sequence
  Description of Artificial Sequence: Synthetic oligonucleotide
gtgcgtggagttgctccgcagatacct

SEQ ID NO: 37657 - DNA, 27 bp, Artificial Sequence
  Description of Artificial Sequence: Synthetic oligonucleotide
tgcgtggagttgctccgcagatacctg

SEQ ID NO: 37658 - DNA, 26 bp, Artificial Sequence
  Description of Artificial Sequence: Synthetic oligonucleotide
gcgtggagttgctccgcagatacctg

SEQ ID NO: 37659 - DNA, 27 bp, Artificial Sequence
  Description of Artificial Sequence: Synthetic oligonucleotide
cgtggagttgctccgcagatacctgga

SEQ ID NO: 37660 - DNA, 27 bp, Artificial Sequence
  Description of Artificial Sequence: Synthetic oligonucleotide
gtggagttgctccgcagatacctggag

SEQ ID NO: 37661 - DNA, 29 bp, Artificial Sequence
  Description of Artificial Sequence: Synthetic oligonucleotide
tggagttgctccgcagatacctggagaac

SEQ ID NO: 37662 - DNA, 28 bp, Artificial Sequence
  Description of Artificial Sequence: Synthetic oligonucleotide
ggagttgctccgcagatacctggagaac

SEQ ID NO: 37663 - DNA, 28 bp, Artificial Sequence
  Description of Artificial Sequence: Synthetic oligonucleotide
gagttgctccgcagatacctggagaacg

SEQ ID NO: 37664 - DNA, 28 bp, Artificial Sequence
  Description of Artificial Sequence: Synthetic oligonucleotide
agttgctccgcagatacctggagaacgg

SEQ ID NO: 37665 - DNA, 27 bp, Artificial Sequence
  Description of Artificial Sequence: Synthetic oligonucleotide
gttgctccgcagatacctggagaacgg

SEQ ID NO: 37666 - DNA, 27 bp, Artificial Sequence
  Description of Artificial Sequence: Synthetic oligonucleotide
ttgctccgcagatacctggagaacggg

SEQ ID NO: 37667 - DNA, 27 bp, Artificial Sequence
  Description of Artificial Sequence: Synthetic oligonucleotide
tgctccgcagatacctggagaacggga

SEQ ID NO: 37668 - DNA, 23 bp, Artificial Sequence
  Description of Artificial Sequence: Synthetic oligonucleotide
gggccggagtattgggaccgggt

SEQ ID NO: 37669 - DNA, 24 bp, Artificial Sequence
  Description of Artificial Sequence: Synthetic oligonucleotide
ggccggagtattgggaccgggtga

SEQ ID NO: 37670 - DNA, 25 bp, Artificial Sequence
  Description of Artificial Sequence: Synthetic oligonucleotide
gccggagtattgggaccgggtgaca

SEQ ID NO: 37671 - DNA, 26 bp, Artificial Sequence
  Description of Artificial Sequence: Synthetic oligonucleotide
ccggagtattgggaccgggtgacaca

SEQ ID NO: 37672 - DNA, 27 bp, Artificial Sequence
  Description of Artificial Sequence: Synthetic oligonucleotide
cggagtattgggaccgggtgacacaga

SEQ ID NO: 37673 - DNA, 28 bp, Artificial Sequence
  Description of Artificial Sequence: Synthetic oligonucleotide
ggagtattgggaccgggtgacacagatc

SEQ ID NO: 37674 - DNA, 29 bp, Artificial Sequence
  Description of Artificial Sequence: Synthetic oligonucleotide
gagtattgggaccgggtgacacagatctc

SEQ ID NO: 37675 - DNA, 29 bp, Artificial Sequence
  Description of Artificial Sequence: Synthetic oligonucleotide
agtattgggaccgggtgacacagatctcc

SEQ ID NO: 37676 - DNA, 28 bp, Artificial Sequence
  Description of Artificial Sequence: Synthetic oligonucleotide
gtattgggaccgggtgacacagatctcc

SEQ ID NO: 37677 - DNA, 30 bp, Artificial Sequence
  Description of Artificial Sequence: Synthetic oligonucleotide
tattgggaccgggtgacacagatctccaag

SEQ ID NO: 37678 - DNA, 29 bp, Artificial Sequence
  Description of Artificial Sequence: Synthetic oligonucleotide
attgggaccgggtgacacagatctccaag

SEQ ID NO: 37679 - DNA, 28 bp, Artificial Sequence
  Description of Artificial Sequence: Synthetic oligonucleotide
ttgggaccgggtgacacagatctccaag

SEQ ID NO: 37680 - DNA, 27 bp, Artificial Sequence
  Description of Artificial Sequence: Synthetic oligonucleotide
tgggaccgggtgacacagatctccaag

SEQ ID NO: 37681 - DNA, 27 bp, Artificial Sequence
  Description of Artificial Sequence: Synthetic oligonucleotide
gggaccgggtgacacagatctccaaga

SEQ ID NO: 37682 - DNA, 27 bp, Artificial Sequence
  Description of Artificial Sequence: Synthetic oligonucleotide
ggaccgggtgacacagatctccaagac

SEQ ID NO: 37683 - DNA, 27 bp, Artificial Sequence
  Description of Artificial Sequence: Synthetic oligonucleotide
gaccgggtgacacagatctccaagacc

SEQ ID NO: 37684 - DNA, 29 bp, Artificial Sequence
  Description of Artificial Sequence: Synthetic oligonucleotide
accgggtgacacagatctccaagaccaac

SEQ ID NO: 37685 - DNA, 28 bp, Artificial Sequence
  Description of Artificial Sequence: Synthetic oligonucleotide
ccgggtgacacagatctccaagaccaac

SEQ ID NO: 37686 - DNA, 29 bp, Artificial Sequence
  Description of Artificial Sequence: Synthetic oligonucleotide
cgggtgacacagatctccaagaccaacac

SEQ ID NO: 37687 - DNA, 30 bp, Artificial Sequence
  Description of Artificial Sequence: Synthetic oligonucleotide
gggtgacacagatctccaagaccaacacac

SEQ ID NO: 37688 - DNA, 31 bp, Artificial Sequence
  Description of Artificial Sequence: Synthetic oligonucleotide
ggtgacacagatctccaagaccaacacacag

SEQ ID NO: 37689 - DNA, 32 bp, Artificial Sequence
  Description of Artificial Sequence: Synthetic oligonucleotide
gtgacacagatctccaagaccaacacacagac

SEQ ID NO: 37690 - DNA, 35 bp, Artificial Sequence
  Description of Artificial Sequence: Synthetic oligonucleotide
tgacacagatctccaagaccaacacacagacttac

SEQ ID NO: 37691 - DNA, 21 bp, Artificial Sequence
  Description of Artificial Sequence: Synthetic oligonucleotide
gagccgcgggcgccgtgcata

SEQ ID NO: 37692 - DNA, 22 bp, Artificial Sequence
  Description of Artificial Sequence: Synthetic oligonucleotide
agccgcgggcgccgtgcataga

SEQ ID NO: 37693 - DNA, 21 bp, Artificial Sequence
  Description of Artificial Sequence: Synthetic oligonucleotide
gccgcgggcgccgtgcataga

SEQ ID NO: 37694 - DNA, 21 bp, Artificial Sequence
  Description of Artificial Sequence: Synthetic oligonucleotide
ccgcgggcgccgtgcatagag

SEQ ID NO: 37695 - DNA, 22 bp, Artificial Sequence
  Description of Artificial Sequence: Synthetic oligonucleotide
cgcgggcgccgtgcatagagca

SEQ ID NO: 37696 - DNA, 22 bp, Artificial Sequence
  Description of Artificial Sequence: Synthetic oligonucleotide
gcgggcgccgtgcatagagcag

SEQ ID NO: 37697 - DNA, 23 bp, Artificial Sequence
  Description of Artificial Sequence: Synthetic oligonucleotide
cgggcgccgtgcatagagcagga

SEQ ID NO: 37698 - DNA, 23 bp, Artificial Sequence
  Description of Artificial Sequence: Synthetic oligonucleotide
gggcgccgtgcatagagcaggag

SEQ ID NO: 37699 - DNA, 23 bp, Artificial Sequence
  Description of Artificial Sequence: Synthetic oligonucleotide
ggcgccgtgcatagagcaggagg

SEQ ID NO: 37700 - DNA, 23 bp, Artificial Sequence
  Description of Artificial Sequence: Synthetic oligonucleotide
gcgccgtgcatagagcaggaggg

SEQ ID NO: 37701 - DNA, 23 bp, Artificial Sequence
  Description of Artificial Sequence: Synthetic oligonucleotide
cgccgtgcatagagcaggagggg

SEQ ID NO: 37702 - DNA, 23 bp, Artificial Sequence
  Description of Artificial Sequence: Synthetic oligonucleotide
gccgtgcatagagcaggaggggc

SEQ ID NO: 37703 - DNA, 23 bp, Artificial Sequence
  Description of Artificial Sequence: Synthetic oligonucleotide
ccgtgcatagagcaggaggggcc

SEQ ID NO: 37704 - DNA, 23 bp, Artificial Sequence
  Description of Artificial Sequence: Synthetic oligonucleotide
cgtgcatagagcaggaggggccg

SEQ ID NO: 37705 - DNA, 24 bp, Artificial Sequence
  Description of Artificial Sequence: Synthetic oligonucleotide
gtgcatagagcaggaggggccgga

SEQ ID NO: 37706 - DNA, 27 bp, Artificial Sequence
  Description of Artificial Sequence: Synthetic oligonucleotide
tgcatagagcaggaggggccggagtat

SEQ ID NO: 37707 - DNA, 27 bp, Artificial Sequence
  Description of Artificial Sequence: Synthetic oligonucleotide
gcatagagcaggaggggccggagtatt

SEQ ID NO: 37708 - DNA, 27 bp, Artificial Sequence
  Description of Artificial Sequence: Synthetic oligonucleotide
catagagcaggaggggccggagtattg

SEQ ID NO: 37709 - DNA, 21 bp, Artificial Sequence
  Description of Artificial Sequence: Synthetic oligonucleotide
gcggcccgtgaagcggagcag

SEQ ID NO: 37710 - DNA, 22 bp, Artificial Sequence
  Description of Artificial Sequence: Synthetic oligonucleotide
cggcccgtgaagcggagcagct

SEQ ID NO: 37711 - DNA, 23 bp, Artificial Sequence
  Description of Artificial Sequence: Synthetic oligonucleotide
ggcccgtgaagcggagcagctga

SEQ ID NO: 37712 - DNA, 24 bp, Artificial Sequence
  Description of Artificial Sequence: Synthetic oligonucleotide
gcccgtgaagcggagcagctgaga

SEQ ID NO: 37713 - DNA, 24 bp, Artificial Sequence
  Description of Artificial Sequence: Synthetic oligonucleotide
cccgtgaagcggagcagctgagag

SEQ ID NO: 37714 - DNA, 24 bp, Artificial Sequence
  Description of Artificial Sequence: Synthetic oligonucleotide
ccgtgaagcggagcagctgagagc

SEQ ID NO: 37715 - DNA, 26 bp, Artificial Sequence
  Description of Artificial Sequence: Synthetic oligonucleotide
cgtgaagcggagcagctgagagccta

SEQ ID NO: 37716 - DNA, 26 bp, Artificial Sequence
  Description of Artificial Sequence: Synthetic oligonucleotide
gtgaagcggagcagctgagagcctac

SEQ ID NO: 37717 - DNA, 27 bp, Artificial Sequence
  Description of Artificial Sequence: Synthetic oligonucleotide
tgaagcggagcagctgagagcctacct

SEQ ID NO: 37718 - DNA, 26 bp, Artificial Sequence
  Description of Artificial Sequence: Synthetic oligonucleotide
gaagcggagcagctgagagcctacct

SEQ ID NO: 37719 - DNA, 26 bp, Artificial Sequence
  Description of Artificial Sequence: Synthetic oligonucleotide
aagcggagcagctgagagcctacctg

SEQ ID NO: 37720 - DNA, 25 bp, Artificial Sequence
  Description of Artificial Sequence: Synthetic oligonucleotide
agcggagcagctgagagcctacctg

SEQ ID NO: 37721 - DNA, 30 bp, Artificial Sequence
  Description of Artificial Sequence: Synthetic oligonucleotide
gacggcaaggattacatcgccctgaacaag

SEQ ID NO: 37722 - DNA, 30 bp, Artificial Sequence
  Description of Artificial Sequence: Synthetic oligonucleotide
acggcaaggattacatcgccctgaacaagg

SEQ ID NO: 37723 - DNA, 29 bp, Artificial Sequence
  Description of Artificial Sequence: Synthetic oligonucleotide
cggcaaggattacatcgccctgaacaagg

SEQ ID NO: 37724 - DNA, 30 bp, Artificial Sequence
  Description of Artificial Sequence: Synthetic oligonucleotide
ggcaaggattacatcgccctgaacaaggac

SEQ ID NO: 37725 - DNA, 30 bp, Artificial Sequence
  Description of Artificial Sequence: Synthetic oligonucleotide
gcaaggattacatcgccctgaacaaggacc

SEQ ID NO: 37726 - DNA, 31 bp, Artificial Sequence
  Description of Artificial Sequence: Synthetic oligonucleotide
caaggattacatcgccctgaacaaggacctg

SEQ ID NO: 37727 - DNA, 32 bp, Artificial Sequence
  Description of Artificial Sequence: Synthetic oligonucleotide
aaggattacatcgccctgaacaaggacctgag

SEQ ID NO: 37728 - DNA, 31 bp, Artificial Sequence
  Description of Artificial Sequence: Synthetic oligonucleotide
aggattacatcgccctgaacaaggacctgag

SEQ ID NO: 37729 - DNA, 30 bp, Artificial Sequence
  Description of Artificial Sequence: Synthetic oligonucleotide
ggattacatcgccctgaacaaggacctgag

SEQ ID NO: 37730 - DNA, 30 bp, Artificial Sequence
  Description of Artificial Sequence: Synthetic oligonucleotide
gattacatcgccctgaacaaggacctgagc

SEQ ID NO: 37731 - DNA, 31 bp, Artificial Sequence
  Description of Artificial Sequence: Synthetic oligonucleotide
attacatcgccctgaacaaggacctgagctc

SEQ ID NO: 37732 - DNA, 30 bp, Artificial Sequence
  Description of Artificial Sequence: Synthetic oligonucleotide
ttacatcgccctgaacaaggacctgagctc

SEQ ID NO: 37733 - DNA, 29 bp, Artificial Sequence
  Description of Artificial Sequence: Synthetic oligonucleotide
tacatcgccctgaacaaggacctgagctc

SEQ ID NO: 37734 - DNA, 28 bp, Artificial Sequence
  Description of Artificial Sequence: Synthetic oligonucleotide
acatcgccctgaacaaggacctgagctc

SEQ ID NO: 37735 - DNA, 27 bp, Artificial Sequence
  Description of Artificial Sequence: Synthetic oligonucleotide
catcgccctgaacaaggacctgagctc

SEQ ID NO: 37736 - DNA, 27 bp, Artificial Sequence
  Description of Artificial Sequence: Synthetic oligonucleotide
atcgccctgaacaaggacctgagctcc

SEQ ID NO: 37737 - DNA, 27 bp, Artificial Sequence
  Description of Artificial Sequence: Synthetic oligonucleotide
tcgccctgaacaaggacctgagctcct

SEQ ID NO: 37738 - DNA, 26 bp, Artificial Sequence
  Description of Artificial Sequence: Synthetic oligonucleotide
cgccctgaacaaggacctgagctcct

SEQ ID NO: 37739 - DNA, 26 bp, Artificial Sequence
  Description of Artificial Sequence: Synthetic oligonucleotide
gccctgaacaaggacctgagctcctg

SEQ ID NO: 37740 - DNA, 27 bp, Artificial Sequence
  Description of Artificial Sequence: Synthetic oligonucleotide
ccctgaacaaggacctgagctcctgga

SEQ ID NO: 37741 - DNA, 27 bp, Artificial Sequence
  Description of Artificial Sequence: Synthetic oligonucleotide
cctgaacaaggacctgagctcctggac

SEQ ID NO: 37742 - DNA, 27 bp, Artificial Sequence
  Description of Artificial Sequence: Synthetic oligonucleotide
ctgaacaaggacctgagctcctggacc

SEQ ID NO: 37743 - DNA, 27 bp, Artificial Sequence
  Description of Artificial Sequence: Synthetic oligonucleotide
tgaacaaggacctgagctcctggaccg

SEQ ID NO: 37744 - DNA, 26 bp, Artificial Sequence
  Description of Artificial Sequence: Synthetic oligonucleotide
gaacaaggacctgagctcctggaccg

SEQ ID NO: 37745 - DNA, 26 bp, Artificial Sequence
  Description of Artificial Sequence: Synthetic oligonucleotide
aacaaggacctgagctcctggaccgc

SEQ ID NO: 37746 - DNA, 25 bp, Artificial Sequence
  Description of Artificial Sequence: Synthetic oligonucleotide
acaaggacctgagctcctggaccgc

SEQ ID NO: 37747 - DNA, 24 bp, Artificial Sequence
  Description of Artificial Sequence: Synthetic oligonucleotide
caaggacctgagctcctggaccgc

SEQ ID NO: 37748 - DNA, 24 bp, Artificial Sequence
  Description of Artificial Sequence: Synthetic oligonucleotide
aaggacctgagctcctggaccgcg

SEQ ID NO: 37749 - DNA, 30 bp, Artificial Sequence
  Description of Artificial Sequence: Synthetic oligonucleotide
acacttggcagaggatgtatggctgcgatc

SEQ ID NO: 37750 - DNA, 29 bp, Artificial Sequence
  Description of Artificial Sequence: Synthetic oligonucleotide
cacttggcagaggatgtatggctgcgatc

SEQ ID NO: 37751 - DNA, 30 bp, Artificial Sequence
  Description of Artificial Sequence: Synthetic oligonucleotide
acttggcagaggatgtatggctgcgatctg

SEQ ID NO: 37752 - DNA, 29 bp, Artificial Sequence
  Description of Artificial Sequence: Synthetic oligonucleotide
cttggcagaggatgtatggctgcgatctg

SEQ ID NO: 37753 - DNA, 29 bp, Artificial Sequence
  Description of Artificial Sequence: Synthetic oligonucleotide
ttggcagaggatgtatggctgcgatctgg

SEQ ID NO: 37754 - DNA, 28 bp, Artificial Sequence
  Description of Artificial Sequence: Synthetic oligonucleotide
tggcagaggatgtatggctgcgatctgg

SEQ ID NO: 37755 - DNA, 27 bp, Artificial Sequence
  Description of Artificial Sequence: Synthetic oligonucleotide
ggcagaggatgtatggctgcgatctgg

SEQ ID NO: 37756 - DNA, 27 bp, Artificial Sequence
  Description of Artificial Sequence: Synthetic oligonucleotide
gcagaggatgtatggctgcgatctggg

SEQ ID NO: 37757 - DNA, 27 bp, Artificial Sequence
  Description of Artificial Sequence: Synthetic oligonucleotide
cagaggatgtatggctgcgatctgggg

SEQ ID NO: 37758 - DNA, 27 bp, Artificial Sequence
  Description of Artificial Sequence: Synthetic oligonucleotide
agaggatgtatggctgcgatctggggc

SEQ ID NO: 37759 - DNA, 26 bp, Artificial Sequence
  Description of Artificial Sequence: Synthetic oligonucleotide
gaggatgtatggctgcgatctggggc

SEQ ID NO: 37760 - DNA, 26 bp, Artificial Sequence
  Description of Artificial Sequence: Synthetic oligonucleotide
aggatgtatggctgcgatctggggcc

SEQ ID NO: 37761 - DNA, 25 bp, Artificial Sequence
  Description of Artificial Sequence: Synthetic oligonucleotide
ggatgtatggctgcgatctggggcc

SEQ ID NO: 37762 - DNA, 25 bp, Artificial Sequence
  Description of Artificial Sequence: Synthetic oligonucleotide
gatgtatggctgcgatctggggccc

SEQ ID NO: 37763 - DNA, 26 bp, Artificial Sequence
  Description of Artificial Sequence: Synthetic oligonucleotide
atgtatggctgcgatctggggcccga

SEQ ID NO: 37764 - DNA, 25 bp, Artificial Sequence
  Description of Artificial Sequence: Synthetic oligonucleotide
tgtatggctgcgatctggggcccga

SEQ ID NO: 37765 - DNA, 24 bp, Artificial Sequence
  Description of Artificial Sequence: Synthetic oligonucleotide
gtatggctgcgatctggggcccga

SEQ ID NO: 37766 - DNA, 24 bp, Artificial Sequence
  Description of Artificial Sequence: Synthetic oligonucleotide
tatggctgcgatctggggcccgac

SEQ ID NO: 37767 - DNA, 23 bp, Artificial Sequence
  Description of Artificial Sequence: Synthetic oligonucleotide
atggctgcgatctggggcccgac

SEQ ID NO: 37768 - DNA, 22 bp, Artificial Sequence
  Description of Artificial Sequence: Synthetic oligonucleotide
tggctgcgatctggggcccgac

SEQ ID NO: 37769 - DNA, 21 bp, Artificial Sequence
  Description of Artificial Sequence: Synthetic oligonucleotide
ggctgcgatctggggcccgac

SEQ ID NO: 37770 - DNA, 21 bp, Artificial Sequence
  Description of Artificial Sequence: Synthetic oligonucleotide
gctgcgatctggggcccgacg

SEQ ID NO: 37771 - DNA, 21 bp, Artificial Sequence
  Description of Artificial Sequence: Synthetic oligonucleotide
ctgcgatctggggcccgacgg

SEQ ID NO: 37772 - DNA, 21 bp, Artificial Sequence
  Description of Artificial Sequence: Synthetic oligonucleotide
tgcgatctggggcccgacggg

SEQ ID NO: 37773 - DNA, 20 bp, Artificial Sequence
  Description of Artificial Sequence: Synthetic oligonucleotide
gcgatctggggcccgacggg

SEQ ID NO: 37774 - DNA, 20 bp, Artificial Sequence
  Description of Artificial Sequence: Synthetic oligonucleotide
cgatctggggcccgacgggc

SEQ ID NO: 37775 - DNA, 20 bp, Artificial Sequence
  Description of Artificial Sequence: Synthetic oligonucleotide
gatctggggcccgacgggcg

SEQ ID NO: 37776 - DNA, 20 bp, Artificial Sequence
  Description of Artificial Sequence: Synthetic oligonucleotide
atctggggcccgacgggcgc

SEQ ID NO: 37777 - DNA, 20 bp, Artificial Sequence
  Description of Artificial Sequence: Synthetic oligonucleotide
tctggggcccgacgggcgct

SEQ ID NO: 37778 - DNA, 27 bp, Artificial Sequence
  Description of Artificial Sequence: Synthetic oligonucleotide
gctgttcgtgaggttcgacagcgacgt

SEQ ID NO: 37779 - DNA, 27 bp, Artificial Sequence
  Description of Artificial Sequence: Synthetic oligonucleotide
ctgttcgtgaggttcgacagcgacgtc

SEQ ID NO: 37780 - DNA, 28 bp, Artificial Sequence
  Description of Artificial Sequence: Synthetic oligonucleotide
tgttcgtgaggttcgacagcgacgtcac

SEQ ID NO: 37781 - DNA, 27 bp, Artificial Sequence
  Description of Artificial Sequence: Synthetic oligonucleotide
gttcgtgaggttcgacagcgacgtcac

SEQ ID NO: 37782 - DNA, 27 bp, Artificial Sequence
  Description of Artificial Sequence: Synthetic oligonucleotide
ttcgtgaggttcgacagcgacgtcacg

SEQ ID NO: 37783 - DNA, 27 bp, Artificial Sequence
  Description of Artificial Sequence: Synthetic oligonucleotide
tcgtgaggttcgacagcgacgtcacga

SEQ ID NO: 37784 - DNA, 26 bp, Artificial Sequence
  Description of Artificial Sequence: Synthetic oligonucleotide
cgtgaggttcgacagcgacgtcacga

SEQ ID NO: 37785 - DNA, 27 bp, Artificial Sequence
  Description of Artificial Sequence: Synthetic oligonucleotide
gtgaggttcgacagcgacgtcacgagt

SEQ ID NO: 37786 - DNA, 27 bp, Artificial Sequence
  Description of Artificial Sequence: Synthetic oligonucleotide
tgaggttcgacagcgacgtcacgagtc

SEQ ID NO: 37787 - DNA, 26 bp, Artificial Sequence
  Description of Artificial Sequence: Synthetic oligonucleotide
gaggttcgacagcgacgtcacgagtc

SEQ ID NO: 37788 - DNA, 26 bp, Artificial Sequence
  Description of Artificial Sequence: Synthetic oligonucleotide
aggttcgacagcgacgtcacgagtcc

SEQ ID NO: 37789 - DNA, 25 bp, Artificial Sequence
  Description of Artificial Sequence: Synthetic oligonucleotide
ggttcgacagcgacgtcacgagtcc

SEQ ID NO: 37790 - DNA, 26 bp, Artificial Sequence
  Description of Artificial Sequence: Synthetic oligonucleotide
gttcgacagcgacgtcacgagtccga

SEQ ID NO: 37791 - DNA, 26 bp, Artificial Sequence
  Description of Artificial Sequence: Synthetic oligonucleotide
ttcgacagcgacgtcacgagtccgag

SEQ ID NO: 37792 - DNA, 25 bp, Artificial Sequence
  Description of Artificial Sequence: Synthetic oligonucleotide
tcgacagcgacgtcacgagtccgag

SEQ ID NO: 37793 - DNA, 24 bp, Artificial Sequence
  Description of Artificial Sequence: Synthetic oligonucleotide
cgacagcgacgtcacgagtccgag

SEQ ID NO: 37794 - DNA, 26 bp, Artificial Sequence
  Description of Artificial Sequence: Synthetic oligonucleotide
gacagcgacgtcacgagtccgaggaa

SEQ ID NO: 37795 - DNA, 26 bp, Artificial Sequence
  Description of Artificial Sequence: Synthetic oligonucleotide
acagcgacgtcacgagtccgaggaag

SEQ ID NO: 37796 - DNA, 25 bp, Artificial Sequence
  Description of Artificial Sequence: Synthetic oligonucleotide
cagcgacgtcacgagtccgaggaag

SEQ ID NO: 37797 - DNA, 26 bp, Artificial Sequence
  Description of Artificial Sequence: Synthetic oligonucleotide
agcgacgtcacgagtccgaggaagga

SEQ ID NO: 37798 - DNA, 25 bp, Artificial Sequence
  Description of Artificial Sequence: Synthetic oligonucleotide
gcgacgtcacgagtccgaggaagga

SEQ ID NO: 37799 - DNA, 25 bp, Artificial Sequence
  Description of Artificial Sequence: Synthetic oligonucleotide
cgacgtcacgagtccgaggaaggag

SEQ ID NO: 37800 - DNA, 25 bp, Artificial Sequence
  Description of Artificial Sequence: Synthetic oligonucleotide
gacgtcacgagtccgaggaaggagc

SEQ ID NO: 37801 - DNA, 25 bp, Artificial Sequence
  Description of Artificial Sequence: Synthetic oligonucleotide
acgtcacgagtccgaggaaggagcc

SEQ ID NO: 37802 - DNA, 24 bp, Artificial Sequence
  Description of Artificial Sequence: Synthetic oligonucleotide
cgtcacgagtccgaggaaggagcc

SEQ ID NO: 37803 - DNA, 24 bp, Artificial Sequence
  Description of Artificial Sequence: Synthetic oligonucleotide
gtcacgagtccgaggaaggagccg

SEQ ID NO: 37804 - DNA, 24 bp, Artificial Sequence
  Description of Artificial Sequence: Synthetic oligonucleotide
tcacgagtccgaggaaggagccgc

SEQ ID NO: 37805 - DNA, 24 bp, Artificial Sequence
  Description of Artificial Sequence: Synthetic oligonucleotide
acagcgacgccacgagtccgagga

SEQ ID NO: 37806 - DNA, 23 bp, Artificial Sequence
  Description of Artificial Sequence: Synthetic oligonucleotide
cagcgacgccacgagtccgagga

SEQ ID NO: 37807 - DNA, 23 bp, Artificial Sequence
  Description of Artificial Sequence: Synthetic oligonucleotide
agcgacgccacgagtccgaggag

SEQ ID NO: 37808 - DNA, 22 bp, Artificial Sequence
  Description of Artificial Sequence: Synthetic oligonucleotide
gcgacgccacgagtccgaggag

SEQ ID NO: 37809 - DNA, 22 bp, Artificial Sequence
  Description of Artificial Sequence: Synthetic oligonucleotide
cgacgccacgagtccgaggagg

SEQ ID NO: 37810 - DNA, 23 bp, Artificial Sequence
  Description of Artificial Sequence: Synthetic oligonucleotide
gacgccacgagtccgaggaggga

SEQ ID NO: 37811 - DNA, 23 bp, Artificial Sequence
  Description of Artificial Sequence: Synthetic oligonucleotide
acgccacgagtccgaggagggag

SEQ ID NO: 37812 - DNA, 22 bp, Artificial Sequence
  Description of Artificial Sequence: Synthetic oligonucleotide
cgccacgagtccgaggagggag

SEQ ID NO: 37813 - DNA, 22 bp, Artificial Sequence
  Description of Artificial Sequence: Synthetic oligonucleotide
gccacgagtccgaggagggagc

SEQ ID NO: 37814 - DNA, 22 bp, Artificial Sequence
  Description of Artificial Sequence: Synthetic oligonucleotide
ccacgagtccgaggagggagcc

SEQ ID NO: 37815 - DNA, 22 bp, Artificial Sequence
  Description of Artificial Sequence: Synthetic oligonucleotide
cacgagtccgaggagggagccg

SEQ ID NO: 37816 - DNA, 22 bp, Artificial Sequence
  Description of Artificial Sequence: Synthetic oligonucleotide
acgagtccgaggagggagccgc

SEQ ID NO: 37817 - DNA, 21 bp, Artificial Sequence
  Description of Artificial Sequence: Synthetic oligonucleotide
cgagtccgaggagggagccgc

SEQ ID NO: 37818 - DNA, 21 bp, Artificial Sequence
  Description of Artificial Sequence: Synthetic oligonucleotide
gagtccgaggagggagccgcg

SEQ ID NO: 37819 - DNA, 21 bp, Artificial Sequence
  Description of Artificial Sequence: Synthetic oligonucleotide
agtccgaggagggagccgcgg

SEQ ID NO: 37820 - DNA, 20 bp, Artificial Sequence
  Description of Artificial Sequence: Synthetic oligonucleotide
gtccgaggagggagccgcgg

SEQ ID NO: 37821 - DNA, 20 bp, Artificial Sequence
  Description of Artificial Sequence: Synthetic oligonucleotide
tccgaggagggagccgcggg

SEQ ID NO: 37822 - DNA, 20 bp, Artificial Sequence
  Description of Artificial Sequence: Synthetic oligonucleotide
ccgaggagggagccgcgggt

SEQ ID NO: 37823 - DNA, 20 bp, Artificial Sequence
  Description of Artificial Sequence: Synthetic oligonucleotide
cgaggagggagccgcgggct

SEQ ID NO: 37824 - DNA, 20 bp, Artificial Sequence
  Description of Artificial Sequence: Synthetic oligonucleotide
gaggagggagccgcgggcgt

SEQ ID NO: 37825 - DNA, 20 bp, Artificial Sequence
  Description of Artificial Sequence: Synthetic oligonucleotide
aggagggagccgcgggcgct

SEQ ID NO: 37826 - DNA, 20 bp, Artificial Sequence
  Description of Artificial Sequence: Synthetic oligonucleotide
ggagggagccgcgggcgctt

SEQ ID NO: 37827 - DNA, 20 bp, Artificial Sequence
  Description of Artificial Sequence: Synthetic oligonucleotide
gagggagccgcgggcgccat

SEQ ID NO: 37828 - DNA, 20 bp, Artificial Sequence
  Description of Artificial Sequence: Synthetic oligonucleotide
agggagccgcgggcgccatg

SEQ ID NO: 37829 - DNA, 20 bp, Artificial Sequence
  Description of Artificial Sequence: Synthetic oligonucleotide
gggagccgcgggcgccatgt

SEQ ID NO: 37830 - DNA, 28 bp, Artificial Sequence
  Description of Artificial Sequence: Synthetic oligonucleotide
gagtggctccgcagatacctggagaaag

SEQ ID NO: 37831 - DNA, 28 bp, Artificial Sequence
  Description of Artificial Sequence: Synthetic oligonucleotide
agtggctccgcagatacctggagaaagg

SEQ ID NO: 37832 - DNA, 27 bp, Artificial Sequence
  Description of Artificial Sequence: Synthetic oligonucleotide
gtggctccgcagatacctggagaaagg

SEQ ID NO: 37833 - DNA, 27 bp, Artificial Sequence
  Description of Artificial Sequence: Synthetic oligonucleotide
tggctccgcagatacctggagaaaggg

SEQ ID NO: 37834 - DNA, 27 bp, Artificial Sequence
  Description of Artificial Sequence: Synthetic oligonucleotide
ggctccgcagatacctggagaaaggga

SEQ ID NO: 37835 - DNA, 28 bp, Artificial Sequence
  Description of Artificial Sequence: Synthetic oligonucleotide
gctccgcagatacctggagaaagggaag

SEQ ID NO: 37836 - DNA, 28 bp, Artificial Sequence
  Description of Artificial Sequence: Synthetic oligonucleotide
ctccgcagatacctggagaaagggaagg

SEQ ID NO: 37837 - DNA, 29 bp, Artificial Sequence
  Description of Artificial Sequence: Synthetic oligonucleotide
tccgcagatacctggagaaagggaaggag

SEQ ID NO: 37838 - DNA, 28 bp, Artificial Sequence
  Description of Artificial Sequence: Synthetic oligonucleotide
ccgcagatacctggagaaagggaaggag

SEQ ID NO: 37839 - DNA, 29 bp, Artificial Sequence
  Description of Artificial Sequence: Synthetic oligonucleotide
cgcagatacctggagaaagggaaggagac

SEQ ID NO: 37840 - DNA, 29 bp, Artificial Sequence
  Description of Artificial Sequence: Synthetic oligonucleotide
gcagatacctggagaaagggaaggagacg

SEQ ID NO: 37841 - DNA, 29 bp, Artificial Sequence
  Description of Artificial Sequence: Synthetic oligonucleotide
cagatacctggagaaagggaaggagacgc

SEQ ID NO: 37842 - DNA, 30 bp, Artificial Sequence
  Description of Artificial Sequence: Synthetic oligonucleotide
agatacctggagaaagggaaggagacgctg

SEQ ID NO: 37843 - DNA, 29 bp, Artificial Sequence
  Description of Artificial Sequence: Synthetic oligonucleotide
gatacctggagaaagggaaggagacgctg

SEQ ID NO: 37844 - DNA, 29 bp, Artificial Sequence
  Description of Artificial Sequence: Synthetic oligonucleotide
atacctggagaaagggaaggagacgctgc

SEQ ID NO: 37845 - DNA, 28 bp, Artificial Sequence
  Description of Artificial Sequence: Synthetic oligonucleotide
tacctggagaaagggaaggagacgctgc

SEQ ID NO: 37846 - DNA, 27 bp, Artificial Sequence
  Description of Artificial Sequence: Synthetic oligonucleotide
acctggagaaagggaaggagacgctgc

SEQ ID NO: 37847 - DNA, 27 bp, Artificial Sequence
  Description of Artificial Sequence: Synthetic oligonucleotide
cctggagaaagggaaggagacgctgca

SEQ ID NO: 37848 - DNA, 27 bp, Artificial Sequence
  Description of Artificial Sequence: Synthetic oligonucleotide
ctggagaaagggaaggagacgctgcag

SEQ ID NO: 37849 - DNA, 27 bp, Artificial Sequence
  Description of Artificial Sequence: Synthetic oligonucleotide
tggagaaagggaaggagacgctgcagc

SEQ ID NO: 37850 - DNA, 26 bp, Artificial Sequence
  Description of Artificial Sequence: Synthetic oligonucleotide
ggagaaagggaaggagacgctgcagc

SEQ ID NO: 37851 - DNA, 26 bp, Artificial Sequence
  Description of Artificial Sequence: Synthetic oligonucleotide
gagaaagggaaggagacgctgcagcg

SEQ ID NO: 37852 - DNA, 26 bp, Artificial Sequence
  Description of Artificial Sequence: Synthetic oligonucleotide
agaaagggaaggagacgctgcagcgc

SEQ ID NO: 37853 - DNA, 25 bp, Artificial Sequence
  Description of Artificial Sequence: Synthetic oligonucleotide
gaaagggaaggagacgctgcagcgc

SEQ ID NO: 37854 - DNA, 25 bp, Artificial Sequence
  Description of Artificial Sequence: Synthetic oligonucleotide
aaagggaaggagacgctgcagcgcg

SEQ ID NO: 37855 - DNA, 24 bp, Artificial Sequence
  Description of Artificial Sequence: Synthetic oligonucleotide
aagggaaggagacgctgcagcgcg

SEQ ID NO: 37856 - DNA, 23 bp, Artificial Sequence
  Description of Artificial Sequence: Synthetic oligonucleotide
agggaaggagacgctgcagcgcg

SEQ ID NO: 37857 - DNA, 27 bp, Artificial Sequence
  Description of Artificial Sequence: Synthetic oligonucleotide
caaagacacatgtgacccaccaccccg

SEQ ID NO: 37858 - DNA, 28 bp, Artificial Sequence
  Description of Artificial Sequence: Synthetic oligonucleotide
aaagacacatgtgacccaccaccccgtc

SEQ ID NO: 37859 - DNA, 27 bp, Artificial Sequence
  Description of Artificial Sequence: Synthetic oligonucleotide
aagacacatgtgacccaccaccccgtc

SEQ ID NO: 37860 - DNA, 27 bp, Artificial Sequence
  Description of Artificial Sequence: Synthetic oligonucleotide
agacacatgtgacccaccaccccgtct

SEQ ID NO: 37861 - DNA, 26 bp, Artificial Sequence
  Description of Artificial Sequence: Synthetic oligonucleotide
gacacatgtgacccaccaccccgtct

SEQ ID NO: 37862 - DNA, 27 bp, Artificial Sequence
  Description of Artificial Sequence: Synthetic oligonucleotide
acacatgtgacccaccaccccgtctct

SEQ ID NO: 37863 - DNA, 26 bp, Artificial Sequence
  Description of Artificial Sequence: Synthetic oligonucleotide
cacatgtgacccaccaccccgtctct

SEQ ID NO: 37864 - DNA, 27 bp, Artificial Sequence
  Description of Artificial Sequence: Synthetic oligonucleotide
acatgtgacccaccaccccgtctctga

SEQ ID NO: 37865 - DNA, 26 bp, Artificial Sequence
  Description of Artificial Sequence: Synthetic oligonucleotide
catgtgacccaccaccccgtctctga

SEQ ID NO: 37866 - DNA, 26 bp, Artificial Sequence
  Description of Artificial Sequence: Synthetic oligonucleotide
atgtgacccaccaccccgtctctgac

SEQ ID NO: 37867 - DNA, 25 bp, Artificial Sequence
  Description of Artificial Sequence: Synthetic oligonucleotide
tgtgacccaccaccccgtctctgac

SEQ ID NO: 37868 - DNA, 36 bp, Artificial Sequence
  Description of Artificial Sequence: Synthetic oligonucleotide
tattgggaccggaacacacagatcttcaagactaac

SEQ ID NO: 37869 - DNA, 35 bp, Artificial Sequence
  Description of Artificial Sequence: Synthetic oligonucleotide
attgggaccggaacacacagatcttcaagactaac

SEQ ID NO: 37870 - DNA, 34 bp, Artificial Sequence
  Description of Artificial Sequence: Synthetic oligonucleotide
ttgggaccggaacacacagatcttcaagactaac

SEQ ID NO: 37871 - DNA, 33 bp, Artificial Sequence
  Description of Artificial Sequence: Synthetic oligonucleotide
tgggaccggaacacacagatcttcaagactaac

SEQ ID NO: 37872 - DNA, 32 bp, Artificial Sequence
  Description of Artificial Sequence: Synthetic oligonucleotide
gggaccggaacacacagatcttcaagactaac

SEQ ID NO: 37873 - DNA, 33 bp, Artificial Sequence
  Description of Artificial Sequence: Synthetic oligonucleotide
ggaccggaacacacagatcttcaagactaacac

SEQ ID NO: 37874 - DNA, 34 bp, Artificial Sequence
  Description of Artificial Sequence: Synthetic oligonucleotide
gaccggaacacacagatcttcaagactaacacac

SEQ ID NO: 37875 - DNA, 35 bp, Artificial Sequence
  Description of Artificial Sequence: Synthetic oligonucleotide
accggaacacacagatcttcaagactaacacacag

SEQ ID NO: 37876 - DNA, 34 bp, Artificial Sequence
  Description of Artificial Sequence: Synthetic oligonucleotide
ccggaacacacagatcttcaagactaacacacag

SEQ ID NO: 37877 - DNA, 35 bp, Artificial Sequence
  Description of Artificial Sequence: Synthetic oligonucleotide
cggaacacacagatcttcaagactaacacacagac

SEQ ID NO: 37878 - DNA, 38 bp, Artificial Sequence
  Description of Artificial Sequence: Synthetic oligonucleotide
ggaacacacagatcttcaagactaacacacagacttac

SEQ ID NO: 37879 - DNA, 38 bp, Artificial Sequence
  Description of Artificial Sequence: Synthetic oligonucleotide
gaacacacagatcttcaagactaacacacagacttacc

SEQ ID NO: 37880 - DNA, 38 bp, Artificial Sequence
  Description of Artificial Sequence: Synthetic oligonucleotide
aacacacagatcttcaagactaacacacagacttaccg

SEQ ID NO: 37881 - DNA, 37 bp, Artificial Sequence
  Description of Artificial Sequence: Synthetic oligonucleotide
acacacagatcttcaagactaacacacagacttaccg

SEQ ID NO: 37882 - DNA, 36 bp, Artificial Sequence
  Description of Artificial Sequence: Synthetic oligonucleotide
cacacagatcttcaagactaacacacagacttaccg

SEQ ID NO: 37883 - DNA, 37 bp, Artificial Sequence
  Description of Artificial Sequence: Synthetic oligonucleotide
acacagatcttcaagactaacacacagacttaccgag

SEQ ID NO: 37884 - DNA, 36 bp, Artificial Sequence
  Description of Artificial Sequence: Synthetic oligonucleotide
cacagatcttcaagactaacacacagacttaccgag

SEQ ID NO: 37885 - DNA, 37 bp, Artificial Sequence
  Description of Artificial Sequence: Synthetic oligonucleotide
acagatcttcaagactaacacacagacttaccgagag

SEQ ID NO: 37886 - DNA, 36 bp, Artificial Sequence
  Description of Artificial Sequence: Synthetic oligonucleotide
cagatcttcaagactaacacacagacttaccgagag

SEQ ID NO: 37887 - DNA, 38 bp, Artificial Sequence
  Description of Artificial Sequence: Synthetic oligonucleotide
agatcttcaagactaacacacagacttaccgagagaac

SEQ ID NO: 37888 - DNA, 37 bp, Artificial Sequence
  Description of Artificial Sequence: Synthetic oligonucleotide
gatcttcaagactaacacacagacttaccgagagaac

SEQ ID NO: 37889 - DNA, 37 bp, Artificial Sequence
  Description of Artificial Sequence: Synthetic oligonucleotide
atcttcaagactaacacacagacttaccgagagaacc

SEQ ID NO: 37890 - DNA, 36 bp, Artificial Sequence
  Description of Artificial Sequence: Synthetic oligonucleotide
tcttcaagactaacacacagacttaccgagagaacc

SEQ ID NO: 37891 - DNA, 35 bp, Artificial Sequence
  Description of Artificial Sequence: Synthetic oligonucleotide
cttcaagactaacacacagacttaccgagagaacc

SEQ ID NO: 37892 - DNA, 36 bp, Artificial Sequence
  Description of Artificial Sequence: Synthetic oligonucleotide
ttcaagactaacacacagacttaccgagagaacctg

SEQ ID NO: 37893 - DNA, 35 bp, Artificial Sequence
  Description of Artificial Sequence: Synthetic oligonucleotide
tcaagactaacacacagacttaccgagagaacctg

SEQ ID NO: 37894 - DNA, 34 bp, Artificial Sequence
  Description of Artificial Sequence: Synthetic oligonucleotide
caagactaacacacagacttaccgagagaacctg

SEQ ID NO: 37895 - DNA, 34 bp, Artificial Sequence
  Description of Artificial Sequence: Synthetic oligonucleotide
aagactaacacacagacttaccgagagaacctgc

SEQ ID NO: 37896 - DNA, 33 bp, Artificial Sequence
  Description of Artificial Sequence: Synthetic oligonucleotide
agactaacacacagacttaccgagagaacctgc

SEQ ID NO: 37897 - DNA, 32 bp, Artificial Sequence
  Description of Artificial Sequence: Synthetic oligonucleotide
gactaacacacagacttaccgagagaacctgc

SEQ ID NO: 37898 - DNA, 32 bp, Artificial Sequence
  Description of Artificial Sequence: Synthetic oligonucleotide
actaacacacagacttaccgagagaacctgcg

SEQ ID NO: 37899 - DNA, 31 bp, Artificial Sequence
  Description of Artificial Sequence: Synthetic oligonucleotide
ctaacacacagacttaccgagagaacctgcg

SEQ ID NO: 37900 - DNA, 31 bp, Artificial Sequence
  Description of Artificial Sequence: Synthetic oligonucleotide
taacacacagacttaccgagagaacctgcgg

SEQ ID NO: 37901 - DNA, 36 bp, Artificial Sequence
  Description of Artificial Sequence: Synthetic oligonucleotide
aagagcagagatacacatgccatgtacagcatgaag

SEQ ID NO: 37902 - DNA, 35 bp, Artificial Sequence
  Description of Artificial Sequence: Synthetic oligonucleotide
agagcagagatacacatgccatgtacagcatgaag

SEQ ID NO: 37903 - DNA, 34 bp, Artificial Sequence
  Description of Artificial Sequence: Synthetic oligonucleotide
gagcagagatacacatgccatgtacagcatgaag

SEQ ID NO: 37904 - DNA, 34 bp, Artificial Sequence
  Description of Artificial Sequence: Synthetic oligonucleotide
agcagagatacacatgccatgtacagcatgaagg

SEQ ID NO: 37905 - DNA, 33 bp, Artificial Sequence
  Description of Artificial Sequence: Synthetic oligonucleotide
gcagagatacacatgccatgtacagcatgaagg

SEQ ID NO: 37906 - DNA, 33 bp, Artificial Sequence
  Description of Artificial Sequence: Synthetic oligonucleotide
cagagatacacatgccatgtacagcatgaaggg

SEQ ID NO: 37907 - DNA, 33 bp, Artificial Sequence
  Description of Artificial Sequence: Synthetic oligonucleotide
agagatacacatgccatgtacagcatgaagggc

SEQ ID NO: 37908 - DNA, 32 bp, Artificial Sequence
  Description of Artificial Sequence: Synthetic oligonucleotide
gagatacacatgccatgtacagcatgaagggc

SEQ ID NO: 37909 - DNA, 33 bp, Artificial Sequence
  Description of Artificial Sequence: Synthetic oligonucleotide
agatacacatgccatgtacagcatgaagggctg

SEQ ID NO: 37910 - DNA, 32 bp, Artificial Sequence
  Description of Artificial Sequence: Synthetic oligonucleotide
gatacacatgccatgtacagcatgaagggctg

SEQ ID NO: 37911 - DNA, 32 bp, Artificial Sequence
  Description of Artificial Sequence: Synthetic oligonucleotide
atacacatgccatgtacagcatgaagggctgc

SEQ ID NO: 37912 - DNA, 31 bp, Artificial Sequence
  Description of Artificial Sequence: Synthetic oligonucleotide
tacacatgccatgtacagcatgaagggctgc

SEQ ID NO: 37913 - DNA, 30 bp, Artificial Sequence
  Description of Artificial Sequence: Synthetic oligonucleotide
acacatgccatgtacagcatgaagggctgc

SEQ ID NO: 37914 - DNA, 29 bp, Artificial Sequence
  Description of Artificial Sequence: Synthetic oligonucleotide
cacatgccatgtacagcatgaagggctgc

SEQ ID NO: 37915 - DNA, 29 bp, Artificial Sequence
  Description of Artificial Sequence: Synthetic oligonucleotide
acatgccatgtacagcatgaagggctgcc

SEQ ID NO: 37916 - DNA, 28 bp, Artificial Sequence
  Description of Artificial Sequence: Synthetic oligonucleotide
catgccatgtacagcatgaagggctgcc

SEQ ID NO: 37917 - DNA, 28 bp, Artificial Sequence
  Description of Artificial Sequence: Synthetic oligonucleotide
atgccatgtacagcatgaagggctgccg

SEQ ID NO: 37918 - DNA, 27 bp, Artificial Sequence
  Description of Artificial Sequence: Synthetic oligonucleotide
tgccatgtacagcatgaagggctgccg

SEQ ID NO: 37919 - DNA, 27 bp, Artificial Sequence
  Description of Artificial Sequence: Synthetic oligonucleotide
gccatgtacagcatgaagggctgccga

SEQ ID NO: 37920 - DNA, 28 bp, Artificial Sequence
  Description of Artificial Sequence: Synthetic oligonucleotide
ccatgtacagcatgaagggctgccgaag

SEQ ID NO: 37921 - DNA, 28 bp, Artificial Sequence
  Description of Artificial Sequence: Synthetic oligonucleotide
catgtacagcatgaagggctgccgaagc

SEQ ID NO: 37922 - DNA, 28 bp, Artificial Sequence
  Description of Artificial Sequence: Synthetic oligonucleotide
atgtacagcatgaagggctgccgaagcc

SEQ ID NO: 37923 - DNA, 27 bp, Artificial Sequence
  Description of Artificial Sequence: Synthetic oligonucleotide
tgtacagcatgaagggctgccgaagcc

SEQ ID NO: 37924 - DNA, 26 bp, Artificial Sequence
  Description of Artificial Sequence: Synthetic oligonucleotide
gtacagcatgaagggctgccgaagcc

SEQ ID NO: 37925 - DNA, 26 bp, Artificial Sequence
  Description of Artificial Sequence: Synthetic oligonucleotide
tacagcatgaagggctgccgaagccc

SEQ ID NO: 37926 - DNA, 25 bp, Artificial Sequence
  Description of Artificial Sequence: Synthetic oligonucleotide
acagcatgaagggctgccgaagccc

SEQ ID NO: 37927 - DNA, 24 bp, Artificial Sequence
  Description of Artificial Sequence: Synthetic oligonucleotide
cagcatgaagggctgccgaagccc

SEQ ID NO: 37928 - DNA, 25 bp, Artificial Sequence
  Description of Artificial Sequence: Synthetic oligonucleotide
agcatgaagggctgccgaagcccct

SEQ ID NO: 37929 - DNA, 24 bp, Artificial Sequence
  Description of Artificial Sequence: Synthetic oligonucleotide
gcatgaagggctgccgaagcccct

SEQ ID NO: 37930 - DNA, 25 bp, Artificial Sequence
  Description of Artificial Sequence: Synthetic oligonucleotide
catgaagggctgccgaagcccctca

SEQ ID NO: 37931 - DNA, 25 bp, Artificial Sequence
  Description of Artificial Sequence: Synthetic oligonucleotide
atgaagggctgccgaagcccctcac

SEQ ID NO: 37932 - DNA, 24 bp, Artificial Sequence
  Description of Artificial Sequence: Synthetic oligonucleotide
tgaagggctgccgaagcccctcac

SEQ ID NO: 37933 - DNA, 23 bp, Artificial Sequence
  Description of Artificial Sequence: Synthetic oligonucleotide
gaagggctgccgaagcccctcac

SEQ ID NO: 37934 - DNA, 23 bp, Artificial Sequence
  Description of Artificial Sequence: Synthetic oligonucleotide
aagggctgccgaagcccctcacc

SEQ ID NO: 37935 - DNA, 22 bp, Artificial Sequence
  Description of Artificial Sequence: Synthetic oligonucleotide
agggctgccgaagcccctcacc

SEQ ID NO: 37936 - DNA, 27 bp, Artificial Sequence
  Description of Artificial Sequence: Synthetic oligonucleotide
acttaccgagagaacctgcggatcgcc

SEQ ID NO: 37937 - DNA, 26 bp, Artificial Sequence
  Description of Artificial Sequence: Synthetic oligonucleotide
cttaccgagagaacctgcggatcgcc

SEQ ID NO: 37938 - DNA, 27 bp, Artificial Sequence
  Description of Artificial Sequence: Synthetic oligonucleotide
ttaccgagagaacctgcggatcgccct

SEQ ID NO: 37939 - DNA, 26 bp, Artificial Sequence
  Description of Artificial Sequence: Synthetic oligonucleotide
taccgagagaacctgcggatcgccct

SEQ ID NO: 37940 - DNA, 25 bp, Artificial Sequence
  Description of Artificial Sequence: Synthetic oligonucleotide
accgagagaacctgcggatcgccct

SEQ ID NO: 37941 - DNA, 24 bp, Artificial Sequence
  Description of Artificial Sequence: Synthetic oligonucleotide
ccgagagaacctgcggatcgccct

SEQ ID NO: 37942 - DNA, 24 bp, Artificial Sequence
  Description of Artificial Sequence: Synthetic oligonucleotide
cgagagaacctgcggatcgccctc

SEQ ID NO: 37943 - DNA, 24 bp, Artificial Sequence
  Description of Artificial Sequence: Synthetic oligonucleotide
gagagaacctgcggatcgccctcc

SEQ ID NO: 37944 - DNA, 24 bp, Artificial Sequence
  Description of Artificial Sequence: Synthetic oligonucleotide
agagaacctgcggatcgccctccg

SEQ ID NO: 37945 - DNA, 23 bp, Artificial Sequence
  Description of Artificial Sequence: Synthetic oligonucleotide
gagaacctgcggatcgccctccg

SEQ ID NO: 37946 - DNA, 25 bp, Artificial Sequence
  Description of Artificial Sequence: Synthetic oligonucleotide
agaacctgcggatcgccctccgcta

SEQ ID NO: 37947 - DNA, 24 bp, Artificial Sequence
  Description of Artificial Sequence: Synthetic oligonucleotide
gaacctgcggatcgccctccgcta

SEQ ID NO: 37948 - DNA, 26 bp, Artificial Sequence
  Description of Artificial Sequence: Synthetic oligonucleotide
aacctgcggatcgccctccgctacta

SEQ ID NO: 37949 - DNA, 25 bp, Artificial Sequence
  Description of Artificial Sequence: Synthetic oligonucleotide
acctgcggatcgccctccgctacta

SEQ ID NO: 37950 - DNA, 24 bp, Artificial Sequence
  Description of Artificial Sequence: Synthetic oligonucleotide
cctgcggatcgccctccgctacta

SEQ ID NO: 37951 - DNA, 26 bp, Artificial Sequence
  Description of Artificial Sequence: Synthetic oligonucleotide
ctgcggatcgccctccgctactacaa

SEQ ID NO: 37952 - DNA, 26 bp, Artificial Sequence
  Description of Artificial Sequence: Synthetic oligonucleotide
tgcggatcgccctccgctactacaac

SEQ ID NO: 37953 - DNA, 25 bp, Artificial Sequence
  Description of Artificial Sequence: Synthetic oligonucleotide
gcggatcgccctccgctactacaac

SEQ ID NO: 37954 - DNA, 26 bp, Artificial Sequence
  Description of Artificial Sequence: Synthetic oligonucleotide
cggatcgccctccgctactacaacca

SEQ ID NO: 37955 - DNA, 27 bp, Artificial Sequence
  Description of Artificial Sequence: Synthetic oligonucleotide
ggatcgccctccgctactacaaccaga

SEQ ID NO: 37956 - DNA, 27 bp, Artificial Sequence
  Description of Artificial Sequence: Synthetic oligonucleotide
gatcgccctccgctactacaaccagag

SEQ ID NO: 37957 - DNA, 27 bp, Artificial Sequence
  Description of Artificial Sequence: Synthetic oligonucleotide
atcgccctccgctactacaaccagagc

SEQ ID NO: 37958 - DNA, 26 bp, Artificial Sequence
  Description of Artificial Sequence: Synthetic oligonucleotide
tcgccctccgctactacaaccagagc

SEQ ID NO: 37959 - DNA, 25 bp, Artificial Sequence
  Description of Artificial Sequence: Synthetic oligonucleotide
cgccctccgctactacaaccagagc

SEQ ID NO: 37960 - DNA, 26 bp, Artificial Sequence
  Description of Artificial Sequence: Synthetic oligonucleotide
gccctccgctactacaaccagagcga

SEQ ID NO: 37961 - DNA, 26 bp, Artificial Sequence
  Description of Artificial Sequence: Synthetic oligonucleotide
ccctccgctactacaaccagagcgag

SEQ ID NO: 37962 - DNA, 26 bp, Artificial Sequence
  Description of Artificial Sequence: Synthetic oligonucleotide
cctccgctactacaaccagagcgagg

SEQ ID NO: 37963 - DNA, 32 bp, Artificial Sequence
  Description of Artificial Sequence: Synthetic oligonucleotide
gcaaagattacatcgccctgaacgaggacttg

SEQ ID NO: 37964 - DNA, 33 bp, Artificial Sequence
  Description of Artificial Sequence: Synthetic oligonucleotide
caaagattacatcgccctgaacgaggacttgag

SEQ ID NO: 37965 - DNA, 33 bp, Artificial Sequence
  Description of Artificial Sequence: Synthetic oligonucleotide
aaagattacatcgccctgaacgaggacttgagc

SEQ ID NO: 37966 - DNA, 32 bp, Artificial Sequence
  Description of Artificial Sequence: Synthetic oligonucleotide
aagattacatcgccctgaacgaggacttgagc

SEQ ID NO: 37967 - DNA, 31 bp, Artificial Sequence
  Description of Artificial Sequence: Synthetic oligonucleotide
agattacatcgccctgaacgaggacttgagc

SEQ ID NO: 37968 - DNA, 25 bp, Artificial Sequence
  Description of Artificial Sequence: Synthetic oligonucleotide
ggccggagtattgggaccggaacac

SEQ ID NO: 37969 - DNA, 25 bp, Artificial Sequence
  Description of Artificial Sequence: Synthetic oligonucleotide
gccggagtattgggaccggaacacc

SEQ ID NO: 37970 - DNA, 26 bp, Artificial Sequence
  Description of Artificial Sequence: Synthetic oligonucleotide
ccggagtattgggaccggaacaccca

SEQ ID NO: 37971 - DNA, 27 bp, Artificial Sequence
  Description of Artificial Sequence: Synthetic oligonucleotide
cggagtattgggaccggaacacccaga

SEQ ID NO: 37972 - DNA, 28 bp, Artificial Sequence
  Description of Artificial Sequence: Synthetic oligonucleotide
ggagtattgggaccggaacacccagatc

SEQ ID NO: 37973 - DNA, 30 bp, Artificial Sequence
  Description of Artificial Sequence: Synthetic oligonucleotide
gagtattgggaccggaacacccagatcttc

SEQ ID NO: 37974 - DNA, 32 bp, Artificial Sequence
  Description of Artificial Sequence: Synthetic oligonucleotide
agtattgggaccggaacacccagatcttcaag

SEQ ID NO: 37975 - DNA, 31 bp, Artificial Sequence
  Description of Artificial Sequence: Synthetic oligonucleotide
gtattgggaccggaacacccagatcttcaag

SEQ ID NO: 37976 - DNA, 32 bp, Artificial Sequence
  Description of Artificial Sequence: Synthetic oligonucleotide
tattgggaccggaacacccagatcttcaagac

SEQ ID NO: 37977 - DNA, 31 bp, Artificial Sequence
  Description of Artificial Sequence: Synthetic oligonucleotide
attgggaccggaacacccagatcttcaagac

SEQ ID NO: 37978 - DNA, 30 bp, Artificial Sequence
  Description of Artificial Sequence: Synthetic oligonucleotide
ttgggaccggaacacccagatcttcaagac

SEQ ID NO: 37979 - DNA, 29 bp, Artificial Sequence
  Description of Artificial Sequence: Synthetic oligonucleotide
tgggaccggaacacccagatcttcaagac

SEQ ID NO: 37980 - DNA, 28 bp, Artificial Sequence
  Description of Artificial Sequence: Synthetic oligonucleotide
gggaccggaacacccagatcttcaagac

SEQ ID NO: 37981 - DNA, 28 bp, Artificial Sequence
  Description of Artificial Sequence: Synthetic oligonucleotide
ggaccggaacacccagatcttcaagacc

SEQ ID NO: 37982 - DNA, 30 bp, Artificial Sequence
  Description of Artificial Sequence: Synthetic oligonucleotide
gaccggaacacccagatcttcaagaccaac

SEQ ID NO: 37983 - DNA, 31 bp, Artificial Sequence
  Description of Artificial Sequence: Synthetic oligonucleotide
accggaacacccagatcttcaagaccaacac

SEQ ID NO: 37984 - DNA, 30 bp, Artificial Sequence
  Description of Artificial Sequence: Synthetic oligonucleotide
ccggaacacccagatcttcaagaccaacac

SEQ ID NO: 37985 - DNA, 31 bp, Artificial Sequence
  Description of Artificial Sequence: Synthetic oligonucleotide
cggaacacccagatcttcaagaccaacacac

SEQ ID NO: 37986 - DNA, 32 bp, Artificial Sequence
  Description of Artificial Sequence: Synthetic oligonucleotide
ggaacacccagatcttcaagaccaacacacag

SEQ ID NO: 37987 - DNA, 33 bp, Artificial Sequence
  Description of Artificial Sequence: Synthetic oligonucleotide
gaacacccagatcttcaagaccaacacacagac

SEQ ID NO: 37988 - DNA, 36 bp, Artificial Sequence
  Description of Artificial Sequence: Synthetic oligonucleotide
aacacccagatcttcaagaccaacacacagacttac

SEQ ID NO: 37989 - DNA, 35 bp, Artificial Sequence
  Description of Artificial Sequence: Synthetic oligonucleotide
acacccagatcttcaagaccaacacacagacttac

SEQ ID NO: 37990 - DNA, 34 bp, Artificial Sequence
  Description of Artificial Sequence: Synthetic oligonucleotide
cacccagatcttcaagaccaacacacagacttac

SEQ ID NO: 37991 - DNA, 34 bp, Artificial Sequence
  Description of Artificial Sequence: Synthetic oligonucleotide
acccagatcttcaagaccaacacacagacttacc

SEQ ID NO: 37992 - DNA, 33 bp, Artificial Sequence
  Description of Artificial Sequence: Synthetic oligonucleotide
cccagatcttcaagaccaacacacagacttacc

SEQ ID NO: 37993 - DNA, 33 bp, Artificial Sequence
  Description of Artificial Sequence: Synthetic oligonucleotide
ccagatcttcaagaccaacacacagacttaccg

SEQ ID NO: 37994 - DNA, 31 bp, Artificial Sequence
  Description of Artificial Sequence: Synthetic oligonucleotide
gctcccactccatgagatatttctacaccgc

SEQ ID NO: 37995 - DNA, 31 bp, Artificial Sequence
  Description of Artificial Sequence: Synthetic oligonucleotide
ctcccactccatgagatatttctacaccgcc

SEQ ID NO: 37996 - DNA, 33 bp, Artificial Sequence
  Description of Artificial Sequence: Synthetic oligonucleotide
tcccactccatgagatatttctacaccgccatg

SEQ ID NO: 37997 - DNA, 32 bp, Artificial Sequence
  Description of Artificial Sequence: Synthetic oligonucleotide
cccactccatgagatatttctacaccgccatg

SEQ ID NO: 37998 - DNA, 33 bp, Artificial Sequence
  Description of Artificial Sequence: Synthetic oligonucleotide
ccactccatgagatatttctacaccgccatgtc

SEQ ID NO: 37999 - DNA, 33 bp, Artificial Sequence
  Description of Artificial Sequence: Synthetic oligonucleotide
cactccatgagatatttctacaccgccatgtcc

SEQ ID NO: 38000 - DNA, 33 bp, Artificial Sequence
  Description of Artificial Sequence: Synthetic oligonucleotide
actccatgagatatttctacaccgccatgtccc

SEQ ID NO: 38001 - DNA, 32 bp, Artificial Sequence
  Description of Artificial Sequence: Synthetic oligonucleotide
ctccatgagatatttctacaccgccatgtccc

SEQ ID NO: 38002 - DNA, 32 bp, Artificial Sequence
  Description of Artificial Sequence: Synthetic oligonucleotide
tccatgagatatttctacaccgccatgtcccg

SEQ ID NO: 38003 - DNA, 31 bp, Artificial Sequence
  Description of Artificial Sequence: Synthetic oligonucleotide
ccatgagatatttctacaccgccatgtcccg

SEQ ID NO: 38004 - DNA, 31 bp, Artificial Sequence
  Description of Artificial Sequence: Synthetic oligonucleotide
catgagatatttctacaccgccatgtcccgg

SEQ ID NO: 38005 - DNA, 31 bp, Artificial Sequence
  Description of Artificial Sequence: Synthetic oligonucleotide
atgagatatttctacaccgccatgtcccggc

SEQ ID NO: 38006 - DNA, 30 bp, Artificial Sequence
  Description of Artificial Sequence: Synthetic oligonucleotide
tgagatatttctacaccgccatgtcccggc

SEQ ID NO: 38007 - DNA, 29 bp, Artificial Sequence
  Description of Artificial Sequence: Synthetic oligonucleotide
gagatatttctacaccgccatgtcccggc

SEQ ID NO: 38008 - DNA, 29 bp, Artificial Sequence
  Description of Artificial Sequence: Synthetic oligonucleotide
agatatttctacaccgccatgtcccggcc

SEQ ID NO: 38009 - DNA, 28 bp, Artificial Sequence
  Description of Artificial Sequence: Synthetic oligonucleotide
gatatttctacaccgccatgtcccggcc

SEQ ID NO: 38010 - DNA, 28 bp, Artificial Sequence
  Description of Artificial Sequence: Synthetic oligonucleotide
atatttctacaccgccatgtcccggccc

SEQ ID NO: 38011 - DNA, 36 bp, Artificial Sequence
  Description of Artificial Sequence: Synthetic oligonucleotide
ataaccagtacgcctacgacggcaaagattacattg

SEQ ID NO: 38012 - DNA, 35 bp, Artificial Sequence
  Description of Artificial Sequence: Synthetic oligonucleotide
taaccagtacgcctacgacggcaaagattacattg

SEQ ID NO: 38013 - DNA, 34 bp, Artificial Sequence
  Description of Artificial Sequence: Synthetic oligonucleotide
aaccagtacgcctacgacggcaaagattacattg

SEQ ID NO: 38014 - DNA, 33 bp, Artificial Sequence
  Description of Artificial Sequence: Synthetic oligonucleotide
accagtacgcctacgacggcaaagattacattg

SEQ ID NO: 38015 - DNA, 32 bp, Artificial Sequence
  Description of Artificial Sequence: Synthetic oligonucleotide
ccagtacgcctacgacggcaaagattacattg

SEQ ID NO: 38016 - DNA, 32 bp, Artificial Sequence
  Description of Artificial Sequence: Synthetic oligonucleotide
cagtacgcctacgacggcaaagattacattgc

SEQ ID NO: 38017 - DNA, 32 bp, Artificial Sequence
  Description of Artificial Sequence: Synthetic oligonucleotide
agtacgcctacgacggcaaagattacattgcc

SEQ ID NO: 38018 - DNA, 31 bp, Artificial Sequence
  Description of Artificial Sequence: Synthetic oligonucleotide
gtacgcctacgacggcaaagattacattgcc

SEQ ID NO: 38019 - DNA, 31 bp, Artificial Sequence
  Description of Artificial Sequence: Synthetic oligonucleotide
tacgcctacgacggcaaagattacattgccc

SEQ ID NO: 38020 - DNA, 30 bp, Artificial Sequence
  Description of Artificial Sequence: Synthetic oligonucleotide
acgcctacgacggcaaagattacattgccc

SEQ ID NO: 38021 - DNA, 29 bp, Artificial Sequence
  Description of Artificial Sequence: Synthetic oligonucleotide
cgcctacgacggcaaagattacattgccc

SEQ ID NO: 38022 - DNA, 30 bp, Artificial Sequence
  Description of Artificial Sequence: Synthetic oligonucleotide
gcctacgacggcaaagattacattgccctg

SEQ ID NO: 38023 - DNA, 32 bp, Artificial Sequence
  Description of Artificial Sequence: Synthetic oligonucleotide
cctacgacggcaaagattacattgccctgaac

SEQ ID NO: 38024 - DNA, 32 bp, Artificial Sequence
  Description of Artificial Sequence: Synthetic oligonucleotide
ctacgacggcaaagattacattgccctgaacg

SEQ ID NO: 38025 - DNA, 33 bp, Artificial Sequence
  Description of Artificial Sequence: Synthetic oligonucleotide
tacgacggcaaagattacattgccctgaacgag

SEQ ID NO: 38026 - DNA, 32 bp, Artificial Sequence
  Description of Artificial Sequence: Synthetic oligonucleotide
acgacggcaaagattacattgccctgaacgag

SEQ ID NO: 38027 - DNA, 31 bp, Artificial Sequence
  Description of Artificial Sequence: Synthetic oligonucleotide
cgacggcaaagattacattgccctgaacgag

SEQ ID NO: 38028 - DNA, 31 bp, Artificial Sequence
  Description of Artificial Sequence: Synthetic oligonucleotide
gacggcaaagattacattgccctgaacgagg

SEQ ID NO: 38029 - DNA, 32 bp, Artificial Sequence
  Description of Artificial Sequence: Synthetic oligonucleotide
acggcaaagattacattgccctgaacgaggac

SEQ ID NO: 38030 - DNA, 31 bp, Artificial Sequence
  Description of Artificial Sequence: Synthetic oligonucleotide
cggcaaagattacattgccctgaacgaggac

SEQ ID NO: 38031 - DNA, 31 bp, Artificial Sequence
  Description of Artificial Sequence: Synthetic oligonucleotide
ggcaaagattacattgccctgaacgaggacc

SEQ ID NO: 38032 - DNA, 32 bp, Artificial Sequence
  Description of Artificial Sequence: Synthetic oligonucleotide
gcaaagattacattgccctgaacgaggacctg

SEQ ID NO: 38033 - DNA, 33 bp, Artificial Sequence
  Description of Artificial Sequence: Synthetic oligonucleotide
caaagattacattgccctgaacgaggacctgag

SEQ ID NO: 38034 - DNA, 33 bp, Artificial Sequence
  Description of Artificial Sequence: Synthetic oligonucleotide
aaagattacattgccctgaacgaggacctgagc

SEQ ID NO: 38035 - DNA, 32 bp, Artificial Sequence
  Description of Artificial Sequence: Synthetic oligonucleotide
aagattacattgccctgaacgaggacctgagc

SEQ ID NO: 38036 - DNA, 31 bp, Artificial Sequence
  Description of Artificial Sequence: Synthetic oligonucleotide
agattacattgccctgaacgaggacctgagc

SEQ ID NO: 38037 - DNA, 30 bp, Artificial Sequence
  Description of Artificial Sequence: Synthetic oligonucleotide
gattacattgccctgaacgaggacctgagc

SEQ ID NO: 38038 - DNA, 31 bp, Artificial Sequence
  Description of Artificial Sequence: Synthetic oligonucleotide
attacattgccctgaacgaggacctgagctc

SEQ ID NO: 38039 - DNA, 30 bp, Artificial Sequence
  Description of Artificial Sequence: Synthetic oligonucleotide
ttacattgccctgaacgaggacctgagctc

SEQ ID NO: 38040 - DNA, 29 bp, Artificial Sequence
  Description of Artificial Sequence: Synthetic oligonucleotide
tacattgccctgaacgaggacctgagctc

SEQ ID NO: 38041 - DNA, 28 bp, Artificial Sequence
  Description of Artificial Sequence: Synthetic oligonucleotide
acattgccctgaacgaggacctgagctc

SEQ ID NO: 38042 - DNA, 27 bp, Artificial Sequence
  Description of Artificial Sequence: Synthetic oligonucleotide
cattgccctgaacgaggacctgagctc

SEQ ID NO: 38043 - DNA, 27 bp, Artificial Sequence
  Description of Artificial Sequence: Synthetic oligonucleotide
attgccctgaacgaggacctgagctcc

SEQ ID NO: 38044 - DNA, 27 bp, Artificial Sequence
  Description of Artificial Sequence: Synthetic oligonucleotide
ttgccctgaacgaggacctgagctcct

SEQ ID NO: 38045 - DNA, 26 bp, Artificial Sequence
  Description of Artificial Sequence: Synthetic oligonucleotide
tgccctgaacgaggacctgagctcct

SEQ ID NO: 38046 - DNA, 25 bp, Artificial Sequence
  Description of Artificial Sequence: Synthetic oligonucleotide
gtgaggttcgacagcgacgccgcaa

SEQ ID NO: 38047 - DNA, 26 bp, Artificial Sequence
  Description of Artificial Sequence: Synthetic oligonucleotide
tgaggttcgacagcgacgccgcaagt

SEQ ID NO: 38048 - DNA, 25 bp, Artificial Sequence
  Description of Artificial Sequence: Synthetic oligonucleotide
gaggttcgacagcgacgccgcaagt

SEQ ID NO: 38049 - DNA, 25 bp, Artificial Sequence
  Description of Artificial Sequence: Synthetic oligonucleotide
aggttcgacagcgacgccgcaagtc

SEQ ID NO: 38050 - DNA, 24 bp, Artificial Sequence
  Description of Artificial Sequence: Synthetic oligonucleotide
ggttcgacagcgacgccgcaagtc

SEQ ID NO: 38051 - DNA, 24 bp, Artificial Sequence
  Description of Artificial Sequence: Synthetic oligonucleotide
gttcgacagcgacgccgcaagtcc

SEQ ID NO: 38052 - DNA, 25 bp, Artificial Sequence
  Description of Artificial Sequence: Synthetic oligonucleotide
ttcgacagcgacgccgcaagtccga

SEQ ID NO: 38053 - DNA, 24 bp, Artificial Sequence
  Description of Artificial Sequence: Synthetic oligonucleotide
tcgacagcgacgccgcaagtccga

SEQ ID NO: 38054 - DNA, 23 bp, Artificial Sequence
  Description of Artificial Sequence: Synthetic oligonucleotide
cgacagcgacgccgcaagtccga

SEQ ID NO: 38055 - DNA, 23 bp, Artificial Sequence
  Description of Artificial Sequence: Synthetic oligonucleotide
gacagcgacgccgcaagtccgag

SEQ ID NO: 38056 - DNA, 24 bp, Artificial Sequence
  Description of Artificial Sequence: Synthetic oligonucleotide
acagcgacgccgcaagtccgagga

SEQ ID NO: 38057 - DNA, 23 bp, Artificial Sequence
  Description of Artificial Sequence: Synthetic oligonucleotide
cagcgacgccgcaagtccgagga

SEQ ID NO: 38058 - DNA, 23 bp, Artificial Sequence
  Description of Artificial Sequence: Synthetic oligonucleotide
agcgacgccgcaagtccgaggac

SEQ ID NO: 38059 - DNA, 22 bp, Artificial Sequence
  Description of Artificial Sequence: Synthetic oligonucleotide
gcgacgccgcaagtccgaggac

SEQ ID NO: 38060 - DNA, 22 bp, Artificial Sequence
  Description of Artificial Sequence: Synthetic oligonucleotide
cgacgccgcaagtccgaggacg

SEQ ID NO: 38061 - DNA, 23 bp, Artificial Sequence
  Description of Artificial Sequence: Synthetic oligonucleotide
gacgccgcaagtccgaggacgga

SEQ ID NO: 38062 - DNA, 23 bp, Artificial Sequence
  Description of Artificial Sequence: Synthetic oligonucleotide
acgccgcaagtccgaggacggag

SEQ ID NO: 38063 - DNA, 22 bp, Artificial Sequence
  Description of Artificial Sequence: Synthetic oligonucleotide
cgccgcaagtccgaggacggag

SEQ ID NO: 38064 - DNA, 22 bp, Artificial Sequence
  Description of Artificial Sequence: Synthetic oligonucleotide
gccgcaagtccgaggacggagc

SEQ ID NO: 38065 - DNA, 22 bp, Artificial Sequence
  Description of Artificial Sequence: Synthetic oligonucleotide
ccgcaagtccgaggacggagcc

SEQ ID NO: 38066 - DNA, 22 bp, Artificial Sequence
  Description of Artificial Sequence: Synthetic oligonucleotide
cgcaagtccgaggacggagccc

SEQ ID NO: 38067 - DNA, 22 bp, Artificial Sequence
  Description of Artificial Sequence: Synthetic oligonucleotide
gcaagtccgaggacggagcccc

SEQ ID NO: 38068 - DNA, 22 bp, Artificial Sequence
  Description of Artificial Sequence: Synthetic oligonucleotide
caagtccgaggacggagccccg

SEQ ID NO: 38069 - DNA, 22 bp, Artificial Sequence
  Description of Artificial Sequence: Synthetic oligonucleotide
aagtccgaggacggagccccgg

SEQ ID NO: 38070 - DNA, 23 bp, Artificial Sequence
  Description of Artificial Sequence: Synthetic oligonucleotide
ggcgcctcctccgcgggcataat

SEQ ID NO: 38071 - DNA, 24 bp, Artificial Sequence
  Description of Artificial Sequence: Synthetic oligonucleotide
gcgcctcctccgcgggcataatca

SEQ ID NO: 38072 - DNA, 26 bp, Artificial Sequence
  Description of Artificial Sequence: Synthetic oligonucleotide
cgcctcctccgcgggcataatcagta

SEQ ID NO: 38073 - DNA, 26 bp, Artificial Sequence
  Description of Artificial Sequence: Synthetic oligonucleotide
gcctcctccgcgggcataatcagtac

SEQ ID NO: 38074 - DNA, 26 bp, Artificial Sequence
  Description of Artificial Sequence: Synthetic oligonucleotide
cctcctccgcgggcataatcagtacg

SEQ ID NO: 38075 - DNA, 26 bp, Artificial Sequence
  Description of Artificial Sequence: Synthetic oligonucleotide
ctcctccgcgggcataatcagtacgc

SEQ ID NO: 38076 - DNA, 27 bp, Artificial Sequence
  Description of Artificial Sequence: Synthetic oligonucleotide
tcctccgcgggcataatcagtacgcct

SEQ ID NO: 38077 - DNA, 27 bp, Artificial Sequence
  Description of Artificial Sequence: Synthetic oligonucleotide
cctccgcgggcataatcagtacgccta

SEQ ID NO: 38078 - DNA, 27 bp, Artificial Sequence
  Description of Artificial Sequence: Synthetic oligonucleotide
ctccgcgggcataatcagtacgcctac

SEQ ID NO: 38079 - DNA, 27 bp, Artificial Sequence
  Description of Artificial Sequence: Synthetic oligonucleotide
tccgcgggcataatcagtacgcctacg

SEQ ID NO: 38080 - DNA, 27 bp, Artificial Sequence
  Description of Artificial Sequence: Synthetic oligonucleotide
ccgcgggcataatcagtacgcctacga

SEQ ID NO: 38081 - DNA, 27 bp, Artificial Sequence
  Description of Artificial Sequence: Synthetic oligonucleotide
cgcgggcataatcagtacgcctacgac

SEQ ID NO: 38082 - DNA, 27 bp, Artificial Sequence
  Description of Artificial Sequence: Synthetic oligonucleotide
gcgggcataatcagtacgcctacgacg

SEQ ID NO: 38083 - DNA, 27 bp, Artificial Sequence
  Description of Artificial Sequence: Synthetic oligonucleotide
cgggcataatcagtacgcctacgacgg

SEQ ID NO: 38084 - DNA, 27 bp, Artificial Sequence
  Description of Artificial Sequence: Synthetic oligonucleotide
gggcataatcagtacgcctacgacggc

SEQ ID NO: 38085 - DNA, 30 bp, Artificial Sequence
  Description of Artificial Sequence: Synthetic oligonucleotide
ggcataatcagtacgcctacgacggcaaag

SEQ ID NO: 38086 - DNA, 34 bp, Artificial Sequence
  Description of Artificial Sequence: Synthetic oligonucleotide
gcataatcagtacgcctacgacggcaaagattac

SEQ ID NO: 38087 - DNA, 36 bp, Artificial Sequence
  Description of Artificial Sequence: Synthetic oligonucleotide
cataatcagtacgcctacgacggcaaagattacatc

SEQ ID NO: 38088 - DNA, 36 bp, Artificial Sequence
  Description of Artificial Sequence: Synthetic oligonucleotide
ataatcagtacgcctacgacggcaaagattacatcg

SEQ ID NO: 38089 - DNA, 35 bp, Artificial Sequence
  Description of Artificial Sequence: Synthetic oligonucleotide
taatcagtacgcctacgacggcaaagattacatcg

SEQ ID NO: 38090 - DNA, 34 bp, Artificial Sequence
  Description of Artificial Sequence: Synthetic oligonucleotide
aatcagtacgcctacgacggcaaagattacatcg

SEQ ID NO: 38091 - DNA, 33 bp, Artificial Sequence
  Description of Artificial Sequence: Synthetic oligonucleotide
atcagtacgcctacgacggcaaagattacatcg

SEQ ID NO: 38092 - DNA, 32 bp, Artificial Sequence
  Description of Artificial Sequence: Synthetic oligonucleotide
tcagtacgcctacgacggcaaagattacatcg

SEQ ID NO: 38093 - DNA, 30 bp, Artificial Sequence
  Description of Artificial Sequence: Synthetic oligonucleotide
ccggagtattgggaccggaacacacaaatc

SEQ ID NO: 38094 - DNA, 32 bp, Artificial Sequence
  Description of Artificial Sequence: Synthetic oligonucleotide
cggagtattgggaccggaacacacaaatcttc

SEQ ID NO: 38095 - DNA, 34 bp, Artificial Sequence
  Description of Artificial Sequence: Synthetic oligonucleotide
ggagtattgggaccggaacacacaaatcttcaag

SEQ ID NO: 38096 - DNA, 35 bp, Artificial Sequence
  Description of Artificial Sequence: Synthetic oligonucleotide
gagtattgggaccggaacacacaaatcttcaagac

SEQ ID NO: 38097 - DNA, 35 bp, Artificial Sequence
  Description of Artificial Sequence: Synthetic oligonucleotide
agtattgggaccggaacacacaaatcttcaagacc

SEQ ID NO: 38098 - DNA, 34 bp, Artificial Sequence
  Description of Artificial Sequence: Synthetic oligonucleotide
gtattgggaccggaacacacaaatcttcaagacc

SEQ ID NO: 38099 - DNA, 36 bp, Artificial Sequence
  Description of Artificial Sequence: Synthetic oligonucleotide
tattgggaccggaacacacaaatcttcaagaccaac

SEQ ID NO: 38100 - DNA, 35 bp, Artificial Sequence
  Description of Artificial Sequence: Synthetic oligonucleotide
attgggaccggaacacacaaatcttcaagaccaac

SEQ ID NO: 38101 - DNA, 34 bp, Artificial Sequence
  Description of Artificial Sequence: Synthetic oligonucleotide
ttgggaccggaacacacaaatcttcaagaccaac

SEQ ID NO: 38102 - DNA, 33 bp, Artificial Sequence
  Description of Artificial Sequence: Synthetic oligonucleotide
tgggaccggaacacacaaatcttcaagaccaac

SEQ ID NO: 38103 - DNA, 32 bp, Artificial Sequence
  Description of Artificial Sequence: Synthetic oligonucleotide
gggaccggaacacacaaatcttcaagaccaac

SEQ ID NO: 38104 - DNA, 33 bp, Artificial Sequence
  Description of Artificial Sequence: Synthetic oligonucleotide
ggaccggaacacacaaatcttcaagaccaacac

SEQ ID NO: 38105 - DNA, 34 bp, Artificial Sequence
  Description of Artificial Sequence: Synthetic oligonucleotide
gaccggaacacacaaatcttcaagaccaacacac

SEQ ID NO: 38106 - DNA, 35 bp, Artificial Sequence
  Description of Artificial Sequence: Synthetic oligonucleotide
accggaacacacaaatcttcaagaccaacacacag

SEQ ID NO: 38107 - DNA, 34 bp, Artificial Sequence
  Description of Artificial Sequence: Synthetic oligonucleotide
ccggaacacacaaatcttcaagaccaacacacag

SEQ ID NO: 38108 - DNA, 35 bp, Artificial Sequence
  Description of Artificial Sequence: Synthetic oligonucleotide
cggaacacacaaatcttcaagaccaacacacagac

SEQ ID NO: 38109 - DNA, 38 bp, Artificial Sequence
  Description of Artificial Sequence: Synthetic oligonucleotide
ggaacacacaaatcttcaagaccaacacacagacttac

SEQ ID NO: 38110 - DNA, 38 bp, Artificial Sequence
  Description of Artificial Sequence: Synthetic oligonucleotide
gaacacacaaatcttcaagaccaacacacagacttacc

SEQ ID NO: 38111 - DNA, 38 bp, Artificial Sequence
  Description of Artificial Sequence: Synthetic oligonucleotide
aacacacaaatcttcaagaccaacacacagacttaccg

SEQ ID NO: 38112 - DNA, 37 bp, Artificial Sequence
  Description of Artificial Sequence: Synthetic oligonucleotide
acacacaaatcttcaagaccaacacacagacttaccg

SEQ ID NO: 38113 - DNA, 36 bp, Artificial Sequence
  Description of Artificial Sequence: Synthetic oligonucleotide
cacacaaatcttcaagaccaacacacagacttaccg

SEQ ID NO: 38114 - DNA, 37 bp, Artificial Sequence
  Description of Artificial Sequence: Synthetic oligonucleotide
acacaaatcttcaagaccaacacacagacttaccgag

SEQ ID NO: 38115 - DNA, 36 bp, Artificial Sequence
  Description of Artificial Sequence: Synthetic oligonucleotide
cacaaatcttcaagaccaacacacagacttaccgag

SEQ ID NO: 38116 - DNA, 37 bp, Artificial Sequence
  Description of Artificial Sequence: Synthetic oligonucleotide
acaaatcttcaagaccaacacacagacttaccgagag

SEQ ID NO: 38117 - DNA, 36 bp, Artificial Sequence
  Description of Artificial Sequence: Synthetic oligonucleotide
caaatcttcaagaccaacacacagacttaccgagag

SEQ ID NO: 38118 - DNA, 38 bp, Artificial Sequence
  Description of Artificial Sequence: Synthetic oligonucleotide
aaatcttcaagaccaacacacagacttaccgagagaac

SEQ ID NO: 38119 - DNA, 37 bp, Artificial Sequence
  Description of Artificial Sequence: Synthetic oligonucleotide
aatcttcaagaccaacacacagacttaccgagagaac

SEQ ID NO: 38120 - DNA, 24 bp, Artificial Sequence
  Description of Artificial Sequence: Synthetic oligonucleotide
cctcctccgcgggcacaaccagta

SEQ ID NO: 38121 - DNA, 24 bp, Artificial Sequence
  Description of Artificial Sequence: Synthetic oligonucleotide
ctcctccgcgggcacaaccagtac

SEQ ID NO: 38122 - DNA, 24 bp, Artificial Sequence
  Description of Artificial Sequence: Synthetic oligonucleotide
tcctccgcgggcacaaccagtacg

SEQ ID NO: 38123 - DNA, 23 bp, Artificial Sequence
  Description of Artificial Sequence: Synthetic oligonucleotide
cctccgcgggcacaaccagtacg

SEQ ID NO: 38124 - DNA, 23 bp, Artificial Sequence
  Description of Artificial Sequence: Synthetic oligonucleotide
ctccgcgggcacaaccagtacgc

SEQ ID NO: 38125 - DNA, 25 bp, Artificial Sequence
  Description of Artificial Sequence: Synthetic oligonucleotide
tccgcgggcacaaccagtacgccta

SEQ ID NO: 38126 - DNA, 24 bp, Artificial Sequence
  Description of Artificial Sequence: Synthetic oligonucleotide
ccgcgggcacaaccagtacgccta

SEQ ID NO: 38127 - DNA, 24 bp, Artificial Sequence
  Description of Artificial Sequence: Synthetic oligonucleotide
cgcgggcacaaccagtacgcctac

SEQ ID NO: 38128 - DNA, 25 bp, Artificial Sequence
  Description of Artificial Sequence: Synthetic oligonucleotide
gcgggcacaaccagtacgcctacga

SEQ ID NO: 38129 - DNA, 25 bp, Artificial Sequence
  Description of Artificial Sequence: Synthetic oligonucleotide
cgggcacaaccagtacgcctacgac

SEQ ID NO: 38130 - DNA, 25 bp, Artificial Sequence
  Description of Artificial Sequence: Synthetic oligonucleotide
gggcacaaccagtacgcctacgacg

SEQ ID NO: 38131 - DNA, 25 bp, Artificial Sequence
  Description of Artificial Sequence: Synthetic oligonucleotide
ggcacaaccagtacgcctacgacgg

SEQ ID NO: 38132 - DNA, 27 bp, Artificial Sequence
  Description of Artificial Sequence: Synthetic oligonucleotide
gcacaaccagtacgcctacgacggcaa

SEQ ID NO: 38133 - DNA, 28 bp, Artificial Sequence
  Description of Artificial Sequence: Synthetic oligonucleotide
cacaaccagtacgcctacgacggcaaag

SEQ ID NO: 38134 - DNA, 32 bp, Artificial Sequence
  Description of Artificial Sequence: Synthetic oligonucleotide
acaaccagtacgcctacgacggcaaagattac

SEQ ID NO: 38135 - DNA, 31 bp, Artificial Sequence
  Description of Artificial Sequence: Synthetic oligonucleotide
caaccagtacgcctacgacggcaaagattac

SEQ ID NO: 38136 - DNA, 24 bp, Artificial Sequence
  Description of Artificial Sequence: Synthetic oligonucleotide
tacctggagggcctgtgcgtggag

SEQ ID NO: 38137 - DNA, 23 bp, Artificial Sequence
  Description of Artificial Sequence: Synthetic oligonucleotide
acctggagggcctgtgcgtggag

SEQ ID NO: 38138 - DNA, 22 bp, Artificial Sequence
  Description of Artificial Sequence: Synthetic oligonucleotide
cctggagggcctgtgcgtggag

SEQ ID NO: 38139 - DNA, 22 bp, Artificial Sequence
  Description of Artificial Sequence: Synthetic oligonucleotide
ctggagggcctgtgcgtggagg

SEQ ID NO: 38140 - DNA, 22 bp, Artificial Sequence
  Description of Artificial Sequence: Synthetic oligonucleotide
tggagggcctgtgcgtggaggg

SEQ ID NO: 38141 - DNA, 21 bp, Artificial Sequence
  Description of Artificial Sequence: Synthetic oligonucleotide
ggagggcctgtgcgtggaggg

SEQ ID NO: 38142 - DNA, 21 bp, Artificial Sequence
  Description of Artificial Sequence: Synthetic oligonucleotide
gagggcctgtgcgtggagggg

SEQ ID NO: 38143 - DNA, 22 bp, Artificial Sequence
  Description of Artificial Sequence: Synthetic oligonucleotide
agggcctgtgcgtggaggggct

SEQ ID NO: 38144 - DNA, 21 bp, Artificial Sequence
  Description of Artificial Sequence: Synthetic oligonucleotide
gggcctgtgcgtggaggggct

SEQ ID NO: 38145 - DNA, 21 bp, Artificial Sequence
  Description of Artificial Sequence: Synthetic oligonucleotide
ggcctgtgcgtggaggggctc

SEQ ID NO: 38146 - DNA, 21 bp, Artificial Sequence
  Description of Artificial Sequence: Synthetic oligonucleotide
gcctgtgcgtggaggggctcc

SEQ ID NO: 38147 - DNA, 21 bp, Artificial Sequence
  Description of Artificial Sequence: Synthetic oligonucleotide
cctgtgcgtggaggggctccg

SEQ ID NO: 38148 - DNA, 22 bp, Artificial Sequence
  Description of Artificial Sequence: Synthetic oligonucleotide
ctgtgcgtggaggggctccgca

SEQ ID NO: 38149 - DNA, 23 bp, Artificial Sequence
  Description of Artificial Sequence: Synthetic oligonucleotide
tgtgcgtggaggggctccgcaga

SEQ ID NO: 38150 - DNA, 22 bp, Artificial Sequence
  Description of Artificial Sequence: Synthetic oligonucleotide
gtgcgtggaggggctccgcaga

SEQ ID NO: 38151 - DNA, 23 bp, Artificial Sequence
  Description of Artificial Sequence: Synthetic oligonucleotide
tgcgtggaggggctccgcagaca

SEQ ID NO: 38152 - DNA, 22 bp, Artificial Sequence
  Description of Artificial Sequence: Synthetic oligonucleotide
gcgtggaggggctccgcagaca

SEQ ID NO: 38153 - DNA, 22 bp, Artificial Sequence
  Description of Artificial Sequence: Synthetic oligonucleotide
cgtggaggggctccgcagacac

SEQ ID NO: 38154 - DNA, 23 bp, Artificial Sequence
  Description of Artificial Sequence: Synthetic oligonucleotide
gtggaggggctccgcagacacct

SEQ ID NO: 38155 - DNA, 23 bp, Artificial Sequence
  Description of Artificial Sequence: Synthetic oligonucleotide
tggaggggctccgcagacacctg

SEQ ID NO: 38156 - DNA, 22 bp, Artificial Sequence
  Description of Artificial Sequence: Synthetic oligonucleotide
ggaggggctccgcagacacctg

SEQ ID NO: 38157 - DNA, 23 bp, Artificial Sequence
  Description of Artificial Sequence: Synthetic oligonucleotide
gaggggctccgcagacacctgga

SEQ ID NO: 38158 - DNA, 25 bp, Artificial Sequence
  Description of Artificial Sequence: Synthetic oligonucleotide
aggggctccgcagacacctggagaa

SEQ ID NO: 38159 - DNA, 24 bp, Artificial Sequence
  Description of Artificial Sequence: Synthetic oligonucleotide
ggggctccgcagacacctggagaa

SEQ ID NO: 38160 - DNA, 24 bp, Artificial Sequence
  Description of Artificial Sequence: Synthetic oligonucleotide
gggctccgcagacacctggagaac

SEQ ID NO: 38161 - DNA, 21 bp, Artificial Sequence
  Description of Artificial Sequence: Synthetic oligonucleotide
cagcgcgcggacccccccaaa

SEQ ID NO: 38162 - DNA, 22 bp, Artificial Sequence
  Description of Artificial Sequence: Synthetic oligonucleotide
agcgcgcggacccccccaaaga

SEQ ID NO: 38163 - DNA, 21 bp, Artificial Sequence
  Description of Artificial Sequence: Synthetic oligonucleotide
gcgcgcggacccccccaaaga

SEQ ID NO: 38164 - DNA, 22 bp, Artificial Sequence
  Description of Artificial Sequence: Synthetic oligonucleotide
cgcgcggacccccccaaagaca

SEQ ID NO: 38165 - DNA, 23 bp, Artificial Sequence
  Description of Artificial Sequence: Synthetic oligonucleotide
gcgcggacccccccaaagacaca

SEQ ID NO: 38166 - DNA, 23 bp, Artificial Sequence
  Description of Artificial Sequence: Synthetic oligonucleotide
cgcggacccccccaaagacacac

SEQ ID NO: 38167 - DNA, 24 bp, Artificial Sequence
  Description of Artificial Sequence: Synthetic oligonucleotide
gcggacccccccaaagacacacgt

SEQ ID NO: 38168 - DNA, 25 bp, Artificial Sequence
  Description of Artificial Sequence: Synthetic oligonucleotide
cggacccccccaaagacacacgtga

SEQ ID NO: 38169 - DNA, 25 bp, Artificial Sequence
  Description of Artificial Sequence: Synthetic oligonucleotide
ggacccccccaaagacacacgtgac

SEQ ID NO: 38170 - DNA, 25 bp, Artificial Sequence
  Description of Artificial Sequence: Synthetic oligonucleotide
gacccccccaaagacacacgtgacc

SEQ ID NO: 38171 - DNA, 26 bp, Artificial Sequence
  Description of Artificial Sequence: Synthetic oligonucleotide
acccccccaaagacacacgtgaccca

SEQ ID NO: 38172 - DNA, 25 bp, Artificial Sequence
  Description of Artificial Sequence: Synthetic oligonucleotide
cccccccaaagacacacgtgaccca

SEQ ID NO: 38173 - DNA, 23 bp, Artificial Sequence
  Description of Artificial Sequence: Synthetic oligonucleotide
agaacctgcggatcgcgctccgc

SEQ ID NO: 38174 - DNA, 22 bp, Artificial Sequence
  Description of Artificial Sequence: Synthetic oligonucleotide
gaacctgcggatcgcgctccgc

SEQ ID NO: 38175 - DNA, 23 bp, Artificial Sequence
  Description of Artificial Sequence: Synthetic oligonucleotide
aacctgcggatcgcgctccgcga

SEQ ID NO: 38176 - DNA, 22 bp, Artificial Sequence
  Description of Artificial Sequence: Synthetic oligonucleotide
acctgcggatcgcgctccgcga

SEQ ID NO: 38177 - DNA, 21 bp, Artificial Sequence
  Description of Artificial Sequence: Synthetic oligonucleotide
cctgcggatcgcgctccgcga

SEQ ID NO: 38178 - DNA, 23 bp, Artificial Sequence
  Description of Artificial Sequence: Synthetic oligonucleotide
ctgcggatcgcgctccgcgacta

SEQ ID NO: 38179 - DNA, 25 bp, Artificial Sequence
  Description of Artificial Sequence: Synthetic oligonucleotide
tgcggatcgcgctccgcgactacaa

SEQ ID NO: 38180 - DNA, 24 bp, Artificial Sequence
  Description of Artificial Sequence: Synthetic oligonucleotide
gcggatcgcgctccgcgactacaa

SEQ ID NO: 38181 - DNA, 24 bp, Artificial Sequence
  Description of Artificial Sequence: Synthetic oligonucleotide
cggatcgcgctccgcgactacaac

SEQ ID NO: 38182 - DNA, 25 bp, Artificial Sequence
  Description of Artificial Sequence: Synthetic oligonucleotide
ggatcgcgctccgcgactacaacca

SEQ ID NO: 38183 - DNA, 26 bp, Artificial Sequence
  Description of Artificial Sequence: Synthetic oligonucleotide
gatcgcgctccgcgactacaaccaga

SEQ ID NO: 38184 - DNA, 26 bp, Artificial Sequence
  Description of Artificial Sequence: Synthetic oligonucleotide
atcgcgctccgcgactacaaccagag

SEQ ID NO: 38185 - DNA, 25 bp, Artificial Sequence
  Description of Artificial Sequence: Synthetic oligonucleotide
tcgcgctccgcgactacaaccagag

SEQ ID NO: 38186 - DNA, 24 bp, Artificial Sequence
  Description of Artificial Sequence: Synthetic oligonucleotide
cgcgctccgcgactacaaccagag

SEQ ID NO: 38187 - DNA, 24 bp, Artificial Sequence
  Description of Artificial Sequence: Synthetic oligonucleotide
gcgctccgcgactacaaccagagc

SEQ ID NO: 38188 - DNA, 25 bp, Artificial Sequence
  Description of Artificial Sequence: Synthetic oligonucleotide
cgctccgcgactacaaccagagcga

SEQ ID NO: 38189 - DNA, 25 bp, Artificial Sequence
  Description of Artificial Sequence: Synthetic oligonucleotide
gctccgcgactacaaccagagcgag

SEQ ID NO: 38190 - DNA, 25 bp, Artificial Sequence
  Description of Artificial Sequence: Synthetic oligonucleotide
ctccgcgactacaaccagagcgagg

SEQ ID NO: 38191 - DNA, 25 bp, Artificial Sequence
  Description of Artificial Sequence: Synthetic oligonucleotide
tccgcgactacaaccagagcgaggc

SEQ ID NO: 38192 - DNA, 24 bp, Artificial Sequence
  Description of Artificial Sequence: Synthetic oligonucleotide
ccgcgactacaaccagagcgaggc

SEQ ID NO: 38193 - DNA, 24 bp, Artificial Sequence
  Description of Artificial Sequence: Synthetic oligonucleotide
cgcgactacaaccagagcgaggcc

SEQ ID NO: 38194 - DNA, 24 bp, Artificial Sequence
  Description of Artificial Sequence: Synthetic oligonucleotide
gcgactacaaccagagcgaggccg

SEQ ID NO: 38195 - DNA, 24 bp, Artificial Sequence
  Description of Artificial Sequence: Synthetic oligonucleotide
cgactacaaccagagcgaggccgg

SEQ ID NO: 38196 - DNA, 25 bp, Artificial Sequence
  Description of Artificial Sequence: Synthetic oligonucleotide
gactacaaccagagcgaggccgggt

SEQ ID NO: 38197 - DNA, 29 bp, Artificial Sequence
  Description of Artificial Sequence: Synthetic oligonucleotide
gcataaccagttcgcctacgacggcaaag

SEQ ID NO: 38198 - DNA, 33 bp, Artificial Sequence
  Description of Artificial Sequence: Synthetic oligonucleotide
cataaccagttcgcctacgacggcaaagattac

SEQ ID NO: 38199 - DNA, 35 bp, Artificial Sequence
  Description of Artificial Sequence: Synthetic oligonucleotide
ataaccagttcgcctacgacggcaaagattacatc

SEQ ID NO: 38200 - DNA, 34 bp, Artificial Sequence
  Description of Artificial Sequence: Synthetic oligonucleotide
taaccagttcgcctacgacggcaaagattacatc

SEQ ID NO: 38201 - DNA, 33 bp, Artificial Sequence
  Description of Artificial Sequence: Synthetic oligonucleotide
aaccagttcgcctacgacggcaaagattacatc

SEQ ID NO: 38202 - DNA, 32 bp, Artificial Sequence
  Description of Artificial Sequence: Synthetic oligonucleotide
accagttcgcctacgacggcaaagattacatc

SEQ ID NO: 38203 - DNA, 31 bp, Artificial Sequence
  Description of Artificial Sequence: Synthetic oligonucleotide
ccagttcgcctacgacggcaaagattacatc

SEQ ID NO: 38204 - DNA, 31 bp, Artificial Sequence
  Description of Artificial Sequence: Synthetic oligonucleotide
cagttcgcctacgacggcaaagattacatcg

SEQ ID NO: 38205 - DNA, 31 bp, Artificial Sequence
  Description of Artificial Sequence: Synthetic oligonucleotide
agttcgcctacgacggcaaagattacatcgc

SEQ ID NO: 38206 - DNA, 30 bp, Artificial Sequence
  Description of Artificial Sequence: Synthetic oligonucleotide
gttcgcctacgacggcaaagattacatcgc

SEQ ID NO: 38207 - DNA, 30 bp, Artificial Sequence
  Description of Artificial Sequence: Synthetic oligonucleotide
ttcgcctacgacggcaaagattacatcgcc

SEQ ID NO: 38208 - DNA, 29 bp, Artificial Sequence
  Description of Artificial Sequence: Synthetic oligonucleotide
tcgcctacgacggcaaagattacatcgcc

SEQ ID NO: 38209 - DNA, 23 bp, Artificial Sequence
  Description of Artificial Sequence: Synthetic oligonucleotide
ggcgcctcctccgcgggcataaa

SEQ ID NO: 38210 - DNA, 24 bp, Artificial Sequence
  Description of Artificial Sequence: Synthetic oligonucleotide
gcgcctcctccgcgggcataaaca

SEQ ID NO: 38211 - DNA, 26 bp, Artificial Sequence
  Description of Artificial Sequence: Synthetic oligonucleotide
cgcctcctccgcgggcataaacagta

SEQ ID NO: 38212 - DNA, 26 bp, Artificial Sequence
  Description of Artificial Sequence: Synthetic oligonucleotide
gcctcctccgcgggcataaacagtac

SEQ ID NO: 38213 - DNA, 26 bp, Artificial Sequence
  Description of Artificial Sequence: Synthetic oligonucleotide
cctcctccgcgggcataaacagtacg

SEQ ID NO: 38214 - DNA, 26 bp, Artificial Sequence
  Description of Artificial Sequence: Synthetic oligonucleotide
ctcctccgcgggcataaacagtacgc

SEQ ID NO: 38215 - DNA, 27 bp, Artificial Sequence
  Description of Artificial Sequence: Synthetic oligonucleotide
tcctccgcgggcataaacagtacgcct

SEQ ID NO: 38216 - DNA, 27 bp, Artificial Sequence
  Description of Artificial Sequence: Synthetic oligonucleotide
cctccgcgggcataaacagtacgccta

SEQ ID NO: 38217 - DNA, 27 bp, Artificial Sequence
  Description of Artificial Sequence: Synthetic oligonucleotide
ctccgcgggcataaacagtacgcctac

SEQ ID NO: 38218 - DNA, 27 bp, Artificial Sequence
  Description of Artificial Sequence: Synthetic oligonucleotide
tccgcgggcataaacagtacgcctacg

SEQ ID NO: 38219 - DNA, 27 bp, Artificial Sequence
  Description of Artificial Sequence: Synthetic oligonucleotide
ccgcgggcataaacagtacgcctacga

SEQ ID NO: 38220 - DNA, 27 bp, Artificial Sequence
  Description of Artificial Sequence: Synthetic oligonucleotide
cgcgggcataaacagtacgcctacgac

SEQ ID NO: 38221 - DNA, 27 bp, Artificial Sequence
  Description of Artificial Sequence: Synthetic oligonucleotide
gcgggcataaacagtacgcctacgacg

SEQ ID NO: 38222 - DNA, 27 bp, Artificial Sequence
  Description of Artificial Sequence: Synthetic oligonucleotide
cgggcataaacagtacgcctacgacgg

SEQ ID NO: 38223 - DNA, 27 bp, Artificial Sequence
  Description of Artificial Sequence: Synthetic oligonucleotide
gggcataaacagtacgcctacgacggc

SEQ ID NO: 38224 - DNA, 30 bp, Artificial Sequence
  Description of Artificial Sequence: Synthetic oligonucleotide
ggcataaacagtacgcctacgacggcaaag

SEQ ID NO: 38225 - DNA, 34 bp, Artificial Sequence
  Description of Artificial Sequence: Synthetic oligonucleotide
gcataaacagtacgcctacgacggcaaagattac

SEQ ID NO: 38226 - DNA, 36 bp, Artificial Sequence
  Description of Artificial Sequence: Synthetic oligonucleotide
cataaacagtacgcctacgacggcaaagattacatc

SEQ ID NO: 38227 - DNA, 36 bp, Artificial Sequence
  Description of Artificial Sequence: Synthetic oligonucleotide
ataaacagtacgcctacgacggcaaagattacatcg

SEQ ID NO: 38228 - DNA, 35 bp, Artificial Sequence
  Description of Artificial Sequence: Synthetic oligonucleotide
taaacagtacgcctacgacggcaaagattacatcg

SEQ ID NO: 38229 - DNA, 34 bp, Artificial Sequence
  Description of Artificial Sequence: Synthetic oligonucleotide
aaacagtacgcctacgacggcaaagattacatcg

SEQ ID NO: 38230 - DNA, 33 bp, Artificial Sequence
  Description of Artificial Sequence: Synthetic oligonucleotide
aacagtacgcctacgacggcaaagattacatcg

SEQ ID NO: 38231 - DNA, 32 bp, Artificial Sequence
  Description of Artificial Sequence: Synthetic oligonucleotide
acagtacgcctacgacggcaaagattacatcg

SEQ ID NO: 38232 - DNA, 20 bp, Artificial Sequence
  Description of Artificial Sequence: Synthetic oligonucleotide
gtggggccggacgggcgtct

SEQ ID NO: 38233 - DNA, 20 bp, Artificial Sequence
  Description of Artificial Sequence: Synthetic oligonucleotide
tggggccggacgggcgtctc

SEQ ID NO: 38234 - DNA, 20 bp, Artificial Sequence
  Description of Artificial Sequence: Synthetic oligonucleotide
ggggccggacgggcgtctct

SEQ ID NO: 38235 - DNA, 20 bp, Artificial Sequence
  Description of Artificial Sequence: Synthetic oligonucleotide
gggccggacgggcgtctcct

SEQ ID NO: 38236 - DNA, 20 bp, Artificial Sequence
  Description of Artificial Sequence: Synthetic oligonucleotide
ggccggacgggcgtctcctc

SEQ ID NO: 38237 - DNA, 20 bp, Artificial Sequence
  Description of Artificial Sequence: Synthetic oligonucleotide
gccggacgggcgtctcctcc

SEQ ID NO: 38238 - DNA, 20 bp, Artificial Sequence
  Description of Artificial Sequence: Synthetic oligonucleotide
ccggacgggcgtctcctccg

SEQ ID NO: 38239 - DNA, 20 bp, Artificial Sequence
  Description of Artificial Sequence: Synthetic oligonucleotide
cggacgggcgtctcctccgc

SEQ ID NO: 38240 - DNA, 20 bp, Artificial Sequence
  Description of Artificial Sequence: Synthetic oligonucleotide
ggacgggcgtctcctccgcg

SEQ ID NO: 38241 - DNA, 26 bp, Artificial Sequence
  Description of Artificial Sequence: Synthetic oligonucleotide
gacgggcgtctcctccgcggttataa

SEQ ID NO: 38242 - DNA, 26 bp, Artificial Sequence
  Description of Artificial Sequence: Synthetic oligonucleotide
acgggcgtctcctccgcggttataac

SEQ ID NO: 38243 - DNA, 25 bp, Artificial Sequence
  Description of Artificial Sequence: Synthetic oligonucleotide
cgggcgtctcctccgcggttataac

SEQ ID NO: 38244 - DNA, 26 bp, Artificial Sequence
  Description of Artificial Sequence: Synthetic oligonucleotide
gggcgtctcctccgcggttataacca

SEQ ID NO: 38245 - DNA, 27 bp, Artificial Sequence
  Description of Artificial Sequence: Synthetic oligonucleotide
ggcgtctcctccgcggttataaccagt

SEQ ID NO: 38246 - DNA, 28 bp, Artificial Sequence
  Description of Artificial Sequence: Synthetic oligonucleotide
gcgtctcctccgcggttataaccagtac

SEQ ID NO: 38247 - DNA, 28 bp, Artificial Sequence
  Description of Artificial Sequence: Synthetic oligonucleotide
cgtctcctccgcggttataaccagtacg

SEQ ID NO: 38248 - DNA, 28 bp, Artificial Sequence
  Description of Artificial Sequence: Synthetic oligonucleotide
gtctcctccgcggttataaccagtacgc

SEQ ID NO: 38249 - DNA, 28 bp, Artificial Sequence
  Description of Artificial Sequence: Synthetic oligonucleotide
tctcctccgcggttataaccagtacgcc

SEQ ID NO: 38250 - DNA, 27 bp, Artificial Sequence
  Description of Artificial Sequence: Synthetic oligonucleotide
ctcctccgcggttataaccagtacgcc

SEQ ID NO: 38251 - DNA, 29 bp, Artificial Sequence
  Description of Artificial Sequence: Synthetic oligonucleotide
tcctccgcggttataaccagtacgcctac

SEQ ID NO: 38252 - DNA, 28 bp, Artificial Sequence
  Description of Artificial Sequence: Synthetic oligonucleotide
cctccgcggttataaccagtacgcctac

SEQ ID NO: 38253 - DNA, 28 bp, Artificial Sequence
  Description of Artificial Sequence: Synthetic oligonucleotide
ctccgcggttataaccagtacgcctacg

SEQ ID NO: 38254 - DNA, 29 bp, Artificial Sequence
  Description of Artificial Sequence: Synthetic oligonucleotide
tccgcggttataaccagtacgcctacgac

SEQ ID NO: 38255 - DNA, 28 bp, Artificial Sequence
  Description of Artificial Sequence: Synthetic oligonucleotide
ccgcggttataaccagtacgcctacgac

SEQ ID NO: 38256 - DNA, 28 bp, Artificial Sequence
  Description of Artificial Sequence: Synthetic oligonucleotide
cgcggttataaccagtacgcctacgacg

SEQ ID NO: 38257 - DNA, 28 bp, Artificial Sequence
  Description of Artificial Sequence: Synthetic oligonucleotide
gcggttataaccagtacgcctacgacgg

SEQ ID NO: 38258 - DNA, 28 bp, Artificial Sequence
  Description of Artificial Sequence: Synthetic oligonucleotide
cggttataaccagtacgcctacgacggc

SEQ ID NO: 38259 - DNA, 31 bp, Artificial Sequence
  Description of Artificial Sequence: Synthetic oligonucleotide
ggttataaccagtacgcctacgacggcaaag

SEQ ID NO: 38260 - DNA, 35 bp, Artificial Sequence
  Description of Artificial Sequence: Synthetic oligonucleotide
gttataaccagtacgcctacgacggcaaagattac

SEQ ID NO: 38261 - DNA, 37 bp, Artificial Sequence
  Description of Artificial Sequence: Synthetic oligonucleotide
ttataaccagtacgcctacgacggcaaagattacatc

SEQ ID NO: 38262 - DNA, 36 bp, Artificial Sequence
  Description of Artificial Sequence: Synthetic oligonucleotide
tataaccagtacgcctacgacggcaaagattacatc

SEQ ID NO: 38263 - DNA, 20 bp, Artificial Sequence
  Description of Artificial Sequence: Synthetic oligonucleotide
cggacgggcgcctcctccct

SEQ ID NO: 38264 - DNA, 20 bp, Artificial Sequence
  Description of Artificial Sequence: Synthetic oligonucleotide
ggacgggcgcctcctcccct

SEQ ID NO: 38265 - DNA, 20 bp, Artificial Sequence
  Description of Artificial Sequence: Synthetic oligonucleotide
gacgggcgcctcctccccgt

SEQ ID NO: 38266 - DNA, 20 bp, Artificial Sequence
  Description of Artificial Sequence: Synthetic oligonucleotide
acgggcgcctcctccccggt

SEQ ID NO: 38267 - DNA, 20 bp, Artificial Sequence
  Description of Artificial Sequence: Synthetic oligonucleotide
cgggcgcctcctccccggtt

SEQ ID NO: 38268 - DNA, 20 bp, Artificial Sequence
  Description of Artificial Sequence: Synthetic oligonucleotide
gggcgcctcctccccgggtt

SEQ ID NO: 38269 - DNA, 22 bp, Artificial Sequence
  Description of Artificial Sequence: Synthetic oligonucleotide
ggcgcctcctccccgggcataa

SEQ ID NO: 38270 - DNA, 22 bp, Artificial Sequence
  Description of Artificial Sequence: Synthetic oligonucleotide
gcgcctcctccccgggcataac

SEQ ID NO: 38271 - DNA, 23 bp, Artificial Sequence
  Description of Artificial Sequence: Synthetic oligonucleotide
cgcctcctccccgggcataacca

SEQ ID NO: 38272 - DNA, 25 bp, Artificial Sequence
  Description of Artificial Sequence: Synthetic oligonucleotide
gcctcctccccgggcataaccagta

SEQ ID NO: 38273 - DNA, 25 bp, Artificial Sequence
  Description of Artificial Sequence: Synthetic oligonucleotide
cctcctccccgggcataaccagtac

SEQ ID NO: 38274 - DNA, 25 bp, Artificial Sequence
  Description of Artificial Sequence: Synthetic oligonucleotide
ctcctccccgggcataaccagtacg

SEQ ID NO: 38275 - DNA, 25 bp, Artificial Sequence
  Description of Artificial Sequence: Synthetic oligonucleotide
tcctccccgggcataaccagtacgc

SEQ ID NO: 38276 - DNA, 24 bp, Artificial Sequence
  Description of Artificial Sequence: Synthetic oligonucleotide
cctccccgggcataaccagtacgc

SEQ ID NO: 38277 - DNA, 26 bp, Artificial Sequence
  Description of Artificial Sequence: Synthetic oligonucleotide
ctccccgggcataaccagtacgccta

SEQ ID NO: 38278 - DNA, 26 bp, Artificial Sequence
  Description of Artificial Sequence: Synthetic oligonucleotide
tccccgggcataaccagtacgcctac

SEQ ID NO: 38279 - DNA, 25 bp, Artificial Sequence
  Description of Artificial Sequence: Synthetic oligonucleotide
ccccgggcataaccagtacgcctac

SEQ ID NO: 38280 - DNA, 26 bp, Artificial Sequence
  Description of Artificial Sequence: Synthetic oligonucleotide
cccgggcataaccagtacgcctacga

SEQ ID NO: 38281 - DNA, 26 bp, Artificial Sequence
  Description of Artificial Sequence: Synthetic oligonucleotide
ccgggcataaccagtacgcctacgac

SEQ ID NO: 38282 - DNA, 22 bp, Artificial Sequence
  Description of Artificial Sequence: Synthetic oligonucleotide
gccgcgagtccgaggacggaga

SEQ ID NO: 38283 - DNA, 22 bp, Artificial Sequence
  Description of Artificial Sequence: Synthetic oligonucleotide
ccgcgagtccgaggacggagac

SEQ ID NO: 38284 - DNA, 22 bp, Artificial Sequence
  Description of Artificial Sequence: Synthetic oligonucleotide
cgcgagtccgaggacggagacc

SEQ ID NO: 38285 - DNA, 22 bp, Artificial Sequence
  Description of Artificial Sequence: Synthetic oligonucleotide
gcgagtccgaggacggagaccc

SEQ ID NO: 38286 - DNA, 22 bp, Artificial Sequence
  Description of Artificial Sequence: Synthetic oligonucleotide
cgagtccgaggacggagacccg

SEQ ID NO: 38287 - DNA, 22 bp, Artificial Sequence
  Description of Artificial Sequence: Synthetic oligonucleotide
gagtccgaggacggagacccgg

SEQ ID NO: 38288 - DNA, 22 bp, Artificial Sequence
  Description of Artificial Sequence: Synthetic oligonucleotide
agtccgaggacggagacccggg

SEQ ID NO: 38289 - DNA, 21 bp, Artificial Sequence
  Description of Artificial Sequence: Synthetic oligonucleotide
gtccgaggacggagacccggg

SEQ ID NO: 38290 - DNA, 21 bp, Artificial Sequence
  Description of Artificial Sequence: Synthetic oligonucleotide
tccgaggacggagacccgggc

SEQ ID NO: 38291 - DNA, 20 bp, Artificial Sequence
  Description of Artificial Sequence: Synthetic oligonucleotide
ccgaggacggagacccgggc

SEQ ID NO: 38292 - DNA, 20 bp, Artificial Sequence
  Description of Artificial Sequence: Synthetic oligonucleotide
cgaggacggagacccgggcg

SEQ ID NO: 38293 - DNA, 20 bp, Artificial Sequence
  Description of Artificial Sequence: Synthetic oligonucleotide
gaggacggagacccgggcgc

SEQ ID NO: 38294 - DNA, 22 bp, Artificial Sequence
  Description of Artificial Sequence: Synthetic oligonucleotide
aggacggagacccgggcgccat

SEQ ID NO: 38295 - DNA, 21 bp, Artificial Sequence
  Description of Artificial Sequence: Synthetic oligonucleotide
ggacggagacccgggcgccat

SEQ ID NO: 38296 - DNA, 21 bp, Artificial Sequence
  Description of Artificial Sequence: Synthetic oligonucleotide
gacggagacccgggcgccatg

SEQ ID NO: 38297 - DNA, 24 bp, Artificial Sequence
  Description of Artificial Sequence: Synthetic oligonucleotide
acggagacccgggcgccatggata

SEQ ID NO: 38298 - DNA, 23 bp, Artificial Sequence
  Description of Artificial Sequence: Synthetic oligonucleotide
cggagacccgggcgccatggata

SEQ ID NO: 38299 - DNA, 24 bp, Artificial Sequence
  Description of Artificial Sequence: Synthetic oligonucleotide
ggagacccgggcgccatggataga

SEQ ID NO: 38300 - DNA, 24 bp, Artificial Sequence
  Description of Artificial Sequence: Synthetic oligonucleotide
gagacccgggcgccatggatagag

SEQ ID NO: 38301 - DNA, 25 bp, Artificial Sequence
  Description of Artificial Sequence: Synthetic oligonucleotide
agacccgggcgccatggatagagca

SEQ ID NO: 38302 - DNA, 24 bp, Artificial Sequence
  Description of Artificial Sequence: Synthetic oligonucleotide
gacccgggcgccatggatagagca

SEQ ID NO: 38303 - DNA, 24 bp, Artificial Sequence
  Description of Artificial Sequence: Synthetic oligonucleotide
acccgggcgccatggatagagcag

SEQ ID NO: 38304 - DNA, 25 bp, Artificial Sequence
  Description of Artificial Sequence: Synthetic oligonucleotide
cggacaccgcggctcagatcaccta

SEQ ID NO: 38305 - DNA, 25 bp, Artificial Sequence
  Description of Artificial Sequence: Synthetic oligonucleotide
ggacaccgcggctcagatcacctag

SEQ ID NO: 38306 - DNA, 25 bp, Artificial Sequence
  Description of Artificial Sequence: Synthetic oligonucleotide
gacaccgcggctcagatcacctagc

SEQ ID NO: 38307 - DNA, 25 bp, Artificial Sequence
  Description of Artificial Sequence: Synthetic oligonucleotide
acaccgcggctcagatcacctagcg

SEQ ID NO: 38308 - DNA, 24 bp, Artificial Sequence
  Description of Artificial Sequence: Synthetic oligonucleotide
caccgcggctcagatcacctagcg

SEQ ID NO: 38309 - DNA, 26 bp, Artificial Sequence
  Description of Artificial Sequence: Synthetic oligonucleotide
accgcggctcagatcacctagcgcaa

SEQ ID NO: 38310 - DNA, 25 bp, Artificial Sequence
  Description of Artificial Sequence: Synthetic oligonucleotide
ccgcggctcagatcacctagcgcaa

SEQ ID NO: 38311 - DNA, 26 bp, Artificial Sequence
  Description of Artificial Sequence: Synthetic oligonucleotide
cgcggctcagatcacctagcgcaagt

SEQ ID NO: 38312 - DNA, 24 bp, Artificial Sequence
  Description of Artificial Sequence: Synthetic oligonucleotide
gccatggatagagcaggaggggcg

SEQ ID NO: 38313 - DNA, 24 bp, Artificial Sequence
  Description of Artificial Sequence: Synthetic oligonucleotide
ccatggatagagcaggaggggcgg

SEQ ID NO: 38314 - DNA, 25 bp, Artificial Sequence
  Description of Artificial Sequence: Synthetic oligonucleotide
catggatagagcaggaggggcggga

SEQ ID NO: 38315 - DNA, 27 bp, Artificial Sequence
  Description of Artificial Sequence: Synthetic oligonucleotide
atggatagagcaggaggggcgggagta

SEQ ID NO: 38316 - DNA, 27 bp, Artificial Sequence
  Description of Artificial Sequence: Synthetic oligonucleotide
tggatagagcaggaggggcgggagtat

SEQ ID NO: 38317 - DNA, 27 bp, Artificial Sequence
  Description of Artificial Sequence: Synthetic oligonucleotide
ggatagagcaggaggggcgggagtatt

SEQ ID NO: 38318 - DNA, 27 bp, Artificial Sequence
  Description of Artificial Sequence: Synthetic oligonucleotide
gatagagcaggaggggcgggagtattg

SEQ ID NO: 38319 - DNA, 27 bp, Artificial Sequence
  Description of Artificial Sequence: Synthetic oligonucleotide
atagagcaggaggggcgggagtattgg

SEQ ID NO: 38320 - DNA, 26 bp, Artificial Sequence
  Description of Artificial Sequence: Synthetic oligonucleotide
tagagcaggaggggcgggagtattgg

SEQ ID NO: 38321 - DNA, 25 bp, Artificial Sequence
  Description of Artificial Sequence: Synthetic oligonucleotide
agagcaggaggggcgggagtattgg

SEQ ID NO: 38322 - DNA, 24 bp, Artificial Sequence
  Description of Artificial Sequence: Synthetic oligonucleotide
gagcaggaggggcgggagtattgg

SEQ ID NO: 38323 - DNA, 25 bp, Artificial Sequence
  Description of Artificial Sequence: Synthetic oligonucleotide
agcaggaggggcgggagtattggga

SEQ ID NO: 38324 - DNA, 24 bp, Artificial Sequence
  Description of Artificial Sequence: Synthetic oligonucleotide
gcaggaggggcgggagtattggga

SEQ ID NO: 38325 - DNA, 24 bp, Artificial Sequence
  Description of Artificial Sequence: Synthetic oligonucleotide
caggaggggcgggagtattgggac

SEQ ID NO: 38326 - DNA, 24 bp, Artificial Sequence
  Description of Artificial Sequence: Synthetic oligonucleotide
aggaggggcgggagtattgggacc

SEQ ID NO: 38327 - DNA, 23 bp, Artificial Sequence
  Description of Artificial Sequence: Synthetic oligonucleotide
ggaggggcgggagtattgggacc

SEQ ID NO: 38328 - DNA, 23 bp, Artificial Sequence
  Description of Artificial Sequence: Synthetic oligonucleotide
gaggggcgggagtattgggaccg

SEQ ID NO: 38329 - DNA, 25 bp, Artificial Sequence
  Description of Artificial Sequence: Synthetic oligonucleotide
aggggcgggagtattgggaccggaa

SEQ ID NO: 38330 - DNA, 24 bp, Artificial Sequence
  Description of Artificial Sequence: Synthetic oligonucleotide
ggggcgggagtattgggaccggaa

SEQ ID NO: 38331 - DNA, 25 bp, Artificial Sequence
  Description of Artificial Sequence: Synthetic oligonucleotide
gggcgggagtattgggaccggaaca

SEQ ID NO: 38332 - DNA, 26 bp, Artificial Sequence
  Description of Artificial Sequence: Synthetic oligonucleotide
ggcgggagtattgggaccggaacaca

SEQ ID NO: 38333 - DNA, 27 bp, Artificial Sequence
  Description of Artificial Sequence: Synthetic oligonucleotide
gcgggagtattgggaccggaacacaca

SEQ ID NO: 38334 - DNA, 27 bp, Artificial Sequence
  Description of Artificial Sequence: Synthetic oligonucleotide
cgggagtattgggaccggaacacacag

SEQ ID NO: 38335 - DNA, 29 bp, Artificial Sequence
  Description of Artificial Sequence: Synthetic oligonucleotide
gggagtattgggaccggaacacacagatc

SEQ ID NO: 38336 - DNA, 28 bp, Artificial Sequence
  Description of Artificial Sequence: Synthetic oligonucleotide
cttgtggagaccagaccagcaggagatg

SEQ ID NO: 38337 - DNA, 28 bp, Artificial Sequence
  Description of Artificial Sequence: Synthetic oligonucleotide
ttgtggagaccagaccagcaggagatgg

SEQ ID NO: 38338 - DNA, 27 bp, Artificial Sequence
  Description of Artificial Sequence: Synthetic oligonucleotide
tgtggagaccagaccagcaggagatgg

SEQ ID NO: 38339 - DNA, 27 bp, Artificial Sequence
  Description of Artificial Sequence: Synthetic oligonucleotide
gtggagaccagaccagcaggagatgga

SEQ ID NO: 38340 - DNA, 28 bp, Artificial Sequence
  Description of Artificial Sequence: Synthetic oligonucleotide
tggagaccagaccagcaggagatggaac

SEQ ID NO: 38341 - DNA, 27 bp, Artificial Sequence
  Description of Artificial Sequence: Synthetic oligonucleotide
ggagaccagaccagcaggagatggaac

SEQ ID NO: 38342 - DNA, 27 bp, Artificial Sequence
  Description of Artificial Sequence: Synthetic oligonucleotide
gagaccagaccagcaggagatggaacc

SEQ ID NO: 38343 - DNA, 29 bp, Artificial Sequence
  Description of Artificial Sequence: Synthetic oligonucleotide
agaccagaccagcaggagatggaaccttc

SEQ ID NO: 38344 - DNA, 28 bp, Artificial Sequence
  Description of Artificial Sequence: Synthetic oligonucleotide
gaccagaccagcaggagatggaaccttc

SEQ ID NO: 38345 - DNA, 28 bp, Artificial Sequence
  Description of Artificial Sequence: Synthetic oligonucleotide
accagaccagcaggagatggaaccttcc

SEQ ID NO: 38346 - DNA, 27 bp, Artificial Sequence
  Description of Artificial Sequence: Synthetic oligonucleotide
ccagaccagcaggagatggaaccttcc

SEQ ID NO: 38347 - DNA, 28 bp, Artificial Sequence
  Description of Artificial Sequence: Synthetic oligonucleotide
cagaccagcaggagatggaaccttccag

SEQ ID NO: 38348 - DNA, 30 bp, Artificial Sequence
  Description of Artificial Sequence: Synthetic oligonucleotide
agaccagcaggagatggaaccttccagaag

SEQ ID NO: 38349 - DNA, 29 bp, Artificial Sequence
  Description of Artificial Sequence: Synthetic oligonucleotide
gaccagcaggagatggaaccttccagaag

SEQ ID NO: 38350 - DNA, 30 bp, Artificial Sequence
  Description of Artificial Sequence: Synthetic oligonucleotide
accagcaggagatggaaccttccagaagtg

SEQ ID NO: 38351 - DNA, 29 bp, Artificial Sequence
  Description of Artificial Sequence: Synthetic oligonucleotide
ccagcaggagatggaaccttccagaagtg

SEQ ID NO: 38352 - DNA, 29 bp, Artificial Sequence
  Description of Artificial Sequence: Synthetic oligonucleotide
cagcaggagatggaaccttccagaagtgg

SEQ ID NO: 38353 - DNA, 29 bp, Artificial Sequence
  Description of Artificial Sequence: Synthetic oligonucleotide
agcaggagatggaaccttccagaagtggg

SEQ ID NO: 38354 - DNA, 28 bp, Artificial Sequence
  Description of Artificial Sequence: Synthetic oligonucleotide
gcaggagatggaaccttccagaagtggg

SEQ ID NO: 38355 - DNA, 28 bp, Artificial Sequence
  Description of Artificial Sequence: Synthetic oligonucleotide
caggagatggaaccttccagaagtgggc

SEQ ID NO: 38356 - DNA, 29 bp, Artificial Sequence
  Description of Artificial Sequence: Synthetic oligonucleotide
aggagatggaaccttccagaagtgggcag

SEQ ID NO: 38357 - DNA, 28 bp, Artificial Sequence
  Description of Artificial Sequence: Synthetic oligonucleotide
ggagatggaaccttccagaagtgggcag

SEQ ID NO: 38358 - DNA, 28 bp, Artificial Sequence
  Description of Artificial Sequence: Synthetic oligonucleotide
gagatggaaccttccagaagtgggcagc

SEQ ID NO: 38359 - DNA, 29 bp, Artificial Sequence
  Description of Artificial Sequence: Synthetic oligonucleotide
agatggaaccttccagaagtgggcagctg

SEQ ID NO: 38360 - DNA, 27 bp, Artificial Sequence
  Description of Artificial Sequence: Synthetic oligonucleotide
cgggcataaccagtacgcctacgacga

SEQ ID NO: 38361 - DNA, 27 bp, Artificial Sequence
  Description of Artificial Sequence: Synthetic oligonucleotide
gggcataaccagtacgcctacgacgac

SEQ ID NO: 38362 - DNA, 30 bp, Artificial Sequence
  Description of Artificial Sequence: Synthetic oligonucleotide
ggcataaccagtacgcctacgacgacaaag

SEQ ID NO: 38363 - DNA, 34 bp, Artificial Sequence
  Description of Artificial Sequence: Synthetic oligonucleotide
gcataaccagtacgcctacgacgacaaagattac

SEQ ID NO: 38364 - DNA, 36 bp, Artificial Sequence
  Description of Artificial Sequence: Synthetic oligonucleotide
cataaccagtacgcctacgacgacaaagattacatc

SEQ ID NO: 38365 - DNA, 36 bp, Artificial Sequence
  Description of Artificial Sequence: Synthetic oligonucleotide
ataaccagtacgcctacgacgacaaagattacatcg

SEQ ID NO: 38366 - DNA, 35 bp, Artificial Sequence
  Description of Artificial Sequence: Synthetic oligonucleotide
taaccagtacgcctacgacgacaaagattacatcg

SEQ ID NO: 38367 - DNA, 34 bp, Artificial Sequence
  Description of Artificial Sequence: Synthetic oligonucleotide
aaccagtacgcctacgacgacaaagattacatcg

SEQ ID NO: 38368 - DNA, 33 bp, Artificial Sequence
  Description of Artificial Sequence: Synthetic oligonucleotide
accagtacgcctacgacgacaaagattacatcg

SEQ ID NO: 38369 - DNA, 32 bp, Artificial Sequence
  Description of Artificial Sequence: Synthetic oligonucleotide
ccagtacgcctacgacgacaaagattacatcg

SEQ ID NO: 38370 - DNA, 32 bp, Artificial Sequence
  Description of Artificial Sequence: Synthetic oligonucleotide
cagtacgcctacgacgacaaagattacatcgc

SEQ ID NO: 38371 - DNA, 32 bp, Artificial Sequence
  Description of Artificial Sequence: Synthetic oligonucleotide
agtacgcctacgacgacaaagattacatcgcc

SEQ ID NO: 38372 - DNA, 31 bp, Artificial Sequence
  Description of Artificial Sequence: Synthetic oligonucleotide
gtacgcctacgacgacaaagattacatcgcc

SEQ ID NO: 38373 - DNA, 31 bp, Artificial Sequence
  Description of Artificial Sequence: Synthetic oligonucleotide
tacgcctacgacgacaaagattacatcgccc

SEQ ID NO: 38374 - DNA, 30 bp, Artificial Sequence
  Description of Artificial Sequence: Synthetic oligonucleotide
acgcctacgacgacaaagattacatcgccc

SEQ ID NO: 38375 - DNA, 29 bp, Artificial Sequence
  Description of Artificial Sequence: Synthetic oligonucleotide
cgcctacgacgacaaagattacatcgccc

SEQ ID NO: 38376 - DNA, 30 bp, Artificial Sequence
  Description of Artificial Sequence: Synthetic oligonucleotide
gcctacgacgacaaagattacatcgccctg

SEQ ID NO: 38377 - DNA, 32 bp, Artificial Sequence
  Description of Artificial Sequence: Synthetic oligonucleotide
cctacgacgacaaagattacatcgccctgaac

SEQ ID NO: 38378 - DNA, 32 bp, Artificial Sequence
  Description of Artificial Sequence: Synthetic oligonucleotide
ctacgacgacaaagattacatcgccctgaacg

SEQ ID NO: 38379 - DNA, 33 bp, Artificial Sequence
  Description of Artificial Sequence: Synthetic oligonucleotide
tacgacgacaaagattacatcgccctgaacgag

SEQ ID NO: 38380 - DNA, 32 bp, Artificial Sequence
  Description of Artificial Sequence: Synthetic oligonucleotide
acgacgacaaagattacatcgccctgaacgag

SEQ ID NO: 38381 - DNA, 31 bp, Artificial Sequence
  Description of Artificial Sequence: Synthetic oligonucleotide
cgacgacaaagattacatcgccctgaacgag

SEQ ID NO: 38382 - DNA, 31 bp, Artificial Sequence
  Description of Artificial Sequence: Synthetic oligonucleotide
gacgacaaagattacatcgccctgaacgagg

SEQ ID NO: 38383 - DNA, 32 bp, Artificial Sequence
  Description of Artificial Sequence: Synthetic oligonucleotide
acgacaaagattacatcgccctgaacgaggac

SEQ ID NO: 38384 - DNA, 31 bp, Artificial Sequence
  Description of Artificial Sequence: Synthetic oligonucleotide
cgacaaagattacatcgccctgaacgaggac

SEQ ID NO: 38385 - DNA, 31 bp, Artificial Sequence
  Description of Artificial Sequence: Synthetic oligonucleotide
gacaaagattacatcgccctgaacgaggacc

SEQ ID NO: 38386 - DNA, 32 bp, Artificial Sequence
  Description of Artificial Sequence: Synthetic oligonucleotide
acaaagattacatcgccctgaacgaggacctg

SEQ ID NO: 38387 - DNA, 32 bp, Artificial Sequence
  Description of Artificial Sequence: Synthetic oligonucleotide
cagtacgcctacgacggcaaagattacatctc

SEQ ID NO: 38388 - DNA, 32 bp, Artificial Sequence
  Description of Artificial Sequence: Synthetic oligonucleotide
agtacgcctacgacggcaaagattacatctcc

SEQ ID NO: 38389 - DNA, 31 bp, Artificial Sequence
  Description of Artificial Sequence: Synthetic oligonucleotide
gtacgcctacgacggcaaagattacatctcc

SEQ ID NO: 38390 - DNA, 31 bp, Artificial Sequence
  Description of Artificial Sequence: Synthetic oligonucleotide
tacgcctacgacggcaaagattacatctccc

SEQ ID NO: 38391 - DNA, 30 bp, Artificial Sequence
  Description of Artificial Sequence: Synthetic oligonucleotide
acgcctacgacggcaaagattacatctccc

SEQ ID NO: 38392 - DNA, 29 bp, Artificial Sequence
  Description of Artificial Sequence: Synthetic oligonucleotide
cgcctacgacggcaaagattacatctccc

SEQ ID NO: 38393 - DNA, 30 bp, Artificial Sequence
  Description of Artificial Sequence: Synthetic oligonucleotide
gcctacgacggcaaagattacatctccctg

SEQ ID NO: 38394 - DNA, 32 bp, Artificial Sequence
  Description of Artificial Sequence: Synthetic oligonucleotide
cctacgacggcaaagattacatctccctgaac

SEQ ID NO: 38395 - DNA, 32 bp, Artificial Sequence
  Description of Artificial Sequence: Synthetic oligonucleotide
ctacgacggcaaagattacatctccctgaacg

SEQ ID NO: 38396 - DNA, 33 bp, Artificial Sequence
  Description of Artificial Sequence: Synthetic oligonucleotide
tacgacggcaaagattacatctccctgaacgag

SEQ ID NO: 38397 - DNA, 32 bp, Artificial Sequence
  Description of Artificial Sequence: Synthetic oligonucleotide
acgacggcaaagattacatctccctgaacgag

SEQ ID NO: 38398 - DNA, 31 bp, Artificial Sequence
  Description of Artificial Sequence: Synthetic oligonucleotide
cgacggcaaagattacatctccctgaacgag

SEQ ID NO: 38399 - DNA, 31 bp, Artificial Sequence
  Description of Artificial Sequence: Synthetic oligonucleotide
gacggcaaagattacatctccctgaacgagg

SEQ ID NO: 38400 - DNA, 32 bp, Artificial Sequence
  Description of Artificial Sequence: Synthetic oligonucleotide
acggcaaagattacatctccctgaacgaggac

SEQ ID NO: 38401 - DNA, 31 bp, Artificial Sequence
  Description of Artificial Sequence: Synthetic oligonucleotide
cggcaaagattacatctccctgaacgaggac

SEQ ID NO: 38402 - DNA, 31 bp, Artificial Sequence
  Description of Artificial Sequence: Synthetic oligonucleotide
ggcaaagattacatctccctgaacgaggacc

SEQ ID NO: 38403 - DNA, 32 bp, Artificial Sequence
  Description of Artificial Sequence: Synthetic oligonucleotide
gcaaagattacatctccctgaacgaggacctg

SEQ ID NO: 38404 - DNA, 33 bp, Artificial Sequence
  Description of Artificial Sequence: Synthetic oligonucleotide
caaagattacatctccctgaacgaggacctgag

SEQ ID NO: 38405 - DNA, 33 bp, Artificial Sequence
  Description of Artificial Sequence: Synthetic oligonucleotide
aaagattacatctccctgaacgaggacctgagc

SEQ ID NO: 38406 - DNA, 32 bp, Artificial Sequence
  Description of Artificial Sequence: Synthetic oligonucleotide
aagattacatctccctgaacgaggacctgagc

SEQ ID NO: 38407 - DNA, 31 bp, Artificial Sequence
  Description of Artificial Sequence: Synthetic oligonucleotide
agattacatctccctgaacgaggacctgagc

SEQ ID NO: 38408 - DNA, 30 bp, Artificial Sequence
  Description of Artificial Sequence: Synthetic oligonucleotide
gattacatctccctgaacgaggacctgagc

SEQ ID NO: 38409 - DNA, 31 bp, Artificial Sequence
  Description of Artificial Sequence: Synthetic oligonucleotide
attacatctccctgaacgaggacctgagctc

SEQ ID NO: 38410 - DNA, 30 bp, Artificial Sequence
  Description of Artificial Sequence: Synthetic oligonucleotide
ttacatctccctgaacgaggacctgagctc

SEQ ID NO: 38411 - DNA, 29 bp, Artificial Sequence
  Description of Artificial Sequence: Synthetic oligonucleotide
tacatctccctgaacgaggacctgagctc

SEQ ID NO: 38412 - DNA, 28 bp, Artificial Sequence
  Description of Artificial Sequence: Synthetic oligonucleotide
acatctccctgaacgaggacctgagctc

SEQ ID NO: 38413 - DNA, 27 bp, Artificial Sequence
  Description of Artificial Sequence: Synthetic oligonucleotide
catctccctgaacgaggacctgagctc

SEQ ID NO: 38414 - DNA, 27 bp, Artificial Sequence
  Description of Artificial Sequence: Synthetic oligonucleotide
atctccctgaacgaggacctgagctcc

SEQ ID NO: 38415 - DNA, 27 bp, Artificial Sequence
  Description of Artificial Sequence: Synthetic oligonucleotide
tctccctgaacgaggacctgagctcct

SEQ ID NO: 38416 - DNA, 26 bp, Artificial Sequence
  Description of Artificial Sequence: Synthetic oligonucleotide
ctccctgaacgaggacctgagctcct

SEQ ID NO: 38417 - DNA, 26 bp, Artificial Sequence
  Description of Artificial Sequence: Synthetic oligonucleotide
tccctgaacgaggacctgagctcctg

SEQ ID NO: 38418 - DNA, 20 bp, Artificial Sequence
  Description of Artificial Sequence: Synthetic oligonucleotide
gagccccgggcgccgtggtt

SEQ ID NO: 38419 - DNA, 20 bp, Artificial Sequence
  Description of Artificial Sequence: Synthetic oligonucleotide
agccccgggcgccgtgggtt

SEQ ID NO: 38420 - DNA, 20 bp, Artificial Sequence
  Description of Artificial Sequence: Synthetic oligonucleotide
gccccgggcgccgtgggttt

SEQ ID NO: 38421 - DNA, 20 bp, Artificial Sequence
  Description of Artificial Sequence: Synthetic oligonucleotide
ccccgggcgccgtgggtgtt

SEQ ID NO: 38422 - DNA, 20 bp, Artificial Sequence
  Description of Artificial Sequence: Synthetic oligonucleotide
cccgggcgccgtgggtggat

SEQ ID NO: 38423 - DNA, 20 bp, Artificial Sequence
  Description of Artificial Sequence: Synthetic oligonucleotide
ccgggcgccgtgggtggagt

SEQ ID NO: 38424 - DNA, 38 bp, Artificial Sequence
  Description of Artificial Sequence: Synthetic oligonucleotide
aacacacagatcttcaagaccaacacacagacttactg

SEQ ID NO: 38425 - DNA, 37 bp, Artificial Sequence
  Description of Artificial Sequence: Synthetic oligonucleotide
acacacagatcttcaagaccaacacacagacttactg

SEQ ID NO: 38426 - DNA, 36 bp, Artificial Sequence
  Description of Artificial Sequence: Synthetic oligonucleotide
cacacagatcttcaagaccaacacacagacttactg

SEQ ID NO: 38427 - DNA, 37 bp, Artificial Sequence
  Description of Artificial Sequence: Synthetic oligonucleotide
acacagatcttcaagaccaacacacagacttactgag

SEQ ID NO: 38428 - DNA, 36 bp, Artificial Sequence
  Description of Artificial Sequence: Synthetic oligonucleotide
cacagatcttcaagaccaacacacagacttactgag

SEQ ID NO: 38429 - DNA, 37 bp, Artificial Sequence
  Description of Artificial Sequence: Synthetic oligonucleotide
acagatcttcaagaccaacacacagacttactgagag

SEQ ID NO: 38430 - DNA, 36 bp, Artificial Sequence
  Description of Artificial Sequence: Synthetic oligonucleotide
cagatcttcaagaccaacacacagacttactgagag

SEQ ID NO: 38431 - DNA, 38 bp, Artificial Sequence
  Description of Artificial Sequence: Synthetic oligonucleotide
agatcttcaagaccaacacacagacttactgagagaac

SEQ ID NO: 38432 - DNA, 37 bp, Artificial Sequence
  Description of Artificial Sequence: Synthetic oligonucleotide
gatcttcaagaccaacacacagacttactgagagaac

SEQ ID NO: 38433 - DNA, 37 bp, Artificial Sequence
  Description of Artificial Sequence: Synthetic oligonucleotide
atcttcaagaccaacacacagacttactgagagaacc

SEQ ID NO: 38434 - DNA, 36 bp, Artificial Sequence
  Description of Artificial Sequence: Synthetic oligonucleotide
tcttcaagaccaacacacagacttactgagagaacc

SEQ ID NO: 38435 - DNA, 35 bp, Artificial Sequence
  Description of Artificial Sequence: Synthetic oligonucleotide
cttcaagaccaacacacagacttactgagagaacc

SEQ ID NO: 38436 - DNA, 36 bp, Artificial Sequence
  Description of Artificial Sequence: Synthetic oligonucleotide
ttcaagaccaacacacagacttactgagagaacctg

SEQ ID NO: 38437 - DNA, 35 bp, Artificial Sequence
  Description of Artificial Sequence: Synthetic oligonucleotide
tcaagaccaacacacagacttactgagagaacctg

SEQ ID NO: 38438 - DNA, 31 bp, Artificial Sequence
  Description of Artificial Sequence: Synthetic oligonucleotide
caacacacagacttactgagagaacctgcgg

SEQ ID NO: 38439 - DNA, 33 bp, Artificial Sequence
  Description of Artificial Sequence: Synthetic oligonucleotide
aacacacagacttactgagagaacctgcggatc

SEQ ID NO: 38440 - DNA, 32 bp, Artificial Sequence
  Description of Artificial Sequence: Synthetic oligonucleotide
acacacagacttactgagagaacctgcggatc

SEQ ID NO: 38441 - DNA, 31 bp, Artificial Sequence
  Description of Artificial Sequence: Synthetic oligonucleotide
cacacagacttactgagagaacctgcggatc

SEQ ID NO: 38442 - DNA, 31 bp, Artificial Sequence
  Description of Artificial Sequence: Synthetic oligonucleotide
acacagacttactgagagaacctgcggatcg

SEQ ID NO: 38443 - DNA, 30 bp, Artificial Sequence
  Description of Artificial Sequence: Synthetic oligonucleotide
cacagacttactgagagaacctgcggatcg

SEQ ID NO: 38444 - DNA, 30 bp, Artificial Sequence
  Description of Artificial Sequence: Synthetic oligonucleotide
acagacttactgagagaacctgcggatcgc

SEQ ID NO: 38445 - DNA, 29 bp, Artificial Sequence
  Description of Artificial Sequence: Synthetic oligonucleotide
cagacttactgagagaacctgcggatcgc

SEQ ID NO: 38446 - DNA, 29 bp, Artificial Sequence
  Description of Artificial Sequence: Synthetic oligonucleotide
agacttactgagagaacctgcggatcgcg

SEQ ID NO: 38447 - DNA, 28 bp, Artificial Sequence
  Description of Artificial Sequence: Synthetic oligonucleotide
gacttactgagagaacctgcggatcgcg

SEQ ID NO: 38448 - DNA, 28 bp, Artificial Sequence
  Description of Artificial Sequence: Synthetic oligonucleotide
acttactgagagaacctgcggatcgcgc

SEQ ID NO: 38449 - DNA, 27 bp, Artificial Sequence
  Description of Artificial Sequence: Synthetic oligonucleotide
cttactgagagaacctgcggatcgcgc

SEQ ID NO: 38450 - DNA, 28 bp, Artificial Sequence
  Description of Artificial Sequence: Synthetic oligonucleotide
ttactgagagaacctgcggatcgcgctc

SEQ ID NO: 38451 - DNA, 27 bp, Artificial Sequence
  Description of Artificial Sequence: Synthetic oligonucleotide
tactgagagaacctgcggatcgcgctc

SEQ ID NO: 38452 - DNA, 20 bp, Artificial Sequence
  Description of Artificial Sequence: Synthetic oligonucleotide
cggccgcggggagcccgttt

SEQ ID NO: 38453 - DNA, 20 bp, Artificial Sequence
  Description of Artificial Sequence: Synthetic oligonucleotide
ggccgcggggagcccggttt

SEQ ID NO: 38454 - DNA, 20 bp, Artificial Sequence
  Description of Artificial Sequence: Synthetic oligonucleotide
gccgcggggagcccggcttt

SEQ ID NO: 38455 - DNA, 22 bp, Artificial Sequence
  Description of Artificial Sequence: Synthetic oligonucleotide
ccgcggggagcccggcttcatt

SEQ ID NO: 38456 - DNA, 22 bp, Artificial Sequence
  Description of Artificial Sequence: Synthetic oligonucleotide
cgcggggagcccggcttcattg

SEQ ID NO: 38457 - DNA, 23 bp, Artificial Sequence
  Description of Artificial Sequence: Synthetic oligonucleotide
gcggggagcccggcttcattgca

SEQ ID NO: 38458 - DNA, 24 bp, Artificial Sequence
  Description of Artificial Sequence: Synthetic oligonucleotide
cggggagcccggcttcattgcagt

SEQ ID NO: 38459 - DNA, 24 bp, Artificial Sequence
  Description of Artificial Sequence: Synthetic oligonucleotide
ggggagcccggcttcattgcagtg

SEQ ID NO: 38460 - DNA, 24 bp, Artificial Sequence
  Description of Artificial Sequence: Synthetic oligonucleotide
gggagcccggcttcattgcagtgg

SEQ ID NO: 38461 - DNA, 24 bp, Artificial Sequence
  Description of Artificial Sequence: Synthetic oligonucleotide
ggagcccggcttcattgcagtggg

SEQ ID NO: 38462 - DNA, 26 bp, Artificial Sequence
  Description of Artificial Sequence: Synthetic oligonucleotide
gagcccggcttcattgcagtgggcta

SEQ ID NO: 38463 - DNA, 26 bp, Artificial Sequence
  Description of Artificial Sequence: Synthetic oligonucleotide
agcccggcttcattgcagtgggctac

SEQ ID NO: 38464 - DNA, 25 bp, Artificial Sequence
  Description of Artificial Sequence: Synthetic oligonucleotide
gcccggcttcattgcagtgggctac

SEQ ID NO: 38465 - DNA, 26 bp, Artificial Sequence
  Description of Artificial Sequence: Synthetic oligonucleotide
cccggcttcattgcagtgggctacgt

SEQ ID NO: 38466 - DNA, 26 bp, Artificial Sequence
  Description of Artificial Sequence: Synthetic oligonucleotide
ccggcttcattgcagtgggctacgtg

SEQ ID NO: 38467 - DNA, 27 bp, Artificial Sequence
  Description of Artificial Sequence: Synthetic oligonucleotide
cggcttcattgcagtgggctacgtgga

SEQ ID NO: 38468 - DNA, 27 bp, Artificial Sequence
  Description of Artificial Sequence: Synthetic oligonucleotide
ggcttcattgcagtgggctacgtggac

SEQ ID NO: 38469 - DNA, 26 bp, Artificial Sequence
  Description of Artificial Sequence: Synthetic oligonucleotide
cagtccaccatccccatcgtgggcat

SEQ ID NO: 38470 - DNA, 27 bp, Artificial Sequence
  Description of Artificial Sequence: Synthetic oligonucleotide
ggccggagtattgggaccggaacacat

SEQ ID NO: 38471 - DNA, 28 bp, Artificial Sequence
  Description of Artificial Sequence: Synthetic oligonucleotide
gccggagtattgggaccggaacacatag

SEQ ID NO: 38472 - DNA, 30 bp, Artificial Sequence
  Description of Artificial Sequence: Synthetic oligonucleotide
ccggagtattgggaccggaacacatagatc

SEQ ID NO: 38473 - DNA, 32 bp, Artificial Sequence
  Description of Artificial Sequence: Synthetic oligonucleotide
cggagtattgggaccggaacacatagatcttc

SEQ ID NO: 38474 - DNA, 34 bp, Artificial Sequence
  Description of Artificial Sequence: Synthetic oligonucleotide
ggagtattgggaccggaacacatagatcttcaag

SEQ ID NO: 38475 - DNA, 35 bp, Artificial Sequence
  Description of Artificial Sequence: Synthetic oligonucleotide
gagtattgggaccggaacacatagatcttcaagac

SEQ ID NO: 38476 - DNA, 35 bp, Artificial Sequence
  Description of Artificial Sequence: Synthetic oligonucleotide
agtattgggaccggaacacatagatcttcaagacc

SEQ ID NO: 38477 - DNA, 34 bp, Artificial Sequence
  Description of Artificial Sequence: Synthetic oligonucleotide
gtattgggaccggaacacatagatcttcaagacc

SEQ ID NO: 38478 - DNA, 36 bp, Artificial Sequence
  Description of Artificial Sequence: Synthetic oligonucleotide
tattgggaccggaacacatagatcttcaagaccaac

SEQ ID NO: 38479 - DNA, 35 bp, Artificial Sequence
  Description of Artificial Sequence: Synthetic oligonucleotide
attgggaccggaacacatagatcttcaagaccaac

SEQ ID NO: 38480 - DNA, 34 bp, Artificial Sequence
  Description of Artificial Sequence: Synthetic oligonucleotide
ttgggaccggaacacatagatcttcaagaccaac

SEQ ID NO: 38481 - DNA, 33 bp, Artificial Sequence
  Description of Artificial Sequence: Synthetic oligonucleotide
tgggaccggaacacatagatcttcaagaccaac

SEQ ID NO: 38482 - DNA, 32 bp, Artificial Sequence
  Description of Artificial Sequence: Synthetic oligonucleotide
gggaccggaacacatagatcttcaagaccaac

SEQ ID NO: 38483 - DNA, 33 bp, Artificial Sequence
  Description of Artificial Sequence: Synthetic oligonucleotide
ggaccggaacacatagatcttcaagaccaacac

SEQ ID NO: 38484 - DNA, 34 bp, Artificial Sequence
  Description of Artificial Sequence: Synthetic oligonucleotide
gaccggaacacatagatcttcaagaccaacacac

SEQ ID NO: 38485 - DNA, 35 bp, Artificial Sequence
  Description of Artificial Sequence: Synthetic oligonucleotide
accggaacacatagatcttcaagaccaacacacag

SEQ ID NO: 38486 - DNA, 34 bp, Artificial Sequence
  Description of Artificial Sequence: Synthetic oligonucleotide
ccggaacacatagatcttcaagaccaacacacag

SEQ ID NO: 38487 - DNA, 35 bp, Artificial Sequence
  Description of Artificial Sequence: Synthetic oligonucleotide
cggaacacatagatcttcaagaccaacacacagac

SEQ ID NO: 38488 - DNA, 38 bp, Artificial Sequence
  Description of Artificial Sequence: Synthetic oligonucleotide
ggaacacatagatcttcaagaccaacacacagacttac

SEQ ID NO: 38489 - DNA, 38 bp, Artificial Sequence
  Description of Artificial Sequence: Synthetic oligonucleotide
gaacacatagatcttcaagaccaacacacagacttacc

SEQ ID NO: 38490 - DNA, 38 bp, Artificial Sequence
  Description of Artificial Sequence: Synthetic oligonucleotide
aacacatagatcttcaagaccaacacacagacttaccg

SEQ ID NO: 38491 - DNA, 37 bp, Artificial Sequence
  Description of Artificial Sequence: Synthetic oligonucleotide
acacatagatcttcaagaccaacacacagacttaccg

SEQ ID NO: 38492 - DNA, 36 bp, Artificial Sequence
  Description of Artificial Sequence: Synthetic oligonucleotide
cacatagatcttcaagaccaacacacagacttaccg

SEQ ID NO: 38493 - DNA, 37 bp, Artificial Sequence
  Description of Artificial Sequence: Synthetic oligonucleotide
acatagatcttcaagaccaacacacagacttaccgag

SEQ ID NO: 38494 - DNA, 36 bp, Artificial Sequence
  Description of Artificial Sequence: Synthetic oligonucleotide
catagatcttcaagaccaacacacagacttaccgag

SEQ ID NO: 38495 - DNA, 37 bp, Artificial Sequence
  Description of Artificial Sequence: Synthetic oligonucleotide
atagatcttcaagaccaacacacagacttaccgagag

SEQ ID NO: 38496 - DNA, 36 bp, Artificial Sequence
  Description of Artificial Sequence: Synthetic oligonucleotide
tagatcttcaagaccaacacacagacttaccgagag

SEQ ID NO: 38497 - DNA, 26 bp, Artificial Sequence
  Description of Artificial Sequence: Synthetic oligonucleotide
gaggccgggtctcacatcatccagac

SEQ ID NO: 38498 - DNA, 27 bp, Artificial Sequence
  Description of Artificial Sequence: Synthetic oligonucleotide
aggccgggtctcacatcatccagacga

SEQ ID NO: 38499 - DNA, 27 bp, Artificial Sequence
  Description of Artificial Sequence: Synthetic oligonucleotide
ggccgggtctcacatcatccagacgat

SEQ ID NO: 38500 - DNA, 27 bp, Artificial Sequence
  Description of Artificial Sequence: Synthetic oligonucleotide
gccgggtctcacatcatccagacgatg

SEQ ID NO: 38501 - DNA, 30 bp, Artificial Sequence
  Description of Artificial Sequence: Synthetic oligonucleotide
ccgggtctcacatcatccagacgatgtatg

SEQ ID NO: 38502 - DNA, 30 bp, Artificial Sequence
  Description of Artificial Sequence: Synthetic oligonucleotide
cgggtctcacatcatccagacgatgtatgg

SEQ ID NO: 38503 - DNA, 30 bp, Artificial Sequence
  Description of Artificial Sequence: Synthetic oligonucleotide
gggtctcacatcatccagacgatgtatggc

SEQ ID NO: 38504 - DNA, 31 bp, Artificial Sequence
  Description of Artificial Sequence: Synthetic oligonucleotide
ggtctcacatcatccagacgatgtatggctg

SEQ ID NO: 38505 - DNA, 31 bp, Artificial Sequence
  Description of Artificial Sequence: Synthetic oligonucleotide
gtctcacatcatccagacgatgtatggctgc

SEQ ID NO: 38506 - DNA, 31 bp, Artificial Sequence
  Description of Artificial Sequence: Synthetic oligonucleotide
tctcacatcatccagacgatgtatggctgcg

SEQ ID NO: 38507 - DNA, 30 bp, Artificial Sequence
  Description of Artificial Sequence: Synthetic oligonucleotide
ctcacatcatccagacgatgtatggctgcg

SEQ ID NO: 38508 - DNA, 31 bp, Artificial Sequence
  Description of Artificial Sequence: Synthetic oligonucleotide
tcacatcatccagacgatgtatggctgcgac

SEQ ID NO: 38509 - DNA, 30 bp, Artificial Sequence
  Description of Artificial Sequence: Synthetic oligonucleotide
cacatcatccagacgatgtatggctgcgac

SEQ ID NO: 38510 - DNA, 30 bp, Artificial Sequence
  Description of Artificial Sequence: Synthetic oligonucleotide
acatcatccagacgatgtatggctgcgacg

SEQ ID NO: 38511 - DNA, 29 bp, Artificial Sequence
  Description of Artificial Sequence: Synthetic oligonucleotide
catcatccagacgatgtatggctgcgacg

SEQ ID NO: 38512 - DNA, 30 bp, Artificial Sequence
  Description of Artificial Sequence: Synthetic oligonucleotide
atcatccagacgatgtatggctgcgacgtg

SEQ ID NO: 38513 - DNA, 29 bp, Artificial Sequence
  Description of Artificial Sequence: Synthetic oligonucleotide
tcatccagacgatgtatggctgcgacgtg

SEQ ID NO: 38514 - DNA, 28 bp, Artificial Sequence
  Description of Artificial Sequence: Synthetic oligonucleotide
catccagacgatgtatggctgcgacgtg

SEQ ID NO: 38515 - DNA, 28 bp, Artificial Sequence
  Description of Artificial Sequence: Synthetic oligonucleotide
atccagacgatgtatggctgcgacgtgg

SEQ ID NO: 38516 - DNA, 27 bp, Artificial Sequence
  Description of Artificial Sequence: Synthetic oligonucleotide
tccagacgatgtatggctgcgacgtgg

SEQ ID NO: 38517 - DNA, 26 bp, Artificial Sequence
  Description of Artificial Sequence: Synthetic oligonucleotide
ccagacgatgtatggctgcgacgtgg

SEQ ID NO: 38518 - DNA, 26 bp, Artificial Sequence
  Description of Artificial Sequence: Synthetic oligonucleotide
acactgacctggcagcgggatggcaa

SEQ ID NO: 38519 - DNA, 25 bp, Artificial Sequence
  Description of Artificial Sequence: Synthetic oligonucleotide
cactgacctggcagcgggatggcaa

SEQ ID NO: 38520 - DNA, 25 bp, Artificial Sequence
  Description of Artificial Sequence: Synthetic oligonucleotide
actgacctggcagcgggatggcaag

SEQ ID NO: 38521 - DNA, 24 bp, Artificial Sequence
  Description of Artificial Sequence: Synthetic oligonucleotide
ctgacctggcagcgggatggcaag

SEQ ID NO: 38522 - DNA, 25 bp, Artificial Sequence
  Description of Artificial Sequence: Synthetic oligonucleotide
tgacctggcagcgggatggcaagga

SEQ ID NO: 38523 - DNA, 24 bp, Artificial Sequence
  Description of Artificial Sequence: Synthetic oligonucleotide
gacctggcagcgggatggcaagga

SEQ ID NO: 38524 - DNA, 24 bp, Artificial Sequence
  Description of Artificial Sequence: Synthetic oligonucleotide
acctggcagcgggatggcaaggac

SEQ ID NO: 38525 - DNA, 23 bp, Artificial Sequence
  Description of Artificial Sequence: Synthetic oligonucleotide
cctggcagcgggatggcaaggac

SEQ ID NO: 38526 - DNA, 26 bp, Artificial Sequence
  Description of Artificial Sequence: Synthetic oligonucleotide
ctggcagcgggatggcaaggaccaaa

SEQ ID NO: 38527 - DNA, 27 bp, Artificial Sequence
  Description of Artificial Sequence: Synthetic oligonucleotide
tggcagcgggatggcaaggaccaaact

SEQ ID NO: 38528 - DNA, 26 bp, Artificial Sequence
  Description of Artificial Sequence: Synthetic oligonucleotide
ggcagcgggatggcaaggaccaaact

SEQ ID NO: 38529 - DNA, 27 bp, Artificial Sequence
  Description of Artificial Sequence: Synthetic oligonucleotide
gcagcgggatggcaaggaccaaactca

SEQ ID NO: 38530 - DNA, 27 bp, Artificial Sequence
  Description of Artificial Sequence: Synthetic oligonucleotide
cagcgggatggcaaggaccaaactcag

SEQ ID NO: 38531 - DNA, 27 bp, Artificial Sequence
  Description of Artificial Sequence: Synthetic oligonucleotide
agcgggatggcaaggaccaaactcagg

SEQ ID NO: 38532 - DNA, 27 bp, Artificial Sequence
  Description of Artificial Sequence: Synthetic oligonucleotide
gcgggatggcaaggaccaaactcagga

SEQ ID NO: 38533 - DNA, 27 bp, Artificial Sequence
  Description of Artificial Sequence: Synthetic oligonucleotide
cgggatggcaaggaccaaactcaggac

SEQ ID NO: 38534 - DNA, 28 bp, Artificial Sequence
  Description of Artificial Sequence: Synthetic oligonucleotide
gggatggcaaggaccaaactcaggacac

SEQ ID NO: 38535 - DNA, 29 bp, Artificial Sequence
  Description of Artificial Sequence: Synthetic oligonucleotide
ggatggcaaggaccaaactcaggacactg

SEQ ID NO: 38536 - DNA, 30 bp, Artificial Sequence
  Description of Artificial Sequence: Synthetic oligonucleotide
gatggcaaggaccaaactcaggacactgag

SEQ ID NO: 38537 - DNA, 30 bp, Artificial Sequence
  Description of Artificial Sequence: Synthetic oligonucleotide
atggcaaggaccaaactcaggacactgagc

SEQ ID NO: 38538 - DNA, 29 bp, Artificial Sequence
  Description of Artificial Sequence: Synthetic oligonucleotide
tggcaaggaccaaactcaggacactgagc

SEQ ID NO: 38539 - DNA, 28 bp, Artificial Sequence
  Description of Artificial Sequence: Synthetic oligonucleotide
ggcaaggaccaaactcaggacactgagc

SEQ ID NO: 38540 - DNA, 30 bp, Artificial Sequence
  Description of Artificial Sequence: Synthetic oligonucleotide
gcaaggaccaaactcaggacactgagcttg

SEQ ID NO: 38541 - DNA, 31 bp, Artificial Sequence
  Description of Artificial Sequence: Synthetic oligonucleotide
caaggaccaaactcaggacactgagcttgtg

SEQ ID NO: 38542 - DNA, 31 bp, Artificial Sequence
  Description of Artificial Sequence: Synthetic oligonucleotide
aaggaccaaactcaggacactgagcttgtgg

SEQ ID NO: 38543 - DNA, 20 bp, Artificial Sequence
  Description of Artificial Sequence: Synthetic oligonucleotide
tggaccgcggcggacaccgg

SEQ ID NO: 38544 - DNA, 20 bp, Artificial Sequence
  Description of Artificial Sequence: Synthetic oligonucleotide
ggaccgcggcggacaccggt

SEQ ID NO: 38545 - DNA, 20 bp, Artificial Sequence
  Description of Artificial Sequence: Synthetic oligonucleotide
gaccgcggcggacaccgggt

SEQ ID NO: 38546 - DNA, 20 bp, Artificial Sequence
  Description of Artificial Sequence: Synthetic oligonucleotide
accgcggcggacaccggggt

SEQ ID NO: 38547 - DNA, 20 bp, Artificial Sequence
  Description of Artificial Sequence: Synthetic oligonucleotide
ccgcggcggacaccggggtt

SEQ ID NO: 38548 - DNA, 20 bp, Artificial Sequence
  Description of Artificial Sequence: Synthetic oligonucleotide
cgcggcggacaccggggctt

SEQ ID NO: 38549 - DNA, 20 bp, Artificial Sequence
  Description of Artificial Sequence: Synthetic oligonucleotide
gcggcggacaccggggctca

SEQ ID NO: 38550 - DNA, 22 bp, Artificial Sequence
  Description of Artificial Sequence: Synthetic oligonucleotide
cggcggacaccggggctcagat

SEQ ID NO: 38551 - DNA, 23 bp, Artificial Sequence
  Description of Artificial Sequence: Synthetic oligonucleotide
ggcggacaccggggctcagatca

SEQ ID NO: 38552 - DNA, 23 bp, Artificial Sequence
  Description of Artificial Sequence: Synthetic oligonucleotide
gcggacaccggggctcagatcac

SEQ ID NO: 38553 - DNA, 23 bp, Artificial Sequence
  Description of Artificial Sequence: Synthetic oligonucleotide
cggacaccggggctcagatcacc

SEQ ID NO: 38554 - DNA, 24 bp, Artificial Sequence
  Description of Artificial Sequence: Synthetic oligonucleotide
ggacaccggggctcagatcaccca

SEQ ID NO: 38555 - DNA, 24 bp, Artificial Sequence
  Description of Artificial Sequence: Synthetic oligonucleotide
gacaccggggctcagatcacccag

SEQ ID NO: 38556 - DNA, 24 bp, Artificial Sequence
  Description of Artificial Sequence: Synthetic oligonucleotide
acaccggggctcagatcacccagc

SEQ ID NO: 38557 - DNA, 23 bp, Artificial Sequence
  Description of Artificial Sequence: Synthetic oligonucleotide
caccggggctcagatcacccagc

SEQ ID NO: 38558 - DNA, 23 bp, Artificial Sequence
  Description of Artificial Sequence: Synthetic oligonucleotide
accggggctcagatcacccagcg

SEQ ID NO: 38559 - DNA, 22 bp, Artificial Sequence
  Description of Artificial Sequence: Synthetic oligonucleotide
ccggggctcagatcacccagcg

SEQ ID NO: 38560 - DNA, 24 bp, Artificial Sequence
  Description of Artificial Sequence: Synthetic oligonucleotide
cggggctcagatcacccagcgcaa

SEQ ID NO: 38561 - DNA, 28 bp, Artificial Sequence
  Description of Artificial Sequence: Synthetic oligonucleotide
agacttaccgagagaacctgcggatcgg

SEQ ID NO: 38562 - DNA, 27 bp, Artificial Sequence
  Description of Artificial Sequence: Synthetic oligonucleotide
gacttaccgagagaacctgcggatcgg

SEQ ID NO: 38563 - DNA, 27 bp, Artificial Sequence
  Description of Artificial Sequence: Synthetic oligonucleotide
acttaccgagagaacctgcggatcggg

SEQ ID NO: 38564 - DNA, 26 bp, Artificial Sequence
  Description of Artificial Sequence: Synthetic oligonucleotide
cttaccgagagaacctgcggatcggg

SEQ ID NO: 38565 - DNA, 27 bp, Artificial Sequence
  Description of Artificial Sequence: Synthetic oligonucleotide
ttaccgagagaacctgcggatcgggct

SEQ ID NO: 38566 - DNA, 26 bp, Artificial Sequence
  Description of Artificial Sequence: Synthetic oligonucleotide
taccgagagaacctgcggatcgggct

SEQ ID NO: 38567 - DNA, 25 bp, Artificial Sequence
  Description of Artificial Sequence: Synthetic oligonucleotide
accgagagaacctgcggatcgggct

SEQ ID NO: 38568 - DNA, 24 bp, Artificial Sequence
  Description of Artificial Sequence: Synthetic oligonucleotide
ccgagagaacctgcggatcgggct

SEQ ID NO: 38569 - DNA, 24 bp, Artificial Sequence
  Description of Artificial Sequence: Synthetic oligonucleotide
cgagagaacctgcggatcgggctc

SEQ ID NO: 38570 - DNA, 24 bp, Artificial Sequence
  Description of Artificial Sequence: Synthetic oligonucleotide
gagagaacctgcggatcgggctcc

SEQ ID NO: 38571 - DNA, 24 bp, Artificial Sequence
  Description of Artificial Sequence: Synthetic oligonucleotide
agagaacctgcggatcgggctccg

SEQ ID NO: 38572 - DNA, 23 bp, Artificial Sequence
  Description of Artificial Sequence: Synthetic oligonucleotide
gagaacctgcggatcgggctccg

SEQ ID NO: 38573 - DNA, 25 bp, Artificial Sequence
  Description of Artificial Sequence: Synthetic oligonucleotide
agaacctgcggatcgggctccgcta

SEQ ID NO: 38574 - DNA, 24 bp, Artificial Sequence
  Description of Artificial Sequence: Synthetic oligonucleotide
gaacctgcggatcgggctccgcta

SEQ ID NO: 38575 - DNA, 26 bp, Artificial Sequence
  Description of Artificial Sequence: Synthetic oligonucleotide
aacctgcggatcgggctccgctacta

SEQ ID NO: 38576 - DNA, 25 bp, Artificial Sequence
  Description of Artificial Sequence: Synthetic oligonucleotide
acctgcggatcgggctccgctacta

SEQ ID NO: 38577 - DNA, 24 bp, Artificial Sequence
  Description of Artificial Sequence: Synthetic oligonucleotide
cctgcggatcgggctccgctacta

SEQ ID NO: 38578 - DNA, 26 bp, Artificial Sequence
  Description of Artificial Sequence: Synthetic oligonucleotide
ctgcggatcgggctccgctactacaa

SEQ ID NO: 38579 - DNA, 26 bp, Artificial Sequence
  Description of Artificial Sequence: Synthetic oligonucleotide
tgcggatcgggctccgctactacaac

SEQ ID NO: 38580 - DNA, 25 bp, Artificial Sequence
  Description of Artificial Sequence: Synthetic oligonucleotide
gcggatcgggctccgctactacaac

SEQ ID NO: 38581 - DNA, 26 bp, Artificial Sequence
  Description of Artificial Sequence: Synthetic oligonucleotide
cggatcgggctccgctactacaacca

SEQ ID NO: 38582 - DNA, 27 bp, Artificial Sequence
  Description of Artificial Sequence: Synthetic oligonucleotide
ggatcgggctccgctactacaaccaga

SEQ ID NO: 38583 - DNA, 27 bp, Artificial Sequence
  Description of Artificial Sequence: Synthetic oligonucleotide
gatcgggctccgctactacaaccagag

SEQ ID NO: 38584 - DNA, 27 bp, Artificial Sequence
  Description of Artificial Sequence: Synthetic oligonucleotide
atcgggctccgctactacaaccagagc

SEQ ID NO: 38585 - DNA, 26 bp, Artificial Sequence
  Description of Artificial Sequence: Synthetic oligonucleotide
tcgggctccgctactacaaccagagc

SEQ ID NO: 38586 - DNA, 25 bp, Artificial Sequence
  Description of Artificial Sequence: Synthetic oligonucleotide
cgggctccgctactacaaccagagc

SEQ ID NO: 38587 - DNA, 26 bp, Artificial Sequence
  Description of Artificial Sequence: Synthetic oligonucleotide
gggctccgctactacaaccagagcga

SEQ ID NO: 38588 - DNA, 26 bp, Artificial Sequence
  Description of Artificial Sequence: Synthetic oligonucleotide
ggctccgctactacaaccagagcgag

SEQ ID NO: 38589 - DNA, 26 bp, Artificial Sequence
  Description of Artificial Sequence: Synthetic oligonucleotide
ccaccaccccgtctctgaccatgaga

SEQ ID NO: 38590 - DNA, 26 bp, Artificial Sequence
  Description of Artificial Sequence: Synthetic oligonucleotide
caccaccccgtctctgaccatgagac

SEQ ID NO: 38591 - DNA, 27 bp, Artificial Sequence
  Description of Artificial Sequence: Synthetic oligonucleotide
accaccccgtctctgaccatgagacca

SEQ ID NO: 38592 - DNA, 26 bp, Artificial Sequence
  Description of Artificial Sequence: Synthetic oligonucleotide
ccaccccgtctctgaccatgagacca

SEQ ID NO: 38593 - DNA, 26 bp, Artificial Sequence
  Description of Artificial Sequence: Synthetic oligonucleotide
caccccgtctctgaccatgagaccac

SEQ ID NO: 38594 - DNA, 26 bp, Artificial Sequence
  Description of Artificial Sequence: Synthetic oligonucleotide
accccgtctctgaccatgagaccacc

SEQ ID NO: 38595 - DNA, 25 bp, Artificial Sequence
  Description of Artificial Sequence: Synthetic oligonucleotide
ccccgtctctgaccatgagaccacc

SEQ ID NO: 38596 - DNA, 26 bp, Artificial Sequence
  Description of Artificial Sequence: Synthetic oligonucleotide
cccgtctctgaccatgagaccaccct

SEQ ID NO: 38597 - DNA, 27 bp, Artificial Sequence
  Description of Artificial Sequence: Synthetic oligonucleotide
ccgtctctgaccatgagaccaccctga

SEQ ID NO: 38598 - DNA, 27 bp, Artificial Sequence
  Description of Artificial Sequence: Synthetic oligonucleotide
cgtctctgaccatgagaccaccctgag

SEQ ID NO: 38599 - DNA, 27 bp, Artificial Sequence
  Description of Artificial Sequence: Synthetic oligonucleotide
gtctctgaccatgagaccaccctgagg

SEQ ID NO: 38600 - DNA, 28 bp, Artificial Sequence
  Description of Artificial Sequence: Synthetic oligonucleotide
tctctgaccatgagaccaccctgaggtg

SEQ ID NO: 38601 - DNA, 27 bp, Artificial Sequence
  Description of Artificial Sequence: Synthetic oligonucleotide
ctctgaccatgagaccaccctgaggtg

SEQ ID NO: 38602 - DNA, 27 bp, Artificial Sequence
  Description of Artificial Sequence: Synthetic oligonucleotide
tctgaccatgagaccaccctgaggtgc

SEQ ID NO: 38603 - DNA, 27 bp, Artificial Sequence
  Description of Artificial Sequence: Synthetic oligonucleotide
ctgaccatgagaccaccctgaggtgct

SEQ ID NO: 38604 - DNA, 27 bp, Artificial Sequence
  Description of Artificial Sequence: Synthetic oligonucleotide
tgaccatgagaccaccctgaggtgctg

SEQ ID NO: 38605 - DNA, 26 bp, Artificial Sequence
  Description of Artificial Sequence: Synthetic oligonucleotide
gaccatgagaccaccctgaggtgctg

SEQ ID NO: 38606 - DNA, 26 bp, Artificial Sequence
  Description of Artificial Sequence: Synthetic oligonucleotide
accatgagaccaccctgaggtgctgg

SEQ ID NO: 38607 - DNA, 25 bp, Artificial Sequence
  Description of Artificial Sequence: Synthetic oligonucleotide
ccatgagaccaccctgaggtgctgg

SEQ ID NO: 38608 - DNA, 25 bp, Artificial Sequence
  Description of Artificial Sequence: Synthetic oligonucleotide
catgagaccaccctgaggtgctggg

SEQ ID NO: 38609 - DNA, 25 bp, Artificial Sequence
  Description of Artificial Sequence: Synthetic oligonucleotide
atgagaccaccctgaggtgctgggc

SEQ ID NO: 38610 - DNA, 24 bp, Artificial Sequence
  Description of Artificial Sequence: Synthetic oligonucleotide
tgagaccaccctgaggtgctgggc

SEQ ID NO: 38611 - DNA, 23 bp, Artificial Sequence
  Description of Artificial Sequence: Synthetic oligonucleotide
gagaccaccctgaggtgctgggc

SEQ ID NO: 38612 - DNA, 23 bp, Artificial Sequence
  Description of Artificial Sequence: Synthetic oligonucleotide
agaccaccctgaggtgctgggcc

SEQ ID NO: 38613 - DNA, 22 bp, Artificial Sequence
  Description of Artificial Sequence: Synthetic oligonucleotide
gaccaccctgaggtgctgggcc

SEQ ID NO: 38614 - DNA, 23 bp, Artificial Sequence
  Description of Artificial Sequence: Synthetic oligonucleotide
accaccctgaggtgctgggccct

SEQ ID NO: 38615 - DNA, 35 bp, Artificial Sequence
  Description of Artificial Sequence: Synthetic oligonucleotide
gaacacacagatcttcaagaccaacacacagactc

SEQ ID NO: 38616 - DNA, 36 bp, Artificial Sequence
  Description of Artificial Sequence: Synthetic oligonucleotide
aacacacagatcttcaagaccaacacacagactcac

SEQ ID NO: 38617 - DNA, 35 bp, Artificial Sequence
  Description of Artificial Sequence: Synthetic oligonucleotide
acacacagatcttcaagaccaacacacagactcac

SEQ ID NO: 38618 - DNA, 34 bp, Artificial Sequence
  Description of Artificial Sequence: Synthetic oligonucleotide
cacacagatcttcaagaccaacacacagactcac

SEQ ID NO: 38619 - DNA, 34 bp, Artificial Sequence
  Description of Artificial Sequence: Synthetic oligonucleotide
acacagatcttcaagaccaacacacagactcacc

SEQ ID NO: 38620 - DNA, 33 bp, Artificial Sequence
  Description of Artificial Sequence: Synthetic oligonucleotide
cacagatcttcaagaccaacacacagactcacc

SEQ ID NO: 38621 - DNA, 33 bp, Artificial Sequence
  Description of Artificial Sequence: Synthetic oligonucleotide
acagatcttcaagaccaacacacagactcaccg

SEQ ID NO: 38622 - DNA, 32 bp, Artificial Sequence
  Description of Artificial Sequence: Synthetic oligonucleotide
cagatcttcaagaccaacacacagactcaccg

SEQ ID NO: 38623 - DNA, 33 bp, Artificial Sequence
  Description of Artificial Sequence: Synthetic oligonucleotide
agatcttcaagaccaacacacagactcaccgag

SEQ ID NO: 38624 - DNA, 32 bp, Artificial Sequence
  Description of Artificial Sequence: Synthetic oligonucleotide
gatcttcaagaccaacacacagactcaccgag

SEQ ID NO: 38625 - DNA, 33 bp, Artificial Sequence
  Description of Artificial Sequence: Synthetic oligonucleotide
atcttcaagaccaacacacagactcaccgagag

SEQ ID NO: 38626 - DNA, 32 bp, Artificial Sequence
  Description of Artificial Sequence: Synthetic oligonucleotide
tcttcaagaccaacacacagactcaccgagag

SEQ ID NO: 38627 - DNA, 31 bp, Artificial Sequence
  Description of Artificial Sequence: Synthetic oligonucleotide
cttcaagaccaacacacagactcaccgagag

SEQ ID NO: 38628 - DNA, 33 bp, Artificial Sequence
  Description of Artificial Sequence: Synthetic oligonucleotide
ttcaagaccaacacacagactcaccgagagaac

SEQ ID NO: 38629 - DNA, 32 bp, Artificial Sequence
  Description of Artificial Sequence: Synthetic oligonucleotide
tcaagaccaacacacagactcaccgagagaac

SEQ ID NO: 38630 - DNA, 31 bp, Artificial Sequence
  Description of Artificial Sequence: Synthetic oligonucleotide
caagaccaacacacagactcaccgagagaac

SEQ ID NO: 38631 - DNA, 31 bp, Artificial Sequence
  Description of Artificial Sequence: Synthetic oligonucleotide
aagaccaacacacagactcaccgagagaacc

SEQ ID NO: 38632 - DNA, 30 bp, Artificial Sequence
  Description of Artificial Sequence: Synthetic oligonucleotide
agaccaacacacagactcaccgagagaacc

SEQ ID NO: 38633 - DNA, 29 bp, Artificial Sequence
  Description of Artificial Sequence: Synthetic oligonucleotide
gaccaacacacagactcaccgagagaacc

SEQ ID NO: 38634 - DNA, 30 bp, Artificial Sequence
  Description of Artificial Sequence: Synthetic oligonucleotide
accaacacacagactcaccgagagaacctg

SEQ ID NO: 38635 - DNA, 29 bp, Artificial Sequence
  Description of Artificial Sequence: Synthetic oligonucleotide
ccaacacacagactcaccgagagaacctg

SEQ ID NO: 38636 - DNA, 29 bp, Artificial Sequence
  Description of Artificial Sequence: Synthetic oligonucleotide
caacacacagactcaccgagagaacctgc

SEQ ID NO: 38637 - DNA, 29 bp, Artificial Sequence
  Description of Artificial Sequence: Synthetic oligonucleotide
aacacacagactcaccgagagaacctgcg

SEQ ID NO: 38638 - DNA, 28 bp, Artificial Sequence
  Description of Artificial Sequence: Synthetic oligonucleotide
acacacagactcaccgagagaacctgcg

SEQ ID NO: 38639 - DNA, 27 bp, Artificial Sequence
  Description of Artificial Sequence: Synthetic oligonucleotide
cacacagactcaccgagagaacctgcg

SEQ ID NO: 38640 - DNA, 27 bp, Artificial Sequence
  Description of Artificial Sequence: Synthetic oligonucleotide
acacagactcaccgagagaacctgcgg

SEQ ID NO: 38641 - DNA, 21 bp, Artificial Sequence
  Description of Artificial Sequence: Synthetic oligonucleotide
gcggcctgtgaggcggagcag

SEQ ID NO: 38642 - DNA, 22 bp, Artificial Sequence
  Description of Artificial Sequence: Synthetic oligonucleotide
cggcctgtgaggcggagcagct

SEQ ID NO: 38643 - DNA, 23 bp, Artificial Sequence
  Description of Artificial Sequence: Synthetic oligonucleotide
ggcctgtgaggcggagcagctga

SEQ ID NO: 38644 - DNA, 24 bp, Artificial Sequence
  Description of Artificial Sequence: Synthetic oligonucleotide
gcctgtgaggcggagcagctgaga

SEQ ID NO: 38645 - DNA, 24 bp, Artificial Sequence
  Description of Artificial Sequence: Synthetic oligonucleotide
cctgtgaggcggagcagctgagag

SEQ ID NO: 38646 - DNA, 24 bp, Artificial Sequence
  Description of Artificial Sequence: Synthetic oligonucleotide
ctgtgaggcggagcagctgagagc

SEQ ID NO: 38647 - DNA, 26 bp, Artificial Sequence
  Description of Artificial Sequence: Synthetic oligonucleotide
tgtgaggcggagcagctgagagccta

SEQ ID NO: 38648 - DNA, 22 bp, Artificial Sequence
  Description of Artificial Sequence: Synthetic oligonucleotide
gcgagtccgaggacggagccct

SEQ ID NO: 38649 - DNA, 22 bp, Artificial Sequence
  Description of Artificial Sequence: Synthetic oligonucleotide
cgagtccgaggacggagccctg

SEQ ID NO: 38650 - DNA, 22 bp, Artificial Sequence
  Description of Artificial Sequence: Synthetic oligonucleotide
gagtccgaggacggagccctgg

SEQ ID NO: 38651 - DNA, 22 bp, Artificial Sequence
  Description of Artificial Sequence: Synthetic oligonucleotide
agtccgaggacggagccctggg

SEQ ID NO: 38652 - DNA, 21 bp, Artificial Sequence
  Description of Artificial Sequence: Synthetic oligonucleotide
gtccgaggacggagccctggg

SEQ ID NO: 38653 - DNA, 21 bp, Artificial Sequence
  Description of Artificial Sequence: Synthetic oligonucleotide
tccgaggacggagccctgggc

SEQ ID NO: 38654 - DNA, 20 bp, Artificial Sequence
  Description of Artificial Sequence: Synthetic oligonucleotide
ccgaggacggagccctgggc

SEQ ID NO: 38655 - DNA, 20 bp, Artificial Sequence
  Description of Artificial Sequence: Synthetic oligonucleotide
cgaggacggagccctgggcg

SEQ ID NO: 38656 - DNA, 20 bp, Artificial Sequence
  Description of Artificial Sequence: Synthetic oligonucleotide
gaggacggagccctgggcgc

SEQ ID NO: 38657 - DNA, 22 bp, Artificial Sequence
  Description of Artificial Sequence: Synthetic oligonucleotide
aggacggagccctgggcgccat

SEQ ID NO: 38658 - DNA, 21 bp, Artificial Sequence
  Description of Artificial Sequence: Synthetic oligonucleotide
ggacggagccctgggcgccat

SEQ ID NO: 38659 - DNA, 21 bp, Artificial Sequence
  Description of Artificial Sequence: Synthetic oligonucleotide
gacggagccctgggcgccatg

SEQ ID NO: 38660 - DNA, 24 bp, Artificial Sequence
  Description of Artificial Sequence: Synthetic oligonucleotide
acggagccctgggcgccatggata

SEQ ID NO: 38661 - DNA, 23 bp, Artificial Sequence
  Description of Artificial Sequence: Synthetic oligonucleotide
cggagccctgggcgccatggata

SEQ ID NO: 38662 - DNA, 24 bp, Artificial Sequence
  Description of Artificial Sequence: Synthetic oligonucleotide
ggagccctgggcgccatggataga

SEQ ID NO: 38663 - DNA, 24 bp, Artificial Sequence
  Description of Artificial Sequence: Synthetic oligonucleotide
gagccctgggcgccatggatagag

SEQ ID NO: 38664 - DNA, 25 bp, Artificial Sequence
  Description of Artificial Sequence: Synthetic oligonucleotide
agccctgggcgccatggatagagca

SEQ ID NO: 38665 - DNA, 24 bp, Artificial Sequence
  Description of Artificial Sequence: Synthetic oligonucleotide
gccctgggcgccatggatagagca

SEQ ID NO: 38666 - DNA, 24 bp, Artificial Sequence
  Description of Artificial Sequence: Synthetic oligonucleotide
ccctgggcgccatggatagagcag

SEQ ID NO: 38667 - DNA, 25 bp, Artificial Sequence
  Description of Artificial Sequence: Synthetic oligonucleotide
cctgggcgccatggatagagcagga

SEQ ID NO: 38668 - DNA, 25 bp, Artificial Sequence
  Description of Artificial Sequence: Synthetic oligonucleotide
ctgggcgccatggatagagcaggag

SEQ ID NO: 38669 - DNA, 25 bp, Artificial Sequence
  Description of Artificial Sequence: Synthetic oligonucleotide
tgggcgccatggatagagcaggagg

SEQ ID NO: 38670 - DNA, 28 bp, Artificial Sequence
  Description of Artificial Sequence: Synthetic oligonucleotide
ttcattgcagtgggctacgtggacgacg

SEQ ID NO: 38671 - DNA, 27 bp, Artificial Sequence
  Description of Artificial Sequence: Synthetic oligonucleotide
tcattgcagtgggctacgtggacgacg

SEQ ID NO: 38672 - DNA, 26 bp, Artificial Sequence
  Description of Artificial Sequence: Synthetic oligonucleotide
cattgcagtgggctacgtggacgacg

SEQ ID NO: 38673 - DNA, 26 bp, Artificial Sequence
  Description of Artificial Sequence: Synthetic oligonucleotide
attgcagtgggctacgtggacgacgc

SEQ ID NO: 38674 - DNA, 25 bp, Artificial Sequence
  Description of Artificial Sequence: Synthetic oligonucleotide
ttgcagtgggctacgtggacgacgc

SEQ ID NO: 38675 - DNA, 24 bp, Artificial Sequence
  Description of Artificial Sequence: Synthetic oligonucleotide
tgcagtgggctacgtggacgacgc

SEQ ID NO: 38676 - DNA, 23 bp, Artificial Sequence
  Description of Artificial Sequence: Synthetic oligonucleotide
cagtgggctacgtggacgacgcc

SEQ ID NO: 38677 - DNA, 24 bp, Artificial Sequence
  Description of Artificial Sequence: Synthetic oligonucleotide
agtgggctacgtggacgacgccca

SEQ ID NO: 38678 - DNA, 23 bp, Artificial Sequence
  Description of Artificial Sequence: Synthetic oligonucleotide
gtgggctacgtggacgacgccca

SEQ ID NO: 38679 - DNA, 25 bp, Artificial Sequence
  Description of Artificial Sequence: Synthetic oligonucleotide
tgggctacgtggacgacgcccagtt

SEQ ID NO: 38680 - DNA, 24 bp, Artificial Sequence
  Description of Artificial Sequence: Synthetic oligonucleotide
gggctacgtggacgacgcccagtt

SEQ ID NO: 38681 - DNA, 24 bp, Artificial Sequence
  Description of Artificial Sequence: Synthetic oligonucleotide
ggctacgtggacgacgcccagttc

SEQ ID NO: 38682 - DNA, 25 bp, Artificial Sequence
  Description of Artificial Sequence: Synthetic oligonucleotide
gctacgtggacgacgcccagttcgt

SEQ ID NO: 38683 - DNA, 26 bp, Artificial Sequence
  Description of Artificial Sequence: Synthetic oligonucleotide
ctacgtggacgacgcccagttcgtga

SEQ ID NO: 38684 - DNA, 26 bp, Artificial Sequence
  Description of Artificial Sequence: Synthetic oligonucleotide
tacgtggacgacgcccagttcgtgag

SEQ ID NO: 38685 - DNA, 25 bp, Artificial Sequence
  Description of Artificial Sequence: Synthetic oligonucleotide
acgtggacgacgcccagttcgtgag

SEQ ID NO: 38686 - DNA, 24 bp, Artificial Sequence
  Description of Artificial Sequence: Synthetic oligonucleotide
cgtggacgacgcccagttcgtgag

SEQ ID NO: 38687 - DNA, 26 bp, Artificial Sequence
  Description of Artificial Sequence: Synthetic oligonucleotide
gtggacgacgcccagttcgtgaggtt

SEQ ID NO: 38688 - DNA, 26 bp, Artificial Sequence
  Description of Artificial Sequence: Synthetic oligonucleotide
tggacgacgcccagttcgtgaggttc

SEQ ID NO: 38689 - DNA, 25 bp, Artificial Sequence
  Description of Artificial Sequence: Synthetic oligonucleotide
ggacgacgcccagttcgtgaggttc

SEQ ID NO: 38690 - DNA, 26 bp, Artificial Sequence
  Description of Artificial Sequence: Synthetic oligonucleotide
gacgacgcccagttcgtgaggttcga

SEQ ID NO: 38691 - DNA, 27 bp, Artificial Sequence
  Description of Artificial Sequence: Synthetic oligonucleotide
acgacgcccagttcgtgaggttcgaca

SEQ ID NO: 38692 - DNA, 26 bp, Artificial Sequence
  Description of Artificial Sequence: Synthetic oligonucleotide
cgacgcccagttcgtgaggttcgaca

SEQ ID NO: 38693 - DNA, 26 bp, Artificial Sequence
  Description of Artificial Sequence: Synthetic oligonucleotide
gacgcccagttcgtgaggttcgacag

SEQ ID NO: 38694 - DNA, 26 bp, Artificial Sequence
  Description of Artificial Sequence: Synthetic oligonucleotide
acgcccagttcgtgaggttcgacagc

SEQ ID NO: 38695 - DNA, 25 bp, Artificial Sequence
  Description of Artificial Sequence: Synthetic oligonucleotide
cgcccagttcgtgaggttcgacagc

SEQ ID NO: 38696 - DNA, 26 bp, Artificial Sequence
  Description of Artificial Sequence: Synthetic oligonucleotide
gcccagttcgtgaggttcgacagcga

SEQ ID NO: 38697 - DNA, 28 bp, Artificial Sequence
  Description of Artificial Sequence: Synthetic oligonucleotide
cataaccagtccgcctacgacggcaaag

SEQ ID NO: 38698 - DNA, 32 bp, Artificial Sequence
  Description of Artificial Sequence: Synthetic oligonucleotide
ataaccagtccgcctacgacggcaaagattac

SEQ ID NO: 38699 - DNA, 31 bp, Artificial Sequence
  Description of Artificial Sequence: Synthetic oligonucleotide
taaccagtccgcctacgacggcaaagattac

SEQ ID NO: 38700 - DNA, 30 bp, Artificial Sequence
  Description of Artificial Sequence: Synthetic oligonucleotide
aaccagtccgcctacgacggcaaagattac

SEQ ID NO: 38701 - DNA, 27 bp, Artificial Sequence
  Description of Artificial Sequence: Synthetic oligonucleotide
gcagacgatgtatggctgcgacgtgga

SEQ ID NO: 38702 - DNA, 27 bp, Artificial Sequence
  Description of Artificial Sequence: Synthetic oligonucleotide
cagacgatgtatggctgcgacgtggag

SEQ ID NO: 38703 - DNA, 27 bp, Artificial Sequence
  Description of Artificial Sequence: Synthetic oligonucleotide
agacgatgtatggctgcgacgtggagc

SEQ ID NO: 38704 - DNA, 26 bp, Artificial Sequence
  Description of Artificial Sequence: Synthetic oligonucleotide
gacgatgtatggctgcgacgtggagc

SEQ ID NO: 38705 - DNA, 26 bp, Artificial Sequence
  Description of Artificial Sequence: Synthetic oligonucleotide
acgatgtatggctgcgacgtggagcc

SEQ ID NO: 38706 - DNA, 25 bp, Artificial Sequence
  Description of Artificial Sequence: Synthetic oligonucleotide
cgatgtatggctgcgacgtggagcc

SEQ ID NO: 38707 - DNA, 25 bp, Artificial Sequence
  Description of Artificial Sequence: Synthetic oligonucleotide
gatgtatggctgcgacgtggagccg

SEQ ID NO: 38708 - DNA, 20 bp, Artificial Sequence
  Description of Artificial Sequence: Synthetic oligonucleotide
acgtggagccggacgggcgc

SEQ ID NO: 38709 - DNA, 20 bp, Artificial Sequence
  Description of Artificial Sequence: Synthetic oligonucleotide
cgtggagccggacgggcgct

SEQ ID NO: 38710 - DNA, 20 bp, Artificial Sequence
  Description of Artificial Sequence: Synthetic oligonucleotide
gtggagccggacgggcgcct

SEQ ID NO: 38711 - DNA, 20 bp, Artificial Sequence
  Description of Artificial Sequence: Synthetic oligonucleotide
tggagccggacgggcgcctc

SEQ ID NO: 38712 - DNA, 20 bp, Artificial Sequence
  Description of Artificial Sequence: Synthetic oligonucleotide
ggagccggacgggcgcctct

SEQ ID NO: 38713 - DNA, 20 bp, Artificial Sequence
  Description of Artificial Sequence: Synthetic oligonucleotide
gagccggacgggcgcctcct

SEQ ID NO: 38714 - DNA, 20 bp, Artificial Sequence
  Description of Artificial Sequence: Synthetic oligonucleotide
agccggacgggcgcctcctc

SEQ ID NO: 38715 - DNA, 25 bp, Artificial Sequence
  Description of Artificial Sequence: Synthetic oligonucleotide
gcggggagccccgcttcattgcaat

SEQ ID NO: 38716 - DNA, 25 bp, Artificial Sequence
  Description of Artificial Sequence: Synthetic oligonucleotide
cggggagccccgcttcattgcaatg

SEQ ID NO: 38717 - DNA, 25 bp, Artificial Sequence
  Description of Artificial Sequence: Synthetic oligonucleotide
ggggagccccgcttcattgcaatgg

SEQ ID NO: 38718 - DNA, 25 bp, Artificial Sequence
  Description of Artificial Sequence: Synthetic oligonucleotide
gggagccccgcttcattgcaatggg

SEQ ID NO: 38719 - DNA, 27 bp, Artificial Sequence
  Description of Artificial Sequence: Synthetic oligonucleotide
ggagccccgcttcattgcaatgggcta

SEQ ID NO: 38720 - DNA, 27 bp, Artificial Sequence
  Description of Artificial Sequence: Synthetic oligonucleotide
gagccccgcttcattgcaatgggctac

SEQ ID NO: 38721 - DNA, 27 bp, Artificial Sequence
  Description of Artificial Sequence: Synthetic oligonucleotide
agccccgcttcattgcaatgggctacg

SEQ ID NO: 38722 - DNA, 27 bp, Artificial Sequence
  Description of Artificial Sequence: Synthetic oligonucleotide
gccccgcttcattgcaatgggctacgt

SEQ ID NO: 38723 - DNA, 27 bp, Artificial Sequence
  Description of Artificial Sequence: Synthetic oligonucleotide
ccccgcttcattgcaatgggctacgtg

SEQ ID NO: 38724 - DNA, 27 bp, Artificial Sequence
  Description of Artificial Sequence: Synthetic oligonucleotide
cccgcttcattgcaatgggctacgtgg

SEQ ID NO: 38725 - DNA, 28 bp, Artificial Sequence
  Description of Artificial Sequence: Synthetic oligonucleotide
ccgcttcattgcaatgggctacgtggac

SEQ ID NO: 38726 - DNA, 28 bp, Artificial Sequence
  Description of Artificial Sequence: Synthetic oligonucleotide
cgcttcattgcaatgggctacgtggacg

SEQ ID NO: 38727 - DNA, 29 bp, Artificial Sequence
  Description of Artificial Sequence: Synthetic oligonucleotide
gcttcattgcaatgggctacgtggacgac

SEQ ID NO: 38728 - DNA, 30 bp, Artificial Sequence
  Description of Artificial Sequence: Synthetic oligonucleotide
cttcattgcaatgggctacgtggacgacac

SEQ ID NO: 38729 - DNA, 30 bp, Artificial Sequence
  Description of Artificial Sequence: Synthetic oligonucleotide
ttcattgcaatgggctacgtggacgacacc

SEQ ID NO: 38730 - DNA, 29 bp, Artificial Sequence
  Description of Artificial Sequence: Synthetic oligonucleotide
tcattgcaatgggctacgtggacgacacc

SEQ ID NO: 38731 - DNA, 28 bp, Artificial Sequence
  Description of Artificial Sequence: Synthetic oligonucleotide
cattgcaatgggctacgtggacgacacc

SEQ ID NO: 38732 - DNA, 28 bp, Artificial Sequence
  Description of Artificial Sequence: Synthetic oligonucleotide
attgcaatgggctacgtggacgacaccc

SEQ ID NO: 38733 - DNA, 27 bp, Artificial Sequence
  Description of Artificial Sequence: Synthetic oligonucleotide
ttgcaatgggctacgtggacgacaccc

SEQ ID NO: 38734 - DNA, 27 bp, Artificial Sequence
  Description of Artificial Sequence: Synthetic oligonucleotide
tgcaatgggctacgtggacgacaccca

SEQ ID NO: 38735 - DNA, 23 bp, Artificial Sequence
  Description of Artificial Sequence: Synthetic oligonucleotide
ttcgacagcgacgccgcgagtcg

SEQ ID NO: 38736 - DNA, 22 bp, Artificial Sequence
  Description of Artificial Sequence: Synthetic oligonucleotide
tcgacagcgacgccgcgagtcg

SEQ ID NO: 38737 - DNA, 21 bp, Artificial Sequence
  Description of Artificial Sequence: Synthetic oligonucleotide
cgacagcgacgccgcgagtcg

SEQ ID NO: 38738 - DNA, 22 bp, Artificial Sequence
  Description of Artificial Sequence: Synthetic oligonucleotide
gacagcgacgccgcgagtcgga

SEQ ID NO: 38739 - DNA, 22 bp, Artificial Sequence
  Description of Artificial Sequence: Synthetic oligonucleotide
acagcgacgccgcgagtcggag

SEQ ID NO: 38740 - DNA, 21 bp, Artificial Sequence
  Description of Artificial Sequence: Synthetic oligonucleotide
cagcgacgccgcgagtcggag

SEQ ID NO: 38741 - DNA, 22 bp, Artificial Sequence
  Description of Artificial Sequence: Synthetic oligonucleotide
agcgacgccgcgagtcggagga

SEQ ID NO: 38742 - DNA, 21 bp, Artificial Sequence
  Description of Artificial Sequence: Synthetic oligonucleotide
gcgacgccgcgagtcggagga

SEQ ID NO: 38743 - DNA, 21 bp, Artificial Sequence
  Description of Artificial Sequence: Synthetic oligonucleotide
cgacgccgcgagtcggaggac

SEQ ID NO: 38744 - DNA, 21 bp, Artificial Sequence
  Description of Artificial Sequence: Synthetic oligonucleotide
gacgccgcgagtcggaggacg

SEQ ID NO: 38745 - DNA, 22 bp, Artificial Sequence
  Description of Artificial Sequence: Synthetic oligonucleotide
acgccgcgagtcggaggacgga

SEQ ID NO: 38746 - DNA, 21 bp, Artificial Sequence
  Description of Artificial Sequence: Synthetic oligonucleotide
cgccgcgagtcggaggacgga

SEQ ID NO: 38747 - DNA, 21 bp, Artificial Sequence
  Description of Artificial Sequence: Synthetic oligonucleotide
gccgcgagtcggaggacggag

SEQ ID NO: 38748 - DNA, 21 bp, Artificial Sequence
  Description of Artificial Sequence: Synthetic oligonucleotide
ccgcgagtcggaggacggagc

SEQ ID NO: 38749 - DNA, 21 bp, Artificial Sequence
  Description of Artificial Sequence: Synthetic oligonucleotide
cgcgagtcggaggacggagcc

SEQ ID NO: 38750 - DNA, 21 bp, Artificial Sequence
  Description of Artificial Sequence: Synthetic oligonucleotide
gcgagtcggaggacggagccc

SEQ ID NO: 38751 - DNA, 21 bp, Artificial Sequence
  Description of Artificial Sequence: Synthetic oligonucleotide
cgagtcggaggacggagcccc

SEQ ID NO: 38752 - DNA, 21 bp, Artificial Sequence
  Description of Artificial Sequence: Synthetic oligonucleotide
gagtcggaggacggagccccg

SEQ ID NO: 38753 - DNA, 21 bp, Artificial Sequence
  Description of Artificial Sequence: Synthetic oligonucleotide
agtcggaggacggagccccgg

SEQ ID NO: 38754 - DNA, 20 bp, Artificial Sequence
  Description of Artificial Sequence: Synthetic oligonucleotide
gtcggaggacggagccccgg

SEQ ID NO: 38755 - DNA, 20 bp, Artificial Sequence
  Description of Artificial Sequence: Synthetic oligonucleotide
tcggaggacggagccccggg

SEQ ID NO: 38756 - DNA, 20 bp, Artificial Sequence
  Description of Artificial Sequence: Synthetic oligonucleotide
cggaggacggagccccgggt

SEQ ID NO: 38757 - DNA, 20 bp, Artificial Sequence
  Description of Artificial Sequence: Synthetic oligonucleotide
ggaggacggagccccgggct

SEQ ID NO: 38758 - DNA, 27 bp, Artificial Sequence
  Description of Artificial Sequence: Synthetic oligonucleotide
tgaacgaggacctgagctcctggacca

SEQ ID NO: 38759 - DNA, 26 bp, Artificial Sequence
  Description of Artificial Sequence: Synthetic oligonucleotide
gaacgaggacctgagctcctggacca

SEQ ID NO: 38760 - DNA, 26 bp, Artificial Sequence
  Description of Artificial Sequence: Synthetic oligonucleotide
aacgaggacctgagctcctggaccac

SEQ ID NO: 38761 - DNA, 25 bp, Artificial Sequence
  Description of Artificial Sequence: Synthetic oligonucleotide
acgaggacctgagctcctggaccac

SEQ ID NO: 38762 - DNA, 24 bp, Artificial Sequence
  Description of Artificial Sequence: Synthetic oligonucleotide
cgaggacctgagctcctggaccac

SEQ ID NO: 38763 - DNA, 24 bp, Artificial Sequence
  Description of Artificial Sequence: Synthetic oligonucleotide
gaggacctgagctcctggaccacg

SEQ ID NO: 38764 - DNA, 24 bp, Artificial Sequence
  Description of Artificial Sequence: Synthetic oligonucleotide
aggacctgagctcctggaccacgg

SEQ ID NO: 38765 - DNA, 23 bp, Artificial Sequence
  Description of Artificial Sequence: Synthetic oligonucleotide
ggacctgagctcctggaccacgg

SEQ ID NO: 38766 - DNA, 23 bp, Artificial Sequence
  Description of Artificial Sequence: Synthetic oligonucleotide
gacctgagctcctggaccacggc

SEQ ID NO: 38767 - DNA, 23 bp, Artificial Sequence
  Description of Artificial Sequence: Synthetic oligonucleotide
acctgagctcctggaccacggcg

SEQ ID NO: 38768 - DNA, 22 bp, Artificial Sequence
  Description of Artificial Sequence: Synthetic oligonucleotide
cctgagctcctggaccacggcg

SEQ ID NO: 38769 - DNA, 23 bp, Artificial Sequence
  Description of Artificial Sequence: Synthetic oligonucleotide
ctgagctcctggaccacggcgga

SEQ ID NO: 38770 - DNA, 24 bp, Artificial Sequence
  Description of Artificial Sequence: Synthetic oligonucleotide
tgagctcctggaccacggcggaca

SEQ ID NO: 38771 - DNA, 23 bp, Artificial Sequence
  Description of Artificial Sequence: Synthetic oligonucleotide
gagctcctggaccacggcggaca

SEQ ID NO: 38772 - DNA, 23 bp, Artificial Sequence
  Description of Artificial Sequence: Synthetic oligonucleotide
agctcctggaccacggcggacac

SEQ ID NO: 38773 - DNA, 22 bp, Artificial Sequence
  Description of Artificial Sequence: Synthetic oligonucleotide
gctcctggaccacggcggacac

SEQ ID NO: 38774 - DNA, 22 bp, Artificial Sequence
  Description of Artificial Sequence: Synthetic oligonucleotide
ctcctggaccacggcggacacc

SEQ ID NO: 38775 - DNA, 22 bp, Artificial Sequence
  Description of Artificial Sequence: Synthetic oligonucleotide
tcctggaccacggcggacaccg

SEQ ID NO: 38776 - DNA, 21 bp, Artificial Sequence
  Description of Artificial Sequence: Synthetic oligonucleotide
cctggaccacggcggacaccg

SEQ ID NO: 38777 - DNA, 21 bp, Artificial Sequence
  Description of Artificial Sequence: Synthetic oligonucleotide
ctggaccacggcggacaccgc

SEQ ID NO: 38778 - DNA, 21 bp, Artificial Sequence
  Description of Artificial Sequence: Synthetic oligonucleotide
tggaccacggcggacaccgcg

SEQ ID NO: 38779 - DNA, 20 bp, Artificial Sequence
  Description of Artificial Sequence: Synthetic oligonucleotide
ggaccacggcggacaccgcg

SEQ ID NO: 38780 - DNA, 20 bp, Artificial Sequence
  Description of Artificial Sequence: Synthetic oligonucleotide
gaccacggcggacaccgcgg

SEQ ID NO: 38781 - DNA, 21 bp, Artificial Sequence
  Description of Artificial Sequence: Synthetic oligonucleotide
accacggcggacaccgcggct

SEQ ID NO: 38782 - DNA, 20 bp, Artificial Sequence
  Description of Artificial Sequence: Synthetic oligonucleotide
ccacggcggacaccgcggct

SEQ ID NO: 38783 - DNA, 21 bp, Artificial Sequence
  Description of Artificial Sequence: Synthetic oligonucleotide
cacggcggacaccgcggctca

SEQ ID NO: 38784 - DNA, 23 bp, Artificial Sequence
  Description of Artificial Sequence: Synthetic oligonucleotide
acggcggacaccgcggctcagat

SEQ ID NO: 38785 - DNA, 23 bp, Artificial Sequence
  Description of Artificial Sequence: Synthetic oligonucleotide
ggcctgtgcgtggagtggctcct

SEQ ID NO: 38786 - DNA, 24 bp, Artificial Sequence
  Description of Artificial Sequence: Synthetic oligonucleotide
gcctgtgcgtggagtggctcctca

SEQ ID NO: 38787 - DNA, 25 bp, Artificial Sequence
  Description of Artificial Sequence: Synthetic oligonucleotide
cctgtgcgtggagtggctcctcaga

SEQ ID NO: 38788 - DNA, 26 bp, Artificial Sequence
  Description of Artificial Sequence: Synthetic oligonucleotide
ctgtgcgtggagtggctcctcagaca

SEQ ID NO: 38789 - DNA, 26 bp, Artificial Sequence
  Description of Artificial Sequence: Synthetic oligonucleotide
tgtgcgtggagtggctcctcagacac

SEQ ID NO: 38790 - DNA, 25 bp, Artificial Sequence
  Description of Artificial Sequence: Synthetic oligonucleotide
gtgcgtggagtggctcctcagacac

SEQ ID NO: 38791 - DNA, 26 bp, Artificial Sequence
  Description of Artificial Sequence: Synthetic oligonucleotide
tgcgtggagtggctcctcagacacct

SEQ ID NO: 38792 - DNA, 25 bp, Artificial Sequence
  Description of Artificial Sequence: Synthetic oligonucleotide
gcgtggagtggctcctcagacacct

SEQ ID NO: 38793 - DNA, 25 bp, Artificial Sequence
  Description of Artificial Sequence: Synthetic oligonucleotide
cgtggagtggctcctcagacacctg

SEQ ID NO: 38794 - DNA, 26 bp, Artificial Sequence
  Description of Artificial Sequence: Synthetic oligonucleotide
gtggagtggctcctcagacacctgga

SEQ ID NO: 38795 - DNA, 27 bp, Artificial Sequence
  Description of Artificial Sequence: Synthetic oligonucleotide
tggagtggctcctcagacacctggaga

SEQ ID NO: 38796 - DNA, 27 bp, Artificial Sequence
  Description of Artificial Sequence: Synthetic oligonucleotide
ggagtggctcctcagacacctggagaa

SEQ ID NO: 38797 - DNA, 27 bp, Artificial Sequence
  Description of Artificial Sequence: Synthetic oligonucleotide
gagtggctcctcagacacctggagaac

SEQ ID NO: 38798 - DNA, 27 bp, Artificial Sequence
  Description of Artificial Sequence: Synthetic oligonucleotide
agtggctcctcagacacctggagaacg

SEQ ID NO: 38799 - DNA, 26 bp, Artificial Sequence
  Description of Artificial Sequence: Synthetic oligonucleotide
gtggctcctcagacacctggagaacg

SEQ ID NO: 38800 - DNA, 26 bp, Artificial Sequence
  Description of Artificial Sequence: Synthetic oligonucleotide
tggctcctcagacacctggagaacgg

SEQ ID NO: 38801 - DNA, 25 bp, Artificial Sequence
  Description of Artificial Sequence: Synthetic oligonucleotide
ggctcctcagacacctggagaacgg

SEQ ID NO: 38802 - DNA, 27 bp, Artificial Sequence
  Description of Artificial Sequence: Synthetic oligonucleotide
gctcctcagacacctggagaacgggaa

SEQ ID NO: 38803 - DNA, 27 bp, Artificial Sequence
  Description of Artificial Sequence: Synthetic oligonucleotide
ctcctcagacacctggagaacgggaag

SEQ ID NO: 38804 - DNA, 27 bp, Artificial Sequence
  Description of Artificial Sequence: Synthetic oligonucleotide
tcctcagacacctggagaacgggaagg

SEQ ID NO: 38805 - DNA, 27 bp, Artificial Sequence
  Description of Artificial Sequence: Synthetic oligonucleotide
cctcagacacctggagaacgggaagga

SEQ ID NO: 38806 - DNA, 27 bp, Artificial Sequence
  Description of Artificial Sequence: Synthetic oligonucleotide
ctcagacacctggagaacgggaaggag

SEQ ID NO: 38807 - DNA, 28 bp, Artificial Sequence
  Description of Artificial Sequence: Synthetic oligonucleotide
tcagacacctggagaacgggaaggagac

SEQ ID NO: 38808 - DNA, 22 bp, Artificial Sequence
  Description of Artificial Sequence: Synthetic oligonucleotide
tgagctcctggaccgcggcgca

SEQ ID NO: 38809 - DNA, 21 bp, Artificial Sequence
  Description of Artificial Sequence: Synthetic oligonucleotide
gagctcctggaccgcggcgca

SEQ ID NO: 38810 - DNA, 22 bp, Artificial Sequence
  Description of Artificial Sequence: Synthetic oligonucleotide
agctcctggaccgcggcgcaca

SEQ ID NO: 38811 - DNA, 21 bp, Artificial Sequence
  Description of Artificial Sequence: Synthetic oligonucleotide
gctcctggaccgcggcgcaca

SEQ ID NO: 38812 - DNA, 21 bp, Artificial Sequence
  Description of Artificial Sequence: Synthetic oligonucleotide
ctcctggaccgcggcgcacac

SEQ ID NO: 38813 - DNA, 21 bp, Artificial Sequence
  Description of Artificial Sequence: Synthetic oligonucleotide
tcctggaccgcggcgcacacc

SEQ ID NO: 38814 - DNA, 20 bp, Artificial Sequence
  Description of Artificial Sequence: Synthetic oligonucleotide
cctggaccgcggcgcacacc

SEQ ID NO: 38815 - DNA, 20 bp, Artificial Sequence
  Description of Artificial Sequence: Synthetic oligonucleotide
ctggaccgcggcgcacaccg

SEQ ID NO: 38816 - DNA, 20 bp, Artificial Sequence
  Description of Artificial Sequence: Synthetic oligonucleotide
tggaccgcggcgcacaccgc

SEQ ID NO: 38817 - DNA, 20 bp, Artificial Sequence
  Description of Artificial Sequence: Synthetic oligonucleotide
ggaccgcggcgcacaccgct

SEQ ID NO: 38818 - DNA, 20 bp, Artificial Sequence
  Description of Artificial Sequence: Synthetic oligonucleotide
gaccgcggcgcacaccgcgt

SEQ ID NO: 38819 - DNA, 20 bp, Artificial Sequence
  Description of Artificial Sequence: Synthetic oligonucleotide
accgcggcgcacaccgcggt

SEQ ID NO: 38820 - DNA, 20 bp, Artificial Sequence
  Description of Artificial Sequence: Synthetic oligonucleotide
ccgcggcgcacaccgcggtt

SEQ ID NO: 38821 - DNA, 20 bp, Artificial Sequence
  Description of Artificial Sequence: Synthetic oligonucleotide
cgcggcgcacaccgcggctt

SEQ ID NO: 38822 - DNA, 20 bp, Artificial Sequence
  Description of Artificial Sequence: Synthetic oligonucleotide
gcggcgcacaccgcggctca

SEQ ID NO: 38823 - DNA, 22 bp, Artificial Sequence
  Description of Artificial Sequence: Synthetic oligonucleotide
cggcgcacaccgcggctcagat

SEQ ID NO: 38824 - DNA, 23 bp, Artificial Sequence
  Description of Artificial Sequence: Synthetic oligonucleotide
ggcgcacaccgcggctcagatca

SEQ ID NO: 38825 - DNA, 23 bp, Artificial Sequence
  Description of Artificial Sequence: Synthetic oligonucleotide
gcgcacaccgcggctcagatcac

SEQ ID NO: 38826 - DNA, 23 bp, Artificial Sequence
  Description of Artificial Sequence: Synthetic oligonucleotide
cgcacaccgcggctcagatcacc

SEQ ID NO: 38827 - DNA, 24 bp, Artificial Sequence
  Description of Artificial Sequence: Synthetic oligonucleotide
gcacaccgcggctcagatcaccca

SEQ ID NO: 38828 - DNA, 24 bp, Artificial Sequence
  Description of Artificial Sequence: Synthetic oligonucleotide
cacaccgcggctcagatcacccag

SEQ ID NO: 38829 - DNA, 23 bp, Artificial Sequence
  Description of Artificial Sequence: Synthetic oligonucleotide
aagtgggaggcggcccgtgagga

SEQ ID NO: 38830 - DNA, 22 bp, Artificial Sequence
  Description of Artificial Sequence: Synthetic oligonucleotide
agtgggaggcggcccgtgagga

SEQ ID NO: 38831 - DNA, 21 bp, Artificial Sequence
  Description of Artificial Sequence: Synthetic oligonucleotide
gtgggaggcggcccgtgagga

SEQ ID NO: 38832 - DNA, 21 bp, Artificial Sequence
  Description of Artificial Sequence: Synthetic oligonucleotide
tgggaggcggcccgtgaggag

SEQ ID NO: 38833 - DNA, 20 bp, Artificial Sequence
  Description of Artificial Sequence: Synthetic oligonucleotide
gggaggcggcccgtgaggag

SEQ ID NO: 38834 - DNA, 21 bp, Artificial Sequence
  Description of Artificial Sequence: Synthetic oligonucleotide
ggaggcggcccgtgaggagga

SEQ ID NO: 38835 - DNA, 21 bp, Artificial Sequence
  Description of Artificial Sequence: Synthetic oligonucleotide
gaggcggcccgtgaggaggag

SEQ ID NO: 38836 - DNA, 22 bp, Artificial Sequence
  Description of Artificial Sequence: Synthetic oligonucleotide
aggcggcccgtgaggaggagca

SEQ ID NO: 38837 - DNA, 21 bp, Artificial Sequence
  Description of Artificial Sequence: Synthetic oligonucleotide
ggcggcccgtgaggaggagca

SEQ ID NO: 38838 - DNA, 21 bp, Artificial Sequence
  Description of Artificial Sequence: Synthetic oligonucleotide
gcggcccgtgaggaggagcag

SEQ ID NO: 38839 - DNA, 22 bp, Artificial Sequence
  Description of Artificial Sequence: Synthetic oligonucleotide
cggcccgtgaggaggagcagct

SEQ ID NO: 38840 - DNA, 23 bp, Artificial Sequence
  Description of Artificial Sequence: Synthetic oligonucleotide
ggcccgtgaggaggagcagctga

SEQ ID NO: 38841 - DNA, 24 bp, Artificial Sequence
  Description of Artificial Sequence: Synthetic oligonucleotide
gcccgtgaggaggagcagctgaga

SEQ ID NO: 38842 - DNA, 24 bp, Artificial Sequence
  Description of Artificial Sequence: Synthetic oligonucleotide
cccgtgaggaggagcagctgagag

SEQ ID NO: 38843 - DNA, 24 bp, Artificial Sequence
  Description of Artificial Sequence: Synthetic oligonucleotide
ccgtgaggaggagcagctgagagc

SEQ ID NO: 38844 - DNA, 26 bp, Artificial Sequence
  Description of Artificial Sequence: Synthetic oligonucleotide
cgtgaggaggagcagctgagagccta

SEQ ID NO: 38845 - DNA, 26 bp, Artificial Sequence
  Description of Artificial Sequence: Synthetic oligonucleotide
gtgaggaggagcagctgagagcctac

SEQ ID NO: 38846 - DNA, 27 bp, Artificial Sequence
  Description of Artificial Sequence: Synthetic oligonucleotide
tgaggaggagcagctgagagcctacct

SEQ ID NO: 38847 - DNA, 26 bp, Artificial Sequence
  Description of Artificial Sequence: Synthetic oligonucleotide
gaggaggagcagctgagagcctacct

SEQ ID NO: 38848 - DNA, 26 bp, Artificial Sequence
  Description of Artificial Sequence: Synthetic oligonucleotide
aggaggagcagctgagagcctacctg

SEQ ID NO: 38849 - DNA, 25 bp, Artificial Sequence
  Description of Artificial Sequence: Synthetic oligonucleotide
ggaggagcagctgagagcctacctg

SEQ ID NO: 38850 - DNA, 26 bp, Artificial Sequence
  Description of Artificial Sequence: Synthetic oligonucleotide
gaggagcagctgagagcctacctgga

SEQ ID NO: 38851 - DNA, 26 bp, Artificial Sequence
  Description of Artificial Sequence: Synthetic oligonucleotide
aggagcagctgagagcctacctggag

SEQ ID NO: 38852 - DNA, 29 bp, Artificial Sequence
  Description of Artificial Sequence: Synthetic oligonucleotide
gcttcattgcagtgggctacgtggacaac

SEQ ID NO: 38853 - DNA, 30 bp, Artificial Sequence
  Description of Artificial Sequence: Synthetic oligonucleotide
cttcattgcagtgggctacgtggacaacac

SEQ ID NO: 38854 - DNA, 30 bp, Artificial Sequence
  Description of Artificial Sequence: Synthetic oligonucleotide
ttcattgcagtgggctacgtggacaacacc

SEQ ID NO: 38855 - DNA, 29 bp, Artificial Sequence
  Description of Artificial Sequence: Synthetic oligonucleotide
tcattgcagtgggctacgtggacaacacc

SEQ ID NO: 38856 - DNA, 28 bp, Artificial Sequence
  Description of Artificial Sequence: Synthetic oligonucleotide
cattgcagtgggctacgtggacaacacc

SEQ ID NO: 38857 - DNA, 28 bp, Artificial Sequence
  Description of Artificial Sequence: Synthetic oligonucleotide
attgcagtgggctacgtggacaacaccc

SEQ ID NO: 38858 - DNA, 27 bp, Artificial Sequence
  Description of Artificial Sequence: Synthetic oligonucleotide
ttgcagtgggctacgtggacaacaccc

SEQ ID NO: 38859 - DNA, 27 bp, Artificial Sequence
  Description of Artificial Sequence: Synthetic oligonucleotide
tgcagtgggctacgtggacaacaccca

SEQ ID NO: 38860 - DNA, 23 bp, Artificial Sequence
  Description of Artificial Sequence: Synthetic oligonucleotide
agcgacgccacgagtccgaggac

SEQ ID NO: 38861 - DNA, 22 bp, Artificial Sequence
  Description of Artificial Sequence: Synthetic oligonucleotide
gcgacgccacgagtccgaggac

SEQ ID NO: 38862 - DNA, 22 bp, Artificial Sequence
  Description of Artificial Sequence: Synthetic oligonucleotide
cgacgccacgagtccgaggacg

SEQ ID NO: 38863 - DNA, 23 bp, Artificial Sequence
  Description of Artificial Sequence: Synthetic oligonucleotide
gacgccacgagtccgaggacgga

SEQ ID NO: 38864 - DNA, 23 bp, Artificial Sequence
  Description of Artificial Sequence: Synthetic oligonucleotide
acgccacgagtccgaggacggag

SEQ ID NO: 38865 - DNA, 22 bp, Artificial Sequence
  Description of Artificial Sequence: Synthetic oligonucleotide
cgccacgagtccgaggacggag

SEQ ID NO: 38866 - DNA, 22 bp, Artificial Sequence
  Description of Artificial Sequence: Synthetic oligonucleotide
gccacgagtccgaggacggagc

SEQ ID NO: 38867 - DNA, 22 bp, Artificial Sequence
  Description of Artificial Sequence: Synthetic oligonucleotide
ccacgagtccgaggacggagcc

SEQ ID NO: 38868 - DNA, 22 bp, Artificial Sequence
  Description of Artificial Sequence: Synthetic oligonucleotide
cacgagtccgaggacggagccc

SEQ ID NO: 38869 - DNA, 22 bp, Artificial Sequence
  Description of Artificial Sequence: Synthetic oligonucleotide
acgagtccgaggacggagcccc

SEQ ID NO: 38870 - DNA, 26 bp, Artificial Sequence
  Description of Artificial Sequence: Synthetic oligonucleotide
gctcagatcacccagcgcaagtggca

SEQ ID NO: 38871 - DNA, 26 bp, Artificial Sequence
  Description of Artificial Sequence: Synthetic oligonucleotide
ctcagatcacccagcgcaagtggcag

SEQ ID NO: 38872 - DNA, 26 bp, Artificial Sequence
  Description of Artificial Sequence: Synthetic oligonucleotide
tcagatcacccagcgcaagtggcagg

SEQ ID NO: 38873 - DNA, 25 bp, Artificial Sequence
  Description of Artificial Sequence: Synthetic oligonucleotide
cagatcacccagcgcaagtggcagg

SEQ ID NO: 38874 - DNA, 25 bp, Artificial Sequence
  Description of Artificial Sequence: Synthetic oligonucleotide
agatcacccagcgcaagtggcaggc

SEQ ID NO: 38875 - DNA, 24 bp, Artificial Sequence
  Description of Artificial Sequence: Synthetic oligonucleotide
gatcacccagcgcaagtggcaggc

SEQ ID NO: 38876 - DNA, 24 bp, Artificial Sequence
  Description of Artificial Sequence: Synthetic oligonucleotide
atcacccagcgcaagtggcaggcg

SEQ ID NO: 38877 - DNA, 23 bp, Artificial Sequence
  Description of Artificial Sequence: Synthetic oligonucleotide
tcacccagcgcaagtggcaggcg

SEQ ID NO: 38878 - DNA, 22 bp, Artificial Sequence
  Description of Artificial Sequence: Synthetic oligonucleotide
cacccagcgcaagtggcaggcg

SEQ ID NO: 38879 - DNA, 22 bp, Artificial Sequence
  Description of Artificial Sequence: Synthetic oligonucleotide
acccagcgcaagtggcaggcgg

SEQ ID NO: 38880 - DNA, 21 bp, Artificial Sequence
  Description of Artificial Sequence: Synthetic oligonucleotide
cccagcgcaagtggcaggcgg

SEQ ID NO: 38881 - DNA, 21 bp, Artificial Sequence
  Description of Artificial Sequence: Synthetic oligonucleotide
ccagcgcaagtggcaggcggc

SEQ ID NO: 38882 - DNA, 21 bp, Artificial Sequence
  Description of Artificial Sequence: Synthetic oligonucleotide
cagcgcaagtggcaggcggcc

SEQ ID NO: 38883 - DNA, 21 bp, Artificial Sequence
  Description of Artificial Sequence: Synthetic oligonucleotide
agcgcaagtggcaggcggccc

SEQ ID NO: 38884 - DNA, 20 bp, Artificial Sequence
  Description of Artificial Sequence: Synthetic oligonucleotide
gcgcaagtggcaggcggccc

SEQ ID NO: 38885 - DNA, 21 bp, Artificial Sequence
  Description of Artificial Sequence: Synthetic oligonucleotide
cgcaagtggcaggcggcccgt

SEQ ID NO: 38886 - DNA, 22 bp, Artificial Sequence
  Description of Artificial Sequence: Synthetic oligonucleotide
gcaagtggcaggcggcccgtga

SEQ ID NO: 38887 - DNA, 22 bp, Artificial Sequence
  Description of Artificial Sequence: Synthetic oligonucleotide
caagtggcaggcggcccgtgag

SEQ ID NO: 38888 - DNA, 22 bp, Artificial Sequence
  Description of Artificial Sequence: Synthetic oligonucleotide
aagtggcaggcggcccgtgagg

SEQ ID NO: 38889 - DNA, 21 bp, Artificial Sequence
  Description of Artificial Sequence: Synthetic oligonucleotide
agtggcaggcggcccgtgagg

SEQ ID NO: 38890 - DNA, 20 bp, Artificial Sequence
  Description of Artificial Sequence: Synthetic oligonucleotide
gtggcaggcggcccgtgagg

SEQ ID NO: 38891 - DNA, 20 bp, Artificial Sequence
  Description of Artificial Sequence: Synthetic oligonucleotide
tggcaggcggcccgtgaggc

SEQ ID NO: 38892 - DNA, 20 bp, Artificial Sequence
  Description of Artificial Sequence: Synthetic oligonucleotide
ggcaggcggcccgtgaggct

SEQ ID NO: 38893 - DNA, 20 bp, Artificial Sequence
  Description of Artificial Sequence: Synthetic oligonucleotide
gcaggcggcccgtgaggcgt

SEQ ID NO: 38894 - DNA, 20 bp, Artificial Sequence
  Description of Artificial Sequence: Synthetic oligonucleotide
caggcggcccgtgaggcgga

SEQ ID NO: 38895 - DNA, 27 bp, Artificial Sequence
  Description of Artificial Sequence: Synthetic oligonucleotide
tccgctactacaaccagagcgaggcca

SEQ ID NO: 38896 - DNA, 26 bp, Artificial Sequence
  Description of Artificial Sequence: Synthetic oligonucleotide
ccgctactacaaccagagcgaggcca

SEQ ID NO: 38897 - DNA, 26 bp, Artificial Sequence
  Description of Artificial Sequence: Synthetic oligonucleotide
cgctactacaaccagagcgaggccag

SEQ ID NO: 38898 - DNA, 27 bp, Artificial Sequence
  Description of Artificial Sequence: Synthetic oligonucleotide
aaccagagcgaggccaggtctcacact

SEQ ID NO: 38899 - DNA, 27 bp, Artificial Sequence
  Description of Artificial Sequence: Synthetic oligonucleotide
accagagcgaggccaggtctcacactt

SEQ ID NO: 38900 - DNA, 26 bp, Artificial Sequence
  Description of Artificial Sequence: Synthetic oligonucleotide
ccagagcgaggccaggtctcacactt

SEQ ID NO: 38901 - DNA, 26 bp, Artificial Sequence
  Description of Artificial Sequence: Synthetic oligonucleotide
cagagcgaggccaggtctcacacttg

SEQ ID NO: 38902 - DNA, 26 bp, Artificial Sequence
  Description of Artificial Sequence: Synthetic oligonucleotide
agagcgaggccaggtctcacacttgg

SEQ ID NO: 38903 - DNA, 25 bp, Artificial Sequence
  Description of Artificial Sequence: Synthetic oligonucleotide
gagcgaggccaggtctcacacttgg

SEQ ID NO: 38904 - DNA, 26 bp, Artificial Sequence
  Description of Artificial Sequence: Synthetic oligonucleotide
agcgaggccaggtctcacacttggca

SEQ ID NO: 38905 - DNA, 25 bp, Artificial Sequence
  Description of Artificial Sequence: Synthetic oligonucleotide
gcgaggccaggtctcacacttggca

SEQ ID NO: 38906 - DNA, 26 bp, Artificial Sequence
  Description of Artificial Sequence: Synthetic oligonucleotide
cgaggccaggtctcacacttggcaga

SEQ ID NO: 38907 - DNA, 26 bp, Artificial Sequence
  Description of Artificial Sequence: Synthetic oligonucleotide
gaggccaggtctcacacttggcagac

SEQ ID NO: 38908 - DNA, 27 bp, Artificial Sequence
  Description of Artificial Sequence: Synthetic oligonucleotide
aggccaggtctcacacttggcagacga

SEQ ID NO: 38909 - DNA, 27 bp, Artificial Sequence
  Description of Artificial Sequence: Synthetic oligonucleotide
ggccaggtctcacacttggcagacgat

SEQ ID NO: 38910 - DNA, 27 bp, Artificial Sequence
  Description of Artificial Sequence: Synthetic oligonucleotide
gccaggtctcacacttggcagacgatg

SEQ ID NO: 38911 - DNA, 30 bp, Artificial Sequence
  Description of Artificial Sequence: Synthetic oligonucleotide
ccaggtctcacacttggcagacgatgtatg

SEQ ID NO: 38912 - DNA, 30 bp, Artificial Sequence
  Description of Artificial Sequence: Synthetic oligonucleotide
caggtctcacacttggcagacgatgtatgg

SEQ ID NO: 38913 - DNA, 30 bp, Artificial Sequence
  Description of Artificial Sequence: Synthetic oligonucleotide
aggtctcacacttggcagacgatgtatggc

SEQ ID NO: 38914 - DNA, 30 bp, Artificial Sequence
  Description of Artificial Sequence: Synthetic oligonucleotide
tacgtggacgacacccagttcgtgagtttc

SEQ ID NO: 38915 - DNA, 29 bp, Artificial Sequence
  Description of Artificial Sequence: Synthetic oligonucleotide
acgtggacgacacccagttcgtgagtttc

SEQ ID NO: 38916 - DNA, 28 bp, Artificial Sequence
  Description of Artificial Sequence: Synthetic oligonucleotide
cgtggacgacacccagttcgtgagtttc

SEQ ID NO: 38917 - DNA, 28 bp, Artificial Sequence
  Description of Artificial Sequence: Synthetic oligonucleotide
gtggacgacacccagttcgtgagtttcg

SEQ ID NO: 38918 - DNA, 29 bp, Artificial Sequence
  Description of Artificial Sequence: Synthetic oligonucleotide
tggacgacacccagttcgtgagtttcgac

SEQ ID NO: 38919 - DNA, 28 bp, Artificial Sequence
  Description of Artificial Sequence: Synthetic oligonucleotide
ggacgacacccagttcgtgagtttcgac

SEQ ID NO: 38920 - DNA, 29 bp, Artificial Sequence
  Description of Artificial Sequence: Synthetic oligonucleotide
gacgacacccagttcgtgagtttcgacag

SEQ ID NO: 38921 - DNA, 29 bp, Artificial Sequence
  Description of Artificial Sequence: Synthetic oligonucleotide
acgacacccagttcgtgagtttcgacagc

SEQ ID NO: 38922 - DNA, 28 bp, Artificial Sequence
  Description of Artificial Sequence: Synthetic oligonucleotide
cgacacccagttcgtgagtttcgacagc

SEQ ID NO: 38923 - DNA, 28 bp, Artificial Sequence
  Description of Artificial Sequence: Synthetic oligonucleotide
gacacccagttcgtgagtttcgacagcg

SEQ ID NO: 38924 - DNA, 29 bp, Artificial Sequence
  Description of Artificial Sequence: Synthetic oligonucleotide
acacccagttcgtgagtttcgacagcgac

SEQ ID NO: 38925 - DNA, 28 bp, Artificial Sequence
  Description of Artificial Sequence: Synthetic oligonucleotide
cacccagttcgtgagtttcgacagcgac

SEQ ID NO: 38926 - DNA, 28 bp, Artificial Sequence
  Description of Artificial Sequence: Synthetic oligonucleotide
acccagttcgtgagtttcgacagcgacg

SEQ ID NO: 38927 - DNA, 27 bp, Artificial Sequence
  Description of Artificial Sequence: Synthetic oligonucleotide
cccagttcgtgagtttcgacagcgacg

SEQ ID NO: 38928 - DNA, 27 bp, Artificial Sequence
  Description of Artificial Sequence: Synthetic oligonucleotide
ccagttcgtgagtttcgacagcgacgc

SEQ ID NO: 38929 - DNA, 27 bp, Artificial Sequence
  Description of Artificial Sequence: Synthetic oligonucleotide
catggatagagcaggaggggccggatt

SEQ ID NO: 38930 - DNA, 30 bp, Artificial Sequence
  Description of Artificial Sequence: Synthetic oligonucleotide
atggatagagcaggaggggccggattattg

SEQ ID NO: 38931 - DNA, 29 bp, Artificial Sequence
  Description of Artificial Sequence: Synthetic oligonucleotide
tggatagagcaggaggggccggattattg

SEQ ID NO: 38932 - DNA, 28 bp, Artificial Sequence
  Description of Artificial Sequence: Synthetic oligonucleotide
ggatagagcaggaggggccggattattg

SEQ ID NO: 38933 - DNA, 28 bp, Artificial Sequence
  Description of Artificial Sequence: Synthetic oligonucleotide
gatagagcaggaggggccggattattgg

SEQ ID NO: 38934 - DNA, 28 bp, Artificial Sequence
  Description of Artificial Sequence: Synthetic oligonucleotide
atagagcaggaggggccggattattggg

SEQ ID NO: 38935 - DNA, 27 bp, Artificial Sequence
  Description of Artificial Sequence: Synthetic oligonucleotide
tagagcaggaggggccggattattggg

SEQ ID NO: 38936 - DNA, 27 bp, Artificial Sequence
  Description of Artificial Sequence: Synthetic oligonucleotide
agagcaggaggggccggattattggga

SEQ ID NO: 38937 - DNA, 26 bp, Artificial Sequence
  Description of Artificial Sequence: Synthetic oligonucleotide
gagcaggaggggccggattattggga

SEQ ID NO: 38938 - DNA, 26 bp, Artificial Sequence
  Description of Artificial Sequence: Synthetic oligonucleotide
agcaggaggggccggattattgggac

SEQ ID NO: 38939 - DNA, 25 bp, Artificial Sequence
  Description of Artificial Sequence: Synthetic oligonucleotide
gcaggaggggccggattattgggac

SEQ ID NO: 38940 - DNA, 25 bp, Artificial Sequence
  Description of Artificial Sequence: Synthetic oligonucleotide
caggaggggccggattattgggacc

SEQ ID NO: 38941 - DNA, 25 bp, Artificial Sequence
  Description of Artificial Sequence: Synthetic oligonucleotide
aggaggggccggattattgggaccg

SEQ ID NO: 38942 - DNA, 24 bp, Artificial Sequence
  Description of Artificial Sequence: Synthetic oligonucleotide
ggaggggccggattattgggaccg

SEQ ID NO: 38943 - DNA, 26 bp, Artificial Sequence
  Description of Artificial Sequence: Synthetic oligonucleotide
gaggggccggattattgggaccggaa

SEQ ID NO: 38944 - DNA, 27 bp, Artificial Sequence
  Description of Artificial Sequence: Synthetic oligonucleotide
aggggccggattattgggaccggaaca

SEQ ID NO: 38945 - DNA, 26 bp, Artificial Sequence
  Description of Artificial Sequence: Synthetic oligonucleotide
ggggccggattattgggaccggaaca

SEQ ID NO: 38946 - DNA, 27 bp, Artificial Sequence
  Description of Artificial Sequence: Synthetic oligonucleotide
gggccggattattgggaccggaacaca

SEQ ID NO: 38947 - DNA, 27 bp, Artificial Sequence
  Description of Artificial Sequence: Synthetic oligonucleotide
ggccggattattgggaccggaacacac

SEQ ID NO: 38948 - DNA, 28 bp, Artificial Sequence
  Description of Artificial Sequence: Synthetic oligonucleotide
gccggattattgggaccggaacacacag

SEQ ID NO: 38949 - DNA, 30 bp, Artificial Sequence
  Description of Artificial Sequence: Synthetic oligonucleotide
ccggattattgggaccggaacacacagatc

SEQ ID NO: 38950 - DNA, 32 bp, Artificial Sequence
  Description of Artificial Sequence: Synthetic oligonucleotide
cggattattgggaccggaacacacagatcttc

SEQ ID NO: 38951 - DNA, 34 bp, Artificial Sequence
  Description of Artificial Sequence: Synthetic oligonucleotide
ggattattgggaccggaacacacagatcttcaag

SEQ ID NO: 38952 - DNA, 35 bp, Artificial Sequence
  Description of Artificial Sequence: Synthetic oligonucleotide
gattattgggaccggaacacacagatcttcaagac

SEQ ID NO: 38953 - DNA, 35 bp, Artificial Sequence
  Description of Artificial Sequence: Synthetic oligonucleotide
attattgggaccggaacacacagatcttcaagacc

SEQ ID NO: 38954 - DNA, 34 bp, Artificial Sequence
  Description of Artificial Sequence: Synthetic oligonucleotide
ttattgggaccggaacacacagatcttcaagacc

SEQ ID NO: 38955 - DNA, 30 bp, Artificial Sequence
  Description of Artificial Sequence: Synthetic oligonucleotide
acggcaaagattacatcgccctgaacgagc

SEQ ID NO: 38956 - DNA, 29 bp, Artificial Sequence
  Description of Artificial Sequence: Synthetic oligonucleotide
cggcaaagattacatcgccctgaacgagc

SEQ ID NO: 38957 - DNA, 30 bp, Artificial Sequence
  Description of Artificial Sequence: Synthetic oligonucleotide
ggcaaagattacatcgccctgaacgagcac

SEQ ID NO: 38958 - DNA, 30 bp, Artificial Sequence
  Description of Artificial Sequence: Synthetic oligonucleotide
gcaaagattacatcgccctgaacgagcacc

SEQ ID NO: 38959 - DNA, 31 bp, Artificial Sequence
  Description of Artificial Sequence: Synthetic oligonucleotide
caaagattacatcgccctgaacgagcacctg

SEQ ID NO: 38960 - DNA, 32 bp, Artificial Sequence
  Description of Artificial Sequence: Synthetic oligonucleotide
aaagattacatcgccctgaacgagcacctgag

SEQ ID NO: 38961 - DNA, 31 bp, Artificial Sequence
  Description of Artificial Sequence: Synthetic oligonucleotide
aagattacatcgccctgaacgagcacctgag

SEQ ID NO: 38962 - DNA, 30 bp, Artificial Sequence
  Description of Artificial Sequence: Synthetic oligonucleotide
agattacatcgccctgaacgagcacctgag

SEQ ID NO: 38963 - DNA, 29 bp, Artificial Sequence
  Description of Artificial Sequence: Synthetic oligonucleotide
gattacatcgccctgaacgagcacctgag

SEQ ID NO: 38964 - DNA, 29 bp, Artificial Sequence
  Description of Artificial Sequence: Synthetic oligonucleotide
attacatcgccctgaacgagcacctgagc

SEQ ID NO: 38965 - DNA, 28 bp, Artificial Sequence
  Description of Artificial Sequence: Synthetic oligonucleotide
ttacatcgccctgaacgagcacctgagc

SEQ ID NO: 38966 - DNA, 27 bp, Artificial Sequence
  Description of Artificial Sequence: Synthetic oligonucleotide
tacatcgccctgaacgagcacctgagc

SEQ ID NO: 38967 - DNA, 27 bp, Artificial Sequence
  Description of Artificial Sequence: Synthetic oligonucleotide
acatcgccctgaacgagcacctgagct

SEQ ID NO: 38968 - DNA, 26 bp, Artificial Sequence
  Description of Artificial Sequence: Synthetic oligonucleotide
catcgccctgaacgagcacctgagct

SEQ ID NO: 38969 - DNA, 26 bp, Artificial Sequence
  Description of Artificial Sequence: Synthetic oligonucleotide
atcgccctgaacgagcacctgagctc

SEQ ID NO: 38970 - DNA, 25 bp, Artificial Sequence
  Description of Artificial Sequence: Synthetic oligonucleotide
tcgccctgaacgagcacctgagctc

SEQ ID NO: 38971 - DNA, 24 bp, Artificial Sequence
  Description of Artificial Sequence: Synthetic oligonucleotide
cgccctgaacgagcacctgagctc

SEQ ID NO: 38972 - DNA, 25 bp, Artificial Sequence
  Description of Artificial Sequence: Synthetic oligonucleotide
gccctgaacgagcacctgagctcct

SEQ ID NO: 38973 - DNA, 25 bp, Artificial Sequence
  Description of Artificial Sequence: Synthetic oligonucleotide
ccctgaacgagcacctgagctcctg

SEQ ID NO: 38974 - DNA, 26 bp, Artificial Sequence
  Description of Artificial Sequence: Synthetic oligonucleotide
cctgaacgagcacctgagctcctgga

SEQ ID NO: 38975 - DNA, 26 bp, Artificial Sequence
  Description of Artificial Sequence: Synthetic oligonucleotide
ctgaacgagcacctgagctcctggac

SEQ ID NO: 38976 - DNA, 26 bp, Artificial Sequence
  Description of Artificial Sequence: Synthetic oligonucleotide
tgaacgagcacctgagctcctggacc

SEQ ID NO: 38977 - DNA, 25 bp, Artificial Sequence
  Description of Artificial Sequence: Synthetic oligonucleotide
gaacgagcacctgagctcctggacc

SEQ ID NO: 38978 - DNA, 25 bp, Artificial Sequence
  Description of Artificial Sequence: Synthetic oligonucleotide
aacgagcacctgagctcctggaccg

SEQ ID NO: 38979 - DNA, 24 bp, Artificial Sequence
  Description of Artificial Sequence: Synthetic oligonucleotide
acgagcacctgagctcctggaccg

SEQ ID NO: 38980 - DNA, 23 bp, Artificial Sequence
  Description of Artificial Sequence: Synthetic oligonucleotide
cgagcacctgagctcctggaccg

SEQ ID NO: 38981 - DNA, 23 bp, Artificial Sequence
  Description of Artificial Sequence: Synthetic oligonucleotide
gagcacctgagctcctggaccgc

SEQ ID NO: 38982 - DNA, 23 bp, Artificial Sequence
  Description of Artificial Sequence: Synthetic oligonucleotide
agcacctgagctcctggaccgcg

SEQ ID NO: 38983 - DNA, 22 bp, Artificial Sequence
  Description of Artificial Sequence: Synthetic oligonucleotide
gcacctgagctcctggaccgcg

SEQ ID NO: 38984 - DNA, 22 bp, Artificial Sequence
  Description of Artificial Sequence: Synthetic oligonucleotide
cacctgagctcctggaccgcgg

SEQ ID NO: 38985 - DNA, 20 bp, Artificial Sequence
  Description of Artificial Sequence: Synthetic oligonucleotide
cgaggacggagccccggggt

SEQ ID NO: 38986 - DNA, 20 bp, Artificial Sequence
  Description of Artificial Sequence: Synthetic oligonucleotide
gaggacggagccccgggggt

SEQ ID NO: 38987 - DNA, 20 bp, Artificial Sequence
  Description of Artificial Sequence: Synthetic oligonucleotide
aggacggagccccgggggct

SEQ ID NO: 38988 - DNA, 20 bp, Artificial Sequence
  Description of Artificial Sequence: Synthetic oligonucleotide
ggacggagccccgggggctt

SEQ ID NO: 38989 - DNA, 20 bp, Artificial Sequence
  Description of Artificial Sequence: Synthetic oligonucleotide
gacggagccccgggggccat

SEQ ID NO: 38990 - DNA, 20 bp, Artificial Sequence
  Description of Artificial Sequence: Synthetic oligonucleotide
acggagccccgggggccatg

SEQ ID NO: 38991 - DNA, 20 bp, Artificial Sequence
  Description of Artificial Sequence: Synthetic oligonucleotide
cggagccccgggggccatgt

SEQ ID NO: 38992 - DNA, 22 bp, Artificial Sequence
  Description of Artificial Sequence: Synthetic oligonucleotide
ggagccccgggggccatggata

SEQ ID NO: 38993 - DNA, 23 bp, Artificial Sequence
  Description of Artificial Sequence: Synthetic oligonucleotide
gagccccgggggccatggataga

SEQ ID NO: 38994 - DNA, 23 bp, Artificial Sequence
  Description of Artificial Sequence: Synthetic oligonucleotide
agccccgggggccatggatagag

SEQ ID NO: 38995 - DNA, 22 bp, Artificial Sequence
  Description of Artificial Sequence: Synthetic oligonucleotide
gccccgggggccatggatagag

SEQ ID NO: 38996 - DNA, 23 bp, Artificial Sequence
  Description of Artificial Sequence: Synthetic oligonucleotide
ccccgggggccatggatagagca

SEQ ID NO: 38997 - DNA, 23 bp, Artificial Sequence
  Description of Artificial Sequence: Synthetic oligonucleotide
cccgggggccatggatagagcag

SEQ ID NO: 38998 - DNA, 24 bp, Artificial Sequence
  Description of Artificial Sequence: Synthetic oligonucleotide
ccgggggccatggatagagcagga

SEQ ID NO: 38999 - DNA, 24 bp, Artificial Sequence
  Description of Artificial Sequence: Synthetic oligonucleotide
cgggggccatggatagagcaggag

SEQ ID NO: 39000 - DNA, 24 bp, Artificial Sequence
  Description of Artificial Sequence: Synthetic oligonucleotide
gggggccatggatagagcaggagg

SEQ ID NO: 39001 - DNA, 24 bp, Artificial Sequence
  Description of Artificial Sequence: Synthetic oligonucleotide
ggggccatggatagagcaggaggg

SEQ ID NO: 39002 - DNA, 24 bp, Artificial Sequence
  Description of Artificial Sequence: Synthetic oligonucleotide
gggccatggatagagcaggagggg

SEQ ID NO: 39003 - DNA, 24 bp, Artificial Sequence
  Description of Artificial Sequence: Synthetic oligonucleotide
ggccatggatagagcaggaggggc

SEQ ID NO: 39004 - DNA, 24 bp, Artificial Sequence
  Description of Artificial Sequence: Synthetic oligonucleotide
acaccgcggctcagatcacccagg

SEQ ID NO: 39005 - DNA, 23 bp, Artificial Sequence
  Description of Artificial Sequence: Synthetic oligonucleotide
caccgcggctcagatcacccagg

SEQ ID NO: 39006 - DNA, 23 bp, Artificial Sequence
  Description of Artificial Sequence: Synthetic oligonucleotide
accgcggctcagatcacccaggg

SEQ ID NO: 39007 - DNA, 22 bp, Artificial Sequence
  Description of Artificial Sequence: Synthetic oligonucleotide
ccgcggctcagatcacccaggg

SEQ ID NO: 39008 - DNA, 24 bp, Artificial Sequence
  Description of Artificial Sequence: Synthetic oligonucleotide
cgcggctcagatcacccagggcaa

SEQ ID NO: 39009 - DNA, 20 bp, Artificial Sequence
  Description of Artificial Sequence: Synthetic oligonucleotide
cgcggcggacaccgcggcta

SEQ ID NO: 39010 - DNA, 20 bp, Artificial Sequence
  Description of Artificial Sequence: Synthetic oligonucleotide
gcggcggacaccgcggctag

SEQ ID NO: 39011 - DNA, 22 bp, Artificial Sequence
  Description of Artificial Sequence: Synthetic oligonucleotide
cggcggacaccgcggctaggat

SEQ ID NO: 39012 - DNA, 23 bp, Artificial Sequence
  Description of Artificial Sequence: Synthetic oligonucleotide
ggcggacaccgcggctaggatca

SEQ ID NO: 39013 - DNA, 23 bp, Artificial Sequence
  Description of Artificial Sequence: Synthetic oligonucleotide
gcggacaccgcggctaggatcac

SEQ ID NO: 39014 - DNA, 23 bp, Artificial Sequence
  Description of Artificial Sequence: Synthetic oligonucleotide
cggacaccgcggctaggatcacc

SEQ ID NO: 39015 - DNA, 24 bp, Artificial Sequence
  Description of Artificial Sequence: Synthetic oligonucleotide
ggacaccgcggctaggatcaccca

SEQ ID NO: 39016 - DNA, 24 bp, Artificial Sequence
  Description of Artificial Sequence: Synthetic oligonucleotide
gacaccgcggctaggatcacccag

SEQ ID NO: 39017 - DNA, 24 bp, Artificial Sequence
  Description of Artificial Sequence: Synthetic oligonucleotide
acaccgcggctaggatcacccagc

SEQ ID NO: 39018 - DNA, 23 bp, Artificial Sequence
  Description of Artificial Sequence: Synthetic oligonucleotide
caccgcggctaggatcacccagc

SEQ ID NO: 39019 - DNA, 23 bp, Artificial Sequence
  Description of Artificial Sequence: Synthetic oligonucleotide
accgcggctaggatcacccagcg

SEQ ID NO: 39020 - DNA, 22 bp, Artificial Sequence
  Description of Artificial Sequence: Synthetic oligonucleotide
ccgcggctaggatcacccagcg

SEQ ID NO: 39021 - DNA, 24 bp, Artificial Sequence
  Description of Artificial Sequence: Synthetic oligonucleotide
cgcggctaggatcacccagcgcaa

SEQ ID NO: 39022 - DNA, 25 bp, Artificial Sequence
  Description of Artificial Sequence: Synthetic oligonucleotide
gcggctaggatcacccagcgcaagt

SEQ ID NO: 39023 - DNA, 25 bp, Artificial Sequence
  Description of Artificial Sequence: Synthetic oligonucleotide
cggctaggatcacccagcgcaagtg

SEQ ID NO: 39024 - DNA, 25 bp, Artificial Sequence
  Description of Artificial Sequence: Synthetic oligonucleotide
ggctaggatcacccagcgcaagtgg

SEQ ID NO: 39025 - DNA, 26 bp, Artificial Sequence
  Description of Artificial Sequence: Synthetic oligonucleotide
gctaggatcacccagcgcaagtggga

SEQ ID NO: 39026 - DNA, 26 bp, Artificial Sequence
  Description of Artificial Sequence: Synthetic oligonucleotide
ctaggatcacccagcgcaagtgggag

SEQ ID NO: 39027 - DNA, 26 bp, Artificial Sequence
  Description of Artificial Sequence: Synthetic oligonucleotide
taggatcacccagcgcaagtgggagg

SEQ ID NO: 39028 - DNA, 25 bp, Artificial Sequence
  Description of Artificial Sequence: Synthetic oligonucleotide
aggatcacccagcgcaagtgggagg

SEQ ID NO: 39029 - DNA, 23 bp, Artificial Sequence
  Description of Artificial Sequence: Synthetic oligonucleotide
gcaagtgggaggcggcccgtgat

SEQ ID NO: 39030 - DNA, 23 bp, Artificial Sequence
  Description of Artificial Sequence: Synthetic oligonucleotide
caagtgggaggcggcccgtgatg

SEQ ID NO: 39031 - DNA, 23 bp, Artificial Sequence
  Description of Artificial Sequence: Synthetic oligonucleotide
aagtgggaggcggcccgtgatgc

SEQ ID NO: 39032 - DNA, 22 bp, Artificial Sequence
  Description of Artificial Sequence: Synthetic oligonucleotide
agtgggaggcggcccgtgatgc

SEQ ID NO: 39033 - DNA, 21 bp, Artificial Sequence
  Description of Artificial Sequence: Synthetic oligonucleotide
gtgggaggcggcccgtgatgc

SEQ ID NO: 39034 - DNA, 21 bp, Artificial Sequence
  Description of Artificial Sequence: Synthetic oligonucleotide
tgggaggcggcccgtgatgcg

SEQ ID NO: 39035 - DNA, 20 bp, Artificial Sequence
  Description of Artificial Sequence: Synthetic oligonucleotide
gggaggcggcccgtgatgcg

SEQ ID NO: 39036 - DNA, 21 bp, Artificial Sequence
  Description of Artificial Sequence: Synthetic oligonucleotide
ggaggcggcccgtgatgcgga

SEQ ID NO: 39037 - DNA, 21 bp, Artificial Sequence
  Description of Artificial Sequence: Synthetic oligonucleotide
gaggcggcccgtgatgcggag

SEQ ID NO: 39038 - DNA, 22 bp, Artificial Sequence
  Description of Artificial Sequence: Synthetic oligonucleotide
aggcggcccgtgatgcggagca

SEQ ID NO: 39039 - DNA, 21 bp, Artificial Sequence
  Description of Artificial Sequence: Synthetic oligonucleotide
ggcggcccgtgatgcggagca

SEQ ID NO: 39040 - DNA, 21 bp, Artificial Sequence
  Description of Artificial Sequence: Synthetic oligonucleotide
gcggcccgtgatgcggagcag

SEQ ID NO: 39041 - DNA, 22 bp, Artificial Sequence
  Description of Artificial Sequence: Synthetic oligonucleotide
cggcccgtgatgcggagcagct

SEQ ID NO: 39042 - DNA, 23 bp, Artificial Sequence
  Description of Artificial Sequence: Synthetic oligonucleotide
ggcccgtgatgcggagcagctga

SEQ ID NO: 39043 - DNA, 24 bp, Artificial Sequence
  Description of Artificial Sequence: Synthetic oligonucleotide
gcccgtgatgcggagcagctgaga

SEQ ID NO: 39044 - DNA, 24 bp, Artificial Sequence
  Description of Artificial Sequence: Synthetic oligonucleotide
cccgtgatgcggagcagctgagag

SEQ ID NO: 39045 - DNA, 24 bp, Artificial Sequence
  Description of Artificial Sequence: Synthetic oligonucleotide
ccgtgatgcggagcagctgagagc

SEQ ID NO: 39046 - DNA, 26 bp, Artificial Sequence
  Description of Artificial Sequence: Synthetic oligonucleotide
cgtgatgcggagcagctgagagccta

SEQ ID NO: 39047 - DNA, 26 bp, Artificial Sequence
  Description of Artificial Sequence: Synthetic oligonucleotide
gtgatgcggagcagctgagagcctac

SEQ ID NO: 39048 - DNA, 27 bp, Artificial Sequence
  Description of Artificial Sequence: Synthetic oligonucleotide
tgatgcggagcagctgagagcctacct

SEQ ID NO: 39049 - DNA, 26 bp, Artificial Sequence
  Description of Artificial Sequence: Synthetic oligonucleotide
gatgcggagcagctgagagcctacct

SEQ ID NO: 39050 - DNA, 26 bp, Artificial Sequence
  Description of Artificial Sequence: Synthetic oligonucleotide
atgcggagcagctgagagcctacctg

SEQ ID NO: 39051 - DNA, 25 bp, Artificial Sequence
  Description of Artificial Sequence: Synthetic oligonucleotide
tgcggagcagctgagagcctacctg

SEQ ID NO: 39052 - DNA, 25 bp, Artificial Sequence
  Description of Artificial Sequence: Synthetic oligonucleotide
ggagcagctgagagcctacctggac

SEQ ID NO: 39053 - DNA, 25 bp, Artificial Sequence
  Description of Artificial Sequence: Synthetic oligonucleotide
gagcagctgagagcctacctggacg

SEQ ID NO: 39054 - DNA, 25 bp, Artificial Sequence
  Description of Artificial Sequence: Synthetic oligonucleotide
agcagctgagagcctacctggacgg

SEQ ID NO: 39055 - DNA, 24 bp, Artificial Sequence
  Description of Artificial Sequence: Synthetic oligonucleotide
gcagctgagagcctacctggacgg

SEQ ID NO: 39056 - DNA, 24 bp, Artificial Sequence
  Description of Artificial Sequence: Synthetic oligonucleotide
cagctgagagcctacctggacggc

SEQ ID NO: 39057 - DNA, 25 bp, Artificial Sequence
  Description of Artificial Sequence: Synthetic oligonucleotide
agctgagagcctacctggacggcct

SEQ ID NO: 39058 - DNA, 24 bp, Artificial Sequence
  Description of Artificial Sequence: Synthetic oligonucleotide
gctgagagcctacctggacggcct

SEQ ID NO: 39059 - DNA, 25 bp, Artificial Sequence
  Description of Artificial Sequence: Synthetic oligonucleotide
ctgagagcctacctggacggcctgt

SEQ ID NO: 39060 - DNA, 25 bp, Artificial Sequence
  Description of Artificial Sequence: Synthetic oligonucleotide
tgagagcctacctggacggcctgtg

SEQ ID NO: 39061 - DNA, 24 bp, Artificial Sequence
  Description of Artificial Sequence: Synthetic oligonucleotide
gagagcctacctggacggcctgtg

SEQ ID NO: 39062 - DNA, 24 bp, Artificial Sequence
  Description of Artificial Sequence: Synthetic oligonucleotide
agagcctacctggacggcctgtgc

SEQ ID NO: 39063 - DNA, 23 bp, Artificial Sequence
  Description of Artificial Sequence: Synthetic oligonucleotide
gagcctacctggacggcctgtgc

SEQ ID NO: 39064 - DNA, 24 bp, Artificial Sequence
  Description of Artificial Sequence: Synthetic oligonucleotide
agcctacctggacggcctgtgcgt

SEQ ID NO: 39065 - DNA, 23 bp, Artificial Sequence
  Description of Artificial Sequence: Synthetic oligonucleotide
gcctacctggacggcctgtgcgt

SEQ ID NO: 39066 - DNA, 23 bp, Artificial Sequence
  Description of Artificial Sequence: Synthetic oligonucleotide
cctacctggacggcctgtgcgtg

SEQ ID NO: 39067 - DNA, 24 bp, Artificial Sequence
  Description of Artificial Sequence: Synthetic oligonucleotide
ctacctggacggcctgtgcgtgga

SEQ ID NO: 39068 - DNA, 25 bp, Artificial Sequence
  Description of Artificial Sequence: Synthetic oligonucleotide
tacctggacggcctgtgcgtggagt

SEQ ID NO: 39069 - DNA, 24 bp, Artificial Sequence
  Description of Artificial Sequence: Synthetic oligonucleotide
acctggacggcctgtgcgtggagt

SEQ ID NO: 39070 - DNA, 23 bp, Artificial Sequence
  Description of Artificial Sequence: Synthetic oligonucleotide
cctggacggcctgtgcgtggagt

SEQ ID NO: 39071 - DNA, 23 bp, Artificial Sequence
  Description of Artificial Sequence: Synthetic oligonucleotide
ctggacggcctgtgcgtggagtg

SEQ ID NO: 39072 - DNA, 23 bp, Artificial Sequence
  Description of Artificial Sequence: Synthetic oligonucleotide
tggacggcctgtgcgtggagtgg

SEQ ID NO: 39073 - DNA, 22 bp, Artificial Sequence
  Description of Artificial Sequence: Synthetic oligonucleotide
ggacggcctgtgcgtggagtgg

SEQ ID NO: 39074 - DNA, 23 bp, Artificial Sequence
  Description of Artificial Sequence: Synthetic oligonucleotide
gacggcctgtgcgtggagtggct

SEQ ID NO: 39075 - DNA, 23 bp, Artificial Sequence
  Description of Artificial Sequence: Synthetic oligonucleotide
acggcctgtgcgtggagtggctc

SEQ ID NO: 39076 - DNA, 22 bp, Artificial Sequence
  Description of Artificial Sequence: Synthetic oligonucleotide
cggcctgtgcgtggagtggctc

SEQ ID NO: 39077 - DNA, 22 bp, Artificial Sequence
  Description of Artificial Sequence: Synthetic oligonucleotide
ccgcggggagccccgcttgatt

SEQ ID NO: 39078 - DNA, 22 bp, Artificial Sequence
  Description of Artificial Sequence: Synthetic oligonucleotide
cgcggggagccccgcttgattg

SEQ ID NO: 39079 - DNA, 23 bp, Artificial Sequence
  Description of Artificial Sequence: Synthetic oligonucleotide
gcggggagccccgcttgattgca

SEQ ID NO: 39080 - DNA, 24 bp, Artificial Sequence
  Description of Artificial Sequence: Synthetic oligonucleotide
cggggagccccgcttgattgcagt

SEQ ID NO: 39081 - DNA, 24 bp, Artificial Sequence
  Description of Artificial Sequence: Synthetic oligonucleotide
ggggagccccgcttgattgcagtg

SEQ ID NO: 39082 - DNA, 24 bp, Artificial Sequence
  Description of Artificial Sequence: Synthetic oligonucleotide
gggagccccgcttgattgcagtgg

SEQ ID NO: 39083 - DNA, 24 bp, Artificial Sequence
  Description of Artificial Sequence: Synthetic oligonucleotide
ggagccccgcttgattgcagtggg

SEQ ID NO: 39084 - DNA, 26 bp, Artificial Sequence
  Description of Artificial Sequence: Synthetic oligonucleotide
gagccccgcttgattgcagtgggcta

SEQ ID NO: 39085 - DNA, 26 bp, Artificial Sequence
  Description of Artificial Sequence: Synthetic oligonucleotide
agccccgcttgattgcagtgggctac

SEQ ID NO: 39086 - DNA, 25 bp, Artificial Sequence
  Description of Artificial Sequence: Synthetic oligonucleotide
gccccgcttgattgcagtgggctac

SEQ ID NO: 39087 - DNA, 26 bp, Artificial Sequence
  Description of Artificial Sequence: Synthetic oligonucleotide
ccccgcttgattgcagtgggctacgt

SEQ ID NO: 39088 - DNA, 26 bp, Artificial Sequence
  Description of Artificial Sequence: Synthetic oligonucleotide
cccgcttgattgcagtgggctacgtg

SEQ ID NO: 39089 - DNA, 27 bp, Artificial Sequence
  Description of Artificial Sequence: Synthetic oligonucleotide
ccgcttgattgcagtgggctacgtgga

SEQ ID NO: 39090 - DNA, 27 bp, Artificial Sequence
  Description of Artificial Sequence: Synthetic oligonucleotide
cgcttgattgcagtgggctacgtggac

SEQ ID NO: 39091 - DNA, 27 bp, Artificial Sequence
  Description of Artificial Sequence: Synthetic oligonucleotide
gcttgattgcagtgggctacgtggacg

SEQ ID NO: 39092 - DNA, 28 bp, Artificial Sequence
  Description of Artificial Sequence: Synthetic oligonucleotide
cttgattgcagtgggctacgtggacgac

SEQ ID NO: 39093 - DNA, 29 bp, Artificial Sequence
  Description of Artificial Sequence: Synthetic oligonucleotide
ttgattgcagtgggctacgtggacgacac

SEQ ID NO: 39094 - DNA, 28 bp, Artificial Sequence
  Description of Artificial Sequence: Synthetic oligonucleotide
tgattgcagtgggctacgtggacgacac

SEQ ID NO: 39095 - DNA, 27 bp, Artificial Sequence
  Description of Artificial Sequence: Synthetic oligonucleotide
gattgcagtgggctacgtggacgacac

SEQ ID NO: 39096 - DNA, 23 bp, Artificial Sequence
  Description of Artificial Sequence: Synthetic oligonucleotide
caagtgggaggcggcccgtgaga

SEQ ID NO: 39097 - DNA, 23 bp, Artificial Sequence
  Description of Artificial Sequence: Synthetic oligonucleotide
aagtgggaggcggcccgtgagac

SEQ ID NO: 39098 - DNA, 22 bp, Artificial Sequence
  Description of Artificial Sequence: Synthetic oligonucleotide
agtgggaggcggcccgtgagac

SEQ ID NO: 39099 - DNA, 21 bp, Artificial Sequence
  Description of Artificial Sequence: Synthetic oligonucleotide
gtgggaggcggcccgtgagac

SEQ ID NO: 39100 - DNA, 21 bp, Artificial Sequence
  Description of Artificial Sequence: Synthetic oligonucleotide
tgggaggcggcccgtgagacg

SEQ ID NO: 39101 - DNA, 20 bp, Artificial Sequence
  Description of Artificial Sequence: Synthetic oligonucleotide
gggaggcggcccgtgagacg

SEQ ID NO: 39102 - DNA, 21 bp, Artificial Sequence
  Description of Artificial Sequence: Synthetic oligonucleotide
ggaggcggcccgtgagacgga

SEQ ID NO: 39103 - DNA, 21 bp, Artificial Sequence
  Description of Artificial Sequence: Synthetic oligonucleotide
gaggcggcccgtgagacggag

SEQ ID NO: 39104 - DNA, 22 bp, Artificial Sequence
  Description of Artificial Sequence: Synthetic oligonucleotide
aggcggcccgtgagacggagca

SEQ ID NO: 39105 - DNA, 21 bp, Artificial Sequence
  Description of Artificial Sequence: Synthetic oligonucleotide
ggcggcccgtgagacggagca

SEQ ID NO: 39106 - DNA, 21 bp, Artificial Sequence
  Description of Artificial Sequence: Synthetic oligonucleotide
gcggcccgtgagacggagcag

SEQ ID NO: 39107 - DNA, 22 bp, Artificial Sequence
  Description of Artificial Sequence: Synthetic oligonucleotide
cggcccgtgagacggagcagct

SEQ ID NO: 39108 - DNA, 23 bp, Artificial Sequence
  Description of Artificial Sequence: Synthetic oligonucleotide
ggcccgtgagacggagcagctga

SEQ ID NO: 39109 - DNA, 24 bp, Artificial Sequence
  Description of Artificial Sequence: Synthetic oligonucleotide
gcccgtgagacggagcagctgaga

SEQ ID NO: 39110 - DNA, 24 bp, Artificial Sequence
  Description of Artificial Sequence: Synthetic oligonucleotide
cccgtgagacggagcagctgagag

SEQ ID NO: 39111 - DNA, 24 bp, Artificial Sequence
  Description of Artificial Sequence: Synthetic oligonucleotide
ccgtgagacggagcagctgagagc

SEQ ID NO: 39112 - DNA, 26 bp, Artificial Sequence
  Description of Artificial Sequence: Synthetic oligonucleotide
cgtgagacggagcagctgagagccta

SEQ ID NO: 39113 - DNA, 26 bp, Artificial Sequence
  Description of Artificial Sequence: Synthetic oligonucleotide
gtgagacggagcagctgagagcctac

SEQ ID NO: 39114 - DNA, 27 bp, Artificial Sequence
  Description of Artificial Sequence: Synthetic oligonucleotide
tgagacggagcagctgagagcctacct

SEQ ID NO: 39115 - DNA, 26 bp, Artificial Sequence
  Description of Artificial Sequence: Synthetic oligonucleotide
gagacggagcagctgagagcctacct

SEQ ID NO: 39116 - DNA, 26 bp, Artificial Sequence
  Description of Artificial Sequence: Synthetic oligonucleotide
agacggagcagctgagagcctacctg

SEQ ID NO: 39117 - DNA, 25 bp, Artificial Sequence
  Description of Artificial Sequence: Synthetic oligonucleotide
gacggagcagctgagagcctacctg

SEQ ID NO: 39118 - DNA, 26 bp, Artificial Sequence
  Description of Artificial Sequence: Synthetic oligonucleotide
acggagcagctgagagcctacctgga

SEQ ID NO: 39119 - DNA, 20 bp, Artificial Sequence
  Description of Artificial Sequence: Synthetic oligonucleotide
ccggacgggcgcctcctctg

SEQ ID NO: 39120 - DNA, 20 bp, Artificial Sequence
  Description of Artificial Sequence: Synthetic oligonucleotide
cggacgggcgcctcctctgc

SEQ ID NO: 39121 - DNA, 20 bp, Artificial Sequence
  Description of Artificial Sequence: Synthetic oligonucleotide
ggacgggcgcctcctctgcg

SEQ ID NO: 39122 - DNA, 20 bp, Artificial Sequence
  Description of Artificial Sequence: Synthetic oligonucleotide
gacgggcgcctcctctgcgg

SEQ ID NO: 39123 - DNA, 20 bp, Artificial Sequence
  Description of Artificial Sequence: Synthetic oligonucleotide
acgggcgcctcctctgcggg

SEQ ID NO: 39124 - DNA, 20 bp, Artificial Sequence
  Description of Artificial Sequence: Synthetic oligonucleotide
cgggcgcctcctctgcgggt

SEQ ID NO: 39125 - DNA, 23 bp, Artificial Sequence
  Description of Artificial Sequence: Synthetic oligonucleotide
gggcgcctcctctgcgggcataa

SEQ ID NO: 39126 - DNA, 23 bp, Artificial Sequence
  Description of Artificial Sequence: Synthetic oligonucleotide
ggcgcctcctctgcgggcataac

SEQ ID NO: 39127 - DNA, 24 bp, Artificial Sequence
  Description of Artificial Sequence: Synthetic oligonucleotide
gcgcctcctctgcgggcataacca

SEQ ID NO: 39128 - DNA, 26 bp, Artificial Sequence
  Description of Artificial Sequence: Synthetic oligonucleotide
cgcctcctctgcgggcataaccagta

SEQ ID NO: 39129 - DNA, 26 bp, Artificial Sequence
  Description of Artificial Sequence: Synthetic oligonucleotide
gcctcctctgcgggcataaccagtac

SEQ ID NO: 39130 - DNA, 26 bp, Artificial Sequence
  Description of Artificial Sequence: Synthetic oligonucleotide
cctcctctgcgggcataaccagtacg

SEQ ID NO: 39131 - DNA, 26 bp, Artificial Sequence
  Description of Artificial Sequence: Synthetic oligonucleotide
ctcctctgcgggcataaccagtacgc

SEQ ID NO: 39132 - DNA, 27 bp, Artificial Sequence
  Description of Artificial Sequence: Synthetic oligonucleotide
tcctctgcgggcataaccagtacgcct

SEQ ID NO: 39133 - DNA, 27 bp, Artificial Sequence
  Description of Artificial Sequence: Synthetic oligonucleotide
cctctgcgggcataaccagtacgccta

SEQ ID NO: 39134 - DNA, 27 bp, Artificial Sequence
  Description of Artificial Sequence: Synthetic oligonucleotide
ctctgcgggcataaccagtacgcctac

SEQ ID NO: 39135 - DNA, 27 bp, Artificial Sequence
  Description of Artificial Sequence: Synthetic oligonucleotide
tctgcgggcataaccagtacgcctacg

SEQ ID NO: 39136 - DNA, 27 bp, Artificial Sequence
  Description of Artificial Sequence: Synthetic oligonucleotide
ctgcgggcataaccagtacgcctacga

SEQ ID NO: 39137 - DNA, 27 bp, Artificial Sequence
  Description of Artificial Sequence: Synthetic oligonucleotide
tgcgggcataaccagtacgcctacgac

SEQ ID NO: 39138 - DNA, 25 bp, Artificial Sequence
  Description of Artificial Sequence: Synthetic oligonucleotide
cctgtgcatggagtggctccgcaga

SEQ ID NO: 39139 - DNA, 26 bp, Artificial Sequence
  Description of Artificial Sequence: Synthetic oligonucleotide
ctgtgcatggagtggctccgcagaca

SEQ ID NO: 39140 - DNA, 26 bp, Artificial Sequence
  Description of Artificial Sequence: Synthetic oligonucleotide
tgtgcatggagtggctccgcagacac

SEQ ID NO: 39141 - DNA, 25 bp, Artificial Sequence
  Description of Artificial Sequence: Synthetic oligonucleotide
gtgcatggagtggctccgcagacac

SEQ ID NO: 39142 - DNA, 26 bp, Artificial Sequence
  Description of Artificial Sequence: Synthetic oligonucleotide
tgcatggagtggctccgcagacacct

SEQ ID NO: 39143 - DNA, 25 bp, Artificial Sequence
  Description of Artificial Sequence: Synthetic oligonucleotide
gcatggagtggctccgcagacacct

SEQ ID NO: 39144 - DNA, 25 bp, Artificial Sequence
  Description of Artificial Sequence: Synthetic oligonucleotide
catggagtggctccgcagacacctg

SEQ ID NO: 39145 - DNA, 26 bp, Artificial Sequence
  Description of Artificial Sequence: Synthetic oligonucleotide
atggagtggctccgcagacacctgga

SEQ ID NO: 39146 - DNA, 25 bp, Artificial Sequence
  Description of Artificial Sequence: Synthetic oligonucleotide
gagaacgggaaggagacgctgcagg

SEQ ID NO: 39147 - DNA, 25 bp, Artificial Sequence
  Description of Artificial Sequence: Synthetic oligonucleotide
agaacgggaaggagacgctgcaggg

SEQ ID NO: 39148 - DNA, 24 bp, Artificial Sequence
  Description of Artificial Sequence: Synthetic oligonucleotide
gaacgggaaggagacgctgcaggg

SEQ ID NO: 39149 - DNA, 24 bp, Artificial Sequence
  Description of Artificial Sequence: Synthetic oligonucleotide
aacgggaaggagacgctgcagggc

SEQ ID NO: 39150 - DNA, 23 bp, Artificial Sequence
  Description of Artificial Sequence: Synthetic oligonucleotide
acgggaaggagacgctgcagggc

SEQ ID NO: 39151 - DNA, 22 bp, Artificial Sequence
  Description of Artificial Sequence: Synthetic oligonucleotide
cgggaaggagacgctgcagggc

SEQ ID NO: 39152 - DNA, 22 bp, Artificial Sequence
  Description of Artificial Sequence: Synthetic oligonucleotide
gggaaggagacgctgcagggcg

SEQ ID NO: 39153 - DNA, 22 bp, Artificial Sequence
  Description of Artificial Sequence: Synthetic oligonucleotide
ggaaggagacgctgcagggcgc

SEQ ID NO: 39154 - DNA, 22 bp, Artificial Sequence
  Description of Artificial Sequence: Synthetic oligonucleotide
gaaggagacgctgcagggcgcg

SEQ ID NO: 39155 - DNA, 23 bp, Artificial Sequence
  Description of Artificial Sequence: Synthetic oligonucleotide
aaggagacgctgcagggcgcgga

SEQ ID NO: 39156 - DNA, 22 bp, Artificial Sequence
  Description of Artificial Sequence: Synthetic oligonucleotide
aggagacgctgcagggcgcgga

SEQ ID NO: 39157 - DNA, 21 bp, Artificial Sequence
  Description of Artificial Sequence: Synthetic oligonucleotide
ggagacgctgcagggcgcgga

SEQ ID NO: 39158 - DNA, 21 bp, Artificial Sequence
  Description of Artificial Sequence: Synthetic oligonucleotide
gagacgctgcagggcgcggac

SEQ ID NO: 39159 - DNA, 21 bp, Artificial Sequence
  Description of Artificial Sequence: Synthetic oligonucleotide
agacgctgcagggcgcggacc

SEQ ID NO: 39160 - DNA, 20 bp, Artificial Sequence
  Description of Artificial Sequence: Synthetic oligonucleotide
gacgctgcagggcgcggacc

SEQ ID NO: 39161 - DNA, 20 bp, Artificial Sequence
  Description of Artificial Sequence: Synthetic oligonucleotide
acgctgcagggcgcggaccc

SEQ ID NO: 39162 - DNA, 20 bp, Artificial Sequence
  Description of Artificial Sequence: Synthetic oligonucleotide
cgctgcagggcgcggaccct

SEQ ID NO: 39163 - DNA, 20 bp, Artificial Sequence
  Description of Artificial Sequence: Synthetic oligonucleotide
gctgcagggcgcggacccct

SEQ ID NO: 39164 - DNA, 20 bp, Artificial Sequence
  Description of Artificial Sequence: Synthetic oligonucleotide
ctgcagggcgcggaccccct

SEQ ID NO: 39165 - DNA, 22 bp, Artificial Sequence
  Description of Artificial Sequence: Synthetic oligonucleotide
tgcagggcgcggaccccccaaa

SEQ ID NO: 39166 - DNA, 21 bp, Artificial Sequence
  Description of Artificial Sequence: Synthetic oligonucleotide
gcagggcgcggaccccccaaa

SEQ ID NO: 39167 - DNA, 22 bp, Artificial Sequence
  Description of Artificial Sequence: Synthetic oligonucleotide
cagggcgcggaccccccaaaga

SEQ ID NO: 39168 - DNA, 23 bp, Artificial Sequence
  Description of Artificial Sequence: Synthetic oligonucleotide
agggcgcggaccccccaaagaca

SEQ ID NO: 39169 - DNA, 22 bp, Artificial Sequence
  Description of Artificial Sequence: Synthetic oligonucleotide
gggcgcggaccccccaaagaca

SEQ ID NO: 39170 - DNA, 23 bp, Artificial Sequence
  Description of Artificial Sequence: Synthetic oligonucleotide
ggcgcggaccccccaaagacaca

SEQ ID NO: 39171 - DNA, 34 bp, Artificial Sequence
  Description of Artificial Sequence: Synthetic oligonucleotide
caagaccaacacacagacttaccgagagaacttg

SEQ ID NO: 39172 - DNA, 34 bp, Artificial Sequence
  Description of Artificial Sequence: Synthetic oligonucleotide
aagaccaacacacagacttaccgagagaacttgc

SEQ ID NO: 39173 - DNA, 33 bp, Artificial Sequence
  Description of Artificial Sequence: Synthetic oligonucleotide
agaccaacacacagacttaccgagagaacttgc

SEQ ID NO: 39174 - DNA, 32 bp, Artificial Sequence
  Description of Artificial Sequence: Synthetic oligonucleotide
gaccaacacacagacttaccgagagaacttgc

SEQ ID NO: 39175 - DNA, 32 bp, Artificial Sequence
  Description of Artificial Sequence: Synthetic oligonucleotide
accaacacacagacttaccgagagaacttgcg

SEQ ID NO: 39176 - DNA, 31 bp, Artificial Sequence
  Description of Artificial Sequence: Synthetic oligonucleotide
ccaacacacagacttaccgagagaacttgcg

SEQ ID NO: 39177 - DNA, 31 bp, Artificial Sequence
  Description of Artificial Sequence: Synthetic oligonucleotide
caacacacagacttaccgagagaacttgcgg

SEQ ID NO: 39178 - DNA, 33 bp, Artificial Sequence
  Description of Artificial Sequence: Synthetic oligonucleotide
aacacacagacttaccgagagaacttgcggatc

SEQ ID NO: 39179 - DNA, 32 bp, Artificial Sequence
  Description of Artificial Sequence: Synthetic oligonucleotide
acacacagacttaccgagagaacttgcggatc

SEQ ID NO: 39180 - DNA, 31 bp, Artificial Sequence
  Description of Artificial Sequence: Synthetic oligonucleotide
cacacagacttaccgagagaacttgcggatc

SEQ ID NO: 39181 - DNA, 31 bp, Artificial Sequence
  Description of Artificial Sequence: Synthetic oligonucleotide
acacagacttaccgagagaacttgcggatcg

SEQ ID NO: 39182 - DNA, 30 bp, Artificial Sequence
  Description of Artificial Sequence: Synthetic oligonucleotide
cacagacttaccgagagaacttgcggatcg

SEQ ID NO: 39183 - DNA, 30 bp, Artificial Sequence
  Description of Artificial Sequence: Synthetic oligonucleotide
acagacttaccgagagaacttgcggatcgc

SEQ ID NO: 39184 - DNA, 29 bp, Artificial Sequence
  Description of Artificial Sequence: Synthetic oligonucleotide
cagacttaccgagagaacttgcggatcgc

SEQ ID NO: 39185 - DNA, 29 bp, Artificial Sequence
  Description of Artificial Sequence: Synthetic oligonucleotide
agacttaccgagagaacttgcggatcgcg

SEQ ID NO: 39186 - DNA, 28 bp, Artificial Sequence
  Description of Artificial Sequence: Synthetic oligonucleotide
gacttaccgagagaacttgcggatcgcg

SEQ ID NO: 39187 - DNA, 28 bp, Artificial Sequence
  Description of Artificial Sequence: Synthetic oligonucleotide
acttaccgagagaacttgcggatcgcgc

SEQ ID NO: 39188 - DNA, 27 bp, Artificial Sequence
  Description of Artificial Sequence: Synthetic oligonucleotide
cttaccgagagaacttgcggatcgcgc

SEQ ID NO: 39189 - DNA, 28 bp, Artificial Sequence
  Description of Artificial Sequence: Synthetic oligonucleotide
ttaccgagagaacttgcggatcgcgctc

SEQ ID NO: 39190 - DNA, 27 bp, Artificial Sequence
  Description of Artificial Sequence: Synthetic oligonucleotide
taccgagagaacttgcggatcgcgctc

SEQ ID NO: 39191 - DNA, 26 bp, Artificial Sequence
  Description of Artificial Sequence: Synthetic oligonucleotide
accgagagaacttgcggatcgcgctc

SEQ ID NO: 39192 - DNA, 25 bp, Artificial Sequence
  Description of Artificial Sequence: Synthetic oligonucleotide
ccgagagaacttgcggatcgcgctc

SEQ ID NO: 39193 - DNA, 25 bp, Artificial Sequence
  Description of Artificial Sequence: Synthetic oligonucleotide
cgagagaacttgcggatcgcgctcc

SEQ ID NO: 39194 - DNA, 25 bp, Artificial Sequence
  Description of Artificial Sequence: Synthetic oligonucleotide
gagagaacttgcggatcgcgctccg

SEQ ID NO: 39195 - DNA, 27 bp, Artificial Sequence
  Description of Artificial Sequence: Synthetic oligonucleotide
agagaacttgcggatcgcgctccgcta

SEQ ID NO: 39196 - DNA, 26 bp, Artificial Sequence
  Description of Artificial Sequence: Synthetic oligonucleotide
gagaacttgcggatcgcgctccgcta

SEQ ID NO: 39197 - DNA, 27 bp, Artificial Sequence
  Description of Artificial Sequence: Synthetic oligonucleotide
agaacttgcggatcgcgctccgctact

SEQ ID NO: 39198 - DNA, 27 bp, Artificial Sequence
  Description of Artificial Sequence: Synthetic oligonucleotide
gaacttgcggatcgcgctccgctacta

SEQ ID NO: 39199 - DNA, 27 bp, Artificial Sequence
  Description of Artificial Sequence: Synthetic oligonucleotide
aacttgcggatcgcgctccgctactac

SEQ ID NO: 39200 - DNA, 27 bp, Artificial Sequence
  Description of Artificial Sequence: Synthetic oligonucleotide
acttgcggatcgcgctccgctactaca

SEQ ID NO: 39201 - DNA, 27 bp, Artificial Sequence
  Description of Artificial Sequence: Synthetic oligonucleotide
cttgcggatcgcgctccgctactacaa

SEQ ID NO: 39202 - DNA, 27 bp, Artificial Sequence
  Description of Artificial Sequence: Synthetic oligonucleotide
ttgcggatcgcgctccgctactacaac

SEQ ID NO: 39203 - DNA, 24 bp, Artificial Sequence
  Description of Artificial Sequence: Synthetic oligonucleotide
gttcgacagcgacgccgcgagtca

SEQ ID NO: 39204 - DNA, 25 bp, Artificial Sequence
  Description of Artificial Sequence: Synthetic oligonucleotide
ttcgacagcgacgccgcgagtcaga

SEQ ID NO: 39205 - DNA, 24 bp, Artificial Sequence
  Description of Artificial Sequence: Synthetic oligonucleotide
tcgacagcgacgccgcgagtcaga

SEQ ID NO: 39206 - DNA, 23 bp, Artificial Sequence
  Description of Artificial Sequence: Synthetic oligonucleotide
cgacagcgacgccgcgagtcaga

SEQ ID NO: 39207 - DNA, 23 bp, Artificial Sequence
  Description of Artificial Sequence: Synthetic oligonucleotide
gacagcgacgccgcgagtcagag

SEQ ID NO: 39208 - DNA, 24 bp, Artificial Sequence
  Description of Artificial Sequence: Synthetic oligonucleotide
acagcgacgccgcgagtcagagga

SEQ ID NO: 39209 - DNA, 23 bp, Artificial Sequence
  Description of Artificial Sequence: Synthetic oligonucleotide
cagcgacgccgcgagtcagagga

SEQ ID NO: 39210 - DNA, 23 bp, Artificial Sequence
  Description of Artificial Sequence: Synthetic oligonucleotide
agcgacgccgcgagtcagaggac

SEQ ID NO: 39211 - DNA, 22 bp, Artificial Sequence
  Description of Artificial Sequence: Synthetic oligonucleotide
gcgacgccgcgagtcagaggac

SEQ ID NO: 39212 - DNA, 22 bp, Artificial Sequence
  Description of Artificial Sequence: Synthetic oligonucleotide
cgacgccgcgagtcagaggacg

SEQ ID NO: 39213 - DNA, 23 bp, Artificial Sequence
  Description of Artificial Sequence: Synthetic oligonucleotide
gacgccgcgagtcagaggacgga

SEQ ID NO: 39214 - DNA, 23 bp, Artificial Sequence
  Description of Artificial Sequence: Synthetic oligonucleotide
acgccgcgagtcagaggacggag

SEQ ID NO: 39215 - DNA, 22 bp, Artificial Sequence
  Description of Artificial Sequence: Synthetic oligonucleotide
cgccgcgagtcagaggacggag

SEQ ID NO: 39216 - DNA, 22 bp, Artificial Sequence
  Description of Artificial Sequence: Synthetic oligonucleotide
gccgcgagtcagaggacggagc

SEQ ID NO: 39217 - DNA, 22 bp, Artificial Sequence
  Description of Artificial Sequence: Synthetic oligonucleotide
ccgcgagtcagaggacggagcc

SEQ ID NO: 39218 - DNA, 22 bp, Artificial Sequence
  Description of Artificial Sequence: Synthetic oligonucleotide
cgcgagtcagaggacggagccc

SEQ ID NO: 39219 - DNA, 22 bp, Artificial Sequence
  Description of Artificial Sequence: Synthetic oligonucleotide
gcgagtcagaggacggagcccc

SEQ ID NO: 39220 - DNA, 22 bp, Artificial Sequence
  Description of Artificial Sequence: Synthetic oligonucleotide
cgagtcagaggacggagccccg

SEQ ID NO: 39221 - DNA, 22 bp, Artificial Sequence
  Description of Artificial Sequence: Synthetic oligonucleotide
gagtcagaggacggagccccgg

SEQ ID NO: 39222 - DNA, 22 bp, Artificial Sequence
  Description of Artificial Sequence: Synthetic oligonucleotide
agtcagaggacggagccccggg

SEQ ID NO: 39223 - DNA, 21 bp, Artificial Sequence
  Description of Artificial Sequence: Synthetic oligonucleotide
gtcagaggacggagccccggg

SEQ ID NO: 39224 - DNA, 21 bp, Artificial Sequence
  Description of Artificial Sequence: Synthetic oligonucleotide
tcagaggacggagccccgggc

SEQ ID NO: 39225 - DNA, 20 bp, Artificial Sequence
  Description of Artificial Sequence: Synthetic oligonucleotide
cagaggacggagccccgggc

SEQ ID NO: 39226 - DNA, 20 bp, Artificial Sequence
  Description of Artificial Sequence: Synthetic oligonucleotide
agaggacggagccccgggcg

SEQ ID NO: 39227 - DNA, 20 bp, Artificial Sequence
  Description of Artificial Sequence: Synthetic oligonucleotide
ggccgcggggagcccccttt

SEQ ID NO: 39228 - DNA, 20 bp, Artificial Sequence
  Description of Artificial Sequence: Synthetic oligonucleotide
gccgcggggagccccccttt

SEQ ID NO: 39229 - DNA, 21 bp, Artificial Sequence
  Description of Artificial Sequence: Synthetic oligonucleotide
ccgcggggagccccccttcat

SEQ ID NO: 39230 - DNA, 21 bp, Artificial Sequence
  Description of Artificial Sequence: Synthetic oligonucleotide
cgcggggagccccccttcatc

SEQ ID NO: 39231 - DNA, 21 bp, Artificial Sequence
  Description of Artificial Sequence: Synthetic oligonucleotide
gcggggagccccccttcatcg

SEQ ID NO: 39232 - DNA, 22 bp, Artificial Sequence
  Description of Artificial Sequence: Synthetic oligonucleotide
cggggagccccccttcatcgca

SEQ ID NO: 39233 - DNA, 23 bp, Artificial Sequence
  Description of Artificial Sequence: Synthetic oligonucleotide
ggggagccccccttcatcgcagt

SEQ ID NO: 39234 - DNA, 23 bp, Artificial Sequence
  Description of Artificial Sequence: Synthetic oligonucleotide
gggagccccccttcatcgcagtg

SEQ ID NO: 39235 - DNA, 23 bp, Artificial Sequence
  Description of Artificial Sequence: Synthetic oligonucleotide
ggagccccccttcatcgcagtgg

SEQ ID NO: 39236 - DNA, 23 bp, Artificial Sequence
  Description of Artificial Sequence: Synthetic oligonucleotide
gagccccccttcatcgcagtggg

SEQ ID NO: 39237 - DNA, 25 bp, Artificial Sequence
  Description of Artificial Sequence: Synthetic oligonucleotide
agccccccttcatcgcagtgggcta

SEQ ID NO: 39238 - DNA, 24 bp, Artificial Sequence
  Description of Artificial Sequence: Synthetic oligonucleotide
gccccccttcatcgcagtgggcta

SEQ ID NO: 39239 - DNA, 24 bp, Artificial Sequence
  Description of Artificial Sequence: Synthetic oligonucleotide
ccccccttcatcgcagtgggctac

SEQ ID NO: 39240 - DNA, 25 bp, Artificial Sequence
  Description of Artificial Sequence: Synthetic oligonucleotide
cccccttcatcgcagtgggctacgt

SEQ ID NO: 39241 - DNA, 25 bp, Artificial Sequence
  Description of Artificial Sequence: Synthetic oligonucleotide
ccccttcatcgcagtgggctacgtg

SEQ ID NO: 39242 - DNA, 26 bp, Artificial Sequence
  Description of Artificial Sequence: Synthetic oligonucleotide
cccttcatcgcagtgggctacgtgga

SEQ ID NO: 39243 - DNA, 26 bp, Artificial Sequence
  Description of Artificial Sequence: Synthetic oligonucleotide
ccttcatcgcagtgggctacgtggac

SEQ ID NO: 39244 - DNA, 30 bp, Artificial Sequence
  Description of Artificial Sequence: Synthetic oligonucleotide
gctcccactccaagaggtatttctacaccg

SEQ ID NO: 39245 - DNA, 30 bp, Artificial Sequence
  Description of Artificial Sequence: Synthetic oligonucleotide
ctcccactccaagaggtatttctacaccgc

SEQ ID NO: 39246 - DNA, 30 bp, Artificial Sequence
  Description of Artificial Sequence: Synthetic oligonucleotide
tcccactccaagaggtatttctacaccgcc

SEQ ID NO: 39247 - DNA, 29 bp, Artificial Sequence
  Description of Artificial Sequence: Synthetic oligonucleotide
cccactccaagaggtatttctacaccgcc

SEQ ID NO: 39248 - DNA, 31 bp, Artificial Sequence
  Description of Artificial Sequence: Synthetic oligonucleotide
ccactccaagaggtatttctacaccgccatg

SEQ ID NO: 39249 - DNA, 32 bp, Artificial Sequence
  Description of Artificial Sequence: Synthetic oligonucleotide
cactccaagaggtatttctacaccgccatgtc

SEQ ID NO: 39250 - DNA, 32 bp, Artificial Sequence
  Description of Artificial Sequence: Synthetic oligonucleotide
actccaagaggtatttctacaccgccatgtcc

SEQ ID NO: 39251 - DNA, 31 bp, Artificial Sequence
  Description of Artificial Sequence: Synthetic oligonucleotide
ctccaagaggtatttctacaccgccatgtcc

SEQ ID NO: 39252 - DNA, 31 bp, Artificial Sequence
  Description of Artificial Sequence: Synthetic oligonucleotide
tccaagaggtatttctacaccgccatgtccc

SEQ ID NO: 39253 - DNA, 30 bp, Artificial Sequence
  Description of Artificial Sequence: Synthetic oligonucleotide
ccaagaggtatttctacaccgccatgtccc

SEQ ID NO: 39254 - DNA, 30 bp, Artificial Sequence
  Description of Artificial Sequence: Synthetic oligonucleotide
caagaggtatttctacaccgccatgtcccg

SEQ ID NO: 39255 - DNA, 30 bp, Artificial Sequence
  Description of Artificial Sequence: Synthetic oligonucleotide
aagaggtatttctacaccgccatgtcccgg

SEQ ID NO: 39256 - DNA, 29 bp, Artificial Sequence
  Description of Artificial Sequence: Synthetic oligonucleotide
agaggtatttctacaccgccatgtcccgg

SEQ ID NO: 39257 - DNA, 24 bp, Artificial Sequence
  Description of Artificial Sequence: Synthetic oligonucleotide
ctgtgcgtggagtcgctccgcaga

SEQ ID NO: 39258 - DNA, 25 bp, Artificial Sequence
  Description of Artificial Sequence: Synthetic oligonucleotide
tgtgcgtggagtcgctccgcagaca

SEQ ID NO: 39259 - DNA, 24 bp, Artificial Sequence
  Description of Artificial Sequence: Synthetic oligonucleotide
gtgcgtggagtcgctccgcagaca

SEQ ID NO: 39260 - DNA, 24 bp, Artificial Sequence
  Description of Artificial Sequence: Synthetic oligonucleotide
tgcgtggagtcgctccgcagacac

SEQ ID NO: 39261 - DNA, 23 bp, Artificial Sequence
  Description of Artificial Sequence: Synthetic oligonucleotide
gcgtggagtcgctccgcagacac

SEQ ID NO: 39262 - DNA, 24 bp, Artificial Sequence
  Description of Artificial Sequence: Synthetic oligonucleotide
cgtggagtcgctccgcagacacct

SEQ ID NO: 39263 - DNA, 24 bp, Artificial Sequence
  Description of Artificial Sequence: Synthetic oligonucleotide
gtggagtcgctccgcagacacctg

SEQ ID NO: 39264 - DNA, 25 bp, Artificial Sequence
  Description of Artificial Sequence: Synthetic oligonucleotide
tggagtcgctccgcagacacctgga

SEQ ID NO: 39265 - DNA, 24 bp, Artificial Sequence
  Description of Artificial Sequence: Synthetic oligonucleotide
ggagtcgctccgcagacacctgga

SEQ ID NO: 39266 - DNA, 26 bp, Artificial Sequence
  Description of Artificial Sequence: Synthetic oligonucleotide
gagtcgctccgcagacacctggagaa

SEQ ID NO: 39267 - DNA, 26 bp, Artificial Sequence
  Description of Artificial Sequence: Synthetic oligonucleotide
agtcgctccgcagacacctggagaac

SEQ ID NO: 39268 - DNA, 25 bp, Artificial Sequence
  Description of Artificial Sequence: Synthetic oligonucleotide
gtcgctccgcagacacctggagaac

SEQ ID NO: 39269 - DNA, 25 bp, Artificial Sequence
  Description of Artificial Sequence: Synthetic oligonucleotide
tcgctccgcagacacctggagaacg

SEQ ID NO: 39270 - DNA, 24 bp, Artificial Sequence
  Description of Artificial Sequence: Synthetic oligonucleotide
cgctccgcagacacctggagaacg

SEQ ID NO: 39271 - DNA, 20 bp, Artificial Sequence
  Description of Artificial Sequence: Synthetic oligonucleotide
ccggccgcggggagcccatt

SEQ ID NO: 39272 - DNA, 20 bp, Artificial Sequence
  Description of Artificial Sequence: Synthetic oligonucleotide
cggccgcggggagcccagtt

SEQ ID NO: 39273 - DNA, 20 bp, Artificial Sequence
  Description of Artificial Sequence: Synthetic oligonucleotide
ggccgcggggagcccagctt

SEQ ID NO: 39274 - DNA, 22 bp, Artificial Sequence
  Description of Artificial Sequence: Synthetic oligonucleotide
gccgcggggagcccagcttcat

SEQ ID NO: 39275 - DNA, 22 bp, Artificial Sequence
  Description of Artificial Sequence: Synthetic oligonucleotide
ccgcggggagcccagcttcatc

SEQ ID NO: 39276 - DNA, 22 bp, Artificial Sequence
  Description of Artificial Sequence: Synthetic oligonucleotide
cgcggggagcccagcttcatcg

SEQ ID NO: 39277 - DNA, 23 bp, Artificial Sequence
  Description of Artificial Sequence: Synthetic oligonucleotide
gcggggagcccagcttcatcgca

SEQ ID NO: 39278 - DNA, 24 bp, Artificial Sequence
  Description of Artificial Sequence: Synthetic oligonucleotide
cggggagcccagcttcatcgcagt

SEQ ID NO: 39279 - DNA, 24 bp, Artificial Sequence
  Description of Artificial Sequence: Synthetic oligonucleotide
ggggagcccagcttcatcgcagtg

SEQ ID NO: 39280 - DNA, 24 bp, Artificial Sequence
  Description of Artificial Sequence: Synthetic oligonucleotide
gggagcccagcttcatcgcagtgg

SEQ ID NO: 39281 - DNA, 24 bp, Artificial Sequence
  Description of Artificial Sequence: Synthetic oligonucleotide
ggagcccagcttcatcgcagtggg

SEQ ID NO: 39282 - DNA, 26 bp, Artificial Sequence
  Description of Artificial Sequence: Synthetic oligonucleotide
gagcccagcttcatcgcagtgggcta

SEQ ID NO: 39283 - DNA, 26 bp, Artificial Sequence
  Description of Artificial Sequence: Synthetic oligonucleotide
agcccagcttcatcgcagtgggctac

SEQ ID NO: 39284 - DNA, 25 bp, Artificial Sequence
  Description of Artificial Sequence: Synthetic oligonucleotide
gcccagcttcatcgcagtgggctac

SEQ ID NO: 39285 - DNA, 26 bp, Artificial Sequence
  Description of Artificial Sequence: Synthetic oligonucleotide
cccagcttcatcgcagtgggctacgt

SEQ ID NO: 39286 - DNA, 26 bp, Artificial Sequence
  Description of Artificial Sequence: Synthetic oligonucleotide
ccagcttcatcgcagtgggctacgtg

SEQ ID NO: 39287 - DNA, 27 bp, Artificial Sequence
  Description of Artificial Sequence: Synthetic oligonucleotide
cagcttcatcgcagtgggctacgtgga

SEQ ID NO: 39288 - DNA, 27 bp, Artificial Sequence
  Description of Artificial Sequence: Synthetic oligonucleotide
agcttcatcgcagtgggctacgtggac

SEQ ID NO: 39289 - DNA, 23 bp, Artificial Sequence
  Description of Artificial Sequence: Synthetic oligonucleotide
ggccggagtattgggaccgggag

SEQ ID NO: 39290 - DNA, 23 bp, Artificial Sequence
  Description of Artificial Sequence: Synthetic oligonucleotide
gccggagtattgggaccgggagg

SEQ ID NO: 39291 - DNA, 24 bp, Artificial Sequence
  Description of Artificial Sequence: Synthetic oligonucleotide
ccggagtattgggaccgggaggca

SEQ ID NO: 39292 - DNA, 25 bp, Artificial Sequence
  Description of Artificial Sequence: Synthetic oligonucleotide
cggagtattgggaccgggaggcaca

SEQ ID NO: 39293 - DNA, 27 bp, Artificial Sequence
  Description of Artificial Sequence: Synthetic oligonucleotide
ggagtattgggaccgggaggcacagat

SEQ ID NO: 39294 - DNA, 27 bp, Artificial Sequence
  Description of Artificial Sequence: Synthetic oligonucleotide
gagtattgggaccgggaggcacagatc

SEQ ID NO: 39295 - DNA, 28 bp, Artificial Sequence
  Description of Artificial Sequence: Synthetic oligonucleotide
agtattgggaccgggaggcacagatctc

SEQ ID NO: 39296 - DNA, 27 bp, Artificial Sequence
  Description of Artificial Sequence: Synthetic oligonucleotide
gtattgggaccgggaggcacagatctc

SEQ ID NO: 39297 - DNA, 27 bp, Artificial Sequence
  Description of Artificial Sequence: Synthetic oligonucleotide
tattgggaccgggaggcacagatctcc

SEQ ID NO: 39298 - DNA, 27 bp, Artificial Sequence
  Description of Artificial Sequence: Synthetic oligonucleotide
attgggaccgggaggcacagatctcca

SEQ ID NO: 39299 - DNA, 27 bp, Artificial Sequence
  Description of Artificial Sequence: Synthetic oligonucleotide
ttgggaccgggaggcacagatctccaa

SEQ ID NO: 39300 - DNA, 26 bp, Artificial Sequence
  Description of Artificial Sequence: Synthetic oligonucleotide
tgggaccgggaggcacagatctccaa

SEQ ID NO: 39301 - DNA, 25 bp, Artificial Sequence
  Description of Artificial Sequence: Synthetic oligonucleotide
gggaccgggaggcacagatctccaa

SEQ ID NO: 39302 - DNA, 26 bp, Artificial Sequence
  Description of Artificial Sequence: Synthetic oligonucleotide
ggaccgggaggcacagatctccaaga

SEQ ID NO: 39303 - DNA, 26 bp, Artificial Sequence
  Description of Artificial Sequence: Synthetic oligonucleotide
gaccgggaggcacagatctccaagac

SEQ ID NO: 39304 - DNA, 27 bp, Artificial Sequence
  Description of Artificial Sequence: Synthetic oligonucleotide
accgggaggcacagatctccaagacca

SEQ ID NO: 39305 - DNA, 27 bp, Artificial Sequence
  Description of Artificial Sequence: Synthetic oligonucleotide
ccgggaggcacagatctccaagaccaa

SEQ ID NO: 39306 - DNA, 27 bp, Artificial Sequence
  Description of Artificial Sequence: Synthetic oligonucleotide
cgggaggcacagatctccaagaccaac

SEQ ID NO: 39307 - DNA, 28 bp, Artificial Sequence
  Description of Artificial Sequence: Synthetic oligonucleotide
gggaggcacagatctccaagaccaacac

SEQ ID NO: 39308 - DNA, 29 bp, Artificial Sequence
  Description of Artificial Sequence: Synthetic oligonucleotide
ggaggcacagatctccaagaccaacacac

SEQ ID NO: 39309 - DNA, 30 bp, Artificial Sequence
  Description of Artificial Sequence: Synthetic oligonucleotide
gaggcacagatctccaagaccaacacacag

SEQ ID NO: 39310 - DNA, 31 bp, Artificial Sequence
  Description of Artificial Sequence: Synthetic oligonucleotide
aggcacagatctccaagaccaacacacagac

SEQ ID NO: 39311 - DNA, 30 bp, Artificial Sequence
  Description of Artificial Sequence: Synthetic oligonucleotide
ggcacagatctccaagaccaacacacagac

SEQ ID NO: 39312 - DNA, 33 bp, Artificial Sequence
  Description of Artificial Sequence: Synthetic oligonucleotide
gcacagatctccaagaccaacacacagacttac

SEQ ID NO: 39313 - DNA, 20 bp, Artificial Sequence
  Description of Artificial Sequence: Synthetic oligonucleotide
gcccgacgggcgcctcctgt

SEQ ID NO: 39314 - DNA, 20 bp, Artificial Sequence
  Description of Artificial Sequence: Synthetic oligonucleotide
cccgacgggcgcctcctgct

SEQ ID NO: 39315 - DNA, 20 bp, Artificial Sequence
  Description of Artificial Sequence: Synthetic oligonucleotide
ccgacgggcgcctcctgcgt

SEQ ID NO: 39316 - DNA, 20 bp, Artificial Sequence
  Description of Artificial Sequence: Synthetic oligonucleotide
cgacgggcgcctcctgcgct

SEQ ID NO: 39317 - DNA, 20 bp, Artificial Sequence
  Description of Artificial Sequence: Synthetic oligonucleotide
ggcgcctcctgcgcgggcat

SEQ ID NO: 39318 - DNA, 21 bp, Artificial Sequence
  Description of Artificial Sequence: Synthetic oligonucleotide
gcgcctcctgcgcgggcatga

SEQ ID NO: 39319 - DNA, 21 bp, Artificial Sequence
  Description of Artificial Sequence: Synthetic oligonucleotide
cgcctcctgcgcgggcatgac

SEQ ID NO: 39320 - DNA, 22 bp, Artificial Sequence
  Description of Artificial Sequence: Synthetic oligonucleotide
gcctcctgcgcgggcatgacca

SEQ ID NO: 39321 - DNA, 23 bp, Artificial Sequence
  Description of Artificial Sequence: Synthetic oligonucleotide
cctcctgcgcgggcatgaccagt

SEQ ID NO: 39322 - DNA, 23 bp, Artificial Sequence
  Description of Artificial Sequence: Synthetic oligonucleotide
ctcctgcgcgggcatgaccagtc

SEQ ID NO: 39323 - DNA, 23 bp, Artificial Sequence
  Description of Artificial Sequence: Synthetic oligonucleotide
tcctgcgcgggcatgaccagtcc

SEQ ID NO: 39324 - DNA, 22 bp, Artificial Sequence
  Description of Artificial Sequence: Synthetic oligonucleotide
cctgcgcgggcatgaccagtcc

SEQ ID NO: 39325 - DNA, 22 bp, Artificial Sequence
  Description of Artificial Sequence: Synthetic oligonucleotide
ctgcgcgggcatgaccagtccg

SEQ ID NO: 39326 - DNA, 22 bp, Artificial Sequence
  Description of Artificial Sequence: Synthetic oligonucleotide
tgcgcgggcatgaccagtccgc

SEQ ID NO: 39327 - DNA, 21 bp, Artificial Sequence
  Description of Artificial Sequence: Synthetic oligonucleotide
gcgcgggcatgaccagtccgc

SEQ ID NO: 39328 - DNA, 26 bp, Artificial Sequence
  Description of Artificial Sequence: Synthetic oligonucleotide
tgaggttcgacagcgacgccgcgatt

SEQ ID NO: 39329 - DNA, 25 bp, Artificial Sequence
  Description of Artificial Sequence: Synthetic oligonucleotide
gaggttcgacagcgacgccgcgatt

SEQ ID NO: 39330 - DNA, 25 bp, Artificial Sequence
  Description of Artificial Sequence: Synthetic oligonucleotide
aggttcgacagcgacgccgcgattc

SEQ ID NO: 39331 - DNA, 24 bp, Artificial Sequence
  Description of Artificial Sequence: Synthetic oligonucleotide
ggttcgacagcgacgccgcgattc

SEQ ID NO: 39332 - DNA, 24 bp, Artificial Sequence
  Description of Artificial Sequence: Synthetic oligonucleotide
gttcgacagcgacgccgcgattcc

SEQ ID NO: 39333 - DNA, 25 bp, Artificial Sequence
  Description of Artificial Sequence: Synthetic oligonucleotide
ttcgacagcgacgccgcgattccga

SEQ ID NO: 39334 - DNA, 24 bp, Artificial Sequence
  Description of Artificial Sequence: Synthetic oligonucleotide
tcgacagcgacgccgcgattccga

SEQ ID NO: 39335 - DNA, 23 bp, Artificial Sequence
  Description of Artificial Sequence: Synthetic oligonucleotide
cgacagcgacgccgcgattccga

SEQ ID NO: 39336 - DNA, 23 bp, Artificial Sequence
  Description of Artificial Sequence: Synthetic oligonucleotide
gacagcgacgccgcgattccgag

SEQ ID NO: 39337 - DNA, 24 bp, Artificial Sequence
  Description of Artificial Sequence: Synthetic oligonucleotide
acagcgacgccgcgattccgagga

SEQ ID NO: 39338 - DNA, 23 bp, Artificial Sequence
  Description of Artificial Sequence: Synthetic oligonucleotide
cagcgacgccgcgattccgagga

SEQ ID NO: 39339 - DNA, 23 bp, Artificial Sequence
  Description of Artificial Sequence: Synthetic oligonucleotide
agcgacgccgcgattccgaggac

SEQ ID NO: 39340 - DNA, 22 bp, Artificial Sequence
  Description of Artificial Sequence: Synthetic oligonucleotide
gcgacgccgcgattccgaggac

SEQ ID NO: 39341 - DNA, 22 bp, Artificial Sequence
  Description of Artificial Sequence: Synthetic oligonucleotide
cgacgccgcgattccgaggacg

SEQ ID NO: 39342 - DNA, 23 bp, Artificial Sequence
  Description of Artificial Sequence: Synthetic oligonucleotide
gacgccgcgattccgaggacgga

SEQ ID NO: 39343 - DNA, 23 bp, Artificial Sequence
  Description of Artificial Sequence: Synthetic oligonucleotide
acgccgcgattccgaggacggag

SEQ ID NO: 39344 - DNA, 22 bp, Artificial Sequence
  Description of Artificial Sequence: Synthetic oligonucleotide
cgccgcgattccgaggacggag

SEQ ID NO: 39345 - DNA, 22 bp, Artificial Sequence
  Description of Artificial Sequence: Synthetic oligonucleotide
gccgcgattccgaggacggagc

SEQ ID NO: 39346 - DNA, 22 bp, Artificial Sequence
  Description of Artificial Sequence: Synthetic oligonucleotide
ccgcgattccgaggacggagcc

SEQ ID NO: 39347 - DNA, 22 bp, Artificial Sequence
  Description of Artificial Sequence: Synthetic oligonucleotide
cgcgattccgaggacggagccc

SEQ ID NO: 39348 - DNA, 22 bp, Artificial Sequence
  Description of Artificial Sequence: Synthetic oligonucleotide
gcgattccgaggacggagcccc

SEQ ID NO: 39349 - DNA, 22 bp, Artificial Sequence
  Description of Artificial Sequence: Synthetic oligonucleotide
cgattccgaggacggagccccg

SEQ ID NO: 39350 - DNA, 22 bp, Artificial Sequence
  Description of Artificial Sequence: Synthetic oligonucleotide
gattccgaggacggagccccgg

SEQ ID NO: 39351 - DNA, 22 bp, Artificial Sequence
  Description of Artificial Sequence: Synthetic oligonucleotide
attccgaggacggagccccggg

SEQ ID NO: 39352 - DNA, 21 bp, Artificial Sequence
  Description of Artificial Sequence: Synthetic oligonucleotide
ttccgaggacggagccccggg

SEQ ID NO: 39353 - DNA, 31 bp, Artificial Sequence
  Description of Artificial Sequence: Synthetic oligonucleotide
gctcctactccatgaggtatttctacaccgc

SEQ ID NO: 39354 - DNA, 31 bp, Artificial Sequence
  Description of Artificial Sequence: Synthetic oligonucleotide
ctcctactccatgaggtatttctacaccgcc

SEQ ID NO: 39355 - DNA, 33 bp, Artificial Sequence
  Description of Artificial Sequence: Synthetic oligonucleotide
tcctactccatgaggtatttctacaccgccatg

SEQ ID NO: 39356 - DNA, 32 bp, Artificial Sequence
  Description of Artificial Sequence: Synthetic oligonucleotide
cctactccatgaggtatttctacaccgccatg

SEQ ID NO: 39357 - DNA, 33 bp, Artificial Sequence
  Description of Artificial Sequence: Synthetic oligonucleotide
ctactccatgaggtatttctacaccgccatgtc

SEQ ID NO: 39358 - DNA, 33 bp, Artificial Sequence
  Description of Artificial Sequence: Synthetic oligonucleotide
tactccatgaggtatttctacaccgccatgtcc

SEQ ID NO: 39359 - DNA, 31 bp, Artificial Sequence
  Description of Artificial Sequence: Synthetic oligonucleotide
gcttccactccatgaggtatttctacaccgc

SEQ ID NO: 39360 - DNA, 31 bp, Artificial Sequence
  Description of Artificial Sequence: Synthetic oligonucleotide
cttccactccatgaggtatttctacaccgcc

SEQ ID NO: 39361 - DNA, 33 bp, Artificial Sequence
  Description of Artificial Sequence: Synthetic oligonucleotide
ttccactccatgaggtatttctacaccgccatg

SEQ ID NO: 39362 - DNA, 32 bp, Artificial Sequence
  Description of Artificial Sequence: Synthetic oligonucleotide
tccactccatgaggtatttctacaccgccatg

SEQ ID NO: 39363 - DNA, 22 bp, Artificial Sequence
  Description of Artificial Sequence: Synthetic oligonucleotide
gggtcacggcaccccgaaccct

SEQ ID NO: 39364 - DNA, 22 bp, Artificial Sequence
  Description of Artificial Sequence: Synthetic oligonucleotide
ggtcacggcaccccgaaccctc

SEQ ID NO: 39365 - DNA, 23 bp, Artificial Sequence
  Description of Artificial Sequence: Synthetic oligonucleotide
gtcacggcaccccgaaccctcct

SEQ ID NO: 39366 - DNA, 23 bp, Artificial Sequence
  Description of Artificial Sequence: Synthetic oligonucleotide
tcacggcaccccgaaccctcctc

SEQ ID NO: 39367 - DNA, 22 bp, Artificial Sequence
  Description of Artificial Sequence: Synthetic oligonucleotide
cacggcaccccgaaccctcctc

SEQ ID NO: 39368 - DNA, 23 bp, Artificial Sequence
  Description of Artificial Sequence: Synthetic oligonucleotide
acggcaccccgaaccctcctcct

SEQ ID NO: 39369 - DNA, 22 bp, Artificial Sequence
  Description of Artificial Sequence: Synthetic oligonucleotide
cggcaccccgaaccctcctcct

SEQ ID NO: 39370 - DNA, 22 bp, Artificial Sequence
  Description of Artificial Sequence: Synthetic oligonucleotide
ggcaccccgaaccctcctcctg

SEQ ID NO: 39371 - DNA, 23 bp, Artificial Sequence
  Description of Artificial Sequence: Synthetic oligonucleotide
gcaccccgaaccctcctcctgct

SEQ ID NO: 39372 - DNA, 23 bp, Artificial Sequence
  Description of Artificial Sequence: Synthetic oligonucleotide
caccccgaaccctcctcctgctg

SEQ ID NO: 39373 - DNA, 24 bp, Artificial Sequence
  Description of Artificial Sequence: Synthetic oligonucleotide
accccgaaccctcctcctgctgct

SEQ ID NO: 39374 - DNA, 22 bp, Artificial Sequence
  Description of Artificial Sequence: Synthetic oligonucleotide
tcctcctgctgctctggggggc

SEQ ID NO: 39375 - DNA, 21 bp, Artificial Sequence
  Description of Artificial Sequence: Synthetic oligonucleotide
cctcctgctgctctggggggc

SEQ ID NO: 39376 - DNA, 21 bp, Artificial Sequence
  Description of Artificial Sequence: Synthetic oligonucleotide
ctcctgctgctctggggggcc

SEQ ID NO: 39377 - DNA, 22 bp, Artificial Sequence
  Description of Artificial Sequence: Synthetic oligonucleotide
tcctgctgctctggggggccct

SEQ ID NO: 39378 - DNA, 21 bp, Artificial Sequence
  Description of Artificial Sequence: Synthetic oligonucleotide
cctgctgctctggggggccct

SEQ ID NO: 39379 - DNA, 21 bp, Artificial Sequence
  Description of Artificial Sequence: Synthetic oligonucleotide
ctgctgctctggggggccctg

SEQ ID NO: 39380 - DNA, 21 bp, Artificial Sequence
  Description of Artificial Sequence: Synthetic oligonucleotide
tgctgctctggggggccctgg

SEQ ID NO: 39381 - DNA, 20 bp, Artificial Sequence
  Description of Artificial Sequence: Synthetic oligonucleotide
gctgctctggggggccctgg

SEQ ID NO: 39382 - DNA, 20 bp, Artificial Sequence
  Description of Artificial Sequence: Synthetic oligonucleotide
ctgctctggggggccctggc

SEQ ID NO: 39383 - DNA, 20 bp, Artificial Sequence
  Description of Artificial Sequence: Synthetic oligonucleotide
tgctctggggggccctggcc

SEQ ID NO: 39384 - DNA, 20 bp, Artificial Sequence
  Description of Artificial Sequence: Synthetic oligonucleotide
gctctggggggccctggcct

SEQ ID NO: 39385 - DNA, 20 bp, Artificial Sequence
  Description of Artificial Sequence: Synthetic oligonucleotide
ctctggggggccctggccct

SEQ ID NO: 39386 - DNA, 21 bp, Artificial Sequence
  Description of Artificial Sequence: Synthetic oligonucleotide
tctggggggccctggccctga

SEQ ID NO: 39387 - DNA, 20 bp, Artificial Sequence
  Description of Artificial Sequence: Synthetic oligonucleotide
ctggggggccctggccctga

SEQ ID NO: 39388 - DNA, 20 bp, Artificial Sequence
  Description of Artificial Sequence: Synthetic oligonucleotide
tggggggccctggccctgac

SEQ ID NO: 39389 - DNA, 20 bp, Artificial Sequence
  Description of Artificial Sequence: Synthetic oligonucleotide
ggggggccctggccctgact

SEQ ID NO: 39390 - DNA, 20 bp, Artificial Sequence
  Description of Artificial Sequence: Synthetic oligonucleotide
ggggccctggccctgaccga

SEQ ID NO: 39391 - DNA, 21 bp, Artificial Sequence
  Description of Artificial Sequence: Synthetic oligonucleotide
gggccctggccctgaccgaga

SEQ ID NO: 39392 - DNA, 22 bp, Artificial Sequence
  Description of Artificial Sequence: Synthetic oligonucleotide
ccgcgagtccgagaggggagca

SEQ ID NO: 39393 - DNA, 22 bp, Artificial Sequence
  Description of Artificial Sequence: Synthetic oligonucleotide
cgcgagtccgagaggggagcag

SEQ ID NO: 39394 - DNA, 23 bp, Artificial Sequence
  Description of Artificial Sequence: Synthetic oligonucleotide
gcgagtccgagaggggagcagga

SEQ ID NO: 39395 - DNA, 23 bp, Artificial Sequence
  Description of Artificial Sequence: Synthetic oligonucleotide
cgagtccgagaggggagcaggag

SEQ ID NO: 39396 - DNA, 23 bp, Artificial Sequence
  Description of Artificial Sequence: Synthetic oligonucleotide
gagtccgagaggggagcaggagg

SEQ ID NO: 39397 - DNA, 23 bp, Artificial Sequence
  Description of Artificial Sequence: Synthetic oligonucleotide
agtccgagaggggagcaggaggg

SEQ ID NO: 39398 - DNA, 22 bp, Artificial Sequence
  Description of Artificial Sequence: Synthetic oligonucleotide
gtccgagaggggagcaggaggg

SEQ ID NO: 39399 - DNA, 22 bp, Artificial Sequence
  Description of Artificial Sequence: Synthetic oligonucleotide
tccgagaggggagcaggagggg

SEQ ID NO: 39400 - DNA, 21 bp, Artificial Sequence
  Description of Artificial Sequence: Synthetic oligonucleotide
ccgagaggggagcaggagggg

SEQ ID NO: 39401 - DNA, 21 bp, Artificial Sequence
  Description of Artificial Sequence: Synthetic oligonucleotide
cgagaggggagcaggaggggc

SEQ ID NO: 39402 - DNA, 21 bp, Artificial Sequence
  Description of Artificial Sequence: Synthetic oligonucleotide
gagaggggagcaggaggggcc

SEQ ID NO: 39403 - DNA, 21 bp, Artificial Sequence
  Description of Artificial Sequence: Synthetic oligonucleotide
agaggggagcaggaggggccg

SEQ ID NO: 39404 - DNA, 20 bp, Artificial Sequence
  Description of Artificial Sequence: Synthetic oligonucleotide
gaggggagcaggaggggccg

SEQ ID NO: 39405 - DNA, 21 bp, Artificial Sequence
  Description of Artificial Sequence: Synthetic oligonucleotide
aggggagcaggaggggccgga

SEQ ID NO: 39406 - DNA, 20 bp, Artificial Sequence
  Description of Artificial Sequence: Synthetic oligonucleotide
ggggagcaggaggggccgga

SEQ ID NO: 39407 - DNA, 24 bp, Artificial Sequence
  Description of Artificial Sequence: Synthetic oligonucleotide
gggagcaggaggggccggagtatt

SEQ ID NO: 39408 - DNA, 33 bp, Artificial Sequence
  Description of Artificial Sequence: Synthetic oligonucleotide
gagtattgggaccggaacacacagatctacatg

SEQ ID NO: 39409 - DNA, 33 bp, Artificial Sequence
  Description of Artificial Sequence: Synthetic oligonucleotide
agtattgggaccggaacacacagatctacatgg

SEQ ID NO: 39410 - DNA, 32 bp, Artificial Sequence
  Description of Artificial Sequence: Synthetic oligonucleotide
gtattgggaccggaacacacagatctacatgg

SEQ ID NO: 39411 - DNA, 32 bp, Artificial Sequence
  Description of Artificial Sequence: Synthetic oligonucleotide
tattgggaccggaacacacagatctacatggc

SEQ ID NO: 39412 - DNA, 31 bp, Artificial Sequence
  Description of Artificial Sequence: Synthetic oligonucleotide
attgggaccggaacacacagatctacatggc

SEQ ID NO: 39413 - DNA, 30 bp, Artificial Sequence
  Description of Artificial Sequence: Synthetic oligonucleotide
ttgggaccggaacacacagatctacatggc

SEQ ID NO: 39414 - DNA, 29 bp, Artificial Sequence
  Description of Artificial Sequence: Synthetic oligonucleotide
tgggaccggaacacacagatctacatggc

SEQ ID NO: 39415 - DNA, 28 bp, Artificial Sequence
  Description of Artificial Sequence: Synthetic oligonucleotide
gggaccggaacacacagatctacatggc

SEQ ID NO: 39416 - DNA, 28 bp, Artificial Sequence
  Description of Artificial Sequence: Synthetic oligonucleotide
ggaccggaacacacagatctacatggcc

SEQ ID NO: 39417 - DNA, 28 bp, Artificial Sequence
  Description of Artificial Sequence: Synthetic oligonucleotide
gaccggaacacacagatctacatggccc

SEQ ID NO: 39418 - DNA, 29 bp, Artificial Sequence
  Description of Artificial Sequence: Synthetic oligonucleotide
accggaacacacagatctacatggcccag

SEQ ID NO: 39419 - DNA, 28 bp, Artificial Sequence
  Description of Artificial Sequence: Synthetic oligonucleotide
ccggaacacacagatctacatggcccag

SEQ ID NO: 39420 - DNA, 28 bp, Artificial Sequence
  Description of Artificial Sequence: Synthetic oligonucleotide
cggaacacacagatctacatggcccagg

SEQ ID NO: 39421 - DNA, 28 bp, Artificial Sequence
  Description of Artificial Sequence: Synthetic oligonucleotide
ggaacacacagatctacatggcccaggc

SEQ ID NO: 39422 - DNA, 29 bp, Artificial Sequence
  Description of Artificial Sequence: Synthetic oligonucleotide
gaacacacagatctacatggcccaggcac

SEQ ID NO: 39423 - DNA, 30 bp, Artificial Sequence
  Description of Artificial Sequence: Synthetic oligonucleotide
aacacacagatctacatggcccaggcacag

SEQ ID NO: 39424 - DNA, 29 bp, Artificial Sequence
  Description of Artificial Sequence: Synthetic oligonucleotide
acacacagatctacatggcccaggcacag

SEQ ID NO: 39425 - DNA, 28 bp, Artificial Sequence
  Description of Artificial Sequence: Synthetic oligonucleotide
cacacagatctacatggcccaggcacag

SEQ ID NO: 39426 - DNA, 29 bp, Artificial Sequence
  Description of Artificial Sequence: Synthetic oligonucleotide
acacagatctacatggcccaggcacagac

SEQ ID NO: 39427 - DNA, 28 bp, Artificial Sequence
  Description of Artificial Sequence: Synthetic oligonucleotide
cacagatctacatggcccaggcacagac

SEQ ID NO: 39428 - DNA, 29 bp, Artificial Sequence
  Description of Artificial Sequence: Synthetic oligonucleotide
acagatctacatggcccaggcacagactg

SEQ ID NO: 39429 - DNA, 28 bp, Artificial Sequence
  Description of Artificial Sequence: Synthetic oligonucleotide
cagatctacatggcccaggcacagactg

SEQ ID NO: 39430 - DNA, 29 bp, Artificial Sequence
  Description of Artificial Sequence: Synthetic oligonucleotide
agatctacatggcccaggcacagactgac

SEQ ID NO: 39431 - DNA, 28 bp, Artificial Sequence
  Description of Artificial Sequence: Synthetic oligonucleotide
gatctacatggcccaggcacagactgac

SEQ ID NO: 39432 - DNA, 28 bp, Artificial Sequence
  Description of Artificial Sequence: Synthetic oligonucleotide
atctacatggcccaggcacagactgacc

SEQ ID NO: 39433 - DNA, 27 bp, Artificial Sequence
  Description of Artificial Sequence: Synthetic oligonucleotide
tctacatggcccaggcacagactgacc

SEQ ID NO: 39434 - DNA, 26 bp, Artificial Sequence
  Description of Artificial Sequence: Synthetic oligonucleotide
ctacatggcccaggcacagactgacc

SEQ ID NO: 39435 - DNA, 27 bp, Artificial Sequence
  Description of Artificial Sequence: Synthetic oligonucleotide
tacatggcccaggcacagactgaccga

SEQ ID NO: 39436 - DNA, 26 bp, Artificial Sequence
  Description of Artificial Sequence: Synthetic oligonucleotide
acatggcccaggcacagactgaccga

SEQ ID NO: 39437 - DNA, 25 bp, Artificial Sequence
  Description of Artificial Sequence: Synthetic oligonucleotide
catggcccaggcacagactgaccga

SEQ ID NO: 39438 - DNA, 26 bp, Artificial Sequence
  Description of Artificial Sequence: Synthetic oligonucleotide
atggcccaggcacagactgaccgaga

SEQ ID NO: 39439 - DNA, 25 bp, Artificial Sequence
  Description of Artificial Sequence: Synthetic oligonucleotide
tggcccaggcacagactgaccgaga

SEQ ID NO: 39440 - DNA, 26 bp, Artificial Sequence
  Description of Artificial Sequence: Synthetic oligonucleotide
gcggagcagctgagagcctacctgta

SEQ ID NO: 39441 - DNA, 26 bp, Artificial Sequence
  Description of Artificial Sequence: Synthetic oligonucleotide
cggagcagctgagagcctacctgtag

SEQ ID NO: 39442 - DNA, 26 bp, Artificial Sequence
  Description of Artificial Sequence: Synthetic oligonucleotide
ggagcagctgagagcctacctgtagg

SEQ ID NO: 39443 - DNA, 26 bp, Artificial Sequence
  Description of Artificial Sequence: Synthetic oligonucleotide
gagcagctgagagcctacctgtaggg

SEQ ID NO: 39444 - DNA, 27 bp, Artificial Sequence
  Description of Artificial Sequence: Synthetic oligonucleotide
agcagctgagagcctacctgtagggca

SEQ ID NO: 39445 - DNA, 26 bp, Artificial Sequence
  Description of Artificial Sequence: Synthetic oligonucleotide
gcagctgagagcctacctgtagggca

SEQ ID NO: 39446 - DNA, 26 bp, Artificial Sequence
  Description of Artificial Sequence: Synthetic oligonucleotide
cagctgagagcctacctgtagggcac

SEQ ID NO: 39447 - DNA, 27 bp, Artificial Sequence
  Description of Artificial Sequence: Synthetic oligonucleotide
agctgagagcctacctgtagggcacgt

SEQ ID NO: 39448 - DNA, 26 bp, Artificial Sequence
  Description of Artificial Sequence: Synthetic oligonucleotide
gctgagagcctacctgtagggcacgt

SEQ ID NO: 39449 - DNA, 26 bp, Artificial Sequence
  Description of Artificial Sequence: Synthetic oligonucleotide
ctgagagcctacctgtagggcacgtg

SEQ ID NO: 39450 - DNA, 26 bp, Artificial Sequence
  Description of Artificial Sequence: Synthetic oligonucleotide
tgagagcctacctgtagggcacgtgc

SEQ ID NO: 39451 - DNA, 25 bp, Artificial Sequence
  Description of Artificial Sequence: Synthetic oligonucleotide
gagagcctacctgtagggcacgtgc

SEQ ID NO: 39452 - DNA, 26 bp, Artificial Sequence
  Description of Artificial Sequence: Synthetic oligonucleotide
agagcctacctgtagggcacgtgcgt

SEQ ID NO: 39453 - DNA, 25 bp, Artificial Sequence
  Description of Artificial Sequence: Synthetic oligonucleotide
gagcctacctgtagggcacgtgcgt

SEQ ID NO: 39454 - DNA, 25 bp, Artificial Sequence
  Description of Artificial Sequence: Synthetic oligonucleotide
agcctacctgtagggcacgtgcgtg

SEQ ID NO: 39455 - DNA, 24 bp, Artificial Sequence
  Description of Artificial Sequence: Synthetic oligonucleotide
gcctacctgtagggcacgtgcgtg

SEQ ID NO: 39456 - DNA, 25 bp, Artificial Sequence
  Description of Artificial Sequence: Synthetic oligonucleotide
cctacctgtagggcacgtgcgtgga

SEQ ID NO: 39457 - DNA, 26 bp, Artificial Sequence
  Description of Artificial Sequence: Synthetic oligonucleotide
ctacctgtagggcacgtgcgtggagt

SEQ ID NO: 39458 - DNA, 26 bp, Artificial Sequence
  Description of Artificial Sequence: Synthetic oligonucleotide
tacctgtagggcacgtgcgtggagtg

SEQ ID NO: 39459 - DNA, 25 bp, Artificial Sequence
  Description of Artificial Sequence: Synthetic oligonucleotide
acctgtagggcacgtgcgtggagtg

SEQ ID NO: 39460 - DNA, 24 bp, Artificial Sequence
  Description of Artificial Sequence: Synthetic oligonucleotide
cctgtagggcacgtgcgtggagtg

SEQ ID NO: 39461 - DNA, 24 bp, Artificial Sequence
  Description of Artificial Sequence: Synthetic oligonucleotide
ctgtagggcacgtgcgtggagtgg

SEQ ID NO: 39462 - DNA, 25 bp, Artificial Sequence
  Description of Artificial Sequence: Synthetic oligonucleotide
tgtagggcacgtgcgtggagtggct

SEQ ID NO: 39463 - DNA, 24 bp, Artificial Sequence
  Description of Artificial Sequence: Synthetic oligonucleotide
gtagggcacgtgcgtggagtggct

SEQ ID NO: 39464 - DNA, 24 bp, Artificial Sequence
  Description of Artificial Sequence: Synthetic oligonucleotide
tagggcacgtgcgtggagtggctc

SEQ ID NO: 39465 - DNA, 21 bp, Artificial Sequence
  Description of Artificial Sequence: Synthetic oligonucleotide
ccgcggggagcccggcttcat

SEQ ID NO: 39466 - DNA, 21 bp, Artificial Sequence
  Description of Artificial Sequence: Synthetic oligonucleotide
cgcggggagcccggcttcatc

SEQ ID NO: 39467 - DNA, 21 bp, Artificial Sequence
  Description of Artificial Sequence: Synthetic oligonucleotide
gcggggagcccggcttcatcg

SEQ ID NO: 39468 - DNA, 22 bp, Artificial Sequence
  Description of Artificial Sequence: Synthetic oligonucleotide
cggggagcccggcttcatcgca

SEQ ID NO: 39469 - DNA, 23 bp, Artificial Sequence
  Description of Artificial Sequence: Synthetic oligonucleotide
ggggagcccggcttcatcgcagt

SEQ ID NO: 39470 - DNA, 23 bp, Artificial Sequence
  Description of Artificial Sequence: Synthetic oligonucleotide
gggagcccggcttcatcgcagtg

SEQ ID NO: 39471 - DNA, 23 bp, Artificial Sequence
  Description of Artificial Sequence: Synthetic oligonucleotide
ggagcccggcttcatcgcagtgg

SEQ ID NO: 39472 - DNA, 23 bp, Artificial Sequence
  Description of Artificial Sequence: Synthetic oligonucleotide
gagcccggcttcatcgcagtggg

SEQ ID NO: 39473 - DNA, 25 bp, Artificial Sequence
  Description of Artificial Sequence: Synthetic oligonucleotide
agcccggcttcatcgcagtgggcta

SEQ ID NO: 39474 - DNA, 24 bp, Artificial Sequence
  Description of Artificial Sequence: Synthetic oligonucleotide
gcccggcttcatcgcagtgggcta

SEQ ID NO: 39475 - DNA, 24 bp, Artificial Sequence
  Description of Artificial Sequence: Synthetic oligonucleotide
cccggcttcatcgcagtgggctac

SEQ ID NO: 39476 - DNA, 25 bp, Artificial Sequence
  Description of Artificial Sequence: Synthetic oligonucleotide
ccggcttcatcgcagtgggctacgt

SEQ ID NO: 39477 - DNA, 25 bp, Artificial Sequence
  Description of Artificial Sequence: Synthetic oligonucleotide
cggcttcatcgcagtgggctacgtg

SEQ ID NO: 39478 - DNA, 26 bp, Artificial Sequence
  Description of Artificial Sequence: Synthetic oligonucleotide
ggcttcatcgcagtgggctacgtgga

SEQ ID NO: 39479 - DNA, 27 bp, Artificial Sequence
  Description of Artificial Sequence: Synthetic oligonucleotide
ttggcagacgatgtacggctgcgacct

SEQ ID NO: 39480 - DNA, 26 bp, Artificial Sequence
  Description of Artificial Sequence: Synthetic oligonucleotide
tggcagacgatgtacggctgcgacct

SEQ ID NO: 39481 - DNA, 25 bp, Artificial Sequence
  Description of Artificial Sequence: Synthetic oligonucleotide
ggcagacgatgtacggctgcgacct

SEQ ID NO: 39482 - DNA, 25 bp, Artificial Sequence
  Description of Artificial Sequence: Synthetic oligonucleotide
gcagacgatgtacggctgcgacctg

SEQ ID NO: 39483 - DNA, 25 bp, Artificial Sequence
  Description of Artificial Sequence: Synthetic oligonucleotide
cagacgatgtacggctgcgacctgg

SEQ ID NO: 39484 - DNA, 25 bp, Artificial Sequence
  Description of Artificial Sequence: Synthetic oligonucleotide
agacgatgtacggctgcgacctggg

SEQ ID NO: 39485 - DNA, 24 bp, Artificial Sequence
  Description of Artificial Sequence: Synthetic oligonucleotide
gacgatgtacggctgcgacctggg

SEQ ID NO: 39486 - DNA, 24 bp, Artificial Sequence
  Description of Artificial Sequence: Synthetic oligonucleotide
acgatgtacggctgcgacctgggg

SEQ ID NO: 39487 - DNA, 23 bp, Artificial Sequence
  Description of Artificial Sequence: Synthetic oligonucleotide
cgatgtacggctgcgacctgggg

SEQ ID NO: 39488 - DNA, 25 bp, Artificial Sequence
  Description of Artificial Sequence: Synthetic oligonucleotide
cctcctccgcgggcatgaccagtta

SEQ ID NO: 39489 - DNA, 25 bp, Artificial Sequence
  Description of Artificial Sequence: Synthetic oligonucleotide
ctcctccgcgggcatgaccagttag

SEQ ID NO: 39490 - DNA, 25 bp, Artificial Sequence
  Description of Artificial Sequence: Synthetic oligonucleotide
tcctccgcgggcatgaccagttagc

SEQ ID NO: 39491 - DNA, 24 bp, Artificial Sequence
  Description of Artificial Sequence: Synthetic oligonucleotide
cctccgcgggcatgaccagttagc

SEQ ID NO: 39492 - DNA, 26 bp, Artificial Sequence
  Description of Artificial Sequence: Synthetic oligonucleotide
ctccgcgggcatgaccagttagccta

SEQ ID NO: 39493 - DNA, 26 bp, Artificial Sequence
  Description of Artificial Sequence: Synthetic oligonucleotide
tccgcgggcatgaccagttagcctac

SEQ ID NO: 39494 - DNA, 25 bp, Artificial Sequence
  Description of Artificial Sequence: Synthetic oligonucleotide
ccgcgggcatgaccagttagcctac

SEQ ID NO: 39495 - DNA, 26 bp, Artificial Sequence
  Description of Artificial Sequence: Synthetic oligonucleotide
cgcgggcatgaccagttagcctacga

SEQ ID NO: 39496 - DNA, 26 bp, Artificial Sequence
  Description of Artificial Sequence: Synthetic oligonucleotide
gcgggcatgaccagttagcctacgac

SEQ ID NO: 39497 - DNA, 26 bp, Artificial Sequence
  Description of Artificial Sequence: Synthetic oligonucleotide
cgggcatgaccagttagcctacgacg

SEQ ID NO: 39498 - DNA, 26 bp, Artificial Sequence
  Description of Artificial Sequence: Synthetic oligonucleotide
gggcatgaccagttagcctacgacgg

SEQ ID NO: 39499 - DNA, 27 bp, Artificial Sequence
  Description of Artificial Sequence: Synthetic oligonucleotide
ggcatgaccagttagcctacgacggca

SEQ ID NO: 39500 - DNA, 28 bp, Artificial Sequence
  Description of Artificial Sequence: Synthetic oligonucleotide
gcatgaccagttagcctacgacggcaag

SEQ ID NO: 39501 - DNA, 28 bp, Artificial Sequence
  Description of Artificial Sequence: Synthetic oligonucleotide
catgaccagttagcctacgacggcaagg

SEQ ID NO: 39502 - DNA, 32 bp, Artificial Sequence
  Description of Artificial Sequence: Synthetic oligonucleotide
atgaccagttagcctacgacggcaaggattac

SEQ ID NO: 39503 - DNA, 31 bp, Artificial Sequence
  Description of Artificial Sequence: Synthetic oligonucleotide
tgaccagttagcctacgacggcaaggattac

SEQ ID NO: 39504 - DNA, 30 bp, Artificial Sequence
  Description of Artificial Sequence: Synthetic oligonucleotide
gaccagttagcctacgacggcaaggattac

SEQ ID NO: 39505 - DNA, 23 bp, Artificial Sequence
  Description of Artificial Sequence: Synthetic oligonucleotide
ccctgggcttctaccctgcggag

SEQ ID NO: 39506 - DNA, 24 bp, Artificial Sequence
  Description of Artificial Sequence: Synthetic oligonucleotide
cctgggcttctaccctgcggaggt

SEQ ID NO: 39507 - DNA, 25 bp, Artificial Sequence
  Description of Artificial Sequence: Synthetic oligonucleotide
ctgggcttctaccctgcggaggtca

SEQ ID NO: 39508 - DNA, 26 bp, Artificial Sequence
  Description of Artificial Sequence: Synthetic oligonucleotide
tgggcttctaccctgcggaggtcaca

SEQ ID NO: 39509 - DNA, 25 bp, Artificial Sequence
  Description of Artificial Sequence: Synthetic oligonucleotide
gggcttctaccctgcggaggtcaca

SEQ ID NO: 39510 - DNA, 26 bp, Artificial Sequence
  Description of Artificial Sequence: Synthetic oligonucleotide
ggcttctaccctgcggaggtcacact

SEQ ID NO: 39511 - DNA, 24 bp, Artificial Sequence
  Description of Artificial Sequence: Synthetic oligonucleotide
ctgggccggctcccactccatgaa

SEQ ID NO: 39512 - DNA, 27 bp, Artificial Sequence
  Description of Artificial Sequence: Synthetic oligonucleotide
tgggccggctcccactccatgaagtat

SEQ ID NO: 39513 - DNA, 27 bp, Artificial Sequence
  Description of Artificial Sequence: Synthetic oligonucleotide
gggccggctcccactccatgaagtatt

SEQ ID NO: 39514 - DNA, 28 bp, Artificial Sequence
  Description of Artificial Sequence: Synthetic oligonucleotide
ggccggctcccactccatgaagtatttc

SEQ ID NO: 39515 - DNA, 30 bp, Artificial Sequence
  Description of Artificial Sequence: Synthetic oligonucleotide
gccggctcccactccatgaagtatttctac

SEQ ID NO: 39516 - DNA, 31 bp, Artificial Sequence
  Description of Artificial Sequence: Synthetic oligonucleotide
ccggctcccactccatgaagtatttctacac

SEQ ID NO: 39517 - DNA, 31 bp, Artificial Sequence
  Description of Artificial Sequence: Synthetic oligonucleotide
cggctcccactccatgaagtatttctacacc

SEQ ID NO: 39518 - DNA, 31 bp, Artificial Sequence
  Description of Artificial Sequence: Synthetic oligonucleotide
ggctcccactccatgaagtatttctacaccg

SEQ ID NO: 39519 - DNA, 31 bp, Artificial Sequence
  Description of Artificial Sequence: Synthetic oligonucleotide
gctcccactccatgaagtatttctacaccgc

SEQ ID NO: 39520 - DNA, 31 bp, Artificial Sequence
  Description of Artificial Sequence: Synthetic oligonucleotide
ctcccactccatgaagtatttctacaccgcc

SEQ ID NO: 39521 - DNA, 33 bp, Artificial Sequence
  Description of Artificial Sequence: Synthetic oligonucleotide
tcccactccatgaagtatttctacaccgccatg

SEQ ID NO: 39522 - DNA, 32 bp, Artificial Sequence
  Description of Artificial Sequence: Synthetic oligonucleotide
cccactccatgaagtatttctacaccgccatg

SEQ ID NO: 39523 - DNA, 33 bp, Artificial Sequence
  Description of Artificial Sequence: Synthetic oligonucleotide
ccactccatgaagtatttctacaccgccatgtc

SEQ ID NO: 39524 - DNA, 33 bp, Artificial Sequence
  Description of Artificial Sequence: Synthetic oligonucleotide
cactccatgaagtatttctacaccgccatgtcc

SEQ ID NO: 39525 - DNA, 33 bp, Artificial Sequence
  Description of Artificial Sequence: Synthetic oligonucleotide
actccatgaagtatttctacaccgccatgtccc

SEQ ID NO: 39526 - DNA, 32 bp, Artificial Sequence
  Description of Artificial Sequence: Synthetic oligonucleotide
ctccatgaagtatttctacaccgccatgtccc

SEQ ID NO: 39527 - DNA, 32 bp, Artificial Sequence
  Description of Artificial Sequence: Synthetic oligonucleotide
tccatgaagtatttctacaccgccatgtcccg

SEQ ID NO: 39528 - DNA, 31 bp, Artificial Sequence
  Description of Artificial Sequence: Synthetic oligonucleotide
ccatgaagtatttctacaccgccatgtcccg

SEQ ID NO: 39529 - DNA, 31 bp, Artificial Sequence
  Description of Artificial Sequence: Synthetic oligonucleotide
catgaagtatttctacaccgccatgtcccgg

SEQ ID NO: 39530 - DNA, 31 bp, Artificial Sequence
  Description of Artificial Sequence: Synthetic oligonucleotide
atgaagtatttctacaccgccatgtcccggc

SEQ ID NO: 39531 - DNA, 30 bp, Artificial Sequence
  Description of Artificial Sequence: Synthetic oligonucleotide
tgaagtatttctacaccgccatgtcccggc

SEQ ID NO: 39532 - DNA, 29 bp, Artificial Sequence
  Description of Artificial Sequence: Synthetic oligonucleotide
gaagtatttctacaccgccatgtcccggc

SEQ ID NO: 39533 - DNA, 29 bp, Artificial Sequence
  Description of Artificial Sequence: Synthetic oligonucleotide
aagtatttctacaccgccatgtcccggcc

SEQ ID NO: 39534 - DNA, 28 bp, Artificial Sequence
  Description of Artificial Sequence: Synthetic oligonucleotide
agtatttctacaccgccatgtcccggcc

SEQ ID NO: 39535 - DNA, 33 bp, Artificial Sequence
  Description of Artificial Sequence: Synthetic oligonucleotide
cactccatgaggtatttctacaccgccatgttc

SEQ ID NO: 39536 - DNA, 33 bp, Artificial Sequence
  Description of Artificial Sequence: Synthetic oligonucleotide
actccatgaggtatttctacaccgccatgttcc

SEQ ID NO: 39537 - DNA, 32 bp, Artificial Sequence
  Description of Artificial Sequence: Synthetic oligonucleotide
ctccatgaggtatttctacaccgccatgttcc

SEQ ID NO: 39538 - DNA, 32 bp, Artificial Sequence
  Description of Artificial Sequence: Synthetic oligonucleotide
tccatgaggtatttctacaccgccatgttccg

SEQ ID NO: 39539 - DNA, 31 bp, Artificial Sequence
  Description of Artificial Sequence: Synthetic oligonucleotide
ccatgaggtatttctacaccgccatgttccg

SEQ ID NO: 39540 - DNA, 31 bp, Artificial Sequence
  Description of Artificial Sequence: Synthetic oligonucleotide
catgaggtatttctacaccgccatgttccgg

SEQ ID NO: 39541 - DNA, 31 bp, Artificial Sequence
  Description of Artificial Sequence: Synthetic oligonucleotide
atgaggtatttctacaccgccatgttccggc

SEQ ID NO: 39542 - DNA, 30 bp, Artificial Sequence
  Description of Artificial Sequence: Synthetic oligonucleotide
tgaggtatttctacaccgccatgttccggc

SEQ ID NO: 39543 - DNA, 29 bp, Artificial Sequence
  Description of Artificial Sequence: Synthetic oligonucleotide
gaggtatttctacaccgccatgttccggc

SEQ ID NO: 39544 - DNA, 29 bp, Artificial Sequence
  Description of Artificial Sequence: Synthetic oligonucleotide
aggtatttctacaccgccatgttccggcc

SEQ ID NO: 39545 - DNA, 28 bp, Artificial Sequence
  Description of Artificial Sequence: Synthetic oligonucleotide
ggtatttctacaccgccatgttccggcc

SEQ ID NO: 39546 - DNA, 28 bp, Artificial Sequence
  Description of Artificial Sequence: Synthetic oligonucleotide
gtatttctacaccgccatgttccggccc

SEQ ID NO: 39547 - DNA, 28 bp, Artificial Sequence
  Description of Artificial Sequence: Synthetic oligonucleotide
tatttctacaccgccatgttccggcccg

SEQ ID NO: 39548 - DNA, 27 bp, Artificial Sequence
  Description of Artificial Sequence: Synthetic oligonucleotide
atttctacaccgccatgttccggcccg

SEQ ID NO: 39549 - DNA, 26 bp, Artificial Sequence
  Description of Artificial Sequence: Synthetic oligonucleotide
tttctacaccgccatgttccggcccg

SEQ ID NO: 39550 - DNA, 25 bp, Artificial Sequence
  Description of Artificial Sequence: Synthetic oligonucleotide
ttctacaccgccatgttccggcccg

SEQ ID NO: 39551 - DNA, 24 bp, Artificial Sequence
  Description of Artificial Sequence: Synthetic oligonucleotide
tctacaccgccatgttccggcccg

SEQ ID NO: 39552 - DNA, 23 bp, Artificial Sequence
  Description of Artificial Sequence: Synthetic oligonucleotide
ctacaccgccatgttccggcccg

SEQ ID NO: 39553 - DNA, 23 bp, Artificial Sequence
  Description of Artificial Sequence: Synthetic oligonucleotide
tacaccgccatgttccggcccgg

SEQ ID NO: 39554 - DNA, 22 bp, Artificial Sequence
  Description of Artificial Sequence: Synthetic oligonucleotide
acaccgccatgttccggcccgg

SEQ ID NO: 39555 - DNA, 21 bp, Artificial Sequence
  Description of Artificial Sequence: Synthetic oligonucleotide
caccgccatgttccggcccgg

SEQ ID NO: 39556 - DNA, 21 bp, Artificial Sequence
  Description of Artificial Sequence: Synthetic oligonucleotide
accgccatgttccggcccggc

SEQ ID NO: 39557 - DNA, 20 bp, Artificial Sequence
  Description of Artificial Sequence: Synthetic oligonucleotide
ccgccatgttccggcccggc

SEQ ID NO: 39558 - DNA, 20 bp, Artificial Sequence
  Description of Artificial Sequence: Synthetic oligonucleotide
cgccatgttccggcccggcc

SEQ ID NO: 39559 - DNA, 20 bp, Artificial Sequence
  Description of Artificial Sequence: Synthetic oligonucleotide
gccatgttccggcccggccg

SEQ ID NO: 39560 - DNA, 20 bp, Artificial Sequence
  Description of Artificial Sequence: Synthetic oligonucleotide
ccatgttccggcccggccgc

SEQ ID NO: 39561 - DNA, 20 bp, Artificial Sequence
  Description of Artificial Sequence: Synthetic oligonucleotide
catgttccggcccggccgcg

SEQ ID NO: 39562 - DNA, 20 bp, Artificial Sequence
  Description of Artificial Sequence: Synthetic oligonucleotide
atgttccggcccggccgcgg

SEQ ID NO: 39563 - DNA, 20 bp, Artificial Sequence
  Description of Artificial Sequence: Synthetic oligonucleotide
tgttccggcccggccgcggt

SEQ ID NO: 39564 - DNA, 20 bp, Artificial Sequence
  Description of Artificial Sequence: Synthetic oligonucleotide
gttccggcccggccgcggtt

SEQ ID NO: 39565 - DNA, 20 bp, Artificial Sequence
  Description of Artificial Sequence: Synthetic oligonucleotide
ttccggcccggccgcgggtt

SEQ ID NO: 39566 - DNA, 20 bp, Artificial Sequence
  Description of Artificial Sequence: Synthetic oligonucleotide
tccggcccggccgcgggttt

SEQ ID NO: 39567 - DNA, 29 bp, Artificial Sequence
  Description of Artificial Sequence: Synthetic oligonucleotide
agatctacaaggcccaggcacagactgag

SEQ ID NO: 39568 - DNA, 28 bp, Artificial Sequence
  Description of Artificial Sequence: Synthetic oligonucleotide
gatctacaaggcccaggcacagactgag

SEQ ID NO: 39569 - DNA, 28 bp, Artificial Sequence
  Description of Artificial Sequence: Synthetic oligonucleotide
atctacaaggcccaggcacagactgagc

SEQ ID NO: 39570 - DNA, 27 bp, Artificial Sequence
  Description of Artificial Sequence: Synthetic oligonucleotide
tctacaaggcccaggcacagactgagc

SEQ ID NO: 39571 - DNA, 26 bp, Artificial Sequence
  Description of Artificial Sequence: Synthetic oligonucleotide
ctacaaggcccaggcacagactgagc

SEQ ID NO: 39572 - DNA, 27 bp, Artificial Sequence
  Description of Artificial Sequence: Synthetic oligonucleotide
tacaaggcccaggcacagactgagcga

SEQ ID NO: 39573 - DNA, 26 bp, Artificial Sequence
  Description of Artificial Sequence: Synthetic oligonucleotide
acaaggcccaggcacagactgagcga

SEQ ID NO: 39574 - DNA, 25 bp, Artificial Sequence
  Description of Artificial Sequence: Synthetic oligonucleotide
caaggcccaggcacagactgagcga

SEQ ID NO: 39575 - DNA, 26 bp, Artificial Sequence
  Description of Artificial Sequence: Synthetic oligonucleotide
aaggcccaggcacagactgagcgaga

SEQ ID NO: 39576 - DNA, 25 bp, Artificial Sequence
  Description of Artificial Sequence: Synthetic oligonucleotide
aggcccaggcacagactgagcgaga

SEQ ID NO: 39577 - DNA, 24 bp, Artificial Sequence
  Description of Artificial Sequence: Synthetic oligonucleotide
ggcccaggcacagactgagcgaga

SEQ ID NO: 39578 - DNA, 25 bp, Artificial Sequence
  Description of Artificial Sequence: Synthetic oligonucleotide
gcccaggcacagactgagcgagaga

SEQ ID NO: 39579 - DNA, 25 bp, Artificial Sequence
  Description of Artificial Sequence: Synthetic oligonucleotide
cccaggcacagactgagcgagagag

SEQ ID NO: 39580 - DNA, 25 bp, Artificial Sequence
  Description of Artificial Sequence: Synthetic oligonucleotide
ccaggcacagactgagcgagagagc

SEQ ID NO: 39581 - DNA, 26 bp, Artificial Sequence
  Description of Artificial Sequence: Synthetic oligonucleotide
caggcacagactgagcgagagagcct

SEQ ID NO: 39582 - DNA, 26 bp, Artificial Sequence
  Description of Artificial Sequence: Synthetic oligonucleotide
aggcacagactgagcgagagagcctg

SEQ ID NO: 39583 - DNA, 25 bp, Artificial Sequence
  Description of Artificial Sequence: Synthetic oligonucleotide
ggcacagactgagcgagagagcctg

SEQ ID NO: 39584 - DNA, 25 bp, Artificial Sequence
  Description of Artificial Sequence: Synthetic oligonucleotide
gcacagactgagcgagagagcctgc

SEQ ID NO: 39585 - DNA, 25 bp, Artificial Sequence
  Description of Artificial Sequence: Synthetic oligonucleotide
cacagactgagcgagagagcctgcg

SEQ ID NO: 39586 - DNA, 27 bp, Artificial Sequence
  Description of Artificial Sequence: Synthetic oligonucleotide
acagactgagcgagagagcctgcggaa

SEQ ID NO: 39587 - DNA, 26 bp, Artificial Sequence
  Description of Artificial Sequence: Synthetic oligonucleotide
cagactgagcgagagagcctgcggaa

SEQ ID NO: 39588 - DNA, 26 bp, Artificial Sequence
  Description of Artificial Sequence: Synthetic oligonucleotide
agactgagcgagagagcctgcggaac

SEQ ID NO: 39589 - DNA, 25 bp, Artificial Sequence
  Description of Artificial Sequence: Synthetic oligonucleotide
gactgagcgagagagcctgcggaac

SEQ ID NO: 39590 - DNA, 26 bp, Artificial Sequence
  Description of Artificial Sequence: Synthetic oligonucleotide
actgagcgagagagcctgcggaacct

SEQ ID NO: 39591 - DNA, 25 bp, Artificial Sequence
  Description of Artificial Sequence: Synthetic oligonucleotide
ctgagcgagagagcctgcggaacct

SEQ ID NO: 39592 - DNA, 25 bp, Artificial Sequence
  Description of Artificial Sequence: Synthetic oligonucleotide
tgagcgagagagcctgcggaacctg

SEQ ID NO: 39593 - DNA, 24 bp, Artificial Sequence
  Description of Artificial Sequence: Synthetic oligonucleotide
gagcgagagagcctgcggaacctg

SEQ ID NO: 39594 - DNA, 24 bp, Artificial Sequence
  Description of Artificial Sequence: Synthetic oligonucleotide
agcgagagagcctgcggaacctgc

SEQ ID NO: 39595 - DNA, 23 bp, Artificial Sequence
  Description of Artificial Sequence: Synthetic oligonucleotide
gcgagagagcctgcggaacctgc

SEQ ID NO: 39596 - DNA, 31 bp, Artificial Sequence
  Description of Artificial Sequence: Synthetic oligonucleotide
gctcccactctatgaggtatttctacaccgc

SEQ ID NO: 39597 - DNA, 31 bp, Artificial Sequence
  Description of Artificial Sequence: Synthetic oligonucleotide
ctcccactctatgaggtatttctacaccgcc

SEQ ID NO: 39598 - DNA, 33 bp, Artificial Sequence
  Description of Artificial Sequence: Synthetic oligonucleotide
tcccactctatgaggtatttctacaccgccatg

SEQ ID NO: 39599 - DNA, 32 bp, Artificial Sequence
  Description of Artificial Sequence: Synthetic oligonucleotide
cccactctatgaggtatttctacaccgccatg

SEQ ID NO: 39600 - DNA, 33 bp, Artificial Sequence
  Description of Artificial Sequence: Synthetic oligonucleotide
ccactctatgaggtatttctacaccgccatgtc

SEQ ID NO: 39601 - DNA, 33 bp, Artificial Sequence
  Description of Artificial Sequence: Synthetic oligonucleotide
cactctatgaggtatttctacaccgccatgtcc

SEQ ID NO: 39602 - DNA, 33 bp, Artificial Sequence
  Description of Artificial Sequence: Synthetic oligonucleotide
actctatgaggtatttctacaccgccatgtccc

SEQ ID NO: 39603 - DNA, 32 bp, Artificial Sequence
  Description of Artificial Sequence: Synthetic oligonucleotide
ctctatgaggtatttctacaccgccatgtccc

SEQ ID NO: 39604 - DNA, 32 bp, Artificial Sequence
  Description of Artificial Sequence: Synthetic oligonucleotide
tctatgaggtatttctacaccgccatgtcccg

SEQ ID NO: 39605 - DNA, 31 bp, Artificial Sequence
  Description of Artificial Sequence: Synthetic oligonucleotide
ctatgaggtatttctacaccgccatgtcccg

SEQ ID NO: 39606 - DNA, 31 bp, Artificial Sequence
  Description of Artificial Sequence: Synthetic oligonucleotide
tatgaggtatttctacaccgccatgtcccgg

SEQ ID NO: 39607 - DNA, 27 bp, Artificial Sequence
  Description of Artificial Sequence: Synthetic oligonucleotide
gacactgagcttgtggagaccagaccg

SEQ ID NO: 39608 - DNA, 27 bp, Artificial Sequence
  Description of Artificial Sequence: Synthetic oligonucleotide
acactgagcttgtggagaccagaccgg

SEQ ID NO: 39609 - DNA, 26 bp, Artificial Sequence
  Description of Artificial Sequence: Synthetic oligonucleotide
cactgagcttgtggagaccagaccgg

SEQ ID NO: 39610 - DNA, 27 bp, Artificial Sequence
  Description of Artificial Sequence: Synthetic oligonucleotide
actgagcttgtggagaccagaccggca

SEQ ID NO: 39611 - DNA, 26 bp, Artificial Sequence
  Description of Artificial Sequence: Synthetic oligonucleotide
ctgagcttgtggagaccagaccggca

SEQ ID NO: 39612 - DNA, 26 bp, Artificial Sequence
  Description of Artificial Sequence: Synthetic oligonucleotide
tgagcttgtggagaccagaccggcag

SEQ ID NO: 39613 - DNA, 25 bp, Artificial Sequence
  Description of Artificial Sequence: Synthetic oligonucleotide
gagcttgtggagaccagaccggcag

SEQ ID NO: 39614 - DNA, 26 bp, Artificial Sequence
  Description of Artificial Sequence: Synthetic oligonucleotide
agcttgtggagaccagaccggcagga

SEQ ID NO: 39615 - DNA, 25 bp, Artificial Sequence
  Description of Artificial Sequence: Synthetic oligonucleotide
gcttgtggagaccagaccggcagga

SEQ ID NO: 39616 - DNA, 27 bp, Artificial Sequence
  Description of Artificial Sequence: Synthetic oligonucleotide
cttgtggagaccagaccggcaggagat

SEQ ID NO: 39617 - DNA, 28 bp, Artificial Sequence
  Description of Artificial Sequence: Synthetic oligonucleotide
ttgtggagaccagaccggcaggagatag

SEQ ID NO: 39618 - DNA, 27 bp, Artificial Sequence
  Description of Artificial Sequence: Synthetic oligonucleotide
tgtggagaccagaccggcaggagatag

SEQ ID NO: 39619 - DNA, 27 bp, Artificial Sequence
  Description of Artificial Sequence: Synthetic oligonucleotide
gtggagaccagaccggcaggagataga

SEQ ID NO: 39620 - DNA, 28 bp, Artificial Sequence
  Description of Artificial Sequence: Synthetic oligonucleotide
tggagaccagaccggcaggagatagaac

SEQ ID NO: 39621 - DNA, 27 bp, Artificial Sequence
  Description of Artificial Sequence: Synthetic oligonucleotide
ggagaccagaccggcaggagatagaac

SEQ ID NO: 39622 - DNA, 27 bp, Artificial Sequence
  Description of Artificial Sequence: Synthetic oligonucleotide
gagaccagaccggcaggagatagaacc

SEQ ID NO: 39623 - DNA, 29 bp, Artificial Sequence
  Description of Artificial Sequence: Synthetic oligonucleotide
agaccagaccggcaggagatagaaccttc

SEQ ID NO: 39624 - DNA, 28 bp, Artificial Sequence
  Description of Artificial Sequence: Synthetic oligonucleotide
gaccagaccggcaggagatagaaccttc

SEQ ID NO: 39625 - DNA, 28 bp, Artificial Sequence
  Description of Artificial Sequence: Synthetic oligonucleotide
accagaccggcaggagatagaaccttcc

SEQ ID NO: 39626 - DNA, 27 bp, Artificial Sequence
  Description of Artificial Sequence: Synthetic oligonucleotide
ccagaccggcaggagatagaaccttcc

SEQ ID NO: 39627 - DNA, 28 bp, Artificial Sequence
  Description of Artificial Sequence: Synthetic oligonucleotide
cagaccggcaggagatagaaccttccag

SEQ ID NO: 39628 - DNA, 30 bp, Artificial Sequence
  Description of Artificial Sequence: Synthetic oligonucleotide
agaccggcaggagatagaaccttccagaag

SEQ ID NO: 39629 - DNA, 29 bp, Artificial Sequence
  Description of Artificial Sequence: Synthetic oligonucleotide
gaccggcaggagatagaaccttccagaag

SEQ ID NO: 39630 - DNA, 30 bp, Artificial Sequence
  Description of Artificial Sequence: Synthetic oligonucleotide
accggcaggagatagaaccttccagaagtg

SEQ ID NO: 39631 - DNA, 29 bp, Artificial Sequence
  Description of Artificial Sequence: Synthetic oligonucleotide
ccggcaggagatagaaccttccagaagtg

SEQ ID NO: 39632 - DNA, 29 bp, Artificial Sequence
  Description of Artificial Sequence: Synthetic oligonucleotide
cggcaggagatagaaccttccagaagtgg

SEQ ID NO: 39633 - DNA, 29 bp, Artificial Sequence
  Description of Artificial Sequence: Synthetic oligonucleotide
ggcaggagatagaaccttccagaagtggg

SEQ ID NO: 39634 - DNA, 30 bp, Artificial Sequence
  Description of Artificial Sequence: Synthetic oligonucleotide
ggcataaccagttagcctacgacggcaaag

SEQ ID NO: 39635 - DNA, 34 bp, Artificial Sequence
  Description of Artificial Sequence: Synthetic oligonucleotide
gcataaccagttagcctacgacggcaaagattac

SEQ ID NO: 39636 - DNA, 36 bp, Artificial Sequence
  Description of Artificial Sequence: Synthetic oligonucleotide
cataaccagttagcctacgacggcaaagattacatc

SEQ ID NO: 39637 - DNA, 36 bp, Artificial Sequence
  Description of Artificial Sequence: Synthetic oligonucleotide
ataaccagttagcctacgacggcaaagattacatcg

SEQ ID NO: 39638 - DNA, 35 bp, Artificial Sequence
  Description of Artificial Sequence: Synthetic oligonucleotide
taaccagttagcctacgacggcaaagattacatcg

SEQ ID NO: 39639 - DNA, 34 bp, Artificial Sequence
  Description of Artificial Sequence: Synthetic oligonucleotide
aaccagttagcctacgacggcaaagattacatcg

SEQ ID NO: 39640 - DNA, 33 bp, Artificial Sequence
  Description of Artificial Sequence: Synthetic oligonucleotide
accagttagcctacgacggcaaagattacatcg

SEQ ID NO: 39641 - DNA, 32 bp, Artificial Sequence
  Description of Artificial Sequence: Synthetic oligonucleotide
ccagttagcctacgacggcaaagattacatcg

SEQ ID NO: 39642 - DNA, 32 bp, Artificial Sequence
  Description of Artificial Sequence: Synthetic oligonucleotide
cagttagcctacgacggcaaagattacatcgc

SEQ ID NO: 39643 - DNA, 32 bp, Artificial Sequence
  Description of Artificial Sequence: Synthetic oligonucleotide
agttagcctacgacggcaaagattacatcgcc

SEQ ID NO: 39644 - DNA, 31 bp, Artificial Sequence
  Description of Artificial Sequence: Synthetic oligonucleotide
gttagcctacgacggcaaagattacatcgcc

SEQ ID NO: 39645 - DNA, 31 bp, Artificial Sequence
  Description of Artificial Sequence: Synthetic oligonucleotide
ttagcctacgacggcaaagattacatcgccc

SEQ ID NO: 39646 - DNA, 30 bp, Artificial Sequence
  Description of Artificial Sequence: Synthetic oligonucleotide
tagcctacgacggcaaagattacatcgccc

SEQ ID NO: 39647 - DNA, 29 bp, Artificial Sequence
  Description of Artificial Sequence: Synthetic oligonucleotide
agcctacgacggcaaagattacatcgccc

SEQ ID NO: 39648 - DNA, 26 bp, Artificial Sequence
  Description of Artificial Sequence: Synthetic oligonucleotide
agaacgggaaagagacgctgcagcgc

SEQ ID NO: 39649 - DNA, 25 bp, Artificial Sequence
  Description of Artificial Sequence: Synthetic oligonucleotide
gaacgggaaagagacgctgcagcgc

SEQ ID NO: 39650 - DNA, 25 bp, Artificial Sequence
  Description of Artificial Sequence: Synthetic oligonucleotide
aacgggaaagagacgctgcagcgcg

SEQ ID NO: 39651 - DNA, 24 bp, Artificial Sequence
  Description of Artificial Sequence: Synthetic oligonucleotide
acgggaaagagacgctgcagcgcg

SEQ ID NO: 39652 - DNA, 23 bp, Artificial Sequence
  Description of Artificial Sequence: Synthetic oligonucleotide
cgggaaagagacgctgcagcgcg

SEQ ID NO: 39653 - DNA, 23 bp, Artificial Sequence
  Description of Artificial Sequence: Synthetic oligonucleotide
gggaaagagacgctgcagcgcgc

SEQ ID NO: 39654 - DNA, 23 bp, Artificial Sequence
  Description of Artificial Sequence: Synthetic oligonucleotide
ggaaagagacgctgcagcgcgcg

SEQ ID NO: 39655 - DNA, 23 bp, Artificial Sequence
  Description of Artificial Sequence: Synthetic oligonucleotide
gaaagagacgctgcagcgcgcgg

SEQ ID NO: 39656 - DNA, 31 bp, Artificial Sequence
  Description of Artificial Sequence: Synthetic oligonucleotide
tctcacacttggcagacgatgtatggctgtg

SEQ ID NO: 39657 - DNA, 30 bp, Artificial Sequence
  Description of Artificial Sequence: Synthetic oligonucleotide
ctcacacttggcagacgatgtatggctgtg

SEQ ID NO: 39658 - DNA, 31 bp, Artificial Sequence
  Description of Artificial Sequence: Synthetic oligonucleotide
tcacacttggcagacgatgtatggctgtgac

SEQ ID NO: 39659 - DNA, 30 bp, Artificial Sequence
  Description of Artificial Sequence: Synthetic oligonucleotide
cacacttggcagacgatgtatggctgtgac

SEQ ID NO: 39660 - DNA, 30 bp, Artificial Sequence
  Description of Artificial Sequence: Synthetic oligonucleotide
acacttggcagacgatgtatggctgtgacc

SEQ ID NO: 39661 - DNA, 29 bp, Artificial Sequence
  Description of Artificial Sequence: Synthetic oligonucleotide
cacttggcagacgatgtatggctgtgacc

SEQ ID NO: 39662 - DNA, 30 bp, Artificial Sequence
  Description of Artificial Sequence: Synthetic oligonucleotide
acttggcagacgatgtatggctgtgacctg

SEQ ID NO: 39663 - DNA, 29 bp, Artificial Sequence
  Description of Artificial Sequence: Synthetic oligonucleotide
cttggcagacgatgtatggctgtgacctg

SEQ ID NO: 39664 - DNA, 29 bp, Artificial Sequence
  Description of Artificial Sequence: Synthetic oligonucleotide
ttggcagacgatgtatggctgtgacctgg

SEQ ID NO: 39665 - DNA, 28 bp, Artificial Sequence
  Description of Artificial Sequence: Synthetic oligonucleotide
tggcagacgatgtatggctgtgacctgg

SEQ ID NO: 39666 - DNA, 27 bp, Artificial Sequence
  Description of Artificial Sequence: Synthetic oligonucleotide
ggcagacgatgtatggctgtgacctgg

SEQ ID NO: 39667 - DNA, 27 bp, Artificial Sequence
  Description of Artificial Sequence: Synthetic oligonucleotide
gcagacgatgtatggctgtgacctggg

SEQ ID NO: 39668 - DNA, 27 bp, Artificial Sequence
  Description of Artificial Sequence: Synthetic oligonucleotide
cagacgatgtatggctgtgacctgggg

SEQ ID NO: 39669 - DNA, 27 bp, Artificial Sequence
  Description of Artificial Sequence: Synthetic oligonucleotide
agacgatgtatggctgtgacctggggc

SEQ ID NO: 39670 - DNA, 26 bp, Artificial Sequence
  Description of Artificial Sequence: Synthetic oligonucleotide
gacgatgtatggctgtgacctggggc

SEQ ID NO: 39671 - DNA, 26 bp, Artificial Sequence
  Description of Artificial Sequence: Synthetic oligonucleotide
acgatgtatggctgtgacctggggcc

SEQ ID NO: 39672 - DNA, 25 bp, Artificial Sequence
  Description of Artificial Sequence: Synthetic oligonucleotide
cgatgtatggctgtgacctggggcc

SEQ ID NO: 39673 - DNA, 25 bp, Artificial Sequence
  Description of Artificial Sequence: Synthetic oligonucleotide
gatgtatggctgtgacctggggccg

SEQ ID NO: 39674 - DNA, 26 bp, Artificial Sequence
  Description of Artificial Sequence: Synthetic oligonucleotide
atgtatggctgtgacctggggccgga

SEQ ID NO: 39675 - DNA, 25 bp, Artificial Sequence
  Description of Artificial Sequence: Synthetic oligonucleotide
tgtatggctgtgacctggggccgga

SEQ ID NO: 39676 - DNA, 24 bp, Artificial Sequence
  Description of Artificial Sequence: Synthetic oligonucleotide
gtatggctgtgacctggggccgga

SEQ ID NO: 39677 - DNA, 24 bp, Artificial Sequence
  Description of Artificial Sequence: Synthetic oligonucleotide
tatggctgtgacctggggccggac

SEQ ID NO: 39678 - DNA, 23 bp, Artificial Sequence
  Description of Artificial Sequence: Synthetic oligonucleotide
atggctgtgacctggggccggac

SEQ ID NO: 39679 - DNA, 22 bp, Artificial Sequence
  Description of Artificial Sequence: Synthetic oligonucleotide
tggctgtgacctggggccggac

SEQ ID NO: 39680 - DNA, 21 bp, Artificial Sequence
  Description of Artificial Sequence: Synthetic oligonucleotide
ggctgtgacctggggccggac

SEQ ID NO: 39681 - DNA, 21 bp, Artificial Sequence
  Description of Artificial Sequence: Synthetic oligonucleotide
gctgtgacctggggccggacg

SEQ ID NO: 39682 - DNA, 21 bp, Artificial Sequence
  Description of Artificial Sequence: Synthetic oligonucleotide
ctgtgacctggggccggacgg

SEQ ID NO: 39683 - DNA, 21 bp, Artificial Sequence
  Description of Artificial Sequence: Synthetic oligonucleotide
tgtgacctggggccggacggg

SEQ ID NO: 39684 - DNA, 20 bp, Artificial Sequence
  Description of Artificial Sequence: Synthetic oligonucleotide
gtgacctggggccggacggg

SEQ ID NO: 39685 - DNA, 20 bp, Artificial Sequence
  Description of Artificial Sequence: Synthetic oligonucleotide
tgacctggggccggacgggc

SEQ ID NO: 39686 - DNA, 26 bp, Artificial Sequence
  Description of Artificial Sequence: Synthetic oligonucleotide
gcggctactacaaccagagcgaggca

SEQ ID NO: 39687 - DNA, 26 bp, Artificial Sequence
  Description of Artificial Sequence: Synthetic oligonucleotide
cggctactacaaccagagcgaggcag

SEQ ID NO: 39688 - DNA, 26 bp, Artificial Sequence
  Description of Artificial Sequence: Synthetic oligonucleotide
ggctactacaaccagagcgaggcagg

SEQ ID NO: 39689 - DNA, 27 bp, Artificial Sequence
  Description of Artificial Sequence: Synthetic oligonucleotide
gctactacaaccagagcgaggcagggt

SEQ ID NO: 39690 - DNA, 27 bp, Artificial Sequence
  Description of Artificial Sequence: Synthetic oligonucleotide
ctactacaaccagagcgaggcagggtc

SEQ ID NO: 39691 - DNA, 28 bp, Artificial Sequence
  Description of Artificial Sequence: Synthetic oligonucleotide
tactacaaccagagcgaggcagggtctc

SEQ ID NO: 39692 - DNA, 27 bp, Artificial Sequence
  Description of Artificial Sequence: Synthetic oligonucleotide
actacaaccagagcgaggcagggtctc

SEQ ID NO: 39693 - DNA, 27 bp, Artificial Sequence
  Description of Artificial Sequence: Synthetic oligonucleotide
ctacaaccagagcgaggcagggtctca

SEQ ID NO: 39694 - DNA, 27 bp, Artificial Sequence
  Description of Artificial Sequence: Synthetic oligonucleotide
tacaaccagagcgaggcagggtctcac

SEQ ID NO: 39695 - DNA, 27 bp, Artificial Sequence
  Description of Artificial Sequence: Synthetic oligonucleotide
acaaccagagcgaggcagggtctcaca

SEQ ID NO: 39696 - DNA, 26 bp, Artificial Sequence
  Description of Artificial Sequence: Synthetic oligonucleotide
caaccagagcgaggcagggtctcaca

SEQ ID NO: 39697 - DNA, 27 bp, Artificial Sequence
  Description of Artificial Sequence: Synthetic oligonucleotide
aaccagagcgaggcagggtctcacact

SEQ ID NO: 39698 - DNA, 27 bp, Artificial Sequence
  Description of Artificial Sequence: Synthetic oligonucleotide
accagagcgaggcagggtctcacactt

SEQ ID NO: 39699 - DNA, 26 bp, Artificial Sequence
  Description of Artificial Sequence: Synthetic oligonucleotide
ccagagcgaggcagggtctcacactt

SEQ ID NO: 39700 - DNA, 26 bp, Artificial Sequence
  Description of Artificial Sequence: Synthetic oligonucleotide
cagagcgaggcagggtctcacacttg

SEQ ID NO: 39701 - DNA, 26 bp, Artificial Sequence
  Description of Artificial Sequence: Synthetic oligonucleotide
agagcgaggcagggtctcacacttgg

SEQ ID NO: 39702 - DNA, 25 bp, Artificial Sequence
  Description of Artificial Sequence: Synthetic oligonucleotide
gagcgaggcagggtctcacacttgg

SEQ ID NO: 39703 - DNA, 26 bp, Artificial Sequence
  Description of Artificial Sequence: Synthetic oligonucleotide
agcgaggcagggtctcacacttggca

SEQ ID NO: 39704 - DNA, 25 bp, Artificial Sequence
  Description of Artificial Sequence: Synthetic oligonucleotide
gcgaggcagggtctcacacttggca

SEQ ID NO: 39705 - DNA, 26 bp, Artificial Sequence
  Description of Artificial Sequence: Synthetic oligonucleotide
cgaggcagggtctcacacttggcaga

SEQ ID NO: 39706 - DNA, 26 bp, Artificial Sequence
  Description of Artificial Sequence: Synthetic oligonucleotide
gaggcagggtctcacacttggcagac

SEQ ID NO: 39707 - DNA, 27 bp, Artificial Sequence
  Description of Artificial Sequence: Synthetic oligonucleotide
aggcagggtctcacacttggcagacga

SEQ ID NO: 39708 - DNA, 27 bp, Artificial Sequence
  Description of Artificial Sequence: Synthetic oligonucleotide
ggcagggtctcacacttggcagacgat

SEQ ID NO: 39709 - DNA, 27 bp, Artificial Sequence
  Description of Artificial Sequence: Synthetic oligonucleotide
gcagggtctcacacttggcagacgatg

SEQ ID NO: 39710 - DNA, 30 bp, Artificial Sequence
  Description of Artificial Sequence: Synthetic oligonucleotide
cagggtctcacacttggcagacgatgtatg

SEQ ID NO: 39711 - DNA, 30 bp, Artificial Sequence
  Description of Artificial Sequence: Synthetic oligonucleotide
agggtctcacacttggcagacgatgtatgg

SEQ ID NO: 39712 - DNA, 23 bp, Artificial Sequence
  Description of Artificial Sequence: Synthetic oligonucleotide
tggatagagcaggaggggccggc

SEQ ID NO: 39713 - DNA, 22 bp, Artificial Sequence
  Description of Artificial Sequence: Synthetic oligonucleotide
ggatagagcaggaggggccggc

SEQ ID NO: 39714 - DNA, 26 bp, Artificial Sequence
  Description of Artificial Sequence: Synthetic oligonucleotide
gatagagcaggaggggccggcgtatt

SEQ ID NO: 39715 - DNA, 26 bp, Artificial Sequence
  Description of Artificial Sequence: Synthetic oligonucleotide
atagagcaggaggggccggcgtattg

SEQ ID NO: 39716 - DNA, 25 bp, Artificial Sequence
  Description of Artificial Sequence: Synthetic oligonucleotide
tagagcaggaggggccggcgtattg

SEQ ID NO: 39717 - DNA, 24 bp, Artificial Sequence
  Description of Artificial Sequence: Synthetic oligonucleotide
agagcaggaggggccggcgtattg

SEQ ID NO: 39718 - DNA, 23 bp, Artificial Sequence
  Description of Artificial Sequence: Synthetic oligonucleotide
gagcaggaggggccggcgtattg

SEQ ID NO: 39719 - DNA, 23 bp, Artificial Sequence
  Description of Artificial Sequence: Synthetic oligonucleotide
agcaggaggggccggcgtattgg

SEQ ID NO: 39720 - DNA, 22 bp, Artificial Sequence
  Description of Artificial Sequence: Synthetic oligonucleotide
gcaggaggggccggcgtattgg

SEQ ID NO: 39721 - DNA, 23 bp, Artificial Sequence
  Description of Artificial Sequence: Synthetic oligonucleotide
caggaggggccggcgtattggga

SEQ ID NO: 39722 - DNA, 23 bp, Artificial Sequence
  Description of Artificial Sequence: Synthetic oligonucleotide
aggaggggccggcgtattgggac

SEQ ID NO: 39723 - DNA, 22 bp, Artificial Sequence
  Description of Artificial Sequence: Synthetic oligonucleotide
ggaggggccggcgtattgggac

SEQ ID NO: 39724 - DNA, 22 bp, Artificial Sequence
  Description of Artificial Sequence: Synthetic oligonucleotide
gaggggccggcgtattgggacc

SEQ ID NO: 39725 - DNA, 22 bp, Artificial Sequence
  Description of Artificial Sequence: Synthetic oligonucleotide
aggggccggcgtattgggaccg

SEQ ID NO: 39726 - DNA, 21 bp, Artificial Sequence
  Description of Artificial Sequence: Synthetic oligonucleotide
ggggccggcgtattgggaccg

SEQ ID NO: 39727 - DNA, 23 bp, Artificial Sequence
  Description of Artificial Sequence: Synthetic oligonucleotide
gggccggcgtattgggaccggaa

SEQ ID NO: 39728 - DNA, 24 bp, Artificial Sequence
  Description of Artificial Sequence: Synthetic oligonucleotide
ggccggcgtattgggaccggaaca

SEQ ID NO: 39729 - DNA, 25 bp, Artificial Sequence
  Description of Artificial Sequence: Synthetic oligonucleotide
gccggcgtattgggaccggaacaca

SEQ ID NO: 39730 - DNA, 26 bp, Artificial Sequence
  Description of Artificial Sequence: Synthetic oligonucleotide
ccggcgtattgggaccggaacacaca

SEQ ID NO: 39731 - DNA, 27 bp, Artificial Sequence
  Description of Artificial Sequence: Synthetic oligonucleotide
cggcgtattgggaccggaacacacaga

SEQ ID NO: 39732 - DNA, 28 bp, Artificial Sequence
  Description of Artificial Sequence: Synthetic oligonucleotide
ggcgtattgggaccggaacacacagatc

SEQ ID NO: 39733 - DNA, 30 bp, Artificial Sequence
  Description of Artificial Sequence: Synthetic oligonucleotide
gcgtattgggaccggaacacacagatctac

SEQ ID NO: 39734 - DNA, 32 bp, Artificial Sequence
  Description of Artificial Sequence: Synthetic oligonucleotide
cgtattgggaccggaacacacagatctacaag

SEQ ID NO: 39735 - DNA, 26 bp, Artificial Sequence
  Description of Artificial Sequence: Synthetic oligonucleotide
gaggccgggtctcacacttggcagat

SEQ ID NO: 39736 - DNA, 27 bp, Artificial Sequence
  Description of Artificial Sequence: Synthetic oligonucleotide
aggccgggtctcacacttggcagatga

SEQ ID NO: 39737 - DNA, 27 bp, Artificial Sequence
  Description of Artificial Sequence: Synthetic oligonucleotide
ggccgggtctcacacttggcagatgat

SEQ ID NO: 39738 - DNA, 27 bp, Artificial Sequence
  Description of Artificial Sequence: Synthetic oligonucleotide
gccgggtctcacacttggcagatgatg

SEQ ID NO: 39739 - DNA, 30 bp, Artificial Sequence
  Description of Artificial Sequence: Synthetic oligonucleotide
ccgggtctcacacttggcagatgatgtatg

SEQ ID NO: 39740 - DNA, 30 bp, Artificial Sequence
  Description of Artificial Sequence: Synthetic oligonucleotide
cgggtctcacacttggcagatgatgtatgg

SEQ ID NO: 39741 - DNA, 30 bp, Artificial Sequence
  Description of Artificial Sequence: Synthetic oligonucleotide
gggtctcacacttggcagatgatgtatggc

SEQ ID NO: 39742 - DNA, 31 bp, Artificial Sequence
  Description of Artificial Sequence: Synthetic oligonucleotide
ggtctcacacttggcagatgatgtatggctg

SEQ ID NO: 39743 - DNA, 31 bp, Artificial Sequence
  Description of Artificial Sequence: Synthetic oligonucleotide
gtctcacacttggcagatgatgtatggctgc

SEQ ID NO: 39744 - DNA, 31 bp, Artificial Sequence
  Description of Artificial Sequence: Synthetic oligonucleotide
tctcacacttggcagatgatgtatggctgcg

SEQ ID NO: 39745 - DNA, 30 bp, Artificial Sequence
  Description of Artificial Sequence: Synthetic oligonucleotide
ctcacacttggcagatgatgtatggctgcg

SEQ ID NO: 39746 - DNA, 31 bp, Artificial Sequence
  Description of Artificial Sequence: Synthetic oligonucleotide
tcacacttggcagatgatgtatggctgcgac

SEQ ID NO: 39747 - DNA, 30 bp, Artificial Sequence
  Description of Artificial Sequence: Synthetic oligonucleotide
cacacttggcagatgatgtatggctgcgac

SEQ ID NO: 39748 - DNA, 30 bp, Artificial Sequence
  Description of Artificial Sequence: Synthetic oligonucleotide
acacttggcagatgatgtatggctgcgacc

SEQ ID NO: 39749 - DNA, 29 bp, Artificial Sequence
  Description of Artificial Sequence: Synthetic oligonucleotide
cacttggcagatgatgtatggctgcgacc

SEQ ID NO: 39750 - DNA, 30 bp, Artificial Sequence
  Description of Artificial Sequence: Synthetic oligonucleotide
acttggcagatgatgtatggctgcgacctg

SEQ ID NO: 39751 - DNA, 29 bp, Artificial Sequence
  Description of Artificial Sequence: Synthetic oligonucleotide
cttggcagatgatgtatggctgcgacctg

SEQ ID NO: 39752 - DNA, 29 bp, Artificial Sequence
  Description of Artificial Sequence: Synthetic oligonucleotide
ttggcagatgatgtatggctgcgacctgg

SEQ ID NO: 39753 - DNA, 28 bp, Artificial Sequence
  Description of Artificial Sequence: Synthetic oligonucleotide
tggcagatgatgtatggctgcgacctgg

SEQ ID NO: 39754 - DNA, 27 bp, Artificial Sequence
  Description of Artificial Sequence: Synthetic oligonucleotide
ggcagatgatgtatggctgcgacctgg

SEQ ID NO: 39755 - DNA, 27 bp, Artificial Sequence
  Description of Artificial Sequence: Synthetic oligonucleotide
gcagatgatgtatggctgcgacctggg

SEQ ID NO: 39756 - DNA, 27 bp, Artificial Sequence
  Description of Artificial Sequence: Synthetic oligonucleotide
cagatgatgtatggctgcgacctgggg

SEQ ID NO: 39757 - DNA, 27 bp, Artificial Sequence
  Description of Artificial Sequence: Synthetic oligonucleotide
agatgatgtatggctgcgacctggggc

SEQ ID NO: 39758 - DNA, 26 bp, Artificial Sequence
  Description of Artificial Sequence: Synthetic oligonucleotide
gatgatgtatggctgcgacctggggc

SEQ ID NO: 39759 - DNA, 26 bp, Artificial Sequence
  Description of Artificial Sequence: Synthetic oligonucleotide
atgatgtatggctgcgacctggggcc

SEQ ID NO: 39760 - DNA, 25 bp, Artificial Sequence
  Description of Artificial Sequence: Synthetic oligonucleotide
tgatgtatggctgcgacctggggcc

SEQ ID NO: 39761 - DNA, 28 bp, Artificial Sequence
  Description of Artificial Sequence: Synthetic oligonucleotide
gacacgcagttcgtgaggttcgacagag

SEQ ID NO: 39762 - DNA, 29 bp, Artificial Sequence
  Description of Artificial Sequence: Synthetic oligonucleotide
acacgcagttcgtgaggttcgacagagac

SEQ ID NO: 39763 - DNA, 28 bp, Artificial Sequence
  Description of Artificial Sequence: Synthetic oligonucleotide
cacgcagttcgtgaggttcgacagagac

SEQ ID NO: 39764 - DNA, 28 bp, Artificial Sequence
  Description of Artificial Sequence: Synthetic oligonucleotide
acgcagttcgtgaggttcgacagagacg

SEQ ID NO: 39765 - DNA, 27 bp, Artificial Sequence
  Description of Artificial Sequence: Synthetic oligonucleotide
cgcagttcgtgaggttcgacagagacg

SEQ ID NO: 39766 - DNA, 27 bp, Artificial Sequence
  Description of Artificial Sequence: Synthetic oligonucleotide
gcagttcgtgaggttcgacagagacgc

SEQ ID NO: 39767 - DNA, 24 bp, Artificial Sequence
  Description of Artificial Sequence: Synthetic oligonucleotide
gacagagacgccgcgagtccgaga

SEQ ID NO: 39768 - DNA, 25 bp, Artificial Sequence
  Description of Artificial Sequence: Synthetic oligonucleotide
acagagacgccgcgagtccgagaga

SEQ ID NO: 39769 - DNA, 24 bp, Artificial Sequence
  Description of Artificial Sequence: Synthetic oligonucleotide
cagagacgccgcgagtccgagaga

SEQ ID NO: 39770 - DNA, 24 bp, Artificial Sequence
  Description of Artificial Sequence: Synthetic oligonucleotide
agagacgccgcgagtccgagagag

SEQ ID NO: 39771 - DNA, 23 bp, Artificial Sequence
  Description of Artificial Sequence: Synthetic oligonucleotide
gagacgccgcgagtccgagagag

SEQ ID NO: 39772 - DNA, 24 bp, Artificial Sequence
  Description of Artificial Sequence: Synthetic oligonucleotide
agacgccgcgagtccgagagagga

SEQ ID NO: 39773 - DNA, 29 bp, Artificial Sequence
  Description of Artificial Sequence: Synthetic oligonucleotide
acacgcagttcgtgaggttcgacagcaac

SEQ ID NO: 39774 - DNA, 28 bp, Artificial Sequence
  Description of Artificial Sequence: Synthetic oligonucleotide
cacgcagttcgtgaggttcgacagcaac

SEQ ID NO: 39775 - DNA, 28 bp, Artificial Sequence
  Description of Artificial Sequence: Synthetic oligonucleotide
acgcagttcgtgaggttcgacagcaacg

SEQ ID NO: 39776 - DNA, 27 bp, Artificial Sequence
  Description of Artificial Sequence: Synthetic oligonucleotide
cgcagttcgtgaggttcgacagcaacg

SEQ ID NO: 39777 - DNA, 27 bp, Artificial Sequence
  Description of Artificial Sequence: Synthetic oligonucleotide
gcagttcgtgaggttcgacagcaacgc

SEQ ID NO: 39778 - DNA, 24 bp, Artificial Sequence
  Description of Artificial Sequence: Synthetic oligonucleotide
gacagcaacgccgcgagtccgaga

SEQ ID NO: 39779 - DNA, 25 bp, Artificial Sequence
  Description of Artificial Sequence: Synthetic oligonucleotide
acagcaacgccgcgagtccgagaga

SEQ ID NO: 39780 - DNA, 24 bp, Artificial Sequence
  Description of Artificial Sequence: Synthetic oligonucleotide
cagcaacgccgcgagtccgagaga

SEQ ID NO: 39781 - DNA, 24 bp, Artificial Sequence
  Description of Artificial Sequence: Synthetic oligonucleotide
agcaacgccgcgagtccgagagag

SEQ ID NO: 39782 - DNA, 23 bp, Artificial Sequence
  Description of Artificial Sequence: Synthetic oligonucleotide
gcaacgccgcgagtccgagagag

SEQ ID NO: 39783 - DNA, 24 bp, Artificial Sequence
  Description of Artificial Sequence: Synthetic oligonucleotide
caacgccgcgagtccgagagagga

SEQ ID NO: 39784 - DNA, 24 bp, Artificial Sequence
  Description of Artificial Sequence: Synthetic oligonucleotide
aacgccgcgagtccgagagaggag

SEQ ID NO: 39785 - DNA, 29 bp, Artificial Sequence
  Description of Artificial Sequence: Synthetic oligonucleotide
gctcccactccatgaggtatgtctacacc

SEQ ID NO: 39786 - DNA, 29 bp, Artificial Sequence
  Description of Artificial Sequence: Synthetic oligonucleotide
ctcccactccatgaggtatgtctacaccg

SEQ ID NO: 39787 - DNA, 29 bp, Artificial Sequence
  Description of Artificial Sequence: Synthetic oligonucleotide
tcccactccatgaggtatgtctacaccgc

SEQ ID NO: 39788 - DNA, 28 bp, Artificial Sequence
  Description of Artificial Sequence: Synthetic oligonucleotide
cccactccatgaggtatgtctacaccgc

SEQ ID NO: 39789 - DNA, 28 bp, Artificial Sequence
  Description of Artificial Sequence: Synthetic oligonucleotide
ccactccatgaggtatgtctacaccgcc

SEQ ID NO: 39790 - DNA, 30 bp, Artificial Sequence
  Description of Artificial Sequence: Synthetic oligonucleotide
cactccatgaggtatgtctacaccgccatg

SEQ ID NO: 39791 - DNA, 31 bp, Artificial Sequence
  Description of Artificial Sequence: Synthetic oligonucleotide
actccatgaggtatgtctacaccgccatgtc

SEQ ID NO: 39792 - DNA, 30 bp, Artificial Sequence
  Description of Artificial Sequence: Synthetic oligonucleotide
ctccatgaggtatgtctacaccgccatgtc

SEQ ID NO: 39793 - DNA, 30 bp, Artificial Sequence
  Description of Artificial Sequence: Synthetic oligonucleotide
tccatgaggtatgtctacaccgccatgtcc

SEQ ID NO: 39794 - DNA, 29 bp, Artificial Sequence
  Description of Artificial Sequence: Synthetic oligonucleotide
ccatgaggtatgtctacaccgccatgtcc

SEQ ID NO: 39795 - DNA, 29 bp, Artificial Sequence
  Description of Artificial Sequence: Synthetic oligonucleotide
catgaggtatgtctacaccgccatgtccc

SEQ ID NO: 39796 - DNA, 29 bp, Artificial Sequence
  Description of Artificial Sequence: Synthetic oligonucleotide
atgaggtatgtctacaccgccatgtcccg

SEQ ID NO: 39797 - DNA, 28 bp, Artificial Sequence
  Description of Artificial Sequence: Synthetic oligonucleotide
tgaggtatgtctacaccgccatgtcccg

SEQ ID NO: 39798 - DNA, 27 bp, Artificial Sequence
  Description of Artificial Sequence: Synthetic oligonucleotide
gaggtatgtctacaccgccatgtcccg

SEQ ID NO: 39799 - DNA, 27 bp, Artificial Sequence
  Description of Artificial Sequence: Synthetic oligonucleotide
aggtatgtctacaccgccatgtcccgg

SEQ ID NO: 39800 - DNA, 26 bp, Artificial Sequence
  Description of Artificial Sequence: Synthetic oligonucleotide
ggtatgtctacaccgccatgtcccgg

SEQ ID NO: 39801 - DNA, 26 bp, Artificial Sequence
  Description of Artificial Sequence: Synthetic oligonucleotide
gtatgtctacaccgccatgtcccggc

SEQ ID NO: 39802 - DNA, 26 bp, Artificial Sequence
  Description of Artificial Sequence: Synthetic oligonucleotide
tatgtctacaccgccatgtcccggcc

SEQ ID NO: 39803 - DNA, 25 bp, Artificial Sequence
  Description of Artificial Sequence: Synthetic oligonucleotide
atgtctacaccgccatgtcccggcc

SEQ ID NO: 39804 - DNA, 24 bp, Artificial Sequence
  Description of Artificial Sequence: Synthetic oligonucleotide
tgtctacaccgccatgtcccggcc

SEQ ID NO: 39805 - DNA, 23 bp, Artificial Sequence
  Description of Artificial Sequence: Synthetic oligonucleotide
gtctacaccgccatgtcccggcc

SEQ ID NO: 39806 - DNA, 28 bp, Artificial Sequence
  Description of Artificial Sequence: Synthetic oligonucleotide
gctacgtggacaacacgcagttcgtgag

SEQ ID NO: 39807 - DNA, 28 bp, Artificial Sequence
  Description of Artificial Sequence: Synthetic oligonucleotide
ctacgtggacaacacgcagttcgtgagg

SEQ ID NO: 39808 - DNA, 30 bp, Artificial Sequence
  Description of Artificial Sequence: Synthetic oligonucleotide
tacgtggacaacacgcagttcgtgaggttc

SEQ ID NO: 39809 - DNA, 29 bp, Artificial Sequence
  Description of Artificial Sequence: Synthetic oligonucleotide
acgtggacaacacgcagttcgtgaggttc

SEQ ID NO: 39810 - DNA, 28 bp, Artificial Sequence
  Description of Artificial Sequence: Synthetic oligonucleotide
cgtggacaacacgcagttcgtgaggttc

SEQ ID NO: 39811 - DNA, 28 bp, Artificial Sequence
  Description of Artificial Sequence: Synthetic oligonucleotide
gtggacaacacgcagttcgtgaggttcg

SEQ ID NO: 39812 - DNA, 29 bp, Artificial Sequence
  Description of Artificial Sequence: Synthetic oligonucleotide
tggacaacacgcagttcgtgaggttcgac

SEQ ID NO: 39813 - DNA, 28 bp, Artificial Sequence
  Description of Artificial Sequence: Synthetic oligonucleotide
ggacaacacgcagttcgtgaggttcgac

SEQ ID NO: 39814 - DNA, 29 bp, Artificial Sequence
  Description of Artificial Sequence: Synthetic oligonucleotide
gacaacacgcagttcgtgaggttcgacag

SEQ ID NO: 39815 - DNA, 29 bp, Artificial Sequence
  Description of Artificial Sequence: Synthetic oligonucleotide
acaacacgcagttcgtgaggttcgacagc

SEQ ID NO: 39816 - DNA, 28 bp, Artificial Sequence
  Description of Artificial Sequence: Synthetic oligonucleotide
caacacgcagttcgtgaggttcgacagc

SEQ ID NO: 39817 - DNA, 28 bp, Artificial Sequence
  Description of Artificial Sequence: Synthetic oligonucleotide
aacacgcagttcgtgaggttcgacagcg

SEQ ID NO: 39818 - DNA, 23 bp, Artificial Sequence
  Description of Artificial Sequence: Synthetic oligonucleotide
gacctgagctcctggaccgcggt

SEQ ID NO: 39819 - DNA, 23 bp, Artificial Sequence
  Description of Artificial Sequence: Synthetic oligonucleotide
acctgagctcctggaccgcggtg

SEQ ID NO: 39820 - DNA, 22 bp, Artificial Sequence
  Description of Artificial Sequence: Synthetic oligonucleotide
cctgagctcctggaccgcggtg

SEQ ID NO: 39821 - DNA, 23 bp, Artificial Sequence
  Description of Artificial Sequence: Synthetic oligonucleotide
ctgagctcctggaccgcggtgga

SEQ ID NO: 39822 - DNA, 24 bp, Artificial Sequence
  Description of Artificial Sequence: Synthetic oligonucleotide
tgagctcctggaccgcggtggaca

SEQ ID NO: 39823 - DNA, 23 bp, Artificial Sequence
  Description of Artificial Sequence: Synthetic oligonucleotide
gagctcctggaccgcggtggaca

SEQ ID NO: 39824 - DNA, 23 bp, Artificial Sequence
  Description of Artificial Sequence: Synthetic oligonucleotide
agctcctggaccgcggtggacac

SEQ ID NO: 39825 - DNA, 22 bp, Artificial Sequence
  Description of Artificial Sequence: Synthetic oligonucleotide
gctcctggaccgcggtggacac

SEQ ID NO: 39826 - DNA, 22 bp, Artificial Sequence
  Description of Artificial Sequence: Synthetic oligonucleotide
ctcctggaccgcggtggacacc

SEQ ID NO: 39827 - DNA, 22 bp, Artificial Sequence
  Description of Artificial Sequence: Synthetic oligonucleotide
tcctggaccgcggtggacaccg

SEQ ID NO: 39828 - DNA, 21 bp, Artificial Sequence
  Description of Artificial Sequence: Synthetic oligonucleotide
cctggaccgcggtggacaccg

SEQ ID NO: 39829 - DNA, 21 bp, Artificial Sequence
  Description of Artificial Sequence: Synthetic oligonucleotide
ctggaccgcggtggacaccgc

SEQ ID NO: 39830 - DNA, 21 bp, Artificial Sequence
  Description of Artificial Sequence: Synthetic oligonucleotide
tggaccgcggtggacaccgcg

SEQ ID NO: 39831 - DNA, 20 bp, Artificial Sequence
  Description of Artificial Sequence: Synthetic oligonucleotide
ggaccgcggtggacaccgcg

SEQ ID NO: 39832 - DNA, 20 bp, Artificial Sequence
  Description of Artificial Sequence: Synthetic oligonucleotide
gaccgcggtggacaccgcgg

SEQ ID NO: 39833 - DNA, 21 bp, Artificial Sequence
  Description of Artificial Sequence: Synthetic oligonucleotide
accgcggtggacaccgcggct

SEQ ID NO: 39834 - DNA, 20 bp, Artificial Sequence
  Description of Artificial Sequence: Synthetic oligonucleotide
ccgcggtggacaccgcggct

SEQ ID NO: 39835 - DNA, 21 bp, Artificial Sequence
  Description of Artificial Sequence: Synthetic oligonucleotide
cgcggtggacaccgcggctca

SEQ ID NO: 39836 - DNA, 23 bp, Artificial Sequence
  Description of Artificial Sequence: Synthetic oligonucleotide
gcggtggacaccgcggctcagat

SEQ ID NO: 39837 - DNA, 24 bp, Artificial Sequence
  Description of Artificial Sequence: Synthetic oligonucleotide
cggtggacaccgcggctcagatca

SEQ ID NO: 39838 - DNA, 24 bp, Artificial Sequence
  Description of Artificial Sequence: Synthetic oligonucleotide
ggtggacaccgcggctcagatcac

SEQ ID NO: 39839 - DNA, 24 bp, Artificial Sequence
  Description of Artificial Sequence: Synthetic oligonucleotide
gtggacaccgcggctcagatcacc

SEQ ID NO: 39840 - DNA, 25 bp, Artificial Sequence
  Description of Artificial Sequence: Synthetic oligonucleotide
tggacaccgcggctcagatcaccca

SEQ ID NO: 39841 - DNA, 22 bp, Artificial Sequence
  Description of Artificial Sequence: Synthetic oligonucleotide
ccgcggggagccccacttcatc

SEQ ID NO: 39842 - DNA, 22 bp, Artificial Sequence
  Description of Artificial Sequence: Synthetic oligonucleotide
cgcggggagccccacttcatcg

SEQ ID NO: 39843 - DNA, 23 bp, Artificial Sequence
  Description of Artificial Sequence: Synthetic oligonucleotide
gcggggagccccacttcatcgca

SEQ ID NO: 39844 - DNA, 24 bp, Artificial Sequence
  Description of Artificial Sequence: Synthetic oligonucleotide
cggggagccccacttcatcgcagt

SEQ ID NO: 39845 - DNA, 24 bp, Artificial Sequence
  Description of Artificial Sequence: Synthetic oligonucleotide
ggggagccccacttcatcgcagtg

SEQ ID NO: 39846 - DNA, 24 bp, Artificial Sequence
  Description of Artificial Sequence: Synthetic oligonucleotide
gggagccccacttcatcgcagtgg

SEQ ID NO: 39847 - DNA, 24 bp, Artificial Sequence
  Description of Artificial Sequence: Synthetic oligonucleotide
ggagccccacttcatcgcagtggg

SEQ ID NO: 39848 - DNA, 26 bp, Artificial Sequence
  Description of Artificial Sequence: Synthetic oligonucleotide
gagccccacttcatcgcagtgggcta

SEQ ID NO: 39849 - DNA, 26 bp, Artificial Sequence
  Description of Artificial Sequence: Synthetic oligonucleotide
agccccacttcatcgcagtgggctac

SEQ ID NO: 39850 - DNA, 25 bp, Artificial Sequence
  Description of Artificial Sequence: Synthetic oligonucleotide
gccccacttcatcgcagtgggctac

SEQ ID NO: 39851 - DNA, 26 bp, Artificial Sequence
  Description of Artificial Sequence: Synthetic oligonucleotide
ccccacttcatcgcagtgggctacgt

SEQ ID NO: 39852 - DNA, 26 bp, Artificial Sequence
  Description of Artificial Sequence: Synthetic oligonucleotide
cccacttcatcgcagtgggctacgtg

SEQ ID NO: 39853 - DNA, 27 bp, Artificial Sequence
  Description of Artificial Sequence: Synthetic oligonucleotide
ccacttcatcgcagtgggctacgtgga

SEQ ID NO: 39854 - DNA, 27 bp, Artificial Sequence
  Description of Artificial Sequence: Synthetic oligonucleotide
cacttcatcgcagtgggctacgtggac

SEQ ID NO: 39855 - DNA, 27 bp, Artificial Sequence
  Description of Artificial Sequence: Synthetic oligonucleotide
acttcatcgcagtgggctacgtggacg

SEQ ID NO: 39856 - DNA, 27 bp, Artificial Sequence
  Description of Artificial Sequence: Synthetic oligonucleotide
tgaggcggagcagctgagagcctacat

SEQ ID NO: 39857 - DNA, 26 bp, Artificial Sequence
  Description of Artificial Sequence: Synthetic oligonucleotide
gaggcggagcagctgagagcctacat

SEQ ID NO: 39858 - DNA, 26 bp, Artificial Sequence
  Description of Artificial Sequence: Synthetic oligonucleotide
aggcggagcagctgagagcctacatg

SEQ ID NO: 39859 - DNA, 25 bp, Artificial Sequence
  Description of Artificial Sequence: Synthetic oligonucleotide
ggcggagcagctgagagcctacatg

SEQ ID NO: 39860 - DNA, 26 bp, Artificial Sequence
  Description of Artificial Sequence: Synthetic oligonucleotide
gcggagcagctgagagcctacatgga

SEQ ID NO: 39861 - DNA, 26 bp, Artificial Sequence
  Description of Artificial Sequence: Synthetic oligonucleotide
cggagcagctgagagcctacatggag

SEQ ID NO: 39862 - DNA, 26 bp, Artificial Sequence
  Description of Artificial Sequence: Synthetic oligonucleotide
ggagcagctgagagcctacatggagg

SEQ ID NO: 39863 - DNA, 26 bp, Artificial Sequence
  Description of Artificial Sequence: Synthetic oligonucleotide
gagcagctgagagcctacatggaggg

SEQ ID NO: 39864 - DNA, 27 bp, Artificial Sequence
  Description of Artificial Sequence: Synthetic oligonucleotide
agcagctgagagcctacatggagggca

SEQ ID NO: 39865 - DNA, 26 bp, Artificial Sequence
  Description of Artificial Sequence: Synthetic oligonucleotide
gcagctgagagcctacatggagggca

SEQ ID NO: 39866 - DNA, 26 bp, Artificial Sequence
  Description of Artificial Sequence: Synthetic oligonucleotide
cagctgagagcctacatggagggcac

SEQ ID NO: 39867 - DNA, 27 bp, Artificial Sequence
  Description of Artificial Sequence: Synthetic oligonucleotide
agctgagagcctacatggagggcacgt

SEQ ID NO: 39868 - DNA, 26 bp, Artificial Sequence
  Description of Artificial Sequence: Synthetic oligonucleotide
gctgagagcctacatggagggcacgt

SEQ ID NO: 39869 - DNA, 26 bp, Artificial Sequence
  Description of Artificial Sequence: Synthetic oligonucleotide
ctgagagcctacatggagggcacgtg

SEQ ID NO: 39870 - DNA, 26 bp, Artificial Sequence
  Description of Artificial Sequence: Synthetic oligonucleotide
tgagagcctacatggagggcacgtgc

SEQ ID NO: 39871 - DNA, 25 bp, Artificial Sequence
  Description of Artificial Sequence: Synthetic oligonucleotide
gagagcctacatggagggcacgtgc

SEQ ID NO: 39872 - DNA, 26 bp, Artificial Sequence
  Description of Artificial Sequence: Synthetic oligonucleotide
agagcctacatggagggcacgtgcgt

SEQ ID NO: 39873 - DNA, 25 bp, Artificial Sequence
  Description of Artificial Sequence: Synthetic oligonucleotide
gagcctacatggagggcacgtgcgt

SEQ ID NO: 39874 - DNA, 25 bp, Artificial Sequence
  Description of Artificial Sequence: Synthetic oligonucleotide
agcctacatggagggcacgtgcgtg

SEQ ID NO: 39875 - DNA, 24 bp, Artificial Sequence
  Description of Artificial Sequence: Synthetic oligonucleotide
gcctacatggagggcacgtgcgtg

SEQ ID NO: 39876 - DNA, 25 bp, Artificial Sequence
  Description of Artificial Sequence: Synthetic oligonucleotide
cctacatggagggcacgtgcgtgga

SEQ ID NO: 39877 - DNA, 26 bp, Artificial Sequence
  Description of Artificial Sequence: Synthetic oligonucleotide
ctacatggagggcacgtgcgtggagt

SEQ ID NO: 39878 - DNA, 26 bp, Artificial Sequence
  Description of Artificial Sequence: Synthetic oligonucleotide
tacatggagggcacgtgcgtggagtg

SEQ ID NO: 39879 - DNA, 25 bp, Artificial Sequence
  Description of Artificial Sequence: Synthetic oligonucleotide
acatggagggcacgtgcgtggagtg

SEQ ID NO: 39880 - DNA, 24 bp, Artificial Sequence
  Description of Artificial Sequence: Synthetic oligonucleotide
catggagggcacgtgcgtggagtg

SEQ ID NO: 39881 - DNA, 24 bp, Artificial Sequence
  Description of Artificial Sequence: Synthetic oligonucleotide
atggagggcacgtgcgtggagtgg

SEQ ID NO: 39882 - DNA, 26 bp, Artificial Sequence
  Description of Artificial Sequence: Synthetic oligonucleotide
gggaccgggagacacagatctccaag

SEQ ID NO: 39883 - DNA, 26 bp, Artificial Sequence
  Description of Artificial Sequence: Synthetic oligonucleotide
ggaccgggagacacagatctccaagg

SEQ ID NO: 39884 - DNA, 26 bp, Artificial Sequence
  Description of Artificial Sequence: Synthetic oligonucleotide
gaccgggagacacagatctccaaggc

SEQ ID NO: 39885 - DNA, 26 bp, Artificial Sequence
  Description of Artificial Sequence: Synthetic oligonucleotide
accgggagacacagatctccaaggcc

SEQ ID NO: 39886 - DNA, 25 bp, Artificial Sequence
  Description of Artificial Sequence: Synthetic oligonucleotide
ccgggagacacagatctccaaggcc

SEQ ID NO: 39887 - DNA, 26 bp, Artificial Sequence
  Description of Artificial Sequence: Synthetic oligonucleotide
cgggagacacagatctccaaggccca

SEQ ID NO: 39888 - DNA, 26 bp, Artificial Sequence
  Description of Artificial Sequence: Synthetic oligonucleotide
gggagacacagatctccaaggcccag

SEQ ID NO: 39889 - DNA, 26 bp, Artificial Sequence
  Description of Artificial Sequence: Synthetic oligonucleotide
ggagacacagatctccaaggcccagg

SEQ ID NO: 39890 - DNA, 27 bp, Artificial Sequence
  Description of Artificial Sequence: Synthetic oligonucleotide
gagacacagatctccaaggcccaggca

SEQ ID NO: 39891 - DNA, 27 bp, Artificial Sequence
  Description of Artificial Sequence: Synthetic oligonucleotide
agacacagatctccaaggcccaggcac

SEQ ID NO: 39892 - DNA, 27 bp, Artificial Sequence
  Description of Artificial Sequence: Synthetic oligonucleotide
gacacagatctccaaggcccaggcaca

SEQ ID NO: 39893 - DNA, 27 bp, Artificial Sequence
  Description of Artificial Sequence: Synthetic oligonucleotide
acacagatctccaaggcccaggcacag

SEQ ID NO: 39894 - DNA, 27 bp, Artificial Sequence
  Description of Artificial Sequence: Synthetic oligonucleotide
cacagatctccaaggcccaggcacaga

SEQ ID NO: 39895 - DNA, 27 bp, Artificial Sequence
  Description of Artificial Sequence: Synthetic oligonucleotide
acagatctccaaggcccaggcacagac

SEQ ID NO: 39896 - DNA, 27 bp, Artificial Sequence
  Description of Artificial Sequence: Synthetic oligonucleotide
cagatctccaaggcccaggcacagact

SEQ ID NO: 39897 - DNA, 27 bp, Artificial Sequence
  Description of Artificial Sequence: Synthetic oligonucleotide
agatctccaaggcccaggcacagactg

SEQ ID NO: 39898 - DNA, 27 bp, Artificial Sequence
  Description of Artificial Sequence: Synthetic oligonucleotide
gatctccaaggcccaggcacagactga

SEQ ID NO: 39899 - DNA, 27 bp, Artificial Sequence
  Description of Artificial Sequence: Synthetic oligonucleotide
atctccaaggcccaggcacagactgac

SEQ ID NO: 39900 - DNA, 26 bp, Artificial Sequence
  Description of Artificial Sequence: Synthetic oligonucleotide
tctccaaggcccaggcacagactgac

SEQ ID NO: 39901 - DNA, 25 bp, Artificial Sequence
  Description of Artificial Sequence: Synthetic oligonucleotide
ctccaaggcccaggcacagactgac

SEQ ID NO: 39902 - DNA, 25 bp, Artificial Sequence
  Description of Artificial Sequence: Synthetic oligonucleotide
tccaaggcccaggcacagactgacc

SEQ ID NO: 39903 - DNA, 24 bp, Artificial Sequence
  Description of Artificial Sequence: Synthetic oligonucleotide
ccaaggcccaggcacagactgacc

SEQ ID NO: 39904 - DNA, 22 bp, Artificial Sequence
  Description of Artificial Sequence: Synthetic oligonucleotide
cggggagccccgcttcatggca

SEQ ID NO: 39905 - DNA, 23 bp, Artificial Sequence
  Description of Artificial Sequence: Synthetic oligonucleotide
ggggagccccgcttcatggcagt

SEQ ID NO: 39906 - DNA, 23 bp, Artificial Sequence
  Description of Artificial Sequence: Synthetic oligonucleotide
gggagccccgcttcatggcagtg

SEQ ID NO: 39907 - DNA, 23 bp, Artificial Sequence
  Description of Artificial Sequence: Synthetic oligonucleotide
ggagccccgcttcatggcagtgg

SEQ ID NO: 39908 - DNA, 23 bp, Artificial Sequence
  Description of Artificial Sequence: Synthetic oligonucleotide
gagccccgcttcatggcagtggg

SEQ ID NO: 39909 - DNA, 25 bp, Artificial Sequence
  Description of Artificial Sequence: Synthetic oligonucleotide
agccccgcttcatggcagtgggcta

SEQ ID NO: 39910 - DNA, 24 bp, Artificial Sequence
  Description of Artificial Sequence: Synthetic oligonucleotide
gccccgcttcatggcagtgggcta

SEQ ID NO: 39911 - DNA, 24 bp, Artificial Sequence
  Description of Artificial Sequence: Synthetic oligonucleotide
ccccgcttcatggcagtgggctac

SEQ ID NO: 39912 - DNA, 25 bp, Artificial Sequence
  Description of Artificial Sequence: Synthetic oligonucleotide
cccgcttcatggcagtgggctacgt

SEQ ID NO: 39913 - DNA, 25 bp, Artificial Sequence
  Description of Artificial Sequence: Synthetic oligonucleotide
ccgcttcatggcagtgggctacgtg

SEQ ID NO: 39914 - DNA, 26 bp, Artificial Sequence
  Description of Artificial Sequence: Synthetic oligonucleotide
cgcttcatggcagtgggctacgtgga

SEQ ID NO: 39915 - DNA, 26 bp, Artificial Sequence
  Description of Artificial Sequence: Synthetic oligonucleotide
gcttcatggcagtgggctacgtggac

SEQ ID NO: 39916 - DNA, 27 bp, Artificial Sequence
  Description of Artificial Sequence: Synthetic oligonucleotide
cttcatggcagtgggctacgtggacga

SEQ ID NO: 39917 - DNA, 27 bp, Artificial Sequence
  Description of Artificial Sequence: Synthetic oligonucleotide
ttcatggcagtgggctacgtggacgac

SEQ ID NO: 39918 - DNA, 27 bp, Artificial Sequence
  Description of Artificial Sequence: Synthetic oligonucleotide
tcatggcagtgggctacgtggacgaca

SEQ ID NO: 39919 - DNA, 26 bp, Artificial Sequence
  Description of Artificial Sequence: Synthetic oligonucleotide
catggcagtgggctacgtggacgaca

SEQ ID NO: 39920 - DNA, 26 bp, Artificial Sequence
  Description of Artificial Sequence: Synthetic oligonucleotide
atggcagtgggctacgtggacgacac

SEQ ID NO: 39921 - DNA, 25 bp, Artificial Sequence
  Description of Artificial Sequence: Synthetic oligonucleotide
tggcagtgggctacgtggacgacac

SEQ ID NO: 39922 - DNA, 24 bp, Artificial Sequence
  Description of Artificial Sequence: Synthetic oligonucleotide
ggcagtgggctacgtggacgacac

SEQ ID NO: 39923 - DNA, 26 bp, Artificial Sequence
  Description of Artificial Sequence: Synthetic oligonucleotide
tcctccgcgggcataaccagttagcc

SEQ ID NO: 39924 - DNA, 25 bp, Artificial Sequence
  Description of Artificial Sequence: Synthetic oligonucleotide
cctccgcgggcataaccagttagcc

SEQ ID NO: 39925 - DNA, 26 bp, Artificial Sequence
  Description of Artificial Sequence: Synthetic oligonucleotide
ctccgcgggcataaccagttagccca

SEQ ID NO: 39926 - DNA, 26 bp, Artificial Sequence
  Description of Artificial Sequence: Synthetic oligonucleotide
tccgcgggcataaccagttagcccac

SEQ ID NO: 39927 - DNA, 25 bp, Artificial Sequence
  Description of Artificial Sequence: Synthetic oligonucleotide
ccgcgggcataaccagttagcccac

SEQ ID NO: 39928 - DNA, 26 bp, Artificial Sequence
  Description of Artificial Sequence: Synthetic oligonucleotide
cgcgggcataaccagttagcccacga

SEQ ID NO: 39929 - DNA, 26 bp, Artificial Sequence
  Description of Artificial Sequence: Synthetic oligonucleotide
gcgggcataaccagttagcccacgac

SEQ ID NO: 39930 - DNA, 26 bp, Artificial Sequence
  Description of Artificial Sequence: Synthetic oligonucleotide
cgggcataaccagttagcccacgacg

SEQ ID NO: 39931 - DNA, 26 bp, Artificial Sequence
  Description of Artificial Sequence: Synthetic oligonucleotide
gggcataaccagttagcccacgacgg

SEQ ID NO: 39932 - DNA, 27 bp, Artificial Sequence
  Description of Artificial Sequence: Synthetic oligonucleotide
ggcataaccagttagcccacgacggca

SEQ ID NO: 39933 - DNA, 28 bp, Artificial Sequence
  Description of Artificial Sequence: Synthetic oligonucleotide
gcataaccagttagcccacgacggcaag

SEQ ID NO: 39934 - DNA, 28 bp, Artificial Sequence
  Description of Artificial Sequence: Synthetic oligonucleotide
cataaccagttagcccacgacggcaagg

SEQ ID NO: 39935 - DNA, 32 bp, Artificial Sequence
  Description of Artificial Sequence: Synthetic oligonucleotide
ataaccagttagcccacgacggcaaggattac

SEQ ID NO: 39936 - DNA, 31 bp, Artificial Sequence
  Description of Artificial Sequence: Synthetic oligonucleotide
taaccagttagcccacgacggcaaggattac

SEQ ID NO: 39937 - DNA, 30 bp, Artificial Sequence
  Description of Artificial Sequence: Synthetic oligonucleotide
aaccagttagcccacgacggcaaggattac

SEQ ID NO: 39938 - DNA, 29 bp, Artificial Sequence
  Description of Artificial Sequence: Synthetic oligonucleotide
accagttagcccacgacggcaaggattac

SEQ ID NO: 39939 - DNA, 28 bp, Artificial Sequence
  Description of Artificial Sequence: Synthetic oligonucleotide
ccagttagcccacgacggcaaggattac

SEQ ID NO: 39940 - DNA, 30 bp, Artificial Sequence
  Description of Artificial Sequence: Synthetic oligonucleotide
cagttagcccacgacggcaaggattacatc

SEQ ID NO: 39941 - DNA, 30 bp, Artificial Sequence
  Description of Artificial Sequence: Synthetic oligonucleotide
agttagcccacgacggcaaggattacatcg

SEQ ID NO: 39942 - DNA, 29 bp, Artificial Sequence
  Description of Artificial Sequence: Synthetic oligonucleotide
gttagcccacgacggcaaggattacatcg

SEQ ID NO: 39943 - DNA, 29 bp, Artificial Sequence
  Description of Artificial Sequence: Synthetic oligonucleotide
ttagcccacgacggcaaggattacatcgc

SEQ ID NO: 39944 - DNA, 28 bp, Artificial Sequence
  Description of Artificial Sequence: Synthetic oligonucleotide
tagcccacgacggcaaggattacatcgc

SEQ ID NO: 39945 - DNA, 27 bp, Artificial Sequence
  Description of Artificial Sequence: Synthetic oligonucleotide
agcccacgacggcaaggattacatcgc

SEQ ID NO: 39946 - DNA, 26 bp, Artificial Sequence
  Description of Artificial Sequence: Synthetic oligonucleotide
gcccacgacggcaaggattacatcgc

SEQ ID NO: 39947 - DNA, 26 bp, Artificial Sequence
  Description of Artificial Sequence: Synthetic oligonucleotide
cccacgacggcaaggattacatcgcc

SEQ ID NO: 39948 - DNA, 27 bp, Artificial Sequence
  Description of Artificial Sequence: Synthetic oligonucleotide
ccacgacggcaaggattacatcgccct

SEQ ID NO: 39949 - DNA, 27 bp, Artificial Sequence
  Description of Artificial Sequence: Synthetic oligonucleotide
cacgacggcaaggattacatcgccctg

SEQ ID NO: 39950 - DNA, 28 bp, Artificial Sequence
  Description of Artificial Sequence: Synthetic oligonucleotide
cgggcataaccagttagcctacgacgac

SEQ ID NO: 39951 - DNA, 30 bp, Artificial Sequence
  Description of Artificial Sequence: Synthetic oligonucleotide
gggcataaccagttagcctacgacgacaag

SEQ ID NO: 39952 - DNA, 30 bp, Artificial Sequence
  Description of Artificial Sequence: Synthetic oligonucleotide
ggcataaccagttagcctacgacgacaagg

SEQ ID NO: 39953 - DNA, 34 bp, Artificial Sequence
  Description of Artificial Sequence: Synthetic oligonucleotide
gcataaccagttagcctacgacgacaaggattac

SEQ ID NO: 39954 - DNA, 36 bp, Artificial Sequence
  Description of Artificial Sequence: Synthetic oligonucleotide
cataaccagttagcctacgacgacaaggattacatc

SEQ ID NO: 39955 - DNA, 36 bp, Artificial Sequence
  Description of Artificial Sequence: Synthetic oligonucleotide
ataaccagttagcctacgacgacaaggattacatcg

SEQ ID NO: 39956 - DNA, 35 bp, Artificial Sequence
  Description of Artificial Sequence: Synthetic oligonucleotide
taaccagttagcctacgacgacaaggattacatcg

SEQ ID NO: 39957 - DNA, 34 bp, Artificial Sequence
  Description of Artificial Sequence: Synthetic oligonucleotide
aaccagttagcctacgacgacaaggattacatcg

SEQ ID NO: 39958 - DNA, 33 bp, Artificial Sequence
  Description of Artificial Sequence: Synthetic oligonucleotide
accagttagcctacgacgacaaggattacatcg

SEQ ID NO: 39959 - DNA, 32 bp, Artificial Sequence
  Description of Artificial Sequence: Synthetic oligonucleotide
ccagttagcctacgacgacaaggattacatcg

SEQ ID NO: 39960 - DNA, 32 bp, Artificial Sequence
  Description of Artificial Sequence: Synthetic oligonucleotide
cagttagcctacgacgacaaggattacatcgc

SEQ ID NO: 39961 - DNA, 32 bp, Artificial Sequence
  Description of Artificial Sequence: Synthetic oligonucleotide
agttagcctacgacgacaaggattacatcgcc

SEQ ID NO: 39962 - DNA, 31 bp, Artificial Sequence
  Description of Artificial Sequence: Synthetic oligonucleotide
gttagcctacgacgacaaggattacatcgcc

SEQ ID NO: 39963 - DNA, 31 bp, Artificial Sequence
  Description of Artificial Sequence: Synthetic oligonucleotide
ttagcctacgacgacaaggattacatcgccc

SEQ ID NO: 39964 - DNA, 30 bp, Artificial Sequence
  Description of Artificial Sequence: Synthetic oligonucleotide
tagcctacgacgacaaggattacatcgccc

SEQ ID NO: 39965 - DNA, 29 bp, Artificial Sequence
  Description of Artificial Sequence: Synthetic oligonucleotide
agcctacgacgacaaggattacatcgccc

SEQ ID NO: 39966 - DNA, 22 bp, Artificial Sequence
  Description of Artificial Sequence: Synthetic oligonucleotide
tcctggaccgcggcggacacca

SEQ ID NO: 39967 - DNA, 21 bp, Artificial Sequence
  Description of Artificial Sequence: Synthetic oligonucleotide
cctggaccgcggcggacacca

SEQ ID NO: 39968 - DNA, 21 bp, Artificial Sequence
  Description of Artificial Sequence: Synthetic oligonucleotide
ctggaccgcggcggacaccac

SEQ ID NO: 39969 - DNA, 21 bp, Artificial Sequence
  Description of Artificial Sequence: Synthetic oligonucleotide
tggaccgcggcggacaccacg

SEQ ID NO: 39970 - DNA, 20 bp, Artificial Sequence
  Description of Artificial Sequence: Synthetic oligonucleotide
ggaccgcggcggacaccacg

SEQ ID NO: 39971 - DNA, 20 bp, Artificial Sequence
  Description of Artificial Sequence: Synthetic oligonucleotide
gaccgcggcggacaccacgg

SEQ ID NO: 39972 - DNA, 21 bp, Artificial Sequence
  Description of Artificial Sequence: Synthetic oligonucleotide
accgcggcggacaccacggct

SEQ ID NO: 39973 - DNA, 20 bp, Artificial Sequence
  Description of Artificial Sequence: Synthetic oligonucleotide
ccgcggcggacaccacggct

SEQ ID NO: 39974 - DNA, 21 bp, Artificial Sequence
  Description of Artificial Sequence: Synthetic oligonucleotide
cgcggcggacaccacggctca

SEQ ID NO: 39975 - DNA, 23 bp, Artificial Sequence
  Description of Artificial Sequence: Synthetic oligonucleotide
gcggcggacaccacggctcagat

SEQ ID NO: 39976 - DNA, 24 bp, Artificial Sequence
  Description of Artificial Sequence: Synthetic oligonucleotide
cggcggacaccacggctcagatca

SEQ ID NO: 39977 - DNA, 24 bp, Artificial Sequence
  Description of Artificial Sequence: Synthetic oligonucleotide
ggcggacaccacggctcagatcac

SEQ ID NO: 39978 - DNA, 24 bp, Artificial Sequence
  Description of Artificial Sequence: Synthetic oligonucleotide
gcggacaccacggctcagatcacc

SEQ ID NO: 39979 - DNA, 25 bp, Artificial Sequence
  Description of Artificial Sequence: Synthetic oligonucleotide
cggacaccacggctcagatcaccca

SEQ ID NO: 39980 - DNA, 25 bp, Artificial Sequence
  Description of Artificial Sequence: Synthetic oligonucleotide
ggacaccacggctcagatcacccag

SEQ ID NO: 39981 - DNA, 25 bp, Artificial Sequence
  Description of Artificial Sequence: Synthetic oligonucleotide
gacaccacggctcagatcacccagc

SEQ ID NO: 39982 - DNA, 25 bp, Artificial Sequence
  Description of Artificial Sequence: Synthetic oligonucleotide
acaccacggctcagatcacccagcg

SEQ ID NO: 39983 - DNA, 24 bp, Artificial Sequence
  Description of Artificial Sequence: Synthetic oligonucleotide
caccacggctcagatcacccagcg

SEQ ID NO: 39984 - DNA, 26 bp, Artificial Sequence
  Description of Artificial Sequence: Synthetic oligonucleotide
accacggctcagatcacccagcgcaa

SEQ ID NO: 39985 - DNA, 25 bp, Artificial Sequence
  Description of Artificial Sequence: Synthetic oligonucleotide
ccacggctcagatcacccagcgcaa

SEQ ID NO: 39986 - DNA, 26 bp, Artificial Sequence
  Description of Artificial Sequence: Synthetic oligonucleotide
cacggctcagatcacccagcgcaagt

SEQ ID NO: 39987 - DNA, 25 bp, Artificial Sequence
  Description of Artificial Sequence: Synthetic oligonucleotide
gtgaggttcgacagcgacgccgcta

SEQ ID NO: 39988 - DNA, 26 bp, Artificial Sequence
  Description of Artificial Sequence: Synthetic oligonucleotide
tgaggttcgacagcgacgccgctagt

SEQ ID NO: 39989 - DNA, 25 bp, Artificial Sequence
  Description of Artificial Sequence: Synthetic oligonucleotide
gaggttcgacagcgacgccgctagt

SEQ ID NO: 39990 - DNA, 25 bp, Artificial Sequence
  Description of Artificial Sequence: Synthetic oligonucleotide
aggttcgacagcgacgccgctagtc

SEQ ID NO: 39991 - DNA, 24 bp, Artificial Sequence
  Description of Artificial Sequence: Synthetic oligonucleotide
ggttcgacagcgacgccgctagtc

SEQ ID NO: 39992 - DNA, 24 bp, Artificial Sequence
  Description of Artificial Sequence: Synthetic oligonucleotide
gttcgacagcgacgccgctagtcc

SEQ ID NO: 39993 - DNA, 25 bp, Artificial Sequence
  Description of Artificial Sequence: Synthetic oligonucleotide
ttcgacagcgacgccgctagtccga

SEQ ID NO: 39994 - DNA, 24 bp, Artificial Sequence
  Description of Artificial Sequence: Synthetic oligonucleotide
tcgacagcgacgccgctagtccga

SEQ ID NO: 39995 - DNA, 23 bp, Artificial Sequence
  Description of Artificial Sequence: Synthetic oligonucleotide
cgacagcgacgccgctagtccga

SEQ ID NO: 39996 - DNA, 24 bp, Artificial Sequence
  Description of Artificial Sequence: Synthetic oligonucleotide
gacagcgacgccgctagtccgaga

SEQ ID NO: 39997 - DNA, 25 bp, Artificial Sequence
  Description of Artificial Sequence: Synthetic oligonucleotide
acagcgacgccgctagtccgagaga

SEQ ID NO: 39998 - DNA, 24 bp, Artificial Sequence
  Description of Artificial Sequence: Synthetic oligonucleotide
cagcgacgccgctagtccgagaga

SEQ ID NO: 39999 - DNA, 24 bp, Artificial Sequence
  Description of Artificial Sequence: Synthetic oligonucleotide
agcgacgccgctagtccgagagag

SEQ ID NO: 40000 - DNA, 23 bp, Artificial Sequence
  Description of Artificial Sequence: Synthetic oligonucleotide
gcgacgccgctagtccgagagag

SEQ ID NO: 40001 - DNA, 24 bp, Artificial Sequence
  Description of Artificial Sequence: Synthetic oligonucleotide
cgacgccgctagtccgagagagga

SEQ ID NO: 40002 - DNA, 24 bp, Artificial Sequence
  Description of Artificial Sequence: Synthetic oligonucleotide
gacgccgctagtccgagagaggag

SEQ ID NO: 40003 - DNA, 24 bp, Artificial Sequence
  Description of Artificial Sequence: Synthetic oligonucleotide
acgccgctagtccgagagaggagc

SEQ ID NO: 40004 - DNA, 23 bp, Artificial Sequence
  Description of Artificial Sequence: Synthetic oligonucleotide
cgccgctagtccgagagaggagc

SEQ ID NO: 40005 - DNA, 23 bp, Artificial Sequence
  Description of Artificial Sequence: Synthetic oligonucleotide
gccgctagtccgagagaggagcc

SEQ ID NO: 40006 - DNA, 23 bp, Artificial Sequence
  Description of Artificial Sequence: Synthetic oligonucleotide
ccgctagtccgagagaggagccg

SEQ ID NO: 40007 - DNA, 23 bp, Artificial Sequence
  Description of Artificial Sequence: Synthetic oligonucleotide
cgctagtccgagagaggagccgc

SEQ ID NO: 40008 - DNA, 23 bp, Artificial Sequence
  Description of Artificial Sequence: Synthetic oligonucleotide
gctagtccgagagaggagccgcg

SEQ ID NO: 40009 - DNA, 23 bp, Artificial Sequence
  Description of Artificial Sequence: Synthetic oligonucleotide
ctagtccgagagaggagccgcgg

SEQ ID NO: 40010 - DNA, 23 bp, Artificial Sequence
  Description of Artificial Sequence: Synthetic oligonucleotide
tagtccgagagaggagccgcggg

SEQ ID NO: 40011 - DNA, 27 bp, Artificial Sequence
  Description of Artificial Sequence: Synthetic oligonucleotide
atcgccctgaacgaggacctgagctca

SEQ ID NO: 40012 - DNA, 27 bp, Artificial Sequence
  Description of Artificial Sequence: Synthetic oligonucleotide
tcgccctgaacgaggacctgagctcat

SEQ ID NO: 40013 - DNA, 26 bp, Artificial Sequence
  Description of Artificial Sequence: Synthetic oligonucleotide
cgccctgaacgaggacctgagctcat

SEQ ID NO: 40014 - DNA, 26 bp, Artificial Sequence
  Description of Artificial Sequence: Synthetic oligonucleotide
gccctgaacgaggacctgagctcatg

SEQ ID NO: 40015 - DNA, 27 bp, Artificial Sequence
  Description of Artificial Sequence: Synthetic oligonucleotide
ccctgaacgaggacctgagctcatgga

SEQ ID NO: 40016 - DNA, 27 bp, Artificial Sequence
  Description of Artificial Sequence: Synthetic oligonucleotide
cctgaacgaggacctgagctcatggac

SEQ ID NO: 40017 - DNA, 27 bp, Artificial Sequence
  Description of Artificial Sequence: Synthetic oligonucleotide
ctgaacgaggacctgagctcatggacc

SEQ ID NO: 40018 - DNA, 27 bp, Artificial Sequence
  Description of Artificial Sequence: Synthetic oligonucleotide
tgaacgaggacctgagctcatggaccg

SEQ ID NO: 40019 - DNA, 26 bp, Artificial Sequence
  Description of Artificial Sequence: Synthetic oligonucleotide
gaacgaggacctgagctcatggaccg

SEQ ID NO: 40020 - DNA, 26 bp, Artificial Sequence
  Description of Artificial Sequence: Synthetic oligonucleotide
aacgaggacctgagctcatggaccgc

SEQ ID NO: 40021 - DNA, 25 bp, Artificial Sequence
  Description of Artificial Sequence: Synthetic oligonucleotide
acgaggacctgagctcatggaccgc

SEQ ID NO: 40022 - DNA, 24 bp, Artificial Sequence
  Description of Artificial Sequence: Synthetic oligonucleotide
cgaggacctgagctcatggaccgc

SEQ ID NO: 40023 - DNA, 24 bp, Artificial Sequence
  Description of Artificial Sequence: Synthetic oligonucleotide
gaggacctgagctcatggaccgcg

SEQ ID NO: 40024 - DNA, 24 bp, Artificial Sequence
  Description of Artificial Sequence: Synthetic oligonucleotide
aggacctgagctcatggaccgcgg

SEQ ID NO: 40025 - DNA, 23 bp, Artificial Sequence
  Description of Artificial Sequence: Synthetic oligonucleotide
ggacctgagctcatggaccgcgg

SEQ ID NO: 40026 - DNA, 23 bp, Artificial Sequence
  Description of Artificial Sequence: Synthetic oligonucleotide
gacctgagctcatggaccgcggc

SEQ ID NO: 40027 - DNA, 23 bp, Artificial Sequence
  Description of Artificial Sequence: Synthetic oligonucleotide
acctgagctcatggaccgcggcg

SEQ ID NO: 40028 - DNA, 22 bp, Artificial Sequence
  Description of Artificial Sequence: Synthetic oligonucleotide
cctgagctcatggaccgcggcg

SEQ ID NO: 40029 - DNA, 23 bp, Artificial Sequence
  Description of Artificial Sequence: Synthetic oligonucleotide
ctgagctcatggaccgcggcgga

SEQ ID NO: 40030 - DNA, 24 bp, Artificial Sequence
  Description of Artificial Sequence: Synthetic oligonucleotide
tgagctcatggaccgcggcggaca

SEQ ID NO: 40031 - DNA, 23 bp, Artificial Sequence
  Description of Artificial Sequence: Synthetic oligonucleotide
gagctcatggaccgcggcggaca

SEQ ID NO: 40032 - DNA, 23 bp, Artificial Sequence
  Description of Artificial Sequence: Synthetic oligonucleotide
agctcatggaccgcggcggacac

SEQ ID NO: 40033 - DNA, 22 bp, Artificial Sequence
  Description of Artificial Sequence: Synthetic oligonucleotide
gctcatggaccgcggcggacac

SEQ ID NO: 40034 - DNA, 22 bp, Artificial Sequence
  Description of Artificial Sequence: Synthetic oligonucleotide
ctcatggaccgcggcggacacc

SEQ ID NO: 40035 - DNA, 22 bp, Artificial Sequence
  Description of Artificial Sequence: Synthetic oligonucleotide
tcatggaccgcggcggacaccg

SEQ ID NO: 40036 - DNA, 21 bp, Artificial Sequence
  Description of Artificial Sequence: Synthetic oligonucleotide
catggaccgcggcggacaccg

SEQ ID NO: 40037 - DNA, 21 bp, Artificial Sequence
  Description of Artificial Sequence: Synthetic oligonucleotide
atggaccgcggcggacaccgc

SEQ ID NO: 40038 - DNA, 31 bp, Artificial Sequence
  Description of Artificial Sequence: Synthetic oligonucleotide
tattgggaccgggagacacagaagtacaagg

SEQ ID NO: 40039 - DNA, 30 bp, Artificial Sequence
  Description of Artificial Sequence: Synthetic oligonucleotide
attgggaccgggagacacagaagtacaagg

SEQ ID NO: 40040 - DNA, 29 bp, Artificial Sequence
  Description of Artificial Sequence: Synthetic oligonucleotide
ttgggaccgggagacacagaagtacaagg

SEQ ID NO: 40041 - DNA, 28 bp, Artificial Sequence
  Description of Artificial Sequence: Synthetic oligonucleotide
tgggaccgggagacacagaagtacaagg

SEQ ID NO: 40042 - DNA, 27 bp, Artificial Sequence
  Description of Artificial Sequence: Synthetic oligonucleotide
gggaccgggagacacagaagtacaagg

SEQ ID NO: 40043 - DNA, 27 bp, Artificial Sequence
  Description of Artificial Sequence: Synthetic oligonucleotide
ggaccgggagacacagaagtacaaggg

SEQ ID NO: 40044 - DNA, 27 bp, Artificial Sequence
  Description of Artificial Sequence: Synthetic oligonucleotide
gaccgggagacacagaagtacaagggc

SEQ ID NO: 40045 - DNA, 27 bp, Artificial Sequence
  Description of Artificial Sequence: Synthetic oligonucleotide
accgggagacacagaagtacaagggcc

SEQ ID NO: 40046 - DNA, 27 bp, Artificial Sequence
  Description of Artificial Sequence: Synthetic oligonucleotide
ccgggagacacagaagtacaagggcca

SEQ ID NO: 40047 - DNA, 27 bp, Artificial Sequence
  Description of Artificial Sequence: Synthetic oligonucleotide
cgggagacacagaagtacaagggccag

SEQ ID NO: 40048 - DNA, 27 bp, Artificial Sequence
  Description of Artificial Sequence: Synthetic oligonucleotide
gggagacacagaagtacaagggccagg

SEQ ID NO: 40049 - DNA, 27 bp, Artificial Sequence
  Description of Artificial Sequence: Synthetic oligonucleotide
ggagacacagaagtacaagggccaggc

SEQ ID NO: 40050 - DNA, 28 bp, Artificial Sequence
  Description of Artificial Sequence: Synthetic oligonucleotide
gagacacagaagtacaagggccaggcac

SEQ ID NO: 40051 - DNA, 29 bp, Artificial Sequence
  Description of Artificial Sequence: Synthetic oligonucleotide
agacacagaagtacaagggccaggcacag

SEQ ID NO: 40052 - DNA, 28 bp, Artificial Sequence
  Description of Artificial Sequence: Synthetic oligonucleotide
gacacagaagtacaagggccaggcacag

SEQ ID NO: 40053 - DNA, 29 bp, Artificial Sequence
  Description of Artificial Sequence: Synthetic oligonucleotide
acacagaagtacaagggccaggcacagac

SEQ ID NO: 40054 - DNA, 28 bp, Artificial Sequence
  Description of Artificial Sequence: Synthetic oligonucleotide
cacagaagtacaagggccaggcacagac

SEQ ID NO: 40055 - DNA, 29 bp, Artificial Sequence
  Description of Artificial Sequence: Synthetic oligonucleotide
acagaagtacaagggccaggcacagactg

SEQ ID NO: 40056 - DNA, 28 bp, Artificial Sequence
  Description of Artificial Sequence: Synthetic oligonucleotide
cagaagtacaagggccaggcacagactg

SEQ ID NO: 40057 - DNA, 29 bp, Artificial Sequence
  Description of Artificial Sequence: Synthetic oligonucleotide
agaagtacaagggccaggcacagactgac

SEQ ID NO: 40058 - DNA, 28 bp, Artificial Sequence
  Description of Artificial Sequence: Synthetic oligonucleotide
gaagtacaagggccaggcacagactgac

SEQ ID NO: 40059 - DNA, 28 bp, Artificial Sequence
  Description of Artificial Sequence: Synthetic oligonucleotide
aagtacaagggccaggcacagactgacc

SEQ ID NO: 40060 - DNA, 27 bp, Artificial Sequence
  Description of Artificial Sequence: Synthetic oligonucleotide
agtacaagggccaggcacagactgacc

SEQ ID NO: 40061 - DNA, 26 bp, Artificial Sequence
  Description of Artificial Sequence: Synthetic oligonucleotide
gtacaagggccaggcacagactgacc

SEQ ID NO: 40062 - DNA, 27 bp, Artificial Sequence
  Description of Artificial Sequence: Synthetic oligonucleotide
tacaagggccaggcacagactgaccga

SEQ ID NO: 40063 - DNA, 26 bp, Artificial Sequence
  Description of Artificial Sequence: Synthetic oligonucleotide
acaagggccaggcacagactgaccga

SEQ ID NO: 40064 - DNA, 25 bp, Artificial Sequence
  Description of Artificial Sequence: Synthetic oligonucleotide
caagggccaggcacagactgaccga

SEQ ID NO: 40065 - DNA, 26 bp, Artificial Sequence
  Description of Artificial Sequence: Synthetic oligonucleotide
aagggccaggcacagactgaccgaga

SEQ ID NO: 40066 - DNA, 25 bp, Artificial Sequence
  Description of Artificial Sequence: Synthetic oligonucleotide
agggccaggcacagactgaccgaga

SEQ ID NO: 40067 - DNA, 24 bp, Artificial Sequence
  Description of Artificial Sequence: Synthetic oligonucleotide
gggccaggcacagactgaccgaga

SEQ ID NO: 40068 - DNA, 25 bp, Artificial Sequence
  Description of Artificial Sequence: Synthetic oligonucleotide
ggccaggcacagactgaccgagaga

SEQ ID NO: 40069 - DNA, 25 bp, Artificial Sequence
  Description of Artificial Sequence: Synthetic oligonucleotide
gccaggcacagactgaccgagagag

SEQ ID NO: 40070 - DNA, 26 bp, Artificial Sequence
  Description of Artificial Sequence: Synthetic oligonucleotide
aagcgccaggcacagactgaccgaga

SEQ ID NO: 40071 - DNA, 25 bp, Artificial Sequence
  Description of Artificial Sequence: Synthetic oligonucleotide
agcgccaggcacagactgaccgaga

SEQ ID NO: 40072 - DNA, 24 bp, Artificial Sequence
  Description of Artificial Sequence: Synthetic oligonucleotide
gcgccaggcacagactgaccgaga

SEQ ID NO: 40073 - DNA, 25 bp, Artificial Sequence
  Description of Artificial Sequence: Synthetic oligonucleotide
cgccaggcacagactgaccgagaga

SEQ ID NO: 40074 - DNA, 34 bp, Artificial Sequence
  Description of Artificial Sequence: Synthetic oligonucleotide
aacacacagatctacaaggccaacacacagactg

SEQ ID NO: 40075 - DNA, 33 bp, Artificial Sequence
  Description of Artificial Sequence: Synthetic oligonucleotide
acacacagatctacaaggccaacacacagactg

SEQ ID NO: 40076 - DNA, 32 bp, Artificial Sequence
  Description of Artificial Sequence: Synthetic oligonucleotide
cacacagatctacaaggccaacacacagactg

SEQ ID NO: 40077 - DNA, 33 bp, Artificial Sequence
  Description of Artificial Sequence: Synthetic oligonucleotide
acacagatctacaaggccaacacacagactgac

SEQ ID NO: 40078 - DNA, 32 bp, Artificial Sequence
  Description of Artificial Sequence: Synthetic oligonucleotide
cacagatctacaaggccaacacacagactgac

SEQ ID NO: 40079 - DNA, 32 bp, Artificial Sequence
  Description of Artificial Sequence: Synthetic oligonucleotide
acagatctacaaggccaacacacagactgacc

SEQ ID NO: 40080 - DNA, 31 bp, Artificial Sequence
  Description of Artificial Sequence: Synthetic oligonucleotide
cagatctacaaggccaacacacagactgacc

SEQ ID NO: 40081 - DNA, 31 bp, Artificial Sequence
  Description of Artificial Sequence: Synthetic oligonucleotide
agatctacaaggccaacacacagactgaccg

SEQ ID NO: 40082 - DNA, 30 bp, Artificial Sequence
  Description of Artificial Sequence: Synthetic oligonucleotide
gatctacaaggccaacacacagactgaccg

SEQ ID NO: 40083 - DNA, 31 bp, Artificial Sequence
  Description of Artificial Sequence: Synthetic oligonucleotide
atctacaaggccaacacacagactgaccgag

SEQ ID NO: 40084 - DNA, 30 bp, Artificial Sequence
  Description of Artificial Sequence: Synthetic oligonucleotide
tctacaaggccaacacacagactgaccgag

SEQ ID NO: 40085 - DNA, 29 bp, Artificial Sequence
  Description of Artificial Sequence: Synthetic oligonucleotide
ctacaaggccaacacacagactgaccgag

SEQ ID NO: 40086 - DNA, 30 bp, Artificial Sequence
  Description of Artificial Sequence: Synthetic oligonucleotide
tacaaggccaacacacagactgaccgagag

SEQ ID NO: 40087 - DNA, 29 bp, Artificial Sequence
  Description of Artificial Sequence: Synthetic oligonucleotide
acaaggccaacacacagactgaccgagag

SEQ ID NO: 40088 - DNA, 28 bp, Artificial Sequence
  Description of Artificial Sequence: Synthetic oligonucleotide
caaggccaacacacagactgaccgagag

SEQ ID NO: 40089 - DNA, 29 bp, Artificial Sequence
  Description of Artificial Sequence: Synthetic oligonucleotide
aaggccaacacacagactgaccgagagag

SEQ ID NO: 40090 - DNA, 28 bp, Artificial Sequence
  Description of Artificial Sequence: Synthetic oligonucleotide
aggccaacacacagactgaccgagagag

SEQ ID NO: 40091 - DNA, 27 bp, Artificial Sequence
  Description of Artificial Sequence: Synthetic oligonucleotide
ggccaacacacagactgaccgagagag

SEQ ID NO: 40092 - DNA, 27 bp, Artificial Sequence
  Description of Artificial Sequence: Synthetic oligonucleotide
gccaacacacagactgaccgagagagc

SEQ ID NO: 40093 - DNA, 26 bp, Artificial Sequence
  Description of Artificial Sequence: Synthetic oligonucleotide
tgagagcctacctggagggcctgtga

SEQ ID NO: 40094 - DNA, 25 bp, Artificial Sequence
  Description of Artificial Sequence: Synthetic oligonucleotide
gtgctgggccctgggcttctacctt

SEQ ID NO: 40095 - DNA, 25 bp, Artificial Sequence
  Description of Artificial Sequence: Synthetic oligonucleotide
tgctgggccctgggcttctaccttg

SEQ ID NO: 40096 - DNA, 24 bp, Artificial Sequence
  Description of Artificial Sequence: Synthetic oligonucleotide
gctgggccctgggcttctaccttg

SEQ ID NO: 40097 - DNA, 24 bp, Artificial Sequence
  Description of Artificial Sequence: Synthetic oligonucleotide
ctgggccctgggcttctaccttgc

SEQ ID NO: 40098 - DNA, 24 bp, Artificial Sequence
  Description of Artificial Sequence: Synthetic oligonucleotide
tgggccctgggcttctaccttgcg

SEQ ID NO: 40099 - DNA, 23 bp, Artificial Sequence
  Description of Artificial Sequence: Synthetic oligonucleotide
gggccctgggcttctaccttgcg

SEQ ID NO: 40100 - DNA, 24 bp, Artificial Sequence
  Description of Artificial Sequence: Synthetic oligonucleotide
ggccctgggcttctaccttgcgga

SEQ ID NO: 40101 - DNA, 26 bp, Artificial Sequence
  Description of Artificial Sequence: Synthetic oligonucleotide
gccctgggcttctaccttgcggagat

SEQ ID NO: 40102 - DNA, 27 bp, Artificial Sequence
  Description of Artificial Sequence: Synthetic oligonucleotide
ccctgggcttctaccttgcggagatca

SEQ ID NO: 40103 - DNA, 27 bp, Artificial Sequence
  Description of Artificial Sequence: Synthetic oligonucleotide
cctgggcttctaccttgcggagatcac

SEQ ID NO: 40104 - DNA, 28 bp, Artificial Sequence
  Description of Artificial Sequence: Synthetic oligonucleotide
ctgggcttctaccttgcggagatcacac

SEQ ID NO: 40105 - DNA, 29 bp, Artificial Sequence
  Description of Artificial Sequence: Synthetic oligonucleotide
tgggcttctaccttgcggagatcacactg

SEQ ID NO: 40106 - DNA, 28 bp, Artificial Sequence
  Description of Artificial Sequence: Synthetic oligonucleotide
gggcttctaccttgcggagatcacactg

SEQ ID NO: 40107 - DNA, 29 bp, Artificial Sequence
  Description of Artificial Sequence: Synthetic oligonucleotide
ggcttctaccttgcggagatcacactgac

SEQ ID NO: 40108 - DNA, 29 bp, Artificial Sequence
  Description of Artificial Sequence: Synthetic oligonucleotide
gcttctaccttgcggagatcacactgacc

SEQ ID NO: 40109 - DNA, 30 bp, Artificial Sequence
  Description of Artificial Sequence: Synthetic oligonucleotide
cttctaccttgcggagatcacactgacctg

SEQ ID NO: 40110 - DNA, 30 bp, Artificial Sequence
  Description of Artificial Sequence: Synthetic oligonucleotide
ttctaccttgcggagatcacactgacctgg

SEQ ID NO: 40111 - DNA, 29 bp, Artificial Sequence
  Description of Artificial Sequence: Synthetic oligonucleotide
tctaccttgcggagatcacactgacctgg

SEQ ID NO: 40112 - DNA, 28 bp, Artificial Sequence
  Description of Artificial Sequence: Synthetic oligonucleotide
ctaccttgcggagatcacactgacctgg

SEQ ID NO: 40113 - DNA, 28 bp, Artificial Sequence
  Description of Artificial Sequence: Synthetic oligonucleotide
taccttgcggagatcacactgacctggc

SEQ ID NO: 40114 - DNA, 27 bp, Artificial Sequence
  Description of Artificial Sequence: Synthetic oligonucleotide
accttgcggagatcacactgacctggc

SEQ ID NO: 40115 - DNA, 27 bp, Artificial Sequence
  Description of Artificial Sequence: Synthetic oligonucleotide
ccttgcggagatcacactgacctggca

SEQ ID NO: 40116 - DNA, 27 bp, Artificial Sequence
  Description of Artificial Sequence: Synthetic oligonucleotide
cttgcggagatcacactgacctggcag

SEQ ID NO: 40117 - DNA, 27 bp, Artificial Sequence
  Description of Artificial Sequence: Synthetic oligonucleotide
ttgcggagatcacactgacctggcagc

SEQ ID NO: 40118 - DNA, 28 bp, Artificial Sequence
  Description of Artificial Sequence: Synthetic oligonucleotide
gaacctgcgcggctactacaaccagaac

SEQ ID NO: 40119 - DNA, 28 bp, Artificial Sequence
  Description of Artificial Sequence: Synthetic oligonucleotide
aacctgcgcggctactacaaccagaacg

SEQ ID NO: 40120 - DNA, 27 bp, Artificial Sequence
  Description of Artificial Sequence: Synthetic oligonucleotide
acctgcgcggctactacaaccagaacg

SEQ ID NO: 40121 - DNA, 27 bp, Artificial Sequence
  Description of Artificial Sequence: Synthetic oligonucleotide
cctgcgcggctactacaaccagaacga

SEQ ID NO: 40122 - DNA, 27 bp, Artificial Sequence
  Description of Artificial Sequence: Synthetic oligonucleotide
ctgcgcggctactacaaccagaacgag

SEQ ID NO: 40123 - DNA, 27 bp, Artificial Sequence
  Description of Artificial Sequence: Synthetic oligonucleotide
tgcgcggctactacaaccagaacgagg

SEQ ID NO: 40124 - DNA, 26 bp, Artificial Sequence
  Description of Artificial Sequence: Synthetic oligonucleotide
gcgcggctactacaaccagaacgagg

SEQ ID NO: 40125 - DNA, 26 bp, Artificial Sequence
  Description of Artificial Sequence: Synthetic oligonucleotide
cgcggctactacaaccagaacgaggc

SEQ ID NO: 40126 - DNA, 26 bp, Artificial Sequence
  Description of Artificial Sequence: Synthetic oligonucleotide
gcggctactacaaccagaacgaggcc

SEQ ID NO: 40127 - DNA, 26 bp, Artificial Sequence
  Description of Artificial Sequence: Synthetic oligonucleotide
cggctactacaaccagaacgaggccg

SEQ ID NO: 40128 - DNA, 26 bp, Artificial Sequence
  Description of Artificial Sequence: Synthetic oligonucleotide
ggctactacaaccagaacgaggccgg

SEQ ID NO: 40129 - DNA, 27 bp, Artificial Sequence
  Description of Artificial Sequence: Synthetic oligonucleotide
gctactacaaccagaacgaggccgggt

SEQ ID NO: 40130 - DNA, 27 bp, Artificial Sequence
  Description of Artificial Sequence: Synthetic oligonucleotide
ctactacaaccagaacgaggccgggtc

SEQ ID NO: 40131 - DNA, 28 bp, Artificial Sequence
  Description of Artificial Sequence: Synthetic oligonucleotide
tactacaaccagaacgaggccgggtctc

SEQ ID NO: 40132 - DNA, 27 bp, Artificial Sequence
  Description of Artificial Sequence: Synthetic oligonucleotide
actacaaccagaacgaggccgggtctc

SEQ ID NO: 40133 - DNA, 27 bp, Artificial Sequence
  Description of Artificial Sequence: Synthetic oligonucleotide
ctacaaccagaacgaggccgggtctca

SEQ ID NO: 40134 - DNA, 27 bp, Artificial Sequence
  Description of Artificial Sequence: Synthetic oligonucleotide
tacaaccagaacgaggccgggtctcac

SEQ ID NO: 40135 - DNA, 27 bp, Artificial Sequence
  Description of Artificial Sequence: Synthetic oligonucleotide
acaaccagaacgaggccgggtctcaca

SEQ ID NO: 40136 - DNA, 26 bp, Artificial Sequence
  Description of Artificial Sequence: Synthetic oligonucleotide
caaccagaacgaggccgggtctcaca

SEQ ID NO: 40137 - DNA, 27 bp, Artificial Sequence
  Description of Artificial Sequence: Synthetic oligonucleotide
aaccagaacgaggccgggtctcacact

SEQ ID NO: 40138 - DNA, 27 bp, Artificial Sequence
  Description of Artificial Sequence: Synthetic oligonucleotide
accagaacgaggccgggtctcacactt

SEQ ID NO: 40139 - DNA, 26 bp, Artificial Sequence
  Description of Artificial Sequence: Synthetic oligonucleotide
ccagaacgaggccgggtctcacactt

SEQ ID NO: 40140 - DNA, 26 bp, Artificial Sequence
  Description of Artificial Sequence: Synthetic oligonucleotide
cagaacgaggccgggtctcacacttg

SEQ ID NO: 40141 - DNA, 26 bp, Artificial Sequence
  Description of Artificial Sequence: Synthetic oligonucleotide
agaacgaggccgggtctcacacttgg

SEQ ID NO: 40142 - DNA, 25 bp, Artificial Sequence
  Description of Artificial Sequence: Synthetic oligonucleotide
gaacgaggccgggtctcacacttgg

SEQ ID NO: 40143 - DNA, 26 bp, Artificial Sequence
  Description of Artificial Sequence: Synthetic oligonucleotide
aacgaggccgggtctcacacttggca

SEQ ID NO: 40144 - DNA, 25 bp, Artificial Sequence
  Description of Artificial Sequence: Synthetic oligonucleotide
acgaggccgggtctcacacttggca

SEQ ID NO: 40145 - DNA, 28 bp, Artificial Sequence
  Description of Artificial Sequence: Synthetic oligonucleotide
atagagcaggaggggccggagtattgag

SEQ ID NO: 40146 - DNA, 27 bp, Artificial Sequence
  Description of Artificial Sequence: Synthetic oligonucleotide
tagagcaggaggggccggagtattgag

SEQ ID NO: 40147 - DNA, 27 bp, Artificial Sequence
  Description of Artificial Sequence: Synthetic oligonucleotide
agagcaggaggggccggagtattgaga

SEQ ID NO: 40148 - DNA, 26 bp, Artificial Sequence
  Description of Artificial Sequence: Synthetic oligonucleotide
gagcaggaggggccggagtattgaga

SEQ ID NO: 40149 - DNA, 26 bp, Artificial Sequence
  Description of Artificial Sequence: Synthetic oligonucleotide
agcaggaggggccggagtattgagac

SEQ ID NO: 40150 - DNA, 25 bp, Artificial Sequence
  Description of Artificial Sequence: Synthetic oligonucleotide
gcaggaggggccggagtattgagac

SEQ ID NO: 40151 - DNA, 25 bp, Artificial Sequence
  Description of Artificial Sequence: Synthetic oligonucleotide
caggaggggccggagtattgagacc

SEQ ID NO: 40152 - DNA, 25 bp, Artificial Sequence
  Description of Artificial Sequence: Synthetic oligonucleotide
aggaggggccggagtattgagaccg

SEQ ID NO: 40153 - DNA, 24 bp, Artificial Sequence
  Description of Artificial Sequence: Synthetic oligonucleotide
ggaggggccggagtattgagaccg

SEQ ID NO: 40154 - DNA, 26 bp, Artificial Sequence
  Description of Artificial Sequence: Synthetic oligonucleotide
gaggggccggagtattgagaccggaa

SEQ ID NO: 40155 - DNA, 27 bp, Artificial Sequence
  Description of Artificial Sequence: Synthetic oligonucleotide
aggggccggagtattgagaccggaaca

SEQ ID NO: 40156 - DNA, 26 bp, Artificial Sequence
  Description of Artificial Sequence: Synthetic oligonucleotide
ggggccggagtattgagaccggaaca

SEQ ID NO: 40157 - DNA, 27 bp, Artificial Sequence
  Description of Artificial Sequence: Synthetic oligonucleotide
gggccggagtattgagaccggaacaca

SEQ ID NO: 40158 - DNA, 27 bp, Artificial Sequence
  Description of Artificial Sequence: Synthetic oligonucleotide
ggccggagtattgagaccggaacacac

SEQ ID NO: 40159 - DNA, 28 bp, Artificial Sequence
  Description of Artificial Sequence: Synthetic oligonucleotide
gccggagtattgagaccggaacacacag

SEQ ID NO: 40160 - DNA, 30 bp, Artificial Sequence
  Description of Artificial Sequence: Synthetic oligonucleotide
ccggagtattgagaccggaacacacagatc

SEQ ID NO: 40161 - DNA, 32 bp, Artificial Sequence
  Description of Artificial Sequence: Synthetic oligonucleotide
cggagtattgagaccggaacacacagatctac

SEQ ID NO: 40162 - DNA, 34 bp, Artificial Sequence
  Description of Artificial Sequence: Synthetic oligonucleotide
ggagtattgagaccggaacacacagatctacaag

SEQ ID NO: 40163 - DNA, 34 bp, Artificial Sequence
  Description of Artificial Sequence: Synthetic oligonucleotide
gagtattgagaccggaacacacagatctacaagg

SEQ ID NO: 40164 - DNA, 34 bp, Artificial Sequence
  Description of Artificial Sequence: Synthetic oligonucleotide
agtattgagaccggaacacacagatctacaaggc

SEQ ID NO: 40165 - DNA, 33 bp, Artificial Sequence
  Description of Artificial Sequence: Synthetic oligonucleotide
gtattgagaccggaacacacagatctacaaggc

SEQ ID NO: 40166 - DNA, 33 bp, Artificial Sequence
  Description of Artificial Sequence: Synthetic oligonucleotide
tattgagaccggaacacacagatctacaaggcc

SEQ ID NO: 40167 - DNA, 32 bp, Artificial Sequence
  Description of Artificial Sequence: Synthetic oligonucleotide
attgagaccggaacacacagatctacaaggcc

SEQ ID NO: 40168 - DNA, 31 bp, Artificial Sequence
  Description of Artificial Sequence: Synthetic oligonucleotide
ttgagaccggaacacacagatctacaaggcc

SEQ ID NO: 40169 - DNA, 30 bp, Artificial Sequence
  Description of Artificial Sequence: Synthetic oligonucleotide
tgagaccggaacacacagatctacaaggcc

SEQ ID NO: 40170 - DNA, 29 bp, Artificial Sequence
  Description of Artificial Sequence: Synthetic oligonucleotide
gagaccggaacacacagatctacaaggcc

SEQ ID NO: 40171 - DNA, 29 bp, Artificial Sequence
  Description of Artificial Sequence: Synthetic oligonucleotide
agaccggaacacacagatctacaaggccc

SEQ ID NO: 40172 - DNA, 29 bp, Artificial Sequence
  Description of Artificial Sequence: Synthetic oligonucleotide
agtattgggacggggagacacggaacatg

SEQ ID NO: 40173 - DNA, 28 bp, Artificial Sequence
  Description of Artificial Sequence: Synthetic oligonucleotide
gtattgggacggggagacacggaacatg

SEQ ID NO: 40174 - DNA, 30 bp, Artificial Sequence
  Description of Artificial Sequence: Synthetic oligonucleotide
tattgggacggggagacacggaacatgaag

SEQ ID NO: 40175 - DNA, 29 bp, Artificial Sequence
  Description of Artificial Sequence: Synthetic oligonucleotide
attgggacggggagacacggaacatgaag

SEQ ID NO: 40176 - DNA, 28 bp, Artificial Sequence
  Description of Artificial Sequence: Synthetic oligonucleotide
ttgggacggggagacacggaacatgaag

SEQ ID NO: 40177 - DNA, 27 bp, Artificial Sequence
  Description of Artificial Sequence: Synthetic oligonucleotide
tgggacggggagacacggaacatgaag

SEQ ID NO: 40178 - DNA, 26 bp, Artificial Sequence
  Description of Artificial Sequence: Synthetic oligonucleotide
gggacggggagacacggaacatgaag

SEQ ID NO: 40179 - DNA, 26 bp, Artificial Sequence
  Description of Artificial Sequence: Synthetic oligonucleotide
ggacggggagacacggaacatgaagg

SEQ ID NO: 40180 - DNA, 26 bp, Artificial Sequence
  Description of Artificial Sequence: Synthetic oligonucleotide
gacggggagacacggaacatgaaggc

SEQ ID NO: 40181 - DNA, 27 bp, Artificial Sequence
  Description of Artificial Sequence: Synthetic oligonucleotide
acggggagacacggaacatgaaggcct

SEQ ID NO: 40182 - DNA, 26 bp, Artificial Sequence
  Description of Artificial Sequence: Synthetic oligonucleotide
cggggagacacggaacatgaaggcct

SEQ ID NO: 40183 - DNA, 26 bp, Artificial Sequence
  Description of Artificial Sequence: Synthetic oligonucleotide
ggggagacacggaacatgaaggcctc

SEQ ID NO: 40184 - DNA, 24 bp, Artificial Sequence
  Description of Artificial Sequence: Synthetic oligonucleotide
ctcctccgcgggcatgaccagtct

SEQ ID NO: 40185 - DNA, 24 bp, Artificial Sequence
  Description of Artificial Sequence: Synthetic oligonucleotide
tcctccgcgggcatgaccagtctg

SEQ ID NO: 40186 - DNA, 23 bp, Artificial Sequence
  Description of Artificial Sequence: Synthetic oligonucleotide
cctccgcgggcatgaccagtctg

SEQ ID NO: 40187 - DNA, 23 bp, Artificial Sequence
  Description of Artificial Sequence: Synthetic oligonucleotide
ctccgcgggcatgaccagtctgc

SEQ ID NO: 40188 - DNA, 25 bp, Artificial Sequence
  Description of Artificial Sequence: Synthetic oligonucleotide
tccgcgggcatgaccagtctgccta

SEQ ID NO: 40189 - DNA, 24 bp, Artificial Sequence
  Description of Artificial Sequence: Synthetic oligonucleotide
ccgcgggcatgaccagtctgccta

SEQ ID NO: 40190 - DNA, 24 bp, Artificial Sequence
  Description of Artificial Sequence: Synthetic oligonucleotide
cgcgggcatgaccagtctgcctac

SEQ ID NO: 40191 - DNA, 25 bp, Artificial Sequence
  Description of Artificial Sequence: Synthetic oligonucleotide
gcgggcatgaccagtctgcctacga

SEQ ID NO: 40192 - DNA, 25 bp, Artificial Sequence
  Description of Artificial Sequence: Synthetic oligonucleotide
cgggcatgaccagtctgcctacgac

SEQ ID NO: 40193 - DNA, 25 bp, Artificial Sequence
  Description of Artificial Sequence: Synthetic oligonucleotide
gggcatgaccagtctgcctacgacg

SEQ ID NO: 40194 - DNA, 25 bp, Artificial Sequence
  Description of Artificial Sequence: Synthetic oligonucleotide
ggcatgaccagtctgcctacgacgg

SEQ ID NO: 40195 - DNA, 27 bp, Artificial Sequence
  Description of Artificial Sequence: Synthetic oligonucleotide
gcatgaccagtctgcctacgacggcaa

SEQ ID NO: 40196 - DNA, 27 bp, Artificial Sequence
  Description of Artificial Sequence: Synthetic oligonucleotide
catgaccagtctgcctacgacggcaag

SEQ ID NO: 40197 - DNA, 27 bp, Artificial Sequence
  Description of Artificial Sequence: Synthetic oligonucleotide
atgaccagtctgcctacgacggcaagg

SEQ ID NO: 40198 - DNA, 27 bp, Artificial Sequence
  Description of Artificial Sequence: Synthetic oligonucleotide
tgaccagtctgcctacgacggcaagga

SEQ ID NO: 40199 - DNA, 27 bp, Artificial Sequence
  Description of Artificial Sequence: Synthetic oligonucleotide
gaccagtctgcctacgacggcaaggat

SEQ ID NO: 40200 - DNA, 29 bp, Artificial Sequence
  Description of Artificial Sequence: Synthetic oligonucleotide
accagtctgcctacgacggcaaggattac

SEQ ID NO: 40201 - DNA, 28 bp, Artificial Sequence
  Description of Artificial Sequence: Synthetic oligonucleotide
ccagtctgcctacgacggcaaggattac

SEQ ID NO: 40202 - DNA, 30 bp, Artificial Sequence
  Description of Artificial Sequence: Synthetic oligonucleotide
cagtctgcctacgacggcaaggattacatc

SEQ ID NO: 40203 - DNA, 30 bp, Artificial Sequence
  Description of Artificial Sequence: Synthetic oligonucleotide
agtctgcctacgacggcaaggattacatcg

SEQ ID NO: 40204 - DNA, 29 bp, Artificial Sequence
  Description of Artificial Sequence: Synthetic oligonucleotide
gtctgcctacgacggcaaggattacatcg

SEQ ID NO: 40205 - DNA, 29 bp, Artificial Sequence
  Description of Artificial Sequence: Synthetic oligonucleotide
tctgcctacgacggcaaggattacatcgc

SEQ ID NO: 40206 - DNA, 28 bp, Artificial Sequence
  Description of Artificial Sequence: Synthetic oligonucleotide
ctgcctacgacggcaaggattacatcgc

SEQ ID NO: 40207 - DNA, 26 bp, Artificial Sequence
  Description of Artificial Sequence: Synthetic oligonucleotide
tgagagcctacctggagggcctgtgt

SEQ ID NO: 40208 - DNA, 25 bp, Artificial Sequence
  Description of Artificial Sequence: Synthetic oligonucleotide
gagagcctacctggagggcctgtgt

SEQ ID NO: 40209 - DNA, 26 bp, Artificial Sequence
  Description of Artificial Sequence: Synthetic oligonucleotide
agagcctacctggagggcctgtgtgt

SEQ ID NO: 40210 - DNA, 25 bp, Artificial Sequence
  Description of Artificial Sequence: Synthetic oligonucleotide
gagcctacctggagggcctgtgtgt

SEQ ID NO: 40211 - DNA, 25 bp, Artificial Sequence
  Description of Artificial Sequence: Synthetic oligonucleotide
agcctacctggagggcctgtgtgtg

SEQ ID NO: 40212 - DNA, 24 bp, Artificial Sequence
  Description of Artificial Sequence: Synthetic oligonucleotide
gcctacctggagggcctgtgtgtg

SEQ ID NO: 40213 - DNA, 25 bp, Artificial Sequence
  Description of Artificial Sequence: Synthetic oligonucleotide
cctacctggagggcctgtgtgtgga

SEQ ID NO: 40214 - DNA, 26 bp, Artificial Sequence
  Description of Artificial Sequence: Synthetic oligonucleotide
ctacctggagggcctgtgtgtggagt

SEQ ID NO: 40215 - DNA, 26 bp, Artificial Sequence
  Description of Artificial Sequence: Synthetic oligonucleotide
tacctggagggcctgtgtgtggagtg

SEQ ID NO: 40216 - DNA, 25 bp, Artificial Sequence
  Description of Artificial Sequence: Synthetic oligonucleotide
acctggagggcctgtgtgtggagtg

SEQ ID NO: 40217 - DNA, 24 bp, Artificial Sequence
  Description of Artificial Sequence: Synthetic oligonucleotide
cctggagggcctgtgtgtggagtg

SEQ ID NO: 40218 - DNA, 24 bp, Artificial Sequence
  Description of Artificial Sequence: Synthetic oligonucleotide
ctggagggcctgtgtgtggagtgg

SEQ ID NO: 40219 - DNA, 25 bp, Artificial Sequence
  Description of Artificial Sequence: Synthetic oligonucleotide
tggagggcctgtgtgtggagtggct

SEQ ID NO: 40220 - DNA, 24 bp, Artificial Sequence
  Description of Artificial Sequence: Synthetic oligonucleotide
ggagggcctgtgtgtggagtggct

SEQ ID NO: 40221 - DNA, 24 bp, Artificial Sequence
  Description of Artificial Sequence: Synthetic oligonucleotide
gagggcctgtgtgtggagtggctc

SEQ ID NO: 40222 - DNA, 24 bp, Artificial Sequence
  Description of Artificial Sequence: Synthetic oligonucleotide
agggcctgtgtgtggagtggctcc

SEQ ID NO: 40223 - DNA, 23 bp, Artificial Sequence
  Description of Artificial Sequence: Synthetic oligonucleotide
gggcctgtgtgtggagtggctcc

SEQ ID NO: 40224 - DNA, 23 bp, Artificial Sequence
  Description of Artificial Sequence: Synthetic oligonucleotide
ggcctgtgtgtggagtggctccg

SEQ ID NO: 40225 - DNA, 24 bp, Artificial Sequence
  Description of Artificial Sequence: Synthetic oligonucleotide
gcctgtgtgtggagtggctccgca

SEQ ID NO: 40226 - DNA, 27 bp, Artificial Sequence
  Description of Artificial Sequence: Synthetic oligonucleotide
cctgtgtgtggagtggctccgcagata

SEQ ID NO: 40227 - DNA, 27 bp, Artificial Sequence
  Description of Artificial Sequence: Synthetic oligonucleotide
ctgtgtgtggagtggctccgcagatac

SEQ ID NO: 40228 - DNA, 27 bp, Artificial Sequence
  Description of Artificial Sequence: Synthetic oligonucleotide
tgtgtgtggagtggctccgcagatacc

SEQ ID NO: 40229 - DNA, 31 bp, Artificial Sequence
  Description of Artificial Sequence: Synthetic oligonucleotide
attacatcgccctgaacgaggacctgagttc

SEQ ID NO: 40230 - DNA, 30 bp, Artificial Sequence
  Description of Artificial Sequence: Synthetic oligonucleotide
ttacatcgccctgaacgaggacctgagttc

SEQ ID NO: 40231 - DNA, 29 bp, Artificial Sequence
  Description of Artificial Sequence: Synthetic oligonucleotide
tacatcgccctgaacgaggacctgagttc

SEQ ID NO: 40232 - DNA, 28 bp, Artificial Sequence
  Description of Artificial Sequence: Synthetic oligonucleotide
acatcgccctgaacgaggacctgagttc

SEQ ID NO: 40233 - DNA, 27 bp, Artificial Sequence
  Description of Artificial Sequence: Synthetic oligonucleotide
catcgccctgaacgaggacctgagttc

SEQ ID NO: 40234 - DNA, 27 bp, Artificial Sequence
  Description of Artificial Sequence: Synthetic oligonucleotide
atcgccctgaacgaggacctgagttcc

SEQ ID NO: 40235 - DNA, 27 bp, Artificial Sequence
  Description of Artificial Sequence: Synthetic oligonucleotide
tcgccctgaacgaggacctgagttcct

SEQ ID NO: 40236 - DNA, 26 bp, Artificial Sequence
  Description of Artificial Sequence: Synthetic oligonucleotide
cgccctgaacgaggacctgagttcct

SEQ ID NO: 40237 - DNA, 26 bp, Artificial Sequence
  Description of Artificial Sequence: Synthetic oligonucleotide
gccctgaacgaggacctgagttcctg

SEQ ID NO: 40238 - DNA, 27 bp, Artificial Sequence
  Description of Artificial Sequence: Synthetic oligonucleotide
ccctgaacgaggacctgagttcctgga

SEQ ID NO: 40239 - DNA, 27 bp, Artificial Sequence
  Description of Artificial Sequence: Synthetic oligonucleotide
cctgaacgaggacctgagttcctggac

SEQ ID NO: 40240 - DNA, 27 bp, Artificial Sequence
  Description of Artificial Sequence: Synthetic oligonucleotide
ctgaacgaggacctgagttcctggacc

SEQ ID NO: 40241 - DNA, 27 bp, Artificial Sequence
  Description of Artificial Sequence: Synthetic oligonucleotide
tgaacgaggacctgagttcctggaccg

SEQ ID NO: 40242 - DNA, 26 bp, Artificial Sequence
  Description of Artificial Sequence: Synthetic oligonucleotide
gaacgaggacctgagttcctggaccg

SEQ ID NO: 40243 - DNA, 26 bp, Artificial Sequence
  Description of Artificial Sequence: Synthetic oligonucleotide
aacgaggacctgagttcctggaccgc

SEQ ID NO: 40244 - DNA, 25 bp, Artificial Sequence
  Description of Artificial Sequence: Synthetic oligonucleotide
acgaggacctgagttcctggaccgc

SEQ ID NO: 40245 - DNA, 24 bp, Artificial Sequence
  Description of Artificial Sequence: Synthetic oligonucleotide
cgaggacctgagttcctggaccgc

SEQ ID NO: 40246 - DNA, 24 bp, Artificial Sequence
  Description of Artificial Sequence: Synthetic oligonucleotide
gaggacctgagttcctggaccgcg

SEQ ID NO: 40247 - DNA, 24 bp, Artificial Sequence
  Description of Artificial Sequence: Synthetic oligonucleotide
aggacctgagttcctggaccgcgg

SEQ ID NO: 40248 - DNA, 23 bp, Artificial Sequence
  Description of Artificial Sequence: Synthetic oligonucleotide
ggacctgagttcctggaccgcgg

SEQ ID NO: 40249 - DNA, 23 bp, Artificial Sequence
  Description of Artificial Sequence: Synthetic oligonucleotide
gacctgagttcctggaccgcggc

SEQ ID NO: 40250 - DNA, 23 bp, Artificial Sequence
  Description of Artificial Sequence: Synthetic oligonucleotide
acctgagttcctggaccgcggcg

SEQ ID NO: 40251 - DNA, 22 bp, Artificial Sequence
  Description of Artificial Sequence: Synthetic oligonucleotide
cctgagttcctggaccgcggcg

SEQ ID NO: 40252 - DNA, 23 bp, Artificial Sequence
  Description of Artificial Sequence: Synthetic oligonucleotide
ctgagttcctggaccgcggcgga

SEQ ID NO: 40253 - DNA, 24 bp, Artificial Sequence
  Description of Artificial Sequence: Synthetic oligonucleotide
tgagttcctggaccgcggcggaca

SEQ ID NO: 40254 - DNA, 23 bp, Artificial Sequence
  Description of Artificial Sequence: Synthetic oligonucleotide
gagttcctggaccgcggcggaca

SEQ ID NO: 40255 - DNA, 23 bp, Artificial Sequence
  Description of Artificial Sequence: Synthetic oligonucleotide
agttcctggaccgcggcggacac

SEQ ID NO: 40256 - DNA, 22 bp, Artificial Sequence
  Description of Artificial Sequence: Synthetic oligonucleotide
gttcctggaccgcggcggacac

SEQ ID NO: 40257 - DNA, 22 bp, Artificial Sequence
  Description of Artificial Sequence: Synthetic oligonucleotide
ttcctggaccgcggcggacacg

SEQ ID NO: 40258 - DNA, 26 bp, Artificial Sequence
  Description of Artificial Sequence: Synthetic oligonucleotide
aaaacgggaaggagacgctgcagcgc

SEQ ID NO: 40259 - DNA, 25 bp, Artificial Sequence
  Description of Artificial Sequence: Synthetic oligonucleotide
aaacgggaaggagacgctgcagcgc

SEQ ID NO: 40260 - DNA, 27 bp, Artificial Sequence
  Description of Artificial Sequence: Synthetic oligonucleotide
agagaacctgcggatcgcgctccgata

SEQ ID NO: 40261 - DNA, 26 bp, Artificial Sequence
  Description of Artificial Sequence: Synthetic oligonucleotide
gagaacctgcggatcgcgctccgata

SEQ ID NO: 40262 - DNA, 27 bp, Artificial Sequence
  Description of Artificial Sequence: Synthetic oligonucleotide
agaacctgcggatcgcgctccgatact

SEQ ID NO: 40263 - DNA, 27 bp, Artificial Sequence
  Description of Artificial Sequence: Synthetic oligonucleotide
gaacctgcggatcgcgctccgatacta

SEQ ID NO: 40264 - DNA, 27 bp, Artificial Sequence
  Description of Artificial Sequence: Synthetic oligonucleotide
aacctgcggatcgcgctccgatactac

SEQ ID NO: 40265 - DNA, 27 bp, Artificial Sequence
  Description of Artificial Sequence: Synthetic oligonucleotide
acctgcggatcgcgctccgatactaca

SEQ ID NO: 40266 - DNA, 27 bp, Artificial Sequence
  Description of Artificial Sequence: Synthetic oligonucleotide
cctgcggatcgcgctccgatactacaa

SEQ ID NO: 40267 - DNA, 27 bp, Artificial Sequence
  Description of Artificial Sequence: Synthetic oligonucleotide
ctgcggatcgcgctccgatactacaac

SEQ ID NO: 40268 - DNA, 27 bp, Artificial Sequence
  Description of Artificial Sequence: Synthetic oligonucleotide
tgcggatcgcgctccgatactacaacc

SEQ ID NO: 40269 - DNA, 27 bp, Artificial Sequence
  Description of Artificial Sequence: Synthetic oligonucleotide
gcggatcgcgctccgatactacaacca

SEQ ID NO: 40270 - DNA, 27 bp, Artificial Sequence
  Description of Artificial Sequence: Synthetic oligonucleotide
cggatcgcgctccgatactacaaccag

SEQ ID NO: 40271 - DNA, 28 bp, Artificial Sequence
  Description of Artificial Sequence: Synthetic oligonucleotide
ggatcgcgctccgatactacaaccagag

SEQ ID NO: 40272 - DNA, 28 bp, Artificial Sequence
  Description of Artificial Sequence: Synthetic oligonucleotide
gatcgcgctccgatactacaaccagagc

SEQ ID NO: 40273 - DNA, 28 bp, Artificial Sequence
  Description of Artificial Sequence: Synthetic oligonucleotide
atcgcgctccgatactacaaccagagcg

SEQ ID NO: 40274 - DNA, 27 bp, Artificial Sequence
  Description of Artificial Sequence: Synthetic oligonucleotide
tcgcgctccgatactacaaccagagcg

SEQ ID NO: 40275 - DNA, 27 bp, Artificial Sequence
  Description of Artificial Sequence: Synthetic oligonucleotide
cgcgctccgatactacaaccagagcga

SEQ ID NO: 40276 - DNA, 27 bp, Artificial Sequence
  Description of Artificial Sequence: Synthetic oligonucleotide
gcgctccgatactacaaccagagcgag

SEQ ID NO: 40277 - DNA, 27 bp, Artificial Sequence
  Description of Artificial Sequence: Synthetic oligonucleotide
cgctccgatactacaaccagagcgagg

SEQ ID NO: 40278 - DNA, 27 bp, Artificial Sequence
  Description of Artificial Sequence: Synthetic oligonucleotide
gctccgatactacaaccagagcgaggc

SEQ ID NO: 40279 - DNA, 27 bp, Artificial Sequence
  Description of Artificial Sequence: Synthetic oligonucleotide
ctccgatactacaaccagagcgaggcc

SEQ ID NO: 40280 - DNA, 27 bp, Artificial Sequence
  Description of Artificial Sequence: Synthetic oligonucleotide
tccgatactacaaccagagcgaggccg

SEQ ID NO: 40281 - DNA, 26 bp, Artificial Sequence
  Description of Artificial Sequence: Synthetic oligonucleotide
ccgatactacaaccagagcgaggccg

SEQ ID NO: 40282 - DNA, 26 bp, Artificial Sequence
  Description of Artificial Sequence: Synthetic oligonucleotide
cgatactacaaccagagcgaggccgg

SEQ ID NO: 40283 - DNA, 27 bp, Artificial Sequence
  Description of Artificial Sequence: Synthetic oligonucleotide
gatactacaaccagagcgaggccgggt

SEQ ID NO: 40284 - DNA, 27 bp, Artificial Sequence
  Description of Artificial Sequence: Synthetic oligonucleotide
atactacaaccagagcgaggccgggtc

SEQ ID NO: 40285 - DNA, 27 bp, Artificial Sequence
  Description of Artificial Sequence: Synthetic oligonucleotide
gcgctccgctactacaaccagagcgaa

SEQ ID NO: 40286 - DNA, 27 bp, Artificial Sequence
  Description of Artificial Sequence: Synthetic oligonucleotide
cgctccgctactacaaccagagcgaag

SEQ ID NO: 40287 - DNA, 27 bp, Artificial Sequence
  Description of Artificial Sequence: Synthetic oligonucleotide
gctccgctactacaaccagagcgaagc

SEQ ID NO: 40288 - DNA, 27 bp, Artificial Sequence
  Description of Artificial Sequence: Synthetic oligonucleotide
ctccgctactacaaccagagcgaagcc

SEQ ID NO: 40289 - DNA, 27 bp, Artificial Sequence
  Description of Artificial Sequence: Synthetic oligonucleotide
tccgctactacaaccagagcgaagccg

SEQ ID NO: 40290 - DNA, 26 bp, Artificial Sequence
  Description of Artificial Sequence: Synthetic oligonucleotide
ccgctactacaaccagagcgaagccg

SEQ ID NO: 40291 - DNA, 26 bp, Artificial Sequence
  Description of Artificial Sequence: Synthetic oligonucleotide
cgctactacaaccagagcgaagccgg

SEQ ID NO: 40292 - DNA, 27 bp, Artificial Sequence
  Description of Artificial Sequence: Synthetic oligonucleotide
gctactacaaccagagcgaagccgggt

SEQ ID NO: 40293 - DNA, 27 bp, Artificial Sequence
  Description of Artificial Sequence: Synthetic oligonucleotide
ctactacaaccagagcgaagccgggtc

SEQ ID NO: 40294 - DNA, 28 bp, Artificial Sequence
  Description of Artificial Sequence: Synthetic oligonucleotide
tactacaaccagagcgaagccgggtctc

SEQ ID NO: 40295 - DNA, 27 bp, Artificial Sequence
  Description of Artificial Sequence: Synthetic oligonucleotide
actacaaccagagcgaagccgggtctc

SEQ ID NO: 40296 - DNA, 27 bp, Artificial Sequence
  Description of Artificial Sequence: Synthetic oligonucleotide
ctacaaccagagcgaagccgggtctca

SEQ ID NO: 40297 - DNA, 27 bp, Artificial Sequence
  Description of Artificial Sequence: Synthetic oligonucleotide
tacaaccagagcgaagccgggtctcac

SEQ ID NO: 40298 - DNA, 27 bp, Artificial Sequence
  Description of Artificial Sequence: Synthetic oligonucleotide
acaaccagagcgaagccgggtctcaca

SEQ ID NO: 40299 - DNA, 27 bp, Artificial Sequence
  Description of Artificial Sequence: Synthetic oligonucleotide
caaccagagcgaagccgggtctcacat

SEQ ID NO: 40300 - DNA, 27 bp, Artificial Sequence
  Description of Artificial Sequence: Synthetic oligonucleotide
aaccagagcgaagccgggtctcacatc

SEQ ID NO: 40301 - DNA, 27 bp, Artificial Sequence
  Description of Artificial Sequence: Synthetic oligonucleotide
accagagcgaagccgggtctcacatca

SEQ ID NO: 40302 - DNA, 27 bp, Artificial Sequence
  Description of Artificial Sequence: Synthetic oligonucleotide
ccagagcgaagccgggtctcacatcat

SEQ ID NO: 40303 - DNA, 27 bp, Artificial Sequence
  Description of Artificial Sequence: Synthetic oligonucleotide
cagagcgaagccgggtctcacatcatc

SEQ ID NO: 40304 - DNA, 27 bp, Artificial Sequence
  Description of Artificial Sequence: Synthetic oligonucleotide
agagcgaagccgggtctcacatcatcc

SEQ ID NO: 40305 - DNA, 27 bp, Artificial Sequence
  Description of Artificial Sequence: Synthetic oligonucleotide
gagcgaagccgggtctcacatcatcca

SEQ ID NO: 40306 - DNA, 27 bp, Artificial Sequence
  Description of Artificial Sequence: Synthetic oligonucleotide
agcgaagccgggtctcacatcatccag

SEQ ID NO: 40307 - DNA, 26 bp, Artificial Sequence
  Description of Artificial Sequence: Synthetic oligonucleotide
gcgaagccgggtctcacatcatccag

SEQ ID NO: 40308 - DNA, 27 bp, Artificial Sequence
  Description of Artificial Sequence: Synthetic oligonucleotide
cgaagccgggtctcacatcatccaggt

SEQ ID NO: 40309 - DNA, 27 bp, Artificial Sequence
  Description of Artificial Sequence: Synthetic oligonucleotide
gaagccgggtctcacatcatccaggtg

SEQ ID NO: 40310 - DNA, 29 bp, Artificial Sequence
  Description of Artificial Sequence: Synthetic oligonucleotide
aagccgggtctcacatcatccaggtgatg

SEQ ID NO: 40311 - DNA, 28 bp, Artificial Sequence
  Description of Artificial Sequence: Synthetic oligonucleotide
agccgggtctcacatcatccaggtgatg

SEQ ID NO: 40312 - DNA, 22 bp, Artificial Sequence
  Description of Artificial Sequence: Synthetic oligonucleotide
ctcctggaccgcggcggacaca

SEQ ID NO: 40313 - DNA, 22 bp, Artificial Sequence
  Description of Artificial Sequence: Synthetic oligonucleotide
tcctggaccgcggcggacacag

SEQ ID NO: 40314 - DNA, 21 bp, Artificial Sequence
  Description of Artificial Sequence: Synthetic oligonucleotide
cctggaccgcggcggacacag

SEQ ID NO: 40315 - DNA, 21 bp, Artificial Sequence
  Description of Artificial Sequence: Synthetic oligonucleotide
ctggaccgcggcggacacagc

SEQ ID NO: 40316 - DNA, 21 bp, Artificial Sequence
  Description of Artificial Sequence: Synthetic oligonucleotide
tggaccgcggcggacacagcg

SEQ ID NO: 40317 - DNA, 20 bp, Artificial Sequence
  Description of Artificial Sequence: Synthetic oligonucleotide
ggaccgcggcggacacagcg

SEQ ID NO: 40318 - DNA, 20 bp, Artificial Sequence
  Description of Artificial Sequence: Synthetic oligonucleotide
gaccgcggcggacacagcgg

SEQ ID NO: 40319 - DNA, 21 bp, Artificial Sequence
  Description of Artificial Sequence: Synthetic oligonucleotide
accgcggcggacacagcggct

SEQ ID NO: 40320 - DNA, 20 bp, Artificial Sequence
  Description of Artificial Sequence: Synthetic oligonucleotide
ccgcggcggacacagcggct

SEQ ID NO: 40321 - DNA, 21 bp, Artificial Sequence
  Description of Artificial Sequence: Synthetic oligonucleotide
cgcggcggacacagcggctca

SEQ ID NO: 40322 - DNA, 23 bp, Artificial Sequence
  Description of Artificial Sequence: Synthetic oligonucleotide
gcggcggacacagcggctcagat

SEQ ID NO: 40323 - DNA, 24 bp, Artificial Sequence
  Description of Artificial Sequence: Synthetic oligonucleotide
cggcggacacagcggctcagatca

SEQ ID NO: 40324 - DNA, 24 bp, Artificial Sequence
  Description of Artificial Sequence: Synthetic oligonucleotide
ggcggacacagcggctcagatcac

SEQ ID NO: 40325 - DNA, 34 bp, Artificial Sequence
  Description of Artificial Sequence: Synthetic oligonucleotide
ttctggagaagagcagagatacacatgccatgtg

SEQ ID NO: 40326 - DNA, 33 bp, Artificial Sequence
  Description of Artificial Sequence: Synthetic oligonucleotide
tctggagaagagcagagatacacatgccatgtg

SEQ ID NO: 40327 - DNA, 32 bp, Artificial Sequence
  Description of Artificial Sequence: Synthetic oligonucleotide
ctggagaagagcagagatacacatgccatgtg

SEQ ID NO: 40328 - DNA, 32 bp, Artificial Sequence
  Description of Artificial Sequence: Synthetic oligonucleotide
tggagaagagcagagatacacatgccatgtgc

SEQ ID NO: 40329 - DNA, 31 bp, Artificial Sequence
  Description of Artificial Sequence: Synthetic oligonucleotide
ggagaagagcagagatacacatgccatgtgc

SEQ ID NO: 40330 - DNA, 32 bp, Artificial Sequence
  Description of Artificial Sequence: Synthetic oligonucleotide
gagaagagcagagatacacatgccatgtgcag

SEQ ID NO: 40331 - DNA, 32 bp, Artificial Sequence
  Description of Artificial Sequence: Synthetic oligonucleotide
agaagagcagagatacacatgccatgtgcagc

SEQ ID NO: 40332 - DNA, 31 bp, Artificial Sequence
  Description of Artificial Sequence: Synthetic oligonucleotide
gaagagcagagatacacatgccatgtgcagc

SEQ ID NO: 40333 - DNA, 33 bp, Artificial Sequence
  Description of Artificial Sequence: Synthetic oligonucleotide
aagagcagagatacacatgccatgtgcagcatg

SEQ ID NO: 40334 - DNA, 32 bp, Artificial Sequence
  Description of Artificial Sequence: Synthetic oligonucleotide
agagcagagatacacatgccatgtgcagcatg

SEQ ID NO: 40335 - DNA, 31 bp, Artificial Sequence
  Description of Artificial Sequence: Synthetic oligonucleotide
gagcagagatacacatgccatgtgcagcatg

SEQ ID NO: 40336 - DNA, 32 bp, Artificial Sequence
  Description of Artificial Sequence: Synthetic oligonucleotide
agcagagatacacatgccatgtgcagcatgag

SEQ ID NO: 40337 - DNA, 31 bp, Artificial Sequence
  Description of Artificial Sequence: Synthetic oligonucleotide
gcagagatacacatgccatgtgcagcatgag

SEQ ID NO: 40338 - DNA, 31 bp, Artificial Sequence
  Description of Artificial Sequence: Synthetic oligonucleotide
cagagatacacatgccatgtgcagcatgagg

SEQ ID NO: 40339 - DNA, 31 bp, Artificial Sequence
  Description of Artificial Sequence: Synthetic oligonucleotide
agagatacacatgccatgtgcagcatgaggg

SEQ ID NO: 40340 - DNA, 30 bp, Artificial Sequence
  Description of Artificial Sequence: Synthetic oligonucleotide
gagatacacatgccatgtgcagcatgaggg

SEQ ID NO: 40341 - DNA, 30 bp, Artificial Sequence
  Description of Artificial Sequence: Synthetic oligonucleotide
agatacacatgccatgtgcagcatgagggg

SEQ ID NO: 40342 - DNA, 29 bp, Artificial Sequence
  Description of Artificial Sequence: Synthetic oligonucleotide
gatacacatgccatgtgcagcatgagggg

SEQ ID NO: 40343 - DNA, 29 bp, Artificial Sequence
  Description of Artificial Sequence: Synthetic oligonucleotide
atacacatgccatgtgcagcatgaggggc

SEQ ID NO: 40344 - DNA, 28 bp, Artificial Sequence
  Description of Artificial Sequence: Synthetic oligonucleotide
tacacatgccatgtgcagcatgaggggc

SEQ ID NO: 40345 - DNA, 27 bp, Artificial Sequence
  Description of Artificial Sequence: Synthetic oligonucleotide
acacatgccatgtgcagcatgaggggc

SEQ ID NO: 40346 - DNA, 27 bp, Artificial Sequence
  Description of Artificial Sequence: Synthetic oligonucleotide
cacatgccatgtgcagcatgaggggct

SEQ ID NO: 40347 - DNA, 27 bp, Artificial Sequence
  Description of Artificial Sequence: Synthetic oligonucleotide
acatgccatgtgcagcatgaggggctg

SEQ ID NO: 40348 - DNA, 26 bp, Artificial Sequence
  Description of Artificial Sequence: Synthetic oligonucleotide
catgccatgtgcagcatgaggggctg

SEQ ID NO: 40349 - DNA, 26 bp, Artificial Sequence
  Description of Artificial Sequence: Synthetic oligonucleotide
atgccatgtgcagcatgaggggctgc

SEQ ID NO: 40350 - DNA, 25 bp, Artificial Sequence
  Description of Artificial Sequence: Synthetic oligonucleotide
tgccatgtgcagcatgaggggctgc

SEQ ID NO: 40351 - DNA, 24 bp, Artificial Sequence
  Description of Artificial Sequence: Synthetic oligonucleotide
gccatgtgcagcatgaggggctgc

SEQ ID NO: 40352 - DNA, 27 bp, Artificial Sequence
  Description of Artificial Sequence: Synthetic oligonucleotide
ccatgtgcagcatgaggggctgccaaa

SEQ ID NO: 40353 - DNA, 27 bp, Artificial Sequence
  Description of Artificial Sequence: Synthetic oligonucleotide
catgtgcagcatgaggggctgccaaag

SEQ ID NO: 40354 - DNA, 27 bp, Artificial Sequence
  Description of Artificial Sequence: Synthetic oligonucleotide
atgtgcagcatgaggggctgccaaagc

SEQ ID NO: 40355 - DNA, 26 bp, Artificial Sequence
  Description of Artificial Sequence: Synthetic oligonucleotide
tgtgcagcatgaggggctgccaaagc

SEQ ID NO: 40356 - DNA, 25 bp, Artificial Sequence
  Description of Artificial Sequence: Synthetic oligonucleotide
gtgcagcatgaggggctgccaaagc

SEQ ID NO: 40357 - DNA, 25 bp, Artificial Sequence
  Description of Artificial Sequence: Synthetic oligonucleotide
tgcagcatgaggggctgccaaagcc

SEQ ID NO: 40358 - DNA, 24 bp, Artificial Sequence
  Description of Artificial Sequence: Synthetic oligonucleotide
gcagcatgaggggctgccaaagcc

SEQ ID NO: 40359 - DNA, 25 bp, Artificial Sequence
  Description of Artificial Sequence: Synthetic oligonucleotide
ccaaagcccctcaccctgagatggg

SEQ ID NO: 40360 - DNA, 24 bp, Artificial Sequence
  Description of Artificial Sequence: Synthetic oligonucleotide
ggcggacacggcggctcagatcat

SEQ ID NO: 40361 - DNA, 24 bp, Artificial Sequence
  Description of Artificial Sequence: Synthetic oligonucleotide
agagaacctgcggatcgcgctccc

SEQ ID NO: 40362 - DNA, 23 bp, Artificial Sequence
  Description of Artificial Sequence: Synthetic oligonucleotide
gagaacctgcggatcgcgctccc

SEQ ID NO: 40363 - DNA, 25 bp, Artificial Sequence
  Description of Artificial Sequence: Synthetic oligonucleotide
agaacctgcggatcgcgctccccta

SEQ ID NO: 40364 - DNA, 24 bp, Artificial Sequence
  Description of Artificial Sequence: Synthetic oligonucleotide
gaacctgcggatcgcgctccccta

SEQ ID NO: 40365 - DNA, 26 bp, Artificial Sequence
  Description of Artificial Sequence: Synthetic oligonucleotide
aacctgcggatcgcgctcccctacta

SEQ ID NO: 40366 - DNA, 25 bp, Artificial Sequence
  Description of Artificial Sequence: Synthetic oligonucleotide
acctgcggatcgcgctcccctacta

SEQ ID NO: 40367 - DNA, 24 bp, Artificial Sequence
  Description of Artificial Sequence: Synthetic oligonucleotide
cctgcggatcgcgctcccctacta

SEQ ID NO: 40368 - DNA, 26 bp, Artificial Sequence
  Description of Artificial Sequence: Synthetic oligonucleotide
ctgcggatcgcgctcccctactacaa

SEQ ID NO: 40369 - DNA, 26 bp, Artificial Sequence
  Description of Artificial Sequence: Synthetic oligonucleotide
tgcggatcgcgctcccctactacaac

SEQ ID NO: 40370 - DNA, 25 bp, Artificial Sequence
  Description of Artificial Sequence: Synthetic oligonucleotide
gcggatcgcgctcccctactacaac

SEQ ID NO: 40371 - DNA, 26 bp, Artificial Sequence
  Description of Artificial Sequence: Synthetic oligonucleotide
cggatcgcgctcccctactacaacca

SEQ ID NO: 40372 - DNA, 27 bp, Artificial Sequence
  Description of Artificial Sequence: Synthetic oligonucleotide
ggatcgcgctcccctactacaaccaga

SEQ ID NO: 40373 - DNA, 27 bp, Artificial Sequence
  Description of Artificial Sequence: Synthetic oligonucleotide
gatcgcgctcccctactacaaccagag

SEQ ID NO: 40374 - DNA, 27 bp, Artificial Sequence
  Description of Artificial Sequence: Synthetic oligonucleotide
atcgcgctcccctactacaaccagagc

SEQ ID NO: 40375 - DNA, 26 bp, Artificial Sequence
  Description of Artificial Sequence: Synthetic oligonucleotide
tcgcgctcccctactacaaccagagc

SEQ ID NO: 40376 - DNA, 25 bp, Artificial Sequence
  Description of Artificial Sequence: Synthetic oligonucleotide
cgcgctcccctactacaaccagagc

SEQ ID NO: 40377 - DNA, 26 bp, Artificial Sequence
  Description of Artificial Sequence: Synthetic oligonucleotide
gcgctcccctactacaaccagagcga

SEQ ID NO: 40378 - DNA, 26 bp, Artificial Sequence
  Description of Artificial Sequence: Synthetic oligonucleotide
cgctcccctactacaaccagagcgag

SEQ ID NO: 40379 - DNA, 26 bp, Artificial Sequence
  Description of Artificial Sequence: Synthetic oligonucleotide
gctcccctactacaaccagagcgagg

SEQ ID NO: 40380 - DNA, 26 bp, Artificial Sequence
  Description of Artificial Sequence: Synthetic oligonucleotide
ctcccctactacaaccagagcgaggc

SEQ ID NO: 40381 - DNA, 26 bp, Artificial Sequence
  Description of Artificial Sequence: Synthetic oligonucleotide
tcccctactacaaccagagcgaggcc

SEQ ID NO: 40382 - DNA, 25 bp, Artificial Sequence
  Description of Artificial Sequence: Synthetic oligonucleotide
cccctactacaaccagagcgaggcc

SEQ ID NO: 40383 - DNA, 25 bp, Artificial Sequence
  Description of Artificial Sequence: Synthetic oligonucleotide
ccctactacaaccagagcgaggccg

SEQ ID NO: 40384 - DNA, 25 bp, Artificial Sequence
  Description of Artificial Sequence: Synthetic oligonucleotide
cctactacaaccagagcgaggccgg

SEQ ID NO: 40385 - DNA, 25 bp, Artificial Sequence
  Description of Artificial Sequence: Synthetic oligonucleotide
gcctccgcgcagacttaccgagaga

SEQ ID NO: 40386 - DNA, 25 bp, Artificial Sequence
  Description of Artificial Sequence: Synthetic oligonucleotide
cctccgcgcagacttaccgagagag

SEQ ID NO: 40387 - DNA, 25 bp, Artificial Sequence
  Description of Artificial Sequence: Synthetic oligonucleotide
ctccgcgcagacttaccgagagagc

SEQ ID NO: 40388 - DNA, 26 bp, Artificial Sequence
  Description of Artificial Sequence: Synthetic oligonucleotide
tccgcgcagacttaccgagagagcct

SEQ ID NO: 40389 - DNA, 25 bp, Artificial Sequence
  Description of Artificial Sequence: Synthetic oligonucleotide
ccgcgcagacttaccgagagagcct

SEQ ID NO: 40390 - DNA, 25 bp, Artificial Sequence
  Description of Artificial Sequence: Synthetic oligonucleotide
cgcgcagacttaccgagagagcctg

SEQ ID NO: 40391 - DNA, 25 bp, Artificial Sequence
  Description of Artificial Sequence: Synthetic oligonucleotide
gcgcagacttaccgagagagcctgc

SEQ ID NO: 40392 - DNA, 25 bp, Artificial Sequence
  Description of Artificial Sequence: Synthetic oligonucleotide
cgcagacttaccgagagagcctgcg

SEQ ID NO: 40393 - DNA, 27 bp, Artificial Sequence
  Description of Artificial Sequence: Synthetic oligonucleotide
gcagacttaccgagagagcctgcggaa

SEQ ID NO: 40394 - DNA, 25 bp, Artificial Sequence
  Description of Artificial Sequence: Synthetic oligonucleotide
ggggagacacggaacgtgaaggcct

SEQ ID NO: 40395 - DNA, 25 bp, Artificial Sequence
  Description of Artificial Sequence: Synthetic oligonucleotide
gggagacacggaacgtgaaggcctc

SEQ ID NO: 40396 - DNA, 25 bp, Artificial Sequence
  Description of Artificial Sequence: Synthetic oligonucleotide
ggagacacggaacgtgaaggcctcc

SEQ ID NO: 40397 - DNA, 25 bp, Artificial Sequence
  Description of Artificial Sequence: Synthetic oligonucleotide
gagacacggaacgtgaaggcctccg

SEQ ID NO: 40398 - DNA, 25 bp, Artificial Sequence
  Description of Artificial Sequence: Synthetic oligonucleotide
agacacggaacgtgaaggcctccgc

SEQ ID NO: 40399 - DNA, 24 bp, Artificial Sequence
  Description of Artificial Sequence: Synthetic oligonucleotide
gacacggaacgtgaaggcctccgc

SEQ ID NO: 40400 - DNA, 24 bp, Artificial Sequence
  Description of Artificial Sequence: Synthetic oligonucleotide
acacggaacgtgaaggcctccgcg

SEQ ID NO: 40401 - DNA, 23 bp, Artificial Sequence
  Description of Artificial Sequence: Synthetic oligonucleotide
cacggaacgtgaaggcctccgcg

SEQ ID NO: 40402 - DNA, 24 bp, Artificial Sequence
  Description of Artificial Sequence: Synthetic oligonucleotide
acggaacgtgaaggcctccgcgca

SEQ ID NO: 40403 - DNA, 23 bp, Artificial Sequence
  Description of Artificial Sequence: Synthetic oligonucleotide
cggaacgtgaaggcctccgcgca

SEQ ID NO: 40404 - DNA, 24 bp, Artificial Sequence
  Description of Artificial Sequence: Synthetic oligonucleotide
ggaacgtgaaggcctccgcgcaga

SEQ ID NO: 40405 - DNA, 27 bp, Artificial Sequence
  Description of Artificial Sequence: Synthetic oligonucleotide
gaacgtgaaggcctccgcgcagactta

SEQ ID NO: 40406 - DNA, 27 bp, Artificial Sequence
  Description of Artificial Sequence: Synthetic oligonucleotide
aacgtgaaggcctccgcgcagacttac

SEQ ID NO: 40407 - DNA, 26 bp, Artificial Sequence
  Description of Artificial Sequence: Synthetic oligonucleotide
acgtgaaggcctccgcgcagacttac

SEQ ID NO: 40408 - DNA, 25 bp, Artificial Sequence
  Description of Artificial Sequence: Synthetic oligonucleotide
cgtgaaggcctccgcgcagacttac

SEQ ID NO: 40409 - DNA, 25 bp, Artificial Sequence
  Description of Artificial Sequence: Synthetic oligonucleotide
gtgaaggcctccgcgcagacttacc

SEQ ID NO: 40410 - DNA, 23 bp, Artificial Sequence
  Description of Artificial Sequence: Synthetic oligonucleotide
gacgccgcgagtccgaggatgga

SEQ ID NO: 40411 - DNA, 23 bp, Artificial Sequence
  Description of Artificial Sequence: Synthetic oligonucleotide
acgccgcgagtccgaggatggag

SEQ ID NO: 40412 - DNA, 22 bp, Artificial Sequence
  Description of Artificial Sequence: Synthetic oligonucleotide
cgccgcgagtccgaggatggag

SEQ ID NO: 40413 - DNA, 22 bp, Artificial Sequence
  Description of Artificial Sequence: Synthetic oligonucleotide
gccgcgagtccgaggatggagc

SEQ ID NO: 40414 - DNA, 22 bp, Artificial Sequence
  Description of Artificial Sequence: Synthetic oligonucleotide
ccgcgagtccgaggatggagcc

SEQ ID NO: 40415 - DNA, 22 bp, Artificial Sequence
  Description of Artificial Sequence: Synthetic oligonucleotide
cgcgagtccgaggatggagccc

SEQ ID NO: 40416 - DNA, 22 bp, Artificial Sequence
  Description of Artificial Sequence: Synthetic oligonucleotide
gcgagtccgaggatggagcccc

SEQ ID NO: 40417 - DNA, 22 bp, Artificial Sequence
  Description of Artificial Sequence: Synthetic oligonucleotide
cgagtccgaggatggagccccg

SEQ ID NO: 40418 - DNA, 22 bp, Artificial Sequence
  Description of Artificial Sequence: Synthetic oligonucleotide
gagtccgaggatggagccccgg

SEQ ID NO: 40419 - DNA, 22 bp, Artificial Sequence
  Description of Artificial Sequence: Synthetic oligonucleotide
agtccgaggatggagccccggg

SEQ ID NO: 40420 - DNA, 21 bp, Artificial Sequence
  Description of Artificial Sequence: Synthetic oligonucleotide
gtccgaggatggagccccggg

SEQ ID NO: 40421 - DNA, 21 bp, Artificial Sequence
  Description of Artificial Sequence: Synthetic oligonucleotide
tccgaggatggagccccgggc

SEQ ID NO: 40422 - DNA, 20 bp, Artificial Sequence
  Description of Artificial Sequence: Synthetic oligonucleotide
ccgaggatggagccccgggc

SEQ ID NO: 40423 - DNA, 20 bp, Artificial Sequence
  Description of Artificial Sequence: Synthetic oligonucleotide
cgaggatggagccccgggcg

SEQ ID NO: 40424 - DNA, 20 bp, Artificial Sequence
  Description of Artificial Sequence: Synthetic oligonucleotide
gaggatggagccccgggcgc

SEQ ID NO: 40425 - DNA, 22 bp, Artificial Sequence
  Description of Artificial Sequence: Synthetic oligonucleotide
aggatggagccccgggcgccat

SEQ ID NO: 40426 - DNA, 21 bp, Artificial Sequence
  Description of Artificial Sequence: Synthetic oligonucleotide
ggatggagccccgggcgccat

SEQ ID NO: 40427 - DNA, 21 bp, Artificial Sequence
  Description of Artificial Sequence: Synthetic oligonucleotide
gatggagccccgggcgccatg

SEQ ID NO: 40428 - DNA, 24 bp, Artificial Sequence
  Description of Artificial Sequence: Synthetic oligonucleotide
atggagccccgggcgccatggata

SEQ ID NO: 40429 - DNA, 23 bp, Artificial Sequence
  Description of Artificial Sequence: Synthetic oligonucleotide
tggagccccgggcgccatggata

SEQ ID NO: 40430 - DNA, 30 bp, Artificial Sequence
  Description of Artificial Sequence: Synthetic oligonucleotide
tacgcctacgacggcaaggattacatcgac

SEQ ID NO: 40431 - DNA, 29 bp, Artificial Sequence
  Description of Artificial Sequence: Synthetic oligonucleotide
acgcctacgacggcaaggattacatcgac

SEQ ID NO: 40432 - DNA, 28 bp, Artificial Sequence
  Description of Artificial Sequence: Synthetic oligonucleotide
cgcctacgacggcaaggattacatcgac

SEQ ID NO: 40433 - DNA, 28 bp, Artificial Sequence
  Description of Artificial Sequence: Synthetic oligonucleotide
gcctacgacggcaaggattacatcgacc

SEQ ID NO: 40434 - DNA, 29 bp, Artificial Sequence
  Description of Artificial Sequence: Synthetic oligonucleotide
cctacgacggcaaggattacatcgacctg

SEQ ID NO: 40435 - DNA, 31 bp, Artificial Sequence
  Description of Artificial Sequence: Synthetic oligonucleotide
ctacgacggcaaggattacatcgacctgaac

SEQ ID NO: 40436 - DNA, 31 bp, Artificial Sequence
  Description of Artificial Sequence: Synthetic oligonucleotide
tacgacggcaaggattacatcgacctgaacg

SEQ ID NO: 40437 - DNA, 30 bp, Artificial Sequence
  Description of Artificial Sequence: Synthetic oligonucleotide
acgacggcaaggattacatcgacctgaacg

SEQ ID NO: 40438 - DNA, 29 bp, Artificial Sequence
  Description of Artificial Sequence: Synthetic oligonucleotide
cgacggcaaggattacatcgacctgaacg

SEQ ID NO: 40439 - DNA, 30 bp, Artificial Sequence
  Description of Artificial Sequence: Synthetic oligonucleotide
gacggcaaggattacatcgacctgaacgag

SEQ ID NO: 40440 - DNA, 30 bp, Artificial Sequence
  Description of Artificial Sequence: Synthetic oligonucleotide
acggcaaggattacatcgacctgaacgagg

SEQ ID NO: 40441 - DNA, 29 bp, Artificial Sequence
  Description of Artificial Sequence: Synthetic oligonucleotide
cggcaaggattacatcgacctgaacgagg

SEQ ID NO: 40442 - DNA, 30 bp, Artificial Sequence
  Description of Artificial Sequence: Synthetic oligonucleotide
ggcaaggattacatcgacctgaacgaggac

SEQ ID NO: 40443 - DNA, 30 bp, Artificial Sequence
  Description of Artificial Sequence: Synthetic oligonucleotide
gcaaggattacatcgacctgaacgaggacc

SEQ ID NO: 40444 - DNA, 31 bp, Artificial Sequence
  Description of Artificial Sequence: Synthetic oligonucleotide
caaggattacatcgacctgaacgaggacctg

SEQ ID NO: 40445 - DNA, 32 bp, Artificial Sequence
  Description of Artificial Sequence: Synthetic oligonucleotide
aaggattacatcgacctgaacgaggacctgag

SEQ ID NO: 40446 - DNA, 31 bp, Artificial Sequence
  Description of Artificial Sequence: Synthetic oligonucleotide
aggattacatcgacctgaacgaggacctgag

SEQ ID NO: 40447 - DNA, 30 bp, Artificial Sequence
  Description of Artificial Sequence: Synthetic oligonucleotide
ggattacatcgacctgaacgaggacctgag

SEQ ID NO: 40448 - DNA, 30 bp, Artificial Sequence
  Description of Artificial Sequence: Synthetic oligonucleotide
gattacatcgacctgaacgaggacctgagc

SEQ ID NO: 40449 - DNA, 31 bp, Artificial Sequence
  Description of Artificial Sequence: Synthetic oligonucleotide
attacatcgacctgaacgaggacctgagctc

SEQ ID NO: 40450 - DNA, 30 bp, Artificial Sequence
  Description of Artificial Sequence: Synthetic oligonucleotide
ttacatcgacctgaacgaggacctgagctc

SEQ ID NO: 40451 - DNA, 29 bp, Artificial Sequence
  Description of Artificial Sequence: Synthetic oligonucleotide
tacatcgacctgaacgaggacctgagctc

SEQ ID NO: 40452 - DNA, 28 bp, Artificial Sequence
  Description of Artificial Sequence: Synthetic oligonucleotide
acatcgacctgaacgaggacctgagctc

SEQ ID NO: 40453 - DNA, 27 bp, Artificial Sequence
  Description of Artificial Sequence: Synthetic oligonucleotide
catcgacctgaacgaggacctgagctc

SEQ ID NO: 40454 - DNA, 27 bp, Artificial Sequence
  Description of Artificial Sequence: Synthetic oligonucleotide
atcgacctgaacgaggacctgagctcc

SEQ ID NO: 40455 - DNA, 27 bp, Artificial Sequence
  Description of Artificial Sequence: Synthetic oligonucleotide
tcgacctgaacgaggacctgagctcct

SEQ ID NO: 40456 - DNA, 26 bp, Artificial Sequence
  Description of Artificial Sequence: Synthetic oligonucleotide
cgacctgaacgaggacctgagctcct

SEQ ID NO: 40457 - DNA, 26 bp, Artificial Sequence
  Description of Artificial Sequence: Synthetic oligonucleotide
gacctgaacgaggacctgagctcctg

SEQ ID NO: 40458 - DNA, 27 bp, Artificial Sequence
  Description of Artificial Sequence: Synthetic oligonucleotide
acctgaacgaggacctgagctcctgga

SEQ ID NO: 40459 - DNA, 23 bp, Artificial Sequence
  Description of Artificial Sequence: Synthetic oligonucleotide
ctgagctcctggaccgcggcgta

SEQ ID NO: 40460 - DNA, 24 bp, Artificial Sequence
  Description of Artificial Sequence: Synthetic oligonucleotide
tgagctcctggaccgcggcgtaca

SEQ ID NO: 40461 - DNA, 23 bp, Artificial Sequence
  Description of Artificial Sequence: Synthetic oligonucleotide
gagctcctggaccgcggcgtaca

SEQ ID NO: 40462 - DNA, 23 bp, Artificial Sequence
  Description of Artificial Sequence: Synthetic oligonucleotide
agctcctggaccgcggcgtacac

SEQ ID NO: 40463 - DNA, 22 bp, Artificial Sequence
  Description of Artificial Sequence: Synthetic oligonucleotide
gctcctggaccgcggcgtacac

SEQ ID NO: 40464 - DNA, 22 bp, Artificial Sequence
  Description of Artificial Sequence: Synthetic oligonucleotide
ctcctggaccgcggcgtacacg

SEQ ID NO: 40465 - DNA, 22 bp, Artificial Sequence
  Description of Artificial Sequence: Synthetic oligonucleotide
tcctggaccgcggcgtacacgg

SEQ ID NO: 40466 - DNA, 21 bp, Artificial Sequence
  Description of Artificial Sequence: Synthetic oligonucleotide
cctggaccgcggcgtacacgg

SEQ ID NO: 40467 - DNA, 21 bp, Artificial Sequence
  Description of Artificial Sequence: Synthetic oligonucleotide
ctggaccgcggcgtacacggc

SEQ ID NO: 40468 - DNA, 21 bp, Artificial Sequence
  Description of Artificial Sequence: Synthetic oligonucleotide
tggaccgcggcgtacacggcg

SEQ ID NO: 40469 - DNA, 20 bp, Artificial Sequence
  Description of Artificial Sequence: Synthetic oligonucleotide
ggaccgcggcgtacacggcg

SEQ ID NO: 40470 - DNA, 20 bp, Artificial Sequence
  Description of Artificial Sequence: Synthetic oligonucleotide
gaccgcggcgtacacggcgg

SEQ ID NO: 40471 - DNA, 21 bp, Artificial Sequence
  Description of Artificial Sequence: Synthetic oligonucleotide
accgcggcgtacacggcggct

SEQ ID NO: 40472 - DNA, 20 bp, Artificial Sequence
  Description of Artificial Sequence: Synthetic oligonucleotide
ccgcggcgtacacggcggct

SEQ ID NO: 40473 - DNA, 21 bp, Artificial Sequence
  Description of Artificial Sequence: Synthetic oligonucleotide
cgcggcgtacacggcggctca

SEQ ID NO: 40474 - DNA, 23 bp, Artificial Sequence
  Description of Artificial Sequence: Synthetic oligonucleotide
gcggcgtacacggcggctcagat

SEQ ID NO: 40475 - DNA, 24 bp, Artificial Sequence
  Description of Artificial Sequence: Synthetic oligonucleotide
cggcgtacacggcggctcagatca

SEQ ID NO: 40476 - DNA, 24 bp, Artificial Sequence
  Description of Artificial Sequence: Synthetic oligonucleotide
ggcgtacacggcggctcagatcac

SEQ ID NO: 40477 - DNA, 24 bp, Artificial Sequence
  Description of Artificial Sequence: Synthetic oligonucleotide
gcgtacacggcggctcagatcacc

SEQ ID NO: 40478 - DNA, 25 bp, Artificial Sequence
  Description of Artificial Sequence: Synthetic oligonucleotide
cgtacacggcggctcagatcaccca

SEQ ID NO: 40479 - DNA, 25 bp, Artificial Sequence
  Description of Artificial Sequence: Synthetic oligonucleotide
gtacacggcggctcagatcacccag

SEQ ID NO: 40480 - DNA, 25 bp, Artificial Sequence
  Description of Artificial Sequence: Synthetic oligonucleotide
tacacggcggctcagatcacccagc

SEQ ID NO: 40481 - DNA, 25 bp, Artificial Sequence
  Description of Artificial Sequence: Synthetic oligonucleotide
aggggccggagtattgggacgggaa

SEQ ID NO: 40482 - DNA, 24 bp, Artificial Sequence
  Description of Artificial Sequence: Synthetic oligonucleotide
ggggccggagtattgggacgggaa

SEQ ID NO: 40483 - DNA, 25 bp, Artificial Sequence
  Description of Artificial Sequence: Synthetic oligonucleotide
gggccggagtattgggacgggaaga

SEQ ID NO: 40484 - DNA, 26 bp, Artificial Sequence
  Description of Artificial Sequence: Synthetic oligonucleotide
ggccggagtattgggacgggaagaca

SEQ ID NO: 40485 - DNA, 26 bp, Artificial Sequence
  Description of Artificial Sequence: Synthetic oligonucleotide
gccggagtattgggacgggaagacac

SEQ ID NO: 40486 - DNA, 26 bp, Artificial Sequence
  Description of Artificial Sequence: Synthetic oligonucleotide
ccggagtattgggacgggaagacacg

SEQ ID NO: 40487 - DNA, 27 bp, Artificial Sequence
  Description of Artificial Sequence: Synthetic oligonucleotide
cggagtattgggacgggaagacacgga

SEQ ID NO: 40488 - DNA, 28 bp, Artificial Sequence
  Description of Artificial Sequence: Synthetic oligonucleotide
ggagtattgggacgggaagacacggaac

SEQ ID NO: 40489 - DNA, 30 bp, Artificial Sequence
  Description of Artificial Sequence: Synthetic oligonucleotide
gagtattgggacgggaagacacggaacatg

SEQ ID NO: 40490 - DNA, 32 bp, Artificial Sequence
  Description of Artificial Sequence: Synthetic oligonucleotide
agtattgggacgggaagacacggaacatgaag

SEQ ID NO: 40491 - DNA, 31 bp, Artificial Sequence
  Description of Artificial Sequence: Synthetic oligonucleotide
gtattgggacgggaagacacggaacatgaag

SEQ ID NO: 40492 - DNA, 31 bp, Artificial Sequence
  Description of Artificial Sequence: Synthetic oligonucleotide
tattgggacgggaagacacggaacatgaagg

SEQ ID NO: 40493 - DNA, 30 bp, Artificial Sequence
  Description of Artificial Sequence: Synthetic oligonucleotide
attgggacgggaagacacggaacatgaagg

SEQ ID NO: 40494 - DNA, 29 bp, Artificial Sequence
  Description of Artificial Sequence: Synthetic oligonucleotide
ttgggacgggaagacacggaacatgaagg

SEQ ID NO: 40495 - DNA, 28 bp, Artificial Sequence
  Description of Artificial Sequence: Synthetic oligonucleotide
tgggacgggaagacacggaacatgaagg

SEQ ID NO: 40496 - DNA, 27 bp, Artificial Sequence
  Description of Artificial Sequence: Synthetic oligonucleotide
gggacgggaagacacggaacatgaagg

SEQ ID NO: 40497 - DNA, 27 bp, Artificial Sequence
  Description of Artificial Sequence: Synthetic oligonucleotide
ggacgggaagacacggaacatgaaggc

SEQ ID NO: 40498 - DNA, 27 bp, Artificial Sequence
  Description of Artificial Sequence: Synthetic oligonucleotide
gacgggaagacacggaacatgaaggcc

SEQ ID NO: 40499 - DNA, 28 bp, Artificial Sequence
  Description of Artificial Sequence: Synthetic oligonucleotide
acgggaagacacggaacatgaaggcctc

SEQ ID NO: 40500 - DNA, 27 bp, Artificial Sequence
  Description of Artificial Sequence: Synthetic oligonucleotide
cgggaagacacggaacatgaaggcctc

SEQ ID NO: 40501 - DNA, 27 bp, Artificial Sequence
  Description of Artificial Sequence: Synthetic oligonucleotide
gggaagacacggaacatgaaggcctcc

SEQ ID NO: 40502 - DNA, 27 bp, Artificial Sequence
  Description of Artificial Sequence: Synthetic oligonucleotide
ggaagacacggaacatgaaggcctccg

SEQ ID NO: 40503 - DNA, 27 bp, Artificial Sequence
  Description of Artificial Sequence: Synthetic oligonucleotide
gaagacacggaacatgaaggcctccgc

SEQ ID NO: 40504 - DNA, 27 bp, Artificial Sequence
  Description of Artificial Sequence: Synthetic oligonucleotide
aagacacggaacatgaaggcctccgcg

SEQ ID NO: 40505 - DNA, 24 bp, Artificial Sequence
  Description of Artificial Sequence: Synthetic oligonucleotide
gaggccgggtctcacgtcatccag

SEQ ID NO: 40506 - DNA, 25 bp, Artificial Sequence
  Description of Artificial Sequence: Synthetic oligonucleotide
aggccgggtctcacgtcatccaggt

SEQ ID NO: 40507 - DNA, 24 bp, Artificial Sequence
  Description of Artificial Sequence: Synthetic oligonucleotide
ggccgggtctcacgtcatccaggt

SEQ ID NO: 40508 - DNA, 26 bp, Artificial Sequence
  Description of Artificial Sequence: Synthetic oligonucleotide
gccgggtctcacgtcatccaggtgat

SEQ ID NO: 40509 - DNA, 27 bp, Artificial Sequence
  Description of Artificial Sequence: Synthetic oligonucleotide
ccgggtctcacgtcatccaggtgatgt

SEQ ID NO: 40510 - DNA, 29 bp, Artificial Sequence
  Description of Artificial Sequence: Synthetic oligonucleotide
cgggtctcacgtcatccaggtgatgtatg

SEQ ID NO: 40511 - DNA, 29 bp, Artificial Sequence
  Description of Artificial Sequence: Synthetic oligonucleotide
gggtctcacgtcatccaggtgatgtatgg

SEQ ID NO: 40512 - DNA, 29 bp, Artificial Sequence
  Description of Artificial Sequence: Synthetic oligonucleotide
ggtctcacgtcatccaggtgatgtatggc

SEQ ID NO: 40513 - DNA, 30 bp, Artificial Sequence
  Description of Artificial Sequence: Synthetic oligonucleotide
gtctcacgtcatccaggtgatgtatggctg

SEQ ID NO: 40514 - DNA, 30 bp, Artificial Sequence
  Description of Artificial Sequence: Synthetic oligonucleotide
tctcacgtcatccaggtgatgtatggctgc

SEQ ID NO: 40515 - DNA, 29 bp, Artificial Sequence
  Description of Artificial Sequence: Synthetic oligonucleotide
ctcacgtcatccaggtgatgtatggctgc

SEQ ID NO: 40516 - DNA, 29 bp, Artificial Sequence
  Description of Artificial Sequence: Synthetic oligonucleotide
tcacgtcatccaggtgatgtatggctgcg

SEQ ID NO: 40517 - DNA, 28 bp, Artificial Sequence
  Description of Artificial Sequence: Synthetic oligonucleotide
cacgtcatccaggtgatgtatggctgcg

SEQ ID NO: 40518 - DNA, 29 bp, Artificial Sequence
  Description of Artificial Sequence: Synthetic oligonucleotide
acgtcatccaggtgatgtatggctgcgac

SEQ ID NO: 40519 - DNA, 28 bp, Artificial Sequence
  Description of Artificial Sequence: Synthetic oligonucleotide
cgtcatccaggtgatgtatggctgcgac

SEQ ID NO: 40520 - DNA, 28 bp, Artificial Sequence
  Description of Artificial Sequence: Synthetic oligonucleotide
gtcatccaggtgatgtatggctgcgacg

SEQ ID NO: 40521 - DNA, 22 bp, Artificial Sequence
  Description of Artificial Sequence: Synthetic oligonucleotide
ccgcggggagtcccgcttcatc

SEQ ID NO: 40522 - DNA, 22 bp, Artificial Sequence
  Description of Artificial Sequence: Synthetic oligonucleotide
cgcggggagtcccgcttcatcg

SEQ ID NO: 40523 - DNA, 23 bp, Artificial Sequence
  Description of Artificial Sequence: Synthetic oligonucleotide
gcggggagtcccgcttcatcgca

SEQ ID NO: 40524 - DNA, 24 bp, Artificial Sequence
  Description of Artificial Sequence: Synthetic oligonucleotide
cggggagtcccgcttcatcgcagt

SEQ ID NO: 40525 - DNA, 24 bp, Artificial Sequence
  Description of Artificial Sequence: Synthetic oligonucleotide
ggggagtcccgcttcatcgcagtg

SEQ ID NO: 40526 - DNA, 24 bp, Artificial Sequence
  Description of Artificial Sequence: Synthetic oligonucleotide
gggagtcccgcttcatcgcagtgg

SEQ ID NO: 40527 - DNA, 24 bp, Artificial Sequence
  Description of Artificial Sequence: Synthetic oligonucleotide
ggagtcccgcttcatcgcagtggg

SEQ ID NO: 40528 - DNA, 26 bp, Artificial Sequence
  Description of Artificial Sequence: Synthetic oligonucleotide
gagtcccgcttcatcgcagtgggcta

SEQ ID NO: 40529 - DNA, 26 bp, Artificial Sequence
  Description of Artificial Sequence: Synthetic oligonucleotide
agtcccgcttcatcgcagtgggctac

SEQ ID NO: 40530 - DNA, 25 bp, Artificial Sequence
  Description of Artificial Sequence: Synthetic oligonucleotide
gtcccgcttcatcgcagtgggctac

SEQ ID NO: 40531 - DNA, 26 bp, Artificial Sequence
  Description of Artificial Sequence: Synthetic oligonucleotide
tcccgcttcatcgcagtgggctacgt

SEQ ID NO: 40532 - DNA, 20 bp, Artificial Sequence
  Description of Artificial Sequence: Synthetic oligonucleotide
cggcccgtgtggcggagcac

SEQ ID NO: 40533 - DNA, 21 bp, Artificial Sequence
  Description of Artificial Sequence: Synthetic oligonucleotide
ggcccgtgtggcggagcacct

SEQ ID NO: 40534 - DNA, 22 bp, Artificial Sequence
  Description of Artificial Sequence: Synthetic oligonucleotide
gcccgtgtggcggagcacctga

SEQ ID NO: 40535 - DNA, 23 bp, Artificial Sequence
  Description of Artificial Sequence: Synthetic oligonucleotide
cccgtgtggcggagcacctgaga

SEQ ID NO: 40536 - DNA, 23 bp, Artificial Sequence
  Description of Artificial Sequence: Synthetic oligonucleotide
ccgtgtggcggagcacctgagag

SEQ ID NO: 40537 - DNA, 23 bp, Artificial Sequence
  Description of Artificial Sequence: Synthetic oligonucleotide
cgtgtggcggagcacctgagagc

SEQ ID NO: 40538 - DNA, 25 bp, Artificial Sequence
  Description of Artificial Sequence: Synthetic oligonucleotide
gtgtggcggagcacctgagagccta

SEQ ID NO: 40539 - DNA, 25 bp, Artificial Sequence
  Description of Artificial Sequence: Synthetic oligonucleotide
tgtggcggagcacctgagagcctac

SEQ ID NO: 40540 - DNA, 24 bp, Artificial Sequence
  Description of Artificial Sequence: Synthetic oligonucleotide
gtggcggagcacctgagagcctac

SEQ ID NO: 40541 - DNA, 25 bp, Artificial Sequence
  Description of Artificial Sequence: Synthetic oligonucleotide
tggcggagcacctgagagcctacct

SEQ ID NO: 40542 - DNA, 24 bp, Artificial Sequence
  Description of Artificial Sequence: Synthetic oligonucleotide
ggcggagcacctgagagcctacct

SEQ ID NO: 40543 - DNA, 24 bp, Artificial Sequence
  Description of Artificial Sequence: Synthetic oligonucleotide
gcggagcacctgagagcctacctg

SEQ ID NO: 40544 - DNA, 25 bp, Artificial Sequence
  Description of Artificial Sequence: Synthetic oligonucleotide
cggagcacctgagagcctacctgga

SEQ ID NO: 40545 - DNA, 25 bp, Artificial Sequence
  Description of Artificial Sequence: Synthetic oligonucleotide
ggagcacctgagagcctacctggag

SEQ ID NO: 40546 - DNA, 25 bp, Artificial Sequence
  Description of Artificial Sequence: Synthetic oligonucleotide
gagcacctgagagcctacctggagg

SEQ ID NO: 40547 - DNA, 25 bp, Artificial Sequence
  Description of Artificial Sequence: Synthetic oligonucleotide
agcacctgagagcctacctggaggg

SEQ ID NO: 40548 - DNA, 24 bp, Artificial Sequence
  Description of Artificial Sequence: Synthetic oligonucleotide
gcacctgagagcctacctggaggg

SEQ ID NO: 40549 - DNA, 24 bp, Artificial Sequence
  Description of Artificial Sequence: Synthetic oligonucleotide
cacctgagagcctacctggagggc

SEQ ID NO: 40550 - DNA, 25 bp, Artificial Sequence
  Description of Artificial Sequence: Synthetic oligonucleotide
acctgagagcctacctggagggcct

SEQ ID NO: 40551 - DNA, 24 bp, Artificial Sequence
  Description of Artificial Sequence: Synthetic oligonucleotide
cctgagagcctacctggagggcct

SEQ ID NO: 40552 - DNA, 25 bp, Artificial Sequence
  Description of Artificial Sequence: Synthetic oligonucleotide
cctcctccgcgggcataaccagtag

SEQ ID NO: 40553 - DNA, 25 bp, Artificial Sequence
  Description of Artificial Sequence: Synthetic oligonucleotide
ctcctccgcgggcataaccagtagg

SEQ ID NO: 40554 - DNA, 25 bp, Artificial Sequence
  Description of Artificial Sequence: Synthetic oligonucleotide
tcctccgcgggcataaccagtaggc

SEQ ID NO: 40555 - DNA, 24 bp, Artificial Sequence
  Description of Artificial Sequence: Synthetic oligonucleotide
cctccgcgggcataaccagtaggc

SEQ ID NO: 40556 - DNA, 26 bp, Artificial Sequence
  Description of Artificial Sequence: Synthetic oligonucleotide
ctccgcgggcataaccagtaggccta

SEQ ID NO: 40557 - DNA, 26 bp, Artificial Sequence
  Description of Artificial Sequence: Synthetic oligonucleotide
tccgcgggcataaccagtaggcctac

SEQ ID NO: 40558 - DNA, 25 bp, Artificial Sequence
  Description of Artificial Sequence: Synthetic oligonucleotide
ccgcgggcataaccagtaggcctac

SEQ ID NO: 40559 - DNA, 26 bp, Artificial Sequence
  Description of Artificial Sequence: Synthetic oligonucleotide
cgcgggcataaccagtaggcctacga

SEQ ID NO: 40560 - DNA, 26 bp, Artificial Sequence
  Description of Artificial Sequence: Synthetic oligonucleotide
gcgggcataaccagtaggcctacgac

SEQ ID NO: 40561 - DNA, 26 bp, Artificial Sequence
  Description of Artificial Sequence: Synthetic oligonucleotide
cgggcataaccagtaggcctacgacg

SEQ ID NO: 40562 - DNA, 26 bp, Artificial Sequence
  Description of Artificial Sequence: Synthetic oligonucleotide
gggcataaccagtaggcctacgacgg

SEQ ID NO: 40563 - DNA, 27 bp, Artificial Sequence
  Description of Artificial Sequence: Synthetic oligonucleotide
ggcataaccagtaggcctacgacggca

SEQ ID NO: 40564 - DNA, 28 bp, Artificial Sequence
  Description of Artificial Sequence: Synthetic oligonucleotide
gcataaccagtaggcctacgacggcaag

SEQ ID NO: 40565 - DNA, 28 bp, Artificial Sequence
  Description of Artificial Sequence: Synthetic oligonucleotide
cataaccagtaggcctacgacggcaagg

SEQ ID NO: 40566 - DNA, 32 bp, Artificial Sequence
  Description of Artificial Sequence: Synthetic oligonucleotide
ataaccagtaggcctacgacggcaaggattac

SEQ ID NO: 40567 - DNA, 31 bp, Artificial Sequence
  Description of Artificial Sequence: Synthetic oligonucleotide
taaccagtaggcctacgacggcaaggattac

SEQ ID NO: 40568 - DNA, 30 bp, Artificial Sequence
  Description of Artificial Sequence: Synthetic oligonucleotide
aaccagtaggcctacgacggcaaggattac

SEQ ID NO: 40569 - DNA, 24 bp, Artificial Sequence
  Description of Artificial Sequence: Synthetic oligonucleotide
tatggctgcgacctggggcccgat

SEQ ID NO: 40570 - DNA, 23 bp, Artificial Sequence
  Description of Artificial Sequence: Synthetic oligonucleotide
atggctgcgacctggggcccgat

SEQ ID NO: 40571 - DNA, 22 bp, Artificial Sequence
  Description of Artificial Sequence: Synthetic oligonucleotide
tggctgcgacctggggcccgat

SEQ ID NO: 40572 - DNA, 21 bp, Artificial Sequence
  Description of Artificial Sequence: Synthetic oligonucleotide
ggctgcgacctggggcccgat

SEQ ID NO: 40573 - DNA, 21 bp, Artificial Sequence
  Description of Artificial Sequence: Synthetic oligonucleotide
gctgcgacctggggcccgatg

SEQ ID NO: 40574 - DNA, 21 bp, Artificial Sequence
  Description of Artificial Sequence: Synthetic oligonucleotide
ctgcgacctggggcccgatgg

SEQ ID NO: 40575 - DNA, 21 bp, Artificial Sequence
  Description of Artificial Sequence: Synthetic oligonucleotide
tgcgacctggggcccgatggg

SEQ ID NO: 40576 - DNA, 20 bp, Artificial Sequence
  Description of Artificial Sequence: Synthetic oligonucleotide
gcgacctggggcccgatggg

SEQ ID NO: 40577 - DNA, 20 bp, Artificial Sequence
  Description of Artificial Sequence: Synthetic oligonucleotide
cgacctggggcccgatgggc

SEQ ID NO: 40578 - DNA, 20 bp, Artificial Sequence
  Description of Artificial Sequence: Synthetic oligonucleotide
gacctggggcccgatgggcg

SEQ ID NO: 40579 - DNA, 20 bp, Artificial Sequence
  Description of Artificial Sequence: Synthetic oligonucleotide
acctggggcccgatgggcgc

SEQ ID NO: 40580 - DNA, 20 bp, Artificial Sequence
  Description of Artificial Sequence: Synthetic oligonucleotide
cctggggcccgatgggcgct

SEQ ID NO: 40581 - DNA, 20 bp, Artificial Sequence
  Description of Artificial Sequence: Synthetic oligonucleotide
ctggggcccgatgggcgcct

SEQ ID NO: 40582 - DNA, 20 bp, Artificial Sequence
  Description of Artificial Sequence: Synthetic oligonucleotide
tggggcccgatgggcgcctc

SEQ ID NO: 40583 - DNA, 20 bp, Artificial Sequence
  Description of Artificial Sequence: Synthetic oligonucleotide
ggggcccgatgggcgcctct

SEQ ID NO: 40584 - DNA, 20 bp, Artificial Sequence
  Description of Artificial Sequence: Synthetic oligonucleotide
gggcccgatgggcgcctcct

SEQ ID NO: 40585 - DNA, 20 bp, Artificial Sequence
  Description of Artificial Sequence: Synthetic oligonucleotide
ggcccgatgggcgcctcctc

SEQ ID NO: 40586 - DNA, 20 bp, Artificial Sequence
  Description of Artificial Sequence: Synthetic oligonucleotide
gcccgatgggcgcctcctcc

SEQ ID NO: 40587 - DNA, 20 bp, Artificial Sequence
  Description of Artificial Sequence: Synthetic oligonucleotide
cccgatgggcgcctcctccg

SEQ ID NO: 40588 - DNA, 20 bp, Artificial Sequence
  Description of Artificial Sequence: Synthetic oligonucleotide
ccgatgggcgcctcctccgc

SEQ ID NO: 40589 - DNA, 20 bp, Artificial Sequence
  Description of Artificial Sequence: Synthetic oligonucleotide
cgatgggcgcctcctccgcg

SEQ ID NO: 40590 - DNA, 27 bp, Artificial Sequence
  Description of Artificial Sequence: Synthetic oligonucleotide
atcgccctgaacgaggacctgagctct

SEQ ID NO: 40591 - DNA, 27 bp, Artificial Sequence
  Description of Artificial Sequence: Synthetic oligonucleotide
tcgccctgaacgaggacctgagctctt

SEQ ID NO: 40592 - DNA, 26 bp, Artificial Sequence
  Description of Artificial Sequence: Synthetic oligonucleotide
cgccctgaacgaggacctgagctctt

SEQ ID NO: 40593 - DNA, 26 bp, Artificial Sequence
  Description of Artificial Sequence: Synthetic oligonucleotide
gccctgaacgaggacctgagctcttg

SEQ ID NO: 40594 - DNA, 27 bp, Artificial Sequence
  Description of Artificial Sequence: Synthetic oligonucleotide
ccctgaacgaggacctgagctcttgga

SEQ ID NO: 40595 - DNA, 27 bp, Artificial Sequence
  Description of Artificial Sequence: Synthetic oligonucleotide
cctgaacgaggacctgagctcttggac

SEQ ID NO: 40596 - DNA, 27 bp, Artificial Sequence
  Description of Artificial Sequence: Synthetic oligonucleotide
ctgaacgaggacctgagctcttggacc

SEQ ID NO: 40597 - DNA, 27 bp, Artificial Sequence
  Description of Artificial Sequence: Synthetic oligonucleotide
tgaacgaggacctgagctcttggaccg

SEQ ID NO: 40598 - DNA, 26 bp, Artificial Sequence
  Description of Artificial Sequence: Synthetic oligonucleotide
gaacgaggacctgagctcttggaccg

SEQ ID NO: 40599 - DNA, 26 bp, Artificial Sequence
  Description of Artificial Sequence: Synthetic oligonucleotide
aacgaggacctgagctcttggaccgc

SEQ ID NO: 40600 - DNA, 25 bp, Artificial Sequence
  Description of Artificial Sequence: Synthetic oligonucleotide
acgaggacctgagctcttggaccgc

SEQ ID NO: 40601 - DNA, 24 bp, Artificial Sequence
  Description of Artificial Sequence: Synthetic oligonucleotide
cgaggacctgagctcttggaccgc

SEQ ID NO: 40602 - DNA, 24 bp, Artificial Sequence
  Description of Artificial Sequence: Synthetic oligonucleotide
gaggacctgagctcttggaccgcg

SEQ ID NO: 40603 - DNA, 24 bp, Artificial Sequence
  Description of Artificial Sequence: Synthetic oligonucleotide
aggacctgagctcttggaccgcgg

SEQ ID NO: 40604 - DNA, 23 bp, Artificial Sequence
  Description of Artificial Sequence: Synthetic oligonucleotide
ggacctgagctcttggaccgcgg

SEQ ID NO: 40605 - DNA, 23 bp, Artificial Sequence
  Description of Artificial Sequence: Synthetic oligonucleotide
gacctgagctcttggaccgcggc

SEQ ID NO: 40606 - DNA, 23 bp, Artificial Sequence
  Description of Artificial Sequence: Synthetic oligonucleotide
acctgagctcttggaccgcggcg

SEQ ID NO: 40607 - DNA, 22 bp, Artificial Sequence
  Description of Artificial Sequence: Synthetic oligonucleotide
cctgagctcttggaccgcggcg

SEQ ID NO: 40608 - DNA, 23 bp, Artificial Sequence
  Description of Artificial Sequence: Synthetic oligonucleotide
ctgagctcttggaccgcggcgga

SEQ ID NO: 40609 - DNA, 24 bp, Artificial Sequence
  Description of Artificial Sequence: Synthetic oligonucleotide
tgagctcttggaccgcggcggaca

SEQ ID NO: 40610 - DNA, 23 bp, Artificial Sequence
  Description of Artificial Sequence: Synthetic oligonucleotide
gagctcttggaccgcggcggaca

SEQ ID NO: 40611 - DNA, 23 bp, Artificial Sequence
  Description of Artificial Sequence: Synthetic oligonucleotide
agctcttggaccgcggcggacac

SEQ ID NO: 40612 - DNA, 35 bp, Artificial Sequence
  Description of Artificial Sequence: Synthetic oligonucleotide
tggagaagagcagagatacacatgccatgtacaac

SEQ ID NO: 40613 - DNA, 34 bp, Artificial Sequence
  Description of Artificial Sequence: Synthetic oligonucleotide
ggagaagagcagagatacacatgccatgtacaac

SEQ ID NO: 40614 - DNA, 36 bp, Artificial Sequence
  Description of Artificial Sequence: Synthetic oligonucleotide
gagaagagcagagatacacatgccatgtacaacatg

SEQ ID NO: 40615 - DNA, 37 bp, Artificial Sequence
  Description of Artificial Sequence: Synthetic oligonucleotide
agaagagcagagatacacatgccatgtacaacatgag

SEQ ID NO: 40616 - DNA, 36 bp, Artificial Sequence
  Description of Artificial Sequence: Synthetic oligonucleotide
gaagagcagagatacacatgccatgtacaacatgag

SEQ ID NO: 40617 - DNA, 36 bp, Artificial Sequence
  Description of Artificial Sequence: Synthetic oligonucleotide
aagagcagagatacacatgccatgtacaacatgagg

SEQ ID NO: 40618 - DNA, 35 bp, Artificial Sequence
  Description of Artificial Sequence: Synthetic oligonucleotide
agagcagagatacacatgccatgtacaacatgagg

SEQ ID NO: 40619 - DNA, 34 bp, Artificial Sequence
  Description of Artificial Sequence: Synthetic oligonucleotide
gagcagagatacacatgccatgtacaacatgagg

SEQ ID NO: 40620 - DNA, 34 bp, Artificial Sequence
  Description of Artificial Sequence: Synthetic oligonucleotide
agcagagatacacatgccatgtacaacatgaggg

SEQ ID NO: 40621 - DNA, 33 bp, Artificial Sequence
  Description of Artificial Sequence: Synthetic oligonucleotide
gcagagatacacatgccatgtacaacatgaggg

SEQ ID NO: 40622 - DNA, 33 bp, Artificial Sequence
  Description of Artificial Sequence: Synthetic oligonucleotide
cagagatacacatgccatgtacaacatgagggg

SEQ ID NO: 40623 - DNA, 33 bp, Artificial Sequence
  Description of Artificial Sequence: Synthetic oligonucleotide
agagatacacatgccatgtacaacatgaggggc

SEQ ID NO: 40624 - DNA, 32 bp, Artificial Sequence
  Description of Artificial Sequence: Synthetic oligonucleotide
gagatacacatgccatgtacaacatgaggggc

SEQ ID NO: 40625 - DNA, 33 bp, Artificial Sequence
  Description of Artificial Sequence: Synthetic oligonucleotide
agatacacatgccatgtacaacatgaggggctg

SEQ ID NO: 40626 - DNA, 32 bp, Artificial Sequence
  Description of Artificial Sequence: Synthetic oligonucleotide
gatacacatgccatgtacaacatgaggggctg

SEQ ID NO: 40627 - DNA, 32 bp, Artificial Sequence
  Description of Artificial Sequence: Synthetic oligonucleotide
atacacatgccatgtacaacatgaggggctgc

SEQ ID NO: 40628 - DNA, 31 bp, Artificial Sequence
  Description of Artificial Sequence: Synthetic oligonucleotide
tacacatgccatgtacaacatgaggggctgc

SEQ ID NO: 40629 - DNA, 30 bp, Artificial Sequence
  Description of Artificial Sequence: Synthetic oligonucleotide
acacatgccatgtacaacatgaggggctgc

SEQ ID NO: 40630 - DNA, 29 bp, Artificial Sequence
  Description of Artificial Sequence: Synthetic oligonucleotide
cacatgccatgtacaacatgaggggctgc

SEQ ID NO: 40631 - DNA, 29 bp, Artificial Sequence
  Description of Artificial Sequence: Synthetic oligonucleotide
acatgccatgtacaacatgaggggctgcc

SEQ ID NO: 40632 - DNA, 28 bp, Artificial Sequence
  Description of Artificial Sequence: Synthetic oligonucleotide
catgccatgtacaacatgaggggctgcc

SEQ ID NO: 40633 - DNA, 28 bp, Artificial Sequence
  Description of Artificial Sequence: Synthetic oligonucleotide
atgccatgtacaacatgaggggctgccg

SEQ ID NO: 40634 - DNA, 27 bp, Artificial Sequence
  Description of Artificial Sequence: Synthetic oligonucleotide
tgccatgtacaacatgaggggctgccg

SEQ ID NO: 40635 - DNA, 27 bp, Artificial Sequence
  Description of Artificial Sequence: Synthetic oligonucleotide
gccatgtacaacatgaggggctgccga

SEQ ID NO: 40636 - DNA, 28 bp, Artificial Sequence
  Description of Artificial Sequence: Synthetic oligonucleotide
ccatgtacaacatgaggggctgccgaag

SEQ ID NO: 40637 - DNA, 28 bp, Artificial Sequence
  Description of Artificial Sequence: Synthetic oligonucleotide
catgtacaacatgaggggctgccgaagc

SEQ ID NO: 40638 - DNA, 28 bp, Artificial Sequence
  Description of Artificial Sequence: Synthetic oligonucleotide
atgtacaacatgaggggctgccgaagcc

SEQ ID NO: 40639 - DNA, 27 bp, Artificial Sequence
  Description of Artificial Sequence: Synthetic oligonucleotide
tgtacaacatgaggggctgccgaagcc

SEQ ID NO: 40640 - DNA, 26 bp, Artificial Sequence
  Description of Artificial Sequence: Synthetic oligonucleotide
gtacaacatgaggggctgccgaagcc

SEQ ID NO: 40641 - DNA, 26 bp, Artificial Sequence
  Description of Artificial Sequence: Synthetic oligonucleotide
tacaacatgaggggctgccgaagccc

SEQ ID NO: 40642 - DNA, 25 bp, Artificial Sequence
  Description of Artificial Sequence: Synthetic oligonucleotide
acaacatgaggggctgccgaagccc

SEQ ID NO: 40643 - DNA, 24 bp, Artificial Sequence
  Description of Artificial Sequence: Synthetic oligonucleotide
caacatgaggggctgccgaagccc

SEQ ID NO: 40644 - DNA, 25 bp, Artificial Sequence
  Description of Artificial Sequence: Synthetic oligonucleotide
aacatgaggggctgccgaagcccct

SEQ ID NO: 40645 - DNA, 24 bp, Artificial Sequence
  Description of Artificial Sequence: Synthetic oligonucleotide
acatgaggggctgccgaagcccct

SEQ ID NO: 40646 - DNA, 26 bp, Artificial Sequence
  Description of Artificial Sequence: Synthetic oligonucleotide
gcagctgtggtggtgccttctggaga

SEQ ID NO: 40647 - DNA, 26 bp, Artificial Sequence
  Description of Artificial Sequence: Synthetic oligonucleotide
cagctgtggtggtgccttctggagag

SEQ ID NO: 40648 - DNA, 27 bp, Artificial Sequence
  Description of Artificial Sequence: Synthetic oligonucleotide
agctgtggtggtgccttctggagagga

SEQ ID NO: 40649 - DNA, 31 bp, Artificial Sequence
  Description of Artificial Sequence: Synthetic oligonucleotide
tgccttctggagaggagcagagatacacatg

SEQ ID NO: 40650 - DNA, 30 bp, Artificial Sequence
  Description of Artificial Sequence: Synthetic oligonucleotide
gccttctggagaggagcagagatacacatg

SEQ ID NO: 40651 - DNA, 30 bp, Artificial Sequence
  Description of Artificial Sequence: Synthetic oligonucleotide
ccttctggagaggagcagagatacacatgc

SEQ ID NO: 40652 - DNA, 30 bp, Artificial Sequence
  Description of Artificial Sequence: Synthetic oligonucleotide
cttctggagaggagcagagatacacatgcc

SEQ ID NO: 40653 - DNA, 32 bp, Artificial Sequence
  Description of Artificial Sequence: Synthetic oligonucleotide
ttctggagaggagcagagatacacatgccatg

SEQ ID NO: 40654 - DNA, 31 bp, Artificial Sequence
  Description of Artificial Sequence: Synthetic oligonucleotide
tctggagaggagcagagatacacatgccatg

SEQ ID NO: 40655 - DNA, 30 bp, Artificial Sequence
  Description of Artificial Sequence: Synthetic oligonucleotide
ctggagaggagcagagatacacatgccatg

SEQ ID NO: 40656 - DNA, 32 bp, Artificial Sequence
  Description of Artificial Sequence: Synthetic oligonucleotide
tggagaggagcagagatacacatgccatgtac

SEQ ID NO: 40657 - DNA, 31 bp, Artificial Sequence
  Description of Artificial Sequence: Synthetic oligonucleotide
ggagaggagcagagatacacatgccatgtac

SEQ ID NO: 40658 - DNA, 32 bp, Artificial Sequence
  Description of Artificial Sequence: Synthetic oligonucleotide
gagaggagcagagatacacatgccatgtacag

SEQ ID NO: 40659 - DNA, 32 bp, Artificial Sequence
  Description of Artificial Sequence: Synthetic oligonucleotide
agaggagcagagatacacatgccatgtacagc

SEQ ID NO: 40660 - DNA, 31 bp, Artificial Sequence
  Description of Artificial Sequence: Synthetic oligonucleotide
gaggagcagagatacacatgccatgtacagc

SEQ ID NO: 40661 - DNA, 33 bp, Artificial Sequence
  Description of Artificial Sequence: Synthetic oligonucleotide
aggagcagagatacacatgccatgtacagcatg

SEQ ID NO: 40662 - DNA, 32 bp, Artificial Sequence
  Description of Artificial Sequence: Synthetic oligonucleotide
ggagcagagatacacatgccatgtacagcatg

SEQ ID NO: 40663 - DNA, 27 bp, Artificial Sequence
  Description of Artificial Sequence: Synthetic oligonucleotide
cctccagtggatgtatggctgcgacct

SEQ ID NO: 40664 - DNA, 27 bp, Artificial Sequence
  Description of Artificial Sequence: Synthetic oligonucleotide
ctccagtggatgtatggctgcgacctg

SEQ ID NO: 40665 - DNA, 27 bp, Artificial Sequence
  Description of Artificial Sequence: Synthetic oligonucleotide
tccagtggatgtatggctgcgacctgg

SEQ ID NO: 40666 - DNA, 26 bp, Artificial Sequence
  Description of Artificial Sequence: Synthetic oligonucleotide
ccagtggatgtatggctgcgacctgg

SEQ ID NO: 40667 - DNA, 26 bp, Artificial Sequence
  Description of Artificial Sequence: Synthetic oligonucleotide
cagtggatgtatggctgcgacctggg

SEQ ID NO: 40668 - DNA, 26 bp, Artificial Sequence
  Description of Artificial Sequence: Synthetic oligonucleotide
agtggatgtatggctgcgacctgggg

SEQ ID NO: 40669 - DNA, 25 bp, Artificial Sequence
  Description of Artificial Sequence: Synthetic oligonucleotide
gtggatgtatggctgcgacctgggg

SEQ ID NO: 40670 - DNA, 25 bp, Artificial Sequence
  Description of Artificial Sequence: Synthetic oligonucleotide
tggatgtatggctgcgacctggggc

SEQ ID NO: 40671 - DNA, 28 bp, Artificial Sequence
  Description of Artificial Sequence: Synthetic oligonucleotide
ggagtattgggacgaggagacacggaac

SEQ ID NO: 40672 - DNA, 30 bp, Artificial Sequence
  Description of Artificial Sequence: Synthetic oligonucleotide
gagtattgggacgaggagacacggaacatg

SEQ ID NO: 40673 - DNA, 32 bp, Artificial Sequence
  Description of Artificial Sequence: Synthetic oligonucleotide
agtattgggacgaggagacacggaacatgaag

SEQ ID NO: 40674 - DNA, 31 bp, Artificial Sequence
  Description of Artificial Sequence: Synthetic oligonucleotide
gtattgggacgaggagacacggaacatgaag

SEQ ID NO: 40675 - DNA, 31 bp, Artificial Sequence
  Description of Artificial Sequence: Synthetic oligonucleotide
tattgggacgaggagacacggaacatgaagg

SEQ ID NO: 40676 - DNA, 30 bp, Artificial Sequence
  Description of Artificial Sequence: Synthetic oligonucleotide
attgggacgaggagacacggaacatgaagg

SEQ ID NO: 40677 - DNA, 29 bp, Artificial Sequence
  Description of Artificial Sequence: Synthetic oligonucleotide
ttgggacgaggagacacggaacatgaagg

SEQ ID NO: 40678 - DNA, 28 bp, Artificial Sequence
  Description of Artificial Sequence: Synthetic oligonucleotide
tgggacgaggagacacggaacatgaagg

SEQ ID NO: 40679 - DNA, 27 bp, Artificial Sequence
  Description of Artificial Sequence: Synthetic oligonucleotide
gggacgaggagacacggaacatgaagg

SEQ ID NO: 40680 - DNA, 27 bp, Artificial Sequence
  Description of Artificial Sequence: Synthetic oligonucleotide
ggacgaggagacacggaacatgaaggc

SEQ ID NO: 40681 - DNA, 27 bp, Artificial Sequence
  Description of Artificial Sequence: Synthetic oligonucleotide
gacgaggagacacggaacatgaaggcc

SEQ ID NO: 40682 - DNA, 28 bp, Artificial Sequence
  Description of Artificial Sequence: Synthetic oligonucleotide
acgaggagacacggaacatgaaggcctc

SEQ ID NO: 40683 - DNA, 27 bp, Artificial Sequence
  Description of Artificial Sequence: Synthetic oligonucleotide
cgaggagacacggaacatgaaggcctc

SEQ ID NO: 40684 - DNA, 27 bp, Artificial Sequence
  Description of Artificial Sequence: Synthetic oligonucleotide
gaggagacacggaacatgaaggcctcc

SEQ ID NO: 40685 - DNA, 22 bp, Artificial Sequence
  Description of Artificial Sequence: Synthetic oligonucleotide
cgcaagttggaggcggcccgtg

SEQ ID NO: 40686 - DNA, 22 bp, Artificial Sequence
  Description of Artificial Sequence: Synthetic oligonucleotide
gcaagttggaggcggcccgtgc

SEQ ID NO: 40687 - DNA, 22 bp, Artificial Sequence
  Description of Artificial Sequence: Synthetic oligonucleotide
caagttggaggcggcccgtgcg

SEQ ID NO: 40688 - DNA, 22 bp, Artificial Sequence
  Description of Artificial Sequence: Synthetic oligonucleotide
aagttggaggcggcccgtgcgg

SEQ ID NO: 40689 - DNA, 21 bp, Artificial Sequence
  Description of Artificial Sequence: Synthetic oligonucleotide
agttggaggcggcccgtgcgg

SEQ ID NO: 40690 - DNA, 20 bp, Artificial Sequence
  Description of Artificial Sequence: Synthetic oligonucleotide
gttggaggcggcccgtgcgg

SEQ ID NO: 40691 - DNA, 20 bp, Artificial Sequence
  Description of Artificial Sequence: Synthetic oligonucleotide
ttggaggcggcccgtgcggc

SEQ ID NO: 40692 - DNA, 20 bp, Artificial Sequence
  Description of Artificial Sequence: Synthetic oligonucleotide
tggaggcggcccgtgcggct

SEQ ID NO: 40693 - DNA, 30 bp, Artificial Sequence
  Description of Artificial Sequence: Synthetic oligonucleotide
gccgggtctcacatcatccagaggattatg

SEQ ID NO: 40694 - DNA, 30 bp, Artificial Sequence
  Description of Artificial Sequence: Synthetic oligonucleotide
ccgggtctcacatcatccagaggattatgg

SEQ ID NO: 40695 - DNA, 30 bp, Artificial Sequence
  Description of Artificial Sequence: Synthetic oligonucleotide
cgggtctcacatcatccagaggattatggc

SEQ ID NO: 40696 - DNA, 31 bp, Artificial Sequence
  Description of Artificial Sequence: Synthetic oligonucleotide
gggtctcacatcatccagaggattatggctg

SEQ ID NO: 40697 - DNA, 31 bp, Artificial Sequence
  Description of Artificial Sequence: Synthetic oligonucleotide
ggtctcacatcatccagaggattatggctgc

SEQ ID NO: 40698 - DNA, 31 bp, Artificial Sequence
  Description of Artificial Sequence: Synthetic oligonucleotide
gtctcacatcatccagaggattatggctgcg

SEQ ID NO: 40699 - DNA, 32 bp, Artificial Sequence
  Description of Artificial Sequence: Synthetic oligonucleotide
tctcacatcatccagaggattatggctgcgac

SEQ ID NO: 40700 - DNA, 31 bp, Artificial Sequence
  Description of Artificial Sequence: Synthetic oligonucleotide
ctcacatcatccagaggattatggctgcgac

SEQ ID NO: 40701 - DNA, 31 bp, Artificial Sequence
  Description of Artificial Sequence: Synthetic oligonucleotide
tcacatcatccagaggattatggctgcgacc

SEQ ID NO: 40702 - DNA, 30 bp, Artificial Sequence
  Description of Artificial Sequence: Synthetic oligonucleotide
cacatcatccagaggattatggctgcgacc

SEQ ID NO: 40703 - DNA, 31 bp, Artificial Sequence
  Description of Artificial Sequence: Synthetic oligonucleotide
acatcatccagaggattatggctgcgacctg

SEQ ID NO: 40704 - DNA, 30 bp, Artificial Sequence
  Description of Artificial Sequence: Synthetic oligonucleotide
catcatccagaggattatggctgcgacctg

SEQ ID NO: 40705 - DNA, 30 bp, Artificial Sequence
  Description of Artificial Sequence: Synthetic oligonucleotide
atcatccagaggattatggctgcgacctgg

SEQ ID NO: 40706 - DNA, 29 bp, Artificial Sequence
  Description of Artificial Sequence: Synthetic oligonucleotide
tcatccagaggattatggctgcgacctgg

SEQ ID NO: 40707 - DNA, 28 bp, Artificial Sequence
  Description of Artificial Sequence: Synthetic oligonucleotide
catccagaggattatggctgcgacctgg

SEQ ID NO: 40708 - DNA, 28 bp, Artificial Sequence
  Description of Artificial Sequence: Synthetic oligonucleotide
atccagaggattatggctgcgacctggg

SEQ ID NO: 40709 - DNA, 27 bp, Artificial Sequence
  Description of Artificial Sequence: Synthetic oligonucleotide
tccagaggattatggctgcgacctggg

SEQ ID NO: 40710 - DNA, 26 bp, Artificial Sequence
  Description of Artificial Sequence: Synthetic oligonucleotide
ccagaggattatggctgcgacctggg

SEQ ID NO: 40711 - DNA, 26 bp, Artificial Sequence
  Description of Artificial Sequence: Synthetic oligonucleotide
cagaggattatggctgcgacctgggg

SEQ ID NO: 40712 - DNA, 26 bp, Artificial Sequence
  Description of Artificial Sequence: Synthetic oligonucleotide
agaggattatggctgcgacctggggc

SEQ ID NO: 40713 - DNA, 25 bp, Artificial Sequence
  Description of Artificial Sequence: Synthetic oligonucleotide
gaggattatggctgcgacctggggc

SEQ ID NO: 40714 - DNA, 25 bp, Artificial Sequence
  Description of Artificial Sequence: Synthetic oligonucleotide
aggattatggctgcgacctggggcc

SEQ ID NO: 40715 - DNA, 24 bp, Artificial Sequence
  Description of Artificial Sequence: Synthetic oligonucleotide
ggattatggctgcgacctggggcc

SEQ ID NO: 40716 - DNA, 24 bp, Artificial Sequence
  Description of Artificial Sequence: Synthetic oligonucleotide
gattatggctgcgacctggggccc

SEQ ID NO: 40717 - DNA, 25 bp, Artificial Sequence
  Description of Artificial Sequence: Synthetic oligonucleotide
attatggctgcgacctggggcccga

SEQ ID NO: 40718 - DNA, 24 bp, Artificial Sequence
  Description of Artificial Sequence: Synthetic oligonucleotide
ttatggctgcgacctggggcccga

SEQ ID NO: 40719 - DNA, 30 bp, Artificial Sequence
  Description of Artificial Sequence: Synthetic oligonucleotide
acatcatccaggtgatgtatggctgcgacc

SEQ ID NO: 40720 - DNA, 29 bp, Artificial Sequence
  Description of Artificial Sequence: Synthetic oligonucleotide
catcatccaggtgatgtatggctgcgacc

SEQ ID NO: 40721 - DNA, 30 bp, Artificial Sequence
  Description of Artificial Sequence: Synthetic oligonucleotide
atcatccaggtgatgtatggctgcgacctg

SEQ ID NO: 40722 - DNA, 29 bp, Artificial Sequence
  Description of Artificial Sequence: Synthetic oligonucleotide
tcatccaggtgatgtatggctgcgacctg

SEQ ID NO: 40723 - DNA, 28 bp, Artificial Sequence
  Description of Artificial Sequence: Synthetic oligonucleotide
catccaggtgatgtatggctgcgacctg

SEQ ID NO: 40724 - DNA, 28 bp, Artificial Sequence
  Description of Artificial Sequence: Synthetic oligonucleotide
atccaggtgatgtatggctgcgacctgg

SEQ ID NO: 40725 - DNA, 27 bp, Artificial Sequence
  Description of Artificial Sequence: Synthetic oligonucleotide
tccaggtgatgtatggctgcgacctgg

SEQ ID NO: 40726 - DNA, 26 bp, Artificial Sequence
  Description of Artificial Sequence: Synthetic oligonucleotide
ccaggtgatgtatggctgcgacctgg

SEQ ID NO: 40727 - DNA, 26 bp, Artificial Sequence
  Description of Artificial Sequence: Synthetic oligonucleotide
caggtgatgtatggctgcgacctggg

SEQ ID NO: 40728 - DNA, 26 bp, Artificial Sequence
  Description of Artificial Sequence: Synthetic oligonucleotide
aggtgatgtatggctgcgacctgggg

SEQ ID NO: 40729 - DNA, 25 bp, Artificial Sequence
  Description of Artificial Sequence: Synthetic oligonucleotide
ggtgatgtatggctgcgacctgggg

SEQ ID NO: 40730 - DNA, 25 bp, Artificial Sequence
  Description of Artificial Sequence: Synthetic oligonucleotide
gtgatgtatggctgcgacctggggc

SEQ ID NO: 40731 - DNA, 27 bp, Artificial Sequence
  Description of Artificial Sequence: Synthetic oligonucleotide
atgaaggcctccgcgcagacttaccca

SEQ ID NO: 40732 - DNA, 26 bp, Artificial Sequence
  Description of Artificial Sequence: Synthetic oligonucleotide
tgaaggcctccgcgcagacttaccca

SEQ ID NO: 40733 - DNA, 25 bp, Artificial Sequence
  Description of Artificial Sequence: Synthetic oligonucleotide
gaaggcctccgcgcagacttaccca

SEQ ID NO: 40734 - DNA, 26 bp, Artificial Sequence
  Description of Artificial Sequence: Synthetic oligonucleotide
aaggcctccgcgcagacttacccaga

SEQ ID NO: 40735 - DNA, 25 bp, Artificial Sequence
  Description of Artificial Sequence: Synthetic oligonucleotide
aggcctccgcgcagacttacccaga

SEQ ID NO: 40736 - DNA, 24 bp, Artificial Sequence
  Description of Artificial Sequence: Synthetic oligonucleotide
ggcctccgcgcagacttacccaga

SEQ ID NO: 40737 - DNA, 26 bp, Artificial Sequence
  Description of Artificial Sequence: Synthetic oligonucleotide
gcctccgcgcagacttacccagagaa

SEQ ID NO: 40738 - DNA, 26 bp, Artificial Sequence
  Description of Artificial Sequence: Synthetic oligonucleotide
cctccgcgcagacttacccagagaac

SEQ ID NO: 40739 - DNA, 27 bp, Artificial Sequence
  Description of Artificial Sequence: Synthetic oligonucleotide
ctccgcgcagacttacccagagaacct

SEQ ID NO: 40740 - DNA, 27 bp, Artificial Sequence
  Description of Artificial Sequence: Synthetic oligonucleotide
tccgcgcagacttacccagagaacctg

SEQ ID NO: 40741 - DNA, 26 bp, Artificial Sequence
  Description of Artificial Sequence: Synthetic oligonucleotide
ccgcgcagacttacccagagaacctg

SEQ ID NO: 40742 - DNA, 26 bp, Artificial Sequence
  Description of Artificial Sequence: Synthetic oligonucleotide
cgcgcagacttacccagagaacctgc

SEQ ID NO: 40743 - DNA, 26 bp, Artificial Sequence
  Description of Artificial Sequence: Synthetic oligonucleotide
gcgcagacttacccagagaacctgcg

SEQ ID NO: 40744 - DNA, 27 bp, Artificial Sequence
  Description of Artificial Sequence: Synthetic oligonucleotide
cgcagacttacccagagaacctgcgga

SEQ ID NO: 40745 - DNA, 28 bp, Artificial Sequence
  Description of Artificial Sequence: Synthetic oligonucleotide
gcagacttacccagagaacctgcggatc

SEQ ID NO: 40746 - DNA, 28 bp, Artificial Sequence
  Description of Artificial Sequence: Synthetic oligonucleotide
cagacttacccagagaacctgcggatcg

SEQ ID NO: 40747 - DNA, 28 bp, Artificial Sequence
  Description of Artificial Sequence: Synthetic oligonucleotide
agacttacccagagaacctgcggatcgc

SEQ ID NO: 40748 - DNA, 27 bp, Artificial Sequence
  Description of Artificial Sequence: Synthetic oligonucleotide
gacttacccagagaacctgcggatcgc

SEQ ID NO: 40749 - DNA, 27 bp, Artificial Sequence
  Description of Artificial Sequence: Synthetic oligonucleotide
acttacccagagaacctgcggatcgcg

SEQ ID NO: 40750 - DNA, 26 bp, Artificial Sequence
  Description of Artificial Sequence: Synthetic oligonucleotide
cttacccagagaacctgcggatcgcg

SEQ ID NO: 40751 - DNA, 27 bp, Artificial Sequence
  Description of Artificial Sequence: Synthetic oligonucleotide
ttacccagagaacctgcggatcgcgct

SEQ ID NO: 40752 - DNA, 26 bp, Artificial Sequence
  Description of Artificial Sequence: Synthetic oligonucleotide
tacccagagaacctgcggatcgcgct

SEQ ID NO: 40753 - DNA, 25 bp, Artificial Sequence
  Description of Artificial Sequence: Synthetic oligonucleotide
acccagagaacctgcggatcgcgct

SEQ ID NO: 40754 - DNA, 24 bp, Artificial Sequence
  Description of Artificial Sequence: Synthetic oligonucleotide
cccagagaacctgcggatcgcgct

SEQ ID NO: 40755 - DNA, 24 bp, Artificial Sequence
  Description of Artificial Sequence: Synthetic oligonucleotide
ccagagaacctgcggatcgcgctc

SEQ ID NO: 40756 - DNA, 24 bp, Artificial Sequence
  Description of Artificial Sequence: Synthetic oligonucleotide
cagagaacctgcggatcgcgctcc

SEQ ID NO: 40757 - DNA, 27 bp, Artificial Sequence
  Description of Artificial Sequence: Synthetic oligonucleotide
cgcagacttaccgagagaacctgcggt

SEQ ID NO: 40758 - DNA, 27 bp, Artificial Sequence
  Description of Artificial Sequence: Synthetic oligonucleotide
gcagacttaccgagagaacctgcggtc

SEQ ID NO: 40759 - DNA, 27 bp, Artificial Sequence
  Description of Artificial Sequence: Synthetic oligonucleotide
cagacttaccgagagaacctgcggtcg

SEQ ID NO: 40760 - DNA, 27 bp, Artificial Sequence
  Description of Artificial Sequence: Synthetic oligonucleotide
agacttaccgagagaacctgcggtcgc

SEQ ID NO: 40761 - DNA, 26 bp, Artificial Sequence
  Description of Artificial Sequence: Synthetic oligonucleotide
gacttaccgagagaacctgcggtcgc

SEQ ID NO: 40762 - DNA, 26 bp, Artificial Sequence
  Description of Artificial Sequence: Synthetic oligonucleotide
acttaccgagagaacctgcggtcgcg

SEQ ID NO: 40763 - DNA, 25 bp, Artificial Sequence
  Description of Artificial Sequence: Synthetic oligonucleotide
cttaccgagagaacctgcggtcgcg

SEQ ID NO: 40764 - DNA, 26 bp, Artificial Sequence
  Description of Artificial Sequence: Synthetic oligonucleotide
ttaccgagagaacctgcggtcgcgct

SEQ ID NO: 40765 - DNA, 25 bp, Artificial Sequence
  Description of Artificial Sequence: Synthetic oligonucleotide
taccgagagaacctgcggtcgcgct

SEQ ID NO: 40766 - DNA, 24 bp, Artificial Sequence
  Description of Artificial Sequence: Synthetic oligonucleotide
accgagagaacctgcggtcgcgct

SEQ ID NO: 40767 - DNA, 23 bp, Artificial Sequence
  Description of Artificial Sequence: Synthetic oligonucleotide
ccgagagaacctgcggtcgcgct

SEQ ID NO: 40768 - DNA, 23 bp, Artificial Sequence
  Description of Artificial Sequence: Synthetic oligonucleotide
cgagagaacctgcggtcgcgctc

SEQ ID NO: 40769 - DNA, 23 bp, Artificial Sequence
  Description of Artificial Sequence: Synthetic oligonucleotide
gagagaacctgcggtcgcgctcc

SEQ ID NO: 40770 - DNA, 23 bp, Artificial Sequence
  Description of Artificial Sequence: Synthetic oligonucleotide
agagaacctgcggtcgcgctccg

SEQ ID NO: 40771 - DNA, 22 bp, Artificial Sequence
  Description of Artificial Sequence: Synthetic oligonucleotide
gagaacctgcggtcgcgctccg

SEQ ID NO: 40772 - DNA, 24 bp, Artificial Sequence
  Description of Artificial Sequence: Synthetic oligonucleotide
agaacctgcggtcgcgctccgcta

SEQ ID NO: 40773 - DNA, 23 bp, Artificial Sequence
  Description of Artificial Sequence: Synthetic oligonucleotide
gaacctgcggtcgcgctccgcta

SEQ ID NO: 40774 - DNA, 25 bp, Artificial Sequence
  Description of Artificial Sequence: Synthetic oligonucleotide
aacctgcggtcgcgctccgctacta

SEQ ID NO: 40775 - DNA, 24 bp, Artificial Sequence
  Description of Artificial Sequence: Synthetic oligonucleotide
acctgcggtcgcgctccgctacta

SEQ ID NO: 40776 - DNA, 23 bp, Artificial Sequence
  Description of Artificial Sequence: Synthetic oligonucleotide
cctgcggtcgcgctccgctacta

SEQ ID NO: 40777 - DNA, 25 bp, Artificial Sequence
  Description of Artificial Sequence: Synthetic oligonucleotide
ctgcggtcgcgctccgctactacaa

SEQ ID NO: 40778 - DNA, 25 bp, Artificial Sequence
  Description of Artificial Sequence: Synthetic oligonucleotide
tgcggtcgcgctccgctactacaac

SEQ ID NO: 40779 - DNA, 24 bp, Artificial Sequence
  Description of Artificial Sequence: Synthetic oligonucleotide
gcggtcgcgctccgctactacaac

SEQ ID NO: 40780 - DNA, 25 bp, Artificial Sequence
  Description of Artificial Sequence: Synthetic oligonucleotide
cggtcgcgctccgctactacaacca

SEQ ID NO: 40781 - DNA, 26 bp, Artificial Sequence
  Description of Artificial Sequence: Synthetic oligonucleotide
ggtcgcgctccgctactacaaccaga

SEQ ID NO: 40782 - DNA, 26 bp, Artificial Sequence
  Description of Artificial Sequence: Synthetic oligonucleotide
gtcgcgctccgctactacaaccagag

SEQ ID NO: 40783 - DNA, 27 bp, Artificial Sequence
  Description of Artificial Sequence: Synthetic oligonucleotide
cgctccgctactacaaccagagcgaga

SEQ ID NO: 40784 - DNA, 27 bp, Artificial Sequence
  Description of Artificial Sequence: Synthetic oligonucleotide
gctccgctactacaaccagagcgagac

SEQ ID NO: 40785 - DNA, 27 bp, Artificial Sequence
  Description of Artificial Sequence: Synthetic oligonucleotide
ctccgctactacaaccagagcgagacc

SEQ ID NO: 40786 - DNA, 27 bp, Artificial Sequence
  Description of Artificial Sequence: Synthetic oligonucleotide
tccgctactacaaccagagcgagaccg

SEQ ID NO: 40787 - DNA, 26 bp, Artificial Sequence
  Description of Artificial Sequence: Synthetic oligonucleotide
ccgctactacaaccagagcgagaccg

SEQ ID NO: 40788 - DNA, 26 bp, Artificial Sequence
  Description of Artificial Sequence: Synthetic oligonucleotide
cgctactacaaccagagcgagaccgg

SEQ ID NO: 40789 - DNA, 27 bp, Artificial Sequence
  Description of Artificial Sequence: Synthetic oligonucleotide
gctactacaaccagagcgagaccgggt

SEQ ID NO: 40790 - DNA, 27 bp, Artificial Sequence
  Description of Artificial Sequence: Synthetic oligonucleotide
ctactacaaccagagcgagaccgggtc

SEQ ID NO: 40791 - DNA, 28 bp, Artificial Sequence
  Description of Artificial Sequence: Synthetic oligonucleotide
tactacaaccagagcgagaccgggtctc

SEQ ID NO: 40792 - DNA, 27 bp, Artificial Sequence
  Description of Artificial Sequence: Synthetic oligonucleotide
actacaaccagagcgagaccgggtctc

SEQ ID NO: 40793 - DNA, 27 bp, Artificial Sequence
  Description of Artificial Sequence: Synthetic oligonucleotide
ctacaaccagagcgagaccgggtctca

SEQ ID NO: 40794 - DNA, 27 bp, Artificial Sequence
  Description of Artificial Sequence: Synthetic oligonucleotide
tacaaccagagcgagaccgggtctcac

SEQ ID NO: 40795 - DNA, 27 bp, Artificial Sequence
  Description of Artificial Sequence: Synthetic oligonucleotide
acaaccagagcgagaccgggtctcaca

SEQ ID NO: 40796 - DNA, 27 bp, Artificial Sequence
  Description of Artificial Sequence: Synthetic oligonucleotide
caaccagagcgagaccgggtctcacat

SEQ ID NO: 40797 - DNA, 27 bp, Artificial Sequence
  Description of Artificial Sequence: Synthetic oligonucleotide
aaccagagcgagaccgggtctcacatc

SEQ ID NO: 40798 - DNA, 27 bp, Artificial Sequence
  Description of Artificial Sequence: Synthetic oligonucleotide
accagagcgagaccgggtctcacatca

SEQ ID NO: 40799 - DNA, 27 bp, Artificial Sequence
  Description of Artificial Sequence: Synthetic oligonucleotide
ccagagcgagaccgggtctcacatcat

SEQ ID NO: 40800 - DNA, 27 bp, Artificial Sequence
  Description of Artificial Sequence: Synthetic oligonucleotide
cagagcgagaccgggtctcacatcatc

SEQ ID NO: 40801 - DNA, 27 bp, Artificial Sequence
  Description of Artificial Sequence: Synthetic oligonucleotide
agagcgagaccgggtctcacatcatcc

SEQ ID NO: 40802 - DNA, 27 bp, Artificial Sequence
  Description of Artificial Sequence: Synthetic oligonucleotide
gagcgagaccgggtctcacatcatcca

SEQ ID NO: 40803 - DNA, 27 bp, Artificial Sequence
  Description of Artificial Sequence: Synthetic oligonucleotide
agcgagaccgggtctcacatcatccag

SEQ ID NO: 40804 - DNA, 27 bp, Artificial Sequence
  Description of Artificial Sequence: Synthetic oligonucleotide
gcgagaccgggtctcacatcatccaga

SEQ ID NO: 40805 - DNA, 27 bp, Artificial Sequence
  Description of Artificial Sequence: Synthetic oligonucleotide
cgagaccgggtctcacatcatccagag

SEQ ID NO: 40806 - DNA, 27 bp, Artificial Sequence
  Description of Artificial Sequence: Synthetic oligonucleotide
gagaccgggtctcacatcatccagagg

SEQ ID NO: 40807 - DNA, 29 bp, Artificial Sequence
  Description of Artificial Sequence: Synthetic oligonucleotide
agaccgggtctcacatcatccagaggatg

SEQ ID NO: 40808 - DNA, 28 bp, Artificial Sequence
  Description of Artificial Sequence: Synthetic oligonucleotide
gaccgggtctcacatcatccagaggatg

SEQ ID NO: 40809 - DNA, 31 bp, Artificial Sequence
  Description of Artificial Sequence: Synthetic oligonucleotide
accgggtctcacatcatccagaggatgtatg

SEQ ID NO: 40810 - DNA, 24 bp, Artificial Sequence
  Description of Artificial Sequence: Synthetic oligonucleotide
ggcatgaccagtccgcctacgacc

SEQ ID NO: 40811 - DNA, 24 bp, Artificial Sequence
  Description of Artificial Sequence: Synthetic oligonucleotide
gcatgaccagtccgcctacgaccg

SEQ ID NO: 40812 - DNA, 26 bp, Artificial Sequence
  Description of Artificial Sequence: Synthetic oligonucleotide
catgaccagtccgcctacgaccgcaa

SEQ ID NO: 40813 - DNA, 26 bp, Artificial Sequence
  Description of Artificial Sequence: Synthetic oligonucleotide
atgaccagtccgcctacgaccgcaag

SEQ ID NO: 40814 - DNA, 25 bp, Artificial Sequence
  Description of Artificial Sequence: Synthetic oligonucleotide
tgaccagtccgcctacgaccgcaag

SEQ ID NO: 40815 - DNA, 24 bp, Artificial Sequence
  Description of Artificial Sequence: Synthetic oligonucleotide
gaccagtccgcctacgaccgcaag

SEQ ID NO: 40816 - DNA, 27 bp, Artificial Sequence
  Description of Artificial Sequence: Synthetic oligonucleotide
accagtccgcctacgaccgcaaggatt

SEQ ID NO: 40817 - DNA, 27 bp, Artificial Sequence
  Description of Artificial Sequence: Synthetic oligonucleotide
ccagtccgcctacgaccgcaaggatta

SEQ ID NO: 40818 - DNA, 27 bp, Artificial Sequence
  Description of Artificial Sequence: Synthetic oligonucleotide
cagtccgcctacgaccgcaaggattac

SEQ ID NO: 40819 - DNA, 29 bp, Artificial Sequence
  Description of Artificial Sequence: Synthetic oligonucleotide
agtccgcctacgaccgcaaggattacatc

SEQ ID NO: 40820 - DNA, 28 bp, Artificial Sequence
  Description of Artificial Sequence: Synthetic oligonucleotide
gtccgcctacgaccgcaaggattacatc

SEQ ID NO: 40821 - DNA, 28 bp, Artificial Sequence
  Description of Artificial Sequence: Synthetic oligonucleotide
tccgcctacgaccgcaaggattacatcg

SEQ ID NO: 40822 - DNA, 27 bp, Artificial Sequence
  Description of Artificial Sequence: Synthetic oligonucleotide
ccgcctacgaccgcaaggattacatcg

SEQ ID NO: 40823 - DNA, 24 bp, Artificial Sequence
  Description of Artificial Sequence: Synthetic oligonucleotide
ggcgccatggatagagcaggaggc

SEQ ID NO: 40824 - DNA, 24 bp, Artificial Sequence
  Description of Artificial Sequence: Synthetic oligonucleotide
gcgccatggatagagcaggaggcg

SEQ ID NO: 40825 - DNA, 24 bp, Artificial Sequence
  Description of Artificial Sequence: Synthetic oligonucleotide
cgccatggatagagcaggaggcgc

SEQ ID NO: 40826 - DNA, 24 bp, Artificial Sequence
  Description of Artificial Sequence: Synthetic oligonucleotide
gccatggatagagcaggaggcgcc

SEQ ID NO: 40827 - DNA, 24 bp, Artificial Sequence
  Description of Artificial Sequence: Synthetic oligonucleotide
ccatggatagagcaggaggcgccg

SEQ ID NO: 40828 - DNA, 25 bp, Artificial Sequence
  Description of Artificial Sequence: Synthetic oligonucleotide
catggatagagcaggaggcgccgga

SEQ ID NO: 40829 - DNA, 27 bp, Artificial Sequence
  Description of Artificial Sequence: Synthetic oligonucleotide
atggatagagcaggaggcgccggagta

SEQ ID NO: 40830 - DNA, 27 bp, Artificial Sequence
  Description of Artificial Sequence: Synthetic oligonucleotide
tggatagagcaggaggcgccggagtat

SEQ ID NO: 40831 - DNA, 27 bp, Artificial Sequence
  Description of Artificial Sequence: Synthetic oligonucleotide
ggatagagcaggaggcgccggagtatt

SEQ ID NO: 40832 - DNA, 27 bp, Artificial Sequence
  Description of Artificial Sequence: Synthetic oligonucleotide
gatagagcaggaggcgccggagtattg

SEQ ID NO: 40833 - DNA, 27 bp, Artificial Sequence
  Description of Artificial Sequence: Synthetic oligonucleotide
atagagcaggaggcgccggagtattgg

SEQ ID NO: 40834 - DNA, 26 bp, Artificial Sequence
  Description of Artificial Sequence: Synthetic oligonucleotide
tagagcaggaggcgccggagtattgg

SEQ ID NO: 40835 - DNA, 25 bp, Artificial Sequence
  Description of Artificial Sequence: Synthetic oligonucleotide
agagcaggaggcgccggagtattgg

SEQ ID NO: 40836 - DNA, 24 bp, Artificial Sequence
  Description of Artificial Sequence: Synthetic oligonucleotide
gagcaggaggcgccggagtattgg

SEQ ID NO: 40837 - DNA, 25 bp, Artificial Sequence
  Description of Artificial Sequence: Synthetic oligonucleotide
agcaggaggcgccggagtattggga

SEQ ID NO: 40838 - DNA, 24 bp, Artificial Sequence
  Description of Artificial Sequence: Synthetic oligonucleotide
gcaggaggcgccggagtattggga

SEQ ID NO: 40839 - DNA, 24 bp, Artificial Sequence
  Description of Artificial Sequence: Synthetic oligonucleotide
caggaggcgccggagtattgggac

SEQ ID NO: 40840 - DNA, 24 bp, Artificial Sequence
  Description of Artificial Sequence: Synthetic oligonucleotide
aggaggcgccggagtattgggacg

SEQ ID NO: 40841 - DNA, 23 bp, Artificial Sequence
  Description of Artificial Sequence: Synthetic oligonucleotide
ggaggcgccggagtattgggacg

SEQ ID NO: 40842 - DNA, 23 bp, Artificial Sequence
  Description of Artificial Sequence: Synthetic oligonucleotide
gaggcgccggagtattgggacgg

SEQ ID NO: 40843 - DNA, 23 bp, Artificial Sequence
  Description of Artificial Sequence: Synthetic oligonucleotide
aggcgccggagtattgggacggg

SEQ ID NO: 40844 - DNA, 22 bp, Artificial Sequence
  Description of Artificial Sequence: Synthetic oligonucleotide
ggcgccggagtattgggacggg

SEQ ID NO: 40845 - DNA, 23 bp, Artificial Sequence
  Description of Artificial Sequence: Synthetic oligonucleotide
gcgccggagtattgggacgggga

SEQ ID NO: 40846 - DNA, 24 bp, Artificial Sequence
  Description of Artificial Sequence: Synthetic oligonucleotide
cgccggagtattgggacggggaga

SEQ ID NO: 40847 - DNA, 27 bp, Artificial Sequence
  Description of Artificial Sequence: Synthetic oligonucleotide
atagagcaggaggggccggagtattgc

SEQ ID NO: 40848 - DNA, 26 bp, Artificial Sequence
  Description of Artificial Sequence: Synthetic oligonucleotide
tagagcaggaggggccggagtattgc

SEQ ID NO: 40849 - DNA, 25 bp, Artificial Sequence
  Description of Artificial Sequence: Synthetic oligonucleotide
agagcaggaggggccggagtattgc

SEQ ID NO: 40850 - DNA, 24 bp, Artificial Sequence
  Description of Artificial Sequence: Synthetic oligonucleotide
gagcaggaggggccggagtattgc

SEQ ID NO: 40851 - DNA, 25 bp, Artificial Sequence
  Description of Artificial Sequence: Synthetic oligonucleotide
agcaggaggggccggagtattgcga

SEQ ID NO: 40852 - DNA, 24 bp, Artificial Sequence
  Description of Artificial Sequence: Synthetic oligonucleotide
gcaggaggggccggagtattgcga

SEQ ID NO: 40853 - DNA, 24 bp, Artificial Sequence
  Description of Artificial Sequence: Synthetic oligonucleotide
caggaggggccggagtattgcgac

SEQ ID NO: 40854 - DNA, 24 bp, Artificial Sequence
  Description of Artificial Sequence: Synthetic oligonucleotide
aggaggggccggagtattgcgacg

SEQ ID NO: 40855 - DNA, 23 bp, Artificial Sequence
  Description of Artificial Sequence: Synthetic oligonucleotide
ggaggggccggagtattgcgacg

SEQ ID NO: 40856 - DNA, 23 bp, Artificial Sequence
  Description of Artificial Sequence: Synthetic oligonucleotide
gaggggccggagtattgcgacgg

SEQ ID NO: 40857 - DNA, 23 bp, Artificial Sequence
  Description of Artificial Sequence: Synthetic oligonucleotide
aggggccggagtattgcgacggg

SEQ ID NO: 40858 - DNA, 22 bp, Artificial Sequence
  Description of Artificial Sequence: Synthetic oligonucleotide
ggggccggagtattgcgacggg

SEQ ID NO: 40859 - DNA, 23 bp, Artificial Sequence
  Description of Artificial Sequence: Synthetic oligonucleotide
gggccggagtattgcgacgggga

SEQ ID NO: 40860 - DNA, 24 bp, Artificial Sequence
  Description of Artificial Sequence: Synthetic oligonucleotide
ggccggagtattgcgacggggaga

SEQ ID NO: 40861 - DNA, 25 bp, Artificial Sequence
  Description of Artificial Sequence: Synthetic oligonucleotide
gccggagtattgcgacggggagaca

SEQ ID NO: 40862 - DNA, 25 bp, Artificial Sequence
  Description of Artificial Sequence: Synthetic oligonucleotide
ccggagtattgcgacggggagacac

SEQ ID NO: 40863 - DNA, 25 bp, Artificial Sequence
  Description of Artificial Sequence: Synthetic oligonucleotide
cggagtattgcgacggggagacacg

SEQ ID NO: 40864 - DNA, 27 bp, Artificial Sequence
  Description of Artificial Sequence: Synthetic oligonucleotide
ggagtattgcgacggggagacacggaa

SEQ ID NO: 40865 - DNA, 27 bp, Artificial Sequence
  Description of Artificial Sequence: Synthetic oligonucleotide
gagtattgcgacggggagacacggaac

SEQ ID NO: 40866 - DNA, 29 bp, Artificial Sequence
  Description of Artificial Sequence: Synthetic oligonucleotide
agtattgcgacggggagacacggaacatg

SEQ ID NO: 40867 - DNA, 28 bp, Artificial Sequence
  Description of Artificial Sequence: Synthetic oligonucleotide
gtattgcgacggggagacacggaacatg

SEQ ID NO: 40868 - DNA, 30 bp, Artificial Sequence
  Description of Artificial Sequence: Synthetic oligonucleotide
tattgcgacggggagacacggaacatgaag

SEQ ID NO: 40869 - DNA, 29 bp, Artificial Sequence
  Description of Artificial Sequence: Synthetic oligonucleotide
attgcgacggggagacacggaacatgaag

SEQ ID NO: 40870 - DNA, 28 bp, Artificial Sequence
  Description of Artificial Sequence: Synthetic oligonucleotide
ttgcgacggggagacacggaacatgaag

SEQ ID NO: 40871 - DNA, 27 bp, Artificial Sequence
  Description of Artificial Sequence: Synthetic oligonucleotide
tgcgacggggagacacggaacatgaag

SEQ ID NO: 40872 - DNA, 26 bp, Artificial Sequence
  Description of Artificial Sequence: Synthetic oligonucleotide
gcgacggggagacacggaacatgaag

SEQ ID NO: 40873 - DNA, 26 bp, Artificial Sequence
  Description of Artificial Sequence: Synthetic oligonucleotide
cgacggggagacacggaacatgaagg

SEQ ID NO: 40874 - DNA, 25 bp, Artificial Sequence
  Description of Artificial Sequence: Synthetic oligonucleotide
cggagcagctgagagcctacctgca

SEQ ID NO: 40875 - DNA, 25 bp, Artificial Sequence
  Description of Artificial Sequence: Synthetic oligonucleotide
ggagcagctgagagcctacctgcag

SEQ ID NO: 40876 - DNA, 25 bp, Artificial Sequence
  Description of Artificial Sequence: Synthetic oligonucleotide
gagcagctgagagcctacctgcagg

SEQ ID NO: 40877 - DNA, 25 bp, Artificial Sequence
  Description of Artificial Sequence: Synthetic oligonucleotide
agcagctgagagcctacctgcaggg

SEQ ID NO: 40878 - DNA, 24 bp, Artificial Sequence
  Description of Artificial Sequence: Synthetic oligonucleotide
gcagctgagagcctacctgcaggg

SEQ ID NO: 40879 - DNA, 25 bp, Artificial Sequence
  Description of Artificial Sequence: Synthetic oligonucleotide
cagctgagagcctacctgcagggca

SEQ ID NO: 40880 - DNA, 25 bp, Artificial Sequence
  Description of Artificial Sequence: Synthetic oligonucleotide
agctgagagcctacctgcagggcac

SEQ ID NO: 40881 - DNA, 24 bp, Artificial Sequence
  Description of Artificial Sequence: Synthetic oligonucleotide
gctgagagcctacctgcagggcac

SEQ ID NO: 40882 - DNA, 25 bp, Artificial Sequence
  Description of Artificial Sequence: Synthetic oligonucleotide
ctgagagcctacctgcagggcacgt

SEQ ID NO: 40883 - DNA, 25 bp, Artificial Sequence
  Description of Artificial Sequence: Synthetic oligonucleotide
tgagagcctacctgcagggcacgtg

SEQ ID NO: 40884 - DNA, 24 bp, Artificial Sequence
  Description of Artificial Sequence: Synthetic oligonucleotide
gagagcctacctgcagggcacgtg

SEQ ID NO: 40885 - DNA, 24 bp, Artificial Sequence
  Description of Artificial Sequence: Synthetic oligonucleotide
agagcctacctgcagggcacgtgc

SEQ ID NO: 40886 - DNA, 23 bp, Artificial Sequence
  Description of Artificial Sequence: Synthetic oligonucleotide
gagcctacctgcagggcacgtgc

SEQ ID NO: 40887 - DNA, 24 bp, Artificial Sequence
  Description of Artificial Sequence: Synthetic oligonucleotide
agcctacctgcagggcacgtgcgt

SEQ ID NO: 40888 - DNA, 23 bp, Artificial Sequence
  Description of Artificial Sequence: Synthetic oligonucleotide
gcctacctgcagggcacgtgcgt

SEQ ID NO: 40889 - DNA, 23 bp, Artificial Sequence
  Description of Artificial Sequence: Synthetic oligonucleotide
cctacctgcagggcacgtgcgtg

SEQ ID NO: 40890 - DNA, 24 bp, Artificial Sequence
  Description of Artificial Sequence: Synthetic oligonucleotide
ctacctgcagggcacgtgcgtgga

SEQ ID NO: 40891 - DNA, 25 bp, Artificial Sequence
  Description of Artificial Sequence: Synthetic oligonucleotide
tacctgcagggcacgtgcgtggagt

SEQ ID NO: 40892 - DNA, 24 bp, Artificial Sequence
  Description of Artificial Sequence: Synthetic oligonucleotide
acctgcagggcacgtgcgtggagt

SEQ ID NO: 40893 - DNA, 23 bp, Artificial Sequence
  Description of Artificial Sequence: Synthetic oligonucleotide
cctgcagggcacgtgcgtggagt

SEQ ID NO: 40894 - DNA, 23 bp, Artificial Sequence
  Description of Artificial Sequence: Synthetic oligonucleotide
ctgcagggcacgtgcgtggagtg

SEQ ID NO: 40895 - DNA, 23 bp, Artificial Sequence
  Description of Artificial Sequence: Synthetic oligonucleotide
tgcagggcacgtgcgtggagtgg

SEQ ID NO: 40896 - DNA, 22 bp, Artificial Sequence
  Description of Artificial Sequence: Synthetic oligonucleotide
gcagggcacgtgcgtggagtgg

SEQ ID NO: 40897 - DNA, 23 bp, Artificial Sequence
  Description of Artificial Sequence: Synthetic oligonucleotide
cagggcacgtgcgtggagtggct

SEQ ID NO: 40898 - DNA, 32 bp, Artificial Sequence
  Description of Artificial Sequence: Synthetic oligonucleotide
cggaatattgggaccggaacacacagatctac

SEQ ID NO: 40899 - DNA, 34 bp, Artificial Sequence
  Description of Artificial Sequence: Synthetic oligonucleotide
ggaatattgggaccggaacacacagatctacaag

SEQ ID NO: 40900 - DNA, 34 bp, Artificial Sequence
  Description of Artificial Sequence: Synthetic oligonucleotide
gaatattgggaccggaacacacagatctacaagg

SEQ ID NO: 40901 - DNA, 34 bp, Artificial Sequence
  Description of Artificial Sequence: Synthetic oligonucleotide
aatattgggaccggaacacacagatctacaaggc

SEQ ID NO: 40902 - DNA, 33 bp, Artificial Sequence
  Description of Artificial Sequence: Synthetic oligonucleotide
atattgggaccggaacacacagatctacaaggc

SEQ ID NO: 40903 - DNA, 24 bp, Artificial Sequence
  Description of Artificial Sequence: Synthetic oligonucleotide
gacagcgacgccgcgagtccaaga

SEQ ID NO: 40904 - DNA, 24 bp, Artificial Sequence
  Description of Artificial Sequence: Synthetic oligonucleotide
acagcgacgccgcgagtccaagag

SEQ ID NO: 40905 - DNA, 23 bp, Artificial Sequence
  Description of Artificial Sequence: Synthetic oligonucleotide
cagcgacgccgcgagtccaagag

SEQ ID NO: 40906 - DNA, 23 bp, Artificial Sequence
  Description of Artificial Sequence: Synthetic oligonucleotide
agcgacgccgcgagtccaagagg

SEQ ID NO: 40907 - DNA, 22 bp, Artificial Sequence
  Description of Artificial Sequence: Synthetic oligonucleotide
gcgacgccgcgagtccaagagg

SEQ ID NO: 40908 - DNA, 22 bp, Artificial Sequence
  Description of Artificial Sequence: Synthetic oligonucleotide
cgacgccgcgagtccaagaggg

SEQ ID NO: 40909 - DNA, 23 bp, Artificial Sequence
  Description of Artificial Sequence: Synthetic oligonucleotide
gacgccgcgagtccaagagggga

SEQ ID NO: 40910 - DNA, 23 bp, Artificial Sequence
  Description of Artificial Sequence: Synthetic oligonucleotide
acgccgcgagtccaagaggggag

SEQ ID NO: 40911 - DNA, 22 bp, Artificial Sequence
  Description of Artificial Sequence: Synthetic oligonucleotide
cgccgcgagtccaagaggggag

SEQ ID NO: 40912 - DNA, 22 bp, Artificial Sequence
  Description of Artificial Sequence: Synthetic oligonucleotide
gccgcgagtccaagaggggagc

SEQ ID NO: 40913 - DNA, 22 bp, Artificial Sequence
  Description of Artificial Sequence: Synthetic oligonucleotide
ccgcgagtccaagaggggagcc

SEQ ID NO: 40914 - DNA, 22 bp, Artificial Sequence
  Description of Artificial Sequence: Synthetic oligonucleotide
cgcgagtccaagaggggagccg

SEQ ID NO: 40915 - DNA, 22 bp, Artificial Sequence
  Description of Artificial Sequence: Synthetic oligonucleotide
gcgagtccaagaggggagccgc

SEQ ID NO: 40916 - DNA, 22 bp, Artificial Sequence
  Description of Artificial Sequence: Synthetic oligonucleotide
cgagtccaagaggggagccgcg

SEQ ID NO: 40917 - DNA, 22 bp, Artificial Sequence
  Description of Artificial Sequence: Synthetic oligonucleotide
gagtccaagaggggagccgcgg

SEQ ID NO: 40918 - DNA, 22 bp, Artificial Sequence
  Description of Artificial Sequence: Synthetic oligonucleotide
agtccaagaggggagccgcggg

SEQ ID NO: 40919 - DNA, 21 bp, Artificial Sequence
  Description of Artificial Sequence: Synthetic oligonucleotide
gtccaagaggggagccgcggg

SEQ ID NO: 40920 - DNA, 21 bp, Artificial Sequence
  Description of Artificial Sequence: Synthetic oligonucleotide
tccaagaggggagccgcgggc

SEQ ID NO: 40921 - DNA, 20 bp, Artificial Sequence
  Description of Artificial Sequence: Synthetic oligonucleotide
ccaagaggggagccgcgggc

SEQ ID NO: 40922 - DNA, 20 bp, Artificial Sequence
  Description of Artificial Sequence: Synthetic oligonucleotide
caagaggggagccgcgggcg

SEQ ID NO: 40923 - DNA, 20 bp, Artificial Sequence
  Description of Artificial Sequence: Synthetic oligonucleotide
aagaggggagccgcgggcgc

SEQ ID NO: 40924 - DNA, 29 bp, Artificial Sequence
  Description of Artificial Sequence: Synthetic oligonucleotide
accggaacacacagatctgcaaggccaag

SEQ ID NO: 40925 - DNA, 28 bp, Artificial Sequence
  Description of Artificial Sequence: Synthetic oligonucleotide
ccggaacacacagatctgcaaggccaag

SEQ ID NO: 40926 - DNA, 28 bp, Artificial Sequence
  Description of Artificial Sequence: Synthetic oligonucleotide
cggaacacacagatctgcaaggccaagg

SEQ ID NO: 40927 - DNA, 28 bp, Artificial Sequence
  Description of Artificial Sequence: Synthetic oligonucleotide
ggaacacacagatctgcaaggccaaggc

SEQ ID NO: 40928 - DNA, 29 bp, Artificial Sequence
  Description of Artificial Sequence: Synthetic oligonucleotide
gaacacacagatctgcaaggccaaggcac

SEQ ID NO: 40929 - DNA, 30 bp, Artificial Sequence
  Description of Artificial Sequence: Synthetic oligonucleotide
aacacacagatctgcaaggccaaggcacag

SEQ ID NO: 40930 - DNA, 29 bp, Artificial Sequence
  Description of Artificial Sequence: Synthetic oligonucleotide
acacacagatctgcaaggccaaggcacag

SEQ ID NO: 40931 - DNA, 28 bp, Artificial Sequence
  Description of Artificial Sequence: Synthetic oligonucleotide
cacacagatctgcaaggccaaggcacag

SEQ ID NO: 40932 - DNA, 27 bp, Artificial Sequence
  Description of Artificial Sequence: Synthetic oligonucleotide
caaggccaaggcacagactgaccgagt

SEQ ID NO: 40933 - DNA, 27 bp, Artificial Sequence
  Description of Artificial Sequence: Synthetic oligonucleotide
aaggccaaggcacagactgaccgagtg

SEQ ID NO: 40934 - DNA, 26 bp, Artificial Sequence
  Description of Artificial Sequence: Synthetic oligonucleotide
aggccaaggcacagactgaccgagtg

SEQ ID NO: 40935 - DNA, 25 bp, Artificial Sequence
  Description of Artificial Sequence: Synthetic oligonucleotide
ggccaaggcacagactgaccgagtg

SEQ ID NO: 40936 - DNA, 25 bp, Artificial Sequence
  Description of Artificial Sequence: Synthetic oligonucleotide
gccaaggcacagactgaccgagtgg

SEQ ID NO: 40937 - DNA, 25 bp, Artificial Sequence
  Description of Artificial Sequence: Synthetic oligonucleotide
ccaaggcacagactgaccgagtggg

SEQ ID NO: 40938 - DNA, 25 bp, Artificial Sequence
  Description of Artificial Sequence: Synthetic oligonucleotide
caaggcacagactgaccgagtgggc

SEQ ID NO: 40939 - DNA, 26 bp, Artificial Sequence
  Description of Artificial Sequence: Synthetic oligonucleotide
aaggcacagactgaccgagtgggcct

SEQ ID NO: 40940 - DNA, 25 bp, Artificial Sequence
  Description of Artificial Sequence: Synthetic oligonucleotide
aggcacagactgaccgagtgggcct

SEQ ID NO: 40941 - DNA, 24 bp, Artificial Sequence
  Description of Artificial Sequence: Synthetic oligonucleotide
ggcacagactgaccgagtgggcct

SEQ ID NO: 40942 - DNA, 24 bp, Artificial Sequence
  Description of Artificial Sequence: Synthetic oligonucleotide
gcacagactgaccgagtgggcctg

SEQ ID NO: 40943 - DNA, 24 bp, Artificial Sequence
  Description of Artificial Sequence: Synthetic oligonucleotide
cacagactgaccgagtgggcctgc

SEQ ID NO: 40944 - DNA, 24 bp, Artificial Sequence
  Description of Artificial Sequence: Synthetic oligonucleotide
acagactgaccgagtgggcctgcg

SEQ ID NO: 40945 - DNA, 23 bp, Artificial Sequence
  Description of Artificial Sequence: Synthetic oligonucleotide
cagactgaccgagtgggcctgcg

SEQ ID NO: 40946 - DNA, 25 bp, Artificial Sequence
  Description of Artificial Sequence: Synthetic oligonucleotide
agactgaccgagtgggcctgcggaa

SEQ ID NO: 40947 - DNA, 24 bp, Artificial Sequence
  Description of Artificial Sequence: Synthetic oligonucleotide
gactgaccgagtgggcctgcggaa

SEQ ID NO: 40948 - DNA, 24 bp, Artificial Sequence
  Description of Artificial Sequence: Synthetic oligonucleotide
actgaccgagtgggcctgcggaac

SEQ ID NO: 40949 - DNA, 23 bp, Artificial Sequence
  Description of Artificial Sequence: Synthetic oligonucleotide
ctgaccgagtgggcctgcggaac

SEQ ID NO: 40950 - DNA, 24 bp, Artificial Sequence
  Description of Artificial Sequence: Synthetic oligonucleotide
tgaccgagtgggcctgcggaacct

SEQ ID NO: 40951 - DNA, 23 bp, Artificial Sequence
  Description of Artificial Sequence: Synthetic oligonucleotide
gaccgagtgggcctgcggaacct

SEQ ID NO: 40952 - DNA, 23 bp, Artificial Sequence
  Description of Artificial Sequence: Synthetic oligonucleotide
accgagtgggcctgcggaacctg

SEQ ID NO: 40953 - DNA, 22 bp, Artificial Sequence
  Description of Artificial Sequence: Synthetic oligonucleotide
ccgagtgggcctgcggaacctg

SEQ ID NO: 40954 - DNA, 22 bp, Artificial Sequence
  Description of Artificial Sequence: Synthetic oligonucleotide
cgagtgggcctgcggaacctgc

SEQ ID NO: 40955 - DNA, 22 bp, Artificial Sequence
  Description of Artificial Sequence: Synthetic oligonucleotide
gagtgggcctgcggaacctgcg

SEQ ID NO: 40956 - DNA, 22 bp, Artificial Sequence
  Description of Artificial Sequence: Synthetic oligonucleotide
agtgggcctgcggaacctgcgc

SEQ ID NO: 40957 - DNA, 21 bp, Artificial Sequence
  Description of Artificial Sequence: Synthetic oligonucleotide
gtgggcctgcggaacctgcgc

SEQ ID NO: 40958 - DNA, 21 bp, Artificial Sequence
  Description of Artificial Sequence: Synthetic oligonucleotide
tgggcctgcggaacctgcgcg

SEQ ID NO: 40959 - DNA, 20 bp, Artificial Sequence
  Description of Artificial Sequence: Synthetic oligonucleotide
gggcctgcggaacctgcgcg

SEQ ID NO: 40960 - DNA, 20 bp, Artificial Sequence
  Description of Artificial Sequence: Synthetic oligonucleotide
ggcctgcggaacctgcgcgg

SEQ ID NO: 40961 - DNA, 27 bp, Artificial Sequence
  Description of Artificial Sequence: Synthetic oligonucleotide
aaccagagcgaggacgggtctcacact

SEQ ID NO: 40962 - DNA, 27 bp, Artificial Sequence
  Description of Artificial Sequence: Synthetic oligonucleotide
accagagcgaggacgggtctcacactt

SEQ ID NO: 40963 - DNA, 26 bp, Artificial Sequence
  Description of Artificial Sequence: Synthetic oligonucleotide
ccagagcgaggacgggtctcacactt

SEQ ID NO: 40964 - DNA, 26 bp, Artificial Sequence
  Description of Artificial Sequence: Synthetic oligonucleotide
cagagcgaggacgggtctcacacttg

SEQ ID NO: 40965 - DNA, 26 bp, Artificial Sequence
  Description of Artificial Sequence: Synthetic oligonucleotide
agagcgaggacgggtctcacacttgg

SEQ ID NO: 40966 - DNA, 25 bp, Artificial Sequence
  Description of Artificial Sequence: Synthetic oligonucleotide
gagcgaggacgggtctcacacttgg

SEQ ID NO: 40967 - DNA, 26 bp, Artificial Sequence
  Description of Artificial Sequence: Synthetic oligonucleotide
agcgaggacgggtctcacacttggca

SEQ ID NO: 40968 - DNA, 25 bp, Artificial Sequence
  Description of Artificial Sequence: Synthetic oligonucleotide
gcgaggacgggtctcacacttggca

SEQ ID NO: 40969 - DNA, 26 bp, Artificial Sequence
  Description of Artificial Sequence: Synthetic oligonucleotide
cgaggacgggtctcacacttggcaga

SEQ ID NO: 40970 - DNA, 26 bp, Artificial Sequence
  Description of Artificial Sequence: Synthetic oligonucleotide
gaggacgggtctcacacttggcagac

SEQ ID NO: 40971 - DNA, 27 bp, Artificial Sequence
  Description of Artificial Sequence: Synthetic oligonucleotide
aggacgggtctcacacttggcagacga

SEQ ID NO: 40972 - DNA, 27 bp, Artificial Sequence
  Description of Artificial Sequence: Synthetic oligonucleotide
ggacgggtctcacacttggcagacgat

SEQ ID NO: 40973 - DNA, 27 bp, Artificial Sequence
  Description of Artificial Sequence: Synthetic oligonucleotide
gacgggtctcacacttggcagacgatg

SEQ ID NO: 40974 - DNA, 30 bp, Artificial Sequence
  Description of Artificial Sequence: Synthetic oligonucleotide
acgggtctcacacttggcagacgatgtatg

SEQ ID NO: 40975 - DNA, 30 bp, Artificial Sequence
  Description of Artificial Sequence: Synthetic oligonucleotide
acttggcagacgatgtatggctgcgacatg

SEQ ID NO: 40976 - DNA, 29 bp, Artificial Sequence
  Description of Artificial Sequence: Synthetic oligonucleotide
cttggcagacgatgtatggctgcgacatg

SEQ ID NO: 40977 - DNA, 29 bp, Artificial Sequence
  Description of Artificial Sequence: Synthetic oligonucleotide
ttggcagacgatgtatggctgcgacatgg

SEQ ID NO: 40978 - DNA, 28 bp, Artificial Sequence
  Description of Artificial Sequence: Synthetic oligonucleotide
tggcagacgatgtatggctgcgacatgg

SEQ ID NO: 40979 - DNA, 27 bp, Artificial Sequence
  Description of Artificial Sequence: Synthetic oligonucleotide
ggcagacgatgtatggctgcgacatgg

SEQ ID NO: 40980 - DNA, 27 bp, Artificial Sequence
  Description of Artificial Sequence: Synthetic oligonucleotide
gcagacgatgtatggctgcgacatggg

SEQ ID NO: 40981 - DNA, 27 bp, Artificial Sequence
  Description of Artificial Sequence: Synthetic oligonucleotide
cagacgatgtatggctgcgacatgggg

SEQ ID NO: 40982 - DNA, 27 bp, Artificial Sequence
  Description of Artificial Sequence: Synthetic oligonucleotide
agacgatgtatggctgcgacatggggc

SEQ ID NO: 40983 - DNA, 26 bp, Artificial Sequence
  Description of Artificial Sequence: Synthetic oligonucleotide
gacgatgtatggctgcgacatggggc

SEQ ID NO: 40984 - DNA, 26 bp, Artificial Sequence
  Description of Artificial Sequence: Synthetic oligonucleotide
acgatgtatggctgcgacatggggcc

SEQ ID NO: 40985 - DNA, 25 bp, Artificial Sequence
  Description of Artificial Sequence: Synthetic oligonucleotide
cgatgtatggctgcgacatggggcc

SEQ ID NO: 40986 - DNA, 25 bp, Artificial Sequence
  Description of Artificial Sequence: Synthetic oligonucleotide
gatgtatggctgcgacatggggccg

SEQ ID NO: 40987 - DNA, 26 bp, Artificial Sequence
  Description of Artificial Sequence: Synthetic oligonucleotide
atgtatggctgcgacatggggccgga

SEQ ID NO: 40988 - DNA, 25 bp, Artificial Sequence
  Description of Artificial Sequence: Synthetic oligonucleotide
tgtatggctgcgacatggggccgga

SEQ ID NO: 40989 - DNA, 24 bp, Artificial Sequence
  Description of Artificial Sequence: Synthetic oligonucleotide
gtatggctgcgacatggggccgga

SEQ ID NO: 40990 - DNA, 24 bp, Artificial Sequence
  Description of Artificial Sequence: Synthetic oligonucleotide
tatggctgcgacatggggccggac

SEQ ID NO: 40991 - DNA, 23 bp, Artificial Sequence
  Description of Artificial Sequence: Synthetic oligonucleotide
atggctgcgacatggggccggac

SEQ ID NO: 40992 - DNA, 22 bp, Artificial Sequence
  Description of Artificial Sequence: Synthetic oligonucleotide
tggctgcgacatggggccggac

SEQ ID NO: 40993 - DNA, 26 bp, Artificial Sequence
  Description of Artificial Sequence: Synthetic oligonucleotide
caggacaccgagcttgtggagaccag

SEQ ID NO: 40994 - DNA, 26 bp, Artificial Sequence
  Description of Artificial Sequence: Synthetic oligonucleotide
aggacaccgagcttgtggagaccagg

SEQ ID NO: 40995 - DNA, 25 bp, Artificial Sequence
  Description of Artificial Sequence: Synthetic oligonucleotide
ggacaccgagcttgtggagaccagg

SEQ ID NO: 40996 - DNA, 25 bp, Artificial Sequence
  Description of Artificial Sequence: Synthetic oligonucleotide
gacaccgagcttgtggagaccaggc

SEQ ID NO: 40997 - DNA, 26 bp, Artificial Sequence
  Description of Artificial Sequence: Synthetic oligonucleotide
acaccgagcttgtggagaccaggcca

SEQ ID NO: 40998 - DNA, 25 bp, Artificial Sequence
  Description of Artificial Sequence: Synthetic oligonucleotide
caccgagcttgtggagaccaggcca

SEQ ID NO: 40999 - DNA, 25 bp, Artificial Sequence
  Description of Artificial Sequence: Synthetic oligonucleotide
accgagcttgtggagaccaggccag

SEQ ID NO: 41000 - DNA, 24 bp, Artificial Sequence
  Description of Artificial Sequence: Synthetic oligonucleotide
ccgagcttgtggagaccaggccag

SEQ ID NO: 41001 - DNA, 25 bp, Artificial Sequence
  Description of Artificial Sequence: Synthetic oligonucleotide
cgagcttgtggagaccaggccagca

SEQ ID NO: 41002 - DNA, 25 bp, Artificial Sequence
  Description of Artificial Sequence: Synthetic oligonucleotide
gagcttgtggagaccaggccagcag

SEQ ID NO: 41003 - DNA, 26 bp, Artificial Sequence
  Description of Artificial Sequence: Synthetic oligonucleotide
agcttgtggagaccaggccagcagga

SEQ ID NO: 41004 - DNA, 25 bp, Artificial Sequence
  Description of Artificial Sequence: Synthetic oligonucleotide
gcttgtggagaccaggccagcagga

SEQ ID NO: 41005 - DNA, 27 bp, Artificial Sequence
  Description of Artificial Sequence: Synthetic oligonucleotide
cttgtggagaccaggccagcaggagat

SEQ ID NO: 41006 - DNA, 27 bp, Artificial Sequence
  Description of Artificial Sequence: Synthetic oligonucleotide
ttgtggagaccaggccagcaggagatg

SEQ ID NO: 41007 - DNA, 26 bp, Artificial Sequence
  Description of Artificial Sequence: Synthetic oligonucleotide
tgtggagaccaggccagcaggagatg

SEQ ID NO: 41008 - DNA, 25 bp, Artificial Sequence
  Description of Artificial Sequence: Synthetic oligonucleotide
gtggagaccaggccagcaggagatg

SEQ ID NO: 41009 - DNA, 27 bp, Artificial Sequence
  Description of Artificial Sequence: Synthetic oligonucleotide
tggagaccaggccagcaggagatggaa

SEQ ID NO: 41010 - DNA, 26 bp, Artificial Sequence
  Description of Artificial Sequence: Synthetic oligonucleotide
ggagaccaggccagcaggagatggaa

SEQ ID NO: 41011 - DNA, 26 bp, Artificial Sequence
  Description of Artificial Sequence: Synthetic oligonucleotide
gagaccaggccagcaggagatggaac

SEQ ID NO: 41012 - DNA, 27 bp, Artificial Sequence
  Description of Artificial Sequence: Synthetic oligonucleotide
agaccaggccagcaggagatggaacct

SEQ ID NO: 41013 - DNA, 27 bp, Artificial Sequence
  Description of Artificial Sequence: Synthetic oligonucleotide
gaccaggccagcaggagatggaacctt

SEQ ID NO: 41014 - DNA, 27 bp, Artificial Sequence
  Description of Artificial Sequence: Synthetic oligonucleotide
accaggccagcaggagatggaaccttc

SEQ ID NO: 41015 - DNA, 26 bp, Artificial Sequence
  Description of Artificial Sequence: Synthetic oligonucleotide
ccaggccagcaggagatggaaccttc

SEQ ID NO: 41016 - DNA, 27 bp, Artificial Sequence
  Description of Artificial Sequence: Synthetic oligonucleotide
caggccagcaggagatggaaccttcca

SEQ ID NO: 41017 - DNA, 27 bp, Artificial Sequence
  Description of Artificial Sequence: Synthetic oligonucleotide
aggccagcaggagatggaaccttccag

SEQ ID NO: 41018 - DNA, 27 bp, Artificial Sequence
  Description of Artificial Sequence: Synthetic oligonucleotide
ggccagcaggagatggaaccttccaga

SEQ ID NO: 41019 - DNA, 28 bp, Artificial Sequence
  Description of Artificial Sequence: Synthetic oligonucleotide
gccagcaggagatggaaccttccagaag

SEQ ID NO: 41020 - DNA, 27 bp, Artificial Sequence
  Description of Artificial Sequence: Synthetic oligonucleotide
gcagctgtggtggtgccttctggacaa

SEQ ID NO: 41021 - DNA, 27 bp, Artificial Sequence
  Description of Artificial Sequence: Synthetic oligonucleotide
cagctgtggtggtgccttctggacaag

SEQ ID NO: 41022 - DNA, 29 bp, Artificial Sequence
  Description of Artificial Sequence: Synthetic oligonucleotide
agctgtggtggtgccttctggacaagaac

SEQ ID NO: 41023 - DNA, 28 bp, Artificial Sequence
  Description of Artificial Sequence: Synthetic oligonucleotide
gctgtggtggtgccttctggacaagaac

SEQ ID NO: 41024 - DNA, 29 bp, Artificial Sequence
  Description of Artificial Sequence: Synthetic oligonucleotide
ctgtggtggtgccttctggacaagaacag

SEQ ID NO: 41025 - DNA, 30 bp, Artificial Sequence
  Description of Artificial Sequence: Synthetic oligonucleotide
tgtggtggtgccttctggacaagaacagag

SEQ ID NO: 41026 - DNA, 29 bp, Artificial Sequence
  Description of Artificial Sequence: Synthetic oligonucleotide
gtggtggtgccttctggacaagaacagag

SEQ ID NO: 41027 - DNA, 32 bp, Artificial Sequence
  Description of Artificial Sequence: Synthetic oligonucleotide
tggtggtgccttctggacaagaacagagatac

SEQ ID NO: 41028 - DNA, 31 bp, Artificial Sequence
  Description of Artificial Sequence: Synthetic oligonucleotide
ggtggtgccttctggacaagaacagagatac

SEQ ID NO: 41029 - DNA, 32 bp, Artificial Sequence
  Description of Artificial Sequence: Synthetic oligonucleotide
gtggtgccttctggacaagaacagagatacac

SEQ ID NO: 41030 - DNA, 32 bp, Artificial Sequence
  Description of Artificial Sequence: Synthetic oligonucleotide
tggtgccttctggacaagaacagagatacacg

SEQ ID NO: 41031 - DNA, 31 bp, Artificial Sequence
  Description of Artificial Sequence: Synthetic oligonucleotide
ggtgccttctggacaagaacagagatacacg

SEQ ID NO: 41032 - DNA, 32 bp, Artificial Sequence
  Description of Artificial Sequence: Synthetic oligonucleotide
gtgccttctggacaagaacagagatacacgtg

SEQ ID NO: 41033 - DNA, 32 bp, Artificial Sequence
  Description of Artificial Sequence: Synthetic oligonucleotide
tgccttctggacaagaacagagatacacgtgc

SEQ ID NO: 41034 - DNA, 31 bp, Artificial Sequence
  Description of Artificial Sequence: Synthetic oligonucleotide
gccttctggacaagaacagagatacacgtgc

SEQ ID NO: 41035 - DNA, 31 bp, Artificial Sequence
  Description of Artificial Sequence: Synthetic oligonucleotide
ccttctggacaagaacagagatacacgtgcc

SEQ ID NO: 41036 - DNA, 33 bp, Artificial Sequence
  Description of Artificial Sequence: Synthetic oligonucleotide
cttctggacaagaacagagatacacgtgccatg

SEQ ID NO: 41037 - DNA, 34 bp, Artificial Sequence
  Description of Artificial Sequence: Synthetic oligonucleotide
ttctggacaagaacagagatacacgtgccatgtg

SEQ ID NO: 41038 - DNA, 33 bp, Artificial Sequence
  Description of Artificial Sequence: Synthetic oligonucleotide
tctggacaagaacagagatacacgtgccatgtg

SEQ ID NO: 41039 - DNA, 32 bp, Artificial Sequence
  Description of Artificial Sequence: Synthetic oligonucleotide
ctggacaagaacagagatacacgtgccatgtg

SEQ ID NO: 41040 - DNA, 32 bp, Artificial Sequence
  Description of Artificial Sequence: Synthetic oligonucleotide
tggacaagaacagagatacacgtgccatgtgc

SEQ ID NO: 41041 - DNA, 31 bp, Artificial Sequence
  Description of Artificial Sequence: Synthetic oligonucleotide
ggacaagaacagagatacacgtgccatgtgc

SEQ ID NO: 41042 - DNA, 32 bp, Artificial Sequence
  Description of Artificial Sequence: Synthetic oligonucleotide
gacaagaacagagatacacgtgccatgtgcag

SEQ ID NO: 41043 - DNA, 32 bp, Artificial Sequence
  Description of Artificial Sequence: Synthetic oligonucleotide
acaagaacagagatacacgtgccatgtgcagc

SEQ ID NO: 41044 - DNA, 31 bp, Artificial Sequence
  Description of Artificial Sequence: Synthetic oligonucleotide
caagaacagagatacacgtgccatgtgcagc

SEQ ID NO: 41045 - DNA, 32 bp, Artificial Sequence
  Description of Artificial Sequence: Synthetic oligonucleotide
aagaacagagatacacgtgccatgtgcagcac

SEQ ID NO: 41046 - DNA, 31 bp, Artificial Sequence
  Description of Artificial Sequence: Synthetic oligonucleotide
agaacagagatacacgtgccatgtgcagcac

SEQ ID NO: 41047 - DNA, 30 bp, Artificial Sequence
  Description of Artificial Sequence: Synthetic oligonucleotide
gaacagagatacacgtgccatgtgcagcac

SEQ ID NO: 41048 - DNA, 30 bp, Artificial Sequence
  Description of Artificial Sequence: Synthetic oligonucleotide
aacagagatacacgtgccatgtgcagcacg

SEQ ID NO: 41049 - DNA, 29 bp, Artificial Sequence
  Description of Artificial Sequence: Synthetic oligonucleotide
acagagatacacgtgccatgtgcagcacg

SEQ ID NO: 41050 - DNA, 28 bp, Artificial Sequence
  Description of Artificial Sequence: Synthetic oligonucleotide
cagagatacacgtgccatgtgcagcacg

SEQ ID NO: 41051 - DNA, 29 bp, Artificial Sequence
  Description of Artificial Sequence: Synthetic oligonucleotide
agagatacacgtgccatgtgcagcacgag

SEQ ID NO: 41052 - DNA, 28 bp, Artificial Sequence
  Description of Artificial Sequence: Synthetic oligonucleotide
gagatacacgtgccatgtgcagcacgag

SEQ ID NO: 41053 - DNA, 28 bp, Artificial Sequence
  Description of Artificial Sequence: Synthetic oligonucleotide
agatacacgtgccatgtgcagcacgagg

SEQ ID NO: 41054 - DNA, 27 bp, Artificial Sequence
  Description of Artificial Sequence: Synthetic oligonucleotide
gatacacgtgccatgtgcagcacgagg

SEQ ID NO: 41055 - DNA, 27 bp, Artificial Sequence
  Description of Artificial Sequence: Synthetic oligonucleotide
atacacgtgccatgtgcagcacgaggg

SEQ ID NO: 41056 - DNA, 26 bp, Artificial Sequence
  Description of Artificial Sequence: Synthetic oligonucleotide
tacacgtgccatgtgcagcacgaggg

SEQ ID NO: 41057 - DNA, 25 bp, Artificial Sequence
  Description of Artificial Sequence: Synthetic oligonucleotide
acacgtgccatgtgcagcacgaggg

SEQ ID NO: 41058 - DNA, 24 bp, Artificial Sequence
  Description of Artificial Sequence: Synthetic oligonucleotide
cacgtgccatgtgcagcacgaggg

SEQ ID NO: 41059 - DNA, 24 bp, Artificial Sequence
  Description of Artificial Sequence: Synthetic oligonucleotide
acgtgccatgtgcagcacgagggg

SEQ ID NO: 41060 - DNA, 23 bp, Artificial Sequence
  Description of Artificial Sequence: Synthetic oligonucleotide
cgtgccatgtgcagcacgagggg

SEQ ID NO: 41061 - DNA, 24 bp, Artificial Sequence
  Description of Artificial Sequence: Synthetic oligonucleotide
gtgccatgtgcagcacgaggggct

SEQ ID NO: 41062 - DNA, 24 bp, Artificial Sequence
  Description of Artificial Sequence: Synthetic oligonucleotide
tgccatgtgcagcacgaggggctg

SEQ ID NO: 41063 - DNA, 23 bp, Artificial Sequence
  Description of Artificial Sequence: Synthetic oligonucleotide
gccatgtgcagcacgaggggctg

SEQ ID NO: 41064 - DNA, 24 bp, Artificial Sequence
  Description of Artificial Sequence: Synthetic oligonucleotide
ccatgtgcagcacgaggggctgca

SEQ ID NO: 41065 - DNA, 24 bp, Artificial Sequence
  Description of Artificial Sequence: Synthetic oligonucleotide
catgtgcagcacgaggggctgcag

SEQ ID NO: 41066 - DNA, 25 bp, Artificial Sequence
  Description of Artificial Sequence: Synthetic oligonucleotide
atgtgcagcacgaggggctgcagga

SEQ ID NO: 41067 - DNA, 24 bp, Artificial Sequence
  Description of Artificial Sequence: Synthetic oligonucleotide
tgtgcagcacgaggggctgcagga

SEQ ID NO: 41068 - DNA, 23 bp, Artificial Sequence
  Description of Artificial Sequence: Synthetic oligonucleotide
gtgcagcacgaggggctgcagga

SEQ ID NO: 41069 - DNA, 23 bp, Artificial Sequence
  Description of Artificial Sequence: Synthetic oligonucleotide
tgcagcacgaggggctgcaggag

SEQ ID NO: 41070 - DNA, 22 bp, Artificial Sequence
  Description of Artificial Sequence: Synthetic oligonucleotide
gcagcacgaggggctgcaggag

SEQ ID NO: 41071 - DNA, 22 bp, Artificial Sequence
  Description of Artificial Sequence: Synthetic oligonucleotide
cagcacgaggggctgcaggagc

SEQ ID NO: 41072 - DNA, 22 bp, Artificial Sequence
  Description of Artificial Sequence: Synthetic oligonucleotide
agcacgaggggctgcaggagcc

SEQ ID NO: 41073 - DNA, 21 bp, Artificial Sequence
  Description of Artificial Sequence: Synthetic oligonucleotide
gcacgaggggctgcaggagcc

SEQ ID NO: 41074 - DNA, 22 bp, Artificial Sequence
  Description of Artificial Sequence: Synthetic oligonucleotide
cacgaggggctgcaggagccct

SEQ ID NO: 41075 - DNA, 22 bp, Artificial Sequence
  Description of Artificial Sequence: Synthetic oligonucleotide
acgaggggctgcaggagccctg

SEQ ID NO: 41076 - DNA, 21 bp, Artificial Sequence
  Description of Artificial Sequence: Synthetic oligonucleotide
cgaggggctgcaggagccctg

SEQ ID NO: 41077 - DNA, 22 bp, Artificial Sequence
  Description of Artificial Sequence: Synthetic oligonucleotide
gaggggctgcaggagccctgca

SEQ ID NO: 41078 - DNA, 22 bp, Artificial Sequence
  Description of Artificial Sequence: Synthetic oligonucleotide
aggggctgcaggagccctgcac

SEQ ID NO: 41079 - DNA, 21 bp, Artificial Sequence
  Description of Artificial Sequence: Synthetic oligonucleotide
ggggctgcaggagccctgcac

SEQ ID NO: 41080 - DNA, 21 bp, Artificial Sequence
  Description of Artificial Sequence: Synthetic oligonucleotide
gggctgcaggagccctgcacc

SEQ ID NO: 41081 - DNA, 22 bp, Artificial Sequence
  Description of Artificial Sequence: Synthetic oligonucleotide
ggctgcaggagccctgcaccct

SEQ ID NO: 41082 - DNA, 23 bp, Artificial Sequence
  Description of Artificial Sequence: Synthetic oligonucleotide
gctgcaggagccctgcaccctga

SEQ ID NO: 41083 - DNA, 25 bp, Artificial Sequence
  Description of Artificial Sequence: Synthetic oligonucleotide
ctgcaggagccctgcaccctgagat

SEQ ID NO: 41084 - DNA, 25 bp, Artificial Sequence
  Description of Artificial Sequence: Synthetic oligonucleotide
tgcaggagccctgcaccctgagatg

SEQ ID NO: 41085 - DNA, 24 bp, Artificial Sequence
  Description of Artificial Sequence: Synthetic oligonucleotide
gcaggagccctgcaccctgagatg

SEQ ID NO: 41086 - DNA, 26 bp, Artificial Sequence
  Description of Artificial Sequence: Synthetic oligonucleotide
caggagccctgcaccctgagatggaa

SEQ ID NO: 41087 - DNA, 26 bp, Artificial Sequence
  Description of Artificial Sequence: Synthetic oligonucleotide
aggagccctgcaccctgagatggaag

SEQ ID NO: 41088 - DNA, 25 bp, Artificial Sequence
  Description of Artificial Sequence: Synthetic oligonucleotide
ggagccctgcaccctgagatggaag

SEQ ID NO: 41089 - DNA, 25 bp, Artificial Sequence
  Description of Artificial Sequence: Synthetic oligonucleotide
gagccctgcaccctgagatggaagc

SEQ ID NO: 41090 - DNA, 27 bp, Artificial Sequence
  Description of Artificial Sequence: Synthetic oligonucleotide
agccctgcaccctgagatggaagccat

SEQ ID NO: 41091 - DNA, 26 bp, Artificial Sequence
  Description of Artificial Sequence: Synthetic oligonucleotide
gccctgcaccctgagatggaagccat

SEQ ID NO: 41092 - DNA, 27 bp, Artificial Sequence
  Description of Artificial Sequence: Synthetic oligonucleotide
ccctgcaccctgagatggaagccatct

SEQ ID NO: 41093 - DNA, 28 bp, Artificial Sequence
  Description of Artificial Sequence: Synthetic oligonucleotide
cctgcaccctgagatggaagccatcttc

SEQ ID NO: 41094 - DNA, 28 bp, Artificial Sequence
  Description of Artificial Sequence: Synthetic oligonucleotide
ctgcaccctgagatggaagccatcttcc

SEQ ID NO: 41095 - DNA, 28 bp, Artificial Sequence
  Description of Artificial Sequence: Synthetic oligonucleotide
tgcaccctgagatggaagccatcttccc

SEQ ID NO: 41096 - DNA, 27 bp, Artificial Sequence
  Description of Artificial Sequence: Synthetic oligonucleotide
gcaccctgagatggaagccatcttccc

SEQ ID NO: 41097 - DNA, 28 bp, Artificial Sequence
  Description of Artificial Sequence: Synthetic oligonucleotide
caccctgagatggaagccatcttcccag

SEQ ID NO: 41098 - DNA, 29 bp, Artificial Sequence
  Description of Artificial Sequence: Synthetic oligonucleotide
accctgagatggaagccatcttcccagtc

SEQ ID NO: 41099 - DNA, 28 bp, Artificial Sequence
  Description of Artificial Sequence: Synthetic oligonucleotide
ccctgagatggaagccatcttcccagtc

SEQ ID NO: 41100 - DNA, 28 bp, Artificial Sequence
  Description of Artificial Sequence: Synthetic oligonucleotide
cctgagatggaagccatcttcccagtcc

SEQ ID NO: 41101 - DNA, 29 bp, Artificial Sequence
  Description of Artificial Sequence: Synthetic oligonucleotide
ctgagatggaagccatcttcccagtccac

SEQ ID NO: 41102 - DNA, 29 bp, Artificial Sequence
  Description of Artificial Sequence: Synthetic oligonucleotide
tgagatggaagccatcttcccagtccacc

SEQ ID NO: 41103 - DNA, 28 bp, Artificial Sequence
  Description of Artificial Sequence: Synthetic oligonucleotide
gagatggaagccatcttcccagtccacc

SEQ ID NO: 41104 - DNA, 30 bp, Artificial Sequence
  Description of Artificial Sequence: Synthetic oligonucleotide
agatggaagccatcttcccagtccaccatc

SEQ ID NO: 41105 - DNA, 29 bp, Artificial Sequence
  Description of Artificial Sequence: Synthetic oligonucleotide
gatggaagccatcttcccagtccaccatc

SEQ ID NO: 41106 - DNA, 29 bp, Artificial Sequence
  Description of Artificial Sequence: Synthetic oligonucleotide
atggaagccatcttcccagtccaccatcc

SEQ ID NO: 41107 - DNA, 28 bp, Artificial Sequence
  Description of Artificial Sequence: Synthetic oligonucleotide
tggaagccatcttcccagtccaccatcc

SEQ ID NO: 41108 - DNA, 27 bp, Artificial Sequence
  Description of Artificial Sequence: Synthetic oligonucleotide
ggaagccatcttcccagtccaccatcc

SEQ ID NO: 41109 - DNA, 27 bp, Artificial Sequence
  Description of Artificial Sequence: Synthetic oligonucleotide
gaagccatcttcccagtccaccatccc

SEQ ID NO: 41110 - DNA, 27 bp, Artificial Sequence
  Description of Artificial Sequence: Synthetic oligonucleotide
aagccatcttcccagtccaccatcccc

SEQ ID NO: 41111 - DNA, 27 bp, Artificial Sequence
  Description of Artificial Sequence: Synthetic oligonucleotide
ggcattgttgctggcctggctgtcctt

SEQ ID NO: 41112 - DNA, 27 bp, Artificial Sequence
  Description of Artificial Sequence: Synthetic oligonucleotide
gcattgttgctggcctggctgtccttg

SEQ ID NO: 41113 - DNA, 28 bp, Artificial Sequence
  Description of Artificial Sequence: Synthetic oligonucleotide
cattgttgctggcctggctgtccttgtg

SEQ ID NO: 41114 - DNA, 28 bp, Artificial Sequence
  Description of Artificial Sequence: Synthetic oligonucleotide
attgttgctggcctggctgtccttgtgg

SEQ ID NO: 41115 - DNA, 27 bp, Artificial Sequence
  Description of Artificial Sequence: Synthetic oligonucleotide
ttgttgctggcctggctgtccttgtgg

SEQ ID NO: 41116 - DNA, 27 bp, Artificial Sequence
  Description of Artificial Sequence: Synthetic oligonucleotide
tgttgctggcctggctgtccttgtggt

SEQ ID NO: 41117 - DNA, 26 bp, Artificial Sequence
  Description of Artificial Sequence: Synthetic oligonucleotide
gttgctggcctggctgtccttgtggt

SEQ ID NO: 41118 - DNA, 27 bp, Artificial Sequence
  Description of Artificial Sequence: Synthetic oligonucleotide
ttgctggcctggctgtccttgtggtca

SEQ ID NO: 41119 - DNA, 26 bp, Artificial Sequence
  Description of Artificial Sequence: Synthetic oligonucleotide
tgctggcctggctgtccttgtggtca

SEQ ID NO: 41120 - DNA, 25 bp, Artificial Sequence
  Description of Artificial Sequence: Synthetic oligonucleotide
gctggcctggctgtccttgtggtca

SEQ ID NO: 41121 - DNA, 25 bp, Artificial Sequence
  Description of Artificial Sequence: Synthetic oligonucleotide
ctggcctggctgtccttgtggtcac

SEQ ID NO: 41122 - DNA, 25 bp, Artificial Sequence
  Description of Artificial Sequence: Synthetic oligonucleotide
tggcctggctgtccttgtggtcacc

SEQ ID NO: 41123 - DNA, 24 bp, Artificial Sequence
  Description of Artificial Sequence: Synthetic oligonucleotide
ggcctggctgtccttgtggtcacc

SEQ ID NO: 41124 - DNA, 26 bp, Artificial Sequence
  Description of Artificial Sequence: Synthetic oligonucleotide
gcctggctgtccttgtggtcaccgta

SEQ ID NO: 41125 - DNA, 26 bp, Artificial Sequence
  Description of Artificial Sequence: Synthetic oligonucleotide
cctggctgtccttgtggtcaccgtag

SEQ ID NO: 41126 - DNA, 27 bp, Artificial Sequence
  Description of Artificial Sequence: Synthetic oligonucleotide
ctggctgtccttgtggtcaccgtagct

SEQ ID NO: 41127 - DNA, 27 bp, Artificial Sequence
  Description of Artificial Sequence: Synthetic oligonucleotide
tggctgtccttgtggtcaccgtagctg

SEQ ID NO: 41128 - DNA, 27 bp, Artificial Sequence
  Description of Artificial Sequence: Synthetic oligonucleotide
ggctgtccttgtggtcaccgtagctgt

SEQ ID NO: 41129 - DNA, 27 bp, Artificial Sequence
  Description of Artificial Sequence: Synthetic oligonucleotide
gctgtccttgtggtcaccgtagctgtg

SEQ ID NO: 41130 - DNA, 27 bp, Artificial Sequence
  Description of Artificial Sequence: Synthetic oligonucleotide
ctgtccttgtggtcaccgtagctgtgg

SEQ ID NO: 41131 - DNA, 28 bp, Artificial Sequence
  Description of Artificial Sequence: Synthetic oligonucleotide
tgtccttgtggtcaccgtagctgtggtc

SEQ ID NO: 41132 - DNA, 27 bp, Artificial Sequence
  Description of Artificial Sequence: Synthetic oligonucleotide
gtccttgtggtcaccgtagctgtggtc

SEQ ID NO: 41133 - DNA, 27 bp, Artificial Sequence
  Description of Artificial Sequence: Synthetic oligonucleotide
tccttgtggtcaccgtagctgtggtcg

SEQ ID NO: 41134 - DNA, 26 bp, Artificial Sequence
  Description of Artificial Sequence: Synthetic oligonucleotide
ccttgtggtcaccgtagctgtggtcg

SEQ ID NO: 41135 - DNA, 27 bp, Artificial Sequence
  Description of Artificial Sequence: Synthetic oligonucleotide
cttgtggtcaccgtagctgtggtcgct

SEQ ID NO: 41136 - DNA, 27 bp, Artificial Sequence
  Description of Artificial Sequence: Synthetic oligonucleotide
ttgtggtcaccgtagctgtggtcgctg

SEQ ID NO: 41137 - DNA, 27 bp, Artificial Sequence
  Description of Artificial Sequence: Synthetic oligonucleotide
tgtggtcaccgtagctgtggtcgctgt

SEQ ID NO: 41138 - DNA, 26 bp, Artificial Sequence
  Description of Artificial Sequence: Synthetic oligonucleotide
gtggtcaccgtagctgtggtcgctgt

SEQ ID NO: 41139 - DNA, 26 bp, Artificial Sequence
  Description of Artificial Sequence: Synthetic oligonucleotide
tggtcaccgtagctgtggtcgctgtg

SEQ ID NO: 41140 - DNA, 25 bp, Artificial Sequence
  Description of Artificial Sequence: Synthetic oligonucleotide
ggtcaccgtagctgtggtcgctgtg

SEQ ID NO: 41141 - DNA, 26 bp, Artificial Sequence
  Description of Artificial Sequence: Synthetic oligonucleotide
gtcaccgtagctgtggtcgctgtggt

SEQ ID NO: 41142 - DNA, 26 bp, Artificial Sequence
  Description of Artificial Sequence: Synthetic oligonucleotide
tcaccgtagctgtggtcgctgtggtc

SEQ ID NO: 41143 - DNA, 25 bp, Artificial Sequence
  Description of Artificial Sequence: Synthetic oligonucleotide
caccgtagctgtggtcgctgtggtc

SEQ ID NO: 41144 - DNA, 25 bp, Artificial Sequence
  Description of Artificial Sequence: Synthetic oligonucleotide
accgtagctgtggtcgctgtggtcg

SEQ ID NO: 41145 - DNA, 24 bp, Artificial Sequence
  Description of Artificial Sequence: Synthetic oligonucleotide
ccgtagctgtggtcgctgtggtcg

SEQ ID NO: 41146 - DNA, 25 bp, Artificial Sequence
  Description of Artificial Sequence: Synthetic oligonucleotide
cgtagctgtggtcgctgtggtcgct

SEQ ID NO: 41147 - DNA, 25 bp, Artificial Sequence
  Description of Artificial Sequence: Synthetic oligonucleotide
gtagctgtggtcgctgtggtcgctg

SEQ ID NO: 41148 - DNA, 26 bp, Artificial Sequence
  Description of Artificial Sequence: Synthetic oligonucleotide
tagctgtggtcgctgtggtcgctgct

SEQ ID NO: 41149 - DNA, 25 bp, Artificial Sequence
  Description of Artificial Sequence: Synthetic oligonucleotide
agctgtggtcgctgtggtcgctgct

SEQ ID NO: 41150 - DNA, 24 bp, Artificial Sequence
  Description of Artificial Sequence: Synthetic oligonucleotide
gctgtggtcgctgtggtcgctgct

SEQ ID NO: 41151 - DNA, 25 bp, Artificial Sequence
  Description of Artificial Sequence: Synthetic oligonucleotide
ctgtggtcgctgtggtcgctgctgt

SEQ ID NO: 41152 - DNA, 27 bp, Artificial Sequence
  Description of Artificial Sequence: Synthetic oligonucleotide
tgtggtcgctgtggtcgctgctgtgat

SEQ ID NO: 41153 - DNA, 26 bp, Artificial Sequence
  Description of Artificial Sequence: Synthetic oligonucleotide
gtggtcgctgtggtcgctgctgtgat

SEQ ID NO: 41154 - DNA, 27 bp, Artificial Sequence
  Description of Artificial Sequence: Synthetic oligonucleotide
tggtcgctgtggtcgctgctgtgatgt

SEQ ID NO: 41155 - DNA, 26 bp, Artificial Sequence
  Description of Artificial Sequence: Synthetic oligonucleotide
ggtcgctgtggtcgctgctgtgatgt

SEQ ID NO: 41156 - DNA, 27 bp, Artificial Sequence
  Description of Artificial Sequence: Synthetic oligonucleotide
gtcgctgtggtcgctgctgtgatgtgt

SEQ ID NO: 41157 - DNA, 28 bp, Artificial Sequence
  Description of Artificial Sequence: Synthetic oligonucleotide
tcgctgtggtcgctgctgtgatgtgtag

SEQ ID NO: 41158 - DNA, 27 bp, Artificial Sequence
  Description of Artificial Sequence: Synthetic oligonucleotide
cgctgtggtcgctgctgtgatgtgtag

SEQ ID NO: 41159 - DNA, 31 bp, Artificial Sequence
  Description of Artificial Sequence: Synthetic oligonucleotide
gctgctgtgatgtgtaggaggaagagttctg

SEQ ID NO: 41160 - DNA, 31 bp, Artificial Sequence
  Description of Artificial Sequence: Synthetic oligonucleotide
ctgctgtgatgtgtaggaggaagagttctgg

SEQ ID NO: 41161 - DNA, 32 bp, Artificial Sequence
  Description of Artificial Sequence: Synthetic oligonucleotide
tgctgtgatgtgtaggaggaagagttctggtg

SEQ ID NO: 41162 - DNA, 31 bp, Artificial Sequence
  Description of Artificial Sequence: Synthetic oligonucleotide
gctgtgatgtgtaggaggaagagttctggtg

SEQ ID NO: 41163 - DNA, 31 bp, Artificial Sequence
  Description of Artificial Sequence: Synthetic oligonucleotide
ctgtgatgtgtaggaggaagagttctggtgg

SEQ ID NO: 41164 - DNA, 35 bp, Artificial Sequence
  Description of Artificial Sequence: Synthetic oligonucleotide
tgtgatgtgtaggaggaagagttctggtggaaaag

SEQ ID NO: 41165 - DNA, 34 bp, Artificial Sequence
  Description of Artificial Sequence: Synthetic oligonucleotide
gtgatgtgtaggaggaagagttctggtggaaaag

SEQ ID NO: 41166 - DNA, 34 bp, Artificial Sequence
  Description of Artificial Sequence: Synthetic oligonucleotide
tgatgtgtaggaggaagagttctggtggaaaagg

SEQ ID NO: 41167 - DNA, 33 bp, Artificial Sequence
  Description of Artificial Sequence: Synthetic oligonucleotide
gatgtgtaggaggaagagttctggtggaaaagg

SEQ ID NO: 41168 - DNA, 34 bp, Artificial Sequence
  Description of Artificial Sequence: Synthetic oligonucleotide
atgtgtaggaggaagagttctggtggaaaaggag

SEQ ID NO: 41169 - DNA, 33 bp, Artificial Sequence
  Description of Artificial Sequence: Synthetic oligonucleotide
tgtgtaggaggaagagttctggtggaaaaggag

SEQ ID NO: 41170 - DNA, 32 bp, Artificial Sequence
  Description of Artificial Sequence: Synthetic oligonucleotide
gtgtaggaggaagagttctggtggaaaaggag

SEQ ID NO: 41171 - DNA, 32 bp, Artificial Sequence
  Description of Artificial Sequence: Synthetic oligonucleotide
tgtaggaggaagagttctggtggaaaaggagg

SEQ ID NO: 41172 - DNA, 31 bp, Artificial Sequence
  Description of Artificial Sequence: Synthetic oligonucleotide
gtaggaggaagagttctggtggaaaaggagg

SEQ ID NO: 41173 - DNA, 31 bp, Artificial Sequence
  Description of Artificial Sequence: Synthetic oligonucleotide
taggaggaagagttctggtggaaaaggaggg

SEQ ID NO: 41174 - DNA, 30 bp, Artificial Sequence
  Description of Artificial Sequence: Synthetic oligonucleotide
aggaggaagagttctggtggaaaaggaggg

SEQ ID NO: 41175 - DNA, 29 bp, Artificial Sequence
  Description of Artificial Sequence: Synthetic oligonucleotide
ggaggaagagttctggtggaaaaggaggg

SEQ ID NO: 41176 - DNA, 30 bp, Artificial Sequence
  Description of Artificial Sequence: Synthetic oligonucleotide
gaggaagagttctggtggaaaaggagggag

SEQ ID NO: 41177 - DNA, 30 bp, Artificial Sequence
  Description of Artificial Sequence: Synthetic oligonucleotide
aggaagagttctggtggaaaaggagggagc

SEQ ID NO: 41178 - DNA, 29 bp, Artificial Sequence
  Description of Artificial Sequence: Synthetic oligonucleotide
ggaagagttctggtggaaaaggagggagc

SEQ ID NO: 41179 - DNA, 31 bp, Artificial Sequence
  Description of Artificial Sequence: Synthetic oligonucleotide
gaagagttctggtggaaaaggagggagctac

SEQ ID NO: 41180 - DNA, 32 bp, Artificial Sequence
  Description of Artificial Sequence: Synthetic oligonucleotide
aagagttctggtggaaaaggagggagctactc

SEQ ID NO: 41181 - DNA, 31 bp, Artificial Sequence
  Description of Artificial Sequence: Synthetic oligonucleotide
agagttctggtggaaaaggagggagctactc

SEQ ID NO: 41182 - DNA, 30 bp, Artificial Sequence
  Description of Artificial Sequence: Synthetic oligonucleotide
gagttctggtggaaaaggagggagctactc

SEQ ID NO: 41183 - DNA, 31 bp, Artificial Sequence
  Description of Artificial Sequence: Synthetic oligonucleotide
agttctggtggaaaaggagggagctactctc

SEQ ID NO: 41184 - DNA, 30 bp, Artificial Sequence
  Description of Artificial Sequence: Synthetic oligonucleotide
gttctggtggaaaaggagggagctactctc

SEQ ID NO: 41185 - DNA, 31 bp, Artificial Sequence
  Description of Artificial Sequence: Synthetic oligonucleotide
ttctggtggaaaaggagggagctactctcag

SEQ ID NO: 41186 - DNA, 30 bp, Artificial Sequence
  Description of Artificial Sequence: Synthetic oligonucleotide
tctggtggaaaaggagggagctactctcag

SEQ ID NO: 41187 - DNA, 29 bp, Artificial Sequence
  Description of Artificial Sequence: Synthetic oligonucleotide
ctggtggaaaaggagggagctactctcag

SEQ ID NO: 41188 - DNA, 29 bp, Artificial Sequence
  Description of Artificial Sequence: Synthetic oligonucleotide
tggtggaaaaggagggagctactctcagg

SEQ ID NO: 41189 - DNA, 25 bp, Artificial Sequence
  Description of Artificial Sequence: Synthetic oligonucleotide
agtccaccgtccccatcgtgggcat

SEQ ID NO: 41190 - DNA, 25 bp, Artificial Sequence
  Description of Artificial Sequence: Synthetic oligonucleotide
cgtggatagagcaggaggggccgta

SEQ ID NO: 41191 - DNA, 27 bp, Artificial Sequence
  Description of Artificial Sequence: Synthetic oligonucleotide
gtggatagagcaggaggggccgtagta

SEQ ID NO: 41192 - DNA, 29 bp, Artificial Sequence
  Description of Artificial Sequence: Synthetic oligonucleotide
tggatagagcaggaggggccgtagtattg

SEQ ID NO: 41193 - DNA, 28 bp, Artificial Sequence
  Description of Artificial Sequence: Synthetic oligonucleotide
ggatagagcaggaggggccgtagtattg

SEQ ID NO: 41194 - DNA, 28 bp, Artificial Sequence
  Description of Artificial Sequence: Synthetic oligonucleotide
gatagagcaggaggggccgtagtattgg

SEQ ID NO: 41195 - DNA, 28 bp, Artificial Sequence
  Description of Artificial Sequence: Synthetic oligonucleotide
atagagcaggaggggccgtagtattggg

SEQ ID NO: 41196 - DNA, 27 bp, Artificial Sequence
  Description of Artificial Sequence: Synthetic oligonucleotide
tagagcaggaggggccgtagtattggg

SEQ ID NO: 41197 - DNA, 27 bp, Artificial Sequence
  Description of Artificial Sequence: Synthetic oligonucleotide
agagcaggaggggccgtagtattggga

SEQ ID NO: 41198 - DNA, 26 bp, Artificial Sequence
  Description of Artificial Sequence: Synthetic oligonucleotide
gagcaggaggggccgtagtattggga

SEQ ID NO: 41199 - DNA, 26 bp, Artificial Sequence
  Description of Artificial Sequence: Synthetic oligonucleotide
agcaggaggggccgtagtattgggac

SEQ ID NO: 41200 - DNA, 25 bp, Artificial Sequence
  Description of Artificial Sequence: Synthetic oligonucleotide
gcaggaggggccgtagtattgggac

SEQ ID NO: 41201 - DNA, 25 bp, Artificial Sequence
  Description of Artificial Sequence: Synthetic oligonucleotide
caggaggggccgtagtattgggacc

SEQ ID NO: 41202 - DNA, 25 bp, Artificial Sequence
  Description of Artificial Sequence: Synthetic oligonucleotide
aggaggggccgtagtattgggaccg

SEQ ID NO: 41203 - DNA, 24 bp, Artificial Sequence
  Description of Artificial Sequence: Synthetic oligonucleotide
ggaggggccgtagtattgggaccg

SEQ ID NO: 41204 - DNA, 26 bp, Artificial Sequence
  Description of Artificial Sequence: Synthetic oligonucleotide
gaggggccgtagtattgggaccggaa

SEQ ID NO: 41205 - DNA, 27 bp, Artificial Sequence
  Description of Artificial Sequence: Synthetic oligonucleotide
aggggccgtagtattgggaccggaaca

SEQ ID NO: 41206 - DNA, 26 bp, Artificial Sequence
  Description of Artificial Sequence: Synthetic oligonucleotide
ggggccgtagtattgggaccggaaca

SEQ ID NO: 41207 - DNA, 27 bp, Artificial Sequence
  Description of Artificial Sequence: Synthetic oligonucleotide
gggccgtagtattgggaccggaacaca

SEQ ID NO: 41208 - DNA, 27 bp, Artificial Sequence
  Description of Artificial Sequence: Synthetic oligonucleotide
ggccgtagtattgggaccggaacacac

SEQ ID NO: 41209 - DNA, 28 bp, Artificial Sequence
  Description of Artificial Sequence: Synthetic oligonucleotide
gccgtagtattgggaccggaacacacag

SEQ ID NO: 41210 - DNA, 30 bp, Artificial Sequence
  Description of Artificial Sequence: Synthetic oligonucleotide
ccgtagtattgggaccggaacacacagatc

SEQ ID NO: 41211 - DNA, 32 bp, Artificial Sequence
  Description of Artificial Sequence: Synthetic oligonucleotide
cgtagtattgggaccggaacacacagatctac

SEQ ID NO: 41212 - DNA, 34 bp, Artificial Sequence
  Description of Artificial Sequence: Synthetic oligonucleotide
gtagtattgggaccggaacacacagatctacaag

SEQ ID NO: 41213 - DNA, 34 bp, Artificial Sequence
  Description of Artificial Sequence: Synthetic oligonucleotide
tagtattgggaccggaacacacagatctacaagg

SEQ ID NO: 41214 - DNA, 33 bp, Artificial Sequence
  Description of Artificial Sequence: Synthetic oligonucleotide
tcccactccatgaggtatttctacaccgctatg

SEQ ID NO: 41215 - DNA, 32 bp, Artificial Sequence
  Description of Artificial Sequence: Synthetic oligonucleotide
cccactccatgaggtatttctacaccgctatg

SEQ ID NO: 41216 - DNA, 33 bp, Artificial Sequence
  Description of Artificial Sequence: Synthetic oligonucleotide
ccactccatgaggtatttctacaccgctatgtc

SEQ ID NO: 41217 - DNA, 33 bp, Artificial Sequence
  Description of Artificial Sequence: Synthetic oligonucleotide
cactccatgaggtatttctacaccgctatgtcc

SEQ ID NO: 41218 - DNA, 33 bp, Artificial Sequence
  Description of Artificial Sequence: Synthetic oligonucleotide
actccatgaggtatttctacaccgctatgtccc

SEQ ID NO: 41219 - DNA, 32 bp, Artificial Sequence
  Description of Artificial Sequence: Synthetic oligonucleotide
ctccatgaggtatttctacaccgctatgtccc

SEQ ID NO: 41220 - DNA, 32 bp, Artificial Sequence
  Description of Artificial Sequence: Synthetic oligonucleotide
tccatgaggtatttctacaccgctatgtcccg

SEQ ID NO: 41221 - DNA, 31 bp, Artificial Sequence
  Description of Artificial Sequence: Synthetic oligonucleotide
ccatgaggtatttctacaccgctatgtcccg

SEQ ID NO: 41222 - DNA, 31 bp, Artificial Sequence
  Description of Artificial Sequence: Synthetic oligonucleotide
catgaggtatttctacaccgctatgtcccgg

SEQ ID NO: 41223 - DNA, 31 bp, Artificial Sequence
  Description of Artificial Sequence: Synthetic oligonucleotide
atgaggtatttctacaccgctatgtcccggc

SEQ ID NO: 41224 - DNA, 30 bp, Artificial Sequence
  Description of Artificial Sequence: Synthetic oligonucleotide
tgaggtatttctacaccgctatgtcccggc

SEQ ID NO: 41225 - DNA, 29 bp, Artificial Sequence
  Description of Artificial Sequence: Synthetic oligonucleotide
gaggtatttctacaccgctatgtcccggc

SEQ ID NO: 41226 - DNA, 29 bp, Artificial Sequence
  Description of Artificial Sequence: Synthetic oligonucleotide
aggtatttctacaccgctatgtcccggcc

SEQ ID NO: 41227 - DNA, 28 bp, Artificial Sequence
  Description of Artificial Sequence: Synthetic oligonucleotide
ggtatttctacaccgctatgtcccggcc

SEQ ID NO: 41228 - DNA, 28 bp, Artificial Sequence
  Description of Artificial Sequence: Synthetic oligonucleotide
gtatttctacaccgctatgtcccggccc

SEQ ID NO: 41229 - DNA, 28 bp, Artificial Sequence
  Description of Artificial Sequence: Synthetic oligonucleotide
tatttctacaccgctatgtcccggcccg

SEQ ID NO: 41230 - DNA, 27 bp, Artificial Sequence
  Description of Artificial Sequence: Synthetic oligonucleotide
atttctacaccgctatgtcccggcccg

SEQ ID NO: 41231 - DNA, 26 bp, Artificial Sequence
  Description of Artificial Sequence: Synthetic oligonucleotide
tttctacaccgctatgtcccggcccg

SEQ ID NO: 41232 - DNA, 25 bp, Artificial Sequence
  Description of Artificial Sequence: Synthetic oligonucleotide
ttctacaccgctatgtcccggcccg

SEQ ID NO: 41233 - DNA, 24 bp, Artificial Sequence
  Description of Artificial Sequence: Synthetic oligonucleotide
tctacaccgctatgtcccggcccg

SEQ ID NO: 41234 - DNA, 23 bp, Artificial Sequence
  Description of Artificial Sequence: Synthetic oligonucleotide
ctacaccgctatgtcccggcccg

SEQ ID NO: 41235 - DNA, 23 bp, Artificial Sequence
  Description of Artificial Sequence: Synthetic oligonucleotide
tacaccgctatgtcccggcccgg

SEQ ID NO: 41236 - DNA, 22 bp, Artificial Sequence
  Description of Artificial Sequence: Synthetic oligonucleotide
acaccgctatgtcccggcccgg

SEQ ID NO: 41237 - DNA, 21 bp, Artificial Sequence
  Description of Artificial Sequence: Synthetic oligonucleotide
caccgctatgtcccggcccgg

SEQ ID NO: 41238 - DNA, 21 bp, Artificial Sequence
  Description of Artificial Sequence: Synthetic oligonucleotide
accgctatgtcccggcccggc

SEQ ID NO: 41239 - DNA, 20 bp, Artificial Sequence
  Description of Artificial Sequence: Synthetic oligonucleotide
ccgctatgtcccggcccggc

SEQ ID NO: 41240 - DNA, 20 bp, Artificial Sequence
  Description of Artificial Sequence: Synthetic oligonucleotide
cgctatgtcccggcccggcc

SEQ ID NO: 41241 - DNA, 20 bp, Artificial Sequence
  Description of Artificial Sequence: Synthetic oligonucleotide
gctatgtcccggcccggccg

SEQ ID NO: 41242 - DNA, 20 bp, Artificial Sequence
  Description of Artificial Sequence: Synthetic oligonucleotide
ctatgtcccggcccggccgc

SEQ ID NO: 41243 - DNA, 20 bp, Artificial Sequence
  Description of Artificial Sequence: Synthetic oligonucleotide
tatgtcccggcccggccgcg

SEQ ID NO: 41244 - DNA, 27 bp, Artificial Sequence
  Description of Artificial Sequence: Synthetic oligonucleotide
cctccagaggatgtttggctgcgacct

SEQ ID NO: 41245 - DNA, 27 bp, Artificial Sequence
  Description of Artificial Sequence: Synthetic oligonucleotide
ctccagaggatgtttggctgcgacctg

SEQ ID NO: 41246 - DNA, 26 bp, Artificial Sequence
  Description of Artificial Sequence: Synthetic oligonucleotide
gagcaggacagagcctacctggagga

SEQ ID NO: 41247 - DNA, 26 bp, Artificial Sequence
  Description of Artificial Sequence: Synthetic oligonucleotide
agcaggacagagcctacctggaggac

SEQ ID NO: 41248 - DNA, 25 bp, Artificial Sequence
  Description of Artificial Sequence: Synthetic oligonucleotide
gcaggacagagcctacctggaggac

SEQ ID NO: 41249 - DNA, 26 bp, Artificial Sequence
  Description of Artificial Sequence: Synthetic oligonucleotide
caggacagagcctacctggaggacct

SEQ ID NO: 41250 - DNA, 27 bp, Artificial Sequence
  Description of Artificial Sequence: Synthetic oligonucleotide
aggacagagcctacctggaggacctgt

SEQ ID NO: 41251 - DNA, 26 bp, Artificial Sequence
  Description of Artificial Sequence: Synthetic oligonucleotide
ggacagagcctacctggaggacctgt

SEQ ID NO: 41252 - DNA, 26 bp, Artificial Sequence
  Description of Artificial Sequence: Synthetic oligonucleotide
gacagagcctacctggaggacctgtg

SEQ ID NO: 41253 - DNA, 26 bp, Artificial Sequence
  Description of Artificial Sequence: Synthetic oligonucleotide
acagagcctacctggaggacctgtgc

SEQ ID NO: 41254 - DNA, 25 bp, Artificial Sequence
  Description of Artificial Sequence: Synthetic oligonucleotide
cagagcctacctggaggacctgtgc

SEQ ID NO: 41255 - DNA, 26 bp, Artificial Sequence
  Description of Artificial Sequence: Synthetic oligonucleotide
agagcctacctggaggacctgtgcgt

SEQ ID NO: 41256 - DNA, 25 bp, Artificial Sequence
  Description of Artificial Sequence: Synthetic oligonucleotide
gagcctacctggaggacctgtgcgt

SEQ ID NO: 41257 - DNA, 25 bp, Artificial Sequence
  Description of Artificial Sequence: Synthetic oligonucleotide
agcctacctggaggacctgtgcgtg

SEQ ID NO: 41258 - DNA, 24 bp, Artificial Sequence
  Description of Artificial Sequence: Synthetic oligonucleotide
gcctacctggaggacctgtgcgtg

SEQ ID NO: 41259 - DNA, 25 bp, Artificial Sequence
  Description of Artificial Sequence: Synthetic oligonucleotide
cctacctggaggacctgtgcgtgga

SEQ ID NO: 41260 - DNA, 26 bp, Artificial Sequence
  Description of Artificial Sequence: Synthetic oligonucleotide
ctacctggaggacctgtgcgtggagt

SEQ ID NO: 41261 - DNA, 26 bp, Artificial Sequence
  Description of Artificial Sequence: Synthetic oligonucleotide
tacctggaggacctgtgcgtggagtc

SEQ ID NO: 41262 - DNA, 25 bp, Artificial Sequence
  Description of Artificial Sequence: Synthetic oligonucleotide
acctggaggacctgtgcgtggagtc

SEQ ID NO: 41263 - DNA, 24 bp, Artificial Sequence
  Description of Artificial Sequence: Synthetic oligonucleotide
cctggaggacctgtgcgtggagtc

SEQ ID NO: 41264 - DNA, 24 bp, Artificial Sequence
  Description of Artificial Sequence: Synthetic oligonucleotide
ctggaggacctgtgcgtggagtcg

SEQ ID NO: 41265 - DNA, 25 bp, Artificial Sequence
  Description of Artificial Sequence: Synthetic oligonucleotide
tggaggacctgtgcgtggagtcgct

SEQ ID NO: 41266 - DNA, 24 bp, Artificial Sequence
  Description of Artificial Sequence: Synthetic oligonucleotide
ggaggacctgtgcgtggagtcgct

SEQ ID NO: 41267 - DNA, 24 bp, Artificial Sequence
  Description of Artificial Sequence: Synthetic oligonucleotide
gaggacctgtgcgtggagtcgctc

SEQ ID NO: 41268 - DNA, 24 bp, Artificial Sequence
  Description of Artificial Sequence: Synthetic oligonucleotide
aggacctgtgcgtggagtcgctcc

SEQ ID NO: 41269 - DNA, 23 bp, Artificial Sequence
  Description of Artificial Sequence: Synthetic oligonucleotide
ggacctgtgcgtggagtcgctcc

SEQ ID NO: 41270 - DNA, 23 bp, Artificial Sequence
  Description of Artificial Sequence: Synthetic oligonucleotide
gacctgtgcgtggagtcgctccg

SEQ ID NO: 41271 - DNA, 24 bp, Artificial Sequence
  Description of Artificial Sequence: Synthetic oligonucleotide
acctgtgcgtggagtcgctccgca

SEQ ID NO: 41272 - DNA, 30 bp, Artificial Sequence
  Description of Artificial Sequence: Synthetic oligonucleotide
tagcagttgtggtcatcggagctgtggttg

SEQ ID NO: 41273 - DNA, 29 bp, Artificial Sequence
  Description of Artificial Sequence: Synthetic oligonucleotide
agcagttgtggtcatcggagctgtggttg

SEQ ID NO: 41274 - DNA, 28 bp, Artificial Sequence
  Description of Artificial Sequence: Synthetic oligonucleotide
gcagttgtggtcatcggagctgtggttg

SEQ ID NO: 41275 - DNA, 28 bp, Artificial Sequence
  Description of Artificial Sequence: Synthetic oligonucleotide
cagttgtggtcatcggagctgtggttgc

SEQ ID NO: 41276 - DNA, 30 bp, Artificial Sequence
  Description of Artificial Sequence: Synthetic oligonucleotide
agttgtggtcatcggagctgtggttgctac

SEQ ID NO: 41277 - DNA, 29 bp, Artificial Sequence
  Description of Artificial Sequence: Synthetic oligonucleotide
gttgtggtcatcggagctgtggttgctac

SEQ ID NO: 41278 - DNA, 30 bp, Artificial Sequence
  Description of Artificial Sequence: Synthetic oligonucleotide
ttgtggtcatcggagctgtggttgctactg

SEQ ID NO: 41279 - DNA, 29 bp, Artificial Sequence
  Description of Artificial Sequence: Synthetic oligonucleotide
tgtggtcatcggagctgtggttgctactg

SEQ ID NO: 41280 - DNA, 28 bp, Artificial Sequence
  Description of Artificial Sequence: Synthetic oligonucleotide
gtggtcatcggagctgtggttgctactg

SEQ ID NO: 41281 - DNA, 29 bp, Artificial Sequence
  Description of Artificial Sequence: Synthetic oligonucleotide
tggtcatcggagctgtggttgctactgtg

SEQ ID NO: 41282 - DNA, 28 bp, Artificial Sequence
  Description of Artificial Sequence: Synthetic oligonucleotide
ggtcatcggagctgtggttgctactgtg

SEQ ID NO: 41283 - DNA, 30 bp, Artificial Sequence
  Description of Artificial Sequence: Synthetic oligonucleotide
gtcatcggagctgtggttgctactgtgatg

SEQ ID NO: 41284 - DNA, 31 bp, Artificial Sequence
  Description of Artificial Sequence: Synthetic oligonucleotide
tcatcggagctgtggttgctactgtgatgtg

SEQ ID NO: 41285 - DNA, 30 bp, Artificial Sequence
  Description of Artificial Sequence: Synthetic oligonucleotide
catcggagctgtggttgctactgtgatgtg

SEQ ID NO: 41286 - DNA, 32 bp, Artificial Sequence
  Description of Artificial Sequence: Synthetic oligonucleotide
atcggagctgtggttgctactgtgatgtgtag

SEQ ID NO: 41287 - DNA, 31 bp, Artificial Sequence
  Description of Artificial Sequence: Synthetic oligonucleotide
tcggagctgtggttgctactgtgatgtgtag

SEQ ID NO: 41288 - DNA, 30 bp, Artificial Sequence
  Description of Artificial Sequence: Synthetic oligonucleotide
cggagctgtggttgctactgtgatgtgtag

SEQ ID NO: 41289 - DNA, 30 bp, Artificial Sequence
  Description of Artificial Sequence: Synthetic oligonucleotide
ggagctgtggttgctactgtgatgtgtagg

SEQ ID NO: 41290 - DNA, 31 bp, Artificial Sequence
  Description of Artificial Sequence: Synthetic oligonucleotide
gagctgtggttgctactgtgatgtgtaggag

SEQ ID NO: 41291 - DNA, 31 bp, Artificial Sequence
  Description of Artificial Sequence: Synthetic oligonucleotide
agctgtggttgctactgtgatgtgtaggagg

SEQ ID NO: 41292 - DNA, 30 bp, Artificial Sequence
  Description of Artificial Sequence: Synthetic oligonucleotide
gctgtggttgctactgtgatgtgtaggagg

SEQ ID NO: 41293 - DNA, 32 bp, Artificial Sequence
  Description of Artificial Sequence: Synthetic oligonucleotide
ctgtggttgctactgtgatgtgtaggaggaag

SEQ ID NO: 41294 - DNA, 33 bp, Artificial Sequence
  Description of Artificial Sequence: Synthetic oligonucleotide
tgtggttgctactgtgatgtgtaggaggaagag

SEQ ID NO: 41295 - DNA, 32 bp, Artificial Sequence
  Description of Artificial Sequence: Synthetic oligonucleotide
gtggttgctactgtgatgtgtaggaggaagag

SEQ ID NO: 41296 - DNA, 32 bp, Artificial Sequence
  Description of Artificial Sequence: Synthetic oligonucleotide
tggttgctactgtgatgtgtaggaggaagagc

SEQ ID NO: 41297 - DNA, 31 bp, Artificial Sequence
  Description of Artificial Sequence: Synthetic oligonucleotide
ggttgctactgtgatgtgtaggaggaagagc

SEQ ID NO: 41298 - DNA, 32 bp, Artificial Sequence
  Description of Artificial Sequence: Synthetic oligonucleotide
gttgctactgtgatgtgtaggaggaagagctc

SEQ ID NO: 41299 - DNA, 33 bp, Artificial Sequence
  Description of Artificial Sequence: Synthetic oligonucleotide
ttgctactgtgatgtgtaggaggaagagctcag

SEQ ID NO: 41300 - DNA, 32 bp, Artificial Sequence
  Description of Artificial Sequence: Synthetic oligonucleotide
tgctactgtgatgtgtaggaggaagagctcag

SEQ ID NO: 41301 - DNA, 20 bp, Artificial Sequence
  Description of Artificial Sequence: Synthetic oligonucleotide
cgagagaggagccgcgggcc

SEQ ID NO: 41302 - DNA, 20 bp, Artificial Sequence
  Description of Artificial Sequence: Synthetic oligonucleotide
gagagaggagccgcgggccc

SEQ ID NO: 41303 - DNA, 20 bp, Artificial Sequence
  Description of Artificial Sequence: Synthetic oligonucleotide
agagaggagccgcgggcccc

SEQ ID NO: 41304 - DNA, 20 bp, Artificial Sequence
  Description of Artificial Sequence: Synthetic oligonucleotide
gagaggagccgcgggcccct

SEQ ID NO: 41305 - DNA, 20 bp, Artificial Sequence
  Description of Artificial Sequence: Synthetic oligonucleotide
agaggagccgcgggccccgt

SEQ ID NO: 41306 - DNA, 20 bp, Artificial Sequence
  Description of Artificial Sequence: Synthetic oligonucleotide
gaggagccgcgggccccgtt

SEQ ID NO: 41307 - DNA, 20 bp, Artificial Sequence
  Description of Artificial Sequence: Synthetic oligonucleotide
aggagccgcgggccccgtgt

SEQ ID NO: 41308 - DNA, 20 bp, Artificial Sequence
  Description of Artificial Sequence: Synthetic oligonucleotide
ggagccgcgggccccgtgtt

SEQ ID NO: 41309 - DNA, 21 bp, Artificial Sequence
  Description of Artificial Sequence: Synthetic oligonucleotide
gagccgcgggccccgtggata

SEQ ID NO: 41310 - DNA, 22 bp, Artificial Sequence
  Description of Artificial Sequence: Synthetic oligonucleotide
agccgcgggccccgtggataga

SEQ ID NO: 41311 - DNA, 21 bp, Artificial Sequence
  Description of Artificial Sequence: Synthetic oligonucleotide
gccgcgggccccgtggataga

SEQ ID NO: 41312 - DNA, 21 bp, Artificial Sequence
  Description of Artificial Sequence: Synthetic oligonucleotide
ccgcgggccccgtggatagag

SEQ ID NO: 41313 - DNA, 22 bp, Artificial Sequence
  Description of Artificial Sequence: Synthetic oligonucleotide
cgcgggccccgtggatagagca

SEQ ID NO: 41314 - DNA, 22 bp, Artificial Sequence
  Description of Artificial Sequence: Synthetic oligonucleotide
gcgggccccgtggatagagcag

SEQ ID NO: 41315 - DNA, 23 bp, Artificial Sequence
  Description of Artificial Sequence: Synthetic oligonucleotide
cgggccccgtggatagagcagga

SEQ ID NO: 41316 - DNA, 23 bp, Artificial Sequence
  Description of Artificial Sequence: Synthetic oligonucleotide
gggccccgtggatagagcaggag

SEQ ID NO: 41317 - DNA, 23 bp, Artificial Sequence
  Description of Artificial Sequence: Synthetic oligonucleotide
ggccccgtggatagagcaggagg

SEQ ID NO: 41318 - DNA, 23 bp, Artificial Sequence
  Description of Artificial Sequence: Synthetic oligonucleotide
gccccgtggatagagcaggaggg

SEQ ID NO: 41319 - DNA, 23 bp, Artificial Sequence
  Description of Artificial Sequence: Synthetic oligonucleotide
ccccgtggatagagcaggagggg

SEQ ID NO: 41320 - DNA, 23 bp, Artificial Sequence
  Description of Artificial Sequence: Synthetic oligonucleotide
cccgtggatagagcaggaggggc

SEQ ID NO: 41321 - DNA, 22 bp, Artificial Sequence
  Description of Artificial Sequence: Synthetic oligonucleotide
gggtcatggcgccccgaaccct

SEQ ID NO: 41322 - DNA, 24 bp, Artificial Sequence
  Description of Artificial Sequence: Synthetic oligonucleotide
ggtcatggcgccccgaaccctcat

SEQ ID NO: 41323 - DNA, 24 bp, Artificial Sequence
  Description of Artificial Sequence: Synthetic oligonucleotide
gtcatggcgccccgaaccctcatc

SEQ ID NO: 41324 - DNA, 25 bp, Artificial Sequence
  Description of Artificial Sequence: Synthetic oligonucleotide
tcatggcgccccgaaccctcatcct

SEQ ID NO: 41325 - DNA, 24 bp, Artificial Sequence
  Description of Artificial Sequence: Synthetic oligonucleotide
catggcgccccgaaccctcatcct

SEQ ID NO: 41326 - DNA, 24 bp, Artificial Sequence
  Description of Artificial Sequence: Synthetic oligonucleotide
atggcgccccgaaccctcatcctg

SEQ ID NO: 41327 - DNA, 23 bp, Artificial Sequence
  Description of Artificial Sequence: Synthetic oligonucleotide
tggcgccccgaaccctcatcctg

SEQ ID NO: 41328 - DNA, 22 bp, Artificial Sequence
  Description of Artificial Sequence: Synthetic oligonucleotide
ggcgccccgaaccctcatcctg

SEQ ID NO: 41329 - DNA, 23 bp, Artificial Sequence
  Description of Artificial Sequence: Synthetic oligonucleotide
gcgccccgaaccctcatcctgct

SEQ ID NO: 41330 - DNA, 23 bp, Artificial Sequence
  Description of Artificial Sequence: Synthetic oligonucleotide
cgccccgaaccctcatcctgctg

SEQ ID NO: 41331 - DNA, 24 bp, Artificial Sequence
  Description of Artificial Sequence: Synthetic oligonucleotide
gccccgaaccctcatcctgctgct

SEQ ID NO: 41332 - DNA, 25 bp, Artificial Sequence
  Description of Artificial Sequence: Synthetic oligonucleotide
ccccgaaccctcatcctgctgctct

SEQ ID NO: 41333 - DNA, 25 bp, Artificial Sequence
  Description of Artificial Sequence: Synthetic oligonucleotide
cccgaaccctcatcctgctgctctc

SEQ ID NO: 41334 - DNA, 25 bp, Artificial Sequence
  Description of Artificial Sequence: Synthetic oligonucleotide
ccgaaccctcatcctgctgctctcg

SEQ ID NO: 41335 - DNA, 25 bp, Artificial Sequence
  Description of Artificial Sequence: Synthetic oligonucleotide
cgaaccctcatcctgctgctctcgg

SEQ ID NO: 41336 - DNA, 26 bp, Artificial Sequence
  Description of Artificial Sequence: Synthetic oligonucleotide
gaaccctcatcctgctgctctcggga

SEQ ID NO: 41337 - DNA, 26 bp, Artificial Sequence
  Description of Artificial Sequence: Synthetic oligonucleotide
aaccctcatcctgctgctctcgggag

SEQ ID NO: 41338 - DNA, 25 bp, Artificial Sequence
  Description of Artificial Sequence: Synthetic oligonucleotide
accctcatcctgctgctctcgggag

SEQ ID NO: 41339 - DNA, 24 bp, Artificial Sequence
  Description of Artificial Sequence: Synthetic oligonucleotide
ccctcatcctgctgctctcgggag

SEQ ID NO: 41340 - DNA, 24 bp, Artificial Sequence
  Description of Artificial Sequence: Synthetic oligonucleotide
cctcatcctgctgctctcgggagc

SEQ ID NO: 41341 - DNA, 24 bp, Artificial Sequence
  Description of Artificial Sequence: Synthetic oligonucleotide
ctcatcctgctgctctcgggagcc

SEQ ID NO: 41342 - DNA, 25 bp, Artificial Sequence
  Description of Artificial Sequence: Synthetic oligonucleotide
tcatcctgctgctctcgggagccct

SEQ ID NO: 41343 - DNA, 24 bp, Artificial Sequence
  Description of Artificial Sequence: Synthetic oligonucleotide
catcctgctgctctcgggagccct

SEQ ID NO: 41344 - DNA, 24 bp, Artificial Sequence
  Description of Artificial Sequence: Synthetic oligonucleotide
atcctgctgctctcgggagccctg

SEQ ID NO: 41345 - DNA, 22 bp, Artificial Sequence
  Description of Artificial Sequence: Synthetic oligonucleotide
gccctgaccgagacctgggcct

SEQ ID NO: 41346 - DNA, 22 bp, Artificial Sequence
  Description of Artificial Sequence: Synthetic oligonucleotide
ccctgaccgagacctgggcctg

SEQ ID NO: 41347 - DNA, 23 bp, Artificial Sequence
  Description of Artificial Sequence: Synthetic oligonucleotide
cctgaccgagacctgggcctgct

SEQ ID NO: 41348 - DNA, 23 bp, Artificial Sequence
  Description of Artificial Sequence: Synthetic oligonucleotide
ctgaccgagacctgggcctgctc

SEQ ID NO: 41349 - DNA, 23 bp, Artificial Sequence
  Description of Artificial Sequence: Synthetic oligonucleotide
tgaccgagacctgggcctgctcc

SEQ ID NO: 41350 - DNA, 22 bp, Artificial Sequence
  Description of Artificial Sequence: Synthetic oligonucleotide
gaccgagacctgggcctgctcc

SEQ ID NO: 41351 - DNA, 23 bp, Artificial Sequence
  Description of Artificial Sequence: Synthetic oligonucleotide
accgagacctgggcctgctccca

SEQ ID NO: 41352 - DNA, 22 bp, Artificial Sequence
  Description of Artificial Sequence: Synthetic oligonucleotide
ccgagacctgggcctgctccca

SEQ ID NO: 41353 - DNA, 23 bp, Artificial Sequence
  Description of Artificial Sequence: Synthetic oligonucleotide
cgagacctgggcctgctcccact

SEQ ID NO: 41354 - DNA, 23 bp, Artificial Sequence
  Description of Artificial Sequence: Synthetic oligonucleotide
gagacctgggcctgctcccactc

SEQ ID NO: 41355 - DNA, 25 bp, Artificial Sequence
  Description of Artificial Sequence: Synthetic oligonucleotide
agacctgggcctgctcccactccat

SEQ ID NO: 41356 - DNA, 24 bp, Artificial Sequence
  Description of Artificial Sequence: Synthetic oligonucleotide
gacctgggcctgctcccactccat

SEQ ID NO: 41357 - DNA, 26 bp, Artificial Sequence
  Description of Artificial Sequence: Synthetic oligonucleotide
acctgggcctgctcccactccatgaa

SEQ ID NO: 41358 - DNA, 25 bp, Artificial Sequence
  Description of Artificial Sequence: Synthetic oligonucleotide
cctgggcctgctcccactccatgaa

SEQ ID NO: 41359 - DNA, 27 bp, Artificial Sequence
  Description of Artificial Sequence: Synthetic oligonucleotide
ctgggcctgctcccactccatgaagta

SEQ ID NO: 41360 - DNA, 30 bp, Artificial Sequence
  Description of Artificial Sequence: Synthetic oligonucleotide
tgggcctgctcccactccatgaagtatttc

SEQ ID NO: 41361 - DNA, 29 bp, Artificial Sequence
  Description of Artificial Sequence: Synthetic oligonucleotide
gggcctgctcccactccatgaagtatttc

SEQ ID NO: 41362 - DNA, 31 bp, Artificial Sequence
  Description of Artificial Sequence: Synthetic oligonucleotide
ggcctgctcccactccatgaagtatttcttc

SEQ ID NO: 41363 - DNA, 32 bp, Artificial Sequence
  Description of Artificial Sequence: Synthetic oligonucleotide
gcctgctcccactccatgaagtatttcttcac

SEQ ID NO: 41364 - DNA, 34 bp, Artificial Sequence
  Description of Artificial Sequence: Synthetic oligonucleotide
cctgctcccactccatgaagtatttcttcacatc

SEQ ID NO: 41365 - DNA, 34 bp, Artificial Sequence
  Description of Artificial Sequence: Synthetic oligonucleotide
ctgctcccactccatgaagtatttcttcacatcc

SEQ ID NO: 41366 - DNA, 34 bp, Artificial Sequence
  Description of Artificial Sequence: Synthetic oligonucleotide
tgctcccactccatgaagtatttcttcacatccg

SEQ ID NO: 41367 - DNA, 31 bp, Artificial Sequence
  Description of Artificial Sequence: Synthetic oligonucleotide
aagtatttcttcacatccgtgtcccggcctg

SEQ ID NO: 41368 - DNA, 30 bp, Artificial Sequence
  Description of Artificial Sequence: Synthetic oligonucleotide
agtatttcttcacatccgtgtcccggcctg

SEQ ID NO: 41369 - DNA, 20 bp, Artificial Sequence
  Description of Artificial Sequence: Synthetic oligonucleotide
tgtcccggcctggccgcgga

SEQ ID NO: 41370 - DNA, 20 bp, Artificial Sequence
  Description of Artificial Sequence: Synthetic oligonucleotide
gtcccggcctggccgcggat

SEQ ID NO: 41371 - DNA, 20 bp, Artificial Sequence
  Description of Artificial Sequence: Synthetic oligonucleotide
tcccggcctggccgcggaga

SEQ ID NO: 41372 - DNA, 20 bp, Artificial Sequence
  Description of Artificial Sequence: Synthetic oligonucleotide
cccggcctggccgcggagat

SEQ ID NO: 41373 - DNA, 20 bp, Artificial Sequence
  Description of Artificial Sequence: Synthetic oligonucleotide
ccggcctggccgcggagagt

SEQ ID NO: 41374 - DNA, 20 bp, Artificial Sequence
  Description of Artificial Sequence: Synthetic oligonucleotide
cggcctggccgcggagagct

SEQ ID NO: 41375 - DNA, 20 bp, Artificial Sequence
  Description of Artificial Sequence: Synthetic oligonucleotide
ggcctggccgcggagagcct

SEQ ID NO: 41376 - DNA, 20 bp, Artificial Sequence
  Description of Artificial Sequence: Synthetic oligonucleotide
gcctggccgcggagagccct

SEQ ID NO: 41377 - DNA, 20 bp, Artificial Sequence
  Description of Artificial Sequence: Synthetic oligonucleotide
cctggccgcggagagcccct

SEQ ID NO: 41378 - DNA, 20 bp, Artificial Sequence
  Description of Artificial Sequence: Synthetic oligonucleotide
ctggccgcggagagccccgt

SEQ ID NO: 41379 - DNA, 21 bp, Artificial Sequence
  Description of Artificial Sequence: Synthetic oligonucleotide
tggccgcggagagccccgctt

SEQ ID NO: 41380 - DNA, 26 bp, Artificial Sequence
  Description of Artificial Sequence: Synthetic oligonucleotide
cgggtctcacaccctccagtggatgt

SEQ ID NO: 41381 - DNA, 27 bp, Artificial Sequence
  Description of Artificial Sequence: Synthetic oligonucleotide
gggtctcacaccctccagtggatgtgt

SEQ ID NO: 41382 - DNA, 27 bp, Artificial Sequence
  Description of Artificial Sequence: Synthetic oligonucleotide
ggtctcacaccctccagtggatgtgtg

SEQ ID NO: 41383 - DNA, 27 bp, Artificial Sequence
  Description of Artificial Sequence: Synthetic oligonucleotide
gtctcacaccctccagtggatgtgtgg

SEQ ID NO: 41384 - DNA, 27 bp, Artificial Sequence
  Description of Artificial Sequence: Synthetic oligonucleotide
tctcacaccctccagtggatgtgtggc

SEQ ID NO: 41385 - DNA, 27 bp, Artificial Sequence
  Description of Artificial Sequence: Synthetic oligonucleotide
ctcacaccctccagtggatgtgtggct

SEQ ID NO: 41386 - DNA, 27 bp, Artificial Sequence
  Description of Artificial Sequence: Synthetic oligonucleotide
tcacaccctccagtggatgtgtggctg

SEQ ID NO: 41387 - DNA, 26 bp, Artificial Sequence
  Description of Artificial Sequence: Synthetic oligonucleotide
cacaccctccagtggatgtgtggctg

SEQ ID NO: 41388 - DNA, 26 bp, Artificial Sequence
  Description of Artificial Sequence: Synthetic oligonucleotide
acaccctccagtggatgtgtggctgc

SEQ ID NO: 41389 - DNA, 25 bp, Artificial Sequence
  Description of Artificial Sequence: Synthetic oligonucleotide
caccctccagtggatgtgtggctgc

SEQ ID NO: 41390 - DNA, 26 bp, Artificial Sequence
  Description of Artificial Sequence: Synthetic oligonucleotide
accctccagtggatgtgtggctgcga

SEQ ID NO: 41391 - DNA, 25 bp, Artificial Sequence
  Description of Artificial Sequence: Synthetic oligonucleotide
ccctccagtggatgtgtggctgcga

SEQ ID NO: 41392 - DNA, 25 bp, Artificial Sequence
  Description of Artificial Sequence: Synthetic oligonucleotide
cctccagtggatgtgtggctgcgac

SEQ ID NO: 41393 - DNA, 26 bp, Artificial Sequence
  Description of Artificial Sequence: Synthetic oligonucleotide
ctccagtggatgtgtggctgcgacct

SEQ ID NO: 41394 - DNA, 26 bp, Artificial Sequence
  Description of Artificial Sequence: Synthetic oligonucleotide
tccagtggatgtgtggctgcgacctg

SEQ ID NO: 41395 - DNA, 25 bp, Artificial Sequence
  Description of Artificial Sequence: Synthetic oligonucleotide
ccagtggatgtgtggctgcgacctg

SEQ ID NO: 41396 - DNA, 25 bp, Artificial Sequence
  Description of Artificial Sequence: Synthetic oligonucleotide
cagtggatgtgtggctgcgacctgg

SEQ ID NO: 41397 - DNA, 25 bp, Artificial Sequence
  Description of Artificial Sequence: Synthetic oligonucleotide
agtggatgtgtggctgcgacctggg

SEQ ID NO: 41398 - DNA, 24 bp, Artificial Sequence
  Description of Artificial Sequence: Synthetic oligonucleotide
gtggatgtgtggctgcgacctggg

SEQ ID NO: 41399 - DNA, 24 bp, Artificial Sequence
  Description of Artificial Sequence: Synthetic oligonucleotide
tggatgtgtggctgcgacctgggg

SEQ ID NO: 41400 - DNA, 23 bp, Artificial Sequence
  Description of Artificial Sequence: Synthetic oligonucleotide
ggatgtgtggctgcgacctgggg

SEQ ID NO: 41401 - DNA, 23 bp, Artificial Sequence
  Description of Artificial Sequence: Synthetic oligonucleotide
gatgtgtggctgcgacctggggc

SEQ ID NO: 41402 - DNA, 23 bp, Artificial Sequence
  Description of Artificial Sequence: Synthetic oligonucleotide
atgtgtggctgcgacctggggcc

SEQ ID NO: 41403 - DNA, 22 bp, Artificial Sequence
  Description of Artificial Sequence: Synthetic oligonucleotide
tgtgtggctgcgacctggggcc

SEQ ID NO: 41404 - DNA, 21 bp, Artificial Sequence
  Description of Artificial Sequence: Synthetic oligonucleotide
gtgtggctgcgacctggggcc

SEQ ID NO: 41405 - DNA, 21 bp, Artificial Sequence
  Description of Artificial Sequence: Synthetic oligonucleotide
tgtggctgcgacctggggccc

SEQ ID NO: 41406 - DNA, 20 bp, Artificial Sequence
  Description of Artificial Sequence: Synthetic oligonucleotide
gtggctgcgacctggggccc

SEQ ID NO: 41407 - DNA, 24 bp, Artificial Sequence
  Description of Artificial Sequence: Synthetic oligonucleotide
aaggagacgctgcagcgcgcggaa

SEQ ID NO: 41408 - DNA, 23 bp, Artificial Sequence
  Description of Artificial Sequence: Synthetic oligonucleotide
aggagacgctgcagcgcgcggaa

SEQ ID NO: 41409 - DNA, 22 bp, Artificial Sequence
  Description of Artificial Sequence: Synthetic oligonucleotide
ggagacgctgcagcgcgcggaa

SEQ ID NO: 41410 - DNA, 23 bp, Artificial Sequence
  Description of Artificial Sequence: Synthetic oligonucleotide
gagacgctgcagcgcgcggaaca

SEQ ID NO: 41411 - DNA, 23 bp, Artificial Sequence
  Description of Artificial Sequence: Synthetic oligonucleotide
agacgctgcagcgcgcggaacac

SEQ ID NO: 41412 - DNA, 22 bp, Artificial Sequence
  Description of Artificial Sequence: Synthetic oligonucleotide
gacgctgcagcgcgcggaacac

SEQ ID NO: 41413 - DNA, 22 bp, Artificial Sequence
  Description of Artificial Sequence: Synthetic oligonucleotide
acgctgcagcgcgcggaacacc

SEQ ID NO: 41414 - DNA, 21 bp, Artificial Sequence
  Description of Artificial Sequence: Synthetic oligonucleotide
cgctgcagcgcgcggaacacc

SEQ ID NO: 41415 - DNA, 24 bp, Artificial Sequence
  Description of Artificial Sequence: Synthetic oligonucleotide
gctgcagcgcgcggaacacccaaa

SEQ ID NO: 41416 - DNA, 25 bp, Artificial Sequence
  Description of Artificial Sequence: Synthetic oligonucleotide
ctgcagcgcgcggaacacccaaaga

SEQ ID NO: 41417 - DNA, 26 bp, Artificial Sequence
  Description of Artificial Sequence: Synthetic oligonucleotide
tgcagcgcgcggaacacccaaagaca

SEQ ID NO: 41418 - DNA, 25 bp, Artificial Sequence
  Description of Artificial Sequence: Synthetic oligonucleotide
gcagcgcgcggaacacccaaagaca

SEQ ID NO: 41419 - DNA, 26 bp, Artificial Sequence
  Description of Artificial Sequence: Synthetic oligonucleotide
cagcgcgcggaacacccaaagacaca

SEQ ID NO: 41420 - DNA, 26 bp, Artificial Sequence
  Description of Artificial Sequence: Synthetic oligonucleotide
agcgcgcggaacacccaaagacacac

SEQ ID NO: 41421 - DNA, 25 bp, Artificial Sequence
  Description of Artificial Sequence: Synthetic oligonucleotide
gcgcgcggaacacccaaagacacac

SEQ ID NO: 41422 - DNA, 26 bp, Artificial Sequence
  Description of Artificial Sequence: Synthetic oligonucleotide
cgcgcggaacacccaaagacacacgt

SEQ ID NO: 41423 - DNA, 27 bp, Artificial Sequence
  Description of Artificial Sequence: Synthetic oligonucleotide
gcgcggaacacccaaagacacacgtga

SEQ ID NO: 41424 - DNA, 27 bp, Artificial Sequence
  Description of Artificial Sequence: Synthetic oligonucleotide
cgcggaacacccaaagacacacgtgac

SEQ ID NO: 41425 - DNA, 27 bp, Artificial Sequence
  Description of Artificial Sequence: Synthetic oligonucleotide
gcggaacacccaaagacacacgtgacc

SEQ ID NO: 41426 - DNA, 27 bp, Artificial Sequence
  Description of Artificial Sequence: Synthetic oligonucleotide
cggaacacccaaagacacacgtgaccc

SEQ ID NO: 41427 - DNA, 28 bp, Artificial Sequence
  Description of Artificial Sequence: Synthetic oligonucleotide
ggaacacccaaagacacacgtgacccac

SEQ ID NO: 41428 - DNA, 28 bp, Artificial Sequence
  Description of Artificial Sequence: Synthetic oligonucleotide
gaacacccaaagacacacgtgacccacc

SEQ ID NO: 41429 - DNA, 30 bp, Artificial Sequence
  Description of Artificial Sequence: Synthetic oligonucleotide
aacacccaaagacacacgtgacccaccatc

SEQ ID NO: 41430 - DNA, 29 bp, Artificial Sequence
  Description of Artificial Sequence: Synthetic oligonucleotide
acacccaaagacacacgtgacccaccatc

SEQ ID NO: 41431 - DNA, 28 bp, Artificial Sequence
  Description of Artificial Sequence: Synthetic oligonucleotide
cacccaaagacacacgtgacccaccatc

SEQ ID NO: 41432 - DNA, 28 bp, Artificial Sequence
  Description of Artificial Sequence: Synthetic oligonucleotide
acccaaagacacacgtgacccaccatcc

SEQ ID NO: 41433 - DNA, 27 bp, Artificial Sequence
  Description of Artificial Sequence: Synthetic oligonucleotide
cccaaagacacacgtgacccaccatcc

SEQ ID NO: 41434 - DNA, 27 bp, Artificial Sequence
  Description of Artificial Sequence: Synthetic oligonucleotide
ccaaagacacacgtgacccaccatccc

SEQ ID NO: 41435 - DNA, 27 bp, Artificial Sequence
  Description of Artificial Sequence: Synthetic oligonucleotide
caaagacacacgtgacccaccatcccg

SEQ ID NO: 41436 - DNA, 28 bp, Artificial Sequence
  Description of Artificial Sequence: Synthetic oligonucleotide
aaagacacacgtgacccaccatcccgtc

SEQ ID NO: 41437 - DNA, 27 bp, Artificial Sequence
  Description of Artificial Sequence: Synthetic oligonucleotide
aagacacacgtgacccaccatcccgtc

SEQ ID NO: 41438 - DNA, 27 bp, Artificial Sequence
  Description of Artificial Sequence: Synthetic oligonucleotide
agacacacgtgacccaccatcccgtct

SEQ ID NO: 41439 - DNA, 26 bp, Artificial Sequence
  Description of Artificial Sequence: Synthetic oligonucleotide
gacacacgtgacccaccatcccgtct

SEQ ID NO: 41440 - DNA, 27 bp, Artificial Sequence
  Description of Artificial Sequence: Synthetic oligonucleotide
acacacgtgacccaccatcccgtctct

SEQ ID NO: 41441 - DNA, 26 bp, Artificial Sequence
  Description of Artificial Sequence: Synthetic oligonucleotide
cacacgtgacccaccatcccgtctct

SEQ ID NO: 41442 - DNA, 27 bp, Artificial Sequence
  Description of Artificial Sequence: Synthetic oligonucleotide
acacgtgacccaccatcccgtctctga

SEQ ID NO: 41443 - DNA, 26 bp, Artificial Sequence
  Description of Artificial Sequence: Synthetic oligonucleotide
cacgtgacccaccatcccgtctctga

SEQ ID NO: 41444 - DNA, 26 bp, Artificial Sequence
  Description of Artificial Sequence: Synthetic oligonucleotide
acgtgacccaccatcccgtctctgac

SEQ ID NO: 41445 - DNA, 25 bp, Artificial Sequence
  Description of Artificial Sequence: Synthetic oligonucleotide
cgtgacccaccatcccgtctctgac

SEQ ID NO: 41446 - DNA, 27 bp, Artificial Sequence
  Description of Artificial Sequence: Synthetic oligonucleotide
gtgacccaccatcccgtctctgaccat

SEQ ID NO: 41447 - DNA, 27 bp, Artificial Sequence
  Description of Artificial Sequence: Synthetic oligonucleotide
tgacccaccatcccgtctctgaccatg

SEQ ID NO: 41448 - DNA, 27 bp, Artificial Sequence
  Description of Artificial Sequence: Synthetic oligonucleotide
gacccaccatcccgtctctgaccatga

SEQ ID NO: 41449 - DNA, 27 bp, Artificial Sequence
  Description of Artificial Sequence: Synthetic oligonucleotide
acccaccatcccgtctctgaccatgag

SEQ ID NO: 41450 - DNA, 26 bp, Artificial Sequence
  Description of Artificial Sequence: Synthetic oligonucleotide
cccaccatcccgtctctgaccatgag

SEQ ID NO: 41451 - DNA, 26 bp, Artificial Sequence
  Description of Artificial Sequence: Synthetic oligonucleotide
ccaccatcccgtctctgaccatgagg

SEQ ID NO: 41452 - DNA, 26 bp, Artificial Sequence
  Description of Artificial Sequence: Synthetic oligonucleotide
caccatcccgtctctgaccatgaggc

SEQ ID NO: 41453 - DNA, 27 bp, Artificial Sequence
  Description of Artificial Sequence: Synthetic oligonucleotide
accatcccgtctctgaccatgaggcca

SEQ ID NO: 41454 - DNA, 26 bp, Artificial Sequence
  Description of Artificial Sequence: Synthetic oligonucleotide
ccatcccgtctctgaccatgaggcca

SEQ ID NO: 41455 - DNA, 26 bp, Artificial Sequence
  Description of Artificial Sequence: Synthetic oligonucleotide
catcccgtctctgaccatgaggccac

SEQ ID NO: 41456 - DNA, 26 bp, Artificial Sequence
  Description of Artificial Sequence: Synthetic oligonucleotide
atcccgtctctgaccatgaggccacc

SEQ ID NO: 41457 - DNA, 25 bp, Artificial Sequence
  Description of Artificial Sequence: Synthetic oligonucleotide
tcccgtctctgaccatgaggccacc

SEQ ID NO: 41458 - DNA, 26 bp, Artificial Sequence
  Description of Artificial Sequence: Synthetic oligonucleotide
ctggcagtgggatggggaggaccaaa

SEQ ID NO: 41459 - DNA, 27 bp, Artificial Sequence
  Description of Artificial Sequence: Synthetic oligonucleotide
tggcagtgggatggggaggaccaaact

SEQ ID NO: 41460 - DNA, 26 bp, Artificial Sequence
  Description of Artificial Sequence: Synthetic oligonucleotide
ggcagtgggatggggaggaccaaact

SEQ ID NO: 41461 - DNA, 27 bp, Artificial Sequence
  Description of Artificial Sequence: Synthetic oligonucleotide
gcagtgggatggggaggaccaaactca

SEQ ID NO: 41462 - DNA, 27 bp, Artificial Sequence
  Description of Artificial Sequence: Synthetic oligonucleotide
cagtgggatggggaggaccaaactcag

SEQ ID NO: 41463 - DNA, 27 bp, Artificial Sequence
  Description of Artificial Sequence: Synthetic oligonucleotide
agtgggatggggaggaccaaactcagg

SEQ ID NO: 41464 - DNA, 27 bp, Artificial Sequence
  Description of Artificial Sequence: Synthetic oligonucleotide
gtgggatggggaggaccaaactcagga

SEQ ID NO: 41465 - DNA, 27 bp, Artificial Sequence
  Description of Artificial Sequence: Synthetic oligonucleotide
tgggatggggaggaccaaactcaggac

SEQ ID NO: 41466 - DNA, 27 bp, Artificial Sequence
  Description of Artificial Sequence: Synthetic oligonucleotide
gggatggggaggaccaaactcaggaca

SEQ ID NO: 41467 - DNA, 27 bp, Artificial Sequence
  Description of Artificial Sequence: Synthetic oligonucleotide
ggatggggaggaccaaactcaggacac

SEQ ID NO: 41468 - DNA, 27 bp, Artificial Sequence
  Description of Artificial Sequence: Synthetic oligonucleotide
gatggggaggaccaaactcaggacacc

SEQ ID NO: 41469 - DNA, 27 bp, Artificial Sequence
  Description of Artificial Sequence: Synthetic oligonucleotide
atggggaggaccaaactcaggacaccg

SEQ ID NO: 41470 - DNA, 27 bp, Artificial Sequence
  Description of Artificial Sequence: Synthetic oligonucleotide
tggggaggaccaaactcaggacaccga

SEQ ID NO: 41471 - DNA, 26 bp, Artificial Sequence
  Description of Artificial Sequence: Synthetic oligonucleotide
ggggaggaccaaactcaggacaccga

SEQ ID NO: 41472 - DNA, 26 bp, Artificial Sequence
  Description of Artificial Sequence: Synthetic oligonucleotide
gggaggaccaaactcaggacaccgag

SEQ ID NO: 41473 - DNA, 27 bp, Artificial Sequence
  Description of Artificial Sequence: Synthetic oligonucleotide
ggaggaccaaactcaggacaccgagct

SEQ ID NO: 41474 - DNA, 30 bp, Artificial Sequence
  Description of Artificial Sequence: Synthetic oligonucleotide
gtgccttctggagaagagcagagatacacg

SEQ ID NO: 41475 - DNA, 31 bp, Artificial Sequence
  Description of Artificial Sequence: Synthetic oligonucleotide
tgccttctggagaagagcagagatacacgtg

SEQ ID NO: 41476 - DNA, 30 bp, Artificial Sequence
  Description of Artificial Sequence: Synthetic oligonucleotide
gccttctggagaagagcagagatacacgtg

SEQ ID NO: 41477 - DNA, 30 bp, Artificial Sequence
  Description of Artificial Sequence: Synthetic oligonucleotide
ccttctggagaagagcagagatacacgtgc

SEQ ID NO: 41478 - DNA, 30 bp, Artificial Sequence
  Description of Artificial Sequence: Synthetic oligonucleotide
cttctggagaagagcagagatacacgtgcc

SEQ ID NO: 41479 - DNA, 32 bp, Artificial Sequence
  Description of Artificial Sequence: Synthetic oligonucleotide
ttctggagaagagcagagatacacgtgccatg

SEQ ID NO: 41480 - DNA, 31 bp, Artificial Sequence
  Description of Artificial Sequence: Synthetic oligonucleotide
tctggagaagagcagagatacacgtgccatg

SEQ ID NO: 41481 - DNA, 30 bp, Artificial Sequence
  Description of Artificial Sequence: Synthetic oligonucleotide
ctggagaagagcagagatacacgtgccatg

SEQ ID NO: 41482 - DNA, 31 bp, Artificial Sequence
  Description of Artificial Sequence: Synthetic oligonucleotide
tggagaagagcagagatacacgtgccatgtg

SEQ ID NO: 41483 - DNA, 30 bp, Artificial Sequence
  Description of Artificial Sequence: Synthetic oligonucleotide
ggagaagagcagagatacacgtgccatgtg

SEQ ID NO: 41484 - DNA, 30 bp, Artificial Sequence
  Description of Artificial Sequence: Synthetic oligonucleotide
gagaagagcagagatacacgtgccatgtgc

SEQ ID NO: 41485 - DNA, 31 bp, Artificial Sequence
  Description of Artificial Sequence: Synthetic oligonucleotide
agaagagcagagatacacgtgccatgtgcag

SEQ ID NO: 41486 - DNA, 30 bp, Artificial Sequence
  Description of Artificial Sequence: Synthetic oligonucleotide
gaagagcagagatacacgtgccatgtgcag

SEQ ID NO: 41487 - DNA, 30 bp, Artificial Sequence
  Description of Artificial Sequence: Synthetic oligonucleotide
aagagcagagatacacgtgccatgtgcagc

SEQ ID NO: 41488 - DNA, 29 bp, Artificial Sequence
  Description of Artificial Sequence: Synthetic oligonucleotide
agagcagagatacacgtgccatgtgcagc

SEQ ID NO: 41489 - DNA, 28 bp, Artificial Sequence
  Description of Artificial Sequence: Synthetic oligonucleotide
gagcagagatacacgtgccatgtgcagc

SEQ ID NO: 41490 - DNA, 29 bp, Artificial Sequence
  Description of Artificial Sequence: Synthetic oligonucleotide
agcagagatacacgtgccatgtgcagcac

SEQ ID NO: 41491 - DNA, 28 bp, Artificial Sequence
  Description of Artificial Sequence: Synthetic oligonucleotide
gcagagatacacgtgccatgtgcagcac

SEQ ID NO: 41492 - DNA, 23 bp, Artificial Sequence
  Description of Artificial Sequence: Synthetic oligonucleotide
ccatgtgcagcacgaggggctgc

SEQ ID NO: 41493 - DNA, 23 bp, Artificial Sequence
  Description of Artificial Sequence: Synthetic oligonucleotide
catgtgcagcacgaggggctgcc

SEQ ID NO: 41494 - DNA, 23 bp, Artificial Sequence
  Description of Artificial Sequence: Synthetic oligonucleotide
atgtgcagcacgaggggctgccg

SEQ ID NO: 41495 - DNA, 22 bp, Artificial Sequence
  Description of Artificial Sequence: Synthetic oligonucleotide
tgtgcagcacgaggggctgccg

SEQ ID NO: 41496 - DNA, 21 bp, Artificial Sequence
  Description of Artificial Sequence: Synthetic oligonucleotide
gtgcagcacgaggggctgccg

SEQ ID NO: 41497 - DNA, 22 bp, Artificial Sequence
  Description of Artificial Sequence: Synthetic oligonucleotide
tgcagcacgaggggctgccgga

SEQ ID NO: 41498 - DNA, 21 bp, Artificial Sequence
  Description of Artificial Sequence: Synthetic oligonucleotide
gcagcacgaggggctgccgga

SEQ ID NO: 41499 - DNA, 21 bp, Artificial Sequence
  Description of Artificial Sequence: Synthetic oligonucleotide
cagcacgaggggctgccggag

SEQ ID NO: 41500 - DNA, 21 bp, Artificial Sequence
  Description of Artificial Sequence: Synthetic oligonucleotide
agcacgaggggctgccggagc

SEQ ID NO: 41501 - DNA, 20 bp, Artificial Sequence
  Description of Artificial Sequence: Synthetic oligonucleotide
gcacgaggggctgccggagc

SEQ ID NO: 41502 - DNA, 20 bp, Artificial Sequence
  Description of Artificial Sequence: Synthetic oligonucleotide
cacgaggggctgccggagcc

SEQ ID NO: 41503 - DNA, 20 bp, Artificial Sequence
  Description of Artificial Sequence: Synthetic oligonucleotide
acgaggggctgccggagccc

SEQ ID NO: 41504 - DNA, 20 bp, Artificial Sequence
  Description of Artificial Sequence: Synthetic oligonucleotide
cgaggggctgccggagccct

SEQ ID NO: 41505 - DNA, 24 bp, Artificial Sequence
  Description of Artificial Sequence: Synthetic oligonucleotide
ggagcccctcaccctgagatggga

SEQ ID NO: 41506 - DNA, 26 bp, Artificial Sequence
  Description of Artificial Sequence: Synthetic oligonucleotide
ccaccatccccatcgtgggcatcgtt

SEQ ID NO: 41507 - DNA, 26 bp, Artificial Sequence
  Description of Artificial Sequence: Synthetic oligonucleotide
caccatccccatcgtgggcatcgttg

SEQ ID NO: 41508 - DNA, 27 bp, Artificial Sequence
  Description of Artificial Sequence: Synthetic oligonucleotide
accatccccatcgtgggcatcgttgct

SEQ ID NO: 41509 - DNA, 26 bp, Artificial Sequence
  Description of Artificial Sequence: Synthetic oligonucleotide
ccatccccatcgtgggcatcgttgct

SEQ ID NO: 41510 - DNA, 26 bp, Artificial Sequence
  Description of Artificial Sequence: Synthetic oligonucleotide
catccccatcgtgggcatcgttgctg

SEQ ID NO: 41511 - DNA, 26 bp, Artificial Sequence
  Description of Artificial Sequence: Synthetic oligonucleotide
atccccatcgtgggcatcgttgctgg

SEQ ID NO: 41512 - DNA, 25 bp, Artificial Sequence
  Description of Artificial Sequence: Synthetic oligonucleotide
tccccatcgtgggcatcgttgctgg

SEQ ID NO: 41513 - DNA, 24 bp, Artificial Sequence
  Description of Artificial Sequence: Synthetic oligonucleotide
ccccatcgtgggcatcgttgctgg

SEQ ID NO: 41514 - DNA, 24 bp, Artificial Sequence
  Description of Artificial Sequence: Synthetic oligonucleotide
cccatcgtgggcatcgttgctggc

SEQ ID NO: 41515 - DNA, 25 bp, Artificial Sequence
  Description of Artificial Sequence: Synthetic oligonucleotide
ccatcgtgggcatcgttgctggcct

SEQ ID NO: 41516 - DNA, 25 bp, Artificial Sequence
  Description of Artificial Sequence: Synthetic oligonucleotide
catcgtgggcatcgttgctggcctg

SEQ ID NO: 41517 - DNA, 25 bp, Artificial Sequence
  Description of Artificial Sequence: Synthetic oligonucleotide
atcgtgggcatcgttgctggcctgg

SEQ ID NO: 41518 - DNA, 24 bp, Artificial Sequence
  Description of Artificial Sequence: Synthetic oligonucleotide
tcgtgggcatcgttgctggcctgg

SEQ ID NO: 41519 - DNA, 23 bp, Artificial Sequence
  Description of Artificial Sequence: Synthetic oligonucleotide
cgtgggcatcgttgctggcctgg

SEQ ID NO: 41520 - DNA, 24 bp, Artificial Sequence
  Description of Artificial Sequence: Synthetic oligonucleotide
gtgggcatcgttgctggcctggct

SEQ ID NO: 41521 - DNA, 25 bp, Artificial Sequence
  Description of Artificial Sequence: Synthetic oligonucleotide
tgggcatcgttgctggcctggctgt

SEQ ID NO: 41522 - DNA, 24 bp, Artificial Sequence
  Description of Artificial Sequence: Synthetic oligonucleotide
gggcatcgttgctggcctggctgt

SEQ ID NO: 41523 - DNA, 24 bp, Artificial Sequence
  Description of Artificial Sequence: Synthetic oligonucleotide
ggcatcgttgctggcctggctgtc

SEQ ID NO: 41524 - DNA, 25 bp, Artificial Sequence
  Description of Artificial Sequence: Synthetic oligonucleotide
gcatcgttgctggcctggctgtcct

SEQ ID NO: 41525 - DNA, 25 bp, Artificial Sequence
  Description of Artificial Sequence: Synthetic oligonucleotide
catcgttgctggcctggctgtcctg

SEQ ID NO: 41526 - DNA, 25 bp, Artificial Sequence
  Description of Artificial Sequence: Synthetic oligonucleotide
atcgttgctggcctggctgtcctgg

SEQ ID NO: 41527 - DNA, 24 bp, Artificial Sequence
  Description of Artificial Sequence: Synthetic oligonucleotide
tcgttgctggcctggctgtcctgg

SEQ ID NO: 41528 - DNA, 23 bp, Artificial Sequence
  Description of Artificial Sequence: Synthetic oligonucleotide
cgttgctggcctggctgtcctgg

SEQ ID NO: 41529 - DNA, 24 bp, Artificial Sequence
  Description of Artificial Sequence: Synthetic oligonucleotide
gttgctggcctggctgtcctggct

SEQ ID NO: 41530 - DNA, 25 bp, Artificial Sequence
  Description of Artificial Sequence: Synthetic oligonucleotide
ttgctggcctggctgtcctggctgt

SEQ ID NO: 41531 - DNA, 24 bp, Artificial Sequence
  Description of Artificial Sequence: Synthetic oligonucleotide
tgctggcctggctgtcctggctgt

SEQ ID NO: 41532 - DNA, 23 bp, Artificial Sequence
  Description of Artificial Sequence: Synthetic oligonucleotide
gctggcctggctgtcctggctgt

SEQ ID NO: 41533 - DNA, 23 bp, Artificial Sequence
  Description of Artificial Sequence: Synthetic oligonucleotide
ctggcctggctgtcctggctgtc

SEQ ID NO: 41534 - DNA, 25 bp, Artificial Sequence
  Description of Artificial Sequence: Synthetic oligonucleotide
tggcctggctgtcctggctgtccta

SEQ ID NO: 41535 - DNA, 24 bp, Artificial Sequence
  Description of Artificial Sequence: Synthetic oligonucleotide
ggcctggctgtcctggctgtccta

SEQ ID NO: 41536 - DNA, 24 bp, Artificial Sequence
  Description of Artificial Sequence: Synthetic oligonucleotide
gcctggctgtcctggctgtcctag

SEQ ID NO: 41537 - DNA, 25 bp, Artificial Sequence
  Description of Artificial Sequence: Synthetic oligonucleotide
cctggctgtcctggctgtcctagct

SEQ ID NO: 41538 - DNA, 26 bp, Artificial Sequence
  Description of Artificial Sequence: Synthetic oligonucleotide
ctggctgtcctggctgtcctagctgt

SEQ ID NO: 41539 - DNA, 26 bp, Artificial Sequence
  Description of Artificial Sequence: Synthetic oligonucleotide
tggctgtcctggctgtcctagctgtc

SEQ ID NO: 41540 - DNA, 25 bp, Artificial Sequence
  Description of Artificial Sequence: Synthetic oligonucleotide
ggctgtcctggctgtcctagctgtc

SEQ ID NO: 41541 - DNA, 27 bp, Artificial Sequence
  Description of Artificial Sequence: Synthetic oligonucleotide
gctgtcctggctgtcctagctgtccta

SEQ ID NO: 41542 - DNA, 27 bp, Artificial Sequence
  Description of Artificial Sequence: Synthetic oligonucleotide
ctgtcctggctgtcctagctgtcctag

SEQ ID NO: 41543 - DNA, 27 bp, Artificial Sequence
  Description of Artificial Sequence: Synthetic oligonucleotide
tgtcctggctgtcctagctgtcctagg

SEQ ID NO: 41544 - DNA, 27 bp, Artificial Sequence
  Description of Artificial Sequence: Synthetic oligonucleotide
gtcctggctgtcctagctgtcctagga

SEQ ID NO: 41545 - DNA, 27 bp, Artificial Sequence
  Description of Artificial Sequence: Synthetic oligonucleotide
tcctggctgtcctagctgtcctaggag

SEQ ID NO: 41546 - DNA, 26 bp, Artificial Sequence
  Description of Artificial Sequence: Synthetic oligonucleotide
cctggctgtcctagctgtcctaggag

SEQ ID NO: 41547 - DNA, 27 bp, Artificial Sequence
  Description of Artificial Sequence: Synthetic oligonucleotide
ctggctgtcctagctgtcctaggagct

SEQ ID NO: 41548 - DNA, 27 bp, Artificial Sequence
  Description of Artificial Sequence: Synthetic oligonucleotide
tggctgtcctagctgtcctaggagctg

SEQ ID NO: 41549 - DNA, 27 bp, Artificial Sequence
  Description of Artificial Sequence: Synthetic oligonucleotide
ggctgtcctagctgtcctaggagctgt

SEQ ID NO: 41550 - DNA, 27 bp, Artificial Sequence
  Description of Artificial Sequence: Synthetic oligonucleotide
gctgtcctagctgtcctaggagctgtg

SEQ ID NO: 41551 - DNA, 27 bp, Artificial Sequence
  Description of Artificial Sequence: Synthetic oligonucleotide
ctgtcctagctgtcctaggagctgtgg

SEQ ID NO: 41552 - DNA, 28 bp, Artificial Sequence
  Description of Artificial Sequence: Synthetic oligonucleotide
tgtcctagctgtcctaggagctgtggtg

SEQ ID NO: 41553 - DNA, 27 bp, Artificial Sequence
  Description of Artificial Sequence: Synthetic oligonucleotide
gtcctagctgtcctaggagctgtggtg

SEQ ID NO: 41554 - DNA, 27 bp, Artificial Sequence
  Description of Artificial Sequence: Synthetic oligonucleotide
tcctagctgtcctaggagctgtggtgg

SEQ ID NO: 41555 - DNA, 26 bp, Artificial Sequence
  Description of Artificial Sequence: Synthetic oligonucleotide
cctagctgtcctaggagctgtggtgg

SEQ ID NO: 41556 - DNA, 27 bp, Artificial Sequence
  Description of Artificial Sequence: Synthetic oligonucleotide
ctagctgtcctaggagctgtggtggct

SEQ ID NO: 41557 - DNA, 27 bp, Artificial Sequence
  Description of Artificial Sequence: Synthetic oligonucleotide
tagctgtcctaggagctgtggtggctg

SEQ ID NO: 41558 - DNA, 27 bp, Artificial Sequence
  Description of Artificial Sequence: Synthetic oligonucleotide
agctgtcctaggagctgtggtggctgt

SEQ ID NO: 41559 - DNA, 27 bp, Artificial Sequence
  Description of Artificial Sequence: Synthetic oligonucleotide
gctgtcctaggagctgtggtggctgtt

SEQ ID NO: 41560 - DNA, 27 bp, Artificial Sequence
  Description of Artificial Sequence: Synthetic oligonucleotide
ctgtcctaggagctgtggtggctgttg

SEQ ID NO: 41561 - DNA, 28 bp, Artificial Sequence
  Description of Artificial Sequence: Synthetic oligonucleotide
tgtcctaggagctgtggtggctgttgtg

SEQ ID NO: 41562 - DNA, 27 bp, Artificial Sequence
  Description of Artificial Sequence: Synthetic oligonucleotide
gtcctaggagctgtggtggctgttgtg

SEQ ID NO: 41563 - DNA, 29 bp, Artificial Sequence
  Description of Artificial Sequence: Synthetic oligonucleotide
tcctaggagctgtggtggctgttgtgatg

SEQ ID NO: 41564 - DNA, 28 bp, Artificial Sequence
  Description of Artificial Sequence: Synthetic oligonucleotide
cctaggagctgtggtggctgttgtgatg

SEQ ID NO: 41565 - DNA, 29 bp, Artificial Sequence
  Description of Artificial Sequence: Synthetic oligonucleotide
ctaggagctgtggtggctgttgtgatgtg

SEQ ID NO: 41566 - DNA, 31 bp, Artificial Sequence
  Description of Artificial Sequence: Synthetic oligonucleotide
taggagctgtggtggctgttgtgatgtgtag

SEQ ID NO: 41567 - DNA, 30 bp, Artificial Sequence
  Description of Artificial Sequence: Synthetic oligonucleotide
aggagctgtggtggctgttgtgatgtgtag

SEQ ID NO: 41568 - DNA, 29 bp, Artificial Sequence
  Description of Artificial Sequence: Synthetic oligonucleotide
ggagctgtggtggctgttgtgatgtgtag

SEQ ID NO: 41569 - DNA, 29 bp, Artificial Sequence
  Description of Artificial Sequence: Synthetic oligonucleotide
gagctgtggtggctgttgtgatgtgtagg

SEQ ID NO: 41570 - DNA, 30 bp, Artificial Sequence
  Description of Artificial Sequence: Synthetic oligonucleotide
agctgtggtggctgttgtgatgtgtaggag

SEQ ID NO: 41571 - DNA, 29 bp, Artificial Sequence
  Description of Artificial Sequence: Synthetic oligonucleotide
gctgtggtggctgttgtgatgtgtaggag

SEQ ID NO: 41572 - DNA, 29 bp, Artificial Sequence
  Description of Artificial Sequence: Synthetic oligonucleotide
ctgtggtggctgttgtgatgtgtaggagg

SEQ ID NO: 41573 - DNA, 31 bp, Artificial Sequence
  Description of Artificial Sequence: Synthetic oligonucleotide
tgtggtggctgttgtgatgtgtaggaggaag

SEQ ID NO: 41574 - DNA, 30 bp, Artificial Sequence
  Description of Artificial Sequence: Synthetic oligonucleotide
gtggtggctgttgtgatgtgtaggaggaag

SEQ ID NO: 41575 - DNA, 31 bp, Artificial Sequence
  Description of Artificial Sequence: Synthetic oligonucleotide
tggtggctgttgtgatgtgtaggaggaagag

SEQ ID NO: 41576 - DNA, 30 bp, Artificial Sequence
  Description of Artificial Sequence: Synthetic oligonucleotide
ggtggctgttgtgatgtgtaggaggaagag

SEQ ID NO: 41577 - DNA, 30 bp, Artificial Sequence
  Description of Artificial Sequence: Synthetic oligonucleotide
gtggctgttgtgatgtgtaggaggaagagc

SEQ ID NO: 41578 - DNA, 31 bp, Artificial Sequence
  Description of Artificial Sequence: Synthetic oligonucleotide
tggctgttgtgatgtgtaggaggaagagctc

SEQ ID NO: 41579 - DNA, 30 bp, Artificial Sequence
  Description of Artificial Sequence: Synthetic oligonucleotide
ggctgttgtgatgtgtaggaggaagagctc

SEQ ID NO: 41580 - DNA, 31 bp, Artificial Sequence
  Description of Artificial Sequence: Synthetic oligonucleotide
gctgttgtgatgtgtaggaggaagagctcag

SEQ ID NO: 41581 - DNA, 31 bp, Artificial Sequence
  Description of Artificial Sequence: Synthetic oligonucleotide
ctgttgtgatgtgtaggaggaagagctcagg

SEQ ID NO: 41582 - DNA, 32 bp, Artificial Sequence
  Description of Artificial Sequence: Synthetic oligonucleotide
tgttgtgatgtgtaggaggaagagctcaggtg

SEQ ID NO: 41583 - DNA, 31 bp, Artificial Sequence
  Description of Artificial Sequence: Synthetic oligonucleotide
gttgtgatgtgtaggaggaagagctcaggtg

SEQ ID NO: 41584 - DNA, 31 bp, Artificial Sequence
  Description of Artificial Sequence: Synthetic oligonucleotide
ttgtgatgtgtaggaggaagagctcaggtgg

SEQ ID NO: 41585 - DNA, 29 bp, Artificial Sequence
  Description of Artificial Sequence: Synthetic oligonucleotide
aagagctcaggtggaaaaggagggagctg

SEQ ID NO: 41586 - DNA, 28 bp, Artificial Sequence
  Description of Artificial Sequence: Synthetic oligonucleotide
agagctcaggtggaaaaggagggagctg

SEQ ID NO: 41587 - DNA, 27 bp, Artificial Sequence
  Description of Artificial Sequence: Synthetic oligonucleotide
gagctcaggtggaaaaggagggagctg

SEQ ID NO: 41588 - DNA, 27 bp, Artificial Sequence
  Description of Artificial Sequence: Synthetic oligonucleotide
agctcaggtggaaaaggagggagctgc

SEQ ID NO: 41589 - DNA, 27 bp, Artificial Sequence
  Description of Artificial Sequence: Synthetic oligonucleotide
gctcaggtggaaaaggagggagctgct

SEQ ID NO: 41590 - DNA, 27 bp, Artificial Sequence
  Description of Artificial Sequence: Synthetic oligonucleotide
ctcaggtggaaaaggagggagctgctc

SEQ ID NO: 41591 - DNA, 28 bp, Artificial Sequence
  Description of Artificial Sequence: Synthetic oligonucleotide
tcaggtggaaaaggagggagctgctctc

SEQ ID NO: 41592 - DNA, 27 bp, Artificial Sequence
  Description of Artificial Sequence: Synthetic oligonucleotide
caggtggaaaaggagggagctgctctc

SEQ ID NO: 41593 - DNA, 28 bp, Artificial Sequence
  Description of Artificial Sequence: Synthetic oligonucleotide
aggtggaaaaggagggagctgctctcag

SEQ ID NO: 41594 - DNA, 27 bp, Artificial Sequence
  Description of Artificial Sequence: Synthetic oligonucleotide
ggtggaaaaggagggagctgctctcag

SEQ ID NO: 41595 - DNA, 27 bp, Artificial Sequence
  Description of Artificial Sequence: Synthetic oligonucleotide
gtggaaaaggagggagctgctctcagg

SEQ ID NO: 41596 - DNA, 27 bp, Artificial Sequence
  Description of Artificial Sequence: Synthetic oligonucleotide
tggaaaaggagggagctgctctcaggc

SEQ ID NO: 41597 - DNA, 27 bp, Artificial Sequence
  Description of Artificial Sequence: Synthetic oligonucleotide
ggaaaaggagggagctgctctcaggct

SEQ ID NO: 41598 - DNA, 27 bp, Artificial Sequence
  Description of Artificial Sequence: Synthetic oligonucleotide
gaaaaggagggagctgctctcaggctg

SEQ ID NO: 41599 - DNA, 27 bp, Artificial Sequence
  Description of Artificial Sequence: Synthetic oligonucleotide
aaaaggagggagctgctctcaggctgc

SEQ ID NO: 41600 - DNA, 26 bp, Artificial Sequence
  Description of Artificial Sequence: Synthetic oligonucleotide
aaaggagggagctgctctcaggctgc

SEQ ID NO: 41601 - DNA, 25 bp, Artificial Sequence
  Description of Artificial Sequence: Synthetic oligonucleotide
aaggagggagctgctctcaggctgc

SEQ ID NO: 41602 - DNA, 24 bp, Artificial Sequence
  Description of Artificial Sequence: Synthetic oligonucleotide
aggagggagctgctctcaggctgc

SEQ ID NO: 41603 - DNA, 23 bp, Artificial Sequence
  Description of Artificial Sequence: Synthetic oligonucleotide
ggagggagctgctctcaggctgc

SEQ ID NO: 41604 - DNA, 24 bp, Artificial Sequence
  Description of Artificial Sequence: Synthetic oligonucleotide
gagggagctgctctcaggctgcgt

SEQ ID NO: 41605 - DNA, 24 bp, Artificial Sequence
  Description of Artificial Sequence: Synthetic oligonucleotide
agggagctgctctcaggctgcgtc

SEQ ID NO: 41606 - DNA, 23 bp, Artificial Sequence
  Description of Artificial Sequence: Synthetic oligonucleotide
gggagctgctctcaggctgcgtc

SEQ ID NO: 41607 - DNA, 24 bp, Artificial Sequence
  Description of Artificial Sequence: Synthetic oligonucleotide
ggagctgctctcaggctgcgtcca

SEQ ID NO: 41608 - DNA, 24 bp, Artificial Sequence
  Description of Artificial Sequence: Synthetic oligonucleotide
gagctgctctcaggctgcgtccag

SEQ ID NO: 41609 - DNA, 26 bp, Artificial Sequence
  Description of Artificial Sequence: Synthetic oligonucleotide
agctgctctcaggctgcgtccagcaa

SEQ ID NO: 41610 - DNA, 25 bp, Artificial Sequence
  Description of Artificial Sequence: Synthetic oligonucleotide
gctgctctcaggctgcgtccagcaa

SEQ ID NO: 41611 - DNA, 26 bp, Artificial Sequence
  Description of Artificial Sequence: Synthetic oligonucleotide
ctgctctcaggctgcgtccagcaaca

SEQ ID NO: 41612 - DNA, 27 bp, Artificial Sequence
  Description of Artificial Sequence: Synthetic oligonucleotide
tgctctcaggctgcgtccagcaacagt

SEQ ID NO: 41613 - DNA, 26 bp, Artificial Sequence
  Description of Artificial Sequence: Synthetic oligonucleotide
gctctcaggctgcgtccagcaacagt

SEQ ID NO: 41614 - DNA, 26 bp, Artificial Sequence
  Description of Artificial Sequence: Synthetic oligonucleotide
ctctcaggctgcgtccagcaacagtg

SEQ ID NO: 41615 - DNA, 26 bp, Artificial Sequence
  Description of Artificial Sequence: Synthetic oligonucleotide
tctcaggctgcgtccagcaacagtgc

SEQ ID NO: 41616 - DNA, 25 bp, Artificial Sequence
  Description of Artificial Sequence: Synthetic oligonucleotide
ctcaggctgcgtccagcaacagtgc

SEQ ID NO: 41617 - DNA, 25 bp, Artificial Sequence
  Description of Artificial Sequence: Synthetic oligonucleotide
tcaggctgcgtccagcaacagtgcc

SEQ ID NO: 41618 - DNA, 24 bp, Artificial Sequence
  Description of Artificial Sequence: Synthetic oligonucleotide
caggctgcgtccagcaacagtgcc

SEQ ID NO: 41619 - DNA, 25 bp, Artificial Sequence
  Description of Artificial Sequence: Synthetic oligonucleotide
aggctgcgtccagcaacagtgccca

SEQ ID NO: 41620 - DNA, 24 bp, Artificial Sequence
  Description of Artificial Sequence: Synthetic oligonucleotide
ggctgcgtccagcaacagtgccca

SEQ ID NO: 41621 - DNA, 24 bp, Artificial Sequence
  Description of Artificial Sequence: Synthetic oligonucleotide
gctgcgtccagcaacagtgcccag

SEQ ID NO: 41622 - DNA, 24 bp, Artificial Sequence
  Description of Artificial Sequence: Synthetic oligonucleotide
ctgcgtccagcaacagtgcccagg

SEQ ID NO: 41623 - DNA, 24 bp, Artificial Sequence
  Description of Artificial Sequence: Synthetic oligonucleotide
tgcgtccagcaacagtgcccaggg

SEQ ID NO: 41624 - DNA, 23 bp, Artificial Sequence
  Description of Artificial Sequence: Synthetic oligonucleotide
gcgtccagcaacagtgcccaggg

SEQ ID NO: 41625 - DNA, 24 bp, Artificial Sequence
  Description of Artificial Sequence: Synthetic oligonucleotide
cgtccagcaacagtgcccagggct

SEQ ID NO: 41626 - DNA, 25 bp, Artificial Sequence
  Description of Artificial Sequence: Synthetic oligonucleotide
gtccagcaacagtgcccagggctct

SEQ ID NO: 41627 - DNA, 27 bp, Artificial Sequence
  Description of Artificial Sequence: Synthetic oligonucleotide
tccagcaacagtgcccagggctctgat

SEQ ID NO: 41628 - DNA, 26 bp, Artificial Sequence
  Description of Artificial Sequence: Synthetic oligonucleotide
ccagcaacagtgcccagggctctgat

SEQ ID NO: 41629 - DNA, 27 bp, Artificial Sequence
  Description of Artificial Sequence: Synthetic oligonucleotide
cagcaacagtgcccagggctctgatga

SEQ ID NO: 41630 - DNA, 27 bp, Artificial Sequence
  Description of Artificial Sequence: Synthetic oligonucleotide
agcaacagtgcccagggctctgatgag

SEQ ID NO: 41631 - DNA, 27 bp, Artificial Sequence
  Description of Artificial Sequence: Synthetic oligonucleotide
gcaacagtgcccagggctctgatgagt

SEQ ID NO: 41632 - DNA, 27 bp, Artificial Sequence
  Description of Artificial Sequence: Synthetic oligonucleotide
caacagtgcccagggctctgatgagtc

SEQ ID NO: 41633 - DNA, 28 bp, Artificial Sequence
  Description of Artificial Sequence: Synthetic oligonucleotide
aacagtgcccagggctctgatgagtctc

SEQ ID NO: 41634 - DNA, 27 bp, Artificial Sequence
  Description of Artificial Sequence: Synthetic oligonucleotide
acagtgcccagggctctgatgagtctc

SEQ ID NO: 41635 - DNA, 27 bp, Artificial Sequence
  Description of Artificial Sequence: Synthetic oligonucleotide
cagtgcccagggctctgatgagtctct

SEQ ID NO: 41636 - DNA, 27 bp, Artificial Sequence
  Description of Artificial Sequence: Synthetic oligonucleotide
agtgcccagggctctgatgagtctctc

SEQ ID NO: 41637 - DNA, 27 bp, Artificial Sequence
  Description of Artificial Sequence: Synthetic oligonucleotide
gtgcccagggctctgatgagtctctca

SEQ ID NO: 41638 - DNA, 28 bp, Artificial Sequence
  Description of Artificial Sequence: Synthetic oligonucleotide
tgcccagggctctgatgagtctctcatc

SEQ ID NO: 41639 - DNA, 27 bp, Artificial Sequence
  Description of Artificial Sequence: Synthetic oligonucleotide
gcccagggctctgatgagtctctcatc

SEQ ID NO: 41640 - DNA, 27 bp, Artificial Sequence
  Description of Artificial Sequence: Synthetic oligonucleotide
cccagggctctgatgagtctctcatcg

SEQ ID NO: 41641 - DNA, 27 bp, Artificial Sequence
  Description of Artificial Sequence: Synthetic oligonucleotide
ccagggctctgatgagtctctcatcgc

SEQ ID NO: 41642 - DNA, 29 bp, Artificial Sequence
  Description of Artificial Sequence: Synthetic oligonucleotide
cagggctctgatgagtctctcatcgcttg

SEQ ID NO: 41643 - DNA, 33 bp, Artificial Sequence
  Description of Artificial Sequence: Synthetic oligonucleotide
agggctctgatgagtctctcatcgcttgtaaag

SEQ ID NO: 41644 - DNA, 32 bp, Artificial Sequence
  Description of Artificial Sequence: Synthetic oligonucleotide
gggctctgatgagtctctcatcgcttgtaaag

SEQ ID NO: 41645 - DNA, 32 bp, Artificial Sequence
  Description of Artificial Sequence: Synthetic oligonucleotide
ggctctgatgagtctctcatcgcttgtaaagc

SEQ ID NO: 41646 - DNA, 32 bp, Artificial Sequence
  Description of Artificial Sequence: Synthetic oligonucleotide
gctctgatgagtctctcatcgcttgtaaagcc

SEQ ID NO: 41647 - DNA, 33 bp, Artificial Sequence
  Description of Artificial Sequence: Synthetic oligonucleotide
ctctgatgagtctctcatcgcttgtaaagcctg

SEQ ID NO: 41648 - DNA, 26 bp, Artificial Sequence
  Description of Artificial Sequence: Synthetic oligonucleotide
ctcaggacaccgagcttgtggagacc

SEQ ID NO: 41649 - DNA, 26 bp, Artificial Sequence
  Description of Artificial Sequence: Synthetic oligonucleotide
tcaggacaccgagcttgtggagaccc

SEQ ID NO: 41650 - DNA, 25 bp, Artificial Sequence
  Description of Artificial Sequence: Synthetic oligonucleotide
caggacaccgagcttgtggagaccc

SEQ ID NO: 41651 - DNA, 25 bp, Artificial Sequence
  Description of Artificial Sequence: Synthetic oligonucleotide
aggacaccgagcttgtggagacccg

SEQ ID NO: 41652 - DNA, 24 bp, Artificial Sequence
  Description of Artificial Sequence: Synthetic oligonucleotide
ggacaccgagcttgtggagacccg

SEQ ID NO: 41653 - DNA, 24 bp, Artificial Sequence
  Description of Artificial Sequence: Synthetic oligonucleotide
gacaccgagcttgtggagacccgg

SEQ ID NO: 41654 - DNA, 24 bp, Artificial Sequence
  Description of Artificial Sequence: Synthetic oligonucleotide
acaccgagcttgtggagacccggc

SEQ ID NO: 41655 - DNA, 23 bp, Artificial Sequence
  Description of Artificial Sequence: Synthetic oligonucleotide
caccgagcttgtggagacccggc

SEQ ID NO: 41656 - DNA, 24 bp, Artificial Sequence
  Description of Artificial Sequence: Synthetic oligonucleotide
accgagcttgtggagacccggcca

SEQ ID NO: 41657 - DNA, 23 bp, Artificial Sequence
  Description of Artificial Sequence: Synthetic oligonucleotide
ccgagcttgtggagacccggcca

SEQ ID NO: 41658 - DNA, 23 bp, Artificial Sequence
  Description of Artificial Sequence: Synthetic oligonucleotide
cgagcttgtggagacccggccag

SEQ ID NO: 41659 - DNA, 24 bp, Artificial Sequence
  Description of Artificial Sequence: Synthetic oligonucleotide
gagcttgtggagacccggccagca

SEQ ID NO: 41660 - DNA, 24 bp, Artificial Sequence
  Description of Artificial Sequence: Synthetic oligonucleotide
agcttgtggagacccggccagcag

SEQ ID NO: 41661 - DNA, 23 bp, Artificial Sequence
  Description of Artificial Sequence: Synthetic oligonucleotide
gcttgtggagacccggccagcag

SEQ ID NO: 41662 - DNA, 24 bp, Artificial Sequence
  Description of Artificial Sequence: Synthetic oligonucleotide
cttgtggagacccggccagcagga

SEQ ID NO: 41663 - DNA, 26 bp, Artificial Sequence
  Description of Artificial Sequence: Synthetic oligonucleotide
ttgtggagacccggccagcaggagat

SEQ ID NO: 41664 - DNA, 25 bp, Artificial Sequence
  Description of Artificial Sequence: Synthetic oligonucleotide
tgtggagacccggccagcaggagat

SEQ ID NO: 41665 - DNA, 24 bp, Artificial Sequence
  Description of Artificial Sequence: Synthetic oligonucleotide
gtggagacccggccagcaggagat

SEQ ID NO: 41666 - DNA, 24 bp, Artificial Sequence
  Description of Artificial Sequence: Synthetic oligonucleotide
tggagacccggccagcaggagatg

SEQ ID NO: 41667 - DNA, 23 bp, Artificial Sequence
  Description of Artificial Sequence: Synthetic oligonucleotide
ggagacccggccagcaggagatg

SEQ ID NO: 41668 - DNA, 25 bp, Artificial Sequence
  Description of Artificial Sequence: Synthetic oligonucleotide
gagacccggccagcaggagatggaa

SEQ ID NO: 41669 - DNA, 25 bp, Artificial Sequence
  Description of Artificial Sequence: Synthetic oligonucleotide
agacccggccagcaggagatggaac

SEQ ID NO: 41670 - DNA, 24 bp, Artificial Sequence
  Description of Artificial Sequence: Synthetic oligonucleotide
gacccggccagcaggagatggaac

SEQ ID NO: 41671 - DNA, 26 bp, Artificial Sequence
  Description of Artificial Sequence: Synthetic oligonucleotide
acccggccagcaggagatggaacctt

SEQ ID NO: 41672 - DNA, 25 bp, Artificial Sequence
  Description of Artificial Sequence: Synthetic oligonucleotide
cccggccagcaggagatggaacctt

SEQ ID NO: 41673 - DNA, 25 bp, Artificial Sequence
  Description of Artificial Sequence: Synthetic oligonucleotide
ccggccagcaggagatggaaccttc

SEQ ID NO: 41674 - DNA, 26 bp, Artificial Sequence
  Description of Artificial Sequence: Synthetic oligonucleotide
cggccagcaggagatggaaccttcca

SEQ ID NO: 41675 - DNA, 31 bp, Artificial Sequence
  Description of Artificial Sequence: Synthetic oligonucleotide
aaggattacatcgccctgaacgaggacctac

SEQ ID NO: 41676 - DNA, 30 bp, Artificial Sequence
  Description of Artificial Sequence: Synthetic oligonucleotide
aggattacatcgccctgaacgaggacctac

SEQ ID NO: 41677 - DNA, 29 bp, Artificial Sequence
  Description of Artificial Sequence: Synthetic oligonucleotide
ggattacatcgccctgaacgaggacctac

SEQ ID NO: 41678 - DNA, 29 bp, Artificial Sequence
  Description of Artificial Sequence: Synthetic oligonucleotide
gattacatcgccctgaacgaggacctacg

SEQ ID NO: 41679 - DNA, 29 bp, Artificial Sequence
  Description of Artificial Sequence: Synthetic oligonucleotide
attacatcgccctgaacgaggacctacgc

SEQ ID NO: 41680 - DNA, 28 bp, Artificial Sequence
  Description of Artificial Sequence: Synthetic oligonucleotide
ttacatcgccctgaacgaggacctacgc

SEQ ID NO: 41681 - DNA, 27 bp, Artificial Sequence
  Description of Artificial Sequence: Synthetic oligonucleotide
tacatcgccctgaacgaggacctacgc

SEQ ID NO: 41682 - DNA, 27 bp, Artificial Sequence
  Description of Artificial Sequence: Synthetic oligonucleotide
acatcgccctgaacgaggacctacgct

SEQ ID NO: 41683 - DNA, 26 bp, Artificial Sequence
  Description of Artificial Sequence: Synthetic oligonucleotide
catcgccctgaacgaggacctacgct

SEQ ID NO: 41684 - DNA, 26 bp, Artificial Sequence
  Description of Artificial Sequence: Synthetic oligonucleotide
atcgccctgaacgaggacctacgctc

SEQ ID NO: 41685 - DNA, 25 bp, Artificial Sequence
  Description of Artificial Sequence: Synthetic oligonucleotide
tcgccctgaacgaggacctacgctc

SEQ ID NO: 41686 - DNA, 24 bp, Artificial Sequence
  Description of Artificial Sequence: Synthetic oligonucleotide
cgccctgaacgaggacctacgctc

SEQ ID NO: 41687 - DNA, 25 bp, Artificial Sequence
  Description of Artificial Sequence: Synthetic oligonucleotide
gccctgaacgaggacctacgctcct

SEQ ID NO: 41688 - DNA, 25 bp, Artificial Sequence
  Description of Artificial Sequence: Synthetic oligonucleotide
ccctgaacgaggacctacgctcctg

SEQ ID NO: 41689 - DNA, 26 bp, Artificial Sequence
  Description of Artificial Sequence: Synthetic oligonucleotide
cctgaacgaggacctacgctcctgga

SEQ ID NO: 41690 - DNA, 26 bp, Artificial Sequence
  Description of Artificial Sequence: Synthetic oligonucleotide
ctgaacgaggacctacgctcctggac

SEQ ID NO: 41691 - DNA, 26 bp, Artificial Sequence
  Description of Artificial Sequence: Synthetic oligonucleotide
tgaacgaggacctacgctcctggacc

SEQ ID NO: 41692 - DNA, 25 bp, Artificial Sequence
  Description of Artificial Sequence: Synthetic oligonucleotide
gaacgaggacctacgctcctggacc

SEQ ID NO: 41693 - DNA, 25 bp, Artificial Sequence
  Description of Artificial Sequence: Synthetic oligonucleotide
aacgaggacctacgctcctggaccg

SEQ ID NO: 41694 - DNA, 24 bp, Artificial Sequence
  Description of Artificial Sequence: Synthetic oligonucleotide
acgaggacctacgctcctggaccg

SEQ ID NO: 41695 - DNA, 23 bp, Artificial Sequence
  Description of Artificial Sequence: Synthetic oligonucleotide
cgaggacctacgctcctggaccg

SEQ ID NO: 41696 - DNA, 23 bp, Artificial Sequence
  Description of Artificial Sequence: Synthetic oligonucleotide
gaggacctacgctcctggaccgc

SEQ ID NO: 41697 - DNA, 23 bp, Artificial Sequence
  Description of Artificial Sequence: Synthetic oligonucleotide
aggacctacgctcctggaccgcc

SEQ ID NO: 41698 - DNA, 22 bp, Artificial Sequence
  Description of Artificial Sequence: Synthetic oligonucleotide
ggacctacgctcctggaccgcc

SEQ ID NO: 41699 - DNA, 22 bp, Artificial Sequence
  Description of Artificial Sequence: Synthetic oligonucleotide
gacctacgctcctggaccgccg

SEQ ID NO: 41700 - DNA, 22 bp, Artificial Sequence
  Description of Artificial Sequence: Synthetic oligonucleotide
acctacgctcctggaccgccgc

SEQ ID NO: 41701 - DNA, 21 bp, Artificial Sequence
  Description of Artificial Sequence: Synthetic oligonucleotide
cctacgctcctggaccgccgc

SEQ ID NO: 41702 - DNA, 21 bp, Artificial Sequence
  Description of Artificial Sequence: Synthetic oligonucleotide
ctacgctcctggaccgccgcg

SEQ ID NO: 41703 - DNA, 22 bp, Artificial Sequence
  Description of Artificial Sequence: Synthetic oligonucleotide
tacgctcctggaccgccgcgga

SEQ ID NO: 41704 - DNA, 21 bp, Artificial Sequence
  Description of Artificial Sequence: Synthetic oligonucleotide
acgctcctggaccgccgcgga

SEQ ID NO: 41705 - DNA, 27 bp, Artificial Sequence
  Description of Artificial Sequence: Synthetic oligonucleotide
tacgtggacgacacgcagttcgtgcga

SEQ ID NO: 41706 - DNA, 27 bp, Artificial Sequence
  Description of Artificial Sequence: Synthetic oligonucleotide
acgtggacgacacgcagttcgtgcgat

SEQ ID NO: 41707 - DNA, 27 bp, Artificial Sequence
  Description of Artificial Sequence: Synthetic oligonucleotide
cgtggacgacacgcagttcgtgcgatt

SEQ ID NO: 41708 - DNA, 27 bp, Artificial Sequence
  Description of Artificial Sequence: Synthetic oligonucleotide
gtggacgacacgcagttcgtgcgattc

SEQ ID NO: 41709 - DNA, 27 bp, Artificial Sequence
  Description of Artificial Sequence: Synthetic oligonucleotide
tggacgacacgcagttcgtgcgattcg

SEQ ID NO: 41710 - DNA, 27 bp, Artificial Sequence
  Description of Artificial Sequence: Synthetic oligonucleotide
ggacgacacgcagttcgtgcgattcga

SEQ ID NO: 41711 - DNA, 27 bp, Artificial Sequence
  Description of Artificial Sequence: Synthetic oligonucleotide
gacgacacgcagttcgtgcgattcgac

SEQ ID NO: 41712 - DNA, 28 bp, Artificial Sequence
  Description of Artificial Sequence: Synthetic oligonucleotide
acgacacgcagttcgtgcgattcgacag

SEQ ID NO: 41713 - DNA, 27 bp, Artificial Sequence
  Description of Artificial Sequence: Synthetic oligonucleotide
cgacacgcagttcgtgcgattcgacag

SEQ ID NO: 41714 - DNA, 27 bp, Artificial Sequence
  Description of Artificial Sequence: Synthetic oligonucleotide
gacacgcagttcgtgcgattcgacagc

SEQ ID NO: 41715 - DNA, 27 bp, Artificial Sequence
  Description of Artificial Sequence: Synthetic oligonucleotide
acacgcagttcgtgcgattcgacagcg

SEQ ID NO: 41716 - DNA, 27 bp, Artificial Sequence
  Description of Artificial Sequence: Synthetic oligonucleotide
cacgcagttcgtgcgattcgacagcga

SEQ ID NO: 41717 - DNA, 27 bp, Artificial Sequence
  Description of Artificial Sequence: Synthetic oligonucleotide
acgcagttcgtgcgattcgacagcgac

SEQ ID NO: 41718 - DNA, 26 bp, Artificial Sequence
  Description of Artificial Sequence: Synthetic oligonucleotide
cgcagttcgtgcgattcgacagcgac

SEQ ID NO: 41719 - DNA, 26 bp, Artificial Sequence
  Description of Artificial Sequence: Synthetic oligonucleotide
gcagttcgtgcgattcgacagcgacg

SEQ ID NO: 41720 - DNA, 26 bp, Artificial Sequence
  Description of Artificial Sequence: Synthetic oligonucleotide
cagttcgtgcgattcgacagcgacgc

SEQ ID NO: 41721 - DNA, 26 bp, Artificial Sequence
  Description of Artificial Sequence: Synthetic oligonucleotide
agttcgtgcgattcgacagcgacgcc

SEQ ID NO: 41722 - DNA, 25 bp, Artificial Sequence
  Description of Artificial Sequence: Synthetic oligonucleotide
gttcgtgcgattcgacagcgacgcc

SEQ ID NO: 41723 - DNA, 25 bp, Artificial Sequence
  Description of Artificial Sequence: Synthetic oligonucleotide
ttcgtgcgattcgacagcgacgccg

SEQ ID NO: 41724 - DNA, 24 bp, Artificial Sequence
  Description of Artificial Sequence: Synthetic oligonucleotide
tcgtgcgattcgacagcgacgccg

SEQ ID NO: 41725 - DNA, 23 bp, Artificial Sequence
  Description of Artificial Sequence: Synthetic oligonucleotide
cgtgcgattcgacagcgacgccg

SEQ ID NO: 41726 - DNA, 23 bp, Artificial Sequence
  Description of Artificial Sequence: Synthetic oligonucleotide
gtgcgattcgacagcgacgccgc

SEQ ID NO: 41727 - DNA, 24 bp, Artificial Sequence
  Description of Artificial Sequence: Synthetic oligonucleotide
tgcgattcgacagcgacgccgcga

SEQ ID NO: 41728 - DNA, 23 bp, Artificial Sequence
  Description of Artificial Sequence: Synthetic oligonucleotide
gcgattcgacagcgacgccgcga

SEQ ID NO: 41729 - DNA, 24 bp, Artificial Sequence
  Description of Artificial Sequence: Synthetic oligonucleotide
cgattcgacagcgacgccgcgagt

SEQ ID NO: 41730 - DNA, 23 bp, Artificial Sequence
  Description of Artificial Sequence: Synthetic oligonucleotide
cggacaccgcggctcagatcacg

SEQ ID NO: 41731 - DNA, 24 bp, Artificial Sequence
  Description of Artificial Sequence: Synthetic oligonucleotide
ggacaccgcggctcagatcacgca

SEQ ID NO: 41732 - DNA, 24 bp, Artificial Sequence
  Description of Artificial Sequence: Synthetic oligonucleotide
gacaccgcggctcagatcacgcag

SEQ ID NO: 41733 - DNA, 24 bp, Artificial Sequence
  Description of Artificial Sequence: Synthetic oligonucleotide
acaccgcggctcagatcacgcagc

SEQ ID NO: 41734 - DNA, 23 bp, Artificial Sequence
  Description of Artificial Sequence: Synthetic oligonucleotide
caccgcggctcagatcacgcagc

SEQ ID NO: 41735 - DNA, 23 bp, Artificial Sequence
  Description of Artificial Sequence: Synthetic oligonucleotide
accgcggctcagatcacgcagcg

SEQ ID NO: 41736 - DNA, 22 bp, Artificial Sequence
  Description of Artificial Sequence: Synthetic oligonucleotide
ccgcggctcagatcacgcagcg

SEQ ID NO: 41737 - DNA, 24 bp, Artificial Sequence
  Description of Artificial Sequence: Synthetic oligonucleotide
cgcggctcagatcacgcagcgcaa

SEQ ID NO: 41738 - DNA, 26 bp, Artificial Sequence
  Description of Artificial Sequence: Synthetic oligonucleotide
ctcagatcacgcagcgcaagtgggag

SEQ ID NO: 41739 - DNA, 26 bp, Artificial Sequence
  Description of Artificial Sequence: Synthetic oligonucleotide
tcagatcacgcagcgcaagtgggagg

SEQ ID NO: 41740 - DNA, 25 bp, Artificial Sequence
  Description of Artificial Sequence: Synthetic oligonucleotide
cagatcacgcagcgcaagtgggagg

SEQ ID NO: 41741 - DNA, 25 bp, Artificial Sequence
  Description of Artificial Sequence: Synthetic oligonucleotide
agatcacgcagcgcaagtgggaggc

SEQ ID NO: 41742 - DNA, 24 bp, Artificial Sequence
  Description of Artificial Sequence: Synthetic oligonucleotide
gatcacgcagcgcaagtgggaggc

SEQ ID NO: 41743 - DNA, 24 bp, Artificial Sequence
  Description of Artificial Sequence: Synthetic oligonucleotide
atcacgcagcgcaagtgggaggcg

SEQ ID NO: 41744 - DNA, 23 bp, Artificial Sequence
  Description of Artificial Sequence: Synthetic oligonucleotide
tcacgcagcgcaagtgggaggcg

SEQ ID NO: 41745 - DNA, 22 bp, Artificial Sequence
  Description of Artificial Sequence: Synthetic oligonucleotide
cacgcagcgcaagtgggaggcg

SEQ ID NO: 41746 - DNA, 22 bp, Artificial Sequence
  Description of Artificial Sequence: Synthetic oligonucleotide
acgcagcgcaagtgggaggcgg

SEQ ID NO: 41747 - DNA, 21 bp, Artificial Sequence
  Description of Artificial Sequence: Synthetic oligonucleotide
cgcagcgcaagtgggaggcgg

SEQ ID NO: 41748 - DNA, 21 bp, Artificial Sequence
  Description of Artificial Sequence: Synthetic oligonucleotide
gcagcgcaagtgggaggcggc

SEQ ID NO: 41749 - DNA, 22 bp, Artificial Sequence
  Description of Artificial Sequence: Synthetic oligonucleotide
cgctcttggaccgccgcggaca

SEQ ID NO: 41750 - DNA, 22 bp, Artificial Sequence
  Description of Artificial Sequence: Synthetic oligonucleotide
gctcttggaccgccgcggacac

SEQ ID NO: 41751 - DNA, 22 bp, Artificial Sequence
  Description of Artificial Sequence: Synthetic oligonucleotide
ctcttggaccgccgcggacacc

SEQ ID NO: 41752 - DNA, 22 bp, Artificial Sequence
  Description of Artificial Sequence: Synthetic oligonucleotide
tcttggaccgccgcggacaccg

SEQ ID NO: 41753 - DNA, 21 bp, Artificial Sequence
  Description of Artificial Sequence: Synthetic oligonucleotide
cttggaccgccgcggacaccg

SEQ ID NO: 41754 - DNA, 21 bp, Artificial Sequence
  Description of Artificial Sequence: Synthetic oligonucleotide
ttggaccgccgcggacaccgc

SEQ ID NO: 41755 - DNA, 35 bp, Artificial Sequence
  Description of Artificial Sequence: Synthetic oligonucleotide
gctcccattccatgaagtatttcttcacatccgtg

SEQ ID NO: 41756 - DNA, 36 bp, Artificial Sequence
  Description of Artificial Sequence: Synthetic oligonucleotide
ctcccattccatgaagtatttcttcacatccgtgtc

SEQ ID NO: 41757 - DNA, 36 bp, Artificial Sequence
  Description of Artificial Sequence: Synthetic oligonucleotide
tcccattccatgaagtatttcttcacatccgtgtcc

SEQ ID NO: 41758 - DNA, 35 bp, Artificial Sequence
  Description of Artificial Sequence: Synthetic oligonucleotide
cccattccatgaagtatttcttcacatccgtgtcc

SEQ ID NO: 41759 - DNA, 35 bp, Artificial Sequence
  Description of Artificial Sequence: Synthetic oligonucleotide
ccattccatgaagtatttcttcacatccgtgtccc

SEQ ID NO: 41760 - DNA, 35 bp, Artificial Sequence
  Description of Artificial Sequence: Synthetic oligonucleotide
cattccatgaagtatttcttcacatccgtgtcccg

SEQ ID NO: 41761 - DNA, 35 bp, Artificial Sequence
  Description of Artificial Sequence: Synthetic oligonucleotide
attccatgaagtatttcttcacatccgtgtcccgg

SEQ ID NO: 41762 - DNA, 34 bp, Artificial Sequence
  Description of Artificial Sequence: Synthetic oligonucleotide
ttccatgaagtatttcttcacatccgtgtcccgg

SEQ ID NO: 41763 - DNA, 27 bp, Artificial Sequence
  Description of Artificial Sequence: Synthetic oligonucleotide
aaaggagggagctgctctcaggctgca

SEQ ID NO: 41764 - DNA, 27 bp, Artificial Sequence
  Description of Artificial Sequence: Synthetic oligonucleotide
aaggagggagctgctctcaggctgcat

SEQ ID NO: 41765 - DNA, 26 bp, Artificial Sequence
  Description of Artificial Sequence: Synthetic oligonucleotide
aggagggagctgctctcaggctgcat

SEQ ID NO: 41766 - DNA, 25 bp, Artificial Sequence
  Description of Artificial Sequence: Synthetic oligonucleotide
ggagggagctgctctcaggctgcat

SEQ ID NO: 41767 - DNA, 25 bp, Artificial Sequence
  Description of Artificial Sequence: Synthetic oligonucleotide
gagggagctgctctcaggctgcatc

SEQ ID NO: 41768 - DNA, 26 bp, Artificial Sequence
  Description of Artificial Sequence: Synthetic oligonucleotide
agggagctgctctcaggctgcatcca

SEQ ID NO: 41769 - DNA, 25 bp, Artificial Sequence
  Description of Artificial Sequence: Synthetic oligonucleotide
gggagctgctctcaggctgcatcca

SEQ ID NO: 41770 - DNA, 25 bp, Artificial Sequence
  Description of Artificial Sequence: Synthetic oligonucleotide
ggagctgctctcaggctgcatccag

SEQ ID NO: 41771 - DNA, 27 bp, Artificial Sequence
  Description of Artificial Sequence: Synthetic oligonucleotide
gagctgctctcaggctgcatccagcaa

SEQ ID NO: 41772 - DNA, 27 bp, Artificial Sequence
  Description of Artificial Sequence: Synthetic oligonucleotide
agctgctctcaggctgcatccagcaac

SEQ ID NO: 41773 - DNA, 27 bp, Artificial Sequence
  Description of Artificial Sequence: Synthetic oligonucleotide
gctgctctcaggctgcatccagcaaca

SEQ ID NO: 41774 - DNA, 27 bp, Artificial Sequence
  Description of Artificial Sequence: Synthetic oligonucleotide
ctgctctcaggctgcatccagcaacag

SEQ ID NO: 41775 - DNA, 28 bp, Artificial Sequence
  Description of Artificial Sequence: Synthetic oligonucleotide
tgctctcaggctgcatccagcaacagtg

SEQ ID NO: 41776 - DNA, 27 bp, Artificial Sequence
  Description of Artificial Sequence: Synthetic oligonucleotide
gctctcaggctgcatccagcaacagtg

SEQ ID NO: 41777 - DNA, 27 bp, Artificial Sequence
  Description of Artificial Sequence: Synthetic oligonucleotide
ctctcaggctgcatccagcaacagtgc

SEQ ID NO: 41778 - DNA, 27 bp, Artificial Sequence
  Description of Artificial Sequence: Synthetic oligonucleotide
tctcaggctgcatccagcaacagtgcc

SEQ ID NO: 41779 - DNA, 26 bp, Artificial Sequence
  Description of Artificial Sequence: Synthetic oligonucleotide
ctcaggctgcatccagcaacagtgcc

SEQ ID NO: 41780 - DNA, 27 bp, Artificial Sequence
  Description of Artificial Sequence: Synthetic oligonucleotide
tcaggctgcatccagcaacagtgccca

SEQ ID NO: 41781 - DNA, 26 bp, Artificial Sequence
  Description of Artificial Sequence: Synthetic oligonucleotide
caggctgcatccagcaacagtgccca

SEQ ID NO: 41782 - DNA, 26 bp, Artificial Sequence
  Description of Artificial Sequence: Synthetic oligonucleotide
aggctgcatccagcaacagtgcccag

SEQ ID NO: 41783 - DNA, 25 bp, Artificial Sequence
  Description of Artificial Sequence: Synthetic oligonucleotide
ggctgcatccagcaacagtgcccag

SEQ ID NO: 41784 - DNA, 25 bp, Artificial Sequence
  Description of Artificial Sequence: Synthetic oligonucleotide
gctgcatccagcaacagtgcccagg

SEQ ID NO: 41785 - DNA, 25 bp, Artificial Sequence
  Description of Artificial Sequence: Synthetic oligonucleotide
ctgcatccagcaacagtgcccaggg

SEQ ID NO: 41786 - DNA, 26 bp, Artificial Sequence
  Description of Artificial Sequence: Synthetic oligonucleotide
tgcatccagcaacagtgcccagggct

SEQ ID NO: 41787 - DNA, 25 bp, Artificial Sequence
  Description of Artificial Sequence: Synthetic oligonucleotide
gcatccagcaacagtgcccagggct

SEQ ID NO: 41788 - DNA, 26 bp, Artificial Sequence
  Description of Artificial Sequence: Synthetic oligonucleotide
catccagcaacagtgcccagggctct

SEQ ID NO: 41789 - DNA, 27 bp, Artificial Sequence
  Description of Artificial Sequence: Synthetic oligonucleotide
atccagcaacagtgcccagggctctga

SEQ ID NO: 41790 - DNA, 23 bp, Artificial Sequence
  Description of Artificial Sequence: Synthetic oligonucleotide
aggacctgcgctcctggaccgct

SEQ ID NO: 41791 - DNA, 22 bp, Artificial Sequence
  Description of Artificial Sequence: Synthetic oligonucleotide
ggacctgcgctcctggaccgct

SEQ ID NO: 41792 - DNA, 22 bp, Artificial Sequence
  Description of Artificial Sequence: Synthetic oligonucleotide
gacctgcgctcctggaccgctg

SEQ ID NO: 41793 - DNA, 22 bp, Artificial Sequence
  Description of Artificial Sequence: Synthetic oligonucleotide
acctgcgctcctggaccgctgc

SEQ ID NO: 41794 - DNA, 21 bp, Artificial Sequence
  Description of Artificial Sequence: Synthetic oligonucleotide
cctgcgctcctggaccgctgc

SEQ ID NO: 41795 - DNA, 21 bp, Artificial Sequence
  Description of Artificial Sequence: Synthetic oligonucleotide
ctgcgctcctggaccgctgcg

SEQ ID NO: 41796 - DNA, 22 bp, Artificial Sequence
  Description of Artificial Sequence: Synthetic oligonucleotide
tgcgctcctggaccgctgcgga

SEQ ID NO: 41797 - DNA, 21 bp, Artificial Sequence
  Description of Artificial Sequence: Synthetic oligonucleotide
gcgctcctggaccgctgcgga

SEQ ID NO: 41798 - DNA, 22 bp, Artificial Sequence
  Description of Artificial Sequence: Synthetic oligonucleotide
cgctcctggaccgctgcggaca

SEQ ID NO: 41799 - DNA, 22 bp, Artificial Sequence
  Description of Artificial Sequence: Synthetic oligonucleotide
gctcctggaccgctgcggacac

SEQ ID NO: 41800 - DNA, 22 bp, Artificial Sequence
  Description of Artificial Sequence: Synthetic oligonucleotide
ctcctggaccgctgcggacacg

SEQ ID NO: 41801 - DNA, 22 bp, Artificial Sequence
  Description of Artificial Sequence: Synthetic oligonucleotide
tcctggaccgctgcggacacgg

SEQ ID NO: 41802 - DNA, 21 bp, Artificial Sequence
  Description of Artificial Sequence: Synthetic oligonucleotide
cctggaccgctgcggacacgg

SEQ ID NO: 41803 - DNA, 21 bp, Artificial Sequence
  Description of Artificial Sequence: Synthetic oligonucleotide
ctggaccgctgcggacacggc

SEQ ID NO: 41804 - DNA, 21 bp, Artificial Sequence
  Description of Artificial Sequence: Synthetic oligonucleotide
tggaccgctgcggacacggcg

SEQ ID NO: 41805 - DNA, 20 bp, Artificial Sequence
  Description of Artificial Sequence: Synthetic oligonucleotide
ggaccgctgcggacacggcg

SEQ ID NO: 41806 - DNA, 20 bp, Artificial Sequence
  Description of Artificial Sequence: Synthetic oligonucleotide
gaccgctgcggacacggcgg

SEQ ID NO: 41807 - DNA, 21 bp, Artificial Sequence
  Description of Artificial Sequence: Synthetic oligonucleotide
accgctgcggacacggcggct

SEQ ID NO: 41808 - DNA, 20 bp, Artificial Sequence
  Description of Artificial Sequence: Synthetic oligonucleotide
ccgctgcggacacggcggct

SEQ ID NO: 41809 - DNA, 21 bp, Artificial Sequence
  Description of Artificial Sequence: Synthetic oligonucleotide
cgctgcggacacggcggctca

SEQ ID NO: 41810 - DNA, 23 bp, Artificial Sequence
  Description of Artificial Sequence: Synthetic oligonucleotide
gctgcggacacggcggctcagat

SEQ ID NO: 41811 - DNA, 24 bp, Artificial Sequence
  Description of Artificial Sequence: Synthetic oligonucleotide
ctgcggacacggcggctcagatca

SEQ ID NO: 41812 - DNA, 24 bp, Artificial Sequence
  Description of Artificial Sequence: Synthetic oligonucleotide
tgcggacacggcggctcagatcac

SEQ ID NO: 41813 - DNA, 24 bp, Artificial Sequence
  Description of Artificial Sequence: Synthetic oligonucleotide
catgtgcagcacgaggggctgcca

SEQ ID NO: 41814 - DNA, 25 bp, Artificial Sequence
  Description of Artificial Sequence: Synthetic oligonucleotide
atgtgcagcacgaggggctgccaga

SEQ ID NO: 41815 - DNA, 24 bp, Artificial Sequence
  Description of Artificial Sequence: Synthetic oligonucleotide
tgtgcagcacgaggggctgccaga

SEQ ID NO: 41816 - DNA, 23 bp, Artificial Sequence
  Description of Artificial Sequence: Synthetic oligonucleotide
gtgcagcacgaggggctgccaga

SEQ ID NO: 41817 - DNA, 23 bp, Artificial Sequence
  Description of Artificial Sequence: Synthetic oligonucleotide
tgcagcacgaggggctgccagag

SEQ ID NO: 41818 - DNA, 22 bp, Artificial Sequence
  Description of Artificial Sequence: Synthetic oligonucleotide
gcagcacgaggggctgccagag

SEQ ID NO: 41819 - DNA, 22 bp, Artificial Sequence
  Description of Artificial Sequence: Synthetic oligonucleotide
cagcacgaggggctgccagagc

SEQ ID NO: 41820 - DNA, 22 bp, Artificial Sequence
  Description of Artificial Sequence: Synthetic oligonucleotide
agcacgaggggctgccagagcc

SEQ ID NO: 41821 - DNA, 21 bp, Artificial Sequence
  Description of Artificial Sequence: Synthetic oligonucleotide
gcacgaggggctgccagagcc

SEQ ID NO: 41822 - DNA, 21 bp, Artificial Sequence
  Description of Artificial Sequence: Synthetic oligonucleotide
cacgaggggctgccagagccc

SEQ ID NO: 41823 - DNA, 22 bp, Artificial Sequence
  Description of Artificial Sequence: Synthetic oligonucleotide
acgaggggctgccagagcccct

SEQ ID NO: 41824 - DNA, 21 bp, Artificial Sequence
  Description of Artificial Sequence: Synthetic oligonucleotide
cgaggggctgccagagcccct

SEQ ID NO: 41825 - DNA, 22 bp, Artificial Sequence
  Description of Artificial Sequence: Synthetic oligonucleotide
gaggggctgccagagcccctca

SEQ ID NO: 41826 - DNA, 22 bp, Artificial Sequence
  Description of Artificial Sequence: Synthetic oligonucleotide
aggggctgccagagcccctcac

SEQ ID NO: 41827 - DNA, 21 bp, Artificial Sequence
  Description of Artificial Sequence: Synthetic oligonucleotide
ggggctgccagagcccctcac

SEQ ID NO: 41828 - DNA, 21 bp, Artificial Sequence
  Description of Artificial Sequence: Synthetic oligonucleotide
gggctgccagagcccctcacc

SEQ ID NO: 41829 - DNA, 22 bp, Artificial Sequence
  Description of Artificial Sequence: Synthetic oligonucleotide
ggctgccagagcccctcaccct

SEQ ID NO: 41830 - DNA, 23 bp, Artificial Sequence
  Description of Artificial Sequence: Synthetic oligonucleotide
gctgccagagcccctcaccctga

SEQ ID NO: 41831 - DNA, 25 bp, Artificial Sequence
  Description of Artificial Sequence: Synthetic oligonucleotide
ctgccagagcccctcaccctgagat

SEQ ID NO: 41832 - DNA, 25 bp, Artificial Sequence
  Description of Artificial Sequence: Synthetic oligonucleotide
tgccagagcccctcaccctgagatg

SEQ ID NO: 41833 - DNA, 24 bp, Artificial Sequence
  Description of Artificial Sequence: Synthetic oligonucleotide
gccagagcccctcaccctgagatg

SEQ ID NO: 41834 - DNA, 24 bp, Artificial Sequence
  Description of Artificial Sequence: Synthetic oligonucleotide
ccagagcccctcaccctgagatgg

SEQ ID NO: 41835 - DNA, 25 bp, Artificial Sequence
  Description of Artificial Sequence: Synthetic oligonucleotide
cagagcccctcaccctgagatggga

SEQ ID NO: 41836 - DNA, 25 bp, Artificial Sequence
  Description of Artificial Sequence: Synthetic oligonucleotide
agagcccctcaccctgagatgggag

SEQ ID NO: 41837 - DNA, 26 bp, Artificial Sequence
  Description of Artificial Sequence: Synthetic oligonucleotide
ccatcttcccagcccaccatccccat

SEQ ID NO: 41838 - DNA, 26 bp, Artificial Sequence
  Description of Artificial Sequence: Synthetic oligonucleotide
catcttcccagcccaccatccccatc

SEQ ID NO: 41839 - DNA, 27 bp, Artificial Sequence
  Description of Artificial Sequence: Synthetic oligonucleotide
atcttcccagcccaccatccccatcgt

SEQ ID NO: 41840 - DNA, 29 bp, Artificial Sequence
  Description of Artificial Sequence: Synthetic oligonucleotide
ctgtcctagctgtcctaggagctgtgatg

SEQ ID NO: 41841 - DNA, 29 bp, Artificial Sequence
  Description of Artificial Sequence: Synthetic oligonucleotide
tgtcctagctgtcctaggagctgtgatgg

SEQ ID NO: 41842 - DNA, 28 bp, Artificial Sequence
  Description of Artificial Sequence: Synthetic oligonucleotide
gtcctagctgtcctaggagctgtgatgg

SEQ ID NO: 41843 - DNA, 28 bp, Artificial Sequence
  Description of Artificial Sequence: Synthetic oligonucleotide
tcctagctgtcctaggagctgtgatggc

SEQ ID NO: 41844 - DNA, 27 bp, Artificial Sequence
  Description of Artificial Sequence: Synthetic oligonucleotide
cctagctgtcctaggagctgtgatggc

SEQ ID NO: 41845 - DNA, 28 bp, Artificial Sequence
  Description of Artificial Sequence: Synthetic oligonucleotide
ctagctgtcctaggagctgtgatggctg

SEQ ID NO: 41846 - DNA, 30 bp, Artificial Sequence
  Description of Artificial Sequence: Synthetic oligonucleotide
tagctgtcctaggagctgtgatggctgttg

SEQ ID NO: 41847 - DNA, 29 bp, Artificial Sequence
  Description of Artificial Sequence: Synthetic oligonucleotide
agctgtcctaggagctgtgatggctgttg

SEQ ID NO: 41848 - DNA, 28 bp, Artificial Sequence
  Description of Artificial Sequence: Synthetic oligonucleotide
gctgtcctaggagctgtgatggctgttg

SEQ ID NO: 41849 - DNA, 29 bp, Artificial Sequence
  Description of Artificial Sequence: Synthetic oligonucleotide
ctgtcctaggagctgtgatggctgttgtg

SEQ ID NO: 41850 - DNA, 31 bp, Artificial Sequence
  Description of Artificial Sequence: Synthetic oligonucleotide
tgtcctaggagctgtgatggctgttgtgatg

SEQ ID NO: 41851 - DNA, 30 bp, Artificial Sequence
  Description of Artificial Sequence: Synthetic oligonucleotide
gtcctaggagctgtgatggctgttgtgatg

SEQ ID NO: 41852 - DNA, 31 bp, Artificial Sequence
  Description of Artificial Sequence: Synthetic oligonucleotide
tcctaggagctgtgatggctgttgtgatgtg

SEQ ID NO: 41853 - DNA, 30 bp, Artificial Sequence
  Description of Artificial Sequence: Synthetic oligonucleotide
cctaggagctgtgatggctgttgtgatgtg

SEQ ID NO: 41854 - DNA, 32 bp, Artificial Sequence
  Description of Artificial Sequence: Synthetic oligonucleotide
ctaggagctgtgatggctgttgtgatgtgtag

SEQ ID NO: 41855 - DNA, 32 bp, Artificial Sequence
  Description of Artificial Sequence: Synthetic oligonucleotide
taggagctgtgatggctgttgtgatgtgtagg

SEQ ID NO: 41856 - DNA, 31 bp, Artificial Sequence
  Description of Artificial Sequence: Synthetic oligonucleotide
aggagctgtgatggctgttgtgatgtgtagg

SEQ ID NO: 41857 - DNA, 30 bp, Artificial Sequence
  Description of Artificial Sequence: Synthetic oligonucleotide
ggagctgtgatggctgttgtgatgtgtagg

SEQ ID NO: 41858 - DNA, 31 bp, Artificial Sequence
  Description of Artificial Sequence: Synthetic oligonucleotide
gagctgtgatggctgttgtgatgtgtaggag

SEQ ID NO: 41859 - DNA, 31 bp, Artificial Sequence
  Description of Artificial Sequence: Synthetic oligonucleotide
agctgtgatggctgttgtgatgtgtaggagg

SEQ ID NO: 41860 - DNA, 30 bp, Artificial Sequence
  Description of Artificial Sequence: Synthetic oligonucleotide
gctgtgatggctgttgtgatgtgtaggagg

SEQ ID NO: 41861 - DNA, 32 bp, Artificial Sequence
  Description of Artificial Sequence: Synthetic oligonucleotide
ctgtgatggctgttgtgatgtgtaggaggaag

SEQ ID NO: 41862 - DNA, 33 bp, Artificial Sequence
  Description of Artificial Sequence: Synthetic oligonucleotide
tgtgatggctgttgtgatgtgtaggaggaagag

SEQ ID NO: 41863 - DNA, 32 bp, Artificial Sequence
  Description of Artificial Sequence: Synthetic oligonucleotide
gtgatggctgttgtgatgtgtaggaggaagag

SEQ ID NO: 41864 - DNA, 32 bp, Artificial Sequence
  Description of Artificial Sequence: Synthetic oligonucleotide
tgatggctgttgtgatgtgtaggaggaagagc

SEQ ID NO: 41865 - DNA, 31 bp, Artificial Sequence
  Description of Artificial Sequence: Synthetic oligonucleotide
gatggctgttgtgatgtgtaggaggaagagc

SEQ ID NO: 41866 - DNA, 32 bp, Artificial Sequence
  Description of Artificial Sequence: Synthetic oligonucleotide
atggctgttgtgatgtgtaggaggaagagctc

SEQ ID NO: 41867 - DNA, 20 bp, Artificial Sequence
  Description of Artificial Sequence: Synthetic oligonucleotide
cgacgggcgcctcctccgca

SEQ ID NO: 41868 - DNA, 23 bp, Artificial Sequence
  Description of Artificial Sequence: Synthetic oligonucleotide
acgggcgcctcctccgcaggtat

SEQ ID NO: 41869 - DNA, 22 bp, Artificial Sequence
  Description of Artificial Sequence: Synthetic oligonucleotide
cgggcgcctcctccgcaggtat

SEQ ID NO: 41870 - DNA, 23 bp, Artificial Sequence
  Description of Artificial Sequence: Synthetic oligonucleotide
gggcgcctcctccgcaggtatga

SEQ ID NO: 41871 - DNA, 23 bp, Artificial Sequence
  Description of Artificial Sequence: Synthetic oligonucleotide
ggcgcctcctccgcaggtatgac

SEQ ID NO: 41872 - DNA, 24 bp, Artificial Sequence
  Description of Artificial Sequence: Synthetic oligonucleotide
gcgcctcctccgcaggtatgacca

SEQ ID NO: 41873 - DNA, 26 bp, Artificial Sequence
  Description of Artificial Sequence: Synthetic oligonucleotide
cgcctcctccgcaggtatgaccagta

SEQ ID NO: 41874 - DNA, 26 bp, Artificial Sequence
  Description of Artificial Sequence: Synthetic oligonucleotide
gcctcctccgcaggtatgaccagtac

SEQ ID NO: 41875 - DNA, 26 bp, Artificial Sequence
  Description of Artificial Sequence: Synthetic oligonucleotide
cctcctccgcaggtatgaccagtacg

SEQ ID NO: 41876 - DNA, 26 bp, Artificial Sequence
  Description of Artificial Sequence: Synthetic oligonucleotide
ctcctccgcaggtatgaccagtacgc

SEQ ID NO: 41877 - DNA, 27 bp, Artificial Sequence
  Description of Artificial Sequence: Synthetic oligonucleotide
tcctccgcaggtatgaccagtacgcct

SEQ ID NO: 41878 - DNA, 27 bp, Artificial Sequence
  Description of Artificial Sequence: Synthetic oligonucleotide
cctccgcaggtatgaccagtacgccta

SEQ ID NO: 41879 - DNA, 27 bp, Artificial Sequence
  Description of Artificial Sequence: Synthetic oligonucleotide
ctccgcaggtatgaccagtacgcctac

SEQ ID NO: 41880 - DNA, 27 bp, Artificial Sequence
  Description of Artificial Sequence: Synthetic oligonucleotide
tccgcaggtatgaccagtacgcctacg

SEQ ID NO: 41881 - DNA, 27 bp, Artificial Sequence
  Description of Artificial Sequence: Synthetic oligonucleotide
ccgcaggtatgaccagtacgcctacga

SEQ ID NO: 41882 - DNA, 27 bp, Artificial Sequence
  Description of Artificial Sequence: Synthetic oligonucleotide
cgcaggtatgaccagtacgcctacgac

SEQ ID NO: 41883 - DNA, 27 bp, Artificial Sequence
  Description of Artificial Sequence: Synthetic oligonucleotide
gcaggtatgaccagtacgcctacgacg

SEQ ID NO: 41884 - DNA, 27 bp, Artificial Sequence
  Description of Artificial Sequence: Synthetic oligonucleotide
caggtatgaccagtacgcctacgacgg

SEQ ID NO: 41885 - DNA, 27 bp, Artificial Sequence
  Description of Artificial Sequence: Synthetic oligonucleotide
aggtatgaccagtacgcctacgacggc

SEQ ID NO: 41886 - DNA, 21 bp, Artificial Sequence
  Description of Artificial Sequence: Synthetic oligonucleotide
cggcctgtgaggcggagcagc

SEQ ID NO: 41887 - DNA, 21 bp, Artificial Sequence
  Description of Artificial Sequence: Synthetic oligonucleotide
ggcctgtgaggcggagcagcg

SEQ ID NO: 41888 - DNA, 22 bp, Artificial Sequence
  Description of Artificial Sequence: Synthetic oligonucleotide
gcctgtgaggcggagcagcgga

SEQ ID NO: 41889 - DNA, 23 bp, Artificial Sequence
  Description of Artificial Sequence: Synthetic oligonucleotide
cctgtgaggcggagcagcggaga

SEQ ID NO: 41890 - DNA, 23 bp, Artificial Sequence
  Description of Artificial Sequence: Synthetic oligonucleotide
ctgtgaggcggagcagcggagag

SEQ ID NO: 41891 - DNA, 23 bp, Artificial Sequence
  Description of Artificial Sequence: Synthetic oligonucleotide
tgtgaggcggagcagcggagagc

SEQ ID NO: 41892 - DNA, 25 bp, Artificial Sequence
  Description of Artificial Sequence: Synthetic oligonucleotide
gaaggagacgctgcagcgcgcgaaa

SEQ ID NO: 41893 - DNA, 26 bp, Artificial Sequence
  Description of Artificial Sequence: Synthetic oligonucleotide
aaggagacgctgcagcgcgcgaaaca

SEQ ID NO: 41894 - DNA, 25 bp, Artificial Sequence
  Description of Artificial Sequence: Synthetic oligonucleotide
aggagacgctgcagcgcgcgaaaca

SEQ ID NO: 41895 - DNA, 24 bp, Artificial Sequence
  Description of Artificial Sequence: Synthetic oligonucleotide
ggagacgctgcagcgcgcgaaaca

SEQ ID NO: 41896 - DNA, 24 bp, Artificial Sequence
  Description of Artificial Sequence: Synthetic oligonucleotide
gagacgctgcagcgcgcgaaacac

SEQ ID NO: 41897 - DNA, 24 bp, Artificial Sequence
  Description of Artificial Sequence: Synthetic oligonucleotide
agacgctgcagcgcgcgaaacacc

SEQ ID NO: 41898 - DNA, 23 bp, Artificial Sequence
  Description of Artificial Sequence: Synthetic oligonucleotide
gacgctgcagcgcgcgaaacacc

SEQ ID NO: 41899 - DNA, 26 bp, Artificial Sequence
  Description of Artificial Sequence: Synthetic oligonucleotide
acgctgcagcgcgcgaaacacccaaa

SEQ ID NO: 41900 - DNA, 25 bp, Artificial Sequence
  Description of Artificial Sequence: Synthetic oligonucleotide
cgctgcagcgcgcgaaacacccaaa

SEQ ID NO: 41901 - DNA, 26 bp, Artificial Sequence
  Description of Artificial Sequence: Synthetic oligonucleotide
gctgcagcgcgcgaaacacccaaaga

SEQ ID NO: 41902 - DNA, 27 bp, Artificial Sequence
  Description of Artificial Sequence: Synthetic oligonucleotide
ctgcagcgcgcgaaacacccaaagaca

SEQ ID NO: 41903 - DNA, 27 bp, Artificial Sequence
  Description of Artificial Sequence: Synthetic oligonucleotide
tgcagcgcgcgaaacacccaaagacac

SEQ ID NO: 41904 - DNA, 27 bp, Artificial Sequence
  Description of Artificial Sequence: Synthetic oligonucleotide
gcagcgcgcgaaacacccaaagacaca

SEQ ID NO: 41905 - DNA, 27 bp, Artificial Sequence
  Description of Artificial Sequence: Synthetic oligonucleotide
cagcgcgcgaaacacccaaagacacac

SEQ ID NO: 41906 - DNA, 27 bp, Artificial Sequence
  Description of Artificial Sequence: Synthetic oligonucleotide
agcgcgcgaaacacccaaagacacacg

SEQ ID NO: 41907 - DNA, 27 bp, Artificial Sequence
  Description of Artificial Sequence: Synthetic oligonucleotide
gcgcgcgaaacacccaaagacacacgt

SEQ ID NO: 41908 - DNA, 27 bp, Artificial Sequence
  Description of Artificial Sequence: Synthetic oligonucleotide
cgcgcgaaacacccaaagacacacgtg

SEQ ID NO: 41909 - DNA, 28 bp, Artificial Sequence
  Description of Artificial Sequence: Synthetic oligonucleotide
gcgcgaaacacccaaagacacacgtgac

SEQ ID NO: 41910 - DNA, 28 bp, Artificial Sequence
  Description of Artificial Sequence: Synthetic oligonucleotide
cgcgaaacacccaaagacacacgtgacc

SEQ ID NO: 41911 - DNA, 28 bp, Artificial Sequence
  Description of Artificial Sequence: Synthetic oligonucleotide
gcgaaacacccaaagacacacgtgaccc

SEQ ID NO: 41912 - DNA, 29 bp, Artificial Sequence
  Description of Artificial Sequence: Synthetic oligonucleotide
cgaaacacccaaagacacacgtgacccac

SEQ ID NO: 41913 - DNA, 29 bp, Artificial Sequence
  Description of Artificial Sequence: Synthetic oligonucleotide
gaaacacccaaagacacacgtgacccacc

SEQ ID NO: 41914 - DNA, 31 bp, Artificial Sequence
  Description of Artificial Sequence: Synthetic oligonucleotide
aaacacccaaagacacacgtgacccaccatc

SEQ ID NO: 41915 - DNA, 26 bp, Artificial Sequence
  Description of Artificial Sequence: Synthetic oligonucleotide
cgccaggcacagactgaccgagtgaa

SEQ ID NO: 41916 - DNA, 26 bp, Artificial Sequence
  Description of Artificial Sequence: Synthetic oligonucleotide
gccaggcacagactgaccgagtgaac

SEQ ID NO: 41917 - DNA, 27 bp, Artificial Sequence
  Description of Artificial Sequence: Synthetic oligonucleotide
ccaggcacagactgaccgagtgaacct

SEQ ID NO: 41918 - DNA, 27 bp, Artificial Sequence
  Description of Artificial Sequence: Synthetic oligonucleotide
caggcacagactgaccgagtgaacctg

SEQ ID NO: 41919 - DNA, 27 bp, Artificial Sequence
  Description of Artificial Sequence: Synthetic oligonucleotide
aggcacagactgaccgagtgaacctgc

SEQ ID NO: 41920 - DNA, 26 bp, Artificial Sequence
  Description of Artificial Sequence: Synthetic oligonucleotide
ggcacagactgaccgagtgaacctgc

SEQ ID NO: 41921 - DNA, 26 bp, Artificial Sequence
  Description of Artificial Sequence: Synthetic oligonucleotide
gcacagactgaccgagtgaacctgcg

SEQ ID NO: 41922 - DNA, 27 bp, Artificial Sequence
  Description of Artificial Sequence: Synthetic oligonucleotide
cacagactgaccgagtgaacctgcgga

SEQ ID NO: 41923 - DNA, 29 bp, Artificial Sequence
  Description of Artificial Sequence: Synthetic oligonucleotide
acagactgaccgagtgaacctgcggaaac

SEQ ID NO: 41924 - DNA, 28 bp, Artificial Sequence
  Description of Artificial Sequence: Synthetic oligonucleotide
cagactgaccgagtgaacctgcggaaac

SEQ ID NO: 41925 - DNA, 29 bp, Artificial Sequence
  Description of Artificial Sequence: Synthetic oligonucleotide
agactgaccgagtgaacctgcggaaactg

SEQ ID NO: 41926 - DNA, 28 bp, Artificial Sequence
  Description of Artificial Sequence: Synthetic oligonucleotide
gactgaccgagtgaacctgcggaaactg

SEQ ID NO: 41927 - DNA, 28 bp, Artificial Sequence
  Description of Artificial Sequence: Synthetic oligonucleotide
actgaccgagtgaacctgcggaaactgc

SEQ ID NO: 41928 - DNA, 27 bp, Artificial Sequence
  Description of Artificial Sequence: Synthetic oligonucleotide
ctgaccgagtgaacctgcggaaactgc

SEQ ID NO: 41929 - DNA, 27 bp, Artificial Sequence
  Description of Artificial Sequence: Synthetic oligonucleotide
tgaccgagtgaacctgcggaaactgcg

SEQ ID NO: 41930 - DNA, 26 bp, Artificial Sequence
  Description of Artificial Sequence: Synthetic oligonucleotide
gaccgagtgaacctgcggaaactgcg

SEQ ID NO: 41931 - DNA, 26 bp, Artificial Sequence
  Description of Artificial Sequence: Synthetic oligonucleotide
accgagtgaacctgcggaaactgcgc

SEQ ID NO: 41932 - DNA, 25 bp, Artificial Sequence
  Description of Artificial Sequence: Synthetic oligonucleotide
ccgagtgaacctgcggaaactgcgc

SEQ ID NO: 41933 - DNA, 25 bp, Artificial Sequence
  Description of Artificial Sequence: Synthetic oligonucleotide
cgagtgaacctgcggaaactgcgcg

SEQ ID NO: 41934 - DNA, 25 bp, Artificial Sequence
  Description of Artificial Sequence: Synthetic oligonucleotide
gagtgaacctgcggaaactgcgcgg

SEQ ID NO: 41935 - DNA, 27 bp, Artificial Sequence
  Description of Artificial Sequence: Synthetic oligonucleotide
agtgaacctgcggaaactgcgcggcta

SEQ ID NO: 41936 - DNA, 26 bp, Artificial Sequence
  Description of Artificial Sequence: Synthetic oligonucleotide
gtgaacctgcggaaactgcgcggcta

SEQ ID NO: 41937 - DNA, 27 bp, Artificial Sequence
  Description of Artificial Sequence: Synthetic oligonucleotide
tgaacctgcggaaactgcgcggctact

SEQ ID NO: 41938 - DNA, 27 bp, Artificial Sequence
  Description of Artificial Sequence: Synthetic oligonucleotide
gaacctgcggaaactgcgcggctacta

SEQ ID NO: 41939 - DNA, 27 bp, Artificial Sequence
  Description of Artificial Sequence: Synthetic oligonucleotide
aacctgcggaaactgcgcggctactac

SEQ ID NO: 41940 - DNA, 27 bp, Artificial Sequence
  Description of Artificial Sequence: Synthetic oligonucleotide
acctgcggaaactgcgcggctactaca

SEQ ID NO: 41941 - DNA, 26 bp, Artificial Sequence
  Description of Artificial Sequence: Synthetic oligonucleotide
agaacaggaaggagacgctgcagcgc

SEQ ID NO: 41942 - DNA, 25 bp, Artificial Sequence
  Description of Artificial Sequence: Synthetic oligonucleotide
gaacaggaaggagacgctgcagcgc

SEQ ID NO: 41943 - DNA, 25 bp, Artificial Sequence
  Description of Artificial Sequence: Synthetic oligonucleotide
aacaggaaggagacgctgcagcgcg

SEQ ID NO: 41944 - DNA, 24 bp, Artificial Sequence
  Description of Artificial Sequence: Synthetic oligonucleotide
acaggaaggagacgctgcagcgcg

SEQ ID NO: 41945 - DNA, 23 bp, Artificial Sequence
  Description of Artificial Sequence: Synthetic oligonucleotide
caggaaggagacgctgcagcgcg

SEQ ID NO: 41946 - DNA, 23 bp, Artificial Sequence
  Description of Artificial Sequence: Synthetic oligonucleotide
aggaaggagacgctgcagcgcgc

SEQ ID NO: 41947 - DNA, 28 bp, Artificial Sequence
  Description of Artificial Sequence: Synthetic oligonucleotide
agacacagaagtacaagcgccaggcacc

SEQ ID NO: 41948 - DNA, 27 bp, Artificial Sequence
  Description of Artificial Sequence: Synthetic oligonucleotide
gacacagaagtacaagcgccaggcacc

SEQ ID NO: 41949 - DNA, 27 bp, Artificial Sequence
  Description of Artificial Sequence: Synthetic oligonucleotide
acacagaagtacaagcgccaggcaccg

SEQ ID NO: 41950 - DNA, 27 bp, Artificial Sequence
  Description of Artificial Sequence: Synthetic oligonucleotide
cacagaagtacaagcgccaggcaccga

SEQ ID NO: 41951 - DNA, 27 bp, Artificial Sequence
  Description of Artificial Sequence: Synthetic oligonucleotide
acagaagtacaagcgccaggcaccgac

SEQ ID NO: 41952 - DNA, 27 bp, Artificial Sequence
  Description of Artificial Sequence: Synthetic oligonucleotide
cagaagtacaagcgccaggcaccgact

SEQ ID NO: 41953 - DNA, 27 bp, Artificial Sequence
  Description of Artificial Sequence: Synthetic oligonucleotide
agaagtacaagcgccaggcaccgactg

SEQ ID NO: 41954 - DNA, 27 bp, Artificial Sequence
  Description of Artificial Sequence: Synthetic oligonucleotide
gaagtacaagcgccaggcaccgactga

SEQ ID NO: 41955 - DNA, 27 bp, Artificial Sequence
  Description of Artificial Sequence: Synthetic oligonucleotide
aagtacaagcgccaggcaccgactgac

SEQ ID NO: 41956 - DNA, 26 bp, Artificial Sequence
  Description of Artificial Sequence: Synthetic oligonucleotide
agtacaagcgccaggcaccgactgac

SEQ ID NO: 41957 - DNA, 25 bp, Artificial Sequence
  Description of Artificial Sequence: Synthetic oligonucleotide
gtacaagcgccaggcaccgactgac

SEQ ID NO: 41958 - DNA, 25 bp, Artificial Sequence
  Description of Artificial Sequence: Synthetic oligonucleotide
tacaagcgccaggcaccgactgacc

SEQ ID NO: 41959 - DNA, 24 bp, Artificial Sequence
  Description of Artificial Sequence: Synthetic oligonucleotide
acaagcgccaggcaccgactgacc

SEQ ID NO: 41960 - DNA, 23 bp, Artificial Sequence
  Description of Artificial Sequence: Synthetic oligonucleotide
caagcgccaggcaccgactgacc

SEQ ID NO: 41961 - DNA, 24 bp, Artificial Sequence
  Description of Artificial Sequence: Synthetic oligonucleotide
aagcgccaggcaccgactgaccga

SEQ ID NO: 41962 - DNA, 23 bp, Artificial Sequence
  Description of Artificial Sequence: Synthetic oligonucleotide
agcgccaggcaccgactgaccga

SEQ ID NO: 41963 - DNA, 22 bp, Artificial Sequence
  Description of Artificial Sequence: Synthetic oligonucleotide
gcgccaggcaccgactgaccga

SEQ ID NO: 41964 - DNA, 23 bp, Artificial Sequence
  Description of Artificial Sequence: Synthetic oligonucleotide
cgccaggcaccgactgaccgagt

SEQ ID NO: 41965 - DNA, 24 bp, Artificial Sequence
  Description of Artificial Sequence: Synthetic oligonucleotide
gccaggcaccgactgaccgagtga

SEQ ID NO: 41966 - DNA, 24 bp, Artificial Sequence
  Description of Artificial Sequence: Synthetic oligonucleotide
ccaggcaccgactgaccgagtgag

SEQ ID NO: 41967 - DNA, 24 bp, Artificial Sequence
  Description of Artificial Sequence: Synthetic oligonucleotide
caggcaccgactgaccgagtgagc

SEQ ID NO: 41968 - DNA, 25 bp, Artificial Sequence
  Description of Artificial Sequence: Synthetic oligonucleotide
aggcaccgactgaccgagtgagcct

SEQ ID NO: 41969 - DNA, 24 bp, Artificial Sequence
  Description of Artificial Sequence: Synthetic oligonucleotide
ggcaccgactgaccgagtgagcct

SEQ ID NO: 41970 - DNA, 24 bp, Artificial Sequence
  Description of Artificial Sequence: Synthetic oligonucleotide
gcaccgactgaccgagtgagcctg

SEQ ID NO: 41971 - DNA, 24 bp, Artificial Sequence
  Description of Artificial Sequence: Synthetic oligonucleotide
caccgactgaccgagtgagcctgc

SEQ ID NO: 41972 - DNA, 24 bp, Artificial Sequence
  Description of Artificial Sequence: Synthetic oligonucleotide
accgactgaccgagtgagcctgcg

SEQ ID NO: 41973 - DNA, 23 bp, Artificial Sequence
  Description of Artificial Sequence: Synthetic oligonucleotide
ccgactgaccgagtgagcctgcg

SEQ ID NO: 41974 - DNA, 25 bp, Artificial Sequence
  Description of Artificial Sequence: Synthetic oligonucleotide
cgactgaccgagtgagcctgcggaa

SEQ ID NO: 41975 - DNA, 28 bp, Artificial Sequence
  Description of Artificial Sequence: Synthetic oligonucleotide
ggaccgggagacacagaagtacaagcac

SEQ ID NO: 41976 - DNA, 28 bp, Artificial Sequence
  Description of Artificial Sequence: Synthetic oligonucleotide
gaccgggagacacagaagtacaagcacc

SEQ ID NO: 41977 - DNA, 29 bp, Artificial Sequence
  Description of Artificial Sequence: Synthetic oligonucleotide
accgggagacacagaagtacaagcaccag

SEQ ID NO: 41978 - DNA, 28 bp, Artificial Sequence
  Description of Artificial Sequence: Synthetic oligonucleotide
ccgggagacacagaagtacaagcaccag

SEQ ID NO: 41979 - DNA, 28 bp, Artificial Sequence
  Description of Artificial Sequence: Synthetic oligonucleotide
cgggagacacagaagtacaagcaccagg

SEQ ID NO: 41980 - DNA, 28 bp, Artificial Sequence
  Description of Artificial Sequence: Synthetic oligonucleotide
gggagacacagaagtacaagcaccaggc

SEQ ID NO: 41981 - DNA, 29 bp, Artificial Sequence
  Description of Artificial Sequence: Synthetic oligonucleotide
ggagacacagaagtacaagcaccaggcac

SEQ ID NO: 41982 - DNA, 30 bp, Artificial Sequence
  Description of Artificial Sequence: Synthetic oligonucleotide
gagacacagaagtacaagcaccaggcacag

SEQ ID NO: 41983 - DNA, 31 bp, Artificial Sequence
  Description of Artificial Sequence: Synthetic oligonucleotide
agacacagaagtacaagcaccaggcacagac

SEQ ID NO: 41984 - DNA, 30 bp, Artificial Sequence
  Description of Artificial Sequence: Synthetic oligonucleotide
gacacagaagtacaagcaccaggcacagac

SEQ ID NO: 41985 - DNA, 31 bp, Artificial Sequence
  Description of Artificial Sequence: Synthetic oligonucleotide
acacagaagtacaagcaccaggcacagactg

SEQ ID NO: 41986 - DNA, 30 bp, Artificial Sequence
  Description of Artificial Sequence: Synthetic oligonucleotide
cacagaagtacaagcaccaggcacagactg

SEQ ID NO: 41987 - DNA, 31 bp, Artificial Sequence
  Description of Artificial Sequence: Synthetic oligonucleotide
acagaagtacaagcaccaggcacagactgac

SEQ ID NO: 41988 - DNA, 30 bp, Artificial Sequence
  Description of Artificial Sequence: Synthetic oligonucleotide
cagaagtacaagcaccaggcacagactgac

SEQ ID NO: 41989 - DNA, 30 bp, Artificial Sequence
  Description of Artificial Sequence: Synthetic oligonucleotide
agaagtacaagcaccaggcacagactgacc

SEQ ID NO: 41990 - DNA, 29 bp, Artificial Sequence
  Description of Artificial Sequence: Synthetic oligonucleotide
gaagtacaagcaccaggcacagactgacc

SEQ ID NO: 41991 - DNA, 29 bp, Artificial Sequence
  Description of Artificial Sequence: Synthetic oligonucleotide
aagtacaagcaccaggcacagactgaccg

SEQ ID NO: 41992 - DNA, 28 bp, Artificial Sequence
  Description of Artificial Sequence: Synthetic oligonucleotide
agtacaagcaccaggcacagactgaccg

SEQ ID NO: 41993 - DNA, 27 bp, Artificial Sequence
  Description of Artificial Sequence: Synthetic oligonucleotide
gtacaagcaccaggcacagactgaccg

SEQ ID NO: 41994 - DNA, 28 bp, Artificial Sequence
  Description of Artificial Sequence: Synthetic oligonucleotide
tacaagcaccaggcacagactgaccgag

SEQ ID NO: 41995 - DNA, 27 bp, Artificial Sequence
  Description of Artificial Sequence: Synthetic oligonucleotide
acaagcaccaggcacagactgaccgag

SEQ ID NO: 41996 - DNA, 27 bp, Artificial Sequence
  Description of Artificial Sequence: Synthetic oligonucleotide
caagcaccaggcacagactgaccgagt

SEQ ID NO: 41997 - DNA, 27 bp, Artificial Sequence
  Description of Artificial Sequence: Synthetic oligonucleotide
aagcaccaggcacagactgaccgagtg

SEQ ID NO: 41998 - DNA, 27 bp, Artificial Sequence
  Description of Artificial Sequence: Synthetic oligonucleotide
agcaccaggcacagactgaccgagtga

SEQ ID NO: 41999 - DNA, 26 bp, Artificial Sequence
  Description of Artificial Sequence: Synthetic oligonucleotide
gcaccaggcacagactgaccgagtga

SEQ ID NO: 42000 - DNA, 26 bp, Artificial Sequence
  Description of Artificial Sequence: Synthetic oligonucleotide
caccaggcacagactgaccgagtgag

SEQ ID NO: 42001 - DNA, 26 bp, Artificial Sequence
  Description of Artificial Sequence: Synthetic oligonucleotide
accaggcacagactgaccgagtgagc

SEQ ID NO: 42002 - DNA, 25 bp, Artificial Sequence
  Description of Artificial Sequence: Synthetic oligonucleotide
cgccaggcacagactgaccgagtgt

SEQ ID NO: 42003 - DNA, 25 bp, Artificial Sequence
  Description of Artificial Sequence: Synthetic oligonucleotide
gccaggcacagactgaccgagtgtg

SEQ ID NO: 42004 - DNA, 25 bp, Artificial Sequence
  Description of Artificial Sequence: Synthetic oligonucleotide
ccaggcacagactgaccgagtgtgc

SEQ ID NO: 42005 - DNA, 26 bp, Artificial Sequence
  Description of Artificial Sequence: Synthetic oligonucleotide
caggcacagactgaccgagtgtgcct

SEQ ID NO: 42006 - DNA, 26 bp, Artificial Sequence
  Description of Artificial Sequence: Synthetic oligonucleotide
aggcacagactgaccgagtgtgcctg

SEQ ID NO: 42007 - DNA, 25 bp, Artificial Sequence
  Description of Artificial Sequence: Synthetic oligonucleotide
ggcacagactgaccgagtgtgcctg

SEQ ID NO: 42008 - DNA, 25 bp, Artificial Sequence
  Description of Artificial Sequence: Synthetic oligonucleotide
gcacagactgaccgagtgtgcctgc

SEQ ID NO: 42009 - DNA, 25 bp, Artificial Sequence
  Description of Artificial Sequence: Synthetic oligonucleotide
cacagactgaccgagtgtgcctgcg

SEQ ID NO: 42010 - DNA, 27 bp, Artificial Sequence
  Description of Artificial Sequence: Synthetic oligonucleotide
acagactgaccgagtgtgcctgcggaa

SEQ ID NO: 42011 - DNA, 26 bp, Artificial Sequence
  Description of Artificial Sequence: Synthetic oligonucleotide
cagactgaccgagtgtgcctgcggaa

SEQ ID NO: 42012 - DNA, 26 bp, Artificial Sequence
  Description of Artificial Sequence: Synthetic oligonucleotide
agactgaccgagtgtgcctgcggaac

SEQ ID NO: 42013 - DNA, 25 bp, Artificial Sequence
  Description of Artificial Sequence: Synthetic oligonucleotide
gactgaccgagtgtgcctgcggaac

SEQ ID NO: 42014 - DNA, 26 bp, Artificial Sequence
  Description of Artificial Sequence: Synthetic oligonucleotide
actgaccgagtgtgcctgcggaacct

SEQ ID NO: 42015 - DNA, 25 bp, Artificial Sequence
  Description of Artificial Sequence: Synthetic oligonucleotide
ctgaccgagtgtgcctgcggaacct

SEQ ID NO: 42016 - DNA, 25 bp, Artificial Sequence
  Description of Artificial Sequence: Synthetic oligonucleotide
tgaccgagtgtgcctgcggaacctg

SEQ ID NO: 42017 - DNA, 24 bp, Artificial Sequence
  Description of Artificial Sequence: Synthetic oligonucleotide
gaccgagtgtgcctgcggaacctg

SEQ ID NO: 42018 - DNA, 24 bp, Artificial Sequence
  Description of Artificial Sequence: Synthetic oligonucleotide
accgagtgtgcctgcggaacctgc

SEQ ID NO: 42019 - DNA, 23 bp, Artificial Sequence
  Description of Artificial Sequence: Synthetic oligonucleotide
ccgagtgtgcctgcggaacctgc

SEQ ID NO: 42020 - DNA, 23 bp, Artificial Sequence
  Description of Artificial Sequence: Synthetic oligonucleotide
cgagtgtgcctgcggaacctgcg

SEQ ID NO: 42021 - DNA, 23 bp, Artificial Sequence
  Description of Artificial Sequence: Synthetic oligonucleotide
gagtgtgcctgcggaacctgcgc

SEQ ID NO: 42022 - DNA, 23 bp, Artificial Sequence
  Description of Artificial Sequence: Synthetic oligonucleotide
agtgtgcctgcggaacctgcgcg

SEQ ID NO: 42023 - DNA, 22 bp, Artificial Sequence
  Description of Artificial Sequence: Synthetic oligonucleotide
gtgtgcctgcggaacctgcgcg

SEQ ID NO: 42024 - DNA, 22 bp, Artificial Sequence
  Description of Artificial Sequence: Synthetic oligonucleotide
tgtgcctgcggaacctgcgcgg

SEQ ID NO: 42025 - DNA, 27 bp, Artificial Sequence
  Description of Artificial Sequence: Synthetic oligonucleotide
atacctggagaacgggaaggagacgcc

SEQ ID NO: 42026 - DNA, 26 bp, Artificial Sequence
  Description of Artificial Sequence: Synthetic oligonucleotide
tacctggagaacgggaaggagacgcc

SEQ ID NO: 42027 - DNA, 25 bp, Artificial Sequence
  Description of Artificial Sequence: Synthetic oligonucleotide
acctggagaacgggaaggagacgcc

SEQ ID NO: 42028 - DNA, 24 bp, Artificial Sequence
  Description of Artificial Sequence: Synthetic oligonucleotide
cctggagaacgggaaggagacgcc

SEQ ID NO: 42029 - DNA, 24 bp, Artificial Sequence
  Description of Artificial Sequence: Synthetic oligonucleotide
ctggagaacgggaaggagacgccg

SEQ ID NO: 42030 - DNA, 25 bp, Artificial Sequence
  Description of Artificial Sequence: Synthetic oligonucleotide
tggagaacgggaaggagacgccgca

SEQ ID NO: 42031 - DNA, 24 bp, Artificial Sequence
  Description of Artificial Sequence: Synthetic oligonucleotide
ggagaacgggaaggagacgccgca

SEQ ID NO: 42032 - DNA, 24 bp, Artificial Sequence
  Description of Artificial Sequence: Synthetic oligonucleotide
gagaacgggaaggagacgccgcag

SEQ ID NO: 42033 - DNA, 24 bp, Artificial Sequence
  Description of Artificial Sequence: Synthetic oligonucleotide
agaacgggaaggagacgccgcagc

SEQ ID NO: 42034 - DNA, 23 bp, Artificial Sequence
  Description of Artificial Sequence: Synthetic oligonucleotide
gaacgggaaggagacgccgcagc

SEQ ID NO: 42035 - DNA, 23 bp, Artificial Sequence
  Description of Artificial Sequence: Synthetic oligonucleotide
aacgggaaggagacgccgcagcg

SEQ ID NO: 42036 - DNA, 22 bp, Artificial Sequence
  Description of Artificial Sequence: Synthetic oligonucleotide
acgggaaggagacgccgcagcg

SEQ ID NO: 42037 - DNA, 21 bp, Artificial Sequence
  Description of Artificial Sequence: Synthetic oligonucleotide
cgggaaggagacgccgcagcg

SEQ ID NO: 42038 - DNA, 21 bp, Artificial Sequence
  Description of Artificial Sequence: Synthetic oligonucleotide
gggaaggagacgccgcagcgc

SEQ ID NO: 42039 - DNA, 21 bp, Artificial Sequence
  Description of Artificial Sequence: Synthetic oligonucleotide
ggaaggagacgccgcagcgcg

SEQ ID NO: 42040 - DNA, 21 bp, Artificial Sequence
  Description of Artificial Sequence: Synthetic oligonucleotide
gaaggagacgccgcagcgcgc

SEQ ID NO: 42041 - DNA, 21 bp, Artificial Sequence
  Description of Artificial Sequence: Synthetic oligonucleotide
aaggagacgccgcagcgcgcg

SEQ ID NO: 42042 - DNA, 20 bp, Artificial Sequence
  Description of Artificial Sequence: Synthetic oligonucleotide
aggagacgccgcagcgcgcg

SEQ ID NO: 42043 - DNA, 20 bp, Artificial Sequence
  Description of Artificial Sequence: Synthetic oligonucleotide
ggagacgccgcagcgcgcgt

SEQ ID NO: 42044 - DNA, 20 bp, Artificial Sequence
  Description of Artificial Sequence: Synthetic oligonucleotide
gagacgccgcagcgcgcggt

SEQ ID NO: 42045 - DNA, 22 bp, Artificial Sequence
  Description of Artificial Sequence: Synthetic oligonucleotide
ctcctggaccgccgtggacacc

SEQ ID NO: 42046 - DNA, 22 bp, Artificial Sequence
  Description of Artificial Sequence: Synthetic oligonucleotide
tcctggaccgccgtggacaccg

SEQ ID NO: 42047 - DNA, 21 bp, Artificial Sequence
  Description of Artificial Sequence: Synthetic oligonucleotide
cctggaccgccgtggacaccg

SEQ ID NO: 42048 - DNA, 21 bp, Artificial Sequence
  Description of Artificial Sequence: Synthetic oligonucleotide
ctggaccgccgtggacaccgc

SEQ ID NO: 42049 - DNA, 21 bp, Artificial Sequence
  Description of Artificial Sequence: Synthetic oligonucleotide
tggaccgccgtggacaccgcg

SEQ ID NO: 42050 - DNA, 20 bp, Artificial Sequence
  Description of Artificial Sequence: Synthetic oligonucleotide
ggaccgccgtggacaccgcg

SEQ ID NO: 42051 - DNA, 20 bp, Artificial Sequence
  Description of Artificial Sequence: Synthetic oligonucleotide
gaccgccgtggacaccgcgg

SEQ ID NO: 42052 - DNA, 21 bp, Artificial Sequence
  Description of Artificial Sequence: Synthetic oligonucleotide
accgccgtggacaccgcggct

SEQ ID NO: 42053 - DNA, 20 bp, Artificial Sequence
  Description of Artificial Sequence: Synthetic oligonucleotide
ccgccgtggacaccgcggct

SEQ ID NO: 42054 - DNA, 21 bp, Artificial Sequence
  Description of Artificial Sequence: Synthetic oligonucleotide
cgccgtggacaccgcggctca

SEQ ID NO: 42055 - DNA, 23 bp, Artificial Sequence
  Description of Artificial Sequence: Synthetic oligonucleotide
gccgtggacaccgcggctcagat

SEQ ID NO: 42056 - DNA, 24 bp, Artificial Sequence
  Description of Artificial Sequence: Synthetic oligonucleotide
ccgtggacaccgcggctcagatca

SEQ ID NO: 42057 - DNA, 24 bp, Artificial Sequence
  Description of Artificial Sequence: Synthetic oligonucleotide
cgtggacaccgcggctcagatcac

SEQ ID NO: 42058 - DNA, 25 bp, Artificial Sequence
  Description of Artificial Sequence: Synthetic oligonucleotide
gaggacgggtctcacaccctccagt

SEQ ID NO: 42059 - DNA, 25 bp, Artificial Sequence
  Description of Artificial Sequence: Synthetic oligonucleotide
aggacgggtctcacaccctccagtg

SEQ ID NO: 42060 - DNA, 24 bp, Artificial Sequence
  Description of Artificial Sequence: Synthetic oligonucleotide
ggacgggtctcacaccctccagtg

SEQ ID NO: 42061 - DNA, 26 bp, Artificial Sequence
  Description of Artificial Sequence: Synthetic oligonucleotide
gacgggtctcacaccctccagtggat

SEQ ID NO: 42062 - DNA, 27 bp, Artificial Sequence
  Description of Artificial Sequence: Synthetic oligonucleotide
acgggtctcacaccctccagtggatgt

SEQ ID NO: 42063 - DNA, 30 bp, Artificial Sequence
  Description of Artificial Sequence: Synthetic oligonucleotide
caggagatggaaccttccagaagtgggaag

SEQ ID NO: 42064 - DNA, 30 bp, Artificial Sequence
  Description of Artificial Sequence: Synthetic oligonucleotide
aggagatggaaccttccagaagtgggaagc

SEQ ID NO: 42065 - DNA, 29 bp, Artificial Sequence
  Description of Artificial Sequence: Synthetic oligonucleotide
ggagatggaaccttccagaagtgggaagc

SEQ ID NO: 42066 - DNA, 30 bp, Artificial Sequence
  Description of Artificial Sequence: Synthetic oligonucleotide
gagatggaaccttccagaagtgggaagctg

SEQ ID NO: 42067 - DNA, 31 bp, Artificial Sequence
  Description of Artificial Sequence: Synthetic oligonucleotide
agatggaaccttccagaagtgggaagctgtg

SEQ ID NO: 42068 - DNA, 30 bp, Artificial Sequence
  Description of Artificial Sequence: Synthetic oligonucleotide
gatggaaccttccagaagtgggaagctgtg

SEQ ID NO: 42069 - DNA, 32 bp, Artificial Sequence
  Description of Artificial Sequence: Synthetic oligonucleotide
atggaaccttccagaagtgggaagctgtgatg

SEQ ID NO: 42070 - DNA, 31 bp, Artificial Sequence
  Description of Artificial Sequence: Synthetic oligonucleotide
tggaaccttccagaagtgggaagctgtgatg

SEQ ID NO: 42071 - DNA, 30 bp, Artificial Sequence
  Description of Artificial Sequence: Synthetic oligonucleotide
ggaaccttccagaagtgggaagctgtgatg

SEQ ID NO: 42072 - DNA, 30 bp, Artificial Sequence
  Description of Artificial Sequence: Synthetic oligonucleotide
gaaccttccagaagtgggaagctgtgatgg

SEQ ID NO: 42073 - DNA, 31 bp, Artificial Sequence
  Description of Artificial Sequence: Synthetic oligonucleotide
aaccttccagaagtgggaagctgtgatggtg

SEQ ID NO: 42074 - DNA, 30 bp, Artificial Sequence
  Description of Artificial Sequence: Synthetic oligonucleotide
accttccagaagtgggaagctgtgatggtg

SEQ ID NO: 42075 - DNA, 29 bp, Artificial Sequence
  Description of Artificial Sequence: Synthetic oligonucleotide
ccttccagaagtgggaagctgtgatggtg

SEQ ID NO: 42076 - DNA, 29 bp, Artificial Sequence
  Description of Artificial Sequence: Synthetic oligonucleotide
cttccagaagtgggaagctgtgatggtgc

SEQ ID NO: 42077 - DNA, 29 bp, Artificial Sequence
  Description of Artificial Sequence: Synthetic oligonucleotide
ttccagaagtgggaagctgtgatggtgcc

SEQ ID NO: 42078 - DNA, 28 bp, Artificial Sequence
  Description of Artificial Sequence: Synthetic oligonucleotide
tccagaagtgggaagctgtgatggtgcc

SEQ ID NO: 42079 - DNA, 27 bp, Artificial Sequence
  Description of Artificial Sequence: Synthetic oligonucleotide
ccagaagtgggaagctgtgatggtgcc

SEQ ID NO: 42080 - DNA, 29 bp, Artificial Sequence
  Description of Artificial Sequence: Synthetic oligonucleotide
cagaagtgggaagctgtgatggtgccttc

SEQ ID NO: 42081 - DNA, 30 bp, Artificial Sequence
  Description of Artificial Sequence: Synthetic oligonucleotide
agaagtgggaagctgtgatggtgccttctg

SEQ ID NO: 42082 - DNA, 29 bp, Artificial Sequence
  Description of Artificial Sequence: Synthetic oligonucleotide
gaagtgggaagctgtgatggtgccttctg

SEQ ID NO: 42083 - DNA, 29 bp, Artificial Sequence
  Description of Artificial Sequence: Synthetic oligonucleotide
aagtgggaagctgtgatggtgccttctgg

SEQ ID NO: 42084 - DNA, 28 bp, Artificial Sequence
  Description of Artificial Sequence: Synthetic oligonucleotide
agtgggaagctgtgatggtgccttctgg

SEQ ID NO: 42085 - DNA, 27 bp, Artificial Sequence
  Description of Artificial Sequence: Synthetic oligonucleotide
gtgggaagctgtgatggtgccttctgg

SEQ ID NO: 42086 - DNA, 28 bp, Artificial Sequence
  Description of Artificial Sequence: Synthetic oligonucleotide
tgggaagctgtgatggtgccttctggag

SEQ ID NO: 42087 - DNA, 27 bp, Artificial Sequence
  Description of Artificial Sequence: Synthetic oligonucleotide
gggaagctgtgatggtgccttctggag

SEQ ID NO: 42088 - DNA, 29 bp, Artificial Sequence
  Description of Artificial Sequence: Synthetic oligonucleotide
ggaagctgtgatggtgccttctggagaag

SEQ ID NO: 42089 - DNA, 30 bp, Artificial Sequence
  Description of Artificial Sequence: Synthetic oligonucleotide
gaagctgtgatggtgccttctggagaagag

SEQ ID NO: 42090 - DNA, 30 bp, Artificial Sequence
  Description of Artificial Sequence: Synthetic oligonucleotide
aagctgtgatggtgccttctggagaagagc

SEQ ID NO: 42091 - DNA, 27 bp, Artificial Sequence
  Description of Artificial Sequence: Synthetic oligonucleotide
cttccagaagtgggcagctgtgatggc

SEQ ID NO: 42092 - DNA, 27 bp, Artificial Sequence
  Description of Artificial Sequence: Synthetic oligonucleotide
ttccagaagtgggcagctgtgatggcg

SEQ ID NO: 42093 - DNA, 26 bp, Artificial Sequence
  Description of Artificial Sequence: Synthetic oligonucleotide
tccagaagtgggcagctgtgatggcg

SEQ ID NO: 42094 - DNA, 25 bp, Artificial Sequence
  Description of Artificial Sequence: Synthetic oligonucleotide
ccagaagtgggcagctgtgatggcg

SEQ ID NO: 42095 - DNA, 25 bp, Artificial Sequence
  Description of Artificial Sequence: Synthetic oligonucleotide
cagaagtgggcagctgtgatggcgc

SEQ ID NO: 42096 - DNA, 27 bp, Artificial Sequence
  Description of Artificial Sequence: Synthetic oligonucleotide
agaagtgggcagctgtgatggcgcctt

SEQ ID NO: 42097 - DNA, 26 bp, Artificial Sequence
  Description of Artificial Sequence: Synthetic oligonucleotide
gaagtgggcagctgtgatggcgcctt

SEQ ID NO: 42098 - DNA, 27 bp, Artificial Sequence
  Description of Artificial Sequence: Synthetic oligonucleotide
aagtgggcagctgtgatggcgccttct

SEQ ID NO: 42099 - DNA, 26 bp, Artificial Sequence
  Description of Artificial Sequence: Synthetic oligonucleotide
agtgggcagctgtgatggcgccttct

SEQ ID NO: 42100 - DNA, 25 bp, Artificial Sequence
  Description of Artificial Sequence: Synthetic oligonucleotide
gtgggcagctgtgatggcgccttct

SEQ ID NO: 42101 - DNA, 25 bp, Artificial Sequence
  Description of Artificial Sequence: Synthetic oligonucleotide
tgggcagctgtgatggcgccttctg

SEQ ID NO: 42102 - DNA, 24 bp, Artificial Sequence
  Description of Artificial Sequence: Synthetic oligonucleotide
gggcagctgtgatggcgccttctg

SEQ ID NO: 42103 - DNA, 25 bp, Artificial Sequence
  Description of Artificial Sequence: Synthetic oligonucleotide
ggcagctgtgatggcgccttctgga

SEQ ID NO: 42104 - DNA, 27 bp, Artificial Sequence
  Description of Artificial Sequence: Synthetic oligonucleotide
gcagctgtgatggcgccttctggagaa

SEQ ID NO: 42105 - DNA, 27 bp, Artificial Sequence
  Description of Artificial Sequence: Synthetic oligonucleotide
cagctgtgatggcgccttctggagaag

SEQ ID NO: 42106 - DNA, 28 bp, Artificial Sequence
  Description of Artificial Sequence: Synthetic oligonucleotide
agctgtgatggcgccttctggagaagag

SEQ ID NO: 42107 - DNA, 27 bp, Artificial Sequence
  Description of Artificial Sequence: Synthetic oligonucleotide
gctgtgatggcgccttctggagaagag

SEQ ID NO: 42108 - DNA, 27 bp, Artificial Sequence
  Description of Artificial Sequence: Synthetic oligonucleotide
ctgtgatggcgccttctggagaagagc

SEQ ID NO: 42109 - DNA, 28 bp, Artificial Sequence
  Description of Artificial Sequence: Synthetic oligonucleotide
tgtgatggcgccttctggagaagagcag

SEQ ID NO: 42110 - DNA, 27 bp, Artificial Sequence
  Description of Artificial Sequence: Synthetic oligonucleotide
gtgatggcgccttctggagaagagcag

SEQ ID NO: 42111 - DNA, 28 bp, Artificial Sequence
  Description of Artificial Sequence: Synthetic oligonucleotide
tgatggcgccttctggagaagagcagag

SEQ ID NO: 42112 - DNA, 27 bp, Artificial Sequence
  Description of Artificial Sequence: Synthetic oligonucleotide
gatggcgccttctggagaagagcagag

SEQ ID NO: 42113 - DNA, 30 bp, Artificial Sequence
  Description of Artificial Sequence: Synthetic oligonucleotide
atggcgccttctggagaagagcagagatac

SEQ ID NO: 42114 - DNA, 29 bp, Artificial Sequence
  Description of Artificial Sequence: Synthetic oligonucleotide
tggcgccttctggagaagagcagagatac

SEQ ID NO: 42115 - DNA, 28 bp, Artificial Sequence
  Description of Artificial Sequence: Synthetic oligonucleotide
ggcgccttctggagaagagcagagatac

SEQ ID NO: 42116 - DNA, 29 bp, Artificial Sequence
  Description of Artificial Sequence: Synthetic oligonucleotide
gcgccttctggagaagagcagagatacac

SEQ ID NO: 42117 - DNA, 29 bp, Artificial Sequence
  Description of Artificial Sequence: Synthetic oligonucleotide
cgccttctggagaagagcagagatacacg

SEQ ID NO: 42118 - DNA, 21 bp, Artificial Sequence
  Description of Artificial Sequence: Synthetic oligonucleotide
ggtggagcaggaggggccgca

SEQ ID NO: 42119 - DNA, 25 bp, Artificial Sequence
  Description of Artificial Sequence: Synthetic oligonucleotide
gtggagcaggaggggccgcagtatt

SEQ ID NO: 42120 - DNA, 25 bp, Artificial Sequence
  Description of Artificial Sequence: Synthetic oligonucleotide
tggagcaggaggggccgcagtattg

SEQ ID NO: 42121 - DNA, 24 bp, Artificial Sequence
  Description of Artificial Sequence: Synthetic oligonucleotide
ggagcaggaggggccgcagtattg

SEQ ID NO: 42122 - DNA, 24 bp, Artificial Sequence
  Description of Artificial Sequence: Synthetic oligonucleotide
gagcaggaggggccgcagtattgg

SEQ ID NO: 42123 - DNA, 25 bp, Artificial Sequence
  Description of Artificial Sequence: Synthetic oligonucleotide
agcaggaggggccgcagtattggga

SEQ ID NO: 42124 - DNA, 24 bp, Artificial Sequence
  Description of Artificial Sequence: Synthetic oligonucleotide
gcaggaggggccgcagtattggga

SEQ ID NO: 42125 - DNA, 24 bp, Artificial Sequence
  Description of Artificial Sequence: Synthetic oligonucleotide
caggaggggccgcagtattgggac

SEQ ID NO: 42126 - DNA, 24 bp, Artificial Sequence
  Description of Artificial Sequence: Synthetic oligonucleotide
aggaggggccgcagtattgggacc

SEQ ID NO: 42127 - DNA, 23 bp, Artificial Sequence
  Description of Artificial Sequence: Synthetic oligonucleotide
ggaggggccgcagtattgggacc

SEQ ID NO: 42128 - DNA, 23 bp, Artificial Sequence
  Description of Artificial Sequence: Synthetic oligonucleotide
gaggggccgcagtattgggaccg

SEQ ID NO: 42129 - DNA, 23 bp, Artificial Sequence
  Description of Artificial Sequence: Synthetic oligonucleotide
aggggccgcagtattgggaccgg

SEQ ID NO: 42130 - DNA, 22 bp, Artificial Sequence
  Description of Artificial Sequence: Synthetic oligonucleotide
ggggccgcagtattgggaccgg

SEQ ID NO: 42131 - DNA, 23 bp, Artificial Sequence
  Description of Artificial Sequence: Synthetic oligonucleotide
gggccgcagtattgggaccggga

SEQ ID NO: 42132 - DNA, 24 bp, Artificial Sequence
  Description of Artificial Sequence: Synthetic oligonucleotide
ggccgcagtattgggaccgggaga

SEQ ID NO: 42133 - DNA, 25 bp, Artificial Sequence
  Description of Artificial Sequence: Synthetic oligonucleotide
gccgcagtattgggaccgggagaca

SEQ ID NO: 42134 - DNA, 26 bp, Artificial Sequence
  Description of Artificial Sequence: Synthetic oligonucleotide
ccgcagtattgggaccgggagacaca

SEQ ID NO: 42135 - DNA, 27 bp, Artificial Sequence
  Description of Artificial Sequence: Synthetic oligonucleotide
cgcagtattgggaccgggagacacaga

SEQ ID NO: 42136 - DNA, 28 bp, Artificial Sequence
  Description of Artificial Sequence: Synthetic oligonucleotide
gcagtattgggaccgggagacacagaag

SEQ ID NO: 42137 - DNA, 30 bp, Artificial Sequence
  Description of Artificial Sequence: Synthetic oligonucleotide
cagtattgggaccgggagacacagaagtac

SEQ ID NO: 42138 - DNA, 27 bp, Artificial Sequence
  Description of Artificial Sequence: Synthetic oligonucleotide
tccgcgggtatgaccagtacgcctact

SEQ ID NO: 42139 - DNA, 27 bp, Artificial Sequence
  Description of Artificial Sequence: Synthetic oligonucleotide
ccgcgggtatgaccagtacgcctacta

SEQ ID NO: 42140 - DNA, 27 bp, Artificial Sequence
  Description of Artificial Sequence: Synthetic oligonucleotide
cgcgggtatgaccagtacgcctactac

SEQ ID NO: 42141 - DNA, 27 bp, Artificial Sequence
  Description of Artificial Sequence: Synthetic oligonucleotide
gcgggtatgaccagtacgcctactacg

SEQ ID NO: 42142 - DNA, 27 bp, Artificial Sequence
  Description of Artificial Sequence: Synthetic oligonucleotide
cgggtatgaccagtacgcctactacgg

SEQ ID NO: 42143 - DNA, 27 bp, Artificial Sequence
  Description of Artificial Sequence: Synthetic oligonucleotide
gggtatgaccagtacgcctactacggc

SEQ ID NO: 42144 - DNA, 29 bp, Artificial Sequence
  Description of Artificial Sequence: Synthetic oligonucleotide
ggtatgaccagtacgcctactacggcaag

SEQ ID NO: 42145 - DNA, 29 bp, Artificial Sequence
  Description of Artificial Sequence: Synthetic oligonucleotide
gtatgaccagtacgcctactacggcaagg

SEQ ID NO: 42146 - DNA, 33 bp, Artificial Sequence
  Description of Artificial Sequence: Synthetic oligonucleotide
tatgaccagtacgcctactacggcaaggattac

SEQ ID NO: 42147 - DNA, 32 bp, Artificial Sequence
  Description of Artificial Sequence: Synthetic oligonucleotide
atgaccagtacgcctactacggcaaggattac

SEQ ID NO: 42148 - DNA, 31 bp, Artificial Sequence
  Description of Artificial Sequence: Synthetic oligonucleotide
tgaccagtacgcctactacggcaaggattac

SEQ ID NO: 42149 - DNA, 30 bp, Artificial Sequence
  Description of Artificial Sequence: Synthetic oligonucleotide
gaccagtacgcctactacggcaaggattac

SEQ ID NO: 42150 - DNA, 31 bp, Artificial Sequence
  Description of Artificial Sequence: Synthetic oligonucleotide
ctactacggcaaggattacatcgccctgaac

SEQ ID NO: 42151 - DNA, 31 bp, Artificial Sequence
  Description of Artificial Sequence: Synthetic oligonucleotide
tactacggcaaggattacatcgccctgaacg

SEQ ID NO: 42152 - DNA, 30 bp, Artificial Sequence
  Description of Artificial Sequence: Synthetic oligonucleotide
actacggcaaggattacatcgccctgaacg

SEQ ID NO: 42153 - DNA, 29 bp, Artificial Sequence
  Description of Artificial Sequence: Synthetic oligonucleotide
ctacggcaaggattacatcgccctgaacg

SEQ ID NO: 42154 - DNA, 30 bp, Artificial Sequence
  Description of Artificial Sequence: Synthetic oligonucleotide
tacggcaaggattacatcgccctgaacgag

SEQ ID NO: 42155 - DNA, 23 bp, Artificial Sequence
  Description of Artificial Sequence: Synthetic oligonucleotide
aagtgggaggcggcccgtgaggt

SEQ ID NO: 42156 - DNA, 22 bp, Artificial Sequence
  Description of Artificial Sequence: Synthetic oligonucleotide
agtgggaggcggcccgtgaggt

SEQ ID NO: 42157 - DNA, 21 bp, Artificial Sequence
  Description of Artificial Sequence: Synthetic oligonucleotide
gtgggaggcggcccgtgaggt

SEQ ID NO: 42158 - DNA, 21 bp, Artificial Sequence
  Description of Artificial Sequence: Synthetic oligonucleotide
tgggaggcggcccgtgaggtg

SEQ ID NO: 42159 - DNA, 20 bp, Artificial Sequence
  Description of Artificial Sequence: Synthetic oligonucleotide
gggaggcggcccgtgaggtg

SEQ ID NO: 42160 - DNA, 21 bp, Artificial Sequence
  Description of Artificial Sequence: Synthetic oligonucleotide
ggaggcggcccgtgaggtgga

SEQ ID NO: 42161 - DNA, 21 bp, Artificial Sequence
  Description of Artificial Sequence: Synthetic oligonucleotide
gaggcggcccgtgaggtggag

SEQ ID NO: 42162 - DNA, 22 bp, Artificial Sequence
  Description of Artificial Sequence: Synthetic oligonucleotide
aggcggcccgtgaggtggagca

SEQ ID NO: 42163 - DNA, 21 bp, Artificial Sequence
  Description of Artificial Sequence: Synthetic oligonucleotide
ggcggcccgtgaggtggagca

SEQ ID NO: 42164 - DNA, 21 bp, Artificial Sequence
  Description of Artificial Sequence: Synthetic oligonucleotide
gcggcccgtgaggtggagcag

SEQ ID NO: 42165 - DNA, 21 bp, Artificial Sequence
  Description of Artificial Sequence: Synthetic oligonucleotide
cggcccgtgaggtggagcagc

SEQ ID NO: 42166 - DNA, 21 bp, Artificial Sequence
  Description of Artificial Sequence: Synthetic oligonucleotide
ggcccgtgaggtggagcagcg

SEQ ID NO: 42167 - DNA, 22 bp, Artificial Sequence
  Description of Artificial Sequence: Synthetic oligonucleotide
gcccgtgaggtggagcagcgga

SEQ ID NO: 42168 - DNA, 23 bp, Artificial Sequence
  Description of Artificial Sequence: Synthetic oligonucleotide
cccgtgaggtggagcagcggaga

SEQ ID NO: 42169 - DNA, 23 bp, Artificial Sequence
  Description of Artificial Sequence: Synthetic oligonucleotide
ccgtgaggtggagcagcggagag

SEQ ID NO: 42170 - DNA, 23 bp, Artificial Sequence
  Description of Artificial Sequence: Synthetic oligonucleotide
cgtgaggtggagcagcggagagc

SEQ ID NO: 42171 - DNA, 25 bp, Artificial Sequence
  Description of Artificial Sequence: Synthetic oligonucleotide
gtgaggtggagcagcggagagccta

SEQ ID NO: 42172 - DNA, 25 bp, Artificial Sequence
  Description of Artificial Sequence: Synthetic oligonucleotide
tgaggtggagcagcggagagcctac

SEQ ID NO: 42173 - DNA, 24 bp, Artificial Sequence
  Description of Artificial Sequence: Synthetic oligonucleotide
gaggtggagcagcggagagcctac

SEQ ID NO: 42174 - DNA, 25 bp, Artificial Sequence
  Description of Artificial Sequence: Synthetic oligonucleotide
aggtggagcagcggagagcctacct

SEQ ID NO: 42175 - DNA, 24 bp, Artificial Sequence
  Description of Artificial Sequence: Synthetic oligonucleotide
ggtggagcagcggagagcctacct

SEQ ID NO: 42176 - DNA, 24 bp, Artificial Sequence
  Description of Artificial Sequence: Synthetic oligonucleotide
gtggagcagcggagagcctacctg

SEQ ID NO: 42177 - DNA, 25 bp, Artificial Sequence
  Description of Artificial Sequence: Synthetic oligonucleotide
tggagcagcggagagcctacctgga

SEQ ID NO: 42178 - DNA, 24 bp, Artificial Sequence
  Description of Artificial Sequence: Synthetic oligonucleotide
ctggagggcacgtgcgtggagtgt

SEQ ID NO: 42179 - DNA, 25 bp, Artificial Sequence
  Description of Artificial Sequence: Synthetic oligonucleotide
tggagggcacgtgcgtggagtgtct

SEQ ID NO: 42180 - DNA, 24 bp, Artificial Sequence
  Description of Artificial Sequence: Synthetic oligonucleotide
ggagggcacgtgcgtggagtgtct

SEQ ID NO: 42181 - DNA, 24 bp, Artificial Sequence
  Description of Artificial Sequence: Synthetic oligonucleotide
gagggcacgtgcgtggagtgtctc

SEQ ID NO: 42182 - DNA, 24 bp, Artificial Sequence
  Description of Artificial Sequence: Synthetic oligonucleotide
agggcacgtgcgtggagtgtctcc

SEQ ID NO: 42183 - DNA, 23 bp, Artificial Sequence
  Description of Artificial Sequence: Synthetic oligonucleotide
gggcacgtgcgtggagtgtctcc

SEQ ID NO: 42184 - DNA, 23 bp, Artificial Sequence
  Description of Artificial Sequence: Synthetic oligonucleotide
ggcacgtgcgtggagtgtctccg

SEQ ID NO: 42185 - DNA, 24 bp, Artificial Sequence
  Description of Artificial Sequence: Synthetic oligonucleotide
gcacgtgcgtggagtgtctccgca

SEQ ID NO: 42186 - DNA, 27 bp, Artificial Sequence
  Description of Artificial Sequence: Synthetic oligonucleotide
cacgtgcgtggagtgtctccgcagata

SEQ ID NO: 42187 - DNA, 27 bp, Artificial Sequence
  Description of Artificial Sequence: Synthetic oligonucleotide
acgtgcgtggagtgtctccgcagatac

SEQ ID NO: 42188 - DNA, 26 bp, Artificial Sequence
  Description of Artificial Sequence: Synthetic oligonucleotide
cgtgcgtggagtgtctccgcagatac

SEQ ID NO: 42189 - DNA, 27 bp, Artificial Sequence
  Description of Artificial Sequence: Synthetic oligonucleotide
gtgcgtggagtgtctccgcagatacct

SEQ ID NO: 42190 - DNA, 27 bp, Artificial Sequence
  Description of Artificial Sequence: Synthetic oligonucleotide
tgcgtggagtgtctccgcagatacctg

SEQ ID NO: 42191 - DNA, 26 bp, Artificial Sequence
  Description of Artificial Sequence: Synthetic oligonucleotide
gcgtggagtgtctccgcagatacctg

SEQ ID NO: 42192 - DNA, 27 bp, Artificial Sequence
  Description of Artificial Sequence: Synthetic oligonucleotide
cgtggagtgtctccgcagatacctgga

SEQ ID NO: 42193 - DNA, 27 bp, Artificial Sequence
  Description of Artificial Sequence: Synthetic oligonucleotide
gtggagtgtctccgcagatacctggag

SEQ ID NO: 42194 - DNA, 29 bp, Artificial Sequence
  Description of Artificial Sequence: Synthetic oligonucleotide
tggagtgtctccgcagatacctggagaac

SEQ ID NO: 42195 - DNA, 28 bp, Artificial Sequence
  Description of Artificial Sequence: Synthetic oligonucleotide
ggagtgtctccgcagatacctggagaac

SEQ ID NO: 42196 - DNA, 28 bp, Artificial Sequence
  Description of Artificial Sequence: Synthetic oligonucleotide
gagtgtctccgcagatacctggagaacg

SEQ ID NO: 42197 - DNA, 28 bp, Artificial Sequence
  Description of Artificial Sequence: Synthetic oligonucleotide
agtgtctccgcagatacctggagaacgg

SEQ ID NO: 42198 - DNA, 27 bp, Artificial Sequence
  Description of Artificial Sequence: Synthetic oligonucleotide
gtgtctccgcagatacctggagaacgg

SEQ ID NO: 42199 - DNA, 27 bp, Artificial Sequence
  Description of Artificial Sequence: Synthetic oligonucleotide
tgtctccgcagatacctggagaacggg

SEQ ID NO: 42200 - DNA, 27 bp, Artificial Sequence
  Description of Artificial Sequence: Synthetic oligonucleotide
gtctccgcagatacctggagaacggga

SEQ ID NO: 42201 - DNA, 28 bp, Artificial Sequence
  Description of Artificial Sequence: Synthetic oligonucleotide
tctccgcagatacctggagaacgggaag

SEQ ID NO: 42202 - DNA, 25 bp, Artificial Sequence
  Description of Artificial Sequence: Synthetic oligonucleotide
agcggagagcctacctggagggcat

SEQ ID NO: 42203 - DNA, 24 bp, Artificial Sequence
  Description of Artificial Sequence: Synthetic oligonucleotide
gcggagagcctacctggagggcat

SEQ ID NO: 42204 - DNA, 25 bp, Artificial Sequence
  Description of Artificial Sequence: Synthetic oligonucleotide
cggagagcctacctggagggcatgt

SEQ ID NO: 42205 - DNA, 26 bp, Artificial Sequence
  Description of Artificial Sequence: Synthetic oligonucleotide
gccgggtctcacaccctccagtgaat

SEQ ID NO: 42206 - DNA, 27 bp, Artificial Sequence
  Description of Artificial Sequence: Synthetic oligonucleotide
ccgggtctcacaccctccagtgaatgt

SEQ ID NO: 42207 - DNA, 27 bp, Artificial Sequence
  Description of Artificial Sequence: Synthetic oligonucleotide
cgggtctcacaccctccagtgaatgtg

SEQ ID NO: 42208 - DNA, 28 bp, Artificial Sequence
  Description of Artificial Sequence: Synthetic oligonucleotide
gggtctcacaccctccagtgaatgtgtg

SEQ ID NO: 42209 - DNA, 28 bp, Artificial Sequence
  Description of Artificial Sequence: Synthetic oligonucleotide
ggtctcacaccctccagtgaatgtgtgg

SEQ ID NO: 42210 - DNA, 28 bp, Artificial Sequence
  Description of Artificial Sequence: Synthetic oligonucleotide
gtctcacaccctccagtgaatgtgtggc

SEQ ID NO: 42211 - DNA, 29 bp, Artificial Sequence
  Description of Artificial Sequence: Synthetic oligonucleotide
tctcacaccctccagtgaatgtgtggctg

SEQ ID NO: 42212 - DNA, 28 bp, Artificial Sequence
  Description of Artificial Sequence: Synthetic oligonucleotide
ctcacaccctccagtgaatgtgtggctg

SEQ ID NO: 42213 - DNA, 28 bp, Artificial Sequence
  Description of Artificial Sequence: Synthetic oligonucleotide
tcacaccctccagtgaatgtgtggctgc

SEQ ID NO: 42214 - DNA, 27 bp, Artificial Sequence
  Description of Artificial Sequence: Synthetic oligonucleotide
cacaccctccagtgaatgtgtggctgc

SEQ ID NO: 42215 - DNA, 27 bp, Artificial Sequence
  Description of Artificial Sequence: Synthetic oligonucleotide
acaccctccagtgaatgtgtggctgcg

SEQ ID NO: 42216 - DNA, 27 bp, Artificial Sequence
  Description of Artificial Sequence: Synthetic oligonucleotide
caccctccagtgaatgtgtggctgcga

SEQ ID NO: 42217 - DNA, 27 bp, Artificial Sequence
  Description of Artificial Sequence: Synthetic oligonucleotide
accctccagtgaatgtgtggctgcgac

SEQ ID NO: 42218 - DNA, 26 bp, Artificial Sequence
  Description of Artificial Sequence: Synthetic oligonucleotide
ccctccagtgaatgtgtggctgcgac

SEQ ID NO: 42219 - DNA, 27 bp, Artificial Sequence
  Description of Artificial Sequence: Synthetic oligonucleotide
cctccagtgaatgtgtggctgcgacct

SEQ ID NO: 42220 - DNA, 27 bp, Artificial Sequence
  Description of Artificial Sequence: Synthetic oligonucleotide
ctccagtgaatgtgtggctgcgacctg

SEQ ID NO: 42221 - DNA, 27 bp, Artificial Sequence
  Description of Artificial Sequence: Synthetic oligonucleotide
tccagtgaatgtgtggctgcgacctgg

SEQ ID NO: 42222 - DNA, 26 bp, Artificial Sequence
  Description of Artificial Sequence: Synthetic oligonucleotide
ccagtgaatgtgtggctgcgacctgg

SEQ ID NO: 42223 - DNA, 26 bp, Artificial Sequence
  Description of Artificial Sequence: Synthetic oligonucleotide
cagtgaatgtgtggctgcgacctggg

SEQ ID NO: 42224 - DNA, 26 bp, Artificial Sequence
  Description of Artificial Sequence: Synthetic oligonucleotide
agtgaatgtgtggctgcgacctgggg

SEQ ID NO: 42225 - DNA, 25 bp, Artificial Sequence
  Description of Artificial Sequence: Synthetic oligonucleotide
gtgaatgtgtggctgcgacctgggg

SEQ ID NO: 42226 - DNA, 25 bp, Artificial Sequence
  Description of Artificial Sequence: Synthetic oligonucleotide
tgaatgtgtggctgcgacctggggc

SEQ ID NO: 42227 - DNA, 24 bp, Artificial Sequence
  Description of Artificial Sequence: Synthetic oligonucleotide
gaatgtgtggctgcgacctggggc

SEQ ID NO: 42228 - DNA, 24 bp, Artificial Sequence
  Description of Artificial Sequence: Synthetic oligonucleotide
aatgtgtggctgcgacctggggcc

SEQ ID NO: 42229 - DNA, 27 bp, Artificial Sequence
  Description of Artificial Sequence: Synthetic oligonucleotide
gcgggtatgaccagtacgcctacgaca

SEQ ID NO: 42230 - DNA, 27 bp, Artificial Sequence
  Description of Artificial Sequence: Synthetic oligonucleotide
cgggtatgaccagtacgcctacgacag

SEQ ID NO: 42231 - DNA, 27 bp, Artificial Sequence
  Description of Artificial Sequence: Synthetic oligonucleotide
gggtatgaccagtacgcctacgacagc

SEQ ID NO: 42232 - DNA, 29 bp, Artificial Sequence
  Description of Artificial Sequence: Synthetic oligonucleotide
ggtatgaccagtacgcctacgacagcaag

SEQ ID NO: 42233 - DNA, 29 bp, Artificial Sequence
  Description of Artificial Sequence: Synthetic oligonucleotide
gtatgaccagtacgcctacgacagcaagg

SEQ ID NO: 42234 - DNA, 33 bp, Artificial Sequence
  Description of Artificial Sequence: Synthetic oligonucleotide
tatgaccagtacgcctacgacagcaaggattac

SEQ ID NO: 42235 - DNA, 32 bp, Artificial Sequence
  Description of Artificial Sequence: Synthetic oligonucleotide
atgaccagtacgcctacgacagcaaggattac

SEQ ID NO: 42236 - DNA, 31 bp, Artificial Sequence
  Description of Artificial Sequence: Synthetic oligonucleotide
tgaccagtacgcctacgacagcaaggattac

SEQ ID NO: 42237 - DNA, 30 bp, Artificial Sequence
  Description of Artificial Sequence: Synthetic oligonucleotide
gaccagtacgcctacgacagcaaggattac

SEQ ID NO: 42238 - DNA, 32 bp, Artificial Sequence
  Description of Artificial Sequence: Synthetic oligonucleotide
accagtacgcctacgacagcaaggattacatc

SEQ ID NO: 42239 - DNA, 31 bp, Artificial Sequence
  Description of Artificial Sequence: Synthetic oligonucleotide
ccagtacgcctacgacagcaaggattacatc

SEQ ID NO: 42240 - DNA, 31 bp, Artificial Sequence
  Description of Artificial Sequence: Synthetic oligonucleotide
cagtacgcctacgacagcaaggattacatcg

SEQ ID NO: 42241 - DNA, 31 bp, Artificial Sequence
  Description of Artificial Sequence: Synthetic oligonucleotide
agtacgcctacgacagcaaggattacatcgc

SEQ ID NO: 42242 - DNA, 30 bp, Artificial Sequence
  Description of Artificial Sequence: Synthetic oligonucleotide
gtacgcctacgacagcaaggattacatcgc

SEQ ID NO: 42243 - DNA, 30 bp, Artificial Sequence
  Description of Artificial Sequence: Synthetic oligonucleotide
tacgcctacgacagcaaggattacatcgcc

SEQ ID NO: 42244 - DNA, 35 bp, Artificial Sequence
  Description of Artificial Sequence: Synthetic oligonucleotide
gctcccactccatgaagtatttcttcatatccgtg

SEQ ID NO: 42245 - DNA, 36 bp, Artificial Sequence
  Description of Artificial Sequence: Synthetic oligonucleotide
ctcccactccatgaagtatttcttcatatccgtgtc

SEQ ID NO: 42246 - DNA, 36 bp, Artificial Sequence
  Description of Artificial Sequence: Synthetic oligonucleotide
tcccactccatgaagtatttcttcatatccgtgtcc

SEQ ID NO: 42247 - DNA, 35 bp, Artificial Sequence
  Description of Artificial Sequence: Synthetic oligonucleotide
cccactccatgaagtatttcttcatatccgtgtcc

SEQ ID NO: 42248 - DNA, 35 bp, Artificial Sequence
  Description of Artificial Sequence: Synthetic oligonucleotide
ccactccatgaagtatttcttcatatccgtgtccc

SEQ ID NO: 42249 - DNA, 35 bp, Artificial Sequence
  Description of Artificial Sequence: Synthetic oligonucleotide
cactccatgaagtatttcttcatatccgtgtcccg

SEQ ID NO: 42250 - DNA, 35 bp, Artificial Sequence
  Description of Artificial Sequence: Synthetic oligonucleotide
actccatgaagtatttcttcatatccgtgtcccgg

SEQ ID NO: 42251 - DNA, 34 bp, Artificial Sequence
  Description of Artificial Sequence: Synthetic oligonucleotide
ctccatgaagtatttcttcatatccgtgtcccgg

SEQ ID NO: 42252 - DNA, 34 bp, Artificial Sequence
  Description of Artificial Sequence: Synthetic oligonucleotide
tccatgaagtatttcttcatatccgtgtcccggc

SEQ ID NO: 42253 - DNA, 33 bp, Artificial Sequence
  Description of Artificial Sequence: Synthetic oligonucleotide
ccatgaagtatttcttcatatccgtgtcccggc

SEQ ID NO: 42254 - DNA, 33 bp, Artificial Sequence
  Description of Artificial Sequence: Synthetic oligonucleotide
catgaagtatttcttcatatccgtgtcccggcc

SEQ ID NO: 42255 - DNA, 34 bp, Artificial Sequence
  Description of Artificial Sequence: Synthetic oligonucleotide
atgaagtatttcttcatatccgtgtcccggcctg

SEQ ID NO: 42256 - DNA, 33 bp, Artificial Sequence
  Description of Artificial Sequence: Synthetic oligonucleotide
tgaagtatttcttcatatccgtgtcccggcctg

SEQ ID NO: 42257 - DNA, 32 bp, Artificial Sequence
  Description of Artificial Sequence: Synthetic oligonucleotide
gaagtatttcttcatatccgtgtcccggcctg

SEQ ID NO: 42258 - DNA, 32 bp, Artificial Sequence
  Description of Artificial Sequence: Synthetic oligonucleotide
aagtatttcttcatatccgtgtcccggcctgg

SEQ ID NO: 42259 - DNA, 31 bp, Artificial Sequence
  Description of Artificial Sequence: Synthetic oligonucleotide
agtatttcttcatatccgtgtcccggcctgg

SEQ ID NO: 42260 - DNA, 30 bp, Artificial Sequence
  Description of Artificial Sequence: Synthetic oligonucleotide
gtatttcttcatatccgtgtcccggcctgg

SEQ ID NO: 42261 - DNA, 30 bp, Artificial Sequence
  Description of Artificial Sequence: Synthetic oligonucleotide
tatttcttcatatccgtgtcccggcctggc

SEQ ID NO: 42262 - DNA, 29 bp, Artificial Sequence
  Description of Artificial Sequence: Synthetic oligonucleotide
atttcttcatatccgtgtcccggcctggc

SEQ ID NO: 42263 - DNA, 28 bp, Artificial Sequence
  Description of Artificial Sequence: Synthetic oligonucleotide
tttcttcatatccgtgtcccggcctggc

SEQ ID NO: 42264 - DNA, 27 bp, Artificial Sequence
  Description of Artificial Sequence: Synthetic oligonucleotide
ttcttcatatccgtgtcccggcctggc

SEQ ID NO: 42265 - DNA, 26 bp, Artificial Sequence
  Description of Artificial Sequence: Synthetic oligonucleotide
tcttcatatccgtgtcccggcctggc

SEQ ID NO: 42266 - DNA, 25 bp, Artificial Sequence
  Description of Artificial Sequence: Synthetic oligonucleotide
cttcatatccgtgtcccggcctggc

SEQ ID NO: 42267 - DNA, 25 bp, Artificial Sequence
  Description of Artificial Sequence: Synthetic oligonucleotide
ttcatatccgtgtcccggcctggcc

SEQ ID NO: 42268 - DNA, 24 bp, Artificial Sequence
  Description of Artificial Sequence: Synthetic oligonucleotide
tcatatccgtgtcccggcctggcc

SEQ ID NO: 42269 - DNA, 23 bp, Artificial Sequence
  Description of Artificial Sequence: Synthetic oligonucleotide
catatccgtgtcccggcctggcc

SEQ ID NO: 42270 - DNA, 23 bp, Artificial Sequence
  Description of Artificial Sequence: Synthetic oligonucleotide
atatccgtgtcccggcctggccg

SEQ ID NO: 42271 - DNA, 22 bp, Artificial Sequence
  Description of Artificial Sequence: Synthetic oligonucleotide
tatccgtgtcccggcctggccg

SEQ ID NO: 42272 - DNA, 22 bp, Artificial Sequence
  Description of Artificial Sequence: Synthetic oligonucleotide
ccctgaccgagacctgggcctc

SEQ ID NO: 42273 - DNA, 23 bp, Artificial Sequence
  Description of Artificial Sequence: Synthetic oligonucleotide
cctgaccgagacctgggcctcct

SEQ ID NO: 42274 - DNA, 23 bp, Artificial Sequence
  Description of Artificial Sequence: Synthetic oligonucleotide
ctgaccgagacctgggcctcctc

SEQ ID NO: 42275 - DNA, 23 bp, Artificial Sequence
  Description of Artificial Sequence: Synthetic oligonucleotide
tgaccgagacctgggcctcctcc

SEQ ID NO: 42276 - DNA, 22 bp, Artificial Sequence
  Description of Artificial Sequence: Synthetic oligonucleotide
gaccgagacctgggcctcctcc

SEQ ID NO: 42277 - DNA, 23 bp, Artificial Sequence
  Description of Artificial Sequence: Synthetic oligonucleotide
accgagacctgggcctcctccca

SEQ ID NO: 42278 - DNA, 22 bp, Artificial Sequence
  Description of Artificial Sequence: Synthetic oligonucleotide
ccgagacctgggcctcctccca

SEQ ID NO: 42279 - DNA, 23 bp, Artificial Sequence
  Description of Artificial Sequence: Synthetic oligonucleotide
cgagacctgggcctcctcccact

SEQ ID NO: 42280 - DNA, 23 bp, Artificial Sequence
  Description of Artificial Sequence: Synthetic oligonucleotide
gagacctgggcctcctcccactc

SEQ ID NO: 42281 - DNA, 25 bp, Artificial Sequence
  Description of Artificial Sequence: Synthetic oligonucleotide
agacctgggcctcctcccactccat

SEQ ID NO: 42282 - DNA, 24 bp, Artificial Sequence
  Description of Artificial Sequence: Synthetic oligonucleotide
gacctgggcctcctcccactccat

SEQ ID NO: 42283 - DNA, 26 bp, Artificial Sequence
  Description of Artificial Sequence: Synthetic oligonucleotide
acctgggcctcctcccactccatgaa

SEQ ID NO: 42284 - DNA, 25 bp, Artificial Sequence
  Description of Artificial Sequence: Synthetic oligonucleotide
cctgggcctcctcccactccatgaa

SEQ ID NO: 42285 - DNA, 27 bp, Artificial Sequence
  Description of Artificial Sequence: Synthetic oligonucleotide
ctgggcctcctcccactccatgaagta

SEQ ID NO: 42286 - DNA, 30 bp, Artificial Sequence
  Description of Artificial Sequence: Synthetic oligonucleotide
tgggcctcctcccactccatgaagtatttc

SEQ ID NO: 42287 - DNA, 29 bp, Artificial Sequence
  Description of Artificial Sequence: Synthetic oligonucleotide
gggcctcctcccactccatgaagtatttc

SEQ ID NO: 42288 - DNA, 31 bp, Artificial Sequence
  Description of Artificial Sequence: Synthetic oligonucleotide
ggcctcctcccactccatgaagtatttcttc

SEQ ID NO: 42289 - DNA, 32 bp, Artificial Sequence
  Description of Artificial Sequence: Synthetic oligonucleotide
gcctcctcccactccatgaagtatttcttcac

SEQ ID NO: 42290 - DNA, 34 bp, Artificial Sequence
  Description of Artificial Sequence: Synthetic oligonucleotide
cctcctcccactccatgaagtatttcttcacatc

SEQ ID NO: 42291 - DNA, 34 bp, Artificial Sequence
  Description of Artificial Sequence: Synthetic oligonucleotide
ctcctcccactccatgaagtatttcttcacatcc

SEQ ID NO: 42292 - DNA, 34 bp, Artificial Sequence
  Description of Artificial Sequence: Synthetic oligonucleotide
tcctcccactccatgaagtatttcttcacatccg

SEQ ID NO: 42293 - DNA, 33 bp, Artificial Sequence
  Description of Artificial Sequence: Synthetic oligonucleotide
cctcccactccatgaagtatttcttcacatccg

SEQ ID NO: 42294 - DNA, 22 bp, Artificial Sequence
  Description of Artificial Sequence: Synthetic oligonucleotide
ggtcatggcgccccgaaccctc

SEQ ID NO: 42295 - DNA, 24 bp, Artificial Sequence
  Description of Artificial Sequence: Synthetic oligonucleotide
ccgaaccctcctcctgctgctctc

SEQ ID NO: 42296 - DNA, 24 bp, Artificial Sequence
  Description of Artificial Sequence: Synthetic oligonucleotide
cgaaccctcctcctgctgctctcg

SEQ ID NO: 42297 - DNA, 24 bp, Artificial Sequence
  Description of Artificial Sequence: Synthetic oligonucleotide
gaaccctcctcctgctgctctcgg

SEQ ID NO: 42298 - DNA, 25 bp, Artificial Sequence
  Description of Artificial Sequence: Synthetic oligonucleotide
aaccctcctcctgctgctctcggga

SEQ ID NO: 42299 - DNA, 24 bp, Artificial Sequence
  Description of Artificial Sequence: Synthetic oligonucleotide
accctcctcctgctgctctcggga

SEQ ID NO: 42300 - DNA, 23 bp, Artificial Sequence
  Description of Artificial Sequence: Synthetic oligonucleotide
ccctcctcctgctgctctcggga

SEQ ID NO: 42301 - DNA, 23 bp, Artificial Sequence
  Description of Artificial Sequence: Synthetic oligonucleotide
cctcctcctgctgctctcgggag

SEQ ID NO: 42302 - DNA, 23 bp, Artificial Sequence
  Description of Artificial Sequence: Synthetic oligonucleotide
ctcctcctgctgctctcgggagc

SEQ ID NO: 42303 - DNA, 25 bp, Artificial Sequence
  Description of Artificial Sequence: Synthetic oligonucleotide
acctgggcctgctcccactccatga

SEQ ID NO: 42304 - DNA, 24 bp, Artificial Sequence
  Description of Artificial Sequence: Synthetic oligonucleotide
cctgggcctgctcccactccatga

SEQ ID NO: 42305 - DNA, 24 bp, Artificial Sequence
  Description of Artificial Sequence: Synthetic oligonucleotide
ctgggcctgctcccactccatgag

SEQ ID NO: 42306 - DNA, 27 bp, Artificial Sequence
  Description of Artificial Sequence: Synthetic oligonucleotide
tgggcctgctcccactccatgaggtat

SEQ ID NO: 42307 - DNA, 27 bp, Artificial Sequence
  Description of Artificial Sequence: Synthetic oligonucleotide
gggcctgctcccactccatgaggtatt

SEQ ID NO: 42308 - DNA, 28 bp, Artificial Sequence
  Description of Artificial Sequence: Synthetic oligonucleotide
ggcctgctcccactccatgaggtatttc

SEQ ID NO: 42309 - DNA, 30 bp, Artificial Sequence
  Description of Artificial Sequence: Synthetic oligonucleotide
gcctgctcccactccatgaggtatttctac

SEQ ID NO: 42310 - DNA, 31 bp, Artificial Sequence
  Description of Artificial Sequence: Synthetic oligonucleotide
cctgctcccactccatgaggtatttctacac

SEQ ID NO: 42311 - DNA, 31 bp, Artificial Sequence
  Description of Artificial Sequence: Synthetic oligonucleotide
ctgctcccactccatgaggtatttctacacc

SEQ ID NO: 42312 - DNA, 31 bp, Artificial Sequence
  Description of Artificial Sequence: Synthetic oligonucleotide
tgctcccactccatgaggtatttctacaccg

SEQ ID NO: 42313 - DNA, 31 bp, Artificial Sequence
  Description of Artificial Sequence: Synthetic oligonucleotide
tcccactccatgaggtatttctacaccgctg

SEQ ID NO: 42314 - DNA, 30 bp, Artificial Sequence
  Description of Artificial Sequence: Synthetic oligonucleotide
cccactccatgaggtatttctacaccgctg

SEQ ID NO: 42315 - DNA, 31 bp, Artificial Sequence
  Description of Artificial Sequence: Synthetic oligonucleotide
ccactccatgaggtatttctacaccgctgtg

SEQ ID NO: 42316 - DNA, 32 bp, Artificial Sequence
  Description of Artificial Sequence: Synthetic oligonucleotide
cactccatgaggtatttctacaccgctgtgtc

SEQ ID NO: 42317 - DNA, 32 bp, Artificial Sequence
  Description of Artificial Sequence: Synthetic oligonucleotide
actccatgaggtatttctacaccgctgtgtcc

SEQ ID NO: 42318 - DNA, 31 bp, Artificial Sequence
  Description of Artificial Sequence: Synthetic oligonucleotide
ctccatgaggtatttctacaccgctgtgtcc

SEQ ID NO: 42319 - DNA, 31 bp, Artificial Sequence
  Description of Artificial Sequence: Synthetic oligonucleotide
tccatgaggtatttctacaccgctgtgtccc

SEQ ID NO: 42320 - DNA, 30 bp, Artificial Sequence
  Description of Artificial Sequence: Synthetic oligonucleotide
ccatgaggtatttctacaccgctgtgtccc

SEQ ID NO: 42321 - DNA, 30 bp, Artificial Sequence
  Description of Artificial Sequence: Synthetic oligonucleotide
catgaggtatttctacaccgctgtgtcccg

SEQ ID NO: 42322 - DNA, 30 bp, Artificial Sequence
  Description of Artificial Sequence: Synthetic oligonucleotide
atgaggtatttctacaccgctgtgtcccgg

SEQ ID NO: 42323 - DNA, 29 bp, Artificial Sequence
  Description of Artificial Sequence: Synthetic oligonucleotide
tgaggtatttctacaccgctgtgtcccgg

SEQ ID NO: 42324 - DNA, 28 bp, Artificial Sequence
  Description of Artificial Sequence: Synthetic oligonucleotide
gaggtatttctacaccgctgtgtcccgg

SEQ ID NO: 42325 - DNA, 28 bp, Artificial Sequence
  Description of Artificial Sequence: Synthetic oligonucleotide
aggtatttctacaccgctgtgtcccggc

SEQ ID NO: 42326 - DNA, 27 bp, Artificial Sequence
  Description of Artificial Sequence: Synthetic oligonucleotide
ggtatttctacaccgctgtgtcccggc

SEQ ID NO: 42327 - DNA, 27 bp, Artificial Sequence
  Description of Artificial Sequence: Synthetic oligonucleotide
gtatttctacaccgctgtgtcccggcc

SEQ ID NO: 42328 - DNA, 27 bp, Artificial Sequence
  Description of Artificial Sequence: Synthetic oligonucleotide
tatttctacaccgctgtgtcccggccc

SEQ ID NO: 42329 - DNA, 27 bp, Artificial Sequence
  Description of Artificial Sequence: Synthetic oligonucleotide
atttctacaccgctgtgtcccggccca

SEQ ID NO: 42330 - DNA, 26 bp, Artificial Sequence
  Description of Artificial Sequence: Synthetic oligonucleotide
tttctacaccgctgtgtcccggccca

SEQ ID NO: 42331 - DNA, 25 bp, Artificial Sequence
  Description of Artificial Sequence: Synthetic oligonucleotide
ttctacaccgctgtgtcccggccca

SEQ ID NO: 42332 - DNA, 24 bp, Artificial Sequence
  Description of Artificial Sequence: Synthetic oligonucleotide
tctacaccgctgtgtcccggccca

SEQ ID NO: 42333 - DNA, 23 bp, Artificial Sequence
  Description of Artificial Sequence: Synthetic oligonucleotide
ctacaccgctgtgtcccggccca

SEQ ID NO: 42334 - DNA, 23 bp, Artificial Sequence
  Description of Artificial Sequence: Synthetic oligonucleotide
tacaccgctgtgtcccggcccag

SEQ ID NO: 42335 - DNA, 22 bp, Artificial Sequence
  Description of Artificial Sequence: Synthetic oligonucleotide
acaccgctgtgtcccggcccag

SEQ ID NO: 42336 - DNA, 21 bp, Artificial Sequence
  Description of Artificial Sequence: Synthetic oligonucleotide
caccgctgtgtcccggcccag

SEQ ID NO: 42337 - DNA, 21 bp, Artificial Sequence
  Description of Artificial Sequence: Synthetic oligonucleotide
accgctgtgtcccggcccagc

SEQ ID NO: 42338 - DNA, 20 bp, Artificial Sequence
  Description of Artificial Sequence: Synthetic oligonucleotide
ccgctgtgtcccggcccagc

SEQ ID NO: 42339 - DNA, 20 bp, Artificial Sequence
  Description of Artificial Sequence: Synthetic oligonucleotide
cgctgtgtcccggcccagcc

SEQ ID NO: 42340 - DNA, 20 bp, Artificial Sequence
  Description of Artificial Sequence: Synthetic oligonucleotide
gctgtgtcccggcccagccg

SEQ ID NO: 42341 - DNA, 20 bp, Artificial Sequence
  Description of Artificial Sequence: Synthetic oligonucleotide
ctgtgtcccggcccagccgc

SEQ ID NO: 42342 - DNA, 20 bp, Artificial Sequence
  Description of Artificial Sequence: Synthetic oligonucleotide
tgtgtcccggcccagccgcg

SEQ ID NO: 42343 - DNA, 20 bp, Artificial Sequence
  Description of Artificial Sequence: Synthetic oligonucleotide
gtgtcccggcccagccgcgt

SEQ ID NO: 42344 - DNA, 20 bp, Artificial Sequence
  Description of Artificial Sequence: Synthetic oligonucleotide
tgtcccggcccagccgcgga

SEQ ID NO: 42345 - DNA, 20 bp, Artificial Sequence
  Description of Artificial Sequence: Synthetic oligonucleotide
gtcccggcccagccgcggat

SEQ ID NO: 42346 - DNA, 20 bp, Artificial Sequence
  Description of Artificial Sequence: Synthetic oligonucleotide
tcccggcccagccgcggaga

SEQ ID NO: 42347 - DNA, 20 bp, Artificial Sequence
  Description of Artificial Sequence: Synthetic oligonucleotide
cccggcccagccgcggagat

SEQ ID NO: 42348 - DNA, 20 bp, Artificial Sequence
  Description of Artificial Sequence: Synthetic oligonucleotide
ccggcccagccgcggagagt

SEQ ID NO: 42349 - DNA, 20 bp, Artificial Sequence
  Description of Artificial Sequence: Synthetic oligonucleotide
cggcccagccgcggagagct

SEQ ID NO: 42350 - DNA, 20 bp, Artificial Sequence
  Description of Artificial Sequence: Synthetic oligonucleotide
ggcccagccgcggagagcct

SEQ ID NO: 42351 - DNA, 20 bp, Artificial Sequence
  Description of Artificial Sequence: Synthetic oligonucleotide
gcccagccgcggagagccct

SEQ ID NO: 42352 - DNA, 20 bp, Artificial Sequence
  Description of Artificial Sequence: Synthetic oligonucleotide
cccagccgcggagagcccca

SEQ ID NO: 42353 - DNA, 22 bp, Artificial Sequence
  Description of Artificial Sequence: Synthetic oligonucleotide
ccagccgcggagagccccactt

SEQ ID NO: 42354 - DNA, 24 bp, Artificial Sequence
  Description of Artificial Sequence: Synthetic oligonucleotide
cagccgcggagagccccacttcat

SEQ ID NO: 42355 - DNA, 24 bp, Artificial Sequence
  Description of Artificial Sequence: Synthetic oligonucleotide
agccgcggagagccccacttcatc

SEQ ID NO: 42356 - DNA, 23 bp, Artificial Sequence
  Description of Artificial Sequence: Synthetic oligonucleotide
gccgcggagagccccacttcatc

SEQ ID NO: 42357 - DNA, 23 bp, Artificial Sequence
  Description of Artificial Sequence: Synthetic oligonucleotide
ccgcggagagccccacttcatcg

SEQ ID NO: 42358 - DNA, 24 bp, Artificial Sequence
  Description of Artificial Sequence: Synthetic oligonucleotide
cgcggagagccccacttcatcgca

SEQ ID NO: 42359 - DNA, 25 bp, Artificial Sequence
  Description of Artificial Sequence: Synthetic oligonucleotide
gcggagagccccacttcatcgcagt

SEQ ID NO: 42360 - DNA, 25 bp, Artificial Sequence
  Description of Artificial Sequence: Synthetic oligonucleotide
cggagagccccacttcatcgcagtg

SEQ ID NO: 42361 - DNA, 25 bp, Artificial Sequence
  Description of Artificial Sequence: Synthetic oligonucleotide
ggagagccccacttcatcgcagtgg

SEQ ID NO: 42362 - DNA, 25 bp, Artificial Sequence
  Description of Artificial Sequence: Synthetic oligonucleotide
gagagccccacttcatcgcagtggg

SEQ ID NO: 42363 - DNA, 27 bp, Artificial Sequence
  Description of Artificial Sequence: Synthetic oligonucleotide
agagccccacttcatcgcagtgggcta

SEQ ID NO: 42364 - DNA, 30 bp, Artificial Sequence
  Description of Artificial Sequence: Synthetic oligonucleotide
agactgaccgagtgaacctgcggaaactac

SEQ ID NO: 42365 - DNA, 29 bp, Artificial Sequence
  Description of Artificial Sequence: Synthetic oligonucleotide
gactgaccgagtgaacctgcggaaactac

SEQ ID NO: 42366 - DNA, 29 bp, Artificial Sequence
  Description of Artificial Sequence: Synthetic oligonucleotide
actgaccgagtgaacctgcggaaactacg

SEQ ID NO: 42367 - DNA, 28 bp, Artificial Sequence
  Description of Artificial Sequence: Synthetic oligonucleotide
ctgaccgagtgaacctgcggaaactacg

SEQ ID NO: 42368 - DNA, 28 bp, Artificial Sequence
  Description of Artificial Sequence: Synthetic oligonucleotide
tgaccgagtgaacctgcggaaactacgc

SEQ ID NO: 42369 - DNA, 27 bp, Artificial Sequence
  Description of Artificial Sequence: Synthetic oligonucleotide
gaccgagtgaacctgcggaaactacgc

SEQ ID NO: 42370 - DNA, 27 bp, Artificial Sequence
  Description of Artificial Sequence: Synthetic oligonucleotide
accgagtgaacctgcggaaactacgcg

SEQ ID NO: 42371 - DNA, 26 bp, Artificial Sequence
  Description of Artificial Sequence: Synthetic oligonucleotide
ccgagtgaacctgcggaaactacgcg

SEQ ID NO: 42372 - DNA, 26 bp, Artificial Sequence
  Description of Artificial Sequence: Synthetic oligonucleotide
cgagtgaacctgcggaaactacgcgg

SEQ ID NO: 42373 - DNA, 27 bp, Artificial Sequence
  Description of Artificial Sequence: Synthetic oligonucleotide
gagtgaacctgcggaaactacgcggct

SEQ ID NO: 42374 - DNA, 28 bp, Artificial Sequence
  Description of Artificial Sequence: Synthetic oligonucleotide
agtgaacctgcggaaactacgcggctac

SEQ ID NO: 42375 - DNA, 27 bp, Artificial Sequence
  Description of Artificial Sequence: Synthetic oligonucleotide
gtgaacctgcggaaactacgcggctac

SEQ ID NO: 42376 - DNA, 29 bp, Artificial Sequence
  Description of Artificial Sequence: Synthetic oligonucleotide
tgaacctgcggaaactacgcggctactac

SEQ ID NO: 42377 - DNA, 28 bp, Artificial Sequence
  Description of Artificial Sequence: Synthetic oligonucleotide
gaacctgcggaaactacgcggctactac

SEQ ID NO: 42378 - DNA, 30 bp, Artificial Sequence
  Description of Artificial Sequence: Synthetic oligonucleotide
aacctgcggaaactacgcggctactacaac

SEQ ID NO: 42379 - DNA, 29 bp, Artificial Sequence
  Description of Artificial Sequence: Synthetic oligonucleotide
acctgcggaaactacgcggctactacaac

SEQ ID NO: 42380 - DNA, 28 bp, Artificial Sequence
  Description of Artificial Sequence: Synthetic oligonucleotide
cctgcggaaactacgcggctactacaac

SEQ ID NO: 42381 - DNA, 28 bp, Artificial Sequence
  Description of Artificial Sequence: Synthetic oligonucleotide
ctgcggaaactacgcggctactacaacc

SEQ ID NO: 42382 - DNA, 29 bp, Artificial Sequence
  Description of Artificial Sequence: Synthetic oligonucleotide
tgcggaaactacgcggctactacaaccag

SEQ ID NO: 42383 - DNA, 28 bp, Artificial Sequence
  Description of Artificial Sequence: Synthetic oligonucleotide
gcggaaactacgcggctactacaaccag

SEQ ID NO: 42384 - DNA, 29 bp, Artificial Sequence
  Description of Artificial Sequence: Synthetic oligonucleotide
cggaaactacgcggctactacaaccagag

SEQ ID NO: 42385 - DNA, 29 bp, Artificial Sequence
  Description of Artificial Sequence: Synthetic oligonucleotide
ggaaactacgcggctactacaaccagagc

SEQ ID NO: 42386 - DNA, 29 bp, Artificial Sequence
  Description of Artificial Sequence: Synthetic oligonucleotide
gaaactacgcggctactacaaccagagcg

SEQ ID NO: 42387 - DNA, 30 bp, Artificial Sequence
  Description of Artificial Sequence: Synthetic oligonucleotide
aaactacgcggctactacaaccagagcgag

SEQ ID NO: 42388 - DNA, 29 bp, Artificial Sequence
  Description of Artificial Sequence: Synthetic oligonucleotide
aactacgcggctactacaaccagagcgag

SEQ ID NO: 42389 - DNA, 28 bp, Artificial Sequence
  Description of Artificial Sequence: Synthetic oligonucleotide
actacgcggctactacaaccagagcgag

SEQ ID NO: 42390 - DNA, 27 bp, Artificial Sequence
  Description of Artificial Sequence: Synthetic oligonucleotide
ctacgcggctactacaaccagagcgag

SEQ ID NO: 42391 - DNA, 27 bp, Artificial Sequence
  Description of Artificial Sequence: Synthetic oligonucleotide
tacgcggctactacaaccagagcgagg

SEQ ID NO: 42392 - DNA, 26 bp, Artificial Sequence
  Description of Artificial Sequence: Synthetic oligonucleotide
acgcggctactacaaccagagcgagg

SEQ ID NO: 42393 - DNA, 25 bp, Artificial Sequence
  Description of Artificial Sequence: Synthetic oligonucleotide
tgctgggccctgggcttctacccta

SEQ ID NO: 42394 - DNA, 24 bp, Artificial Sequence
  Description of Artificial Sequence: Synthetic oligonucleotide
gctgggccctgggcttctacccta

SEQ ID NO: 42395 - DNA, 24 bp, Artificial Sequence
  Description of Artificial Sequence: Synthetic oligonucleotide
ctgggccctgggcttctaccctac

SEQ ID NO: 42396 - DNA, 24 bp, Artificial Sequence
  Description of Artificial Sequence: Synthetic oligonucleotide
tgggccctgggcttctaccctacg

SEQ ID NO: 42397 - DNA, 23 bp, Artificial Sequence
  Description of Artificial Sequence: Synthetic oligonucleotide
gggccctgggcttctaccctacg

SEQ ID NO: 42398 - DNA, 24 bp, Artificial Sequence
  Description of Artificial Sequence: Synthetic oligonucleotide
ggccctgggcttctaccctacgga

SEQ ID NO: 42399 - DNA, 26 bp, Artificial Sequence
  Description of Artificial Sequence: Synthetic oligonucleotide
gccctgggcttctaccctacggagat

SEQ ID NO: 42400 - DNA, 27 bp, Artificial Sequence
  Description of Artificial Sequence: Synthetic oligonucleotide
ccctgggcttctaccctacggagatca

SEQ ID NO: 42401 - DNA, 27 bp, Artificial Sequence
  Description of Artificial Sequence: Synthetic oligonucleotide
cctgggcttctaccctacggagatcac

SEQ ID NO: 42402 - DNA, 28 bp, Artificial Sequence
  Description of Artificial Sequence: Synthetic oligonucleotide
ctgggcttctaccctacggagatcacac

SEQ ID NO: 42403 - DNA, 29 bp, Artificial Sequence
  Description of Artificial Sequence: Synthetic oligonucleotide
tgggcttctaccctacggagatcacactg

SEQ ID NO: 42404 - DNA, 28 bp, Artificial Sequence
  Description of Artificial Sequence: Synthetic oligonucleotide
gggcttctaccctacggagatcacactg

SEQ ID NO: 42405 - DNA, 29 bp, Artificial Sequence
  Description of Artificial Sequence: Synthetic oligonucleotide
ggcttctaccctacggagatcacactgac

SEQ ID NO: 42406 - DNA, 29 bp, Artificial Sequence
  Description of Artificial Sequence: Synthetic oligonucleotide
gcttctaccctacggagatcacactgacc

SEQ ID NO: 42407 - DNA, 30 bp, Artificial Sequence
  Description of Artificial Sequence: Synthetic oligonucleotide
cttctaccctacggagatcacactgacctg

SEQ ID NO: 42408 - DNA, 30 bp, Artificial Sequence
  Description of Artificial Sequence: Synthetic oligonucleotide
ttctaccctacggagatcacactgacctgg

SEQ ID NO: 42409 - DNA, 29 bp, Artificial Sequence
  Description of Artificial Sequence: Synthetic oligonucleotide
tctaccctacggagatcacactgacctgg

SEQ ID NO: 42410 - DNA, 28 bp, Artificial Sequence
  Description of Artificial Sequence: Synthetic oligonucleotide
ctaccctacggagatcacactgacctgg

SEQ ID NO: 42411 - DNA, 28 bp, Artificial Sequence
  Description of Artificial Sequence: Synthetic oligonucleotide
taccctacggagatcacactgacctggc

SEQ ID NO: 42412 - DNA, 27 bp, Artificial Sequence
  Description of Artificial Sequence: Synthetic oligonucleotide
accctacggagatcacactgacctggc

SEQ ID NO: 42413 - DNA, 27 bp, Artificial Sequence
  Description of Artificial Sequence: Synthetic oligonucleotide
ccctacggagatcacactgacctggca

SEQ ID NO: 42414 - DNA, 27 bp, Artificial Sequence
  Description of Artificial Sequence: Synthetic oligonucleotide
cctacggagatcacactgacctggcag

SEQ ID NO: 42415 - DNA, 27 bp, Artificial Sequence
  Description of Artificial Sequence: Synthetic oligonucleotide
ctacggagatcacactgacctggcagc

SEQ ID NO: 42416 - DNA, 27 bp, Artificial Sequence
  Description of Artificial Sequence: Synthetic oligonucleotide
tacggagatcacactgacctggcagcg

SEQ ID NO: 42417 - DNA, 25 bp, Artificial Sequence
  Description of Artificial Sequence: Synthetic oligonucleotide
cctcctccgcgggtatgaccagtct

SEQ ID NO: 42418 - DNA, 25 bp, Artificial Sequence
  Description of Artificial Sequence: Synthetic oligonucleotide
ctcctccgcgggtatgaccagtctg

SEQ ID NO: 42419 - DNA, 25 bp, Artificial Sequence
  Description of Artificial Sequence: Synthetic oligonucleotide
tcctccgcgggtatgaccagtctgc

SEQ ID NO: 42420 - DNA, 24 bp, Artificial Sequence
  Description of Artificial Sequence: Synthetic oligonucleotide
cctccgcgggtatgaccagtctgc

SEQ ID NO: 42421 - DNA, 26 bp, Artificial Sequence
  Description of Artificial Sequence: Synthetic oligonucleotide
ctccgcgggtatgaccagtctgccta

SEQ ID NO: 42422 - DNA, 26 bp, Artificial Sequence
  Description of Artificial Sequence: Synthetic oligonucleotide
tccgcgggtatgaccagtctgcctac

SEQ ID NO: 42423 - DNA, 25 bp, Artificial Sequence
  Description of Artificial Sequence: Synthetic oligonucleotide
ccgcgggtatgaccagtctgcctac

SEQ ID NO: 42424 - DNA, 26 bp, Artificial Sequence
  Description of Artificial Sequence: Synthetic oligonucleotide
cgcgggtatgaccagtctgcctacga

SEQ ID NO: 42425 - DNA, 26 bp, Artificial Sequence
  Description of Artificial Sequence: Synthetic oligonucleotide
gcgggtatgaccagtctgcctacgac

SEQ ID NO: 42426 - DNA, 26 bp, Artificial Sequence
  Description of Artificial Sequence: Synthetic oligonucleotide
cgggtatgaccagtctgcctacgacg

SEQ ID NO: 42427 - DNA, 26 bp, Artificial Sequence
  Description of Artificial Sequence: Synthetic oligonucleotide
gggtatgaccagtctgcctacgacgg

SEQ ID NO: 42428 - DNA, 27 bp, Artificial Sequence
  Description of Artificial Sequence: Synthetic oligonucleotide
ggtatgaccagtctgcctacgacggca

SEQ ID NO: 42429 - DNA, 28 bp, Artificial Sequence
  Description of Artificial Sequence: Synthetic oligonucleotide
gtatgaccagtctgcctacgacggcaag

SEQ ID NO: 42430 - DNA, 28 bp, Artificial Sequence
  Description of Artificial Sequence: Synthetic oligonucleotide
tatgaccagtctgcctacgacggcaagg

SEQ ID NO: 42431 - DNA, 29 bp, Artificial Sequence
  Description of Artificial Sequence: Synthetic oligonucleotide
cggaatattgggaccgggagacacagaag

SEQ ID NO: 42432 - DNA, 31 bp, Artificial Sequence
  Description of Artificial Sequence: Synthetic oligonucleotide
ggaatattgggaccgggagacacagaagtac

SEQ ID NO: 42433 - DNA, 33 bp, Artificial Sequence
  Description of Artificial Sequence: Synthetic oligonucleotide
gaatattgggaccgggagacacagaagtacaag

SEQ ID NO: 42434 - DNA, 33 bp, Artificial Sequence
  Description of Artificial Sequence: Synthetic oligonucleotide
aatattgggaccgggagacacagaagtacaagc

SEQ ID NO: 42435 - DNA, 32 bp, Artificial Sequence
  Description of Artificial Sequence: Synthetic oligonucleotide
atattgggaccgggagacacagaagtacaagc

SEQ ID NO: 42436 - DNA, 22 bp, Artificial Sequence
  Description of Artificial Sequence: Synthetic oligonucleotide
gacagcgacgccgcgagcccaa

SEQ ID NO: 42437 - DNA, 23 bp, Artificial Sequence
  Description of Artificial Sequence: Synthetic oligonucleotide
acagcgacgccgcgagcccaaga

SEQ ID NO: 42438 - DNA, 22 bp, Artificial Sequence
  Description of Artificial Sequence: Synthetic oligonucleotide
cagcgacgccgcgagcccaaga

SEQ ID NO: 42439 - DNA, 22 bp, Artificial Sequence
  Description of Artificial Sequence: Synthetic oligonucleotide
agcgacgccgcgagcccaagag

SEQ ID NO: 42440 - DNA, 21 bp, Artificial Sequence
  Description of Artificial Sequence: Synthetic oligonucleotide
gcgacgccgcgagcccaagag

SEQ ID NO: 42441 - DNA, 21 bp, Artificial Sequence
  Description of Artificial Sequence: Synthetic oligonucleotide
cgacgccgcgagcccaagagg

SEQ ID NO: 42442 - DNA, 21 bp, Artificial Sequence
  Description of Artificial Sequence: Synthetic oligonucleotide
gacgccgcgagcccaagaggg

SEQ ID NO: 42443 - DNA, 22 bp, Artificial Sequence
  Description of Artificial Sequence: Synthetic oligonucleotide
acgccgcgagcccaagagggga

SEQ ID NO: 42444 - DNA, 21 bp, Artificial Sequence
  Description of Artificial Sequence: Synthetic oligonucleotide
cgccgcgagcccaagagggga

SEQ ID NO: 42445 - DNA, 21 bp, Artificial Sequence
  Description of Artificial Sequence: Synthetic oligonucleotide
gccgcgagcccaagaggggag

SEQ ID NO: 42446 - DNA, 21 bp, Artificial Sequence
  Description of Artificial Sequence: Synthetic oligonucleotide
ccgcgagcccaagaggggagc

SEQ ID NO: 42447 - DNA, 21 bp, Artificial Sequence
  Description of Artificial Sequence: Synthetic oligonucleotide
cgcgagcccaagaggggagcc

SEQ ID NO: 42448 - DNA, 21 bp, Artificial Sequence
  Description of Artificial Sequence: Synthetic oligonucleotide
gcgagcccaagaggggagccg

SEQ ID NO: 42449 - DNA, 21 bp, Artificial Sequence
  Description of Artificial Sequence: Synthetic oligonucleotide
cgagcccaagaggggagccgc

SEQ ID NO: 42450 - DNA, 21 bp, Artificial Sequence
  Description of Artificial Sequence: Synthetic oligonucleotide
gagcccaagaggggagccgcg

SEQ ID NO: 42451 - DNA, 21 bp, Artificial Sequence
  Description of Artificial Sequence: Synthetic oligonucleotide
agcccaagaggggagccgcgg

SEQ ID NO: 42452 - DNA, 20 bp, Artificial Sequence
  Description of Artificial Sequence: Synthetic oligonucleotide
gcccaagaggggagccgcgg

SEQ ID NO: 42453 - DNA, 20 bp, Artificial Sequence
  Description of Artificial Sequence: Synthetic oligonucleotide
cccaagaggggagccgcggg

SEQ ID NO: 42454 - DNA, 27 bp, Artificial Sequence
  Description of Artificial Sequence: Synthetic oligonucleotide
tctccagaggatgtacggctgcgacct

SEQ ID NO: 42455 - DNA, 26 bp, Artificial Sequence
  Description of Artificial Sequence: Synthetic oligonucleotide
agaggatgtacggctgcgacctgggt

SEQ ID NO: 42456 - DNA, 25 bp, Artificial Sequence
  Description of Artificial Sequence: Synthetic oligonucleotide
gaggatgtacggctgcgacctgggt

SEQ ID NO: 42457 - DNA, 25 bp, Artificial Sequence
  Description of Artificial Sequence: Synthetic oligonucleotide
aggatgtacggctgcgacctgggtc

SEQ ID NO: 42458 - DNA, 24 bp, Artificial Sequence
  Description of Artificial Sequence: Synthetic oligonucleotide
ggatgtacggctgcgacctgggtc

SEQ ID NO: 42459 - DNA, 24 bp, Artificial Sequence
  Description of Artificial Sequence: Synthetic oligonucleotide
gatgtacggctgcgacctgggtcc

SEQ ID NO: 42460 - DNA, 24 bp, Artificial Sequence
  Description of Artificial Sequence: Synthetic oligonucleotide
atgtacggctgcgacctgggtccc

SEQ ID NO: 42461 - DNA, 23 bp, Artificial Sequence
  Description of Artificial Sequence: Synthetic oligonucleotide
tgtacggctgcgacctgggtccc

SEQ ID NO: 42462 - DNA, 22 bp, Artificial Sequence
  Description of Artificial Sequence: Synthetic oligonucleotide
gtacggctgcgacctgggtccc

SEQ ID NO: 42463 - DNA, 23 bp, Artificial Sequence
  Description of Artificial Sequence: Synthetic oligonucleotide
tacggctgcgacctgggtcccga

SEQ ID NO: 42464 - DNA, 22 bp, Artificial Sequence
  Description of Artificial Sequence: Synthetic oligonucleotide
acggctgcgacctgggtcccga

SEQ ID NO: 42465 - DNA, 21 bp, Artificial Sequence
  Description of Artificial Sequence: Synthetic oligonucleotide
cggctgcgacctgggtcccga

SEQ ID NO: 42466 - DNA, 27 bp, Artificial Sequence
  Description of Artificial Sequence: Synthetic oligonucleotide
gccaggcacagactgaccgagtgaact

SEQ ID NO: 42467 - DNA, 28 bp, Artificial Sequence
  Description of Artificial Sequence: Synthetic oligonucleotide
ccaggcacagactgaccgagtgaacttg

SEQ ID NO: 42468 - DNA, 28 bp, Artificial Sequence
  Description of Artificial Sequence: Synthetic oligonucleotide
caggcacagactgaccgagtgaacttgc

SEQ ID NO: 42469 - DNA, 28 bp, Artificial Sequence
  Description of Artificial Sequence: Synthetic oligonucleotide
aggcacagactgaccgagtgaacttgcg

SEQ ID NO: 42470 - DNA, 27 bp, Artificial Sequence
  Description of Artificial Sequence: Synthetic oligonucleotide
ggcacagactgaccgagtgaacttgcg

SEQ ID NO: 42471 - DNA, 27 bp, Artificial Sequence
  Description of Artificial Sequence: Synthetic oligonucleotide
gcacagactgaccgagtgaacttgcgg

SEQ ID NO: 42472 - DNA, 30 bp, Artificial Sequence
  Description of Artificial Sequence: Synthetic oligonucleotide
cacagactgaccgagtgaacttgcggaaac

SEQ ID NO: 42473 - DNA, 31 bp, Artificial Sequence
  Description of Artificial Sequence: Synthetic oligonucleotide
acagactgaccgagtgaacttgcggaaactg

SEQ ID NO: 42474 - DNA, 30 bp, Artificial Sequence
  Description of Artificial Sequence: Synthetic oligonucleotide
cagactgaccgagtgaacttgcggaaactg

SEQ ID NO: 42475 - DNA, 30 bp, Artificial Sequence
  Description of Artificial Sequence: Synthetic oligonucleotide
agactgaccgagtgaacttgcggaaactgc

SEQ ID NO: 42476 - DNA, 29 bp, Artificial Sequence
  Description of Artificial Sequence: Synthetic oligonucleotide
gactgaccgagtgaacttgcggaaactgc

SEQ ID NO: 42477 - DNA, 29 bp, Artificial Sequence
  Description of Artificial Sequence: Synthetic oligonucleotide
actgaccgagtgaacttgcggaaactgcg

SEQ ID NO: 42478 - DNA, 28 bp, Artificial Sequence
  Description of Artificial Sequence: Synthetic oligonucleotide
ctgaccgagtgaacttgcggaaactgcg

SEQ ID NO: 42479 - DNA, 28 bp, Artificial Sequence
  Description of Artificial Sequence: Synthetic oligonucleotide
tgaccgagtgaacttgcggaaactgcgc

SEQ ID NO: 42480 - DNA, 27 bp, Artificial Sequence
  Description of Artificial Sequence: Synthetic oligonucleotide
gaccgagtgaacttgcggaaactgcgc

SEQ ID NO: 42481 - DNA, 27 bp, Artificial Sequence
  Description of Artificial Sequence: Synthetic oligonucleotide
accgagtgaacttgcggaaactgcgcg

SEQ ID NO: 42482 - DNA, 26 bp, Artificial Sequence
  Description of Artificial Sequence: Synthetic oligonucleotide
ccgagtgaacttgcggaaactgcgcg

SEQ ID NO: 42483 - DNA, 26 bp, Artificial Sequence
  Description of Artificial Sequence: Synthetic oligonucleotide
cgagtgaacttgcggaaactgcgcgg

SEQ ID NO: 42484 - DNA, 27 bp, Artificial Sequence
  Description of Artificial Sequence: Synthetic oligonucleotide
gagtgaacttgcggaaactgcgcggct

SEQ ID NO: 42485 - DNA, 28 bp, Artificial Sequence
  Description of Artificial Sequence: Synthetic oligonucleotide
agtgaacttgcggaaactgcgcggctac

SEQ ID NO: 42486 - DNA, 27 bp, Artificial Sequence
  Description of Artificial Sequence: Synthetic oligonucleotide
gtgaacttgcggaaactgcgcggctac

SEQ ID NO: 42487 - DNA, 29 bp, Artificial Sequence
  Description of Artificial Sequence: Synthetic oligonucleotide
tgaacttgcggaaactgcgcggctactac

SEQ ID NO: 42488 - DNA, 28 bp, Artificial Sequence
  Description of Artificial Sequence: Synthetic oligonucleotide
gaacttgcggaaactgcgcggctactac

SEQ ID NO: 42489 - DNA, 30 bp, Artificial Sequence
  Description of Artificial Sequence: Synthetic oligonucleotide
aacttgcggaaactgcgcggctactacaac

SEQ ID NO: 42490 - DNA, 29 bp, Artificial Sequence
  Description of Artificial Sequence: Synthetic oligonucleotide
acttgcggaaactgcgcggctactacaac

SEQ ID NO: 42491 - DNA, 28 bp, Artificial Sequence
  Description of Artificial Sequence: Synthetic oligonucleotide
cttgcggaaactgcgcggctactacaac

SEQ ID NO: 42492 - DNA, 28 bp, Artificial Sequence
  Description of Artificial Sequence: Synthetic oligonucleotide
ttgcggaaactgcgcggctactacaacc

SEQ ID NO: 42493 - DNA, 21 bp, Artificial Sequence
  Description of Artificial Sequence: Synthetic oligonucleotide
gcgagtccgagaggggagccc

SEQ ID NO: 42494 - DNA, 21 bp, Artificial Sequence
  Description of Artificial Sequence: Synthetic oligonucleotide
cgagtccgagaggggagcccc

SEQ ID NO: 42495 - DNA, 21 bp, Artificial Sequence
  Description of Artificial Sequence: Synthetic oligonucleotide
gagtccgagaggggagccccg

SEQ ID NO: 42496 - DNA, 21 bp, Artificial Sequence
  Description of Artificial Sequence: Synthetic oligonucleotide
agtccgagaggggagccccgg

SEQ ID NO: 42497 - DNA, 20 bp, Artificial Sequence
  Description of Artificial Sequence: Synthetic oligonucleotide
gtccgagaggggagccccgg

SEQ ID NO: 42498 - DNA, 20 bp, Artificial Sequence
  Description of Artificial Sequence: Synthetic oligonucleotide
tccgagaggggagccccggg

SEQ ID NO: 42499 - DNA, 20 bp, Artificial Sequence
  Description of Artificial Sequence: Synthetic oligonucleotide
ccgagaggggagccccgggt

SEQ ID NO: 42500 - DNA, 20 bp, Artificial Sequence
  Description of Artificial Sequence: Synthetic oligonucleotide
cgagaggggagccccgggct

SEQ ID NO: 42501 - DNA, 20 bp, Artificial Sequence
  Description of Artificial Sequence: Synthetic oligonucleotide
gagaggggagccccgggcgt

SEQ ID NO: 42502 - DNA, 20 bp, Artificial Sequence
  Description of Artificial Sequence: Synthetic oligonucleotide
agaggggagccccgggcgct

SEQ ID NO: 42503 - DNA, 20 bp, Artificial Sequence
  Description of Artificial Sequence: Synthetic oligonucleotide
gaggggagccccgggcgctt

SEQ ID NO: 42504 - DNA, 20 bp, Artificial Sequence
  Description of Artificial Sequence: Synthetic oligonucleotide
aggggagccccgggcgcctt

SEQ ID NO: 42505 - DNA, 20 bp, Artificial Sequence
  Description of Artificial Sequence: Synthetic oligonucleotide
ggggagccccgggcgccttt

SEQ ID NO: 42506 - DNA, 20 bp, Artificial Sequence
  Description of Artificial Sequence: Synthetic oligonucleotide
gggagccccgggcgccgttt

SEQ ID NO: 42507 - DNA, 29 bp, Artificial Sequence
  Description of Artificial Sequence: Synthetic oligonucleotide
gctcccactccatgaggtgtttctacacc

SEQ ID NO: 42508 - DNA, 29 bp, Artificial Sequence
  Description of Artificial Sequence: Synthetic oligonucleotide
ctcccactccatgaggtgtttctacaccg

SEQ ID NO: 42509 - DNA, 29 bp, Artificial Sequence
  Description of Artificial Sequence: Synthetic oligonucleotide
tcccactccatgaggtgtttctacaccgc

SEQ ID NO: 42510 - DNA, 28 bp, Artificial Sequence
  Description of Artificial Sequence: Synthetic oligonucleotide
cccactccatgaggtgtttctacaccgc

SEQ ID NO: 42511 - DNA, 29 bp, Artificial Sequence
  Description of Artificial Sequence: Synthetic oligonucleotide
ccactccatgaggtgtttctacaccgctg

SEQ ID NO: 42512 - DNA, 30 bp, Artificial Sequence
  Description of Artificial Sequence: Synthetic oligonucleotide
cactccatgaggtgtttctacaccgctgtg

SEQ ID NO: 42513 - DNA, 31 bp, Artificial Sequence
  Description of Artificial Sequence: Synthetic oligonucleotide
actccatgaggtgtttctacaccgctgtgtc

SEQ ID NO: 42514 - DNA, 30 bp, Artificial Sequence
  Description of Artificial Sequence: Synthetic oligonucleotide
ctccatgaggtgtttctacaccgctgtgtc

SEQ ID NO: 42515 - DNA, 30 bp, Artificial Sequence
  Description of Artificial Sequence: Synthetic oligonucleotide
tccatgaggtgtttctacaccgctgtgtcc

SEQ ID NO: 42516 - DNA, 29 bp, Artificial Sequence
  Description of Artificial Sequence: Synthetic oligonucleotide
ccatgaggtgtttctacaccgctgtgtcc

SEQ ID NO: 42517 - DNA, 29 bp, Artificial Sequence
  Description of Artificial Sequence: Synthetic oligonucleotide
catgaggtgtttctacaccgctgtgtccc

SEQ ID NO: 42518 - DNA, 29 bp, Artificial Sequence
  Description of Artificial Sequence: Synthetic oligonucleotide
atgaggtgtttctacaccgctgtgtcccg

SEQ ID NO: 42519 - DNA, 28 bp, Artificial Sequence
  Description of Artificial Sequence: Synthetic oligonucleotide
tgaggtgtttctacaccgctgtgtcccg

SEQ ID NO: 42520 - DNA, 27 bp, Artificial Sequence
  Description of Artificial Sequence: Synthetic oligonucleotide
gaggtgtttctacaccgctgtgtcccg

SEQ ID NO: 42521 - DNA, 27 bp, Artificial Sequence
  Description of Artificial Sequence: Synthetic oligonucleotide
aggtgtttctacaccgctgtgtcccgg

SEQ ID NO: 42522 - DNA, 26 bp, Artificial Sequence
  Description of Artificial Sequence: Synthetic oligonucleotide
ggtgtttctacaccgctgtgtcccgg

SEQ ID NO: 42523 - DNA, 26 bp, Artificial Sequence
  Description of Artificial Sequence: Synthetic oligonucleotide
gtgtttctacaccgctgtgtcccggc

SEQ ID NO: 42524 - DNA, 26 bp, Artificial Sequence
  Description of Artificial Sequence: Synthetic oligonucleotide
tgtttctacaccgctgtgtcccggcc

SEQ ID NO: 42525 - DNA, 25 bp, Artificial Sequence
  Description of Artificial Sequence: Synthetic oligonucleotide
gtttctacaccgctgtgtcccggcc

SEQ ID NO: 42526 - DNA, 20 bp, Artificial Sequence
  Description of Artificial Sequence: Synthetic oligonucleotide
cccagccgcggagagcccct

SEQ ID NO: 42527 - DNA, 20 bp, Artificial Sequence
  Description of Artificial Sequence: Synthetic oligonucleotide
ccagccgcggagagccccgt

SEQ ID NO: 42528 - DNA, 21 bp, Artificial Sequence
  Description of Artificial Sequence: Synthetic oligonucleotide
cagccgcggagagccccgctt

SEQ ID NO: 42529 - DNA, 23 bp, Artificial Sequence
  Description of Artificial Sequence: Synthetic oligonucleotide
agccgcggagagccccgcttcat

SEQ ID NO: 42530 - DNA, 28 bp, Artificial Sequence
  Description of Artificial Sequence: Synthetic oligonucleotide
ctacgacggcaaggattacatcgcccag

SEQ ID NO: 42531 - DNA, 30 bp, Artificial Sequence
  Description of Artificial Sequence: Synthetic oligonucleotide
tacgacggcaaggattacatcgcccagaac

SEQ ID NO: 42532 - DNA, 29 bp, Artificial Sequence
  Description of Artificial Sequence: Synthetic oligonucleotide
acgacggcaaggattacatcgcccagaac

SEQ ID NO: 42533 - DNA, 28 bp, Artificial Sequence
  Description of Artificial Sequence: Synthetic oligonucleotide
cgacggcaaggattacatcgcccagaac

SEQ ID NO: 42534 - DNA, 28 bp, Artificial Sequence
  Description of Artificial Sequence: Synthetic oligonucleotide
gacggcaaggattacatcgcccagaacg

SEQ ID NO: 42535 - DNA, 29 bp, Artificial Sequence
  Description of Artificial Sequence: Synthetic oligonucleotide
acggcaaggattacatcgcccagaacgag

SEQ ID NO: 42536 - DNA, 28 bp, Artificial Sequence
  Description of Artificial Sequence: Synthetic oligonucleotide
cggcaaggattacatcgcccagaacgag

SEQ ID NO: 42537 - DNA, 28 bp, Artificial Sequence
  Description of Artificial Sequence: Synthetic oligonucleotide
ggcaaggattacatcgcccagaacgagg

SEQ ID NO: 42538 - DNA, 29 bp, Artificial Sequence
  Description of Artificial Sequence: Synthetic oligonucleotide
gcaaggattacatcgcccagaacgaggac

SEQ ID NO: 42539 - DNA, 29 bp, Artificial Sequence
  Description of Artificial Sequence: Synthetic oligonucleotide
caaggattacatcgcccagaacgaggacc

SEQ ID NO: 42540 - DNA, 30 bp, Artificial Sequence
  Description of Artificial Sequence: Synthetic oligonucleotide
aaggattacatcgcccagaacgaggacctg

SEQ ID NO: 42541 - DNA, 29 bp, Artificial Sequence
  Description of Artificial Sequence: Synthetic oligonucleotide
aggattacatcgcccagaacgaggacctg

SEQ ID NO: 42542 - DNA, 28 bp, Artificial Sequence
  Description of Artificial Sequence: Synthetic oligonucleotide
ggattacatcgcccagaacgaggacctg

SEQ ID NO: 42543 - DNA, 28 bp, Artificial Sequence
  Description of Artificial Sequence: Synthetic oligonucleotide
gattacatcgcccagaacgaggacctgc

SEQ ID NO: 42544 - DNA, 28 bp, Artificial Sequence
  Description of Artificial Sequence: Synthetic oligonucleotide
attacatcgcccagaacgaggacctgcg

SEQ ID NO: 42545 - DNA, 27 bp, Artificial Sequence
  Description of Artificial Sequence: Synthetic oligonucleotide
ttacatcgcccagaacgaggacctgcg

SEQ ID NO: 42546 - DNA, 26 bp, Artificial Sequence
  Description of Artificial Sequence: Synthetic oligonucleotide
tacatcgcccagaacgaggacctgcg

SEQ ID NO: 42547 - DNA, 25 bp, Artificial Sequence
  Description of Artificial Sequence: Synthetic oligonucleotide
acatcgcccagaacgaggacctgcg

SEQ ID NO: 42548 - DNA, 24 bp, Artificial Sequence
  Description of Artificial Sequence: Synthetic oligonucleotide
catcgcccagaacgaggacctgcg

SEQ ID NO: 42549 - DNA, 25 bp, Artificial Sequence
  Description of Artificial Sequence: Synthetic oligonucleotide
atcgcccagaacgaggacctgcgct

SEQ ID NO: 42550 - DNA, 24 bp, Artificial Sequence
  Description of Artificial Sequence: Synthetic oligonucleotide
tcgcccagaacgaggacctgcgct

SEQ ID NO: 42551 - DNA, 23 bp, Artificial Sequence
  Description of Artificial Sequence: Synthetic oligonucleotide
cgcccagaacgaggacctgcgct

SEQ ID NO: 42552 - DNA, 23 bp, Artificial Sequence
  Description of Artificial Sequence: Synthetic oligonucleotide
gcccagaacgaggacctgcgctc

SEQ ID NO: 42553 - DNA, 24 bp, Artificial Sequence
  Description of Artificial Sequence: Synthetic oligonucleotide
cccagaacgaggacctgcgctcct

SEQ ID NO: 42554 - DNA, 24 bp, Artificial Sequence
  Description of Artificial Sequence: Synthetic oligonucleotide
ccagaacgaggacctgcgctcctg

SEQ ID NO: 42555 - DNA, 25 bp, Artificial Sequence
  Description of Artificial Sequence: Synthetic oligonucleotide
cagaacgaggacctgcgctcctgga

SEQ ID NO: 42556 - DNA, 25 bp, Artificial Sequence
  Description of Artificial Sequence: Synthetic oligonucleotide
agaacgaggacctgcgctcctggac

SEQ ID NO: 42557 - DNA, 26 bp, Artificial Sequence
  Description of Artificial Sequence: Synthetic oligonucleotide
aggctgaccgagtgagcctgcggaaa

SEQ ID NO: 42558 - DNA, 25 bp, Artificial Sequence
  Description of Artificial Sequence: Synthetic oligonucleotide
ggctgaccgagtgagcctgcggaaa

SEQ ID NO: 42559 - DNA, 26 bp, Artificial Sequence
  Description of Artificial Sequence: Synthetic oligonucleotide
gctgaccgagtgagcctgcggaaact

SEQ ID NO: 42560 - DNA, 26 bp, Artificial Sequence
  Description of Artificial Sequence: Synthetic oligonucleotide
ctgaccgagtgagcctgcggaaactg

SEQ ID NO: 42561 - DNA, 26 bp, Artificial Sequence
  Description of Artificial Sequence: Synthetic oligonucleotide
tgaccgagtgagcctgcggaaactgc

SEQ ID NO: 42562 - DNA, 25 bp, Artificial Sequence
  Description of Artificial Sequence: Synthetic oligonucleotide
gaccgagtgagcctgcggaaactgc

SEQ ID NO: 42563 - DNA, 25 bp, Artificial Sequence
  Description of Artificial Sequence: Synthetic oligonucleotide
accgagtgagcctgcggaaactgcg

SEQ ID NO: 42564 - DNA, 24 bp, Artificial Sequence
  Description of Artificial Sequence: Synthetic oligonucleotide
ccgagtgagcctgcggaaactgcg

SEQ ID NO: 42565 - DNA, 24 bp, Artificial Sequence
  Description of Artificial Sequence: Synthetic oligonucleotide
cgagtgagcctgcggaaactgcgc

SEQ ID NO: 42566 - DNA, 24 bp, Artificial Sequence
  Description of Artificial Sequence: Synthetic oligonucleotide
gagtgagcctgcggaaactgcgcg

SEQ ID NO: 42567 - DNA, 24 bp, Artificial Sequence
  Description of Artificial Sequence: Synthetic oligonucleotide
agtgagcctgcggaaactgcgcgg

SEQ ID NO: 42568 - DNA, 23 bp, Artificial Sequence
  Description of Artificial Sequence: Synthetic oligonucleotide
gtgagcctgcggaaactgcgcgg

SEQ ID NO: 42569 - DNA, 25 bp, Artificial Sequence
  Description of Artificial Sequence: Synthetic oligonucleotide
tgagcctgcggaaactgcgcggcta

SEQ ID NO: 42570 - DNA, 20 bp, Artificial Sequence
  Description of Artificial Sequence: Synthetic oligonucleotide
gcccgtgcggcggagcagtg

SEQ ID NO: 42571 - DNA, 21 bp, Artificial Sequence
  Description of Artificial Sequence: Synthetic oligonucleotide
cccgtgcggcggagcagtgga

SEQ ID NO: 42572 - DNA, 22 bp, Artificial Sequence
  Description of Artificial Sequence: Synthetic oligonucleotide
ccgtgcggcggagcagtggaga

SEQ ID NO: 42573 - DNA, 22 bp, Artificial Sequence
  Description of Artificial Sequence: Synthetic oligonucleotide
cgtgcggcggagcagtggagag

SEQ ID NO: 42574 - DNA, 22 bp, Artificial Sequence
  Description of Artificial Sequence: Synthetic oligonucleotide
gtgcggcggagcagtggagagc

SEQ ID NO: 42575 - DNA, 24 bp, Artificial Sequence
  Description of Artificial Sequence: Synthetic oligonucleotide
tgcggcggagcagtggagagccta

SEQ ID NO: 42576 - DNA, 23 bp, Artificial Sequence
  Description of Artificial Sequence: Synthetic oligonucleotide
gcggcggagcagtggagagccta

SEQ ID NO: 42577 - DNA, 23 bp, Artificial Sequence
  Description of Artificial Sequence: Synthetic oligonucleotide
cggcggagcagtggagagcctac

SEQ ID NO: 42578 - DNA, 29 bp, Artificial Sequence
  Description of Artificial Sequence: Synthetic oligonucleotide
ccactccatgaggtatttcgacaccgctg

SEQ ID NO: 42579 - DNA, 30 bp, Artificial Sequence
  Description of Artificial Sequence: Synthetic oligonucleotide
cactccatgaggtatttcgacaccgctgtg

SEQ ID NO: 42580 - DNA, 31 bp, Artificial Sequence
  Description of Artificial Sequence: Synthetic oligonucleotide
actccatgaggtatttcgacaccgctgtgtc

SEQ ID NO: 42581 - DNA, 30 bp, Artificial Sequence
  Description of Artificial Sequence: Synthetic oligonucleotide
ctccatgaggtatttcgacaccgctgtgtc

SEQ ID NO: 42582 - DNA, 30 bp, Artificial Sequence
  Description of Artificial Sequence: Synthetic oligonucleotide
tccatgaggtatttcgacaccgctgtgtcc

SEQ ID NO: 42583 - DNA, 29 bp, Artificial Sequence
  Description of Artificial Sequence: Synthetic oligonucleotide
ccatgaggtatttcgacaccgctgtgtcc

SEQ ID NO: 42584 - DNA, 29 bp, Artificial Sequence
  Description of Artificial Sequence: Synthetic oligonucleotide
catgaggtatttcgacaccgctgtgtccc

SEQ ID NO: 42585 - DNA, 29 bp, Artificial Sequence
  Description of Artificial Sequence: Synthetic oligonucleotide
atgaggtatttcgacaccgctgtgtcccg

SEQ ID NO: 42586 - DNA, 28 bp, Artificial Sequence
  Description of Artificial Sequence: Synthetic oligonucleotide
tgaggtatttcgacaccgctgtgtcccg

SEQ ID NO: 42587 - DNA, 27 bp, Artificial Sequence
  Description of Artificial Sequence: Synthetic oligonucleotide
gaggtatttcgacaccgctgtgtcccg

SEQ ID NO: 42588 - DNA, 27 bp, Artificial Sequence
  Description of Artificial Sequence: Synthetic oligonucleotide
aggtatttcgacaccgctgtgtcccgg

SEQ ID NO: 42589 - DNA, 26 bp, Artificial Sequence
  Description of Artificial Sequence: Synthetic oligonucleotide
ggtatttcgacaccgctgtgtcccgg

SEQ ID NO: 42590 - DNA, 26 bp, Artificial Sequence
  Description of Artificial Sequence: Synthetic oligonucleotide
gtatttcgacaccgctgtgtcccggc

SEQ ID NO: 42591 - DNA, 26 bp, Artificial Sequence
  Description of Artificial Sequence: Synthetic oligonucleotide
tatttcgacaccgctgtgtcccggcc

SEQ ID NO: 42592 - DNA, 25 bp, Artificial Sequence
  Description of Artificial Sequence: Synthetic oligonucleotide
atttcgacaccgctgtgtcccggcc

SEQ ID NO: 42593 - DNA, 24 bp, Artificial Sequence
  Description of Artificial Sequence: Synthetic oligonucleotide
tttcgacaccgctgtgtcccggcc

SEQ ID NO: 42594 - DNA, 23 bp, Artificial Sequence
  Description of Artificial Sequence: Synthetic oligonucleotide
ttcgacaccgctgtgtcccggcc

SEQ ID NO: 42595 - DNA, 22 bp, Artificial Sequence
  Description of Artificial Sequence: Synthetic oligonucleotide
tcgacaccgctgtgtcccggcc

SEQ ID NO: 42596 - DNA, 21 bp, Artificial Sequence
  Description of Artificial Sequence: Synthetic oligonucleotide
cgacaccgctgtgtcccggcc

SEQ ID NO: 42597 - DNA, 22 bp, Artificial Sequence
  Description of Artificial Sequence: Synthetic oligonucleotide
gacaccgctgtgtcccggccca

SEQ ID NO: 42598 - DNA, 27 bp, Artificial Sequence
  Description of Artificial Sequence: Synthetic oligonucleotide
tcagatcacccagcgcaagtgggaggt

SEQ ID NO: 42599 - DNA, 26 bp, Artificial Sequence
  Description of Artificial Sequence: Synthetic oligonucleotide
cagatcacccagcgcaagtgggaggt

SEQ ID NO: 42600 - DNA, 26 bp, Artificial Sequence
  Description of Artificial Sequence: Synthetic oligonucleotide
agatcacccagcgcaagtgggaggtg

SEQ ID NO: 42601 - DNA, 25 bp, Artificial Sequence
  Description of Artificial Sequence: Synthetic oligonucleotide
gatcacccagcgcaagtgggaggtg

SEQ ID NO: 42602 - DNA, 25 bp, Artificial Sequence
  Description of Artificial Sequence: Synthetic oligonucleotide
atcacccagcgcaagtgggaggtgg

SEQ ID NO: 42603 - DNA, 24 bp, Artificial Sequence
  Description of Artificial Sequence: Synthetic oligonucleotide
tcacccagcgcaagtgggaggtgg

SEQ ID NO: 42604 - DNA, 23 bp, Artificial Sequence
  Description of Artificial Sequence: Synthetic oligonucleotide
cacccagcgcaagtgggaggtgg

SEQ ID NO: 42605 - DNA, 23 bp, Artificial Sequence
  Description of Artificial Sequence: Synthetic oligonucleotide
acccagcgcaagtgggaggtggc

SEQ ID NO: 42606 - DNA, 22 bp, Artificial Sequence
  Description of Artificial Sequence: Synthetic oligonucleotide
cccagcgcaagtgggaggtggc

SEQ ID NO: 42607 - DNA, 22 bp, Artificial Sequence
  Description of Artificial Sequence: Synthetic oligonucleotide
ccagcgcaagtgggaggtggcc

SEQ ID NO: 42608 - DNA, 22 bp, Artificial Sequence
  Description of Artificial Sequence: Synthetic oligonucleotide
cagcgcaagtgggaggtggccc

SEQ ID NO: 42609 - DNA, 23 bp, Artificial Sequence
  Description of Artificial Sequence: Synthetic oligonucleotide
agcgcaagtgggaggtggcccgt

SEQ ID NO: 42610 - DNA, 22 bp, Artificial Sequence
  Description of Artificial Sequence: Synthetic oligonucleotide
gcgcaagtgggaggtggcccgt

SEQ ID NO: 42611 - DNA, 23 bp, Artificial Sequence
  Description of Artificial Sequence: Synthetic oligonucleotide
cgcaagtgggaggtggcccgtga

SEQ ID NO: 42612 - DNA, 23 bp, Artificial Sequence
  Description of Artificial Sequence: Synthetic oligonucleotide
gcaagtgggaggtggcccgtgag

SEQ ID NO: 42613 - DNA, 23 bp, Artificial Sequence
  Description of Artificial Sequence: Synthetic oligonucleotide
caagtgggaggtggcccgtgagg

SEQ ID NO: 42614 - DNA, 23 bp, Artificial Sequence
  Description of Artificial Sequence: Synthetic oligonucleotide
aagtgggaggtggcccgtgaggc

SEQ ID NO: 42615 - DNA, 22 bp, Artificial Sequence
  Description of Artificial Sequence: Synthetic oligonucleotide
agtgggaggtggcccgtgaggc

SEQ ID NO: 42616 - DNA, 21 bp, Artificial Sequence
  Description of Artificial Sequence: Synthetic oligonucleotide
gtgggaggtggcccgtgaggc

SEQ ID NO: 42617 - DNA, 21 bp, Artificial Sequence
  Description of Artificial Sequence: Synthetic oligonucleotide
tgggaggtggcccgtgaggcg

SEQ ID NO: 42618 - DNA, 20 bp, Artificial Sequence
  Description of Artificial Sequence: Synthetic oligonucleotide
gggaggtggcccgtgaggcg

SEQ ID NO: 42619 - DNA, 21 bp, Artificial Sequence
  Description of Artificial Sequence: Synthetic oligonucleotide
ggaggtggcccgtgaggcgga

SEQ ID NO: 42620 - DNA, 21 bp, Artificial Sequence
  Description of Artificial Sequence: Synthetic oligonucleotide
gaggtggcccgtgaggcggag

SEQ ID NO: 42621 - DNA, 22 bp, Artificial Sequence
  Description of Artificial Sequence: Synthetic oligonucleotide
aggtggcccgtgaggcggagca

SEQ ID NO: 42622 - DNA, 21 bp, Artificial Sequence
  Description of Artificial Sequence: Synthetic oligonucleotide
ggtggcccgtgaggcggagca

SEQ ID NO: 42623 - DNA, 22 bp, Artificial Sequence
  Description of Artificial Sequence: Synthetic oligonucleotide
gtggcccgtgaggcggagcagt

SEQ ID NO: 42624 - DNA, 22 bp, Artificial Sequence
  Description of Artificial Sequence: Synthetic oligonucleotide
tggcccgtgaggcggagcagtg

SEQ ID NO: 42625 - DNA, 27 bp, Artificial Sequence
  Description of Artificial Sequence: Synthetic oligonucleotide
cgggtctcacaccctccagtggatgtt

SEQ ID NO: 42626 - DNA, 28 bp, Artificial Sequence
  Description of Artificial Sequence: Synthetic oligonucleotide
gggtctcacaccctccagtggatgtttg

SEQ ID NO: 42627 - DNA, 28 bp, Artificial Sequence
  Description of Artificial Sequence: Synthetic oligonucleotide
ggtctcacaccctccagtggatgtttgg

SEQ ID NO: 42628 - DNA, 28 bp, Artificial Sequence
  Description of Artificial Sequence: Synthetic oligonucleotide
gtctcacaccctccagtggatgtttggc

SEQ ID NO: 42629 - DNA, 29 bp, Artificial Sequence
  Description of Artificial Sequence: Synthetic oligonucleotide
tctcacaccctccagtggatgtttggctg

SEQ ID NO: 42630 - DNA, 28 bp, Artificial Sequence
  Description of Artificial Sequence: Synthetic oligonucleotide
ctcacaccctccagtggatgtttggctg

SEQ ID NO: 42631 - DNA, 28 bp, Artificial Sequence
  Description of Artificial Sequence: Synthetic oligonucleotide
tcacaccctccagtggatgtttggctgc

SEQ ID NO: 42632 - DNA, 27 bp, Artificial Sequence
  Description of Artificial Sequence: Synthetic oligonucleotide
cacaccctccagtggatgtttggctgc

SEQ ID NO: 42633 - DNA, 27 bp, Artificial Sequence
  Description of Artificial Sequence: Synthetic oligonucleotide
acaccctccagtggatgtttggctgcg

SEQ ID NO: 42634 - DNA, 27 bp, Artificial Sequence
  Description of Artificial Sequence: Synthetic oligonucleotide
caccctccagtggatgtttggctgcga

SEQ ID NO: 42635 - DNA, 27 bp, Artificial Sequence
  Description of Artificial Sequence: Synthetic oligonucleotide
accctccagtggatgtttggctgcgac

SEQ ID NO: 42636 - DNA, 26 bp, Artificial Sequence
  Description of Artificial Sequence: Synthetic oligonucleotide
ccctccagtggatgtttggctgcgac

SEQ ID NO: 42637 - DNA, 27 bp, Artificial Sequence
  Description of Artificial Sequence: Synthetic oligonucleotide
cctccagtggatgtttggctgcgacct

SEQ ID NO: 42638 - DNA, 27 bp, Artificial Sequence
  Description of Artificial Sequence: Synthetic oligonucleotide
ctccagtggatgtttggctgcgacctg

SEQ ID NO: 42639 - DNA, 27 bp, Artificial Sequence
  Description of Artificial Sequence: Synthetic oligonucleotide
tccagtggatgtttggctgcgacctgg

SEQ ID NO: 42640 - DNA, 26 bp, Artificial Sequence
  Description of Artificial Sequence: Synthetic oligonucleotide
ccagtggatgtttggctgcgacctgg

SEQ ID NO: 42641 - DNA, 26 bp, Artificial Sequence
  Description of Artificial Sequence: Synthetic oligonucleotide
cagtggatgtttggctgcgacctggg

SEQ ID NO: 42642 - DNA, 26 bp, Artificial Sequence
  Description of Artificial Sequence: Synthetic oligonucleotide
agtggatgtttggctgcgacctgggg

SEQ ID NO: 42643 - DNA, 25 bp, Artificial Sequence
  Description of Artificial Sequence: Synthetic oligonucleotide
gtggatgtttggctgcgacctgggg

SEQ ID NO: 42644 - DNA, 25 bp, Artificial Sequence
  Description of Artificial Sequence: Synthetic oligonucleotide
tggatgtttggctgcgacctggggc

SEQ ID NO: 42645 - DNA, 23 bp, Artificial Sequence
  Description of Artificial Sequence: Synthetic oligonucleotide
ggcgagtgcgtggagtggctcca

SEQ ID NO: 42646 - DNA, 24 bp, Artificial Sequence
  Description of Artificial Sequence: Synthetic oligonucleotide
gcgagtgcgtggagtggctccaca

SEQ ID NO: 42647 - DNA, 27 bp, Artificial Sequence
  Description of Artificial Sequence: Synthetic oligonucleotide
cgagtgcgtggagtggctccacagata

SEQ ID NO: 42648 - DNA, 27 bp, Artificial Sequence
  Description of Artificial Sequence: Synthetic oligonucleotide
gagtgcgtggagtggctccacagatac

SEQ ID NO: 42649 - DNA, 27 bp, Artificial Sequence
  Description of Artificial Sequence: Synthetic oligonucleotide
agtgcgtggagtggctccacagatacc

SEQ ID NO: 42650 - DNA, 31 bp, Artificial Sequence
  Description of Artificial Sequence: Synthetic oligonucleotide
catgaggtatttctacaccgctgtgtcccag

SEQ ID NO: 42651 - DNA, 31 bp, Artificial Sequence
  Description of Artificial Sequence: Synthetic oligonucleotide
atgaggtatttctacaccgctgtgtcccagc

SEQ ID NO: 42652 - DNA, 30 bp, Artificial Sequence
  Description of Artificial Sequence: Synthetic oligonucleotide
tgaggtatttctacaccgctgtgtcccagc

SEQ ID NO: 42653 - DNA, 29 bp, Artificial Sequence
  Description of Artificial Sequence: Synthetic oligonucleotide
gaggtatttctacaccgctgtgtcccagc

SEQ ID NO: 42654 - DNA, 29 bp, Artificial Sequence
  Description of Artificial Sequence: Synthetic oligonucleotide
aggtatttctacaccgctgtgtcccagcc

SEQ ID NO: 42655 - DNA, 28 bp, Artificial Sequence
  Description of Artificial Sequence: Synthetic oligonucleotide
ggtatttctacaccgctgtgtcccagcc

SEQ ID NO: 42656 - DNA, 28 bp, Artificial Sequence
  Description of Artificial Sequence: Synthetic oligonucleotide
gtatttctacaccgctgtgtcccagccc

SEQ ID NO: 42657 - DNA, 29 bp, Artificial Sequence
  Description of Artificial Sequence: Synthetic oligonucleotide
tatttctacaccgctgtgtcccagcccag

SEQ ID NO: 42658 - DNA, 28 bp, Artificial Sequence
  Description of Artificial Sequence: Synthetic oligonucleotide
atttctacaccgctgtgtcccagcccag

SEQ ID NO: 42659 - DNA, 27 bp, Artificial Sequence
  Description of Artificial Sequence: Synthetic oligonucleotide
tttctacaccgctgtgtcccagcccag

SEQ ID NO: 42660 - DNA, 26 bp, Artificial Sequence
  Description of Artificial Sequence: Synthetic oligonucleotide
ttctacaccgctgtgtcccagcccag

SEQ ID NO: 42661 - DNA, 25 bp, Artificial Sequence
  Description of Artificial Sequence: Synthetic oligonucleotide
tctacaccgctgtgtcccagcccag

SEQ ID NO: 42662 - DNA, 24 bp, Artificial Sequence
  Description of Artificial Sequence: Synthetic oligonucleotide
ctacaccgctgtgtcccagcccag

SEQ ID NO: 42663 - DNA, 24 bp, Artificial Sequence
  Description of Artificial Sequence: Synthetic oligonucleotide
tacaccgctgtgtcccagcccagc

SEQ ID NO: 42664 - DNA, 23 bp, Artificial Sequence
  Description of Artificial Sequence: Synthetic oligonucleotide
acaccgctgtgtcccagcccagc

SEQ ID NO: 42665 - DNA, 22 bp, Artificial Sequence
  Description of Artificial Sequence: Synthetic oligonucleotide
caccgctgtgtcccagcccagc

SEQ ID NO: 42666 - DNA, 22 bp, Artificial Sequence
  Description of Artificial Sequence: Synthetic oligonucleotide
accgctgtgtcccagcccagcc

SEQ ID NO: 42667 - DNA, 21 bp, Artificial Sequence
  Description of Artificial Sequence: Synthetic oligonucleotide
ccgctgtgtcccagcccagcc

SEQ ID NO: 42668 - DNA, 21 bp, Artificial Sequence
  Description of Artificial Sequence: Synthetic oligonucleotide
cgctgtgtcccagcccagccg

SEQ ID NO: 42669 - DNA, 21 bp, Artificial Sequence
  Description of Artificial Sequence: Synthetic oligonucleotide
gctgtgtcccagcccagccgc

SEQ ID NO: 42670 - DNA, 21 bp, Artificial Sequence
  Description of Artificial Sequence: Synthetic oligonucleotide
ctgtgtcccagcccagccgcg

SEQ ID NO: 42671 - DNA, 22 bp, Artificial Sequence
  Description of Artificial Sequence: Synthetic oligonucleotide
tgtgtcccagcccagccgcgga

SEQ ID NO: 42672 - DNA, 21 bp, Artificial Sequence
  Description of Artificial Sequence: Synthetic oligonucleotide
gtgtcccagcccagccgcgga

SEQ ID NO: 42673 - DNA, 22 bp, Artificial Sequence
  Description of Artificial Sequence: Synthetic oligonucleotide
tgtcccagcccagccgcggaga

SEQ ID NO: 42674 - DNA, 21 bp, Artificial Sequence
  Description of Artificial Sequence: Synthetic oligonucleotide
gtcccagcccagccgcggaga

SEQ ID NO: 42675 - DNA, 21 bp, Artificial Sequence
  Description of Artificial Sequence: Synthetic oligonucleotide
tcccagcccagccgcggagag

SEQ ID NO: 42676 - DNA, 20 bp, Artificial Sequence
  Description of Artificial Sequence: Synthetic oligonucleotide
cccagcccagccgcggagag

SEQ ID NO: 42677 - DNA, 20 bp, Artificial Sequence
  Description of Artificial Sequence: Synthetic oligonucleotide
ccagcccagccgcggagagc

SEQ ID NO: 42678 - DNA, 20 bp, Artificial Sequence
  Description of Artificial Sequence: Synthetic oligonucleotide
cagcccagccgcggagagcc

SEQ ID NO: 42679 - DNA, 20 bp, Artificial Sequence
  Description of Artificial Sequence: Synthetic oligonucleotide
agcccagccgcggagagccc

SEQ ID NO: 42680 - DNA, 25 bp, Artificial Sequence
  Description of Artificial Sequence: Synthetic oligonucleotide
gaaggacaagctggagcgcgcggaa

SEQ ID NO: 42681 - DNA, 26 bp, Artificial Sequence
  Description of Artificial Sequence: Synthetic oligonucleotide
aaggacaagctggagcgcgcggaaca

SEQ ID NO: 42682 - DNA, 25 bp, Artificial Sequence
  Description of Artificial Sequence: Synthetic oligonucleotide
aggacaagctggagcgcgcggaaca

SEQ ID NO: 42683 - DNA, 24 bp, Artificial Sequence
  Description of Artificial Sequence: Synthetic oligonucleotide
ggacaagctggagcgcgcggaaca

SEQ ID NO: 42684 - DNA, 24 bp, Artificial Sequence
  Description of Artificial Sequence: Synthetic oligonucleotide
gacaagctggagcgcgcggaacac

SEQ ID NO: 42685 - DNA, 24 bp, Artificial Sequence
  Description of Artificial Sequence: Synthetic oligonucleotide
acaagctggagcgcgcggaacacc

SEQ ID NO: 42686 - DNA, 23 bp, Artificial Sequence
  Description of Artificial Sequence: Synthetic oligonucleotide
caagctggagcgcgcggaacacc

SEQ ID NO: 42687 - DNA, 26 bp, Artificial Sequence
  Description of Artificial Sequence: Synthetic oligonucleotide
aagctggagcgcgcggaacacccaaa

SEQ ID NO: 42688 - DNA, 25 bp, Artificial Sequence
  Description of Artificial Sequence: Synthetic oligonucleotide
agctggagcgcgcggaacacccaaa

SEQ ID NO: 42689 - DNA, 24 bp, Artificial Sequence
  Description of Artificial Sequence: Synthetic oligonucleotide
gctggagcgcgcggaacacccaaa

SEQ ID NO: 42690 - DNA, 25 bp, Artificial Sequence
  Description of Artificial Sequence: Synthetic oligonucleotide
ctggagcgcgcggaacacccaaaga

SEQ ID NO: 42691 - DNA, 26 bp, Artificial Sequence
  Description of Artificial Sequence: Synthetic oligonucleotide
tggagcgcgcggaacacccaaagaca

SEQ ID NO: 42692 - DNA, 25 bp, Artificial Sequence
  Description of Artificial Sequence: Synthetic oligonucleotide
ggagcgcgcggaacacccaaagaca

SEQ ID NO: 42693 - DNA, 26 bp, Artificial Sequence
  Description of Artificial Sequence: Synthetic oligonucleotide
gagcgcgcggaacacccaaagacaca

SEQ ID NO: 42694 - DNA, 25 bp, Artificial Sequence
  Description of Artificial Sequence: Synthetic oligonucleotide
acacagcggctcagatcacccagcc

SEQ ID NO: 42695 - DNA, 24 bp, Artificial Sequence
  Description of Artificial Sequence: Synthetic oligonucleotide
cacagcggctcagatcacccagcc

SEQ ID NO: 42696 - DNA, 26 bp, Artificial Sequence
  Description of Artificial Sequence: Synthetic oligonucleotide
acagcggctcagatcacccagcccaa

SEQ ID NO: 42697 - DNA, 25 bp, Artificial Sequence
  Description of Artificial Sequence: Synthetic oligonucleotide
cagcggctcagatcacccagcccaa

SEQ ID NO: 42698 - DNA, 26 bp, Artificial Sequence
  Description of Artificial Sequence: Synthetic oligonucleotide
agcggctcagatcacccagcccaagt

SEQ ID NO: 42699 - DNA, 28 bp, Artificial Sequence
  Description of Artificial Sequence: Synthetic oligonucleotide
tcacaccctccagaggatgtacggctac

SEQ ID NO: 42700 - DNA, 27 bp, Artificial Sequence
  Description of Artificial Sequence: Synthetic oligonucleotide
cacaccctccagaggatgtacggctac

SEQ ID NO: 42701 - DNA, 27 bp, Artificial Sequence
  Description of Artificial Sequence: Synthetic oligonucleotide
acaccctccagaggatgtacggctacg

SEQ ID NO: 42702 - DNA, 27 bp, Artificial Sequence
  Description of Artificial Sequence: Synthetic oligonucleotide
caccctccagaggatgtacggctacga

SEQ ID NO: 42703 - DNA, 27 bp, Artificial Sequence
  Description of Artificial Sequence: Synthetic oligonucleotide
accctccagaggatgtacggctacgac

SEQ ID NO: 42704 - DNA, 26 bp, Artificial Sequence
  Description of Artificial Sequence: Synthetic oligonucleotide
ccctccagaggatgtacggctacgac

SEQ ID NO: 42705 - DNA, 27 bp, Artificial Sequence
  Description of Artificial Sequence: Synthetic oligonucleotide
cctccagaggatgtacggctacgacct

SEQ ID NO: 42706 - DNA, 27 bp, Artificial Sequence
  Description of Artificial Sequence: Synthetic oligonucleotide
ctccagaggatgtacggctacgacctg

SEQ ID NO: 42707 - DNA, 27 bp, Artificial Sequence
  Description of Artificial Sequence: Synthetic oligonucleotide
tccagaggatgtacggctacgacctgg

SEQ ID NO: 42708 - DNA, 26 bp, Artificial Sequence
  Description of Artificial Sequence: Synthetic oligonucleotide
ccagaggatgtacggctacgacctgg

SEQ ID NO: 42709 - DNA, 26 bp, Artificial Sequence
  Description of Artificial Sequence: Synthetic oligonucleotide
cagaggatgtacggctacgacctggg

SEQ ID NO: 42710 - DNA, 26 bp, Artificial Sequence
  Description of Artificial Sequence: Synthetic oligonucleotide
agaggatgtacggctacgacctgggg

SEQ ID NO: 42711 - DNA, 25 bp, Artificial Sequence
  Description of Artificial Sequence: Synthetic oligonucleotide
gaggatgtacggctacgacctgggg

SEQ ID NO: 42712 - DNA, 25 bp, Artificial Sequence
  Description of Artificial Sequence: Synthetic oligonucleotide
aggatgtacggctacgacctggggc

SEQ ID NO: 42713 - DNA, 24 bp, Artificial Sequence
  Description of Artificial Sequence: Synthetic oligonucleotide
ggatgtacggctacgacctggggc

SEQ ID NO: 42714 - DNA, 24 bp, Artificial Sequence
  Description of Artificial Sequence: Synthetic oligonucleotide
gatgtacggctacgacctggggcc

SEQ ID NO: 42715 - DNA, 24 bp, Artificial Sequence
  Description of Artificial Sequence: Synthetic oligonucleotide
atgtacggctacgacctggggccc

SEQ ID NO: 42716 - DNA, 23 bp, Artificial Sequence
  Description of Artificial Sequence: Synthetic oligonucleotide
tgtacggctacgacctggggccc

SEQ ID NO: 42717 - DNA, 22 bp, Artificial Sequence
  Description of Artificial Sequence: Synthetic oligonucleotide
gtacggctacgacctggggccc

SEQ ID NO: 42718 - DNA, 23 bp, Artificial Sequence
  Description of Artificial Sequence: Synthetic oligonucleotide
tacggctacgacctggggcccga

SEQ ID NO: 42719 - DNA, 22 bp, Artificial Sequence
  Description of Artificial Sequence: Synthetic oligonucleotide
acggctacgacctggggcccga

SEQ ID NO: 42720 - DNA, 21 bp, Artificial Sequence
  Description of Artificial Sequence: Synthetic oligonucleotide
cggctacgacctggggcccga

SEQ ID NO: 42721 - DNA, 21 bp, Artificial Sequence
  Description of Artificial Sequence: Synthetic oligonucleotide
ggctacgacctggggcccgac

SEQ ID NO: 42722 - DNA, 21 bp, Artificial Sequence
  Description of Artificial Sequence: Synthetic oligonucleotide
gctacgacctggggcccgacg

SEQ ID NO: 42723 - DNA, 21 bp, Artificial Sequence
  Description of Artificial Sequence: Synthetic oligonucleotide
ctacgacctggggcccgacgg

SEQ ID NO: 42724 - DNA, 21 bp, Artificial Sequence
  Description of Artificial Sequence: Synthetic oligonucleotide
tacgacctggggcccgacggg

SEQ ID NO: 42725 - DNA, 20 bp, Artificial Sequence
  Description of Artificial Sequence: Synthetic oligonucleotide
acgacctggggcccgacggg

SEQ ID NO: 42726 - DNA, 20 bp, Artificial Sequence
  Description of Artificial Sequence: Synthetic oligonucleotide
ccggccgcggagagccccat

SEQ ID NO: 42727 - DNA, 21 bp, Artificial Sequence
  Description of Artificial Sequence: Synthetic oligonucleotide
cggccgcggagagccccactt

SEQ ID NO: 42728 - DNA, 23 bp, Artificial Sequence
  Description of Artificial Sequence: Synthetic oligonucleotide
ggccgcggagagccccacttcat

SEQ ID NO: 42729 - DNA, 26 bp, Artificial Sequence
  Description of Artificial Sequence: Synthetic oligonucleotide
atttctacaccgctgtgtcccggccc

SEQ ID NO: 42730 - DNA, 25 bp, Artificial Sequence
  Description of Artificial Sequence: Synthetic oligonucleotide
tttctacaccgctgtgtcccggccc

SEQ ID NO: 42731 - DNA, 24 bp, Artificial Sequence
  Description of Artificial Sequence: Synthetic oligonucleotide
ttctacaccgctgtgtcccggccc

SEQ ID NO: 42732 - DNA, 23 bp, Artificial Sequence
  Description of Artificial Sequence: Synthetic oligonucleotide
tctacaccgctgtgtcccggccc

SEQ ID NO: 42733 - DNA, 22 bp, Artificial Sequence
  Description of Artificial Sequence: Synthetic oligonucleotide
ctacaccgctgtgtcccggccc

SEQ ID NO: 42734 - DNA, 22 bp, Artificial Sequence
  Description of Artificial Sequence: Synthetic oligonucleotide
tacaccgctgtgtcccggcccg

SEQ ID NO: 42735 - DNA, 21 bp, Artificial Sequence
  Description of Artificial Sequence: Synthetic oligonucleotide
acaccgctgtgtcccggcccg

SEQ ID NO: 42736 - DNA, 20 bp, Artificial Sequence
  Description of Artificial Sequence: Synthetic oligonucleotide
caccgctgtgtcccggcccg

SEQ ID NO: 42737 - DNA, 20 bp, Artificial Sequence
  Description of Artificial Sequence: Synthetic oligonucleotide
accgctgtgtcccggcccgg

SEQ ID NO: 42738 - DNA, 20 bp, Artificial Sequence
  Description of Artificial Sequence: Synthetic oligonucleotide
ccgctgtgtcccggcccggt

SEQ ID NO: 42739 - DNA, 20 bp, Artificial Sequence
  Description of Artificial Sequence: Synthetic oligonucleotide
cgctgtgtcccggcccggct

SEQ ID NO: 42740 - DNA, 20 bp, Artificial Sequence
  Description of Artificial Sequence: Synthetic oligonucleotide
gctgtgtcccggcccggcct

SEQ ID NO: 42741 - DNA, 29 bp, Artificial Sequence
  Description of Artificial Sequence: Synthetic oligonucleotide
agatacacgtgccatgtgcagcacgagag

SEQ ID NO: 42742 - DNA, 28 bp, Artificial Sequence
  Description of Artificial Sequence: Synthetic oligonucleotide
gatacacgtgccatgtgcagcacgagag

SEQ ID NO: 42743 - DNA, 28 bp, Artificial Sequence
  Description of Artificial Sequence: Synthetic oligonucleotide
atacacgtgccatgtgcagcacgagagg

SEQ ID NO: 42744 - DNA, 27 bp, Artificial Sequence
  Description of Artificial Sequence: Synthetic oligonucleotide
tacacgtgccatgtgcagcacgagagg

SEQ ID NO: 42745 - DNA, 26 bp, Artificial Sequence
  Description of Artificial Sequence: Synthetic oligonucleotide
acacgtgccatgtgcagcacgagagg

SEQ ID NO: 42746 - DNA, 25 bp, Artificial Sequence
  Description of Artificial Sequence: Synthetic oligonucleotide
cacgtgccatgtgcagcacgagagg

SEQ ID NO: 42747 - DNA, 26 bp, Artificial Sequence
  Description of Artificial Sequence: Synthetic oligonucleotide
acgtgccatgtgcagcacgagaggct

SEQ ID NO: 42748 - DNA, 25 bp, Artificial Sequence
  Description of Artificial Sequence: Synthetic oligonucleotide
cgtgccatgtgcagcacgagaggct

SEQ ID NO: 42749 - DNA, 25 bp, Artificial Sequence
  Description of Artificial Sequence: Synthetic oligonucleotide
gtgccatgtgcagcacgagaggctg

SEQ ID NO: 42750 - DNA, 25 bp, Artificial Sequence
  Description of Artificial Sequence: Synthetic oligonucleotide
tgccatgtgcagcacgagaggctgc

SEQ ID NO: 42751 - DNA, 24 bp, Artificial Sequence
  Description of Artificial Sequence: Synthetic oligonucleotide
gccatgtgcagcacgagaggctgc

SEQ ID NO: 42752 - DNA, 24 bp, Artificial Sequence
  Description of Artificial Sequence: Synthetic oligonucleotide
ccatgtgcagcacgagaggctgcc

SEQ ID NO: 42753 - DNA, 24 bp, Artificial Sequence
  Description of Artificial Sequence: Synthetic oligonucleotide
catgtgcagcacgagaggctgccg

SEQ ID NO: 42754 - DNA, 25 bp, Artificial Sequence
  Description of Artificial Sequence: Synthetic oligonucleotide
atgtgcagcacgagaggctgccgga

SEQ ID NO: 42755 - DNA, 24 bp, Artificial Sequence
  Description of Artificial Sequence: Synthetic oligonucleotide
tgtgcagcacgagaggctgccgga

SEQ ID NO: 42756 - DNA, 23 bp, Artificial Sequence
  Description of Artificial Sequence: Synthetic oligonucleotide
gtgcagcacgagaggctgccgga

SEQ ID NO: 42757 - DNA, 23 bp, Artificial Sequence
  Description of Artificial Sequence: Synthetic oligonucleotide
tgcagcacgagaggctgccggag

SEQ ID NO: 42758 - DNA, 22 bp, Artificial Sequence
  Description of Artificial Sequence: Synthetic oligonucleotide
gcagcacgagaggctgccggag

SEQ ID NO: 42759 - DNA, 22 bp, Artificial Sequence
  Description of Artificial Sequence: Synthetic oligonucleotide
cagcacgagaggctgccggagc

SEQ ID NO: 42760 - DNA, 22 bp, Artificial Sequence
  Description of Artificial Sequence: Synthetic oligonucleotide
agcacgagaggctgccggagcc

SEQ ID NO: 42761 - DNA, 21 bp, Artificial Sequence
  Description of Artificial Sequence: Synthetic oligonucleotide
gcacgagaggctgccggagcc

SEQ ID NO: 42762 - DNA, 21 bp, Artificial Sequence
  Description of Artificial Sequence: Synthetic oligonucleotide
cacgagaggctgccggagccc

SEQ ID NO: 42763 - DNA, 22 bp, Artificial Sequence
  Description of Artificial Sequence: Synthetic oligonucleotide
acgagaggctgccggagcccct

SEQ ID NO: 42764 - DNA, 21 bp, Artificial Sequence
  Description of Artificial Sequence: Synthetic oligonucleotide
cgagaggctgccggagcccct

SEQ ID NO: 42765 - DNA, 22 bp, Artificial Sequence
  Description of Artificial Sequence: Synthetic oligonucleotide
gagaggctgccggagcccctca

SEQ ID NO: 42766 - DNA, 22 bp, Artificial Sequence
  Description of Artificial Sequence: Synthetic oligonucleotide
agaggctgccggagcccctcac

SEQ ID NO: 42767 - DNA, 21 bp, Artificial Sequence
  Description of Artificial Sequence: Synthetic oligonucleotide
gaggctgccggagcccctcac

SEQ ID NO: 42768 - DNA, 21 bp, Artificial Sequence
  Description of Artificial Sequence: Synthetic oligonucleotide
aggctgccggagcccctcacc

SEQ ID NO: 42769 - DNA, 22 bp, Artificial Sequence
  Description of Artificial Sequence: Synthetic oligonucleotide
tgtgtcccggcccagccgcgaa

SEQ ID NO: 42770 - DNA, 21 bp, Artificial Sequence
  Description of Artificial Sequence: Synthetic oligonucleotide
gtgtcccggcccagccgcgaa

SEQ ID NO: 42771 - DNA, 22 bp, Artificial Sequence
  Description of Artificial Sequence: Synthetic oligonucleotide
tgtcccggcccagccgcgaaga

SEQ ID NO: 42772 - DNA, 21 bp, Artificial Sequence
  Description of Artificial Sequence: Synthetic oligonucleotide
gtcccggcccagccgcgaaga

SEQ ID NO: 42773 - DNA, 21 bp, Artificial Sequence
  Description of Artificial Sequence: Synthetic oligonucleotide
tcccggcccagccgcgaagag

SEQ ID NO: 42774 - DNA, 20 bp, Artificial Sequence
  Description of Artificial Sequence: Synthetic oligonucleotide
cccggcccagccgcgaagag

SEQ ID NO: 42775 - DNA, 20 bp, Artificial Sequence
  Description of Artificial Sequence: Synthetic oligonucleotide
ccggcccagccgcgaagagc

SEQ ID NO: 42776 - DNA, 20 bp, Artificial Sequence
  Description of Artificial Sequence: Synthetic oligonucleotide
cggcccagccgcgaagagcc

SEQ ID NO: 42777 - DNA, 20 bp, Artificial Sequence
  Description of Artificial Sequence: Synthetic oligonucleotide
ggcccagccgcgaagagccc

SEQ ID NO: 42778 - DNA, 21 bp, Artificial Sequence
  Description of Artificial Sequence: Synthetic oligonucleotide
gcccagccgcgaagagcccca

SEQ ID NO: 42779 - DNA, 23 bp, Artificial Sequence
  Description of Artificial Sequence: Synthetic oligonucleotide
cccagccgcgaagagccccactt

SEQ ID NO: 42780 - DNA, 25 bp, Artificial Sequence
  Description of Artificial Sequence: Synthetic oligonucleotide
ccagccgcgaagagccccacttcat

SEQ ID NO: 42781 - DNA, 25 bp, Artificial Sequence
  Description of Artificial Sequence: Synthetic oligonucleotide
cagccgcgaagagccccacttcatc

SEQ ID NO: 42782 - DNA, 25 bp, Artificial Sequence
  Description of Artificial Sequence: Synthetic oligonucleotide
agccgcgaagagccccacttcatcg

SEQ ID NO: 42783 - DNA, 24 bp, Artificial Sequence
  Description of Artificial Sequence: Synthetic oligonucleotide
gccgcgaagagccccacttcatcg

SEQ ID NO: 42784 - DNA, 25 bp, Artificial Sequence
  Description of Artificial Sequence: Synthetic oligonucleotide
ccgcgaagagccccacttcatcgca

SEQ ID NO: 42785 - DNA, 26 bp, Artificial Sequence
  Description of Artificial Sequence: Synthetic oligonucleotide
cgcgaagagccccacttcatcgcagt

SEQ ID NO: 42786 - DNA, 26 bp, Artificial Sequence
  Description of Artificial Sequence: Synthetic oligonucleotide
gcgaagagccccacttcatcgcagtg

SEQ ID NO: 42787 - DNA, 26 bp, Artificial Sequence
  Description of Artificial Sequence: Synthetic oligonucleotide
cgaagagccccacttcatcgcagtgg

SEQ ID NO: 42788 - DNA, 26 bp, Artificial Sequence
  Description of Artificial Sequence: Synthetic oligonucleotide
gaagagccccacttcatcgcagtggg

SEQ ID NO: 42789 - DNA, 27 bp, Artificial Sequence
  Description of Artificial Sequence: Synthetic oligonucleotide
aagagccccacttcatcgcagtgggct

SEQ ID NO: 42790 - DNA, 25 bp, Artificial Sequence
  Description of Artificial Sequence: Synthetic oligonucleotide
ggagcagtggagagcctacctggac

SEQ ID NO: 42791 - DNA, 25 bp, Artificial Sequence
  Description of Artificial Sequence: Synthetic oligonucleotide
gagcagtggagagcctacctggacg

SEQ ID NO: 42792 - DNA, 25 bp, Artificial Sequence
  Description of Artificial Sequence: Synthetic oligonucleotide
agcagtggagagcctacctggacgg

SEQ ID NO: 42793 - DNA, 24 bp, Artificial Sequence
  Description of Artificial Sequence: Synthetic oligonucleotide
gcagtggagagcctacctggacgg

SEQ ID NO: 42794 - DNA, 24 bp, Artificial Sequence
  Description of Artificial Sequence: Synthetic oligonucleotide
cagtggagagcctacctggacggc

SEQ ID NO: 42795 - DNA, 25 bp, Artificial Sequence
  Description of Artificial Sequence: Synthetic oligonucleotide
agtggagagcctacctggacggcga

SEQ ID NO: 42796 - DNA, 24 bp, Artificial Sequence
  Description of Artificial Sequence: Synthetic oligonucleotide
gtggagagcctacctggacggcga

SEQ ID NO: 42797 - DNA, 25 bp, Artificial Sequence
  Description of Artificial Sequence: Synthetic oligonucleotide
tggagagcctacctggacggcgagt

SEQ ID NO: 42798 - DNA, 24 bp, Artificial Sequence
  Description of Artificial Sequence: Synthetic oligonucleotide
ggagagcctacctggacggcgagt

SEQ ID NO: 42799 - DNA, 24 bp, Artificial Sequence
  Description of Artificial Sequence: Synthetic oligonucleotide
gagagcctacctggacggcgagtg

SEQ ID NO: 42800 - DNA, 24 bp, Artificial Sequence
  Description of Artificial Sequence: Synthetic oligonucleotide
agagcctacctggacggcgagtgc

SEQ ID NO: 42801 - DNA, 23 bp, Artificial Sequence
  Description of Artificial Sequence: Synthetic oligonucleotide
gagcctacctggacggcgagtgc

SEQ ID NO: 42802 - DNA, 24 bp, Artificial Sequence
  Description of Artificial Sequence: Synthetic oligonucleotide
agcctacctggacggcgagtgcgt

SEQ ID NO: 42803 - DNA, 23 bp, Artificial Sequence
  Description of Artificial Sequence: Synthetic oligonucleotide
gcctacctggacggcgagtgcgt

SEQ ID NO: 42804 - DNA, 23 bp, Artificial Sequence
  Description of Artificial Sequence: Synthetic oligonucleotide
cctacctggacggcgagtgcgtg

SEQ ID NO: 42805 - DNA, 24 bp, Artificial Sequence
  Description of Artificial Sequence: Synthetic oligonucleotide
ctacctggacggcgagtgcgtgga

SEQ ID NO: 42806 - DNA, 25 bp, Artificial Sequence
  Description of Artificial Sequence: Synthetic oligonucleotide
tacctggacggcgagtgcgtggagt

SEQ ID NO: 42807 - DNA, 24 bp, Artificial Sequence
  Description of Artificial Sequence: Synthetic oligonucleotide
acctggacggcgagtgcgtggagt

SEQ ID NO: 42808 - DNA, 23 bp, Artificial Sequence
  Description of Artificial Sequence: Synthetic oligonucleotide
cctggacggcgagtgcgtggagt

SEQ ID NO: 42809 - DNA, 23 bp, Artificial Sequence
  Description of Artificial Sequence: Synthetic oligonucleotide
ctggacggcgagtgcgtggagtg

SEQ ID NO: 42810 - DNA, 23 bp, Artificial Sequence
  Description of Artificial Sequence: Synthetic oligonucleotide
tggacggcgagtgcgtggagtgg

SEQ ID NO: 42811 - DNA, 22 bp, Artificial Sequence
  Description of Artificial Sequence: Synthetic oligonucleotide
ggacggcgagtgcgtggagtgg

SEQ ID NO: 42812 - DNA, 23 bp, Artificial Sequence
  Description of Artificial Sequence: Synthetic oligonucleotide
gacggcgagtgcgtggagtggct

SEQ ID NO: 42813 - DNA, 23 bp, Artificial Sequence
  Description of Artificial Sequence: Synthetic oligonucleotide
acggcgagtgcgtggagtggctc

SEQ ID NO: 42814 - DNA, 22 bp, Artificial Sequence
  Description of Artificial Sequence: Synthetic oligonucleotide
cggcgagtgcgtggagtggctc

SEQ ID NO: 42815 - DNA, 25 bp, Artificial Sequence
  Description of Artificial Sequence: Synthetic oligonucleotide
aaccagagcgaggcccggtctcaca

SEQ ID NO: 42816 - DNA, 24 bp, Artificial Sequence
  Description of Artificial Sequence: Synthetic oligonucleotide
accagagcgaggcccggtctcaca

SEQ ID NO: 42817 - DNA, 23 bp, Artificial Sequence
  Description of Artificial Sequence: Synthetic oligonucleotide
ccagagcgaggcccggtctcaca

SEQ ID NO: 42818 - DNA, 23 bp, Artificial Sequence
  Description of Artificial Sequence: Synthetic oligonucleotide
cagagcgaggcccggtctcacac

SEQ ID NO: 42819 - DNA, 23 bp, Artificial Sequence
  Description of Artificial Sequence: Synthetic oligonucleotide
agagcgaggcccggtctcacacc

SEQ ID NO: 42820 - DNA, 22 bp, Artificial Sequence
  Description of Artificial Sequence: Synthetic oligonucleotide
gagcgaggcccggtctcacacc

SEQ ID NO: 42821 - DNA, 23 bp, Artificial Sequence
  Description of Artificial Sequence: Synthetic oligonucleotide
agcgaggcccggtctcacaccct

SEQ ID NO: 42822 - DNA, 22 bp, Artificial Sequence
  Description of Artificial Sequence: Synthetic oligonucleotide
gcgaggcccggtctcacaccct

SEQ ID NO: 42823 - DNA, 22 bp, Artificial Sequence
  Description of Artificial Sequence: Synthetic oligonucleotide
cgaggcccggtctcacaccctc

SEQ ID NO: 42824 - DNA, 23 bp, Artificial Sequence
  Description of Artificial Sequence: Synthetic oligonucleotide
gaggcccggtctcacaccctcca

SEQ ID NO: 42825 - DNA, 24 bp, Artificial Sequence
  Description of Artificial Sequence: Synthetic oligonucleotide
aggcccggtctcacaccctccaga

SEQ ID NO: 42826 - DNA, 23 bp, Artificial Sequence
  Description of Artificial Sequence: Synthetic oligonucleotide
ggcccggtctcacaccctccaga

SEQ ID NO: 42827 - DNA, 23 bp, Artificial Sequence
  Description of Artificial Sequence: Synthetic oligonucleotide
gcccggtctcacaccctccagag

SEQ ID NO: 42828 - DNA, 25 bp, Artificial Sequence
  Description of Artificial Sequence: Synthetic oligonucleotide
cccggtctcacaccctccagaggat

SEQ ID NO: 42829 - DNA, 27 bp, Artificial Sequence
  Description of Artificial Sequence: Synthetic oligonucleotide
ccggtctcacaccctccagaggatgta

SEQ ID NO: 42830 - DNA, 27 bp, Artificial Sequence
  Description of Artificial Sequence: Synthetic oligonucleotide
cggtctcacaccctccagaggatgtac

SEQ ID NO: 42831 - DNA, 25 bp, Artificial Sequence
  Description of Artificial Sequence: Synthetic oligonucleotide
agtgaacctgcggaaactgcgcggc

SEQ ID NO: 42832 - DNA, 24 bp, Artificial Sequence
  Description of Artificial Sequence: Synthetic oligonucleotide
gtgaacctgcggaaactgcgcggc

SEQ ID NO: 42833 - DNA, 25 bp, Artificial Sequence
  Description of Artificial Sequence: Synthetic oligonucleotide
tgaacctgcggaaactgcgcggcca

SEQ ID NO: 42834 - DNA, 24 bp, Artificial Sequence
  Description of Artificial Sequence: Synthetic oligonucleotide
gaacctgcggaaactgcgcggcca

SEQ ID NO: 42835 - DNA, 26 bp, Artificial Sequence
  Description of Artificial Sequence: Synthetic oligonucleotide
aacctgcggaaactgcgcggccacta

SEQ ID NO: 42836 - DNA, 25 bp, Artificial Sequence
  Description of Artificial Sequence: Synthetic oligonucleotide
acctgcggaaactgcgcggccacta

SEQ ID NO: 42837 - DNA, 24 bp, Artificial Sequence
  Description of Artificial Sequence: Synthetic oligonucleotide
cctgcggaaactgcgcggccacta

SEQ ID NO: 42838 - DNA, 26 bp, Artificial Sequence
  Description of Artificial Sequence: Synthetic oligonucleotide
ctgcggaaactgcgcggccactacaa

SEQ ID NO: 42839 - DNA, 26 bp, Artificial Sequence
  Description of Artificial Sequence: Synthetic oligonucleotide
tgcggaaactgcgcggccactacaac

SEQ ID NO: 42840 - DNA, 25 bp, Artificial Sequence
  Description of Artificial Sequence: Synthetic oligonucleotide
gcggaaactgcgcggccactacaac

SEQ ID NO: 42841 - DNA, 26 bp, Artificial Sequence
  Description of Artificial Sequence: Synthetic oligonucleotide
cggaaactgcgcggccactacaacca

SEQ ID NO: 42842 - DNA, 27 bp, Artificial Sequence
  Description of Artificial Sequence: Synthetic oligonucleotide
ggaaactgcgcggccactacaaccaga

SEQ ID NO: 42843 - DNA, 27 bp, Artificial Sequence
  Description of Artificial Sequence: Synthetic oligonucleotide
gaaactgcgcggccactacaaccagag

SEQ ID NO: 42844 - DNA, 27 bp, Artificial Sequence
  Description of Artificial Sequence: Synthetic oligonucleotide
aaactgcgcggccactacaaccagagc

SEQ ID NO: 42845 - DNA, 26 bp, Artificial Sequence
  Description of Artificial Sequence: Synthetic oligonucleotide
aactgcgcggccactacaaccagagc

SEQ ID NO: 42846 - DNA, 25 bp, Artificial Sequence
  Description of Artificial Sequence: Synthetic oligonucleotide
actgcgcggccactacaaccagagc

SEQ ID NO: 42847 - DNA, 22 bp, Artificial Sequence
  Description of Artificial Sequence: Synthetic oligonucleotide
gaggccgggtctcacaccctcc

SEQ ID NO: 42848 - DNA, 22 bp, Artificial Sequence
  Description of Artificial Sequence: Synthetic oligonucleotide
aggccgggtctcacaccctccg

SEQ ID NO: 42849 - DNA, 21 bp, Artificial Sequence
  Description of Artificial Sequence: Synthetic oligonucleotide
ggccgggtctcacaccctccg

SEQ ID NO: 42850 - DNA, 22 bp, Artificial Sequence
  Description of Artificial Sequence: Synthetic oligonucleotide
gccgggtctcacaccctccgga

SEQ ID NO: 42851 - DNA, 22 bp, Artificial Sequence
  Description of Artificial Sequence: Synthetic oligonucleotide
ccgggtctcacaccctccggag

SEQ ID NO: 42852 - DNA, 24 bp, Artificial Sequence
  Description of Artificial Sequence: Synthetic oligonucleotide
cgggtctcacaccctccggaggat

SEQ ID NO: 42853 - DNA, 26 bp, Artificial Sequence
  Description of Artificial Sequence: Synthetic oligonucleotide
gggtctcacaccctccggaggatgta

SEQ ID NO: 42854 - DNA, 26 bp, Artificial Sequence
  Description of Artificial Sequence: Synthetic oligonucleotide
ggtctcacaccctccggaggatgtac

SEQ ID NO: 42855 - DNA, 26 bp, Artificial Sequence
  Description of Artificial Sequence: Synthetic oligonucleotide
gtctcacaccctccggaggatgtacg

SEQ ID NO: 42856 - DNA, 26 bp, Artificial Sequence
  Description of Artificial Sequence: Synthetic oligonucleotide
tctcacaccctccggaggatgtacgg

SEQ ID NO: 42857 - DNA, 25 bp, Artificial Sequence
  Description of Artificial Sequence: Synthetic oligonucleotide
ctcacaccctccggaggatgtacgg

SEQ ID NO: 42858 - DNA, 26 bp, Artificial Sequence
  Description of Artificial Sequence: Synthetic oligonucleotide
tcacaccctccggaggatgtacggct

SEQ ID NO: 42859 - DNA, 25 bp, Artificial Sequence
  Description of Artificial Sequence: Synthetic oligonucleotide
cacaccctccggaggatgtacggct

SEQ ID NO: 42860 - DNA, 25 bp, Artificial Sequence
  Description of Artificial Sequence: Synthetic oligonucleotide
acaccctccggaggatgtacggctg

SEQ ID NO: 42861 - DNA, 24 bp, Artificial Sequence
  Description of Artificial Sequence: Synthetic oligonucleotide
caccctccggaggatgtacggctg

SEQ ID NO: 42862 - DNA, 24 bp, Artificial Sequence
  Description of Artificial Sequence: Synthetic oligonucleotide
accctccggaggatgtacggctgc

SEQ ID NO: 42863 - DNA, 23 bp, Artificial Sequence
  Description of Artificial Sequence: Synthetic oligonucleotide
ccctccggaggatgtacggctgc

SEQ ID NO: 42864 - DNA, 24 bp, Artificial Sequence
  Description of Artificial Sequence: Synthetic oligonucleotide
cctccggaggatgtacggctgcga

SEQ ID NO: 42865 - DNA, 24 bp, Artificial Sequence
  Description of Artificial Sequence: Synthetic oligonucleotide
ctccggaggatgtacggctgcgac

SEQ ID NO: 42866 - DNA, 25 bp, Artificial Sequence
  Description of Artificial Sequence: Synthetic oligonucleotide
tccggaggatgtacggctgcgacct

SEQ ID NO: 42867 - DNA, 24 bp, Artificial Sequence
  Description of Artificial Sequence: Synthetic oligonucleotide
ccggaggatgtacggctgcgacct

SEQ ID NO: 42868 - DNA, 24 bp, Artificial Sequence
  Description of Artificial Sequence: Synthetic oligonucleotide
cggaggatgtacggctgcgacctg

SEQ ID NO: 42869 - DNA, 24 bp, Artificial Sequence
  Description of Artificial Sequence: Synthetic oligonucleotide
ggaggatgtacggctgcgacctgg

SEQ ID NO: 42870 - DNA, 27 bp, Artificial Sequence
  Description of Artificial Sequence: Synthetic oligonucleotide
cctccagaggatgtaaggctgcgacct

SEQ ID NO: 42871 - DNA, 27 bp, Artificial Sequence
  Description of Artificial Sequence: Synthetic oligonucleotide
ctccagaggatgtaaggctgcgacctg

SEQ ID NO: 42872 - DNA, 27 bp, Artificial Sequence
  Description of Artificial Sequence: Synthetic oligonucleotide
tccagaggatgtaaggctgcgacctgg

SEQ ID NO: 42873 - DNA, 26 bp, Artificial Sequence
  Description of Artificial Sequence: Synthetic oligonucleotide
ccagaggatgtaaggctgcgacctgg

SEQ ID NO: 42874 - DNA, 26 bp, Artificial Sequence
  Description of Artificial Sequence: Synthetic oligonucleotide
cagaggatgtaaggctgcgacctggg

SEQ ID NO: 42875 - DNA, 26 bp, Artificial Sequence
  Description of Artificial Sequence: Synthetic oligonucleotide
agaggatgtaaggctgcgacctgggg

SEQ ID NO: 42876 - DNA, 25 bp, Artificial Sequence
  Description of Artificial Sequence: Synthetic oligonucleotide
gaggatgtaaggctgcgacctgggg

SEQ ID NO: 42877 - DNA, 25 bp, Artificial Sequence
  Description of Artificial Sequence: Synthetic oligonucleotide
aggatgtaaggctgcgacctggggc

SEQ ID NO: 42878 - DNA, 24 bp, Artificial Sequence
  Description of Artificial Sequence: Synthetic oligonucleotide
ggatgtaaggctgcgacctggggc

SEQ ID NO: 42879 - DNA, 24 bp, Artificial Sequence
  Description of Artificial Sequence: Synthetic oligonucleotide
gatgtaaggctgcgacctggggcc

SEQ ID NO: 42880 - DNA, 24 bp, Artificial Sequence
  Description of Artificial Sequence: Synthetic oligonucleotide
atgtaaggctgcgacctggggccc

SEQ ID NO: 42881 - DNA, 23 bp, Artificial Sequence
  Description of Artificial Sequence: Synthetic oligonucleotide
tgtaaggctgcgacctggggccc

SEQ ID NO: 42882 - DNA, 22 bp, Artificial Sequence
  Description of Artificial Sequence: Synthetic oligonucleotide
gtaaggctgcgacctggggccc

SEQ ID NO: 42883 - DNA, 23 bp, Artificial Sequence
  Description of Artificial Sequence: Synthetic oligonucleotide
taaggctgcgacctggggcccga

SEQ ID NO: 42884 - DNA, 22 bp, Artificial Sequence
  Description of Artificial Sequence: Synthetic oligonucleotide
aaggctgcgacctggggcccga

SEQ ID NO: 42885 - DNA, 21 bp, Artificial Sequence
  Description of Artificial Sequence: Synthetic oligonucleotide
aggctgcgacctggggcccga

SEQ ID NO: 42886 - DNA, 24 bp, Artificial Sequence
  Description of Artificial Sequence: Synthetic oligonucleotide
gacagcgacgccgcgagtccaaca

SEQ ID NO: 42887 - DNA, 24 bp, Artificial Sequence
  Description of Artificial Sequence: Synthetic oligonucleotide
acagcgacgccgcgagtccaacag

SEQ ID NO: 42888 - DNA, 23 bp, Artificial Sequence
  Description of Artificial Sequence: Synthetic oligonucleotide
cagcgacgccgcgagtccaacag

SEQ ID NO: 42889 - DNA, 23 bp, Artificial Sequence
  Description of Artificial Sequence: Synthetic oligonucleotide
agcgacgccgcgagtccaacagg

SEQ ID NO: 42890 - DNA, 22 bp, Artificial Sequence
  Description of Artificial Sequence: Synthetic oligonucleotide
gcgacgccgcgagtccaacagg

SEQ ID NO: 42891 - DNA, 22 bp, Artificial Sequence
  Description of Artificial Sequence: Synthetic oligonucleotide
cgacgccgcgagtccaacaggg

SEQ ID NO: 42892 - DNA, 23 bp, Artificial Sequence
  Description of Artificial Sequence: Synthetic oligonucleotide
gacgccgcgagtccaacagggga

SEQ ID NO: 42893 - DNA, 23 bp, Artificial Sequence
  Description of Artificial Sequence: Synthetic oligonucleotide
acgccgcgagtccaacaggggag

SEQ ID NO: 42894 - DNA, 22 bp, Artificial Sequence
  Description of Artificial Sequence: Synthetic oligonucleotide
cgccgcgagtccaacaggggag

SEQ ID NO: 42895 - DNA, 22 bp, Artificial Sequence
  Description of Artificial Sequence: Synthetic oligonucleotide
gccgcgagtccaacaggggagc

SEQ ID NO: 42896 - DNA, 22 bp, Artificial Sequence
  Description of Artificial Sequence: Synthetic oligonucleotide
ccgcgagtccaacaggggagcc

SEQ ID NO: 42897 - DNA, 22 bp, Artificial Sequence
  Description of Artificial Sequence: Synthetic oligonucleotide
cgcgagtccaacaggggagccg

SEQ ID NO: 42898 - DNA, 22 bp, Artificial Sequence
  Description of Artificial Sequence: Synthetic oligonucleotide
gcgagtccaacaggggagccgc

SEQ ID NO: 42899 - DNA, 22 bp, Artificial Sequence
  Description of Artificial Sequence: Synthetic oligonucleotide
cgagtccaacaggggagccgcg

SEQ ID NO: 42900 - DNA, 22 bp, Artificial Sequence
  Description of Artificial Sequence: Synthetic oligonucleotide
gagtccaacaggggagccgcgg

SEQ ID NO: 42901 - DNA, 22 bp, Artificial Sequence
  Description of Artificial Sequence: Synthetic oligonucleotide
agtccaacaggggagccgcggg

SEQ ID NO: 42902 - DNA, 21 bp, Artificial Sequence
  Description of Artificial Sequence: Synthetic oligonucleotide
gtccaacaggggagccgcggg

SEQ ID NO: 42903 - DNA, 21 bp, Artificial Sequence
  Description of Artificial Sequence: Synthetic oligonucleotide
tccaacaggggagccgcgggc

SEQ ID NO: 42904 - DNA, 20 bp, Artificial Sequence
  Description of Artificial Sequence: Synthetic oligonucleotide
ccaacaggggagccgcgggc

SEQ ID NO: 42905 - DNA, 20 bp, Artificial Sequence
  Description of Artificial Sequence: Synthetic oligonucleotide
caacaggggagccgcgggcg

SEQ ID NO: 42906 - DNA, 20 bp, Artificial Sequence
  Description of Artificial Sequence: Synthetic oligonucleotide
aacaggggagccgcgggcgc

SEQ ID NO: 42907 - DNA, 20 bp, Artificial Sequence
  Description of Artificial Sequence: Synthetic oligonucleotide
acaggggagccgcgggcgct

SEQ ID NO: 42908 - DNA, 20 bp, Artificial Sequence
  Description of Artificial Sequence: Synthetic oligonucleotide
caggggagccgcgggcgctt

SEQ ID NO: 42909 - DNA, 22 bp, Artificial Sequence
  Description of Artificial Sequence: Synthetic oligonucleotide
cgagtgcgtggagtggctccgc

SEQ ID NO: 42910 - DNA, 22 bp, Artificial Sequence
  Description of Artificial Sequence: Synthetic oligonucleotide
gagtgcgtggagtggctccgcg

SEQ ID NO: 42911 - DNA, 25 bp, Artificial Sequence
  Description of Artificial Sequence: Synthetic oligonucleotide
agtgcgtggagtggctccgcggata

SEQ ID NO: 42912 - DNA, 24 bp, Artificial Sequence
  Description of Artificial Sequence: Synthetic oligonucleotide
gtgcgtggagtggctccgcggata

SEQ ID NO: 42913 - DNA, 24 bp, Artificial Sequence
  Description of Artificial Sequence: Synthetic oligonucleotide
tgcgtggagtggctccgcggatac

SEQ ID NO: 42914 - DNA, 23 bp, Artificial Sequence
  Description of Artificial Sequence: Synthetic oligonucleotide
gcgtggagtggctccgcggatac

SEQ ID NO: 42915 - DNA, 24 bp, Artificial Sequence
  Description of Artificial Sequence: Synthetic oligonucleotide
cgtggagtggctccgcggatacct

SEQ ID NO: 42916 - DNA, 24 bp, Artificial Sequence
  Description of Artificial Sequence: Synthetic oligonucleotide
gtggagtggctccgcggatacctg

SEQ ID NO: 42917 - DNA, 25 bp, Artificial Sequence
  Description of Artificial Sequence: Synthetic oligonucleotide
tggagtggctccgcggatacctgga

SEQ ID NO: 42918 - DNA, 24 bp, Artificial Sequence
  Description of Artificial Sequence: Synthetic oligonucleotide
ggagtggctccgcggatacctgga

SEQ ID NO: 42919 - DNA, 26 bp, Artificial Sequence
  Description of Artificial Sequence: Synthetic oligonucleotide
gagtggctccgcggatacctggagaa

SEQ ID NO: 42920 - DNA, 26 bp, Artificial Sequence
  Description of Artificial Sequence: Synthetic oligonucleotide
agtggctccgcggatacctggagaac

SEQ ID NO: 42921 - DNA, 25 bp, Artificial Sequence
  Description of Artificial Sequence: Synthetic oligonucleotide
gtggctccgcggatacctggagaac

SEQ ID NO: 42922 - DNA, 25 bp, Artificial Sequence
  Description of Artificial Sequence: Synthetic oligonucleotide
tggctccgcggatacctggagaacg

SEQ ID NO: 42923 - DNA, 24 bp, Artificial Sequence
  Description of Artificial Sequence: Synthetic oligonucleotide
ggctccgcggatacctggagaacg

SEQ ID NO: 42924 - DNA, 24 bp, Artificial Sequence
  Description of Artificial Sequence: Synthetic oligonucleotide
gctccgcggatacctggagaacgg

SEQ ID NO: 42925 - DNA, 26 bp, Artificial Sequence
  Description of Artificial Sequence: Synthetic oligonucleotide
ctccgcggatacctggagaacgggaa

SEQ ID NO: 42926 - DNA, 26 bp, Artificial Sequence
  Description of Artificial Sequence: Synthetic oligonucleotide
tccgcggatacctggagaacgggaag

SEQ ID NO: 42927 - DNA, 25 bp, Artificial Sequence
  Description of Artificial Sequence: Synthetic oligonucleotide
ccgcggatacctggagaacgggaag

SEQ ID NO: 42928 - DNA, 26 bp, Artificial Sequence
  Description of Artificial Sequence: Synthetic oligonucleotide
cgcggatacctggagaacgggaagga

SEQ ID NO: 42929 - DNA, 27 bp, Artificial Sequence
  Description of Artificial Sequence: Synthetic oligonucleotide
gcggatacctggagaacgggaaggaga

SEQ ID NO: 42930 - DNA, 27 bp, Artificial Sequence
  Description of Artificial Sequence: Synthetic oligonucleotide
cggatacctggagaacgggaaggagac

SEQ ID NO: 42931 - DNA, 27 bp, Artificial Sequence
  Description of Artificial Sequence: Synthetic oligonucleotide
ggatacctggagaacgggaaggagacg

SEQ ID NO: 42932 - DNA, 28 bp, Artificial Sequence
  Description of Artificial Sequence: Synthetic oligonucleotide
atcctccagaggatgtatggctgcgacg

SEQ ID NO: 42933 - DNA, 27 bp, Artificial Sequence
  Description of Artificial Sequence: Synthetic oligonucleotide
tcctccagaggatgtatggctgcgacg

SEQ ID NO: 42934 - DNA, 30 bp, Artificial Sequence
  Description of Artificial Sequence: Synthetic oligonucleotide
gcaaggattacatcgccctgaacgaggatc

SEQ ID NO: 42935 - DNA, 31 bp, Artificial Sequence
  Description of Artificial Sequence: Synthetic oligonucleotide
caaggattacatcgccctgaacgaggatctg

SEQ ID NO: 42936 - DNA, 31 bp, Artificial Sequence
  Description of Artificial Sequence: Synthetic oligonucleotide
aaggattacatcgccctgaacgaggatctgc

SEQ ID NO: 42937 - DNA, 30 bp, Artificial Sequence
  Description of Artificial Sequence: Synthetic oligonucleotide
aggattacatcgccctgaacgaggatctgc

SEQ ID NO: 42938 - DNA, 29 bp, Artificial Sequence
  Description of Artificial Sequence: Synthetic oligonucleotide
ggattacatcgccctgaacgaggatctgc

SEQ ID NO: 42939 - DNA, 29 bp, Artificial Sequence
  Description of Artificial Sequence: Synthetic oligonucleotide
gattacatcgccctgaacgaggatctgcg

SEQ ID NO: 42940 - DNA, 29 bp, Artificial Sequence
  Description of Artificial Sequence: Synthetic oligonucleotide
attacatcgccctgaacgaggatctgcgc

SEQ ID NO: 42941 - DNA, 28 bp, Artificial Sequence
  Description of Artificial Sequence: Synthetic oligonucleotide
ttacatcgccctgaacgaggatctgcgc

SEQ ID NO: 42942 - DNA, 27 bp, Artificial Sequence
  Description of Artificial Sequence: Synthetic oligonucleotide
tacatcgccctgaacgaggatctgcgc

SEQ ID NO: 42943 - DNA, 27 bp, Artificial Sequence
  Description of Artificial Sequence: Synthetic oligonucleotide
acatcgccctgaacgaggatctgcgct

SEQ ID NO: 42944 - DNA, 26 bp, Artificial Sequence
  Description of Artificial Sequence: Synthetic oligonucleotide
catcgccctgaacgaggatctgcgct

SEQ ID NO: 42945 - DNA, 26 bp, Artificial Sequence
  Description of Artificial Sequence: Synthetic oligonucleotide
atcgccctgaacgaggatctgcgctc

SEQ ID NO: 42946 - DNA, 25 bp, Artificial Sequence
  Description of Artificial Sequence: Synthetic oligonucleotide
tcgccctgaacgaggatctgcgctc

SEQ ID NO: 42947 - DNA, 24 bp, Artificial Sequence
  Description of Artificial Sequence: Synthetic oligonucleotide
cgccctgaacgaggatctgcgctc

SEQ ID NO: 42948 - DNA, 25 bp, Artificial Sequence
  Description of Artificial Sequence: Synthetic oligonucleotide
gccctgaacgaggatctgcgctcct

SEQ ID NO: 42949 - DNA, 25 bp, Artificial Sequence
  Description of Artificial Sequence: Synthetic oligonucleotide
ccctgaacgaggatctgcgctcctg

SEQ ID NO: 42950 - DNA, 26 bp, Artificial Sequence
  Description of Artificial Sequence: Synthetic oligonucleotide
cctgaacgaggatctgcgctcctgga

SEQ ID NO: 42951 - DNA, 26 bp, Artificial Sequence
  Description of Artificial Sequence: Synthetic oligonucleotide
ctgaacgaggatctgcgctcctggac

SEQ ID NO: 42952 - DNA, 26 bp, Artificial Sequence
  Description of Artificial Sequence: Synthetic oligonucleotide
tgaacgaggatctgcgctcctggacc

SEQ ID NO: 42953 - DNA, 25 bp, Artificial Sequence
  Description of Artificial Sequence: Synthetic oligonucleotide
gaacgaggatctgcgctcctggacc

SEQ ID NO: 42954 - DNA, 25 bp, Artificial Sequence
  Description of Artificial Sequence: Synthetic oligonucleotide
aacgaggatctgcgctcctggaccg

SEQ ID NO: 42955 - DNA, 24 bp, Artificial Sequence
  Description of Artificial Sequence: Synthetic oligonucleotide
acgaggatctgcgctcctggaccg

SEQ ID NO: 42956 - DNA, 23 bp, Artificial Sequence
  Description of Artificial Sequence: Synthetic oligonucleotide
cgaggatctgcgctcctggaccg

SEQ ID NO: 42957 - DNA, 23 bp, Artificial Sequence
  Description of Artificial Sequence: Synthetic oligonucleotide
gaggatctgcgctcctggaccgc

SEQ ID NO: 42958 - DNA, 23 bp, Artificial Sequence
  Description of Artificial Sequence: Synthetic oligonucleotide
aggatctgcgctcctggaccgcc

SEQ ID NO: 42959 - DNA, 22 bp, Artificial Sequence
  Description of Artificial Sequence: Synthetic oligonucleotide
ggatctgcgctcctggaccgcc

SEQ ID NO: 42960 - DNA, 22 bp, Artificial Sequence
  Description of Artificial Sequence: Synthetic oligonucleotide
gatctgcgctcctggaccgccg

SEQ ID NO: 42961 - DNA, 22 bp, Artificial Sequence
  Description of Artificial Sequence: Synthetic oligonucleotide
atctgcgctcctggaccgccgc

SEQ ID NO: 42962 - DNA, 21 bp, Artificial Sequence
  Description of Artificial Sequence: Synthetic oligonucleotide
tctgcgctcctggaccgccgc

SEQ ID NO: 42963 - DNA, 28 bp, Artificial Sequence
  Description of Artificial Sequence: Synthetic oligonucleotide
gatggggaggaccaaactcaggacactg

SEQ ID NO: 42964 - DNA, 29 bp, Artificial Sequence
  Description of Artificial Sequence: Synthetic oligonucleotide
atggggaggaccaaactcaggacactgag

SEQ ID NO: 42965 - DNA, 28 bp, Artificial Sequence
  Description of Artificial Sequence: Synthetic oligonucleotide
tggggaggaccaaactcaggacactgag

SEQ ID NO: 42966 - DNA, 27 bp, Artificial Sequence
  Description of Artificial Sequence: Synthetic oligonucleotide
ggggaggaccaaactcaggacactgag

SEQ ID NO: 42967 - DNA, 27 bp, Artificial Sequence
  Description of Artificial Sequence: Synthetic oligonucleotide
gggaggaccaaactcaggacactgagc

SEQ ID NO: 42968 - DNA, 29 bp, Artificial Sequence
  Description of Artificial Sequence: Synthetic oligonucleotide
ggaggaccaaactcaggacactgagcttg

SEQ ID NO: 42969 - DNA, 28 bp, Artificial Sequence
  Description of Artificial Sequence: Synthetic oligonucleotide
tcaggacactgagcttgtggagaccagg

SEQ ID NO: 42970 - DNA, 27 bp, Artificial Sequence
  Description of Artificial Sequence: Synthetic oligonucleotide
caggacactgagcttgtggagaccagg

SEQ ID NO: 42971 - DNA, 27 bp, Artificial Sequence
  Description of Artificial Sequence: Synthetic oligonucleotide
aggacactgagcttgtggagaccaggc

SEQ ID NO: 42972 - DNA, 26 bp, Artificial Sequence
  Description of Artificial Sequence: Synthetic oligonucleotide
ggacactgagcttgtggagaccaggc

SEQ ID NO: 42973 - DNA, 27 bp, Artificial Sequence
  Description of Artificial Sequence: Synthetic oligonucleotide
gacactgagcttgtggagaccaggcca

SEQ ID NO: 42974 - DNA, 27 bp, Artificial Sequence
  Description of Artificial Sequence: Synthetic oligonucleotide
acactgagcttgtggagaccaggccag

SEQ ID NO: 42975 - DNA, 26 bp, Artificial Sequence
  Description of Artificial Sequence: Synthetic oligonucleotide
cactgagcttgtggagaccaggccag

SEQ ID NO: 42976 - DNA, 27 bp, Artificial Sequence
  Description of Artificial Sequence: Synthetic oligonucleotide
actgagcttgtggagaccaggccagca

SEQ ID NO: 42977 - DNA, 26 bp, Artificial Sequence
  Description of Artificial Sequence: Synthetic oligonucleotide
ctgagcttgtggagaccaggccagca

SEQ ID NO: 42978 - DNA, 26 bp, Artificial Sequence
  Description of Artificial Sequence: Synthetic oligonucleotide
tgagcttgtggagaccaggccagcag

SEQ ID NO: 42979 - DNA, 21 bp, Artificial Sequence
  Description of Artificial Sequence: Synthetic oligonucleotide
gggctgccggagcccctcact

SEQ ID NO: 42980 - DNA, 22 bp, Artificial Sequence
  Description of Artificial Sequence: Synthetic oligonucleotide
ggctgccggagcccctcactct

SEQ ID NO: 42981 - DNA, 23 bp, Artificial Sequence
  Description of Artificial Sequence: Synthetic oligonucleotide
gctgccggagcccctcactctga

SEQ ID NO: 42982 - DNA, 25 bp, Artificial Sequence
  Description of Artificial Sequence: Synthetic oligonucleotide
ctgccggagcccctcactctgagat

SEQ ID NO: 42983 - DNA, 25 bp, Artificial Sequence
  Description of Artificial Sequence: Synthetic oligonucleotide
tgccggagcccctcactctgagatg

SEQ ID NO: 42984 - DNA, 24 bp, Artificial Sequence
  Description of Artificial Sequence: Synthetic oligonucleotide
gccggagcccctcactctgagatg

SEQ ID NO: 42985 - DNA, 24 bp, Artificial Sequence
  Description of Artificial Sequence: Synthetic oligonucleotide
ccggagcccctcactctgagatgg

SEQ ID NO: 42986 - DNA, 25 bp, Artificial Sequence
  Description of Artificial Sequence: Synthetic oligonucleotide
cggagcccctcactctgagatggga

SEQ ID NO: 42987 - DNA, 25 bp, Artificial Sequence
  Description of Artificial Sequence: Synthetic oligonucleotide
ggagcccctcactctgagatgggag

SEQ ID NO: 42988 - DNA, 25 bp, Artificial Sequence
  Description of Artificial Sequence: Synthetic oligonucleotide
gagcccctcactctgagatgggagc

SEQ ID NO: 42989 - DNA, 25 bp, Artificial Sequence
  Description of Artificial Sequence: Synthetic oligonucleotide
agcccctcactctgagatgggagcc

SEQ ID NO: 42990 - DNA, 24 bp, Artificial Sequence
  Description of Artificial Sequence: Synthetic oligonucleotide
gcccctcactctgagatgggagcc

SEQ ID NO: 42991 - DNA, 25 bp, Artificial Sequence
  Description of Artificial Sequence: Synthetic oligonucleotide
cccctcactctgagatgggagccgt

SEQ ID NO: 42992 - DNA, 27 bp, Artificial Sequence
  Description of Artificial Sequence: Synthetic oligonucleotide
ccctcactctgagatgggagccgtctt

SEQ ID NO: 42993 - DNA, 27 bp, Artificial Sequence
  Description of Artificial Sequence: Synthetic oligonucleotide
cctcactctgagatgggagccgtcttc

SEQ ID NO: 42994 - DNA, 27 bp, Artificial Sequence
  Description of Artificial Sequence: Synthetic oligonucleotide
ctcactctgagatgggagccgtcttcc

SEQ ID NO: 42995 - DNA, 27 bp, Artificial Sequence
  Description of Artificial Sequence: Synthetic oligonucleotide
tcactctgagatgggagccgtcttccc

SEQ ID NO: 42996 - DNA, 27 bp, Artificial Sequence
  Description of Artificial Sequence: Synthetic oligonucleotide
cactctgagatgggagccgtcttccca

SEQ ID NO: 42997 - DNA, 27 bp, Artificial Sequence
  Description of Artificial Sequence: Synthetic oligonucleotide
actctgagatgggagccgtcttcccag

SEQ ID NO: 42998 - DNA, 26 bp, Artificial Sequence
  Description of Artificial Sequence: Synthetic oligonucleotide
ctctgagatgggagccgtcttcccag

SEQ ID NO: 42999 - DNA, 26 bp, Artificial Sequence
  Description of Artificial Sequence: Synthetic oligonucleotide
tctgagatgggagccgtcttcccagc

SEQ ID NO: 43000 - DNA, 27 bp, Artificial Sequence
  Description of Artificial Sequence: Synthetic oligonucleotide
gagccccacttcatcgcagtgggctat

SEQ ID NO: 43001 - DNA, 27 bp, Artificial Sequence
  Description of Artificial Sequence: Synthetic oligonucleotide
agccccacttcatcgcagtgggctatg

SEQ ID NO: 43002 - DNA, 27 bp, Artificial Sequence
  Description of Artificial Sequence: Synthetic oligonucleotide
gccccacttcatcgcagtgggctatgt

SEQ ID NO: 43003 - DNA, 27 bp, Artificial Sequence
  Description of Artificial Sequence: Synthetic oligonucleotide
ccccacttcatcgcagtgggctatgtg

SEQ ID NO: 43004 - DNA, 27 bp, Artificial Sequence
  Description of Artificial Sequence: Synthetic oligonucleotide
cccacttcatcgcagtgggctatgtgg

SEQ ID NO: 43005 - DNA, 28 bp, Artificial Sequence
  Description of Artificial Sequence: Synthetic oligonucleotide
ccacttcatcgcagtgggctatgtggac

SEQ ID NO: 43006 - DNA, 28 bp, Artificial Sequence
  Description of Artificial Sequence: Synthetic oligonucleotide
cacttcatcgcagtgggctatgtggacg

SEQ ID NO: 43007 - DNA, 29 bp, Artificial Sequence
  Description of Artificial Sequence: Synthetic oligonucleotide
acttcatcgcagtgggctatgtggacgac

SEQ ID NO: 43008 - DNA, 28 bp, Artificial Sequence
  Description of Artificial Sequence: Synthetic oligonucleotide
cttcatcgcagtgggctatgtggacgac

SEQ ID NO: 43009 - DNA, 29 bp, Artificial Sequence
  Description of Artificial Sequence: Synthetic oligonucleotide
ttcatcgcagtgggctatgtggacgacac

SEQ ID NO: 43010 - DNA, 28 bp, Artificial Sequence
  Description of Artificial Sequence: Synthetic oligonucleotide
tcatcgcagtgggctatgtggacgacac

SEQ ID NO: 43011 - DNA, 27 bp, Artificial Sequence
  Description of Artificial Sequence: Synthetic oligonucleotide
catcgcagtgggctatgtggacgacac

SEQ ID NO: 43012 - DNA, 27 bp, Artificial Sequence
  Description of Artificial Sequence: Synthetic oligonucleotide
atcgcagtgggctatgtggacgacacg

SEQ ID NO: 43013 - DNA, 26 bp, Artificial Sequence
  Description of Artificial Sequence: Synthetic oligonucleotide
tcgcagtgggctatgtggacgacacg

SEQ ID NO: 43014 - DNA, 25 bp, Artificial Sequence
  Description of Artificial Sequence: Synthetic oligonucleotide
cgcagtgggctatgtggacgacacg

SEQ ID NO: 43015 - DNA, 26 bp, Artificial Sequence
  Description of Artificial Sequence: Synthetic oligonucleotide
gcagtgggctatgtggacgacacgca

SEQ ID NO: 43016 - DNA, 27 bp, Artificial Sequence
  Description of Artificial Sequence: Synthetic oligonucleotide
cagtgggctatgtggacgacacgcagt

SEQ ID NO: 43017 - DNA, 28 bp, Artificial Sequence
  Description of Artificial Sequence: Synthetic oligonucleotide
agtgggctatgtggacgacacgcagttc

SEQ ID NO: 43018 - DNA, 27 bp, Artificial Sequence
  Description of Artificial Sequence: Synthetic oligonucleotide
gtgggctatgtggacgacacgcagttc

SEQ ID NO: 43019 - DNA, 27 bp, Artificial Sequence
  Description of Artificial Sequence: Synthetic oligonucleotide
tgggctatgtggacgacacgcagttcg

SEQ ID NO: 43020 - DNA, 27 bp, Artificial Sequence
  Description of Artificial Sequence: Synthetic oligonucleotide
gggctatgtggacgacacgcagttcgt

SEQ ID NO: 43021 - DNA, 27 bp, Artificial Sequence
  Description of Artificial Sequence: Synthetic oligonucleotide
ggctatgtggacgacacgcagttcgtg

SEQ ID NO: 43022 - DNA, 27 bp, Artificial Sequence
  Description of Artificial Sequence: Synthetic oligonucleotide
gctatgtggacgacacgcagttcgtgc

SEQ ID NO: 43023 - DNA, 27 bp, Artificial Sequence
  Description of Artificial Sequence: Synthetic oligonucleotide
ctatgtggacgacacgcagttcgtgcg

SEQ ID NO: 43024 - DNA, 27 bp, Artificial Sequence
  Description of Artificial Sequence: Synthetic oligonucleotide
tatgtggacgacacgcagttcgtgcgg

SEQ ID NO: 43025 - DNA, 27 bp, Artificial Sequence
  Description of Artificial Sequence: Synthetic oligonucleotide
atgtggacgacacgcagttcgtgcggt

SEQ ID NO: 43026 - DNA, 27 bp, Artificial Sequence
  Description of Artificial Sequence: Synthetic oligonucleotide
tgtggacgacacgcagttcgtgcggtt

SEQ ID NO: 43027 - DNA, 27 bp, Artificial Sequence
  Description of Artificial Sequence: Synthetic oligonucleotide
atcgcagtgggctacgtggacgatacg

SEQ ID NO: 43028 - DNA, 26 bp, Artificial Sequence
  Description of Artificial Sequence: Synthetic oligonucleotide
tcgcagtgggctacgtggacgatacg

SEQ ID NO: 43029 - DNA, 25 bp, Artificial Sequence
  Description of Artificial Sequence: Synthetic oligonucleotide
cgcagtgggctacgtggacgatacg

SEQ ID NO: 43030 - DNA, 26 bp, Artificial Sequence
  Description of Artificial Sequence: Synthetic oligonucleotide
gcagtgggctacgtggacgatacgca

SEQ ID NO: 43031 - DNA, 27 bp, Artificial Sequence
  Description of Artificial Sequence: Synthetic oligonucleotide
cagtgggctacgtggacgatacgcagt

SEQ ID NO: 43032 - DNA, 28 bp, Artificial Sequence
  Description of Artificial Sequence: Synthetic oligonucleotide
agtgggctacgtggacgatacgcagttc

SEQ ID NO: 43033 - DNA, 27 bp, Artificial Sequence
  Description of Artificial Sequence: Synthetic oligonucleotide
gtgggctacgtggacgatacgcagttc

SEQ ID NO: 43034 - DNA, 27 bp, Artificial Sequence
  Description of Artificial Sequence: Synthetic oligonucleotide
tgggctacgtggacgatacgcagttcg

SEQ ID NO: 43035 - DNA, 27 bp, Artificial Sequence
  Description of Artificial Sequence: Synthetic oligonucleotide
gggctacgtggacgatacgcagttcgt

SEQ ID NO: 43036 - DNA, 27 bp, Artificial Sequence
  Description of Artificial Sequence: Synthetic oligonucleotide
ggctacgtggacgatacgcagttcgtg

SEQ ID NO: 43037 - DNA, 27 bp, Artificial Sequence
  Description of Artificial Sequence: Synthetic oligonucleotide
gctacgtggacgatacgcagttcgtgc

SEQ ID NO: 43038 - DNA, 27 bp, Artificial Sequence
  Description of Artificial Sequence: Synthetic oligonucleotide
ctacgtggacgatacgcagttcgtgcg

SEQ ID NO: 43039 - DNA, 27 bp, Artificial Sequence
  Description of Artificial Sequence: Synthetic oligonucleotide
tacgtggacgatacgcagttcgtgcgg

SEQ ID NO: 43040 - DNA, 27 bp, Artificial Sequence
  Description of Artificial Sequence: Synthetic oligonucleotide
acgtggacgatacgcagttcgtgcggt

SEQ ID NO: 43041 - DNA, 27 bp, Artificial Sequence
  Description of Artificial Sequence: Synthetic oligonucleotide
cgtggacgatacgcagttcgtgcggtt

SEQ ID NO: 43042 - DNA, 27 bp, Artificial Sequence
  Description of Artificial Sequence: Synthetic oligonucleotide
gtggacgatacgcagttcgtgcggttc

SEQ ID NO: 43043 - DNA, 27 bp, Artificial Sequence
  Description of Artificial Sequence: Synthetic oligonucleotide
tggacgatacgcagttcgtgcggttcg

SEQ ID NO: 43044 - DNA, 27 bp, Artificial Sequence
  Description of Artificial Sequence: Synthetic oligonucleotide
ggacgatacgcagttcgtgcggttcga

SEQ ID NO: 43045 - DNA, 27 bp, Artificial Sequence
  Description of Artificial Sequence: Synthetic oligonucleotide
gacgatacgcagttcgtgcggttcgac

SEQ ID NO: 43046 - DNA, 28 bp, Artificial Sequence
  Description of Artificial Sequence: Synthetic oligonucleotide
acgatacgcagttcgtgcggttcgacag

SEQ ID NO: 43047 - DNA, 27 bp, Artificial Sequence
  Description of Artificial Sequence: Synthetic oligonucleotide
cgatacgcagttcgtgcggttcgacag

SEQ ID NO: 43048 - DNA, 27 bp, Artificial Sequence
  Description of Artificial Sequence: Synthetic oligonucleotide
gatacgcagttcgtgcggttcgacagc

SEQ ID NO: 43049 - DNA, 27 bp, Artificial Sequence
  Description of Artificial Sequence: Synthetic oligonucleotide
atacgcagttcgtgcggttcgacagcg

SEQ ID NO: 43050 - DNA, 27 bp, Artificial Sequence
  Description of Artificial Sequence: Synthetic oligonucleotide
tacgcagttcgtgcggttcgacagcga

SEQ ID NO: 43051 - DNA, 20 bp, Artificial Sequence
  Description of Artificial Sequence: Synthetic oligonucleotide
gccgcggacacggcggcctt

SEQ ID NO: 43052 - DNA, 20 bp, Artificial Sequence
  Description of Artificial Sequence: Synthetic oligonucleotide
ccgcggacacggcggcccat

SEQ ID NO: 43053 - DNA, 21 bp, Artificial Sequence
  Description of Artificial Sequence: Synthetic oligonucleotide
cgcggacacggcggcccagat

SEQ ID NO: 43054 - DNA, 22 bp, Artificial Sequence
  Description of Artificial Sequence: Synthetic oligonucleotide
gcggacacggcggcccagatca

SEQ ID NO: 43055 - DNA, 22 bp, Artificial Sequence
  Description of Artificial Sequence: Synthetic oligonucleotide
cggacacggcggcccagatcac

SEQ ID NO: 43056 - DNA, 22 bp, Artificial Sequence
  Description of Artificial Sequence: Synthetic oligonucleotide
ggacacggcggcccagatcacc

SEQ ID NO: 43057 - DNA, 23 bp, Artificial Sequence
  Description of Artificial Sequence: Synthetic oligonucleotide
gacacggcggcccagatcaccca

SEQ ID NO: 43058 - DNA, 23 bp, Artificial Sequence
  Description of Artificial Sequence: Synthetic oligonucleotide
acacggcggcccagatcacccag

SEQ ID NO: 43059 - DNA, 22 bp, Artificial Sequence
  Description of Artificial Sequence: Synthetic oligonucleotide
cacggcggcccagatcacccag

SEQ ID NO: 43060 - DNA, 22 bp, Artificial Sequence
  Description of Artificial Sequence: Synthetic oligonucleotide
acggcggcccagatcacccagc

SEQ ID NO: 43061 - DNA, 21 bp, Artificial Sequence
  Description of Artificial Sequence: Synthetic oligonucleotide
cggcggcccagatcacccagc

SEQ ID NO: 43062 - DNA, 21 bp, Artificial Sequence
  Description of Artificial Sequence: Synthetic oligonucleotide
ggcggcccagatcacccagcg

SEQ ID NO: 43063 - DNA, 23 bp, Artificial Sequence
  Description of Artificial Sequence: Synthetic oligonucleotide
gcggcccagatcacccagcgcaa

SEQ ID NO: 43064 - DNA, 24 bp, Artificial Sequence
  Description of Artificial Sequence: Synthetic oligonucleotide
cggcccagatcacccagcgcaagt

SEQ ID NO: 43065 - DNA, 24 bp, Artificial Sequence
  Description of Artificial Sequence: Synthetic oligonucleotide
ggcccagatcacccagcgcaagtg

SEQ ID NO: 43066 - DNA, 24 bp, Artificial Sequence
  Description of Artificial Sequence: Synthetic oligonucleotide
gcccagatcacccagcgcaagtgg

SEQ ID NO: 43067 - DNA, 25 bp, Artificial Sequence
  Description of Artificial Sequence: Synthetic oligonucleotide
cccagatcacccagcgcaagtggga

SEQ ID NO: 43068 - DNA, 25 bp, Artificial Sequence
  Description of Artificial Sequence: Synthetic oligonucleotide
ccagatcacccagcgcaagtgggag

SEQ ID NO: 43069 - DNA, 27 bp, Artificial Sequence
  Description of Artificial Sequence: Synthetic oligonucleotide
agaggatgtatggctgcgacgtgggac

SEQ ID NO: 43070 - DNA, 26 bp, Artificial Sequence
  Description of Artificial Sequence: Synthetic oligonucleotide
gaggatgtatggctgcgacgtgggac

SEQ ID NO: 43071 - DNA, 26 bp, Artificial Sequence
  Description of Artificial Sequence: Synthetic oligonucleotide
aggatgtatggctgcgacgtgggacc

SEQ ID NO: 43072 - DNA, 25 bp, Artificial Sequence
  Description of Artificial Sequence: Synthetic oligonucleotide
ggatgtatggctgcgacgtgggacc

SEQ ID NO: 43073 - DNA, 25 bp, Artificial Sequence
  Description of Artificial Sequence: Synthetic oligonucleotide
gatgtatggctgcgacgtgggaccc

SEQ ID NO: 43074 - DNA, 26 bp, Artificial Sequence
  Description of Artificial Sequence: Synthetic oligonucleotide
atgtatggctgcgacgtgggacccga

SEQ ID NO: 43075 - DNA, 25 bp, Artificial Sequence
  Description of Artificial Sequence: Synthetic oligonucleotide
tgtatggctgcgacgtgggacccga

SEQ ID NO: 43076 - DNA, 24 bp, Artificial Sequence
  Description of Artificial Sequence: Synthetic oligonucleotide
gtatggctgcgacgtgggacccga

SEQ ID NO: 43077 - DNA, 24 bp, Artificial Sequence
  Description of Artificial Sequence: Synthetic oligonucleotide
tatggctgcgacgtgggacccgac

SEQ ID NO: 43078 - DNA, 23 bp, Artificial Sequence
  Description of Artificial Sequence: Synthetic oligonucleotide
atggctgcgacgtgggacccgac

SEQ ID NO: 43079 - DNA, 22 bp, Artificial Sequence
  Description of Artificial Sequence: Synthetic oligonucleotide
tggctgcgacgtgggacccgac

SEQ ID NO: 43080 - DNA, 21 bp, Artificial Sequence
  Description of Artificial Sequence: Synthetic oligonucleotide
ggctgcgacgtgggacccgac

SEQ ID NO: 43081 - DNA, 21 bp, Artificial Sequence
  Description of Artificial Sequence: Synthetic oligonucleotide
gctgcgacgtgggacccgacg

SEQ ID NO: 43082 - DNA, 21 bp, Artificial Sequence
  Description of Artificial Sequence: Synthetic oligonucleotide
ctgcgacgtgggacccgacgg

SEQ ID NO: 43083 - DNA, 21 bp, Artificial Sequence
  Description of Artificial Sequence: Synthetic oligonucleotide
tgcgacgtgggacccgacggg

SEQ ID NO: 43084 - DNA, 20 bp, Artificial Sequence
  Description of Artificial Sequence: Synthetic oligonucleotide
gcgacgtgggacccgacggg

SEQ ID NO: 43085 - DNA, 20 bp, Artificial Sequence
  Description of Artificial Sequence: Synthetic oligonucleotide
cgacgtgggacccgacgggc

SEQ ID NO: 43086 - DNA, 20 bp, Artificial Sequence
  Description of Artificial Sequence: Synthetic oligonucleotide
gacgtgggacccgacgggcg

SEQ ID NO: 43087 - DNA, 20 bp, Artificial Sequence
  Description of Artificial Sequence: Synthetic oligonucleotide
acgtgggacccgacgggcgc

SEQ ID NO: 43088 - DNA, 20 bp, Artificial Sequence
  Description of Artificial Sequence: Synthetic oligonucleotide
cgtgggacccgacgggcgct

SEQ ID NO: 43089 - DNA, 20 bp, Artificial Sequence
  Description of Artificial Sequence: Synthetic oligonucleotide
gtgggacccgacgggcgcct

SEQ ID NO: 43090 - DNA, 20 bp, Artificial Sequence
  Description of Artificial Sequence: Synthetic oligonucleotide
tgggacccgacgggcgcctc

SEQ ID NO: 43091 - DNA, 20 bp, Artificial Sequence
  Description of Artificial Sequence: Synthetic oligonucleotide
gggacccgacgggcgcctct

SEQ ID NO: 43092 - DNA, 20 bp, Artificial Sequence
  Description of Artificial Sequence: Synthetic oligonucleotide
ggacccgacgggcgcctcct

SEQ ID NO: 43093 - DNA, 20 bp, Artificial Sequence
  Description of Artificial Sequence: Synthetic oligonucleotide
gacccgacgggcgcctcctc

SEQ ID NO: 43094 - DNA, 20 bp, Artificial Sequence
  Description of Artificial Sequence: Synthetic oligonucleotide
acccgacgggcgcctcctcc

SEQ ID NO: 43095 - DNA, 30 bp, Artificial Sequence
  Description of Artificial Sequence: Synthetic oligonucleotide
gccaggtctcacatcatccagaggatgtac

SEQ ID NO: 43096 - DNA, 30 bp, Artificial Sequence
  Description of Artificial Sequence: Synthetic oligonucleotide
ccaggtctcacatcatccagaggatgtacg

SEQ ID NO: 43097 - DNA, 30 bp, Artificial Sequence
  Description of Artificial Sequence: Synthetic oligonucleotide
caggtctcacatcatccagaggatgtacgg

SEQ ID NO: 43098 - DNA, 30 bp, Artificial Sequence
  Description of Artificial Sequence: Synthetic oligonucleotide
aggtctcacatcatccagaggatgtacggc

SEQ ID NO: 43099 - DNA, 20 bp, Artificial Sequence
  Description of Artificial Sequence: Synthetic oligonucleotide
ggaggcggcccgtgaggcct

SEQ ID NO: 43100 - DNA, 20 bp, Artificial Sequence
  Description of Artificial Sequence: Synthetic oligonucleotide
gaggcggcccgtgaggccga

SEQ ID NO: 43101 - DNA, 20 bp, Artificial Sequence
  Description of Artificial Sequence: Synthetic oligonucleotide
aggcggcccgtgaggccgag

SEQ ID NO: 43102 - DNA, 20 bp, Artificial Sequence
  Description of Artificial Sequence: Synthetic oligonucleotide
ggcggcccgtgaggccgagt

SEQ ID NO: 43103 - DNA, 20 bp, Artificial Sequence
  Description of Artificial Sequence: Synthetic oligonucleotide
gcggcccgtgaggccgagca

SEQ ID NO: 43104 - DNA, 20 bp, Artificial Sequence
  Description of Artificial Sequence: Synthetic oligonucleotide
cggcccgtgaggccgagcag

SEQ ID NO: 43105 - DNA, 21 bp, Artificial Sequence
  Description of Artificial Sequence: Synthetic oligonucleotide
ggcccgtgaggccgagcagct

SEQ ID NO: 43106 - DNA, 22 bp, Artificial Sequence
  Description of Artificial Sequence: Synthetic oligonucleotide
gcccgtgaggccgagcagctga

SEQ ID NO: 43107 - DNA, 23 bp, Artificial Sequence
  Description of Artificial Sequence: Synthetic oligonucleotide
cccgtgaggccgagcagctgaga

SEQ ID NO: 43108 - DNA, 23 bp, Artificial Sequence
  Description of Artificial Sequence: Synthetic oligonucleotide
ccgtgaggccgagcagctgagag

SEQ ID NO: 43109 - DNA, 23 bp, Artificial Sequence
  Description of Artificial Sequence: Synthetic oligonucleotide
cgtgaggccgagcagctgagagc

SEQ ID NO: 43110 - DNA, 25 bp, Artificial Sequence
  Description of Artificial Sequence: Synthetic oligonucleotide
gtgaggccgagcagctgagagccta

SEQ ID NO: 43111 - DNA, 25 bp, Artificial Sequence
  Description of Artificial Sequence: Synthetic oligonucleotide
tgaggccgagcagctgagagcctac

SEQ ID NO: 43112 - DNA, 24 bp, Artificial Sequence
  Description of Artificial Sequence: Synthetic oligonucleotide
gaggccgagcagctgagagcctac

SEQ ID NO: 43113 - DNA, 25 bp, Artificial Sequence
  Description of Artificial Sequence: Synthetic oligonucleotide
aggccgagcagctgagagcctacct

SEQ ID NO: 43114 - DNA, 23 bp, Artificial Sequence
  Description of Artificial Sequence: Synthetic oligonucleotide
cggacacggcggctcagatcacg

SEQ ID NO: 43115 - DNA, 24 bp, Artificial Sequence
  Description of Artificial Sequence: Synthetic oligonucleotide
ggacacggcggctcagatcacgca

SEQ ID NO: 43116 - DNA, 24 bp, Artificial Sequence
  Description of Artificial Sequence: Synthetic oligonucleotide
gacacggcggctcagatcacgcag

SEQ ID NO: 43117 - DNA, 24 bp, Artificial Sequence
  Description of Artificial Sequence: Synthetic oligonucleotide
acacggcggctcagatcacgcagc

SEQ ID NO: 43118 - DNA, 23 bp, Artificial Sequence
  Description of Artificial Sequence: Synthetic oligonucleotide
cacggcggctcagatcacgcagc

SEQ ID NO: 43119 - DNA, 23 bp, Artificial Sequence
  Description of Artificial Sequence: Synthetic oligonucleotide
acggcggctcagatcacgcagcg

SEQ ID NO: 43120 - DNA, 22 bp, Artificial Sequence
  Description of Artificial Sequence: Synthetic oligonucleotide
cggcggctcagatcacgcagcg

SEQ ID NO: 43121 - DNA, 23 bp, Artificial Sequence
  Description of Artificial Sequence: Synthetic oligonucleotide
atctgcgctcctggaccgccgca

SEQ ID NO: 43122 - DNA, 22 bp, Artificial Sequence
  Description of Artificial Sequence: Synthetic oligonucleotide
tctgcgctcctggaccgccgca

SEQ ID NO: 43123 - DNA, 28 bp, Artificial Sequence
  Description of Artificial Sequence: Synthetic oligonucleotide
tatttctacaccgctgtgtcccggcctg

SEQ ID NO: 43124 - DNA, 27 bp, Artificial Sequence
  Description of Artificial Sequence: Synthetic oligonucleotide
atttctacaccgctgtgtcccggcctg

SEQ ID NO: 43125 - DNA, 26 bp, Artificial Sequence
  Description of Artificial Sequence: Synthetic oligonucleotide
tttctacaccgctgtgtcccggcctg

SEQ ID NO: 43126 - DNA, 25 bp, Artificial Sequence
  Description of Artificial Sequence: Synthetic oligonucleotide
ttctacaccgctgtgtcccggcctg

SEQ ID NO: 43127 - DNA, 24 bp, Artificial Sequence
  Description of Artificial Sequence: Synthetic oligonucleotide
tctacaccgctgtgtcccggcctg

SEQ ID NO: 43128 - DNA, 23 bp, Artificial Sequence
  Description of Artificial Sequence: Synthetic oligonucleotide
ctacaccgctgtgtcccggcctg

SEQ ID NO: 43129 - DNA, 23 bp, Artificial Sequence
  Description of Artificial Sequence: Synthetic oligonucleotide
tacaccgctgtgtcccggcctgg

SEQ ID NO: 43130 - DNA, 22 bp, Artificial Sequence
  Description of Artificial Sequence: Synthetic oligonucleotide
acaccgctgtgtcccggcctgg

SEQ ID NO: 43131 - DNA, 21 bp, Artificial Sequence
  Description of Artificial Sequence: Synthetic oligonucleotide
caccgctgtgtcccggcctgg

SEQ ID NO: 43132 - DNA, 21 bp, Artificial Sequence
  Description of Artificial Sequence: Synthetic oligonucleotide
accgctgtgtcccggcctggc

SEQ ID NO: 43133 - DNA, 20 bp, Artificial Sequence
  Description of Artificial Sequence: Synthetic oligonucleotide
ccgctgtgtcccggcctggc

SEQ ID NO: 43134 - DNA, 20 bp, Artificial Sequence
  Description of Artificial Sequence: Synthetic oligonucleotide
cgctgtgtcccggcctggcc

SEQ ID NO: 43135 - DNA, 20 bp, Artificial Sequence
  Description of Artificial Sequence: Synthetic oligonucleotide
gctgtgtcccggcctggccg

SEQ ID NO: 43136 - DNA, 20 bp, Artificial Sequence
  Description of Artificial Sequence: Synthetic oligonucleotide
ctgtgtcccggcctggccgc

SEQ ID NO: 43137 - DNA, 20 bp, Artificial Sequence
  Description of Artificial Sequence: Synthetic oligonucleotide
tgtgtcccggcctggccgcg

SEQ ID NO: 43138 - DNA, 20 bp, Artificial Sequence
  Description of Artificial Sequence: Synthetic oligonucleotide
ctggccgcggggagccccat

SEQ ID NO: 43139 - DNA, 21 bp, Artificial Sequence
  Description of Artificial Sequence: Synthetic oligonucleotide
tggccgcggggagccccactt

SEQ ID NO: 43140 - DNA, 24 bp, Artificial Sequence
  Description of Artificial Sequence: Synthetic oligonucleotide
cggttcgacagcgacgctgcgagt

SEQ ID NO: 43141 - DNA, 24 bp, Artificial Sequence
  Description of Artificial Sequence: Synthetic oligonucleotide
acagcgacgctgcgagtccgagag

SEQ ID NO: 43142 - DNA, 23 bp, Artificial Sequence
  Description of Artificial Sequence: Synthetic oligonucleotide
cagcgacgctgcgagtccgagag

SEQ ID NO: 43143 - DNA, 23 bp, Artificial Sequence
  Description of Artificial Sequence: Synthetic oligonucleotide
agcgacgctgcgagtccgagagg

SEQ ID NO: 43144 - DNA, 22 bp, Artificial Sequence
  Description of Artificial Sequence: Synthetic oligonucleotide
gcgacgctgcgagtccgagagg

SEQ ID NO: 43145 - DNA, 22 bp, Artificial Sequence
  Description of Artificial Sequence: Synthetic oligonucleotide
cgacgctgcgagtccgagaggg

SEQ ID NO: 43146 - DNA, 23 bp, Artificial Sequence
  Description of Artificial Sequence: Synthetic oligonucleotide
gacgctgcgagtccgagagggga

SEQ ID NO: 43147 - DNA, 23 bp, Artificial Sequence
  Description of Artificial Sequence: Synthetic oligonucleotide
acgctgcgagtccgagaggggag

SEQ ID NO: 43148 - DNA, 22 bp, Artificial Sequence
  Description of Artificial Sequence: Synthetic oligonucleotide
cgctgcgagtccgagaggggag

SEQ ID NO: 43149 - DNA, 22 bp, Artificial Sequence
  Description of Artificial Sequence: Synthetic oligonucleotide
gctgcgagtccgagaggggagc

SEQ ID NO: 43150 - DNA, 22 bp, Artificial Sequence
  Description of Artificial Sequence: Synthetic oligonucleotide
ctgcgagtccgagaggggagcc

SEQ ID NO: 43151 - DNA, 22 bp, Artificial Sequence
  Description of Artificial Sequence: Synthetic oligonucleotide
tgcgagtccgagaggggagccg

SEQ ID NO: 43152 - DNA, 24 bp, Artificial Sequence
  Description of Artificial Sequence: Synthetic oligonucleotide
cagagcccctcaccctgagatggg

SEQ ID NO: 43153 - DNA, 24 bp, Artificial Sequence
  Description of Artificial Sequence: Synthetic oligonucleotide
gccggagtattgggaccgggagac

SEQ ID NO: 43154 - DNA, 24 bp, Artificial Sequence
  Description of Artificial Sequence: Synthetic oligonucleotide
ccggagtattgggaccgggagacg

SEQ ID NO: 43155 - DNA, 25 bp, Artificial Sequence
  Description of Artificial Sequence: Synthetic oligonucleotide
cggagtattgggaccgggagacgca

SEQ ID NO: 43156 - DNA, 27 bp, Artificial Sequence
  Description of Artificial Sequence: Synthetic oligonucleotide
ggagtattgggaccgggagacgcagaa

SEQ ID NO: 43157 - DNA, 27 bp, Artificial Sequence
  Description of Artificial Sequence: Synthetic oligonucleotide
gagtattgggaccgggagacgcagaag

SEQ ID NO: 43158 - DNA, 29 bp, Artificial Sequence
  Description of Artificial Sequence: Synthetic oligonucleotide
agtattgggaccgggagacgcagaagtac

SEQ ID NO: 43159 - DNA, 28 bp, Artificial Sequence
  Description of Artificial Sequence: Synthetic oligonucleotide
gtattgggaccgggagacgcagaagtac

SEQ ID NO: 43160 - DNA, 30 bp, Artificial Sequence
  Description of Artificial Sequence: Synthetic oligonucleotide
tattgggaccgggagacgcagaagtacaag

SEQ ID NO: 43161 - DNA, 29 bp, Artificial Sequence
  Description of Artificial Sequence: Synthetic oligonucleotide
attgggaccgggagacgcagaagtacaag

SEQ ID NO: 43162 - DNA, 28 bp, Artificial Sequence
  Description of Artificial Sequence: Synthetic oligonucleotide
ttgggaccgggagacgcagaagtacaag

SEQ ID NO: 43163 - DNA, 27 bp, Artificial Sequence
  Description of Artificial Sequence: Synthetic oligonucleotide
tgggaccgggagacgcagaagtacaag

SEQ ID NO: 43164 - DNA, 26 bp, Artificial Sequence
  Description of Artificial Sequence: Synthetic oligonucleotide
gggaccgggagacgcagaagtacaag

SEQ ID NO: 43165 - DNA, 26 bp, Artificial Sequence
  Description of Artificial Sequence: Synthetic oligonucleotide
ggaccgggagacgcagaagtacaagc

SEQ ID NO: 43166 - DNA, 26 bp, Artificial Sequence
  Description of Artificial Sequence: Synthetic oligonucleotide
gaccgggagacgcagaagtacaagcg

SEQ ID NO: 43167 - DNA, 26 bp, Artificial Sequence
  Description of Artificial Sequence: Synthetic oligonucleotide
accgggagacgcagaagtacaagcgc

SEQ ID NO: 43168 - DNA, 25 bp, Artificial Sequence
  Description of Artificial Sequence: Synthetic oligonucleotide
ccgggagacgcagaagtacaagcgc

SEQ ID NO: 43169 - DNA, 26 bp, Artificial Sequence
  Description of Artificial Sequence: Synthetic oligonucleotide
cgggagacgcagaagtacaagcgcca

SEQ ID NO: 43170 - DNA, 26 bp, Artificial Sequence
  Description of Artificial Sequence: Synthetic oligonucleotide
gggagacgcagaagtacaagcgccag

SEQ ID NO: 43171 - DNA, 26 bp, Artificial Sequence
  Description of Artificial Sequence: Synthetic oligonucleotide
ggagacgcagaagtacaagcgccagg

SEQ ID NO: 43172 - DNA, 27 bp, Artificial Sequence
  Description of Artificial Sequence: Synthetic oligonucleotide
gagacgcagaagtacaagcgccaggca

SEQ ID NO: 43173 - DNA, 27 bp, Artificial Sequence
  Description of Artificial Sequence: Synthetic oligonucleotide
agacgcagaagtacaagcgccaggcac

SEQ ID NO: 43174 - DNA, 27 bp, Artificial Sequence
  Description of Artificial Sequence: Synthetic oligonucleotide
gacgcagaagtacaagcgccaggcaca

SEQ ID NO: 43175 - DNA, 27 bp, Artificial Sequence
  Description of Artificial Sequence: Synthetic oligonucleotide
acgcagaagtacaagcgccaggcacag

SEQ ID NO: 43176 - DNA, 27 bp, Artificial Sequence
  Description of Artificial Sequence: Synthetic oligonucleotide
cgcagaagtacaagcgccaggcacaga

SEQ ID NO: 43177 - DNA, 27 bp, Artificial Sequence
  Description of Artificial Sequence: Synthetic oligonucleotide
gcagaagtacaagcgccaggcacagac

SEQ ID NO: 43178 - DNA, 27 bp, Artificial Sequence
  Description of Artificial Sequence: Synthetic oligonucleotide
atcgcagtgggctacgtggacgacaca

SEQ ID NO: 43179 - DNA, 26 bp, Artificial Sequence
  Description of Artificial Sequence: Synthetic oligonucleotide
tcgcagtgggctacgtggacgacaca

SEQ ID NO: 43180 - DNA, 25 bp, Artificial Sequence
  Description of Artificial Sequence: Synthetic oligonucleotide
cgcagtgggctacgtggacgacaca

SEQ ID NO: 43181 - DNA, 26 bp, Artificial Sequence
  Description of Artificial Sequence: Synthetic oligonucleotide
gcagtgggctacgtggacgacacaca

SEQ ID NO: 43182 - DNA, 27 bp, Artificial Sequence
  Description of Artificial Sequence: Synthetic oligonucleotide
gctacgtggacgacacacagttcgtgc

SEQ ID NO: 43183 - DNA, 27 bp, Artificial Sequence
  Description of Artificial Sequence: Synthetic oligonucleotide
ctacgtggacgacacacagttcgtgcg

SEQ ID NO: 43184 - DNA, 27 bp, Artificial Sequence
  Description of Artificial Sequence: Synthetic oligonucleotide
tacgtggacgacacacagttcgtgcgg

SEQ ID NO: 43185 - DNA, 27 bp, Artificial Sequence
  Description of Artificial Sequence: Synthetic oligonucleotide
acgtggacgacacacagttcgtgcggt

SEQ ID NO: 43186 - DNA, 27 bp, Artificial Sequence
  Description of Artificial Sequence: Synthetic oligonucleotide
cgtggacgacacacagttcgtgcggtt

SEQ ID NO: 43187 - DNA, 27 bp, Artificial Sequence
  Description of Artificial Sequence: Synthetic oligonucleotide
gtggacgacacacagttcgtgcggttc

SEQ ID NO: 43188 - DNA, 27 bp, Artificial Sequence
  Description of Artificial Sequence: Synthetic oligonucleotide
tggacgacacacagttcgtgcggttcg

SEQ ID NO: 43189 - DNA, 27 bp, Artificial Sequence
  Description of Artificial Sequence: Synthetic oligonucleotide
ggacgacacacagttcgtgcggttcga

SEQ ID NO: 43190 - DNA, 27 bp, Artificial Sequence
  Description of Artificial Sequence: Synthetic oligonucleotide
gacgacacacagttcgtgcggttcgac

SEQ ID NO: 43191 - DNA, 28 bp, Artificial Sequence
  Description of Artificial Sequence: Synthetic oligonucleotide
acgacacacagttcgtgcggttcgacag

SEQ ID NO: 43192 - DNA, 27 bp, Artificial Sequence
  Description of Artificial Sequence: Synthetic oligonucleotide
cgacacacagttcgtgcggttcgacag

SEQ ID NO: 43193 - DNA, 27 bp, Artificial Sequence
  Description of Artificial Sequence: Synthetic oligonucleotide
gacacacagttcgtgcggttcgacagc

SEQ ID NO: 43194 - DNA, 27 bp, Artificial Sequence
  Description of Artificial Sequence: Synthetic oligonucleotide
acacacagttcgtgcggttcgacagcg

SEQ ID NO: 43195 - DNA, 27 bp, Artificial Sequence
  Description of Artificial Sequence: Synthetic oligonucleotide
cacacagttcgtgcggttcgacagcga

SEQ ID NO: 43196 - DNA, 27 bp, Artificial Sequence
  Description of Artificial Sequence: Synthetic oligonucleotide
acacagttcgtgcggttcgacagcgac

SEQ ID NO: 43197 - DNA, 26 bp, Artificial Sequence
  Description of Artificial Sequence: Synthetic oligonucleotide
cacagttcgtgcggttcgacagcgac

SEQ ID NO: 43198 - DNA, 26 bp, Artificial Sequence
  Description of Artificial Sequence: Synthetic oligonucleotide
acagttcgtgcggttcgacagcgacg

SEQ ID NO: 43199 - DNA, 21 bp, Artificial Sequence
  Description of Artificial Sequence: Synthetic oligonucleotide
tgggtggagcaggaggggccc

SEQ ID NO: 43200 - DNA, 20 bp, Artificial Sequence
  Description of Artificial Sequence: Synthetic oligonucleotide
gggtggagcaggaggggccc

SEQ ID NO: 43201 - DNA, 21 bp, Artificial Sequence
  Description of Artificial Sequence: Synthetic oligonucleotide
ggtggagcaggaggggcccga

SEQ ID NO: 43202 - DNA, 25 bp, Artificial Sequence
  Description of Artificial Sequence: Synthetic oligonucleotide
gtggagcaggaggggcccgagtatt

SEQ ID NO: 43203 - DNA, 25 bp, Artificial Sequence
  Description of Artificial Sequence: Synthetic oligonucleotide
tggagcaggaggggcccgagtattg

SEQ ID NO: 43204 - DNA, 24 bp, Artificial Sequence
  Description of Artificial Sequence: Synthetic oligonucleotide
ggagcaggaggggcccgagtattg

SEQ ID NO: 43205 - DNA, 28 bp, Artificial Sequence
  Description of Artificial Sequence: Synthetic oligonucleotide
cgagtattgggaccgggagacacagaag

SEQ ID NO: 43206 - DNA, 31 bp, Artificial Sequence
  Description of Artificial Sequence: Synthetic oligonucleotide
atgaggtatttctacaccgctgtgtcccgac

SEQ ID NO: 43207 - DNA, 30 bp, Artificial Sequence
  Description of Artificial Sequence: Synthetic oligonucleotide
tgaggtatttctacaccgctgtgtcccgac

SEQ ID NO: 43208 - DNA, 29 bp, Artificial Sequence
  Description of Artificial Sequence: Synthetic oligonucleotide
gaggtatttctacaccgctgtgtcccgac

SEQ ID NO: 43209 - DNA, 29 bp, Artificial Sequence
  Description of Artificial Sequence: Synthetic oligonucleotide
aggtatttctacaccgctgtgtcccgacc

SEQ ID NO: 43210 - DNA, 28 bp, Artificial Sequence
  Description of Artificial Sequence: Synthetic oligonucleotide
ggtatttctacaccgctgtgtcccgacc

SEQ ID NO: 43211 - DNA, 28 bp, Artificial Sequence
  Description of Artificial Sequence: Synthetic oligonucleotide
gtatttctacaccgctgtgtcccgaccc

SEQ ID NO: 43212 - DNA, 28 bp, Artificial Sequence
  Description of Artificial Sequence: Synthetic oligonucleotide
tatttctacaccgctgtgtcccgacccg

SEQ ID NO: 43213 - DNA, 27 bp, Artificial Sequence
  Description of Artificial Sequence: Synthetic oligonucleotide
atttctacaccgctgtgtcccgacccg

SEQ ID NO: 43214 - DNA, 26 bp, Artificial Sequence
  Description of Artificial Sequence: Synthetic oligonucleotide
tttctacaccgctgtgtcccgacccg

SEQ ID NO: 43215 - DNA, 25 bp, Artificial Sequence
  Description of Artificial Sequence: Synthetic oligonucleotide
ttctacaccgctgtgtcccgacccg

SEQ ID NO: 43216 - DNA, 24 bp, Artificial Sequence
  Description of Artificial Sequence: Synthetic oligonucleotide
tctacaccgctgtgtcccgacccg

SEQ ID NO: 43217 - DNA, 23 bp, Artificial Sequence
  Description of Artificial Sequence: Synthetic oligonucleotide
ctacaccgctgtgtcccgacccg

SEQ ID NO: 43218 - DNA, 23 bp, Artificial Sequence
  Description of Artificial Sequence: Synthetic oligonucleotide
tacaccgctgtgtcccgacccgg

SEQ ID NO: 43219 - DNA, 22 bp, Artificial Sequence
  Description of Artificial Sequence: Synthetic oligonucleotide
acaccgctgtgtcccgacccgg

SEQ ID NO: 43220 - DNA, 21 bp, Artificial Sequence
  Description of Artificial Sequence: Synthetic oligonucleotide
caccgctgtgtcccgacccgg

SEQ ID NO: 43221 - DNA, 21 bp, Artificial Sequence
  Description of Artificial Sequence: Synthetic oligonucleotide
accgctgtgtcccgacccggc

SEQ ID NO: 43222 - DNA, 20 bp, Artificial Sequence
  Description of Artificial Sequence: Synthetic oligonucleotide
ccgctgtgtcccgacccggc

SEQ ID NO: 43223 - DNA, 20 bp, Artificial Sequence
  Description of Artificial Sequence: Synthetic oligonucleotide
cgctgtgtcccgacccggcc

SEQ ID NO: 43224 - DNA, 20 bp, Artificial Sequence
  Description of Artificial Sequence: Synthetic oligonucleotide
gctgtgtcccgacccggccg

SEQ ID NO: 43225 - DNA, 20 bp, Artificial Sequence
  Description of Artificial Sequence: Synthetic oligonucleotide
ctgtgtcccgacccggccgc

SEQ ID NO: 43226 - DNA, 20 bp, Artificial Sequence
  Description of Artificial Sequence: Synthetic oligonucleotide
tgtgtcccgacccggccgcg

SEQ ID NO: 43227 - DNA, 20 bp, Artificial Sequence
  Description of Artificial Sequence: Synthetic oligonucleotide
gtgtcccgacccggccgcgt

SEQ ID NO: 43228 - DNA, 24 bp, Artificial Sequence
  Description of Artificial Sequence: Synthetic oligonucleotide
ggcggctcagatcacccagcggaa

SEQ ID NO: 43229 - DNA, 25 bp, Artificial Sequence
  Description of Artificial Sequence: Synthetic oligonucleotide
gcggctcagatcacccagcggaagt

SEQ ID NO: 43230 - DNA, 25 bp, Artificial Sequence
  Description of Artificial Sequence: Synthetic oligonucleotide
cggctcagatcacccagcggaagtg

SEQ ID NO: 43231 - DNA, 25 bp, Artificial Sequence
  Description of Artificial Sequence: Synthetic oligonucleotide
ggctcagatcacccagcggaagtgg

SEQ ID NO: 43232 - DNA, 26 bp, Artificial Sequence
  Description of Artificial Sequence: Synthetic oligonucleotide
gctcagatcacccagcggaagtggga

SEQ ID NO: 43233 - DNA, 26 bp, Artificial Sequence
  Description of Artificial Sequence: Synthetic oligonucleotide
ctcagatcacccagcggaagtgggag

SEQ ID NO: 43234 - DNA, 26 bp, Artificial Sequence
  Description of Artificial Sequence: Synthetic oligonucleotide
tcagatcacccagcggaagtgggagg

SEQ ID NO: 43235 - DNA, 25 bp, Artificial Sequence
  Description of Artificial Sequence: Synthetic oligonucleotide
cagatcacccagcggaagtgggagg

SEQ ID NO: 43236 - DNA, 25 bp, Artificial Sequence
  Description of Artificial Sequence: Synthetic oligonucleotide
agatcacccagcggaagtgggaggc

SEQ ID NO: 43237 - DNA, 24 bp, Artificial Sequence
  Description of Artificial Sequence: Synthetic oligonucleotide
gatcacccagcggaagtgggaggc

SEQ ID NO: 43238 - DNA, 24 bp, Artificial Sequence
  Description of Artificial Sequence: Synthetic oligonucleotide
atcacccagcggaagtgggaggcg

SEQ ID NO: 43239 - DNA, 23 bp, Artificial Sequence
  Description of Artificial Sequence: Synthetic oligonucleotide
tcacccagcggaagtgggaggcg

SEQ ID NO: 43240 - DNA, 22 bp, Artificial Sequence
  Description of Artificial Sequence: Synthetic oligonucleotide
cacccagcggaagtgggaggcg

SEQ ID NO: 43241 - DNA, 22 bp, Artificial Sequence
  Description of Artificial Sequence: Synthetic oligonucleotide
acccagcggaagtgggaggcgg

SEQ ID NO: 43242 - DNA, 21 bp, Artificial Sequence
  Description of Artificial Sequence: Synthetic oligonucleotide
cccagcggaagtgggaggcgg

SEQ ID NO: 43243 - DNA, 21 bp, Artificial Sequence
  Description of Artificial Sequence: Synthetic oligonucleotide
ccagcggaagtgggaggcggc

SEQ ID NO: 43244 - DNA, 21 bp, Artificial Sequence
  Description of Artificial Sequence: Synthetic oligonucleotide
cagcggaagtgggaggcggcc

SEQ ID NO: 43245 - DNA, 21 bp, Artificial Sequence
  Description of Artificial Sequence: Synthetic oligonucleotide
agcggaagtgggaggcggccc

SEQ ID NO: 43246 - DNA, 20 bp, Artificial Sequence
  Description of Artificial Sequence: Synthetic oligonucleotide
gcggaagtgggaggcggccc

SEQ ID NO: 43247 - DNA, 21 bp, Artificial Sequence
  Description of Artificial Sequence: Synthetic oligonucleotide
cggaagtgggaggcggcccgt

SEQ ID NO: 43248 - DNA, 22 bp, Artificial Sequence
  Description of Artificial Sequence: Synthetic oligonucleotide
ggaagtgggaggcggcccgtga

SEQ ID NO: 43249 - DNA, 22 bp, Artificial Sequence
  Description of Artificial Sequence: Synthetic oligonucleotide
gaagtgggaggcggcccgtgag

SEQ ID NO: 43250 - DNA, 23 bp, Artificial Sequence
  Description of Artificial Sequence: Synthetic oligonucleotide
gtggagcaggaggggccggagta

SEQ ID NO: 43251 - DNA, 24 bp, Artificial Sequence
  Description of Artificial Sequence: Synthetic oligonucleotide
tggagcaggaggggccggagtact

SEQ ID NO: 43252 - DNA, 23 bp, Artificial Sequence
  Description of Artificial Sequence: Synthetic oligonucleotide
ggagcaggaggggccggagtact

SEQ ID NO: 43253 - DNA, 27 bp, Artificial Sequence
  Description of Artificial Sequence: Synthetic oligonucleotide
ggagtactgggaccgggagacacagaa

SEQ ID NO: 43254 - DNA, 27 bp, Artificial Sequence
  Description of Artificial Sequence: Synthetic oligonucleotide
gagtactgggaccgggagacacagaag

SEQ ID NO: 43255 - DNA, 29 bp, Artificial Sequence
  Description of Artificial Sequence: Synthetic oligonucleotide
agtactgggaccgggagacacagaagtac

SEQ ID NO: 43256 - DNA, 28 bp, Artificial Sequence
  Description of Artificial Sequence: Synthetic oligonucleotide
gtactgggaccgggagacacagaagtac

SEQ ID NO: 43257 - DNA, 30 bp, Artificial Sequence
  Description of Artificial Sequence: Synthetic oligonucleotide
tactgggaccgggagacacagaagtacaag

SEQ ID NO: 43258 - DNA, 29 bp, Artificial Sequence
  Description of Artificial Sequence: Synthetic oligonucleotide
actgggaccgggagacacagaagtacaag

SEQ ID NO: 43259 - DNA, 28 bp, Artificial Sequence
  Description of Artificial Sequence: Synthetic oligonucleotide
ctgggaccgggagacacagaagtacaag

SEQ ID NO: 43260 - DNA, 25 bp, Artificial Sequence
  Description of Artificial Sequence: Synthetic oligonucleotide
cggggagccccacttcatcgcagta

SEQ ID NO: 43261 - DNA, 25 bp, Artificial Sequence
  Description of Artificial Sequence: Synthetic oligonucleotide
ggggagccccacttcatcgcagtag

SEQ ID NO: 43262 - DNA, 25 bp, Artificial Sequence
  Description of Artificial Sequence: Synthetic oligonucleotide
gggagccccacttcatcgcagtagg

SEQ ID NO: 43263 - DNA, 27 bp, Artificial Sequence
  Description of Artificial Sequence: Synthetic oligonucleotide
ggagccccacttcatcgcagtaggcta

SEQ ID NO: 43264 - DNA, 27 bp, Artificial Sequence
  Description of Artificial Sequence: Synthetic oligonucleotide
gagccccacttcatcgcagtaggctac

SEQ ID NO: 43265 - DNA, 27 bp, Artificial Sequence
  Description of Artificial Sequence: Synthetic oligonucleotide
agccccacttcatcgcagtaggctacg

SEQ ID NO: 43266 - DNA, 27 bp, Artificial Sequence
  Description of Artificial Sequence: Synthetic oligonucleotide
gccccacttcatcgcagtaggctacgt

SEQ ID NO: 43267 - DNA, 27 bp, Artificial Sequence
  Description of Artificial Sequence: Synthetic oligonucleotide
ccccacttcatcgcagtaggctacgtg

SEQ ID NO: 43268 - DNA, 27 bp, Artificial Sequence
  Description of Artificial Sequence: Synthetic oligonucleotide
cccacttcatcgcagtaggctacgtgg

SEQ ID NO: 43269 - DNA, 28 bp, Artificial Sequence
  Description of Artificial Sequence: Synthetic oligonucleotide
ccacttcatcgcagtaggctacgtggac

SEQ ID NO: 43270 - DNA, 28 bp, Artificial Sequence
  Description of Artificial Sequence: Synthetic oligonucleotide
cacttcatcgcagtaggctacgtggacg

SEQ ID NO: 43271 - DNA, 29 bp, Artificial Sequence
  Description of Artificial Sequence: Synthetic oligonucleotide
acttcatcgcagtaggctacgtggacgac

SEQ ID NO: 43272 - DNA, 28 bp, Artificial Sequence
  Description of Artificial Sequence: Synthetic oligonucleotide
cttcatcgcagtaggctacgtggacgac

SEQ ID NO: 43273 - DNA, 29 bp, Artificial Sequence
  Description of Artificial Sequence: Synthetic oligonucleotide
ttcatcgcagtaggctacgtggacgacac

SEQ ID NO: 43274 - DNA, 28 bp, Artificial Sequence
  Description of Artificial Sequence: Synthetic oligonucleotide
tcatcgcagtaggctacgtggacgacac

SEQ ID NO: 43275 - DNA, 27 bp, Artificial Sequence
  Description of Artificial Sequence: Synthetic oligonucleotide
catcgcagtaggctacgtggacgacac

SEQ ID NO: 43276 - DNA, 27 bp, Artificial Sequence
  Description of Artificial Sequence: Synthetic oligonucleotide
atcgcagtaggctacgtggacgacacg

SEQ ID NO: 43277 - DNA, 26 bp, Artificial Sequence
  Description of Artificial Sequence: Synthetic oligonucleotide
tcgcagtaggctacgtggacgacacg

SEQ ID NO: 43278 - DNA, 25 bp, Artificial Sequence
  Description of Artificial Sequence: Synthetic oligonucleotide
cgcagtaggctacgtggacgacacg

SEQ ID NO: 43279 - DNA, 26 bp, Artificial Sequence
  Description of Artificial Sequence: Synthetic oligonucleotide
gcagtaggctacgtggacgacacgca

SEQ ID NO: 43280 - DNA, 27 bp, Artificial Sequence
  Description of Artificial Sequence: Synthetic oligonucleotide
cagtaggctacgtggacgacacgcagt

SEQ ID NO: 43281 - DNA, 28 bp, Artificial Sequence
  Description of Artificial Sequence: Synthetic oligonucleotide
agtaggctacgtggacgacacgcagttc

SEQ ID NO: 43282 - DNA, 27 bp, Artificial Sequence
  Description of Artificial Sequence: Synthetic oligonucleotide
gtaggctacgtggacgacacgcagttc

SEQ ID NO: 43283 - DNA, 27 bp, Artificial Sequence
  Description of Artificial Sequence: Synthetic oligonucleotide
taggctacgtggacgacacgcagttcg

SEQ ID NO: 43284 - DNA, 27 bp, Artificial Sequence
  Description of Artificial Sequence: Synthetic oligonucleotide
aggctacgtggacgacacgcagttcgt

SEQ ID NO: 43285 - DNA, 20 bp, Artificial Sequence
  Description of Artificial Sequence: Synthetic oligonucleotide
aggggagccgcgggcgccat

SEQ ID NO: 43286 - DNA, 20 bp, Artificial Sequence
  Description of Artificial Sequence: Synthetic oligonucleotide
ggggagccgcgggcgccatt

SEQ ID NO: 43287 - DNA, 20 bp, Artificial Sequence
  Description of Artificial Sequence: Synthetic oligonucleotide
ggagccgcgggcgccatggt

SEQ ID NO: 43288 - DNA, 20 bp, Artificial Sequence
  Description of Artificial Sequence: Synthetic oligonucleotide
gagccgcgggcgccatgggt

SEQ ID NO: 43289 - DNA, 20 bp, Artificial Sequence
  Description of Artificial Sequence: Synthetic oligonucleotide
agccgcgggcgccatgggtg

SEQ ID NO: 43290 - DNA, 20 bp, Artificial Sequence
  Description of Artificial Sequence: Synthetic oligonucleotide
gccgcgggcgccatgggtgt

SEQ ID NO: 43291 - DNA, 20 bp, Artificial Sequence
  Description of Artificial Sequence: Synthetic oligonucleotide
ccgcgggcgccatgggtgga

SEQ ID NO: 43292 - DNA, 20 bp, Artificial Sequence
  Description of Artificial Sequence: Synthetic oligonucleotide
cgcgggcgccatgggtggag

SEQ ID NO: 43293 - DNA, 21 bp, Artificial Sequence
  Description of Artificial Sequence: Synthetic oligonucleotide
gcgggcgccatgggtggagca

SEQ ID NO: 43294 - DNA, 21 bp, Artificial Sequence
  Description of Artificial Sequence: Synthetic oligonucleotide
cgggcgccatgggtggagcag

SEQ ID NO: 43295 - DNA, 22 bp, Artificial Sequence
  Description of Artificial Sequence: Synthetic oligonucleotide
gggcgccatgggtggagcagga

SEQ ID NO: 43296 - DNA, 22 bp, Artificial Sequence
  Description of Artificial Sequence: Synthetic oligonucleotide
ggcgccatgggtggagcaggag

SEQ ID NO: 43297 - DNA, 22 bp, Artificial Sequence
  Description of Artificial Sequence: Synthetic oligonucleotide
gcgccatgggtggagcaggagg

SEQ ID NO: 43298 - DNA, 22 bp, Artificial Sequence
  Description of Artificial Sequence: Synthetic oligonucleotide
cgccatgggtggagcaggaggg

SEQ ID NO: 43299 - DNA, 22 bp, Artificial Sequence
  Description of Artificial Sequence: Synthetic oligonucleotide
gccatgggtggagcaggagggg

SEQ ID NO: 43300 - DNA, 22 bp, Artificial Sequence
  Description of Artificial Sequence: Synthetic oligonucleotide
ccatgggtggagcaggaggggc

SEQ ID NO: 43301 - DNA, 22 bp, Artificial Sequence
  Description of Artificial Sequence: Synthetic oligonucleotide
catgggtggagcaggaggggcc

SEQ ID NO: 43302 - DNA, 22 bp, Artificial Sequence
  Description of Artificial Sequence: Synthetic oligonucleotide
atgggtggagcaggaggggccg

SEQ ID NO: 43303 - DNA, 22 bp, Artificial Sequence
  Description of Artificial Sequence: Synthetic oligonucleotide
gagtccgagaggggagccgcga

SEQ ID NO: 43304 - DNA, 22 bp, Artificial Sequence
  Description of Artificial Sequence: Synthetic oligonucleotide
agtccgagaggggagccgcgag

SEQ ID NO: 43305 - DNA, 21 bp, Artificial Sequence
  Description of Artificial Sequence: Synthetic oligonucleotide
gtccgagaggggagccgcgag

SEQ ID NO: 43306 - DNA, 21 bp, Artificial Sequence
  Description of Artificial Sequence: Synthetic oligonucleotide
tccgagaggggagccgcgagc

SEQ ID NO: 43307 - DNA, 20 bp, Artificial Sequence
  Description of Artificial Sequence: Synthetic oligonucleotide
ccgagaggggagccgcgagc

SEQ ID NO: 43308 - DNA, 20 bp, Artificial Sequence
  Description of Artificial Sequence: Synthetic oligonucleotide
cgagaggggagccgcgagcg

SEQ ID NO: 43309 - DNA, 20 bp, Artificial Sequence
  Description of Artificial Sequence: Synthetic oligonucleotide
gagaggggagccgcgagcgc

SEQ ID NO: 43310 - DNA, 20 bp, Artificial Sequence
  Description of Artificial Sequence: Synthetic oligonucleotide
agaggggagccgcgagcgcc

SEQ ID NO: 43311 - DNA, 20 bp, Artificial Sequence
  Description of Artificial Sequence: Synthetic oligonucleotide
gaggggagccgcgagcgcct

SEQ ID NO: 43312 - DNA, 20 bp, Artificial Sequence
  Description of Artificial Sequence: Synthetic oligonucleotide
aggggagccgcgagcgccgt

SEQ ID NO: 43313 - DNA, 20 bp, Artificial Sequence
  Description of Artificial Sequence: Synthetic oligonucleotide
ggggagccgcgagcgccgtt

SEQ ID NO: 43314 - DNA, 20 bp, Artificial Sequence
  Description of Artificial Sequence: Synthetic oligonucleotide
gggagccgcgagcgccgtgt

SEQ ID NO: 43315 - DNA, 20 bp, Artificial Sequence
  Description of Artificial Sequence: Synthetic oligonucleotide
ggagccgcgagcgccgtggt

SEQ ID NO: 43316 - DNA, 20 bp, Artificial Sequence
  Description of Artificial Sequence: Synthetic oligonucleotide
gagccgcgagcgccgtgggt

SEQ ID NO: 43317 - DNA, 20 bp, Artificial Sequence
  Description of Artificial Sequence: Synthetic oligonucleotide
agccgcgagcgccgtgggtg

SEQ ID NO: 43318 - DNA, 20 bp, Artificial Sequence
  Description of Artificial Sequence: Synthetic oligonucleotide
gccgcgagcgccgtgggtgt

SEQ ID NO: 43319 - DNA, 20 bp, Artificial Sequence
  Description of Artificial Sequence: Synthetic oligonucleotide
ccgcgagcgccgtgggtgga

SEQ ID NO: 43320 - DNA, 20 bp, Artificial Sequence
  Description of Artificial Sequence: Synthetic oligonucleotide
cgcgagcgccgtgggtggag

SEQ ID NO: 43321 - DNA, 21 bp, Artificial Sequence
  Description of Artificial Sequence: Synthetic oligonucleotide
gcgagcgccgtgggtggagca

SEQ ID NO: 43322 - DNA, 21 bp, Artificial Sequence
  Description of Artificial Sequence: Synthetic oligonucleotide
cgagcgccgtgggtggagcag

SEQ ID NO: 43323 - DNA, 22 bp, Artificial Sequence
  Description of Artificial Sequence: Synthetic oligonucleotide
gagcgccgtgggtggagcagga

SEQ ID NO: 43324 - DNA, 22 bp, Artificial Sequence
  Description of Artificial Sequence: Synthetic oligonucleotide
agcgccgtgggtggagcaggag

SEQ ID NO: 43325 - DNA, 22 bp, Artificial Sequence
  Description of Artificial Sequence: Synthetic oligonucleotide
gccgtgggtggagcaggaggga

SEQ ID NO: 43326 - DNA, 22 bp, Artificial Sequence
  Description of Artificial Sequence: Synthetic oligonucleotide
ccgtgggtggagcaggagggac

SEQ ID NO: 43327 - DNA, 22 bp, Artificial Sequence
  Description of Artificial Sequence: Synthetic oligonucleotide
cgtgggtggagcaggagggacc

SEQ ID NO: 43328 - DNA, 22 bp, Artificial Sequence
  Description of Artificial Sequence: Synthetic oligonucleotide
gtgggtggagcaggagggaccg

SEQ ID NO: 43329 - DNA, 23 bp, Artificial Sequence
  Description of Artificial Sequence: Synthetic oligonucleotide
tgggtggagcaggagggaccgga

SEQ ID NO: 43330 - DNA, 22 bp, Artificial Sequence
  Description of Artificial Sequence: Synthetic oligonucleotide
gggtggagcaggagggaccgga

SEQ ID NO: 43331 - DNA, 26 bp, Artificial Sequence
  Description of Artificial Sequence: Synthetic oligonucleotide
ggtggagcaggagggaccggagtatt

SEQ ID NO: 43332 - DNA, 26 bp, Artificial Sequence
  Description of Artificial Sequence: Synthetic oligonucleotide
gtggagcaggagggaccggagtattg

SEQ ID NO: 43333 - DNA, 26 bp, Artificial Sequence
  Description of Artificial Sequence: Synthetic oligonucleotide
tggagcaggagggaccggagtattgg

SEQ ID NO: 43334 - DNA, 25 bp, Artificial Sequence
  Description of Artificial Sequence: Synthetic oligonucleotide
ggagcaggagggaccggagtattgg

SEQ ID NO: 43335 - DNA, 24 bp, Artificial Sequence
  Description of Artificial Sequence: Synthetic oligonucleotide
gagggaccggagtattgggaccgg

SEQ ID NO: 43336 - DNA, 25 bp, Artificial Sequence
  Description of Artificial Sequence: Synthetic oligonucleotide
agggaccggagtattgggaccggga

SEQ ID NO: 43337 - DNA, 24 bp, Artificial Sequence
  Description of Artificial Sequence: Synthetic oligonucleotide
gggaccggagtattgggaccggga

SEQ ID NO: 43338 - DNA, 25 bp, Artificial Sequence
  Description of Artificial Sequence: Synthetic oligonucleotide
ggaccggagtattgggaccgggaga

SEQ ID NO: 43339 - DNA, 26 bp, Artificial Sequence
  Description of Artificial Sequence: Synthetic oligonucleotide
gaccggagtattgggaccgggagaca

SEQ ID NO: 43340 - DNA, 27 bp, Artificial Sequence
  Description of Artificial Sequence: Synthetic oligonucleotide
accggagtattgggaccgggagacaca

SEQ ID NO: 43341 - DNA, 27 bp, Artificial Sequence
  Description of Artificial Sequence: Synthetic oligonucleotide
cacagactgaccgagtgagcctgcgaa

SEQ ID NO: 43342 - DNA, 28 bp, Artificial Sequence
  Description of Artificial Sequence: Synthetic oligonucleotide
acagactgaccgagtgagcctgcgaaac

SEQ ID NO: 43343 - DNA, 27 bp, Artificial Sequence
  Description of Artificial Sequence: Synthetic oligonucleotide
cagactgaccgagtgagcctgcgaaac

SEQ ID NO: 43344 - DNA, 27 bp, Artificial Sequence
  Description of Artificial Sequence: Synthetic oligonucleotide
agactgaccgagtgagcctgcgaaacc

SEQ ID NO: 43345 - DNA, 27 bp, Artificial Sequence
  Description of Artificial Sequence: Synthetic oligonucleotide
gactgaccgagtgagcctgcgaaacct

SEQ ID NO: 43346 - DNA, 27 bp, Artificial Sequence
  Description of Artificial Sequence: Synthetic oligonucleotide
actgaccgagtgagcctgcgaaacctg

SEQ ID NO: 43347 - DNA, 26 bp, Artificial Sequence
  Description of Artificial Sequence: Synthetic oligonucleotide
ctgaccgagtgagcctgcgaaacctg

SEQ ID NO: 43348 - DNA, 26 bp, Artificial Sequence
  Description of Artificial Sequence: Synthetic oligonucleotide
tgaccgagtgagcctgcgaaacctgc

SEQ ID NO: 43349 - DNA, 25 bp, Artificial Sequence
  Description of Artificial Sequence: Synthetic oligonucleotide
gaccgagtgagcctgcgaaacctgc

SEQ ID NO: 43350 - DNA, 25 bp, Artificial Sequence
  Description of Artificial Sequence: Synthetic oligonucleotide
accgagtgagcctgcgaaacctgcg

SEQ ID NO: 43351 - DNA, 24 bp, Artificial Sequence
  Description of Artificial Sequence: Synthetic oligonucleotide
ccgagtgagcctgcgaaacctgcg

SEQ ID NO: 43352 - DNA, 24 bp, Artificial Sequence
  Description of Artificial Sequence: Synthetic oligonucleotide
cgagtgagcctgcgaaacctgcgc

SEQ ID NO: 43353 - DNA, 24 bp, Artificial Sequence
  Description of Artificial Sequence: Synthetic oligonucleotide
gagtgagcctgcgaaacctgcgcg

SEQ ID NO: 43354 - DNA, 24 bp, Artificial Sequence
  Description of Artificial Sequence: Synthetic oligonucleotide
agtgagcctgcgaaacctgcgcgg

SEQ ID NO: 43355 - DNA, 23 bp, Artificial Sequence
  Description of Artificial Sequence: Synthetic oligonucleotide
gtgagcctgcgaaacctgcgcgg

SEQ ID NO: 43356 - DNA, 25 bp, Artificial Sequence
  Description of Artificial Sequence: Synthetic oligonucleotide
tgagcctgcgaaacctgcgcggcta

SEQ ID NO: 43357 - DNA, 24 bp, Artificial Sequence
  Description of Artificial Sequence: Synthetic oligonucleotide
gagcctgcgaaacctgcgcggcta

SEQ ID NO: 43358 - DNA, 26 bp, Artificial Sequence
  Description of Artificial Sequence: Synthetic oligonucleotide
agcctgcgaaacctgcgcggctacta

SEQ ID NO: 43359 - DNA, 25 bp, Artificial Sequence
  Description of Artificial Sequence: Synthetic oligonucleotide
gcctgcgaaacctgcgcggctacta

SEQ ID NO: 43360 - DNA, 27 bp, Artificial Sequence
  Description of Artificial Sequence: Synthetic oligonucleotide
cctgcgaaacctgcgcggctactacaa

SEQ ID NO: 43361 - DNA, 27 bp, Artificial Sequence
  Description of Artificial Sequence: Synthetic oligonucleotide
ctgcgaaacctgcgcggctactacaac

SEQ ID NO: 43362 - DNA, 27 bp, Artificial Sequence
  Description of Artificial Sequence: Synthetic oligonucleotide
tgcgaaacctgcgcggctactacaacc

SEQ ID NO: 43363 - DNA, 27 bp, Artificial Sequence
  Description of Artificial Sequence: Synthetic oligonucleotide
gcgaaacctgcgcggctactacaacca

SEQ ID NO: 43364 - DNA, 27 bp, Artificial Sequence
  Description of Artificial Sequence: Synthetic oligonucleotide
cgaaacctgcgcggctactacaaccag

SEQ ID NO: 43365 - DNA, 28 bp, Artificial Sequence
  Description of Artificial Sequence: Synthetic oligonucleotide
gaaacctgcgcggctactacaaccagag

SEQ ID NO: 43366 - DNA, 28 bp, Artificial Sequence
  Description of Artificial Sequence: Synthetic oligonucleotide
aaacctgcgcggctactacaaccagagc

SEQ ID NO: 43367 - DNA, 22 bp, Artificial Sequence
  Description of Artificial Sequence: Synthetic oligonucleotide
ggcgcctcctccgcgggtatgt

SEQ ID NO: 43368 - DNA, 22 bp, Artificial Sequence
  Description of Artificial Sequence: Synthetic oligonucleotide
gcgcctcctccgcgggtatgtc

SEQ ID NO: 43369 - DNA, 23 bp, Artificial Sequence
  Description of Artificial Sequence: Synthetic oligonucleotide
cgcctcctccgcgggtatgtcca

SEQ ID NO: 43370 - DNA, 25 bp, Artificial Sequence
  Description of Artificial Sequence: Synthetic oligonucleotide
gcctcctccgcgggtatgtccagta

SEQ ID NO: 43371 - DNA, 25 bp, Artificial Sequence
  Description of Artificial Sequence: Synthetic oligonucleotide
cctcctccgcgggtatgtccagtac

SEQ ID NO: 43372 - DNA, 25 bp, Artificial Sequence
  Description of Artificial Sequence: Synthetic oligonucleotide
ctcctccgcgggtatgtccagtacg

SEQ ID NO: 43373 - DNA, 25 bp, Artificial Sequence
  Description of Artificial Sequence: Synthetic oligonucleotide
tcctccgcgggtatgtccagtacgc

SEQ ID NO: 43374 - DNA, 24 bp, Artificial Sequence
  Description of Artificial Sequence: Synthetic oligonucleotide
cctccgcgggtatgtccagtacgc

SEQ ID NO: 43375 - DNA, 26 bp, Artificial Sequence
  Description of Artificial Sequence: Synthetic oligonucleotide
ctccgcgggtatgtccagtacgccta

SEQ ID NO: 43376 - DNA, 26 bp, Artificial Sequence
  Description of Artificial Sequence: Synthetic oligonucleotide
tccgcgggtatgtccagtacgcctac

SEQ ID NO: 43377 - DNA, 25 bp, Artificial Sequence
  Description of Artificial Sequence: Synthetic oligonucleotide
ccgcgggtatgtccagtacgcctac

SEQ ID NO: 43378 - DNA, 26 bp, Artificial Sequence
  Description of Artificial Sequence: Synthetic oligonucleotide
cgcgggtatgtccagtacgcctacga

SEQ ID NO: 43379 - DNA, 26 bp, Artificial Sequence
  Description of Artificial Sequence: Synthetic oligonucleotide
gcgggtatgtccagtacgcctacgac

SEQ ID NO: 43380 - DNA, 26 bp, Artificial Sequence
  Description of Artificial Sequence: Synthetic oligonucleotide
cgggtatgtccagtacgcctacgacg

SEQ ID NO: 43381 - DNA, 26 bp, Artificial Sequence
  Description of Artificial Sequence: Synthetic oligonucleotide
gggtatgtccagtacgcctacgacgg

SEQ ID NO: 43382 - DNA, 27 bp, Artificial Sequence
  Description of Artificial Sequence: Synthetic oligonucleotide
ggtatgtccagtacgcctacgacggca

SEQ ID NO: 43383 - DNA, 28 bp, Artificial Sequence
  Description of Artificial Sequence: Synthetic oligonucleotide
gtatgtccagtacgcctacgacggcaag

SEQ ID NO: 43384 - DNA, 28 bp, Artificial Sequence
  Description of Artificial Sequence: Synthetic oligonucleotide
tatgtccagtacgcctacgacggcaagg

SEQ ID NO: 43385 - DNA, 27 bp, Artificial Sequence
  Description of Artificial Sequence: Synthetic oligonucleotide
atgtccagtacgcctacgacggcaagg

SEQ ID NO: 43386 - DNA, 27 bp, Artificial Sequence
  Description of Artificial Sequence: Synthetic oligonucleotide
tgtccagtacgcctacgacggcaagga

SEQ ID NO: 43387 - DNA, 27 bp, Artificial Sequence
  Description of Artificial Sequence: Synthetic oligonucleotide
gtccagtacgcctacgacggcaaggat

SEQ ID NO: 43388 - DNA, 29 bp, Artificial Sequence
  Description of Artificial Sequence: Synthetic oligonucleotide
tccagtacgcctacgacggcaaggattac

SEQ ID NO: 43389 - DNA, 28 bp, Artificial Sequence
  Description of Artificial Sequence: Synthetic oligonucleotide
ggagtattgggaccgggagacacagaac

SEQ ID NO: 43390 - DNA, 30 bp, Artificial Sequence
  Description of Artificial Sequence: Synthetic oligonucleotide
gagtattgggaccgggagacacagaactac

SEQ ID NO: 43391 - DNA, 32 bp, Artificial Sequence
  Description of Artificial Sequence: Synthetic oligonucleotide
agtattgggaccgggagacacagaactacaag

SEQ ID NO: 43392 - DNA, 31 bp, Artificial Sequence
  Description of Artificial Sequence: Synthetic oligonucleotide
gtattgggaccgggagacacagaactacaag

SEQ ID NO: 43393 - DNA, 31 bp, Artificial Sequence
  Description of Artificial Sequence: Synthetic oligonucleotide
tattgggaccgggagacacagaactacaagc

SEQ ID NO: 43394 - DNA, 30 bp, Artificial Sequence
  Description of Artificial Sequence: Synthetic oligonucleotide
attgggaccgggagacacagaactacaagc

SEQ ID NO: 43395 - DNA, 29 bp, Artificial Sequence
  Description of Artificial Sequence: Synthetic oligonucleotide
ttgggaccgggagacacagaactacaagc

SEQ ID NO: 43396 - DNA, 28 bp, Artificial Sequence
  Description of Artificial Sequence: Synthetic oligonucleotide
tgggaccgggagacacagaactacaagc

SEQ ID NO: 43397 - DNA, 27 bp, Artificial Sequence
  Description of Artificial Sequence: Synthetic oligonucleotide
gggaccgggagacacagaactacaagc

SEQ ID NO: 43398 - DNA, 27 bp, Artificial Sequence
  Description of Artificial Sequence: Synthetic oligonucleotide
ggaccgggagacacagaactacaagcg

SEQ ID NO: 43399 - DNA, 27 bp, Artificial Sequence
  Description of Artificial Sequence: Synthetic oligonucleotide
gaccgggagacacagaactacaagcgc

SEQ ID NO: 43400 - DNA, 27 bp, Artificial Sequence
  Description of Artificial Sequence: Synthetic oligonucleotide
accgggagacacagaactacaagcgcc

SEQ ID NO: 43401 - DNA, 27 bp, Artificial Sequence
  Description of Artificial Sequence: Synthetic oligonucleotide
ccgggagacacagaactacaagcgcca

SEQ ID NO: 43402 - DNA, 27 bp, Artificial Sequence
  Description of Artificial Sequence: Synthetic oligonucleotide
cgggagacacagaactacaagcgccag

SEQ ID NO: 43403 - DNA, 27 bp, Artificial Sequence
  Description of Artificial Sequence: Synthetic oligonucleotide
gggagacacagaactacaagcgccagg

SEQ ID NO: 43404 - DNA, 27 bp, Artificial Sequence
  Description of Artificial Sequence: Synthetic oligonucleotide
ggagacacagaactacaagcgccaggc

SEQ ID NO: 43405 - DNA, 28 bp, Artificial Sequence
  Description of Artificial Sequence: Synthetic oligonucleotide
gagacacagaactacaagcgccaggcac

SEQ ID NO: 43406 - DNA, 29 bp, Artificial Sequence
  Description of Artificial Sequence: Synthetic oligonucleotide
agacacagaactacaagcgccaggcacag

SEQ ID NO: 43407 - DNA, 28 bp, Artificial Sequence
  Description of Artificial Sequence: Synthetic oligonucleotide
gacacagaactacaagcgccaggcacag

SEQ ID NO: 43408 - DNA, 29 bp, Artificial Sequence
  Description of Artificial Sequence: Synthetic oligonucleotide
acacagaactacaagcgccaggcacagac

SEQ ID NO: 43409 - DNA, 28 bp, Artificial Sequence
  Description of Artificial Sequence: Synthetic oligonucleotide
cacagaactacaagcgccaggcacagac

SEQ ID NO: 43410 - DNA, 29 bp, Artificial Sequence
  Description of Artificial Sequence: Synthetic oligonucleotide
acagaactacaagcgccaggcacagactg

SEQ ID NO: 43411 - DNA, 28 bp, Artificial Sequence
  Description of Artificial Sequence: Synthetic oligonucleotide
cagaactacaagcgccaggcacagactg

SEQ ID NO: 43412 - DNA, 29 bp, Artificial Sequence
  Description of Artificial Sequence: Synthetic oligonucleotide
agaactacaagcgccaggcacagactgac

SEQ ID NO: 43413 - DNA, 28 bp, Artificial Sequence
  Description of Artificial Sequence: Synthetic oligonucleotide
gaactacaagcgccaggcacagactgac

SEQ ID NO: 43414 - DNA, 28 bp, Artificial Sequence
  Description of Artificial Sequence: Synthetic oligonucleotide
aactacaagcgccaggcacagactgacc

SEQ ID NO: 43415 - DNA, 27 bp, Artificial Sequence
  Description of Artificial Sequence: Synthetic oligonucleotide
actacaagcgccaggcacagactgacc

SEQ ID NO: 43416 - DNA, 26 bp, Artificial Sequence
  Description of Artificial Sequence: Synthetic oligonucleotide
ctacaagcgccaggcacagactgacc

SEQ ID NO: 43417 - DNA, 27 bp, Artificial Sequence
  Description of Artificial Sequence: Synthetic oligonucleotide
cagactgaccgagtgagcctgcggaaa

SEQ ID NO: 43418 - DNA, 27 bp, Artificial Sequence
  Description of Artificial Sequence: Synthetic oligonucleotide
agactgaccgagtgagcctgcggaaac

SEQ ID NO: 43419 - DNA, 27 bp, Artificial Sequence
  Description of Artificial Sequence: Synthetic oligonucleotide
gactgaccgagtgagcctgcggaaact

SEQ ID NO: 43420 - DNA, 27 bp, Artificial Sequence
  Description of Artificial Sequence: Synthetic oligonucleotide
actgaccgagtgagcctgcggaaactg

SEQ ID NO: 43421 - DNA, 26 bp, Artificial Sequence
  Description of Artificial Sequence: Synthetic oligonucleotide
gcctcctccgcgggtatgaccagtta

SEQ ID NO: 43422 - DNA, 26 bp, Artificial Sequence
  Description of Artificial Sequence: Synthetic oligonucleotide
cctcctccgcgggtatgaccagttag

SEQ ID NO: 43423 - DNA, 26 bp, Artificial Sequence
  Description of Artificial Sequence: Synthetic oligonucleotide
ctcctccgcgggtatgaccagttagc

SEQ ID NO: 43424 - DNA, 27 bp, Artificial Sequence
  Description of Artificial Sequence: Synthetic oligonucleotide
tcctccgcgggtatgaccagttagcct

SEQ ID NO: 43425 - DNA, 27 bp, Artificial Sequence
  Description of Artificial Sequence: Synthetic oligonucleotide
cctccgcgggtatgaccagttagccta

SEQ ID NO: 43426 - DNA, 27 bp, Artificial Sequence
  Description of Artificial Sequence: Synthetic oligonucleotide
ctccgcgggtatgaccagttagcctac

SEQ ID NO: 43427 - DNA, 27 bp, Artificial Sequence
  Description of Artificial Sequence: Synthetic oligonucleotide
tccgcgggtatgaccagttagcctacg

SEQ ID NO: 43428 - DNA, 27 bp, Artificial Sequence
  Description of Artificial Sequence: Synthetic oligonucleotide
ccgcgggtatgaccagttagcctacga

SEQ ID NO: 43429 - DNA, 27 bp, Artificial Sequence
  Description of Artificial Sequence: Synthetic oligonucleotide
cgcgggtatgaccagttagcctacgac

SEQ ID NO: 43430 - DNA, 27 bp, Artificial Sequence
  Description of Artificial Sequence: Synthetic oligonucleotide
gcgggtatgaccagttagcctacgacg

SEQ ID NO: 43431 - DNA, 27 bp, Artificial Sequence
  Description of Artificial Sequence: Synthetic oligonucleotide
cgggtatgaccagttagcctacgacgg

SEQ ID NO: 43432 - DNA, 27 bp, Artificial Sequence
  Description of Artificial Sequence: Synthetic oligonucleotide
gggtatgaccagttagcctacgacggc

SEQ ID NO: 43433 - DNA, 29 bp, Artificial Sequence
  Description of Artificial Sequence: Synthetic oligonucleotide
ggtatgaccagttagcctacgacggcaag

SEQ ID NO: 43434 - DNA, 29 bp, Artificial Sequence
  Description of Artificial Sequence: Synthetic oligonucleotide
gtatgaccagttagcctacgacggcaagg

SEQ ID NO: 43435 - DNA, 33 bp, Artificial Sequence
  Description of Artificial Sequence: Synthetic oligonucleotide
tatgaccagttagcctacgacggcaaggattac

SEQ ID NO: 43436 - DNA, 26 bp, Artificial Sequence
  Description of Artificial Sequence: Synthetic oligonucleotide
gccaggtctcacaccctccagaggat

SEQ ID NO: 43437 - DNA, 27 bp, Artificial Sequence
  Description of Artificial Sequence: Synthetic oligonucleotide
ccaggtctcacaccctccagaggatgt

SEQ ID NO: 43438 - DNA, 29 bp, Artificial Sequence
  Description of Artificial Sequence: Synthetic oligonucleotide
caggtctcacaccctccagaggatgtatg

SEQ ID NO: 43439 - DNA, 29 bp, Artificial Sequence
  Description of Artificial Sequence: Synthetic oligonucleotide
aggtctcacaccctccagaggatgtatgg

SEQ ID NO: 43440 - DNA, 25 bp, Artificial Sequence
  Description of Artificial Sequence: Synthetic oligonucleotide
gccaggcacaggctgaccgagtgaa

SEQ ID NO: 43441 - DNA, 25 bp, Artificial Sequence
  Description of Artificial Sequence: Synthetic oligonucleotide
ccaggcacaggctgaccgagtgaac

SEQ ID NO: 43442 - DNA, 26 bp, Artificial Sequence
  Description of Artificial Sequence: Synthetic oligonucleotide
caggcacaggctgaccgagtgaacct

SEQ ID NO: 43443 - DNA, 26 bp, Artificial Sequence
  Description of Artificial Sequence: Synthetic oligonucleotide
aggcacaggctgaccgagtgaacctg

SEQ ID NO: 43444 - DNA, 25 bp, Artificial Sequence
  Description of Artificial Sequence: Synthetic oligonucleotide
ggcacaggctgaccgagtgaacctg

SEQ ID NO: 43445 - DNA, 25 bp, Artificial Sequence
  Description of Artificial Sequence: Synthetic oligonucleotide
gcacaggctgaccgagtgaacctgc

SEQ ID NO: 43446 - DNA, 25 bp, Artificial Sequence
  Description of Artificial Sequence: Synthetic oligonucleotide
cacaggctgaccgagtgaacctgcg

SEQ ID NO: 43447 - DNA, 27 bp, Artificial Sequence
  Description of Artificial Sequence: Synthetic oligonucleotide
acaggctgaccgagtgaacctgcggaa

SEQ ID NO: 43448 - DNA, 27 bp, Artificial Sequence
  Description of Artificial Sequence: Synthetic oligonucleotide
caggctgaccgagtgaacctgcggaaa

SEQ ID NO: 43449 - DNA, 27 bp, Artificial Sequence
  Description of Artificial Sequence: Synthetic oligonucleotide
aggctgaccgagtgaacctgcggaaac

SEQ ID NO: 43450 - DNA, 27 bp, Artificial Sequence
  Description of Artificial Sequence: Synthetic oligonucleotide
ggctgaccgagtgaacctgcggaaact

SEQ ID NO: 43451 - DNA, 27 bp, Artificial Sequence
  Description of Artificial Sequence: Synthetic oligonucleotide
gctgaccgagtgaacctgcggaaactg

SEQ ID NO: 43452 - DNA, 27 bp, Artificial Sequence
  Description of Artificial Sequence: Synthetic oligonucleotide
caaccagagcgaggacgggtctcacat

SEQ ID NO: 43453 - DNA, 27 bp, Artificial Sequence
  Description of Artificial Sequence: Synthetic oligonucleotide
aaccagagcgaggacgggtctcacatc

SEQ ID NO: 43454 - DNA, 26 bp, Artificial Sequence
  Description of Artificial Sequence: Synthetic oligonucleotide
accagagcgaggacgggtctcacatc

SEQ ID NO: 43455 - DNA, 25 bp, Artificial Sequence
  Description of Artificial Sequence: Synthetic oligonucleotide
ccagagcgaggacgggtctcacatc

SEQ ID NO: 43456 - DNA, 26 bp, Artificial Sequence
  Description of Artificial Sequence: Synthetic oligonucleotide
cagagcgaggacgggtctcacatcct

SEQ ID NO: 43457 - DNA, 26 bp, Artificial Sequence
  Description of Artificial Sequence: Synthetic oligonucleotide
agagcgaggacgggtctcacatcctc

SEQ ID NO: 43458 - DNA, 25 bp, Artificial Sequence
  Description of Artificial Sequence: Synthetic oligonucleotide
gagcgaggacgggtctcacatcctc

SEQ ID NO: 43459 - DNA, 26 bp, Artificial Sequence
  Description of Artificial Sequence: Synthetic oligonucleotide
agcgaggacgggtctcacatcctcca

SEQ ID NO: 43460 - DNA, 25 bp, Artificial Sequence
  Description of Artificial Sequence: Synthetic oligonucleotide
gcgaggacgggtctcacatcctcca

SEQ ID NO: 43461 - DNA, 26 bp, Artificial Sequence
  Description of Artificial Sequence: Synthetic oligonucleotide
cgaggacgggtctcacatcctccaga

SEQ ID NO: 43462 - DNA, 26 bp, Artificial Sequence
  Description of Artificial Sequence: Synthetic oligonucleotide
gaggacgggtctcacatcctccagag

SEQ ID NO: 43463 - DNA, 27 bp, Artificial Sequence
  Description of Artificial Sequence: Synthetic oligonucleotide
aggacgggtctcacatcctccagagga

SEQ ID NO: 43464 - DNA, 27 bp, Artificial Sequence
  Description of Artificial Sequence: Synthetic oligonucleotide
ggacgggtctcacatcctccagaggat

SEQ ID NO: 43465 - DNA, 27 bp, Artificial Sequence
  Description of Artificial Sequence: Synthetic oligonucleotide
gacgggtctcacatcctccagaggatg

SEQ ID NO: 43466 - DNA, 30 bp, Artificial Sequence
  Description of Artificial Sequence: Synthetic oligonucleotide
acgggtctcacatcctccagaggatgtatg

SEQ ID NO: 43467 - DNA, 24 bp, Artificial Sequence
  Description of Artificial Sequence: Synthetic oligonucleotide
atgcgggtcatggcgccctgaacc

SEQ ID NO: 43468 - DNA, 23 bp, Artificial Sequence
  Description of Artificial Sequence: Synthetic oligonucleotide
tgcgggtcatggcgccctgaacc

SEQ ID NO: 43469 - DNA, 22 bp, Artificial Sequence
  Description of Artificial Sequence: Synthetic oligonucleotide
gcgggtcatggcgccctgaacc

SEQ ID NO: 43470 - DNA, 23 bp, Artificial Sequence
  Description of Artificial Sequence: Synthetic oligonucleotide
cgggtcatggcgccctgaaccct

SEQ ID NO: 43471 - DNA, 25 bp, Artificial Sequence
  Description of Artificial Sequence: Synthetic oligonucleotide
gggtcatggcgccctgaaccctcat

SEQ ID NO: 43472 - DNA, 25 bp, Artificial Sequence
  Description of Artificial Sequence: Synthetic oligonucleotide
ggtcatggcgccctgaaccctcatc

SEQ ID NO: 43473 - DNA, 26 bp, Artificial Sequence
  Description of Artificial Sequence: Synthetic oligonucleotide
gtcatggcgccctgaaccctcatcct

SEQ ID NO: 43474 - DNA, 26 bp, Artificial Sequence
  Description of Artificial Sequence: Synthetic oligonucleotide
tcatggcgccctgaaccctcatcctg

SEQ ID NO: 43475 - DNA, 25 bp, Artificial Sequence
  Description of Artificial Sequence: Synthetic oligonucleotide
catggcgccctgaaccctcatcctg

SEQ ID NO: 43476 - DNA, 26 bp, Artificial Sequence
  Description of Artificial Sequence: Synthetic oligonucleotide
atggcgccctgaaccctcatcctgct

SEQ ID NO: 43477 - DNA, 25 bp, Artificial Sequence
  Description of Artificial Sequence: Synthetic oligonucleotide
tggcgccctgaaccctcatcctgct

SEQ ID NO: 43478 - DNA, 24 bp, Artificial Sequence
  Description of Artificial Sequence: Synthetic oligonucleotide
ggcgccctgaaccctcatcctgct

SEQ ID NO: 43479 - DNA, 24 bp, Artificial Sequence
  Description of Artificial Sequence: Synthetic oligonucleotide
gcgccctgaaccctcatcctgctg

SEQ ID NO: 43480 - DNA, 25 bp, Artificial Sequence
  Description of Artificial Sequence: Synthetic oligonucleotide
cgccctgaaccctcatcctgctgct

SEQ ID NO: 43481 - DNA, 26 bp, Artificial Sequence
  Description of Artificial Sequence: Synthetic oligonucleotide
gccctgaaccctcatcctgctgctct

SEQ ID NO: 43482 - DNA, 26 bp, Artificial Sequence
  Description of Artificial Sequence: Synthetic oligonucleotide
ccctgaaccctcatcctgctgctctc

SEQ ID NO: 43483 - DNA, 26 bp, Artificial Sequence
  Description of Artificial Sequence: Synthetic oligonucleotide
cctgaaccctcatcctgctgctctcg

SEQ ID NO: 43484 - DNA, 26 bp, Artificial Sequence
  Description of Artificial Sequence: Synthetic oligonucleotide
ctgaaccctcatcctgctgctctcgg

SEQ ID NO: 43485 - DNA, 27 bp, Artificial Sequence
  Description of Artificial Sequence: Synthetic oligonucleotide
tgaaccctcatcctgctgctctcggga

SEQ ID NO: 43486 - DNA, 33 bp, Artificial Sequence
  Description of Artificial Sequence: Synthetic oligonucleotide
aggtctcacatcatccagaggatgtatggctac

SEQ ID NO: 43487 - DNA, 32 bp, Artificial Sequence
  Description of Artificial Sequence: Synthetic oligonucleotide
ggtctcacatcatccagaggatgtatggctac

SEQ ID NO: 43488 - DNA, 32 bp, Artificial Sequence
  Description of Artificial Sequence: Synthetic oligonucleotide
gtctcacatcatccagaggatgtatggctacg

SEQ ID NO: 43489 - DNA, 33 bp, Artificial Sequence
  Description of Artificial Sequence: Synthetic oligonucleotide
tctcacatcatccagaggatgtatggctacgac

SEQ ID NO: 43490 - DNA, 32 bp, Artificial Sequence
  Description of Artificial Sequence: Synthetic oligonucleotide
ctcacatcatccagaggatgtatggctacgac

SEQ ID NO: 43491 - DNA, 32 bp, Artificial Sequence
  Description of Artificial Sequence: Synthetic oligonucleotide
tcacatcatccagaggatgtatggctacgacg

SEQ ID NO: 43492 - DNA, 31 bp, Artificial Sequence
  Description of Artificial Sequence: Synthetic oligonucleotide
cacatcatccagaggatgtatggctacgacg

SEQ ID NO: 43493 - DNA, 32 bp, Artificial Sequence
  Description of Artificial Sequence: Synthetic oligonucleotide
acatcatccagaggatgtatggctacgacgtg

SEQ ID NO: 43494 - DNA, 31 bp, Artificial Sequence
  Description of Artificial Sequence: Synthetic oligonucleotide
catcatccagaggatgtatggctacgacgtg

SEQ ID NO: 43495 - DNA, 31 bp, Artificial Sequence
  Description of Artificial Sequence: Synthetic oligonucleotide
atcatccagaggatgtatggctacgacgtgg

SEQ ID NO: 43496 - DNA, 30 bp, Artificial Sequence
  Description of Artificial Sequence: Synthetic oligonucleotide
tcatccagaggatgtatggctacgacgtgg

SEQ ID NO: 43497 - DNA, 29 bp, Artificial Sequence
  Description of Artificial Sequence: Synthetic oligonucleotide
catccagaggatgtatggctacgacgtgg

SEQ ID NO: 43498 - DNA, 29 bp, Artificial Sequence
  Description of Artificial Sequence: Synthetic oligonucleotide
atccagaggatgtatggctacgacgtggg

SEQ ID NO: 43499 - DNA, 28 bp, Artificial Sequence
  Description of Artificial Sequence: Synthetic oligonucleotide
tccagaggatgtatggctacgacgtggg

SEQ ID NO: 43500 - DNA, 27 bp, Artificial Sequence
  Description of Artificial Sequence: Synthetic oligonucleotide
ccagaggatgtatggctacgacgtggg

SEQ ID NO: 43501 - DNA, 27 bp, Artificial Sequence
  Description of Artificial Sequence: Synthetic oligonucleotide
cagaggatgtatggctacgacgtgggg

SEQ ID NO: 43502 - DNA, 27 bp, Artificial Sequence
  Description of Artificial Sequence: Synthetic oligonucleotide
agaggatgtatggctacgacgtggggc

SEQ ID NO: 43503 - DNA, 26 bp, Artificial Sequence
  Description of Artificial Sequence: Synthetic oligonucleotide
gaggatgtatggctacgacgtggggc

SEQ ID NO: 43504 - DNA, 26 bp, Artificial Sequence
  Description of Artificial Sequence: Synthetic oligonucleotide
aggatgtatggctacgacgtggggcc

SEQ ID NO: 43505 - DNA, 25 bp, Artificial Sequence
  Description of Artificial Sequence: Synthetic oligonucleotide
ggatgtatggctacgacgtggggcc

SEQ ID NO: 43506 - DNA, 25 bp, Artificial Sequence
  Description of Artificial Sequence: Synthetic oligonucleotide
gatgtatggctacgacgtggggccc

SEQ ID NO: 43507 - DNA, 26 bp, Artificial Sequence
  Description of Artificial Sequence: Synthetic oligonucleotide
atgtatggctacgacgtggggcccga

SEQ ID NO: 43508 - DNA, 25 bp, Artificial Sequence
  Description of Artificial Sequence: Synthetic oligonucleotide
tgtatggctacgacgtggggcccga

SEQ ID NO: 43509 - DNA, 24 bp, Artificial Sequence
  Description of Artificial Sequence: Synthetic oligonucleotide
gtatggctacgacgtggggcccga

SEQ ID NO: 43510 - DNA, 24 bp, Artificial Sequence
  Description of Artificial Sequence: Synthetic oligonucleotide
tatggctacgacgtggggcccgac

SEQ ID NO: 43511 - DNA, 23 bp, Artificial Sequence
  Description of Artificial Sequence: Synthetic oligonucleotide
atggctacgacgtggggcccgac

SEQ ID NO: 43512 - DNA, 22 bp, Artificial Sequence
  Description of Artificial Sequence: Synthetic oligonucleotide
tggctacgacgtggggcccgac

SEQ ID NO: 43513 - DNA, 21 bp, Artificial Sequence
  Description of Artificial Sequence: Synthetic oligonucleotide
ggctacgacgtggggcccgac

SEQ ID NO: 43514 - DNA, 21 bp, Artificial Sequence
  Description of Artificial Sequence: Synthetic oligonucleotide
gctacgacgtggggcccgacg

SEQ ID NO: 43515 - DNA, 21 bp, Artificial Sequence
  Description of Artificial Sequence: Synthetic oligonucleotide
ctacgacgtggggcccgacgg

SEQ ID NO: 43516 - DNA, 21 bp, Artificial Sequence
  Description of Artificial Sequence: Synthetic oligonucleotide
tacgacgtggggcccgacggg

SEQ ID NO: 43517 - DNA, 20 bp, Artificial Sequence
  Description of Artificial Sequence: Synthetic oligonucleotide
acgacgtggggcccgacggg

SEQ ID NO: 43518 - DNA, 24 bp, Artificial Sequence
  Description of Artificial Sequence: Synthetic oligonucleotide
cagtgggctacgtggacgacacgc

SEQ ID NO: 43519 - DNA, 24 bp, Artificial Sequence
  Description of Artificial Sequence: Synthetic oligonucleotide
agtgggctacgtggacgacacgcg

SEQ ID NO: 43520 - DNA, 23 bp, Artificial Sequence
  Description of Artificial Sequence: Synthetic oligonucleotide
gtgggctacgtggacgacacgcg

SEQ ID NO: 43521 - DNA, 25 bp, Artificial Sequence
  Description of Artificial Sequence: Synthetic oligonucleotide
tgggctacgtggacgacacgcggtt

SEQ ID NO: 43522 - DNA, 24 bp, Artificial Sequence
  Description of Artificial Sequence: Synthetic oligonucleotide
gggctacgtggacgacacgcggtt

SEQ ID NO: 43523 - DNA, 24 bp, Artificial Sequence
  Description of Artificial Sequence: Synthetic oligonucleotide
ggctacgtggacgacacgcggttc

SEQ ID NO: 43524 - DNA, 25 bp, Artificial Sequence
  Description of Artificial Sequence: Synthetic oligonucleotide
gctacgtggacgacacgcggttcgt

SEQ ID NO: 43525 - DNA, 25 bp, Artificial Sequence
  Description of Artificial Sequence: Synthetic oligonucleotide
ctacgtggacgacacgcggttcgtg

SEQ ID NO: 43526 - DNA, 25 bp, Artificial Sequence
  Description of Artificial Sequence: Synthetic oligonucleotide
tacgtggacgacacgcggttcgtgc

SEQ ID NO: 43527 - DNA, 24 bp, Artificial Sequence
  Description of Artificial Sequence: Synthetic oligonucleotide
acgtggacgacacgcggttcgtgc

SEQ ID NO: 43528 - DNA, 23 bp, Artificial Sequence
  Description of Artificial Sequence: Synthetic oligonucleotide
cgtggacgacacgcggttcgtgc

SEQ ID NO: 43529 - DNA, 23 bp, Artificial Sequence
  Description of Artificial Sequence: Synthetic oligonucleotide
gtggacgacacgcggttcgtgcg

SEQ ID NO: 43530 - DNA, 25 bp, Artificial Sequence
  Description of Artificial Sequence: Synthetic oligonucleotide
tggacgacacgcggttcgtgcggtt

SEQ ID NO: 43531 - DNA, 24 bp, Artificial Sequence
  Description of Artificial Sequence: Synthetic oligonucleotide
ggacgacacgcggttcgtgcggtt

SEQ ID NO: 43532 - DNA, 24 bp, Artificial Sequence
  Description of Artificial Sequence: Synthetic oligonucleotide
gacgacacgcggttcgtgcggttc

SEQ ID NO: 43533 - DNA, 25 bp, Artificial Sequence
  Description of Artificial Sequence: Synthetic oligonucleotide
acgacacgcggttcgtgcggttcga

SEQ ID NO: 43534 - DNA, 24 bp, Artificial Sequence
  Description of Artificial Sequence: Synthetic oligonucleotide
cgacacgcggttcgtgcggttcga

SEQ ID NO: 43535 - DNA, 25 bp, Artificial Sequence
  Description of Artificial Sequence: Synthetic oligonucleotide
gacacgcggttcgtgcggttcgaca

SEQ ID NO: 43536 - DNA, 25 bp, Artificial Sequence
  Description of Artificial Sequence: Synthetic oligonucleotide
acacgcggttcgtgcggttcgacag

SEQ ID NO: 43537 - DNA, 24 bp, Artificial Sequence
  Description of Artificial Sequence: Synthetic oligonucleotide
cacgcggttcgtgcggttcgacag

SEQ ID NO: 43538 - DNA, 24 bp, Artificial Sequence
  Description of Artificial Sequence: Synthetic oligonucleotide
acgcggttcgtgcggttcgacagc

SEQ ID NO: 43539 - DNA, 23 bp, Artificial Sequence
  Description of Artificial Sequence: Synthetic oligonucleotide
cgcggttcgtgcggttcgacagc

SEQ ID NO: 43540 - DNA, 24 bp, Artificial Sequence
  Description of Artificial Sequence: Synthetic oligonucleotide
gcggttcgtgcggttcgacagcga

SEQ ID NO: 43541 - DNA, 24 bp, Artificial Sequence
  Description of Artificial Sequence: Synthetic oligonucleotide
cggttcgtgcggttcgacagcgac

SEQ ID NO: 43542 - DNA, 24 bp, Artificial Sequence
  Description of Artificial Sequence: Synthetic oligonucleotide
ggttcgtgcggttcgacagcgacg

SEQ ID NO: 43543 - DNA, 27 bp, Artificial Sequence
  Description of Artificial Sequence: Synthetic oligonucleotide
catcgccctgaacgaggatctgcgctt

SEQ ID NO: 43544 - DNA, 27 bp, Artificial Sequence
  Description of Artificial Sequence: Synthetic oligonucleotide
atcgccctgaacgaggatctgcgcttc

SEQ ID NO: 43545 - DNA, 27 bp, Artificial Sequence
  Description of Artificial Sequence: Synthetic oligonucleotide
tcgccctgaacgaggatctgcgcttct

SEQ ID NO: 43546 - DNA, 26 bp, Artificial Sequence
  Description of Artificial Sequence: Synthetic oligonucleotide
cgccctgaacgaggatctgcgcttct

SEQ ID NO: 43547 - DNA, 26 bp, Artificial Sequence
  Description of Artificial Sequence: Synthetic oligonucleotide
gccctgaacgaggatctgcgcttctg

SEQ ID NO: 43548 - DNA, 27 bp, Artificial Sequence
  Description of Artificial Sequence: Synthetic oligonucleotide
ccctgaacgaggatctgcgcttctgga

SEQ ID NO: 43549 - DNA, 27 bp, Artificial Sequence
  Description of Artificial Sequence: Synthetic oligonucleotide
cctgaacgaggatctgcgcttctggac

SEQ ID NO: 43550 - DNA, 27 bp, Artificial Sequence
  Description of Artificial Sequence: Synthetic oligonucleotide
ctgaacgaggatctgcgcttctggacc

SEQ ID NO: 43551 - DNA, 27 bp, Artificial Sequence
  Description of Artificial Sequence: Synthetic oligonucleotide
tgaacgaggatctgcgcttctggaccg

SEQ ID NO: 43552 - DNA, 26 bp, Artificial Sequence
  Description of Artificial Sequence: Synthetic oligonucleotide
gaacgaggatctgcgcttctggaccg

SEQ ID NO: 43553 - DNA, 26 bp, Artificial Sequence
  Description of Artificial Sequence: Synthetic oligonucleotide
aacgaggatctgcgcttctggaccgc

SEQ ID NO: 43554 - DNA, 25 bp, Artificial Sequence
  Description of Artificial Sequence: Synthetic oligonucleotide
acgaggatctgcgcttctggaccgc

SEQ ID NO: 43555 - DNA, 24 bp, Artificial Sequence
  Description of Artificial Sequence: Synthetic oligonucleotide
cgaggatctgcgcttctggaccgc

SEQ ID NO: 43556 - DNA, 24 bp, Artificial Sequence
  Description of Artificial Sequence: Synthetic oligonucleotide
gaggatctgcgcttctggaccgcc

SEQ ID NO: 43557 - DNA, 24 bp, Artificial Sequence
  Description of Artificial Sequence: Synthetic oligonucleotide
aggatctgcgcttctggaccgccg

SEQ ID NO: 43558 - DNA, 23 bp, Artificial Sequence
  Description of Artificial Sequence: Synthetic oligonucleotide
ggatctgcgcttctggaccgccg

SEQ ID NO: 43559 - DNA, 23 bp, Artificial Sequence
  Description of Artificial Sequence: Synthetic oligonucleotide
gatctgcgcttctggaccgccgc

SEQ ID NO: 43560 - DNA, 23 bp, Artificial Sequence
  Description of Artificial Sequence: Synthetic oligonucleotide
atctgcgcttctggaccgccgcg

SEQ ID NO: 43561 - DNA, 22 bp, Artificial Sequence
  Description of Artificial Sequence: Synthetic oligonucleotide
tctgcgcttctggaccgccgcg

SEQ ID NO: 43562 - DNA, 21 bp, Artificial Sequence
  Description of Artificial Sequence: Synthetic oligonucleotide
ctgcgcttctggaccgccgcg

SEQ ID NO: 43563 - DNA, 22 bp, Artificial Sequence
  Description of Artificial Sequence: Synthetic oligonucleotide
tgcgcttctggaccgccgcgga

SEQ ID NO: 43564 - DNA, 21 bp, Artificial Sequence
  Description of Artificial Sequence: Synthetic oligonucleotide
gcgcttctggaccgccgcgga

SEQ ID NO: 43565 - DNA, 22 bp, Artificial Sequence
  Description of Artificial Sequence: Synthetic oligonucleotide
cgcttctggaccgccgcggaca

SEQ ID NO: 43566 - DNA, 22 bp, Artificial Sequence
  Description of Artificial Sequence: Synthetic oligonucleotide
gcttctggaccgccgcggacac

SEQ ID NO: 43567 - DNA, 22 bp, Artificial Sequence
  Description of Artificial Sequence: Synthetic oligonucleotide
cttctggaccgccgcggacacg

SEQ ID NO: 43568 - DNA, 22 bp, Artificial Sequence
  Description of Artificial Sequence: Synthetic oligonucleotide
ttctggaccgccgcggacacgg

SEQ ID NO: 43569 - DNA, 21 bp, Artificial Sequence
  Description of Artificial Sequence: Synthetic oligonucleotide
tctggaccgccgcggacacgg

SEQ ID NO: 43570 - DNA, 25 bp, Artificial Sequence
  Description of Artificial Sequence: Synthetic oligonucleotide
gcctcctccgcgggtatgaccagtt

SEQ ID NO: 43571 - DNA, 25 bp, Artificial Sequence
  Description of Artificial Sequence: Synthetic oligonucleotide
cctcctccgcgggtatgaccagttc

SEQ ID NO: 43572 - DNA, 25 bp, Artificial Sequence
  Description of Artificial Sequence: Synthetic oligonucleotide
ctcctccgcgggtatgaccagttcg

SEQ ID NO: 43573 - DNA, 25 bp, Artificial Sequence
  Description of Artificial Sequence: Synthetic oligonucleotide
tcctccgcgggtatgaccagttcgc

SEQ ID NO: 43574 - DNA, 24 bp, Artificial Sequence
  Description of Artificial Sequence: Synthetic oligonucleotide
cctccgcgggtatgaccagttcgc

SEQ ID NO: 43575 - DNA, 26 bp, Artificial Sequence
  Description of Artificial Sequence: Synthetic oligonucleotide
ctccgcgggtatgaccagttcgccta

SEQ ID NO: 43576 - DNA, 26 bp, Artificial Sequence
  Description of Artificial Sequence: Synthetic oligonucleotide
tccgcgggtatgaccagttcgcctac

SEQ ID NO: 43577 - DNA, 25 bp, Artificial Sequence
  Description of Artificial Sequence: Synthetic oligonucleotide
ccgcgggtatgaccagttcgcctac

SEQ ID NO: 43578 - DNA, 26 bp, Artificial Sequence
  Description of Artificial Sequence: Synthetic oligonucleotide
cgcgggtatgaccagttcgcctacga

SEQ ID NO: 43579 - DNA, 26 bp, Artificial Sequence
  Description of Artificial Sequence: Synthetic oligonucleotide
gcgggtatgaccagttcgcctacgac

SEQ ID NO: 43580 - DNA, 26 bp, Artificial Sequence
  Description of Artificial Sequence: Synthetic oligonucleotide
cgggtatgaccagttcgcctacgacg

SEQ ID NO: 43581 - DNA, 26 bp, Artificial Sequence
  Description of Artificial Sequence: Synthetic oligonucleotide
gggtatgaccagttcgcctacgacgg

SEQ ID NO: 43582 - DNA, 27 bp, Artificial Sequence
  Description of Artificial Sequence: Synthetic oligonucleotide
ggtatgaccagttcgcctacgacggca

SEQ ID NO: 43583 - DNA, 28 bp, Artificial Sequence
  Description of Artificial Sequence: Synthetic oligonucleotide
gtatgaccagttcgcctacgacggcaag

SEQ ID NO: 43584 - DNA, 28 bp, Artificial Sequence
  Description of Artificial Sequence: Synthetic oligonucleotide
tatgaccagttcgcctacgacggcaagg

SEQ ID NO: 43585 - DNA, 27 bp, Artificial Sequence
  Description of Artificial Sequence: Synthetic oligonucleotide
accagagcgaggacgggtctcacatca

SEQ ID NO: 43586 - DNA, 27 bp, Artificial Sequence
  Description of Artificial Sequence: Synthetic oligonucleotide
ccagagcgaggacgggtctcacatcat

SEQ ID NO: 43587 - DNA, 27 bp, Artificial Sequence
  Description of Artificial Sequence: Synthetic oligonucleotide
cagagcgaggacgggtctcacatcatc

SEQ ID NO: 43588 - DNA, 27 bp, Artificial Sequence
  Description of Artificial Sequence: Synthetic oligonucleotide
agagcgaggacgggtctcacatcatcc

SEQ ID NO: 43589 - DNA, 27 bp, Artificial Sequence
  Description of Artificial Sequence: Synthetic oligonucleotide
gagcgaggacgggtctcacatcatcca

SEQ ID NO: 43590 - DNA, 27 bp, Artificial Sequence
  Description of Artificial Sequence: Synthetic oligonucleotide
agcgaggacgggtctcacatcatccag

SEQ ID NO: 43591 - DNA, 27 bp, Artificial Sequence
  Description of Artificial Sequence: Synthetic oligonucleotide
gcgaggacgggtctcacatcatccaga

SEQ ID NO: 43592 - DNA, 27 bp, Artificial Sequence
  Description of Artificial Sequence: Synthetic oligonucleotide
cgaggacgggtctcacatcatccagag

SEQ ID NO: 43593 - DNA, 27 bp, Artificial Sequence
  Description of Artificial Sequence: Synthetic oligonucleotide
gaggacgggtctcacatcatccagagg

SEQ ID NO: 43594 - DNA, 29 bp, Artificial Sequence
  Description of Artificial Sequence: Synthetic oligonucleotide
aggacgggtctcacatcatccagaggatg

SEQ ID NO: 43595 - DNA, 28 bp, Artificial Sequence
  Description of Artificial Sequence: Synthetic oligonucleotide
ggacgggtctcacatcatccagaggatg

SEQ ID NO: 43596 - DNA, 31 bp, Artificial Sequence
  Description of Artificial Sequence: Synthetic oligonucleotide
gacgggtctcacatcatccagaggatgtatg

SEQ ID NO: 43597 - DNA, 31 bp, Artificial Sequence
  Description of Artificial Sequence: Synthetic oligonucleotide
acgggtctcacatcatccagaggatgtatgg

SEQ ID NO: 43598 - DNA, 22 bp, Artificial Sequence
  Description of Artificial Sequence: Synthetic oligonucleotide
agcctgcggaacctgcgcggct

SEQ ID NO: 43599 - DNA, 21 bp, Artificial Sequence
  Description of Artificial Sequence: Synthetic oligonucleotide
gcctgcggaacctgcgcggct

SEQ ID NO: 43600 - DNA, 21 bp, Artificial Sequence
  Description of Artificial Sequence: Synthetic oligonucleotide
cctgcggaacctgcgcggctg

SEQ ID NO: 43601 - DNA, 23 bp, Artificial Sequence
  Description of Artificial Sequence: Synthetic oligonucleotide
ctgcggaacctgcgcggctgcta

SEQ ID NO: 43602 - DNA, 25 bp, Artificial Sequence
  Description of Artificial Sequence: Synthetic oligonucleotide
tgcggaacctgcgcggctgctacaa

SEQ ID NO: 43603 - DNA, 24 bp, Artificial Sequence
  Description of Artificial Sequence: Synthetic oligonucleotide
gcggaacctgcgcggctgctacaa

SEQ ID NO: 43604 - DNA, 24 bp, Artificial Sequence
  Description of Artificial Sequence: Synthetic oligonucleotide
cggaacctgcgcggctgctacaac

SEQ ID NO: 43605 - DNA, 25 bp, Artificial Sequence
  Description of Artificial Sequence: Synthetic oligonucleotide
ggaacctgcgcggctgctacaacca

SEQ ID NO: 43606 - DNA, 26 bp, Artificial Sequence
  Description of Artificial Sequence: Synthetic oligonucleotide
gaacctgcgcggctgctacaaccaga

SEQ ID NO: 43607 - DNA, 26 bp, Artificial Sequence
  Description of Artificial Sequence: Synthetic oligonucleotide
aacctgcgcggctgctacaaccagag

SEQ ID NO: 43608 - DNA, 25 bp, Artificial Sequence
  Description of Artificial Sequence: Synthetic oligonucleotide
acctgcgcggctgctacaaccagag

SEQ ID NO: 43609 - DNA, 24 bp, Artificial Sequence
  Description of Artificial Sequence: Synthetic oligonucleotide
cctgcgcggctgctacaaccagag

SEQ ID NO: 43610 - DNA, 24 bp, Artificial Sequence
  Description of Artificial Sequence: Synthetic oligonucleotide
ctgcgcggctgctacaaccagagc

SEQ ID NO: 43611 - DNA, 25 bp, Artificial Sequence
  Description of Artificial Sequence: Synthetic oligonucleotide
tgcgcggctgctacaaccagagcga

SEQ ID NO: 43612 - DNA, 24 bp, Artificial Sequence
  Description of Artificial Sequence: Synthetic oligonucleotide
gcgcggctgctacaaccagagcga

SEQ ID NO: 43613 - DNA, 24 bp, Artificial Sequence
  Description of Artificial Sequence: Synthetic oligonucleotide
cgcggctgctacaaccagagcgag

SEQ ID NO: 43614 - DNA, 24 bp, Artificial Sequence
  Description of Artificial Sequence: Synthetic oligonucleotide
gcggctgctacaaccagagcgagg

SEQ ID NO: 43615 - DNA, 24 bp, Artificial Sequence
  Description of Artificial Sequence: Synthetic oligonucleotide
cggctgctacaaccagagcgaggc

SEQ ID NO: 43616 - DNA, 24 bp, Artificial Sequence
  Description of Artificial Sequence: Synthetic oligonucleotide
ggctgctacaaccagagcgaggcc

SEQ ID NO: 43617 - DNA, 25 bp, Artificial Sequence
  Description of Artificial Sequence: Synthetic oligonucleotide
ctcctccgcgggtatgaccagtacc

SEQ ID NO: 43618 - DNA, 25 bp, Artificial Sequence
  Description of Artificial Sequence: Synthetic oligonucleotide
tcctccgcgggtatgaccagtaccc

SEQ ID NO: 43619 - DNA, 24 bp, Artificial Sequence
  Description of Artificial Sequence: Synthetic oligonucleotide
cctccgcgggtatgaccagtaccc

SEQ ID NO: 43620 - DNA, 26 bp, Artificial Sequence
  Description of Artificial Sequence: Synthetic oligonucleotide
ctccgcgggtatgaccagtaccccta

SEQ ID NO: 43621 - DNA, 26 bp, Artificial Sequence
  Description of Artificial Sequence: Synthetic oligonucleotide
tccgcgggtatgaccagtacccctac

SEQ ID NO: 43622 - DNA, 25 bp, Artificial Sequence
  Description of Artificial Sequence: Synthetic oligonucleotide
ccgcgggtatgaccagtacccctac

SEQ ID NO: 43623 - DNA, 26 bp, Artificial Sequence
  Description of Artificial Sequence: Synthetic oligonucleotide
cgcgggtatgaccagtacccctacga

SEQ ID NO: 43624 - DNA, 26 bp, Artificial Sequence
  Description of Artificial Sequence: Synthetic oligonucleotide
gcgggtatgaccagtacccctacgac

SEQ ID NO: 43625 - DNA, 26 bp, Artificial Sequence
  Description of Artificial Sequence: Synthetic oligonucleotide
cgggtatgaccagtacccctacgacg

SEQ ID NO: 43626 - DNA, 26 bp, Artificial Sequence
  Description of Artificial Sequence: Synthetic oligonucleotide
gggtatgaccagtacccctacgacgg

SEQ ID NO: 43627 - DNA, 27 bp, Artificial Sequence
  Description of Artificial Sequence: Synthetic oligonucleotide
ggtatgaccagtacccctacgacggca

SEQ ID NO: 43628 - DNA, 28 bp, Artificial Sequence
  Description of Artificial Sequence: Synthetic oligonucleotide
gtatgaccagtacccctacgacggcaag

SEQ ID NO: 43629 - DNA, 28 bp, Artificial Sequence
  Description of Artificial Sequence: Synthetic oligonucleotide
tatgaccagtacccctacgacggcaagg

SEQ ID NO: 43630 - DNA, 27 bp, Artificial Sequence
  Description of Artificial Sequence: Synthetic oligonucleotide
atgaccagtacccctacgacggcaagg

SEQ ID NO: 43631 - DNA, 27 bp, Artificial Sequence
  Description of Artificial Sequence: Synthetic oligonucleotide
tgaccagtacccctacgacggcaagga

SEQ ID NO: 43632 - DNA, 27 bp, Artificial Sequence
  Description of Artificial Sequence: Synthetic oligonucleotide
gaccagtacccctacgacggcaaggat

SEQ ID NO: 43633 - DNA, 29 bp, Artificial Sequence
  Description of Artificial Sequence: Synthetic oligonucleotide
accagtacccctacgacggcaaggattac

SEQ ID NO: 43634 - DNA, 28 bp, Artificial Sequence
  Description of Artificial Sequence: Synthetic oligonucleotide
ccagtacccctacgacggcaaggattac

SEQ ID NO: 43635 - DNA, 30 bp, Artificial Sequence
  Description of Artificial Sequence: Synthetic oligonucleotide
cagtacccctacgacggcaaggattacatc

SEQ ID NO: 43636 - DNA, 30 bp, Artificial Sequence
  Description of Artificial Sequence: Synthetic oligonucleotide
agtacccctacgacggcaaggattacatcg

SEQ ID NO: 43637 - DNA, 29 bp, Artificial Sequence
  Description of Artificial Sequence: Synthetic oligonucleotide
gtacccctacgacggcaaggattacatcg

SEQ ID NO: 43638 - DNA, 29 bp, Artificial Sequence
  Description of Artificial Sequence: Synthetic oligonucleotide
tacccctacgacggcaaggattacatcgc

SEQ ID NO: 43639 - DNA, 28 bp, Artificial Sequence
  Description of Artificial Sequence: Synthetic oligonucleotide
acccctacgacggcaaggattacatcgc

SEQ ID NO: 43640 - DNA, 27 bp, Artificial Sequence
  Description of Artificial Sequence: Synthetic oligonucleotide
cccctacgacggcaaggattacatcgc

SEQ ID NO: 43641 - DNA, 27 bp, Artificial Sequence
  Description of Artificial Sequence: Synthetic oligonucleotide
ccctacgacggcaaggattacatcgcc

SEQ ID NO: 43642 - DNA, 20 bp, Artificial Sequence
  Description of Artificial Sequence: Synthetic oligonucleotide
cgggcgccgtgggtggagga

SEQ ID NO: 43643 - DNA, 20 bp, Artificial Sequence
  Description of Artificial Sequence: Synthetic oligonucleotide
gggcgccgtgggtggaggag

SEQ ID NO: 43644 - DNA, 20 bp, Artificial Sequence
  Description of Artificial Sequence: Synthetic oligonucleotide
ggcgccgtgggtggaggagg

SEQ ID NO: 43645 - DNA, 20 bp, Artificial Sequence
  Description of Artificial Sequence: Synthetic oligonucleotide
gcgccgtgggtggaggaggg

SEQ ID NO: 43646 - DNA, 20 bp, Artificial Sequence
  Description of Artificial Sequence: Synthetic oligonucleotide
cgccgtgggtggaggagggg

SEQ ID NO: 43647 - DNA, 20 bp, Artificial Sequence
  Description of Artificial Sequence: Synthetic oligonucleotide
gccgtgggtggaggaggggc

SEQ ID NO: 43648 - DNA, 20 bp, Artificial Sequence
  Description of Artificial Sequence: Synthetic oligonucleotide
ccgtgggtggaggaggggcc

SEQ ID NO: 43649 - DNA, 20 bp, Artificial Sequence
  Description of Artificial Sequence: Synthetic oligonucleotide
cgtgggtggaggaggggccg

SEQ ID NO: 43650 - DNA, 21 bp, Artificial Sequence
  Description of Artificial Sequence: Synthetic oligonucleotide
gtgggtggaggaggggccgga

SEQ ID NO: 43651 - DNA, 25 bp, Artificial Sequence
  Description of Artificial Sequence: Synthetic oligonucleotide
tgggtggaggaggggccggagtatt

SEQ ID NO: 43652 - DNA, 24 bp, Artificial Sequence
  Description of Artificial Sequence: Synthetic oligonucleotide
gggtggaggaggggccggagtatt

SEQ ID NO: 43653 - DNA, 24 bp, Artificial Sequence
  Description of Artificial Sequence: Synthetic oligonucleotide
ggtggaggaggggccggagtattg

SEQ ID NO: 43654 - DNA, 24 bp, Artificial Sequence
  Description of Artificial Sequence: Synthetic oligonucleotide
gtggaggaggggccggagtattgg

SEQ ID NO: 43655 - DNA, 25 bp, Artificial Sequence
  Description of Artificial Sequence: Synthetic oligonucleotide
tggaggaggggccggagtattggga

SEQ ID NO: 43656 - DNA, 24 bp, Artificial Sequence
  Description of Artificial Sequence: Synthetic oligonucleotide
ggaggaggggccggagtattggga

SEQ ID NO: 43657 - DNA, 24 bp, Artificial Sequence
  Description of Artificial Sequence: Synthetic oligonucleotide
gaggaggggccggagtattgggac

SEQ ID NO: 43658 - DNA, 31 bp, Artificial Sequence
  Description of Artificial Sequence: Synthetic oligonucleotide
tcccactccaagaggtatttctacaccgctg

SEQ ID NO: 43659 - DNA, 30 bp, Artificial Sequence
  Description of Artificial Sequence: Synthetic oligonucleotide
cccactccaagaggtatttctacaccgctg

SEQ ID NO: 43660 - DNA, 31 bp, Artificial Sequence
  Description of Artificial Sequence: Synthetic oligonucleotide
ccactccaagaggtatttctacaccgctgtg

SEQ ID NO: 43661 - DNA, 32 bp, Artificial Sequence
  Description of Artificial Sequence: Synthetic oligonucleotide
cactccaagaggtatttctacaccgctgtgtc

SEQ ID NO: 43662 - DNA, 32 bp, Artificial Sequence
  Description of Artificial Sequence: Synthetic oligonucleotide
actccaagaggtatttctacaccgctgtgtcc

SEQ ID NO: 43663 - DNA, 31 bp, Artificial Sequence
  Description of Artificial Sequence: Synthetic oligonucleotide
ctccaagaggtatttctacaccgctgtgtcc

SEQ ID NO: 43664 - DNA, 31 bp, Artificial Sequence
  Description of Artificial Sequence: Synthetic oligonucleotide
tccaagaggtatttctacaccgctgtgtccc

SEQ ID NO: 43665 - DNA, 30 bp, Artificial Sequence
  Description of Artificial Sequence: Synthetic oligonucleotide
ccaagaggtatttctacaccgctgtgtccc

SEQ ID NO: 43666 - DNA, 30 bp, Artificial Sequence
  Description of Artificial Sequence: Synthetic oligonucleotide
caagaggtatttctacaccgctgtgtcccg

SEQ ID NO: 43667 - DNA, 30 bp, Artificial Sequence
  Description of Artificial Sequence: Synthetic oligonucleotide
aagaggtatttctacaccgctgtgtcccgg

SEQ ID NO: 43668 - DNA, 29 bp, Artificial Sequence
  Description of Artificial Sequence: Synthetic oligonucleotide
agaggtatttctacaccgctgtgtcccgg

SEQ ID NO: 43669 - DNA, 22 bp, Artificial Sequence
  Description of Artificial Sequence: Synthetic oligonucleotide
cgtgggtggagcaggaggggct

SEQ ID NO: 43670 - DNA, 22 bp, Artificial Sequence
  Description of Artificial Sequence: Synthetic oligonucleotide
gtgggtggagcaggaggggctg

SEQ ID NO: 43671 - DNA, 23 bp, Artificial Sequence
  Description of Artificial Sequence: Synthetic oligonucleotide
tgggtggagcaggaggggctgga

SEQ ID NO: 43672 - DNA, 22 bp, Artificial Sequence
  Description of Artificial Sequence: Synthetic oligonucleotide
gggtggagcaggaggggctgga

SEQ ID NO: 43673 - DNA, 26 bp, Artificial Sequence
  Description of Artificial Sequence: Synthetic oligonucleotide
ggtggagcaggaggggctggagtatt

SEQ ID NO: 43674 - DNA, 26 bp, Artificial Sequence
  Description of Artificial Sequence: Synthetic oligonucleotide
gtggagcaggaggggctggagtattg

SEQ ID NO: 43675 - DNA, 26 bp, Artificial Sequence
  Description of Artificial Sequence: Synthetic oligonucleotide
tggagcaggaggggctggagtattgg

SEQ ID NO: 43676 - DNA, 25 bp, Artificial Sequence
  Description of Artificial Sequence: Synthetic oligonucleotide
ggagcaggaggggctggagtattgg

SEQ ID NO: 43677 - DNA, 29 bp, Artificial Sequence
  Description of Artificial Sequence: Synthetic oligonucleotide
tggagtattgggaccgggagacacagaag

SEQ ID NO: 43678 - DNA, 20 bp, Artificial Sequence
  Description of Artificial Sequence: Synthetic oligonucleotide
ccggccgcggggagccctat

SEQ ID NO: 43679 - DNA, 21 bp, Artificial Sequence
  Description of Artificial Sequence: Synthetic oligonucleotide
cggccgcggggagccctactt

SEQ ID NO: 43680 - DNA, 23 bp, Artificial Sequence
  Description of Artificial Sequence: Synthetic oligonucleotide
ggccgcggggagccctacttcat

SEQ ID NO: 43681 - DNA, 23 bp, Artificial Sequence
  Description of Artificial Sequence: Synthetic oligonucleotide
gccgcggggagccctacttcatc

SEQ ID NO: 43682 - DNA, 23 bp, Artificial Sequence
  Description of Artificial Sequence: Synthetic oligonucleotide
ccgcggggagccctacttcatcg

SEQ ID NO: 43683 - DNA, 24 bp, Artificial Sequence
  Description of Artificial Sequence: Synthetic oligonucleotide
cgcggggagccctacttcatcgca

SEQ ID NO: 43684 - DNA, 25 bp, Artificial Sequence
  Description of Artificial Sequence: Synthetic oligonucleotide
gcggggagccctacttcatcgcagt

SEQ ID NO: 43685 - DNA, 25 bp, Artificial Sequence
  Description of Artificial Sequence: Synthetic oligonucleotide
cggggagccctacttcatcgcagtg

SEQ ID NO: 43686 - DNA, 25 bp, Artificial Sequence
  Description of Artificial Sequence: Synthetic oligonucleotide
ggggagccctacttcatcgcagtgg

SEQ ID NO: 43687 - DNA, 25 bp, Artificial Sequence
  Description of Artificial Sequence: Synthetic oligonucleotide
gggagccctacttcatcgcagtggg

SEQ ID NO: 43688 - DNA, 27 bp, Artificial Sequence
  Description of Artificial Sequence: Synthetic oligonucleotide
ggagccctacttcatcgcagtgggcta

SEQ ID NO: 43689 - DNA, 27 bp, Artificial Sequence
  Description of Artificial Sequence: Synthetic oligonucleotide
gagccctacttcatcgcagtgggctac

SEQ ID NO: 43690 - DNA, 27 bp, Artificial Sequence
  Description of Artificial Sequence: Synthetic oligonucleotide
agccctacttcatcgcagtgggctacg

SEQ ID NO: 43691 - DNA, 27 bp, Artificial Sequence
  Description of Artificial Sequence: Synthetic oligonucleotide
gccctacttcatcgcagtgggctacgt

SEQ ID NO: 43692 - DNA, 27 bp, Artificial Sequence
  Description of Artificial Sequence: Synthetic oligonucleotide
ccctacttcatcgcagtgggctacgtg

SEQ ID NO: 43693 - DNA, 27 bp, Artificial Sequence
  Description of Artificial Sequence: Synthetic oligonucleotide
cctacttcatcgcagtgggctacgtgg

SEQ ID NO: 43694 - DNA, 28 bp, Artificial Sequence
  Description of Artificial Sequence: Synthetic oligonucleotide
ctacttcatcgcagtgggctacgtggac

SEQ ID NO: 43695 - DNA, 28 bp, Artificial Sequence
  Description of Artificial Sequence: Synthetic oligonucleotide
tacttcatcgcagtgggctacgtggacg

SEQ ID NO: 43696 - DNA, 26 bp, Artificial Sequence
  Description of Artificial Sequence: Synthetic oligonucleotide
gtggagtggctccgcagacacctgaa

SEQ ID NO: 43697 - DNA, 27 bp, Artificial Sequence
  Description of Artificial Sequence: Synthetic oligonucleotide
tggagtggctccgcagacacctgaaga

SEQ ID NO: 43698 - DNA, 27 bp, Artificial Sequence
  Description of Artificial Sequence: Synthetic oligonucleotide
ggagtggctccgcagacacctgaagaa

SEQ ID NO: 43699 - DNA, 28 bp, Artificial Sequence
  Description of Artificial Sequence: Synthetic oligonucleotide
gagtggctccgcagacacctgaagaatg

SEQ ID NO: 43700 - DNA, 28 bp, Artificial Sequence
  Description of Artificial Sequence: Synthetic oligonucleotide
agtggctccgcagacacctgaagaatgg

SEQ ID NO: 43701 - DNA, 27 bp, Artificial Sequence
  Description of Artificial Sequence: Synthetic oligonucleotide
gtggctccgcagacacctgaagaatgg

SEQ ID NO: 43702 - DNA, 27 bp, Artificial Sequence
  Description of Artificial Sequence: Synthetic oligonucleotide
tggctccgcagacacctgaagaatggg

SEQ ID NO: 43703 - DNA, 27 bp, Artificial Sequence
  Description of Artificial Sequence: Synthetic oligonucleotide
ggctccgcagacacctgaagaatggga

SEQ ID NO: 43704 - DNA, 28 bp, Artificial Sequence
  Description of Artificial Sequence: Synthetic oligonucleotide
gctccgcagacacctgaagaatgggaag

SEQ ID NO: 43705 - DNA, 28 bp, Artificial Sequence
  Description of Artificial Sequence: Synthetic oligonucleotide
ctccgcagacacctgaagaatgggaagg

SEQ ID NO: 43706 - DNA, 29 bp, Artificial Sequence
  Description of Artificial Sequence: Synthetic oligonucleotide
tccgcagacacctgaagaatgggaaggag

SEQ ID NO: 43707 - DNA, 28 bp, Artificial Sequence
  Description of Artificial Sequence: Synthetic oligonucleotide
ccgcagacacctgaagaatgggaaggag

SEQ ID NO: 43708 - DNA, 29 bp, Artificial Sequence
  Description of Artificial Sequence: Synthetic oligonucleotide
cgcagacacctgaagaatgggaaggagac

SEQ ID NO: 43709 - DNA, 29 bp, Artificial Sequence
  Description of Artificial Sequence: Synthetic oligonucleotide
gcagacacctgaagaatgggaaggagacg

SEQ ID NO: 43710 - DNA, 29 bp, Artificial Sequence
  Description of Artificial Sequence: Synthetic oligonucleotide
cagacacctgaagaatgggaaggagacgc

SEQ ID NO: 43711 - DNA, 30 bp, Artificial Sequence
  Description of Artificial Sequence: Synthetic oligonucleotide
agacacctgaagaatgggaaggagacgctg

SEQ ID NO: 43712 - DNA, 29 bp, Artificial Sequence
  Description of Artificial Sequence: Synthetic oligonucleotide
gacacctgaagaatgggaaggagacgctg

SEQ ID NO: 43713 - DNA, 29 bp, Artificial Sequence
  Description of Artificial Sequence: Synthetic oligonucleotide
acacctgaagaatgggaaggagacgctgc

SEQ ID NO: 43714 - DNA, 28 bp, Artificial Sequence
  Description of Artificial Sequence: Synthetic oligonucleotide
cacctgaagaatgggaaggagacgctgc

SEQ ID NO: 43715 - DNA, 21 bp, Artificial Sequence
  Description of Artificial Sequence: Synthetic oligonucleotide
gtggcccgtgaggcggagcag

SEQ ID NO: 43716 - DNA, 22 bp, Artificial Sequence
  Description of Artificial Sequence: Synthetic oligonucleotide
tggcccgtgaggcggagcagct

SEQ ID NO: 43717 - DNA, 28 bp, Artificial Sequence
  Description of Artificial Sequence: Synthetic oligonucleotide
aagtacaagcgccaggcacagactgacg

SEQ ID NO: 43718 - DNA, 27 bp, Artificial Sequence
  Description of Artificial Sequence: Synthetic oligonucleotide
agtacaagcgccaggcacagactgacg

SEQ ID NO: 43719 - DNA, 26 bp, Artificial Sequence
  Description of Artificial Sequence: Synthetic oligonucleotide
gtacaagcgccaggcacagactgacg

SEQ ID NO: 43720 - DNA, 27 bp, Artificial Sequence
  Description of Artificial Sequence: Synthetic oligonucleotide
tacaagcgccaggcacagactgacgga

SEQ ID NO: 43721 - DNA, 26 bp, Artificial Sequence
  Description of Artificial Sequence: Synthetic oligonucleotide
acaagcgccaggcacagactgacgga

SEQ ID NO: 43722 - DNA, 25 bp, Artificial Sequence
  Description of Artificial Sequence: Synthetic oligonucleotide
caagcgccaggcacagactgacgga

SEQ ID NO: 43723 - DNA, 26 bp, Artificial Sequence
  Description of Artificial Sequence: Synthetic oligonucleotide
aagcgccaggcacagactgacggagt

SEQ ID NO: 43724 - DNA, 25 bp, Artificial Sequence
  Description of Artificial Sequence: Synthetic oligonucleotide
agcgccaggcacagactgacggagt

SEQ ID NO: 43725 - DNA, 24 bp, Artificial Sequence
  Description of Artificial Sequence: Synthetic oligonucleotide
gcgccaggcacagactgacggagt

SEQ ID NO: 43726 - DNA, 25 bp, Artificial Sequence
  Description of Artificial Sequence: Synthetic oligonucleotide
cgccaggcacagactgacggagtga

SEQ ID NO: 43727 - DNA, 25 bp, Artificial Sequence
  Description of Artificial Sequence: Synthetic oligonucleotide
gccaggcacagactgacggagtgag

SEQ ID NO: 43728 - DNA, 25 bp, Artificial Sequence
  Description of Artificial Sequence: Synthetic oligonucleotide
ccaggcacagactgacggagtgagc

SEQ ID NO: 43729 - DNA, 26 bp, Artificial Sequence
  Description of Artificial Sequence: Synthetic oligonucleotide
caggcacagactgacggagtgagcct

SEQ ID NO: 43730 - DNA, 26 bp, Artificial Sequence
  Description of Artificial Sequence: Synthetic oligonucleotide
aggcacagactgacggagtgagcctg

SEQ ID NO: 43731 - DNA, 25 bp, Artificial Sequence
  Description of Artificial Sequence: Synthetic oligonucleotide
ggcacagactgacggagtgagcctg

SEQ ID NO: 43732 - DNA, 25 bp, Artificial Sequence
  Description of Artificial Sequence: Synthetic oligonucleotide
gcacagactgacggagtgagcctgc

SEQ ID NO: 43733 - DNA, 25 bp, Artificial Sequence
  Description of Artificial Sequence: Synthetic oligonucleotide
cacagactgacggagtgagcctgcg

SEQ ID NO: 43734 - DNA, 27 bp, Artificial Sequence
  Description of Artificial Sequence: Synthetic oligonucleotide
acagactgacggagtgagcctgcggaa

SEQ ID NO: 43735 - DNA, 26 bp, Artificial Sequence
  Description of Artificial Sequence: Synthetic oligonucleotide
cagactgacggagtgagcctgcggaa

SEQ ID NO: 43736 - DNA, 26 bp, Artificial Sequence
  Description of Artificial Sequence: Synthetic oligonucleotide
agactgacggagtgagcctgcggaac

SEQ ID NO: 43737 - DNA, 25 bp, Artificial Sequence
  Description of Artificial Sequence: Synthetic oligonucleotide
gactgacggagtgagcctgcggaac

SEQ ID NO: 43738 - DNA, 26 bp, Artificial Sequence
  Description of Artificial Sequence: Synthetic oligonucleotide
actgacggagtgagcctgcggaacct

SEQ ID NO: 43739 - DNA, 25 bp, Artificial Sequence
  Description of Artificial Sequence: Synthetic oligonucleotide
ctgacggagtgagcctgcggaacct

SEQ ID NO: 43740 - DNA, 25 bp, Artificial Sequence
  Description of Artificial Sequence: Synthetic oligonucleotide
tgacggagtgagcctgcggaacctg

SEQ ID NO: 43741 - DNA, 24 bp, Artificial Sequence
  Description of Artificial Sequence: Synthetic oligonucleotide
gacggagtgagcctgcggaacctg

SEQ ID NO: 43742 - DNA, 24 bp, Artificial Sequence
  Description of Artificial Sequence: Synthetic oligonucleotide
acggagtgagcctgcggaacctgc

SEQ ID NO: 43743 - DNA, 23 bp, Artificial Sequence
  Description of Artificial Sequence: Synthetic oligonucleotide
cggagtgagcctgcggaacctgc

SEQ ID NO: 43744 - DNA, 23 bp, Artificial Sequence
  Description of Artificial Sequence: Synthetic oligonucleotide
ggagtgagcctgcggaacctgcg

SEQ ID NO: 43745 - DNA, 23 bp, Artificial Sequence
  Description of Artificial Sequence: Synthetic oligonucleotide
ccgtgaggcggagcagctgagac

SEQ ID NO: 43746 - DNA, 23 bp, Artificial Sequence
  Description of Artificial Sequence: Synthetic oligonucleotide
cgtgaggcggagcagctgagacc

SEQ ID NO: 43747 - DNA, 25 bp, Artificial Sequence
  Description of Artificial Sequence: Synthetic oligonucleotide
gtgaggcggagcagctgagacccta

SEQ ID NO: 43748 - DNA, 25 bp, Artificial Sequence
  Description of Artificial Sequence: Synthetic oligonucleotide
tgaggcggagcagctgagaccctac

SEQ ID NO: 43749 - DNA, 24 bp, Artificial Sequence
  Description of Artificial Sequence: Synthetic oligonucleotide
gaggcggagcagctgagaccctac

SEQ ID NO: 43750 - DNA, 25 bp, Artificial Sequence
  Description of Artificial Sequence: Synthetic oligonucleotide
aggcggagcagctgagaccctacct

SEQ ID NO: 43751 - DNA, 24 bp, Artificial Sequence
  Description of Artificial Sequence: Synthetic oligonucleotide
ggcggagcagctgagaccctacct

SEQ ID NO: 43752 - DNA, 24 bp, Artificial Sequence
  Description of Artificial Sequence: Synthetic oligonucleotide
gcggagcagctgagaccctacctg

SEQ ID NO: 43753 - DNA, 25 bp, Artificial Sequence
  Description of Artificial Sequence: Synthetic oligonucleotide
cggagcagctgagaccctacctgga

SEQ ID NO: 43754 - DNA, 25 bp, Artificial Sequence
  Description of Artificial Sequence: Synthetic oligonucleotide
ggagcagctgagaccctacctggag

SEQ ID NO: 43755 - DNA, 25 bp, Artificial Sequence
  Description of Artificial Sequence: Synthetic oligonucleotide
gagcagctgagaccctacctggagg

SEQ ID NO: 43756 - DNA, 25 bp, Artificial Sequence
  Description of Artificial Sequence: Synthetic oligonucleotide
agcagctgagaccctacctggaggg

SEQ ID NO: 43757 - DNA, 24 bp, Artificial Sequence
  Description of Artificial Sequence: Synthetic oligonucleotide
gcagctgagaccctacctggaggg

SEQ ID NO: 43758 - DNA, 24 bp, Artificial Sequence
  Description of Artificial Sequence: Synthetic oligonucleotide
cagctgagaccctacctggagggc

SEQ ID NO: 43759 - DNA, 25 bp, Artificial Sequence
  Description of Artificial Sequence: Synthetic oligonucleotide
agctgagaccctacctggagggcct

SEQ ID NO: 43760 - DNA, 24 bp, Artificial Sequence
  Description of Artificial Sequence: Synthetic oligonucleotide
gctgagaccctacctggagggcct

SEQ ID NO: 43761 - DNA, 25 bp, Artificial Sequence
  Description of Artificial Sequence: Synthetic oligonucleotide
ctgagaccctacctggagggcctgt

SEQ ID NO: 43762 - DNA, 25 bp, Artificial Sequence
  Description of Artificial Sequence: Synthetic oligonucleotide
tgagaccctacctggagggcctgtg

SEQ ID NO: 43763 - DNA, 24 bp, Artificial Sequence
  Description of Artificial Sequence: Synthetic oligonucleotide
gagaccctacctggagggcctgtg

SEQ ID NO: 43764 - DNA, 24 bp, Artificial Sequence
  Description of Artificial Sequence: Synthetic oligonucleotide
agaccctacctggagggcctgtgc

SEQ ID NO: 43765 - DNA, 23 bp, Artificial Sequence
  Description of Artificial Sequence: Synthetic oligonucleotide
gaccctacctggagggcctgtgc

SEQ ID NO: 43766 - DNA, 24 bp, Artificial Sequence
  Description of Artificial Sequence: Synthetic oligonucleotide
accctacctggagggcctgtgcgt

SEQ ID NO: 43767 - DNA, 23 bp, Artificial Sequence
  Description of Artificial Sequence: Synthetic oligonucleotide
ccctacctggagggcctgtgcgt

SEQ ID NO: 43768 - DNA, 28 bp, Artificial Sequence
  Description of Artificial Sequence: Synthetic oligonucleotide
gtatgaccagtacgcctacgacggcatg

SEQ ID NO: 43769 - DNA, 28 bp, Artificial Sequence
  Description of Artificial Sequence: Synthetic oligonucleotide
tatgaccagtacgcctacgacggcatgg

SEQ ID NO: 43770 - DNA, 27 bp, Artificial Sequence
  Description of Artificial Sequence: Synthetic oligonucleotide
atgaccagtacgcctacgacggcatgg

SEQ ID NO: 43771 - DNA, 27 bp, Artificial Sequence
  Description of Artificial Sequence: Synthetic oligonucleotide
tgaccagtacgcctacgacggcatgga

SEQ ID NO: 43772 - DNA, 27 bp, Artificial Sequence
  Description of Artificial Sequence: Synthetic oligonucleotide
gaccagtacgcctacgacggcatggat

SEQ ID NO: 43773 - DNA, 29 bp, Artificial Sequence
  Description of Artificial Sequence: Synthetic oligonucleotide
accagtacgcctacgacggcatggattac

SEQ ID NO: 43774 - DNA, 28 bp, Artificial Sequence
  Description of Artificial Sequence: Synthetic oligonucleotide
ccagtacgcctacgacggcatggattac

SEQ ID NO: 43775 - DNA, 30 bp, Artificial Sequence
  Description of Artificial Sequence: Synthetic oligonucleotide
cagtacgcctacgacggcatggattacatc

SEQ ID NO: 43776 - DNA, 30 bp, Artificial Sequence
  Description of Artificial Sequence: Synthetic oligonucleotide
agtacgcctacgacggcatggattacatcg

SEQ ID NO: 43777 - DNA, 29 bp, Artificial Sequence
  Description of Artificial Sequence: Synthetic oligonucleotide
gtacgcctacgacggcatggattacatcg

SEQ ID NO: 43778 - DNA, 29 bp, Artificial Sequence
  Description of Artificial Sequence: Synthetic oligonucleotide
tacgcctacgacggcatggattacatcgc

SEQ ID NO: 43779 - DNA, 28 bp, Artificial Sequence
  Description of Artificial Sequence: Synthetic oligonucleotide
acgcctacgacggcatggattacatcgc

SEQ ID NO: 43780 - DNA, 27 bp, Artificial Sequence
  Description of Artificial Sequence: Synthetic oligonucleotide
cgcctacgacggcatggattacatcgc

SEQ ID NO: 43781 - DNA, 27 bp, Artificial Sequence
  Description of Artificial Sequence: Synthetic oligonucleotide
gcctacgacggcatggattacatcgcc

SEQ ID NO: 43782 - DNA, 27 bp, Artificial Sequence
  Description of Artificial Sequence: Synthetic oligonucleotide
cctacgacggcatggattacatcgccc

SEQ ID NO: 43783 - DNA, 28 bp, Artificial Sequence
  Description of Artificial Sequence: Synthetic oligonucleotide
ctacgacggcatggattacatcgccctg

SEQ ID NO: 43784 - DNA, 30 bp, Artificial Sequence
  Description of Artificial Sequence: Synthetic oligonucleotide
tacgacggcatggattacatcgccctgaac

SEQ ID NO: 43785 - DNA, 29 bp, Artificial Sequence
  Description of Artificial Sequence: Synthetic oligonucleotide
acgacggcatggattacatcgccctgaac

SEQ ID NO: 43786 - DNA, 28 bp, Artificial Sequence
  Description of Artificial Sequence: Synthetic oligonucleotide
cgacggcatggattacatcgccctgaac

SEQ ID NO: 43787 - DNA, 28 bp, Artificial Sequence
  Description of Artificial Sequence: Synthetic oligonucleotide
gacggcatggattacatcgccctgaacg

SEQ ID NO: 43788 - DNA, 29 bp, Artificial Sequence
  Description of Artificial Sequence: Synthetic oligonucleotide
acggcatggattacatcgccctgaacgag

SEQ ID NO: 43789 - DNA, 28 bp, Artificial Sequence
  Description of Artificial Sequence: Synthetic oligonucleotide
cggcatggattacatcgccctgaacgag

SEQ ID NO: 43790 - DNA, 28 bp, Artificial Sequence
  Description of Artificial Sequence: Synthetic oligonucleotide
ggcatggattacatcgccctgaacgagg

SEQ ID NO: 43791 - DNA, 30 bp, Artificial Sequence
  Description of Artificial Sequence: Synthetic oligonucleotide
gcatggattacatcgccctgaacgaggatc

SEQ ID NO: 43792 - DNA, 31 bp, Artificial Sequence
  Description of Artificial Sequence: Synthetic oligonucleotide
catggattacatcgccctgaacgaggatctg

SEQ ID NO: 43793 - DNA, 31 bp, Artificial Sequence
  Description of Artificial Sequence: Synthetic oligonucleotide
atggattacatcgccctgaacgaggatctgc

SEQ ID NO: 43794 - DNA, 30 bp, Artificial Sequence
  Description of Artificial Sequence: Synthetic oligonucleotide
tggattacatcgccctgaacgaggatctgc

SEQ ID NO: 43795 - DNA, 21 bp, Artificial Sequence
  Description of Artificial Sequence: Synthetic oligonucleotide
gctgcgacgtggggcccgaca

SEQ ID NO: 43796 - DNA, 21 bp, Artificial Sequence
  Description of Artificial Sequence: Synthetic oligonucleotide
ctgcgacgtggggcccgacag

SEQ ID NO: 43797 - DNA, 21 bp, Artificial Sequence
  Description of Artificial Sequence: Synthetic oligonucleotide
tgcgacgtggggcccgacagg

SEQ ID NO: 43798 - DNA, 20 bp, Artificial Sequence
  Description of Artificial Sequence: Synthetic oligonucleotide
gcgacgtggggcccgacagg

SEQ ID NO: 43799 - DNA, 20 bp, Artificial Sequence
  Description of Artificial Sequence: Synthetic oligonucleotide
cgacgtggggcccgacaggc

SEQ ID NO: 43800 - DNA, 20 bp, Artificial Sequence
  Description of Artificial Sequence: Synthetic oligonucleotide
gacgtggggcccgacaggcg

SEQ ID NO: 43801 - DNA, 20 bp, Artificial Sequence
  Description of Artificial Sequence: Synthetic oligonucleotide
acgtggggcccgacaggcgc

SEQ ID NO: 43802 - DNA, 20 bp, Artificial Sequence
  Description of Artificial Sequence: Synthetic oligonucleotide
cgtggggcccgacaggcgct

SEQ ID NO: 43803 - DNA, 20 bp, Artificial Sequence
  Description of Artificial Sequence: Synthetic oligonucleotide
gtggggcccgacaggcgcct

SEQ ID NO: 43804 - DNA, 20 bp, Artificial Sequence
  Description of Artificial Sequence: Synthetic oligonucleotide
tggggcccgacaggcgcctc

SEQ ID NO: 43805 - DNA, 20 bp, Artificial Sequence
  Description of Artificial Sequence: Synthetic oligonucleotide
ggggcccgacaggcgcctct

SEQ ID NO: 43806 - DNA, 20 bp, Artificial Sequence
  Description of Artificial Sequence: Synthetic oligonucleotide
gggcccgacaggcgcctcct

SEQ ID NO: 43807 - DNA, 20 bp, Artificial Sequence
  Description of Artificial Sequence: Synthetic oligonucleotide
ggcccgacaggcgcctcctc

SEQ ID NO: 43808 - DNA, 20 bp, Artificial Sequence
  Description of Artificial Sequence: Synthetic oligonucleotide
gcccgacaggcgcctcctcc

SEQ ID NO: 43809 - DNA, 20 bp, Artificial Sequence
  Description of Artificial Sequence: Synthetic oligonucleotide
cccgacaggcgcctcctccg

SEQ ID NO: 43810 - DNA, 20 bp, Artificial Sequence
  Description of Artificial Sequence: Synthetic oligonucleotide
ccgacaggcgcctcctccgc

SEQ ID NO: 43811 - DNA, 20 bp, Artificial Sequence
  Description of Artificial Sequence: Synthetic oligonucleotide
cgacaggcgcctcctccgcg

SEQ ID NO: 43812 - DNA, 20 bp, Artificial Sequence
  Description of Artificial Sequence: Synthetic oligonucleotide
gacaggcgcctcctccgcgg

SEQ ID NO: 43813 - DNA, 23 bp, Artificial Sequence
  Description of Artificial Sequence: Synthetic oligonucleotide
acaggcgcctcctccgcgggtat

SEQ ID NO: 43814 - DNA, 22 bp, Artificial Sequence
  Description of Artificial Sequence: Synthetic oligonucleotide
caggcgcctcctccgcgggtat

SEQ ID NO: 43815 - DNA, 23 bp, Artificial Sequence
  Description of Artificial Sequence: Synthetic oligonucleotide
aggcgcctcctccgcgggtatga

SEQ ID NO: 43816 - DNA, 25 bp, Artificial Sequence
  Description of Artificial Sequence: Synthetic oligonucleotide
gaggccaggtctcacaccctccagt

SEQ ID NO: 43817 - DNA, 25 bp, Artificial Sequence
  Description of Artificial Sequence: Synthetic oligonucleotide
aggccaggtctcacaccctccagtg

SEQ ID NO: 43818 - DNA, 24 bp, Artificial Sequence
  Description of Artificial Sequence: Synthetic oligonucleotide
ggccaggtctcacaccctccagtg

SEQ ID NO: 43819 - DNA, 26 bp, Artificial Sequence
  Description of Artificial Sequence: Synthetic oligonucleotide
gccaggtctcacaccctccagtggat

SEQ ID NO: 43820 - DNA, 27 bp, Artificial Sequence
  Description of Artificial Sequence: Synthetic oligonucleotide
ccaggtctcacaccctccagtggatgt

SEQ ID NO: 43821 - DNA, 27 bp, Artificial Sequence
  Description of Artificial Sequence: Synthetic oligonucleotide
caggtctcacaccctccagtggatgtg

SEQ ID NO: 43822 - DNA, 28 bp, Artificial Sequence
  Description of Artificial Sequence: Synthetic oligonucleotide
aggtctcacaccctccagtggatgtgtg

SEQ ID NO: 43823 - DNA, 22 bp, Artificial Sequence
  Description of Artificial Sequence: Synthetic oligonucleotide
cggcccgtgaggtggagcagct

SEQ ID NO: 43824 - DNA, 23 bp, Artificial Sequence
  Description of Artificial Sequence: Synthetic oligonucleotide
ggcccgtgaggtggagcagctga

SEQ ID NO: 43825 - DNA, 24 bp, Artificial Sequence
  Description of Artificial Sequence: Synthetic oligonucleotide
gcccgtgaggtggagcagctgaga

SEQ ID NO: 43826 - DNA, 24 bp, Artificial Sequence
  Description of Artificial Sequence: Synthetic oligonucleotide
cccgtgaggtggagcagctgagag

SEQ ID NO: 43827 - DNA, 24 bp, Artificial Sequence
  Description of Artificial Sequence: Synthetic oligonucleotide
ccgtgaggtggagcagctgagagc

SEQ ID NO: 43828 - DNA, 26 bp, Artificial Sequence
  Description of Artificial Sequence: Synthetic oligonucleotide
cgtgaggtggagcagctgagagccta

SEQ ID NO: 43829 - DNA, 26 bp, Artificial Sequence
  Description of Artificial Sequence: Synthetic oligonucleotide
gtgaggtggagcagctgagagcctac

SEQ ID NO: 43830 - DNA, 27 bp, Artificial Sequence
  Description of Artificial Sequence: Synthetic oligonucleotide
tgaggtggagcagctgagagcctacct

SEQ ID NO: 43831 - DNA, 26 bp, Artificial Sequence
  Description of Artificial Sequence: Synthetic oligonucleotide
gaggtggagcagctgagagcctacct

SEQ ID NO: 43832 - DNA, 26 bp, Artificial Sequence
  Description of Artificial Sequence: Synthetic oligonucleotide
aggtggagcagctgagagcctacctg

SEQ ID NO: 43833 - DNA, 25 bp, Artificial Sequence
  Description of Artificial Sequence: Synthetic oligonucleotide
ggtggagcagctgagagcctacctg

SEQ ID NO: 43834 - DNA, 26 bp, Artificial Sequence
  Description of Artificial Sequence: Synthetic oligonucleotide
gtggagcagctgagagcctacctgga

SEQ ID NO: 43835 - DNA, 26 bp, Artificial Sequence
  Description of Artificial Sequence: Synthetic oligonucleotide
tggagcagctgagagcctacctggag

SEQ ID NO: 43836 - DNA, 24 bp, Artificial Sequence
  Description of Artificial Sequence: Synthetic oligonucleotide
agcctacctggagggcctgtgcga

SEQ ID NO: 43837 - DNA, 23 bp, Artificial Sequence
  Description of Artificial Sequence: Synthetic oligonucleotide
gcctacctggagggcctgtgcga

SEQ ID NO: 43838 - DNA, 23 bp, Artificial Sequence
  Description of Artificial Sequence: Synthetic oligonucleotide
cctacctggagggcctgtgcgag

SEQ ID NO: 43839 - DNA, 24 bp, Artificial Sequence
  Description of Artificial Sequence: Synthetic oligonucleotide
ctacctggagggcctgtgcgagga

SEQ ID NO: 43840 - DNA, 25 bp, Artificial Sequence
  Description of Artificial Sequence: Synthetic oligonucleotide
tacctggagggcctgtgcgaggagt

SEQ ID NO: 43841 - DNA, 24 bp, Artificial Sequence
  Description of Artificial Sequence: Synthetic oligonucleotide
acctggagggcctgtgcgaggagt

SEQ ID NO: 43842 - DNA, 23 bp, Artificial Sequence
  Description of Artificial Sequence: Synthetic oligonucleotide
cctggagggcctgtgcgaggagt

SEQ ID NO: 43843 - DNA, 23 bp, Artificial Sequence
  Description of Artificial Sequence: Synthetic oligonucleotide
ctggagggcctgtgcgaggagtg

SEQ ID NO: 43844 - DNA, 23 bp, Artificial Sequence
  Description of Artificial Sequence: Synthetic oligonucleotide
tggagggcctgtgcgaggagtgg

SEQ ID NO: 43845 - DNA, 22 bp, Artificial Sequence
  Description of Artificial Sequence: Synthetic oligonucleotide
ggagggcctgtgcgaggagtgg

SEQ ID NO: 43846 - DNA, 23 bp, Artificial Sequence
  Description of Artificial Sequence: Synthetic oligonucleotide
gagggcctgtgcgaggagtggct

SEQ ID NO: 43847 - DNA, 23 bp, Artificial Sequence
  Description of Artificial Sequence: Synthetic oligonucleotide
agggcctgtgcgaggagtggctc

SEQ ID NO: 43848 - DNA, 22 bp, Artificial Sequence
  Description of Artificial Sequence: Synthetic oligonucleotide
gggcctgtgcgaggagtggctc

SEQ ID NO: 43849 - DNA, 22 bp, Artificial Sequence
  Description of Artificial Sequence: Synthetic oligonucleotide
ggcctgtgcgaggagtggctcc

SEQ ID NO: 43850 - DNA, 22 bp, Artificial Sequence
  Description of Artificial Sequence: Synthetic oligonucleotide
gcctgtgcgaggagtggctccg

SEQ ID NO: 43851 - DNA, 23 bp, Artificial Sequence
  Description of Artificial Sequence: Synthetic oligonucleotide
cctgtgcgaggagtggctccgca

SEQ ID NO: 43852 - DNA, 26 bp, Artificial Sequence
  Description of Artificial Sequence: Synthetic oligonucleotide
ctgtgcgaggagtggctccgcagata

SEQ ID NO: 43853 - DNA, 26 bp, Artificial Sequence
  Description of Artificial Sequence: Synthetic oligonucleotide
tgtgcgaggagtggctccgcagatac

SEQ ID NO: 43854 - DNA, 25 bp, Artificial Sequence
  Description of Artificial Sequence: Synthetic oligonucleotide
gtgcgaggagtggctccgcagatac

SEQ ID NO: 43855 - DNA, 26 bp, Artificial Sequence
  Description of Artificial Sequence: Synthetic oligonucleotide
tgcgaggagtggctccgcagatacct

SEQ ID NO: 43856 - DNA, 25 bp, Artificial Sequence
  Description of Artificial Sequence: Synthetic oligonucleotide
gcgaggagtggctccgcagatacct

SEQ ID NO: 43857 - DNA, 27 bp, Artificial Sequence
  Description of Artificial Sequence: Synthetic oligonucleotide
cgaggagtggctccgcagatacctgaa

SEQ ID NO: 43858 - DNA, 27 bp, Artificial Sequence
  Description of Artificial Sequence: Synthetic oligonucleotide
gaggagtggctccgcagatacctgaag

SEQ ID NO: 43859 - DNA, 30 bp, Artificial Sequence
  Description of Artificial Sequence: Synthetic oligonucleotide
aggagtggctccgcagatacctgaagaatg

SEQ ID NO: 43860 - DNA, 25 bp, Artificial Sequence
  Description of Artificial Sequence: Synthetic oligonucleotide
gtgacccaccatcccgtctctgacc

SEQ ID NO: 43861 - DNA, 26 bp, Artificial Sequence
  Description of Artificial Sequence: Synthetic oligonucleotide
tgacccaccatcccgtctctgaccct

SEQ ID NO: 43862 - DNA, 25 bp, Artificial Sequence
  Description of Artificial Sequence: Synthetic oligonucleotide
gacccaccatcccgtctctgaccct

SEQ ID NO: 43863 - DNA, 26 bp, Artificial Sequence
  Description of Artificial Sequence: Synthetic oligonucleotide
acccaccatcccgtctctgaccctga

SEQ ID NO: 43864 - DNA, 25 bp, Artificial Sequence
  Description of Artificial Sequence: Synthetic oligonucleotide
cccaccatcccgtctctgaccctga

SEQ ID NO: 43865 - DNA, 25 bp, Artificial Sequence
  Description of Artificial Sequence: Synthetic oligonucleotide
ccaccatcccgtctctgaccctgag

SEQ ID NO: 43866 - DNA, 25 bp, Artificial Sequence
  Description of Artificial Sequence: Synthetic oligonucleotide
caccatcccgtctctgaccctgagg

SEQ ID NO: 43867 - DNA, 25 bp, Artificial Sequence
  Description of Artificial Sequence: Synthetic oligonucleotide
accatcccgtctctgaccctgaggc

SEQ ID NO: 43868 - DNA, 24 bp, Artificial Sequence
  Description of Artificial Sequence: Synthetic oligonucleotide
ccatcccgtctctgaccctgaggc

SEQ ID NO: 43869 - DNA, 25 bp, Artificial Sequence
  Description of Artificial Sequence: Synthetic oligonucleotide
catcccgtctctgaccctgaggcca

SEQ ID NO: 43870 - DNA, 25 bp, Artificial Sequence
  Description of Artificial Sequence: Synthetic oligonucleotide
atcccgtctctgaccctgaggccac

SEQ ID NO: 43871 - DNA, 24 bp, Artificial Sequence
  Description of Artificial Sequence: Synthetic oligonucleotide
tcccgtctctgaccctgaggccac

SEQ ID NO: 43872 - DNA, 23 bp, Artificial Sequence
  Description of Artificial Sequence: Synthetic oligonucleotide
cccgtctctgaccctgaggccac

SEQ ID NO: 43873 - DNA, 23 bp, Artificial Sequence
  Description of Artificial Sequence: Synthetic oligonucleotide
ccgtctctgaccctgaggccacc

SEQ ID NO: 43874 - DNA, 24 bp, Artificial Sequence
  Description of Artificial Sequence: Synthetic oligonucleotide
cgtctctgaccctgaggccaccct

SEQ ID NO: 43875 - DNA, 25 bp, Artificial Sequence
  Description of Artificial Sequence: Synthetic oligonucleotide
gtctctgaccctgaggccaccctga

SEQ ID NO: 43876 - DNA, 25 bp, Artificial Sequence
  Description of Artificial Sequence: Synthetic oligonucleotide
tctctgaccctgaggccaccctgag

SEQ ID NO: 43877 - DNA, 24 bp, Artificial Sequence
  Description of Artificial Sequence: Synthetic oligonucleotide
ctctgaccctgaggccaccctgag

SEQ ID NO: 43878 - DNA, 25 bp, Artificial Sequence
  Description of Artificial Sequence: Synthetic oligonucleotide
tctgaccctgaggccaccctgaggt

SEQ ID NO: 43879 - DNA, 24 bp, Artificial Sequence
  Description of Artificial Sequence: Synthetic oligonucleotide
ctgaccctgaggccaccctgaggt

SEQ ID NO: 43880 - DNA, 24 bp, Artificial Sequence
  Description of Artificial Sequence: Synthetic oligonucleotide
tgaccctgaggccaccctgaggtg

SEQ ID NO: 43881 - DNA, 23 bp, Artificial Sequence
  Description of Artificial Sequence: Synthetic oligonucleotide
gaccctgaggccaccctgaggtg

SEQ ID NO: 43882 - DNA, 24 bp, Artificial Sequence
  Description of Artificial Sequence: Synthetic oligonucleotide
accctgaggccaccctgaggtgct

SEQ ID NO: 43883 - DNA, 23 bp, Artificial Sequence
  Description of Artificial Sequence: Synthetic oligonucleotide
ccctgaggccaccctgaggtgct

SEQ ID NO: 43884 - DNA, 23 bp, Artificial Sequence
  Description of Artificial Sequence: Synthetic oligonucleotide
cctgaggccaccctgaggtgctg

SEQ ID NO: 43885 - DNA, 23 bp, Artificial Sequence
  Description of Artificial Sequence: Synthetic oligonucleotide
ctgaggccaccctgaggtgctgg

SEQ ID NO: 43886 - DNA, 20 bp, Artificial Sequence
  Description of Artificial Sequence: Synthetic oligonucleotide
cgggcgccgtgggtggagct

SEQ ID NO: 43887 - DNA, 20 bp, Artificial Sequence
  Description of Artificial Sequence: Synthetic oligonucleotide
gggcgccgtgggtggagctg

SEQ ID NO: 43888 - DNA, 21 bp, Artificial Sequence
  Description of Artificial Sequence: Synthetic oligonucleotide
ggcgccgtgggtggagctgga

SEQ ID NO: 43889 - DNA, 21 bp, Artificial Sequence
  Description of Artificial Sequence: Synthetic oligonucleotide
gcgccgtgggtggagctggag

SEQ ID NO: 43890 - DNA, 21 bp, Artificial Sequence
  Description of Artificial Sequence: Synthetic oligonucleotide
cgccgtgggtggagctggagg

SEQ ID NO: 43891 - DNA, 21 bp, Artificial Sequence
  Description of Artificial Sequence: Synthetic oligonucleotide
gccgtgggtggagctggaggg

SEQ ID NO: 43892 - DNA, 21 bp, Artificial Sequence
  Description of Artificial Sequence: Synthetic oligonucleotide
ccgtgggtggagctggagggg

SEQ ID NO: 43893 - DNA, 21 bp, Artificial Sequence
  Description of Artificial Sequence: Synthetic oligonucleotide
cgtgggtggagctggaggggc

SEQ ID NO: 43894 - DNA, 21 bp, Artificial Sequence
  Description of Artificial Sequence: Synthetic oligonucleotide
gtgggtggagctggaggggcc

SEQ ID NO: 43895 - DNA, 21 bp, Artificial Sequence
  Description of Artificial Sequence: Synthetic oligonucleotide
tgggtggagctggaggggccg

SEQ ID NO: 43896 - DNA, 20 bp, Artificial Sequence
  Description of Artificial Sequence: Synthetic oligonucleotide
gggtggagctggaggggccg

SEQ ID NO: 43897 - DNA, 21 bp, Artificial Sequence
  Description of Artificial Sequence: Synthetic oligonucleotide
ggtggagctggaggggccgga

SEQ ID NO: 43898 - DNA, 25 bp, Artificial Sequence
  Description of Artificial Sequence: Synthetic oligonucleotide
gtggagctggaggggccggagtatt

SEQ ID NO: 43899 - DNA, 25 bp, Artificial Sequence
  Description of Artificial Sequence: Synthetic oligonucleotide
tggagctggaggggccggagtattg

SEQ ID NO: 43900 - DNA, 24 bp, Artificial Sequence
  Description of Artificial Sequence: Synthetic oligonucleotide
ggagctggaggggccggagtattg

SEQ ID NO: 43901 - DNA, 24 bp, Artificial Sequence
  Description of Artificial Sequence: Synthetic oligonucleotide
gagctggaggggccggagtattgg

SEQ ID NO: 43902 - DNA, 25 bp, Artificial Sequence
  Description of Artificial Sequence: Synthetic oligonucleotide
agctggaggggccggagtattggga

SEQ ID NO: 43903 - DNA, 24 bp, Artificial Sequence
  Description of Artificial Sequence: Synthetic oligonucleotide
gctggaggggccggagtattggga

SEQ ID NO: 43904 - DNA, 24 bp, Artificial Sequence
  Description of Artificial Sequence: Synthetic oligonucleotide
ctggaggggccggagtattgggac

SEQ ID NO: 43905 - DNA, 24 bp, Artificial Sequence
  Description of Artificial Sequence: Synthetic oligonucleotide
tggaggggccggagtattgggacc

SEQ ID NO: 43906 - DNA, 27 bp, Artificial Sequence
  Description of Artificial Sequence: Synthetic oligonucleotide
atttctacaccgctgtgtcccggccct

SEQ ID NO: 43907 - DNA, 26 bp, Artificial Sequence
  Description of Artificial Sequence: Synthetic oligonucleotide
tttctacaccgctgtgtcccggccct

SEQ ID NO: 43908 - DNA, 25 bp, Artificial Sequence
  Description of Artificial Sequence: Synthetic oligonucleotide
ttctacaccgctgtgtcccggccct

SEQ ID NO: 43909 - DNA, 24 bp, Artificial Sequence
  Description of Artificial Sequence: Synthetic oligonucleotide
tctacaccgctgtgtcccggccct

SEQ ID NO: 43910 - DNA, 23 bp, Artificial Sequence
  Description of Artificial Sequence: Synthetic oligonucleotide
ctacaccgctgtgtcccggccct

SEQ ID NO: 43911 - DNA, 23 bp, Artificial Sequence
  Description of Artificial Sequence: Synthetic oligonucleotide
tacaccgctgtgtcccggccctg

SEQ ID NO: 43912 - DNA, 22 bp, Artificial Sequence
  Description of Artificial Sequence: Synthetic oligonucleotide
acaccgctgtgtcccggccctg

SEQ ID NO: 43913 - DNA, 21 bp, Artificial Sequence
  Description of Artificial Sequence: Synthetic oligonucleotide
caccgctgtgtcccggccctg

SEQ ID NO: 43914 - DNA, 21 bp, Artificial Sequence
  Description of Artificial Sequence: Synthetic oligonucleotide
accgctgtgtcccggccctgc

SEQ ID NO: 43915 - DNA, 20 bp, Artificial Sequence
  Description of Artificial Sequence: Synthetic oligonucleotide
ccgctgtgtcccggccctgc

SEQ ID NO: 43916 - DNA, 20 bp, Artificial Sequence
  Description of Artificial Sequence: Synthetic oligonucleotide
cgctgtgtcccggccctgcc

SEQ ID NO: 43917 - DNA, 20 bp, Artificial Sequence
  Description of Artificial Sequence: Synthetic oligonucleotide
gctgtgtcccggccctgccg

SEQ ID NO: 43918 - DNA, 20 bp, Artificial Sequence
  Description of Artificial Sequence: Synthetic oligonucleotide
ctgtgtcccggccctgccgc

SEQ ID NO: 43919 - DNA, 20 bp, Artificial Sequence
  Description of Artificial Sequence: Synthetic oligonucleotide
tgtgtcccggccctgccgcg

SEQ ID NO: 43920 - DNA, 20 bp, Artificial Sequence
  Description of Artificial Sequence: Synthetic oligonucleotide
gtgtcccggccctgccgcgt

SEQ ID NO: 43921 - DNA, 20 bp, Artificial Sequence
  Description of Artificial Sequence: Synthetic oligonucleotide
tgtcccggccctgccgcggt

SEQ ID NO: 43922 - DNA, 20 bp, Artificial Sequence
  Description of Artificial Sequence: Synthetic oligonucleotide
gtcccggccctgccgcggtt

SEQ ID NO: 43923 - DNA, 20 bp, Artificial Sequence
  Description of Artificial Sequence: Synthetic oligonucleotide
tcccggccctgccgcgggtt

SEQ ID NO: 43924 - DNA, 20 bp, Artificial Sequence
  Description of Artificial Sequence: Synthetic oligonucleotide
cccggccctgccgcgggttt

SEQ ID NO: 43925 - DNA, 20 bp, Artificial Sequence
  Description of Artificial Sequence: Synthetic oligonucleotide
ccggccctgccgcggggatt

SEQ ID NO: 43926 - DNA, 20 bp, Artificial Sequence
  Description of Artificial Sequence: Synthetic oligonucleotide
cggccctgccgcggggagtt

SEQ ID NO: 43927 - DNA, 20 bp, Artificial Sequence
  Description of Artificial Sequence: Synthetic oligonucleotide
ggccctgccgcggggagctt

SEQ ID NO: 43928 - DNA, 20 bp, Artificial Sequence
  Description of Artificial Sequence: Synthetic oligonucleotide
gccctgccgcggggagcctt

SEQ ID NO: 43929 - DNA, 20 bp, Artificial Sequence
  Description of Artificial Sequence: Synthetic oligonucleotide
ccctgccgcggggagccctt

SEQ ID NO: 43930 - DNA, 20 bp, Artificial Sequence
  Description of Artificial Sequence: Synthetic oligonucleotide
cctgccgcggggagccccat

SEQ ID NO: 43931 - DNA, 21 bp, Artificial Sequence
  Description of Artificial Sequence: Synthetic oligonucleotide
ctgccgcggggagccccactt

SEQ ID NO: 43932 - DNA, 23 bp, Artificial Sequence
  Description of Artificial Sequence: Synthetic oligonucleotide
tgccgcggggagccccacttcat

SEQ ID NO: 43933 - DNA, 21 bp, Artificial Sequence
  Description of Artificial Sequence: Synthetic oligonucleotide
gacaccgctgtgtcccggccc

SEQ ID NO: 43934 - DNA, 26 bp, Artificial Sequence
  Description of Artificial Sequence: Synthetic oligonucleotide
ccggagtattgggaccgggagacgaa

SEQ ID NO: 43935 - DNA, 27 bp, Artificial Sequence
  Description of Artificial Sequence: Synthetic oligonucleotide
cggagtattgggaccgggagacgaaga

SEQ ID NO: 43936 - DNA, 28 bp, Artificial Sequence
  Description of Artificial Sequence: Synthetic oligonucleotide
ggagtattgggaccgggagacgaagaag

SEQ ID NO: 43937 - DNA, 30 bp, Artificial Sequence
  Description of Artificial Sequence: Synthetic oligonucleotide
gagtattgggaccgggagacgaagaagtac

SEQ ID NO: 43938 - DNA, 32 bp, Artificial Sequence
  Description of Artificial Sequence: Synthetic oligonucleotide
agtattgggaccgggagacgaagaagtacaag

SEQ ID NO: 43939 - DNA, 31 bp, Artificial Sequence
  Description of Artificial Sequence: Synthetic oligonucleotide
gtattgggaccgggagacgaagaagtacaag

SEQ ID NO: 43940 - DNA, 31 bp, Artificial Sequence
  Description of Artificial Sequence: Synthetic oligonucleotide
tattgggaccgggagacgaagaagtacaagc

SEQ ID NO: 43941 - DNA, 30 bp, Artificial Sequence
  Description of Artificial Sequence: Synthetic oligonucleotide
attgggaccgggagacgaagaagtacaagc

SEQ ID NO: 43942 - DNA, 29 bp, Artificial Sequence
  Description of Artificial Sequence: Synthetic oligonucleotide
ttgggaccgggagacgaagaagtacaagc

SEQ ID NO: 43943 - DNA, 28 bp, Artificial Sequence
  Description of Artificial Sequence: Synthetic oligonucleotide
tgggaccgggagacgaagaagtacaagc

SEQ ID NO: 43944 - DNA, 27 bp, Artificial Sequence
  Description of Artificial Sequence: Synthetic oligonucleotide
gggaccgggagacgaagaagtacaagc

SEQ ID NO: 43945 - DNA, 27 bp, Artificial Sequence
  Description of Artificial Sequence: Synthetic oligonucleotide
ggaccgggagacgaagaagtacaagcg

SEQ ID NO: 43946 - DNA, 27 bp, Artificial Sequence
  Description of Artificial Sequence: Synthetic oligonucleotide
gaccgggagacgaagaagtacaagcgc

SEQ ID NO: 43947 - DNA, 27 bp, Artificial Sequence
  Description of Artificial Sequence: Synthetic oligonucleotide
accgggagacgaagaagtacaagcgcc

SEQ ID NO: 43948 - DNA, 27 bp, Artificial Sequence
  Description of Artificial Sequence: Synthetic oligonucleotide
ccgggagacgaagaagtacaagcgcca

SEQ ID NO: 43949 - DNA, 27 bp, Artificial Sequence
  Description of Artificial Sequence: Synthetic oligonucleotide
cgggagacgaagaagtacaagcgccag

SEQ ID NO: 43950 - DNA, 27 bp, Artificial Sequence
  Description of Artificial Sequence: Synthetic oligonucleotide
gggagacgaagaagtacaagcgccagg

SEQ ID NO: 43951 - DNA, 27 bp, Artificial Sequence
  Description of Artificial Sequence: Synthetic oligonucleotide
ggagacgaagaagtacaagcgccaggc

SEQ ID NO: 43952 - DNA, 28 bp, Artificial Sequence
  Description of Artificial Sequence: Synthetic oligonucleotide
gagacgaagaagtacaagcgccaggcac

SEQ ID NO: 43953 - DNA, 29 bp, Artificial Sequence
  Description of Artificial Sequence: Synthetic oligonucleotide
agacgaagaagtacaagcgccaggcacag

SEQ ID NO: 43954 - DNA, 28 bp, Artificial Sequence
  Description of Artificial Sequence: Synthetic oligonucleotide
gacgaagaagtacaagcgccaggcacag

SEQ ID NO: 43955 - DNA, 29 bp, Artificial Sequence
  Description of Artificial Sequence: Synthetic oligonucleotide
acgaagaagtacaagcgccaggcacagac

SEQ ID NO: 43956 - DNA, 28 bp, Artificial Sequence
  Description of Artificial Sequence: Synthetic oligonucleotide
cgaagaagtacaagcgccaggcacagac

SEQ ID NO: 43957 - DNA, 29 bp, Artificial Sequence
  Description of Artificial Sequence: Synthetic oligonucleotide
gaagaagtacaagcgccaggcacagactg

SEQ ID NO: 43958 - DNA, 30 bp, Artificial Sequence
  Description of Artificial Sequence: Synthetic oligonucleotide
aagaagtacaagcgccaggcacagactgac

SEQ ID NO: 43959 - DNA, 20 bp, Artificial Sequence
  Description of Artificial Sequence: Synthetic oligonucleotide
gacgtggggcccgacggggt

SEQ ID NO: 43960 - DNA, 20 bp, Artificial Sequence
  Description of Artificial Sequence: Synthetic oligonucleotide
acgtggggcccgacgggggt

SEQ ID NO: 43961 - DNA, 20 bp, Artificial Sequence
  Description of Artificial Sequence: Synthetic oligonucleotide
cgtggggcccgacgggggtt

SEQ ID NO: 43962 - DNA, 20 bp, Artificial Sequence
  Description of Artificial Sequence: Synthetic oligonucleotide
gtggggcccgacgggggctt

SEQ ID NO: 43963 - DNA, 20 bp, Artificial Sequence
  Description of Artificial Sequence: Synthetic oligonucleotide
tggggcccgacgggggcctt

SEQ ID NO: 43964 - DNA, 20 bp, Artificial Sequence
  Description of Artificial Sequence: Synthetic oligonucleotide
ggggcccgacgggggccttt

SEQ ID NO: 43965 - DNA, 20 bp, Artificial Sequence
  Description of Artificial Sequence: Synthetic oligonucleotide
gggcccgacgggggcctctt

SEQ ID NO: 43966 - DNA, 20 bp, Artificial Sequence
  Description of Artificial Sequence: Synthetic oligonucleotide
ggcccgacgggggcctcctt

SEQ ID NO: 43967 - DNA, 20 bp, Artificial Sequence
  Description of Artificial Sequence: Synthetic oligonucleotide
gcccgacgggggcctcctct

SEQ ID NO: 43968 - DNA, 20 bp, Artificial Sequence
  Description of Artificial Sequence: Synthetic oligonucleotide
cccgacgggggcctcctcct

SEQ ID NO: 43969 - DNA, 20 bp, Artificial Sequence
  Description of Artificial Sequence: Synthetic oligonucleotide
ccgacgggggcctcctccgt

SEQ ID NO: 43970 - DNA, 20 bp, Artificial Sequence
  Description of Artificial Sequence: Synthetic oligonucleotide
cgacgggggcctcctccgct

SEQ ID NO: 43971 - DNA, 20 bp, Artificial Sequence
  Description of Artificial Sequence: Synthetic oligonucleotide
gacgggggcctcctccgcgt

SEQ ID NO: 43972 - DNA, 20 bp, Artificial Sequence
  Description of Artificial Sequence: Synthetic oligonucleotide
acgggggcctcctccgcggt

SEQ ID NO: 43973 - DNA, 20 bp, Artificial Sequence
  Description of Artificial Sequence: Synthetic oligonucleotide
cgggggcctcctccgcggtt

SEQ ID NO: 43974 - DNA, 21 bp, Artificial Sequence
  Description of Artificial Sequence: Synthetic oligonucleotide
gggggcctcctccgcgggtat

SEQ ID NO: 43975 - DNA, 22 bp, Artificial Sequence
  Description of Artificial Sequence: Synthetic oligonucleotide
ggggcctcctccgcgggtatga

SEQ ID NO: 43976 - DNA, 22 bp, Artificial Sequence
  Description of Artificial Sequence: Synthetic oligonucleotide
gggcctcctccgcgggtatgac

SEQ ID NO: 43977 - DNA, 23 bp, Artificial Sequence
  Description of Artificial Sequence: Synthetic oligonucleotide
ggcctcctccgcgggtatgacca

SEQ ID NO: 43978 - DNA, 24 bp, Artificial Sequence
  Description of Artificial Sequence: Synthetic oligonucleotide
ctgcggaacctgcgcggctactac

SEQ ID NO: 43979 - DNA, 25 bp, Artificial Sequence
  Description of Artificial Sequence: Synthetic oligonucleotide
tgcggaacctgcgcggctactacga

SEQ ID NO: 43980 - DNA, 24 bp, Artificial Sequence
  Description of Artificial Sequence: Synthetic oligonucleotide
gcggaacctgcgcggctactacga

SEQ ID NO: 43981 - DNA, 24 bp, Artificial Sequence
  Description of Artificial Sequence: Synthetic oligonucleotide
cggaacctgcgcggctactacgac

SEQ ID NO: 43982 - DNA, 25 bp, Artificial Sequence
  Description of Artificial Sequence: Synthetic oligonucleotide
ggaacctgcgcggctactacgacca

SEQ ID NO: 43983 - DNA, 26 bp, Artificial Sequence
  Description of Artificial Sequence: Synthetic oligonucleotide
gaacctgcgcggctactacgaccaga

SEQ ID NO: 43984 - DNA, 26 bp, Artificial Sequence
  Description of Artificial Sequence: Synthetic oligonucleotide
aacctgcgcggctactacgaccagag

SEQ ID NO: 43985 - DNA, 25 bp, Artificial Sequence
  Description of Artificial Sequence: Synthetic oligonucleotide
acctgcgcggctactacgaccagag

SEQ ID NO: 43986 - DNA, 24 bp, Artificial Sequence
  Description of Artificial Sequence: Synthetic oligonucleotide
cctgcgcggctactacgaccagag

SEQ ID NO: 43987 - DNA, 24 bp, Artificial Sequence
  Description of Artificial Sequence: Synthetic oligonucleotide
ctgcgcggctactacgaccagagc

SEQ ID NO: 43988 - DNA, 25 bp, Artificial Sequence
  Description of Artificial Sequence: Synthetic oligonucleotide
tgcgcggctactacgaccagagcga

SEQ ID NO: 43989 - DNA, 24 bp, Artificial Sequence
  Description of Artificial Sequence: Synthetic oligonucleotide
gcgcggctactacgaccagagcga

SEQ ID NO: 43990 - DNA, 24 bp, Artificial Sequence
  Description of Artificial Sequence: Synthetic oligonucleotide
cgcggctactacgaccagagcgag

SEQ ID NO: 43991 - DNA, 24 bp, Artificial Sequence
  Description of Artificial Sequence: Synthetic oligonucleotide
gcggctactacgaccagagcgagg

SEQ ID NO: 43992 - DNA, 24 bp, Artificial Sequence
  Description of Artificial Sequence: Synthetic oligonucleotide
cggctactacgaccagagcgaggc

SEQ ID NO: 43993 - DNA, 24 bp, Artificial Sequence
  Description of Artificial Sequence: Synthetic oligonucleotide
ggctactacgaccagagcgaggcc

SEQ ID NO: 43994 - DNA, 24 bp, Artificial Sequence
  Description of Artificial Sequence: Synthetic oligonucleotide
gctactacgaccagagcgaggccg

SEQ ID NO: 43995 - DNA, 24 bp, Artificial Sequence
  Description of Artificial Sequence: Synthetic oligonucleotide
ctactacgaccagagcgaggccgg

SEQ ID NO: 43996 - DNA, 25 bp, Artificial Sequence
  Description of Artificial Sequence: Synthetic oligonucleotide
tactacgaccagagcgaggccgggt

SEQ ID NO: 43997 - DNA, 24 bp, Artificial Sequence
  Description of Artificial Sequence: Synthetic oligonucleotide
actacgaccagagcgaggccgggt

SEQ ID NO: 43998 - DNA, 23 bp, Artificial Sequence
  Description of Artificial Sequence: Synthetic oligonucleotide
ctacgaccagagcgaggccgggt

SEQ ID NO: 43999 - DNA, 24 bp, Artificial Sequence
  Description of Artificial Sequence: Synthetic oligonucleotide
tacgaccagagcgaggccgggtct

SEQ ID NO: 44000 - DNA, 23 bp, Artificial Sequence
  Description of Artificial Sequence: Synthetic oligonucleotide
acgaccagagcgaggccgggtct

SEQ ID NO: 44001 - DNA, 22 bp, Artificial Sequence
  Description of Artificial Sequence: Synthetic oligonucleotide
cgaccagagcgaggccgggtct

SEQ ID NO: 44002 - DNA, 23 bp, Artificial Sequence
  Description of Artificial Sequence: Synthetic oligonucleotide
gaccagagcgaggccgggtctca

SEQ ID NO: 44003 - DNA, 28 bp, Artificial Sequence
  Description of Artificial Sequence: Synthetic oligonucleotide
gtatttctacaccgctgtgtcccggctc

SEQ ID NO: 44004 - DNA, 28 bp, Artificial Sequence
  Description of Artificial Sequence: Synthetic oligonucleotide
tatttctacaccgctgtgtcccggctcg

SEQ ID NO: 44005 - DNA, 27 bp, Artificial Sequence
  Description of Artificial Sequence: Synthetic oligonucleotide
atttctacaccgctgtgtcccggctcg

SEQ ID NO: 44006 - DNA, 26 bp, Artificial Sequence
  Description of Artificial Sequence: Synthetic oligonucleotide
tttctacaccgctgtgtcccggctcg

SEQ ID NO: 44007 - DNA, 25 bp, Artificial Sequence
  Description of Artificial Sequence: Synthetic oligonucleotide
ttctacaccgctgtgtcccggctcg

SEQ ID NO: 44008 - DNA, 24 bp, Artificial Sequence
  Description of Artificial Sequence: Synthetic oligonucleotide
tctacaccgctgtgtcccggctcg

SEQ ID NO: 44009 - DNA, 23 bp, Artificial Sequence
  Description of Artificial Sequence: Synthetic oligonucleotide
ctacaccgctgtgtcccggctcg

SEQ ID NO: 44010 - DNA, 23 bp, Artificial Sequence
  Description of Artificial Sequence: Synthetic oligonucleotide
tacaccgctgtgtcccggctcgg

SEQ ID NO: 44011 - DNA, 22 bp, Artificial Sequence
  Description of Artificial Sequence: Synthetic oligonucleotide
acaccgctgtgtcccggctcgg

SEQ ID NO: 44012 - DNA, 21 bp, Artificial Sequence
  Description of Artificial Sequence: Synthetic oligonucleotide
caccgctgtgtcccggctcgg

SEQ ID NO: 44013 - DNA, 21 bp, Artificial Sequence
  Description of Artificial Sequence: Synthetic oligonucleotide
accgctgtgtcccggctcggc

SEQ ID NO: 44014 - DNA, 20 bp, Artificial Sequence
  Description of Artificial Sequence: Synthetic oligonucleotide
ccgctgtgtcccggctcggc

SEQ ID NO: 44015 - DNA, 20 bp, Artificial Sequence
  Description of Artificial Sequence: Synthetic oligonucleotide
cgctgtgtcccggctcggcc

SEQ ID NO: 44016 - DNA, 20 bp, Artificial Sequence
  Description of Artificial Sequence: Synthetic oligonucleotide
gctgtgtcccggctcggccg

SEQ ID NO: 44017 - DNA, 20 bp, Artificial Sequence
  Description of Artificial Sequence: Synthetic oligonucleotide
ctgtgtcccggctcggccgc

SEQ ID NO: 44018 - DNA, 20 bp, Artificial Sequence
  Description of Artificial Sequence: Synthetic oligonucleotide
tgtgtcccggctcggccgcg

SEQ ID NO: 44019 - DNA, 20 bp, Artificial Sequence
  Description of Artificial Sequence: Synthetic oligonucleotide
gtgtcccggctcggccgcgt

SEQ ID NO: 44020 - DNA, 20 bp, Artificial Sequence
  Description of Artificial Sequence: Synthetic oligonucleotide
tgtcccggctcggccgcggt

SEQ ID NO: 44021 - DNA, 20 bp, Artificial Sequence
  Description of Artificial Sequence: Synthetic oligonucleotide
gtcccggctcggccgcggtt

SEQ ID NO: 44022 - DNA, 20 bp, Artificial Sequence
  Description of Artificial Sequence: Synthetic oligonucleotide
tcccggctcggccgcgggtt

SEQ ID NO: 44023 - DNA, 20 bp, Artificial Sequence
  Description of Artificial Sequence: Synthetic oligonucleotide
cccggctcggccgcgggttt

SEQ ID NO: 44024 - DNA, 20 bp, Artificial Sequence
  Description of Artificial Sequence: Synthetic oligonucleotide
ccggctcggccgcggggatt

SEQ ID NO: 44025 - DNA, 20 bp, Artificial Sequence
  Description of Artificial Sequence: Synthetic oligonucleotide
cggctcggccgcggggagtt

SEQ ID NO: 44026 - DNA, 20 bp, Artificial Sequence
  Description of Artificial Sequence: Synthetic oligonucleotide
ggctcggccgcggggagctt

SEQ ID NO: 44027 - DNA, 20 bp, Artificial Sequence
  Description of Artificial Sequence: Synthetic oligonucleotide
gctcggccgcggggagcctt

SEQ ID NO: 44028 - DNA, 20 bp, Artificial Sequence
  Description of Artificial Sequence: Synthetic oligonucleotide
ctcggccgcggggagccctt

SEQ ID NO: 44029 - DNA, 20 bp, Artificial Sequence
  Description of Artificial Sequence: Synthetic oligonucleotide
tcggccgcggggagccccat

SEQ ID NO: 44030 - DNA, 26 bp, Artificial Sequence
  Description of Artificial Sequence: Synthetic oligonucleotide
aacgaggatctgcgctcctggaccgt

SEQ ID NO: 44031 - DNA, 25 bp, Artificial Sequence
  Description of Artificial Sequence: Synthetic oligonucleotide
acgaggatctgcgctcctggaccgt

SEQ ID NO: 44032 - DNA, 24 bp, Artificial Sequence
  Description of Artificial Sequence: Synthetic oligonucleotide
cgaggatctgcgctcctggaccgt

SEQ ID NO: 44033 - DNA, 24 bp, Artificial Sequence
  Description of Artificial Sequence: Synthetic oligonucleotide
gaggatctgcgctcctggaccgtc

SEQ ID NO: 44034 - DNA, 24 bp, Artificial Sequence
  Description of Artificial Sequence: Synthetic oligonucleotide
aggatctgcgctcctggaccgtcg

SEQ ID NO: 44035 - DNA, 23 bp, Artificial Sequence
  Description of Artificial Sequence: Synthetic oligonucleotide
ggatctgcgctcctggaccgtcg

SEQ ID NO: 44036 - DNA, 23 bp, Artificial Sequence
  Description of Artificial Sequence: Synthetic oligonucleotide
gatctgcgctcctggaccgtcgc

SEQ ID NO: 44037 - DNA, 23 bp, Artificial Sequence
  Description of Artificial Sequence: Synthetic oligonucleotide
atctgcgctcctggaccgtcgcg

SEQ ID NO: 44038 - DNA, 22 bp, Artificial Sequence
  Description of Artificial Sequence: Synthetic oligonucleotide
tctgcgctcctggaccgtcgcg

SEQ ID NO: 44039 - DNA, 21 bp, Artificial Sequence
  Description of Artificial Sequence: Synthetic oligonucleotide
ctgcgctcctggaccgtcgcg

SEQ ID NO: 44040 - DNA, 22 bp, Artificial Sequence
  Description of Artificial Sequence: Synthetic oligonucleotide
tgcgctcctggaccgtcgcgga

SEQ ID NO: 44041 - DNA, 21 bp, Artificial Sequence
  Description of Artificial Sequence: Synthetic oligonucleotide
gcgctcctggaccgtcgcgga

SEQ ID NO: 44042 - DNA, 22 bp, Artificial Sequence
  Description of Artificial Sequence: Synthetic oligonucleotide
cgctcctggaccgtcgcggaca

SEQ ID NO: 44043 - DNA, 22 bp, Artificial Sequence
  Description of Artificial Sequence: Synthetic oligonucleotide
gctcctggaccgtcgcggacac

SEQ ID NO: 44044 - DNA, 22 bp, Artificial Sequence
  Description of Artificial Sequence: Synthetic oligonucleotide
ctcctggaccgtcgcggacacg

SEQ ID NO: 44045 - DNA, 22 bp, Artificial Sequence
  Description of Artificial Sequence: Synthetic oligonucleotide
tcctggaccgtcgcggacacgg

SEQ ID NO: 44046 - DNA, 21 bp, Artificial Sequence
  Description of Artificial Sequence: Synthetic oligonucleotide
cctggaccgtcgcggacacgg

SEQ ID NO: 44047 - DNA, 21 bp, Artificial Sequence
  Description of Artificial Sequence: Synthetic oligonucleotide
ctggaccgtcgcggacacggc

SEQ ID NO: 44048 - DNA, 21 bp, Artificial Sequence
  Description of Artificial Sequence: Synthetic oligonucleotide
tggaccgtcgcggacacggcg

SEQ ID NO: 44049 - DNA, 20 bp, Artificial Sequence
  Description of Artificial Sequence: Synthetic oligonucleotide
ggaccgtcgcggacacggcg

SEQ ID NO: 44050 - DNA, 20 bp, Artificial Sequence
  Description of Artificial Sequence: Synthetic oligonucleotide
gaccgtcgcggacacggcgg

SEQ ID NO: 44051 - DNA, 21 bp, Artificial Sequence
  Description of Artificial Sequence: Synthetic oligonucleotide
accgtcgcggacacggcggct

SEQ ID NO: 44052 - DNA, 20 bp, Artificial Sequence
  Description of Artificial Sequence: Synthetic oligonucleotide
ccgtcgcggacacggcggct

SEQ ID NO: 44053 - DNA, 21 bp, Artificial Sequence
  Description of Artificial Sequence: Synthetic oligonucleotide
cgtcgcggacacggcggctca

SEQ ID NO: 44054 - DNA, 23 bp, Artificial Sequence
  Description of Artificial Sequence: Synthetic oligonucleotide
gtcgcggacacggcggctcagat

SEQ ID NO: 44055 - DNA, 24 bp, Artificial Sequence
  Description of Artificial Sequence: Synthetic oligonucleotide
tcgcggacacggcggctcagatca

SEQ ID NO: 44056 - DNA, 29 bp, Artificial Sequence
  Description of Artificial Sequence: Synthetic oligonucleotide
ccactccatgaggcatttctacaccgctg

SEQ ID NO: 44057 - DNA, 30 bp, Artificial Sequence
  Description of Artificial Sequence: Synthetic oligonucleotide
cactccatgaggcatttctacaccgctgtg

SEQ ID NO: 44058 - DNA, 31 bp, Artificial Sequence
  Description of Artificial Sequence: Synthetic oligonucleotide
actccatgaggcatttctacaccgctgtgtc

SEQ ID NO: 44059 - DNA, 30 bp, Artificial Sequence
  Description of Artificial Sequence: Synthetic oligonucleotide
ctccatgaggcatttctacaccgctgtgtc

SEQ ID NO: 44060 - DNA, 30 bp, Artificial Sequence
  Description of Artificial Sequence: Synthetic oligonucleotide
tccatgaggcatttctacaccgctgtgtcc

SEQ ID NO: 44061 - DNA, 29 bp, Artificial Sequence
  Description of Artificial Sequence: Synthetic oligonucleotide
ccatgaggcatttctacaccgctgtgtcc

SEQ ID NO: 44062 - DNA, 29 bp, Artificial Sequence
  Description of Artificial Sequence: Synthetic oligonucleotide
catgaggcatttctacaccgctgtgtccc

SEQ ID NO: 44063 - DNA, 29 bp, Artificial Sequence
  Description of Artificial Sequence: Synthetic oligonucleotide
atgaggcatttctacaccgctgtgtcccg

SEQ ID NO: 44064 - DNA, 28 bp, Artificial Sequence
  Description of Artificial Sequence: Synthetic oligonucleotide
tgaggcatttctacaccgctgtgtcccg

SEQ ID NO: 44065 - DNA, 27 bp, Artificial Sequence
  Description of Artificial Sequence: Synthetic oligonucleotide
gaggcatttctacaccgctgtgtcccg

SEQ ID NO: 44066 - DNA, 27 bp, Artificial Sequence
  Description of Artificial Sequence: Synthetic oligonucleotide
aggcatttctacaccgctgtgtcccgg

SEQ ID NO: 44067 - DNA, 26 bp, Artificial Sequence
  Description of Artificial Sequence: Synthetic oligonucleotide
ggcatttctacaccgctgtgtcccgg

SEQ ID NO: 44068 - DNA, 26 bp, Artificial Sequence
  Description of Artificial Sequence: Synthetic oligonucleotide
gcatttctacaccgctgtgtcccggc

SEQ ID NO: 44069 - DNA, 26 bp, Artificial Sequence
  Description of Artificial Sequence: Synthetic oligonucleotide
catttctacaccgctgtgtcccggcc

SEQ ID NO: 44070 - DNA, 22 bp, Artificial Sequence
  Description of Artificial Sequence: Synthetic oligonucleotide
cggcccgtgaggcggagcagat

SEQ ID NO: 44071 - DNA, 23 bp, Artificial Sequence
  Description of Artificial Sequence: Synthetic oligonucleotide
ggcccgtgaggcggagcagatga

SEQ ID NO: 44072 - DNA, 24 bp, Artificial Sequence
  Description of Artificial Sequence: Synthetic oligonucleotide
gcccgtgaggcggagcagatgaga

SEQ ID NO: 44073 - DNA, 24 bp, Artificial Sequence
  Description of Artificial Sequence: Synthetic oligonucleotide
cccgtgaggcggagcagatgagag

SEQ ID NO: 44074 - DNA, 24 bp, Artificial Sequence
  Description of Artificial Sequence: Synthetic oligonucleotide
ccgtgaggcggagcagatgagagc

SEQ ID NO: 44075 - DNA, 26 bp, Artificial Sequence
  Description of Artificial Sequence: Synthetic oligonucleotide
cgtgaggcggagcagatgagagccta

SEQ ID NO: 44076 - DNA, 26 bp, Artificial Sequence
  Description of Artificial Sequence: Synthetic oligonucleotide
gtgaggcggagcagatgagagcctac

SEQ ID NO: 44077 - DNA, 27 bp, Artificial Sequence
  Description of Artificial Sequence: Synthetic oligonucleotide
tgaggcggagcagatgagagcctacct

SEQ ID NO: 44078 - DNA, 26 bp, Artificial Sequence
  Description of Artificial Sequence: Synthetic oligonucleotide
gaggcggagcagatgagagcctacct

SEQ ID NO: 44079 - DNA, 26 bp, Artificial Sequence
  Description of Artificial Sequence: Synthetic oligonucleotide
aggcggagcagatgagagcctacctg

SEQ ID NO: 44080 - DNA, 25 bp, Artificial Sequence
  Description of Artificial Sequence: Synthetic oligonucleotide
ggcggagcagatgagagcctacctg

SEQ ID NO: 44081 - DNA, 26 bp, Artificial Sequence
  Description of Artificial Sequence: Synthetic oligonucleotide
gcggagcagatgagagcctacctgga

SEQ ID NO: 44082 - DNA, 26 bp, Artificial Sequence
  Description of Artificial Sequence: Synthetic oligonucleotide
cggagcagatgagagcctacctggag

SEQ ID NO: 44083 - DNA, 26 bp, Artificial Sequence
  Description of Artificial Sequence: Synthetic oligonucleotide
ggagcagatgagagcctacctggagg

SEQ ID NO: 44084 - DNA, 26 bp, Artificial Sequence
  Description of Artificial Sequence: Synthetic oligonucleotide
gagcagatgagagcctacctggaggg

SEQ ID NO: 44085 - DNA, 26 bp, Artificial Sequence
  Description of Artificial Sequence: Synthetic oligonucleotide
agcagatgagagcctacctggagggc

SEQ ID NO: 44086 - DNA, 25 bp, Artificial Sequence
  Description of Artificial Sequence: Synthetic oligonucleotide
gcagatgagagcctacctggagggc

SEQ ID NO: 44087 - DNA, 26 bp, Artificial Sequence
  Description of Artificial Sequence: Synthetic oligonucleotide
cagatgagagcctacctggagggcct

SEQ ID NO: 44088 - DNA, 27 bp, Artificial Sequence
  Description of Artificial Sequence: Synthetic oligonucleotide
agatgagagcctacctggagggcctgt

SEQ ID NO: 44089 - DNA, 26 bp, Artificial Sequence
  Description of Artificial Sequence: Synthetic oligonucleotide
gatgagagcctacctggagggcctgt

SEQ ID NO: 44090 - DNA, 26 bp, Artificial Sequence
  Description of Artificial Sequence: Synthetic oligonucleotide
atgagagcctacctggagggcctgtg

SEQ ID NO: 44091 - DNA, 25 bp, Artificial Sequence
  Description of Artificial Sequence: Synthetic oligonucleotide
gctcagatcacccagcgcaagtggg

SEQ ID NO: 44092 - DNA, 25 bp, Artificial Sequence
  Description of Artificial Sequence: Synthetic oligonucleotide
ctcagatcacccagcgcaagtgggg

SEQ ID NO: 44093 - DNA, 25 bp, Artificial Sequence
  Description of Artificial Sequence: Synthetic oligonucleotide
tcagatcacccagcgcaagtggggg

SEQ ID NO: 44094 - DNA, 24 bp, Artificial Sequence
  Description of Artificial Sequence: Synthetic oligonucleotide
cagatcacccagcgcaagtggggg

SEQ ID NO: 44095 - DNA, 24 bp, Artificial Sequence
  Description of Artificial Sequence: Synthetic oligonucleotide
agatcacccagcgcaagtgggggg

SEQ ID NO: 44096 - DNA, 23 bp, Artificial Sequence
  Description of Artificial Sequence: Synthetic oligonucleotide
gatcacccagcgcaagtgggggg

SEQ ID NO: 44097 - DNA, 23 bp, Artificial Sequence
  Description of Artificial Sequence: Synthetic oligonucleotide
atcacccagcgcaagtggggggc

SEQ ID NO: 44098 - DNA, 22 bp, Artificial Sequence
  Description of Artificial Sequence: Synthetic oligonucleotide
tcacccagcgcaagtggggggc

SEQ ID NO: 44099 - DNA, 21 bp, Artificial Sequence
  Description of Artificial Sequence: Synthetic oligonucleotide
cacccagcgcaagtggggggc

SEQ ID NO: 44100 - DNA, 21 bp, Artificial Sequence
  Description of Artificial Sequence: Synthetic oligonucleotide
acccagcgcaagtggggggcg

SEQ ID NO: 44101 - DNA, 20 bp, Artificial Sequence
  Description of Artificial Sequence: Synthetic oligonucleotide
cccagcgcaagtggggggcg

SEQ ID NO: 44102 - DNA, 20 bp, Artificial Sequence
  Description of Artificial Sequence: Synthetic oligonucleotide
ccagcgcaagtggggggcgg

SEQ ID NO: 44103 - DNA, 20 bp, Artificial Sequence
  Description of Artificial Sequence: Synthetic oligonucleotide
cagcgcaagtggggggcggc

SEQ ID NO: 44104 - DNA, 20 bp, Artificial Sequence
  Description of Artificial Sequence: Synthetic oligonucleotide
agcgcaagtggggggcggcc

SEQ ID NO: 44105 - DNA, 20 bp, Artificial Sequence
  Description of Artificial Sequence: Synthetic oligonucleotide
gcgcaagtggggggcggcct

SEQ ID NO: 44106 - DNA, 20 bp, Artificial Sequence
  Description of Artificial Sequence: Synthetic oligonucleotide
cgcaagtggggggcggccct

SEQ ID NO: 44107 - DNA, 20 bp, Artificial Sequence
  Description of Artificial Sequence: Synthetic oligonucleotide
gcaagtggggggcggcccgt

SEQ ID NO: 44108 - DNA, 21 bp, Artificial Sequence
  Description of Artificial Sequence: Synthetic oligonucleotide
caagtggggggcggcccgtga

SEQ ID NO: 44109 - DNA, 21 bp, Artificial Sequence
  Description of Artificial Sequence: Synthetic oligonucleotide
aagtggggggcggcccgtgag

SEQ ID NO: 44110 - DNA, 20 bp, Artificial Sequence
  Description of Artificial Sequence: Synthetic oligonucleotide
agtggggggcggcccgtgag

SEQ ID NO: 44111 - DNA, 20 bp, Artificial Sequence
  Description of Artificial Sequence: Synthetic oligonucleotide
gtggggggcggcccgtgagt

SEQ ID NO: 44112 - DNA, 20 bp, Artificial Sequence
  Description of Artificial Sequence: Synthetic oligonucleotide
tggggggcggcccgtgaggt

SEQ ID NO: 44113 - DNA, 20 bp, Artificial Sequence
  Description of Artificial Sequence: Synthetic oligonucleotide
ggggggcggcccgtgaggtt

SEQ ID NO: 44114 - DNA, 20 bp, Artificial Sequence
  Description of Artificial Sequence: Synthetic oligonucleotide
gggggcggcccgtgaggctt

SEQ ID NO: 44115 - DNA, 20 bp, Artificial Sequence
  Description of Artificial Sequence: Synthetic oligonucleotide
ggggcggcccgtgaggcgtt

SEQ ID NO: 44116 - DNA, 20 bp, Artificial Sequence
  Description of Artificial Sequence: Synthetic oligonucleotide
gggcggcccgtgaggcggat

SEQ ID NO: 44117 - DNA, 28 bp, Artificial Sequence
  Description of Artificial Sequence: Synthetic oligonucleotide
gggagacacagaagtacaagcgccagtc

SEQ ID NO: 44118 - DNA, 29 bp, Artificial Sequence
  Description of Artificial Sequence: Synthetic oligonucleotide
ggagacacagaagtacaagcgccagtcac

SEQ ID NO: 44119 - DNA, 30 bp, Artificial Sequence
  Description of Artificial Sequence: Synthetic oligonucleotide
gagacacagaagtacaagcgccagtcacag

SEQ ID NO: 44120 - DNA, 31 bp, Artificial Sequence
  Description of Artificial Sequence: Synthetic oligonucleotide
agacacagaagtacaagcgccagtcacagac

SEQ ID NO: 44121 - DNA, 30 bp, Artificial Sequence
  Description of Artificial Sequence: Synthetic oligonucleotide
gacacagaagtacaagcgccagtcacagac

SEQ ID NO: 44122 - DNA, 31 bp, Artificial Sequence
  Description of Artificial Sequence: Synthetic oligonucleotide
acacagaagtacaagcgccagtcacagactg

SEQ ID NO: 44123 - DNA, 30 bp, Artificial Sequence
  Description of Artificial Sequence: Synthetic oligonucleotide
cacagaagtacaagcgccagtcacagactg

SEQ ID NO: 44124 - DNA, 31 bp, Artificial Sequence
  Description of Artificial Sequence: Synthetic oligonucleotide
acagaagtacaagcgccagtcacagactgac

SEQ ID NO: 44125 - DNA, 30 bp, Artificial Sequence
  Description of Artificial Sequence: Synthetic oligonucleotide
cagaagtacaagcgccagtcacagactgac

SEQ ID NO: 44126 - DNA, 30 bp, Artificial Sequence
  Description of Artificial Sequence: Synthetic oligonucleotide
agaagtacaagcgccagtcacagactgacc

SEQ ID NO: 44127 - DNA, 29 bp, Artificial Sequence
  Description of Artificial Sequence: Synthetic oligonucleotide
gaagtacaagcgccagtcacagactgacc

SEQ ID NO: 44128 - DNA, 29 bp, Artificial Sequence
  Description of Artificial Sequence: Synthetic oligonucleotide
aagtacaagcgccagtcacagactgaccg

SEQ ID NO: 44129 - DNA, 28 bp, Artificial Sequence
  Description of Artificial Sequence: Synthetic oligonucleotide
agtacaagcgccagtcacagactgaccg

SEQ ID NO: 44130 - DNA, 27 bp, Artificial Sequence
  Description of Artificial Sequence: Synthetic oligonucleotide
gtacaagcgccagtcacagactgaccg

SEQ ID NO: 44131 - DNA, 28 bp, Artificial Sequence
  Description of Artificial Sequence: Synthetic oligonucleotide
tacaagcgccagtcacagactgaccgag

SEQ ID NO: 44132 - DNA, 27 bp, Artificial Sequence
  Description of Artificial Sequence: Synthetic oligonucleotide
acaagcgccagtcacagactgaccgag

SEQ ID NO: 44133 - DNA, 27 bp, Artificial Sequence
  Description of Artificial Sequence: Synthetic oligonucleotide
caagcgccagtcacagactgaccgagt

SEQ ID NO: 44134 - DNA, 27 bp, Artificial Sequence
  Description of Artificial Sequence: Synthetic oligonucleotide
aagcgccagtcacagactgaccgagtg

SEQ ID NO: 44135 - DNA, 27 bp, Artificial Sequence
  Description of Artificial Sequence: Synthetic oligonucleotide
agcgccagtcacagactgaccgagtga

SEQ ID NO: 44136 - DNA, 26 bp, Artificial Sequence
  Description of Artificial Sequence: Synthetic oligonucleotide
gcgccagtcacagactgaccgagtga

SEQ ID NO: 44137 - DNA, 26 bp, Artificial Sequence
  Description of Artificial Sequence: Synthetic oligonucleotide
cgccagtcacagactgaccgagtgag

SEQ ID NO: 44138 - DNA, 26 bp, Artificial Sequence
  Description of Artificial Sequence: Synthetic oligonucleotide
gccagtcacagactgaccgagtgagc

SEQ ID NO: 44139 - DNA, 27 bp, Artificial Sequence
  Description of Artificial Sequence: Synthetic oligonucleotide
ccagtcacagactgaccgagtgagcct

SEQ ID NO: 44140 - DNA, 27 bp, Artificial Sequence
  Description of Artificial Sequence: Synthetic oligonucleotide
cagtcacagactgaccgagtgagcctg

SEQ ID NO: 44141 - DNA, 27 bp, Artificial Sequence
  Description of Artificial Sequence: Synthetic oligonucleotide
agtcacagactgaccgagtgagcctgc

SEQ ID NO: 44142 - DNA, 26 bp, Artificial Sequence
  Description of Artificial Sequence: Synthetic oligonucleotide
gtcacagactgaccgagtgagcctgc

SEQ ID NO: 44143 - DNA, 26 bp, Artificial Sequence
  Description of Artificial Sequence: Synthetic oligonucleotide
tcacagactgaccgagtgagcctgcg

SEQ ID NO: 44144 - DNA, 33 bp, Artificial Sequence
  Description of Artificial Sequence: Synthetic oligonucleotide
tatgaccagtacgcctacgacggcaagaattac

SEQ ID NO: 44145 - DNA, 32 bp, Artificial Sequence
  Description of Artificial Sequence: Synthetic oligonucleotide
atgaccagtacgcctacgacggcaagaattac

SEQ ID NO: 44146 - DNA, 31 bp, Artificial Sequence
  Description of Artificial Sequence: Synthetic oligonucleotide
tgaccagtacgcctacgacggcaagaattac

SEQ ID NO: 44147 - DNA, 30 bp, Artificial Sequence
  Description of Artificial Sequence: Synthetic oligonucleotide
gaccagtacgcctacgacggcaagaattac

SEQ ID NO: 44148 - DNA, 31 bp, Artificial Sequence
  Description of Artificial Sequence: Synthetic oligonucleotide
ggcaagaattacatcgccctgaacgaggatc

SEQ ID NO: 44149 - DNA, 32 bp, Artificial Sequence
  Description of Artificial Sequence: Synthetic oligonucleotide
gcaagaattacatcgccctgaacgaggatctg

SEQ ID NO: 44150 - DNA, 32 bp, Artificial Sequence
  Description of Artificial Sequence: Synthetic oligonucleotide
caagaattacatcgccctgaacgaggatctgc

SEQ ID NO: 44151 - DNA, 32 bp, Artificial Sequence
  Description of Artificial Sequence: Synthetic oligonucleotide
aagaattacatcgccctgaacgaggatctgcg

SEQ ID NO: 44152 - DNA, 31 bp, Artificial Sequence
  Description of Artificial Sequence: Synthetic oligonucleotide
agaattacatcgccctgaacgaggatctgcg

SEQ ID NO: 44153 - DNA, 30 bp, Artificial Sequence
  Description of Artificial Sequence: Synthetic oligonucleotide
gaattacatcgccctgaacgaggatctgcg

SEQ ID NO: 44154 - DNA, 30 bp, Artificial Sequence
  Description of Artificial Sequence: Synthetic oligonucleotide
aattacatcgccctgaacgaggatctgcgc

SEQ ID NO: 44155 - DNA, 22 bp, Artificial Sequence
  Description of Artificial Sequence: Synthetic oligonucleotide
cgtgggtggagcaggaggggca

SEQ ID NO: 44156 - DNA, 22 bp, Artificial Sequence
  Description of Artificial Sequence: Synthetic oligonucleotide
gtgggtggagcaggaggggcag

SEQ ID NO: 44157 - DNA, 23 bp, Artificial Sequence
  Description of Artificial Sequence: Synthetic oligonucleotide
tgggtggagcaggaggggcagga

SEQ ID NO: 44158 - DNA, 22 bp, Artificial Sequence
  Description of Artificial Sequence: Synthetic oligonucleotide
gggtggagcaggaggggcagga

SEQ ID NO: 44159 - DNA, 26 bp, Artificial Sequence
  Description of Artificial Sequence: Synthetic oligonucleotide
ggtggagcaggaggggcaggagtatt

SEQ ID NO: 44160 - DNA, 26 bp, Artificial Sequence
  Description of Artificial Sequence: Synthetic oligonucleotide
gtggagcaggaggggcaggagtattg

SEQ ID NO: 44161 - DNA, 26 bp, Artificial Sequence
  Description of Artificial Sequence: Synthetic oligonucleotide
tggagcaggaggggcaggagtattgg

SEQ ID NO: 44162 - DNA, 25 bp, Artificial Sequence
  Description of Artificial Sequence: Synthetic oligonucleotide
ggagcaggaggggcaggagtattgg

SEQ ID NO: 44163 - DNA, 26 bp, Artificial Sequence
  Description of Artificial Sequence: Synthetic oligonucleotide
gagcaggaggggcaggagtattggga

SEQ ID NO: 44164 - DNA, 26 bp, Artificial Sequence
  Description of Artificial Sequence: Synthetic oligonucleotide
agcaggaggggcaggagtattgggac

SEQ ID NO: 44165 - DNA, 25 bp, Artificial Sequence
  Description of Artificial Sequence: Synthetic oligonucleotide
gcaggaggggcaggagtattgggac

SEQ ID NO: 44166 - DNA, 25 bp, Artificial Sequence
  Description of Artificial Sequence: Synthetic oligonucleotide
caggaggggcaggagtattgggacc

SEQ ID NO: 44167 - DNA, 25 bp, Artificial Sequence
  Description of Artificial Sequence: Synthetic oligonucleotide
aggaggggcaggagtattgggaccg

SEQ ID NO: 44168 - DNA, 24 bp, Artificial Sequence
  Description of Artificial Sequence: Synthetic oligonucleotide
ggaggggcaggagtattgggaccg

SEQ ID NO: 44169 - DNA, 24 bp, Artificial Sequence
  Description of Artificial Sequence: Synthetic oligonucleotide
gaggggcaggagtattgggaccgg

SEQ ID NO: 44170 - DNA, 25 bp, Artificial Sequence
  Description of Artificial Sequence: Synthetic oligonucleotide
aggggcaggagtattgggaccggga

SEQ ID NO: 44171 - DNA, 24 bp, Artificial Sequence
  Description of Artificial Sequence: Synthetic oligonucleotide
ggggcaggagtattgggaccggga

SEQ ID NO: 44172 - DNA, 25 bp, Artificial Sequence
  Description of Artificial Sequence: Synthetic oligonucleotide
gggcaggagtattgggaccgggaga

SEQ ID NO: 44173 - DNA, 26 bp, Artificial Sequence
  Description of Artificial Sequence: Synthetic oligonucleotide
ggcaggagtattgggaccgggagaca

SEQ ID NO: 44174 - DNA, 27 bp, Artificial Sequence
  Description of Artificial Sequence: Synthetic oligonucleotide
gcaggagtattgggaccgggagacaca

SEQ ID NO: 44175 - DNA, 27 bp, Artificial Sequence
  Description of Artificial Sequence: Synthetic oligonucleotide
caggagtattgggaccgggagacacag

SEQ ID NO: 44176 - DNA, 29 bp, Artificial Sequence
  Description of Artificial Sequence: Synthetic oligonucleotide
aggagtattgggaccgggagacacagaag

SEQ ID NO: 44177 - DNA, 32 bp, Artificial Sequence
  Description of Artificial Sequence: Synthetic oligonucleotide
agtattgggaccgggagacacagaagtacaac

SEQ ID NO: 44178 - DNA, 31 bp, Artificial Sequence
  Description of Artificial Sequence: Synthetic oligonucleotide
gtattgggaccgggagacacagaagtacaac

SEQ ID NO: 44179 - DNA, 31 bp, Artificial Sequence
  Description of Artificial Sequence: Synthetic oligonucleotide
tattgggaccgggagacacagaagtacaacc

SEQ ID NO: 44180 - DNA, 30 bp, Artificial Sequence
  Description of Artificial Sequence: Synthetic oligonucleotide
attgggaccgggagacacagaagtacaacc

SEQ ID NO: 44181 - DNA, 29 bp, Artificial Sequence
  Description of Artificial Sequence: Synthetic oligonucleotide
ttgggaccgggagacacagaagtacaacc

SEQ ID NO: 44182 - DNA, 28 bp, Artificial Sequence
  Description of Artificial Sequence: Synthetic oligonucleotide
tgggaccgggagacacagaagtacaacc

SEQ ID NO: 44183 - DNA, 27 bp, Artificial Sequence
  Description of Artificial Sequence: Synthetic oligonucleotide
gggaccgggagacacagaagtacaacc

SEQ ID NO: 44184 - DNA, 27 bp, Artificial Sequence
  Description of Artificial Sequence: Synthetic oligonucleotide
ggaccgggagacacagaagtacaaccg

SEQ ID NO: 44185 - DNA, 27 bp, Artificial Sequence
  Description of Artificial Sequence: Synthetic oligonucleotide
gaccgggagacacagaagtacaaccgc

SEQ ID NO: 44186 - DNA, 27 bp, Artificial Sequence
  Description of Artificial Sequence: Synthetic oligonucleotide
accgggagacacagaagtacaaccgcc

SEQ ID NO: 44187 - DNA, 27 bp, Artificial Sequence
  Description of Artificial Sequence: Synthetic oligonucleotide
ccgggagacacagaagtacaaccgcca

SEQ ID NO: 44188 - DNA, 27 bp, Artificial Sequence
  Description of Artificial Sequence: Synthetic oligonucleotide
cgggagacacagaagtacaaccgccag

SEQ ID NO: 44189 - DNA, 27 bp, Artificial Sequence
  Description of Artificial Sequence: Synthetic oligonucleotide
gggagacacagaagtacaaccgccagg

SEQ ID NO: 44190 - DNA, 27 bp, Artificial Sequence
  Description of Artificial Sequence: Synthetic oligonucleotide
ggagacacagaagtacaaccgccaggc

SEQ ID NO: 44191 - DNA, 28 bp, Artificial Sequence
  Description of Artificial Sequence: Synthetic oligonucleotide
gagacacagaagtacaaccgccaggcac

SEQ ID NO: 44192 - DNA, 29 bp, Artificial Sequence
  Description of Artificial Sequence: Synthetic oligonucleotide
agacacagaagtacaaccgccaggcacag

SEQ ID NO: 44193 - DNA, 28 bp, Artificial Sequence
  Description of Artificial Sequence: Synthetic oligonucleotide
gacacagaagtacaaccgccaggcacag

SEQ ID NO: 44194 - DNA, 29 bp, Artificial Sequence
  Description of Artificial Sequence: Synthetic oligonucleotide
acacagaagtacaaccgccaggcacagac

SEQ ID NO: 44195 - DNA, 28 bp, Artificial Sequence
  Description of Artificial Sequence: Synthetic oligonucleotide
cacagaagtacaaccgccaggcacagac

SEQ ID NO: 44196 - DNA, 29 bp, Artificial Sequence
  Description of Artificial Sequence: Synthetic oligonucleotide
acagaagtacaaccgccaggcacagactg

SEQ ID NO: 44197 - DNA, 28 bp, Artificial Sequence
  Description of Artificial Sequence: Synthetic oligonucleotide
cagaagtacaaccgccaggcacagactg

SEQ ID NO: 44198 - DNA, 29 bp, Artificial Sequence
  Description of Artificial Sequence: Synthetic oligonucleotide
agaagtacaaccgccaggcacagactgac

SEQ ID NO: 44199 - DNA, 28 bp, Artificial Sequence
  Description of Artificial Sequence: Synthetic oligonucleotide
gaagtacaaccgccaggcacagactgac

SEQ ID NO: 44200 - DNA, 28 bp, Artificial Sequence
  Description of Artificial Sequence: Synthetic oligonucleotide
aagtacaaccgccaggcacagactgacc

SEQ ID NO: 44201 - DNA, 27 bp, Artificial Sequence
  Description of Artificial Sequence: Synthetic oligonucleotide
agtacaaccgccaggcacagactgacc

SEQ ID NO: 44202 - DNA, 26 bp, Artificial Sequence
  Description of Artificial Sequence: Synthetic oligonucleotide
gtacaaccgccaggcacagactgacc

SEQ ID NO: 44203 - DNA, 27 bp, Artificial Sequence
  Description of Artificial Sequence: Synthetic oligonucleotide
tacaaccgccaggcacagactgaccga

SEQ ID NO: 44204 - DNA, 26 bp, Artificial Sequence
  Description of Artificial Sequence: Synthetic oligonucleotide
acaaccgccaggcacagactgaccga

SEQ ID NO: 44205 - DNA, 25 bp, Artificial Sequence
  Description of Artificial Sequence: Synthetic oligonucleotide
caaccgccaggcacagactgaccga

SEQ ID NO: 44206 - DNA, 26 bp, Artificial Sequence
  Description of Artificial Sequence: Synthetic oligonucleotide
aaccgccaggcacagactgaccgagt

SEQ ID NO: 44207 - DNA, 25 bp, Artificial Sequence
  Description of Artificial Sequence: Synthetic oligonucleotide
accgccaggcacagactgaccgagt

SEQ ID NO: 44208 - DNA, 24 bp, Artificial Sequence
  Description of Artificial Sequence: Synthetic oligonucleotide
ccgccaggcacagactgaccgagt

SEQ ID NO: 44209 - DNA, 20 bp, Artificial Sequence
  Description of Artificial Sequence: Synthetic oligonucleotide
gacgtggggcccgacgggca

SEQ ID NO: 44210 - DNA, 20 bp, Artificial Sequence
  Description of Artificial Sequence: Synthetic oligonucleotide
acgtggggcccgacgggcac

SEQ ID NO: 44211 - DNA, 20 bp, Artificial Sequence
  Description of Artificial Sequence: Synthetic oligonucleotide
cgtggggcccgacgggcact

SEQ ID NO: 44212 - DNA, 20 bp, Artificial Sequence
  Description of Artificial Sequence: Synthetic oligonucleotide
gtggggcccgacgggcacct

SEQ ID NO: 44213 - DNA, 20 bp, Artificial Sequence
  Description of Artificial Sequence: Synthetic oligonucleotide
tggggcccgacgggcacctc

SEQ ID NO: 44214 - DNA, 20 bp, Artificial Sequence
  Description of Artificial Sequence: Synthetic oligonucleotide
ggggcccgacgggcacctct

SEQ ID NO: 44215 - DNA, 20 bp, Artificial Sequence
  Description of Artificial Sequence: Synthetic oligonucleotide
gggcccgacgggcacctcct

SEQ ID NO: 44216 - DNA, 20 bp, Artificial Sequence
  Description of Artificial Sequence: Synthetic oligonucleotide
ggcccgacgggcacctcctc

SEQ ID NO: 44217 - DNA, 20 bp, Artificial Sequence
  Description of Artificial Sequence: Synthetic oligonucleotide
gcccgacgggcacctcctcc

SEQ ID NO: 44218 - DNA, 20 bp, Artificial Sequence
  Description of Artificial Sequence: Synthetic oligonucleotide
cccgacgggcacctcctccg

SEQ ID NO: 44219 - DNA, 20 bp, Artificial Sequence
  Description of Artificial Sequence: Synthetic oligonucleotide
ccgacgggcacctcctccgc

SEQ ID NO: 44220 - DNA, 20 bp, Artificial Sequence
  Description of Artificial Sequence: Synthetic oligonucleotide
cgacgggcacctcctccgcg

SEQ ID NO: 44221 - DNA, 20 bp, Artificial Sequence
  Description of Artificial Sequence: Synthetic oligonucleotide
gacgggcacctcctccgcgg

SEQ ID NO: 44222 - DNA, 23 bp, Artificial Sequence
  Description of Artificial Sequence: Synthetic oligonucleotide
acgggcacctcctccgcgggtat

SEQ ID NO: 44223 - DNA, 22 bp, Artificial Sequence
  Description of Artificial Sequence: Synthetic oligonucleotide
cgggcacctcctccgcgggtat

SEQ ID NO: 44224 - DNA, 23 bp, Artificial Sequence
  Description of Artificial Sequence: Synthetic oligonucleotide
gggcacctcctccgcgggtatga

SEQ ID NO: 44225 - DNA, 23 bp, Artificial Sequence
  Description of Artificial Sequence: Synthetic oligonucleotide
ggcacctcctccgcgggtatgac

SEQ ID NO: 44226 - DNA, 24 bp, Artificial Sequence
  Description of Artificial Sequence: Synthetic oligonucleotide
gcacctcctccgcgggtatgacca

SEQ ID NO: 44227 - DNA, 26 bp, Artificial Sequence
  Description of Artificial Sequence: Synthetic oligonucleotide
cacctcctccgcgggtatgaccagta

SEQ ID NO: 44228 - DNA, 26 bp, Artificial Sequence
  Description of Artificial Sequence: Synthetic oligonucleotide
acctcctccgcgggtatgaccagtac

SEQ ID NO: 44229 - DNA, 29 bp, Artificial Sequence
  Description of Artificial Sequence: Synthetic oligonucleotide
cgggtctcacatcctccagaggatgtttg

SEQ ID NO: 44230 - DNA, 29 bp, Artificial Sequence
  Description of Artificial Sequence: Synthetic oligonucleotide
gggtctcacatcctccagaggatgtttgg

SEQ ID NO: 44231 - DNA, 29 bp, Artificial Sequence
  Description of Artificial Sequence: Synthetic oligonucleotide
ggtctcacatcctccagaggatgtttggc

SEQ ID NO: 44232 - DNA, 30 bp, Artificial Sequence
  Description of Artificial Sequence: Synthetic oligonucleotide
gtctcacatcctccagaggatgtttggctg

SEQ ID NO: 44233 - DNA, 30 bp, Artificial Sequence
  Description of Artificial Sequence: Synthetic oligonucleotide
tctcacatcctccagaggatgtttggctgc

SEQ ID NO: 44234 - DNA, 29 bp, Artificial Sequence
  Description of Artificial Sequence: Synthetic oligonucleotide
ctcacatcctccagaggatgtttggctgc

SEQ ID NO: 44235 - DNA, 29 bp, Artificial Sequence
  Description of Artificial Sequence: Synthetic oligonucleotide
tcacatcctccagaggatgtttggctgcg

SEQ ID NO: 44236 - DNA, 28 bp, Artificial Sequence
  Description of Artificial Sequence: Synthetic oligonucleotide
cacatcctccagaggatgtttggctgcg

SEQ ID NO: 44237 - DNA, 29 bp, Artificial Sequence
  Description of Artificial Sequence: Synthetic oligonucleotide
acatcctccagaggatgtttggctgcgac

SEQ ID NO: 44238 - DNA, 28 bp, Artificial Sequence
  Description of Artificial Sequence: Synthetic oligonucleotide
catcctccagaggatgtttggctgcgac

SEQ ID NO: 44239 - DNA, 28 bp, Artificial Sequence
  Description of Artificial Sequence: Synthetic oligonucleotide
atcctccagaggatgtttggctgcgacc

SEQ ID NO: 44240 - DNA, 27 bp, Artificial Sequence
  Description of Artificial Sequence: Synthetic oligonucleotide
tcctccagaggatgtttggctgcgacc

SEQ ID NO: 44241 - DNA, 28 bp, Artificial Sequence
  Description of Artificial Sequence: Synthetic oligonucleotide
atcatccagaggatgtctggctgcgacg

SEQ ID NO: 44242 - DNA, 27 bp, Artificial Sequence
  Description of Artificial Sequence: Synthetic oligonucleotide
tcatccagaggatgtctggctgcgacg

SEQ ID NO: 44243 - DNA, 21 bp, Artificial Sequence
  Description of Artificial Sequence: Synthetic oligonucleotide
tctggctgcgacgtggggccc

SEQ ID NO: 44244 - DNA, 20 bp, Artificial Sequence
  Description of Artificial Sequence: Synthetic oligonucleotide
ctggctgcgacgtggggccc

SEQ ID NO: 44245 - DNA, 29 bp, Artificial Sequence
  Description of Artificial Sequence: Synthetic oligonucleotide
atccagaggatgtatggctgcgacgtgag

SEQ ID NO: 44246 - DNA, 28 bp, Artificial Sequence
  Description of Artificial Sequence: Synthetic oligonucleotide
tccagaggatgtatggctgcgacgtgag

SEQ ID NO: 44247 - DNA, 27 bp, Artificial Sequence
  Description of Artificial Sequence: Synthetic oligonucleotide
ccagaggatgtatggctgcgacgtgag

SEQ ID NO: 44248 - DNA, 27 bp, Artificial Sequence
  Description of Artificial Sequence: Synthetic oligonucleotide
cagaggatgtatggctgcgacgtgagg

SEQ ID NO: 44249 - DNA, 27 bp, Artificial Sequence
  Description of Artificial Sequence: Synthetic oligonucleotide
agaggatgtatggctgcgacgtgaggc

SEQ ID NO: 44250 - DNA, 26 bp, Artificial Sequence
  Description of Artificial Sequence: Synthetic oligonucleotide
gaggatgtatggctgcgacgtgaggc

SEQ ID NO: 44251 - DNA, 26 bp, Artificial Sequence
  Description of Artificial Sequence: Synthetic oligonucleotide
aggatgtatggctgcgacgtgaggcc

SEQ ID NO: 44252 - DNA, 25 bp, Artificial Sequence
  Description of Artificial Sequence: Synthetic oligonucleotide
ggatgtatggctgcgacgtgaggcc

SEQ ID NO: 44253 - DNA, 25 bp, Artificial Sequence
  Description of Artificial Sequence: Synthetic oligonucleotide
gatgtatggctgcgacgtgaggccc

SEQ ID NO: 44254 - DNA, 26 bp, Artificial Sequence
  Description of Artificial Sequence: Synthetic oligonucleotide
atgtatggctgcgacgtgaggcccga

SEQ ID NO: 44255 - DNA, 25 bp, Artificial Sequence
  Description of Artificial Sequence: Synthetic oligonucleotide
tgtatggctgcgacgtgaggcccga

SEQ ID NO: 44256 - DNA, 24 bp, Artificial Sequence
  Description of Artificial Sequence: Synthetic oligonucleotide
gtatggctgcgacgtgaggcccga

SEQ ID NO: 44257 - DNA, 24 bp, Artificial Sequence
  Description of Artificial Sequence: Synthetic oligonucleotide
tatggctgcgacgtgaggcccgac

SEQ ID NO: 44258 - DNA, 23 bp, Artificial Sequence
  Description of Artificial Sequence: Synthetic oligonucleotide
atggctgcgacgtgaggcccgac

SEQ ID NO: 44259 - DNA, 22 bp, Artificial Sequence
  Description of Artificial Sequence: Synthetic oligonucleotide
tggctgcgacgtgaggcccgac

SEQ ID NO: 44260 - DNA, 21 bp, Artificial Sequence
  Description of Artificial Sequence: Synthetic oligonucleotide
ggctgcgacgtgaggcccgac

SEQ ID NO: 44261 - DNA, 21 bp, Artificial Sequence
  Description of Artificial Sequence: Synthetic oligonucleotide
gctgcgacgtgaggcccgacg

SEQ ID NO: 44262 - DNA, 21 bp, Artificial Sequence
  Description of Artificial Sequence: Synthetic oligonucleotide
ctgcgacgtgaggcccgacgg

SEQ ID NO: 44263 - DNA, 21 bp, Artificial Sequence
  Description of Artificial Sequence: Synthetic oligonucleotide
tgcgacgtgaggcccgacggg

SEQ ID NO: 44264 - DNA, 20 bp, Artificial Sequence
  Description of Artificial Sequence: Synthetic oligonucleotide
gcgacgtgaggcccgacggg

SEQ ID NO: 44265 - DNA, 20 bp, Artificial Sequence
  Description of Artificial Sequence: Synthetic oligonucleotide
cgacgtgaggcccgacgggc

SEQ ID NO: 44266 - DNA, 20 bp, Artificial Sequence
  Description of Artificial Sequence: Synthetic oligonucleotide
gacgtgaggcccgacgggcg

SEQ ID NO: 44267 - DNA, 20 bp, Artificial Sequence
  Description of Artificial Sequence: Synthetic oligonucleotide
acgtgaggcccgacgggcgc

SEQ ID NO: 44268 - DNA, 20 bp, Artificial Sequence
  Description of Artificial Sequence: Synthetic oligonucleotide
cgtgaggcccgacgggcgct

SEQ ID NO: 44269 - DNA, 20 bp, Artificial Sequence
  Description of Artificial Sequence: Synthetic oligonucleotide
gtgaggcccgacgggcgcct

SEQ ID NO: 44270 - DNA, 20 bp, Artificial Sequence
  Description of Artificial Sequence: Synthetic oligonucleotide
tgaggcccgacgggcgcctc

SEQ ID NO: 44271 - DNA, 20 bp, Artificial Sequence
  Description of Artificial Sequence: Synthetic oligonucleotide
gaggcccgacgggcgcctct

SEQ ID NO: 44272 - DNA, 20 bp, Artificial Sequence
  Description of Artificial Sequence: Synthetic oligonucleotide
aggcccgacgggcgcctcct

SEQ ID NO: 44273 - DNA, 24 bp, Artificial Sequence
  Description of Artificial Sequence: Synthetic oligonucleotide
ccgcggacacggcgactcagatca

SEQ ID NO: 44274 - DNA, 24 bp, Artificial Sequence
  Description of Artificial Sequence: Synthetic oligonucleotide
cgcggacacggcgactcagatcac

SEQ ID NO: 44275 - DNA, 24 bp, Artificial Sequence
  Description of Artificial Sequence: Synthetic oligonucleotide
gcggacacggcgactcagatcacc

SEQ ID NO: 44276 - DNA, 25 bp, Artificial Sequence
  Description of Artificial Sequence: Synthetic oligonucleotide
cggacacggcgactcagatcaccca

SEQ ID NO: 44277 - DNA, 25 bp, Artificial Sequence
  Description of Artificial Sequence: Synthetic oligonucleotide
ggacacggcgactcagatcacccag

SEQ ID NO: 44278 - DNA, 25 bp, Artificial Sequence
  Description of Artificial Sequence: Synthetic oligonucleotide
gacacggcgactcagatcacccagc

SEQ ID NO: 44279 - DNA, 25 bp, Artificial Sequence
  Description of Artificial Sequence: Synthetic oligonucleotide
acacggcgactcagatcacccagcg

SEQ ID NO: 44280 - DNA, 24 bp, Artificial Sequence
  Description of Artificial Sequence: Synthetic oligonucleotide
cacggcgactcagatcacccagcg

SEQ ID NO: 44281 - DNA, 26 bp, Artificial Sequence
  Description of Artificial Sequence: Synthetic oligonucleotide
acggcgactcagatcacccagcgcaa

SEQ ID NO: 44282 - DNA, 25 bp, Artificial Sequence
  Description of Artificial Sequence: Synthetic oligonucleotide
cggcgactcagatcacccagcgcaa

SEQ ID NO: 44283 - DNA, 26 bp, Artificial Sequence
  Description of Artificial Sequence: Synthetic oligonucleotide
ggcgactcagatcacccagcgcaagt

SEQ ID NO: 44284 - DNA, 26 bp, Artificial Sequence
  Description of Artificial Sequence: Synthetic oligonucleotide
gcgactcagatcacccagcgcaagtg

SEQ ID NO: 44285 - DNA, 26 bp, Artificial Sequence
  Description of Artificial Sequence: Synthetic oligonucleotide
cgactcagatcacccagcgcaagtgg

SEQ ID NO: 44286 - DNA, 27 bp, Artificial Sequence
  Description of Artificial Sequence: Synthetic oligonucleotide
gactcagatcacccagcgcaagtggga

SEQ ID NO: 44287 - DNA, 27 bp, Artificial Sequence
  Description of Artificial Sequence: Synthetic oligonucleotide
actcagatcacccagcgcaagtgggag

SEQ ID NO: 44288 - DNA, 28 bp, Artificial Sequence
  Description of Artificial Sequence: Synthetic oligonucleotide
ccggctcccactccatgaggtatttctc

SEQ ID NO: 44289 - DNA, 28 bp, Artificial Sequence
  Description of Artificial Sequence: Synthetic oligonucleotide
cggctcccactccatgaggtatttctcc

SEQ ID NO: 44290 - DNA, 32 bp, Artificial Sequence
  Description of Artificial Sequence: Synthetic oligonucleotide
tccatgaggtatttctccacatccgtgtcctg

SEQ ID NO: 44291 - DNA, 31 bp, Artificial Sequence
  Description of Artificial Sequence: Synthetic oligonucleotide
ccatgaggtatttctccacatccgtgtcctg

SEQ ID NO: 44292 - DNA, 31 bp, Artificial Sequence
  Description of Artificial Sequence: Synthetic oligonucleotide
catgaggtatttctccacatccgtgtcctgg

SEQ ID NO: 44293 - DNA, 31 bp, Artificial Sequence
  Description of Artificial Sequence: Synthetic oligonucleotide
atgaggtatttctccacatccgtgtcctggc

SEQ ID NO: 44294 - DNA, 30 bp, Artificial Sequence
  Description of Artificial Sequence: Synthetic oligonucleotide
tgaggtatttctccacatccgtgtcctggc

SEQ ID NO: 44295 - DNA, 29 bp, Artificial Sequence
  Description of Artificial Sequence: Synthetic oligonucleotide
gaggtatttctccacatccgtgtcctggc

SEQ ID NO: 44296 - DNA, 29 bp, Artificial Sequence
  Description of Artificial Sequence: Synthetic oligonucleotide
aggtatttctccacatccgtgtcctggcc

SEQ ID NO: 44297 - DNA, 28 bp, Artificial Sequence
  Description of Artificial Sequence: Synthetic oligonucleotide
ggtatttctccacatccgtgtcctggcc

SEQ ID NO: 44298 - DNA, 28 bp, Artificial Sequence
  Description of Artificial Sequence: Synthetic oligonucleotide
gtatttctccacatccgtgtcctggccc

SEQ ID NO: 44299 - DNA, 28 bp, Artificial Sequence
  Description of Artificial Sequence: Synthetic oligonucleotide
tatttctccacatccgtgtcctggcccg

SEQ ID NO: 44300 - DNA, 27 bp, Artificial Sequence
  Description of Artificial Sequence: Synthetic oligonucleotide
atttctccacatccgtgtcctggcccg

SEQ ID NO: 44301 - DNA, 26 bp, Artificial Sequence
  Description of Artificial Sequence: Synthetic oligonucleotide
tttctccacatccgtgtcctggcccg

SEQ ID NO: 44302 - DNA, 25 bp, Artificial Sequence
  Description of Artificial Sequence: Synthetic oligonucleotide
ttctccacatccgtgtcctggcccg

SEQ ID NO: 44303 - DNA, 24 bp, Artificial Sequence
  Description of Artificial Sequence: Synthetic oligonucleotide
tctccacatccgtgtcctggcccg

SEQ ID NO: 44304 - DNA, 23 bp, Artificial Sequence
  Description of Artificial Sequence: Synthetic oligonucleotide
ctccacatccgtgtcctggcccg

SEQ ID NO: 44305 - DNA, 23 bp, Artificial Sequence
  Description of Artificial Sequence: Synthetic oligonucleotide
tccacatccgtgtcctggcccgg

SEQ ID NO: 44306 - DNA, 22 bp, Artificial Sequence
  Description of Artificial Sequence: Synthetic oligonucleotide
ccacatccgtgtcctggcccgg

SEQ ID NO: 44307 - DNA, 23 bp, Artificial Sequence
  Description of Artificial Sequence: Synthetic oligonucleotide
agtccaagaggggagccgcggga

SEQ ID NO: 44308 - DNA, 22 bp, Artificial Sequence
  Description of Artificial Sequence: Synthetic oligonucleotide
gtccaagaggggagccgcggga

SEQ ID NO: 44309 - DNA, 22 bp, Artificial Sequence
  Description of Artificial Sequence: Synthetic oligonucleotide
tccaagaggggagccgcgggag

SEQ ID NO: 44310 - DNA, 21 bp, Artificial Sequence
  Description of Artificial Sequence: Synthetic oligonucleotide
ccaagaggggagccgcgggag

SEQ ID NO: 44311 - DNA, 21 bp, Artificial Sequence
  Description of Artificial Sequence: Synthetic oligonucleotide
caagaggggagccgcgggagc

SEQ ID NO: 44312 - DNA, 21 bp, Artificial Sequence
  Description of Artificial Sequence: Synthetic oligonucleotide
aagaggggagccgcgggagcc

SEQ ID NO: 44313 - DNA, 20 bp, Artificial Sequence
  Description of Artificial Sequence: Synthetic oligonucleotide
agaggggagccgcgggagcc

SEQ ID NO: 44314 - DNA, 20 bp, Artificial Sequence
  Description of Artificial Sequence: Synthetic oligonucleotide
gaggggagccgcgggagcct

SEQ ID NO: 44315 - DNA, 20 bp, Artificial Sequence
  Description of Artificial Sequence: Synthetic oligonucleotide
aggggagccgcgggagccgt

SEQ ID NO: 44316 - DNA, 20 bp, Artificial Sequence
  Description of Artificial Sequence: Synthetic oligonucleotide
ggggagccgcgggagccgtt

SEQ ID NO: 44317 - DNA, 20 bp, Artificial Sequence
  Description of Artificial Sequence: Synthetic oligonucleotide
gggagccgcgggagccgtgt

SEQ ID NO: 44318 - DNA, 20 bp, Artificial Sequence
  Description of Artificial Sequence: Synthetic oligonucleotide
ggagccgcgggagccgtggt

SEQ ID NO: 44319 - DNA, 20 bp, Artificial Sequence
  Description of Artificial Sequence: Synthetic oligonucleotide
gagccgcgggagccgtgggt

SEQ ID NO: 44320 - DNA, 20 bp, Artificial Sequence
  Description of Artificial Sequence: Synthetic oligonucleotide
agccgcgggagccgtgggtg

SEQ ID NO: 44321 - DNA, 20 bp, Artificial Sequence
  Description of Artificial Sequence: Synthetic oligonucleotide
gccgcgggagccgtgggtgt

SEQ ID NO: 44322 - DNA, 20 bp, Artificial Sequence
  Description of Artificial Sequence: Synthetic oligonucleotide
ccgcgggagccgtgggtgga

SEQ ID NO: 44323 - DNA, 20 bp, Artificial Sequence
  Description of Artificial Sequence: Synthetic oligonucleotide
cgcgggagccgtgggtggag

SEQ ID NO: 44324 - DNA, 21 bp, Artificial Sequence
  Description of Artificial Sequence: Synthetic oligonucleotide
gcgggagccgtgggtggagca

SEQ ID NO: 44325 - DNA, 21 bp, Artificial Sequence
  Description of Artificial Sequence: Synthetic oligonucleotide
cgggagccgtgggtggagcag

SEQ ID NO: 44326 - DNA, 22 bp, Artificial Sequence
  Description of Artificial Sequence: Synthetic oligonucleotide
gggagccgtgggtggagcagga

SEQ ID NO: 44327 - DNA, 22 bp, Artificial Sequence
  Description of Artificial Sequence: Synthetic oligonucleotide
ggagccgtgggtggagcaggag

SEQ ID NO: 44328 - DNA, 22 bp, Artificial Sequence
  Description of Artificial Sequence: Synthetic oligonucleotide
gagccgtgggtggagcaggagg

SEQ ID NO: 44329 - DNA, 22 bp, Artificial Sequence
  Description of Artificial Sequence: Synthetic oligonucleotide
agccgtgggtggagcaggaggg

SEQ ID NO: 44330 - DNA, 26 bp, Artificial Sequence
  Description of Artificial Sequence: Synthetic oligonucleotide
gacgggtctcacaccctccagaggat

SEQ ID NO: 44331 - DNA, 27 bp, Artificial Sequence
  Description of Artificial Sequence: Synthetic oligonucleotide
acgggtctcacaccctccagaggatgt

SEQ ID NO: 44332 - DNA, 32 bp, Artificial Sequence
  Description of Artificial Sequence: Synthetic oligonucleotide
tggagaagagcagagatacacgtgccatgttc

SEQ ID NO: 44333 - DNA, 31 bp, Artificial Sequence
  Description of Artificial Sequence: Synthetic oligonucleotide
ggagaagagcagagatacacgtgccatgttc

SEQ ID NO: 44334 - DNA, 32 bp, Artificial Sequence
  Description of Artificial Sequence: Synthetic oligonucleotide
gagaagagcagagatacacgtgccatgttcag

SEQ ID NO: 44335 - DNA, 32 bp, Artificial Sequence
  Description of Artificial Sequence: Synthetic oligonucleotide
agaagagcagagatacacgtgccatgttcagc

SEQ ID NO: 44336 - DNA, 31 bp, Artificial Sequence
  Description of Artificial Sequence: Synthetic oligonucleotide
gaagagcagagatacacgtgccatgttcagc

SEQ ID NO: 44337 - DNA, 32 bp, Artificial Sequence
  Description of Artificial Sequence: Synthetic oligonucleotide
aagagcagagatacacgtgccatgttcagcac

SEQ ID NO: 44338 - DNA, 31 bp, Artificial Sequence
  Description of Artificial Sequence: Synthetic oligonucleotide
agagcagagatacacgtgccatgttcagcac

SEQ ID NO: 44339 - DNA, 30 bp, Artificial Sequence
  Description of Artificial Sequence: Synthetic oligonucleotide
gagcagagatacacgtgccatgttcagcac

SEQ ID NO: 44340 - DNA, 30 bp, Artificial Sequence
  Description of Artificial Sequence: Synthetic oligonucleotide
agcagagatacacgtgccatgttcagcacg

SEQ ID NO: 44341 - DNA, 29 bp, Artificial Sequence
  Description of Artificial Sequence: Synthetic oligonucleotide
gcagagatacacgtgccatgttcagcacg

SEQ ID NO: 44342 - DNA, 30 bp, Artificial Sequence
  Description of Artificial Sequence: Synthetic oligonucleotide
cagagatacacgtgccatgttcagcacgag

SEQ ID NO: 44343 - DNA, 30 bp, Artificial Sequence
  Description of Artificial Sequence: Synthetic oligonucleotide
agagatacacgtgccatgttcagcacgagg

SEQ ID NO: 44344 - DNA, 29 bp, Artificial Sequence
  Description of Artificial Sequence: Synthetic oligonucleotide
gagatacacgtgccatgttcagcacgagg

SEQ ID NO: 44345 - DNA, 29 bp, Artificial Sequence
  Description of Artificial Sequence: Synthetic oligonucleotide
agatacacgtgccatgttcagcacgaggg

SEQ ID NO: 44346 - DNA, 28 bp, Artificial Sequence
  Description of Artificial Sequence: Synthetic oligonucleotide
gatacacgtgccatgttcagcacgaggg

SEQ ID NO: 44347 - DNA, 28 bp, Artificial Sequence
  Description of Artificial Sequence: Synthetic oligonucleotide
atacacgtgccatgttcagcacgagggg

SEQ ID NO: 44348 - DNA, 27 bp, Artificial Sequence
  Description of Artificial Sequence: Synthetic oligonucleotide
tacacgtgccatgttcagcacgagggg

SEQ ID NO: 44349 - DNA, 26 bp, Artificial Sequence
  Description of Artificial Sequence: Synthetic oligonucleotide
acacgtgccatgttcagcacgagggg

SEQ ID NO: 44350 - DNA, 25 bp, Artificial Sequence
  Description of Artificial Sequence: Synthetic oligonucleotide
cacgtgccatgttcagcacgagggg

SEQ ID NO: 44351 - DNA, 26 bp, Artificial Sequence
  Description of Artificial Sequence: Synthetic oligonucleotide
acgtgccatgttcagcacgaggggct

SEQ ID NO: 44352 - DNA, 25 bp, Artificial Sequence
  Description of Artificial Sequence: Synthetic oligonucleotide
cgtgccatgttcagcacgaggggct

SEQ ID NO: 44353 - DNA, 25 bp, Artificial Sequence
  Description of Artificial Sequence: Synthetic oligonucleotide
gtgccatgttcagcacgaggggctg

SEQ ID NO: 44354 - DNA, 25 bp, Artificial Sequence
  Description of Artificial Sequence: Synthetic oligonucleotide
tgccatgttcagcacgaggggctgc

SEQ ID NO: 44355 - DNA, 24 bp, Artificial Sequence
  Description of Artificial Sequence: Synthetic oligonucleotide
gccatgttcagcacgaggggctgc

SEQ ID NO: 44356 - DNA, 24 bp, Artificial Sequence
  Description of Artificial Sequence: Synthetic oligonucleotide
ccatgttcagcacgaggggctgcc

SEQ ID NO: 44357 - DNA, 24 bp, Artificial Sequence
  Description of Artificial Sequence: Synthetic oligonucleotide
catgttcagcacgaggggctgccg

SEQ ID NO: 44358 - DNA, 25 bp, Artificial Sequence
  Description of Artificial Sequence: Synthetic oligonucleotide
atgttcagcacgaggggctgccgga

SEQ ID NO: 44359 - DNA, 24 bp, Artificial Sequence
  Description of Artificial Sequence: Synthetic oligonucleotide
tgttcagcacgaggggctgccgga

SEQ ID NO: 44360 - DNA, 23 bp, Artificial Sequence
  Description of Artificial Sequence: Synthetic oligonucleotide
gttcagcacgaggggctgccgga

SEQ ID NO: 44361 - DNA, 23 bp, Artificial Sequence
  Description of Artificial Sequence: Synthetic oligonucleotide
ttcagcacgaggggctgccggag

SEQ ID NO: 44362 - DNA, 22 bp, Artificial Sequence
  Description of Artificial Sequence: Synthetic oligonucleotide
tcagcacgaggggctgccggag

SEQ ID NO: 44363 - DNA, 25 bp, Artificial Sequence
  Description of Artificial Sequence: Synthetic oligonucleotide
cggagcccctcaccctgagatggaa

SEQ ID NO: 44364 - DNA, 25 bp, Artificial Sequence
  Description of Artificial Sequence: Synthetic oligonucleotide
ggagcccctcaccctgagatggaag

SEQ ID NO: 44365 - DNA, 25 bp, Artificial Sequence
  Description of Artificial Sequence: Synthetic oligonucleotide
gagcccctcaccctgagatggaagc

SEQ ID NO: 44366 - DNA, 25 bp, Artificial Sequence
  Description of Artificial Sequence: Synthetic oligonucleotide
agcccctcaccctgagatggaagcc

SEQ ID NO: 44367 - DNA, 24 bp, Artificial Sequence
  Description of Artificial Sequence: Synthetic oligonucleotide
gcccctcaccctgagatggaagcc

SEQ ID NO: 44368 - DNA, 25 bp, Artificial Sequence
  Description of Artificial Sequence: Synthetic oligonucleotide
cccctcaccctgagatggaagccgt

SEQ ID NO: 44369 - DNA, 27 bp, Artificial Sequence
  Description of Artificial Sequence: Synthetic oligonucleotide
ccctcaccctgagatggaagccgtctt

SEQ ID NO: 44370 - DNA, 27 bp, Artificial Sequence
  Description of Artificial Sequence: Synthetic oligonucleotide
cctcaccctgagatggaagccgtcttc

SEQ ID NO: 44371 - DNA, 27 bp, Artificial Sequence
  Description of Artificial Sequence: Synthetic oligonucleotide
ctcaccctgagatggaagccgtcttcc

SEQ ID NO: 44372 - DNA, 27 bp, Artificial Sequence
  Description of Artificial Sequence: Synthetic oligonucleotide
tcaccctgagatggaagccgtcttccc

SEQ ID NO: 44373 - DNA, 27 bp, Artificial Sequence
  Description of Artificial Sequence: Synthetic oligonucleotide
caccctgagatggaagccgtcttccca

SEQ ID NO: 44374 - DNA, 27 bp, Artificial Sequence
  Description of Artificial Sequence: Synthetic oligonucleotide
accctgagatggaagccgtcttcccag

SEQ ID NO: 44375 - DNA, 26 bp, Artificial Sequence
  Description of Artificial Sequence: Synthetic oligonucleotide
ccctgagatggaagccgtcttcccag

SEQ ID NO: 44376 - DNA, 26 bp, Artificial Sequence
  Description of Artificial Sequence: Synthetic oligonucleotide
cctgagatggaagccgtcttcccagc

SEQ ID NO: 44377 - DNA, 26 bp, Artificial Sequence
  Description of Artificial Sequence: Synthetic oligonucleotide
ctgagatggaagccgtcttcccagcc

SEQ ID NO: 44378 - DNA, 27 bp, Artificial Sequence
  Description of Artificial Sequence: Synthetic oligonucleotide
tgagatggaagccgtcttcccagccca

SEQ ID NO: 44379 - DNA, 26 bp, Artificial Sequence
  Description of Artificial Sequence: Synthetic oligonucleotide
gagatggaagccgtcttcccagccca

SEQ ID NO: 44380 - DNA, 26 bp, Artificial Sequence
  Description of Artificial Sequence: Synthetic oligonucleotide
agatggaagccgtcttcccagcccac

SEQ ID NO: 44381 - DNA, 25 bp, Artificial Sequence
  Description of Artificial Sequence: Synthetic oligonucleotide
gatggaagccgtcttcccagcccac

SEQ ID NO: 44382 - DNA, 27 bp, Artificial Sequence
  Description of Artificial Sequence: Synthetic oligonucleotide
atggaagccgtcttcccagcccaccat

SEQ ID NO: 44383 - DNA, 26 bp, Artificial Sequence
  Description of Artificial Sequence: Synthetic oligonucleotide
tggaagccgtcttcccagcccaccat

SEQ ID NO: 44384 - DNA, 25 bp, Artificial Sequence
  Description of Artificial Sequence: Synthetic oligonucleotide
ggaagccgtcttcccagcccaccat

SEQ ID NO: 44385 - DNA, 25 bp, Artificial Sequence
  Description of Artificial Sequence: Synthetic oligonucleotide
gaagccgtcttcccagcccaccatc

SEQ ID NO: 44386 - DNA, 25 bp, Artificial Sequence
  Description of Artificial Sequence: Synthetic oligonucleotide
aagccgtcttcccagcccaccatcc

SEQ ID NO: 44387 - DNA, 29 bp, Artificial Sequence
  Description of Artificial Sequence: Synthetic oligonucleotide
tggctgtcctagctgtcctaggagctatg

SEQ ID NO: 44388 - DNA, 28 bp, Artificial Sequence
  Description of Artificial Sequence: Synthetic oligonucleotide
ggctgtcctagctgtcctaggagctatg

SEQ ID NO: 44389 - DNA, 28 bp, Artificial Sequence
  Description of Artificial Sequence: Synthetic oligonucleotide
gctgtcctagctgtcctaggagctatgg

SEQ ID NO: 44390 - DNA, 29 bp, Artificial Sequence
  Description of Artificial Sequence: Synthetic oligonucleotide
ctgtcctagctgtcctaggagctatggtg

SEQ ID NO: 44391 - DNA, 29 bp, Artificial Sequence
  Description of Artificial Sequence: Synthetic oligonucleotide
tgtcctagctgtcctaggagctatggtgg

SEQ ID NO: 44392 - DNA, 28 bp, Artificial Sequence
  Description of Artificial Sequence: Synthetic oligonucleotide
gtcctagctgtcctaggagctatggtgg

SEQ ID NO: 44393 - DNA, 28 bp, Artificial Sequence
  Description of Artificial Sequence: Synthetic oligonucleotide
tcctagctgtcctaggagctatggtggc

SEQ ID NO: 44394 - DNA, 27 bp, Artificial Sequence
  Description of Artificial Sequence: Synthetic oligonucleotide
cctagctgtcctaggagctatggtggc

SEQ ID NO: 44395 - DNA, 28 bp, Artificial Sequence
  Description of Artificial Sequence: Synthetic oligonucleotide
ctagctgtcctaggagctatggtggctg

SEQ ID NO: 44396 - DNA, 30 bp, Artificial Sequence
  Description of Artificial Sequence: Synthetic oligonucleotide
tagctgtcctaggagctatggtggctgttg

SEQ ID NO: 44397 - DNA, 29 bp, Artificial Sequence
  Description of Artificial Sequence: Synthetic oligonucleotide
agctgtcctaggagctatggtggctgttg

SEQ ID NO: 44398 - DNA, 28 bp, Artificial Sequence
  Description of Artificial Sequence: Synthetic oligonucleotide
gctgtcctaggagctatggtggctgttg

SEQ ID NO: 44399 - DNA, 29 bp, Artificial Sequence
  Description of Artificial Sequence: Synthetic oligonucleotide
ctgtcctaggagctatggtggctgttgtg

SEQ ID NO: 44400 - DNA, 31 bp, Artificial Sequence
  Description of Artificial Sequence: Synthetic oligonucleotide
tgtcctaggagctatggtggctgttgtgatg

SEQ ID NO: 44401 - DNA, 30 bp, Artificial Sequence
  Description of Artificial Sequence: Synthetic oligonucleotide
gtcctaggagctatggtggctgttgtgatg

SEQ ID NO: 44402 - DNA, 31 bp, Artificial Sequence
  Description of Artificial Sequence: Synthetic oligonucleotide
tcctaggagctatggtggctgttgtgatgtg

SEQ ID NO: 44403 - DNA, 30 bp, Artificial Sequence
  Description of Artificial Sequence: Synthetic oligonucleotide
cctaggagctatggtggctgttgtgatgtg

SEQ ID NO: 44404 - DNA, 32 bp, Artificial Sequence
  Description of Artificial Sequence: Synthetic oligonucleotide
ctaggagctatggtggctgttgtgatgtgtag

SEQ ID NO: 44405 - DNA, 32 bp, Artificial Sequence
  Description of Artificial Sequence: Synthetic oligonucleotide
taggagctatggtggctgttgtgatgtgtagg

SEQ ID NO: 44406 - DNA, 31 bp, Artificial Sequence
  Description of Artificial Sequence: Synthetic oligonucleotide
aggagctatggtggctgttgtgatgtgtagg

SEQ ID NO: 44407 - DNA, 30 bp, Artificial Sequence
  Description of Artificial Sequence: Synthetic oligonucleotide
ggagctatggtggctgttgtgatgtgtagg

SEQ ID NO: 44408 - DNA, 31 bp, Artificial Sequence
  Description of Artificial Sequence: Synthetic oligonucleotide
gagctatggtggctgttgtgatgtgtaggag

SEQ ID NO: 44409 - DNA, 31 bp, Artificial Sequence
  Description of Artificial Sequence: Synthetic oligonucleotide
agctatggtggctgttgtgatgtgtaggagg

SEQ ID NO: 44410 - DNA, 30 bp, Artificial Sequence
  Description of Artificial Sequence: Synthetic oligonucleotide
gctatggtggctgttgtgatgtgtaggagg

SEQ ID NO: 44411 - DNA, 32 bp, Artificial Sequence
  Description of Artificial Sequence: Synthetic oligonucleotide
ctatggtggctgttgtgatgtgtaggaggaag

SEQ ID NO: 44412 - DNA, 33 bp, Artificial Sequence
  Description of Artificial Sequence: Synthetic oligonucleotide
tatggtggctgttgtgatgtgtaggaggaagag

SEQ ID NO: 44413 - DNA, 32 bp, Artificial Sequence
  Description of Artificial Sequence: Synthetic oligonucleotide
atggtggctgttgtgatgtgtaggaggaagag

SEQ ID NO: 44414 - DNA, 24 bp, Artificial Sequence
  Description of Artificial Sequence: Synthetic oligonucleotide
cggagcccctcaccctgagatgga

SEQ ID NO: 44415 - DNA, 25 bp, Artificial Sequence
  Description of Artificial Sequence: Synthetic oligonucleotide
acgggcgccttctccgcgggtataa

SEQ ID NO: 44416 - DNA, 24 bp, Artificial Sequence
  Description of Artificial Sequence: Synthetic oligonucleotide
cgggcgccttctccgcgggtataa

SEQ ID NO: 44417 - DNA, 24 bp, Artificial Sequence
  Description of Artificial Sequence: Synthetic oligonucleotide
gggcgccttctccgcgggtataac

SEQ ID NO: 44418 - DNA, 25 bp, Artificial Sequence
  Description of Artificial Sequence: Synthetic oligonucleotide
ggcgccttctccgcgggtataacca

SEQ ID NO: 44419 - DNA, 27 bp, Artificial Sequence
  Description of Artificial Sequence: Synthetic oligonucleotide
gcgccttctccgcgggtataaccagtt

SEQ ID NO: 44420 - DNA, 27 bp, Artificial Sequence
  Description of Artificial Sequence: Synthetic oligonucleotide
cgccttctccgcgggtataaccagttc

SEQ ID NO: 44421 - DNA, 27 bp, Artificial Sequence
  Description of Artificial Sequence: Synthetic oligonucleotide
gccttctccgcgggtataaccagttcg

SEQ ID NO: 44422 - DNA, 27 bp, Artificial Sequence
  Description of Artificial Sequence: Synthetic oligonucleotide
ccttctccgcgggtataaccagttcgc

SEQ ID NO: 44423 - DNA, 27 bp, Artificial Sequence
  Description of Artificial Sequence: Synthetic oligonucleotide
cttctccgcgggtataaccagttcgcc

SEQ ID NO: 44424 - DNA, 29 bp, Artificial Sequence
  Description of Artificial Sequence: Synthetic oligonucleotide
ttctccgcgggtataaccagttcgcctac

SEQ ID NO: 44425 - DNA, 28 bp, Artificial Sequence
  Description of Artificial Sequence: Synthetic oligonucleotide
tctccgcgggtataaccagttcgcctac

SEQ ID NO: 44426 - DNA, 23 bp, Artificial Sequence
  Description of Artificial Sequence: Synthetic oligonucleotide
tctcgggagccctggccctgact

SEQ ID NO: 44427 - DNA, 22 bp, Artificial Sequence
  Description of Artificial Sequence: Synthetic oligonucleotide
ctcgggagccctggccctgact

SEQ ID NO: 44428 - DNA, 23 bp, Artificial Sequence
  Description of Artificial Sequence: Synthetic oligonucleotide
tcgggagccctggccctgactga

SEQ ID NO: 44429 - DNA, 22 bp, Artificial Sequence
  Description of Artificial Sequence: Synthetic oligonucleotide
cgggagccctggccctgactga

SEQ ID NO: 44430 - DNA, 23 bp, Artificial Sequence
  Description of Artificial Sequence: Synthetic oligonucleotide
gggagccctggccctgactgaga

SEQ ID NO: 44431 - DNA, 23 bp, Artificial Sequence
  Description of Artificial Sequence: Synthetic oligonucleotide
ggagccctggccctgactgagac

SEQ ID NO: 44432 - DNA, 24 bp, Artificial Sequence
  Description of Artificial Sequence: Synthetic oligonucleotide
gagccctggccctgactgagacct

SEQ ID NO: 44433 - DNA, 24 bp, Artificial Sequence
  Description of Artificial Sequence: Synthetic oligonucleotide
agccctggccctgactgagacctg

SEQ ID NO: 44434 - DNA, 23 bp, Artificial Sequence
  Description of Artificial Sequence: Synthetic oligonucleotide
gccctggccctgactgagacctg

SEQ ID NO: 44435 - DNA, 23 bp, Artificial Sequence
  Description of Artificial Sequence: Synthetic oligonucleotide
ccctggccctgactgagacctgg

SEQ ID NO: 44436 - DNA, 23 bp, Artificial Sequence
  Description of Artificial Sequence: Synthetic oligonucleotide
cctggccctgactgagacctggg

SEQ ID NO: 44437 - DNA, 23 bp, Artificial Sequence
  Description of Artificial Sequence: Synthetic oligonucleotide
ctggccctgactgagacctgggc

SEQ ID NO: 44438 - DNA, 23 bp, Artificial Sequence
  Description of Artificial Sequence: Synthetic oligonucleotide
tggccctgactgagacctgggcc

SEQ ID NO: 44439 - DNA, 22 bp, Artificial Sequence
  Description of Artificial Sequence: Synthetic oligonucleotide
ggccctgactgagacctgggcc

SEQ ID NO: 44440 - DNA, 22 bp, Artificial Sequence
  Description of Artificial Sequence: Synthetic oligonucleotide
gccctgactgagacctgggccg

SEQ ID NO: 44441 - DNA, 22 bp, Artificial Sequence
  Description of Artificial Sequence: Synthetic oligonucleotide
ccctgactgagacctgggccgg

SEQ ID NO: 44442 - DNA, 23 bp, Artificial Sequence
  Description of Artificial Sequence: Synthetic oligonucleotide
cctgactgagacctgggccggct

SEQ ID NO: 44443 - DNA, 23 bp, Artificial Sequence
  Description of Artificial Sequence: Synthetic oligonucleotide
ctgactgagacctgggccggctc

SEQ ID NO: 44444 - DNA, 23 bp, Artificial Sequence
  Description of Artificial Sequence: Synthetic oligonucleotide
tgactgagacctgggccggctcc

SEQ ID NO: 44445 - DNA, 22 bp, Artificial Sequence
  Description of Artificial Sequence: Synthetic oligonucleotide
gactgagacctgggccggctcc

SEQ ID NO: 44446 - DNA, 23 bp, Artificial Sequence
  Description of Artificial Sequence: Synthetic oligonucleotide
actgagacctgggccggctccca

SEQ ID NO: 44447 - DNA, 22 bp, Artificial Sequence
  Description of Artificial Sequence: Synthetic oligonucleotide
ctgagacctgggccggctccca

SEQ ID NO: 44448 - DNA, 23 bp, Artificial Sequence
  Description of Artificial Sequence: Synthetic oligonucleotide
tgagacctgggccggctcccact

SEQ ID NO: 44449 - DNA, 26 bp, Artificial Sequence
  Description of Artificial Sequence: Synthetic oligonucleotide
tgaacgaggacctgcgctcctggact

SEQ ID NO: 44450 - DNA, 25 bp, Artificial Sequence
  Description of Artificial Sequence: Synthetic oligonucleotide
gaacgaggacctgcgctcctggact

SEQ ID NO: 44451 - DNA, 25 bp, Artificial Sequence
  Description of Artificial Sequence: Synthetic oligonucleotide
aacgaggacctgcgctcctggactg

SEQ ID NO: 44452 - DNA, 24 bp, Artificial Sequence
  Description of Artificial Sequence: Synthetic oligonucleotide
acgaggacctgcgctcctggactg

SEQ ID NO: 44453 - DNA, 23 bp, Artificial Sequence
  Description of Artificial Sequence: Synthetic oligonucleotide
cgaggacctgcgctcctggactg

SEQ ID NO: 44454 - DNA, 23 bp, Artificial Sequence
  Description of Artificial Sequence: Synthetic oligonucleotide
gaggacctgcgctcctggactgc

SEQ ID NO: 44455 - DNA, 23 bp, Artificial Sequence
  Description of Artificial Sequence: Synthetic oligonucleotide
aggacctgcgctcctggactgcc

SEQ ID NO: 44456 - DNA, 22 bp, Artificial Sequence
  Description of Artificial Sequence: Synthetic oligonucleotide
ggacctgcgctcctggactgcc

SEQ ID NO: 44457 - DNA, 22 bp, Artificial Sequence
  Description of Artificial Sequence: Synthetic oligonucleotide
gacctgcgctcctggactgccg

SEQ ID NO: 44458 - DNA, 22 bp, Artificial Sequence
  Description of Artificial Sequence: Synthetic oligonucleotide
acctgcgctcctggactgccgc

SEQ ID NO: 44459 - DNA, 21 bp, Artificial Sequence
  Description of Artificial Sequence: Synthetic oligonucleotide
cctgcgctcctggactgccgc

SEQ ID NO: 44460 - DNA, 21 bp, Artificial Sequence
  Description of Artificial Sequence: Synthetic oligonucleotide
ctgcgctcctggactgccgcg

SEQ ID NO: 44461 - DNA, 22 bp, Artificial Sequence
  Description of Artificial Sequence: Synthetic oligonucleotide
tgcgctcctggactgccgcgga

SEQ ID NO: 44462 - DNA, 21 bp, Artificial Sequence
  Description of Artificial Sequence: Synthetic oligonucleotide
gcgctcctggactgccgcgga

SEQ ID NO: 44463 - DNA, 22 bp, Artificial Sequence
  Description of Artificial Sequence: Synthetic oligonucleotide
cgctcctggactgccgcggaca

SEQ ID NO: 44464 - DNA, 22 bp, Artificial Sequence
  Description of Artificial Sequence: Synthetic oligonucleotide
gctcctggactgccgcggacac

SEQ ID NO: 44465 - DNA, 22 bp, Artificial Sequence
  Description of Artificial Sequence: Synthetic oligonucleotide
ctcctggactgccgcggacacg

SEQ ID NO: 44466 - DNA, 22 bp, Artificial Sequence
  Description of Artificial Sequence: Synthetic oligonucleotide
tcctggactgccgcggacacgg

SEQ ID NO: 44467 - DNA, 21 bp, Artificial Sequence
  Description of Artificial Sequence: Synthetic oligonucleotide
cctggactgccgcggacacgg

SEQ ID NO: 44468 - DNA, 21 bp, Artificial Sequence
  Description of Artificial Sequence: Synthetic oligonucleotide
ctggactgccgcggacacggc

SEQ ID NO: 44469 - DNA, 21 bp, Artificial Sequence
  Description of Artificial Sequence: Synthetic oligonucleotide
tggactgccgcggacacggcg

SEQ ID NO: 44470 - DNA, 20 bp, Artificial Sequence
  Description of Artificial Sequence: Synthetic oligonucleotide
ggactgccgcggacacggcg

SEQ ID NO: 44471 - DNA, 20 bp, Artificial Sequence
  Description of Artificial Sequence: Synthetic oligonucleotide
gactgccgcggacacggcgg

SEQ ID NO: 44472 - DNA, 21 bp, Artificial Sequence
  Description of Artificial Sequence: Synthetic oligonucleotide
actgccgcggacacggcggct

SEQ ID NO: 44473 - DNA, 20 bp, Artificial Sequence
  Description of Artificial Sequence: Synthetic oligonucleotide
ctgccgcggacacggcggct

SEQ ID NO: 44474 - DNA, 21 bp, Artificial Sequence
  Description of Artificial Sequence: Synthetic oligonucleotide
tgccgcggacacggcggctca

SEQ ID NO: 44475 - DNA, 25 bp, Artificial Sequence
  Description of Artificial Sequence: Synthetic oligonucleotide
cggagagcctacctggagggcactt

SEQ ID NO: 44476 - DNA, 25 bp, Artificial Sequence
  Description of Artificial Sequence: Synthetic oligonucleotide
ggagagcctacctggagggcacttg

SEQ ID NO: 44477 - DNA, 25 bp, Artificial Sequence
  Description of Artificial Sequence: Synthetic oligonucleotide
gagagcctacctggagggcacttgc

SEQ ID NO: 44478 - DNA, 26 bp, Artificial Sequence
  Description of Artificial Sequence: Synthetic oligonucleotide
agagcctacctggagggcacttgcgt

SEQ ID NO: 44479 - DNA, 25 bp, Artificial Sequence
  Description of Artificial Sequence: Synthetic oligonucleotide
gagcctacctggagggcacttgcgt

SEQ ID NO: 44480 - DNA, 25 bp, Artificial Sequence
  Description of Artificial Sequence: Synthetic oligonucleotide
agcctacctggagggcacttgcgtg

SEQ ID NO: 44481 - DNA, 24 bp, Artificial Sequence
  Description of Artificial Sequence: Synthetic oligonucleotide
gcctacctggagggcacttgcgtg

SEQ ID NO: 44482 - DNA, 25 bp, Artificial Sequence
  Description of Artificial Sequence: Synthetic oligonucleotide
cctacctggagggcacttgcgtgga

SEQ ID NO: 44483 - DNA, 26 bp, Artificial Sequence
  Description of Artificial Sequence: Synthetic oligonucleotide
ctacctggagggcacttgcgtggagt

SEQ ID NO: 44484 - DNA, 26 bp, Artificial Sequence
  Description of Artificial Sequence: Synthetic oligonucleotide
tacctggagggcacttgcgtggagtg

SEQ ID NO: 44485 - DNA, 25 bp, Artificial Sequence
  Description of Artificial Sequence: Synthetic oligonucleotide
acctggagggcacttgcgtggagtg

SEQ ID NO: 44486 - DNA, 24 bp, Artificial Sequence
  Description of Artificial Sequence: Synthetic oligonucleotide
cctggagggcacttgcgtggagtg

SEQ ID NO: 44487 - DNA, 24 bp, Artificial Sequence
  Description of Artificial Sequence: Synthetic oligonucleotide
ctggagggcacttgcgtggagtgg

SEQ ID NO: 44488 - DNA, 25 bp, Artificial Sequence
  Description of Artificial Sequence: Synthetic oligonucleotide
tggagggcacttgcgtggagtggct

SEQ ID NO: 44489 - DNA, 24 bp, Artificial Sequence
  Description of Artificial Sequence: Synthetic oligonucleotide
ggagggcacttgcgtggagtggct

SEQ ID NO: 44490 - DNA, 24 bp, Artificial Sequence
  Description of Artificial Sequence: Synthetic oligonucleotide
gagggcacttgcgtggagtggctc

SEQ ID NO: 44491 - DNA, 24 bp, Artificial Sequence
  Description of Artificial Sequence: Synthetic oligonucleotide
agggcacttgcgtggagtggctcc

SEQ ID NO: 44492 - DNA, 23 bp, Artificial Sequence
  Description of Artificial Sequence: Synthetic oligonucleotide
gggcacttgcgtggagtggctcc

SEQ ID NO: 44493 - DNA, 23 bp, Artificial Sequence
  Description of Artificial Sequence: Synthetic oligonucleotide
ggcacttgcgtggagtggctccg

SEQ ID NO: 44494 - DNA, 24 bp, Artificial Sequence
  Description of Artificial Sequence: Synthetic oligonucleotide
gcacttgcgtggagtggctccgca

SEQ ID NO: 44495 - DNA, 27 bp, Artificial Sequence
  Description of Artificial Sequence: Synthetic oligonucleotide
cacttgcgtggagtggctccgcagata

SEQ ID NO: 44496 - DNA, 27 bp, Artificial Sequence
  Description of Artificial Sequence: Synthetic oligonucleotide
acttgcgtggagtggctccgcagatac

SEQ ID NO: 44497 - DNA, 26 bp, Artificial Sequence
  Description of Artificial Sequence: Synthetic oligonucleotide
cttgcgtggagtggctccgcagatac

SEQ ID NO: 44498 - DNA, 27 bp, Artificial Sequence
  Description of Artificial Sequence: Synthetic oligonucleotide
ttgcgtggagtggctccgcagatacct

SEQ ID NO: 44499 - DNA, 21 bp, Artificial Sequence
  Description of Artificial Sequence: Synthetic oligonucleotide
cccaagaggggagccgcggga

SEQ ID NO: 44500 - DNA, 29 bp, Artificial Sequence
  Description of Artificial Sequence: Synthetic oligonucleotide
gtatttctccacatccgtgtcctggcctg

SEQ ID NO: 44501 - DNA, 29 bp, Artificial Sequence
  Description of Artificial Sequence: Synthetic oligonucleotide
tatttctccacatccgtgtcctggcctgg

SEQ ID NO: 44502 - DNA, 28 bp, Artificial Sequence
  Description of Artificial Sequence: Synthetic oligonucleotide
atttctccacatccgtgtcctggcctgg

SEQ ID NO: 44503 - DNA, 27 bp, Artificial Sequence
  Description of Artificial Sequence: Synthetic oligonucleotide
tttctccacatccgtgtcctggcctgg

SEQ ID NO: 44504 - DNA, 26 bp, Artificial Sequence
  Description of Artificial Sequence: Synthetic oligonucleotide
ttctccacatccgtgtcctggcctgg

SEQ ID NO: 44505 - DNA, 25 bp, Artificial Sequence
  Description of Artificial Sequence: Synthetic oligonucleotide
tctccacatccgtgtcctggcctgg

SEQ ID NO: 44506 - DNA, 24 bp, Artificial Sequence
  Description of Artificial Sequence: Synthetic oligonucleotide
ctccacatccgtgtcctggcctgg

SEQ ID NO: 44507 - DNA, 24 bp, Artificial Sequence
  Description of Artificial Sequence: Synthetic oligonucleotide
tccacatccgtgtcctggcctggc

SEQ ID NO: 44508 - DNA, 23 bp, Artificial Sequence
  Description of Artificial Sequence: Synthetic oligonucleotide
ccacatccgtgtcctggcctggc

SEQ ID NO: 44509 - DNA, 23 bp, Artificial Sequence
  Description of Artificial Sequence: Synthetic oligonucleotide
cacatccgtgtcctggcctggcc

SEQ ID NO: 44510 - DNA, 23 bp, Artificial Sequence
  Description of Artificial Sequence: Synthetic oligonucleotide
acatccgtgtcctggcctggccg

SEQ ID NO: 44511 - DNA, 22 bp, Artificial Sequence
  Description of Artificial Sequence: Synthetic oligonucleotide
catccgtgtcctggcctggccg

SEQ ID NO: 44512 - DNA, 22 bp, Artificial Sequence
  Description of Artificial Sequence: Synthetic oligonucleotide
atccgtgtcctggcctggccgc

SEQ ID NO: 44513 - DNA, 21 bp, Artificial Sequence
  Description of Artificial Sequence: Synthetic oligonucleotide
tccgtgtcctggcctggccgc

SEQ ID NO: 44514 - DNA, 20 bp, Artificial Sequence
  Description of Artificial Sequence: Synthetic oligonucleotide
ccgtgtcctggcctggccgc

SEQ ID NO: 44515 - DNA, 20 bp, Artificial Sequence
  Description of Artificial Sequence: Synthetic oligonucleotide
cgtgtcctggcctggccgcg

SEQ ID NO: 44516 - DNA, 20 bp, Artificial Sequence
  Description of Artificial Sequence: Synthetic oligonucleotide
gtgtcctggcctggccgcgg

SEQ ID NO: 44517 - DNA, 20 bp, Artificial Sequence
  Description of Artificial Sequence: Synthetic oligonucleotide
tgtcctggcctggccgcggg

SEQ ID NO: 44518 - DNA, 20 bp, Artificial Sequence
  Description of Artificial Sequence: Synthetic oligonucleotide
gtcctggcctggccgcgggt

SEQ ID NO: 44519 - DNA, 20 bp, Artificial Sequence
  Description of Artificial Sequence: Synthetic oligonucleotide
tcctggcctggccgcgggga

SEQ ID NO: 44520 - DNA, 20 bp, Artificial Sequence
  Description of Artificial Sequence: Synthetic oligonucleotide
cctggcctggccgcggggat

SEQ ID NO: 44521 - DNA, 20 bp, Artificial Sequence
  Description of Artificial Sequence: Synthetic oligonucleotide
ctggcctggccgcggggagt

SEQ ID NO: 44522 - DNA, 20 bp, Artificial Sequence
  Description of Artificial Sequence: Synthetic oligonucleotide
tggcctggccgcggggagct

SEQ ID NO: 44523 - DNA, 24 bp, Artificial Sequence
  Description of Artificial Sequence: Synthetic oligonucleotide
ttcgtgcggttcgacagcgacgcg

SEQ ID NO: 44524 - DNA, 23 bp, Artificial Sequence
  Description of Artificial Sequence: Synthetic oligonucleotide
tcgtgcggttcgacagcgacgcg

SEQ ID NO: 44525 - DNA, 22 bp, Artificial Sequence
  Description of Artificial Sequence: Synthetic oligonucleotide
cgtgcggttcgacagcgacgcg

SEQ ID NO: 44526 - DNA, 22 bp, Artificial Sequence
  Description of Artificial Sequence: Synthetic oligonucleotide
gtgcggttcgacagcgacgcgg

SEQ ID NO: 44527 - DNA, 22 bp, Artificial Sequence
  Description of Artificial Sequence: Synthetic oligonucleotide
tgcggttcgacagcgacgcggc

SEQ ID NO: 44528 - DNA, 21 bp, Artificial Sequence
  Description of Artificial Sequence: Synthetic oligonucleotide
gcggttcgacagcgacgcggc

SEQ ID NO: 44529 - DNA, 22 bp, Artificial Sequence
  Description of Artificial Sequence: Synthetic oligonucleotide
cggttcgacagcgacgcggcga

SEQ ID NO: 44530 - DNA, 25 bp, Artificial Sequence
  Description of Artificial Sequence: Synthetic oligonucleotide
ttcgacagcgacgcggcgagtccaa

SEQ ID NO: 44531 - DNA, 24 bp, Artificial Sequence
  Description of Artificial Sequence: Synthetic oligonucleotide
tcgacagcgacgcggcgagtccaa

SEQ ID NO: 44532 - DNA, 23 bp, Artificial Sequence
  Description of Artificial Sequence: Synthetic oligonucleotide
cgacagcgacgcggcgagtccaa

SEQ ID NO: 44533 - DNA, 24 bp, Artificial Sequence
  Description of Artificial Sequence: Synthetic oligonucleotide
gacagcgacgcggcgagtccaaga

SEQ ID NO: 44534 - DNA, 24 bp, Artificial Sequence
  Description of Artificial Sequence: Synthetic oligonucleotide
acagcgacgcggcgagtccaagag

SEQ ID NO: 44535 - DNA, 23 bp, Artificial Sequence
  Description of Artificial Sequence: Synthetic oligonucleotide
cagcgacgcggcgagtccaagag

SEQ ID NO: 44536 - DNA, 23 bp, Artificial Sequence
  Description of Artificial Sequence: Synthetic oligonucleotide
agcgacgcggcgagtccaagagg

SEQ ID NO: 44537 - DNA, 22 bp, Artificial Sequence
  Description of Artificial Sequence: Synthetic oligonucleotide
gcgacgcggcgagtccaagagg

SEQ ID NO: 44538 - DNA, 22 bp, Artificial Sequence
  Description of Artificial Sequence: Synthetic oligonucleotide
cgacgcggcgagtccaagaggg

SEQ ID NO: 44539 - DNA, 23 bp, Artificial Sequence
  Description of Artificial Sequence: Synthetic oligonucleotide
gacgcggcgagtccaagagggga

SEQ ID NO: 44540 - DNA, 23 bp, Artificial Sequence
  Description of Artificial Sequence: Synthetic oligonucleotide
acgcggcgagtccaagaggggag

SEQ ID NO: 44541 - DNA, 22 bp, Artificial Sequence
  Description of Artificial Sequence: Synthetic oligonucleotide
cgcggcgagtccaagaggggag

SEQ ID NO: 44542 - DNA, 22 bp, Artificial Sequence
  Description of Artificial Sequence: Synthetic oligonucleotide
gcggcgagtccaagaggggagc

SEQ ID NO: 44543 - DNA, 22 bp, Artificial Sequence
  Description of Artificial Sequence: Synthetic oligonucleotide
cggcgagtccaagaggggagcc

SEQ ID NO: 44544 - DNA, 22 bp, Artificial Sequence
  Description of Artificial Sequence: Synthetic oligonucleotide
ggcgagtccaagaggggagccg

SEQ ID NO: 44545 - DNA, 22 bp, Artificial Sequence
  Description of Artificial Sequence: Synthetic oligonucleotide
atccgtgtcctggcccggccgt

SEQ ID NO: 44546 - DNA, 21 bp, Artificial Sequence
  Description of Artificial Sequence: Synthetic oligonucleotide
tccgtgtcctggcccggccgt

SEQ ID NO: 44547 - DNA, 20 bp, Artificial Sequence
  Description of Artificial Sequence: Synthetic oligonucleotide
cgtgtcctggcccggccgtg

SEQ ID NO: 44548 - DNA, 20 bp, Artificial Sequence
  Description of Artificial Sequence: Synthetic oligonucleotide
gtgtcctggcccggccgtgg

SEQ ID NO: 44549 - DNA, 20 bp, Artificial Sequence
  Description of Artificial Sequence: Synthetic oligonucleotide
tgtcctggcccggccgtggg

SEQ ID NO: 44550 - DNA, 20 bp, Artificial Sequence
  Description of Artificial Sequence: Synthetic oligonucleotide
gtcctggcccggccgtgggt

SEQ ID NO: 44551 - DNA, 20 bp, Artificial Sequence
  Description of Artificial Sequence: Synthetic oligonucleotide
tcctggcccggccgtgggga

SEQ ID NO: 44552 - DNA, 20 bp, Artificial Sequence
  Description of Artificial Sequence: Synthetic oligonucleotide
cctggcccggccgtggggat

SEQ ID NO: 44553 - DNA, 20 bp, Artificial Sequence
  Description of Artificial Sequence: Synthetic oligonucleotide
ctggcccggccgtggggagt

SEQ ID NO: 44554 - DNA, 20 bp, Artificial Sequence
  Description of Artificial Sequence: Synthetic oligonucleotide
tggcccggccgtggggagct

SEQ ID NO: 44555 - DNA, 23 bp, Artificial Sequence
  Description of Artificial Sequence: Synthetic oligonucleotide
gggagccgtgggtggagcaggaa

SEQ ID NO: 44556 - DNA, 23 bp, Artificial Sequence
  Description of Artificial Sequence: Synthetic oligonucleotide
ggagccgtgggtggagcaggaag

SEQ ID NO: 44557 - DNA, 23 bp, Artificial Sequence
  Description of Artificial Sequence: Synthetic oligonucleotide
gagccgtgggtggagcaggaagg

SEQ ID NO: 44558 - DNA, 23 bp, Artificial Sequence
  Description of Artificial Sequence: Synthetic oligonucleotide
agccgtgggtggagcaggaaggg

SEQ ID NO: 44559 - DNA, 22 bp, Artificial Sequence
  Description of Artificial Sequence: Synthetic oligonucleotide
gccgtgggtggagcaggaaggg

SEQ ID NO: 44560 - DNA, 22 bp, Artificial Sequence
  Description of Artificial Sequence: Synthetic oligonucleotide
ccgtgggtggagcaggaagggc

SEQ ID NO: 44561 - DNA, 22 bp, Artificial Sequence
  Description of Artificial Sequence: Synthetic oligonucleotide
cgtgggtggagcaggaagggcc

SEQ ID NO: 44562 - DNA, 22 bp, Artificial Sequence
  Description of Artificial Sequence: Synthetic oligonucleotide
gtgggtggagcaggaagggccg

SEQ ID NO: 44563 - DNA, 23 bp, Artificial Sequence
  Description of Artificial Sequence: Synthetic oligonucleotide
tgggtggagcaggaagggccgga

SEQ ID NO: 44564 - DNA, 22 bp, Artificial Sequence
  Description of Artificial Sequence: Synthetic oligonucleotide
gggtggagcaggaagggccgga

SEQ ID NO: 44565 - DNA, 26 bp, Artificial Sequence
  Description of Artificial Sequence: Synthetic oligonucleotide
ggtggagcaggaagggccggagtatt

SEQ ID NO: 44566 - DNA, 26 bp, Artificial Sequence
  Description of Artificial Sequence: Synthetic oligonucleotide
gtggagcaggaagggccggagtattg

SEQ ID NO: 44567 - DNA, 26 bp, Artificial Sequence
  Description of Artificial Sequence: Synthetic oligonucleotide
tggagcaggaagggccggagtattgg

SEQ ID NO: 44568 - DNA, 25 bp, Artificial Sequence
  Description of Artificial Sequence: Synthetic oligonucleotide
ggagcaggaagggccggagtattgg

SEQ ID NO: 44569 - DNA, 26 bp, Artificial Sequence
  Description of Artificial Sequence: Synthetic oligonucleotide
gagcaggaagggccggagtattggga

SEQ ID NO: 44570 - DNA, 26 bp, Artificial Sequence
  Description of Artificial Sequence: Synthetic oligonucleotide
agcaggaagggccggagtattgggac

SEQ ID NO: 44571 - DNA, 25 bp, Artificial Sequence
  Description of Artificial Sequence: Synthetic oligonucleotide
gcaggaagggccggagtattgggac

SEQ ID NO: 44572 - DNA, 25 bp, Artificial Sequence
  Description of Artificial Sequence: Synthetic oligonucleotide
caggaagggccggagtattgggacc

SEQ ID NO: 44573 - DNA, 25 bp, Artificial Sequence
  Description of Artificial Sequence: Synthetic oligonucleotide
aggaagggccggagtattgggaccg

SEQ ID NO: 44574 - DNA, 24 bp, Artificial Sequence
  Description of Artificial Sequence: Synthetic oligonucleotide
ggaagggccggagtattgggaccg

SEQ ID NO: 44575 - DNA, 24 bp, Artificial Sequence
  Description of Artificial Sequence: Synthetic oligonucleotide
gaagggccggagtattgggaccgg

SEQ ID NO: 44576 - DNA, 25 bp, Artificial Sequence
  Description of Artificial Sequence: Synthetic oligonucleotide
aagggccggagtattgggaccggga

SEQ ID NO: 44577 - DNA, 24 bp, Artificial Sequence
  Description of Artificial Sequence: Synthetic oligonucleotide
agggccggagtattgggaccggga

SEQ ID NO: 44578 - DNA, 24 bp, Artificial Sequence
  Description of Artificial Sequence: Synthetic oligonucleotide
gaggggccggagtattgggaccga

SEQ ID NO: 44579 - DNA, 25 bp, Artificial Sequence
  Description of Artificial Sequence: Synthetic oligonucleotide
aggggccggagtattgggaccgaga

SEQ ID NO: 44580 - DNA, 24 bp, Artificial Sequence
  Description of Artificial Sequence: Synthetic oligonucleotide
ggggccggagtattgggaccgaga

SEQ ID NO: 44581 - DNA, 25 bp, Artificial Sequence
  Description of Artificial Sequence: Synthetic oligonucleotide
gggccggagtattgggaccgagaga

SEQ ID NO: 44582 - DNA, 26 bp, Artificial Sequence
  Description of Artificial Sequence: Synthetic oligonucleotide
ggccggagtattgggaccgagagaca

SEQ ID NO: 44583 - DNA, 27 bp, Artificial Sequence
  Description of Artificial Sequence: Synthetic oligonucleotide
gccggagtattgggaccgagagacaca

SEQ ID NO: 44584 - DNA, 27 bp, Artificial Sequence
  Description of Artificial Sequence: Synthetic oligonucleotide
ccggagtattgggaccgagagacacag

SEQ ID NO: 44585 - DNA, 29 bp, Artificial Sequence
  Description of Artificial Sequence: Synthetic oligonucleotide
cggagtattgggaccgagagacacagaag

SEQ ID NO: 44586 - DNA, 31 bp, Artificial Sequence
  Description of Artificial Sequence: Synthetic oligonucleotide
ggagtattgggaccgagagacacagaagtac

SEQ ID NO: 44587 - DNA, 33 bp, Artificial Sequence
  Description of Artificial Sequence: Synthetic oligonucleotide
gagtattgggaccgagagacacagaagtacaag

SEQ ID NO: 44588 - DNA, 33 bp, Artificial Sequence
  Description of Artificial Sequence: Synthetic oligonucleotide
agtattgggaccgagagacacagaagtacaagc

SEQ ID NO: 44589 - DNA, 32 bp, Artificial Sequence
  Description of Artificial Sequence: Synthetic oligonucleotide
gtattgggaccgagagacacagaagtacaagc

SEQ ID NO: 44590 - DNA, 32 bp, Artificial Sequence
  Description of Artificial Sequence: Synthetic oligonucleotide
tattgggaccgagagacacagaagtacaagcg

SEQ ID NO: 44591 - DNA, 31 bp, Artificial Sequence
  Description of Artificial Sequence: Synthetic oligonucleotide
attgggaccgagagacacagaagtacaagcg

SEQ ID NO: 44592 - DNA, 30 bp, Artificial Sequence
  Description of Artificial Sequence: Synthetic oligonucleotide
ttgggaccgagagacacagaagtacaagcg

SEQ ID NO: 44593 - DNA, 29 bp, Artificial Sequence
  Description of Artificial Sequence: Synthetic oligonucleotide
tgggaccgagagacacagaagtacaagcg

SEQ ID NO: 44594 - DNA, 28 bp, Artificial Sequence
  Description of Artificial Sequence: Synthetic oligonucleotide
gggaccgagagacacagaagtacaagcg

SEQ ID NO: 44595 - DNA, 28 bp, Artificial Sequence
  Description of Artificial Sequence: Synthetic oligonucleotide
ggaccgagagacacagaagtacaagcgc

SEQ ID NO: 44596 - DNA, 28 bp, Artificial Sequence
  Description of Artificial Sequence: Synthetic oligonucleotide
gaccgagagacacagaagtacaagcgcc

SEQ ID NO: 44597 - DNA, 29 bp, Artificial Sequence
  Description of Artificial Sequence: Synthetic oligonucleotide
accgagagacacagaagtacaagcgccag

SEQ ID NO: 44598 - DNA, 28 bp, Artificial Sequence
  Description of Artificial Sequence: Synthetic oligonucleotide
ccgagagacacagaagtacaagcgccag

SEQ ID NO: 44599 - DNA, 28 bp, Artificial Sequence
  Description of Artificial Sequence: Synthetic oligonucleotide
cgagagacacagaagtacaagcgccagg

SEQ ID NO: 44600 - DNA, 28 bp, Artificial Sequence
  Description of Artificial Sequence: Synthetic oligonucleotide
gagagacacagaagtacaagcgccaggc

SEQ ID NO: 44601 - DNA, 29 bp, Artificial Sequence
  Description of Artificial Sequence: Synthetic oligonucleotide
agagacacagaagtacaagcgccaggcac

SEQ ID NO: 44602 - DNA, 23 bp, Artificial Sequence
  Description of Artificial Sequence: Synthetic oligonucleotide
gggcgcctcctccgcggctataa

SEQ ID NO: 44603 - DNA, 23 bp, Artificial Sequence
  Description of Artificial Sequence: Synthetic oligonucleotide
ggcgcctcctccgcggctataac

SEQ ID NO: 44604 - DNA, 24 bp, Artificial Sequence
  Description of Artificial Sequence: Synthetic oligonucleotide
gcgcctcctccgcggctataacca

SEQ ID NO: 44605 - DNA, 26 bp, Artificial Sequence
  Description of Artificial Sequence: Synthetic oligonucleotide
cgcctcctccgcggctataaccagtt

SEQ ID NO: 44606 - DNA, 26 bp, Artificial Sequence
  Description of Artificial Sequence: Synthetic oligonucleotide
gcctcctccgcggctataaccagttc

SEQ ID NO: 44607 - DNA, 26 bp, Artificial Sequence
  Description of Artificial Sequence: Synthetic oligonucleotide
cctcctccgcggctataaccagttcg

SEQ ID NO: 44608 - DNA, 26 bp, Artificial Sequence
  Description of Artificial Sequence: Synthetic oligonucleotide
ctcctccgcggctataaccagttcgc

SEQ ID NO: 44609 - DNA, 27 bp, Artificial Sequence
  Description of Artificial Sequence: Synthetic oligonucleotide
tcctccgcggctataaccagttcgcct

SEQ ID NO: 44610 - DNA, 27 bp, Artificial Sequence
  Description of Artificial Sequence: Synthetic oligonucleotide
cctccgcggctataaccagttcgccta

SEQ ID NO: 44611 - DNA, 27 bp, Artificial Sequence
  Description of Artificial Sequence: Synthetic oligonucleotide
ctccgcggctataaccagttcgcctac

SEQ ID NO: 44612 - DNA, 27 bp, Artificial Sequence
  Description of Artificial Sequence: Synthetic oligonucleotide
tccgcggctataaccagttcgcctacg

SEQ ID NO: 44613 - DNA, 27 bp, Artificial Sequence
  Description of Artificial Sequence: Synthetic oligonucleotide
ccgcggctataaccagttcgcctacga

SEQ ID NO: 44614 - DNA, 27 bp, Artificial Sequence
  Description of Artificial Sequence: Synthetic oligonucleotide
cgcggctataaccagttcgcctacgac

SEQ ID NO: 44615 - DNA, 27 bp, Artificial Sequence
  Description of Artificial Sequence: Synthetic oligonucleotide
gcggctataaccagttcgcctacgacg

SEQ ID NO: 44616 - DNA, 27 bp, Artificial Sequence
  Description of Artificial Sequence: Synthetic oligonucleotide
cggctataaccagttcgcctacgacgg

SEQ ID NO: 44617 - DNA, 27 bp, Artificial Sequence
  Description of Artificial Sequence: Synthetic oligonucleotide
ggctataaccagttcgcctacgacggc

SEQ ID NO: 44618 - DNA, 29 bp, Artificial Sequence
  Description of Artificial Sequence: Synthetic oligonucleotide
gctataaccagttcgcctacgacggcaag

SEQ ID NO: 44619 - DNA, 29 bp, Artificial Sequence
  Description of Artificial Sequence: Synthetic oligonucleotide
ctataaccagttcgcctacgacggcaagg

SEQ ID NO: 44620 - DNA, 30 bp, Artificial Sequence
  Description of Artificial Sequence: Synthetic oligonucleotide
gtctcacaccctccagaggatgtttggttg

SEQ ID NO: 44621 - DNA, 30 bp, Artificial Sequence
  Description of Artificial Sequence: Synthetic oligonucleotide
tctcacaccctccagaggatgtttggttgc

SEQ ID NO: 44622 - DNA, 29 bp, Artificial Sequence
  Description of Artificial Sequence: Synthetic oligonucleotide
ctcacaccctccagaggatgtttggttgc

SEQ ID NO: 44623 - DNA, 29 bp, Artificial Sequence
  Description of Artificial Sequence: Synthetic oligonucleotide
tcacaccctccagaggatgtttggttgcg

SEQ ID NO: 44624 - DNA, 28 bp, Artificial Sequence
  Description of Artificial Sequence: Synthetic oligonucleotide
cacaccctccagaggatgtttggttgcg

SEQ ID NO: 44625 - DNA, 29 bp, Artificial Sequence
  Description of Artificial Sequence: Synthetic oligonucleotide
acaccctccagaggatgtttggttgcgac

SEQ ID NO: 44626 - DNA, 28 bp, Artificial Sequence
  Description of Artificial Sequence: Synthetic oligonucleotide
caccctccagaggatgtttggttgcgac

SEQ ID NO: 44627 - DNA, 28 bp, Artificial Sequence
  Description of Artificial Sequence: Synthetic oligonucleotide
accctccagaggatgtttggttgcgacc

SEQ ID NO: 44628 - DNA, 27 bp, Artificial Sequence
  Description of Artificial Sequence: Synthetic oligonucleotide
ccctccagaggatgtttggttgcgacc

SEQ ID NO: 44629 - DNA, 28 bp, Artificial Sequence
  Description of Artificial Sequence: Synthetic oligonucleotide
cctccagaggatgtttggttgcgacctg

SEQ ID NO: 44630 - DNA, 28 bp, Artificial Sequence
  Description of Artificial Sequence: Synthetic oligonucleotide
ctccagaggatgtttggttgcgacctgg

SEQ ID NO: 44631 - DNA, 28 bp, Artificial Sequence
  Description of Artificial Sequence: Synthetic oligonucleotide
tccagaggatgtttggttgcgacctggg

SEQ ID NO: 44632 - DNA, 27 bp, Artificial Sequence
  Description of Artificial Sequence: Synthetic oligonucleotide
ccagaggatgtttggttgcgacctggg

SEQ ID NO: 44633 - DNA, 27 bp, Artificial Sequence
  Description of Artificial Sequence: Synthetic oligonucleotide
cagaggatgtttggttgcgacctgggg

SEQ ID NO: 44634 - DNA, 27 bp, Artificial Sequence
  Description of Artificial Sequence: Synthetic oligonucleotide
agaggatgtttggttgcgacctggggc

SEQ ID NO: 44635 - DNA, 26 bp, Artificial Sequence
  Description of Artificial Sequence: Synthetic oligonucleotide
gaggatgtttggttgcgacctggggc

SEQ ID NO: 44636 - DNA, 26 bp, Artificial Sequence
  Description of Artificial Sequence: Synthetic oligonucleotide
aggatgtttggttgcgacctggggcc

SEQ ID NO: 44637 - DNA, 25 bp, Artificial Sequence
  Description of Artificial Sequence: Synthetic oligonucleotide
ggatgtttggttgcgacctggggcc

SEQ ID NO: 44638 - DNA, 25 bp, Artificial Sequence
  Description of Artificial Sequence: Synthetic oligonucleotide
gatgtttggttgcgacctggggccg

SEQ ID NO: 44639 - DNA, 26 bp, Artificial Sequence
  Description of Artificial Sequence: Synthetic oligonucleotide
atgtttggttgcgacctggggccgga

SEQ ID NO: 44640 - DNA, 25 bp, Artificial Sequence
  Description of Artificial Sequence: Synthetic oligonucleotide
tgtttggttgcgacctggggccgga

SEQ ID NO: 44641 - DNA, 24 bp, Artificial Sequence
  Description of Artificial Sequence: Synthetic oligonucleotide
gtttggttgcgacctggggccgga

SEQ ID NO: 44642 - DNA, 24 bp, Artificial Sequence
  Description of Artificial Sequence: Synthetic oligonucleotide
tttggttgcgacctggggccggac

SEQ ID NO: 44643 - DNA, 23 bp, Artificial Sequence
  Description of Artificial Sequence: Synthetic oligonucleotide
ttggttgcgacctggggccggac

SEQ ID NO: 44644 - DNA, 22 bp, Artificial Sequence
  Description of Artificial Sequence: Synthetic oligonucleotide
tggttgcgacctggggccggac

SEQ ID NO: 44645 - DNA, 21 bp, Artificial Sequence
  Description of Artificial Sequence: Synthetic oligonucleotide
ggttgcgacctggggccggac

SEQ ID NO: 44646 - DNA, 21 bp, Artificial Sequence
  Description of Artificial Sequence: Synthetic oligonucleotide
gttgcgacctggggccggacg

SEQ ID NO: 44647 - DNA, 21 bp, Artificial Sequence
  Description of Artificial Sequence: Synthetic oligonucleotide
ttgcgacctggggccggacgg

SEQ ID NO: 44648 - DNA, 25 bp, Artificial Sequence
  Description of Artificial Sequence: Synthetic oligonucleotide
caggaggggccggagtattgggatc

SEQ ID NO: 44649 - DNA, 25 bp, Artificial Sequence
  Description of Artificial Sequence: Synthetic oligonucleotide
aggaggggccggagtattgggatcg

SEQ ID NO: 44650 - DNA, 24 bp, Artificial Sequence
  Description of Artificial Sequence: Synthetic oligonucleotide
ggaggggccggagtattgggatcg

SEQ ID NO: 44651 - DNA, 24 bp, Artificial Sequence
  Description of Artificial Sequence: Synthetic oligonucleotide
gaggggccggagtattgggatcgg

SEQ ID NO: 44652 - DNA, 25 bp, Artificial Sequence
  Description of Artificial Sequence: Synthetic oligonucleotide
aggggccggagtattgggatcggga

SEQ ID NO: 44653 - DNA, 24 bp, Artificial Sequence
  Description of Artificial Sequence: Synthetic oligonucleotide
ggggccggagtattgggatcggga

SEQ ID NO: 44654 - DNA, 25 bp, Artificial Sequence
  Description of Artificial Sequence: Synthetic oligonucleotide
gggccggagtattgggatcgggaga

SEQ ID NO: 44655 - DNA, 26 bp, Artificial Sequence
  Description of Artificial Sequence: Synthetic oligonucleotide
ggccggagtattgggatcgggagaca

SEQ ID NO: 44656 - DNA, 27 bp, Artificial Sequence
  Description of Artificial Sequence: Synthetic oligonucleotide
gccggagtattgggatcgggagacaca

SEQ ID NO: 44657 - DNA, 27 bp, Artificial Sequence
  Description of Artificial Sequence: Synthetic oligonucleotide
ccggagtattgggatcgggagacacag

SEQ ID NO: 44658 - DNA, 29 bp, Artificial Sequence
  Description of Artificial Sequence: Synthetic oligonucleotide
cggagtattgggatcgggagacacagaag

SEQ ID NO: 44659 - DNA, 31 bp, Artificial Sequence
  Description of Artificial Sequence: Synthetic oligonucleotide
ggagtattgggatcgggagacacagaagtac

SEQ ID NO: 44660 - DNA, 33 bp, Artificial Sequence
  Description of Artificial Sequence: Synthetic oligonucleotide
gagtattgggatcgggagacacagaagtacaag

SEQ ID NO: 44661 - DNA, 33 bp, Artificial Sequence
  Description of Artificial Sequence: Synthetic oligonucleotide
agtattgggatcgggagacacagaagtacaagc

SEQ ID NO: 44662 - DNA, 32 bp, Artificial Sequence
  Description of Artificial Sequence: Synthetic oligonucleotide
gtattgggatcgggagacacagaagtacaagc

SEQ ID NO: 44663 - DNA, 32 bp, Artificial Sequence
  Description of Artificial Sequence: Synthetic oligonucleotide
tattgggatcgggagacacagaagtacaagcg

SEQ ID NO: 44664 - DNA, 31 bp, Artificial Sequence
  Description of Artificial Sequence: Synthetic oligonucleotide
attgggatcgggagacacagaagtacaagcg

SEQ ID NO: 44665 - DNA, 30 bp, Artificial Sequence
  Description of Artificial Sequence: Synthetic oligonucleotide
ttgggatcgggagacacagaagtacaagcg

SEQ ID NO: 44666 - DNA, 29 bp, Artificial Sequence
  Description of Artificial Sequence: Synthetic oligonucleotide
tgggatcgggagacacagaagtacaagcg

SEQ ID NO: 44667 - DNA, 28 bp, Artificial Sequence
  Description of Artificial Sequence: Synthetic oligonucleotide
gggatcgggagacacagaagtacaagcg

SEQ ID NO: 44668 - DNA, 28 bp, Artificial Sequence
  Description of Artificial Sequence: Synthetic oligonucleotide
ggatcgggagacacagaagtacaagcgc

SEQ ID NO: 44669 - DNA, 28 bp, Artificial Sequence
  Description of Artificial Sequence: Synthetic oligonucleotide
gatcgggagacacagaagtacaagcgcc

SEQ ID NO: 44670 - DNA, 29 bp, Artificial Sequence
  Description of Artificial Sequence: Synthetic oligonucleotide
atcgggagacacagaagtacaagcgccag

SEQ ID NO: 44671 - DNA, 28 bp, Artificial Sequence
  Description of Artificial Sequence: Synthetic oligonucleotide
tcgggagacacagaagtacaagcgccag

SEQ ID NO: 44672 - DNA, 28 bp, Artificial Sequence
  Description of Artificial Sequence: Synthetic oligonucleotide
ctccgcgggtataaccagttcgcctatg

SEQ ID NO: 44673 - DNA, 29 bp, Artificial Sequence
  Description of Artificial Sequence: Synthetic oligonucleotide
tccgcgggtataaccagttcgcctatgac

SEQ ID NO: 44674 - DNA, 28 bp, Artificial Sequence
  Description of Artificial Sequence: Synthetic oligonucleotide
ccgcgggtataaccagttcgcctatgac

SEQ ID NO: 44675 - DNA, 28 bp, Artificial Sequence
  Description of Artificial Sequence: Synthetic oligonucleotide
cgcgggtataaccagttcgcctatgacg

SEQ ID NO: 44676 - DNA, 28 bp, Artificial Sequence
  Description of Artificial Sequence: Synthetic oligonucleotide
gcgggtataaccagttcgcctatgacgg

SEQ ID NO: 44677 - DNA, 28 bp, Artificial Sequence
  Description of Artificial Sequence: Synthetic oligonucleotide
cgggtataaccagttcgcctatgacggc

SEQ ID NO: 44678 - DNA, 30 bp, Artificial Sequence
  Description of Artificial Sequence: Synthetic oligonucleotide
gggtataaccagttcgcctatgacggcaag

SEQ ID NO: 44679 - DNA, 30 bp, Artificial Sequence
  Description of Artificial Sequence: Synthetic oligonucleotide
ggtataaccagttcgcctatgacggcaagg

SEQ ID NO: 44680 - DNA, 34 bp, Artificial Sequence
  Description of Artificial Sequence: Synthetic oligonucleotide
gtataaccagttcgcctatgacggcaaggattac

SEQ ID NO: 44681 - DNA, 36 bp, Artificial Sequence
  Description of Artificial Sequence: Synthetic oligonucleotide
tataaccagttcgcctatgacggcaaggattacatc

SEQ ID NO: 44682 - DNA, 35 bp, Artificial Sequence
  Description of Artificial Sequence: Synthetic oligonucleotide
ataaccagttcgcctatgacggcaaggattacatc

SEQ ID NO: 44683 - DNA, 34 bp, Artificial Sequence
  Description of Artificial Sequence: Synthetic oligonucleotide
taaccagttcgcctatgacggcaaggattacatc

SEQ ID NO: 44684 - DNA, 33 bp, Artificial Sequence
  Description of Artificial Sequence: Synthetic oligonucleotide
aaccagttcgcctatgacggcaaggattacatc

SEQ ID NO: 44685 - DNA, 32 bp, Artificial Sequence
  Description of Artificial Sequence: Synthetic oligonucleotide
accagttcgcctatgacggcaaggattacatc

SEQ ID NO: 44686 - DNA, 31 bp, Artificial Sequence
  Description of Artificial Sequence: Synthetic oligonucleotide
ccagttcgcctatgacggcaaggattacatc

SEQ ID NO: 44687 - DNA, 31 bp, Artificial Sequence
  Description of Artificial Sequence: Synthetic oligonucleotide
cagttcgcctatgacggcaaggattacatcg

SEQ ID NO: 44688 - DNA, 31 bp, Artificial Sequence
  Description of Artificial Sequence: Synthetic oligonucleotide
agttcgcctatgacggcaaggattacatcgc

SEQ ID NO: 44689 - DNA, 30 bp, Artificial Sequence
  Description of Artificial Sequence: Synthetic oligonucleotide
gttcgcctatgacggcaaggattacatcgc

SEQ ID NO: 44690 - DNA, 30 bp, Artificial Sequence
  Description of Artificial Sequence: Synthetic oligonucleotide
ttcgcctatgacggcaaggattacatcgcc

SEQ ID NO: 44691 - DNA, 29 bp, Artificial Sequence
  Description of Artificial Sequence: Synthetic oligonucleotide
tcgcctatgacggcaaggattacatcgcc

SEQ ID NO: 44692 - DNA, 24 bp, Artificial Sequence
  Description of Artificial Sequence: Synthetic oligonucleotide
agcgacgccgcgagtccaagagga

SEQ ID NO: 44693 - DNA, 23 bp, Artificial Sequence
  Description of Artificial Sequence: Synthetic oligonucleotide
gcgacgccgcgagtccaagagga

SEQ ID NO: 44694 - DNA, 24 bp, Artificial Sequence
  Description of Artificial Sequence: Synthetic oligonucleotide
cgacgccgcgagtccaagaggaga

SEQ ID NO: 44695 - DNA, 24 bp, Artificial Sequence
  Description of Artificial Sequence: Synthetic oligonucleotide
gacgccgcgagtccaagaggagag

SEQ ID NO: 44696 - DNA, 24 bp, Artificial Sequence
  Description of Artificial Sequence: Synthetic oligonucleotide
acgccgcgagtccaagaggagagc

SEQ ID NO: 44697 - DNA, 23 bp, Artificial Sequence
  Description of Artificial Sequence: Synthetic oligonucleotide
cgccgcgagtccaagaggagagc

SEQ ID NO: 44698 - DNA, 23 bp, Artificial Sequence
  Description of Artificial Sequence: Synthetic oligonucleotide
gccgcgagtccaagaggagagcc

SEQ ID NO: 44699 - DNA, 23 bp, Artificial Sequence
  Description of Artificial Sequence: Synthetic oligonucleotide
ccgcgagtccaagaggagagccg

SEQ ID NO: 44700 - DNA, 23 bp, Artificial Sequence
  Description of Artificial Sequence: Synthetic oligonucleotide
cgcgagtccaagaggagagccgc

SEQ ID NO: 44701 - DNA, 23 bp, Artificial Sequence
  Description of Artificial Sequence: Synthetic oligonucleotide
gcgagtccaagaggagagccgcg

SEQ ID NO: 44702 - DNA, 23 bp, Artificial Sequence
  Description of Artificial Sequence: Synthetic oligonucleotide
cgagtccaagaggagagccgcgg

SEQ ID NO: 44703 - DNA, 24 bp, Artificial Sequence
  Description of Artificial Sequence: Synthetic oligonucleotide
gagtccaagaggagagccgcggga

SEQ ID NO: 44704 - DNA, 24 bp, Artificial Sequence
  Description of Artificial Sequence: Synthetic oligonucleotide
agtccaagaggagagccgcgggag

SEQ ID NO: 44705 - DNA, 23 bp, Artificial Sequence
  Description of Artificial Sequence: Synthetic oligonucleotide
gtccaagaggagagccgcgggag

SEQ ID NO: 44706 - DNA, 23 bp, Artificial Sequence
  Description of Artificial Sequence: Synthetic oligonucleotide
tccaagaggagagccgcgggagc

SEQ ID NO: 44707 - DNA, 22 bp, Artificial Sequence
  Description of Artificial Sequence: Synthetic oligonucleotide
ccaagaggagagccgcgggagc

SEQ ID NO: 44708 - DNA, 22 bp, Artificial Sequence
  Description of Artificial Sequence: Synthetic oligonucleotide
caagaggagagccgcgggagcc

SEQ ID NO: 44709 - DNA, 23 bp, Artificial Sequence
  Description of Artificial Sequence: Synthetic oligonucleotide
aagaggagagccgcgggagccgt

SEQ ID NO: 44710 - DNA, 22 bp, Artificial Sequence
  Description of Artificial Sequence: Synthetic oligonucleotide
agaggagagccgcgggagccgt

SEQ ID NO: 44711 - DNA, 21 bp, Artificial Sequence
  Description of Artificial Sequence: Synthetic oligonucleotide
gaggagagccgcgggagccgt

SEQ ID NO: 44712 - DNA, 21 bp, Artificial Sequence
  Description of Artificial Sequence: Synthetic oligonucleotide
aggagagccgcgggagccgtg

SEQ ID NO: 44713 - DNA, 20 bp, Artificial Sequence
  Description of Artificial Sequence: Synthetic oligonucleotide
ggagagccgcgggagccgtg

SEQ ID NO: 44714 - DNA, 20 bp, Artificial Sequence
  Description of Artificial Sequence: Synthetic oligonucleotide
gagagccgcgggagccgtgg

SEQ ID NO: 44715 - DNA, 21 bp, Artificial Sequence
  Description of Artificial Sequence: Synthetic oligonucleotide
agagccgcgggagccgtgggt

SEQ ID NO: 44716 - DNA, 25 bp, Artificial Sequence
  Description of Artificial Sequence: Synthetic oligonucleotide
cccgcttcatcgcagtgggctacct

SEQ ID NO: 44717 - DNA, 25 bp, Artificial Sequence
  Description of Artificial Sequence: Synthetic oligonucleotide
ccgcttcatcgcagtgggctacctg

SEQ ID NO: 44718 - DNA, 26 bp, Artificial Sequence
  Description of Artificial Sequence: Synthetic oligonucleotide
cgcttcatcgcagtgggctacctgga

SEQ ID NO: 44719 - DNA, 26 bp, Artificial Sequence
  Description of Artificial Sequence: Synthetic oligonucleotide
gcttcatcgcagtgggctacctggac

SEQ ID NO: 44720 - DNA, 27 bp, Artificial Sequence
  Description of Artificial Sequence: Synthetic oligonucleotide
cttcatcgcagtgggctacctggacga

SEQ ID NO: 44721 - DNA, 27 bp, Artificial Sequence
  Description of Artificial Sequence: Synthetic oligonucleotide
ttcatcgcagtgggctacctggacgac

SEQ ID NO: 44722 - DNA, 27 bp, Artificial Sequence
  Description of Artificial Sequence: Synthetic oligonucleotide
tcatcgcagtgggctacctggacgaca

SEQ ID NO: 44723 - DNA, 26 bp, Artificial Sequence
  Description of Artificial Sequence: Synthetic oligonucleotide
catcgcagtgggctacctggacgaca

SEQ ID NO: 44724 - DNA, 26 bp, Artificial Sequence
  Description of Artificial Sequence: Synthetic oligonucleotide
atcgcagtgggctacctggacgacac

SEQ ID NO: 44725 - DNA, 25 bp, Artificial Sequence
  Description of Artificial Sequence: Synthetic oligonucleotide
tcgcagtgggctacctggacgacac

SEQ ID NO: 44726 - DNA, 24 bp, Artificial Sequence
  Description of Artificial Sequence: Synthetic oligonucleotide
cgcagtgggctacctggacgacac

SEQ ID NO: 44727 - DNA, 24 bp, Artificial Sequence
  Description of Artificial Sequence: Synthetic oligonucleotide
gcagtgggctacctggacgacacg

SEQ ID NO: 44728 - DNA, 25 bp, Artificial Sequence
  Description of Artificial Sequence: Synthetic oligonucleotide
cagtgggctacctggacgacacgca

SEQ ID NO: 44729 - DNA, 27 bp, Artificial Sequence
  Description of Artificial Sequence: Synthetic oligonucleotide
agtgggctacctggacgacacgcagtt

SEQ ID NO: 44730 - DNA, 26 bp, Artificial Sequence
  Description of Artificial Sequence: Synthetic oligonucleotide
gtgggctacctggacgacacgcagtt

SEQ ID NO: 44731 - DNA, 26 bp, Artificial Sequence
  Description of Artificial Sequence: Synthetic oligonucleotide
tgggctacctggacgacacgcagttc

SEQ ID NO: 44732 - DNA, 25 bp, Artificial Sequence
  Description of Artificial Sequence: Synthetic oligonucleotide
gggctacctggacgacacgcagttc

SEQ ID NO: 44733 - DNA, 26 bp, Artificial Sequence
  Description of Artificial Sequence: Synthetic oligonucleotide
ggctacctggacgacacgcagttcgt

SEQ ID NO: 44734 - DNA, 26 bp, Artificial Sequence
  Description of Artificial Sequence: Synthetic oligonucleotide
gctacctggacgacacgcagttcgtg

SEQ ID NO: 44735 - DNA, 26 bp, Artificial Sequence
  Description of Artificial Sequence: Synthetic oligonucleotide
ctacctggacgacacgcagttcgtgc

SEQ ID NO: 44736 - DNA, 26 bp, Artificial Sequence
  Description of Artificial Sequence: Synthetic oligonucleotide
tacctggacgacacgcagttcgtgcg

SEQ ID NO: 44737 - DNA, 25 bp, Artificial Sequence
  Description of Artificial Sequence: Synthetic oligonucleotide
acctggacgacacgcagttcgtgcg

SEQ ID NO: 44738 - DNA, 24 bp, Artificial Sequence
  Description of Artificial Sequence: Synthetic oligonucleotide
cctggacgacacgcagttcgtgcg

SEQ ID NO: 44739 - DNA, 26 bp, Artificial Sequence
  Description of Artificial Sequence: Synthetic oligonucleotide
ctggacgacacgcagttcgtgcggtt

SEQ ID NO: 44740 - DNA, 32 bp, Artificial Sequence
  Description of Artificial Sequence: Synthetic oligonucleotide
agggctctgatgagtctctcatcgcttgtaag

SEQ ID NO: 44741 - DNA, 31 bp, Artificial Sequence
  Description of Artificial Sequence: Synthetic oligonucleotide
gggctctgatgagtctctcatcgcttgtaag

SEQ ID NO: 44742 - DNA, 31 bp, Artificial Sequence
  Description of Artificial Sequence: Synthetic oligonucleotide
ggctctgatgagtctctcatcgcttgtaagc

SEQ ID NO: 44743 - DNA, 31 bp, Artificial Sequence
  Description of Artificial Sequence: Synthetic oligonucleotide
gctctgatgagtctctcatcgcttgtaagcc

SEQ ID NO: 44744 - DNA, 32 bp, Artificial Sequence
  Description of Artificial Sequence: Synthetic oligonucleotide
ctctgatgagtctctcatcgcttgtaagcctg

SEQ ID NO: 44745 - DNA, 33 bp, Artificial Sequence
  Description of Artificial Sequence: Synthetic oligonucleotide
tctgatgagtctctcatcgcttgtaagcctgag

SEQ ID NO: 44746 - DNA, 32 bp, Artificial Sequence
  Description of Artificial Sequence: Synthetic oligonucleotide
ctgatgagtctctcatcgcttgtaagcctgag

SEQ ID NO: 44747 - DNA, 33 bp, Artificial Sequence
  Description of Artificial Sequence: Synthetic oligonucleotide
tgatgagtctctcatcgcttgtaagcctgagac

SEQ ID NO: 44748 - DNA, 32 bp, Artificial Sequence
  Description of Artificial Sequence: Synthetic oligonucleotide
gatgagtctctcatcgcttgtaagcctgagac

SEQ ID NO: 44749 - DNA, 33 bp, Artificial Sequence
  Description of Artificial Sequence: Synthetic oligonucleotide
atgagtctctcatcgcttgtaagcctgagacag

SEQ ID NO: 44750 - DNA, 32 bp, Artificial Sequence
  Description of Artificial Sequence: Synthetic oligonucleotide
tgagtctctcatcgcttgtaagcctgagacag

SEQ ID NO: 44751 - DNA, 31 bp, Artificial Sequence
  Description of Artificial Sequence: Synthetic oligonucleotide
gagtctctcatcgcttgtaagcctgagacag

SEQ ID NO: 44752 - DNA, 31 bp, Artificial Sequence
  Description of Artificial Sequence: Synthetic oligonucleotide
agtctctcatcgcttgtaagcctgagacagc

SEQ ID NO: 44753 - DNA, 30 bp, Artificial Sequence
  Description of Artificial Sequence: Synthetic oligonucleotide
gtctctcatcgcttgtaagcctgagacagc

SEQ ID NO: 44754 - DNA, 31 bp, Artificial Sequence
  Description of Artificial Sequence: Synthetic oligonucleotide
tctctcatcgcttgtaagcctgagacagctg

SEQ ID NO: 44755 - DNA, 30 bp, Artificial Sequence
  Description of Artificial Sequence: Synthetic oligonucleotide
ctctcatcgcttgtaagcctgagacagctg

SEQ ID NO: 44756 - DNA, 30 bp, Artificial Sequence
  Description of Artificial Sequence: Synthetic oligonucleotide
tctcatcgcttgtaagcctgagacagctgc

SEQ ID NO: 44757 - DNA, 29 bp, Artificial Sequence
  Description of Artificial Sequence: Synthetic oligonucleotide
ctcatcgcttgtaagcctgagacagctgc

SEQ ID NO: 44758 - DNA, 29 bp, Artificial Sequence
  Description of Artificial Sequence: Synthetic oligonucleotide
tcatcgcttgtaagcctgagacagctgcc

SEQ ID NO: 44759 - DNA, 28 bp, Artificial Sequence
  Description of Artificial Sequence: Synthetic oligonucleotide
catcgcttgtaagcctgagacagctgcc

SEQ ID NO: 44760 - DNA, 29 bp, Artificial Sequence
  Description of Artificial Sequence: Synthetic oligonucleotide
atcgcttgtaagcctgagacagctgcctg

SEQ ID NO: 44761 - DNA, 28 bp, Artificial Sequence
  Description of Artificial Sequence: Synthetic oligonucleotide
tcgcttgtaagcctgagacagctgcctg

SEQ ID NO: 44762 - DNA, 27 bp, Artificial Sequence
  Description of Artificial Sequence: Synthetic oligonucleotide
cgcttgtaagcctgagacagctgcctg

SEQ ID NO: 44763 - DNA, 28 bp, Artificial Sequence
  Description of Artificial Sequence: Synthetic oligonucleotide
gcttgtaagcctgagacagctgcctgtg

SEQ ID NO: 44764 - DNA, 29 bp, Artificial Sequence
  Description of Artificial Sequence: Synthetic oligonucleotide
cttgtaagcctgagacagctgcctgtgtg

SEQ ID NO: 44765 - DNA, 29 bp, Artificial Sequence
  Description of Artificial Sequence: Synthetic oligonucleotide
ttgtaagcctgagacagctgcctgtgtgg

SEQ ID NO: 44766 - DNA, 28 bp, Artificial Sequence
  Description of Artificial Sequence: Synthetic oligonucleotide
tgtaagcctgagacagctgcctgtgtgg

SEQ ID NO: 44767 - DNA, 27 bp, Artificial Sequence
  Description of Artificial Sequence: Synthetic oligonucleotide
gtaagcctgagacagctgcctgtgtgg

SEQ ID NO: 44768 - DNA, 27 bp, Artificial Sequence
  Description of Artificial Sequence: Synthetic oligonucleotide
taagcctgagacagctgcctgtgtggg

SEQ ID NO: 44769 - DNA, 27 bp, Artificial Sequence
  Description of Artificial Sequence: Synthetic oligonucleotide
aagcctgagacagctgcctgtgtggga

SEQ ID NO: 44770 - DNA, 26 bp, Artificial Sequence
  Description of Artificial Sequence: Synthetic oligonucleotide
agcctgagacagctgcctgtgtggga

SEQ ID NO: 44771 - DNA, 25 bp, Artificial Sequence
  Description of Artificial Sequence: Synthetic oligonucleotide
gcctgagacagctgcctgtgtggga

SEQ ID NO: 44772 - DNA, 26 bp, Artificial Sequence
  Description of Artificial Sequence: Synthetic oligonucleotide
cctgagacagctgcctgtgtgggact

SEQ ID NO: 44773 - DNA, 27 bp, Artificial Sequence
  Description of Artificial Sequence: Synthetic oligonucleotide
ctgagacagctgcctgtgtgggactga

SEQ ID NO: 44774 - DNA, 27 bp, Artificial Sequence
  Description of Artificial Sequence: Synthetic oligonucleotide
tgagacagctgcctgtgtgggactgag

SEQ ID NO: 44775 - DNA, 27 bp, Artificial Sequence
  Description of Artificial Sequence: Synthetic oligonucleotide
gagacagctgcctgtgtgggactgaga

SEQ ID NO: 44776 - DNA, 28 bp, Artificial Sequence
  Description of Artificial Sequence: Synthetic oligonucleotide
agacagctgcctgtgtgggactgagatg

SEQ ID NO: 44777 - DNA, 27 bp, Artificial Sequence
  Description of Artificial Sequence: Synthetic oligonucleotide
gacagctgcctgtgtgggactgagatg

SEQ ID NO: 44778 - DNA, 27 bp, Artificial Sequence
  Description of Artificial Sequence: Synthetic oligonucleotide
acagctgcctgtgtgggactgagatgc

SEQ ID NO: 44779 - DNA, 27 bp, Artificial Sequence
  Description of Artificial Sequence: Synthetic oligonucleotide
cagctgcctgtgtgggactgagatgca

SEQ ID NO: 44780 - DNA, 27 bp, Artificial Sequence
  Description of Artificial Sequence: Synthetic oligonucleotide
agctgcctgtgtgggactgagatgcag

SEQ ID NO: 44781 - DNA, 26 bp, Artificial Sequence
  Description of Artificial Sequence: Synthetic oligonucleotide
gctgcctgtgtgggactgagatgcag

SEQ ID NO: 44782 - DNA, 27 bp, Artificial Sequence
  Description of Artificial Sequence: Synthetic oligonucleotide
ctgcctgtgtgggactgagatgcagga

SEQ ID NO: 44783 - DNA, 30 bp, Artificial Sequence
  Description of Artificial Sequence: Synthetic oligonucleotide
tgcctgtgtgggactgagatgcaggatttc

SEQ ID NO: 44784 - DNA, 29 bp, Artificial Sequence
  Description of Artificial Sequence: Synthetic oligonucleotide
gcctgtgtgggactgagatgcaggatttc

SEQ ID NO: 44785 - DNA, 31 bp, Artificial Sequence
  Description of Artificial Sequence: Synthetic oligonucleotide
cctgtgtgggactgagatgcaggatttcttc

SEQ ID NO: 44786 - DNA, 32 bp, Artificial Sequence
  Description of Artificial Sequence: Synthetic oligonucleotide
ctgtgtgggactgagatgcaggatttcttcac

SEQ ID NO: 44787 - DNA, 33 bp, Artificial Sequence
  Description of Artificial Sequence: Synthetic oligonucleotide
tgtgtgggactgagatgcaggatttcttcacac

SEQ ID NO: 44788 - DNA, 32 bp, Artificial Sequence
  Description of Artificial Sequence: Synthetic oligonucleotide
gtgtgggactgagatgcaggatttcttcacac

SEQ ID NO: 44789 - DNA, 32 bp, Artificial Sequence
  Description of Artificial Sequence: Synthetic oligonucleotide
tgtgggactgagatgcaggatttcttcacacc

SEQ ID NO: 44790 - DNA, 31 bp, Artificial Sequence
  Description of Artificial Sequence: Synthetic oligonucleotide
gtgggactgagatgcaggatttcttcacacc

SEQ ID NO: 44791 - DNA, 32 bp, Artificial Sequence
  Description of Artificial Sequence: Synthetic oligonucleotide
tgggactgagatgcaggatttcttcacacctc

SEQ ID NO: 44792 - DNA, 31 bp, Artificial Sequence
  Description of Artificial Sequence: Synthetic oligonucleotide
gggactgagatgcaggatttcttcacacctc

SEQ ID NO: 44793 - DNA, 32 bp, Artificial Sequence
  Description of Artificial Sequence: Synthetic oligonucleotide
ggactgagatgcaggatttcttcacacctctc

SEQ ID NO: 44794 - DNA, 32 bp, Artificial Sequence
  Description of Artificial Sequence: Synthetic oligonucleotide
gactgagatgcaggatttcttcacacctctcc

SEQ ID NO: 44795 - DNA, 35 bp, Artificial Sequence
  Description of Artificial Sequence: Synthetic oligonucleotide
actgagatgcaggatttcttcacacctctcctttg

SEQ ID NO: 44796 - DNA, 34 bp, Artificial Sequence
  Description of Artificial Sequence: Synthetic oligonucleotide
ctgagatgcaggatttcttcacacctctcctttg

SEQ ID NO: 44797 - DNA, 35 bp, Artificial Sequence
  Description of Artificial Sequence: Synthetic oligonucleotide
tgagatgcaggatttcttcacacctctcctttgtg

SEQ ID NO: 44798 - DNA, 34 bp, Artificial Sequence
  Description of Artificial Sequence: Synthetic oligonucleotide
gagatgcaggatttcttcacacctctcctttgtg

SEQ ID NO: 44799 - DNA, 35 bp, Artificial Sequence
  Description of Artificial Sequence: Synthetic oligonucleotide
agatgcaggatttcttcacacctctcctttgtgac

SEQ ID NO: 44800 - DNA, 34 bp, Artificial Sequence
  Description of Artificial Sequence: Synthetic oligonucleotide
gatgcaggatttcttcacacctctcctttgtgac

SEQ ID NO: 44801 - DNA, 36 bp, Artificial Sequence
  Description of Artificial Sequence: Synthetic oligonucleotide
atgcaggatttcttcacacctctcctttgtgacttc

SEQ ID NO: 44802 - DNA, 35 bp, Artificial Sequence
  Description of Artificial Sequence: Synthetic oligonucleotide
tgcaggatttcttcacacctctcctttgtgacttc

SEQ ID NO: 44803 - DNA, 34 bp, Artificial Sequence
  Description of Artificial Sequence: Synthetic oligonucleotide
gcaggatttcttcacacctctcctttgtgacttc

SEQ ID NO: 44804 - DNA, 36 bp, Artificial Sequence
  Description of Artificial Sequence: Synthetic oligonucleotide
caggatttcttcacacctctcctttgtgacttcaag

SEQ ID NO: 44805 - DNA, 37 bp, Artificial Sequence
  Description of Artificial Sequence: Synthetic oligonucleotide
aggatttcttcacacctctcctttgtgacttcaagag

SEQ ID NO: 44806 - DNA, 36 bp, Artificial Sequence
  Description of Artificial Sequence: Synthetic oligonucleotide
ggatttcttcacacctctcctttgtgacttcaagag

SEQ ID NO: 44807 - DNA, 36 bp, Artificial Sequence
  Description of Artificial Sequence: Synthetic oligonucleotide
gatttcttcacacctctcctttgtgacttcaagagc

SEQ ID NO: 44808 - DNA, 36 bp, Artificial Sequence
  Description of Artificial Sequence: Synthetic oligonucleotide
atttcttcacacctctcctttgtgacttcaagagcc

SEQ ID NO: 44809 - DNA, 35 bp, Artificial Sequence
  Description of Artificial Sequence: Synthetic oligonucleotide
tttcttcacacctctcctttgtgacttcaagagcc

SEQ ID NO: 44810 - DNA, 34 bp, Artificial Sequence
  Description of Artificial Sequence: Synthetic oligonucleotide
ttcttcacacctctcctttgtgacttcaagagcc

SEQ ID NO: 44811 - DNA, 33 bp, Artificial Sequence
  Description of Artificial Sequence: Synthetic oligonucleotide
tcttcacacctctcctttgtgacttcaagagcc

SEQ ID NO: 44812 - DNA, 32 bp, Artificial Sequence
  Description of Artificial Sequence: Synthetic oligonucleotide
cttcacacctctcctttgtgacttcaagagcc

SEQ ID NO: 44813 - DNA, 33 bp, Artificial Sequence
  Description of Artificial Sequence: Synthetic oligonucleotide
ttcacacctctcctttgtgacttcaagagcctc

SEQ ID NO: 44814 - DNA, 32 bp, Artificial Sequence
  Description of Artificial Sequence: Synthetic oligonucleotide
tcacacctctcctttgtgacttcaagagcctc

SEQ ID NO: 44815 - DNA, 31 bp, Artificial Sequence
  Description of Artificial Sequence: Synthetic oligonucleotide
cacacctctcctttgtgacttcaagagcctc

SEQ ID NO: 44816 - DNA, 32 bp, Artificial Sequence
  Description of Artificial Sequence: Synthetic oligonucleotide
acacctctcctttgtgacttcaagagcctctg

SEQ ID NO: 44817 - DNA, 31 bp, Artificial Sequence
  Description of Artificial Sequence: Synthetic oligonucleotide
cacctctcctttgtgacttcaagagcctctg

SEQ ID NO: 44818 - DNA, 31 bp, Artificial Sequence
  Description of Artificial Sequence: Synthetic oligonucleotide
acctctcctttgtgacttcaagagcctctgg

SEQ ID NO: 44819 - DNA, 30 bp, Artificial Sequence
  Description of Artificial Sequence: Synthetic oligonucleotide
cctctcctttgtgacttcaagagcctctgg

SEQ ID NO: 44820 - DNA, 30 bp, Artificial Sequence
  Description of Artificial Sequence: Synthetic oligonucleotide
ctctcctttgtgacttcaagagcctctggc

SEQ ID NO: 44821 - DNA, 32 bp, Artificial Sequence
  Description of Artificial Sequence: Synthetic oligonucleotide
tctcctttgtgacttcaagagcctctggcatc

SEQ ID NO: 44822 - DNA, 31 bp, Artificial Sequence
  Description of Artificial Sequence: Synthetic oligonucleotide
ctcctttgtgacttcaagagcctctggcatc

SEQ ID NO: 44823 - DNA, 32 bp, Artificial Sequence
  Description of Artificial Sequence: Synthetic oligonucleotide
tcctttgtgacttcaagagcctctggcatctc

SEQ ID NO: 44824 - DNA, 31 bp, Artificial Sequence
  Description of Artificial Sequence: Synthetic oligonucleotide
cctttgtgacttcaagagcctctggcatctc

SEQ ID NO: 44825 - DNA, 34 bp, Artificial Sequence
  Description of Artificial Sequence: Synthetic oligonucleotide
ctttgtgacttcaagagcctctggcatctctttc

SEQ ID NO: 44826 - DNA, 35 bp, Artificial Sequence
  Description of Artificial Sequence: Synthetic oligonucleotide
tttgtgacttcaagagcctctggcatctctttctg

SEQ ID NO: 44827 - DNA, 34 bp, Artificial Sequence
  Description of Artificial Sequence: Synthetic oligonucleotide
ttgtgacttcaagagcctctggcatctctttctg

SEQ ID NO: 44828 - DNA, 33 bp, Artificial Sequence
  Description of Artificial Sequence: Synthetic oligonucleotide
tgtgacttcaagagcctctggcatctctttctg

SEQ ID NO: 44829 - DNA, 32 bp, Artificial Sequence
  Description of Artificial Sequence: Synthetic oligonucleotide
gtgacttcaagagcctctggcatctctttctg

SEQ ID NO: 44830 - DNA, 32 bp, Artificial Sequence
  Description of Artificial Sequence: Synthetic oligonucleotide
tgacttcaagagcctctggcatctctttctgc

SEQ ID NO: 44831 - DNA, 31 bp, Artificial Sequence
  Description of Artificial Sequence: Synthetic oligonucleotide
gacttcaagagcctctggcatctctttctgc

SEQ ID NO: 44832 - DNA, 34 bp, Artificial Sequence
  Description of Artificial Sequence: Synthetic oligonucleotide
acttcaagagcctctggcatctctttctgcaaag

SEQ ID NO: 44833 - DNA, 33 bp, Artificial Sequence
  Description of Artificial Sequence: Synthetic oligonucleotide
cttcaagagcctctggcatctctttctgcaaag

SEQ ID NO: 44834 - DNA, 33 bp, Artificial Sequence
  Description of Artificial Sequence: Synthetic oligonucleotide
ttcaagagcctctggcatctctttctgcaaagg

SEQ ID NO: 44835 - DNA, 32 bp, Artificial Sequence
  Description of Artificial Sequence: Synthetic oligonucleotide
tcaagagcctctggcatctctttctgcaaagg

SEQ ID NO: 44836 - DNA, 31 bp, Artificial Sequence
  Description of Artificial Sequence: Synthetic oligonucleotide
caagagcctctggcatctctttctgcaaagg

SEQ ID NO: 44837 - DNA, 31 bp, Artificial Sequence
  Description of Artificial Sequence: Synthetic oligonucleotide
aagagcctctggcatctctttctgcaaaggc

SEQ ID NO: 44838 - DNA, 30 bp, Artificial Sequence
  Description of Artificial Sequence: Synthetic oligonucleotide
agagcctctggcatctctttctgcaaaggc

SEQ ID NO: 44839 - DNA, 29 bp, Artificial Sequence
  Description of Artificial Sequence: Synthetic oligonucleotide
gagcctctggcatctctttctgcaaaggc

SEQ ID NO: 44840 - DNA, 31 bp, Artificial Sequence
  Description of Artificial Sequence: Synthetic oligonucleotide
agcctctggcatctctttctgcaaaggcatc

SEQ ID NO: 44841 - DNA, 30 bp, Artificial Sequence
  Description of Artificial Sequence: Synthetic oligonucleotide
gcctctggcatctctttctgcaaaggcatc

SEQ ID NO: 44842 - DNA, 31 bp, Artificial Sequence
  Description of Artificial Sequence: Synthetic oligonucleotide
cctctggcatctctttctgcaaaggcatctg

SEQ ID NO: 44843 - DNA, 25 bp, Artificial Sequence
  Description of Artificial Sequence: Synthetic oligonucleotide
tacaagcgccaggcacaggctgacg

SEQ ID NO: 44844 - DNA, 24 bp, Artificial Sequence
  Description of Artificial Sequence: Synthetic oligonucleotide
acaagcgccaggcacaggctgacg

SEQ ID NO: 44845 - DNA, 23 bp, Artificial Sequence
  Description of Artificial Sequence: Synthetic oligonucleotide
caagcgccaggcacaggctgacg

SEQ ID NO: 44846 - DNA, 24 bp, Artificial Sequence
  Description of Artificial Sequence: Synthetic oligonucleotide
aagcgccaggcacaggctgacgga

SEQ ID NO: 44847 - DNA, 23 bp, Artificial Sequence
  Description of Artificial Sequence: Synthetic oligonucleotide
agcgccaggcacaggctgacgga

SEQ ID NO: 44848 - DNA, 22 bp, Artificial Sequence
  Description of Artificial Sequence: Synthetic oligonucleotide
gcgccaggcacaggctgacgga

SEQ ID NO: 44849 - DNA, 23 bp, Artificial Sequence
  Description of Artificial Sequence: Synthetic oligonucleotide
cgccaggcacaggctgacggagt

SEQ ID NO: 44850 - DNA, 25 bp, Artificial Sequence
  Description of Artificial Sequence: Synthetic oligonucleotide
gccaggcacaggctgacggagtgaa

SEQ ID NO: 44851 - DNA, 25 bp, Artificial Sequence
  Description of Artificial Sequence: Synthetic oligonucleotide
ccaggcacaggctgacggagtgaac

SEQ ID NO: 44852 - DNA, 26 bp, Artificial Sequence
  Description of Artificial Sequence: Synthetic oligonucleotide
caggcacaggctgacggagtgaacct

SEQ ID NO: 44853 - DNA, 26 bp, Artificial Sequence
  Description of Artificial Sequence: Synthetic oligonucleotide
aggcacaggctgacggagtgaacctg

SEQ ID NO: 44854 - DNA, 25 bp, Artificial Sequence
  Description of Artificial Sequence: Synthetic oligonucleotide
ggcacaggctgacggagtgaacctg

SEQ ID NO: 44855 - DNA, 25 bp, Artificial Sequence
  Description of Artificial Sequence: Synthetic oligonucleotide
gcacaggctgacggagtgaacctgc

SEQ ID NO: 44856 - DNA, 25 bp, Artificial Sequence
  Description of Artificial Sequence: Synthetic oligonucleotide
cacaggctgacggagtgaacctgcg

SEQ ID NO: 44857 - DNA, 27 bp, Artificial Sequence
  Description of Artificial Sequence: Synthetic oligonucleotide
acaggctgacggagtgaacctgcggaa

SEQ ID NO: 44858 - DNA, 27 bp, Artificial Sequence
  Description of Artificial Sequence: Synthetic oligonucleotide
caggctgacggagtgaacctgcggaaa

SEQ ID NO: 44859 - DNA, 27 bp, Artificial Sequence
  Description of Artificial Sequence: Synthetic oligonucleotide
aggctgacggagtgaacctgcggaaac

SEQ ID NO: 44860 - DNA, 27 bp, Artificial Sequence
  Description of Artificial Sequence: Synthetic oligonucleotide
ggctgacggagtgaacctgcggaaact

SEQ ID NO: 44861 - DNA, 27 bp, Artificial Sequence
  Description of Artificial Sequence: Synthetic oligonucleotide
gctgacggagtgaacctgcggaaactg

SEQ ID NO: 44862 - DNA, 27 bp, Artificial Sequence
  Description of Artificial Sequence: Synthetic oligonucleotide
ctgacggagtgaacctgcggaaactgc

SEQ ID NO: 44863 - DNA, 27 bp, Artificial Sequence
  Description of Artificial Sequence: Synthetic oligonucleotide
tgacggagtgaacctgcggaaactgcg

SEQ ID NO: 44864 - DNA, 26 bp, Artificial Sequence
  Description of Artificial Sequence: Synthetic oligonucleotide
gacggagtgaacctgcggaaactgcg

SEQ ID NO: 44865 - DNA, 26 bp, Artificial Sequence
  Description of Artificial Sequence: Synthetic oligonucleotide
acggagtgaacctgcggaaactgcgc

SEQ ID NO: 44866 - DNA, 25 bp, Artificial Sequence
  Description of Artificial Sequence: Synthetic oligonucleotide
cggagtgaacctgcggaaactgcgc

SEQ ID NO: 44867 - DNA, 25 bp, Artificial Sequence
  Description of Artificial Sequence: Synthetic oligonucleotide
ggagtgaacctgcggaaactgcgcg

SEQ ID NO: 44868 - DNA, 25 bp, Artificial Sequence
  Description of Artificial Sequence: Synthetic oligonucleotide
aggcggagcagcggagagcctacat

SEQ ID NO: 44869 - DNA, 24 bp, Artificial Sequence
  Description of Artificial Sequence: Synthetic oligonucleotide
ggcggagcagcggagagcctacat

SEQ ID NO: 44870 - DNA, 24 bp, Artificial Sequence
  Description of Artificial Sequence: Synthetic oligonucleotide
gcggagcagcggagagcctacatg

SEQ ID NO: 44871 - DNA, 25 bp, Artificial Sequence
  Description of Artificial Sequence: Synthetic oligonucleotide
cggagcagcggagagcctacatgga

SEQ ID NO: 44872 - DNA, 25 bp, Artificial Sequence
  Description of Artificial Sequence: Synthetic oligonucleotide
ggagcagcggagagcctacatggag

SEQ ID NO: 44873 - DNA, 25 bp, Artificial Sequence
  Description of Artificial Sequence: Synthetic oligonucleotide
gagcagcggagagcctacatggagg

SEQ ID NO: 44874 - DNA, 25 bp, Artificial Sequence
  Description of Artificial Sequence: Synthetic oligonucleotide
agcagcggagagcctacatggaggg

SEQ ID NO: 44875 - DNA, 24 bp, Artificial Sequence
  Description of Artificial Sequence: Synthetic oligonucleotide
gcagcggagagcctacatggaggg

SEQ ID NO: 44876 - DNA, 25 bp, Artificial Sequence
  Description of Artificial Sequence: Synthetic oligonucleotide
cagcggagagcctacatggagggca

SEQ ID NO: 44877 - DNA, 25 bp, Artificial Sequence
  Description of Artificial Sequence: Synthetic oligonucleotide
agcggagagcctacatggagggcac

SEQ ID NO: 44878 - DNA, 24 bp, Artificial Sequence
  Description of Artificial Sequence: Synthetic oligonucleotide
gcggagagcctacatggagggcac

SEQ ID NO: 44879 - DNA, 25 bp, Artificial Sequence
  Description of Artificial Sequence: Synthetic oligonucleotide
cggagagcctacatggagggcacgt

SEQ ID NO: 44880 - DNA, 25 bp, Artificial Sequence
  Description of Artificial Sequence: Synthetic oligonucleotide
ggagagcctacatggagggcacgtg

SEQ ID NO: 44881 - DNA, 29 bp, Artificial Sequence
  Description of Artificial Sequence: Synthetic oligonucleotide
ctactacaaccagagcgaggacgggtatc

SEQ ID NO: 44882 - DNA, 30 bp, Artificial Sequence
  Description of Artificial Sequence: Synthetic oligonucleotide
tactacaaccagagcgaggacgggtatcac

SEQ ID NO: 44883 - DNA, 29 bp, Artificial Sequence
  Description of Artificial Sequence: Synthetic oligonucleotide
actacaaccagagcgaggacgggtatcac

SEQ ID NO: 44884 - DNA, 28 bp, Artificial Sequence
  Description of Artificial Sequence: Synthetic oligonucleotide
ctacaaccagagcgaggacgggtatcac

SEQ ID NO: 44885 - DNA, 29 bp, Artificial Sequence
  Description of Artificial Sequence: Synthetic oligonucleotide
tacaaccagagcgaggacgggtatcacac

SEQ ID NO: 44886 - DNA, 28 bp, Artificial Sequence
  Description of Artificial Sequence: Synthetic oligonucleotide
acaaccagagcgaggacgggtatcacac

SEQ ID NO: 44887 - DNA, 27 bp, Artificial Sequence
  Description of Artificial Sequence: Synthetic oligonucleotide
caaccagagcgaggacgggtatcacac

SEQ ID NO: 44888 - DNA, 27 bp, Artificial Sequence
  Description of Artificial Sequence: Synthetic oligonucleotide
aaccagagcgaggacgggtatcacacc

SEQ ID NO: 44889 - DNA, 26 bp, Artificial Sequence
  Description of Artificial Sequence: Synthetic oligonucleotide
accagagcgaggacgggtatcacacc

SEQ ID NO: 44890 - DNA, 25 bp, Artificial Sequence
  Description of Artificial Sequence: Synthetic oligonucleotide
ccagagcgaggacgggtatcacacc

SEQ ID NO: 44891 - DNA, 26 bp, Artificial Sequence
  Description of Artificial Sequence: Synthetic oligonucleotide
cagagcgaggacgggtatcacaccct

SEQ ID NO: 44892 - DNA, 26 bp, Artificial Sequence
  Description of Artificial Sequence: Synthetic oligonucleotide
agagcgaggacgggtatcacaccctc

SEQ ID NO: 44893 - DNA, 25 bp, Artificial Sequence
  Description of Artificial Sequence: Synthetic oligonucleotide
gagcgaggacgggtatcacaccctc

SEQ ID NO: 44894 - DNA, 26 bp, Artificial Sequence
  Description of Artificial Sequence: Synthetic oligonucleotide
agcgaggacgggtatcacaccctcca

SEQ ID NO: 44895 - DNA, 25 bp, Artificial Sequence
  Description of Artificial Sequence: Synthetic oligonucleotide
gcgaggacgggtatcacaccctcca

SEQ ID NO: 44896 - DNA, 26 bp, Artificial Sequence
  Description of Artificial Sequence: Synthetic oligonucleotide
cgaggacgggtatcacaccctccaga

SEQ ID NO: 44897 - DNA, 26 bp, Artificial Sequence
  Description of Artificial Sequence: Synthetic oligonucleotide
gaggacgggtatcacaccctccagag

SEQ ID NO: 44898 - DNA, 27 bp, Artificial Sequence
  Description of Artificial Sequence: Synthetic oligonucleotide
aggacgggtatcacaccctccagagga

SEQ ID NO: 44899 - DNA, 27 bp, Artificial Sequence
  Description of Artificial Sequence: Synthetic oligonucleotide
ggacgggtatcacaccctccagaggat

SEQ ID NO: 44900 - DNA, 27 bp, Artificial Sequence
  Description of Artificial Sequence: Synthetic oligonucleotide
gacgggtatcacaccctccagaggatg

SEQ ID NO: 44901 - DNA, 30 bp, Artificial Sequence
  Description of Artificial Sequence: Synthetic oligonucleotide
acgggtatcacaccctccagaggatgtttg

SEQ ID NO: 44902 - DNA, 29 bp, Artificial Sequence
  Description of Artificial Sequence: Synthetic oligonucleotide
cgggtatcacaccctccagaggatgtttg

SEQ ID NO: 44903 - DNA, 29 bp, Artificial Sequence
  Description of Artificial Sequence: Synthetic oligonucleotide
gggtatcacaccctccagaggatgtttgg

SEQ ID NO: 44904 - DNA, 29 bp, Artificial Sequence
  Description of Artificial Sequence: Synthetic oligonucleotide
ggtatcacaccctccagaggatgtttggc

SEQ ID NO: 44905 - DNA, 30 bp, Artificial Sequence
  Description of Artificial Sequence: Synthetic oligonucleotide
gtatcacaccctccagaggatgtttggctg

SEQ ID NO: 44906 - DNA, 30 bp, Artificial Sequence
  Description of Artificial Sequence: Synthetic oligonucleotide
tatcacaccctccagaggatgtttggctgc

SEQ ID NO: 44907 - DNA, 29 bp, Artificial Sequence
  Description of Artificial Sequence: Synthetic oligonucleotide
atcacaccctccagaggatgtttggctgc

SEQ ID NO: 44908 - DNA, 20 bp, Artificial Sequence
  Description of Artificial Sequence: Synthetic oligonucleotide
tcctggcccggccgcgggaa

SEQ ID NO: 44909 - DNA, 20 bp, Artificial Sequence
  Description of Artificial Sequence: Synthetic oligonucleotide
cctggcccggccgcgggaat

SEQ ID NO: 44910 - DNA, 20 bp, Artificial Sequence
  Description of Artificial Sequence: Synthetic oligonucleotide
ctggcccggccgcgggaagt

SEQ ID NO: 44911 - DNA, 20 bp, Artificial Sequence
  Description of Artificial Sequence: Synthetic oligonucleotide
tggcccggccgcgggaagct

SEQ ID NO: 44912 - DNA, 23 bp, Artificial Sequence
  Description of Artificial Sequence: Synthetic oligonucleotide
gcgggaagccccgcttcatcgca

SEQ ID NO: 44913 - DNA, 24 bp, Artificial Sequence
  Description of Artificial Sequence: Synthetic oligonucleotide
cgggaagccccgcttcatcgcagt

SEQ ID NO: 44914 - DNA, 24 bp, Artificial Sequence
  Description of Artificial Sequence: Synthetic oligonucleotide
gggaagccccgcttcatcgcagtg

SEQ ID NO: 44915 - DNA, 24 bp, Artificial Sequence
  Description of Artificial Sequence: Synthetic oligonucleotide
ggaagccccgcttcatcgcagtgg

SEQ ID NO: 44916 - DNA, 24 bp, Artificial Sequence
  Description of Artificial Sequence: Synthetic oligonucleotide
gaagccccgcttcatcgcagtggg

SEQ ID NO: 44917 - DNA, 26 bp, Artificial Sequence
  Description of Artificial Sequence: Synthetic oligonucleotide
aagccccgcttcatcgcagtgggcta

SEQ ID NO: 44918 - DNA, 32 bp, Artificial Sequence
  Description of Artificial Sequence: Synthetic oligonucleotide
gctcccactccatgatgtatttctccacatcc

SEQ ID NO: 44919 - DNA, 32 bp, Artificial Sequence
  Description of Artificial Sequence: Synthetic oligonucleotide
ctcccactccatgatgtatttctccacatccg

SEQ ID NO: 44920 - DNA, 33 bp, Artificial Sequence
  Description of Artificial Sequence: Synthetic oligonucleotide
tcccactccatgatgtatttctccacatccgtg

SEQ ID NO: 44921 - DNA, 32 bp, Artificial Sequence
  Description of Artificial Sequence: Synthetic oligonucleotide
cccactccatgatgtatttctccacatccgtg

SEQ ID NO: 44922 - DNA, 33 bp, Artificial Sequence
  Description of Artificial Sequence: Synthetic oligonucleotide
ccactccatgatgtatttctccacatccgtgtc

SEQ ID NO: 44923 - DNA, 33 bp, Artificial Sequence
  Description of Artificial Sequence: Synthetic oligonucleotide
cactccatgatgtatttctccacatccgtgtcc

SEQ ID NO: 44924 - DNA, 34 bp, Artificial Sequence
  Description of Artificial Sequence: Synthetic oligonucleotide
actccatgatgtatttctccacatccgtgtcctg

SEQ ID NO: 44925 - DNA, 33 bp, Artificial Sequence
  Description of Artificial Sequence: Synthetic oligonucleotide
ctccatgatgtatttctccacatccgtgtcctg

SEQ ID NO: 44926 - DNA, 33 bp, Artificial Sequence
  Description of Artificial Sequence: Synthetic oligonucleotide
tccatgatgtatttctccacatccgtgtcctgg

SEQ ID NO: 44927 - DNA, 32 bp, Artificial Sequence
  Description of Artificial Sequence: Synthetic oligonucleotide
ccatgatgtatttctccacatccgtgtcctgg

SEQ ID NO: 44928 - DNA, 32 bp, Artificial Sequence
  Description of Artificial Sequence: Synthetic oligonucleotide
catgatgtatttctccacatccgtgtcctggc

SEQ ID NO: 44929 - DNA, 32 bp, Artificial Sequence
  Description of Artificial Sequence: Synthetic oligonucleotide
atgatgtatttctccacatccgtgtcctggcc

SEQ ID NO: 44930 - DNA, 31 bp, Artificial Sequence
  Description of Artificial Sequence: Synthetic oligonucleotide
tgatgtatttctccacatccgtgtcctggcc

SEQ ID NO: 44931 - DNA, 30 bp, Artificial Sequence
  Description of Artificial Sequence: Synthetic oligonucleotide
gatgtatttctccacatccgtgtcctggcc

SEQ ID NO: 44932 - DNA, 30 bp, Artificial Sequence
  Description of Artificial Sequence: Synthetic oligonucleotide
atgtatttctccacatccgtgtcctggccc

SEQ ID NO: 44933 - DNA, 29 bp, Artificial Sequence
  Description of Artificial Sequence: Synthetic oligonucleotide
tgtatttctccacatccgtgtcctggccc

SEQ ID NO: 44934 - DNA, 26 bp, Artificial Sequence
  Description of Artificial Sequence: Synthetic oligonucleotide
cggctactacaaccagagcgaggacc

SEQ ID NO: 44935 - DNA, 26 bp, Artificial Sequence
  Description of Artificial Sequence: Synthetic oligonucleotide
ggctactacaaccagagcgaggaccg

SEQ ID NO: 44936 - DNA, 27 bp, Artificial Sequence
  Description of Artificial Sequence: Synthetic oligonucleotide
gctactacaaccagagcgaggaccggt

SEQ ID NO: 44937 - DNA, 27 bp, Artificial Sequence
  Description of Artificial Sequence: Synthetic oligonucleotide
ctactacaaccagagcgaggaccggtc

SEQ ID NO: 44938 - DNA, 28 bp, Artificial Sequence
  Description of Artificial Sequence: Synthetic oligonucleotide
tactacaaccagagcgaggaccggtctc

SEQ ID NO: 44939 - DNA, 27 bp, Artificial Sequence
  Description of Artificial Sequence: Synthetic oligonucleotide
actacaaccagagcgaggaccggtctc

SEQ ID NO: 44940 - DNA, 27 bp, Artificial Sequence
  Description of Artificial Sequence: Synthetic oligonucleotide
ctacaaccagagcgaggaccggtctca

SEQ ID NO: 44941 - DNA, 27 bp, Artificial Sequence
  Description of Artificial Sequence: Synthetic oligonucleotide
tacaaccagagcgaggaccggtctcac

SEQ ID NO: 44942 - DNA, 27 bp, Artificial Sequence
  Description of Artificial Sequence: Synthetic oligonucleotide
acaaccagagcgaggaccggtctcaca

SEQ ID NO: 44943 - DNA, 26 bp, Artificial Sequence
  Description of Artificial Sequence: Synthetic oligonucleotide
caaccagagcgaggaccggtctcaca

SEQ ID NO: 44944 - DNA, 26 bp, Artificial Sequence
  Description of Artificial Sequence: Synthetic oligonucleotide
aaccagagcgaggaccggtctcacac

SEQ ID NO: 44945 - DNA, 25 bp, Artificial Sequence
  Description of Artificial Sequence: Synthetic oligonucleotide
accagagcgaggaccggtctcacac

SEQ ID NO: 44946 - DNA, 24 bp, Artificial Sequence
  Description of Artificial Sequence: Synthetic oligonucleotide
ccagagcgaggaccggtctcacac

SEQ ID NO: 44947 - DNA, 24 bp, Artificial Sequence
  Description of Artificial Sequence: Synthetic oligonucleotide
cagagcgaggaccggtctcacacc

SEQ ID NO: 44948 - DNA, 25 bp, Artificial Sequence
  Description of Artificial Sequence: Synthetic oligonucleotide
agagcgaggaccggtctcacaccct

SEQ ID NO: 44949 - DNA, 24 bp, Artificial Sequence
  Description of Artificial Sequence: Synthetic oligonucleotide
gagcgaggaccggtctcacaccct

SEQ ID NO: 44950 - DNA, 24 bp, Artificial Sequence
  Description of Artificial Sequence: Synthetic oligonucleotide
agcgaggaccggtctcacaccctc

SEQ ID NO: 44951 - DNA, 23 bp, Artificial Sequence
  Description of Artificial Sequence: Synthetic oligonucleotide
gcgaggaccggtctcacaccctc

SEQ ID NO: 44952 - DNA, 24 bp, Artificial Sequence
  Description of Artificial Sequence: Synthetic oligonucleotide
cgaggaccggtctcacaccctcca

SEQ ID NO: 44953 - DNA, 25 bp, Artificial Sequence
  Description of Artificial Sequence: Synthetic oligonucleotide
gaggaccggtctcacaccctccaga

SEQ ID NO: 44954 - DNA, 25 bp, Artificial Sequence
  Description of Artificial Sequence: Synthetic oligonucleotide
aggaccggtctcacaccctccagag

SEQ ID NO: 44955 - DNA, 24 bp, Artificial Sequence
  Description of Artificial Sequence: Synthetic oligonucleotide
ggaccggtctcacaccctccagag

SEQ ID NO: 44956 - DNA, 26 bp, Artificial Sequence
  Description of Artificial Sequence: Synthetic oligonucleotide
gaccggtctcacaccctccagaggat

SEQ ID NO: 44957 - DNA, 27 bp, Artificial Sequence
  Description of Artificial Sequence: Synthetic oligonucleotide
accggtctcacaccctccagaggatgt

SEQ ID NO: 44958 - DNA, 27 bp, Artificial Sequence
  Description of Artificial Sequence: Synthetic oligonucleotide
ccggtctcacaccctccagaggatgtt

SEQ ID NO: 44959 - DNA, 28 bp, Artificial Sequence
  Description of Artificial Sequence: Synthetic oligonucleotide
cggtctcacaccctccagaggatgtttg

SEQ ID NO: 44960 - DNA, 23 bp, Artificial Sequence
  Description of Artificial Sequence: Synthetic oligonucleotide
tgaggtgctgggccctgggcttc

SEQ ID NO: 44961 - DNA, 22 bp, Artificial Sequence
  Description of Artificial Sequence: Synthetic oligonucleotide
gaggtgctgggccctgggcttc

SEQ ID NO: 44962 - DNA, 23 bp, Artificial Sequence
  Description of Artificial Sequence: Synthetic oligonucleotide
aggtgctgggccctgggcttcca

SEQ ID NO: 44963 - DNA, 22 bp, Artificial Sequence
  Description of Artificial Sequence: Synthetic oligonucleotide
ggtgctgggccctgggcttcca

SEQ ID NO: 44964 - DNA, 22 bp, Artificial Sequence
  Description of Artificial Sequence: Synthetic oligonucleotide
gtgctgggccctgggcttccac

SEQ ID NO: 44965 - DNA, 22 bp, Artificial Sequence
  Description of Artificial Sequence: Synthetic oligonucleotide
tgctgggccctgggcttccacc

SEQ ID NO: 44966 - DNA, 21 bp, Artificial Sequence
  Description of Artificial Sequence: Synthetic oligonucleotide
gctgggccctgggcttccacc

SEQ ID NO: 44967 - DNA, 22 bp, Artificial Sequence
  Description of Artificial Sequence: Synthetic oligonucleotide
ctgggccctgggcttccaccct

SEQ ID NO: 44968 - DNA, 22 bp, Artificial Sequence
  Description of Artificial Sequence: Synthetic oligonucleotide
tgggccctgggcttccaccctg

SEQ ID NO: 44969 - DNA, 21 bp, Artificial Sequence
  Description of Artificial Sequence: Synthetic oligonucleotide
gggccctgggcttccaccctg

SEQ ID NO: 44970 - DNA, 21 bp, Artificial Sequence
  Description of Artificial Sequence: Synthetic oligonucleotide
ggccctgggcttccaccctgc

SEQ ID NO: 44971 - DNA, 21 bp, Artificial Sequence
  Description of Artificial Sequence: Synthetic oligonucleotide
gccctgggcttccaccctgcg

SEQ ID NO: 44972 - DNA, 22 bp, Artificial Sequence
  Description of Artificial Sequence: Synthetic oligonucleotide
ccctgggcttccaccctgcgga

SEQ ID NO: 44973 - DNA, 24 bp, Artificial Sequence
  Description of Artificial Sequence: Synthetic oligonucleotide
cctgggcttccaccctgcggagat

SEQ ID NO: 44974 - DNA, 25 bp, Artificial Sequence
  Description of Artificial Sequence: Synthetic oligonucleotide
ctgggcttccaccctgcggagatca

SEQ ID NO: 44975 - DNA, 26 bp, Artificial Sequence
  Description of Artificial Sequence: Synthetic oligonucleotide
tgggcttccaccctgcggagatcaca

SEQ ID NO: 44976 - DNA, 25 bp, Artificial Sequence
  Description of Artificial Sequence: Synthetic oligonucleotide
gggcttccaccctgcggagatcaca

SEQ ID NO: 44977 - DNA, 26 bp, Artificial Sequence
  Description of Artificial Sequence: Synthetic oligonucleotide
ggcttccaccctgcggagatcacact

SEQ ID NO: 44978 - DNA, 27 bp, Artificial Sequence
  Description of Artificial Sequence: Synthetic oligonucleotide
gcttccaccctgcggagatcacactga

SEQ ID NO: 44979 - DNA, 27 bp, Artificial Sequence
  Description of Artificial Sequence: Synthetic oligonucleotide
cttccaccctgcggagatcacactgac

SEQ ID NO: 44980 - DNA, 27 bp, Artificial Sequence
  Description of Artificial Sequence: Synthetic oligonucleotide
ttccaccctgcggagatcacactgacc

SEQ ID NO: 44981 - DNA, 27 bp, Artificial Sequence
  Description of Artificial Sequence: Synthetic oligonucleotide
tccaccctgcggagatcacactgacct

SEQ ID NO: 44982 - DNA, 26 bp, Artificial Sequence
  Description of Artificial Sequence: Synthetic oligonucleotide
ccaccctgcggagatcacactgacct

SEQ ID NO: 44983 - DNA, 26 bp, Artificial Sequence
  Description of Artificial Sequence: Synthetic oligonucleotide
caccctgcggagatcacactgacctg

SEQ ID NO: 44984 - DNA, 24 bp, Artificial Sequence
  Description of Artificial Sequence: Synthetic oligonucleotide
gagctgctctcaggctgcgtccac

SEQ ID NO: 44985 - DNA, 26 bp, Artificial Sequence
  Description of Artificial Sequence: Synthetic oligonucleotide
agctgctctcaggctgcgtccaccaa

SEQ ID NO: 44986 - DNA, 25 bp, Artificial Sequence
  Description of Artificial Sequence: Synthetic oligonucleotide
gctgctctcaggctgcgtccaccaa

SEQ ID NO: 44987 - DNA, 26 bp, Artificial Sequence
  Description of Artificial Sequence: Synthetic oligonucleotide
ctgctctcaggctgcgtccaccaaca

SEQ ID NO: 44988 - DNA, 27 bp, Artificial Sequence
  Description of Artificial Sequence: Synthetic oligonucleotide
tgctctcaggctgcgtccaccaacagt

SEQ ID NO: 44989 - DNA, 26 bp, Artificial Sequence
  Description of Artificial Sequence: Synthetic oligonucleotide
gctctcaggctgcgtccaccaacagt

SEQ ID NO: 44990 - DNA, 26 bp, Artificial Sequence
  Description of Artificial Sequence: Synthetic oligonucleotide
ctctcaggctgcgtccaccaacagtg

SEQ ID NO: 44991 - DNA, 26 bp, Artificial Sequence
  Description of Artificial Sequence: Synthetic oligonucleotide
tctcaggctgcgtccaccaacagtgc

SEQ ID NO: 44992 - DNA, 25 bp, Artificial Sequence
  Description of Artificial Sequence: Synthetic oligonucleotide
ctcaggctgcgtccaccaacagtgc

SEQ ID NO: 44993 - DNA, 25 bp, Artificial Sequence
  Description of Artificial Sequence: Synthetic oligonucleotide
tcaggctgcgtccaccaacagtgcc

SEQ ID NO: 44994 - DNA, 24 bp, Artificial Sequence
  Description of Artificial Sequence: Synthetic oligonucleotide
caggctgcgtccaccaacagtgcc

SEQ ID NO: 44995 - DNA, 25 bp, Artificial Sequence
  Description of Artificial Sequence: Synthetic oligonucleotide
aggctgcgtccaccaacagtgccca

SEQ ID NO: 44996 - DNA, 24 bp, Artificial Sequence
  Description of Artificial Sequence: Synthetic oligonucleotide
ggctgcgtccaccaacagtgccca

SEQ ID NO: 44997 - DNA, 24 bp, Artificial Sequence
  Description of Artificial Sequence: Synthetic oligonucleotide
gctgcgtccaccaacagtgcccag

SEQ ID NO: 44998 - DNA, 24 bp, Artificial Sequence
  Description of Artificial Sequence: Synthetic oligonucleotide
ctgcgtccaccaacagtgcccagg

SEQ ID NO: 44999 - DNA, 24 bp, Artificial Sequence
  Description of Artificial Sequence: Synthetic oligonucleotide
tgcgtccaccaacagtgcccaggg

SEQ ID NO: 45000 - DNA, 23 bp, Artificial Sequence
  Description of Artificial Sequence: Synthetic oligonucleotide
gcgtccaccaacagtgcccaggg

SEQ ID NO: 45001 - DNA, 24 bp, Artificial Sequence
  Description of Artificial Sequence: Synthetic oligonucleotide
cgtccaccaacagtgcccagggct

SEQ ID NO: 45002 - DNA, 25 bp, Artificial Sequence
  Description of Artificial Sequence: Synthetic oligonucleotide
gtccaccaacagtgcccagggctct

SEQ ID NO: 45003 - DNA, 27 bp, Artificial Sequence
  Description of Artificial Sequence: Synthetic oligonucleotide
tccaccaacagtgcccagggctctgat

SEQ ID NO: 45004 - DNA, 26 bp, Artificial Sequence
  Description of Artificial Sequence: Synthetic oligonucleotide
ccaccaacagtgcccagggctctgat

SEQ ID NO: 45005 - DNA, 27 bp, Artificial Sequence
  Description of Artificial Sequence: Synthetic oligonucleotide
caccaacagtgcccagggctctgatga

SEQ ID NO: 45006 - DNA, 27 bp, Artificial Sequence
  Description of Artificial Sequence: Synthetic oligonucleotide
accaacagtgcccagggctctgatgag

SEQ ID NO: 45007 - DNA, 27 bp, Artificial Sequence
  Description of Artificial Sequence: Synthetic oligonucleotide
ccaacagtgcccagggctctgatgagt

SEQ ID NO: 45008 - DNA, 22 bp, Artificial Sequence
  Description of Artificial Sequence: Synthetic oligonucleotide
cagcgcaagtgggaggcggtcc

SEQ ID NO: 45009 - DNA, 23 bp, Artificial Sequence
  Description of Artificial Sequence: Synthetic oligonucleotide
agcgcaagtgggaggcggtccgt

SEQ ID NO: 45010 - DNA, 22 bp, Artificial Sequence
  Description of Artificial Sequence: Synthetic oligonucleotide
gcgcaagtgggaggcggtccgt

SEQ ID NO: 45011 - DNA, 23 bp, Artificial Sequence
  Description of Artificial Sequence: Synthetic oligonucleotide
cgcaagtgggaggcggtccgtga

SEQ ID NO: 45012 - DNA, 23 bp, Artificial Sequence
  Description of Artificial Sequence: Synthetic oligonucleotide
gcaagtgggaggcggtccgtgag

SEQ ID NO: 45013 - DNA, 23 bp, Artificial Sequence
  Description of Artificial Sequence: Synthetic oligonucleotide
caagtgggaggcggtccgtgagg

SEQ ID NO: 45014 - DNA, 23 bp, Artificial Sequence
  Description of Artificial Sequence: Synthetic oligonucleotide
aagtgggaggcggtccgtgaggc

SEQ ID NO: 45015 - DNA, 22 bp, Artificial Sequence
  Description of Artificial Sequence: Synthetic oligonucleotide
agtgggaggcggtccgtgaggc

SEQ ID NO: 45016 - DNA, 21 bp, Artificial Sequence
  Description of Artificial Sequence: Synthetic oligonucleotide
gtgggaggcggtccgtgaggc

SEQ ID NO: 45017 - DNA, 21 bp, Artificial Sequence
  Description of Artificial Sequence: Synthetic oligonucleotide
tgggaggcggtccgtgaggcg

SEQ ID NO: 45018 - DNA, 20 bp, Artificial Sequence
  Description of Artificial Sequence: Synthetic oligonucleotide
gggaggcggtccgtgaggcg

SEQ ID NO: 45019 - DNA, 21 bp, Artificial Sequence
  Description of Artificial Sequence: Synthetic oligonucleotide
ggaggcggtccgtgaggcgga

SEQ ID NO: 45020 - DNA, 21 bp, Artificial Sequence
  Description of Artificial Sequence: Synthetic oligonucleotide
gaggcggtccgtgaggcggag

SEQ ID NO: 45021 - DNA, 22 bp, Artificial Sequence
  Description of Artificial Sequence: Synthetic oligonucleotide
aggcggtccgtgaggcggagca

SEQ ID NO: 45022 - DNA, 21 bp, Artificial Sequence
  Description of Artificial Sequence: Synthetic oligonucleotide
ggcggtccgtgaggcggagca

SEQ ID NO: 45023 - DNA, 21 bp, Artificial Sequence
  Description of Artificial Sequence: Synthetic oligonucleotide
gcggtccgtgaggcggagcag

SEQ ID NO: 45024 - DNA, 21 bp, Artificial Sequence
  Description of Artificial Sequence: Synthetic oligonucleotide
cggtccgtgaggcggagcagc

SEQ ID NO: 45025 - DNA, 21 bp, Artificial Sequence
  Description of Artificial Sequence: Synthetic oligonucleotide
ggtccgtgaggcggagcagcg

SEQ ID NO: 45026 - DNA, 22 bp, Artificial Sequence
  Description of Artificial Sequence: Synthetic oligonucleotide
gtccgtgaggcggagcagcgga

SEQ ID NO: 45027 - DNA, 23 bp, Artificial Sequence
  Description of Artificial Sequence: Synthetic oligonucleotide
tccgtgaggcggagcagcggaga

SEQ ID NO: 45028 - DNA, 20 bp, Artificial Sequence
  Description of Artificial Sequence: Synthetic oligonucleotide
ctgcgacctggggccggacc

SEQ ID NO: 45029 - DNA, 20 bp, Artificial Sequence
  Description of Artificial Sequence: Synthetic oligonucleotide
tgcgacctggggccggaccg

SEQ ID NO: 45030 - DNA, 20 bp, Artificial Sequence
  Description of Artificial Sequence: Synthetic oligonucleotide
gcgacctggggccggaccgt

SEQ ID NO: 45031 - DNA, 20 bp, Artificial Sequence
  Description of Artificial Sequence: Synthetic oligonucleotide
cgacctggggccggaccggt

SEQ ID NO: 45032 - DNA, 20 bp, Artificial Sequence
  Description of Artificial Sequence: Synthetic oligonucleotide
gacctggggccggaccggct

SEQ ID NO: 45033 - DNA, 20 bp, Artificial Sequence
  Description of Artificial Sequence: Synthetic oligonucleotide
acctggggccggaccggcgt

SEQ ID NO: 45034 - DNA, 20 bp, Artificial Sequence
  Description of Artificial Sequence: Synthetic oligonucleotide
cctggggccggaccggcgtt

SEQ ID NO: 45035 - DNA, 20 bp, Artificial Sequence
  Description of Artificial Sequence: Synthetic oligonucleotide
ctggggccggaccggcgctt

SEQ ID NO: 45036 - DNA, 23 bp, Artificial Sequence
  Description of Artificial Sequence: Synthetic oligonucleotide
cggcgcctcctccgcgggtataa

SEQ ID NO: 45037 - DNA, 25 bp, Artificial Sequence
  Description of Artificial Sequence: Synthetic oligonucleotide
cctgaacgaggatctgcgctcctgg

SEQ ID NO: 45038 - DNA, 25 bp, Artificial Sequence
  Description of Artificial Sequence: Synthetic oligonucleotide
ctgaacgaggatctgcgctcctggg

SEQ ID NO: 45039 - DNA, 25 bp, Artificial Sequence
  Description of Artificial Sequence: Synthetic oligonucleotide
tgaacgaggatctgcgctcctgggc

SEQ ID NO: 45040 - DNA, 24 bp, Artificial Sequence
  Description of Artificial Sequence: Synthetic oligonucleotide
gaacgaggatctgcgctcctgggc

SEQ ID NO: 45041 - DNA, 24 bp, Artificial Sequence
  Description of Artificial Sequence: Synthetic oligonucleotide
aacgaggatctgcgctcctgggcc

SEQ ID NO: 45042 - DNA, 23 bp, Artificial Sequence
  Description of Artificial Sequence: Synthetic oligonucleotide
acgaggatctgcgctcctgggcc

SEQ ID NO: 45043 - DNA, 22 bp, Artificial Sequence
  Description of Artificial Sequence: Synthetic oligonucleotide
cgaggatctgcgctcctgggcc

SEQ ID NO: 45044 - DNA, 22 bp, Artificial Sequence
  Description of Artificial Sequence: Synthetic oligonucleotide
gaggatctgcgctcctgggccg

SEQ ID NO: 45045 - DNA, 22 bp, Artificial Sequence
  Description of Artificial Sequence: Synthetic oligonucleotide
aggatctgcgctcctgggccgc

SEQ ID NO: 45046 - DNA, 21 bp, Artificial Sequence
  Description of Artificial Sequence: Synthetic oligonucleotide
ggatctgcgctcctgggccgc

SEQ ID NO: 45047 - DNA, 21 bp, Artificial Sequence
  Description of Artificial Sequence: Synthetic oligonucleotide
gatctgcgctcctgggccgcc

SEQ ID NO: 45048 - DNA, 21 bp, Artificial Sequence
  Description of Artificial Sequence: Synthetic oligonucleotide
atctgcgctcctgggccgccg

SEQ ID NO: 45049 - DNA, 20 bp, Artificial Sequence
  Description of Artificial Sequence: Synthetic oligonucleotide
tctgcgctcctgggccgccg

SEQ ID NO: 45050 - DNA, 20 bp, Artificial Sequence
  Description of Artificial Sequence: Synthetic oligonucleotide
ctgcgctcctgggccgccgt

SEQ ID NO: 45051 - DNA, 20 bp, Artificial Sequence
  Description of Artificial Sequence: Synthetic oligonucleotide
tgcgctcctgggccgccgct

SEQ ID NO: 45052 - DNA, 20 bp, Artificial Sequence
  Description of Artificial Sequence: Synthetic oligonucleotide
gcgctcctgggccgccgctt

SEQ ID NO: 45053 - DNA, 20 bp, Artificial Sequence
  Description of Artificial Sequence: Synthetic oligonucleotide
cgctcctgggccgccgcgtt

SEQ ID NO: 45054 - DNA, 20 bp, Artificial Sequence
  Description of Artificial Sequence: Synthetic oligonucleotide
gctcctgggccgccgcggat

SEQ ID NO: 45055 - DNA, 20 bp, Artificial Sequence
  Description of Artificial Sequence: Synthetic oligonucleotide
ctcctgggccgccgcggaca

SEQ ID NO: 45056 - DNA, 20 bp, Artificial Sequence
  Description of Artificial Sequence: Synthetic oligonucleotide
tcctgggccgccgcggacac

SEQ ID NO: 45057 - DNA, 20 bp, Artificial Sequence
  Description of Artificial Sequence: Synthetic oligonucleotide
cctgggccgccgcggacact

SEQ ID NO: 45058 - DNA, 20 bp, Artificial Sequence
  Description of Artificial Sequence: Synthetic oligonucleotide
ctgggccgccgcggacacgt

SEQ ID NO: 45059 - DNA, 20 bp, Artificial Sequence
  Description of Artificial Sequence: Synthetic oligonucleotide
tgggccgccgcggacacggt

SEQ ID NO: 45060 - DNA, 20 bp, Artificial Sequence
  Description of Artificial Sequence: Synthetic oligonucleotide
gggccgccgcggacacggtt

SEQ ID NO: 45061 - DNA, 20 bp, Artificial Sequence
  Description of Artificial Sequence: Synthetic oligonucleotide
ggccgccgcggacacggctt

SEQ ID NO: 45062 - DNA, 20 bp, Artificial Sequence
  Description of Artificial Sequence: Synthetic oligonucleotide
gccgccgcggacacggcgtt

SEQ ID NO: 45063 - DNA, 26 bp, Artificial Sequence
  Description of Artificial Sequence: Synthetic oligonucleotide
cagagcgaggacgggtctcacacctt

SEQ ID NO: 45064 - DNA, 26 bp, Artificial Sequence
  Description of Artificial Sequence: Synthetic oligonucleotide
agagcgaggacgggtctcacaccttc

SEQ ID NO: 45065 - DNA, 25 bp, Artificial Sequence
  Description of Artificial Sequence: Synthetic oligonucleotide
gagcgaggacgggtctcacaccttc

SEQ ID NO: 45066 - DNA, 26 bp, Artificial Sequence
  Description of Artificial Sequence: Synthetic oligonucleotide
agcgaggacgggtctcacaccttcca

SEQ ID NO: 45067 - DNA, 25 bp, Artificial Sequence
  Description of Artificial Sequence: Synthetic oligonucleotide
gcgaggacgggtctcacaccttcca

SEQ ID NO: 45068 - DNA, 26 bp, Artificial Sequence
  Description of Artificial Sequence: Synthetic oligonucleotide
cgaggacgggtctcacaccttccaga

SEQ ID NO: 45069 - DNA, 26 bp, Artificial Sequence
  Description of Artificial Sequence: Synthetic oligonucleotide
gaggacgggtctcacaccttccagag

SEQ ID NO: 45070 - DNA, 27 bp, Artificial Sequence
  Description of Artificial Sequence: Synthetic oligonucleotide
aggacgggtctcacaccttccagagga

SEQ ID NO: 45071 - DNA, 27 bp, Artificial Sequence
  Description of Artificial Sequence: Synthetic oligonucleotide
ggacgggtctcacaccttccagaggat

SEQ ID NO: 45072 - DNA, 27 bp, Artificial Sequence
  Description of Artificial Sequence: Synthetic oligonucleotide
gacgggtctcacaccttccagaggatg

SEQ ID NO: 45073 - DNA, 30 bp, Artificial Sequence
  Description of Artificial Sequence: Synthetic oligonucleotide
acgggtctcacaccttccagaggatgtttg

SEQ ID NO: 45074 - DNA, 29 bp, Artificial Sequence
  Description of Artificial Sequence: Synthetic oligonucleotide
cgggtctcacaccttccagaggatgtttg

SEQ ID NO: 45075 - DNA, 29 bp, Artificial Sequence
  Description of Artificial Sequence: Synthetic oligonucleotide
gggtctcacaccttccagaggatgtttgg

SEQ ID NO: 45076 - DNA, 29 bp, Artificial Sequence
  Description of Artificial Sequence: Synthetic oligonucleotide
ggtctcacaccttccagaggatgtttggc

SEQ ID NO: 45077 - DNA, 30 bp, Artificial Sequence
  Description of Artificial Sequence: Synthetic oligonucleotide
gtctcacaccttccagaggatgtttggctg

SEQ ID NO: 45078 - DNA, 30 bp, Artificial Sequence
  Description of Artificial Sequence: Synthetic oligonucleotide
tctcacaccttccagaggatgtttggctgc

SEQ ID NO: 45079 - DNA, 29 bp, Artificial Sequence
  Description of Artificial Sequence: Synthetic oligonucleotide
ctcacaccttccagaggatgtttggctgc

SEQ ID NO: 45080 - DNA, 29 bp, Artificial Sequence
  Description of Artificial Sequence: Synthetic oligonucleotide
tcacaccttccagaggatgtttggctgcg

SEQ ID NO: 45081 - DNA, 28 bp, Artificial Sequence
  Description of Artificial Sequence: Synthetic oligonucleotide
cacaccttccagaggatgtttggctgcg

SEQ ID NO: 45082 - DNA, 29 bp, Artificial Sequence
  Description of Artificial Sequence: Synthetic oligonucleotide
acaccttccagaggatgtttggctgcgac

SEQ ID NO: 45083 - DNA, 28 bp, Artificial Sequence
  Description of Artificial Sequence: Synthetic oligonucleotide
caccttccagaggatgtttggctgcgac

SEQ ID NO: 45084 - DNA, 28 bp, Artificial Sequence
  Description of Artificial Sequence: Synthetic oligonucleotide
accttccagaggatgtttggctgcgacc

SEQ ID NO: 45085 - DNA, 27 bp, Artificial Sequence
  Description of Artificial Sequence: Synthetic oligonucleotide
ccttccagaggatgtttggctgcgacc

SEQ ID NO: 45086 - DNA, 28 bp, Artificial Sequence
  Description of Artificial Sequence: Synthetic oligonucleotide
cttccagaggatgtttggctgcgacctg

SEQ ID NO: 45087 - DNA, 28 bp, Artificial Sequence
  Description of Artificial Sequence: Synthetic oligonucleotide
ttccagaggatgtttggctgcgacctgg

SEQ ID NO: 45088 - DNA, 26 bp, Artificial Sequence
  Description of Artificial Sequence: Synthetic oligonucleotide
accatcccgtctctgaccatgaggcc

SEQ ID NO: 45089 - DNA, 25 bp, Artificial Sequence
  Description of Artificial Sequence: Synthetic oligonucleotide
ccatcccgtctctgaccatgaggcc

SEQ ID NO: 45090 - DNA, 25 bp, Artificial Sequence
  Description of Artificial Sequence: Synthetic oligonucleotide
catcccgtctctgaccatgaggccg

SEQ ID NO: 45091 - DNA, 25 bp, Artificial Sequence
  Description of Artificial Sequence: Synthetic oligonucleotide
atcccgtctctgaccatgaggccgc

SEQ ID NO: 45092 - DNA, 24 bp, Artificial Sequence
  Description of Artificial Sequence: Synthetic oligonucleotide
tcccgtctctgaccatgaggccgc

SEQ ID NO: 45093 - DNA, 23 bp, Artificial Sequence
  Description of Artificial Sequence: Synthetic oligonucleotide
cccgtctctgaccatgaggccgc

SEQ ID NO: 45094 - DNA, 23 bp, Artificial Sequence
  Description of Artificial Sequence: Synthetic oligonucleotide
ccgtctctgaccatgaggccgcc

SEQ ID NO: 45095 - DNA, 24 bp, Artificial Sequence
  Description of Artificial Sequence: Synthetic oligonucleotide
cgtctctgaccatgaggccgccct

SEQ ID NO: 45096 - DNA, 25 bp, Artificial Sequence
  Description of Artificial Sequence: Synthetic oligonucleotide
gtctctgaccatgaggccgccctga

SEQ ID NO: 45097 - DNA, 25 bp, Artificial Sequence
  Description of Artificial Sequence: Synthetic oligonucleotide
tctctgaccatgaggccgccctgag

SEQ ID NO: 45098 - DNA, 24 bp, Artificial Sequence
  Description of Artificial Sequence: Synthetic oligonucleotide
ctctgaccatgaggccgccctgag

SEQ ID NO: 45099 - DNA, 25 bp, Artificial Sequence
  Description of Artificial Sequence: Synthetic oligonucleotide
tctgaccatgaggccgccctgaggt

SEQ ID NO: 45100 - DNA, 24 bp, Artificial Sequence
  Description of Artificial Sequence: Synthetic oligonucleotide
ctgaccatgaggccgccctgaggt

SEQ ID NO: 45101 - DNA, 24 bp, Artificial Sequence
  Description of Artificial Sequence: Synthetic oligonucleotide
tgaccatgaggccgccctgaggtg

SEQ ID NO: 45102 - DNA, 23 bp, Artificial Sequence
  Description of Artificial Sequence: Synthetic oligonucleotide
gaccatgaggccgccctgaggtg

SEQ ID NO: 45103 - DNA, 24 bp, Artificial Sequence
  Description of Artificial Sequence: Synthetic oligonucleotide
accatgaggccgccctgaggtgct

SEQ ID NO: 45104 - DNA, 23 bp, Artificial Sequence
  Description of Artificial Sequence: Synthetic oligonucleotide
ccatgaggccgccctgaggtgct

SEQ ID NO: 45105 - DNA, 23 bp, Artificial Sequence
  Description of Artificial Sequence: Synthetic oligonucleotide
catgaggccgccctgaggtgctg

SEQ ID NO: 45106 - DNA, 23 bp, Artificial Sequence
  Description of Artificial Sequence: Synthetic oligonucleotide
atgaggccgccctgaggtgctgg

SEQ ID NO: 45107 - DNA, 22 bp, Artificial Sequence
  Description of Artificial Sequence: Synthetic oligonucleotide
tgaggccgccctgaggtgctgg

SEQ ID NO: 45108 - DNA, 21 bp, Artificial Sequence
  Description of Artificial Sequence: Synthetic oligonucleotide
gaggccgccctgaggtgctgg

SEQ ID NO: 45109 - DNA, 21 bp, Artificial Sequence
  Description of Artificial Sequence: Synthetic oligonucleotide
aggccgccctgaggtgctggg

SEQ ID NO: 45110 - DNA, 20 bp, Artificial Sequence
  Description of Artificial Sequence: Synthetic oligonucleotide
ggccgccctgaggtgctggg

SEQ ID NO: 45111 - DNA, 20 bp, Artificial Sequence
  Description of Artificial Sequence: Synthetic oligonucleotide
gccgccctgaggtgctgggc

SEQ ID NO: 45112 - DNA, 20 bp, Artificial Sequence
  Description of Artificial Sequence: Synthetic oligonucleotide
ccgccctgaggtgctgggcc

SEQ ID NO: 45113 - DNA, 21 bp, Artificial Sequence
  Description of Artificial Sequence: Synthetic oligonucleotide
cgccctgaggtgctgggccct

SEQ ID NO: 45114 - DNA, 21 bp, Artificial Sequence
  Description of Artificial Sequence: Synthetic oligonucleotide
gccctgaggtgctgggccctg

SEQ ID NO: 45115 - DNA, 21 bp, Artificial Sequence
  Description of Artificial Sequence: Synthetic oligonucleotide
tggcccgtgaggcggagcagc

SEQ ID NO: 45116 - DNA, 23 bp, Artificial Sequence
  Description of Artificial Sequence: Synthetic oligonucleotide
ggagccgtgggtggagcaggagt

SEQ ID NO: 45117 - DNA, 23 bp, Artificial Sequence
  Description of Artificial Sequence: Synthetic oligonucleotide
gagccgtgggtggagcaggagtg

SEQ ID NO: 45118 - DNA, 23 bp, Artificial Sequence
  Description of Artificial Sequence: Synthetic oligonucleotide
agccgtgggtggagcaggagtgg

SEQ ID NO: 45119 - DNA, 22 bp, Artificial Sequence
  Description of Artificial Sequence: Synthetic oligonucleotide
gccgtgggtggagcaggagtgg

SEQ ID NO: 45120 - DNA, 22 bp, Artificial Sequence
  Description of Artificial Sequence: Synthetic oligonucleotide
ccgtgggtggagcaggagtggc

SEQ ID NO: 45121 - DNA, 22 bp, Artificial Sequence
  Description of Artificial Sequence: Synthetic oligonucleotide
cgtgggtggagcaggagtggcc

SEQ ID NO: 45122 - DNA, 22 bp, Artificial Sequence
  Description of Artificial Sequence: Synthetic oligonucleotide
gtgggtggagcaggagtggccg

SEQ ID NO: 45123 - DNA, 23 bp, Artificial Sequence
  Description of Artificial Sequence: Synthetic oligonucleotide
tgggtggagcaggagtggccgga

SEQ ID NO: 45124 - DNA, 22 bp, Artificial Sequence
  Description of Artificial Sequence: Synthetic oligonucleotide
gggtggagcaggagtggccgga

SEQ ID NO: 45125 - DNA, 26 bp, Artificial Sequence
  Description of Artificial Sequence: Synthetic oligonucleotide
ggtggagcaggagtggccggagtatt

SEQ ID NO: 45126 - DNA, 26 bp, Artificial Sequence
  Description of Artificial Sequence: Synthetic oligonucleotide
gtggagcaggagtggccggagtattg

SEQ ID NO: 45127 - DNA, 26 bp, Artificial Sequence
  Description of Artificial Sequence: Synthetic oligonucleotide
tggagcaggagtggccggagtattgg

SEQ ID NO: 45128 - DNA, 25 bp, Artificial Sequence
  Description of Artificial Sequence: Synthetic oligonucleotide
ggagcaggagtggccggagtattgg

SEQ ID NO: 45129 - DNA, 26 bp, Artificial Sequence
  Description of Artificial Sequence: Synthetic oligonucleotide
gagcaggagtggccggagtattggga

SEQ ID NO: 45130 - DNA, 26 bp, Artificial Sequence
  Description of Artificial Sequence: Synthetic oligonucleotide
agcaggagtggccggagtattgggac

SEQ ID NO: 45131 - DNA, 25 bp, Artificial Sequence
  Description of Artificial Sequence: Synthetic oligonucleotide
gcaggagtggccggagtattgggac

SEQ ID NO: 45132 - DNA, 25 bp, Artificial Sequence
  Description of Artificial Sequence: Synthetic oligonucleotide
caggagtggccggagtattgggacc

SEQ ID NO: 45133 - DNA, 25 bp, Artificial Sequence
  Description of Artificial Sequence: Synthetic oligonucleotide
aggagtggccggagtattgggaccg

SEQ ID NO: 45134 - DNA, 24 bp, Artificial Sequence
  Description of Artificial Sequence: Synthetic oligonucleotide
ggagtggccggagtattgggaccg

SEQ ID NO: 45135 - DNA, 24 bp, Artificial Sequence
  Description of Artificial Sequence: Synthetic oligonucleotide
gagtggccggagtattgggaccgg

SEQ ID NO: 45136 - DNA, 25 bp, Artificial Sequence
  Description of Artificial Sequence: Synthetic oligonucleotide
agtggccggagtattgggaccggga

SEQ ID NO: 45137 - DNA, 24 bp, Artificial Sequence
  Description of Artificial Sequence: Synthetic oligonucleotide
gtggccggagtattgggaccggga

SEQ ID NO: 45138 - DNA, 25 bp, Artificial Sequence
  Description of Artificial Sequence: Synthetic oligonucleotide
tggccggagtattgggaccgggaga

SEQ ID NO: 45139 - DNA, 29 bp, Artificial Sequence
  Description of Artificial Sequence: Synthetic oligonucleotide
ggagacacagaagtacaagcgccaggtac

SEQ ID NO: 45140 - DNA, 30 bp, Artificial Sequence
  Description of Artificial Sequence: Synthetic oligonucleotide
gagacacagaagtacaagcgccaggtacag

SEQ ID NO: 45141 - DNA, 30 bp, Artificial Sequence
  Description of Artificial Sequence: Synthetic oligonucleotide
agacacagaagtacaagcgccaggtacagg

SEQ ID NO: 45142 - DNA, 29 bp, Artificial Sequence
  Description of Artificial Sequence: Synthetic oligonucleotide
gacacagaagtacaagcgccaggtacagg

SEQ ID NO: 45143 - DNA, 29 bp, Artificial Sequence
  Description of Artificial Sequence: Synthetic oligonucleotide
acacagaagtacaagcgccaggtacaggc

SEQ ID NO: 45144 - DNA, 28 bp, Artificial Sequence
  Description of Artificial Sequence: Synthetic oligonucleotide
cacagaagtacaagcgccaggtacaggc

SEQ ID NO: 45145 - DNA, 29 bp, Artificial Sequence
  Description of Artificial Sequence: Synthetic oligonucleotide
acagaagtacaagcgccaggtacaggctg

SEQ ID NO: 45146 - DNA, 28 bp, Artificial Sequence
  Description of Artificial Sequence: Synthetic oligonucleotide
cagaagtacaagcgccaggtacaggctg

SEQ ID NO: 45147 - DNA, 29 bp, Artificial Sequence
  Description of Artificial Sequence: Synthetic oligonucleotide
agaagtacaagcgccaggtacaggctgac

SEQ ID NO: 45148 - DNA, 28 bp, Artificial Sequence
  Description of Artificial Sequence: Synthetic oligonucleotide
gaagtacaagcgccaggtacaggctgac

SEQ ID NO: 45149 - DNA, 28 bp, Artificial Sequence
  Description of Artificial Sequence: Synthetic oligonucleotide
aagtacaagcgccaggtacaggctgacc

SEQ ID NO: 45150 - DNA, 27 bp, Artificial Sequence
  Description of Artificial Sequence: Synthetic oligonucleotide
agtacaagcgccaggtacaggctgacc

SEQ ID NO: 45151 - DNA, 26 bp, Artificial Sequence
  Description of Artificial Sequence: Synthetic oligonucleotide
gtacaagcgccaggtacaggctgacc

SEQ ID NO: 45152 - DNA, 27 bp, Artificial Sequence
  Description of Artificial Sequence: Synthetic oligonucleotide
tacaagcgccaggtacaggctgaccga

SEQ ID NO: 45153 - DNA, 26 bp, Artificial Sequence
  Description of Artificial Sequence: Synthetic oligonucleotide
acaagcgccaggtacaggctgaccga

SEQ ID NO: 45154 - DNA, 25 bp, Artificial Sequence
  Description of Artificial Sequence: Synthetic oligonucleotide
caagcgccaggtacaggctgaccga

SEQ ID NO: 45155 - DNA, 26 bp, Artificial Sequence
  Description of Artificial Sequence: Synthetic oligonucleotide
aagcgccaggtacaggctgaccgagt

SEQ ID NO: 45156 - DNA, 25 bp, Artificial Sequence
  Description of Artificial Sequence: Synthetic oligonucleotide
agcgccaggtacaggctgaccgagt

SEQ ID NO: 45157 - DNA, 24 bp, Artificial Sequence
  Description of Artificial Sequence: Synthetic oligonucleotide
gcgccaggtacaggctgaccgagt

SEQ ID NO: 45158 - DNA, 26 bp, Artificial Sequence
  Description of Artificial Sequence: Synthetic oligonucleotide
cgccaggtacaggctgaccgagtgaa

SEQ ID NO: 45159 - DNA, 26 bp, Artificial Sequence
  Description of Artificial Sequence: Synthetic oligonucleotide
gccaggtacaggctgaccgagtgaac

SEQ ID NO: 45160 - DNA, 27 bp, Artificial Sequence
  Description of Artificial Sequence: Synthetic oligonucleotide
ccaggtacaggctgaccgagtgaacct

SEQ ID NO: 45161 - DNA, 27 bp, Artificial Sequence
  Description of Artificial Sequence: Synthetic oligonucleotide
caggtacaggctgaccgagtgaacctg

SEQ ID NO: 45162 - DNA, 27 bp, Artificial Sequence
  Description of Artificial Sequence: Synthetic oligonucleotide
aggtacaggctgaccgagtgaacctgc

SEQ ID NO: 45163 - DNA, 26 bp, Artificial Sequence
  Description of Artificial Sequence: Synthetic oligonucleotide
ggtacaggctgaccgagtgaacctgc

SEQ ID NO: 45164 - DNA, 26 bp, Artificial Sequence
  Description of Artificial Sequence: Synthetic oligonucleotide
gtacaggctgaccgagtgaacctgcg

SEQ ID NO: 45165 - DNA, 27 bp, Artificial Sequence
  Description of Artificial Sequence: Synthetic oligonucleotide
tacaggctgaccgagtgaacctgcgga

SEQ ID NO: 45166 - DNA, 27 bp, Artificial Sequence
  Description of Artificial Sequence: Synthetic oligonucleotide
accgagtgaacctgcggaaactgcgca

SEQ ID NO: 45167 - DNA, 26 bp, Artificial Sequence
  Description of Artificial Sequence: Synthetic oligonucleotide
ccgagtgaacctgcggaaactgcgca

SEQ ID NO: 45168 - DNA, 26 bp, Artificial Sequence
  Description of Artificial Sequence: Synthetic oligonucleotide
cgagtgaacctgcggaaactgcgcag

SEQ ID NO: 45169 - DNA, 27 bp, Artificial Sequence
  Description of Artificial Sequence: Synthetic oligonucleotide
gagtgaacctgcggaaactgcgcagct

SEQ ID NO: 45170 - DNA, 28 bp, Artificial Sequence
  Description of Artificial Sequence: Synthetic oligonucleotide
agtgaacctgcggaaactgcgcagctac

SEQ ID NO: 45171 - DNA, 27 bp, Artificial Sequence
  Description of Artificial Sequence: Synthetic oligonucleotide
gtgaacctgcggaaactgcgcagctac

SEQ ID NO: 45172 - DNA, 29 bp, Artificial Sequence
  Description of Artificial Sequence: Synthetic oligonucleotide
tgaacctgcggaaactgcgcagctactac

SEQ ID NO: 45173 - DNA, 28 bp, Artificial Sequence
  Description of Artificial Sequence: Synthetic oligonucleotide
gaacctgcggaaactgcgcagctactac

SEQ ID NO: 45174 - DNA, 30 bp, Artificial Sequence
  Description of Artificial Sequence: Synthetic oligonucleotide
aacctgcggaaactgcgcagctactacaac

SEQ ID NO: 45175 - DNA, 29 bp, Artificial Sequence
  Description of Artificial Sequence: Synthetic oligonucleotide
acctgcggaaactgcgcagctactacaac

SEQ ID NO: 45176 - DNA, 28 bp, Artificial Sequence
  Description of Artificial Sequence: Synthetic oligonucleotide
cctgcggaaactgcgcagctactacaac

SEQ ID NO: 45177 - DNA, 28 bp, Artificial Sequence
  Description of Artificial Sequence: Synthetic oligonucleotide
ctgcggaaactgcgcagctactacaacc

SEQ ID NO: 45178 - DNA, 29 bp, Artificial Sequence
  Description of Artificial Sequence: Synthetic oligonucleotide
tgcggaaactgcgcagctactacaaccag

SEQ ID NO: 45179 - DNA, 28 bp, Artificial Sequence
  Description of Artificial Sequence: Synthetic oligonucleotide
gcggaaactgcgcagctactacaaccag

SEQ ID NO: 45180 - DNA, 29 bp, Artificial Sequence
  Description of Artificial Sequence: Synthetic oligonucleotide
cggaaactgcgcagctactacaaccagag

SEQ ID NO: 45181 - DNA, 29 bp, Artificial Sequence
  Description of Artificial Sequence: Synthetic oligonucleotide
ggaaactgcgcagctactacaaccagagc

SEQ ID NO: 45182 - DNA, 29 bp, Artificial Sequence
  Description of Artificial Sequence: Synthetic oligonucleotide
gaaactgcgcagctactacaaccagagcg

SEQ ID NO: 45183 - DNA, 30 bp, Artificial Sequence
  Description of Artificial Sequence: Synthetic oligonucleotide
aaactgcgcagctactacaaccagagcgag

SEQ ID NO: 45184 - DNA, 29 bp, Artificial Sequence
  Description of Artificial Sequence: Synthetic oligonucleotide
aactgcgcagctactacaaccagagcgag

SEQ ID NO: 45185 - DNA, 28 bp, Artificial Sequence
  Description of Artificial Sequence: Synthetic oligonucleotide
actgcgcagctactacaaccagagcgag

SEQ ID NO: 45186 - DNA, 27 bp, Artificial Sequence
  Description of Artificial Sequence: Synthetic oligonucleotide
gcgcagctactacaaccagagcgagga

SEQ ID NO: 45187 - DNA, 27 bp, Artificial Sequence
  Description of Artificial Sequence: Synthetic oligonucleotide
cgcagctactacaaccagagcgaggac

SEQ ID NO: 45188 - DNA, 27 bp, Artificial Sequence
  Description of Artificial Sequence: Synthetic oligonucleotide
gcagctactacaaccagagcgaggacg

SEQ ID NO: 45189 - DNA, 27 bp, Artificial Sequence
  Description of Artificial Sequence: Synthetic oligonucleotide
cagctactacaaccagagcgaggacgg

SEQ ID NO: 45190 - DNA, 27 bp, Artificial Sequence
  Description of Artificial Sequence: Synthetic oligonucleotide
agctactacaaccagagcgaggacggg

SEQ ID NO: 45191 - DNA, 22 bp, Artificial Sequence
  Description of Artificial Sequence: Synthetic oligonucleotide
cgtgaggcggagcagcggagac

SEQ ID NO: 45192 - DNA, 22 bp, Artificial Sequence
  Description of Artificial Sequence: Synthetic oligonucleotide
gtgaggcggagcagcggagacc

SEQ ID NO: 45193 - DNA, 24 bp, Artificial Sequence
  Description of Artificial Sequence: Synthetic oligonucleotide
tgaggcggagcagcggagacccta

SEQ ID NO: 45194 - DNA, 23 bp, Artificial Sequence
  Description of Artificial Sequence: Synthetic oligonucleotide
gaggcggagcagcggagacccta

SEQ ID NO: 45195 - DNA, 23 bp, Artificial Sequence
  Description of Artificial Sequence: Synthetic oligonucleotide
aggcggagcagcggagaccctac

SEQ ID NO: 45196 - DNA, 22 bp, Artificial Sequence
  Description of Artificial Sequence: Synthetic oligonucleotide
ggcggagcagcggagaccctac

SEQ ID NO: 45197 - DNA, 23 bp, Artificial Sequence
  Description of Artificial Sequence: Synthetic oligonucleotide
gcggagcagcggagaccctacct

SEQ ID NO: 45198 - DNA, 23 bp, Artificial Sequence
  Description of Artificial Sequence: Synthetic oligonucleotide
cggagcagcggagaccctacctg

SEQ ID NO: 45199 - DNA, 24 bp, Artificial Sequence
  Description of Artificial Sequence: Synthetic oligonucleotide
ggagcagcggagaccctacctgga

SEQ ID NO: 45200 - DNA, 24 bp, Artificial Sequence
  Description of Artificial Sequence: Synthetic oligonucleotide
gagcagcggagaccctacctggag

SEQ ID NO: 45201 - DNA, 24 bp, Artificial Sequence
  Description of Artificial Sequence: Synthetic oligonucleotide
agcagcggagaccctacctggagg

SEQ ID NO: 45202 - DNA, 23 bp, Artificial Sequence
  Description of Artificial Sequence: Synthetic oligonucleotide
gcagcggagaccctacctggagg

SEQ ID NO: 45203 - DNA, 23 bp, Artificial Sequence
  Description of Artificial Sequence: Synthetic oligonucleotide
cagcggagaccctacctggaggg

SEQ ID NO: 45204 - DNA, 24 bp, Artificial Sequence
  Description of Artificial Sequence: Synthetic oligonucleotide
agcggagaccctacctggagggca

SEQ ID NO: 45205 - DNA, 23 bp, Artificial Sequence
  Description of Artificial Sequence: Synthetic oligonucleotide
gcggagaccctacctggagggca

SEQ ID NO: 45206 - DNA, 23 bp, Artificial Sequence
  Description of Artificial Sequence: Synthetic oligonucleotide
cggagaccctacctggagggcac

SEQ ID NO: 45207 - DNA, 24 bp, Artificial Sequence
  Description of Artificial Sequence: Synthetic oligonucleotide
ggagaccctacctggagggcacgt

SEQ ID NO: 45208 - DNA, 29 bp, Artificial Sequence
  Description of Artificial Sequence: Synthetic oligonucleotide
cggagtattgggactgggagacacagaag

SEQ ID NO: 45209 - DNA, 31 bp, Artificial Sequence
  Description of Artificial Sequence: Synthetic oligonucleotide
ggagtattgggactgggagacacagaagtac

SEQ ID NO: 45210 - DNA, 33 bp, Artificial Sequence
  Description of Artificial Sequence: Synthetic oligonucleotide
gagtattgggactgggagacacagaagtacaag

SEQ ID NO: 45211 - DNA, 33 bp, Artificial Sequence
  Description of Artificial Sequence: Synthetic oligonucleotide
agtattgggactgggagacacagaagtacaagc

SEQ ID NO: 45212 - DNA, 32 bp, Artificial Sequence
  Description of Artificial Sequence: Synthetic oligonucleotide
gtattgggactgggagacacagaagtacaagc

SEQ ID NO: 45213 - DNA, 32 bp, Artificial Sequence
  Description of Artificial Sequence: Synthetic oligonucleotide
tattgggactgggagacacagaagtacaagcg

SEQ ID NO: 45214 - DNA, 31 bp, Artificial Sequence
  Description of Artificial Sequence: Synthetic oligonucleotide
attgggactgggagacacagaagtacaagcg

SEQ ID NO: 45215 - DNA, 30 bp, Artificial Sequence
  Description of Artificial Sequence: Synthetic oligonucleotide
ttgggactgggagacacagaagtacaagcg

SEQ ID NO: 45216 - DNA, 29 bp, Artificial Sequence
  Description of Artificial Sequence: Synthetic oligonucleotide
tgggactgggagacacagaagtacaagcg

SEQ ID NO: 45217 - DNA, 28 bp, Artificial Sequence
  Description of Artificial Sequence: Synthetic oligonucleotide
gggactgggagacacagaagtacaagcg

SEQ ID NO: 45218 - DNA, 28 bp, Artificial Sequence
  Description of Artificial Sequence: Synthetic oligonucleotide
ggactgggagacacagaagtacaagcgc

SEQ ID NO: 45219 - DNA, 28 bp, Artificial Sequence
  Description of Artificial Sequence: Synthetic oligonucleotide
gactgggagacacagaagtacaagcgcc

SEQ ID NO: 45220 - DNA, 29 bp, Artificial Sequence
  Description of Artificial Sequence: Synthetic oligonucleotide
actgggagacacagaagtacaagcgccag

SEQ ID NO: 45221 - DNA, 28 bp, Artificial Sequence
  Description of Artificial Sequence: Synthetic oligonucleotide
ctgggagacacagaagtacaagcgccag

SEQ ID NO: 45222 - DNA, 28 bp, Artificial Sequence
  Description of Artificial Sequence: Synthetic oligonucleotide
tgggagacacagaagtacaagcgccagg

SEQ ID NO: 45223 - DNA, 30 bp, Artificial Sequence
  Description of Artificial Sequence: Synthetic oligonucleotide
gcaaggattacatcgccctgaaccaggatc

SEQ ID NO: 45224 - DNA, 31 bp, Artificial Sequence
  Description of Artificial Sequence: Synthetic oligonucleotide
caaggattacatcgccctgaaccaggatctg

SEQ ID NO: 45225 - DNA, 31 bp, Artificial Sequence
  Description of Artificial Sequence: Synthetic oligonucleotide
aaggattacatcgccctgaaccaggatctgc

SEQ ID NO: 45226 - DNA, 30 bp, Artificial Sequence
  Description of Artificial Sequence: Synthetic oligonucleotide
aggattacatcgccctgaaccaggatctgc

SEQ ID NO: 45227 - DNA, 29 bp, Artificial Sequence
  Description of Artificial Sequence: Synthetic oligonucleotide
ggattacatcgccctgaaccaggatctgc

SEQ ID NO: 45228 - DNA, 29 bp, Artificial Sequence
  Description of Artificial Sequence: Synthetic oligonucleotide
gattacatcgccctgaaccaggatctgcg

SEQ ID NO: 45229 - DNA, 29 bp, Artificial Sequence
  Description of Artificial Sequence: Synthetic oligonucleotide
attacatcgccctgaaccaggatctgcgc

SEQ ID NO: 45230 - DNA, 28 bp, Artificial Sequence
  Description of Artificial Sequence: Synthetic oligonucleotide
ttacatcgccctgaaccaggatctgcgc

SEQ ID NO: 45231 - DNA, 27 bp, Artificial Sequence
  Description of Artificial Sequence: Synthetic oligonucleotide
tacatcgccctgaaccaggatctgcgc

SEQ ID NO: 45232 - DNA, 27 bp, Artificial Sequence
  Description of Artificial Sequence: Synthetic oligonucleotide
acatcgccctgaaccaggatctgcgct

SEQ ID NO: 45233 - DNA, 26 bp, Artificial Sequence
  Description of Artificial Sequence: Synthetic oligonucleotide
catcgccctgaaccaggatctgcgct

SEQ ID NO: 45234 - DNA, 26 bp, Artificial Sequence
  Description of Artificial Sequence: Synthetic oligonucleotide
atcgccctgaaccaggatctgcgctc

SEQ ID NO: 45235 - DNA, 25 bp, Artificial Sequence
  Description of Artificial Sequence: Synthetic oligonucleotide
tcgccctgaaccaggatctgcgctc

SEQ ID NO: 45236 - DNA, 24 bp, Artificial Sequence
  Description of Artificial Sequence: Synthetic oligonucleotide
cgccctgaaccaggatctgcgctc

SEQ ID NO: 45237 - DNA, 25 bp, Artificial Sequence
  Description of Artificial Sequence: Synthetic oligonucleotide
gccctgaaccaggatctgcgctcct

SEQ ID NO: 45238 - DNA, 25 bp, Artificial Sequence
  Description of Artificial Sequence: Synthetic oligonucleotide
ccctgaaccaggatctgcgctcctg

SEQ ID NO: 45239 - DNA, 26 bp, Artificial Sequence
  Description of Artificial Sequence: Synthetic oligonucleotide
cctgaaccaggatctgcgctcctgga

SEQ ID NO: 45240 - DNA, 26 bp, Artificial Sequence
  Description of Artificial Sequence: Synthetic oligonucleotide
ctgaaccaggatctgcgctcctggac

SEQ ID NO: 45241 - DNA, 26 bp, Artificial Sequence
  Description of Artificial Sequence: Synthetic oligonucleotide
tgaaccaggatctgcgctcctggacc

SEQ ID NO: 45242 - DNA, 25 bp, Artificial Sequence
  Description of Artificial Sequence: Synthetic oligonucleotide
gaaccaggatctgcgctcctggacc

SEQ ID NO: 45243 - DNA, 25 bp, Artificial Sequence
  Description of Artificial Sequence: Synthetic oligonucleotide
aaccaggatctgcgctcctggaccg

SEQ ID NO: 45244 - DNA, 24 bp, Artificial Sequence
  Description of Artificial Sequence: Synthetic oligonucleotide
accaggatctgcgctcctggaccg

SEQ ID NO: 45245 - DNA, 23 bp, Artificial Sequence
  Description of Artificial Sequence: Synthetic oligonucleotide
ccaggatctgcgctcctggaccg

SEQ ID NO: 45246 - DNA, 23 bp, Artificial Sequence
  Description of Artificial Sequence: Synthetic oligonucleotide
caggatctgcgctcctggaccgc

SEQ ID NO: 45247 - DNA, 31 bp, Artificial Sequence
  Description of Artificial Sequence: Synthetic oligonucleotide
gctcccagtccatgaggtatttctccacatc

SEQ ID NO: 45248 - DNA, 31 bp, Artificial Sequence
  Description of Artificial Sequence: Synthetic oligonucleotide
ctcccagtccatgaggtatttctccacatcc

SEQ ID NO: 45249 - DNA, 31 bp, Artificial Sequence
  Description of Artificial Sequence: Synthetic oligonucleotide
tcccagtccatgaggtatttctccacatccg

SEQ ID NO: 45250 - DNA, 30 bp, Artificial Sequence
  Description of Artificial Sequence: Synthetic oligonucleotide
cccagtccatgaggtatttctccacatccg

SEQ ID NO: 45251 - DNA, 31 bp, Artificial Sequence
  Description of Artificial Sequence: Synthetic oligonucleotide
ccagtccatgaggtatttctccacatccgtg

SEQ ID NO: 45252 - DNA, 32 bp, Artificial Sequence
  Description of Artificial Sequence: Synthetic oligonucleotide
cagtccatgaggtatttctccacatccgtgtc

SEQ ID NO: 45253 - DNA, 32 bp, Artificial Sequence
  Description of Artificial Sequence: Synthetic oligonucleotide
agtccatgaggtatttctccacatccgtgtcc

SEQ ID NO: 45254 - DNA, 31 bp, Artificial Sequence
  Description of Artificial Sequence: Synthetic oligonucleotide
gtccatgaggtatttctccacatccgtgtcc

SEQ ID NO: 45255 - DNA, 27 bp, Artificial Sequence
  Description of Artificial Sequence: Synthetic oligonucleotide
gcggctactacaaccagagcgaggaca

SEQ ID NO: 45256 - DNA, 27 bp, Artificial Sequence
  Description of Artificial Sequence: Synthetic oligonucleotide
cggctactacaaccagagcgaggacag

SEQ ID NO: 45257 - DNA, 27 bp, Artificial Sequence
  Description of Artificial Sequence: Synthetic oligonucleotide
ggctactacaaccagagcgaggacagg

SEQ ID NO: 45258 - DNA, 28 bp, Artificial Sequence
  Description of Artificial Sequence: Synthetic oligonucleotide
gctactacaaccagagcgaggacaggtc

SEQ ID NO: 45259 - DNA, 29 bp, Artificial Sequence
  Description of Artificial Sequence: Synthetic oligonucleotide
ctactacaaccagagcgaggacaggtctc

SEQ ID NO: 45260 - DNA, 30 bp, Artificial Sequence
  Description of Artificial Sequence: Synthetic oligonucleotide
tactacaaccagagcgaggacaggtctcac

SEQ ID NO: 45261 - DNA, 29 bp, Artificial Sequence
  Description of Artificial Sequence: Synthetic oligonucleotide
actacaaccagagcgaggacaggtctcac

SEQ ID NO: 45262 - DNA, 28 bp, Artificial Sequence
  Description of Artificial Sequence: Synthetic oligonucleotide
ctacaaccagagcgaggacaggtctcac

SEQ ID NO: 45263 - DNA, 29 bp, Artificial Sequence
  Description of Artificial Sequence: Synthetic oligonucleotide
tacaaccagagcgaggacaggtctcacac

SEQ ID NO: 45264 - DNA, 28 bp, Artificial Sequence
  Description of Artificial Sequence: Synthetic oligonucleotide
acaaccagagcgaggacaggtctcacac

SEQ ID NO: 45265 - DNA, 27 bp, Artificial Sequence
  Description of Artificial Sequence: Synthetic oligonucleotide
caaccagagcgaggacaggtctcacac

SEQ ID NO: 45266 - DNA, 27 bp, Artificial Sequence
  Description of Artificial Sequence: Synthetic oligonucleotide
aaccagagcgaggacaggtctcacacc

SEQ ID NO: 45267 - DNA, 26 bp, Artificial Sequence
  Description of Artificial Sequence: Synthetic oligonucleotide
accagagcgaggacaggtctcacacc

SEQ ID NO: 45268 - DNA, 25 bp, Artificial Sequence
  Description of Artificial Sequence: Synthetic oligonucleotide
ccagagcgaggacaggtctcacacc

SEQ ID NO: 45269 - DNA, 26 bp, Artificial Sequence
  Description of Artificial Sequence: Synthetic oligonucleotide
cagagcgaggacaggtctcacaccct

SEQ ID NO: 45270 - DNA, 26 bp, Artificial Sequence
  Description of Artificial Sequence: Synthetic oligonucleotide
agagcgaggacaggtctcacaccctc

SEQ ID NO: 45271 - DNA, 25 bp, Artificial Sequence
  Description of Artificial Sequence: Synthetic oligonucleotide
gagcgaggacaggtctcacaccctc

SEQ ID NO: 45272 - DNA, 26 bp, Artificial Sequence
  Description of Artificial Sequence: Synthetic oligonucleotide
agcgaggacaggtctcacaccctcca

SEQ ID NO: 45273 - DNA, 25 bp, Artificial Sequence
  Description of Artificial Sequence: Synthetic oligonucleotide
gcgaggacaggtctcacaccctcca

SEQ ID NO: 45274 - DNA, 26 bp, Artificial Sequence
  Description of Artificial Sequence: Synthetic oligonucleotide
cgaggacaggtctcacaccctccaga

SEQ ID NO: 45275 - DNA, 26 bp, Artificial Sequence
  Description of Artificial Sequence: Synthetic oligonucleotide
gaggacaggtctcacaccctccagag

SEQ ID NO: 45276 - DNA, 27 bp, Artificial Sequence
  Description of Artificial Sequence: Synthetic oligonucleotide
aggacaggtctcacaccctccagagga

SEQ ID NO: 45277 - DNA, 27 bp, Artificial Sequence
  Description of Artificial Sequence: Synthetic oligonucleotide
ggacaggtctcacaccctccagaggat

SEQ ID NO: 45278 - DNA, 27 bp, Artificial Sequence
  Description of Artificial Sequence: Synthetic oligonucleotide
gacaggtctcacaccctccagaggatg

SEQ ID NO: 45279 - DNA, 30 bp, Artificial Sequence
  Description of Artificial Sequence: Synthetic oligonucleotide
acaggtctcacaccctccagaggatgtttg

SEQ ID NO: 45280 - DNA, 29 bp, Artificial Sequence
  Description of Artificial Sequence: Synthetic oligonucleotide
caggtctcacaccctccagaggatgtttg

SEQ ID NO: 45281 - DNA, 29 bp, Artificial Sequence
  Description of Artificial Sequence: Synthetic oligonucleotide
aggtctcacaccctccagaggatgtttgg

SEQ ID NO: 45282 - DNA, 22 bp, Artificial Sequence
  Description of Artificial Sequence: Synthetic oligonucleotide
ccgcgagtccaagaggggagcg

SEQ ID NO: 45283 - DNA, 22 bp, Artificial Sequence
  Description of Artificial Sequence: Synthetic oligonucleotide
cgcgagtccaagaggggagcgg

SEQ ID NO: 45284 - DNA, 22 bp, Artificial Sequence
  Description of Artificial Sequence: Synthetic oligonucleotide
gcgagtccaagaggggagcggc

SEQ ID NO: 45285 - DNA, 22 bp, Artificial Sequence
  Description of Artificial Sequence: Synthetic oligonucleotide
cgagtccaagaggggagcggcg

SEQ ID NO: 45286 - DNA, 22 bp, Artificial Sequence
  Description of Artificial Sequence: Synthetic oligonucleotide
gagtccaagaggggagcggcgg

SEQ ID NO: 45287 - DNA, 23 bp, Artificial Sequence
  Description of Artificial Sequence: Synthetic oligonucleotide
agtccaagaggggagcggcggga

SEQ ID NO: 45288 - DNA, 22 bp, Artificial Sequence
  Description of Artificial Sequence: Synthetic oligonucleotide
gtccaagaggggagcggcggga

SEQ ID NO: 45289 - DNA, 22 bp, Artificial Sequence
  Description of Artificial Sequence: Synthetic oligonucleotide
tccaagaggggagcggcgggag

SEQ ID NO: 45290 - DNA, 21 bp, Artificial Sequence
  Description of Artificial Sequence: Synthetic oligonucleotide
ccaagaggggagcggcgggag

SEQ ID NO: 45291 - DNA, 21 bp, Artificial Sequence
  Description of Artificial Sequence: Synthetic oligonucleotide
caagaggggagcggcgggagc

SEQ ID NO: 45292 - DNA, 21 bp, Artificial Sequence
  Description of Artificial Sequence: Synthetic oligonucleotide
aagaggggagcggcgggagcc

SEQ ID NO: 45293 - DNA, 20 bp, Artificial Sequence
  Description of Artificial Sequence: Synthetic oligonucleotide
agaggggagcggcgggagcc

SEQ ID NO: 45294 - DNA, 20 bp, Artificial Sequence
  Description of Artificial Sequence: Synthetic oligonucleotide
gaggggagcggcgggagcct

SEQ ID NO: 45295 - DNA, 20 bp, Artificial Sequence
  Description of Artificial Sequence: Synthetic oligonucleotide
aggggagcggcgggagccgt

SEQ ID NO: 45296 - DNA, 20 bp, Artificial Sequence
  Description of Artificial Sequence: Synthetic oligonucleotide
ggggagcggcgggagccgtt

SEQ ID NO: 45297 - DNA, 20 bp, Artificial Sequence
  Description of Artificial Sequence: Synthetic oligonucleotide
gggagcggcgggagccgtgt

SEQ ID NO: 45298 - DNA, 20 bp, Artificial Sequence
  Description of Artificial Sequence: Synthetic oligonucleotide
ggagcggcgggagccgtggt

SEQ ID NO: 45299 - DNA, 20 bp, Artificial Sequence
  Description of Artificial Sequence: Synthetic oligonucleotide
gagcggcgggagccgtgggt

SEQ ID NO: 45300 - DNA, 20 bp, Artificial Sequence
  Description of Artificial Sequence: Synthetic oligonucleotide
agcggcgggagccgtgggtg

SEQ ID NO: 45301 - DNA, 20 bp, Artificial Sequence
  Description of Artificial Sequence: Synthetic oligonucleotide
gcggcgggagccgtgggtgt

SEQ ID NO: 45302 - DNA, 20 bp, Artificial Sequence
  Description of Artificial Sequence: Synthetic oligonucleotide
cggcgggagccgtgggtgga

SEQ ID NO: 45303 - DNA, 20 bp, Artificial Sequence
  Description of Artificial Sequence: Synthetic oligonucleotide
ggcgggagccgtgggtggag

SEQ ID NO: 45304 - DNA, 26 bp, Artificial Sequence
  Description of Artificial Sequence: Synthetic oligonucleotide
cagaggatgtttggctgcgacctggc

SEQ ID NO: 45305 - DNA, 26 bp, Artificial Sequence
  Description of Artificial Sequence: Synthetic oligonucleotide
agaggatgtttggctgcgacctggcg

SEQ ID NO: 45306 - DNA, 25 bp, Artificial Sequence
  Description of Artificial Sequence: Synthetic oligonucleotide
gaggatgtttggctgcgacctggcg

SEQ ID NO: 45307 - DNA, 25 bp, Artificial Sequence
  Description of Artificial Sequence: Synthetic oligonucleotide
aggatgtttggctgcgacctggcgc

SEQ ID NO: 45308 - DNA, 24 bp, Artificial Sequence
  Description of Artificial Sequence: Synthetic oligonucleotide
ggatgtttggctgcgacctggcgc

SEQ ID NO: 45309 - DNA, 24 bp, Artificial Sequence
  Description of Artificial Sequence: Synthetic oligonucleotide
gatgtttggctgcgacctggcgcc

SEQ ID NO: 45310 - DNA, 24 bp, Artificial Sequence
  Description of Artificial Sequence: Synthetic oligonucleotide
atgtttggctgcgacctggcgccg

SEQ ID NO: 45311 - DNA, 23 bp, Artificial Sequence
  Description of Artificial Sequence: Synthetic oligonucleotide
tgtttggctgcgacctggcgccg

SEQ ID NO: 45312 - DNA, 22 bp, Artificial Sequence
  Description of Artificial Sequence: Synthetic oligonucleotide
gtttggctgcgacctggcgccg

SEQ ID NO: 45313 - DNA, 23 bp, Artificial Sequence
  Description of Artificial Sequence: Synthetic oligonucleotide
tttggctgcgacctggcgccgga

SEQ ID NO: 45314 - DNA, 22 bp, Artificial Sequence
  Description of Artificial Sequence: Synthetic oligonucleotide
ttggctgcgacctggcgccgga

SEQ ID NO: 45315 - DNA, 21 bp, Artificial Sequence
  Description of Artificial Sequence: Synthetic oligonucleotide
tggctgcgacctggcgccgga

SEQ ID NO: 45316 - DNA, 20 bp, Artificial Sequence
  Description of Artificial Sequence: Synthetic oligonucleotide
ggctgcgacctggcgccgga

SEQ ID NO: 45317 - DNA, 20 bp, Artificial Sequence
  Description of Artificial Sequence: Synthetic oligonucleotide
gctgcgacctggcgccggac

SEQ ID NO: 45318 - DNA, 20 bp, Artificial Sequence
  Description of Artificial Sequence: Synthetic oligonucleotide
ctgcgacctggcgccggacg

SEQ ID NO: 45319 - DNA, 20 bp, Artificial Sequence
  Description of Artificial Sequence: Synthetic oligonucleotide
tgcgacctggcgccggacgg

SEQ ID NO: 45320 - DNA, 20 bp, Artificial Sequence
  Description of Artificial Sequence: Synthetic oligonucleotide
gcgacctggcgccggacggt

SEQ ID NO: 45321 - DNA, 20 bp, Artificial Sequence
  Description of Artificial Sequence: Synthetic oligonucleotide
cgacctggcgccggacgggt

SEQ ID NO: 45322 - DNA, 20 bp, Artificial Sequence
  Description of Artificial Sequence: Synthetic oligonucleotide
gacctggcgccggacgggct

SEQ ID NO: 45323 - DNA, 20 bp, Artificial Sequence
  Description of Artificial Sequence: Synthetic oligonucleotide
acctggcgccggacgggcgt

SEQ ID NO: 45324 - DNA, 20 bp, Artificial Sequence
  Description of Artificial Sequence: Synthetic oligonucleotide
cctggcgccggacgggcgtt

SEQ ID NO: 45325 - DNA, 20 bp, Artificial Sequence
  Description of Artificial Sequence: Synthetic oligonucleotide
ctggcgccggacgggcgctt

SEQ ID NO: 45326 - DNA, 20 bp, Artificial Sequence
  Description of Artificial Sequence: Synthetic oligonucleotide
tggcgccggacgggcgcctt

SEQ ID NO: 45327 - DNA, 20 bp, Artificial Sequence
  Description of Artificial Sequence: Synthetic oligonucleotide
ggcgccggacgggcgccttt

SEQ ID NO: 45328 - DNA, 20 bp, Artificial Sequence
  Description of Artificial Sequence: Synthetic oligonucleotide
gcgccggacgggcgcctctt

SEQ ID NO: 45329 - DNA, 20 bp, Artificial Sequence
  Description of Artificial Sequence: Synthetic oligonucleotide
cgccggacgggcgcctcctt

SEQ ID NO: 45330 - DNA, 25 bp, Artificial Sequence
  Description of Artificial Sequence: Synthetic oligonucleotide
ggagagcctacctggagggcacgta

SEQ ID NO: 45331 - DNA, 25 bp, Artificial Sequence
  Description of Artificial Sequence: Synthetic oligonucleotide
gagagcctacctggagggcacgtac

SEQ ID NO: 45332 - DNA, 24 bp, Artificial Sequence
  Description of Artificial Sequence: Synthetic oligonucleotide
gacgggtctcacaccctccagagg

SEQ ID NO: 45333 - DNA, 25 bp, Artificial Sequence
  Description of Artificial Sequence: Synthetic oligonucleotide
acgggtctcacaccctccagagggt

SEQ ID NO: 45334 - DNA, 24 bp, Artificial Sequence
  Description of Artificial Sequence: Synthetic oligonucleotide
cgggtctcacaccctccagagggt

SEQ ID NO: 45335 - DNA, 27 bp, Artificial Sequence
  Description of Artificial Sequence: Synthetic oligonucleotide
gggtctcacaccctccagagggtgttt

SEQ ID NO: 45336 - DNA, 27 bp, Artificial Sequence
  Description of Artificial Sequence: Synthetic oligonucleotide
ggtctcacaccctccagagggtgtttg

SEQ ID NO: 45337 - DNA, 27 bp, Artificial Sequence
  Description of Artificial Sequence: Synthetic oligonucleotide
gtctcacaccctccagagggtgtttgg

SEQ ID NO: 45338 - DNA, 27 bp, Artificial Sequence
  Description of Artificial Sequence: Synthetic oligonucleotide
tctcacaccctccagagggtgtttggc

SEQ ID NO: 45339 - DNA, 27 bp, Artificial Sequence
  Description of Artificial Sequence: Synthetic oligonucleotide
ctcacaccctccagagggtgtttggct

SEQ ID NO: 45340 - DNA, 27 bp, Artificial Sequence
  Description of Artificial Sequence: Synthetic oligonucleotide
tcacaccctccagagggtgtttggctg

SEQ ID NO: 45341 - DNA, 26 bp, Artificial Sequence
  Description of Artificial Sequence: Synthetic oligonucleotide
cacaccctccagagggtgtttggctg

SEQ ID NO: 45342 - DNA, 26 bp, Artificial Sequence
  Description of Artificial Sequence: Synthetic oligonucleotide
acaccctccagagggtgtttggctgc

SEQ ID NO: 45343 - DNA, 25 bp, Artificial Sequence
  Description of Artificial Sequence: Synthetic oligonucleotide
caccctccagagggtgtttggctgc

SEQ ID NO: 45344 - DNA, 26 bp, Artificial Sequence
  Description of Artificial Sequence: Synthetic oligonucleotide
accctccagagggtgtttggctgcga

SEQ ID NO: 45345 - DNA, 25 bp, Artificial Sequence
  Description of Artificial Sequence: Synthetic oligonucleotide
ccctccagagggtgtttggctgcga

SEQ ID NO: 45346 - DNA, 25 bp, Artificial Sequence
  Description of Artificial Sequence: Synthetic oligonucleotide
cctccagagggtgtttggctgcgac

SEQ ID NO: 45347 - DNA, 26 bp, Artificial Sequence
  Description of Artificial Sequence: Synthetic oligonucleotide
ctccagagggtgtttggctgcgacct

SEQ ID NO: 45348 - DNA, 26 bp, Artificial Sequence
  Description of Artificial Sequence: Synthetic oligonucleotide
tccagagggtgtttggctgcgacctg

SEQ ID NO: 45349 - DNA, 25 bp, Artificial Sequence
  Description of Artificial Sequence: Synthetic oligonucleotide
ccagagggtgtttggctgcgacctg

SEQ ID NO: 45350 - DNA, 25 bp, Artificial Sequence
  Description of Artificial Sequence: Synthetic oligonucleotide
cagagggtgtttggctgcgacctgg

SEQ ID NO: 45351 - DNA, 25 bp, Artificial Sequence
  Description of Artificial Sequence: Synthetic oligonucleotide
agagggtgtttggctgcgacctggg

SEQ ID NO: 45352 - DNA, 24 bp, Artificial Sequence
  Description of Artificial Sequence: Synthetic oligonucleotide
gagggtgtttggctgcgacctggg

SEQ ID NO: 45353 - DNA, 24 bp, Artificial Sequence
  Description of Artificial Sequence: Synthetic oligonucleotide
agggtgtttggctgcgacctgggg

SEQ ID NO: 45354 - DNA, 23 bp, Artificial Sequence
  Description of Artificial Sequence: Synthetic oligonucleotide
gggtgtttggctgcgacctgggg

SEQ ID NO: 45355 - DNA, 23 bp, Artificial Sequence
  Description of Artificial Sequence: Synthetic oligonucleotide
ggtgtttggctgcgacctggggc

SEQ ID NO: 45356 - DNA, 23 bp, Artificial Sequence
  Description of Artificial Sequence: Synthetic oligonucleotide
gtgtttggctgcgacctggggcc

SEQ ID NO: 45357 - DNA, 26 bp, Artificial Sequence
  Description of Artificial Sequence: Synthetic oligonucleotide
ccccgcttcatcgcagtgggctacat

SEQ ID NO: 45358 - DNA, 26 bp, Artificial Sequence
  Description of Artificial Sequence: Synthetic oligonucleotide
cccgcttcatcgcagtgggctacatg

SEQ ID NO: 45359 - DNA, 27 bp, Artificial Sequence
  Description of Artificial Sequence: Synthetic oligonucleotide
ccgcttcatcgcagtgggctacatgga

SEQ ID NO: 45360 - DNA, 27 bp, Artificial Sequence
  Description of Artificial Sequence: Synthetic oligonucleotide
cgcttcatcgcagtgggctacatggac

SEQ ID NO: 45361 - DNA, 27 bp, Artificial Sequence
  Description of Artificial Sequence: Synthetic oligonucleotide
gcttcatcgcagtgggctacatggacg

SEQ ID NO: 45362 - DNA, 28 bp, Artificial Sequence
  Description of Artificial Sequence: Synthetic oligonucleotide
cttcatcgcagtgggctacatggacgac

SEQ ID NO: 45363 - DNA, 29 bp, Artificial Sequence
  Description of Artificial Sequence: Synthetic oligonucleotide
ttcatcgcagtgggctacatggacgacac

SEQ ID NO: 45364 - DNA, 28 bp, Artificial Sequence
  Description of Artificial Sequence: Synthetic oligonucleotide
tcatcgcagtgggctacatggacgacac

SEQ ID NO: 45365 - DNA, 27 bp, Artificial Sequence
  Description of Artificial Sequence: Synthetic oligonucleotide
catcgcagtgggctacatggacgacac

SEQ ID NO: 45366 - DNA, 27 bp, Artificial Sequence
  Description of Artificial Sequence: Synthetic oligonucleotide
atcgcagtgggctacatggacgacacg

SEQ ID NO: 45367 - DNA, 26 bp, Artificial Sequence
  Description of Artificial Sequence: Synthetic oligonucleotide
tcgcagtgggctacatggacgacacg

SEQ ID NO: 45368 - DNA, 25 bp, Artificial Sequence
  Description of Artificial Sequence: Synthetic oligonucleotide
cgcagtgggctacatggacgacacg

SEQ ID NO: 45369 - DNA, 26 bp, Artificial Sequence
  Description of Artificial Sequence: Synthetic oligonucleotide
gcagtgggctacatggacgacacgca

SEQ ID NO: 45370 - DNA, 27 bp, Artificial Sequence
  Description of Artificial Sequence: Synthetic oligonucleotide
cagtgggctacatggacgacacgcagt

SEQ ID NO: 45371 - DNA, 28 bp, Artificial Sequence
  Description of Artificial Sequence: Synthetic oligonucleotide
agtgggctacatggacgacacgcagttc

SEQ ID NO: 45372 - DNA, 27 bp, Artificial Sequence
  Description of Artificial Sequence: Synthetic oligonucleotide
gtgggctacatggacgacacgcagttc

SEQ ID NO: 45373 - DNA, 27 bp, Artificial Sequence
  Description of Artificial Sequence: Synthetic oligonucleotide
tgggctacatggacgacacgcagttcg

SEQ ID NO: 45374 - DNA, 27 bp, Artificial Sequence
  Description of Artificial Sequence: Synthetic oligonucleotide
gggctacatggacgacacgcagttcgt

SEQ ID NO: 45375 - DNA, 27 bp, Artificial Sequence
  Description of Artificial Sequence: Synthetic oligonucleotide
ggctacatggacgacacgcagttcgtg

SEQ ID NO: 45376 - DNA, 27 bp, Artificial Sequence
  Description of Artificial Sequence: Synthetic oligonucleotide
gctacatggacgacacgcagttcgtgc

SEQ ID NO: 45377 - DNA, 27 bp, Artificial Sequence
  Description of Artificial Sequence: Synthetic oligonucleotide
ctacatggacgacacgcagttcgtgcg

SEQ ID NO: 45378 - DNA, 27 bp, Artificial Sequence
  Description of Artificial Sequence: Synthetic oligonucleotide
tacatggacgacacgcagttcgtgcgg

SEQ ID NO: 45379 - DNA, 27 bp, Artificial Sequence
  Description of Artificial Sequence: Synthetic oligonucleotide
acatggacgacacgcagttcgtgcggt

SEQ ID NO: 45380 - DNA, 27 bp, Artificial Sequence
  Description of Artificial Sequence: Synthetic oligonucleotide
catggacgacacgcagttcgtgcggtt

SEQ ID NO: 45381 - DNA, 27 bp, Artificial Sequence
  Description of Artificial Sequence: Synthetic oligonucleotide
atggacgacacgcagttcgtgcggttc

SEQ ID NO: 45382 - DNA, 26 bp, Artificial Sequence
  Description of Artificial Sequence: Synthetic oligonucleotide
aggatgtttggctgcgacctggggca

SEQ ID NO: 45383 - DNA, 25 bp, Artificial Sequence
  Description of Artificial Sequence: Synthetic oligonucleotide
ggatgtttggctgcgacctggggca

SEQ ID NO: 45384 - DNA, 25 bp, Artificial Sequence
  Description of Artificial Sequence: Synthetic oligonucleotide
gatgtttggctgcgacctggggcag

SEQ ID NO: 45385 - DNA, 26 bp, Artificial Sequence
  Description of Artificial Sequence: Synthetic oligonucleotide
atgtttggctgcgacctggggcagga

SEQ ID NO: 45386 - DNA, 25 bp, Artificial Sequence
  Description of Artificial Sequence: Synthetic oligonucleotide
tgtttggctgcgacctggggcagga

SEQ ID NO: 45387 - DNA, 24 bp, Artificial Sequence
  Description of Artificial Sequence: Synthetic oligonucleotide
gtttggctgcgacctggggcagga

SEQ ID NO: 45388 - DNA, 24 bp, Artificial Sequence
  Description of Artificial Sequence: Synthetic oligonucleotide
tttggctgcgacctggggcaggac

SEQ ID NO: 45389 - DNA, 23 bp, Artificial Sequence
  Description of Artificial Sequence: Synthetic oligonucleotide
ttggctgcgacctggggcaggac

SEQ ID NO: 45390 - DNA, 22 bp, Artificial Sequence
  Description of Artificial Sequence: Synthetic oligonucleotide
tggctgcgacctggggcaggac

SEQ ID NO: 45391 - DNA, 21 bp, Artificial Sequence
  Description of Artificial Sequence: Synthetic oligonucleotide
ggctgcgacctggggcaggac

SEQ ID NO: 45392 - DNA, 21 bp, Artificial Sequence
  Description of Artificial Sequence: Synthetic oligonucleotide
gctgcgacctggggcaggacg

SEQ ID NO: 45393 - DNA, 21 bp, Artificial Sequence
  Description of Artificial Sequence: Synthetic oligonucleotide
ctgcgacctggggcaggacgg

SEQ ID NO: 45394 - DNA, 21 bp, Artificial Sequence
  Description of Artificial Sequence: Synthetic oligonucleotide
tgcgacctggggcaggacggg

SEQ ID NO: 45395 - DNA, 20 bp, Artificial Sequence
  Description of Artificial Sequence: Synthetic oligonucleotide
gcgacctggggcaggacggg

SEQ ID NO: 45396 - DNA, 20 bp, Artificial Sequence
  Description of Artificial Sequence: Synthetic oligonucleotide
cgacctggggcaggacgggc

SEQ ID NO: 45397 - DNA, 20 bp, Artificial Sequence
  Description of Artificial Sequence: Synthetic oligonucleotide
gacctggggcaggacgggcg

SEQ ID NO: 45398 - DNA, 20 bp, Artificial Sequence
  Description of Artificial Sequence: Synthetic oligonucleotide
acctggggcaggacgggcgc

SEQ ID NO: 45399 - DNA, 20 bp, Artificial Sequence
  Description of Artificial Sequence: Synthetic oligonucleotide
cctggggcaggacgggcgct

SEQ ID NO: 45400 - DNA, 20 bp, Artificial Sequence
  Description of Artificial Sequence: Synthetic oligonucleotide
ctggggcaggacgggcgcct

SEQ ID NO: 45401 - DNA, 20 bp, Artificial Sequence
  Description of Artificial Sequence: Synthetic oligonucleotide
gtgtcctggcccggccgctg

SEQ ID NO: 45402 - DNA, 20 bp, Artificial Sequence
  Description of Artificial Sequence: Synthetic oligonucleotide
tgtcctggcccggccgctgg

SEQ ID NO: 45403 - DNA, 20 bp, Artificial Sequence
  Description of Artificial Sequence: Synthetic oligonucleotide
gtcctggcccggccgctggt

SEQ ID NO: 45404 - DNA, 20 bp, Artificial Sequence
  Description of Artificial Sequence: Synthetic oligonucleotide
tcctggcccggccgctggga

SEQ ID NO: 45405 - DNA, 20 bp, Artificial Sequence
  Description of Artificial Sequence: Synthetic oligonucleotide
cctggcccggccgctgggat

SEQ ID NO: 45406 - DNA, 20 bp, Artificial Sequence
  Description of Artificial Sequence: Synthetic oligonucleotide
ctggcccggccgctgggagt

SEQ ID NO: 45407 - DNA, 20 bp, Artificial Sequence
  Description of Artificial Sequence: Synthetic oligonucleotide
tggcccggccgctgggagct

SEQ ID NO: 45408 - DNA, 20 bp, Artificial Sequence
  Description of Artificial Sequence: Synthetic oligonucleotide
ggcccggccgctgggagctt

SEQ ID NO: 45409 - DNA, 20 bp, Artificial Sequence
  Description of Artificial Sequence: Synthetic oligonucleotide
gcccggccgctgggagcctt

SEQ ID NO: 45410 - DNA, 20 bp, Artificial Sequence
  Description of Artificial Sequence: Synthetic oligonucleotide
cccggccgctgggagccctt

SEQ ID NO: 45411 - DNA, 20 bp, Artificial Sequence
  Description of Artificial Sequence: Synthetic oligonucleotide
ccggccgctgggagcccctt

SEQ ID NO: 45412 - DNA, 20 bp, Artificial Sequence
  Description of Artificial Sequence: Synthetic oligonucleotide
cggccgctgggagccccgtt

SEQ ID NO: 45413 - DNA, 20 bp, Artificial Sequence
  Description of Artificial Sequence: Synthetic oligonucleotide
ggccgctgggagccccgctt

SEQ ID NO: 45414 - DNA, 22 bp, Artificial Sequence
  Description of Artificial Sequence: Synthetic oligonucleotide
gccgctgggagccccgcttcat

SEQ ID NO: 45415 - DNA, 22 bp, Artificial Sequence
  Description of Artificial Sequence: Synthetic oligonucleotide
ccgctgggagccccgcttcatc

SEQ ID NO: 45416 - DNA, 22 bp, Artificial Sequence
  Description of Artificial Sequence: Synthetic oligonucleotide
cgctgggagccccgcttcatcg

SEQ ID NO: 45417 - DNA, 23 bp, Artificial Sequence
  Description of Artificial Sequence: Synthetic oligonucleotide
gctgggagccccgcttcatcgca

SEQ ID NO: 45418 - DNA, 24 bp, Artificial Sequence
  Description of Artificial Sequence: Synthetic oligonucleotide
ctgggagccccgcttcatcgcagt

SEQ ID NO: 45419 - DNA, 24 bp, Artificial Sequence
  Description of Artificial Sequence: Synthetic oligonucleotide
tgggagccccgcttcatcgcagtg

SEQ ID NO: 45420 - DNA, 32 bp, Artificial Sequence
  Description of Artificial Sequence: Synthetic oligonucleotide
gctcccactacatgaggtatttctccacatcc

SEQ ID NO: 45421 - DNA, 32 bp, Artificial Sequence
  Description of Artificial Sequence: Synthetic oligonucleotide
ctcccactacatgaggtatttctccacatccg

SEQ ID NO: 45422 - DNA, 33 bp, Artificial Sequence
  Description of Artificial Sequence: Synthetic oligonucleotide
tcccactacatgaggtatttctccacatccgtg

SEQ ID NO: 45423 - DNA, 32 bp, Artificial Sequence
  Description of Artificial Sequence: Synthetic oligonucleotide
cccactacatgaggtatttctccacatccgtg

SEQ ID NO: 45424 - DNA, 33 bp, Artificial Sequence
  Description of Artificial Sequence: Synthetic oligonucleotide
ccactacatgaggtatttctccacatccgtgtc

SEQ ID NO: 45425 - DNA, 33 bp, Artificial Sequence
  Description of Artificial Sequence: Synthetic oligonucleotide
cactacatgaggtatttctccacatccgtgtcc

SEQ ID NO: 45426 - DNA, 34 bp, Artificial Sequence
  Description of Artificial Sequence: Synthetic oligonucleotide
actacatgaggtatttctccacatccgtgtcctg

SEQ ID NO: 45427 - DNA, 33 bp, Artificial Sequence
  Description of Artificial Sequence: Synthetic oligonucleotide
ctacatgaggtatttctccacatccgtgtcctg

SEQ ID NO: 45428 - DNA, 33 bp, Artificial Sequence
  Description of Artificial Sequence: Synthetic oligonucleotide
tacatgaggtatttctccacatccgtgtcctgg

SEQ ID NO: 45429 - DNA, 32 bp, Artificial Sequence
  Description of Artificial Sequence: Synthetic oligonucleotide
acatgaggtatttctccacatccgtgtcctgg

SEQ ID NO: 45430 - DNA, 20 bp, Artificial Sequence
  Description of Artificial Sequence: Synthetic oligonucleotide
gcccgtgcggcggagcagca

SEQ ID NO: 45431 - DNA, 21 bp, Artificial Sequence
  Description of Artificial Sequence: Synthetic oligonucleotide
cccgtgcggcggagcagcaga

SEQ ID NO: 45432 - DNA, 22 bp, Artificial Sequence
  Description of Artificial Sequence: Synthetic oligonucleotide
ccgtgcggcggagcagcagaga

SEQ ID NO: 45433 - DNA, 22 bp, Artificial Sequence
  Description of Artificial Sequence: Synthetic oligonucleotide
cgtgcggcggagcagcagagag

SEQ ID NO: 45434 - DNA, 22 bp, Artificial Sequence
  Description of Artificial Sequence: Synthetic oligonucleotide
gtgcggcggagcagcagagagc

SEQ ID NO: 45435 - DNA, 26 bp, Artificial Sequence
  Description of Artificial Sequence: Synthetic oligonucleotide
ccggagtattgggacggggagacaca

SEQ ID NO: 45436 - DNA, 27 bp, Artificial Sequence
  Description of Artificial Sequence: Synthetic oligonucleotide
cggagtattgggacggggagacacaga

SEQ ID NO: 45437 - DNA, 28 bp, Artificial Sequence
  Description of Artificial Sequence: Synthetic oligonucleotide
ggagtattgggacggggagacacagaag

SEQ ID NO: 45438 - DNA, 30 bp, Artificial Sequence
  Description of Artificial Sequence: Synthetic oligonucleotide
gagtattgggacggggagacacagaagtac

SEQ ID NO: 45439 - DNA, 32 bp, Artificial Sequence
  Description of Artificial Sequence: Synthetic oligonucleotide
agtattgggacggggagacacagaagtacaag

SEQ ID NO: 45440 - DNA, 31 bp, Artificial Sequence
  Description of Artificial Sequence: Synthetic oligonucleotide
gtattgggacggggagacacagaagtacaag

SEQ ID NO: 45441 - DNA, 31 bp, Artificial Sequence
  Description of Artificial Sequence: Synthetic oligonucleotide
tattgggacggggagacacagaagtacaagc

SEQ ID NO: 45442 - DNA, 30 bp, Artificial Sequence
  Description of Artificial Sequence: Synthetic oligonucleotide
attgggacggggagacacagaagtacaagc

SEQ ID NO: 45443 - DNA, 29 bp, Artificial Sequence
  Description of Artificial Sequence: Synthetic oligonucleotide
ttgggacggggagacacagaagtacaagc

SEQ ID NO: 45444 - DNA, 28 bp, Artificial Sequence
  Description of Artificial Sequence: Synthetic oligonucleotide
tgggacggggagacacagaagtacaagc

SEQ ID NO: 45445 - DNA, 27 bp, Artificial Sequence
  Description of Artificial Sequence: Synthetic oligonucleotide
gggacggggagacacagaagtacaagc

SEQ ID NO: 45446 - DNA, 27 bp, Artificial Sequence
  Description of Artificial Sequence: Synthetic oligonucleotide
ggacggggagacacagaagtacaagcg

SEQ ID NO: 45447 - DNA, 27 bp, Artificial Sequence
  Description of Artificial Sequence: Synthetic oligonucleotide
gacggggagacacagaagtacaagcgc

SEQ ID NO: 45448 - DNA, 27 bp, Artificial Sequence
  Description of Artificial Sequence: Synthetic oligonucleotide
acggggagacacagaagtacaagcgcc

SEQ ID NO: 45449 - DNA, 27 bp, Artificial Sequence
  Description of Artificial Sequence: Synthetic oligonucleotide
cggggagacacagaagtacaagcgcca

SEQ ID NO: 45450 - DNA, 27 bp, Artificial Sequence
  Description of Artificial Sequence: Synthetic oligonucleotide
ggggagacacagaagtacaagcgccag

SEQ ID NO: 45451 - DNA, 21 bp, Artificial Sequence
  Description of Artificial Sequence: Synthetic oligonucleotide
ggagccgcgggagccgtggat

SEQ ID NO: 45452 - DNA, 21 bp, Artificial Sequence
  Description of Artificial Sequence: Synthetic oligonucleotide
gagccgcgggagccgtggatg

SEQ ID NO: 45453 - DNA, 22 bp, Artificial Sequence
  Description of Artificial Sequence: Synthetic oligonucleotide
agccgcgggagccgtggatgga

SEQ ID NO: 45454 - DNA, 21 bp, Artificial Sequence
  Description of Artificial Sequence: Synthetic oligonucleotide
gccgcgggagccgtggatgga

SEQ ID NO: 45455 - DNA, 21 bp, Artificial Sequence
  Description of Artificial Sequence: Synthetic oligonucleotide
ccgcgggagccgtggatggag

SEQ ID NO: 45456 - DNA, 22 bp, Artificial Sequence
  Description of Artificial Sequence: Synthetic oligonucleotide
cgcgggagccgtggatggagca

SEQ ID NO: 45457 - DNA, 22 bp, Artificial Sequence
  Description of Artificial Sequence: Synthetic oligonucleotide
gcgggagccgtggatggagcag

SEQ ID NO: 45458 - DNA, 23 bp, Artificial Sequence
  Description of Artificial Sequence: Synthetic oligonucleotide
cgggagccgtggatggagcagga

SEQ ID NO: 45459 - DNA, 23 bp, Artificial Sequence
  Description of Artificial Sequence: Synthetic oligonucleotide
gggagccgtggatggagcaggag

SEQ ID NO: 45460 - DNA, 23 bp, Artificial Sequence
  Description of Artificial Sequence: Synthetic oligonucleotide
ggagccgtggatggagcaggagg

SEQ ID NO: 45461 - DNA, 23 bp, Artificial Sequence
  Description of Artificial Sequence: Synthetic oligonucleotide
gagccgtggatggagcaggaggg

SEQ ID NO: 45462 - DNA, 23 bp, Artificial Sequence
  Description of Artificial Sequence: Synthetic oligonucleotide
agccgtggatggagcaggagggg

SEQ ID NO: 45463 - DNA, 27 bp, Artificial Sequence
  Description of Artificial Sequence: Synthetic oligonucleotide
ctacgtggacgacacgcagttcgtgca

SEQ ID NO: 45464 - DNA, 27 bp, Artificial Sequence
  Description of Artificial Sequence: Synthetic oligonucleotide
tacgtggacgacacgcagttcgtgcag

SEQ ID NO: 45465 - DNA, 27 bp, Artificial Sequence
  Description of Artificial Sequence: Synthetic oligonucleotide
acgtggacgacacgcagttcgtgcagt

SEQ ID NO: 45466 - DNA, 27 bp, Artificial Sequence
  Description of Artificial Sequence: Synthetic oligonucleotide
cgtggacgacacgcagttcgtgcagtt

SEQ ID NO: 45467 - DNA, 27 bp, Artificial Sequence
  Description of Artificial Sequence: Synthetic oligonucleotide
gtggacgacacgcagttcgtgcagttc

SEQ ID NO: 45468 - DNA, 27 bp, Artificial Sequence
  Description of Artificial Sequence: Synthetic oligonucleotide
tggacgacacgcagttcgtgcagttcg

SEQ ID NO: 45469 - DNA, 27 bp, Artificial Sequence
  Description of Artificial Sequence: Synthetic oligonucleotide
ggacgacacgcagttcgtgcagttcga

SEQ ID NO: 45470 - DNA, 27 bp, Artificial Sequence
  Description of Artificial Sequence: Synthetic oligonucleotide
gacgacacgcagttcgtgcagttcgac

SEQ ID NO: 45471 - DNA, 28 bp, Artificial Sequence
  Description of Artificial Sequence: Synthetic oligonucleotide
acgacacgcagttcgtgcagttcgacag

SEQ ID NO: 45472 - DNA, 27 bp, Artificial Sequence
  Description of Artificial Sequence: Synthetic oligonucleotide
cgacacgcagttcgtgcagttcgacag

SEQ ID NO: 45473 - DNA, 27 bp, Artificial Sequence
  Description of Artificial Sequence: Synthetic oligonucleotide
gacacgcagttcgtgcagttcgacagc

SEQ ID NO: 45474 - DNA, 27 bp, Artificial Sequence
  Description of Artificial Sequence: Synthetic oligonucleotide
acacgcagttcgtgcagttcgacagcg

SEQ ID NO: 45475 - DNA, 27 bp, Artificial Sequence
  Description of Artificial Sequence: Synthetic oligonucleotide
cacgcagttcgtgcagttcgacagcga

SEQ ID NO: 45476 - DNA, 27 bp, Artificial Sequence
  Description of Artificial Sequence: Synthetic oligonucleotide
acgcagttcgtgcagttcgacagcgac

SEQ ID NO: 45477 - DNA, 24 bp, Artificial Sequence
  Description of Artificial Sequence: Synthetic oligonucleotide
cagttcgacagcgacgccgcgagt

SEQ ID NO: 45478 - DNA, 26 bp, Artificial Sequence
  Description of Artificial Sequence: Synthetic oligonucleotide
agaacgggaagaagacgctgcagcgc

SEQ ID NO: 45479 - DNA, 25 bp, Artificial Sequence
  Description of Artificial Sequence: Synthetic oligonucleotide
gaacgggaagaagacgctgcagcgc

SEQ ID NO: 45480 - DNA, 25 bp, Artificial Sequence
  Description of Artificial Sequence: Synthetic oligonucleotide
aacgggaagaagacgctgcagcgcg

SEQ ID NO: 45481 - DNA, 24 bp, Artificial Sequence
  Description of Artificial Sequence: Synthetic oligonucleotide
acgggaagaagacgctgcagcgcg

SEQ ID NO: 45482 - DNA, 23 bp, Artificial Sequence
  Description of Artificial Sequence: Synthetic oligonucleotide
cgggaagaagacgctgcagcgcg

SEQ ID NO: 45483 - DNA, 23 bp, Artificial Sequence
  Description of Artificial Sequence: Synthetic oligonucleotide
gggaagaagacgctgcagcgcgc

SEQ ID NO: 45484 - DNA, 23 bp, Artificial Sequence
  Description of Artificial Sequence: Synthetic oligonucleotide
ggaagaagacgctgcagcgcgcg

SEQ ID NO: 45485 - DNA, 25 bp, Artificial Sequence
  Description of Artificial Sequence: Synthetic oligonucleotide
gaagaagacgctgcagcgcgcggaa

SEQ ID NO: 45486 - DNA, 26 bp, Artificial Sequence
  Description of Artificial Sequence: Synthetic oligonucleotide
aagaagacgctgcagcgcgcggaaca

SEQ ID NO: 45487 - DNA, 25 bp, Artificial Sequence
  Description of Artificial Sequence: Synthetic oligonucleotide
agaagacgctgcagcgcgcggaaca

SEQ ID NO: 45488 - DNA, 24 bp, Artificial Sequence
  Description of Artificial Sequence: Synthetic oligonucleotide
gaagacgctgcagcgcgcggaaca

SEQ ID NO: 45489 - DNA, 24 bp, Artificial Sequence
  Description of Artificial Sequence: Synthetic oligonucleotide
aagacgctgcagcgcgcggaacac

SEQ ID NO: 45490 - DNA, 24 bp, Artificial Sequence
  Description of Artificial Sequence: Synthetic oligonucleotide
agagcccctcaccctgagatgggg

SEQ ID NO: 45491 - DNA, 23 bp, Artificial Sequence
  Description of Artificial Sequence: Synthetic oligonucleotide
gagcccctcaccctgagatgggg

SEQ ID NO: 45492 - DNA, 23 bp, Artificial Sequence
  Description of Artificial Sequence: Synthetic oligonucleotide
agcccctcaccctgagatggggg

SEQ ID NO: 45493 - DNA, 22 bp, Artificial Sequence
  Description of Artificial Sequence: Synthetic oligonucleotide
gcccctcaccctgagatggggg

SEQ ID NO: 45494 - DNA, 22 bp, Artificial Sequence
  Description of Artificial Sequence: Synthetic oligonucleotide
cccctcaccctgagatgggggc

SEQ ID NO: 45495 - DNA, 24 bp, Artificial Sequence
  Description of Artificial Sequence: Synthetic oligonucleotide
ccctcaccctgagatgggggccat

SEQ ID NO: 45496 - DNA, 26 bp, Artificial Sequence
  Description of Artificial Sequence: Synthetic oligonucleotide
cctcaccctgagatgggggccatctt

SEQ ID NO: 45497 - DNA, 26 bp, Artificial Sequence
  Description of Artificial Sequence: Synthetic oligonucleotide
ctcaccctgagatgggggccatcttc

SEQ ID NO: 45498 - DNA, 26 bp, Artificial Sequence
  Description of Artificial Sequence: Synthetic oligonucleotide
tcaccctgagatgggggccatcttcc

SEQ ID NO: 45499 - DNA, 25 bp, Artificial Sequence
  Description of Artificial Sequence: Synthetic oligonucleotide
caccctgagatgggggccatcttcc

SEQ ID NO: 45500 - DNA, 26 bp, Artificial Sequence
  Description of Artificial Sequence: Synthetic oligonucleotide
accctgagatgggggccatcttccca

SEQ ID NO: 45501 - DNA, 25 bp, Artificial Sequence
  Description of Artificial Sequence: Synthetic oligonucleotide
ccctgagatgggggccatcttccca

SEQ ID NO: 45502 - DNA, 25 bp, Artificial Sequence
  Description of Artificial Sequence: Synthetic oligonucleotide
cctgagatgggggccatcttcccag

SEQ ID NO: 45503 - DNA, 25 bp, Artificial Sequence
  Description of Artificial Sequence: Synthetic oligonucleotide
ctgagatgggggccatcttcccagc

SEQ ID NO: 45504 - DNA, 25 bp, Artificial Sequence
  Description of Artificial Sequence: Synthetic oligonucleotide
tgagatgggggccatcttcccagcc

SEQ ID NO: 45505 - DNA, 24 bp, Artificial Sequence
  Description of Artificial Sequence: Synthetic oligonucleotide
gagatgggggccatcttcccagcc

SEQ ID NO: 45506 - DNA, 25 bp, Artificial Sequence
  Description of Artificial Sequence: Synthetic oligonucleotide
agatgggggccatcttcccagccca

SEQ ID NO: 45507 - DNA, 24 bp, Artificial Sequence
  Description of Artificial Sequence: Synthetic oligonucleotide
gatgggggccatcttcccagccca

SEQ ID NO: 45508 - DNA, 24 bp, Artificial Sequence
  Description of Artificial Sequence: Synthetic oligonucleotide
atgggggccatcttcccagcccac

SEQ ID NO: 45509 - DNA, 23 bp, Artificial Sequence
  Description of Artificial Sequence: Synthetic oligonucleotide
tgggggccatcttcccagcccac

SEQ ID NO: 45510 - DNA, 22 bp, Artificial Sequence
  Description of Artificial Sequence: Synthetic oligonucleotide
gggggccatcttcccagcccac

SEQ ID NO: 45511 - DNA, 24 bp, Artificial Sequence
  Description of Artificial Sequence: Synthetic oligonucleotide
ggggccatcttcccagcccaccat

SEQ ID NO: 45512 - DNA, 24 bp, Artificial Sequence
  Description of Artificial Sequence: Synthetic oligonucleotide
gggccatcttcccagcccaccatc

SEQ ID NO: 45513 - DNA, 24 bp, Artificial Sequence
  Description of Artificial Sequence: Synthetic oligonucleotide
ggccatcttcccagcccaccatcc

SEQ ID NO: 45514 - DNA, 23 bp, Artificial Sequence
  Description of Artificial Sequence: Synthetic oligonucleotide
gaagaagacgctgcagcgcgcgg

SEQ ID NO: 45515 - DNA, 30 bp, Artificial Sequence
  Description of Artificial Sequence: Synthetic oligonucleotide
agcagagatacacgtgccatgtgcagcatg

SEQ ID NO: 45516 - DNA, 29 bp, Artificial Sequence
  Description of Artificial Sequence: Synthetic oligonucleotide
gcagagatacacgtgccatgtgcagcatg

SEQ ID NO: 45517 - DNA, 30 bp, Artificial Sequence
  Description of Artificial Sequence: Synthetic oligonucleotide
cagagatacacgtgccatgtgcagcatgag

SEQ ID NO: 45518 - DNA, 30 bp, Artificial Sequence
  Description of Artificial Sequence: Synthetic oligonucleotide
agagatacacgtgccatgtgcagcatgagg

SEQ ID NO: 45519 - DNA, 29 bp, Artificial Sequence
  Description of Artificial Sequence: Synthetic oligonucleotide
gagatacacgtgccatgtgcagcatgagg

SEQ ID NO: 45520 - DNA, 29 bp, Artificial Sequence
  Description of Artificial Sequence: Synthetic oligonucleotide
agatacacgtgccatgtgcagcatgaggg

SEQ ID NO: 45521 - DNA, 28 bp, Artificial Sequence
  Description of Artificial Sequence: Synthetic oligonucleotide
gatacacgtgccatgtgcagcatgaggg

SEQ ID NO: 45522 - DNA, 28 bp, Artificial Sequence
  Description of Artificial Sequence: Synthetic oligonucleotide
atacacgtgccatgtgcagcatgagggg

SEQ ID NO: 45523 - DNA, 27 bp, Artificial Sequence
  Description of Artificial Sequence: Synthetic oligonucleotide
tacacgtgccatgtgcagcatgagggg

SEQ ID NO: 45524 - DNA, 26 bp, Artificial Sequence
  Description of Artificial Sequence: Synthetic oligonucleotide
acacgtgccatgtgcagcatgagggg

SEQ ID NO: 45525 - DNA, 25 bp, Artificial Sequence
  Description of Artificial Sequence: Synthetic oligonucleotide
cacgtgccatgtgcagcatgagggg

SEQ ID NO: 45526 - DNA, 26 bp, Artificial Sequence
  Description of Artificial Sequence: Synthetic oligonucleotide
acgtgccatgtgcagcatgaggggct

SEQ ID NO: 45527 - DNA, 25 bp, Artificial Sequence
  Description of Artificial Sequence: Synthetic oligonucleotide
cgtgccatgtgcagcatgaggggct

SEQ ID NO: 45528 - DNA, 25 bp, Artificial Sequence
  Description of Artificial Sequence: Synthetic oligonucleotide
gtgccatgtgcagcatgaggggctg

SEQ ID NO: 45529 - DNA, 25 bp, Artificial Sequence
  Description of Artificial Sequence: Synthetic oligonucleotide
ccatgtgcagcatgaggggctgcca

SEQ ID NO: 45530 - DNA, 26 bp, Artificial Sequence
  Description of Artificial Sequence: Synthetic oligonucleotide
catgtgcagcatgaggggctgccaga

SEQ ID NO: 45531 - DNA, 26 bp, Artificial Sequence
  Description of Artificial Sequence: Synthetic oligonucleotide
atgtgcagcatgaggggctgccagag

SEQ ID NO: 45532 - DNA, 25 bp, Artificial Sequence
  Description of Artificial Sequence: Synthetic oligonucleotide
tgtgcagcatgaggggctgccagag

SEQ ID NO: 45533 - DNA, 24 bp, Artificial Sequence
  Description of Artificial Sequence: Synthetic oligonucleotide
gtgcagcatgaggggctgccagag

SEQ ID NO: 45534 - DNA, 24 bp, Artificial Sequence
  Description of Artificial Sequence: Synthetic oligonucleotide
tgcagcatgaggggctgccagagc

SEQ ID NO: 45535 - DNA, 23 bp, Artificial Sequence
  Description of Artificial Sequence: Synthetic oligonucleotide
gcagcatgaggggctgccagagc

SEQ ID NO: 45536 - DNA, 23 bp, Artificial Sequence
  Description of Artificial Sequence: Synthetic oligonucleotide
cagcatgaggggctgccagagcc

SEQ ID NO: 45537 - DNA, 23 bp, Artificial Sequence
  Description of Artificial Sequence: Synthetic oligonucleotide
agcatgaggggctgccagagccc

SEQ ID NO: 45538 - DNA, 22 bp, Artificial Sequence
  Description of Artificial Sequence: Synthetic oligonucleotide
gcatgaggggctgccagagccc

SEQ ID NO: 45539 - DNA, 23 bp, Artificial Sequence
  Description of Artificial Sequence: Synthetic oligonucleotide
catgaggggctgccagagcccct

SEQ ID NO: 45540 - DNA, 24 bp, Artificial Sequence
  Description of Artificial Sequence: Synthetic oligonucleotide
atgaggggctgccagagcccctca

SEQ ID NO: 45541 - DNA, 23 bp, Artificial Sequence
  Description of Artificial Sequence: Synthetic oligonucleotide
tgaggggctgccagagcccctca

SEQ ID NO: 45542 - DNA, 32 bp, Artificial Sequence
  Description of Artificial Sequence: Synthetic oligonucleotide
aagagcagagatacacatgccatgtgcagcac

SEQ ID NO: 45543 - DNA, 31 bp, Artificial Sequence
  Description of Artificial Sequence: Synthetic oligonucleotide
agagcagagatacacatgccatgtgcagcac

SEQ ID NO: 45544 - DNA, 30 bp, Artificial Sequence
  Description of Artificial Sequence: Synthetic oligonucleotide
gagcagagatacacatgccatgtgcagcac

SEQ ID NO: 45545 - DNA, 30 bp, Artificial Sequence
  Description of Artificial Sequence: Synthetic oligonucleotide
agcagagatacacatgccatgtgcagcacg

SEQ ID NO: 45546 - DNA, 29 bp, Artificial Sequence
  Description of Artificial Sequence: Synthetic oligonucleotide
gcagagatacacatgccatgtgcagcacg

SEQ ID NO: 45547 - DNA, 30 bp, Artificial Sequence
  Description of Artificial Sequence: Synthetic oligonucleotide
cagagatacacatgccatgtgcagcacgag

SEQ ID NO: 45548 - DNA, 30 bp, Artificial Sequence
  Description of Artificial Sequence: Synthetic oligonucleotide
agagatacacatgccatgtgcagcacgagg

SEQ ID NO: 45549 - DNA, 29 bp, Artificial Sequence
  Description of Artificial Sequence: Synthetic oligonucleotide
gagatacacatgccatgtgcagcacgagg

SEQ ID NO: 45550 - DNA, 29 bp, Artificial Sequence
  Description of Artificial Sequence: Synthetic oligonucleotide
agatacacatgccatgtgcagcacgaggg

SEQ ID NO: 45551 - DNA, 28 bp, Artificial Sequence
  Description of Artificial Sequence: Synthetic oligonucleotide
gatacacatgccatgtgcagcacgaggg

SEQ ID NO: 45552 - DNA, 28 bp, Artificial Sequence
  Description of Artificial Sequence: Synthetic oligonucleotide
atacacatgccatgtgcagcacgagggg

SEQ ID NO: 45553 - DNA, 27 bp, Artificial Sequence
  Description of Artificial Sequence: Synthetic oligonucleotide
tacacatgccatgtgcagcacgagggg

SEQ ID NO: 45554 - DNA, 26 bp, Artificial Sequence
  Description of Artificial Sequence: Synthetic oligonucleotide
acacatgccatgtgcagcacgagggg

SEQ ID NO: 45555 - DNA, 25 bp, Artificial Sequence
  Description of Artificial Sequence: Synthetic oligonucleotide
cacatgccatgtgcagcacgagggg

SEQ ID NO: 45556 - DNA, 26 bp, Artificial Sequence
  Description of Artificial Sequence: Synthetic oligonucleotide
acatgccatgtgcagcacgaggggct

SEQ ID NO: 45557 - DNA, 25 bp, Artificial Sequence
  Description of Artificial Sequence: Synthetic oligonucleotide
catgccatgtgcagcacgaggggct

SEQ ID NO: 45558 - DNA, 25 bp, Artificial Sequence
  Description of Artificial Sequence: Synthetic oligonucleotide
atgccatgtgcagcacgaggggctg

SEQ ID NO: 45559 - DNA, 30 bp, Artificial Sequence
  Description of Artificial Sequence: Synthetic oligonucleotide
gtctcacaccctccagaggatgtatggttg

SEQ ID NO: 45560 - DNA, 30 bp, Artificial Sequence
  Description of Artificial Sequence: Synthetic oligonucleotide
tctcacaccctccagaggatgtatggttgc

SEQ ID NO: 45561 - DNA, 29 bp, Artificial Sequence
  Description of Artificial Sequence: Synthetic oligonucleotide
ctcacaccctccagaggatgtatggttgc

SEQ ID NO: 45562 - DNA, 29 bp, Artificial Sequence
  Description of Artificial Sequence: Synthetic oligonucleotide
tcacaccctccagaggatgtatggttgcg

SEQ ID NO: 45563 - DNA, 28 bp, Artificial Sequence
  Description of Artificial Sequence: Synthetic oligonucleotide
cacaccctccagaggatgtatggttgcg

SEQ ID NO: 45564 - DNA, 29 bp, Artificial Sequence
  Description of Artificial Sequence: Synthetic oligonucleotide
acaccctccagaggatgtatggttgcgac

SEQ ID NO: 45565 - DNA, 28 bp, Artificial Sequence
  Description of Artificial Sequence: Synthetic oligonucleotide
caccctccagaggatgtatggttgcgac

SEQ ID NO: 45566 - DNA, 28 bp, Artificial Sequence
  Description of Artificial Sequence: Synthetic oligonucleotide
accctccagaggatgtatggttgcgacc

SEQ ID NO: 45567 - DNA, 27 bp, Artificial Sequence
  Description of Artificial Sequence: Synthetic oligonucleotide
ccctccagaggatgtatggttgcgacc

SEQ ID NO: 45568 - DNA, 28 bp, Artificial Sequence
  Description of Artificial Sequence: Synthetic oligonucleotide
cctccagaggatgtatggttgcgacctg

SEQ ID NO: 45569 - DNA, 28 bp, Artificial Sequence
  Description of Artificial Sequence: Synthetic oligonucleotide
ctccagaggatgtatggttgcgacctgg

SEQ ID NO: 45570 - DNA, 28 bp, Artificial Sequence
  Description of Artificial Sequence: Synthetic oligonucleotide
tccagaggatgtatggttgcgacctggg

SEQ ID NO: 45571 - DNA, 27 bp, Artificial Sequence
  Description of Artificial Sequence: Synthetic oligonucleotide
ccagaggatgtatggttgcgacctggg

SEQ ID NO: 45572 - DNA, 27 bp, Artificial Sequence
  Description of Artificial Sequence: Synthetic oligonucleotide
cagaggatgtatggttgcgacctgggg

SEQ ID NO: 45573 - DNA, 27 bp, Artificial Sequence
  Description of Artificial Sequence: Synthetic oligonucleotide
agaggatgtatggttgcgacctggggc

SEQ ID NO: 45574 - DNA, 26 bp, Artificial Sequence
  Description of Artificial Sequence: Synthetic oligonucleotide
gaggatgtatggttgcgacctggggc

SEQ ID NO: 45575 - DNA, 26 bp, Artificial Sequence
  Description of Artificial Sequence: Synthetic oligonucleotide
aggatgtatggttgcgacctggggcc

SEQ ID NO: 45576 - DNA, 25 bp, Artificial Sequence
  Description of Artificial Sequence: Synthetic oligonucleotide
ggatgtatggttgcgacctggggcc

SEQ ID NO: 45577 - DNA, 25 bp, Artificial Sequence
  Description of Artificial Sequence: Synthetic oligonucleotide
gatgtatggttgcgacctggggccc

SEQ ID NO: 45578 - DNA, 26 bp, Artificial Sequence
  Description of Artificial Sequence: Synthetic oligonucleotide
atgtatggttgcgacctggggcccga

SEQ ID NO: 45579 - DNA, 25 bp, Artificial Sequence
  Description of Artificial Sequence: Synthetic oligonucleotide
tgtatggttgcgacctggggcccga

SEQ ID NO: 45580 - DNA, 24 bp, Artificial Sequence
  Description of Artificial Sequence: Synthetic oligonucleotide
gtatggttgcgacctggggcccga

SEQ ID NO: 45581 - DNA, 24 bp, Artificial Sequence
  Description of Artificial Sequence: Synthetic oligonucleotide
tatggttgcgacctggggcccgac

SEQ ID NO: 45582 - DNA, 23 bp, Artificial Sequence
  Description of Artificial Sequence: Synthetic oligonucleotide
atggttgcgacctggggcccgac

SEQ ID NO: 45583 - DNA, 22 bp, Artificial Sequence
  Description of Artificial Sequence: Synthetic oligonucleotide
tggttgcgacctggggcccgac

SEQ ID NO: 45584 - DNA, 21 bp, Artificial Sequence
  Description of Artificial Sequence: Synthetic oligonucleotide
ggttgcgacctggggcccgac

SEQ ID NO: 45585 - DNA, 21 bp, Artificial Sequence
  Description of Artificial Sequence: Synthetic oligonucleotide
gttgcgacctggggcccgacg

SEQ ID NO: 45586 - DNA, 21 bp, Artificial Sequence
  Description of Artificial Sequence: Synthetic oligonucleotide
ttgcgacctggggcccgacgg

SEQ ID NO: 45587 - DNA, 30 bp, Artificial Sequence
  Description of Artificial Sequence: Synthetic oligonucleotide
cttcgcagatacctggagaacgggaagaag

SEQ ID NO: 45588 - DNA, 31 bp, Artificial Sequence
  Description of Artificial Sequence: Synthetic oligonucleotide
ttcgcagatacctggagaacgggaagaagac

SEQ ID NO: 45589 - DNA, 30 bp, Artificial Sequence
  Description of Artificial Sequence: Synthetic oligonucleotide
tcgcagatacctggagaacgggaagaagac

SEQ ID NO: 45590 - DNA, 25 bp, Artificial Sequence
  Description of Artificial Sequence: Synthetic oligonucleotide
gccgcggacaaggcggctcagatta

SEQ ID NO: 45591 - DNA, 25 bp, Artificial Sequence
  Description of Artificial Sequence: Synthetic oligonucleotide
ccgcggacaaggcggctcagattac

SEQ ID NO: 45592 - DNA, 25 bp, Artificial Sequence
  Description of Artificial Sequence: Synthetic oligonucleotide
cgcggacaaggcggctcagattacc

SEQ ID NO: 45593 - DNA, 26 bp, Artificial Sequence
  Description of Artificial Sequence: Synthetic oligonucleotide
gcggacaaggcggctcagattaccca

SEQ ID NO: 45594 - DNA, 26 bp, Artificial Sequence
  Description of Artificial Sequence: Synthetic oligonucleotide
cggacaaggcggctcagattacccag

SEQ ID NO: 45595 - DNA, 26 bp, Artificial Sequence
  Description of Artificial Sequence: Synthetic oligonucleotide
ggacaaggcggctcagattacccagc

SEQ ID NO: 45596 - DNA, 26 bp, Artificial Sequence
  Description of Artificial Sequence: Synthetic oligonucleotide
gacaaggcggctcagattacccagcg

SEQ ID NO: 45597 - DNA, 27 bp, Artificial Sequence
  Description of Artificial Sequence: Synthetic oligonucleotide
acaaggcggctcagattacccagcgca

SEQ ID NO: 45598 - DNA, 27 bp, Artificial Sequence
  Description of Artificial Sequence: Synthetic oligonucleotide
caaggcggctcagattacccagcgcaa

SEQ ID NO: 45599 - DNA, 27 bp, Artificial Sequence
  Description of Artificial Sequence: Synthetic oligonucleotide
aaggcggctcagattacccagcgcaag

SEQ ID NO: 45600 - DNA, 27 bp, Artificial Sequence
  Description of Artificial Sequence: Synthetic oligonucleotide
aggcggctcagattacccagcgcaagt

SEQ ID NO: 45601 - DNA, 23 bp, Artificial Sequence
  Description of Artificial Sequence: Synthetic oligonucleotide
cgctcttggaccgccgcggacaa

SEQ ID NO: 45602 - DNA, 23 bp, Artificial Sequence
  Description of Artificial Sequence: Synthetic oligonucleotide
gctcttggaccgccgcggacaag

SEQ ID NO: 45603 - DNA, 23 bp, Artificial Sequence
  Description of Artificial Sequence: Synthetic oligonucleotide
ctcttggaccgccgcggacaagg

SEQ ID NO: 45604 - DNA, 23 bp, Artificial Sequence
  Description of Artificial Sequence: Synthetic oligonucleotide
tcttggaccgccgcggacaaggc

SEQ ID NO: 45605 - DNA, 22 bp, Artificial Sequence
  Description of Artificial Sequence: Synthetic oligonucleotide
cttggaccgccgcggacaaggc

SEQ ID NO: 45606 - DNA, 22 bp, Artificial Sequence
  Description of Artificial Sequence: Synthetic oligonucleotide
ttggaccgccgcggacaaggcg

SEQ ID NO: 45607 - DNA, 27 bp, Artificial Sequence
  Description of Artificial Sequence: Synthetic oligonucleotide
cagttcgtgcagttcgacagcgacgca

SEQ ID NO: 45608 - DNA, 27 bp, Artificial Sequence
  Description of Artificial Sequence: Synthetic oligonucleotide
agttcgtgcagttcgacagcgacgcag

SEQ ID NO: 45609 - DNA, 26 bp, Artificial Sequence
  Description of Artificial Sequence: Synthetic oligonucleotide
gttcgtgcagttcgacagcgacgcag

SEQ ID NO: 45610 - DNA, 26 bp, Artificial Sequence
  Description of Artificial Sequence: Synthetic oligonucleotide
ttcgtgcagttcgacagcgacgcagc

SEQ ID NO: 45611 - DNA, 25 bp, Artificial Sequence
  Description of Artificial Sequence: Synthetic oligonucleotide
tcgtgcagttcgacagcgacgcagc

SEQ ID NO: 45612 - DNA, 24 bp, Artificial Sequence
  Description of Artificial Sequence: Synthetic oligonucleotide
cgtgcagttcgacagcgacgcagc

SEQ ID NO: 45613 - DNA, 25 bp, Artificial Sequence
  Description of Artificial Sequence: Synthetic oligonucleotide
gtgcagttcgacagcgacgcagcga

SEQ ID NO: 45614 - DNA, 26 bp, Artificial Sequence
  Description of Artificial Sequence: Synthetic oligonucleotide
tgcagttcgacagcgacgcagcgagt

SEQ ID NO: 45615 - DNA, 25 bp, Artificial Sequence
  Description of Artificial Sequence: Synthetic oligonucleotide
gcagttcgacagcgacgcagcgagt

SEQ ID NO: 45616 - DNA, 25 bp, Artificial Sequence
  Description of Artificial Sequence: Synthetic oligonucleotide
cagttcgacagcgacgcagcgagtc

SEQ ID NO: 45617 - DNA, 27 bp, Artificial Sequence
  Description of Artificial Sequence: Synthetic oligonucleotide
agttcgacagcgacgcagcgagtccaa

SEQ ID NO: 45618 - DNA, 26 bp, Artificial Sequence
  Description of Artificial Sequence: Synthetic oligonucleotide
gttcgacagcgacgcagcgagtccaa

SEQ ID NO: 45619 - DNA, 27 bp, Artificial Sequence
  Description of Artificial Sequence: Synthetic oligonucleotide
ttcgacagcgacgcagcgagtccaaga

SEQ ID NO: 45620 - DNA, 26 bp, Artificial Sequence
  Description of Artificial Sequence: Synthetic oligonucleotide
tcgacagcgacgcagcgagtccaaga

SEQ ID NO: 45621 - DNA, 25 bp, Artificial Sequence
  Description of Artificial Sequence: Synthetic oligonucleotide
cgacagcgacgcagcgagtccaaga

SEQ ID NO: 45622 - DNA, 25 bp, Artificial Sequence
  Description of Artificial Sequence: Synthetic oligonucleotide
gacagcgacgcagcgagtccaagag

SEQ ID NO: 45623 - DNA, 25 bp, Artificial Sequence
  Description of Artificial Sequence: Synthetic oligonucleotide
acagcgacgcagcgagtccaagagg

SEQ ID NO: 45624 - DNA, 24 bp, Artificial Sequence
  Description of Artificial Sequence: Synthetic oligonucleotide
cagcgacgcagcgagtccaagagg

SEQ ID NO: 45625 - DNA, 24 bp, Artificial Sequence
  Description of Artificial Sequence: Synthetic oligonucleotide
agcgacgcagcgagtccaagaggg

SEQ ID NO: 45626 - DNA, 23 bp, Artificial Sequence
  Description of Artificial Sequence: Synthetic oligonucleotide
gcgacgcagcgagtccaagaggg

SEQ ID NO: 45627 - DNA, 24 bp, Artificial Sequence
  Description of Artificial Sequence: Synthetic oligonucleotide
cgacgcagcgagtccaagagggga

SEQ ID NO: 45628 - DNA, 24 bp, Artificial Sequence
  Description of Artificial Sequence: Synthetic oligonucleotide
gacgcagcgagtccaagaggggag

SEQ ID NO: 45629 - DNA, 24 bp, Artificial Sequence
  Description of Artificial Sequence: Synthetic oligonucleotide
acgcagcgagtccaagaggggagc

SEQ ID NO: 45630 - DNA, 23 bp, Artificial Sequence
  Description of Artificial Sequence: Synthetic oligonucleotide
cgcagcgagtccaagaggggagc

SEQ ID NO: 45631 - DNA, 23 bp, Artificial Sequence
  Description of Artificial Sequence: Synthetic oligonucleotide
gcagcgagtccaagaggggagcc

SEQ ID NO: 45632 - DNA, 23 bp, Artificial Sequence
  Description of Artificial Sequence: Synthetic oligonucleotide
cagcgagtccaagaggggagccg

SEQ ID NO: 45633 - DNA, 23 bp, Artificial Sequence
  Description of Artificial Sequence: Synthetic oligonucleotide
agcgagtccaagaggggagccgc

SEQ ID NO: 45634 - DNA, 25 bp, Artificial Sequence
  Description of Artificial Sequence: Synthetic oligonucleotide
gatgtatggctgcgacctggggcca

SEQ ID NO: 45635 - DNA, 26 bp, Artificial Sequence
  Description of Artificial Sequence: Synthetic oligonucleotide
atgtatggctgcgacctggggccaga

SEQ ID NO: 45636 - DNA, 25 bp, Artificial Sequence
  Description of Artificial Sequence: Synthetic oligonucleotide
tgtatggctgcgacctggggccaga

SEQ ID NO: 45637 - DNA, 24 bp, Artificial Sequence
  Description of Artificial Sequence: Synthetic oligonucleotide
gtatggctgcgacctggggccaga

SEQ ID NO: 45638 - DNA, 24 bp, Artificial Sequence
  Description of Artificial Sequence: Synthetic oligonucleotide
tatggctgcgacctggggccagac

SEQ ID NO: 45639 - DNA, 23 bp, Artificial Sequence
  Description of Artificial Sequence: Synthetic oligonucleotide
atggctgcgacctggggccagac

SEQ ID NO: 45640 - DNA, 22 bp, Artificial Sequence
  Description of Artificial Sequence: Synthetic oligonucleotide
tggctgcgacctggggccagac

SEQ ID NO: 45641 - DNA, 21 bp, Artificial Sequence
  Description of Artificial Sequence: Synthetic oligonucleotide
ggctgcgacctggggccagac

SEQ ID NO: 45642 - DNA, 21 bp, Artificial Sequence
  Description of Artificial Sequence: Synthetic oligonucleotide
gctgcgacctggggccagacg

SEQ ID NO: 45643 - DNA, 21 bp, Artificial Sequence
  Description of Artificial Sequence: Synthetic oligonucleotide
ctgcgacctggggccagacgg

SEQ ID NO: 45644 - DNA, 21 bp, Artificial Sequence
  Description of Artificial Sequence: Synthetic oligonucleotide
tgcgacctggggccagacggg

SEQ ID NO: 45645 - DNA, 20 bp, Artificial Sequence
  Description of Artificial Sequence: Synthetic oligonucleotide
gcgacctggggccagacggg

SEQ ID NO: 45646 - DNA, 20 bp, Artificial Sequence
  Description of Artificial Sequence: Synthetic oligonucleotide
cgacctggggccagacgggc

SEQ ID NO: 45647 - DNA, 20 bp, Artificial Sequence
  Description of Artificial Sequence: Synthetic oligonucleotide
gacctggggccagacgggcg

SEQ ID NO: 45648 - DNA, 20 bp, Artificial Sequence
  Description of Artificial Sequence: Synthetic oligonucleotide
acctggggccagacgggcgc

SEQ ID NO: 45649 - DNA, 20 bp, Artificial Sequence
  Description of Artificial Sequence: Synthetic oligonucleotide
cctggggccagacgggcgct

SEQ ID NO: 45650 - DNA, 20 bp, Artificial Sequence
  Description of Artificial Sequence: Synthetic oligonucleotide
ctggggccagacgggcgcct

SEQ ID NO: 45651 - DNA, 20 bp, Artificial Sequence
  Description of Artificial Sequence: Synthetic oligonucleotide
tggggccagacgggcgcctc

SEQ ID NO: 45652 - DNA, 20 bp, Artificial Sequence
  Description of Artificial Sequence: Synthetic oligonucleotide
ggggccagacgggcgcctct

SEQ ID NO: 45653 - DNA, 20 bp, Artificial Sequence
  Description of Artificial Sequence: Synthetic oligonucleotide
gggccagacgggcgcctcct

SEQ ID NO: 45654 - DNA, 20 bp, Artificial Sequence
  Description of Artificial Sequence: Synthetic oligonucleotide
ggccagacgggcgcctcctc

SEQ ID NO: 45655 - DNA, 20 bp, Artificial Sequence
  Description of Artificial Sequence: Synthetic oligonucleotide
gccagacgggcgcctcctcc

SEQ ID NO: 45656 - DNA, 20 bp, Artificial Sequence
  Description of Artificial Sequence: Synthetic oligonucleotide
ccagacgggcgcctcctccg

SEQ ID NO: 45657 - DNA, 20 bp, Artificial Sequence
  Description of Artificial Sequence: Synthetic oligonucleotide
cagacgggcgcctcctccgc

SEQ ID NO: 45658 - DNA, 20 bp, Artificial Sequence
  Description of Artificial Sequence: Synthetic oligonucleotide
agacgggcgcctcctccgcg

SEQ ID NO: 45659 - DNA, 24 bp, Artificial Sequence
  Description of Artificial Sequence: Synthetic oligonucleotide
gaagaagacgctgcagcgcgcgga

SEQ ID NO: 45660 - DNA, 24 bp, Artificial Sequence
  Description of Artificial Sequence: Synthetic oligonucleotide
aagaagacgctgcagcgcgcggac

SEQ ID NO: 45661 - DNA, 23 bp, Artificial Sequence
  Description of Artificial Sequence: Synthetic oligonucleotide
agaagacgctgcagcgcgcggac

SEQ ID NO: 45662 - DNA, 22 bp, Artificial Sequence
  Description of Artificial Sequence: Synthetic oligonucleotide
gaagacgctgcagcgcgcggac

SEQ ID NO: 45663 - DNA, 22 bp, Artificial Sequence
  Description of Artificial Sequence: Synthetic oligonucleotide
aagacgctgcagcgcgcggacc

SEQ ID NO: 45664 - DNA, 20 bp, Artificial Sequence
  Description of Artificial Sequence: Synthetic oligonucleotide
aggggagccgcgggcgcgtt

SEQ ID NO: 45665 - DNA, 20 bp, Artificial Sequence
  Description of Artificial Sequence: Synthetic oligonucleotide
ggggagccgcgggcgcgttt

SEQ ID NO: 45666 - DNA, 20 bp, Artificial Sequence
  Description of Artificial Sequence: Synthetic oligonucleotide
gggagccgcgggcgcggttt

SEQ ID NO: 45667 - DNA, 20 bp, Artificial Sequence
  Description of Artificial Sequence: Synthetic oligonucleotide
gagccgcgggcgcggtggtt

SEQ ID NO: 45668 - DNA, 20 bp, Artificial Sequence
  Description of Artificial Sequence: Synthetic oligonucleotide
agccgcgggcgcggtgggtt

SEQ ID NO: 45669 - DNA, 20 bp, Artificial Sequence
  Description of Artificial Sequence: Synthetic oligonucleotide
gccgcgggcgcggtgggttt

SEQ ID NO: 45670 - DNA, 20 bp, Artificial Sequence
  Description of Artificial Sequence: Synthetic oligonucleotide
ccgcgggcgcggtgggtgtt

SEQ ID NO: 45671 - DNA, 20 bp, Artificial Sequence
  Description of Artificial Sequence: Synthetic oligonucleotide
cgcgggcgcggtgggtggat

SEQ ID NO: 45672 - DNA, 20 bp, Artificial Sequence
  Description of Artificial Sequence: Synthetic oligonucleotide
gcgggcgcggtgggtggagt

SEQ ID NO: 45673 - DNA, 20 bp, Artificial Sequence
  Description of Artificial Sequence: Synthetic oligonucleotide
cgggcgcggtgggtggagca

SEQ ID NO: 45674 - DNA, 20 bp, Artificial Sequence
  Description of Artificial Sequence: Synthetic oligonucleotide
gggcgcggtgggtggagcag

SEQ ID NO: 45675 - DNA, 21 bp, Artificial Sequence
  Description of Artificial Sequence: Synthetic oligonucleotide
ggcgcggtgggtggagcagga

SEQ ID NO: 45676 - DNA, 21 bp, Artificial Sequence
  Description of Artificial Sequence: Synthetic oligonucleotide
gcgcggtgggtggagcaggag

SEQ ID NO: 45677 - DNA, 21 bp, Artificial Sequence
  Description of Artificial Sequence: Synthetic oligonucleotide
cgcggtgggtggagcaggagg

SEQ ID NO: 45678 - DNA, 21 bp, Artificial Sequence
  Description of Artificial Sequence: Synthetic oligonucleotide
gcggtgggtggagcaggaggg

SEQ ID NO: 45679 - DNA, 21 bp, Artificial Sequence
  Description of Artificial Sequence: Synthetic oligonucleotide
cggtgggtggagcaggagggg

SEQ ID NO: 45680 - DNA, 21 bp, Artificial Sequence
  Description of Artificial Sequence: Synthetic oligonucleotide
ggtgggtggagcaggaggggc

SEQ ID NO: 45681 - DNA, 22 bp, Artificial Sequence
  Description of Artificial Sequence: Synthetic oligonucleotide
cagagcgaggccgggtctcacc

SEQ ID NO: 45682 - DNA, 23 bp, Artificial Sequence
  Description of Artificial Sequence: Synthetic oligonucleotide
agagcgaggccgggtctcaccct

SEQ ID NO: 45683 - DNA, 22 bp, Artificial Sequence
  Description of Artificial Sequence: Synthetic oligonucleotide
gagcgaggccgggtctcaccct

SEQ ID NO: 45684 - DNA, 22 bp, Artificial Sequence
  Description of Artificial Sequence: Synthetic oligonucleotide
agcgaggccgggtctcaccctc

SEQ ID NO: 45685 - DNA, 21 bp, Artificial Sequence
  Description of Artificial Sequence: Synthetic oligonucleotide
gcgaggccgggtctcaccctc

SEQ ID NO: 45686 - DNA, 22 bp, Artificial Sequence
  Description of Artificial Sequence: Synthetic oligonucleotide
cgaggccgggtctcaccctcca

SEQ ID NO: 45687 - DNA, 23 bp, Artificial Sequence
  Description of Artificial Sequence: Synthetic oligonucleotide
gaggccgggtctcaccctccaga

SEQ ID NO: 45688 - DNA, 23 bp, Artificial Sequence
  Description of Artificial Sequence: Synthetic oligonucleotide
aggccgggtctcaccctccagag

SEQ ID NO: 45689 - DNA, 22 bp, Artificial Sequence
  Description of Artificial Sequence: Synthetic oligonucleotide
ggccgggtctcaccctccagag

SEQ ID NO: 45690 - DNA, 24 bp, Artificial Sequence
  Description of Artificial Sequence: Synthetic oligonucleotide
gccgggtctcaccctccagaggat

SEQ ID NO: 45691 - DNA, 27 bp, Artificial Sequence
  Description of Artificial Sequence: Synthetic oligonucleotide
ccgggtctcaccctccagaggatgtat

SEQ ID NO: 45692 - DNA, 27 bp, Artificial Sequence
  Description of Artificial Sequence: Synthetic oligonucleotide
cgggtctcaccctccagaggatgtatg

SEQ ID NO: 45693 - DNA, 27 bp, Artificial Sequence
  Description of Artificial Sequence: Synthetic oligonucleotide
gggtctcaccctccagaggatgtatgg

SEQ ID NO: 45694 - DNA, 27 bp, Artificial Sequence
  Description of Artificial Sequence: Synthetic oligonucleotide
ggtctcaccctccagaggatgtatggc

SEQ ID NO: 45695 - DNA, 28 bp, Artificial Sequence
  Description of Artificial Sequence: Synthetic oligonucleotide
gtctcaccctccagaggatgtatggctg

SEQ ID NO: 45696 - DNA, 28 bp, Artificial Sequence
  Description of Artificial Sequence: Synthetic oligonucleotide
tctcaccctccagaggatgtatggctgc

SEQ ID NO: 45697 - DNA, 27 bp, Artificial Sequence
  Description of Artificial Sequence: Synthetic oligonucleotide
ctcaccctccagaggatgtatggctgc

SEQ ID NO: 45698 - DNA, 27 bp, Artificial Sequence
  Description of Artificial Sequence: Synthetic oligonucleotide
tcaccctccagaggatgtatggctgcg

SEQ ID NO: 45699 - DNA, 27 bp, Artificial Sequence
  Description of Artificial Sequence: Synthetic oligonucleotide
ggtatttctacaccgccgtgtcccgga

SEQ ID NO: 45700 - DNA, 27 bp, Artificial Sequence
  Description of Artificial Sequence: Synthetic oligonucleotide
gtatttctacaccgccgtgtcccggac

SEQ ID NO: 45701 - DNA, 27 bp, Artificial Sequence
  Description of Artificial Sequence: Synthetic oligonucleotide
tatttctacaccgccgtgtcccggacc

SEQ ID NO: 45702 - DNA, 26 bp, Artificial Sequence
  Description of Artificial Sequence: Synthetic oligonucleotide
atttctacaccgccgtgtcccggacc

SEQ ID NO: 45703 - DNA, 25 bp, Artificial Sequence
  Description of Artificial Sequence: Synthetic oligonucleotide
tttctacaccgccgtgtcccggacc

SEQ ID NO: 45704 - DNA, 24 bp, Artificial Sequence
  Description of Artificial Sequence: Synthetic oligonucleotide
ttctacaccgccgtgtcccggacc

SEQ ID NO: 45705 - DNA, 23 bp, Artificial Sequence
  Description of Artificial Sequence: Synthetic oligonucleotide
tctacaccgccgtgtcccggacc

SEQ ID NO: 45706 - DNA, 22 bp, Artificial Sequence
  Description of Artificial Sequence: Synthetic oligonucleotide
ctacaccgccgtgtcccggacc

SEQ ID NO: 45707 - DNA, 22 bp, Artificial Sequence
  Description of Artificial Sequence: Synthetic oligonucleotide
tacaccgccgtgtcccggaccg

SEQ ID NO: 45708 - DNA, 21 bp, Artificial Sequence
  Description of Artificial Sequence: Synthetic oligonucleotide
acaccgccgtgtcccggaccg

SEQ ID NO: 45709 - DNA, 20 bp, Artificial Sequence
  Description of Artificial Sequence: Synthetic oligonucleotide
caccgccgtgtcccggaccg

SEQ ID NO: 45710 - DNA, 20 bp, Artificial Sequence
  Description of Artificial Sequence: Synthetic oligonucleotide
accgccgtgtcccggaccgg

SEQ ID NO: 45711 - DNA, 20 bp, Artificial Sequence
  Description of Artificial Sequence: Synthetic oligonucleotide
ccgccgtgtcccggaccggt

SEQ ID NO: 45712 - DNA, 20 bp, Artificial Sequence
  Description of Artificial Sequence: Synthetic oligonucleotide
cgccgtgtcccggaccggct

SEQ ID NO: 45713 - DNA, 20 bp, Artificial Sequence
  Description of Artificial Sequence: Synthetic oligonucleotide
gccgtgtcccggaccggcct

SEQ ID NO: 45714 - DNA, 20 bp, Artificial Sequence
  Description of Artificial Sequence: Synthetic oligonucleotide
ccgtgtcccggaccggccgt

SEQ ID NO: 45715 - DNA, 20 bp, Artificial Sequence
  Description of Artificial Sequence: Synthetic oligonucleotide
cgtgtcccggaccggccgct

SEQ ID NO: 45716 - DNA, 20 bp, Artificial Sequence
  Description of Artificial Sequence: Synthetic oligonucleotide
gtgtcccggaccggccgcgt

SEQ ID NO: 45717 - DNA, 20 bp, Artificial Sequence
  Description of Artificial Sequence: Synthetic oligonucleotide
tgtcccggaccggccgcgga

SEQ ID NO: 45718 - DNA, 20 bp, Artificial Sequence
  Description of Artificial Sequence: Synthetic oligonucleotide
gtcccggaccggccgcggat

SEQ ID NO: 45719 - DNA, 20 bp, Artificial Sequence
  Description of Artificial Sequence: Synthetic oligonucleotide
tcccggaccggccgcggaga

SEQ ID NO: 45720 - DNA, 20 bp, Artificial Sequence
  Description of Artificial Sequence: Synthetic oligonucleotide
cccggaccggccgcggagat

SEQ ID NO: 45721 - DNA, 20 bp, Artificial Sequence
  Description of Artificial Sequence: Synthetic oligonucleotide
ccggaccggccgcggagagt

SEQ ID NO: 45722 - DNA, 20 bp, Artificial Sequence
  Description of Artificial Sequence: Synthetic oligonucleotide
cggaccggccgcggagagct

SEQ ID NO: 45723 - DNA, 20 bp, Artificial Sequence
  Description of Artificial Sequence: Synthetic oligonucleotide
ggaccggccgcggagagcct

SEQ ID NO: 45724 - DNA, 20 bp, Artificial Sequence
  Description of Artificial Sequence: Synthetic oligonucleotide
gaccggccgcggagagccct

SEQ ID NO: 45725 - DNA, 20 bp, Artificial Sequence
  Description of Artificial Sequence: Synthetic oligonucleotide
accggccgcggagagcccct

SEQ ID NO: 45726 - DNA, 30 bp, Artificial Sequence
  Description of Artificial Sequence: Synthetic oligonucleotide
ttcgcctacgacggcaaggattacatcgtc

SEQ ID NO: 45727 - DNA, 29 bp, Artificial Sequence
  Description of Artificial Sequence: Synthetic oligonucleotide
tcgcctacgacggcaaggattacatcgtc

SEQ ID NO: 45728 - DNA, 32 bp, Artificial Sequence
  Description of Artificial Sequence: Synthetic oligonucleotide
ctacgacggcaaggattacatcgtcctgaatg

SEQ ID NO: 45729 - DNA, 33 bp, Artificial Sequence
  Description of Artificial Sequence: Synthetic oligonucleotide
tacgacggcaaggattacatcgtcctgaatgag

SEQ ID NO: 45730 - DNA, 32 bp, Artificial Sequence
  Description of Artificial Sequence: Synthetic oligonucleotide
acgacggcaaggattacatcgtcctgaatgag

SEQ ID NO: 45731 - DNA, 31 bp, Artificial Sequence
  Description of Artificial Sequence: Synthetic oligonucleotide
cgacggcaaggattacatcgtcctgaatgag

SEQ ID NO: 45732 - DNA, 31 bp, Artificial Sequence
  Description of Artificial Sequence: Synthetic oligonucleotide
gacggcaaggattacatcgtcctgaatgagg

SEQ ID NO: 45733 - DNA, 32 bp, Artificial Sequence
  Description of Artificial Sequence: Synthetic oligonucleotide
acggcaaggattacatcgtcctgaatgaggac

SEQ ID NO: 45734 - DNA, 31 bp, Artificial Sequence
  Description of Artificial Sequence: Synthetic oligonucleotide
cggcaaggattacatcgtcctgaatgaggac

SEQ ID NO: 45735 - DNA, 31 bp, Artificial Sequence
  Description of Artificial Sequence: Synthetic oligonucleotide
ggcaaggattacatcgtcctgaatgaggacc

SEQ ID NO: 45736 - DNA, 32 bp, Artificial Sequence
  Description of Artificial Sequence: Synthetic oligonucleotide
gcaaggattacatcgtcctgaatgaggacctg

SEQ ID NO: 45737 - DNA, 32 bp, Artificial Sequence
  Description of Artificial Sequence: Synthetic oligonucleotide
caaggattacatcgtcctgaatgaggacctgc

SEQ ID NO: 45738 - DNA, 32 bp, Artificial Sequence
  Description of Artificial Sequence: Synthetic oligonucleotide
aaggattacatcgtcctgaatgaggacctgcg

SEQ ID NO: 45739 - DNA, 31 bp, Artificial Sequence
  Description of Artificial Sequence: Synthetic oligonucleotide
aggattacatcgtcctgaatgaggacctgcg

SEQ ID NO: 45740 - DNA, 30 bp, Artificial Sequence
  Description of Artificial Sequence: Synthetic oligonucleotide
ggattacatcgtcctgaatgaggacctgcg

SEQ ID NO: 45741 - DNA, 30 bp, Artificial Sequence
  Description of Artificial Sequence: Synthetic oligonucleotide
gattacatcgtcctgaatgaggacctgcgc

SEQ ID NO: 45742 - DNA, 31 bp, Artificial Sequence
  Description of Artificial Sequence: Synthetic oligonucleotide
attacatcgtcctgaatgaggacctgcgctc

SEQ ID NO: 45743 - DNA, 30 bp, Artificial Sequence
  Description of Artificial Sequence: Synthetic oligonucleotide
ttacatcgtcctgaatgaggacctgcgctc

SEQ ID NO: 45744 - DNA, 29 bp, Artificial Sequence
  Description of Artificial Sequence: Synthetic oligonucleotide
tacatcgtcctgaatgaggacctgcgctc

SEQ ID NO: 45745 - DNA, 28 bp, Artificial Sequence
  Description of Artificial Sequence: Synthetic oligonucleotide
acatcgtcctgaatgaggacctgcgctc

SEQ ID NO: 45746 - DNA, 27 bp, Artificial Sequence
  Description of Artificial Sequence: Synthetic oligonucleotide
catcgtcctgaatgaggacctgcgctc

SEQ ID NO: 45747 - DNA, 27 bp, Artificial Sequence
  Description of Artificial Sequence: Synthetic oligonucleotide
atcgtcctgaatgaggacctgcgctcc

SEQ ID NO: 45748 - DNA, 27 bp, Artificial Sequence
  Description of Artificial Sequence: Synthetic oligonucleotide
tcgtcctgaatgaggacctgcgctcct

SEQ ID NO: 45749 - DNA, 26 bp, Artificial Sequence
  Description of Artificial Sequence: Synthetic oligonucleotide
cgtcctgaatgaggacctgcgctcct

SEQ ID NO: 45750 - DNA, 26 bp, Artificial Sequence
  Description of Artificial Sequence: Synthetic oligonucleotide
gtcctgaatgaggacctgcgctcctg

SEQ ID NO: 45751 - DNA, 27 bp, Artificial Sequence
  Description of Artificial Sequence: Synthetic oligonucleotide
tcctgaatgaggacctgcgctcctgga

SEQ ID NO: 45752 - DNA, 25 bp, Artificial Sequence
  Description of Artificial Sequence: Synthetic oligonucleotide
gaaggagacgctgcagcgcgcagaa

SEQ ID NO: 45753 - DNA, 26 bp, Artificial Sequence
  Description of Artificial Sequence: Synthetic oligonucleotide
aaggagacgctgcagcgcgcagaaca

SEQ ID NO: 45754 - DNA, 25 bp, Artificial Sequence
  Description of Artificial Sequence: Synthetic oligonucleotide
aggagacgctgcagcgcgcagaaca

SEQ ID NO: 45755 - DNA, 24 bp, Artificial Sequence
  Description of Artificial Sequence: Synthetic oligonucleotide
ggagacgctgcagcgcgcagaaca

SEQ ID NO: 45756 - DNA, 24 bp, Artificial Sequence
  Description of Artificial Sequence: Synthetic oligonucleotide
gagacgctgcagcgcgcagaacac

SEQ ID NO: 45757 - DNA, 24 bp, Artificial Sequence
  Description of Artificial Sequence: Synthetic oligonucleotide
agacgctgcagcgcgcagaacacc

SEQ ID NO: 45758 - DNA, 23 bp, Artificial Sequence
  Description of Artificial Sequence: Synthetic oligonucleotide
gacgctgcagcgcgcagaacacc

SEQ ID NO: 45759 - DNA, 26 bp, Artificial Sequence
  Description of Artificial Sequence: Synthetic oligonucleotide
acgctgcagcgcgcagaacacccaaa

SEQ ID NO: 45760 - DNA, 25 bp, Artificial Sequence
  Description of Artificial Sequence: Synthetic oligonucleotide
cgctgcagcgcgcagaacacccaaa

SEQ ID NO: 45761 - DNA, 26 bp, Artificial Sequence
  Description of Artificial Sequence: Synthetic oligonucleotide
gctgcagcgcgcagaacacccaaaga

SEQ ID NO: 45762 - DNA, 27 bp, Artificial Sequence
  Description of Artificial Sequence: Synthetic oligonucleotide
ctgcagcgcgcagaacacccaaagaca

SEQ ID NO: 45763 - DNA, 27 bp, Artificial Sequence
  Description of Artificial Sequence: Synthetic oligonucleotide
tgcagcgcgcagaacacccaaagacac

SEQ ID NO: 45764 - DNA, 27 bp, Artificial Sequence
  Description of Artificial Sequence: Synthetic oligonucleotide
gcagcgcgcagaacacccaaagacaca

SEQ ID NO: 45765 - DNA, 27 bp, Artificial Sequence
  Description of Artificial Sequence: Synthetic oligonucleotide
cagcgcgcagaacacccaaagacacac

SEQ ID NO: 45766 - DNA, 27 bp, Artificial Sequence
  Description of Artificial Sequence: Synthetic oligonucleotide
agcgcgcagaacacccaaagacacacg

SEQ ID NO: 45767 - DNA, 27 bp, Artificial Sequence
  Description of Artificial Sequence: Synthetic oligonucleotide
gcgcgcagaacacccaaagacacacgt

SEQ ID NO: 45768 - DNA, 27 bp, Artificial Sequence
  Description of Artificial Sequence: Synthetic oligonucleotide
cgcgcagaacacccaaagacacacgtg

SEQ ID NO: 45769 - DNA, 28 bp, Artificial Sequence
  Description of Artificial Sequence: Synthetic oligonucleotide
gcgcagaacacccaaagacacacgtgac

SEQ ID NO: 45770 - DNA, 28 bp, Artificial Sequence
  Description of Artificial Sequence: Synthetic oligonucleotide
cgcagaacacccaaagacacacgtgacc

SEQ ID NO: 45771 - DNA, 28 bp, Artificial Sequence
  Description of Artificial Sequence: Synthetic oligonucleotide
gcagaacacccaaagacacacgtgaccc

SEQ ID NO: 45772 - DNA, 29 bp, Artificial Sequence
  Description of Artificial Sequence: Synthetic oligonucleotide
cagaacacccaaagacacacgtgacccac

SEQ ID NO: 45773 - DNA, 29 bp, Artificial Sequence
  Description of Artificial Sequence: Synthetic oligonucleotide
agaacacccaaagacacacgtgacccacc

SEQ ID NO: 45774 - DNA, 23 bp, Artificial Sequence
  Description of Artificial Sequence: Synthetic oligonucleotide
gggcgcctcctccgccggtataa

SEQ ID NO: 45775 - DNA, 23 bp, Artificial Sequence
  Description of Artificial Sequence: Synthetic oligonucleotide
ggcgcctcctccgccggtataac

SEQ ID NO: 45776 - DNA, 24 bp, Artificial Sequence
  Description of Artificial Sequence: Synthetic oligonucleotide
gcgcctcctccgccggtataacca

SEQ ID NO: 45777 - DNA, 26 bp, Artificial Sequence
  Description of Artificial Sequence: Synthetic oligonucleotide
cgcctcctccgccggtataaccagtt

SEQ ID NO: 45778 - DNA, 26 bp, Artificial Sequence
  Description of Artificial Sequence: Synthetic oligonucleotide
gcctcctccgccggtataaccagttc

SEQ ID NO: 45779 - DNA, 26 bp, Artificial Sequence
  Description of Artificial Sequence: Synthetic oligonucleotide
cctcctccgccggtataaccagttcg

SEQ ID NO: 45780 - DNA, 26 bp, Artificial Sequence
  Description of Artificial Sequence: Synthetic oligonucleotide
ctcctccgccggtataaccagttcgc

SEQ ID NO: 45781 - DNA, 27 bp, Artificial Sequence
  Description of Artificial Sequence: Synthetic oligonucleotide
tcctccgccggtataaccagttcgcct

SEQ ID NO: 45782 - DNA, 27 bp, Artificial Sequence
  Description of Artificial Sequence: Synthetic oligonucleotide
cctccgccggtataaccagttcgccta

SEQ ID NO: 45783 - DNA, 27 bp, Artificial Sequence
  Description of Artificial Sequence: Synthetic oligonucleotide
ctccgccggtataaccagttcgcctac

SEQ ID NO: 45784 - DNA, 27 bp, Artificial Sequence
  Description of Artificial Sequence: Synthetic oligonucleotide
tccgccggtataaccagttcgcctacg

SEQ ID NO: 45785 - DNA, 27 bp, Artificial Sequence
  Description of Artificial Sequence: Synthetic oligonucleotide
ccgccggtataaccagttcgcctacga

SEQ ID NO: 45786 - DNA, 27 bp, Artificial Sequence
  Description of Artificial Sequence: Synthetic oligonucleotide
cgccggtataaccagttcgcctacgac

SEQ ID NO: 45787 - DNA, 27 bp, Artificial Sequence
  Description of Artificial Sequence: Synthetic oligonucleotide
gccggtataaccagttcgcctacgacg

SEQ ID NO: 45788 - DNA, 27 bp, Artificial Sequence
  Description of Artificial Sequence: Synthetic oligonucleotide
ccggtataaccagttcgcctacgacgg

SEQ ID NO: 45789 - DNA, 27 bp, Artificial Sequence
  Description of Artificial Sequence: Synthetic oligonucleotide
cggtataaccagttcgcctacgacggc

SEQ ID NO: 45790 - DNA, 28 bp, Artificial Sequence
  Description of Artificial Sequence: Synthetic oligonucleotide
acagactgaccgagtgaacctgcggaac

SEQ ID NO: 45791 - DNA, 27 bp, Artificial Sequence
  Description of Artificial Sequence: Synthetic oligonucleotide
cagactgaccgagtgaacctgcggaac

SEQ ID NO: 45792 - DNA, 27 bp, Artificial Sequence
  Description of Artificial Sequence: Synthetic oligonucleotide
agactgaccgagtgaacctgcggaacc

SEQ ID NO: 45793 - DNA, 27 bp, Artificial Sequence
  Description of Artificial Sequence: Synthetic oligonucleotide
gactgaccgagtgaacctgcggaacct

SEQ ID NO: 45794 - DNA, 27 bp, Artificial Sequence
  Description of Artificial Sequence: Synthetic oligonucleotide
actgaccgagtgaacctgcggaacctg

SEQ ID NO: 45795 - DNA, 26 bp, Artificial Sequence
  Description of Artificial Sequence: Synthetic oligonucleotide
ctgaccgagtgaacctgcggaacctg

SEQ ID NO: 45796 - DNA, 26 bp, Artificial Sequence
  Description of Artificial Sequence: Synthetic oligonucleotide
tgaccgagtgaacctgcggaacctgc

SEQ ID NO: 45797 - DNA, 25 bp, Artificial Sequence
  Description of Artificial Sequence: Synthetic oligonucleotide
gaccgagtgaacctgcggaacctgc

SEQ ID NO: 45798 - DNA, 21 bp, Artificial Sequence
  Description of Artificial Sequence: Synthetic oligonucleotide
tccaagaggggagccgcgggg

SEQ ID NO: 45799 - DNA, 20 bp, Artificial Sequence
  Description of Artificial Sequence: Synthetic oligonucleotide
ccaagaggggagccgcgggg

SEQ ID NO: 45800 - DNA, 20 bp, Artificial Sequence
  Description of Artificial Sequence: Synthetic oligonucleotide
caagaggggagccgcggggg

SEQ ID NO: 45801 - DNA, 20 bp, Artificial Sequence
  Description of Artificial Sequence: Synthetic oligonucleotide
aagaggggagccgcgggggc

SEQ ID NO: 45802 - DNA, 20 bp, Artificial Sequence
  Description of Artificial Sequence: Synthetic oligonucleotide
agaggggagccgcgggggct

SEQ ID NO: 45803 - DNA, 20 bp, Artificial Sequence
  Description of Artificial Sequence: Synthetic oligonucleotide
gaggggagccgcgggggctt

SEQ ID NO: 45804 - DNA, 20 bp, Artificial Sequence
  Description of Artificial Sequence: Synthetic oligonucleotide
aggggagccgcgggggcctt

SEQ ID NO: 45805 - DNA, 20 bp, Artificial Sequence
  Description of Artificial Sequence: Synthetic oligonucleotide
ggggagccgcgggggccttt

SEQ ID NO: 45806 - DNA, 20 bp, Artificial Sequence
  Description of Artificial Sequence: Synthetic oligonucleotide
gggagccgcgggggccgttt

SEQ ID NO: 45807 - DNA, 20 bp, Artificial Sequence
  Description of Artificial Sequence: Synthetic oligonucleotide
gagccgcgggggccgtggtt

SEQ ID NO: 45808 - DNA, 20 bp, Artificial Sequence
  Description of Artificial Sequence: Synthetic oligonucleotide
agccgcgggggccgtgggtt

SEQ ID NO: 45809 - DNA, 20 bp, Artificial Sequence
  Description of Artificial Sequence: Synthetic oligonucleotide
gccgcgggggccgtgggttt

SEQ ID NO: 45810 - DNA, 20 bp, Artificial Sequence
  Description of Artificial Sequence: Synthetic oligonucleotide
ccgcgggggccgtgggtgtt

SEQ ID NO: 45811 - DNA, 20 bp, Artificial Sequence
  Description of Artificial Sequence: Synthetic oligonucleotide
cgcgggggccgtgggtggat

SEQ ID NO: 45812 - DNA, 20 bp, Artificial Sequence
  Description of Artificial Sequence: Synthetic oligonucleotide
gcgggggccgtgggtggagt

SEQ ID NO: 45813 - DNA, 20 bp, Artificial Sequence
  Description of Artificial Sequence: Synthetic oligonucleotide
cgggggccgtgggtggagca

SEQ ID NO: 45814 - DNA, 20 bp, Artificial Sequence
  Description of Artificial Sequence: Synthetic oligonucleotide
gggggccgtgggtggagcag

SEQ ID NO: 45815 - DNA, 21 bp, Artificial Sequence
  Description of Artificial Sequence: Synthetic oligonucleotide
ggggccgtgggtggagcagga

SEQ ID NO: 45816 - DNA, 21 bp, Artificial Sequence
  Description of Artificial Sequence: Synthetic oligonucleotide
gggccgtgggtggagcaggag

SEQ ID NO: 45817 - DNA, 21 bp, Artificial Sequence
  Description of Artificial Sequence: Synthetic oligonucleotide
ggccgtgggtggagcaggagg

SEQ ID NO: 45818 - DNA, 22 bp, Artificial Sequence
  Description of Artificial Sequence: Synthetic oligonucleotide
tacaccgccgtgtcccggccca

SEQ ID NO: 45819 - DNA, 21 bp, Artificial Sequence
  Description of Artificial Sequence: Synthetic oligonucleotide
acaccgccgtgtcccggccca

SEQ ID NO: 45820 - DNA, 20 bp, Artificial Sequence
  Description of Artificial Sequence: Synthetic oligonucleotide
caccgccgtgtcccggccca

SEQ ID NO: 45821 - DNA, 20 bp, Artificial Sequence
  Description of Artificial Sequence: Synthetic oligonucleotide
accgccgtgtcccggcccag

SEQ ID NO: 45822 - DNA, 20 bp, Artificial Sequence
  Description of Artificial Sequence: Synthetic oligonucleotide
ccgccgtgtcccggcccagt

SEQ ID NO: 45823 - DNA, 20 bp, Artificial Sequence
  Description of Artificial Sequence: Synthetic oligonucleotide
cgccgtgtcccggcccagct

SEQ ID NO: 45824 - DNA, 20 bp, Artificial Sequence
  Description of Artificial Sequence: Synthetic oligonucleotide
gccgtgtcccggcccagcct

SEQ ID NO: 45825 - DNA, 20 bp, Artificial Sequence
  Description of Artificial Sequence: Synthetic oligonucleotide
ccgtgtcccggcccagccgt

SEQ ID NO: 45826 - DNA, 20 bp, Artificial Sequence
  Description of Artificial Sequence: Synthetic oligonucleotide
cgtgtcccggcccagccgct

SEQ ID NO: 45827 - DNA, 25 bp, Artificial Sequence
  Description of Artificial Sequence: Synthetic oligonucleotide
cgcttcatcgcagtgggctacgtgg

SEQ ID NO: 45828 - DNA, 25 bp, Artificial Sequence
  Description of Artificial Sequence: Synthetic oligonucleotide
gcttcatcgcagtgggctacgtggg

SEQ ID NO: 45829 - DNA, 25 bp, Artificial Sequence
  Description of Artificial Sequence: Synthetic oligonucleotide
cttcatcgcagtgggctacgtgggc

SEQ ID NO: 45830 - DNA, 26 bp, Artificial Sequence
  Description of Artificial Sequence: Synthetic oligonucleotide
ttcatcgcagtgggctacgtgggcga

SEQ ID NO: 45831 - DNA, 25 bp, Artificial Sequence
  Description of Artificial Sequence: Synthetic oligonucleotide
tcatcgcagtgggctacgtgggcga

SEQ ID NO: 45832 - DNA, 24 bp, Artificial Sequence
  Description of Artificial Sequence: Synthetic oligonucleotide
catcgcagtgggctacgtgggcga

SEQ ID NO: 45833 - DNA, 25 bp, Artificial Sequence
  Description of Artificial Sequence: Synthetic oligonucleotide
atcgcagtgggctacgtgggcgaca

SEQ ID NO: 45834 - DNA, 24 bp, Artificial Sequence
  Description of Artificial Sequence: Synthetic oligonucleotide
tcgcagtgggctacgtgggcgaca

SEQ ID NO: 45835 - DNA, 23 bp, Artificial Sequence
  Description of Artificial Sequence: Synthetic oligonucleotide
cgcagtgggctacgtgggcgaca

SEQ ID NO: 45836 - DNA, 23 bp, Artificial Sequence
  Description of Artificial Sequence: Synthetic oligonucleotide
gcagtgggctacgtgggcgacac

SEQ ID NO: 45837 - DNA, 23 bp, Artificial Sequence
  Description of Artificial Sequence: Synthetic oligonucleotide
cagtgggctacgtgggcgacacg

SEQ ID NO: 45838 - DNA, 24 bp, Artificial Sequence
  Description of Artificial Sequence: Synthetic oligonucleotide
agtgggctacgtgggcgacacgca

SEQ ID NO: 45839 - DNA, 26 bp, Artificial Sequence
  Description of Artificial Sequence: Synthetic oligonucleotide
tacgtgggcgacacgcagttcgtgca

SEQ ID NO: 45840 - DNA, 25 bp, Artificial Sequence
  Description of Artificial Sequence: Synthetic oligonucleotide
acgtgggcgacacgcagttcgtgca

SEQ ID NO: 45841 - DNA, 24 bp, Artificial Sequence
  Description of Artificial Sequence: Synthetic oligonucleotide
cgtgggcgacacgcagttcgtgca

SEQ ID NO: 45842 - DNA, 26 bp, Artificial Sequence
  Description of Artificial Sequence: Synthetic oligonucleotide
gtgggcgacacgcagttcgtgcagtt

SEQ ID NO: 45843 - DNA, 26 bp, Artificial Sequence
  Description of Artificial Sequence: Synthetic oligonucleotide
tgggcgacacgcagttcgtgcagttc

SEQ ID NO: 45844 - DNA, 25 bp, Artificial Sequence
  Description of Artificial Sequence: Synthetic oligonucleotide
gggcgacacgcagttcgtgcagttc

SEQ ID NO: 45845 - DNA, 26 bp, Artificial Sequence
  Description of Artificial Sequence: Synthetic oligonucleotide
ggcgacacgcagttcgtgcagttcga

SEQ ID NO: 45846 - DNA, 27 bp, Artificial Sequence
  Description of Artificial Sequence: Synthetic oligonucleotide
gcgacacgcagttcgtgcagttcgaca

SEQ ID NO: 45847 - DNA, 27 bp, Artificial Sequence
  Description of Artificial Sequence: Synthetic oligonucleotide
acagactgaccgagtgaacctgcggag

SEQ ID NO: 45848 - DNA, 27 bp, Artificial Sequence
  Description of Artificial Sequence: Synthetic oligonucleotide
cagactgaccgagtgaacctgcggaga

SEQ ID NO: 45849 - DNA, 27 bp, Artificial Sequence
  Description of Artificial Sequence: Synthetic oligonucleotide
agactgaccgagtgaacctgcggagac

SEQ ID NO: 45850 - DNA, 27 bp, Artificial Sequence
  Description of Artificial Sequence: Synthetic oligonucleotide
gactgaccgagtgaacctgcggagact

SEQ ID NO: 45851 - DNA, 27 bp, Artificial Sequence
  Description of Artificial Sequence: Synthetic oligonucleotide
actgaccgagtgaacctgcggagactg

SEQ ID NO: 45852 - DNA, 26 bp, Artificial Sequence
  Description of Artificial Sequence: Synthetic oligonucleotide
ctgaccgagtgaacctgcggagactg

SEQ ID NO: 45853 - DNA, 26 bp, Artificial Sequence
  Description of Artificial Sequence: Synthetic oligonucleotide
tgaccgagtgaacctgcggagactgc

SEQ ID NO: 45854 - DNA, 25 bp, Artificial Sequence
  Description of Artificial Sequence: Synthetic oligonucleotide
gaccgagtgaacctgcggagactgc

SEQ ID NO: 45855 - DNA, 25 bp, Artificial Sequence
  Description of Artificial Sequence: Synthetic oligonucleotide
accgagtgaacctgcggagactgcg

SEQ ID NO: 45856 - DNA, 24 bp, Artificial Sequence
  Description of Artificial Sequence: Synthetic oligonucleotide
ccgagtgaacctgcggagactgcg

SEQ ID NO: 45857 - DNA, 24 bp, Artificial Sequence
  Description of Artificial Sequence: Synthetic oligonucleotide
cgagtgaacctgcggagactgcgc

SEQ ID NO: 45858 - DNA, 24 bp, Artificial Sequence
  Description of Artificial Sequence: Synthetic oligonucleotide
gagtgaacctgcggagactgcgcg

SEQ ID NO: 45859 - DNA, 24 bp, Artificial Sequence
  Description of Artificial Sequence: Synthetic oligonucleotide
agtgaacctgcggagactgcgcgg

SEQ ID NO: 45860 - DNA, 23 bp, Artificial Sequence
  Description of Artificial Sequence: Synthetic oligonucleotide
gtgaacctgcggagactgcgcgg

SEQ ID NO: 45861 - DNA, 25 bp, Artificial Sequence
  Description of Artificial Sequence: Synthetic oligonucleotide
tgaacctgcggagactgcgcggcta

SEQ ID NO: 45862 - DNA, 24 bp, Artificial Sequence
  Description of Artificial Sequence: Synthetic oligonucleotide
gaacctgcggagactgcgcggcta

SEQ ID NO: 45863 - DNA, 26 bp, Artificial Sequence
  Description of Artificial Sequence: Synthetic oligonucleotide
aacctgcggagactgcgcggctacta

SEQ ID NO: 45864 - DNA, 25 bp, Artificial Sequence
  Description of Artificial Sequence: Synthetic oligonucleotide
acctgcggagactgcgcggctacta

SEQ ID NO: 45865 - DNA, 24 bp, Artificial Sequence
  Description of Artificial Sequence: Synthetic oligonucleotide
cctgcggagactgcgcggctacta

SEQ ID NO: 45866 - DNA, 26 bp, Artificial Sequence
  Description of Artificial Sequence: Synthetic oligonucleotide
ctgcggagactgcgcggctactacaa

SEQ ID NO: 45867 - DNA, 26 bp, Artificial Sequence
  Description of Artificial Sequence: Synthetic oligonucleotide
tgcggagactgcgcggctactacaac

SEQ ID NO: 45868 - DNA, 25 bp, Artificial Sequence
  Description of Artificial Sequence: Synthetic oligonucleotide
gcggagactgcgcggctactacaac

SEQ ID NO: 45869 - DNA, 26 bp, Artificial Sequence
  Description of Artificial Sequence: Synthetic oligonucleotide
cggagactgcgcggctactacaacca

SEQ ID NO: 45870 - DNA, 27 bp, Artificial Sequence
  Description of Artificial Sequence: Synthetic oligonucleotide
ggagactgcgcggctactacaaccaga

SEQ ID NO: 45871 - DNA, 27 bp, Artificial Sequence
  Description of Artificial Sequence: Synthetic oligonucleotide
gagactgcgcggctactacaaccagag

SEQ ID NO: 45872 - DNA, 27 bp, Artificial Sequence
  Description of Artificial Sequence: Synthetic oligonucleotide
agactgcgcggctactacaaccagagc

SEQ ID NO: 45873 - DNA, 26 bp, Artificial Sequence
  Description of Artificial Sequence: Synthetic oligonucleotide
gactgcgcggctactacaaccagagc

SEQ ID NO: 45874 - DNA, 22 bp, Artificial Sequence
  Description of Artificial Sequence: Synthetic oligonucleotide
gtggagcaggaggggccggagt

SEQ ID NO: 45875 - DNA, 24 bp, Artificial Sequence
  Description of Artificial Sequence: Synthetic oligonucleotide
tggagcaggaggggccggagtgtt

SEQ ID NO: 45876 - DNA, 23 bp, Artificial Sequence
  Description of Artificial Sequence: Synthetic oligonucleotide
ggagcaggaggggccggagtgtt

SEQ ID NO: 45877 - DNA, 23 bp, Artificial Sequence
  Description of Artificial Sequence: Synthetic oligonucleotide
gagcaggaggggccggagtgttg

SEQ ID NO: 45878 - DNA, 23 bp, Artificial Sequence
  Description of Artificial Sequence: Synthetic oligonucleotide
agcaggaggggccggagtgttgg

SEQ ID NO: 45879 - DNA, 22 bp, Artificial Sequence
  Description of Artificial Sequence: Synthetic oligonucleotide
gcaggaggggccggagtgttgg

SEQ ID NO: 45880 - DNA, 23 bp, Artificial Sequence
  Description of Artificial Sequence: Synthetic oligonucleotide
caggaggggccggagtgttggga

SEQ ID NO: 45881 - DNA, 23 bp, Artificial Sequence
  Description of Artificial Sequence: Synthetic oligonucleotide
aggaggggccggagtgttgggac

SEQ ID NO: 45882 - DNA, 22 bp, Artificial Sequence
  Description of Artificial Sequence: Synthetic oligonucleotide
ggaggggccggagtgttgggac

SEQ ID NO: 45883 - DNA, 22 bp, Artificial Sequence
  Description of Artificial Sequence: Synthetic oligonucleotide
gaggggccggagtgttgggacc

SEQ ID NO: 45884 - DNA, 22 bp, Artificial Sequence
  Description of Artificial Sequence: Synthetic oligonucleotide
aggggccggagtgttgggaccg

SEQ ID NO: 45885 - DNA, 21 bp, Artificial Sequence
  Description of Artificial Sequence: Synthetic oligonucleotide
ggggccggagtgttgggaccg

SEQ ID NO: 45886 - DNA, 21 bp, Artificial Sequence
  Description of Artificial Sequence: Synthetic oligonucleotide
gggccggagtgttgggaccgg

SEQ ID NO: 45887 - DNA, 22 bp, Artificial Sequence
  Description of Artificial Sequence: Synthetic oligonucleotide
ggccggagtgttgggaccggga

SEQ ID NO: 45888 - DNA, 23 bp, Artificial Sequence
  Description of Artificial Sequence: Synthetic oligonucleotide
gccggagtgttgggaccgggaga

SEQ ID NO: 45889 - DNA, 24 bp, Artificial Sequence
  Description of Artificial Sequence: Synthetic oligonucleotide
ccggagtgttgggaccgggagaca

SEQ ID NO: 45890 - DNA, 25 bp, Artificial Sequence
  Description of Artificial Sequence: Synthetic oligonucleotide
cggagtgttgggaccgggagacaca

SEQ ID NO: 45891 - DNA, 27 bp, Artificial Sequence
  Description of Artificial Sequence: Synthetic oligonucleotide
ggagtgttgggaccgggagacacagaa

SEQ ID NO: 45892 - DNA, 27 bp, Artificial Sequence
  Description of Artificial Sequence: Synthetic oligonucleotide
gagtgttgggaccgggagacacagaag

SEQ ID NO: 45893 - DNA, 29 bp, Artificial Sequence
  Description of Artificial Sequence: Synthetic oligonucleotide
agtgttgggaccgggagacacagaagtac

SEQ ID NO: 45894 - DNA, 28 bp, Artificial Sequence
  Description of Artificial Sequence: Synthetic oligonucleotide
gtgttgggaccgggagacacagaagtac

SEQ ID NO: 45895 - DNA, 30 bp, Artificial Sequence
  Description of Artificial Sequence: Synthetic oligonucleotide
tgttgggaccgggagacacagaagtacaag

SEQ ID NO: 45896 - DNA, 29 bp, Artificial Sequence
  Description of Artificial Sequence: Synthetic oligonucleotide
gttgggaccgggagacacagaagtacaag

SEQ ID NO: 45897 - DNA, 27 bp, Artificial Sequence
  Description of Artificial Sequence: Synthetic oligonucleotide
tgaatgaggacctgcgctcctggacca

SEQ ID NO: 45898 - DNA, 26 bp, Artificial Sequence
  Description of Artificial Sequence: Synthetic oligonucleotide
gaatgaggacctgcgctcctggacca

SEQ ID NO: 45899 - DNA, 26 bp, Artificial Sequence
  Description of Artificial Sequence: Synthetic oligonucleotide
aatgaggacctgcgctcctggaccac

SEQ ID NO: 45900 - DNA, 25 bp, Artificial Sequence
  Description of Artificial Sequence: Synthetic oligonucleotide
atgaggacctgcgctcctggaccac

SEQ ID NO: 45901 - DNA, 24 bp, Artificial Sequence
  Description of Artificial Sequence: Synthetic oligonucleotide
tgaggacctgcgctcctggaccac

SEQ ID NO: 45902 - DNA, 23 bp, Artificial Sequence
  Description of Artificial Sequence: Synthetic oligonucleotide
gaggacctgcgctcctggaccac

SEQ ID NO: 45903 - DNA, 23 bp, Artificial Sequence
  Description of Artificial Sequence: Synthetic oligonucleotide
aggacctgcgctcctggaccacc

SEQ ID NO: 45904 - DNA, 22 bp, Artificial Sequence
  Description of Artificial Sequence: Synthetic oligonucleotide
ggacctgcgctcctggaccacc

SEQ ID NO: 45905 - DNA, 22 bp, Artificial Sequence
  Description of Artificial Sequence: Synthetic oligonucleotide
gacctgcgctcctggaccaccg

SEQ ID NO: 45906 - DNA, 22 bp, Artificial Sequence
  Description of Artificial Sequence: Synthetic oligonucleotide
acctgcgctcctggaccaccgc

SEQ ID NO: 45907 - DNA, 21 bp, Artificial Sequence
  Description of Artificial Sequence: Synthetic oligonucleotide
cctgcgctcctggaccaccgc

SEQ ID NO: 45908 - DNA, 21 bp, Artificial Sequence
  Description of Artificial Sequence: Synthetic oligonucleotide
ctgcgctcctggaccaccgcg

SEQ ID NO: 45909 - DNA, 22 bp, Artificial Sequence
  Description of Artificial Sequence: Synthetic oligonucleotide
tgcgctcctggaccaccgcgga

SEQ ID NO: 45910 - DNA, 21 bp, Artificial Sequence
  Description of Artificial Sequence: Synthetic oligonucleotide
gcgctcctggaccaccgcgga

SEQ ID NO: 45911 - DNA, 23 bp, Artificial Sequence
  Description of Artificial Sequence: Synthetic oligonucleotide
cgctcctggaccaccgcggacaa

SEQ ID NO: 45912 - DNA, 23 bp, Artificial Sequence
  Description of Artificial Sequence: Synthetic oligonucleotide
gctcctggaccaccgcggacaag

SEQ ID NO: 45913 - DNA, 23 bp, Artificial Sequence
  Description of Artificial Sequence: Synthetic oligonucleotide
ctcctggaccaccgcggacaagg

SEQ ID NO: 45914 - DNA, 23 bp, Artificial Sequence
  Description of Artificial Sequence: Synthetic oligonucleotide
tcctggaccaccgcggacaaggc

SEQ ID NO: 45915 - DNA, 22 bp, Artificial Sequence
  Description of Artificial Sequence: Synthetic oligonucleotide
cctggaccaccgcggacaaggc

SEQ ID NO: 45916 - DNA, 22 bp, Artificial Sequence
  Description of Artificial Sequence: Synthetic oligonucleotide
ctggaccaccgcggacaaggcg

SEQ ID NO: 45917 - DNA, 22 bp, Artificial Sequence
  Description of Artificial Sequence: Synthetic oligonucleotide
tggaccaccgcggacaaggcgg

SEQ ID NO: 45918 - DNA, 21 bp, Artificial Sequence
  Description of Artificial Sequence: Synthetic oligonucleotide
ggaccaccgcggacaaggcgg

SEQ ID NO: 45919 - DNA, 22 bp, Artificial Sequence
  Description of Artificial Sequence: Synthetic oligonucleotide
gaccaccgcggacaaggcggct

SEQ ID NO: 45920 - DNA, 23 bp, Artificial Sequence
  Description of Artificial Sequence: Synthetic oligonucleotide
accaccgcggacaaggcggctca

SEQ ID NO: 45921 - DNA, 22 bp, Artificial Sequence
  Description of Artificial Sequence: Synthetic oligonucleotide
ccaccgcggacaaggcggctca

SEQ ID NO: 45922 - DNA, 24 bp, Artificial Sequence
  Description of Artificial Sequence: Synthetic oligonucleotide
caccgcggacaaggcggctcagat

SEQ ID NO: 45923 - DNA, 25 bp, Artificial Sequence
  Description of Artificial Sequence: Synthetic oligonucleotide
accgcggacaaggcggctcagatca

SEQ ID NO: 45924 - DNA, 26 bp, Artificial Sequence
  Description of Artificial Sequence: Synthetic oligonucleotide
cgcggctactacaaccagagcgaggt

SEQ ID NO: 45925 - DNA, 26 bp, Artificial Sequence
  Description of Artificial Sequence: Synthetic oligonucleotide
gcggctactacaaccagagcgaggtc

SEQ ID NO: 45926 - DNA, 26 bp, Artificial Sequence
  Description of Artificial Sequence: Synthetic oligonucleotide
cggctactacaaccagagcgaggtcg

SEQ ID NO: 45927 - DNA, 26 bp, Artificial Sequence
  Description of Artificial Sequence: Synthetic oligonucleotide
ggctactacaaccagagcgaggtcgg

SEQ ID NO: 45928 - DNA, 27 bp, Artificial Sequence
  Description of Artificial Sequence: Synthetic oligonucleotide
gctactacaaccagagcgaggtcgggt

SEQ ID NO: 45929 - DNA, 27 bp, Artificial Sequence
  Description of Artificial Sequence: Synthetic oligonucleotide
ctactacaaccagagcgaggtcgggtc

SEQ ID NO: 45930 - DNA, 28 bp, Artificial Sequence
  Description of Artificial Sequence: Synthetic oligonucleotide
tactacaaccagagcgaggtcgggtctc

SEQ ID NO: 45931 - DNA, 27 bp, Artificial Sequence
  Description of Artificial Sequence: Synthetic oligonucleotide
actacaaccagagcgaggtcgggtctc

SEQ ID NO: 45932 - DNA, 27 bp, Artificial Sequence
  Description of Artificial Sequence: Synthetic oligonucleotide
ctacaaccagagcgaggtcgggtctca

SEQ ID NO: 45933 - DNA, 27 bp, Artificial Sequence
  Description of Artificial Sequence: Synthetic oligonucleotide
tacaaccagagcgaggtcgggtctcac

SEQ ID NO: 45934 - DNA, 27 bp, Artificial Sequence
  Description of Artificial Sequence: Synthetic oligonucleotide
acaaccagagcgaggtcgggtctcaca

SEQ ID NO: 45935 - DNA, 26 bp, Artificial Sequence
  Description of Artificial Sequence: Synthetic oligonucleotide
caaccagagcgaggtcgggtctcaca

SEQ ID NO: 45936 - DNA, 26 bp, Artificial Sequence
  Description of Artificial Sequence: Synthetic oligonucleotide
aaccagagcgaggtcgggtctcacac

SEQ ID NO: 45937 - DNA, 25 bp, Artificial Sequence
  Description of Artificial Sequence: Synthetic oligonucleotide
accagagcgaggtcgggtctcacac

SEQ ID NO: 45938 - DNA, 24 bp, Artificial Sequence
  Description of Artificial Sequence: Synthetic oligonucleotide
ccagagcgaggtcgggtctcacac

SEQ ID NO: 45939 - DNA, 24 bp, Artificial Sequence
  Description of Artificial Sequence: Synthetic oligonucleotide
cagagcgaggtcgggtctcacacc

SEQ ID NO: 45940 - DNA, 25 bp, Artificial Sequence
  Description of Artificial Sequence: Synthetic oligonucleotide
agagcgaggtcgggtctcacaccct

SEQ ID NO: 45941 - DNA, 24 bp, Artificial Sequence
  Description of Artificial Sequence: Synthetic oligonucleotide
gagcgaggtcgggtctcacaccct

SEQ ID NO: 45942 - DNA, 24 bp, Artificial Sequence
  Description of Artificial Sequence: Synthetic oligonucleotide
agcgaggtcgggtctcacaccctc

SEQ ID NO: 45943 - DNA, 23 bp, Artificial Sequence
  Description of Artificial Sequence: Synthetic oligonucleotide
gcgaggtcgggtctcacaccctc

SEQ ID NO: 45944 - DNA, 24 bp, Artificial Sequence
  Description of Artificial Sequence: Synthetic oligonucleotide
cgaggtcgggtctcacaccctcca

SEQ ID NO: 45945 - DNA, 25 bp, Artificial Sequence
  Description of Artificial Sequence: Synthetic oligonucleotide
gaggtcgggtctcacaccctccaga

SEQ ID NO: 45946 - DNA, 25 bp, Artificial Sequence
  Description of Artificial Sequence: Synthetic oligonucleotide
aggtcgggtctcacaccctccagag

SEQ ID NO: 45947 - DNA, 24 bp, Artificial Sequence
  Description of Artificial Sequence: Synthetic oligonucleotide
ggtcgggtctcacaccctccagag

SEQ ID NO: 45948 - DNA, 26 bp, Artificial Sequence
  Description of Artificial Sequence: Synthetic oligonucleotide
gtcgggtctcacaccctccagaggat

SEQ ID NO: 45949 - DNA, 27 bp, Artificial Sequence
  Description of Artificial Sequence: Synthetic oligonucleotide
tcgggtctcacaccctccagaggatgt

SEQ ID NO: 45950 - DNA, 23 bp, Artificial Sequence
  Description of Artificial Sequence: Synthetic oligonucleotide
gctgcagcgcgcggaacacccaa

SEQ ID NO: 45951 - DNA, 23 bp, Artificial Sequence
  Description of Artificial Sequence: Synthetic oligonucleotide
ctgcagcgcgcggaacacccaag

SEQ ID NO: 45952 - DNA, 24 bp, Artificial Sequence
  Description of Artificial Sequence: Synthetic oligonucleotide
tgcagcgcgcggaacacccaagga

SEQ ID NO: 45953 - DNA, 23 bp, Artificial Sequence
  Description of Artificial Sequence: Synthetic oligonucleotide
gcagcgcgcggaacacccaagga

SEQ ID NO: 45954 - DNA, 24 bp, Artificial Sequence
  Description of Artificial Sequence: Synthetic oligonucleotide
cagcgcgcggaacacccaaggaca

SEQ ID NO: 45955 - DNA, 25 bp, Artificial Sequence
  Description of Artificial Sequence: Synthetic oligonucleotide
agcgcgcggaacacccaaggacaca

SEQ ID NO: 45956 - DNA, 24 bp, Artificial Sequence
  Description of Artificial Sequence: Synthetic oligonucleotide
gcgcgcggaacacccaaggacaca

SEQ ID NO: 45957 - DNA, 24 bp, Artificial Sequence
  Description of Artificial Sequence: Synthetic oligonucleotide
cgcgcggaacacccaaggacacac

SEQ ID NO: 45958 - DNA, 25 bp, Artificial Sequence
  Description of Artificial Sequence: Synthetic oligonucleotide
gcgcggaacacccaaggacacacgt

SEQ ID NO: 45959 - DNA, 26 bp, Artificial Sequence
  Description of Artificial Sequence: Synthetic oligonucleotide
cgcggaacacccaaggacacacgtga

SEQ ID NO: 45960 - DNA, 26 bp, Artificial Sequence
  Description of Artificial Sequence: Synthetic oligonucleotide
gcggaacacccaaggacacacgtgac

SEQ ID NO: 45961 - DNA, 26 bp, Artificial Sequence
  Description of Artificial Sequence: Synthetic oligonucleotide
cggaacacccaaggacacacgtgacc

SEQ ID NO: 45962 - DNA, 27 bp, Artificial Sequence
  Description of Artificial Sequence: Synthetic oligonucleotide
ggaacacccaaggacacacgtgaccca

SEQ ID NO: 45963 - DNA, 27 bp, Artificial Sequence
  Description of Artificial Sequence: Synthetic oligonucleotide
gaacacccaaggacacacgtgacccac

SEQ ID NO: 45964 - DNA, 27 bp, Artificial Sequence
  Description of Artificial Sequence: Synthetic oligonucleotide
aacacccaaggacacacgtgacccacc

SEQ ID NO: 45965 - DNA, 27 bp, Artificial Sequence
  Description of Artificial Sequence: Synthetic oligonucleotide
acacccaaggacacacgtgacccacca

SEQ ID NO: 45966 - DNA, 27 bp, Artificial Sequence
  Description of Artificial Sequence: Synthetic oligonucleotide
cacccaaggacacacgtgacccaccat

SEQ ID NO: 45967 - DNA, 27 bp, Artificial Sequence
  Description of Artificial Sequence: Synthetic oligonucleotide
acccaaggacacacgtgacccaccatc

SEQ ID NO: 45968 - DNA, 26 bp, Artificial Sequence
  Description of Artificial Sequence: Synthetic oligonucleotide
cccaaggacacacgtgacccaccatc

SEQ ID NO: 45969 - DNA, 26 bp, Artificial Sequence
  Description of Artificial Sequence: Synthetic oligonucleotide
ccaaggacacacgtgacccaccatcc

SEQ ID NO: 45970 - DNA, 26 bp, Artificial Sequence
  Description of Artificial Sequence: Synthetic oligonucleotide
caaggacacacgtgacccaccatccc

SEQ ID NO: 45971 - DNA, 27 bp, Artificial Sequence
  Description of Artificial Sequence: Synthetic oligonucleotide
aaggacacacgtgacccaccatcccgt

SEQ ID NO: 45972 - DNA, 26 bp, Artificial Sequence
  Description of Artificial Sequence: Synthetic oligonucleotide
aggacacacgtgacccaccatcccgt

SEQ ID NO: 45973 - DNA, 25 bp, Artificial Sequence
  Description of Artificial Sequence: Synthetic oligonucleotide
ggacacacgtgacccaccatcccgt

SEQ ID NO: 45974 - DNA, 25 bp, Artificial Sequence
  Description of Artificial Sequence: Synthetic oligonucleotide
gcctcctccgcgggtataaccggtt

SEQ ID NO: 45975 - DNA, 25 bp, Artificial Sequence
  Description of Artificial Sequence: Synthetic oligonucleotide
cctcctccgcgggtataaccggttc

SEQ ID NO: 45976 - DNA, 25 bp, Artificial Sequence
  Description of Artificial Sequence: Synthetic oligonucleotide
ctcctccgcgggtataaccggttcg

SEQ ID NO: 45977 - DNA, 25 bp, Artificial Sequence
  Description of Artificial Sequence: Synthetic oligonucleotide
tcctccgcgggtataaccggttcgc

SEQ ID NO: 45978 - DNA, 24 bp, Artificial Sequence
  Description of Artificial Sequence: Synthetic oligonucleotide
cctccgcgggtataaccggttcgc

SEQ ID NO: 45979 - DNA, 26 bp, Artificial Sequence
  Description of Artificial Sequence: Synthetic oligonucleotide
ctccgcgggtataaccggttcgccta

SEQ ID NO: 45980 - DNA, 26 bp, Artificial Sequence
  Description of Artificial Sequence: Synthetic oligonucleotide
tccgcgggtataaccggttcgcctac

SEQ ID NO: 45981 - DNA, 25 bp, Artificial Sequence
  Description of Artificial Sequence: Synthetic oligonucleotide
ccgcgggtataaccggttcgcctac

SEQ ID NO: 45982 - DNA, 26 bp, Artificial Sequence
  Description of Artificial Sequence: Synthetic oligonucleotide
cgcgggtataaccggttcgcctacga

SEQ ID NO: 45983 - DNA, 26 bp, Artificial Sequence
  Description of Artificial Sequence: Synthetic oligonucleotide
gcgggtataaccggttcgcctacgac

SEQ ID NO: 45984 - DNA, 26 bp, Artificial Sequence
  Description of Artificial Sequence: Synthetic oligonucleotide
cgggtataaccggttcgcctacgacg

SEQ ID NO: 45985 - DNA, 26 bp, Artificial Sequence
  Description of Artificial Sequence: Synthetic oligonucleotide
gggtataaccggttcgcctacgacgg

SEQ ID NO: 45986 - DNA, 27 bp, Artificial Sequence
  Description of Artificial Sequence: Synthetic oligonucleotide
ggtataaccggttcgcctacgacggca

SEQ ID NO: 45987 - DNA, 28 bp, Artificial Sequence
  Description of Artificial Sequence: Synthetic oligonucleotide
gtataaccggttcgcctacgacggcaag

SEQ ID NO: 45988 - DNA, 28 bp, Artificial Sequence
  Description of Artificial Sequence: Synthetic oligonucleotide
tataaccggttcgcctacgacggcaagg

SEQ ID NO: 45989 - DNA, 27 bp, Artificial Sequence
  Description of Artificial Sequence: Synthetic oligonucleotide
ataaccggttcgcctacgacggcaagg

SEQ ID NO: 45990 - DNA, 27 bp, Artificial Sequence
  Description of Artificial Sequence: Synthetic oligonucleotide
taaccggttcgcctacgacggcaagga

SEQ ID NO: 45991 - DNA, 27 bp, Artificial Sequence
  Description of Artificial Sequence: Synthetic oligonucleotide
aaccggttcgcctacgacggcaaggat

SEQ ID NO: 45992 - DNA, 27 bp, Artificial Sequence
  Description of Artificial Sequence: Synthetic oligonucleotide
accggttcgcctacgacggcaaggatt

SEQ ID NO: 45993 - DNA, 27 bp, Artificial Sequence
  Description of Artificial Sequence: Synthetic oligonucleotide
ccggttcgcctacgacggcaaggatta

SEQ ID NO: 45994 - DNA, 27 bp, Artificial Sequence
  Description of Artificial Sequence: Synthetic oligonucleotide
cggttcgcctacgacggcaaggattac

SEQ ID NO: 45995 - DNA, 29 bp, Artificial Sequence
  Description of Artificial Sequence: Synthetic oligonucleotide
ggttcgcctacgacggcaaggattacatc

SEQ ID NO: 45996 - DNA, 22 bp, Artificial Sequence
  Description of Artificial Sequence: Synthetic oligonucleotide
ccgtgggtggagcaggaggggt

SEQ ID NO: 45997 - DNA, 22 bp, Artificial Sequence
  Description of Artificial Sequence: Synthetic oligonucleotide
cgtgggtggagcaggaggggtc

SEQ ID NO: 45998 - DNA, 22 bp, Artificial Sequence
  Description of Artificial Sequence: Synthetic oligonucleotide
gtgggtggagcaggaggggtcg

SEQ ID NO: 45999 - DNA, 23 bp, Artificial Sequence
  Description of Artificial Sequence: Synthetic oligonucleotide
tgggtggagcaggaggggtcgga

SEQ ID NO: 46000 - DNA, 22 bp, Artificial Sequence
  Description of Artificial Sequence: Synthetic oligonucleotide
gggtggagcaggaggggtcgga

SEQ ID NO: 46001 - DNA, 26 bp, Artificial Sequence
  Description of Artificial Sequence: Synthetic oligonucleotide
ggtggagcaggaggggtcggagtatt

SEQ ID NO: 46002 - DNA, 26 bp, Artificial Sequence
  Description of Artificial Sequence: Synthetic oligonucleotide
gtggagcaggaggggtcggagtattg

SEQ ID NO: 46003 - DNA, 26 bp, Artificial Sequence
  Description of Artificial Sequence: Synthetic oligonucleotide
tggagcaggaggggtcggagtattgg

SEQ ID NO: 46004 - DNA, 25 bp, Artificial Sequence
  Description of Artificial Sequence: Synthetic oligonucleotide
ggagcaggaggggtcggagtattgg

SEQ ID NO: 46005 - DNA, 24 bp, Artificial Sequence
  Description of Artificial Sequence: Synthetic oligonucleotide
gaggggtcggagtattgggaccgg

SEQ ID NO: 46006 - DNA, 25 bp, Artificial Sequence
  Description of Artificial Sequence: Synthetic oligonucleotide
aggggtcggagtattgggaccggga

SEQ ID NO: 46007 - DNA, 24 bp, Artificial Sequence
  Description of Artificial Sequence: Synthetic oligonucleotide
ggggtcggagtattgggaccggga

SEQ ID NO: 46008 - DNA, 25 bp, Artificial Sequence
  Description of Artificial Sequence: Synthetic oligonucleotide
gggtcggagtattgggaccgggaga

SEQ ID NO: 46009 - DNA, 26 bp, Artificial Sequence
  Description of Artificial Sequence: Synthetic oligonucleotide
ggtcggagtattgggaccgggagaca

SEQ ID NO: 46010 - DNA, 27 bp, Artificial Sequence
  Description of Artificial Sequence: Synthetic oligonucleotide
gtcggagtattgggaccgggagacaca

SEQ ID NO: 46011 - DNA, 27 bp, Artificial Sequence
  Description of Artificial Sequence: Synthetic oligonucleotide
tcggagtattgggaccgggagacacag

SEQ ID NO: 46012 - DNA, 28 bp, Artificial Sequence
  Description of Artificial Sequence: Synthetic oligonucleotide
gcgggtataaccagttcgcctacgactg

SEQ ID NO: 46013 - DNA, 28 bp, Artificial Sequence
  Description of Artificial Sequence: Synthetic oligonucleotide
cgggtataaccagttcgcctacgactgc

SEQ ID NO: 46014 - DNA, 30 bp, Artificial Sequence
  Description of Artificial Sequence: Synthetic oligonucleotide
gggtataaccagttcgcctacgactgcaag

SEQ ID NO: 46015 - DNA, 30 bp, Artificial Sequence
  Description of Artificial Sequence: Synthetic oligonucleotide
ggtataaccagttcgcctacgactgcaagg

SEQ ID NO: 46016 - DNA, 34 bp, Artificial Sequence
  Description of Artificial Sequence: Synthetic oligonucleotide
gtataaccagttcgcctacgactgcaaggattac

SEQ ID NO: 46017 - DNA, 36 bp, Artificial Sequence
  Description of Artificial Sequence: Synthetic oligonucleotide
tataaccagttcgcctacgactgcaaggattacatc

SEQ ID NO: 46018 - DNA, 35 bp, Artificial Sequence
  Description of Artificial Sequence: Synthetic oligonucleotide
ataaccagttcgcctacgactgcaaggattacatc

SEQ ID NO: 46019 - DNA, 34 bp, Artificial Sequence
  Description of Artificial Sequence: Synthetic oligonucleotide
taaccagttcgcctacgactgcaaggattacatc

SEQ ID NO: 46020 - DNA, 33 bp, Artificial Sequence
  Description of Artificial Sequence: Synthetic oligonucleotide
aaccagttcgcctacgactgcaaggattacatc

SEQ ID NO: 46021 - DNA, 32 bp, Artificial Sequence
  Description of Artificial Sequence: Synthetic oligonucleotide
accagttcgcctacgactgcaaggattacatc

SEQ ID NO: 46022 - DNA, 31 bp, Artificial Sequence
  Description of Artificial Sequence: Synthetic oligonucleotide
ccagttcgcctacgactgcaaggattacatc

SEQ ID NO: 46023 - DNA, 31 bp, Artificial Sequence
  Description of Artificial Sequence: Synthetic oligonucleotide
cagttcgcctacgactgcaaggattacatcg

SEQ ID NO: 46024 - DNA, 31 bp, Artificial Sequence
  Description of Artificial Sequence: Synthetic oligonucleotide
agttcgcctacgactgcaaggattacatcgc

SEQ ID NO: 46025 - DNA, 30 bp, Artificial Sequence
  Description of Artificial Sequence: Synthetic oligonucleotide
gttcgcctacgactgcaaggattacatcgc

SEQ ID NO: 46026 - DNA, 30 bp, Artificial Sequence
  Description of Artificial Sequence: Synthetic oligonucleotide
ttcgcctacgactgcaaggattacatcgcc

SEQ ID NO: 46027 - DNA, 29 bp, Artificial Sequence
  Description of Artificial Sequence: Synthetic oligonucleotide
tcgcctacgactgcaaggattacatcgcc

SEQ ID NO: 46028 - DNA, 32 bp, Artificial Sequence
  Description of Artificial Sequence: Synthetic oligonucleotide
ctacgactgcaaggattacatcgccctgaatg

SEQ ID NO: 46029 - DNA, 33 bp, Artificial Sequence
  Description of Artificial Sequence: Synthetic oligonucleotide
tacgactgcaaggattacatcgccctgaatgag

SEQ ID NO: 46030 - DNA, 32 bp, Artificial Sequence
  Description of Artificial Sequence: Synthetic oligonucleotide
acgactgcaaggattacatcgccctgaatgag

SEQ ID NO: 46031 - DNA, 31 bp, Artificial Sequence
  Description of Artificial Sequence: Synthetic oligonucleotide
cgactgcaaggattacatcgccctgaatgag

SEQ ID NO: 46032 - DNA, 31 bp, Artificial Sequence
  Description of Artificial Sequence: Synthetic oligonucleotide
gactgcaaggattacatcgccctgaatgagg

SEQ ID NO: 46033 - DNA, 32 bp, Artificial Sequence
  Description of Artificial Sequence: Synthetic oligonucleotide
actgcaaggattacatcgccctgaatgaggac

SEQ ID NO: 46034 - DNA, 31 bp, Artificial Sequence
  Description of Artificial Sequence: Synthetic oligonucleotide
ctgcaaggattacatcgccctgaatgaggac

SEQ ID NO: 46035 - DNA, 31 bp, Artificial Sequence
  Description of Artificial Sequence: Synthetic oligonucleotide
tgcaaggattacatcgccctgaatgaggacc

SEQ ID NO: 46036 - DNA, 30 bp, Artificial Sequence
  Description of Artificial Sequence: Synthetic oligonucleotide
ctccgcagatacctggagaacaggaagaag

SEQ ID NO: 46037 - DNA, 31 bp, Artificial Sequence
  Description of Artificial Sequence: Synthetic oligonucleotide
tccgcagatacctggagaacaggaagaagac

SEQ ID NO: 46038 - DNA, 30 bp, Artificial Sequence
  Description of Artificial Sequence: Synthetic oligonucleotide
ccgcagatacctggagaacaggaagaagac

SEQ ID NO: 46039 - DNA, 30 bp, Artificial Sequence
  Description of Artificial Sequence: Synthetic oligonucleotide
cgcagatacctggagaacaggaagaagacg

SEQ ID NO: 46040 - DNA, 30 bp, Artificial Sequence
  Description of Artificial Sequence: Synthetic oligonucleotide
gcagatacctggagaacaggaagaagacgc

SEQ ID NO: 46041 - DNA, 31 bp, Artificial Sequence
  Description of Artificial Sequence: Synthetic oligonucleotide
cagatacctggagaacaggaagaagacgctg

SEQ ID NO: 46042 - DNA, 31 bp, Artificial Sequence
  Description of Artificial Sequence: Synthetic oligonucleotide
agatacctggagaacaggaagaagacgctgc

SEQ ID NO: 46043 - DNA, 30 bp, Artificial Sequence
  Description of Artificial Sequence: Synthetic oligonucleotide
gatacctggagaacaggaagaagacgctgc

SEQ ID NO: 46044 - DNA, 31 bp, Artificial Sequence
  Description of Artificial Sequence: Synthetic oligonucleotide
atacctggagaacaggaagaagacgctgcag

SEQ ID NO: 46045 - DNA, 30 bp, Artificial Sequence
  Description of Artificial Sequence: Synthetic oligonucleotide
tacctggagaacaggaagaagacgctgcag

SEQ ID NO: 46046 - DNA, 29 bp, Artificial Sequence
  Description of Artificial Sequence: Synthetic oligonucleotide
acctggagaacaggaagaagacgctgcag

SEQ ID NO: 46047 - DNA, 28 bp, Artificial Sequence
  Description of Artificial Sequence: Synthetic oligonucleotide
cctggagaacaggaagaagacgctgcag

SEQ ID NO: 46048 - DNA, 28 bp, Artificial Sequence
  Description of Artificial Sequence: Synthetic oligonucleotide
ctggagaacaggaagaagacgctgcagc

SEQ ID NO: 46049 - DNA, 28 bp, Artificial Sequence
  Description of Artificial Sequence: Synthetic oligonucleotide
tggagaacaggaagaagacgctgcagcg

SEQ ID NO: 46050 - DNA, 27 bp, Artificial Sequence
  Description of Artificial Sequence: Synthetic oligonucleotide
ggagaacaggaagaagacgctgcagcg

SEQ ID NO: 46051 - DNA, 27 bp, Artificial Sequence
  Description of Artificial Sequence: Synthetic oligonucleotide
gagaacaggaagaagacgctgcagcgc

SEQ ID NO: 46052 - DNA, 27 bp, Artificial Sequence
  Description of Artificial Sequence: Synthetic oligonucleotide
agaacaggaagaagacgctgcagcgcg

SEQ ID NO: 46053 - DNA, 26 bp, Artificial Sequence
  Description of Artificial Sequence: Synthetic oligonucleotide
gaacaggaagaagacgctgcagcgcg

SEQ ID NO: 46054 - DNA, 26 bp, Artificial Sequence
  Description of Artificial Sequence: Synthetic oligonucleotide
aacaggaagaagacgctgcagcgcgc

SEQ ID NO: 46055 - DNA, 25 bp, Artificial Sequence
  Description of Artificial Sequence: Synthetic oligonucleotide
acaggaagaagacgctgcagcgcgc

SEQ ID NO: 46056 - DNA, 24 bp, Artificial Sequence
  Description of Artificial Sequence: Synthetic oligonucleotide
caggaagaagacgctgcagcgcgc

SEQ ID NO: 46057 - DNA, 24 bp, Artificial Sequence
  Description of Artificial Sequence: Synthetic oligonucleotide
aggaagaagacgctgcagcgcgcg

SEQ ID NO: 46058 - DNA, 23 bp, Artificial Sequence
  Description of Artificial Sequence: Synthetic oligonucleotide
tcctggaccgccgcggacaagga

SEQ ID NO: 46059 - DNA, 22 bp, Artificial Sequence
  Description of Artificial Sequence: Synthetic oligonucleotide
cctggaccgccgcggacaagga

SEQ ID NO: 46060 - DNA, 22 bp, Artificial Sequence
  Description of Artificial Sequence: Synthetic oligonucleotide
ctggaccgccgcggacaaggag

SEQ ID NO: 46061 - DNA, 22 bp, Artificial Sequence
  Description of Artificial Sequence: Synthetic oligonucleotide
tggaccgccgcggacaaggagg

SEQ ID NO: 46062 - DNA, 21 bp, Artificial Sequence
  Description of Artificial Sequence: Synthetic oligonucleotide
ggaccgccgcggacaaggagg

SEQ ID NO: 46063 - DNA, 22 bp, Artificial Sequence
  Description of Artificial Sequence: Synthetic oligonucleotide
gaccgccgcggacaaggaggct

SEQ ID NO: 46064 - DNA, 23 bp, Artificial Sequence
  Description of Artificial Sequence: Synthetic oligonucleotide
accgccgcggacaaggaggctca

SEQ ID NO: 46065 - DNA, 22 bp, Artificial Sequence
  Description of Artificial Sequence: Synthetic oligonucleotide
ccgccgcggacaaggaggctca

SEQ ID NO: 46066 - DNA, 24 bp, Artificial Sequence
  Description of Artificial Sequence: Synthetic oligonucleotide
cgccgcggacaaggaggctcagat

SEQ ID NO: 46067 - DNA, 25 bp, Artificial Sequence
  Description of Artificial Sequence: Synthetic oligonucleotide
gccgcggacaaggaggctcagatca

SEQ ID NO: 46068 - DNA, 25 bp, Artificial Sequence
  Description of Artificial Sequence: Synthetic oligonucleotide
ccgcggacaaggaggctcagatcac

SEQ ID NO: 46069 - DNA, 25 bp, Artificial Sequence
  Description of Artificial Sequence: Synthetic oligonucleotide
cgcggacaaggaggctcagatcacc

SEQ ID NO: 46070 - DNA, 26 bp, Artificial Sequence
  Description of Artificial Sequence: Synthetic oligonucleotide
gcggacaaggaggctcagatcaccca

SEQ ID NO: 46071 - DNA, 26 bp, Artificial Sequence
  Description of Artificial Sequence: Synthetic oligonucleotide
cggacaaggaggctcagatcacccag

SEQ ID NO: 46072 - DNA, 26 bp, Artificial Sequence
  Description of Artificial Sequence: Synthetic oligonucleotide
ggacaaggaggctcagatcacccagc

SEQ ID NO: 46073 - DNA, 26 bp, Artificial Sequence
  Description of Artificial Sequence: Synthetic oligonucleotide
gacaaggaggctcagatcacccagcg

SEQ ID NO: 46074 - DNA, 27 bp, Artificial Sequence
  Description of Artificial Sequence: Synthetic oligonucleotide
acaaggaggctcagatcacccagcgca

SEQ ID NO: 46075 - DNA, 27 bp, Artificial Sequence
  Description of Artificial Sequence: Synthetic oligonucleotide
caaggaggctcagatcacccagcgcaa

SEQ ID NO: 46076 - DNA, 27 bp, Artificial Sequence
  Description of Artificial Sequence: Synthetic oligonucleotide
aaggaggctcagatcacccagcgcaag

SEQ ID NO: 46077 - DNA, 27 bp, Artificial Sequence
  Description of Artificial Sequence: Synthetic oligonucleotide
aggaggctcagatcacccagcgcaagt

SEQ ID NO: 46078 - DNA, 26 bp, Artificial Sequence
  Description of Artificial Sequence: Synthetic oligonucleotide
ggaggctcagatcacccagcgcaagt

SEQ ID NO: 46079 - DNA, 26 bp, Artificial Sequence
  Description of Artificial Sequence: Synthetic oligonucleotide
gaggctcagatcacccagcgcaagtg

SEQ ID NO: 46080 - DNA, 26 bp, Artificial Sequence
  Description of Artificial Sequence: Synthetic oligonucleotide
aggctcagatcacccagcgcaagtgg

SEQ ID NO: 46081 - DNA, 28 bp, Artificial Sequence
  Description of Artificial Sequence: Synthetic oligonucleotide
gcctgctcccactccatgaggtatttcg

SEQ ID NO: 46082 - DNA, 29 bp, Artificial Sequence
  Description of Artificial Sequence: Synthetic oligonucleotide
cctgctcccactccatgaggtatttcgac

SEQ ID NO: 46083 - DNA, 30 bp, Artificial Sequence
  Description of Artificial Sequence: Synthetic oligonucleotide
ctgctcccactccatgaggtatttcgacac

SEQ ID NO: 46084 - DNA, 30 bp, Artificial Sequence
  Description of Artificial Sequence: Synthetic oligonucleotide
tgctcccactccatgaggtatttcgacacc

SEQ ID NO: 46085 - DNA, 23 bp, Artificial Sequence
  Description of Artificial Sequence: Synthetic oligonucleotide
cacgtgcgtggagtggctccgga

SEQ ID NO: 46086 - DNA, 26 bp, Artificial Sequence
  Description of Artificial Sequence: Synthetic oligonucleotide
acgtgcgtggagtggctccggagata

SEQ ID NO: 46087 - DNA, 25 bp, Artificial Sequence
  Description of Artificial Sequence: Synthetic oligonucleotide
cgtgcgtggagtggctccggagata

SEQ ID NO: 46088 - DNA, 25 bp, Artificial Sequence
  Description of Artificial Sequence: Synthetic oligonucleotide
gtgcgtggagtggctccggagatac

SEQ ID NO: 46089 - DNA, 26 bp, Artificial Sequence
  Description of Artificial Sequence: Synthetic oligonucleotide
tgcgtggagtggctccggagatacct

SEQ ID NO: 46090 - DNA, 25 bp, Artificial Sequence
  Description of Artificial Sequence: Synthetic oligonucleotide
gcgtggagtggctccggagatacct

SEQ ID NO: 46091 - DNA, 25 bp, Artificial Sequence
  Description of Artificial Sequence: Synthetic oligonucleotide
cgtggagtggctccggagatacctg

SEQ ID NO: 46092 - DNA, 26 bp, Artificial Sequence
  Description of Artificial Sequence: Synthetic oligonucleotide
gtggagtggctccggagatacctgga

SEQ ID NO: 46093 - DNA, 27 bp, Artificial Sequence
  Description of Artificial Sequence: Synthetic oligonucleotide
tggagtggctccggagatacctggaga

SEQ ID NO: 46094 - DNA, 27 bp, Artificial Sequence
  Description of Artificial Sequence: Synthetic oligonucleotide
ggagtggctccggagatacctggagaa

SEQ ID NO: 46095 - DNA, 27 bp, Artificial Sequence
  Description of Artificial Sequence: Synthetic oligonucleotide
gagtggctccggagatacctggagaac

SEQ ID NO: 46096 - DNA, 27 bp, Artificial Sequence
  Description of Artificial Sequence: Synthetic oligonucleotide
agtggctccggagatacctggagaacg

SEQ ID NO: 46097 - DNA, 26 bp, Artificial Sequence
  Description of Artificial Sequence: Synthetic oligonucleotide
gtggctccggagatacctggagaacg

SEQ ID NO: 46098 - DNA, 26 bp, Artificial Sequence
  Description of Artificial Sequence: Synthetic oligonucleotide
tggctccggagatacctggagaacgg

SEQ ID NO: 46099 - DNA, 25 bp, Artificial Sequence
  Description of Artificial Sequence: Synthetic oligonucleotide
ggctccggagatacctggagaacgg

SEQ ID NO: 46100 - DNA, 27 bp, Artificial Sequence
  Description of Artificial Sequence: Synthetic oligonucleotide
gctccggagatacctggagaacgggaa

SEQ ID NO: 46101 - DNA, 27 bp, Artificial Sequence
  Description of Artificial Sequence: Synthetic oligonucleotide
ctccggagatacctggagaacgggaag

SEQ ID NO: 46102 - DNA, 27 bp, Artificial Sequence
  Description of Artificial Sequence: Synthetic oligonucleotide
tccggagatacctggagaacgggaagg

SEQ ID NO: 46103 - DNA, 27 bp, Artificial Sequence
  Description of Artificial Sequence: Synthetic oligonucleotide
ccggagatacctggagaacgggaagga

SEQ ID NO: 46104 - DNA, 27 bp, Artificial Sequence
  Description of Artificial Sequence: Synthetic oligonucleotide
cggagatacctggagaacgggaaggag

SEQ ID NO: 46105 - DNA, 28 bp, Artificial Sequence
  Description of Artificial Sequence: Synthetic oligonucleotide
ggagatacctggagaacgggaaggagac

SEQ ID NO: 46106 - DNA, 28 bp, Artificial Sequence
  Description of Artificial Sequence: Synthetic oligonucleotide
gagatacctggagaacgggaaggagacg

SEQ ID NO: 46107 - DNA, 20 bp, Artificial Sequence
  Description of Artificial Sequence: Synthetic oligonucleotide
gagaggggagccccgggctc

SEQ ID NO: 46108 - DNA, 20 bp, Artificial Sequence
  Description of Artificial Sequence: Synthetic oligonucleotide
agaggggagccccgggctcc

SEQ ID NO: 46109 - DNA, 20 bp, Artificial Sequence
  Description of Artificial Sequence: Synthetic oligonucleotide
gaggggagccccgggctcct

SEQ ID NO: 46110 - DNA, 20 bp, Artificial Sequence
  Description of Artificial Sequence: Synthetic oligonucleotide
aggggagccccgggctccgt

SEQ ID NO: 46111 - DNA, 20 bp, Artificial Sequence
  Description of Artificial Sequence: Synthetic oligonucleotide
ggggagccccgggctccgtt

SEQ ID NO: 46112 - DNA, 20 bp, Artificial Sequence
  Description of Artificial Sequence: Synthetic oligonucleotide
gggagccccgggctccgtgt

SEQ ID NO: 46113 - DNA, 20 bp, Artificial Sequence
  Description of Artificial Sequence: Synthetic oligonucleotide
ggagccccgggctccgtggt

SEQ ID NO: 46114 - DNA, 20 bp, Artificial Sequence
  Description of Artificial Sequence: Synthetic oligonucleotide
gagccccgggctccgtgggt

SEQ ID NO: 46115 - DNA, 20 bp, Artificial Sequence
  Description of Artificial Sequence: Synthetic oligonucleotide
agccccgggctccgtgggtg

SEQ ID NO: 46116 - DNA, 20 bp, Artificial Sequence
  Description of Artificial Sequence: Synthetic oligonucleotide
gccccgggctccgtgggtgt

SEQ ID NO: 46117 - DNA, 20 bp, Artificial Sequence
  Description of Artificial Sequence: Synthetic oligonucleotide
ccccgggctccgtgggtgga

SEQ ID NO: 46118 - DNA, 20 bp, Artificial Sequence
  Description of Artificial Sequence: Synthetic oligonucleotide
cccgggctccgtgggtggag

SEQ ID NO: 46119 - DNA, 21 bp, Artificial Sequence
  Description of Artificial Sequence: Synthetic oligonucleotide
ccgggctccgtgggtggagca

SEQ ID NO: 46120 - DNA, 21 bp, Artificial Sequence
  Description of Artificial Sequence: Synthetic oligonucleotide
cgggctccgtgggtggagcag

SEQ ID NO: 46121 - DNA, 22 bp, Artificial Sequence
  Description of Artificial Sequence: Synthetic oligonucleotide
gggctccgtgggtggagcagga

SEQ ID NO: 46122 - DNA, 22 bp, Artificial Sequence
  Description of Artificial Sequence: Synthetic oligonucleotide
ggctccgtgggtggagcaggag

SEQ ID NO: 46123 - DNA, 22 bp, Artificial Sequence
  Description of Artificial Sequence: Synthetic oligonucleotide
gctccgtgggtggagcaggagg

SEQ ID NO: 46124 - DNA, 22 bp, Artificial Sequence
  Description of Artificial Sequence: Synthetic oligonucleotide
ctccgtgggtggagcaggaggg

SEQ ID NO: 46125 - DNA, 22 bp, Artificial Sequence
  Description of Artificial Sequence: Synthetic oligonucleotide
tccgtgggtggagcaggagggg

SEQ ID NO: 46126 - DNA, 30 bp, Artificial Sequence
  Description of Artificial Sequence: Synthetic oligonucleotide
gctcccactccatgaggtattttgacaccg

SEQ ID NO: 46127 - DNA, 30 bp, Artificial Sequence
  Description of Artificial Sequence: Synthetic oligonucleotide
ctcccactccatgaggtattttgacaccgc

SEQ ID NO: 46128 - DNA, 30 bp, Artificial Sequence
  Description of Artificial Sequence: Synthetic oligonucleotide
tcccactccatgaggtattttgacaccgcc

SEQ ID NO: 46129 - DNA, 29 bp, Artificial Sequence
  Description of Artificial Sequence: Synthetic oligonucleotide
cccactccatgaggtattttgacaccgcc

SEQ ID NO: 46130 - DNA, 29 bp, Artificial Sequence
  Description of Artificial Sequence: Synthetic oligonucleotide
ccactccatgaggtattttgacaccgccg

SEQ ID NO: 46131 - DNA, 30 bp, Artificial Sequence
  Description of Artificial Sequence: Synthetic oligonucleotide
cactccatgaggtattttgacaccgccgtg

SEQ ID NO: 46132 - DNA, 31 bp, Artificial Sequence
  Description of Artificial Sequence: Synthetic oligonucleotide
actccatgaggtattttgacaccgccgtgtc

SEQ ID NO: 46133 - DNA, 30 bp, Artificial Sequence
  Description of Artificial Sequence: Synthetic oligonucleotide
ctccatgaggtattttgacaccgccgtgtc

SEQ ID NO: 46134 - DNA, 30 bp, Artificial Sequence
  Description of Artificial Sequence: Synthetic oligonucleotide
tccatgaggtattttgacaccgccgtgtcc

SEQ ID NO: 46135 - DNA, 29 bp, Artificial Sequence
  Description of Artificial Sequence: Synthetic oligonucleotide
ccatgaggtattttgacaccgccgtgtcc

SEQ ID NO: 46136 - DNA, 29 bp, Artificial Sequence
  Description of Artificial Sequence: Synthetic oligonucleotide
catgaggtattttgacaccgccgtgtccc

SEQ ID NO: 46137 - DNA, 29 bp, Artificial Sequence
  Description of Artificial Sequence: Synthetic oligonucleotide
atgaggtattttgacaccgccgtgtcccg

SEQ ID NO: 46138 - DNA, 28 bp, Artificial Sequence
  Description of Artificial Sequence: Synthetic oligonucleotide
tgaggtattttgacaccgccgtgtcccg

SEQ ID NO: 46139 - DNA, 27 bp, Artificial Sequence
  Description of Artificial Sequence: Synthetic oligonucleotide
gaggtattttgacaccgccgtgtcccg

SEQ ID NO: 46140 - DNA, 27 bp, Artificial Sequence
  Description of Artificial Sequence: Synthetic oligonucleotide
aggtattttgacaccgccgtgtcccgg

SEQ ID NO: 46141 - DNA, 26 bp, Artificial Sequence
  Description of Artificial Sequence: Synthetic oligonucleotide
ggtattttgacaccgccgtgtcccgg

SEQ ID NO: 46142 - DNA, 26 bp, Artificial Sequence
  Description of Artificial Sequence: Synthetic oligonucleotide
gtattttgacaccgccgtgtcccggc

SEQ ID NO: 46143 - DNA, 26 bp, Artificial Sequence
  Description of Artificial Sequence: Synthetic oligonucleotide
tattttgacaccgccgtgtcccggcc

SEQ ID NO: 46144 - DNA, 25 bp, Artificial Sequence
  Description of Artificial Sequence: Synthetic oligonucleotide
attttgacaccgccgtgtcccggcc

SEQ ID NO: 46145 - DNA, 24 bp, Artificial Sequence
  Description of Artificial Sequence: Synthetic oligonucleotide
ttttgacaccgccgtgtcccggcc

SEQ ID NO: 46146 - DNA, 23 bp, Artificial Sequence
  Description of Artificial Sequence: Synthetic oligonucleotide
tttgacaccgccgtgtcccggcc

SEQ ID NO: 46147 - DNA, 22 bp, Artificial Sequence
  Description of Artificial Sequence: Synthetic oligonucleotide
ttgacaccgccgtgtcccggcc

SEQ ID NO: 46148 - DNA, 21 bp, Artificial Sequence
  Description of Artificial Sequence: Synthetic oligonucleotide
tgacaccgccgtgtcccggcc

SEQ ID NO: 46149 - DNA, 27 bp, Artificial Sequence
  Description of Artificial Sequence: Synthetic oligonucleotide
gctccgcagatacctggagaacggcaa

SEQ ID NO: 46150 - DNA, 27 bp, Artificial Sequence
  Description of Artificial Sequence: Synthetic oligonucleotide
ctccgcagatacctggagaacggcaag

SEQ ID NO: 46151 - DNA, 27 bp, Artificial Sequence
  Description of Artificial Sequence: Synthetic oligonucleotide
tccgcagatacctggagaacggcaagg

SEQ ID NO: 46152 - DNA, 27 bp, Artificial Sequence
  Description of Artificial Sequence: Synthetic oligonucleotide
ccgcagatacctggagaacggcaagga

SEQ ID NO: 46153 - DNA, 27 bp, Artificial Sequence
  Description of Artificial Sequence: Synthetic oligonucleotide
cgcagatacctggagaacggcaaggag

SEQ ID NO: 46154 - DNA, 28 bp, Artificial Sequence
  Description of Artificial Sequence: Synthetic oligonucleotide
gcagatacctggagaacggcaaggagac

SEQ ID NO: 46155 - DNA, 28 bp, Artificial Sequence
  Description of Artificial Sequence: Synthetic oligonucleotide
cagatacctggagaacggcaaggagacg

SEQ ID NO: 46156 - DNA, 28 bp, Artificial Sequence
  Description of Artificial Sequence: Synthetic oligonucleotide
agatacctggagaacggcaaggagacgc

SEQ ID NO: 46157 - DNA, 27 bp, Artificial Sequence
  Description of Artificial Sequence: Synthetic oligonucleotide
gatacctggagaacggcaaggagacgc

SEQ ID NO: 46158 - DNA, 28 bp, Artificial Sequence
  Description of Artificial Sequence: Synthetic oligonucleotide
atacctggagaacggcaaggagacgctg

SEQ ID NO: 46159 - DNA, 27 bp, Artificial Sequence
  Description of Artificial Sequence: Synthetic oligonucleotide
tacctggagaacggcaaggagacgctg

SEQ ID NO: 46160 - DNA, 22 bp, Artificial Sequence
  Description of Artificial Sequence: Synthetic oligonucleotide
cgcgagtccaagaggggagccc

SEQ ID NO: 46161 - DNA, 22 bp, Artificial Sequence
  Description of Artificial Sequence: Synthetic oligonucleotide
gcgagtccaagaggggagcccc

SEQ ID NO: 46162 - DNA, 22 bp, Artificial Sequence
  Description of Artificial Sequence: Synthetic oligonucleotide
cgagtccaagaggggagccccg

SEQ ID NO: 46163 - DNA, 22 bp, Artificial Sequence
  Description of Artificial Sequence: Synthetic oligonucleotide
gagtccaagaggggagccccgg

SEQ ID NO: 46164 - DNA, 22 bp, Artificial Sequence
  Description of Artificial Sequence: Synthetic oligonucleotide
agtccaagaggggagccccggg

SEQ ID NO: 46165 - DNA, 21 bp, Artificial Sequence
  Description of Artificial Sequence: Synthetic oligonucleotide
gtccaagaggggagccccggg

SEQ ID NO: 46166 - DNA, 21 bp, Artificial Sequence
  Description of Artificial Sequence: Synthetic oligonucleotide
tccaagaggggagccccgggc

SEQ ID NO: 46167 - DNA, 20 bp, Artificial Sequence
  Description of Artificial Sequence: Synthetic oligonucleotide
ccaagaggggagccccgggc

SEQ ID NO: 46168 - DNA, 20 bp, Artificial Sequence
  Description of Artificial Sequence: Synthetic oligonucleotide
caagaggggagccccgggcg

SEQ ID NO: 46169 - DNA, 20 bp, Artificial Sequence
  Description of Artificial Sequence: Synthetic oligonucleotide
aagaggggagccccgggcgc

SEQ ID NO: 46170 - DNA, 21 bp, Artificial Sequence
  Description of Artificial Sequence: Synthetic oligonucleotide
ccgggcgccgtgggtggagaa

SEQ ID NO: 46171 - DNA, 21 bp, Artificial Sequence
  Description of Artificial Sequence: Synthetic oligonucleotide
cgggcgccgtgggtggagaag

SEQ ID NO: 46172 - DNA, 22 bp, Artificial Sequence
  Description of Artificial Sequence: Synthetic oligonucleotide
gggcgccgtgggtggagaagga

SEQ ID NO: 46173 - DNA, 22 bp, Artificial Sequence
  Description of Artificial Sequence: Synthetic oligonucleotide
ggcgccgtgggtggagaaggag

SEQ ID NO: 46174 - DNA, 22 bp, Artificial Sequence
  Description of Artificial Sequence: Synthetic oligonucleotide
gcgccgtgggtggagaaggagg

SEQ ID NO: 46175 - DNA, 22 bp, Artificial Sequence
  Description of Artificial Sequence: Synthetic oligonucleotide
cgccgtgggtggagaaggaggg

SEQ ID NO: 46176 - DNA, 22 bp, Artificial Sequence
  Description of Artificial Sequence: Synthetic oligonucleotide
gccgtgggtggagaaggagggg

SEQ ID NO: 46177 - DNA, 22 bp, Artificial Sequence
  Description of Artificial Sequence: Synthetic oligonucleotide
ccgtgggtggagaaggaggggc

SEQ ID NO: 46178 - DNA, 22 bp, Artificial Sequence
  Description of Artificial Sequence: Synthetic oligonucleotide
cgtgggtggagaaggaggggcc

SEQ ID NO: 46179 - DNA, 22 bp, Artificial Sequence
  Description of Artificial Sequence: Synthetic oligonucleotide
gtgggtggagaaggaggggccg

SEQ ID NO: 46180 - DNA, 23 bp, Artificial Sequence
  Description of Artificial Sequence: Synthetic oligonucleotide
tgggtggagaaggaggggccgga

SEQ ID NO: 46181 - DNA, 22 bp, Artificial Sequence
  Description of Artificial Sequence: Synthetic oligonucleotide
gggtggagaaggaggggccgga

SEQ ID NO: 46182 - DNA, 26 bp, Artificial Sequence
  Description of Artificial Sequence: Synthetic oligonucleotide
ggtggagaaggaggggccggagtatt

SEQ ID NO: 46183 - DNA, 26 bp, Artificial Sequence
  Description of Artificial Sequence: Synthetic oligonucleotide
gtggagaaggaggggccggagtattg

SEQ ID NO: 46184 - DNA, 26 bp, Artificial Sequence
  Description of Artificial Sequence: Synthetic oligonucleotide
tggagaaggaggggccggagtattgg

SEQ ID NO: 46185 - DNA, 25 bp, Artificial Sequence
  Description of Artificial Sequence: Synthetic oligonucleotide
ggagaaggaggggccggagtattgg

SEQ ID NO: 46186 - DNA, 26 bp, Artificial Sequence
  Description of Artificial Sequence: Synthetic oligonucleotide
gagaaggaggggccggagtattggga

SEQ ID NO: 46187 - DNA, 26 bp, Artificial Sequence
  Description of Artificial Sequence: Synthetic oligonucleotide
agaaggaggggccggagtattgggac

SEQ ID NO: 46188 - DNA, 25 bp, Artificial Sequence
  Description of Artificial Sequence: Synthetic oligonucleotide
gaaggaggggccggagtattgggac

SEQ ID NO: 46189 - DNA, 25 bp, Artificial Sequence
  Description of Artificial Sequence: Synthetic oligonucleotide
aaggaggggccggagtattgggacc

SEQ ID NO: 46190 - DNA, 22 bp, Artificial Sequence
  Description of Artificial Sequence: Synthetic oligonucleotide
cgcggagagccccgcttcatcc

SEQ ID NO: 46191 - DNA, 23 bp, Artificial Sequence
  Description of Artificial Sequence: Synthetic oligonucleotide
gcggagagccccgcttcatccca

SEQ ID NO: 46192 - DNA, 24 bp, Artificial Sequence
  Description of Artificial Sequence: Synthetic oligonucleotide
cggagagccccgcttcatcccagt

SEQ ID NO: 46193 - DNA, 24 bp, Artificial Sequence
  Description of Artificial Sequence: Synthetic oligonucleotide
ggagagccccgcttcatcccagtg

SEQ ID NO: 46194 - DNA, 24 bp, Artificial Sequence
  Description of Artificial Sequence: Synthetic oligonucleotide
gagagccccgcttcatcccagtgg

SEQ ID NO: 46195 - DNA, 24 bp, Artificial Sequence
  Description of Artificial Sequence: Synthetic oligonucleotide
agagccccgcttcatcccagtggg

SEQ ID NO: 46196 - DNA, 23 bp, Artificial Sequence
  Description of Artificial Sequence: Synthetic oligonucleotide
gagccccgcttcatcccagtggg

SEQ ID NO: 46197 - DNA, 25 bp, Artificial Sequence
  Description of Artificial Sequence: Synthetic oligonucleotide
agccccgcttcatcccagtgggcta

SEQ ID NO: 46198 - DNA, 24 bp, Artificial Sequence
  Description of Artificial Sequence: Synthetic oligonucleotide
gccccgcttcatcccagtgggcta

SEQ ID NO: 46199 - DNA, 24 bp, Artificial Sequence
  Description of Artificial Sequence: Synthetic oligonucleotide
ccccgcttcatcccagtgggctac

SEQ ID NO: 46200 - DNA, 25 bp, Artificial Sequence
  Description of Artificial Sequence: Synthetic oligonucleotide
cccgcttcatcccagtgggctacgt

SEQ ID NO: 46201 - DNA, 25 bp, Artificial Sequence
  Description of Artificial Sequence: Synthetic oligonucleotide
ccgcttcatcccagtgggctacgtg

SEQ ID NO: 46202 - DNA, 26 bp, Artificial Sequence
  Description of Artificial Sequence: Synthetic oligonucleotide
cgcttcatcccagtgggctacgtgga

SEQ ID NO: 46203 - DNA, 26 bp, Artificial Sequence
  Description of Artificial Sequence: Synthetic oligonucleotide
gcttcatcccagtgggctacgtggac

SEQ ID NO: 46204 - DNA, 27 bp, Artificial Sequence
  Description of Artificial Sequence: Synthetic oligonucleotide
cttcatcccagtgggctacgtggacga

SEQ ID NO: 46205 - DNA, 27 bp, Artificial Sequence
  Description of Artificial Sequence: Synthetic oligonucleotide
ttcatcccagtgggctacgtggacgac

SEQ ID NO: 46206 - DNA, 27 bp, Artificial Sequence
  Description of Artificial Sequence: Synthetic oligonucleotide
tcatcccagtgggctacgtggacgaca

SEQ ID NO: 46207 - DNA, 26 bp, Artificial Sequence
  Description of Artificial Sequence: Synthetic oligonucleotide
catcccagtgggctacgtggacgaca

SEQ ID NO: 46208 - DNA, 26 bp, Artificial Sequence
  Description of Artificial Sequence: Synthetic oligonucleotide
atcccagtgggctacgtggacgacac

SEQ ID NO: 46209 - DNA, 25 bp, Artificial Sequence
  Description of Artificial Sequence: Synthetic oligonucleotide
tcccagtgggctacgtggacgacac

SEQ ID NO: 46210 - DNA, 24 bp, Artificial Sequence
  Description of Artificial Sequence: Synthetic oligonucleotide
cccagtgggctacgtggacgacac

SEQ ID NO: 46211 - DNA, 24 bp, Artificial Sequence
  Description of Artificial Sequence: Synthetic oligonucleotide
ccagtgggctacgtggacgacacg

SEQ ID NO: 46212 - DNA, 22 bp, Artificial Sequence
  Description of Artificial Sequence: Synthetic oligonucleotide
gcggcccgtgagacggagcagt

SEQ ID NO: 46213 - DNA, 22 bp, Artificial Sequence
  Description of Artificial Sequence: Synthetic oligonucleotide
cggcccgtgagacggagcagtg

SEQ ID NO: 46214 - DNA, 23 bp, Artificial Sequence
  Description of Artificial Sequence: Synthetic oligonucleotide
ggcccgtgagacggagcagtgga

SEQ ID NO: 46215 - DNA, 24 bp, Artificial Sequence
  Description of Artificial Sequence: Synthetic oligonucleotide
gcccgtgagacggagcagtggaga

SEQ ID NO: 46216 - DNA, 24 bp, Artificial Sequence
  Description of Artificial Sequence: Synthetic oligonucleotide
cccgtgagacggagcagtggagag

SEQ ID NO: 46217 - DNA, 24 bp, Artificial Sequence
  Description of Artificial Sequence: Synthetic oligonucleotide
ccgtgagacggagcagtggagagc

SEQ ID NO: 46218 - DNA, 26 bp, Artificial Sequence
  Description of Artificial Sequence: Synthetic oligonucleotide
cgtgagacggagcagtggagagccta

SEQ ID NO: 46219 - DNA, 26 bp, Artificial Sequence
  Description of Artificial Sequence: Synthetic oligonucleotide
gtgagacggagcagtggagagcctac

SEQ ID NO: 46220 - DNA, 27 bp, Artificial Sequence
  Description of Artificial Sequence: Synthetic oligonucleotide
tgagacggagcagtggagagcctacct

SEQ ID NO: 46221 - DNA, 26 bp, Artificial Sequence
  Description of Artificial Sequence: Synthetic oligonucleotide
gagacggagcagtggagagcctacct

SEQ ID NO: 46222 - DNA, 26 bp, Artificial Sequence
  Description of Artificial Sequence: Synthetic oligonucleotide
agacggagcagtggagagcctacctg

SEQ ID NO: 46223 - DNA, 25 bp, Artificial Sequence
  Description of Artificial Sequence: Synthetic oligonucleotide
gacggagcagtggagagcctacctg

SEQ ID NO: 46224 - DNA, 26 bp, Artificial Sequence
  Description of Artificial Sequence: Synthetic oligonucleotide
acggagcagtggagagcctacctgga

SEQ ID NO: 46225 - DNA, 25 bp, Artificial Sequence
  Description of Artificial Sequence: Synthetic oligonucleotide
aacgaggacctgcgctcctggacca

SEQ ID NO: 46226 - DNA, 24 bp, Artificial Sequence
  Description of Artificial Sequence: Synthetic oligonucleotide
acgaggacctgcgctcctggacca

SEQ ID NO: 46227 - DNA, 23 bp, Artificial Sequence
  Description of Artificial Sequence: Synthetic oligonucleotide
cgaggacctgcgctcctggacca

SEQ ID NO: 46228 - DNA, 22 bp, Artificial Sequence
  Description of Artificial Sequence: Synthetic oligonucleotide
cgctcctggaccaccgcggaca

SEQ ID NO: 46229 - DNA, 22 bp, Artificial Sequence
  Description of Artificial Sequence: Synthetic oligonucleotide
gctcctggaccaccgcggacac

SEQ ID NO: 46230 - DNA, 22 bp, Artificial Sequence
  Description of Artificial Sequence: Synthetic oligonucleotide
ctcctggaccaccgcggacacg

SEQ ID NO: 46231 - DNA, 22 bp, Artificial Sequence
  Description of Artificial Sequence: Synthetic oligonucleotide
tcctggaccaccgcggacacgg

SEQ ID NO: 46232 - DNA, 21 bp, Artificial Sequence
  Description of Artificial Sequence: Synthetic oligonucleotide
cctggaccaccgcggacacgg

SEQ ID NO: 46233 - DNA, 21 bp, Artificial Sequence
  Description of Artificial Sequence: Synthetic oligonucleotide
ctggaccaccgcggacacggc

SEQ ID NO: 46234 - DNA, 21 bp, Artificial Sequence
  Description of Artificial Sequence: Synthetic oligonucleotide
tggaccaccgcggacacggcg

SEQ ID NO: 46235 - DNA, 20 bp, Artificial Sequence
  Description of Artificial Sequence: Synthetic oligonucleotide
ggaccaccgcggacacggcg

SEQ ID NO: 46236 - DNA, 20 bp, Artificial Sequence
  Description of Artificial Sequence: Synthetic oligonucleotide
gaccaccgcggacacggcgg

SEQ ID NO: 46237 - DNA, 21 bp, Artificial Sequence
  Description of Artificial Sequence: Synthetic oligonucleotide
accaccgcggacacggcggct

SEQ ID NO: 46238 - DNA, 20 bp, Artificial Sequence
  Description of Artificial Sequence: Synthetic oligonucleotide
ccaccgcggacacggcggct

SEQ ID NO: 46239 - DNA, 21 bp, Artificial Sequence
  Description of Artificial Sequence: Synthetic oligonucleotide
caccgcggacacggcggctca

SEQ ID NO: 46240 - DNA, 23 bp, Artificial Sequence
  Description of Artificial Sequence: Synthetic oligonucleotide
accgcggacacggcggctcagat

SEQ ID NO: 46241 - DNA, 27 bp, Artificial Sequence
  Description of Artificial Sequence: Synthetic oligonucleotide
gcgaggacgggtctcacatcatccagt

SEQ ID NO: 46242 - DNA, 27 bp, Artificial Sequence
  Description of Artificial Sequence: Synthetic oligonucleotide
cgaggacgggtctcacatcatccagtg

SEQ ID NO: 46243 - DNA, 27 bp, Artificial Sequence
  Description of Artificial Sequence: Synthetic oligonucleotide
gaggacgggtctcacatcatccagtgg

SEQ ID NO: 46244 - DNA, 29 bp, Artificial Sequence
  Description of Artificial Sequence: Synthetic oligonucleotide
aggacgggtctcacatcatccagtggatg

SEQ ID NO: 46245 - DNA, 28 bp, Artificial Sequence
  Description of Artificial Sequence: Synthetic oligonucleotide
ggacgggtctcacatcatccagtggatg

SEQ ID NO: 46246 - DNA, 31 bp, Artificial Sequence
  Description of Artificial Sequence: Synthetic oligonucleotide
gacgggtctcacatcatccagtggatgtatg

SEQ ID NO: 46247 - DNA, 31 bp, Artificial Sequence
  Description of Artificial Sequence: Synthetic oligonucleotide
acgggtctcacatcatccagtggatgtatgg

SEQ ID NO: 46248 - DNA, 30 bp, Artificial Sequence
  Description of Artificial Sequence: Synthetic oligonucleotide
cgggtctcacatcatccagtggatgtatgg

SEQ ID NO: 46249 - DNA, 30 bp, Artificial Sequence
  Description of Artificial Sequence: Synthetic oligonucleotide
gggtctcacatcatccagtggatgtatggc

SEQ ID NO: 46250 - DNA, 31 bp, Artificial Sequence
  Description of Artificial Sequence: Synthetic oligonucleotide
ggtctcacatcatccagtggatgtatggctg

SEQ ID NO: 46251 - DNA, 31 bp, Artificial Sequence
  Description of Artificial Sequence: Synthetic oligonucleotide
gtctcacatcatccagtggatgtatggctgc

SEQ ID NO: 46252 - DNA, 31 bp, Artificial Sequence
  Description of Artificial Sequence: Synthetic oligonucleotide
tctcacatcatccagtggatgtatggctgcg

SEQ ID NO: 46253 - DNA, 30 bp, Artificial Sequence
  Description of Artificial Sequence: Synthetic oligonucleotide
ctcacatcatccagtggatgtatggctgcg

SEQ ID NO: 46254 - DNA, 31 bp, Artificial Sequence
  Description of Artificial Sequence: Synthetic oligonucleotide
tcacatcatccagtggatgtatggctgcgac

SEQ ID NO: 46255 - DNA, 30 bp, Artificial Sequence
  Description of Artificial Sequence: Synthetic oligonucleotide
cacatcatccagtggatgtatggctgcgac

SEQ ID NO: 46256 - DNA, 30 bp, Artificial Sequence
  Description of Artificial Sequence: Synthetic oligonucleotide
acatcatccagtggatgtatggctgcgacc

SEQ ID NO: 46257 - DNA, 29 bp, Artificial Sequence
  Description of Artificial Sequence: Synthetic oligonucleotide
catcatccagtggatgtatggctgcgacc

SEQ ID NO: 46258 - DNA, 30 bp, Artificial Sequence
  Description of Artificial Sequence: Synthetic oligonucleotide
atcatccagtggatgtatggctgcgacctg

SEQ ID NO: 46259 - DNA, 29 bp, Artificial Sequence
  Description of Artificial Sequence: Synthetic oligonucleotide
tcatccagtggatgtatggctgcgacctg

SEQ ID NO: 46260 - DNA, 28 bp, Artificial Sequence
  Description of Artificial Sequence: Synthetic oligonucleotide
catccagtggatgtatggctgcgacctg

SEQ ID NO: 46261 - DNA, 28 bp, Artificial Sequence
  Description of Artificial Sequence: Synthetic oligonucleotide
atccagtggatgtatggctgcgacctgg

SEQ ID NO: 46262 - DNA, 29 bp, Artificial Sequence
  Description of Artificial Sequence: Synthetic oligonucleotide
acaccctccagtggatgtatggctgctac

SEQ ID NO: 46263 - DNA, 28 bp, Artificial Sequence
  Description of Artificial Sequence: Synthetic oligonucleotide
caccctccagtggatgtatggctgctac

SEQ ID NO: 46264 - DNA, 28 bp, Artificial Sequence
  Description of Artificial Sequence: Synthetic oligonucleotide
accctccagtggatgtatggctgctacc

SEQ ID NO: 46265 - DNA, 27 bp, Artificial Sequence
  Description of Artificial Sequence: Synthetic oligonucleotide
ccctccagtggatgtatggctgctacc

SEQ ID NO: 46266 - DNA, 28 bp, Artificial Sequence
  Description of Artificial Sequence: Synthetic oligonucleotide
cctccagtggatgtatggctgctacctg

SEQ ID NO: 46267 - DNA, 28 bp, Artificial Sequence
  Description of Artificial Sequence: Synthetic oligonucleotide
ctccagtggatgtatggctgctacctgg

SEQ ID NO: 46268 - DNA, 28 bp, Artificial Sequence
  Description of Artificial Sequence: Synthetic oligonucleotide
tccagtggatgtatggctgctacctggg

SEQ ID NO: 46269 - DNA, 27 bp, Artificial Sequence
  Description of Artificial Sequence: Synthetic oligonucleotide
ccagtggatgtatggctgctacctggg

SEQ ID NO: 46270 - DNA, 27 bp, Artificial Sequence
  Description of Artificial Sequence: Synthetic oligonucleotide
cagtggatgtatggctgctacctgggg

SEQ ID NO: 46271 - DNA, 27 bp, Artificial Sequence
  Description of Artificial Sequence: Synthetic oligonucleotide
agtggatgtatggctgctacctggggc

SEQ ID NO: 46272 - DNA, 26 bp, Artificial Sequence
  Description of Artificial Sequence: Synthetic oligonucleotide
gtggatgtatggctgctacctggggc

SEQ ID NO: 46273 - DNA, 26 bp, Artificial Sequence
  Description of Artificial Sequence: Synthetic oligonucleotide
tggatgtatggctgctacctggggcc

SEQ ID NO: 46274 - DNA, 25 bp, Artificial Sequence
  Description of Artificial Sequence: Synthetic oligonucleotide
ggatgtatggctgctacctggggcc

SEQ ID NO: 46275 - DNA, 25 bp, Artificial Sequence
  Description of Artificial Sequence: Synthetic oligonucleotide
gatgtatggctgctacctggggccc

SEQ ID NO: 46276 - DNA, 26 bp, Artificial Sequence
  Description of Artificial Sequence: Synthetic oligonucleotide
atgtatggctgctacctggggcccga

SEQ ID NO: 46277 - DNA, 25 bp, Artificial Sequence
  Description of Artificial Sequence: Synthetic oligonucleotide
tgtatggctgctacctggggcccga

SEQ ID NO: 46278 - DNA, 24 bp, Artificial Sequence
  Description of Artificial Sequence: Synthetic oligonucleotide
gtatggctgctacctggggcccga

SEQ ID NO: 46279 - DNA, 24 bp, Artificial Sequence
  Description of Artificial Sequence: Synthetic oligonucleotide
tatggctgctacctggggcccgac

SEQ ID NO: 46280 - DNA, 23 bp, Artificial Sequence
  Description of Artificial Sequence: Synthetic oligonucleotide
atggctgctacctggggcccgac

SEQ ID NO: 46281 - DNA, 22 bp, Artificial Sequence
  Description of Artificial Sequence: Synthetic oligonucleotide
tggctgctacctggggcccgac

SEQ ID NO: 46282 - DNA, 21 bp, Artificial Sequence
  Description of Artificial Sequence: Synthetic oligonucleotide
ggctgctacctggggcccgac

SEQ ID NO: 46283 - DNA, 21 bp, Artificial Sequence
  Description of Artificial Sequence: Synthetic oligonucleotide
gctgctacctggggcccgacg

SEQ ID NO: 46284 - DNA, 21 bp, Artificial Sequence
  Description of Artificial Sequence: Synthetic oligonucleotide
ctgctacctggggcccgacgg

SEQ ID NO: 46285 - DNA, 21 bp, Artificial Sequence
  Description of Artificial Sequence: Synthetic oligonucleotide
tgctacctggggcccgacggg

SEQ ID NO: 46286 - DNA, 20 bp, Artificial Sequence
  Description of Artificial Sequence: Synthetic oligonucleotide
gctacctggggcccgacggg

SEQ ID NO: 46287 - DNA, 20 bp, Artificial Sequence
  Description of Artificial Sequence: Synthetic oligonucleotide
ctacctggggcccgacgggc

SEQ ID NO: 46288 - DNA, 20 bp, Artificial Sequence
  Description of Artificial Sequence: Synthetic oligonucleotide
tacctggggcccgacgggcg

SEQ ID NO: 46289 - DNA, 20 bp, Artificial Sequence
  Description of Artificial Sequence: Synthetic oligonucleotide
cgcggacacggcggctcagg

SEQ ID NO: 46290 - DNA, 20 bp, Artificial Sequence
  Description of Artificial Sequence: Synthetic oligonucleotide
gcggacacggcggctcaggg

SEQ ID NO: 46291 - DNA, 20 bp, Artificial Sequence
  Description of Artificial Sequence: Synthetic oligonucleotide
cggacacggcggctcagggg

SEQ ID NO: 46292 - DNA, 20 bp, Artificial Sequence
  Description of Artificial Sequence: Synthetic oligonucleotide
ggacacggcggctcaggggc

SEQ ID NO: 46293 - DNA, 21 bp, Artificial Sequence
  Description of Artificial Sequence: Synthetic oligonucleotide
gacacggcggctcaggggcca

SEQ ID NO: 46294 - DNA, 21 bp, Artificial Sequence
  Description of Artificial Sequence: Synthetic oligonucleotide
acacggcggctcaggggccag

SEQ ID NO: 46295 - DNA, 20 bp, Artificial Sequence
  Description of Artificial Sequence: Synthetic oligonucleotide
cacggcggctcaggggccag

SEQ ID NO: 46296 - DNA, 20 bp, Artificial Sequence
  Description of Artificial Sequence: Synthetic oligonucleotide
acggcggctcaggggccagc

SEQ ID NO: 46297 - DNA, 20 bp, Artificial Sequence
  Description of Artificial Sequence: Synthetic oligonucleotide
cggcggctcaggggccagct

SEQ ID NO: 46298 - DNA, 20 bp, Artificial Sequence
  Description of Artificial Sequence: Synthetic oligonucleotide
ggcggctcaggggccagcgt

SEQ ID NO: 46299 - DNA, 21 bp, Artificial Sequence
  Description of Artificial Sequence: Synthetic oligonucleotide
gcggctcaggggccagcgcaa

SEQ ID NO: 46300 - DNA, 22 bp, Artificial Sequence
  Description of Artificial Sequence: Synthetic oligonucleotide
cggctcaggggccagcgcaagt

SEQ ID NO: 46301 - DNA, 22 bp, Artificial Sequence
  Description of Artificial Sequence: Synthetic oligonucleotide
ggctcaggggccagcgcaagtg

SEQ ID NO: 46302 - DNA, 22 bp, Artificial Sequence
  Description of Artificial Sequence: Synthetic oligonucleotide
gctcaggggccagcgcaagtgg

SEQ ID NO: 46303 - DNA, 23 bp, Artificial Sequence
  Description of Artificial Sequence: Synthetic oligonucleotide
ctcaggggccagcgcaagtggga

SEQ ID NO: 46304 - DNA, 23 bp, Artificial Sequence
  Description of Artificial Sequence: Synthetic oligonucleotide
tcaggggccagcgcaagtgggag

SEQ ID NO: 46305 - DNA, 22 bp, Artificial Sequence
  Description of Artificial Sequence: Synthetic oligonucleotide
caggggccagcgcaagtgggag

SEQ ID NO: 46306 - DNA, 22 bp, Artificial Sequence
  Description of Artificial Sequence: Synthetic oligonucleotide
aggggccagcgcaagtgggagg

SEQ ID NO: 46307 - DNA, 21 bp, Artificial Sequence
  Description of Artificial Sequence: Synthetic oligonucleotide
ggggccagcgcaagtgggagg

SEQ ID NO: 46308 - DNA, 21 bp, Artificial Sequence
  Description of Artificial Sequence: Synthetic oligonucleotide
gggccagcgcaagtgggaggc

SEQ ID NO: 46309 - DNA, 21 bp, Artificial Sequence
  Description of Artificial Sequence: Synthetic oligonucleotide
ggccagcgcaagtgggaggcg

SEQ ID NO: 46310 - DNA, 21 bp, Artificial Sequence
  Description of Artificial Sequence: Synthetic oligonucleotide
gccagcgcaagtgggaggcgg

SEQ ID NO: 46311 - DNA, 22 bp, Artificial Sequence
  Description of Artificial Sequence: Synthetic oligonucleotide
atgcgggtcatggcgccccgag

SEQ ID NO: 46312 - DNA, 21 bp, Artificial Sequence
  Description of Artificial Sequence: Synthetic oligonucleotide
tgcgggtcatggcgccccgag

SEQ ID NO: 46313 - DNA, 20 bp, Artificial Sequence
  Description of Artificial Sequence: Synthetic oligonucleotide
gcgggtcatggcgccccgag

SEQ ID NO: 46314 - DNA, 20 bp, Artificial Sequence
  Description of Artificial Sequence: Synthetic oligonucleotide
cgggtcatggcgccccgagc

SEQ ID NO: 46315 - DNA, 20 bp, Artificial Sequence
  Description of Artificial Sequence: Synthetic oligonucleotide
gggtcatggcgccccgagcc

SEQ ID NO: 46316 - DNA, 21 bp, Artificial Sequence
  Description of Artificial Sequence: Synthetic oligonucleotide
ggtcatggcgccccgagccct

SEQ ID NO: 46317 - DNA, 21 bp, Artificial Sequence
  Description of Artificial Sequence: Synthetic oligonucleotide
gtcatggcgccccgagccctc

SEQ ID NO: 46318 - DNA, 22 bp, Artificial Sequence
  Description of Artificial Sequence: Synthetic oligonucleotide
tcatggcgccccgagccctcct

SEQ ID NO: 46319 - DNA, 21 bp, Artificial Sequence
  Description of Artificial Sequence: Synthetic oligonucleotide
catggcgccccgagccctcct

SEQ ID NO: 46320 - DNA, 21 bp, Artificial Sequence
  Description of Artificial Sequence: Synthetic oligonucleotide
atggcgccccgagccctcctc

SEQ ID NO: 46321 - DNA, 20 bp, Artificial Sequence
  Description of Artificial Sequence: Synthetic oligonucleotide
tggcgccccgagccctcctc

SEQ ID NO: 46322 - DNA, 20 bp, Artificial Sequence
  Description of Artificial Sequence: Synthetic oligonucleotide
ggcgccccgagccctcctct

SEQ ID NO: 46323 - DNA, 20 bp, Artificial Sequence
  Description of Artificial Sequence: Synthetic oligonucleotide
gcgccccgagccctcctcct

SEQ ID NO: 46324 - DNA, 20 bp, Artificial Sequence
  Description of Artificial Sequence: Synthetic oligonucleotide
cgccccgagccctcctcctg

SEQ ID NO: 46325 - DNA, 21 bp, Artificial Sequence
  Description of Artificial Sequence: Synthetic oligonucleotide
gccccgagccctcctcctgct

SEQ ID NO: 46326 - DNA, 21 bp, Artificial Sequence
  Description of Artificial Sequence: Synthetic oligonucleotide
ccccgagccctcctcctgctg

SEQ ID NO: 46327 - DNA, 22 bp, Artificial Sequence
  Description of Artificial Sequence: Synthetic oligonucleotide
cccgagccctcctcctgctgct

SEQ ID NO: 46328 - DNA, 23 bp, Artificial Sequence
  Description of Artificial Sequence: Synthetic oligonucleotide
ccgagccctcctcctgctgctct

SEQ ID NO: 46329 - DNA, 23 bp, Artificial Sequence
  Description of Artificial Sequence: Synthetic oligonucleotide
cgagccctcctcctgctgctctc

SEQ ID NO: 46330 - DNA, 23 bp, Artificial Sequence
  Description of Artificial Sequence: Synthetic oligonucleotide
gagccctcctcctgctgctctcg

SEQ ID NO: 46331 - DNA, 23 bp, Artificial Sequence
  Description of Artificial Sequence: Synthetic oligonucleotide
agccctcctcctgctgctctcgg

SEQ ID NO: 46332 - DNA, 22 bp, Artificial Sequence
  Description of Artificial Sequence: Synthetic oligonucleotide
gccctcctcctgctgctctcgg

SEQ ID NO: 46333 - DNA, 23 bp, Artificial Sequence
  Description of Artificial Sequence: Synthetic oligonucleotide
ctcctcctgctgctctcgggagg

SEQ ID NO: 46334 - DNA, 23 bp, Artificial Sequence
  Description of Artificial Sequence: Synthetic oligonucleotide
tcctcctgctgctctcgggaggc

SEQ ID NO: 46335 - DNA, 22 bp, Artificial Sequence
  Description of Artificial Sequence: Synthetic oligonucleotide
cctcctgctgctctcgggaggc

SEQ ID NO: 46336 - DNA, 23 bp, Artificial Sequence
  Description of Artificial Sequence: Synthetic oligonucleotide
ctcctgctgctctcgggaggcct

SEQ ID NO: 46337 - DNA, 23 bp, Artificial Sequence
  Description of Artificial Sequence: Synthetic oligonucleotide
tcctgctgctctcgggaggcctg

SEQ ID NO: 46338 - DNA, 22 bp, Artificial Sequence
  Description of Artificial Sequence: Synthetic oligonucleotide
cctgctgctctcgggaggcctg

SEQ ID NO: 46339 - DNA, 22 bp, Artificial Sequence
  Description of Artificial Sequence: Synthetic oligonucleotide
ctgctgctctcgggaggcctgg

SEQ ID NO: 46340 - DNA, 22 bp, Artificial Sequence
  Description of Artificial Sequence: Synthetic oligonucleotide
tgctgctctcgggaggcctggc

SEQ ID NO: 46341 - DNA, 21 bp, Artificial Sequence
  Description of Artificial Sequence: Synthetic oligonucleotide
gctgctctcgggaggcctggc

SEQ ID NO: 46342 - DNA, 21 bp, Artificial Sequence
  Description of Artificial Sequence: Synthetic oligonucleotide
ctgctctcgggaggcctggcc

SEQ ID NO: 46343 - DNA, 22 bp, Artificial Sequence
  Description of Artificial Sequence: Synthetic oligonucleotide
tgctctcgggaggcctggccct

SEQ ID NO: 46344 - DNA, 21 bp, Artificial Sequence
  Description of Artificial Sequence: Synthetic oligonucleotide
gctctcgggaggcctggccct

SEQ ID NO: 46345 - DNA, 22 bp, Artificial Sequence
  Description of Artificial Sequence: Synthetic oligonucleotide
ctctcgggaggcctggccctga

SEQ ID NO: 46346 - DNA, 22 bp, Artificial Sequence
  Description of Artificial Sequence: Synthetic oligonucleotide
tctcgggaggcctggccctgac

SEQ ID NO: 46347 - DNA, 21 bp, Artificial Sequence
  Description of Artificial Sequence: Synthetic oligonucleotide
ctcgggaggcctggccctgac

SEQ ID NO: 46348 - DNA, 21 bp, Artificial Sequence
  Description of Artificial Sequence: Synthetic oligonucleotide
tcgggaggcctggccctgacc

SEQ ID NO: 46349 - DNA, 20 bp, Artificial Sequence
  Description of Artificial Sequence: Synthetic oligonucleotide
cgggaggcctggccctgacc

SEQ ID NO: 46350 - DNA, 21 bp, Artificial Sequence
  Description of Artificial Sequence: Synthetic oligonucleotide
gggaggcctggccctgaccga

SEQ ID NO: 46351 - DNA, 22 bp, Artificial Sequence
  Description of Artificial Sequence: Synthetic oligonucleotide
ggaggcctggccctgaccgaga

SEQ ID NO: 46352 - DNA, 22 bp, Artificial Sequence
  Description of Artificial Sequence: Synthetic oligonucleotide
gaggcctggccctgaccgagac

SEQ ID NO: 46353 - DNA, 23 bp, Artificial Sequence
  Description of Artificial Sequence: Synthetic oligonucleotide
aggcctggccctgaccgagacct

SEQ ID NO: 46354 - DNA, 22 bp, Artificial Sequence
  Description of Artificial Sequence: Synthetic oligonucleotide
ggcctggccctgaccgagacct

SEQ ID NO: 46355 - DNA, 22 bp, Artificial Sequence
  Description of Artificial Sequence: Synthetic oligonucleotide
gcctggccctgaccgagacctg

SEQ ID NO: 46356 - DNA, 27 bp, Artificial Sequence
  Description of Artificial Sequence: Synthetic oligonucleotide
gaggtatttcgacaccgccgtgtccca

SEQ ID NO: 46357 - DNA, 27 bp, Artificial Sequence
  Description of Artificial Sequence: Synthetic oligonucleotide
aggtatttcgacaccgccgtgtcccag

SEQ ID NO: 46358 - DNA, 26 bp, Artificial Sequence
  Description of Artificial Sequence: Synthetic oligonucleotide
ggtatttcgacaccgccgtgtcccag

SEQ ID NO: 46359 - DNA, 26 bp, Artificial Sequence
  Description of Artificial Sequence: Synthetic oligonucleotide
gtatttcgacaccgccgtgtcccagc

SEQ ID NO: 46360 - DNA, 26 bp, Artificial Sequence
  Description of Artificial Sequence: Synthetic oligonucleotide
tatttcgacaccgccgtgtcccagcc

SEQ ID NO: 46361 - DNA, 25 bp, Artificial Sequence
  Description of Artificial Sequence: Synthetic oligonucleotide
atttcgacaccgccgtgtcccagcc

SEQ ID NO: 46362 - DNA, 24 bp, Artificial Sequence
  Description of Artificial Sequence: Synthetic oligonucleotide
tttcgacaccgccgtgtcccagcc

SEQ ID NO: 46363 - DNA, 23 bp, Artificial Sequence
  Description of Artificial Sequence: Synthetic oligonucleotide
ttcgacaccgccgtgtcccagcc

SEQ ID NO: 46364 - DNA, 22 bp, Artificial Sequence
  Description of Artificial Sequence: Synthetic oligonucleotide
tcgacaccgccgtgtcccagcc

SEQ ID NO: 46365 - DNA, 21 bp, Artificial Sequence
  Description of Artificial Sequence: Synthetic oligonucleotide
cgacaccgccgtgtcccagcc

SEQ ID NO: 46366 - DNA, 21 bp, Artificial Sequence
  Description of Artificial Sequence: Synthetic oligonucleotide
gacaccgccgtgtcccagccc

SEQ ID NO: 46367 - DNA, 20 bp, Artificial Sequence
  Description of Artificial Sequence: Synthetic oligonucleotide
tgtcccagcccggccgcgga

SEQ ID NO: 46368 - DNA, 20 bp, Artificial Sequence
  Description of Artificial Sequence: Synthetic oligonucleotide
gtcccagcccggccgcggat

SEQ ID NO: 46369 - DNA, 20 bp, Artificial Sequence
  Description of Artificial Sequence: Synthetic oligonucleotide
tcccagcccggccgcggaga

SEQ ID NO: 46370 - DNA, 20 bp, Artificial Sequence
  Description of Artificial Sequence: Synthetic oligonucleotide
cccagcccggccgcggagat

SEQ ID NO: 46371 - DNA, 20 bp, Artificial Sequence
  Description of Artificial Sequence: Synthetic oligonucleotide
ccagcccggccgcggagagt

SEQ ID NO: 46372 - DNA, 20 bp, Artificial Sequence
  Description of Artificial Sequence: Synthetic oligonucleotide
cagcccggccgcggagagct

SEQ ID NO: 46373 - DNA, 20 bp, Artificial Sequence
  Description of Artificial Sequence: Synthetic oligonucleotide
agcccggccgcggagagcct

SEQ ID NO: 46374 - DNA, 27 bp, Artificial Sequence
  Description of Artificial Sequence: Synthetic oligonucleotide
cccgcttcatctcagtgggctacgtga

SEQ ID NO: 46375 - DNA, 28 bp, Artificial Sequence
  Description of Artificial Sequence: Synthetic oligonucleotide
ccgcttcatctcagtgggctacgtgaac

SEQ ID NO: 46376 - DNA, 28 bp, Artificial Sequence
  Description of Artificial Sequence: Synthetic oligonucleotide
cgcttcatctcagtgggctacgtgaacg

SEQ ID NO: 46377 - DNA, 29 bp, Artificial Sequence
  Description of Artificial Sequence: Synthetic oligonucleotide
gcttcatctcagtgggctacgtgaacgac

SEQ ID NO: 46378 - DNA, 30 bp, Artificial Sequence
  Description of Artificial Sequence: Synthetic oligonucleotide
cttcatctcagtgggctacgtgaacgacac

SEQ ID NO: 46379 - DNA, 30 bp, Artificial Sequence
  Description of Artificial Sequence: Synthetic oligonucleotide
ttcatctcagtgggctacgtgaacgacacg

SEQ ID NO: 46380 - DNA, 29 bp, Artificial Sequence
  Description of Artificial Sequence: Synthetic oligonucleotide
tcatctcagtgggctacgtgaacgacacg

SEQ ID NO: 46381 - DNA, 28 bp, Artificial Sequence
  Description of Artificial Sequence: Synthetic oligonucleotide
catctcagtgggctacgtgaacgacacg

SEQ ID NO: 46382 - DNA, 28 bp, Artificial Sequence
  Description of Artificial Sequence: Synthetic oligonucleotide
atctcagtgggctacgtgaacgacacgc

SEQ ID NO: 46383 - DNA, 27 bp, Artificial Sequence
  Description of Artificial Sequence: Synthetic oligonucleotide
tctcagtgggctacgtgaacgacacgc

SEQ ID NO: 46384 - DNA, 27 bp, Artificial Sequence
  Description of Artificial Sequence: Synthetic oligonucleotide
ctcagtgggctacgtgaacgacacgca

SEQ ID NO: 46385 - DNA, 27 bp, Artificial Sequence
  Description of Artificial Sequence: Synthetic oligonucleotide
tcagtgggctacgtgaacgacacgcag

SEQ ID NO: 46386 - DNA, 23 bp, Artificial Sequence
  Description of Artificial Sequence: Synthetic oligonucleotide
gtgaggcggagcagtggagagcc

SEQ ID NO: 46387 - DNA, 24 bp, Artificial Sequence
  Description of Artificial Sequence: Synthetic oligonucleotide
tgaggcggagcagtggagagccca

SEQ ID NO: 46388 - DNA, 23 bp, Artificial Sequence
  Description of Artificial Sequence: Synthetic oligonucleotide
gaggcggagcagtggagagccca

SEQ ID NO: 46389 - DNA, 23 bp, Artificial Sequence
  Description of Artificial Sequence: Synthetic oligonucleotide
aggcggagcagtggagagcccac

SEQ ID NO: 46390 - DNA, 22 bp, Artificial Sequence
  Description of Artificial Sequence: Synthetic oligonucleotide
ggcggagcagtggagagcccac

SEQ ID NO: 46391 - DNA, 23 bp, Artificial Sequence
  Description of Artificial Sequence: Synthetic oligonucleotide
gcggagcagtggagagcccacct

SEQ ID NO: 46392 - DNA, 23 bp, Artificial Sequence
  Description of Artificial Sequence: Synthetic oligonucleotide
cggagcagtggagagcccacctg

SEQ ID NO: 46393 - DNA, 24 bp, Artificial Sequence
  Description of Artificial Sequence: Synthetic oligonucleotide
ggagcagtggagagcccacctgga

SEQ ID NO: 46394 - DNA, 24 bp, Artificial Sequence
  Description of Artificial Sequence: Synthetic oligonucleotide
gagcagtggagagcccacctggag

SEQ ID NO: 46395 - DNA, 24 bp, Artificial Sequence
  Description of Artificial Sequence: Synthetic oligonucleotide
agcagtggagagcccacctggagg

SEQ ID NO: 46396 - DNA, 23 bp, Artificial Sequence
  Description of Artificial Sequence: Synthetic oligonucleotide
gcagtggagagcccacctggagg

SEQ ID NO: 46397 - DNA, 23 bp, Artificial Sequence
  Description of Artificial Sequence: Synthetic oligonucleotide
cagtggagagcccacctggaggg

SEQ ID NO: 46398 - DNA, 24 bp, Artificial Sequence
  Description of Artificial Sequence: Synthetic oligonucleotide
agtggagagcccacctggagggca

SEQ ID NO: 46399 - DNA, 23 bp, Artificial Sequence
  Description of Artificial Sequence: Synthetic oligonucleotide
gtggagagcccacctggagggca

SEQ ID NO: 46400 - DNA, 23 bp, Artificial Sequence
  Description of Artificial Sequence: Synthetic oligonucleotide
tggagagcccacctggagggcac

SEQ ID NO: 46401 - DNA, 22 bp, Artificial Sequence
  Description of Artificial Sequence: Synthetic oligonucleotide
ggagagcccacctggagggcac

SEQ ID NO: 46402 - DNA, 23 bp, Artificial Sequence
  Description of Artificial Sequence: Synthetic oligonucleotide
gagagcccacctggagggcacgt

SEQ ID NO: 46403 - DNA, 23 bp, Artificial Sequence
  Description of Artificial Sequence: Synthetic oligonucleotide
agagcccacctggagggcacgtg

SEQ ID NO: 46404 - DNA, 22 bp, Artificial Sequence
  Description of Artificial Sequence: Synthetic oligonucleotide
gagcccacctggagggcacgtg

SEQ ID NO: 46405 - DNA, 22 bp, Artificial Sequence
  Description of Artificial Sequence: Synthetic oligonucleotide
agcccacctggagggcacgtgc

SEQ ID NO: 46406 - DNA, 21 bp, Artificial Sequence
  Description of Artificial Sequence: Synthetic oligonucleotide
gcccacctggagggcacgtgc

SEQ ID NO: 46407 - DNA, 22 bp, Artificial Sequence
  Description of Artificial Sequence: Synthetic oligonucleotide
cccacctggagggcacgtgcgt

SEQ ID NO: 46408 - DNA, 22 bp, Artificial Sequence
  Description of Artificial Sequence: Synthetic oligonucleotide
ccacctggagggcacgtgcgtg

SEQ ID NO: 46409 - DNA, 23 bp, Artificial Sequence
  Description of Artificial Sequence: Synthetic oligonucleotide
cacctggagggcacgtgcgtgga

SEQ ID NO: 46410 - DNA, 22 bp, Artificial Sequence
  Description of Artificial Sequence: Synthetic oligonucleotide
cgccgtgggtggagcaggagga

SEQ ID NO: 46411 - DNA, 22 bp, Artificial Sequence
  Description of Artificial Sequence: Synthetic oligonucleotide
gccgtgggtggagcaggaggag

SEQ ID NO: 46412 - DNA, 22 bp, Artificial Sequence
  Description of Artificial Sequence: Synthetic oligonucleotide
ccgtgggtggagcaggaggagc

SEQ ID NO: 46413 - DNA, 22 bp, Artificial Sequence
  Description of Artificial Sequence: Synthetic oligonucleotide
cgtgggtggagcaggaggagcc

SEQ ID NO: 46414 - DNA, 22 bp, Artificial Sequence
  Description of Artificial Sequence: Synthetic oligonucleotide
gtgggtggagcaggaggagccg

SEQ ID NO: 46415 - DNA, 23 bp, Artificial Sequence
  Description of Artificial Sequence: Synthetic oligonucleotide
tgggtggagcaggaggagccgga

SEQ ID NO: 46416 - DNA, 22 bp, Artificial Sequence
  Description of Artificial Sequence: Synthetic oligonucleotide
gggtggagcaggaggagccgga

SEQ ID NO: 46417 - DNA, 26 bp, Artificial Sequence
  Description of Artificial Sequence: Synthetic oligonucleotide
ggtggagcaggaggagccggagtatt

SEQ ID NO: 46418 - DNA, 26 bp, Artificial Sequence
  Description of Artificial Sequence: Synthetic oligonucleotide
gtggagcaggaggagccggagtattg

SEQ ID NO: 46419 - DNA, 26 bp, Artificial Sequence
  Description of Artificial Sequence: Synthetic oligonucleotide
tggagcaggaggagccggagtattgg

SEQ ID NO: 46420 - DNA, 25 bp, Artificial Sequence
  Description of Artificial Sequence: Synthetic oligonucleotide
ggagcaggaggagccggagtattgg

SEQ ID NO: 46421 - DNA, 20 bp, Artificial Sequence
  Description of Artificial Sequence: Synthetic oligonucleotide
cgtgtcccggcccggcctct

SEQ ID NO: 46422 - DNA, 20 bp, Artificial Sequence
  Description of Artificial Sequence: Synthetic oligonucleotide
gtgtcccggcccggcctcgt

SEQ ID NO: 46423 - DNA, 20 bp, Artificial Sequence
  Description of Artificial Sequence: Synthetic oligonucleotide
tgtcccggcccggcctcgga

SEQ ID NO: 46424 - DNA, 20 bp, Artificial Sequence
  Description of Artificial Sequence: Synthetic oligonucleotide
gtcccggcccggcctcggat

SEQ ID NO: 46425 - DNA, 20 bp, Artificial Sequence
  Description of Artificial Sequence: Synthetic oligonucleotide
tcccggcccggcctcggaga

SEQ ID NO: 46426 - DNA, 20 bp, Artificial Sequence
  Description of Artificial Sequence: Synthetic oligonucleotide
cccggcccggcctcggagat

SEQ ID NO: 46427 - DNA, 20 bp, Artificial Sequence
  Description of Artificial Sequence: Synthetic oligonucleotide
ccggcccggcctcggagagt

SEQ ID NO: 46428 - DNA, 20 bp, Artificial Sequence
  Description of Artificial Sequence: Synthetic oligonucleotide
cggcccggcctcggagagct

SEQ ID NO: 46429 - DNA, 20 bp, Artificial Sequence
  Description of Artificial Sequence: Synthetic oligonucleotide
ggcccggcctcggagagcct

SEQ ID NO: 46430 - DNA, 20 bp, Artificial Sequence
  Description of Artificial Sequence: Synthetic oligonucleotide
gcccggcctcggagagccct

SEQ ID NO: 46431 - DNA, 20 bp, Artificial Sequence
  Description of Artificial Sequence: Synthetic oligonucleotide
cccggcctcggagagcccct

SEQ ID NO: 46432 - DNA, 20 bp, Artificial Sequence
  Description of Artificial Sequence: Synthetic oligonucleotide
ccggcctcggagagccccgt

SEQ ID NO: 46433 - DNA, 21 bp, Artificial Sequence
  Description of Artificial Sequence: Synthetic oligonucleotide
cggcctcggagagccccgctt

SEQ ID NO: 46434 - DNA, 23 bp, Artificial Sequence
  Description of Artificial Sequence: Synthetic oligonucleotide
ggcctcggagagccccgcttcat

SEQ ID NO: 46435 - DNA, 24 bp, Artificial Sequence
  Description of Artificial Sequence: Synthetic oligonucleotide
gcctcggagagccccgcttcatct

SEQ ID NO: 46436 - DNA, 25 bp, Artificial Sequence
  Description of Artificial Sequence: Synthetic oligonucleotide
cctcggagagccccgcttcatctca

SEQ ID NO: 46437 - DNA, 26 bp, Artificial Sequence
  Description of Artificial Sequence: Synthetic oligonucleotide
ctcggagagccccgcttcatctcagt

SEQ ID NO: 46438 - DNA, 26 bp, Artificial Sequence
  Description of Artificial Sequence: Synthetic oligonucleotide
tcggagagccccgcttcatctcagtg

SEQ ID NO: 46439 - DNA, 28 bp, Artificial Sequence
  Description of Artificial Sequence: Synthetic oligonucleotide
agtggctccgcagatacctggagaactg

SEQ ID NO: 46440 - DNA, 27 bp, Artificial Sequence
  Description of Artificial Sequence: Synthetic oligonucleotide
gtggctccgcagatacctggagaactg

SEQ ID NO: 46441 - DNA, 27 bp, Artificial Sequence
  Description of Artificial Sequence: Synthetic oligonucleotide
tggctccgcagatacctggagaactgg

SEQ ID NO: 46442 - DNA, 27 bp, Artificial Sequence
  Description of Artificial Sequence: Synthetic oligonucleotide
ggctccgcagatacctggagaactgga

SEQ ID NO: 46443 - DNA, 28 bp, Artificial Sequence
  Description of Artificial Sequence: Synthetic oligonucleotide
gctccgcagatacctggagaactggaag

SEQ ID NO: 46444 - DNA, 28 bp, Artificial Sequence
  Description of Artificial Sequence: Synthetic oligonucleotide
ctccgcagatacctggagaactggaagg

SEQ ID NO: 46445 - DNA, 29 bp, Artificial Sequence
  Description of Artificial Sequence: Synthetic oligonucleotide
tccgcagatacctggagaactggaaggag

SEQ ID NO: 46446 - DNA, 28 bp, Artificial Sequence
  Description of Artificial Sequence: Synthetic oligonucleotide
ccgcagatacctggagaactggaaggag

SEQ ID NO: 46447 - DNA, 29 bp, Artificial Sequence
  Description of Artificial Sequence: Synthetic oligonucleotide
cgcagatacctggagaactggaaggagac

SEQ ID NO: 46448 - DNA, 29 bp, Artificial Sequence
  Description of Artificial Sequence: Synthetic oligonucleotide
gcagatacctggagaactggaaggagacg

SEQ ID NO: 46449 - DNA, 29 bp, Artificial Sequence
  Description of Artificial Sequence: Synthetic oligonucleotide
cagatacctggagaactggaaggagacgc

SEQ ID NO: 46450 - DNA, 30 bp, Artificial Sequence
  Description of Artificial Sequence: Synthetic oligonucleotide
agatacctggagaactggaaggagacgctg

SEQ ID NO: 46451 - DNA, 29 bp, Artificial Sequence
  Description of Artificial Sequence: Synthetic oligonucleotide
gatacctggagaactggaaggagacgctg

SEQ ID NO: 46452 - DNA, 29 bp, Artificial Sequence
  Description of Artificial Sequence: Synthetic oligonucleotide
atacctggagaactggaaggagacgctgc

SEQ ID NO: 46453 - DNA, 28 bp, Artificial Sequence
  Description of Artificial Sequence: Synthetic oligonucleotide
tacctggagaactggaaggagacgctgc

SEQ ID NO: 46454 - DNA, 27 bp, Artificial Sequence
  Description of Artificial Sequence: Synthetic oligonucleotide
acctggagaactggaaggagacgctgc

SEQ ID NO: 46455 - DNA, 27 bp, Artificial Sequence
  Description of Artificial Sequence: Synthetic oligonucleotide
cctggagaactggaaggagacgctgca

SEQ ID NO: 46456 - DNA, 27 bp, Artificial Sequence
  Description of Artificial Sequence: Synthetic oligonucleotide
ctggagaactggaaggagacgctgcag

SEQ ID NO: 46457 - DNA, 27 bp, Artificial Sequence
  Description of Artificial Sequence: Synthetic oligonucleotide
tggagaactggaaggagacgctgcagc

SEQ ID NO: 46458 - DNA, 26 bp, Artificial Sequence
  Description of Artificial Sequence: Synthetic oligonucleotide
ggagaactggaaggagacgctgcagc

SEQ ID NO: 46459 - DNA, 26 bp, Artificial Sequence
  Description of Artificial Sequence: Synthetic oligonucleotide
gagaactggaaggagacgctgcagcg

SEQ ID NO: 46460 - DNA, 26 bp, Artificial Sequence
  Description of Artificial Sequence: Synthetic oligonucleotide
agaactggaaggagacgctgcagcgc

SEQ ID NO: 46461 - DNA, 25 bp, Artificial Sequence
  Description of Artificial Sequence: Synthetic oligonucleotide
gaactggaaggagacgctgcagcgc

SEQ ID NO: 46462 - DNA, 25 bp, Artificial Sequence
  Description of Artificial Sequence: Synthetic oligonucleotide
aactggaaggagacgctgcagcgcg

SEQ ID NO: 46463 - DNA, 24 bp, Artificial Sequence
  Description of Artificial Sequence: Synthetic oligonucleotide
actggaaggagacgctgcagcgcg

SEQ ID NO: 46464 - DNA, 23 bp, Artificial Sequence
  Description of Artificial Sequence: Synthetic oligonucleotide
ctggaaggagacgctgcagcgcg

SEQ ID NO: 46465 - DNA, 23 bp, Artificial Sequence
  Description of Artificial Sequence: Synthetic oligonucleotide
tggaaggagacgctgcagcgcgc

SEQ ID NO: 46466 - DNA, 22 bp, Artificial Sequence
  Description of Artificial Sequence: Synthetic oligonucleotide
gcgagtccgagaggggagccct

SEQ ID NO: 46467 - DNA, 22 bp, Artificial Sequence
  Description of Artificial Sequence: Synthetic oligonucleotide
cgagtccgagaggggagccctg

SEQ ID NO: 46468 - DNA, 22 bp, Artificial Sequence
  Description of Artificial Sequence: Synthetic oligonucleotide
gagtccgagaggggagccctgg

SEQ ID NO: 46469 - DNA, 22 bp, Artificial Sequence
  Description of Artificial Sequence: Synthetic oligonucleotide
agtccgagaggggagccctggg

SEQ ID NO: 46470 - DNA, 21 bp, Artificial Sequence
  Description of Artificial Sequence: Synthetic oligonucleotide
gtccgagaggggagccctggg

SEQ ID NO: 46471 - DNA, 21 bp, Artificial Sequence
  Description of Artificial Sequence: Synthetic oligonucleotide
tccgagaggggagccctgggc

SEQ ID NO: 46472 - DNA, 20 bp, Artificial Sequence
  Description of Artificial Sequence: Synthetic oligonucleotide
ccgagaggggagccctgggc

SEQ ID NO: 46473 - DNA, 20 bp, Artificial Sequence
  Description of Artificial Sequence: Synthetic oligonucleotide
cgagaggggagccctgggcg

SEQ ID NO: 46474 - DNA, 20 bp, Artificial Sequence
  Description of Artificial Sequence: Synthetic oligonucleotide
gagaggggagccctgggcgc

SEQ ID NO: 46475 - DNA, 20 bp, Artificial Sequence
  Description of Artificial Sequence: Synthetic oligonucleotide
agaggggagccctgggcgcc

SEQ ID NO: 46476 - DNA, 20 bp, Artificial Sequence
  Description of Artificial Sequence: Synthetic oligonucleotide
gaggggagccctgggcgcct

SEQ ID NO: 46477 - DNA, 20 bp, Artificial Sequence
  Description of Artificial Sequence: Synthetic oligonucleotide
aggggagccctgggcgccgt

SEQ ID NO: 46478 - DNA, 20 bp, Artificial Sequence
  Description of Artificial Sequence: Synthetic oligonucleotide
ggggagccctgggcgccgtt

SEQ ID NO: 46479 - DNA, 20 bp, Artificial Sequence
  Description of Artificial Sequence: Synthetic oligonucleotide
gggagccctgggcgccgtgt

SEQ ID NO: 46480 - DNA, 20 bp, Artificial Sequence
  Description of Artificial Sequence: Synthetic oligonucleotide
ggagccctgggcgccgtggt

SEQ ID NO: 46481 - DNA, 20 bp, Artificial Sequence
  Description of Artificial Sequence: Synthetic oligonucleotide
gagccctgggcgccgtgggt

SEQ ID NO: 46482 - DNA, 20 bp, Artificial Sequence
  Description of Artificial Sequence: Synthetic oligonucleotide
agccctgggcgccgtgggtg

SEQ ID NO: 46483 - DNA, 20 bp, Artificial Sequence
  Description of Artificial Sequence: Synthetic oligonucleotide
gccctgggcgccgtgggtgt

SEQ ID NO: 46484 - DNA, 20 bp, Artificial Sequence
  Description of Artificial Sequence: Synthetic oligonucleotide
ccctgggcgccgtgggtgga

SEQ ID NO: 46485 - DNA, 20 bp, Artificial Sequence
  Description of Artificial Sequence: Synthetic oligonucleotide
cctgggcgccgtgggtggag

SEQ ID NO: 46486 - DNA, 21 bp, Artificial Sequence
  Description of Artificial Sequence: Synthetic oligonucleotide
ctgggcgccgtgggtggagca

SEQ ID NO: 46487 - DNA, 21 bp, Artificial Sequence
  Description of Artificial Sequence: Synthetic oligonucleotide
tgggcgccgtgggtggagcag

SEQ ID NO: 46488 - DNA, 29 bp, Artificial Sequence
  Description of Artificial Sequence: Synthetic oligonucleotide
actccatgaggtatttcgacaccgccgag

SEQ ID NO: 46489 - DNA, 28 bp, Artificial Sequence
  Description of Artificial Sequence: Synthetic oligonucleotide
ctccatgaggtatttcgacaccgccgag

SEQ ID NO: 46490 - DNA, 29 bp, Artificial Sequence
  Description of Artificial Sequence: Synthetic oligonucleotide
tccatgaggtatttcgacaccgccgagtc

SEQ ID NO: 46491 - DNA, 28 bp, Artificial Sequence
  Description of Artificial Sequence: Synthetic oligonucleotide
ccatgaggtatttcgacaccgccgagtc

SEQ ID NO: 46492 - DNA, 28 bp, Artificial Sequence
  Description of Artificial Sequence: Synthetic oligonucleotide
catgaggtatttcgacaccgccgagtcc

SEQ ID NO: 46493 - DNA, 28 bp, Artificial Sequence
  Description of Artificial Sequence: Synthetic oligonucleotide
atgaggtatttcgacaccgccgagtccc

SEQ ID NO: 46494 - DNA, 27 bp, Artificial Sequence
  Description of Artificial Sequence: Synthetic oligonucleotide
tgaggtatttcgacaccgccgagtccc

SEQ ID NO: 46495 - DNA, 26 bp, Artificial Sequence
  Description of Artificial Sequence: Synthetic oligonucleotide
gaggtatttcgacaccgccgagtccc

SEQ ID NO: 46496 - DNA, 26 bp, Artificial Sequence
  Description of Artificial Sequence: Synthetic oligonucleotide
aggtatttcgacaccgccgagtcccg

SEQ ID NO: 46497 - DNA, 25 bp, Artificial Sequence
  Description of Artificial Sequence: Synthetic oligonucleotide
ggtatttcgacaccgccgagtcccg

SEQ ID NO: 46498 - DNA, 25 bp, Artificial Sequence
  Description of Artificial Sequence: Synthetic oligonucleotide
gtatttcgacaccgccgagtcccgg

SEQ ID NO: 46499 - DNA, 25 bp, Artificial Sequence
  Description of Artificial Sequence: Synthetic oligonucleotide
tatttcgacaccgccgagtcccggc

SEQ ID NO: 46500 - DNA, 24 bp, Artificial Sequence
  Description of Artificial Sequence: Synthetic oligonucleotide
atttcgacaccgccgagtcccggc

SEQ ID NO: 46501 - DNA, 23 bp, Artificial Sequence
  Description of Artificial Sequence: Synthetic oligonucleotide
tttcgacaccgccgagtcccggc

SEQ ID NO: 46502 - DNA, 22 bp, Artificial Sequence
  Description of Artificial Sequence: Synthetic oligonucleotide
ttcgacaccgccgagtcccggc

SEQ ID NO: 46503 - DNA, 21 bp, Artificial Sequence
  Description of Artificial Sequence: Synthetic oligonucleotide
tcgacaccgccgagtcccggc

SEQ ID NO: 46504 - DNA, 20 bp, Artificial Sequence
  Description of Artificial Sequence: Synthetic oligonucleotide
cgacaccgccgagtcccggc

SEQ ID NO: 46505 - DNA, 20 bp, Artificial Sequence
  Description of Artificial Sequence: Synthetic oligonucleotide
gacaccgccgagtcccggcc

SEQ ID NO: 46506 - DNA, 20 bp, Artificial Sequence
  Description of Artificial Sequence: Synthetic oligonucleotide
acaccgccgagtcccggccc

SEQ ID NO: 46507 - DNA, 20 bp, Artificial Sequence
  Description of Artificial Sequence: Synthetic oligonucleotide
caccgccgagtcccggccct

SEQ ID NO: 46508 - DNA, 20 bp, Artificial Sequence
  Description of Artificial Sequence: Synthetic oligonucleotide
accgccgagtcccggcccgt

SEQ ID NO: 46509 - DNA, 20 bp, Artificial Sequence
  Description of Artificial Sequence: Synthetic oligonucleotide
ccgccgagtcccggcccgtt

SEQ ID NO: 46510 - DNA, 20 bp, Artificial Sequence
  Description of Artificial Sequence: Synthetic oligonucleotide
cgccgagtcccggcccggtt

SEQ ID NO: 46511 - DNA, 20 bp, Artificial Sequence
  Description of Artificial Sequence: Synthetic oligonucleotide
gccgagtcccggcccggctt

SEQ ID NO: 46512 - DNA, 20 bp, Artificial Sequence
  Description of Artificial Sequence: Synthetic oligonucleotide
ccgagtcccggcccggcctt

SEQ ID NO: 46513 - DNA, 20 bp, Artificial Sequence
  Description of Artificial Sequence: Synthetic oligonucleotide
cgagtcccggcccggccgtt

SEQ ID NO: 46514 - DNA, 20 bp, Artificial Sequence
  Description of Artificial Sequence: Synthetic oligonucleotide
gagtcccggcccggccgctt

SEQ ID NO: 46515 - DNA, 26 bp, Artificial Sequence
  Description of Artificial Sequence: Synthetic oligonucleotide
cagagcgaggacgggtctcacaccat

SEQ ID NO: 46516 - DNA, 26 bp, Artificial Sequence
  Description of Artificial Sequence: Synthetic oligonucleotide
agagcgaggacgggtctcacaccatc

SEQ ID NO: 46517 - DNA, 25 bp, Artificial Sequence
  Description of Artificial Sequence: Synthetic oligonucleotide
gagcgaggacgggtctcacaccatc

SEQ ID NO: 46518 - DNA, 26 bp, Artificial Sequence
  Description of Artificial Sequence: Synthetic oligonucleotide
agcgaggacgggtctcacaccatcca

SEQ ID NO: 46519 - DNA, 25 bp, Artificial Sequence
  Description of Artificial Sequence: Synthetic oligonucleotide
gcgaggacgggtctcacaccatcca

SEQ ID NO: 46520 - DNA, 26 bp, Artificial Sequence
  Description of Artificial Sequence: Synthetic oligonucleotide
cgaggacgggtctcacaccatccaga

SEQ ID NO: 46521 - DNA, 26 bp, Artificial Sequence
  Description of Artificial Sequence: Synthetic oligonucleotide
gaggacgggtctcacaccatccagag

SEQ ID NO: 46522 - DNA, 27 bp, Artificial Sequence
  Description of Artificial Sequence: Synthetic oligonucleotide
aggacgggtctcacaccatccagagga

SEQ ID NO: 46523 - DNA, 27 bp, Artificial Sequence
  Description of Artificial Sequence: Synthetic oligonucleotide
ggacgggtctcacaccatccagaggat

SEQ ID NO: 46524 - DNA, 27 bp, Artificial Sequence
  Description of Artificial Sequence: Synthetic oligonucleotide
gacgggtctcacaccatccagaggatg

SEQ ID NO: 46525 - DNA, 28 bp, Artificial Sequence
  Description of Artificial Sequence: Synthetic oligonucleotide
acgggtctcacaccatccagaggatgtc

SEQ ID NO: 46526 - DNA, 26 bp, Artificial Sequence
  Description of Artificial Sequence: Synthetic oligonucleotide
atgtatggctgcgacctggggcccaa

SEQ ID NO: 46527 - DNA, 25 bp, Artificial Sequence
  Description of Artificial Sequence: Synthetic oligonucleotide
tgtatggctgcgacctggggcccaa

SEQ ID NO: 46528 - DNA, 24 bp, Artificial Sequence
  Description of Artificial Sequence: Synthetic oligonucleotide
gtatggctgcgacctggggcccaa

SEQ ID NO: 46529 - DNA, 24 bp, Artificial Sequence
  Description of Artificial Sequence: Synthetic oligonucleotide
tatggctgcgacctggggcccaac

SEQ ID NO: 46530 - DNA, 23 bp, Artificial Sequence
  Description of Artificial Sequence: Synthetic oligonucleotide
atggctgcgacctggggcccaac

SEQ ID NO: 46531 - DNA, 22 bp, Artificial Sequence
  Description of Artificial Sequence: Synthetic oligonucleotide
tggctgcgacctggggcccaac

SEQ ID NO: 46532 - DNA, 21 bp, Artificial Sequence
  Description of Artificial Sequence: Synthetic oligonucleotide
ggctgcgacctggggcccaac

SEQ ID NO: 46533 - DNA, 21 bp, Artificial Sequence
  Description of Artificial Sequence: Synthetic oligonucleotide
gctgcgacctggggcccaacg

SEQ ID NO: 46534 - DNA, 21 bp, Artificial Sequence
  Description of Artificial Sequence: Synthetic oligonucleotide
ctgcgacctggggcccaacgg

SEQ ID NO: 46535 - DNA, 21 bp, Artificial Sequence
  Description of Artificial Sequence: Synthetic oligonucleotide
tgcgacctggggcccaacggg

SEQ ID NO: 46536 - DNA, 20 bp, Artificial Sequence
  Description of Artificial Sequence: Synthetic oligonucleotide
gcgacctggggcccaacggg

SEQ ID NO: 46537 - DNA, 20 bp, Artificial Sequence
  Description of Artificial Sequence: Synthetic oligonucleotide
cgacctggggcccaacgggc

SEQ ID NO: 46538 - DNA, 20 bp, Artificial Sequence
  Description of Artificial Sequence: Synthetic oligonucleotide
gacctggggcccaacgggcg

SEQ ID NO: 46539 - DNA, 20 bp, Artificial Sequence
  Description of Artificial Sequence: Synthetic oligonucleotide
acctggggcccaacgggcgc

SEQ ID NO: 46540 - DNA, 20 bp, Artificial Sequence
  Description of Artificial Sequence: Synthetic oligonucleotide
cctggggcccaacgggcgct

SEQ ID NO: 46541 - DNA, 20 bp, Artificial Sequence
  Description of Artificial Sequence: Synthetic oligonucleotide
ctggggcccaacgggcgcct

SEQ ID NO: 46542 - DNA, 20 bp, Artificial Sequence
  Description of Artificial Sequence: Synthetic oligonucleotide
tggggcccaacgggcgcctc

SEQ ID NO: 46543 - DNA, 20 bp, Artificial Sequence
  Description of Artificial Sequence: Synthetic oligonucleotide
ggggcccaacgggcgcctct

SEQ ID NO: 46544 - DNA, 20 bp, Artificial Sequence
  Description of Artificial Sequence: Synthetic oligonucleotide
gggcccaacgggcgcctcct

SEQ ID NO: 46545 - DNA, 20 bp, Artificial Sequence
  Description of Artificial Sequence: Synthetic oligonucleotide
ggcccaacgggcgcctcctc

SEQ ID NO: 46546 - DNA, 20 bp, Artificial Sequence
  Description of Artificial Sequence: Synthetic oligonucleotide
gcccaacgggcgcctcctcc

SEQ ID NO: 46547 - DNA, 20 bp, Artificial Sequence
  Description of Artificial Sequence: Synthetic oligonucleotide
cccaacgggcgcctcctccg

SEQ ID NO: 46548 - DNA, 20 bp, Artificial Sequence
  Description of Artificial Sequence: Synthetic oligonucleotide
ccaacgggcgcctcctccgc

SEQ ID NO: 46549 - DNA, 20 bp, Artificial Sequence
  Description of Artificial Sequence: Synthetic oligonucleotide
caacgggcgcctcctccgcg

SEQ ID NO: 46550 - DNA, 20 bp, Artificial Sequence
  Description of Artificial Sequence: Synthetic oligonucleotide
aacgggcgcctcctccgcgg

SEQ ID NO: 46551 - DNA, 21 bp, Artificial Sequence
  Description of Artificial Sequence: Synthetic oligonucleotide
cccgacgggcgcctcctcctt

SEQ ID NO: 46552 - DNA, 21 bp, Artificial Sequence
  Description of Artificial Sequence: Synthetic oligonucleotide
ccgacgggcgcctcctccttg

SEQ ID NO: 46553 - DNA, 21 bp, Artificial Sequence
  Description of Artificial Sequence: Synthetic oligonucleotide
cgacgggcgcctcctccttgg

SEQ ID NO: 46554 - DNA, 24 bp, Artificial Sequence
  Description of Artificial Sequence: Synthetic oligonucleotide
gacgggcgcctcctccttgggtat

SEQ ID NO: 46555 - DNA, 25 bp, Artificial Sequence
  Description of Artificial Sequence: Synthetic oligonucleotide
acgggcgcctcctccttgggtatga

SEQ ID NO: 46556 - DNA, 24 bp, Artificial Sequence
  Description of Artificial Sequence: Synthetic oligonucleotide
cgggcgcctcctccttgggtatga

SEQ ID NO: 46557 - DNA, 24 bp, Artificial Sequence
  Description of Artificial Sequence: Synthetic oligonucleotide
gggcgcctcctccttgggtatgac

SEQ ID NO: 46558 - DNA, 25 bp, Artificial Sequence
  Description of Artificial Sequence: Synthetic oligonucleotide
ggcgcctcctccttgggtatgacca

SEQ ID NO: 46559 - DNA, 26 bp, Artificial Sequence
  Description of Artificial Sequence: Synthetic oligonucleotide
gcgcctcctccttgggtatgaccagt

SEQ ID NO: 46560 - DNA, 26 bp, Artificial Sequence
  Description of Artificial Sequence: Synthetic oligonucleotide
cgcctcctccttgggtatgaccagtc

SEQ ID NO: 46561 - DNA, 26 bp, Artificial Sequence
  Description of Artificial Sequence: Synthetic oligonucleotide
gcctcctccttgggtatgaccagtcc

SEQ ID NO: 46562 - DNA, 26 bp, Artificial Sequence
  Description of Artificial Sequence: Synthetic oligonucleotide
cctcctccttgggtatgaccagtccg

SEQ ID NO: 46563 - DNA, 26 bp, Artificial Sequence
  Description of Artificial Sequence: Synthetic oligonucleotide
ctcctccttgggtatgaccagtccgc

SEQ ID NO: 46564 - DNA, 27 bp, Artificial Sequence
  Description of Artificial Sequence: Synthetic oligonucleotide
tcctccttgggtatgaccagtccgcct

SEQ ID NO: 46565 - DNA, 27 bp, Artificial Sequence
  Description of Artificial Sequence: Synthetic oligonucleotide
cctccttgggtatgaccagtccgccta

SEQ ID NO: 46566 - DNA, 27 bp, Artificial Sequence
  Description of Artificial Sequence: Synthetic oligonucleotide
ctccttgggtatgaccagtccgcctac

SEQ ID NO: 46567 - DNA, 27 bp, Artificial Sequence
  Description of Artificial Sequence: Synthetic oligonucleotide
tccttgggtatgaccagtccgcctacg

SEQ ID NO: 46568 - DNA, 27 bp, Artificial Sequence
  Description of Artificial Sequence: Synthetic oligonucleotide
ccttgggtatgaccagtccgcctacga

SEQ ID NO: 46569 - DNA, 27 bp, Artificial Sequence
  Description of Artificial Sequence: Synthetic oligonucleotide
cttgggtatgaccagtccgcctacgac

SEQ ID NO: 46570 - DNA, 27 bp, Artificial Sequence
  Description of Artificial Sequence: Synthetic oligonucleotide
ttgggtatgaccagtccgcctacgacg

SEQ ID NO: 46571 - DNA, 26 bp, Artificial Sequence
  Description of Artificial Sequence: Synthetic oligonucleotide
tgggtatgaccagtccgcctacgacg

SEQ ID NO: 46572 - DNA, 22 bp, Artificial Sequence
  Description of Artificial Sequence: Synthetic oligonucleotide
gccgcgagtccgagaggggagt

SEQ ID NO: 46573 - DNA, 22 bp, Artificial Sequence
  Description of Artificial Sequence: Synthetic oligonucleotide
ccgcgagtccgagaggggagtc

SEQ ID NO: 46574 - DNA, 22 bp, Artificial Sequence
  Description of Artificial Sequence: Synthetic oligonucleotide
cgcgagtccgagaggggagtcc

SEQ ID NO: 46575 - DNA, 22 bp, Artificial Sequence
  Description of Artificial Sequence: Synthetic oligonucleotide
gcgagtccgagaggggagtccc

SEQ ID NO: 46576 - DNA, 22 bp, Artificial Sequence
  Description of Artificial Sequence: Synthetic oligonucleotide
cgagtccgagaggggagtcccg

SEQ ID NO: 46577 - DNA, 22 bp, Artificial Sequence
  Description of Artificial Sequence: Synthetic oligonucleotide
gagtccgagaggggagtcccgg

SEQ ID NO: 46578 - DNA, 22 bp, Artificial Sequence
  Description of Artificial Sequence: Synthetic oligonucleotide
agtccgagaggggagtcccggg

SEQ ID NO: 46579 - DNA, 21 bp, Artificial Sequence
  Description of Artificial Sequence: Synthetic oligonucleotide
gtccgagaggggagtcccggg

SEQ ID NO: 46580 - DNA, 21 bp, Artificial Sequence
  Description of Artificial Sequence: Synthetic oligonucleotide
tccgagaggggagtcccgggc

SEQ ID NO: 46581 - DNA, 20 bp, Artificial Sequence
  Description of Artificial Sequence: Synthetic oligonucleotide
ccgagaggggagtcccgggc

SEQ ID NO: 46582 - DNA, 20 bp, Artificial Sequence
  Description of Artificial Sequence: Synthetic oligonucleotide
cgagaggggagtcccgggcg

SEQ ID NO: 46583 - DNA, 20 bp, Artificial Sequence
  Description of Artificial Sequence: Synthetic oligonucleotide
gagaggggagtcccgggcgc

SEQ ID NO: 46584 - DNA, 20 bp, Artificial Sequence
  Description of Artificial Sequence: Synthetic oligonucleotide
agaggggagtcccgggcgcc

SEQ ID NO: 46585 - DNA, 20 bp, Artificial Sequence
  Description of Artificial Sequence: Synthetic oligonucleotide
gaggggagtcccgggcgcct

SEQ ID NO: 46586 - DNA, 20 bp, Artificial Sequence
  Description of Artificial Sequence: Synthetic oligonucleotide
aggggagtcccgggcgccgt

SEQ ID NO: 46587 - DNA, 20 bp, Artificial Sequence
  Description of Artificial Sequence: Synthetic oligonucleotide
ggggagtcccgggcgccgtt

SEQ ID NO: 46588 - DNA, 20 bp, Artificial Sequence
  Description of Artificial Sequence: Synthetic oligonucleotide
gggagtcccgggcgccgtgt

SEQ ID NO: 46589 - DNA, 20 bp, Artificial Sequence
  Description of Artificial Sequence: Synthetic oligonucleotide
ggagtcccgggcgccgtggt

SEQ ID NO: 46590 - DNA, 20 bp, Artificial Sequence
  Description of Artificial Sequence: Synthetic oligonucleotide
gagtcccgggcgccgtgggt

SEQ ID NO: 46591 - DNA, 20 bp, Artificial Sequence
  Description of Artificial Sequence: Synthetic oligonucleotide
agtcccgggcgccgtgggtg

SEQ ID NO: 46592 - DNA, 20 bp, Artificial Sequence
  Description of Artificial Sequence: Synthetic oligonucleotide
gtcccgggcgccgtgggtgt

SEQ ID NO: 46593 - DNA, 20 bp, Artificial Sequence
  Description of Artificial Sequence: Synthetic oligonucleotide
tcccgggcgccgtgggtgga

SEQ ID NO: 46594 - DNA, 21 bp, Artificial Sequence
  Description of Artificial Sequence: Synthetic oligonucleotide
accgccgcggacacggcgtct

SEQ ID NO: 46595 - DNA, 20 bp, Artificial Sequence
  Description of Artificial Sequence: Synthetic oligonucleotide
ccgccgcggacacggcgtct

SEQ ID NO: 46596 - DNA, 21 bp, Artificial Sequence
  Description of Artificial Sequence: Synthetic oligonucleotide
cgccgcggacacggcgtctca

SEQ ID NO: 46597 - DNA, 23 bp, Artificial Sequence
  Description of Artificial Sequence: Synthetic oligonucleotide
gccgcggacacggcgtctcagat

SEQ ID NO: 46598 - DNA, 24 bp, Artificial Sequence
  Description of Artificial Sequence: Synthetic oligonucleotide
ccgcggacacggcgtctcagatca

SEQ ID NO: 46599 - DNA, 24 bp, Artificial Sequence
  Description of Artificial Sequence: Synthetic oligonucleotide
cgcggacacggcgtctcagatcac

SEQ ID NO: 46600 - DNA, 24 bp, Artificial Sequence
  Description of Artificial Sequence: Synthetic oligonucleotide
gcggacacggcgtctcagatcacc

SEQ ID NO: 46601 - DNA, 25 bp, Artificial Sequence
  Description of Artificial Sequence: Synthetic oligonucleotide
cggacacggcgtctcagatcaccca

SEQ ID NO: 46602 - DNA, 25 bp, Artificial Sequence
  Description of Artificial Sequence: Synthetic oligonucleotide
ggacacggcgtctcagatcacccag

SEQ ID NO: 46603 - DNA, 25 bp, Artificial Sequence
  Description of Artificial Sequence: Synthetic oligonucleotide
gacacggcgtctcagatcacccagc

SEQ ID NO: 46604 - DNA, 25 bp, Artificial Sequence
  Description of Artificial Sequence: Synthetic oligonucleotide
acacggcgtctcagatcacccagcg

SEQ ID NO: 46605 - DNA, 24 bp, Artificial Sequence
  Description of Artificial Sequence: Synthetic oligonucleotide
cacggcgtctcagatcacccagcg

SEQ ID NO: 46606 - DNA, 26 bp, Artificial Sequence
  Description of Artificial Sequence: Synthetic oligonucleotide
acggcgtctcagatcacccagcgcaa

SEQ ID NO: 46607 - DNA, 25 bp, Artificial Sequence
  Description of Artificial Sequence: Synthetic oligonucleotide
cggcgtctcagatcacccagcgcaa

SEQ ID NO: 46608 - DNA, 26 bp, Artificial Sequence
  Description of Artificial Sequence: Synthetic oligonucleotide
ggcgtctcagatcacccagcgcaagt

SEQ ID NO: 46609 - DNA, 26 bp, Artificial Sequence
  Description of Artificial Sequence: Synthetic oligonucleotide
gcgtctcagatcacccagcgcaagtg

SEQ ID NO: 46610 - DNA, 26 bp, Artificial Sequence
  Description of Artificial Sequence: Synthetic oligonucleotide
cgtctcagatcacccagcgcaagtgg

SEQ ID NO: 46611 - DNA, 27 bp, Artificial Sequence
  Description of Artificial Sequence: Synthetic oligonucleotide
gtctcagatcacccagcgcaagtggga

SEQ ID NO: 46612 - DNA, 27 bp, Artificial Sequence
  Description of Artificial Sequence: Synthetic oligonucleotide
tctcagatcacccagcgcaagtgggag

SEQ ID NO: 46613 - DNA, 25 bp, Artificial Sequence
  Description of Artificial Sequence: Synthetic oligonucleotide
cgcctcctccgcaggtatgaccagt

SEQ ID NO: 46614 - DNA, 25 bp, Artificial Sequence
  Description of Artificial Sequence: Synthetic oligonucleotide
gcctcctccgcaggtatgaccagtc

SEQ ID NO: 46615 - DNA, 25 bp, Artificial Sequence
  Description of Artificial Sequence: Synthetic oligonucleotide
cctcctccgcaggtatgaccagtcc

SEQ ID NO: 46616 - DNA, 25 bp, Artificial Sequence
  Description of Artificial Sequence: Synthetic oligonucleotide
ctcctccgcaggtatgaccagtccg

SEQ ID NO: 46617 - DNA, 25 bp, Artificial Sequence
  Description of Artificial Sequence: Synthetic oligonucleotide
tcctccgcaggtatgaccagtccgc

SEQ ID NO: 46618 - DNA, 24 bp, Artificial Sequence
  Description of Artificial Sequence: Synthetic oligonucleotide
cctccgcaggtatgaccagtccgc

SEQ ID NO: 46619 - DNA, 26 bp, Artificial Sequence
  Description of Artificial Sequence: Synthetic oligonucleotide
ctccgcaggtatgaccagtccgccta

SEQ ID NO: 46620 - DNA, 26 bp, Artificial Sequence
  Description of Artificial Sequence: Synthetic oligonucleotide
tccgcaggtatgaccagtccgcctac

SEQ ID NO: 46621 - DNA, 25 bp, Artificial Sequence
  Description of Artificial Sequence: Synthetic oligonucleotide
ccgcaggtatgaccagtccgcctac

SEQ ID NO: 46622 - DNA, 26 bp, Artificial Sequence
  Description of Artificial Sequence: Synthetic oligonucleotide
cgcaggtatgaccagtccgcctacga

SEQ ID NO: 46623 - DNA, 26 bp, Artificial Sequence
  Description of Artificial Sequence: Synthetic oligonucleotide
gcaggtatgaccagtccgcctacgac

SEQ ID NO: 46624 - DNA, 26 bp, Artificial Sequence
  Description of Artificial Sequence: Synthetic oligonucleotide
caggtatgaccagtccgcctacgacg

SEQ ID NO: 46625 - DNA, 26 bp, Artificial Sequence
  Description of Artificial Sequence: Synthetic oligonucleotide
aggtatgaccagtccgcctacgacgg

SEQ ID NO: 46626 - DNA, 24 bp, Artificial Sequence
  Description of Artificial Sequence: Synthetic oligonucleotide
cggttcgacagctacgccgcgagt

SEQ ID NO: 46627 - DNA, 24 bp, Artificial Sequence
  Description of Artificial Sequence: Synthetic oligonucleotide
ggttcgacagctacgccgcgagtc

SEQ ID NO: 46628 - DNA, 24 bp, Artificial Sequence
  Description of Artificial Sequence: Synthetic oligonucleotide
gttcgacagctacgccgcgagtcc

SEQ ID NO: 46629 - DNA, 25 bp, Artificial Sequence
  Description of Artificial Sequence: Synthetic oligonucleotide
ttcgacagctacgccgcgagtccga

SEQ ID NO: 46630 - DNA, 24 bp, Artificial Sequence
  Description of Artificial Sequence: Synthetic oligonucleotide
tcgacagctacgccgcgagtccga

SEQ ID NO: 46631 - DNA, 23 bp, Artificial Sequence
  Description of Artificial Sequence: Synthetic oligonucleotide
cgacagctacgccgcgagtccga

SEQ ID NO: 46632 - DNA, 24 bp, Artificial Sequence
  Description of Artificial Sequence: Synthetic oligonucleotide
gacagctacgccgcgagtccgaga

SEQ ID NO: 46633 - DNA, 24 bp, Artificial Sequence
  Description of Artificial Sequence: Synthetic oligonucleotide
acagctacgccgcgagtccgagag

SEQ ID NO: 46634 - DNA, 23 bp, Artificial Sequence
  Description of Artificial Sequence: Synthetic oligonucleotide
cagctacgccgcgagtccgagag

SEQ ID NO: 46635 - DNA, 23 bp, Artificial Sequence
  Description of Artificial Sequence: Synthetic oligonucleotide
agctacgccgcgagtccgagagg

SEQ ID NO: 46636 - DNA, 22 bp, Artificial Sequence
  Description of Artificial Sequence: Synthetic oligonucleotide
gctacgccgcgagtccgagagg

SEQ ID NO: 46637 - DNA, 22 bp, Artificial Sequence
  Description of Artificial Sequence: Synthetic oligonucleotide
ctacgccgcgagtccgagaggg

SEQ ID NO: 46638 - DNA, 23 bp, Artificial Sequence
  Description of Artificial Sequence: Synthetic oligonucleotide
tacgccgcgagtccgagagggga

SEQ ID NO: 46639 - DNA, 28 bp, Artificial Sequence
  Description of Artificial Sequence: Synthetic oligonucleotide
acacagaactacaagcgccaggcacagg

SEQ ID NO: 46640 - DNA, 27 bp, Artificial Sequence
  Description of Artificial Sequence: Synthetic oligonucleotide
cacagaactacaagcgccaggcacagg

SEQ ID NO: 46641 - DNA, 27 bp, Artificial Sequence
  Description of Artificial Sequence: Synthetic oligonucleotide
acagaactacaagcgccaggcacaggc

SEQ ID NO: 46642 - DNA, 27 bp, Artificial Sequence
  Description of Artificial Sequence: Synthetic oligonucleotide
cagaactacaagcgccaggcacaggct

SEQ ID NO: 46643 - DNA, 27 bp, Artificial Sequence
  Description of Artificial Sequence: Synthetic oligonucleotide
agaactacaagcgccaggcacaggctg

SEQ ID NO: 46644 - DNA, 27 bp, Artificial Sequence
  Description of Artificial Sequence: Synthetic oligonucleotide
gaactacaagcgccaggcacaggctga

SEQ ID NO: 46645 - DNA, 27 bp, Artificial Sequence
  Description of Artificial Sequence: Synthetic oligonucleotide
aactacaagcgccaggcacaggctgac

SEQ ID NO: 46646 - DNA, 26 bp, Artificial Sequence
  Description of Artificial Sequence: Synthetic oligonucleotide
actacaagcgccaggcacaggctgac

SEQ ID NO: 46647 - DNA, 25 bp, Artificial Sequence
  Description of Artificial Sequence: Synthetic oligonucleotide
ctacaagcgccaggcacaggctgac

SEQ ID NO: 46648 - DNA, 25 bp, Artificial Sequence
  Description of Artificial Sequence: Synthetic oligonucleotide
aaggagacgctgcagcgcgcagaac

SEQ ID NO: 46649 - DNA, 24 bp, Artificial Sequence
  Description of Artificial Sequence: Synthetic oligonucleotide
aggagacgctgcagcgcgcagaac

SEQ ID NO: 46650 - DNA, 23 bp, Artificial Sequence
  Description of Artificial Sequence: Synthetic oligonucleotide
ggagacgctgcagcgcgcagaac

SEQ ID NO: 46651 - DNA, 23 bp, Artificial Sequence
  Description of Artificial Sequence: Synthetic oligonucleotide
gagacgctgcagcgcgcagaacc

SEQ ID NO: 46652 - DNA, 23 bp, Artificial Sequence
  Description of Artificial Sequence: Synthetic oligonucleotide
agacgctgcagcgcgcagaaccc

SEQ ID NO: 46653 - DNA, 22 bp, Artificial Sequence
  Description of Artificial Sequence: Synthetic oligonucleotide
gacgctgcagcgcgcagaaccc

SEQ ID NO: 46654 - DNA, 22 bp, Artificial Sequence
  Description of Artificial Sequence: Synthetic oligonucleotide
acgctgcagcgcgcagaacccc

SEQ ID NO: 46655 - DNA, 21 bp, Artificial Sequence
  Description of Artificial Sequence: Synthetic oligonucleotide
cgctgcagcgcgcagaacccc

SEQ ID NO: 46656 - DNA, 24 bp, Artificial Sequence
  Description of Artificial Sequence: Synthetic oligonucleotide
gctgcagcgcgcagaacccccaaa

SEQ ID NO: 46657 - DNA, 25 bp, Artificial Sequence
  Description of Artificial Sequence: Synthetic oligonucleotide
ctgcagcgcgcagaacccccaaaga

SEQ ID NO: 46658 - DNA, 26 bp, Artificial Sequence
  Description of Artificial Sequence: Synthetic oligonucleotide
tgcagcgcgcagaacccccaaagaca

SEQ ID NO: 46659 - DNA, 25 bp, Artificial Sequence
  Description of Artificial Sequence: Synthetic oligonucleotide
gcagcgcgcagaacccccaaagaca

SEQ ID NO: 46660 - DNA, 26 bp, Artificial Sequence
  Description of Artificial Sequence: Synthetic oligonucleotide
cagcgcgcagaacccccaaagacaca

SEQ ID NO: 46661 - DNA, 26 bp, Artificial Sequence
  Description of Artificial Sequence: Synthetic oligonucleotide
agcgcgcagaacccccaaagacacac

SEQ ID NO: 46662 - DNA, 25 bp, Artificial Sequence
  Description of Artificial Sequence: Synthetic oligonucleotide
gcgcgcagaacccccaaagacacac

SEQ ID NO: 46663 - DNA, 26 bp, Artificial Sequence
  Description of Artificial Sequence: Synthetic oligonucleotide
cgcgcagaacccccaaagacacacgt

SEQ ID NO: 46664 - DNA, 27 bp, Artificial Sequence
  Description of Artificial Sequence: Synthetic oligonucleotide
gcgcagaacccccaaagacacacgtga

SEQ ID NO: 46665 - DNA, 27 bp, Artificial Sequence
  Description of Artificial Sequence: Synthetic oligonucleotide
cgcagaacccccaaagacacacgtgac

SEQ ID NO: 46666 - DNA, 27 bp, Artificial Sequence
  Description of Artificial Sequence: Synthetic oligonucleotide
gcagaacccccaaagacacacgtgacc

SEQ ID NO: 46667 - DNA, 27 bp, Artificial Sequence
  Description of Artificial Sequence: Synthetic oligonucleotide
cagaacccccaaagacacacgtgaccc

SEQ ID NO: 46668 - DNA, 28 bp, Artificial Sequence
  Description of Artificial Sequence: Synthetic oligonucleotide
agaacccccaaagacacacgtgacccac

SEQ ID NO: 46669 - DNA, 27 bp, Artificial Sequence
  Description of Artificial Sequence: Synthetic oligonucleotide
gaacccccaaagacacacgtgacccac

SEQ ID NO: 46670 - DNA, 27 bp, Artificial Sequence
  Description of Artificial Sequence: Synthetic oligonucleotide
aacccccaaagacacacgtgacccacc

SEQ ID NO: 46671 - DNA, 27 bp, Artificial Sequence
  Description of Artificial Sequence: Synthetic oligonucleotide
acccccaaagacacacgtgacccacca

SEQ ID NO: 46672 - DNA, 27 bp, Artificial Sequence
  Description of Artificial Sequence: Synthetic oligonucleotide
aaagacacacgtgacccaccaccccct

SEQ ID NO: 46673 - DNA, 26 bp, Artificial Sequence
  Description of Artificial Sequence: Synthetic oligonucleotide
aagacacacgtgacccaccaccccct

SEQ ID NO: 46674 - DNA, 25 bp, Artificial Sequence
  Description of Artificial Sequence: Synthetic oligonucleotide
agacacacgtgacccaccaccccct

SEQ ID NO: 46675 - DNA, 24 bp, Artificial Sequence
  Description of Artificial Sequence: Synthetic oligonucleotide
gacacacgtgacccaccaccccct

SEQ ID NO: 46676 - DNA, 25 bp, Artificial Sequence
  Description of Artificial Sequence: Synthetic oligonucleotide
acacacgtgacccaccaccccctct

SEQ ID NO: 46677 - DNA, 24 bp, Artificial Sequence
  Description of Artificial Sequence: Synthetic oligonucleotide
cacacgtgacccaccaccccctct

SEQ ID NO: 46678 - DNA, 25 bp, Artificial Sequence
  Description of Artificial Sequence: Synthetic oligonucleotide
acacgtgacccaccaccccctctct

SEQ ID NO: 46679 - DNA, 24 bp, Artificial Sequence
  Description of Artificial Sequence: Synthetic oligonucleotide
cacgtgacccaccaccccctctct

SEQ ID NO: 46680 - DNA, 25 bp, Artificial Sequence
  Description of Artificial Sequence: Synthetic oligonucleotide
acgtgacccaccaccccctctctga

SEQ ID NO: 46681 - DNA, 24 bp, Artificial Sequence
  Description of Artificial Sequence: Synthetic oligonucleotide
cgtgacccaccaccccctctctga

SEQ ID NO: 46682 - DNA, 24 bp, Artificial Sequence
  Description of Artificial Sequence: Synthetic oligonucleotide
gtgacccaccaccccctctctgac

SEQ ID NO: 46683 - DNA, 26 bp, Artificial Sequence
  Description of Artificial Sequence: Synthetic oligonucleotide
tgacccaccaccccctctctgaccat

SEQ ID NO: 46684 - DNA, 25 bp, Artificial Sequence
  Description of Artificial Sequence: Synthetic oligonucleotide
gacccaccaccccctctctgaccat

SEQ ID NO: 46685 - DNA, 26 bp, Artificial Sequence
  Description of Artificial Sequence: Synthetic oligonucleotide
acccaccaccccctctctgaccatga

SEQ ID NO: 46686 - DNA, 25 bp, Artificial Sequence
  Description of Artificial Sequence: Synthetic oligonucleotide
cccaccaccccctctctgaccatga

SEQ ID NO: 46687 - DNA, 25 bp, Artificial Sequence
  Description of Artificial Sequence: Synthetic oligonucleotide
ccaccaccccctctctgaccatgag

SEQ ID NO: 46688 - DNA, 25 bp, Artificial Sequence
  Description of Artificial Sequence: Synthetic oligonucleotide
caccaccccctctctgaccatgagg

SEQ ID NO: 46689 - DNA, 25 bp, Artificial Sequence
  Description of Artificial Sequence: Synthetic oligonucleotide
accaccccctctctgaccatgaggc

SEQ ID NO: 46690 - DNA, 24 bp, Artificial Sequence
  Description of Artificial Sequence: Synthetic oligonucleotide
ccaccccctctctgaccatgaggc

SEQ ID NO: 46691 - DNA, 25 bp, Artificial Sequence
  Description of Artificial Sequence: Synthetic oligonucleotide
caccccctctctgaccatgaggcca

SEQ ID NO: 46692 - DNA, 25 bp, Artificial Sequence
  Description of Artificial Sequence: Synthetic oligonucleotide
accccctctctgaccatgaggccac

SEQ ID NO: 46693 - DNA, 24 bp, Artificial Sequence
  Description of Artificial Sequence: Synthetic oligonucleotide
ccccctctctgaccatgaggccac

SEQ ID NO: 46694 - DNA, 24 bp, Artificial Sequence
  Description of Artificial Sequence: Synthetic oligonucleotide
cccctctctgaccatgaggccacc

SEQ ID NO: 46695 - DNA, 25 bp, Artificial Sequence
  Description of Artificial Sequence: Synthetic oligonucleotide
ccctctctgaccatgaggccaccct

SEQ ID NO: 46696 - DNA, 26 bp, Artificial Sequence
  Description of Artificial Sequence: Synthetic oligonucleotide
cctctctgaccatgaggccaccctga

SEQ ID NO: 46697 - DNA, 26 bp, Artificial Sequence
  Description of Artificial Sequence: Synthetic oligonucleotide
ctctctgaccatgaggccaccctgag

SEQ ID NO: 46698 - DNA, 23 bp, Artificial Sequence
  Description of Artificial Sequence: Synthetic oligonucleotide
gggaggaccagacccaggacacc

SEQ ID NO: 46699 - DNA, 24 bp, Artificial Sequence
  Description of Artificial Sequence: Synthetic oligonucleotide
ggaggaccagacccaggacaccga

SEQ ID NO: 46700 - DNA, 24 bp, Artificial Sequence
  Description of Artificial Sequence: Synthetic oligonucleotide
gaggaccagacccaggacaccgag

SEQ ID NO: 46701 - DNA, 26 bp, Artificial Sequence
  Description of Artificial Sequence: Synthetic oligonucleotide
aggaccagacccaggacaccgagctt

SEQ ID NO: 46702 - DNA, 25 bp, Artificial Sequence
  Description of Artificial Sequence: Synthetic oligonucleotide
ggaccagacccaggacaccgagctt

SEQ ID NO: 46703 - DNA, 26 bp, Artificial Sequence
  Description of Artificial Sequence: Synthetic oligonucleotide
gaccagacccaggacaccgagcttgt

SEQ ID NO: 46704 - DNA, 26 bp, Artificial Sequence
  Description of Artificial Sequence: Synthetic oligonucleotide
accagacccaggacaccgagcttgtg

SEQ ID NO: 46705 - DNA, 25 bp, Artificial Sequence
  Description of Artificial Sequence: Synthetic oligonucleotide
ccagacccaggacaccgagcttgtg

SEQ ID NO: 46706 - DNA, 26 bp, Artificial Sequence
  Description of Artificial Sequence: Synthetic oligonucleotide
cagacccaggacaccgagcttgtgga

SEQ ID NO: 46707 - DNA, 27 bp, Artificial Sequence
  Description of Artificial Sequence: Synthetic oligonucleotide
agacccaggacaccgagcttgtggaga

SEQ ID NO: 46708 - DNA, 26 bp, Artificial Sequence
  Description of Artificial Sequence: Synthetic oligonucleotide
gacccaggacaccgagcttgtggaga

SEQ ID NO: 46709 - DNA, 26 bp, Artificial Sequence
  Description of Artificial Sequence: Synthetic oligonucleotide
acccaggacaccgagcttgtggagac

SEQ ID NO: 46710 - DNA, 25 bp, Artificial Sequence
  Description of Artificial Sequence: Synthetic oligonucleotide
cccaggacaccgagcttgtggagac

SEQ ID NO: 46711 - DNA, 26 bp, Artificial Sequence
  Description of Artificial Sequence: Synthetic oligonucleotide
ccaggacaccgagcttgtggagacca

SEQ ID NO: 46712 - DNA, 28 bp, Artificial Sequence
  Description of Artificial Sequence: Synthetic oligonucleotide
agctgtggtggtgccttctggacaagag

SEQ ID NO: 46713 - DNA, 27 bp, Artificial Sequence
  Description of Artificial Sequence: Synthetic oligonucleotide
gctgtggtggtgccttctggacaagag

SEQ ID NO: 46714 - DNA, 27 bp, Artificial Sequence
  Description of Artificial Sequence: Synthetic oligonucleotide
ctgtggtggtgccttctggacaagagc

SEQ ID NO: 46715 - DNA, 28 bp, Artificial Sequence
  Description of Artificial Sequence: Synthetic oligonucleotide
tgtggtggtgccttctggacaagagcag

SEQ ID NO: 46716 - DNA, 27 bp, Artificial Sequence
  Description of Artificial Sequence: Synthetic oligonucleotide
gtggtggtgccttctggacaagagcag

SEQ ID NO: 46717 - DNA, 28 bp, Artificial Sequence
  Description of Artificial Sequence: Synthetic oligonucleotide
tggtggtgccttctggacaagagcagag

SEQ ID NO: 46718 - DNA, 27 bp, Artificial Sequence
  Description of Artificial Sequence: Synthetic oligonucleotide
ggtggtgccttctggacaagagcagag

SEQ ID NO: 46719 - DNA, 30 bp, Artificial Sequence
  Description of Artificial Sequence: Synthetic oligonucleotide
gtggtgccttctggacaagagcagagatac

SEQ ID NO: 46720 - DNA, 31 bp, Artificial Sequence
  Description of Artificial Sequence: Synthetic oligonucleotide
tggtgccttctggacaagagcagagatacac

SEQ ID NO: 46721 - DNA, 30 bp, Artificial Sequence
  Description of Artificial Sequence: Synthetic oligonucleotide
ggtgccttctggacaagagcagagatacac

SEQ ID NO: 46722 - DNA, 30 bp, Artificial Sequence
  Description of Artificial Sequence: Synthetic oligonucleotide
gtgccttctggacaagagcagagatacacg

SEQ ID NO: 46723 - DNA, 31 bp, Artificial Sequence
  Description of Artificial Sequence: Synthetic oligonucleotide
tgccttctggacaagagcagagatacacgtg

SEQ ID NO: 46724 - DNA, 30 bp, Artificial Sequence
  Description of Artificial Sequence: Synthetic oligonucleotide
gccttctggacaagagcagagatacacgtg

SEQ ID NO: 46725 - DNA, 30 bp, Artificial Sequence
  Description of Artificial Sequence: Synthetic oligonucleotide
ccttctggacaagagcagagatacacgtgc

SEQ ID NO: 46726 - DNA, 30 bp, Artificial Sequence
  Description of Artificial Sequence: Synthetic oligonucleotide
cttctggacaagagcagagatacacgtgcc

SEQ ID NO: 46727 - DNA, 34 bp, Artificial Sequence
  Description of Artificial Sequence: Synthetic oligonucleotide
ttctggacaagagcagagatacacgtgccatatg

SEQ ID NO: 46728 - DNA, 33 bp, Artificial Sequence
  Description of Artificial Sequence: Synthetic oligonucleotide
tctggacaagagcagagatacacgtgccatatg

SEQ ID NO: 46729 - DNA, 32 bp, Artificial Sequence
  Description of Artificial Sequence: Synthetic oligonucleotide
ctggacaagagcagagatacacgtgccatatg

SEQ ID NO: 46730 - DNA, 32 bp, Artificial Sequence
  Description of Artificial Sequence: Synthetic oligonucleotide
tggacaagagcagagatacacgtgccatatgc

SEQ ID NO: 46731 - DNA, 31 bp, Artificial Sequence
  Description of Artificial Sequence: Synthetic oligonucleotide
ggacaagagcagagatacacgtgccatatgc

SEQ ID NO: 46732 - DNA, 32 bp, Artificial Sequence
  Description of Artificial Sequence: Synthetic oligonucleotide
gacaagagcagagatacacgtgccatatgcag

SEQ ID NO: 46733 - DNA, 32 bp, Artificial Sequence
  Description of Artificial Sequence: Synthetic oligonucleotide
acaagagcagagatacacgtgccatatgcagc

SEQ ID NO: 46734 - DNA, 31 bp, Artificial Sequence
  Description of Artificial Sequence: Synthetic oligonucleotide
caagagcagagatacacgtgccatatgcagc

SEQ ID NO: 46735 - DNA, 32 bp, Artificial Sequence
  Description of Artificial Sequence: Synthetic oligonucleotide
aagagcagagatacacgtgccatatgcagcac

SEQ ID NO: 46736 - DNA, 31 bp, Artificial Sequence
  Description of Artificial Sequence: Synthetic oligonucleotide
agagcagagatacacgtgccatatgcagcac

SEQ ID NO: 46737 - DNA, 30 bp, Artificial Sequence
  Description of Artificial Sequence: Synthetic oligonucleotide
gagcagagatacacgtgccatatgcagcac

SEQ ID NO: 46738 - DNA, 30 bp, Artificial Sequence
  Description of Artificial Sequence: Synthetic oligonucleotide
agcagagatacacgtgccatatgcagcacg

SEQ ID NO: 46739 - DNA, 29 bp, Artificial Sequence
  Description of Artificial Sequence: Synthetic oligonucleotide
gcagagatacacgtgccatatgcagcacg

SEQ ID NO: 46740 - DNA, 30 bp, Artificial Sequence
  Description of Artificial Sequence: Synthetic oligonucleotide
cagagatacacgtgccatatgcagcacgag

SEQ ID NO: 46741 - DNA, 30 bp, Artificial Sequence
  Description of Artificial Sequence: Synthetic oligonucleotide
agagatacacgtgccatatgcagcacgagg

SEQ ID NO: 46742 - DNA, 29 bp, Artificial Sequence
  Description of Artificial Sequence: Synthetic oligonucleotide
gagatacacgtgccatatgcagcacgagg

SEQ ID NO: 46743 - DNA, 29 bp, Artificial Sequence
  Description of Artificial Sequence: Synthetic oligonucleotide
agatacacgtgccatatgcagcacgaggg

SEQ ID NO: 46744 - DNA, 28 bp, Artificial Sequence
  Description of Artificial Sequence: Synthetic oligonucleotide
gatacacgtgccatatgcagcacgaggg

SEQ ID NO: 46745 - DNA, 28 bp, Artificial Sequence
  Description of Artificial Sequence: Synthetic oligonucleotide
atacacgtgccatatgcagcacgagggg

SEQ ID NO: 46746 - DNA, 27 bp, Artificial Sequence
  Description of Artificial Sequence: Synthetic oligonucleotide
tacacgtgccatatgcagcacgagggg

SEQ ID NO: 46747 - DNA, 26 bp, Artificial Sequence
  Description of Artificial Sequence: Synthetic oligonucleotide
acacgtgccatatgcagcacgagggg

SEQ ID NO: 46748 - DNA, 25 bp, Artificial Sequence
  Description of Artificial Sequence: Synthetic oligonucleotide
cacgtgccatatgcagcacgagggg

SEQ ID NO: 46749 - DNA, 26 bp, Artificial Sequence
  Description of Artificial Sequence: Synthetic oligonucleotide
acgtgccatatgcagcacgaggggct

SEQ ID NO: 46750 - DNA, 25 bp, Artificial Sequence
  Description of Artificial Sequence: Synthetic oligonucleotide
cgtgccatatgcagcacgaggggct

SEQ ID NO: 46751 - DNA, 25 bp, Artificial Sequence
  Description of Artificial Sequence: Synthetic oligonucleotide
gtgccatatgcagcacgaggggctg

SEQ ID NO: 46752 - DNA, 27 bp, Artificial Sequence
  Description of Artificial Sequence: Synthetic oligonucleotide
tgccatatgcagcacgaggggctgcaa

SEQ ID NO: 46753 - DNA, 26 bp, Artificial Sequence
  Description of Artificial Sequence: Synthetic oligonucleotide
gccatatgcagcacgaggggctgcaa

SEQ ID NO: 46754 - DNA, 27 bp, Artificial Sequence
  Description of Artificial Sequence: Synthetic oligonucleotide
ccatatgcagcacgaggggctgcaaga

SEQ ID NO: 46755 - DNA, 27 bp, Artificial Sequence
  Description of Artificial Sequence: Synthetic oligonucleotide
catatgcagcacgaggggctgcaagag

SEQ ID NO: 46756 - DNA, 27 bp, Artificial Sequence
  Description of Artificial Sequence: Synthetic oligonucleotide
atatgcagcacgaggggctgcaagagc

SEQ ID NO: 46757 - DNA, 26 bp, Artificial Sequence
  Description of Artificial Sequence: Synthetic oligonucleotide
tatgcagcacgaggggctgcaagagc

SEQ ID NO: 46758 - DNA, 25 bp, Artificial Sequence
  Description of Artificial Sequence: Synthetic oligonucleotide
atgcagcacgaggggctgcaagagc

SEQ ID NO: 46759 - DNA, 24 bp, Artificial Sequence
  Description of Artificial Sequence: Synthetic oligonucleotide
tgcagcacgaggggctgcaagagc

SEQ ID NO: 46760 - DNA, 23 bp, Artificial Sequence
  Description of Artificial Sequence: Synthetic oligonucleotide
gcagcacgaggggctgcaagagc

SEQ ID NO: 46761 - DNA, 23 bp, Artificial Sequence
  Description of Artificial Sequence: Synthetic oligonucleotide
cagcacgaggggctgcaagagcc

SEQ ID NO: 46762 - DNA, 23 bp, Artificial Sequence
  Description of Artificial Sequence: Synthetic oligonucleotide
agcacgaggggctgcaagagccc

SEQ ID NO: 46763 - DNA, 22 bp, Artificial Sequence
  Description of Artificial Sequence: Synthetic oligonucleotide
gcacgaggggctgcaagagccc

SEQ ID NO: 46764 - DNA, 23 bp, Artificial Sequence
  Description of Artificial Sequence: Synthetic oligonucleotide
cacgaggggctgcaagagcccct

SEQ ID NO: 46765 - DNA, 24 bp, Artificial Sequence
  Description of Artificial Sequence: Synthetic oligonucleotide
acgaggggctgcaagagcccctca

SEQ ID NO: 46766 - DNA, 23 bp, Artificial Sequence
  Description of Artificial Sequence: Synthetic oligonucleotide
cgaggggctgcaagagcccctca

SEQ ID NO: 46767 - DNA, 23 bp, Artificial Sequence
  Description of Artificial Sequence: Synthetic oligonucleotide
gaggggctgcaagagcccctcac

SEQ ID NO: 46768 - DNA, 23 bp, Artificial Sequence
  Description of Artificial Sequence: Synthetic oligonucleotide
aggggctgcaagagcccctcacc

SEQ ID NO: 46769 - DNA, 22 bp, Artificial Sequence
  Description of Artificial Sequence: Synthetic oligonucleotide
ggggctgcaagagcccctcacc

SEQ ID NO: 46770 - DNA, 23 bp, Artificial Sequence
  Description of Artificial Sequence: Synthetic oligonucleotide
gggctgcaagagcccctcaccct

SEQ ID NO: 46771 - DNA, 24 bp, Artificial Sequence
  Description of Artificial Sequence: Synthetic oligonucleotide
ggctgcaagagcccctcaccctga

SEQ ID NO: 46772 - DNA, 24 bp, Artificial Sequence
  Description of Artificial Sequence: Synthetic oligonucleotide
gctgcaagagcccctcaccctgag

SEQ ID NO: 46773 - DNA, 25 bp, Artificial Sequence
  Description of Artificial Sequence: Synthetic oligonucleotide
ctgcaagagcccctcaccctgagct

SEQ ID NO: 46774 - DNA, 25 bp, Artificial Sequence
  Description of Artificial Sequence: Synthetic oligonucleotide
tgcaagagcccctcaccctgagctg

SEQ ID NO: 46775 - DNA, 24 bp, Artificial Sequence
  Description of Artificial Sequence: Synthetic oligonucleotide
gcaagagcccctcaccctgagctg

SEQ ID NO: 46776 - DNA, 24 bp, Artificial Sequence
  Description of Artificial Sequence: Synthetic oligonucleotide
caagagcccctcaccctgagctgg

SEQ ID NO: 46777 - DNA, 25 bp, Artificial Sequence
  Description of Artificial Sequence: Synthetic oligonucleotide
aagagcccctcaccctgagctggga

SEQ ID NO: 46778 - DNA, 24 bp, Artificial Sequence
  Description of Artificial Sequence: Synthetic oligonucleotide
agagcccctcaccctgagctggga

SEQ ID NO: 46779 - DNA, 23 bp, Artificial Sequence
  Description of Artificial Sequence: Synthetic oligonucleotide
gagcccctcaccctgagctggga

SEQ ID NO: 46780 - DNA, 23 bp, Artificial Sequence
  Description of Artificial Sequence: Synthetic oligonucleotide
agcccctcaccctgagctgggag

SEQ ID NO: 46781 - DNA, 22 bp, Artificial Sequence
  Description of Artificial Sequence: Synthetic oligonucleotide
gcccctcaccctgagctgggag

SEQ ID NO: 46782 - DNA, 22 bp, Artificial Sequence
  Description of Artificial Sequence: Synthetic oligonucleotide
cccctcaccctgagctgggagc

SEQ ID NO: 46783 - DNA, 24 bp, Artificial Sequence
  Description of Artificial Sequence: Synthetic oligonucleotide
ccctcaccctgagctgggagccat

SEQ ID NO: 46784 - DNA, 26 bp, Artificial Sequence
  Description of Artificial Sequence: Synthetic oligonucleotide
cctcaccctgagctgggagccatctt

SEQ ID NO: 46785 - DNA, 26 bp, Artificial Sequence
  Description of Artificial Sequence: Synthetic oligonucleotide
ctcaccctgagctgggagccatcttc

SEQ ID NO: 46786 - DNA, 26 bp, Artificial Sequence
  Description of Artificial Sequence: Synthetic oligonucleotide
tcaccctgagctgggagccatcttcc

SEQ ID NO: 46787 - DNA, 25 bp, Artificial Sequence
  Description of Artificial Sequence: Synthetic oligonucleotide
caccctgagctgggagccatcttcc

SEQ ID NO: 46788 - DNA, 26 bp, Artificial Sequence
  Description of Artificial Sequence: Synthetic oligonucleotide
accctgagctgggagccatcttccca

SEQ ID NO: 46789 - DNA, 25 bp, Artificial Sequence
  Description of Artificial Sequence: Synthetic oligonucleotide
ccctgagctgggagccatcttccca

SEQ ID NO: 46790 - DNA, 25 bp, Artificial Sequence
  Description of Artificial Sequence: Synthetic oligonucleotide
cctgagctgggagccatcttcccag

SEQ ID NO: 46791 - DNA, 25 bp, Artificial Sequence
  Description of Artificial Sequence: Synthetic oligonucleotide
ctgagctgggagccatcttcccagc

SEQ ID NO: 46792 - DNA, 25 bp, Artificial Sequence
  Description of Artificial Sequence: Synthetic oligonucleotide
tgagctgggagccatcttcccagcc

SEQ ID NO: 46793 - DNA, 24 bp, Artificial Sequence
  Description of Artificial Sequence: Synthetic oligonucleotide
gagctgggagccatcttcccagcc

SEQ ID NO: 46794 - DNA, 25 bp, Artificial Sequence
  Description of Artificial Sequence: Synthetic oligonucleotide
agctgggagccatcttcccagccca

SEQ ID NO: 46795 - DNA, 24 bp, Artificial Sequence
  Description of Artificial Sequence: Synthetic oligonucleotide
gctgggagccatcttcccagccca

SEQ ID NO: 46796 - DNA, 24 bp, Artificial Sequence
  Description of Artificial Sequence: Synthetic oligonucleotide
ctgggagccatcttcccagcccac

SEQ ID NO: 46797 - DNA, 27 bp, Artificial Sequence
  Description of Artificial Sequence: Synthetic oligonucleotide
catcttcccagcccaccatccccatca

SEQ ID NO: 46798 - DNA, 28 bp, Artificial Sequence
  Description of Artificial Sequence: Synthetic oligonucleotide
atcttcccagcccaccatccccatcatg

SEQ ID NO: 46799 - DNA, 27 bp, Artificial Sequence
  Description of Artificial Sequence: Synthetic oligonucleotide
tcttcccagcccaccatccccatcatg

SEQ ID NO: 46800 - DNA, 26 bp, Artificial Sequence
  Description of Artificial Sequence: Synthetic oligonucleotide
cttcccagcccaccatccccatcatg

SEQ ID NO: 46801 - DNA, 26 bp, Artificial Sequence
  Description of Artificial Sequence: Synthetic oligonucleotide
ttcccagcccaccatccccatcatgg

SEQ ID NO: 46802 - DNA, 25 bp, Artificial Sequence
  Description of Artificial Sequence: Synthetic oligonucleotide
tcccagcccaccatccccatcatgg

SEQ ID NO: 46803 - DNA, 24 bp, Artificial Sequence
  Description of Artificial Sequence: Synthetic oligonucleotide
cccagcccaccatccccatcatgg

SEQ ID NO: 46804 - DNA, 24 bp, Artificial Sequence
  Description of Artificial Sequence: Synthetic oligonucleotide
ccagcccaccatccccatcatggg

SEQ ID NO: 46805 - DNA, 26 bp, Artificial Sequence
  Description of Artificial Sequence: Synthetic oligonucleotide
cagcccaccatccccatcatgggcat

SEQ ID NO: 46806 - DNA, 26 bp, Artificial Sequence
  Description of Artificial Sequence: Synthetic oligonucleotide
agcccaccatccccatcatgggcatc

SEQ ID NO: 46807 - DNA, 25 bp, Artificial Sequence
  Description of Artificial Sequence: Synthetic oligonucleotide
gcccaccatccccatcatgggcatc

SEQ ID NO: 46808 - DNA, 27 bp, Artificial Sequence
  Description of Artificial Sequence: Synthetic oligonucleotide
cccaccatccccatcatgggcatcgtt

SEQ ID NO: 46809 - DNA, 27 bp, Artificial Sequence
  Description of Artificial Sequence: Synthetic oligonucleotide
ccaccatccccatcatgggcatcgttg

SEQ ID NO: 46810 - DNA, 27 bp, Artificial Sequence
  Description of Artificial Sequence: Synthetic oligonucleotide
caccatccccatcatgggcatcgttgc

SEQ ID NO: 46811 - DNA, 28 bp, Artificial Sequence
  Description of Artificial Sequence: Synthetic oligonucleotide
accatccccatcatgggcatcgttgctg

SEQ ID NO: 46812 - DNA, 27 bp, Artificial Sequence
  Description of Artificial Sequence: Synthetic oligonucleotide
ccatccccatcatgggcatcgttgctg

SEQ ID NO: 46813 - DNA, 27 bp, Artificial Sequence
  Description of Artificial Sequence: Synthetic oligonucleotide
catccccatcatgggcatcgttgctgg

SEQ ID NO: 46814 - DNA, 27 bp, Artificial Sequence
  Description of Artificial Sequence: Synthetic oligonucleotide
atccccatcatgggcatcgttgctggc

SEQ ID NO: 46815 - DNA, 26 bp, Artificial Sequence
  Description of Artificial Sequence: Synthetic oligonucleotide
tccccatcatgggcatcgttgctggc

SEQ ID NO: 46816 - DNA, 25 bp, Artificial Sequence
  Description of Artificial Sequence: Synthetic oligonucleotide
ccccatcatgggcatcgttgctggc

SEQ ID NO: 46817 - DNA, 26 bp, Artificial Sequence
  Description of Artificial Sequence: Synthetic oligonucleotide
cccatcatgggcatcgttgctggcct

SEQ ID NO: 46818 - DNA, 26 bp, Artificial Sequence
  Description of Artificial Sequence: Synthetic oligonucleotide
ccatcatgggcatcgttgctggcctg

SEQ ID NO: 46819 - DNA, 26 bp, Artificial Sequence
  Description of Artificial Sequence: Synthetic oligonucleotide
catcatgggcatcgttgctggcctgg

SEQ ID NO: 46820 - DNA, 27 bp, Artificial Sequence
  Description of Artificial Sequence: Synthetic oligonucleotide
atcatgggcatcgttgctggcctggct

SEQ ID NO: 46821 - DNA, 26 bp, Artificial Sequence
  Description of Artificial Sequence: Synthetic oligonucleotide
tcatgggcatcgttgctggcctggct

SEQ ID NO: 46822 - DNA, 25 bp, Artificial Sequence
  Description of Artificial Sequence: Synthetic oligonucleotide
catgggcatcgttgctggcctggct

SEQ ID NO: 46823 - DNA, 26 bp, Artificial Sequence
  Description of Artificial Sequence: Synthetic oligonucleotide
atgggcatcgttgctggcctggctgt

SEQ ID NO: 46824 - DNA, 27 bp, Artificial Sequence
  Description of Artificial Sequence: Synthetic oligonucleotide
atcgttgctggcctggctgtcctggtt

SEQ ID NO: 46825 - DNA, 26 bp, Artificial Sequence
  Description of Artificial Sequence: Synthetic oligonucleotide
tcgttgctggcctggctgtcctggtt

SEQ ID NO: 46826 - DNA, 25 bp, Artificial Sequence
  Description of Artificial Sequence: Synthetic oligonucleotide
cgttgctggcctggctgtcctggtt

SEQ ID NO: 46827 - DNA, 26 bp, Artificial Sequence
  Description of Artificial Sequence: Synthetic oligonucleotide
gttgctggcctggctgtcctggttgt

SEQ ID NO: 46828 - DNA, 26 bp, Artificial Sequence
  Description of Artificial Sequence: Synthetic oligonucleotide
ttgctggcctggctgtcctggttgtc

SEQ ID NO: 46829 - DNA, 25 bp, Artificial Sequence
  Description of Artificial Sequence: Synthetic oligonucleotide
tgctggcctggctgtcctggttgtc

SEQ ID NO: 46830 - DNA, 24 bp, Artificial Sequence
  Description of Artificial Sequence: Synthetic oligonucleotide
gctggcctggctgtcctggttgtc

SEQ ID NO: 46831 - DNA, 26 bp, Artificial Sequence
  Description of Artificial Sequence: Synthetic oligonucleotide
ctggcctggctgtcctggttgtccta

SEQ ID NO: 46832 - DNA, 26 bp, Artificial Sequence
  Description of Artificial Sequence: Synthetic oligonucleotide
tggcctggctgtcctggttgtcctag

SEQ ID NO: 46833 - DNA, 25 bp, Artificial Sequence
  Description of Artificial Sequence: Synthetic oligonucleotide
ggcctggctgtcctggttgtcctag

SEQ ID NO: 46834 - DNA, 26 bp, Artificial Sequence
  Description of Artificial Sequence: Synthetic oligonucleotide
gcctggctgtcctggttgtcctagct

SEQ ID NO: 46835 - DNA, 27 bp, Artificial Sequence
  Description of Artificial Sequence: Synthetic oligonucleotide
cctggctgtcctggttgtcctagctgt

SEQ ID NO: 46836 - DNA, 27 bp, Artificial Sequence
  Description of Artificial Sequence: Synthetic oligonucleotide
ctggctgtcctggttgtcctagctgtc

SEQ ID NO: 46837 - DNA, 27 bp, Artificial Sequence
  Description of Artificial Sequence: Synthetic oligonucleotide
tggctgtcctggttgtcctagctgtcc

SEQ ID NO: 46838 - DNA, 27 bp, Artificial Sequence
  Description of Artificial Sequence: Synthetic oligonucleotide
ggctgtcctggttgtcctagctgtcct

SEQ ID NO: 46839 - DNA, 28 bp, Artificial Sequence
  Description of Artificial Sequence: Synthetic oligonucleotide
gctgtcctggttgtcctagctgtccttg

SEQ ID NO: 46840 - DNA, 28 bp, Artificial Sequence
  Description of Artificial Sequence: Synthetic oligonucleotide
ctgtcctggttgtcctagctgtccttgg

SEQ ID NO: 46841 - DNA, 29 bp, Artificial Sequence
  Description of Artificial Sequence: Synthetic oligonucleotide
tgtcctggttgtcctagctgtccttggag

SEQ ID NO: 46842 - DNA, 28 bp, Artificial Sequence
  Description of Artificial Sequence: Synthetic oligonucleotide
gtcctggttgtcctagctgtccttggag

SEQ ID NO: 46843 - DNA, 28 bp, Artificial Sequence
  Description of Artificial Sequence: Synthetic oligonucleotide
tcctggttgtcctagctgtccttggagc

SEQ ID NO: 46844 - DNA, 27 bp, Artificial Sequence
  Description of Artificial Sequence: Synthetic oligonucleotide
cctggttgtcctagctgtccttggagc

SEQ ID NO: 46845 - DNA, 28 bp, Artificial Sequence
  Description of Artificial Sequence: Synthetic oligonucleotide
ctggttgtcctagctgtccttggagctg

SEQ ID NO: 46846 - DNA, 29 bp, Artificial Sequence
  Description of Artificial Sequence: Synthetic oligonucleotide
tggttgtcctagctgtccttggagctgtg

SEQ ID NO: 46847 - DNA, 28 bp, Artificial Sequence
  Description of Artificial Sequence: Synthetic oligonucleotide
ggttgtcctagctgtccttggagctgtg

SEQ ID NO: 46848 - DNA, 28 bp, Artificial Sequence
  Description of Artificial Sequence: Synthetic oligonucleotide
gttgtcctagctgtccttggagctgtgg

SEQ ID NO: 46849 - DNA, 29 bp, Artificial Sequence
  Description of Artificial Sequence: Synthetic oligonucleotide
ttgtcctagctgtccttggagctgtggtc

SEQ ID NO: 46850 - DNA, 28 bp, Artificial Sequence
  Description of Artificial Sequence: Synthetic oligonucleotide
tgtcctagctgtccttggagctgtggtc

SEQ ID NO: 46851 - DNA, 27 bp, Artificial Sequence
  Description of Artificial Sequence: Synthetic oligonucleotide
gtcctagctgtccttggagctgtggtc

SEQ ID NO: 46852 - DNA, 28 bp, Artificial Sequence
  Description of Artificial Sequence: Synthetic oligonucleotide
tcctagctgtccttggagctgtggtcac

SEQ ID NO: 46853 - DNA, 27 bp, Artificial Sequence
  Description of Artificial Sequence: Synthetic oligonucleotide
cctagctgtccttggagctgtggtcac

SEQ ID NO: 46854 - DNA, 27 bp, Artificial Sequence
  Description of Artificial Sequence: Synthetic oligonucleotide
ctagctgtccttggagctgtggtcacc

SEQ ID NO: 46855 - DNA, 27 bp, Artificial Sequence
  Description of Artificial Sequence: Synthetic oligonucleotide
tagctgtccttggagctgtggtcaccg

SEQ ID NO: 46856 - DNA, 26 bp, Artificial Sequence
  Description of Artificial Sequence: Synthetic oligonucleotide
agctgtccttggagctgtggtcaccg

SEQ ID NO: 46857 - DNA, 25 bp, Artificial Sequence
  Description of Artificial Sequence: Synthetic oligonucleotide
gctgtccttggagctgtggtcaccg

SEQ ID NO: 46858 - DNA, 27 bp, Artificial Sequence
  Description of Artificial Sequence: Synthetic oligonucleotide
ctgtccttggagctgtggtcaccgcta

SEQ ID NO: 46859 - DNA, 28 bp, Artificial Sequence
  Description of Artificial Sequence: Synthetic oligonucleotide
tgtccttggagctgtggtcaccgctatg

SEQ ID NO: 46860 - DNA, 27 bp, Artificial Sequence
  Description of Artificial Sequence: Synthetic oligonucleotide
gtccttggagctgtggtcaccgctatg

SEQ ID NO: 46861 - DNA, 29 bp, Artificial Sequence
  Description of Artificial Sequence: Synthetic oligonucleotide
tccttggagctgtggtcaccgctatgatg

SEQ ID NO: 46862 - DNA, 28 bp, Artificial Sequence
  Description of Artificial Sequence: Synthetic oligonucleotide
ccttggagctgtggtcaccgctatgatg

SEQ ID NO: 46863 - DNA, 29 bp, Artificial Sequence
  Description of Artificial Sequence: Synthetic oligonucleotide
cttggagctgtggtcaccgctatgatgtg

SEQ ID NO: 46864 - DNA, 31 bp, Artificial Sequence
  Description of Artificial Sequence: Synthetic oligonucleotide
ttggagctgtggtcaccgctatgatgtgtag

SEQ ID NO: 46865 - DNA, 30 bp, Artificial Sequence
  Description of Artificial Sequence: Synthetic oligonucleotide
tggagctgtggtcaccgctatgatgtgtag

SEQ ID NO: 46866 - DNA, 29 bp, Artificial Sequence
  Description of Artificial Sequence: Synthetic oligonucleotide
ggagctgtggtcaccgctatgatgtgtag

SEQ ID NO: 46867 - DNA, 29 bp, Artificial Sequence
  Description of Artificial Sequence: Synthetic oligonucleotide
gagctgtggtcaccgctatgatgtgtagg

SEQ ID NO: 46868 - DNA, 30 bp, Artificial Sequence
  Description of Artificial Sequence: Synthetic oligonucleotide
agctgtggtcaccgctatgatgtgtaggag

SEQ ID NO: 46869 - DNA, 29 bp, Artificial Sequence
  Description of Artificial Sequence: Synthetic oligonucleotide
gctgtggtcaccgctatgatgtgtaggag

SEQ ID NO: 46870 - DNA, 29 bp, Artificial Sequence
  Description of Artificial Sequence: Synthetic oligonucleotide
ctgtggtcaccgctatgatgtgtaggagg

SEQ ID NO: 46871 - DNA, 31 bp, Artificial Sequence
  Description of Artificial Sequence: Synthetic oligonucleotide
tgtggtcaccgctatgatgtgtaggaggaag

SEQ ID NO: 46872 - DNA, 30 bp, Artificial Sequence
  Description of Artificial Sequence: Synthetic oligonucleotide
gtggtcaccgctatgatgtgtaggaggaag

SEQ ID NO: 46873 - DNA, 31 bp, Artificial Sequence
  Description of Artificial Sequence: Synthetic oligonucleotide
tggtcaccgctatgatgtgtaggaggaagag

SEQ ID NO: 46874 - DNA, 30 bp, Artificial Sequence
  Description of Artificial Sequence: Synthetic oligonucleotide
ggtcaccgctatgatgtgtaggaggaagag

SEQ ID NO: 46875 - DNA, 30 bp, Artificial Sequence
  Description of Artificial Sequence: Synthetic oligonucleotide
gtcaccgctatgatgtgtaggaggaagagc

SEQ ID NO: 46876 - DNA, 31 bp, Artificial Sequence
  Description of Artificial Sequence: Synthetic oligonucleotide
tcaccgctatgatgtgtaggaggaagagctc

SEQ ID NO: 46877 - DNA, 30 bp, Artificial Sequence
  Description of Artificial Sequence: Synthetic oligonucleotide
caccgctatgatgtgtaggaggaagagctc

SEQ ID NO: 46878 - DNA, 31 bp, Artificial Sequence
  Description of Artificial Sequence: Synthetic oligonucleotide
accgctatgatgtgtaggaggaagagctcag

SEQ ID NO: 46879 - DNA, 30 bp, Artificial Sequence
  Description of Artificial Sequence: Synthetic oligonucleotide
ccgctatgatgtgtaggaggaagagctcag

SEQ ID NO: 46880 - DNA, 30 bp, Artificial Sequence
  Description of Artificial Sequence: Synthetic oligonucleotide
cgctatgatgtgtaggaggaagagctcagg

SEQ ID NO: 46881 - DNA, 31 bp, Artificial Sequence
  Description of Artificial Sequence: Synthetic oligonucleotide
gctatgatgtgtaggaggaagagctcaggtg

SEQ ID NO: 46882 - DNA, 31 bp, Artificial Sequence
  Description of Artificial Sequence: Synthetic oligonucleotide
ctatgatgtgtaggaggaagagctcaggtgg

SEQ ID NO: 46883 - DNA, 35 bp, Artificial Sequence
  Description of Artificial Sequence: Synthetic oligonucleotide
tatgatgtgtaggaggaagagctcaggtggaaaag

SEQ ID NO: 46884 - DNA, 34 bp, Artificial Sequence
  Description of Artificial Sequence: Synthetic oligonucleotide
atgatgtgtaggaggaagagctcaggtggaaaag

SEQ ID NO: 46885 - DNA, 24 bp, Artificial Sequence
  Description of Artificial Sequence: Synthetic oligonucleotide
agggagctgctctcaggctgcgtg

SEQ ID NO: 46886 - DNA, 23 bp, Artificial Sequence
  Description of Artificial Sequence: Synthetic oligonucleotide
gggagctgctctcaggctgcgtg

SEQ ID NO: 46887 - DNA, 24 bp, Artificial Sequence
  Description of Artificial Sequence: Synthetic oligonucleotide
ggagctgctctcaggctgcgtgca

SEQ ID NO: 46888 - DNA, 24 bp, Artificial Sequence
  Description of Artificial Sequence: Synthetic oligonucleotide
gagctgctctcaggctgcgtgcag

SEQ ID NO: 46889 - DNA, 26 bp, Artificial Sequence
  Description of Artificial Sequence: Synthetic oligonucleotide
agctgctctcaggctgcgtgcagcaa

SEQ ID NO: 46890 - DNA, 25 bp, Artificial Sequence
  Description of Artificial Sequence: Synthetic oligonucleotide
gctgctctcaggctgcgtgcagcaa

SEQ ID NO: 46891 - DNA, 26 bp, Artificial Sequence
  Description of Artificial Sequence: Synthetic oligonucleotide
ctgctctcaggctgcgtgcagcaaca

SEQ ID NO: 46892 - DNA, 27 bp, Artificial Sequence
  Description of Artificial Sequence: Synthetic oligonucleotide
tgctctcaggctgcgtgcagcaacagt

SEQ ID NO: 46893 - DNA, 26 bp, Artificial Sequence
  Description of Artificial Sequence: Synthetic oligonucleotide
gctctcaggctgcgtgcagcaacagt

SEQ ID NO: 46894 - DNA, 26 bp, Artificial Sequence
  Description of Artificial Sequence: Synthetic oligonucleotide
ctctcaggctgcgtgcagcaacagtg

SEQ ID NO: 46895 - DNA, 26 bp, Artificial Sequence
  Description of Artificial Sequence: Synthetic oligonucleotide
tctcaggctgcgtgcagcaacagtgc

SEQ ID NO: 46896 - DNA, 25 bp, Artificial Sequence
  Description of Artificial Sequence: Synthetic oligonucleotide
ctcaggctgcgtgcagcaacagtgc

SEQ ID NO: 46897 - DNA, 25 bp, Artificial Sequence
  Description of Artificial Sequence: Synthetic oligonucleotide
tcaggctgcgtgcagcaacagtgcc

SEQ ID NO: 46898 - DNA, 24 bp, Artificial Sequence
  Description of Artificial Sequence: Synthetic oligonucleotide
caggctgcgtgcagcaacagtgcc

SEQ ID NO: 46899 - DNA, 25 bp, Artificial Sequence
  Description of Artificial Sequence: Synthetic oligonucleotide
aggctgcgtgcagcaacagtgccca

SEQ ID NO: 46900 - DNA, 24 bp, Artificial Sequence
  Description of Artificial Sequence: Synthetic oligonucleotide
ggctgcgtgcagcaacagtgccca

SEQ ID NO: 46901 - DNA, 24 bp, Artificial Sequence
  Description of Artificial Sequence: Synthetic oligonucleotide
gctgcgtgcagcaacagtgcccag

SEQ ID NO: 46902 - DNA, 24 bp, Artificial Sequence
  Description of Artificial Sequence: Synthetic oligonucleotide
ctgcgtgcagcaacagtgcccagg

SEQ ID NO: 46903 - DNA, 24 bp, Artificial Sequence
  Description of Artificial Sequence: Synthetic oligonucleotide
tgcgtgcagcaacagtgcccaggg

SEQ ID NO: 46904 - DNA, 23 bp, Artificial Sequence
  Description of Artificial Sequence: Synthetic oligonucleotide
gcgtgcagcaacagtgcccaggg

SEQ ID NO: 46905 - DNA, 24 bp, Artificial Sequence
  Description of Artificial Sequence: Synthetic oligonucleotide
cgtgcagcaacagtgcccagggct

SEQ ID NO: 46906 - DNA, 25 bp, Artificial Sequence
  Description of Artificial Sequence: Synthetic oligonucleotide
gtgcagcaacagtgcccagggctct

SEQ ID NO: 46907 - DNA, 27 bp, Artificial Sequence
  Description of Artificial Sequence: Synthetic oligonucleotide
tgcagcaacagtgcccagggctctgat

SEQ ID NO: 46908 - DNA, 26 bp, Artificial Sequence
  Description of Artificial Sequence: Synthetic oligonucleotide
gcagcaacagtgcccagggctctgat

SEQ ID NO: 46909 - DNA, 28 bp, Artificial Sequence
  Description of Artificial Sequence: Synthetic oligonucleotide
cccagggctctgatgagtctctcatcac

SEQ ID NO: 46910 - DNA, 30 bp, Artificial Sequence
  Description of Artificial Sequence: Synthetic oligonucleotide
ccagggctctgatgagtctctcatcacttg

SEQ ID NO: 46911 - DNA, 34 bp, Artificial Sequence
  Description of Artificial Sequence: Synthetic oligonucleotide
cagggctctgatgagtctctcatcacttgtaaag

SEQ ID NO: 46912 - DNA, 34 bp, Artificial Sequence
  Description of Artificial Sequence: Synthetic oligonucleotide
agggctctgatgagtctctcatcacttgtaaagc

SEQ ID NO: 46913 - DNA, 33 bp, Artificial Sequence
  Description of Artificial Sequence: Synthetic oligonucleotide
gggctctgatgagtctctcatcacttgtaaagc

SEQ ID NO: 46914 - DNA, 33 bp, Artificial Sequence
  Description of Artificial Sequence: Synthetic oligonucleotide
ggctctgatgagtctctcatcacttgtaaagcc

SEQ ID NO: 46915 - DNA, 34 bp, Artificial Sequence
  Description of Artificial Sequence: Synthetic oligonucleotide
gctctgatgagtctctcatcacttgtaaagcctg

SEQ ID NO: 46916 - DNA, 27 bp, Artificial Sequence
  Description of Artificial Sequence: Synthetic oligonucleotide
tgagctgggagccatcttcccagccta

SEQ ID NO: 46917 - DNA, 26 bp, Artificial Sequence
  Description of Artificial Sequence: Synthetic oligonucleotide
gagctgggagccatcttcccagccta

SEQ ID NO: 46918 - DNA, 26 bp, Artificial Sequence
  Description of Artificial Sequence: Synthetic oligonucleotide
agctgggagccatcttcccagcctac

SEQ ID NO: 46919 - DNA, 25 bp, Artificial Sequence
  Description of Artificial Sequence: Synthetic oligonucleotide
gctgggagccatcttcccagcctac

SEQ ID NO: 46920 - DNA, 27 bp, Artificial Sequence
  Description of Artificial Sequence: Synthetic oligonucleotide
ctgggagccatcttcccagcctaccat

SEQ ID NO: 46921 - DNA, 27 bp, Artificial Sequence
  Description of Artificial Sequence: Synthetic oligonucleotide
tgggagccatcttcccagcctaccatc

SEQ ID NO: 46922 - DNA, 26 bp, Artificial Sequence
  Description of Artificial Sequence: Synthetic oligonucleotide
gggagccatcttcccagcctaccatc

SEQ ID NO: 46923 - DNA, 26 bp, Artificial Sequence
  Description of Artificial Sequence: Synthetic oligonucleotide
ggagccatcttcccagcctaccatcc

SEQ ID NO: 46924 - DNA, 26 bp, Artificial Sequence
  Description of Artificial Sequence: Synthetic oligonucleotide
gagccatcttcccagcctaccatccc

SEQ ID NO: 46925 - DNA, 27 bp, Artificial Sequence
  Description of Artificial Sequence: Synthetic oligonucleotide
agccatcttcccagcctaccatcccca

SEQ ID NO: 46926 - DNA, 27 bp, Artificial Sequence
  Description of Artificial Sequence: Synthetic oligonucleotide
gccatcttcccagcctaccatccccat

SEQ ID NO: 46927 - DNA, 27 bp, Artificial Sequence
  Description of Artificial Sequence: Synthetic oligonucleotide
ccatcttcccagcctaccatccccatc

SEQ ID NO: 46928 - DNA, 29 bp, Artificial Sequence
  Description of Artificial Sequence: Synthetic oligonucleotide
catcttcccagcctaccatccccatcatg

SEQ ID NO: 46929 - DNA, 29 bp, Artificial Sequence
  Description of Artificial Sequence: Synthetic oligonucleotide
atcttcccagcctaccatccccatcatgg

SEQ ID NO: 46930 - DNA, 28 bp, Artificial Sequence
  Description of Artificial Sequence: Synthetic oligonucleotide
tcttcccagcctaccatccccatcatgg

SEQ ID NO: 46931 - DNA, 27 bp, Artificial Sequence
  Description of Artificial Sequence: Synthetic oligonucleotide
cttcccagcctaccatccccatcatgg

SEQ ID NO: 46932 - DNA, 27 bp, Artificial Sequence
  Description of Artificial Sequence: Synthetic oligonucleotide
ttcccagcctaccatccccatcatggg

SEQ ID NO: 46933 - DNA, 26 bp, Artificial Sequence
  Description of Artificial Sequence: Synthetic oligonucleotide
tcccagcctaccatccccatcatggg

SEQ ID NO: 46934 - DNA, 25 bp, Artificial Sequence
  Description of Artificial Sequence: Synthetic oligonucleotide
cccagcctaccatccccatcatggg

SEQ ID NO: 46935 - DNA, 27 bp, Artificial Sequence
  Description of Artificial Sequence: Synthetic oligonucleotide
ccagcctaccatccccatcatgggcat

SEQ ID NO: 46936 - DNA, 27 bp, Artificial Sequence
  Description of Artificial Sequence: Synthetic oligonucleotide
cagcctaccatccccatcatgggcatc

SEQ ID NO: 46937 - DNA, 27 bp, Artificial Sequence
  Description of Artificial Sequence: Synthetic oligonucleotide
agcctaccatccccatcatgggcatcg

SEQ ID NO: 46938 - DNA, 27 bp, Artificial Sequence
  Description of Artificial Sequence: Synthetic oligonucleotide
gcctaccatccccatcatgggcatcgt

SEQ ID NO: 46939 - DNA, 28 bp, Artificial Sequence
  Description of Artificial Sequence: Synthetic oligonucleotide
cctaccatccccatcatgggcatcgttg

SEQ ID NO: 46940 - DNA, 28 bp, Artificial Sequence
  Description of Artificial Sequence: Synthetic oligonucleotide
ctaccatccccatcatgggcatcgttgc

SEQ ID NO: 46941 - DNA, 29 bp, Artificial Sequence
  Description of Artificial Sequence: Synthetic oligonucleotide
taccatccccatcatgggcatcgttgctg

SEQ ID NO: 46942 - DNA, 27 bp, Artificial Sequence
  Description of Artificial Sequence: Synthetic oligonucleotide
agcagctgagagcctacctggagggta

SEQ ID NO: 46943 - DNA, 26 bp, Artificial Sequence
  Description of Artificial Sequence: Synthetic oligonucleotide
gcagctgagagcctacctggagggta

SEQ ID NO: 46944 - DNA, 26 bp, Artificial Sequence
  Description of Artificial Sequence: Synthetic oligonucleotide
cagctgagagcctacctggagggtac

SEQ ID NO: 46945 - DNA, 27 bp, Artificial Sequence
  Description of Artificial Sequence: Synthetic oligonucleotide
agctgagagcctacctggagggtacgt

SEQ ID NO: 46946 - DNA, 26 bp, Artificial Sequence
  Description of Artificial Sequence: Synthetic oligonucleotide
gctgagagcctacctggagggtacgt

SEQ ID NO: 46947 - DNA, 26 bp, Artificial Sequence
  Description of Artificial Sequence: Synthetic oligonucleotide
ctgagagcctacctggagggtacgtg

SEQ ID NO: 46948 - DNA, 26 bp, Artificial Sequence
  Description of Artificial Sequence: Synthetic oligonucleotide
tgagagcctacctggagggtacgtgc

SEQ ID NO: 46949 - DNA, 25 bp, Artificial Sequence
  Description of Artificial Sequence: Synthetic oligonucleotide
gagagcctacctggagggtacgtgc

SEQ ID NO: 46950 - DNA, 26 bp, Artificial Sequence
  Description of Artificial Sequence: Synthetic oligonucleotide
agagcctacctggagggtacgtgcgt

SEQ ID NO: 46951 - DNA, 25 bp, Artificial Sequence
  Description of Artificial Sequence: Synthetic oligonucleotide
gagcctacctggagggtacgtgcgt

SEQ ID NO: 46952 - DNA, 25 bp, Artificial Sequence
  Description of Artificial Sequence: Synthetic oligonucleotide
agcctacctggagggtacgtgcgtg

SEQ ID NO: 46953 - DNA, 24 bp, Artificial Sequence
  Description of Artificial Sequence: Synthetic oligonucleotide
gcctacctggagggtacgtgcgtg

SEQ ID NO: 46954 - DNA, 25 bp, Artificial Sequence
  Description of Artificial Sequence: Synthetic oligonucleotide
cctacctggagggtacgtgcgtgga

SEQ ID NO: 46955 - DNA, 26 bp, Artificial Sequence
  Description of Artificial Sequence: Synthetic oligonucleotide
ctacctggagggtacgtgcgtggagt

SEQ ID NO: 46956 - DNA, 26 bp, Artificial Sequence
  Description of Artificial Sequence: Synthetic oligonucleotide
tacctggagggtacgtgcgtggagtg

SEQ ID NO: 46957 - DNA, 25 bp, Artificial Sequence
  Description of Artificial Sequence: Synthetic oligonucleotide
acctggagggtacgtgcgtggagtg

SEQ ID NO: 46958 - DNA, 24 bp, Artificial Sequence
  Description of Artificial Sequence: Synthetic oligonucleotide
cctggagggtacgtgcgtggagtg

SEQ ID NO: 46959 - DNA, 24 bp, Artificial Sequence
  Description of Artificial Sequence: Synthetic oligonucleotide
ctggagggtacgtgcgtggagtgg

SEQ ID NO: 46960 - DNA, 25 bp, Artificial Sequence
  Description of Artificial Sequence: Synthetic oligonucleotide
tggagggtacgtgcgtggagtggct

SEQ ID NO: 46961 - DNA, 24 bp, Artificial Sequence
  Description of Artificial Sequence: Synthetic oligonucleotide
ggagggtacgtgcgtggagtggct

SEQ ID NO: 46962 - DNA, 24 bp, Artificial Sequence
  Description of Artificial Sequence: Synthetic oligonucleotide
gagggtacgtgcgtggagtggctc

SEQ ID NO: 46963 - DNA, 24 bp, Artificial Sequence
  Description of Artificial Sequence: Synthetic oligonucleotide
agggtacgtgcgtggagtggctcc

SEQ ID NO: 46964 - DNA, 23 bp, Artificial Sequence
  Description of Artificial Sequence: Synthetic oligonucleotide
gggtacgtgcgtggagtggctcc

SEQ ID NO: 46965 - DNA, 23 bp, Artificial Sequence
  Description of Artificial Sequence: Synthetic oligonucleotide
ggtacgtgcgtggagtggctccg

SEQ ID NO: 46966 - DNA, 24 bp, Artificial Sequence
  Description of Artificial Sequence: Synthetic oligonucleotide
gtacgtgcgtggagtggctccgca

SEQ ID NO: 46967 - DNA, 27 bp, Artificial Sequence
  Description of Artificial Sequence: Synthetic oligonucleotide
tacgtgcgtggagtggctccgcagata

SEQ ID NO: 46968 - DNA, 20 bp, Artificial Sequence
  Description of Artificial Sequence: Synthetic oligonucleotide
agccgcgggcgccgtgggta

SEQ ID NO: 46969 - DNA, 20 bp, Artificial Sequence
  Description of Artificial Sequence: Synthetic oligonucleotide
gccgcgggcgccgtgggtat

SEQ ID NO: 46970 - DNA, 20 bp, Artificial Sequence
  Description of Artificial Sequence: Synthetic oligonucleotide
ccgcgggcgccgtgggtaga

SEQ ID NO: 46971 - DNA, 20 bp, Artificial Sequence
  Description of Artificial Sequence: Synthetic oligonucleotide
cgcgggcgccgtgggtagag

SEQ ID NO: 46972 - DNA, 21 bp, Artificial Sequence
  Description of Artificial Sequence: Synthetic oligonucleotide
gcgggcgccgtgggtagagca

SEQ ID NO: 46973 - DNA, 21 bp, Artificial Sequence
  Description of Artificial Sequence: Synthetic oligonucleotide
cgggcgccgtgggtagagcag

SEQ ID NO: 46974 - DNA, 22 bp, Artificial Sequence
  Description of Artificial Sequence: Synthetic oligonucleotide
gggcgccgtgggtagagcagga

SEQ ID NO: 46975 - DNA, 22 bp, Artificial Sequence
  Description of Artificial Sequence: Synthetic oligonucleotide
ggcgccgtgggtagagcaggag

SEQ ID NO: 46976 - DNA, 22 bp, Artificial Sequence
  Description of Artificial Sequence: Synthetic oligonucleotide
gcgccgtgggtagagcaggagg

SEQ ID NO: 46977 - DNA, 22 bp, Artificial Sequence
  Description of Artificial Sequence: Synthetic oligonucleotide
cgccgtgggtagagcaggaggg

SEQ ID NO: 46978 - DNA, 22 bp, Artificial Sequence
  Description of Artificial Sequence: Synthetic oligonucleotide
gccgtgggtagagcaggagggg

SEQ ID NO: 46979 - DNA, 22 bp, Artificial Sequence
  Description of Artificial Sequence: Synthetic oligonucleotide
ccgtgggtagagcaggaggggc

SEQ ID NO: 46980 - DNA, 22 bp, Artificial Sequence
  Description of Artificial Sequence: Synthetic oligonucleotide
cgtgggtagagcaggaggggcc

SEQ ID NO: 46981 - DNA, 22 bp, Artificial Sequence
  Description of Artificial Sequence: Synthetic oligonucleotide
gtgggtagagcaggaggggccg

SEQ ID NO: 46982 - DNA, 23 bp, Artificial Sequence
  Description of Artificial Sequence: Synthetic oligonucleotide
tgggtagagcaggaggggccgga

SEQ ID NO: 46983 - DNA, 22 bp, Artificial Sequence
  Description of Artificial Sequence: Synthetic oligonucleotide
gggtagagcaggaggggccgga

SEQ ID NO: 46984 - DNA, 26 bp, Artificial Sequence
  Description of Artificial Sequence: Synthetic oligonucleotide
ggtagagcaggaggggccggagtatt

SEQ ID NO: 46985 - DNA, 26 bp, Artificial Sequence
  Description of Artificial Sequence: Synthetic oligonucleotide
gtagagcaggaggggccggagtattg

SEQ ID NO: 46986 - DNA, 33 bp, Artificial Sequence
  Description of Artificial Sequence: Synthetic oligonucleotide
aagagcagagatacacgtgccatatgcagcatg

SEQ ID NO: 46987 - DNA, 32 bp, Artificial Sequence
  Description of Artificial Sequence: Synthetic oligonucleotide
agagcagagatacacgtgccatatgcagcatg

SEQ ID NO: 46988 - DNA, 31 bp, Artificial Sequence
  Description of Artificial Sequence: Synthetic oligonucleotide
gagcagagatacacgtgccatatgcagcatg

SEQ ID NO: 46989 - DNA, 32 bp, Artificial Sequence
  Description of Artificial Sequence: Synthetic oligonucleotide
agcagagatacacgtgccatatgcagcatgag

SEQ ID NO: 46990 - DNA, 31 bp, Artificial Sequence
  Description of Artificial Sequence: Synthetic oligonucleotide
gcagagatacacgtgccatatgcagcatgag

SEQ ID NO: 46991 - DNA, 31 bp, Artificial Sequence
  Description of Artificial Sequence: Synthetic oligonucleotide
cagagatacacgtgccatatgcagcatgagg

SEQ ID NO: 46992 - DNA, 31 bp, Artificial Sequence
  Description of Artificial Sequence: Synthetic oligonucleotide
agagatacacgtgccatatgcagcatgaggg

SEQ ID NO: 46993 - DNA, 30 bp, Artificial Sequence
  Description of Artificial Sequence: Synthetic oligonucleotide
gagatacacgtgccatatgcagcatgaggg

SEQ ID NO: 46994 - DNA, 30 bp, Artificial Sequence
  Description of Artificial Sequence: Synthetic oligonucleotide
agatacacgtgccatatgcagcatgagggg

SEQ ID NO: 46995 - DNA, 29 bp, Artificial Sequence
  Description of Artificial Sequence: Synthetic oligonucleotide
gatacacgtgccatatgcagcatgagggg

SEQ ID NO: 46996 - DNA, 29 bp, Artificial Sequence
  Description of Artificial Sequence: Synthetic oligonucleotide
atacacgtgccatatgcagcatgaggggc

SEQ ID NO: 46997 - DNA, 28 bp, Artificial Sequence
  Description of Artificial Sequence: Synthetic oligonucleotide
tacacgtgccatatgcagcatgaggggc

SEQ ID NO: 46998 - DNA, 27 bp, Artificial Sequence
  Description of Artificial Sequence: Synthetic oligonucleotide
acacgtgccatatgcagcatgaggggc

SEQ ID NO: 46999 - DNA, 27 bp, Artificial Sequence
  Description of Artificial Sequence: Synthetic oligonucleotide
cacgtgccatatgcagcatgaggggct

SEQ ID NO: 47000 - DNA, 27 bp, Artificial Sequence
  Description of Artificial Sequence: Synthetic oligonucleotide
acgtgccatatgcagcatgaggggctg

SEQ ID NO: 47001 - DNA, 26 bp, Artificial Sequence
  Description of Artificial Sequence: Synthetic oligonucleotide
cgtgccatatgcagcatgaggggctg

SEQ ID NO: 47002 - DNA, 27 bp, Artificial Sequence
  Description of Artificial Sequence: Synthetic oligonucleotide
gtgccatatgcagcatgaggggctgca

SEQ ID NO: 47003 - DNA, 28 bp, Artificial Sequence
  Description of Artificial Sequence: Synthetic oligonucleotide
tgccatatgcagcatgaggggctgcaag

SEQ ID NO: 47004 - DNA, 27 bp, Artificial Sequence
  Description of Artificial Sequence: Synthetic oligonucleotide
gccatatgcagcatgaggggctgcaag

SEQ ID NO: 47005 - DNA, 28 bp, Artificial Sequence
  Description of Artificial Sequence: Synthetic oligonucleotide
ccatatgcagcatgaggggctgcaagag

SEQ ID NO: 47006 - DNA, 28 bp, Artificial Sequence
  Description of Artificial Sequence: Synthetic oligonucleotide
catatgcagcatgaggggctgcaagagc

SEQ ID NO: 47007 - DNA, 28 bp, Artificial Sequence
  Description of Artificial Sequence: Synthetic oligonucleotide
atatgcagcatgaggggctgcaagagcc

SEQ ID NO: 47008 - DNA, 27 bp, Artificial Sequence
  Description of Artificial Sequence: Synthetic oligonucleotide
tatgcagcatgaggggctgcaagagcc

SEQ ID NO: 47009 - DNA, 26 bp, Artificial Sequence
  Description of Artificial Sequence: Synthetic oligonucleotide
atgcagcatgaggggctgcaagagcc

SEQ ID NO: 47010 - DNA, 25 bp, Artificial Sequence
  Description of Artificial Sequence: Synthetic oligonucleotide
tgcagcatgaggggctgcaagagcc

SEQ ID NO: 47011 - DNA, 24 bp, Artificial Sequence
  Description of Artificial Sequence: Synthetic oligonucleotide
gcagcatgaggggctgcaagagcc

SEQ ID NO: 47012 - DNA, 24 bp, Artificial Sequence
  Description of Artificial Sequence: Synthetic oligonucleotide
cagcatgaggggctgcaagagccc

SEQ ID NO: 47013 - DNA, 25 bp, Artificial Sequence
  Description of Artificial Sequence: Synthetic oligonucleotide
agcatgaggggctgcaagagcccct

SEQ ID NO: 47014 - DNA, 24 bp, Artificial Sequence
  Description of Artificial Sequence: Synthetic oligonucleotide
gcatgaggggctgcaagagcccct

SEQ ID NO: 47015 - DNA, 25 bp, Artificial Sequence
  Description of Artificial Sequence: Synthetic oligonucleotide
catgaggggctgcaagagcccctca

SEQ ID NO: 47016 - DNA, 25 bp, Artificial Sequence
  Description of Artificial Sequence: Synthetic oligonucleotide
atgaggggctgcaagagcccctcac

SEQ ID NO: 47017 - DNA, 24 bp, Artificial Sequence
  Description of Artificial Sequence: Synthetic oligonucleotide
tgaggggctgcaagagcccctcac

SEQ ID NO: 47018 - DNA, 27 bp, Artificial Sequence
  Description of Artificial Sequence: Synthetic oligonucleotide
acgcagttcgtgcggttcgacagcgat

SEQ ID NO: 47019 - DNA, 26 bp, Artificial Sequence
  Description of Artificial Sequence: Synthetic oligonucleotide
cgcagttcgtgcggttcgacagcgat

SEQ ID NO: 47020 - DNA, 26 bp, Artificial Sequence
  Description of Artificial Sequence: Synthetic oligonucleotide
gcagttcgtgcggttcgacagcgatg

SEQ ID NO: 47021 - DNA, 26 bp, Artificial Sequence
  Description of Artificial Sequence: Synthetic oligonucleotide
cagttcgtgcggttcgacagcgatgc

SEQ ID NO: 47022 - DNA, 26 bp, Artificial Sequence
  Description of Artificial Sequence: Synthetic oligonucleotide
agttcgtgcggttcgacagcgatgcc

SEQ ID NO: 47023 - DNA, 25 bp, Artificial Sequence
  Description of Artificial Sequence: Synthetic oligonucleotide
gttcgtgcggttcgacagcgatgcc

SEQ ID NO: 47024 - DNA, 25 bp, Artificial Sequence
  Description of Artificial Sequence: Synthetic oligonucleotide
ttcgtgcggttcgacagcgatgccg

SEQ ID NO: 47025 - DNA, 24 bp, Artificial Sequence
  Description of Artificial Sequence: Synthetic oligonucleotide
tcgtgcggttcgacagcgatgccg

SEQ ID NO: 47026 - DNA, 23 bp, Artificial Sequence
  Description of Artificial Sequence: Synthetic oligonucleotide
cgtgcggttcgacagcgatgccg

SEQ ID NO: 47027 - DNA, 23 bp, Artificial Sequence
  Description of Artificial Sequence: Synthetic oligonucleotide
gtgcggttcgacagcgatgccgc

SEQ ID NO: 47028 - DNA, 24 bp, Artificial Sequence
  Description of Artificial Sequence: Synthetic oligonucleotide
tgcggttcgacagcgatgccgcga

SEQ ID NO: 47029 - DNA, 23 bp, Artificial Sequence
  Description of Artificial Sequence: Synthetic oligonucleotide
gcggttcgacagcgatgccgcga

SEQ ID NO: 47030 - DNA, 24 bp, Artificial Sequence
  Description of Artificial Sequence: Synthetic oligonucleotide
cggttcgacagcgatgccgcgagt

SEQ ID NO: 47031 - DNA, 24 bp, Artificial Sequence
  Description of Artificial Sequence: Synthetic oligonucleotide
ggttcgacagcgatgccgcgagtc

SEQ ID NO: 47032 - DNA, 24 bp, Artificial Sequence
  Description of Artificial Sequence: Synthetic oligonucleotide
gttcgacagcgatgccgcgagtcc

SEQ ID NO: 47033 - DNA, 25 bp, Artificial Sequence
  Description of Artificial Sequence: Synthetic oligonucleotide
ttcgacagcgatgccgcgagtccga

SEQ ID NO: 47034 - DNA, 24 bp, Artificial Sequence
  Description of Artificial Sequence: Synthetic oligonucleotide
tcgacagcgatgccgcgagtccga

SEQ ID NO: 47035 - DNA, 23 bp, Artificial Sequence
  Description of Artificial Sequence: Synthetic oligonucleotide
cgacagcgatgccgcgagtccga

SEQ ID NO: 47036 - DNA, 24 bp, Artificial Sequence
  Description of Artificial Sequence: Synthetic oligonucleotide
gacagcgatgccgcgagtccgaga

SEQ ID NO: 47037 - DNA, 24 bp, Artificial Sequence
  Description of Artificial Sequence: Synthetic oligonucleotide
acagcgatgccgcgagtccgagag

SEQ ID NO: 47038 - DNA, 23 bp, Artificial Sequence
  Description of Artificial Sequence: Synthetic oligonucleotide
cagcgatgccgcgagtccgagag

SEQ ID NO: 47039 - DNA, 23 bp, Artificial Sequence
  Description of Artificial Sequence: Synthetic oligonucleotide
agcgatgccgcgagtccgagagg

SEQ ID NO: 47040 - DNA, 22 bp, Artificial Sequence
  Description of Artificial Sequence: Synthetic oligonucleotide
gcgatgccgcgagtccgagagg

SEQ ID NO: 47041 - DNA, 22 bp, Artificial Sequence
  Description of Artificial Sequence: Synthetic oligonucleotide
cgatgccgcgagtccgagaggg

SEQ ID NO: 47042 - DNA, 23 bp, Artificial Sequence
  Description of Artificial Sequence: Synthetic oligonucleotide
gatgccgcgagtccgagagggga

SEQ ID NO: 47043 - DNA, 23 bp, Artificial Sequence
  Description of Artificial Sequence: Synthetic oligonucleotide
atgccgcgagtccgagaggggag

SEQ ID NO: 47044 - DNA, 22 bp, Artificial Sequence
  Description of Artificial Sequence: Synthetic oligonucleotide
tgccgcgagtccgagaggggag

SEQ ID NO: 47045 - DNA, 24 bp, Artificial Sequence
  Description of Artificial Sequence: Synthetic oligonucleotide
cagagcgaggacgggtctcacacg

SEQ ID NO: 47046 - DNA, 25 bp, Artificial Sequence
  Description of Artificial Sequence: Synthetic oligonucleotide
agagcgaggacgggtctcacacgct

SEQ ID NO: 47047 - DNA, 24 bp, Artificial Sequence
  Description of Artificial Sequence: Synthetic oligonucleotide
gagcgaggacgggtctcacacgct

SEQ ID NO: 47048 - DNA, 24 bp, Artificial Sequence
  Description of Artificial Sequence: Synthetic oligonucleotide
agcgaggacgggtctcacacgctc

SEQ ID NO: 47049 - DNA, 23 bp, Artificial Sequence
  Description of Artificial Sequence: Synthetic oligonucleotide
gcgaggacgggtctcacacgctc

SEQ ID NO: 47050 - DNA, 24 bp, Artificial Sequence
  Description of Artificial Sequence: Synthetic oligonucleotide
cgaggacgggtctcacacgctcca

SEQ ID NO: 47051 - DNA, 25 bp, Artificial Sequence
  Description of Artificial Sequence: Synthetic oligonucleotide
gaggacgggtctcacacgctccaga

SEQ ID NO: 47052 - DNA, 25 bp, Artificial Sequence
  Description of Artificial Sequence: Synthetic oligonucleotide
aggacgggtctcacacgctccagag

SEQ ID NO: 47053 - DNA, 24 bp, Artificial Sequence
  Description of Artificial Sequence: Synthetic oligonucleotide
ggacgggtctcacacgctccagag

SEQ ID NO: 47054 - DNA, 26 bp, Artificial Sequence
  Description of Artificial Sequence: Synthetic oligonucleotide
gacgggtctcacacgctccagaggat

SEQ ID NO: 47055 - DNA, 27 bp, Artificial Sequence
  Description of Artificial Sequence: Synthetic oligonucleotide
acgggtctcacacgctccagaggatgt

SEQ ID NO: 47056 - DNA, 27 bp, Artificial Sequence
  Description of Artificial Sequence: Synthetic oligonucleotide
cgggtctcacacgctccagaggatgta

SEQ ID NO: 47057 - DNA, 28 bp, Artificial Sequence
  Description of Artificial Sequence: Synthetic oligonucleotide
gggtctcacacgctccagaggatgtatg

SEQ ID NO: 47058 - DNA, 28 bp, Artificial Sequence
  Description of Artificial Sequence: Synthetic oligonucleotide
ggtctcacacgctccagaggatgtatgg

SEQ ID NO: 47059 - DNA, 28 bp, Artificial Sequence
  Description of Artificial Sequence: Synthetic oligonucleotide
gtctcacacgctccagaggatgtatggc

SEQ ID NO: 47060 - DNA, 29 bp, Artificial Sequence
  Description of Artificial Sequence: Synthetic oligonucleotide
tctcacacgctccagaggatgtatggctg

SEQ ID NO: 47061 - DNA, 28 bp, Artificial Sequence
  Description of Artificial Sequence: Synthetic oligonucleotide
ctcacacgctccagaggatgtatggctg

SEQ ID NO: 47062 - DNA, 28 bp, Artificial Sequence
  Description of Artificial Sequence: Synthetic oligonucleotide
tcacacgctccagaggatgtatggctgc

SEQ ID NO: 47063 - DNA, 27 bp, Artificial Sequence
  Description of Artificial Sequence: Synthetic oligonucleotide
cacacgctccagaggatgtatggctgc

SEQ ID NO: 47064 - DNA, 27 bp, Artificial Sequence
  Description of Artificial Sequence: Synthetic oligonucleotide
acacgctccagaggatgtatggctgcg

SEQ ID NO: 47065 - DNA, 27 bp, Artificial Sequence
  Description of Artificial Sequence: Synthetic oligonucleotide
cacgctccagaggatgtatggctgcga

SEQ ID NO: 47066 - DNA, 27 bp, Artificial Sequence
  Description of Artificial Sequence: Synthetic oligonucleotide
acgctccagaggatgtatggctgcgac

SEQ ID NO: 47067 - DNA, 26 bp, Artificial Sequence
  Description of Artificial Sequence: Synthetic oligonucleotide
cgctccagaggatgtatggctgcgac

SEQ ID NO: 47068 - DNA, 27 bp, Artificial Sequence
  Description of Artificial Sequence: Synthetic oligonucleotide
gctccagaggatgtatggctgcgacct

SEQ ID NO: 47069 - DNA, 22 bp, Artificial Sequence
  Description of Artificial Sequence: Synthetic oligonucleotide
gtgggtggagcaggaggggcca

SEQ ID NO: 47070 - DNA, 23 bp, Artificial Sequence
  Description of Artificial Sequence: Synthetic oligonucleotide
tgggtggagcaggaggggccaga

SEQ ID NO: 47071 - DNA, 22 bp, Artificial Sequence
  Description of Artificial Sequence: Synthetic oligonucleotide
gggtggagcaggaggggccaga

SEQ ID NO: 47072 - DNA, 26 bp, Artificial Sequence
  Description of Artificial Sequence: Synthetic oligonucleotide
ggtggagcaggaggggccagagtatt

SEQ ID NO: 47073 - DNA, 26 bp, Artificial Sequence
  Description of Artificial Sequence: Synthetic oligonucleotide
gtggagcaggaggggccagagtattg

SEQ ID NO: 47074 - DNA, 26 bp, Artificial Sequence
  Description of Artificial Sequence: Synthetic oligonucleotide
tggagcaggaggggccagagtattgg

SEQ ID NO: 47075 - DNA, 25 bp, Artificial Sequence
  Description of Artificial Sequence: Synthetic oligonucleotide
ggagcaggaggggccagagtattgg

SEQ ID NO: 47076 - DNA, 25 bp, Artificial Sequence
  Description of Artificial Sequence: Synthetic oligonucleotide
caggaggggccagagtattgggacc

SEQ ID NO: 47077 - DNA, 25 bp, Artificial Sequence
  Description of Artificial Sequence: Synthetic oligonucleotide
aggaggggccagagtattgggaccg

SEQ ID NO: 47078 - DNA, 24 bp, Artificial Sequence
  Description of Artificial Sequence: Synthetic oligonucleotide
ggaggggccagagtattgggaccg

SEQ ID NO: 47079 - DNA, 24 bp, Artificial Sequence
  Description of Artificial Sequence: Synthetic oligonucleotide
gaggggccagagtattgggaccgg

SEQ ID NO: 47080 - DNA, 25 bp, Artificial Sequence
  Description of Artificial Sequence: Synthetic oligonucleotide
aggggccagagtattgggaccggga

SEQ ID NO: 47081 - DNA, 24 bp, Artificial Sequence
  Description of Artificial Sequence: Synthetic oligonucleotide
ggggccagagtattgggaccggga

SEQ ID NO: 47082 - DNA, 25 bp, Artificial Sequence
  Description of Artificial Sequence: Synthetic oligonucleotide
gggccagagtattgggaccgggaga

SEQ ID NO: 47083 - DNA, 26 bp, Artificial Sequence
  Description of Artificial Sequence: Synthetic oligonucleotide
ggccagagtattgggaccgggagaca

SEQ ID NO: 47084 - DNA, 27 bp, Artificial Sequence
  Description of Artificial Sequence: Synthetic oligonucleotide
gccagagtattgggaccgggagacaca

SEQ ID NO: 47085 - DNA, 27 bp, Artificial Sequence
  Description of Artificial Sequence: Synthetic oligonucleotide
ccagagtattgggaccgggagacacag

SEQ ID NO: 47086 - DNA, 29 bp, Artificial Sequence
  Description of Artificial Sequence: Synthetic oligonucleotide
cagagtattgggaccgggagacacagaag

SEQ ID NO: 47087 - DNA, 31 bp, Artificial Sequence
  Description of Artificial Sequence: Synthetic oligonucleotide
agagtattgggaccgggagacacagaagtac

SEQ ID NO: 47088 - DNA, 25 bp, Artificial Sequence
  Description of Artificial Sequence: Synthetic oligonucleotide
ctgagagcctacctggagggcacct

SEQ ID NO: 47089 - DNA, 22 bp, Artificial Sequence
  Description of Artificial Sequence: Synthetic oligonucleotide
gagacgctgcagcgcgcggaac

SEQ ID NO: 47090 - DNA, 22 bp, Artificial Sequence
  Description of Artificial Sequence: Synthetic oligonucleotide
agacgctgcagcgcgcggaacc

SEQ ID NO: 47091 - DNA, 21 bp, Artificial Sequence
  Description of Artificial Sequence: Synthetic oligonucleotide
gacgctgcagcgcgcggaacc

SEQ ID NO: 47092 - DNA, 21 bp, Artificial Sequence
  Description of Artificial Sequence: Synthetic oligonucleotide
acgctgcagcgcgcggaaccc

SEQ ID NO: 47093 - DNA, 20 bp, Artificial Sequence
  Description of Artificial Sequence: Synthetic oligonucleotide
cgctgcagcgcgcggaaccc

SEQ ID NO: 47094 - DNA, 20 bp, Artificial Sequence
  Description of Artificial Sequence: Synthetic oligonucleotide
gctgcagcgcgcggaacccc

SEQ ID NO: 47095 - DNA, 23 bp, Artificial Sequence
  Description of Artificial Sequence: Synthetic oligonucleotide
ctgcagcgcgcggaacccccaaa

SEQ ID NO: 47096 - DNA, 24 bp, Artificial Sequence
  Description of Artificial Sequence: Synthetic oligonucleotide
tgcagcgcgcggaacccccaaaga

SEQ ID NO: 47097 - DNA, 23 bp, Artificial Sequence
  Description of Artificial Sequence: Synthetic oligonucleotide
gcagcgcgcggaacccccaaaga

SEQ ID NO: 47098 - DNA, 24 bp, Artificial Sequence
  Description of Artificial Sequence: Synthetic oligonucleotide
cagcgcgcggaacccccaaagaca

SEQ ID NO: 47099 - DNA, 25 bp, Artificial Sequence
  Description of Artificial Sequence: Synthetic oligonucleotide
agcgcgcggaacccccaaagacaca

SEQ ID NO: 47100 - DNA, 24 bp, Artificial Sequence
  Description of Artificial Sequence: Synthetic oligonucleotide
gcgcgcggaacccccaaagacaca

SEQ ID NO: 47101 - DNA, 24 bp, Artificial Sequence
  Description of Artificial Sequence: Synthetic oligonucleotide
cgcgcggaacccccaaagacacac

SEQ ID NO: 47102 - DNA, 25 bp, Artificial Sequence
  Description of Artificial Sequence: Synthetic oligonucleotide
gcgcggaacccccaaagacacacgt

SEQ ID NO: 47103 - DNA, 26 bp, Artificial Sequence
  Description of Artificial Sequence: Synthetic oligonucleotide
cgcggaacccccaaagacacacgtga

SEQ ID NO: 47104 - DNA, 26 bp, Artificial Sequence
  Description of Artificial Sequence: Synthetic oligonucleotide
gcggaacccccaaagacacacgtgac

SEQ ID NO: 47105 - DNA, 26 bp, Artificial Sequence
  Description of Artificial Sequence: Synthetic oligonucleotide
cggaacccccaaagacacacgtgacc

SEQ ID NO: 47106 - DNA, 27 bp, Artificial Sequence
  Description of Artificial Sequence: Synthetic oligonucleotide
ggaacccccaaagacacacgtgaccca

SEQ ID NO: 47107 - DNA, 24 bp, Artificial Sequence
  Description of Artificial Sequence: Synthetic oligonucleotide
ccgcggacaccgcggctcagatta

SEQ ID NO: 47108 - DNA, 24 bp, Artificial Sequence
  Description of Artificial Sequence: Synthetic oligonucleotide
cgcggacaccgcggctcagattac

SEQ ID NO: 47109 - DNA, 24 bp, Artificial Sequence
  Description of Artificial Sequence: Synthetic oligonucleotide
gcggacaccgcggctcagattacc

SEQ ID NO: 47110 - DNA, 25 bp, Artificial Sequence
  Description of Artificial Sequence: Synthetic oligonucleotide
cggacaccgcggctcagattaccca

SEQ ID NO: 47111 - DNA, 25 bp, Artificial Sequence
  Description of Artificial Sequence: Synthetic oligonucleotide
ggacaccgcggctcagattacccag

SEQ ID NO: 47112 - DNA, 25 bp, Artificial Sequence
  Description of Artificial Sequence: Synthetic oligonucleotide
gacaccgcggctcagattacccagc

SEQ ID NO: 47113 - DNA, 25 bp, Artificial Sequence
  Description of Artificial Sequence: Synthetic oligonucleotide
acaccgcggctcagattacccagcg

SEQ ID NO: 47114 - DNA, 24 bp, Artificial Sequence
  Description of Artificial Sequence: Synthetic oligonucleotide
caccgcggctcagattacccagcg

SEQ ID NO: 47115 - DNA, 26 bp, Artificial Sequence
  Description of Artificial Sequence: Synthetic oligonucleotide
accgcggctcagattacccagcgcaa

SEQ ID NO: 47116 - DNA, 25 bp, Artificial Sequence
  Description of Artificial Sequence: Synthetic oligonucleotide
ccgcggctcagattacccagcgcaa

SEQ ID NO: 47117 - DNA, 27 bp, Artificial Sequence
  Description of Artificial Sequence: Synthetic oligonucleotide
cgcggctcagattacccagcgcaagtt

SEQ ID NO: 47118 - DNA, 27 bp, Artificial Sequence
  Description of Artificial Sequence: Synthetic oligonucleotide
gcggctcagattacccagcgcaagttg

SEQ ID NO: 47119 - DNA, 27 bp, Artificial Sequence
  Description of Artificial Sequence: Synthetic oligonucleotide
cggctcagattacccagcgcaagttgg

SEQ ID NO: 47120 - DNA, 28 bp, Artificial Sequence
  Description of Artificial Sequence: Synthetic oligonucleotide
ggctcagattacccagcgcaagttggag

SEQ ID NO: 47121 - DNA, 28 bp, Artificial Sequence
  Description of Artificial Sequence: Synthetic oligonucleotide
gctcagattacccagcgcaagttggagg

SEQ ID NO: 47122 - DNA, 28 bp, Artificial Sequence
  Description of Artificial Sequence: Synthetic oligonucleotide
ctcagattacccagcgcaagttggaggc

SEQ ID NO: 47123 - DNA, 28 bp, Artificial Sequence
  Description of Artificial Sequence: Synthetic oligonucleotide
tcagattacccagcgcaagttggaggcg

SEQ ID NO: 47124 - DNA, 27 bp, Artificial Sequence
  Description of Artificial Sequence: Synthetic oligonucleotide
cagattacccagcgcaagttggaggcg

SEQ ID NO: 47125 - DNA, 27 bp, Artificial Sequence
  Description of Artificial Sequence: Synthetic oligonucleotide
agattacccagcgcaagttggaggcgg

SEQ ID NO: 47126 - DNA, 26 bp, Artificial Sequence
  Description of Artificial Sequence: Synthetic oligonucleotide
gattacccagcgcaagttggaggcgg

SEQ ID NO: 47127 - DNA, 26 bp, Artificial Sequence
  Description of Artificial Sequence: Synthetic oligonucleotide
attacccagcgcaagttggaggcggc

SEQ ID NO: 47128 - DNA, 25 bp, Artificial Sequence
  Description of Artificial Sequence: Synthetic oligonucleotide
ttacccagcgcaagttggaggcggc

SEQ ID NO: 47129 - DNA, 24 bp, Artificial Sequence
  Description of Artificial Sequence: Synthetic oligonucleotide
tacccagcgcaagttggaggcggc

SEQ ID NO: 47130 - DNA, 27 bp, Artificial Sequence
  Description of Artificial Sequence: Synthetic oligonucleotide
cgcggctcagatcactcagcgcaagtt

SEQ ID NO: 47131 - DNA, 27 bp, Artificial Sequence
  Description of Artificial Sequence: Synthetic oligonucleotide
gcggctcagatcactcagcgcaagttg

SEQ ID NO: 47132 - DNA, 27 bp, Artificial Sequence
  Description of Artificial Sequence: Synthetic oligonucleotide
cggctcagatcactcagcgcaagttgg

SEQ ID NO: 47133 - DNA, 28 bp, Artificial Sequence
  Description of Artificial Sequence: Synthetic oligonucleotide
ggctcagatcactcagcgcaagttggag

SEQ ID NO: 47134 - DNA, 28 bp, Artificial Sequence
  Description of Artificial Sequence: Synthetic oligonucleotide
gctcagatcactcagcgcaagttggagg

SEQ ID NO: 47135 - DNA, 28 bp, Artificial Sequence
  Description of Artificial Sequence: Synthetic oligonucleotide
ctcagatcactcagcgcaagttggaggc

SEQ ID NO: 47136 - DNA, 28 bp, Artificial Sequence
  Description of Artificial Sequence: Synthetic oligonucleotide
tcagatcactcagcgcaagttggaggcg

SEQ ID NO: 47137 - DNA, 27 bp, Artificial Sequence
  Description of Artificial Sequence: Synthetic oligonucleotide
cagatcactcagcgcaagttggaggcg

SEQ ID NO: 47138 - DNA, 27 bp, Artificial Sequence
  Description of Artificial Sequence: Synthetic oligonucleotide
agatcactcagcgcaagttggaggcgg

SEQ ID NO: 47139 - DNA, 26 bp, Artificial Sequence
  Description of Artificial Sequence: Synthetic oligonucleotide
gatcactcagcgcaagttggaggcgg

SEQ ID NO: 47140 - DNA, 26 bp, Artificial Sequence
  Description of Artificial Sequence: Synthetic oligonucleotide
atcactcagcgcaagttggaggcggc

SEQ ID NO: 47141 - DNA, 25 bp, Artificial Sequence
  Description of Artificial Sequence: Synthetic oligonucleotide
tcactcagcgcaagttggaggcggc

SEQ ID NO: 47142 - DNA, 24 bp, Artificial Sequence
  Description of Artificial Sequence: Synthetic oligonucleotide
cactcagcgcaagttggaggcggc

SEQ ID NO: 47143 - DNA, 24 bp, Artificial Sequence
  Description of Artificial Sequence: Synthetic oligonucleotide
actcagcgcaagttggaggcggcc

SEQ ID NO: 47144 - DNA, 23 bp, Artificial Sequence
  Description of Artificial Sequence: Synthetic oligonucleotide
ctcagcgcaagttggaggcggcc

SEQ ID NO: 47145 - DNA, 23 bp, Artificial Sequence
  Description of Artificial Sequence: Synthetic oligonucleotide
tcagcgcaagttggaggcggccc

SEQ ID NO: 47146 - DNA, 27 bp, Artificial Sequence
  Description of Artificial Sequence: Synthetic oligonucleotide
cagaagtacaagcgccaggcacaggca

SEQ ID NO: 47147 - DNA, 27 bp, Artificial Sequence
  Description of Artificial Sequence: Synthetic oligonucleotide
agaagtacaagcgccaggcacaggcag

SEQ ID NO: 47148 - DNA, 27 bp, Artificial Sequence
  Description of Artificial Sequence: Synthetic oligonucleotide
gaagtacaagcgccaggcacaggcaga

SEQ ID NO: 47149 - DNA, 27 bp, Artificial Sequence
  Description of Artificial Sequence: Synthetic oligonucleotide
aagtacaagcgccaggcacaggcagac

SEQ ID NO: 47150 - DNA, 26 bp, Artificial Sequence
  Description of Artificial Sequence: Synthetic oligonucleotide
agtacaagcgccaggcacaggcagac

SEQ ID NO: 47151 - DNA, 25 bp, Artificial Sequence
  Description of Artificial Sequence: Synthetic oligonucleotide
gtacaagcgccaggcacaggcagac

SEQ ID NO: 47152 - DNA, 25 bp, Artificial Sequence
  Description of Artificial Sequence: Synthetic oligonucleotide
tacaagcgccaggcacaggcagacc

SEQ ID NO: 47153 - DNA, 24 bp, Artificial Sequence
  Description of Artificial Sequence: Synthetic oligonucleotide
acaagcgccaggcacaggcagacc

SEQ ID NO: 47154 - DNA, 23 bp, Artificial Sequence
  Description of Artificial Sequence: Synthetic oligonucleotide
caagcgccaggcacaggcagacc

SEQ ID NO: 47155 - DNA, 24 bp, Artificial Sequence
  Description of Artificial Sequence: Synthetic oligonucleotide
aagcgccaggcacaggcagaccga

SEQ ID NO: 47156 - DNA, 23 bp, Artificial Sequence
  Description of Artificial Sequence: Synthetic oligonucleotide
agcgccaggcacaggcagaccga

SEQ ID NO: 47157 - DNA, 22 bp, Artificial Sequence
  Description of Artificial Sequence: Synthetic oligonucleotide
gcgccaggcacaggcagaccga

SEQ ID NO: 47158 - DNA, 23 bp, Artificial Sequence
  Description of Artificial Sequence: Synthetic oligonucleotide
cgccaggcacaggcagaccgagt

SEQ ID NO: 47159 - DNA, 24 bp, Artificial Sequence
  Description of Artificial Sequence: Synthetic oligonucleotide
gccaggcacaggcagaccgagtga

SEQ ID NO: 47160 - DNA, 24 bp, Artificial Sequence
  Description of Artificial Sequence: Synthetic oligonucleotide
ccaggcacaggcagaccgagtgag

SEQ ID NO: 47161 - DNA, 24 bp, Artificial Sequence
  Description of Artificial Sequence: Synthetic oligonucleotide
caggcacaggcagaccgagtgagc

SEQ ID NO: 47162 - DNA, 25 bp, Artificial Sequence
  Description of Artificial Sequence: Synthetic oligonucleotide
aggcacaggcagaccgagtgagcct

SEQ ID NO: 47163 - DNA, 24 bp, Artificial Sequence
  Description of Artificial Sequence: Synthetic oligonucleotide
ggcacaggcagaccgagtgagcct

SEQ ID NO: 47164 - DNA, 24 bp, Artificial Sequence
  Description of Artificial Sequence: Synthetic oligonucleotide
gcacaggcagaccgagtgagcctg

SEQ ID NO: 47165 - DNA, 24 bp, Artificial Sequence
  Description of Artificial Sequence: Synthetic oligonucleotide
cacaggcagaccgagtgagcctgc

SEQ ID NO: 47166 - DNA, 24 bp, Artificial Sequence
  Description of Artificial Sequence: Synthetic oligonucleotide
acaggcagaccgagtgagcctgcg

SEQ ID NO: 47167 - DNA, 23 bp, Artificial Sequence
  Description of Artificial Sequence: Synthetic oligonucleotide
caggcagaccgagtgagcctgcg

SEQ ID NO: 47168 - DNA, 25 bp, Artificial Sequence
  Description of Artificial Sequence: Synthetic oligonucleotide
aggcagaccgagtgagcctgcggaa

SEQ ID NO: 47169 - DNA, 24 bp, Artificial Sequence
  Description of Artificial Sequence: Synthetic oligonucleotide
ggcagaccgagtgagcctgcggaa

SEQ ID NO: 47170 - DNA, 24 bp, Artificial Sequence
  Description of Artificial Sequence: Synthetic oligonucleotide
gcagaccgagtgagcctgcggaac

SEQ ID NO: 47171 - DNA, 25 bp, Artificial Sequence
  Description of Artificial Sequence: Synthetic oligonucleotide
cagaccgagtgagcctgcggaacct

SEQ ID NO: 47172 - DNA, 25 bp, Artificial Sequence
  Description of Artificial Sequence: Synthetic oligonucleotide
agaccgagtgagcctgcggaacctg

SEQ ID NO: 47173 - DNA, 21 bp, Artificial Sequence
  Description of Artificial Sequence: Synthetic oligonucleotide
tctggctgcgacctggggccg

SEQ ID NO: 47174 - DNA, 20 bp, Artificial Sequence
  Description of Artificial Sequence: Synthetic oligonucleotide
ctggctgcgacctggggccg

SEQ ID NO: 47175 - DNA, 29 bp, Artificial Sequence
  Description of Artificial Sequence: Synthetic oligonucleotide
actccatgaggtatttcgacaccgccgtc

SEQ ID NO: 47176 - DNA, 28 bp, Artificial Sequence
  Description of Artificial Sequence: Synthetic oligonucleotide
ctccatgaggtatttcgacaccgccgtc

SEQ ID NO: 47177 - DNA, 29 bp, Artificial Sequence
  Description of Artificial Sequence: Synthetic oligonucleotide
tccatgaggtatttcgacaccgccgtctc

SEQ ID NO: 47178 - DNA, 28 bp, Artificial Sequence
  Description of Artificial Sequence: Synthetic oligonucleotide
ccatgaggtatttcgacaccgccgtctc

SEQ ID NO: 47179 - DNA, 28 bp, Artificial Sequence
  Description of Artificial Sequence: Synthetic oligonucleotide
catgaggtatttcgacaccgccgtctcc

SEQ ID NO: 47180 - DNA, 28 bp, Artificial Sequence
  Description of Artificial Sequence: Synthetic oligonucleotide
atgaggtatttcgacaccgccgtctccc

SEQ ID NO: 47181 - DNA, 27 bp, Artificial Sequence
  Description of Artificial Sequence: Synthetic oligonucleotide
tgaggtatttcgacaccgccgtctccc

SEQ ID NO: 47182 - DNA, 26 bp, Artificial Sequence
  Description of Artificial Sequence: Synthetic oligonucleotide
gaggtatttcgacaccgccgtctccc

SEQ ID NO: 47183 - DNA, 26 bp, Artificial Sequence
  Description of Artificial Sequence: Synthetic oligonucleotide
aggtatttcgacaccgccgtctcccg

SEQ ID NO: 47184 - DNA, 25 bp, Artificial Sequence
  Description of Artificial Sequence: Synthetic oligonucleotide
ggtatttcgacaccgccgtctcccg

SEQ ID NO: 47185 - DNA, 25 bp, Artificial Sequence
  Description of Artificial Sequence: Synthetic oligonucleotide
gtatttcgacaccgccgtctcccgg

SEQ ID NO: 47186 - DNA, 25 bp, Artificial Sequence
  Description of Artificial Sequence: Synthetic oligonucleotide
tatttcgacaccgccgtctcccggc

SEQ ID NO: 47187 - DNA, 24 bp, Artificial Sequence
  Description of Artificial Sequence: Synthetic oligonucleotide
atttcgacaccgccgtctcccggc

SEQ ID NO: 47188 - DNA, 23 bp, Artificial Sequence
  Description of Artificial Sequence: Synthetic oligonucleotide
tttcgacaccgccgtctcccggc

SEQ ID NO: 47189 - DNA, 22 bp, Artificial Sequence
  Description of Artificial Sequence: Synthetic oligonucleotide
ttcgacaccgccgtctcccggc

SEQ ID NO: 47190 - DNA, 21 bp, Artificial Sequence
  Description of Artificial Sequence: Synthetic oligonucleotide
tcgacaccgccgtctcccggc

SEQ ID NO: 47191 - DNA, 20 bp, Artificial Sequence
  Description of Artificial Sequence: Synthetic oligonucleotide
cgacaccgccgtctcccggc

SEQ ID NO: 47192 - DNA, 20 bp, Artificial Sequence
  Description of Artificial Sequence: Synthetic oligonucleotide
gacaccgccgtctcccggcc

SEQ ID NO: 47193 - DNA, 20 bp, Artificial Sequence
  Description of Artificial Sequence: Synthetic oligonucleotide
acaccgccgtctcccggccc

SEQ ID NO: 47194 - DNA, 20 bp, Artificial Sequence
  Description of Artificial Sequence: Synthetic oligonucleotide
caccgccgtctcccggccct

SEQ ID NO: 47195 - DNA, 20 bp, Artificial Sequence
  Description of Artificial Sequence: Synthetic oligonucleotide
accgccgtctcccggcccgt

SEQ ID NO: 47196 - DNA, 20 bp, Artificial Sequence
  Description of Artificial Sequence: Synthetic oligonucleotide
ccgccgtctcccggcccgtt

SEQ ID NO: 47197 - DNA, 20 bp, Artificial Sequence
  Description of Artificial Sequence: Synthetic oligonucleotide
cgccgtctcccggcccggtt

SEQ ID NO: 47198 - DNA, 20 bp, Artificial Sequence
  Description of Artificial Sequence: Synthetic oligonucleotide
gccgtctcccggcccggctt

SEQ ID NO: 47199 - DNA, 27 bp, Artificial Sequence
  Description of Artificial Sequence: Synthetic oligonucleotide
ctgcggaacctgcgcggctactacaat

SEQ ID NO: 47200 - DNA, 27 bp, Artificial Sequence
  Description of Artificial Sequence: Synthetic oligonucleotide
tgcggaacctgcgcggctactacaatc

SEQ ID NO: 47201 - DNA, 27 bp, Artificial Sequence
  Description of Artificial Sequence: Synthetic oligonucleotide
gcggaacctgcgcggctactacaatca

SEQ ID NO: 47202 - DNA, 27 bp, Artificial Sequence
  Description of Artificial Sequence: Synthetic oligonucleotide
cggaacctgcgcggctactacaatcag

SEQ ID NO: 47203 - DNA, 28 bp, Artificial Sequence
  Description of Artificial Sequence: Synthetic oligonucleotide
ggaacctgcgcggctactacaatcagag

SEQ ID NO: 47204 - DNA, 28 bp, Artificial Sequence
  Description of Artificial Sequence: Synthetic oligonucleotide
gaacctgcgcggctactacaatcagagc

SEQ ID NO: 47205 - DNA, 28 bp, Artificial Sequence
  Description of Artificial Sequence: Synthetic oligonucleotide
aacctgcgcggctactacaatcagagcg

SEQ ID NO: 47206 - DNA, 27 bp, Artificial Sequence
  Description of Artificial Sequence: Synthetic oligonucleotide
acctgcgcggctactacaatcagagcg

SEQ ID NO: 47207 - DNA, 27 bp, Artificial Sequence
  Description of Artificial Sequence: Synthetic oligonucleotide
ggctactacaatcagagcgaggacggg

SEQ ID NO: 47208 - DNA, 28 bp, Artificial Sequence
  Description of Artificial Sequence: Synthetic oligonucleotide
gctactacaatcagagcgaggacgggtc

SEQ ID NO: 47209 - DNA, 29 bp, Artificial Sequence
  Description of Artificial Sequence: Synthetic oligonucleotide
ctactacaatcagagcgaggacgggtctc

SEQ ID NO: 47210 - DNA, 30 bp, Artificial Sequence
  Description of Artificial Sequence: Synthetic oligonucleotide
tactacaatcagagcgaggacgggtctcac

SEQ ID NO: 47211 - DNA, 29 bp, Artificial Sequence
  Description of Artificial Sequence: Synthetic oligonucleotide
actacaatcagagcgaggacgggtctcac

SEQ ID NO: 47212 - DNA, 28 bp, Artificial Sequence
  Description of Artificial Sequence: Synthetic oligonucleotide
ctacaatcagagcgaggacgggtctcac

SEQ ID NO: 47213 - DNA, 29 bp, Artificial Sequence
  Description of Artificial Sequence: Synthetic oligonucleotide
tacaatcagagcgaggacgggtctcacac

SEQ ID NO: 47214 - DNA, 28 bp, Artificial Sequence
  Description of Artificial Sequence: Synthetic oligonucleotide
acaatcagagcgaggacgggtctcacac

SEQ ID NO: 47215 - DNA, 27 bp, Artificial Sequence
  Description of Artificial Sequence: Synthetic oligonucleotide
caatcagagcgaggacgggtctcacac

SEQ ID NO: 47216 - DNA, 27 bp, Artificial Sequence
  Description of Artificial Sequence: Synthetic oligonucleotide
aatcagagcgaggacgggtctcacacc

SEQ ID NO: 47217 - DNA, 26 bp, Artificial Sequence
  Description of Artificial Sequence: Synthetic oligonucleotide
atcagagcgaggacgggtctcacacc

SEQ ID NO: 47218 - DNA, 25 bp, Artificial Sequence
  Description of Artificial Sequence: Synthetic oligonucleotide
tcagagcgaggacgggtctcacacc

SEQ ID NO: 47219 - DNA, 23 bp, Artificial Sequence
  Description of Artificial Sequence: Synthetic oligonucleotide
atgggcgcctcctccgcgggtat

SEQ ID NO: 47220 - DNA, 22 bp, Artificial Sequence
  Description of Artificial Sequence: Synthetic oligonucleotide
tgggcgcctcctccgcgggtat

SEQ ID NO: 47221 - DNA, 23 bp, Artificial Sequence
  Description of Artificial Sequence: Synthetic oligonucleotide
acgtgcgtggagtggctccgcag

SEQ ID NO: 47222 - DNA, 22 bp, Artificial Sequence
  Description of Artificial Sequence: Synthetic oligonucleotide
cgtgcgtggagtggctccgcag

SEQ ID NO: 47223 - DNA, 27 bp, Artificial Sequence
  Description of Artificial Sequence: Synthetic oligonucleotide
gcaggtacctggagaacgggaaggaga

SEQ ID NO: 47224 - DNA, 27 bp, Artificial Sequence
  Description of Artificial Sequence: Synthetic oligonucleotide
caggtacctggagaacgggaaggagac

SEQ ID NO: 47225 - DNA, 27 bp, Artificial Sequence
  Description of Artificial Sequence: Synthetic oligonucleotide
aggtacctggagaacgggaaggagacg

SEQ ID NO: 47226 - DNA, 26 bp, Artificial Sequence
  Description of Artificial Sequence: Synthetic oligonucleotide
ggtacctggagaacgggaaggagacg

SEQ ID NO: 47227 - DNA, 27 bp, Artificial Sequence
  Description of Artificial Sequence: Synthetic oligonucleotide
gtacctggagaacgggaaggagacgct

SEQ ID NO: 47228 - DNA, 20 bp, Artificial Sequence
  Description of Artificial Sequence: Synthetic oligonucleotide
cgtgtcccggcccggcgctt

SEQ ID NO: 47229 - DNA, 20 bp, Artificial Sequence
  Description of Artificial Sequence: Synthetic oligonucleotide
gtgtcccggcccggcgcctt

SEQ ID NO: 47230 - DNA, 20 bp, Artificial Sequence
  Description of Artificial Sequence: Synthetic oligonucleotide
tgtcccggcccggcgccgtt

SEQ ID NO: 47231 - DNA, 20 bp, Artificial Sequence
  Description of Artificial Sequence: Synthetic oligonucleotide
gtcccggcccggcgccgttt

SEQ ID NO: 47232 - DNA, 20 bp, Artificial Sequence
  Description of Artificial Sequence: Synthetic oligonucleotide
tcccggcccggcgccggatt

SEQ ID NO: 47233 - DNA, 20 bp, Artificial Sequence
  Description of Artificial Sequence: Synthetic oligonucleotide
cccggcccggcgccggattt

SEQ ID NO: 47234 - DNA, 20 bp, Artificial Sequence
  Description of Artificial Sequence: Synthetic oligonucleotide
ccggcccggcgccggagatt

SEQ ID NO: 47235 - DNA, 20 bp, Artificial Sequence
  Description of Artificial Sequence: Synthetic oligonucleotide
cggcccggcgccggagagtt

SEQ ID NO: 47236 - DNA, 20 bp, Artificial Sequence
  Description of Artificial Sequence: Synthetic oligonucleotide
ggcccggcgccggagagctt

SEQ ID NO: 47237 - DNA, 20 bp, Artificial Sequence
  Description of Artificial Sequence: Synthetic oligonucleotide
gcccggcgccggagagcctt

SEQ ID NO: 47238 - DNA, 20 bp, Artificial Sequence
  Description of Artificial Sequence: Synthetic oligonucleotide
cccggcgccggagagccctt

SEQ ID NO: 47239 - DNA, 20 bp, Artificial Sequence
  Description of Artificial Sequence: Synthetic oligonucleotide
ccggcgccggagagcccctt

SEQ ID NO: 47240 - DNA, 20 bp, Artificial Sequence
  Description of Artificial Sequence: Synthetic oligonucleotide
cggcgccggagagccccgtt

SEQ ID NO: 47241 - DNA, 20 bp, Artificial Sequence
  Description of Artificial Sequence: Synthetic oligonucleotide
ggcgccggagagccccgctt

SEQ ID NO: 47242 - DNA, 22 bp, Artificial Sequence
  Description of Artificial Sequence: Synthetic oligonucleotide
gcgccggagagccccgcttcat

SEQ ID NO: 47243 - DNA, 23 bp, Artificial Sequence
  Description of Artificial Sequence: Synthetic oligonucleotide
cgccggagagccccgcttcatct

SEQ ID NO: 47244 - DNA, 24 bp, Artificial Sequence
  Description of Artificial Sequence: Synthetic oligonucleotide
gccggagagccccgcttcatctca

SEQ ID NO: 47245 - DNA, 25 bp, Artificial Sequence
  Description of Artificial Sequence: Synthetic oligonucleotide
ccggagagccccgcttcatctcagt

SEQ ID NO: 47246 - DNA, 26 bp, Artificial Sequence
  Description of Artificial Sequence: Synthetic oligonucleotide
agcagctgagagcctacctggaggga

SEQ ID NO: 47247 - DNA, 25 bp, Artificial Sequence
  Description of Artificial Sequence: Synthetic oligonucleotide
gcagctgagagcctacctggaggga

SEQ ID NO: 47248 - DNA, 26 bp, Artificial Sequence
  Description of Artificial Sequence: Synthetic oligonucleotide
cagctgagagcctacctggagggact

SEQ ID NO: 47249 - DNA, 27 bp, Artificial Sequence
  Description of Artificial Sequence: Synthetic oligonucleotide
agctgagagcctacctggagggactgt

SEQ ID NO: 47250 - DNA, 26 bp, Artificial Sequence
  Description of Artificial Sequence: Synthetic oligonucleotide
gctgagagcctacctggagggactgt

SEQ ID NO: 47251 - DNA, 26 bp, Artificial Sequence
  Description of Artificial Sequence: Synthetic oligonucleotide
ctgagagcctacctggagggactgtg

SEQ ID NO: 47252 - DNA, 26 bp, Artificial Sequence
  Description of Artificial Sequence: Synthetic oligonucleotide
tgagagcctacctggagggactgtgc

SEQ ID NO: 47253 - DNA, 25 bp, Artificial Sequence
  Description of Artificial Sequence: Synthetic oligonucleotide
gagagcctacctggagggactgtgc

SEQ ID NO: 47254 - DNA, 26 bp, Artificial Sequence
  Description of Artificial Sequence: Synthetic oligonucleotide
agagcctacctggagggactgtgcgt

SEQ ID NO: 47255 - DNA, 25 bp, Artificial Sequence
  Description of Artificial Sequence: Synthetic oligonucleotide
gagcctacctggagggactgtgcgt

SEQ ID NO: 47256 - DNA, 25 bp, Artificial Sequence
  Description of Artificial Sequence: Synthetic oligonucleotide
agcctacctggagggactgtgcgtg

SEQ ID NO: 47257 - DNA, 24 bp, Artificial Sequence
  Description of Artificial Sequence: Synthetic oligonucleotide
gcctacctggagggactgtgcgtg

SEQ ID NO: 47258 - DNA, 25 bp, Artificial Sequence
  Description of Artificial Sequence: Synthetic oligonucleotide
cctacctggagggactgtgcgtgga

SEQ ID NO: 47259 - DNA, 26 bp, Artificial Sequence
  Description of Artificial Sequence: Synthetic oligonucleotide
ctacctggagggactgtgcgtggagt

SEQ ID NO: 47260 - DNA, 26 bp, Artificial Sequence
  Description of Artificial Sequence: Synthetic oligonucleotide
tacctggagggactgtgcgtggagtg

SEQ ID NO: 47261 - DNA, 25 bp, Artificial Sequence
  Description of Artificial Sequence: Synthetic oligonucleotide
acctggagggactgtgcgtggagtg

SEQ ID NO: 47262 - DNA, 24 bp, Artificial Sequence
  Description of Artificial Sequence: Synthetic oligonucleotide
cctggagggactgtgcgtggagtg

SEQ ID NO: 47263 - DNA, 24 bp, Artificial Sequence
  Description of Artificial Sequence: Synthetic oligonucleotide
ctggagggactgtgcgtggagtgg

SEQ ID NO: 47264 - DNA, 25 bp, Artificial Sequence
  Description of Artificial Sequence: Synthetic oligonucleotide
tggagggactgtgcgtggagtggct

SEQ ID NO: 47265 - DNA, 24 bp, Artificial Sequence
  Description of Artificial Sequence: Synthetic oligonucleotide
ggagggactgtgcgtggagtggct

SEQ ID NO: 47266 - DNA, 24 bp, Artificial Sequence
  Description of Artificial Sequence: Synthetic oligonucleotide
gagggactgtgcgtggagtggctc

SEQ ID NO: 47267 - DNA, 24 bp, Artificial Sequence
  Description of Artificial Sequence: Synthetic oligonucleotide
agggactgtgcgtggagtggctcc

SEQ ID NO: 47268 - DNA, 23 bp, Artificial Sequence
  Description of Artificial Sequence: Synthetic oligonucleotide
gggactgtgcgtggagtggctcc

SEQ ID NO: 47269 - DNA, 23 bp, Artificial Sequence
  Description of Artificial Sequence: Synthetic oligonucleotide
ggactgtgcgtggagtggctccg

SEQ ID NO: 47270 - DNA, 24 bp, Artificial Sequence
  Description of Artificial Sequence: Synthetic oligonucleotide
gactgtgcgtggagtggctccgca

SEQ ID NO: 47271 - DNA, 27 bp, Artificial Sequence
  Description of Artificial Sequence: Synthetic oligonucleotide
actgtgcgtggagtggctccgcagata

SEQ ID NO: 47272 - DNA, 30 bp, Artificial Sequence
  Description of Artificial Sequence: Synthetic oligonucleotide
acgggtctcacaccttccagaggatgtatg

SEQ ID NO: 47273 - DNA, 29 bp, Artificial Sequence
  Description of Artificial Sequence: Synthetic oligonucleotide
cgggtctcacaccttccagaggatgtatg

SEQ ID NO: 47274 - DNA, 29 bp, Artificial Sequence
  Description of Artificial Sequence: Synthetic oligonucleotide
gggtctcacaccttccagaggatgtatgg

SEQ ID NO: 47275 - DNA, 29 bp, Artificial Sequence
  Description of Artificial Sequence: Synthetic oligonucleotide
ggtctcacaccttccagaggatgtatggc

SEQ ID NO: 47276 - DNA, 30 bp, Artificial Sequence
  Description of Artificial Sequence: Synthetic oligonucleotide
gtctcacaccttccagaggatgtatggctg

SEQ ID NO: 47277 - DNA, 28 bp, Artificial Sequence
  Description of Artificial Sequence: Synthetic oligonucleotide
accttccagaggatgtatggctgcgacc

SEQ ID NO: 47278 - DNA, 27 bp, Artificial Sequence
  Description of Artificial Sequence: Synthetic oligonucleotide
ccttccagaggatgtatggctgcgacc

SEQ ID NO: 47279 - DNA, 28 bp, Artificial Sequence
  Description of Artificial Sequence: Synthetic oligonucleotide
cttccagaggatgtatggctgcgacctg

SEQ ID NO: 47280 - DNA, 28 bp, Artificial Sequence
  Description of Artificial Sequence: Synthetic oligonucleotide
ttccagaggatgtatggctgcgacctgg

SEQ ID NO: 47281 - DNA, 20 bp, Artificial Sequence
  Description of Artificial Sequence: Synthetic oligonucleotide
gcccgtgcggcggagcagga

SEQ ID NO: 47282 - DNA, 21 bp, Artificial Sequence
  Description of Artificial Sequence: Synthetic oligonucleotide
cccgtgcggcggagcaggaca

SEQ ID NO: 47283 - DNA, 22 bp, Artificial Sequence
  Description of Artificial Sequence: Synthetic oligonucleotide
ccgtgcggcggagcaggacaga

SEQ ID NO: 47284 - DNA, 22 bp, Artificial Sequence
  Description of Artificial Sequence: Synthetic oligonucleotide
cgtgcggcggagcaggacagag

SEQ ID NO: 47285 - DNA, 22 bp, Artificial Sequence
  Description of Artificial Sequence: Synthetic oligonucleotide
gtgcggcggagcaggacagagc

SEQ ID NO: 47286 - DNA, 24 bp, Artificial Sequence
  Description of Artificial Sequence: Synthetic oligonucleotide
tgcggcggagcaggacagagccta

SEQ ID NO: 47287 - DNA, 23 bp, Artificial Sequence
  Description of Artificial Sequence: Synthetic oligonucleotide
gcggcggagcaggacagagccta

SEQ ID NO: 47288 - DNA, 23 bp, Artificial Sequence
  Description of Artificial Sequence: Synthetic oligonucleotide
cggcggagcaggacagagcctac

SEQ ID NO: 47289 - DNA, 25 bp, Artificial Sequence
  Description of Artificial Sequence: Synthetic oligonucleotide
aagaagacgctgcagcgcgcggaac

SEQ ID NO: 47290 - DNA, 24 bp, Artificial Sequence
  Description of Artificial Sequence: Synthetic oligonucleotide
agaagacgctgcagcgcgcggaac

SEQ ID NO: 47291 - DNA, 23 bp, Artificial Sequence
  Description of Artificial Sequence: Synthetic oligonucleotide
gaagacgctgcagcgcgcggaac

SEQ ID NO: 47292 - DNA, 23 bp, Artificial Sequence
  Description of Artificial Sequence: Synthetic oligonucleotide
aagacgctgcagcgcgcggaacc

SEQ ID NO: 47293 - DNA, 27 bp, Artificial Sequence
  Description of Artificial Sequence: Synthetic oligonucleotide
gcgcggctactataaccagagcgagga

SEQ ID NO: 47294 - DNA, 27 bp, Artificial Sequence
  Description of Artificial Sequence: Synthetic oligonucleotide
cgcggctactataaccagagcgaggac

SEQ ID NO: 47295 - DNA, 27 bp, Artificial Sequence
  Description of Artificial Sequence: Synthetic oligonucleotide
gcggctactataaccagagcgaggacg

SEQ ID NO: 47296 - DNA, 27 bp, Artificial Sequence
  Description of Artificial Sequence: Synthetic oligonucleotide
cggctactataaccagagcgaggacgg

SEQ ID NO: 47297 - DNA, 27 bp, Artificial Sequence
  Description of Artificial Sequence: Synthetic oligonucleotide
ggctactataaccagagcgaggacggg

SEQ ID NO: 47298 - DNA, 28 bp, Artificial Sequence
  Description of Artificial Sequence: Synthetic oligonucleotide
gctactataaccagagcgaggacgggtc

SEQ ID NO: 47299 - DNA, 29 bp, Artificial Sequence
  Description of Artificial Sequence: Synthetic oligonucleotide
ctactataaccagagcgaggacgggtctc

SEQ ID NO: 47300 - DNA, 30 bp, Artificial Sequence
  Description of Artificial Sequence: Synthetic oligonucleotide
tactataaccagagcgaggacgggtctcac

SEQ ID NO: 47301 - DNA, 29 bp, Artificial Sequence
  Description of Artificial Sequence: Synthetic oligonucleotide
actataaccagagcgaggacgggtctcac

SEQ ID NO: 47302 - DNA, 28 bp, Artificial Sequence
  Description of Artificial Sequence: Synthetic oligonucleotide
ctataaccagagcgaggacgggtctcac

SEQ ID NO: 47303 - DNA, 29 bp, Artificial Sequence
  Description of Artificial Sequence: Synthetic oligonucleotide
tataaccagagcgaggacgggtctcacac

SEQ ID NO: 47304 - DNA, 28 bp, Artificial Sequence
  Description of Artificial Sequence: Synthetic oligonucleotide
ataaccagagcgaggacgggtctcacac

SEQ ID NO: 47305 - DNA, 27 bp, Artificial Sequence
  Description of Artificial Sequence: Synthetic oligonucleotide
taaccagagcgaggacgggtctcacac

SEQ ID NO: 47306 - DNA, 29 bp, Artificial Sequence
  Description of Artificial Sequence: Synthetic oligonucleotide
acgggtctcacaccttccagaggatgtac

SEQ ID NO: 47307 - DNA, 27 bp, Artificial Sequence
  Description of Artificial Sequence: Synthetic oligonucleotide
cttccagaggatgtacggctgcgacct

SEQ ID NO: 47308 - DNA, 27 bp, Artificial Sequence
  Description of Artificial Sequence: Synthetic oligonucleotide
ttccagaggatgtacggctgcgacctg

SEQ ID NO: 47309 - DNA, 25 bp, Artificial Sequence
  Description of Artificial Sequence: Synthetic oligonucleotide
gtgcggcggagcaggacagagctta

SEQ ID NO: 47310 - DNA, 25 bp, Artificial Sequence
  Description of Artificial Sequence: Synthetic oligonucleotide
tgcggcggagcaggacagagcttac

SEQ ID NO: 47311 - DNA, 24 bp, Artificial Sequence
  Description of Artificial Sequence: Synthetic oligonucleotide
gcggcggagcaggacagagcttac

SEQ ID NO: 47312 - DNA, 25 bp, Artificial Sequence
  Description of Artificial Sequence: Synthetic oligonucleotide
cggcggagcaggacagagcttacct

SEQ ID NO: 47313 - DNA, 27 bp, Artificial Sequence
  Description of Artificial Sequence: Synthetic oligonucleotide
agcaggacagagcttacctggagggca

SEQ ID NO: 47314 - DNA, 26 bp, Artificial Sequence
  Description of Artificial Sequence: Synthetic oligonucleotide
gcaggacagagcttacctggagggca

SEQ ID NO: 47315 - DNA, 26 bp, Artificial Sequence
  Description of Artificial Sequence: Synthetic oligonucleotide
caggacagagcttacctggagggcac

SEQ ID NO: 47316 - DNA, 27 bp, Artificial Sequence
  Description of Artificial Sequence: Synthetic oligonucleotide
aggacagagcttacctggagggcacgt

SEQ ID NO: 47317 - DNA, 26 bp, Artificial Sequence
  Description of Artificial Sequence: Synthetic oligonucleotide
ggacagagcttacctggagggcacgt

SEQ ID NO: 47318 - DNA, 26 bp, Artificial Sequence
  Description of Artificial Sequence: Synthetic oligonucleotide
gacagagcttacctggagggcacgtg

SEQ ID NO: 47319 - DNA, 26 bp, Artificial Sequence
  Description of Artificial Sequence: Synthetic oligonucleotide
acagagcttacctggagggcacgtgc

SEQ ID NO: 47320 - DNA, 25 bp, Artificial Sequence
  Description of Artificial Sequence: Synthetic oligonucleotide
cagagcttacctggagggcacgtgc

SEQ ID NO: 47321 - DNA, 27 bp, Artificial Sequence
  Description of Artificial Sequence: Synthetic oligonucleotide
gaggacgggtctcacaccctccagaat

SEQ ID NO: 47322 - DNA, 29 bp, Artificial Sequence
  Description of Artificial Sequence: Synthetic oligonucleotide
aggacgggtctcacaccctccagaatatg

SEQ ID NO: 47323 - DNA, 28 bp, Artificial Sequence
  Description of Artificial Sequence: Synthetic oligonucleotide
ggacgggtctcacaccctccagaatatg

SEQ ID NO: 47324 - DNA, 31 bp, Artificial Sequence
  Description of Artificial Sequence: Synthetic oligonucleotide
gacgggtctcacaccctccagaatatgtatg

SEQ ID NO: 47325 - DNA, 31 bp, Artificial Sequence
  Description of Artificial Sequence: Synthetic oligonucleotide
acgggtctcacaccctccagaatatgtatgg

SEQ ID NO: 47326 - DNA, 30 bp, Artificial Sequence
  Description of Artificial Sequence: Synthetic oligonucleotide
acaccctccagaatatgtatggctgcgacc

SEQ ID NO: 47327 - DNA, 29 bp, Artificial Sequence
  Description of Artificial Sequence: Synthetic oligonucleotide
caccctccagaatatgtatggctgcgacc

SEQ ID NO: 47328 - DNA, 30 bp, Artificial Sequence
  Description of Artificial Sequence: Synthetic oligonucleotide
accctccagaatatgtatggctgcgacctg

SEQ ID NO: 47329 - DNA, 29 bp, Artificial Sequence
  Description of Artificial Sequence: Synthetic oligonucleotide
ccctccagaatatgtatggctgcgacctg

SEQ ID NO: 47330 - DNA, 29 bp, Artificial Sequence
  Description of Artificial Sequence: Synthetic oligonucleotide
cctccagaatatgtatggctgcgacctgg

SEQ ID NO: 47331 - DNA, 29 bp, Artificial Sequence
  Description of Artificial Sequence: Synthetic oligonucleotide
ctccagaatatgtatggctgcgacctggg

SEQ ID NO: 47332 - DNA, 29 bp, Artificial Sequence
  Description of Artificial Sequence: Synthetic oligonucleotide
tccagaatatgtatggctgcgacctgggg

SEQ ID NO: 47333 - DNA, 28 bp, Artificial Sequence
  Description of Artificial Sequence: Synthetic oligonucleotide
ccagaatatgtatggctgcgacctgggg

SEQ ID NO: 47334 - DNA, 28 bp, Artificial Sequence
  Description of Artificial Sequence: Synthetic oligonucleotide
cagaatatgtatggctgcgacctggggc

SEQ ID NO: 47335 - DNA, 28 bp, Artificial Sequence
  Description of Artificial Sequence: Synthetic oligonucleotide
agaatatgtatggctgcgacctggggcc

SEQ ID NO: 47336 - DNA, 27 bp, Artificial Sequence
  Description of Artificial Sequence: Synthetic oligonucleotide
gaatatgtatggctgcgacctggggcc

SEQ ID NO: 47337 - DNA, 27 bp, Artificial Sequence
  Description of Artificial Sequence: Synthetic oligonucleotide
aatatgtatggctgcgacctggggccc

SEQ ID NO: 47338 - DNA, 26 bp, Artificial Sequence
  Description of Artificial Sequence: Synthetic oligonucleotide
atatgtatggctgcgacctggggccc

SEQ ID NO: 47339 - DNA, 25 bp, Artificial Sequence
  Description of Artificial Sequence: Synthetic oligonucleotide
tatgtatggctgcgacctggggccc

SEQ ID NO: 47340 - DNA, 28 bp, Artificial Sequence
  Description of Artificial Sequence: Synthetic oligonucleotide
tgtccttggagctgtggtcaccgctaag

SEQ ID NO: 47341 - DNA, 27 bp, Artificial Sequence
  Description of Artificial Sequence: Synthetic oligonucleotide
gtccttggagctgtggtcaccgctaag

SEQ ID NO: 47342 - DNA, 29 bp, Artificial Sequence
  Description of Artificial Sequence: Synthetic oligonucleotide
tccttggagctgtggtcaccgctaagatg

SEQ ID NO: 47343 - DNA, 28 bp, Artificial Sequence
  Description of Artificial Sequence: Synthetic oligonucleotide
ccttggagctgtggtcaccgctaagatg

SEQ ID NO: 47344 - DNA, 29 bp, Artificial Sequence
  Description of Artificial Sequence: Synthetic oligonucleotide
cttggagctgtggtcaccgctaagatgtg

SEQ ID NO: 47345 - DNA, 31 bp, Artificial Sequence
  Description of Artificial Sequence: Synthetic oligonucleotide
ttggagctgtggtcaccgctaagatgtgtag

SEQ ID NO: 47346 - DNA, 30 bp, Artificial Sequence
  Description of Artificial Sequence: Synthetic oligonucleotide
tggagctgtggtcaccgctaagatgtgtag

SEQ ID NO: 47347 - DNA, 29 bp, Artificial Sequence
  Description of Artificial Sequence: Synthetic oligonucleotide
ggagctgtggtcaccgctaagatgtgtag

SEQ ID NO: 47348 - DNA, 29 bp, Artificial Sequence
  Description of Artificial Sequence: Synthetic oligonucleotide
gagctgtggtcaccgctaagatgtgtagg

SEQ ID NO: 47349 - DNA, 30 bp, Artificial Sequence
  Description of Artificial Sequence: Synthetic oligonucleotide
agctgtggtcaccgctaagatgtgtaggag

SEQ ID NO: 47350 - DNA, 29 bp, Artificial Sequence
  Description of Artificial Sequence: Synthetic oligonucleotide
gctgtggtcaccgctaagatgtgtaggag

SEQ ID NO: 47351 - DNA, 29 bp, Artificial Sequence
  Description of Artificial Sequence: Synthetic oligonucleotide
ctgtggtcaccgctaagatgtgtaggagg

SEQ ID NO: 47352 - DNA, 31 bp, Artificial Sequence
  Description of Artificial Sequence: Synthetic oligonucleotide
tgtggtcaccgctaagatgtgtaggaggaag

SEQ ID NO: 47353 - DNA, 30 bp, Artificial Sequence
  Description of Artificial Sequence: Synthetic oligonucleotide
gtggtcaccgctaagatgtgtaggaggaag

SEQ ID NO: 47354 - DNA, 31 bp, Artificial Sequence
  Description of Artificial Sequence: Synthetic oligonucleotide
tggtcaccgctaagatgtgtaggaggaagag

SEQ ID NO: 47355 - DNA, 30 bp, Artificial Sequence
  Description of Artificial Sequence: Synthetic oligonucleotide
ggtcaccgctaagatgtgtaggaggaagag

SEQ ID NO: 47356 - DNA, 30 bp, Artificial Sequence
  Description of Artificial Sequence: Synthetic oligonucleotide
gtcaccgctaagatgtgtaggaggaagagc

SEQ ID NO: 47357 - DNA, 31 bp, Artificial Sequence
  Description of Artificial Sequence: Synthetic oligonucleotide
tcaccgctaagatgtgtaggaggaagagctc

SEQ ID NO: 47358 - DNA, 30 bp, Artificial Sequence
  Description of Artificial Sequence: Synthetic oligonucleotide
caccgctaagatgtgtaggaggaagagctc

SEQ ID NO: 47359 - DNA, 31 bp, Artificial Sequence
  Description of Artificial Sequence: Synthetic oligonucleotide
accgctaagatgtgtaggaggaagagctcag

SEQ ID NO: 47360 - DNA, 30 bp, Artificial Sequence
  Description of Artificial Sequence: Synthetic oligonucleotide
ccgctaagatgtgtaggaggaagagctcag

SEQ ID NO: 47361 - DNA, 30 bp, Artificial Sequence
  Description of Artificial Sequence: Synthetic oligonucleotide
cgctaagatgtgtaggaggaagagctcagg

SEQ ID NO: 47362 - DNA, 31 bp, Artificial Sequence
  Description of Artificial Sequence: Synthetic oligonucleotide
gctaagatgtgtaggaggaagagctcaggtg

SEQ ID NO: 47363 - DNA, 31 bp, Artificial Sequence
  Description of Artificial Sequence: Synthetic oligonucleotide
ctaagatgtgtaggaggaagagctcaggtgg

SEQ ID NO: 47364 - DNA, 35 bp, Artificial Sequence
  Description of Artificial Sequence: Synthetic oligonucleotide
taagatgtgtaggaggaagagctcaggtggaaaag

SEQ ID NO: 47365 - DNA, 34 bp, Artificial Sequence
  Description of Artificial Sequence: Synthetic oligonucleotide
aagatgtgtaggaggaagagctcaggtggaaaag

SEQ ID NO: 47366 - DNA, 33 bp, Artificial Sequence
  Description of Artificial Sequence: Synthetic oligonucleotide
agatgtgtaggaggaagagctcaggtggaaaag

SEQ ID NO: 47367 - DNA, 29 bp, Artificial Sequence
  Description of Artificial Sequence: Synthetic oligonucleotide
tggaaaaggagggagctgctctcaggttg

SEQ ID NO: 47368 - DNA, 28 bp, Artificial Sequence
  Description of Artificial Sequence: Synthetic oligonucleotide
ggaaaaggagggagctgctctcaggttg

SEQ ID NO: 47369 - DNA, 28 bp, Artificial Sequence
  Description of Artificial Sequence: Synthetic oligonucleotide
gaaaaggagggagctgctctcaggttgc

SEQ ID NO: 47370 - DNA, 28 bp, Artificial Sequence
  Description of Artificial Sequence: Synthetic oligonucleotide
aaaaggagggagctgctctcaggttgcg

SEQ ID NO: 47371 - DNA, 27 bp, Artificial Sequence
  Description of Artificial Sequence: Synthetic oligonucleotide
aaaggagggagctgctctcaggttgcg

SEQ ID NO: 47372 - DNA, 27 bp, Artificial Sequence
  Description of Artificial Sequence: Synthetic oligonucleotide
aaggagggagctgctctcaggttgcgt

SEQ ID NO: 47373 - DNA, 26 bp, Artificial Sequence
  Description of Artificial Sequence: Synthetic oligonucleotide
aggagggagctgctctcaggttgcgt

SEQ ID NO: 47374 - DNA, 25 bp, Artificial Sequence
  Description of Artificial Sequence: Synthetic oligonucleotide
ggagggagctgctctcaggttgcgt

SEQ ID NO: 47375 - DNA, 25 bp, Artificial Sequence
  Description of Artificial Sequence: Synthetic oligonucleotide
gagggagctgctctcaggttgcgtg

SEQ ID NO: 47376 - DNA, 26 bp, Artificial Sequence
  Description of Artificial Sequence: Synthetic oligonucleotide
agggagctgctctcaggttgcgtgca

SEQ ID NO: 47377 - DNA, 25 bp, Artificial Sequence
  Description of Artificial Sequence: Synthetic oligonucleotide
gggagctgctctcaggttgcgtgca

SEQ ID NO: 47378 - DNA, 25 bp, Artificial Sequence
  Description of Artificial Sequence: Synthetic oligonucleotide
ggagctgctctcaggttgcgtgcag

SEQ ID NO: 47379 - DNA, 27 bp, Artificial Sequence
  Description of Artificial Sequence: Synthetic oligonucleotide
gagctgctctcaggttgcgtgcagcaa

SEQ ID NO: 47380 - DNA, 27 bp, Artificial Sequence
  Description of Artificial Sequence: Synthetic oligonucleotide
agctgctctcaggttgcgtgcagcaac

SEQ ID NO: 47381 - DNA, 27 bp, Artificial Sequence
  Description of Artificial Sequence: Synthetic oligonucleotide
gctgctctcaggttgcgtgcagcaaca

SEQ ID NO: 47382 - DNA, 27 bp, Artificial Sequence
  Description of Artificial Sequence: Synthetic oligonucleotide
ctgctctcaggttgcgtgcagcaacag

SEQ ID NO: 47383 - DNA, 28 bp, Artificial Sequence
  Description of Artificial Sequence: Synthetic oligonucleotide
tgctctcaggttgcgtgcagcaacagtg

SEQ ID NO: 47384 - DNA, 27 bp, Artificial Sequence
  Description of Artificial Sequence: Synthetic oligonucleotide
gctctcaggttgcgtgcagcaacagtg

SEQ ID NO: 47385 - DNA, 27 bp, Artificial Sequence
  Description of Artificial Sequence: Synthetic oligonucleotide
ctctcaggttgcgtgcagcaacagtgc

SEQ ID NO: 47386 - DNA, 27 bp, Artificial Sequence
  Description of Artificial Sequence: Synthetic oligonucleotide
tctcaggttgcgtgcagcaacagtgcc

SEQ ID NO: 47387 - DNA, 26 bp, Artificial Sequence
  Description of Artificial Sequence: Synthetic oligonucleotide
ctcaggttgcgtgcagcaacagtgcc

SEQ ID NO: 47388 - DNA, 27 bp, Artificial Sequence
  Description of Artificial Sequence: Synthetic oligonucleotide
tcaggttgcgtgcagcaacagtgccca

SEQ ID NO: 47389 - DNA, 26 bp, Artificial Sequence
  Description of Artificial Sequence: Synthetic oligonucleotide
caggttgcgtgcagcaacagtgccca

SEQ ID NO: 47390 - DNA, 26 bp, Artificial Sequence
  Description of Artificial Sequence: Synthetic oligonucleotide
aggttgcgtgcagcaacagtgcccag

SEQ ID NO: 47391 - DNA, 25 bp, Artificial Sequence
  Description of Artificial Sequence: Synthetic oligonucleotide
ggttgcgtgcagcaacagtgcccag

SEQ ID NO: 47392 - DNA, 25 bp, Artificial Sequence
  Description of Artificial Sequence: Synthetic oligonucleotide
gttgcgtgcagcaacagtgcccagg

SEQ ID NO: 47393 - DNA, 25 bp, Artificial Sequence
  Description of Artificial Sequence: Synthetic oligonucleotide
ttgcgtgcagcaacagtgcccaggg

SEQ ID NO: 47394 - DNA, 29 bp, Artificial Sequence
  Description of Artificial Sequence: Synthetic oligonucleotide
gacgggtctcacatcatccagaggatgtc

SEQ ID NO: 47395 - DNA, 30 bp, Artificial Sequence
  Description of Artificial Sequence: Synthetic oligonucleotide
acgggtctcacatcatccagaggatgtctg

SEQ ID NO: 47396 - DNA, 27 bp, Artificial Sequence
  Description of Artificial Sequence: Synthetic oligonucleotide
ccagtccgcctacgacggcaaggattt

SEQ ID NO: 47397 - DNA, 27 bp, Artificial Sequence
  Description of Artificial Sequence: Synthetic oligonucleotide
cagtccgcctacgacggcaaggatttc

SEQ ID NO: 47398 - DNA, 29 bp, Artificial Sequence
  Description of Artificial Sequence: Synthetic oligonucleotide
agtccgcctacgacggcaaggatttcatc

SEQ ID NO: 47399 - DNA, 28 bp, Artificial Sequence
  Description of Artificial Sequence: Synthetic oligonucleotide
gtccgcctacgacggcaaggatttcatc

SEQ ID NO: 47400 - DNA, 28 bp, Artificial Sequence
  Description of Artificial Sequence: Synthetic oligonucleotide
tccgcctacgacggcaaggatttcatcg

SEQ ID NO: 47401 - DNA, 27 bp, Artificial Sequence
  Description of Artificial Sequence: Synthetic oligonucleotide
ccgcctacgacggcaaggatttcatcg

SEQ ID NO: 47402 - DNA, 27 bp, Artificial Sequence
  Description of Artificial Sequence: Synthetic oligonucleotide
cgcctacgacggcaaggatttcatcgc

SEQ ID NO: 47403 - DNA, 27 bp, Artificial Sequence
  Description of Artificial Sequence: Synthetic oligonucleotide
gcctacgacggcaaggatttcatcgcc

SEQ ID NO: 47404 - DNA, 27 bp, Artificial Sequence
  Description of Artificial Sequence: Synthetic oligonucleotide
cctacgacggcaaggatttcatcgccc

SEQ ID NO: 47405 - DNA, 28 bp, Artificial Sequence
  Description of Artificial Sequence: Synthetic oligonucleotide
ctacgacggcaaggatttcatcgccctg

SEQ ID NO: 47406 - DNA, 30 bp, Artificial Sequence
  Description of Artificial Sequence: Synthetic oligonucleotide
tacgacggcaaggatttcatcgccctgaac

SEQ ID NO: 47407 - DNA, 29 bp, Artificial Sequence
  Description of Artificial Sequence: Synthetic oligonucleotide
acgacggcaaggatttcatcgccctgaac

SEQ ID NO: 47408 - DNA, 28 bp, Artificial Sequence
  Description of Artificial Sequence: Synthetic oligonucleotide
cgacggcaaggatttcatcgccctgaac

SEQ ID NO: 47409 - DNA, 28 bp, Artificial Sequence
  Description of Artificial Sequence: Synthetic oligonucleotide
gacggcaaggatttcatcgccctgaacg

SEQ ID NO: 47410 - DNA, 29 bp, Artificial Sequence
  Description of Artificial Sequence: Synthetic oligonucleotide
acggcaaggatttcatcgccctgaacgag

SEQ ID NO: 47411 - DNA, 28 bp, Artificial Sequence
  Description of Artificial Sequence: Synthetic oligonucleotide
cggcaaggatttcatcgccctgaacgag

SEQ ID NO: 47412 - DNA, 28 bp, Artificial Sequence
  Description of Artificial Sequence: Synthetic oligonucleotide
ggcaaggatttcatcgccctgaacgagg

SEQ ID NO: 47413 - DNA, 29 bp, Artificial Sequence
  Description of Artificial Sequence: Synthetic oligonucleotide
gcaaggatttcatcgccctgaacgaggac

SEQ ID NO: 47414 - DNA, 29 bp, Artificial Sequence
  Description of Artificial Sequence: Synthetic oligonucleotide
caaggatttcatcgccctgaacgaggacc

SEQ ID NO: 47415 - DNA, 30 bp, Artificial Sequence
  Description of Artificial Sequence: Synthetic oligonucleotide
aaggatttcatcgccctgaacgaggacctg

SEQ ID NO: 47416 - DNA, 29 bp, Artificial Sequence
  Description of Artificial Sequence: Synthetic oligonucleotide
aggatttcatcgccctgaacgaggacctg

SEQ ID NO: 47417 - DNA, 28 bp, Artificial Sequence
  Description of Artificial Sequence: Synthetic oligonucleotide
ggatttcatcgccctgaacgaggacctg

SEQ ID NO: 47418 - DNA, 28 bp, Artificial Sequence
  Description of Artificial Sequence: Synthetic oligonucleotide
gatttcatcgccctgaacgaggacctgc

SEQ ID NO: 47419 - DNA, 28 bp, Artificial Sequence
  Description of Artificial Sequence: Synthetic oligonucleotide
atttcatcgccctgaacgaggacctgcg

SEQ ID NO: 47420 - DNA, 27 bp, Artificial Sequence
  Description of Artificial Sequence: Synthetic oligonucleotide
tttcatcgccctgaacgaggacctgcg

SEQ ID NO: 47421 - DNA, 26 bp, Artificial Sequence
  Description of Artificial Sequence: Synthetic oligonucleotide
ttcatcgccctgaacgaggacctgcg

SEQ ID NO: 47422 - DNA, 25 bp, Artificial Sequence
  Description of Artificial Sequence: Synthetic oligonucleotide
tcatcgccctgaacgaggacctgcg

SEQ ID NO: 47423 - DNA, 30 bp, Artificial Sequence
  Description of Artificial Sequence: Synthetic oligonucleotide
ctcccactccatgaggtatttcgacacctc

SEQ ID NO: 47424 - DNA, 30 bp, Artificial Sequence
  Description of Artificial Sequence: Synthetic oligonucleotide
tcccactccatgaggtatttcgacacctcc

SEQ ID NO: 47425 - DNA, 29 bp, Artificial Sequence
  Description of Artificial Sequence: Synthetic oligonucleotide
cccactccatgaggtatttcgacacctcc

SEQ ID NO: 47426 - DNA, 29 bp, Artificial Sequence
  Description of Artificial Sequence: Synthetic oligonucleotide
ccactccatgaggtatttcgacacctccg

SEQ ID NO: 47427 - DNA, 30 bp, Artificial Sequence
  Description of Artificial Sequence: Synthetic oligonucleotide
cactccatgaggtatttcgacacctccgtg

SEQ ID NO: 47428 - DNA, 31 bp, Artificial Sequence
  Description of Artificial Sequence: Synthetic oligonucleotide
actccatgaggtatttcgacacctccgtgtc

SEQ ID NO: 47429 - DNA, 30 bp, Artificial Sequence
  Description of Artificial Sequence: Synthetic oligonucleotide
ctccatgaggtatttcgacacctccgtgtc

SEQ ID NO: 47430 - DNA, 30 bp, Artificial Sequence
  Description of Artificial Sequence: Synthetic oligonucleotide
tccatgaggtatttcgacacctccgtgtcc

SEQ ID NO: 47431 - DNA, 29 bp, Artificial Sequence
  Description of Artificial Sequence: Synthetic oligonucleotide
ccatgaggtatttcgacacctccgtgtcc

SEQ ID NO: 47432 - DNA, 29 bp, Artificial Sequence
  Description of Artificial Sequence: Synthetic oligonucleotide
catgaggtatttcgacacctccgtgtccc

SEQ ID NO: 47433 - DNA, 29 bp, Artificial Sequence
  Description of Artificial Sequence: Synthetic oligonucleotide
atgaggtatttcgacacctccgtgtcccg

SEQ ID NO: 47434 - DNA, 28 bp, Artificial Sequence
  Description of Artificial Sequence: Synthetic oligonucleotide
tgaggtatttcgacacctccgtgtcccg

SEQ ID NO: 47435 - DNA, 27 bp, Artificial Sequence
  Description of Artificial Sequence: Synthetic oligonucleotide
gaggtatttcgacacctccgtgtcccg

SEQ ID NO: 47436 - DNA, 27 bp, Artificial Sequence
  Description of Artificial Sequence: Synthetic oligonucleotide
aggtatttcgacacctccgtgtcccgg

SEQ ID NO: 47437 - DNA, 26 bp, Artificial Sequence
  Description of Artificial Sequence: Synthetic oligonucleotide
ggtatttcgacacctccgtgtcccgg

SEQ ID NO: 47438 - DNA, 26 bp, Artificial Sequence
  Description of Artificial Sequence: Synthetic oligonucleotide
gtatttcgacacctccgtgtcccggc

SEQ ID NO: 47439 - DNA, 26 bp, Artificial Sequence
  Description of Artificial Sequence: Synthetic oligonucleotide
tatttcgacacctccgtgtcccggcc

SEQ ID NO: 47440 - DNA, 25 bp, Artificial Sequence
  Description of Artificial Sequence: Synthetic oligonucleotide
atttcgacacctccgtgtcccggcc

SEQ ID NO: 47441 - DNA, 24 bp, Artificial Sequence
  Description of Artificial Sequence: Synthetic oligonucleotide
tttcgacacctccgtgtcccggcc

SEQ ID NO: 47442 - DNA, 23 bp, Artificial Sequence
  Description of Artificial Sequence: Synthetic oligonucleotide
ttcgacacctccgtgtcccggcc

SEQ ID NO: 47443 - DNA, 22 bp, Artificial Sequence
  Description of Artificial Sequence: Synthetic oligonucleotide
tcgacacctccgtgtcccggcc

SEQ ID NO: 47444 - DNA, 21 bp, Artificial Sequence
  Description of Artificial Sequence: Synthetic oligonucleotide
cgacacctccgtgtcccggcc

SEQ ID NO: 47445 - DNA, 21 bp, Artificial Sequence
  Description of Artificial Sequence: Synthetic oligonucleotide
gacacctccgtgtcccggccc

SEQ ID NO: 47446 - DNA, 26 bp, Artificial Sequence
  Description of Artificial Sequence: Synthetic oligonucleotide
ggctactacaaccagagcgaggacgc

SEQ ID NO: 47447 - DNA, 27 bp, Artificial Sequence
  Description of Artificial Sequence: Synthetic oligonucleotide
gctactacaaccagagcgaggacgcgt

SEQ ID NO: 47448 - DNA, 27 bp, Artificial Sequence
  Description of Artificial Sequence: Synthetic oligonucleotide
ctactacaaccagagcgaggacgcgtc

SEQ ID NO: 47449 - DNA, 28 bp, Artificial Sequence
  Description of Artificial Sequence: Synthetic oligonucleotide
tactacaaccagagcgaggacgcgtctc

SEQ ID NO: 47450 - DNA, 27 bp, Artificial Sequence
  Description of Artificial Sequence: Synthetic oligonucleotide
actacaaccagagcgaggacgcgtctc

SEQ ID NO: 47451 - DNA, 27 bp, Artificial Sequence
  Description of Artificial Sequence: Synthetic oligonucleotide
ctacaaccagagcgaggacgcgtctca

SEQ ID NO: 47452 - DNA, 27 bp, Artificial Sequence
  Description of Artificial Sequence: Synthetic oligonucleotide
tacaaccagagcgaggacgcgtctcac

SEQ ID NO: 47453 - DNA, 27 bp, Artificial Sequence
  Description of Artificial Sequence: Synthetic oligonucleotide
acaaccagagcgaggacgcgtctcaca

SEQ ID NO: 47454 - DNA, 26 bp, Artificial Sequence
  Description of Artificial Sequence: Synthetic oligonucleotide
caaccagagcgaggacgcgtctcaca

SEQ ID NO: 47455 - DNA, 26 bp, Artificial Sequence
  Description of Artificial Sequence: Synthetic oligonucleotide
aaccagagcgaggacgcgtctcacac

SEQ ID NO: 47456 - DNA, 25 bp, Artificial Sequence
  Description of Artificial Sequence: Synthetic oligonucleotide
accagagcgaggacgcgtctcacac

SEQ ID NO: 47457 - DNA, 24 bp, Artificial Sequence
  Description of Artificial Sequence: Synthetic oligonucleotide
ccagagcgaggacgcgtctcacac

SEQ ID NO: 47458 - DNA, 24 bp, Artificial Sequence
  Description of Artificial Sequence: Synthetic oligonucleotide
cagagcgaggacgcgtctcacacc

SEQ ID NO: 47459 - DNA, 25 bp, Artificial Sequence
  Description of Artificial Sequence: Synthetic oligonucleotide
agagcgaggacgcgtctcacaccct

SEQ ID NO: 47460 - DNA, 24 bp, Artificial Sequence
  Description of Artificial Sequence: Synthetic oligonucleotide
gagcgaggacgcgtctcacaccct

SEQ ID NO: 47461 - DNA, 24 bp, Artificial Sequence
  Description of Artificial Sequence: Synthetic oligonucleotide
agcgaggacgcgtctcacaccctc

SEQ ID NO: 47462 - DNA, 23 bp, Artificial Sequence
  Description of Artificial Sequence: Synthetic oligonucleotide
gcgaggacgcgtctcacaccctc

SEQ ID NO: 47463 - DNA, 24 bp, Artificial Sequence
  Description of Artificial Sequence: Synthetic oligonucleotide
cgaggacgcgtctcacaccctcca

SEQ ID NO: 47464 - DNA, 25 bp, Artificial Sequence
  Description of Artificial Sequence: Synthetic oligonucleotide
gaggacgcgtctcacaccctccaga

SEQ ID NO: 47465 - DNA, 25 bp, Artificial Sequence
  Description of Artificial Sequence: Synthetic oligonucleotide
aggacgcgtctcacaccctccagag

SEQ ID NO: 47466 - DNA, 24 bp, Artificial Sequence
  Description of Artificial Sequence: Synthetic oligonucleotide
ggacgcgtctcacaccctccagag

SEQ ID NO: 47467 - DNA, 26 bp, Artificial Sequence
  Description of Artificial Sequence: Synthetic oligonucleotide
gacgcgtctcacaccctccagaggat

SEQ ID NO: 47468 - DNA, 27 bp, Artificial Sequence
  Description of Artificial Sequence: Synthetic oligonucleotide
acgcgtctcacaccctccagaggatgt

SEQ ID NO: 47469 - DNA, 28 bp, Artificial Sequence
  Description of Artificial Sequence: Synthetic oligonucleotide
gcgtctcacaccctccagaggatgtatg

SEQ ID NO: 47470 - DNA, 28 bp, Artificial Sequence
  Description of Artificial Sequence: Synthetic oligonucleotide
cgtctcacaccctccagaggatgtatgg

SEQ ID NO: 47471 - DNA, 24 bp, Artificial Sequence
  Description of Artificial Sequence: Synthetic oligonucleotide
cgcgggtatgaccagtccgcctag

SEQ ID NO: 47472 - DNA, 25 bp, Artificial Sequence
  Description of Artificial Sequence: Synthetic oligonucleotide
gcgggtatgaccagtccgcctagga

SEQ ID NO: 47473 - DNA, 25 bp, Artificial Sequence
  Description of Artificial Sequence: Synthetic oligonucleotide
cgggtatgaccagtccgcctaggac

SEQ ID NO: 47474 - DNA, 25 bp, Artificial Sequence
  Description of Artificial Sequence: Synthetic oligonucleotide
gggtatgaccagtccgcctaggacg

SEQ ID NO: 47475 - DNA, 25 bp, Artificial Sequence
  Description of Artificial Sequence: Synthetic oligonucleotide
ggtatgaccagtccgcctaggacgg

SEQ ID NO: 47476 - DNA, 27 bp, Artificial Sequence
  Description of Artificial Sequence: Synthetic oligonucleotide
gtatgaccagtccgcctaggacggcaa

SEQ ID NO: 47477 - DNA, 27 bp, Artificial Sequence
  Description of Artificial Sequence: Synthetic oligonucleotide
tatgaccagtccgcctaggacggcaag

SEQ ID NO: 47478 - DNA, 26 bp, Artificial Sequence
  Description of Artificial Sequence: Synthetic oligonucleotide
atgaccagtccgcctaggacggcaag

SEQ ID NO: 47479 - DNA, 25 bp, Artificial Sequence
  Description of Artificial Sequence: Synthetic oligonucleotide
tgaccagtccgcctaggacggcaag

SEQ ID NO: 47480 - DNA, 24 bp, Artificial Sequence
  Description of Artificial Sequence: Synthetic oligonucleotide
gaccagtccgcctaggacggcaag

SEQ ID NO: 47481 - DNA, 27 bp, Artificial Sequence
  Description of Artificial Sequence: Synthetic oligonucleotide
accagtccgcctaggacggcaaggatt

SEQ ID NO: 47482 - DNA, 27 bp, Artificial Sequence
  Description of Artificial Sequence: Synthetic oligonucleotide
ccagtccgcctaggacggcaaggatta

SEQ ID NO: 47483 - DNA, 27 bp, Artificial Sequence
  Description of Artificial Sequence: Synthetic oligonucleotide
cagtccgcctaggacggcaaggattac

SEQ ID NO: 47484 - DNA, 29 bp, Artificial Sequence
  Description of Artificial Sequence: Synthetic oligonucleotide
agtccgcctaggacggcaaggattacatc

SEQ ID NO: 47485 - DNA, 28 bp, Artificial Sequence
  Description of Artificial Sequence: Synthetic oligonucleotide
gtccgcctaggacggcaaggattacatc

SEQ ID NO: 47486 - DNA, 28 bp, Artificial Sequence
  Description of Artificial Sequence: Synthetic oligonucleotide
tccgcctaggacggcaaggattacatcg

SEQ ID NO: 47487 - DNA, 27 bp, Artificial Sequence
  Description of Artificial Sequence: Synthetic oligonucleotide
ccgcctaggacggcaaggattacatcg

SEQ ID NO: 47488 - DNA, 27 bp, Artificial Sequence
  Description of Artificial Sequence: Synthetic oligonucleotide
cgcctaggacggcaaggattacatcgc

SEQ ID NO: 47489 - DNA, 27 bp, Artificial Sequence
  Description of Artificial Sequence: Synthetic oligonucleotide
gcctaggacggcaaggattacatcgcc

SEQ ID NO: 47490 - DNA, 27 bp, Artificial Sequence
  Description of Artificial Sequence: Synthetic oligonucleotide
cctaggacggcaaggattacatcgccc

SEQ ID NO: 47491 - DNA, 28 bp, Artificial Sequence
  Description of Artificial Sequence: Synthetic oligonucleotide
ctaggacggcaaggattacatcgccctg

SEQ ID NO: 47492 - DNA, 30 bp, Artificial Sequence
  Description of Artificial Sequence: Synthetic oligonucleotide
taggacggcaaggattacatcgccctgaac

SEQ ID NO: 47493 - DNA, 29 bp, Artificial Sequence
  Description of Artificial Sequence: Synthetic oligonucleotide
aggacggcaaggattacatcgccctgaac

SEQ ID NO: 47494 - DNA, 28 bp, Artificial Sequence
  Description of Artificial Sequence: Synthetic oligonucleotide
ggacggcaaggattacatcgccctgaac

SEQ ID NO: 47495 - DNA, 24 bp, Artificial Sequence
  Description of Artificial Sequence: Synthetic oligonucleotide
aagcgccaggcacaggctgaccca

SEQ ID NO: 47496 - DNA, 23 bp, Artificial Sequence
  Description of Artificial Sequence: Synthetic oligonucleotide
agcgccaggcacaggctgaccca

SEQ ID NO: 47497 - DNA, 22 bp, Artificial Sequence
  Description of Artificial Sequence: Synthetic oligonucleotide
gcgccaggcacaggctgaccca

SEQ ID NO: 47498 - DNA, 23 bp, Artificial Sequence
  Description of Artificial Sequence: Synthetic oligonucleotide
cgccaggcacaggctgacccagt

SEQ ID NO: 47499 - DNA, 24 bp, Artificial Sequence
  Description of Artificial Sequence: Synthetic oligonucleotide
gccaggcacaggctgacccagtga

SEQ ID NO: 47500 - DNA, 24 bp, Artificial Sequence
  Description of Artificial Sequence: Synthetic oligonucleotide
ccaggcacaggctgacccagtgag

SEQ ID NO: 47501 - DNA, 24 bp, Artificial Sequence
  Description of Artificial Sequence: Synthetic oligonucleotide
caggcacaggctgacccagtgagc

SEQ ID NO: 47502 - DNA, 25 bp, Artificial Sequence
  Description of Artificial Sequence: Synthetic oligonucleotide
aggcacaggctgacccagtgagcct

SEQ ID NO: 47503 - DNA, 24 bp, Artificial Sequence
  Description of Artificial Sequence: Synthetic oligonucleotide
ggcacaggctgacccagtgagcct

SEQ ID NO: 47504 - DNA, 24 bp, Artificial Sequence
  Description of Artificial Sequence: Synthetic oligonucleotide
gcacaggctgacccagtgagcctg

SEQ ID NO: 47505 - DNA, 24 bp, Artificial Sequence
  Description of Artificial Sequence: Synthetic oligonucleotide
cacaggctgacccagtgagcctgc

SEQ ID NO: 47506 - DNA, 24 bp, Artificial Sequence
  Description of Artificial Sequence: Synthetic oligonucleotide
acaggctgacccagtgagcctgcg

SEQ ID NO: 47507 - DNA, 23 bp, Artificial Sequence
  Description of Artificial Sequence: Synthetic oligonucleotide
caggctgacccagtgagcctgcg

SEQ ID NO: 47508 - DNA, 25 bp, Artificial Sequence
  Description of Artificial Sequence: Synthetic oligonucleotide
aggctgacccagtgagcctgcggaa

SEQ ID NO: 47509 - DNA, 24 bp, Artificial Sequence
  Description of Artificial Sequence: Synthetic oligonucleotide
ggctgacccagtgagcctgcggaa

SEQ ID NO: 47510 - DNA, 24 bp, Artificial Sequence
  Description of Artificial Sequence: Synthetic oligonucleotide
gctgacccagtgagcctgcggaac

SEQ ID NO: 47511 - DNA, 25 bp, Artificial Sequence
  Description of Artificial Sequence: Synthetic oligonucleotide
ctgacccagtgagcctgcggaacct

SEQ ID NO: 47512 - DNA, 25 bp, Artificial Sequence
  Description of Artificial Sequence: Synthetic oligonucleotide
tgacccagtgagcctgcggaacctg

SEQ ID NO: 47513 - DNA, 24 bp, Artificial Sequence
  Description of Artificial Sequence: Synthetic oligonucleotide
gacccagtgagcctgcggaacctg

SEQ ID NO: 47514 - DNA, 24 bp, Artificial Sequence
  Description of Artificial Sequence: Synthetic oligonucleotide
acccagtgagcctgcggaacctgc

SEQ ID NO: 47515 - DNA, 23 bp, Artificial Sequence
  Description of Artificial Sequence: Synthetic oligonucleotide
cccagtgagcctgcggaacctgc

SEQ ID NO: 47516 - DNA, 23 bp, Artificial Sequence
  Description of Artificial Sequence: Synthetic oligonucleotide
ccagtgagcctgcggaacctgcg

SEQ ID NO: 47517 - DNA, 23 bp, Artificial Sequence
  Description of Artificial Sequence: Synthetic oligonucleotide
cagtgagcctgcggaacctgcgc

SEQ ID NO: 47518 - DNA, 29 bp, Artificial Sequence
  Description of Artificial Sequence: Synthetic oligonucleotide
gcaaggattacatcgccctgaacgaggtc

SEQ ID NO: 47519 - DNA, 29 bp, Artificial Sequence
  Description of Artificial Sequence: Synthetic oligonucleotide
caaggattacatcgccctgaacgaggtcc

SEQ ID NO: 47520 - DNA, 30 bp, Artificial Sequence
  Description of Artificial Sequence: Synthetic oligonucleotide
aaggattacatcgccctgaacgaggtcctg

SEQ ID NO: 47521 - DNA, 29 bp, Artificial Sequence
  Description of Artificial Sequence: Synthetic oligonucleotide
aggattacatcgccctgaacgaggtcctg

SEQ ID NO: 47522 - DNA, 28 bp, Artificial Sequence
  Description of Artificial Sequence: Synthetic oligonucleotide
ggattacatcgccctgaacgaggtcctg

SEQ ID NO: 47523 - DNA, 28 bp, Artificial Sequence
  Description of Artificial Sequence: Synthetic oligonucleotide
gattacatcgccctgaacgaggtcctgc

SEQ ID NO: 47524 - DNA, 28 bp, Artificial Sequence
  Description of Artificial Sequence: Synthetic oligonucleotide
attacatcgccctgaacgaggtcctgcg

SEQ ID NO: 47525 - DNA, 27 bp, Artificial Sequence
  Description of Artificial Sequence: Synthetic oligonucleotide
ttacatcgccctgaacgaggtcctgcg

SEQ ID NO: 47526 - DNA, 26 bp, Artificial Sequence
  Description of Artificial Sequence: Synthetic oligonucleotide
tacatcgccctgaacgaggtcctgcg

SEQ ID NO: 47527 - DNA, 25 bp, Artificial Sequence
  Description of Artificial Sequence: Synthetic oligonucleotide
acatcgccctgaacgaggtcctgcg

SEQ ID NO: 47528 - DNA, 24 bp, Artificial Sequence
  Description of Artificial Sequence: Synthetic oligonucleotide
catcgccctgaacgaggtcctgcg

SEQ ID NO: 47529 - DNA, 25 bp, Artificial Sequence
  Description of Artificial Sequence: Synthetic oligonucleotide
atcgccctgaacgaggtcctgcgct

SEQ ID NO: 47530 - DNA, 24 bp, Artificial Sequence
  Description of Artificial Sequence: Synthetic oligonucleotide
tcgccctgaacgaggtcctgcgct

SEQ ID NO: 47531 - DNA, 23 bp, Artificial Sequence
  Description of Artificial Sequence: Synthetic oligonucleotide
cgccctgaacgaggtcctgcgct

SEQ ID NO: 47532 - DNA, 23 bp, Artificial Sequence
  Description of Artificial Sequence: Synthetic oligonucleotide
gccctgaacgaggtcctgcgctc

SEQ ID NO: 47533 - DNA, 24 bp, Artificial Sequence
  Description of Artificial Sequence: Synthetic oligonucleotide
ccctgaacgaggtcctgcgctcct

SEQ ID NO: 47534 - DNA, 24 bp, Artificial Sequence
  Description of Artificial Sequence: Synthetic oligonucleotide
cctgaacgaggtcctgcgctcctg

SEQ ID NO: 47535 - DNA, 25 bp, Artificial Sequence
  Description of Artificial Sequence: Synthetic oligonucleotide
ctgaacgaggtcctgcgctcctgga

SEQ ID NO: 47536 - DNA, 25 bp, Artificial Sequence
  Description of Artificial Sequence: Synthetic oligonucleotide
tgaacgaggtcctgcgctcctggac

SEQ ID NO: 47537 - DNA, 24 bp, Artificial Sequence
  Description of Artificial Sequence: Synthetic oligonucleotide
gaacgaggtcctgcgctcctggac

SEQ ID NO: 47538 - DNA, 24 bp, Artificial Sequence
  Description of Artificial Sequence: Synthetic oligonucleotide
aacgaggtcctgcgctcctggacc

SEQ ID NO: 47539 - DNA, 23 bp, Artificial Sequence
  Description of Artificial Sequence: Synthetic oligonucleotide
acgaggtcctgcgctcctggacc

SEQ ID NO: 47540 - DNA, 22 bp, Artificial Sequence
  Description of Artificial Sequence: Synthetic oligonucleotide
cgaggtcctgcgctcctggacc

SEQ ID NO: 47541 - DNA, 22 bp, Artificial Sequence
  Description of Artificial Sequence: Synthetic oligonucleotide
gaggtcctgcgctcctggaccg

SEQ ID NO: 47542 - DNA, 22 bp, Artificial Sequence
  Description of Artificial Sequence: Synthetic oligonucleotide
aggtcctgcgctcctggaccgc

SEQ ID NO: 47543 - DNA, 21 bp, Artificial Sequence
  Description of Artificial Sequence: Synthetic oligonucleotide
ggtcctgcgctcctggaccgc

SEQ ID NO: 47544 - DNA, 21 bp, Artificial Sequence
  Description of Artificial Sequence: Synthetic oligonucleotide
gtcctgcgctcctggaccgcc

SEQ ID NO: 47545 - DNA, 21 bp, Artificial Sequence
  Description of Artificial Sequence: Synthetic oligonucleotide
tcctgcgctcctggaccgccg

SEQ ID NO: 47546 - DNA, 30 bp, Artificial Sequence
  Description of Artificial Sequence: Synthetic oligonucleotide
acaggtctcacaccctccagaggatgtatg

SEQ ID NO: 47547 - DNA, 25 bp, Artificial Sequence
  Description of Artificial Sequence: Synthetic oligonucleotide
gacgggtctcacaccctccagagga

SEQ ID NO: 47548 - DNA, 25 bp, Artificial Sequence
  Description of Artificial Sequence: Synthetic oligonucleotide
acgggtctcacaccctccagaggag

SEQ ID NO: 47549 - DNA, 24 bp, Artificial Sequence
  Description of Artificial Sequence: Synthetic oligonucleotide
cgggtctcacaccctccagaggag

SEQ ID NO: 47550 - DNA, 27 bp, Artificial Sequence
  Description of Artificial Sequence: Synthetic oligonucleotide
gggtctcacaccctccagaggaggtat

SEQ ID NO: 47551 - DNA, 27 bp, Artificial Sequence
  Description of Artificial Sequence: Synthetic oligonucleotide
ggtctcacaccctccagaggaggtatg

SEQ ID NO: 47552 - DNA, 27 bp, Artificial Sequence
  Description of Artificial Sequence: Synthetic oligonucleotide
gtctcacaccctccagaggaggtatgg

SEQ ID NO: 47553 - DNA, 27 bp, Artificial Sequence
  Description of Artificial Sequence: Synthetic oligonucleotide
tctcacaccctccagaggaggtatggc

SEQ ID NO: 47554 - DNA, 27 bp, Artificial Sequence
  Description of Artificial Sequence: Synthetic oligonucleotide
ctcacaccctccagaggaggtatggct

SEQ ID NO: 47555 - DNA, 27 bp, Artificial Sequence
  Description of Artificial Sequence: Synthetic oligonucleotide
tcacaccctccagaggaggtatggctg

SEQ ID NO: 47556 - DNA, 26 bp, Artificial Sequence
  Description of Artificial Sequence: Synthetic oligonucleotide
cacaccctccagaggaggtatggctg

SEQ ID NO: 47557 - DNA, 26 bp, Artificial Sequence
  Description of Artificial Sequence: Synthetic oligonucleotide
acaccctccagaggaggtatggctgc

SEQ ID NO: 47558 - DNA, 25 bp, Artificial Sequence
  Description of Artificial Sequence: Synthetic oligonucleotide
caccctccagaggaggtatggctgc

SEQ ID NO: 47559 - DNA, 26 bp, Artificial Sequence
  Description of Artificial Sequence: Synthetic oligonucleotide
accctccagaggaggtatggctgcga

SEQ ID NO: 47560 - DNA, 25 bp, Artificial Sequence
  Description of Artificial Sequence: Synthetic oligonucleotide
ccctccagaggaggtatggctgcga

SEQ ID NO: 47561 - DNA, 25 bp, Artificial Sequence
  Description of Artificial Sequence: Synthetic oligonucleotide
cctccagaggaggtatggctgcgac

SEQ ID NO: 47562 - DNA, 26 bp, Artificial Sequence
  Description of Artificial Sequence: Synthetic oligonucleotide
ctccagaggaggtatggctgcgacct

SEQ ID NO: 47563 - DNA, 26 bp, Artificial Sequence
  Description of Artificial Sequence: Synthetic oligonucleotide
tccagaggaggtatggctgcgacctg

SEQ ID NO: 47564 - DNA, 25 bp, Artificial Sequence
  Description of Artificial Sequence: Synthetic oligonucleotide
ccagaggaggtatggctgcgacctg

SEQ ID NO: 47565 - DNA, 25 bp, Artificial Sequence
  Description of Artificial Sequence: Synthetic oligonucleotide
cagaggaggtatggctgcgacctgg

SEQ ID NO: 47566 - DNA, 25 bp, Artificial Sequence
  Description of Artificial Sequence: Synthetic oligonucleotide
agaggaggtatggctgcgacctggg

SEQ ID NO: 47567 - DNA, 24 bp, Artificial Sequence
  Description of Artificial Sequence: Synthetic oligonucleotide
gaggaggtatggctgcgacctggg

SEQ ID NO: 47568 - DNA, 24 bp, Artificial Sequence
  Description of Artificial Sequence: Synthetic oligonucleotide
aggaggtatggctgcgacctgggg

SEQ ID NO: 47569 - DNA, 23 bp, Artificial Sequence
  Description of Artificial Sequence: Synthetic oligonucleotide
ggaggtatggctgcgacctgggg

SEQ ID NO: 47570 - DNA, 23 bp, Artificial Sequence
  Description of Artificial Sequence: Synthetic oligonucleotide
gaggtatggctgcgacctggggc

SEQ ID NO: 47571 - DNA, 23 bp, Artificial Sequence
  Description of Artificial Sequence: Synthetic oligonucleotide
aggtatggctgcgacctggggcc

SEQ ID NO: 47572 - DNA, 22 bp, Artificial Sequence
  Description of Artificial Sequence: Synthetic oligonucleotide
ggtatggctgcgacctggggcc

SEQ ID NO: 47573 - DNA, 20 bp, Artificial Sequence
  Description of Artificial Sequence: Synthetic oligonucleotide
ggcccgacgggcgcctcgtt

SEQ ID NO: 47574 - DNA, 20 bp, Artificial Sequence
  Description of Artificial Sequence: Synthetic oligonucleotide
gcccgacgggcgcctcgtct

SEQ ID NO: 47575 - DNA, 20 bp, Artificial Sequence
  Description of Artificial Sequence: Synthetic oligonucleotide
cccgacgggcgcctcgtcct

SEQ ID NO: 47576 - DNA, 20 bp, Artificial Sequence
  Description of Artificial Sequence: Synthetic oligonucleotide
ccgacgggcgcctcgtccgt

SEQ ID NO: 47577 - DNA, 20 bp, Artificial Sequence
  Description of Artificial Sequence: Synthetic oligonucleotide
cgacgggcgcctcgtccgct

SEQ ID NO: 47578 - DNA, 20 bp, Artificial Sequence
  Description of Artificial Sequence: Synthetic oligonucleotide
gacgggcgcctcgtccgcgt

SEQ ID NO: 47579 - DNA, 20 bp, Artificial Sequence
  Description of Artificial Sequence: Synthetic oligonucleotide
acgggcgcctcgtccgcggt

SEQ ID NO: 47580 - DNA, 20 bp, Artificial Sequence
  Description of Artificial Sequence: Synthetic oligonucleotide
cgggcgcctcgtccgcggtt

SEQ ID NO: 47581 - DNA, 21 bp, Artificial Sequence
  Description of Artificial Sequence: Synthetic oligonucleotide
gggcgcctcgtccgcgggtat

SEQ ID NO: 47582 - DNA, 22 bp, Artificial Sequence
  Description of Artificial Sequence: Synthetic oligonucleotide
ggcgcctcgtccgcgggtatga

SEQ ID NO: 47583 - DNA, 22 bp, Artificial Sequence
  Description of Artificial Sequence: Synthetic oligonucleotide
gcgcctcgtccgcgggtatgac

SEQ ID NO: 47584 - DNA, 23 bp, Artificial Sequence
  Description of Artificial Sequence: Synthetic oligonucleotide
cgcctcgtccgcgggtatgacca

SEQ ID NO: 47585 - DNA, 24 bp, Artificial Sequence
  Description of Artificial Sequence: Synthetic oligonucleotide
gcctcgtccgcgggtatgaccagt

SEQ ID NO: 47586 - DNA, 24 bp, Artificial Sequence
  Description of Artificial Sequence: Synthetic oligonucleotide
cctcgtccgcgggtatgaccagtc

SEQ ID NO: 47587 - DNA, 24 bp, Artificial Sequence
  Description of Artificial Sequence: Synthetic oligonucleotide
ctcgtccgcgggtatgaccagtcc

SEQ ID NO: 47588 - DNA, 24 bp, Artificial Sequence
  Description of Artificial Sequence: Synthetic oligonucleotide
tcgtccgcgggtatgaccagtccg

SEQ ID NO: 47589 - DNA, 23 bp, Artificial Sequence
  Description of Artificial Sequence: Synthetic oligonucleotide
cgtccgcgggtatgaccagtccg

SEQ ID NO: 47590 - DNA, 23 bp, Artificial Sequence
  Description of Artificial Sequence: Synthetic oligonucleotide
gtccgcgggtatgaccagtccgc

SEQ ID NO: 47591 - DNA, 25 bp, Artificial Sequence
  Description of Artificial Sequence: Synthetic oligonucleotide
acgggtctcacaccctccagaggac

SEQ ID NO: 47592 - DNA, 27 bp, Artificial Sequence
  Description of Artificial Sequence: Synthetic oligonucleotide
gggtctcacaccctccagaggacgtat

SEQ ID NO: 47593 - DNA, 27 bp, Artificial Sequence
  Description of Artificial Sequence: Synthetic oligonucleotide
ggtctcacaccctccagaggacgtatg

SEQ ID NO: 47594 - DNA, 27 bp, Artificial Sequence
  Description of Artificial Sequence: Synthetic oligonucleotide
gtctcacaccctccagaggacgtatgg

SEQ ID NO: 47595 - DNA, 27 bp, Artificial Sequence
  Description of Artificial Sequence: Synthetic oligonucleotide
tctcacaccctccagaggacgtatggc

SEQ ID NO: 47596 - DNA, 27 bp, Artificial Sequence
  Description of Artificial Sequence: Synthetic oligonucleotide
ctcacaccctccagaggacgtatggct

SEQ ID NO: 47597 - DNA, 27 bp, Artificial Sequence
  Description of Artificial Sequence: Synthetic oligonucleotide
tcacaccctccagaggacgtatggctg

SEQ ID NO: 47598 - DNA, 26 bp, Artificial Sequence
  Description of Artificial Sequence: Synthetic oligonucleotide
cacaccctccagaggacgtatggctg

SEQ ID NO: 47599 - DNA, 26 bp, Artificial Sequence
  Description of Artificial Sequence: Synthetic oligonucleotide
acaccctccagaggacgtatggctgc

SEQ ID NO: 47600 - DNA, 25 bp, Artificial Sequence
  Description of Artificial Sequence: Synthetic oligonucleotide
caccctccagaggacgtatggctgc

SEQ ID NO: 47601 - DNA, 26 bp, Artificial Sequence
  Description of Artificial Sequence: Synthetic oligonucleotide
accctccagaggacgtatggctgcga

SEQ ID NO: 47602 - DNA, 25 bp, Artificial Sequence
  Description of Artificial Sequence: Synthetic oligonucleotide
ccctccagaggacgtatggctgcga

SEQ ID NO: 47603 - DNA, 25 bp, Artificial Sequence
  Description of Artificial Sequence: Synthetic oligonucleotide
cctccagaggacgtatggctgcgac

SEQ ID NO: 47604 - DNA, 26 bp, Artificial Sequence
  Description of Artificial Sequence: Synthetic oligonucleotide
ctccagaggacgtatggctgcgacct

SEQ ID NO: 47605 - DNA, 26 bp, Artificial Sequence
  Description of Artificial Sequence: Synthetic oligonucleotide
tccagaggacgtatggctgcgacctg

SEQ ID NO: 47606 - DNA, 25 bp, Artificial Sequence
  Description of Artificial Sequence: Synthetic oligonucleotide
ccagaggacgtatggctgcgacctg

SEQ ID NO: 47607 - DNA, 25 bp, Artificial Sequence
  Description of Artificial Sequence: Synthetic oligonucleotide
cagaggacgtatggctgcgacctgg

SEQ ID NO: 47608 - DNA, 25 bp, Artificial Sequence
  Description of Artificial Sequence: Synthetic oligonucleotide
agaggacgtatggctgcgacctggg

SEQ ID NO: 47609 - DNA, 24 bp, Artificial Sequence
  Description of Artificial Sequence: Synthetic oligonucleotide
gaggacgtatggctgcgacctggg

SEQ ID NO: 47610 - DNA, 24 bp, Artificial Sequence
  Description of Artificial Sequence: Synthetic oligonucleotide
aggacgtatggctgcgacctgggg

SEQ ID NO: 47611 - DNA, 23 bp, Artificial Sequence
  Description of Artificial Sequence: Synthetic oligonucleotide
ggacgtatggctgcgacctgggg

SEQ ID NO: 47612 - DNA, 23 bp, Artificial Sequence
  Description of Artificial Sequence: Synthetic oligonucleotide
gacgtatggctgcgacctggggc

SEQ ID NO: 47613 - DNA, 23 bp, Artificial Sequence
  Description of Artificial Sequence: Synthetic oligonucleotide
acgtatggctgcgacctggggcc

SEQ ID NO: 47614 - DNA, 22 bp, Artificial Sequence
  Description of Artificial Sequence: Synthetic oligonucleotide
cgtatggctgcgacctggggcc

SEQ ID NO: 47615 - DNA, 29 bp, Artificial Sequence
  Description of Artificial Sequence: Synthetic oligonucleotide
agtccgcctacgacggcaaggattacaac

SEQ ID NO: 47616 - DNA, 28 bp, Artificial Sequence
  Description of Artificial Sequence: Synthetic oligonucleotide
gtccgcctacgacggcaaggattacaac

SEQ ID NO: 47617 - DNA, 28 bp, Artificial Sequence
  Description of Artificial Sequence: Synthetic oligonucleotide
tccgcctacgacggcaaggattacaacg

SEQ ID NO: 47618 - DNA, 27 bp, Artificial Sequence
  Description of Artificial Sequence: Synthetic oligonucleotide
ccgcctacgacggcaaggattacaacg

SEQ ID NO: 47619 - DNA, 27 bp, Artificial Sequence
  Description of Artificial Sequence: Synthetic oligonucleotide
cgcctacgacggcaaggattacaacgc

SEQ ID NO: 47620 - DNA, 27 bp, Artificial Sequence
  Description of Artificial Sequence: Synthetic oligonucleotide
gcctacgacggcaaggattacaacgcc

SEQ ID NO: 47621 - DNA, 27 bp, Artificial Sequence
  Description of Artificial Sequence: Synthetic oligonucleotide
cctacgacggcaaggattacaacgccc

SEQ ID NO: 47622 - DNA, 28 bp, Artificial Sequence
  Description of Artificial Sequence: Synthetic oligonucleotide
ctacgacggcaaggattacaacgccctg

SEQ ID NO: 47623 - DNA, 30 bp, Artificial Sequence
  Description of Artificial Sequence: Synthetic oligonucleotide
tacgacggcaaggattacaacgccctgaac

SEQ ID NO: 47624 - DNA, 29 bp, Artificial Sequence
  Description of Artificial Sequence: Synthetic oligonucleotide
acgacggcaaggattacaacgccctgaac

SEQ ID NO: 47625 - DNA, 28 bp, Artificial Sequence
  Description of Artificial Sequence: Synthetic oligonucleotide
cgacggcaaggattacaacgccctgaac

SEQ ID NO: 47626 - DNA, 30 bp, Artificial Sequence
  Description of Artificial Sequence: Synthetic oligonucleotide
gacggcaaggattacaacgccctgaacaag

SEQ ID NO: 47627 - DNA, 30 bp, Artificial Sequence
  Description of Artificial Sequence: Synthetic oligonucleotide
acggcaaggattacaacgccctgaacaagg

SEQ ID NO: 47628 - DNA, 29 bp, Artificial Sequence
  Description of Artificial Sequence: Synthetic oligonucleotide
cggcaaggattacaacgccctgaacaagg

SEQ ID NO: 47629 - DNA, 30 bp, Artificial Sequence
  Description of Artificial Sequence: Synthetic oligonucleotide
ggcaaggattacaacgccctgaacaaggac

SEQ ID NO: 47630 - DNA, 30 bp, Artificial Sequence
  Description of Artificial Sequence: Synthetic oligonucleotide
gcaaggattacaacgccctgaacaaggacc

SEQ ID NO: 47631 - DNA, 31 bp, Artificial Sequence
  Description of Artificial Sequence: Synthetic oligonucleotide
caaggattacaacgccctgaacaaggacctg

SEQ ID NO: 47632 - DNA, 31 bp, Artificial Sequence
  Description of Artificial Sequence: Synthetic oligonucleotide
aaggattacaacgccctgaacaaggacctgc

SEQ ID NO: 47633 - DNA, 30 bp, Artificial Sequence
  Description of Artificial Sequence: Synthetic oligonucleotide
aggattacaacgccctgaacaaggacctgc

SEQ ID NO: 47634 - DNA, 29 bp, Artificial Sequence
  Description of Artificial Sequence: Synthetic oligonucleotide
ggattacaacgccctgaacaaggacctgc

SEQ ID NO: 47635 - DNA, 29 bp, Artificial Sequence
  Description of Artificial Sequence: Synthetic oligonucleotide
gattacaacgccctgaacaaggacctgcg

SEQ ID NO: 47636 - DNA, 29 bp, Artificial Sequence
  Description of Artificial Sequence: Synthetic oligonucleotide
attacaacgccctgaacaaggacctgcgc

SEQ ID NO: 47637 - DNA, 28 bp, Artificial Sequence
  Description of Artificial Sequence: Synthetic oligonucleotide
ttacaacgccctgaacaaggacctgcgc

SEQ ID NO: 47638 - DNA, 27 bp, Artificial Sequence
  Description of Artificial Sequence: Synthetic oligonucleotide
tacaacgccctgaacaaggacctgcgc

SEQ ID NO: 47639 - DNA, 27 bp, Artificial Sequence
  Description of Artificial Sequence: Synthetic oligonucleotide
acaacgccctgaacaaggacctgcgct

SEQ ID NO: 47640 - DNA, 26 bp, Artificial Sequence
  Description of Artificial Sequence: Synthetic oligonucleotide
caacgccctgaacaaggacctgcgct

SEQ ID NO: 47641 - DNA, 26 bp, Artificial Sequence
  Description of Artificial Sequence: Synthetic oligonucleotide
aacgccctgaacaaggacctgcgctc

SEQ ID NO: 47642 - DNA, 25 bp, Artificial Sequence
  Description of Artificial Sequence: Synthetic oligonucleotide
acgccctgaacaaggacctgcgctc

SEQ ID NO: 47643 - DNA, 24 bp, Artificial Sequence
  Description of Artificial Sequence: Synthetic oligonucleotide
cgccctgaacaaggacctgcgctc

SEQ ID NO: 47644 - DNA, 25 bp, Artificial Sequence
  Description of Artificial Sequence: Synthetic oligonucleotide
gccctgaacaaggacctgcgctcct

SEQ ID NO: 47645 - DNA, 25 bp, Artificial Sequence
  Description of Artificial Sequence: Synthetic oligonucleotide
ccctgaacaaggacctgcgctcctg

SEQ ID NO: 47646 - DNA, 26 bp, Artificial Sequence
  Description of Artificial Sequence: Synthetic oligonucleotide
cctgaacaaggacctgcgctcctgga

SEQ ID NO: 47647 - DNA, 26 bp, Artificial Sequence
  Description of Artificial Sequence: Synthetic oligonucleotide
ctgaacaaggacctgcgctcctggac

SEQ ID NO: 47648 - DNA, 26 bp, Artificial Sequence
  Description of Artificial Sequence: Synthetic oligonucleotide
tgaacaaggacctgcgctcctggacc

SEQ ID NO: 47649 - DNA, 25 bp, Artificial Sequence
  Description of Artificial Sequence: Synthetic oligonucleotide
gaacaaggacctgcgctcctggacc

SEQ ID NO: 47650 - DNA, 25 bp, Artificial Sequence
  Description of Artificial Sequence: Synthetic oligonucleotide
aacaaggacctgcgctcctggaccg

SEQ ID NO: 47651 - DNA, 24 bp, Artificial Sequence
  Description of Artificial Sequence: Synthetic oligonucleotide
acaaggacctgcgctcctggaccg

SEQ ID NO: 47652 - DNA, 23 bp, Artificial Sequence
  Description of Artificial Sequence: Synthetic oligonucleotide
caaggacctgcgctcctggaccg

SEQ ID NO: 47653 - DNA, 23 bp, Artificial Sequence
  Description of Artificial Sequence: Synthetic oligonucleotide
aaggacctgcgctcctggaccgc

SEQ ID NO: 47654 - DNA, 22 bp, Artificial Sequence
  Description of Artificial Sequence: Synthetic oligonucleotide
cgcaagttggaggcggccggtg

SEQ ID NO: 47655 - DNA, 22 bp, Artificial Sequence
  Description of Artificial Sequence: Synthetic oligonucleotide
gcaagttggaggcggccggtgc

SEQ ID NO: 47656 - DNA, 22 bp, Artificial Sequence
  Description of Artificial Sequence: Synthetic oligonucleotide
caagttggaggcggccggtgcg

SEQ ID NO: 47657 - DNA, 22 bp, Artificial Sequence
  Description of Artificial Sequence: Synthetic oligonucleotide
aagttggaggcggccggtgcgg

SEQ ID NO: 47658 - DNA, 21 bp, Artificial Sequence
  Description of Artificial Sequence: Synthetic oligonucleotide
agttggaggcggccggtgcgg

SEQ ID NO: 47659 - DNA, 20 bp, Artificial Sequence
  Description of Artificial Sequence: Synthetic oligonucleotide
gttggaggcggccggtgcgg

SEQ ID NO: 47660 - DNA, 20 bp, Artificial Sequence
  Description of Artificial Sequence: Synthetic oligonucleotide
ttggaggcggccggtgcggc

SEQ ID NO: 47661 - DNA, 20 bp, Artificial Sequence
  Description of Artificial Sequence: Synthetic oligonucleotide
tggaggcggccggtgcggct

SEQ ID NO: 47662 - DNA, 20 bp, Artificial Sequence
  Description of Artificial Sequence: Synthetic oligonucleotide
ggaggcggccggtgcggctt

SEQ ID NO: 47663 - DNA, 20 bp, Artificial Sequence
  Description of Artificial Sequence: Synthetic oligonucleotide
gaggcggccggtgcggcgtt

SEQ ID NO: 47664 - DNA, 20 bp, Artificial Sequence
  Description of Artificial Sequence: Synthetic oligonucleotide
aggcggccggtgcggcggat

SEQ ID NO: 47665 - DNA, 20 bp, Artificial Sequence
  Description of Artificial Sequence: Synthetic oligonucleotide
ggcggccggtgcggcggatt

SEQ ID NO: 47666 - DNA, 20 bp, Artificial Sequence
  Description of Artificial Sequence: Synthetic oligonucleotide
gcggccggtgcggcggagtt

SEQ ID NO: 47667 - DNA, 20 bp, Artificial Sequence
  Description of Artificial Sequence: Synthetic oligonucleotide
cggccggtgcggcggagcat

SEQ ID NO: 47668 - DNA, 20 bp, Artificial Sequence
  Description of Artificial Sequence: Synthetic oligonucleotide
ggccggtgcggcggagcagt

SEQ ID NO: 47669 - DNA, 20 bp, Artificial Sequence
  Description of Artificial Sequence: Synthetic oligonucleotide
gccggtgcggcggagcagct

SEQ ID NO: 47670 - DNA, 21 bp, Artificial Sequence
  Description of Artificial Sequence: Synthetic oligonucleotide
ccggtgcggcggagcagctga

SEQ ID NO: 47671 - DNA, 22 bp, Artificial Sequence
  Description of Artificial Sequence: Synthetic oligonucleotide
cggtgcggcggagcagctgaga

SEQ ID NO: 47672 - DNA, 22 bp, Artificial Sequence
  Description of Artificial Sequence: Synthetic oligonucleotide
ggtgcggcggagcagctgagag

SEQ ID NO: 47673 - DNA, 23 bp, Artificial Sequence
  Description of Artificial Sequence: Synthetic oligonucleotide
aggctgaccgagtgagcctgcgg

SEQ ID NO: 47674 - DNA, 22 bp, Artificial Sequence
  Description of Artificial Sequence: Synthetic oligonucleotide
ggctgaccgagtgagcctgcgg

SEQ ID NO: 47675 - DNA, 23 bp, Artificial Sequence
  Description of Artificial Sequence: Synthetic oligonucleotide
gctgaccgagtgagcctgcggga

SEQ ID NO: 47676 - DNA, 23 bp, Artificial Sequence
  Description of Artificial Sequence: Synthetic oligonucleotide
ctgaccgagtgagcctgcgggac

SEQ ID NO: 47677 - DNA, 24 bp, Artificial Sequence
  Description of Artificial Sequence: Synthetic oligonucleotide
tgaccgagtgagcctgcgggacct

SEQ ID NO: 47678 - DNA, 23 bp, Artificial Sequence
  Description of Artificial Sequence: Synthetic oligonucleotide
gaccgagtgagcctgcgggacct

SEQ ID NO: 47679 - DNA, 23 bp, Artificial Sequence
  Description of Artificial Sequence: Synthetic oligonucleotide
accgagtgagcctgcgggacctg

SEQ ID NO: 47680 - DNA, 22 bp, Artificial Sequence
  Description of Artificial Sequence: Synthetic oligonucleotide
ccgagtgagcctgcgggacctg

SEQ ID NO: 47681 - DNA, 22 bp, Artificial Sequence
  Description of Artificial Sequence: Synthetic oligonucleotide
cgagtgagcctgcgggacctgc

SEQ ID NO: 47682 - DNA, 22 bp, Artificial Sequence
  Description of Artificial Sequence: Synthetic oligonucleotide
gagtgagcctgcgggacctgcg

SEQ ID NO: 47683 - DNA, 22 bp, Artificial Sequence
  Description of Artificial Sequence: Synthetic oligonucleotide
agtgagcctgcgggacctgcgc

SEQ ID NO: 47684 - DNA, 21 bp, Artificial Sequence
  Description of Artificial Sequence: Synthetic oligonucleotide
gtgagcctgcgggacctgcgc

SEQ ID NO: 47685 - DNA, 21 bp, Artificial Sequence
  Description of Artificial Sequence: Synthetic oligonucleotide
tgagcctgcgggacctgcgcg

SEQ ID NO: 47686 - DNA, 20 bp, Artificial Sequence
  Description of Artificial Sequence: Synthetic oligonucleotide
gagcctgcgggacctgcgcg

SEQ ID NO: 47687 - DNA, 20 bp, Artificial Sequence
  Description of Artificial Sequence: Synthetic oligonucleotide
agcctgcgggacctgcgcgg

SEQ ID NO: 47688 - DNA, 20 bp, Artificial Sequence
  Description of Artificial Sequence: Synthetic oligonucleotide
gcctgcgggacctgcgcggt

SEQ ID NO: 47689 - DNA, 21 bp, Artificial Sequence
  Description of Artificial Sequence: Synthetic oligonucleotide
cctgcgggacctgcgcggcta

SEQ ID NO: 47690 - DNA, 23 bp, Artificial Sequence
  Description of Artificial Sequence: Synthetic oligonucleotide
ctgcgggacctgcgcggctacta

SEQ ID NO: 47691 - DNA, 25 bp, Artificial Sequence
  Description of Artificial Sequence: Synthetic oligonucleotide
tgcgggacctgcgcggctactacaa

SEQ ID NO: 47692 - DNA, 24 bp, Artificial Sequence
  Description of Artificial Sequence: Synthetic oligonucleotide
gcgggacctgcgcggctactacaa

SEQ ID NO: 47693 - DNA, 24 bp, Artificial Sequence
  Description of Artificial Sequence: Synthetic oligonucleotide
cgggacctgcgcggctactacaac

SEQ ID NO: 47694 - DNA, 25 bp, Artificial Sequence
  Description of Artificial Sequence: Synthetic oligonucleotide
gggacctgcgcggctactacaacca

SEQ ID NO: 47695 - DNA, 26 bp, Artificial Sequence
  Description of Artificial Sequence: Synthetic oligonucleotide
ggacctgcgcggctactacaaccaga

SEQ ID NO: 47696 - DNA, 26 bp, Artificial Sequence
  Description of Artificial Sequence: Synthetic oligonucleotide
gacctgcgcggctactacaaccagag

SEQ ID NO: 47697 - DNA, 24 bp, Artificial Sequence
  Description of Artificial Sequence: Synthetic oligonucleotide
gggaaggagacgctgcagcacgca

SEQ ID NO: 47698 - DNA, 24 bp, Artificial Sequence
  Description of Artificial Sequence: Synthetic oligonucleotide
ggaaggagacgctgcagcacgcag

SEQ ID NO: 47699 - DNA, 26 bp, Artificial Sequence
  Description of Artificial Sequence: Synthetic oligonucleotide
agaacgggaaggagacgctgcagcct

SEQ ID NO: 47700 - DNA, 25 bp, Artificial Sequence
  Description of Artificial Sequence: Synthetic oligonucleotide
gaacgggaaggagacgctgcagcct

SEQ ID NO: 47701 - DNA, 25 bp, Artificial Sequence
  Description of Artificial Sequence: Synthetic oligonucleotide
aacgggaaggagacgctgcagcctg

SEQ ID NO: 47702 - DNA, 24 bp, Artificial Sequence
  Description of Artificial Sequence: Synthetic oligonucleotide
acgggaaggagacgctgcagcctg

SEQ ID NO: 47703 - DNA, 23 bp, Artificial Sequence
  Description of Artificial Sequence: Synthetic oligonucleotide
cgggaaggagacgctgcagcctg

SEQ ID NO: 47704 - DNA, 24 bp, Artificial Sequence
  Description of Artificial Sequence: Synthetic oligonucleotide
gggaaggagacgctgcagcctgca

SEQ ID NO: 47705 - DNA, 24 bp, Artificial Sequence
  Description of Artificial Sequence: Synthetic oligonucleotide
ggaaggagacgctgcagcctgcag

SEQ ID NO: 47706 - DNA, 25 bp, Artificial Sequence
  Description of Artificial Sequence: Synthetic oligonucleotide
tggacgacacgcagttcgtgcggtc

SEQ ID NO: 47707 - DNA, 24 bp, Artificial Sequence
  Description of Artificial Sequence: Synthetic oligonucleotide
ggacgacacgcagttcgtgcggtc

SEQ ID NO: 47708 - DNA, 24 bp, Artificial Sequence
  Description of Artificial Sequence: Synthetic oligonucleotide
gacgacacgcagttcgtgcggtcc

SEQ ID NO: 47709 - DNA, 25 bp, Artificial Sequence
  Description of Artificial Sequence: Synthetic oligonucleotide
acgacacgcagttcgtgcggtccga

SEQ ID NO: 47710 - DNA, 24 bp, Artificial Sequence
  Description of Artificial Sequence: Synthetic oligonucleotide
cgacacgcagttcgtgcggtccga

SEQ ID NO: 47711 - DNA, 25 bp, Artificial Sequence
  Description of Artificial Sequence: Synthetic oligonucleotide
gacacgcagttcgtgcggtccgaca

SEQ ID NO: 47712 - DNA, 25 bp, Artificial Sequence
  Description of Artificial Sequence: Synthetic oligonucleotide
acacgcagttcgtgcggtccgacag

SEQ ID NO: 47713 - DNA, 24 bp, Artificial Sequence
  Description of Artificial Sequence: Synthetic oligonucleotide
cacgcagttcgtgcggtccgacag

SEQ ID NO: 47714 - DNA, 24 bp, Artificial Sequence
  Description of Artificial Sequence: Synthetic oligonucleotide
acgcagttcgtgcggtccgacagc

SEQ ID NO: 47715 - DNA, 23 bp, Artificial Sequence
  Description of Artificial Sequence: Synthetic oligonucleotide
cgcagttcgtgcggtccgacagc

SEQ ID NO: 47716 - DNA, 24 bp, Artificial Sequence
  Description of Artificial Sequence: Synthetic oligonucleotide
gcagttcgtgcggtccgacagcga

SEQ ID NO: 47717 - DNA, 24 bp, Artificial Sequence
  Description of Artificial Sequence: Synthetic oligonucleotide
cagttcgtgcggtccgacagcgac

SEQ ID NO: 47718 - DNA, 24 bp, Artificial Sequence
  Description of Artificial Sequence: Synthetic oligonucleotide
agttcgtgcggtccgacagcgacg

SEQ ID NO: 47719 - DNA, 23 bp, Artificial Sequence
  Description of Artificial Sequence: Synthetic oligonucleotide
gttcgtgcggtccgacagcgacg

SEQ ID NO: 47720 - DNA, 23 bp, Artificial Sequence
  Description of Artificial Sequence: Synthetic oligonucleotide
ttcgtgcggtccgacagcgacgc

SEQ ID NO: 47721 - DNA, 22 bp, Artificial Sequence
  Description of Artificial Sequence: Synthetic oligonucleotide
tcgtgcggtccgacagcgacgc

SEQ ID NO: 47722 - DNA, 21 bp, Artificial Sequence
  Description of Artificial Sequence: Synthetic oligonucleotide
cgtgcggtccgacagcgacgc

SEQ ID NO: 47723 - DNA, 21 bp, Artificial Sequence
  Description of Artificial Sequence: Synthetic oligonucleotide
gtgcggtccgacagcgacgcc

SEQ ID NO: 47724 - DNA, 21 bp, Artificial Sequence
  Description of Artificial Sequence: Synthetic oligonucleotide
tgcggtccgacagcgacgccg

SEQ ID NO: 47725 - DNA, 20 bp, Artificial Sequence
  Description of Artificial Sequence: Synthetic oligonucleotide
gcggtccgacagcgacgccg

SEQ ID NO: 47726 - DNA, 20 bp, Artificial Sequence
  Description of Artificial Sequence: Synthetic oligonucleotide
cggtccgacagcgacgccgc

SEQ ID NO: 47727 - DNA, 21 bp, Artificial Sequence
  Description of Artificial Sequence: Synthetic oligonucleotide
ggtccgacagcgacgccgcga

SEQ ID NO: 47728 - DNA, 22 bp, Artificial Sequence
  Description of Artificial Sequence: Synthetic oligonucleotide
gtccgacagcgacgccgcgagt

SEQ ID NO: 47729 - DNA, 22 bp, Artificial Sequence
  Description of Artificial Sequence: Synthetic oligonucleotide
tccgacagcgacgccgcgagtc

SEQ ID NO: 47730 - DNA, 21 bp, Artificial Sequence
  Description of Artificial Sequence: Synthetic oligonucleotide
ccgacagcgacgccgcgagtc

SEQ ID NO: 47731 - DNA, 21 bp, Artificial Sequence
  Description of Artificial Sequence: Synthetic oligonucleotide
ctggaccgccgcggacaccgt

SEQ ID NO: 47732 - DNA, 21 bp, Artificial Sequence
  Description of Artificial Sequence: Synthetic oligonucleotide
tggaccgccgcggacaccgtg

SEQ ID NO: 47733 - DNA, 20 bp, Artificial Sequence
  Description of Artificial Sequence: Synthetic oligonucleotide
ggaccgccgcggacaccgtg

SEQ ID NO: 47734 - DNA, 20 bp, Artificial Sequence
  Description of Artificial Sequence: Synthetic oligonucleotide
gaccgccgcggacaccgtgg

SEQ ID NO: 47735 - DNA, 21 bp, Artificial Sequence
  Description of Artificial Sequence: Synthetic oligonucleotide
accgccgcggacaccgtggct

SEQ ID NO: 47736 - DNA, 20 bp, Artificial Sequence
  Description of Artificial Sequence: Synthetic oligonucleotide
ccgccgcggacaccgtggct

SEQ ID NO: 47737 - DNA, 21 bp, Artificial Sequence
  Description of Artificial Sequence: Synthetic oligonucleotide
cgccgcggacaccgtggctca

SEQ ID NO: 47738 - DNA, 23 bp, Artificial Sequence
  Description of Artificial Sequence: Synthetic oligonucleotide
gccgcggacaccgtggctcagat

SEQ ID NO: 47739 - DNA, 24 bp, Artificial Sequence
  Description of Artificial Sequence: Synthetic oligonucleotide
ccgcggacaccgtggctcagatca

SEQ ID NO: 47740 - DNA, 24 bp, Artificial Sequence
  Description of Artificial Sequence: Synthetic oligonucleotide
cgcggacaccgtggctcagatcac

SEQ ID NO: 47741 - DNA, 24 bp, Artificial Sequence
  Description of Artificial Sequence: Synthetic oligonucleotide
gcggacaccgtggctcagatcacc

SEQ ID NO: 47742 - DNA, 25 bp, Artificial Sequence
  Description of Artificial Sequence: Synthetic oligonucleotide
cggacaccgtggctcagatcaccca

SEQ ID NO: 47743 - DNA, 25 bp, Artificial Sequence
  Description of Artificial Sequence: Synthetic oligonucleotide
ggacaccgtggctcagatcacccag

SEQ ID NO: 47744 - DNA, 25 bp, Artificial Sequence
  Description of Artificial Sequence: Synthetic oligonucleotide
gacaccgtggctcagatcacccagc

SEQ ID NO: 47745 - DNA, 25 bp, Artificial Sequence
  Description of Artificial Sequence: Synthetic oligonucleotide
acaccgtggctcagatcacccagcg

SEQ ID NO: 47746 - DNA, 24 bp, Artificial Sequence
  Description of Artificial Sequence: Synthetic oligonucleotide
caccgtggctcagatcacccagcg

SEQ ID NO: 47747 - DNA, 26 bp, Artificial Sequence
  Description of Artificial Sequence: Synthetic oligonucleotide
accgtggctcagatcacccagcgcaa

SEQ ID NO: 47748 - DNA, 25 bp, Artificial Sequence
  Description of Artificial Sequence: Synthetic oligonucleotide
ccgtggctcagatcacccagcgcaa

SEQ ID NO: 47749 - DNA, 27 bp, Artificial Sequence
  Description of Artificial Sequence: Synthetic oligonucleotide
cgtggctcagatcacccagcgcaagtt

SEQ ID NO: 47750 - DNA, 27 bp, Artificial Sequence
  Description of Artificial Sequence: Synthetic oligonucleotide
gtggctcagatcacccagcgcaagttg

SEQ ID NO: 47751 - DNA, 27 bp, Artificial Sequence
  Description of Artificial Sequence: Synthetic oligonucleotide
tggctcagatcacccagcgcaagttgg

SEQ ID NO: 47752 - DNA, 23 bp, Artificial Sequence
  Description of Artificial Sequence: Synthetic oligonucleotide
ctgagagcctacctggagggccc

SEQ ID NO: 47753 - DNA, 24 bp, Artificial Sequence
  Description of Artificial Sequence: Synthetic oligonucleotide
tgagagcctacctggagggcccgt

SEQ ID NO: 47754 - DNA, 23 bp, Artificial Sequence
  Description of Artificial Sequence: Synthetic oligonucleotide
gagagcctacctggagggcccgt

SEQ ID NO: 47755 - DNA, 23 bp, Artificial Sequence
  Description of Artificial Sequence: Synthetic oligonucleotide
agagcctacctggagggcccgtg

SEQ ID NO: 47756 - DNA, 22 bp, Artificial Sequence
  Description of Artificial Sequence: Synthetic oligonucleotide
gagcctacctggagggcccgtg

SEQ ID NO: 47757 - DNA, 22 bp, Artificial Sequence
  Description of Artificial Sequence: Synthetic oligonucleotide
agcctacctggagggcccgtgc

SEQ ID NO: 47758 - DNA, 21 bp, Artificial Sequence
  Description of Artificial Sequence: Synthetic oligonucleotide
gcctacctggagggcccgtgc

SEQ ID NO: 47759 - DNA, 22 bp, Artificial Sequence
  Description of Artificial Sequence: Synthetic oligonucleotide
cctacctggagggcccgtgcgt

SEQ ID NO: 47760 - DNA, 22 bp, Artificial Sequence
  Description of Artificial Sequence: Synthetic oligonucleotide
ctacctggagggcccgtgcgtg

SEQ ID NO: 47761 - DNA, 23 bp, Artificial Sequence
  Description of Artificial Sequence: Synthetic oligonucleotide
tacctggagggcccgtgcgtgga

SEQ ID NO: 47762 - DNA, 22 bp, Artificial Sequence
  Description of Artificial Sequence: Synthetic oligonucleotide
acctggagggcccgtgcgtgga

SEQ ID NO: 47763 - DNA, 21 bp, Artificial Sequence
  Description of Artificial Sequence: Synthetic oligonucleotide
cctggagggcccgtgcgtgga

SEQ ID NO: 47764 - DNA, 22 bp, Artificial Sequence
  Description of Artificial Sequence: Synthetic oligonucleotide
ctggagggcccgtgcgtggagt

SEQ ID NO: 47765 - DNA, 22 bp, Artificial Sequence
  Description of Artificial Sequence: Synthetic oligonucleotide
tggagggcccgtgcgtggagtg

SEQ ID NO: 47766 - DNA, 21 bp, Artificial Sequence
  Description of Artificial Sequence: Synthetic oligonucleotide
ggagggcccgtgcgtggagtg

SEQ ID NO: 47767 - DNA, 21 bp, Artificial Sequence
  Description of Artificial Sequence: Synthetic oligonucleotide
gagggcccgtgcgtggagtgg

SEQ ID NO: 47768 - DNA, 22 bp, Artificial Sequence
  Description of Artificial Sequence: Synthetic oligonucleotide
agggcccgtgcgtggagtggct

SEQ ID NO: 47769 - DNA, 21 bp, Artificial Sequence
  Description of Artificial Sequence: Synthetic oligonucleotide
gggcccgtgcgtggagtggct

SEQ ID NO: 47770 - DNA, 21 bp, Artificial Sequence
  Description of Artificial Sequence: Synthetic oligonucleotide
ggcccgtgcgtggagtggctc

SEQ ID NO: 47771 - DNA, 21 bp, Artificial Sequence
  Description of Artificial Sequence: Synthetic oligonucleotide
gcccgtgcgtggagtggctcc

SEQ ID NO: 47772 - DNA, 21 bp, Artificial Sequence
  Description of Artificial Sequence: Synthetic oligonucleotide
cccgtgcgtggagtggctccg

SEQ ID NO: 47773 - DNA, 22 bp, Artificial Sequence
  Description of Artificial Sequence: Synthetic oligonucleotide
ccgtgcgtggagtggctccgca

SEQ ID NO: 47774 - DNA, 26 bp, Artificial Sequence
  Description of Artificial Sequence: Synthetic oligonucleotide
ctgagagcctacctggagggcacgtt

SEQ ID NO: 47775 - DNA, 26 bp, Artificial Sequence
  Description of Artificial Sequence: Synthetic oligonucleotide
tgagagcctacctggagggcacgttc

SEQ ID NO: 47776 - DNA, 25 bp, Artificial Sequence
  Description of Artificial Sequence: Synthetic oligonucleotide
gagagcctacctggagggcacgttc

SEQ ID NO: 47777 - DNA, 26 bp, Artificial Sequence
  Description of Artificial Sequence: Synthetic oligonucleotide
agagcctacctggagggcacgttcgt

SEQ ID NO: 47778 - DNA, 25 bp, Artificial Sequence
  Description of Artificial Sequence: Synthetic oligonucleotide
gagcctacctggagggcacgttcgt

SEQ ID NO: 47779 - DNA, 25 bp, Artificial Sequence
  Description of Artificial Sequence: Synthetic oligonucleotide
agcctacctggagggcacgttcgtg

SEQ ID NO: 47780 - DNA, 24 bp, Artificial Sequence
  Description of Artificial Sequence: Synthetic oligonucleotide
gcctacctggagggcacgttcgtg

SEQ ID NO: 47781 - DNA, 25 bp, Artificial Sequence
  Description of Artificial Sequence: Synthetic oligonucleotide
cggctcagatcacccggcgcaagtt

SEQ ID NO: 47782 - DNA, 25 bp, Artificial Sequence
  Description of Artificial Sequence: Synthetic oligonucleotide
ggctcagatcacccggcgcaagttg

SEQ ID NO: 47783 - DNA, 26 bp, Artificial Sequence
  Description of Artificial Sequence: Synthetic oligonucleotide
gctcagatcacccggcgcaagttgga

SEQ ID NO: 47784 - DNA, 26 bp, Artificial Sequence
  Description of Artificial Sequence: Synthetic oligonucleotide
ctcagatcacccggcgcaagttggag

SEQ ID NO: 47785 - DNA, 26 bp, Artificial Sequence
  Description of Artificial Sequence: Synthetic oligonucleotide
tcagatcacccggcgcaagttggagg

SEQ ID NO: 47786 - DNA, 25 bp, Artificial Sequence
  Description of Artificial Sequence: Synthetic oligonucleotide
cagatcacccggcgcaagttggagg

SEQ ID NO: 47787 - DNA, 25 bp, Artificial Sequence
  Description of Artificial Sequence: Synthetic oligonucleotide
agatcacccggcgcaagttggaggc

SEQ ID NO: 47788 - DNA, 24 bp, Artificial Sequence
  Description of Artificial Sequence: Synthetic oligonucleotide
gatcacccggcgcaagttggaggc

SEQ ID NO: 47789 - DNA, 24 bp, Artificial Sequence
  Description of Artificial Sequence: Synthetic oligonucleotide
atcacccggcgcaagttggaggcg

SEQ ID NO: 47790 - DNA, 23 bp, Artificial Sequence
  Description of Artificial Sequence: Synthetic oligonucleotide
tcacccggcgcaagttggaggcg

SEQ ID NO: 47791 - DNA, 22 bp, Artificial Sequence
  Description of Artificial Sequence: Synthetic oligonucleotide
cacccggcgcaagttggaggcg

SEQ ID NO: 47792 - DNA, 22 bp, Artificial Sequence
  Description of Artificial Sequence: Synthetic oligonucleotide
acccggcgcaagttggaggcgg

SEQ ID NO: 47793 - DNA, 21 bp, Artificial Sequence
  Description of Artificial Sequence: Synthetic oligonucleotide
cccggcgcaagttggaggcgg

SEQ ID NO: 47794 - DNA, 21 bp, Artificial Sequence
  Description of Artificial Sequence: Synthetic oligonucleotide
ccggcgcaagttggaggcggc

SEQ ID NO: 47795 - DNA, 21 bp, Artificial Sequence
  Description of Artificial Sequence: Synthetic oligonucleotide
cggcgcaagttggaggcggcc

SEQ ID NO: 47796 - DNA, 21 bp, Artificial Sequence
  Description of Artificial Sequence: Synthetic oligonucleotide
ggcgcaagttggaggcggccc

SEQ ID NO: 47797 - DNA, 23 bp, Artificial Sequence
  Description of Artificial Sequence: Synthetic oligonucleotide
cgccaggcacaggctgaccgaga

SEQ ID NO: 47798 - DNA, 24 bp, Artificial Sequence
  Description of Artificial Sequence: Synthetic oligonucleotide
gccaggcacaggctgaccgagaga

SEQ ID NO: 47799 - DNA, 24 bp, Artificial Sequence
  Description of Artificial Sequence: Synthetic oligonucleotide
ccaggcacaggctgaccgagagag

SEQ ID NO: 47800 - DNA, 24 bp, Artificial Sequence
  Description of Artificial Sequence: Synthetic oligonucleotide
caggcacaggctgaccgagagagc

SEQ ID NO: 47801 - DNA, 25 bp, Artificial Sequence
  Description of Artificial Sequence: Synthetic oligonucleotide
aggcacaggctgaccgagagagcct

SEQ ID NO: 47802 - DNA, 24 bp, Artificial Sequence
  Description of Artificial Sequence: Synthetic oligonucleotide
ggcacaggctgaccgagagagcct

SEQ ID NO: 47803 - DNA, 24 bp, Artificial Sequence
  Description of Artificial Sequence: Synthetic oligonucleotide
gcacaggctgaccgagagagcctg

SEQ ID NO: 47804 - DNA, 21 bp, Artificial Sequence
  Description of Artificial Sequence: Synthetic oligonucleotide
tccgagaggggagccgcggga

SEQ ID NO: 47805 - DNA, 20 bp, Artificial Sequence
  Description of Artificial Sequence: Synthetic oligonucleotide
ccgagaggggagccgcggga

SEQ ID NO: 47806 - DNA, 20 bp, Artificial Sequence
  Description of Artificial Sequence: Synthetic oligonucleotide
cgagaggggagccgcgggag

SEQ ID NO: 47807 - DNA, 20 bp, Artificial Sequence
  Description of Artificial Sequence: Synthetic oligonucleotide
gagaggggagccgcgggagc

SEQ ID NO: 47808 - DNA, 20 bp, Artificial Sequence
  Description of Artificial Sequence: Synthetic oligonucleotide
cgacctggggcccgacggga

SEQ ID NO: 47809 - DNA, 20 bp, Artificial Sequence
  Description of Artificial Sequence: Synthetic oligonucleotide
gacctggggcccgacgggag

SEQ ID NO: 47810 - DNA, 20 bp, Artificial Sequence
  Description of Artificial Sequence: Synthetic oligonucleotide
acctggggcccgacgggagc

SEQ ID NO: 47811 - DNA, 20 bp, Artificial Sequence
  Description of Artificial Sequence: Synthetic oligonucleotide
cctggggcccgacgggagct

SEQ ID NO: 47812 - DNA, 20 bp, Artificial Sequence
  Description of Artificial Sequence: Synthetic oligonucleotide
ctggggcccgacgggagcct

SEQ ID NO: 47813 - DNA, 20 bp, Artificial Sequence
  Description of Artificial Sequence: Synthetic oligonucleotide
tggggcccgacgggagcctc

SEQ ID NO: 47814 - DNA, 20 bp, Artificial Sequence
  Description of Artificial Sequence: Synthetic oligonucleotide
ggggcccgacgggagcctct

SEQ ID NO: 47815 - DNA, 20 bp, Artificial Sequence
  Description of Artificial Sequence: Synthetic oligonucleotide
gggcccgacgggagcctcct

SEQ ID NO: 47816 - DNA, 20 bp, Artificial Sequence
  Description of Artificial Sequence: Synthetic oligonucleotide
ggcccgacgggagcctcctc

SEQ ID NO: 47817 - DNA, 20 bp, Artificial Sequence
  Description of Artificial Sequence: Synthetic oligonucleotide
gcccgacgggagcctcctcc

SEQ ID NO: 47818 - DNA, 20 bp, Artificial Sequence
  Description of Artificial Sequence: Synthetic oligonucleotide
cccgacgggagcctcctccg

SEQ ID NO: 47819 - DNA, 20 bp, Artificial Sequence
  Description of Artificial Sequence: Synthetic oligonucleotide
ccgacgggagcctcctccgc

SEQ ID NO: 47820 - DNA, 20 bp, Artificial Sequence
  Description of Artificial Sequence: Synthetic oligonucleotide
cgacgggagcctcctccgcg

SEQ ID NO: 47821 - DNA, 23 bp, Artificial Sequence
  Description of Artificial Sequence: Synthetic oligonucleotide
acgggagcctcctccgcgggtat

SEQ ID NO: 47822 - DNA, 22 bp, Artificial Sequence
  Description of Artificial Sequence: Synthetic oligonucleotide
cgggagcctcctccgcgggtat

SEQ ID NO: 47823 - DNA, 23 bp, Artificial Sequence
  Description of Artificial Sequence: Synthetic oligonucleotide
gggagcctcctccgcgggtatga

SEQ ID NO: 47824 - DNA, 23 bp, Artificial Sequence
  Description of Artificial Sequence: Synthetic oligonucleotide
ggagcctcctccgcgggtatgac

SEQ ID NO: 47825 - DNA, 24 bp, Artificial Sequence
  Description of Artificial Sequence: Synthetic oligonucleotide
gagcctcctccgcgggtatgacca

SEQ ID NO: 47826 - DNA, 25 bp, Artificial Sequence
  Description of Artificial Sequence: Synthetic oligonucleotide
agcctcctccgcgggtatgaccagt

SEQ ID NO: 47827 - DNA, 23 bp, Artificial Sequence
  Description of Artificial Sequence: Synthetic oligonucleotide
ccgcggggagccccacttcatct

SEQ ID NO: 47828 - DNA, 24 bp, Artificial Sequence
  Description of Artificial Sequence: Synthetic oligonucleotide
cgcggggagccccacttcatctca

SEQ ID NO: 47829 - DNA, 25 bp, Artificial Sequence
  Description of Artificial Sequence: Synthetic oligonucleotide
gcggggagccccacttcatctcagt

SEQ ID NO: 47830 - DNA, 25 bp, Artificial Sequence
  Description of Artificial Sequence: Synthetic oligonucleotide
cggggagccccacttcatctcagtg

SEQ ID NO: 47831 - DNA, 25 bp, Artificial Sequence
  Description of Artificial Sequence: Synthetic oligonucleotide
ggggagccccacttcatctcagtgg

SEQ ID NO: 47832 - DNA, 25 bp, Artificial Sequence
  Description of Artificial Sequence: Synthetic oligonucleotide
gggagccccacttcatctcagtggg

SEQ ID NO: 47833 - DNA, 27 bp, Artificial Sequence
  Description of Artificial Sequence: Synthetic oligonucleotide
ggagccccacttcatctcagtgggcta

SEQ ID NO: 47834 - DNA, 27 bp, Artificial Sequence
  Description of Artificial Sequence: Synthetic oligonucleotide
gagccccacttcatctcagtgggctac

SEQ ID NO: 47835 - DNA, 27 bp, Artificial Sequence
  Description of Artificial Sequence: Synthetic oligonucleotide
agccccacttcatctcagtgggctacg

SEQ ID NO: 47836 - DNA, 27 bp, Artificial Sequence
  Description of Artificial Sequence: Synthetic oligonucleotide
gccccacttcatctcagtgggctacgt

SEQ ID NO: 47837 - DNA, 27 bp, Artificial Sequence
  Description of Artificial Sequence: Synthetic oligonucleotide
ccccacttcatctcagtgggctacgtg

SEQ ID NO: 47838 - DNA, 27 bp, Artificial Sequence
  Description of Artificial Sequence: Synthetic oligonucleotide
cccacttcatctcagtgggctacgtgg

SEQ ID NO: 47839 - DNA, 28 bp, Artificial Sequence
  Description of Artificial Sequence: Synthetic oligonucleotide
ccacttcatctcagtgggctacgtggac

SEQ ID NO: 47840 - DNA, 28 bp, Artificial Sequence
  Description of Artificial Sequence: Synthetic oligonucleotide
cacttcatctcagtgggctacgtggacg

SEQ ID NO: 47841 - DNA, 29 bp, Artificial Sequence
  Description of Artificial Sequence: Synthetic oligonucleotide
acttcatctcagtgggctacgtggacgac

SEQ ID NO: 47842 - DNA, 27 bp, Artificial Sequence
  Description of Artificial Sequence: Synthetic oligonucleotide
agcagctgagagcctacctggagagca

SEQ ID NO: 47843 - DNA, 26 bp, Artificial Sequence
  Description of Artificial Sequence: Synthetic oligonucleotide
gcagctgagagcctacctggagagca

SEQ ID NO: 47844 - DNA, 26 bp, Artificial Sequence
  Description of Artificial Sequence: Synthetic oligonucleotide
cagctgagagcctacctggagagcac

SEQ ID NO: 47845 - DNA, 27 bp, Artificial Sequence
  Description of Artificial Sequence: Synthetic oligonucleotide
agctgagagcctacctggagagcacgt

SEQ ID NO: 47846 - DNA, 26 bp, Artificial Sequence
  Description of Artificial Sequence: Synthetic oligonucleotide
gctgagagcctacctggagagcacgt

SEQ ID NO: 47847 - DNA, 26 bp, Artificial Sequence
  Description of Artificial Sequence: Synthetic oligonucleotide
ctgagagcctacctggagagcacgtg

SEQ ID NO: 47848 - DNA, 26 bp, Artificial Sequence
  Description of Artificial Sequence: Synthetic oligonucleotide
tgagagcctacctggagagcacgtgc

SEQ ID NO: 47849 - DNA, 25 bp, Artificial Sequence
  Description of Artificial Sequence: Synthetic oligonucleotide
gagagcctacctggagagcacgtgc

SEQ ID NO: 47850 - DNA, 26 bp, Artificial Sequence
  Description of Artificial Sequence: Synthetic oligonucleotide
agagcctacctggagagcacgtgcgt

SEQ ID NO: 47851 - DNA, 25 bp, Artificial Sequence
  Description of Artificial Sequence: Synthetic oligonucleotide
gagcctacctggagagcacgtgcgt

SEQ ID NO: 47852 - DNA, 25 bp, Artificial Sequence
  Description of Artificial Sequence: Synthetic oligonucleotide
agcctacctggagagcacgtgcgtg

SEQ ID NO: 47853 - DNA, 24 bp, Artificial Sequence
  Description of Artificial Sequence: Synthetic oligonucleotide
gcctacctggagagcacgtgcgtg

SEQ ID NO: 47854 - DNA, 25 bp, Artificial Sequence
  Description of Artificial Sequence: Synthetic oligonucleotide
cctacctggagagcacgtgcgtgga

SEQ ID NO: 47855 - DNA, 26 bp, Artificial Sequence
  Description of Artificial Sequence: Synthetic oligonucleotide
ctacctggagagcacgtgcgtggagt

SEQ ID NO: 47856 - DNA, 26 bp, Artificial Sequence
  Description of Artificial Sequence: Synthetic oligonucleotide
tacctggagagcacgtgcgtggagtg

SEQ ID NO: 47857 - DNA, 25 bp, Artificial Sequence
  Description of Artificial Sequence: Synthetic oligonucleotide
acctggagagcacgtgcgtggagtg

SEQ ID NO: 47858 - DNA, 24 bp, Artificial Sequence
  Description of Artificial Sequence: Synthetic oligonucleotide
cctggagagcacgtgcgtggagtg

SEQ ID NO: 47859 - DNA, 24 bp, Artificial Sequence
  Description of Artificial Sequence: Synthetic oligonucleotide
ctggagagcacgtgcgtggagtgg

SEQ ID NO: 47860 - DNA, 25 bp, Artificial Sequence
  Description of Artificial Sequence: Synthetic oligonucleotide
tggagagcacgtgcgtggagtggct

SEQ ID NO: 47861 - DNA, 24 bp, Artificial Sequence
  Description of Artificial Sequence: Synthetic oligonucleotide
ggagagcacgtgcgtggagtggct

SEQ ID NO: 47862 - DNA, 24 bp, Artificial Sequence
  Description of Artificial Sequence: Synthetic oligonucleotide
gagagcacgtgcgtggagtggctc

SEQ ID NO: 47863 - DNA, 24 bp, Artificial Sequence
  Description of Artificial Sequence: Synthetic oligonucleotide
agagcacgtgcgtggagtggctcc

SEQ ID NO: 47864 - DNA, 23 bp, Artificial Sequence
  Description of Artificial Sequence: Synthetic oligonucleotide
gagcacgtgcgtggagtggctcc

SEQ ID NO: 47865 - DNA, 23 bp, Artificial Sequence
  Description of Artificial Sequence: Synthetic oligonucleotide
agcacgtgcgtggagtggctccg

SEQ ID NO: 47866 - DNA, 28 bp, Artificial Sequence
  Description of Artificial Sequence: Synthetic oligonucleotide
gcagtattgggaccgggagacacagaac

SEQ ID NO: 47867 - DNA, 30 bp, Artificial Sequence
  Description of Artificial Sequence: Synthetic oligonucleotide
cagtattgggaccgggagacacagaactac

SEQ ID NO: 47868 - DNA, 22 bp, Artificial Sequence
  Description of Artificial Sequence: Synthetic oligonucleotide
ctcctggaccgccgcggacaac

SEQ ID NO: 47869 - DNA, 22 bp, Artificial Sequence
  Description of Artificial Sequence: Synthetic oligonucleotide
tcctggaccgccgcggacaacg

SEQ ID NO: 47870 - DNA, 21 bp, Artificial Sequence
  Description of Artificial Sequence: Synthetic oligonucleotide
cctggaccgccgcggacaacg

SEQ ID NO: 47871 - DNA, 21 bp, Artificial Sequence
  Description of Artificial Sequence: Synthetic oligonucleotide
ctggaccgccgcggacaacgc

SEQ ID NO: 47872 - DNA, 21 bp, Artificial Sequence
  Description of Artificial Sequence: Synthetic oligonucleotide
tggaccgccgcggacaacgcg

SEQ ID NO: 47873 - DNA, 20 bp, Artificial Sequence
  Description of Artificial Sequence: Synthetic oligonucleotide
ggaccgccgcggacaacgcg

SEQ ID NO: 47874 - DNA, 20 bp, Artificial Sequence
  Description of Artificial Sequence: Synthetic oligonucleotide
gaccgccgcggacaacgcgg

SEQ ID NO: 47875 - DNA, 21 bp, Artificial Sequence
  Description of Artificial Sequence: Synthetic oligonucleotide
accgccgcggacaacgcggct

SEQ ID NO: 47876 - DNA, 20 bp, Artificial Sequence
  Description of Artificial Sequence: Synthetic oligonucleotide
ccgccgcggacaacgcggct

SEQ ID NO: 47877 - DNA, 21 bp, Artificial Sequence
  Description of Artificial Sequence: Synthetic oligonucleotide
cgccgcggacaacgcggctca

SEQ ID NO: 47878 - DNA, 23 bp, Artificial Sequence
  Description of Artificial Sequence: Synthetic oligonucleotide
gccgcggacaacgcggctcagat

SEQ ID NO: 47879 - DNA, 24 bp, Artificial Sequence
  Description of Artificial Sequence: Synthetic oligonucleotide
ccgcggacaacgcggctcagatca

SEQ ID NO: 47880 - DNA, 24 bp, Artificial Sequence
  Description of Artificial Sequence: Synthetic oligonucleotide
cgcggacaacgcggctcagatcac

SEQ ID NO: 47881 - DNA, 24 bp, Artificial Sequence
  Description of Artificial Sequence: Synthetic oligonucleotide
gcggacaacgcggctcagatcacc

SEQ ID NO: 47882 - DNA, 25 bp, Artificial Sequence
  Description of Artificial Sequence: Synthetic oligonucleotide
cggacaacgcggctcagatcaccca

SEQ ID NO: 47883 - DNA, 25 bp, Artificial Sequence
  Description of Artificial Sequence: Synthetic oligonucleotide
ggacaacgcggctcagatcacccag

SEQ ID NO: 47884 - DNA, 25 bp, Artificial Sequence
  Description of Artificial Sequence: Synthetic oligonucleotide
gacaacgcggctcagatcacccagc

SEQ ID NO: 47885 - DNA, 25 bp, Artificial Sequence
  Description of Artificial Sequence: Synthetic oligonucleotide
acaacgcggctcagatcacccagcg

SEQ ID NO: 47886 - DNA, 24 bp, Artificial Sequence
  Description of Artificial Sequence: Synthetic oligonucleotide
caacgcggctcagatcacccagcg

SEQ ID NO: 47887 - DNA, 26 bp, Artificial Sequence
  Description of Artificial Sequence: Synthetic oligonucleotide
aacgcggctcagatcacccagcgcaa

SEQ ID NO: 47888 - DNA, 25 bp, Artificial Sequence
  Description of Artificial Sequence: Synthetic oligonucleotide
acgcggctcagatcacccagcgcaa

SEQ ID NO: 47889 - DNA, 28 bp, Artificial Sequence
  Description of Artificial Sequence: Synthetic oligonucleotide
gctcccactccctgaggtatttcgacac

SEQ ID NO: 47890 - DNA, 28 bp, Artificial Sequence
  Description of Artificial Sequence: Synthetic oligonucleotide
ctcccactccctgaggtatttcgacacc

SEQ ID NO: 47891 - DNA, 28 bp, Artificial Sequence
  Description of Artificial Sequence: Synthetic oligonucleotide
tcccactccctgaggtatttcgacaccg

SEQ ID NO: 47892 - DNA, 27 bp, Artificial Sequence
  Description of Artificial Sequence: Synthetic oligonucleotide
cccactccctgaggtatttcgacaccg

SEQ ID NO: 47893 - DNA, 27 bp, Artificial Sequence
  Description of Artificial Sequence: Synthetic oligonucleotide
ccactccctgaggtatttcgacaccgc

SEQ ID NO: 47894 - DNA, 27 bp, Artificial Sequence
  Description of Artificial Sequence: Synthetic oligonucleotide
cactccctgaggtatttcgacaccgcc

SEQ ID NO: 47895 - DNA, 27 bp, Artificial Sequence
  Description of Artificial Sequence: Synthetic oligonucleotide
actccctgaggtatttcgacaccgccg

SEQ ID NO: 47896 - DNA, 27 bp, Artificial Sequence
  Description of Artificial Sequence: Synthetic oligonucleotide
ctccctgaggtatttcgacaccgccgt

SEQ ID NO: 47897 - DNA, 27 bp, Artificial Sequence
  Description of Artificial Sequence: Synthetic oligonucleotide
tccctgaggtatttcgacaccgccgtg

SEQ ID NO: 47898 - DNA, 27 bp, Artificial Sequence
  Description of Artificial Sequence: Synthetic oligonucleotide
ccctgaggtatttcgacaccgccgtgt

SEQ ID NO: 47899 - DNA, 27 bp, Artificial Sequence
  Description of Artificial Sequence: Synthetic oligonucleotide
cctgaggtatttcgacaccgccgtgtc

SEQ ID NO: 47900 - DNA, 27 bp, Artificial Sequence
  Description of Artificial Sequence: Synthetic oligonucleotide
ctgaggtatttcgacaccgccgtgtcc

SEQ ID NO: 47901 - DNA, 28 bp, Artificial Sequence
  Description of Artificial Sequence: Synthetic oligonucleotide
gctcccactccatgagggatttcgacac

SEQ ID NO: 47902 - DNA, 28 bp, Artificial Sequence
  Description of Artificial Sequence: Synthetic oligonucleotide
ctcccactccatgagggatttcgacacc

SEQ ID NO: 47903 - DNA, 28 bp, Artificial Sequence
  Description of Artificial Sequence: Synthetic oligonucleotide
tcccactccatgagggatttcgacaccg

SEQ ID NO: 47904 - DNA, 27 bp, Artificial Sequence
  Description of Artificial Sequence: Synthetic oligonucleotide
cccactccatgagggatttcgacaccg

SEQ ID NO: 47905 - DNA, 27 bp, Artificial Sequence
  Description of Artificial Sequence: Synthetic oligonucleotide
ccactccatgagggatttcgacaccgc

SEQ ID NO: 47906 - DNA, 27 bp, Artificial Sequence
  Description of Artificial Sequence: Synthetic oligonucleotide
cactccatgagggatttcgacaccgcc

SEQ ID NO: 47907 - DNA, 27 bp, Artificial Sequence
  Description of Artificial Sequence: Synthetic oligonucleotide
actccatgagggatttcgacaccgccg

SEQ ID NO: 47908 - DNA, 27 bp, Artificial Sequence
  Description of Artificial Sequence: Synthetic oligonucleotide
ctccatgagggatttcgacaccgccgt

SEQ ID NO: 47909 - DNA, 27 bp, Artificial Sequence
  Description of Artificial Sequence: Synthetic oligonucleotide
tccatgagggatttcgacaccgccgtg

SEQ ID NO: 47910 - DNA, 27 bp, Artificial Sequence
  Description of Artificial Sequence: Synthetic oligonucleotide
ccatgagggatttcgacaccgccgtgt

SEQ ID NO: 47911 - DNA, 27 bp, Artificial Sequence
  Description of Artificial Sequence: Synthetic oligonucleotide
catgagggatttcgacaccgccgtgtc

SEQ ID NO: 47912 - DNA, 27 bp, Artificial Sequence
  Description of Artificial Sequence: Synthetic oligonucleotide
atgagggatttcgacaccgccgtgtcc

SEQ ID NO: 47913 - DNA, 26 bp, Artificial Sequence
  Description of Artificial Sequence: Synthetic oligonucleotide
tgagggatttcgacaccgccgtgtcc

SEQ ID NO: 47914 - DNA, 25 bp, Artificial Sequence
  Description of Artificial Sequence: Synthetic oligonucleotide
gagggatttcgacaccgccgtgtcc

SEQ ID NO: 47915 - DNA, 25 bp, Artificial Sequence
  Description of Artificial Sequence: Synthetic oligonucleotide
agggatttcgacaccgccgtgtccc

SEQ ID NO: 47916 - DNA, 24 bp, Artificial Sequence
  Description of Artificial Sequence: Synthetic oligonucleotide
gggatttcgacaccgccgtgtccc

SEQ ID NO: 47917 - DNA, 24 bp, Artificial Sequence
  Description of Artificial Sequence: Synthetic oligonucleotide
ggatttcgacaccgccgtgtcccg

SEQ ID NO: 47918 - DNA, 24 bp, Artificial Sequence
  Description of Artificial Sequence: Synthetic oligonucleotide
gatttcgacaccgccgtgtcccgg

SEQ ID NO: 47919 - DNA, 26 bp, Artificial Sequence
  Description of Artificial Sequence: Synthetic oligonucleotide
gacgacacgcagttcgtgcggttcca

SEQ ID NO: 47920 - DNA, 27 bp, Artificial Sequence
  Description of Artificial Sequence: Synthetic oligonucleotide
acgacacgcagttcgtgcggttccaca

SEQ ID NO: 47921 - DNA, 26 bp, Artificial Sequence
  Description of Artificial Sequence: Synthetic oligonucleotide
cgacacgcagttcgtgcggttccaca

SEQ ID NO: 47922 - DNA, 26 bp, Artificial Sequence
  Description of Artificial Sequence: Synthetic oligonucleotide
gacacgcagttcgtgcggttccacag

SEQ ID NO: 47923 - DNA, 26 bp, Artificial Sequence
  Description of Artificial Sequence: Synthetic oligonucleotide
acacgcagttcgtgcggttccacagc

SEQ ID NO: 47924 - DNA, 25 bp, Artificial Sequence
  Description of Artificial Sequence: Synthetic oligonucleotide
cacgcagttcgtgcggttccacagc

SEQ ID NO: 47925 - DNA, 26 bp, Artificial Sequence
  Description of Artificial Sequence: Synthetic oligonucleotide
acgcagttcgtgcggttccacagcga

SEQ ID NO: 47926 - DNA, 25 bp, Artificial Sequence
  Description of Artificial Sequence: Synthetic oligonucleotide
cgcagttcgtgcggttccacagcga

SEQ ID NO: 47927 - DNA, 25 bp, Artificial Sequence
  Description of Artificial Sequence: Synthetic oligonucleotide
gcagttcgtgcggttccacagcgac

SEQ ID NO: 47928 - DNA, 25 bp, Artificial Sequence
  Description of Artificial Sequence: Synthetic oligonucleotide
cagttcgtgcggttccacagcgacg

SEQ ID NO: 47929 - DNA, 25 bp, Artificial Sequence
  Description of Artificial Sequence: Synthetic oligonucleotide
agttcgtgcggttccacagcgacgc

SEQ ID NO: 47930 - DNA, 24 bp, Artificial Sequence
  Description of Artificial Sequence: Synthetic oligonucleotide
gttcgtgcggttccacagcgacgc

SEQ ID NO: 47931 - DNA, 24 bp, Artificial Sequence
  Description of Artificial Sequence: Synthetic oligonucleotide
ttcgtgcggttccacagcgacgcc

SEQ ID NO: 47932 - DNA, 23 bp, Artificial Sequence
  Description of Artificial Sequence: Synthetic oligonucleotide
tcgtgcggttccacagcgacgcc

SEQ ID NO: 47933 - DNA, 22 bp, Artificial Sequence
  Description of Artificial Sequence: Synthetic oligonucleotide
cgtgcggttccacagcgacgcc

SEQ ID NO: 47934 - DNA, 22 bp, Artificial Sequence
  Description of Artificial Sequence: Synthetic oligonucleotide
gtgcggttccacagcgacgccg

SEQ ID NO: 47935 - DNA, 22 bp, Artificial Sequence
  Description of Artificial Sequence: Synthetic oligonucleotide
tgcggttccacagcgacgccgc

SEQ ID NO: 47936 - DNA, 21 bp, Artificial Sequence
  Description of Artificial Sequence: Synthetic oligonucleotide
gcggttccacagcgacgccgc

SEQ ID NO: 47937 - DNA, 22 bp, Artificial Sequence
  Description of Artificial Sequence: Synthetic oligonucleotide
cggttccacagcgacgccgcga

SEQ ID NO: 47938 - DNA, 23 bp, Artificial Sequence
  Description of Artificial Sequence: Synthetic oligonucleotide
aagttggaggcggcccgtgcggt

SEQ ID NO: 47939 - DNA, 22 bp, Artificial Sequence
  Description of Artificial Sequence: Synthetic oligonucleotide
agttggaggcggcccgtgcggt

SEQ ID NO: 47940 - DNA, 21 bp, Artificial Sequence
  Description of Artificial Sequence: Synthetic oligonucleotide
gttggaggcggcccgtgcggt

SEQ ID NO: 47941 - DNA, 21 bp, Artificial Sequence
  Description of Artificial Sequence: Synthetic oligonucleotide
ttggaggcggcccgtgcggtg

SEQ ID NO: 47942 - DNA, 20 bp, Artificial Sequence
  Description of Artificial Sequence: Synthetic oligonucleotide
tggaggcggcccgtgcggtg

SEQ ID NO: 47943 - DNA, 20 bp, Artificial Sequence
  Description of Artificial Sequence: Synthetic oligonucleotide
ggaggcggcccgtgcggtgt

SEQ ID NO: 47944 - DNA, 20 bp, Artificial Sequence
  Description of Artificial Sequence: Synthetic oligonucleotide
gaggcggcccgtgcggtgga

SEQ ID NO: 47945 - DNA, 20 bp, Artificial Sequence
  Description of Artificial Sequence: Synthetic oligonucleotide
aggcggcccgtgcggtggag

SEQ ID NO: 47946 - DNA, 20 bp, Artificial Sequence
  Description of Artificial Sequence: Synthetic oligonucleotide
ggcggcccgtgcggtggagt

SEQ ID NO: 47947 - DNA, 20 bp, Artificial Sequence
  Description of Artificial Sequence: Synthetic oligonucleotide
gcggcccgtgcggtggagca

SEQ ID NO: 47948 - DNA, 20 bp, Artificial Sequence
  Description of Artificial Sequence: Synthetic oligonucleotide
cggcccgtgcggtggagcag

SEQ ID NO: 47949 - DNA, 21 bp, Artificial Sequence
  Description of Artificial Sequence: Synthetic oligonucleotide
ggcccgtgcggtggagcagct

SEQ ID NO: 47950 - DNA, 22 bp, Artificial Sequence
  Description of Artificial Sequence: Synthetic oligonucleotide
gcccgtgcggtggagcagctga

SEQ ID NO: 47951 - DNA, 23 bp, Artificial Sequence
  Description of Artificial Sequence: Synthetic oligonucleotide
cccgtgcggtggagcagctgaga

SEQ ID NO: 47952 - DNA, 23 bp, Artificial Sequence
  Description of Artificial Sequence: Synthetic oligonucleotide
ccgtgcggtggagcagctgagag

SEQ ID NO: 47953 - DNA, 23 bp, Artificial Sequence
  Description of Artificial Sequence: Synthetic oligonucleotide
cgtgcggtggagcagctgagagc

SEQ ID NO: 47954 - DNA, 25 bp, Artificial Sequence
  Description of Artificial Sequence: Synthetic oligonucleotide
gtgcggtggagcagctgagagccta

SEQ ID NO: 47955 - DNA, 25 bp, Artificial Sequence
  Description of Artificial Sequence: Synthetic oligonucleotide
tgcggtggagcagctgagagcctac

SEQ ID NO: 47956 - DNA, 24 bp, Artificial Sequence
  Description of Artificial Sequence: Synthetic oligonucleotide
gcggtggagcagctgagagcctac

SEQ ID NO: 47957 - DNA, 25 bp, Artificial Sequence
  Description of Artificial Sequence: Synthetic oligonucleotide
cggtggagcagctgagagcctacct

SEQ ID NO: 47958 - DNA, 21 bp, Artificial Sequence
  Description of Artificial Sequence: Synthetic oligonucleotide
ggcccgtgcggcggagcagtt

SEQ ID NO: 47959 - DNA, 22 bp, Artificial Sequence
  Description of Artificial Sequence: Synthetic oligonucleotide
gcccgtgcggcggagcagttga

SEQ ID NO: 47960 - DNA, 24 bp, Artificial Sequence
  Description of Artificial Sequence: Synthetic oligonucleotide
cccgtgcggcggagcagttgagaa

SEQ ID NO: 47961 - DNA, 24 bp, Artificial Sequence
  Description of Artificial Sequence: Synthetic oligonucleotide
ccgtgcggcggagcagttgagaac

SEQ ID NO: 47962 - DNA, 26 bp, Artificial Sequence
  Description of Artificial Sequence: Synthetic oligonucleotide
cgtgcggcggagcagttgagaaccta

SEQ ID NO: 47963 - DNA, 26 bp, Artificial Sequence
  Description of Artificial Sequence: Synthetic oligonucleotide
gtgcggcggagcagttgagaacctac

SEQ ID NO: 47964 - DNA, 27 bp, Artificial Sequence
  Description of Artificial Sequence: Synthetic oligonucleotide
tgcggcggagcagttgagaacctacct

SEQ ID NO: 47965 - DNA, 26 bp, Artificial Sequence
  Description of Artificial Sequence: Synthetic oligonucleotide
gcggcggagcagttgagaacctacct

SEQ ID NO: 47966 - DNA, 26 bp, Artificial Sequence
  Description of Artificial Sequence: Synthetic oligonucleotide
cggcggagcagttgagaacctacctg

SEQ ID NO: 47967 - DNA, 27 bp, Artificial Sequence
  Description of Artificial Sequence: Synthetic oligonucleotide
ggcggagcagttgagaacctacctgga

SEQ ID NO: 47968 - DNA, 27 bp, Artificial Sequence
  Description of Artificial Sequence: Synthetic oligonucleotide
gcggagcagttgagaacctacctggag

SEQ ID NO: 47969 - DNA, 27 bp, Artificial Sequence
  Description of Artificial Sequence: Synthetic oligonucleotide
cggagcagttgagaacctacctggagg

SEQ ID NO: 47970 - DNA, 27 bp, Artificial Sequence
  Description of Artificial Sequence: Synthetic oligonucleotide
ggagcagttgagaacctacctggaggg

SEQ ID NO: 47971 - DNA, 27 bp, Artificial Sequence
  Description of Artificial Sequence: Synthetic oligonucleotide
gagcagttgagaacctacctggagggc

SEQ ID NO: 47972 - DNA, 28 bp, Artificial Sequence
  Description of Artificial Sequence: Synthetic oligonucleotide
agcagttgagaacctacctggagggcac

SEQ ID NO: 47973 - DNA, 27 bp, Artificial Sequence
  Description of Artificial Sequence: Synthetic oligonucleotide
gcagttgagaacctacctggagggcac

SEQ ID NO: 47974 - DNA, 27 bp, Artificial Sequence
  Description of Artificial Sequence: Synthetic oligonucleotide
cagttgagaacctacctggagggcacg

SEQ ID NO: 47975 - DNA, 28 bp, Artificial Sequence
  Description of Artificial Sequence: Synthetic oligonucleotide
agttgagaacctacctggagggcacgtg

SEQ ID NO: 47976 - DNA, 27 bp, Artificial Sequence
  Description of Artificial Sequence: Synthetic oligonucleotide
gttgagaacctacctggagggcacgtg

SEQ ID NO: 47977 - DNA, 27 bp, Artificial Sequence
  Description of Artificial Sequence: Synthetic oligonucleotide
ttgagaacctacctggagggcacgtgc

SEQ ID NO: 47978 - DNA, 29 bp, Artificial Sequence
  Description of Artificial Sequence: Synthetic oligonucleotide
gctcccactccatgaggtatatcgacacc

SEQ ID NO: 47979 - DNA, 29 bp, Artificial Sequence
  Description of Artificial Sequence: Synthetic oligonucleotide
ctcccactccatgaggtatatcgacaccg

SEQ ID NO: 47980 - DNA, 29 bp, Artificial Sequence
  Description of Artificial Sequence: Synthetic oligonucleotide
tcccactccatgaggtatatcgacaccgc

SEQ ID NO: 47981 - DNA, 28 bp, Artificial Sequence
  Description of Artificial Sequence: Synthetic oligonucleotide
cccactccatgaggtatatcgacaccgc

SEQ ID NO: 47982 - DNA, 28 bp, Artificial Sequence
  Description of Artificial Sequence: Synthetic oligonucleotide
ccactccatgaggtatatcgacaccgcc

SEQ ID NO: 47983 - DNA, 28 bp, Artificial Sequence
  Description of Artificial Sequence: Synthetic oligonucleotide
cactccatgaggtatatcgacaccgccg

SEQ ID NO: 47984 - DNA, 29 bp, Artificial Sequence
  Description of Artificial Sequence: Synthetic oligonucleotide
actccatgaggtatatcgacaccgccgtg

SEQ ID NO: 47985 - DNA, 28 bp, Artificial Sequence
  Description of Artificial Sequence: Synthetic oligonucleotide
ctccatgaggtatatcgacaccgccgtg

SEQ ID NO: 47986 - DNA, 29 bp, Artificial Sequence
  Description of Artificial Sequence: Synthetic oligonucleotide
tccatgaggtatatcgacaccgccgtgtc

SEQ ID NO: 47987 - DNA, 28 bp, Artificial Sequence
  Description of Artificial Sequence: Synthetic oligonucleotide
ccatgaggtatatcgacaccgccgtgtc

SEQ ID NO: 47988 - DNA, 28 bp, Artificial Sequence
  Description of Artificial Sequence: Synthetic oligonucleotide
catgaggtatatcgacaccgccgtgtcc

SEQ ID NO: 47989 - DNA, 28 bp, Artificial Sequence
  Description of Artificial Sequence: Synthetic oligonucleotide
atgaggtatatcgacaccgccgtgtccc

SEQ ID NO: 47990 - DNA, 27 bp, Artificial Sequence
  Description of Artificial Sequence: Synthetic oligonucleotide
tgaggtatatcgacaccgccgtgtccc

SEQ ID NO: 47991 - DNA, 26 bp, Artificial Sequence
  Description of Artificial Sequence: Synthetic oligonucleotide
gaggtatatcgacaccgccgtgtccc

SEQ ID NO: 47992 - DNA, 26 bp, Artificial Sequence
  Description of Artificial Sequence: Synthetic oligonucleotide
aggtatatcgacaccgccgtgtcccg

SEQ ID NO: 47993 - DNA, 25 bp, Artificial Sequence
  Description of Artificial Sequence: Synthetic oligonucleotide
ggtatatcgacaccgccgtgtcccg

SEQ ID NO: 47994 - DNA, 25 bp, Artificial Sequence
  Description of Artificial Sequence: Synthetic oligonucleotide
gtatatcgacaccgccgtgtcccgg

SEQ ID NO: 47995 - DNA, 25 bp, Artificial Sequence
  Description of Artificial Sequence: Synthetic oligonucleotide
tatatcgacaccgccgtgtcccggc

SEQ ID NO: 47996 - DNA, 24 bp, Artificial Sequence
  Description of Artificial Sequence: Synthetic oligonucleotide
atatcgacaccgccgtgtcccggc

SEQ ID NO: 47997 - DNA, 23 bp, Artificial Sequence
  Description of Artificial Sequence: Synthetic oligonucleotide
tatcgacaccgccgtgtcccggc

SEQ ID NO: 47998 - DNA, 22 bp, Artificial Sequence
  Description of Artificial Sequence: Synthetic oligonucleotide
atcgacaccgccgtgtcccggc

SEQ ID NO: 47999 - DNA, 21 bp, Artificial Sequence
  Description of Artificial Sequence: Synthetic oligonucleotide
gctgcgacctggggcccgaca

SEQ ID NO: 48000 - DNA, 21 bp, Artificial Sequence
  Description of Artificial Sequence: Synthetic oligonucleotide
ctgcgacctggggcccgacag

SEQ ID NO: 48001 - DNA, 21 bp, Artificial Sequence
  Description of Artificial Sequence: Synthetic oligonucleotide
tgcgacctggggcccgacagg

SEQ ID NO: 48002 - DNA, 20 bp, Artificial Sequence
  Description of Artificial Sequence: Synthetic oligonucleotide
gcgacctggggcccgacagg

SEQ ID NO: 48003 - DNA, 20 bp, Artificial Sequence
  Description of Artificial Sequence: Synthetic oligonucleotide
cgacctggggcccgacaggc

SEQ ID NO: 48004 - DNA, 20 bp, Artificial Sequence
  Description of Artificial Sequence: Synthetic oligonucleotide
gacctggggcccgacaggcg

SEQ ID NO: 48005 - DNA, 20 bp, Artificial Sequence
  Description of Artificial Sequence: Synthetic oligonucleotide
acctggggcccgacaggcgc

SEQ ID NO: 48006 - DNA, 20 bp, Artificial Sequence
  Description of Artificial Sequence: Synthetic oligonucleotide
cctggggcccgacaggcgct

SEQ ID NO: 48007 - DNA, 20 bp, Artificial Sequence
  Description of Artificial Sequence: Synthetic oligonucleotide
ctggggcccgacaggcgcct

SEQ ID NO: 48008 - DNA, 20 bp, Artificial Sequence
  Description of Artificial Sequence: Synthetic oligonucleotide
tggggcccgacgggcgcgtt

SEQ ID NO: 48009 - DNA, 20 bp, Artificial Sequence
  Description of Artificial Sequence: Synthetic oligonucleotide
ggggcccgacgggcgcgttt

SEQ ID NO: 48010 - DNA, 20 bp, Artificial Sequence
  Description of Artificial Sequence: Synthetic oligonucleotide
gggcccgacgggcgcgtctt

SEQ ID NO: 48011 - DNA, 20 bp, Artificial Sequence
  Description of Artificial Sequence: Synthetic oligonucleotide
ggcccgacgggcgcgtcctt

SEQ ID NO: 48012 - DNA, 20 bp, Artificial Sequence
  Description of Artificial Sequence: Synthetic oligonucleotide
gcccgacgggcgcgtcctct

SEQ ID NO: 48013 - DNA, 20 bp, Artificial Sequence
  Description of Artificial Sequence: Synthetic oligonucleotide
cccgacgggcgcgtcctcct

SEQ ID NO: 48014 - DNA, 20 bp, Artificial Sequence
  Description of Artificial Sequence: Synthetic oligonucleotide
ccgacgggcgcgtcctccgt

SEQ ID NO: 48015 - DNA, 20 bp, Artificial Sequence
  Description of Artificial Sequence: Synthetic oligonucleotide
cgacgggcgcgtcctccgct

SEQ ID NO: 48016 - DNA, 21 bp, Artificial Sequence
  Description of Artificial Sequence: Synthetic oligonucleotide
gggcgcgtcctccgcgggtat

SEQ ID NO: 48017 - DNA, 22 bp, Artificial Sequence
  Description of Artificial Sequence: Synthetic oligonucleotide
ggcgcgtcctccgcgggtatga

SEQ ID NO: 48018 - DNA, 22 bp, Artificial Sequence
  Description of Artificial Sequence: Synthetic oligonucleotide
gcgcgtcctccgcgggtatgac

SEQ ID NO: 48019 - DNA, 23 bp, Artificial Sequence
  Description of Artificial Sequence: Synthetic oligonucleotide
cgcgtcctccgcgggtatgacca

SEQ ID NO: 48020 - DNA, 24 bp, Artificial Sequence
  Description of Artificial Sequence: Synthetic oligonucleotide
gcgtcctccgcgggtatgaccagt

SEQ ID NO: 48021 - DNA, 24 bp, Artificial Sequence
  Description of Artificial Sequence: Synthetic oligonucleotide
cgtcctccgcgggtatgaccagtc

SEQ ID NO: 48022 - DNA, 24 bp, Artificial Sequence
  Description of Artificial Sequence: Synthetic oligonucleotide
gtcctccgcgggtatgaccagtcc

SEQ ID NO: 48023 - DNA, 26 bp, Artificial Sequence
  Description of Artificial Sequence: Synthetic oligonucleotide
cgggtatgaccagtccgcctacgact

SEQ ID NO: 48024 - DNA, 26 bp, Artificial Sequence
  Description of Artificial Sequence: Synthetic oligonucleotide
gggtatgaccagtccgcctacgactg

SEQ ID NO: 48025 - DNA, 27 bp, Artificial Sequence
  Description of Artificial Sequence: Synthetic oligonucleotide
ggtatgaccagtccgcctacgactgca

SEQ ID NO: 48026 - DNA, 28 bp, Artificial Sequence
  Description of Artificial Sequence: Synthetic oligonucleotide
gtatgaccagtccgcctacgactgcaag

SEQ ID NO: 48027 - DNA, 28 bp, Artificial Sequence
  Description of Artificial Sequence: Synthetic oligonucleotide
tatgaccagtccgcctacgactgcaagg

SEQ ID NO: 48028 - DNA, 27 bp, Artificial Sequence
  Description of Artificial Sequence: Synthetic oligonucleotide
atgaccagtccgcctacgactgcaagg

SEQ ID NO: 48029 - DNA, 27 bp, Artificial Sequence
  Description of Artificial Sequence: Synthetic oligonucleotide
tgaccagtccgcctacgactgcaagga

SEQ ID NO: 48030 - DNA, 27 bp, Artificial Sequence
  Description of Artificial Sequence: Synthetic oligonucleotide
gaccagtccgcctacgactgcaaggat

SEQ ID NO: 48031 - DNA, 29 bp, Artificial Sequence
  Description of Artificial Sequence: Synthetic oligonucleotide
accagtccgcctacgactgcaaggattac

SEQ ID NO: 48032 - DNA, 28 bp, Artificial Sequence
  Description of Artificial Sequence: Synthetic oligonucleotide
ccagtccgcctacgactgcaaggattac

SEQ ID NO: 48033 - DNA, 30 bp, Artificial Sequence
  Description of Artificial Sequence: Synthetic oligonucleotide
cagtccgcctacgactgcaaggattacatc

SEQ ID NO: 48034 - DNA, 30 bp, Artificial Sequence
  Description of Artificial Sequence: Synthetic oligonucleotide
agtccgcctacgactgcaaggattacatcg

SEQ ID NO: 48035 - DNA, 29 bp, Artificial Sequence
  Description of Artificial Sequence: Synthetic oligonucleotide
gtccgcctacgactgcaaggattacatcg

SEQ ID NO: 48036 - DNA, 29 bp, Artificial Sequence
  Description of Artificial Sequence: Synthetic oligonucleotide
tccgcctacgactgcaaggattacatcgc

SEQ ID NO: 48037 - DNA, 28 bp, Artificial Sequence
  Description of Artificial Sequence: Synthetic oligonucleotide
ccgcctacgactgcaaggattacatcgc

SEQ ID NO: 48038 - DNA, 29 bp, Artificial Sequence
  Description of Artificial Sequence: Synthetic oligonucleotide
attacatcgccctgaacgaggacctgcac

SEQ ID NO: 48039 - DNA, 28 bp, Artificial Sequence
  Description of Artificial Sequence: Synthetic oligonucleotide
ttacatcgccctgaacgaggacctgcac

SEQ ID NO: 48040 - DNA, 27 bp, Artificial Sequence
  Description of Artificial Sequence: Synthetic oligonucleotide
tacatcgccctgaacgaggacctgcac

SEQ ID NO: 48041 - DNA, 27 bp, Artificial Sequence
  Description of Artificial Sequence: Synthetic oligonucleotide
acatcgccctgaacgaggacctgcact

SEQ ID NO: 48042 - DNA, 26 bp, Artificial Sequence
  Description of Artificial Sequence: Synthetic oligonucleotide
catcgccctgaacgaggacctgcact

SEQ ID NO: 48043 - DNA, 26 bp, Artificial Sequence
  Description of Artificial Sequence: Synthetic oligonucleotide
atcgccctgaacgaggacctgcactc

SEQ ID NO: 48044 - DNA, 25 bp, Artificial Sequence
  Description of Artificial Sequence: Synthetic oligonucleotide
tcgccctgaacgaggacctgcactc

SEQ ID NO: 48045 - DNA, 24 bp, Artificial Sequence
  Description of Artificial Sequence: Synthetic oligonucleotide
cgccctgaacgaggacctgcactc

SEQ ID NO: 48046 - DNA, 25 bp, Artificial Sequence
  Description of Artificial Sequence: Synthetic oligonucleotide
gccctgaacgaggacctgcactcct

SEQ ID NO: 48047 - DNA, 25 bp, Artificial Sequence
  Description of Artificial Sequence: Synthetic oligonucleotide
ccctgaacgaggacctgcactcctg

SEQ ID NO: 48048 - DNA, 26 bp, Artificial Sequence
  Description of Artificial Sequence: Synthetic oligonucleotide
cctgaacgaggacctgcactcctgga

SEQ ID NO: 48049 - DNA, 26 bp, Artificial Sequence
  Description of Artificial Sequence: Synthetic oligonucleotide
ctgaacgaggacctgcactcctggac

SEQ ID NO: 48050 - DNA, 26 bp, Artificial Sequence
  Description of Artificial Sequence: Synthetic oligonucleotide
tgaacgaggacctgcactcctggacc

SEQ ID NO: 48051 - DNA, 25 bp, Artificial Sequence
  Description of Artificial Sequence: Synthetic oligonucleotide
gaacgaggacctgcactcctggacc

SEQ ID NO: 48052 - DNA, 25 bp, Artificial Sequence
  Description of Artificial Sequence: Synthetic oligonucleotide
aacgaggacctgcactcctggaccg

SEQ ID NO: 48053 - DNA, 24 bp, Artificial Sequence
  Description of Artificial Sequence: Synthetic oligonucleotide
acgaggacctgcactcctggaccg

SEQ ID NO: 48054 - DNA, 23 bp, Artificial Sequence
  Description of Artificial Sequence: Synthetic oligonucleotide
cgaggacctgcactcctggaccg

SEQ ID NO: 48055 - DNA, 23 bp, Artificial Sequence
  Description of Artificial Sequence: Synthetic oligonucleotide
gaggacctgcactcctggaccgc

SEQ ID NO: 48056 - DNA, 23 bp, Artificial Sequence
  Description of Artificial Sequence: Synthetic oligonucleotide
aggacctgcactcctggaccgcc

SEQ ID NO: 48057 - DNA, 22 bp, Artificial Sequence
  Description of Artificial Sequence: Synthetic oligonucleotide
ggacctgcactcctggaccgcc

SEQ ID NO: 48058 - DNA, 22 bp, Artificial Sequence
  Description of Artificial Sequence: Synthetic oligonucleotide
gacctgcactcctggaccgccg

SEQ ID NO: 48059 - DNA, 22 bp, Artificial Sequence
  Description of Artificial Sequence: Synthetic oligonucleotide
acctgcactcctggaccgccgc

SEQ ID NO: 48060 - DNA, 21 bp, Artificial Sequence
  Description of Artificial Sequence: Synthetic oligonucleotide
cctgcactcctggaccgccgc

SEQ ID NO: 48061 - DNA, 21 bp, Artificial Sequence
  Description of Artificial Sequence: Synthetic oligonucleotide
ctgcactcctggaccgccgcg

SEQ ID NO: 48062 - DNA, 22 bp, Artificial Sequence
  Description of Artificial Sequence: Synthetic oligonucleotide
tgcactcctggaccgccgcgga

SEQ ID NO: 48063 - DNA, 21 bp, Artificial Sequence
  Description of Artificial Sequence: Synthetic oligonucleotide
gcactcctggaccgccgcgga

SEQ ID NO: 48064 - DNA, 22 bp, Artificial Sequence
  Description of Artificial Sequence: Synthetic oligonucleotide
cactcctggaccgccgcggaca

SEQ ID NO: 48065 - DNA, 22 bp, Artificial Sequence
  Description of Artificial Sequence: Synthetic oligonucleotide
actcctggaccgccgcggacac

SEQ ID NO: 48066 - DNA, 22 bp, Artificial Sequence
  Description of Artificial Sequence: Synthetic oligonucleotide
agtccgagaggggagccgcgga

SEQ ID NO: 48067 - DNA, 21 bp, Artificial Sequence
  Description of Artificial Sequence: Synthetic oligonucleotide
gtccgagaggggagccgcgga

SEQ ID NO: 48068 - DNA, 21 bp, Artificial Sequence
  Description of Artificial Sequence: Synthetic oligonucleotide
tccgagaggggagccgcggac

SEQ ID NO: 48069 - DNA, 20 bp, Artificial Sequence
  Description of Artificial Sequence: Synthetic oligonucleotide
ccgagaggggagccgcggac

SEQ ID NO: 48070 - DNA, 20 bp, Artificial Sequence
  Description of Artificial Sequence: Synthetic oligonucleotide
cgagaggggagccgcggacg

SEQ ID NO: 48071 - DNA, 20 bp, Artificial Sequence
  Description of Artificial Sequence: Synthetic oligonucleotide
gagaggggagccgcggacgc

SEQ ID NO: 48072 - DNA, 20 bp, Artificial Sequence
  Description of Artificial Sequence: Synthetic oligonucleotide
agaggggagccgcggacgcc

SEQ ID NO: 48073 - DNA, 20 bp, Artificial Sequence
  Description of Artificial Sequence: Synthetic oligonucleotide
gaggggagccgcggacgcct

SEQ ID NO: 48074 - DNA, 20 bp, Artificial Sequence
  Description of Artificial Sequence: Synthetic oligonucleotide
aggggagccgcggacgccgt

SEQ ID NO: 48075 - DNA, 20 bp, Artificial Sequence
  Description of Artificial Sequence: Synthetic oligonucleotide
ggggagccgcggacgccgtt

SEQ ID NO: 48076 - DNA, 20 bp, Artificial Sequence
  Description of Artificial Sequence: Synthetic oligonucleotide
gggagccgcggacgccgtgt

SEQ ID NO: 48077 - DNA, 20 bp, Artificial Sequence
  Description of Artificial Sequence: Synthetic oligonucleotide
ggagccgcggacgccgtggt

SEQ ID NO: 48078 - DNA, 20 bp, Artificial Sequence
  Description of Artificial Sequence: Synthetic oligonucleotide
gagccgcggacgccgtgggt

SEQ ID NO: 48079 - DNA, 20 bp, Artificial Sequence
  Description of Artificial Sequence: Synthetic oligonucleotide
agccgcggacgccgtgggtg

SEQ ID NO: 48080 - DNA, 20 bp, Artificial Sequence
  Description of Artificial Sequence: Synthetic oligonucleotide
gccgcggacgccgtgggtgt

SEQ ID NO: 48081 - DNA, 20 bp, Artificial Sequence
  Description of Artificial Sequence: Synthetic oligonucleotide
ccgcggacgccgtgggtgga

SEQ ID NO: 48082 - DNA, 20 bp, Artificial Sequence
  Description of Artificial Sequence: Synthetic oligonucleotide
cgcggacgccgtgggtggag

SEQ ID NO: 48083 - DNA, 21 bp, Artificial Sequence
  Description of Artificial Sequence: Synthetic oligonucleotide
gcggacgccgtgggtggagca

SEQ ID NO: 48084 - DNA, 21 bp, Artificial Sequence
  Description of Artificial Sequence: Synthetic oligonucleotide
cggacgccgtgggtggagcag

SEQ ID NO: 48085 - DNA, 22 bp, Artificial Sequence
  Description of Artificial Sequence: Synthetic oligonucleotide
ggacgccgtgggtggagcagga

SEQ ID NO: 48086 - DNA, 22 bp, Artificial Sequence
  Description of Artificial Sequence: Synthetic oligonucleotide
gacgccgtgggtggagcaggag

SEQ ID NO: 48087 - DNA, 22 bp, Artificial Sequence
  Description of Artificial Sequence: Synthetic oligonucleotide
acgccgtgggtggagcaggagg

SEQ ID NO: 48088 - DNA, 26 bp, Artificial Sequence
  Description of Artificial Sequence: Synthetic oligonucleotide
gagcagctgagagcctacctggagga

SEQ ID NO: 48089 - DNA, 27 bp, Artificial Sequence
  Description of Artificial Sequence: Synthetic oligonucleotide
agcagctgagagcctacctggaggaca

SEQ ID NO: 48090 - DNA, 26 bp, Artificial Sequence
  Description of Artificial Sequence: Synthetic oligonucleotide
gcagctgagagcctacctggaggaca

SEQ ID NO: 48091 - DNA, 26 bp, Artificial Sequence
  Description of Artificial Sequence: Synthetic oligonucleotide
cagctgagagcctacctggaggacac

SEQ ID NO: 48092 - DNA, 27 bp, Artificial Sequence
  Description of Artificial Sequence: Synthetic oligonucleotide
agctgagagcctacctggaggacacgt

SEQ ID NO: 48093 - DNA, 26 bp, Artificial Sequence
  Description of Artificial Sequence: Synthetic oligonucleotide
gctgagagcctacctggaggacacgt

SEQ ID NO: 48094 - DNA, 26 bp, Artificial Sequence
  Description of Artificial Sequence: Synthetic oligonucleotide
ctgagagcctacctggaggacacgtg

SEQ ID NO: 48095 - DNA, 24 bp, Artificial Sequence
  Description of Artificial Sequence: Synthetic oligonucleotide
aagagcccctcaccctgagctggg

SEQ ID NO: 48096 - DNA, 24 bp, Artificial Sequence
  Description of Artificial Sequence: Synthetic oligonucleotide
ggttcgacagcgacgccgcgagtt

SEQ ID NO: 48097 - DNA, 24 bp, Artificial Sequence
  Description of Artificial Sequence: Synthetic oligonucleotide
gttcgacagcgacgccgcgagttc

SEQ ID NO: 48098 - DNA, 25 bp, Artificial Sequence
  Description of Artificial Sequence: Synthetic oligonucleotide
ttcgacagcgacgccgcgagttcga

SEQ ID NO: 48099 - DNA, 24 bp, Artificial Sequence
  Description of Artificial Sequence: Synthetic oligonucleotide
tcgacagcgacgccgcgagttcga

SEQ ID NO: 48100 - DNA, 23 bp, Artificial Sequence
  Description of Artificial Sequence: Synthetic oligonucleotide
cgacagcgacgccgcgagttcga

SEQ ID NO: 48101 - DNA, 24 bp, Artificial Sequence
  Description of Artificial Sequence: Synthetic oligonucleotide
gacagcgacgccgcgagttcgaga

SEQ ID NO: 48102 - DNA, 24 bp, Artificial Sequence
  Description of Artificial Sequence: Synthetic oligonucleotide
acagcgacgccgcgagttcgagag

SEQ ID NO: 48103 - DNA, 23 bp, Artificial Sequence
  Description of Artificial Sequence: Synthetic oligonucleotide
cagcgacgccgcgagttcgagag

SEQ ID NO: 48104 - DNA, 23 bp, Artificial Sequence
  Description of Artificial Sequence: Synthetic oligonucleotide
agcgacgccgcgagttcgagagg

SEQ ID NO: 48105 - DNA, 22 bp, Artificial Sequence
  Description of Artificial Sequence: Synthetic oligonucleotide
gcgacgccgcgagttcgagagg

SEQ ID NO: 48106 - DNA, 22 bp, Artificial Sequence
  Description of Artificial Sequence: Synthetic oligonucleotide
cgacgccgcgagttcgagaggg

SEQ ID NO: 48107 - DNA, 23 bp, Artificial Sequence
  Description of Artificial Sequence: Synthetic oligonucleotide
gacgccgcgagttcgagagggga

SEQ ID NO: 48108 - DNA, 23 bp, Artificial Sequence
  Description of Artificial Sequence: Synthetic oligonucleotide
acgccgcgagttcgagaggggag

SEQ ID NO: 48109 - DNA, 22 bp, Artificial Sequence
  Description of Artificial Sequence: Synthetic oligonucleotide
cgccgcgagttcgagaggggag

SEQ ID NO: 48110 - DNA, 22 bp, Artificial Sequence
  Description of Artificial Sequence: Synthetic oligonucleotide
gccgcgagttcgagaggggagc

SEQ ID NO: 48111 - DNA, 22 bp, Artificial Sequence
  Description of Artificial Sequence: Synthetic oligonucleotide
ccgcgagttcgagaggggagcc

SEQ ID NO: 48112 - DNA, 22 bp, Artificial Sequence
  Description of Artificial Sequence: Synthetic oligonucleotide
cgcgagttcgagaggggagccg

SEQ ID NO: 48113 - DNA, 22 bp, Artificial Sequence
  Description of Artificial Sequence: Synthetic oligonucleotide
gcgagttcgagaggggagccgc

SEQ ID NO: 48114 - DNA, 22 bp, Artificial Sequence
  Description of Artificial Sequence: Synthetic oligonucleotide
cgagttcgagaggggagccgcg

SEQ ID NO: 48115 - DNA, 22 bp, Artificial Sequence
  Description of Artificial Sequence: Synthetic oligonucleotide
gagttcgagaggggagccgcgg

SEQ ID NO: 48116 - DNA, 22 bp, Artificial Sequence
  Description of Artificial Sequence: Synthetic oligonucleotide
agttcgagaggggagccgcggg

SEQ ID NO: 48117 - DNA, 21 bp, Artificial Sequence
  Description of Artificial Sequence: Synthetic oligonucleotide
gttcgagaggggagccgcggg

SEQ ID NO: 48118 - DNA, 21 bp, Artificial Sequence
  Description of Artificial Sequence: Synthetic oligonucleotide
ttcgagaggggagccgcgggc

SEQ ID NO: 48119 - DNA, 20 bp, Artificial Sequence
  Description of Artificial Sequence: Synthetic oligonucleotide
tcgagaggggagccgcgggc

SEQ ID NO: 48120 - DNA, 26 bp, Artificial Sequence
  Description of Artificial Sequence: Synthetic oligonucleotide
gcggctcagatcacccaccgcaagtt

SEQ ID NO: 48121 - DNA, 26 bp, Artificial Sequence
  Description of Artificial Sequence: Synthetic oligonucleotide
cggctcagatcacccaccgcaagttg

SEQ ID NO: 48122 - DNA, 27 bp, Artificial Sequence
  Description of Artificial Sequence: Synthetic oligonucleotide
ggctcagatcacccaccgcaagttgga

SEQ ID NO: 48123 - DNA, 27 bp, Artificial Sequence
  Description of Artificial Sequence: Synthetic oligonucleotide
gctcagatcacccaccgcaagttggag

SEQ ID NO: 48124 - DNA, 27 bp, Artificial Sequence
  Description of Artificial Sequence: Synthetic oligonucleotide
ctcagatcacccaccgcaagttggagg

SEQ ID NO: 48125 - DNA, 27 bp, Artificial Sequence
  Description of Artificial Sequence: Synthetic oligonucleotide
tcagatcacccaccgcaagttggaggc

SEQ ID NO: 48126 - DNA, 26 bp, Artificial Sequence
  Description of Artificial Sequence: Synthetic oligonucleotide
cagatcacccaccgcaagttggaggc

SEQ ID NO: 48127 - DNA, 26 bp, Artificial Sequence
  Description of Artificial Sequence: Synthetic oligonucleotide
agatcacccaccgcaagttggaggcg

SEQ ID NO: 48128 - DNA, 25 bp, Artificial Sequence
  Description of Artificial Sequence: Synthetic oligonucleotide
gatcacccaccgcaagttggaggcg

SEQ ID NO: 48129 - DNA, 25 bp, Artificial Sequence
  Description of Artificial Sequence: Synthetic oligonucleotide
atcacccaccgcaagttggaggcgg

SEQ ID NO: 48130 - DNA, 24 bp, Artificial Sequence
  Description of Artificial Sequence: Synthetic oligonucleotide
tcacccaccgcaagttggaggcgg

SEQ ID NO: 48131 - DNA, 23 bp, Artificial Sequence
  Description of Artificial Sequence: Synthetic oligonucleotide
cacccaccgcaagttggaggcgg

SEQ ID NO: 48132 - DNA, 23 bp, Artificial Sequence
  Description of Artificial Sequence: Synthetic oligonucleotide
acccaccgcaagttggaggcggc

SEQ ID NO: 48133 - DNA, 22 bp, Artificial Sequence
  Description of Artificial Sequence: Synthetic oligonucleotide
cccaccgcaagttggaggcggc

SEQ ID NO: 48134 - DNA, 22 bp, Artificial Sequence
  Description of Artificial Sequence: Synthetic oligonucleotide
ccaccgcaagttggaggcggcc

SEQ ID NO: 48135 - DNA, 22 bp, Artificial Sequence
  Description of Artificial Sequence: Synthetic oligonucleotide
caccgcaagttggaggcggccc

SEQ ID NO: 48136 - DNA, 23 bp, Artificial Sequence
  Description of Artificial Sequence: Synthetic oligonucleotide
accgcaagttggaggcggcccgt

SEQ ID NO: 48137 - DNA, 22 bp, Artificial Sequence
  Description of Artificial Sequence: Synthetic oligonucleotide
ccgcaagttggaggcggcccgt

SEQ ID NO: 48138 - DNA, 24 bp, Artificial Sequence
  Description of Artificial Sequence: Synthetic oligonucleotide
cagcgcaagttggaggcggcccat

SEQ ID NO: 48139 - DNA, 24 bp, Artificial Sequence
  Description of Artificial Sequence: Synthetic oligonucleotide
agcgcaagttggaggcggcccatg

SEQ ID NO: 48140 - DNA, 23 bp, Artificial Sequence
  Description of Artificial Sequence: Synthetic oligonucleotide
gcgcaagttggaggcggcccatg

SEQ ID NO: 48141 - DNA, 23 bp, Artificial Sequence
  Description of Artificial Sequence: Synthetic oligonucleotide
cgcaagttggaggcggcccatgc

SEQ ID NO: 48142 - DNA, 23 bp, Artificial Sequence
  Description of Artificial Sequence: Synthetic oligonucleotide
gcaagttggaggcggcccatgcg

SEQ ID NO: 48143 - DNA, 23 bp, Artificial Sequence
  Description of Artificial Sequence: Synthetic oligonucleotide
caagttggaggcggcccatgcgg

SEQ ID NO: 48144 - DNA, 23 bp, Artificial Sequence
  Description of Artificial Sequence: Synthetic oligonucleotide
aagttggaggcggcccatgcggc

SEQ ID NO: 48145 - DNA, 22 bp, Artificial Sequence
  Description of Artificial Sequence: Synthetic oligonucleotide
agttggaggcggcccatgcggc

SEQ ID NO: 48146 - DNA, 21 bp, Artificial Sequence
  Description of Artificial Sequence: Synthetic oligonucleotide
gttggaggcggcccatgcggc

SEQ ID NO: 48147 - DNA, 21 bp, Artificial Sequence
  Description of Artificial Sequence: Synthetic oligonucleotide
ttggaggcggcccatgcggcg

SEQ ID NO: 48148 - DNA, 20 bp, Artificial Sequence
  Description of Artificial Sequence: Synthetic oligonucleotide
tggaggcggcccatgcggcg

SEQ ID NO: 48149 - DNA, 22 bp, Artificial Sequence
  Description of Artificial Sequence: Synthetic oligonucleotide
gcaagttggaggcggcccgtgg

SEQ ID NO: 48150 - DNA, 22 bp, Artificial Sequence
  Description of Artificial Sequence: Synthetic oligonucleotide
caagttggaggcggcccgtggg

SEQ ID NO: 48151 - DNA, 22 bp, Artificial Sequence
  Description of Artificial Sequence: Synthetic oligonucleotide
aagttggaggcggcccgtgggg

SEQ ID NO: 48152 - DNA, 21 bp, Artificial Sequence
  Description of Artificial Sequence: Synthetic oligonucleotide
agttggaggcggcccgtgggg

SEQ ID NO: 48153 - DNA, 20 bp, Artificial Sequence
  Description of Artificial Sequence: Synthetic oligonucleotide
gttggaggcggcccgtgggg

SEQ ID NO: 48154 - DNA, 20 bp, Artificial Sequence
  Description of Artificial Sequence: Synthetic oligonucleotide
ttggaggcggcccgtggggc

SEQ ID NO: 48155 - DNA, 20 bp, Artificial Sequence
  Description of Artificial Sequence: Synthetic oligonucleotide
tggaggcggcccgtggggct

SEQ ID NO: 48156 - DNA, 20 bp, Artificial Sequence
  Description of Artificial Sequence: Synthetic oligonucleotide
ggaggcggcccgtggggctt

SEQ ID NO: 48157 - DNA, 20 bp, Artificial Sequence
  Description of Artificial Sequence: Synthetic oligonucleotide
gaggcggcccgtggggcgtt

SEQ ID NO: 48158 - DNA, 20 bp, Artificial Sequence
  Description of Artificial Sequence: Synthetic oligonucleotide
aggcggcccgtggggcggat

SEQ ID NO: 48159 - DNA, 20 bp, Artificial Sequence
  Description of Artificial Sequence: Synthetic oligonucleotide
ggcggcccgtggggcggatt

SEQ ID NO: 48160 - DNA, 20 bp, Artificial Sequence
  Description of Artificial Sequence: Synthetic oligonucleotide
gcggcccgtggggcggagtt

SEQ ID NO: 48161 - DNA, 20 bp, Artificial Sequence
  Description of Artificial Sequence: Synthetic oligonucleotide
cggcccgtggggcggagcat

SEQ ID NO: 48162 - DNA, 20 bp, Artificial Sequence
  Description of Artificial Sequence: Synthetic oligonucleotide
ggcccgtggggcggagcagt

SEQ ID NO: 48163 - DNA, 20 bp, Artificial Sequence
  Description of Artificial Sequence: Synthetic oligonucleotide
gcccgtggggcggagcagct

SEQ ID NO: 48164 - DNA, 21 bp, Artificial Sequence
  Description of Artificial Sequence: Synthetic oligonucleotide
cccgtggggcggagcagctga

SEQ ID NO: 48165 - DNA, 22 bp, Artificial Sequence
  Description of Artificial Sequence: Synthetic oligonucleotide
ccgtggggcggagcagctgaga

SEQ ID NO: 48166 - DNA, 22 bp, Artificial Sequence
  Description of Artificial Sequence: Synthetic oligonucleotide
cgtggggcggagcagctgagag

SEQ ID NO: 48167 - DNA, 22 bp, Artificial Sequence
  Description of Artificial Sequence: Synthetic oligonucleotide
gtggggcggagcagctgagagc

SEQ ID NO: 48168 - DNA, 24 bp, Artificial Sequence
  Description of Artificial Sequence: Synthetic oligonucleotide
tggggcggagcagctgagagccta

SEQ ID NO: 48169 - DNA, 23 bp, Artificial Sequence
  Description of Artificial Sequence: Synthetic oligonucleotide
ggggcggagcagctgagagccta

SEQ ID NO: 48170 - DNA, 24 bp, Artificial Sequence
  Description of Artificial Sequence: Synthetic oligonucleotide
ctgagagcctacctggagggcacc

SEQ ID NO: 48171 - DNA, 24 bp, Artificial Sequence
  Description of Artificial Sequence: Synthetic oligonucleotide
tgagagcctacctggagggcaccg

SEQ ID NO: 48172 - DNA, 23 bp, Artificial Sequence
  Description of Artificial Sequence: Synthetic oligonucleotide
gagagcctacctggagggcaccg

SEQ ID NO: 48173 - DNA, 24 bp, Artificial Sequence
  Description of Artificial Sequence: Synthetic oligonucleotide
agagcctacctggagggcaccgca

SEQ ID NO: 48174 - DNA, 23 bp, Artificial Sequence
  Description of Artificial Sequence: Synthetic oligonucleotide
gagcctacctggagggcaccgca

SEQ ID NO: 48175 - DNA, 26 bp, Artificial Sequence
  Description of Artificial Sequence: Synthetic oligonucleotide
agcctacctggagggcaccgcagata

SEQ ID NO: 48176 - DNA, 25 bp, Artificial Sequence
  Description of Artificial Sequence: Synthetic oligonucleotide
gcctacctggagggcaccgcagata

SEQ ID NO: 48177 - DNA, 25 bp, Artificial Sequence
  Description of Artificial Sequence: Synthetic oligonucleotide
cctacctggagggcaccgcagatac

SEQ ID NO: 48178 - DNA, 26 bp, Artificial Sequence
  Description of Artificial Sequence: Synthetic oligonucleotide
ctacctggagggcaccgcagatacct

SEQ ID NO: 48179 - DNA, 27 bp, Artificial Sequence
  Description of Artificial Sequence: Synthetic oligonucleotide
tacctggagggcaccgcagatacctgt

SEQ ID NO: 48180 - DNA, 26 bp, Artificial Sequence
  Description of Artificial Sequence: Synthetic oligonucleotide
acctggagggcaccgcagatacctgt

SEQ ID NO: 48181 - DNA, 25 bp, Artificial Sequence
  Description of Artificial Sequence: Synthetic oligonucleotide
cctggagggcaccgcagatacctgt

SEQ ID NO: 48182 - DNA, 25 bp, Artificial Sequence
  Description of Artificial Sequence: Synthetic oligonucleotide
ctggagggcaccgcagatacctgtg

SEQ ID NO: 48183 - DNA, 26 bp, Artificial Sequence
  Description of Artificial Sequence: Synthetic oligonucleotide
tggagggcaccgcagatacctgtgga

SEQ ID NO: 48184 - DNA, 25 bp, Artificial Sequence
  Description of Artificial Sequence: Synthetic oligonucleotide
ggagggcaccgcagatacctgtgga

SEQ ID NO: 48185 - DNA, 26 bp, Artificial Sequence
  Description of Artificial Sequence: Synthetic oligonucleotide
gagggcaccgcagatacctgtggagt

SEQ ID NO: 48186 - DNA, 26 bp, Artificial Sequence
  Description of Artificial Sequence: Synthetic oligonucleotide
agggcaccgcagatacctgtggagtg

SEQ ID NO: 48187 - DNA, 25 bp, Artificial Sequence
  Description of Artificial Sequence: Synthetic oligonucleotide
gggcaccgcagatacctgtggagtg

SEQ ID NO: 48188 - DNA, 25 bp, Artificial Sequence
  Description of Artificial Sequence: Synthetic oligonucleotide
ggcaccgcagatacctgtggagtgg

SEQ ID NO: 48189 - DNA, 26 bp, Artificial Sequence
  Description of Artificial Sequence: Synthetic oligonucleotide
gcaccgcagatacctgtggagtggct

SEQ ID NO: 48190 - DNA, 26 bp, Artificial Sequence
  Description of Artificial Sequence: Synthetic oligonucleotide
caccgcagatacctgtggagtggctc

SEQ ID NO: 48191 - DNA, 26 bp, Artificial Sequence
  Description of Artificial Sequence: Synthetic oligonucleotide
accgcagatacctgtggagtggctcc

SEQ ID NO: 48192 - DNA, 25 bp, Artificial Sequence
  Description of Artificial Sequence: Synthetic oligonucleotide
ccgcagatacctgtggagtggctcc

SEQ ID NO: 48193 - DNA, 25 bp, Artificial Sequence
  Description of Artificial Sequence: Synthetic oligonucleotide
cgcagatacctgtggagtggctccg

SEQ ID NO: 48194 - DNA, 26 bp, Artificial Sequence
  Description of Artificial Sequence: Synthetic oligonucleotide
gcagatacctgtggagtggctccgca

SEQ ID NO: 48195 - DNA, 27 bp, Artificial Sequence
  Description of Artificial Sequence: Synthetic oligonucleotide
cagatacctgtggagtggctccgcaga

SEQ ID NO: 48196 - DNA, 29 bp, Artificial Sequence
  Description of Artificial Sequence: Synthetic oligonucleotide
agatacctgtggagtggctccgcagatac

SEQ ID NO: 48197 - DNA, 28 bp, Artificial Sequence
  Description of Artificial Sequence: Synthetic oligonucleotide
gatacctgtggagtggctccgcagatac

SEQ ID NO: 48198 - DNA, 28 bp, Artificial Sequence
  Description of Artificial Sequence: Synthetic oligonucleotide
atacctgtggagtggctccgcagatacc

SEQ ID NO: 48199 - DNA, 27 bp, Artificial Sequence
  Description of Artificial Sequence: Synthetic oligonucleotide
tacctgtggagtggctccgcagatacc

SEQ ID NO: 48200 - DNA, 27 bp, Artificial Sequence
  Description of Artificial Sequence: Synthetic oligonucleotide
acctgtggagtggctccgcagatacct

SEQ ID NO: 48201 - DNA, 26 bp, Artificial Sequence
  Description of Artificial Sequence: Synthetic oligonucleotide
cctgtggagtggctccgcagatacct

SEQ ID NO: 48202 - DNA, 26 bp, Artificial Sequence
  Description of Artificial Sequence: Synthetic oligonucleotide
ctgtggagtggctccgcagatacctg

SEQ ID NO: 48203 - DNA, 28 bp, Artificial Sequence
  Description of Artificial Sequence: Synthetic oligonucleotide
gctcccactccatgagcttttcgacacc

SEQ ID NO: 48204 - DNA, 28 bp, Artificial Sequence
  Description of Artificial Sequence: Synthetic oligonucleotide
ctcccactccatgagcttttcgacaccg

SEQ ID NO: 48205 - DNA, 28 bp, Artificial Sequence
  Description of Artificial Sequence: Synthetic oligonucleotide
tcccactccatgagcttttcgacaccgc

SEQ ID NO: 48206 - DNA, 27 bp, Artificial Sequence
  Description of Artificial Sequence: Synthetic oligonucleotide
cccactccatgagcttttcgacaccgc

SEQ ID NO: 48207 - DNA, 27 bp, Artificial Sequence
  Description of Artificial Sequence: Synthetic oligonucleotide
ccactccatgagcttttcgacaccgcc

SEQ ID NO: 48208 - DNA, 27 bp, Artificial Sequence
  Description of Artificial Sequence: Synthetic oligonucleotide
cactccatgagcttttcgacaccgccg

SEQ ID NO: 48209 - DNA, 28 bp, Artificial Sequence
  Description of Artificial Sequence: Synthetic oligonucleotide
actccatgagcttttcgacaccgccgtg

SEQ ID NO: 48210 - DNA, 27 bp, Artificial Sequence
  Description of Artificial Sequence: Synthetic oligonucleotide
ctccatgagcttttcgacaccgccgtg

SEQ ID NO: 48211 - DNA, 28 bp, Artificial Sequence
  Description of Artificial Sequence: Synthetic oligonucleotide
tccatgagcttttcgacaccgccgtgtc

SEQ ID NO: 48212 - DNA, 27 bp, Artificial Sequence
  Description of Artificial Sequence: Synthetic oligonucleotide
ccatgagcttttcgacaccgccgtgtc

SEQ ID NO: 48213 - DNA, 27 bp, Artificial Sequence
  Description of Artificial Sequence: Synthetic oligonucleotide
catgagcttttcgacaccgccgtgtcc

SEQ ID NO: 48214 - DNA, 27 bp, Artificial Sequence
  Description of Artificial Sequence: Synthetic oligonucleotide
atgagcttttcgacaccgccgtgtccc

SEQ ID NO: 48215 - DNA, 26 bp, Artificial Sequence
  Description of Artificial Sequence: Synthetic oligonucleotide
tgagcttttcgacaccgccgtgtccc

SEQ ID NO: 48216 - DNA, 25 bp, Artificial Sequence
  Description of Artificial Sequence: Synthetic oligonucleotide
gagcttttcgacaccgccgtgtccc

SEQ ID NO: 48217 - DNA, 25 bp, Artificial Sequence
  Description of Artificial Sequence: Synthetic oligonucleotide
agcttttcgacaccgccgtgtcccg

SEQ ID NO: 48218 - DNA, 24 bp, Artificial Sequence
  Description of Artificial Sequence: Synthetic oligonucleotide
gcttttcgacaccgccgtgtcccg

SEQ ID NO: 48219 - DNA, 24 bp, Artificial Sequence
  Description of Artificial Sequence: Synthetic oligonucleotide
cttttcgacaccgccgtgtcccgg

SEQ ID NO: 48220 - DNA, 24 bp, Artificial Sequence
  Description of Artificial Sequence: Synthetic oligonucleotide
ttttcgacaccgccgtgtcccggc

SEQ ID NO: 48221 - DNA, 23 bp, Artificial Sequence
  Description of Artificial Sequence: Synthetic oligonucleotide
cctcctccgcgggtgtgaccagt

SEQ ID NO: 48222 - DNA, 23 bp, Artificial Sequence
  Description of Artificial Sequence: Synthetic oligonucleotide
ctcctccgcgggtgtgaccagtc

SEQ ID NO: 48223 - DNA, 23 bp, Artificial Sequence
  Description of Artificial Sequence: Synthetic oligonucleotide
tcctccgcgggtgtgaccagtcc

SEQ ID NO: 48224 - DNA, 22 bp, Artificial Sequence
  Description of Artificial Sequence: Synthetic oligonucleotide
cctccgcgggtgtgaccagtcc
